(12) United States Patent
Bihain et al.

(10) Patent No.: US 9,068,988 B2
(45) Date of Patent: Jun. 30, 2015

(54) COMPOSITIONS AND METHODS OF DETECTING TIABS

(75) Inventors: Bernard Bihain, Nancy (FR); Virginie Ogier, Nancy (FR); Marie Brulliard, Nancy (FR)

(73) Assignee: TRANSMEDI SA, Vandoeuvre les Nancy (FR)

( * ) Notice: Subject to any disclaimer, the term of this patent is extended or adjusted under 35 U.S.C. 154(b) by 329 days.

(21) Appl. No.: 12/747,945

(22) PCT Filed: Dec. 15, 2008

(86) PCT No.: PCT/IB2008/003836
§ 371 (c)(1),
(2), (4) Date: Dec. 10, 2010

(87) PCT Pub. No.: WO2009/077864
PCT Pub. Date: Jun. 25, 2009

(65) Prior Publication Data
US 2011/0097743 A1 Apr. 28, 2011

(30) Foreign Application Priority Data

Dec. 14, 2007 (EP) .................................... 07301680

(51) Int. Cl.
*G01N 33/53* (2006.01)
*G01N 33/574* (2006.01)

(52) U.S. Cl.
CPC .. *G01N 33/57484* (2013.01); *G01N 2333/7051* (2013.01); *G01N 2800/52* (2013.01); *G01N 2800/56* (2013.01)

(58) Field of Classification Search
None
See application file for complete search history.

(56) References Cited

U.S. PATENT DOCUMENTS

2007/0083334 A1 * 4/2007 Mintz et al. .................... 702/19

FOREIGN PATENT DOCUMENTS

EP 1 887 088 2/2008

OTHER PUBLICATIONS

Mudenda et al (Br J Cancer, 1994, 69: 1115-1119).*
Jezersek et al (Oncol Rep, 2001, 8(1): Abstract).*
Lai et al (Clin Cancer Res, 1998, 4: 3025-3030).*
Tockman et al (Cancer Res., 1992, 52:2711s-2718s).*
Shim et al (J Korean Med Sci, 1998, 13: 44-48).*
Brulliard, M. et al. "Nonrandom variations in human cancer ESTs indiciate that mRNA heterogeneity increases during carcinogenesis" *PNAS*, May 1, 2007, pp. 7522-7527, vol. 104, No. 18, XP-002484008.
Cappione, A. J. et al. "A Potential Role for NF1 mRNA Editing in the Pathogenesis of NF1 Tumors" *Am. J. Hum. Genet.*, 1997, pp. 305-312, vol. 60, No. 2, XP-008072803.
Maas, S. et al. "Underediting of glutamate receptor GluR-B mRNA in malignant gliomas" *PNAS*, Dec. 4, 2001, pp. 14687-14692, vol. 98, No. 25, XP-002974829.
Klimek-Tomczak, K. et al. "Editing of hnRNP K protein mRNA in colorectal adenocarcinoma and surrounding mucosa" *British Journal of Cancer*, 2006, pp. 586-592, vol. 94, XP-002411595.
Anant, S. et al. "Hydrolytic nucleoside and nucleotide deamination, and genetic instability: a possible link between RNA-editing enzymes and cancer?" *TRENDS in Molecular Medicine*, Apr. 2003, pp. 147-152, vol. 9, No. 4, XP-002411597.
Hardouin, J. et al. "Cancer Immunomics: From Serological Proteome Analysis to Multiple Affinity Protein Profiling" *Ann. N.Y. Acad. Sci.*, 2007, pp. 223-230, vol. 1107, XP-002484009.
Finn, O. J. "Immune Response as a Biomarker for Cancer Detection and a Lot More" *N. Eng. J. Med.*, Sep. 22, 2005, pp. 1288-1290, vol. 353, No. 12, XP-002484010.
Leslie, D. et al. "Autoantibodies as predictors of disease" *J. Clin. Invest.*, 2001, pp. 1417-1422, vol. 108, No. 10, XP-002484011.
Tan, E. M. "Autoantibodies as reporters identifying aberrant cellular mechanisms in tumorigenesis" *J. Clin. Invest.*, Nov. 2001, pp. 1411-1415, vol. 108, No. 10, XP-002484012.

* cited by examiner

*Primary Examiner* — Sean Aeder
(74) *Attorney, Agent, or Firm* — Saliwanchik, Lloyd & Eisenschenk

(57) ABSTRACT

The present invention relates to novel methods and products for assessing the physiological status of a subject. More particularly, the invention relates to methods of assessing the presence, risk or stage of a cancer in a subject by measuring the levels of antibodies against particular aberrant protein domains in a sample from the subject, or the presence or number of immune cells hearing TCR specific for such aberrant protein domains. The invention is also suitable to assess the responsiveness of a subject to a treatment, as well as to screen candidate drugs and design novel therapies. The invention may be used in any mammalian subject, particularly in human subjects.

13 Claims, 26 Drawing Sheets
(25 of 26 Drawing Sheet(s) Filed in Color)

| Variable | p-value Wilcoxon |
|---|---|
| TIAB_1 | 2,7E-15 |
| TIAB_28 | 6,8E-15 |
| TIAB_25 | 5,9E-14 |
| TIAB_7 | 6,3E-14 |
| TIAB_24 | 1,0E-13 |
| TIAB_2 | 2,2E-13 |
| TIAB_29 | 2,3E-13 |
| TIAB_48 | 2,9E-13 |
| TIAB_44 | 2,9E-13 |
| TIAB_6 | 3,5E-10 |
| TIAB_4 | 7,8E-10 |
| TIAB_13 | 1,8E-08 |
| TIAB_12 | 2,8E-07 |
| TIAB_14 | 3,5E-06 |
| TIAB_10 | 6,5E-06 |
| TIAB_22 | 2,8E-05 |
| TIAB_9 | 4,7E-05 |
| TIAB_40 | 1,6E-04 |
| TIAB_37 | 2,2E-04 |
| TIAB_21 | 2,4E-04 |
| TIAB_15 | 2,6E-04 |
| TIAB_35 | 9,9E-04 |
| TIAB_23 | 0,001 |
| TIAB_62 | 0,003 |
| TIAB_3 | 0,003 |
| TIAB_20 | 0,004 |
| TIAB_26 | 0,007 |
| TIAB_8 | 0,008 |
| TIAB_49 | 0,010 |
| TIAB_27 | 0,010 |
| TIAB_5 | 0,014 |
| TIAB_47 | 0,020 |
| TIAB_38 | 0,037 |
| TIAB_39 | 0,052 |
| TIAB_11 | 0,082 |
| TIAB_46 | 0,187 |
| TIAB_41 | 0,222 |

FIG. 4B

COMPOSITIONS AND METHODS OF DETECTING TIABS

CROSS-REFERENCE TO RELATED APPLICATION

This application is the U.S. national stage application of International Patent Application No. PCT/IB2008/003836, filed Dec. 15, 2008, the disclosure of which is hereby incorporated by reference in its entirety, including all figures, tables and amino acid or nucleic acid sequences.

The Sequence Listing for this application is labeled "Seq-List-replace-3.txt" which was created on Feb. 15, 2013 and is 949956 KB. The entire contents of the sequence listing is incorporated herein by reference in its entirety.

The present invention relates to novel methods and products for assessing the physiological status of a subject. More particularly, the invention relates to methods of assessing the presence, risk or stage of a cancer in a subject by measuring the levels of antibodies against particular aberrant protein domains in a sample from the subject, or the presence or number of immune cells bearing TCR specific for such aberrant protein domains. The invention is also suitable to assess the responsiveness of a subject to a treatment, as well as to screen candidate drugs and design novel therapies. The invention may be used in any mammalian subject, particularly in human subjects.

INTRODUCTION

Cancer is progressively becoming the leading cause of death in Western countries and strong therapeutic benefits, i.e., event-free long-term survival of >90% of patients are obtained mostly in individuals diagnosed at early stage[1]. Cancer is a genetic disease with accumulation of mutations in oncogenes and tumor suppressor genes[2]. Genetic testing is useful for identifying individuals at risk for colon, lung, breast, ovary and neuro-endocrine cancers[3,4]. However, clinical management of patients with genetic risks is complex because of the lack of precision as to when a given individual will develop cancer[5].

Gene expression varies widely in cancer cells and analysis of differences in transcription patterns have led to definition of molecular signatures associated with good or bad prognosis[6]. Such signatures may guide and optimize therapeutic strategies, but again the prerequisite is prior identification of the tumor.

Massive efforts towards identification of reliable, early stage, cancer molecular markers detectable in accessible human body fluids are pursued through 3 main directions. First, changes in protein concentrations and/or isoforms between normal and cancer patients are analyzed using various separation and identification procedures[7,8]. Some of these methods are suitable for systematic screening, but the technology is currently confronted with huge differences in concentrations of abundant plasma proteins (>>>mg/ml) compared to that of protein released by low-level tissue leakage (<<pg/ml). An alternative approach consists of identification through expression profiling of a few specific targets differentially expressed in cancers and development of sensitive assays to monitor their concentrations in plasma[9]. Both strategies have been successfully implemented, but none has yet provided markers sufficiently robust to be useful in systematic clinical screening[10,11]. The second axis of investigation is based on identification and characterization of circulating DNA in plasma. An early report suggested that the simple presence of circulating DNA in serum was diagnostic[12]; however, this is now questionable because healthy individual circulating free DNA concentrations are in the same range as that of cancer patients[13,14]. Maintenance of normal DNA methylation pattern is critical for proper cell function and its loss is among the earliest molecular alteration during carcinogenesis[15,16]. Several groups have reported detection of tumor-associated methylation patterns in serum, but the success rate varied greatly among different teams that used the same biomarkers and technology[17-20].

This is due both to the diversity of tumor DNA methylation patterns and to low abundance of tumor DNA that represents at most 0.12% of somatically normal haploid genome[21,22]. Thus, detection of cancer somatic mutations in minute amounts of circulating cancer DNA is also too close to background levels to provide robust assays, even when considering recent improvements in sequencing technology[23,24]. The third axis consists of probing the immune system response to cancer by systematic search of auto-antibodies[25,26]. The presence of these antibodies has been established, but the process by which self molecules become immunogenic is not yet understood[27]. Screening of expression libraries constructed from cancer cell mRNA led to identification of a large number of low sensitivity antibodies that, when used in combination of >20, achieved up to 82% sensitivity in prostate cancer patients[28,29]. An alternative method relies on identification of auto-antibody signature by immunoblotting of 2 D gel electrophoresis[30]. This yields subsequent identification primarily of proteins identified by auto-antibodies independently of cancer status and of a limited number of proteins reacting preferentially with cancer sera[30].

Our strategy is based on a different rationale that directly stems from the results obtained through large scale cancer DNA sequencing programs[31,32]. This important work led to the conclusion that cancer somatic mutations occur at rates, higher than expected, but nevertheless remain rare events: the estimated rate is 3.1 per $10^6$ base leading on average to 90 amino-acid substitutions in a given tumor[31]. Virtually all biochemical, biological and clinical attributes are heterogeneous within cancer of the same histological subtype[33]. We have thus sought for alternate mechanisms contributing to cancer cell heterogeneity. We recently showed that cancer cell mRNA sequences contain more base substitutions than that of normal cells[34]. Cancer mRNA base substitution occurs at sites that are $10^4$ more commonly encountered than those bearing somatic mutations and do not correspond to single nucleotide polymorphisms (SNP). Thus the differences in mRNA heterogeneity isolated from normal and cancer cells from the same patient can not be explained by differences occurring at the genomic level. Base substitution in cancer mRNA is determined by the composition of DNA context that corresponds to the portion melted by active RNA Polymerase II (Pol. II)[34,35]. The substituted base is most frequently identical to that immediately preceding or following the event. In vitro data demonstrated forward slipping of Pol II in specific DNA contexts[36,37], and we have therefore proposed that transcription infidelity (TI) explains that a fraction of cancer mRNA are not faithful copies of genomic DNA.

We have expanded this analysis to whole genome and all available human transcripts and confirm that mRNA base substitution is significantly increased (2.5-fold) in cancer. Most importantly, we discovered that single base omission in cancer mRNA is much more dramatically (38-fold) increased. Gaps in mRNA cause the loss of downstream genomic information and can lead to aberrant proteins that might trigger immunological response. We have sought and found, in cancer patients, specific IgG directed against predicted aberrant peptides (PAP) translated from cancer mRNA containing a single base gap. Detection of low abundance diversified IgG provides a novel method for diagnosis of most common forms of human solid tumors. A panel of IgG effectively discriminated patients with non small cell lung cancer (NSCLC) from subjects without cancer.

The present invention thus shows such gaps (and insertions) are dramatically increased in cancer patients and create aberrant but predictable immunogenic proteins which represent very efficient biomarkers.

SUMMARY OF THE INVENTION

An object of this invention relates to a method for detecting the presence, risk or stage of development of a cancer in a subject, the method comprising contacting in vitro a sample from the subject with a polypeptide comprising the sequence of an aberrant protein domain created by transcription infidelity, wherein the formation of a complex between said polypeptide and an antibody (TIAB) or TCR-bearing cell present in said sample is an indication of the presence, risk or stage of development of a cancer.

A further object of this invention relates to a method of assessing the physiological status of a subject, the method comprising a step of measuring the presence or level of antibodies specific for aberrant protein domains created by transcription infidelity (TIAB) or of TCR-bearing immune cells that bind to such domains in a sample from the subject, wherein a modified level of said TIAB or immune cells in said sample as compared to a reference value is an indication of a physiological disorder.

A further object of the invention is a method of determining the efficacy of a treatment of a cancer, the method comprising (i) determining the level of at least one polypeptide comprising the sequence of an aberrant protein domain created by transcription infidelity or the level of TIAB or corresponding TCR-bearing cells, in a sample from the subject and (ii) comparing said level to the level in a sample from said subject taken prior to or at an earlier stage of the treatment.

An other object of the invention is a method of monitoring the progression or the extension of a cancer in a subject, said method comprising (i) contacting a sample obtained from said subject with at least one polypeptide comprising the sequence of an aberrant protein domain created by transcription infidelity, (ii) determining the level of TIAB or corresponding TCR-bearing cells in said sample and (iii) comparing said level to reference level. The reference value may be a mean or median value determined from individuals not having a cancer or disease, a reference level obtained from a control patient, a reference level obtained from the subject before cancer onset or with a control polypeptide.

Another object of the invention relates to a method of determining whether an individual is making a polypeptide comprising a sequence selected from the group consisting of SEQ ID NOs: 1-3334, comprising contacting a sample obtained from said individual with an agent indicative of the presence of said polypeptide and determining whether said agent binds to said sample.

A further object of this invention is a method of selecting, characterizing, screening or optimizing a biologically active compound, said method comprising placing in vitro a test compound in contact with a gene and determining the ability of said test compound to modulate the production, from said gene, of RNA molecules containing transcription infidelity gaps and insertions.

A further object of this invention resides in a method of producing a peptide specific for transcription infidelity, the method comprising:

a) identifying a protein domain resulting from a transcription infidelity gap or insertion;
b) synthesizing a peptide comprising the sequence of said protein domain of a); and
c) optionally verifying, in a biological sample from a mammalian subject, that the peptide binds an antibody.

The invention also relates to any polypeptide comprising the sequence of an aberrant protein domain created by gap or insertion transcription infidelity, or an epitope-containing fragment thereof, especially a polypeptide comprising a sequence selected from SEQ ID NOs: 1 to 3334, or an epitope-containing fragment thereof.

A further object of the invention is an isolated nucleic acid encoding a polypeptide described above or comprising a first nucleotide sequence encoding a polypeptide selected from the group consisting of SEQ ID NOs: 1-3334 or a sequence complementary thereto and a second nucleotide sequence of 100 or less nucleotides in length, wherein said second nucleotide sequence is adjacent to said first nucleotide sequence in a naturally occurring nucleic acid.

Another object of this invention is a cloning or expression vector comprising a polynucleotide described above and the host cell transformed or transfected with this vector A further object of this invention is an isolated antibody or portion of an antibody which specifically binds to any polypeptide comprising the sequence of an aberrant protein domain created by gap or insertion transcription infidelity and, particularly, to a polypeptide comprising a sequence selected from the group consisting of SEQ ID NOs: 1-3334 or an epitope-containing fragment thereof.

A further object of this invention is an immune cell comprising a TCR specific for any polypeptide comprising the sequence of an aberrant protein domain created by gap or insertion transcription infidelity and, particularly, for a polypeptide comprising a sequence selected from the group consisting of SEQ ID NOs: 1-3334.

The invention also relates to a solid support comprising at least one polypeptide comprising the sequence of an aberrant protein domain created by gap or insertion transcription infidelity, and, particularly, at least one polypeptide comprising a sequence selected from the group consisting of SEQ ID NOs: 1-3334 or an epitope-containing fragment thereof.

The invention further relates to a device or product comprising, immobilized on a support, at least one polypeptide comprising the sequence of an aberrant protein domain created by gap or insertion transcription infidelity, and, particularly, at least one polypeptide comprising a sequence selected from the group consisting of SEQ ID NOs: 1-3334 or an epitope-containing fragment thereof.

Another object of this invention is a kit comprising at least a device or product as defined above and a reagent to perform an immune reaction.

The invention further relates to a method of modulating an immune response in a subject, the method comprising treating the subject to deplete immune cells expressing a TCR specific for a polypeptide as defined above. Such immune cells typically include B cells, dendritic cells or T cells. Depletion may be accomplished by methods known in the art, such as ex vivo depletion using specific ligands.

LEGEND TO THE FIGURES

The patent or application file contains at least one drawing executed in color. Copies of this patent or patent application publication, with color drawing(s), will be provided by the Office upon request and payment of the necessary fee.

FIG. 1 Representation of K gaps located within ORF.

Shows for all statistically significant K gaps within ORF the % of deviation measured in the cancer set Y axis and normal set X axis. Red diamonds indicate the 45 K gaps selected for biological evaluation (table 5). Insert shows the number of transcripts affected by the indicated number of statistically significant K gaps located within the ORF.

FIG. 2. Aberrant mRNA detection of a deletion predicted on Cofilin gene in a lung cancer patient c-DNA library.

FIG. 2A. Bioinformatics prediction and characteristics of selected gap (SEQ ID NO: 3340).

FIG. 2B. Cloning strategy.

FIG. 2C. qPCR on normal and variant.

FIG. 2D. cDNA variant sequence (SEQ ID NO: 3341, CFL1.-RefSeq; SEQ ID NO: 3342, CFL1-C39 (upper sequence); SEQ ID NO: 3343, CFL1-C39 (lower sequence).

FIG. 2E. Genomic DNA sequence: Lung-Normal box (nucleotides 51-83 of SEQ ID NO: 3344), Lung-Cancer box (nucleotides 51-83 of SEQ ID NO: 3344), Lung-Adjacent Normal box (nucleotides 51-83 of SEQ ID NO: 3344), Refseq, Lung-Normal, Lung-Cancer, Lung-Adjacent Normal, SEQ ID NO: 3344).

FIG. 3. Detection of IgG recognizing 15 PAP (peptides 1-15 from table 5) in plasma of control and cancer patients bearing the indicated forms of solid tumors.

FIG. 3A. Fluorescence intensity signal recorded for each individual sample incubated with biotinylated PAP were subtracted from that recorded in blank streptavidin coated wells. Intensities of these differences are shown in light blue if it corresponds to the lower half of values recorded in controls. Dark blue corresponds to signals in the highest half of control values. Above controls, but lower half of positive signal are in light red . Dark red is for patients in highest half of positive signals. Blank cells show tests that could not be performed due to sample shortage. Controls are 26 healthy individuals, patients with indicated various forms of cancer are ranked from top (early) to bottom (advanced) for each cancer according to staging. Significant p-values of Wilcoxon tests are shown at the bottom of the figure.

FIG. 3B. Detection of IgG directed 13 predicted aberrant peptides in plasma of controls and cancer patients bearing the indicated forms of solid tumor.

Fluorescence intensity signal recorded for each individual sample incubated with biotinylated PAP were subtracted from the mean value recorded with PAP 14 and 15 or solely PAP 15 when the information was not available for PAP 14. The raw data are the same as that of FIG. 3A. Intensities of calculated signal are shown in light blue if it corresponds to the lower half of value recorded in controls. Dark blue corresponds to signal in the highest half of control. Above control but lower half of positive signal are in light red. Upper half positive signals are in dark red.

FIG. 4. Detection of IgG directed against PAP in sera of NSCLC versus controls without cancer.

FIG. 4A. IgG directed against 37 PAP are measured (37 first peptides from table 5). N terminally biotinylated peptide with AA sequence corresponding to 37 PAP were produced and used as baits in streptavidin wells to bind putative immunoglobulins. Samples were tested at 1/100 dilution, after washing IgG bound to PAP were revealed by secondary anti-human IgG Fc domain. Control patients include 25 healthy individuals and 12 patients with COPD (light and dark blue panels) and 49 NSCLC (Study II, Table 4) (red panel). P-values of Wilcoxon tests of cases versus all controls are shown.

FIG. 4B. Statistical analysis between 37 controls and 49 lung cancers. Non parametric Wilcoxon test p-values are given for each TIAB.

FIG. 5. Lack of detection of IgG directed against canonical peptides (CP).

Fluorescence intensity is measured for IgG directed against peptides corresponding to canonical reading of the genome, i.e., peptides corresponding to translation of mRNA corresponding to RefSeq without gap. Canonical peptide sequences are given in table 6.

FIG. 5A. IgG directed against PAP 1 and canonical peptide chosen on the same gene ($I_{64}$ to $Q_{93}$) are measured. IgG directed against a canonical peptide from albumin (between $Q_{128}$ and $P_{143}$) are also measured. All patients from FIG. 4 are included.

FIG. 5B. Schematic representation of canonical and predicted aberrant peptide sequences.

FIG. 5C. IgG directed against PAP 7, 24 and 28 and their canonical peptides are shown for 11 controls (blue panel) and 16 NSCLC (red panel).

FIG. 6. Detection of IgG directed against PAP in sera of *Mus musculus*.

FIG. 6A. Bioinformatics analysis of homology between *Homo sapiens* and *Mus musculus* sequences. mRNA and PAP alignments are given for PAP 7 (mRNA: SEQ ID NOs: 3349 and 3350: PAP alignments: SEQ ID NOs: 3361, 3362 and 3363), 48 (mRNA: SEQ ID NOs: 3345 and 3346; PAP alignments: SEQ ID NOs: 3355, 3356 and 3357) and 62 (mRNA: SEQ ID NOs: 3347 and 3348; PAP alignments: SEQ ID NOs: 3358, 3359 and 3360) and show that these sequences are conserved. Protein sequence of negative control CP 7 (SEQ ID NO: 3354) is also conserved between human and mouse. PAP 2 (SEQ ID NOs: 3351 and 3352) and 9 (SEQ ID NOs: 3353) are discriminant between controls and NSCLC in human but are not conserved in mouse.

FIG. 6B. 12 normal mice (C57B1/6) were injected in subcutaneous with $5*10^5$ LLC1 cells. The day of injection and 1-2-3 weeks after, TIAB directed against PAP 48, 62, 7 and corresponding CP titers were measured. TIAB directed against PAP 2 and 9 titers were measured in 4 mice the day of injection and 3 weeks after. Mean+−SEM are shown.

FIG. 7. Combination of IgG titers directed against PAP in sera of lung cancers versus controls without cancer.

FIG. 7A. Control patients include 161 healthy individuals (blue panel) and 140 lung cancers (Study III, Table 4) including adenocarcinomas ADK (red panel), squamous (orange panel) and others (yellow panel). Support Vector Machine allows discrimination of controls versus lung cancers with 6 PAP (7, 29, 48, 66, 68, 70). Distance to hyperplane is shown; patients showing negative values by SVM model are classified as non cancerous. Patients showing positive values are classified as cancerous.

FIG. 8. Combination of IgG titers directed against PAP in sera of lung cancers versus breast cancers. Control patients include 20 healthy individuals (blue panel), 20 lung cancers (red panel) and 20 breast cancers (purple panel) (Study IV, Table 4).

Figure 8A:
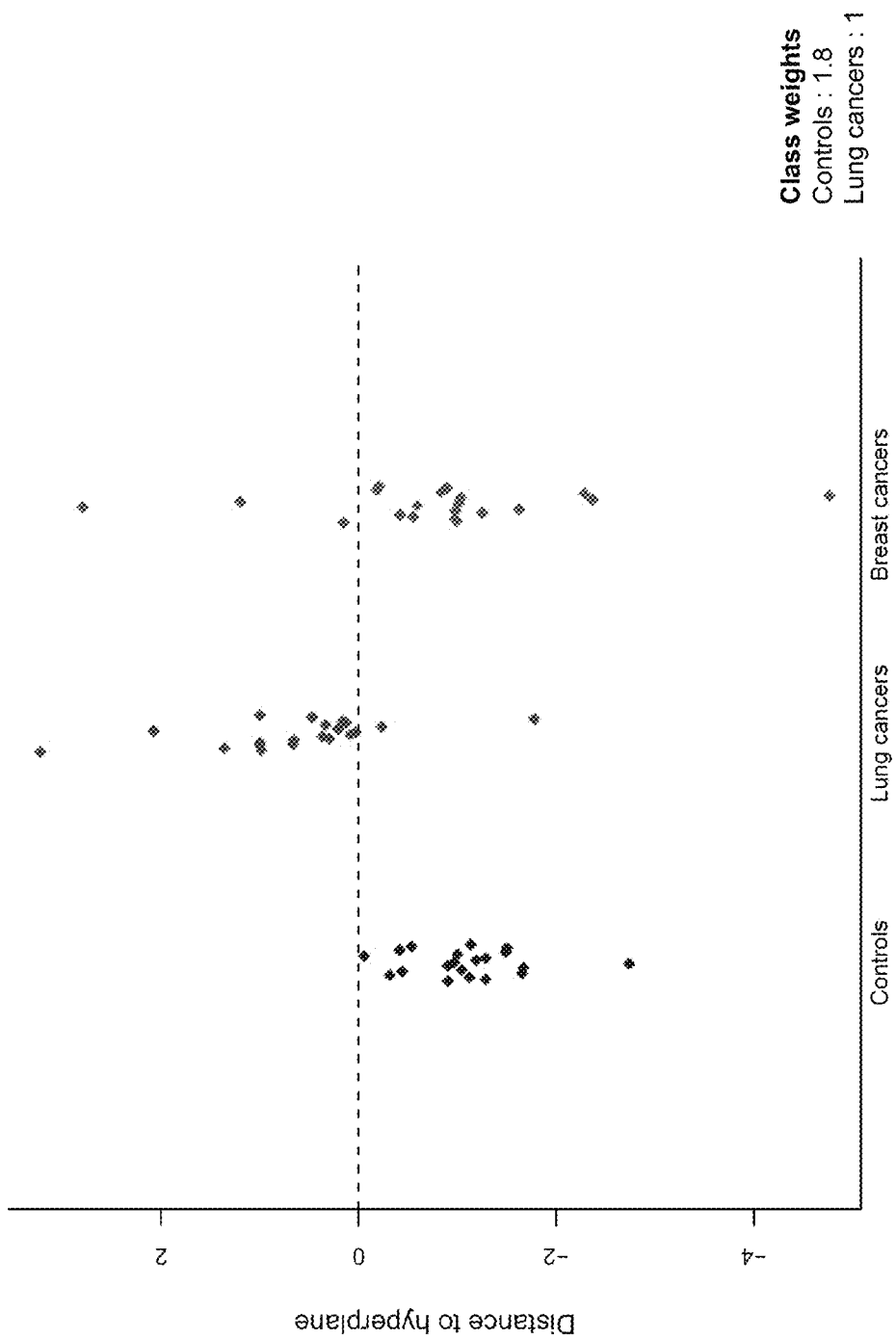

FIG. 8A shows a combination of PAP that discriminates lung cancers versus controls without cancer.

Figure 8B:
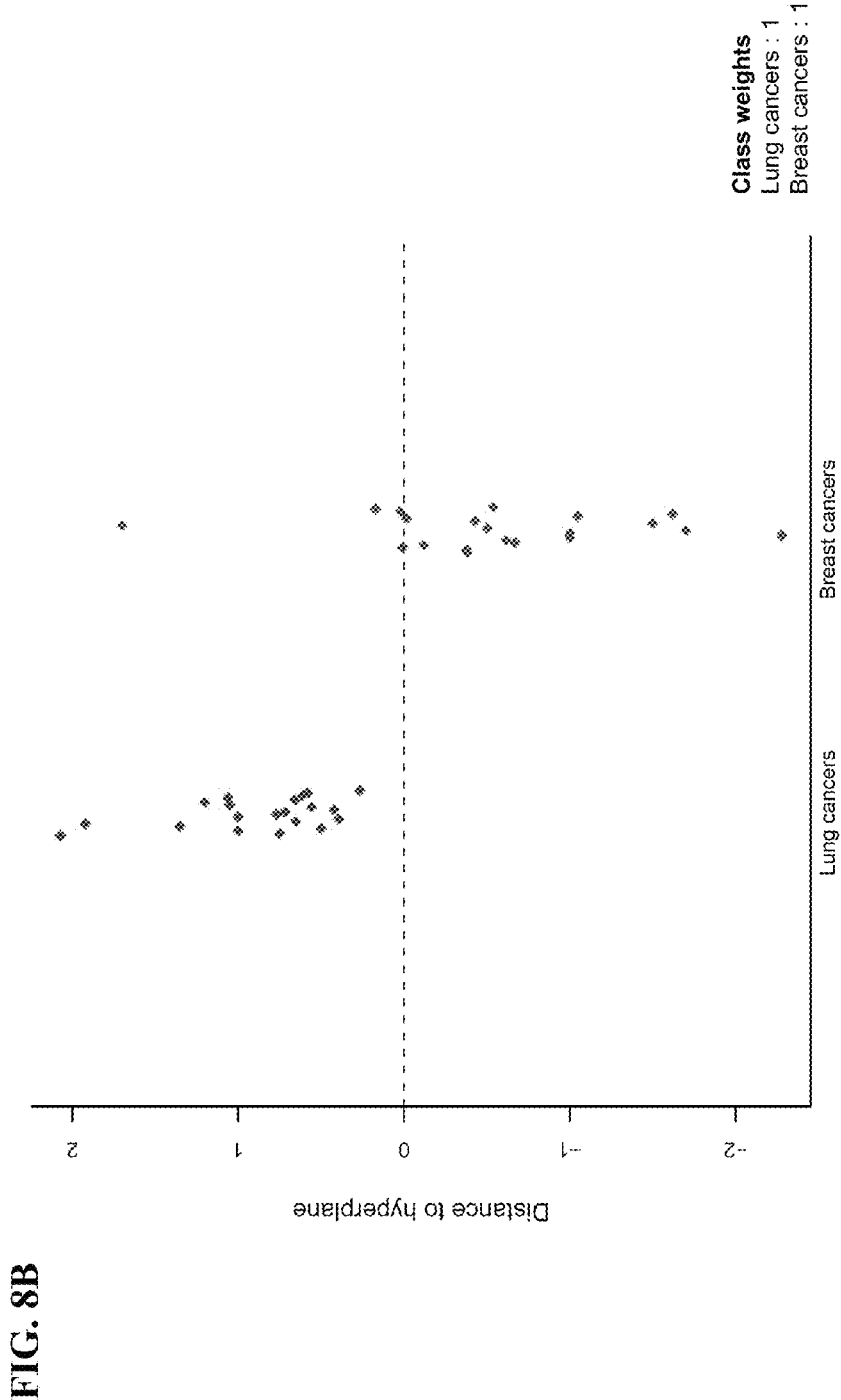
Figure 8B:
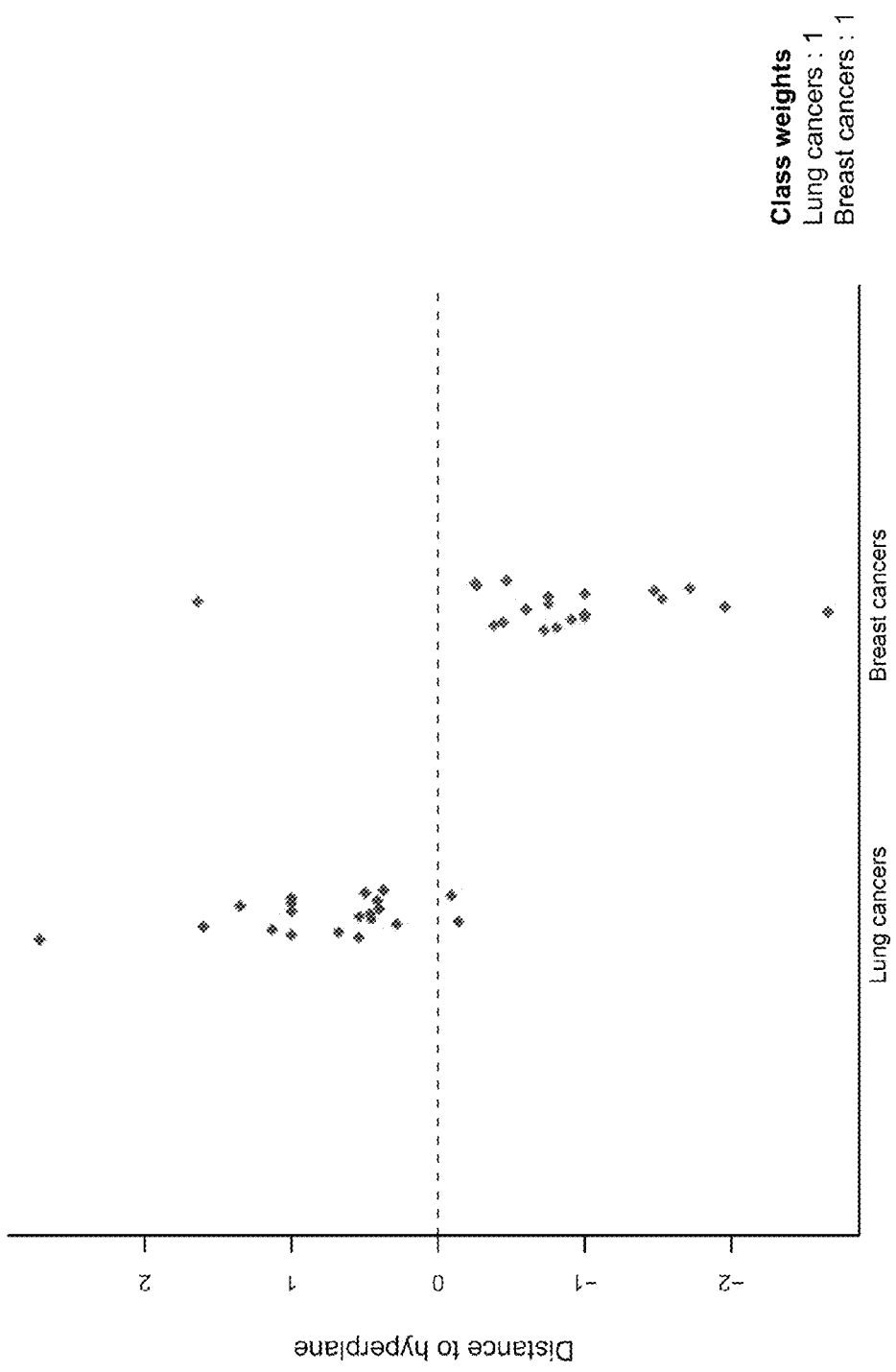
Figure 8B:
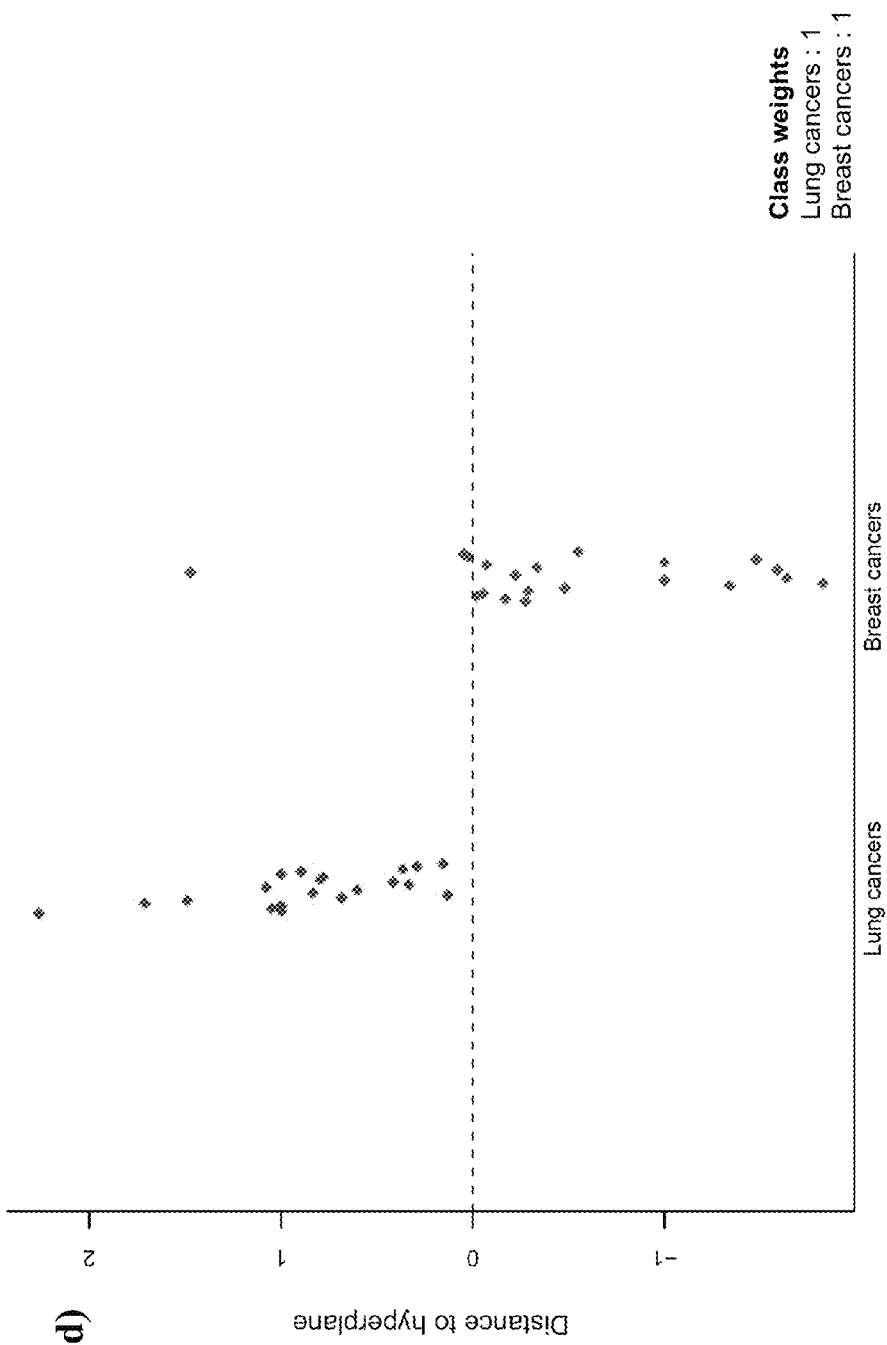
Figure 8B:
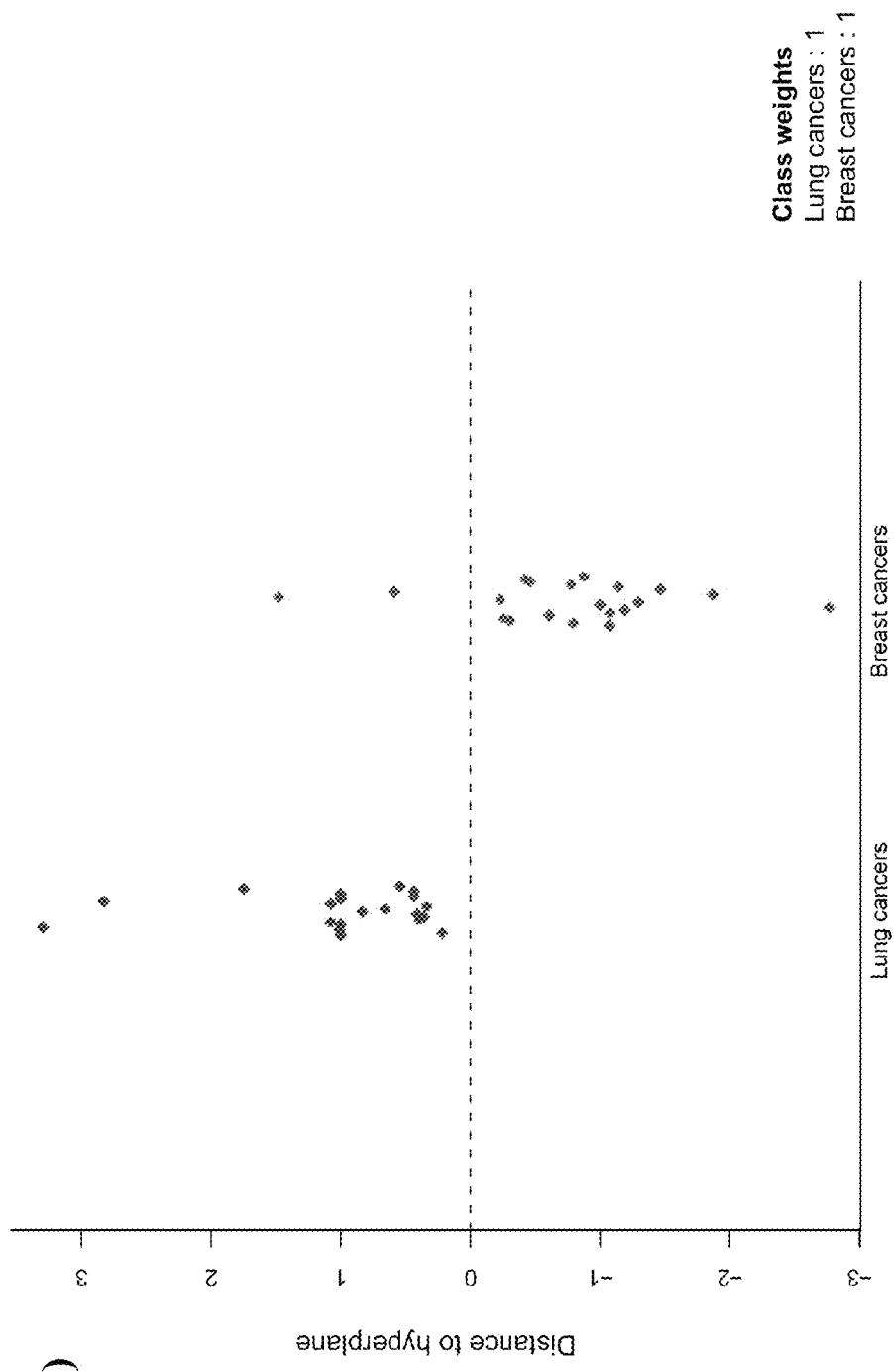

FIG. 8B shows several combinations of PAP that discriminate lung cancers versus breast cancers.

Figure 8C:
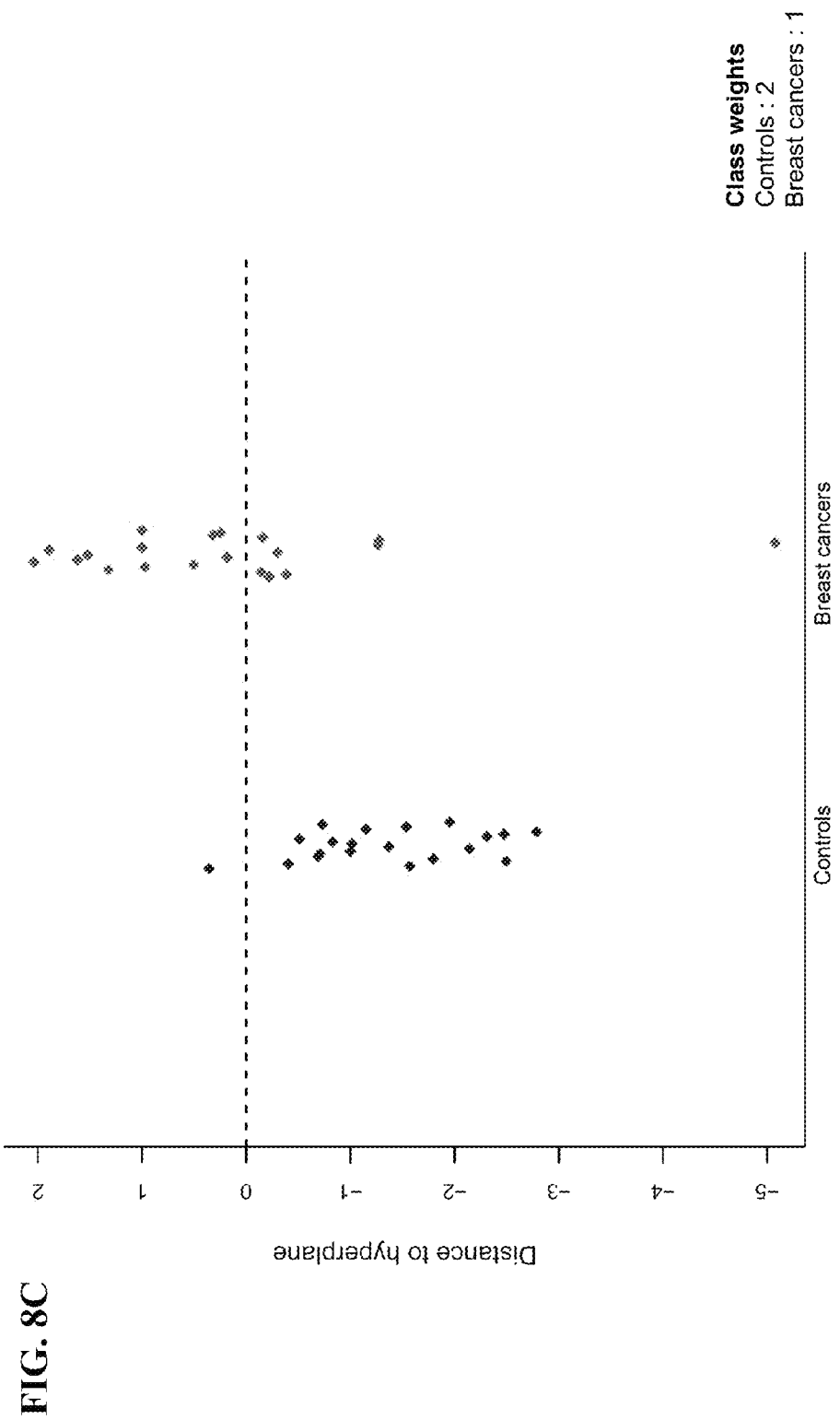

FIG. 8C shows a combination of PAP that discriminates breast cancers versus controls without cancer.

DETAILED DESCRIPTION OF THE INVENTION

The present invention relates to novel methods and products for assessing the physiological status of a subject by measuring TIAB levels. More particularly, the invention relates to methods of assessing the presence, risk or stage of a cancer in a subject by measuring TIAB levels in a sample from the subject. The invention is also suitable to assess the responsiveness of a subject to a treatment, to monitor the progression or the extension of a cancer as well as to screen candidate drugs.

Transcription Infidelity designates a novel mechanism by which several distinct RNA molecules are produced in a cell from a single transcript sequence. This newly identified mechanism potentially affects any gene, is non-random, and follows particular rules, as disclosed in co-pending application no PCT/EP07/057,541, herein incorporated by reference.

The present application shows that transcription infidelity can introduce gaps or insertions in RNA molecules, thereby creating a diversity of detectable aberrant protein sequences from a single gene (TI polypeptide sequences). These TI polypeptide sequences are particularly interesting since they are long enough to contain epitopes against which antibodies may be generated by mammalians. As a result, the expression of such aberrant proteins in a subject can be assessed by measuring the presence of corresponding antibodies or TCR-bearing cells in a sample from the subject.

The present invention now provides a method for predicting and/or identifying the sequence of such aberrant protein domains generated by gap or insertion transcription infidelity events from any gene, as well as methods of producing polypeptides comprising such TI sequences. The invention also discloses more than 2000 gap TI (gTI) polypeptides and more than 1000 insertions TI (iTI) polypeptides, and demonstrates, in human samples, the striking correlation between the presence of antibodies directed against these polypeptide sequences and the presence of a cancer in the subject. More specifically, increased levels of specific IgG directed against predicted aberrant peptide (PAP) are detected in sera of most (>75%) patients with common forms of solid tumours in excess of normal subjects. All 7 of the common forms of solid tumours (colon, lung, breast, ovarian, uterus, head and neck and melanoma) cause the production of IgG directed against aberrant proteins. Increase specific IgG levels were observed in most subjects with early stage disease, i.e., negative lymph node and no metastasis.

Measuring such antibodies directed against TI polypeptides, termed TIABs (Transcriptional Infidelity AntiBody), or corresponding immune cells bearing a TCR receptor specific for such aberrant domains, therefore represents a novel approach for detecting and monitoring disorders, as well as for drug development.

TIAB

Within the context of the present invention, the term TIAB ("Transcription Infidelity AntiBody") designates an antibody that specifically binds an epitope contained in a protein sequence generated by TI, particularly by gTI or iTI. TIABs more specifically designate antibodies naturally produced by a mammalian against an epitope contained in a protein sequence generated by TI, particularly by gTI and iTI (gap and insertion Transcription Infidelity). TIABs may be of any type, including IgG, IgM, IgA, IgE, IgD, etc. An antibody is "specific" for a particular epitope or sequence when the binding of the antibody to said epitope or sequence can be reliably discriminated from non-specific binding (i.e., from binding to another antigen, particularly to the native protein not containing said domain).

In one aspect, TIAB or portion of TIAB may be attached to a solid support. The attachment maintains the TIAB in a suitable conformation to allow binding of a specific gTI or iTI polypeptide when contacted with a sample containing the same. The attachment may be covalent or non-covalent, directly to the support or through a spacer group. Various techniques have been reported in the art to immobilize an antibody on a support (polymers, ceramic, plastic, glass, silica, etc.). The support may be magnetic, such as magnetic beads, to facilitate e.g., separation.

Immune cells bearing a TCR specific for such TI polypeptides include any cells of the immune system which contain a TCR, such as e.g., T cells, such as CTL, CD4+ lymphocytes, CD8+ lymphocytes and/or Treg cells, as well as antigen-presenting cells: B cells, dendritic cells or macrophages. The term includes, in particular, any TIAB-producing immune cells. Such cells may be cultured in conventional conditions, and expanded in vitro or ex vivo using TI polypeptides of this invention as a (co-)stimulatory factor.

TI Polypeptides and their Production

As will be disclosed below, the invention now discloses the sequence of various TI polypeptides and allows the prediction of TI sequences from virtually any gene.

In a first embodiment, the present invention is drawn to an isolated polypeptide comprising a gTI sequence, i.e., a sequence of an aberrant protein domain created by gap transcription infidelity. Specific examples of polypeptides of this invention comprise a sequence selected from SEQ ID NOs: 1 to 2206 (see Table 3a), or an epitope containing fragment thereof.

In a second embodiment, the present invention is drawn to an isolated polypeptide comprising an insertion TI sequence, i.e., a sequence of an aberrant protein domain created by insertion transcription infidelity. Specific examples of polypeptides of this invention comprise a sequence selected from SEQ ID NOs: 2207-3334 (see Table 3b), or an epitope containing fragment thereof.

The term "epitope-containing fragment" denotes any fragment containing at least 6 consecutive amino acid residues, preferably at least 8, even more preferably at least 10, most preferably at least 12, which form an immunologic epitope for antibodies or TCR-expressing cells. Such an epitope may be linear or conformational, and specific for B- or T-cells.

A TI polypeptide of this invention typically comprises between 8 and 100 amino acids, preferably between 8 and 50, more preferably between 10 and 40 amino acids. The polypeptides of this invention may be produced by any conventional technique, such as artificial polypeptide synthesis or recombinant technology.

Polypeptides of this invention may optionally comprise additional residues or functions, such as, without limitation, additional amino acid residues, chemical or biological groups, including labels, tags, stabilizer, targeting moieties, purification tags, secretory peptides, functionalizing reactive groups, etc. Such additional residues or functions may be chemically derivatized, added as an amino acid sequence region of a fusion protein, complexed with or otherwise either covalently or non-covalently attached. They may also contain natural or non-natural amino acids. The polypeptide may be in soluble form, or attached to (or complexed with or embedded in) a support, such as a matrix, a column, a bead, a plate, a membrane, a slide, a cell, a lipid, a well, etc.

In a particular embodiment, polypeptides are biotinylated to form complexes with streptavidin.

The polypeptides of this invention may be present as monomers, or as multimers. Also, they may be in linear conformation, or in particular spatial conformation. In this respect, the polypeptides may be included in particular scaffold to display specific configuration.

Polypeptides of the present invention may be used as immunogens in vaccine compositions or to produce specific antibodies. They may also by used to target drugs or other molecules (e.g., labels) to specific sites within an organism. They may also be used as specific reagents to detect or dose specific antibodies or TCR-bearing immune cells from any sample.

In this respect, a particular object of this invention resides in a device or product comprising a polypeptide as defined above attached to a solid support. The attachment is preferably a terminal attachment, thereby maintaining the polypeptide in a suitable conformation to allow binding of a specific antibody when contacted with a sample containing the same. The attachment may be covalent or non-covalent, directly to the support or through a spacer group. Various techniques have been reported in the art to immobilize a peptide on a support (polymers, ceramic, plastic, glass, silica, etc.), as disclosed for instance in Hall et al., Mechanisms of ageing and development 128 (2007) 161. The support may be magnetic, such as magnetic beads, to facilitate e.g., separation.

The device preferably comprises a plurality of polypeptides of this invention, e.g., arrayed in a pre-defined order, so that several TIABs may be detected or measured with the same device.

The device is typically made of any solid or semi-solid support, such as a titration plate, dish, slide, wells, membrane, bead, column, etc. The support typically comprises at least two polypeptides selected from SEQ ID NO: 1 to 3334, or an epitope-containing fragment thereof, more preferably from the 45 PAP polypeptides of table 5 (included in SEQ ID NO 1-3334).

In a most preferred embodiment, the method or support of the invention uses a combination of at least 2, preferably at least 3 polypeptides comprising the sequence of a distinct PAP polypeptide of Table 5.

In a particular embodiment, the device or method uses at least one, two or three polypeptides selected from PAP 1, 2, 4, 6, 7, 24, 25, 28, 29, 44, or 48 (Table 5).

In another particular embodiment, the method or support of the invention uses a combination of distinct PAP polypeptides of Table 5 selected from:
 polypeptides PAP7, PAP66, PAP70, PAP29, PAP68 and PAP48;
 polypeptides PAP7, PAP48, PAP70 and PAP29;
 polypeptides PAP6, PAP29, PAP70 and PAP82;
 polypeptides PAP6, PAP7, PAP29, PAP48, PAP70 and PAP82;
 polypeptides PAP6, PAP29, PAP70 and PAP69;
 polypeptides PAP7, PAP48, PAP70, PAP74 and PAP29; or
 polypeptides PAP7, PAP29 and PAP94.

In a particular embodiment, the device comprises from 2 to 10 polypeptides.

The support may comprise additional objects or biological elements, such as control polypeptides and/or polypeptides having a different immune reactivity.

Formation of an immune complex between the polypeptide and a TIAB may be assessed by known techniques, such as by using a second labelled antibody specific for human antibodies, or by competition reactions, etc.

A further aspect of this invention resides in a kit comprising a device as disclosed above, as well as one or several reagents to perform an immune reaction, i.e. formation and detection of an immune complex.

TI Polynucleotides

A further embodiment of this invention relates to a polynucleotide comprising a nucleotide sequence encoding a polypeptide as defined above or a complementary strand thereof. Particularly, this polynucleotide comprising a first nucleotide sequence encoding a polypeptide selected from the group consisting of SEQ ID NOs: 1-3334 or a sequence complementary thereto and a second nucleotide sequence of 100 or less nucleotides in length, wherein said second nucleotide sequence is adjacent to said first nucleotide sequence in a naturally occurring nucleic acid. The length of the second nucleotide sequence which is adjacent to the first nucleotide sequence may be, for example, 75, 50, 25, 10 or 0.

The polynucleotides of the present invention may be DNA or RNA, such as complementary DNA, synthetic DNA, mRNA, or analogs of these containing, for example, modified nucleotides such as 3'alkoxyribonucleotides, methylphosphanates, and the like, and peptide nucleic acids (PNAs), etc. The polynucleotide may be labelled. The polynucleotide may be produced according to techniques well-known per se in the art, such as by chemical synthetic methods, in vitro transcription, or through recombinant DNA methodologies, using sequence information contained in the present application. In particular, the polynucleotide may be produced by chemical oligonucleotide synthesis, library screening, amplification, ligation, recombinant techniques, and combination(s) thereof.

A specific embodiment of this invention resides in a polynucleotide encoding a polypeptide comprising a sequence selected from SEQ ID 2207-3334 or an epitope-containing fragment thereof.

Polynucleotides of this invention may comprise additional nucleotide sequences, such as regulatory regions, i.e., promoters, enhancers, silencers, terminators, and the like that can be used to cause or regulate expression of a polypeptide.

Polynucleotides of this invention may be used to produce a recombinant polypeptide of this invention. They may also be used to design specific reagents such as primers, probes or antisense molecules (including antisense RNA, iRNA, aptamers, ribozymes, etc.), that specifically detect, bind or affect expression of a polynucleotide encoding a polypeptide as defined above. They may also be used as therapeutic molecules (e.g., as part of an engineered virus, such as, without limitation, an engineered adenovirus or adeno-associated virus vector in gene therapy programs) or to generate recombinant cells or genetically modified non-human animals, which are useful, for instance, in screening compound libraries for agents that modulate the activity of a polypeptide as defined above.

Within the context of this invention, a nucleic acid "probe" refers to a nucleic acid or oligonucleotide having a polynucleotide sequence which is capable of selective hybridization with a transcription infidelity domain or a complement thereof, and which is suitable for detecting the presence (or amount thereof) in a sample containing said domain or complement. Probes are preferably perfectly complementary to a transcription infidelity domain however, certain mismatch may be tolerated. Probes typically comprise single-stranded nucleic acids of between 8 to 1500 nucleotides in length, for instance between 10 and 1000, more preferably between 10 and 800, typically between 20 and 700. It should be understood that longer probes may be used as well. A preferred probe of this invention is a single stranded nucleic acid molecule of between 8 to 400 nucleotides in length, which can specifically hybridize to a transcription infidelity domain.

The term "primer" designates a nucleic acid or oligonucleotide having a polynucleotide sequence which is capable of selective hybridization with a transcription infidelity domain or a complement thereof, or with a region of a nucleic acid that flanks a transcription infidelity domain, and which is suitable for amplifying all or a portion of said transcription infidelity domain in a sample containing said domain or complement. Typical primers of this invention are single-stranded nucleic acid molecules of about 5 to 60 nucleotides in length, more preferably of about 8 to about 50 nucleotides in length, further preferably of about 10 to 40, 35, 30 or 25 nucleotides in length. Perfect complementarity is preferred, to ensure high specificity. However, certain mismatch may be tolerated, as discussed above for probes.

Another aspect of this invention resides in a vector, such as an expression or cloning vector comprising a polynucleotide as defined above. Such vectors may be selected from plasmids, recombinant viruses, phages, episomes, artificial chromosomes, and the like. Many such vectors are commercially available and may be produced according to recombinant techniques well known in the art, such as the methods set forth in manuals such as Sambrook et al., *Molecular Cloning* (2d ed. Cold Spring Harbor Press 1989), which is hereby incorporated by reference herein in its entirety.

A further aspect of this invention resides in a host cell transformed or transfected with a polynucleotide or a vector as defined above. The host cell may be any cell that can be genetically modified and, preferably, cultivated. The cell can be eukaryotic or prokaryotic, such as a mammalian cell, an insect cell, a plant cell, a yeast, a fungus, a bacterial cell, etc. Typical examples include mammalian primary or established cells (3T3, CHO, Vero, Hela, etc.), as well as yeast cells (e.g., *Saccharomyces* species, *Kluyveromyces*, etc.) and bacteria (e.g., *E. coli*). It should be understood that the invention is not limited with respect to any particular cell type, and can be applied to all kinds of cells, following common general knowledge.

Diagnosis

The present invention allows the performance of detection or diagnostic assays that can be used, e.g., to detect the presence, absence, predisposition, risk or severity of a disease from a sample derived from a subject. In a particular embodiment, the disease is a cancer. The term "diagnostics" shall be construed as including methods of pharmacogenomics, prognostic, and so forth.

In a particular aspect, the invention relates to a method of detecting in vitro or ex vivo the presence, absence, predisposition, risk or severity of a disease in a subject, preferably a human subject, comprising placing a sample from the subject in contact with a polypeptide as defined above and determining the formation of an immune complex. Most preferably, the polypeptide is immobilized on a support. In a preferred embodiment, the method comprises contacting the sample with a device as disclosed above and determining the formation of immune complexes. Preferably, the polypeptide is selected from SEQ ID NO: 1-3334 or an epitope-containing fragment thereof, and most preferably from the 45 PAP of table 5 (included in SEQ ID NO 1-3334).

In an another aspect, the invention relates to a method of detecting in vitro or ex vivo the presence, absence, predisposition, risk or severity of a disease in a subject, preferably a human subject, comprising placing a sample from the subject in contact with a TIAB or a portion of a TIAB or a corresponding TCR-bearing cell as defined above and determining the formation of an immune complex. Most preferably, the TIAB or the corresponding TCR-bearing cell is immobilized on a support. In a preferred embodiment, the method comprises contacting the sample with a device as disclosed above and determining the formation of immune complexes. In another preferred embodiment, the TIAB or the corresponding TCR-bearing cell is specific for a polypeptide selected from SEQ ID NOs: 1-3334 or an epitope-containing fragment thereof, and preferably from the 45 PAP of table 5.

A particular object of this invention resides in a method of detecting the presence, absence, predisposition, risk or severity of cancers in a subject, the method comprising placing in vitro or ex vivo a sample from the subject in contact with a polypeptide as defined above and determining the formation of an immune complex. More preferably, the polypeptide is immobilized on a support and selected from SEQ ID NOs: 1-3334 or an epitope-containing fragment thereof, and most preferably from the 45 PAP of table 5.

Another object of the invention relates to a method of detecting in vitro or ex vivo the presence, absence, predisposition, risk or severity of a disease in a biological sample, preferably, a human biological sample, comprising placing said sample in contact with a polypeptide as defined above and determining the presence of immune cells expressing a TCR specific for such a polypeptide. Preferably, the polypeptide is selected from SEQ ID NOs: 1-3334 or an epitope-containing fragment thereof, and most preferably from the 45 PAP of table 5.

A further aspect of this invention resides in a method of assessing in vitro or ex vivo the level of transcription infidelity in a subject, preferably, a human subject, comprising placing a sample from the subject in contact with a polypeptide as defined above and determining the formation of an immune complex. Most preferably, the polypeptide is immobilized on a support. In a preferred embodiment, the method comprises contacting the sample with a device as disclosed above and determining the formation of immune complexes.

A further aspect of this invention resides in a method of assessing in vitro or ex vivo the level of transcription infidelity in a subject, preferably, a human subject, comprising placing a sample from the subject in contact with a polypeptide as defined above and determining the presence of immune cells expressing a TCR specific for such a polypeptide.

Another embodiment of this invention is directed to a method of determining the efficacy of a treatment of a cancer, the method comprising (i) determining the level of at least one polypeptide comprising the sequence of an aberrant protein domain created by transcription infidelity or the level of TIAB or corresponding TCR-bearing cells, in a sample from the subject and (ii) comparing said level to the level in a sample from said subject taken prior to or at an earlier stage of the treatment. Preferably, polypeptide(s) is(are) selected from SEQ ID NOs: 1-3334 or an epitope-containing fragment thereof, and more preferably from the 45 PAP of table 5.

A further aspect of this invention is directed to a method of determining whether an individual is making a polypeptide comprising the sequence of an aberrant protein domain created by transcription infidelity, and particularly comprising a sequence selected from the group consisting of SEQ ID NOs: 1-3334 or an epitope-containing fragment thereof, said method comprising contacting a sample obtained from said individual with an agent indicative of the presence of said polypeptide and determining whether said agent binds to said sample.

In a first embodiment, the sample obtained from the subject is placed in contact with a polypeptide which binds to antibodies specific for a polypeptide comprising the sequence of an aberrant protein domain created by transcription infidelity, and particularly, comprising a sequence selected from the group consisting of SEQ ID NOs: 1-3334 or an epitope-containing fragment thereof.

In another embodiment, the sample obtained from the subject is placed in contact with a polypeptide which binds immune cell comprising a TCR specific for a polypeptide comprising the sequence of an aberrant protein domain created by transcription infidelity, and particularly, comprising a sequence selected from the group consisting of SEQ ID NOs: 1-3334 or an epitope-containing fragment thereof.

In another embodiment, the sample obtained from the subject is placed in contact with an antibody or portion thereof which is specific for a polypeptide comprising the sequence of an aberrant protein domain created by transcription infidelity, and particularly, comprising a sequence selected from the group consisting of SEQ ID NOs: 1-3334 or an epitope-containing fragment thereof.

In another embodiment, the sample obtained from the subject is placed in contact with immune cells comprising TCR specific for a polypeptide comprising the sequence of an aberrant protein domain created by transcription infidelity, and particularly, comprising a sequence selected from the group consisting of SEQ ID NOs: 1-3334 or an epitope-containing fragment thereof.

This invention further relates to a method of monitoring the progression or the extension of a cancer in a subject, said method comprising (i) contacting a sample obtained from said subject with at least one polypeptide comprising the sequence of an aberrant protein domain created by transcription infidelity, (ii) determining the level of TIAB or corresponding TCR-bearing cells in said sample and (iii) comparing said level to reference level, said reference level being a mean or median value from subjects not having a cancer or control value from the subject before cancer onset. Preferably the polypeptide comprises the sequence of PAP 12, for which titers of antibodies are significantly increased in non operable patients versus operable ones and thus provide indication related to disease extension.

The presence (or increase) in TIAB or corresponding TCR-bearing immune cells in a sample is indicative of the presence, predisposition or stage of progression of a cancer disease. Therefore, the invention allows the design of appropriate therapeutic intervention, which is more effective and customized. Also, this determination at the pre-symptomatic level allows a preventive regimen to be applied.

The diagnostic methods of the present invention can be performed in vitro, ex vivo or in vivo, preferably in vitro or ex vivo. The sample may be any biological sample derived from a subject, which contains antibodies or immune cells, as appropriate. Examples of such samples include body fluids, tissues, cell samples, organs, biopsies, etc. Most preferred samples are blood, plasma, serum, saliva, seminal fluid, and the like. The sample may be treated prior to performing the method, in order to render or improve availability of antibodies for testing. Treatments may include, for instance one or more of the following: cell lysis (e.g., mechanical, physical, chemical, etc.), centrifugation, extraction, column chromatography, and the like.

In a preferred embodiment, the test is performed on serum or plasma.

Furthermore, in a most preferred embodiment, the sample is treated as disclosed in EP08 305 293.6 prior to testing.

Indeed, the applicant has shown that optimal testing conditions are different when the samples have been kept fresh frozen at −20° C. or at −80° C. More preferably, the sample to be tested is subjected to a chemical or physical treatment suitable to unveil antibody binding site, change the conformation of the binding site, or unmask the antibody binding site. More preferably, the treatment comprises heating the sample at a temperature of at least 36° C. for a period of time sufficient to activate the antibody. Preferred temperatures are comprised between 36° C. and 70° C., preferably between 36° C. and 60° C.

Determination of the presence, absence, or relative abundance of a TIAB or specific immune cell in a sample can be performed by a variety of techniques known per se in the art. Such techniques include, without limitation, methods for detecting an immune complex such as, without limitation, ELISA, radio-immunoassays (RIA), fluoro-immunoassays, microarray, microchip, dot-blot, western blot, EIA, IEMA, IRMA or IFMA (see also Immunoassays, a practical approach, Edited by JP Gosling, Oxford University Press). In a particular embodiment, the method comprises contacting the sample and polypeptide(s) under conditions allowing formation of an immune complex and revealing said formation using a second labelled reagent.

In a typical embodiment, the method comprises comparing the measured level of TIAB or immune cells to a reference level, wherein a difference is indicative of a dysfunction in the subject, e.g., a cancer. A change is typically a 10%, 20%, 30%, 40%, 50% or more variation as compared to the reference value. More particularly, the change in the level as compared to the reference value is an increase, which is indicative of the presence of a cancer.

The reference value may be a mean or median value determined from individuals not having a cancer or disease, a reference level obtained from a control patient, a reference level obtained from the subject before cancer onset or with a control polypeptide.

In a preferred embodiment, a change (e.g., an increase) in the level of TIAB or immune cells in said sample as compared to the reference level is indicative of the presence, risk or stage of development of a cancer.

Contacting may be performed in any suitable device, such as a plate, microtitration dish, test tube, wells, glass, column, and so forth. In specific embodiments, the contacting is performed on a substrate coated with the polypeptide. The substrate may be a solid or semi-solid substrate such as any suitable support comprising glass, plastic, nylon, paper, metal, polymers and the like. The substrate may be of various forms and sizes, such as a slide, a membrane, a bead, a column, a gel, etc. The contacting may be made under any condition suitable for a detectable antibody-antigen complex to be formed between the polypeptide and antibodies of the sample.

In a specific embodiment, the method comprises contacting a sample from the subject with (a support coated with) a plurality of polypeptides as described above, and determining the presence of immune complexes.

In a particular embodiment, the method comprises contacting the sample with a plurality of sets of beads, each set of beads being coated with a distinct polypeptide as defined above.

In another particular embodiment, the method comprises contacting the sample with a slide or membrane on which several polypeptides as defined above are arrayed.

In another particular embodiment, the method comprises contacting the sample with a multi-wells titration plate, wherein at least part of the wells are coated with distinct polypeptides as defined above.

The invention may be used for determining the presence, risk or stage of any cancer in a subject. This includes solid tumors, such as, without limitation, colon, lung, breast, ovarian, uterus, liver, or head and neck cancers, as well as melanoma, brain tumors, etc. The invention may also be used for liquid tumors, such as leukemia. The invention may be used in a first screening, to detect a cancer, even at early stages thereof, in a subject having a risk of developing such a disease. In a second screen, the invention may be used to more precisely identify the type of cancer, depending on the polypeptides used for detection. In this respect, as disclosed in FIG. 3, polypeptides comprising the sequence of PAP 1, 2, 3, 4 or 7 (Table 5), or an epitope-containing fragment thereof, allow the identification of patients with various types of cancers.

In a particular embodiment, the invention is used to determine the presence, risk or stage of a lung cancer and the polypeptide comprises a sequence selected from PAP 1, 2, 4, 6, 7, 24, 25, 28, 29, 44 and 48 (Table 5) (FIG. 4) or an epitope-containing fragment thereof.

Drug Screening

The invention also allows the design (or screening) of novel drugs by assessing the ability of a candidate molecule to modulate TIAB levels or corresponding immune cells.

A particular object of this invention resides in a method of selecting, characterizing, screening or optimizing a biologically active compound, said method comprising determining whether a test compound modulates TIAB levels. Modulation of TIAB levels can be assessed with respect to a particular protein, or with respect to a pre-defined set of proteins, or globally.

A further embodiment of the present invention resides in a method of selecting, characterizing, screening or optimizing a biologically active compound, said method comprising placing in vitro a test compound in contact with a gene and determining the ability of said test compound to modulate the production, from said gene, of RNA molecules containing transcription infidelity gaps and insertions.

A further embodiment of the present invention resides in a method of selecting, characterizing, screening or optimizing a biologically active compound, said method comprising placing in vitro a test compound in contact with an immune cell expressing a TCR receptor specific for a polypeptide as defined above, and determining the ability of said test compound to modulate the activity or growth of said cell.

The above screening assays may be performed in any suitable device, such as plates, tubes, dishes, flasks, etc. Typically, the assay is performed in multi-well microtiter dishes. Using the present invention, several test compounds can be assayed in parallel. Furthermore, the test compound may be of various origin, nature and composition. It may be any organic or inorganic substance, such as a lipid, peptide, polypeptide, nucleic acid, small molecule, in isolated or in mixture with other substances. The compounds may be all or part of a combinatorial library of compounds, for instance.

Further aspects and advantages of the present invention will be disclosed in the following experimental section, which should be considered as illustrative and not limiting the scope of this application.

EXAMPLES

A—Materials and Methods

Plasma Samples

Blood samples were drawn from normal human subjects (n=26) attending local university hospital for the purpose of biological testing not related to cancer (Nancy University Hospital). Clinical records were reviewed by a trained physician who ascertained that these subjects were free from acute disease, not suspected of active cancer, allergic or autoimmune conditions. This group includes patients with cancer risk factors, e.g., smoking and obesity, one of the controls had uterus cancer surgically removed 10 years prior to blood sampling and one was pregnant at time of blood sampling. Patients with chronic obstructive pulmonary disease (n=12) were either recruited in the same department (n=6) or recruited in the nuclear medicine department of the same hospital (n=6). All patients with COPD were free from exacerbation episodes at the time of blood sampling. Patients with various forms of solid tumors (n=46) were sampled at the time of PET-CT cancer extension evaluation before treatment and staging was completed by analysis of pathology samples (Nancy University Hospital). Patients with active NSCLC (n=49) were recruited in Strasbourg University Hospital and were part of a lung cancer longitudinal study. Blood samples were drawn at the time of staging. All patients attending these medical research facilities agreed to have their samples anonymously tested for research purposes by signing consent forms. Collection and analysis of these samples were declared to the French ministry of Health and to the Ministry of Research in accordance with French laws.

Bioinformatic Procedures

The analysis was performed as previously described, but with the following modifications[34]. Each EST was retrieved and assigned to either cancer or normal set of sequences using the tissue source available in database. Each sequence was then aligned once using MegaBlast 2.2.16[38] against human RNA RefSeq from NCBI. The single best alignment score was retained. Each EST that did not align on more than 70% of its length was not taken into account. Positions with single base sequence variations were taken into account only if 10 bases upstream and the 10 downstream were a perfect match to RefSeq. The first and last 50 bases at each alignment extremity were deleted. Gaps and insertions were located on the last nucleotide of any n-uplet if need be.

Biochemical Analysis

N-terminal biotinylated peptides with aa sequence defined by in silico translation of RefSeq taking into account the identified K gap and peptides corresponding to canonical sequence of albumin and MRPL12 gene were purchased from different manufacturers. Samples were diluted 100-fold and IgG detection was performed on ImmunoCAP100 (Phadia, Uppsala, Sweden) using commercially available reagents and following manufacturer instructions. Samples were analyzed in duplicate with a few exceptions in FIG. 3 due to sample shortage. The order or testing of cancer and control as well as that of PAP was random. In absence of internal standards, results are expressed as fluorescence units (FU).

Statistical Method

Testing for statistical significance of EST base composition and estimation of false positives due to multiple testing was performed as previously described[34]. Non parametric ranks comparison Wilcoxon test was used to test difference in IgG titers.

B—Results

Identification of Protein Domains that Result from TI Gaps

To analyze EST heterogeneity on a genome-wide scale, we retrieved from noncurated dbEST[39] all sequences released between January 2000 and July 2007. These sequences were separated according to their normal or cancer origin, as indicated in the database. Each EST was then aligned once against all human RefSeq RNA sequences from NCBI (July 2007)[40]. We first tested for statistical significance of differences occurring at any given RefSeq position between normal and cancer matrices, and then estimated false positives due to multiple testing[41]. Positions with statistically significant sequence differences are referred to as K if the variation is in excess in cancer and conversely N when in excess in normal.

The most important observation to be drawn from the results of Table 1 is that K gaps occurred even more commonly than K base substitutions. The bioinformatic constraints defining these gaps are stringent: a given EST position with a single base gap is taken into account only if it is flanked upstream and downstream by 10 bases that are perfect matches to RefSeq. For the 2191 K gaps located within ORF, normal and cancer gapped ESTs percentages are represented on FIG. 1 Strikingly, K insertions were 5 fold more common than N insertions and K gaps were ~13-fold more common than N gaps. Subtracting the estimation of statistical false positives increased the ratio to 38 because p-values of K gaps are much lower than those of N gaps. Unlike K, N gaps were few and obviously contained a large proportion of false positives (Table 1). We therefore focused further analysis on K gap positions located within the ORF.

Table 2 summarizes the entries of our analysis. It is clear that there was no obvious bias resulting from differences in the number of ESTs or transcripts represented in cancer and normal sets. From Tables 1 and 2, one can estimate that in cancer cells mRNA sequence variations i.e. substitutions, insertions and gaps occurred at the rate of 1-2 per thousand bases. This largely exceeded the rate of somatic mutations: 1-2 per megabase[31].

SBG (single base gap) in mRNA can be caused by either somatic or germinal mutation, or by RNAP omitting the reading of a single DNA base and proceeding with transcription. We also considered the hypothesis of a slipping forward or backward of the splicing machinery causing SBG to be located on the first or last exon bases. The latter mechanism was however found unlikely because 99.2% of identified SBG were not within immediate exon-intron boundaries.

The composition of missing mRNA bases were in the following order: U (47%)>C (39%)>>G (10%)>A (4%). This distribution deviated strongly from being random (goodness-of-fit chit test, two-tailed, $\alpha=0.05$, $P=10^{-248}$). Also, 99%, 76%, 98% and 95% of U, C, G, and A gaps, respectively, occurred within repeats of one or more identical bases. Finally, for 97% of U gaps, G was found immediately downstream. Thus genomic DNA context is determining in part the possible occurrence of mRNA gap in cancer cells. Detailed analysis of the impact of DNA context on the occurrence of TI events will be reported elsewhere.

Aberrant mRNA Detection

To verify these bioinformatics conclusions, we cloned from a lung cancer patient c-DNA library a plasmid that after qPCR and sequencing was shown with SBG occurring at the predicted position (FIG. 2 A-E). We analyzed the same number of clones obtained from the same individual normal tissue and did not find any sequence variation (data not shown). Direct sequencing of genomic DNA obtained from cancer, adjacent and normal tissue of the same patient unambiguously demonstrated the lack of either somatic or germinal mutation at this position. We can not exclude that the identified mRNA gap was artificially created during the cloning process. However it is unlikely that such event would precisely coincides with the position predicted by bioinformatics. It was thus reasonable to assume that in cancer cells a small but detectable proportion of mRNA were not faithful copy of genomic DNA.

Materials and Methods
Plasmid Preparation:

The pBAD plasmid (Invitrogen) was used in order to have an inducible promoter upstream of the cloned sequence. The sequence of alpha peptide amplified from the pBS-SK+ plasmid was cloned out of phase of the ATG sequence present in the CCATGG cloning site of the pBAD plasmid to produce the pBAD-Alpha plasmid. In absence of a cloned sequence, no alpha peptide is produced and the E. coli colony is white colored.

Insert Preparation and Cloning:

cDNA from cancerous lung and adjacent normal tissue obtained from the same individual (Biochain Inc.) were amplified by PCR using oligonucleotides complementary to the CFL1 gene and the high fidelity Phusion polymerase (Finnzyme) following manufacturer recommendations. cDNA were then purified on Nucleospin Extract II columns (Macherey Nagel), visualized on agarose gel and digested with the NcoI and NheI restriction enzymes (Biolabs). The products were then ligated in the pBAD-alpha plasmid digested with the same enzymes and dephosphorylated. E. coli TOP10 (Invitrogen) cells were transformed with the ligation mix and spread on LB ampicillin (100 mg/L) arabinose (0.5%) X-Gal (80 μg/mL) plates.

Figure 2A:
Figure 2B:
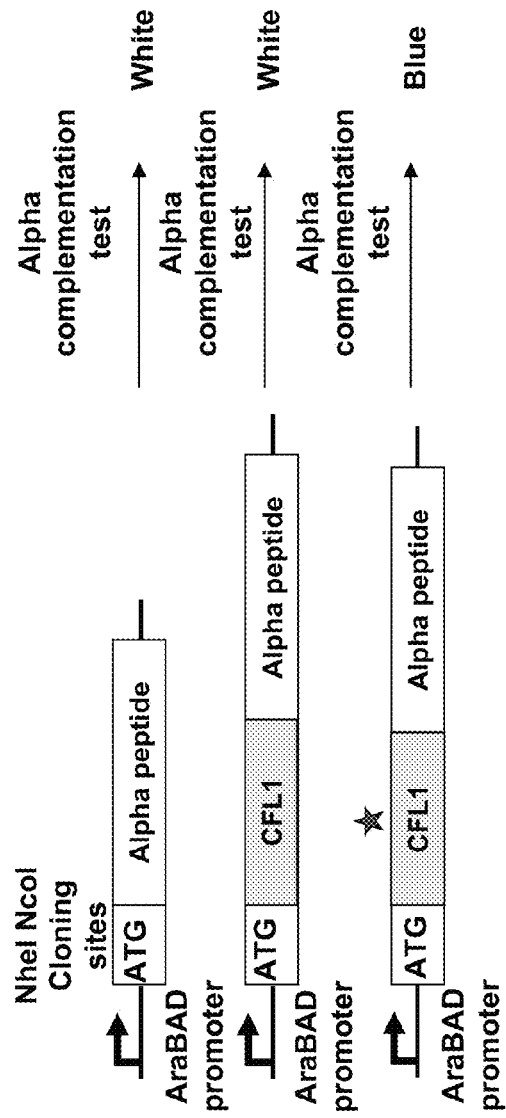

Colonies Screening:

When a CFL1 sequence with no gap is cloned, the alpha peptide is not in phase with the ATG: the colony is white colored. If a CFL1 sequence with a gap is cloned, the alpha peptide is produced, the inactive β-galactosidase (present on the genome of the bacteria) is complemented and the E. coli colony became blue (FIG. 2B).

Figure 2C:
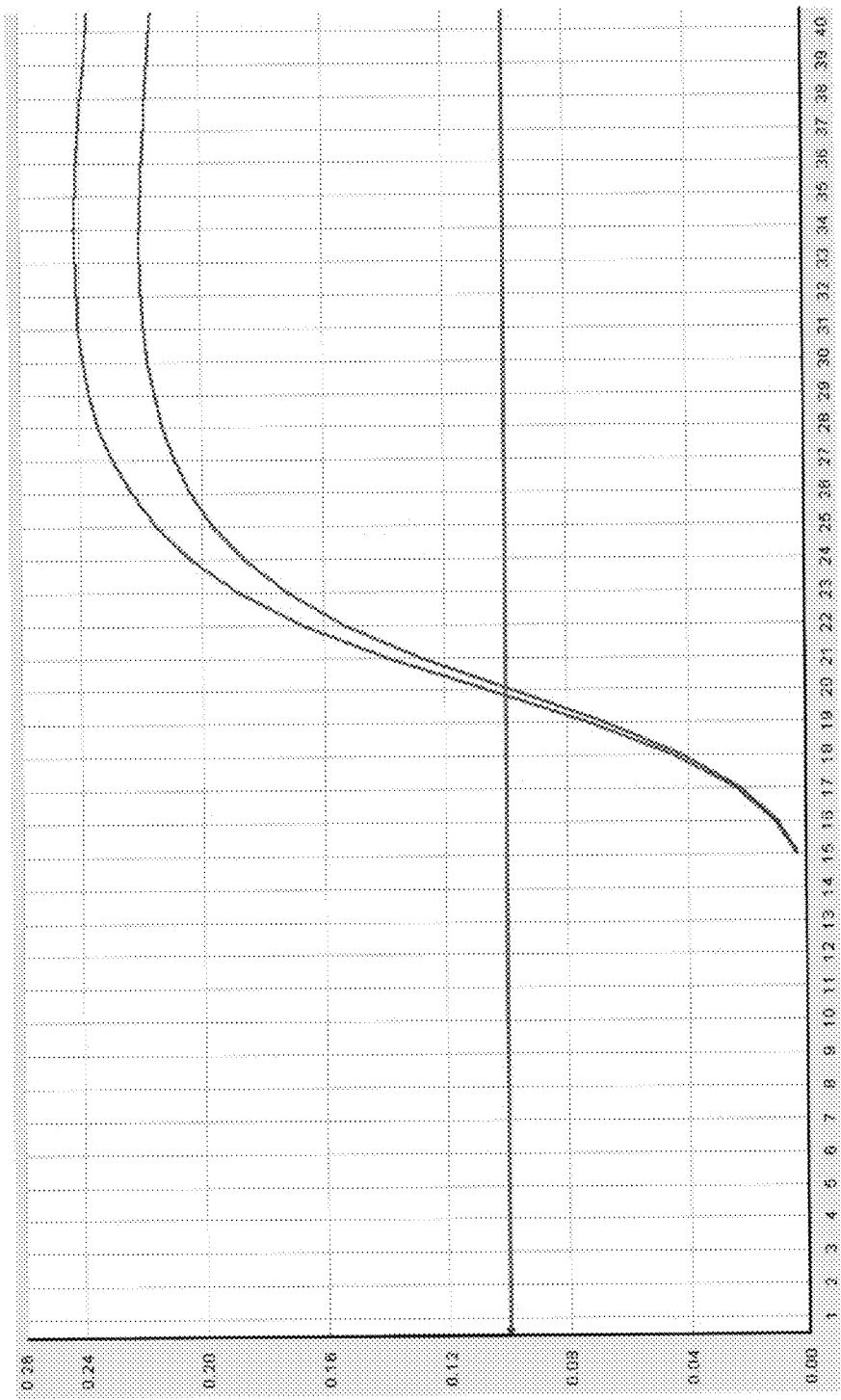
Figure 2C:
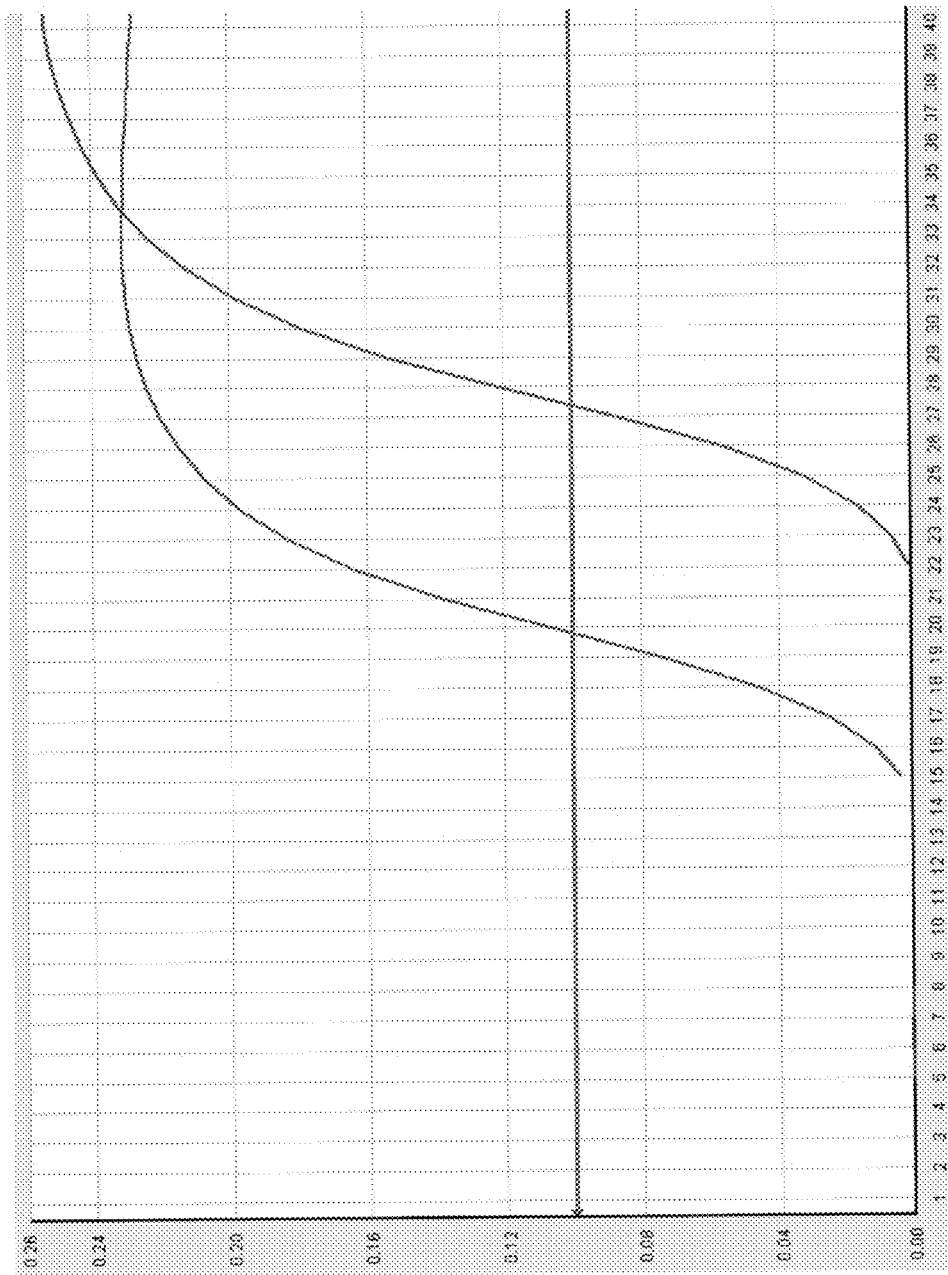
Figure 2D:
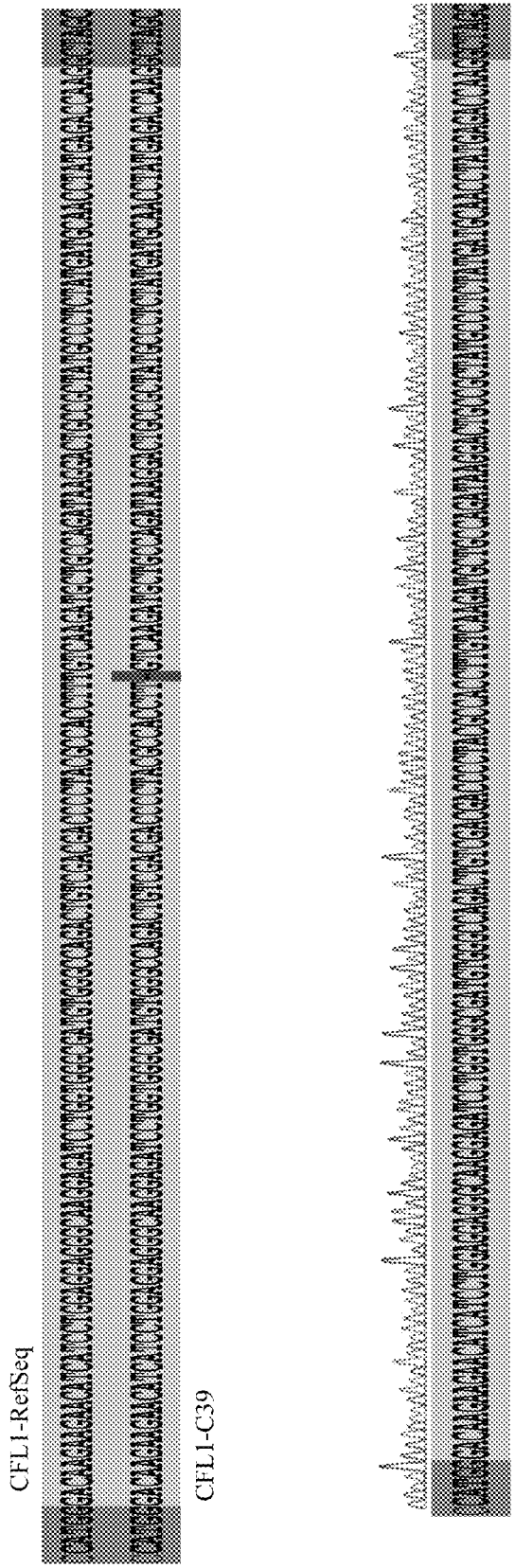
Figure 2E:
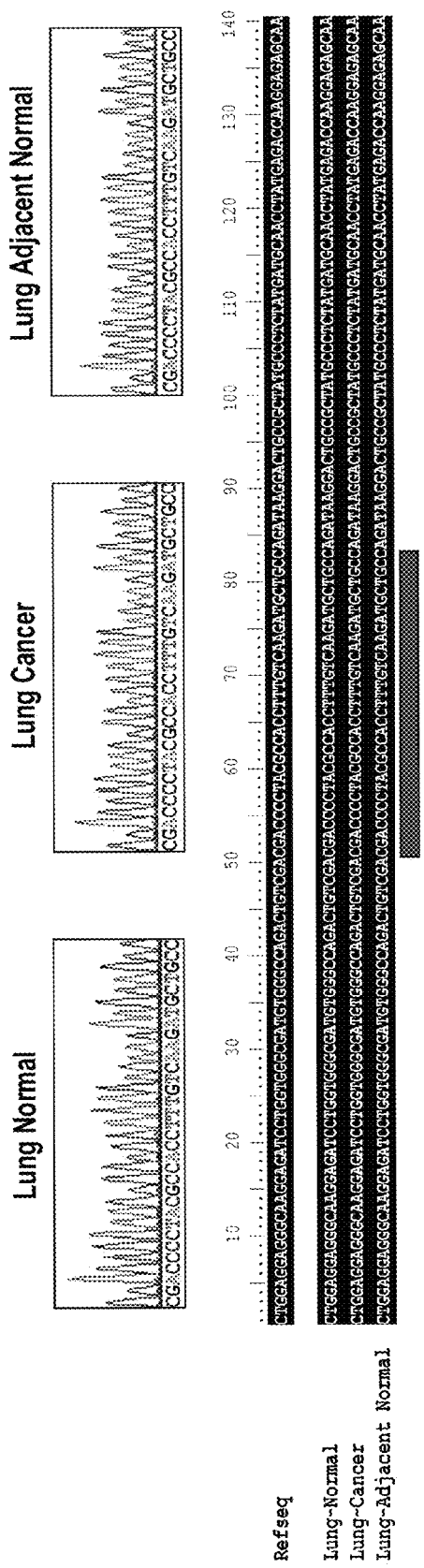

Blue colonies had grown in LB medium supplemented with ampicillin (100 mg/L) and 1 μL of culture was screened with a Real-time PCR using CFL1 specific oligonucleotides and Syber-green I (Sigma) (FIG. 2C). The first oligonucleotide (green on the Figure) is specific of both sequences and shows that the number of plasmid copies is not different between the 2 samples. The second oligonucleotide is specific of the CFL1 Reference sequence (Refseq) and shows a difference between Ct when the sequence is not identical to the Refseq (red on the Figure).

Plasmid DNA of clones that show a difference between Ct were extracted and sequenced using an oligonucleotide present on the plasmid (GATC biotech) (FIG. 2C).

Sequences were aligned to the CFL1 Reference sequence.
TIAB Detection

Figure 1:
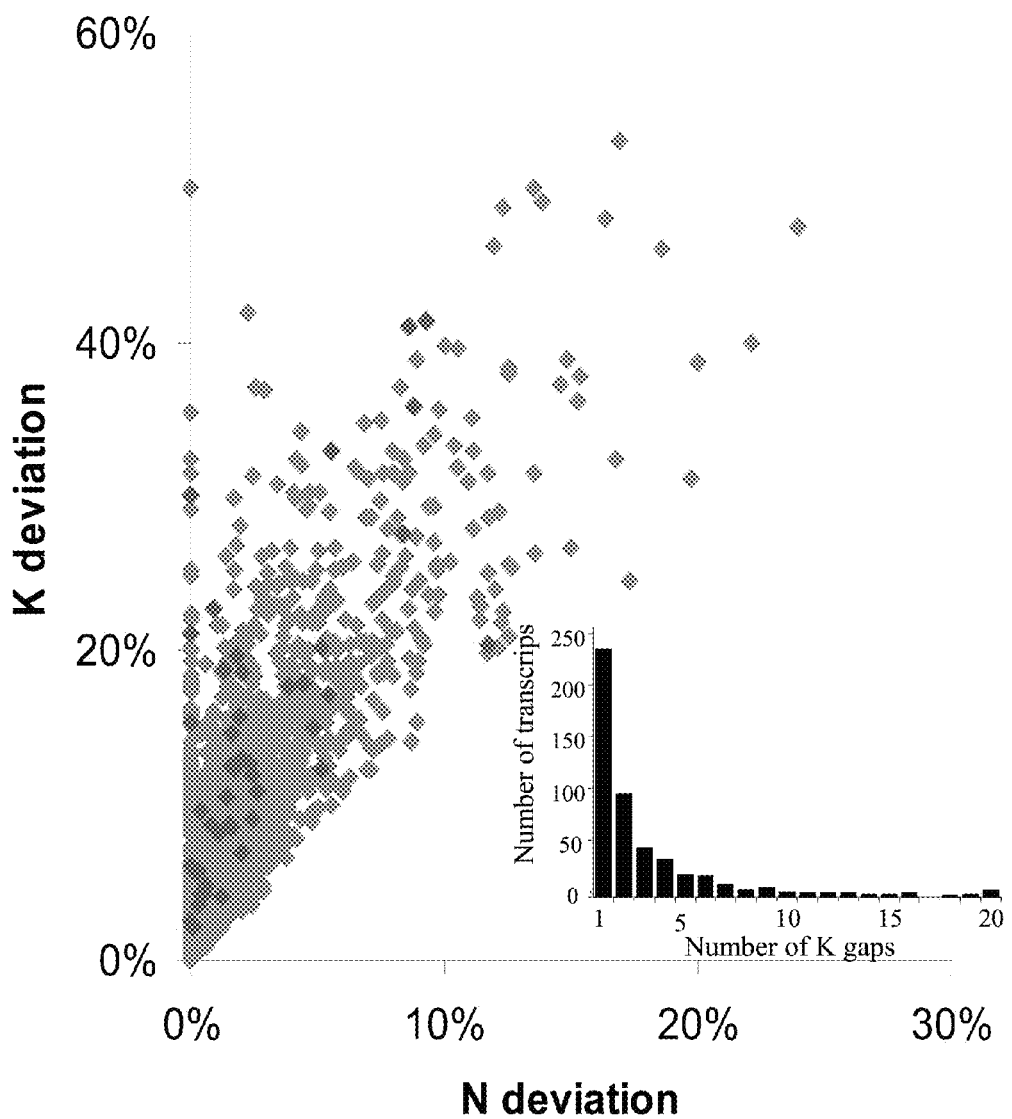

FIG. 1 shows the percentage of deviations recorded for each K position in both the cancer (Y axis) and the normal set (X axis). K gaps were distributed on a limited number (532 or 1.4%) of transcripts (FIG. 1 insert). These mRNA have lost their canonical reading frame and would be translated into aberrant possibly immunogenic proteins. To test this hypothesis, we selected a panel of 15 K gaps representative of the 2206 ORF gap positions (Table 5, PAP 1 to 15) and that were distributed on 8 different human chromosomes. These 15 positions resulted from 8, 5 and 2 omissions of U, C and G, respectively. We verified that AA sequences predicted to result from translation of mRNA with single base gap 1) encode AA sequence longer than 12, 2) did not match with any known human protein on more than 7 consecutive AA (Swiss-Prot[42]), 3) had no AA sequence homology with one another. We also established that selected K gaps had not been identified as cancer somatic mutations by either Sanger Institute Catalogue Of Somatic Mutations (See Worldwide Website: sanger.ac.uk/cosmic)[43] nor by 2 recent large scale in depth cancer cell genome sequencing efforts that included 11 out of 15 genes involved in the current screening[31,32]. K gaps did not correspond to biologically validated or putative SNP. Finally, and according to the most recent update of the dbSNP database (Sep. 21, 2007), there was no SNP introducing a frameshift identical to that caused by a single gap upstream of the defined position[44].

Blood samples are drawn from human subjects divided into two or more groups. All samples are residual sera. At least one group includes patients with active cancers. Clinical data relevant to all groups, including controls and active cancers are collected and ascertained by a trained physician. Data on controls may include cancer risk factors. Data on cancer patients may include staging and response to treatment. The groups are designed to evaluate a panel of TIABs and their specificity and sensitivity for a particular diagnostic indication such as early cancer detection, identification of cancer type, prediction of disease severity and progression, or response to treatment.

Figure 3A:
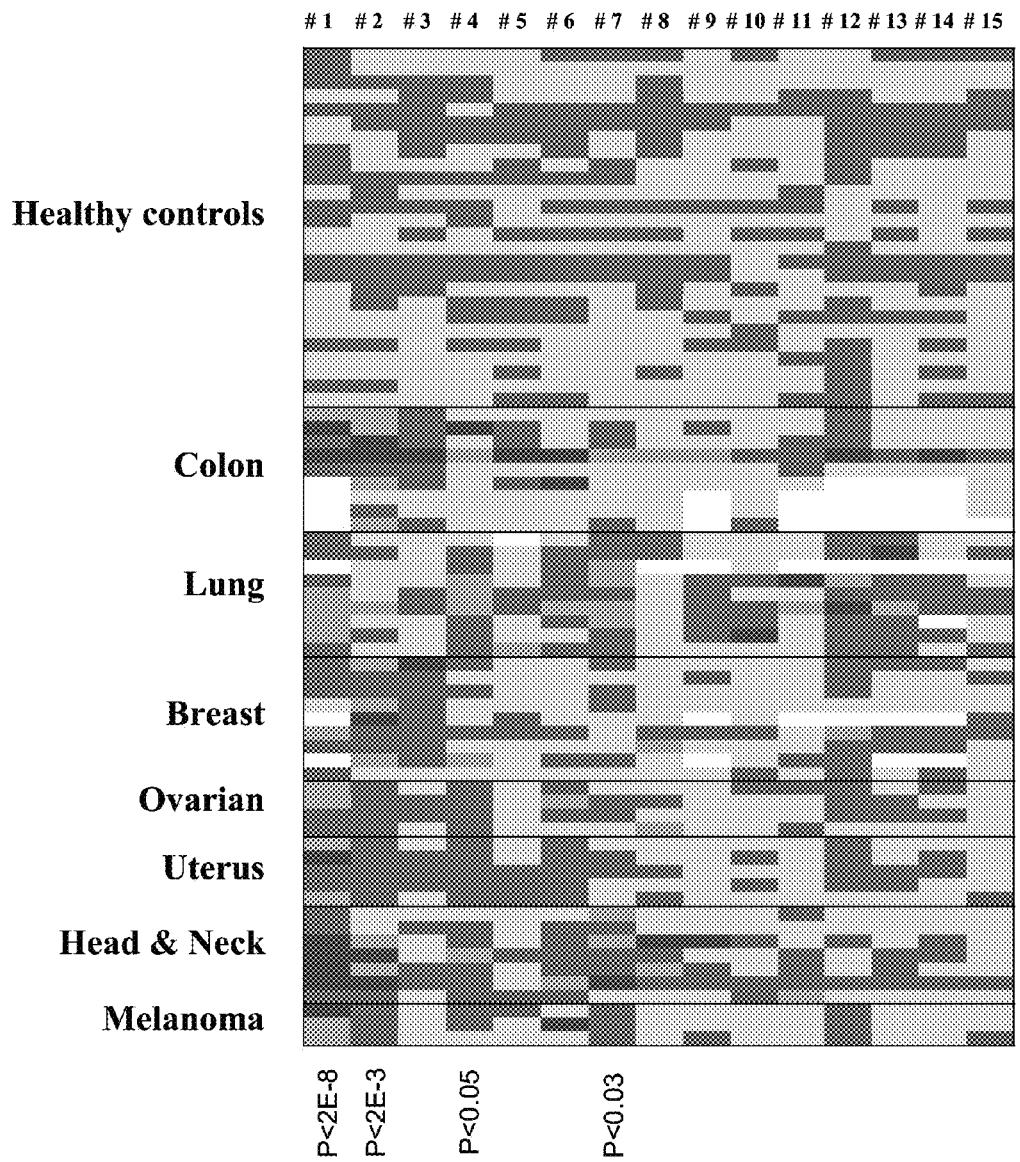
Figure 3B:
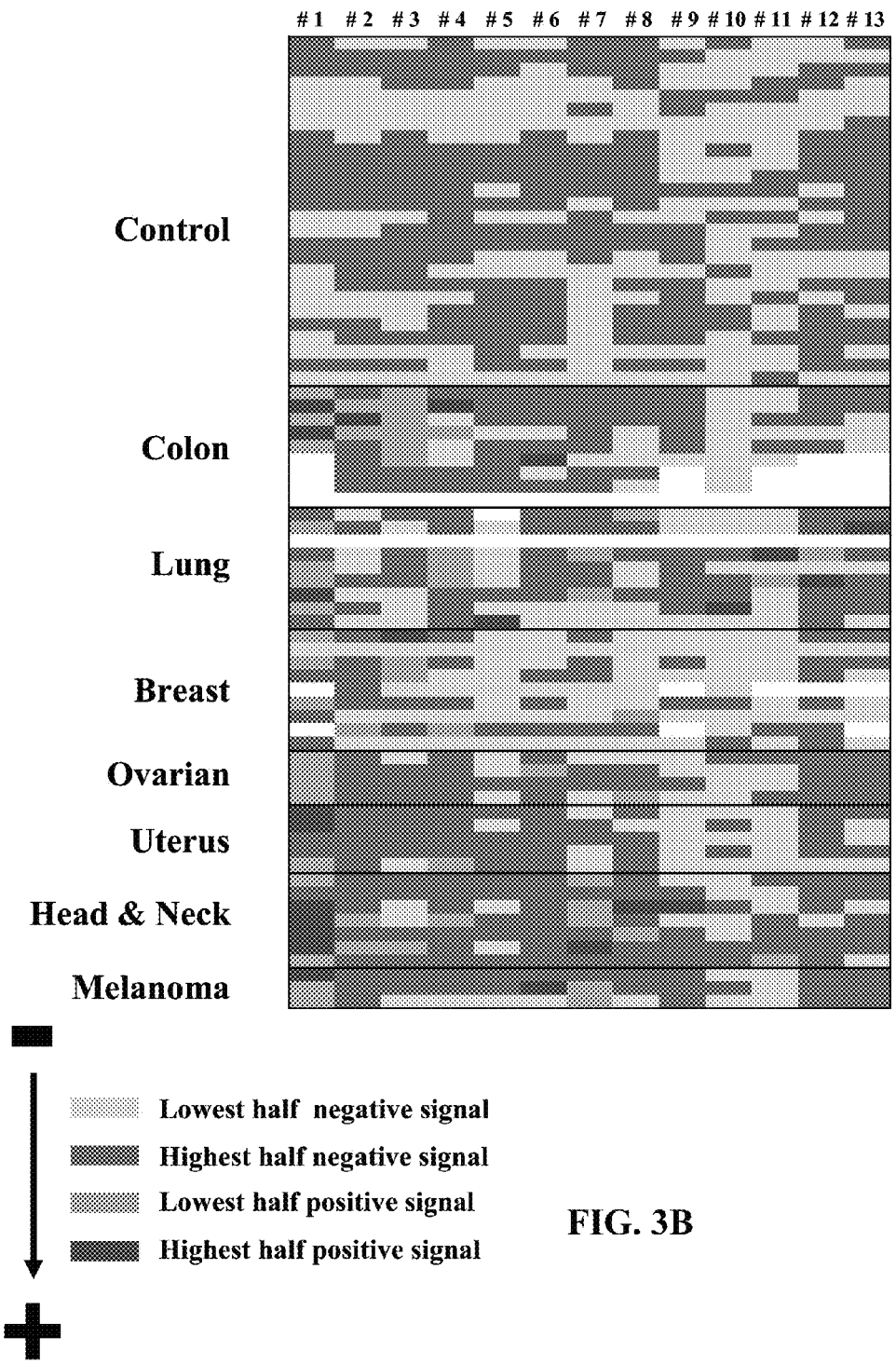

Synthetic N-terminal biotinylated peptides corresponding to these predicted aberrant peptides (PAP) were produced and coated individually onto streptavidin Elia wells (Phadia, Uppsala Sweden). Sera from 46 cancer patients (Study I) and 26 control subjects (Table 4) were incubated with either blank (non peptide coated wells) or peptide coated wells. IgG bound to the wells after washing were revealed with commercial secondary antihuman IgG invariable domain antibodies generating fluorescence. In the first analysis, the intensity of fluorescence measured with any given PAP in a given subject was subtracted from that measured in the same subject using non peptide coated streptavidin well (blank). The results showed in cancer patients versus controls statistically significant increase in IgG directed against PAP 1, 2, 4, 7 (Wilcoxon test $P<2E^{-8}$; $P<2E^{-3}$; $P<5E^{-2}$; $P<3E^{-2}$ respectively) (FIG. 3A). There were no statistically significant differences in the level of any of the IgG detected in young (<50 years) versus older (>50 years) normal subjects (Wilcoxon tests=NS) and no significant differences due to gender of controls (Wilcoxon tests=NS). We next tested whether detection of IgG directed against PAP allowed discrimination between cancer and control subjects. The test was considered positive (FIG. 3 light and dark red) when the difference in fluorescence intensity between PAP coated wells and blank wells was higher than that of the highest value measured in the control group. Thus, specificity was arbitrarily set at 100%. Under these conditions, all but one PAP detected at least one cancer patient; 6 out of 15 PAP identified IgG levels in excess of control in more than 10% of patients. Considered together, 35 out of 46 patients (76%) with 7 forms of the most common solid tumors had IgG levels above threshold defined by the control group. FIG. 3 shows that colon, lung and head and neck cancer patients had a more diversified panel of positive signals and were positive for 11, 10 and 8 PAP respectively. Breast cancer patient IgG bound to only 6 PAP. This diversity further decreased in patients with cancer of ovary, skin and uterus (FIG. 3).

Thus with this first panel of 15 PAP, coverage and sensitivity was optimal for lung cancer. No sensitive early stage lung cancer test exists thus diagnostic at this stage is rare, and 5 year survival only 14% (46).

TIAB Detection for Early Stage Lung Cancer Diagnostic

An important implication of this invention is that early stage lung cancer diagnostic might become possible based on simple blood testing. Analysis of data required no sophisticated statistical method, thus the risk of over fitting is minimal[10]. Also, our test was not a systematic search of biomarkers, but rather hypothesis driven based on bioinformatic predictions, thus the risk of bias due to multiple testing was low[10]. However, because of the clinical implications of such finding, we sought for replication in an independent study.

Synthetic N-terminal biotinylated peptides with AA sequence selected from the 45 PAP of table 5 constituting a panel of TIAB baits are purchased from different manufacturers and coated individually onto Reacti-Bind streptavidin coated plates (Pierce Biotechnology, Rockford, Ill.). Samples are diluted 100 fold and analyzed in duplicate. Serum IgG bound to peptides are revealed with commercial secondary antihuman IgG invariable domain antibodies conjugated with enzyme, particularly phosphatase. Reaction with a fluorescence substrate is performed using commercially available reagents. Fluorescence reading is performed on FLUOstar Galaxy microplate reader (BMG Labtech, Offenburg, Germany) following manufacturer instructions.

A TIAB of the panel is selected for a particular diagnostic indication if a threshold can be established to separate at least two groups of human subjects designed for this indication. For the selected TIAB the absolute fluorescence intensity in one group is higher than the threshold and the fluorescence measured in the same way in the other group is lower than the threshold.

Selection of PAP to Monitor Disease Progression or Extension

We set out to select PAP from a panel in a group of patients representative of various stages of disease progression or extension following the method of the previous example (Selection of PAP/TIABs for a particular diagnostics indication). We next set out to test the efficacy of this panel of PAP in a first group of 49 patients representative of the various stages of non small cell lung cancer (NSCLC) (FIG. 4).

Figure 4A:
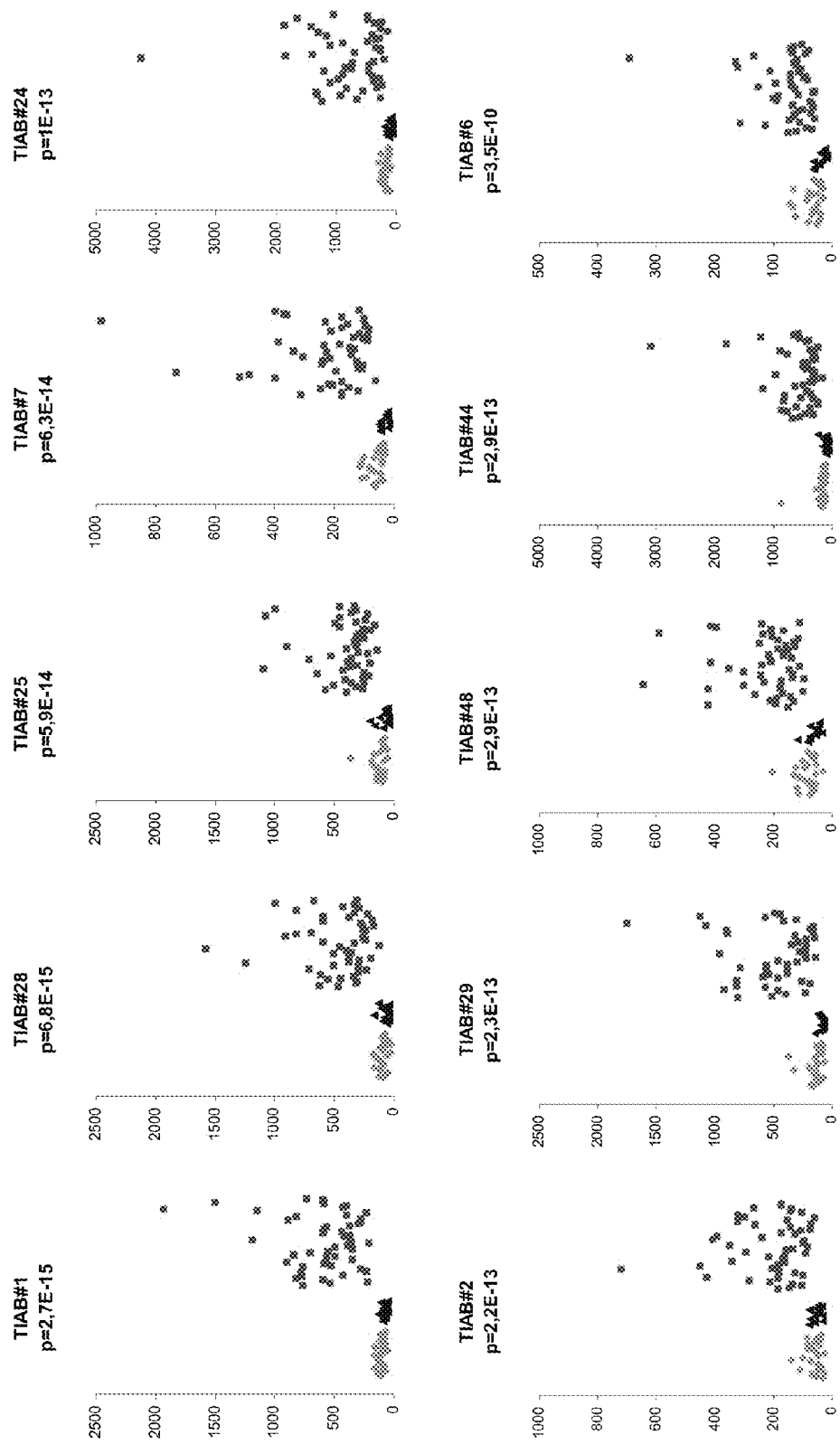
Figure 4A:
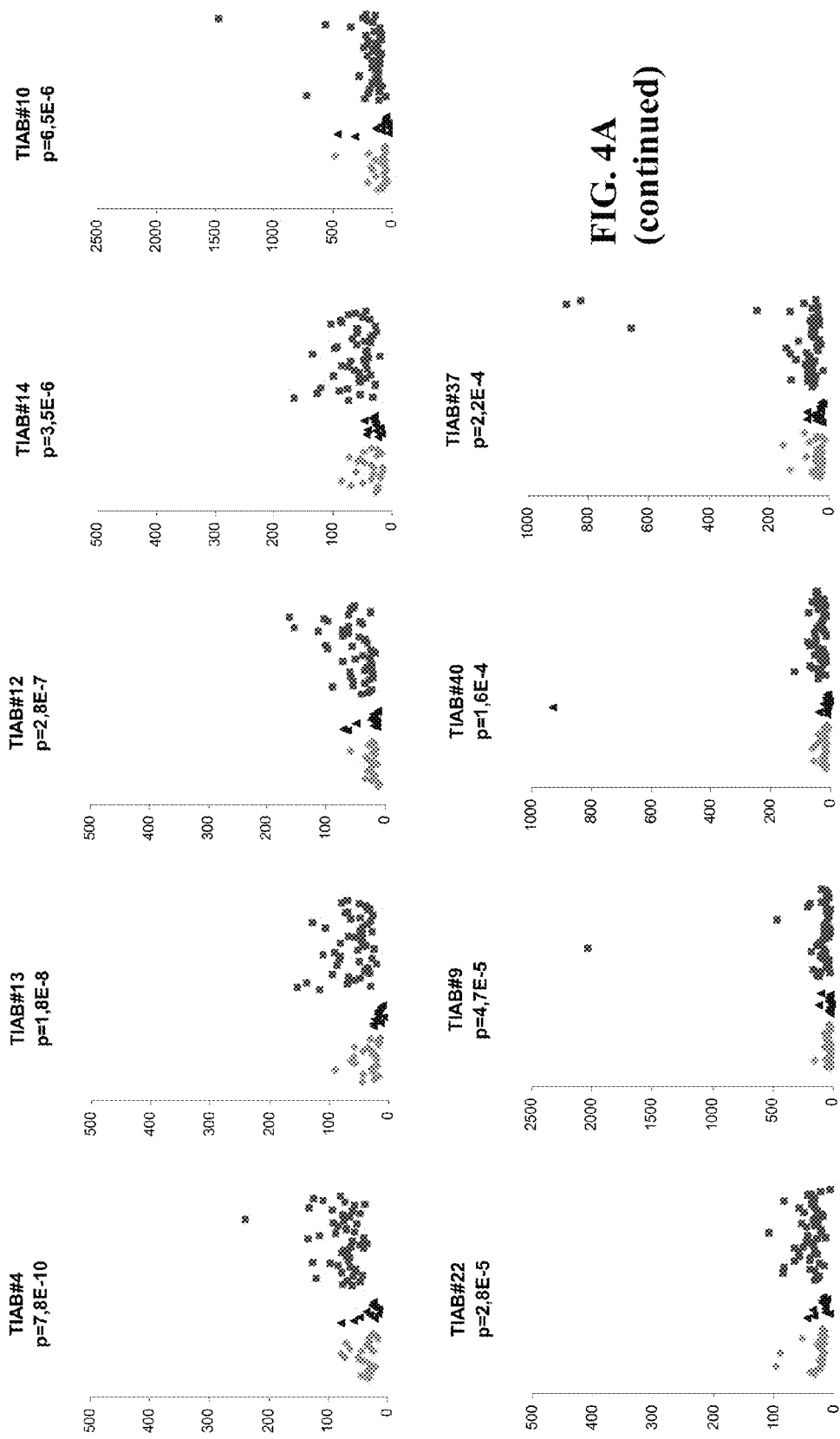
Figure 4A:
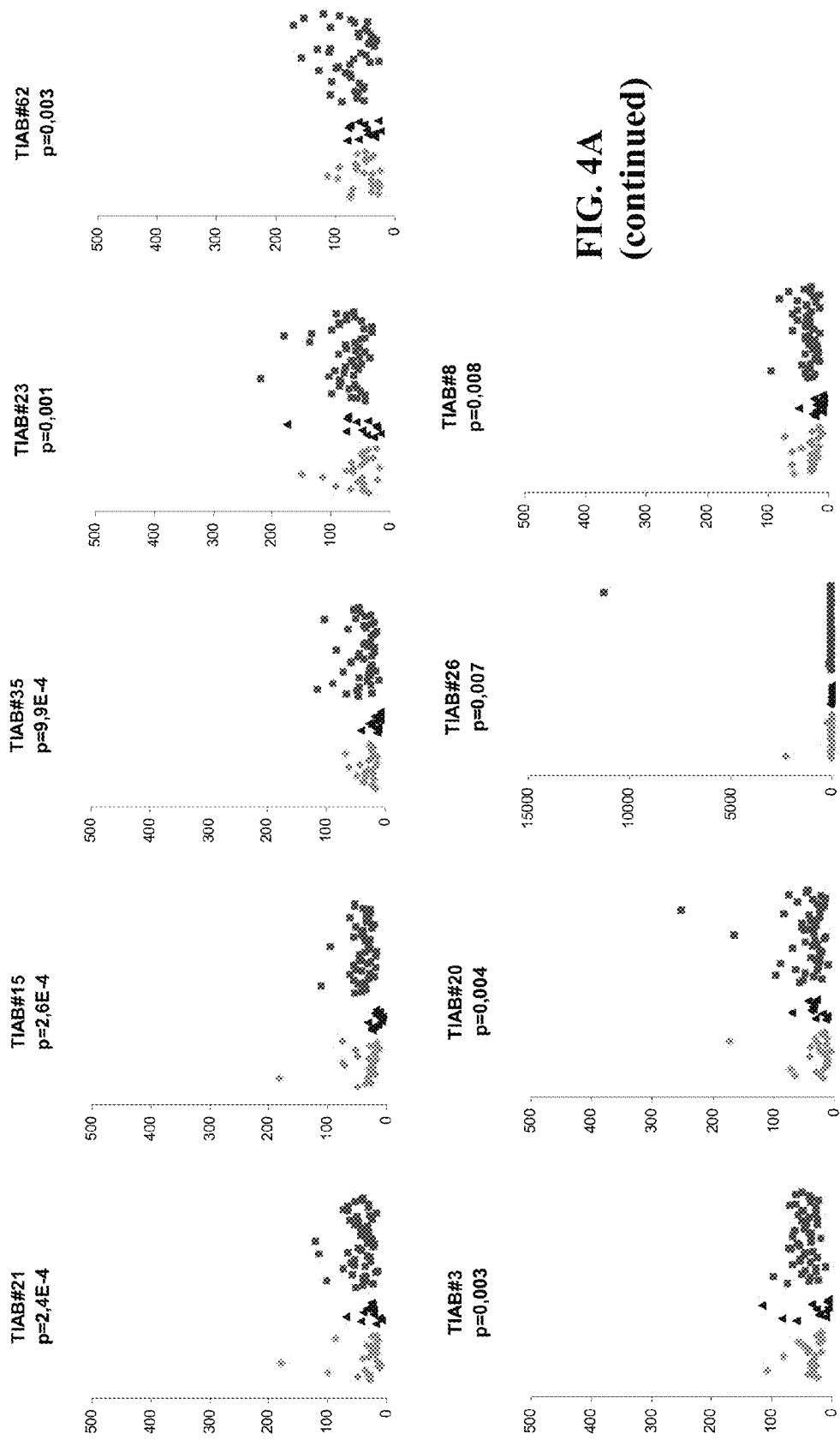
Figure 4A:
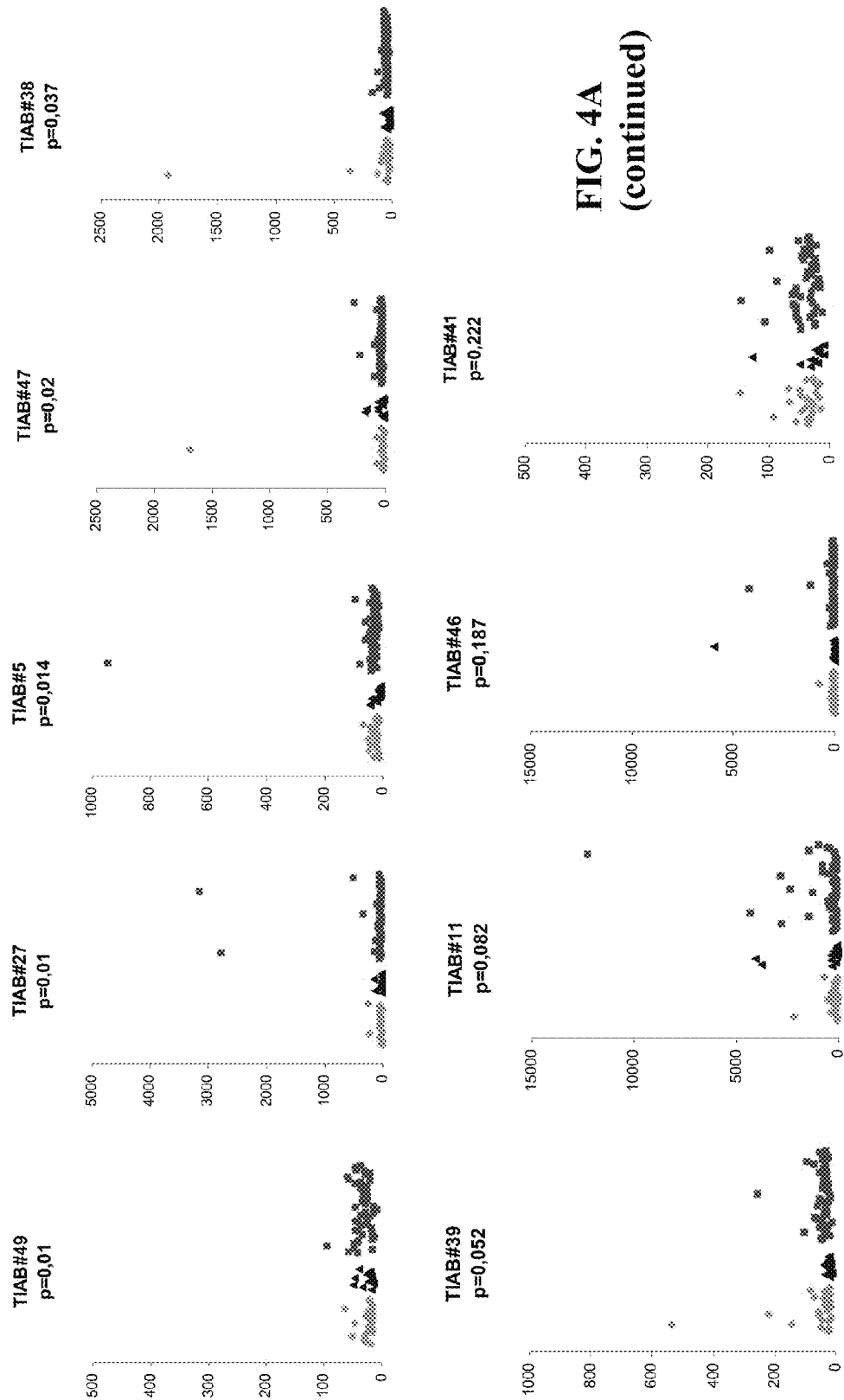

Blood samples were obtained from 25 healthy controls, 12 subjects with non cancer lung disease and, at the time of diagnosis, from 49 patients with different stages of NSCLC (Table 4, study II). These NSCLC patients were representative of the current status of this disease in France. In absence of reliable early stage testing procedures most of NSCLC were diagnosed with advanced diseases and only 20% were at early stage. The result of fluorescence intensity (FI) recorded for the 37 first PAPs of Table 5 for each patient and control are shown as FIG. 4A. Statistical significance of difference between groups was determined by Wilcoxon test, the results are indicated on each panel. It can be seen that the FI significantly increased in lung cancer patients compared to controls for 33 out of 37 PAP. P value of Wilcoxon tests ranged from $10^{-15}$ to $10^{-10}$ for 10 most discriminating PAP (FIG. 4B). PAP1 alone allows to perfectly discriminate controls and NSCLC (specificity=100% and sensitivity=100%).

Figure 5A:
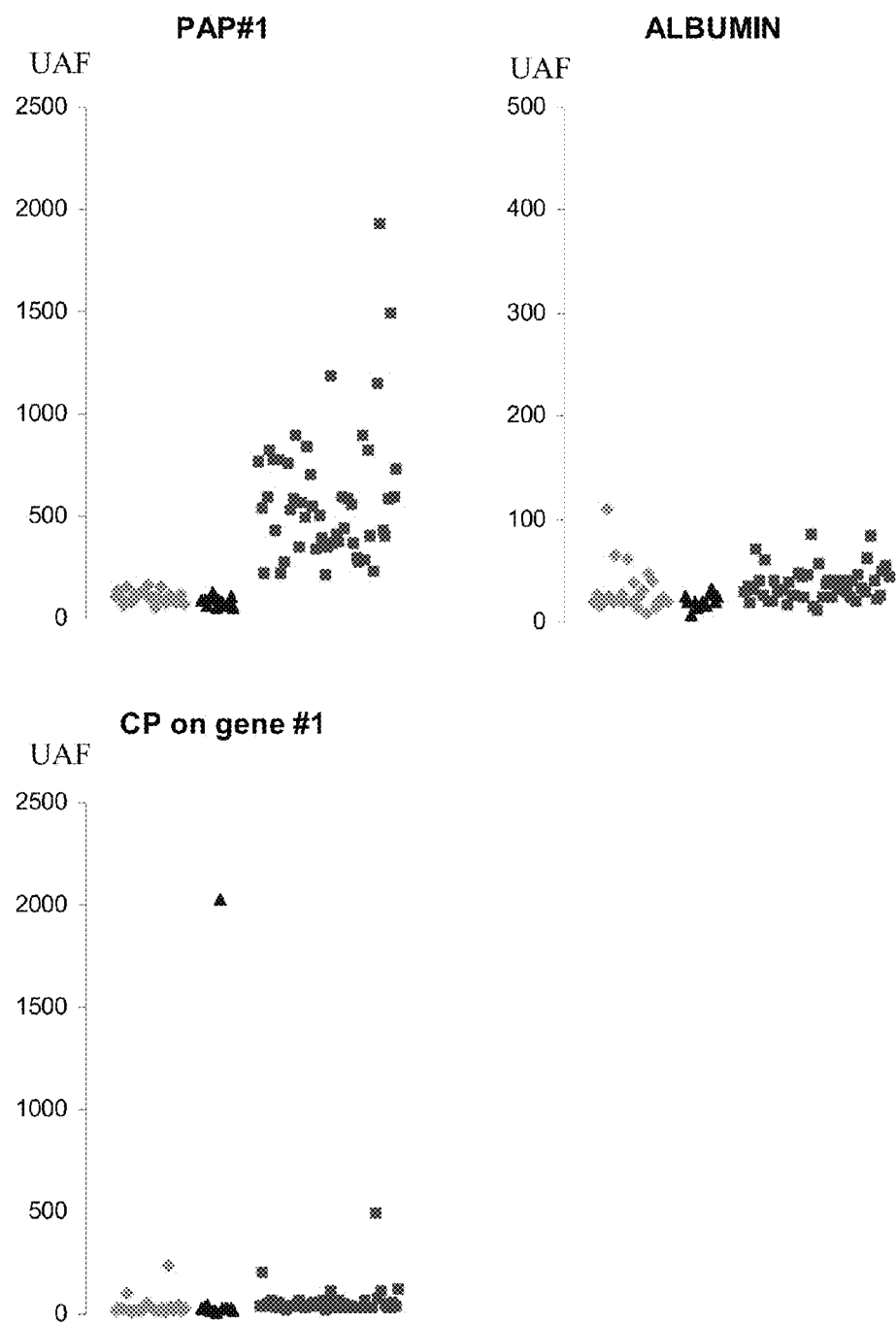
Figure 5B:
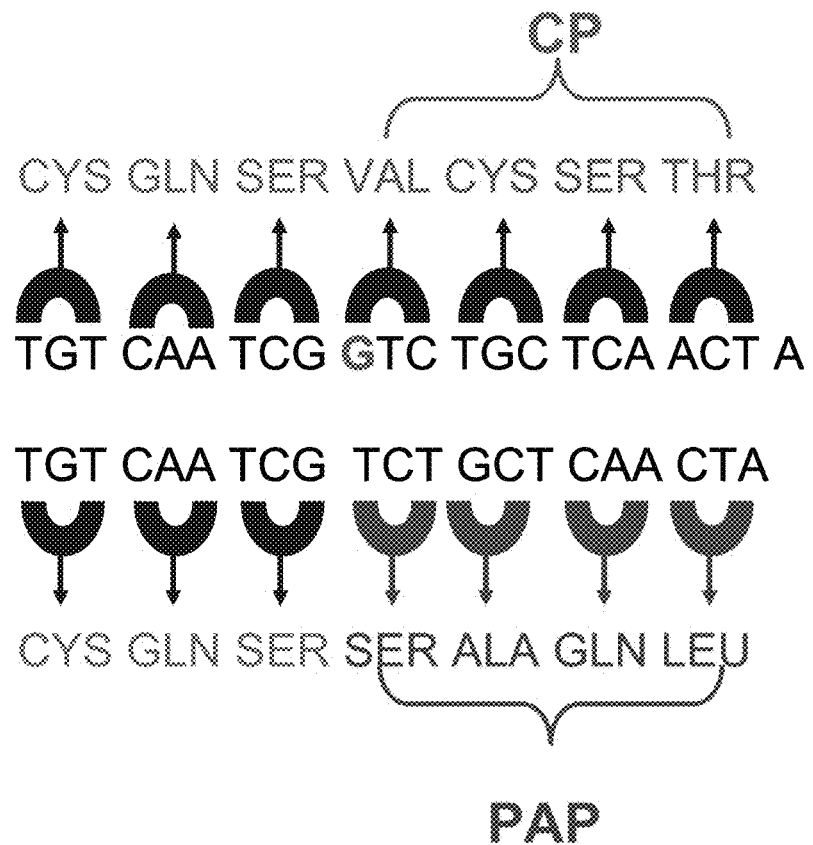
Figure 5C:
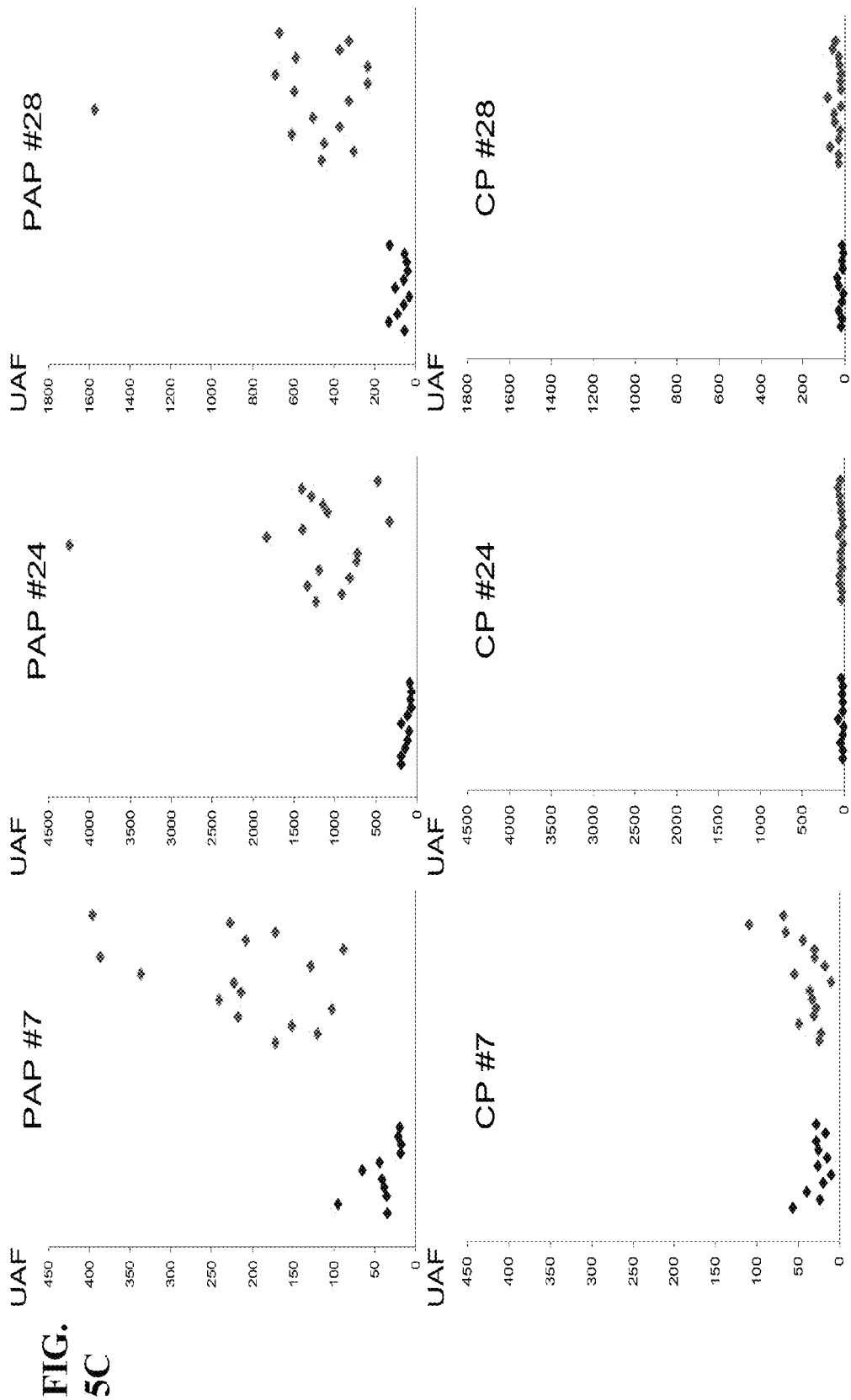

Thus the hypothesis that by-products of translation of aberrant mRNA with SBG contributed to modulate humoral immune response to NSCLC appeared valid. We verified this by testing that IgG binding to PAP was specific of their AA sequence. We thus measured the levels of IgG directed against albumin peptide, peptide corresponding to canonical reading of genome on gene 1 and 3 of the most discriminating PAP to those of IgG directed toward their corresponding canonical peptides (CP). These CPs are encoded by the same genes and segment encoding PAP (7, 24, 28), but their AA sequences were those derived from a canonical reading of the human genome i.e. without frame shift. The data show that in lung cancer patients the titers of Ig directed against CPs were much lower than those directed against PAP (FIG. 5) and that CPs did not discriminate between cases and controls (Wilcoxon NS).

TIAB Detection in Mice

Figure 6A:
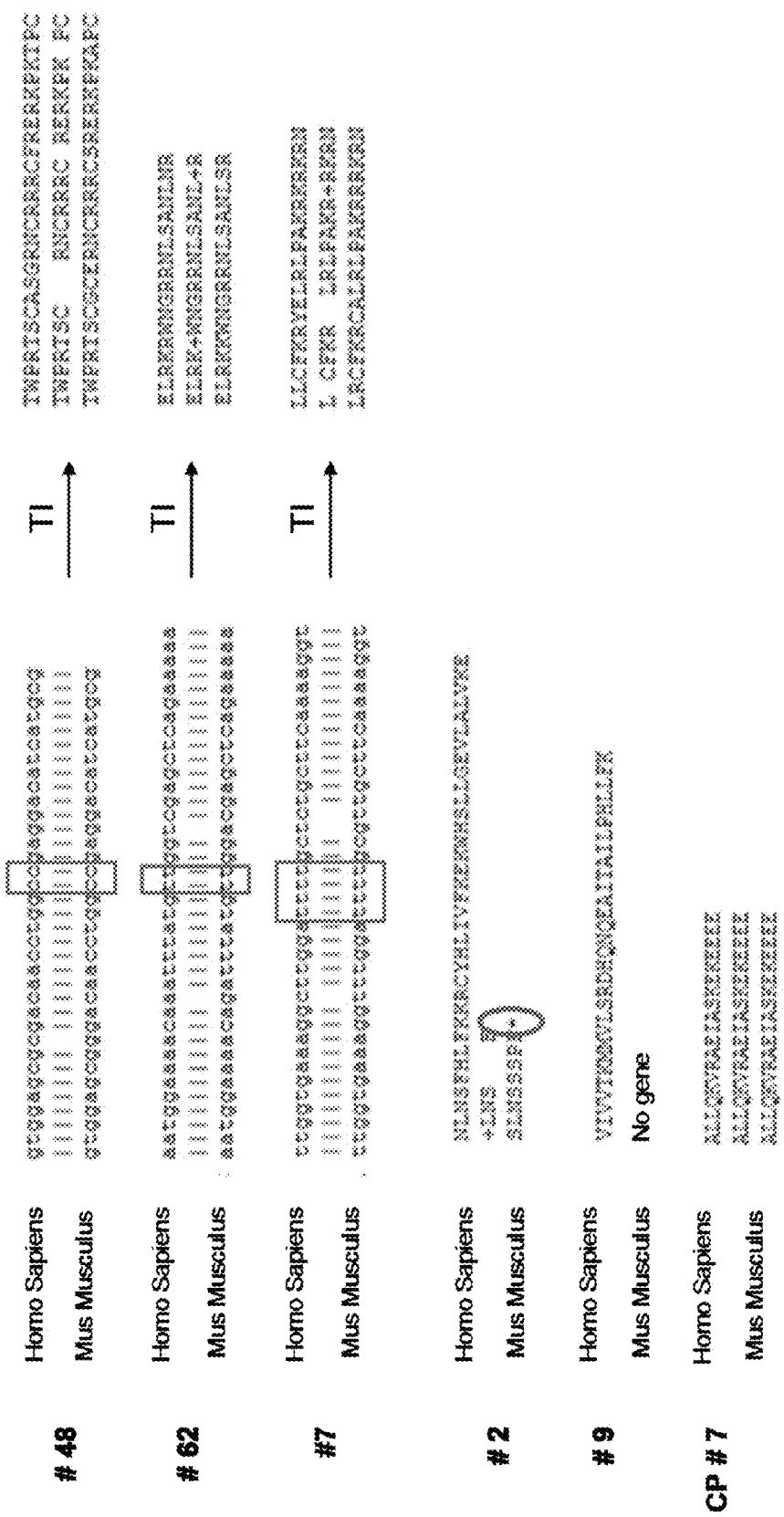
Figure 6B:
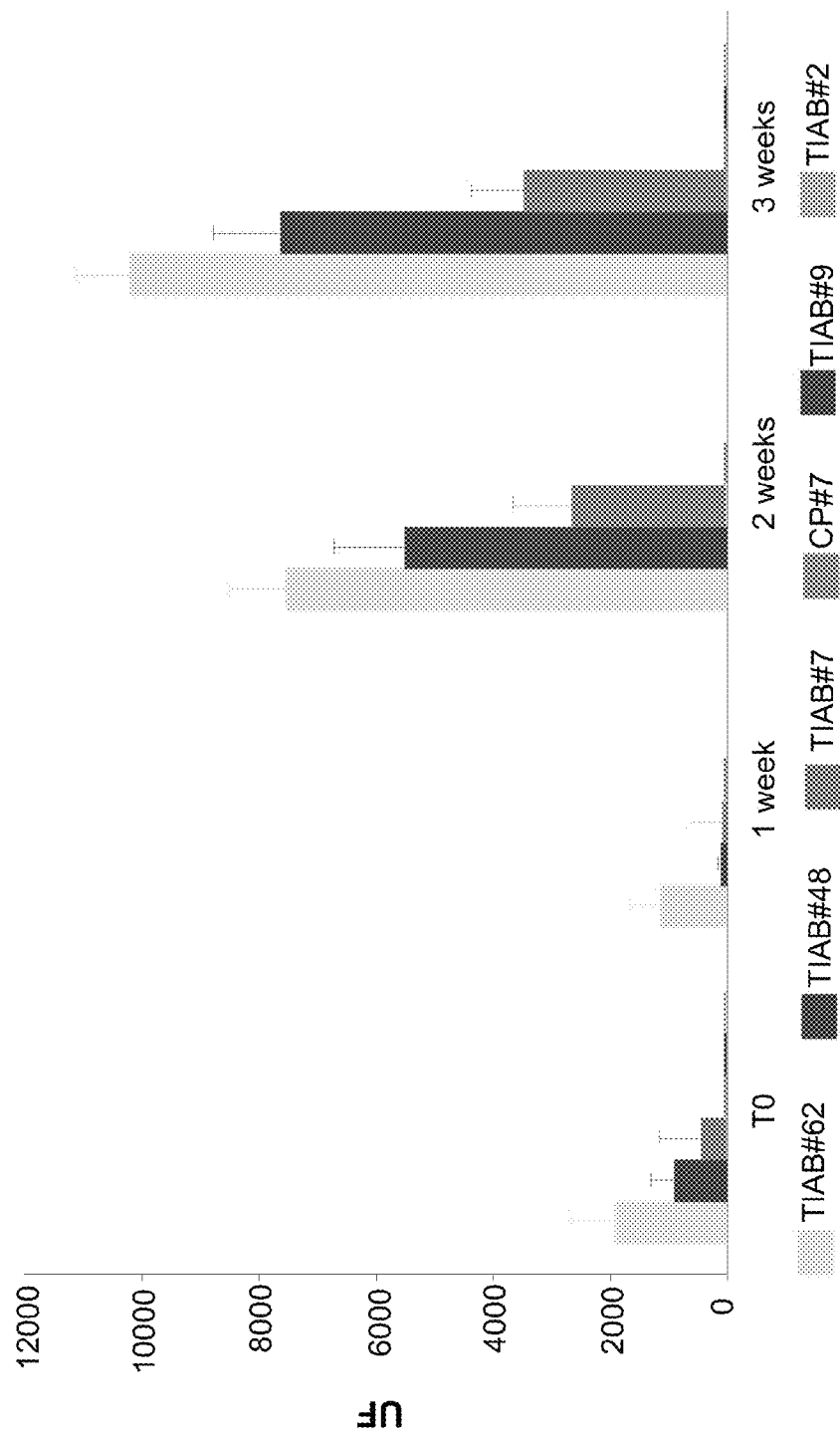

To extend the TIAB concept to other mammals and verify that TIAB detection is caused by cancer, we sought to transpose the observation to a mouse model. We first selected 5 PAP that effectively discriminated patients with NSCLC from controls. As shown in FIG. 6A, three of these are derived from genes highly conserved at the genomic level between mice and human. Most importantly the potentially affected bases were identical in both species this is also the case for the 4 bases upstream and the 2 downstream. We have previously shown the importance of this short DNA context allowing the occurrence of TI event[34]. The 2 other selected PAP were from genes not conserved between mice and human. The gene that can lead to PAP 9 is present in human but not murine genome. In mice, the occurrence of SBG at predicted position of the gene leading to translation of PAP 2 introduced a stop codon after encoding 7 AA. An additional negative control corresponding to CP of PAP 7 was also included. Immuno-competent (C57B16) mice (n=12) were inoculated subcutaneously with mice Lewis Lung Cancer (LLC1)[45,46]. Ig G binding to 5 PAP and one CP were measured before LLC1 transplantation and at weekly interval for up to 21 days. At this time, average tumor sizes were 3.15+/−0.4 cm$^3$. As shown in FIG. 6B, Ig G against PAP 7, PAP 48 and PAP 62 increased significantly 2 weeks after tumor implantation. P values of paired t-Test were $1*10^{-4}$, $3*10^{-4}$ $9*10^{-4}$ for PAP 7, PAP 48 and PAP 62 respectively. We did not observe significant increase of the level of IgG directed against CP7.

Materials and Methods

Cell Culture

The murine Lewis Lung carcinoma cell line (LLC1) was obtained from American Type Culture Collection (ATCC). The cells were cultured in 75 cm$^2$ flask containing RPMI 1640 medium (Invitrogen, France) supplemented with 10% FBS, streptomycin (0.1 mg/ml) and penicillin (100 units/ml) and maintained at 37° C. in humidified atmosphere containing 5% CO2 in air.

Tumor Transplantation

LLC1 tumor cells ($5*10^5$ cells in a 0.1 ml final volume of RPMI 1640) were injected subcutaneously (s.c.) in the right hindquarters area of 7 weeks C57b1/6 female mice (Janvier, France). 21 days after s.c. injection of LLC1 cells, the tumor volumes were measured by measuring bisecting diameters of each tumor and calculating using the formula $V=a^2*b*0.5236$ with "a" as the larger diameter and "b" as the smaller diameter. Before s.c. injection of the tumor cells, a 100 µl of sample blood was taken under isoflurane anaesthesia as the T0. Once a week, a sample of 100 µl blood was taken in EDTA tube under isoflurane anaesthesia as the T 7, 14 and 21 days.

Clinical Validation

Figure 7A:
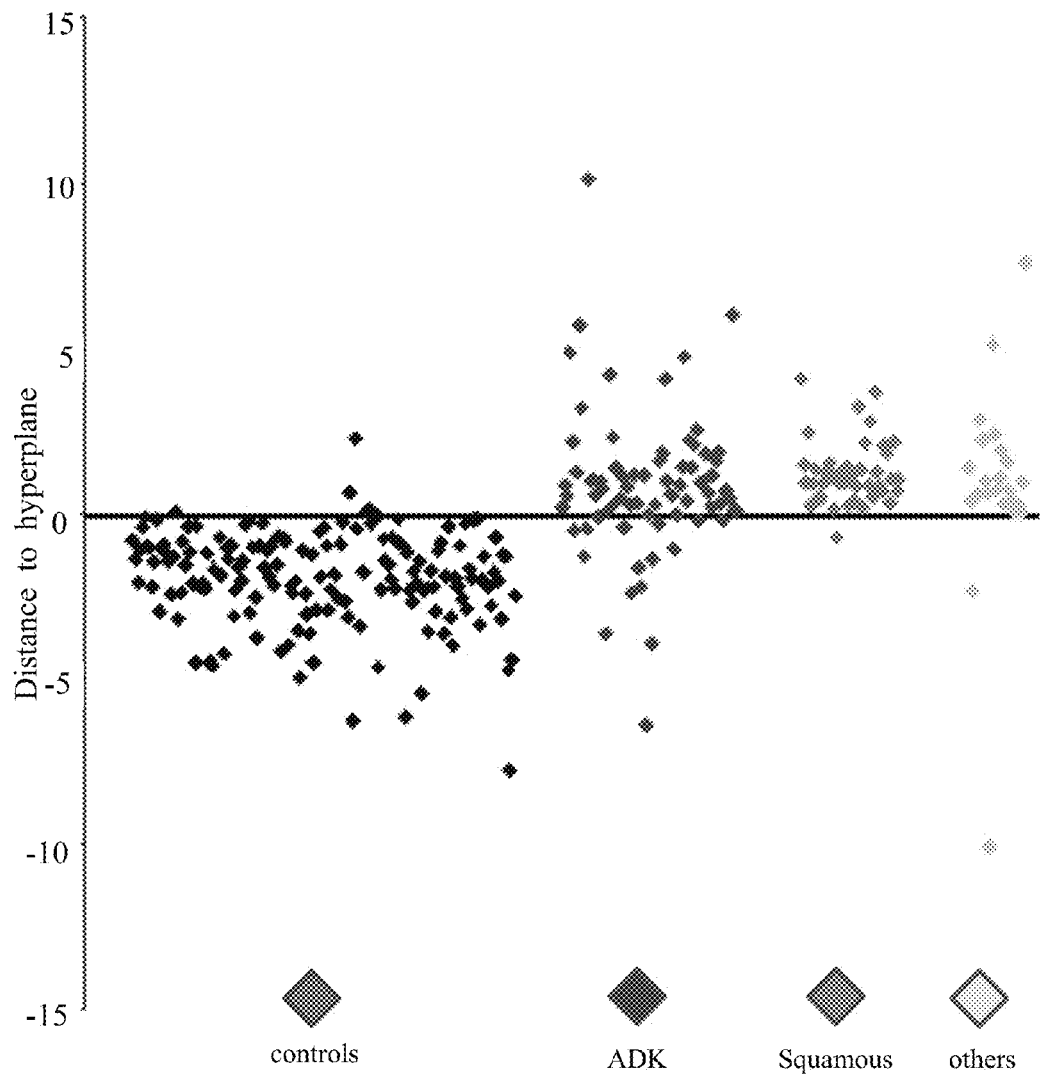
FIG. 7B shows percentage of lung cancer patients classified as positive according to their age.
FIG. 7C shows percentage of lung cancer patients classified as positive according to the histopathology of their disease.
FIG. 7D shows difference of distances to SVM hyperplane between lung cancer patients that are disease free 3 years after surgery and patients that are deceased or alive with recurrent cancer.
Figures 7B, 7C, 7D:
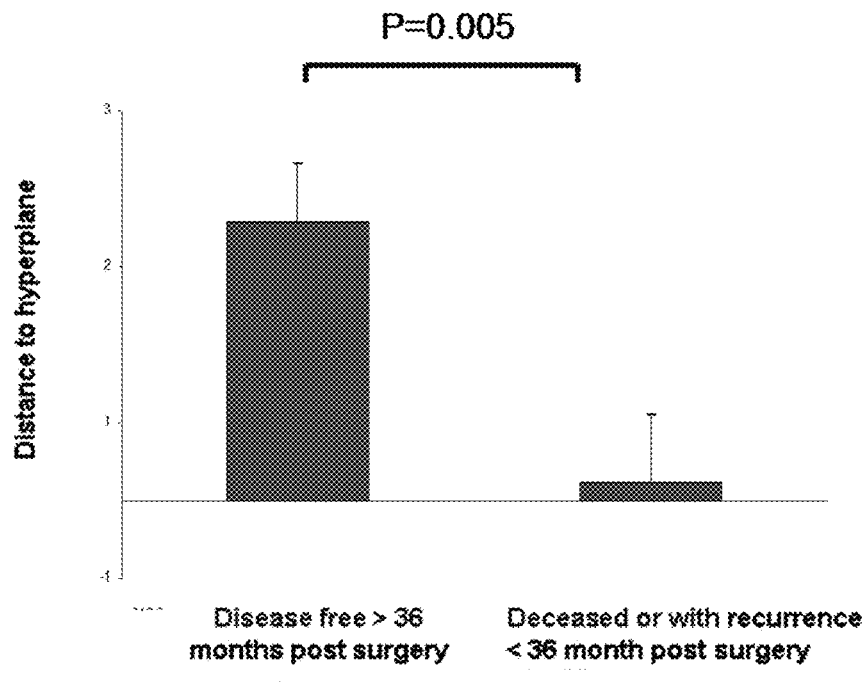

To validate the fact that a combination of PAP of the invention can lead to robust lung cancer diagnosis, we conducted large scale retrospective case control study that included 161 control subjects that were healthy blood donor with age ranging from 18 to 65 years old and that did not excluded smokers. The patients were 140 individuals with early stage non small cell lung cancer. Blood from these patients was collected at time of diagnosis. All patients in this group matched surgical intervention criteria and were thus early stage for the large majority. All patients in this group underwent surgery thus postoperative staging and pathological classification was obtained for all patients. It must be emphasized that patients in this group did not receive pre-operative chemotherapy or radiotherapy. The clinical characteristics of controls and patients are shown as table 4 study III. Patients and controls were tested for TIAB directed against 6 PAP measured under specific experimental conditions. Statistical analysis of the diagnostic value of this combination of markers was determined using support vector machine. SVM was retained after analyzing the performance of alternative classification methods. SVM defines a 6 dimensions hyperplane and provides a measure of individual distance of controls and patients to this hyperplane. The data are therefore presented as the relative distance to the hyperplane for each subject. It can be seen that the 2 populations of cancer patients and controls are well separated (FIG. 7A). The overall test performance was 86% sensitivity and 97% specificity. Only 5 controls are on the wrong side of hyperplane. And 19 patients with lung cancer are on the wrong side of hyperplane. After iterative cross validation sensitivity and specificity were 82% and 95% respectively. Sensitivity is not different between younger or elder patients (FIG. 7B). It can be seen from examination of the data that sensitivity of current test is lower for patients with adenocarcinomas that are diagnosed with 76% sensitivity in contrast test performance are >90% sensitivity for the other classes of non small cell carcinoma. These in test performance were statistically significant (FIG. 7C).

The benefit of surgery for lung cancer is well established. This benefit does not translate only in term of increased life expectancy but into definitive cure that is ascertained by the analysis of number of diagnosis and number of death. In France these numbers are ≈33000 new diagnosis and ≈28000 deaths. Thus it can be firmly ascertained that 5000 patients are cured from lung cancer i.e. 15%. All lung cancer survivors undergo surgical procedure but not all patients with lung cancer undergoing surgery are cured. Currently there is no procedure able to distinguish individuals that will benefit from alone surgery from those that will not. We thus sought to evaluate the performance of this test based on 6 PAP with respect to prediction of severity at the time of diagnosis. To achieve this we subdivided the studied population into 2 groups. In the first group are patients for whom we had documented evidence of disease free survival longer than 36 months. In the second group, patients were either deceased or with recurrence of the disease occurring within 36 months post surgery. We did not include patients for whom follow up was shorter than 36 months simply because the follow up time of these individuals was too short to ascertain outcome. We then compared the distance to the hyperplane for these 2 groups of patients that were of similar size. It is clear from the data of FIG. 7D that patients that strongly benefited from surgery and were disease free at 3 years had a distance to hyperplane significantly (P=0.005) longer than those that benefited less from surgery. This finding bears 2 immediate applications. First, it is likely that this test will identify patients with early stage lung cancer and that will most favourably benefit from surgery. Second appropriate alternative therapeutic intervention should be set in place for patients diagnosed with positive test but with a low distance to hyperplane. Such alternative measure may be conventional radio or chemotherapy. However our current interpretation of the data is that patients with low immunological response to the presence of a lung cancer are less likely to benefit from surgery alone. In this perspective it might be useful to pharmacologically boost their immunological response prior or shortly after surgery. We have therefore exemplified here the importance of PAP discovery as guide for future innovative therapeutic strategy.

We next sought to develop test that are lung cancer specific by testing various combinations of PAP under specific experimental condition. A novel combination of PAP achieved 100% specificity and 90% sensitivity for lung cancer versus controls. Most importantly when applied to patients with breast cancer only 3 out of 20 patients with breast cancer showed positive test. Thus in the comparison of lung versus breast cancer, 10 and 15% of patients are misclassified respectively. We considered that this rate of error will lead to unnecessary and costly downstream diagnosis procedure. The follow up diagnosis for lung cancer is chest CT scan while that of breast cancer is mammography or echography. Pet scan is useful for evaluation of disease extension. We thus developed specific tests able to more efficiently distinguish lung from breast cancer. Four combinations of PAP were found to achieve this objective. These combinations of markers are exemplified in FIG. 8B. In all 4 cases lung cancer patients are distinguished from breast cancer patients with one to three patients in overlap. The clinical significance of these combinations of markers is presented because their predictive value with respect to the severity of the disease requires further evaluation. We indeed predict that, similar to what has been exemplified for lung, a specific combination of PAP will reveal in large scale study predictive of clinical outcome for breast cancer. Before this can be achieved a specific breast cancer test is needed. We currently have identified a combination of 3 markers that under specific conditions identifies breast cancer from control with 60% sensitivity and 95% specificity (FIG. 8C). Our current view is that it will be possible to identify a combination of PAP that will indicate the presence of most common cancers at early stage from a simple blood test. Secondary combinations of PAP will provide accurate indication of the precise localisation of the disease thereby allowing the selection of adequate secondary diagnostic procedure e.g. CT scan, mammography, ultrasonography, fibroscopy, endoscopy, biopsies. A third line of PAP testing will provide prognostic for each individual response to surgical treatment and therefore indication as to the need of additional therapeutic measures. A fourth line of PAP will provide tools for monitoring of disease recurrence and/or its favourable response to treatment.

C—Discussion

We have identified a novel and predictable source of human cancer cell protein heterogeneity that triggers weak but diversified production of IgG. Accurate detection of these low titers specific IgG creates promising opportunities for early stage cancer diagnostic and can provide information regarding disease extension. This discovery stems from convergence of bioinformatic predictions with immunological detection of specific IgG directed toward aberrant peptides. Proteins containing PAP sequence can not be translated from normal human mRNA, but solely from mRNA that have lost their canonical genomic information due to single base gap.

Our data support the conclusion that predicted mRNAs with single gap are present in cancer cells and at least partially translated. Occurrence of identified EST gaps is too common to be generated by cancer somatic mutations[31,32]. Current estimates of cancer somatic mutation rate lead to a prediction of 12 deletions out of which 4 would be single gaps. Instead, we observed 2206 statistically significant events. Also, none of the selected gaps corresponded to either putative or biologically validated SNPs[44]. Thus, it is unlikely that mRNA gaps arose at the genomic level and must thus occur downstream, i.e., during or shortly after transcription.

It has been established that pre and mature mRNA bases can be modified by enzymes, but no known human mRNA editing enzymes have been shown to remove a single base from single stranded human RNA[47]. It has been shown that *Trypanosoma* mitochondrial mRNA editosome is capable of U specific deletion[48]. However, no homologs of *Trypanosoma* and *Leishmania* editosome proteins were found in the human genome. Further, this editing mechanism is U specific and cannot explain the observed 53% of human cancer non-U gaps. We have considered the possibility that slipping forward or backwards of splicing machinery could introduce single base gaps that would affect either exon's last or first base[49]. None of the tested gaps were located on such positions. Moreover, the latter mechanism was found unlikely because 99.2% of more than 2000 identified SBG were not within immediate exon-intron boundaries. Finally, it is clear that a short DNA context exerts a strong influence on the occurrence of cancer EST gaps similar to what was demonstrated for EST base substitutions[34,36,37]. We therefore currently hypothesize that skipping the incorporation of a single base by Pol II, i.e., TI is causing the occurrence of gapped mRNA.

We have further exemplified that mRNA with simple gap occurring at predicted position occur in cancer cell in absence of somatic or germinal mutation. Thus, the bioinformatic concept of transcription infidelity is biologically validated in human.

The second most important consequence of the finding reported here is that a canonical reading of the human genome is insufficient to explain cancer cell heterogeneity. We therefore propose that transcription infidelity increases in cancer cells. The evidence supporting this proposal are as follows. First, we have previously shown by DHPLC that cancer cells mRNAs are more heterogeneous than those isolated from normal cells[34]. Increased sequence variations in cancer versus normal mRNA is confirmed by independent studies relying on SAGE experiments. Second, analysis of all available human mRNA derived sequences showed statistically significant increase in base substitutions, insertions and gaps (SBG) in cancer relative to normal libraries. The occurrence of these events is $10^3$ more common than that of cancer somatic mutations. If present at the DNA level this rate of mutations would most likely be lethal. It is thus reasonable to assume that these variations occurred during or shortly after transcription and affect only pre and mature mRNA i.e. transient molecules. Third, there are currently no known molecular mechanisms other than TI that can either remove or add single base from mRNA and then reassemble the sequence. Thus, direct observation of predicted SBG occurring in human lung cancer cells in absence of mutation at the DNA level indicated that RNAP can skip the reading of a single DNA base and nevertheless proceed. Finally, studies from other groups showed that TI occurs in vivo even in absence of cancer. Specifically, in Brattleboro rat GA deletion occurring within GAGAG sequence reverts vasopressin transcript to normal thereby suppressing diabetes insipidus. Transcription frame shift affecting repetitive A sequence of (3 amyloid and ubiquitin B yield proteins that are detected by immunological staining of Alzheimer disease plaque.

We currently favor the hypothesis that increased cancer mRNA heterogeneity is a consequence rather than a cause of carcinogenesis. Indeed, we are detecting specific IgG directed against our current PAP panel in sera of children that developed anaplastic large cell lymphoma and that carry anaplastic lymphoma kinase (ALK) translocation (G Delsol and B Bihain, unpublished results)[50]. Rodent studies have demonstrated that translocation causing constitutive expression of this kinase is a primary oncogenic event that alone is sufficient to cause transformation[51]. Thus, detection of positive signals that reflect the production of abnormal mRNA encoding functionally non related genes—that are not part of this specific translocation—suggests that the phenomenon occurs as a consequence of this oncogenic lesion. However, it is possible that TI contributes to accelerate carcinogenesis. Indeed, several genes involved in the regulation of transcription, translation and DNA repair—not included in the current study because putative gene function was not part of the PAP selection process—are identified through bioinformatics with K gap. It is thus possible that we are confronted with an autocatalytic process that increases in diversity and intensity as the severity of the diseases progresses.

Bioinformatics indicated that the occurrence of SBG in mRNA is a common feature of cancers. Nevertheless, differences in IgG profiles were also found in lymphoma patients (N=27). PAP 1 and 2 that are commonly positive in NSCLC were negative in both follicular and anaplastic lymphoma patients. This contrasted with PAP 4 and 7 that were commonly positive in anaplastic large cell lymphoma but not in follicular lymphoma. Therefore, with the diversity (>than 2000 candidates) of the available panel of PAP we propose to design tumor specific PAP panels. We have exemplified this concept by demonstrating the capacity of PAP to effectively separate patients with lung cancer from those with breast cancer.

Our conclusion that mRNA with single base gap are translated at least partially into aberrant proteins suggests that in cancer cells the nonsense-mediated mRNA decay might be defective[52]. Considering current proteomic efforts, it is surprising that such highly diversified panel of aberrant proteins has remained thus far undetected. The explanation is 2 fold. 1) Protein identification by mass spectrometry relies on matching observed with predicted spectra defined by known or putative AA sequences[53]. The AA sequences of aberrant proteins resulting from mRNA gaps are not in the current protein databases (Swiss-Prot/TrEMBL[42]) and thus can not be identified by MS/MS analysis. 2) Proteasome rapidly degrades aberrant proteins yielding potentially aberrant immunogenic peptides[54].

The notion that TI increases in cancer leads to question the current strategy of cancer biomarkers discovery and to propose novel methods. Systematic cancer proteomic approaches led to conflicting results, divergences were attributed to variations in pre-analytical conditions. This might very well be the case, but an alternate explanation must now be considered. If one accepts that cancer cell protein heterogeneity largely exceeds current estimates, it becomes possible that sample sizes were insufficient to thoroughly probe a highly diversified repertoire of protein variants. Another limitation of current proteomic is that, as previously mentioned, mass spectrometry data are currently interpreted with a canonical reading of the human genome. Thus, proteins with aberrant AA sequences may have escaped proper identification. It is therefore likely that not only methodological but conceptual changes will be needed before cancer proteomic succeeds. By considering transcription infidelity according to the present invention, more reliable and relevant biomarkers can be identified.

We have shown in mouse cancer cells 3 aberrant proteins encoded by highly conserved but functionally unrelated genes. The most abundant aberrant protein in LLC1 was that derived from Poly(A)binding protein cytoplasmic 1 (PABPC1) (PAP 62). PABPC1 normally binds to mRNA poly A and modulates the nonsense-mediated decay (NMD) pathway that degrades mRNA with premature stop. Tethering of PABPC1 downstream of premature termination codon abolish NMD. The second most abundant aberrant protein in LLC1 was encoded by vimentin gene (VIM) (PAP 48). Vimentin is a type III intermediate filament protein that forms both homo and hereopolymeric structures contributing to support cellular membranes, to keep the nucleus and organelle in defined places as well as to associate with microtubule. The third most abundant aberrant protein was that encoded by the IK gene (PAP 7). IK normal function is that of a cytokine inhibiting interferon gamma induced expression of class II major histocompatibility complex. IK is also identified as chondrosarcoma associated protein 2. The consequences of the presence in cancer cells of these variants are currently unknown. However, the possibility of strong interferences with cancer cell biology must not be excluded and their contribution to cancer cell metabolic, morphological changes as well as mRNA heterogeneity will require further investigation. At this stage we have been able to establish that most of the PAP modulated humoral immune response to NSCL cancer in human and LLC1 in mice. We predict that production by cancer cells of these aberrant proteins might significantly alter cell function through dominant negative or positive effect. Thus, these three highly conserved genes might provide novel therapeutic targets.

Analysis of mice lung cancer model established a causal relationship between the presence of LLC1 and the detection of anti-PAP IgG. Thus anti-PAP IgGs appeared as part of a normal and timely immune response triggered by cancer. Interestingly in mice, the anti-PAP IgG levels were much higher (100 fold) than those measured in humans with lung cancer. The facts that the relative size of the lung tumor were also much greater in mice and that LLC1 were implanted ectopically in subcutaneous tissue provided possible explanations for these differences.

The present invention therefore describes a novel mechanism through which cancer modulates humoral immune response. At this stage we propose that a novel mechanism TI contributes to dramatic increase in the heterogeneity of cancer cell mRNA, part of these aberrant messages are translated into aberrant protein some of which accumulated in cancer cells and most of which modulated cancer humoral immune response. The present invention thus provides products and methods allowing to correctly differentiate patients with cancer from patients without active cancer. It is thus possible to elaborate systematic biochemical screening of at risk individuals, perform all body imaging on patients with positive tests, and increase the proportion of subjects diagnosed at early stage.

TABLE 1

Results of statistical testing

|  | K | LBE | N | LBE | K/N | (K − LBE)/(N − LBE) |
|---|---|---|---|---|---|---|
| Gaps | 2,761 | 11 | 216 | 144 | 12.78 | 38.19 |
| Gaps within ORF | 2,191 |  | 162 |  | 13.52 |  |
| Substitutions | 1,894 | 92 | 928 | 186 | 2.04 | 2.43 |

LBE refers to location based estimator of the false positive rate.

TABLE 2

Results of bioinformatics analysis

|  | Normal | Cancer |
|---|---|---|
| ESTs retrieved from NCBI | 3,949,323 | 3,043,498 |
| Number of transcripts with EST match | 34,974 | 34,788 |
| Number of transcripts with EST match | 33,111 | |
| Nucleotides analyzed | 88,372,747 | |
| Positions defined by >70 ESTs | 2,829,135 | |
| Positions matching statistical constraints | | |
| Substitutions | 5,784 | |
| Gaps | 3,790 | |

Results of analysis drawn after retrieval of all available human ESTs release to noncurated public database from January 2000 to July 2007. The table also shows the number of positions matching first (effective >70) and second statistical test criteria.

Table 3a: Nucleic and amino acid sequences of the 2206 gapTI peptides. SEQ ID NOs 1-2206 as referred to in this document represent the peptide sequences depicted in column 6 of Table 3a.

Table 3b: Nucleic and amino acid sequences of the 1128 insertion TI peptides. SEQ ID NOs 2207-3334 as referred to in this document represent the peptide sequences depicted in column 6 of Table 3b.

TABLE 3A

| SEQ ID | identifier_position | position | modified_RNA | PAP length | PAP |
|---|---|---|---|---|---|
| 1 | NM_002949.2_687 | 687 | GCTCGAATGCCCGGCAGCCGTGGCGGCTAGAGC GTTCCTCCCCAGCTCGAATGCCCGGCGGCCGAGG CGGCTAGAGCGTCGCCTCCTCCCGGGGAACCGC GTGTGACCTTCCAGCCCGCGGACCGATGCTGCCG GCGGCCGCTCGCCCCCTGTGGGGGCCTTGCCTTG GGCTTCGGGCCGCTGCGTTCCGCCTTGCCAGGCG ACAGGTGCCATGTGTCTGTGCCGTGCGACATATGA GGAGCAGCGGCCATCAGAGGTGTGAGGCCCTCG CTGGTGCACCCCTGGATAACGCCCCCAAGGAGTA CCCCCCCAAGATACAGCAGCTGGTCCAGGACATC GCCAGCCTCACTCTCTTGGAAATCTCAGACCTCAA CGAGCTCCTGAAGAAAACGTTGAAGATCCAGGAT GTCGGGCTTGTGCCGATGGGTGGTGTGATGTCTG GGGCTGTCCCTGCTGCAGCAGCCCAGGAGGCGG TGGAAGAAGATATCCCCATAGCGAAAGAACGGAC ACATTTCACCGTCCGCCTGACCGAGGCGAAGCCC GTGGACAAAGTGAAGCTGATCAAGGAAATCAAGAA CTACATCCAAGGCATCAACCTCGTCCAGGCAAAGA AGCTGGTGGAGTCCCTGCCCCAGGAAATCAAAGC CAATGTCGCCAAAGCTGAGGCGGAGAAGATCAAG GCGGCCTGGAGGCGGTGGGCGGCACCGTGGTTC TGGAGTAGCCTCCAGCTCGGAGGACTTGTGTTCA GGGGTCCTGGGCCCCGGGCGAGGTCCCGCCCTC CCGTGGTCACTGGCTCCGCCCCCAGCACCAGGCG CCCAGTGGAGCCGTTTGGGAGAATTGCCTGCGCC ACGCAGCGGGGCCGGACAGGCCGCACAGACCTA CTGTGGCGGGAGGGAGGGGCGGCTGCTGCCTGG TGACGGCACCCGGAGGCCCACCAGGACGCGCCA CCGGTGAATGTGCCTCTGGTGGCTGCTGAGAAAA ATACACTGTGCAGCTCAGAAAAAAAAAAAAAAAAAA AAAAAAAA | 30 | WRRWAAP WFWSSLQ LGGLVFRG PGPRARS R* |
| 2 | NM_001359.1_257 | 257 | ACGCCGCCTGGGTCCCAGTCCCCGTCCCATCCCC CGGCGGCCTAGGCAGCGTTTCCAGCCCCGAGAAC TTTGTTCTTTTTGTCCCGCCCCCTGCGCCCAACCG CCTGCGCCGCCTTCCGGCCCGAGTTCTGGAGACT CAACATGAAGCTACCGGCCAGGGTTTTCTTTACTC TGGGGTCCCGGCTGCCCTGTGGCCTCGCTCCTCG GAGGTTTTTCAGTTATGGGACAAAAATATTATATCA AAACACTGAAGCTTGCAATCTAAATTCTTTTCACCT CTTCAAAAAAGCGATGCTACCACCTAATAGTTTTCAA GGAAAAGTGGCATTCATTACTGGGGGAGGTACTG GCCTTGGTAAAGGAATGACAACTCTTCTGTCCAGC CTAGGTGCTCAGTGCGTGATAGCCAGCCGGAAGA TGGATGTTTTGAAAGCTACCGCAGAACAAATTTCTT CTCAAAACTGGAAATAAGGTTCATGCAATTCAGTGT GATGTGAGGGATCCTGATATGGTTCAAAACACTGT GTCAGAACTGATCAAAGTTGCAGGACATCCTAATA TTGTGATAAACAATGCAGCAGGGAATTTTATTTCTC CTACTGAAAGACTTTCTCCTAATGCTTGGAAAACC ATAACTGACATAGTTCTAAATGGCACAGCCTTCGT GACACTAGAAATTGGAAAACAACTAATTAAAGCAC AGAAAGGAGCAGCATTTCTTTCTATTACTACTATCT ATGCTGAGACTGGTTCAGGTTTTGTAGTACCAAGT GCTTCTGCCAAAGCAGGTGTGGAAGCCATGAGCA AGTCTCTTGCAGCTGAATGGGGTAAATATGGAATG CGATTCAATGTGATTCAACCAGGGCCTATAAAAAC CAAAGGTGCCTTTAGCCGTCTGGACCCAACTGGA ACATTTGAGAAAGAAATGATTGGCAGAATTCCCTG TGGTCGCCTGGGGACTGTAGAAGAACTCGCAAAT CTTGCTGCTTTCCTTTGTAGTGATTATGCTTCTTGG ATTAATGGAGC | 36 | NLNSFHLF KKRCYHLI VFKEKWH SLLGEVLA LVKE* |
| 3 | NM_184041.1_602 | 602 | GTGGTGCCTTTAAAAGGCCGGGCGCCGCCTTCCG CCTGCCCGCCTCCTGCGCCGCCCCTTCCGAGGCT AAATCGGCTGCGTTCCTCTCGGAACGCGCCGCAG AAGGGGTCCTGGTGACGAGTCCCGCGTTCTCTCC TTGAATCCACTCGCCAGCCCGCCGCCCTCTGCCG CCGCACCCTGCACACCCGCCCCTCTCCTGTGCCA | 26 | GWMGCLS AVPSTRRT ELTSPSGV VC* |

TABLE 3A-continued

| SEQ ID | identifier_ position | position | modified_RNA | PAP length | PAP |
|---|---|---|---|---|---|
| | | | GGAACTTGCTACTACCAGCACCATGCCCTACCAAT ATCCAGCACTGACCCCGGAGCAGAAGAAGGAGCT GTCTGACATCGCTCACCGCATCGTGGCACCTGGC AAGGGCATCCTGGCTGCAGATGAGTCCACTGGGA GCATTGCCAAGCGGCTGCAGTCCATTGGCACCGA GAACACCGAGGAGAACCGGCGCTTCTACCGCCAG CTGCTGCTGACAGCTGACGACCGCGTGAACCCCT GCATTGGGGGTGTCATCCTCTTCCATGAGACACTC TACCAGAAGGCGGATGATGGGCGTCCCTTCCCCC AAGTTATCAAATCCAAGGGCGGTGTTGTGGGCATC AAGGTAGACAAGGGCGTGGTCCCCCTGGCAGGGA CAAATGGCGAGACTACCACCAAGGGTTGGATGGG CTGTCTGAGCGCTGTGCCCAGTACAAGAAGGACG GAGCTGACTTCGCCAAGTGGCGTTGTGTGCTGAA GATTGGGGAACACACCCCCTCAGCCCTCGCCATC ATGGAAAATGCCAATGTTCTGGCCCGTTATGCCAG TATCTGCCAGCAGAATGGCATTGTGCCCATCGTGG AGCCTGAGATCCTCCCTGATGGGGACCATGACTT GAAGCGCTGCCAGTATGTGACCGAGAAGGTGCTG GCTGCTGTCTACAAGGCTCTGAGTGACCACCACAT CTACCTGGAAGGCACCTTGCTGAAGCCCAACATG GTCACCCCAGGCCATGCTTGCACTCAGAAGTTTTC TCATGAGGAGATTGCCATGGCGACCGTCACAGCG CTGCGCCGCACAGTGCCCCCCGCTGTCACTG | | |
| 4 | NM_0018 61.2_549 | 549 | CGACGTTCGCAGCGCTACCCTTTTCCGCTCCACG GTGACCTCCGTGCGGCCGGGTGCGGCGGAGTC TTCCTCGATCCCGTGGTGCTCCGCGGCGCGGCCT TGCTCTCTTCCGGTCGCGGGACACCGGGTGTAGA GGGCGGTCGCGGCGGGCAGTGGCGGCAGAATGT TGGCTACCAGGGTATTTAGCCTAGTTGGCAAGCGA GCAATTTCCACCTCTGTGTGTGTACGAGCTCATGA AAGTGTTGTGAAGAGCGAAGACTTTTCGCTCCCAG CTTATATGGATCGGCGTGACCACCCCTTGCCGGA GGTGGCCCATGTCAAGCACCTGTCTGCCAGCCAG AAGGCACTGAAGGAGAAGGAGAAGGCCTCCTGGA GCAGCCTCTCCATGGATGAGAAAGTCGAGTTGTAT CGCATTAAGTTCAAGGAGAGCTTTGCTGAGATGAA CAGGGGGCTCGAACGAGTGGAAGACGGTTGTGGG CGGTGCCATGTTCTTCATCGGTTTCACCGCGCTCG TTATCATGTGGCAGAAGCACTATGTGTACGGCCCC TCCCGCAAAGCTTTGACAAAGAGTGGGTGGCCAA GCAGACCAAGAGGATGCTGGACATGAAGGTGAAC CCCATCCAGGGCTTAGCCTCCAAGTGGGACTACG AAAAGAACGAGTGGAAGAAGTGAGAGATGCTGGC CTGCGCCTGCACCTGCGCCTGGCTCTGTCACCGC CATGCAACTCCATGCCTATTTACTGGAAACCTGTTA TGCCAAACAGTTGTACCACTGCTAATAAATGACCA GTTTACCTGAAA | 19 | RKALTKSG WPSRPRG CWT* |
| 5 | NM_0003 65.4_149 | 149 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTGTGCTCCCCCTACTGCCTATAT CGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTTCGAGCAGACAAAGGTCATC GCAGATAACGTGAAGGACTGGAGCAAGGTCGTCC TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC | 14 | LPLLPISTS PGRS* |

TABLE 3A-continued

| SEQ ID | identifier_position | position | modified_RNA | PAP length | PAP |
|---|---|---|---|---|---|
| 6 | NM_0014 28.2_548 | 548 | TTCTCCACTTACTATAATGGTTGGAACTAAACGTCA CCAAGGTGGCTTCTCCTTGGCTGAGAG TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG AGAAGATTGACAAACTGATGATCGAGATGGATGGA ACAGAAAATAAATCTAAGTTTGGTGCGAACGCCAT TCTGGGGGTGTCCCTTGCCGTCTGCAAAGCTGGT GCCGTTGAGAAGGGGGTCCCCCTGTACCGCACAT CGCTGACTTGGCTGGCAACTCTGAAGTCATCCTGC CAGTCCCGGCGTTCAATGTCATCAATGGCGGTTCT CATGCTGGCAACAAGCTGGCCATGCAGGAGTTCA TGATCCTCCCAGTCGGTGCAGCAAACTTCAGGGA AGCCATGCGCATTGGAGCAGAGGTTTACCACAAC CTGAAGAATGTCATCAAGGAGAAATATGGGAAAGA TGCCACCAATGTGGGGGATGAAGGCGGGTTTGCT CCCAACATCCTGGAGAATAAAGAAGGCCTGGAGC TGCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 29 | SLTWLATL KSSCQSR RSMSSMA VLMLATSW* |
| 7 | NM_0060 83.3_614 | 614 | ACGCAAAGCAGTGTGGGTTGATTCTGAGGTGCAC TGTGGGAAAGAGCTTGTCGCTGCGGTGTTGCTGTT GGGAGACTCGATTGTTGGTGACAGCGAAAGAACGA TAACAAAATGCCGGAGCGAGATAGTGAGCCGTTCT CCAACCCTTTGGCCCCCGATGGCCACGATGTGGA TGATCCTCACTCCTTCCACCAATCAAAACTCACCA ATGAAGACTTCAGGAAACTTCTCATGACCCCCAGG GCTGCACCTACCTCTGCACCACCTTCTAAGTCACG TCACCATGAGATGCCAAGGGAGTACAATGAGGAT GAAGACCCAGCTGCACGAAGGAGGAAAAAGAAAA GTTATTATGCCAAGCTACGCCAACAAGAAATTGAG AGAGAGAGAGAGCTAGCAGAGAAGTACCGGGATC GTGCCAAGGAACGGAGAGATGGAGTGAACAAAGA TTATGAAGAAACCGAGCTTATCAGCACCACAGCTA ACTATAGGGCTGTTGGCCCCACTGCTGAGGCGGA CAAATCAGCTGCAGAGAAGAGAAGACAGTTGATCC AGGAGTCCAAATTCTTGGGTGGTGACATGGAACAC ACCCATTTGGTGAAAGGCTTGGATTTGCTCTGCTT CAAAAGGTACGAGCTGAGATTGCCAGCAAAGAGA AAGAGGAAGAGGAACTGATGGAAAAGCCCCAGAA AGAAACCAAGAAAGATGAGGATCCTGAAAATAAAA TTGAATTTAAAACACGTCTGGGCCGCAATGTTTAC CGAATGCTTTTAAGAGCAAAGCATATGAGCGGAA TGAGTTGTTCCTGCCGGGCCGCATGGCCTATGTG GTAGACCTGGATGATGAGTATGCTGACACAGATAT CCCCACCACTCTTATCCGCAGCAAGGCTGATTGCC CCACCATGGAGGCCCAGACCACACTGACCACAAA TGACATTGTCATTAGCAAGCTGACCCAGATCCTTT CATACCTGAGGCAGGGAACCCGTAACAAGAAGCT TAAGAAGAAGGATAAAGGGAAG | 20 | LCFKRYEL RLPAKRKR KRN* |
| 8 | NM_0002 39.1_78 | 78 | CTAGCACTCTGACCTAGCAGTCAACATGAAGGCTC TCATTGTTCTGGGGCTTGTCCTCCTTTCTGTTACG GTCCAGGCAAGGTCTTTGAAAGGTGTGAGTTGGC CAGAACTCTGAAAAGATTGGGAATGGATGGCTACA GGGGAATCAGCCTAGCAAACTGGATGTGTTTGGC CAAATGGGAGAGTGGTTACAACACACGAGCTACAA ACTACAATGCTGGAGACAGAAGCACTGATTATGGG ATATTTCAGATCAATAGCCGCTACTGGTGTAATGAT GGCAAAACCCCAGGAGCAGTTAATGCCTGTCATTT ATCCTGCAGTGCTTTGCTGCAAGATAACATCGCTG ATGCTGTAGCTTGTGCAAAGAGGGTTGTCCGTGAT CCACAAGGCATTAGAGCATGGGTGGCATGGAGAA ATCGTTGTCAAAACAGAGATGTCCGTCAGTATGTT CAAGGTTGTGGAGTGTAACTCCAGAATTTTCCTTC TTCAGCTCATTTTGTCTCTCTCACATTAAGGGAGTA GGAATTAAGTGAAAGGTCACACTACCATTATTTCC | 12 | ARSLKGVS WPEL* |

TABLE 3A-continued

| SEQ ID | identifier_position | position | modified_RNA | PAP length | PAP |
|---|---|---|---|---|---|
| | | | CCTTCAAACAAATAATATTTTTACAGAAGCAGGAGC<br>AAAATATGGCCTTTCTTCTAAGAGATATAATGTTCA<br>CTAATGTGGTTATTTTACATTAAGCCTACAACATTT<br>TTCAGTTTGCAAATAGAACTAATACTGGTGAAAATT<br>TACCTAAAACCTTGGTTATCAAATACATCTCCAGTA<br>CATTCCGTTCTTTTTTTTTTTGAGACAGTCTCGCT<br>CTGTCGCCCAGGCTGGAGTGCAGTGGCGCAATCT<br>CGGCTCACTGCAACCTCCACCTCCCGGGTTCACG<br>CCATTCTCCTGCCTCAGCCTCCCGAGTAGCTGGG<br>ATTACGGGCGCCCGCCACCACGCCCGGCTAATTT<br>TTTGTATTTTTAGTAGAGACAGGGTTTCACCGTGTT<br>AGCCAGGATGGTCTCGATCTCCTGACCTTGTGATC<br>CACCCACCTCGGCCTCCCAAAGTGCTGGGATTAC<br>AGGCGTGA | | |
| 9 | NM_0072<br>44.2_215 | 215 | CAACGCAGAGTTGGGAGCAACTCCAGAGCCTCCT<br>TCAAGATGCTGCTGGTCCTGCTCTCAGTGGTCCTT<br>CTGGCTCTGAGCTCAGCTCAGAGCACAGATAATGA<br>TGTGAACTATGAAGACTTTACTTTCACCATACCAGA<br>TGTAGAGGACTCAAGTCAGAGACCAGATCAGGGA<br>CCCCAGAGACCTCCTCCTGAAGGACTCCTACCTA<br>GACCCCTGGTGATAGTGGTAACCAAGATGATGGT<br>CCTCAGCAGAGACCACCAAAACCAGGAGGCCATC<br>ACCGCCATCCTCCCCCACCTCCTTTTCAAAATCAG<br>CAACGACCACCCCGACGAGGACACCGTCAACTCT<br>CTCTACCCCGATTTCCTTCTGTCAGCCTGCAGGAA<br>GCATCATCATTCTTCCAGAGGGACAGACCAGCAAG<br>ACATCCCCAGGAGCAACCACTCTGGTAATCTAGAA<br>TTCAGTGGCAGAAAATAAATAAGAAGATAACTTCCT<br>TCAGAAAGCCATGACATTGAAATAATGTGGTCATA<br>ACTCTTTCTTCAGTATACCAATAAAATATTAATAGC<br>ATGCAAAAAAAAAAAAAAAAAAAAAA | 30 | FKISNDHP<br>NEDTVNSL<br>YPDFLLSA<br>CRKHHH |
| 10 | NM_0319<br>66.2_539 | 539 | ACGAACAGGCCAATAAGGAGGGAGCAGTGCGGG<br>GTTTAAATCTGAGGCTAGGCTGGCTCTTCTCGGCG<br>TGCTGCGGCGGAACGGCTGTTGGTTTCTGCTGGG<br>TGTAGGTCCTTGGCTGGTCGGGCCTCCGGTGTTC<br>TGCTTCTCCCCGCTGAGCTGCTGCCTGGTGAAGA<br>GGAAGCCATGGCGCTCCGAGTCACCAGGAACTCG<br>AAAATTAATGCTGAAAATAAGGCGAAGATCAACAT<br>GGCAGGCGCAAAGCGCGTTCCTACGGCCCCTGCT<br>GCAACCTCCAAGCCCGGACTGAGGCCAAGAACAG<br>CTCTTGGGGACATTGGTAACAAAGTCAGTGAACAA<br>CTGCAGGCCAAAATGCCTATGAAGAAGGAAGCAA<br>AACCTTCAGCTACTGGAAAAGTCATTGATAAAAAA<br>CTACCAAAAACCTCTTGAAAAGGTACCTATGCTGGT<br>GCCAGTGCCAGTGTCTGAGCCAGTGCCAGAGCCA<br>GAACCTGAGCCAGAACCTGAGCCTGTTAAAGAAG<br>AAAAACTTTCGCCTGAGCCTATTTGGTTGATACTG<br>CCTCTCCAAGCCCAATGGAAACATCTGGATGTGCC<br>CCTGCAGAAGAAGACCTGTGTCAGGCTTTCTCTGA<br>TGTAATTCTTGCAGTAAATGATGTGGATGCAGAAG<br>ATGGAGCTGATCCAAACCTTTGTAGTGAATATGTG<br>AAAGATATTTATGCTTATCTGAGACAACTTGAGGAA<br>GAGCAAGCAGTCAGACCAAAATACCTACTGGGTC<br>GGGAAGTCACTGGAAACATGAGAGCCATCCTAATT<br>GACTGGCTAGTACAGGTTCAAATGAAATTCAGGTT<br>GTTGCAGGAGACCATGTACATGACTGTCTCCATTA<br>TTGATCGGTTCATGCAGAATAATTGTGTGCCCAAG<br>AAGATGCTGCAGCTGGTTGGTGTCACTGCCATGTT<br>TATTGCAAGCAAATATGAAGAAATGTACCCTCCAG<br>AAATTGGTGACTTTGCTTTTGTGACTGACAACACTT<br>ATACTAAGCACCAAATCAG | 28 | LILPLQAQ<br>WKHLDVPL<br>QKKTCVRL<br>SLM* |
| 11 | NM_0018<br>78.2_537 | 537 | AGCTTTGGGGTTGTCCCTGGACTTGTCTTGGTTCC<br>AGAACCTGACGACCCGGCGACGGCGACGTCTCTT<br>TTGACTAAAAGACAGTGTCCAGTGCTCCAGCCTAG<br>GAGTCTACGGGGACCGCCTCCCGCGCCGCCACC<br>ATGCCCAACTTCTCTGGCAACTGGAAAATCATCCG<br>ATCGGAAAACTTCGAGGAATTGCTCAAAGTGCTGG<br>GGGTGAATGTGATGCTGAGGAAGATTGCTGTGGC<br>TGCAGCGTCCAAGCCAGCAGTGGAGATCAAACAG<br>GAGGGAGACACTTTCTACATCAAAACCTCCACCAC<br>CGTGCGCACCACAGAGATTAACTTCAAGGTTGGG<br>GAGGAGTTTGAGGAGCAGACTGTGGATGGGAGGC<br>CCTGTAAGAGCCTGGTGAAATGGGAGAGTGAGAA<br>TAAAAATGGTCTGTGAGCAGAAGCTCCTGAAGGGA<br>GAGGGCCCCAAGACCTCGTGGACCAGAGAACTGA<br>CCAACGATGGGGAACTGATCCTGACCATGACGGC<br>GGATGACGTTGTGTGCACCAGGTCTACGTCCGAG | 37 | STSESEWP<br>QVEPRPKP<br>TTGHANRP<br>ASLPPPSH<br>PLLLG* |

TABLE 3A-continued

| SEQ ID | identifier_ position | position | modified_RNA | PAP length | PAP |
|---|---|---|---|---|---|
| | | | AGTGAGTGGCCACAGGTAGAACCGCGGCCGAAGC CCACCACTGGCCATGCTCACCGCCCTGCTTCACT GCCCCCTCCGTCCCACCCCCTCCTTCTAGGATAG CGCTCCCCTTACCCCAGTCACTTCTGGGGGTCACT GGGATGCCTCTTGCAGGGTCTTGCTTTCTTTGACC TCTTCTCTCCTCCCCTACACCAACAAAGAGGAATG GCTGCAAGAGCCCAGATCACCCATTCCGGGTTCA CTCCCCGCCTCCCCAAGTCAGCAGTCCTAGCCCC AAACCAGCCCAGAGCAGGGTCTCTCTAAAGGGGA CTTGAGGGCCTGAGCAGGAAAGACTGGCCCTCTA GCTTCTACCCTTTGTCCCTGTAGCCTATACAGTTTA GAATATTTATTTGTTAATTTTATTAAAATGCTTTAAA AAAA | | |
| 12 | NM_153201.1_165 | 165 | CTCATTGAACTCGCCTGCAGCTCTTGGGTTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATGCCAATGATCA GGGAAACCGAACCACTCCAAGCTATGTCGCCTTTA CGGACACTGAACGGTTGATCGGTGATGCCGCAAA GAATCAAGTTGCAATGAACCCCACCAACACAGTTT TTGATGCCAAACGTCTGATTGGACGCAGATTTGAT GATGCTGTTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 21 | PMIRETEP LQAMSPLR TLNG* |
| 13 | NM_002298.2_227 | 227 | TTTTTCTTTCCTGGCTGATGATTTGTCATTCTAGTC ACTTCCTGCCTTGTGACCACACACCCAGGCTTGAC AAAGCTGTTCTGCAGATCAGAAAGAAGGGGTTCCT GGTCATACACCAGTACTACCAAGGACAGCTTTTTT CCTGCAAGATCTGTTACCTAAAGCAATAAAAAATG GCCAGAGGATCAGTGTCCGATGAGGAAATGATGG AGCTCAGAGAAGCTTTGCCAAAGTTGATACTGATG GCAATGGATACATCAGCTTCAATGAGTTGAATGAC TTGTTCAAGGCTGCTTGCTTGCCTTTGCCTGGGTA TAGAGTACGAGAAATTACAGAAAACCTGATGGCTA CAGGTGATCTGGACCAAGATGGAAGGATCAGCTTT GATGAGTTTATCAAGATTTTCCATGGCCTAAAAAG CACAGATGTTGCCAAGACCTTTAGAAAAGCAATCA ATAAGAAGGAAGGGATTTGTGCAATCGGTGGTACT TCAGAGCAGTCTAGCGTTGGCACCCAACACTCCTA TTCAGAGGAAGAAAAGTATGCCTTTGTCAACTGGA TAAACAAAGCCCTGGAAAATGATCCTGATTGTCGG CATGTCATCCCAATGAACCCAAACACGAATGATCT CTTTAATGCTGTTGGAGATGGCATTGTCCTTTGTAA AATGATCAACCTGTCAGTGCCAGACACAATTGATG AAAGAACAATCAACAAAAAGAAGCTAACCCCTTTC ACCATTCAGGAAAATCTGAACTTGGCTCTGAACTC TGCCTCAGCCATCGGGTGCCATGTGGTCAACATA GGGGCTGAGGACCTGAAGGAGGGGAAGCCTTATC TGGTCCTGGGACTTCTGTGGCAAGTCATCAAGATT GGGTTGTTTGCTGACATTGAACTCAGCAGAAATGA AGCTCTGATTGCTCTTTTGAGAGAAGGTGAGAGCC TGGAGGATTTGATGAAACTCTCCCCTGAAGAGCTC TTGCTGAGGTGGGCTAATTACCACCTGGAAAATGC AGGCTGCAAC | 16 | LPKLILMA MDTSASM S* |
| 14 | NM_002817.2_223 | 223 | AGCATTTCCGGCAGCCATCCCCGCGGTGCTGACA TCCCGGTTGTTCTTCTGTGCCGGGGGTCTTCCTGC TGTCATGAAGGACGTACCGGGCTTCCTACAGCAG AGCCAGAGCTCCGGGCCCGGGCAGCCCGCTGTG | 21 | LPKEMVSL SFMKTLSV NLNTG* |

TABLE 3A-continued

| SEQ ID | identifier_position | position | modified_RNA | PAP length | PAP |
|---|---|---|---|---|---|
| | | | TGGCACCGTCTGGAGGAGCTCTACACGAAGAAGT<br>TGTGGCATCAGCTGACACTTCAGGTGCTTGATTTT<br>GTGCAGGATCCGTGCTTGCCCAAGGAGATGGTCT<br>CATTAAGCTTTATGAAAACTTTATCAGTGAATTTGA<br>ACACAGGGTGAATCCTCTGTCCCTCGTGGAAATCA<br>TTCTTCACGTAGTTAGACAGATGACTGATCCTAATG<br>TGGCTCTTACTTTTCTGGAAAAGACTCGTGAGAAG<br>GTGAAAAGTAGTGATGAGGCAGTGATCCTGTGTAA<br>AACAGCAATTGGAGCTCTAAAATTAAACATCGGGG<br>ACCTACAGGTTACAAAGGAAACAATTGAAGATGTT<br>GAAGAAATGCTCAACAACCTTCCTGGTGTGACATC<br>GGTTCACAGTCGTTTCTATGATCTCTCCAGTAAATA<br>CTATCAAACAATCGGAAACCACGCGTCCTACTACA<br>AAGATGCTCTGCGGTTTTTGGGCTGTGTTGACATC<br>AAGGATCTACCAGTGTCTGAGCAGCAGGAGAGAG<br>CCTTCACGCTGGGGCTAGCAGGACTTCTCGGCGA<br>GGGAGTTTTTAACTTTGGAGAACTCCTCATGCACC<br>CTGTGCTGGAGTCCCTGAGGAATACTGACCGGCA<br>GTGGCTGATTGACACCCTCTATGCCTTCAACAGTG<br>GCAACGTAGAGCGGTTCCAGACTCTGAAGACTGC<br>CTGGGGCCAGCAGCCTGATTTAGCAGCTAATGAA<br>GCCCAGCTTCTGAGGAAAATTCAGTTGTTGTGCCT<br>CATGGAGATGACTTTCACACGACCTGCCAATCACA<br>GACAACTCACTTTTGAAGAAATTGCCAAAAGTGCT<br>AAAATCACAGTGAATGAGGTGGAGCTTCTGGTGAT<br>GAAGGCCCTTTCGGTGG | | |
| 15 | NM_0001<br>43.2_141 | 141 | CCCAGAAATTCTACCCAAGCTCCCTCAGCACCATG<br>TACCGAGCACTTCGGCTCCTCGCGCGCTCGCGTC<br>CCCTCGTGCGGGCTCCAGCCGCAGCCTTAGCTTC<br>GGCTCCCGGCTTGGGTGGCGCGGCCGTGCCCTC<br>GTTTGGCCTCCGAACGCGGCTCGAATGGCAAGCC<br>AAAATTCCTTCCGGATAGAATATGATACCTTTGGTG<br>AACTAAAGGTGCCAAATGATAAGTATTATGGCGCC<br>CAGACCGTGAGATCTACGATGAACTTTAAGATTGG<br>AGGTGTGACAGAACGCATGCCAACCCCAGTTATTA<br>AAGCTTTTGGCATCTTGAAGCGAGCGGCCGCTGA<br>AGTAAACCAGGATTATGGTCTTGATCCAAAGATTG<br>CTAATGCAATAATGAAGGCAGCAGATGAGGTAGCT<br>GAAGGTAAATTAAATGATCATTTTCCTCTCGTGGTA<br>TGGCAGACTGGATCAGGAACTCAGACAAATATGAA<br>TGTAAATGAAGTCATTAGCAATAGAGCAATTGAAAT<br>GTTAGGAGGTGAACTTGGCAGCAAGATACCTGTG<br>CATCCCAACGATCATGTTAATAAAAGCCAGAGCTC<br>AAATGATACTTTTCCCACAGCAATGCACATTGCTG<br>CTGCAATAGAAGTTCATGAAGTACTGTTACCAGGA<br>CTACAGAAGTTACATGATGCTCTTGATGCAAAATC<br>CAAAGAGTTTGCACAGATCATCAAGATTGGACGTA<br>CTCATACTCAGGATGCTGTTCCACTTACTCTTGGG<br>CAGGAATTTAGTGGTTATGTTCAACAAGTAAAATAT<br>GCAATGACAAGAATAAAAGCTGCCATGCCAAGAAT<br>CTATGAGCTCGCAGCTGGAGGCACTGCTGTTGGT<br>ACAGGTTTAAATACTAGAATTGGCTTTGCAGAAAA<br>GGTTGCTGCAAAAGTGGCTGCACTTACAGGCTTGC<br>CTTTTGTCACTGCTCCGAATAAATTTGAAGCTCTGG<br>CTGCTCATGACGCTCTGGTTGAGCTCAGTGGAGC<br>CATGAACACTACT | 15 | FGLRTRLE<br>WQAKIPSG* |
| 16 | NM_0000<br>26.1_397 | 397 | CCATGGCGGCTGGAGGCGATCATGGTTCGCCCGA<br>CAGCTACCGCTCACCTCTTGCCTCCCGCTATGCCA<br>GCCCGGAGATGTGCTTCGTGTTTAGCGACAGGTAT<br>AAATTCCGGACATGGCGGCAGCTGTGGCTGTGGC<br>TGGCGGAGGCCGAGCAGACATTGGGTTTGCCTAT<br>CACAGATGAACAAATCCAGGAGATGAAATCAAACC<br>TGGAGAACATAGACTTCAAGATGGCAGCTGAGGA<br>AGAGAAACGTTTACGACATGATGTGATGGCTCACG<br>TGCACACATTTGGCCACTGCTGTCCAAAAGCTGCA<br>GGCATTATTCACCTTGGTGCTACTTCTTGCTATGTT<br>GGAGACAATACTGACTTGATTATTCTTAGAAATGCA<br>CTTGACCTGCTTTGCCAAAGCTTGCCAGAGTGATC<br>TCTCGGCTTGCCGACTTTGCTAAGGAACGAGCCA<br>GTCTACCCACATTAGGTTTCACACATTTCCAGCCT<br>GCACAGCTGACCACAGTTGGGAAACGTTGCTGTC<br>TTTGGATTCAGGATCTTTGCATGGATCTCCAGAAC<br>TTGAAGCGTGTCCGAGATGACCTGCGCTTCCGGG<br>GAGTAAAGGGTACCACTGGCACTCAGGCCAGTTT<br>CCTGCAGCTCTTTGAGGGAGATGACCATAAGGTA<br>GAGCAGCTTGACAAGATGGTGACAGAAAAGGCAG<br>GATTTAAGAGAGCTTTCATCATCACAGGGCAGACA | 6 | CQSLPE* |

TABLE 3A-continued

| SEQ ID | identifier_position | position | modified_RNA | PAP length | PAP |
|---|---|---|---|---|---|
| | | | TATACACGAAAAGTGGATATTGAAGTACTGTCTGT GCTGGCTAGCTTGGGGGCATCAGTGCACAAGATT TGCACCGACATACGCCTCCTGGCAAACCTCAAGG AGATGGAGGAACCCTTTGAAAAACAGCAGATTGGC TCAAGTGCGATGCCATATAAGCGGAATCCCATGCG TTCAGAACGTTGCTGCAGTCTTGCCCGCCACCTGA TGACCCTTGTCATGGACCCGCTACAGACAGCATCT GTCCAGTGGTTTGAACGCACACTGGATGATAGTGC CAACCGACGGATCTGTTTG | | |
| 17 | NM_0000 50.4_560 | 560 | GCCGGCGCGCCCCTGGGAGGGTGAGCCGGCGCC GGGCCCAGGCCCGGACCTGGTGGGAGGCGGGG GGAGGTGGGGACGAGGCCTGGGGAGGCGGGCC CCGCCCATCTGCAGGTGGCTGTGAACGCTGAGCG GCTCCAGGCGGGGGCCGGGCCCGGGGGCGGGG TCTGTGGCGCGCGTCCCCGCCACGTGTCCCCGGT CACCGGCCCTGCCCCCGGGCCCTGTGCTTATAAC CTGGGATGGGCACCCCTGCCAGTCCTGCTCTGCC GCCTGCCACCGCTGCCCGAGCCCGAGTGGTTCAC TGCACTGTGAAAACAGATTCCAGACGCCGGGAAC TCACGCCTCCAATCCCAGACGCTATGTCCAGCAAA GGCTCCGTGGTTCTGGCCTACAGTGGCGGCCTGG ACACCTCGTGCATCCTCGTGTGGCTGAAGGAACA AGGCTATGACGTCATTGCCTATCTGGCCAACATTG GCCAGAAGGAAGACTTCGAGGAAGCCAGGAAGAA GGCACTGAAGCTTGGGGCCAAAAAGGTGTTCATT GAGGATGTCAGCAGGGAGTTGTGGAGGAGTTCAT CTGGCCGGCCATCCAGTCCAGCGCACTGTATGAG GACCGCTACCTCCTGGGCACCTCTCTTGCCAGGC CCTGCATCGCCCGCAAACAAGTGGAAATCGCCCA GCGGGAGGGGGCCAAGTATGTGTCCCACGGCGC CACAGGAAAGGGGAACGATCAGGTCCGGTTTGAG CTCAGCTGCTACTCACTGGCCCCCAGATAAAGGT CATTGCTCCCTGGAGGATGCCTGAATTCTACAACC GGTTCAAGGGCCGCAATGACCTGATGGAGTACGC AAAGCAACACGGGATTCCCATCCCGGTCACTCCC AAGAACCCGTGGAGCATGGATGAGAACCTCATGC ACATCAGCTACGAGGCTGGAATCCTGGAGAACCC CAAGAACCAAGCGCCTCCAGGTCTCTACACGAAG ACCCAGGACCCAGCCAAAGCCCCCAACACCCCTG ACATTCTC | 71 | LWRSSSG RPSSPAHC MRTATSW APLLPGPA SPANKWK SPSGRGP SMCPTAP QERGTIRS GLSSAATH WPPR* |
| 18 | NM_0000 75.2_569 | 569 | AGCCCTCCCAGTTTCCGCGCGCCTCTTTGGCAGC TGGTCACATGGTGAGGGTGGGGGTGAGGGGGCC TCTCTAGCTTGCGGCCTGTGTCTATGGTCGGGCC CTCTGCGTCCAGCTGCTCCGGACCGAGCTCGGGT GTATGGGGCCGTAGGAACCGGCTCCGGGGCCCC GATAACGGGCCGCCCCACAGCACCCCGGGCTG GCGTGAGGGTCTCCCTTGATCTGAGAATGGCTAC CTCTCGATATGAGCCAGTGGCTGAAATTGGTGTCG GTGCCTATGGGACAGTGTACAAGGCCCGTGATCC CCACAGTGGCCACTTTGTGGCCCTCAAGAGTGTG AGAGTCCCCAATGGAGGAGGAGGTGGAGGAGGC CTTCCCATCAGCACAGTTCGTGAGGTGGCTTTACT GAGGCGACTGGAGGCTTTTGAGCATCCCAATGTT GTCCGGCTGATGGACGTCTGTGCCACATCCCGAA CTGACCGGGAGATCAAGGTAACCCTGGTGTTTGA GCATGTAGACCAGGACCTAAGGACATATCTGGACA AGGCACCCCCACCAGGCTTGCCAGCGAAACGATC AAGGATCTGATGCGCCAGTTTCTAAGAGGCCTAGA TTTCCTTCATGCCAATTGCATCGTTCACCGAGATCT GAAGCCAGAGAACATTCTGGTGACAAGTGGTGGA ACAGTCAAGCTGGCTGACTTTGGCCTGGCCAGAA TCTACAGCTACCAGATGGCACTTACACCCGTGGTT GTTACACTCTGGTACCGAGCTCCCGAAGTTCTTCT GCAGTCCACATATGCAACACCTGTGGACATGTGGA GTGTTGGCTGTATCTTTGCAGAGATGTTTCGTCGA AAGCCTCTCTTCTGTGGAAACTCTGAAGCCGACCA GTTGGGCAAAATCTTTGACCTGATTGGGCTGCCTC CAGAGGATGACTGGCCTCGAGATGTATCCCTGCC CCGTGGAGCCTTTCCCCCAGAGGGCCCCGCCCA GTGCAGTCGGTGGTACCTGAGATGGAGGAG | 5 | KRSRI* |
| 19 | NM_0000 75.2_713 | 713 | AGCCCTCCCAGTTTCCGCGCGCCTCTTTGGCAGC TGGTCACATGGTGAGGGTGGGGGTGAGGGGGCC TCTCTAGCTTGCGGCCTGTGTCTATGGTCGGGCC CTCTGCGTCCAGCTGCTCCGGACCGAGCTCGGGT GTATGGGGCCGTAGGAACCGGCTCCGGGGCCCC GATAACGGGCCGCCCCACAGCACCCCGGGCTG GCGTGAGGGTCTCCCTTGATCTGAGAATGGCTAC | 66 | ESTATRW HLHPWLLH SGTELPKF FCSPHMQ HLWTCGVL AVSLQRCF VESLSSVE |

TABLE 3A-continued

| SEQ ID | identifier_position | position | modified_RNA | PAP length | PAP |
|---|---|---|---|---|---|
| | | | CTCTCGATATGAGCCAGTGGCTGAAATTGGTGTCG<br>GTGCCTATGGGACAGTGTACAAGGCCCGTGATCC<br>CCACAGTGGCCACTTTGTGGCCCTCAAGAGTGTG<br>AGAGTCCCCAATGGAGGAGGAGGTGGAGGAGGC<br>CTTCCCATCAGCACAGTTCGTGAGGTGGCTTTACT<br>GAGGCGACTGGAGGCTTTTGAGCATCCCAATGTT<br>GTCCGGCTGATGGACGTCTGTGCCACATCCCGAA<br>CTGACCGGGAGATCAAGGTAACCCTGGTGTTTGA<br>GCATGTAGACCAGGACCTAAGGACATATCTGGACA<br>AGGCACCCCCACCAGGCTTGCCAGCCGAAACGAT<br>CAAGGATCTGATGCGCCAGTTTCTAAGAGGCCTAG<br>ATTTCCTTCATGCCAATTGCATCGTTCACCGAGATC<br>TGAAGCCAGAGAACATTCTGGTGACAAGTGGTGG<br>AACAGTCAAGCTGGCTGACTTTGGCCTGGCAGAAT<br>CTACAGCTACCAGATGGCACTTACACCCGTGGTTG<br>TTACACTCTGGTACCGAGCTCCCGAAGTTCTTCTG<br>CAGTCCACATATGCAACACCTGTGGACATGTGGAG<br>TGTTGGCTGTATCTTTGCAGAGATGTTTCGTCGAA<br>AGCCTCTCTTCTGTGGAAACTCTGAAGCCGACCAG<br>TTGGGCAAAATCTTTGACCTGATTGGGCTGCCTCC<br>AGAGGATGACTGGCCTCGAGATGTATCCCTGCCC<br>CGTGGAGCCTTTCCCCCCAGAGGGCCCCGCCCA<br>TGCAGTCGGTGGTACCTGAGATGGAGGAG | | TLKPTSWA<br>KSLT* |
| 20 | NM_0000<br>75.2_725 | 725 | AGCCCTCCCAGTTTCCGCGCGCCTCTTTGGCAGC<br>TGGGTCACATGGTGAGGGTGGGGGTGAGGGGGCC<br>TCTCTAGCTTGCGGCCTGTGTCTATGGTCGGGCC<br>CTCTGCGTCCAGCTGCTCCGGACCGAGCTCGGGT<br>GTATGGGGCCGTAGGAACCGGCTCCGGGGCCCC<br>GATAACGGGCCGCCCCCACAGCACCCCGGGCTG<br>GCGTGAGGGTCTCCCTTGATCTGAGAATGGCTAC<br>CTCTCGATATGAGCCAGTGGCTGAAATTGGTGTCG<br>GTGCCTATGGGACAGTGTACAAGGCCCGTGATCC<br>CCACAGTGGCCACTTTGTGGCCCTCAAGAGTGTG<br>AGAGTCCCCAATGGAGGAGGAGGTGGAGGAGGC<br>CTTCCCATCAGCACAGTTCGTGAGGTGGCTTTACT<br>GAGGCGACTGGAGGCTTTTGAGCATCCCAATGTT<br>GTCCGGCTGATGGACGTCTGTGCCACATCCCGAA<br>CTGACCGGGAGATCAAGGTAACCCTGGTGTTTGA<br>GCATGTAGACCAGGACCTAAGGACATATCTGGACA<br>AGGCACCCCCACCAGGCTTGCCAGCCGAAACGAT<br>CAAGGATCTGATGCGCCAGTTTCTAAGAGGCCTAG<br>ATTTCCTTCATGCCAATTGCATCGTTCACCGAGATC<br>TGAAGCCAGAGAACATTCTGGTGACAAGTGGTGG<br>AACAGTCAAGCTGGCTGACTTTGGCCTGGCCAGA<br>ATCTACAGTACCAGATGGCACTTACACCCGTGGTT<br>GTTACACTCTGGTACCGAGCTCCCGAAGTTCTTCT<br>GCAGTCCACATATGCAACACCTGTGGACATGTGGA<br>GTGTTGGCTGTATCTTTGCAGAGATGTTTCGTCGA<br>AAGCCTCTCTTCTGTGGAAACTCTGAAGCCGACCA<br>GTTGGGCAAAATCTTTGACCTGATTGGGCTGCCTC<br>CAGAGGATGACTGGCCTCGAGATGTATCCCTGCC<br>CCGTGGAGCCTTTCCCCCCAGAGGGCCCCGCCCA<br>GTGCAGTCGGTGGTACCTGAGATGGAGGAG | 62 | TRWHLHP<br>WLLHSGTE<br>LPKFFCSP<br>HMQHLWT<br>CGVLAVSL<br>QRCFVESL<br>SSVETLKP<br>TSWAKSLT* |
| 21 | NM_0001<br>43.2_141 | 141 | CCCAGAAATTCTACCCAAGCTCCCTCAGCACCATG<br>TACCGAGCACTTCGGCTCCTCGCGCGCTCGCGTC<br>CCCTCGTGCGGGCTCCAGCCGCAGCCTTAGCTTC<br>GGCTCCGGCTTGGGTGGCGCGGCCGTGCCCTC<br>GTTTGGCCTCCGAACGCGGCTCGAATGGCAAGCC<br>AAAATTCCTTCCGGATAGAAATATGATACCTTTGGTG<br>AACTAAAGGTGCCAAATGATAAGTATTATGGCGCC<br>CAGACCGTGAGATCTACGATGAACTTTAAGATTGG<br>AGGTGTGACAGAACGCATGCCAACCCCAGTTATTA<br>AAGCTTTTGGCATCTTGAAGCGAGCGGCCGCTGA<br>AGTAAACCAGGATTATGGTCTTGATCCAAAGATTG<br>CTAATGCAATAATGAAGGCAGCAGATGAGGTAGCT<br>GAAGGTAAATTAAATGATCATTTTCCTCTCGTGGTA<br>TGGCAGACTGGATCAGGAACTCAGACAAATATGAA<br>TGTAAATGAAGTCATTAGCAATAGAGCAATTGAAAT<br>GTTAGGAGGTGAACTTGGCAGCAAGATACCTGTG<br>CATCCCAACGATCATGTTAATAAAAGCCAGAGCTC<br>AAATGATACTTTTCCCACAGCAATGCACATTGCTG<br>CTGCAATAGAAGTTCATGAAGTACTGTTACCAGGA<br>CTACAGAAGTTACATGATGCTCTTGATGCAAAATC<br>CAAAGAGTTTGCACAGATCATCAAGATTGGACGTA<br>CTCATACTCAGGATGCTGTTCCACTTACTCTTGGG<br>CAGGAATTTAGTGGTTATGTTCAACAAGTAAAAATAT<br>GCAATGACAAGAATAAAAGCTGCCATGCCAAGAAT | 15 | GLRTRLEW<br>QAKIPSG* |

TABLE 3A-continued

| SEQ ID | identifier_position | position | modified_RNA | PAP length | PAP |
|---|---|---|---|---|---|
| | | | CTATGAGCTCGCAGCTGGAGGCACTGCTGTTGGT ACAGGTTTAAATACTAGAATTGGCTTTGCAGAAAA GGTTGCTGCAAAAGTGGCTGCACTTACAGGCTTGC CTTTTGTCACTGCTCCGAATAAATTTGAAGCTCTGG CTGCTCATGACGCTCTGGTTGAGCTCAGTGGAGC CATGAACACTACT | | |
| 22 | NM_0001 43.2_320 | 320 | CCCAGAAATTCTACCCAAGCTCCCTCAGCACCATG TACCGAGCACTTCGGCTCCTCGCGCGCTCGCGTC CCCTCGTGCGGGCTCCAGCCGCAGCCTTAGCTTC GGCTCCCGGCTTGGGTGGCGCGGCCGTGCCCTC GTTTTGGCCTCCGAACGCGGCTCGAATGGCAAGC CAAAATTCCTTCCGGATAGAATATGATACCTTTGGT GAACTAAAGGTGCCAAATGATAAGTATTATGGCGC CCAGACCGTGAGATCTACGATGAACTTTAAGATTG GAGGTGTGACAGAACGCATGCCAACCCCAGTTATT AAAGCTTTGGCATCTTGAAGCGAGCGGCCGCTGA AGTAAACCAGGATTATGGTCTTGATCCAAAGATTG CTAATGCAATAATGAAGGCAGCAGATGAGGTAGCT GAAGGTAAATTAAATGATCATTTTCCTCTCGTGGTA TGGCAGACTGGATCAGGAACTCAGACAAATATGAA TGTAAATGAAGTCATTAGCAATAGAGCAATTGAAAT GTTAGGAGGTGAACTTGGCAGCAAGATACCTGTG CATCCCAACGATCATGTTAATAAAAGCCAGAGCTC AAATGATACTTTTCCCACAGCAATGCACATTGCTG CTGCAATAGAAGTTCATGAAGTACTGTTACCAGGA CTACAGAAGTTACATGATGCTCTTGATGCAAAATC CAAAGAGTTTGCACAGATCATCAAGATTGGACGTA CTCATACTCAGGATGCTGTTCCACTTACTCTTGGG CAGGAATTTAGTGGTTATGTTCAACAAGTAAAATAT GCAATGACAAGAATAAAAGCTGCCATGCCAAGAAT CTATGAGCTCGCAGCTGGAGGCACTGCTGTTGGT ACAGGTTTAAATACTAGAATTGGCTTTGCAGAAAA GGTTGCTGCAAAAGTGGCTGCACTTACAGGCTTGC CTTTTGTCACTGCTCCGAATAAATTTGAAGCTCTGG CTGCTCATGACGCTCTGGTTGAGCTCAGTGGAGC CATGAACACTACT | 3 | LAS* |
| 23 | NM_0001 46.3_239 | 239 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGAGGCA GCCGTCAACAGCCTGGTCAATTTGTACCTGCAGGC CTCCTACACCTACCTCTCTCTGGGCTTCTATTTCGA CCGCGATGATGTGGCTCTGGAAGGCGTGAGCCAC TTCTTCCGCGAATTGGCCGAGGAGAAGCGCGAGG GCTACGAGCGTCTCCTGAAGATGCAAAACCAGCG TGGCGGCCGCGCTCTCTTCCAGGACATCAAGAAG CCAGCTGAAGATGAGTGGGGTAAAACCCCAGACG CCATGAAAGCTGCCATGGCCCTGGAGAAAAAGCT GAACCAGGCCCTTTTGGATCTTCATGCCCTGGGTT CTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | 34 | RQPSTAW SICTCRPP TPTSLWAS ISTAMMWL WKA* |
| 24 | NM_0001 46.3_247 | 247 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCGTCAACAGCCTGGTCAATTTGTACCTGCAGGC CTCCTACACCTACCTCTCTCTGGGCTTCTATTTCGA CCGCGATGATGTGGCTCTGGAAGGCGTGAGCCAC TTCTTCCGCGAATTGGCCGAGGAGAAGCGCGAGG GCTACGAGCGTCTCCTGAAGATGCAAAACCAGCG TGGCGGCCGCGCTCTCTTCCAGGACATCAAGAAG CCAGCTGAAGATGAGTGGGGTAAAACCCCAGACG CCATGAAAGCTGCCATGGCCCTGGAGAAAAAGCT | 31 | STAWSICT CRPPTPTS LWASISTA MMWLWKA* |

TABLE 3A-continued

| SEQ ID | identifier_position | position | modified_RNA | PAP length | PAP |
|---|---|---|---|---|---|
| | | | GAACCAGGCCCTTTTGGATCTTCATGCCCTGGGTT<br>CTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | | |
| 25 | NM_0001<br>46.3_267 | 267 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCCATGGCCCTGGAGAAAAAG<br>CTGAACCAGGCCCTTTTGGATCTTCATGCCCTGGG<br>TTCTGCCCGCACGGACCCCCATCTCTGTGACTTCC<br>TGGAGACTCACTTCCTAGATGAGGAAGTGAAGCTT<br>ATCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | 25 | CTCRPPTP<br>TSLWASIS<br>TAMMWLW<br>KA* |
| 26 | NM_0001<br>46.3_286 | 286 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTAACCTACCTCTCTCTGGGCTTCTATTTCGA<br>CCGCGATGATGTGGCTCTGGAAGGCGTGAGCCAC<br>TTCTTCCGCGAATTGGCCGAGGAGAAGCGCGAGG<br>GCTACGAGCGTCTCCTGAAGATGCAAAACCAGCG<br>TGGCGGCCGCGCTCTCTTCCAGGACATCAAGAAG<br>CCAGCTGAAGATGAGTGGGGTAAAACCCCAGACG<br>CCATGAAAGCTGCCATGGCCCTGGAGAAAAAGCT<br>GAACCAGGCCCTTTTGGATCTTCATGCCCTGGGTT<br>CTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | 0 | * |
| 27 | NM_0001<br>46.3_289 | 289 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACTACCTCTCTCTGGGCTTCTATTTCGA<br>CCGCGATGATGTGGCTCTGGAAGGCGTGAGCCAC<br>TTCTTCCGCGAATTGGCCGAGGAGAAGCGCGAGG<br>GCTACGAGCGTCTCCTGAAGATGCAAAACCAGCG<br>TGGCGGCCGCGCTCTCTTCCAGGACATCAAGAAG<br>CCAGCTGAAGATGAGTGGGGTAAAACCCCAGACG | 17 | TSLWASIS<br>TAMMWLW<br>KA* |

TABLE 3A-continued

| SEQ ID | identifier_position | position | modified_RNA | PAP length | PAP |
|---|---|---|---|---|---|
| | | | CCATGAAAGCTGCCATGGCCCTGGAGAAAAAGCT GAACCAGGCCCTTTTGGATCTTCATGCCCTGGGTT CTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | | |
| 28 | NM_0001 46.3_319 | 319 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC GACCGGATGATGTGGCTCTGGAAGGCGTGAGCCA CTTCTTCCGCGAATTGGCCGAGGAGAAGCGCGAG GGCTACGAGCGTCTCCTGAAGATGCAAAACCAGC GTGGCGGCCGCGCTCTCTTCCAGGACATCAAGAA GCCAGCTGAAGATGAGTGGGGTAAAACCCCAGAC GCCATGAAAGCTGCCATGGCCCTGGAGAAAAAGC TGAACCAGGCCCTTTTGGATCTTCATGCCCTGGGT TCTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | 7 | MMWLWKA* |
| 29 | NM_0001 46.3_349 | 349 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC GACCGCGATGATGTGGCTCTGGAAGGCGTGAGCC ATTCTTCCGCGAATTGGCCGAGGAGAAGCGCGAG GGCTACGAGCGTCTCCTGAAGATGCAAAACCAGC GTGGCGGCCGCGCTCTCTTCCAGGACATCAAGAA GCCAGCTGAAGATGAGTGGGGTAAAACCCCAGAC GCCATGAAAGCTGCCATGGCCCTGGAGAAAAAGC TGAACCAGGCCCTTTTGGATCTTCATGCCCTGGGT TCTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | 16 | SSANWPR RSARATSV S* |
| 30 | NM_0001 46.3_363 | 363 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC GACCGCGATGATGTGGCTCTGGAAGGCGTGAGCC ACTTCTTCCGCGAATGGCCGAGGAGAAGCGCGAG GGCTACGAGCGTCTCCTGAAGATGCAAAACCAGC GTGGCGGCCGCGCTCTCTTCCAGGACATCAAGAA | 12 | WPRRSAR ATSVS* |

TABLE 3A-continued

| SEQ ID | identifier_position | position | modified_RNA | PAP length | PAP |
|---|---|---|---|---|---|
| | | | GCCAGCTGAAGATGAGTGGGGTAAAACCCCAGAC<br>GCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | | |
| 31 | NM_0001<br>46.3_421 | 421 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGGGCCGCGCTCTCTTCCAGGACATCAAGAA<br>GCCAGCTGAAGATGAGTGGGGTAAAACCCCAGAC<br>GCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | 22 | AALSSRTS<br>RSQLKMS<br>GVKPQTP* |
| 32 | NM_0001<br>46.3_425 | 425 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCGCGCTCTCTTCCAGGACATCAAGAA<br>GCCAGCTGAAGATGAGTGGGGTAAAACCCCAGAC<br>GCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | 21 | ALSSRTSR<br>SQLKMSG<br>VKPQTP* |
| 33 | NM_0001<br>46.3_456 | 456 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG | 11 | VKMSGVK<br>PQTP* |

TABLE 3A-continued

| SEQ ID | identifier_position | position | modified_RNA | PAP length | PAP |
|---|---|---|---|---|---|
| | | | CGTGGCGGCCGCGCTCTCTTCCAGGACATCAAGA<br>AGCCAGTGAAGATGAGTGGGGTAAAACCCCAGAC<br>GCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | | |
| 34 | NM_0001<br>46.3_484 | 484 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGTGAAGATGAGTGGGGTAAAACCCCAGA<br>GCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | 2 | EP* |
| 35 | NM_0001<br>46.3_487 | 487 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGTGAAGATGAGTGGGGTAAAACCCCAGA<br>CGCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | 0 | * |
| 36 | NM_0001<br>46.3_499 | 499 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA | 6 | WPWRKS* |

TABLE 3A-continued

| SEQ ID | identifier_position | position | modified_RNA | PAP length | PAP |
|---|---|---|---|---|---|
| | | | GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | | |
| 37 | NM_0001<br>46.3_506 | 506 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCCATGGCCCTGGAGAAAAAGC<br>TGAACCAGGCCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | 4 | WRKS* |
| 38 | NM_0001<br>46.3_530 | 530 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCCATGGCCCTGGAGAAAAAG<br>CTGAACCAGGCCTTTTGGATCTTCATGCCCTGGGT<br>TCTGCCCGCACGGACCCCCATCTCTGTGACTTCCT<br>GGAGACTCACTTCCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAAA | 24 | FWIFMPWV<br>LPARTPISV<br>TSWRLTS* |
| 39 | NM_0001<br>46.3_534 | 534 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC | 23 | WIFMPWVL<br>PARTPISVT<br>SWRLTS* |

TABLE 3A-continued

| SEQ ID | identifier_position | position | modified_RNA | PAP length | PAP |
|---|---|---|---|---|---|
| | | | ACTTCTTCCGCGAATTGGCCGAGGAGAAGCGCGA GGGCTACGAGCGTCTCCTGAAGATGCAAAACCAG CGTGGCGGCCGCGCTCTCTTCCAGGACATCAAGA AGCCAGCTGAAGATGAGTGGGGTAAAACCCCAGA CGCCATGAAAGCTGCCATGGCCCTGGAGAAAAAG CTGAACCAGGCCCTTTTGGATCTTCATGCCCTGGGT TCTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | | |
| 40 | NM_0001 46.3_548 | 548 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC GACCGCGATGATGTGGCTCTGGAAGGCGTGAGCC ACTTCTTCCGCGAATTGGCCGAGGAGAAGCGCGA GGGCTACGAGCGTCTCCTGAAGATGCAAAACCAG CGTGGCGGCCGCGCTCTCTTCCAGGACATCAAGA AGCCAGCTGAAGATGAGTGGGGTAAAACCCCAGA CGCCATGAAAGCTGCCATGGCCCTGGAGAAAAAG CTGAACCAGGCCCTTTTGGATCTTCATGCCCTGGGT TCTGCCCGCACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | 18 | WVLPARTP ISVTSWRL TS* |
| 41 | NM_0001 46.3_562 | 562 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC GACCGCGATGATGTGGCTCTGGAAGGCGTGAGCC ACTTCTTCCGCGAATTGGCCGAGGAGAAGCGCGA GGGCTACGAGCGTCTCCTGAAGATGCAAAACCAG CGTGGCGGCCGCGCTCTCTTCCAGGACATCAAGA AGCCAGCTGAAGATGAGTGGGGTAAAACCCCAGA CGCCATGAAAGCTGCCATGGCCCTGGAGAAAAAG CTGAACCAGGCCCTTTTGGATCTTCATGCCCTGGG TTCTGCCCGACGGACCCCCATCTCTGTGACTTCCT GGAGACTCACTTCCTAGATGAGGAAGTGAAGCTTA TCAAGAAGATGGGTGACCACCTGACCAACCTCCA CAGGCTGGGTGGCCCGGAGGCTGGGCTGGGCGA GTATCTCTTCGAAAGGCTCACTCTCAAGCACGACT AAGAGCCTTCTGAGCCCAGCGACTTCTGAAGGGC CCCTTGCAAAGTAATAGGGCTTCTGCCTAAGCCTC TCCCTCCAGCCAATAGGCAGCTTTCTTAACTATCC TAACAAGCCTTGGACCAAATGGAAATAAAGCTTTTT GATGCAAAAAAAAAAAAAAAAAAA | 13 | RTPISVTS WRLTS* |
| 42 | NM_0001 46.3_602 | 602 | GCAGTTCGGCGGTCCCGCGGGTCTGTCTCTTGCT TCAACAGTGTTTGGACGGAACAGATCCGGGGACT CTCTTCCAGCCTCCGACCGCCCTCCGATTTCCTCT CCGCTTGCAACCTCCGGGACCATCTTCTCGGCCAT CTCCTGCTTCTGGGACCTGCCAGCACCGTTTTTGT GGTTAGCTCCTTCTTGCCAACCAACCATGAGCTCC CAGATTCGTCAGAATTATTCCACCGACGTGGAGGC AGCCGTCAACAGCCTGGTCAATTTGTACCTGCAGG CCTCCTACACCTACCTCTCTCTGGGCTTCTATTTC | 0 | * |

TABLE 3A-continued

| SEQ ID | identifier_position | position | modified_RNA | PAP length | PAP |
|---|---|---|---|---|---|
| | | | GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCCATGGCCCTGGAGAAAAAG<br>CTGAACCAGGCCCTTTTGGATCTTCATGCCCTGGG<br>TTCTGCCCGCACGGACCCCCATCTCTGTGACTTCC<br>TGGAGACTCACTTCTAGATGAGGAAGTGAAGCTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | | |
| 43 | NM_0001<br>46.3_620 | 620 | GCAGTTCGGCGGTCCCGCGGGTCTGTCTCTTGCT<br>TCAACAGTGTTTGGACGGAACAGATCCGGGGACT<br>CTCTTCCAGCCTCCGACCGCCCTCCGATTTCCTCT<br>CCGCTTGCAACCTCCGGGACCATCTTCTCGGCCAT<br>CTCCTGCTTCTGGGACCTGCCAGCACCGTTTTTGT<br>GGTTAGCTCCTTCTTGCCAACCAACCATGAGCTCC<br>CAGATTCGTCAGAATTATTCCACCGACGTGGAGGC<br>AGCCGTCAACAGCCTGGTCAATTTGTACCTGCAGG<br>CCTCCTACACCTACCTCTCTCTGGGCTTCTATTTC<br>GACCGCGATGATGTGGCTCTGGAAGGCGTGAGCC<br>ACTTCTTCCGCGAATTGGCCGAGGAGAAGCGCGA<br>GGGCTACGAGCGTCTCCTGAAGATGCAAAACCAG<br>CGTGGCGGCCGCGCTCTCTTCCAGGACATCAAGA<br>AGCCAGCTGAAGATGAGTGGGGTAAAACCCCAGA<br>CGCCATGAAAGCTGCCATGGCCCTGGAGAAAAAG<br>CTGAACCAGGCCCTTTTGGATCTTCATGCCCTGGG<br>TTCTGCCCGCACGGACCCCCATCTCTGTGACTTCC<br>TGGAGACTCACTTCCTAGATGAGGAAGTGAAGTTA<br>TCAAGAAGATGGGTGACCACCTGACCAACCTCCA<br>CAGGCTGGGTGGCCCGGAGGCTGGGCTGGGCGA<br>GTATCTCTTCGAAAGGCTCACTCTCAAGCACGACT<br>AAGAGCCTTCTGAGCCCAGCGACTTCTGAAGGGC<br>CCCTTGCAAAGTAATAGGGCTTCTGCCTAAGCCTC<br>TCCCTCCAGCCAATAGGCAGCTTTCTTAACTATCC<br>TAACAAGCCTTGGACCAAATGGAAATAAAGCTTTTT<br>GATGCAAAAAAAAAAAAAAAAAAA | 7 | SRRWVTT* |
| 44 | NM_0001<br>75.2_125<br>5 | 1255 | GCCATAAAGGCCGCCGCGCGCCCACGCGCCTCG<br>CTTGCTGCGCGCTGCCGGCGCTCCTTCCTCCTCG<br>GCTCGCGTCTCACTCAGTGTACCTTCTAGTCCCGC<br>CATGGCCGCTCTCACCCGGGACCCCCAGTTCCAG<br>AAGCTGCAGCAATGGTACCGCGAGCACCGCTCCG<br>AGCTGAACCTGCGCCGCCTCTTCGATGCCAACAA<br>GGACCGCTTCAACCACTTCAGCTTGACCCTCAACA<br>CCAACCATGGGCATATCCTGGTGGATTACTCCAAG<br>AACCTGGTGACGGAGGACGTGATGCGGATGCTGG<br>TGGACTTGGCCAAGTCCAGGGGCGTGGAGGCCG<br>CCCGGGAGCGGATGTTCAATGGTGAGAAGATCAA<br>CTACACCGAGGGTCGAGCCGTGCTGCACGTGGCT<br>CTGCGGAACCGGTCAAACACACCCATCCTGGTAG<br>ACGGCAAGGATGTGATGCCAGAGGTCAACAAGGT<br>TCTGGACAAGATGAAGTCTTTCTGCCAGCGTGTCC<br>GGAGCGGTGACTGGAAGGGGTACACAGGCAAGA<br>CCATCACGGACGTCATCAACATTGGCATTGGCGG<br>CTCCGACCTGGGACCCCTCATGGTGACTGAAGCC<br>CTTAAGCCATACTCTTCAGGAGGTCCCCGCGTCTG<br>GTATGTCTCCAACATTGATGGAACTCACATTGCCA<br>AAACCCTGGCCCAGCTGAACCCCGAGTCCTCCCT<br>GTTCATCATTGCCTCCAAGACCTTTACTACCCAGG<br>AGACCATCACGAATGCAGAGACGGCGAAGGAGTG<br>GTTTCTCCAGGCGGCCAAGGATCCTTCTGCAGTG<br>GCGAAGCACTTTGTTGCCCTGTCTACTAACACAAC<br>CAAAGTGAAGGAGTTTGGAATTGACCCTCAAAACA<br>TGTTCGAGTTCTGGGATTGGGTGGGAGGACGCTA<br>CTCGCTGTGGTCGGCCATCGGACTCTCCATTGCC<br>CTGCACGTGGGTTTTGACAACTTCGAGCAGCTGCT<br>CTCGGGGGCTCACTGGATGGACCAGCACTTC | 16 | PMASMLFT<br>SSSTKAPR* |
| 45 | NM_0001<br>82.4_234 | 234 | CGGCCACTCGGCATCTGGGTTTTAGTCAGGCAGT<br>GCTCCAGGCGCCTGGCTGCCAGGCTACGGGAGA<br>AAAGTCCTCCGCTCGGCCGCACCCGTTAGAGGCG<br>CTCTCCACTGCTGTCCTCTTCAGCTCAAGATGGTG | 1 | C* |

TABLE 3A-continued

| SEQ ID | identifier_position | position | modified_RNA | PAP length | PAP |
|---|---|---|---|---|---|
| | | | GCCTGCCGGGCGATTGGCATCCTCAGCCGCTTTT<br>CTGCCTTCAGGATCCTCCGCTCCCGAGGTTATATA<br>TGCCGCAATTTTACAGGGTCTTCTGCTTGCTGACC<br>AGAACCCATATTAACTATGGAGTCAAAGGGGATGT<br>GGCAGTTGTTCGAATTAACTCTCCCAATTCAAAGG<br>TAAATACACTGAGTAAAGAGCTACATTCAGAGTTCT<br>CAGAAGTTATGAATGAAATCTGGGCTAGTGATCAA<br>ATCAGAAGTGCCGTCCTTATCTCATCAAAGCCAGG<br>CTGCTTTATTGCAGGTGCTGATATCAACATGTTAG<br>CCGCTTGCAAGACCCTTCAAGAAGTAACACAGCTA<br>TCACAAGAAGCACAGAGAATAGTTGAGAAACTTGA<br>AAAGTCCACAAAGCCTATTGTGGCTGCCATCAATG<br>GATCCTGCCTGGGAGGAGGACTTGAGGTTGCCAT<br>TTCATGCCAATACAGAATAGCAACAAAAGACAGAA<br>AAACAGTATTAGGTACCCCTGAAGTTTTGCTGGGG<br>GCCTTACCAGGAGCAGGAGGCACACAAAGGCTGC<br>CCAAAATGGTGGGTGTGCCTGCTGCTTTGGACATG<br>ATGCTGACTGGTAGAAGCATTCGTGCAGACAGGG<br>CAAAGAAAATGGGACTGGTTGACCAACTGGTGGA<br>ACCCCTGGGACCAGGACTAAAACCTCCAGAGGAA<br>CGGACAATAGAATACCTAGAAGAAGTTGCAATTAC<br>TTTTGCCAAAGGACTAGCTGATAAGAAGATCTCTC<br>CAAAGAGAGACAAGGGATTGGTGGAAAAATTGACA<br>GCGTATGCCATGACTATTCCATTTGTCAGGCAACA<br>GGTTTACAAAAAAGTGGAAGAAAAAGTGCGAAAGC<br>AGACTAAAGGCCTTTATC | | |
| 46 | NM_0001<br>82.4_283 | 283 | CGGCCACTCGGCATCTGGGTTTTAGTCAGGCAGT<br>GCTCCAGGCGCCTGGCTGCCAGGCTACGGGAGA<br>AAAGTCCTCCGCTCGGCCGCACCCGTTAGAGGCG<br>CTCTCCACTGCTGTCCTCTTCAGCTCAAGATGGTG<br>GCCTGCCGGGCGATTGGCATCCTCAGCCGCTTTT<br>CTGCCTTCAGGATCCTCCGCTCCCGAGGTTATATA<br>TGCCGCAATTTTACAGGGTCTTCTGCTTTGCTGAC<br>CAGAACCCATATTAACTATGGAGTCAAAGGGGATG<br>TGGCAGTGTTCGAATTAACTCTCCCAATTCAAAGG<br>TAAATACACTGAGTAAAGAGCTACATTCAGAGTTCT<br>CAGAAGTTATGAATGAAATCTGGGCTAGTGATCAA<br>ATCAGAAGTGCCGTCCTTATCTCATCAAAGCCAGG<br>CTGCTTTATTGCAGGTGCTGATATCAACATGTTAG<br>CCGCTTGCAAGACCCTTCAAGAAGTAACACAGCTA<br>TCACAAGAAGCACAGAGAATAGTTGAGAAACTTGA<br>AAAGTCCACAAAGCCTATTGTGGCTGCCATCAATG<br>GATCCTGCCTGGGAGGAGGACTTGAGGTTGCCAT<br>TTCATGCCAATACAGAATAGCAACAAAAGACAGAA<br>AAACAGTATTAGGTACCCCTGAAGTTTTGCTGGGG<br>GCCTTACCAGGAGCAGGAGGCACACAAAGGCTGC<br>CCAAAATGGTGGGTGTGCCTGCTGCTTTGGACATG<br>ATGCTGACTGGTAGAAGCATTCGTGCAGACAGGG<br>CAAAGAAAATGGGACTGGTTGACCAACTGGTGGA<br>ACCCCTGGGACCAGGACTAAAACCTCCAGAGGAA<br>CGGACAATAGAATACCTAGAAGAAGTTGCAATTAC<br>TTTTGCCAAAGGACTAGCTGATAAGAAGATCTCTC<br>CAAAGAGAGACAAGGGATTGGTGGAAAAATTGACA<br>GCGTATGCCATGACTATTCCATTTGTCAGGCAACA<br>GGTTTACAAAAAAGTGGAAGAAAAAGTGCGAAAGC<br>AGACTAAAGGCCTTTATC | 9 | FELTLPIQR* |
| 47 | NM_0001<br>82.4_697 | 697 | CGGCCACTCGGCATCTGGGTTTTAGTCAGGCAGT<br>GCTCCAGGCGCCTGGCTGCCAGGCTACGGGAGA<br>AAAGTCCTCCGCTCGGCCGCACCCGTTAGAGGCG<br>CTCTCCACTGCTGTCCTCTTCAGCTCAAGATGGTG<br>GCCTGCCGGGCGATTGGCATCCTCAGCCGCTTTT<br>CTGCCTTCAGGATCCTCCGCTCCCGAGGTTATATA<br>TGCCGCAATTTTACAGGGTCTTCTGCTTTGCTGAC<br>CAGAACCCATATTAACTATGGAGTCAAAGGGGATG<br>TGGCAGTTGTTCGAATTAACTCTCCCAATTCAAAG<br>GTAAATACACTGAGTAAAGAGCTACATTCAGAGTT<br>CTCAGAAGTTATGAATGAAATCTGGGCTAGTGATC<br>AAATCAGAAGTGCCGTCCTTATCTCATCAAAGCCA<br>GGCTGCTTTATTGCAGGTGCTGATATCAACATGTT<br>AGCCGCTTGCAAGACCCTTCAAGAAGTAACACAGC<br>TATCACAAGAAGCACAGAGAATAGTTGAGAAACTT<br>GAAAAGTCCACAAAGCCTATTGTGGCTGCCATCAA<br>TGGATCCTGCCTGGGAGGAGGACTTGAGGTTGCC<br>ATTTCATGCCAATACAGAATAGCAACAAAAGACAG<br>AAAAACAGTATTAGGTACCCCTGAAGTTTTGCTGG<br>GGGCCTTACCAGGAGCAGGAGGCACACAAAGGCT<br>GCCAAAATGGTGGGTGTGCCTGCTGCTTTGGACAT | 9 | WWVCLLL<br>WT* |

TABLE 3A-continued

| SEQ ID | identifier_ position | position | modified_RNA | PAP length | PAP |
|---|---|---|---|---|---|
| | | | GATGCTGACTGGTAGAAGCATTCGTGCAGACAGG GCAAAGAAAATGGGACTGGTTGACCAACTGGTGG AACCCCTGGGACCAGGACTAAAACCTCCAGAGGA ACGGACAATAGAATACCTAGAAGAAGTTGCAATTA CTTTTGCCAAAGGACTAGCTGATAAGAAGATCTCT CCAAAGAGAGACAAGGGATTGGTGGAAAAATTGA CAGCGTATGCCATGACTATTCCATTTGTCAGGCAA CAGGTTTACAAAAAAGTGGAAGAAAAAGTGCGAAA GCAGACTAAAGGCCTTTATC | | |
| 48 | NM_0002 24.2_214 | 214 | TCCGGGGCGGGGGCGGGGCCTCACTCTGCGATA TAACTCGGGTCGCGCGGCTCGCGCAGGCCGCCA CCGTCGTCCGCAAAGCCTGAGTCCTGTCCTTTCTC TCTCCCCGGACAGCATGAGCTTCACCACTCGCTCC ACCTTCTCCACCAACTACCGGTCCCTGGGCTCTGT CCAGGCGCCCAGCTACGGCGCCCGGCCGGTCAG CAGCGCGGCAGCGTCTATGCAGGCGCTGGGGGC TCTGGTTCCCGGATCTCCGTGTCCCGCTCCACCA GCTTCAGGGGCGGCATGGGGTCCGGGGGCCTGG CCACCGGGATAGCCGGGGGTCTGGCAGGAATGG GAGGCATCCAGAACGAGAAGGAGACCATGCAAAG CCTGAACGACCGCCTGGCCTCTTACCTGGACAGA GTGAGGAGCCTGGAGACCGAGAACCGGAGGCTG GAGAGCAAAATCCGGGAGCACTTGGAGAAGAAGG GACCCCAGGTCAGAGACTGGAGCCATTACTTCAA GATCATCGAGGACCTGAGGGCTCAGATCTTCGCA AATACTGTGGACAATGCCCGCATCGTTCTGCAGAT TGACAATGCCCGTCTTGCTGCTGATGACTTTAGAG TCAAGTATGAGACAGAGCTGGCCATGCGCCAGTC TGTGGAGAACGACATCCATGGGCTCCGCAAGGTC ATTGATGACACCAATATCACACGACTGCAGCTGGA GACAGAGATCGAGGCTCTCAAGGAGGAGCTGCTC TTCATGAAGAAGAACCACGAAGAGGAAGTAAAAGG CCTACAAGCCCAGATTGCCAGCTCTGGGTTGACC GTGGAGGTAGATGCCCCCAAATCTCAGGACCTCG CCAAGATCATGGCAGACATCCGGGCCCAATATGA CGAGCTGGCTCGGAAGAACCGAGAGGAGCTAGAC AAGTACTGGTCTCAGCAGATTGAGGAGAGCACCA CAGTGGTCACCACACAGTCTGCTGAGGTTGGAGC TGCTGAGACGACGCTCACAGAGCTGAGACGTACA GTCC | 33 | ASMQALG ALVPGSPC PAPPASGA AWGPGAW PPG* |
| 49 | NM_0002 24.2_391 | 391 | TCCGGGGCGGGGGCGGGGCCTCACTCTGCGATA TAACTCGGGTCGCGCGGCTCGCGCAGGCCGCCA CCGTCGTCCGCAAAGCCTGAGTCCTGTCCTTTCTC TCTCCCCGGACAGCATGAGCTTCACCACTCGCTCC ACCTTCTCCACCAACTACCGGTCCCTGGGCTCTGT CCAGGCGCCCAGCTACGGCGCCCGGCCGGTCAG CAGCGCGGCCAGCGTCTATGCAGGCGCTGGGGG CTCTGGTTCCCGGATCTCCGTGTCCCGCTCCACCA GCTTCAGGGGCGGCATGGGGTCCGGGGGCCTGG CCACCGGGATAGCCGGGGGTCTGGCAGGAATGG GAGGCATCCAGAACGAGAAGGAGACCATGCAAAG CCTGAACGACCGCCTGGCTCTTACCTGGACAGAG TGAGGAGCCTGGAGACCGAGAACCGGAGGCTGG AGAGCAAAATCCGGGAGCACTTGGAGAAGAAGGG ACCCCAGGTCAGAGACTGGAGCCATTACTTCAAGA TCATCGAGGACCTGAGGGCTCAGATCTTCGCAAAT ACTGTGGACAATGCCCGCATCGTTCTGCAGATTGA CAATGCCCGTCTTGCTGCTGATGACTTTAGAGTCA AGTATGAGACAGAGCTGGCCATGCGCCAGTCTGT GGAGAACGACATCCATGGGCTCCGCAAGGTCATT GATGACACCAATATCACACGACTGCAGCTGGAGA CAGAGATCGAGGCTCTCAAGGAGGAGCTGCTCTT CATGAAGAAGAACCACGAAGAGGAAGTAAAAGGC CTACAAGCCCAGATTGCCAGCTCTGGGTTGACCGT GGAGGTAGATGCCCCCAAATCTCAGGACCTCGCC AAGATCATGGCAGACATCCGGGCCCAATATGACG AGCTGGCTCGGAAGAACCGAGAGGAGCTAGACAA GTACTGGTCTCAGCAGATTGAGGAGAGCACCACA GTGGTCACCACACAGTCTGCTGAGGTTGGAGCTG CTGAGACGACGCTCACAGAGCTGAGACGTACAGT CC | 5 | LTWTE* |
| 50 | NM_0002 24.2_746 | 746 | TCCGGGGCGGGGGCGGGGCCTCACTCTGCGATA TAACTCGGGTCGCGCGGCTCGCGCAGGCCGCCA CCGTCGTCCGCAAAGCCTGAGTCCTGTCCTTTCTC TCTCCCCGGACAGCATGAGCTTCACCACTCGCTCC ACCTTCTCCACCAACTACCGGTCCCTGGGCTCTGT CCAGGCGCCCAGCTACGGCGCCCGGCCGGTCAG | 2 | SS* |

TABLE 3A-continued

| SEQ ID | identifier_position | position | modified_RNA | PAP length | PAP |
|---|---|---|---|---|---|
| | | | CAGCGCGGCCAGCGTCTATGCAGGCGCTGGGGG | | |
| | | | CTCTGGTTCCCGGATCTCCGTGTCCCGCTCCACCA | | |
| | | | GCTTCAGGGGCGGCATGGGGTCCGGGGGCCTGG | | |
| | | | CCACCGGGATAGCCGGGGGTCTGGCAGGAATGG | | |
| | | | GAGGCATCCAGAACGAGAAGGAGACCATGCAAAG | | |
| | | | CCTGAACGACCGCCTGGCCTCTTACCTGGACAGA | | |
| | | | GTGAGGAGCCTGGAGACCGAGAACCGGAGGCTG | | |
| | | | GAGAGCAAAATCCGGGAGCACTTGGAGAAGAAGG | | |
| | | | GACCCCAGGTCAGAGACTGGAGCCATTACTTCAA | | |
| | | | GATCATCGAGGACCTGAGGGCTCAGATCTTCGCA | | |
| | | | AATACTGTGGACAATGCCCGCATCGTTCTGCAGAT | | |
| | | | TGACAATGCCCGTCTTGCTGCTGATGACTTTAGAG | | |
| | | | TCAAGTATGAGACAGAGCTGGCCATGCGCCAGTC | | |
| | | | TGTGGAGAACGACATCCATGGGCTCCGCAAGGTC | | |
| | | | ATTGATGACACCAATATCACACGACTGCAGCTGGA | | |
| | | | GACAGAGATCGAGGCTCTCAAGGAGGAGCTGTCT | | |
| | | | TCATGAAGAAGAACCACGAAGAGGAAGTAAAAGG | | |
| | | | CCTACAAGCCCAGATTGCCAGCTCTGGGTTGACC | | |
| | | | GTGGAGGTAGATGCCCCCAAATCTCAGGACCTCG | | |
| | | | CCAAGATCATGGCAGACATCCGGGCCCAATATGA | | |
| | | | CGAGCTGGCTCGGAAGAACCGAGAGGAGCTAGAC | | |
| | | | AAGTACTGGTCTCAGCAGATTGAGGAGAGCACCA | | |
| | | | CAGTGGTCACCACACAGTCTGCTGAGGTTGGAGC | | |
| | | | TGCTGAGACGACGCTCACAGAGCTGAGACGTACA | | |
| | | | GTCC | | |
| 51 | NM_0002 24.2_762 | 762 | TCCGGGGCGGGGGCGGGGCCTCACTCTGCGATA TAACTCGGGTCGCGCGGCTCGCGCAGGCCGCCA CCGTCGTCCGCAAAGCCTGAGTCCTGTCCTTTCTC TCTCCCCGGACAGCATGAGCTTCACCACTCGCTCC ACCTTCTCCACCAACTACCGGTCCCTGGGCTCTGT CCAGGCGCCCAGCTACGGCGCCCGGCCGGTCAG CAGCGCGGCCAGCGTCTATGCAGGCGCTGGGGG CTCTGGTTCCCGGATCTCCGTGTCCCGCTCCACCA GCTTCAGGGGCGGCATGGGGTCCGGGGGCCTGG CCACCGGGATAGCCGGGGGTCTGGCAGGAATGG GAGGCATCCAGAACGAGAAGGAGACCATGCAAAG CCTGAACGACCGCCTGGCCTCTTACCTGGACAGA GTGAGGAGCCTGGAGACCGAGAACCGGAGGCTG GAGAGCAAAATCCGGGAGCACTTGGAGAAGAAGG GACCCCAGGTCAGAGACTGGAGCCATTACTTCAA GATCATCGAGGACCTGAGGGCTCAGATCTTCGCA AATACTGTGGACAATGCCCGCATCGTTCTGCAGAT TGACAATGCCCGTCTTGCTGCTGATGACTTTAGAG TCAAGTATGAGACAGAGCTGGCCATGCGCCAGTC TGTGGAGAACGACATCCATGGGCTCCGCAAGGTC ATTGATGACACCAATATCACACGACTGCAGCTGGA GACAGAGATCGAGGCTCTCAAGGAGGAGCTGCTC TTCATGAAGAAGACCACGAAGAGGAAGTAAAAGG CCTACAAGCCCAGATTGCCAGCTCTGGGTTGACC GTGGAGGTAGATGCCCCCAAATCTCAGGACCTCG CCAAGATCATGGCAGACATCCGGGCCCAATATGA CGAGCTGGCTCGGAAGAACCGAGAGGAGCTAGAC AAGTACTGGTCTCAGCAGATTGAGGAGAGCACCA CAGTGGTCACCACACAGTCTGCTGAGGTTGGAGC TGCTGAGACGACGCTCACAGAGCTGAGACGTACA GTCC | 5 | TTKRK* |
| 52 | NM_0002 24.2_764 | 764 | TCCGGGGCGGGGGCGGGGCCTCACTCTGCGATA TAACTCGGGTCGCGCGGCTCGCGCAGGCCGCCA CCGTCGTCCGCAAAGCCTGAGTCCTGTCCTTTCTC TCTCCCCGGACAGCATGAGCTTCACCACTCGCTCC ACCTTCTCCACCAACTACCGGTCCCTGGGCTCTGT CCAGGCGCCCAGCTACGGCGCCCGGCCGGTCAG CAGCGCGGCCAGCGTCTATGCAGGCGCTGGGGG CTCTGGTTCCCGGATCTCCGTGTCCCGCTCCACCA GCTTCAGGGGCGGCATGGGGTCCGGGGGCCTGG CCACCGGGATAGCCGGGGGTCTGGCAGGAATGG GAGGCATCCAGAACGAGAAGGAGACCATGCAAAG CCTGAACGACCGCCTGGCCTCTTACCTGGACAGA GTGAGGAGCCTGGAGACCGAGAACCGGAGGCTG GAGAGCAAAATCCGGGAGCACTTGGAGAAGAAGG GACCCCAGGTCAGAGACTGGAGCCATTACTTCAA GATCATCGAGGACCTGAGGGCTCAGATCTTCGCA AATACTGTGGACAATGCCCGCATCGTTCTGCAGAT TGACAATGCCCGTCTTGCTGCTGATGACTTTAGAG TCAAGTATGAGACAGAGCTGGCCATGCGCCAGTC TGTGGAGAACGACATCCATGGGCTCCGCAAGGTC ATTGATGACACCAATATCACACGACTGCAGCTGGA | 4 | TKRK* |

TABLE 3A-continued

| SEQ ID | identifier_position | position | modified_RNA | PAP length | PAP |
|---|---|---|---|---|---|
| | | | GACAGAGATCGAGGCTCTCAAGGAGGAGCTGCTC TTCATGAAGAAGAACACGAAGAGGAAGTAAAAGGC CTACAAGCCCAGATTGCCAGCTCTGGGTTGACCGT GGAGGTAGATGCCCCCAAATCTCAGGACCTCGCC AAGATCATGGCAGACATCCGGGCCCAATATGACG AGCTGGCTCGGAAGAACCGAGAGGAGCTAGACAA GTACTGGTCTCAGCAGATTGAGGAGAGCACCACA GTGGTCACCACACAGTCTGCTGAGGTTGGAGCTG CTGAGACGACGCTCACAGAGCTGAGACGTACAGT CC | | |
| 53 | NM_0002 69.2_192 | 192 | GCAGAAGCGTTCCGTGCGTGCAAGTGCTGCGAAC CACGTGGGTCCCGGGCGCGTTTCGGGTGCTGGC GGCTGCAGCCGGAGTTCAAACCTAAGCAGCTGGA AGGAACCATGGCCAACTGTGAGCGTACCTTCATTG CGATCAAACCAGATGGGGTCCAGCGGGGTCTTGT GGGAGAGATTATCAAGCGTTTGAGCAGAAAGGATT CCGCCTTGTTGGTCTGAAATTCATGCAAGCTTCCG AAGATCTTCTCAAGGAACACTACGTTGACCTGAAG GACCGTCCATTCTTTGCCGGCCTGGTGAAATACAT GCACTCAGGGCCGGTAGTTGCCATGGTCTGGGAG GGGCTGAATGTGGTGAAGACGGGCCGAGTCATGC TCGGGGAGACCAACCCTGCAGACTCCAAGCCTGG GACCATCCGTGGAGACTTCTGCATACAAGTTGGCA GGAACATTATACATGGCAGTGATTCTGTGGAGAGT GCAGAGAAGGAGATCGGCTTGTGGTTTCACCCTG AGGAACTGGTAGATTACACGAGCTGTGCTCAGAAC TGGATCTATGAATGACAGGAGGGCAGACCACATT GCTTTTCACATCCATTTCCCCTCCTTCCCATGGGC AGAGGACCAGGCTGTAGGAAATCTAGTTATTTACA GGAACTTCATCATAATTTGGAGGGAAGCTCTTGGA GCTGTGAGTTCTCCCTGTACAGTGTTACCATCCCC GACCATCTGATTAAAATGCTTCCTCCCAGCATAGG ATTCATTGAGTTGGTTACTTCATATTGTTGCATTGC TTTTTTTTCCTTCT | 10 | LSRKDSAL LV* |
| 54 | NM_0002 84.1_280 | 280 | ACTGAGGCGTGGCGTCTGCTGGGGCACCTGAAGG AGACTTGGGGGCACCCGCGTCGTGCCTCCTGGGT TGTGAGGAGTCGCCGCTGCCGCCACTGCCTGTGC TTCATGAGGAAGATGCTCGCCGCCGTCTCCCGCG TGCTGTCTGGCGCTTCTCAGAAAGCCGGCAAGCAG AGTGCTGGTAGCATCCCGTAATTTTGCAAATGATG CTACATTTGAAATTAAGAAATGTGACCTTCACCGG CTGGAAGAAGGCCCTCCTGTCACAACAGTGCTCA CCAGGAGGATGGGCTCAAATACTACAGGATGATG CAGACTGTACGCCGAATGGAGTTGAAAGCAGATC AGCTGTATAAACAGAAAATTATTCGTGGTTTCTGTC ACTTGTGTGATGGTCAGGAAGCTTGCTGTGTGGG CCTGGAGGCCGGCATCAACCCCACAGACCATCTC ATCACAGCCTACCGGGCTCACGGCTTTACTTTCAC CCGGGGGCCTTTCCGTCCGAGAAATTCTCGCAGAG CTTACAGGACGAAAAGGAGGTTGTGCTAAAGGGA AAGGAGGATCGATGCACATGTATGCCAAGAACTTC TACGGGGGCAATGGCATCGTGGGAGCGCAGGTG CCCCTGGGCGCTGGGATTGCTCTAGCCTGTAAGT ATAATGGAAAAGATGAGGTCTGCCTGACTTTATAT GGCGATGGTGCTGCTAACCAGGGCCAGATATTCG AAGCTTACAACATGGCAGCTTTGTGGAAATTACCT TGTATTTTCATCTGTGAGAATAATCGCTATGGAATG GGAACGTCTGTTGAGAGAGCGGCAGCCAGCACTG ATTACTACAAGAGAGGCGATTTCATTCCTGGGCTG AGAGTGGATGGAATGGATATCCTGTGCGTCCGAG AGGCAACAAGGTTTGCTGCTGCCTATTGTAGATCT GGGAAGGGGCCCATCCTGATGGAGCTGCAGACTT ACCGTTACCACGGACACAGTATGAGTGACCCTGG AGTCAGTTACCGTACACGAGAAGAAAT | 8 | RMGSNTT G* |
| 55 | NM_0002 91.2_269 | 269 | AGCGCACGTCGGCAGTCGGCTCCCTCGTTGACCG AATCACCGACCTCTCTCCCCAGCTGTATTTCCAAA ATGTCGCTTTCTAACAAGCTGACGCTGGACAAGCT GGACGTTAAAGGGAAGCGGGTCGTTATGAGAGTC GACTTCAATGTTCCTATGAAGAACAACCAGATAAC AAACAACCAGAGGATTAAGGCTGCTGTCCCAAGCA TCAAATTCTGCTTGGACAATGGAGCCAAGTCGGTA GTCCTTATGAGCCACCTAGGCCGGCTGATGGTGT GCCCATGCCTGACAAGTACTCCTTAGAGCCAGTTG CTGTAGAACTCAAATCTCTGCTGGGCAAGGATGTT CTGTTCTTGAAGGACTGTGTAGGCCCAGAAGTGG AGAAAGCCTGTGCCAACCCAGCTGCTGGGTCTGT CATCCTGCTGGAGAACCTCCGCTTTCATGTGGAGG | 11 | LMVCPCLT STP* |

TABLE 3A-continued

| SEQ ID | identifier_position | position | modified_RNA | PAP length | PAP |
|---|---|---|---|---|---|
| | | | AAGAAGGGAAGGGAAAAGATGCTTCTGGGAACAA<br>GGTTAAAGCCGAGCCAGCCAAAATAGAAGCTTTCC<br>GAGCTTCACTTTCCAAGCTAGGGGATGTCTATGTC<br>AATGATGCTTTTGGCACTGCTCACAGAGCCCACAG<br>CTCCATGGTAGGAGTCAATCTGCCACAGAAGGCT<br>GGTGGGTTTTTGATGAAGAAGGAGCTGAACTACTT<br>TGCAAAGGCCTTGGAGAGCCCAGAGCGACCCTTC<br>CTGGCCATCCTGGGCGGAGCTAAAGTTGCAGACA<br>AGATCCAGCTCATCAATAATATGCTGGACAAAGTC<br>AATGAGATGATTATTGGTGGTGGAATGGCTTTTAC<br>CTTCCTTAAGGTGCTCAACAACATGGAGATTGGCA<br>CTTCTCTGTTTGATGAAGAGGGAGCCAAGATTGTC<br>AAAGACCTAATGTCCAAAGCTGAGAAGAATGGTGT<br>GAAGATTACCTTGCCTGTTGACTTTGTCACTGCTG<br>ACAAGTTTGATGAGAATGCCAAGACTGGCCAAGCC<br>ACTGTGGCTTCTGGCATACCTGCTGGCTGGATGG<br>GCTTGGACTGTGGTCCTGA | | |
| 56 | NM_0002<br>91.2_504 | 504 | AGCGCACGTCGGCAGTCGGCTCCCTCGTTGACCG<br>AATCACCGACCTCTCTCCCCAGCTGTATTTCCAAA<br>ATGTCGCTTTCTAACAAGCTGACGCTGGACAAGCT<br>GGACGTTAAAGGGAAGCGGGTCGTTATGAGAGTC<br>GACTTCAATGTTCCTATGAAGAACAACCAGATAAC<br>AAACAACCAGAGGATTAAGGCTGCTGTCCCAAGCA<br>TCAAATTCTGCTTGGACAATGGAGCCAAGTCGGTA<br>GTCCTTATGAGCCACCTAGGCCGGCCTGATGGTG<br>TGCCCATGCCTGACAAGTACTCCTTAGAGCCAGTT<br>GCTGTAGAACTCAAATCTCTGCTGGGCAAGGATGT<br>TCTGTTCTTGAAGGACTGTGTAGGCCCAGAAGTGG<br>AGAAAGCCTGTGCCAACCCAGCTGCTGGGTCTGT<br>CATCCTGCTGGAGAACCTCCGCTTTCATGTGGAGG<br>AAGAAGGGAAGGGAAAAGATGCTTCTGGGAACAA<br>GGTTAAAGCCGAGCCAGCAAAATAGAAGCTTTCCG<br>AGCTTCACTTTCCAAGCTAGGGGATGTCTATGTCA<br>ATGATGCTTTTGGCACTGCTCACAGAGCCCACAGC<br>TCCATGGTAGGAGTCAATCTGCCACAGAAGGCTG<br>GTGGGTTTTTGATGAAGAAGGAGCTGAACTACTTT<br>GCAAAGGCCTTGGAGAGCCCAGAGCGACCCTTCC<br>TGGCCATCCTGGGCGGAGCTAAAGTTGCAGACAA<br>GATCCAGCTCATCAATAATATGCTGGACAAAGTCA<br>ATGAGATGATTATTGGTGGTGGAATGGCTTTTACC<br>TTCCTTAAGGTGCTCAACAACATGGAGATTGGCAC<br>TTCTCTGTTTGATGAAGAGGGAGCCAAGATTGTCA<br>AAGACCTAATGTCCAAAGCTGAGAAGAATGGTGTG<br>AAGATTACCTTGCCTGTTGACTTTGTCACTGCTGA<br>CAAGTTTGATGAGAATGCCAAGACTGGCCAAGCCA<br>CTGTGGCTTCTGGCATACCTGCTGGCTGGATGGG<br>CTTGGACTGTGGTCCTGA | 0 | * |
| 57 | NM_0002<br>91.2_567 | 567 | AGCGCACGTCGGCAGTCGGCTCCCTCGTTGACCG<br>AATCACCGACCTCTCTCCCCAGCTGTATTTCCAAA<br>ATGTCGCTTTCTAACAAGCTGACGCTGGACAAGCT<br>GGACGTTAAAGGGAAGCGGGTCGTTATGAGAGTC<br>GACTTCAATGTTCCTATGAAGAACAACCAGATAAC<br>AAACAACCAGAGGATTAAGGCTGCTGTCCCAAGCA<br>TCAAATTCTGCTTGGACAATGGAGCCAAGTCGGTA<br>GTCCTTATGAGCCACCTAGGCCGGCCTGATGGTG<br>TGCCCATGCCTGACAAGTACTCCTTAGAGCCAGTT<br>GCTGTAGAACTCAAATCTCTGCTGGGCAAGGATGT<br>TCTGTTCTTGAAGGACTGTGTAGGCCCAGAAGTGG<br>AGAAAGCCTGTGCCAACCCAGCTGCTGGGTCTGT<br>CATCCTGCTGGAGAACCTCCGCTTTCATGTGGAGG<br>AAGAAGGGAAGGGAAAAGATGCTTCTGGGAACAA<br>GGTTAAAGCCGAGCCAGCCAAAATAGAAGCTTTCC<br>GAGCTTCACTTTCCAAGCTAGGGGATGTCTATGTC<br>AATGATGCTTTGGCACTGCTCACAGAGCCCACAGC<br>TCCATGGTAGGAGTCAATCTGCCACAGAAGGCTG<br>GTGGGTTTTTGATGAAGAAGGAGCTGAACTACTTT<br>GCAAAGGCCTTGGAGAGCCCAGAGCGACCCTTCC<br>TGGCCATCCTGGGCGGAGCTAAAGTTGCAGACAA<br>GATCCAGCTCATCAATAATATGCTGGACAAAGTCA<br>ATGAGATGATTATTGGTGGTGGAATGGCTTTTACC<br>TTCCTTAAGGTGCTCAACAACATGGAGATTGGCAC<br>TTCTCTGTTTGATGAAGAGGGAGCCAAGATTGTCA<br>AAGACCTAATGTCCAAAGCTGAGAAGAATGGTGTG<br>AAGATTACCTTGCCTGTTGACTTTGTCACTGCTGA<br>CAAGTTTGATGAGAATGCCAAGACTGGCCAAGCCA<br>CTGTGGCTTCTGGCATACCTGCTGGCTGGATGGG<br>CTTGGACTGTGGTCCTGA | 11 | LALLTEPTA<br>PW* |

TABLE 3A-continued

| SEQ ID | identifier_position | position | modified_RNA | PAP length | PAP |
|---|---|---|---|---|---|
| 58 | NM_000291.2_591 | 591 | AGCGCACGTCGGCAGTCGGCTCCCTCGTTGACCG<br>AATCACCGACCTCTCTCCCCAGCTGTATTTCCAAA<br>ATGTCGCTTTCTAACAAGCTGACGCTGGACAAGCT<br>GGACGTTAAAGGGAAGCGGGTCGTTATGAGAGTC<br>GACTTCAATGTTCCTATGAAGAACAACCAGATAAC<br>AAACAACCAGAGGATTAAGGCTGCTGTCCCAAGCA<br>TCAAATTCTGCTTGGACAATGGAGCCAAGTCGGTA<br>GTCCTTATGAGCCACCTAGGCCGGCCTGATGGTG<br>TGCCCATGCCTGACAAGTACTCCTTAGAGCCAGTT<br>GCTGTAGAACTCAAATCTCTGCTGGGCAAGGATGT<br>TCTGTTCTTGAAGGACTGTGTAGGCCCAGAAGTGG<br>AGAAAGCCTGTGCCAACCCAGCTGCTGGGTCTGT<br>CATCCTGCTGGAGAACCTCCGCTTTCATGTGGAGG<br>AAGAAGGGAAGGGAAAAGATGCTTCTGGGAACAA<br>GGTTAAAGCCGAGCCAGCCAAAATAGAAGCTTTCC<br>GAGCTTCACTTTCCAAGCTAGGGGATGTCTATGTC<br>AATGATGCTTTTGGCACTGCTCACAGAGCCCACAG<br>TCCATGGTAGGAGTCAATCTGCCACAGAAGGCTG<br>GTGGGTTTTTGATGAAGAAGGAGCTGAACTACTTT<br>GCAAAGGCCTTGGAGAGCCCAGAGCGACCCTTCC<br>TGGCCATCCTGGGCGGAGCTAAAGTTGCAGACAA<br>GATCCAGCTCATCAATAATATGCTGGACAAAGTCA<br>ATGAGATGATTATTGGTGGTGGAATGGCTTTTACC<br>TTCCTTAAGGTGCTCAACAACATGGAGATTGGCAC<br>TTCTCTGTTTGATGAAGAGGGAGCCAAGATTGTCA<br>AAGACCTAATGTCCAAAGCTGAGAAGAATGGTGTG<br>AAGATTACCTTGCCTGTTGACTTTGTCACTGCTGA<br>CAAGTTTGATGAGAATGCCAAGACTGGCCAAGCCA<br>CTGTGGCTTCTGGCATACCTGCTGGCTGGATGGG<br>CTTGGACTGTGGTCCTGA | 2 | PW* |
| 59 | NM_000291.2_614 | 614 | AGCGCACGTCGGCAGTCGGCTCCCTCGTTGACCG<br>AATCACCGACCTCTCTCCCCAGCTGTATTTCCAAA<br>ATGTCGCTTTCTAACAAGCTGACGCTGGACAAGCT<br>GGACGTTAAAGGGAAGCGGGTCGTTATGAGAGTC<br>GACTTCAATGTTCCTATGAAGAACAACCAGATAAC<br>AAACAACCAGAGGATTAAGGCTGCTGTCCCAAGCA<br>TCAAATTCTGCTTGGACAATGGAGCCAAGTCGGTA<br>GTCCTTATGAGCCACCTAGGCCGGCCTGATGGTG<br>TGCCCATGCCTGACAAGTACTCCTTAGAGCCAGTT<br>GCTGTAGAACTCAAATCTCTGCTGGGCAAGGATGT<br>TCTGTTCTTGAAGGACTGTGTAGGCCCAGAAGTGG<br>AGAAAGCCTGTGCCAACCCAGCTGCTGGGTCTGT<br>CATCCTGCTGGAGAACCTCCGCTTTCATGTGGAGG<br>AAGAAGGGAAGGGAAAAGATGCTTCTGGGAACAA<br>GGTTAAAGCCGAGCCAGCCAAAATAGAAGCTTTCC<br>GAGCTTCACTTTCCAAGCTAGGGGATGTCTATGTC<br>AATGATGCTTTTGGCACTGCTCACAGAGCCCACAG<br>CTCCATGGTAGGAGTCAATCTGCACAGAAGGCTG<br>GTGGGTTTTTGATGAAGAAGGAGCTGAACTACTTT<br>GCAAAGGCCTTGGAGAGCCCAGAGCGACCCTTCC<br>TGGCCATCCTGGGCGGAGCTAAAGTTGCAGACAA<br>GATCCAGCTCATCAATAATATGCTGGACAAAGTCA<br>ATGAGATGATTATTGGTGGTGGAATGGCTTTTACC<br>TTCCTTAAGGTGCTCAACAACATGGAGATTGGCAC<br>TTCTCTGTTTGATGAAGAGGGAGCCAAGATTGTCA<br>AAGACCTAATGTCCAAAGCTGAGAAGAATGGTGTG<br>AAGATTACCTTGCCTGTTGACTTTGTCACTGCTGA<br>CAAGTTTGATGAGAATGCCAAGACTGGCCAAGCCA<br>CTGTGGCTTCTGGCATACCTGCTGGCTGGATGGG<br>CTTGGACTGTGGTCCTGA | 7 | HRRLVGF* |
| 60 | NM_000291.2_635 | 635 | AGCGCACGTCGGCAGTCGGCTCCCTCGTTGACCG<br>AATCACCGACCTCTCTCCCCAGCTGTATTTCCAAA<br>ATGTCGCTTTCTAACAAGCTGACGCTGGACAAGCT<br>GGACGTTAAAGGGAAGCGGGTCGTTATGAGAGTC<br>GACTTCAATGTTCCTATGAAGAACAACCAGATAAC<br>AAACAACCAGAGGATTAAGGCTGCTGTCCCAAGCA<br>TCAAATTCTGCTTGGACAATGGAGCCAAGTCGGTA<br>GTCCTTATGAGCCACCTAGGCCGGCCTGATGGTG<br>TGCCCATGCCTGACAAGTACTCCTTAGAGCCAGTT<br>GCTGTAGAACTCAAATCTCTGCTGGGCAAGGATGT<br>TCTGTTCTTGAAGGACTGTGTAGGCCCAGAAGTGG<br>AGAAAGCCTGTGCCAACCCAGCTGCTGGGTCTGT<br>CATCCTGCTGGAGAACCTCCGCTTTCATGTGGAGG<br>AAGAAGGGAAGGGAAAAGATGCTTCTGGGAACAA<br>GGTTAAAGCCGAGCCAGCCAAAATAGAAGCTTTCC<br>GAGCTTCACTTTCCAAGCTAGGGGATGTCTATGTC<br>AATGATGCTTTTGGCACTGCTCACAGAGCCCACAG | 0 | * |

TABLE 3A-continued

| SEQ ID | identifier_position | position | modified_RNA | PAP length | PAP |
|---|---|---|---|---|---|
| | | | CTCCATGGTAGGAGTCAATCTGCCACAGAAGGCT GGTGGGTTTTTGATGAAGAAGGAGCTGAACTACTTT GCAAAGGCCTTGGAGAGCCCAGAGCGACCCTTCC TGGCCATCCTGGGCGGAGCTAAAGTTGCAGACAA GATCCAGCTCATCAATAATATGCTGGACAAAGTCA ATGAGATGATTATTGGTGGTGGAATGGCTTTTACC TTCCTTAAGGTGCTCAACAACATGGAGATTGGCAC TTCTCTGTTTGATGAAGAGGGAGCCAAGATTGTCA AAGACCTAATGTCCAAAGCTGAGAAGAATGGTGTG AAGATTACCTTGCCTGTTGACTTTGTCACTGCTGA CAAGTTTGATGAGAATGCCAAGACTGGCCAAGCCA CTGTGGCTTCTGGCATACCTGCTGGCTGGATGGG CTTGGACTGTGGTCCTGA | | |
| 61 | NM_0002 91.2_777 | 777 | AGCGCACGTCGGCAGTCGGCTCCCTCGTTGACCG AATCACCGACCTCTCTCCCCAGCTGTATTTCCAAA ATGTCGCTTTCTAACAAGCTGACGCTGGACAAGCT GGACGTTAAAGGGAAGCGGGTCGTTATGAGAGTC GACTTCAATGTTCCTATGAAGAACAACCAGATAAC AAACAACCAGAGGATTAAGGCTGCTGTCCCAAGCA TCAAATTCTGCTTGGACAATGGAGCCAAGTCGGTA GTCCTTATGAGCCACCTAGGCCGGCCTGATGGTG TGCCCATGCCTGACAAGTACTCCTTAGAGCCAGTT GCTGTAGAACTCAAATCTCTGCTGGGCAAGGATGT TCTGTTCTTGAAGGACTGTGTAGGCCCAGAAGTGG AGAAAGCCTGTGCCAACCCAGCTGCTGGGTCTGT CATCCTGCTGGAGAACCTCCGCTTTCATGTGGAGG AAGAAGGGAAGGGAAAAGATGCTTCTGGGAACAA GGTTAAAGCCGAGCCAGCCAAAATAGAAGCTTTCC GAGCTTCACTTTCCAAGCTAGGGGATGTCTATGTC AATGATGCTTTTGGCACTGCTCACAGAGCCCACAG CTCCATGGTAGGAGTCAATCTGCCACAGAAGGCT GGTGGGTTTTTGATGAAGAAGGAGCTGAACTACTT TGCAAAGGCCTTGGAGAGCCCAGAGCGACCCTTC CTGGCCATCCTGGGCGGAGCTAAAGTTGCAGACA AGATCCAGCTCATCAATAATATGCTGGACAAAGTC AATGAGATGATTATGGTGGTGGAATGGCTTTTACC TTCCTTAAGGTGCTCAACAACATGGAGATTGGCAC TTCTCTGTTTGATGAAGAGGGAGCCAAGATTGTCA AAGACCTAATGTCCAAAGCTGAGAAGAATGGTGTG AAGATTACCTTGCCTGTTGACTTTGTCACTGCTGA CAAGTTTGATGAGAATGCCAAGACTGGCCAAGCCA CTGTGGCTTCTGGCATACCTGCTGGCTGGATGGG CTTGGACTGTGGTCCTGA | 33 | MVVEWLLP SLRCSTTW RLALLCLM KREPRLSK T* |
| 62 | NM_0003 58.1_144 5 | 1445 | GCTTGCCCGTCGGTCGCTAGCTCGCTCGGTGCGC GTCGTCCCGCTCCATGGCGCTCTTCGTGCGGCTG CTGGCTCTCGCCCTGGCTCTGGCCCTGGGCCCCG CCGCGACCCTGGCGGGTCCCGCCAAGTCGCCCTA CCAGCTGGTGCTGCAGCACAGCAGGCTCCGGGG CCGCCAGCACGGCCCCAACGTGTGTGCTGTGCAG AAGGTTATTGGCACTAATAGGAAGTACTTCACCAA CTGCAAGCAGTGGTACCAAAGGAAAATCTGTGGC AAATCAACAGTCATCAGCTACGAGTGCTGTCCTGG ATATGAAAAGGTCCCTGGGGAGAAGGGCTGTCCA GCAGCCCTACCACTCTCAAACCTTTACGAGACCCT GGGAGTCGTTGGATCCACCACCACTCAGCTGTAC ACGGACCGCACGGAGAAGCTGAGGCCTGAGATG GAGGGGCCCGGCAGCTTCACCATCTTCGCCCCTA GCAACGAGGCCTGGGCCTCCTTGCCAGCTGAAGT GCTGGACTCCCTGGTCAGCAATGTCAACATTGAGC TGCTCAATGCCCTCCGCTACCATATGGTGGGCAG GCGAGTCCTGACTGATGAGCTGAAACACGGCATG ACCCTCACCTCTATGTACCAGAATTCCAACATCCA GATCCACCACTATCCTAATGGGATTGTAACTGTGA ACTGTGCCCGGCTCCTGAAAGCCGACCACCATGC AACCAACGGGGTGGTGCACCTCATCGATAAGGTC ATCTCCACCATCACCAACAACATCCAGCAGATCAT TGAGATCGAGGACACCTTTGAGACCCTTCGGGCT GCTGTGGCTGCATCAGGGCTCAACACGATGCTTG AAGGTAACGGCCAGTACACGCTTTTGGCCCCGAC CAATGAGGCCTTCGAGAAGATCCCTAGTGAGACTT TGAACCGTATCCTGGGCGACCCAGAAGCCCTGAG AGACCTGCTGAACAACCACATCTTGAAGTCAGCTA TGTGTGCTGAAGCCATCGTTGCGGGGCTGTC | 32 | LFIVIASAL RTAASRPT TRGGGTG PCSRWTG C* |
| 63 | NM_0003 58.1_149 1 | 1491 | GCTTGCCCGTCGGTCGCTAGCTCGCTCGGTGCGC GTCGTCCCGCTCCATGGCGCTCTTCGTGCGGCTG CTGGCTCTCGCCCTGGCTCTGGCCCTGGGCCCCG CCGCGACCCTGGCGGGTCCCGCCAAGTCGCCCTA | 16 | TTRGGGT GPCSRWT GC* |

TABLE 3A-continued

| SEQ ID | identifier_position | position | modified_RNA | PAP length | PAP |
|---|---|---|---|---|---|
| | | | CCAGCTGGTGCTGCAGCACAGCAGGCTCCGGGG<br>CCGCCAGCACGGCCCCAACGTGTGTGCTGTGCAG<br>AAGGTTATTGGCACTAATAGGAAGTACTTCACCAA<br>CTGCAAGCAGTGGTACCAAAGGAAAATCTGTGGC<br>AAATCAACAGTCATCAGCTACGAGTGCTGTCCTGG<br>ATATGAAAAGGTCCCTGGGGAGAAGGGCTGTCCA<br>GCAGCCCTACCACTCTCAAACCTTTACGAGACCCT<br>GGGAGTCGTTGGATCCACCACCACTCAGCTGTAC<br>ACGGACCGCACGGAGAAGCTGAGGCCTGAGATG<br>GAGGGGCCCGGCAGCTTCACCATCTTCGCCCCTA<br>GCAACGAGGCCTGGGCCTCCTTGCCAGCTGAAGT<br>GCTGGACTCCCTGGTCAGCAATGTCAACATTGAGC<br>TGCTCAATGCCCTCCGCTACCATATGGTGGGCAG<br>GCGAGTCCTGACTGATGAGCTGAAACACGGCATG<br>ACCCTCACCTCTATGTACCAGAATTCCAACATCCA<br>GATCCACCACTATCCTAATGGGATTGTAACTGTGA<br>ACTGTGCCCGGCTCCTGAAAGCCGACCACCATGC<br>AACCAACGGGGTGGTGCACCTCATCGATAAGGTC<br>ATCTCCACCATCACCAACAACATCCAGCAGATCAT<br>TGAGATCGAGGACACCTTTGAGACCCTTCGGGCT<br>GCTGTGGCTGCATCAGGGCTCAACACGATGCTTG<br>AAGGTAACGGCCAGTACACGCTTTTGGCCCCGAC<br>CAATGAGGCCTTCGAGAAGATCCCTAGTGAGACTT<br>TGAACCGTATCCTGGGCGACCCAGAAGCCCTGAG<br>AGACCTGCTGAACAACCACATCTTGAAGTCAGCTA<br>TGTGTGCTGAAGCCATCGTTGCGGGGCTGTC | | |
| 64 | NM_0003 58.1_185 | 185 | GCTTGCCCGTCGGTCGCTAGCTCGCTCGGTGCGC<br>GTCGTCCCGCTCCATGGCGCTCTTCGTGCGGCTG<br>CTGGCTCTCGCCCTGGCTCTGGCCCTGGGCCCCG<br>CCGCGACCCTGGCGGGTCCCGCCAAGTCGCCCTA<br>CCAGCTGGTGCTGCAGCACAGCAGGCTCCGGGG<br>CCGCCAGCACGGCCCCAACGTGTGTGCTGTGCAGA<br>AGGTTATTGGCACTAATAGGAAGTACTTCACCAAC<br>TGCAAGCAGTGGTACCAAAGGAAAATCTGTGGCAA<br>ATCAACAGTCATCAGCTACGAGTGCTGTCCTGGAT<br>ATGAAAAGGTCCCTGGGGAGAAGGGCTGTCCAGC<br>AGCCCTACCACTCTCAAACCTTTACGAGACCCTGG<br>GAGTCGTTGGATCCACCACCACTCAGCTGTACAC<br>GGACCGCACGGAGAAGCTGAGGCCTGAGATGGA<br>GGGGCCCGGCAGCTTCACCATCTTCGCCCCTAGC<br>AACGAGGCCTGGGCCTCCTTGCCAGCTGAAGTGC<br>TGGACTCCCTGGTCAGCAATGTCAACATTGAGCTG<br>CTCAATGCCCTCCGCTACCATATGGTGGGCAGGC<br>GAGTCCTGACTGATGAGCTGAAACACGGCATGAC<br>CCTCACCTCTATGTACCAGAATTCCAACATCCAGA<br>TCCACCACTATCCTAATGGGATTGTAACTGTGAAC<br>TGTGCCCGGCTCCTGAAAGCCGACCACCATGCAA<br>CCAACGGGGTGGTGCACCTCATCGATAAGGTCAT<br>CTCCACCATCACCAACAACATCCAGCAGATCATTG<br>AGATCGAGGACACCTTTGAGACCCTTCGGGCTGC<br>TGTGGCTGCATCAGGGCTCAACACGATGCTTGAA<br>GGTAACGGCCAGTACACGCTTTTGGCCCCGACCA<br>ATGAGGCCTTCGAGAAGATCCCTAGTGAGACTTTG<br>AACCGTATCCTGGGCGACCCAGAAGCCCTGAGAG<br>ACCTGCTGAACAACCACATCTTGAAGTCAGCTATG<br>TGTGCTGAAGCCATCGTTGCGGGGCTGTCT | 81 | TCVLCRRL LALIGSTSP TASSGTKG KSVANQQ SSATSAVL DMKRSLG RRAVQQP YHSQTFTR PWESLDPP PLSCTRTA RRS* |
| 65 | NM_0003 58.1_611 | 611 | GCTTGCCCGTCGGTCGCTAGCTCGCTCGGTGCGC<br>GTCGTCCCGCTCCATGGCGCTCTTCGTGCGGCTG<br>CTGGCTCTCGCCCTGGCTCTGGCCCTGGGCCCCG<br>CCGCGACCCTGGCGGGTCCCGCCAAGTCGCCCTA<br>CCAGCTGGTGCTGCAGCACAGCAGGCTCCGGGG<br>CCGCCAGCACGGCCCCAACGTGTGTGCTGTGCAG<br>AAGGTTATTGGCACTAATAGGAAGTACTTCACCAA<br>CTGCAAGCAGTGGTACCAAAGGAAAATCTGTGGC<br>AAATCAACAGTCATCAGCTACGAGTGCTGTCCTGG<br>ATATGAAAAGGTCCCTGGGGAGAAGGGCTGTCCA<br>GCAGCCCTACCACTCTCAAACCTTTACGAGACCCT<br>GGGAGTCGTTGGATCCACCACCACTCAGCTGTAC<br>ACGGACCGCACGGAGAAGCTGAGGCCTGAGATG<br>GAGGGGCCCGGCAGCTTCACCATCTTCGCCCCTA<br>GCAACGAGGCCTGGGCCTCCTTGCCAGCTGAAGT<br>GCTGGACTCCCTGGTCAGCAATGTCAACATTGAGC<br>TGCTCAATGCCCTCCGCTACCATATGGTGGGCAG<br>GCGAGTCCTGACTGATGAGCTGAAACACGGCATGA<br>CCCTCACCTCTATGTACCAGAATTCCAACATCCAG<br>ATCCACCACTATCCTAATGGGATTGTAACTGTGAA<br>CTGTGCCCGGCTCCTGAAAGCCGACCACCATGCA | 0 | * |

TABLE 3A-continued

| SEQ ID | identifier_position | position | modified_RNA | PAP length | PAP |
|---|---|---|---|---|---|
| | | | ACCAACGGGGTGGTGCACCTCATCGATAAGGTCA TCTCCACCATCACCAACAACATCCAGCAGATCATT GAGATCGAGGACACCTTTGAGACCCTTCGGGCTG CTGTGGCTGCATCAGGGCTCAACACGATGCTTGA AGGTAACGGCCAGTACACGCTTTTGGCCCCGACC AATGAGGCCTTCGAGAAGATCCCTAGTGAGACTTT GAACCGTATCCTGGGCGACCCAGAAGCCCTGAGA GACCTGCTGAACAACCACATCTTGAAGTCAGCTAT GTGTGCTGAAGCCATCGTTGCGGGGCTGTCT | | |
| 66 | NM_0003 58.1_946 | 946 | GCTTGCCCGTCGGTCGCTAGCTCGCTCGGTGCGC GTCGTCCCGCTCCATGGCGCTCTTCGTGCGGCTG CTGGCTCTCGCCCTGGCTCTGGCCCTGGGCCCCG CCGCGACCCTGGCGGGTCCCGCCAAGTCGCCCTA CCAGCTGGTGCTGCAGCACAGCAGGCTCCGGGG CCGCCAGCACGGCCCCAACGTGTGTGCTGTGCAG AAGGTTATTGGCACTAATAGGAAGTACTTCACCAA CTGCAAGCAGTGGTACCAAAGGAAAATCTGTGGC AAATCAACAGTCATCAGCTACGAGTGCTGTCCTGG ATATGAAAAGGTCCCTGGGGAGAAGGGCTGTCCA GCAGCCCTACCACTCTCAAACCTTTACGAGACCCT GGGAGTCGTTGGATCCACCACCACTCAGCTGTAC ACGGACCGCACGGAGAAGCTGAGGCCTGAGATG GAGGGGCCCGGCAGCTTCACCATCTTCGCCCCTA GCAACGAGGCCTGGGCCTCCTTGCCAGCTGAAGT GCTGGACTCCCTGGTCAGCAATGTCAACATTGAGC TGCTCAATGCCCTCCGCTACCATATGGTGGGCAG GCGAGTCCTGACTGATGAGCTGAAACACGGCATG ACCCTCACCTCTATGTACCAGAATTCCAACATCCA GATCCACCACTATCCTAATGGGATTGTAACTGTGA ACTGTGCCCGGCTCCTGAAAGCCGACCACCATGC AACCAACGGGGTGGTGCACCTCATCGATAAGGTC ATCTCCACCATCACCAACAACATCCAGCAGATCAT TGAGATCGAGGACACCTTTGAGACCCTTCGGGCT GCTGTGGCTGCATCAGGGCTCAACACGATGCTTG AAGGTAACGGCCAGTACACGCTTTTGGCCCCGAC CAATGAGGCCTTCGAGAAGATCCCTAGTGAGACTT TGAACCGTATCCTGGGCGACCAGAAGCCCTGAGA GACCTGCTGAACAACCACATCTTGAAGTCAGCTAT GTGTGCTGAAGCCATCGTTGCGGGGCTGTCT | 3 | QKP* |
| 67 | NM_0003 65.4_121 | 121 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCGAC ACCGAGGTGGTTTGTGCTCCCCCTACTGCCTATAT CGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTTCGAGCAGACAAAGGTCATC GCAGATAACGTGAAGGACTGGAGCAAGGTCGTCC TGGCCTATGAGCCTGTGTGGGCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC TTCTCCACTTACTATAATGGTTGGAACTAAACGTCA CCAAGGTGGCTTCTCCTTGGCTGAGAG | 23 | RCRPTPR WFVLPLLPI STSPGRS* |
| 68 | NM_0003 65.4_133 | 133 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCGAC ACCGAGGTGGTTTGTGCTCCCCCTACTGCCTATAT CGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT | 19 | TPRWFVLP LLPISTSPG RS* |

TABLE 3A-continued

| SEQ ID | identifier_position | position | modified_RNA | PAP length | PAP |
|---|---|---|---|---|---|
| | | | GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTTCGAGCAGACAAAGGTCATC GCAGATAACGTGAAGGACTGGAGCAAGGTCGTCC TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC TTCTCCACTTACTATAATGGTTGGAACTAAACGTCA CCAAGGTGGCTTCTCCTTGGCTGAGAG | | |
| 69 | NM_0003 65.4_149 | 149 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTGTGCTCCCCCTACTGCCTATAT CGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTTCGAGCAGACAAAGGTCATC GCAGATAACGTGAAGGACTGGAGCAAGGTCGTCC TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC TTCTCCACTTACTATAATGGTTGGAACTAAACGTCA CCAAGGTGGCTTCTCCTTGGCTGAGAG | 14 | VLPLLPIST SPGRS* |
| 70 | NM_0003 65.4_205 | 205 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGAT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTTCGAGCAGACAAAGGTCATC GCAGATAACGTGAAGGACTGGAGCAAGGTCGTCC TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT | 10 | MLWLRRT ATK* |

TABLE 3A-continued

| SEQ ID | identifier_position | position | modified_RNA | PAP length | PAP |
|---|---|---|---|---|---|
| 71 | NM_0003 65.4_334 | 334 | ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC TTCTCCACTTACTATAATGGTTGGAACTAAACGTCA CCAAGGTGGCTTCTCCTTGGCTGAGAG CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTGGGGAGTC AGATGAGCTGATTGGGCAGAAAGTGGCCCATGCT CTGGCAGAGGGACTCGGAGTAATCGCCTGCATTG GGGAGAAGCTAGATGAAAGGGAAGCTGGCATCAC TGAGAAGGTTGTTTTCGAGCAGACAAAGGTCATCG CAGATAACGTGAAGGACTGGAGCAAGGTCGTCCT GGCCTATGAGCCTGTGTGGGCCATTGGTACTGGC AAGACTGCAACACCCCAACAGGCCCAGGAAGTAC ACGAGAAGCTCCGAGGATGGCTGAAGTCCAACGT CTCTGATGCGGTGGCTCAGAGCACCCGTATCATTT ATGGAGGCTCTGTGACTGGGGCAACCTGCAAGGA GCTGGCCAGCCAGCCTGATGTGGATGGCTTCCTT GTGGGTGGTGCTTCCCTCAAGCCCGAATTCGTGG ACATCATCAATGCCAAACAATGAGCCCCATCCATC TTCCCTACCCTTCCTGCCAAGCCAGGGACTAAGCA GCCCAGAAGCCCAGTAACTGCCCTTTCCCTGCATA TGCTTCTGATGGTGTCATCTGCTCCTTCCTGTGGC CTCATCCAAACTGTATCTTCCTTTACTGTTTATATCT TCACCCTGTAATGGTTGGGACCAGGCCAATCCCTT CTCCACTTACTATAATGGTTGGAACTAAACGTCAC CAAGGTGGCTTCTCCTTGGCTGAGAG | 6 | LGSQMS* |
| 72 | NM_0003 65.4_371 | 371 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCATGCT CTGGCAGAGGGACTCGGAGTAATCGCCTGCATTG GGGAGAAGCTAGATGAAAGGGAAGCTGGCATCAC TGAGAAGGTTGTTTTCGAGCAGACAAAGGTCATCG CAGATAACGTGAAGGACTGGAGCAAGGTCGTCCT GGCCTATGAGCCTGTGTGGGCCATTGGTACTGGC AAGACTGCAACACCCCAACAGGCCCAGGAAGTAC ACGAGAAGCTCCGAGGATGGCTGAAGTCCAACGT CTCTGATGCGGTGGCTCAGAGCACCCGTATCATTT ATGGAGGCTCTGTGACTGGGGCAACCTGCAAGGA GCTGGCCAGCCAGCCTGATGTGGATGGCTTCCTT GTGGGTGGTGCTTCCCTCAAGCCCGAATTCGTGG ACATCATCAATGCCAAACAATGAGCCCCATCCATC TTCCCTACCCTTCCTGCCAAGCCAGGGACTAAGCA GCCCAGAAGCCCAGTAACTGCCCTTTCCCTGCATA TGCTTCTGATGGTGTCATCTGCTCCTTCCTGTGGC CTCATCCAAACTGTATCTTCCTTTACTGTTTATATCT TCACCCTGTAATGGTTGGGACCAGGCCAATCCCTT CTCCACTTACTATAATGGTTGGAACTAAACGTCAC CAAGGTGGCTTCTCCTTGGCTGAGAG | 8 | MLWQRDSE* |
| 73 | NM_0003 65.4_459 | 459 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTGGGGAGT CAGATGAGCTGATTGGGCAGAAAGTGGCCATGC TCTGGCAGAGGGACTCGGAGTAATCGCCTGCATT | 10 | SSRQRSSQIT* |

TABLE 3A-continued

| SEQ ID | identifier_ position | position | modified_RNA | PAP length | PAP |
|---|---|---|---|---|---|
| | | | GGGGAGAAGCTAGATGAAAGGGAAGCTGGCATCA CTGAGAAGGTTGTTTCGAGCAGACAAAGGTCATCG CAGATAACGTGAAGGACTGGAGCAAGGTCGTCCT GGCCTATGAGCCTGTGTGGGCCATTGGTACTGGC AAGACTGCAACACCCCAACAGGCCCAGGAAGTAC ACGAGAAGCTCCGAGGATGGCTGAAGTCCAACGT CTCTGATGCGGTGGCTCAGAGCACCCGTATCATTT ATGGAGGCTCTGTGACTGGGGCAACCTGCAAGGA GCTGGCCAGCCAGCCTGATGTGGATGGCTTCCTT GTGGGTGGTGCTTCCCTCAAGCCCGAATTCGTGG ACATCATCAATGCCAAACAATGAGCCCCATCCATC TTCCCTACCCTTCCTGCCAAGCCAGGGACTAAGCA GCCCAGAAGCCCAGTAACTGCCCTTTCCCTGCATA TGCTTCTGATGGTGTCATCTGCTCCTTCCTGTGGC CTCATCCAAACTGTATCTTCCTTTACTGTTTATATCT TCACCCTGTAATGGTTGGGACCAGGCCAATCCCTT CTCCACTTACTATAATGGTTGGAACTAAACGTCAC CAAGGTGGCTTCTCCTTGGCTGAGAG | | |
| 74 | NM_0003 65.4_517 | 517 | CCTTCAGCGCCTCGGCTCCAGCGCCATGGCGCCC TCCAGGAAGTTCTTCGTTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTCGAGCAGACAAAGGTCATC GCAGATAACGTGAAGGACTGGAGCAAGGTCGTCC TGGCTATGAGCCTGTGTGGGCCATTGGTACTGGC AAGACTGCAACACCCCAACAGGCCCAGGAAGTAC ACGAGAAGCTCCGAGGATGGCTGAAGTCCAACGT CTCTGATGCGGTGGCTCAGAGCACCCGTATCATTT ATGGAGGCTCTGTGACTGGGGCAACCTGCAAGGA GCTGGCCAGCCAGCCTGATGTGGATGGCTTCCTT GTGGGTGGTGCTTCCCTCAAGCCCGAATTCGTGG ACATCATCAATGCCAAACAATGAGCCCCATCCATC TTCCCTACCCTTCCTGCCAAGCCAGGGACTAAGCA GCCCAGAAGCCCAGTAACTGCCCTTTCCCTGCATA TGCTTCTGATGGTGTCATCTGCTCCTTCCTGTGGC CTCATCCAAACTGTATCTTCCTTTACTGTTTATATCT TCACCCTGTAATGGTTGGGACCAGGCCAATCCCTT CTCCACTTACTATAATGGTTGGAACTAAACGTCAC CAAGGTGGCTTCTCCTTGGCTGAGAG | 28 | MSLCGPLV LARLQHPN RPRKYTRS SEDG* |
| 75 | NM_0003 65.4_52 | 52 | CCTTCAGCGCCTCGGCTCCAGCGCCATGGCGCCC TCCAGGAAGTTCTTCGTGGGGGAAACTGGAAGAT GAACGGGCGGAAGCAGAGTCTGGGGGAGCTCAT CGGCACTCTGAACGCGGCCAAGGTGCCGGCCGA CACCGAGGTGGTTTGTGCTCCCCCTACTGCCTATA TCGACTTCGCCCGGCAGAAGCTAGATCCCAAGATT GCTGTGGCTGCGCAGAACTGCTACAAAGTGACTA ATGGGGCTTTTACTGGGGAGATCAGCCCTGGCAT GATCAAAGACTGCGGAGCCACGTGGGTGGTCCTG GGGCACTCAGAGAGAAGGCATGTCTTTGGGGAGT CAGATGAGCTGATTGGGCAGAAAGTGGCCCATGC TCTGGCAGAGGGACTCGGAGTAATCGCCTGCATT GGGGAGAAGCTAGATGAAAGGGAAGCTGGCATCA CTGAGAAGGTTGTTTCGAGCAGACAAAGGTCATC GCAGATAACGTGAAGGACTGGAGCAAGGTCGTCC TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGCTTCCT TGTGGGTGGTGCTTCCCTCAAGCCCGAATTCGTG GACATCATCAATGCCAAACAATGAGCCCCATCCAT CTTCCCTACCCTTCCTGCCAAGCCAGGGACTAAGC AGCCCAGAAGCCCAGTAACTGCCCTTTCCCTGCAT ATGCTTCTGATGGTGTCATCTGCTCCTTCCTGTGG CCTCATCCAAACTGTATCTTCCTTTACTGTTTATAT CTTCACCCTGTAATGGTTGGGACCAGGCCAATCCC | 4 | ETGR* |

TABLE 3A-continued

| SEQ ID | identifier_position | position | modified_RNA | PAP length | PAP |
|---|---|---|---|---|---|
| | | | TTCTCCACTTACTATAATGGTTGGAACTAAACGTCA<br>CCAAGGTGGCTTCTCCTTGGCTGAGAG | | |
| 76 | NM_0003<br>65.4_555 | 555 | CCTTCAGCGCCTCGGCTCCAGCGCCATGGCGCCC<br>TCCAGGAAGTTCTTCGTTGGGGGAAACTGGAAGAT<br>GAACGGGCGGAAGCAGAGTCTGGGGGAGCTCAT<br>CGGCACTCTGAACGCGGCCAAGGTGCCGGCCGA<br>CACCGAGGTGGTTTGTGCTCCCCCTACTGCCTATA<br>TCGACTTCGCCCGGCAGAAGCTAGATCCCAAGATT<br>GCTGTGGCTGCGCAGAACTGCTACAAAGTGACTA<br>ATGGGGCTTTTACTGGGGAGATCAGCCCTGGCAT<br>GATCAAAGACTGCGGAGCCACGTGGGTGGTCCTG<br>GGGCACTCAGAGAGAAGGCATGTCTTTGGGGAGT<br>CAGATGAGCTGATTGGGCAGAAAGTGGCCCATGC<br>TCTGGCAGAGGGACTCGGAGTAATCGCCTGCATT<br>GGGGAGAAGCTAGATGAAAGGGAAGCTGGCATCA<br>CTGAGAAGGTTGTTTTCGAGCAGACAAAGGTCATC<br>GCAGATAACGTGAAGGACTGGAGCAAGGTCGTCC<br>TGGCCTATGAGCCTGTGTGGGCCATTGGTACTGG<br>CAAGACTGAACACCCCAACAGGCCCAGGAAGTAC<br>ACGAGAAGCTCCGAGGATGGCTGAAGTCCAACGT<br>CTCTGATGCGGTGGCTCAGAGCACCCGTATCATTT<br>ATGGAGGCTCTGTGACTGGGGCAACCTGCAAGGA<br>GCTGGCCAGCCAGCCTGATGTGGATGGCTTCCTT<br>GTGGGTGGTGCTTCCCTCAAGCCCGAATTCGTGG<br>ACATCATCAATGCCAAACAATGAGCCCCATCCATC<br>TTCCCTACCCTTCCTGCCAAGCCAGGGACTAAGCA<br>GCCCAGAAGCCCAGTAACTGCCCTTTCCCTGCATA<br>TGCTTCTGATGGTGTCATCTGCTCCTTCCTGTGGC<br>CTCATCCAAACTGTATCTTCCTTTACTGTTTATATCT<br>TCACCCTGTAATGGTTGGGACCAGGCCAATCCCTT<br>CTCCACTTACTATAATGGTTGGAACTAAACGTCAC<br>CAAGGTGGCTTCTCCTTGGCTGAGAG | 16 | EHPNRPRK<br>YTRSSEDG* |
| 77 | NM_0003<br>65.4_558 | 558 | CCTTCAGCGCCTCGGCTCCAGCGCCATGGCGCCC<br>TCCAGGAAGTTCTTCGTTGGGGGAAACTGGAAGAT<br>GAACGGGCGGAAGCAGAGTCTGGGGGAGCTCAT<br>CGGCACTCTGAACGCGGCCAAGGTGCCGGCCGA<br>CACCGAGGTGGTTTGTGCTCCCCCTACTGCCTATA<br>TCGACTTCGCCCGGCAGAAGCTAGATCCCAAGATT<br>GCTGTGGCTGCGCAGAACTGCTACAAAGTGACTA<br>ATGGGGCTTTTACTGGGGAGATCAGCCCTGGCAT<br>GATCAAAGACTGCGGAGCCACGTGGGTGGTCCTG<br>GGGCACTCAGAGAGAAGGCATGTCTTTGGGGAGT<br>CAGATGAGCTGATTGGGCAGAAAGTGGCCCATGC<br>TCTGGCAGAGGGACTCGGAGTAATCGCCTGCATT<br>GGGGAGAAGCTAGATGAAAGGGAAGCTGGCATCA<br>CTGAGAAGGTTGTTTTCGAGCAGACAAAGGTCATC<br>GCAGATAACGTGAAGGACTGGAGCAAGGTCGTCC<br>TGGCCTATGAGCCTGTGTGGGCCATTGGTACTGG<br>CAAGACTGCAAACCCCAACAGGCCCAGGAAGTAC<br>ACGAGAAGCTCCGAGGATGGCTGAAGTCCAACGT<br>CTCTGATGCGGTGGCTCAGAGCACCCGTATCATTT<br>ATGGAGGCTCTGTGACTGGGGCAACCTGCAAGGA<br>GCTGGCCAGCCAGCCTGATGTGGATGGCTTCCTT<br>GTGGGTGGTGCTTCCCTCAAGCCCGAATTCGTGG<br>ACATCATCAATGCCAAACAATGAGCCCCATCCATC<br>TTCCCTACCCTTCCTGCCAAGCCAGGGACTAAGCA<br>GCCCAGAAGCCCAGTAACTGCCCTTTCCCTGCATA<br>TGCTTCTGATGGTGTCATCTGCTCCTTCCTGTGGC<br>CTCATCCAAACTGTATCTTCCTTTACTGTTTATATCT<br>TCACCCTGTAATGGTTGGGACCAGGCCAATCCCTT<br>CTCCACTTACTATAATGGTTGGAACTAAACGTCAC<br>CAAGGTGGCTTCTCCTTGGCTGAGAG | 15 | NPNRPRKY<br>TRSSEDG* |
| 78 | NM_0003<br>65.4_712 | 712 | CCTTCAGCGCCTCGGCTCCAGCGCCATGGCGCCC<br>TCCAGGAAGTTCTTCGTTGGGGGAAACTGGAAGAT<br>GAACGGGCGGAAGCAGAGTCTGGGGGAGCTCAT<br>CGGCACTCTGAACGCGGCCAAGGTGCCGGCCGA<br>CACCGAGGTGGTTTGTGCTCCCCCTACTGCCTATA<br>TCGACTTCGCCCGGCAGAAGCTAGATCCCAAGATT<br>GCTGTGGCTGCGCAGAACTGCTACAAAGTGACTA<br>ATGGGGCTTTTACTGGGGAGATCAGCCCTGGCAT<br>GATCAAAGACTGCGGAGCCACGTGGGTGGTCCTG<br>GGGCACTCAGAGAGAAGGCATGTCTTTGGGGAGT<br>CAGATGAGCTGATTGGGCAGAAAGTGGCCCATGC<br>TCTGGCAGAGGGACTCGGAGTAATCGCCTGCATT<br>GGGGAGAAGCTAGATGAAAGGGAAGCTGGCATCA<br>CTGAGAAGGTTGTTTTCGAGCAGACAAAGGTCATC<br>GCAGATAACGTGAAGGACTGGAGCAAGGTCGTCC | 41 | SLWVVLPS<br>SPNSWTS<br>SMPNNEP<br>HPSSLPFL<br>PSQGLSSP<br>EAQ* |

TABLE 3A-continued

| SEQ ID | identifier_position | position | modified_RNA | PAP length | PAP |
|---|---|---|---|---|---|
| | | | TGGCCTATGAGCCTGTGTGGGCCATTGGTACTGG CAAGACTGCAACACCCCAACAGGCCCAGGAAGTA CACGAGAAGCTCCGAGGATGGCTGAAGTCCAACG TCTCTGATGCGGTGGCTCAGAGCACCCGTATCATT TATGGAGGCTCTGTGACTGGGGCAACCTGCAAGG AGCTGGCCAGCCAGCCTGATGTGGATGGTTCCTT GTGGGTGGTGCTTCCCTCAAGCCCGAATTCGTGG ACATCATCAATGCCAAACAATGAGCCCCATCCATC TTCCCTACCCTTCCTGCCAAGCCAGGGACTAAGCA GCCCAGAAGCCCAGTAACTGCCCTTTCCCTGCATA TGCTTCTGATGGTGTCATCTGCTCCTTCCTGTGGC CTCATCCAAACTGTATCTTCCTTTACTGTTTATATCT TCACCCTGTAATGGTTGGGACCAGGCCAATCCCTT CTCCACTTACTATAATGGTTGGAACTAAACGTCAC CAAGGTGGCTTCTCCTTGGCTGAGAG | | |
| 79 | NM_0003 73.1_502 | 502 | CTGCAGACGAGGCAGGGAGAGGCGGGACTTCGC GGGCGAGACGTCATCGGGGCGCCGGACGCCGGG GCGCCTGGGAGTTTGAAGCAAACAGGCAGCGCGC GACAATGGCGGTCGCTCGTGCAGCTTTGGGGCCA TTGGTGACGGGTCTGTACGACGTGCAGGCTTTCAA GTTTGGGGACTTCGTGCTGAAGAGCGGGCTTTCC TCCCCCATCTACATCGATCTGCGGGGCATCGTGTC TCGACCGCGTCTTCTGAGTCAGGTTGCAGATATTT TATTCCAAACTGCCCAAAATGCAGGCATCAGTTTT GACACCGTGTGTGGAGTGCCTTATACAGCTTTGCC ATTGGCTACAGTTATCTGTTCAACCAATCAAATTCC AATGCTTATTAGAAGGAAAGAAACAAAGGATTATG GAACTAAGCGTCTTGTAGAAGGAACTATTAATCCA GGAGAAACCTGTTTAATCATTGAAGATGTTGTCAC CAGTGGATCTAGTGTTTGGAAACTGTTGAGGTTCT TCAGAAGGAGGGCTTGAAGGTCACTGATGCCATA GTGCTGTTGGACAGAGAGCAGGGAGGCAAGGACA AGTTGCAGGCGCACGGGATCCGCCTCCACTCAGT GTGTACATTGTCCAAAATGCTGGAGATTCTCGAGC AGCAGAAAAAAGTTGATGCTGAGACAGTTGGGAG AGTGAAGAGGTTTATTCAGGAGAATGTCTTTGTGG CAGCGAATCATAATGGTTCTCCCCTTTCTATAAAG GAAGCACCCAAAGAACTCAGCTTCGGTGCACGTG CAGAGCTGCCCAGGATCCACCCAGTTGCATCGAA GCTTCTCAGGCTTATGCAAAAGAAGGAGACCAATC TGTGTCTATCTGCTGATGTTTCACTGGCCAGAGAG CTGTTGCAGCTAGCAGATGCTTTAGGACCTAGTAT CTGCATGCTGAAGACTCATGTAGATATTTTGAATG ATTTTACTCTGGATGTGATGAAGGAGTTGATAACTC TGGCAAAATGCCATGAGTTC | 11 | WKLLRFFR RRA* |
| 80 | NM_0003 89.2_378 | 378 | AGCTGAGGTGTGAGCAGCTGCCGAAGTCAGTTCC TTGTGGAGCCGGAGCTGGGCGCGGATTCGCCGA GGCACCGAGGCACTCAGAGGAGGCGCCATGTCA GAACCGGCTGGGGATGTCCGTCAGAACCCATGCG GCAGCAAGGCCTGCCGCCGCCTCTTCGGCCCAGT GGACAGCGAGCAGCTGAGCCGCGACTGTGATGC GCTAATGGCGGGCTGCATCCAGGAGGCCCGTGAG CGATGGAACTTCGACTTTGTCACCGAGACACCACT GGAGGGTGACTTCGCCTGGGAGCGTGTGCGGGG CCTTGGCCTGCCCAAGCTCTACCTTCCCACGGGG CCCCGGCGAGGCCGGGATGAGTTGGGAGGAGGC AGGCGGCTGGCACCTCACCTGCTCTGCTGCAGGG GACAGCAGAGGAAGACCATGTGGACCTGTCACTG TCTTGTACCCTTGTGCCTCGCTCAGGGGAGCAGG CTGAAGGGTCCCCAGGTGGACCTGGAGACTCTCA GGGTCGAAAACGGCGGCAGACCAGCATGACAGAT TTCTACCACTCCAAACGCCGGCTGATCTTCTCCAA GAGGAAGCCCTAATCCGCCCACAGGAAGCCTGCA GTCCTGGAAGCGCGAGGGCCTCAAAGGCCCGCTC TACATCTTCTGCCTTAGTCTCAGTTTGTGTGTCTTA ATTATTATTTGTGTTTTAATTTAAACACCTCCTCATG TACATACCCTGGCCGCCCCCTGCCCCCCAGCCTC TGGCATTAGAATTATTTAAACAAAAACTAGGCGGTT GAATGAGAGGTTCCTAAGAGTGCTGGGCATTTTTA TTTTATGAAATACTATTTAAAGCCTCCTCATCCCGT GTTCTCCTTTTCCTCTCTCCCGGAGGTTGGGTGGG CCGGCTTCATGCCAGCTACTTCCTCCTCCCCACTT GTCCGCTGGGTGGTACCCTCTGGAGGGGTGTGGC TCCTTCCCATCGCTGTCACAGGCGGTTATGAAATT CACCCCCTTTCCTGGACACTCAGACCTG | 52 | LAPHLLCC RGQQRKT MWTCHCL VPLCLAQG SRLKGPQV DLETLRVE NGGRPA* |

TABLE 3A-continued

| SEQ ID | identifier_position | position | modified_RNA | PAP length | PAP |
|---|---|---|---|---|---|
| 81 | NM_0004 22.1_583 | 583 | CTCCTCTCCAGCCCTTCTCCTGTGTGCCTGCCTCC TGCCGCCGCCACCATGACCACCTCCATCCGCCAG TTCACCTCCTCCAGCTCCATCAAGGGCTCCTCCGG CCTGGGGGGCGGCTCGTCCCGCACCTCCTGCCG GCTGTCTGGCGGCCTGGGTGCCGGCTCCTGCAG GCTGGGATCTGCTGGCGGCCTGGGCAGCACCCTC GGGGGTAGCAGCTACTCCAGCTGCTACAGCTTTG GCTCTGGTGGTGGCTATGGCAGCAGCTTTGGGGG TGTTGATGGGCTGCTGGCTGGAGGTGAGAAGGCC ACCATGCAGAACCTCAATGACCGCCTGGCCTCCTA CCTGGACAAGGTGCGTGCCCTGGAGGAGGCCAAC ACTGAGCTGGAGGTGAAGATCCGTGACTGGTACC AGAGGCAGGCCCCGGGGCCCGCCCGTGACTACA GCCAGTACTACAGGACAATTGAGGAGCTGCAGAA CAAGATCCTCACAGCCACCGTGGACAATGCCAAC ATCCTGCTACAGATTGACAATGCCCGTCTGGCTGC TGATGACTTCCGCACCAAGTTTGAGACAGAGCAG GCCCTGCGCCTGAGTGTGGAGGCCGACATCAATG GCTGCGCAGGGTGCTGGATGAGCTGACCCTGGCC AGAGCCGACCTGGAGATGCAGATTGAGAACCTCA AGGAGGAGCTGGCCTACCTGAAGAAGAACCACGA GGAGGAGATGAACGCCCTGCGAGGCCAGGTGGG TGGTGAGATCAATGTGGAGATGGACGCTGCCCCA GGCGTGGACCTGAGCCGCATCCTCAACGAGATGC GTGACCAGTATGAGAAGATGGCAGAGAAGAACCG CAAGGATGCCGAGGATTGGTTCTTCAGCAAGACA GAGGAACTGAACCGCGAGGTGGCCACCAACAGTG AGCTGGTGCAGAGTGGCAAGAGTGAGATCTCGGA GCTCCGGCGCACCATGCAGGCCTTGGAGATAGAG CTGCAGTCCCAGCTCAGCATGAAAGCATCCCTGG AGGG | 2 | CA* |
| 82 | NM_0004 22.1_616 | 616 | CTCCTCTCCAGCCCTTCTCCTGTGTGCCTGCCTCC TGCCGCCGCCACCATGACCACCTCCATCCGCCAG TTCACCTCCTCCAGCTCCATCAAGGGCTCCTCCGG CCTGGGGGGCGGCTCGTCCCGCACCTCCTGCCG GCTGTCTGGCGGCCTGGGTGCCGGCTCCTGCAG GCTGGGATCTGCTGGCGGCCTGGGCAGCACCCTC GGGGGTAGCAGCTACTCCAGCTGCTACAGCTTTG GCTCTGGTGGTGGCTATGGCAGCAGCTTTGGGGG TGTTGATGGGCTGCTGGCTGGAGGTGAGAAGGCC ACCATGCAGAACCTCAATGACCGCCTGGCCTCCTA CCTGGACAAGGTGCGTGCCCTGGAGGAGGCCAAC ACTGAGCTGGAGGTGAAGATCCGTGACTGGTACC AGAGGCAGGCCCCGGGGCCCGCCCGTGACTACA GCCAGTACTACAGGACAATTGAGGAGCTGCAGAA CAAGATCCTCACAGCCACCGTGGACAATGCCAAC ATCCTGCTACAGATTGACAATGCCCGTCTGGCTGC TGATGACTTCCGCACCAAGTTTGAGACAGAGCAG GCCCTGCGCCTGAGTGTGGAGGCCGACATCAATG GCTGCGCAGGGTGCTGGATGAGCTGACCCTGGCC AGAGCCGACCTGGAGATGCAGATTGAGAACCTCA AGGAGGAGCTGGCCTACCTGAAGAAGAACCACGA GGAGGAGATGAACGCCCTGCGAGGCCAGGTGGG TGGTGAGATCAATGTGGAGATGGACGCTGCCCCA GGCGTGGACCTGAGCCGCATCCTCAACGAGATGC GTGACCAGTATGAGAAGATGGCAGAGAAGAACCG CAAGGATGCCGAGGATTGGTTCTTCAGCAAGACA GAGGAACTGAACCGCGAGGTGGCCACCAACAGTG AGCTGGTGCAGAGTGGCAAGAGTGAGATCTCGGA GCTCCGGCGCACCATGCAGGCCTTGGAGATAGAG CTGCAGTCCCAGCTCAGCATGAAAGCATCCCTGG AGGG | 7 | CAGCWMS* |
| 83 | NM_0004 22.1_648 | 648 | CTCCTCTCCAGCCCTTCTCCTGTGTGCCTGCCTCC TGCCGCCGCCACCATGACCACCTCCATCCGCCAG TTCACCTCCTCCAGCTCCATCAAGGGCTCCTCCGG CCTGGGGGGCGGCTCGTCCCGCACCTCCTGCCG GCTGTCTGGCGGCCTGGGTGCCGGCTCCTGCAG GCTGGGATCTGCTGGCGGCCTGGGCAGCACCCTC GGGGGTAGCAGCTACTCCAGCTGCTACAGCTTTG GCTCTGGTGGTGGCTATGGCAGCAGCTTTGGGGG TGTTGATGGGCTGCTGGCTGGAGGTGAGAAGGCC ACCATGCAGAACCTCAATGACCGCCTGGCCTCCTA CCTGGACAAGGTGCGTGCCCTGGAGGAGGCCAAC ACTGAGCTGGAGGTGAAGATCCGTGACTGGTACC AGAGGCAGGCCCCGGGGCCCGCCCGTGACTACA GCCAGTACTACAGGACAATTGAGGAGCTGCAGAA CAAGATCCTCACAGCCACCGTGGACAATGCCAAC | 17 | EPTWRCR LRTSRRS WPT* |

TABLE 3A-continued

| SEQ ID | identifier_position | position | modified_RNA | PAP length | PAP |
|---|---|---|---|---|---|
| | | | ATCCTGCTACAGATTGACAATGCCCGTCTGGCTGC TGATGACTTCCGCACCAAGTTTGAGACAGAGCAG GCCCTGCGCCTGAGTGTGGAGGCCGACATCAATG GCCTGCGCAGGGTGCTGGATGAGCTGACCCTGGC AGAGCCGACCTGGAGATGCAGATTGAGAACCTCA AGGAGGAGCTGGCCTACCTGAAGAAGAACCACGA GGAGGAGATGAACGCCCTGCGAGGCCAGGTGGG TGGTGAGATCAATGTGGAGATGGACGCTGCCCCA GGCGTGGACCTGAGCCGCATCCTCAACGAGATGC GTGACCAGTATGAGAAGATGGCAGAGAAGAACCG CAAGGATGCCGAGGATTGGTTCTTCAGCAAGACA GAGGAACTGAACCGCGAGGTGGCCACCAACAGTG AGCTGGTGCAGAGTGGCAAGAGTGAGATCTCGGA GCTCCGGCGCACCATGCAGGCCTTGGAGATAGAG CTGCAGTCCCAGCTCAGCATGAAAGCATCCCTGG AGGG | | |
| 84 | NM_0004 22.1_696 | 696 | CTCCTCTCCAGCCCTTCTCCTGTGTGCCTGCCTCC TGCCGCCGCCACCATGACCACCTCCATCCGCCAG TTCACCTCCTCCAGCTCCATCAAGGGCTCCTCCGG CCTGGGGGGCGGCTCGTCCCGCACCTCCTGCCG GCTGTCTGGCGGCCTGGGTGCCGGCTCCTGCAG GCTGGGATCTGCTGGCGGCCTGGGCAGCACCCTC GGGGGTAGCAGCTACTCCAGCTGCTACAGCTTTG GCTCTGGTGGTGGCTATGGCAGCAGCTTTGGGGG TGTTGATGGGCTGCTGGCTGGAGGTGAGAAGGCC ACCATGCAGAACCTCAATGACCGCCTGGCCTCCTA CCTGGACAAGGTGCGTGCCCTGGAGGAGGCCAAC ACTGAGCTGGAGGTGAAGATCCGTGACTGGTACC AGAGGCAGGCCCCGGGGCCCGCCCGTGACTACA GCCAGTACTACAGGACAATTGAGGAGCTGCAGAA CAAGATCCTCACAGCCACCGTGGACAATGCCAAC ATCCTGCTACAGATTGACAATGCCCGTCTGGCTGC TGATGACTTCCGCACCAAGTTTGAGACAGAGCAG GCCCTGCGCCTGAGTGTGGAGGCCGACATCAATG GCCTGCGCAGGGTGCTGGATGAGCTGACCCTGGC CAGAGCCGACCTGGAGATGCAGATTGAGAACCTC AAGGAGGAGCTGGCTACCTGAAGAAGAACCACGA GGAGGAGATGAACGCCCTGCGAGGCCAGGTGGG TGGTGAGATCAATGTGGAGATGGACGCTGCCCCA GGCGTGGACCTGAGCCGCATCCTCAACGAGATGC GTGACCAGTATGAGAAGATGGCAGAGAAGAACCG CAAGGATGCCGAGGATTGGTTCTTCAGCAAGACA GAGGAACTGAACCGCGAGGTGGCCACCAACAGTG AGCTGGTGCAGAGTGGCAAGAGTGAGATCTCGGA GCTCCGGCGCACCATGCAGGCCTTGGAGATAGAG CTGCAGTCCCAGCTCAGCATGAAAGCATCCCTGG AGGG | 1 | T* |
| 85 | NM_0004 54.4_301 | 301 | GTTTGGGGCCAGAGTGGGCGAGGCGCGGAGGTC TGGCCTATAAAGTAGTCGCGGAGACGGGGTGCTG GTTTGCGTCGTAGTCTCCTGCAGCGTCGGGGTTT CCGTTGCAGTCCTCGGAACCAGGACCTCGGCGTG GCCTAGCGAGTTATGGCGACGAAGGCCGTGTGCG TGCTGAAGGGCGACGGCCCAGTGCAGGGCATCAT CAATTTCGAGCAGAAGGAAAGTAATGGACCAGTGA AGGTGTGGGGAAGCATTAAAGGACTGACTGAAGG CCTGCATGGATTCCATGTTCATGAGTTGGAGATAA TACAGCAGGCTGTACCAGTGCAGGTCCTCACTTTA ATCCTCTATCCAGAAAACACGGTGGGCCAAAGGAT GAAGAGAGGCATGTTGGAGACTTGGGCAATGTGA CTGCTGACAAAGATGGTGTGGCCGATGTGTCTATT GAAGATTCTGTGATCTCACTCTCAGGAGACCATTG CATCATTGGCCGCACACTGGTGGTCCATGAAAAAG CAGATGACTTGGGCAAAGGTGGAAATGAAGAAAG TACAAAGACAGGAAACGCTGGAAGTCGTTTGGCTT GTGGTGTAATTGGGATCGCCCAATAAACATTCCCT TGGATGTAGTCTGAGGCCCCTTAACTCATCTGTTA TCCTGCTAGCTGTAGAAATGTATCCTGATAAACATT AAACACTGTAATCTTAAAAGTGTAATTGTGTGACTT TTTCAGAGTTGCTTTAAAGTACCTGTAGTGAGAAA CTGATTTATGATCACTTGGAAGATTTGTATAGTTTT ATAAAACTCAGTTAAAATGTCTGTTTCAATGACCTG TATTTTGCCAGACTTAAATCACAGATGGGTATTAAA CTTGTCAGAATTTCTTTGTCATTCAAGCCTGTGAAT AAAAACCCTGTATGGCACTTATTATGAGGCTATTAA AAGAATCCAAATTCAAACTAAAAAAAAAAAAAAAA A | 37 | LEIIQQAVP VQVLTLILY PENTVGQ RMKRGML ETWAM* |

TABLE 3A-continued

| SEQ ID | identifier_ position | position | modified_RNA | PAP length | PAP |
|---|---|---|---|---|---|
| 86 | NM_0005 81.2_521 | 521 | CAGTTAAAAGGAGGCGCCTGCTGGCCTCCCCTTA CAGTGCTTGTTCGGGGCGCTCCGCTGGCTTCTTG GACAATTGCGCCATGTGTGCTGCTCGGCTAGCGG CGGCGGCGGCGGCGGCCCAGTCGGTGTATGCCT TCTCGGCGCCCCGCTGGCCGGCGGGGAGCCTG TGAGCCTGGGCTCCCTGCGGGGCAAGGTACTACT TATCGAGAATGTGGCGTCCCTCTGAGGCACCACG GTCCGGGACTACACCCAGATGAACGAGCTGCAGC GGCGCCTCGGACCCCGGGGCCTGGTGGTGCTCG GCTTCCCGTGCAACCAGTTTGGGCATCAGGAGAA CGCCAAGAACGAAGAGATTCTGAATTCCCTCAAGT ACGTCCGGCCTGGTGGTGGGTTCGAGCCCAACTT CATGCTCTTCGAGAAGTGCGAGGTGAACGGTGCG GGGGCGCACCCTCTCTTCGCCTTCCTGCGGGAGG CCCTGCCAGCTCCCAGCGACGACGCCACCGCGCT TATGACCGACCCAAGCTCATCACCTGGTCTCCGGT GTGTCGCAACGATGTTGCCTGGAACTTTGAGAAGT TCCTGGTGGGCCCTGACGGTGTGCCCCTACGCAG GTACAGCCGCCGCTTCCAGACCATTGACATCGAG CCTGACATCGAAGCCCTGCTGTCTCAAGGGCCCA GCTGTGCCTAGGGCGCCCCTCCTACCCCGGCTGC TTGGCAGTTGCAGTGCTGCTGTCTCGGGGGGGTT TTCATCTATGAGGGTGTTTCCTCTAAACCTACGAG GGAGGAACACCTGATCTTACAGAAAATACCACCTC GAGATGGGTGCTGGTCCTGTTGATCCCAGTCTCTG CCAGACCAAGGCGAGTTTCCCCACTAATAAAGTGC CGGGTGTCAGCAGAAAAAAAAAAAAAAAAAAA | 91 | SSSPGLRC VATMLPGT LRSSWWA LTVCPYAG TAAASRPL TSSLTSKP CCLKGPAV PRAPLLPR LLGSCSAA VSGGFSS MRVFPLNL RGRNT* |
| 87 | NM_0006 61.4_279 | 279 | ACGCGATACAAGTACGTAATGACGACAGACGTTCT TTCTTTGCTGCGTCTACTGCGAGAATGAAGACTAT TCTCAGCAATCAGACTGTCGACATTCCAGAAAATG TCGACATTACTCTGAAGGGACGCACAGTTATCGTG AAGGGCCCCAGAGGAACCCTGCGGAGGGACTTCA ATCACATCAATGTAGAACTCAGCCTTCTTGGAAAG AAAAAAAAGAGGCTCCGGGTTGACAAATGGTGGG GTAACAGAAAGGAACTGGCTACCGTTCGGACTATT GTAGTCATGTACAGAACATGATCAAGGGTGTTACA CTGGGCTTCCGTTACAAGATGAGGTCTGTGTATGC TCACTTCCCCATCAACGTTGTTATCCAGGAGAATG GGTCTCTTGTTGAAATCCGAAATTTCTTGGGTGAA AAATATATCCGCAGGGTTCGGATGAGACCAGGTGT TGCTTGTTCAGTATCTCAAGCCCAGAAAGATGAAT TAATCCTTGAAGGAAATGACATTGAGCTTGTTTCAA ATTCAGCGGCTTTGATTCAGCAAGCCACAACAGTT AAAAACAAGGATATCAGGAAATTTTTGGATGGTAT CTATGTCTCTGAAAAAGGAACTGTTCAGCAGGCTG ATGAATAAGATCTAAGAGTTACCTGGCTACAGAAA GAAGATGCCAGATGACACTTAAGACCTACTTGTGA TATTTAAATGATGCAATAAAAGACCTATTGATTTGG ACCTTCTTCTTAAAAAAAAAAAAAAAAAAAA | 6 | VVMYRT* |
| 88 | NM_0006 61.4_455 | 455 | ACGCGATACAAGTACGTAATGACGACAGACGTTCT TTCTTTGCTGCGTCTACTGCGAGAATGAAGACTAT TCTCAGCAATCAGACTGTCGACATTCCAGAAAATG TCGACATTACTCTGAAGGGACGCACAGTTATCGTG AAGGGCCCCAGAGGAACCCTGCGGAGGGACTTCA ATCACATCAATGTAGAACTCAGCCTTCTTGGAAAG AAAAAAAAGAGGCTCCGGGTTGACAAATGGTGGG GTAACAGAAAGGAACTGGCTACCGTTCGGACTATT TGTAGTCATGTACAGAACATGATCAAGGGTGTTAC ACTGGGCTTCCGTTACAAGATGAGGTCTGTGTATG CTCACTTCCCCATCAACGTTGTTATCCAGGAGAAT GGGTCTCTTGTTGAAATCCGAAATTTCTTGGGTGA AAAATATATCCGCAGGGTTCGGATGAGACCAGGT GTGCTTGTTCAGTATCTCAAGCCCAGAAAGATGAA TTAATCCTTGAAGGAAATGACATTGAGCTTGTTTCA AATTCAGCGGCTTTGATTCAGCAAGCCACAACAGT TAAAAACAAGGATATCAGGAAATTTTTGGATGGTAT CTATGTCTCTGAAAAAGGAACTGTTCAGCAGGCTG ATGAATAAGATCTAAGAGTTACCTGGCTACAGAAA GAAGATGCCAGATGACACTTAAGACCTACTTGTGA TATTTAAATGATGCAATAAAAGACCTATTGATTTGG ACCTTCTTCTTAAAAAAAAAAAAAAAAAAAA | 11 | LVQYLKPR KMN* |
| 89 | NM_0006 61.4_535 | 535 | ACGCGATACAAGTACGTAATGACGACAGACGTTCT TTCTTTGCTGCGTCTACTGCGAGAATGAAGACTAT TCTCAGCAATCAGACTGTCGACATTCCAGAAAATG TCGACATTACTCTGAAGGGACGCACAGTTATCGTG AAGGGCCCCAGAGGAACCCTGCGGAGGGACTTCA ATCACATCAATGTAGAACTCAGCCTTCTTGGAAAG AAAAAAAAGAGGCTCCGGGTTGACAAATGGTGGG | 1 | V* |

TABLE 3A-continued

| SEQ ID | identifier_position | position | modified_RNA | PAP length | PAP |
|---|---|---|---|---|---|
| | | | GTAACAGAAAGGAACTGGCTACCGTTCGGACTATT<br>TGTAGTCATGTACAGAACATGATCAAGGGTGTTAC<br>ACTGGGCTTCCGTTACAAGATGAGGTCTGTGTATG<br>CTCACTTCCCCATCAACGTTGTTATCCAGGAGAAT<br>GGGTCTCTTGTTGAAATCCGAAATTTCTTGGGTGA<br>AAAATATATCCGCAGGGTTCGGATGAGACCAGGT<br>GTTGCTTGTTCAGTATCTCAAGCCCAGAAAGATGA<br>ATTAATCCTTGAAGGAAATGACATTGAGCTTGTTTC<br>AAATTCAGCGGTTTGATTCAGCAAGCCACAACAGT<br>TAAAAACAAGGATATCAGGAAATTTTTGGATGGTAT<br>CTATGTCTCTGAAAAAGGAACTGTTCAGCAGGCTG<br>ATGAATAAGATCTAAGAGTTACCTGGCTACAGAAA<br>GAAGATGCCAGATGACACTTAAGACCTACTTGTGA<br>TATTTAAATGATGCAATAAAAGACCTATTGATTTGG<br>ACCTTCTTCTTAAAAAAAAAAAAAAAAAAAA | | |
| 90 | NM_0006 61.4_538 | 538 | ACGCGATACAAGTACGTAATGACGACAGACGTTCT<br>TTCTTTGCTGCGTCTACTGCGAGAATGAAGACTAT<br>TCTCAGCAATCAGACTGTCGACATTCCAGAAAATG<br>TCGACATTACTCTGAAGGGACGCACAGTTATCGTG<br>AAGGGCCCCAGAGGAACCCTGCGGAGGGACTTCA<br>ATCACATCAATGTAGAACTCAGCCTTCTTGGAAAG<br>AAAAAAAAGAGGCTCCGGGTTGACAAATGGTGGG<br>GTAACAGAAAGGAACTGGCTACCGTTCGGACTATT<br>TGTAGTCATGTACAGAACATGATCAAGGGTGTTAC<br>ACTGGGCTTCCGTTACAAGATGAGGTCTGTGTATG<br>CTCACTTCCCCATCAACGTTGTTATCCAGGAGAAT<br>GGGTCTCTTGTTGAAATCCGAAATTTCTTGGGTGA<br>AAAATATATCCGCAGGGTTCGGATGAGACCAGGT<br>GTTGCTTGTTCAGTATCTCAAGCCCAGAAAGATGA<br>ATTAATCCTTGAAGGAAATGACATTGAGCTTGTTTC<br>AAATTCAGCGGCTTGATTCAGCAAGCCACAACAGT<br>TAAAAACAAGGATATCAGGAAATTTTTGGATGGTAT<br>CTATGTCTCTGAAAAAGGAACTGTTCAGCAGGCTG<br>ATGAATAAGATCTAAGAGTTACCTGGCTACAGAAA<br>GAAGATGCCAGATGACACTTAAGACCTACTTGTGA<br>TATTTAAATGATGCAATAAAAGACCTATTGATTTGG<br>ACCTTCTTCTTAAAAAAAAAAAAAAAAAAAA | 0 | * |
| 91 | NM_0006 61.4_586 | 586 | ACGCGATACAAGTACGTAATGACGACAGACGTTCT<br>TTCTTTGCTGCGTCTACTGCGAGAATGAAGACTAT<br>TCTCAGCAATCAGACTGTCGACATTCCAGAAAATG<br>TCGACATTACTCTGAAGGGACGCACAGTTATCGTG<br>AAGGGCCCCAGAGGAACCCTGCGGAGGGACTTCA<br>ATCACATCAATGTAGAACTCAGCCTTCTTGGAAAG<br>AAAAAAAAGAGGCTCCGGGTTGACAAATGGTGGG<br>GTAACAGAAAGGAACTGGCTACCGTTCGGACTATT<br>TGTAGTCATGTACAGAACATGATCAAGGGTGTTAC<br>ACTGGGCTTCCGTTACAAGATGAGGTCTGTGTATG<br>CTCACTTCCCCATCAACGTTGTTATCCAGGAGAAT<br>GGGTCTCTTGTTGAAATCCGAAATTTCTTGGGTGA<br>AAAATATATCCGCAGGGTTCGGATGAGACCAGGT<br>GTTGCTTGTTCAGTATCTCAAGCCCAGAAAGATGA<br>ATTAATCCTTGAAGGAAATGACATTGAGCTTGTTTC<br>AAATTCAGCGGCTTTGATTCAGCAAGCCACAACAG<br>TTAAAAACAAGGATATCAGGAAATTTTGGATGGTAT<br>CTATGTCTCTGAAAAAGGAACTGTTCAGCAGGCTG<br>ATGAATAAGATCTAAGAGTTACCTGGCTACAGAAA<br>GAAGATGCCAGATGACACTTAAGACCTACTTGTGA<br>TATTTAAATGATGCAATAAAAGACCTATTGATTTGG<br>ACCTTCTTCTTAAAAAAAAAAAAAAAAAAAA | 19 | WMVSMSL<br>KKELFSRL<br>MNKI* |
| 92 | NM_0006 71.3_387 | 387 | GCGCTCGCCACGCCCATGCCTCCGTCGCTGCGCG<br>GCCCACCCCGGATGTCAGCCCCCGCGCCGACC<br>AGAATCCGTGAACATGGCGAACGAGGTTATCAAGT<br>GCAAGGCTGCAGTTGCTTGGGAGGCTGGAAAGCC<br>TCTCTCCATAGAGGAGATAGAGGTGGCACCCCCA<br>AAGGCTCATGAAGTTCGAATCAAGATCATTGCCAC<br>TGCGGTTTGCCACACCGATGCCTATACCCTGAGTG<br>GAGCTGATCCTGAGGGTTGTTTTCCAGTGATCTTG<br>GGACATGAAGGTGCTGGAATTGTGGAAAGTGTTG<br>GTGAGGGAGTTACTAAGCTGAAGGCGGGTGACAC<br>TGTCATCCCACTTTACATCCCACAGTGTGGAGAAT<br>GCAAATTGTCTAAATCCTAAAACTAACCTTTGCCA<br>GAAGATAAGAGTCACTCAAGGGAAAGGATTAATGC<br>CAGATGGTACCAGCAGATTTACTTGCAAAGGAAAG<br>ACAATTTTGCATTACATGGGAACCAGCACATTTTCT<br>GAATACACAGTTGTGGCTGATATCTCTGTTGCTAA<br>AATAGATCCTTTAGCACCTTTGGATAAAGTCTGCCT<br>TCTAGGTTGTGGCATTTCAACCGGTTATGGTGCTG | 1 | V* |

TABLE 3A-continued

| SEQ ID | identifier_position | position | modified_RNA | PAP length | PAP |
|---|---|---|---|---|---|
| | | | CTGTGAACACTGCCAAGTTGGAGCCTGGCTCTGTT<br>TGTGCCGTCTTTGGTCTGGGAGGAGTCGGATTGG<br>CAGTTATCATGGGCTGTAAAGTGGCTGGTGCTTCC<br>CGGATCATTGGTGTGGACATCAATAAAGATAAATT<br>TGCAAGGGCCAAAGAGTTTGGAGCCACTGAATGT<br>ATTAACCCTCAGGATTTTAGTAAACCCATCCAGGA<br>AGTGCTCATTGAGATGACCGATGGAGGAGTGGAC<br>TATTCCTTTGAATGTATTGGTAATGTGAAGGTCATG<br>AGAGCAGCACTTGAGGCATGTCACAAGGGCTGGG<br>GCGTCAGCGTCGTGGTTGGAGTAGCTGCTTCAGG<br>TGAAGAAATTGCCACTCGTCCATTCCAGCTGGTAA<br>CAGGTCGCACATGGAAA | | |
| 93 | NM_0007 00.1_687 | 687 | AGTGTGAAATCTTCAGAGAAGAATTTCTCTTTAGTT<br>CTTTGCAAGAAGGTAGAGATAAAGACACTTTTTCA<br>AAAATGGCAATGGTATCAGAATTCCTCAAGCAGGC<br>CTGGTTTATTGAAAATGAAGAGCAGGAATATGTTC<br>AAACTGTGAAGTCATCCAAAGGTGGTCCCGGATCA<br>GCGGTGAGCCCCTATCCTACCTTCAATCCATCCTC<br>GGATGTCGCTGCCTTGCATAAGGCCATAATGGTTA<br>AAGGTGTGGATGAAGCAACCATCATTGACATTCTA<br>ACTAAGCGAAACAATGCACAGCGTCAACAGATCAA<br>AGCAGCATATCTCCAGGAAACAGGAAAGCCCCTG<br>GATGAAACACTTAAGAAAGCCCTTACAGGTCACCT<br>TGAGGAGGTTGTTTAGCTCTGCTAAAAACTCCAG<br>CGCAATTTGATGCTGATGAACTTCGTGCTGCCATG<br>AAGGGCCTTGGAACTGATGAAGATACTCTAATTGA<br>GATTTTGGCATCAAGAACTAACAAAGAAATCAGAG<br>ACATTAACAGGGTCTACAGAGAGGAACTGAAGAGA<br>GATCTGGCCAAAGACATAACCTCAGACACATCTGG<br>AGATTTTCGGAACGCTTTGCTTTCTCTTGCTAAGG<br>GTGACCGATCTGAGGACTTTGGTGTGAATGAAGAC<br>TTGGCTGATTCAGATGCCAGGCCTTGTATGAAGCA<br>GGAGAAAGGAGAAAGGGGACAGACGTAAACGTGT<br>TCAATACCATCCTTACCACCAGAAGCTATCCACAA<br>CTTCGCAGAGTGTTTCAGAAATACACCAAGTACAG<br>TAAGCATGACATGAACAAAGTTCTGGACCTGGAGT<br>TGAAAGGTGACATTGAGAAATGCCTCACAGCTATC<br>GTGAAGTGCGCCACAAGCAAACCAGCTTTCTTTGC<br>AGAGAAGCTTCATCAAGCCATGAAAGGTGTTGGAA<br>CTCGCCATAAGGCATTGATCAGGATTATGGTTTCC<br>CGTTCTGAAATTGACATGAATGATATCAAAGCATTC<br>TATCAGAAG | 13 | PCMKQEK<br>GERGQT* |
| 94 | NM_0007 01.6_205 3 | 2053 | ATTTTAGGAAGTGAGGAGGAGGCGCGGGCTGGAG<br>CTGCGGCGGGGTCTGGGGCGCAGAGCAGCGGCG<br>GGAGGAGGCGGACACGTGGCAACAGCGGTAGCA<br>GCCCGGGCGGCGGCAGCAACAGCGGCGGCGGCA<br>TCGGCCCGAGCCGCCGGCCGCCCTCCCACCCTC<br>CCGCCCCGCGGCAGCCCTAGCTCCCTCCACTTGG<br>CTCCCCTGGTCCCGCTCGCTCGGCCGGGAGCTGC<br>TCTGTGCTTTTCTCTCTGATTCTCCAGCGACAGGA<br>CCCGGCGCCGGGCACTGAGCACCGCCACCATGG<br>GGAAGGGGGTTGGACGTGATAAGTATGAGCCTGC<br>AGCTGTTTCAGAACAAGGTGATAAAAAGGGCAAAA<br>AGGGCAAAAAAGACAGGGACATGGATGAACTGAA<br>GAAAGAAGTTTCTATGGATGATCATAAACTTAGCCT<br>TGATGAACTTCATCGTAAATATGGAACAGACTTGA<br>GCCGGGGATTAACATCTGCTCGTGCAGCTGAGAT<br>CCTGGCGCGAGATGGTCCCAACGCCCTCACTCCC<br>CCTCCCACTACTCCTGAATGGATCAAGTTTTGTCG<br>GCAGCTCTTTGGGGGGTTCTCAATGTTACTGTGGA<br>TTGGAGCGATTCTTTGTTTCTTGGCTTATAGCATCC<br>AAGCTGCTACAGAAGAGGAACCTCAAAACGATAAT<br>CTGTACCTGGGTGTGGTGCTATCAGCCGTTGTAAT<br>CATAACTGGTTGCTTCTCCTACTATCAAGAAGCTAA<br>AAGTTCAAAGATCATGGAATCCTTCAAAAACATGG<br>TCCCTCAGCAAGCCCTTGTGATTCGAAATGGTGAG<br>AAAATGAGCATAAATGCGGAGGAAGTTGTGGTTGG<br>GGATCTGGTGGAAGTAAAAGGAGGAGACCGAATT<br>CCTGCTGACCTCAGAATCATATCTGCAAATGGCTG<br>CAAGGTGGATAACTCCTCGCTCACTGGTGAATCAG<br>AACCCCAGACTAGGTCTCCAGATTTCACAAATGAA<br>AACCCCCTGGAGACGAGGAACATT | 6 | LLGSSP* |
| 95 | NM_0007 01.6_209 2 | 2092 | ATTTTAGGAAGTGAGGAGGAGGCGCGGGCTGGAG<br>CTGCGGCGGGGTCTGGGGCGCAGAGCAGCGGCG<br>GGAGGAGGCGGACACGTGGCAACAGCGGTAGCA<br>GCCCGGGCGGCGGCAGCAACAGCGGCGGCGGCA<br>TCGGCCCGAGCCGCCGGCCGCCCTCCCACCCTC | 56 | FLMPWAN<br>VEVLELRS<br>SWSQETIQ<br>SQLKLLPK<br>VWASSQK |

TABLE 3A-continued

| SEQ ID | identifier_ position | position | modified_RNA | PAP length | PAP |
|---|---|---|---|---|---|
| | | | CCGCCCCGCGGCAGCCCTAGCTCCCTCCACTTGG<br>CTCCCCTGGTCCCGCTCGCTCGGCCGGGAGCTGC<br>TCTGTGCTTTTCTCTCTGATTCTCCAGCGACAGGA<br>CCCGGCGCCGGGCACTGAGCACCGCCACCATGG<br>GGAAGGGGGTTGGACGTGATAAGTATGAGCCTGC<br>AGCTGTTTCAGAACAAGGTGATAAAAAGGGCAAAA<br>AGGGCAAAAAAGACAGGGACATGGATGAACTGAA<br>GAAAGAAGTTTCTATGGATGATCATAAACTTAGCCT<br>TGATGAACTTCATCGTAAATATGGAACAGACTTGA<br>GCCGGGGATTAACATCTGCTCGTGCAGCTGAGAT<br>CCTGGCGCGAGATGGTCCCAACGCCCTCACTCCC<br>CCTCCCACTACTCCTGAATGGATCAAGTTTTGTCG<br>GCAGCTCTTTGGGGGGTTCTCAATGTTACTGTGGA<br>TTGGAGCGATTCTTTGTTTCTTGGCTTATAGCATCC<br>AAGCTGCTACAGAAGAGGAACCTCAAAACGATAAT<br>CTGTACCTGGGTGTGGTGCTATCAGCCGTTGTAAT<br>CATAACTGGTTGCTTCTCCTACTATCAAGAAGCTAA<br>AAGTTCAAAGATCATGGAATCCTTCAAAAACATGG<br>TCCCTCAGCAAGCCCTTGTGATTCGAAATGGTGAG<br>AAAATGAGCATAAATGCGGAGGAAGTTGTGGTTGG<br>GGATCTGGTGGAAGTAAAAGGAGGAGACCGAATT<br>CCTGCTGACCTCAGAATCATATCTGCAAATGGCTG<br>CAAGGTGGATAACTCCTCGCTCACTGGTGAATCAG<br>AACCCCAGACTAGGTCTCCAGATTTCACAAATGAA<br>AACCCCCTGGAGACGAGGAACATT | | AMRPWKT<br>LLPASTSQ<br>SAR* |
| 96 | NM_0007<br>01.6_227<br>3 | 2273 | ATTTTAGGAAGTGAGGAGGAGGCGCGGGCTGGAG<br>CTGCGGCGGGGTCTGGGGCGCAGAGCAGCGGCG<br>GGAGGAGGCGGACACGTGGCAACAGCGGTAGCA<br>GCCCGGGCGGCGGCAGCAACAGCGGCGGCGGCA<br>TCGGCCCGAGCCGCCGGCCGCCCTCCCACCCTC<br>CCGCCCCGCGGCAGCCCTAGCTCCCTCCACTTGG<br>CTCCCCTGGTCCCGCTCGCTCGGCCGGGAGCTGC<br>TCTGTGCTTTTCTCTCTGATTCTCCAGCGACAGGA<br>CCCGGCGCCGGGCACTGAGCACCGCCACCATGG<br>GGAAGGGGGTTGGACGTGATAAGTATGAGCCTGC<br>AGCTGTTTCAGAACAAGGTGATAAAAAGGGCAAAA<br>AGGGCAAAAAAGACAGGGACATGGATGAACTGAA<br>GAAAGAAGTTTCTATGGATGATCATAAACTTAGCCT<br>TGATGAACTTCATCGTAAATATGGAACAGACTTGA<br>GCCGGGGATTAACATCTGCTCGTGCAGCTGAGAT<br>CCTGGCGCGAGATGGTCCCAACGCCCTCACTCCC<br>CCTCCCACTACTCCTGAATGGATCAAGTTTTGTCG<br>GCAGCTCTTTGGGGGGTTCTCAATGTTACTGTGGA<br>TTGGAGCGATTCTTTGTTTCTTGGCTTATAGCATCC<br>AAGCTGCTACAGAAGAGGAACCTCAAAACGATAAT<br>CTGTACCTGGGTGTGGTGCTATCAGCCGTTGTAAT<br>CATAACTGGTTGCTTCTCCTACTATCAAGAAGCTAA<br>AAGTTCAAAGATCATGGAATCCTTCAAAAACATGG<br>TCCCTCAGCAAGCCCTTGTGATTCGAAATGGTGAG<br>AAAATGAGCATAAATGCGGAGGAAGTTGTGGTTGG<br>GGATCTGGTGGAAGTAAAAGGAGGAGACCGAATT<br>CCTGCTGACCTCAGAATCATATCTGCAAATGGCTG<br>CAAGGTGGATAACTCCTCGCTCACTGGTGAATCAG<br>AACCCCAGACTAGGTCTCCAGATTTCACAAATGAA<br>AACCCCCTGGAGACGAGGAACATT | 5 | MPRPA* |
| 97 | NM_0008<br>01.2_164 | 164 | GCGACGCGCCGAGGTACTAGGCAGAGCCGTGGA<br>ACCGCCGCCAGGTCGCTGTTGGTCACGCCGCCC<br>GTCGCGCCGCCCGCCCGCTCAGCGTCCGCCGCC<br>GCCATGGGAGTGCAGGTGGAAACCATCTCCCCAG<br>GAGACGGGCGCACCTTCCCCAAGCGCGGCAGAC<br>CTGCGTGGTGCACTACACCGGGATGCTTGAAGAT<br>GGAAAGAAATTTGATTCCTCCCGGGACAGAAACAA<br>GCCCTTTAAGTTTATGCTAGGCAAGCAGGAGGTGA<br>TCCGAGGCTGGGAAGAAGGGGTTGCCCAGATGAG<br>TGTGGGTCAGAGAGCCAAACTGACTATATCTCCAG<br>ATTATGCCTATGGTGCCACTGGGCACCCAGGCATC<br>ATCCCACCACATGCCACTCTCGTCTTCGATGTGGA<br>GCTTCTAAAACTGGAATGACAGGAATGGCCTCCTC<br>CCTTAGCTCCCTGTTCTTGGATCTGCCATGGAGGG<br>ATCTGGTGCCTCCAGACATGTGCACATGAGTCCAT<br>ATGGAGCTTTTCCTGATGTTCCACTCCACTTTGTAT<br>AGACATCTGCCCTGACTGAATGTGTTCTGTCACTC<br>AGCTTTGCTTCCGACACCTCTGTTTCCTCTTCCCCT<br>TTCTCCTCGTATGTGTGTTTACCTAAACTATATGCC<br>ATAAACCTCAAGTTATTCATTTTATTTTGTTTTCATT<br>TTGGGGTGAAGATTCAGTTTCAGTCTTTTGGATATA<br>GGTTTCCAATTAAGTACATGGTCAAGTATTAACAG | 30 | RPAWCTT<br>PGCLKME<br>RNLIPPGT<br>ETSPLSLC* |

TABLE 3A-continued

| SEQ ID | identifier_position | position | modified_RNA | PAP length | PAP |
|---|---|---|---|---|---|
| | | | CACAAGTGGTAGGTTAACATTAGAATAGGAATTGG<br>TGTTGGGGGGGGGGTTTGCAAGAATATTTTATTTT<br>AATTTTTTGGATGAAATTTTTATCTATTATATATTAA<br>ACATTCTTGCTGCTGCGCTGCAAAGCCATAGCAGA<br>TTTGAGGCGCTGTTGAGGACTGAATTACTCTCCAA<br>GTTGAGAGATGTCTTTGGGTTAAATTAAAAGCCCT<br>ACCTAAAACTGAGGTGGGGATGGGGAGAGCCTTT<br>GCCTCCACCATT | | |
| 98 | NM_0008<br>52.2_445 | 445 | GGAGTTTCGCCGCCGCAGTCTTCGCCACCATGCC<br>GCCCTACACCGTGGTCTATTTCCCAGTTCGAGGCC<br>GCTGCGCGGCCCTGCGCATGCTGCTGGCAGATCA<br>GGGCCAGAGCTGGAAGGAGGAGGTGGTGACCGT<br>GGAGACGTGGCAGGAGGGCTCACTCAAAGCCTCC<br>TGCCTATACGGGCAGCTCCCCAAGTTCCAGGACG<br>GAGACCTCACCCTGTACCAGTCCAATACCATCCTG<br>CGTCACCTGGGCCGCACCCTTGGGCTCTATGGGA<br>AGGACCAGCAGGAGGCAGCCCTGGTGGACATGGT<br>GAATGACGGCGTGGAGGACCTCCGCTGCAAATAC<br>ATCTCCCTCATCTACACCAACTATGAGGCGGGCAA<br>GGATGACTATGTGAAGGCACTGCCCGGGCAACTG<br>AAGCCTTTTGAGACCCTGCTGTCCCAGAACCAGGA<br>GGCAAGACCTTCATTGTGGGAGACCAGATCTCCTT<br>CGCTGACTACAACCTGCTGGACTTGCTGCTGATCC<br>ATGAGGTCCTAGCCCCTGGCTGCCTGGATGCGTT<br>CCCCCTGCTCTCAGCATATGTGGGGCGCCTCAGC<br>GCCCGGCCCAAGCTCAAGGCCTTCCTGGCCTCCC<br>CTGAGTACGTGAACCTCCCCATCAATGGCAACGG<br>GAAACAGTGAGGGTTGGGGGGACTCTGAGCGGG<br>AGGCAGAGTTTGCCTTCCTTTCTCCAGGACCAATA<br>AAATTTCTAAGAGAGCT | 22 | EARPSLWE<br>TRSPSLTT<br>TCWTCC* |
| 99 | NM_0008<br>52.2_540 | 540 | GGAGTTTCGCCGCCGCAGTCTTCGCCACCATGCC<br>GCCCTACACCGTGGTCTATTTCCCAGTTCGAGGCC<br>GCTGCGCGGCCCTGCGCATGCTGCTGGCAGATCA<br>GGGCCAGAGCTGGAAGGAGGAGGTGGTGACCGT<br>GGAGACGTGGCAGGAGGGCTCACTCAAAGCCTCC<br>TGCCTATACGGGCAGCTCCCCAAGTTCCAGGACG<br>GAGACCTCACCCTGTACCAGTCCAATACCATCCTG<br>CGTCACCTGGGCCGCACCCTTGGGCTCTATGGGA<br>AGGACCAGCAGGAGGCAGCCCTGGTGGACATGGT<br>GAATGACGGCGTGGAGGACCTCCGCTGCAAATAC<br>ATCTCCCTCATCTACACCAACTATGAGGCGGGCAA<br>GGATGACTATGTGAAGGCACTGCCCGGGCAACTG<br>AAGCCTTTTGAGACCCTGCTGTCCCAGAACCAGG<br>GAGGCAAGACCTTCATTGTGGGAGACCAGATCTC<br>CTTCGCTGACTACAACCTGCTGGACTTGCTGCTGA<br>TCCATGAGGTCCTAGCCCCTGGCTGCTGGATGCG<br>TTCCCCCTGCTCTCAGCATATGTGGGGCGCCTCA<br>GCGCCCGGCCCAAGCTCAAGGCCTTCCTGGCCTC<br>CCCTGAGTACGTGAACCTCCCCATCAATGGCAAC<br>GGGAAACAGTGAGGGTTGGGGGGACTCTGAGCG<br>GGAGGCAGAGTTTGCCTTCCTTTCTCCAGGACCAA<br>TAAAATTTCTAAGAGAGCT | 29 | WMRSPCS<br>QHMWGAS<br>APGPSSRP<br>SWPPLST* |
| 100 | NM_0008<br>52.2_614 | 614 | GGAGTTTCGCCGCCGCAGTCTTCGCCACCATGCC<br>GCCCTACACCGTGGTCTATTTCCCAGTTCGAGGCC<br>GCTGCGCGGCCCTGCGCATGCTGCTGGCAGATCA<br>GGGCCAGAGCTGGAAGGAGGAGGTGGTGACCGT<br>GGAGACGTGGCAGGAGGGCTCACTCAAAGCCTCC<br>TGCCTATACGGGCAGCTCCCCAAGTTCCAGGACG<br>GAGACCTCACCCTGTACCAGTCCAATACCATCCTG<br>CGTCACCTGGGCCGCACCCTTGGGCTCTATGGGA<br>AGGACCAGCAGGAGGCAGCCCTGGTGGACATGGT<br>GAATGACGGCGTGGAGGACCTCCGCTGCAAATAC<br>ATCTCCCTCATCTACACCAACTATGAGGCGGGCAA<br>GGATGACTATGTGAAGGCACTGCCCGGGCAACTG<br>AAGCCTTTTGAGACCCTGCTGTCCCAGAACCAGG<br>GAGGCAAGACCTTCATTGTGGGAGACCAGATCTC<br>CTTCGCTGACTACAACCTGCTGGACTTGCTGCTGA<br>TCCATGAGGTCCTAGCCCCTGGCTGCCTGGATGC<br>GTTCCCCCTGCTCTCAGCATATGTGGGGCGCCTC<br>AGCGCCCGGCCCAAGCTCAAGGCCTTCCTGGCTC<br>CCCTGAGTACGTGAACCTCCCCATCAATGGCAAC<br>GGGAAACAGTGAGGGTTGGGGGGACTCTGAGCG<br>GGAGGCAGAGTTTGCCTTCCTTTCTCCAGGACCAA<br>TAAAATTTCTAAGAGAGCT | 4 | PLST* |
| 101 | NM_0008<br>52.2_81 | 81 | GGAGTTTCGCCGCCGCAGTCTTCGCCACCATGCC<br>GCCCTACACCGTGGTCTATTTCCCAGTTCGAGGCC<br>GCTGCGCGGCCTGCGCATGCTGCTGGCAGATCAG | 16 | CACCWQIR<br>ARAGRRR<br>W* |

TABLE 3A-continued

| SEQ ID | identifier_position | position | modified_RNA | PAP length | PAP |
|---|---|---|---|---|---|
| | | | GGCCAGAGCTGGAAGGAGGAGGTGGTGACCGTG GAGACGTGGCAGGAGGGCTCACTCAAAGCCTCCT GCCTATACGGGCAGCTCCCCAAGTTCCAGGACGG AGACCTCACCCTGTACCAGTCCAATACCATCCTGC GTCACCTGGGCCGCACCCTTGGGCTCTATGGGAA GGACCAGCAGGAGGCAGCCCTGGTGGACATGGT GAATGACGGCGTGGAGGACCTCCGCTGCAAATAC ATCTCCCTCATCTACACCAACTATGAGGCGGGCAA GGATGACTATGTGAAGGCACTGCCCGGGCAACTG AAGCCTTTTGAGACCCTGCTGTCCCAGAACCAGG GAGGCAAGACCTTCATTGTGGGAGACCAGATCTC CTTCGCTGACTACAACCTGCTGGACTTGCTGCTGA TCCATGAGGTCCTAGCCCCTGGCTGCCTGGATGC GTTCCCCCTGCTCTCAGCATATGTGGGGCGCCTC AGCGCCCGGCCCAAGCTCAAGGCCTTCCTGGCCT CCCCTGAGTACGTGAACCTCCCCATCAATGGCAAC GGGAAACAGTGAGGGTTGGGGGGACTCTGAGCG GGAGGCAGAGTTTGCCTTCCTTTCTCCAGGACCAA TAAAAATTTCTAAGAGAGCT | | |
| 102 | NM_0008 84.2_111 9 | 1119 | CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATTGGCTTCATCCACCACAACTGTA CACCTGAATTCCAGGCCAATGAAGTTCGGAAAGTG AAGAAATATGAACAGGGATTCATCACAGACCCTGT GGTCCTCAGCCCCAAGGATCGCGTGCGGGATGTT TTTGAGGCCAAGGCCCGGCATGGTTTCTGCGGTA TCCCAATCACAGACACAGGCCGGATGGGGAGCCG CTTGGTGGGCATCATCTCCTCCAGGGACATTGATT TTCTCAAAGAGGAGGAACATGACTGTTTCTTGGAA GAGATAATGACAAAGAGGGAAGACTTGGTGGTAG CCCCTGCAGGCATCACACTGAAGGAGGCAAATGA AATTCTGCAGCGCAGCAAGAAGGGAAAGTTGCCC ATTGTAAATGAAGATGATGAGCTTGTGGCCATCAT TGCCCGGACAGACCTGAAGAAGAATCGGGACTAC CCACTAGCCTCCAAAGATGCCAAGAAACAGCTGCT GTGTGGGGCAGCCATTGGCACTCATGAGGATGAC AAGTATAGGCTGGACTTGCTCGCCCAGGCTGGTG TGGATGTAGTGGTTTTGGACTCTTCCCAGGGAAAT TCCATCTTCCAGATCAATATGATCAAGTACATCAAA GACAAATACCCTAATCTCCAAGTCATTGGAGGCAA TGTGGTCACTGCTGCCCAGGCCAA | 42 | KQQQCTR CQSMHGA LVFRSLLM EESKMWVI LRKPWPLG PPQS* |
| 103 | NM_0008 84.2_356 | 356 | CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATGGCTTCATCCACCACAACTGTAC ACCTGAATTCCAGGCCAATGAAGTTCGGAAAGTGA AGAAATATGAACAGGGATTCATCACAGACCCTGTG GTCCTCAGCCCCAAGGATCGCGTGCGGGATGTTT TTGAGGCCAAGGCCCGGCATGGTTTCTGCGGTAT CCCAATCACAGACACAGGCCGGATGGGGAGCCGC TTGGTGGGCATCATCTCCTCCAGGGACATTGATTT TCTCAAAGAGGAGGAACATGACTGTTTCTTGGAAG AGATAATGACAAAGAGGGAAGACTTGGTGGTAGC CCCTGCAGGCATCACACTGAAGGAGGCAAATGAA ATTCTGCAGCGCAGCAAGAAGGGAAAGTTGCCCA TTGTAAATGAAGATGATGAGCTTGTGGCCATCATT GCCCGGACAGACCTGAAGAAGAATCGGGACTACC CACTAGCCTCCAAAGATGCCAAGAAACAGCTGCTG TGTGGGGCAGCCATTGGCACTCATGAGGATGACA AGTATAGGCTGGACTTGCTCGCCCAGGCTGGTGT GGATGTAGTGGTTTTGGACTCTTCCCAGGGAAATT CCATCTTCCAGATCAATATGATCAAGTACATCAAAG | 19 | MASSTTTV HLNSRPMK FGK* |

| SEQ ID | identifier_position | position | modified_RNA | PAP length | PAP |
|---|---|---|---|---|---|
| 104 | NM_0008 84.2_485 | 485 | ACAAATACCCTAATCTCCAAGTCATTGGAGGCAAT GTGGTCACTGCTGCCCAGGCCAAG CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATTGGCTTCATCCACCACAACTGTA CACCTGAATTCCAGGCCAATGAAGTTCGGAAAGTG AAGAAATATGAACAGGGATTCATCACAGACCCTGT GGTCCTCAGCCCCAAGGATCGCGTGCGGGATGTT TTGAGGCCAAGGCCCGGCATGGTTTCTGCGGTAT CCCAATCACAGACACAGGCCGGATGGGGAGCCGC TTGGTGGGCATCATCTCCTCCAGGGACATTGATTT TCTCAAAGAGGAGGAACATGACTGTTTCTTGGAAG AGATAATGACAAAGAGGGAAGACTTGGTGGTAGC CCCTGCAGGCATCACACTGAAGGAGGCAAATGAA ATTCTGCAGCGCAGCAAGAAGGGAAAGTTGCCCA TTGTAAATGAAGATGATGAGCTTGTGGCCATCATT GCCCGGACAGACCTGAAGAAGAATCGGGACTACC CACTAGCCTCCAAAGATGCCAAGAAACAGCTGCTG TGTGGGGCAGCCATTGGCACTCATGAGGATGACA AGTATAGGCTGGACTTGCTCGCCCAGGCTGGTGT GGATGTAGTGGTTTTGGACTCTTCCCAGGGAAATT CCATCTTCCAGATCAATATGATCAAGTACATCAAAG ACAAATACCCTAATCTCCAAGTCATTGGAGGCAAT GTGGTCACTGCTGCCCAGGCCAAG | 47 | LRPRPGM VSAVSQSQ TQAGWGA AWWASSP PGTLIFSKR RNMTVSW KR* |
| 105 | NM_0008 84.2_685 | 685 | CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATTGGCTTCATCCACCACAACTGTA CACCTGAATTCCAGGCCAATGAAGTTCGGAAAGTG AAGAAATATGAACAGGGATTCATCACAGACCCTGT GGTCCTCAGCCCCAAGGATCGCGTGCGGGATGTT TTGAGGCCAAGGCCCGGCATGGTTTCTGCGGTA TCCCAATCACAGACACAGGCCGGATGGGGAGCCG CTTGGTGGGCATCATCTCCTCCAGGGACATTGATT TTCTCAAAGAGGAGGAACATGACTGTTTCTTGGAA GAGATAATGACAAAGAGGGAAGACTTGGTGGTAG CCCCTGCAGGCATCACACTGAAGGAGGCAATGAA ATTCTGCAGCGCAGCAAGAAGGGAAAGTTGCCCA TTGTAAATGAAGATGATGAGCTTGTGGCCATCATT GCCCGGACAGACCTGAAGAAGAATCGGGACTACC CACTAGCCTCCAAAGATGCCAAGAAACAGCTGCTG TGTGGGGCAGCCATTGGCACTCATGAGGATGACA AGTATAGGCTGGACTTGCTCGCCCAGGCTGGTGT GGATGTAGTGGTTTTGGACTCTTCCCAGGGAAATT CCATCTTCCAGATCAATATGATCAAGTACATCAAAG ACAAATACCCTAATCTCCAAGTCATTGGAGGCAAT GTGGTCACTGCTGCCCAGGCCAAG | 14 | MKFCSAAR RESCPL* |
| 106 | NM_0008 84.2_910 | 910 | CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATTGGCTTCATCCACCACAACTGTA CACCTGAATTCCAGGCCAATGAAGTTCGGAAAGTG AAGAAATATGAACAGGGATTCATCACAGACCCTGT GGTCCTCAGCCCCAAGGATCGCGTGCGGGATGTT TTGAGGCCAAGGCCCGGCATGGTTTCTGCGGTA | 13 | WTLPREIP SSRSI* |

TABLE 3A-continued

| SEQ ID | identifier_ position | position | modified_RNA | PAP length | PAP |
|---|---|---|---|---|---|
| | | | TCCCAATCACAGACACAGGCCGGATGGGGAGCCG CTTGGTGGGCATCATCTCCTCCAGGGACATTGATT TTCTCAAAGAGGAGGAACATGACTGTTTCTTGGAA GAGATAATGACAAAGAGGGAAGACTTGGTGGTAG CCCCTGCAGGCATCACACTGAAGGAGGCAAATGA AATTCTGCAGCGCAGCAAGAAGGGAAAGTTGCCC ATTGTAAATGAAGATGATGAGCTTGTGGCCATCAT TGCCCGGACAGACCTGAAGAAGAATCGGGACTAC CCACTAGCCTCCAAAGATGCCAAGAAACAGCTGCT GTGTGGGGCAGCCATTGGCACTCATGAGGATGAC AAGTATAGGCTGGACTTGCTCGCCCAGGCTGGTG TGGATGTAGTGGTTTGGACTCTTCCCAGGGAAATT CCATCTTCCAGATCAATATGATCAAGTACATCAAAG ACAAATACCCTAATCTCCAAGTCATTGGAGGCAAT GTGGTCACTGCTGCCCAGGCCAAG | | |
| 107 | NM_0008 84.2_925 | 925 | CGAAATCGGCTGGTTTATATTGGCGCGGCCCAGA CGGCAGAGGTCTCTGCGGCGCGGTCCTCGGAGA CACGCGGCGGTGTCCTGTGTTGGCCATGGCCGAC TACCTGATTAGTGGGGGCACGTCCTACGTGCCAG ACGACGGACTCACAGCACAGCAGCTCTTCAACTG CGGAGACGGCCTCACCTACAATGACTTTCTCATTC TCCCTGGGTACATCGACTTCACTGCAGACCAGGTG GACCTGACTTCTGCTCTGACCAAGAAAATCACTCT TAAGACCCCACTGGTTTCCTCTCCCATGGACACAG TCACAGAGGCTGGGATGGCCATAGCAATGGCGCT TACAGGCGGTATTGGCTTCATCCACCACAACTGTA CACCTGAATTCCAGGCCAATGAAGTTCGGAAAGTG AAGAAATATGAACAGGGATTCATCACAGACCCTGT GGTCCTCAGCCCCAAGGATCGCGTGCGGGATGTT TTTGAGGCCAAGGCCCGGCATGGTTTCTGCGGTA TCCCAATCACAGACACAGGCCGGATGGGGAGCCG CTTGGTGGGCATCATCTCCTCCAGGGACATTGATT TTCTCAAAGAGGAGGAACATGACTGTTTCTTGGAA GAGATAATGACAAAGAGGGAAGACTTGGTGGTAG CCCCTGCAGGCATCACACTGAAGGAGGCAAATGA AATTCTGCAGCGCAGCAAGAAGGGAAAGTTGCCC ATTGTAAATGAAGATGATGAGCTTGTGGCCATCAT TGCCCGGACAGACCTGAAGAAGAATCGGGACTAC CCACTAGCCTCCAAAGATGCCAAGAAACAGCTGCT GTGTGGGGCAGCCATTGGCACTCATGAGGATGAC AAGTATAGGCTGGACTTGCTCGCCCAGGCTGGTG TGGATGTAGTGGTTTTGGACTCTTCCCAGGGAAATT CCATCTTCCAGATCAATATGATCAAGTACATCAAAG ACAAATACCCTAATCTCCAAGTCATTGGAGGCAAT GTGGTCACTGCTGCCCAGGCCAAG | 8 | EIPSSRSI* |
| 108 | NM_0009 30.3_604 | 604 | ATGGCCCTGTCCACTGAGCATCCTCCCGCCACAC AGAAACCCGCCCAGCCGGGGCCACCGACCCCAC CCCCTGCCTGGAAACTTAAAGGAGGCCGGAGCTG TGGGGAGCTCAGAGCTGAGATCCTACAGGAGTCC AGGGCTGGAGAGAAAACCTCTGCGAGGAAAGGGA AGGAGCAAGCCGTGAATTTAAGGGACGCTGTGAA GCAATCATGGATGCAATGAAGAGAGGGCTCTGCT GTGTGCTGCTGCTGTGTGGAGCAGTCTTCGTTTCG CCCAGCCAGGAAATCCATGCCCGATTCAGAAGAG GAGCCAGATCTTACCAAGTGATCTGCAGAGATGAA AAAACGCAGATGATATACCAGCAACATCAGTCATG GCTGCGCCCTGTGCTCAGAAGCAACCGGGTGGAA TATTGCTGGTGCAACAGTGGCAGGGCACAGTGCC ACTCAGTGCCTGTCAAAAGTTGCAGCGAGCCAAG GTGTTTCAACGGGGGCACCTGCCAGCAGGCCCTG TACTTCTCAGATTTCGTGTGCCAGTGCCCCGAAGG ATTTGCTGGGAAGTGCTGTGAAATAGATACCAGGG CCACGTGCTACGAGGACCAGGCATCAGCTACAGG GGCACGTGGAGCACAGCGGAGAGTGGCGCCGAG TGCACCAACTGGAACAGCAGCGCGTTGGCCCAGA AGCCCTACAGCGGGCGGAGGCCAGACGCCATCA GGCTGGGCCTGGGGAACCACAACTACTGCAGAAA CCCAGATCGAGACTCAAAGCCCTGGTGCTACGTC TTTAAGGCGGGGAAGTACAGCTCAGAGTTCTGCA GCACCCCTGCCTGCTCTGAGGGAAACAGTGACTG CTACTTTGGGAATGGGTCAGCCTACCGTGGCACG CACAGCCTCACCGAGTCGGGTGCCTCCTGCCTCC CGTGGAATTCCATGATCCTGATAGGCAAGGTTTAC ACAGCACAGAACCCCAGTGCCCAGGCACTGGGCC TGGGCAAACATAATTACTGCCGGAATCCTGATGGG | 110 | ASATGARG AQRRVAPS APTGTAAR WPRSPTA GGGQTPS GWAWGTT TTAETQIET QSPGATSL RRGSTAQ SSAAPLPA LRETVTAT LGMGQPT VARTASPS RVPPASRG IP* |

TABLE 3A-continued

| SEQ ID | identifier_ position | position | modified_RNA | PAP length | PAP |
|---|---|---|---|---|---|
| 109 | NM_0009 42.4_325 | 325 | ACTATCCGGCGCCGAGCCGGAGGGGGGAAACGG CGCCCGCCGCCCGCCCGGAGCCCGCGAGCAACC CCAGTCCCCCCCACCCGCGCGTGGCGGCGCCGG CTCCCTAGCCACCGCGGCCCCACCCTCTTCCGGC CTCAGCTGTCCGGGCTGCTTTCGCCTCCGCCTGT GGATGCTGCGCCTCTCCGAACGCAACATGAAGGT GCTCCTTGCCGCCGCCCTCATCGCGGGGTCCGTC TTCTTCCTGCTGCTGCCGGGACCTTCTGCGGCCG ATGAGAAGAAGAAGGGGCCCAAAGTCACCGTCAA GGTGTATTTTGACCTACGAATGGAGATGAAGATGT AGGCCGGGTGATCTTTGGTCTCTTCGGAAAGACTG TTCCAAAAACAGTGGATAATTTTGTGGCCTTAGCTA CAGGAGAGAAAGGATTTGGCTACAAAAACAGCAAA TTCCATCGTGTAATCAAGGACTTCATGATCCAGGG CGGAGACTTCACCAGGGGAGATGGCACAGGAGGA AAGAGCATCTACGGTGAGCGCTTCCCCGATGAGA ACTTCAAACTGAAGCACTACGGGCCTGGCTGGGT GAGCATGGCCAACGCAGGCAAAGACACCAACGGC TCCCAGTTCTTCATCACGACAGTCAAGACAGCCTG GCTAGATGGCAAGCATGTGGTGTTTGGCAAAGTTC TAGAGGGCATGGAGGTGGTGCGGAAGGTGGAGA GCACCAAGACAGACAGCCGGGATAAACCCCTGAA GGATGTGATCATCGCAGACTGCGGCAAGATCGAG GTGGAGAAGCCCTTTGCCATCGCCAAGGAGTAGG GCACAGGGACATCTTTCTTTGAGTGACCGTCTGTG CAGGCCCTGTAGTCCGCCACAGGGCTCTGAGCTG CACTGGCCCCGGTGCTGGCATCTGGTGGAGCGGA CCCACTCCCCTCACATTCCACAGGCCCATGGACTC ACTTTTGTAACAAACTCCTACCAACACTGACCAATA AAAAAAAATGTGGGTTTTTTTTTTTTAAT | 5 | MEMKM* |
| 110 | NM_0009 42.4_355 | 355 | ACTATCCGGCGCCGAGCCGGAGGGGGGAAACGG CGCCCGCCGCCCGCCCGGAGCCCGCGAGCAACC CCAGTCCCCCCCACCCGCGCGTGGCGGCGCCGG CTCCCTAGCCACCGCGGCCCCACCCTCTTCCGGC CTCAGCTGTCCGGGCTGCTTTCGCCTCCGCCTGT GGATGCTGCGCCTCTCCGAACGCAACATGAAGGT GCTCCTTGCCGCCGCCCTCATCGCGGGGTCCGTC TTCTTCCTGCTGCTGCCGGGACCTTCTGCGGCCG ATGAGAAGAAGAAGGGGCCCAAAGTCACCGTCAA GGTGTATTTTGACCTACGAATTGGAGATGAAGATG TAGGCCGGGTGATCTTGGTCTCTTCGGAAAGACTG TTCCAAAAACAGTGGATAATTTTGTGGCCTTAGCTA CAGGAGAGAAAGGATTTGGCTACAAAAACAGCAAA TTCCATCGTGTAATCAAGGACTTCATGATCCAGGG CGGAGACTTCACCAGGGGAGATGGCACAGGAGGA AAGAGCATCTACGGTGAGCGCTTCCCCGATGAGA ACTTCAAACTGAAGCACTACGGGCCTGGCTGGGT GAGCATGGCCAACGCAGGCAAAGACACCAACGGC TCCCAGTTCTTCATCACGACAGTCAAGACAGCCTG GCTAGATGGCAAGCATGTGGTGTTTGGCAAAGTTC TAGAGGGCATGGAGGTGGTGCGGAAGGTGGAGA GCACCAAGACAGACAGCCGGGATAAACCCCTGAA GGATGTGATCATCGCAGACTGCGGCAAGATCGAG GTGGAGAAGCCCTTTGCCATCGCCAAGGAGTAGG GCACAGGGACATCTTTCTTTGAGTGACCGTCTGTG CAGGCCCTGTAGTCCGCCACAGGGCTCTGAGCTG CACTGGCCCCGGTGCTGGCATCTGGTGGAGCGGA CCCACTCCCCTCACATTCCACAGGCCCATGGACTC ACTTTTGTAACAAACTCCTACCAACACTGACCAATA AAAAAAAATGTGGGTTTTTTTTTTTTAAT | 17 | LVSSERLF QKQWIILW P* |
| 111 | NM_0009 42.4_397 | 397 | ACTATCCGGCGCCGAGCCGGAGGGGGGAAACGG CGCCCGCCGCCCGCCCGGAGCCCGCGAGCAACC CCAGTCCCCCCCACCCGCGCGTGGCGGCGCCGG CTCCCTAGCCACCGCGGCCCCACCCTCTTCCGGC CTCAGCTGTCCGGGCTGCTTTCGCCTCCGCCTGT GGATGCTGCGCCTCTCCGAACGCAACATGAAGGT GCTCCTTGCCGCCGCCCTCATCGCGGGGTCCGTC TTCTTCCTGCTGCTGCCGGGACCTTCTGCGGCCG ATGAGAAGAAGAAGGGGCCCAAAGTCACCGTCAA GGTGTATTTTGACCTACGAATTGGAGATGAAGATG TAGGCCGGGTGATCTTTGGTCTCTTCGGAAAGACT GTTCCAAAAACAGTGGATAATTTTGTGGCCTTAGCT ACAGGAGAGAAAGGATTTGGCTACAAAAACAGCAA ATTCCATCGTGTAATCAAGGACTTCATGATCCAGG GCGGAGACTTCACCAGGGGAGATGGCACAGGAG GAAAGAGCATCTACGGTGAGCGCTTCCCCGATGA GAACTTCAAACTGAAGCACTACGGGCCTGGCTGG | 3 | LWP* |

TABLE 3A-continued

| SEQ ID | identifier_position | position | modified_RNA | PAP length | PAP |
|---|---|---|---|---|---|
| | | | GTGAGCATGGCCAACGCAGGCAAAGACACCAACG<br>GCTCCCAGTTCTTCATCACGACAGTCAAGACAGCC<br>TGGCTAGATGGCAAGCATGTGGTGTTTGGCAAAGT<br>TCTAGAGGGCATGGAGGTGGTGCGGAAGGTGGA<br>GAGCACCAAGACAGACAGCCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAAATGTGGGTTTTTTTTTTTTAAT | | |
| 112 | NM_0009<br>42.4_427 | 427 | ACTATCCGGCGCCGAGCCGGAGGGGGGAAACGG<br>CGCCCGCCGCCCGCCCGGAGCCCGCGAGCAACC<br>CCAGTCCCCCCCACCCGCGCGTGGCGGCGCCGG<br>CTCCCTAGCCACCGCGGCCCCACCCTCTTCCGGC<br>CTCAGCTGTCCGGGCTGCTTTCGCCTCCGCCTGT<br>GGATGCTGCGCCTCTCCGAACGCAACATGAAGGT<br>GCTCCTTGCCGCCGCCCTCATCGCGGGGTCCGTC<br>TTCTTCCTGCTGCTGCCGGGACCTTCTGCGGCCG<br>ATGAGAAGAAGAAGGGGCCCAAAGTCACCGTCAA<br>GGTGTATTTTGACCTACGAATTGGAGATGAAGATG<br>TAGGCCGGGTGATCTTTGGTCTCTTCGGAAAGACT<br>GTTCCAAAAACAGTGGATAATTTTGTGGCCTTAGC<br>TACAGGAGAGAAAGGATTGGCTACAAAAACAGCAA<br>ATTCCATCGTGTAATCAAGGACTTCATGATCCAGG<br>GCGGAGACTTCACCAGGGGAGATGGCACAGGAG<br>GAAAGAGCATCTACGGTGAGCGCTTCCCCGATGA<br>GAACTTCAAACTGAAGCACTACGGGCCTGGCTGG<br>GTGAGCATGGCCAACGCAGGCAAAGACACCAACG<br>GCTCCCAGTTCTTCATCACGACAGTCAAGACAGCC<br>TGGCTAGATGGCAAGCATGTGGTGTTTGGCAAAGT<br>TCTAGAGGGCATGGAGGTGGTGCGGAAGGTGGA<br>GAGCACCAAGACAGACAGCCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAAATGTGGGTTTTTTTTTTTTAAT | 10 | LATKTANSI<br>V* |
| 113 | NM_0009<br>42.4_480 | 480 | ACTATCCGGCGCCGAGCCGGAGGGGGGAAACGG<br>CGCCCGCCGCCCGCCCGGAGCCCGCGAGCAACC<br>CCAGTCCCCCCCACCCGCGCGTGGCGGCGCCGG<br>CTCCCTAGCCACCGCGGCCCCACCCTCTTCCGGC<br>CTCAGCTGTCCGGGCTGCTTTCGCCTCCGCCTGT<br>GGATGCTGCGCCTCTCCGAACGCAACATGAAGGT<br>GCTCCTTGCCGCCGCCCTCATCGCGGGGTCCGTC<br>TTCTTCCTGCTGCTGCCGGGACCTTCTGCGGCCG<br>ATGAGAAGAAGAAGGGGCCCAAAGTCACCGTCAA<br>GGTGTATTTTGACCTACGAATTGGAGATGAAGATG<br>TAGGCCGGGTGATCTTTGGTCTCTTCGGAAAGACT<br>GTTCCAAAAACAGTGGATAATTTTGTGGCCTTAGC<br>TACAGGAGAGAAAGGATTTGGCTACAAAAACAGCA<br>AATTCCATCGTGTAATCAAGGACTTCATGATCCAG<br>GCGGAGACTTCACCAGGGGAGATGGCACAGGAG<br>GAAAGAGCATCTACGGTGAGCGCTTCCCCGATGA<br>GAACTTCAAACTGAAGCACTACGGGCCTGGCTGG<br>GTGAGCATGGCCAACGCAGGCAAAGACACCAACG<br>GCTCCCAGTTCTTCATCACGACAGTCAAGACAGCC<br>TGGCTAGATGGCAAGCATGTGGTGTTTGGCAAAGT<br>TCTAGAGGGCATGGAGGTGGTGCGGAAGGTGGA<br>GAGCACCAAGACAGACAGCCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAAATGTGGGTTTTTTTTTTTTAAT | 26 | AETSPGEM<br>AQEERAST<br>VSASPMRT<br>SN* |
| 114 | NM_0009<br>42.4_498 | 498 | ACTATCCGGCGCCGAGCCGGAGGGGGGAAACGG<br>CGCCCGCCGCCCGCCCGGAGCCCGCGAGCAACC<br>CCAGTCCCCCCCACCCGCGCGTGGCGGCGCCGG<br>CTCCCTAGCCACCGCGGCCCCACCCTCTTCCGGC | 20 | EMAQEER<br>ASTVSASP<br>MRTSN* |

| SEQ ID | identifier_ position | position | modified_RNA | PAP length | PAP |
|---|---|---|---|---|---|
| | | | CTCAGCTGTCCGGGCTGCTTTCGCCTCCGCCTGT<br>GGATGCTGCGCCTCTCCGAACGCAACATGAAGGT<br>GCTCCTTGCCGCCGCCCTCATCGCGGGGTCCGTC<br>TTCTTCCTGCTGCTGCCGGGACCTTCTGCGGCCG<br>ATGAGAAGAAGAAGGGGCCCAAAGTCACCGTCAA<br>GGTGTATTTTGACCTACGAATTGGAGATGAAGATG<br>TAGGCCGGGTGATCTTTGGTCTCTTCGGAAAGACT<br>GTTCCAAAAACAGTGGATAATTTTGTGGCCTTAGC<br>TACAGGAGAGAAAGGATTTGGCTACAAAAACAGCA<br>AATTCCATCGTGTAATCAAGGACTTCATGATCCAG<br>GGCGGAGACTTCACCAGGGGAGATGGCACAGGAG<br>GAAAGAGCATCTACGGTGAGCGCTTCCCCGATGA<br>GAACTTCAAACTGAAGCACTACGGGCCTGGCTGG<br>GTGAGCATGGCCAACGCAGGCAAAGACACCAACG<br>GCTCCCAGTTCTTCATCACGACAGTCAAGACAGCC<br>TGGCTAGATGGCAAGCATGTGGTGTTTGGCAAAGT<br>TCTAGAGGGCATGGAGGTGGTGCGGAAGGTGGA<br>GAGCACCAAGACAGACAGCCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAAATGTGGGTTTTTTTTTTTTTAAT | | |
| 115 | NM_0009 42.4_676 | 676 | ACTATCCGGCGCCGAGCCGGAGGGGGGAAACGG<br>CGCCCGCCGCCCGCCCGGAGCCCGCGAGCAACC<br>CCAGTCCCCCCCACCCGCGCGTGGCGGCGCCGG<br>CTCCCTAGCCACCGCGGCCCCACCCTCTTCCGGC<br>CTCAGCTGTCCGGGCTGCTTTCGCCTCCGCCTGT<br>GGATGCTGCGCCTCTCCGAACGCAACATGAAGGT<br>GCTCCTTGCCGCCGCCCTCATCGCGGGGTCCGTC<br>TTCTTCCTGCTGCTGCCGGGACCTTCTGCGGCCG<br>ATGAGAAGAAGAAGGGGCCCAAAGTCACCGTCAA<br>GGTGTATTTTGACCTACGAATTGGAGATGAAGATG<br>TAGGCCGGGTGATCTTTGGTCTCTTCGGAAAGACT<br>GTTCCAAAAACAGTGGATAATTTTGTGGCCTTAGC<br>TACAGGAGAGAAAGGATTTGGCTACAAAAACAGCA<br>AATTCCATCGTGTAATCAAGGACTTCATGATCCAG<br>GGCGGAGACTTCACCAGGGGAGATGGCACAGGA<br>GGAAAGAGCATCTACGGTGAGCGCTTCCCCGATG<br>AGAACTTCAAACTGAAGCACTACGGGCCTGGCTG<br>GGTGAGCATGGCCAACGCAGGCAAAGACACCAAC<br>GGCTCCCAGTTCTTCATCACGACAGTCAAGACAGC<br>CTGGCTAGATGGCAAGCATGTGGTGTTTGGCAAAG<br>TTCTAGAGGGCATGGAGGTGGTGCGGAAGGTGGA<br>GAGCACCAAGACAGACAGCCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAAATGTGGGTTTTTTTTTTTTAAT | 4 | LAKF* |
| 116 | NM_0009 42.4_737 | 737 | ACTATCCGGCGCCGAGCCGGAGGGGGGAAACGG<br>CGCCCGCCGCCCGCCCGGAGCCCGCGAGCAACC<br>CCAGTCCCCCCCACCCGCGCGTGGCGGCGCCGG<br>CTCCCTAGCCACCGCGGCCCCACCCTCTTCCGGC<br>CTCAGCTGTCCGGGCTGCTTTCGCCTCCGCCTGT<br>GGATGCTGCGCCTCTCCGAACGCAACATGAAGGT<br>GCTCCTTGCCGCCGCCCTCATCGCGGGGTCCGTC<br>TTCTTCCTGCTGCTGCCGGGACCTTCTGCGGCCG<br>ATGAGAAGAAGAAGGGGCCCAAAGTCACCGTCAA<br>GGTGTATTTTGACCTACGAATTGGAGATGAAGATG<br>TAGGCCGGGTGATCTTTGGTCTCTTCGGAAAGACT<br>GTTCCAAAAACAGTGGATAATTTTGTGGCCTTAGC<br>TACAGGAGAGAAAGGATTTGGCTACAAAAACAGCA<br>AATTCCATCGTGTAATCAAGGACTTCATGATCCAG<br>GGCGGAGACTTCACCAGGGGAGATGGCACAGGA<br>GGAAAGAGCATCTACGGTGAGCGCTTCCCCGATG<br>AGAACTTCAAACTGAAGCACTACGGGCCTGGCTG<br>GGTGAGCATGGCCAACGCAGGCAAAGACACCAAC<br>GGCTCCCAGTTCTTCATCACGACAGTCAAGACAGC<br>CTGGCTAGATGGCAAGCATGTGGTGTTTGGCAAA<br>GTTCTAGAGGGCATGGAGGTGGTGCGGAAGGTGG | 4 | GINP* |

| SEQ ID | identifier_position | position | modified_RNA | PAP length | PAP |
|---|---|---|---|---|---|
| | | | AGAGCACCAAGACAGACAGCGGGATAAACCCCTG<br>AAGGATGTGATCATCGCAGACTGCGGCAAGATCG<br>AGGTGGAGAAGCCCTTTGCCATCGCCAAGGAGTA<br>GGGCACAGGGACATCTTTCTTTGAGTGACCGTCTG<br>TGCAGGCCCTGTAGTCCGCCACAGGGCTCTGAGC<br>TGCACTGGCCCCGGTGCTGGCATCTGGTGGAGCG<br>GACCCACTCCCCTCACATTCCACAGGCCCATGGA<br>CTCACTTTTGTAACAAACTCCTACCAACACTGACCA<br>ATAAAAAAAAATGTGGGTTTTTTTTTTTAAT | | |
| 117 | NM_000967.3_335 | 335 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATGTGGGCTA<br>CGTGGAAACCCCTCGAGGCCTCCGGACCTTCAAG<br>ACTGTCTTTGCTGAGCACATCAGTGATGAATGCAA<br>GAGGCGTTTCTATAAGAATTGGCATAAATCTAAGA<br>AGAAGGCCTTTACCAAGTACTGCAAGAAATGGCAG<br>GATGAGGATGGCAAGAAGCAGCTGGAGAAGGACT<br>TCAGCAGCATGAAGAAGTACTGCCAAGTCATCCGT<br>GTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 64 | MWATWKP<br>LEASGPSR<br>LSLLSTSV<br>MNARGVSI<br>RIGINLRRR<br>PLPSTARN<br>GRMRMAR<br>SSWRRTS<br>AA* |
| 118 | NM_000967.3_363 | 363 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCTCCGGACCTTCAAG<br>ACTGTCTTTGCTGAGCACATCAGTGATGAATGCAA<br>GAGGCGTTTCTATAAGAATTGGCATAAATCTAAGA<br>AGAAGGCCTTTACCAAGTACTGCAAGAAATGGCAG<br>GATGAGGATGGCAAGAAGCAGCTGGAGAAGGACT<br>TCAGCAGCATGAAGAAGTACTGCCAAGTCATCCGT<br>GTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 54 | SGPSRLSL<br>LSTSVMNA<br>RGVSIRIGI<br>NLRRRPLP<br>STARNGR<br>MRMARSS<br>WRRTSAA* |
| 119 | NM_000967.3_371 | 371 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA | 51 | SRLSLLST<br>SVMNARG<br>VSIRIGINL<br>RRRPLPST<br>ARNGRMR<br>MARSSWR<br>RTSAA* |

| SEQ ID | identifier_position | position | modified_RNA | PAP length | PAP |
|---|---|---|---|---|---|
| | | | GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACTTCAAG<br>ACTGTCTTTGCTGAGCACATCAGTGATGAATGCAA<br>GAGGCGTTTCTATAAGAATTGGCATAAATCTAAGA<br>AGAAGGCCTTTACCAAGTACTGCAAGAAATGGCAG<br>GATGAGGATGGCAAGAAGCAGCTGGAGAAGGACT<br>TCAGCAGCATGAAGAAGTACTGCCAAGTCATCCGT<br>GTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | | |
| 120 | NM_0009<br>67.3_421 | 421 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTCTATAAGAATTGGCATAAATCTAAGA<br>AGAAGGCCTTTACCAAGTACTGCAAGAAATGGCAG<br>GATGAGGATGGCAAGAAGCAGCTGGAGAAGGACT<br>TCAGCAGCATGAAGAAGTACTGCCAAGTCATCCGT<br>GTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 35 | SIRIGINLR<br>RRPLPSTA<br>RNGRMRM<br>ARSSWRR<br>TSAA* |
| 121 | NM_0009<br>67.3_432 | 432 | CCAGATTTGGCTTTATATAGCGGACCCGTAAGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTCTATAAGAATGGCATAAATCTAAGA<br>AGAAGGCCTTTACCAAGTACTGCAAGAAATGGCAG<br>GATGAGGATGGCAAGAAGCAGCTGGAGAAGGACT<br>TCAGCAGCATGAAGAAGTACTGCCAAGTCATCCGT<br>GTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT | 31 | GINLRRRP<br>LPSTARNG<br>RMRMARS<br>SWRRTSA<br>A* |

TABLE 3A-continued

| SEQ ID | identifier_position | position | modified_RNA | PAP length | PAP |
|---|---|---|---|---|---|
| | | | TCTCTGTGGCACGCGCTGGGCAGAAAGGCTACCA TCACCGCACTGAGATCAACAAGAAGATTTATAAGA TTGGCCAGGGCTACCTTATCAAGGACGGCAAGCT GATCAAGAACAATGCCTCCACTGACTATGACCTAT CTGACAAGAGCATCAACCCTCTGGGTGGC | | |
| 122 | NM_0009 67.3_455 | 455 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCTTTACCAAGTACTGCAAGAAATGGCAG GATGAGGATGGCAAGAAGCAGCTGGAGAAGGACT TCAGCAGCATGAAGAAGTACTGCCAAGTCATCCGT GTCATTGCCCACACCCAGATGCGCCTGCTTCCTCT GCGCCAGAAGAAGGCCCACCTGATGGAGATCCAG GTGAACGGAGGCACTGTGGCCGAGAAGCTGGACT GGGCCCGCGAGAGGCTTGAGCAGCAGGTACCTGT GAACCAAGTGTTTGGGCAGGATGAGATGATCGAC GTCATCGGGGTGACCAAGGGCAAAGGCTACAAAG GGGTCACCAGTCGTTGGCACACCAAGAAGCTGCC CCGCAAGACCCACCGAGGCCTGCGCAAGGTGGC CTGTATTGGGGCATGGCATCCTGCTCGTGTAGCCT TCTCTGTGGCACGCGCTGGGCAGAAAGGCTACCA TCACCGCACTGAGATCAACAAGAAGATTTATAAGA TTGGCCAGGGCTACCTTATCAAGGACGGCAAGCT GATCAAGAACAATGCCTCCACTGACTATGACCTAT CTGACAAGAGCATCAACCCTCTGGGTGGC | 23 | LPSTARNG RMRMARS SWRRTSA A* |
| 123 | NM_0009 67.3_540 | 540 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCTTTACCAAGTACTGCAAGAAATGGCA GGATGAGGATGGCAAGAAGCAGCTGGAGAAGGAC TTCAGCAGCATGAAGAAGTACTGCCAAGTCATCCGT GTCATTGCCCACACCCAGATGCGCCTGCTTCCTCT GCGCCAGAAGAAGGCCCACCTGATGGAGATCCAG GTGAACGGAGGCACTGTGGCCGAGAAGCTGGACT GGGCCCGCGAGAGGCTTGAGCAGCAGGTACCTGT GAACCAAGTGTTTGGGCAGGATGAGATGATCGAC GTCATCGGGGTGACCAAGGGCAAAGGCTACAAAG GGGTCACCAGTCGTTGGCACACCAAGAAGCTGCC CCGCAAGACCCACCGAGGCCTGCGCAAGGTGGC CTGTATTGGGGCATGGCATCCTGCTCGTGTAGCCT TCTCTGTGGCACGCGCTGGGCAGAAAGGCTACCA TCACCGCACTGAGATCAACAAGAAGATTTATAAGA TTGGCCAGGGCTACCTTATCAAGGACGGCAAGCT GATCAAGAACAATGCCTCCACTGACTATGACCTAT CTGACAAGAGCATCAACCCTCTGGGTGGC | 22 | KSSVSLPT PRCACFLC ARRRPT* |
| 124 | NM_0009 67.3_557 | 557 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA | 17 | MPTPRCA CFLCARRR PT* |

TABLE 3A-continued

| SEQ ID | identifier_position | position | modified_RNA | PAP length | PAP |
|---|---|---|---|---|---|
| | | | AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | | |
| 125 | NM_0009<br>67.3_561 | 561 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 15 | TPRCACFL<br>CARRRPT* |
| 126 | NM_0009<br>67.3_567 | 567 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTCT<br>GCGCCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT | 13 | RCACFLCA<br>RRRPT* |

TABLE 3A-continued

| SEQ ID | identifier_position | position | modified_RNA | PAP length | PAP |
|---|---|---|---|---|---|
| 127 | NM_000967.3_579 | 579 | GATCAAGAACAATGCCTCCACTGACTATGACCTAT CTGACAAGAGCATCAACCCTCTGGGTGGC CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGTTCCTCT GCGCCAGAAGAAGGCCCACCTGATGGAGATCCAG GTGAACGGAGGCACTGTGGCCGAGAAGCTGGACT GGGCCCGCGAGAGGCTTGAGCAGCAGGTACCTGT GAACCAAGTGTTTGGGCAGGATGAGATGATCGAC GTCATCGGGGTGACCAAGGGCAAAGGCTACAAAG GGGTCACCAGTCGTTGGCACACCAAGAAGCTGCC CCGCAAGACCCACCGAGGCCTGCGCAAGGTGGC CTGTATTGGGGCATGGCATCCTGCTCGTGTAGCCT TCTCTGTGGCACGCGCTGGGCAGAAAGGCTACCA TCACCGCACTGAGATCAACAAGAAGATTTATAAGA TTGGCCAGGGCTACCTTATCAAGGACGGCAAGCT GATCAAGAACAATGCCTCCACTGACTATGACCTAT CTGACAAGAGCATCAACCCTCTGGGTGGC | 9 | FLCARRRPT* |
| 128 | NM_000967.3_591 | 591 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCAGAAGAAGGCCCACCTGATGGAGATCCAG GTGAACGGAGGCACTGTGGCCGAGAAGCTGGACT GGGCCCGCGAGAGGCTTGAGCAGCAGGTACCTGT GAACCAAGTGTTTGGGCAGGATGAGATGATCGAC GTCATCGGGGTGACCAAGGGCAAAGGCTACAAAG GGGTCACCAGTCGTTGGCACACCAAGAAGCTGCC CCGCAAGACCCACCGAGGCCTGCGCAAGGTGGC CTGTATTGGGGCATGGCATCCTGCTCGTGTAGCCT TCTCTGTGGCACGCGCTGGGCAGAAAGGCTACCA TCACCGCACTGAGATCAACAAGAAGATTTATAAGA TTGGCCAGGGCTACCTTATCAAGGACGGCAAGCT GATCAAGAACAATGCCTCCACTGACTATGACCTAT CTGACAAGAGCATCAACCCTCTGGGTGGC | 5 | RRRPT* |
| 129 | NM_000967.3_603 | 603 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG | 1 | T* |

TABLE 3A-continued

| SEQ ID | identifier_position | position | modified_RNA | PAP length | PAP |
|---|---|---|---|---|---|
| | | | TGTCATTGCCCACACCCAGATGCGCCTGCTTCCTC<br>TGCGCAGAAGAAGGCCCACCTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | | |
| 130 | NM_0009<br>67.3_606 | 606 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACTGATGGAGATCCAG<br>GTGAACGGAGGCACTGTGGCCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 0 | * |
| 131 | NM_0009<br>67.3_641 | 641 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCGAGAAGCTGGACT<br>GGGCCCGCGAGAGGCTTGAGCAGCAGGTACCTGT<br>GAACCAAGTGTTTGGGCAGGATGAGATGATCGAC<br>GTCATCGGGGTGACCAAGGGCAAAGGCTACAAAG<br>GGGTCACCAGTCGTTGGCACACCAAGAAGCTGCC<br>CCGCAAGACCCACCGAGGCCTGCGCAAGGTGGC<br>CTGTATTGGGGCATGGCATCCTGCTCGTGTAGCCT<br>TCTCTGTGGCACGCGCTGGGCAGAAAGGCTACCA<br>TCACCGCACTGAGATCAACAAGAAGATTTATAAGA<br>TTGGCCAGGGCTACCTTATCAAGGACGGCAAGCT<br>GATCAAGAACAATGCCTCCACTGACTATGACCTAT<br>CTGACAAGAGCATCAACCCTCTGGGTGGC | 15 | RSWTGPA<br>RGLSSRYL* |
| 132 | NM_0009<br>67.3_657 | 657 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG | 10 | PARGLSSR<br>YL* |

TABLE 3A-continued

| SEQ ID | identifier_position | position | modified_RNA | PAP length | PAP |
|---|---|---|---|---|---|
| | | | TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGCCCGCGAGAGGCTTGAGCAGCAGGTACCTG TGAACCAAGTGTTTGGGCAGGATGAGATGATCGA CGTCATCGGGGTGACCAAGGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | | |
| 133 | NM_0009 67.3_660 | 660 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCGCGAGAGGCTTGAGCAGCAGGTACCTG TGAACCAAGTGTTTGGGCAGGATGAGATGATCGA CGTCATCGGGGTGACCAAGGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 9 | ARGLSSRY L* |
| 134 | NM_0009 67.3_662 | 662 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGGAGAGGCTTGAGCAGCAGGTACCTG | 8 | RGLSSRYL* |

TABLE 3A-continued

| SEQ ID | identifier_ position | position | modified_RNA | PAP length | PAP |
|---|---|---|---|---|---|
| | | | TGAACCAAGTGTTTGGGCAGGATGAGATGATCGA CGTCATCGGGGTGACCAAGGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | | |
| 135 | NM_0009 67.3_671 | 671 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTGAGCAGCAGGTACCT GTGAACCAAGTGTTTGGGCAGGATGAGATGATCG ACGTCATCGGGGTGACCAAGGGCAAAGGCTACAA AGGGGTCACCAGTCGTTGGCACACCAAGAAGCTG CCCCGCAAGACCCACCGAGGCCTGCGCAAGGTG GCCTGTATTGGGGCATGGCATCCTGCTCGTGTAG CCTTCTCTGTGGCACGCGCTGGGCAGAAAGGCTA CCATCACCGCACTGAGATCAACAAGAAGATTTATA AGATTGGCCAGGGCTACCTTATCAAGGACGGCAA GCTGATCAAGAACAATGCCTCCACTGACTATGACC TATCTGACAAGAGCATCAACCCTCTGGGTGGC | 5 | SSRYL* |
| 136 | NM_0009 67.3_685 | 685 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACTG TGAACCAAGTGTTTGGGCAGGATGAGATGATCGA CGTCATCGGGGTGACCAAGGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 1 | L* |
| 137 | NM_0009 67.3_701 | 701 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC | 5 | LGRMR* |

TABLE 3A-continued

| SEQ ID | identifier_position | position | modified_RNA | PAP length | PAP |
|---|---|---|---|---|---|
| | | | GGGAAGTCGACAGGCCGGGATCCAAGGTGAACAA | | |
| | | | GAAGGAGGTGGTGGAGGCTGTGACCATTGTAGAG | | |
| | | | ACACCACCCATGGTGGTTGTGGGCATTGTGGGCT | | |
| | | | ACGTGGAAACCCCTCGAGGCCTCCGGACCTTCAA | | |
| | | | GACTGTCTTTGCTGAGCACATCAGTGATGAATGCA | | |
| | | | AGAGGCGTTTCTATAAGAATTGGCATAAATCTAAG | | |
| | | | AAGAAGGCCTTTACCAAGTACTGCAAGAAATGGCA | | |
| | | | GGATGAGGATGGCAAGAAGCAGCTGGAGAAGGAC | | |
| | | | TTCAGCAGCATGAAGAAGTACTGCCAAGTCATCCG | | |
| | | | TGTCATTGCCCACACCCAGATGCGCCTGCTTCCTC | | |
| | | | TGCGCCAGAAGAAGGCCCACCTGATGGAGATCCA | | |
| | | | GGTGAACGGAGGCACTGTGGCCGAGAAGCTGGA | | |
| | | | CTGGGCCCGCGAGAGGCTTGAGCAGCAGGTACCT | | |
| | | | GTGAACCAAGTGTTTGGGCGGATGAGATGATCGA | | |
| | | | CGTCATCGGGGTGACCAAGGGCAAAGGCTACAAA | | |
| | | | GGGGTCACCAGTCGTTGGCACACCAAGAAGCTGC | | |
| | | | CCCGCAAGACCCACCGAGGCCTGCGCAAGGTGG | | |
| | | | CCTGTATTGGGGCATGGCATCCTGCTCGTGTAGC | | |
| | | | CTTCTCTGTGGCACGCGCTGGGCAGAAAGGCTAC | | |
| | | | CATCACCGCACTGAGATCAACAAGAAGATTTATAA | | |
| | | | GATTGGCCAGGGCTACCTTATCAAGGACGGCAAG | | |
| | | | CTGATCAAGAACAATGCCTCCACTGACTATGACCT | | |
| | | | ATCTGACAAGAGCATCAACCCTCTGGGTGGC | | |
| 138 | NM_000967.3_706 | 706 | CCAGATTTGGCTTTATATAGCGGACCCGTAAGGCC | 3 | RMR* |
| | | | GACCGGCCTCTACCGGCGGGATTTGATGGCGTGA | | |
| | | | TGTCTCACAGAAAGTTCTCCGCTCCCAGACATGGG | | |
| | | | TCCCTCGGCTTCCTGCCTCGGAAGCGCAGCAGCA | | |
| | | | GGCATCGTGGGAAGGTGAAGAGCTTCCCTAAGGA | | |
| | | | TGACCCGTCCAAGCCGGTCCACCTCACAGCCTTC | | |
| | | | CTGGGATACAAGGCTGGCATGACTCACATCGTGC | | |
| | | | GGGAAGTCGACAGGCCGGGATCCAAGGTGAACAA | | |
| | | | GAAGGAGGTGGTGGAGGCTGTGACCATTGTAGAG | | |
| | | | ACACCACCCATGGTGGTTGTGGGCATTGTGGGCT | | |
| | | | ACGTGGAAACCCCTCGAGGCCTCCGGACCTTCAA | | |
| | | | GACTGTCTTTGCTGAGCACATCAGTGATGAATGCA | | |
| | | | AGAGGCGTTTCTATAAGAATTGGCATAAATCTAAG | | |
| | | | AAGAAGGCCTTTACCAAGTACTGCAAGAAATGGCA | | |
| | | | GGATGAGGATGGCAAGAAGCAGCTGGAGAAGGAC | | |
| | | | TTCAGCAGCATGAAGAAGTACTGCCAAGTCATCCG | | |
| | | | TGTCATTGCCCACACCCAGATGCGCCTGCTTCCTC | | |
| | | | TGCGCCAGAAGAAGGCCCACCTGATGGAGATCCA | | |
| | | | GGTGAACGGAGGCACTGTGGCCGAGAAGCTGGA | | |
| | | | CTGGGCCCGCGAGAGGCTTGAGCAGCAGGTACCT | | |
| | | | GTGAACCAAGTGTTTGGGCGGATGAGATGATCGA | | |
| | | | CGTCATCGGGGTGACCAAGGGCAAAGGCTACAAA | | |
| | | | GGGGTCACCAGTCGTTGGCACACCAAGAAGCTGC | | |
| | | | CCCGCAAGACCCACCGAGGCCTGCGCAAGGTGG | | |
| | | | CCTGTATTGGGGCATGGCATCCTGCTCGTGTAGC | | |
| | | | CTTCTCTGTGGCACGCGCTGGGCAGAAAGGCTAC | | |
| | | | CATCACCGCACTGAGATCAACAAGAAGATTTATAA | | |
| | | | GATTGGCCAGGGCTACCTTATCAAGGACGGCAAG | | |
| | | | CTGATCAAGAACAATGCCTCCACTGACTATGACCT | | |
| | | | ATCTGACAAGAGCATCAACCCTCTGGGTGGC | | |
| 139 | NM_000967.3_726 | 726 | CCAGATTTGGCTTTATATAGCGGACCCGTAAGGCC | 2 | SG* |
| | | | GACCGGCCTCTACCGGCGGGATTTGATGGCGTGA | | |
| | | | TGTCTCACAGAAAGTTCTCCGCTCCCAGACATGGG | | |
| | | | TCCCTCGGCTTCCTGCCTCGGAAGCGCAGCAGCA | | |
| | | | GGCATCGTGGGAAGGTGAAGAGCTTCCCTAAGGA | | |
| | | | TGACCCGTCCAAGCCGGTCCACCTCACAGCCTTC | | |
| | | | CTGGGATACAAGGCTGGCATGACTCACATCGTGC | | |
| | | | GGGAAGTCGACAGGCCGGGATCCAAGGTGAACAA | | |
| | | | GAAGGAGGTGGTGGAGGCTGTGACCATTGTAGAG | | |
| | | | ACACCACCCATGGTGGTTGTGGGCATTGTGGGCT | | |
| | | | ACGTGGAAACCCCTCGAGGCCTCCGGACCTTCAA | | |
| | | | GACTGTCTTTGCTGAGCACATCAGTGATGAATGCA | | |
| | | | AGAGGCGTTTCTATAAGAATTGGCATAAATCTAAG | | |
| | | | AAGAAGGCCTTTACCAAGTACTGCAAGAAATGGCA | | |
| | | | GGATGAGGATGGCAAGAAGCAGCTGGAGAAGGAC | | |
| | | | TTCAGCAGCATGAAGAAGTACTGCCAAGTCATCCG | | |
| | | | TGTCATTGCCCACACCCAGATGCGCCTGCTTCCTC | | |
| | | | TGCGCCAGAAGAAGGCCCACCTGATGGAGATCCA | | |
| | | | GGTGAACGGAGGCACTGTGGCCGAGAAGCTGGA | | |
| | | | CTGGGCCCGCGAGAGGCTTGAGCAGCAGGTACCT | | |
| | | | GTGAACCAAGTGTTTGGGCAGGATGAGATGATCG | | |
| | | | ACGTCTCGGGGTGACCAAGGGCAAAGGCTACAAA | | |
| | | | GGGGTCACCAGTCGTTGGCACACCAAGAAGCTGC | | |
| | | | CCCGCAAGACCCACCGAGGCCTGCGCAAGGTGG | | |

TABLE 3A-continued

| SEQ ID | identifier_ position | position | modified_RNA | PAP length | PAP |
|---|---|---|---|---|---|
| | | | CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | | |
| 140 | NM_0009 67.3_737 | 737 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACCT GTGAACCAAGTGTTTGGGCAGGATGAGATGATCG ACGTCATCGGGGTGACAAGGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 38 | RAKATKGS PVVGTPRS CPARPTEA CARWPVL GHGILLV* |
| 141 | NM_0009 67.3_742 | 742 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACCT GTGAACCAAGTGTTTGGGCAGGATGAGATGATCG ACGTCATCGGGGTGACCAAGGCAAAGGCTACAAA GGGGTCACCAGTCGTTGGCACACCAAGAAGCTGC CCCGCAAGACCCACCGAGGCCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 37 | AKATKGSP VVGTPRSC PARPTEAC ARWPVLG HGILLV* |
| 142 | NM_0009 67.3_755 | 755 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA | 31 | SPVVGTPR SCPARPTE ACARWPV LGHGILLV* |

TABLE 3A-continued

| SEQ ID | identifier_position | position | modified_RNA | PAP length | PAP |
|---|---|---|---|---|---|
| | | | GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>GGGGTCACCAGTCGTTGGCACACCAAGAAGCTGC<br>CCCGCAAGACCCACCGAGGCCTGCGCAAGGTGG<br>CCTGTATTGGGGCATGGCATCCTGCTCGTGTAGC<br>CTTCTCTGTGGCACGCGCTGGGCAGAAAGGCTAC<br>CATCACCGCACTGAGATCAACAAGAAGATTTATAA<br>GATTGGCCAGGGCTACCTTATCAAGGACGGCAAG<br>CTGATCAAGAACAATGCCTCCACTGACTATGACCT<br>ATCTGACAAGAGCATCAACCCTCTGGGTGGC | | |
| 143 | NM_0009<br>67.3_771 | 771 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>AGGGGTCACCAGTCGTGGCACACCAAGAAGCTGC<br>CCCGCAAGACCCACCGAGGCCTGCGCAAGGTGG<br>CCTGTATTGGGGCATGGCATCCTGCTCGTGTAGC<br>CTTCTCTGTGGCACGCGCTGGGCAGAAAGGCTAC<br>CATCACCGCACTGAGATCAACAAGAAGATTTATAA<br>GATTGGCCAGGGCTACCTTATCAAGGACGGCAAG<br>CTGATCAAGAACAATGCCTCCACTGACTATGACCT<br>ATCTGACAAGAGCATCAACCCTCTGGGTGGC | 27 | GTPRSCPA<br>RPTEACAR<br>WPVLGHGI<br>LLV* |
| 144 | NM_0009<br>67.3_774 | 774 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>AGGGGTCACCAGTCGTTGGCACACCAAGAAGCTGC<br>CCCGCAAGACCCACCGAGGCCTGCGCAAGGTGG<br>CCTGTATTGGGGCATGGCATCCTGCTCGTGTAGC<br>CTTCTCTGTGGCACGCGCTGGGCAGAAAGGCTAC<br>CATCACCGCACTGAGATCAACAAGAAGATTTATAA<br>GATTGGCCAGGGCTACCTTATCAAGGACGGCAAG | 26 | TPRSCPAR<br>PTEACAR<br>WPVLGHGI<br>LLV* |

TABLE 3A-continued

| SEQ ID | identifier_ position | position | modified_RNA | PAP length | PAP |
|---|---|---|---|---|---|
| 145 | NM_0009 67.3_810 | 810 | CTGATCAAGAACAATGCCTCCACTGACTATGACCT ATCTGACAAGAGCATCAACCCTCTGGGTGGC CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACCT GTGAACCAAGTGTTTGGGCAGGATGAGATGATCG ACGTCATCGGGGTGACCAAGGGCAAAGGCTACAA AGGGGTCACCAGTCGTTGGCACACCAAGAAGCTG CCCCGCAAGACCCACCGAGGCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 14 | CARWPVL GHGILLV* |
| 146 | NM_0009 67.3_830 | 830 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACCT GTGAACCAAGTGTTTGGGCAGGATGAGATGATCG ACGTCATCGGGGTGACCAAGGGCAAAGGCTACAA AGGGGTCACCAGTCGTTGGCACACCAAGAAGCTG CCCCGCAAGACCCACCGAGGCTGCGCAAGGTGG CCTGTATTGGGGCATGGCATCCTGCTCGTGTAGC CTTCTCTGTGGCACGCGCTGGGCAGAAAGGCTAC CATCACCGCACTGAGATCAACAAGAAGATTTATAA GATTGGCCAGGGCTACCTTATCAAGGACGGCAAG CTGATCAAGAACAATGCCTCCACTGACTATGACCT ATCTGACAAGAGCATCAACCCTCTGGGTGGC | 8 | MGHGILLV* |
| 147 | NM_0009 67.3_886 | 886 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC | 25 | ATITALRST RRFIRLAR ATLSRTAS* |

TABLE 3A-continued

| SEQ ID | identifier_ position | position | modified_RNA | PAP length | PAP |
|---|---|---|---|---|---|
| | | | TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>AGGGGTCACCAGTCGTTGGCACACCAAGAAGCTG<br>CCCCGCAAGACCCACCGAGGCCTGCGCAAGGTG<br>GCCTGTATTGGGGCATGGCATCCTGCTCGTGTAG<br>CCTTCTCTGTGGCACGCGCTGGGCAGAAAGCTAC<br>CATCACCGCACTGAGATCAACAAGAAGATTTATAA<br>GATTGGCCAGGGCTACCTTATCAAGGACGGCAAG<br>CTGATCAAGAACAATGCCTCCACTGACTATGACCT<br>ATCTGACAAGAGCATCAACCCTCTGGGTGGC | | |
| 148 | NM_0009 67.3_899 | 899 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>AGGGGTCACCAGTCGTTGGCACACCAAGAAGCTG<br>CCCCGCAAGACCCACCGAGGCCTGCGCAAGGTG<br>GCCTGTATTGGGGCATGGCATCCTGCTCGTGTAG<br>CCTTCTCTGTGGCACGCGCTGGGCAGAAAGGCTA<br>CCATCACCGACTGAGATCAACAAGAAGATTTATAA<br>GATTGGCCAGGGCTACCTTATCAAGGACGGCAAG<br>CTGATCAAGAACAATGCCTCCACTGACTATGACCT<br>ATCTGACAAGAGCATCAACCCTCTGGGTGGC | 20 | LRSTRRFI RLARATLS RTAS* |
| 149 | NM_0009 67.3_913 | 913 | CCAGATTTGGCTTTATATAGCGGACCCGTAAGGCC<br>GACCGGCCTCTACCGGCGGGATTTGATGGCGTGA<br>TGTCTCACAGAAAGTTCTCCGCTCCCAGACATGGG<br>TCCCTCGGCTTCCTGCCTCGGAAGCGCAGCAGCA<br>GGCATCGTGGGAAGGTGAAGAGCTTCCCTAAGGA<br>TGACCCGTCCAAGCCGGTCCACCTCACAGCCTTC<br>CTGGGATACAAGGCTGGCATGACTCACATCGTGC<br>GGGAAGTCGACAGGCCGGGATCCAAGGTGAACAA<br>GAAGGAGGTGGTGGAGGCTGTGACCATTGTAGAG<br>ACACCACCCATGGTGGTTGTGGGCATTGTGGGCT<br>ACGTGGAAACCCCTCGAGGCCTCCGGACCTTCAA<br>GACTGTCTTTGCTGAGCACATCAGTGATGAATGCA<br>AGAGGCGTTTCTATAAGAATTGGCATAAATCTAAG<br>AAGAAGGCCTTTACCAAGTACTGCAAGAAATGGCA<br>GGATGAGGATGGCAAGAAGCAGCTGGAGAAGGAC<br>TTCAGCAGCATGAAGAAGTACTGCCAAGTCATCCG<br>TGTCATTGCCCACACCCAGATGCGCCTGCTTCCTC<br>TGCGCCAGAAGAAGGCCCACCTGATGGAGATCCA<br>GGTGAACGGAGGCACTGTGGCCGAGAAGCTGGA<br>CTGGGCCCGCGAGAGGCTTGAGCAGCAGGTACCT<br>GTGAACCAAGTGTTTGGGCAGGATGAGATGATCG<br>ACGTCATCGGGGTGACCAAGGGCAAAGGCTACAA<br>AGGGGTCACCAGTCGTTGGCACACCAAGAAGCTG<br>CCCCGCAAGACCCACCGAGGCCTGCGCAAGGTG<br>GCCTGTATTGGGGCATGGCATCCTGCTCGTGTAG<br>CCTTCTCTGTGGCACGCGCTGGGCAGAAAGGCTA<br>CCATCACCGCACTGAGATCAACAGAAGATTTATAA<br>GATTGGCCAGGGCTACCTTATCAAGGACGGCAAG<br>CTGATCAAGAACAATGCCTCCACTGACTATGACCT<br>ATCTGACAAGAGCATCAACCCTCTGGGTGGC | 16 | RRFIRLAR ATLSRTAS* |

TABLE 3A-continued

| SEQ ID | identifier_ position | position | modified_RNA | PAP length | PAP |
|---|---|---|---|---|---|
| 150 | NM_0009 67.3_937 | 937 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCTTTACCAAGTACTGCAAGAAATGGCA GGATGAGGATGGCAAGAAGCAGCTGGAGAAGGAC TTCAGCAGCATGAAGAAGTACTGCCAAGTCATCCG TGTCATTGCCCACACCCAGATGCGCCTGCTTCCTC TGCGCCAGAAGAAGGCCCACCTGATGGAGATCCA GGTGAACGGAGGCACTGTGGCCGAGAAGCTGGA CTGGGCCCGCGAGAGGCTTGAGCAGCAGGTACCT GTGAACCAAGTGTTTGGGCAGGATGAGATGATCG ACGTCATCGGGGTGACCAAGGGCAAAGGCTACAA AGGGGTCACCAGTCGTTGGCACACCAAGAAGCTG CCCCGCAAGACCCACCGAGGCCTGCGCAAGGTG GCCTGTATTGGGGCATGGCATCCTGCTCGTGTAG CCTTCTCTGTGGCACGCGCTGGGCAGAAAGGCTA CCATCACCGCACTGAGATCAACAAGAAGATTTATA AGATTGGCCAGGCTACCTTATCAAGGACGGCAAG CTGATCAAGAACAATGCCTCCACTGACTATGACCT ATCTGACAAGAGCATCAACCCTCTGGGTGGC | 8 | ATLSRTAS* |
| 151 | NM_0009 68.2_1033 | 1033 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAG | 0 | * |
| 152 | NM_0009 68.2_1217 | 1217 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA | 48 | VLRSRRSL WWEKRQQ LPRNQPLK RSLQRRNL LQRRRSLL HKLLNLIP* |

TABLE 3A-continued

| SEQ ID | identifier_position | position | modified_RNA | PAP length | PAP |
|---|---|---|---|---|---|
| | | | ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAG | | |
| 153 | NM_0009 68.2_127 | 127 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTGCCTGCTGTAT TCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAGA | 13 | CLLYSRLL FDQIL* |
| 154 | NM_0009 68.2_173 | 173 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAGA | 18 | LFTPTCAK TTDSPMLS VN* |
| 155 | NM_0009 68.2_255 | 255 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA | 48 | GVLAELWL EFPEFEVV GLTALARV LLETCVVE |

TABLE 3A-continued

| SEQ ID | identifier_position | position | modified_RNA | length PAP | PAP |
|---|---|---|---|---|---|
| | | | TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTGGGGTACTGGCAGAGCTGTGGCT<br>CGAATTCCCAGAGTTCGAGGTGGTGGGACTCACC<br>GCTCTGGCCAGGGTGCTTTTGGAAACATGTGTCGT<br>GGAGGCCGAATGTTTGCACCAACCAAAACCTGGC<br>GCCGTTGGCATCGTAGAGTGAACACAACCCAAAAA<br>CGATACGCCATCTGTTCTGCCCTGGCTGCCTCAGC<br>CCTACCAGCACTGGTCATGTCTAAAGGTCATCGTA<br>TTGAGGAAGTTCCTGAACTTCCTTTGGTAGTTGAA<br>GATAAAGTTGAAGGCTACAAGAAGACCAAGGAAG<br>CTGTTTTGCTCCTTAAGAAACTTAAAGCCTGGAATG<br>ATATCAAAAAGGTCTATGCCTCTCAGCGAATGAGA<br>GCTGGCAAAGGCAAAATGAGAAACCGTCGCCGTA<br>TCCAGCGCAGGGGCCCGTGCATCATCTATAATGA<br>GGATAATGGTATCATCAAGGCCTTCAGAAACATCC<br>CTGGAATTACTCTGCTTAATGTAAGCAAGCTGAAC<br>ATTTTGAAGCTTGCTCCTGGTGGGCATGTGGGACG<br>TTTCTGCATTTGGACTGAAAGTGCTTTCCGGAAGT<br>TAGATGAATTGTACGGCACTTGGCGTAAAGCCGCT<br>TCCCTCAAGAGTAACTACAATCTTCCCATGCACAA<br>GATGATTAATACAGATCTTAGCAGAATCTTGAAAAG<br>CCCAGAGATCCAAAGAGCCCTTCGAGCACCACGC<br>AAGAAGATCCATCGCAGAGTCCTAAAGAAGAACCC<br>ACTGAAAAACTTGAGA | | AECLHQPK<br>PGAVGIVE* |
| 156 | NM_0009<br>68.2_325 | 325 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGTGCTTTTGGAAACATGTGTCGT<br>GGAGGCCGAATGTTTGCACCAACCAAAACCTGGC<br>GCCGTTGGCATCGTAGAGTGAACACAACCCAAAAA<br>CGATACGCCATCTGTTCTGCCCTGGCTGCCTCAGC<br>CCTACCAGCACTGGTCATGTCTAAAGGTCATCGTA<br>TTGAGGAAGTTCCTGAACTTCCTTTGGTAGTTGAA<br>GATAAAGTTGAAGGCTACAAGAAGACCAAGGAAG<br>CTGTTTTGCTCCTTAAGAAACTTAAAGCCTGGAATG<br>ATATCAAAAAGGTCTATGCCTCTCAGCGAATGAGA<br>GCTGGCAAAGGCAAAATGAGAAACCGTCGCCGTA<br>TCCAGCGCAGGGGCCCGTGCATCATCTATAATGA<br>GGATAATGGTATCATCAAGGCCTTCAGAAACATCC<br>CTGGAATTACTCTGCTTAATGTAAGCAAGCTGAAC<br>ATTTTGAAGCTTGCTCCTGGTGGGCATGTGGGACG<br>TTTCTGCATTTGGACTGAAAGTGCTTTCCGGAAGT<br>TAGATGAATTGTACGGCACTTGGCGTAAAGCCGCT<br>TCCCTCAAGAGTAACTACAATCTTCCCATGCACAA<br>GATGATTAATACAGATCTTAGCAGAATCTTGAAAAG<br>CCCAGAGATCCAAAGAGCCCTTCGAGCACCACGC<br>AAGAAGATCCATCGCAGAGTCCTAAAGAAGAACCC<br>ACTGAAAAACTTGAGA | 25 | VLLETCVV<br>EAECLHQP<br>KPGAVGIV<br>E* |
| 157 | NM_0009<br>68.2_332 | 332 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGGTGCTTTGGAAACATGTGTCG<br>TGGAGGCCGAATGTTTGCACCAACCAAAACCTGG<br>CGCCGTTGGCATCGTAGAGTGAACACAACCCAAA<br>AACGATACGCCATCTGTTCTGCCCTGGCTGCCTCA<br>GCCCTACCAGCACTGGTCATGTCTAAAGGTCATCG<br>TATTGAGGAAGTTCCTGAACTTCCTTTGGTAGTTGA<br>AGATAAAGTTGAAGGCTACAAGAAGACCAAGGAAG<br>CTGTTTTGCTCCTTAAGAAACTTAAAGCCTGGAATG<br>ATATCAAAAAGGTCTATGCCTCTCAGCGAATGAGA<br>GCTGGCAAAGGCAAAATGAGAAACCGTCGCCGTA<br>TCCAGCGCAGGGGCCCGTGCATCATCTATAATGA<br>GGATAATGGTATCATCAAGGCCTTCAGAAACATCC | 23 | LETCVVEA<br>ECLHQPKP<br>GAVGIVE* |

TABLE 3A-continued

| SEQ ID | identifier_position | position | modified_RNA | PAP length | PAP |
|---|---|---|---|---|---|
| | | | CTGGAATTACTCTGCTTAATGTAAGCAAGCTGAAC<br>ATTTTGAAGCTTGCTCCTGGTGGGCATGTGGGACG<br>TTTCTGCATTTGGACTGAAAGTGCTTTCCGGAAGT<br>TAGATGAATTGTACGGCACTTGGCGTAAAGCCGCT<br>TCCCTCAAGAGTAACTACAATCTTCCCATGCACAA<br>GATGATTAATACAGATCTTAGCAGAATCTTGAAAAG<br>CCCAGAGATCCAAAGAGCCCTTCGAGCACCACGC<br>AAGAAGATCCATCGCAGAGTCCTAAAGAAGAACCC<br>ACTGAAAAACTTGAGA | | |
| 158 | NM_0009<br>68.2_362 | 362 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGGTGCTTTTGGAAACATGTGTC<br>GTGGAGGCCGAATGTTGCACCAACCAAAACCTGG<br>CGCCGTTGGCATCGTAGAGTGAACACAACCCAAA<br>AACGATACGCCATCTGTTCTGCCCTGGCTGCCTCA<br>GCCCTACCAGCACTGGTCATGTCTAAAGGTCATCG<br>TATTGAGGAAGTTCCTGAACTTCCTTTGGTAGTTGA<br>AGATAAAGTTGAAGGCTACAAGAAGACCAAGGAAG<br>CTGTTTTGCTCCTTAAGAAACTTAAAGCCTGGAATG<br>ATATCAAAAAGGTCTATGCCTCTCAGCGAATGAGA<br>GCTGGCAAAGGCAAAATGAGAAACCGTCGCCGTA<br>TCCAGCGCAGGGGCCCGTGCATCATCTATAATGA<br>GGATAATGGTATCATCAAGGCCTTCAGAAACATCC<br>CTGGAATTACTCTGCTTAATGTAAGCAAGCTGAAC<br>ATTTTGAAGCTTGCTCCTGGTGGGCATGTGGGACG<br>TTTCTGCATTTGGACTGAAAGTGCTTTCCGGAAGT<br>TAGATGAATTGTACGGCACTTGGCGTAAAGCCGCT<br>TCCCTCAAGAGTAACTACAATCTTCCCATGCACAA<br>GATGATTAATACAGATCTTAGCAGAATCTTGAAAAG<br>CCCAGAGATCCAAAGAGCCCTTCGAGCACCACGC<br>AAGAAGATCCATCGCAGAGTCCTAAAGAAGAACCC<br>ACTGAAAAACTTGAGA | 13 | LHQPKPGA<br>VGIVE* |
| 159 | NM_0009<br>68.2_377 | 377 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGGTGCTTTTGGAAACATGTGTC<br>GTGGAGGCCGAATGTTTGCACCAACCAAAACTGG<br>CGCCGTTGGCATCGTAGAGTGAACACAACCCAAA<br>AACGATACGCCATCTGTTCTGCCCTGGCTGCCTCA<br>GCCCTACCAGCACTGGTCATGTCTAAAGGTCATCG<br>TATTGAGGAAGTTCCTGAACTTCCTTTGGTAGTTGA<br>AGATAAAGTTGAAGGCTACAAGAAGACCAAGGAAG<br>CTGTTTTGCTCCTTAAGAAACTTAAAGCCTGGAATG<br>ATATCAAAAAGGTCTATGCCTCTCAGCGAATGAGA<br>GCTGGCAAAGGCAAAATGAGAAACCGTCGCCGTA<br>TCCAGCGCAGGGGCCCGTGCATCATCTATAATGA<br>GGATAATGGTATCATCAAGGCCTTCAGAAACATCC<br>CTGGAATTACTCTGCTTAATGTAAGCAAGCTGAAC<br>ATTTTGAAGCTTGCTCCTGGTGGGCATGTGGGACG<br>TTTCTGCATTTGGACTGAAAGTGCTTTCCGGAAGT<br>TAGATGAATTGTACGGCACTTGGCGTAAAGCCGCT<br>TCCCTCAAGAGTAACTACAATCTTCCCATGCACAA<br>GATGATTAATACAGATCTTAGCAGAATCTTGAAAAG<br>CCCAGAGATCCAAAGAGCCCTTCGAGCACCACGC<br>AAGAAGATCCATCGCAGAGTCCTAAAGAAGAACCC<br>ACTGAAAAACTTGAGA | 7 | GAVGIVE* |
| 160 | NM_0009<br>68.2_411 | 411 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC | 34 | KNDTPSVL<br>PWLPQPY<br>QHWSCLK<br>VIVLRKFLN<br>FLW* |

TABLE 3A-continued

| SEQ ID | identifier_ position | position | modified_RNA | PAP length | PAP |
|---|---|---|---|---|---|
| | | | TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCAAA AACGATACGCCATCTGTTCTGCCCTGGCTGCCTCA GCCCTACCAGCACTGGTCATGTCTAAAGGTCATCG TATTGAGGAAGTTCCTGAACTTCCTTTGGTAGTTGA AGATAAAGTTGAAGGCTACAAGAAGACCAAGGAAG CTGTTTTGCTCCTTAAGAAACTTAAAGCCTGGAATG ATATCAAAAAGGTCTATGCCTCTCAGCGAATGAGA GCTGGCAAAGGCAAAATGAGAAACCGTCGCCGTA TCCAGCGCAGGGGCCCGTGCATCATCTATAATGA GGATAATGGTATCATCAAGGCCTTCAGAAACATCC CTGGAATTACTCTGCTTAATGTAAGCAAGCTGAAC ATTTTGAAGCTTGCTCCTGGTGGGCATGTGGGACG TTTCTGCATTTGGACTGAAAGTGCTTTCCGGAAGT TAGATGAATTGTACGGCACTTGGCGTAAAGCCGCT TCCCTCAAGAGTAACTACAATCTTCCCATGCACAA GATGATTAATACAGATCTTAGCAGAATCTTGAAAAG CCCAGAGATCCAAAGAGCCCTTCGAGCACCACGC AAGAAGATCCATCGCAGAGTCCTAAAGAAGAACCC ACTGAAAAACTTGAGA | | |
| 161 | NM_0009 68.2_442 | 442 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGTGCCTCA GCCCTACCAGCACTGGTCATGTCTAAAGGTCATCG TATTGAGGAAGTTCCTGAACTTCCTTTGGTAGTTGA AGATAAAGTTGAAGGCTACAAGAAGACCAAGGAAG CTGTTTTGCTCCTTAAGAAACTTAAAGCCTGGAATG ATATCAAAAAGGTCTATGCCTCTCAGCGAATGAGA GCTGGCAAAGGCAAAATGAGAAACCGTCGCCGTA TCCAGCGCAGGGGCCCGTGCATCATCTATAATGA GGATAATGGTATCATCAAGGCCTTCAGAAACATCC CTGGAATTACTCTGCTTAATGTAAGCAAGCTGAAC ATTTTGAAGCTTGCTCCTGGTGGGCATGTGGGACG TTTCTGCATTTGGACTGAAAGTGCTTTCCGGAAGT TAGATGAATTGTACGGCACTTGGCGTAAAGCCGCT TCCCTCAAGAGTAACTACAATCTTCCCATGCACAA GATGATTAATACAGATCTTAGCAGAATCTTGAAAAG CCCAGAGATCCAAAGAGCCCTTCGAGCACCACGC AAGAAGATCCATCGCAGAGTCCTAAAGAAGAACCC ACTGAAAAACTTGAGA | 24 | VPQPYQH WSCLKVIV LRKFLNFL W* |
| 162 | NM_0009 68.2_446 | 446 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCTCA GCCCTACCAGCACTGGTCATGTCTAAAGGTCATCG TATTGAGGAAGTTCCTGAACTTCCTTTGGTAGTTGA AGATAAAGTTGAAGGCTACAAGAAGACCAAGGAAG CTGTTTTGCTCCTTAAGAAACTTAAAGCCTGGAATG ATATCAAAAAGGTCTATGCCTCTCAGCGAATGAGA GCTGGCAAAGGCAAAATGAGAAACCGTCGCCGTA TCCAGCGCAGGGGCCCGTGCATCATCTATAATGA GGATAATGGTATCATCAAGGCCTTCAGAAACATCC CTGGAATTACTCTGCTTAATGTAAGCAAGCTGAAC ATTTTGAAGCTTGCTCCTGGTGGGCATGTGGGACG TTTCTGCATTTGGACTGAAAGTGCTTTCCGGAAGT TAGATGAATTGTACGGCACTTGGCGTAAAGCCGCT | 22 | QPYQHWS CLKVIVLRK FLNFLW* |

TABLE 3A-continued

| SEQ ID | identifier_position | position | modified_RNA | PAP length | PAP |
|---|---|---|---|---|---|
| 163 | NM_0009 68.2_488 | 488 | TCCCTCAAGAGTAACTACAATCTTCCCATGCACAA GATGATTAATACAGATCTTAGCAGAATCTTGAAAAG CCCAGAGATCCAAAGAGCCCTTCGAGCACCACGC AAGAAGATCCATCGCAGAGTCCTAAAGAAGAACCC ACTGAAAAACTTGAGA CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATGAGGAAGTTCCTGAACTTCCTTTGGTAGTTG AAGATAAAGTTGAAGGCTACAAGAAGACCAAGGAA GCTGTTTTGCTCCTTAAGAAACTTAAAGCCTGGAAT GATATCAAAAAGGTCTATGCCTCTCAGCGAATGAG AGCTGGCAAAGGCAAAATGAGAAACCGTCGCCGT ATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 9 | MRKFLNFL W* |
| 164 | NM_0009 68.2_511 | 511 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTGGTAGTTG AAGATAAAGTTGAAGGCTACAAGAAGACCAAGGAA GCTGTTTTGCTCCTTAAGAAACTTAAAGCCTGGAAT GATATCAAAAAGGTCTATGCCTCTCAGCGAATGAG AGCTGGCAAAGGCAAAATGAGAAACCGTCGCCGT ATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 1 | W* |
| 165 | NM_0009 68.2_562 | 562 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA | 20 | CSLRNLKP GMISKRSM PLSE* |

TABLE 3A-continued

| SEQ ID | identifier_position | position | modified_RNA | PAP length | PAP |
|---|---|---|---|---|---|
| | | | AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTGCTCCTTAAGAAACTTAAAGCCTGGAA TGATATCAAAAAGGTCTATGCCTCTCAGCGAATGA GAGCTGGCAAAGGCAAAATGAGAAACCGTCGCCG TATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | | |
| 166 | NM_0009 68.2_587 | 587 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGAAT GATATCAAAAAGGTCTATGCCTCTCAGCGAATGAG AGCTGGCAAAGGCAAAATGAGAAACCGTCGCCGT ATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 0 | * |
| 167 | NM_0009 68.2_601 | 601 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAGGTCTATGCCTCTCAGCGAATGA GAGCTGGCAAAGGCAAAATGAGAAACCGTCGCCG TATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG | 7 | RSMPLSE* |

TABLE 3A-continued

| SEQ ID | identifier_position | position | modified_RNA | PAP length | PAP |
|---|---|---|---|---|---|
| 168 | NM_000968.2_618 | 618 | CAAGAAGATCCATCGCAGAGTCCTAAAGAAGAACC CACTGAAAAACTTGAGA CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGGAATGA GAGCTGGCAAAGGCAAAATGAGAAACCGTCGCCG TATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 1 | E* |
| 169 | NM_000968.2_632 | 632 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGAAAGGCAAAATGAGAAACCGTCGCCG TATCCAGCGCAGGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 2 | AK* |
| 170 | NM_000968.2_635 | 635 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT | 2 | AK* |

TABLE 3A-continued

| SEQ ID | identifier_position | position | modified_RNA | PAP length | PAP |
|---|---|---|---|---|---|
| | | | GAAGATAAAGTTGAAGGCTACAAGAAGACCAAGGA<br>AGCTGTTTTGCTCCTTAAGAAACTTAAAGCCTGGA<br>ATGATATCAAAAAGGTCTATGCCTCTCAGCGAATG<br>AGAGCTGGCAAGGCAAAATGAGAAACCGTCGCCG<br>TATCCAGCGCAGGGGCCCGTGCATCATCTATAATG<br>AGGATAATGGTATCATCAAGGCCTTCAGAAACATC<br>CCTGGAATTACTCTGCTTAATGTAAGCAAGCTGAA<br>CATTTTGAAGCTTGCTCCTGGTGGGCATGTGGGAC<br>GTTTCTGCATTTGGACTGAAAGTGCTTTCCGGAAG<br>TTAGATGAATTGTACGGCACTTGGCGTAAAGCCGC<br>TTCCCTCAAGAGTAACTACAATCTTCCCATGCACA<br>AGATGATTAATACAGATCTTAGCAGAATCTTGAAAA<br>GCCCAGAGATCCAAAGAGCCCTTCGAGCACCACG<br>CAAGAAGATCCATCGCAGAGTCCTAAAGAAGAACC<br>CACTGAAAAACTTGAGA | | |
| 171 | NM_0009<br>68.2_642 | 642 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGGTGCTTTTGGAAACATGTGTC<br>GTGGAGGCCGAATGTTTGCACCAACCAAAACCTG<br>GCGCCGTTGGCATCGTAGAGTGAACACAACCCAA<br>AAACGATACGCCATCTGTTCTGCCCTGGCTGCCTC<br>AGCCCTACCAGCACTGGTCATGTCTAAAGGTCATC<br>GTATTGAGGAAGTTCCTGAACTTCCTTTGGTAGTT<br>GAAGATAAAGTTGAAGGCTACAAGAAGACCAAGGA<br>AGCTGTTTTGCTCCTTAAGAAACTTAAAGCCTGGA<br>ATGATATCAAAAAGGTCTATGCCTCTCAGCGAATG<br>AGAGCTGGCAAAGGCAAATGAGAAACCGTCGCCG<br>TATCCAGCGCAGGGGCCCGTGCATCATCTATAATG<br>AGGATAATGGTATCATCAAGGCCTTCAGAAACATC<br>CCTGGAATTACTCTGCTTAATGTAAGCAAGCTGAA<br>CATTTTGAAGCTTGCTCCTGGTGGGCATGTGGGAC<br>GTTTCTGCATTTGGACTGAAAGTGCTTTCCGGAAG<br>TTAGATGAATTGTACGGCACTTGGCGTAAAGCCGC<br>TTCCCTCAAGAGTAACTACAATCTTCCCATGCACA<br>AGATGATTAATACAGATCTTAGCAGAATCTTGAAAA<br>GCCCAGAGATCCAAAGAGCCCTTCGAGCACCACG<br>CAAGAAGATCCATCGCAGAGTCCTAAAGAAGAACC<br>CACTGAAAAACTTGAGA | 0 | * |
| 172 | NM_0009<br>68.2_657 | 657 | CTTTTCCTGTGGCAGCAGCCGGGCTGAGAGGAGC<br>GTGGCTGTCTCCTCTCTCCGCCATGGCGTGTGCT<br>CGCCCACTGATATCGGTGTACTCCGAAAAGGGGG<br>AGTCATCTGGCAAAAATGTCACTTTGCCTGCTGTA<br>TTCAAGGCTCCTATTCGACCAGATATTGTGAACTTT<br>GTTCACACCAACTTGCGCAAAAACAACAGACAGCC<br>CTATGCTGTCAGTGAATTAGCAGGTCATCAGACTA<br>GTGCTGAGTCTTGGGGTACTGGCAGAGCTGTGGC<br>TCGAATTCCCAGAGTTCGAGGTGGTGGGACTCAC<br>CGCTCTGGCCAGGGTGCTTTTGGAAACATGTGTC<br>GTGGAGGCCGAATGTTTGCACCAACCAAAACCTG<br>GCGCCGTTGGCATCGTAGAGTGAACACAACCCAA<br>AAACGATACGCCATCTGTTCTGCCCTGGCTGCCTC<br>AGCCCTACCAGCACTGGTCATGTCTAAAGGTCATC<br>GTATTGAGGAAGTTCCTGAACTTCCTTTGGTAGTT<br>GAAGATAAAGTTGAAGGCTACAAGAAGACCAAGGA<br>AGCTGTTTTGCTCCTTAAGAAACTTAAAGCCTGGA<br>ATGATATCAAAAAGGTCTATGCCTCTCAGCGAATG<br>AGAGCTGGCAAAGGCAAATGAGAAACCGTCGCG<br>TATCCAGCGCAGGGGCCCGTGCATCATCTATAATG<br>AGGATAATGGTATCATCAAGGCCTTCAGAAACATC<br>CCTGGAATTACTCTGCTTAATGTAAGCAAGCTGAA<br>CATTTTGAAGCTTGCTCCTGGTGGGCATGTGGGAC<br>GTTTCTGCATTTGGACTGAAAGTGCTTTCCGGAAG<br>TTAGATGAATTGTACGGCACTTGGCGTAAAGCCGC<br>TTCCCTCAAGAGTAACTACAATCTTCCCATGCACA<br>AGATGATTAATACAGATCTTAGCAGAATCTTGAAAA<br>GCCCAGAGATCCAAAGAGCCCTTCGAGCACCACG<br>CAAGAAGATCCATCGCAGAGTCCTAAAGAAGAACC<br>CACTGAAAAACTTGAGA | 31 | VSSAGARA<br>SSIMRIMV<br>SSRPSETS<br>LELLCLM* |

TABLE 3A-continued

| SEQ ID | identifier_position | position | modified_RNA | PAP length | PAP |
|---|---|---|---|---|---|
| 173 | NM_0009 68.2_673 | 673 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGCCCGTGCATCATCTATAATG AGGATAATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 26 | ARASSIMRI MVSSRPSE TSLELLCL M* |
| 174 | NM_0009 68.2_676 | 676 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAGA | 25 | RASSIMRI MVSSRPSE TSLELLCL M* |
| 175 | NM_0009 68.2_691 | 691 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA | 20 | MRIMVSSR PSETSLEL LCLM* |

| SEQ ID | identifier_position | position | modified_RNA | PAP length | PAP |
|---|---|---|---|---|---|
| | | | ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATTGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAGA | | |
| 176 | NM_0009 68.2_700 | 700 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATATGGTATCATCAAGGCCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 17 | MVSSRPSE TSLELLCL M* |
| 177 | NM_0009 68.2_716 | 716 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCTTCAGAAACATC CCTGGAATTACTCTGCTTAATGTAAGCAAGCTGAA CATTTTGAAGCTTGCTCCTGGTGGGCATGTGGGAC GTTTCTGCATTTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | 11 | SETSLELL CLM* |
| 178 | NM_0009 68.2_730 | 730 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA | 7 | LELLCLM* |

TABLE 3A-continued

| SEQ ID | identifier_position | position | modified_RNA | PAP length | PAP |
|---|---|---|---|---|---|
| | | | TTCAAGGCTCCTATTCGACCAGATATTGTGAACTTT | | |
| | | | GTTCACACCAACTTGCGCAAAAACAACAGACAGCC | | |
| | | | CTATGCTGTCAGTGAATTAGCAGGTCATCAGACTA | | |
| | | | GTGCTGAGTCTTGGGGTACTGGCAGAGCTGTGGC | | |
| | | | TCGAATTCCCAGAGTTCGAGGTGGTGGGACTCAC | | |
| | | | CGCTCTGGCCAGGGTGCTTTTGGAAACATGTGTC | | |
| | | | GTGGAGGCCGAATGTTTGCACCAACCAAAACCTG | | |
| | | | GCGCCGTTGGCATCGTAGAGTGAACACAACCCAA | | |
| | | | AAACGATACGCCATCTGTTCTGCCCTGGCTGCCTC | | |
| | | | AGCCCTACCAGCACTGGTCATGTCTAAAGGTCATC | | |
| | | | GTATTGAGGAAGTTCCTGAACTTCCTTTGGTAGTT | | |
| | | | GAAGATAAAGTTGAAGGCTACAAGAAGACCAAGGA | | |
| | | | AGCTGTTTTGCTCCTTAAGAAACTTAAAGCCTGGA | | |
| | | | ATGATATCAAAAAGGTCTATGCCTCTCAGCGAATG | | |
| | | | AGAGCTGGCAAAGGCAAAATGAGAAACCGTCGCC | | |
| | | | GTATCCAGCGCAGGGGCCCGTGCATCATCTATAAT | | |
| | | | GAGGATAATGGTATCATCAAGGCCTTCAGAAACAT | | |
| | | | CCTGGAATTACTCTGCTTAATGTAAGCAAGCTGAA | | |
| | | | CATTTTGAAGCTTGCTCCTGGTGGGCATGTGGGAC | | |
| | | | GTTTCTGCATTTGGACTGAAAGTGCTTTCCGGAAG | | |
| | | | TTAGATGAATTGTACGGCACTTGGCGTAAAGCCGC | | |
| | | | TTCCCTCAAGAGTAACTACAATCTTCCCATGCACA | | |
| | | | AGATGATTAATACAGATCTTAGCAGAATCTTGAAAA | | |
| | | | GCCCAGAGATCCAAAGAGCCCTTCGAGCACCACG | | |
| | | | CAAGAAGATCCATCGCAGAGTCCTAAAGAAGAACC | | |
| | | | CACTGAAAAACTTGAGA | | |
| 179 | NM_0009 68.2_769 | 769 | CTTTTCCTGTGGCAGCAGCCGGGCTGAGAGGAGC | 0 | * |
| | | | GTGGCTGTCTCCTCTCTCCGCCATGGCGTGTGCT | | |
| | | | CGCCCACTGATATCGGTGTACTCCGAAAAGGGGG | | |
| | | | AGTCATCTGGCAAAAATGTCACTTTGCCTGCTGTA | | |
| | | | TTCAAGGCTCCTATTCGACCAGATATTGTGAACTTT | | |
| | | | GTTCACACCAACTTGCGCAAAAACAACAGACAGCC | | |
| | | | CTATGCTGTCAGTGAATTAGCAGGTCATCAGACTA | | |
| | | | GTGCTGAGTCTTGGGGTACTGGCAGAGCTGTGGC | | |
| | | | TCGAATTCCCAGAGTTCGAGGTGGTGGGACTCAC | | |
| | | | CGCTCTGGCCAGGGTGCTTTTGGAAACATGTGTC | | |
| | | | GTGGAGGCCGAATGTTTGCACCAACCAAAACCTG | | |
| | | | GCGCCGTTGGCATCGTAGAGTGAACACAACCCAA | | |
| | | | AAACGATACGCCATCTGTTCTGCCCTGGCTGCCTC | | |
| | | | AGCCCTACCAGCACTGGTCATGTCTAAAGGTCATC | | |
| | | | GTATTGAGGAAGTTCCTGAACTTCCTTTGGTAGTT | | |
| | | | GAAGATAAAGTTGAAGGCTACAAGAAGACCAAGGA | | |
| | | | AGCTGTTTTGCTCCTTAAGAAACTTAAAGCCTGGA | | |
| | | | ATGATATCAAAAAGGTCTATGCCTCTCAGCGAATG | | |
| | | | AGAGCTGGCAAAGGCAAAATGAGAAACCGTCGCC | | |
| | | | GTATCCAGCGCAGGGGCCCGTGCATCATCTATAAT | | |
| | | | GAGGATAATGGTATCATCAAGGCCTTCAGAAACAT | | |
| | | | CCCTGGAATTACTCTGCTTAATGTAAGCAAGCTGA | | |
| | | | ACATTTGAAGCTTGCTCCTGGTGGGCATGTGGGAC | | |
| | | | GTTTCTGCATTTGGACTGAAAGTGCTTTCCGGAAG | | |
| | | | TTAGATGAATTGTACGGCACTTGGCGTAAAGCCGC | | |
| | | | TTCCCTCAAGAGTAACTACAATCTTCCCATGCACA | | |
| | | | AGATGATTAATACAGATCTTAGCAGAATCTTGAAAA | | |
| | | | GCCCAGAGATCCAAAGAGCCCTTCGAGCACCACG | | |
| | | | CAAGAAGATCCATCGCAGAGTCCTAAAGAAGAACC | | |
| | | | CACTGAAAAACTTGAGA | | |
| 180 | NM_0009 68.2_810 | 810 | CTTTTCCTGTGGCAGCAGCCGGGCTGAGAGGAGC | 8 | GLKVLSGS* |
| | | | GTGGCTGTCTCCTCTCTCCGCCATGGCGTGTGCT | | |
| | | | CGCCCACTGATATCGGTGTACTCCGAAAAGGGGG | | |
| | | | AGTCATCTGGCAAAAATGTCACTTTGCCTGCTGTA | | |
| | | | TTCAAGGCTCCTATTCGACCAGATATTGTGAACTTT | | |
| | | | GTTCACACCAACTTGCGCAAAAACAACAGACAGCC | | |
| | | | CTATGCTGTCAGTGAATTAGCAGGTCATCAGACTA | | |
| | | | GTGCTGAGTCTTGGGGTACTGGCAGAGCTGTGGC | | |
| | | | TCGAATTCCCAGAGTTCGAGGTGGTGGGACTCAC | | |
| | | | CGCTCTGGCCAGGGTGCTTTTGGAAACATGTGTC | | |
| | | | GTGGAGGCCGAATGTTTGCACCAACCAAAACCTG | | |
| | | | GCGCCGTTGGCATCGTAGAGTGAACACAACCCAA | | |
| | | | AAACGATACGCCATCTGTTCTGCCCTGGCTGCCTC | | |
| | | | AGCCCTACCAGCACTGGTCATGTCTAAAGGTCATC | | |
| | | | GTATTGAGGAAGTTCCTGAACTTCCTTTGGTAGTT | | |
| | | | GAAGATAAAGTTGAAGGCTACAAGAAGACCAAGGA | | |
| | | | AGCTGTTTTGCTCCTTAAGAAACTTAAAGCCTGGA | | |
| | | | ATGATATCAAAAAGGTCTATGCCTCTCAGCGAATG | | |
| | | | AGAGCTGGCAAAGGCAAAATGAGAAACCGTCGCC | | |
| | | | GTATCCAGCGCAGGGGCCCGTGCATCATCTATAAT | | |
| | | | GAGGATAATGGTATCATCAAGGCCTTCAGAAACAT | | |

TABLE 3A-continued

| SEQ ID | identifier_position | position | modified_RNA | PAP length | PAP |
|---|---|---|---|---|---|
| | | | CCCTGGAATTACTCTGCTTAATGTAAGCAAGCTGA ACATTTTGAAGCTTGCTCCTGGTGGGCATGTGGGA CGTTTCTGCATTGGACTGAAAGTGCTTTCCGGAAG TTAGATGAATTGTACGGCACTTGGCGTAAAGCCGC TTCCCTCAAGAGTAACTACAATCTTCCCATGCACA AGATGATTAATACAGATCTTAGCAGAATCTTGAAAA GCCCAGAGATCCAAAGAGCCCTTCGAGCACCACG CAAGAAGATCCATCGCAGAGTCCTAAAGAAGAACC CACTGAAAAACTTGAGA | | |
| 181 | NM_0009 68.2_844 | 844 | CTTTTCCTGTGGCAGCAGCCGGGCTGAGAGGAGC GTGGCTGTCTCCTCTCTCCGCCATGGCGTGTGCT CGCCCACTGATATCGGTGTACTCCGAAAAGGGGG AGTCATCTGGCAAAAATGTCACTTTGCCTGCTGTA TTCAAGGCTCCTATTCGACCAGATATTGTGAACTTT GTTCACACCAACTTGCGCAAAAACAACAGACAGCC CTATGCTGTCAGTGAATTAGCAGGTCATCAGACTA GTGCTGAGTCTTGGGGTACTGGCAGAGCTGTGGC TCGAATTCCCAGAGTTCGAGGTGGTGGGACTCAC CGCTCTGGCCAGGGTGCTTTTGGAAACATGTGTC GTGGAGGCCGAATGTTTGCACCAACCAAAACCTG GCGCCGTTGGCATCGTAGAGTGAACACAACCCAA AAACGATACGCCATCTGTTCTGCCCTGGCTGCCTC AGCCCTACCAGCACTGGTCATGTCTAAAGGTCATC GTATTGAGGAAGTTCCTGAACTTCCTTTGGTAGTT GAAGATAAAGTTGAAGGCTACAAGAAGACCAAGGA AGCTGTTTTGCTCCTTAAGAAACTTAAAGCCTGGA ATGATATCAAAAAGGTCTATGCCTCTCAGCGAATG AGAGCTGGCAAAGGCAAAATGAGAAACCGTCGCC GTATCCAGCGCAGGGGCCCGTGCATCATCTATAAT GAGGATAATGGTATCATCAAGGCCTTCAGAAACAT CCCTGGAATTACTCTGCTTAATGTAAGCAAGCTGA ACATTTTGAAGCTTGCTCCTGGTGGGCATGTGGGA CGTTTCTGCATTTGGACTGAAAGTGCTTTCCGGAA GTTAGATGAATGTACGGCACTTGGCGTAAAGCCG CTTCCCTCAAGAGTAACTACAATCTTCCCATGCAC AAGATGATTAATACAGATCTTAGCAGAATCTTGAAA AGCCCAGAGATCCAAAGAGCCCTTCGAGCACCAC GCAAGAAGATCCATCGCAGAGTCCTAAAGAAGAAC CCACTGAAAAACTTGAGA | 21 | CTALGVKP LPSRVTTIF PCTR* |
| 182 | NM_0009 69.3_262 | 262 | GGCCCTTTTCCCACCCCCTAGCGCCGCTGGGCCT GCAGGTCTCTGTCGAGCAGCGGACGCCGGTCTCT GTTCCGCAGGATGGGGTTTGTTAAAGTTGTTAAGA ATAAGGCCTACTTTAAGAGATACCAAGTGAAATTTA GAAGACGACGAGAGGGTAAAACTGATTATTATGCT CGGAAACGCTTGGTGATACAAGATAAAAATAAATA CAACACACCCAAATACAGGATGATAGTTCGTGTGA CAAACAGAGATATCATTGTCAGATTGCTTATGCCC GTATAGAGGGGGATATGATAGTCTGCGCAGCGTA TGCACACGAACTGCCAAAATATGGTGTGAAGGTTG GCCTGACAAATTATGCTGCAGCATATTGTACTGGC CTGCTGCTGGCCCGCAGGCTTCTCAATAGGTTTG GCATGGACAAGATCTATGAAGGCCAAGTGGAGGT GACTGGTGATGAATACAATGTGGAAAGCATTGATG GTCAGCCAGGTGCCTTCACCTGCTATTTGGATGCA GGCCTTGCCAGAACTACCACTGGCAATAAAGTTTT TGGTGCCCTGAAGGGAGCTGTGGATGGAGGCTTG TCTATCCCTCACAGTACCAAACGATTCCCTGGTTAT GATTCTGAAAGCAAGGAATTTAATGCAGAAGTACA TCGGAAGCACATCATGGGCCAGAATGTTGCAGATT ACATGCGCTACTTAATGGAAGAAGATGAAGATGCT TACAAGAAACAGTTCTCTCAATACATAAAGAACAG CGTAACTCCAGACATGATGGAGGAGATGTATAAGA AAGCTCATGCTGCTATACGAGAGAATCCAGTCTAT GAAAAGAAGCCCAAGAAAGAAGTTAAAAAGAAGAG GTGGAACCGTCCCAAAATGTCCCTTGCTCAGAAGA AGGATCGGGTAGCTCAAAAGAAGGCAAGCTTCCT CAGAGCTCAGGAGCGGGCTGCTGAGAGCTAAACC CAGCAATTTTCTATGATTTTTTCAGATATAGATAATA AACTTATGAACAG | 7 | VRLLMPV* |
| 183 | NM_0009 69.3_376 | 376 | GGCCCTTTTCCCACCCCCTAGCGCCGCTGGGCCT GCAGGTCTCTGTCGAGCAGCGGACGCCGGTCTCT GTTCCGCAGGATGGGGTTTGTTAAAGTTGTTAAGA ATAAGGCCTACTTTAAGAGATACCAAGTGAAATTTA GAAGACGACGAGAGGGTAAAACTGATTATTATGCT CGGAAACGCTTGGTGATACAAGATAAAAATAAATA CAACACACCCAAATACAGGATGATAGTTCGTGTGA CAAACAGAGATATCATTTGTCAGATTGCTTATGCC | 25 | VLACCWP AGFSIGLA WTRSMKA KWR* |

TABLE 3A-continued

| SEQ ID | identifier_ position | position | modified_RNA | PAP length | PAP |
|---|---|---|---|---|---|
| | | | CGTATAGAGGGGGATATGATAGTCTGCGCAGCGT<br>ATGCACACGAACTGCCAAAATATGGTGTGAAGGTT<br>GGCCTGACAAATTATGCTGCAGCATATGTACTGGC<br>CTGCTGCTGGCCCGCAGGCTTCTCAATAGGTTTG<br>GCATGGACAAGATCTATGAAGGCCAAGTGGAGGT<br>GACTGGTGATGAATACAATGTGGAAAGCATTGATG<br>GTCAGCCAGGTGCCTTCACCTGCTATTTGGATGCA<br>GGCCTTGCCAGAACTACCACTGGCAATAAAGTTTT<br>TGGTGCCCTGAAGGGAGCTGTGGATGGAGGCTTG<br>TCTATCCCTCACAGTACCAAACGATTCCCTGGTTAT<br>GATTCTGAAAGCAAGGAATTTAATGCAGAAGTACA<br>TCGGAAGCACATCATGGGCCAGAATGTTGCAGATT<br>ACATGCGCTACTTAATGGAAGAAGATGAAGATGCT<br>TACAAGAAACAGTTCTCTCAATACATAAAGAACAG<br>CGTAACTCCAGACATGATGGAGGAGATGTATAAGA<br>AAGCTCATGCTGCTATACGAGAGAATCCAGTCTAT<br>GAAAAGAAGCCCAAGAAAGAAGTTAAAAAGAAGAG<br>GTGGAACCGTCCCAAAATGTCCCTTGCTCAGAAGA<br>AGGATCGGGTAGCTCAAAAGAAGGCAAGCTTCCT<br>CAGAGCTCAGGAGCGGGCTGCTGAGAGCTAAACC<br>CAGCAATTTTCTATGATTTTTTCAGATATAGATAATA<br>AACTTATGAACAG | | |
| 184 | NM_0009 69.3_397 | 397 | GGCCCTTTTCCCACCCCCTAGCGCCGCTGGGCCT<br>GCAGGTCTCTGTCGAGCAGCGGACGCCGGTCTCT<br>GTTCCGCAGGATGGGGTTTGTTAAAGTTGTTAAGA<br>ATAAGGCCTACTTTAAGAGATACCAAGTGAAATTTA<br>GAAGACGACGAGAGGGTAAAACTGATTATTATGCT<br>CGGAAACGCTTGGTGATACAAGATAAAAATAAATA<br>CAACACACCCAAATACAGGATGATAGTTCGTGTGA<br>CAAACAGAGATATCATTTGTCAGATTGCTTATGCC<br>CGTATAGAGGGGGATATGATAGTCTGCGCAGCGT<br>ATGCACACGAACTGCCAAAATATGGTGTGAAGGTT<br>GGCCTGACAAATTATGCTGCAGCATATTGTACTGG<br>CCTGCTGCTGGCCGCAGGCTTCTCAATAGGTTTG<br>GCATGGACAAGATCTATGAAGGCCAAGTGGAGGT<br>GACTGGTGATGAATACAATGTGGAAAGCATTGATG<br>GTCAGCCAGGTGCCTTCACCTGCTATTTGGATGCA<br>GGCCTTGCCAGAACTACCACTGGCAATAAAGTTTT<br>TGGTGCCCTGAAGGGAGCTGTGGATGGAGGCTTG<br>TCTATCCCTCACAGTACCAAACGATTCCCTGGTTAT<br>GATTCTGAAAGCAAGGAATTTAATGCAGAAGTACA<br>TCGGAAGCACATCATGGGCCAGAATGTTGCAGATT<br>ACATGCGCTACTTAATGGAAGAAGATGAAGATGCT<br>TACAAGAAACAGTTCTCTCAATACATAAAGAACAG<br>CGTAACTCCAGACATGATGGAGGAGATGTATAAGA<br>AAGCTCATGCTGCTATACGAGAGAATCCAGTCTAT<br>GAAAAGAAGCCCAAGAAAGAAGTTAAAAAGAAGAG<br>GTGGAACCGTCCCAAAATGTCCCTTGCTCAGAAGA<br>AGGATCGGGTAGCTCAAAAGAAGGCAAGCTTCCT<br>CAGAGCTCAGGAGCGGGCTGCTGAGAGCTAAACC<br>CAGCAATTTTCTATGATTTTTTCAGATATAGATAATA<br>AACTTATGAACAG | 18 | AGFSIGLA<br>WTRSMKA<br>KWR* |
| 185 | NM_0009 69.3_417 | 417 | GGCCCTTTTCCCACCCCCTAGCGCCGCTGGGCCT<br>GCAGGTCTCTGTCGAGCAGCGGACGCCGGTCTCT<br>GTTCCGCAGGATGGGGTTTGTTAAAGTTGTTAAGA<br>ATAAGGCCTACTTTAAGAGATACCAAGTGAAATTTA<br>GAAGACGACGAGAGGGTAAAACTGATTATTATGCT<br>CGGAAACGCTTGGTGATACAAGATAAAAATAAATA<br>CAACACACCCAAATACAGGATGATAGTTCGTGTGA<br>CAAACAGAGATATCATTTGTCAGATTGCTTATGCC<br>CGTATAGAGGGGGATATGATAGTCTGCGCAGCGT<br>ATGCACACGAACTGCCAAAATATGGTGTGAAGGTT<br>GGCCTGACAAATTATGCTGCAGCATATTGTACTGG<br>CCTGCTGCTGGCCCGCAGGCTTCTCAATAGGTTG<br>GCATGGACAAGATCTATGAAGGCCAAGTGGAGGT<br>GACTGGTGATGAATACAATGTGGAAAGCATTGATG<br>GTCAGCCAGGTGCCTTCACCTGCTATTTGGATGCA<br>GGCCTTGCCAGAACTACCACTGGCAATAAAGTTTT<br>TGGTGCCCTGAAGGGAGCTGTGGATGGAGGCTTG<br>TCTATCCCTCACAGTACCAAACGATTCCCTGGTTAT<br>GATTCTGAAAGCAAGGAATTTAATGCAGAAGTACA<br>TCGGAAGCACATCATGGGCCAGAATGTTGCAGATT<br>ACATGCGCTACTTAATGGAAGAAGATGAAGATGCT<br>TACAAGAAACAGTTCTCTCAATACATAAAGAACAG<br>CGTAACTCCAGACATGATGGAGGAGATGTATAAGA<br>AAGCTCATGCTGCTATACGAGAGAATCCAGTCTAT<br>GAAAAGAAGCCCAAGAAAGAAGTTAAAAAGAAGAG | 12 | LAWTRSM<br>KAKWR* |

TABLE 3A-continued

| SEQ ID | identifier_position | position | modified_RNA | PAP length | PAP |
|---|---|---|---|---|---|
| 186 | NM_0009 69.3_558 | 558 | GTGGAACCGTCCCAAAATGTCCCTTGCTCAGAAGA<br>AGGATCGGGTAGCTCAAAAGAAGGCAAGCTTCCT<br>CAGAGCTCAGGAGCGGGCTGCTGAGAGCTAAACC<br>CAGCAATTTTCTATGATTTTTTCAGATATAGATAATA<br>AACTTATGAACAG<br>GGCCCTTTTCCCACCCCCTAGCGCCGCTGGGCCT<br>GCAGGTCTCTGTCGAGCAGCGGACGCCGGTCTCT<br>GTTCCGCAGGATGGGGTTTGTTAAAGTTGTTAAGA<br>ATAAGGCCTACTTTAAGAGATACCAAGTGAAATTTA<br>GAAGACGACGAGAGGGTAAAACTGATTATTATGCT<br>CGGAAACGCTTGGTGATACAAGATAAAAATAAATA<br>CAACACACCCAAATACAGGATGATAGTTCGTGTGA<br>CAAACAGAGATATCATTTGTCAGATTGCTTATGCC<br>CGTATAGAGGGGGATATGATAGTCTGCGCAGCGT<br>ATGCACACGAACTGCCAAAATATGGTGTGAAGGTT<br>GGCCTGACAAATTATGCTGCAGCATATTGTACTGG<br>CCTGCTGCTGGCCCGCAGGCTTCTCAATAGGTTTG<br>GCATGGACAAGATCTATGAAGGCCAAGTGGAGGT<br>GACTGGTGATGAATACAATGTGGAAAGCATTGATG<br>GTCAGCCAGGTGCCTTCACCTGCTATTTGGATGCA<br>GGCCTTGCCAGAACTACCACTGGCAATAAAGTTTT<br>GGTGCCCTGAAGGGAGCTGTGGATGGAGGCTTGT<br>CTATCCCTCACAGTACCAAACGATTCCCTGGTTAT<br>GATTCTGAAAGCAAGGAATTTAATGCAGAAGTACA<br>TCGGAAGCACATCATGGGCCAGAATGTTGCAGATT<br>ACATGCGCTACTTAATGGAAGAAGATGAAGATGCT<br>TACAAGAAACAGTTCTCTCAATACATAAAGAACAG<br>CGTAACTCCAGACATGATGGAGGAGATGTATAAGA<br>AAGCTCATGCTGCTATACGAGAGAATCCAGTCTAT<br>GAAAAGAAGCCCAAGAAAGAAGTTAAAAAGAAGAG<br>GTGGAACCGTCCCAAAATGTCCCTTGCTCAGAAGA<br>AGGATCGGGTAGCTCAAAAGAAGGCAAGCTTCCT<br>CAGAGCTCAGGAGCGGGCTGCTGAGAGCTAAACC<br>CAGCAATTTTCTATGATTTTTTCAGATATAGATAATA<br>AACTTATGAACAG | 3 | LVP* |
| 187 | NM_0009 69.3_620 | 620 | GGCCCTTTTCCCACCCCCTAGCGCCGCTGGGCCT<br>GCAGGTCTCTGTCGAGCAGCGGACGCCGGTCTCT<br>GTTCCGCAGGATGGGGTTTGTTAAAGTTGTTAAGA<br>ATAAGGCCTACTTTAAGAGATACCAAGTGAAATTTA<br>GAAGACGACGAGAGGGTAAAACTGATTATTATGCT<br>CGGAAACGCTTGGTGATACAAGATAAAAATAAATA<br>CAACACACCCAAATACAGGATGATAGTTCGTGTGA<br>CAAACAGAGATATCATTTGTCAGATTGCTTATGCC<br>CGTATAGAGGGGGATATGATAGTCTGCGCAGCGT<br>ATGCACACGAACTGCCAAAATATGGTGTGAAGGTT<br>GGCCTGACAAATTATGCTGCAGCATATTGTACTGG<br>CCTGCTGCTGGCCCGCAGGCTTCTCAATAGGTTTG<br>GCATGGACAAGATCTATGAAGGCCAAGTGGAGGT<br>GACTGGTGATGAATACAATGTGGAAAGCATTGATG<br>GTCAGCCAGGTGCCTTCACCTGCTATTTGGATGCA<br>GGCCTTGCCAGAACTACCACTGGCAATAAAGTTTT<br>TGGTGCCCTGAAGGGAGCTGTGGATGGAGGCTTG<br>TCTATCCCTCACAGTACCAAACGATTCCCTGGTTAT<br>GATTCTGAAAGCAAGGAATTTAATGCAGAAGTACA<br>TCGGAAGCACATCATGGGCCAGAATGTTGCAGATT<br>ACATGCGCTACTTAATGGAAGAAGATGAAGATGCT<br>TACAAGAAACAGTTCTCTCAATACATAAAGAACAG<br>CGTAACTCCAGACATGATGGAGGAGATGTATAAGA<br>AAGCTCATGCTGCTATACGAGAGAATCCAGTCTAT<br>GAAAAGAAGCCCAAGAAAGAAGTTAAAAAGAAGAG<br>GTGGAACCGTCCCAAAATGTCCCTTGCTCAGAAGA<br>AGGATCGGGTAGCTCAAAAGAAGGCAAGCTTCCT<br>CAGAGCTCAGGAGCGGGCTGCTGAGAGCTAAACC<br>CAGCAATTTTCTATGATTTTTTCAGATATAGATAATA<br>AACTTATGAACAG | 30 | LVMILKAR<br>NLMQKYIG<br>STSWARM<br>LQITCAT* |
| 188 | NM_0009 69.3_87 | 87 | GGCCCTTTTCCCACCCCCTAGCGCCGCTGGGCCT<br>GCAGGTCTCTGTCGAGCAGCGGACGCCGGTCTCT<br>GTTCCGCAGGATGGGGTTTGTTAAAGTTGTTAAGAA<br>TAAGGCCTACTTTAAGAGATACCAAGTGAAATTTA<br>GAAGACGACGAGAGGGTAAAACTGATTATTATGCT<br>CGGAAACGCTTGGTGATACAAGATAAAAATAAATA<br>CAACACACCCAAATACAGGATGATAGTTCGTGTGA<br>CAAACAGAGATATCATTTGTCAGATTGCTTATGCC<br>CGTATAGAGGGGGATATGATAGTCTGCGCAGCGT<br>ATGCACACGAACTGCCAAAATATGGTGTGAAGGTT<br>GGCCTGACAAATTATGCTGCAGCATATTGTACTGG<br>CCTGCTGCTGGCCCGCAGGCTTCTCAATAGGTTTG | 15 | LLKLLRIRP<br>TLRDTK* |

TABLE 3A-continued

| SEQ ID | identifier_position | position | modified_RNA | length PAP | PAP |
|---|---|---|---|---|---|
| | | | GCATGGACAAGATCTATGAAGGCCAAGTGGAGGT GACTGGTGATGAATACAATGTGGAAAGCATTGATG GTCAGCCAGGTGCCTTCACCTGCTATTTGGATGCA GGCCTTGCCAGAACTACCACTGGCAATAAAGTTTT TGGTGCCCTGAAGGGAGCTGTGGATGGAGGCTTG TCTATCCCTCACAGTACCAAACGATTCCCTGGTTAT GATTCTGAAAGCAAGGAATTTAATGCAGAAGTACA TCGGAAGCACATCATGGGCCAGAATGTTGCAGATT ACATGCGCTACTTAATGGAAGAAGATGAAGATGCT TACAAGAAACAGTTCTCTCAATACATAAAGAACAG CGTAACTCCAGACATGATGGAGGAGATGTATAAGA AAGCTCATGCTGCTATACGAGAGAATCCAGTCTAT GAAAAGAAGCCCAAGAAAGAAGTTAAAAAGAAGAG GTGGAACCGTCCCAAAATGTCCCTTGCTCAGAAGA AGGATCGGGTAGCTCAAAAGAAGGCAAGCTTCCT CAGAGCTCAGGAGCGGGCTGCTGAGAGCTAAACC CAGCAATTTTCTATGATTTTTTCAGATATAGATAATA AACTTATGAACAG | | |
| 189 | NM_0009 70.3_215 | 215 | GATTGCTTATAGACCGGAAGCCGGGACCTTAATTC TCTTTCCCATCTTGCAAGATGGCGGGTGAAAAAGT TGAGAAGCCAGATACTAAAGAGAAGAAACCCGAA GCCAAGAAGGTTGATGCTGGTGGCAAGGTGAAAA AGGGTAACCTCAAAGCTAAAAAGCCCAAGAAGGG GAAGCCCCATTGCAGCCGCAACCCTGTCCTTGTCA GAGGAATGGCAGGTATTCCCGATCTGCCATGTATT CCAGAAAGGCCATGTACAAGAGGAAGTACTCAGC CGCTAAATCCAAGGTTGAAAAGAAAAAGAAGGAGA AGGTTCTCGCAACTGTTACAAAACCAGTTGGTGGT GACAAGAACGGCGGTACCCGGGTGGTTAAACTTC GCAAAATGCCTAGATATTATCCTACTGAAGATGTG CCTCGAAAGCTGTTGAGCCACGGCAAAAAACCCTT CAGTCAGCACGTGAGAAAACTGCGAGCCAGCATT ACCCCCGGGACCATTCTGATCATCCTCACTGGACG CCACAGGGGCAAGAGGGTGGTTTTCCTGAAGCAG CTGGCTAGTGGCTTATTACTTGTGACTGGACCTCT GGTCCTCAATCGAGTTCCTCTACGAAGAACACACC AGAAATTTGTCATTGCCACTTCAACCAAAATCGATA TCAGCAATGTAAAAATCCCAAAACATCTTACTGATG CTTACTTCAAGAAGAAGAAGCTGCGGAAGCCCAG ACACCAGGAAGGTGAGATCTTCGACACAGAAAAA GAGAAATATGAGATTACGGAGCAGCGCAAGATTGA TCAGAAAGCTGTGGACTCACAAATTTTACCAAAAAT CAAAGCTATTCCTCAGCTCCAGGGCTACCTGCGAT CTGTGTTTGCTCTGACGAATGGAATTTATCCTCACA AATTGGTGTTCTAAATGTCTTAAGAACCTAATTAAA TAGCTGACTACAAAAAAAAAAAAAAAAAAAA | 72 | MAGIPDLP CIPERPCT RGSTQPLN PRLKRKRR RRFSQLLQ NQLVVTRT AVPGWLN FAKCLDIIL LKMCLESC* |
| 190 | NM_0009 70.3_440 | 440 | GATTGCTTATAGACCGGAAGCCGGGACCTTAATTC TCTTTCCCATCTTGCAAGATGGCGGGTGAAAAAGT TGAGAAGCCAGATACTAAAGAGAAGAAACCCGAA GCCAAGAAGGTTGATGCTGGTGGCAAGGTGAAAA AGGGTAACCTCAAAGCTAAAAAGCCCAAGAAGGG GAAGCCCCATTGCAGCCGCAACCCTGTCCTTGTCA GAGGAATTGGCAGGTATTCCCGATCTGCCATGTAT TCCAGAAAGGCCATGTACAAGAGGAAGTACTCAG CCGCTAAATCCAAGGTTGAAAAGAAAAAGAAGGAG AAGGTTCTCGCAACTGTTACAAAACCAGTTGGTGG TGACAAGAACGGCGGTACCCGGGTGGTTAAACTT CGCAAAATGCCTAGATATTATCCTACTGAAGATGT GCCTCGAAAGCTGTTGAGCCACGGAAAAAACCCTT CAGTCAGCACGTGAGAAAACTGCGAGCCAGCATT ACCCCCGGGACCATTCTGATCATCCTCACTGGACG CCACAGGGGCAAGAGGGTGGTTTTCCTGAAGCAG CTGGCTAGTGGCTTATTACTTGTGACTGGACCTCT GGTCCTCAATCGAGTTCCTCTACGAAGAACACACC AGAAATTTGTCATTGCCACTTCAACCAAAATCGATA TCAGCAATGTAAAAATCCCAAAACATCTTACTGATG CTTACTTCAAGAAGAAGAAGCTGCGGAAGCCCAG ACACCAGGAAGGTGAGATCTTCGACACAGAAAAA GAGAAATATGAGATTACGGAGCAGCGCAAGATTGA TCAGAAAGCTGTGGACTCACAAATTTTACCAAAAAT CAAAGCTATTCCTCAGCTCCAGGGCTACCTGCGAT CTGTGTTTGCTCTGACGAATGGAATTTATCCTCACA AATTGGTGTTCTAAATGTCTTAAGAACCTAATTAAA TAGCTGACTACAAAAAAAAAAAAAAAAAAAA | 6 | NPSVST* |
| 191 | NM_0009 70.3_497 | 497 | GATTGCTTATAGACCGGAAGCCGGGACCTTAATTC TCTTTCCCATCTTGCAAGATGGCGGGTGAAAAAGT TGAGAAGCCAGATACTAAAGAGAAGAAACCCGAA | 1 | F* |

TABLE 3A-continued

| SEQ ID | identifier_position | position | modified_RNA | PAP length | PAP |
|---|---|---|---|---|---|
| | | | GCCAAGAAGGTTGATGCTGGTGGCAAGGTGAAAA<br>AGGGTAACCTCAAAGCTAAAAAGCCCAAGAAGGG<br>GAAGCCCCATTGCAGCCGCAACCCTGTCCTTGTCA<br>GAGGAATTGGCAGGTATTCCCGATCTGCCATGTAT<br>TCCAGAAAGGCCATGTACAAGAGGAAGTACTCAG<br>CCGCTAAATCCAAGGTTGAAAAGAAAAAGAAGGAG<br>AAGGTTCTCGCAACTGTTACAAAACCAGTTGGTGG<br>TGACAAGAACGGCGGTACCCGGGTGGTTAAACTT<br>CGCAAAATGCCTAGATATTATCCTACTGAAGATGT<br>GCCTCGAAAGCTGTTGAGCCACGGCAAAAAACCC<br>TTCAGTCAGCACGTGAGAAAACTGCGAGCCAGCA<br>TTACCCCCGGGACATTCTGATCATCCTCACTGGAC<br>GCCACAGGGGCAAGAGGGTGGTTTTCCTGAAGCA<br>GCTGGCTAGTGGCTTATTACTTGTGACTGGACCTC<br>TGGTCCTCAATCGAGTTCCTCTACGAAGAACACAC<br>CAGAAATTTGTCATTGCCACTTCAACCAAAATCGAT<br>ATCAGCAATGTAAAAATCCCAAAACATCTTACTGAT<br>GCTTACTTCAAGAAGAAGAAGCTGCGGAAGCCCA<br>GACACCAGGAAGGTGAGATCTTCGACACAGAAAA<br>AGAGAAATATGAGATTACGGAGCAGCGCAAGATTG<br>ATCAGAAAGCTGTGGACTCACAAATTTTACCAAAA<br>ATCAAAGCTATTCCTCAGCTCCAGGGCTACCTGCG<br>ATCTGTGTTTGCTCTGACGAATGGAATTTATCCTCA<br>CAAATTGGTGTTCTAAATGTCTTAAGAACCTAATTA<br>AATAGCTGACTACAAAAAAAAAAAAAAAAAAAA | | |
| 192 | NM_0009<br>70.3_566 | 566 | GATTGCTTATAGACCGGAAGCCGGGACCTTAATTC<br>TCTTTCCCATCTTGCAAGATGGCGGGTGAAAAAGT<br>TGAGAAGCCAGATACTAAAGAGAAGAAACCCGAA<br>GCCAAGAAGGTTGATGCTGGTGGCAAGGTGAAAA<br>AGGGTAACCTCAAAGCTAAAAAGCCCAAGAAGGG<br>GAAGCCCCATTGCAGCCGCAACCCTGTCCTTGTCA<br>GAGGAATTGGCAGGTATTCCCGATCTGCCATGTAT<br>TCCAGAAAGGCCATGTACAAGAGGAAGTACTCAG<br>CCGCTAAATCCAAGGTTGAAAAGAAAAAGAAGGAG<br>AAGGTTCTCGCAACTGTTACAAAACCAGTTGGTGG<br>TGACAAGAACGGCGGTACCCGGGTGGTTAAACTT<br>CGCAAAATGCCTAGATATTATCCTACTGAAGATGT<br>GCCTCGAAAGCTGTTGAGCCACGGCAAAAAACCC<br>TTCAGTCAGCACGTGAGAAAACTGCGAGCCAGCA<br>TTACCCCCGGGACCATTCTGATCATCCTCACTGGA<br>CGCCACAGGGGCAAGAGGGTGGTTTTCCTGAAGC<br>AGCTGGCTAGTGGTTATTACTTGTGACTGGACCTC<br>TGGTCCTCAATCGAGTTCCTCTACGAAGAACACAC<br>CAGAAATTTGTCATTGCCACTTCAACCAAAATCGAT<br>ATCAGCAATGTAAAAATCCCAAAACATCTTACTGAT<br>GCTTACTTCAAGAAGAAGAAGCTGCGGAAGCCCA<br>GACACCAGGAAGGTGAGATCTTCGACACAGAAAA<br>AGAGAAATATGAGATTACGGAGCAGCGCAAGATTG<br>ATCAGAAAGCTGTGGACTCACAAATTTTACCAAAA<br>ATCAAAGCTATTCCTCAGCTCCAGGGCTACCTGCG<br>ATCTGTGTTTGCTCTGACGAATGGAATTTATCCTCA<br>CAAATTGGTGTTCTAAATGTCTTAAGAACCTAATTA<br>AATAGCTGACTACAAAAAAAAAAAAAAAAAAAA | 3 | YYL* |
| 193 | NM_0009<br>71.3_133 | 133 | TCCTCTTTTTCCGGCTGGAACCATGGAGGGTGTAG<br>AAGAGAAGAAGAAGGAGGTTCCTGCTGTGCCAGA<br>AACCCTTAAGAAAAAGCGAAGGAATTTCGCAGAGC<br>TGAAGATCAAGCGCCTGAGAAAGAAGTTGCCCAAA<br>AGATGCTTCGAAAGGCAAGGAGGAAGCTTATCTAT<br>GAAAAAGCAAAGCACTATCACAAGGAATATAGGCA<br>GATGTACAGAACTGAAATTCGAATGGCGAGGATG<br>GCAAGAAAAGCTGGCAACTTCTATGTACCTGCAGA<br>ACCCAAATTGGCGTTTGTCATCAGAATCAGAGGTA<br>TCAATGGAGTGAGCCCAAAGGTTCGAAAGGTGTT<br>GCAGCTTCTTCGCCTTCGTCAAATCTTCAATGGAA<br>CCTTTGTGAAGCTCAACAAGGCTTCGATTAACATG<br>CTGAGGATTGTAGAGCCATATATTGCATGGGGGTA<br>CCCCAATCTGAAGTCAGTAAATGAACTAATCTACA<br>AGCGTGGTTATGGCAAAATCAATAAGAAGCGAATT<br>GCTTTGACAGATAACGCTTTGATTGCTCGATCTCTT<br>GGTAAATACGGCATCATCTGCATGGAGGATTTGAT<br>TCATGAGATCTATACTGTTGGAAAACGCTTCAAAG<br>AGGCAAATAACTTCCTGTGGCCCTTCAAATTGTCTT<br>CTCCACGAGGTGGAATGAAGAAAAAGACCACCCA<br>TTTTGTAGAAGGTGGAGATGCTGGCAACAGGGAG<br>GACCAGATCAACAGGCTTATTAGAAGAATGAACTA<br>AGGTGTCTACCATGATTATTTTTCTAAGCTGGTTGG | 64 | LPKRCFER<br>QGGSLSM<br>KKQSTITR<br>NIGRCTEL<br>KFEWRGW<br>QEKLATSM<br>YLQNPNW<br>RLSSESEV<br>SME* |

TABLE 3A-continued

| SEQ ID | identifier_position | position | modified_RNA | PAP length | PAP |
|---|---|---|---|---|---|
| 194 | NM_0009 71.3_295 | 295 | TTAATAAACAGTACCTGCTCTCAAATTGAAATAAAA AAAAAAAAAAAAAAAAAAAAAAAAAA TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTGTCATCAGAATCAGAGGTAT CAATGGAGTGAGCCCAAAGGTTCGAAAGGTGTTG CAGCTTCTTCGCCTTCGTCAAATCTTCAATGGAAC CTTTGTGAAGCTCAACAAGGCTTCGATTAACATGC TGAGGATTGTAGAGCCATATATTGCATGGGGGTAC CCCAATCTGAAGTCAGTAAATGAACTAATCTACAA GCGTGGTTATGGCAAAATCAATAAGAAGCGAATTG CTTTGACAGATAACGCTTTGATTGCTCGATCTCTTG GTAAATACGGCATCATCTGCATGGAGGATTTGATT CATGGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAA | 10 | LSSESEVS ME* |
| 195 | NM_0009 71.3_348 | 348 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTG CAGCTTCTTCGCCTTCGTCAAATCTTCAATGGAAC CTTTGTGAAGCTCAACAAGGCTTCGATTAACATGC TGAGGATTGTAGAGCCATATATTGCATGGGGGTAC CCCAATCTGAAGTCAGTAAATGAACTAATCTACAA GCGTGGTTATGGCAAAATCAATAAGAAGCGAATTG CTTTGACAGATAACGCTTTGATTGCTCGATCTCTTG GTAAATACGGCATCATCTGCATGGAGGATTTGATT CATGGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAA | 14 | CSFFAFVK SSMEPL* |
| 196 | NM_0009 71.3_388 | 388 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTGTGAAGCTCAACAAGGCTTCGATTAACATGC TGAGGATTGTAGAGCCATATATTGCATGGGGGTAC CCCAATCTGAAGTCAGTAAATGAACTAATCTACAA GCGTGGTTATGGCAAAATCAATAAGAAGCGAATTG CTTTGACAGATAACGCTTTGATTGCTCGATCTCTTG GTAAATACGGCATCATCTGCATGGAGGATTTGATT CATGGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAA | 1 | L* |

TABLE 3A-continued

| SEQ ID | identifier_ position | position | modified_RNA | PAP length | PAP |
|---|---|---|---|---|---|
| 197 | NM_0009 71.3_427 | 427 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATGTAGAGCCATATATTGCATGGGGGTAC CCCAATCTGAAGTCAGTAAATGAACTAATCTACAA GCGTGGTTATGGCAAAATCAATAAGAAGCGAATTG CTTTGACAGATAACGCTTTGATTGCTCGATCTCTTG GTAAATACGGCATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAAA | 1 | M* |
| 198 | NM_0009 71.3_442 | 442 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATGCATGGGGGTAC CCCAATCTGAAGTCAGTAAATGAACTAATCTACAA GCGTGGTTATGGCAAAATCAATAAGAAGCGAATTG CTTTGACAGATAACGCTTTGATTGCTCGATCTCTTG GTAAATACGGCATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAAA | 7 | MHGGTPI* |
| 199 | NM_0009 71.3_523 | 523 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATG CTTTGACAGATAACGCTTTGATTGCTCGATCTCTTG GTAAATACGGCATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAAA | 2 | ML* |

TABLE 3A-continued

| SEQ ID | identifier_position | position | modified_RNA | PAP length | PAP |
|---|---|---|---|---|---|
| 200 | NM_0009 71.3_525 | 525 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GTTTGACAGATAACGCTTTGATTGCTCGATCTCTTG GTAAATACGGCATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAA | 1 | V* |
| 201 | NM_0009 71.3_547 | 547 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAA | 15 | MLDLLVNT ASSAWRI* |
| 202 | NM_0009 71.3_549 | 549 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGTCGATCTCTTG GTAAATACGGCATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAA | 14 | VDLLVNTA SSAWRI* |

TABLE 3A-continued

| SEQ ID | identifier_position | position | modified_RNA | PAP length | PAP |
|---|---|---|---|---|---|
| 203 | NM_0009 71.3_571 | 571 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGATCATCTGCATGGAGGATTTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAA | 6 | SSAWRI* |
| 204 | NM_0009 71.3_591 | 591 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTGATT CATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAA | 0 | * |
| 205 | NM_0009 71.3_613 | 613 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAGA GGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAAA | 22 | ENASKRQI TSCGPSNC LLHEVE* |

TABLE 3A-continued

| SEQ ID | identifier_position | position | modified_RNA | PAP length | PAP |
|---|---|---|---|---|---|
| 206 | NM_0009 71.3_636 | 636 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAA | 15 | ITSCGPSN CLLHEVE* |
| 207 | NM_0009 71.3_652 | 652 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCTTCAAATTGTCTTC TCCACGAGGTGGAATGAAGAAAAAGACCACCCATT TTGTAGAAGGTGGAGATGCTGGCAACAGGGAGGA CCAGATCAACAGGCTTATTAGAAGAATGAACTAAG GTGTCTACCATGATTATTTTTCTAAGCTGGTTGGTT AATAAACAGTACCTGCTCTCAAATTGAAATAAAAAA AAAAAAAAAAAAAAAAAAAAAAAAA | 9 | SNCLLHEV E* |
| 208 | NM_0009 71.3_660 | 660 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTA AGGTGTCTACCATGATTATTTTTCTAAGCTGGTTGG TTAATAAACAGTACCTGCTCTCAAATTGAAATAAAA AAAAAAAAAAAAAAAAAAAAAAAAAA | 7 | CLLHEVE* |

TABLE 3A-continued

| SEQ ID | identifier_position | position | modified_RNA | PAP length | PAP |
|---|---|---|---|---|---|
| 209 | NM_0009 71.3_694 | 694 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACACCCATT TTGTAGAAGGTGGAGATGCTGGCAACAGGGAGGA CCAGATCAACAGGCTTATTAGAAGAATGAACTAAG GTGTCTACCATGATTATTTTTCTAAGCTGGTTGGTT AATAAACAGTACCTGCTCTCAAATTGAAATAAAAAA AAAAAAAAAAAAAAAAAAAAAAAAA | 3 | PIL* |
| 210 | NM_0009 71.3_698 | 698 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCATT TTGTAGAAGGTGGAGATGCTGGCAACAGGGAGGA CCAGATCAACAGGCTTATTAGAAGAATGAACTAAG GTGTCTACCATGATTATTTTTCTAAGCTGGTTGGTT AATAAACAGTACCTGCTCTCAAATTGAAATAAAAAA AAAAAAAAAAAAAAAAAAAAAAAAA | 2 | IL* |
| 211 | NM_0009 71.3_703 | 703 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTGTAGAAGGTGGAGATGCTGGCAACAGGGAGG ACCAGATCAACAGGCTTATTAGAAGAATGAACTAA GGTGTCTACCATGATTATTTTTCTAAGCTGGTTGGT TAATAAACAGTACCTGCTCTCAAATTGAAATAAAAA AAAAAAAAAAAAAAAAAAAAAAAAAA | 1 | L* |

TABLE 3A-continued

| SEQ ID | identifier_position | position | modified_RNA | PAP length | PAP |
|---|---|---|---|---|---|
| 212 | NM_000971.3_726 | 726 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTTGTAGAAGGTGGAGATGCTGGCACAGGGAGG ACCAGATCAACAGGCTTATTAGAAGAATGAACTAA GGTGTCTACCATGATTATTTTTCTAAGCTGGTTGGT TAATAAACAGTACCTGCTCTCAAATTGAAATAAAAA AAAAAAAAAAAAAAAAAAAAAAAAA | 12 | TGRTRSTG LLEE* |
| 213 | NM_000971.3_749 | 749 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGTTATTAGAAGAATGAACTAA GGTGTCTACCATGATTATTTTTCTAAGCTGGTTGGT TAATAAACAGTACCTGCTCTCAAATTGAAATAAAAA AAAAAAAAAAAAAAAAAAAAAAAAA | 3 | LEE* |
| 214 | NM_000971.3_765 | 765 | TCCTCTTTTTCCGGCTGGAACCATGGAGGGTGTAG AAGAGAAGAAGAAGGAGGTTCCTGCTGTGCCAGA AACCCTTAAGAAAAAGCGAAGGAATTTCGCAGAGC TGAAGATCAAGCGCCTGAGAAAGAAGTTTGCCCAA AAGATGCTTCGAAAGGCAAGGAGGAAGCTTATCTA TGAAAAAGCAAAGCACTATCACAAGGAATATAGGC AGATGTACAGAACTGAAATTCGAATGGCGAGGATG GCAAGAAAAGCTGGCAACTTCTATGTACCTGCAGA ACCCAAATTGGCGTTTGTCATCAGAATCAGAGGTA TCAATGGAGTGAGCCCAAAGGTTCGAAAGGTGTT GCAGCTTCTTCGCCTTCGTCAAATCTTCAATGGAA CCTTTGTGAAGCTCAACAAGGCTTCGATTAACATG CTGAGGATTGTAGAGCCATATATTGCATGGGGGTA CCCCAATCTGAAGTCAGTAAATGAACTAATCTACA AGCGTGGTTATGGCAAAATCAATAAGAAGCGAATT GCTTTGACAGATAACGCTTTGATTGCTCGATCTCTT GGTAAATACGGCATCATCTGCATGGAGGATTTGAT TCATGAGATCTATACTGTTGGAAAACGCTTCAAAG AGGCAAATAACTTCCTGTGGCCCTTCAAATTGTCTT CTCCACGAGGTGGAATGAAGAAAAAGACCACCCA TTTTGTAGAAGGTGGAGATGCTGGCAACAGGGAG GACCAGATCAACAGGCTTATTAGAAGAATGAACTAA GGTGTCTACCATGATTATTTTTCTAAGCTGGTTGGT TAATAAACAGTACCTGCTCTCAAATTGAAATAAAAA AAAAAAAAAAAAAAAAAAAAAAAAA | 22 | TKVSTMIIF LSWLVNKQ YLLSN* |

TABLE 3A-continued

| SEQ ID | identifier_position | position | modified_RNA | PAP length | PAP |
|---|---|---|---|---|---|
| 215 | NM_000972.2_126 | 126 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTGAGAAAAGGCCTA AGAATTTTGGCATTGGACAGGACATCCAGCCCAAA AGAGACCTCACCCGCTTTGTGAAATGGCCCCGCT ATATCAGGTTGCAGCGGCAGAGAGCCATCCTCTAT AAGCGGCTGAAAGTGCCTCCTGCGATTAACCAGTT CACCCAGGCCCTGGACCGCCAAACAGCTACTCAG CTGCTTAAGCTGGCCCACAAGTACAGACCAGAGA CAAAGCAAGAGAAGAAGCAGAGACTGTTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC | 23 | LRKGLRILA LDRTSSPK ETSPAL* |
| 216 | NM_000972.2_147 | 147 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTGGCATTGGACAGGACATCCAGCCCAAA AGAGACCTCACCCGCTTTGTGAAATGGCCCCGCT ATATCAGGTTGCAGCGGCAGAGAGCCATCCTCTAT AAGCGGCTGAAAGTGCCTCCTGCGATTAACCAGTT CACCCAGGCCCTGGACCGCCAAACAGCTACTCAG CTGCTTAAGCTGGCCCACAAGTACAGACCAGAGA CAAAGCAAGAGAAGAAGCAGAGACTGTTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC | 16 | LALDRTSS PKETSPAL* |
| 217 | NM_000972.2_153 | 153 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATGGACAGGACATCCAGCCCAAA AGAGACCTCACCCGCTTTGTGAAATGGCCCCGCT ATATCAGGTTGCAGCGGCAGAGAGCCATCCTCTAT AAGCGGCTGAAAGTGCCTCCTGCGATTAACCAGTT CACCCAGGCCCTGGACCGCCAAACAGCTACTCAG CTGCTTAAGCTGGCCCACAAGTACAGACCAGAGA CAAAGCAAGAGAAGAAGCAGAGACTGTTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT | 14 | MDRTSSPK ETSPAL* |

TABLE 3A-continued

| SEQ ID | identifier_position | position | modified_RNA | PAP length | PAP |
|---|---|---|---|---|---|
| 218 | NM_000972.2_192 | 192 | TAAATGTACACTGTTGAGTTTTCTGTACATAAAAAT AATTGAAATAATACAAATTTTCCTTC<br>TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCCTGTTTGAGAAAAGGCCT AAGAATTTTGGCATTGGACAGGACATCCAGCCCAA AAGAGACCTCACCCGCTTGTGAAATGGCCCCGCT ATATCAGGTTGCAGCGGCAGAGAGCCATCCTCTAT AAGCGGCTGAAAGTGCCTCCTGCGATTAACCAGTT CACCCAGGCCCTGGACCGCCAAACAGCTACTCAG CTGCTTAAGCTGGCCCACAAGTACAGACCAGAGA CAAAGCAAGAGAAGAAGCAGAGACTGTTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC | 1 | L* |
| 219 | NM_000972.2_328 | 328 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAGA CAAAGCAAGAGAAGAAGCAGAGACTGTTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC | 56 | TSTDQRQS KRRSRDC WPGPRRR LLAKGTSQ RRDHLSFE QELTPSPP WWRTRKL SWW* |
| 220 | NM_000972.2_374 | 374 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTGGCCCG GGCCGAGAAGAAGGCTGCTGGCAAAGGGGACGT CCCAACGAAGAGACCACCTGTCCTTCGAGCAGGA GTTAACACCGTCACCACCTTGGTGGAGAACAAGAA AGCTCAGCTGGTGGTGATTGCACACGACGTGGAT CCCATCGAGCTGGTTGTCTTCTTGCCTGCCCTGTG TCGTAAAATGGGGGTCCCTTACTGCATTATCAAGG GAAAGGCAAGACTGGGACGTCTAGTCCACAGGAA GACCTGCACCACTGTCGCCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA | 41 | WPGPRRR LLAKGTSQ RRDHLSFE QELTPSPP WWRTRKL SWW* |

TABLE 3A-continued

| SEQ ID | identifier_position | position | modified_RNA | PAP length | PAP |
|---|---|---|---|---|---|
| 221 | NM_0009<br>72.2_501 | 501 | AGGCAAAGGCTAAAGAACTTGCCACTAAACTGGGT<br>TAAATGTACACTGTTGAGTTTTCTGTACATAAAAAT<br>AATTGAAATAATACAAATTTTCCTTC<br>TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATGCACACGACGTGGAT<br>CCCATCGAGCTGGTTGTCTTCTTGCCTGCCCTGTG<br>TCGTAAAATGGGGGTCCCTTACTGCATTATCAAGG<br>GAAAGGCAAGACTGGGACGTCTAGTCCACAGGAA<br>GACCTGCACCACTGTCGCCTTCACACAGGTGAACT<br>CGGAAGACAAAGGCGCTTTGGCTAAGCTGGTGGA<br>AGCTATCAGGACCAATTACAATGACAGATACGATG<br>AGATCCGCCGTCACTGGGGTGGCAATGTCCTGGG<br>TCCTAAGTCTGTGGCTCGTATCGCCAAGCTCGAAA<br>AGGCAAAGGCTAAAGAACTTGCCACTAAACTGGGT<br>TAAATGTACACTGTTGAGTTTTCTGTACATAAAAAT<br>AATTGAAATAATACAAATTTTCCTTC | 36 | MHTTWIPS<br>SWLSSCLP<br>CVVKWGS<br>LTALSRER<br>QDWDV* |
| 222 | NM_0009<br>72.2_547 | 547 | TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATTGCACACGACGTGGA<br>TCCCATCGAGCTGGTTGTCTTCTTGCCTGCCTGTG<br>TCGTAAAATGGGGGTCCCTTACTGCATTATCAAGG<br>GAAAGGCAAGACTGGGACGTCTAGTCCACAGGAA<br>GACCTGCACCACTGTCGCCTTCACACAGGTGAACT<br>CGGAAGACAAAGGCGCTTTGGCTAAGCTGGTGGA<br>AGCTATCAGGACCAATTACAATGACAGATACGATG<br>AGATCCGCCGTCACTGGGGTGGCAATGTCCTGGG<br>TCCTAAGTCTGTGGCTCGTATCGCCAAGCTCGAAA<br>AGGCAAAGGCTAAAGAACTTGCCACTAAACTGGGT<br>TAAATGTACACTGTTGAGTTTTCTGTACATAAAAAT<br>AATTGAAATAATACAAATTTTCCTTC | 20 | CVVKWGS<br>LTALSRER<br>QDWDV* |
| 223 | NM_0009<br>72.2_569 | 569 | TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATTGCACACGACGTGGA<br>TCCCATCGAGCTGGTTGTCTTCTTGCCTGCCCTGT<br>GTCGTAAAATGGGGGTCCTTACTGCATTATCAAGG<br>GAAAGGCAAGACTGGGACGTCTAGTCCACAGGAA<br>GACCTGCACCACTGTCGCCTTCACACAGGTGAACT<br>CGGAAGACAAAGGCGCTTTGGCTAAGCTGGTGGA<br>AGCTATCAGGACCAATTACAATGACAGATACGATG<br>AGATCCGCCGTCACTGGGGTGGCAATGTCCTGGG | 13 | LTALSRER<br>QDWDV* |

TABLE 3A-continued

| SEQ ID | identifier_position | position | modified_RNA | PAP length | PAP |
|---|---|---|---|---|---|
| 224 | NM_000972.2_639 | 639 | TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCTTCACACAGGTGAACT CGGAAGACAAAGGCGCTTTGGCTAAGCTGGTGGA AGCTATCAGGACCAATTACAATGACAGATACGATG AGATCCGCCGTCACTGGGGTGGCAATGTCCTGGG TCCTAAGTCTGTGGCTCGTATCGCCAAGCTCGAAA AGGCAAAGGCTAAAGAACTTGCCACTAAACTGGGT TAAATGTACACTGTTGAGTTTTCTGTACATAAAAAT AATTGAAATAATACAAATTTTCCTTC | 3 | SHR* |
| 225 | NM_000972.2_674 | 674 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA CTCGGAAGACAAAGGCGCTTGGCTAAGCTGGTGG AAGCTATCAGGACCAATTACAATGACAGATACGAT GAGATCCGCCGTCACTGGGGTGGCAATGTCCTGG GTCCTAAGTCTGTGGCTCGTATCGCCAAGCTCGAA AAGGCAAAGGCTAAAGAACTTGCCACTAAACTGGG TTAAATGTACACTGTTGAGTTTTCTGTACATAAAAA TAATTGAAATAATACAAATTTTCCTTC | 71 | WLSWWKL SGPITMTD TMRSAVTG VAMSWVL SLWLVSPS SKRQRLKN LPLNWVKC TLLSFLYIKI IEIIQIFL |
| 226 | NM_000972.2_677 | 677 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA CTCGGAAGACAAAGGCGCTTTGGCTAAGCTGGTGG AAGCTATCAGGACCAATTACAATGACAGATACGAT | 70 | VSWWKLS GPITMTDT MRSAVTG VAMSWVL SLWLVSPS SKRQRLKN LPLNWVKC TLLSFLYIKI IEIIQIFL |

TABLE 3A-continued

| SEQ ID | identifier_position | position | modified_RNA | PAP length | PAP |
|---|---|---|---|---|---|
| | | | GAGATCCGCCGTCACTGGGGTGGCAATGTCCTGG<br>GTCCTAAGTCTGTGGCTCGTATCGCCAAGCTCGAA<br>AAGGCAAAGGCTAAAGAACTTGCCACTAAACTGGG<br>TTAAATGTACACTGTTGAGTTTTCTGTACATAAAAA<br>TAATTGAAATAATACAAATTTTCCTTC | | |
| 227 | NM_0009<br>72.2_710 | 710 | TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATTGCACACGACGTGGA<br>TCCCATCGAGCTGGTTGTCTTCTTGCCTGCCCTGT<br>GTCGTAAAATGGGGGTCCCTTACTGCATTATCAAG<br>GGAAAGGCAAGACTGGGACGTCTAGTCCACAGGA<br>AGACCTGCACCACTGTCGCCTTCACACAGGTGAA<br>CTCGGAAGACAAAGGCGCTTTGGCTAAGCTGGTG<br>GAAGCTATCAGGACCAATTACATGACAGATACGAT<br>GAGATCCGCCGTCACTGGGGTGGCAATGTCCTGG<br>GTCCTAAGTCTGTGGCTCGTATCGCCAAGCTCGAA<br>AAGGCAAAGGCTAAAGAACTTGCCACTAAACTGGG<br>TTAAATGTACACTGTTGAGTTTTCTGTACATAAAAA<br>TAATTGAAATAATACAAATTTTCCTTC | 59 | MTDTMRS<br>AVTGVAMS<br>WVLSLWLV<br>SPSSKRQR<br>LKNLPLNW<br>VKCTLLSF<br>LYIKIIEIIQI<br>FL |
| 228 | NM_0009<br>72.2_733 | 733 | TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATTGCACACGACGTGGA<br>TCCCATCGAGCTGGTTGTCTTCTTGCCTGCCCTGT<br>GTCGTAAAATGGGGGTCCCTTACTGCATTATCAAG<br>GGAAAGGCAAGACTGGGACGTCTAGTCCACAGGA<br>AGACCTGCACCACTGTCGCCTTCACACAGGTGAA<br>CTCGGAAGACAAAGGCGCTTTGGCTAAGCTGGTG<br>GAAGCTATCAGGACCAATTACAATGACAGATACGA<br>TGAGATCCGCGTCACTGGGGTGGCAATGTCCTGG<br>GTCCTAAGTCTGTGGCTCGTATCGCCAAGCTCGAA<br>AAGGCAAAGGCTAAAGAACTTGCCACTAAACTGGG<br>TTAAATGTACACTGTTGAGTTTTCTGTACATAAAAA<br>TAATTGAAATAATACAAATTTTCCTTC | 51 | VTGVAMS<br>WVLSLWLV<br>SPSSKRQR<br>LKNLPLNW<br>VKCTLLSF<br>LYIKIIEIIQI<br>FL |
| 229 | NM_0009<br>72.2_749 | 749 | TTTCCTTTCTCTCTCCTCCCGCCGCCCAAGATGCC<br>GAAAGGAAAGAAGGCCAAGGGAAAGAAGGTGGCT<br>CCGGCCCCAGCTGTCGTGAAGAAGCAGGAGGCTA<br>AGAAAGTGGTGAATCCCTGTTTGAGAAAAGGCCT<br>AAGAATTTTGGCATTGGACAGGACATCCAGCCCAA<br>AAGAGACCTCACCCGCTTTGTGAAATGGCCCCGC<br>TATATCAGGTTGCAGCGGCAGAGAGCCATCCTCTA<br>TAAGCGGCTGAAAGTGCCTCCTGCGATTAACCAGT<br>TCACCCAGGCCCTGGACCGCCAAACAGCTACTCA<br>GCTGCTTAAGCTGGCCCACAAGTACAGACCAGAG<br>ACAAAGCAAGAGAAGAAGCAGAGACTGTTGGCCC<br>GGGCCGAGAAGAAGGCTGCTGGCAAAGGGGACG<br>TCCCAACGAAGAGACCACCTGTCCTTCGAGCAGG<br>AGTTAACACCGTCACCACCTTGGTGGAGAACAAGA<br>AAGCTCAGCTGGTGGTGATTGCACACGACGTGGA<br>TCCCATCGAGCTGGTTGTCTTCTTGCCTGCCCTGT<br>GTCGTAAAATGGGGGTCCCTTACTGCATTATCAAG<br>GGAAAGGCAAGACTGGGACGTCTAGTCCACAGGA<br>AGACCTGCACCACTGTCGCCTTCACACAGGTGAA<br>CTCGGAAGACAAAGGCGCTTTGGCTAAGCTGGTG | 46 | MSWVLSL<br>WLVSPSSK<br>RQRLKNLP<br>LNWVKCTL<br>LSFLYIKIIEI<br>IQIFL |

TABLE 3A-continued

| SEQ ID | identifier_position | position | modified_RNA | PAP length | PAP |
|---|---|---|---|---|---|
| | | | GAAGCTATCAGGACCAATTACAATGACAGATACGA TGAGATCCGCCGTCACTGGGGTGGCATGTCCTGG GTCCTAAGTCTGTGGCTCGTATCGCCAAGCTCGAA AAGGCAAAGGCTAAAGAACTTGCCACTAAACTGGG TTAAATGTACACTGTTGAGTTTTCTGTACATAAAAA TAATTGAAATAATACAAATTTTCCTTC | | |
| 230 | NM_000972.2_761 | 761 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA CTCGGAAGACAAAGGCGCTTTGGCTAAGCTGGTG GAAGCTATCAGGACCAATTACAATGACAGATACGA TGAGATCCGCCGTCACTGGGGTGGCAATGTCCTG GGTCTAAGTCTGTGGTCGTATCGCCAAGCTCGAA AAGGCAAAGGCTAAAGAACTTGCCACTAAACTGGG TTAAATGTACACTGTTGAGTTTTCTGTACATAAAAA TAATTGAAATAATACAAATTTTCCTTC | 42 | LSLWLVSP SSKRQRLK NLPLNWVK CTLLSFLYI KIIEIIQIFL |
| 231 | NM_000972.2_773 | 773 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA CTCGGAAGACAAAGGCGCTTTGGCTAAGCTGGTG GAAGCTATCAGGACCAATTACAATGACAGATACGA TGAGATCCGCCGTCACTGGGGTGGCAATGTCCTG GGTCCTAAGTCTGTGGTCGTATCGCCAAGCTCGAA AAGGCAAAGGCTAAAGAACTTGCCACTAAACTGGG TTAAATGTACACTGTTGAGTTTTCTGTACATAAAAA TAATTGAAATAATACAAATTTTCCTTC | 38 | VVSPSSKR QRLKNLPL NWVKCTLL SFLYIKIIEII QIFL |
| 232 | NM_000972.2_796 | 796 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA AGAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA | 30 | QRLKNLPL NWVKCTLL SFLYIKIIEII QIFL |

TABLE 3A-continued

| SEQ ID | identifier_position | position | modified_RNA | PAP length | PAP |
|---|---|---|---|---|---|
| | | | CTCGGAAGACAAAGGCGCTTTGGCTAAGCTGGTG GAAGCTATCAGGACCAATTACAATGACAGATACGA TGAGATCCGCCGTCACTGGGGTGGCAATGTCCTG GGTCCTAAGTCTGTGGCTCGTATCGCCAAGCTCGA AAAGCAAAGGCTAAAGAACTTGCCACTAAACTGGG TTAAATGTACACTGTTGAGTTTTCTGTACATAAAAA TAATTGAAATAATACAAATTTTCCTTC | | |
| 233 | NM_0009 72.2_800 | 800 | TTTCCTTTCTCTCTCCTCCCGCCGCCCAAGATGCC GAAAGGAAAGAAGGCCAAGGGAAAGAAGGTGGCT CCGGCCCCAGCTGTCGTGAAGAAGCAGGAGGCTA GAAAAGTGGTGAATCCCTGTTTGAGAAAAGGCCT AAGAATTTTGGCATTGGACAGGACATCCAGCCCAA AAGAGACCTCACCCGCTTTGTGAAATGGCCCCGC TATATCAGGTTGCAGCGGCAGAGAGCCATCCTCTA TAAGCGGCTGAAAGTGCCTCCTGCGATTAACCAGT TCACCCAGGCCCTGGACCGCCAAACAGCTACTCA GCTGCTTAAGCTGGCCCACAAGTACAGACCAGAG ACAAAGCAAGAGAAGAAGCAGAGACTGTTGGCCC GGGCCGAGAAGAAGGCTGCTGGCAAAGGGGACG TCCCAACGAAGAGACCACCTGTCCTTCGAGCAGG AGTTAACACCGTCACCACCTTGGTGGAGAACAAGA AAGCTCAGCTGGTGGTGATTGCACACGACGTGGA TCCCATCGAGCTGGTTGTCTTCTTGCCTGCCCTGT GTCGTAAAATGGGGGTCCCTTACTGCATTATCAAG GGAAAGGCAAGACTGGGACGTCTAGTCCACAGGA AGACCTGCACCACTGTCGCCTTCACACAGGTGAA CTCGGAAGACAAAGGCGCTTTGGCTAAGCTGGTG GAAGCTATCAGGACCAATTACAATGACAGATACGA TGAGATCCGCCGTCACTGGGGTGGCAATGTCCTG GGTCCTAAGTCTGTGGCTCGTATCGCCAAGCTCGA AAAGGCAAGGCTAAAGAACTTGCCACTAAACTGGG TTAAATGTACACTGTTGAGTTTTCTGTACATAAAAA TAATTGAAATAATACAAATTTTCCTTC | 29 | RLKNLPLN WVKCTLLS FLYIKIIEIIQ IFL |
| 234 | NM_0009 73.3_183 | 183 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAGG ACATCATCCACGACCCGGGCCGCGGCGCGCCCCT CGCCAAGGTGGTCTTCCGGGATCCGTATCGGTTTA AGAAGCGGACGGAGCTGTTCATTGCCGCCGAGGG CATTCACACGGGCCAGTTTGTGTATTGCGGCAAGA AGGCCCAGCTCAACATTGGCAATGTGCTCCCTGTG GGCACCATGCCTGAGGGTACAATCGTGTGCTGCC TGGAGGAGAAGCCTGGAGACCGTGGCAAGCTGG CCCGGGCATCAGGGAACTATGCCACCGTTATCTC CCACAACCCTGAGACCAAGAAGACCCGTGTGAAG CTGCCCTCCGGCTCCAAGAAGGTTATCTCCTCAGC CAACAGAGCTGTGGTTGGTGTGGTGGCTGGAGGT GGCCGAATTGACAAACCCATCTTGAAGGCTGGCC GGGCGTACCACAAATATAAGGCAAAGAGGAACTG CTGGCCACGAGTACGGGGTGTGGCCATGAATCCT GTGGAGCATCCTTTTGGAGGTGGCAACCACCAGC ACATCGGCAAGCCCTCCACCATCCGCAGAGATGC CCCTGCTGGCCGCAAAGTGGGTCTCATTGCTGCC CGCCGGACTGGACGTCTCCGGGGAACCAAGACTG TGCAGGAGAAAGAGAACTAGTGCTGAGGGCCTCA ATAAAGTTTGTGTTTATGCCAAAAAAAAAAAAAAAAA AAAAAAAAAAAAA | 108 | TSRASSRT SSTTRAAA RPSPRWS SGIRIGLRS GRSCSLPP RAFTRASL CIAARRPS STLAMCSL WAPCLRV QSCAAWR RSLETVAS WPGHQGT MPPLSPTT LRPRRPV* |
| 235 | NM_0009 73.3_231 | 231 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGGCGCCCC TCGCCAAGGTGGTCTTCCGGGATCCGTATCGGTTT AAGAAGCGGACGGAGCTGTTCATTGCCGCCGAGG GCATTCACACGGGCCAGTTTGTGTATTGCGGCAAG AAGGCCCAGCTCAACATTGGCAATGTGCTCCCTGT GGGCACCATGCCTGAGGGTACAATCGTGTGCTGC CTGGAGGAGAAGCCTGGAGACCGTGGCAAGCTG GCCCGGGCATCAGGGAACTATGCCACCGTTATCT CCCACAACCCTGAGACCAAGAAGACCCGTGTGAA GCTGCCCTCCGGCTCCAAGAAGGTTATCTCCTCAG CCAACAGAGCTGTGGTTGGTGTGGTGGCTGGAGG | 92 | RPSPRWS SGIRIGLRS GRSCSLPP RAFTRASL CIAARRPS STLAMCSL WAPCLRV QSCAAWR RSLETVAS WPGHQGT MPPLSPTT LRPRRPV* |

TABLE 3A-continued

| SEQ ID | identifier_position | position | modified_RNA | PAP length | PAP |
|---|---|---|---|---|---|
| | | | TGGCCGAATTGACAAACCCATCTTGAAGGCTGGC<br>CGGGCGTACCACAAATATAAGGCAAAGAGGAACT<br>GCTGGCCACGAGTACGGGGTGTGGCCATGAATCC<br>TGTGGAGCATCCTTTTGGAGGTGGCAACCACCAG<br>CACATCGGCAAGCCCTCCACCATCCGCAGAGATG<br>CCCCTGCTGGCCGCAAAGTGGGTCTCATTGCTGC<br>CCGCCGGACTGGACGTCTCCGGGGAACCAAGACT<br>GTGCAGGAGAAAGAGAACTAGTGCTGAGGGCCTC<br>AATAAAGTTTGTGTTTATGCCAAAAAAAAAAAAAAA<br>AAAAAAAAAAAAAA | | |
| 236 | NM_0009<br>73.3_327 | 327 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTGTGTATTGCGGCA<br>AGAAGGCCCAGCTCAACATTGGCAATGTGCTCCCT<br>GTGGGCACCATGCCTGAGGGTACAATCGTGTGCT<br>GCCTGGAGGAGAAGCCTGGAGACCGTGGCAAGCT<br>GGCCCGGGCATCAGGGAACTATGCCACCGTTATC<br>TCCCACAACCCTGAGACCAAGAAGACCCGTGTGA<br>AGCTGCCCTCCGGCTCCAAGAAGGTTATCTCCTCA<br>GCCAACAGAGCTGTGGTTGGTGTGGTGGCTGGAG<br>GTGGCCGAATTGACAAACCCATCTTGAAGGCTGG<br>CCGGGCGTACCACAAATATAAGGCAAAGAGGAAC<br>TGCTGGCCACGAGTACGGGGTGTGGCCATGAATC<br>CTGTGGAGCATCCTTTTGGAGGTGGCAACCACCA<br>GCACATCGGCAAGCCCTCCACCATCCGCAGAGAT<br>GCCCCTGCTGGCCGCAAAGTGGGTCTCATTGCTG<br>CCCGCCGGACTGGACGTCTCCGGGGAACCAAGAC<br>TGTGCAGGAGAAAGAGAACTAGTGCTGAGGGCCT<br>CAATAAAGTTTGTGTTTATGCCAAAAAAAAAAAAAA<br>AAAAAAAAAAAAAAA | 61 | LCIAARRP<br>SSTLAMCS<br>LWAPCLRV<br>QSCAAWR<br>RSLETVAS<br>WPGHQGT<br>MPPLSPTT<br>LRPRRPV* |
| 237 | NM_0009<br>73.3_334 | 334 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATGCGGCA<br>AGAAGGCCCAGCTCAACATTGGCAATGTGCTCCCT<br>GTGGGCACCATGCCTGAGGGTACAATCGTGTGCT<br>GCCTGGAGGAGAAGCCTGGAGACCGTGGCAAGCT<br>GGCCCGGGCATCAGGGAACTATGCCACCGTTATC<br>TCCCACAACCCTGAGACCAAGAAGACCCGTGTGA<br>AGCTGCCCTCCGGCTCCAAGAAGGTTATCTCCTCA<br>GCCAACAGAGCTGTGGTTGGTGTGGTGGCTGGAG<br>GTGGCCGAATTGACAAACCCATCTTGAAGGCTGG<br>CCGGGCGTACCACAAATATAAGGCAAAGAGGAAC<br>TGCTGGCCACGAGTACGGGGTGTGGCCATGAATC<br>CTGTGGAGCATCCTTTTGGAGGTGGCAACCACCA<br>GCACATCGGCAAGCCCTCCACCATCCGCAGAGAT<br>GCCCCTGCTGGCCGCAAAGTGGGTCTCATTGCTG<br>CCCGCCGGACTGGACGTCTCCGGGGAACCAAGAC<br>TGTGCAGGAGAAAGAGAACTAGTGCTGAGGGCCT<br>CAATAAAGTTTGTGTTTATGCCAAAAAAAAAAAAAA<br>AAAAAAAAAAAAAAA | 58 | AARRPSST<br>LAMCSLW<br>APCLRVQS<br>CAAWRRS<br>LETVASWP<br>GHQGTMP<br>PLSPTTLR<br>PRRPV* |
| 238 | NM_0009<br>73.3_448 | 448 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG | 20 | GHQGTMP<br>PLSPTTLR<br>PRRPV* |

TABLE 3A-continued

| SEQ ID | identifier_position | position | modified_RNA | PAP length | PAP |
|---|---|---|---|---|---|
| | | | CTGGCCGGGCATCAGGGAACTATGCCACCGTTAT<br>CTCCCACAACCCTGAGACCAAGAAGACCCGTGTG<br>AAGCTGCCCTCCGGCTCCAAGAAGGTTATCTCCTC<br>AGCCAACAGAGCTGTGGTTGGTGTGGTGGCTGGA<br>GGTGGCCGAATTGACAAACCCATCTTGAAGGCTG<br>GCCGGGCGTACCACAAATATAAGGCAAAGAGGAA<br>CTGCTGGCCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | | |
| 239 | NM_0009<br>73.3_488 | 488 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG<br>CTGGCCCGGGCATCAGGGAACTATGCCACCGTTA<br>TCTCCCACAACCTGAGACCAAGAAGACCCGTGTG<br>AAGCTGCCCTCCGGCTCCAAGAAGGTTATCTCCTC<br>AGCCAACAGAGCTGTGGTTGGTGTGGTGGCTGGA<br>GGTGGCCGAATTGACAAACCCATCTTGAAGGCTG<br>GCCGGGCGTACCACAAATATAAGGCAAAGAGGAA<br>CTGCTGGCCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | 7 | LRPRRPV* |
| 240 | NM_0009<br>73.3_519 | 519 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG<br>CTGGCCCGGGCATCAGGGAACTATGCCACCGTTA<br>TCTCCCACAACCCTGAGACCAAGAAGACCCGTGT<br>GAAGCTGCCTCCGGCTCCAAGAAGGTTATCTCCTC<br>AGCCAACAGAGCTGTGGTTGGTGTGGTGGCTGGA<br>GGTGGCCGAATTGACAAACCCATCTTGAAGGCTG<br>GCCGGGCGTACCACAAATATAAGGCAAAGAGGAA<br>CTGCTGGCCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | 28 | PAPRRLSP<br>QPTELWLV<br>WWLEVAE<br>LTNPS* |
| 241 | NM_0009<br>73.3_586 | 586 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA | 6 | ELTNPS* |

TABLE 3A-continued

| SEQ ID | identifier_position | position | modified_RNA | PAP length | PAP |
|---|---|---|---|---|---|
| | | | GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCGAATTGACAAACCCATCTTGAAGGCTG GCCGGGCGTACCACAAATATAAGGCAAAGAGGAA CTGCTGGCCACGAGTACGGGGTGTGGCCATGAAT CCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCCGCCGGACTGGACGTCTCCGGGGAACCAAG ACTGTGCAGGAGAAAGAGAACTAGTGCTGAGGGC CTCAATAAAGTTTGTGTTTATGCCAAAAAAAAAAA AAAAAAAAAAAAAAAAA | | |
| 242 | NM_000973.3_600 | 600 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCTG GCCGGGCGTACCACAAATATAAGGCAAAGAGGAA CTGCTGGCCACGAGTACGGGGTGTGGCCATGAAT CCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCCGCCGGACTGGACGTCTCCGGGGAACCAAG ACTGTGCAGGAGAAAGAGAACTAGTGCTGAGGGC CTCAATAAAGTTTGTGTTTATGCCAAAAAAAAAAA AAAAAAAAAAAAAAAAA | 1 | S* |
| 243 | NM_000973.3_616 | 616 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCGAATTGACAAACCCATCTTGAAGGCT GGCGGGCGTACCACAAATATAAGGCAAAGAGGAA CTGCTGGCCACGAGTACGGGGTGTGGCCATGAAT CCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCCGCCGGACTGGACGTCTCCGGGGAACCAAG ACTGTGCAGGAGAAAGAGAACTAGTGCTGAGGGC CTCAATAAAGTTTGTGTTTATGCCAAAAAAAAAAA AAAAAAAAAAAAAAAAA | 20 | GRTTNIRQ RGTAGHE YGVWP* |
| 244 | NM_000973.3_635 | 635 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC | 14 | RQRGTAG HEYGVWP* |

TABLE 3A-continued

| SEQ ID | identifier_position | position | modified_RNA | PAP length | PAP |
|---|---|---|---|---|---|
| | | | TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG<br>CTGGCCCGGGCATCAGGGAACTATGCCACCGTTA<br>TCTCCCACAACCCTGAGACCAAGAAGACCCGTGT<br>GAAGCTGCCCTCCGGCTCCAAGAAGGTTATCTCCT<br>CAGCCAACAGAGCTGTGGTTGGTGTGGTGGCTGG<br>AGGTGGCCGAATTGACAAACCCATCTTGAAGGCT<br>GGCCGGGCGTACCACAAATATAGGCAAAGAGGAA<br>CTGCTGGCCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | | |
| 245 | NM_0009<br>73.3_651 | 651 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG<br>CTGGCCCGGGCATCAGGGAACTATGCCACCGTTA<br>TCTCCCACAACCCTGAGACCAAGAAGACCCGTGT<br>GAAGCTGCCCTCCGGCTCCAAGAAGGTTATCTCCT<br>CAGCCAACAGAGCTGTGGTTGGTGTGGTGGCTGG<br>AGGTGGCCGAATTGACAAACCCATCTTGAAGGCT<br>GGCCGGGCGTACCACAAATATAAGGCAAAGAGGA<br>ACTGTGGCCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | 8 | GHEYGVW<br>P* |
| 246 | NM_0009<br>73.3_656 | 656 | AGATAAGGCCGCTCGCTGACGCCGTGTTTCCTCTT<br>TCGGCCGCGCTGGTGAACAGGACCCGTCGCCATG<br>GGCCGTGTGATCCGTGGACAGAGGAAGGGCGCC<br>GGGTCTGTGTTCCGCGCGCACGTGAAGCACCGTA<br>AAGGCGCTGCGCGCCTGCGCGCCGTGGATTTCGC<br>TGAGCGGCACGGCTACATCAAGGGCATCGTCAAG<br>GACATCATCCACGACCCGGGCCGCGGCGCGCCC<br>CTCGCCAAGGTGGTCTTCCGGGATCCGTATCGGT<br>TTAAGAAGCGGACGGAGCTGTTCATTGCCGCCGA<br>GGGCATTCACACGGGCCAGTTTGTGTATTGCGGC<br>AAGAAGGCCCAGCTCAACATTGGCAATGTGCTCC<br>CTGTGGGCACCATGCCTGAGGGTACAATCGTGTG<br>CTGCCTGGAGGAGAAGCCTGGAGACCGTGGCAAG<br>CTGGCCCGGGCATCAGGGAACTATGCCACCGTTA<br>TCTCCCACAACCCTGAGACCAAGAAGACCCGTGT<br>GAAGCTGCCCTCCGGCTCCAAGAAGGTTATCTCCT<br>CAGCCAACAGAGCTGTGGTTGGTGTGGTGGCTGG<br>AGGTGGCCGAATTGACAAACCCATCTTGAAGGCT<br>GGCCGGGCGTACCACAAATATAAGGCAAAGAGGA<br>ACTGCTGGCACGAGTACGGGGTGTGGCCATGAAT<br>CCTGTGGAGCATCCTTTTGGAGGTGGCAACCACC<br>AGCACATCGGCAAGCCCTCCACCATCCGCAGAGA<br>TGCCCCTGCTGGCCGCAAAGTGGGTCTCATTGCT<br>GCCCGCCGGACTGGACGTCTCCGGGGAACCAAG<br>ACTGTGCAGGAGAAAGAGAACTAGTGCTGAGGGC<br>CTCAATAAAGTTTGTGTTTATGCCAAAAAAAAAAA<br>AAAAAAAAAAAAAAAAA | 7 | HEYGVWP* |

TABLE 3A-continued

| SEQ ID | identifier_position | position | modified_RNA | PAP length | PAP |
|---|---|---|---|---|---|
| 247 | NM_000973.3_675 | 675 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCATGAAT CCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCCGCCGGACTGGACGTCTCCGGGGAACCAAG ACTGTGCAGGAGAAAGAGAACTAGTGCTGAGGGC CTCAATAAAGTTTGTGTTTATGCCAAAAAAAAAAA AAAAAAAAAAAAAAAA | 0 | * |
| 248 | NM_000973.3_695 | 695 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCATGAA TCCTGTGGAGCATCTTTTGGAGGTGGCAACCACCA GCACATCGGCAAGCCCTCCACCATCCGCAGAGAT GCCCCTGCTGGCCGCAAAGTGGGTCTCATTGCTG CCCGCCGGACTGGACGTCTCCGGGGAACCAAGAC TGTGCAGGAGAAAGAGAACTAGTGCTGAGGGCCT CAATAAAGTTTGTGTTTATGCCAAAAAAAAAAAAA AAAAAAAAAAAAAAA | 68 | LLEVATTS TSASPPPS AEMPLLAA KWVSLLPA GLDVSGEP RLCRRKRT SAEGLNKV CVYAKKKK KKKKK |
| 249 | NM_000973.3_699 | 699 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCATGAA TCCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT | 67 | LEVATTST SASPPPSA EMPLLAAK WVSLLPAG LDVSGEPR LCRRKRTS AEGLNKVC VYAKKKKK KKKK |

TABLE 3A-continued

| SEQ ID | identifier_ position | position | modified_RNA | PAP length | PAP |
|---|---|---|---|---|---|
| | | | GCCCGCCGGACTGGACGTCTCCGGGGAACCAAG ACTGTGCAGGAGAAAGAGAACTAGTGCTGAGGGC CTCAATAAAGTTTGTGTTTATGCCAAAAAAAAAAAA AAAAAAAAAAAAAAAAA | | |
| 250 | NM_0009 73.3_708 | 708 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCCATGAA TCCTGTGGAGCATCCTTTTGGAGGTGGAACCACCA GCACATCGGCAAGCCCTCCACCATCCGAGAGAT GCCCCTGCTGGCCGCAAAGTGGGTCTCATTGCTG CCCGCCGGACTGGACGTCTCCGGGGAACCAAGAC TGTGCAGGAGAAAGAGAACTAGTGCTGAGGGCCT CAATAAAGTTTGTGTTTATGCCAAAAAAAAAAAAAA AAAAAAAAAAAAAAA | 63 | TTSTSASP PPSAEMPL LAAKWVSL LPAGLDVS GEPRLCRR KRTSAEGL NKVCVYAK KKKKKKKK |
| 251 | NM_0009 73.3_744 | 744 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCCATGAA TCCTGTGGAGCATCCTTTTGGAGGTGGAACCACC AGCACATCGGCAAGCCCTCCACCATCCGAGAGAT GCCCCTGCTGGCCGCAAAGTGGGTCTCATTGCTG CCCGCCGGACTGGACGTCTCCGGGGAACCAAGAC TGTGCAGGAGAAAGAGAACTAGTGCTGAGGGCCT CAATAAAGTTTGTGTTTATGCCAAAAAAAAAAAAAA AAAAAAAAAAAAAAA | 51 | EMPLLAAK WVSLLPAG LDVSGEPR LCRRKRTS AEGLNKVC VYAKKKKK KKKK |
| 252 | NM_0009 73.3_787 | 787 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA | 37 | AGLDVSGE PRLCRRKR TSAEGLNK VCVYAKKK KKKKKK |

TABLE 3A-continued

| SEQ ID | identifier_position | position | modified_RNA | PAP length | PAP |
|---|---|---|---|---|---|
| | | | ACTGCTGGCCACGAGTACGGGGTGTGGCCATGAA TCCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCGCCGGACTGGACGTCTCCGGGGAACCAAGA CTGTGCAGGAGAAAGAGAACTAGTGCTGAGGGCC TCAATAAAGTTTGTGTTTATGCCAAAAAAAAAAAAA AAAAAAAAAAAAAAAA | | |
| 253 | NM_0009 73.3_790 | 790 | AGATAAGGCCGCTCGCTGACGCCGTGTTTCCTCTT TCGGCCGCGCTGGTGAACAGGACCCGTCGCCATG GGCCGTGTGATCCGTGGACAGAGGAAGGGCGCC GGGTCTGTGTTCCGCGCGCACGTGAAGCACCGTA AAGGCGCTGCGCGCCTGCGCGCCGTGGATTTCGC TGAGCGGCACGGCTACATCAAGGGCATCGTCAAG GACATCATCCACGACCCGGGCCGCGGCGCGCCC CTCGCCAAGGTGGTCTTCCGGGATCCGTATCGGT TTAAGAAGCGGACGGAGCTGTTCATTGCCGCCGA GGGCATTCACACGGGCCAGTTTGTGTATTGCGGC AAGAAGGCCCAGCTCAACATTGGCAATGTGCTCC CTGTGGGCACCATGCCTGAGGGTACAATCGTGTG CTGCCTGGAGGAGAAGCCTGGAGACCGTGGCAAG CTGGCCCGGGCATCAGGGAACTATGCCACCGTTA TCTCCCACAACCCTGAGACCAAGAAGACCCGTGT GAAGCTGCCCTCCGGCTCCAAGAAGGTTATCTCCT CAGCCAACAGAGCTGTGGTTGGTGTGGTGGCTGG AGGTGGCCGAATTGACAAACCCATCTTGAAGGCT GGCCGGGCGTACCACAAATATAAGGCAAAGAGGA ACTGCTGGCCACGAGTACGGGGTGTGGCCATGAA TCCTGTGGAGCATCCTTTTGGAGGTGGCAACCACC AGCACATCGGCAAGCCCTCCACCATCCGCAGAGA TGCCCCTGCTGGCCGCAAAGTGGGTCTCATTGCT GCCCGCGGACTGGACGTCTCCGGGGAACCAAGA CTGTGCAGGAGAAAGAGAACTAGTGCTGAGGGCC TCAATAAAGTTTGTGTTTATGCCAAAAAAAAAAAAA AAAAAAAAAAAAAAAA | 36 | GLDVSGEP RLCRRKRT SAEGLNKV CVYAKKKK KKKKK |
| 254 | NM_0009 75.2_200 | 200 | TTCTCTTCCTGCTCTCCATCATGGCGCAGGATCAA GGTGAAAAGGAGAACCCCATGCGGGAACTTCGCA TCCGCAAACTCTGTCTCAACATCTGTGTTGGGGAG AGTGGAGACAGACTGACGCGAGCAGCCAAGGTGT TGGAGCAGCTCACAGGGCAGACCCCTGTGTTTTC CAAAGCTAGATACACTGTCAGATCCTTGGCATCCG GAGAAATGAAAAGATTGCTGTCCACTGCACAGTTC GAGGGGCCAAGGCAGAAGAAATCTTGGAGAAGGG TCTAAAGGTGCGGGAGTATGAGTTAAGAAAAAACA ACTTCTCAGATACTGGAAACTTTGGTTTTGGGATC CAGGAACACATCGATCTGGGTATCAAATATGACCC AAGCATTGGTATCTACGGCCTGGACTTCTATGTGG TGCTGGGTAGGCCAGGTTTCAGCATCGCAGACAA GAAGCGCAGGACAGGCTGCATTGGGGCCAAACAC AGAATCAGCAAAGAGGAGGCCATGCGCTGGTTCC AGCAGAAGTATGATGGGATCATCCTTCCTGGCAAA TAAATTCCCGTTTCTATCCAAAAGAGCAATAAAAAG TTTTCAGTGAAATGTGCAA | 27 | LASGEMKR LLSTAQFE GPRQKKS WRRV* |
| 255 | NM_0009 75.2_341 | 341 | TTCTCTTCCTGCTCTCCATCATGGCGCAGGATCAA GGTGAAAAGGAGAACCCCATGCGGGAACTTCGCA TCCGCAAACTCTGTCTCAACATCTGTGTTGGGGAG AGTGGAGACAGACTGACGCGAGCAGCCAAGGTGT TGGAGCAGCTCACAGGGCAGACCCCTGTGTTTTC CAAAGCTAGATACACTGTCAGATCCTTTGGCATCC GGAGAAATGAAAAGATTGCTGTCCACTGCACAGTT CGAGGGGCCAAGGCAGAAGAAATCTTGGAGAAGG GTCTAAAGGTGCGGGAGTATGAGTTAAGAAAAAAC AACTTCTCAGATACTGGAAACTTTGGTTTGGGATC CAGGAACACATCGATCTGGGTATCAAATATGACCC AAGCATTGGTATCTACGGCCTGGACTTCTATGTGG TGCTGGGTAGGCCAGGTTTCAGCATCGCAGACAA GAAGCGCAGGACAGGCTGCATTGGGGCCAAACAC AGAATCAGCAAAGAGGAGGCCATGCGCTGGTTCC AGCAGAAGTATGATGGGATCATCCTTCCTGGCAAA TAAATTCCCGTTTCTATCCAAAAGAGCAATAAAAAG TTTTCAGTGAAATGTGCAA | 86 | LGSRNTSI WVSNMTQ ALVSTAWT SMWCWVG QVSASQTR SAGQAALG PNTESAKR RPCAGSS RSMMGSS FLANKFPF LSKRAIKSF Q* |
| 256 | NM_0009 75.2_389 | 389 | TTCTCTTCCTGCTCTCCATCATGGCGCAGGATCAA GGTGAAAAGGAGAACCCCATGCGGGAACTTCGCA TCCGCAAACTCTGTCTCAACATCTGTGTTGGGGAG AGTGGAGACAGACTGACGCGAGCAGCCAAGGTGT TGGAGCAGCTCACAGGGCAGACCCCTGTGTTTTC CAAAGCTAGATACACTGTCAGATCCTTTGGCATCC GGAGAAATGAAAAGATTGCTGTCCACTGCACAGTT | 70 | MVSTAWT SMWCWVG QVSASQTR SAGQAALG PNTESAKR RPCAGSS RSMMGSS |

TABLE 3A-continued

| SEQ ID | identifier_position | position | modified_RNA | PAP length | PAP |
|---|---|---|---|---|---|
| | | | CGAGGGGCCAAGGCAGAAGAAATCTTGGAGAAGG<br>GTCTAAAGGTGCGGGAGTATGAGTTAAGAAAAAAC<br>AACTTCTCAGATACTGGAAACTTTGGTTTTGGGATC<br>CAGGAACACATCGATCTGGGTATCAAATATGACCC<br>AAGCATGGTATCTACGGCCTGGACTTCTATGTGGT<br>GCTGGGTAGGCCAGGTTTCAGCATCGCAGACAAG<br>AAGCGCAGGACAGGCTGCATTGGGGCCAAACACA<br>GAATCAGCAAAGAGGAGGCCATGCGCTGGTTCCA<br>GCAGAAGTATGATGGGATCATCCTTCCTGGCAAAT<br>AAATTCCCGTTTCTATCCAAAAGAGCAATAAAAAGT<br>TTTCAGTGAAATGTGCAA | | FLANKFPF<br>LSKRAIKSF<br>Q* |
| 257 | NM_0009<br>75.2_473 | 473 | TTCTCTTCCTGCTCTCCATCATGGCGCAGGATCAA<br>GGTGAAAAGGAGAACCCCATGCGGGAACTTCGCA<br>TCCGCAAACTCTGTCTCAACATCTGTGTTGGGGAG<br>AGTGGAGACAGACTGACGCGAGCAGCCAAGGTGT<br>TGGAGCAGCTCACAGGGCAGACCCCTGTGTTTTC<br>CAAAGCTAGATACACTGTCAGATCCTTTGGCATCC<br>GGAGAAATGAAAAGATTGCTGTCCACTGCACAGTT<br>CGAGGGGCCAAGGCAGAAGAAATCTTGGAGAAGG<br>GTCTAAAGGTGCGGGAGTATGAGTTAAGAAAAAAC<br>AACTTCTCAGATACTGGAAACTTTGGTTTTGGGATC<br>CAGGAACACATCGATCTGGGTATCAAATATGACCC<br>AAGCATTGGTATCTACGGCCTGGACTTCTATGTGG<br>TGCTGGGTAGGCCAGGTTTCAGCATCGCAGACAA<br>GAAGCGCAGGACAGGCTGCATGGGGCCAAACACA<br>GAATCAGCAAAGAGGAGGCCATGCGCTGGTTCCA<br>GCAGAAGTATGATGGGATCATCCTTCCTGGCAAAT<br>AAATTCCCGTTTCTATCCAAAAGAGCAATAAAAAGT<br>TTTCAGTGAAATGTGCAA | 42 | MGPNTES<br>AKRRPCA<br>GSSRSMM<br>GSSFLANK<br>FPFLSKRAI<br>KSFQ* |
| 258 | NM_0009<br>75.2_98 | 98 | TTCTCTTCCTGCTCTCCATCATGGCGCAGGATCAA<br>GGTGAAAAGGAGAACCCCATGCGGGAACTTCGCA<br>TCCGCAAACTCTGTCTCAACATCTGTGTGGGGAGA<br>GTGGAGACAGACTGACGCGAGCAGCCAAGGTGTT<br>GGAGCAGCTCACAGGGCAGACCCCTGTGTTTTCC<br>AAAGCTAGATACACTGTCAGATCCTTTGGCATCCG<br>GAGAAATGAAAAGATTGCTGTCCACTGCACAGTTC<br>GAGGGGCCAAGGCAGAAGAAATCTTGGAGAAGGG<br>TCTAAAGGTGCGGGAGTATGAGTTAAGAAAAAACA<br>ACTTCTCAGATACTGGAAACTTTGGTTTTGGGATC<br>CAGGAACACATCGATCTGGGTATCAAATATGACCC<br>AAGCATTGGTATCTACGGCCTGGACTTCTATGTGG<br>TGCTGGGTAGGCCAGGTTTCAGCATCGCAGACAA<br>GAAGCGCAGGACAGGCTGCATTGGGGCCAAACAC<br>AGAATCAGCAAAGAGGAGGCCATGCGCTGGTTCC<br>AGCAGAAGTATGATGGGATCATCCTTCCTGGCAAA<br>TAAATTCCCGTTTCTATCCAAAAGAGCAATAAAAAG<br>TTTTCAGTGAAATGTGCAA | 5 | RVETD* |
| 259 | NM_0009<br>76.2_178 | 178 | CTCTCGGCTTTCGGCTCGGAGGAGGCCAAGGTGC<br>AACTTCCTTCGGTCGTCCCGAATCCGGGTTCATCC<br>GACACCAGCCGCCTCCACCATGCCGCCGAAGTTC<br>GACCCCAACGAGATCAAAGTCGTATACCTGAGGT<br>GCACCGGAGGTGAAGTCGGTGCCACTTCTGCCCT<br>GGCCCCAAGATCGGCCCCTGGGTCTGTCTCCAA<br>AAAAAGTTGGTGATGACATTGCCAAGGCAACGGGT<br>GACTGGAAGGGCCTGAGGATTACAGTGAAACTGA<br>CCATTCAGAACAGACAGGCCCAGATTGAGGTGGT<br>GCCTTCTGCCTCTGCCCTGATCATCAAAGCCCTCA<br>AGGAACCACCAAGAGACAGAAAGAAACAGAAAAA<br>CATTAAACACAGTGGGAATATCACTTTTGATGAGAT<br>TGTCAACATTGCTCGACAGATGCGGCACCGATCCT<br>TAGCCAGAGAACTCTCTGGAACCATTAAAGAGATC<br>CTGGGGACTGCCCAGTCAGTGGGCTGTAATGTTG<br>ATGGCCGCCATCCTCATGACATCATCGATGACATC<br>AACAGTGGTGCTGTGAATGCCCAGCCAGTTAAG<br>CACAAAGGAAAACATTTCAATAAAGGATCATTTGAC<br>AACTGGTGA | 25 | RSAPWVC<br>LQKKLVMT<br>LPRQRVTG<br>RA* |
| 260 | NM_0009<br>76.2_191 | 191 | CTCTCGGCTTTCGGCTCGGAGGAGGCCAAGGTGC<br>AACTTCCTTCGGTCGTCCCGAATCCGGGTTCATCC<br>GACACCAGCCGCCTCCACCATGCCGCCGAAGTTC<br>GACCCCAACGAGATCAAAGTCGTATACCTGAGGT<br>GCACCGGAGGTGAAGTCGGTGCCACTTCTGCCCT<br>GGCCCCAAGATCGGCCCCTGGGTCTGTCTCCAA<br>AAAAAGTTGGTGATGACATTGCCAAGGCAACGGGT<br>GACTGGAAGGGCCTGAGGATTACAGTGAAACTGA<br>CCATTCAGAACAGACAGGCCCAGATTGAGGTGGT<br>GCCTTCTGCCTCTGCCCTGATCATCAAAGCCCTCA<br>AGGAACCACCAAGAGACAGAAAGAAACAGAAAAA | 21 | WVCLQKKL<br>VMTLPRQR<br>VTGRA* |

TABLE 3A-continued

| SEQ ID | identifier_position | position | modified_RNA | PAP length | PAP |
|---|---|---|---|---|---|
| | | | CATTAAACACAGTGGGAATATCACTTTTGATGAGAT TGTCAACATTGCTCGACAGATGCGGCACCGATCCT TAGCCAGAGAACTCTCTGGAACCATTAAAGAGATC CTGGGGACTGCCCAGTCAGTGGGCTGTAATGTTG ATGGCCGCCATCCTCATGACATCATCGATGACATC AACAGTGGTGCTGTGGAATGCCCAGCCAGTTAAG CACAAAGGAAAACATTTCAATAAAGGATCATTTGAC AACTGGTGA | | |
| 261 | NM_0009 76.2_527 | 527 | CTCTCGGCTTTCGGCTCGGAGGAGGCCAAGGTGC AACTTCCTTCGGTCGTCCCGAATCCGGGTTCATCC GACACCAGCCGCCTCCACCATGCCGCCGAAGTTC GACCCCAACGAGATCAAAGTCGTATACCTGAGGT GCACCGGAGGTGAAGTCGGTGCCACTTCTGCCCT GGCCCCCAAGATCGGCCCCCTGGGTCTGTCTCCA AAAAAAGTTGGTGATGACATTGCCAAGGCAACGG GTGACTGGAAGGGCCTGAGGATTACAGTGAAACT GACCATTCAGAACAGACAGGCCCAGATTGAGGTG GTGCCTTCTGCCTCTGCCCTGATCATCAAAGCCCT CAAGGAACCACCAAGAGACAGAAAGAAACAGAAA AACATTAAACACAGTGGGAATATCACTTTTGATGA GATTGTCAACATTGCTCGACAGATGCGGCACCGAT CCTTAGCCAGAGAACTCTCTGGAACCATTAAAGAG ATCCTGGGGACTGCCCAGTCAGTGGGCTGTAATG TTGATGGCCGCATCCTCATGACATCATCGATGACA TCAACAGTGGTGCTGTGGAATGCCCAGCCAGTTAA GCACAAAGGAAAACATTTCAATAAAGGATCATTTG ACAACTGGTGA | 33 | ILMTSSMT STVVLWNA QPVKHKG KHFNKGSF DNW |
| 262 | NM_0009 77.2_120 | 120 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCACGTGGTTCAACCAGCC GGCCCGTAAGATCCGCAGACGTAAGGCCCGGCAA GCCAAGGCGCGCCGCATCGCCCCGCGCCCCGCG TCGGGTCCCATCCGGCCCATCGTGCGCTGCCCCA CGGTTCGGTACCACACGAAGGTGCGCGCCGGCC GCGGCTTCAGCCTGGAGGAGCTCAGGGTGGCCG GCATTCACAAGAAGGTGGCCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCCGTGCCA ACGCCCGGCTCTTCGGCATACGGGCAAAAAGAGC CAAGGAAGCCGCAGAACAGGATGTTGAAAAGAAA AAATAAAGCCCTCCTGGGGACTTGGAATCAGTCG GCAGTCATGCTGGGTCTCCACGTGGTGTGTTTCGT GGGAACAACTGGGCCTGGGATGGGGCTTCACTGC TGTGACTTCCTCCTGCCAGGGGATTTGGGGCTTTC TTGAAAGACAGTCCAAGCCCTGGATAATGCTTTAC TTTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTC TTTTTAAAGAGGCAAGGTTGGGCTGGTGCTCACAG CTGTAATCCCAGCACTTTGAGGTTGGCTGG | 93 | RGSTSRPV RSADVRP GKPRRAAS PRAPRRVP SGPSCAAP RFGTTRRC APAAASA WRSSGWP AFTRRWP GPSAFLWI RGGGTSP RSPCRPTC SG* |
| 263 | NM_0009 77.2_186 | 186 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCACGTGGTTCAACCAGC CGGCCCGTAAGATCCGCAGACGTAAGGCCCGGCA AGCCAAGGCGCGCCGATCGCCCCGCGCCCCGCG TCGGGTCCCATCCGGCCCATCGTGCGCTGCCCCA CGGTTCGGTACCACACGAAGGTGCGCGCCGGCC GCGGCTTCAGCCTGGAGGAGCTCAGGGTGGCCG GCATTCACAAGAAGGTGGCCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCCGTGCCA ACGCCCGGCTCTTCGGCATACGGGCAAAAAGAGC CAAGGAAGCCGCAGAACAGGATGTTGAAAAGAAA | 71 | SPRAPRRV PSGPSCAA PRFGTTRR CAPAAASA WRSSGWP AFTRRWP GPSAFLWI RGGGTSP RSPCRPTC SG* |

TABLE 3A-continued

| SEQ ID | identifier_position | position | modified_RNA | PAP length | PAP |
|---|---|---|---|---|---|
| | | | AAATAAAGCCCTCCTGGGGACTTGGAATCAGTCG<br>GCAGTCATGCTGGGTCTCCACGTGGTGTGTTTCGT<br>GGGAACAACTGGGCCTGGGATGGGGCTTCACTGC<br>TGTGACTTCCTCCTGCCAGGGGATTTGGGGCTTTC<br>TTGAAAGACAGTCCAAGCCCTGGATAATGCTTTAC<br>TTTCTGTGTTGAAGCACTGTTGGTTGTTTGGTTAGT<br>GACTGATGTAAAACGGTTTTCTTGTGGGGAGGTTA<br>CAGAGGCTGACTTCAGAGTGGACTTGTGTTTTTTC<br>TTTTTAAAGAGGCAAGGTTGGGCTGGTGCTCACAG<br>CTGTAATCCCAGCACTTTGAGGTTGGCTGG | | |
| 264 | NM_0009<br>77.2_237 | 237 | CTTTCCGCTCGGCTGTTTTCCTGCGCAGGAGCCG<br>CAGGGCCGTAGGCAGCCATGGCGCCCAGCCGGA<br>ATGGCATGGTCTTGAAGCCCCACTTCCACAAGGAC<br>TGGCAGCGGCGCGTGGCCACGTGGTTCAACCAGC<br>CGGCCCGTAAGATCCGCAGACGTAAGGCCCGGCA<br>AGCCAAGGCGCGCCGCATCGCCCCGCGCCCCGC<br>GTCGGGTCCCATCCGGCCCATCGTGCGCTGCCCA<br>CGGTTCGGTACCACACGAAGGTGCGCGCCGGCC<br>GCGGCTTCAGCCTGGAGGAGCTCAGGGTGGCCG<br>GCATTCACAAGAAGGTGGCCCGGACCATCGGCAT<br>TTCTGTGGATCCGAGGAGGCGGAACAAGTCCACG<br>GAGTCCCTGCAGGCCAACGTGCAGCGGCTGAAGG<br>AGTACCGCTCCAAACTCATCCTCTTCCCCAGGAAG<br>CCCTCGGCCCCCAAGAAGGGAGACAGTTCTGCTG<br>AAGAACTGAAACTGGCCACCCAGCTGACCGGACC<br>GGTCATGCCCGTCCGGAACGTCTATAAGAAGGAG<br>AAAGCTCGAGTCATCACTGAGGAAGAGAAGAATTT<br>CAAAGCCTTCGCTAGTCTCCGTATGGCCCGTGCCA<br>ACGCCCGGCTCTTCGGCATACGGGCAAAAAGAGC<br>CAAGGAAGCCGCAGAACAGGATGTTGAAAAGAAA<br>AAATAAAGCCCTCCTGGGGACTTGGAATCAGTCG<br>GCAGTCATGCTGGGTCTCCACGTGGTGTGTTTCGT<br>GGGAACAACTGGGCCTGGGATGGGGCTTCACTGC<br>TGTGACTTCCTCCTGCCAGGGGATTTGGGGCTTTC<br>TTGAAAGACAGTCCAAGCCCTGGATAATGCTTTAC<br>TTTCTGTGTTGAAGCACTGTTGGTTGTTTGGTTAGT<br>GACTGATGTAAAACGGTTTTCTTGTGGGGAGGTTA<br>CAGAGGCTGACTTCAGAGTGGACTTGTGTTTTTTC<br>TTTTTAAAGAGGCAAGGTTGGGCTGGTGCTCACAG<br>CTGTAATCCCAGCACTTTGAGGTTGGCTGG | 54 | RFGTTRRC<br>APAAASA<br>WRSSGWP<br>AFTRRWP<br>GPSAFLWI<br>RGGGTSP<br>RSPCRPTC<br>SG* |
| 265 | NM_0009<br>77.2_271 | 271 | CTTTCCGCTCGGCTGTTTTCCTGCGCAGGAGCCG<br>CAGGGCCGTAGGCAGCCATGGCGCCCAGCCGGA<br>ATGGCATGGTCTTGAAGCCCCACTTCCACAAGGAC<br>TGGCAGCGGCGCGTGGCCACGTGGTTCAACCAGC<br>CGGCCCGTAAGATCCGCAGACGTAAGGCCCGGCA<br>AGCCAAGGCGCGCCGCATCGCCCCGCGCCCCGC<br>GTCGGGTCCCATCCGGCCCATCGTGCGCTGCCCC<br>ACGGTTCGGTACCACACGAAGGTGCGCGCCGGC<br>GCGGCTTCAGCCTGGAGGAGCTCAGGGTGGCCG<br>GCATTCACAAGAAGGTGGCCCGGACCATCGGCAT<br>TTCTGTGGATCCGAGGAGGCGGAACAAGTCCACG<br>GAGTCCCTGCAGGCCAACGTGCAGCGGCTGAAGG<br>AGTACCGCTCCAAACTCATCCTCTTCCCCAGGAAG<br>CCCTCGGCCCCCAAGAAGGGAGACAGTTCTGCTG<br>AAGAACTGAAACTGGCCACCCAGCTGACCGGACC<br>GGTCATGCCCGTCCGGAACGTCTATAAGAAGGAG<br>AAAGCTCGAGTCATCACTGAGGAAGAGAAGAATTT<br>CAAAGCCTTCGCTAGTCTCCGTATGGCCCGTGCCA<br>ACGCCCGGCTCTTCGGCATACGGGCAAAAAGAGC<br>CAAGGAAGCCGCAGAACAGGATGTTGAAAAGAAA<br>AAATAAAGCCCTCCTGGGGACTTGGAATCAGTCG<br>GCAGTCATGCTGGGTCTCCACGTGGTGTGTTTCGT<br>GGGAACAACTGGGCCTGGGATGGGGCTTCACTGC<br>TGTGACTTCCTCCTGCCAGGGGATTTGGGGCTTTC<br>TTGAAAGACAGTCCAAGCCCTGGATAATGCTTTAC<br>TTTCTGTGTTGAAGCACTGTTGGTTGTTTGGTTAGT<br>GACTGATGTAAAACGGTTTTCTTGTGGGGAGGTTA<br>CAGAGGCTGACTTCAGAGTGGACTTGTGTTTTTTC<br>TTTTTAAAGAGGCAAGGTTGGGCTGGTGCTCACAG<br>CTGTAATCCCAGCACTTTGAGGTTGGCTGG | 43 | AASAWRS<br>SGWPAFT<br>RRWPGPS<br>AFLWIRGG<br>GTSPRSPC<br>RPTCSG* |
| 266 | NM_0009<br>77.2_276 | 276 | CTTTCCGCTCGGCTGTTTTCCTGCGCAGGAGCCG<br>CAGGGCCGTAGGCAGCCATGGCGCCCAGCCGGA<br>ATGGCATGGTCTTGAAGCCCCACTTCCACAAGGAC<br>TGGCAGCGGCGCGTGGCCACGTGGTTCAACCAGC<br>CGGCCCGTAAGATCCGCAGACGTAAGGCCCGGCA<br>AGCCAAGGCGCGCCGCATCGCCCCGCGCCCCGC<br>GTCGGGTCCCATCCGGCCCATCGTGCGCTGCCCC | 41 | SAWRSSG<br>WPAFTRR<br>WPGPSAFL<br>WIRGGGTS<br>PRSPCRPT<br>CSG* |

TABLE 3A-continued

| SEQ ID | identifier_position | position | modified_RNA | PAP length | PAP |
|---|---|---|---|---|---|
| | | | ACGGTTCGGTACCACACGAAGGTGCGCGCCGGCC GCGGTTCAGCCTGGAGGAGCTCAGGGTGGCCGG CATTCACAAGAAGGTGGCCCGGACCATCGGCATT TCTGTGGATCCGAGGAGGCGGAACAAGTCCACGG AGTCCCTGCAGGCCAACGTGCAGCGGCTGAAGGA GTACCGCTCCAAACTCATCCTCTTCCCCAGGAAGC CCTCGGCCCCAAGAAGGGAGACAGTTCTGCTGA AGAACTGAAACTGGCCACCCAGCTGACCGGACCG GTCATGCCCGTCCGGAACGTCTATAAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTC TTTTTAAAGAGGCAAGGTTGGGCTGGTGCTCACAG CTGTAATCCCAGCACTTTGAGGTTGGCTGG | | |
| 267 | NM_0009 77.2_330 | 330 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCGG GCATTCACAAGAAGGTGGCCCGGACATCGGCATT TCTGTGGATCCGAGGAGGCGGAACAAGTCCACGG AGTCCCTGCAGGCCAACGTGCAGCGGCTGAAGGA GTACCGCTCCAAACTCATCCTCTTCCCCAGGAAGC CCTCGGCCCCAAGAAGGGAGACAGTTCTGCTGA AGAACTGAAACTGGCCACCCAGCTGACCGGACCG GTCATGCCCGTCCGGAACGTCTATAAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTC TTTTTAAAGAGGCAAGGTTGGGCTGGTGCTCACAG CTGTAATCCCAGCACTTTGAGGTTGGCTGG | 23 | SAFLWIRG GGTSPRSP CRPTCSG* |
| 268 | NM_0009 77.2_400 | 400 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCGG GCATTCACAAGAAGGTGGCCCGGACCATCGGCAT TTCTGTGGATCCGAGGAGGCGGAACAAGTCCACG GAGTCCCTGCAGGCCAACGTGCAGCGGTGAAGGA GTACCGCTCCAAACTCATCCTCTTCCCCAGGAAGC CCTCGGCCCCAAGAAGGGAGACAGTTCTGCTGA AGAACTGAAACTGGCCACCCAGCTGACCGGACCG GTCATGCCCGTCCGGAACGTCTATAAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT | 0 | * |

TABLE 3A-continued

| SEQ ID | identifier_position | position | modified_RNA | PAP length | PAP |
|---|---|---|---|---|---|
| | | | TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | | |
| 269 | NM_0009 77.2_414 | 414 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGTCCAAACTCATCCTCTTCCCCAGGAAGC CCTCGGCCCCAAGAAGGGAGACAGTTCTGCTGA AGAACTGAAACTGGCCACCCAGCTGACCGGACCG GTCATGCCCGTCCGGAACGTCTATAAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | 22 | PNSSSSPG SPRPPRRE TVLLKN* |
| 270 | NM_0009 77.2_453 | 453 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTGA AGAACTGAAACTGGCCACCCAGCTGACCGGACCG GTCATGCCCGTCCGGAACGTCTATAAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | 9 | RRETVLLK N* |
| 271 | NM_0009 77.2_492 | 492 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG | 2 | PS* |

| SEQ ID | identifier_position | position | modified_RNA | PAP length | PAP |
|---|---|---|---|---|---|
| | | | GAGTCCCTGCAGGCCAACGTGCAGCGGCTGAAGG | | |
| | | | AGTACCGCTCCAAACTCATCCTCTTCCCCAGGAAG | | |
| | | | CCCTCGGCCCCAAGAAGGGAGACAGTTCTGCTG | | |
| | | | AAGAACTGAAACTGGCACCCAGCTGACCGGACCG | | |
| | | | GTCATGCCCGTCCGGAACGTCTATAAGAAGGAGA | | |
| | | | AAGCTCGAGTCATCACTGAGGAAGAGAAGAATTTC | | |
| | | | AAAGCCTTCGCTAGTCTCCGTATGGCCCGTGCCAA | | |
| | | | CGCCCGGCTCTTCGGCATACGGGCAAAAAGAGCC | | |
| | | | AAGGAAGCCGCAGAACAGGATGTTGAAAAGAAAA | | |
| | | | AATAAAGCCCTCCTGGGGACTTGGAATCAGTCGG | | |
| | | | CAGTCATGCTGGGTCTCCACGTGGTGTGTTTCGTG | | |
| | | | GGAACAACTGGGCCTGGGATGGGGCTTCACTGCT | | |
| | | | GTGACTTCCTCCTGCCAGGGGATTTGGGGCTTTCT | | |
| | | | TGAAAGACAGTCCAAGCCCTGGATAATGCTTTACT | | |
| | | | TTCTGTGTTGAAGCACTGTTGGTTGTTTGGTTAGT | | |
| | | | GACTGATGTAAAACGGTTTTCTTGTGGGGAGGTTA | | |
| | | | CAGAGGCTGACTTCAGAGTGGACTTGTGTTTTTTC | | |
| | | | TTTTTAAAGAGGCAAGGTTGGGCTGGTGCTCACAG | | |
| | | | CTGTAATCCCAGCACTTTGAGGTTGGCTGG | | |
| 272 | NM_0009 77.2_496 | 496 | CTTTCCGCTCGGCTGTTTTCCTGCGCAGGAGCCG | 1 | S* |
| | | | CAGGGCCGTAGGCAGCCATGGCGCCCAGCCGGA | | |
| | | | ATGGCATGGTCTTGAAGCCCCACTTCCACAAGGAC | | |
| | | | TGGCAGCGGCGCGTGGCCACGTGGTTCAACCAGC | | |
| | | | CGGCCCGTAAGATCCGCAGACGTAAGGCCCGGCA | | |
| | | | AGCCAAGGCGCGCCGCATCGCCCCGCGCCCCGC | | |
| | | | GTCGGGTCCCATCCGGCCCATCGTGCGCTGCCCC | | |
| | | | ACGGTTCGGTACCACACGAAGGTGCGCGCCGGCC | | |
| | | | GCGGCTTCAGCCTGGAGGAGCTCAGGGTGGCCG | | |
| | | | GCATTCACAAGAAGGTGGCCCGGACCATCGGCAT | | |
| | | | TTCTGTGGATCCGAGGAGGCGGAACAAGTCCACG | | |
| | | | GAGTCCCTGCAGGCCAACGTGCAGCGGCTGAAGG | | |
| | | | AGTACCGCTCCAAACTCATCCTCTTCCCCAGGAAG | | |
| | | | CCCTCGGCCCCAAGAAGGGAGACAGTTCTGCTG | | |
| | | | AAGAACTGAAACTGGCCACCAGCTGACCGGACCG | | |
| | | | GTCATGCCCGTCCGGAACGTCTATAAGAAGGAGA | | |
| | | | AAGCTCGAGTCATCACTGAGGAAGAGAAGAATTTC | | |
| | | | AAAGCCTTCGCTAGTCTCCGTATGGCCCGTGCCAA | | |
| | | | CGCCCGGCTCTTCGGCATACGGGCAAAAAGAGCC | | |
| | | | AAGGAAGCCGCAGAACAGGATGTTGAAAAGAAAA | | |
| | | | AATAAAGCCCTCCTGGGGACTTGGAATCAGTCGG | | |
| | | | CAGTCATGCTGGGTCTCCACGTGGTGTGTTTCGTG | | |
| | | | GGAACAACTGGGCCTGGGATGGGGCTTCACTGCT | | |
| | | | GTGACTTCCTCCTGCCAGGGGATTTGGGGCTTTCT | | |
| | | | TGAAAGACAGTCCAAGCCCTGGATAATGCTTTACT | | |
| | | | TTCTGTGTTGAAGCACTGTTGGTTGTTTGGTTAGT | | |
| | | | GACTGATGTAAAACGGTTTTCTTGTGGGGAGGTTA | | |
| | | | CAGAGGCTGACTTCAGAGTGGACTTGTGTTTTTTC | | |
| | | | TTTTTAAAGAGGCAAGGTTGGGCTGGTGCTCACAG | | |
| | | | CTGTAATCCCAGCACTTTGAGGTTGGCTGG | | |
| 273 | NM_0009 77.2_509 | 509 | CTTTCCGCTCGGCTGTTTTCCTGCGCAGGAGCCG | 104 | RSCPSGTS |
| | | | CAGGGCCGTAGGCAGCCATGGCGCCCAGCCGGA | | IRRRKLES |
| | | | ATGGCATGGTCTTGAAGCCCCACTTCCACAAGGAC | | SLRKRRIS |
| | | | TGGCAGCGGCGCGTGGCCACGTGGTTCAACCAGC | | KPSLVSVW |
| | | | CGGCCCGTAAGATCCGCAGACGTAAGGCCCGGCA | | PVPTPGSS |
| | | | AGCCAAGGCGCGCCGCATCGCCCCGCGCCCCGC | | AYGQKEP |
| | | | GTCGGGTCCCATCCGGCCCATCGTGCGCTGCCCC | | RKPQNRM |
| | | | ACGGTTCGGTACCACACGAAGGTGCGCGCCGGCC | | LKRKNKAL |
| | | | GCGGCTTCAGCCTGGAGGAGCTCAGGGTGGCCG | | LGTWNQS |
| | | | GCATTCACAAGAAGGTGGCCCGGACCATCGGCAT | | AVMLGLHV |
| | | | TTCTGTGGATCCGAGGAGGCGGAACAAGTCCACG | | VCFVGTTG |
| | | | GAGTCCCTGCAGGCCAACGTGCAGCGGCTGAAGG | | PGMGLHC |
| | | | AGTACCGCTCCAAACTCATCCTCTTCCCCAGGAAG | | CDFLLPGD |
| | | | CCCTCGGCCCCAAGAAGGGAGACAGTTCTGCTG | | LGLS* |
| | | | AAGAACTGAAACTGGCCACCAGCTGACCGGACG | | |
| | | | GTCATGCCCGTCCGGAACGTCTATAAGAAGGAGA | | |
| | | | AAGCTCGAGTCATCACTGAGGAAGAGAAGAATTTC | | |
| | | | AAAGCCTTCGCTAGTCTCCGTATGGCCCGTGCCAA | | |
| | | | CGCCCGGCTCTTCGGCATACGGGCAAAAAGAGCC | | |
| | | | AAGGAAGCCGCAGAACAGGATGTTGAAAAGAAAA | | |
| | | | AATAAAGCCCTCCTGGGGACTTGGAATCAGTCGG | | |
| | | | CAGTCATGCTGGGTCTCCACGTGGTGTGTTTCGTG | | |
| | | | GGAACAACTGGGCCTGGGATGGGGCTTCACTGCT | | |
| | | | GTGACTTCCTCCTGCCAGGGGATTTGGGGCTTTCT | | |
| | | | TGAAAGACAGTCCAAGCCCTGGATAATGCTTTACT | | |
| | | | TTCTGTGTTGAAGCACTGTTGGTTGTTTGGTTAGT | | |
| | | | GACTGATGTAAAACGGTTTTCTTGTGGGGAGGTTA | | |
| | | | CAGAGGCTGACTTCAGAGTGGACTTGTGTTTTTTC | | |

TABLE 3A-continued

| SEQ ID | identifier_position | position | modified_RNA | length PAP | PAP |
|---|---|---|---|---|---|
| 274 | NM_0009 77.2_536 | 536 | TTTTTAAAGAGGCAAGGTTGGGCTGGTGCTCACAG CTGTAATCCCAGCACTTTGAGGTTGGCTGG CTTTCCGCTCGGCTGTTTTCCTGCGCAGGAGCC CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTG AAGAACTGAAACTGGCCACCCAGCTGACCGGACC GGTCATGCCCGTCCGGAACGTCTATAGAAGGAGA AAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTC TTTTTAAAGAGGCAAGGTTGGGCTGGTGCTCACAG CTGTAATCCCAGCACTTTGAGGTTGGCTGG | 95 | RRRKLESS LRKRRISK PSLVSVWP VPTPGSSA YGQKEPR KPQNRML KRKNKALL GTWNQSA VMLGLHVV CFVGTTGP GMGLHCC DFLLPGDL GLS* |
| 275 | NM_0009 77.2_578 | 578 | CTTTCCGCTCGGCTGTTTTCCTGCGCAGGAGCC CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTTC AAAGCCTTCGCTAGTCTCCGTATGGCCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTC TTTTTAAAGAGGCAAGGTTGGGCTGGTGCTCACAG CTGTAATCCCAGCACTTTGAGGTTGGCTGG | 81 | SKPSLVSV WPVPTPG SSAYGQKE PRKPQNR MLKRKNKA LLGTWNQ SAVMLGLH VVCFVGTT GPGMGLH CCDFLLPG DLGLS* |
| 276 | NM_0009 77.2_607 | 607 | CTTTCCGCTCGGCTGTTTTCCTGCGCAGGAGCC CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTG AAGAACTGAAACTGGCCACCCAGCTGACCGGACC | 71 | VPTPGSSA YGQKEPR KPQNRML KRKNKALL GTWNQSA VMLGLHVV CFVGTTGP GMGLHCC DFLLPGDL GLS* |

TABLE 3A-continued

| SEQ ID | identifier_position | position | modified_RNA | PAP length | PAP |
|---|---|---|---|---|---|
| | | | GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCGTGCCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | | |
| 277 | NM_0009 77.2_612 | 612 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCCGTGCAA CGCCCGGCTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | 69 | TPGSSAYG QKEPRKP QNRMLKR KNKALLGT WNQSAVM LGLHVVCF VGTTGPG MGLHCCD FLLPGDLG LS* |
| 278 | NM_0009 77.2_622 | 622 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCCGTGCCA ACGCCCGGTCTTCGGCATACGGGCAAAAAGAGCC AAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | 66 | SSAYGQKE PRKPQNR MLKRKNKA LLGTWNQ SAVMLGLH VVCFVGTT GPGMGLH CCDFLLPG DLGLS* |

TABLE 3A-continued

| SEQ ID | identifier_ position | position | modified_RNA | PAP length | PAP |
|---|---|---|---|---|---|
| 279 | NM_000977.2_650 | 650 | CTTTCCGCTCGGCTGTTTTCCTGCGCAGGAGCCG CAGGGCCGTAGGCAGCCATGGCGCCCAGCCGGA ATGGCATGGTCTTGAAGCCCCACTTCCACAAGGAC TGGCAGCGGCGCGTGGCCACGTGGTTCAACCAGC CGGCCCGTAAGATCCGCAGACGTAAGGCCCGGCA AGCCAAGGCGCGCCGCATCGCCCCGCGCCCCGC GTCGGGTCCCATCCGGCCCATCGTGCGCTGCCCC ACGGTTCGGTACCACACGAAGGTGCGCGCCGGCC GCGGCTTCAGCCTGGAGGAGCTCAGGGTGGCCG GCATTCACAAGAAGGTGGCCCGGACCATCGGCAT TTCTGTGGATCCGAGGAGGCGGAACAAGTCCACG GAGTCCCTGCAGGCCAACGTGCAGCGGCTGAAGG AGTACCGCTCCAAACTCATCCTCTTCCCCAGGAAG CCCTCGGCCCCCAAGAAGGGAGACAGTTCTGCTG AAGAACTGAAACTGGCCACCCAGCTGACCGGACC GGTCATGCCCGTCCGGAACGTCTATAAGAAGGAG AAAGCTCGAGTCATCACTGAGGAAGAGAAGAATTT CAAAGCCTTCGCTAGTCTCCGTATGGCCCGTGCCA ACGCCCGGCTCTTCGGCATACGGGCAAAAAGAGC CAGGAAGCCGCAGAACAGGATGTTGAAAAGAAAA AATAAAGCCCTCCTGGGGACTTGGAATCAGTCGG CAGTCATGCTGGGTCTCCACGTGGTGTGTTTCGTG GGAACAACTGGGCCTGGATGGGGCTTCACTGCT GTGACTTCCTCCTGCCAGGGGATTTGGGGCTTTCT TGAAAGACAGTCCAAGCCCTGGATAATGCTTTACT TTCTGTGTTGAAGCACTGTTGGTTGTTTGGTTAGT GACTGATGTAAAACGGTTTTCTTGTGGGGAGGTTA CAGAGGCTGACTTCAGAGTGGACTTGTGTTTTTTC TTTTTAAAGAGGCAAGGTTGGGCTGGTGCTCACAG CTGTAATCCCAGCACTTTGAGGTTGGCTGG | 57 | RKPQNRM LKRKNKAL LGTWNQS AVMLGLHV VCFVGTTG PGMGLHC CDFLLPGD LGLS* |
| 280 | NM_000978.3_384 | 384 | GGCCACGTGAGGAGGGTGGGCGGGGCGTTAAAG TTCATATCCCAGTGTCCTTTGAATCGACTTCCTTTT TTCTTTTTTCCGGCGTTCAAGATGTCGAAGCGAGG ACGTGGTGGGTCCTCTGGTGCGAAATTCCGGATTT CCTTGGGTCTTCCGGTAGGAGCTGTAATCAATTGT GCTGACAACACAGGAGCCAAAAACCTGTATATCAT CTCCGTGAAGGGGATCAAGGGACGGCTGAACAGA CTTCCCGCTGCTGGTGTGGGTGACATGGTGATGG CCACAGTCAAGAAAGGCAAACCAGAGCTCAGAAA AAAGGTACATCCAGCAGTGGTCATTCGACAACGAA AGTCATACCGTAGAAAAGATGGCGTGTTTCTTTATT TGAAGATAATGCAGGAGTCATAGTGAACAATAAAG GCGAGATGAAAGGTTCTGCCATTACAGGACCAGTA GCAAAGGAGTGTGCAGACTTGTGGCCCCGGATTG CATCCAATGCTGGCAGCATTGCATGATTCTCCAGT ATATTTGTAAAAAATAAAAAAAAAAACTAAACCCAT TAAAAAGTATTTGTTTGCAAAAAAAAAAAAAAAAAA | 7 | LKIMQES* |
| 281 | NM_000979.2_116 | 116 | CTTTCCGGACCTGGCCGAGCAGGAGGCGCCATCA TGGGAGTGGACATCCGCCATAACAAGGACCGAAA GGTTCGGCGCAAGGAGCCCAAGAGCCAGGATATC TACCTGAGGCTGTGGTCAAGTTATACAGGTTTCTG GCCAGAAGAACCAACTCCACATTCAACCAGGTTGT GTTGAAGAGGTTGTTTATGAGTCGCACCAACCGGC CGCCTCTGTCCCTTTCCCGGATGATCCGGAAGATG AAGCTTCCTGGCCGGGAAAAACAAGACGGCCGTGG TTGTGGGGACCATAACTGATGATGTGCGGGTTCAG GAGGTACCCAAACTGAAGGTATGTGCACTGCGCG TGACCAGCCGGGCCCGCAGCCGCATCCTCAGGG CAGGGGGCAAGATCCTCACTTTCGACCAGCTGGC CCTGGACTCCCCTAAGGGCTGTGGCACTGTCCTG CTCTCCGGTCCTCGCAAGGGCCGAGAGGTGTACC GGCATTTCGGCAAGGCCCCAGGAACCCCGCACAG CCACACCAAACCCTACGTCCGCTCCAAGGGCCGG AAGTTCGAGCGTGCCAGAGGCCGACGGGCCAGC CGAGGCTACAAAAACTAACCCTGGATCCTACTCTC TTATTAAAAAGATTTTTGCTGACAAAAAAAAA | 20 | WSSYTGF WPEEPTP HSTRLC* |
| 282 | NM_000979.2_185 | 185 | CTTTCCGGACCTGGCCGAGCAGGAGGCGCCATCA TGGGAGTGGACATCCGCCATAACAAGGACCGAAA GGTTCGGCGCAAGGAGCCCAAGAGCCAGGATATC TACCTGAGGCTGTGGTCAAGTTATACAGGTTTCT GGCCAGAAGAACCAACTCCACATTCAACCAGGTTG TGTTGAAGAGGTGTTTATGAGTCGCACCAACCGGC CGCCTCTGTCCCTTTCCCGGATGATCCGGAAGATG AAGCTTCCTGGCCGGGAAAAACAAGACGGCCGTGG TTGTGGGGACCATAACTGATGATGTGCGGGTTCAG GAGGTACCCAAACTGAAGGTATGTGCACTGCGCG TGACCAGCCGGGCCCGCAGCCGCATCCTCAGGG | 2 | CL* |

TABLE 3A-continued

| SEQ ID | identifier_position | position | modified_RNA | PAP length | PAP |
|---|---|---|---|---|---|
| 283 | NM_0009<br>79.2_273 | 273 | CAGGGGGCAAGATCCTCACTTTCGACCAGCTGGC<br>CCTGGACTCCCCTAAGGGCTGTGGCACTGTCCTG<br>CTCTCCGGTCCTCGCAAGGGCCGAGAGGTGTACC<br>GGCATTTCGGCAAGGCCCCAGGAACCCCGCACAG<br>CCACACCAAACCCTACGTCCGCTCCAAGGGCCGG<br>AAGTTCGAGCGTGCCAGAGGCCGACGGGCCAGC<br>CGAGGCTACAAAAACTAACCCTGGATCCTACTCTC<br>TTATTAAAAAGATTTTGCTGACAAAAAAAA<br>CTTTCCGGACCTGGCCGAGCAGGAGGCGCCATCA<br>TGGGAGTGGACATCCGCCATAACAAGGACCGAAA<br>GGTTCGGCGCAAGGAGCCCAAGAGCCAGGATATC<br>TACCTGAGGCTGTTGGTCAAGTTATACAGGTTTCT<br>GGCCAGAAGAACCAACTCCACATTCAACCAGGTTG<br>TGTTGAAGAGGTTGTTTATGAGTCGCACCAACCGG<br>CCGCCTCTGTCCCTTTCCCGGATGATCCGGAAGAT<br>GAAGCTTCCTGGCCGGGAAAACAAGACGGCGTGG<br>TTGTGGGGACCATAACTGATGATGTGCGGGTTCAG<br>GAGGTACCCAAACTGAAGGTATGTGCACTGCGCG<br>TGACCAGCCGGGCCCGCAGCCGCATCCTCAGGG<br>CAGGGGGCAAGATCCTCACTTTCGACCAGCTGGC<br>CCTGGACTCCCCTAAGGGCTGTGGCACTGTCCTG<br>CTCTCCGGTCCTCGCAAGGGCCGAGAGGTGTACC<br>GGCATTTCGGCAAGGCCCCAGGAACCCCGCACAG<br>CCACACCAAACCCTACGTCCGCTCCAAGGGCCGG<br>AAGTTCGAGCGTGCCAGAGGCCGACGGGCCAGC<br>CGAGGCTACAAAAACTAACCCTGGATCCTACTCTC<br>TTATTAAAAAGATTTTGCTGACAAAAAAAA | 5 | WLWGP* |
| 284 | NM_0009<br>79.2_517 | 517 | CTTTCCGGACCTGGCCGAGCAGGAGGCGCCATCA<br>TGGGAGTGGACATCCGCCATAACAAGGACCGAAA<br>GGTTCGGCGCAAGGAGCCCAAGAGCCAGGATATC<br>TACCTGAGGCTGTTGGTCAAGTTATACAGGTTTCT<br>GGCCAGAAGAACCAACTCCACATTCAACCAGGTTG<br>TGTTGAAGAGGTTGTTTATGAGTCGCACCAACCGG<br>CCGCCTCTGTCCCTTTCCCGGATGATCCGGAAGAT<br>GAAGCTTCCTGGCCGGGAAAACAAGACGGCCGTG<br>GTTGTGGGGACCATAACTGATGATGTGCGGGTTCA<br>GGAGGTACCCAAACTGAAGGTATGTGCACTGCGC<br>GTGACCAGCCGGGCCCGCAGCCGCATCCTCAGG<br>GCAGGGGGCAAGATCCTCACTTTCGACCAGCTGG<br>CCCTGGACTCCCCTAAGGGCTGTGGCACTGTCCT<br>GCTCTCCGGTCCTCGCAAGGGCCGAGAGGTGTAC<br>CGGCATTTCGGCAAGGCCCCAGGAACCCCGCACA<br>GCACACCAAACCCTACGTCCGCTCCAAGGGCCGG<br>AAGTTCGAGCGTGCCAGAGGCCGACGGGCCAGC<br>CGAGGCTACAAAAACTAACCCTGGATCCTACTCTC<br>TTATTAAAAAGATTTTGCTGACAAAAAAAA | 42 | TPNPTSAP<br>RAGSSSVP<br>EADGPAEA<br>TKTNPGSY<br>SLIKKIFAD<br>KK |
| 285 | NM_0009<br>79.2_564 | 564 | CTTTCCGGACCTGGCCGAGCAGGAGGCGCCATCA<br>TGGGAGTGGACATCCGCCATAACAAGGACCGAAA<br>GGTTCGGCGCAAGGAGCCCAAGAGCCAGGATATC<br>TACCTGAGGCTGTTGGTCAAGTTATACAGGTTTCT<br>GGCCAGAAGAACCAACTCCACATTCAACCAGGTTG<br>TGTTGAAGAGGTTGTTTATGAGTCGCACCAACCGG<br>CCGCCTCTGTCCCTTTCCCGGATGATCCGGAAGAT<br>GAAGCTTCCTGGCCGGGAAAACAAGACGGCCGTG<br>GTTGTGGGGACCATAACTGATGATGTGCGGGTTCA<br>GGAGGTACCCAAACTGAAGGTATGTGCACTGCGC<br>GTGACCAGCCGGGCCCGCAGCCGCATCCTCAGG<br>GCAGGGGGCAAGATCCTCACTTTCGACCAGCTGG<br>CCCTGGACTCCCCTAAGGGCTGTGGCACTGTCCT<br>GCTCTCCGGTCCTCGCAAGGGCCGAGAGGTGTAC<br>CGGCATTTCGGCAAGGCCCCAGGAACCCCGCACA<br>GCCACACCAAACCCTACGTCCGCTCCAAGGGCCG<br>GAAGTTCGAGCGTGCCAGAGGCCGACGGGCCAGC<br>CGAGGCTACAAAAACTAACCCTGGATCCTACTCTC<br>TTATTAAAAAGATTTTGCTGACAAAAAAAA | 26 | EADGPAEA<br>TKTNPGSY<br>SLIKKIFAD<br>KK |
| 286 | NM_0009<br>80.2_114 | 114 | CTTTTGCGGGTGGCGGCAACGCGGAGAGCACG<br>CCATGAAGGCCTCGGGCACGCTACGAGAGTACAA<br>GGTAGTGGGTCGCTGCCTGCCCACCCCCAAATGC<br>CACACGCCGCCCTCTACCGCATGCGAATCTTTGC<br>GCCTAATCATGTCGTCGCCAAGTCCCGCTTCTGGT<br>ACTTTGTATCTCAGTTAAAGAAGATGAAGAAGTCTT<br>CAGGGGAGATTGTCTACTGTGGGCAGGTGTTTGA<br>GAAGTCCCCCCTGCGGGTGAAGAACTTCGGGATC<br>TGGCTGCGCTATGACTCCCGGAGCGGCACCCACA<br>ACATGTACCGGGAATACCGGGACCTGACCACCGC<br>AGGCGCTGTCACCCAGTGCTACCGAGACATGGGT<br>GCCCGGCACCGCGCCCGAGCCCACTCCATTCAGA | 24 | STACESLR<br>LIMSSPSP<br>ASGTLYLS* |

TABLE 3A-continued

| SEQ ID | identifier_position | position | modified_RNA | PAP length | PAP |
|---|---|---|---|---|---|
| | | | TCATGAAGGTGGAGGAGATCGCGGCCAGCAAGTG CCGCCGGCCGGCTGTCAAGCAGTTCCACGACTCC AAGATCAAGTTCCCGCTGCCCCACCGGGTCCTGC GCCGTCAGCACAAGCCACGCTTCACCACCAAGAG GCCCAACACCTTCTTCTAGGTGCAGGGCCCTCGT CCGGGTGTGCCCCAAATAAACTCAGGAACGCCCC GGT | | |
| 287 | NM_0009 80.2_176 | 176 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTGTATCTCAGTTAAAGAAGATGAAGAAGTCTTC AGGGGAGATTGTCTACTGTGGGCAGGTGTTTGAG AAGTCCCCCCTGCGGGTGAAGAACTTCGGGATCT GGCTGCGCTATGACTCCCGGAGCGGCACCCACAA CATGTACCGGGAATACCGGGACCTGACCACCGCA GGCGCTGTCACCCAGTGCTACCGAGACATGGGTG CCCGGCACCGCGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 4 | LYLS* |
| 288 | NM_0009 80.2_218 | 218 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATGTCTACTGTGGGCAGGTGTTTGAG AAGTCCCCCCTGCGGGTGAAGAACTTCGGGATCT GGCTGCGCTATGACTCCCGGAGCGGCACCCACAA CATGTACCGGGAATACCGGGACCTGACCACCGCA GGCGCTGTCACCCAGTGCTACCGAGACATGGGTG CCCGGCACCGCGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 14 | MSTVGRCL RSPPCG* |
| 289 | NM_0009 80.2_239 | 239 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTGAG AAGTCCCCCCTGCGGGTGAAGAACTTCGGGATCT GGCTGCGCTATGACTCCCGGAGCGGCACCCACAA CATGTACCGGGAATACCGGGACCTGACCACCGCA GGCGCTGTCACCCAGTGCTACCGAGACATGGGTG CCCGGCACCGCGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 7 | LRSPPCG* |
| 290 | NM_0009 80.2_302 | 302 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGACCCACAA CATGTACCGGGAATACCGGGACCTGACCACCGCA GGCGCTGTCACCCAGTGCTACCGAGACATGGGTG CCCGGCACCGCGCCCGAGCCCACTCCATTCAGAT CATGAAGGTGGAGGAGATCGCGGCCAGCAAGTGC | 10 | PTTCTGNT GT* |

TABLE 3A-continued

| SEQ ID | identifier_position | position | modified_RNA | PAP length | PAP |
|---|---|---|---|---|---|
| | | | CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | | |
| 291 | NM_0009 80.2_306 | 306 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCACAA CATGTACCGGGAATACCGGGACCTGACCACCGCA GGCGCTGTCACCCAGTGCTACCGAGACATGGGTG CCCGGCACCGCGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 9 | TTCTGNTG T* |
| 292 | NM_0009 80.2_387 | 387 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACGCGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 9 | APEPTPFR S* |
| 293 | NM_0009 80.2_389 | 389 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGGCCCGAGCCCACTCCATTCAGAT CATGAAGGTGGAGGAGATCGCGGCCAGCAAGTGC CGCCGGCCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 8 | PEPTPFRS* |
| 294 | NM_0009 80.2_437 | 437 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTGC CGCCGGCCGGCTGTCAAGCAGTTCCACGACTCCA | 53 | ASAAGRLS SSSTTPRS SSRCPTGS CAVSTSHA SPPRGPTP SSRCRALV RVCPK* |

TABLE 3A-continued

| SEQ ID | identifier_position | position | modified_RNA | PAP length | PAP |
|---|---|---|---|---|---|
| | | | AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | | |
| 295 | NM_0009 80.2_454 | 454 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTG CCGCCGGCGGCTGTCAAGCAGTTCCACGACTCCA AGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 48 | RLSSSSTT PRSSSRCP TGSCAVST SHASPPRG PTPSSRCR ALVRVCPK* |
| 296 | NM_0009 80.2_501 | 501 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTG CCGCCGGCGGCTGTCAAGCAGTTCCACGACTCC AAGATCAAGTTCCCGCTGCCCCACCGGGTCCTGCG CCGTCAGCACAAGCCACGCTTCACCACCAAGAGG CCCAACACCTTCTTCTAGGTGCAGGGCCCTCGTCC GGGTGTGCCCCAAATAAACTCAGGAACGCCCCGG T | 32 | TGSCAVST SHASPPRG PTPSSRCR ALVRVCPK* |
| 297 | NM_0009 80.2_539 | 539 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTG CCGCCGGCGGCTGTCAAGCAGTTCCACGACTCC AAGATCAAGTTCCCGCTGCCCCACCGGGTCCTGC GCCGTCAGCACAAGCCACGCTTCACACCAAGAGG CCCAACACCTTCTTCTAGGTGCAGGGCCCTCGTCC GGGTGTGCCCCAAATAAACTCAGGAACGCCCCGG T | 19 | PRGPTPSS RCRALVRV CPK* |
| 298 | NM_0009 80.2_551 | 551 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTG CCGCCGGCGGCTGTCAAGCAGTTCCACGACTCC AAGATCAAGTTCCCGCTGCCCCACCGGGTCCTGC | 15 | TPSSRCRA LVRVCPK* |

TABLE 3A-continued

| SEQ ID | identifier_ position | position | modified_RNA | PAP length | PAP |
|---|---|---|---|---|---|
| | | | GCCGTCAGCACAAGCCACGCTTCACCACCAAGAG GCCAACACCTTCTTCTAGGTGCAGGGCCCTCGTC CGGGTGTGCCCCAAATAAACTCAGGAACGCCCCG GT | | |
| 299 | NM_0009 80.2_557 | 557 | CTTTTGCGGGTGGCGGCGAACGCGGAGAGCACG CCATGAAGGCCTCGGGCACGCTACGAGAGTACAA GGTAGTGGGTCGCTGCCTGCCCACCCCCAAATGC CACACGCCGCCCCTCTACCGCATGCGAATCTTTGC GCCTAATCATGTCGTCGCCAAGTCCCGCTTCTGGT ACTTTGTATCTCAGTTAAAGAAGATGAAGAAGTCTT CAGGGGAGATTGTCTACTGTGGGCAGGTGTTTGA GAAGTCCCCCCTGCGGGTGAAGAACTTCGGGATC TGGCTGCGCTATGACTCCCGGAGCGGCACCCACA ACATGTACCGGGAATACCGGGACCTGACCACCGC AGGCGCTGTCACCCAGTGCTACCGAGACATGGGT GCCCGGCACCGCGCCCGAGCCCACTCCATTCAGA TCATGAAGGTGGAGGAGATCGCGGCCAGCAAGTG CCGCCGGCCGGCTGTCAAGCAGTTCCACGACTCC AAGATCAAGTTCCCGCTGCCCCACCGGGTCCTGC GCCGTCAGCACAAGCCACGCTTCACCACCAAGAG GCCCAACACTTCTTCTAGGTGCAGGGCCCTCGTC CGGGTGTGCCCCAAATAAACTCAGGAACGCCCCG GT | 13 | SSRCRALV RVCPK* |
| 300 | NM_0009 81.3_367 | 367 | GCAGATAATGGGAGGAGCCGGGCCCGAGCGAGC TCTTTCCTTTCGCTGCTGCGGCCGCAGCCATGAGT ATGCTCAGGCTTCAGAAGAGGCTCGCCTCTAGTGT CCTCCGCTGTGGCAAGAAGAAGGTCTGGTTAGAC CCCAATGAGACCAATGAAATCGCCAATGCCAACTC CCGTCAGCAGATCCGGAAGCTCATCAAAGATGGG CTGATCATCCGCAAGCCTGTGACGGTCCATTCCCG GGCTCGATGCCGGAAAAACACCTTGGCCCGCCGG AAGGGCAGGCACATGGGCATAGGTAAGCGGAAGG GTACAGCCAATGCCCGAATGCCAGAGAAGGTCAC ATGGATGAGGAGAATGAGGATTTGCGCCGGCTGC TCAGAAGATACCGTGAATCTAAGAAGATCGATCGC CACATGTATCACAGCCTGTACCTGAAGGTGAAGG GGAATGTGTTCAAAAACAAGCGGATTCTCATGGAA CACATCCACAAGCTGAAGGCAGACAAGGCCCGCA AGAAGCTCCTGGCTGACCAGGCTGAGGCCCGCAG GTCTAAGACCAAGGAAGCACGCAAGCGCCGTGAA GAGCGCCTCCAGGCCAAGAAGGAGGAGATCATCA AGACTTTATCCAAGGAGGAAGAGACCAAGAAATAA AACCTCCCACTTTGTCTGTACATACTGGCCTCTGT GATTACATAGATCAGCCATTAAAATAAAACAAGCCT TAATCTGCAAAAAAAAAAAAAAAAA | 23 | CAGCSEDT VNLRRSIA TCITACT* |
| 301 | NM_0009 87.3_297 | 297 | ATAGGTCTCGCGAGATCTTTGGTAAACTTACAGAA CCGGAAGCAGCGTGTAGTTCTCTTCCCTTTTGCGG CCATCACCGAAGCGGGAGCGGCCAAAATGAAGTT TAATCCCTTTGTGACTTCCGACCGAAGCAAGAATC GCAAAAGGCATTTCAATGCACCTTCCCACATTCGA AGGAAGATTATGTCTTCCCCTCTTTCCAAAGAGCT GAGACAGAAGTACAACGTGCGATCCATGCCCATC CGAAAGGATGATGAAGTTCAGGTTGTACGTGGACA CTATAAAGGTCAGCAAATGGCAAAGTAGTCCAGGT TTACAGGAAGAAATATGTTATCTACATTGAACGGG TGCAGCGGGAAAAGGCTAATGGCACAACTGTCCA CGTAGGCATTCACCCCAGCAAGGTGGTTATCACTA GGCTAAAACTGGACAAAGACCGCAAAAAGATCCTC GAACGGAAAGCCAAATCTCGCCAAGTAGGAAAGG AAAAGGGCAAATACAAGGAAGAAACCATTGAGAAG ATGCAGGAATAAAGTAATCTTATATACAAGCTTTGA TTAAAAACTTGAAACAAAGAGCCTGAAAAAAAAAAA AAAAAAAA | 3 | MAK* |
| 302 | NM_0009 88.3_258 | 258 | TCCTTCTTTCCTTTTTGCTGGTAGGGCCGGGTGGT TGCTGCCGAAATGGGCAAGTTCATGAAACCTGGG AAGGTGGTGCTTGTCCTGGCTGGACGCTACTCCG GACGCAAAGCTGTCATCGTGAAGAACATTGATGAT GGCACCTCAGATCGCCCCTACAGCCATGCTCTGG TGGCTGGAATTGACCGCTACCCCCGCAAAGTGAC AGCTGCCATGGGCAAGAAGAAGATCGCCAAGAGA TCAAAGATAAAATCTTTGTGAAAGTGTATAACTACA ATCACCTAATGCCCACAAGGTACTCTGTGGATATC CCCTTGGACAAAACTGTCGTCAATAAGGATGTCTT CAGAGATCCTGCTCTTAAACGCAAGGCCCGACGG GAGGCCAAGGTCAAGTTTGAAGAGAGATACAAGA CAGGCAAGAACAAGTGGTTCTTCCAGAAACTGCG | 1 | L* |

| SEQ ID | identifier_position | position | modified_RNA | PAP length | PAP |
|---|---|---|---|---|---|
| | | | GTTTTAGATGCTTTGTTTTGATCATTAAAAATTATAAAGAAAAAAAAAAAAAAAAAAAAAAAAAAA | | |
| 303 | NM_000990.3_150 | 150 | GGCCGATACCTCGCGAGACTTGGCGAAGGCCTTCCTTTTTCGTCTGGGCTGCCAACATGCCATCCAGACTGAGGAAGACCCGGAAACTTAGGGGCCACGTGAGCCACGGCCACGGCCGCATAGGCAAGCACCGGAAGCACCCCGGCGGCGCGGTAATGCTGGTGGTCTGCATCACCACCGGATCAACTTCGACAAATACCACCCAGGCTACTTTGGGAAAGTTGGTATGAAGCATTACCACTTAAAGAGGAACCAGAGCTTCTGCCCAACTGTCAACCTTGACAAATTGTGGACTTTGGTCAGTGAACAGACACGGGTGAATGCTGCTAAAAACAAGACTGGGGCTGCTCCCATCATTGATGTGGTGCGATCGGGCTACTACAAAGTTCTGGGAAAGGGAAAGCTCCCAAAGCAGCCTGTCATCGTGAAGGCCAAATTCTTCAGCAGAAGAGCTGAGGAGAAGATTAAGAGTGTTGGGGGGGCCTGTGTCCTGGTGGCTTGAAGCCACATGGAGGGAGTTTCATTAAATGCTAACTACTTTTTCAAAAAAAAAAAAAAAAAAAA | 26 | AVMLVVCITTGSTSTNTTQATLGKLV* |
| 304 | NM_000991.3_441 | 441 | CTCTTTCCGTCTCAGGTCGCCGCTGCGAAGGGAGCCGCCGCCATGTCTGCGCATCTGCAATGGATGGTCGTGCGGAACTGCTCCAGTTTCCTGATCAAGAGGAATAAGCAGACCTACAGCACTGAGCCCAATAACTTGAAGGCCCGCAATTCCTTCCGCTACAACGGACTGATTCACCGCAAGACTGTGGGCGTGGAGCCGGCAGCCGACGGCAAAGGTGTCGTGGTGGTCATTAAGCGGAGATCCGGCCAGCGGAAGCCTGCCACCTCCTATGTGCGGACCACCATCAACAAGAATGCTCGCGCCACGCTCAGCAGCATCAGACACATGATCCGCAAGAACAAGTACCGCCCCGACCTGCGCATGGCAGCCATCCGCAGGGCCAGCGCCATCCTGCGCAGCCAGAAGCCTGTGATGGTGAAGAGGAAGCGGACCCGCCCACCAAGAGCTCCTGAGCCCCCTGCCCCAGAGCAATAAAGTCAGCTGGCTTTCTCACCTGCCTCGACTGGGCCTCCCTTTTTGAAACGCTCTGGGGAGCTCTGGCCCTGTGTGTTGTCATTCAGGCCATGTCATCAAAACTCTGCATGTCACCTTGTCCATCTGGAGGTGATGTCAATGGCTGGCCATGCAGGAGGGGTGGGGTAGCTGCCTTGTCCCTGGTGAGGGCAAGGGTCACTGTCTTCACAGAAAAAGTTTGCTGACTTGTGATTGAGACCTACTGTCCCATTGTGAGGTGGCCTGAAGAATCCCAGCTGGGGCAGTGGCTTCCATTCAGAAGAAGAAAGGCCTTTTCTAGCCCAGAAGGGTGCAGGCTGAGGGCTGGGCCCTGGGCCCTGGTGCTGTAGCACGGTTTGGGGACTTGGGGTGTTCCCAAGACCTGGGGGACGACAGACATCACGGGAGGAAGATGAGATGACTTTTGCATCCAGGGAGTGGGTGCAGCCACATTTGGAGGGGATGGGCTTTACTTGATGCAACCTCATCTCTGAGATGGGCAACTTGGTGGGTGGTGGCTTATAACTG | 86 | PRAPEPPAPRAIKSAGFLTCLDWASLFETLWGALALCVVIQAMSSKLCMSPCPSGGDVNGWPCRRGGVAALSLVRARVTVFTEKVC* |
| 305 | NM_000994.3_268 | 268 | AGGGGTTACGACCCATCAGCCCTTGCGCGCCACCGTCCCTTCTCTCTTCCTCGGCGTGCCTACGGAGGTGGCAGCCATCTCCTTCTCGGCATCATGGCCGCCCTCAGACCCCTTGTGAAGCCCAAGATCGTCAAAAAGAGAACCAAGAAGTTCATCCGGCACCAGTCAGACCGATATGTCAAAATTAAGCGTAACTGGCGGAAACCCAGAGGCATTGACAACAGGGTTCGTAGAAGATTCAAGGGCCAGATCTTGATGCCCAACATGGTTATGGAAGCAACAAAAAAACAAAGCACATGCTGCCCAGTGGCTTCCGGAAGTTCCTGGTCCACAACGTCAAGGAGCTGGAAGTGCTGCTGATGTGCAACAAATCTTACTGTGCCGAGATCGCTCACAATGTTTCCTCCAAGAACCGCAAAGCCATCGTGGAAAGAGCTGCCCAACTGGCCATCAGAGTCACCAACCCCAATGCCAGGCTGCGCAGTGAAGAAAATGAGTAGGCAGCTCATGTGCACGTTTTCTGTTTAAATAAATGTAAAAACTGCCATCTGGCATCTTCCTTCCTTGATTTTAAGTCTTCAGCTTCTTGGCCAACTTAGTTTGCCACAGAGATTGTTCTTTTGCTTAAGCCCCTTTGGAATCTCCCATTTGGAGGGGATTTGTAAAGGACACTCAGTCCTTGAACAGGGGAATGTGGCCTCAAGTGCACAGACTAGCCTTAGTCATCTCCAGTTGAGGCTGGGTATGAGGGGTACAGACTTGGCCCTCACACCAGGTAGGTTCTGAGACACTTGAAGAAGCTTGTGGCTCCCAAGCCACAAGTAGTCATTCTTAGCCTTGCTTTTGTAAAGTTAGGTGACAAGTTATTCCATGTGATGCTTGTGAGAATTGAGAAAATATGCATGGAAATATCCAGATGAATTTCTTACACAGATTCTTACGGGATGCCTAAATTGCATCCTGTAACTTCTGTCCA | 31 | MVMEATKKQSTCCPVASGSSWSTTSRSWKCC* |

TABLE 3A-continued

| SEQ ID | identifier_position | position | modified_RNA | PAP length | PAP |
|---|---|---|---|---|---|
| 306 | NM_000996.2_106 | 106 | AAAAGAACAGGATGATGTACAAATTGCTCTTCCAGGTAATCCACCAC GGCCTCGTCCTTCTCTTACCGCCATCTTGGCTCCTGTGGAGGCCTGCTGGGAACGGGACTTCTAAAAGGAACTATGTCTGGAAGGCTGTGGTCCAAGGCCATTTTGCTGGCTATAAGCGGGGTCTCCGGAACCAAAGGGAGCACACAGCTCTTCTTAAAAATTGAAGGTGTTTACGCCCGAGATGAAACAGAATTCTATTTGGGCAAGAGATGCGCTTATGTATATAAAGCAAAGAACAACACAGTCACTCCTGGCGGCAAACCAAACAAAACCAGAGTCATCTGGGGAAAAGTAACTCGGGCCCATGGAAACAGTGGCATGGTTCGTGCCAAATTCCGAAGCAATCTTCCTGCTAAGGCCATTGGACACAGAATCCGAGTGATGCTGTACCCCTCAAGGATTTAAACTAACGAAAAATCAATAAATAAATGTGGATTTGTGCTCTTGTATTTTTAAGTGGATTAAAAAACTTACTACCTTAAAAAAAAAAAAAAAAAAAAAAAAAAAAAAAA | 63 | LLAISGVSGTKGSTQLFLKLKVFTPEMKQNSIWARDALMYIKQRTTQSLLAANQTKPESSGEK* |
| 307 | NM_000998.4_136 | 136 | ACTTCCGCTCGTCCGCCTAATACCGCGCCTGCGCACCGCGTCTCTTCCTTTCTGGGCTCGGACCTAGGTCGCGGCGACATGGCCAAACGTACCAAGAAAGTCGGGATCGTCGGTAAATACGGGACCCGCTATGGGCCTCCCTCCGGAAAATGGTGAAGAAAATTGAAATCAGCCAGCACGCCAAGTACACTTGCTCTTTCTGTGGCAAAACCAAGATGAAGAGACGAGCTGTGGGGATCTGGCACTGTGGTTCCTGCATGAAGACAGTGGCTGGCGGTGCCTGGACGTACAATACCACTTCCGCTGTCACGGTAAAGTCCGCCATCAGAAGACTGAAGGAGTTGAAAGACCAGTAGACGCTCCTCTACTCTTTGAGACATCACTGGCCTATAATAAATGGGTTAATTTATGTAACAAAAAAAAAAAAAAAAAAA | 6 | PPSGKW* |
| 308 | NM_001001522.1_1071 | 1071 | TCACCACGGCGGCAGCCCTTTAAACCCCTCACCCAGCCAGCGCCCCATCCTGTCTGTCCGAACCCAGACACAAGTCTTCACTCCTTCCTGCGAGCCCTGAGGAAGCCTTGTGAGTGCATTGGCTGGGGCTTGGAGGGAAGTTGGGCTGGAGCTGGACAGGAGCAGTGGGTGCATTTCAGGCAGGCTCTCCTGAGGTCCCAGGCGCCAGCTCCAGCTCCCTGGCTAGGGAAACCCACCCTCTCAGTCAGCATGGGGGCCCAAGCTCCAGGCAGGGTGGGCTGGATCACTAGCGTCCTGGATCTCTCTCAGACTGGGCAGCCCCGGGCTCATTGAAATGCCCCGGATGACTTGGCTAGTGCAGAGGAATTGATGGAAACCACCGGGGTGAGAGGGAGGCTCCCCATCTCAGCCAGCCACATCCACAAGGTGTGTAAGGGTGCAGGCGCCGGCCGGTTAGGCCAAGGCTCTACTGTCTGTTGCCCCTCCAGGAGAACTTCCAAGGAGCTTTCCCCAGACATGGCCAACAAGGGTCCTTCCTATGGCATGAGCCGCGAAGTGCAGTCCAAAATCGAGAAGAAGTATGACGAGGAGCTGGAGGAGCGGCTGGTGGAGTGGATCATAGTGCAGTGTGGCCCTGATGTGGGCCGCCCAGACCGTGGGCGCTTGGGCTTCCAGGTCTGGCTGAAGAATGGCGTGATTCTGAGCAAGCTGGTGAACAGCCTGTACCCTGATGGCTCCAAGCCGGTGAAGGTGCCCGAGAACCCACCCTCCATGGTCTTCAAGCAGATGGAGCAGGTGGCTCAGTTCCTGAAGGCGGCTGAGGACTATGGGGTCATCAAGACTGACATGTTCCAGACTGTTGACCTCTTTGAAGGCAAAGACATGGCAGCAGTGCAGAGGACCCTGATGGCTTTGGGCAGCTTGGCAGTGACCAAGAATGATGGGCACTACCGTGGAGATCCCAACTGGTTTATGAAGAAAGCGCAGGAGCATAAGAGGGAATTCACAGAGAGCCAGCTGCA | 5 | PPRPA* |
| 309 | NM_001001660.2_266 | 266 | GGCCGGCGCCCCGCCCCCTTTACTGACAGGTTGCCCACCTCCCCCAACGCCACCCCGCTTCGCAGTAGACGGACAGAGGAGTCGTAGCGGTCGAGGCTTTTGCGGCTCCGGCGTGCCGGAAAGTATGTTATGCATAAAAGTGGATAATTTACATGATAAATGAAAATGGCCAATTCTTTAAGAGGAGAAGTACTAAAACTTTATAAAAATCTGCTGTATCTTGGACGAGACTATCCAAAAGGAGCAGACTATTTTAAAAAGCGTTGAAGAACATTTTCCTTAAAAAACAAAGATGTGAAGAATCCAGAGAAGATCAAAGAACTTATTGCACAGGGCGAATTTGTAATGAAAGAGCTAGAAGCTTTGTACTTCCTTAGGAAATACAGAGCTATGAAACAACGCTATTATTCAGATACCAACAAAACTAATTGATCATTACTACTTTAATTTAGCTATCAGTGCCAGCTGTTTATGTATACCAGATGTTGTAAAATAATTCTAACTTAAAATGGGAAGATATACATGTTGTGTAAAAAAATCCCTGAGCTGCCCTACTGAACTAAATAGGTTTCAACTTCTGTTCATACGGAGAAAGTATCA | 0 | * |

TABLE 3A-continued

| SEQ ID | identifier_position | position | modified_RNA | PAP length | PAP |
|---|---|---|---|---|---|
| | | | GCAACTTTATGCTCAATTTTGATACAAACATAGCAA TTTAGCTATACTACCGATCATAAATTAATGAGCACC CAATTTTGAATGAAAATATAATACACTTAATCCTCT AACTTAATAGGACTTAGCCAATTATTTTTAGCTTATT TCTCCATTTTACTGACAAGAGAATGCCATTTACCGA ACATTTAATAAGCAAAATAATTTCTTACACACTTACT TCTCTTAACTTTTGAAAGGAATCCCTTATTTTTTCAC CCAATTTGGTATATTAACAGCACATACTCAAGGTTC ACTACAAAACAAACAGTTCCTGGTAATGATTTAAAT GTAGTTATAGAAATAAATAATATGTATGGAGTCATT ACTTCTGACCTTGAAATAGCCTGCTGGTGACTGGC ATTAACATACATAACTAACTATTCAATT | | |
| 310 | NM_0010 01660.2_ 327 | 327 | GGCCGGCGCCCCGCCCCCTTTACTGACAGGTTGC CCACCTCCCCCAACGCCACCCCGCTTCGCAGTAG ACGGACAGAGGAGTCGTAGCGGTCGAGGCTTTTG CGGCTCCGGCGTGCCGGAAAGTATGTTATGCATA AAAGTGGATAATTTACATGATAAATGAAAATGGCCA ATTCTTTAAGAGGAGAAGTACTAAAACTTTATAAAA ATCTGCTGTATCTTGGACGAGACTATCCAAAAGGA GCAGACTATTTTAAAAAGCGTTTGAAGAACATTTTC CTTAAAAACAAAGATGTGAAGAATCCAGAGAAGAT CAAAGAACTTATGCACAGGGCGAATTTGTAATGAA AGAGCTAGAAGCTTTGTACTTCCTTAGGAAATACA GAGCTATGAAACAACGCTATTATTCAGATACCAAC AAAACTAATTGATCATTACTACTTTAATTTAGCTATC AGTGCCAGCTGTTTATGTATACCAGATGTTGTAAA ATAATTCTAACTTAAAATGGGAAGATATACATGTTG TGTAAAAAATCCCTGAGCTGCCCTACTGAACTAAA TAGGTTTCAACTTCTGTTCATACGGAGAAAGTATCA GCAACTTTATGCTCAATTTTGATACAAACATAGCAA TTTAGCTATACTACCGATCATAAATTAATGAGCACC CAATTTTGAATGAAAATATAATACACTTAATCCTCT AACTTAATAGGACTTAGCCAATTATTTTTAGCTTATT TCTCCATTTTACTGACAAGAGAATGCCATTTACCGA ACATTTAATAAGCAAAATAATTTCTTACACACTTACT TCTCTTAACTTTTGAAAGGAATCCCTTATTTTTTCAC CCAATTTGGTATATTAACAGCACATACTCAAGGTTC ACTACAAAACAAACAGTTCCTGGTAATGATTTAAAT GTAGTTATAGAAATAAATAATATGTATGGAGTCATT ACTTCTGACCTTGAAATAGCCTGCTGGTGACTGGC ATTAACATACATAACTAACTATTCAATT | 6 | MHRANL* |
| 311 | NM_0010 01660.2_ 342 | 342 | GGCCGGCGCCCCGCCCCCTTTACTGACAGGTTGC CCACCTCCCCCAACGCCACCCCGCTTCGCAGTAG ACGGACAGAGGAGTCGTAGCGGTCGAGGCTTTTG CGGCTCCGGCGTGCCGGAAAGTATGTTATGCATA AAAGTGGATAATTTACATGATAAATGAAAATGGCCA ATTCTTTAAGAGGAGAAGTACTAAAACTTTATAAAA ATCTGCTGTATCTTGGACGAGACTATCCAAAAGGA GCAGACTATTTTAAAAAGCGTTTGAAGAACATTTTC CTTAAAAACAAAGATGTGAAGAATCCAGAGAAGAT CAAAGAACTTATGCACAGGGCGAATTTGTAATGAA AGAGCTAGAAGCTTTGTACTTCCTTAGGAAATACA GAGCTATGAAACAACGCTATTATTCAGATACCAAC AAAACTAATTGATCATTACTACTTTAATTTAGCTATC AGTGCCAGCTGTTTATGTATACCAGATGTTGTAAA ATAATTCTAACTTAAAATGGGAAGATATACATGTTG TGTAAAAAATCCCTGAGCTGCCCTACTGAACTAAA TAGGTTTCAACTTCTGTTCATACGGAGAAAGTATCA GCAACTTTATGCTCAATTTTGATACAAACATAGCAA TTTAGCTATACTACCGATCATAAATTAATGAGCACC CAATTTTGAATGAAAATATAATACACTTAATCCTCT AACTTAATAGGACTTAGCCAATTATTTTTAGCTTATT TCTCCATTTTACTGACAAGAGAATGCCATTTACCGA ACATTTAATAAGCAAAATAATTTCTTACACACTTACT TCTCTTAACTTTTGAAAGGAATCCCTTATTTTTTCAC CCAATTTGGTATATTAACAGCACATACTCAAGGTTC ACTACAAAACAAACAGTTCCTGGTAATGATTTAAAT GTAGTTATAGAAATAAATAATATGTATGGAGTCATT ACTTCTGACCTTGAAATAGCCTGCTGGTGACTGGC ATTAACATACATAACTAACTATTCAATT | 1 | L* |
| 312 | NM_0010 01660.2_ 365 | 365 | GGCCGGCGCCCCGCCCCCTTTACTGACAGGTTGC CCACCTCCCCCAACGCCACCCCGCTTCGCAGTAG ACGGACAGAGGAGTCGTAGCGGTCGAGGCTTTTG CGGCTCCGGCGTGCCGGAAAGTATGTTATGCATA AAAGTGGATAATTTACATGATAAATGAAAATGGCCA ATTCTTTAAGAGGAGAAGTACTAAAACTTTATAAAA ATCTGCTGTATCTTGGACGAGACTATCCAAAAGGA | 9 | CTSLGNTE L* |

TABLE 3A-continued

| SEQ ID | identifier_ position | position | modified_RNA | PAP length | PAP |
|---|---|---|---|---|---|
| | | | GCAGACTATTTTAAAAAGCGTTTGAAGAACATTTTC CTTAAAAACAAAGATGTGAAGAATCCAGAGAAGAT CAAAGAACTTATTGCACAGGGCGAATTTGTAATGA AAGAGCTAGAAGCTTGTACTTCCTTAGGAAATACA GAGCTATGAAACAACGCTATTATTCAGATACCAAC AAAACTAATTGATCATTACTACTTTAATTTAGCTATC AGTGCCAGCTGTTTATGTATACCAGATGTTGTAAA ATAATTCTAACTTAAAATGGGAAGATATACATGTTG TGTAAAAAAATCCCTGAGCTGCCCTACTGAACTAAA TAGGTTTCAACTTCTGTTCATACGGAGAAAGTATCA GCAACTTTATGCTCAATTTTGATACAAACATAGCAA TTTAGCTATACTACCGATCATAAATTAATGAGCACC CAATTTTGAATGAAAATATAATACACTTAATCCTCT AACTTAATAGGACTTAGCCAATTATTTTTAGCTTATT TCTCCATTTTACTGACAAGAGAATGCCATTTACCGA ACATTTAATAAGCAAAATAATTTCTTACACACTTACT TCTCTTAACTTTTGAAAGGAATCCCTTATTTTTTCAC CCAATTTGGTATATTAACAGCACATACTCAAGGTTC ACTACAAAACAAACAGTTCCTGGTAATGATTTAAAT GTAGTTATAGAAATAAATAATATGTATGGAGTCATT ACTTCTGACCTTGAAATAGCCTGCTGGTGACTGGC ATTAACATACATAACTAACTATTCAATT | | |
| 313 | NM_0010 01937.1_ 1222 | 1222 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGC | 5 | LVVAP* |
| 314 | NM_0010 01937.1_ 1341 | 1341 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT | 27 | CSTKVSAL QLTLVCLY LVSDPLPK PGL* |

TABLE 3A-continued

| SEQ ID | identifier_ position | position | modified_RNA | PAP length | PAP |
|---|---|---|---|---|---|
| | | | CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGC | | |
| 315 | NM_0010 01937.1_ 1418 | 1418 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGC | 1 | L* |
| 316 | NM_0010 01937.1_ 1463 | 1463 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGC | 21 | IVRLLLLPS SVLTSMLP LNNF* |
| 317 | NM_0010 01937.1_ 1567 | 1567 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA | 17 | SILPWLLK NKWLLSM RV* |

TABLE 3A-continued

| SEQ ID | identifier_position | position | modified_RNA | PAP length | PAP |
|---|---|---|---|---|---|
| | | | AAGGGTATGTCCTTGAACTTGGAACCTGACAATGT<br>TGGTGTTGTCGTGTTTGGAAATGATAAACTAATTAA<br>GGAAGGAGATATAGTGAAGAGGACAGGAGCCATT<br>GTGGACGTTCCAGTTGGTGAGGAGCTGTTGGGTC<br>GTGTAGTTGATGCCCTTGGTAATGCTATTGATGGA<br>AAGGGTCCAATTGGTTCCAAGACGCGTAGGCGAG<br>TTGGTCTGAAAGCCCCCGGTATCATTCCTCGAATT<br>TCAGTGCGGGAACCAATGCAGACTGGCATTAAGG<br>CTGTGGATAGCTTGGTGCCAATTGGTCGTGGTCAG<br>CGTGAACTGATTATTGGTGACCGACAGACTGGGAA<br>AACCTCAATTGCTATTGACACAATCATTAACCAGAA<br>ACGTTTCAATGATGGATCTGATGAAAAGAAGAAGC<br>TGTACTGTATTTATGTTGCTATTGGTCAAAAGAGAT<br>CCACTGTTGCCCAGTTGGTGAAGAGACTTACAGAT<br>GCAGATGCCATGAAGTACACCATTGTGGTGTCGG<br>CTACGGCCTCGGATGCTGCCCCACTTCAGTACCT<br>GGCTCCTTACTCTGGC | | |
| 318 | NM_0010 01937.1_ 163 | 163 | TCTGGCATTGCAAGCCTCGCTTCGTTGCCACTTCC<br>CAGCTCTTCCCGCCTTCCGCGGTATAATCAACACT<br>ACGAGAGATAGAGCCGCCTAGAACCAGTCCGGAG<br>GCTGCGGCTGCAGAAGTACCGCCTGCGGAGTAAC<br>TGCAAAGATGCTGTCCGTGCGCGTTGCTGCGGCCG<br>TGGTCCGCGCCCTTCCTCGGCGGGCCGGACTGGT<br>CTCCAGAAATGCTTTGGGTTCATCTTTCATTGCTGC<br>AAGGAACTTCCATGCCTCTAACACTCATCTTCAAAA<br>GACTGGGACTGCTGAGATGTCCTCTATTCTTGAAG<br>AGCGTATTCTTGGAGCTGATACCTCTGTTGATCTT<br>GAAGAAACTGGGCGTGTCTTAAGTATTGGTGATGG<br>TATTGCCCGCGTACATGGGCTGAGGAATGTTCAAG<br>CAGAAGAAATGGTAGAGTTTTCTTCAGGCTTAAAG<br>GGTATGTCCTTGAACTTGGAACCTGACAATGTTGG<br>TGTTGTCGTGTTTGGAAATGATAAACTAATTAAGGA<br>AGGAGATATAGTGAAGAGGACAGGAGCCATTGTG<br>GACGTTCCAGTTGGTGAGGAGCTGTTGGGTCGTG<br>TAGTTGATGCCCTTGGTAATGCTATTGATGGAAAG<br>GGTCCAATTGGTTCCAAGACGCGTAGGCGAGTTG<br>GTCTGAAAGCCCCCGGTATCATTCCTCGAATTTCA<br>GTGCGGGAACCAATGCAGACTGGCATTAAGGCTG<br>TGGATAGCTTGGTGCCAATTGGTCGTGGTCAGCGT<br>GAACTGATTATTGGTGACCGACAGACTGGGAAAAC<br>CTCAATTGCTATTGACACAATCATTAACCAGAAACG<br>TTTCAATGATGGATCTGATGAAAAGAAGAAGCTGT<br>ACTGTATTTATGTTGCTATTGGTCAAAAGAGATCCA<br>CTGTTGCCCAGTTGGTGAAGAGACTTACAGATGCA<br>GATGCCATGAAGTACACCATTGTGGTGTCGGCTAC<br>GGCCTCGGATGCTGCCCCACTTCAGTACCTGGCT<br>CCTTACTCTGGCT | 68 | LRPWSAPF<br>LGGPDWS<br>PEMLWVH<br>LSLLQGTS<br>MPLTLIFKR<br>LGLLRCPL<br>FLKSVFLEL<br>IPLLILKKLG<br>VS* |
| 319 | NM_0010 01937.1_ 172 | 172 | TCTGGCATTGCAAGCCTCGCTTCGTTGCCACTTCC<br>CAGCTCTTCCCGCCTTCCGCGGTATAATCAACACT<br>ACGAGAGATAGAGCCGCCTAGAACCAGTCCGGAG<br>GCTGCGGCTGCAGAAGTACCGCCTGCGGAGTAAC<br>TGCAAAGATGCTGTCCGTGCGCGTTGCTGCGGCG<br>TGGTCCGCGCCCTTCCTCGGCGGGCCGGACTGGT<br>CTCCAGAAATGCTTTGGGTTCATCTTTCATTGCTGC<br>AAGGAACTTCCATGCCTCTAACACTCATCTTCAAAA<br>GACTGGGACTGCTGAGATGTCCTCTATTCTTGAAG<br>AGCGTATTCTTGGAGCTGATACCTCTGTTGATCTT<br>GAAGAAACTGGGCGTGTCTTAAGTATTGGTGATGG<br>TATTGCCCGCGTACATGGGCTGAGGAATGTTCAAG<br>CAGAAGAAATGGTAGAGTTTTCTTCAGGCTTAAAG<br>GGTATGTCCTTGAACTTGGAACCTGACAATGTTGG<br>TGTTGTCGTGTTTGGAAATGATAAACTAATTAAGGA<br>AGGAGATATAGTGAAGAGGACAGGAGCCATTGTG<br>GACGTTCCAGTTGGTGAGGAGCTGTTGGGTCGTG<br>TAGTTGATGCCCTTGGTAATGCTATTGATGGAAAG<br>GGTCCAATTGGTTCCAAGACGCGTAGGCGAGTTG<br>GTCTGAAAGCCCCCGGTATCATTCCTCGAATTTCA<br>GTGCGGGAACCAATGCAGACTGGCATTAAGGCTG<br>TGGATAGCTTGGTGCCAATTGGTCGTGGTCAGCGT<br>GAACTGATTATTGGTGACCGACAGACTGGGAAAAC<br>CTCAATTGCTATTGACACAATCATTAACCAGAAACG<br>TTTCAATGATGGATCTGATGAAAAGAAGAAGCTGT<br>ACTGTATTTATGTTGCTATTGGTCAAAAGAGATCCA<br>CTGTTGCCCAGTTGGTGAAGAGACTTACAGATGCA<br>GATGCCATGAAGTACACCATTGTGGTGTCGGCTAC<br>GGCCTCGGATGCTGCCCCACTTCAGTACCTGGCT<br>CCTTACTCTGGCT | 65 | WSAPFLG<br>GPDWSPE<br>MLWVHLSL<br>LQGTSMPL<br>TLIFKRLGL<br>LRCPLFLK<br>SVFLELIPL<br>LILKKLGVS* |

TABLE 3A-continued

| SEQ ID | identifier_position | position | modified_RNA | PAP length | PAP |
|---|---|---|---|---|---|
| 320 | NM_0010 01937.1_ 222 | 222 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | 49 | WVHLSLLQ GTSMPLTLI FKRLGLLR CPLFLKSV FLELIPLLIL KKLGVS* |
| 321 | NM_0010 01937.1_ 238 | 238 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | 44 | MLQGTSM PLTLIFKRL GLLRCPLF LKSVFLELI PLLILKKLG VS* |
| 322 | NM_0010 01937.1_ 376 | 376 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATGGTGAT GGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC | 10 | MVMVLPAY MG* |

TABLE 3A-continued

| SEQ ID | identifier_position | position | modified_RNA | PAP length | PAP |
|---|---|---|---|---|---|
| | | | GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | | |
| 323 | NM_0010 01937.1_ 440 | 440 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTCTTCAGGCTTAA AGGGTATGTCCTTGAACTTGGAACCTGACAATGTT GGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | 3 | LQA* |
| 324 | NM_0010 01937.1_ 502 | 502 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | 5 | LEMIN* |
| 325 | NM_0010 01937.1_ 585 | 585 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC | 3 | WVV* |

TABLE 3A-continued

| SEQ ID | identifier_ position | position | modified_RNA | PAP length | PAP |
|---|---|---|---|---|---|
| | | | TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTGGGTCG TGTAGTTGATGCCCTTGGTAATGCTATTGATGGAA AGGGTCCAATTGGTTCCAAGACGCGTAGGCGAGT TGGTCTGAAAGCCCCCGGTATCATTCCTCGAATTT CAGTGCGGGAACCAATGCAGACTGGCATTAAGGC TGTGGATAGCTTGGTGCCAATTGGTCGTGGTCAGC GTGAACTGATTATTGGTGACCGACAGACTGGGAAA ACCTCAATTGCTATTGACACAATCATTAACCAGAAA CGTTTCAATGATGGATCTGATGAAAAGAAGAAGCT GTACTGTATTTATGTTGCTATTGGTCAAAAGAGATC CACTGTTGCCCAGTTGGTGAAGAGACTTACAGATG CAGATGCCATGAAGTACACCATTGTGGTGTCGGCT ACGGCCTCGGATGCTGCCCCACTTCAGTACCTGG CTCCTTACTCTGGCT | | |
| 326 | NM_0010 01937.1_ 637 | 637 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTGGGTC GTGTAGTTGATGCCCTTGGTAATGCTATTGATGGA AAGGGTCCAATTGGTTCCAAGACGCGTAGGCGAGT TGGTCTGAAAGCCCCCGGTATCATTCCTCGAATTT CAGTGCGGGAACCAATGCAGACTGGCATTAAGGC TGTGGATAGCTTGGTGCCAATTGGTCGTGGTCAGC GTGAACTGATTATTGGTGACCGACAGACTGGGAAA ACCTCAATTGCTATTGACACAATCATTAACCAGAAA CGTTTCAATGATGGATCTGATGAAAAGAAGAAGCT GTACTGTATTTATGTTGCTATTGGTCAAAAGAGATC CACTGTTGCCCAGTTGGTGAAGAGACTTACAGATG CAGATGCCATGAAGTACACCATTGTGGTGTCGGCT ACGGCCTCGGATGCTGCCCCACTTCAGTACCTGG CTCCTTACTCTGGCT | 10 | MVPRRVG ELV* |
| 327 | NM_0010 01937.1_ 661 | 661 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TGGTCTGAAAGCCCCCGGTATCATTCCTCGAATTT CAGTGCGGGAACCAATGCAGACTGGCATTAAGGC | 1 | V* |

TABLE 3A-continued

| SEQ ID | identifier_position | position | modified_RNA | PAP length | PAP |
|---|---|---|---|---|---|
| | | | TGTGGATAGCTTGGTGCCAATTGGTCGTGGTCAGC GTGAACTGATTATTGGTGACCGACAGACTGGGAAA ACCTCAATTGCTATTGACACAATCATTAACCAGAAA CGTTTCAATGATGGATCTGATGAAAAGAAGAAGCT GTACTGTATTTATGTTGCTATTGGTCAAAAGAGATC CACTGTTGCCCAGTTGGTGAAGAGACTTACAGATG CAGATGCCATGAAGTACACCATTGTGGTGTCGGCT ACGGCCTCGGATGCTGCCCCACTTCAGTACCTGG CTCCTTACTCTGGCT | | |
| 328 | NM_0010 01937.1_ 676 | 676 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATTT CAGTGCGGGAACCAATGCAGACTGGCATTAAGGC TGTGGATAGCTTGGTGCCAATTGGTCGTGGTCAGC GTGAACTGATTATTGGTGACCGACAGACTGGGAAA ACCTCAATTGCTATTGACACAATCATTAACCAGAAA CGTTTCAATGATGGATCTGATGAAAAGAAGAAGCT GTACTGTATTTATGTTGCTATTGGTCAAAAGAGATC CACTGTTGCCCAGTTGGTGAAGAGACTTACAGATG CAGATGCCATGAAGTACACCATTGTGGTGTCGGCT ACGGCCTCGGATGCTGCCCCACTTCAGTACCTGG CTCCTTACTCTGGCT | 31 | VSFLEFQC GNQCRLAL RLWIAWC QLVVVSVN* |
| 329 | NM_0010 01937.1_ 751 | 751 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | 7 | MVVVSVN* |
| 330 | NM_0010 01937.1_ 778 | 778 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA | 49 | MVTDRLGK PQLLLTQS LTRNVSM MDLMKRR SCTVFMLL LVKRDPLL PSW* |

TABLE 3A-continued

| SEQ ID | identifier_position | position | modified_RNA | PAP length | PAP |
|---|---|---|---|---|---|
| | | | AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATTGGTCAAAAGAGAT CCACTGTTGCCCAGTTGGTGAAGAGACTTACAGAT GCAGATGCCATGAAGTACACCATTGTGGTGTCGG CTACGGCCTCGGATGCTGCCCCACTTCAGTACCT GGCTCCTTACTCTGGCT | | |
| 331 | NM_001001937.1_892 | 892 | TCTGGCATTGCAAGCCTCGCTTCGTTGCCACTTCC CAGCTCTTCCCGCCTTCCGCGGTATAATCAACACT ACGAGAGATAGAGCCGCCTAGAACCAGTCCGGAG GCTGCGGCTGCAGAAGTACCGCCTGCGGAGTAAC TGCAAAGATGCTGTCCGTGCGCGTTGCTGCGGCC GTGGTCCGCGCCCTTCCTCGGCGGGCCGGACTG GTCTCCAGAAATGCTTTGGGTTCATCTTTCATTGCT GCAAGGAACTTCCATGCCTCTAACACTCATCTTCA AAAGACTGGGACTGCTGAGATGTCCTCTATTCTTG AAGAGCGTATTCTTGGAGCTGATACCTCTGTTGAT CTTGAAGAAACTGGGCGTGTCTTAAGTATTGGTGA TGGTATTGCCCGCGTACATGGGCTGAGGAATGTTC AAGCAGAAGAAATGGTAGAGTTTTCTTCAGGCTTA AAGGGTATGTCCTTGAACTTGGAACCTGACAATGT TGGTGTTGTCGTGTTTGGAAATGATAAACTAATTAA GGAAGGAGATATAGTGAAGAGGACAGGAGCCATT GTGGACGTTCCAGTTGGTGAGGAGCTGTTGGGTC GTGTAGTTGATGCCCTTGGTAATGCTATTGATGGA AAGGGTCCAATTGGTTCCAAGACGCGTAGGCGAG TTGGTCTGAAAGCCCCCGGTATCATTCCTCGAATT TCAGTGCGGGAACCAATGCAGACTGGCATTAAGG CTGTGGATAGCTTGGTGCCAATTGGTCGTGGTCAG CGTGAACTGATTATTGGTGACCGACAGACTGGGAA AACCTCAATTGCTATTGACACAATCATTAACCAGAA ACGTTTCAATGATGGATCTGATGAAAAGAAGAAGC TGTACTGTATTTATGTTGCTATGGTCAAAAGAGATC CACTGTTGCCCAGTTGGTGAAGAGACTTACAGATG CAGATGCCATGAAGTACACCATTGTGGTGTCGGCT ACGGCCTCGGATGCTGCCCCACTTCAGTACCTGG CTCCTTACTCTGGCT | 11 | MVKRDPLL PSW* |
| 332 | NM_001001973.1_290 | 290 | GGGAGGGGCGCGCTGGGGAGCTTCGGCGCATGC GCGCTGAGGCCTGCCTGACCGACCTTCAGCAGGG CTGTGGCTACCATGTTCTCTCGCGCGGGTGTCGC TGGGCTGTCGGCCTGGACCTTGCAGCCGCAATGG ATTCAAGTTCGAAATATGGCAACTTTGAAAGATATC ACCAGGAGACTAAAGTCCATCAAAAACATCCAGAA AATTACCAAGTCTATGAAAATGGTAGCGGCAGCAA AATATGCCCGAGCTGAGAGAGAGCTGAAACCAGC TCGAATATATGGATGGGATCTTTAGCTCTGTATGAA AAAGCTGATATCAAGGGGCCTGAAGACAAGAAGA AACACCTCCTTATTGGTGTGTCCTCAGATCGAGGA CTGTGTGGTGCTATTCATTCCTCCATTGCTAAACA GATGAAAAGCGAGGTTGCTACACTAACAGCAGCT GGGAAAGAAGTTATGCTTGTTGGAATTGGTGACAA AATCAGAGGCATACTTTATAGGACTCATTCTGACC AGTTTCTGGTGGCATTCAAAGAAGTGGGAAGAAAG CCCCCCACTTTTGGAGATGCGTCAGTCATTGCCCT TGAATTACTAAATTCTGGATATGAATTTGATGAAGG CTCCATCATCTTTAATAAATTCAGGTCTGTCATCTC CTATAAGACAGAAGAAAAAGCCCATCTTTTCCCTTAA TACCGTTGCAAGTGCTGACAGCATGAGTATCTATG ACGATATTGATGCTGACGTGCTGCAAAATTACCAA GAATACAATCTGGCCAACATCATCTACTACTCTCT GAAGGAGTCCACCACTAGTGAGCAGAGTGCCAGG ATGACAGCCATGGACAATGCCAGCAAGAATGCTTC | 3 | WDL* |

TABLE 3A-continued

| SEQ ID | identifier_position | position | modified_RNA | PAP length | PAP |
|---|---|---|---|---|---|
| | | | TGAGATGATTGACAAATTGACATTGACATTCAACC GTACCCGCCAAGCTGTCATCACAAAAGAGTTGATT GAAATTATCTCTGGTGCTGCAGCTCTGGATTAATG AAAATCAAGTTCCATCCTCAGACAAGAGGTAAAGA AGGAAAATTCAGC | | |
| 333 | NM_0010 01973.1_ 471 | 471 | GGGAGGGGCGCGCTGGGGAGCTTCGGCGCATGC GCGCTGAGGCCTGCCTGACCGACCTTCAGCAGGG CTGTGGCTACCATGTTCTCTCGCGCGGGTGTCGC TGGGCTGTCGGCCTGGACCTTGCAGCCGCAATGG ATTCAAGTTCGAAATATGGCAACTTTGAAAGATATC ACCAGGAGACTAAAGTCCATCAAAAACATCCAGAA AATTACCAAGTCTATGAAAATGGTAGCGGCAGCAA AATATGCCCGAGCTGAGAGAGAGCTGAAACCAGC TCGAATATATGGATTGGGATCTTTAGCTCTGTATGA AAAAGCTGATATCAAGGGGCCTGAAGACAAGAAG AAACACCTCCTTATTGGTGTGTCCTCAGATCGAGG ACTGTGTGGTGCTATTCATTCCTCCATTGCTAAACA GATGAAAAGCGAGGTTGCTACACTAACAGCAGCT GGGAAAGAAGTTATGCTTGTGGAATTGGTGACAAA ATCAGAGGCATACTTTATAGGACTCATTCTGACCA GTTTCTGGTGGCATTCAAAGAAGTGGGAAGAAAGC CCCCCACTTTTGGAGATGCGTCAGTCATTGCCCTT GAATTACTAAATTCTGGATATGAATTTGATGAAGGC TCCATCATCTTTAATAAATTCAGGTCTGTCATCTCC TATAAGACAGAAGAAAAGCCCATCTTTTCCCTTAAT ACCGTTGCAAGTGCTGACAGCATGAGTATCTATGA CGATATTGATGCTGACGTGCTGCAAAATTACCAAG AATACAATCTGGCCAACATCATCTACTACTCTCTGA AGGAGTCCACCACTAGTGAGCAGAGTGCCAGGAT GACAGCCATGGACAATGCCAGCAAGAATGCTTCT GAGATGATTGACAAATTGACATTGACATTCAACCG TACCCGCCAAGCTGTCATCACAAAAGAGTTGATTG AAATTATCTCTGGTGCTGCAGCTCTGGATTAATGA AAATCAAGTTCCATCCTCAGACAAGAGGTAAAGAA GGAAAATTCAGC | 42 | ELVTKSEA YFIGLILTS FWWHSKK WEESPPLL EMRQSLPL NY* |
| 334 | NM_0010 02.3_187 | 187 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAAG TCCAACTACTTCCTTAAGATCATCCAACTATTGGAT GATTATCCGAAATGTTTCATTGTGGGAGCAGACAA TGTGGGCTCCAAGCAGATGCAGCAGATCCGCATG TCCCTTCGCGGGAAGGCTGTGGTGCTGATGGGCA AGAACACCATGATGCGCAAGGCCATCCGAGGGCA CCTGGAAAACAACCCAGCTCTGGAGAAACTGCTG CCTCATATCCGGGGGAATGTGGGCTTTGTGTTCAC CAAGGAGGACCTCACTGAGATCAGGGACATGTTG CTGGCCAATAAGGTGCCAGCTGCTGCCCGTGCTG GTGCCATTGCCCCATGTGAAGTCACTGTGCCAGC CCAGAACACTGGTCTCGGGCCCAGAAGACCTCC TTTTTCCAGGCTTTAGGTATCACCACTAAAATCTCC AGGGGCACCATTGAAATCCTGAGTGATGTGCAGC TGATCAAGACTGGAGACAAAGTGGGAGCCAGCGA AGCCACGCTGCTGAACATGCTCAACATCTCCCCCT TCTCCTTTGGGCTGGTCATCCAGCAGGTGTTCGAC AATGGCAGCATCTACAACCCTGAAGTGCTTGATAT CACAGAGGAAACTCTGCATTCTCGCTTCCTGGAGG GTGTCCGCAATGTTGCCAGTGTCTGTCTGCAGATT GGCTACCCAACTGTTGCATCAGTACCCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCTGTGGCTGC | 50 | KTGRPGSP TTSLRSSN YWMIIRNV SLWEQTM WAPSRCS RSACPFAG RLWC* |
| 335 | NM_0010 02.3_201 | 201 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT | 45 | GSPTTSLR SSNYWMII RNVSLWE QTMWAPS RCSRSACP FAGRLWC* |

| SEQ ID | identifier_position | position | modified_RNA | PAP length | PAP |
|---|---|---|---|---|---|
| | | | GCCTCATATCCGGGGGAATGTGGGCTTTGTGTTCA<br>CCAAGGAGGACCTCACTGAGATCAGGGACATGTT<br>GCTGGCCAATAAGGTGCCAGCTGCTGCCCGTGCT<br>GGTGCCATTGCCCCATGTGAAGTCACTGTGCCAG<br>CCCAGAACACTGGTCTCGGGCCCGAGAAGACCTC<br>CTTTTTCCAGGCTTTAGGTATCACCACTAAAATCTC<br>CAGGGGCACCATTGAAATCCTGAGTGATGTGCAG<br>CTGATCAAGACTGGAGACAAAGTGGGAGCCAGCG<br>AAGCCACGCTGCTGAACATGCTCAACATCTCCCCC<br>TTCTCCTTTGGGCTGGTCATCCAGCAGGTGTTCGA<br>CAATGGCAGCATCTACAACCCTGAAGTGCTTGATA<br>TCACAGAGGAAACTCTGCATTCTCGCTTCCTGGAG<br>GGTGTCCGCAATGTTGCCAGTGTCTGTCTGCAGAT<br>TGGCTACCCAACTGTTGCATCAGTACCCCATTCTA<br>TCATCAACGGGTACAAACGAGTCCTGGCCTTGTCT<br>GTGGAGACGGATTACACCTTCCCACTTGCTGAAAA<br>GGTCAAGGCCTTCTTGGCTGATCCATCTGCCTTTG<br>TGGCTGCTGCCCCTGTGGCTGC | | |
| 336 | NM_0010<br>02.3_239 | 239 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATGGAT<br>GATTATCCGAAATGTTTCATTGTGGGAGCAGACAA<br>TGTGGGCTCCAAGCAGATGCAGCAGATCCGCATG<br>TCCCTTCGCGGGAAGGCTGTGGTGCTGATGGGCA<br>AGAACACCATGATGCGCAAGGCCATCCGAGGGCA<br>CCTGGAAAAACAACCCAGCTCTGGAGAAACTGCTG<br>CCTCATATCCGGGGGAATGTGGGCTTTGTGTTCAC<br>CAAGGAGGACCTCACTGAGATCAGGGACATGTTG<br>CTGGCCAATAAGGTGCCAGCTGCTGCCCGTGCTG<br>GTGCCATTGCCCCATGTGAAGTCACTGTGCCAGC<br>CCAGAACACTGGTCTCGGGCCCGAGAAGACCTCC<br>TTTTTCCAGGCTTTAGGTATCACCACTAAAATCTCC<br>AGGGGCACCATTGAAATCCTGAGTGATGTGCAGC<br>TGATCAAGACTGGAGACAAAGTGGGAGCCAGCGA<br>AGCCACGCTGCTGAACATGCTCAACATCTCCCCCT<br>TCTCCTTTGGGCTGGTCATCCAGCAGGTGTTCGAC<br>AATGGCAGCATCTACAACCCTGAAGTGCTTGATAT<br>CACAGAGGAAACTCTGCATTCTCGCTTCCTGGAGG<br>TGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | 33 | WMIIRNVS<br>LWEQTMW<br>APSRCSRS<br>ACPFAGRL<br>WC* |
| 337 | NM_0010<br>02.3_264 | 264 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA<br>TGATTATCCGAAATGTTTCATGTGGGAGCAGACAA<br>TGTGGGCTCCAAGCAGATGCAGCAGATCCGCATG<br>TCCCTTCGCGGGAAGGCTGTGGTGCTGATGGGCA<br>AGAACACCATGATGCGCAAGGCCATCCGAGGGCA<br>CCTGGAAAAACAACCCAGCTCTGGAGAAACTGCTG<br>CCTCATATCCGGGGGAATGTGGGCTTTGTGTTCAC<br>CAAGGAGGACCTCACTGAGATCAGGGACATGTTG<br>CTGGCCAATAAGGTGCCAGCTGCTGCCCGTGCTG<br>GTGCCATTGCCCCATGTGAAGTCACTGTGCCAGC<br>CCAGAACACTGGTCTCGGGCCCGAGAAGACCTCC<br>TTTTTCCAGGCTTTAGGTATCACCACTAAAATCTCC<br>AGGGGCACCATTGAAATCCTGAGTGATGTGCAGC<br>TGATCAAGACTGGAGACAAAGTGGGAGCCAGCGA<br>AGCCACGCTGCTGAACATGCTCAACATCTCCCCCT<br>TCTCCTTTGGGCTGGTCATCCAGCAGGTGTTCGAC<br>AATGGCAGCATCTACAACCCTGAAGTGCTTGATAT<br>CACAGAGGAAACTCTGCATTCTCGCTTCCTGGAGG<br>TGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG | 25 | MWEQTMW<br>APSRCSRS<br>ACPFAGRL<br>WC* |

TABLE 3A-continued

| SEQ ID | identifier_position | position | modified_RNA | PAP length | PAP |
|---|---|---|---|---|---|
| | | | GTCAAGGCCTTCTTGGCTGATCCATCTGCCTTTGT GGCTGCTGCCCCTGTGGCTGC | | |
| 338 | NM_0010 02.3_441 | 441 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCCAGAACACTGGTCTCGGGCCCGAGAAGACCTC CTTTTTCCAGGCTTTAGGTATCACCACTAAAATCTC CAGGGGCACCATTGAAATCCTGAGTGATGTGCAG CTGATCAAGACTGGAGACAAAGTGGGAGCCAGCG AAGCCACGCTGCTGAACATGCTCAACATCTCCCCC TTCTCCTTTGGGCTGGTCATCCAGCAGGTGTTCGA CAATGGCAGCATCTACAACCCTGAAGTGCTTGATA TCACAGAGGAAACTCTGCATTCTCGCTTCCTGGAG GGTGTCCGCAATGTTGCCAGTGTCTGTCTGCAGAT TGGCTACCCAACTGTTGCATCAGTACCCCATTCTA TCATCAACGGGTACAAACGAGTCCTGGCCTTGTCT GTGGAGACGGATTACACCTTCCCACTTGCTGAAAA GGTCAAGGCCTTCTTGGCTGATCCATCTGCCTTTG TGGCTGCTGCCCCTGTGGCTGC | 53 | LCSPRRTS LRSGTCC WPIRCQLL PVLVPLPH VKSLCQPR TLVSGPRR PPFSRL* |
| 339 | NM_0010 02.3_553 | 553 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCAGAACACTGGTCTCGGGCCCGAGAAGACCTCC TTTTTCCAGGCTTTAGGTATCACCACTAAAATCTCC AGGGGCACCATTGAAATCCTGAGTGATGTGCAGC TGATCAAGACTGGAGACAAAGTGGGAGCCAGCGA AGCCACGCTGCTGAACATGCTCAACATCTCCCCCT TCTCCTTTGGGCTGGTCATCCAGCAGGTGTTCGAC AATGGCAGCATCTACAACCCTGAAGTGCTTGATAT CACAGAGGAAACTCTGCATTCTCGCTTCCTGGAGG GTGTCCGCAATGTTGCCAGTGTCTGTCTGCAGATT GGCTACCCAACTGTTGCATCAGTACCCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | 15 | RTLVSGPR RPPFSRL* |
| 340 | NM_0010 02.3_626 | 626 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG | 5 | APLKS* |

TABLE 3A-continued

| SEQ ID | identifier_ position | position | modified_RNA | PAP length | PAP |
|---|---|---|---|---|---|
| | | | CCCAGAACACTGGTCTCGGGCCCGAGAAGACCTC<br>CTTTTTCCAGGCTTTAGGTATCACCACTAAAATCTC<br>CAGGGCACCATTGAAATCCTGAGTGATGTGCAGCT<br>GATCAAGACTGGAGACAAAGTGGGAGCCAGCGAA<br>GCCACGCTGCTGAACATGCTCAACATCTCCCCCTT<br>CTCCTTTGGGCTGGTCATCCAGCAGGTGTTCGACA<br>ATGGCAGCATCTACAACCCTGAAGTGCTTGATATC<br>ACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | | |
| 341 | NM_0010<br>02.3_655 | 655 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA<br>TGATTATCCGAAATGTTTCATTGTGGGAGCAGACA<br>ATGTGGGCTCCAAGCAGATGCAGCAGATCCGCAT<br>GTCCCTTCGCGGGAAGGCTGTGGTGCTGATGGGC<br>AAGAACACCATGATGCGCAAGGCCATCCGAGGGC<br>ACCTGGAAAACAACCCAGCTCTGGAGAAACTGCT<br>GCCTCATATCCGGGGGAATGTGGGCTTTGTGTTCA<br>CCAAGGAGGACCTCACTGAGATCAGGGACATGTT<br>GCTGGCCAATAAGGTGCCAGCTGCTGCCCGTGCT<br>GGTGCCATTGCCCCATGTGAAGTCACTGTGCCAG<br>CCCAGAACACTGGTCTCGGGCCCGAGAAGACCTC<br>CTTTTTCCAGGCTTTAGGTATCACCACTAAAATCTC<br>CAGGGGCACCATTGAAATCCTGAGTGATGTGCAG<br>TGATCAAGACTGGAGACAAAGTGGGAGCCAGCGA<br>AGCCACGCTGCTGAACATGCTCAACATCTCCCCCT<br>TCTCCTTTGGGCTGGTCATCCAGCAGGTGTTCGAC<br>AATGGCAGCATCTACAACCCTGAAGTGCTTGATAT<br>CACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | 0 | * |
| 342 | NM_0010<br>02.3_700 | 700 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA<br>TGATTATCCGAAATGTTTCATTGTGGGAGCAGACA<br>ATGTGGGCTCCAAGCAGATGCAGCAGATCCGCAT<br>GTCCCTTCGCGGGAAGGCTGTGGTGCTGATGGGC<br>AAGAACACCATGATGCGCAAGGCCATCCGAGGGC<br>ACCTGGAAAACAACCCAGCTCTGGAGAAACTGCT<br>GCCTCATATCCGGGGGAATGTGGGCTTTGTGTTCA<br>CCAAGGAGGACCTCACTGAGATCAGGGACATGTT<br>GCTGGCCAATAAGGTGCCAGCTGCTGCCCGTGCT<br>GGTGCCATTGCCCCATGTGAAGTCACTGTGCCAG<br>CCCAGAACACTGGTCTCGGGCCCGAGAAGACCTC<br>CTTTTTCCAGGCTTTAGGTATCACCACTAAAATCTC<br>CAGGGGCACCATTGAAATCCTGAGTGATGTGCAG<br>CTGATCAAGACTGGAGACAAAGTGGGAGCCAGCG<br>AAGCCACGCTGTGAACATGCTCAACATCTCCCCCT<br>TCTCCTTTGGGCTGGTCATCCAGCAGGTGTTCGAC<br>AATGGCAGCATCTACAACCCTGAAGTGCTTGATAT<br>CACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | 0 | * |
| 343 | NM_0010<br>02.3_714 | 714 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT | 156 | KSPPSPLG<br>WSSSRCS<br>TMAASTTL |

TABLE 3A-continued

| SEQ ID | identifier_position | position | modified_RNA | PAP length | PAP |
|---|---|---|---|---|---|
| | | | TCTCTCGCCAGGCGTCCTCGTGGAAGTGACATCG | | KCLISQRK |
| | | | TCTTTAAACCCTGCGTGGCAATCCCTGACGCACCG | | LCILASWR |
| | | | CCGTGATGCCCAGGGAAGACAGGGCGACCTGGAA | | VSAMLPVS |
| | | | GTCCAACTACTTCCTTAAGATCATCCAACTATTGGA | | VCRLATQL |
| | | | TGATTATCCGAAATGTTTCATTGTGGGAGCAGACA | | LHQYPILSS |
| | | | ATGTGGGCTCCAAGCAGATGCAGCAGATCCGCAT | | TGTNESW |
| | | | GTCCCTTCGCGGGAAGGCTGTGGTGCTGATGGGC | | PCLWRRIT |
| | | | AAGAACACCATGATGCGCAAGGCCATCCGAGGGC | | PSHLLKRS |
| | | | ACCTGGAAAACAACCCAGCTCTGGAGAAACTGCT | | RPSWLIHL |
| | | | GCCTCATATCCGGGGGAATGTGGGCTTTGTGTTCA | | PLWLLPLW |
| | | | CCAAGGAGGACCTCACTGAGATCAGGGACATGTT | | LLPPQLLLL |
| | | | GCTGGCCAATAAGGTGCCAGCTGCTGCCCGTGCT | | LLQPQLRL |
| | | | GGTGCCATTGCCCCATGTGAAGTCACTGTGCCAG | | KPRKSRRS |
| | | | CCCAGAACACTGGTCTCGGGCCCGAGAAGACCTC | | RTRIWDLV |
| | | | CTTTTTCCAGGCTTTAGGTATCACCACTAAAATCTC | | SLTNHQKA |
| | | | CAGGGGCACCATTGAAATCCTGAGTGATGTGCAG | | TNLASFICK |
| | | | CTGATCAAGACTGGAGACAAAGTGGGAGCCAGCG | | TRK* |
| | | | AAGCCACGCTGCTGAACATGCTCAAATCTCCCCCT | | |
| | | | TCTCCTTTGGGCTGGTCATCCAGCAGGTGTTCGAC | | |
| | | | AATGGCAGCATCTACAACCCTGAAGTGCTTGATAT | | |
| | | | CACAGAGGAAACTCTGCATTCTCGCTTCCTGGAGG | | |
| | | | GTGTCCGCAATGTTGCCAGTGTCTGTCTGCAGATT | | |
| | | | GGCTACCCAACTGTTGCATCAGTACCCCATTCTAT | | |
| | | | CATCAACGGGTACAAACGAGTCCTGGCCTTGTCTG | | |
| | | | TGGAGACGGATTACACCTTCCCACTTGCTGAAAAG | | |
| | | | GTCAAGGCCTTCTTGGCTGATCCATCTGCCTTTGT | | |
| | | | GGCTGCTGCCCCTGTGGCTGC | | |
| 344 | NM_0010 02.3_732 | 732 | GTCTGACGGGCGATGGCGCAGCCAATAGACAGGA | 150 | LGWSSSR |
| | | | GCGCTATCCGCGGTTTCTGATTGGCTACTTTGTTC | | CSTMAAST |
| | | | GCATTATAAAAGGCACGCGCGGGCGCGAGGCCCT | | TLKCLISQR |
| | | | TCTCTCGCCAGGCGTCCTCGTGGAAGTGACATCG | | KLCILASW |
| | | | TCTTTAAACCCTGCGTGGCAATCCCTGACGCACCG | | RVSAMLPV |
| | | | CCGTGATGCCCAGGGAAGACAGGGCGACCTGGAA | | SVCRLATQ |
| | | | GTCCAACTACTTCCTTAAGATCATCCAACTATTGGA | | LLHQYPILS |
| | | | TGATTATCCGAAATGTTTCATTGTGGGAGCAGACA | | STGTNES |
| | | | ATGTGGGCTCCAAGCAGATGCAGCAGATCCGCAT | | WPCLWRRI |
| | | | GTCCCTTCGCGGGAAGGCTGTGGTGCTGATGGGC | | TPSHLLKR |
| | | | AAGAACACCATGATGCGCAAGGCCATCCGAGGGC | | SRPSWLIH |
| | | | ACCTGGAAAACAACCCAGCTCTGGAGAAACTGCT | | LPLWLLPL |
| | | | GCCTCATATCCGGGGGAATGTGGGCTTTGTGTTCA | | WLLPPQLL |
| | | | CCAAGGAGGACCTCACTGAGATCAGGGACATGTT | | LLLLQPQL |
| | | | GCTGGCCAATAAGGTGCCAGCTGCTGCCCGTGCT | | RLKPRKSR |
| | | | GGTGCCATTGCCCCATGTGAAGTCACTGTGCCAG | | RSRTRIWD |
| | | | CCCAGAACACTGGTCTCGGGCCCGAGAAGACCTC | | LVSLTNHQ |
| | | | CTTTTTCCAGGCTTTAGGTATCACCACTAAAATCTC | | KATNLASFI |
| | | | CAGGGGCACCATTGAAATCCTGAGTGATGTGCAG | | CKTRK* |
| | | | CTGATCAAGACTGGAGACAAAGTGGGAGCCAGCG | | |
| | | | AAGCCACGCTGCTGAACATGCTCAACATCTCCCCC | | |
| | | | TTCTCCTTGGGCTGGTCATCCAGCAGGTGTTCGAC | | |
| | | | AATGGCAGCATCTACAACCCTGAAGTGCTTGATAT | | |
| | | | CACAGAGGAAACTCTGCATTCTCGCTTCCTGGAGG | | |
| | | | GTGTCCGCAATGTTGCCAGTGTCTGTCTGCAGATT | | |
| | | | GGCTACCCAACTGTTGCATCAGTACCCCATTCTAT | | |
| | | | CATCAACGGGTACAAACGAGTCCTGGCCTTGTCTG | | |
| | | | TGGAGACGGATTACACCTTCCCACTTGCTGAAAAG | | |
| | | | GTCAAGGCCTTCTTGGCTGATCCATCTGCCTTTGT | | |
| | | | GGCTGCTGCCCCTGTGGCTGC | | |
| 345 | NM_0010 02.3_755 | 755 | GTCTGACGGGCGATGGCGCAGCCAATAGACAGGA | 142 | STMAASTT |
| | | | GCGCTATCCGCGGTTTCTGATTGGCTACTTTGTTC | | LKCLISQR |
| | | | GCATTATAAAAGGCACGCGCGGGCGCGAGGCCCT | | KLCILASW |
| | | | TCTCTCGCCAGGCGTCCTCGTGGAAGTGACATCG | | RVSAMLPV |
| | | | TCTTTAAACCCTGCGTGGCAATCCCTGACGCACCG | | SVCRLATQ |
| | | | CCGTGATGCCCAGGGAAGACAGGGCGACCTGGAA | | LLHQYPILS |
| | | | GTCCAACTACTTCCTTAAGATCATCCAACTATTGGA | | STGTNES |
| | | | TGATTATCCGAAATGTTTCATTGTGGGAGCAGACA | | WPCLWRRI |
| | | | ATGTGGGCTCCAAGCAGATGCAGCAGATCCGCAT | | TPSHLLKR |
| | | | GTCCCTTCGCGGGAAGGCTGTGGTGCTGATGGGC | | SRPSWLIH |
| | | | AAGAACACCATGATGCGCAAGGCCATCCGAGGGC | | LPLWLLPL |
| | | | ACCTGGAAAACAACCCAGCTCTGGAGAAACTGCT | | WLLPPQLL |
| | | | GCCTCATATCCGGGGGAATGTGGGCTTTGTGTTCA | | LLLLQPQL |
| | | | CCAAGGAGGACCTCACTGAGATCAGGGACATGTT | | RLKPRKSR |
| | | | GCTGGCCAATAAGGTGCCAGCTGCTGCCCGTGCT | | RSRTRIWD |
| | | | GGTGCCATTGCCCCATGTGAAGTCACTGTGCCAG | | LVSLTNHQ |
| | | | CCCAGAACACTGGTCTCGGGCCCGAGAAGACCTC | | KATNLASFI |
| | | | CTTTTTCCAGGCTTTAGGTATCACCACTAAAATCTC | | CKTRK* |
| | | | CAGGGGCACCATTGAAATCCTGAGTGATGTGCAG | | |
| | | | CTGATCAAGACTGGAGACAAAGTGGGAGCCAGCG | | |

TABLE 3A-continued

| SEQ ID | identifier_position | position | modified_RNA | PAP length | PAP |
|---|---|---|---|---|---|
| | | | AAGCCACGCTGCTGAACATGCTCAACATCTCCCCC<br>TTCTCCTTTGGGCTGGTCATCCAGCAGGTGTCGAC<br>AATGGCAGCATCTACAACCCTGAAGTGCTTGATAT<br>CACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | | |
| 346 | NM_0010<br>02.3_765 | 765 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA<br>TGATTATCCGAAATGTTTCATTGTGGGAGCAGACA<br>ATGTGGGCTCCAAGCAGATGCAGCAGATCCGCAT<br>GTCCCTTCGCGGGAAGGCTGTGGTGCTGATGGGC<br>AAGAACACCATGATGCGCAAGGCCATCCGAGGGC<br>ACCTGGAAAACAACCCAGCTCTGGAGAAACTGCT<br>GCCTCATATCCGGGGGAATGTGGGCTTTGTGTTCA<br>CCAAGGAGGACCTCACTGAGATCAGGGACATGTT<br>GCTGGCCAATAAGGTGCCAGCTGCTGCCCGTGCT<br>GGTGCCATTGCCCCATGTGAAGTCACTGTGCCAG<br>CCCAGAACACTGGTCTCGGGCCCGAGAAGACCTC<br>CTTTTTCCAGGCTTTAGGTATCACCACTAAAATCTC<br>CAGGGGCACCATTGAAATCCTGAGTGATGTGCAG<br>CTGATCAAGACTGGAGACAAAGTGGGAGCCAGCG<br>AAGCCACGCTGCTGAACATGCTCAACATCTCCCCC<br>TTCTCCTTTGGGCTGGTCATCCAGCAGGTGTTCGA<br>CAATGGAGCATCTACAACCCTGAAGTGCTTGATAT<br>CACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | 138 | ASTTLKCLI<br>SQRKLCIL<br>ASWRVSA<br>MLPVSVCR<br>LATQLLHQ<br>YPILSSTGT<br>NESWPCL<br>WRRITPSH<br>LLKRSRPS<br>WLIHLPLW<br>LLPLWLLP<br>PQLLLLLLQ<br>PQLRLKPR<br>KSRRSRTR<br>IWDLVSLT<br>NHQKATNL<br>ASFICKTR<br>K* |
| 347 | NM_0010<br>02.3_768 | 768 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA<br>TGATTATCCGAAATGTTTCATTGTGGGAGCAGACA<br>ATGTGGGCTCCAAGCAGATGCAGCAGATCCGCAT<br>GTCCCTTCGCGGGAAGGCTGTGGTGCTGATGGGC<br>AAGAACACCATGATGCGCAAGGCCATCCGAGGGC<br>ACCTGGAAAACAACCCAGCTCTGGAGAAACTGCT<br>GCCTCATATCCGGGGGAATGTGGGCTTTGTGTTCA<br>CCAAGGAGGACCTCACTGAGATCAGGGACATGTT<br>GCTGGCCAATAAGGTGCCAGCTGCTGCCCGTGCT<br>GGTGCCATTGCCCCATGTGAAGTCACTGTGCCAG<br>CCCAGAACACTGGTCTCGGGCCCGAGAAGACCTC<br>CTTTTTCCAGGCTTTAGGTATCACCACTAAAATCTC<br>CAGGGGCACCATTGAAATCCTGAGTGATGTGCAG<br>CTGATCAAGACTGGAGACAAAGTGGGAGCCAGCG<br>AAGCCACGCTGCTGAACATGCTCAACATCTCCCCC<br>TTCTCCTTTGGGCTGGTCATCCAGCAGGTGTTCGA<br>CAATGGCAGATCTACAACCCTGAAGTGCTTGATAT<br>CACAGAGGAAACTCTGCATTCTCGCTTCCTGGAGG<br>GTGTCCGCAATGTTGCCAGTGTCTGTCTGCAGATT<br>GGCTACCCAACTGTTGCATCAGTACCCCATTCTAT<br>CATCAACGGGTACAAACGAGTCCTGGCCTTGTCTG<br>TGGAGACGGATTACACCTTCCCACTTGCTGAAAAG<br>GTCAAGGCCTTCTTGGCTGATCCATCTGCCTTTGT<br>GGCTGCTGCCCCTGTGGCTGC | 138 | RSTTLKCLI<br>SQRKLCIL<br>ASWRVSA<br>MLPVSVCR<br>LATQLLHQ<br>YPILSSTGT<br>NESWPCL<br>WRRITPSH<br>LLKRSRPS<br>WLIHLPLW<br>LLPLWLLP<br>PQLLLLLLQ<br>PQLRLKPR<br>KSRRSRTR<br>IWDLVSLT<br>NHQKATNL<br>ASFICKTR<br>K* |
| 348 | NM_0010<br>02.3_779 | 779 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGTGACATCG<br>TCTTTAAACCCTGCGTGGCAATCCCTGACGCACCG<br>CCGTGATGCCCAGGGAAGACAGGGCGACCTGGAA<br>GTCCAACTACTTCCTTAAGATCATCCAACTATTGGA | 134 | LKCLISQR<br>KLCILASW<br>RVSAMLPV<br>SVCRLATQ<br>LLHQYPILS<br>STGTNES<br>WPCLWRRI |

| SEQ ID | identifier_position | position | modified_RNA | PAP length | PAP |
|---|---|---|---|---|---|
| | | | TGATTATCCGAAATGTTTCATTGTGGGAGCAGACA | | TPSHLLKR |
| | | | ATGTGGGCTCCAAGCAGATGCAGCAGATCCGCAT | | SRPSWLIH |
| | | | GTCCCTTCGCGGGAAGGCTGTGGTGCTGATGGGC | | LPLWLLPL |
| | | | AAGAACACCATGATGCGCAAGGCCATCCGAGGGC | | WLLPPQLL |
| | | | ACCTGGAAAACAACCCAGCTCTGGAGAAACTGCT | | LLLLQPQL |
| | | | GCCTCATATCCGGGGAATGTGGGCTTTGTGTTCA | | RLKPRKSR |
| | | | CCAAGGAGGACCTCACTGAGATCAGGGACATGTT | | RSRTRIWD |
| | | | GCTGGCCAATAAGGTGCCAGCTGCTGCCCGTGCT | | LVSLTNHQ |
| | | | GGTGCCATTGCCCCATGTGAAGTCACTGTGCCAG | | KATNLASFI |
| | | | CCCAGAACACTGGTCTCGGGCCCGAGAAGACCTC | | CKTRK* |
| | | | CTTTTTCCAGGCTTTAGGTATCACCACTAAAATCTC | | |
| | | | CAGGGGCACCATTGAAATCCTGAGTGATGTGCAG | | |
| | | | CTGATCAAGACTGGAGACAAAGTGGGAGCCAGCG | | |
| | | | AAGCCACGCTGCTGAACATGCTCAACATCTCCCCC | | |
| | | | TTCTCCTTTGGGCTGGTCATCCAGCAGGTGTTCGA | | |
| | | | CAATGGCAGCATCTACAACCTGAAGTGCTTGATAT | | |
| | | | CACAGAGGAAACTCTGCATTCTCGCTTCCTGGAGG | | |
| | | | GTGTCCGCAATGTTGCCAGTGTCTGTCTGCAGATT | | |
| | | | GGCTACCCAACTGTTGCATCAGTACCCCATTCTAT | | |
| | | | CATCAACGGGTACAAACGAGTCCTGGCCTTGTCTG | | |
| | | | TGGAGACGGATTACACCTTCCCACTTGCTGAAAAG | | |
| | | | GTCAAGGCCTTCTTGGCTGATCCATCTGCCTTTGT | | |
| | | | GGCTGCTGCCCCTGTGGCTGC | | |
| 349 | NM_0010 02.3_805 | 805 | GTCTGACGGGCGATGGCGCAGCCAATAGACAGGA | 125 | LCILASWR |
| | | | GCGCTATCCGCGGTTTCTGATTGGCTACTTTGTTC | | VSAMLPVS |
| | | | GCATTATAAAAGGCACGCGCGGGCGCGAGGCCCT | | VCRLATQL |
| | | | TCTCTCGCCAGGCGTCCTCGTGGAAGTGACATCG | | LHQYPILSS |
| | | | TCTTTAAACCCTGCGTGGCAATCCCTGACGCACCG | | TGTNESW |
| | | | CCGTGATGCCCAGGGAAGACAGGGCGACCTGGAA | | PCLWRRIT |
| | | | GTCCAACTACTTCCTTAAGATCATCCAACTATTGGA | | PSHLLKRS |
| | | | TGATTATCCGAAATGTTTCATTGTGGGAGCAGACA | | RPSWLIHL |
| | | | ATGTGGGCTCCAAGCAGATGCAGCAGATCCGCAT | | PLWLLPLW |
| | | | GTCCCTTCGCGGGAAGGCTGTGGTGCTGATGGGC | | LLPPQLLLL |
| | | | AAGAACACCATGATGCGCAAGGCCATCCGAGGGC | | LLQPQLRL |
| | | | ACCTGGAAAACAACCCAGCTCTGGAGAAACTGCT | | KPRKSRRS |
| | | | GCCTCATATCCGGGGAATGTGGGCTTTGTGTTCA | | RTRIWDLV |
| | | | CCAAGGAGGACCTCACTGAGATCAGGGACATGTT | | SLTNHQKA |
| | | | GCTGGCCAATAAGGTGCCAGCTGCTGCCCGTGCT | | TNLASFICK |
| | | | GGTGCCATTGCCCCATGTGAAGTCACTGTGCCAG | | TRK* |
| | | | CCCAGAACACTGGTCTCGGGCCCGAGAAGACCTC | | |
| | | | CTTTTTCCAGGCTTTAGGTATCACCACTAAAATCTC | | |
| | | | CAGGGGCACCATTGAAATCCTGAGTGATGTGCAG | | |
| | | | CTGATCAAGACTGGAGACAAAGTGGGAGCCAGCG | | |
| | | | AAGCCACGCTGCTGAACATGCTCAACATCTCCCCC | | |
| | | | TTCTCCTTTGGGCTGGTCATCCAGCAGGTGTTCGA | | |
| | | | CAATGGCAGCATCTACAACCTGAAGTGCTTGATA | | |
| | | | TCACAGAGGAACTCTGCATTCTCGCTTCCTGGAGG | | |
| | | | GTGTCCGCAATGTTGCCAGTGTCTGTCTGCAGATT | | |
| | | | GGCTACCCAACTGTTGCATCAGTACCCCATTCTAT | | |
| | | | CATCAACGGGTACAAACGAGTCCTGGCCTTGTCTG | | |
| | | | TGGAGACGGATTACACCTTCCCACTTGCTGAAAAG | | |
| | | | GTCAAGGCCTTCTTGGCTGATCCATCTGCCTTTGT | | |
| | | | GGCTGCTGCCCCTGTGGCTGC | | |
| 350 | NM_0010 02.3_811 | 811 | GTCTGACGGGCGATGGCGCAGCCAATAGACAGGA | 123 | ILASWRVS |
| | | | GCGCTATCCGCGGTTTCTGATTGGCTACTTTGTTC | | AMLPVSVC |
| | | | GCATTATAAAAGGCACGCGCGGGCGCGAGGCCCT | | RLATQLLH |
| | | | TCTCTCGCCAGGCGTCCTCGTGGAAGTGACATCG | | QYPILSST |
| | | | TCTTTAAACCCTGCGTGGCAATCCCTGACGCACCG | | GTNESWP |
| | | | CCGTGATGCCCAGGGAAGACAGGGCGACCTGGAA | | CLWRRITP |
| | | | GTCCAACTACTTCCTTAAGATCATCCAACTATTGGA | | SHLLKRSR |
| | | | TGATTATCCGAAATGTTTCATTGTGGGAGCAGACA | | PSWLIHLP |
| | | | ATGTGGGCTCCAAGCAGATGCAGCAGATCCGCAT | | LWLLPLWL |
| | | | GTCCCTTCGCGGGAAGGCTGTGGTGCTGATGGGC | | LPPQLLLLL |
| | | | AAGAACACCATGATGCGCAAGGCCATCCGAGGGC | | LQPQLRLK |
| | | | ACCTGGAAAACAACCCAGCTCTGGAGAAACTGCT | | PRKSRRSR |
| | | | GCCTCATATCCGGGGAATGTGGGCTTTGTGTTCA | | TRIWDLVS |
| | | | CCAAGGAGGACCTCACTGAGATCAGGGACATGTT | | LTNHQKAT |
| | | | GCTGGCCAATAAGGTGCCAGCTGCTGCCCGTGCT | | NLASFICKT |
| | | | GGTGCCATTGCCCCATGTGAAGTCACTGTGCCAG | | RK* |
| | | | CCCAGAACACTGGTCTCGGGCCCGAGAAGACCTC | | |
| | | | CTTTTTCCAGGCTTTAGGTATCACCACTAAAATCTC | | |
| | | | CAGGGGCACCATTGAAATCCTGAGTGATGTGCAG | | |
| | | | CTGATCAAGACTGGAGACAAAGTGGGAGCCAGCG | | |
| | | | AAGCCACGCTGCTGAACATGCTCAACATCTCCCCC | | |
| | | | TTCTCCTTTGGGCTGGTCATCCAGCAGGTGTTCGA | | |
| | | | CAATGGCAGCATCTACAACCTGAAGTGCTTGATA | | |
| | | | TCACAGAGGAAACTCTGATTCTCGCTTCCTGGAGG | | |

TABLE 3A-continued

| SEQ ID | identifier_ position | position | modified_RNA | PAP length | PAP |
|---|---|---|---|---|---|
| | | | GTGTCCGCAATGTTGCCAGTGTCTGTCTGCAGATT GGCTACCCAACTGTTGCATCAGTACCCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | | |
| 351 | NM_0010 02.3_823 | 823 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCCAGAACACTGGTCTCGGGCCCGAGAAGACCTC CTTTTTCCAGGCTTTAGGTATCACCACTAAAATCTC CAGGGGCACCATTGAAATCCTGAGTGATGTGCAG CTGATCAAGACTGGAGACAAAGTGGGAGCCAGCG AAGCCACGCTGCTGAACATGCTCAACATCTCCCCC TTCTCCTTTGGGCTGGTCATCCAGCAGGTGTTCGA CAATGGCAGCATCTACAACCCTGAAGTGCTTGATA TCACAGAGGAAACTCTGCATTCTCGCTTCTGGAGG GTGTCCGCAATGTTGCCAGTGTCTGTCTGCAGATT GGCTACCCAACTGTTGCATCAGTACCCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | 119 | WRVSAML PVSVCRLA TQLLHQYP ILSSTGTNE SWPCLWR RITPSHLLK RSRPSWLI HLPLWLLP LWLLPPQL LLLLLQPQL RLKPRKSR RSRTRIWD LVSLTNHQ KATNLASFI CKTRK* |
| 352 | NM_0010 02.3_867 | 867 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCCAGAACACTGGTCTCGGGCCCGAGAAGACCTC CTTTTTCCAGGCTTTAGGTATCACCACTAAAATCTC CAGGGGCACCATTGAAATCCTGAGTGATGTGCAG CTGATCAAGACTGGAGACAAAGTGGGAGCCAGCG AAGCCACGCTGCTGAACATGCTCAACATCTCCCCC TTCTCCTTTGGGCTGGTCATCCAGCAGGTGTTCGA CAATGGCAGCATCTACAACCCTGAAGTGCTTGATA TCACAGAGGAAACTCTGCATTCTCGCTTCTGGAG GGTGTCCGCAATGTTGCCAGTGTCTGTCTGCAGAT TGGTACCCAACTGTTGCATCAGTACCCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | 104 | TQLLHQYP ILSSTGTNE SWPCLWR RITPSHLLK RSRPSWLI HLPLWLLP LWLLPPQL LLLLLQPQL RLKPRKSR RSRTRIWD LVSLTNHQ KATNLASFI CKTRK* |
| 353 | NM_0010 02.3_892 | 892 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC | 96 | ILSSTGTNE SWPCLWR RITPSHLLK RSRPSWLI HLPLWLLP LWLLPPQL LLLLLQPQL RLKPRKSR RSRTRIWD LVSLTNHQ KATNLASFI |

TABLE 3A-continued

| SEQ ID | identifier_position | position | modified_RNA | PAP length | PAP |
|---|---|---|---|---|---|
| | | | ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCCAGAACACTGGTCTCGGGCCCGAGAAGACCTC CTTTTTCCAGGCTTTAGGTATCACCACTAAAATCTC CAGGGGCACCATTGAAATCCTGAGTGATGTGCAG CTGATCAAGACTGGAGACAAAGTGGGAGCCAGCG AAGCCACGCTGCTGAACATGCTCAACATCTCCCCC TTCTCCTTTGGGCTGGTCATCCAGCAGGTGTTCGA CAATGGCAGCATCTACAACCCTGAAGTGCTTGATA TCACAGAGGAAACTCTGCATTCTCGCTTCCTGGAG GGTGTCCGCAATGTTGCCAGTGTCTGTCTGCAGAT TGGCTACCCAACTGTTGCATCAGTACCCATTCTAT CATCAACGGGTACAAACGAGTCCTGGCCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | | CKTRK* |
| 354 | NM_0010 02.3_927 | 927 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGTGACATCG TCTTTAAACCCTGCGTGGCAATCCCTGACGCACCG CCGTGATGCCCAGGGAAGACAGGGCGACCTGGAA GTCCAACTACTTCCTTAAGATCATCCAACTATTGGA TGATTATCCGAAATGTTTCATTGTGGGAGCAGACA ATGTGGGCTCCAAGCAGATGCAGCAGATCCGCAT GTCCCTTCGCGGGAAGGCTGTGGTGCTGATGGGC AAGAACACCATGATGCGCAAGGCCATCCGAGGGC ACCTGGAAAACAACCCAGCTCTGGAGAAACTGCT GCCTCATATCCGGGGGAATGTGGGCTTTGTGTTCA CCAAGGAGGACCTCACTGAGATCAGGGACATGTT GCTGGCCAATAAGGTGCCAGCTGCTGCCCGTGCT GGTGCCATTGCCCCATGTGAAGTCACTGTGCCAG CCCAGAACACTGGTCTCGGGCCCGAGAAGACCTC CTTTTTCCAGGCTTTAGGTATCACCACTAAAATCTC CAGGGGCACCATTGAAATCCTGAGTGATGTGCAG CTGATCAAGACTGGAGACAAAGTGGGAGCCAGCG AAGCCACGCTGCTGAACATGCTCAACATCTCCCCC TTCTCCTTTGGGCTGGTCATCCAGCAGGTGTTCGA CAATGGCAGCATCTACAACCCTGAAGTGCTTGATA TCACAGAGGAAACTCTGCATTCTCGCTTCCTGGAG GGTGTCCGCAATGTTGCCAGTGTCTGTCTGCAGAT TGGCTACCCAACTGTTGCATCAGTACCCCATTCTA TCATCAACGGGTACAAACGAGTCCTGGCTTGTCTG TGGAGACGGATTACACCTTCCCACTTGCTGAAAAG GTCAAGGCCTTCTTGGCTGATCCATCTGCCTTTGT GGCTGCTGCCCCTGTGGCTGC | 84 | CLWRRITP SHLLKRSR PSWLIHLP LWLLPLWL LPPQLLLLL LQPQLRLK PRKSRRSR TRIWDLVS LTNHQKAT NLASFICKT RK* |
| 355 | NM_0010 02027.1_ 123 | 123 | CAGGACACGTGGGTGGGGGAAGCTGAGCGCTGA GACCAAGGGCTAAAGCTGGGAGACTGAAAAAATG CAGACCGCCGGGGCATTATTCATTTCTCCAGCTCT GATCCGCTGTTGTACCAGGGTCTAATCAGGCCTGT GTCTGCCTCCTTCTTGAATAGCCCAGTGAATTCAT CTAAACAGCCTTCCTACAGCAACTTCCCACTCCAG GTGGCCAGACGGGAGTTCCAGACCAGTGTTGTCT CCCGGGACATTGACACAGCAGCCAAGTTTATTGGT GCTGGGGCAGCCACAGTTGGTGTGGCTGGTTCAG GGGCTGGCATTGGAACCGTGTTTGGCAGCTTGAT CATTGGCTATGCCAGGAACCCGTCTCTCAAGCAG CAGCTCTTCTCCTATGCCATTCTTGGCTTTGCCCT GTCTGAGGCCATGGGGCTTTTCTGTTTGATGGTCG CCTTCCTCATCCTCTTCGCCATGTGAGGCTCCATG GGGGGTCACCGGCCTGTTGCAACTCCAC ACCATTCTTGGTGCTGGGGTGTGTTAAGCTTTACC ATTAAACACAACGTTTCTCTAAAAAAAAAAAAAAA AAAA | 1 | V* |
| 356 | NM_0010 02857.1_ 315 | 315 | GCTCAGCATTTGGGGACGCTCTCAGCTCTCGGCG CACGGCCCAGGTTATCTTGTAGCATAGCAACTTCG GATTTCACTCTACCCGGAGAGTTTCCCGCTTGGTT GAACACATTGGCCTCAGGAAGCTTCCTTCAAAATG TCTACTGTTCACGAAATCCTGTGCAAGCTCAGCTT GGAGGGTGATCACTCTACACCCCCAAGTGCATAT GGGTCTGTCAAAGCCTATACTAACTTTGATGCTGA GCGGGATGCTTTGAACATTGAAACAGCCATCAAGA CCAAAGGTGTGGATGAGGTCACCATTGTCAACATT TGACCAACCGCAGCAATGCACAGAGACAGGATATT | 0 | * |

TABLE 3A-continued

| SEQ ID | identifier_position | position | modified_RNA | PAP length | PAP |
|---|---|---|---|---|---|
| | | | GCCTTCGCCTACCAGAGAAGGACCAAAAAGGAAC<br>TTGCATCAGCACTGAAGTCAGCCTTATCTGGCCAC<br>CTGGAGACGGTGATTTTGGGCCTATTGAAGACACC<br>TGCTCAGTATGACGCTTCTGAGCTAAAAGCTTCCA<br>TGAAGGGGCTGGGAACCGACGAGGACTCTCTCAT<br>TGAGATCATCTGCTCCAGAACCAACCAGGAGCTG<br>CAGGAAATTAACAGAGTCTACAAGGAAATGTACAA<br>GACTGATCTGGAGAAGGACATTATTTCGGACACAT<br>CTGGTGACTTCCGCAAGCTGATGGTTGCCCTGGC<br>AAAGGGTAGAAGAGCAGAGGATGGCTCTGTCATT<br>GATTATGAACTGATTGACCAAGATGCTCGGGATCT<br>CTATGACGCTGGAGTGAAGAGGAAAGGAACTGAT<br>GTTCCCAAGTGGATCAGCATCATGACCGAGCGGA<br>GCGTGCCCCACCTCCAGAAAGTATTTGATAGGTAC<br>AAGAGTTACAGCCCTTATGACATGTTGGAAAGCAT<br>CAGGAAAGAGGTTAAAGGAGACCTGGAAAATGCTT<br>TCCTGAACCTGGTTCAGTGCATTCAGAACAAGCCC<br>CTGTATTTTGCTGATCGGCTGTATGACTCCATGAA<br>GGGCAAGGGGACGCGAGATAAGGTCCTGATCAGA<br>ATCATGGTCTCCCGCAGTG | | |
| 357 | NM_0010<br>02858.1_<br>306 | 306 | GCTCAGCATTTGGGGACGCTCTCAGCTCTCGGCG<br>CACGGCCCAGGTAAGCGGGGCGCGCCCTGCCCG<br>CCCGCGATGGGCCGCCAGCTAGCGGGGTGCGGA<br>GACGCTGGGAAGAAGGCTTCCTTCAAAATGTCTAC<br>TGTTCACGAAATCCTGTGCAAGCTCAGCTTGGAGG<br>GTGATCACTCTACACCCCCAAGTGCATATGGGTCT<br>GTCAAAGCCTATACTAACTTTGATGCTGAGCGGGA<br>TGCTTTGAACATTGAAACAGCCATCAAGACCAAAG<br>GTGTGGATGAGGTCACCATTGTCAACATTTGACCA<br>ACCGCAGCAATGCACAGAGACAGGATATTGCCTTC<br>GCCTACCAGAGAAGGACCAAAAAGGAACTTGCAT<br>CAGCACTGAAGTCAGCCTTATCTGGCCACCTGGA<br>GACGGTGATTTTGGGCCTATTGAAGACACCTGCTC<br>AGTATGACGCTTCTGAGCTAAAAGCTTCCATGAAG<br>GGGCTGGGAACCGACGAGGACTCTCTCATTGAGA<br>TCATCTGCTCCAGAACCAACCAGGAGCTGCAGGA<br>AATTAACAGAGTCTACAAGGAAATGTACAAGACTG<br>ATCTGGAGAAGGACATTATTTCGGACACATCTGGT<br>GACTTCCGCAAGCTGATGGTTGCCCTGGCAAAGG<br>GTAGAAGAGCAGAGGATGGCTCTGTCATTGATTAT<br>GAACTGATTGACCAAGATGCTCGGGATCTCTATGA<br>CGCTGGAGTGAAGAGGAAAGGAACTGATGTTCCC<br>AAGTGGATCAGCATCATGACCGAGCGGAGCGTGC<br>CCCACCTCCAGAAAGTATTTGATAGGTACAAGAGT<br>TACAGCCCTTATGACATGTTGGAAAGCATCAGGAA<br>AGAGGTTAAAGGAGACCTGGAAAATGCTTTCCTGA<br>ACCTGGTTCAGTGCATTCAGAACAAGCCCCTGTAT<br>TTTGCTGATCGGCTGTATGACTCCATGAAGGGCAA<br>GGGGACGCGAGATAAGGTCCTGATCAGAATCATG<br>GTCTCCCGCAGTGAAGTGGACA | 0 | * |
| 358 | NM_0010<br>02858.1_<br>890 | 890 | GCTCAGCATTTGGGGACGCTCTCAGCTCTCGGCG<br>CACGGCCCAGGTAAGCGGGGCGCGCCCTGCCCG<br>CCCGCGATGGGCCGCCAGCTAGCGGGGTGCGGA<br>GACGCTGGGAAGAAGGCTTCCTTCAAAATGTCTAC<br>TGTTCACGAAATCCTGTGCAAGCTCAGCTTGGAGG<br>GTGATCACTCTACACCCCCAAGTGCATATGGGTCT<br>GTCAAAGCCTATACTAACTTTGATGCTGAGCGGGA<br>TGCTTTGAACATTGAAACAGCCATCAAGACCAAAG<br>GTGTGGATGAGGTCACCATTGTCAACATTTTGACC<br>AACCGCAGCAATGCACAGAGACAGGATATTGCCTT<br>CGCCTACCAGAGAAGGACCAAAAAGGAACTTGCA<br>TCAGCACTGAAGTCAGCCTTATCTGGCCACCTGGA<br>GACGGTGATTTTGGGCCTATTGAAGACACCTGCTC<br>AGTATGACGCTTCTGAGCTAAAAGCTTCCATGAAG<br>GGGCTGGGAACCGACGAGGACTCTCTCATTGAGA<br>TCATCTGCTCCAGAACCAACCAGGAGCTGCAGGA<br>AATTAACAGAGTCTACAAGGAAATGTACAAGACTG<br>ATCTGGAGAAGGACATTATTTCGGACACATCTGGT<br>GACTTCCGCAAGCTGATGGTTGCCCTGGCAAAGG<br>GTAGAAGAGCAGAGGATGGCTCTGTCATTGATTAT<br>GAACTGATTGACCAAGATGCTCGGGATCTCTATGA<br>CGCTGGAGTGAAGAGGAAAGGAACTGATGTTCCC<br>AAGTGGATCAGCATCATGACCGAGCGGAGCGTGC<br>CCCACCTCCAGAAAGTATTTGATAGGTACAAGAGT<br>TACAGCCCTTATGACATGTTGGAAAGCATCAGGAA<br>AGAGGTTAAAGGAGACCTGGAAAATGCTTTCCTGAA<br>CCTGGTTCAGTGCATTCAGAACAAGCCCCTGTATT | 2 | LS* |

TABLE 3A-continued

| SEQ ID | identifier_position | position | modified_RNA | PAP length | PAP |
|---|---|---|---|---|---|
| | | | TTGCTGATCGGCTGTATGACTCCATGAAGGGCAAG GGGACGCGAGATAAGGTCCTGATCAGAATCATGG TCTCCCGCAGTGAAGTGGACA | | |
| 359 | NM_0010 02858.1_ 937 | 937 | GCTCAGCATTTGGGGACGCTCTCAGCTCTCGGCG CACGGCCCAGGTAAGCGGGGCGCGCCCTGCCCG CCCGCGATGGGCCGCCAGCTAGCGGGGTGCGGA GACGCTGGGAAGAAGGCTTCCTTCAAAATGTCTAC TGTTCACGAAATCCTGTGCAAGCTCAGCTTGGAGG GTGATCACTCTACACCCCCAAGTGCATATGGGTCT GTCAAAGCCTATACTAACTTTGATGCTGAGCGGGA TGCTTTGAACATTGAAACAGCCATCAAGACCAAAG GTGTGGATGAGGTCACCATTGTCAACATTTTGACC AACCGCAGCAATGCACAGAGACAGGATATTGCCTT CGCCTACCAGAGAAGGACCAAAAAGGAACTTGCA TCAGCACTGAAGTCAGCCTTATCTGGCCACCTGGA GACGGTGATTTTGGGCCTATTGAAGACACCTGCTC AGTATGACGCTTCTGAGCTAAAAGCTTCCATGAAG GGGCTGGGAACCGACGAGGACTCTCTCATTGAGA TCATCTGCTCCAGAACCAACCAGGAGCTGCAGGA AATTAACAGAGTCTACAAGGAAATGTACAAGACTG ATCTGGAGAAGGACATTATTTCGGACACATCTGGT GACTTCCGCAAGCTGATGGTTGCCCTGGCAAAGG GTAGAAGAGCAGAGGATGGCTCTGTCATTGATTAT GAACTGATTGACCAAGATGCTCGGGATCTCTATGA CGCTGGAGTGAAGAGGAAAGGAACTGATGTTCCC AAGTGGATCAGCATCATGACCGAGCGGAGCGTGC CCCACCTCCAGAAAGTATTTGATAGGTACAAGAGT TACAGCCCTTATGACATGTTGGAAAGCATCAGGAA AGAGGTTAAAGGAGACCTGGAAAATGCTTTCCTGA ACCTGGTTCAGTGCATTCAGAACAAGCCCCTGTAT TTGCTGATCGGCTGTATGACTCCATGAAGGGCAAG GGGACGCGAGATAAGGTCCTGATCAGAATCATGG TCTCCCGCAGTGAAGTGGACA | 8 | LLIGCMTP* |
| 360 | NM_0010 03.2_169 | 169 | CCTTTCCTCAGCTGCCGCCAAGGTGCTCGGTCCTT CCGAGGAAGCTAAGGCTGCGTTGGGGTGAGGCC CTCACTTCATCCGGCGACTAGCACCGCGTCCGGC AGCGCCAGCCCTACACTCGCCCGCGCCATGGCCT CTGTCTCCGAGCTCGCCTGCATCTACTCGGCCTCA TTCTGCACGACGATGAGGTGACAGTCACGGAGGA TAAGATCAATGCCCTCATTAAAGCAGCCGGTGTAA ATGTTGAGCCTTTTTGGCCTGGCTTGTTTGCAAAG GCCCTGGCCAACGTCAACATTGGGAGCCTCATCT GCAATGTAGGGGCCGGTGGACCTGCTCCAGCAGC TGGTGCTGCACCAGCAGGAGGTCCTGCCCCCTCC ACTGCTGCTGCTCCAGCTGAGGAGAAGAAAGTGG AAGCAAAGAAAGAAGAATCCGAGGAGTCTGATGAT GACATGGGCTTTGGTCTTTTTGACTAAACCTCTTTT ATAACATGTTCAATAAAAAGCTGAACTTT | 7 | SFCTTMR* |
| 361 | NM_0010 03.2_256 | 256 | CCTTTCCTCAGCTGCCGCCAAGGTGCTCGGTCCTT CCGAGGAAGCTAAGGCTGCGTTGGGGTGAGGCC CTCACTTCATCCGGCGACTAGCACCGCGTCCGGC AGCGCCAGCCCTACACTCGCCCGCGCCATGGCCT CTGTCTCCGAGCTCGCCTGCATCTACTCGGCCCTC ATTCTGCACGACGATGAGGTGACAGTCACGGAGG ATAAGATCAATGCCCTCATTAAAGCAGCCGGTGTA AATGTTGAGCCTTTTGGCCTGGCTTGTTTGCAAAG GCCCTGGCCAACGTCAACATTGGGAGCCTCATCT GCAATGTAGGGGCCGGTGGACCTGCTCCAGCAGC TGGTGCTGCACCAGCAGGAGGTCCTGCCCCCTCC ACTGCTGCTGCTCCAGCTGAGGAGAAGAAAGTGG AAGCAAAGAAAGAAGAATCCGAGGAGTCTGATGAT GACATGGGCTTTGGTCTTTTTGACTAAACCTCTTTT ATAACATGTTCAATAAAAAGCTGAACTTT | 20 | GLACLQRP WPTSTLGA SSAM* |
| 362 | NM_0010 03.2_285 | 285 | CCTTTCCTCAGCTGCCGCCAAGGTGCTCGGTCCTT CCGAGGAAGCTAAGGCTGCGTTGGGGTGAGGCC CTCACTTCATCCGGCGACTAGCACCGCGTCCGGC AGCGCCAGCCCTACACTCGCCCGCGCCATGGCCT CTGTCTCCGAGCTCGCCTGCATCTACTCGGCCCTC ATTCTGCACGACGATGAGGTGACAGTCACGGAGG ATAAGATCAATGCCCTCATTAAAGCAGCCGGTGTA AATGTTGAGCCTTTTTGGCCTGGCTTGTTTGCAAA GGCCCTGGCAACGTCAACATTGGGAGCCTCATCT GCAATGTAGGGGCCGGTGGACCTGCTCCAGCAGC TGGTGCTGCACCAGCAGGAGGTCCTGCCCCCTCC ACTGCTGCTGCTCCAGCTGAGGAGAAGAAAGTGG AAGCAAAGAAAGAAGAATCCGAGGAGTCTGATGAT | 10 | TSTLGASS AM* |

TABLE 3A-continued

| SEQ ID | identifier_position | position | modified_RNA | PAP length | PAP |
|---|---|---|---|---|---|
| 363 | NM_0010 03.2_459 | 459 | GACATGGGCTTTGGTCTTTTTGACTAAACCTCTTTT<br>ATAACATGTTCAATAAAAAGCTGAACTTT<br>CCTTTCCTCAGCTGCCGCCAAGGTGCTCGGTCCTT<br>CCGAGGAAGCTAAGGCTGCGTTGGGGTGAGGCC<br>CTCACTTCATCCGGCGACTAGCACCGCGTCCGGC<br>AGCGCCAGCCCTACACTCGCCCGCGCCATGGCCT<br>CTGTCTCCGAGCTCGCCTGCATCTACTCGGCCCTC<br>ATTCTGCACGACGATGAGGTGACAGTCACGGAGG<br>ATAAGATCAATGCCCTCATTAAAGCAGCCGGTGTA<br>AATGTTGAGCCTTTTTGGCCTGGCTTGTTTGCAAA<br>GGCCCTGGCCAACGTCAACATTGGGAGCCTCATC<br>TGCAATGTAGGGGCCGGTGGACCTGCTCCAGCAG<br>CTGGTGCTGCACCAGCAGGAGGTCCTGCCCCCTC<br>CACTGCTGCTCCAGCTGAGGAGAAGAAAGTG<br>GAAGCAAAGAAAGAAGAATCCGAGGAGTCTGATG<br>ATGACATGGGCTTGGTCTTTTTGACTAAACCTCTTT<br>TATAACATGTTCAATAAAAAGCTGAACTTT | 9 | LVFLTKPLL* |
| 364 | NM_0010 05.3_207 | 207 | CCTTTCCTTTCAGCGGAGCGCGGCCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATTGTGGAACCCAAAGATGAGATACTGCCCA<br>CCACCCCCATCTCAGAACAGAAGGGTGGGAAGCC<br>AGAGCCGCCTGCCATGCCCCAGCCAGTCCCCACA<br>GCATAACAGGGTCTCCTTGGCAGCTGTATTCTGGA<br>GTCTGGATGTTGCTCTCTAAAGACCTTTAATAAAAT<br>TTTGTACAAAGACAAAAAAAAAAAAAAAA | 9 | VRRAGGF GN* |
| 365 | NM_0010 05.3_261 | 261 | CCTTTCCTTTCAGCGGAGCGCGGCCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATTGTGGAACCCAAAGATGAGATACTGCCCA<br>CCACCCCCATCTCAGAACAGAAGGGTGGGAAGCC<br>AGAGCCGCCTGCCATGCCCCAGCCAGTCCCCACA<br>GCATAACAGGGTCTCCTTGGCAGCTGTATTCTGGA<br>GTCTGGATGTTGCTCTCTAAAGACCTTTAATAAAAT<br>TTTGTACAAAGACAAAAAAAAAAAAAAAA | 7 | LAFQRAV* |
| 366 | NM_0010 05.3_486 | 486 | CCTTTCCTTTCAGCGGAGCGCGGCCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC | 4 | LWMA* |

| SEQ ID | identifier_position | position | modified_RNA | PAP length | PAP |
|---|---|---|---|---|---|
| | | | GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTGTGGATGGCCTGATGATCCACAGCGGAGACC<br>CTGTTAACTACTACGTTGACACTGCTGTGCGCCAC<br>GTGTTGCTCAGACAGGGTGTGCTGGGCATCAAGG<br>TGAAGATCATGCTGCCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | | |
| 367 | NM_0010<br>05.3_496 | 496 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCTGATGATCCACAGCGGAGACC<br>CTGTTAACTACTACGTTGACACTGCTGTGCGCCAC<br>GTGTTGCTCAGACAGGGTGTGCTGGGCATCAAGG<br>TGAAGATCATGCTGCCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 0 | * |
| 368 | NM_0010<br>05.3_550 | 550 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCAC<br>GTGTTGCTCAGACAGGGTGTGCTGGGCATCAAGG<br>TGAAGATCATGCTGCCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 12 | TCCSDRVC<br>WASR* |
| 369 | NM_0010<br>05.3_557 | 557 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG | 10 | CSDRVCW<br>ASR* |

TABLE 3A-continued

| SEQ ID | identifier_position | position | modified_RNA | PAP length | PAP |
|---|---|---|---|---|---|
| | | | AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTGCTCAGACAGGGTGTGCTGGGCATCAAGG<br>TGAAGATCATGCTGCCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | | |
| 370 | NM_0010<br>05.3_603 | 603 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 16 | GTQLVRLA<br>LRSPCLTT* |
| 371 | NM_0010<br>05.3_611 | 611 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTAA<br>GATTGGCCCTAAGAAGCCCCTGCCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 14 | QLVRLALR<br>SPCLTT* |
| 372 | NM_0010<br>05.3_629 | 629 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC | 8 | LRSPCLTT* |

TABLE 3A-continued

| SEQ ID | identifier_position | position | modified_RNA | PAP length | PAP |
|---|---|---|---|---|---|
| | | | CCTGTTAACTACTACGTTGACACTGCTGTGCGCCA CGTGTTGCTCAGACAGGGTGTGCTGGGCATCAAG GTGAAGATCATGCTGCCCTGGGACCCAACTGGTA AGATTGGCCTAAGAAGCCCCTGCCTGACCACGTG AGCATTGTGGAACCCAAAGATGAGATACTGCCCAC CACCCCCATCTCAGAACAGAAGGGTGGGAAGCCA GAGCCGCCTGCCATGCCCCAGCCAGTCCCCACAG CATAACAGGGTCTCCTTGGCAGCTGTATTCTGGAG TCTGGATGTTGCTCTCTAAAGACCTTTAATAAAATT TTGTACAAAGACAAAAAAAAAAAAAAAA | | |
| 373 | NM_0010 05.3_63 | 63 | CCTTTCCTTTCAGCGGAGCGCGGCGGCAAGATGG CAGTGCAAATATCCAAGAAGAGGAAGTTGTCGCTG ATGGCATCTTCAAAGCTGAACTGAATGAGTTTCTTA CTCGGGAGCTGGCTGAAGATGGCTACTCTGGAGT TGAGGTGCGAGTTACACCAACCAGGACAGAAATC ATTATCTTAGCCACCAGAACACAGAATGTTCTTGG TGAGAAGGGCCGGCGGATTCGGGAACTGACTGCT GTAGTTCAGAAGAGGTTTGGCTTTCCAGAGGGCA GTGTAGAGCTTTATGCTGAAAAGGTGGCCACTAGA GGTCTGTGTGCCATTGCCCAGGCAGAGTCTCTGC GTTACAAACTCCTAGGAGGGCTTGCTGTGCGGAG GGCCTGCTATGGTGTGCTGCGGTTCATCATGGAG AGTGGGGCCAAAGGCTGCGAGGTTGTGGTGTCTG GGAAACTCCGAGGACAGAGGGCTAAATCCATGAA GTTTGTGGATGGCCTGATGATCCACAGCGGAGAC CCTGTTAACTACTACGTTGACACTGCTGTGCGCCA CGTGTTGCTCAGACAGGGTGTGCTGGGCATCAAG GTGAAGATCATGCTGCCCTGGGACCCAACTGGTA AGATTGGCCCTAAGAAGCCCCTGCCTGACCACGT GAGCATTGTGGAACCCAAAGATGAGATACTGCCCA CCACCCCCATCTCAGAACAGAAGGGTGGGAAGCC AGAGCCGCCTGCCATGCCCCAGCCAGTCCCCACA GCATAACAGGGTCTCCTTGGCAGCTGTATTCTGGA GTCTGGATGTTGCTCTCTAAAGACCTTTAATAAAAT TTTGTACAAAGACAAAAAAAAAAAAAAAA | 10 | LSLMASSK LN* |
| 374 | NM_0010 05.3_640 | 640 | CCTTTCCTTTCAGCGGAGCGCGGCGGCAAGATGG CAGTGCAAATATCCAAGAAGAGGAAGTTTGTCGCT GATGGCATCTTCAAAGCTGAACTGAATGAGTTTCT TACTCGGGAGCTGGCTGAAGATGGCTACTCTGGA GTTGAGGTGCGAGTTACACCAACCAGGACAGAAA TCATTATCTTAGCCACCAGAACACAGAATGTTCTTG GTGAGAAGGGCCGGCGGATTCGGGAACTGACTGC TGTAGTTCAGAAGAGGTTTGGCTTTCCAGAGGGCA GTGTAGAGCTTTATGCTGAAAAGGTGGCCACTAGA GGTCTGTGTGCCATTGCCCAGGCAGAGTCTCTGC GTTACAAACTCCTAGGAGGGCTTGCTGTGCGGAG GGCCTGCTATGGTGTGCTGCGGTTCATCATGGAG AGTGGGGCCAAAGGCTGCGAGGTTGTGGTGTCTG GGAAACTCCGAGGACAGAGGGCTAAATCCATGAA GTTTGTGGATGGCCTGATGATCCACAGCGGAGAC CCTGTTAACTACTACGTTGACACTGCTGTGCGCCA CGTGTTGCTCAGACAGGGTGTGCTGGGCATCAAG GTGAAGATCATGCTGCCCTGGGACCCAACTGGTA AGATTGGCCCTAAGAAGCCCTGCCTGACCACGTG AGCATTGTGGAACCCAAAGATGAGATACTGCCCAC CACCCCCATCTCAGAACAGAAGGGTGGGAAGCCA GAGCCGCCTGCCATGCCCCAGCCAGTCCCCACAG CATAACAGGGTCTCCTTGGCAGCTGTATTCTGGAG TCTGGATGTTGCTCTCTAAAGACCTTTAATAAAATT TTGTACAAAGACAAAAAAAAAAAAAAAA | 4 | CLTT* |
| 375 | NM_0010 05.3_644 | 644 | CCTTTCCTTTCAGCGGAGCGCGGCGGCAAGATGG CAGTGCAAATATCCAAGAAGAGGAAGTTTGTCGCT GATGGCATCTTCAAAGCTGAACTGAATGAGTTTCT TACTCGGGAGCTGGCTGAAGATGGCTACTCTGGA GTTGAGGTGCGAGTTACACCAACCAGGACAGAAA TCATTATCTTAGCCACCAGAACACAGAATGTTCTTG GTGAGAAGGGCCGGCGGATTCGGGAACTGACTGC TGTAGTTCAGAAGAGGTTTGGCTTTCCAGAGGGCA GTGTAGAGCTTTATGCTGAAAAGGTGGCCACTAGA GGTCTGTGTGCCATTGCCCAGGCAGAGTCTCTGC GTTACAAACTCCTAGGAGGGCTTGCTGTGCGGAG GGCCTGCTATGGTGTGCTGCGGTTCATCATGGAG AGTGGGGCCAAAGGCTGCGAGGTTGTGGTGTCTG GGAAACTCCGAGGACAGAGGGCTAAATCCATGAA GTTTGTGGATGGCCTGATGATCCACAGCGGAGAC CCTGTTAACTACTACGTTGACACTGCTGTGCGCCA CGTGTTGCTCAGACAGGGTGTGCTGGGCATCAAG | 3 | LTT* |

TABLE 3A-continued

| SEQ ID | identifier_position | position | modified_RNA | PAP length | PAP |
|---|---|---|---|---|---|
| | | | GTGAAGATCATGCTGCCCTGGGACCCAACTGGTA<br>AGATTGGCCCTAAGAAGCCCCTGCTGACCACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | | |
| 376 | NM_0010 05.3_649 | 649 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACACGTG<br>AGCATTGTGGAACCCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 1 | T* |
| 377 | NM_0010 05.3_660 | 660 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATGTGGAACCCAAAGATGAGATACTGCCCA<br>CCACCCCCATCTCAGAACAGAAGGGTGGGAAGCC<br>AGAGCCGCCTGCCATGCCCCAGCCAGTCCCCACA<br>GCATAACAGGGTCTCCTTGGCAGCTGTATTCTGGA<br>GTCTGGATGTTGCTCTCTAAAGACCTTTAATAAAAT<br>TTTGTACAAAGACAAAAAAAAAAAAAAAA | 50 | MWNPKMR<br>YCPPPPSQ<br>NRRVGSQ<br>SRLPCPSQ<br>SPQHNRV<br>SLAAVFWS<br>LDVAL* |
| 378 | NM_0010 05.3_666 | 666 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT | 48 | DPKMRYC<br>PPPPSQNR<br>RVGSQSRL<br>PCPSQSP<br>QHNRVSLA<br>AVFWSLDV<br>AL* |

TABLE 3A-continued

| SEQ ID | identifier_position | position | modified_RNA | PAP length | PAP |
|---|---|---|---|---|---|
| | | | GAGCATTGTGGACCCAAAGATGAGATACTGCCCA<br>CCACCCCCATCTCAGAACAGAAGGGTGGGAAGCC<br>AGAGCCGCCTGCCATGCCCCAGCCAGTCCCCACA<br>GCATAACAGGGTCTCCTTGGCAGCTGTATTCTGGA<br>GTCTGGATGTTGCTCTCTAAAGACCTTTAATAAAAT<br>TTTGTACAAAGACAAAAAAAAAAAAAAAA | | |
| 379 | NM_0010<br>05.3_669 | 669 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATTGTGGAACCAAAGATGAGATACTGCCCAC<br>CACCCCCATCTCAGAACAGAAGGGTGGGAAGCCA<br>GAGCCGCCTGCCATGCCCCAGCCAGTCCCCACAG<br>CATAACAGGGTCTCCTTGGCAGCTGTATTCTGGAG<br>TCTGGATGTTGCTCTCTAAAGACCTTTAATAAAATT<br>TTGTACAAAGACAAAAAAAAAAAAAAAA | 45 | MRYCPPP<br>PSQNRRV<br>GSQSRLPC<br>PSQSPQH<br>NRVSLAAV<br>FWSLDVAL* |
| 380 | NM_0010<br>05.3_672 | 672 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATTGTGGAACCAAAGATGAGATACTGCCCA<br>CCACCCCCATCTCAGAACAGAAGGGTGGGAAGCC<br>AGAGCCGCCTGCCATGCCCCAGCCAGTCCCCACA<br>GCATAACAGGGTCTCCTTGGCAGCTGTATTCTGGA<br>GTCTGGATGTTGCTCTCTAAAGACCTTTAATAAAAT<br>TTTGTACAAAGACAAAAAAAAAAAAAAAA | 45 | MRYCPPP<br>PSQNRRV<br>GSQSRLPC<br>PSQSPQH<br>NRVSLAAV<br>FWSLDVAL* |
| 381 | NM_0010<br>05.3_713 | 713 | CCTTTCCTTTCAGCGGAGCGCGGCGGCAAGATGG<br>CAGTGCAAATATCCAAGAAGAGGAAGTTTGTCGCT<br>GATGGCATCTTCAAAGCTGAACTGAATGAGTTTCT<br>TACTCGGGAGCTGGCTGAAGATGGCTACTCTGGA<br>GTTGAGGTGCGAGTTACACCAACCAGGACAGAAA<br>TCATTATCTTAGCCACCAGAACACAGAATGTTCTTG<br>GTGAGAAGGGCCGGCGGATTCGGGAACTGACTGC<br>TGTAGTTCAGAAGAGGTTTGGCTTTCCAGAGGGCA<br>GTGTAGAGCTTTATGCTGAAAAGGTGGCCACTAGA<br>GGTCTGTGTGCCATTGCCCAGGCAGAGTCTCTGC<br>GTTACAAACTCCTAGGAGGGCTTGCTGTGCGGAG<br>GGCCTGCTATGGTGTGCTGCGGTTCATCATGGAG<br>AGTGGGGCCAAAGGCTGCGAGGTTGTGGTGTCTG<br>GGAAACTCCGAGGACAGAGGGCTAAATCCATGAA<br>GTTTGTGGATGGCCTGATGATCCACAGCGGAGAC<br>CCTGTTAACTACTACGTTGACACTGCTGTGCGCCA<br>CGTGTTGCTCAGACAGGGTGTGCTGGGCATCAAG<br>GTGAAGATCATGCTGCCCTGGGACCCAACTGGTA<br>AGATTGGCCCTAAGAAGCCCCTGCCTGACCACGT<br>GAGCATTGTGGAACCCAAAGATGAGATACTGCCCA<br>CCACCCCCATCTCAGAACAGAAGGGTGGGAAGCCA | 32 | VGSQSRLP<br>CPSQSPQ<br>HNRVSLAA<br>VFWSLDVA<br>L* |

TABLE 3A-continued

| SEQ ID | identifier_position | position | modified_RNA | PAP length | PAP |
|---|---|---|---|---|---|
| | | | GAGCCGCCTGCCATGCCCCAGCCAGTCCCCACAG CATAACAGGGTCTCCTTGGCAGCTGTATTCTGGAG TCTGGATGTTGCTCTCTAAAGACCTTTAATAAAATT TTGTACAAAGACAAAAAAAAAAAAAAAA | | |
| 382 | NM_0010 05.3_731 | 731 | CCTTTCCTTTCAGCGGAGCGCGGCGGCAAGATGG CAGTGCAAATATCCAAGAAGAGGAAGTTTGTCGCT GATGGCATCTTCAAAGCTGAACTGAATGAGTTTCT TACTCGGGAGCTGGCTGAAGATGGCTACTCTGGA GTTGAGGTGCGAGTTACACCAACCAGGACAGAAA TCATTATCTTAGCCACCAGAACACAGAATGTTCTTG GTGAGAAGGGCCGGCGGATTCGGGAACTGACTGC TGTAGTTCAGAAGAGGTTTGGCTTTCCAGAGGGCA GTGTAGAGCTTTATGCTGAAAAGGTGGCCACTAGA GGTCTGTGTGCCATTGCCCAGGCAGAGTCTCTGC GTTACAAACTCCTAGGAGGGCTTGCTGTGCGGAG GGCCTGCTATGGTGTGCTGCGGTTCATCATGGAG AGTGGGGCCAAAGGCTGCGAGGTTGTGGTGTCTG GGAAACTCCGAGGACAGAGGGCTAAATCCATGAA GTTTGTGGATGGCCTGATGATCCACAGCGGAGAC CCTGTTAACTACTACGTTGACACTGCTGTGCGCCA CGTGTTGCTCAGACAGGGTGTGCTGGGCATCAAG GTGAAGATCATGCTGCCCTGGGACCCAACTGGTA AGATTGGCCCTAAGAAGCCCCTGCCTGACCACGT GAGCATTGTGGAACCCAAAGATGAGATACTGCCCA CCACCCCCATCTCAGAACAGAAGGGTGGGAAGCC AGAGCCGCTGCCATGCCCCAGCCAGTCCCCACAG CATAACAGGGTCTCCTTGGCAGCTGTATTCTGGAG TCTGGATGTTGCTCTCTAAAGACCTTTAATAAAATT TTGTACAAAGACAAAAAAAAAAAAAAAA | 26 | LPCPSQSP QHNRVSLA AVFWSLDV AL* |
| 383 | NM_0010 05.3_746 | 746 | CCTTTCCTTTCAGCGGAGCGCGGCGGCAAGATGG CAGTGCAAATATCCAAGAAGAGGAAGTTTGTCGCT GATGGCATCTTCAAAGCTGAACTGAATGAGTTTCT TACTCGGGAGCTGGCTGAAGATGGCTACTCTGGA GTTGAGGTGCGAGTTACACCAACCAGGACAGAAA TCATTATCTTAGCCACCAGAACACAGAATGTTCTTG GTGAGAAGGGCCGGCGGATTCGGGAACTGACTGC TGTAGTTCAGAAGAGGTTTGGCTTTCCAGAGGGCA GTGTAGAGCTTTATGCTGAAAAGGTGGCCACTAGA GGTCTGTGTGCCATTGCCCAGGCAGAGTCTCTGC GTTACAAACTCCTAGGAGGGCTTGCTGTGCGGAG GGCCTGCTATGGTGTGCTGCGGTTCATCATGGAG AGTGGGGCCAAAGGCTGCGAGGTTGTGGTGTCTG GGAAACTCCGAGGACAGAGGGCTAAATCCATGAA GTTTGTGGATGGCCTGATGATCCACAGCGGAGAC CCTGTTAACTACTACGTTGACACTGCTGTGCGCCA CGTGTTGCTCAGACAGGGTGTGCTGGGCATCAAG GTGAAGATCATGCTGCCCTGGGACCCAACTGGTA AGATTGGCCCTAAGAAGCCCCTGCCTGACCACGT GAGCATTGTGGAACCCAAAGATGAGATACTGCCCA CCACCCCCATCTCAGAACAGAAGGGTGGGAAGCC AGAGCCGCTGCCATGCCCCAGCCAGTCCCCACAG CATAACAGGGTCTCCTTGGCAGCTGTATTCTGGAG TCTGGATGTTGCTCTCTAAAGACCTTTAATAAAATT TTGTACAAAGACAAAAAAAAAAAAAAAA | 21 | QSPQHNR VSLAAVFW SLDVAL* |
| 384 | NM_0010 06.3_139 | 139 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGAT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCCACTGGGGACGAGACAGGTGCTAAAGTTGAAC | 3 | GMM* |

TABLE 3A-continued

| SEQ ID | identifier_position | position | modified_RNA | PAP length | PAP |
|---|---|---|---|---|---|
| | | | GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | | |
| 385 | NM_0010 06.3_183 | 183 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 25 | MERRSSP GPKEPKLH LMVSRVVC LK* |
| 386 | NM_0010 06.3_222 | 222 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATGCATCTGATGGTCTCAAGGGTCG TGTGTTTGAAGTGAGTCTTGCTGATTTGCAGAATG ATGAAGTTGCATTTAGAAAATTCAAGCTGATTACTG AAGATGTTCAGGGTAAAAACTGCCTGACTAACTTC CATGGCATGGATCTTACCCGTGACAAAATGTGTTC CATGGTCAAAAAATGGCAGACAATGATTGAAGCTC ACGTTGATGTCAAGACTACCGATGGTTACTTGCTT CGTCTGTTCTGTGTTGGTTTTACTAAAAAAACGCAAC AATCAGATACGGAAGACCTCTTATGCTCAGCACCA ACAGGTCCGCCAAATCCGGAAGAAGATGATGGAA ATCATGACCCGAGAGGTGCAGACAAATGACTTGAA AGAAGTGGTCAATAAATTGATTCCAGACAGCATTG GAAAAGACATAGAAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 12 | MHLMVSR VVCLK* |
| 387 | NM_0010 06.3_252 | 252 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTGAAGTGAGTCTTGCTGATTTGCAGAATG ATGAAGTTGCATTTAGAAAATTCAAGCTGATTACTG AAGATGTTCAGGGTAAAAACTGCCTGACTAACTTC CATGGCATGGATCTTACCCGTGACAAAATGTGTTC CATGGTCAAAAAATGGCAGACAATGATTGAAGCTC ACGTTGATGTCAAGACTACCGATGGTTACTTGCTT CGTCTGTTCTGTGTTGGTTTTACTAAAAAAACGCAAC AATCAGATACGGAAGACCTCTTATGCTCAGCACCA ACAGGTCCGCCAAATCCGGAAGAAGATGATGGAA ATCATGACCCGAGAGGTGCAGACAAATGACTTGAA AGAAGTGGTCAATAAATTGATTCCAGACAGCATTG GAAAAGACATAGAAAAGGCTTGCCAATCTATTTAT | 2 | LK* |

TABLE 3A-continued

| SEQ ID | identifier_position | position | modified_RNA | PAP length | PAP |
|---|---|---|---|---|---|
| | | | CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | | |
| 388 | NM_0010 06.3_264 | 264 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTGCTGATTTGCAGAATG ATGAAGTTGCATTTAGAAAATTCAAGCTGATTACTG AAGATGTTCAGGGTAAAAACTGCCTGACTAACTTC CATGGCATGGATCTTACCCGTGACAAAATGTGTTC CATGGTCAAAAAATGGCAGACAATGATTGAAGCTC ACGTTGATGTCAAGACTACCGATGGTTACTTGCTT CGTCTGTTCTGTGTTGGTTTTACTAAAAAACGCAAC AATCAGATACGGAAGACCTCTTATGCTCAGCACCA ACAGGTCCGCCAAATCCGGAAGAAGATGATGGAA ATCATGACCCGAGAGGTGCAGACAAATGACTTGAA AGAAGTGGTCAATAAATTGATTCCAGACAGCATTG GAAAAGACATAGAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 14 | LICRMMKL HLENSS* |
| 389 | NM_0010 06.3_272 | 272 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTGCTGATTGCAGAATG ATGAAGTTGCATTTAGAAAATTCAAGCTGATTACTG AAGATGTTCAGGGTAAAAACTGCCTGACTAACTTC CATGGCATGGATCTTACCCGTGACAAAATGTGTTC CATGGTCAAAAAATGGCAGACAATGATTGAAGCTC ACGTTGATGTCAAGACTACCGATGGTTACTTGCTT CGTCTGTTCTGTGTTGGTTTTACTAAAAAACGCAAC AATCAGATACGGAAGACCTCTTATGCTCAGCACCA ACAGGTCCGCCAAATCCGGAAGAAGATGATGGAA ATCATGACCCGAGAGGTGCAGACAAATGACTTGAA AGAAGTGGTCAATAAATTGATTCCAGACAGCATTG GAAAAGACATAGAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 12 | CRMMKLH LENSS* |
| 390 | NM_0010 06.3_471 | 471 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTGGTTTTACTAAAAAACGCAAC AATCAGATACGGAAGACCTCTTATGCTCAGCACCA | 27 | VLLKNATIR YGRPLMLS TNRSAKSG RR* |

TABLE 3A-continued

| SEQ ID | identifier_position | position | modified_RNA | PAP length | PAP |
|---|---|---|---|---|---|
| | | | ACAGGTCCGCCAAATCCGGAAGAAGATGATGGAA<br>ATCATGACCCGAGAGGTGCAGACAAATGACTTGAA<br>AGAAGTGGTCAATAAATTGATTCCAGACAGCATTG<br>GAAAAGACATAGAAAAGGCTTGCCAATCTATTTAT<br>CCTCTCCATGATGTCTTCGTTAGAAAAGTAAAAATG<br>CTGAAGAAGCCCAAGTTTGAATTGGGAAAGCTCAT<br>GGAGCTTCATGGTGAAGGCAGTAGTTCTGGAAAA<br>GCCACTGGGGACGAGACAGGTGCTAAAGTTGAAC<br>GAGCTGATGGATATGAACCACCAGTCCAAGAATCT<br>GTTTAAAGTTCAGACTTCAAATAGTGGCAAATAAAA<br>AGTGCTATTTGTGATGGTTTGCTTCTGAAAAAAAAA<br>AAAAAAAAAAAAAAAAAA | | |
| 391 | NM_0010<br>06.3_538 | 538 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT<br>CCATGGTCAAAAAATGGCAGACAATGATTGAAGCT<br>CACGTTGATGTCAAGACTACCGATGGTTACTTGCT<br>TCGTCTGTTCTGTGTTGGTTTTACTAAAAAACGCAA<br>CAATCAGATACGGAAGACCTCTTATGCTCAGCACC<br>AACAGGTCCGCAAATCCGGAAGAAGATGATGGAA<br>ATCATGACCCGAGAGGTGCAGACAAATGACTTGAA<br>AGAAGTGGTCAATAAATTGATTCCAGACAGCATTG<br>GAAAAGACATAGAAAAGGCTTGCCAATCTATTTAT<br>CCTCTCCATGATGTCTTCGTTAGAAAAGTAAAAATG<br>CTGAAGAAGCCCAAGTTTGAATTGGGAAAGCTCAT<br>GGAGCTTCATGGTGAAGGCAGTAGTTCTGGAAAA<br>GCCACTGGGGACGAGACAGGTGCTAAAGTTGAAC<br>GAGCTGATGGATATGAACCACCAGTCCAAGAATCT<br>GTTTAAAGTTCAGACTTCAAATAGTGGCAAATAAAA<br>AGTGCTATTTGTGATGGTTTGCTTCTGAAAAAAAAA<br>AAAAAAAAAAAAAAAAAA | 5 | KSGRR* |
| 392 | NM_0010<br>06.3_587 | 587 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT<br>CCATGGTCAAAAAATGGCAGACAATGATTGAAGCT<br>CACGTTGATGTCAAGACTACCGATGGTTACTTGCT<br>TCGTCTGTTCTGTGTTGGTTTTACTAAAAAACGCAA<br>CAATCAGATACGGAAGACCTCTTATGCTCAGCACC<br>AACAGGTCCGCCAAATCCGGAAGAAGATGATGGA<br>AATCATGACCCGAGAGGTGCAGACAAATGACTTGAA<br>AGAAGTGGTCAATAAATTGATTCCAGACAGCATTG<br>GAAAAGACATAGAAAAGGCTTGCCAATCTATTTAT<br>CCTCTCCATGATGTCTTCGTTAGAAAAGTAAAAATG<br>CTGAAGAAGCCCAAGTTTGAATTGGGAAAGCTCAT<br>GGAGCTTCATGGTGAAGGCAGTAGTTCTGGAAAA<br>GCCACTGGGGACGAGACAGGTGCTAAAGTTGAAC<br>GAGCTGATGGATATGAACCACCAGTCCAAGAATCT<br>GTTTAAAGTTCAGACTTCAAATAGTGGCAAATAAAA<br>AGTGCTATTTGTGATGGTTTGCTTCTGAAAAAAAAA<br>AAAAAAAAAAAAAAAAAA | 2 | MT* |
| 393 | NM_0010<br>06.3_608 | 608 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT | 2 | IN* |

TABLE 3A-continued

| SEQ ID | identifier_position | position | modified_RNA | PAP length | PAP |
|---|---|---|---|---|---|
| | | | CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCATAAATTGATTCCAGACAGCATTG GAAAAGACATAGAAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | | |
| 394 | NM_0010 06.3_614 | 614 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATGATTCCAGACAGCATTG GAAAAGACATAGAAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 0 | * |
| 395 | NM_0010 06.3_630 | 630 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATG GAAAAGACATAGAAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 4 | MEKT* |
| 396 | NM_0010 06.3_636 | 636 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC | 1 | T* |

TABLE 3A-continued

| SEQ ID | identifier_position | position | modified_RNA | PAP length | PAP |
|---|---|---|---|---|---|
| | | | GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | | |
| 397 | NM_0010 06.3_650 | 650 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGTTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 15 | VANLFILSM MSSLEK* |
| 398 | NM_0010 06.3_652 | 652 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTGCCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 14 | ANLFILSM MSSLEK* |
| 399 | NM_0010 06.3_655 | 655 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA | 13 | NLFILSMM SSLEK* |

TABLE 3A-continued

| SEQ ID | identifier_position | position | modified_RNA | length PAP | PAP |
|---|---|---|---|---|---|
| | | | AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCAATCTATTTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | | |
| 400 | NM_0010 06.3_664 | 664 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTAT CCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 10 | ILSMMSSL EK* |
| 401 | NM_0010 06.3_668 | 668 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCTCTCCATGATGTCTTCGTTAGAAAAGTAAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA | 9 | LSMMSSLE K* |

| SEQ ID | identifier_position | position | modified_RNA | PAP length | PAP |
|---|---|---|---|---|---|
| | | | AGTGCTATTTGTGATGGTTTGCTTCTGAAAAAAAAA AAAAAAAAAAAAAAAAAA | | |
| 402 | NM_0010 06.3_700 | 700 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAATG CTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 1 | C* |
| 403 | NM_0010 06.3_703 | 703 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAT GTGAAGAAGCCCAAGTTTGAATTGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAA | 0 | * |
| 404 | NM_0010 06.3_714 | 714 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCAT GGAGCTTCATGGTGAAGGCAGTAGTTCTGGAAAA | 52 | SLNWESS WSFMVKA VVLEKPLG TRQVLKLN ELMDMNH QSKNLFKV QTSNSGK* |

TABLE 3A-continued

| SEQ ID | identifier_position | position | modified_RNA | PAP length | PAP |
|---|---|---|---|---|---|
| | | | GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | | |
| 405 | NM_0010 06.3_720 | 720 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTGAATGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 51 | LNWESSW SFMVKAVV LEKPLGTR QVLKLNEL MDMNHQS KNLFKVQT SNSGK* |
| 406 | NM_0010 06.3_725 | 725 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATGGGAAAGCTCAT GGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCT GTTTAAAGTTCAGACTTCAAATAGTGGCAAATAAAA AGTGCTATTTGTGATGGTTTGCTTCTGAAAAAAAAA AAAAAAAAAAAAAAAAAAA | 49 | WESSWSF MVKAVVLE KPLGTRQV LKLNELMD MNHQSKN LFKVQTSN SGK* |
| 407 | NM_0010 06.3_744 | 744 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT | 42 | MVKAVVLE KPLGTRQV LKLNELMD MNHQSKN LFKVQTSN SGK* |

TABLE 3A-continued

| SEQ ID | identifier_position | position | modified_RNA | PAP length | PAP |
|---|---|---|---|---|---|
| | | | GGAAAAGACATAGAAAAGGCTTGCCAATCTATTTA<br>TCCTCTCCATGATGTCTTCGTTAGAAAAGTAAAAAT<br>GCTGAAGAAGCCCAAGTTTGAATTGGGAAAGCTCA<br>TGGAGCTCATGGTGAAGGCAGTAGTTCTGGAAAA<br>GCCACTGGGGACGAGACAGGTGCTAAAGTTGAAC<br>GAGCTGATGGATATGAACCACCAGTCCAAGAATCT<br>GTTTAAAGTTCAGACTTCAAATAGTGGCAAATAAAA<br>AGTGCTATTTGTGATGGTTTGCTTCTGAAAAAAAAA<br>AAAAAAAAAAAAAAAAAAA | | |
| 408 | NM_0010<br>06.3_763 | 763 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT<br>CCATGGTCAAAAAATGGCAGACAATGATTGAAGCT<br>CACGTTGATGTCAAGACTACCGATGGTTACTTGCT<br>TCGTCTGTTCTGTGTTGGTTTTACTAAAAAACGCAA<br>CAATCAGATACGGAAGACCTCTTATGCTCAGCACC<br>AACAGGTCCGCCAAATCCGGAAGAAGATGATGGA<br>AATCATGACCCGAGAGGTGCAGACAAATGACTTGA<br>AAGAAGTGGTCAATAAATTGATTCCAGACAGCATT<br>GGAAAAGACATAGAAAAGGCTTGCCAATCTATTTA<br>TCCTCTCCATGATGTCTTCGTTAGAAAAGTAAAAAT<br>GCTGAAGAAGCCCAAGTTTGAATTGGGAAAGCTCA<br>TGGAGCTTCATGGTGAAGGCAGTAGTCTGGAAAA<br>GCCACTGGGGACGAGACAGGTGCTAAAGTTGAAC<br>GAGCTGATGGATATGAACCACCAGTCCAAGAATCT<br>GTTTAAAGTTCAGACTTCAAATAGTGGCAAATAAAA<br>AGTGCTATTTGTGATGGTTTGCTTCTGAAAAAAAAA<br>AAAAAAAAAAAAAAAAAAA | 36 | LEKPLGTR<br>QVLKLNEL<br>MDMNHQS<br>KNLFKVQT<br>SNSGK* |
| 409 | NM_0010<br>06.3_772 | 772 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT<br>CCATGGTCAAAAAATGGCAGACAATGATTGAAGCT<br>CACGTTGATGTCAAGACTACCGATGGTTACTTGCT<br>TCGTCTGTTCTGTGTTGGTTTTACTAAAAAACGCAA<br>CAATCAGATACGGAAGACCTCTTATGCTCAGCACC<br>AACAGGTCCGCCAAATCCGGAAGAAGATGATGGA<br>AATCATGACCCGAGAGGTGCAGACAAATGACTTGA<br>AAGAAGTGGTCAATAAATTGATTCCAGACAGCATT<br>GGAAAAGACATAGAAAAGGCTTGCCAATCTATTTA<br>TCCTCTCCATGATGTCTTCGTTAGAAAAGTAAAAAT<br>GCTGAAGAAGCCCAAGTTTGAATTGGGAAAGCTCA<br>TGGAGCTTCATGGTGAAGGCAGTAGTTCTGGAAAA<br>CCACTGGGGACGAGACAGGTGCTAAAGTTGAACG<br>AGCTGATGGATATGAACCACCAGTCCAAGAATCTG<br>TTTAAAGTTCAGACTTCAAATAGTGGCAAATAAAA<br>GTGCTATTTGTGATGGTTTGCTTCTGAAAAAAAAA<br>AAAAAAAAAAAAAAAAAA | 33 | PLGTRQVL<br>KLNELMDM<br>NHQSKNLF<br>KVQTSNSG<br>K* |
| 410 | NM_0010<br>06.3_774 | 774 | AAGTTCTCGCGCGACTCCCACTTCCGCCCTTTTGG<br>CTCTCTGACCAGCACCATGGCGGTTGGCAAGAAC<br>AAGCGCCTTACGAAAGGCGGCAAAAAGGGAGCCA<br>AGAAGAAAGTGGTTGATCCATTTTCTAAGAAAGATT<br>GGTATGATGTGAAAGCACCTGCTATGTTCAATATA<br>AGAAATATTGGAAAGACGCTCGTCACCAGGACCCA<br>AGGAACCAAAATTGCATCTGATGGTCTCAAGGGTC<br>GTGTGTTTGAAGTGAGTCTTGCTGATTTGCAGAAT<br>GATGAAGTTGCATTTAGAAAATTCAAGCTGATTACT<br>GAAGATGTTCAGGGTAAAAACTGCCTGACTAACTT<br>CCATGGCATGGATCTTACCCGTGACAAAATGTGTT<br>CCATGGTCAAAAAATGGCAGACAATGATTGAAGCT<br>CACGTTGATGTCAAGACTACCGATGGTTACTTGCT<br>TCGTCTGTTCTGTGTTGGTTTTACTAAAAAACGCAA | 32 | LGTRQVLK<br>LNELMDM<br>NHQSKNLF<br>KVQTSNSG<br>K* |

TABLE 3A-continued

| SEQ ID | identifier_position | position | modified_RNA | PAP length | PAP |
|---|---|---|---|---|---|
| | | | CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCACTGGGGACGAGACAGGTGCTAAAGTTGAACG AGCTGATGGATATGAACCACCAGTCCAAGAATCTG TTTAAAGTTCAGACTTCAAATAGTGGCAAATAAAAA GTGCTATTTGTGATGGTTTGCTTCTGAAAAAAAAAA AAAAAAAAAAAAAAAAA | | |
| 411 | NM_0010 06.3_809 | 809 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCCACTGGGGACGAGACAGGTGCTAAAGTTGAAC GAGTGATGGATATGAACCACCAGTCCAAGAATCTG TTTAAAGTTCAGACTTCAAATAGTGGCAAATAAAAA GTGCTATTTGTGATGGTTTGCTTCTGAAAAAAAAAA AAAAAAAAAAAAAAAAA | 21 | VMDMNHQ SKNLFKVQ TSNSGK* |
| 412 | NM_0010 06.3_824 | 824 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCCACTGGGGACGAGACAGGTGCTAAAGTTGAAC GAGCTGATGGATATGAACCACCAGTCCAAGAATCTG TTTAAAGTTCAGACTTCAAATAGTGGCAAATAAAAA GTGCTATTTGTGATGGTTTGCTTCTGAAAAAAAAAA AAAAAAAAAAAAAAAAA | 16 | HQSKNLFK VQTSNSGK* |
| 413 | NM_0010 06.3_827 | 827 | AAGTTCTCGCGCGACTCCCACTTCCGCCCTTTTGG CTCTCTGACCAGCACCATGGCGGTTGGCAAGAAC AAGCGCCTTACGAAAGGCGGCAAAAAGGGAGCCA AGAAGAAAGTGGTTGATCCATTTTCTAAGAAAGATT GGTATGATGTGAAAGCACCTGCTATGTTCAATATA AGAAATATTGGAAAGACGCTCGTCACCAGGACCCA AGGAACCAAAATTGCATCTGATGGTCTCAAGGGTC GTGTGTTTGAAGTGAGTCTTGCTGATTTGCAGAAT GATGAAGTTGCATTTAGAAAATTCAAGCTGATTACT GAAGATGTTCAGGGTAAAAACTGCCTGACTAACTT | 15 | QSKNLFKV QTSNSGK* |

TABLE 3A-continued

| SEQ ID | identifier_position | position | modified_RNA | PAP length | PAP |
|---|---|---|---|---|---|
| | | | CCATGGCATGGATCTTACCCGTGACAAAATGTGTT CCATGGTCAAAAAATGGCAGACAATGATTGAAGCT CACGTTGATGTCAAGACTACCGATGGTTACTTGCT TCGTCTGTTCTGTGTTGGTTTTACTAAAAAACGCAA CAATCAGATACGGAAGACCTCTTATGCTCAGCACC AACAGGTCCGCCAAATCCGGAAGAAGATGATGGA AATCATGACCCGAGAGGTGCAGACAAATGACTTGA AAGAAGTGGTCAATAAATTGATTCCAGACAGCATT GGAAAAGACATAGAAAAGGCTTGCCAATCTATTTA TCCTCTCCATGATGTCTTCGTTAGAAAAGTAAAAAT GCTGAAGAAGCCCAAGTTTGAATTGGGAAAGCTCA TGGAGCTTCATGGTGAAGGCAGTAGTTCTGGAAAA GCCACTGGGGACGAGACAGGTGCTAAAGTTGAAC GAGCTGATGGATATGAACCACAGTCCAAGAATCTG TTTAAAGTTCAGACTTCAAATAGTGGCAAATAAAAA GTGCTATTTGTGATGGTTTGCTTCTGAAAAAAAAAA AAAAAAAAAAAAAAAAA | | |
| 414 | NM_0010 07553.1_ 2056 | 2056 | GAGAGAAGCGAGATTTATTCCTACGTACCGGGCC GTGCTGCTTATGGCGGCGCTGGAGAGGGGGCGC TGAGCTGTTGGGTATGAAGTGTAACAGAACAGACT TTACCACCTGAAACTGCTGCTTCAAGTTCAGATCA GGCAAGGAACAAACCTCGTAACAACTAACAAGACC AAAGAAGAGTACACTTAAGTTGAAGACACAACACT TGATCTGAAACAAGAAGTTTGTGCCTACTCAACAG CTTTGAAAGAGCACTTCCCAACGCTGCTAGTAGTC TTTGTTTTCTTCAGTGCTGTACTGTGAGATTGCCCG GTACAGCAGCAGTTGTATTCTTTATTAGCTTGGTAG ATCATTTTCTCTCGCTCTTTTTTTTAATACTAGCAAC TTTCATCCTTTGAAACGTGTGCTGAAAAAGAAGAAT CAGCAAATACTACTGAAAGTGCAATATTTGAGTATC ACTGCGAGATGAGCTTTGATCCAAACCTTCTCCAC AACAATGGACATAATGGGTACCCTAATGGTACTTC AGCAGCACTGCGTGAAACTGGGGTTATTGAAAAAC TGTTAACCTCTTACGGATTTATTCAGTGTTCAGAAC GTCAAGCTAGACTTTTCTTCCACTGTTCACAGTATA ATGGCAACCTGCAAGACTTAAAAGTAGGAGATGAT GTTGAATTTGAAGTATCATCGGACCGACGGACTGG GAAACCCATTGCTGTTAAACTGGTGAAGATAAAAC AAGAAATCCTCCCTGAAGAACGAATGAATGGACAA GTTGTGTGCGCTGTTCCTCACAACTTAGAGAGTAA ATCTCCAGCTGCCCCGGGTCAGAGTCCAACAGGG AGTGTATGCTACGAACGTAATGGGGAAGTGTTTTA TCTGACTTACACCCCTGAAGATGTCGAAGGGAACG TTCAGCTGGAAACTGGAGATAAAATAAACTTTGTAA TTGATAACAATAAACATACTGGTGCTGTAAGTGCT CGCAACATTATGCTGTTGAAAAAGAAACAAGCCCG CTGT | 49 | LDLLKQPI MIRKSFSIT VSSLVMLIA WNWGTWS SIACPKAK ATKSVQKK* |
| 415 | NM_0010 07553.1_ 2521 | 2521 | GAGAGAAGCGAGATTTATTCCTACGTACCGGGCC GTGCTGCTTATGGCGGCGCTGGAGAGGGGGCGC TGAGCTGTTGGGTATGAAGTGTAACAGAACAGACT TTACCACCTGAAACTGCTGCTTCAAGTTCAGATCA GGCAAGGAACAAACCTCGTAACAACTAACAAGACC AAAGAAGAGTACACTTAAGTTGAAGACACAACACT TGATCTGAAACAAGAAGTTTGTGCCTACTCAACAG CTTTGAAAGAGCACTTCCCAACGCTGCTAGTAGTC TTTGTTTTCTTCAGTGCTGTACTGTGAGATTGCCCG GTACAGCAGCAGTTGTATTCTTTATTAGCTTGGTAG ATCATTTTCTCTCGCTCTTTTTTTTAATACTAGCAAC TTTCATCCTTTGAAACGTGTGCTGAAAAAGAAGAAT CAGCAAATACTACTGAAAGTGCAATATTTGAGTATC ACTGCGAGATGAGCTTTGATCCAAACCTTCTCCAC AACAATGGACATAATGGGTACCCTAATGGTACTTC AGCAGCACTGCGTGAAACTGGGGTTATTGAAAAAC TGTTAACCTCTTACGGATTTATTCAGTGTTCAGAAC GTCAAGCTAGACTTTTCTTCCACTGTTCACAGTATA ATGGCAACCTGCAAGACTTAAAAGTAGGAGATGAT GTTGAATTTGAAGTATCATCGGACCGACGGACTGG GAAACCCATTGCTGTTAAACTGGTGAAGATAAAAC AAGAAATCCTCCCTGAAGAACGAATGAATGGACAA GTTGTGTGCGCTGTTCCTCACAACTTAGAGAGTAA ATCTCCAGCTGCCCCGGGTCAGAGTCCAACAGGG AGTGTATGCTACGAACGTAATGGGGAAGTGTTTTA TCTGACTTACACCCCTGAAGATGTCGAAGGGAACG TTCAGCTGGAAACTGGAGATAAAATAAACTTTGTAA TTGATAACAATAAACATACTGGTGCTGTAAGTGCT CGCAACATTATGCTGTTGAAAAAGAAACAAGCCCG CTGT | 7 | LASLTMK* |

TABLE 3A-continued

| SEQ ID | identifier_position | position | modified_RNA | PAP length | PAP |
|---|---|---|---|---|---|
| 416 | NM_0010 07553.1_ 2672 | 2672 | GAGAGAAGCGAGATTATTCCTACGTACCGGCC GTGCTGCTTATGGCGGCGCTGGAGAGGGGGCGC TGAGCTGTTGGGTATGAAGTGTAACAGAACAGACT TTACCACCTGAAACTGCTGCTTCAAGTTCAGATCA GGCAAGGAACAAACCTCGTAACAACTAACAAGACC AAAGAAGAGTACACTTAAGTTGAAGACACAACACT TGATCTGAAACAAGAAGTTTGTGCCTACTCAACAG CTTTGAAAGAGCACTTCCCAACGCTGCTAGTAGTC TTTGTTTTCTTCAGTGCTGTACTGTGAGATTGCCCG GTACAGCAGCAGTTGTATTCTTTATTAGCTTGGTAG ATCATTTTCTCTCGCTCTTTTTTTTAATACTAGCAAC TTTCATCCTTTGAAACGTGTGCTGAAAAAGAAGAAT CAGCAAATACTACTGAAAGTGCAATATTTGAGTATC ACTGCGAGATGAGCTTTGATCCAAACCTTCTCCAC AACAATGGACATAATGGGTACCCTAATGGTACTTC AGCAGCACTGCGTGAAACTGGGGTTATTGAAAAAC TGTTAACCTCTTACGGATTTATTCAGTGTTCAGAAC GTCAAGCTAGACTTTTCTTCCACTGTTCACAGTATA ATGGCAACCTGCAAGACTTAAAAGTAGGAGATGAT GTTGAATTTGAAGTATCATCGGACCGACGGACTGG GAAACCCATTGCTGTTAAACTGGTGAAGATAAAAC AAGAAATCCTCCCTGAAGAACGAATGAATGGACAA GTTGTGTGCGCTGTTCCTCACAACTTAGAGAGTAA ATCTCCAGCTGCCCCGGGTCAGAGTCCAACAGGG AGTGTATGCTACGAACGTAATGGGGAAGTGTTTTA TCTGACTTACACCCCTGAAGATGTCGAAGGGAACG TTCAGCTGGAAACTGGAGATAAAATAAACTTTGTAA TTGATAACAATAAACATACTGGTGCTGTAAGTGCT CGCAACATTATGCTGTTGAAAAAGAAACAAGCCCG CTGT | 21 | GESVRAPR LLQLLDLIG WSIA* |
| 417 | NM_0010 07553.1_ 2821 | 2821 | GAGAGAAGCGAGATTATTCCTACGTACCGGCC GTGCTGCTTATGGCGGCGCTGGAGAGGGGGCGC TGAGCTGTTGGGTATGAAGTGTAACAGAACAGACT TTACCACCTGAAACTGCTGCTTCAAGTTCAGATCA GGCAAGGAACAAACCTCGTAACAACTAACAAGACC AAAGAAGAGTACACTTAAGTTGAAGACACAACACT TGATCTGAAACAAGAAGTTTGTGCCTACTCAACAG CTTTGAAAGAGCACTTCCCAACGCTGCTAGTAGTC TTTGTTTTCTTCAGTGCTGTACTGTGAGATTGCCCG GTACAGCAGCAGTTGTATTCTTTATTAGCTTGGTAG ATCATTTTCTCTCGCTCTTTTTTTTAATACTAGCAAC TTTCATCCTTTGAAACGTGTGCTGAAAAAGAAGAAT CAGCAAATACTACTGAAAGTGCAATATTTGAGTATC ACTGCGAGATGAGCTTTGATCCAAACCTTCTCCAC AACAATGGACATAATGGGTACCCTAATGGTACTTC AGCAGCACTGCGTGAAACTGGGGTTATTGAAAAAC TGTTAACCTCTTACGGATTTATTCAGTGTTCAGAAC GTCAAGCTAGACTTTTCTTCCACTGTTCACAGTATA ATGGCAACCTGCAAGACTTAAAAGTAGGAGATGAT GTTGAATTTGAAGTATCATCGGACCGACGGACTGG GAAACCCATTGCTGTTAAACTGGTGAAGATAAAAC AAGAAATCCTCCCTGAAGAACGAATGAATGGACAA GTTGTGTGCGCTGTTCCTCACAACTTAGAGAGTAA ATCTCCAGCTGCCCCGGGTCAGAGTCCAACAGGG AGTGTATGCTACGAACGTAATGGGGAAGTGTTTTA TCTGACTTACACCCCTGAAGATGTCGAAGGGAACG TTCAGCTGGAAACTGGAGATAAAATAAACTTTGTAA TTGATAACAATAAACATACTGGTGCTGTAAGTGCT CGCAACATTATGCTGTTGAAAAAGAAACAAGCCCG CTGT | 22 | LVQKERSV KLVSLTNHI HKAHH* |
| 418 | NM_0010 08883.1_ 1449 | 1449 | GGCCGTTCTTGCGTAGGGGGCGGGACTAAGGCTG TCAATTGGTCTGTTTTTGTGCCGATCAATGAGATG GGTGCGGTGATTGGCGACTACCTTGAGAGTAGCG GGTTGAGGTGTAAGCCCTGAGGAGGCAGCGTTTT CTGGGCTTCTGTCTGGTTCTCTCTCTCCAGAAGGT TCTGCCGGTTCCCCCAGCTCTGGGTACCCGGCTC TGCATCGCGTCGCCATGATGGGCCATCGTCCAGT GCTCGTGCTCAGCCAGAACACAAAGCGTGAATCC GGAAGAAAAGTTCAATCTGGAAACATCAATGCTGC CAAGACTATTGCAGATATCATCCGAACATGTTTGG GACCCAAGTCCATGATGAAGATGCTTTTGGACCCA ATGGGAGGCATTGTGATGACCAATGATGGCAATG CCATTCTTCGAGAGATTCAAGTCCAGCATCCAGCG GCCAAGTCCATGATCGAAATTAGCCGGACCCAGG ATGAAGAGGTTGGAGATGGGACCACATCAGTAATT ATTCTTGGGGAAATGCTGTCTGTAGCTGAGCACTT CCTGGAGCAGCAGATGCACCCAACAGTGGTGATC | 11 | VGPPRWL WPMP* |

TABLE 3A-continued

| SEQ ID | identifier_position | position | modified_RNA | PAP length | PAP |
|---|---|---|---|---|---|
| | | | AGTGCTTACCGCAAGGCATTGGATGATATGATCAG<br>CACCCTAAAGAAAATAAGTATCCCAGTCGACATCA<br>GTGACAGTGATATGATGCTGAACATCATCAACAGC<br>TCTATTACTACCAAAGCCATCAGTCGGTGGTCATC<br>TTTGGCTTGCAACATTGCCCTGGATGCTGTCAAGA<br>TGGTACAGTTTGAGGAGAATGGTCGGAAAGAGATT<br>GACATAAAAAAATATGCAAGAGTGGAAAAGATACC<br>TGGAGGCATCATTGAAGACTCCTGTGTCTTGCGTG<br>GAGTCATGATTAACAAGGATGTGACCCATCCACGT<br>ATGCGGCGCTATATCAAGAACCCTCGCATTGTGCT<br>GCTGGATTCTTCTCTGGAATACAAGAAAGGAGAAA<br>GCCAGACTGACATTGAGATTACACGAGAGGAGGA<br>CTTCACCCGAATTCTCCAG | | |
| 419 | NM_0010<br>08897.1_<br>1049 | 1049 | GTCCTGTTTCTCTCCCTGTTGTCCCTGCCTCTTTTT<br>CCTTCCCGCCGTGCCCCGCGGCCGGGCCGGGGC<br>AGCCGGGAAGCGGGTGGGGTGGTGTGTTACCCA<br>GTAGCTCCTGGGACATCGCTCGGGTACGCTCCAC<br>GCCGTCGCAGCCACTGCTGTGGTCGCCGGTCGGC<br>CGAGGGGCCGCGATACTGGTTGCCCGCGGTGTAA<br>GCAGAATTCGACGTGTATCGCTGCCGTCAAGATG<br>GAGGGGCCTTTGTCCGTGTTCGGTGACCGCAGCA<br>CTGGGGAAACGATCCGCTCCCAAAACGGATGTAA<br>CCATTACTAACGATGGTGCAACCATCCTGAAGTTA<br>CTGGAGGTAGAACATCCTGCAGCTAAAGTTCTTTG<br>TGAGCTGGCTGATCTGCAAGACAAAGAAGTTGGA<br>GATGGAACTACTTCAGTGGTTATTATTGCAGCAGA<br>ACTCCTAAAAAATGCAGATGAATTAGTCAAACAGA<br>AAATTCATCCCACATCAGTTATTAGTGGCTATCGAC<br>TTGCTTGCAAGGAAGCAGTGCGTTATATCAATGAA<br>AACCTAATTGTTAACACAGATGAACTGGGAAGAGA<br>TTGCCTGATTAATGCTGCTAAGACATCCATGTCTTC<br>CAAAATCATTGGAATAAATGGTGATTTCTTTGCTAA<br>CATGGTAGTAGATGCTGTACTTGCTATTAAATACAC<br>AGACATAAGAGGCCAGCCACGCTATCCAGTCAACT<br>CTGTTAATATTTTGAAAGCCCATGGGAGAAGTCAA<br>ATGGAGAGTATGCTCATCAGTGGCTATGCACTCAA<br>CTGTGTGGTGGGATCCCAGGGCATGCCCAAGAGA<br>ATCGTAAATGCAAAAATTGCTTGCCTTGACTTCAG<br>CCTGCAAAAAACAAAAATGAAGCTTGGTGTACAGG<br>TGGTCATTACAGACCCTGAAAAACTGGACCAAATT<br>AGACAGAGAGAATCAGATATCACCAAGGAGAGAAT<br>TCAGAAGATCCTGGCAACTGGTGCCAATGTTATTC<br>TAACCACTGGTGGAAT | 12 | LWRLVLW<br>QLEEF* |
| 420 | NM_0010<br>09.3_132 | 132 | CTCTTCCTGTCTGTACCAGGGCGGCGCGTGGTCT<br>ACGCCGAGTGACAGAGACGCTCAGGCTGTGTTCT<br>CAGGATGACCGAGTGGGAGACAGCAGCACCAGC<br>GGTGGCAGAGACCCCAGACATCAAGCTCTTGGGA<br>AGTGGAGCACCGATGATGTGCAGATCAATGACATT<br>TCCCTGCAGGATTACATTGCAGTGAAGGAGAAGTA<br>TGCCAAGTACCTGCCTCACAGTGCAGGGCGGTAT<br>GCCGCCAAAACGCTTCCGCAAAGCTCAGTGTCCCA<br>TTGTGGAGCGCCTCACTAACTCCATGATGATGCAC<br>GGCCGCAACAACGGCAAGAAGCTCATGACTGTGC<br>GCATCGTCAAGCATGCCTTCGAGATCATACACCTG<br>CTCACAGGCGAGAACCCTCTGCAGGTCCTGGTGA<br>ACGCCATCATCAACAGTGGTCCCCGGGAGGACTC<br>CACACGCATTGGGCGCGCGGGACTGTGAGACGA<br>CAGGCTGTGGATGTGTCCCCCCTGCGCCGTGTGA<br>ACCAGGCCATCTGGCTGCTGTGCACAGGCGCTCG<br>TGAGGCTGCCTTCCGGAACATTAAGACCATTGCTG<br>AGTGCCTGGCAGATGAGCTCATCAATGCTGCCAA<br>GGGCTCCTCGAACTCCTATGCCATTAAGAAGAAGG<br>ACGAGCTGGAGCGTGTGGCCAAGTCCAACCGCTG<br>ATTTTCCCAGCTGCTGCCCAATAAACCTGTCTGCC<br>CTTTGGGGCAGTCCCAGCCAAAAAAAAAAAAAAA | 21 | LGSGAPM<br>MCRSMTF<br>PCRITLQ* |
| 421 | NM_0010<br>09.3_313 | 313 | CTCTTCCTGTCTGTACCAGGGCGGCGCGTGGTCT<br>ACGCCGAGTGACAGAGACGCTCAGGCTGTGTTCT<br>CAGGATGACCGAGTGGGAGACAGCAGCACCAGC<br>GGTGGCAGAGACCCCAGACATCAAGCTCTTTGGG<br>AAGTGGAGCACCGATGATGTGCAGATCAATGACAT<br>TTCCCTGCAGGATTACATTGCAGTGAAGGAGAAGT<br>ATGCCAAGTACCTGCCTCACAGTGCAGGGCGGTA<br>TGCCGCCAAAACGCTTCCGCAAAGCTCAGTGTCCC<br>ATTGTGGAGCGCCTCACTAACTCCATGATGATGCA<br>CGGCGCAACAACGGCAAGAAGCTCATGACTGTGC<br>GCATCGTCAAGCATGCCTTCGAGATCATACACCTG<br>CTCACAGGCGAGAACCCTCTGCAGGTCCTGGTGA | 7 | ATTARSS* |

TABLE 3A-continued

| SEQ ID | identifier_position | position | modified_RNA | PAP length | PAP |
|---|---|---|---|---|---|
| | | | ACGCCATCATCAACAGTGGTCCCCGGGAGGACTC CACACGCATTGGGCGCGCCGGGACTGTGAGACGA CAGGCTGTGGATGTGTCCCCCCTGCGCCGTGTGA ACCAGGCCATCTGGCTGCTGTGCACAGGCGCTCG TGAGGCTGCCTTCCGGAACATTAAGACCATTGCTG AGTGCCTGGCAGATGAGCTCATCAATGCTGCCAA GGGCTCCTCGAACTCCTATGCCATTAAGAAGAAGG ACGAGCTGGAGCGTGTGGCCAAGTCCAACCGCTG ATTTTCCCAGCTGCTGCCCAATAAACCTGTCTGCC CTTTGGGGCAGTCCCAGCCAAAAAAAAAAAAAAA | | |
| 422 | NM_0010 09.3_522 | 522 | CTCTTCCTGTCTGTACCAGGGCGGCGCGTGGTCT ACGCCGAGTGACAGAGACGCTCAGGCTGTGTTCT CAGGATGACCGAGTGGGAGACAGCAGCACCAGC GGTGGCAGAGACCCCAGACATCAAGCTCTTTGGG AAGTGGAGCACCGATGATGTGCAGATCAATGACAT TCCCTGCAGGATTACATTGCAGTGAAGGAGAAGT ATGCCAAGTACCTGCCTCACAGTGCAGGGCGGTA TGCCGCCAAACGCTTCCGCAAAGCTCAGTGTCCC ATTGTGGAGCGCCTCACTAACTCCATGATGATGCA CGGCCGCAACAACGGCAAGAAGCTCATGACTGTG CGCATCGTCAAGCATGCCTTCGAGATCATACACCT GCTCACAGGCGAGAACCCTCTGCAGGTCCTGGTG AACGCCATCATCAACAGTGGTCCCCGGGAGGACT CCACACGCATTGGGCGCGCCGGGACTGTGAGAC GACAGGCTGTGGATGTGTCCCCCCTGCGCCGTGT GAACCAGGCATCTGGCTGCTGTGCACAGGCGCTC GTGAGGCTGCCTTCCGGAACATTAAGACCATTGCT GAGTGCCTGGCAGATGAGCTCATCAATGCTGCCA AGGGCTCCTCGAACTCCTATGCCATTAAGAAGAAG GACGAGCTGGAGCGTGTGGCCAAGTCCAACCGCT GATTTTCCCAGCTGCTGCCCAATAAACCTGTCTGC CCTTTGGGGCAGTCCCAGCCAAAAAAAAAAAAAAA | 76 | SGCCAQAL VRLPSGTL RPLLSAWQ MSSSMLP RAPRTPMP LRRRTSW SVWPSPTA DFPSCCPI NLSALWGS PSQKKKK |
| 423 | NM_0010 09.3_558 | 558 | CTCTTCCTGTCTGTACCAGGGCGGCGCGTGGTCT ACGCCGAGTGACAGAGACGCTCAGGCTGTGTTCT CAGGATGACCGAGTGGGAGACAGCAGCACCAGC GGTGGCAGAGACCCCAGACATCAAGCTCTTTGGG AAGTGGAGCACCGATGATGTGCAGATCAATGACAT TCCCTGCAGGATTACATTGCAGTGAAGGAGAAGT ATGCCAAGTACCTGCCTCACAGTGCAGGGCGGTA TGCCGCCAAACGCTTCCGCAAAGCTCAGTGTCCC ATTGTGGAGCGCCTCACTAACTCCATGATGATGCA CGGCCGCAACAACGGCAAGAAGCTCATGACTGTG CGCATCGTCAAGCATGCCTTCGAGATCATACACCT GCTCACAGGCGAGAACCCTCTGCAGGTCCTGGTG AACGCCATCATCAACAGTGGTCCCCGGGAGGACT CCACACGCATTGGGCGCGCCGGGACTGTGAGAC GACAGGCTGTGGATGTGTCCCCCCTGCGCCGTGT GAACCAGGCCATCTGGCTGCTGTGCACAGGCGCT CGTGAGGCTGCTTCCGGAACATTAAGACCATTGCT GAGTGCCTGGCAGATGAGCTCATCAATGCTGCCA AGGGCTCCTCGAACTCCTATGCCATTAAGAAGAAG GACGAGCTGGAGCGTGTGGCCAAGTCCAACCGCT GATTTTCCCAGCTGCTGCCCAATAAACCTGTCTGC CCTTTGGGGCAGTCCCAGCCAAAAAAAAAAAAAAA | 64 | SGTLRPLL SAWQMSS SMLPRAPR TPMPLRRR TSWSVWP SPTADFPS CCPINLSAL WGSPSQK KKK |
| 424 | NM_0010 09.3_615 | 615 | CTCTTCCTGTCTGTACCAGGGCGGCGCGTGGTCT ACGCCGAGTGACAGAGACGCTCAGGCTGTGTTCT CAGGATGACCGAGTGGGAGACAGCAGCACCAGC GGTGGCAGAGACCCCAGACATCAAGCTCTTTGGG AAGTGGAGCACCGATGATGTGCAGATCAATGACAT TCCCTGCAGGATTACATTGCAGTGAAGGAGAAGT ATGCCAAGTACCTGCCTCACAGTGCAGGGCGGTA TGCCGCCAAACGCTTCCGCAAAGCTCAGTGTCCC ATTGTGGAGCGCCTCACTAACTCCATGATGATGCA CGGCCGCAACAACGGCAAGAAGCTCATGACTGTG CGCATCGTCAAGCATGCCTTCGAGATCATACACCT GCTCACAGGCGAGAACCCTCTGCAGGTCCTGGTG AACGCCATCATCAACAGTGGTCCCCGGGAGGACT CCACACGCATTGGGCGCGCCGGGACTGTGAGAC GACAGGCTGTGGATGTGTCCCCCCTGCGCCGTGT GAACCAGGCCATCTGGCTGCTGTGCACAGGCGCT CGTGAGGCTGCCTTCCGGAACATTAAGACCATTGC TGAGTGCCTGGCAGATGAGCTCATCAATGCTGCAA GGGCTCCTCGAACTCCTATGCCATTAAGAAGAAGG ACGAGCTGGAGCGTGTGGCCAAGTCCAACCGCTG ATTTTCCCAGCTGCTGCCCAATAAACCTGTCTGCC CTTTGGGGCAGTCCCAGCCAAAAAAAAAAAAAAA | 45 | RAPRTPMP LRRRTSW SVWPSPTA DFPSCCPI NLSALWGS PSQKKKK |

TABLE 3A-continued

| SEQ ID | identifier_ position | position | modified_RNA | PAP length | PAP |
|---|---|---|---|---|---|
| 425 | NM_0010 09.3_644 | 644 | CTCTTCCTGTCTGTACCAGGGCGGCGCGTGGTCT ACGCCGAGTGACAGAGACGCTCAGGCTGTGTTCT CAGGATGACCGAGTGGGAGACAGCAGCACCAGC GGTGGCAGAGACCCCAGACATCAAGCTCTTTGGG AAGTGGAGCACCGATGATGTGCAGATCAATGACAT TTCCCTGCAGGATTACATTGCAGTGAAGGAGAAGT ATGCCAAGTACCTGCCTCACAGTGCAGGGCGGTA TGCCGCCAAACGCTTCCGCAAAGCTCAGTGTCCC ATTGTGGAGCGCCTCACTAACTCCATGATGATGCA CGGCCGCAACAACGGCAAGAAGCTCATGACTGTG CGCATCGTCAAGCATGCCTTCGAGATCATACACCT GCTCACAGGCGAGAACCCTCTGCAGGTCCTGGTG AACGCCATCATCAACAGTGGTCCCCGGGAGGACT CCACACGCATTGGGCGCGCCGGGACTGTGAGAC GACAGGCTGTGGATGTGTCCCCCCTGCGCCGTGT GAACCAGGCCATCTGGCTGCTGTGCACAGGCGCT CGTGAGGCTGCCTTCCGGAACATTAAGACCATTGC TGAGTGCCTGGCAGATGAGCTCATCAATGCTGCC AAGGGCTCCTCGAACTCCTATGCCATTAGAAGAAG GACGAGCTGGAGCGTGTGGCCAAGTCCAACCGCT GATTTTCCCAGCTGCTGCCCAATAAACCTGTCTGC CCTTTTTTCCGGCAGTCCCAGCCAAAAAAAAAAAAAAA | 36 | RRRTSWS VWPSPTA DFPSCCPI NLSALWGS PSQKKKK |
| 426 | NM_0010 10.2_150 | 150 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTGCTGCTGACGCTCTGGGTGAAGAA TGGAAGGGTTATGTGGTCCGAATCAGTGGTGGGA ACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATTGCTCTG AAGAAGCAGCGTACCAAGAAAAATAAAGAAGAGG CTGCAGAATATGCTAAACTTTTGGCCAAGAGAATG AAGGAGGCTAAGGAGAAGCGCCAGGAACAAATTG CGAAGAGACGCAGACTTTCCTCTCTGCGAGCTTCT ACTTCTAAGTCTGAATCCAGTCAGAAATAAGATTTT TTGAGTAACAAATAAATAAGATCAGACTCTG | 26 | LLTLWVKN GRVMWSE SVVGTTNK VSP* |
| 427 | NM_0010 10.2_207 | 207 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGA ACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATTGCTCTG AAGAAGCAGCGTACCAAGAAAAATAAAGAAGAGG CTGCAGAATATGCTAAACTTTTGGCCAAGAGAATG AAGGAGGCTAAGGAGAAGCGCCAGGAACAAATTG CGAAGAGACGCAGACTTTCCTCTCTGCGAGCTTCT ACTTCTAAGTCTGAATCCAGTCAGAAATAAGATTTT TTGAGTAACAAATAAATAAGATCAGACTCTG | 7 | TTNKVSP* |
| 428 | NM_0010 10.2_345 | 345 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT | 5 | MWMQI* |

TABLE 3A-continued

| SEQ ID | identifier_position | position | modified_RNA | PAP length | PAP |
|---|---|---|---|---|---|
| | | | CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATGT<br>GGATGCAAATCTGAGCGTTCTCAACTTGGTTATTG<br>TAAAAAAAGGAGAGAAGGATATTCCTGGACTGACT<br>GATACTACAGTGCCTCGCCGCCTGGGCCCCAAAA<br>GAGCTAGCAGAATCCGCAAACTTTTCAATCTCTCT<br>AAAGAAGATGATGTCCGCCAGTATGTTGTAAGAAA<br>GCCCTTAAATAAAGAAGGTAAGAAACCTAGGACCA<br>AAGCACCCAAGATTCAGCGTCTTGTTACTCCACGT<br>GTCCTGCAGCACAAACGGCGGCGTATTGCTCTGA<br>AGAAGCAGCGTACCAAGAAAAATAAAGAAGAGGCT<br>GCAGAATATGCTAAACTTTTGGCCAAGAGAATGAA<br>GGAGGCTAAGGAGAAGCGCCAGGAACAAATTGCG<br>AAGAGACGCAGACTTTCCTCTCTGCGAGCTTCTAC<br>TTCTAAGTCTGAATCCAGTCAGAAATAAGATTTTTT<br>GAGTAACAAATAAATAAGATCAGACTCTG | | |
| 429 | NM_0010<br>10.2_439 | 439 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCTGGGCCCCAAAA<br>GAGCTAGCAGAATCCGCAAACTTTTCAATCTCTCT<br>AAAGAAGATGATGTCCGCCAGTATGTTGTAAGAAA<br>GCCCTTAAATAAAGAAGGTAAGAAACCTAGGACCA<br>AAGCACCCAAGATTCAGCGTCTTGTTACTCCACGT<br>GTCCTGCAGCACAAACGGCGGCGTATTGCTCTGA<br>AGAAGCAGCGTACCAAGAAAAATAAAGAAGAGGCT<br>GCAGAATATGCTAAACTTTTGGCCAAGAGAATGAA<br>GGAGGCTAAGGAGAAGCGCCAGGAACAAATTGCG<br>AAGAGACGCAGACTTTCCTCTCTGCGAGCTTCTAC<br>TTCTAAGTCTGAATCCAGTCAGAAATAAGATTTTTT<br>GAGTAACAAATAAATAAGATCAGACTCTG | 25 | WAPKELAE<br>SANFSISLK<br>KMMSASM<br>L* |
| 430 | NM_0010<br>10.2_505 | 505 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAAA<br>GCCCTTAAATAAAGAAGGTAAGAAACCTAGGACCA<br>AAGCACCCAAGATTCAGCGTCTTGTTACTCCACGT<br>GTCCTGCAGCACAAACGGCGGCGTATTGCTCTGA<br>AGAAGCAGCGTACCAAGAAAAATAAAGAAGAGGCT<br>GCAGAATATGCTAAACTTTTGGCCAAGAGAATGAA<br>GGAGGCTAAGGAGAAGCGCCAGGAACAAATTGCG<br>AAGAGACGCAGACTTTCCTCTCTGCGAGCTTCTAC<br>TTCTAAGTCTGAATCCAGTCAGAAATAAGATTTTTT<br>GAGTAACAAATAAATAAGATCAGACTCTG | 3 | SML* |
| 431 | NM_0010<br>10.2_513 | 513 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC | 0 | * |

TABLE 3A-continued

| SEQ ID | identifier_position | position | modified_RNA | length PAP | PAP |
|---|---|---|---|---|---|
| | | | TGATACTACAGTGCCTCGCCGCCTGGGCCCCAAA AGAGCTAGCAGAATCCGCAAACTTTTCAATCTCTC TAAAGAAGATGATGTCCGCCAGTATGTGTAAGAAA GCCCTTAAATAAAGAAGGTAAGAAACCTAGGACCA AAGCACCCAAGATTCAGCGTCTTGTTACTCCACGT GTCCTGCAGCACAAACGGCGGCGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | | |
| 432 | NM_0010 10.2_564 | 564 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCAAGATTCAGCGTCTTGTTACTCCACGT GTCCTGCAGCACAAACGGCGGCGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | 19 | RFSVLLLH VSCSTNG GVLL* |
| 433 | NM_0010 10.2_579 | 579 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTGTTACTCCACGT GTCCTGCAGCACAAACGGCGGCGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | 14 | LLHVSCST NGGVLL* |
| 434 | NM_0010 10.2_595 | 595 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG | 9 | CSTNGGVL L* |

TABLE 3A-continued

| SEQ ID | identifier_position | position | modified_RNA | PAP length | PAP |
|---|---|---|---|---|---|
| | | | TGTCTGCAGCACAAACGGCGGCGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | | |
| 435 | NM_0010 10.2_610 | 610 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGGGCGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | 4 | GVLL* |
| 436 | NM_0010 10.2_613 | 613 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGGTATTGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC TTCTAAGTCTGAATCCAGTCAGAAATAAGATTTTTT GAGTAACAAATAAATAAGATCAGACTCTG | 3 | VLL* |
| 437 | NM_0010 10.2_618 | 618 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATGCTCTGA AGAAGCAGCGTACCAAGAAAAATAAAGAAGAGGCT GCAGAATATGCTAAACTTTTGGCCAAGAGAATGAA GGAGGCTAAGGAGAAGCGCCAGGAACAAATTGCG AAGAGACGCAGACTTTCCTCTCTGCGAGCTTCTAC | 2 | ML* |

TABLE 3A-continued

| SEQ ID | identifier_position | position | modified_RNA | PAP length | PAP |
|---|---|---|---|---|---|
| 438 | NM_0010 10.2_634 | 634 | TTCTAAGTCTGAATCCAGTCAGAAATAAGATTTTTT<br>GAGTAACAAATAAATAAGATCAGACTCTG<br>CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGGTACCAAGAAAAATAAAGAAGAGGCT<br>GCAGAATATGCTAAACTTTTGGCCAAGAGAATGAA<br>GGAGGCTAAGGAGAAGCGCCAGGAACAAATTGCG<br>AAGAGACGCAGACTTTCCTCTCTGCGAGCTTCTAC<br>TTCTAAGTCTGAATCCAGTCAGAAATAAGATTTTTT<br>GAGTAACAAATAAATAAGATCAGACTCTG | 19 | VPRKIKKR LQNMLNF WPRE* |
| 439 | NM_0010 10.2_662 | 662 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGAGAATATGCTAAACTTTTGGCCAAGAGAATGA<br>AGGAGGCTAAGGAGAAGCGCCAGGAACAAATTGC<br>GAAGAGACGCAGACTTTCCTCTCTGCGAGCTTCTA<br>CTTCTAAGTCTGAATCCAGTCAGAAATAAGATTTTT<br>TGAGTAACAAATAAATAAGATCAGACTCTG | 10 | ENMLNFW PRE* |
| 440 | NM_0010 10.2_680 | 680 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGCAGAATATGCTAAACTTTGGCCAAGAGAATGA<br>AGGAGGCTAAGGAGAAGCGCCAGGAACAAATTGC<br>GAAGAGACGCAGACTTTCCTCTCTGCGAGCTTCTA<br>CTTCTAAGTCTGAATCCAGTCAGAAATAAGATTTTT<br>TGAGTAACAAATAAATAAGATCAGACTCTG | 4 | WPRE* |
| 441 | NM_0010 10.2_684 | 684 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA | 2 | RE* |

TABLE 3A-continued

| SEQ ID | identifier_position | position | modified_RNA | PAP length | PAP |
|---|---|---|---|---|---|
| | | | ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGCAGAATATGCTAAACTTTTGGCAAGAGAATGA<br>AGGAGGCTAAGGAGAAGCGCCAGGAACAAATTGC<br>GAAGAGACGCAGACTTTCCTCTCTGCGAGCTTCTA<br>CTTCTAAGTCTGAATCCAGTCAGAAATAAGATTTTT<br>TGAGTAACAAATAAATAAGATCAGACTCTG | | |
| 442 | NM_0010<br>10.2_701 | 701 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGCAGAATATGCTAAACTTTTGGCCAAGAGAATG<br>AAGGAGGTAAGGAGAAGCGCCAGGAACAAATTGC<br>GAAGAGACGCAGACTTTCCTCTCTGCGAGCTTCTA<br>CTTCTAAGTCTGAATCCAGTCAGAAATAAGATTTTT<br>TGAGTAACAAATAAATAAGATCAGACTCTG | 33 | VRRSARNK<br>LRRDADFP<br>LCELLLLSL<br>NPVRNKIF* |
| 443 | NM_0010<br>10.2_724 | 724 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA<br>AGGGGCATTCCTGTTACAGACCAAGGAGAACTGG<br>AGAAAGAAAGAGAAAATCAGTTCGTGGTTGCATTG<br>TGGATGCAAATCTGAGCGTTCTCAACTTGGTTATT<br>GTAAAAAAAGGAGAGAAGGATATTCCTGGACTGAC<br>TGATACTACAGTGCCTCGCCGCCTGGGCCCCAAA<br>AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGCAGAATATGCTAAACTTTTGGCCAAGAGAATG<br>AAGGAGGCTAAGGAGAAGCGCCAGGAACAAATTGC<br>GAAGAGACGCAGACTTTCCTCTCTGCGAGCTTCTA<br>CTTCTAAGTCTGAATCCAGTCAGAAATAAGATTTTT<br>TGAGTAACAAATAAATAAGATCAGACTCTG | 25 | LRRDADFP<br>LCELLLLSL<br>NPVRNKIF* |
| 444 | NM_0010<br>10.2_726 | 726 | CCTCTTTTCCGTGGCGCCTCGGAGGCGTTCAGCT<br>GCTTCAAGATGAAGCTGAACATCTCCTTCCCAGCC<br>ACTGGCTGCCAGAAACTCATTGAAGTGGACGATGA<br>ACGCAAACTTCGTACTTTCTATGAGAAGCGTATGG<br>CCACAGAAGTTGCTGCTGACGCTCTGGGTGAAGA<br>ATGGAAGGGTTATGTGGTCCGAATCAGTGGTGGG<br>AACGACAAACAAGGTTTCCCCATGAAGCAGGGTGT<br>CTTGACCCATGGCCGTGTCCGCCTGCTACTGAGTA | 25 | MRRDADF<br>PLCELLLLS<br>LNPVRNKI<br>F* |

| SEQ ID | identifier_position | position | modified_RNA | PAP length | PAP |
|---|---|---|---|---|---|
| | | | AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATTGCTCTG AAGAAGCAGCGTACCAAGAAAAATAAAGAAGAGG CTGCAGAATATGCTAAACTTTTGGCCAAGAGAATG AAGGAGGCTAAGGAGAAGCGCCAGGAACAAATGC GAAGAGACGCAGACTTTCCTCTCTGCGAGCTTCTA CTTCTAAGTCTGAATCCAGTCAGAAATAAGATTTTT TGAGTAACAAATAAATAAGATCAGACTCTG | | |
| 445 | NM_0010 10.2_728 | 728 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATTGCTCTG AAGAAGCAGCGTACCAAGAAAAATAAAGAAGAGG CTGCAGAATATGCTAAACTTTTGGCCAAGAGAATG AAGGAGGCTAAGGAGAAGCGCCAGGAACAAATTG GAAGAGACGCAGACTTTCCTCTCTGCGAGCTTCTA CTTCTAAGTCTGAATCCAGTCAGAAATAAGATTTTT TGAGTAACAAATAAATAAGATCAGACTCTG | 24 | GRDADFPL CELLLLSLN PVRNKIF* |
| 446 | NM_0010 10.2_754 | 754 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA AGAGCTAGCAGAATCCGCAAACTTTTCAATCTCTC TAAAGAAGATGATGTCCGCCAGTATGTTGTAAGAA AGCCCTTAAATAAAGAAGGTAAGAAACCTAGGACC AAAGCACCCAAGATTCAGCGTCTTGTTACTCCACG TGTCCTGCAGCACAAACGGCGGCGTATTGCTCTG AAGAAGCAGCGTACCAAGAAAAATAAAGAAGAGG CTGCAGAATATGCTAAACTTTTGGCCAAGAGAATG AAGGAGGCTAAGGAGAAGCGCCAGGAACAAATTG CGAAGAGACGCAGACTTTCCTCTCTGGAGCTTCTA CTTCTAAGTCTGAATCCAGTCAGAAATAAGATTTTT TGAGTAACAAATAAATAAGATCAGACTCTG | 15 | ELLLLSLNP VRNKIF* |
| 447 | NM_0010 10.2_90 | 90 | CCTCTTTTCCGTGGCGCCTCGGAGGCGTTCAGCT GCTTCAAGATGAAGCTGAACATCTCCTTCCCAGCC ACTGGCTGCCAGAAACTCATTGAAGTGGACGATGA ACGCAAACTTCGTACTTTCTATGAGAAGCGTATGG CCACAGAAGTTGCTGCTGACGCTCTGGGTGAAGA ATGGAAGGGTTATGTGGTCCGAATCAGTGGTGGG AACGACAAACAAGGTTTCCCCATGAAGCAGGGTGT CTTGACCCATGGCCGTGTCCGCCTGCTACTGAGTA AGGGGCATTCCTGTTACAGACCAAGGAGAACTGG AGAAAGAAAGAGAAAATCAGTTCGTGGTTGCATTG TGGATGCAAATCTGAGCGTTCTCAACTTGGTTATT GTAAAAAAAGGAGAGAAGGATATTCCTGGACTGAC TGATACTACAGTGCCTCGCCGCCTGGGCCCCAAA | 47 | MKWTMNA NFVLSMRS VWPQKLLL TLWVKNG RVMWSES VVGTTNKV SP* |

TABLE 3A-continued

| SEQ ID | identifier_position | position | modified_RNA | PAP length | PAP |
|---|---|---|---|---|---|
| | | | AGAGCTAGCAGAATCCGCAAACTTTTCAATCTCTC<br>TAAAGAAGATGATGTCCGCCAGTATGTTGTAAGAA<br>AGCCCTTAAATAAAGAAGGTAAGAAACCTAGGACC<br>AAAGCACCCAAGATTCAGCGTCTTGTTACTCCACG<br>TGTCCTGCAGCACAAACGGCGGCGTATTGCTCTG<br>AAGAAGCAGCGTACCAAGAAAAATAAAGAAGAGG<br>CTGCAGAATATGCTAAACTTTTGGCCAAGAGAATG<br>AAGGAGGCTAAGGAGAAGCGCCAGGAACAAATTG<br>CGAAGAGACGCAGACTTTCCTCTCTGCGAGCTTCT<br>ACTTCTAAGTCTGAATCCAGTCAGAAATAAGATTTT<br>TTGAGTAACAAATAAATAAGATCAGACTCTG | | |
| 448 | NM_0010<br>11.3_295 | 295 | GCGCTGTTTCCGCCTCTTGCCTTCGGACGCCGGA<br>TTTTGACGTGCTCTCGCGAGATTTGGGTCTCTTCC<br>TAAGCCGGCGCTCGGCAAGTTCTCCCAGGAGAAA<br>GCCATGTTCAGTTCGAGCGCCAAGATCGTGAAGC<br>CCAATGGCGAGAAGCCGGACGAGTTCGAGTCCGG<br>CATCTCCCAGGCTCTTCTGGAGCTGGAGATGAACT<br>CGGACCTCAAGGCTCAGCTCAGGGAGCTGAATAT<br>TACGGCAGCTAAGGAAATTGAAGTTGGTGGTGGT<br>CGGAAAGCTATCATAATCTTGTTCCCGTTCCTCAA<br>CTGAAATCTTTCCAGAAAATCCAAGTCCGGCTAGT<br>ACGCGAATTGGAGAAAAAGTTCAGTGGGAAGCAT<br>GTCGTCTTTATCGCTCAGAGGAGAATTCTGCCTAA<br>GCCAACTCGAAAAAGCCGTACAAAAAATAAGCAAA<br>AGCGTCCCAGGAGCCGTACTCTGACAGCTGTGCA<br>CGATGCCATCCTTGAGGACTTGGTCTTCCCAAGCG<br>AAATTGTGGGCAAGAGAATCCGCGTCAAACTAGAT<br>GGCAGCCGGCTCATAAAGGTTCATTTGGACAAAG<br>CACAGCAGAACAATGTGGAACACAAGGTTGAAACT<br>TTTTCTGGTGTCTATAAGAAGCTCACGGGCAAGGA<br>TGTTAATTTTGAATTCCCAGAGTTTCAATTGTAAAC<br>AAAAAATGACTAAATAAAAAGTATATATTCACAGTAA<br>AAAAAAAAAAAAAAAA | 6 | LFPFLN* |
| 449 | NM_0010<br>11.3_354 | 354 | GCGCTGTTTCCGCCTCTTGCCTTCGGACGCCGGA<br>TTTTGACGTGCTCTCGCGAGATTTGGGTCTCTTCC<br>TAAGCCGGCGCTCGGCAAGTTCTCCCAGGAGAAA<br>GCCATGTTCAGTTCGAGCGCCAAGATCGTGAAGC<br>CCAATGGCGAGAAGCCGGACGAGTTCGAGTCCGG<br>CATCTCCCAGGCTCTTCTGGAGCTGGAGATGAACT<br>CGGACCTCAAGGCTCAGCTCAGGGAGCTGAATAT<br>TACGGCAGCTAAGGAAATTGAAGTTGGTGGTGGT<br>CGGAAAGCTATCATAATCTTGTTCCCGTTCCTCAA<br>CTGAAATCTTTCCAGAAAATCCAAGTCCGGCTAGT<br>ACGCGAATGGAGAAAAAGTTCAGTGGGAAGCATG<br>TCGTCTTTATCGCTCAGAGGAGAATTCTGCCTAAG<br>CCAACTCGAAAAAGCCGTACAAAAAATAAGCAAAA<br>GCGTCCCAGGAGCCGTACTCTGACAGCTGTGCAC<br>GATGCCATCCTTGAGGACTTGGTCTTCCCAAGCGA<br>AATTGTGGGCAAGAGAATCCGCGTCAAACTAGATG<br>GCAGCCGGCTCATAAAGGTTCATTTGGACAAAGCA<br>CAGCAGAACAATGTGGAACACAAGGTTGAAACTTT<br>TTCTGGTGTCTATAAGAAGCTCACGGGCAAGGATG<br>TTAATTTTGAATTCCCAGAGTTTCAATTGTAAACAA<br>AAATGACTAAATAAAAAGTATATATTCACAGTAAAA<br>AAAAAAAAAAAAAA | 39 | WRKSSVG<br>SMSSLSLR<br>GEFCLSQL<br>EKAVQKIS<br>KSVPGAVL* |
| 450 | NM_0010<br>11.3_654 | 654 | GCGCTGTTTCCGCCTCTTGCCTTCGGACGCCGGA<br>TTTTGACGTGCTCTCGCGAGATTTGGGTCTCTTCC<br>TAAGCCGGCGCTCGGCAAGTTCTCCCAGGAGAAA<br>GCCATGTTCAGTTCGAGCGCCAAGATCGTGAAGC<br>CCAATGGCGAGAAGCCGGACGAGTTCGAGTCCGG<br>CATCTCCCAGGCTCTTCTGGAGCTGGAGATGAACT<br>CGGACCTCAAGGCTCAGCTCAGGGAGCTGAATAT<br>TACGGCAGCTAAGGAAATTGAAGTTGGTGGTGGT<br>CGGAAAGCTATCATAATCTTGTTCCCGTTCCTCAA<br>CTGAAATCTTTCCAGAAAATCCAAGTCCGGCTAGT<br>ACGCGAATTGGAGAAAAAGTTCAGTGGGAAGCAT<br>GTCGTCTTTATCGCTCAGAGGAGAATTCTGCCTAA<br>GCCAACTCGAAAAAGCCGTACAAAAAATAAGCAAA<br>AGCGTCCCAGGAGCCGTACTCTGACAGCTGTGCA<br>CGATGCCATCCTTGAGGACTTGGTCTTCCCAAGCG<br>AAATTGTGGGCAAGAGAATCCGCGTCAAACTAGAT<br>GGCAGCCGGCTCATAAAGGTTCATTTGGACAAAG<br>CACAGCAGAACAATGTGGAACACAAGGTTGAAACT<br>TTTTCTGGTGTCTATAAGAAGCTCACGGGCAGGAT<br>GTTAATTTTGAATTCCCAGAGTTTCAATTGTAAACA<br>AAAATGACTAAATAAAAAGTATATATTCACAGTAAA<br>AAAAAAAAAAAAAAA | 15 | RMLILNSQ<br>SFNCKQK* |

TABLE 3A-continued

| SEQ ID | identifier_ position | position | modified_RNA | PAP length | PAP |
|---|---|---|---|---|---|
| 451 | NM_0010 12662.1_ 1613 | 1613 | CCTGAACTTGCGGCGCGAAAAAGGCGCGCATGCG TCCTACGGGAGCGTGCTGGCTCACCGACCGCATT GCGGCTTGGTTTTCTCACCCAGTGCATGTGGCAG GAGCGGTGAGATCACTGCCTCACGGCGATCCTGG ACTGACGGTCACGACTGCCTACCCTCTAACCCTGT TCTGAGCTGCCCCTTGCCCACACACCCCAAACCTG TGTGCAGGATCCGCCTCCATGGAGCTACAGCCTC CTGAAGCCTCGATCGCCGTCGTGTCGATTCCGCG CCAGTTGCCTGGCTCACATTCGGAGGCTGGTGTC CAGGGTCTCAGCGCGGGGGACGACTCAGAGACG GGGTCTGACTGTGTTACCCAGGCTGGTCTTCAACT CTTGGCCTCAAGTGATCCTCCTGCCTTAGCTTCCA AGAATGCTGAGGTTACAGTAGAAACGGGGTTTCAC CATGTTAGCCAGGCTGATATTGAATTCCTGACCTC AATTGATCCGACTGCCTCGGCCTCCGGAAGTGCT GGGATTACAGGCACCATGAGCCAGGACACCGAGG TGGATATGAAGGAGGTGGAGCTGAATGAGTTAGA GCCCGAGAAGCAGCCGATGAACGCGGCGTCTGG GGCGGCCATGTCCCTGGCGGGAGCCGAGAAGAA TGGTCTGGTGAAGATCAAGGTGGCGGAAGACGAG GCGGAGGCGGCAGCCGCGGCTAAGTTCACGGGC CTGTCCAAGGAGGAGCTGCTGAAGGTGGCAGGCA GCCCCGGCTGGGTACGCACCCGCTGGGCACTGCT GCTGCTCTTCTGGCTCGGCTGGCTCGGCATGCTT GCTGGTGCCGTGGTCATAATCGTGCGAGCGCCGC GTTGTCGCGAGCTACCGGCGCAGAAGTGGTGGCA CACGGGCGCCCTCTACCGCATCGGCGACCTTCAG GCCTTCCAGGGCCACGGCGCGGGCAACCTGGCG GGTCTGAAGGGGCGTCTCGATTACCTGAGCTCTCT GAAGGTGAAGGGCCTTGTGCTGGGTCCAATTCAC AA | 40 | PLFSATGM RLAWMQL PFLDSLWR LQSCCGM SPASLTSQ GL* |
| 452 | NM_0010 13.3_228 | 228 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCGGGAACTGCTGAC GCTTGATGAGAAGGACCCACGGCGTCTGTTCGAA GGCAACGCCCTGCTGCGGCGGCTGGTCCGCATTG GGGTGCTGGATGAGGGCAAGATGAAGCTGGATTA CATCCTGGGCCTGAAGATAGAGGATTTCTTAGAGA GACGCCTGCAGACCCAGGTCTTCAAGCTGGGCTT GGCCAAGTCCATCCACCACGCTCGCGTGCTGATC CGCCAGCGCCATATCAGGGTCCGCAAGCAGGTGG TGAACATCCCGTCCTTCATTGTCCGCCTGGATTCC CAGAAGCACATCGACTTCTCTCTGCGCTCTCCCTA CGGGGGTGGCCGCCCGGGCCGCGTGAAGAGGAA GAATGCCAAGAAGGGCCAGGGTGGGGCTGGGGC TGGAGACGACGAGGAGGAGGATTAAGTCCACCTG TCCCTCCTGGGCTGCTGGATTGTCTCGTTTTCCTG CCAAATAAACAGGATCAGCGCTTTACAAAAAAAA AAAAAAAAAAAAAAAAAAAAAAAAAAAAAAAA | 3 | GNC* |
| 453 | NM_0010 13.3_308 | 308 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCCCGGGAACTGCTGA CGCTTGATGAGAAGGACCCACGGCGTCTGTTCGA AGGCAACGCCCTGCTGCGGCGGCTGGTCCGCATG GGGTGCTGGATGAGGGCAAGATGAAGCTGGATTA CATCCTGGGCCTGAAGATAGAGGATTTCTTAGAGA GACGCCTGCAGACCCAGGTCTTCAAGCTGGGCTT GGCCAAGTCCATCCACCACGCTCGCGTGCTGATC CGCCAGCGCCATATCAGGGTCCGCAAGCAGGTGG TGAACATCCCGTCCTTCATTGTCCGCCTGGATTCC CAGAAGCACATCGACTTCTCTCTGCGCTCTCCCTA CGGGGGTGGCCGCCCGGGCCGCGTGAAGAGGAA GAATGCCAAGAAGGGCCAGGGTGGGGCTGGGGC TGGAGACGACGAGGAGGAGGATTAAGTCCACCTG TCCCTCCTGGGCTGCTGGATTGTCTCGTTTTCCTG CCAAATAAACAGGATCAGCGCTTTACAAAAAAAA AAAAAAAAAAAAAAAAAAAAAAAAAAAAAAAA | 8 | MGCWMRA R* |

TABLE 3A-continued

| SEQ ID | identifier_position | position | modified_RNA | PAP length | PAP |
|---|---|---|---|---|---|
| 454 | NM_001013.3_450 | 450 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCCCGGGAACTGCTGA CGCTTGATGAGAAGGACCCACGGCGTCTGTTCGA AGGCAACGCCCTGCTGCGGCGGCTGGTCCGCATT GGGGTGCTGGATGAGGGCAAGATGAAGCTGGATT ACATCCTGGGCCTGAAGATAGAGGATTTCTTAGAG AGACGCCTGCAGACCCAGGTCTTCAAGCTGGGCT TGGCCAAGTCCATCCACCACGCTCGCGTGCTGAT CCGCCAGCGCCATATCAGGGTCCGCAAGCAGGTG TGAACATCCCGTCCTTCATTGTCCGCCTGGATTCC CAGAAGCACATCGACTTCTCTCTGCGCTCTCCCTA CGGGGGTGGCCGCCCGGGCCGCGTGAAGAGGAA GAATGCCAAGAAGGGCCAGGGTGGGGCTGGGGC TGGAGACGACGAGGAGGAGGATTAAGTCCACCTG TCCCTCCTGGGCTGCTGGATTGTCTCGTTTTCCTG CCAAATAAACAGGATCAGCGCTTTACAAAAAAAAA AAAAAAAAAAAAAAAAAAAAAAAAAAAAAAAA | 10 | SAISGSAS RW* |
| 455 | NM_001013.3_507 | 507 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCCCGGGAACTGCTGA CGCTTGATGAGAAGGACCCACGGCGTCTGTTCGA AGGCAACGCCCTGCTGCGGCGGCTGGTCCGCATT GGGGTGCTGGATGAGGGCAAGATGAAGCTGGATT ACATCCTGGGCCTGAAGATAGAGGATTTCTTAGAG AGACGCCTGCAGACCCAGGTCTTCAAGCTGGGCT TGGCCAAGTCCATCCACCACGCTCGCGTGCTGAT CCGCCAGCGCCATATCAGGGTCCGCAAGCAGGTG GTGAACATCCCGTCCTTCATTGTCCGCTGGATTCC CAGAAGCACATCGACTTCTCTCTGCGCTCTCCCTA CGGGGGTGGCCGCCCGGGCCGCGTGAAGAGGAA GAATGCCAAGAAGGGCCAGGGTGGGGCTGGGGC TGGAGACGACGAGGAGGAGGATTAAGTCCACCTG TCCCTCCTGGGCTGCTGGATTGTCTCGTTTTCCTG CCAAATAAACAGGATCAGCGCTTTACAAAAAAAAA AAAAAAAAAAAAAAAAAAAAAAAAAAAAAAAA | 22 | WIPRSTST SLCALPTG VAARAA* |
| 456 | NM_001013.3_565 | 565 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCCCGGGAACTGCTGA CGCTTGATGAGAAGGACCCACGGCGTCTGTTCGA AGGCAACGCCCTGCTGCGGCGGCTGGTCCGCATT GGGGTGCTGGATGAGGGCAAGATGAAGCTGGATT ACATCCTGGGCCTGAAGATAGAGGATTTCTTAGAG AGACGCCTGCAGACCCAGGTCTTCAAGCTGGGCT TGGCCAAGTCCATCCACCACGCTCGCGTGCTGAT CCGCCAGCGCCATATCAGGGTCCGCAAGCAGGTG GTGAACATCCCGTCCTTCATTGTCCGCCTGGATTC CCAGAAGCACATCGACTTCTCTCTGCGCTCTCCCT ACGGGGGTGGCCGCCCGGGCCGCGTGAAGAGGAA GAATGCCAAGAAGGGCCAGGGTGGGGCTGGGGC TGGAGACGACGAGGAGGAGGATTAAGTCCACCTG TCCCTCCTGGGCTGCTGGATTGTCTCGTTTTCCTG CCAAATAAACAGGATCAGCGCTTTACAAAAAAAAA AAAAAAAAAAAAAAAAAAAAAAAAAAAAAAAA | 3 | RAA* |
| 457 | NM_001013.3_570 | 570 | CTCTTTCTCAGTGACCGGGTGGTTTGCTTAGGCGC AGACGGGGAAGCGGAGCCAACATGCCAGTGGCC CGGAGCTGGGTTTGTCGCAAAACTTATGTGACCCC GCGGAGACCCTTCGAGAAATCTCGTCTCGACCAA GAGCTGAAGCTGATCGGCGAGTATGGGCTCCGGA ACAAACGTGAGGTCTGGAGGGTCAAATTTACCCTG GCCAAGATCCGCAAGGCCGCCCGGGAACTGCTGA CGCTTGATGAGAAGGACCCACGGCGTCTGTTCGA AGGCAACGCCCTGCTGCGGCGGCTGGTCCGCATT GGGGTGCTGGATGAGGGCAAGATGAAGCTGGATT ACATCCTGGGCCTGAAGATAGAGGATTTCTTAGAG | 1 | A* |

TABLE 3A-continued

| SEQ ID | identifier_position | position | modified_RNA | PAP length | PAP |
|---|---|---|---|---|---|
| | | | AGACGCCTGCAGACCCAGGTCTTCAAGCTGGGCT<br>TGGCCAAGTCCATCCACCACGCTCGCGTGCTGAT<br>CCGCCAGCGCCATATCAGGGTCCGCAAGCAGGTG<br>GTGAACATCCCGTCCTTCATTGTCCGCCTGGATTC<br>CCAGAAGCACATCGACTTCTCTCTGCGCTCTCCCT<br>ACGGGGGTGGCCGCCCGGGCGCGTGAAGAGGAA<br>GAATGCCAAGAAGGGCCAGGGTGGGGCTGGGGC<br>TGGAGACGACGAGGAGGAGGATTAAGTCCACCTG<br>TCCCTCCTGGGCTGCTGGATTGTCTCGTTTTCCTG<br>CCAAATAAACAGGATCAGCGCTTTACAAAAAAAAA<br>AAAAAAAAAAAAAAAAAAAAAAAAAAAAAAAAA | | |
| 458 | NM_0010<br>13.3_604 | 604 | CTCTTTCTCAGTGACCGGGTGGTTTGCTTAGGCGC<br>AGACGGGGAAGCGGAGCCAACATGCCAGTGGCC<br>CGGAGCTGGGTTTGTCGCAAAACTTATGTGACCCC<br>GCGGAGACCCTTCGAGAAATCTCGTCTCGACCAA<br>GAGCTGAAGCTGATCGGCGAGTATGGGCTCCGGA<br>ACAAACGTGAGGTCTGGAGGGTCAAATTTACCCTG<br>GCCAAGATCCGCAAGGCCGCCCGGGAACTGCTGA<br>CGCTTGATGAGAAGGACCCACGGCGTCTGTTCGA<br>AGGCAACGCCCTGCTGCGGCGGCTGGTCCGCATT<br>GGGGTGCTGGATGAGGGCAAGATGAAGCTGGATT<br>ACATCCTGGGCCTGAAGATAGAGGATTTCTTAGAG<br>AGACGCCTGCAGACCCAGGTCTTCAAGCTGGGCT<br>TGGCCAAGTCCATCCACCACGCTCGCGTGCTGAT<br>CCGCCAGCGCCATATCAGGGTCCGCAAGCAGGTG<br>GTGAACATCCCGTCCTTCATTGTCCGCCTGGATTC<br>CCAGAAGCACATCGACTTCTCTCTGCGCTCTCCCT<br>ACGGGGGTGGCCGCCCGGGCCGCGTGAAGAGGA<br>AGAATGCCAAGAAGGGCCAGGTGGGGCTGGGGC<br>TGGAGACGACGAGGAGGAGGATTAAGTCCACCTG<br>TCCCTCCTGGGCTGCTGGATTGTCTCGTTTTCCTG<br>CCAAATAAACAGGATCAGCGCTTTACAAAAAAAAA<br>AAAAAAAAAAAAAAAAAAAAAAAAAAAAAAAAA | 29 | VGLGLETT<br>RRRIKSTC<br>PSWAAGL<br>SRFPAK* |
| 459 | NM_0010<br>13.3_615 | 615 | CTCTTTCTCAGTGACCGGGTGGTTTGCTTAGGCGC<br>AGACGGGGAAGCGGAGCCAACATGCCAGTGGCC<br>CGGAGCTGGGTTTGTCGCAAAACTTATGTGACCCC<br>GCGGAGACCCTTCGAGAAATCTCGTCTCGACCAA<br>GAGCTGAAGCTGATCGGCGAGTATGGGCTCCGGA<br>ACAAACGTGAGGTCTGGAGGGTCAAATTTACCCTG<br>GCCAAGATCCGCAAGGCCGCCCGGGAACTGCTGA<br>CGCTTGATGAGAAGGACCCACGGCGTCTGTTCGA<br>AGGCAACGCCCTGCTGCGGCGGCTGGTCCGCATT<br>GGGGTGCTGGATGAGGGCAAGATGAAGCTGGATT<br>ACATCCTGGGCCTGAAGATAGAGGATTTCTTAGAG<br>AGACGCCTGCAGACCCAGGTCTTCAAGCTGGGCT<br>TGGCCAAGTCCATCCACCACGCTCGCGTGCTGAT<br>CCGCCAGCGCCATATCAGGGTCCGCAAGCAGGTG<br>GTGAACATCCCGTCCTTCATTGTCCGCCTGGATTC<br>CCAGAAGCACATCGACTTCTCTCTGCGCTCTCCCT<br>ACGGGGGTGGCCGCCCGGGCCGCGTGAAGAGGA<br>AGAATGCCAAGAAGGGCCAGGGTGGGGCTGGGC<br>TGGAGACGACGAGGAGGAGGATTAAGTCCACCTG<br>TCCCTCCTGGGCTGCTGGATTGTCTCGTTTTCCTG<br>CCAAATAAACAGGATCAGCGCTTTACAAAAAAAAA<br>AAAAAAAAAAAAAAAAAAAAAAAAAAAAAAAAA | 25 | LETTRRRIK<br>STCPSWA<br>AGLSRFPA<br>K* |
| 460 | NM_0010<br>13.3_81 | 81 | CTCTTTCTCAGTGACCGGGTGGTTTGCTTAGGCGC<br>AGACGGGGAAGCGGAGCCAACATGCCAGTGGCC<br>CGGAGCTGGGTTGTCGCAAAACTTATGTGACCCC<br>GCGGAGACCCTTCGAGAAATCTCGTCTCGACCAA<br>GAGCTGAAGCTGATCGGCGAGTATGGGCTCCGGA<br>ACAAACGTGAGGTCTGGAGGGTCAAATTTACCCTG<br>GCCAAGATCCGCAAGGCCGCCCGGGAACTGCTGA<br>CGCTTGATGAGAAGGACCCACGGCGTCTGTTCGA<br>AGGCAACGCCCTGCTGCGGCGGCTGGTCCGCATT<br>GGGGTGCTGGATGAGGGCAAGATGAAGCTGGATT<br>ACATCCTGGGCCTGAAGATAGAGGATTTCTTAGAG<br>AGACGCCTGCAGACCCAGGTCTTCAAGCTGGGCT<br>TGGCCAAGTCCATCCACCACGCTCGCGTGCTGAT<br>CCGCCAGCGCCATATCAGGGTCCGCAAGCAGGTG<br>GTGAACATCCCGTCCTTCATTGTCCGCCTGGATTC<br>CCAGAAGCACATCGACTTCTCTCTGCGCTCTCCCT<br>ACGGGGGTGGCCGCCCGGGCCGCGTGAAGAGGA<br>AGAATGCCAAGAAGGGCCAGGGTGGGGCTGGGG<br>CTGGAGACGACGAGGAGGAGGATTAAGTCCACCT<br>GTCCCTCCTGGGCTGCTGGATTGTCTCGTTTTCCT<br>GCCAAATAAACAGGATCAGCGCTTTACAAAAAAAAA<br>AAAAAAAAAAAAAAAAAAAAAAAAAAAAAAAAA | 5 | VAKLM* |

TABLE 3A-continued

| SEQ ID | identifier_position | position | modified_RNA | PAP length | PAP |
|---|---|---|---|---|---|
| 461 | NM_0010 14.3_254 | 254 | GGAAGAGACGCAGCACCGCGCATGCTCCTTCCTT TCCAGCCCCGGTACCGGACCCTGCAGCCGCAGAG ATGTTGATGCCTAAGAAGAACCGGATTGCCATTTA TGAACTCCTTTTTAAGGAGGGAGTCATGGTGGCCA AGAAGGATGTCCACATGCCTAAGCACCCGGAGCT GGCAGACAAGAATGTGCCCAACCTTCATGTCATGA AGGCCATGCAGTCTCTCAAGTCCCGAGGCTACGT GAAGGAACAGTTGCCTGGAGACATTTCTACTGGTA CCTTACCAATGAGGGTATCCAGTATCTCCGTGATT ACCTTCATCTGCCCCCGGAGATTGTGCCTGCCACC CTACGCCGTAGCCGTCCAGAGACTGGCAGGCCTC GGCCTAAAGGTCTGGAGGGTGAGCGACCTGCGAG ACTCACAAGAGGGGAAGCTGACAGAGATACCTAC AGACGGAGTGCTGTGCCACCTGGTGCCGACAAGA AAGCCGAGGCTGGGGCTGGGTCAGCAACCGAATT CCAGTTTAGAGGCGGATTTGGTCGTGGACGTGGT CAGCCACCTCAGTAAAATTGGAGAGGATTCTTTTG CATTGAATAAACTTACAGCCAAAAAACCTTAAAAAA AAAAAAAAAAAAAA | 121 | LPGDISTG TLPMRVSS ISVITFICPR RLCLPPYA VAVQRLAG LGLKVWRV SDLRDSQE GKLTEIPTD GVLCHLVP TRKPRLGL GQQPNSS LEADLVVD VVSHLSKI GEDSFALN KLTAKKP* |
| 462 | NM_0010 14.3_335 | 335 | GGAAGAGACGCAGCACCGCGCATGCTCCTTCCTT TCCAGCCCCGGTACCGGACCCTGCAGCCGCAGAG ATGTTGATGCCTAAGAAGAACCGGATTGCCATTTA TGAACTCCTTTTTAAGGAGGGAGTCATGGTGGCCA AGAAGGATGTCCACATGCCTAAGCACCCGGAGCT GGCAGACAAGAATGTGCCCAACCTTCATGTCATGA AGGCCATGCAGTCTCTCAAGTCCCGAGGCTACGT GAAGGAACAGTTTGCCTGGAGACATTTCTACTGGT ACCTTACCAATGAGGGTATCCAGTATCTCCGTGAT TACCTTCATCTGCCCCCGGAGATGTGCCTGCCACC CTACGCCGTAGCCGTCCAGAGACTGGCAGGCCTC GGCCTAAAGGTCTGGAGGGTGAGCGACCTGCGAG ACTCACAAGAGGGGAAGCTGACAGAGATACCTAC AGACGGAGTGCTGTGCCACCTGGTGCCGACAAGA AAGCCGAGGCTGGGGCTGGGTCAGCAACCGAATT CCAGTTTAGAGGCGGATTTGGTCGTGGACGTGGT CAGCCACCTCAGTAAAATTGGAGAGGATTCTTTTG CATTGAATAAACTTACAGCCAAAAAACCTTAAAAAA AAAAAAAAAAAAAA | 94 | MCLPPYAV AVQRLAGL GLKVVVRV SDLRDSQE GKLTEIPTD GVLCHLVP TRKPRLGL GQQPNSS LEADLVVD VVSHLSKI GEDSFALN KLTAKKP* |
| 463 | NM_0010 14.3_385 | 385 | GGAAGAGACGCAGCACCGCGCATGCTCCTTCCTT TCCAGCCCCGGTACCGGACCCTGCAGCCGCAGAG ATGTTGATGCCTAAGAAGAACCGGATTGCCATTTA TGAACTCCTTTTTAAGGAGGGAGTCATGGTGGCCA AGAAGGATGTCCACATGCCTAAGCACCCGGAGCT GGCAGACAAGAATGTGCCCAACCTTCATGTCATGA AGGCCATGCAGTCTCTCAAGTCCCGAGGCTACGT GAAGGAACAGTTTGCCTGGAGACATTTCTACTGGT ACCTTACCAATGAGGGTATCCAGTATCTCCGTGAT TACCTTCATCTGCCCCCGGAGATTGTGCCTGCCAC CCTACGCCGTAGCCGTCCAGAGACTGGCAGGCCT CGGCTAAAGGTCTGGAGGGTGAGCGACCTGCGAG ACTCACAAGAGGGGAAGCTGACAGAGATACCTAC AGACGGAGTGCTGTGCCACCTGGTGCCGACAAGA AAGCCGAGGCTGGGGCTGGGTCAGCAACCGAATT CCAGTTTAGAGGCGGATTTGGTCGTGGACGTGGT CAGCCACCTCAGTAAAATTGGAGAGGATTCTTTTG CATTGAATAAACTTACAGCCAAAAAACCTTAAAAAA AAAAAAAAAAAAAA | 77 | LKVWRVS DLRDSQE GKLTEIPTD GVLCHLVP TRKPRLGL GQQPNSS LEADLVVD VVSHLSKI GEDSFALN KLTAKKP* |
| 464 | NM_0010 14.3_409 | 409 | GGAAGAGACGCAGCACCGCGCATGCTCCTTCCTT TCCAGCCCCGGTACCGGACCCTGCAGCCGCAGAG ATGTTGATGCCTAAGAAGAACCGGATTGCCATTTA TGAACTCCTTTTTAAGGAGGGAGTCATGGTGGCCA AGAAGGATGTCCACATGCCTAAGCACCCGGAGCT GGCAGACAAGAATGTGCCCAACCTTCATGTCATGA AGGCCATGCAGTCTCTCAAGTCCCGAGGCTACGT GAAGGAACAGTTTGCCTGGAGACATTTCTACTGGT ACCTTACCAATGAGGGTATCCAGTATCTCCGTGAT TACCTTCATCTGCCCCCGGAGATTGTGCCTGCCAC CCTACGCCGTAGCCGTCCAGAGACTGGCAGGCCT CGGCCTAAAGGTCTGGAGGGTGAGCGACCTGCGAG ACTCACAAGAGGGGAAGCTGACAGAGATACCTAC AGACGGAGTGCTGTGCCACCTGGTGCCGACAAGA AAGCCGAGGCTGGGGCTGGGTCAGCAACCGAATT CCAGTTTAGAGGCGGATTTGGTCGTGGACGTGGT CAGCCACCTCAGTAAAATTGGAGAGGATTCTTTTG CATTGAATAAACTTACAGCCAAAAAACCTTAAAAAA AAAAAAAAAAAAAA | 69 | LRDSQEGK LTEIPTDGV LCHLVPTR KPRLGLGQ QPNSSLEA DLVVDVVS HLSKIGED SFALNKLT AKKP* |

TABLE 3A-continued

| SEQ ID | identifier_position | position | modified_RNA | PAP length | PAP |
|---|---|---|---|---|---|
| 465 | NM_0010 14.3_536 | 536 | GGAAGAGACGCAGCACCGCGCATGCTCCTTCCTT TCCAGCCCCGGTACCGGACCCTGCAGCCGCAGAG ATGTTGATGCCTAAGAAGAACCGGATTGCCATTTA TGAACTCCTTTTTAAGGAGGGAGTCATGGTGGCCA AGAAGGATGTCCACATGCCTAAGCACCCGGAGCT GGCAGACAAGAATGTGCCCAACCTTCATGTCATGA AGGCCATGCAGTCTCTCAAGTCCCGAGGCTACGT GAAGGAACAGTTTGCCTGGAGACATTTCTACTGGT ACCTTACCAATGAGGGTATCCAGTATCTCCGTGAT TACCTTCATCTGCCCCCGGAGATTGTGCCTGCCAC CCTACGCCGTAGCCGTCCAGAGACTGGCAGGCCT CGGCCTAAAGGTCTGGAGGGTGAGCGACCTGCGA GACTCACAAGAGGGGAAGCTGACAGAGATACCTA CAGACGGAGTGCTGTGCCACCTGGTGCCGACAAG AAAGCCGAGGCTGGGGCTGGGTCAGCAACCGAAT TCCAGTTTAGAGGCGGATTGGTCGTGGACGTGGT CAGCCACCTCAGTAAAATTGGAGAGGATTCTTTTG CATTGAATAAACTTACAGCCAAAAAACCTTAAAAAA AAAAAAAAAAAAAA | 27 | LVVDVVSH LSKIGEDS FALNKLTA KKP* |
| 466 | NM_0010 14999.1_222 | 222 | CTTCTACACCCGCCTCCAGACAGGAGAGGGGCAC GTACCGGCGCTACGGCTTCCTGCAGGCTGCCTCC GGATAGTCCCCGAGAGCTTGTTCCGAAGCAAGCA CCCTGCAGCCCTAGCGATCCAGCCCTCCCCTGGA CCCTAGGTCACGGCAATCAACCCCCTGCTGTGGTT CCCGAACCCCAAGGCCCGATGGGTCCCGCGGGG GTCGCGGCGAGGCCAGGCGCTTTTTCGGCGTCTA CCTGCTCTACTGCCTGAACCCCCGGTACCGGGGC CGCGTCTACGTGGGGTTCACTGTCAACACTGCTC GTCGGGTCCAGCAGCACAATGGGGGCCGCAAAAA AGGCGGGGCCTGGCGGACCAGCGGGCGAGGGC CCTGGGAGATGGTGCTCGTCGTGCACGGCTTCCC GTCCTCCGTGGCCGCCCTTCGGTTTGAGTGGGCT TGGCAGCACCCGCACGCCTCGCGCCGCCTGGCG CACGTGGGGCCTCGCCTGCGAGGAGAGACAGCC TTCGCTTTCCACCTGCGCGTGCTGGCGCACATGCT GCGCGCACCGCCCTGGGCTCGCCTCCCGCTCAC GCTGCGCTGGGTGCGCCCAGACCTCCGCCAGGA CCTCTGCCTCCCGCCGCCGCCGCACGTGCCTCTG GCCTTCGGGCCTCCACCGCCCCAGGCCCCGGCC CCAAGGCGCCGCGCAGGTCCCTTTGATGACGCGG AGCCTGAGCCAGACCAGGGGGATCCAGGGGCCT GCTGCTCCCTGTGCGCCCAGACCATCCAGGATGA AGAGGGGCCCTTGTGTTGCCCCCACCCTGGCTGC CTGCTAAGGGCCCATGTGATCTGCCTGGCAGAGG AGTTTCTTCAGGAAGAACCAGGGCAGCTTCTGCCC CTAGAGGGCCAATGCCCTTGCTGTGAGAAGTCAC TGCTTTGGGGAGACCTGATCTGGCTGTGCCAGAT GGACACTGAGAAAGAAGTAGAAGACTCAGAATTAG AAGAGGCACACTGGACAGACCTGCTGGAGACCTG ATCCTCAGT | 10 | AFSASTCS TA* |
| 467 | NM_0010 16.3_100 | 100 | CTCTTTCCCTGCCGCCGCCGAGTCGCGCGGAGGC GGGAGGCTTGGGTGCGTTCAAGATTCAACTTCACCC GTAACCCACCGCCATGGCCGAGGAAGGCATGCTG CTGGAGGTGTAATGGACGTTAATACTGCTTTACAA GAGGTTCTGAAGACTGCCCTCATCCACGATGGCCT AGCACGTGGAATTCGCGAAGCTGCCAAAGCCTTA GACAAGCGCCAAGCCCATCTTTGTGTGCTTGCATC CAACTGTGATGAGCCTATGTATGTCAAGTTGGTGG AGGCCCTTTGTGCTGAACACCAAATCAACCTAATT AAGGTTGATGACAACAAGAAACTAGGAGAATGGGT AGGCCTTTGTAAAATTGACAGAGAGGGGAAACCC CGTAAAGTGGTTGGTTGCAGTTGTGTAGTAGTTAA GGACTATGGCAAGGAGTCTCAGGCCAAGGATGTC ATTGAAGAGTATTTCAAATGCAAGAAATGAAGAAAT AAATCTTTGGCTCACAAAAAAAAAAAAAAAAAAAAA AAAAAAAAA | 5 | MLLEV* |
| 468 | NM_0010 17.2_212 | 212 | CGCTCTCCTTTCGTTGCCTGATCGCCGCCATCATG GGTCGCATGCATGCTCCCGGGAAGGGCCTGTCCC AGTCGGCTTTACCCTATCGACGCAGCGTCCCCACT TGGTTGAAGTTGACATCTGACGACGTGAAGGAGC AGATTTACAAACTGGCCAAGAAGGGCCTTACTCCT TCACAGATCGGTGTAATCCTGAGAGATTCACATGG TGTGCACAAGTACGTTTTGTGACAGGCAATAAAAT TTTAAGAATTCTTAAGTCTAAGGGACTTGCTCCTGA TCTTCCTGAAGATCTCTACCATTTAATTAAGAAAGC AGTTGCTGTTCGAAAGCATCTTGAGAGGAACAGAA AGGATAAGGATGCTAAATTCCGTCTGATTCTAATA | 5 | HKYVL* |

TABLE 3A-continued

| SEQ ID | identifier_position | position | modified_RNA | PAP length | PAP |
|---|---|---|---|---|---|
| | | | GAGAGCCGGATTCACCGTTTGGCTCGATATTATAAGACCAAGCGAGTCCTCCCTCCCAATTGGAAATATGAATCATCTACAGCCTCTGCCCTGGTCGCATAAATTTGTCTGTGTACTCAAGCAATAAAATGATTGTTTAACTA | | |
| 469 | NM_0010 17.2_227 | 227 | CGCTCTCCTTTCGTTGCCTGATCGCCGCCATCATGGGTCGCATGCATGCTCCCGGGAAGGGCCTGTCCCAGTCGGCTTTACCCTATCGACGCAGCGTCCCCACTTGGTTGAAGTTGACATCTGACGACGTGAAGGAGCAGATTTACAAACTGGCCAAGAAGGGCCTTACTCCTTCACAGATCGGTGTAATCCTGAGAGATTCACATGGTGTTGCACAAGTACGTTTGTGACAGGCAATAAAATTTTAAGAATTCTTAAGTCTAAGGGACTTGCTCCTGATCTTCCTGAAGATCTCTACCATTTAATTAAGAAAGCAGTTGCTGTTCGAAAGCATCTTGAGAGGAACAGAAAGGATAAGGATGCTAAATTCCGTCTGATTCTAATAGAGAGCCGGATTCACCGTTTGGCTCGATATTATAAGACCAAGCGAGTCCTCCCTCCCAATTGGAAATATGAATCATCTACAGCCTCTGCCCTGGTCGCATAAATTTGTCTGTGTACTCAAGCAATAAAATGATTGTTTAACTA | 1 | L* |
| 470 | NM_0010 17.2_406 | 406 | CGCTCTCCTTTCGTTGCCTGATCGCCGCCATCATGGGTCGCATGCATGCTCCCGGGAAGGGCCTGTCCCAGTCGGCTTTACCCTATCGACGCAGCGTCCCCACTTGGTTGAAGTTGACATCTGACGACGTGAAGGAGCAGATTTACAAACTGGCCAAGAAGGGCCTTACTCCTTCACAGATCGGTGTAATCCTGAGAGATTCACATGGTGTTGCACAAGTACGTTTTGTGACAGGCAATAAAATTTTAAGAATTCTTAAGTCTAAGGGACTTGCTCCTGATCTTCCTGAAGATCTCTACCATTTAATTAAGAAAGCAGTTGCTGTTCGAAAGCATCTTGAGAGGAACAGAAAGGATAAGGATGCTAAATTCCGTCTGATTCTAATAGAGAGCCGGATTCACCGTTTGGCTCGATATTATAAGACCAAGCGAGTCCTCCCTCCCAATTGGAAATATGAATCATCTACAGCCTCTGCCCTGGTCGCATAAATTTGTCTGTGTACTCAAGCAATAAAATGATTGTTTAACTA | 35 | WLDIIRPSESSLPIGNMNHLQPLPWSHKFVCVLKQ* |
| 471 | NM_0010 17956.1_245 | 245 | GAGGCCGCTGCCTGGCTTAGGGCGGAAACAGATTCTCTGCATAAGAAGGGGAACGAAAGATGGCGGCGGAAACGCTGCTGTCCAGTTTGTTAGGACTGCTGCTTCTGGGACTCCTGTTACCCGCAAGTCTGACCGGCGGTGTCGGGAGCCTGAACCTGGAGGAGCTGAGTGAGATGCGTTATGGGATCGAGATCCTGCCGTTGCCTGTCATGGGAGGGCAGAGCCAATCTTCGGACGTGGTGATGTCTCCTCTAAGTACAAACAGCGCTATGAGTGTCGCCTGCCAGCTGGAGCTATTCACTTCCAGCGTGAAAGGGAGGAGGAAACACCTGCTTACCAAGGGCCTGGGATCCCTGAGTTGTTGAGCCCAATGAGAGATGCTCCCTGCTTGCTGAAGACAAAGGACTGGTGGACATATGAATTCTGTTATGGACGCCACATCCAGCAATACCACATGGAAGATTCAGAGATCAAAGGTGAAGTCCTCTATCTCGGCTACTACCAATCAGCCTTCGACTGGGATGATGAAACAGCCAAGGCCTCCAAGCAGCATCGTCTTAAACGCTACCACAGCCAGACCTATGGCAATGGGTCCAAGTGCGACCTTAATGGGAGGCCCCGGGAGGCCGAGGTTCGGTTCCTCTGTGACGAGGGTGCAGGTATCTCTGGGGACTACATCGATCGCGTGGACGAGCCCTTGTCCTGCTCTTATGTGCTGACCATTCGCACTCCTCGGCTCTGCCCCCACCCTCTCCTCCGGCCCCCACCCAGTGCTGCACCGCAGGCCATCCTCTGTCACCCTTCCCTACAGCCTGAGGAGTACATGGCCTACGTTCAGAGGCAAGCCGACTCAAAGCAGTATGGAGATAAAATCATAGAGGAGCTGCAAGATCTAGGCCCCCAAGTGTGGAGTGAGACCAAGTCTGGGGTGGCACCCCAAAAGATGGCAGGTGCGAGCCCGACCAAGGATGACAGTAAGGACTCAGATTTCTGGAAGATGCTTAATGAGCCAGAGGACCAGGCC | 40 | MSPLSTNSAMSVACQLELFTSSVKGRRKHLLTKGLGSLSC* |
| 472 | NM_0010 18068.1_318 | 318 | CGGATGTGTGCCTGGCGCCGGAAGAGAAGACGGCCCCCCTCTCTCGGCCCGGCCATCTTGTGGGAAGAGCTGAAGCAGGCGCTCTTGGCTCGGCGCGGCCCGCTGCAATCCGTGGAGGAACGCGCCGCCGAGCCACCATCATGCCTGGCACTTACAGGAAGGCTTCGGCTGCGTGGTCACCAACCGATTCGACCAGTTATTTGACGACGAATCGGACCCCTTCGAGGTGCTGAAGGCAGCAGAGAACAAGAAAAAAGAAGCCGGCGGGGGCGGCGTTGGGGGCCCTGGGGCAAGAGCGCAGCTCAGGCCGCGGCCAGACCAACTCCAACGCGGCAG | 46 | RPTPTRQANSCARSPRKTARTRCPPALAWLTRKRRRSRPWRLRKKE* |

TABLE 3A-continued

| SEQ ID | identifier_ position | position | modified_RNA | PAP length | PAP |
|---|---|---|---|---|---|
| | | | GCAAACAGCTGCGCAAGGAGTCCCAGAAAGACCG CAAGAACCCGCTGCCCCCCAGCGTTGGCGTGGTT GACAAGAAAGAGGAGACGCAGCCGCCCGTGGCG CTTAAGAAAGAAGGAATAAGACGAGTTGGAAGAAG ACCTGATCAACAACTTCAGGGTGAAGGGAAAATAA TTGATAGAAGACCAGAAAGGCGACCACCTCGTGA ACGAAGATTCGAAAAGCCACTTGAAGAAAAGGGTG AAGGAGGCGAATTTTCAGTTGATAGACCGATTATT GACCGACCTATTCGAGGTCGTGGTGGTCTTGGAA GAGGTCGAGGGGGCCGTGGACGTGGAATGGGCC GAGGAGATGGATTTGATTCTCGTGGCAAACGTGAA TTTGATAGGCATAGTGGAAGTGATAGATCTGGCCT GAAGCACGAGGACAAACGTGGAGGTAGCGGATCT CACAACTGGGGAACTGTCAAAGACGAATTAACAGA GTCCCCCAAATACATTCAGAAACAAATATCTTATAA TTACAGTGACTTGGATCAATCAAATGTGACTGAGG AAACACCTGAAGGTGAAGAACATCATCCAGTGGCA GACACTGAAAATAAGGAGAATGAAGTTGAAGAGGT AAAAGAGGAGGGTCCAAAAGAGATGACTTTGGAT GAGTGGAAGGCTATTCAAAATAAGGACCGG | | |
| 473 | NM_0010 18068.1_ 535 | 535 | CGGATGTGTGCCTGGCGCCGGAAGAGAAGACGG CCCCCCTCTCTCGGCCCGGCCATCTTGTGGGAAG AGCTGAAGCAGGCGCTCTTGGCTCGGCGCGGCCC GCTGCAATCCGTGGAGGAACGCGCCGCCGAGCC ACCATCATGCCTGGGCACTTACAGGAAGGCTTCG GCTGCGTGGTCACCAACCGATTCGACCAGTTATTT GACGACGAATCGGACCCCTTCGAGGTGCTGAAGG CAGCAGAGAACAAGAAAAAAGAAGCCGGCGGGGG CGGCGTTGGGGGCCCTGGGGCCAAGAGCGCAGC TCAGGCCGCGGCCCAGACCAACTCCAACGCGGCA GGCAAACAGCTGCGCAAGGAGTCCCAGAAAGACC GCAAGAACCCGCTGCCCCCCAGCGTTGGCGTGGT TGACAAGAAAGAGGAGACGCAGCCGCCCGTGGGC GCTTAAGAAAGAAGGAATAAGACGAGTTGGAAGAA GACCTGATCAACAACTTCAGGGTGAAGGGAAAATA ATTGATAGAAGACCAGAAAGGCGACACCTCGTGAA CGAAGATTCGAAAAGCCACTTGAAGAAAAGGGTGA AGGAGGCGAATTTTCAGTTGATAGACCGATTATTG ACCGACCTATTCGAGGTCGTGGTGGTCTTGGAAG AGGTCGAGGGGGCCGTGGACGTGGAATGGGCCG AGGAGATGGATTTGATTCTCGTGGCAAACGTGAAT TTGATAGGCATAGTGGAAGTGATAGATCTGGCCTG AAGCACGAGGACAAACGTGGAGGTAGCGGATCTC ACAACTGGGGAACTGTCAAAGACGAATTAACAGAG TCCCCCAAATACATTCAGAAACAAATATCTTATAAT TACAGTGACTTGGATCAATCAAATGTGACTGAGGA AACACCTGAAGGTGAAGAACATCATCCAGTGGCA GACACTGAAAATAAGGAGAATGAAGTTGAAGAGGT AAAAGAGGAGGGTCCAAAAGAGATGACTTTGGAT GAGTGGAAGGCTATTCAAAATAAGGACCGG | 72 | HLVNEDSK SHLKKRVK EANFQLID RLLTDLFE VVVVLEEV EGAVDVE WAEEMDLI LVANVNLI GIVEVIDLA* |
| 474 | NM_0010 18069.1_ 318 | 318 | CGGATGTGTGCCTGGCGCCGGAAGAGAAGACGG CCCCCCTCTCTCGGCCCGGCCATCTTGTGGGAAG AGCTGAAGCAGGCGCTCTTGGCTCGGCGCGGCCC GCTGCAATCCGTGGAGGAACGCGCCGCCGAGCC ACCATCATGCCTGGGCACTTACAGGAAGGCTTCG GCTGCGTGGTCACCAACCGATTCGACCAGTTATTT GACGACGAATCGGACCCCTTCGAGGTGCTGAAGG CAGCAGAGAACAAGAAAAAAGAAGCCGGCGGGGG CGGCGTTGGGGGCCCTGGGGCCAAGAGCGCAGC TCAGGCCGCGGCCAGACCAACTCCAACGCGGCAG GCAAACAGCTGCGCAAGGAGTCCCAGAAAGACCG CAAGAACCCGCTGCCCCCCAGCGTTGGCGTGGTT GACAAGAAAGAGGAGACGCAGCCGCCCGTGGCG CTTAAGAAAGAAGGAATAAGACGAGTTGGAAGAAG ACCTGATCAACAACTTCAGGGTGAAGGGAAAATAA TTGATAGAAGACCAGAAAGGCGACCACCTCGTGA ACGAAGATTCGAAAAGCCACTTGAAGAAAAGGGTG AAGGAGGCGAATTTTCAGTTGATAGACCGATTATT GACCGACCTATTCGAGGTCGTGGTGGTCTTGGAA GAGGTCGAGGGGGCCGTGGACGTGGAATGGGCC GAGGAGATGGATTTGATTCTCGTGGCAAACGTGAA TTTGATAGGCATAGTGGAAGTGATAGATCTTCTTTT TCACATTACAGTGGCCTGAAGCACGAGGACAAAC GTGGAGGTAGCGGATCTCACAACTGGGGAACTGT CAAAGACGAATTAACTGACTTGGATCAATCAAATG TGACTGAGGAAACACCTGAAGGTGAAGAACATCAT CCAGTGGCAGACACTGAAAATAAGGAGAATGAAGT | 46 | RPTPTRQA NSCARSPR KTARTRCP PALAWLTR KRRRSRP WRLRKKE* |

TABLE 3A-continued

| SEQ ID | identifier_position | position | modified_RNA | PAP length | PAP |
|---|---|---|---|---|---|
| 475 | NM_0010 18069.1_ 535 | 535 | TGAAGAGGTAAAAGAGGAGGGTCCAAAAGAGATG ACTTTGGATGAGTGGAAGGCTATTCAAAATAAGGA CCGGGCAAAAGTAGAATTTAATATCCGAAAA CGGATGTGTGCCTGGCGCCGGAAGAGAAGACGG CCCCCCTCTCTCGGCCCGGCCATCTTGTGGGAAG AGCTGAAGCAGGCGCTCTTGGCTCGGCGCGGCCC GCTGCAATCCGTGGAGGAACGCGCCGCCGAGCC ACCATCATGCCTGGGCACTTACAGGAAGGCTTCG GCTGCGTGGTCACCAACCGATTCGACCAGTTATTT GACGACGAATCGGACCCCTTCGAGGTGCTGAAGG CAGCAGAGAACAAGAAAAAAGAAGCCGGCGGGGG CGGCGTTGGGGGCCCTGGGGCCAAGAGCGCAGC TCAGGCCGCGGCCCAGACCAACTCCAACGCGGCA GGCAAACAGCTGCGCAAGGAGTCCCAGAAAGACC GCAAGAACCCGCTGCCCCCCAGCGTTGGCGTGGT TGACAAGAAAGAGGAGACGCAGCCGCCCGTGGC GCTTAAGAAAGAAGGAATAAGACGAGTTGGAAGAA GACCTGATCAACAACTTCAGGGTGAAGGGAAAATA ATTGATAGAAGACCAGAAAGGCGACACCTCGTGAA CGAAGATTCGAAAAGCCACTTGAAGAAAAGGGTGA AGGAGGCGAATTTTCAGTTGATAGACCGATTATTG ACCGACCTATTCGAGGTCGTGGTGGTCTTGGAAG AGGTCGAGGGGGCCGTGGACGTGGAATGGGCCG AGGAGATGGATTTGATTCTCGTGGCAAACGTGAAT TTGATAGGCATAGTGGAAGTGATAGATCTTCTTTTT CACATTACAGTGGCCTGAAGCACGAGGACAAACG TGGAGGTAGCGGATCTCACAACTGGGGAACTGTC AAAGACGAATTAACTGACTTGGATCAATCAAATGT GACTGAGGAAACACCTGAAGGTGAAGAACATCATC CAGTGGCAGACACTGAAAAATAAGGAGAATGAAGTT GAAGAGGTAAAAGAGGAGGGTCCAAAAGAGATGA CTTTGGATGAGTGGAAGGCTATTCAAAATAAGGAC CGGGCAAAAGTAGAATTTAATATCCGAAAA | 78 | HLVNEDSK SHLKKRVK EANFQLID RLLTDLFE VVVVLEEV EGAVDVE WAEEMDLI LVANVNLI GIVEVIDLL FHITVA* |
| 476 | NM_0010 18073.1_ 157 | 157 | CCCCCTCCTTTTTAAGCGCCTCCCGCCAGCCTCTG CTGTGGCTCGCTTCGCCGCGCTCCCTCCTTCCCC GCCTTCCATACCTCCCCGGCTCCGCTCGGTTCCT GGCCACCCCGCAGCCCCTGCCCAGGTGCCATGG CCGCATTGTACCGCCCTGGCTGCGGCTTAACTGG CATGGGCTGAGCCCCTTGGGCTGGCCATCATGCC GTAGCATCCAGACCCTGCGAGTGCTTAGTGGAGA TCTGGGCCAGCTTCCCACTGGCATTCGAGATTTTG TAGAGCACAGTGCCCGCCTGTGCCAACCAGAGGG CATCCACATCTGTGATGGAACTGAGGCTGAGAATA CTGCCACACTGACCCTGCTGGAGCAGCAGGGCCT CATCCGAAAGCTCCCCAAGTACAATAACTGCTGGC TGGCCCGCACAGACCCCAAGGATGTGGCACGAGT AGAGAGCAAGACGGTGATTGTAACTCCTTCTCAGC GGGACACGGTACAACTCCCGCCTGGTGGGGCCC GTGGGCAGCTGGGCAACTGGATGTCCCCAGCTGA TTTCCAGCGAGCTGTGGATGAGAGGTTTCCAGGCT GCATGCAGGGCCGCACCATGTATGTGCTTCCATTC AGCATGGGTCCTGTGGGCTCCCCGCTGTCCCGCA TCGGGGTGCAGCTCACTGACTCAGCCTATGTGGT GGCAAGCATGCGTATTATGACCCGACTGGGGACA CCTGTGCTTCAGGCCCTGGGAGATGGTGACTTTGT CAAGTGTCTGCACTCCGTGGGCCAGCCCCTGACA GGACAAGGGGAGCCAGTGAGCCAGTGGCCGTGC AACCCAGAGAAAACCCTGATTGGCCACGTGCCCG ACCAGCGGGAGATCATCTCCTTCGGCAGCGGCTA TGGTGGCAACTCCCTGCTGGGCAAGAAGTGCTTT GCCCTACGCATCGCCTCTCGGCTGGCCCGGGATG AGGGCTGGCTGGCAGAGCACATGCTGATCCTGGG CATCACCAGCCCTGCAGGGAAGAAGCGCTATGT | 7 | CGLTGMG* |
| 477 | NM_0010 18073.1_ 313 | 313 | CCCCCTCCTTTTTAAGCGCCTCCCGCCAGCCTCTG CTGTGGCTCGCTTCGCCGCGCTCCCTCCTTCCCC GCCTTCCATACCTCCCCGGCTCCGCTCGGTTCCT GGCCACCCCGCAGCCCCTGCCCAGGTGCCATGG CCGCATTGTACCGCCCTGGCTGCGGCTTAACTG GCATGGGCTGAGCCCCTTGGGCTGGCCATCATGC CGTAGCATCCAGACCCTGCGAGTGCTTAGTGGAG ATCTGGGCCAGCTTCCCACTGGCATTCGAGATTTT GTAGAGCACAGTGCCCGCCTGTGCCAACCAGAGG GCATCACATCTGTGATGGAACTGAGGCTGAGAATA CTGCCACACTGACCCTGCTGGAGCAGCAGGGCCT CATCCGAAAGCTCCCCAAGTACAATAACTGCTGGC TGGCCCGCACAGACCCCAAGGATGTGGCACGAGT AGAGAGCAAGACGGTGATTGTAACTCCTTCTCAGC | 13 | TSVMELRL RILPH* |

TABLE 3A-continued

| SEQ ID | identifier_position | position | modified_RNA | PAP length | PAP |
|---|---|---|---|---|---|
| | | | GGGACACGGTACAACTCCCGCCTGGTGGGGCCC<br>GTGGGCAGCTGGGCAACTGGATGTCCCCAGCTGA<br>TTTCCAGCGAGCTGTGGATGAGAGGTTTCCAGGCT<br>GCATGCAGGGCCGCACCATGTATGTGCTTCCATTC<br>AGCATGGGTCCTGTGGGCTCCCCGCTGTCCCGCA<br>TCGGGGTGCAGCTCACTGACTCAGCCTATGTGGT<br>GGCAAGCATGCGTATTATGACCCGACTGGGGACA<br>CCTGTGCTTCAGGCCCTGGGAGATGGTGACTTTGT<br>CAAGTGTCTGCACTCCGTGGGCCAGCCCCTGACA<br>GGACAAGGGGAGCCAGTGAGCCAGTGGCCGTGC<br>AACCCAGAGAAAACCCTGATTGGCCACGTGCCCG<br>ACCAGCGGGAGATCATCTCCTTCGGCAGCGGCTA<br>TGGTGGCAACTCCCTGCTGGGCAAGAAGTGCTTT<br>GCCCTACGCATCGCCTCTCGGCTGGCCCGGGATG<br>AGGGCTGGCTGGCAGAGCACATGCTGATCCTGGG<br>CATCACCAGCCCTGCAGGGAAGAAGCGCTATGT | | |
| 478 | NM_0010<br>20.4_198 | 198 | GAAAAGCGGCCAGGGTGGCCCCTAGCTTTCCTTTT<br>CCGGTTGCGGCGCCGCGCGGTGAGGTTGTCTAGT<br>CCACGCTCGGAGCCATGCCGTCCAAGGGCCCGCT<br>GCAGTCTGTGCAGGTCTTCGGACGCAAGAAGACA<br>GCGACAGCTGTGGCGCACTGCAAACGCGGCAATG<br>GTCTCATCAAGGTGAACGGGCGGCCCTGGAGATG<br>ATTGAGCCGCGCACGCTACAGTACAAGCTGCTGG<br>AGCCAGTTCTGCTTCTCGGCAAGGAGCGATTTGCT<br>GGTGTAGACATCCGTGTCCGTGTAAAGGGTGGTG<br>GTCACGTGGCCCAGATTTATGCTATCCGTCAGTCC<br>ATCTCCAAAGCCCTGGTGGCCTATTACCAGAAATA<br>TGTGGATGAGGCTTCCAAGAAGGAGATCAAAGAC<br>ATCCTCATCCAGTATGACCGGACCCTGCTGGTAGC<br>TGACCCTCGTCGCTGCGAGTCCAAAAAGTTTGGA<br>GGCCCTGGTGCCCGCGCTCGCTACCAGAAATCCT<br>ACCGATAAGCCCATCGTGACTCAAAACTCACTTGT<br>ATAATAAACAGTTTTTGAGGGATTTTAAAGTTTCAA<br>GAAAAAAAAAAAAAAAA | 2 | WR* |
| 479 | NM_0010<br>20.4_272 | 272 | GAAAAGCGGCCAGGGTGGCCCCTAGCTTTCCTTTT<br>CCGGTTGCGGCGCCGCGCGGTGAGGTTGTCTAGT<br>CCACGCTCGGAGCCATGCCGTCCAAGGGCCCGCT<br>GCAGTCTGTGCAGGTCTTCGGACGCAAGAAGACA<br>GCGACAGCTGTGGCGCACTGCAAACGCGGCAATG<br>GTCTCATCAAGGTGAACGGGCGGCCCTGGAGAT<br>GATTGAGCCGCGCACGCTACAGTACAAGCTGCTG<br>GAGCCAGTTCTGCTTCTCGGCAAGGAGCGATTGC<br>TGGTGTAGACATCCGTGTCCGTGTAAAGGGTGGT<br>GGTCACGTGGCCCAGATTTATGCTATCCGTCAGTC<br>CATCTCCAAAGCCCTGGTGGCCTATTACCAGAAAT<br>ATGTGGATGAGGCTTCCAAGAAGGAGATCAAAGA<br>CATCCTCATCCAGTATGACCGGACCCTGCTGGTAG<br>CTGACCCTCGTCGCTGCGAGTCCAAAAAGTTTGGA<br>GGCCCTGGTGCCCGCGCTCGCTACCAGAAATCCT<br>ACCGATAAGCCCATCGTGACTCAAAACTCACTTGT<br>ATAATAAACAGTTTTTGAGGGATTTTAAAGTTTCAA<br>GAAAAAAAAAAAAAAAA | 3 | LLV* |
| 480 | NM_0010<br>20.4_438 | 438 | GAAAAGCGGCCAGGGTGGCCCCTAGCTTTCCTTTT<br>CCGGTTGCGGCGCCGCGCGGTGAGGTTGTCTAGT<br>CCACGCTCGGAGCCATGCCGTCCAAGGGCCCGCT<br>GCAGTCTGTGCAGGTCTTCGGACGCAAGAAGACA<br>GCGACAGCTGTGGCGCACTGCAAACGCGGCAATG<br>GTCTCATCAAGGTGAACGGGCGGCCCTGGAGAT<br>GATTGAGCCGCGCACGCTACAGTACAAGCTGCTG<br>GAGCCAGTTCTGCTTCTCGGCAAGGAGCGATTTG<br>CTGGTGTAGACATCCGTGTCCGTGTAAAGGGTGG<br>TGGTCACGTGGCCCAGATTTATGCTATCCGTCAGT<br>CCATCTCCAAAGCCCTGGTGGCCTATTACCAGAAA<br>TATGTGGATGAGGCTTCCAAGAAGGAGATCAAAGA<br>CATCCTCATCCAGTATGACCGGACCCTGCTGGTAGC<br>TGACCCTCGTCGCTGCGAGTCCAAAAAGTTTGGA<br>GGCCCTGGTGCCCGCGCTCGCTACCAGAAATCCT<br>ACCGATAAGCCCATCGTGACTCAAAACTCACTTGT<br>ATAATAAACAGTTTTTGAGGGATTTTAAAGTTTCAA<br>GAAAAAAAAAAAAAAAA | 2 | CW* |
| 481 | NM_0010<br>21.3_301 | 301 | GTTTCCTCTTTTACCAAGGACCCGCCAACATGGGC<br>CGCGTTCGCACCAAAAACCGTGAAGAAGGCGGCCC<br>GGGTCATCATAGAAAAGTACTACACGCGCCTGGG<br>CAACGACTTCCACACGAACAAGCGCGTGTGCGAG<br>GAGATCGCCATTATCCCCAGCAAAAAGCTCCGCAA<br>CAAGATAGCAGGTTATGTCACGCATCTGATGAAGC<br>GAATTCAGAGAGGCCCAGTAAGAGGTATCTCCATC | 7 | WIRRLLK* |

TABLE 3A-continued

| SEQ ID | identifier_ position | position | modified_RNA | PAP length | PAP |
|---|---|---|---|---|---|
| | | | AAGCTGCAGGAGGAGGAGAGAGAAAGGAGAGACA ATTATGTTCCTGAGGTCTCAGCCTGGATCAGGAGA TTATTGAAGTAGATCCTGACACTAAGGAAATGCTG AAGCTTTTGGACTTCGGCAGTCTGTCCAACCTTCA GGTCACTCAGCCTACAGTTGGGATGAATTTCAAAA CGCCTCGGGGACCTGTTTGAATTTTTTCTGTAGTG CTGTATTATTTTCAATAAATCTGGGACAACAGCAAA AAAAAAAAAAAAAAAAAAAAAAAAA | | |
| 482 | NM_0010 21.3_317 | 317 | GTTTCCTCTTTTACCAAGGACCCGCCAACATGGGC CGCGTTCGCACCAAAACCGTGAAGAAGGCGGCCC GGGTCATCATAGAAAAGTACTACACGCGCCTGGG CAACGACTTCCACACGAACAAGCGCGTGTGCGAG GAGATCGCCATTATCCCCAGCAAAAAGCTCCGCAA CAAGATAGCAGGTTATGTCACGCATCTGATGAAGC GAATTCAGAGAGGCCCAGTAAGAGGTATCTCCATC AAGCTGCAGGAGGAGGAGAGAGAAAGGAGAGACA ATTATGTTCCTGAGGTCTCAGCCTTGGATCAGGAG ATTATGAAGTAGATCCTGACACTAAGGAAATGCTG AAGCTTTTGGACTTCGGCAGTCTGTCCAACCTTCA GGTCACTCAGCCTACAGTTGGGATGAATTTCAAAA CGCCTCGGGGACCTGTTTGAATTTTTTCTGTAGTG CTGTATTATTTTCAATAAATCTGGGACAACAGCAAA AAAAAAAAAAAAAAAAAAAAAAAAA | 2 | MK* |
| 483 | NM_0010 21.3_355 | 355 | GTTTCCTCTTTTACCAAGGACCCGCCAACATGGGC CGCGTTCGCACCAAAACCGTGAAGAAGGCGGCCC GGGTCATCATAGAAAAGTACTACACGCGCCTGGG CAACGACTTCCACACGAACAAGCGCGTGTGCGAG GAGATCGCCATTATCCCCAGCAAAAAGCTCCGCAA CAAGATAGCAGGTTATGTCACGCATCTGATGAAGC GAATTCAGAGAGGCCCAGTAAGAGGTATCTCCATC AAGCTGCAGGAGGAGGAGAGAGAAAGGAGAGACA ATTATGTTCCTGAGGTCTCAGCCTTGGATCAGGAG ATTATTGAAGTAGATCCTGACACTAAGGAAATGCT GAAGCTTTGGACTTCGGCAGTCTGTCCAACCTTCA GGTCACTCAGCCTACAGTTGGGATGAATTTCAAAA CGCCTCGGGGACCTGTTTGAATTTTTTCTGTAGTG CTGTATTATTTTCAATAAATCTGGGACAACAGCAAA AAAAAAAAAAAAAAAAAAAAAAAAA | 17 | WTSAVCPT FRSLSLQL G* |
| 484 | NM_0010 21.3_87 | 87 | GTTTCCTCTTTTACCAAGGACCCGCCAACATGGGC CGCGTTCGCACCAAAACCGTGAAGAAGGCGGCCC GGGTCATCATAGAAAAGACTACACGCGCCTGGGC AACGACTTCCACACGAACAAGCGCGTGTGCGAGG AGATCGCCATTATCCCCAGCAAAAAGCTCCGCAAC AAGATAGCAGGTTATGTCACGCATCTGATGAAGCG AATTCAGAGAGGCCCAGTAAGAGGTATCTCCATCA AGCTGCAGGAGGAGGAGAGAGAAAGGAGAGACAA TTATGTTCCTGAGGTCTCAGCCTTGGATCAGGAGA TTATTGAAGTAGATCCTGACACTAAGGAAATGCTG AAGCTTTTGGACTTCGGCAGTCTGTCCAACCTTCA GGTCACTCAGCCTACAGTTGGGATGAATTTCAAAA CGCCTCGGGGACCTGTTTGAATTTTTTCTGTAGTG CTGTATTATTTTCAATAAATCTGGGACAACAGCAAA AAAAAAAAAAAAAAAAAAAAAAAAA | 30 | TTRAWATT STRTSACA RRSPLSPA KSSATR* |
| 485 | NM_0010 22.3_733 | 733 | GTACTTTCGCCATCATAGTATTCTCCACCACTGTTC CTTCCAGCCACGAACGACGCAAACGAAGCCAAGT TCCCCCAGCTCCGAACAGGAGCTCTCTATCCTCTC TCTATTACACTCCGGGAGAAGGAAACGCGGGAGG AAACCCAGGCCTCCACGCGCGACCCCTTGGCCCT CCCCTTTACCTCTCCACCCCTCACTAGACACCCTC CCCTCTAGGCGGGGACGAACTTTCGCCCTGAGAG AGGCGGAGCCTCAGCGTCTACCCTCGCTCTCGCG AGCTTTCGGAACTCTCGCGAGACCCTACGCCCGA CTTGTGCGCCCGGGAAACCCCGTCGTTCCCTTTC CCCTGGCTGGCAGCGCGGAGGCCGCACGATGCC TGGAGTTACTGTAAAAGACGTGAACCAGCAGGAGT TCGTCAGAGCTCTGGCAGCCTTCCTCAAAAAGTCC GGGAAGCTGAAAGTCCCCGAATGGGTGGATACCG TCAAGCTGGCCAAGCACAAAGAGCTTGCTCCCTAC GATGAGAACTGGTTCTACACGCGAGCTGCTTCCAC AGCGCGGCACCTGTACCTCCGGGGTGGCGCTGG GGTTGGCTCCATGACCAAGATCTATGGGGACGT CAGAGAAACGGCGTCATGCCCAGCCACTTCAGCC GAGGCTCCAAGAGTGTGGCCCGCCGGGTCCTCCA AGCCCTGGAGGGGCTGAAAATGGTGGAAAAGGAC CAAGATGGCGGCGCAAACTGACACCTCAGGGACA AAGAGATCTGGACAGAATCGCCGGACAGGTGGCA GCTGCCAACAAGAAGCATTAGAACAAACCATGCTG | 2 | AN* |

TABLE 3A-continued

| SEQ ID | identifier_position | position | modified_RNA | PAP length | PAP |
|---|---|---|---|---|---|
| | | | GGTTAATAAATTGCCTCATTCGTAAAAAAAAAAAAAAAAAAAAAAAAA | | |
| 486 | NM_0010 23.2_418 | 418 | CTTTCTTTTTGAGGAAGACGCGGTCGTAAGGGCTG AGGATTTTTGGTCCGCACGCTCCTGCTCCTGACTC ACCGCTGTTCGCTCTCGCCGAGGAACAAGTCGGT CAGGAAGCCCGCGCGCAACAGCCATGGCTTTTAA GGATACCGGAAAAACACCCGTGGAGCCGGAGGTG GCAATTCACCGAATTCGAATCACCCTAACAAGCCG CAACGTAAAATCCTTGGAAAAGGTGTGTGCTGACT TGATAAGAGGCGCAAAAGAAAAGAATCTCAAAGTG AAAGGACCAGTTCGAATGCCTACCAAGACTTTGAG AATCACTACAAGAAAAACTCCTTGTGGTGAAGGTT CTAAGACGTGGGATCGTTTCCAGATGAGAATTCAC AAGCGACTCATTGACTTGCACAGTCCTTCTGAGAT GTTAAGCAGATTACTTCCATCAGTATTGAGCCAGG AGTTGAGGTGGAAGTCACCATTGCAGATGCTTAAG TCAACTATTTTAATAAATTGATGACCAGTTGTTAAA AAAAAAAAAAAAAAA | 30 | MLSRLLPS VLSQELRW KSPLQMLK STILIN* |
| 487 | NM_0010 24662.1_ 1035 | 1035 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGGTTCTCGCAACTGTTACAAAACCAGTTGGTG GTGACAAGAACGGCGGTACCCGGGTGGTTAAACT TCGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAACATCTTACTG ATGCTTACTTCAAGAAGAAGAAGCTGCGGAAGCCC AGACACCAGGAAGGTGAGATCTTCGACACAGAAA AAGAGAAATATGAGATTACGGAGCAGCGCAAGATT GATCAGAAAGCTGTGGACTCACAAATTTTACCAAA AATCAAAGCTATTCCT | 8 | ATCDLCLL* |
| 488 | NM_0010 24662.1_ 1054 | 1054 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGGTTCTCGCAACTGTTACAAAACCAGTTGGTG GTGACAAGAACGGCGGTACCCGGGTGGTTAAACT TCGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAACATCTTACTG ATGCTTACTTCAAGAAGAAGAAGCTGCGGAAGCCC AGACACCAGGAAGGTGAGATCTTCGACACAGAAA AAGAGAAATATGAGATTACGGAGCAGCGCAAGATT | 2 | LL* |

TABLE 3A-continued

| SEQ ID | identifier_position | position | modified_RNA | PAP length | PAP |
|---|---|---|---|---|---|
| 489 | NM_0010 24662.1_ 391 | 391 | GATCAGAAAGCTGTGGACTCACAAATTTTACCAAA AATCAAAGCTATTCCT GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATGGCAGGTATTCCCGATCTGCCATGTA TTCCAGAAAGGCCATGTACAAGAGGAAGTACTCAG CCGCTAAATCCAAGGTTGAAAAGAAAAAGAAGGAG AAGGTTCTCGCAACTGTTACAAAACCAGTTGGTGG TGACAAGAACGGCGGTACCCGGGTGGTTAAACTT CGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAACATCTTACTG ATGCTTACTTCAAGAAGAAGAAGCTGCGGAAGCCC AGACACCAGGAAGGTGAGATCTTCGACACAGAAA AAGAGAAATATGAGATTACGGAGCAGCGCAAGATT GATCAGAAAGCTGTGGACTCACAAATTTTACCAAA AATCAAAGCTATTCCTC | 72 | MAGIPDLP CIPERPCT RGSTQPLN PRLKRKRR RRFSQLLQ NQLVVTRT AVPGWLN FAKCLDIIL LKMCLESC* |
| 490 | NM_0010 24662.1_ 491 | 491 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGTTCTCGCAACTGTTACAAAACCAGTTGGTGG TGACAAGAACGGCGGTACCCGGGTGGTTAAACTT CGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAACATCTTACTG ATGCTTACTTCAAGAAGAAGAAGCTGCGGAAGCCC AGACACCAGGAAGGTGAGATCTTCGACACAGAAA AAGAGAAATATGAGATTACGGAGCAGCGCAAGATT GATCAGAAAGCTGTGGACTCACAAATTTTACCAAA AATCAAAGCTATTCCTC | 38 | FSQLLQNQ LVVTRTAV PGWLNFA KCLDIILLK MCLESC* |
| 491 | NM_0010 24662.1_ 673 | 673 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGTTCTCGCAACTGTTACAAAACCAGTTGGTG GTGACAAGAACGGCGGTACCCGGGTGGTTAAACT | 1 | F* |

TABLE 3A-continued

| SEQ ID | identifier_position | position | modified_RNA | PAP length | PAP |
|---|---|---|---|---|---|
| | | | TCGCAAAATGCCTAGATATTATCCTACTGAAGATGT<br>GCCTCGAAAGCTGTTGAGCCACGGCAAAAAACCC<br>TTCAGTCAGCACGTGAGAAAACTGCGAGCCAGCA<br>TTACCCCCGGGACATTCTGATCATCCTCACTGGAC<br>GCCACAGGGGCAAGAGGGTGGTTTTCCTGAAGCA<br>GCTGGCTAGTGGCTTATTACTTGTGACTGGACCTC<br>TGGTCCTCAATCGAGTTCCTCTACGAAGAACACAC<br>CAGAAATTTGTCATTGCCACTTCAACCAAAATCGAT<br>ATCAGCAATGTAAAAATCCCAAAACATCTTACTGAT<br>GCTTACTTCAAGAAGAAGAAGCTGCGGAAGCCCA<br>GACACCAGGAAGGTGAGATCTTCGACACAGAAAA<br>AGAGAAATATGAGATTACGGAGCAGCGCAAGATTG<br>ATCAGAAAGCTGTGGACTCACAAATTTTACCAAAA<br>ATCAAAGCTATTCCTC | | |
| 492 | NM_0010<br>24662.1_<br>716 | 716 | GATTGCTTATAGACCGGAAGCCGGGACCTTAATTC<br>TCTTTCCCATCTTGCAAGGTAAGAATCGCGGGCCT<br>GTCTGCAAGACTTGAGTTCAGGACTCCCAATCCTT<br>CGCCATCCGAACCTGGAGGGCATCCAGTCGACAC<br>CTACAGGGGTCGGACATGTCCAAGGCTAACTGAG<br>AGGCCTTCCAGACGCTTCATTTTTGTTGTTTGGGTT<br>TGCGGCAGGGCACAAAGAGGATGGCGGGTGAAAA<br>AGTTGAGAAGCCAGATACTAAAGAGAAGAAACCCG<br>AAGCCAAGAAGGTTGATGCTGGTGGCAAGGTGAA<br>AAAGGGTAACCTCAAAGCTAAAAAGCCCAAGAAGG<br>GGAAGCCCCATTGCAGCCGCAACCCTGTCCTTGT<br>CAGAGGAATTGGCAGGTATTCCCGATCTGCCATGT<br>ATTCCAGAAAGGCCATGTACAAGAGGAAGTACTCA<br>GCCGCTAAATCCAAGGTTGAAAAGAAAAAGAAGGA<br>GAAGGTTCTCGCAACTGTTACAAAACCAGTTGGTG<br>GTGACAAGAACGGCGGTACCCGGGTGGTTAAACT<br>TCGCAAAATGCCTAGATATTATCCTACTGAAGATGT<br>GCCTCGAAAGCTGTTGAGCCACGGCAAAAAACCC<br>TTCAGTCAGCACGTGAGAAAACTGCGAGCCAGCA<br>TTACCCCCGGGACCATTCTGATCATCCTCACTGGA<br>CGCCACAGGGGCAAGAGGGTGTTTTCCTGAAGCA<br>GCTGGCTAGTGGCTTATTACTTGTGACTGGACCTC<br>TGGTCCTCAATCGAGTTCCTCTACGAAGAACACAC<br>CAGAAATTTGTCATTGCCACTTCAACCAAAATCGAT<br>ATCAGCAATGTAAAAATCCCAAAACATCTTACTGAT<br>GCTTACTTCAAGAAGAAGAAGCTGCGGAAGCCCA<br>GACACCAGGAAGGTGAGATCTTCGACACAGAAAA<br>AGAGAAATATGAGATTACGGAGCAGCGCAAGATTG<br>ATCAGAAAGCTGTGGACTCACAAATTTTACCAAAA<br>ATCAAAGCTATTCCTC | 2 | FS* |
| 493 | NM_0010<br>24662.1_<br>808 | 808 | GATTGCTTATAGACCGGAAGCCGGGACCTTAATTC<br>TCTTTCCCATCTTGCAAGGTAAGAATCGCGGGCCT<br>GTCTGCAAGACTTGAGTTCAGGACTCCCAATCCTT<br>CGCCATCCGAACCTGGAGGGCATCCAGTCGACAC<br>CTACAGGGGTCGGACATGTCCAAGGCTAACTGAG<br>AGGCCTTCCAGACGCTTCATTTTTGTTGTTTGGGTT<br>TGCGGCAGGGCACAAAGAGGATGGCGGGTGAAAA<br>AGTTGAGAAGCCAGATACTAAAGAGAAGAAACCCG<br>AAGCCAAGAAGGTTGATGCTGGTGGCAAGGTGAA<br>AAAGGGTAACCTCAAAGCTAAAAAGCCCAAGAAGG<br>GGAAGCCCCATTGCAGCCGCAACCCTGTCCTTGT<br>CAGAGGAATTGGCAGGTATTCCCGATCTGCCATGT<br>ATTCCAGAAAGGCCATGTACAAGAGGAAGTACTCA<br>GCCGCTAAATCCAAGGTTGAAAAGAAAAAGAAGGA<br>GAAGGTTCTCGCAACTGTTACAAAACCAGTTGGTG<br>GTGACAAGAACGGCGGTACCCGGGTGGTTAAACT<br>TCGCAAAATGCCTAGATATTATCCTACTGAAGATGT<br>GCCTCGAAAGCTGTTGAGCCACGGCAAAAAACCC<br>TTCAGTCAGCACGTGAGAAAACTGCGAGCCAGCA<br>TTACCCCCGGGACCATTCTGATCATCCTCACTGGA<br>CGCCACAGGGGCAAGAGGGTGGTTTTCCTGAAGC<br>AGCTGGCTAGTGGCTTATTACTTGTGACTGGACCT<br>CTGGTCCTCAATCGAGTTCCTCTACGAAGAACACA<br>CCAGAAATTGTCATTGCCACTTCAACCAAAATCGA<br>TATCAGCAATGTAAAAATCCCAAAACATCTTACTGA<br>TGCTTACTTCAAGAAGAAGAAGCTGCGGAAGCCCA<br>GACACCAGGAAGGTGAGATCTTCGACACAGAAAA<br>AGAGAAATATGAGATTACGGAGCAGCGCAAGATTG<br>ATCAGAAAGCTGTGGACTCACAAATTTTACCAAAA<br>ATCAAAGCTATTCCTC | 13 | LSLPLQPK<br>SISAM* |

TABLE 3A-continued

| SEQ ID | identifier_position | position | modified_RNA | PAP length | PAP |
|---|---|---|---|---|---|
| 494 | NM_0010 24662.1_ 860 | 860 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGGTTCTCGCAACTGTTACAAAACCAGTTGGTG GTGACAAGAACGGCGGTACCCGGGTGGTTAAACT TCGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAAATCTTACTGA TGCTTACTTCAAGAAGAAGAAGCTGCGGAAGCCCA GACACCAGGAAGGTGAGATCTTCGACACAGAAAA AGAGAAATATGAGATTACGGAGCAGCGCAAGATTG ATCAGAAAGCTGTGGACTCACAAATTTTACCAAAA ATCAAAGCTATTCCTC | 66 | ILLMLTSRR RSCGSPDT RKVRSSTQ KKRNMRL RSSARLIR KLWTHKFY QKSKLFLS SRATCDLC LL* |
| 495 | NM_0010 24662.1_ 973 | 973 | GATTGCTTATAGACCGGAAGCCGGGACCTTAATTC TCTTTCCCATCTTGCAAGGTAAGAATCGCGGGCCT GTCTGCAAGACTTGAGTTCAGGACTCCCAATCCTT CGCCATCCGAACCTGGAGGGCATCCAGTCGACAC CTACAGGGGTCGGACATGTCCAAGGCTAACTGAG AGGCCTTCCAGACGCTTCATTTTTGTTGTTTGGGTT TGCGGCAGGGCACAAAGAGGATGGCGGGTGAAAA AGTTGAGAAGCCAGATACTAAAGAGAAGAAACCCG AAGCCAAGAAGGTTGATGCTGGTGGCAAGGTGAA AAAGGGTAACCTCAAAGCTAAAAAGCCCAAGAAGG GGAAGCCCCATTGCAGCCGCAACCCTGTCCTTGT CAGAGGAATTGGCAGGTATTCCCGATCTGCCATGT ATTCCAGAAAGGCCATGTACAAGAGGAAGTACTCA GCCGCTAAATCCAAGGTTGAAAAGAAAAAGAAGGA GAAGGTTCTCGCAACTGTTACAAAACCAGTTGGTG GTGACAAGAACGGCGGTACCCGGGTGGTTAAACT TCGCAAAATGCCTAGATATTATCCTACTGAAGATGT GCCTCGAAAGCTGTTGAGCCACGGCAAAAAACCC TTCAGTCAGCACGTGAGAAAACTGCGAGCCAGCA TTACCCCCGGGACCATTCTGATCATCCTCACTGGA CGCCACAGGGGCAAGAGGGTGGTTTTCCTGAAGC AGCTGGCTAGTGGCTTATTACTTGTGACTGGACCT CTGGTCCTCAATCGAGTTCCTCTACGAAGAACACA CCAGAAATTTGTCATTGCCACTTCAACCAAAATCG ATATCAGCAATGTAAAAATCCCAAAACATCTTACTGA ATGCTTACTTCAAGAAGAAGAAGCTGCGGAAGCCC AGACACCAGGAAGGTGAGATCTTCGACACAGAAA AAGAGAAATATGAGATTACGGAGCAGCGCAAGAT GATCAGAAAGCTGTGGACTCACAAATTTTACCAAA AATCAAAGCTATTCCTC | 29 | MIRKLWTH KFYQKSKL FLSSRATC DLCLL* |
| 496 | NM_0010 25.4_216 | 216 | GGGGTCCTTGGCTGGGCGGGGCTTGCTCGCGGT GGCTTGTGGCTCCTTCCTGCGGTGCTTCTCTCTTT CGCTCAGGCCCGTGGCGCCGACAGGATGGGCAA GTGTCGTGGACTTCGTACTGCTAGGAAGCTCCGTA GTCACCGACGAGACCAGAAGTGGCATGATAAACA GTATAAGAAAGCTCATTTGGGCACAGCCCTAAAGG CCAACCCTTTGGAGGTGCTTCTCATGCAAAAGGAA TCGTGCTGGAAAAAGTAGGAGTTGAAGCCAAACA GCCAAATTCTGCCATTAGGAAGTGTGTAAGGGTCC AGCTGATCAAGAATGGCAAGAAAATCACAGCCTTT GTACCCAATGACGGTTGCTTGAACTTTATTGAGGA AAATGATGAAGTTCTGGTTGCTGGATTTGGTCGCA AAGGTCATGCTGTTGGTGATATTCCTGGAGTCCGC TTTAAGGTTGTCAAAGTAGCCAATGTTTCTCTTTTG GCCCTATACAAAGGCAAGAAGGAAAGACCAAGAT CATAAATATTAATGGTGAAAACACTGTAGTAATAAA TTTTCATATGCCAAAAAATGTTTGTATCTTACTGTC | 14 | LEVLLMQK ESCWKK* |

TABLE 3A-continued

| SEQ ID | identifier_position | position | modified_RNA | PAP length | PAP |
|---|---|---|---|---|---|
| | | | CCCTGTTCTCACCACGAAGATCATGTTCATTACCA CCACCACCCCCCTTATTTTTTTATCCTAAACCAG CAAACGCAGGACCTGTACCAATTTTAGGAGACAAT AAGACAGGGTTGTTTCAGGATTCTCTAGAGTTAAT AACATTTGTAACCTGGCACAGTTTCCCTCATCCTGT GGAATAAGAAAATGGGATAGATCTGGAATAAATGT GCAGTATTGTAGTATTACTTTAAGAACTTTAAGGGA ACTTCAAAAACTCACTGAAATTCTAGTGAGATACTT TCTTTTTTATTCTTGGTATTTTCCATATCGGGTGCA ACACTTCAGTTACCAAATTTCATTGCACATAGATTA TCTTAGGTACCCTTGGAAATGCACATTCTTGTATCC ATCTTACAGGGGCCCAAGATGATAAATAGTAAACT CAAAAT | | |
| 497 | NM_0010 25.4_408 | 408 | GGGGTCCTTGGCTGGGCGGGGCTTGCTCGCGGT GGCTTGTGGCTCCTTCCTGCGGTGCTTCTCTCTTT CGCTCAGGCCCGTGGCGCCGACAGGATGGGCAA GTGTCGTGGACTTCGTACTGCTAGGAAGCTCCGTA GTCACCGACGAGACCAGAAGTGGCATGATAAACA GTATAAGAAAGCTCATTTGGGCACAGCCCTAAAGG CCAACCCTTTTGGAGGTGCTTCTCATGCAAAAGGA ATCGTGCTGGAAAAAGTAGGAGTTGAAGCCAAACA GCCAAATTCTGCCATTAGGAAGTGTGTAAGGGTCC AGCTGATCAAGAATGGCAAGAAAATCACAGCCTTT GTACCCAATGACGGTTGCTTGAACTTTATTGAGGA AAATGATGAAGTTCTGGTTGCTGGATTGGTCGCAA AGGTCATGCTGTTGGTGATATTCCTGGAGTCCGCT TTAAGGTTGTCAAAGTAGCCAATGTTTCTCTTTTGG CCCTATACAAAGGCAAGAAGGAAAGACCAAGATCA TAAATATTAATGGTGAAAACACTGTAGTAATAAATT TTCATATGCCAAAAAATGTTTGTATCTTACTGTCCC CTGTTCTCACCACGAAGATCATGTTCATTACCACC ACCACCCCCCTTATTTTTTTATCCTAAACCAGCA AACGCAGGACCTGTACCAATTTTAGGAGACAATAA GACAGGGTTGTTTCAGGATTCTCTAGAGTTAATAA CATTTGTAACCTGGCACAGTTTCCCTCATCCTGTG GAATAAGAAAATGGGATAGATCTGGAATAAATGTG CAGTATTGTAGTATTACTTTAAGAACTTTAAGGGAA CTTCAAAAACTCACTGAAATTCTAGTGAGATACTTT CTTTTTTATTCTTGGTATTTTCCATATCGGGTGCAA CACTTCAGTTACCAAATTTCATTGCACATAGATTAT CTTAGGTACCCTTGGAAATGCACATTCTTGTATCCA TCTTACAGGGGCCCAAGATGATAAATAGTAAACTC AAAAT | 20 | LVAKVMLL VIFLESALR LSK* |
| 498 | NM_0010 25.4_485 | 485 | GGGGTCCTTGGCTGGGCGGGGCTTGCTCGCGGT GGCTTGTGGCTCCTTCCTGCGGTGCTTCTCTCTTT CGCTCAGGCCCGTGGCGCCGACAGGATGGGCAA GTGTCGTGGACTTCGTACTGCTAGGAAGCTCCGTA GTCACCGACGAGACCAGAAGTGGCATGATAAACA GTATAAGAAAGCTCATTTGGGCACAGCCCTAAAGG CCAACCCTTTTGGAGGTGCTTCTCATGCAAAAGGA ATCGTGCTGGAAAAAGTAGGAGTTGAAGCCAAACA GCCAAATTCTGCCATTAGGAAGTGTGTAAGGGTCC AGCTGATCAAGAATGGCAAGAAAATCACAGCCTTT GTACCCAATGACGGTTGCTTGAACTTTATTGAGGA AAATGATGAAGTTCTGGTTGCTGGATTTGGTCGCA AAGGTCATGCTGTTGGTGATATTCCTGGAGTCCGC TTTAAGGTTGTCAAAGTAGCCAATGTTTCTCTTTGG CCCTATACAAAGGCAAGAAGGAAAGACCAAGATCA TAAATATTAATGGTGAAAACACTGTAGTAATAAATT TTCATATGCCAAAAAATGTTTGTATCTTACTGTCCC CTGTTCTCACCACGAAGATCATGTTCATTACCACC ACCACCCCCCTTATTTTTTTATCCTAAACCAGCA AACGCAGGACCTGTACCAATTTTAGGAGACAATAA GACAGGGTTGTTTCAGGATTCTCTAGAGTTAATAA CATTTGTAACCTGGCACAGTTTCCCTCATCCTGTG GAATAAGAAAATGGGATAGATCTGGAATAAATGTG CAGTATTGTAGTATTACTTTAAGAACTTTAAGGGAA CTTCAAAAACTCACTGAAATTCTAGTGAGATACTTT CTTTTTTATTCTTGGTATTTTCCATATCGGGTGCAA CACTTCAGTTACCAAATTTCATTGCACATAGATTAT CTTAGGTACCCTTGGAAATGCACATTCTTGTATCCA TCTTACAGGGGCCCAAGATGATAAATAGTAAACTC AAAAT | 15 | WPYTKAR RKDQDHK Y* |

TABLE 3A-continued

| SEQ ID | identifier_position | position | modified_RNA | PAP length | PAP |
|---|---|---|---|---|---|
| 499 | NM_0010 25070.1_ 390 | 390 | CTCCGCCCCCTCCCACTCTCTCTTTCCGGTGTGGA GTCTGGAGACGACGTGCAGGTAGGAGGCCCGGG CGCGACAATCGGGGGGCATCCTGCGGCGAGGGG ACCCTGTGGGGCTTGGGACGAGAGACGGGGGTC TTTCCGTGGGAACCGAGCTAGGTGCCGGGCAAGA GACGCGCGGCTGGCCCACCTGGATCCTGGCCAAC TCGGGATTGAGTTCGTTCCTGGTCTCAGAAGGCCC GTTTTGCTTTCAGGGAGGAGCTTGTGAAAAATGGC ACCTCGAAAGGGGAAGGAAAAGAAGGAAGAACAG GTCATCAGCCTCGGACCTCAGGTGGCTGAAGGAG AGAATGTATTTGGTGTCTGCCATATCTTTGCATCCT TCAATGACACTTTGTCCATGTCACTGATCTTTCTGG CAAGGAAACCATCTGCCGTGTGACTGGTGGGATG AAGGTAAAGGCAGACCGAGATGAATCCTCACCATA TGCTGCTATGTTGGCTGCCCAGGATGTGGCCCAG AGGTGCAAGGAGCTGGGTATCACCGCCCTACACA TCAAACTCCGGGCCACAGGAGGAAATAGGACCAA GACCCCTGGACCTGGGGCCCAGTCGGCCCTCAGA GCCCTTGCCCGCTCGGGTATGAAGATCGGGCGGA TTGAGGATGTCACCCCCATCCCCTCTGACAGCACT CGCAGGAAGGGGGGTCGCCGTGGTCGCCGTCTG TGAACAAGATTCCTCAAAATATTTTCTGTTAATAAA TTGCCTTCATGTAAACTGTTTCAAAAAAAAA | 15 | LSMSLIFLA RKPSAV* |
| 500 | NM_0010 28.2_319 | 319 | CTTCCTTTTTGTCCGACATCTTGACGAGGCTGCGG TGTCTGCTGCTATTCTCCGAGCTTCGCAATGCCGC CTAAGGACGACAAGAAGAAGAAGGACGCTGGAAA GTCGGCCAAGAAAGACAAAGACCCAGTGAACAAA TCCGGGGGCAAGGCCAAAAAGAAGAAGTGGTCCA AAGGCAAAGTTCGGGACAAGCTCAATAACTTAGTC TTGTTTGACAAAGCTACCTATGATAAACTCTGTAAG GAAGTTCCCAACTATAAACTTATAACCCCAGCTGT GGTCTCTGAGAGACTGAAGATTCGAGGCTCCCTG GCCAGGCAGCCCTTCAGGAGCTCCTTAGTAAAGG ACTTATCAAACTGGTTTCAAAGCACAGAGCTCAAG TAAATTTACACCAGAAATACCAAGGGTGGAGATGCT CCAGCTGCTGGTGAAGATGCATGAATAGGTCCAA CCAGCTGTACATTTGGAAAAATAAAACTTTATTAAA TCAAAAAAAAAAAAAAAAAAAAAAAAAA | 21 | QPFRSSLV KDLSNWF QSTELK* |
| 501 | NM_0010 29.3_314 | 314 | GGAGACACATAACCTCGATTTTCTTCCGCCATCCG GCTAAATAGTCCCATGTGCACTTTGTTCCATGGAT AAATAAAACACTAGGAACGCATTTCCACCCTAGATTT CAGCAGAAATGCTGAATGTAAAGGAATATTTGAGT AAAGTGAGTTGCCGTTCTTGAAGCCCGTCTCCTAA GGATTCTCCCGGTGTCCGCGTAGGGATCTCATGC TATATAGGAGGGCCCTGCCAGGCACCGTCTCCTC TCTCCGGTCCGTGCCTCCAAGATGACAAAGAAAAG AAGGAACAATGGTCGTGCCAAAAAGGGCCGCGGC ACGTGCAGCCTATTCGCTGCACTAACTGTGCCCGA TGCGTGCCCAAGGACAAGGCCATTAAGAAATTCGT CATTCGAAACATAGTGGAGGCCGCAGCAGTCAGG GACATTTCTGAAGCGAGCGTCTTCGATGCCTATGT GCTTCCCAAGCTGTATGTGAAGCTACATTACTGTG TGAGTTGTGCAATTCACAGCAAAGTAGTCAGGAAT CGATCTCGTGAAGCCCGCAAGGACCGAACACCCC CACCCCGATTTAGACCTGCGGGTGCTGCCCCACG TCCCCCACCAAAGCCCATGTAAGGAGCTGAGTTCT TAAAGACTGAAGACAGGCTATTCTCTGGAGAAAAA TAAAAATGGAAATTGTACTTAAAAAAAAAAAAAAAAAA AA | 27 | TCSLFAAL TVPDACPR TRPLRNSS FET* |
| 502 | NM_0010 32.3_80 | 80 | CTTTTACCTCGTTGCACTGCTGAGAGCAAGATGGG TCACCAGCAGCTGTACTGGAGCCACCCGCGAAAA TTCGGCCAGGTTCTCGCTCTTGTCGTGTCTGTTCA AACCGGCACGGTCTGATCCGGAAATATGGCCTCA ATATGTGCCGCCAGTGTTTCCGTCAGTACGCGAAG GATATCGGTTTCATTAAGTTGGACTAAATGCTCTTC CTTCAGAGGATTATCCGGGGCATCTACTCAATGAA AAACCATGATAATTCTTTGTATATAAAATAAACATTT GAAAAAAACCCTTCAAAAAAA | 13 | VLALVVSV QTGTV* |
| 503 | NM_0010 32293.2_ 194 | 194 | CGGAGCGGGGAACGAGGCCGTCGGCCATTTTGTG TCTGCTTCCTGTGGGACGTGGTGGTAGCCGTTGG GTTGGGAAAGTGAGGGATTTTTGGCCTCGTTTCTC CTGCTTCTTTTCTCCTCCCTTTTACTTTGCCGGTAG AACACAGTTATGGGTCGCAAGAAGAAGAAGCAGC TGAAGCCGTGGTGCTGGTATGTAATAGAGATTTTG ATGATGAGAAGATCCTTATTCAGCACCAAAAAGCA AAGCATTTTAAATGCCATATATGTCACAAGAAATTG TATACAGGACCTGGCTTAGCTATTCATTGCATGCA | 34 | VIEILMMRR SLFSTKKQ SILNAIYVT RNCIQDLA* |

TABLE 3A-continued

| SEQ ID | identifier_position | position | modified_RNA | PAP length | PAP |
|---|---|---|---|---|---|
| | | | GGTACATAAAGAAACAATAGATGCCGTACCAAATG<br>CAATACCTGGAAGAACAGACATAGAGTTGGAAATA<br>TATGGTATGGAAGGTATTCCAGAAAAAGACATGGA<br>TGAAAGACGACGACTTCTTGAACAGAAAACACAAG<br>AAAGTCAAAAAAAGAAGCAACAAGATGATTCTGAT<br>GAATATGATGATGACGACTCTGCAGCCTCAACTTC<br>ATTTCAGCCACAGCCTGTTCAACCTCAGCAAGGTT<br>ATATTCCTCCAATGGCACAGCCAGGACTGCCACCA<br>GTACCAGGAGCACCAGGAATGCCTCCAGGCATAC<br>CTCCATTAATGCCAGGTGTTCCTCCTCTGATGCCA<br>GGAATGCCACCAGTTATGCCAGGCATGCCACCTG<br>GATTGCATCATCAGAGAAAATACACCCAGTCATTTT<br>GCGGTGAAAACATAATGATGCCAATGGGTGGAAT<br>GATGCCACCTGGACCAGGAATACCACCTCTGATG<br>CCTGGAATGCCACCAGGTATGCCCCCACCTGTTC<br>CACGTCCTGGAATTCCTCCAATGACTCAAGCACAG<br>GCTGTTTCAGCGCCAGGTATTCTTAATAGACCACC<br>TGCACCAACAGCAACTGTACCTGCCCCACAGCCT<br>CCAGTTACTAAGCCTCTTTTCCCCAGTGCTGGACA<br>GGCTCAGGCAGCTGTCCAAGGACCTGTTGGTACA<br>GATTTCAAACCCTTAA | | |
| 504 | NM_0010<br>33044.1_<br>599 | 599 | GGTGCGGGGCTGCTGGCGGCTCTGCAGAGTCGA<br>GAGTGGGAGAAGAGCGGAGCGTGTGAGCAGTACT<br>GCGGCCTCCTCTCCTCTCCTAACCTCGCTCTCGCG<br>GCCTAGCTTTACCCGCCCGCCTGCTCGGCGACCA<br>GAACACCTTCCACCATGACCACCTCAGCAAGTTCC<br>CACTTAAATAAAGGCATCAAGCAGGTGTACATGTC<br>CCTGCCTCAGGGTGAGAAAGTCCAGGCCATGTAT<br>ATCTGGATCGATGGTACTGGAGAAGGACTGCGCT<br>GCAAGACCCGGACCCTGGACAGTGAGCCCAAGTG<br>TGTGGAAGAGTTGCCTGAGTGGAATTTCGATGGCT<br>CTAGTACTTTACAGTCTGAGGGTTCCAACAGTGAC<br>ATGTATCTCGTGCCTGCTGCCATGTTTCGGGACCC<br>CTTCCGTAAGGACCCTAACAAGCTGGTGTTATGTG<br>AAGTTTTCAAGTACAATCGAAGGCCTGCAGAGACC<br>AATTTGAGGCACACCTGTAAACGGATAATGGACAT<br>GGTGAGCAACCAGCACCCCTGGTTTGGCATGGAG<br>CAGGAGTATACCCTCATGGGGACAGATGGGCACC<br>CCTTTGGTTGGCTTCCAACGGCTTCCCAGGGCCC<br>CAGGGTCCATATTACTGTGGTGTGGGAGCAGACA<br>GAGCCTATGGCAGGGACATCGTGGAGGCCCATTA<br>CCGGGCCTGCTTGTATGCTGGAGTCAAGATTGCG<br>GGGACTAATGCCGAGGTCATGCCTGCCCAGTGGG<br>AATTTCAGATTGGACCTTGTGAAGGAATCAGCATG<br>GGAGATCATCTCTGGGTGGCCCGTTTCATCTTGCA<br>TCGTGTGTGTGAAGACTTTGGAGTGATAGCAACCT<br>TTGATCCTAAGCCCATTCCTGGGAACTGGAATGGT<br>GCAGGCTGCCATACCAACTTCAGCACCAAGGCCA<br>TGCGGGAGGAGAATGGTCTGAAGTACATCGAGGA<br>GGCCATTGAGAAACTAAGCAAGCGGCACCAGTAC<br>CACATCCGTGCCTATGATCCCAAGGGG | 84 | LPTASQGP<br>RVHITVVW<br>EQTEPMA<br>GTSWRPIT<br>GPACMLES<br>RLRGLMPR<br>SCLPSGNF<br>RLDLVKES<br>AWEIISGW<br>PVSSCIVC<br>VKTLE* |
| 505 | NM_0010<br>33044.1_<br>626 | 626 | GGTGCGGGGCTGCTGGCGGCTCTGCAGAGTCGA<br>GAGTGGGAGAAGAGCGGAGCGTGTGAGCAGTACT<br>GCGGCCTCCTCTCCTCTCCTAACCTCGCTCTCGCG<br>GCCTAGCTTTACCCGCCCGCCTGCTCGGCGACCA<br>GAACACCTTCCACCATGACCACCTCAGCAAGTTCC<br>CACTTAAATAAAGGCATCAAGCAGGTGTACATGTC<br>CCTGCCTCAGGGTGAGAAAGTCCAGGCCATGTAT<br>ATCTGGATCGATGGTACTGGAGAAGGACTGCGCT<br>GCAAGACCCGGACCCTGGACAGTGAGCCCAAGTG<br>TGTGGAAGAGTTGCCTGAGTGGAATTTCGATGGCT<br>CTAGTACTTTACAGTCTGAGGGTTCCAACAGTGAC<br>ATGTATCTCGTGCCTGCTGCCATGTTTCGGGACCC<br>CTTCCGTAAGGACCCTAACAAGCTGGTGTTATGTG<br>AAGTTTTCAAGTACAATCGAAGGCCTGCAGAGACC<br>AATTTGAGGCACACCTGTAAACGGATAATGGACAT<br>GGTGAGCAACCAGCACCCCTGGTTTGGCATGGAG<br>CAGGAGTATACCCTCATGGGGACAGATGGGCACC<br>CCTTTGGTTGGCTTCCAACGGCTTCCCAGGGCC<br>CCAGGTCCATATTACTGTGGTGTGGGAGCAGACA<br>GAGCCTATGGCAGGGACATCGTGGAGGCCCATTA<br>CCGGGCCTGCTTGTATGCTGGAGTCAAGATTGCG<br>GGGACTAATGCCGAGGTCATGCCTGCCCAGTGGG<br>AATTTCAGATTGGACCTTGTGAAGGAATCAGCATG<br>GGAGATCATCTCTGGGTGGCCCGTTTCATCTTGCA<br>TCGTGTGTGTGAAGACTTTGGAGTGATAGCAACCT<br>TTGATCCTAAGCCCATTCCTGGGAACTGGAATGGT | 75 | VHITVVWE<br>QTEPMAG<br>TSWRPITG<br>PACMLESR<br>LRGLMPRS<br>CLPSGNFR<br>LDLVKESA<br>WEIISGWP<br>VSSCIVCV<br>KTLE* |

TABLE 3A-continued

| SEQ ID | identifier_ position | position | modified_RNA | PAP length | PAP |
|---|---|---|---|---|---|
| | | | GCAGGCTGCCATACCAACTTCAGCACCAAGGCCA TGCGGGAGGAGAATGGTCTGAAGTACATCGAGGA GGCCATTGAGAAACTAAGCAAGCGGCACCAGTAC CACATCCGTGCCTATGATCCCAAGGG | | |
| 506 | NM_0010 33853.1_ 1112 | 1112 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCCACCTGATGGAGATCCAGGTGAACG GAGGCACTGTGGCCGAGAAGCTGGACTGGGCCC GCGAGAGGCTTGAGCAGCAGGTACCTGTGAACCA AGTGTTTGGGCAGGATGAGATGATCGACGTCATC GGGGTGACCAAGGGCAAAGGCTACAAAGGGGTCA CCAGTCGTTGGCACACCAAGAAGCTGCCCCGCAA GACCCACCGAGGCCTGCGCAAGGTGGCCTGTATT GGGGCATGGCATCCTGCTCGTGTAGCCTTCTCTGT GGCACGCGCTGGGCAGAAAGGCTACCATCACCGC ACTGAGATCAACAAGAAGATTTATAAGATTGGCCA GGGCTACCTTATCAAGGACGGCAAGCTGATCAAG AACAATGCCTCCACTGACTATGACCTATCTGACAA GAGCATCAACCCTCTGGGTGGCTTTGTCCACTATG GTGAAGTGACCAATGACTTTGTCATGCTGAAAGGC TGTGTGGTGGGAACCAAGAAGCGGGTGCTCACCC TCCGCAAGTCCTTGCTGGTGCAGACGAAGCGGCG GGCTCTGGAGAAGATTGACCTTAAGTTCAT | 29 | MQRKKEL NARNRFCS WWGLNKS YFPLTKKK |
| 507 | NM_0010 33853.1_ 790 | 790 | CCAGATTTGGCTTTATATAGCGGACCCGTAAGGCC GACCGGCCTCTACCGGCGGGATTTGATGGCGTGA TGTCTCACAGAAAGTTCTCCGCTCCCAGACATGGG TCCCTCGGCTTCCTGCCTCGGAAGCGCAGCAGCA GGCATCGTGGGAAGGTGAAGAGCTTCCCTAAGGA TGACCCGTCCAAGCCGGTCCACCTCACAGCCTTC CTGGGATACAAGGCTGGCATGACTCACATCGTGC GGGAAGTCGACAGGCCGGGATCCAAGGTGAACAA GAAGGAGGTGGTGGAGGCTGTGACCATTGTAGAG ACACCACCCATGGTGGTTGTGGGCATTGTGGGCT ACGTGGAAACCCCTCGAGGCCTCCGGACCTTCAA GACTGTCTTTGCTGAGCACATCAGTGATGAATGCA AGAGGCGTTTCTATAAGAATTGGCATAAATCTAAG AAGAAGGCCCACCTGATGGAGATCCAGGTGAACG GAGGCACTGTGGCCGAGAAGCTGGACTGGGCCC GCGAGAGGCTTGAGCAGCAGGTACCTGTGAACCA AGTGTTTGGGCAGGATGAGATGATCGACGTCATC GGGGTGACCAAGGGCAAAGGCTACAAAGGGGTCA CCAGTCGTTGGCACACCAAGAAGCTGCCCCGCAA GACCCACCGAGGCCTGCGCAAGGTGGCCTGTATT GGGGCATGGCATCCTGCTCGTGTAGCCTTCTCTGT GGCACGCGCTGGGCAGAAAGGCTACCATCACCGC ACTGAGATCAACAAGAAGATTTATAAGATTGGCCA GGGCTACCTTATCAAGGACGGCAAGCTGATCAAGAA CAATGCCTCCACTGACTATGACCTATCTGACAAGA GCATCAACCCTCTGGGTGGCTTTGTCCACTATGGT GAAGTGACCAATGACTTTGTCATGCTGAAAGGCTG TGTGGTGGGAACCAAGAAGCGGGTGCTCACCCTC CGCAAGTCCTTGCTGGTGCAGACGAAGCGGCGGG CTCTGGAGAAGATTGACCTTAAGTTCATT | 8 | ATLSRTAS* |
| 508 | NM_0010 33859.1_ 1305 | 1305 | TACAGCTCCCAGCATGCCCCGGGGCCCGCAACCG TCCGCCGCCCGGTGCACTGTGGACGATGAGTCAG GGTTAGGGGCGCCAGGACGTGGGCGTGCAGGAC GCCAGAGCTGGGTCAGAGCTCGAGCCAGCGGCG CCCGGAGAGATTCGGAGATGCAGGCGGCTCGGAT GGCCGCGAGCTTGGGGCGGCAGCTGCTGAGGCT CGGGGGCGGAAGCTCGCGGCTCACGGCGCTCCT GGGGCAGCCCCGGCCCGGCCCTGCCCGGCGGCC CTATGCCGGGGGTGCCGCTCAGGAATCTAAGTCC TTTGCTGTGGGAATGTTCAAAGGCCAGCTCACCAC AGATCAGGTGTTCCCATACCCGTCCGTGCTCAACG AAGAGCAGACACAGTTTCTTAAAGAGCTGGTGGAG CCTGTGTCCCGTTTCTTCGAGGAAGTGAACGATCC | 6 | EPRTSR* |

TABLE 3A-continued

| SEQ ID | identifier_ position | position | modified_RNA | PAP length | PAP |
|---|---|---|---|---|---|
| | | | CGCCAAGAATGACGCTCTGGAGATGGTGGAGGAG | | |
| | | | ACCACTTGGCAGGGCCTCAAGGAGCTGGGGGCCT | | |
| | | | TTGGTCTGCAAGTGCCCAGTGAGCTGGGTGGTGT | | |
| | | | GGGCCTTTGCAACACCCAGTACGCCCGTTTGGTG | | |
| | | | GAGATCGTGGGCATGCATGACCTTGGCGTGGGCA | | |
| | | | TTACCCTGGGGGCCCATCAGAGCATCGGTTTCAAA | | |
| | | | GGCATCCTGCTCTTTGGCACAAAGGCCCAGAAAG | | |
| | | | AAAAATACCTCCCCAAGCTGGCATCTGGGGAGACT | | |
| | | | GTGGCCGCTTTCTGTCTAACCGAGCCCTCAAGCG | | |
| | | | GGTCAGATGCAGCCTCCATCCGAACCTCTGCTGT | | |
| | | | GCCCAGCCCCTGTGGAAAATACTATACCCTCAATG | | |
| | | | GAAGCAAGCTTTGGATCAGTAATGGGGGCCTAGC | | |
| | | | AGACATCTTCACGGTCTTTGCCAAGACACCAGTTA | | |
| | | | CAGATCCAGCCACAGGAGCCGTGAAGGAGAAGAT | | |
| | | | CACAGCTTTTGTGGTGGAGAGGGGCTTCGGGGGC | | |
| | | | ATTACCCATGGGCCCCCTGAGAAGAAGATGGGCA | | |
| | | | TCAAGGCTTCAAACACAGCAGAGGTGTTCTTTGAT | | |
| 509 | NM_0010 34.1_214 | 214 | CCCAGGCGCAGCCAATGGGAAGGGTCGGAGGCA TGGCACAGCCAATGGGAAGGGCCGGGGCACCAA AGCCAATGGGAAGGGCCGGGAGCGCGCGGCGCG GGAGATTTAAAGGCTGCTGGAGTGAGGGGTCGCC CGTGCACCCTGTCCCAGCCGTCCTGTCCTGGCTG CTCGCTCTGCTTCGCTGCGCCTCCACTATGCTCTC CCTCCGTGTCCGCTCGCGCCCATCACGGACCCGC AGCAGCTGCAGCTCTCGCCGCTGAAGGGGCTCAG CTTGGTCGACAAGGAGAACACGCCGCCGGCCCTG AGCGGGACCCGCGTCCTGGCCAGCAAGACCGCG AGGAGGATCTTCCAGGAGCCCACGGAGCCGAAAA CTAAAGCAGCTGCCCCCGGCGTGGAGGATGAGCC GCTGCTGAGAGAAAACCCCCGCCGCTTTGTCATCT TCCCCATCGAGTACCATGATATCTGGCAGATGTAT AAGAAGGCAGAGGCTTCCTTTTGGACCGCCGAGG AGGTTGACCTCTCCAAGGACATTCAGCACTGGGAA TCCCTGAAACCCGAGGAGAGATATTTTATATCCCA TGTTCTGGCTTTCTTTGCAGCAAGCGATGGCATAG TAAATGAAAACTTGGTGGAGCGATTTAGCCAAGAA GTTCAGATTACAGAAGCCCGCTGTTTCTATGGCTT CCAAATTGCCATGGAAAACATACATTCTGAAATGTA TAGTCTTCTTATTGCACTTACATAAAAGATCCCAA AGAAAGGGAATTTCTCTTCAATGCCATTGAAACGA TGCCTTGTGTCAAGAAGAAGGCAGACTGGGCCTT GCGCTGGATTGGGGACAAAGAGGCTACCTATGGT GAACGTGTTGTAGCCTTTGCTGCAGTGGAAGGCAT TTTCTTTTCCGGTTCTTTTGCGTCGATATTCTGGCT CAAGAAACGAGGACTGATGCCTGGCCTCACATTTT CTAATGAACTTATTAGCAGAGATGAGGGTTTACAC TGTGATTTTGCTTGCCTGATGTTC | 15 | RSRPSRTR SSCSSRR* |
| 510 | NM_0010 35006.1_ 293 | 293 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGCTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA CTTTACAGAAACAGTGTGTACCATTCCGACGTTAC AATGGTGGAGTGGCAGGTGTGCGCAGGCCAAGCA ATGGGGCTGGACACAAGGTCGGTGGCCCAAAAAG AGTGCTGAATTTTTGCTGCACATGCTTAAAAACGC AGAGAGTAATGCTGAACTTAAGGGTTTAGATGTAG ATTCTCTGGTCATTGAGCATATCCAAGTGAACAAA GCACCTAAGATGCGCCGCCGGACCTACAGAGCTC ATGGTCGGATTAACCCATACATGAGCTCTCCCTGC CACATTGAGATGATCCTTACGGAAAAGGAACAGAT TGTTCCTAAACCAAGAGGAGGTTGCCCAGAAG AAAAAGATATCCCAGAAGAAACTGAAGAAACAAAA ACTTATGGCACGGGAGTAAATTCAGCATTAAAATA AATGTAATTAAAAGGAAAAAAAAAAAAAAAA | 39 | AGVRRPS NGAGHKV GGPKRVLN FCCTCLKT QRVMLNLR V* |
| 511 | NM_0010 35006.1_ 364 | 364 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGCTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA CTTTACAGAAACAGTGTGTACCATTCCGACGTTAC AATGGTGGAGTGGCAGGTGTGCGCAGGCCAAGC AATGGGGCTGGACACAAGGTCGGTGGCCCAAAAA | 16 | CCTCLKTQ RVMLNLRV* |

TABLE 3A-continued

| SEQ ID | identifier_ position | position | modified_RNA | PAP length | PAP |
|---|---|---|---|---|---|
| | | | GAGTGCTGAATTTTGCTGCACATGCTTAAAAACGC AGAGAGTAATGCTGAACTTAAGGGTTTAGATGTAG ATTCTCTGGTCATTGAGCATATCCAAGTGAACAAA GCACCTAAGATGCGCCGCCGGACCTACAGAGCTC ATGGTCGGATTAACCCATACATGAGCTCTCCCTGC CACATTGAGATGATCCTTACGGAAAAGGAACAGAT TGTTCCTAAACCAGAAGAGGAGGTTGCCCAGAAG AAAAAGATATCCCAGAAGAAACTGAAGAAACAAA ACTTATGGCACGGGAGTAAATTCAGCATTAAAATA AATGTAATTAAAAGGAAAAAAAAAAAAAAA | | |
| 512 | NM_0010 35006.1_ 474 | 474 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA CTTTACAGAAACAGTGTGTACCATTCCGACGTTAC AATGGTGGAGTTGGCAGGTGTGCGCAGGCCAAGC AATGGGGCTGGACACAAGGTCGGTGGCCCAAAAA GAGTGCTGAATTTTGCTGCACATGCTTAAAAACG CAGAGAGTAATGCTGAACTTAAGGGTTTAGATGTA GATTCTCTGGTCATTGAGCATATCCAAGTGAACAA AGCACCTAAGATGCGCCGCGGACCTACAGAGCTC ATGGTCGGATTAACCCATACATGAGCTCTCCCTGC CACATTGAGATGATCCTTACGGAAAAGGAACAGAT TGTTCCTAAACCAGAAGAGGAGGTTGCCCAGAAG AAAAAGATATCCCAGAAGAAACTGAAGAAACAAAA ACTTATGGCACGGGAGTAAATTCAGCATTAAAATA AATGTAATTAAAAGGAAAAAAAAAAAAAAA | 12 | GPTELMVG LTHT* |
| 513 | NM_0010 35006.1_ 479 | 479 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA CTTTACAGAAACAGTGTGTACCATTCCGACGTTAC AATGGTGGAGTTGGCAGGTGTGCGCAGGCCAAGC AATGGGGCTGGACACAAGGTCGGTGGCCCAAAAA GAGTGCTGAATTTTGCTGCACATGCTTAAAAACG CAGAGAGTAATGCTGAACTTAAGGGTTTAGATGTA GATTCTCTGGTCATTGAGCATATCCAAGTGAACAA AGCACCTAAGATGCGCCGCCGGACTACAGAGCTC ATGGTCGGATTAACCCATACATGAGCTCTCCCTGC CACATTGAGATGATCCTTACGGAAAAGGAACAGAT TGTTCCTAAACCAGAAGAGGAGGTTGCCCAGAAG AAAAAGATATCCCAGAAGAAACTGAAGAAACAAAA ACTTATGGCACGGGAGTAAATTCAGCATTAAAATA AATGTAATTAAAAGGAAAAAAAAAAAAAAA | 10 | TELMVGLT HT* |
| 514 | NM_0010 35006.1_ 560 | 560 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA CTTTACAGAAACAGTGTGTACCATTCCGACGTTAC AATGGTGGAGTTGGCAGGTGTGCGCAGGCCAAGC AATGGGGCTGGACACAAGGTCGGTGGCCCAAAAA GAGTGCTGAATTTTGCTGCACATGCTTAAAAACG CAGAGAGTAATGCTGAACTTAAGGGTTTAGATGTA GATTCTCTGGTCATTGAGCATATCCAAGTGAACAA AGCACCTAAGATGCGCCGCCGGACCTACAGAGCT CATGGTCGGATTAACCCATACATGAGCTCTCCCTG CCACATTGAGATGATCCTTACGGAAAAGGAACAGA TGTTCCTAAACCAGAAGAGGAGGTTGCCCAGAAG AAAAAGATATCCCAGAAGAAACTGAAGAAACAAAA ACTTATGGCACGGGAGTAAATTCAGCATTAAAATA AATGTAATTAAAAGGAAAAAAAAAAAAAAA | 19 | MFLNQKR RLPRRKRY PRRN* |
| 515 | NM_0010 35006.1_ 588 | 588 | TACGAATCTCGCGAGAAGTCAAGTTCTCATGAGTT CTCCCAAAATCCACCGCTCTTCCTCTTTCCCTAAG CAGCCTGAGGTGATCTGTGAAAATGGTTCGTATT CACTTGACCCGGAGAACCCCACGAAATCATGCAAA TCAAGAGGTTCCAATCTTCGTGTTCACTTTAAGAAC ACTCGTGAAACTGCTCAGGCCATCAAGGGTATGCA TATACGAAAAGCCACGAAGTATCTGAAAGATGTCA | 9 | RRKRYPR RN* |

TABLE 3A-continued

| SEQ ID | identifier_position | position | modified_RNA | PAP length | PAP |
|---|---|---|---|---|---|
| | | | CTTTACAGAAACAGTGTGTACCATTCCGACGTTAC AATGGTGGAGTTGGCAGGTGTGCGCAGGCCAAGC AATGGGGCTGGACACAAGGTCGGTGGCCCAAAAA GAGTGCTGAATTTTTGCTGCACATGCTTAAAAACG CAGAGAGTAATGCTGAACTTAAGGGTTTAGATGTA GATTCTCTGGTCATTGAGCATATCCAAGTGAACAA AGCACCTAAGATGCGCCGCCGGACCTACAGAGCT CATGGTCGGATTAACCCATACATGAGCTCTCCCTG CCACATTGAGATGATCCTTACGGAAAAGGAACAGA TTGTTCCTAAACCAGAAGAGGAGGTTGCCAGAAGA AAAAGATATCCCAGAAGAAACTGAAGAAACAAAAA CTTATGGCACGGGAGTAAATTCAGCATTAAAATAA ATGTAATTAAAAGGAAAAAAAAAAAAAAA | | |
| 516 | NM_0010 37663.1_ 192 | 192 | GCCGGAAGTGGCCCCAGCCTCGAGGCCGGGCGT CTTCGGTCATCTCCGGCGCTTCTAGGGCTGGTTCC CGTCATCTTCGGGAGCCGTGGAGCGTGGGGCGC CCACAATTTGCGCGCTCTCTTTCTGCTGCTCCCCA GCTCTCGGATACAGCCGACACCATGGGTTTCGGA GACCTGAAAAGCCCTGCCGGCTCCAGGTGCTCAA CGATTACCTGGCGGACAAGAGCTACATCGAGGGG TATGTGCCATCACAAGCAGATGTGGCAGTATTTGA AGCCGTGTCCAGCCCACCGCCTGCCGACTTGTGT CATGCCCTACGTTGGTATAATCACATCAAGTCTTAC GAAAAGGAAAAGGCCAGCCTGCCAGGAGTGAAGA AAGCTTTGGGCAAATATGGTCCTGCCGATGTGGAA GACACTACAGGAAGTGGAGCTACAGATAGTAAAGA TGATGATGACATTGACCTCTTTGGATCTGATGATG AGGAGGAAAGTGAAGAAGCAAAGAGGCTAAGGGA AGAACGTCTTGCACAATATGAATCAAAGAAAGCCA AAAAACCTGCACTTGTTGCCAAGTCTTCCATCTTAC TAGATGTGAAACCTTGGGATGATGAGACAGATATG GCGAAATTAGAGGAGTGCGTCAGAAGCATTCAAG CAGACGGCTTAGTCTGGGGCTCATCTAAACTAGTT CCAGTGGGATACGGAATTAAGAAACTTCAAATACA GTGTGTAGTTGAAGATGATAAAGTTGGAACAGATA TGCTGGAGGAGCAGATCACTGCTTTTGAGGACTAT GTGCAGTCCATGGATGTGGCTGCTTTCAACAAGAT CTAAAATCCATCCTGGATCATGGCATTTAAATAAAA GATTGAAAGATTACAAAAAAAAAAAAAAAAAA | 60 | SRCSTITW RTRATSRG MCHHKQM WQYLKPC PAHRLPTC VMPYVGIIT SSLTKRKR PACQE* |
| 517 | NM_0010 37663.1_ 385 | 385 | GCCGGAAGTGGCCCCAGCCTCGAGGCCGGGCGT CTTCGGTCATCTCCGGCGCTTCTAGGGCTGGTTCC CGTCATCTTCGGGAGCCGTGGAGCGTGGGGCGC CCACAATTTGCGCGCTCTCTTTCTGCTGCTCCCCA GCTCTCGGATACAGCCGACACCATGGGTTTCGGA GACCTGAAAAGCCCTGCCGGCCTCCAGGTGCTCA ACGATTACCTGGCGGACAAGAGCTACATCGAGGG GTATGTGCCATCACAAGCAGATGTGGCAGTATTTG AAGCCGTGTCCAGCCCACCGCCTGCCGACTTGTG TCATGCCCTACGTTGGTATAATCACATCAAGTCTTA CGAAAAGGAAAAGGCCAGCCTGCCAGGAGTGAAG AAAGCTTTGGGCAAATATGGTCCTGCCGATGTGGAA GACACTACAGGAAGTGGAGCTACAGATAGTAAAGA TGATGATGACATTGACCTCTTTGGATCTGATGATG AGGAGGAAAGTGAAGAAGCAAAGAGGCTAAGGGA AGAACGTCTTGCACAATATGAATCAAAGAAAGCCA AAAAACCTGCACTTGTTGCCAAGTCTTCCATCTTAC TAGATGTGAAACCTTGGGATGATGAGACAGATATG GCGAAATTAGAGGAGTGCGTCAGAAGCATTCAAG CAGACGGCTTAGTCTGGGGCTCATCTAAACTAGTT CCAGTGGGATACGGAATTAAGAAACTTCAAATACA GTGTGTAGTTGAAGATGATAAAGTTGGAACAGATA TGCTGGAGGAGCAGATCACTGCTTTTGAGGACTAT GTGCAGTCCATGGATGTGGCTGCTTTCAACAAGAT CTAAAATCCATCCTGGATCATGGCATTTAAATAAAA GATTGAAAGATTACAAAAAAAAAAAAAAAAAA | 42 | WANMVLP MWKTLQE VELQIVKM MMTLTSLD LMMRRKV KKQRG* |
| 518 | NM_0010 37663.1_ 625 | 625 | GCCGGAAGTGGCCCCAGCCTCGAGGCCGGGCGT CTTCGGTCATCTCCGGCGCTTCTAGGGCTGGTTCC CGTCATCTTCGGGAGCCGTGGAGCGTGGGGCGC CCACAATTTGCGCGCTCTCTTTCTGCTGCTCCCCA GCTCTCGGATACAGCCGACACCATGGGTTTCGGA GACCTGAAAAGCCCTGCCGGCCTCCAGGTGCTCA ACGATTACCTGGCGGACAAGAGCTACATCGAGGG GTATGTGCCATCACAAGCAGATGTGGCAGTATTTG AAGCCGTGTCCAGCCCACCGCCTGCCGACTTGTG TCATGCCCTACGTTGGTATAATCACATCAAGTCTTA CGAAAAGGAAAAGGCCAGCCTGCCAGGAGTGAAG AAAGCTTTGGGCAAATATGGTCCTGCCGATGTGGA | 2 | GN* |

TABLE 3A-continued

| SEQ ID | identifier_position | position | modified_RNA | PAP length | PAP |
|---|---|---|---|---|---|
| | | | AGACACTACAGGAAGTGGAGCTACAGATAGTAAAG<br>ATGATGATGACATTGACCTCTTTGGATCTGATGAT<br>GAGGAGGAAAGTGAAGAAGCAAAGAGGCTAAGGG<br>AAGAACGTCTTGCACAATATGAATCAAAGAAAGCC<br>AAAAAACCTGCACTTGTTGCCAAGTCTTCCATCTTA<br>CTAGATGTGAAACCTTGGGATGATGAGACAGATAT<br>GGGAAATTAGAGGAGTGCGTCAGAAGCATTCAAG<br>CAGACGGCTTAGTCTGGGGCTCATCTAAACTAGTT<br>CCAGTGGGATACGGAATTAAGAAACTTCAAATACA<br>GTGTGTAGTTGAAGATGATAAAGTTGGAACAGATA<br>TGCTGGAGGAGCAGATCACTGCTTTTGAGGACTAT<br>GTGCAGTCCATGGATGTGGCTGCTTTCAACAAGAT<br>CTAAAATCCATCCTGGATCATGGCATTTAAATAAAA<br>GATTGAAAGATTACAAAAAAAAAAAAAAAAAA | | |
| 519 | NM_0010<br>37663.1_<br>665 | 665 | GCCGGAAGTGGCCCCAGCCTCGAGGCCGGGCGT<br>CTTCGGTCATCTCCGGCGCTTCTAGGGCTGGTTCC<br>CGTCATCTTCGGGAGCCGTGGAGCGTGGGGCGC<br>CCACAATTTGCGCGCTCTCTTTCTGCTGCTCCCCA<br>GCTCTCGGATACAGCCGACACCATGGGTTTCGGA<br>GACCTGAAAAGCCCTGCCGGCCTCCAGGTGCTCA<br>ACGATTACCTGGCGGACAAGAGCTACATCGAGGG<br>GTATGTGCCATCACAAGCAGATGTGGCAGTATTTG<br>AAGCCGTGTCCAGCCCACCGCCTGCCGACTTGTG<br>TCATGCCCTACGTTGGTATAATCACATCAAGTCTTA<br>CGAAAAGGAAAAGGCCAGCCTGCCAGGAGTGAAG<br>AAAGCTTTGGGCAAATATGGTCCTGCCGATGTGGA<br>AGACACTACAGGAAGTGGAGCTACAGATAGTAAAG<br>ATGATGATGACATTGACCTCTTTGGATCTGATGAT<br>GAGGAGGAAAGTGAAGAAGCAAAGAGGCTAAGGG<br>AAGAACGTCTTGCACAATATGAATCAAAGAAAGCC<br>AAAAAACCTGCACTTGTTGCCAAGTCTTCCATCTTA<br>CTAGATGTGAAACCTTGGGATGATGAGACAGATAT<br>GGCGAAATTAGAGGAGTGCGTCAGAAGCATTCAA<br>GCAGACGGTTAGTCTGGGGCTCATCTAAACTAGTT<br>CCAGTGGGATACGGAATTAAGAAACTTCAAATACA<br>GTGTGTAGTTGAAGATGATAAAGTTGGAACAGATA<br>TGCTGGAGGAGCAGATCACTGCTTTTGAGGACTAT<br>GTGCAGTCCATGGATGTGGCTGCTTTCAACAAGAT<br>CTAAAATCCATCCTGGATCATGGCATTTAAATAAAA<br>GATTGAAAGATTACAAAAAAAAAAAAAAAAAA | 0 | * |
| 520 | NM_0010<br>40034.1_<br>324 | 324 | CAGCTGTTACCGCGTCACATGAGGGAGGCCGGCG<br>GCCACTCGGCGGGGGAGGGGACCGTGGCTGGAG<br>CCCGGGGCGGGCGCGCGGCAGGCGGGGCGG<br>GAGCCGGGGGGCGCAGCTAGAGAGCCCCGGAGC<br>CGCGGCGGGAGAGGAACGCGCAGCCAGCCTTGG<br>GAAGCCCAGGCCCGGCAGCCATGGCGGTGGAAG<br>GAGGAATGAAATGTGTGAAGTTCTTGCTCTACGTC<br>CTCCTGCTGGCCTTTTGCGCCTGTGCAGTGGGAC<br>TGATTGCCGTGGGTGTCGGGGCACAGCTTGTCCT<br>GAGTCAGACCATAATCCAGGGGCTACCCCTGGCT<br>CTCTGTTGCCAGTGGTCATCATCGCAGTGGGTGTC<br>TTCCTCTTCCTGGTGGCTTTTGTGGGCTGCTGCGG<br>GGCCTGCAAGGAGAACTATTGTCTTATGATCACGT<br>TTGCCATCTTTCTGTCTCTTATCATGTTGGTGGAGG<br>TGGCCGCAGCCATTGCTGGCTATGTGTTTAGAGAT<br>AAGGTGATGTCAGAGTTTAATAACAACTTCCGGCA<br>GCAGATGGAGAATTACCCGAAAAACAACCACACTG<br>CTTCGATCCTGGACAGGATGCAGGCAGATTTTAAG<br>TGCTGTGGGGCTGCTAACTACACAGATTGGGAGA<br>AAATCCCTTCCATGTCGAAGAACCGAGTCCCCGAC<br>TCCTGCTGCATTAATGTTACTGTGGGCTGTGGGAT<br>TAATTTCAACGAGAAGGCGATCCATAAGGAGGGCT<br>GTGTGGAGAAGATTGGGGGCTGGCTGAGGAAAAA<br>TGTGCTGGTGGTAGCTGCAGCAGCCCTTGGAATT<br>GCTTTTGTTTTGGGAATTGTCTTTGCCTGCTGCCTC<br>GTGAAGAGTATCAGAAGTGGCTACGAGGTGATGT<br>AGGGGTCTGGTCTCCTCAGCCTCCTCATCTGGGG<br>GAGTGGAATAGTATCCTCCAGGTTTTTCAATTAAAC<br>GGATTATTTTTTCAGACCGAAAAGAGATGGTCTGA<br>GTTTGTCTTAGAAAAAAAAAAAAAAAA | 36 | LPLALCCQ<br>WSSSQWV<br>SSSSWWL<br>LWAAAGP<br>ARRTIVL* |
| 521 | NM_0010<br>42423.1_<br>674 | 674 | GGCCACTGCACGGACCCAGGGAACGGGCTGACA<br>GTCCAGCAGAGGCCTCAGCGAGGCGGCGGCGCT<br>GCGCACAAACCTGAGGACCTAGGCGGGTGAGGC<br>GGAACCAACCCTCCTGGCCATGGGAGGGGCCGT<br>GGTGGACGAGGGCCCCACAGGCGTCAAGGCCCC<br>TGACGGCGGCTGGGGCTGGGCCGTGCTCTTCGG<br>CTGTTTCGTCATCACTGGCTTCTCCTACGCCTTCC | 11 | CCSTAACV<br>PHS* |

TABLE 3A-continued

| SEQ ID | identifier_position | position | modified_RNA | PAP length | PAP |
|---|---|---|---|---|---|
| | | | CCAAGGCCGTCAGTGTCTTCTTCAAGGAGCTCATA CAGGAGTTTGGGATCGGCTACAGCGACACAGCCT GGATCTCCTCCATCCTGCTGGCCATGCTCTACGG GACAGGTCCGCTCTGCAGTGTGTGCGTGAACCGC TTTGGCTGCCGGCCCGTCATGCTTGTGGGGGGTC TCTTTGCGTCGCTGGGCATGGTGGCTGCGTCCTTT TGCCGGAGCATCATCCAGGTCTACCTCACCACTG GGGTCATCACGGGGTTGGGTTTGGCACTCAACTT CCAGCCCTCGCTCATCATGCTGAACCGCTACTTCA GCAAGCGGCGCCCCATGGCCAACGGGCTGGCGG CAGCAGGTAGCCCTGTCTTCCTGTGTGCCCTGAG CCCGCTGGGGCAGCTGCTGCAGGACCGCTACGG CTGGCGGGGCGGCTTCCTCATCCTGGGCGGCTGC TGCTCAACTGCTGCGTGTGTGCCGCACTCATGAG GCCCCTGGTGGTCACGGCCCAGCCGGGCTCGGG GCCGCCGCGACCCTCCCGGCGCCTGCTAGACCTG AGCGTCTTCCGGGACCGCGGCTTTGTGCTTTACG CCGTGGCCGCCTCGGTCATGGTGCTGGGGCTCTT CGTCCCGCCCGTGTTCGTGGTGAGCTACGCCAAG GACCTGGGCGTGCCCGACACCAAGGCCGCCTTCC TGCTCACCATCCTGGGCTTCATTGACATCTTCGCG CGGCCGGCCGCGGGCTTCGTGGCGGGGCTTGGG AAGGTGCGGCCCTACTCCGTCTACCTCTTCAGCTT CTCCATGT | | |
| 522 | NM_0010 64.1_213 | 213 | ATGGAGAGCTACCACAAGCCTGACCAGCAGAAGC TGCAGGCCTTGAAGGACACGGCCAACCGCCTACG TATCAGCTCCATCCAGGCCACCACTGCGGCGGGC TCTGGCCACCCCACGTCATGCTGCAGCGCCGCAG AGATCATGGCTGTCCTCTTTTTCCACACCATGCGC TACAAGTCCCAGGACCCCCGGAATCCGCACAATG ACCGCTTTGTGCTCTCCAAGGGCCATGCAGCTCCC ATCCTCTACGCGGTCTGGGCTGAAGCTGGTTTCCT GGCCGAGGCGGAGCTGCTGAACCTGAGGAAGATC AGCTCCGACTTGGACGGGCACCCGGTCCCGAAAC AAGCTTTCACCGACGTGGCCACTGGCTCCCTGGG CCAGGGCCTCGGGGCCGCTTGTGGGATGGCCTAC ACCGGCAAATACTTCGACAAGGCCAGCTACCGAG TCTATTGCTTGCTGGGAGACGGGGAGCTGTCAGA GGGCTCTGTATGGGAGGCCATGGCCTTCGCCAGC ATCTATAAGCTGGACAACCTCGTGGCCATTCTAGA CATCAATCGCCTGGGCCAGAGTGACCCGGCCCCT CTGCAGCACCAGATGGACATCTACCAGAAGCGGT GCGAGGCCTTCGGTTGGCATGCCATCATCGTGGA TGGACACAGCGTGGAGGAGCTGTGCAAGGCCTTT GGCCAGGCCAAGCACCAGCCAACAGCCATCATTG CCAAGACCTTCAAGGGCCGAGGGATCACGGGGGT AGAAGATAAGGAGTCTTGGCATGGGAAGCCCCTC CCCAAAAACATGGCTGAGCAGATCATCCAGGAGAT CTACAGCCAGATCCAGAGCAAAAAGAAGATCCTG GCAACCCCTCCACAGGAGGACGCACCCTCAGTGG ACATTGCCAACATCCGCATGCCCAGCCTGCCCAG CTACAAAGTTGGGGACAAGATAGCCACCCGCAAG GCCTACGGGCAGGCACTGGCCAAGCTGGGCCAT GCCAGTGACCGCATCATCGCCCTGGATGGGGACA C | 27 | LCSPRAM QLPSSTRS GLKLVSWP RRSC* |
| 523 | NM_0010 64.1_383 | 383 | ATGGAGAGCTACCACAAGCCTGACCAGCAGAAGC TGCAGGCCTTGAAGGACACGGCCAACCGCCTACG TATCAGCTCCATCCAGGCCACCACTGCGGCGGGC TCTGGCCACCCCACGTCATGCTGCAGCGCCGCAG AGATCATGGCTGTCCTCTTTTTCCACACCATGCGC TACAAGTCCCAGGACCCCCGGAATCCGCACAATG ACCGCTTTGTGCTCTCCAAGGGCCATGCAGCTCC CATCCTCTACGCGGTCTGGGCTGAAGCTGGTTTCC TGGCCGAGGCGGAGCTGCTGAACCTGAGGAAGAT CAGCTCCGACTTGGACGGGCACCCGGTCCCGAAA CAAGCTTTCACCGACGTGGCCACTGGCTCCCTGG GCCAGGGCCTCGGGGCCGCTTGTGGGATGGCCTAC ACCGGCAAATACTTCGACAAGGCCAGCTACCGAG TCTATTGCTTGCTGGGAGACGGGGAGCTGTCAGA GGGCTCTGTATGGGAGGCCATGGCCTTCGCCAGC ATCTATAAGCTGGACAACCTCGTGGCCATTCTAGA CATCAATCGCCTGGGCCAGAGTGACCCGGCCCCT CTGCAGCACCAGATGGACATCTACCAGAAGCGGT GCGAGGCCTTCGGTTGGCATGCCATCATCGTGGA TGGACACAGCGTGGAGGAGCTGTGCAAGGCCTTT GGCCAGGCCAAGCACCAGCCAACAGCCATCATTG CCAAGACCTTCAAGGGCCGAGGGATCACGGGGGT | 54 | ASGPLVG WPTPANTS TRPATESIA CWETGSC QRALYGRP WPSPASIS WTTSWPF* |

TABLE 3A-continued

| SEQ ID | identifier_position | position | modified_RNA | PAP length | PAP |
|---|---|---|---|---|---|
| | | | AGAAGATAAGGAGTCTTGGCATGGGAAGCCCCTC CCCAAAAACATGGCTGAGCAGATCATCCAGGAGAT CTACAGCCAGATCCAGAGCAAAAAGAAGATCCTG GCAACCCCTCCACAGGAGGACGCACCCTCAGTGG ACATTGCCAACATCCGCATGCCCAGCCTGCCCAG CTACAAAGTTGGGGACAAGATAGCCACCCGCAAG GCCTACGGGCAGGCACTGGCCAAGCTGGGCCAT GCCAGTGACCGCATCATCGCCCTGGATGGGGACA C | | |
| 524 | NM_0010 64.1_57 | 57 | ATGGAGAGCTACCACAAGCCTGACCAGCAGAAGC TGCAGGCCTTGAAGGACACGGCAACCGCCTACGT ATCAGCTCCATCCAGGCCACCACTGCGGCGGGCT CTGGCCACCCCACGTCATGCTGCAGCGCCGCAGA GATCATGGCTGTCCTCTTTTTCCACACCATGCGCT ACAAGTCCCAGGACCCCCGGAATCCGCACAATGA CCGCTTTGTGCTCTCCAAGGGCCATGCAGCTCCC ATCCTCTACGCGGTCTGGGCTGAAGCTGGTTTCCT GGCCGAGGCGGAGCTGCTGAACCTGAGGAAGATC AGCTCCGACTTGGACGGGCACCCGGTCCCGAAAC AAGCTTTCACCGACGTGGCCACTGGCTCCCTGGG CCAGGGCCTCGGGGCCGCTTGTGGGATGGCCTAC ACCGGCAAATACTTCGACAAGGCCAGCTACCGAG TCTATTGCTTGCTGGGAGACGGGGAGCTGTCAGA GGGCTCTGTATGGGAGGCCATGGCCTTCGCCAGC ATCTATAAGCTGGACAACCTCGTGGCCATTCTAGA CATCAATCGCCTGGGCCAGAGTGACCCGGCCCCT CTGCAGCACCAGATGGACATCTACCAGAAGCGGT GCGAGGCCTTCGGTTGGCATGCCATCATCGTGGA TGGACACAGCGTGGAGGAGCTGTGCAAGGCCTTT GGCCAGGCCAAGCACCAGCCAACAGCCATCATTG CCAAGACCTTCAAGGGCCGAGGGATCACGGGGGT AGAAGATAAGGAGTCTTGGCATGGGAAGCCCCTC CCCAAAAACATGGCTGAGCAGATCATCCAGGAGAT CTACAGCCAGATCCAGAGCAAAAAGAAGATCCTG GCAACCCCTCCACAGGAGGACGCACCCTCAGTGG ACATTGCCAACATCCGCATGCCCAGCCTGCCCAG CTACAAAGTTGGGGACAAGATAGCCACCCGCAAG GCCTACGGGCAGGCACTGGCCAAGCTGGGCCAT GCCAGTGACCGCATCATCGCCCTGGATGGGGACA C | 78 | TAYVSAPS RPPLRRAL ATPRHAAA PQRSWLS SFSTPCAT SPRTPGIR TMTALCSP RAMQLPSS TRSGLKLV SWPRRSC* |
| 525 | NM_0010 77442.1_ 374 | 374 | AGGAATGGGGCGGGGACTAGGCCTTCGCCTCGG CGGCAGAGGAGACTCGGGGGCCATTTTGTGAAGA GACGAAGACTGAGCGGTTGTGGCCGCGTTGCCGA CCTCCAGCAGCAGTCGGCTTCTCTACGCAGAACC CGGGAGTAGGAGACTCAGAATCGAATCTCTTCTCC CTCCCCTTCTTGTTTTCGGCTTTGTGAGAAACCTTA CCATCAAACACGATGGCCAGCAACGTTACCAACAA GACAGATCCTCGCTCCATGAACTCCCGTGTATTCA TTGGGAATCTCAACACTCTTGTGGTCAAGAAATCT GATGTGGAGGCAATCTTTTCGAAGTATGGCAAAAT TGTGGGCTGCTCTGTTCATAAGGGCTTGCCTTCGT TCAGTATGTTAATGAGAGAAATGCCCGGGCTGCTG TAGCAGGAGAGGATGGCAGAATGATTGCTGGCCA GGTTTTAGATATTAACCTGGCTGCAGAGCCAAAAG TGAACCGAGGAAAAGCAGGTGTGAAACGATCTGC AGCGGAGATGTACGGGTCAGTAACAGAACACCCT TCTCCGTCCCCTCTACTCAGCTCCTCTTTTGACTTG GACTATGACTTTCAACGGGACTATTATGATAGGAT GTACAGTTACCCAGCACGTGTACCTCCTCCTCCTC CTATTGCTCGGGCTGTAGTGCCCTCGAAACGTCAG CGTGTATCAGGAAACACTTCACGAAGGGGCAAAA GTGGCTTCAATTCTAAGAGTGGACAGCGGGGATC TTCCAAGTCTGGAAAGTTGAAAGGAGATGACCTTC AGGCCATTAAGAAGGAGCTGACCCAGATAAAACAA AAAGTGGATTCTCTCCTGGAAAAACCTGGAAAAAAT TGAAAAGGAACAGAGCAAACAAGCAGTAGAGATG AAGAATGATAAGTCAGAAGAGGAGCAGAGCAGCA GCTCCGTGAAGAAAGATGAGACTAATGTGAAGATG GAGTCTGAGGGGGGTGCAGATGACTCTGCTGAGG AGGGGGACCTACTGGATGAT | 15 | LPSFSMLM REMPGLL* |
| 526 | NM_0010 77443.1_ 374 | 374 | AGGAATGGGGCGGGGACTAGGCCTTCGCCTCGG CGGCAGAGGAGACTCGGGGGCCATTTTGTGAAGA GACGAAGACTGAGCGGTTGTGGCCGCGTTGCCGA CCTCCAGCAGCAGTCGGCTTCTCTACGCAGAACC CGGGAGTAGGAGACTCAGAATCGAATCTCTTCTCC CTCCCCTTCTTGTTTTCGGCTTTGTGAGAAACCTTA CCATCAAACACGATGGCCAGCAACGTTACCAACAA | 15 | LPSFSMLM REMPGLL* |

TABLE 3A-continued

| SEQ ID | identifier_position | position | modified_RNA | PAP length | PAP |
|---|---|---|---|---|---|
| | | | GACAGATCCTCGCTCCATGAACTCCCGTGTATTCA TTGGGAATCTCAACACTCTTGTGGTCAAGAAATCT GATGTGGAGGCAATCTTTTCGAAGTATGGCAAAAT TGTGGGCTGCTCTGTTCATAAGGGCTTGCCTTCGT TCAGTATGTTAATGAGAGAAATGCCCGGGCTGCTG TAGCAGGAGAGGATGGCAGAATGATTGCTGGCCA GGTTTTAGATATTAACCTGGCTGCAGAGCCAAAAG TGAACCGAGGAAAAGCAGGTGTGAAACGATCTGC AGCGGAGATGTACGGCTCCTCTTTTGACTTGGACT ATGACTTTCAACGGGACTATTATGATAGGATGTAC AGTTACCCAGCACGTGTACCTCCTCCTCCTCCTAT TGCTCGGGCTGTAGTGCCCTCGAAACGTCAGCGT GTATCAGGAAACACTTCACGAAGGGGCAAAAGTG GCTTCAATTCTAAGAGTGGACAGCGGGGATCTTCC AAGTCTGGAAAGTTGAAAGGAGATGACCTTCAGGC CATTAAGAAGGAGCTGACCCAGATAAAACAAAAAG TGGATTCTCTCCTGGAAAACCTGGAAAAAATTGAA AAGGAACAGAGCAAACAAGCAGTAGAGATGAAGA ATGATAAGTCAGAAGAGGAGCAGAGCAGCAGCTC CGTGAAGAAAGATGAGACTAATGTGAAGATGGAGT CTGAGGGGGGTGCAGATGACTCTGCTGAGGAGG GGGACCTACTGGATGATGATGATAATGAAGATCGG GGGGATGACCAGCTGGAGTTG | | |
| 527 | NM_0010 79524.1_ 281 | 281 | CAGTGGGGCGTTGTTTCGTCCGATATCCGCGTTTC AGTCTCCGCCCATACCCCTCCGGGTTAGGCGGCT GTAGCGGAGCTCGAAAAGAGTGGCGCAGGGTCG CGCGGCCCCGCCTCCTTCCCCGCCCAGCGAAGCT CTCTGACCACCCCTCTTTTCTAGAGTTCTGCCTCG CTTCCCGGCGCGGTCGCAGCCCTCAGCCCACTTA GGATAATGGCGACAGCTGAGGTACTGAACATTGG TAAAAAATTATATGAGGGTAAAACAAAAGAAGTCTA CGAATGTTAGACAGTCCAGGAAAAGTCCTCCTGCA GTCCAAGGACCAGATTACAGCAGGAAATGCAGCT AGAAAAAAACCACCTGGAAGGAAAAGCTGCAATCTC AAATAAAATCACCAGTTGTATTTTTCAGTTATTACA GGAAGCAGGTATTAAAACTGCCTTCACCAGAAAAT GTGGGGAGACAGCTTTCATTGCACCGCAGTGTGA AATGATTCCAATTGAATGGGTTTGCAGAAGAATAG CAACTGGTTCTTTTCTCAAAAGAAATCCTGGTGTCA AGGAAGGATATAAGTTTTACCCACCTAAAGTGGAG TTGTTTTTCAAGGATGATGCCAATAATGACCCACA GTGGTCTGAGGAACAGCTGATTGCTGCAAAATTTT GCTTTGCTGGACTTCTTATAGGCCAGACTGAAGTG GATATCATGAGTCATGCTACACAGGCTATATTTGA AATACTGGAGAAATCCTGGTTGCCCCAGAATTGTA CACTGGTTGATATGAAGATTGAATTTGGTGTTGAT GTAACCACCAAAGAAATTGTTCTTGCTGATGTTATT GACAATGATTCCTGGAGACTCTGGCCATCAGGAG ATCGAAGCCAACAGAAAGACAAACAGTCTTATCGG GACCTCAAAGAAGTAACTCCTGAAGGGCTCCAAAT GGTAAAGAAAAACTTTGAGTGGGTTGCAGAGAGA GTAGAGTTGCTTTTGAAATCAGAAAGTCAGTGCAG GGTTGTAGTGTTGAT | 1 | C* |
| 528 | NM_0010 79524.1_ 661 | 661 | CAGTGGGGCGTTGTTTCGTCCGATATCCGCGTTTC AGTCTCCGCCCATACCCCTCCGGGTTAGGCGGCT GTAGCGGAGCTCGAAAAGAGTGGCGCAGGGTCG CGCGGCCCCGCCTCCTTCCCCGCCCAGCGAAGCT CTCTGACCACCCCTCTTTTCTAGAGTTCTGCCTCG CTTCCCGGCGCGGTCGCAGCCCTCAGCCCACTTA GGATAATGGCGACAGCTGAGGTACTGAACATTGG TAAAAAATTATATGAGGGTAAAACAAAAGAAGTCTA CGAATTGTTAGACAGTCCAGGAAAAGTCCTCCTGC AGTCCAAGGACCAGATTACAGCAGGAAATGCAGC TAGAAAAAAACCACCTGGAAGGAAAAGCTGCAATCT CAAATAAAATCACCAGTTGTATTTTTCAGTTATTAC AGGAAGCAGGTATTAAAACTGCCTTCACCAGAAAA TGTGGGGAGACAGCTTTCATTGCACCGCAGTGTG AAATGATTCCAATTGAATGGGTTTGCAGAAGAATA GCAACTGGTTCTTTTCTCAAAAGAAATCCTGGTGT CAAGGAAGGATATAAGTTTTACCCACCTAAAGTGG AGTTGTTTTTCAAGGATGATGCCAATAATGACCCA CAGTGGTCTGAGGAACAGCTGATTGCTGCAAAATT TGCTTTGCTGGACTTCTTATAGGCCAGACTGAAGT GGATATCATGAGTCATGCTACACAGGCTATATTTG AAATACTGGAGAAATCCTGGTTGCCCCAGAATTGT ACACTGGTTGATATGAAGATTGAATTTGGTGTTGAT GTAACCACCAAAGAAATTGTTCTTGCTGATGTTATT | 6 | ALLDFL* |

TABLE 3A-continued

| SEQ ID | identifier_position | position | modified_RNA | PAP length | PAP |
|---|---|---|---|---|---|
| | | | GACAATGATTCCTGGAGACTCTGGCCATCAGGAG<br>ATCGAAGCCAACAGAAAGACAAACAGTCTTATCGG<br>GACCTCAAAGAAGTAACTCCTGAAGGGCTCCAAAT<br>GGTAAAGAAAAACTTTGAGTGGGTTGCAGAGAGA<br>GTAGAGTTGCTTTTGAAATCAGAAAGTCAGTGCAG<br>GGTTGTAGTGTTGAT | | |
| 529 | NM_0010<br>87.3_370 | 370 | AGGGGCTCGAGTTCCGCGTCGTCGCGCAGAGCTG<br>ACTCTGGGAGGCGTTTGGGCCCAGAGAAGTGGAT<br>CCGCCGCTTGCGCCGCATGGAGTCCGAATCGGAA<br>AGCGGGGCTGCTGCTGACACCCCCCCACTGGAGA<br>CCCTAAGCTTCCATGGTGATGAAGAGATTATCGAG<br>GTGGTAGAACTTGATCCCGGTCCGCCGGACCCAG<br>ATGACCTGGCCCAGGAGATGGAAGATGTGGACTT<br>TGAGGAAGAAGAGGAGGAAGAGGGCAACGAAGA<br>GGGCTGGGTTCTAGAACCCCAGGAAGGGGTGGTC<br>GGCAGCATGGAGGGCCCCGACGATAGCGAGGTC<br>ACCTTTGCATTGCACTCAGCATCTGTGTTTGTGTG<br>AGCCTGGACCCCAAGACCAATACCTTGGCAGTGA<br>CCGGGGGTGAAGATGACAAAGCCTTCGTATGGCG<br>GCTCAGCGATGGGGAGCTGCTCTTTGAGTGTGCA<br>GGCCATAAAGACTCTGTGACTTGTGCTGGTTTCAG<br>CCATGACTCCACTCTAGTGGCCACAGGGGACATG<br>AGTGGCCTCTTGAAAGTGTGGCAGGTGGACACTA<br>AGGAGGAGGTCTGGTCCTTTGAAGCGGGAGACCT<br>GGAGTGGATGGAGTGGCATCCTCGGGCACCTGTC<br>CTGTTGGCGGGCACAGCTGACGGCAACACCTGGA<br>TGTGGAAAGTCCCGAATGGTGACTGCAAGACCTTC<br>CAGGGTCCCAACTGCCCAGCCACCTGTGGCCGAG<br>TCCTCCCTGATGGGAAGAGAGCTGTGGTAGGCTA<br>TGAAGATGGGACCATCAGGATTTGGGACCTGAAG<br>CAGGGAAGCCCTATCCATGTACTGAAAGGGACTG<br>AGGGTCACCAGGGCCCACTCACCTGTGTTGCTGC<br>CAACCAGGATGGCAGCTTGATCCTAACTGGCTCTG<br>TGGACTGCCAGGCCAAGCTGGTCAGTGCCACCAC<br>CGGCAAGGTGGTGGGTGTTTTTAGACCTGAGACT<br>GTGGCCTCCCAGCCCAGCCTGGGAGAAGGGGAG<br>GA | 1 | V* |
| 530 | NM_0010<br>87.3_695 | 695 | AGGGGCTCGAGTTCCGCGTCGTCGCGCAGAGCTG<br>ACTCTGGGAGGCGTTTGGGCCCAGAGAAGTGGAT<br>CCGCCGCTTGCGCCGCATGGAGTCCGAATCGGAA<br>AGCGGGGCTGCTGCTGACACCCCCCCACTGGAGA<br>CCCTAAGCTTCCATGGTGATGAAGAGATTATCGAG<br>GTGGTAGAACTTGATCCCGGTCCGCCGGACCCAG<br>ATGACCTGGCCCAGGAGATGGAAGATGTGGACTT<br>TGAGGAAGAAGAGGAGGAAGAGGGCAACGAAGA<br>GGGCTGGGTTCTAGAACCCCAGGAAGGGGTGGTC<br>GGCAGCATGGAGGGCCCCGACGATAGCGAGGTC<br>ACCTTTGCATTGCACTCAGCATCTGTGTTTTGTGTG<br>AGCCTGGACCCCAAGACCAATACCTTGGCAGTGA<br>CCGGGGGTGAAGATGACAAAGCCTTCGTATGGCG<br>GCTCAGCGATGGGGAGCTGCTCTTTGAGTGTGCA<br>GGCCATAAAGACTCTGTGACTTGTGCTGGTTTCAG<br>CCATGACTCCACTCTAGTGGCCACAGGGGACATG<br>AGTGGCCTCTTGAAAGTGTGGCAGGTGGACACTA<br>AGGAGGAGGTCTGGTCCTTTGAAGCGGGAGACCT<br>GGAGTGGATGGAGTGGCATCCTCGGGCACCTGTC<br>CTGTTGGCGGGCACAGCTGACGGCAACACCTGGA<br>TGTGGAAAGTCCGAATGGTGACTGCAAGACCTTCC<br>AGGGTCCCAACTGCCCAGCCACCTGTGGCCGAGT<br>CCTCCCTGATGGGAAGAGAGCTGTGGTAGGCTAT<br>GAAGATGGGACCATCAGGATTTGGGACCTGAAGC<br>AGGGAAGCCCTATCCATGTACTGAAAGGGACTGA<br>GGGTCACCAGGGCCCACTCACCTGTGTTGCTGCC<br>AACCAGGATGGCAGCTTGATCCTAACTGGCTCTGT<br>GGACTGCCAGGCCAAGCTGGTCAGTGCCACCACC<br>GGCAAGGTGGTGGGTGTTTTTAGACCTGAGACTGT<br>GGCCTCCCAGCCCAGCCTGGGAGAAGGGGAGGA | 28 | RMVTARPS<br>RVPTAQPP<br>VAESSLMG<br>RELW* |
| 531 | NM_0010<br>93758.2_<br>312 | 312 | GACCCTTTTCACAACATGGCGCCAAAGCGAAGA<br>AGGAAGCTCCTGCCCCTCCTAAAGCTGAAGCCAA<br>AGCGAAGGCTTTAAAGGCCAAGAAGGCAGTGTTG<br>AAAGGTGTCCACAGCCACAAAAAGAAGAAGATCC<br>GCACGTCACCCACCTTCCGGCGGCCGAAGACACT<br>GCGACTCCGGAGACAGCCCAAATATCCTCGGAAG<br>AGCGCTCCAGGAGAAACAAGCTTGACCACTATG<br>CTATCATCAAGTTTCCGCTGACCACTGAGTCTGCC<br>ATGAAGAAGATAGAAGACAACAACACACTTGTGTT<br>CATGTGGATGTTAAAGCCAACAAGCACCAGATTAA | 14 | MWMLKPT<br>STRLNRL* |

TABLE 3A-continued

| SEQ ID | identifier_ position | position | modified_RNA | PAP length | PAP |
|---|---|---|---|---|---|
| 532 | NM_0010 98.2_623 | 623 | ACAGGCTGTGAAGAAGCTGTATGACATTGATGTGG CCAAGGTCAACACCCTGATTCGGCCTGATGGAGA GAAGAAGGCATATGTTCGACTGGCTCCTGATTACG ATGCTTTGGATGTTGCCAACAAAATTGGGATCATC TAAACTGAGTCCAGCTGCCTAATTCTGAATATATAT ATATATATATCTTTTCACCATAAAAAAAAAAAACA CTCATCTTTGTCAGTGCACAAAATGGCGCCCTACA GCCTACTGGTGACTCGGCTGCAGAAAGCTCTGGG TGTGCGGCAGTACCATGTGGCCTCAGTCCTGTGC CAACGGGCCAAGGTGGCGATGAGCCACTTTGAGC CCAACGAGTACATCCATTATGACCTGCTAGAGAAG AACATTAACATTGTTCGCAAACGACTGAACCGGCC GCTGACACTCTCGGAGAAGATTGTGTATGGACACC TGGATGACCCCGCCAGCCAGGAAATTGAGCGAGG CAAGTCGTACCTGCGGCTGCGGCCGGACCGTGTG GCCATGCAGGATGCGACGGCCCAGATGGCCATGC TCCAGTTCATCAGCAGCGGGCTGTCCAAGGTGGC TGTGCCATCCACCATCCACTGTGACCATCTGATTG AAGCCCAGGTTGGGGGCGAGAAAGACCTGCGCC GGGCCAAGGACATCAACCAGGAAGTTTATAATTTC CTGGCAACTGCAGGTGCCAAATATGGCGTGGGCT TCTGGAAGCCTGGATCTGGAATCATTCACCAGATT ATTCTGGAAAACTATGCGTACCCTGGTGTTCTTCT GATTGGCACTGACTCCCACACCCCCAATGGTGGC GGCTTGGGGGCATCTGCATTGGAGTTGGGGGTGC CGATGCTGTGGATGTCATGGCTGGGATCCCCTGG GAGCTGAAGTGCCCCAAGGTGATTGGCGTGAAGC TGACGGGCTCTCTCTCCGGTTGGTCCTCACCCAAA GATGTGATCCTGAAGGTGGCAGGCATCCTCACGG TGAAAGGTGGCACAGGTGCAATCGTGGAATACCA CGGGCCTGGTGTAGACTCCATCTCCTGCACTGGC ATGGCGACAATCTGCAACATGGGTGCAGAAATTG GGGCCACCACTTCCGTGTTCCCTTACAACCACAGG ATGAAGAAGTACCTGAGCAAGACCGGCCGGGAAG ACATTGCCAATCTAGCTGATGAATTCAAGGATCAC TTGGTGCCTGACCCTGGCTGCCATTATG | 21 | ASALELGV PMLWMSW LGSPGS* |
| 533 | NM_0011 01.2_103 1 | 1031 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCCGAGCGGGAAATCGTGCGTGACATTAAGGAG AAGCTGTGCTACGTCGCCCTGGACTTCGAGCAAG AGATGGCCACGGCTGCTTCCAGCTCCTCCCTGGA GAAGAGCTACGAGCTGCCTGACGGCCAGGTCATC ACCATTGGCAATGAGCGGTTCCGCTGCCCTGAGG CACTCTTCCAGCCTTCCTTCCTGGGCATGGAGTCC TGTGGCATCCACGAAACTACCTTCAACTCCATCAT GAAGTGTGACGTGGACATCCGCAAAGACCTGTAC GCCAACACAGTGCTGTCGGCGGCACCACCATGT ACCCTGGCATTGCCGACAGGATGCAGAAGGAGAT C | 5 | WHPAQ* |
| 534 | NM_0011 01.2_111 4 | 1114 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC | 33 | RCPPSSRC GSASRSM TSPAPPSS TANASRRT MT* |

TABLE 3A-continued

| SEQ ID | identifier_position | position | modified_RNA | PAP length | PAP |
|---|---|---|---|---|---|
| | | | CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC<br>GGCCGAGCGGGAAATCGTGCGTGACATTAAGGAG<br>AAGCTGTGCTACGTCGCCCTGGACTTCGAGCAAG<br>AGATGGCCACGGCTGCTTCCAGCTCCTCCCTGGA<br>GAAGAGCTACGAGCTGCCTGACGGCCAGGTCATC<br>ACCATTGGCAATGAGCGGTTCCGCTGCCCTGAGG<br>CACTCTTCCAGCCTTCCTTCCTGGGCATGGAGTCC<br>TGTGGCATCCACGAAACTACCTTCAACTCCATCAT<br>GAAGTGTGACGTGGACATCCGCAAAGACCTGTAC<br>GCCAACACAGTGCTGTCTGGCGGCACCACCATGT<br>ACCCTGGCATTGCCGACAGGATGCAGAAGGAGAT<br>C | | |
| 535 | NM_0011 01.2_117 4 | 1174 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC<br>GGCCGAGCGGGAAATCGTGCGTGACATTAAGGAG<br>AAGCTGTGCTACGTCGCCCTGGACTTCGAGCAAG<br>AGATGGCCACGGCTGCTTCCAGCTCCTCCCTGGA<br>GAAGAGCTACGAGCTGCCTGACGGCCAGGTCATC<br>ACCATTGGCAATGAGCGGTTCCGCTGCCCTGAGG<br>CACTCTTCCAGCCTTCCTTCCTGGGCATGGAGTCC<br>TGTGGCATCCACGAAACTACCTTCAACTCCATCAT<br>GAAGTGTGACGTGGACATCCGCAAAGACCTGTAC<br>GCCAACACAGTGCTGTCTGGCGGCACCACCATGT<br>ACCCTGGCATTGCCGACAGGATGCAGAAGGAGAT<br>C | 13 | PSSTANAS RRTMT* |
| 536 | NM_0011 01.2_118 9 | 1189 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC<br>GGCCGAGCGGGAAATCGTGCGTGACATTAAGGAG<br>AAGCTGTGCTACGTCGCCCTGGACTTCGAGCAAG<br>AGATGGCCACGGCTGCTTCCAGCTCCTCCCTGGA<br>GAAGAGCTACGAGCTGCCTGACGGCCAGGTCATC<br>ACCATTGGCAATGAGCGGTTCCGCTGCCCTGAGG | 8 | NASRRTMT* |

TABLE 3A-continued

| SEQ ID | identifier_position | position | modified_RNA | PAP length | PAP |
|---|---|---|---|---|---|
| | | | CACTCTTCCAGCCTTCCTTCCTGGGCATGGAGTCC TGTGGCATCCACGAAACTACCTTCAACTCCATCAT GAAGTGTGACGTGGACATCCGCAAAGACCTGTAC GCCAACACAGTGCTGTCTGGCGGCACCACCATGT ACCCTGGCATTGCCGACAGGATGCAGAAGGAGAT C | | |
| 537 | NM_0011 01.2_198 | 198 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGCGTGAT GGTGGGCATGGGTCAGAAGGATTCCTATGTGGGC GACGAGGCCCAGAGCAAGAGAGGCATCCTCACCC TGAAGTACCCCATCGAGCACGGCATCGTCACCAA CTGGGACGACATGGAGAAAATCTGGCACCACACC TTCTACAATGAGCTGCGTGTGGCTCCCGAGGAGC ACCCCGTGCTGCTGACCGAGGCCCCCCTGAACCC CAAGGCCAACCGCGAGAAGATGACCCAGATCATG TTTGAGACCTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 1 | A* |
| 538 | NM_0011 01.2_248 | 248 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCAGAGCAAGAGAGGCATCCTCACCC TGAAGTACCCCATCGAGCACGGCATCGTCACCAA CTGGGACGACATGGAGAAAATCTGGCACCACACC TTCTACAATGAGCTGCGTGTGGCTCCCGAGGAGC ACCCCGTGCTGCTGACCGAGGCCCCCCTGAACCC CAAGGCCAACCGCGAGAAGATGACCCAGATCATG TTTGAGACCTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 8 | RAREASSP* |
| 539 | NM_0011 01.2_266 | 266 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACCC TGAAGTACCCCATCGAGCACGGCATCGTCACCAA | 2 | SP* |

TABLE 3A-continued

| SEQ ID | identifier_position | position | modified_RNA | PAP length | PAP |
|---|---|---|---|---|---|
| | | | CTGGGACGACATGGAGAAAATCTGGCACCACACC<br>TTCTACAATGAGCTGCGTGTGGCTCCCGAGGAGC<br>ACCCCGTGCTGCTGACCGAGGCCCCCCTGAACCC<br>CAAGGCCAACCGCGAGAAGATGACCCAGATCATG<br>TTTGAGACCTTCAACACCCCAGCCATGTACGTTGC<br>TATCCAGGCTGTGCTATCCCTGTACGCCTCTGGCC<br>GTACCACTGGCATCGTGATGGACTCCGGTGACGG<br>GGTCACCCACACTGTGCCCATCTACGAGGGGTAT<br>GCCCTCCCCCATGCCATCCTGCGTCTGGACCTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | | |
| 540 | NM_0011<br>01.2_295 | 295 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGATCGTCACCAA<br>CTGGGACGACATGGAGAAAATCTGGCACCACACC<br>TTCTACAATGAGCTGCGTGTGGCTCCCGAGGAGC<br>ACCCCGTGCTGCTGACCGAGGCCCCCCTGAACCC<br>CAAGGCCAACCGCGAGAAGATGACCCAGATCATG<br>TTTGAGACCTTCAACACCCCAGCCATGTACGTTGC<br>TATCCAGGCTGTGCTATCCCTGTACGCCTCTGGCC<br>GTACCACTGGCATCGTGATGGACTCCGGTGACGG<br>GGTCACCCACACTGTGCCCATCTACGAGGGGTAT<br>GCCCTCCCCCATGCCATCCTGCGTCTGGACCTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 30 | SSPTGTTW<br>RKSGTTPS<br>TMSCVWL<br>PRSTPCC* |
| 541 | NM_0011<br>01.2_401 | 401 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACCC<br>CAAGGCCAACCGCGAGAAGATGACCCAGATCATG<br>TTTGAGACCTTCAACACCCCAGCCATGTACGTTGC<br>TATCCAGGCTGTGCTATCCCTGTACGCCTCTGGCC<br>GTACCACTGGCATCGTGATGGACTCCGGTGACGG<br>GGTCACCCACACTGTGCCCATCTACGAGGGGTAT<br>GCCCTCCCCCATGCCATCCTGCGTCTGGACCTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA | 0 | * |

TABLE 3A-continued

| SEQ ID | identifier_position | position | modified_RNA | PAP length | PAP |
|---|---|---|---|---|---|
| | | | CCATTGGCAATGAGCGGTTCCGCTGCCCTGAGGCACTCTTCCAGCCTTCCTTCCTGGGCATGGAGTCCTGTGGCATCCACGAAACTACCTTCAACTCCATCATGAAGTGTGACGTGGACATCCGCAAAGACCTGTACGCCAACACAGTGCTGTCTGGCGGCACCACCATGTACCCTGGCATTGCCGACAGGATGCAGAAGGAGATCA | | |
| 542 | NM_001101.2_415 | 415 | CGCGTCCGCCCCGCGAGCACAGAGCCTCGCCTTTGCCGATCCGCCGCCCGTCCACACCCGCCGCCAGCTCACCATGGATGATGATATCGCCGCGCTCGTCGTCGACAACGGCTCCGGCATGTGCAAGGCCGGCTTCGCGGGCGACGATGCCCCCGGGCCGTCTTCCCCTCCATCGTGGGGCGCCCCAGGCACCAGGGCGTGATGGTGGGCATGGGTCAGAAGGATTCCTATGTGGGCGACGAGGCCCAGAGCAAGAGAGGCATCCTCACCCTGAAGTACCCCATCGAGCACGGCATCGTCACCAACTGGGACGACATGGAGAAAATCTGGCACCACACCTTCTACAATGAGCTGCGTGTGGCTCCCGAGGAGCACCCCGTGCTGCTGACCGAGGCCCCCCTGAACCCCAAGGCAACCGCGAGAAGATGACCCAGATCATGTTTGAGACCTTCAACACCCCAGCCATGTACGTTGCTATCCAGGCTGTGCTATCCCTGTACGCCTCTGGCCGTACCACTGGCATCGTGATGGACTCCGGTGACGGGGTCACCCACACTGTGCCCATCTACGAGGGGTATGCCCTCCCCCATGCCATCCTGCGTCTGGACCTGGCTGGCCGGGACCTGACTGACTACCTCATGAAGATCCTCACCGAGCGCGGCTACAGCTTCACCACCACGGCCGAGCGGGAAATCGTGCGTGACATTAAGGAGAAGCTGTGCTACGTCGCCCTGGACTTCGAGCAAGAGATGGCCACGGCTGCTTCCAGCTCCTCCCTGGAGAAGAGCTACGAGCTGCCTGACGGCCAGGTCATCACCATTGGCAATGAGCGGTTCCGCTGCCCTGAGGCACTCTTCCAGCCTTCCTTCCTGGGCATGGAGTCCTGTGGCATCCACGAAACTACCTTCAACTCCATCATGAAGTGTGACGTGGACATCCGCAAAGACCTGTACGCCAACACAGTGCTGTCTGGCGGCACCACCATGTACCCTGGCATTGCCGACAGGATGCAGAAGGAGATCA | 4 | TARR* |
| 543 | NM_001101.2_434 | 434 | CGCGTCCGCCCCGCGAGCACAGAGCCTCGCCTTTGCCGATCCGCCGCCCGTCCACACCCGCCGCCAGCTCACCATGGATGATGATATCGCCGCGCTCGTCGTCGACAACGGCTCCGGCATGTGCAAGGCCGGCTTCGCGGGCGACGATGCCCCCGGGCCGTCTTCCCCTCCATCGTGGGGCGCCCCAGGCACCAGGGCGTGATGGTGGGCATGGGTCAGAAGGATTCCTATGTGGGCGACGAGGCCCAGAGCAAGAGAGGCATCCTCACCCTGAAGTACCCCATCGAGCACGGCATCGTCACCAACTGGGACGACATGGAGAAAATCTGGCACCACACCTTCTACAATGAGCTGCGTGTGGCTCCCGAGGAGCACCCCGTGCTGCTGACCGAGGCCCCCCTGAACCCCAAGGCCAACCGCGAGAAGATGACCCAGATCATGTTTGAGACCTTCAACACCCCAGCCATGTACGTTGCTATCCAGGCTGTGCTATCCCTGTACGCCTCTGGCCGTACCACTGGCATCGTGATGGACTCCGGTGACGGGGTCACCCACACTGTGCCCATCTACGAGGGGTATGCCCTCCCCCATGCCATCCTGCGTCTGGACCTGGCTGGCCGGGACCTGACTGACTACCTCATGAAGATCCTCACCGAGCGCGGCTACAGCTTCACCACCACGGCCGAGCGGGAAATCGTGCGTGACATTAAGGAGAAGCTGTGCTACGTCGCCCTGGACTTCGAGCAAGAGATGGCCACGGCTGCTTCCAGCTCCTCCCTGGAGAAGAGCTACGAGCTGCCTGACGGCCAGGTCATCACCATTGGCAATGAGCGGTTCCGCTGCCCTGAGGCACTCTTCCAGCCTTCCTTCCTGGGCATGGAGTCCTGTGGCATCCACGAAACTACCTTCAACTCCATCATGAAGTGTGACGTGGACATCCGCAAAGACCTGTACGCCAACACAGTGCTGTCTGGCGGCACCACCATGTACCCTGGCATTGCCGACAGGATGCAGAAGGAGATCA | 31 | RSCLRPSTPQPCTLLSRLCYPCTPLAVPLAS* |
| 544 | NM_001101.2_445 | 445 | CGCGTCCGCCCCGCGAGCACAGAGCCTCGCCTTTGCCGATCCGCCGCCCGTCCACACCCGCCGCCAGCTCACCATGGATGATGATATCGCCGCGCTCGTCGTCGACAACGGCTCCGGCATGTGCAAGGCCGGCTTCGCGGGCGACGATGCCCCCGGGCCGTCTTCCCCTCCATCGTGGGGCGCCCCAGGCACCAGGGCGTGATGGTGGGCATGGGTCAGAAGGATTCCTATGTGGGCGACGAGGCCCAGAGCAAGAGAGGCATCCTCACC | 28 | LRPSTPQPCTLLSRLCYPCTPLAVPLAS* |

TABLE 3A-continued

| SEQ ID | identifier_position | position | modified_RNA | PAP length | PAP |
|---|---|---|---|---|---|
| | | | CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTGAGACCTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | | |
| 545 | NM_0011 01.2_451 | 451 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 25 | STPQPCTL LSRLCYPC TPLAVPLA S* |
| 546 | NM_0011 01.2_462 | 462 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG | 22 | QPCTLLSR LCYPCTPL AVPLAS* |

TABLE 3A-continued

| SEQ ID | identifier_position | position | modified_RNA | PAP length | PAP |
|---|---|---|---|---|---|
| | | | AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | | |
| 547 | NM_0011 01.2_466 | 466 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTGC TATCCAGGCTGTGCTATCCCTGTACGCCTCTGGCC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 20 | CTLLSRLC YPCTPLAV PLAS* |
| 548 | NM_0011 01.2_512 | 512 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC GTACCACTGGCATCGTGATGGACTCCGGTGACGG GGTCACCCACACTGTGCCCATCTACGAGGGGTAT GCCCTCCCCCATGCCATCCTGCGTCTGGACCTGG CTGGCCGGGACCTGACTGACTACCTCATGAAGAT CCTCACCGAGCGCGGCTACAGCTTCACCACCACG GCCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 5 | VPLAS* |
| 549 | NM_0011 01.2_565 | 565 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG | 20 | STRGMPS PMPSCVW TWLAGT* |

TABLE 3A-continued

| SEQ ID | identifier_position | position | modified_RNA | PAP length | PAP |
|---|---|---|---|---|---|
| | | | CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCATCTACGAGGGGTAT<br>GCCCTCCCCCATGCCATCCTGCGTCTGGACCTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | | |
| 550 | NM_0011 01.2_595 | 595 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCATCCTGCGTCTGGACCTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 10 | SCVWTWL AGT* |
| 551 | NM_0011 01.2_611 | 611 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACTGG<br>CTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA | 5 | WLAGT* |

TABLE 3A-continued

| SEQ ID | identifier_position | position | modified_RNA | PAP length | PAP |
|---|---|---|---|---|---|
| | | | GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | | |
| 552 | NM_0011<br>01.2_620 | 620 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 2 | GT* |
| 553 | NM_0011<br>01.2_626 | 626 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACTGACTGACTACCTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 0 | * |
| 554 | NM_0011<br>01.2_638 | 638 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA | 1 | S* |

TABLE 3A-continued

| SEQ ID | identifier_position | position | modified_RNA | PAP length | PAP |
|---|---|---|---|---|---|
| | | | TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACTCATGAAGAT<br>CCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | | |
| 555 | NM_0011<br>01.2_650 | 650 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCTCACCGAGCGCGGCTACAGCTTCACCACCACG<br>GCCGAGCGGGAAATCGTGCGTGACATTAAGGAGA<br>AGCTGTGCTACGTCGCCCTGGACTTCGAGCAAGA<br>GATGGCCACGGCTGCTTCCAGCTCCTCCCTGGAG<br>AAGAGCTACGAGCTGCCTGACGGCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 90 | SPSAATAS<br>PPRPSGKS<br>CVTLRRSC<br>ATSPWTSS<br>KRWPRLLP<br>APPWRRA<br>TSCLTARS<br>SPLAMSGS<br>AALRHSSS<br>LPSWAWS<br>PVASTKLP<br>STPS* |
| 556 | NM_0011<br>01.2_664 | 664 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCACG<br>GCCGAGCGGGAAATCGTGCGTGACATTAAGGAGA | 85 | TASPPRPS<br>GKSCVTLR<br>RSCATSP<br>WTSSKRW<br>PRLLPAPP<br>WRRATSC<br>LTARSSPL<br>AMSGSAAL<br>RHSSSLPS<br>WAWSPVA<br>STKLPSTP<br>S* |

TABLE 3A-continued

| SEQ ID | identifier_position | position | modified_RNA | PAP length | PAP |
|---|---|---|---|---|---|
| | | | AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | | |
| 557 | NM_0011 01.2_679 | 679 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 80 | RPSGKSCV TLRRSCAT SPWTSSK RWPRLLPA PPWRRAT SCLTARSS PLAMSGSA ALRHSSSL PSWAWSP VASTKLPS TPS* |
| 558 | NM_0011 01.2_685 | 685 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCGAGCGGGAAATCGTGCGTGACATTAAGGAGA AGCTGTGCTACGTCGCCCTGGACTTCGAGCAAGA GATGGCCACGGCTGCTTCCAGCTCCTCCCTGGAG AAGAGCTACGAGCTGCCTGACGGCCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 78 | SGKSCVTL RRSCATSP WTSSKRW PRLLPAPP WRRATSC LTARSSPL AMSGSAAL RHSSSLPS WAWSPVA STKLPSTP S* |
| 559 | NM_0011 01.2_734 | 734 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCGGGCCGTCTTCCCCT | 62 | WTSSKRW PRLLPAPP WRRATSC LTARSSPL AMSGSAAL |

TABLE 3A-continued

| SEQ ID | identifier_position | position | modified_RNA | PAP length | PAP |
|---|---|---|---|---|---|
| | | | CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC<br>GGCCGAGCGGGAAATCGTGCGTGACATTAAGGAG<br>AAGCTGTGCTACGTCGCCTGGACTTCGAGCAAGA<br>GATGGCCACGGCTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | | RHSSSLPS<br>WAWSPVA<br>STKLPSTP<br>S* |
| 560 | NM_0011<br>01.2_762 | 762 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC<br>GGCCGAGCGGGAAATCGTGCGTGACATTAAGGAG<br>AAGCTGTGCTACGTCGCCCTGGACTTCGAGCAAG<br>AGATGGCCACGGTGCTTCCAGCTCCTCCCTGGAG<br>AAGAGCTACGAGCTGCCTGACGGCCAGGTCATCA<br>CCATTGGCAATGAGCGGTTCCGCTGCCCTGAGGC<br>ACTCTTCCAGCCTTCCTTCCTGGGCATGGAGTCCT<br>GTGGCATCCACGAAACTACCTTCAACTCCATCATG<br>AAGTGTGACGTGGACATCCGCAAAGACCTGTACG<br>CCAACACAGTGCTGTCTGGCGGCACCACCATGTA<br>CCCTGGCATTGCCGACAGGATGCAGAAGGAGATC<br>A | 53 | VLPAPPWR<br>RATSCLTA<br>RSSPLAMS<br>GSAALRHS<br>SSLPSWA<br>WSPVASTK<br>LPSTPS* |
| 561 | NM_0011<br>01.2_809 | 809 | CGCGTCCGCCCCGCGAGCACAGAGCCTCGCCTTT<br>GCCGATCCGCCGCCCGTCCACACCCGCCGCCAG<br>CTCACCATGGATGATGATATCGCCGCGCTCGTCGT<br>CGACAACGGCTCCGGCATGTGCAAGGCCGGCTTC<br>GCGGGCGACGATGCCCCCCGGGCCGTCTTCCCCT<br>CCATCGTGGGGCGCCCCAGGCACCAGGGCGTGA<br>TGGTGGGCATGGGTCAGAAGGATTCCTATGTGGG<br>CGACGAGGCCCAGAGCAAGAGAGGCATCCTCACC<br>CTGAAGTACCCCATCGAGCACGGCATCGTCACCA<br>ACTGGGACGACATGGAGAAAATCTGGCACCACAC<br>CTTCTACAATGAGCTGCGTGTGGCTCCCGAGGAG<br>CACCCCGTGCTGCTGACCGAGGCCCCCCTGAACC<br>CCAAGGCCAACCGCGAGAAGATGACCCAGATCAT<br>GTTTGAGACCTTCAACACCCCAGCCATGTACGTTG<br>CTATCCAGGCTGTGCTATCCCTGTACGCCTCTGGC<br>CGTACCACTGGCATCGTGATGGACTCCGGTGACG<br>GGGTCACCCACACTGTGCCCATCTACGAGGGGTA<br>TGCCCTCCCCCATGCCATCCTGCGTCTGGACCTG<br>GCTGGCCGGGACCTGACTGACTACCTCATGAAGA<br>TCCTCACCGAGCGCGGCTACAGCTTCACCACCAC | 37 | RSSPLAMS<br>GSAALRHS<br>SSLPSWA<br>WSPVASTK<br>LPSTPS* |

TABLE 3A-continued

| SEQ ID | identifier_position | position | modified_RNA | PAP length | PAP |
|---|---|---|---|---|---|
| | | | GGCCGAGCGGGAAATCGTGCGTGACATTAAGGAG AAGCTGTGCTACGTCGCCCTGGACTTCGAGCAAG AGATGGCCACGGCTGCTTCCAGCTCCTCCCTGGA GAAGAGCTACGAGCTGCCTGACGGCAGGTCATCA CCATTGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | | |
| 562 | NM_0011 01.2_823 | 823 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCCGAGCGGGAAATCGTGCGTGACATTAAGGAG AAGCTGTGCTACGTCGCCCTGGACTTCGAGCAAG AGATGGCCACGGCTGCTTCCAGCTCCTCCCTGGA GAAGAGCTACGAGCTGCCTGACGGCCAGGTCATC ACCATGGCAATGAGCGGTTCCGCTGCCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 33 | MAMSGSA ALRHSSSL PSWAWSP VASTKLPS TPS* |
| 563 | NM_0011 01.2_846 | 846 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC GCGGGCGACGATGCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCCGAGCGGGAAATCGTGCGTGACATTAAGGAG AAGCTGTGCTACGTCGCCCTGGACTTCGAGCAAG AGATGGCCACGGCTGCTTCCAGCTCCTCCCTGGA GAAGAGCTACGAGCTGCCTGACGGCCAGGTCATC ACCATTGGCAATGAGCGGTTCCGCTGCCTGAGGC ACTCTTCCAGCCTTCCTTCCTGGGCATGGAGTCCT GTGGCATCCACGAAACTACCTTCAACTCCATCATG AAGTGTGACGTGGACATCCGCAAAGACCTGTACG CCAACACAGTGCTGTCTGGCGGCACCACCATGTA CCCTGGCATTGCCGACAGGATGCAGAAGGAGATC A | 25 | LRHSSSLP SWAWSPV ASTKLPST PS* |
| 564 | NM_0011 01.2_979 | 979 | CGCGTCCGCCCCGCGAGCACAGAGCCTCGCCTTT GCCGATCCGCCGCCCGTCCACACCCGCCGCCAG CTCACCATGGATGATGATATCGCCGCGCTCGTCGT CGACAACGGCTCCGGCATGTGCAAGGCCGGCTTC | 22 | PPCTLALP TGCRRRSL PWHPAQ* |

TABLE 3A-continued

| SEQ ID | identifier_position | position | modified_RNA | PAP length | PAP |
|---|---|---|---|---|---|
| | | | GCGGGCGACGATGCCCCCCGGGCCGTCTTCCCCT CCATCGTGGGGCGCCCCAGGCACCAGGGCGTGA TGGTGGGCATGGGTCAGAAGGATTCCTATGTGGG CGACGAGGCCCAGAGCAAGAGAGGCATCCTCACC CTGAAGTACCCCATCGAGCACGGCATCGTCACCA ACTGGGACGACATGGAGAAAATCTGGCACCACAC CTTCTACAATGAGCTGCGTGTGGCTCCCGAGGAG CACCCCGTGCTGCTGACCGAGGCCCCCCTGAACC CCAAGGCCAACCGCGAGAAGATGACCCAGATCAT GTTTGAGACCTTCAACACCCCAGCCATGTACGTTG CTATCCAGGCTGTGCTATCCCTGTACGCCTCTGGC CGTACCACTGGCATCGTGATGGACTCCGGTGACG GGGTCACCCACACTGTGCCCATCTACGAGGGGTA TGCCCTCCCCCATGCCATCCTGCGTCTGGACCTG GCTGGCCGGGACCTGACTGACTACCTCATGAAGA TCCTCACCGAGCGCGGCTACAGCTTCACCACCAC GGCCGAGCGGGAAATCGTGCGTGACATTAAGGAG AAGCTGTGCTACGTCGCCCTGGACTTCGAGCAAG AGATGGCCACGGCTGCTTCCAGCTCCTCCCTGGA GAAGAGCTACGAGCTGCCTGACGGCCAGGTCATC ACCATTGGCAATGAGCGGTTCCGCTGCCCTGAGG CACTCTTCCAGCCTTCCTTCCTGGGCATGGAGTCC TGTGGCATCCACGAAACTACCTTCAACTCCATCAT GAAGTGTGACGTGGACATCCGCAAAGACCTGTAC GCCAACACAGTGCTGTCTGGCGGACCACCATGTA CCCTGGCATTGCCGACAGGATGCAGAAGGAGATC A | | |
| 565 | NM_0011 02.2_182 0 | 1820 | CGCTGTCGCCGCCAGTAGCAGCCTTCGCCAGCAG CGCCGCGGCGGAACCGGGCGCAGGGGAGCGAG CCCGGCCCCGCCAGCCCAGCCCAGCCCAGCCCT ACTCCCTCCCCACGCCAGGGCAGCAGCCGTTGCT CAGAGAGAAGGTGGAGGAAGAAATCCAGACCCTA GCACGCGCGCACCATCATGGACCATTATGATTCTC AGCAAACCAACGATTACATGCAGCCAGAAGAGGA CTGGGACCGGGACCTGCTCCTGGACCCGGCCTG GGAGAAGCAGCAGAGAAAGACATTCACGGCATGG TGTAACTCCCACCTCCGGAAGGCGGGGACACAGA TCGAGAACATCGAAGAGGACTTCCGGGATGGCCT GAAGCTCATGCTGCTGCTGGAGGTCATCTCAGGT GAACGCTTGGCCAAGCCAGAGCGAGGCAAGATGA GAGTGCACAAGATCTCCAACGTCAACAAGGCCCT GGATTTCATAGCCAGCAAAGGCGTCAAACTGGTGT CCATCGGAGCCGAAGAAATCGTGGATGGGAATGT GAAGATGACCCTGGGCATGATCTGGACCATCATC CTGCGCTTTGCCATCCAGGACATCTCCGTGGAAGA GACTTCAGCCAAGGAAGGGCTGCTCCTGTGGTGT CAGAGAAAGACAGCCCCTTACAAAAATGTCAACAT CCAGAACTTCCACATAAGCTGGAAGGATGGCCTC GGCTTCTGTGCTTTGATCCACCGACACCGGCCCG AGCTGATTGACTACGGGAAGCTGCGGAAGGATGA TCCACTCACAAATCTGAATACGGCTTTTGACGTGG CAGAGAAGTACCTGGACATCCCCAAGATGCTGGA TGCCGAAGACATCGTTGGAACTGCCCGACCGGAT GAGAAAGCCATCATGACTTACGTGTCTAGCTTCTA CCACGCCTTCTCTGGAGCCCAGAAGGCGGAGACA GCAGCCAATCGCATCTGCAAGGTGTTGGCCGTCA ACCAGGAGAACGAGCAGCTTATGGAAGACTACGA GA | 1 | D* |
| 566 | NM_0011 54.2_106 8 | 1068 | AGGGCCGGGGTGGGGCGCTGGCGTTTCCGTTGC TTGGATCAGTCTAGGTGCAGCTGCGGATCCTTCAG CGTCTGCATCTCGGCGTCGCCCCGCGTACCGTCG CCCGGCTCTCCGCCGCTCTCCCGGGGGTTCGGG GCACTTGGGTCCCACAGTCTGGTCCTGCTTCACCT TCCCCTGACCTGAGTAGTCGCCATGGCACAGGTT CTCAGAGGCACTGTGACTGACTTCCCTGGATTTGA TGAGCGGGCTGATGCAGAAACTCTTCGGAAGGCT ATGAAAGGCTTGGGCACAGATGAGGAGAGCATCC TGACTCTGTTGACATCCCGAAGTAATGCTCAGCGC CAGGAAATCTCTGCAGCTTTTAAGACTCTGTTTGG CAGGGATCTTCTGGATGACCTGAAATCAGAACTAA CTGGAAAATTTGAAAAATTAATTGTGGCTCTGATGA AACCCTCTCGGCTTTATGATGCTTATGAACTGAAA CATGCCTTGAAGGGAGCTGGAACAAATGAAAAAGT ACTGACAGAAATTATTGCTTCAAGGACACCTGAAG AACTGAGAGCCATCAAACAAGTTTATGAAGAAGAA TATGGCTCAAGCCTGGAAGATGACGTGGTGGGGG ACACTTCAGGGTACTACCAGCGGATGTTGGTGGTT | 7 | LPPLFIP* |

TABLE 3A-continued

| SEQ ID | identifier_position | position | modified_RNA | PAP length | PAP |
|---|---|---|---|---|---|
| | | | CTCCTTCAGGCTAACAGAGACCCTGATGCTGGAAT TGATGAAGCTCAAGTTGAACAAGATGCTCAGGCTT TATTTCAGGCTGGAGAACTTAAATGGGGACAGAT GAAGAAAAGTTTATCACCATCTTTGGAACACGAAG TGTGTCTCATTTGAGAAAGGTGTTTGACAAGTACAT GACTATATCAGGATTTCAAATTGAGGAAACCATTG ACCGCGAGACTTCTGGCAATTTAGAGCAACTACTC CTTGCTGTTGTGAAATCTATTCGAAGTATACCTGCC TACCTTGCAGAGACCCTCTATTATGCTATGAAGGG AGCTGGGACAGATGATCATACCCTCATCAGAGTCA TGGTTTCCAGGAGTG | | |
| 567 | NM_0011 54.2_375 | 375 | AGGGCCGGGGTGGGGCGCTGGCGTTTCCGTTGC TTGGATCAGTCTAGGTGCAGCTGCGGATCCTTCAG CGTCTGCATCTCGGCGTCGCCCCGCGTACCGTCG CCCGGCTCTCCGCCGCTCTCCCGGGGGTTCGGG GCACTTGGGTCCCACAGTCTGGTCCTGCTTCACCT TCCCCTGACCTGAGTAGTCGCCATGGCACAGGTT CTCAGAGGCACTGTGACTGACTTCCCTGGATTTGA TGAGCGGGCTGATGCAGAAACTCTTCGGAAGGCT ATGAAAGGCTTGGGCACAGATGAGGAGAGCATCC TGACTCTGTTGACATCCCGAAGTAATGCTCAGCGC CAGGAAATCTCTGCAGCTTTTAAGACTCTGTTGGC AGGGATCTTCTGGATGACCTGAAATCAGAACTAAC TGGAAAATTTGAAAAATTAATTGTGGCTCTGATGAA ACCCTCTCGGCTTTATGATGCTTATGAACTGAAAC ATGCCTTGAAGGGAGCTGGAACAAATGAAAAAGTA CTGACAGAAATTATTGCTTCAAGGACACCTGAAGA ACTGAGAGCCATCAAACAAGTTTATGAAGAAGAAT ATGGCTCAAGCCTGGAAGATGACGTGGTGGGGGA CACTTCAGGGTACTACCAGCGGATGTGGTGGTTC TCCTTCAGGCTAACAGAGACCCTGATGCTGGAATT GATGAAGCTCAAGTTGAACAAGATGCTCAGGCTTT ATTTCAGGCTGGAGAACTTAAATGGGGACAGATG AAGAAAAGTTTATCACCATCTTTGGAACACGAAGT GTGTCTCATTTGAGAAAGGTGTTTGACAAGTACAT GACTATATCAGGATTTCAAATTGAGGAAACCATTG ACCGCGAGACTTCTGGCAATTTAGAGCAACTACTC CTTGCTGTTGTGAAATCTATTCGAAGTATACCTGCC TACCTTGCAGAGACCCTCTATTATGCTATGAAGGG AGCTGGGACAGATGATCATACCCTCATCAGAGTCA TGGTTTCCAGGAGTGA | 8 | LAGIFWMT* |
| 568 | NM_0011 54.2_650 | 650 | AGGGCCGGGGTGGGGCGCTGGCGTTTCCGTTGC TTGGATCAGTCTAGGTGCAGCTGCGGATCCTTCAG CGTCTGCATCTCGGCGTCGCCCCGCGTACCGTCG CCCGGCTCTCCGCCGCTCTCCCGGGGGTTCGGG GCACTTGGGTCCCACAGTCTGGTCCTGCTTCACCT TCCCCTGACCTGAGTAGTCGCCATGGCACAGGTT CTCAGAGGCACTGTGACTGACTTCCCTGGATTTGA TGAGCGGGCTGATGCAGAAACTCTTCGGAAGGCT ATGAAAGGCTTGGGCACAGATGAGGAGAGCATCC TGACTCTGTTGACATCCCGAAGTAATGCTCAGCGC CAGGAAATCTCTGCAGCTTTTAAGACTCTGTTTGG CAGGGATCTTCTGGATGACCTGAAATCAGAACTAA CTGGAAAATTTGAAAAATTAATTGTGGCTCTGATGA AACCCTCTCGGCTTTATGATGCTTATGAACTGAAA CATGCCTTGAAGGGAGCTGGAACAAATGAAAAAGT ACTGACAGAAATTATTGCTTCAAGGACACCTGAAG AACTGAGAGCCATCAAACAAGTTTATGAAGAAGAA TATGGCTCAAGCCTGGAAGATGACGTGGTGGGGG ACACTTCAGGGTACTACCAGCGGATGTGGTGGTTC TCCTTCAGGCTAACAGAGACCCTGATGCTGGAATT GATGAAGCTCAAGTTGAACAAGATGCTCAGGCTTT ATTTCAGGCTGGAGAACTTAAATGGGGACAGATG AAGAAAAGTTTATCACCATCTTTGGAACACGAAGT GTGTCTCATTTGAGAAAGGTGTTTGACAAGTACAT GACTATATCAGGATTTCAAATTGAGGAAACCATTG ACCGCGAGACTTCTGGCAATTTAGAGCAACTACTC CTTGCTGTTGTGAAATCTATTCGAAGTATACCTGCC TACCTTGCAGAGACCCTCTATTATGCTATGAAGGG AGCTGGGACAGATGATCATACCCTCATCAGAGTCA TGGTTTCCAGGAGTGA | 53 | WWFSFRL TETLMLEL MKLKLNKM LRLYFRLE NLNGGQM KKSLSPSL EHEVCLI* |
| 569 | NM_0011 56.2_597 | 597 | GAACCCGGTCTCCCGCAAGATGGAGCCGGGTTGG GCTGTGACGCTGCTGCTGGGGTCAGAATGTCATA CCCAGGCTATCCCCAACAGGCTACCCACCTTTCC CTGGATATCCTCCTGCAGGTCAGGAGTCATCTTTT CCCCCTTCTGGTCAGTATCCTTATCCTAGTGGCTT TCCTCCAATGGGAGGAGGTGCCTACCCACAAGTG | 34 | LGQMSRQ LWMWWPT VPMIRGKK LKQHLRPP MARI* |

TABLE 3A-continued

| SEQ ID | identifier_position | position | modified_RNA | PAP length | PAP |
|---|---|---|---|---|---|
| | | | CCAAGTAGTGGCTACCCAGGAGCTGGAGGCTACC CTGCGCCTGGAGGTTATCCAGCCCCTGGAGGCTA TCCTGGTGCCCCACAGCCAGGGGGAGCTCCATCC TATCCCGGAGTTCCTCCAGGCCAAGGATTTGGAGT CCCACCAGGTGGAGCAGGCTTTTCTGGGTATCCA CAGCCACCTTCACAGTCTTATGGAGGTGGTCCAGC ACAGGTTCCACTACCTGGTGGCTTTCCTGGAGGAC AGATGCCTTCTCAGTATCCTGGAGGACAACCTACT TACCCTAGTCAGCCTGCCACAGTGACTCAGGTCAC TCAAGGAACTATCCGACCAGCTGCCAACTTCGATG CTATAAGAGATGCAGAAATTCTTCGTAAGGCAATG AAGGGTTTGGGACAGATGAGCAGGCAATTGTGGA TGTGGTGGCCAACCGTTCCAATGATCAGAGGCAA AAAATTAAAGCAGCATTTAAGACCTCCTATGGCAA GGATTTAATCAAAGATCTCAAATCAGAGTTAAGTG GAAATATGGAAGAACTGATCCTGGCCCTCTTCATG CCTCCTACGTATTACGATGCCTGGAGCTTACGGAA AGCAATGCAGGGAGCAGGAACTCAGGAACGTGTA TTGATTGAGATTTTGTGCACAAGAACAAATCAGGA AATCCGAGAAATTGTCAGATGTTATCAGTCAGAATT TGGACGAGACCTTGAAAAGGACATTAGGTCAGATA CATCAGGACATTTTGAACGTTTACTTGTGTCCATGT GCCAGGGAAATCGTGATGAGAACCAGAGTATAAA CCACCAAATGGCTCAGGA | | |
| 570 | NM_0011 75.4_553 | 553 | CTCATTGACTTCCTTCCTGTTCTAACTGCCAGTACT CAGAAGTCAGAGTTGAGAGACAGAGGCACCCCGG ACAGAGACGTGAAGCACTGAATAAATAGATCAGAA TGACTGAAAAAGCCCCAGAGCCACATGTGGAGGA GGATGATGATGATGAGCTGGACAGCAAGCTCAATT ATAAGCCTCCACCACAGAAGTCCCTGAAAGAGCTG CAGGAAATGGACAAAGATGATGAGAGTCTAATTAA GTACAAGAAAACGCTGCTGGGAGATGGTCCTGTG GTGACAGATCCGAAAGCCCCCAATGTCGTTGTCAC CCGGCTCACCCTGGTTTGTGAGAGTGCCCCGGGA CCAATCACCATGGACCTTACTGGAGATCTGGAAGC CCTCAAAAAGGAAACCATTGTGTTAAAGGAAGGTT CTGAATATAGAGTCAAAATTCACTTCAAAGTGAACA GGGATATTGTGTCAGGCCTGAAATACGTTCAGCAC ACCTACAGGACTGGGGTGAAAGTGGATAAAGCAA CATTTATGGTTGGCAGCTATGGACCTCGGCTGAGG AGTATGAGTTCCTCACTCCAGTTGAGGAGGCTCCC AAGGGCATGCTGGCGCGAGGCACGTACCACAACA AGTCCTTCTTCACCGACGATGACAAGCAAGACCAC CTCAGCTGGGAGTGGAACCTGTCGATTAAGAAGG AGTGGACAGAATGAATGCATCCACCCCTTTCCCCA CCCTTGCCACCTGGAAGAATTCTCTCAGGCGTGTT CAGCACCCTGTCCCTCCTCCCTGTCCACAGCTGG GTCCCTCTTCAACACTGCCACATTTCCTTATTGATG CATCTTTTCCCACCCTGTCACTCAACGTGGTCCCT AGAACAAGAGGCTTAAAACCGGGCTTTCACCCAAC CTGCTCCCTCTGATCCTCCATCAGGGCCAGATCTT CCACGTCTCCATCTCAGTACACAATCATTTAATATT TCCCTGTCTTACCCCTATTCAAGCAACTAGAGGCC AGAAAATGGGCAA | 93 | LRSMSSSL QLRRLPRA CWREART TTSPSSPT MTSKTTSA GSGTCRLR RSGQNECI HPFPHPCH LEEFSQAC SAPCPSSL STAGSLFN TATFPY* |
| 571 | NM_0012 07.4_194 | 194 | TGTGTCACTTCCGGCCTCCCTTTAGCTGCCATCTT GCGTCCCCGCGTGTGTGCGCCTAATCTCAGGTGG TCCACCCGAGACCCCTTGAGCACCAACCCTAGTC CCCCGCGCGGCCCCTTATTCGCTCCGACAAGATG AAAGAAACAATCATGAACCAGGAAAAACTCGCCAA ACTGCAGGCACAAGTGCGCATGGTGGGAAAGGAA CTGCTCGCAGAAAGAAGAAGGTGGTTCATAGAACA GCCACAGCAGATGACAAAAAACTTCAGTTCTCCTT AAAGAAGTTAGGGGTAAACAATATCTCTGGTATTG AAGAGGTGAATATGTTTACAAACCAAGGAACAGTG ATCCACTTTAACAACCCTAAAGTTCAGGCATCTCT GGCAGCGAACACTTTCACCATTACAGGCCATGCTG AGACAAAGCAGCTGACAGAAATGCTACCCAGCATC TTAAACCAGCTTGGTGCGGATAGTCTGACTAGTTT AAGGAGACTGGCCGAAGCTCTGCCCAAACAATCT GTGGATGGAAAAGCACCACTTGCTACTGGAGAGG ATGATGATGATGAAGTTCCAGATCTTGTGGAGAAT TTTGATGAGGCTTCCAAGAATGAGGCAAACTGAAT TGAGTCAACTTCTGAAGATAAAACCTGAAGAAGTT ACTGGGAGCTGCTATTTTATATTATGACTGCTTTTT AAGAAATTTTTGTTTATGGATCTGATAAAATCTAGA TCTCTAATATTTTTAAGCCCAAGCCCCTGGACACT GCAGCTCTTTTCAGTTTTTGCTTATACACAATTCAT | 28 | MVGKELLA ERRRWFIE QPQQMTK NFSSP* |

TABLE 3A-continued

| SEQ ID | identifier_position | position | modified_RNA | PAP length | PAP |
|---|---|---|---|---|---|
| | | | TCTTTGCAGCTAATTAAGCCGAAGAAGCCTGGGAA TCAAGTTTGAAACAAAGATTAATAAAGTTCTTTGCC TAGTATACAGTTTTATTTTTTTATTTCATTGACACCG ATCTGTACACAGTAAAAAAAATTGCTTATAGAAAGC TAATCATGGCATGTAATATGGCTGATAACCTTTGG AATTTGATTAAAGATTTAAAATCACAAAAAAAAAAA AA | | |
| 572 | NM_0012 55.2_239 | 239 | GAGGCGTAAGCCAGGCGTGTTAAAGCCGGTCGGA ACTGCTCCGGAGGGCACGGGCTCCGTAGGCACCA ACTGCAAGGACCCCTCCCCCTGCGGGCGCTCCCA TGGCACAGTTCGCGTTCGAGAGTGACCTGCACTC GCTGCTTCAGCTGGATGCACCCATCCCCAATGCAC CCCCTGCGCGCTGGCAGCGCAAAGCCAAGGAAG CCGCAGGCCCGGCCCCCTCACCCATGCGGGCCG CAACCGATCCCACAGCGCCGGCAGGACTCCGGG CCGAACTCCTGGCAAATCCAGTTCCAAGGTTCAGA CCACTCCTAGCAAACCTGGCGGTGACCGCTATATC CCCCATCGCAGTGCTGCCCAGATGGAGGTGGCCA GCTTCCTCCTGAGCAAGGAGAACCAGCCTGAAAA CAGCCAGACGCCCACCAAGAAGGAACATCAGAAA GCCTGGGCTTTGAACCTGAACGGTTTTGATGTAGA GGAAGCCAAGATCCTTCGGCTCAGTGGAAAACCA CAAAATGCGCCAGAGGGTTATCAGAACAGACTGAA AGTACTCTACAGCCAAAAGGCCACTCCTGGCTCCA GCCGGAAGACCTGCCGTTACATTCCTTCCCTGCCA GACCGTATCCTGGATGCGCCTGAAATCCGAAATGA CTATTACCTGAACCTTGTGGATTGGAGTTCTGGGA ATGTACTGGCCGTGGCACTGGACAACAGTGTGTA CCTGTGGAGTGCAAGCTCTGGTGACATCCTGCAG CTTTTGCAAATGGAGCAGCCTGGGGAATATATATC CTCTGTGGCCTGGATCAAAGAGGGCAACTACTTG GCTGTGGGCACCAGCAGTGCTGAGGTGCAGCTAT GGGATGTGCAGCAGCAGAAACGGCTTCGAAATAT GACCAGTCACTCTGCCCGAGTGGGCTCCCTAAGC TGGAACAGCTATATCCTGTCCAGTGGTTCACGTTC TGGCCACATCCACCACCATGATGTTCGGGTAGCA GAACACCATGTGGCCACACTGAGTGGCCAC | 48 | TDPTAPAG LRAELLAN PVPRFRPL LANLAVTAI SPIAVLPR WRWPASS* |
| 573 | NM_0012 80.1_107 | 107 | TAGCTTGGCACGAGGCTCGGGTCGTTGTGGTGCG CTGTCTTCCCGCTTGCGTCAGGGACCTGCCCGAC TCAGTGGCCGCCATGGCATCAGATGAAGGCAAAC TTTTGTTGGAGGGCTGAGTTTTGACACCAATGAGC AGTCGCTGGAGCAGGTCTTCTCAAAGTACGGACA GATCTCTGAAGTGGTGGTTGTGAAAGACAGGGAG ACCCAGAGATCTCGGGGATTTGGGTTTGTCACCTT TGAGAACATTGACGACGCTAAGGATGCCATGATG GCCATGAATGGGAAGTCTGTAGATGGACGGCAGA TCCGAGTAGACCAGGCAGGCAAGTCGTCAGACAA CCGATCCCGTGGGTACCGTGGTGGCTCTGCCGGG GGCCGGGGCTTCTTCCGTGGGGGCCGAGGACGG GGCCGTGGGTTCTCTAGAGGAGGAGGGGACCGA GGCTATGGGGGGAACCGGTTCGAGTCCAGGAGTG GGGGCTACGGAGGCTCCAGAGACTACTATAGCAG CCGGAGTCAGAGTGGTGGCTACAGTGACCGGAGC TCGGGCGGGTCCTACAGAGACAGTTACGACAGTT ACGCTACACACAACGAGTAAAAACCCTTCCTGCTC AAGATCGTCCTTCCAATGGCTGTGTGTTTAAAGATT GTGGGAGCTTCGCTGAACGTTAATGTGTAGTAAAT GCACCTCCTTGTATTCCCACTTTCGTAGTCATTTCG GTTCTGATCTTGTCAAACCCAGCCTGACCGCTTCT GACGCCGGGATGGCCTCGTTACTAGACTTTTCTTT TTAAGGAAGTGCTGTTTTTTTTTGAGGGTTTTCAAA ACATTTTGAAAAGCATTTACTTTTTTGACCACGAGC CATGAGTTTTCAAAAAAATCGGGGGTTGTGTGGGT TTTTGGTTTTTGTTTTAGTTTTTGGTTGCGTTGCCTT TTTTTTTTAGTGGGGTTGGCCCCATGAAGTGGGTG CCCCACTCACTTCTCTGAGATCGAACGGACTGTGA ATCCGCTCTTTGTCGGAAGC | 4 | LLEG* |
| 574 | NM_0012 88.4_450 | 450 | GTTCAGGGCGGCCGGTCGGTGAGTCAGCGGC TCTCTGATCCAGCCCGGGAGAGGACCGAGCTGGA GGAGCTGGGTGTGGGGTGCGTTGGGCTGGTGGG GAGGCCTAGTTTGGGTGCAAGTAGGTCTGATTGA GCTTGTGTTGTGCTGAAGGGACAGCCCTGGGTCT AGGGGAGAGAGTCCCTGAGTGTGAGACCCGCCTT CCCCGGTCCCAGCCCCTCCCAGTTCCCCCAGGGA CGGCCACTTCCTGGTCCCCGACGCAACCATGGCT GAAGAACAACCGCAGGTCGAATTGTTCGTGAAGG CTGGCAGTGATGGGGCCAAGATTGGGAACTGCCC | 36 | SSHSCCM ALKCTQTP TRLRNFW RQCCALP GTPSWQL* |

TABLE 3A-continued

| SEQ ID | identifier_position | position | modified_RNA | PAP length | PAP |
|---|---|---|---|---|---|
| | | | ATTCTCCCAGAGACTGTTCATGGTACTGTGGCTCA AGGGAGTCACCTTCAATGTTACCACCGTTGACACC AAAAGGCGGACCGAGACAGTGCAGAAGCTGTGCC CAGGGGGCAGCTCCCATTCCTGCTGTATGGCACT GAAGTGCACACAGACACCAACAAGATTGAGGAATT TCTGGAGGCAGTGCTGTGCCCTCCCAGGTACCCC AAGCTGGCAGCTCTGAACCCTGAGTCCAACACAG CTGGGCTGGACATATTTGCCAAATTTTCTGCCTAC ATCAAGAATTCAAACCCAGCACTCAATGACAATCT GGAGAAGGGACTCCTGAAAGCCCTGAAGGTTTTA GACAATTACTTAACATCCCCCCTCCCAGAAGAAGT GGATGAAACCAGTGCTGAAGATGAAGGTGTCTCTC AGAGGAAGTTTTTGGATGGCAACGAGCTCACCCT GGCTGACTGCAACCTGTTGCCAAAGTTACACATAG TACAGGTGGTGTGTAAGAAGTACCGGGGATTCAC CATCCCCGAGGCCTTCCGGGGAGTGCATCGGTAC TTGAGCAATGCCTACGCCCGGGAAGAATTCGCTTC CACCTGTCCAGATGATGAGGAGATCGAGCTCGCC TATGAGCAAGTGGCAAAGGCCCTCAAATAAGCCC CTCCTGGGACTCCCTCAACCCCCTCCATTTT | | |
| 575 | NM_0012 93.1_293 | 293 | GTGACTGCCTCTTCCAGGGCGGGCGGTGTGGTGC ACGCATTGCTGTGCTCCAACTCCCTCAGGGCCTGT GTTGCCGCACTCTGCTGCTATGAGCTTCCTCAAAA GTTTCCCGCCGCCTGGGCCAGCGGAGGGGCTCCT GCGGCAGCAGCCAGACACTGAGGCTGTGCTGAAC GGGAAGGGCCTCGGCACTGGTACCCTTTACATCG CTGAGAGCCGCCTGTCTTGGTTAGATGGCTCTGG ATTAGGATTCTCACTGGAATACCCCACCATTAGTTT ACATGCATTATCCAGGACCGAAGTGACTGTCTAGG AGAGCATTTGTATGTTATGGTGAATGCCAAATTTGA AGAAGAATCAAAAGAACCTGTTGCTGATGAAGAAG AGGAAGACAGTGATGATGATGTTGAACCTATTACT GAATTTAGATTTGTGCCTAGTGATAAATCAGCGTTG GAGGCAATGTTCACTGCAATGTGCGAATGCCAGG CCTTGCATCCAGATCCTGAGGATGAGGATTCAGAT GACTACGATGGAGAAGAATATGATGTGGAAGCACA TGAACAAGGACAGGGGGACATCCCTACATTTTACA CCTATGAAGAAGGATTATCCCATCTAACAGCAGAA GGCCAAGCCACACTGGAGAGATTAGAAGGAATGC TTTCTCAGTCTGTGAGCAGCCAGTATAATATGGCT GGGGTCAGGACAGAAGATTCAATAAGAGATTATGA AGATGGGATGGAGGTGGATACCACACCAACAGTT GCTGGACAGTTTGAGGATGCAGATGTTGATCACTG AAAATGATTTATGCAAGTTTAAGATTCTGCTCCTAA GTGTAGGAGAGAACTTGGTGCCTCTTCCACTCTGG AGTGAAGTTAATGAAAGTCTTTTTCCTTTTCCAAAA CCCAACCTGAACCAGTTCTTTCTTGAGACAGACTA TACTGAGACAACAAGTTGTCACCAGCAGAAGATAG ATAATATGACCTTTATTAACTTGATGAATTAACTTAA CCAAGAGGGT | 5 | TEVTV* |
| 576 | NM_0013 00.4_650 | 650 | GGGGGAGGCTGGCAGCGGAGCTTTGAATAGGGA AGTTTTGCAGGGGTTACGTTTGCAGTCAGTCCGGT GTTTGCAAATATTGTGTGGGCTCCGCGCGCTGCG GGCTGCGGGAGGGTCCGGCCGGGCGTCTCTGCG AGCCTGGAGTTTGCATGAAACTTTCACCTGCGCTC CGGGGAGACTTTCGGCTCCGGCTCCCACCGCGCG CCTCGCCGCCCTCGCGACCGCGGGCTCCGTCCAA CCCGGCCCGACATGGACGTGCTCCCCATGTGCAG CATCTTCCAGGAGCTCCAGATCGTGCACGAGACC GGCTACTTCTCGGCGCTGCCGTCTCTGGAGGAGT ACTGGCAACAGACCTGCCTAGAGCTGGAACGTTA CCTCCAGAGCGAGCCCTGCTATGTTTCAGCCTCAG AAATCAAATTTGACAGCCAGGAAGATCTGTGGACC AAAATCATTCTGGCTCGGGAGAAAAAGGAGGAATC CGAACTGAAGATATCTTCCAGTCCTCCAGAGGACA CTCTCATCAGCCCGAGCTTTTGTTACAACTTAGAG ACCAACAGCCTGAACTCAGATGTCAGCAGCGAATC CTCTGACAGCTCCGAGGAACTTTCTCCCACGGCCA AGTTTACCTCCGACCCCATTGGCGAAGTTTGGTCA GCTCGGGAAAATTGAGCTCCTCTGTCACCTCCACG CCTCCATCTTCTCCGGAACTGAGCAGGGAACCTTC TCAACTGTGGGGTTGCGTGCCCGGGGAGCTGCC TCGCCAGGGAAGGTGCGCAGCGGGACTTCGGGG AAGCCAGGTGACAAGGGAAATGGCGATGCCTCCC CCGACGGCAGGAGGAGGGTGCACCGGTGCCACT TTAACGGCTGCAGGAAAGTTTACACCAAAAGCTCC CACTTGAAAGCACACCAGCGGACGCACACAGGAG | 6 | WSAREN* |

TABLE 3A-continued

| SEQ ID | identifier_position | position | modified_RNA | PAP length | PAP |
|---|---|---|---|---|---|
| | | | AAAAGCCTTACAGATGCTCATGGGAAGGGTGTGA GTGGCGTTTTGCAAGAAGTGATGAGTTAACCAGGC ACTTCCGAAAGCACACCGGGGCCAAGCC | | |
| 577 | NM_0013 05.3_727 | 727 | AAAAGTGCCTTTGTTGGCCTGGGCTCAGGAATCCA GAGAAACTGGTCAGGAGGAGGCCCCAGTGACAAA AACCCCTCCCTCTGCCCCCGCCCCTCTGCCAGAG CCATATAACTGCTCAACCTGTCCCCGAGAGAGAGT GCCCTGGCAGCTGTCGGCTGGAAGGAACTGGTCT GCTCACACTTGCTGGCTTGCGCATCAGGACTGGC TTTATCTCCTGACTCACGGTGCAAAGGTGCACTCT GCGAACGTTAAGTCCGTCCCCAGCGCTTGGAATC CTACGGCCCCCACAGCCGGATCCCCTCAGCCTTC CAGGTCCTCAACTCCCGTGGACGCTGAACAATGG CCTCCATGGGGCTACAGGTAATGGGCATCGCGCT GGCCGTCCTGGGCTGGCTGGCCGTCATGCTGTGC TGCGCGCTGCCCATGTGGCGCGTGACGGCCTTCA TCGGCAGCAACATTGTCACCTCGCAGACCATCTG GGAGGGCCTATGGATGAACTGCGTGGTGCAGAGC ACCGGCCAGATGCAGTGCAAGGTGTACGACTCGC TGCTGGCACTGCCGCAGGACCTGCAGGCGGCCC GCGCCCTCGTCATCATCAGCATCATCGTGGCTGCT CTGGGCGTGCTGCTGTCCGTGGTGGGGGGCAAGT GTACCAACTGCCTGGAGGATGAAAGCGCCAAGGC CAAGACCATGATCGTGGCGGGCGTGGTGTTCCTG TTGGCCGGCTTATGGTGATAGTGCCGGTGTCCTG GACGGCCCACAACATCATCCAAGACTTCTACAATC CGCTGGTGGCCTCCGGGCAGAAGCGGGAGATGG GTGCCTCGCTCTACGTCGGCTGGGCCGCCTCCGG CCTGCTGCTCCTTGGCGGGGGGCTGCTTTGCTGC AACTGTCCACCCCGCACAGACAAGCCTTACTCCG CCAAGTATTCTGCTGCCCGCTCTGCTGCTGCCAGC AACTACGTGTAAGGTGCCACGGCTCCACTCTGTTC CTCTCTGCTTTGTTCTTCCCTGGACTGAGCTCA | 1 | W* |
| 578 | NM_0013 05.3_760 | 760 | AAAAGTGCCTTTGTTGGCCTGGGCTCAGGAATCCA GAGAAACTGGTCAGGAGGAGGCCCCAGTGACAAA AACCCCTCCCTCTGCCCCCGCCCCTCTGCCAGAG CCATATAACTGCTCAACCTGTCCCCGAGAGAGAGT GCCCTGGCAGCTGTCGGCTGGAAGGAACTGGTCT GCTCACACTTGCTGGCTTGCGCATCAGGACTGGC TTTATCTCCTGACTCACGGTGCAAAGGTGCACTCT GCGAACGTTAAGTCCGTCCCCAGCGCTTGGAATC CTACGGCCCCCACAGCCGGATCCCCTCAGCCTTC CAGGTCCTCAACTCCCGTGGACGCTGAACAATGG CCTCCATGGGGCTACAGGTAATGGGCATCGCGCT GGCCGTCCTGGGCTGGCTGGCCGTCATGCTGTGC TGCGCGCTGCCCATGTGGCGCGTGACGGCCTTCA TCGGCAGCAACATTGTCACCTCGCAGACCATCTG GGAGGGCCTATGGATGAACTGCGTGGTGCAGAGC ACCGGCCAGATGCAGTGCAAGGTGTACGACTCGC TGCTGGCACTGCCGCAGGACCTGCAGGCGGCCC GCGCCCTCGTCATCATCAGCATCATCGTGGCTGCT CTGGGCGTGCTGCTGTCCGTGGTGGGGGGCAAGT GTACCAACTGCCTGGAGGATGAAAGCGCCAAGGC CAAGACCATGATCGTGGCGGGCGTGGTGTTCCTG TTGGCCGGCTTATGGTGATAGTGCCGGTGTCCTG GACGGCCCACAACATCATCCAAGACTTCTACAATC CGCTGGTGGCCTCCGGGCAGAAGCGGGAGATGG GTGCCTCGCTCTACGTCGGCTGGGCCGCCTCCGG CCTGCTGCTCCTTGGCGGGGGGCTGCTTTGCTGC AACTGTCCACCCCGCACAGACAAGCCTTACTCCG CCAAGTATTCTGCTGCCCGCTCTGCTGCTGCCAGC AACTACGTGTAAGGTGCCACGGCTCCACTCTGTTC CTCTCTGCTTTGTTCTTCCCTGGACTGAGCTCA | 153 | TTSSKTSTI RWWPPGR SGRWVPR STSAGPPP ACCSLAGG CFAATVHP AQTSLTPP SILLPALLL PATTCKVP RLHSVPLC FVLPWTEL SAGCDPR RALPRATG CWGLGTG QRLSQAG RQQPSASL AHSDNFPR PPPASKNR VHPPLDIG EGRK* |
| 579 | NM_0013 12.2_389 | 389 | GCTGGGCGCGGGCGGCGGCCCGGAGGAGA ACGGGCGGAGGGCGCGGGCCGACCGGGCGCAC CGACCATGGCCTCCAAATGCCCCAAGTGCGACAA GACCGTGTACTTCGCCGAGAAGGTGAGCTCCCTG GGGAAGGACTGGCACAAGTTCTGCCTCAAGTGCG AGCGCTGCAGCAAGACGCTGACGCCCGGGGGCC ACGCCGAGCATGACGGGAAGCCGTTCTGCCACAA GCCGTGCTACGCCACCCTGTTCGGACCCAAAGGC GTGAACATCGGGGGCGCGGGCTCCTACATCTACG AGAAGCCCCTGGCGGAGGGGCCGCAGGTCACCG GCCCCATCGAGGTCCCCGCGGCCCGAGCAGAGG AGCGGAAGGCGAGCGGCCCCCGAAGGGGCCCAG CAGAGCCTCCAGTGTCACCACTTTCACCGGGGAG CCCAACACGTGCCCGCGCTGCAGCAAGAAGGTGT | 32 | RRGPAEPP VSPLSPGS PTRARAAA RRCTSLRR* |

TABLE 3A-continued

| SEQ ID | identifier_position | position | modified_RNA | PAP length | PAP |
|---|---|---|---|---|---|
| | | | ACTTCGCTGAGAAGGTGACGTCTCTGGGCAAGGA<br>TTGGCACCGGCCCTGCCTGCGCTGCGAGCGCTGC<br>GGGAAGACACTGACCCCCGGCGGGCACGCGGAG<br>CACGACGGCCAGCCCTACTGCCACAAGCCCTGCT<br>ATGGAATCCTCTTCGGACCCAAGGGAGTGAACAC<br>CGGTGCGGTGGGCAGCTACATCTATGACCGGGAC<br>CCCGAAGGCAAGGTCCAGCCCTAGGCTACAGCGG<br>CTCTCATGATGTGGGCTCACCTGCGCCCCAGACC<br>CTGCAGGGGCCCCCCTGCTTGGCTCTGCTGGGAG<br>AGTGCTCAGCCGCCCAGTCCTGCCTGCAAGCCCA<br>GGGCGAGTATTGGAGGAGGGGCAGCCACGGGCA<br>GAGCACCATGCCCATCCCCGAGTCTCTGGTGTGT<br>CTGCCCCCTCTGGCATCCTCTGGGCGTCCCATGA<br>TCCCTTCTGTGTCTGCGTGTCCGAATCCCCGTGTG<br>ACCCTGTCCCAGCATTTTCCCGCCGACCCTGCGT<br>GTCCCCGTGGCGCTGTCCGCTCTCCCTCTCCTGC<br>TGCCCACCCACCT | | |
| 580 | NM_0013<br>59.1_257 | 257 | ACGCCGCCTGGGTCCCAGTCCCCGTCCCATCCCC<br>CGGCGGCCTAGGCAGCGTTTCCAGCCCCGAGAAC<br>TTTGTTCTTTTTGTCCCGCCCCCTGCGCCCAACCG<br>CCTGCGCCGCCTTCCGGCCCGAGTTCTGGAGACT<br>CAACATGAAGCTACCGGCCAGGGTTTTCTTTACTC<br>TGGGGTCCCGGCTGCCCTGTGGCCTCGCTCCTCG<br>GAGGTTTTTCAGTTATGGGACAAAAATATTATATCA<br>AAACACTGAAGCTTGCAATCTAAATTCTTTTCACCT<br>CTTCAAAAAGCGATGCTACCACCTAATAGTTTTCAA<br>GGAAAAGTGGCATTCATTACTGGGGGAGGTACTG<br>GCCTTGGTAAAGGAATGACAACTCTTCTGTCCAGC<br>CTAGGTGCTCAGTGCGTGATAGCCAGCCGGAAGA<br>TGGATGTTTTGAAAGCTACCGCAGAACAAATTTCTT<br>CTCAAACTGGAAATAAGGTTCATGCAATTCAGTGT<br>GATGTGAGGGATCCTGATATGGTTCAAAACACTGT<br>GTCAGAACTGATCAAAGTTGCAGGACATCCTAATA<br>TTGTGATAAACAATGCAGCAGGGAATTTTATTTCTC<br>CTACTGAAAGACTTTCTCCTAATGCTTGGAAAACC<br>ATAACTGACATAGTTCTAAATGGCACAGCCTTCGT<br>GACACTAGAAATTGGAAAACAACTAATTAAAGCAC<br>AGAAAGGAGCAGCATTTCTTTCTATTACTACTATCT<br>ATGCTGAGACTGGTTCAGGTTTTGTAGTACCAAGT<br>GCTTCTGCCAAAGCAGGTGTGGAAGCCATGAGCA<br>AGTCTCTTGCAGCTGAATGGGGTAAATATGGAATG<br>CGATTCAATGTGATTCAACCAGGGCCTATAAAAAC<br>CAAAGGTGCCTTTAGCCGTCTGGACCCAACTGGA<br>ACATTTGAGAAAGAAATGATTGGCAGAATTCCCTG<br>TGGTCGCCTGGGGACTGTAGAAGAACTCGCAAAT<br>CTTGCTGCTTTCCTTTGTAGTGATTATGCTTCTTGG<br>ATTAATGGAGC | 36 | CNLNSFHL<br>FKKRCYHL<br>IVFKEKWH<br>SLLGEVLA<br>LVKE* |
| 581 | NM_0013<br>98.2_871 | 871 | GCTCAACATGGCGGCCTTCTGTGCCCGCCCCCTC<br>CGCTAACGGGCACGTTACTCCGTCCGAACGCAGT<br>AGACGAAGGCGGCGGCGATGGCGGCGGGGATAG<br>TGGCTTCTCGCAGACTCCGCGACCTACTGACCCG<br>GCGACTGACAGGCTCCAACTACCCGGGACTCAGT<br>ATTAGCCTTCGCCTCACTGGCTCCTCTGCACAAGA<br>GGAGGCTTCCGGAGTAGCCCTCGGTGAAGCCCCA<br>GACCACAGCTATGAGTCCCTTCGTGTGACGTCTGC<br>GCAGAAACATGTTCTGCATGTCCAGCTCAACCGGC<br>CCAACAAGAGGAATGCCATGAACAAGGTCTTCTGG<br>AGAGAGATGGTAGAGTGCTTCAACAAGATTTCGAG<br>AGACGCTGACTGTCGGGCGGTGGTGATCTCTGGT<br>GCAGGAAAAATGTTCACTGCAGGTATTGACCTGAT<br>GGACATGGCTTCGGACATCCTGCAGCCCAAAGGA<br>GATGATGTGGCCCGGATCAGCTGGTACCTCCGTG<br>ACATCATCACTCGATACCAGGAGACCTTCAACGTC<br>ATCGAGAGGTGCCCCAAGCCCGTGATTGCTGCCG<br>TCCATGGGGGCTGCATTGGCGGAGGTGTGGACCT<br>TGTCACCGCCTGTGACATCCGGTACTGTGCCCAG<br>GATGCTTTCTTCCAGGTGAAGGAGGTGGACGTGG<br>GTTTGGCTGCCGATGTAGGAACACTGCAGCGCCT<br>GCCCAAGGTCATCGGGAACCAGAGCCTGGTCAAC<br>GAGCTGGCCTTCACCGCCCGCAAGATGATGGCTG<br>ACGAGGCCCTGGGCAGTGGGCTGGTCAGCCGGG<br>TGTTCCCAGACAAAGAGGTCATGCTGGATGCTGC<br>CTTAGCGCTGGCGGCGAGATTTCCAGCAAGAGCC<br>CCGTGGCGGTGCAGAGCACCAAGGTCAACCTGCT<br>GTATTCCCGCGACCATTCGGTGGCCGAGAGCCTC<br>AACTACGTGGCGTCCTGGAACATGAGCATGCTGC<br>AGACCCAAGACCTCGTGAAGTCGGTCCAGGCCA | 36 | RFPARAP<br>WRCRAPR<br>STCCIPATI<br>RWPRAST<br>TWRPGT* |

TABLE 3A-continued

| SEQ ID | identifier_ position | position | modified_RNA | PAP length | PAP |
|---|---|---|---|---|---|
| 582 | NM_0014 02.5_100 1 | 1001 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAGAATGTGTCT GTCAAGGATGTTCG | 31 | RMCLSRM FVVATLLV TAKMTHQ WKQLASLL R* |
| 583 | NM_0014 02.5_101 6 | 1016 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAGGATGTTCG | 26 | RMFVVATL LVTAKMTH QWKQLAS LLR* |
| 584 | NM_0014 02.5_102 | 102 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATGGAC ACGTAGATTCGGGCAAGTCCACCACTACTGGCCAT CTGATCTATAAATGCGGTGGCATCGACAAAAGAAC CATTGAAAAATTTGAGAAGGAGGCTGCTGAGATGG GAAAGGGCTCCTTCAAGTATGCCTGGGTCTTGGAT AAACTGAAAGCTGAGCGTGAACGTGGTATCACCAT TGATATCTCCTTGTGGAAATTTGAGACCAGCAAGT ACTATGTGACTATCATTGATGCCCCAGGACACAGA GACTTTATCAAAAACATGATTACAGGGACATCTCA GGCTGACTGTGCTGTCCTGATTGTTGCTGCTGGTG TTGGTGAATTTGAAGCTGGTATCTCCAAGAATGGG CAGACCCGAGAGCATGCCCTTCTGGCTTACACACT GGGTGTGAAACAACTAATTGTCGGTGTTAACAAAA TGGATTCCACTGAGCCACCCTACAGCCAGAAGAG ATATGAGGAAATTGTTAAGGAAGTCAGCACTTACA | 3 | MDT* |

TABLE 3A-continued

| SEQ ID | identifier_position | position | modified_RNA | PAP length | PAP |
|---|---|---|---|---|---|
| | | | TTAAGAAAATTGGCTACAACCCCGACACAGTAGCA TTTGTGCCAATTTCTGGTTGGAATGGTGACAACAT GCTGGAGCCAAGTGCTAACATGCCTTGGTTCAAG GGATGGAAAGTCACCCGTAAGGATGGCAATGCCA GTGGAACCACGCTGCTTGAGGCTCTGGACTGCAT CCTACCACCAACTCGTCCAACTGACAAGCCCTTGC GCCTGCCTCTCCAGGATGTCTACAAAATTGGTGGT ATTGGTACTGTTCCTGTTGGCCGAGTGGAGACTGG TGTTCTCAAACCCGGTATGGTGGTCACCTTTGCTC CAGTCAACGTTACAACGGAAGTAAAATCTGTCGAA ATGCACCATGAAGCTTTGAGTGAAGCTCTTCCTGG GGACAATGTGGGCTTCAATGTCAAGAATGTGTCTG TCAAGGATGTTCG | | |
| 585 | NM_0014 02.5_102 3 | 1023 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTCG | 23 | VVATLLVT AKMTHQW KQLASLLR* |
| 586 | NM_0014 02.5_103 8 | 1038 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 18 | LVTAKMTH QWKQLAS LLR* |
| 587 | NM_0014 02.5_105 0 | 1050 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC | 15 | RKMTHQW KQLASLLR* |

TABLE 3A-continued

| SEQ ID | identifier_position | position | modified_RNA | PAP length | PAP |
|---|---|---|---|---|---|
| | | | ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | | |
| 588 | NM_0014 02.5_106 1 | 1061 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 11 | HQWKQLA SLLR* |
| 589 | NM_0014 02.5_106 4 | 1064 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC | 10 | QWKQLAS LLR* |

TABLE 3A-continued

| SEQ ID | identifier_position | position | modified_RNA | PAP length | PAP |
|---|---|---|---|---|---|
| | | | CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | | |
| 590 | NM_0014<br>02.5_108<br>0 | 1080 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 4 | SLLR* |
| 591 | NM_0014<br>02.5_108<br>8 | 1088 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 2 | VR* |
| 592 | NM_0014<br>02.5_110<br>8 | 1108 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC | 4 | IQAK* |

TABLE 3A-continued

| SEQ ID | identifier_position | position | modified_RNA | PAP length | PAP |
|---|---|---|---|---|---|
| | | | CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAAATGCACCATGAAGCTTTGAGTGAAGCTCTTCCT<br>GGGGACAATGTGGGCTTCAATGTCAAGAATGTGTC<br>TGTCAAGGATGTTC | | |
| 593 | NM_0014<br>02.5_111<br>7 | 1117 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAAATGCACCATGAAGCTTTGAGTGAAGCTCTTCCT<br>GGGGACAATGTGGGCTTCAATGTCAAGAATGTGTC<br>TGTCAAGGATGTTC | 1 | K* |
| 594 | NM_0014<br>02.5_112<br>0 | 1120 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT | 0 | * |

TABLE 3A-continued

| SEQ ID | identifier_position | position | modified_RNA | PAP length | PAP |
|---|---|---|---|---|---|
| | | | GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | | |
| 595 | NM_0014<br>02.5_113<br>1 | 1131 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 18 | MPLYWIAT<br>RLTLHASL<br>LS* |
| 596 | NM_0014<br>02.5_113<br>9 | 1139 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 16 | LYWIATRL<br>TLHASLLS* |
| 597 | NM_0014<br>02.5_114<br>5 | 1145 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG | 14 | WIATRLTL<br>HASLLS* |

TABLE 3A-continued

| SEQ ID | identifier_ position | position | modified_RNA | PAP length | PAP |
|---|---|---|---|---|---|
| | | | GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | | |
| 598 | NM_0014 02.5_115 3 | 1153 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 11 | TRLTLHAS LLS* |
| 599 | NM_0014 02.5_116 0 | 1160 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT | 9 | VTLHASLL S* |

TABLE 3A-continued

| SEQ ID | identifier_position | position | modified_RNA | PAP length | PAP |
|---|---|---|---|---|---|
| 600 | NM_0014 02.5_116 7 | 1167 | GGGGACAATGTGGGCTTCAATGTCAAGAATGTGTC TGTCAAGGATGTTC CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 7 | MHASLLS* |
| 601 | NM_0014 02.5_117 9 | 1179 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 3 | LLS* |
| 602 | NM_0014 02.5_118 1 | 1181 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC | 2 | VS* |

TABLE 3A-continued

| SEQ ID | identifier_position | position | modified_RNA | PAP length | PAP |
|---|---|---|---|---|---|
| | | | AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | | |
| 603 | NM_0014 02.5_120 0 | 1200 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 15 | MIAVLVKS WKMALNS* |
| 604 | NM_0014 02.5_120 7 | 1207 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 12 | VLVKSWK MALNS* |

TABLE 3A-continued

| SEQ ID | identifier_position | position | modified_RNA | length PAP | PAP |
|---|---|---|---|---|---|
| 605 | NM_0014 02.5_121 0 | 1210 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 11 | LVKSWKM ALNS* |
| 606 | NM_0014 02.5_122 0 | 1220 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 8 | SWKMALN S* |
| 607 | NM_0014 02.5_123 5 | 1235 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT | 3 | LNS* |

TABLE 3A-continued

| SEQ ID | identifier_position | position | modified_RNA | PAP length | PAP |
|---|---|---|---|---|---|
| | | | ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | | |
| 608 | NM_0014 02.5_126 3 | 1263 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 28 | LLIWFLASP CVLRASQT IHLWVALLF VI* |
| 609 | NM_0014 02.5_126 6 | 1266 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 28 | MLIWFLAS PCVLRASQ TIHLWVALL FVI* |
| 610 | NM_0014 02.5_126 9 | 1269 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC | 26 | IWFLASPC VLRASQTI HLWVALLF VI* |

TABLE 3A-continued

| SEQ ID | identifier_position | position | modified_RNA | PAP length | PAP |
|---|---|---|---|---|---|
| | | | ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | | |
| 611 | NM_0014<br>02.5_129<br>0 | 1290 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 19 | CVLRASQT<br>IHLWVALLF<br>VI* |
| 612 | NM_0014<br>02.5_129<br>9 | 1299 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC | 16 | RASQTIHL<br>WVALLFVI* |

TABLE 3A-continued

| SEQ ID | identifier_position | position | modified_RNA | PAP length | PAP |
|---|---|---|---|---|---|
| | | | CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | | |
| 613 | NM_0014 02.5_132 5 | 1325 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 8 | WVALLFVI* |
| 614 | NM_0014 02.5_133 5 | 1335 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTC | 5 | LLFVI* |
| 615 | NM_0014 02.5_134 1 | 1341 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC | 2 | VI* |

TABLE 3A-continued

| SEQ ID | identifier_position | position | modified_RNA | PAP length | PAP |
|---|---|---|---|---|---|
| | | | CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAAATGCACCATGAAGCTTTGAGTGAAGCTCTTCCT<br>GGGGACAATGTGGGCTTCAATGTCAAGAATGTGTC<br>TGTCAAGGATGTTC | | |
| 616 | NM_0014 02.5_135 | 135 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACGGCCA<br>TCTGATCTATAAATGCGGTGGCATCGACAAAAGAA<br>CCATTGAAAAATTTGAGAAGGAGGCTGCTGAGATG<br>GGAAAGGGCTCCTTCAAGTATGCCTGGGTCTTGG<br>ATAAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 2 | AI* |
| 617 | NM_0014 02.5_141 2 | 1412 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT | 17 | RSPSLPRK LRRLNEYY P* |

TABLE 3A-continued

| SEQ ID | identifier_position | position | modified_RNA | PAP length | PAP |
|---|---|---|---|---|---|
| | | | GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | | |
| 618 | NM_0014<br>02.5_142<br>9 | 1429 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 11 | RKLRRLNE<br>YYP* |
| 619 | NM_0014<br>02.5_144<br>5 | 1445 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT<br>GGTGTTCTCAAACCCGGTATGGTGGTCACCTTTGC<br>TCCAGTCAACGTTACAACGGAAGTAAAATCTGTCG<br>AAATGCACCATGAAGCTTTGAGTGAAGCTCTTCCT<br>GGGGACAATGTGGGCTTCAATGTCAAGAATGTGTC<br>TGTCAAGGATGTTC | 6 | VNEYYP* |
| 620 | NM_0014<br>02.5_159 | 159 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGGGCATCGACAAAGAA<br>CCATTGAAAAATTTGAGAAGGAGGCTGCTGAGATG<br>GGAAAGGGCTCCTTCAAGTATGCCTGGGTCTTGG<br>ATAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG | 30 | ASTKEPLK<br>NLRRRLLR<br>WERAPSS<br>MPGSWIN* |

| SEQ ID | identifier_position | position | modified_RNA | PAP length | PAP |
|---|---|---|---|---|---|
| | | | TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 621 | NM_0014<br>02.5_172 | 172 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAGAA<br>CCATTGAAAAATTTGAGAAGGAGGCTGCTGAGATG<br>GGAAAGGGCTCCTTCAAGTATGCCTGGGTCTTGG<br>ATAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 26 | EPLKNLRR<br>RLLRWERA<br>PSSMPGS<br>WIN* |
| 622 | NM_0014<br>02.5_180 | 180 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAGA<br>ACCATGAAAAATTTGAGAAGGAGGCTGCTGAGATG<br>GGAAAGGGCTCCTTCAAGTATGCCTGGGTCTTGG<br>ATAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG | 24 | MKNLRRRL<br>LRWERAP<br>SSMPGSWI<br>N* |

TABLE 3A-continued

| SEQ ID | identifier_position | position | modified_RNA | PAP length | PAP |
|---|---|---|---|---|---|
| | | | GGGACAATGTGGGCTTCAATGTCAAGAATGTGTCT<br>GTCAAGGATGTTCG | | |
| 623 | NM_0014<br>02.5_189 | 189 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTGAGAAGGAGGCTGCTGAGATG<br>GGAAAGGGCTCCTTCAAGTATGCCTGGGTCTTGG<br>ATAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 21 | LRRRLLRW<br>ERAPSSMP<br>GSWIN* |
| 624 | NM_0014<br>02.5_242 | 242 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTGG<br>ATAAACTGAAAGCTGAGCGTGAACGTGGTATCACC<br>ATTGATATCTCCTTGTGGAAATTTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 3 | WIN* |
| 625 | NM_0014<br>02.5_303 | 303 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTGAGACCAGCAA<br>GTACTATGTGACTATCATTGATGCCCCAGGACACA<br>GAGACTTTATCAAAAACATGATTACAGGGACATCT<br>CAGGCTGACTGTGCTGTCCTGATTGTTGCTGCTGG<br>TGTTGGTGAATTTGAAGCTGGTATCTCCAAGAATG<br>GGCAGACCCGAGAGCATGCCCTTCTGGCTTACAC<br>ACTGGGTGTGAAACAACTAATTGTCGGTGTTAACA<br>AAATGGATTCCACTGAGCCACCCTACAGCCAGAAG | 7 | LRPASTM* |

TABLE 3A-continued

| SEQ ID | identifier_ position | position | modified_RNA | PAP length | PAP |
|---|---|---|---|---|---|
| | | | AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 626 | NM_0014 02.5_408 | 408 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATGTTGCTGCTGG TGTTGGTGAATTTGAAGCTGGTATCTCCAAGAATG GGCAGACCCGAGAGCATGCCCTTCTGGCTTACAC ACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 30 | MLLLVLVN LKLVSPRM GRPESMP FWLTHWV* |
| 627 | NM_0014 02.5_411 | 411 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTGCTGCTGG TGTTGGTGAATTTGAAGCTGGTATCTCCAAGAATG GGCAGACCCGAGAGCATGCCCTTCTGGCTTACAC ACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 28 | LLVLVNLKL VSPRMGR PESMPFW LTHWV* |

TABLE 3A-continued

| SEQ ID | identifier_ position | position | modified_RNA | PAP length | PAP |
|---|---|---|---|---|---|
| 628 | NM_0014 02.5_423 | 423 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTGGTGAATTTGAAGCTGGTATCTCCAAGAATG GGCAGACCCGAGAGCATGCCCTTCTGGCTTACAC ACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 24 | VNLKLVSP RMGRPES MPFWLTH WV* |
| 629 | NM_0014 02.5_432 | 432 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTGAAGCTGGTATCTCCAAGAATG GGCAGACCCGAGAGCATGCCCTTCTGGCTTACAC ACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 22 | LKLVSPRM GRPESMP FWLTHWV* |
| 630 | NM_0014 02.5_463 | 463 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACAC ACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA | 11 | ESMPFWLT HWV* |

TABLE 3A-continued

| SEQ ID | identifier_position | position | modified_RNA | PAP length | PAP |
|---|---|---|---|---|---|
| | | | CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 631 | NM_0014<br>02.5_475 | 475 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCTTCTGGCTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 7 | FWLTHWV* |
| 632 | NM_0014<br>02.5_482 | 482 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGTTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 5 | VTHWV* |
| 633 | NM_0014<br>02.5_484 | 484 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC | 4 | THWV* |

TABLE 3A-continued

| SEQ ID | identifier_position | position | modified_RNA | PAP length | PAP |
|---|---|---|---|---|---|
| | | | ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTACAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 634 | NM_0014<br>02.5_486 | 486 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTAAC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 0 | * |
| 635 | NM_0014<br>02.5_487 | 487 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACC<br>ACTGGGTGTGAAACAACTAATTGTCGGTGTTAACA<br>AAATGGATTCCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC | 3 | HWV* |

TABLE 3A-continued

| SEQ ID | identifier_position | position | modified_RNA | PAP length | PAP |
|---|---|---|---|---|---|
| | | | AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 636 | NM_001402.5_510 | 510 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 39 | MSVLTKWI PLSHPTAR RDMRKLLR KSALTLRK LATTPTQ* |
| 637 | NM_001402.5_519 | 519 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTAACA AAATGGATTCCACTGAGCCACCCTACAGCCAGAAG AGATATGAGGAAATTGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 35 | TKWI PLSH PTARRDM RKLLRKSA LTLRKLATT PTQ* |
| 638 | NM_001402.5_534 | 534 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC | 30 | LSHPTARR DMRKLLRK SALTLRKL ATTPTQ* |

TABLE 3A-continued

| SEQ ID | identifier_position | position | modified_RNA | PAP length | PAP |
|---|---|---|---|---|---|
| | | | CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCACTGAGCCACCCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 639 | NM_0014<br>02.5_546 | 546 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCTACAGCCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 26 | TARRDMR<br>KLLRKSAL<br>TLRKLATT<br>PTQ* |
| 640 | NM_0014<br>02.5_553 | 553 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCAGAAG<br>AGATATGAGGAAATTGTTAAGGAAGTCAGCACTTA<br>CATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG | 24 | RRDMRKLL<br>RKSALTLR<br>KLATTPTQ* |

TABLE 3A-continued

| SEQ ID | identifier_position | position | modified_RNA | PAP length | PAP |
|---|---|---|---|---|---|
| | | | GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 641 | NM_0014 02.5_573 | 573 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATGTTAAGGAAGTCAGCACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 18 | MLRKSALT LRKLATTP TQ* |
| 642 | NM_0014 02.5_588 | 588 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGACTTA CATTAAGAAAATTGGCTACAACCCCGACACAGTAG CATTTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 13 | RLTLRKLA TTPTQ* |
| 643 | NM_0014 02.5_606 | 606 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG | 7 | MATTPTQ* |

TABLE 3A-continued

| SEQ ID | identifier_position | position | modified_RNA | PAP length | PAP |
|---|---|---|---|---|---|
| | | | GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 644 | NM_0014<br>02.5_609 | 609 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 5 | TTPTQ* |
| 645 | NM_0014<br>02.5_618 | 618 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTAG<br>CATTTGTGCCAATTTCTGGTTGGAATGGTGACAAC<br>ATGCTGGAGCCAAGTGCTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG | 2 | TQ* |

… TABLE 3A-continued

| SEQ ID | identifier_position | position | modified_RNA | PAP length | PAP |
|---|---|---|---|---|---|
| | | | GGGACAATGTGGGCTTCAATGTCAAGAATGTGTCT GTCAAGGATGTTCG | | |
| 646 | NM_0014 02.5_633 | 633 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTGTGCCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 99 | LCQFLVGM VTTCWSQ VLTCLGSR DGKSPVR MAMPVEP RCLRLWTA SYHQLVQL TSPCACLS RMSTKLVV LVLFLLAE WRLVFSNP VWWSPLL QSTLQRK* |
| 647 | NM_0014 02.5_638 | 638 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCAATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 97 | QFLVGMVT TCWSQVLT CLGSRDG KSPVRMA MPVEPRCL RLWTASYH QLVQLTSP CACLSRMS TKLVVLVLF LLAEWRLV FSNPVWW SPLLQSTL QRK* |
| 648 | NM_0014 02.5_640 | 640 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC | 96 | FLVGMVTT CWSQVLT CLGSRDG KSPVRMA MPVEPRCL RLWTASYH QLVQLTSP CACLSRMS TKLVVLVLF LLAEWRLV FSNPVWW SPLLQSTL QRK* |

TABLE 3A-continued

| SEQ ID | identifier_position | position | modified_RNA | PAP length | PAP |
|---|---|---|---|---|---|
| | | | AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCATTTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 649 | NM_0014 02.5_643 | 643 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTCTGGTTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 95 | LVGMVTTC WSQVLTCL GSRDGKS PVRMAMP VEPRCLRL WTASYHQ LVQLTSPC ACLSRMST KLVVLVLFL LAEWRLVF SNPVWWS PLLQSTLQ RK* |
| 650 | NM_0014 02.5_649 | 649 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTCTGGTGGAATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 93 | GMVTTCW SQVLTCLG SRDGKSPV RMAMPVE PRCLRLWT ASYHQLVQ LTSPCACL SRMSTKLV VLVLFLLAE WRLVFSNP VWWSPLL QSTLQRK* |

| SEQ ID | identifier_position | position | modified_RNA | PAP length | PAP |
|---|---|---|---|---|---|
| 651 | NM_0014 02.5_653 | 653 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGATGGTGACAAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 92 | MVTTCWS QVLTCLGS RDGKSPV RMAMPVE PRCLRLWT ASYHQLVQ LTSPCACL SRMSTKLV VLVLFLLAE WRLVFSNP VWWSPLL QSTLQRK* |
| 652 | NM_0014 02.5_662 | 662 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAC ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 89 | TCWSQVLT CLGSRDG KSPVRMA MPVEPRCL RLWTASYH QLVQLTSP CACLSRMS TKLVVLVLF LLAEWRLV FSNPVWW SPLLQSTL QRK* |
| 653 | NM_0014 02.5_663 | 663 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT | 89 | KCWSQVL TCLGSRDG KSPVRMA MPVEPRCL RLWTASYH QLVQLTSP CACLSRMS TKLVVLVLF LLAEWRLV FSNPVWW SPLLQSTL QRK* |

TABLE 3A-continued

| SEQ ID | identifier_position | position | modified_RNA | PAP length | PAP |
|---|---|---|---|---|---|
| | | | ACATTAAGAAAATTGGCTACAACCCCGACACAGTA GCATTTGTGCCAATTTCTGGTTGGAATGGTGACAA ATGCTGGAGCCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 654 | NM_0014 02.5_674 | 674 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCAAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 85 | QVLTCLGS RDGKSPV RMAMPVE PRCLRLWT ASYHQLVQ LTSPCACL SRMSTKLV VLVLFLLAE WRLVFSNP VWWSPLL QSTLQRK* |
| 655 | NM_0014 02.5_676 | 676 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAGTGCTAACATGCCTTGGTTCAA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 84 | VLTCLGSR DGKSPVR MAMPVEP RCLRLWTA SYHQLVQL TSPCACLS RMSTKLVV LVLFLLAE WRLVFSNP VWWSPLL QSTLQRK* |
| 656 | NM_0014 02.5_680 | 680 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC | 83 | VTCLGSRD GKSPVRM AMPVEPR CLRLWTAS |

TABLE 3A-continued

| SEQ ID | identifier_position | position | modified_RNA | PAP length | PAP |
|---|---|---|---|---|---|
| | | | ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGTAACATGCCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | YHQLVQLT<br>SPCACLSR<br>MSTKLVVL<br>VLFLLAEW<br>RLVFSNPV<br>WWSPLLQ<br>STLQRK* |
| 657 | NM_0014<br>02.5_689 | 689 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCTTGGTTCAA<br>GGGATGGAAAGTCACCCGTAAGGATGGCAATGCC<br>AGTGGAACCACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 80 | LGSRDGKS<br>PVRMAMP<br>VEPRCLRL<br>WTASYHQ<br>LVQLTSPC<br>ACLSRMST<br>KLVVLVLFL<br>LAEWRLVF<br>SNPVWWS<br>PLLQSTLQ<br>RK* |
| 658 | NM_0014<br>02.5_691 | 691 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTGGTTCAA<br>GGGATGGAAAGTCACCCGTAAGGATGGCAATGCC | 79 | GSRDGKS<br>PVRMAMP<br>VEPRCLRL<br>WTASYHQ<br>LVQLTSPC<br>ACLSRMST<br>KLVVLVLFL<br>LAEWRLVF<br>SNPVWWS<br>PLLQSTLQ<br>RK* |

TABLE 3A-continued

| SEQ ID | identifier_ position | position | modified_RNA | PAP length | PAP |
|---|---|---|---|---|---|
| | | | AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 659 | NM_0014 02.5_698 | 698 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA GGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 77 | RDGKSPV RMAMPVE PRCLRLWT ASYHQLVQ LTSPCACL SRMSTKLV VLVLFLLAE WRLVFSNP VWWSPLL QSTLQRK* |
| 660 | NM_0014 02.5_701 | 701 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 76 | DGKSPVR MAMPVEP RCLRLWTA SYHQLVQL TSPCACLS RMSTKLVV LVLFLLAE WRLVFSNP VWWSPLL QSTLQRK* |
| 661 | NM_0014 02.5_708 | 708 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC | 73 | SPVRMAM PVEPRCLR LWTASYH QLVQLTSP CACLSRMS TKLVVLVLF LLAEWRLV FSNPVWW |

TABLE 3A-continued

| SEQ ID | identifier_position | position | modified_RNA | PAP length | PAP |
|---|---|---|---|---|---|
| | | | CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | SPLLQSTL QRK* |
| 662 | NM_0014 02.5_715 | 715 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 71 | VRMAMPV EPRCLRLW TASYHQLV QLTSPCAC LSRMSTKL VVLVLFLLA EWRLVFSN PVWWSPL LQSTLQRK* |
| 663 | NM_0014 02.5_719 | 719 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAGGATGGCAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG | 70 | RMAMPVE PRCLRLWT ASYHQLVQ LTSPCACL SRMSTKLV VLVLFLLAE WRLVFSNP VWWSPLL QSTLQRK* |

TABLE 3A-continued

| SEQ ID | identifier_position | position | modified_RNA | PAP length | PAP |
|---|---|---|---|---|---|
| | | | GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 664 | NM_0014 02.5_726 | 726 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGAATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 67 | MPVEPRCL RLWTASYH QLVQLTSP CACLSRMS TKLVVLVLF LLAEWRLV FSNPVWW SPLLQSTL QRK* |
| 665 | NM_0014 02.5_728 | 728 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCATGCC AGTGGAACCACGCTGCTTGAGGCTCTGGACTGCA TCCTACCACCAACTCGTCCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 67 | MPVEPRCL RLWTASYH QLVQLTSP CACLSRMS TKLVVLVLF LLAEWRLV FSNPVWW SPLLQSTL QRK* |
| 666 | NM_0014 02.5_741 | 741 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG | 62 | RCLRLWTA SYHQLVQL TSPCACLS RMSTKLVV LVLFLLAE WRLVFSNP VWWSPLL QSTLQRK* |

TABLE 3A-continued

| SEQ ID | identifier_position | position | modified_RNA | PAP length | PAP |
|---|---|---|---|---|---|
| | | | GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACACGCTGCTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 667 | NM_0014 02.5_748 | 748 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGTTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 59 | RLWTASYH QLVQLTSP CACLSRMS TKLVVLVLF LLAEWRLV FSNPVWW SPLLQSTL QRK* |
| 668 | NM_0014 02.5_750 | 750 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTGAGGCTCTGGACTGCA<br>TCCTACCACCAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG | 59 | RLWTASYH QLVQLTSP CACLSRMS TKLVVLVLF LLAEWRLV FSNPVWW SPLLQSTL QRK* |

TABLE 3A-continued

| SEQ ID | identifier_position | position | modified_RNA | PAP length | PAP |
|---|---|---|---|---|---|
| | | | GGGACAATGTGGGCTTCAATGTCAAGAATGTGTCTGTCAAGGATGTTCG | | |
| 669 | NM_0014 02.5_754 | 754 | CTTTTTCGCAACGGGTTTGCCGCCAGAACACAGGTGTCGTGAAAACTACCCCTAAAAGCCAAAATGGGAAAGGAAAAGACTCATATCAACATTGTCGTCATTGGACACGTAGATTCGGGCAAGTCCACCACTACTGGCCATCTGATCTATAAATGCGGTGGCATCGACAAAAGAACCATTGAAAAATTTGAGAAGGAGGCTGCTGAGATGGGAAAGGGCTCCTTCAAGTATGCCTGGGTCTTGGATAAACTGAAAGCTGAGCGTGAACGTGGTATCACCATTGATATCTCCTTGTGGAAATTTGAGACCAGCAAGTACTATGTGACTATCATTGATGCCCCAGGACACAGAGACTTTATCAAAAACATGATTACAGGGACATCTCAGGCTGACTGTGCTGTCCTGATTGTTGCTGCTGGTGTTGGTGAATTTGAAGCTGGTATCTCCAAGAATGGGCAGACCCGAGAGCATGCCCTTCTGGCTTACACACTGGGTGTGAAACAACTAATTGTCGGTGTTAACAAAATGGATTCCACTGAGCCACCCTACAGCCAGAAGAGATATGAGGAAATTGTTAAGGAAGTCAGCACTTACATTAAGAAAATTGGCTACAACCCCGACACAGTAGCATTTGTGCCAATTTCTGGTTGGAATGGTGACAACATGCTGGAGCCAAGTGCTAACATGCCTTGGTTCAAGGGATGGAAAGTCACCCGTAAGGATGGCAATGCCAGTGGAACCACGCTGCTTGAGCTCTGGACTGCATCCTACCACCAACTCGTCCAACTGACAAGCCCTTGCGCCTGCCTCTCCAGGATGTCTACAAAATTGGTGGTATTGGTACTGTTCCTGTTGGCCAGTGGAGACTGGTGTTCTCAAACCCGGTATGGTGGTCACCTTTGCTCCAGTCAACGTTACAACGGAAGTAAAATCTGTCGAAATGCACCATGAAGCTTTGAGTGAAGCTCTTCCTGGGGACAATGTGGGCTTCAATGTCAAGAATGTGTCTGTCAAGGATGTTCG | 58 | LWTASYHQLVQLTSPCACLSRMSTKLVVLVLFLLAEWRLVFSNPVWWSPLLQSTLQRK* |
| 670 | NM_0014 02.5_765 | 765 | CTTTTTCGCAACGGGTTTGCCGCCAGAACACAGGTGTCGTGAAAACTACCCCTAAAAGCCAAAATGGGAAAGGAAAAGACTCATATCAACATTGTCGTCATTGGACACGTAGATTCGGGCAAGTCCACCACTACTGGCCATCTGATCTATAAATGCGGTGGCATCGACAAAAGAACCATTGAAAAATTTGAGAAGGAGGCTGCTGAGATGGGAAAGGGCTCCTTCAAGTATGCCTGGGTCTTGGATAAACTGAAAGCTGAGCGTGAACGTGGTATCACCATTGATATCTCCTTGTGGAAATTTGAGACCAGCAAGTACTATGTGACTATCATTGATGCCCCAGGACACAGAGACTTTATCAAAAACATGATTACAGGGACATCTCAGGCTGACTGTGCTGTCCTGATTGTTGCTGCTGGTGTTGGTGAATTTGAAGCTGGTATCTCCAAGAATGGGCAGACCCGAGAGCATGCCCTTCTGGCTTACACACTGGGTGTGAAACAACTAATTGTCGGTGTTAACAAAATGGATTCCACTGAGCCACCCTACAGCCAGAAGAGATATGAGGAAATTGTTAAGGAAGTCAGCACTTACATTAAGAAAATTGGCTACAACCCCGACACAGTAGCATTTGTGCCAATTTCTGGTTGGAATGGTGACAACATGCTGGAGCCAAGTGCTAACATGCCTTGGTTCAAGGGATGGAAAGTCACCCGTAAGGATGGCAATGCCAGTGGAACCACGCTGCTTGAGGCTCTGGACTGATCCTACCACCAACTCGTCCAACTGACAAGCCCTTGCGCCTGCCTCTCCAGGATGTCTACAAAATTGGTGGTATTGGTACTGTTCCTGTTGGCCAGTGGAGACTGGTGTTCTCAAACCCGGTATGGTGGTCACCTTTGCTCCAGTCAACGTTACAACGGAAGTAAAATCTGTCGAAATGCACCATGAAGCTTTGAGTGAAGCTCTTCCTGGGGACAATGTGGGCTTCAATGTCAAGAATGTGTCTGTCAAGGATGTTCG | 0 | * |
| 671 | NM_0014 02.5_77 | 77 | CTTTTTCGCAACGGGTTTGCCGCCAGAACACAGGTGTCGTGAAAACTACCCCTAAAAGCCAAAATGGGAAAGGAAAAGACTCATATCAACATTGTCGTCATTGGACACGTAGATTCGGGCAAGTCCACCACTACTGGCCATCTGATCTATAAATGCGGTGGCATCGACAAAAGAACCATTGAAAAATTTGAGAAGGAGGCTGCTGAGATGGGAAAGGGCTCCTTCAAGTATGCCTGGGTCTTGGATAAACTGAAAGCTGAGCGTGAACGTGGTATCACCATTGATATCTCCTTGTGGAAATTTGAGACCAGCAAGTACTATGTGACTATCATTGATGCCCCAGGACACAGAGACTTTATCAAAAACATGATTACAGGGACATCTCAGGCTGACTGTGCTGTCCTGATTGTTGCTGCTGGTGTTGGTGAATTTGAAGCTGGTATCTCCAAGAATGGGCAGACCCGAGAGCATGCCCTTCTGGCTTACACACTGGGTGTGAAACAACTAATTGTCGGTGTTAACAAAA | 11 | RLISTLSSLDT* |

TABLE 3A-continued

| SEQ ID | identifier_position | position | modified_RNA | PAP length | PAP |
|---|---|---|---|---|---|
| | | | TGGATTCCACTGAGCCACCCTACAGCCAGAAGAG<br>ATATGAGGAAATTGTTAAGGAAGTCAGCACTTACA<br>TTAAGAAAATTGGCTACAACCCCGACACAGTAGCA<br>TTTGTGCCAATTTCTGGTTGGAATGGTGACAACAT<br>GCTGGAGCCAAGTGCTAACATGCCTTGGTTCAAG<br>GGATGGAAAGTCACCCGTAAGGATGGCAATGCCA<br>GTGGAACCACGCTGCTTGAGGCTCTGGACTGCAT<br>CCTACCACCAACTCGTCCAACTGACAAGCCCTTGC<br>GCCTGCCTCTCCAGGATGTCTACAAAATTGGTGGT<br>ATTGGTACTGTTCCTGTTGGCCGAGTGGAGACTGG<br>TGTTCTCAAACCCGGTATGGTGGTCACCTTTGCTC<br>CAGTCAACGTTACAACGGAAGTAAAATCTGTCGAA<br>ATGCACCATGAAGCTTTGAGTGAAGCTCTTCCTGG<br>GGACAATGTGGGCTTCAATGTCAAGAATGTGTCTG<br>TCAAGGATGTTCG | | |
| 672 | NM_0014<br>02.5_776 | 776 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACAACTCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGACAATGTGGGCTTCAATGTCAAGAATGTGTCT<br>GTCAAGGATGTTCG | 51 | QLVQLTSP<br>CACLSRMS<br>TKLVVLVLF<br>LLAEWRLV<br>FSNPVWW<br>SPLLQSTL<br>QRK* |
| 673 | NM_0014<br>02.5_779 | 779 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAATCGTCCAACTGACAAGCCCTTG<br>CGCCTGCCTCTCCAGGATGTCTACAAAATTGGTGG<br>TATTGGTACTGTTCCTGTTGGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGACAATGTGGGCTTCAATGTCAAGAATGTGTCT<br>GTCAAGGATGTTCG | 50 | IVQLTSPC<br>ACLSRMST<br>KLVVLVLFL<br>LAEWRLVF<br>SNPVWWS<br>PLLQSTLQ<br>RK* |

TABLE 3A-continued

| SEQ ID | identifier_ position | position | modified_RNA | PAP length | PAP |
|---|---|---|---|---|---|
| 674 | NM_0014 02.5_785 | 785 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCAACTGACAAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 48 | QLTSPCAC LSRMSTKL VVLVLFLLA EWRLVFSN PVWWSPL LQSTLQRK* |
| 675 | NM_0014 02.5_794 | 794 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAGCCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 45 | SPCACLSR MSTKLVVL VLFLLAEW RLVFSNPV WWSPLLQ STLQRK* |
| 676 | NM_0014 02.5_798 | 798 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT | 43 | CACLSRMS TKLVVLVLF LLAEWRLV FSNPVWW SPLLQSTL QRK* |

TABLE 3A-continued

| SEQ ID | identifier_position | position | modified_RNA | PAP length | PAP |
|---|---|---|---|---|---|
| | | | ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCTTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 677 | NM_0014 02.5_800 | 800 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTG CGCCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 43 | CACLSRMS TKLVVLVLF LLAEWRLV FSNPVWW SPLLQSTL QRK* |
| 678 | NM_0014 02.5_805 | 805 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCTGCCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 41 | CLSRMSTK LVVLVLFLL AEWRLVFS NPVWWSP LLQSTLQR K* |
| 679 | NM_0014 02.5_809 | 809 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC | 40 | LSRMSTKL VVLVLFLLA EWRLVFSN PVWWSPL |

TABLE 3A-continued

| SEQ ID | identifier_position | position | modified_RNA | PAP length | PAP |
|---|---|---|---|---|---|
| | | | ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | LQSTLQRK* |
| 680 | NM_0014 02.5_829 | 829 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCTCTCCAGGATGTCTACAAAATTGGTGG TATTGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 33 | LVVLVLFLL AEWRLVFS NPVWWSP LLQSTLQR K* |
| 681 | NM_0014 02.5_831 | 831 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC | 33 | MVVLVLFL LAEWRLVF SNPVWWS PLLQSTLQ RK* |

TABLE 3A-continued

| SEQ ID | identifier_position | position | modified_RNA | PAP length | PAP |
|---|---|---|---|---|---|
| | | | CAGTGGAACCACGCTGCTTGAGGCTCTGGACTGC ATCCTACCACCAACTCGTCCAACTGACAAGCCCTT GCGCCTGCCTCTCCAGGATGTCTACAAAATGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCAATGTCAAGAATGTGTC TGTCAAGGATGTTCG | | |
| 682 | NM_0014 02.5_840 | 840 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATGGTACTGTTCCTGTTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 30 | MVLFLLAE WRLVFSNP VWWSPLL QSTLQRK* |
| 683 | NM_0014 02.5_855 | 855 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTGGCCGAGTGGAGACTG GTGTTCTCAAACCCGGTATGGTGGTCACCTTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 24 | AEWRLVFS NPVWWSP LLQSTLQR K* |
| 684 | NM_0014 02.5_857 | 857 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC | 24 | AEWRLVFS NPVWWSP LLQSTLQR K* |

TABLE 3A-continued

| SEQ ID | identifier_position | position | modified_RNA | PAP length | PAP |
|---|---|---|---|---|---|
| | | | CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGCCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | | |
| 685 | NM_0014<br>02.5_859 | 859 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCGAGTGGAGACTG<br>GTGTTCTCAAACCCGGTATGGTGGTCACCTTTGCT<br>CCAGTCAACGTTACAACGGAAGTAAAATCTGTCGA<br>AATGCACCATGAAGCTTTGAGTGAAGCTCTTCCTG<br>GGGACAATGTGGGCTTCAATGTCAAGAATGTGTCT<br>GTCAAGGATGTTCG | 23 | EWRLVFSN<br>PVWWSPL<br>LQSTLQRK* |
| 686 | NM_0014<br>02.5_903 | 903 | CTTTTTCGCAACGGGTTTGCCGCCAGAACACAGGT<br>GTCGTGAAAACTACCCCTAAAAGCCAAAATGGGAA<br>AGGAAAAGACTCATATCAACATTGTCGTCATTGGA<br>CACGTAGATTCGGGCAAGTCCACCACTACTGGCC<br>ATCTGATCTATAAATGCGGTGGCATCGACAAAAGA<br>ACCATTGAAAAATTTGAGAAGGAGGCTGCTGAGAT<br>GGGAAAGGGCTCCTTCAAGTATGCCTGGGTCTTG<br>GATAAACTGAAAGCTGAGCGTGAACGTGGTATCAC<br>CATTGATATCTCCTTGTGGAAATTTGAGACCAGCA<br>AGTACTATGTGACTATCATTGATGCCCCAGGACAC<br>AGAGACTTTATCAAAAACATGATTACAGGGACATC<br>TCAGGCTGACTGTGCTGTCCTGATTGTTGCTGCTG<br>GTGTTGGTGAATTTGAAGCTGGTATCTCCAAGAAT<br>GGGCAGACCCGAGAGCATGCCCTTCTGGCTTACA<br>CACTGGGTGTGAAACAACTAATTGTCGGTGTTAAC<br>AAAATGGATTCCACTGAGCCACCCTACAGCCAGAA<br>GAGATATGAGGAAATTGTTAAGGAAGTCAGCACTT<br>ACATTAAGAAAATTGGCTACAACCCCGACACAGTA<br>GCATTTGTGCCAATTTCTGGTTGGAATGGTGACAA<br>CATGCTGGAGCCAAGTGCTAACATGCCTTGGTTCA<br>AGGGATGGAAAGTCACCCGTAAGGATGGCAATGC<br>CAGTGGAACCACGCTGCTTGAGGCTCTGGACTGC<br>ATCCTACCACCAACTCGTCCAACTGACAAGCCCTT<br>GCGCCTGCCTCTCCAGGATGTCTACAAAATTGGTG<br>GTATTGGTACTGTTCCTGTTGGCCGAGTGGAGACT | 9 | LLQSTLQR<br>K* |

TABLE 3A-continued

| SEQ ID | identifier_position | position | modified_RNA | PAP length | PAP |
|---|---|---|---|---|---|
| | | | GGTGTTCTCAAACCCGGTATGGTGGTCACCTTGCT CCAGTCAACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 687 | NM_0014 02.5_914 | 914 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCACGTTACAACGGAAGTAAAATCTGTCGA AATGCACCATGAAGCTTTGAGTGAAGCTCTTCCTG GGGACAATGTGGGCTTCAATGTCAAGAATGTGTCT GTCAAGGATGTTCG | 5 | TLQRK* |
| 688 | NM_0014 02.5_93 | 93 | CTTTTTCGCAACGGGTTTGCCGCCAGAACACAGGT GTCGTGAAAACTACCCCTAAAAGCCAAAATGGGAA AGGAAAAGACTCATATCAACATGTCGTCATTGGAC ACGTAGATTCGGGCAAGTCCACCACTACTGGCCAT CTGATCTATAAATGCGGTGGCATCGACAAAAGAAC CATTGAAAAATTTGAGAAGGAGGCTGCTGAGATGG GAAAGGGCTCCTTCAAGTATGCCTGGGTCTTGGAT AAACTGAAAGCTGAGCGTGAACGTGGTATCACCAT TGATATCTCCTTGTGGAAATTTGAGACCAGCAAGT ACTATGTGACTATCATTGATGCCCCAGGACACAGA GACTTTATCAAAAACATGATTACAGGGACATCTCA GGCTGACTGTGCTGTCCTGATTGTTGCTGCTGGTG TTGGTGAATTTGAAGCTGGTATCTCCAAGAATGGG CAGACCCGAGAGCATGCCCTTCTGGCTTACACACT GGGTGTGAAACAACTAATTGTCGGTGTTAACAAAA TGGATTCCACTGAGCCACCCTACAGCCAGAAGAG ATATGAGGAAATTGTTAAGGAAGTCAGCACTTACA TTAAGAAAATTGGCTACAACCCCGACACAGTAGCA TTTGTGCCAATTTCTGGTTGGAATGGTGACAACAT GCTGGAGCCAAGTGCTAACATGCCTTGGTTCAAG GGATGGAAAGTCACCCGTAAGGATGGCAATGCCA GTGGAACCACGCTGCTTGAGGCTCTGGACTGCAT CCTACCACCAACTCGTCCAACTGACAAGCCCTTGC GCCTGCCTCTCCAGGATGTCTACAAAATTGGTGGT ATTGGTACTGTTCCTGTTGGCCGAGTGGAGACTGG TGTTCTCAAACCCGGTATGGTGGTCACCTTTGCTC CAGTCAACGTTACAACGGAAGTAAAATCTGTCGAA ATGCACCATGAAGCTTTGAGTGAAGCTCTTCCTGG GGACAATGTGGGCTTCAATGTCAAGAATGTGTCTG TCAAGGATGTTCG | 6 | MSSLDT* |
| 689 | NM_0014 02.5_933 | 933 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG | 9 | NLSKCTMK L* |

TABLE 3A-continued

| SEQ ID | identifier_position | position | modified_RNA | PAP length | PAP |
|---|---|---|---|---|---|
| | | | GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAATCTGTCGA AATGCACCATGAAGCTTTGAGTGAAGCTCTTCCTG GGGACAATGTGGGCTTCAATGTCAAGAATGTGTCT GTCAAGGATGTTCG | | |
| 690 | NM_0014 02.5_959 | 959 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAATCTGTCG AAATGCACCATGAAGCTTGAGTGAAGCTCTTCCTG GGGACAATGTGGGCTTCAATGTCAAGAATGTGTCT GTCAAGGATGTTCG | 0 | * |
| 691 | NM_0014 02.5_979 | 979 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAATCTGTCG AAATGCACCATGAAGCTTTGAGTGAAGCTCTTCCT | 38 | TMWASMS RMCLSRM FVVATLLV TAKMTHQ WKQLASLL R* |

TABLE 3A-continued

| SEQ ID | identifier_ position | position | modified_RNA | PAP length | PAP |
|---|---|---|---|---|---|
| | | | GGGACAATGTGGGCTTCAATGTCAAGAATGTGTCT GTCAAGGATGTTCG | | |
| 692 | NM_0014 02.5_983 | 983 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACATGTGGGCTTCAATGTCAAGAATGTGTCT GTCAAGGATGTTCG | 37 | MWASMSR MCLSRMF VVATLLVT AKMTHQW KQLASLLR* |
| 693 | NM_0014 02.5_995 | 995 | CTTTTTCGCAACGGGTTTGCCGCCAGAACACAGGT GTCGTGAAAACTACCCCTAAAAGCCAAAATGGGAA AGGAAAAGACTCATATCAACATTGTCGTCATTGGA CACGTAGATTCGGGCAAGTCCACCACTACTGGCC ATCTGATCTATAAATGCGGTGGCATCGACAAAAGA ACCATTGAAAAATTTGAGAAGGAGGCTGCTGAGAT GGGAAAGGGCTCCTTCAAGTATGCCTGGGTCTTG GATAAACTGAAAGCTGAGCGTGAACGTGGTATCAC CATTGATATCTCCTTGTGGAAATTTGAGACCAGCA AGTACTATGTGACTATCATTGATGCCCCAGGACAC AGAGACTTTATCAAAAACATGATTACAGGGACATC TCAGGCTGACTGTGCTGTCCTGATTGTTGCTGCTG GTGTTGGTGAATTTGAAGCTGGTATCTCCAAGAAT GGGCAGACCCGAGAGCATGCCCTTCTGGCTTACA CACTGGGTGTGAAACAACTAATTGTCGGTGTTAAC AAAATGGATTCCACTGAGCCACCCTACAGCCAGAA GAGATATGAGGAAATTGTTAAGGAAGTCAGCACTT ACATTAAGAAAATTGGCTACAACCCCGACACAGTA GCATTTGTGCCAATTTCTGGTTGGAATGGTGACAA CATGCTGGAGCCAAGTGCTAACATGCCTTGGTTCA AGGGATGGAAAGTCACCCGTAAGGATGGCAATGC CAGTGGAACCACGCTGCTTGAGGCTCTGGACTGC ATCCTACCACCAACTCGTCCAACTGACAAGCCCTT GCGCCTGCCTCTCCAGGATGTCTACAAAATTGGTG GTATTGGTACTGTTCCTGTTGGCCGAGTGGAGACT GGTGTTCTCAAACCCGGTATGGTGGTCACCTTTGC TCCAGTCAACGTTACAACGGAAGTAAAATCTGTCG AAATGCACCATGAAGCTTTGAGTGAAGCTCTTCCT GGGGACAATGTGGGCTTCATGTCAAGAATGTGTCT GTCAAGGATGTTCG | 33 | MSRMCLS RMFVVATL LVTAKMTH QWKQLAS LLR* |
| 694 | NM_0014 04.4_110 0 | 1100 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA | 18 | GPCGTQSI ASLKNSLR PS* |

TABLE 3A-continued

| SEQ ID | identifier_position | position | modified_RNA | PAP length | PAP |
|---|---|---|---|---|---|
| | | | CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT TGATGCTAAAAAGTTTGCAGAGACCCAACCTAAAA AGGACACACCACGGAAAGAGAAGGGTTCACGGGA AGAGAAGCAGAAGCCCCAGGCTGAGCGGAAGGA GGAGAAAAAGGCGGCTGCCCCTGCTCCTGAGGAG GAGATGGATGAATGTGAGCAGGCGCTGGCTGCTG AGCCCAAGGCCAAGGACCCCTTCGCTCACCTGCC CAAGAGTACCTTTGTGTTGGATGAATT | | |
| 695 | NM_0014 04.4_123 5 | 1235 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT TGATGCTAAAAAGTTTGCAGAGACCCAACCTAAAA AGGACACACCACGGAAAGAGAAGGGTTCACGGGA AGAGAAGCAGAAGCCCCAGGCTGAGCGGAAGGA GGAGAAAAAGGCGGCTGCCCCTGCTCCTGAGGAG GAGATGGATGAATGTGAGCAGGCGCTGGCTGCTG AGCCCAAGGCCAAGGACCCCTTCGCTCACCTGCC CAAGAGTACCTTTGTGTTGGATGAATT | 23 | LEPTIAAPF LESGSSEA RSLPFR* |
| 696 | NM_0014 04.4_131 4 | 1314 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT TGATGCTAAAAAGTTTGCAGAGACCCAACCTAAAA AGGACACACCACGGAAAGAGAAGGGTTCACGGGA AGAGAAGCAGAAGCCCCAGGCTGAGCGGAAGGA GGAGAAAAAGGCGGCTGCCCCTGCTCCTGAGGAG GAGATGGATGAATGTGAGCAGGCGCTGGCTGCTG AGCCCAAGGCCAAGGACCCCTTCGCTCACCTGCC CAAGAGTACCTTTGTGTTGGATGAATT | 71 | GRWTTSH THGGNWIL AARRPRR WFESTFPG RGPSSMW AKPSIRAR SSSEHLLP SPSCLHLP FREMGVIK GN* |

TABLE 3A-continued

| SEQ ID | identifier_ position | position | modified_RNA | PAP length | PAP |
|---|---|---|---|---|---|
| 697 | NM_0014 04.4_247 | 247 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGACCACCCCACTTCCATTTTGGCCAAACCAA CCGCACCCCTGAATTTCTCCGCAAATTTCCTGCCG GCAAGGTCCCAGCATTTGAGGGTGATGATGGATT CTGTGTGTTTGAGAGCAACGCCATTGCCTACTATG TGAGCAATGAGGAGCTGCGGGGAAGTACTCCAGA GGCAGCAGCCCAGGTGGTGCAGTGGGTGAGCTTT GCTGATTCCGATATAGTGCCCCCAGCCAGTACCTG GGTGTTCCCCACCTTGGGCATCATGCACCACAACA AACAGGCCACTGAGAATGCAAAGGAGGAAGTGAG GCGAATTCTGGGGCTGCTGGATGCTTACTTGAAGA CGAGGACTTTTCTGGTGGGCGAACGAGTGACATT GGCTGACATCACAGTTGTCTGCACCCTGTTGTGGC TCTATAAGCAGGTTCTAGAGCCTTCTTTCCGCCAG GCCTTTCCCAATACCAACCGCTGGTTCCTCACCTG CATTAACCAGCCCCAGTTCCGGGCTGTCTTGGGC GAAGTGAAACTGTGTGAGAAGATGGCCCAGTTTGA TGCTAAAAAGTTTGCAGAGACCCAACCTAAAAAGG ACACACCACGGAAAGAGAAGGGTTCACGGGAAGA GAAGCAGAAGCCCCAGGCTGAGCGGAAGGAGGA GAAAAAGGCGGCTGCCCCTGCTCCTGAGGAGGAG ATGGATGAATGTGAGCAGGCGCTGGCTGCTGAGC CCAAGGCCAAGGACCCCTTCGCTCACCTGCCCAA GAGTACCTTTGTGTTGGATGAATTT | 45 | DHPTSILAK PTAPLNFS ANFLPARS QHLRVMM DSVCLRAT PLPTM* |
| 698 | NM_0014 04.4_250 | 250 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACACCCCACTTCCATTTTGGCCAAACCAA CCGCACCCCTGAATTTCTCCGCAAATTTCCTGCCG GCAAGGTCCCAGCATTTGAGGGTGATGATGGATT CTGTGTGTTTGAGAGCAACGCCATTGCCTACTATG TGAGCAATGAGGAGCTGCGGGGAAGTACTCCAGA GGCAGCAGCCCAGGTGGTGCAGTGGGTGAGCTTT GCTGATTCCGATATAGTGCCCCCAGCCAGTACCTG GGTGTTCCCCACCTTGGGCATCATGCACCACAACA AACAGGCCACTGAGAATGCAAAGGAGGAAGTGAG GCGAATTCTGGGGCTGCTGGATGCTTACTTGAAGA CGAGGACTTTTCTGGTGGGCGAACGAGTGACATT GGCTGACATCACAGTTGTCTGCACCCTGTTGTGGC TCTATAAGCAGGTTCTAGAGCCTTCTTTCCGCCAG GCCTTTCCCAATACCAACCGCTGGTTCCTCACCTG CATTAACCAGCCCCAGTTCCGGGCTGTCTTGGGC GAAGTGAAACTGTGTGAGAAGATGGCCCAGTTTGA TGCTAAAAAGTTTGCAGAGACCCAACCTAAAAAGG ACACACCACGGAAAGAGAAGGGTTCACGGGAAGA GAAGCAGAAGCCCCAGGCTGAGCGGAAGGAGGA GAAAAAGGCGGCTGCCCCTGCTCCTGAGGAGGAG ATGGATGAATGTGAGCAGGCGCTGGCTGCTGAGC CCAAGGCCAAGGACCCCTTCGCTCACCTGCCCAA GAGTACCTTTGTGTTGGATGAATTT | 44 | HPTSILAKP TAPLNFSA NFLPARSQ HLRVMMD SVCLRATP LPTM* |
| 699 | NM_0014 04.4_255 | 255 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCACTTCCATTTTGGCCAAACCAA CCGCACCCCTGAATTTCTCCGCAAATTTCCTGCCG GCAAGGTCCCAGCATTTGAGGGTGATGATGGATT CTGTGTGTTTGAGAGCAACGCCATTGCCTACTATG TGAGCAATGAGGAGCTGCGGGGAAGTACTCCAGA GGCAGCAGCCCAGGTGGTGCAGTGGGTGAGCTTT GCTGATTCCGATATAGTGCCCCCAGCCAGTACCTG GGTGTTCCCCACCTTGGGCATCATGCACCACAACA AACAGGCCACTGAGAATGCAAAGGAGGAAGTGAG GCGAATTCTGGGGCTGCTGGATGCTTACTTGAAGA | 42 | TSILAKPTA PLNFSANF LPARSQHL RVMMDSV CLRATPLP TM* |

TABLE 3A-continued

| SEQ ID | identifier_position | position | modified_RNA | PAP length | PAP |
|---|---|---|---|---|---|
| | | | CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG<br>CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | | |
| 700 | NM_0014<br>04.4_266 | 266 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTGGCCAAACCAA<br>CCGCACCCCTGAATTTCTCCGCAAATTTCCTGCCG<br>GCAAGGTCCCAGCATTTGAGGGTGATGATGGATT<br>CTGTGTGTTTGAGAGCAACGCCATTGCCTACTATG<br>TGAGCAATGAGGAGCTGCGGGGAAGTACTCCAGA<br>GGCAGCAGCCCAGGTGGTGCAGTGGGTGAGCTTT<br>GCTGATTCCGATATAGTGCCCCCAGCCAGTACCTG<br>GGTGTTCCCCACCTTGGGCATCATGCACCACAACA<br>AACAGGCCACTGAGAATGCAAAGGAGGAAGTGAG<br>GCGAATTCTGGGGCTGCTGGATGCTTACTTGAAGA<br>CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG<br>CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | 39 | LAKPTAPL<br>NFSANFLP<br>ARSQHLRV<br>MMDSVCL<br>RATPLPTM* |
| 701 | NM_0014<br>04.4_329 | 329 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTGAGGGTGATGATGGATT<br>CTGTGTGTTTGAGAGCAACGCCATTGCCTACTATG<br>TGAGCAATGAGGAGCTGCGGGGAAGTACTCCAGA<br>GGCAGCAGCCCAGGTGGTGCAGTGGGTGAGCTTT<br>GCTGATTCCGATATAGTGCCCCCAGCCAGTACCTG<br>GGTGTTCCCCACCTTGGGCATCATGCACCACAACA<br>AACAGGCCACTGAGAATGCAAAGGAGGAAGTGAG<br>GCGAATTCTGGGGCTGCTGGATGCTTACTTGAAGA<br>CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG<br>CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | 18 | LRVMMDS<br>VCLRATPL<br>PTM* |
| 702 | NM_0014<br>04.4_356 | 356 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG | 9 | LRATPLPT<br>M* |

TABLE 3A-continued

| SEQ ID | identifier_position | position | modified_RNA | PAP length | PAP |
|---|---|---|---|---|---|
| | | | AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTGAGAGCAACGCCATTGCCTACTATG<br>TGAGCAATGAGGAGCTGCGGGGAAGTACTCCAGA<br>GGCAGCAGCCCAGGTGGTGCAGTGGGTGAGCTTT<br>GCTGATTCCGATATAGTGCCCCCAGCCAGTACCTG<br>GGTGTTCCCCACCTTGGGCATCATGCACCACAACA<br>AACAGGCCACTGAGAATGCAAAGGAGGAAGTGAG<br>GCGAATTCTGGGGCTGCTGGATGCTTACTTGAAGA<br>CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG<br>CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | | |
| 703 | NM_0014<br>04.4_371 | 371 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATGCCTACTATG<br>TGAGCAATGAGGAGCTGCGGGGAAGTACTCCAGA<br>GGCAGCAGCCCAGGTGGTGCAGTGGGTGAGCTTT<br>GCTGATTCCGATATAGTGCCCCCAGCCAGTACCTG<br>GGTGTTCCCCACCTTGGGCATCATGCACCACAACA<br>AACAGGCCACTGAGAATGCAAAGGAGGAAGTGAG<br>GCGAATTCTGGGGCTGCTGGATGCTTACTTGAAGA<br>CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG<br>CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | 4 | MPTM* |
| 704 | NM_0014<br>04.4_449 | 449 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>GCTGATTCCGATATAGTGCCCCCAGCCAGTACCTG<br>GGTGTTCCCCACCTTGGGCATCATGCACCACAACA<br>AACAGGCCACTGAGAATGCAAAGGAGGAAGTGAG<br>GCGAATTCTGGGGCTGCTGGATGCTTACTTGAAGA<br>CGAGGACTTTTCTGGTGGGCGAACGAGTGACATT<br>GGCTGACATCACAGTTGTCTGCACCCTGTTGTGGC<br>TCTATAAGCAGGTTCTAGAGCCTTCTTTCCGCCAG<br>GCCTTTCCCAATACCAACCGCTGGTTCCTCACCTG | 5 | LLIPI* |

TABLE 3A-continued

| SEQ ID | identifier_position | position | modified_RNA | PAP length | PAP |
|---|---|---|---|---|---|
| | | | CATTAACCAGCCCCAGTTCCGGGCTGTCTTGGGC<br>GAAGTGAAACTGTGTGAGAAGATGGCCCAGTTTGA<br>TGCTAAAAAGTTTGCAGAGACCCAACCTAAAAAGG<br>ACACACCACGGAAAGAGAAGGGTTCACGGGAAGA<br>GAAGCAGAAGCCCCAGGCTGAGCGGAAGGAGGA<br>GAAAAAGGCGGCTGCCCCTGCTCCTGAGGAGGAG<br>ATGGATGAATGTGAGCAGGCGCTGGCTGCTGAGC<br>CCAAGGCCAAGGACCCCTTCGCTCACCTGCCCAA<br>GAGTACCTTTGTGTTGGATGAATTT | | |
| 705 | NM_0014<br>04.4_515 | 515 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCAAAC<br>AAACAGGCCACTGAGAATGCAAAGGAGGAAGTGA<br>GGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGCTGGTTCCTCACC<br>TGCATTAACCAGCCCCAGTTCCGGGCTGTCTTGG<br>GCGAAGTGAAACTGTGTGAGAAGATGGCCCAGTT<br>TGATGCTAAAAAGTTTGCAGAGACCCAACCTAAAA<br>AGGACACACCACGGAAAGAGAAGGGTTCACGGGA<br>AGAGAAGCAGAAGCCCCAGGCTGAGCGGAAGGA<br>GGAGAAAAAGGCGGCTGCCCCTGCTCCTGAGGAG<br>GAGATGGATGAATGTGAGCAGGCGCTGGCTGCTG<br>AGCCCAAGGCCAAGGACCCCTTCGCTCACCTGCC<br>CAAGAGTACCTTTGTGTTGGATGAATTT | 12 | QTNRPLR<br>MQRRK* |
| 706 | NM_0014<br>04.4_518 | 518 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>AAACAGGCCACTGAGAATGCAAAGGAGGAAGTGA<br>GGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGCTGGTTCCTCACC<br>TGCATTAACCAGCCCCAGTTCCGGGCTGTCTTGG<br>GCGAAGTGAAACTGTGTGAGAAGATGGCCCAGTT<br>TGATGCTAAAAAGTTTGCAGAGACCCAACCTAAAA<br>AGGACACACCACGGAAAGAGAAGGGTTCACGGGA<br>AGAGAAGCAGAAGCCCCAGGCTGAGCGGAAGGA<br>GGAGAAAAAGGCGGCTGCCCCTGCTCCTGAGGAG<br>GAGATGGATGAATGTGAGCAGGCGCTGGCTGCTG<br>AGCCCAAGGCCAAGGACCCCTTCGCTCACCTGCC<br>CAAGAGTACCTTTGTGTTGGATGAATTT | 11 | KNRPLRM<br>QRRK* |
| 707 | NM_0014<br>04.4_599 | 599 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA | 5 | WWANE* |

TABLE 3A-continued

| SEQ ID | identifier_position | position | modified_RNA | PAP length | PAP |
|---|---|---|---|---|---|
| | | | ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTCTGGTGGGCGAACGAGTGACAT TGGCTGACATCACAGTTGTCTGCACCCTGTTGTGG CTCTATAAGCAGGTTCTAGAGCCTTCTTTCCGCCA GGCCTTTCCCAATACCAACCGCTGGTTCCTCACCT GCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | | |
| 708 | NM_0014 04.4_622 | 622 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TGGCTGACATCACAGTTGTCTGCACCCTGTTGTGG CTCTATAAGCAGGTTCTAGAGCCTTCTTTCCGCCA GGCCTTTCCCAATACCAACCGCTGGTTCCTCACCT GCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 17 | WLTSQLSA PCCGSISR F* |
| 709 | NM_0014 04.4_625 | 625 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGTGACATCACAGTTGTCTGCACCCTGTTGTGG CTCTATAAGCAGGTTCTAGAGCCTTCTTTCCGCCA GGCCTTTCCCAATACCAACCGCTGGTTCCTCACCT GCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA | 16 | VTSQLSAP CCGSISRF* |

TABLE 3A-continued

| SEQ ID | identifier_ position | position | modified_RNA | PAP length | PAP |
|---|---|---|---|---|---|
| | | | GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | | |
| 710 | NM_0014 04.4_638 | 638 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTGG CTCTATAAGCAGGTTCTAGAGCCTTCTTTCCGCCA GGCCTTTCCCAATACCAACCGCTGGTTCCTCACCT GCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 11 | SAPCCGSI SRF* |
| 711 | NM_0014 04.4_652 | 652 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTGTGG CTCTATAAGCAGGTTCTAGAGCCTTCTTTCCGCCA GGCCTTTCCCAATACCAACCGCTGGTTCCTCACCT GCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 7 | CGSISRF* |
| 712 | NM_0014 04.4_690 | 690 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG | 25 | RPFPIPTA GSSPALTS PSSGLSW AK* |

TABLE 3A-continued

| SEQ ID | identifier_ position | position | modified_RNA | PAP length | PAP |
|---|---|---|---|---|---|
| | | | AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCA<br>GGCCTTTCCCAATACCAACCGCTGGTTCCTCACCT<br>GCATTAACCAGCCCCAGTTCCGGGCTGTCTTGGG<br>CGAAGTGAAACTGTGTGAGAAGATGGCCCAGTTT<br>GATGCTAAAAAGTTTGCAGAGACCCAACCTAAAAA<br>GGACACACCACGGAAAGAGAAGGGTTCACGGGAA<br>GAGAAGCAGAAGCCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA<br>GCCCAAGGCCAAGGACCCCTTCGCTCACCTGCCC<br>AAGAGTACCTTTGTGTTGGATGAATTT | | |
| 713 | NM_0014 04.4_695 | 695 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCTTTCCCAATACCAACCGCTGGTTCCTCACCT<br>GCATTAACCAGCCCCAGTTCCGGGCTGTCTTGGG<br>CGAAGTGAAACTGTGTGAGAAGATGGCCCAGTTT<br>GATGCTAAAAAGTTTGCAGAGACCCAACCTAAAAA<br>GGACACACCACGGAAAGAGAAGGGTTCACGGGAA<br>GAGAAGCAGAAGCCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA<br>GCCCAAGGCCAAGGACCCCTTCGCTCACCTGCCC<br>AAGAGTACCTTTGTGTTGGATGAATTT | 21 | IPTAGSSP ALTSPSSG LSWAK* |
| 714 | NM_0014 04.4_711 | 711 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGCTGGTTCCTCACCT<br>GCATTAACCAGCCCCAGTTCCGGGCTGTCTTGGG<br>CGAAGTGAAACTGTGTGAGAAGATGGCCCAGTTT<br>GATGCTAAAAAGTTTGCAGAGACCCAACCTAAAAA<br>GGACACACCACGGAAAGAGAAGGGTTCACGGGAA<br>GAGAAGCAGAAGCCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA | 18 | AGSSPALT SPSSGLS WAK* |

TABLE 3A-continued

| SEQ ID | identifier_position | position | modified_RNA | PAP length | PAP |
|---|---|---|---|---|---|
| 715 | NM_0014 04.4_713 | 713 | GCCCAAGGCCAAGGACCCCTTCGCTCACCTGCCC<br>AAGAGTACCTTTGTGTTGGATGAATTT<br>AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGTGGTTCCTCACCT<br>GCATTAACCAGCCCCAGTTCCGGGCTGTCTTGGG<br>CGAAGTGAAACTGTGTGAGAAGATGGCCCAGTTT<br>GATGCTAAAAAGTTTGCAGAGACCCAACCTAAAAA<br>GGACACACCACGGAAAGAGAAGGGTTCACGGGAA<br>GAGAAGCAGAAGCCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA<br>GCCCAAGGCCAAGGACCCCTTCGCTCACCTGCCC<br>AAGAGTACCTTTGTGTTGGATGAATTT | 17 | GSSPALTS PSSGLSW AK* |
| 716 | NM_0014 04.4_716 | 716 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGCTGTTCCTCACCT<br>GCATTAACCAGCCCCAGTTCCGGGCTGTCTTGGG<br>CGAAGTGAAACTGTGTGAGAAGATGGCCCAGTTT<br>GATGCTAAAAAGTTTGCAGAGACCCAACCTAAAAA<br>GGACACACCACGGAAAGAGAAGGGTTCACGGGAA<br>GAGAAGCAGAAGCCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA<br>GCCCAAGGCCAAGGACCCCTTCGCTCACCTGCCC<br>AAGAGTACCTTTGTGTTGGATGAATTT | 17 | CSSPALTS PSSGLSW AK* |
| 717 | NM_0014 04.4_728 | 728 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA | 0 | * |

TABLE 3A-continued

| SEQ ID | identifier_position | position | modified_RNA | PAP length | PAP |
|---|---|---|---|---|---|
| | | | CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | | |
| 718 | NM_0014 04.4_741 | 741 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 8 | SSGLSWA K* |
| 719 | NM_0014 04.4_757 | 757 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTGGG CGAAGTGAAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 3 | WAK* |

TABLE 3A-continued

| SEQ ID | identifier_ position | position | modified_RNA | PAP length | PAP |
|---|---|---|---|---|---|
| 720 | NM_0014 04.4_770 | 770 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 129 | NCVRRWP SLMLKSLQ RPNLKRTH HGKRRVH GKRSRSP RLSGRRRK RRLPLLLR RRWMNVS RRWLLSPR PRTPSLTC PRVPLCW MNLSASTP MRTHSLW HCHISGST LIRTAGPC GTQSIASL KNSLRPS* |
| 721 | NM_0014 04.4_789 | 789 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAACTGTGTGAGAAGATGGCCCAGTTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 122 | SLMLKSLQ RPNLKRTH HGKRRVH GKRSRSP RLSGRRRK RRLPLLLR RRWMNVS RRWLLSPR PRTPSLTC PRVPLCW MNLSASTP MRTHSLW HCHISGST LIRTAGPC GTQSIASL KNSLRPS* |
| 722 | NM_0014 04.4_794 | 794 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA | 121 | LMLKSLQR PNLKRTHH GKRRVHG KRSRSPRL SGRRRKR RLPLLLRR RWMNVSR RWLLSPRP RTPSLTCP RVPLCWM NLSASTPM RTHSLWH CHISGSTLI RTAGPCGT QSIASLKN SLRPS* |

TABLE 3A-continued

| SEQ ID | identifier_ position | position | modified_RNA | PAP length | PAP |
|---|---|---|---|---|---|
| | | | GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT GATGCTAAAAAGTTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | | |
| 723 | NM_0014 04.4_809 | 809 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT TGATGCTAAAAAGTTGCAGAGACCCAACCTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 116 | LQRPNLKR THHGKRR VHGKRSR SPRLSGRR RKRRLPLL LRRRWMN VSRRWLLS PRPRTPSL TCPRVPLC WMNLSAS TPMRTHSL WHCHISGS TLIRTAGP CGTQSIAS LKNSLRPS* |
| 724 | NM_0014 04.4_823 | 823 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG AATCACCATGGCGGCTGGGACCCTGTACACGTAT CCTGAAAACTGGAGGGCCTTCAAGGCTCTCATCG CTGCTCAGTACAGCGGGGCTCAGGTCCGCGTGCT CTCCGCACCACCCCACTTCCATTTTGGCCAAACCA ACCGCACCCCTGAATTTCTCCGCAAATTTCCTGCC GGCAAGGTCCCAGCATTTGAGGGTGATGATGGAT TCTGTGTGTTTGAGAGCAACGCCATTGCCTACTAT GTGAGCAATGAGGAGCTGCGGGGAAGTACTCCAG AGGCAGCAGCCCAGGTGGTGCAGTGGGTGAGCTT TGCTGATTCCGATATAGTGCCCCCAGCCAGTACCT GGGTGTTCCCCACCTTGGGCATCATGCACCACAA CAAACAGGCCACTGAGAATGCAAAGGAGGAAGTG AGGCGAATTCTGGGGCTGCTGGATGCTTACTTGAA GACGAGGACTTTTCTGGTGGGCGAACGAGTGACA TTGGCTGACATCACAGTTGTCTGCACCCTGTTGTG GCTCTATAAGCAGGTTCTAGAGCCTTCTTTCCGCC AGGCCTTTCCCAATACCAACCGCTGGTTCCTCACC TGCATTAACCAGCCCCAGTTCCGGGCTGTCTTGG GCGAAGTGAAACTGTGTGAGAAGATGGCCCAGTT TGATGCTAAAAAGTTTGCAGAGACCCAACTAAAAA GGACACACCACGGAAAGAGAAGGGTTCACGGGAA GAGAAGCAGAAGCCCCAGGCTGAGCGGAAGGAG GAGAAAAAGGCGGCTGCCCCTGCTCCTGAGGAGG AGATGGATGAATGTGAGCAGGCGCTGGCTGCTGA GCCCAAGGCCAAGGACCCCTTCGCTCACCTGCCC AAGAGTACCTTTGTGTTGGATGAATTT | 111 | LKRTHHGK RRVHGKR SRSPRLSG RRRKRRLP LLLRRRW MNVSRRW LLSPRPRT PSLTCPRV PLCWMNL SASTPMRT HSLWHCHI SGSTLIRTA GPCGTQSI ASLKNSLR PS* |
| 725 | NM_0014 04.4_838 | 838 | AACTGTCGTACGTATGTCTTCTGTTTCGTCCTCGCT TTCCGGCTGCTGTTTCTCCACGGCTCTCCTCTTTC CCCCTCCCTTCTCTCCCGGGCGGCTTACTTTGCG GCAGCGCCGAGAACCCCACCCCCTTTCTTTGCGG | 106 | HGKRRVH GKRSRSP RLSGRRRK RRLPLLLR |

TABLE 3A-continued

| SEQ ID | identifier_ position | position | modified_RNA | PAP length | PAP |
|---|---|---|---|---|---|
| | | | AATCACCATGGCGGCTGGGACCCTGTACACGTAT | | RRWMNVS |
| | | | CCTGAAAACTGGAGGGCCTTCAAGGCTCTCATCG | | RRWLLSPR |
| | | | CTGCTCAGTACAGCGGGGCTCAGGTCCGCGTGCT | | PRTPSLTC |
| | | | CTCCGCACCACCCCACTTCCATTTTGGCCAAACCA | | PRVPLCW |
| | | | ACCGCACCCCTGAATTTCTCCGCAAATTTCCTGCC | | MNLSASTP |
| | | | GGCAAGGTCCCAGCATTTGAGGGTGATGATGGAT | | MRTHSLW |
| | | | TCTGTGTGTTTGAGAGCAACGCCATTGCCTACTAT | | HCHISGST |
| | | | GTGAGCAATGAGGAGCTGCGGGGAAGTACTCCAG | | LIRTAGPC |
| | | | AGGCAGCAGCCCAGGTGGTGCAGTGGGTGAGCTT | | GTQSIASL |
| | | | TGCTGATTCCGATATAGTGCCCCCAGCCAGTACCT | | KNSLRPS* |
| | | | GGGTGTTCCCCACCTTGGGCATCATGCACCACAA | | |
| | | | CAAACAGGCCACTGAGAATGCAAAGGAGGAAGTG | | |
| | | | AGGCGAATTCTGGGGCTGCTGGATGCTTACTTGAA | | |
| | | | GACGAGGACTTTTCTGGTGGGCGAACGAGTGACA | | |
| | | | TTGGCTGACATCACAGTTGTCTGCACCCTGTTGTG | | |
| | | | GCTCTATAAGCAGGTTCTAGAGCCTTCTTTCCGCC | | |
| | | | AGGCCTTTCCCAATACCAACCGCTGGTTCCTCACC | | |
| | | | TGCATTAACCAGCCCCAGTTCCGGGCTGTCTTGG | | |
| | | | GCGAAGTGAAACTGTGTGAGAAGATGGCCCAGTT | | |
| | | | TGATGCTAAAAAGTTTGCAGAGACCCAACCTAAAA | | |
| | | | AGGACACACACGGAAAGAGAAGGGTTCACGGGAA | | |
| | | | GAGAAGCAGAAGCCCCAGGCTGAGCGGAAGGAG | | |
| | | | GAGAAAAAGGCGGCTGCCCCTGCTCCTGAGGAGG | | |
| | | | AGATGGATGAATGTGAGCAGGCGCTGGCTGCTGA | | |
| | | | GCCCAAGGCCAAGGACCCCTTCGCTCACCTGCCC | | |
| | | | AAGAGTACCTTTGTGTTGGATGAATTT | | |
| 726 | NM_0014 04.4_855 | 855 | AACTGTCGTACGTATGTCTTCTGTTTCGTCCTCGCT | 100 | HGKRSRS |
| | | | TTCCGGCTGCTGTTTCTCCACGGCTCTCCTCTTTC | | PRLSGRRR |
| | | | CCCCTCCCTTCTCTCCCGGGCGGCTTACTTTGCG | | KRRLPLLL |
| | | | GCAGCGCCGAGAACCCCACCCCCTTTCTTTGCGG | | RRRWMNV |
| | | | AATCACCATGGCGGCTGGGACCCTGTACACGTAT | | SRRWLLSP |
| | | | CCTGAAAACTGGAGGGCCTTCAAGGCTCTCATCG | | RPRTPSLT |
| | | | CTGCTCAGTACAGCGGGGCTCAGGTCCGCGTGCT | | CPRVPLC |
| | | | CTCCGCACCACCCCACTTCCATTTTGGCCAAACCA | | WMNLSAS |
| | | | ACCGCACCCCTGAATTTCTCCGCAAATTTCCTGCC | | TPMRTHSL |
| | | | GGCAAGGTCCCAGCATTTGAGGGTGATGATGGAT | | WHCHISGS |
| | | | TCTGTGTGTTTGAGAGCAACGCCATTGCCTACTAT | | TLIRTAGP |
| | | | GTGAGCAATGAGGAGCTGCGGGGAAGTACTCCAG | | CGTQSIAS |
| | | | AGGCAGCAGCCCAGGTGGTGCAGTGGGTGAGCTT | | LKNSLRPS* |
| | | | TGCTGATTCCGATATAGTGCCCCCAGCCAGTACCT | | |
| | | | GGGTGTTCCCCACCTTGGGCATCATGCACCACAA | | |
| | | | CAAACAGGCCACTGAGAATGCAAAGGAGGAAGTG | | |
| | | | AGGCGAATTCTGGGGCTGCTGGATGCTTACTTGAA | | |
| | | | GACGAGGACTTTTCTGGTGGGCGAACGAGTGACA | | |
| | | | TTGGCTGACATCACAGTTGTCTGCACCCTGTTGTG | | |
| | | | GCTCTATAAGCAGGTTCTAGAGCCTTCTTTCCGCC | | |
| | | | AGGCCTTTCCCAATACCAACCGCTGGTTCCTCACC | | |
| | | | TGCATTAACCAGCCCCAGTTCCGGGCTGTCTTGG | | |
| | | | GCGAAGTGAAACTGTGTGAGAAGATGGCCCAGTT | | |
| | | | TGATGCTAAAAAGTTTGCAGAGACCCAACCTAAAA | | |
| | | | AGGACACACCACGGAAAGAGAAGGGTCACGGGAA | | |
| | | | GAGAAGCAGAAGCCCCAGGCTGAGCGGAAGGAG | | |
| | | | GAGAAAAAGGCGGCTGCCCCTGCTCCTGAGGAGG | | |
| | | | AGATGGATGAATGTGAGCAGGCGCTGGCTGCTGA | | |
| | | | GCCCAAGGCCAAGGACCCCTTCGCTCACCTGCCC | | |
| | | | AAGAGTACCTTTGTGTTGGATGAATTT | | |
| 727 | NM_0014 04.4_879 | 879 | AACTGTCGTACGTATGTCTTCTGTTTCGTCCTCGCT | 92 | RLSGRRRK |
| | | | TTCCGGCTGCTGTTTCTCCACGGCTCTCCTCTTTC | | RRLPLLLR |
| | | | CCCCTCCCTTCTCTCCCGGGCGGCTTACTTTGCG | | RRWMNVS |
| | | | GCAGCGCCGAGAACCCCACCCCCTTTCTTTGCGG | | RRWLLSPR |
| | | | AATCACCATGGCGGCTGGGACCCTGTACACGTAT | | PRTPSLTC |
| | | | CCTGAAAACTGGAGGGCCTTCAAGGCTCTCATCG | | PRVPLCW |
| | | | CTGCTCAGTACAGCGGGGCTCAGGTCCGCGTGCT | | MNLSASTP |
| | | | CTCCGCACCACCCCACTTCCATTTTGGCCAAACCA | | MRTHSLW |
| | | | ACCGCACCCCTGAATTTCTCCGCAAATTTCCTGCC | | HCHISGST |
| | | | GGCAAGGTCCCAGCATTTGAGGGTGATGATGGAT | | LIRTAGPC |
| | | | TCTGTGTGTTTGAGAGCAACGCCATTGCCTACTAT | | GTQSIASL |
| | | | GTGAGCAATGAGGAGCTGCGGGGAAGTACTCCAG | | KNSLRPS* |
| | | | AGGCAGCAGCCCAGGTGGTGCAGTGGGTGAGCTT | | |
| | | | TGCTGATTCCGATATAGTGCCCCCAGCCAGTACCT | | |
| | | | GGGTGTTCCCCACCTTGGGCATCATGCACCACAA | | |
| | | | CAAACAGGCCACTGAGAATGCAAAGGAGGAAGTG | | |
| | | | AGGCGAATTCTGGGGCTGCTGGATGCTTACTTGAA | | |
| | | | GACGAGGACTTTTCTGGTGGGCGAACGAGTGACA | | |
| | | | TTGGCTGACATCACAGTTGTCTGCACCCTGTTGTG | | |
| | | | GCTCTATAAGCAGGTTCTAGAGCCTTCTTTCCGCC | | |
| | | | AGGCCTTTCCCAATACCAACCGCTGGTTCCTCACC | | |

TABLE 3A-continued

| SEQ ID | identifier_position | position | modified_RNA | PAP length | PAP |
|---|---|---|---|---|---|
| | | | TGCATTAACCAGCCCCAGTTCCGGGCTGTCTTGG<br>GCGAAGTGAAACTGTGTGAGAAGATGGCCCAGTT<br>TGATGCTAAAAAGTTTGCAGAGACCCAACCTAAAA<br>AGGACACACCACGGAAAGAGAAGGGTTCACGGGA<br>AGAGAAGCAGAAGCCCAGGCTGAGCGGAAGGAG<br>GAGAAAAAGGCGGCTGCCCCTGCTCCTGAGGAGG<br>AGATGGATGAATGTGAGCAGGCGCTGGCTGCTGA<br>GCCCAAGGCCAAGGACCCCTTCGCTCACCTGCCC<br>AAGAGTACCTTTGTGTTGGATGAATTT | | |
| 728 | NM_0014<br>04.4_974 | 974 | AACTGTCGTACGTATGTCTTCTGTTTCGTCCTCGCT<br>TTCCGGCTGCTGTTTCTCCACGGCTCTCCTCTTTC<br>CCCCTCCCTTCTCTCCCGGGCGGCTTACTTTGCG<br>GCAGCGCCGAGAACCCCACCCCCTTTCTTTGCGG<br>AATCACCATGGCGGCTGGGACCCTGTACACGTAT<br>CCTGAAAACTGGAGGGCCTTCAAGGCTCTCATCG<br>CTGCTCAGTACAGCGGGGCTCAGGTCCGCGTGCT<br>CTCCGCACCACCCCACTTCCATTTTGGCCAAACCA<br>ACCGCACCCCTGAATTTCTCCGCAAATTTCCTGCC<br>GGCAAGGTCCCAGCATTTGAGGGTGATGATGGAT<br>TCTGTGTGTTTGAGAGCAACGCCATTGCCTACTAT<br>GTGAGCAATGAGGAGCTGCGGGAAGTACTCCAG<br>AGGCAGCAGCCCAGGTGGTGCAGTGGGTGAGCTT<br>TGCTGATTCCGATATAGTGCCCCCAGCCAGTACCT<br>GGGTGTTCCCCACCTTGGGCATCATGCACCACAA<br>CAAACAGGCCACTGAGAATGCAAAGGAGGAAGTG<br>AGGCGAATTCTGGGGCTGCTGGATGCTTACTTGAA<br>GACGAGGACTTTTCTGGTGGGCGAACGAGTGACA<br>TTGGCTGACATCACAGTTGTCTGCACCCTGTTGTG<br>GCTCTATAAGCAGGTTCTAGAGCCTTCTTTCCGCC<br>AGGCCTTTCCCAATACCAACCGCTGGTTCCTCACC<br>TGCATTAACCAGCCCCAGTTCCGGGCTGTCTTGG<br>GCGAAGTGAAACTGTGTGAGAAGATGGCCCAGTT<br>TGATGCTAAAAAGTTTGCAGAGACCCAACCTAAAA<br>AGGACACACCACGGAAAGAGAAGGGTTCACGGGA<br>AGAGAAGCAGAAGCCCAGGCTGAGCGGAAGGA<br>GGAGAAAAAGGCGGCTGCCCCTGCTCCTGAGGAG<br>GAGATGGATGAATGTGAGCAGGCGCTGGCTGCTG<br>AGCCCAAGGCAAGGACCCCTTCGCTCACCTGCCC<br>AAGAGTACCTTTGTGTTGGATGAATTT | 60 | RTPSLTCP<br>RVPLCWM<br>NLSASTPM<br>RTHSLWH<br>CHISGSTLI<br>RTAGPCGT<br>QSIASLKN<br>SLRPS* |
| 729 | NM_0014<br>16.2_108<br>0 | 1080 | GCAGGCGGGGCCGGGGCGGCCAAACCAATGCGA<br>TGGCCGGGGCGGAGTCGGGCGCTCTATAAGTTGT<br>CGATAGGCGGGCACTCCGCCCTAGTTTCTAAGGA<br>TCATGTCTGCGAGCCAGGATTCCCGATCCAGAGA<br>CAATGGCCCCGATGGGATGGAGCCCGAAGGCGTC<br>ATCGAGAGTAACTGGAATGAGATTGTTGACAGCTT<br>TGATGACATGAACCTCTCGGAGTCCCTTCTCCGTG<br>GCATCTACGCGTATGGTTTTGAGAAGCCCTCTGCC<br>ATCCAGCAGCGAGCCATTCTACCTTGTATCAAGGG<br>TTATGATGTGATTGCTCAAGCCCAATCTGGGACTG<br>GGAAAACGGCCACATTTGCCATATCGATTCTGCAG<br>CAGATTGAATTAGATCTAAAAGCCACCCAGGCCTT<br>GGTCCTAGCACCCACTCGAGAATTGGCTCAGCAG<br>ATACAGAAGGTGGTCATGGCACTAGGAGACTACAT<br>GGGCGCCTCCTGTCACGCCTGTATCGGGGGCACC<br>AACGTGCGTGCTGAGGTGCAGAAACTGCAGATGG<br>AAGCTCCCCACATCATCGTGGGTACCCCTGGCCG<br>TGTGTTTGATATGCTTAACCGGAGATACCTGTCCC<br>CCAAATACATCAAGATGTTTGTACTGGATGAAGCT<br>GACGAAATGTTAAGCCGTGGATTCAAGGACCAGAT<br>CTATGACATATTCCAAAAGCTCAACAGCAACACCC<br>AGGTAGTTTTGCTGTCAGCCACAATGCCTTCTGAT<br>GTGCTTGAGGTGACCAAGAAGTTCATGAGGGACC<br>CCATTCGGATTCTTGTCAAGAAGGAAGAGTTGACC<br>CTGGAGGGTATCCGCCAGTTCTACATCAACGTGG<br>AACGAGAGGAGTGGAAGCTGGACACACTATGTGA<br>CTTGTATGAAACCCTGACCATCACCCAGGCAGTCA<br>TCTTCATCAACACCCGGAGGAAGGTGGACTGGCT<br>CACCGAGAAGATGCATGCTCGAGATTTCACTGTAT<br>CCGCCATGCATGGAGATATGGAC | 0 | * |
| 730 | NM_0014<br>16.2_193 | 193 | GCAGGCGGGGCCGGGGCGGCCAAACCAATGCGA<br>TGGCCGGGGCGGAGTCGGGCGCTCTATAAGTTGT<br>CGATAGGCGGGCACTCCGCCCTAGTTTCTAAGGA<br>TCATGTCTGCGAGCCAGGATTCCCGATCCAGAGA<br>CAATGGCCCCGATGGGATGGAGCCCGAAGGCGTC<br>ATCGAGAGTAACTGGAATGAGATGTTGACAGCTTT<br>GATGACATGAACCTCTCGGAGTCCCTTCTCCGTGG<br>CATCTACGCGTATGGTTTTGAGAAGCCCTCTGCCA | 7 | MLTALMT* |

TABLE 3A-continued

| SEQ ID | identifier_position | position | modified_RNA | PAP length | PAP |
|---|---|---|---|---|---|
| | | | TCCAGCAGCGAGCCATTCTACCTTGTATCAAGGGT<br>TATGATGTGATTGCTCAAGCCCAATCTGGGACTGG<br>GAAAACGGCCACATTTGCCATATCGATTCTGCAGC<br>AGATTGAATTAGATCTAAAAGCCACCCAGGCCTTG<br>GTCCTAGCACCCACTCGAGAATTGGCTCAGCAGAT<br>ACAGAAGGTGGTCATGGCACTAGGAGACTACATG<br>GGCGCCTCCTGTCACGCCTGTATCGGGGGCACCA<br>ACGTGCGTGCTGAGGTGCAGAAACTGCAGATGGA<br>AGCTCCCCACATCATCGTGGGTACCCCTGGCCGT<br>GTGTTTGATATGCTTAACCGGAGATACCTGTCCCC<br>CAAATACATCAAGATGTTTGTACTGGATGAAGCTG<br>ACGAAATGTTAAGCCGTGGATTCAAGGACCAGATC<br>TATGACATATTCCAAAAGCTCAACAGCAACACCCA<br>GGTAGTTTTGCTGTCAGCCACAATGCCTTCTGATG<br>TGCTTGAGGTGACCAAGAAGTTCATGAGGGACCC<br>CATTCGGATTCTTGTCAAGAAGGAAGAGTTGACCC<br>TGGAGGGTATCCGCCAGTTCTACATCAACGTGGAA<br>CGAGAGGAGTGGAAGCTGGACACACTATGTGACT<br>TGTATGAAACCCTGACCATCACCCAGGCAGTCATC<br>TTCATCAACACCCGGAGGAAGGTGGACTGGCTCA<br>CCGAGAAGATGCATGCTCGAGATTTCACTGTATCC<br>GCCATGCATGGAGATATGGACC | | |
| 731 | NM_0014 16.2_205 | 205 | GCAGGCGGGGCCGGGGCGGCCAAACCAATGCGA<br>TGGCCGGGGCGGAGTCGGGCGCTCTATAAGTTGT<br>CGATAGGCGGGCACTCCGCCCTAGTTTCTAAGGA<br>TCATGTCTGCGAGCCAGGATTCCCGATCCAGAGA<br>CAATGGCCCCGATGGGATGGAGCCCGAAGGCGTC<br>ATCGAGAGTAACTGGAATGAGATTGTTGACAGCTT<br>GATGACATGAACCTCTCGGAGTCCCTTCTCCGTGG<br>CATCTACGCGTATGGTTTTGAGAAGCCCTCTGCCA<br>TCCAGCAGCGAGCCATTCTACCTTGTATCAAGGGT<br>TATGATGTGATTGCTCAAGCCCAATCTGGGACTGG<br>GAAAACGGCCACATTTGCCATATCGATTCTGCAGC<br>AGATTGAATTAGATCTAAAAGCCACCCAGGCCTTG<br>GTCCTAGCACCCACTCGAGAATTGGCTCAGCAGAT<br>ACAGAAGGTGGTCATGGCACTAGGAGACTACATG<br>GGCGCCTCCTGTCACGCCTGTATCGGGGGCACCA<br>ACGTGCGTGCTGAGGTGCAGAAACTGCAGATGGA<br>AGCTCCCCACATCATCGTGGGTACCCCTGGCCGT<br>GTGTTTGATATGCTTAACCGGAGATACCTGTCCCC<br>CAAATACATCAAGATGTTTGTACTGGATGAAGCTG<br>ACGAAATGTTAAGCCGTGGATTCAAGGACCAGATC<br>TATGACATATTCCAAAAGCTCAACAGCAACACCCA<br>GGTAGTTTTGCTGTCAGCCACAATGCCTTCTGATG<br>TGCTTGAGGTGACCAAGAAGTTCATGAGGGACCC<br>CATTCGGATTCTTGTCAAGAAGGAAGAGTTGACCC<br>TGGAGGGTATCCGCCAGTTCTACATCAACGTGGAA<br>CGAGAGGAGTGGAAGCTGGACACACTATGTGACT<br>TGTATGAAACCCTGACCATCACCCAGGCAGTCATC<br>TTCATCAACACCCGGAGGAAGGTGGACTGGCTCA<br>CCGAGAAGATGCATGCTCGAGATTTCACTGTATCC<br>GCCATGCATGGAGATATGGACC | 3 | LMT* |
| 732 | NM_0014 16.2_322 | 322 | GCAGGCGGGGCCGGGGCGGCCAAACCAATGCGA<br>TGGCCGGGGCGGAGTCGGGCGCTCTATAAGTTGT<br>CGATAGGCGGGCACTCCGCCCTAGTTTCTAAGGA<br>TCATGTCTGCGAGCCAGGATTCCCGATCCAGAGA<br>CAATGGCCCCGATGGGATGGAGCCCGAAGGCGTC<br>ATCGAGAGTAACTGGAATGAGATTGTTGACAGCTT<br>TGATGACATGAACCTCTCGGAGTCCCTTCTCCGTG<br>GCATCTACGCGTATGGTTTTGAGAAGCCCTCTGCC<br>ATCCAGCAGCGAGCCATTCTACCTTGTATCAAGGG<br>TTATGATGTGATGCTCAAGCCCAATCTGGGACTGG<br>GAAAACGGCCACATTTGCCATATCGATTCTGCAGC<br>AGATTGAATTAGATCTAAAAGCCACCCAGGCCTTG<br>GTCCTAGCACCCACTCGAGAATTGGCTCAGCAGAT<br>ACAGAAGGTGGTCATGGCACTAGGAGACTACATG<br>GGCGCCTCCTGTCACGCCTGTATCGGGGGCACCA<br>ACGTGCGTGCTGAGGTGCAGAAACTGCAGATGGA<br>AGCTCCCCACATCATCGTGGGTACCCCTGGCCGT<br>GTGTTTGATATGCTTAACCGGAGATACCTGTCCCC<br>CAAATACATCAAGATGTTTGTACTGGATGAAGCTG<br>ACGAAATGTTAAGCCGTGGATTCAAGGACCAGATC<br>TATGACATATTCCAAAAGCTCAACAGCAACACCCA<br>GGTAGTTTTGCTGTCAGCCACAATGCCTTCTGATG<br>TGCTTGAGGTGACCAAGAAGTTCATGAGGGACCC<br>CATTCGGATTCTTGTCAAGAAGGAAGAGTTGACCC<br>TGGAGGGTATCCGCCAGTTCTACATCAACGTGGAA | 23 | MLKPNLGL<br>GKRPHLPY<br>RFCSRLN* |

TABLE 3A-continued

| SEQ ID | identifier_position | position | modified_RNA | PAP length | PAP |
|---|---|---|---|---|---|
| | | | CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | | |
| 733 | NM_0014 16.2_355 | 355 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCACATTTGCCATATCGATTCTGCAGC AGATTGAATTAGATCTAAAAGCCACCCAGGCCTTG GTCCTAGCACCCACTCGAGAATTGGCTCAGCAGAT ACAGAAGGTGGTCATGGCACTAGGAGACTACATG GGCGCCTCCTGTCACGCCTGTATCGGGGGCACCA ACGTGCGTGCTGAGGTGCAGAAACTGCAGATGGA AGCTCCCCACATCATCGTGGGTACCCCTGGCCGT GTGTTTGATATGCTTAACCGGAGATACCTGTCCCC CAAATACATCAAGATGTTTGTACTGGATGAAGCTG ACGAAATGTTAAGCCGTGGATTCAAGGACCAGATC TATGACATATTCCAAAAGCTCAACAGCAACACCCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 11 | HLPYRFCS RLN* |
| 734 | NM_0014 16.2_361 | 361 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCACATTGCCATATCGATTCTGCAGC AGATTGAATTAGATCTAAAAGCCACCCAGGCCTTG GTCCTAGCACCCACTCGAGAATTGGCTCAGCAGAT ACAGAAGGTGGTCATGGCACTAGGAGACTACATG GGCGCCTCCTGTCACGCCTGTATCGGGGGCACCA ACGTGCGTGCTGAGGTGCAGAAACTGCAGATGGA AGCTCCCCACATCATCGTGGGTACCCCTGGCCGT GTGTTTGATATGCTTAACCGGAGATACCTGTCCCC CAAATACATCAAGATGTTTGTACTGGATGAAGCTG ACGAAATGTTAAGCCGTGGATTCAAGGACCAGATC TATGACATATTCCAAAAGCTCAACAGCAACACCCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 10 | LPYRFCSR LN* |
| 735 | NM_0014 16.2_414 | 414 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCACATTTGCCATATCGATTCTGCAG CAGATTGAATTAGATCTAAAAGCCACCCAGGCCTG | 2 | WS* |

TABLE 3A-continued

| SEQ ID | identifier_position | position | modified_RNA | length PAP | PAP |
|---|---|---|---|---|---|
| | | | GTCCTAGCACCCACTCGAGAATTGGCTCAGCAGAT ACAGAAGGTGGTCATGGCACTAGGAGACTACATG GGCGCCTCCTGTCACGCCTGTATCGGGGGCACCA ACGTGCGTGCTGAGGTGCAGAAACTGCAGATGGA AGCTCCCCACATCATCGTGGGTACCCCTGGCCGT GTGTTTGATATGCTTAACCGGAGATACCTGTCCCC CAAATACATCAAGATGTTTGTACTGGATGAAGCTG ACGAAATGTTAAGCCGTGGATTCAAGGACCAGATC TATGACATATTCCAAAAGCTCAACAGCAACACCCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | | |
| 736 | NM_0014 16.2_438 | 438 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATGGCTCAGCAGA TACAGAAGGTGGTCATGGCACTAGGAGACTACAT GGGCGCCTCCTGTCACGCCTGTATCGGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCC AGGTAGTTTTGCTGTCAGCCACAATGCCTTCTGAT GTGCTTGAGGTGACCAAGAAGTTCATGAGGGACC CCATTCGGATTCTTGTCAAGAAGGAAGAGTTGACC CTGGAGGGTATCCGCCAGTTCTACATCAACGTGG AACGAGAGGAGTGGAAGCTGGACACACTATGTGA CTTGTATGAAACCCTGACCATCACCCAGGCAGTCA TCTTCATCAACACCCGGAGGAAGGTGGACTGGCT CACCGAGAAGATGCATGCTCGAGATTTCACTGTAT CCGCCATGCATGGAGATATGGACC | 11 | WLSRYRR WSWH* |
| 737 | NM_0014 16.2_584 | 584 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGGCACC AACGTGCGTGCTGAGGTGCAGAAACTGCAGATGG AAGCTCCCCACATCATCGTGGGTACCCCTGGCGT GTGTTTGATATGCTTAACCGGAGATACCTGTCCCC CAAATACATCAAGATGTTTGTACTGGATGAAGCTG ACGAAATGTTAAGCCGTGGATTCAAGGACCAGATC TATGACATATTCCAAAAGCTCAACAGCAACACCCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA | 27 | VCLICLTG DTCPPNTS RCLYWMK LTKC* |

TABLE 3A-continued

| SEQ ID | identifier_position | position | modified_RNA | PAP length | PAP |
|---|---|---|---|---|---|
| 738 | NM_0014 16.2_640 | 640 | CCGAGAAGATGCATGCTCGAGATTTCACTGTATCC GCCATGCATGGAGATATGGACC GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCTG ACGAAATGTTAAGCCGTGGATTCAAGGACCAGATC TATGACATATTCCAAAAGCTCAACAGCAACACCCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 9 | LYWMKLTK C* |
| 739 | NM_0014 16.2_725 | 725 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCA GGTAGTTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 1 | R* |
| 740 | NM_0014 16.2_735 | 735 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGCACC | 12 | CCQPQCLL MCLR* |

TABLE 3A-continued

| SEQ ID | identifier_position | position | modified_RNA | PAP length | PAP |
|---|---|---|---|---|---|
| | | | AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCC AGGTAGTTTGCTGTCAGCCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | | |
| 741 | NM_0014 16.2_745 | 745 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCC AGGTAGTTTTGCTGTCAGCACAATGCCTTCTGATG TGCTTGAGGTGACCAAGAAGTTCATGAGGGACCC CATTCGGATTCTTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 8 | QCLLMCLR* |
| 742 | NM_0014 16.2_808 | 808 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCC AGGTAGTTTTGCTGTCAGCCACAATGCCTTCTGAT GTGCTTGAGGTGACCAAGAAGTTCATGAGGGACC CCATTCGGATTCTGTCAAGAAGGAAGAGTTGACCC TGGAGGGTATCCGCCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 5 | SRRKS* |

TABLE 3A-continued

| SEQ ID | identifier_position | position | modified_RNA | PAP length | PAP |
|---|---|---|---|---|---|
| 743 | NM_0014 16.2_845 | 845 | GCAGGCGGGGCCGGGGCGGCCAAACCAATGCGA TGGCCGGGGCGGAGTCGGGCGCTCTATAAGTTGT CGATAGGCGGGCACTCCGCCCTAGTTTCTAAGGA TCATGTCTGCGAGCCAGGATTCCCGATCCAGAGA CAATGGCCCCGATGGGATGGAGCCCGAAGGCGTC ATCGAGAGTAACTGGAATGAGATTGTTGACAGCTT TGATGACATGAACCTCTCGGAGTCCCTTCTCCGTG GCATCTACGCGTATGGTTTTGAGAAGCCCTCTGCC ATCCAGCAGCGAGCCATTCTACCTTGTATCAAGGG TTATGATGTGATTGCTCAAGCCCAATCTGGGACTG GGAAAACGGCCACATTTGCCATATCGATTCTGCAG CAGATTGAATTAGATCTAAAAGCCACCCAGGCCTT GGTCCTAGCACCCACTCGAGAATTGGCTCAGCAG ATACAGAAGGTGGTCATGGCACTAGGAGACTACAT GGGCGCCTCCTGTCACGCCTGTATCGGGGGCACC AACGTGCGTGCTGAGGTGCAGAAACTGCAGATGG AAGCTCCCCACATCATCGTGGGTACCCCTGGCCG TGTGTTTGATATGCTTAACCGGAGATACCTGTCCC CCAAATACATCAAGATGTTTGTACTGGATGAAGCT GACGAAATGTTAAGCCGTGGATTCAAGGACCAGAT CTATGACATATTCCAAAAGCTCAACAGCAACACCC AGGTAGTTTTGCTGTCAGCCACAATGCCTTCTGAT GTGCTTGAGGTGACCAAGAAGTTCATGAGGGACC CCATTCGGATTCTTGTCAAGAAGGAAGAGTTGACC CTGGAGGGTATCCGCAGTTCTACATCAACGTGGAA CGAGAGGAGTGGAAGCTGGACACACTATGTGACT TGTATGAAACCCTGACCATCACCCAGGCAGTCATC TTCATCAACACCCGGAGGAAGGTGGACTGGCTCA CCGAGAAGATGCATGCTCGAGATTTCACTGTATCC GCCATGCATGGAGATATGGACC | 22 | SSTSTWNE RSGSWTH YVTCMKP* |
| 744 | NM_0014 17.4_623 | 623 | GGCCACATGTCGCGCATGTCTTCCCGTCGGACGG CGTGCCACCTCGCCGCGCAGCTTTACGAACCTAG AGCAGCGCCGCCCCGCCTCCTGTCTCCGTCCTCA CCTCCCCGCCCCCTCCCAGCTTGCGTCTCCTAG CTCGACGCGCCCGCTATAATCACGTGATTGCCTCA TCCGGGTCTTTTGCGTTCTCTTTCCCTCTCCCAAC ATGGCGGCCTCAGCAAAAAAGAAGAATAAGAAGG GGAAGACTATCTCCCTAACAGACTTTCTGGCTGAG GATGGGGGTACTGGTGGAGGAAGCACCTATGTTT CCAAACCAGTCAGCTGGGCTGATGAAACGGATGA CCTGGAAGGAGATGTTTCGACCACTTGGCACAGTA ACGATGACGATGTGTATAGGGCGCCTCCAATTGAC CGTTCCATCCTTCCCACTGCTCCACGGGCTGCTCG GGAACCCAATATCGACCGGAGCCGTCTTCCCAAAT CGCCACCCTACACTGCTTTTCTAGGAAACCTACCC TATGATGTTACAGAAGAGTCAATTAAGGAATTCTTT CGAGGATTAAATATCAGTGCAGTGCGTTTACCACG TGAACCCAGCAATCCAGAGAGGTTGAAAGGTTTG GTTATGCTGAATTTGAGGACCTGGATTCCTGCTC AGTGCCCTGAGTCTCAATGAAGAGTCTCTAGGTAA CAGGAGAATTCGAGTGGACGTTGCTGATCAAGCA CAGGATAAAGACAGGGATGATCGTTCTTTTGGCCG TGATAGAAATCGGGATTCTGACAAAACAGATACAG ACTGGAGGGCTCGTCCTGCTACAGACAGCTTTGAT GACTACCCACCTAGAAGAGGTGATGATAGCTTTGG AGACAAGTATCGAGATCGTTATGATTCAGACCGGT ATCGGGATGGGTATCGGGATGGGTATCGGGATGG CCCACGCCGGGATATGGATCGATATGGTGGCCGG GATCGCTATGATGACCGAGGCAGCAGAGACTATG ATAGAGGCTATGATTCCCGG | 15 | LVMLNLRT WIPCSVP* |
| 745 | NM_0014 18.3_168 3 | 1683 | GCAGACGGCAACCGGGCCGCTGATTGGGCGGCG AAGGAGCCATTCGGGGAGACTCTGGTGGGTTCGG CTGCCCCAAGAGTGATAAGTTCGGCTTCAGACAC GCCTTAGCGCCAGCAGTGAGTCGGAGCTCTATGG AGGTGGCAGCGGGTACCGAGTGGCGGCTGCAGC AGCGACTCCTCTGAGCTGAGTTTGAGGCCGTCCC CGACTCCTTCCTCCCCCTTCCCTCCCCCTTTTTTT GTTTTCCGTTCCCCTTTCCCCTCCCTTCCCTATCCC CGACGACCGGATCCTGAGGAGGCAGCTGCGGTG GCAGCTGCTGAGTTCTCGGTGAAGGTATTTCATTT CTCCTGTCCCCTCCCCTCCCCACCCCATCTATTAA TATTATTCTTTTGAAGATTCTTCGTTGTCAAGCCGC CAAAGTGGAGAGTGCGATTGCAGAAGGGGGTGCT TCTCGTTTCAGTGCTTCTTCGGGCGGAGGAGGAA GTAGGGGTGCACCTCAGCACTATCCCAAGACTGC TGGCAACAGCGAGTTCTGGGGAAAACCCCAGGG CAAAACGCTCAGAAATGGATTCCTGCACGAAGCAC | 8 | LERWEASL* |

TABLE 3A-continued

| SEQ ID | identifier_ position | position | modified_RNA | PAP length | PAP |
|---|---|---|---|---|---|
| | | | TAGACGAGATGACAACTCCGCAGCAAACAACTCC<br>GCAAACGAAAAAGAACGACATGATGCAATCTTCAG<br>GAAAGTAAGAGGCATACTAAATAAGCTTACTCCTG<br>AAAAGTTTGACAAGCTATGCCTTGAGCTCCTCAAT<br>GTGGGTGTAGAGTCTAAACTCATCCTTAAAGGGGT<br>CATACTGCTGATTGTGGACAAAGCCCTAGAAGAGC<br>CAAAGTATAGCTCACTGTATGCTCAGCTATGTCTG<br>CGATTGGCAGAAGATGCACCAAACTTTGATGGCCC<br>AGCAGCAGAGGGTCAACCAGGACAGAAGCAAAGC<br>ACCACATTCAGACGCCTCCTAATTTCCAAATTACAA<br>GATGAATTTGAAAACCGAACTAGAAATGTTGATGT<br>CTATGATAAGCGTGAAAATCCCCTCCTCCCCGAGG<br>AGGAGGAACAGAGAGCCATTG | | |
| 746 | NM_0014<br>18.3_171<br>9 | 1719 | GCAGACGGCAACCGGGCCGCTGATTGGGCGGCG<br>AAGGAGCCATTCGGGGAGACTCTGGTGGGTTCGG<br>CTGCCCCAAGAGTGATAAGTTCGGCTTCAGACAC<br>GCCTTAGCGCCAGCAGTGAGTCGGAGCTCTATGG<br>AGGTGGCAGCGGGTACCGAGTGGCGGCTGCAGC<br>AGCGACTCCTCTGAGCTGAGTTTGAGGCCGTCCC<br>CGACTCCTTCCTCCCCCTTCCCTCCCCTTTTTTT<br>GTTTTCCGTTCCCCTTTCCCCTCCCTTCCCTATCCC<br>CGACGACCGGATCCTGAGGAGGCAGCTGCGGTG<br>GCAGCTGCTGAGTTCTCGGTGAAGGTATTTCATTT<br>CTCCTGTCCCCTCCCCTCCCCACCCCATCTATTAA<br>TATTATTCTTTTGAAGATTCTTCGTTGTCAAGCCGC<br>CAAAGTGGAGAGTGCGATTGCAGAAGGGGGTGCT<br>TCTCGTTTCAGTGCTTCTTCGGGCGGAGGAGGAA<br>GTAGGGGTGCACCTCAGCACTATCCCAAGACTGC<br>TGGCAACAGCGAGTTCCTGGGGAAAACCCCAGGG<br>CAAAACGCTCAGAAATGGATTCCTGCACGAAGCAC<br>TAGACGAGATGACAACTCCGCAGCAAACAACTCC<br>GCAAACGAAAAAGAACGACATGATGCAATCTTCAG<br>GAAAGTAAGAGGCATACTAAATAAGCTTACTCCTG<br>AAAAGTTTGACAAGCTATGCCTTGAGCTCCTCAAT<br>GTGGGTGTAGAGTCTAAACTCATCCTTAAAGGGGT<br>CATACTGCTGATTGTGGACAAAGCCCTAGAAGAGC<br>CAAAGTATAGCTCACTGTATGCTCAGCTATGTCTG<br>CGATTGGCAGAAGATGCACCAAACTTTGATGGCCC<br>AGCAGCAGAGGGTCAACCAGGACAGAAGCAAAGC<br>ACCACATTCAGACGCCTCCTAATTTCCAAATTACAA<br>GATGAATTTGAAAACCGAACTAGAAATGTTGATGT<br>CTATGATAAGCGTGAAAATCCCCTCCTCCCCGAGG<br>AGGAGGAACAGAGAGCCATTG | 0 | * |
| 747 | NM_0014<br>18.3_257<br>3 | 2573 | GCAGACGGCAACCGGGCCGCTGATTGGGCGGCG<br>AAGGAGCCATTCGGGGAGACTCTGGTGGGTTCGG<br>CTGCCCCAAGAGTGATAAGTTCGGCTTCAGACAC<br>GCCTTAGCGCCAGCAGTGAGTCGGAGCTCTATGG<br>AGGTGGCAGCGGGTACCGAGTGGCGGCTGCAGC<br>AGCGACTCCTCTGAGCTGAGTTTGAGGCCGTCCC<br>CGACTCCTTCCTCCCCCTTCCCTCCCCTTTTTTT<br>GTTTTCCGTTCCCCTTTCCCCTCCCTTCCCTATCCC<br>CGACGACCGGATCCTGAGGAGGCAGCTGCGGTG<br>GCAGCTGCTGAGTTCTCGGTGAAGGTATTTCATTT<br>CTCCTGTCCCCTCCCCTCCCCACCCCATCTATTAA<br>TATTATTCTTTTGAAGATTCTTCGTTGTCAAGCCGC<br>CAAAGTGGAGAGTGCGATTGCAGAAGGGGGTGCT<br>TCTCGTTTCAGTGCTTCTTCGGGCGGAGGAGGAA<br>GTAGGGGTGCACCTCAGCACTATCCCAAGACTGC<br>TGGCAACAGCGAGTTCCTGGGGAAAACCCCAGGG<br>CAAAACGCTCAGAAATGGATTCCTGCACGAAGCAC<br>TAGACGAGATGACAACTCCGCAGCAAACAACTCC<br>GCAAACGAAAAAGAACGACATGATGCAATCTTCAG<br>GAAAGTAAGAGGCATACTAAATAAGCTTACTCCTG<br>AAAAGTTTGACAAGCTATGCCTTGAGCTCCTCAAT<br>GTGGGTGTAGAGTCTAAACTCATCCTTAAAGGGGT<br>CATACTGCTGATTGTGGACAAAGCCCTAGAAGAGC<br>CAAAGTATAGCTCACTGTATGCTCAGCTATGTCTG<br>CGATTGGCAGAAGATGCACCAAACTTTGATGGCCC<br>AGCAGCAGAGGGTCAACCAGGACAGAAGCAAAGC<br>ACCACATTCAGACGCCTCCTAATTTCCAAATTACAA<br>GATGAATTTGAAAACCGAACTAGAAATGTTGATGT<br>CTATGATAAGCGTGAAAATCCCCTCCTCCCCGAGG<br>AGGAGGAACAGAGAGCCATTG | 5 | WKERD* |
| 748 | NM_0014<br>18.3_271<br>5 | 2715 | GCAGACGGCAACCGGGCCGCTGATTGGGCGGCG<br>AAGGAGCCATTCGGGGAGACTCTGGTGGGTTCGG<br>CTGCCCCAAGAGTGATAAGTTCGGCTTCAGACAC<br>GCCTTAGCGCCAGCAGTGAGTCGGAGCTCTATGG | 2 | DL* |

TABLE 3A-continued

| SEQ ID | identifier_ position | position | modified_RNA | PAP length | PAP |
|---|---|---|---|---|---|
| | | | AGGTGGCAGCGGGTACCGAGTGGCGGCTGCAGC AGCGACTCCTCTGAGCTGAGTTTGAGGCCGTCCC CGACTCCTTCCTCCCCCTTCCCTCCCCCTTTTTTTT GTTTTCCGTTCCCCTTTCCCCTCCCTTCCCTATCCC CGACGACCGGATCCTGAGGAGGCAGCTGCGGTG GCAGCTGCTGAGTTCTCGGTGAAGGTATTTCATTT CTCCTGTCCCCTCCCCTCCCCACCCCATCTATTAA TATTATTCTTTTGAAGATTCTTCGTTGTCAAGCCGC CAAAGTGGAGAGTGCGATTGCAGAAGGGGGTGCT TCTCGTTTCAGTGCTTCTTCGGGCGGAGGAGGAA GTAGGGGTGCACCTCAGCACTATCCCAAGACTGC TGGCAACAGCGAGTTCCTGGGGAAAACCCCAGGG CAAAACGCTCAGAAATGGATTCCTGCACGAAGCAC TAGACGAGATGACAACTCCGCAGCAAACAACTCC GCAAACGAAAAAGAACGACATGATGCAATCTTCAG GAAAGTAAGAGGCATACTAAATAAGCTTACTCCTG AAAAGTTTGACAAGCTATGCCTTGAGCTCCTCAAT GTGGGTGTAGAGTCTAAACTCATCCTTAAAGGGGT CATACTGCTGATTGTGGACAAAGCCCTAGAAGAGC CAAAGTATAGCTCACTGTATGCTCAGCTATGTCTG CGATTGGCAGAAGATGCACCAAACTTTGATGGCCC AGCAGCAGAGGGTCAACCAGGACAGAAGCAAAGC ACCACATTCAGACGCCTCCTAATTTCCAAATTACAA GATGAATTTGAAAACCGAACTAGAAATGTTGATGT CTATGATAAGCGTGAAAATCCCTCCTCCCCGAGG AGGAGGAACAGAGAGCCATTG | | |
| 749 | NM_0014 18.3_272 1 | 2721 | GCAGACGGCAACCGGGCCGCTGATTGGGCGGCG AAGGAGCCATTCGGGGAGACTCTGGTGGGTTCGG CTGCCCCAAGAGTGATAAGTTCGGCTTCAGACAC GCCTTAGCGCCAGCAGTGAGTCGGAGCTCTATGG AGGTGGCAGCGGGTACCGAGTGGCGGCTGCAGC AGCGACTCCTCTGAGCTGAGTTTGAGGCCGTCCC CGACTCCTTCCTCCCCCTTCCCTCCCCCTTTTTTTT GTTTTCCGTTCCCCTTTCCCCTCCCTTCCCTATCCC CGACGACCGGATCCTGAGGAGGCAGCTGCGGTG GCAGCTGCTGAGTTCTCGGTGAAGGTATTTCATTT CTCCTGTCCCCTCCCCTCCCCACCCCATCTATTAA TATTATTCTTTTGAAGATTCTTCGTTGTCAAGCCGC CAAAGTGGAGAGTGCGATTGCAGAAGGGGGTGCT TCTCGTTTCAGTGCTTCTTCGGGCGGAGGAGGAA GTAGGGGTGCACCTCAGCACTATCCCAAGACTGC TGGCAACAGCGAGTTCCTGGGGAAAACCCCAGGG CAAAACGCTCAGAAATGGATTCCTGCACGAAGCAC TAGACGAGATGACAACTCCGCAGCAAACAACTCC GCAAACGAAAAAGAACGACATGATGCAATCTTCAG GAAAGTAAGAGGCATACTAAATAAGCTTACTCCTG AAAAGTTTGACAAGCTATGCCTTGAGCTCCTCAAT GTGGGTGTAGAGTCTAAACTCATCCTTAAAGGGGT CATACTGCTGATTGTGGACAAAGCCCTAGAAGAGC CAAAGTATAGCTCACTGTATGCTCAGCTATGTCTG CGATTGGCAGAAGATGCACCAAACTTTGATGGCCC AGCAGCAGAGGGTCAACCAGGACAGAAGCAAAGC ACCACATTCAGACGCCTCCTAATTTCCAAATTACAA GATGAATTTGAAAACCGAACTAGAAATGTTGATGT CTATGATAAGCGTGAAAATCCCTCCTCCCCGAGG AGGAGGAACAGAGAGCCATTG | 1 | L* |
| 750 | NM_0014 18.3_306 8 | 3068 | GCAGACGGCAACCGGGCCGCTGATTGGGCGGCG AAGGAGCCATTCGGGGAGACTCTGGTGGGTTCGG CTGCCCCAAGAGTGATAAGTTCGGCTTCAGACAC GCCTTAGCGCCAGCAGTGAGTCGGAGCTCTATGG AGGTGGCAGCGGGTACCGAGTGGCGGCTGCAGC AGCGACTCCTCTGAGCTGAGTTTGAGGCCGTCCC CGACTCCTTCCTCCCCCTTCCCTCCCCCTTTTTTTT GTTTTCCGTTCCCCTTTCCCCTCCCTTCCCTATCCC CGACGACCGGATCCTGAGGAGGCAGCTGCGGTG GCAGCTGCTGAGTTCTCGGTGAAGGTATTTCATTT CTCCTGTCCCCTCCCCTCCCCACCCCATCTATTAA TATTATTCTTTTGAAGATTCTTCGTTGTCAAGCCGC CAAAGTGGAGAGTGCGATTGCAGAAGGGGGTGCT TCTCGTTTCAGTGCTTCTTCGGGCGGAGGAGGAA GTAGGGGTGCACCTCAGCACTATCCCAAGACTGC TGGCAACAGCGAGTTCCTGGGGAAAACCCCAGGG CAAAACGCTCAGAAATGGATTCCTGCACGAAGCAC TAGACGAGATGACAACTCCGCAGCAAACAACTCC GCAAACGAAAAAGAACGACATGATGCAATCTTCAG GAAAGTAAGAGGCATACTAAATAAGCTTACTCCTG AAAAGTTTGACAAGCTATGCCTTGAGCTCCTCAAT | 3 | CSR* |

TABLE 3A-continued

| SEQ ID | identifier_position | position | modified_RNA | PAP length | PAP |
|---|---|---|---|---|---|
| | | | GTGGGTGTAGAGTCTAAACTCATCCTTAAAGGGGT CATACTGCTGATTGTGGACAAAGCCCTAGAAGAGC CAAAGTATAGCTCACTGTATGCTCAGCTATGTCTG CGATTGGCAGAAGATGCACCAAACTTTGATGGCCC AGCAGCAGAGGGTCAACCAGGACAGAAGCAAAGC ACCACATTCAGACGCCTCCTAATTTCCAAATTACAA GATGAATTTGAAAACCGAACTAGAAATGTTGATGT CTATGATAAGCGTGAAAATCCCTCCTCCCCGAGG AGGAGGAACAGAGAGCCATTG | | |
| 751 | NM_0014 28.2_1125 | 1125 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG AGAAGATTGACAAACTGATGATCGAGATGGATGGA ACAGAAAATAAATCTAAGTTTGGTGCGAACGCCAT TCTGGGGGTGTCCCTTGCCGTCTGCAAAGCTGGT GCCGTTGAGAAGGGGGTCCCCCTGTACCGCCACA TCGCTGACTTGGCTGGCAACTCTGAAGTCATCCTG CCAGTCCCGGCGTTCAATGTCATCAATGGCGGTTC TCATGCTGGCAACAAGCTGGCCATGCAGGAGTTC ATGATCCTCCCAGTCGGTGCAGCAAACTTCAGGG AAGCCATGCGCATTGGAGCAGAGGTTTACCACAA CCTGAAGAATGTCATCAAGGAGAAATATGGGAAAG ATGCCACCAATGTGGGGGATGAAGGCGGGTTTGC TCCCAACATCCTGGAGAATAAAGAAGGCCTGGAG CTGCTGAAGACTGCTATTGGGAAAGCTGGCTACAC TGATAAGGTGGTCATCGGCATGGACGTAGCGGCC TCCGAGTTCTTCAGGTCTGGGAAGTATGACCTGGA CTTCAAGTCTCCCGATGACCCCAGCAGGTACATCT CGCCTGACCAGCTGGCTGACCTGTACAAGTCCTTC ATCAAGGACTACCCAGTGGTGTCT | 7 | QRGSPRP* |
| 752 | NM_0014 28.2_179 | 179 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCCCA CTGTTGAGGTTGATCTCTTCACCTCAAAAGGTCTC TTCAGAGCTGCTGTGCCCAGTGGTGCTTCAACTGG TATCTATGAGGCCCTAGAGCTCCGGGACAATGATA AGACTCGCTATATGGGGAAGGGTGTCTCAAAGGC TGTTGAGCACATCAATAAAACTATTGCGCCTGCCC TGGTTAGCAAGAAACTGAACGTCACAGAACAAGAG AAGATTGACAAACTGATGATCGAGATGGATGGAAC AGAAAATAAATCTAAGTTTGGTGCGAACGCCATTC TGGGGGTGTCCCTTGCCGTCTGCAAAGCTGGTGC CGTTGAGAAGGGGGTCCCCCTGTACCGCCACATC GCTGACTTGGCTGGCAACTCTGAAGTCATCCTGCC AGTCCCGGCGTTCAATGTCATCAATGGCGGTTCTC ATGCTGGCAACAAGCTGGCCATGCAGGAGTTCAT GATCCTCCCAGTCGGTGCAGCAAACTTCAGGGAA GCCATGCGCATTGGAGCAGAGGTTTACCACAACC TGAAGAATGTCATCAAGGAGAAATATGGGAAAGAT GCCACCAATGTGGGGGATGAAGGCGGGTTTGCTC CCAACATCCTGGAGAATAAAGAAGGCCTGGAGCT GCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 37 | RSLTLAGIP LLRLISSPQ KVSSELLC PVVLQLVS MRP* |
| 753 | NM_0014 28.2_187 | 187 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCCC ACTGTTGAGGTTGATCTCTTCACCTCAAAAGGTCT CTTCAGAGCTGCTGTGCCCAGTGGTGCTTCAACTG | 35 | LTLAGIPLL RLISSPQK VSSELLCP VVLQLVSM RP* |

TABLE 3A-continued

| SEQ ID | identifier_position | position | modified_RNA | PAP length | PAP |
|---|---|---|---|---|---|
| | | | GTATCTATGAGGCCCTAGAGCTCCGGGACAATGAT<br>AAGACTCGCTATATGGGGAAGGGTGTCTCAAAGG<br>CTGTTGAGCACATCAATAAAACTATTGCGCCTGCC<br>CTGGTTAGCAAGAAACTGAACGTCACAGAACAAGA<br>GAAGATTGACAAACTGATGATCGAGATGGATGGAA<br>CAGAAAATAAATCTAAGTTTGGTGCGAACGCCATT<br>CTGGGGGTGTCCCTTGCCGTCTGCAAAGCTGGTG<br>CCGTTGAGAAGGGGGTCCCCCTGTACCGCCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | | |
| 754 | NM_0014<br>28.2_211 | 211 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTGAGGTTGATCTCTTCACCTCAAAAGGTCT<br>CTTCAGAGCTGCTGTGCCCAGTGGTGCTTCAACTG<br>GTATCTATGAGGCCCTAGAGCTCCGGGACAATGAT<br>AAGACTCGCTATATGGGGAAGGGTGTCTCAAAGG<br>CTGTTGAGCACATCAATAAAACTATTGCGCCTGCC<br>CTGGTTAGCAAGAAACTGAACGTCACAGAACAAGA<br>GAAGATTGACAAACTGATGATCGAGATGGATGGAA<br>CAGAAAATAAATCTAAGTTTGGTGCGAACGCCATT<br>CTGGGGGTGTCCCTTGCCGTCTGCAAAGCTGGTG<br>CCGTTGAGAAGGGGGTCCCCCTGTACCGCCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 26 | RLISSPQK<br>VSSELLCP<br>VVLQLVSM<br>RP* |
| 755 | NM_0014<br>28.2_349 | 349 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTGAGCACATCAATAAAACTATTGCGCCTGCC<br>CTGGTTAGCAAGAAACTGAACGTCACAGAACAAGA<br>GAAGATTGACAAACTGATGATCGAGATGGATGGAA<br>CAGAAAATAAATCTAAGTTTGGTGCGAACGCCATT<br>CTGGGGGTGTCCCTTGCCGTCTGCAAAGCTGGTG<br>CCGTTGAGAAGGGGGTCCCCCTGTACCGCCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT | 15 | STSIKLLRL<br>PWLARN* |

TABLE 3A-continued

| SEQ ID | identifier_position | position | modified_RNA | PAP length | PAP |
|---|---|---|---|---|---|
| | | | GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | | |
| 756 | NM_0014 28.2_370 | 370 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATGCGCCTGCC CTGGTTAGCAAGAAACTGAACGTCACAGAACAAGA GAAGATTGACAAACTGATGATCGAGATGGATGGAA CAGAAAATAAATCTAAGTTTGGTGCGAACGCCATT CTGGGGGTGTCCCTTGCCGTCTGCAAAGCTGGTG CCGTTGAGAAGGGGGTCCCCCTGTACCGCCACAT CGCTGACTTGGCTGGCAACTCTGAAGTCATCCTGC CAGTCCCGGCGTTCAATGTCATCAATGGCGGTTCT CATGCTGGCAACAAGCTGGCCATGCAGGAGTTCA TGATCCTCCCAGTCGGTGCAGCAAACTTCAGGGA AGCCATGCGCATTGGAGCAGAGGTTTACCACAAC CTGAAGAATGTCATCAAGGAGAAATATGGGAAAGA TGCCACCAATGTGGGGGATGAAGGCGGGTTTGCT CCCAACATCCTGGAGAATAAAGAAGGCCTGGAGC TGCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 9 | MRLPWLA RN* |
| 757 | NM_0014 28.2_380 | 380 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CTGGTTAGCAAGAAACTGAACGTCACAGAACAAGA GAAGATTGACAAACTGATGATCGAGATGGATGGAA CAGAAAATAAATCTAAGTTTGGTGCGAACGCCATT CTGGGGGTGTCCCTTGCCGTCTGCAAAGCTGGTG CCGTTGAGAAGGGGGTCCCCCTGTACCGCCACAT CGCTGACTTGGCTGGCAACTCTGAAGTCATCCTGC CAGTCCCGGCGTTCAATGTCATCAATGGCGGTTCT CATGCTGGCAACAAGCTGGCCATGCAGGAGTTCA TGATCCTCCCAGTCGGTGCAGCAAACTTCAGGGA AGCCATGCGCATTGGAGCAGAGGTTTACCACAAC CTGAAGAATGTCATCAAGGAGAAATATGGGAAAGA TGCCACCAATGTGGGGGATGAAGGCGGGTTTGCT CCCAACATCCTGGAGAATAAAGAAGGCCTGGAGC TGCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 5 | WLARN* |
| 758 | NM_0014 28.2_421 | 421 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG | 3 | MTN* |

TABLE 3A-continued

| SEQ ID | identifier_position | position | modified_RNA | PAP length | PAP |
|---|---|---|---|---|---|
| | | | AGAAGATGACAAACTGATGATCGAGATGGATGGAA<br>CAGAAAATAAATCTAAGTTTGGTGCGAACGCCATT<br>CTGGGGGTGTCCCTTGCCGTCTGCAAAGCTGGTG<br>CCGTTGAGAAGGGGGTCCCCCTGTACCGCCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | | |
| 759 | NM_0014<br>28.2_469 | 469 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTGGTGCGAACGCCATT<br>CTGGGGGTGTCCCTTGCCGTCTGCAAAGCTGGTG<br>CCGTTGAGAAGGGGGTCCCCCTGTACCGCCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 63 | LVRTPFWG<br>CPLPSAKL<br>VPLRRGSP<br>CTATSLTW<br>LATLKSSC<br>QSRRSMS<br>SMAVLMLA<br>TSWPCRS<br>S* |
| 760 | NM_0014<br>28.2_548 | 548 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCACAT<br>CGCTGACTTGGCTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC | 36 | TSLTWLAT<br>LKSSCQSR<br>RSMSSMA<br>VLMLATSW<br>PCRSS* |

TABLE 3A-continued

| SEQ ID | identifier_position | position | modified_RNA | PAP length | PAP |
|---|---|---|---|---|---|
| | | | GCCTGACCAGCTGGCTGACCTGTACAAGTCCTTCA<br>TCAAGGACTACCCAGTGGTGTCTA | | |
| 761 | NM_0014<br>28.2_564 | 564 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGTGGCAACTCTGAAGTCATCCTGC<br>CAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 31 | VATLKSSC<br>QSRRSMS<br>SMAVLMLA<br>TSWPCRS<br>S* |
| 762 | NM_0014<br>28.2_600 | 600 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTCT<br>CATGCTGGCAACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 19 | SMSSMAVL<br>MLATSWP<br>CRSS* |
| 763 | NM_0014<br>28.2_631 | 631 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT | 8 | TSWPCRS<br>S* |

TABLE 3A-continued

| SEQ ID | identifier_position | position | modified_RNA | PAP length | PAP |
|---|---|---|---|---|---|
| | | | GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTC<br>TCATGCTGGAACAAGCTGGCCATGCAGGAGTTCAT<br>GATCCTCCCAGTCGGTGCAGCAAACTTCAGGGAA<br>GCCATGCGCATTGGAGCAGAGGTTTACCACAACC<br>TGAAGAATGTCATCAAGGAGAAATATGGGAAAGAT<br>GCCACCAATGTGGGGGATGAAGGCGGGTTTGCTC<br>CCAACATCCTGGAGAATAAAGAAGGCCTGGAGCT<br>GCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | | |
| 764 | NM_0014 28.2_633 | 633 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTC<br>TCATGCTGGCACAAGCTGGCCATGCAGGAGTTCA<br>TGATCCTCCCAGTCGGTGCAGCAAACTTCAGGGA<br>AGCCATGCGCATTGGAGCAGAGGTTTACCACAAC<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 8 | TSWPCRSS* |
| 765 | NM_0014 28.2_643 | 643 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTC<br>TCATGCTGGCAACAAGCTGGCATGCAGGAGTTCAT<br>GATCCTCCCAGTCGGTGCAGCAAACTTCAGGGAA<br>GCCATGCGCATTGGAGCAGAGGTTTACCACAACC<br>TGAAGAATGTCATCAAGGAGAAATATGGGAAAGAT<br>GCCACCAATGTGGGGGATGAAGGCGGGTTTGCTC<br>CCAACATCCTGGAGAATAAAGAAGGCCTGGAGCT<br>GCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 4 | CRSS* |

TABLE 3A-continued

| SEQ ID | identifier_position | position | modified_RNA | PAP length | PAP |
|---|---|---|---|---|---|
| 766 | NM_0014 28.2_681 | 681 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG AGAAGATTGACAAACTGATGATCGAGATGGATGGA ACAGAAAATAAATCTAAGTTTGGTGCGAACGCCAT TCTGGGGGTGTCCCTTGCCGTCTGCAAAGCTGGT GCCGTTGAGAAGGGGGTCCCCCTGTACCGCCACA TCGCTGACTTGGCTGGCAACTCTGAAGTCATCCTG CCAGTCCCGGCGTTCAATGTCATCAATGGCGGTTC TCATGCTGGCAACAAGCTGGCCATGCAGGAGTTC ATGATCCTCCCAGTCGGTGCAGCAACTTCAGGGA AGCCATGCGCATTGGAGCAGAGGTTTACCACAAC CTGAAGAATGTCATCAAGGAGAAATATGGGAAAGA TGCCACCAATGTGGGGGATGAAGGCGGGTTTGCT CCCAACATCCTGGAGAATAAAGAAGGCCTGGAGC TGCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 15 | TSGKPCAL EQRFTTT* |
| 767 | NM_0014 28.2_703 | 703 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG AGAAGATTGACAAACTGATGATCGAGATGGATGGA ACAGAAAATAAATCTAAGTTTGGTGCGAACGCCAT TCTGGGGGTGTCCCTTGCCGTCTGCAAAGCTGGT GCCGTTGAGAAGGGGGTCCCCCTGTACCGCCACA TCGCTGACTTGGCTGGCAACTCTGAAGTCATCCTG CCAGTCCCGGCGTTCAATGTCATCAATGGCGGTTC TCATGCTGGCAACAAGCTGGCCATGCAGGAGTTC ATGATCCTCCCAGTCGGTGCAGCAAACTTCAGGG AAGCCATGCGCATTGGAGCAGAGGTTTACCACAAC CTGAAGAATGTCATCAAGGAGAAATATGGGAAAGA TGCCACCAATGTGGGGGATGAAGGCGGGTTTGCT CCCAACATCCTGGAGAATAAAGAAGGCCTGGAGC TGCTGAAGACTGCTATTGGGAAAGCTGGCTACACT GATAAGGTGGTCATCGGCATGGACGTAGCGGCCT CCGAGTTCTTCAGGTCTGGGAAGTATGACCTGGAC TTCAAGTCTCCCGATGACCCCAGCAGGTACATCTC GCCTGACCAGCTGGCTGACCTGTACAAGTCCTTCA TCAAGGACTACCCAGTGGTGTCTA | 8 | MEQRFTTT* |
| 768 | NM_0014 28.2_725 | 725 | TAGCTAGGCAGGAAGTCGGCGCGGGCGGCGCGG ACAGTATCTGTGGGTACCCGGAGCACGGAGATCT CGCCGGCTTTACGTTCACCTCGGTGTCTGCAGCA CCCTCCGCTTCCTCTCCTAGGCGACGAGACCCAG TGGCTAGAAGTTCACCATGTCTATTCTCAAGATCC ATGCCAGGGAGATCTTTGACTCTCGCGGGAATCC CACTGTTGAGGTTGATCTCTTCACCTCAAAAGGTC TCTTCAGAGCTGCTGTGCCCAGTGGTGCTTCAACT GGTATCTATGAGGCCCTAGAGCTCCGGGACAATG ATAAGACTCGCTATATGGGGAAGGGTGTCTCAAAG GCTGTTGAGCACATCAATAAAACTATTGCGCCTGC CCTGGTTAGCAAGAAACTGAACGTCACAGAACAAG AGAAGATTGACAAACTGATGATCGAGATGGATGGA ACAGAAAATAAATCTAAGTTTGGTGCGAACGCCAT TCTGGGGGTGTCCCTTGCCGTCTGCAAAGCTGGT GCCGTTGAGAAGGGGGTCCCCCTGTACCGCCACA TCGCTGACTTGGCTGGCAACTCTGAAGTCATCCTG | 0 | * |

TABLE 3A-continued

| SEQ ID | identifier_position | position | modified_RNA | length PAP | PAP |
|---|---|---|---|---|---|
| | | | CCAGTCCCGGCGTTCAATGTCATCAATGGCGGTTC<br>TCATGCTGGCAACAAGCTGGCCATGCAGGAGTTC<br>ATGATCCTCCCAGTCGGTGCAGCAAACTTCAGGG<br>AAGCCATGCGCATTGGAGCAGAGGTTTACCACAA<br>CTGAAGAATGTCATCAAGGAGAAATATGGGAAAGA<br>TGCCACCAATGTGGGGGATGAAGGCGGGTTTGCT<br>CCCAACATCCTGGAGAATAAAGAAGGCCTGGAGC<br>TGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | | |
| 769 | NM_0014<br>28.2_844 | 844 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTC<br>TCATGCTGGCAACAAGCTGGCCATGCAGGAGTTC<br>ATGATCCTCCCAGTCGGTGCAGCAAACTTCAGGG<br>AAGCCATGCGCATTGGAGCAGAGGTTTACCACAA<br>CCTGAAGAATGTCATCAAGGAGAAATATGGGAAAG<br>ATGCCACCAATGTGGGGGATGAAGGCGGGTTTGC<br>TCCCAACATCCTGGAGAATAAAGAAGGCCTGGAG<br>CTGCTGAAGACTGCTATTGGGAAAGCTGGCTACACT<br>GATAAGGTGGTCATCGGCATGGACGTAGCGGCCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 15 | MGKLATLI<br>RWSSAWT* |
| 770 | NM_0014<br>28.2_895 | 895 | TAGCTAGGCAGGAAGTCGGCGCGGGCGGCGCGG<br>ACAGTATCTGTGGGTACCCGGAGCACGGAGATCT<br>CGCCGGCTTTACGTTCACCTCGGTGTCTGCAGCA<br>CCCTCCGCTTCCTCTCCTAGGCGACGAGACCCAG<br>TGGCTAGAAGTTCACCATGTCTATTCTCAAGATCC<br>ATGCCAGGGAGATCTTTGACTCTCGCGGGAATCC<br>CACTGTTGAGGTTGATCTCTTCACCTCAAAAGGTC<br>TCTTCAGAGCTGCTGTGCCCAGTGGTGCTTCAACT<br>GGTATCTATGAGGCCCTAGAGCTCCGGGACAATG<br>ATAAGACTCGCTATATGGGGAAGGGTGTCTCAAAG<br>GCTGTTGAGCACATCAATAAAACTATTGCGCCTGC<br>CCTGGTTAGCAAGAAACTGAACGTCACAGAACAAG<br>AGAAGATTGACAAACTGATGATCGAGATGGATGGA<br>ACAGAAAATAAATCTAAGTTTGGTGCGAACGCCAT<br>TCTGGGGGTGTCCCTTGCCGTCTGCAAAGCTGGT<br>GCCGTTGAGAAGGGGGTCCCCCTGTACCGCCACA<br>TCGCTGACTTGGCTGGCAACTCTGAAGTCATCCTG<br>CCAGTCCCGGCGTTCAATGTCATCAATGGCGGTTC<br>TCATGCTGGCAACAAGCTGGCCATGCAGGAGTTC<br>ATGATCCTCCCAGTCGGTGCAGCAAACTTCAGGG<br>AAGCCATGCGCATTGGAGCAGAGGTTTACCACAA<br>CCTGAAGAATGTCATCAAGGAGAAATATGGGAAAG<br>ATGCCACCAATGTGGGGGATGAAGGCGGGTTTGC<br>TCCCAACATCCTGGAGAATAAAGAAGGCCTGGAG<br>CTGCTGAAGACTGCTATTGGGAAAGCTGGCTACAC<br>TGATAAGGTGGTCATCGGCATGGACGTAGCGGCT<br>CCGAGTTCTTCAGGTCTGGGAAGTATGACCTGGAC<br>TTCAAGTCTCCCGATGACCCCAGCAGGTACATCTC<br>GCCTGACCAGCTGGCTGACCTGTACAAGTCCTTCA<br>TCAAGGACTACCCAGTGGTGTCTA | 66 | PSSSGLGS<br>MTWTSSLP<br>MTPAGTSR<br>LTSWLTCT<br>SPSSRTTQ<br>WCLSKIPL<br>TRMTGELG<br>RSSQPVQ<br>ESR* |
| 771 | NM_0014<br>69.3_250 | 250 | GCGCATGCGTGGATTGTCGTCTTCTGTCCAAGTTG<br>GTCGCTTCCCTGCGCCAAAGTGAGCAGTAGCCAA<br>CATGTCAGGGTGGGAGTCATATTACAAAACCGAG<br>GGCGATGAAGAAGCAGAGGAAGAACAAGAAGAGA | 2 | LT* |

TABLE 3A-continued

| SEQ ID | identifier_position | position | modified_RNA | PAP length | PAP |
|---|---|---|---|---|---|
| | | | ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTGACATGAGCATCCAGTGTATCCAAAGTGT GTACATCAGTAAGATCATAAGCAGTGATCGAGATC TCTTGGCTGTGGTGTTCTATGGTACCGAGAAAGAC AAAAATTCAGTGAATTTTAAAAATATTTACGTCTTAC AGGAGCTGGATAATCCAGGTGCAAAACGAATTCTA GAGCTTGACCAGTTTAAGGGGCAGCAGGGACAAA AACGTTTCCAAGACATGATGGGCCACGGATCTGAC TACTCACTCAGTGAAGTGCTGTGGGTCTGTGCCAA CCTCTTTAGTGATGTCCAATTCAAGATGAGTCATAA GAGGATCATGCTGTTCACCAATGAAGACAACCCCC ATGGCAATGACAGTGCCAAAGCCAGCCGGGCCAG GACCAAAGCCGGTGATCTCCGAGATACAGGCATC TTCCTTGACTTGATGCACCTGAAGAAACCTGGGGG CTTTGACATATCCTTGTTCTACAGAGATATCATCAG CATAGCAGAGGATGAGGACCTCAGGGTTCACTTT GAGGAATCCAGCAAGCTAGAAGACCTGTTGCGGA AGGTTCGCGCCAAGGAGACCAGGAAGCGAGCACT CAGCAGGTTAAAGCTGAAGCTCAACAAAGATATAG TGATCTCTGTGGGCATTTATAATCTGGTCCAGAAG GCTCTCAAGCCTCCTCCAATAAAGCTCTATCGGGA AACAAATGAACCAGTGAAAACCAAGACCCGGACCT TAATACAAGTACAGGCGGTTTGCTTCTGCCTAGC GATACCAAGAGGT | | |
| 772 | NM_0014 69.3_596 | 596 | GCGCATGCGTGGATTGTCGTCTTCTGTCCAAGTTG GTCGCTTCCCTGCGCCAAAGTGAGCAGTAGCCAA CATGTCAGGGTGGGAGTCATATTACAAAACCGAG GGCGATGAAGAAGCAGAGGAAGAACAAGAAGAGA ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTTGACATGAGCATCCAGTGTATCCAAAGTG TGTACATCAGTAAGATCATAAGCAGTGATCGAGAT CTCTTGGCTGTGGTGTTCTATGGTACCGAGAAAGA CAAAAATTCAGTGAATTTTAAAAATATTTACGTCTTA CAGGAGCTGGATAATCCAGGTGCAAAACGAATTCT AGAGCTTGACCAGTTTAAGGGGCAGCAGGGACAA AAACGTTTCCAAGACATGATGGGCCACGGATCTGA CTACTCACTCAGTGAAGTGCTGTGGGTCTGTGCCA ACCTCTTTAGTGATGTCCAATTCAAGATGAGTCATA AGAGGATCATGCTGTTCACCAATGAAGACAACCCC ATGGCAATGACAGTGCCAAAGCCAGCCGGGCCAG GACCAAAGCCGGTGATCTCCGAGATACAGGCATC TTCCTTGACTTGATGCACCTGAAGAAACCTGGGGG CTTTGACATATCCTTGTTCTACAGAGATATCATCAG CATAGCAGAGGATGAGGACCTCAGGGTTCACTTT GAGGAATCCAGCAAGCTAGAAGACCTGTTGCGGA AGGTTCGCGCCAAGGAGACCAGGAAGCGAGCACT CAGCAGGTTAAAGCTGAAGCTCAACAAAGATATAG TGATCTCTGTGGGCATTTATAATCTGGTCCAGAAG GCTCTCAAGCCTCCTCCAATAAAGCTCTATCGGGA AACAAATGAACCAGTGAAAACCAAGACCCGGACCT TAATACAAGTACAGGCGGTTTGCTTCTGCCTAGC GATACCAAGAGGT | 26 | MAMTVPK PAGPGPKP VISEIQASS LT* |
| 773 | NM_0014 69.3_623 | 623 | GCGCATGCGTGGATTGTCGTCTTCTGTCCAAGTTG GTCGCTTCCCTGCGCCAAAGTGAGCAGTAGCCAA CATGTCAGGGTGGGAGTCATATTACAAAACCGAG GGCGATGAAGAAGCAGAGGAAGAACAAGAAGAGA ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTTGACATGAGCATCCAGTGTATCCAAAGTG TGTACATCAGTAAGATCATAAGCAGTGATCGAGAT CTCTTGGCTGTGGTGTTCTATGGTACCGAGAAAGA CAAAAATTCAGTGAATTTTAAAAATATTTACGTCTTA CAGGAGCTGGATAATCCAGGTGCAAAACGAATTCT AGAGCTTGACCAGTTTAAGGGGCAGCAGGGACAA AAACGTTTCCAAGACATGATGGGCCACGGATCTGA CTACTCACTCAGTGAAGTGCTGTGGGTCTGTGCCA ACCTCTTTAGTGATGTCCAATTCAAGATGAGTCATA AGAGGATCATGCTGTTCACCAATGAAGACAACCCC CATGGCAATGACAGTGCCAAAGCCAGCCGGGCCAG GACCAAAGCCGGTGATCTCCGAGATACAGGCATC TTCCTTGACTTGATGCACCTGAAGAAACCTGGGGG CTTTGACATATCCTTGTTCTACAGAGATATCATCAG | 17 | GPGPKPVI SEIQASSLT* |

TABLE 3A-continued

| SEQ ID | identifier_position | position | modified_RNA | PAP length | PAP |
|---|---|---|---|---|---|
| | | | CATAGCAGAGGATGAGGACCTCAGGGTTCACTTT GAGGAATCCAGCAAGCTAGAAGACCTGTTGCGGA AGGTTCGCGCCAAGGAGACCAGGAAGCGAGCACT CAGCAGGTTAAAGCTGAAGCTCAACAAAGATATAG TGATCTCTGTGGGCATTTATAATCTGGTCCAGAAG GCTCTCAAGCCTCCTCCAATAAAGCTCTATCGGGA AACAAATGAACCAGTGAAAACCAAGACCCGGACCT TTAATACAAGTACAGGCGGTTTGCTTCTGCCTAGC GATACCAAGAGGT | | |
| 774 | NM_0014 69.3_628 | 628 | GCGCATGCGTGGATTGTCGTCTTCTGTCCAAGTTG GTCGCTTCCCTGCGCCAAAGTGAGCAGTAGCCAA CATGTCAGGGTGGGAGTCATATTACAAAACCGAG GGCGATGAAGAAGCAGAGGAAGAACAAGAAGAGA ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTTGACATGAGCATCCAGTGTATCCAAAGTG TGTACATCAGTAAGATCATAAGCAGTGATCGAGAT CTCTTGGCTGTGGTGTTCTATGGTACCGAGAAAGA CAAAAATTCAGTGAATTTTAAAAATATTTACGTCTTA CAGGAGCTGGATAATCCAGGTGCAAAACGAATTCT AGAGCTTGACCAGTTTAAGGGGCAGCAGGGACAA AAACGTTTCCAAGACATGATGGGCCACGGATCTGA CTACTCACTCAGTGAAGTGCTGTGGGTCTGTGCCA ACCTCTTTAGTGATGTCCAATTCAAGATGAGTCATA AGAGGATCATGCTGTTCACCAATGAAGACAACCCC CATGGCAATGACAGTGCCAAAGCCAGCCGGGCAG GACCAAAGCCGGTGATCTCCGAGATACAGGCATC TTCCTTGACTTGATGCACCTGAAGAAACCTGGGGG CTTTGACATATCCTTGTTCTACAGAGATATCATCAG CATAGCAGAGGATGAGGACCTCAGGGTTCACTTT GAGGAATCCAGCAAGCTAGAAGACCTGTTGCGGA AGGTTCGCGCCAAGGAGACCAGGAAGCGAGCACT CAGCAGGTTAAAGCTGAAGCTCAACAAAGATATAG TGATCTCTGTGGGCATTTATAATCTGGTCCAGAAG GCTCTCAAGCCTCCTCCAATAAAGCTCTATCGGGA AACAAATGAACCAGTGAAAACCAAGACCCGGACCT TTAATACAAGTACAGGCGGTTTGCTTCTGCCTAGC GATACCAAGAGGT | 15 | GPKPVISEI QASSLT* |
| 775 | NM_0014 69.3_703 | 703 | GCGCATGCGTGGATTGTCGTCTTCTGTCCAAGTTG GTCGCTTCCCTGCGCCAAAGTGAGCAGTAGCCAA CATGTCAGGGTGGGAGTCATATTACAAAACCGAG GGCGATGAAGAAGCAGAGGAAGAACAAGAAGAGA ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTTGACATGAGCATCCAGTGTATCCAAAGTG TGTACATCAGTAAGATCATAAGCAGTGATCGAGAT CTCTTGGCTGTGGTGTTCTATGGTACCGAGAAAGA CAAAAATTCAGTGAATTTTAAAAATATTTACGTCTTA CAGGAGCTGGATAATCCAGGTGCAAAACGAATTCT AGAGCTTGACCAGTTTAAGGGGCAGCAGGGACAA AAACGTTTCCAAGACATGATGGGCCACGGATCTGA CTACTCACTCAGTGAAGTGCTGTGGGTCTGTGCCA ACCTCTTTAGTGATGTCCAATTCAAGATGAGTCATA AGAGGATCATGCTGTTCACCAATGAAGACAACCCC CATGGCAATGACAGTGCCAAAGCCAGCCGGGCCA GGACCAAAGCCGGTGATCTCCGAGATACAGGCAT CTTCCTTGACTTGATGCACCTGAAGAAACCTGGGG GCTTGACATATCCTTGTTCTACAGAGATATCATCAG CATAGCAGAGGATGAGGACCTCAGGGTTCACTTT GAGGAATCCAGCAAGCTAGAAGACCTGTTGCGGA AGGTTCGCGCCAAGGAGACCAGGAAGCGAGCACT CAGCAGGTTAAAGCTGAAGCTCAACAAAGATATAG TGATCTCTGTGGGCATTTATAATCTGGTCCAGAAG GCTCTCAAGCCTCCTCCAATAAAGCTCTATCGGGA AACAAATGAACCAGTGAAAACCAAGACCCGGACCT TTAATACAAGTACAGGCGGTTTGCTTCTGCCTAGC GATACCAAGAGGT | 12 | LTYPCSTEI SSA* |
| 776 | NM_0014 69.3_999 | 999 | GCGCATGCGTGGATTGTCGTCTTCTGTCCAAGTTG GTCGCTTCCCTGCGCCAAAGTGAGCAGTAGCCAA CATGTCAGGGTGGGAGTCATATTACAAAACCGAG GGCGATGAAGAAGCAGAGGAAGAACAAGAAGAGA ACCTTGAAGCAAGTGGAGACTATAAATATTCAGGA AGAGATAGTTTGATTTTTTTGGTTGATGCCTCCAAG GCTATGTTTGAATCTCAGAGTGAAGATGAGTTGAC ACCTTTTGACATGAGCATCCAGTGTATCCAAAGTG | 27 | CFCLAIPR GLRSMGV VRLYWRK RKQKS* |

TABLE 3A-continued

| SEQ ID | identifier_position | position | modified_RNA | PAP length | PAP |
|---|---|---|---|---|---|
| | | | TGTACATCAGTAAGATCATAAGCAGTGATCGAGAT<br>CTCTTGGCTGTGGTGTTCTATGGTACCGAGAAAGA<br>CAAAAATTCAGTGAATTTTAAAAATATTTACGTCTTA<br>CAGGGAGCTGGATAATCCAGGTGCAAAACGAATTCT<br>AGAGCTTGACCAGTTTAAGGGGCAGCAGGGACAA<br>AAACGTTTCCAAGACATGATGGGCCACGGATCTGA<br>CTACTCACTCAGTGAAGTGCTGTGGGTCTGTGCCA<br>ACCTCTTTAGTGATGTCCAATTCAAGATGAGTCATA<br>AGAGGATCATGCTGTTCACCAATGAAGACAACCCC<br>CATGGCAATGACAGTGCCAAAGCCAGCCGGGCCA<br>GGACCAAAGCCGGTGATCTCCGAGATACAGGCAT<br>CTTCCTTGACTTGATGCACCTGAAGAAACCTGGGG<br>GCTTTGACATATCCTTGTTCTACAGAGATATCATCA<br>GCATAGCAGAGGATGAGGACCTCAGGGTTCACTT<br>TGAGGAATCCAGCAAGCTAGAAGACCTGTTGCGG<br>AAGGTTCGCGCCAAGGAGACCAGGAAGCGAGCAC<br>TCAGCAGGTTAAAGCTGAAGCTCAACAAAGATATA<br>GTGATCTCTGTGGGCATTTATAATCTGGTCCAGAA<br>GGCTCTCAAGCCTCCTCCAATAAAGCTCTATCGGG<br>AAACAAATGAACCAGTGAAAACCAAGACCCGGACC<br>TTTAATACAAGTACAGGCGGTTGCTTCTGCCTAGC<br>GATACCAAGAGGT | | |
| 777 | NM_0014<br>94.2_120<br>2 | 1202 | GGCGGTCGGTCTCGCCTTGTCGCCAGCTCCATTTT<br>CCTCTCTTTCTCTTCCCCTTTCCTTCGCGCCCAAG<br>AGCGCCTCCCAGCCTCGTAGGGTGGTCACGGAGC<br>CCCTGCGCCTTTTCCTTGCTCGGGTCCTGCGTCC<br>GCGCCTGCCCCGCCATGAATGAGGAGTACGACGT<br>GATCGTGCTGGGCACCGGCCTGACGGAATGTATC<br>CTGTCAGGTATAATGTCAGTGAATGGCAAGAAAGT<br>TCTTCATATGGATCGAAACCCTTACTACGGAGGAG<br>AAAGTGCATCTATAACACCATTGGAAGATTTATACA<br>AAAGATTTAAAATACCAGGATCACCACCCGAGTCA<br>ATGGGGAGAGGAAGAGACTGGAATGTTGACTTGA<br>TTCCCAAGTTCCTTATGGCTAATGGTCAGCTGGTT<br>AAGATGCTGCTTTATACAGAGGTAACTCGCTATCT<br>GGATTTTAAAGTGACTGAAGGGAGCTTTGTCTATA<br>AGGGTGGAAAAATCTACAAGGTTCCTTCCACTGAA<br>GCAGAAGCCCTGGCATCTAGCCTAATGGGATTGTT<br>TGAAAAACGTCGCTTCAGGAAATTCCTAGTGTATG<br>TTGCCAACTTCGATGAAAAAGATCCAAGAACTTTT<br>GAAGGCATTGATCCTAAGAAGACCACAATGCGAGA<br>TGTGTATAAGAAATTTGATTTGGGTCAAGACGTTAT<br>AGATTTTACTGGTCATGCTCTTGCACTTTACAGAAC<br>TGATGATTACTTAGATCAACCGTGTTATGAAACCAT<br>TAATAGAATTAAACTTTACAGTGAATCTTTGGCAAG<br>ATATGGCAAAAGCCCATACCTTTATCCACTCTATG<br>GCCTTGGAGAACTGCCCCAAGGATTTGCAAGGCT<br>AAGTGCTATTTATGGAGGTACCTATATGCTGAATAA<br>ACCCATTGAAGAAATCATTGTACAGAATGGAAAAG<br>TAATTGGTGTAAAATCTGAAGGAGAAATTGCTCGC<br>TGTAAGCAGCTCATCTGTGACCCCAGCTACGTAAA<br>AGATCGGGT | 2 | ML* |
| 778 | NM_0014<br>94.2_129<br>2 | 1292 | GGCGGTCGGTCTCGCCTTGTCGCCAGCTCCATTTT<br>CCTCTCTTTCTCTTCCCCTTTCCTTCGCGCCCAAG<br>AGCGCCTCCCAGCCTCGTAGGGTGGTCACGGAGC<br>CCCTGCGCCTTTTCCTTGCTCGGGTCCTGCGTCC<br>GCGCCTGCCCCGCCATGAATGAGGAGTACGACGT<br>GATCGTGCTGGGCACCGGCCTGACGGAATGTATC<br>CTGTCAGGTATAATGTCAGTGAATGGCAAGAAAGT<br>TCTTCATATGGATCGAAACCCTTACTACGGAGGAG<br>AAAGTGCATCTATAACACCATTGGAAGATTTATACA<br>AAAGATTTAAAATACCAGGATCACCACCCGAGTCA<br>ATGGGGAGAGGAAGAGACTGGAATGTTGACTTGA<br>TTCCCAAGTTCCTTATGGCTAATGGTCAGCTGGTT<br>AAGATGCTGCTTTATACAGAGGTAACTCGCTATCT<br>GGATTTTAAAGTGACTGAAGGGAGCTTTGTCTATA<br>AGGGTGGAAAAATCTACAAGGTTCCTTCCACTGAA<br>GCAGAAGCCCTGGCATCTAGCCTAATGGGATTGTT<br>TGAAAAACGTCGCTTCAGGAAATTCCTAGTGTATG<br>TTGCCAACTTCGATGAAAAAGATCCAAGAACTTTT<br>GAAGGCATTGATCCTAAGAAGACCACAATGCGAGA<br>TGTGTATAAGAAATTTGATTTGGGTCAAGACGTTAT<br>AGATTTTACTGGTCATGCTCTTGCACTTTACAGAAC<br>TGATGATTACTTAGATCAACCGTGTTATGAAACCAT<br>TAATAGAATTAAACTTTACAGTGAATCTTTGGCAAG<br>ATATGGCAAAAGCCCATACCTTTATCCACTCTATG<br>GCCTTGGAGAACTGCCCCAAGGATTTGCAAGGCT | 44 | LLASVTSW<br>YQKTWEQ<br>KARSLFPA<br>HMMPPLIL<br>RQRVMTLK<br>TSIRG* |

TABLE 3A-continued

| SEQ ID | identifier_ position | position | modified_RNA | PAP length | PAP |
|---|---|---|---|---|---|
| | | | AAGTGCTATTTATGGAGGTACCTATATGCTGAATAA ACCCATTGAAGAAATCATTGTACAGAATGGAAAAG TAATTGGTGTAAAATCTGAAGGAGAAATTGCTCGC TGTAAGCAGCTCATCTGTGACCCCAGCTACGTAAA AGATCGGGT | | |
| 779 | NM_0014 94.2_479 | 479 | GGCGGTCGGTCTCGCCTTGTCGCCAGCTCCATTTT CCTCTCTTTCTCTTCCCCTTTCCTTCGCGCCCAAG AGCGCCTCCCAGCCTCGTAGGGTGGTCACGGAGC CCCTGCGCCTTTTCCTTGCTCGGGTCCTGCGTCC GCGCCTGCCCCGCCATGAATGAGGAGTACGACGT GATCGTGCTGGGCACCGGCCTGACGGAATGTATC CTGTCAGGTATAATGTCAGTGAATGGCAAGAAAGT TCTTCATATGGATCGAAACCCTTACTACGGAGGAG AAAGTGCATCTATAACACCATTGGAAGATTTATACA AAAGATTTAAAATACCAGGATCACCACCCGAGTCA ATGGGGAGAGGAAGAGACTGGAATGTTGACTTGA TTCCCAAGTTCCTTATGGCTAATGGTCAGCTGGTT AAGATGCTGCTTTATACAGAGGTAACTCGCTATCT GGATTTTAAAGTGACTGAAGGGAGCTTGTCTATAA GGGTGGAAAAATCTACAAGGTTCCTTCCACTGAAG CAGAAGCCCTGGCATCTAGCCTAATGGGATTGTTT GAAAAACGTCGCTTCAGGAAATTCCTAGTGTATGT TGCCAACTTCGATGAAAAAGATCCAAGAACTTTTG AAGGCATTGATCCTAAGAAGACCACAATGCGAGAT GTGTATAAGAAATTTGATTTGGGTCAAGACGTTATA GATTTTACTGGTCATGCTCTTGCACTTTACAGAACT GATGATTACTTAGATCAACCGTGTTATGAAACCATT AATAGAATTAAACTTTACAGTGAATCTTTGGCAAGA TATGGCAAAAGCCCATACCTTTATCCACTCTATGG CCTTGGAGAACTGCCCCAAGGATTTGCAAGGCTAA GTGCTATTTATGGAGGTACCTATATGCTGAATAAA CCCATTGAAGAAATCATTGTACAGAATGGAAAAGT AATTGGTGTAAAATCTGAAGGAGAAATTGCTCGCT GTAAGCAGCTCATCTGTGACCCCAGCTACGTAAAA GATCGGGTA | 22 | LSIRVEKST RFLPLKQK PWHLA* |
| 780 | NM_0014 94.2_553 | 553 | GGCGGTCGGTCTCGCCTTGTCGCCAGCTCCATTTT CCTCTCTTTCTCTTCCCCTTTCCTTCGCGCCCAAG AGCGCCTCCCAGCCTCGTAGGGTGGTCACGGAGC CCCTGCGCCTTTTCCTTGCTCGGGTCCTGCGTCC GCGCCTGCCCCGCCATGAATGAGGAGTACGACGT GATCGTGCTGGGCACCGGCCTGACGGAATGTATC CTGTCAGGTATAATGTCAGTGAATGGCAAGAAAGT TCTTCATATGGATCGAAACCCTTACTACGGAGGAG AAAGTGCATCTATAACACCATTGGAAGATTTATACA AAAGATTTAAAATACCAGGATCACCACCCGAGTCA ATGGGGAGAGGAAGAGACTGGAATGTTGACTTGA TTCCCAAGTTCCTTATGGCTAATGGTCAGCTGGTT AAGATGCTGCTTTATACAGAGGTAACTCGCTATCT GGATTTTAAAGTGACTGAAGGGAGCTTTGTCTATA AGGGTGGAAAAATCTACAAGGTTCCTTCCACTGAA GCAGAAGCCCTGGCATCTAGCCTAATGGGATGTTT GAAAAACGTCGCTTCAGGAAATTCCTAGTGTATGT TGCCAACTTCGATGAAAAAGATCCAAGAACTTTTG AAGGCATTGATCCTAAGAAGACCACAATGCGAGAT GTGTATAAGAAATTTGATTTGGGTCAAGACGTTATA GATTTTACTGGTCATGCTCTTGCACTTTACAGAACT GATGATTACTTAGATCAACCGTGTTATGAAACCATT AATAGAATTAAACTTTACAGTGAATCTTTGGCAAGA TATGGCAAAAGCCCATACCTTTATCCACTCTATGG CCTTGGAGAACTGCCCCAAGGATTTGCAAGGCTAA GTGCTATTTATGGAGGTACCTATATGCTGAATAAA CCCATTGAAGAAATCATTGTACAGAATGGAAAAGT AATTGGTGTAAAATCTGAAGGAGAAATTGCTCGCT GTAAGCAGCTCATCTGTGACCCCAGCTACGTAAAA GATCGGGTA | 10 | CLKNVASG NS* |
| 781 | NM_0015 17.4_527 | 527 | CTTTTCCACTCCTCCCCTTACCTCCCTTCTCTTCTG AATTCTCCATTCTGGGCTCTTGCCTGTGAAATCTTT CTTTGCTTTCCCCATCTTTTCCTGCGCATTTTTTCAC CATCTTTCCCTCAATCTCCAGGAGCCAATGCGAGA CTTTGGCTCCGATTAAGCGACGGCCCGAGACTCG GGGTGCGCGAGGAGGATCGACAGAGTGGTGATG GAGAGCACCCCTTCAAGGGGACTGAACCGAGTAC ACCTACAATGCAGGAATCTGCAGGAATTCTTAGGG GGCCTGAGCCCTGGGGTATTGGACCGATTGTATG GGCACCCTGCCACATGTCTGGCTGTCTTCAGGGA GCTCCCATCCTTGGCTAAGAACTGGGTGATGCGG ATGCTCTTTCTGGAGCAGCCTTTGCCACAGGCTGC | 78 | ASSSTPFS ARTSALPF WVGGRPG LMTQVSW DQTSMPG TFPPLTST PRSDGRW SCTSWWA PPVQLSAR TWLSSSAR LGS* |

TABLE 3A-continued

| SEQ ID | identifier_position | position | modified_RNA | PAP length | PAP |
|---|---|---|---|---|---|
| | | | TGTAGCTCTGTGGGTAAAGAAGGAATTCAGCAAGG CTCAGGAGGAAAGTACAGGGCTGCTGAGCGGCCT CCGGATCTGGCACACACAGCTGCTCCCAGGCGGG CTCCAGGCCTCATCCTCAACCCCATTTTCCGCCAG AACCTCCGCATTGCCCTTCTGGGTGGGGGGAAGG CCTGGTCTGATGACACAAGTCAGCTGGGACCAGA CAAGCATGCCCGGGACGTTCCCTCCCTTGACAAG TACGCCGAGGAGCGATGGGAGGTGGTCTTGCACT TCATGGTGGGCTCCCCCAGTGCAGCTGTCAGCCA GGACTTGGCTCAGCTCCTCAGCCAGGCTGGGCTC ATGAAGAGTACTGAACCTGGAGAGCCGCCCTGCA TTACTTCCGCTGGCTTCCAGTTCCTGTTGCTGGAC ACCCCGGCTCAGCTCTGGTACTTTATGTTGCAGTA TTTGCAGACAGCCCAGAGCCGGGGCATGGACCTG GTAGAGATTCTCTCCTTCCTCTTCCAGCTCAGCTT CTCTACTCTGGGCAAGGATTACTCTGTGGAAGGTA TGAGTGATTCTCTGTTGAACTTCCTGCAACATCTG CGTGAGTTTGGGCTTGTTTTCCA | | |
| 782 | NM_0015 51.2_537 | 537 | GGATCTTCAAACCGTGGGAGTGGTGCGGCGGCTA GAGTCCCTGGACTCCTCAACCTAGGGAGCTACTC GCGAGATGCCTACGACTTGTAACGGGCTGCCTGG TAAAATGAGTCTATGGAAACGGTTGCCAGGGCCG GCTAACAGCGGCTCCCGGAAGTCCTTTGATGCTTT GTTAACAGTGAAGCTACTGGACCAATGAGGTGCTT CTTCCGGTTTTGTCCGCGCTCGCCTAATTCTTCTTT ATCAAGGTTGCCTTTGACCCCGGAAAAGAGATCTT CCGGGTTCCTCTCTCCCCAAGATGGCTGCTGAGG ACGAGTTACAGCTGCCGCGGCTCCCCGAGCTGTT CGAAACTGGTAGACAGTTACTGGACGAAGTAGAA GTGGCGACTGAACCCGCCGGTTCCCGGATAGTCC AGGAGAAGGTGTTCAAGGGCTTGGACCTCCTTGA GAAGGCTGCCGAAATGTTATCGCAGCTCGACTTGT TCAGCCGAAATGAAGATTTGGAAGAGATTGCTTCC ACCGACCTGAAGTACCTTTGGTGCCAGCGTTTCAA GGAGCCCTCACCATGAAACAAGTCAACCCCAGCA AGCGTCTAGATCATTTGCAGCGGGCTCGAGAACA CTTTATAAACTACTTAACTCAGTGCCATTGCTATCA TGTGGCAGAGTTTGAGCTGCCCAAAACCATGAACA ACTCTGCTGAAAATCACACTGCCAATTCCTCCATG GCTTATCCTAGTCTCGTTGCTATGGCATCTCAAAG ACAGGCTAAAATACAGAGATACAAGCAGAAGAAGG AGTTGGAGCATAGGTTGTCTGCAATGAAATCTGCT GTGGAAAGTGGTCAAGCAGATGATGAGCGTGTTC GTGAATATTATCTTCTTCACCTTCAGAGGTGGATTG ATATCAGCTTAGAAGAGATTGAGAGCATTGACCAG GAAATAAAGATCCTGAGAGAAAGAGACTCTTCAAG AGAGGCATCAACTTCTAACTCATCTCGCCAGGAGA GGCCTCCAGTGAAACCCT | 10 | WCQRFKE PSP* |
| 783 | NM_0015 68.2_153 | 153 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATGGACCTTCTTAGTGATACCAACATG GTAGACTTTGCTATGGATGTATACAAAAAACCTTTAT TCTGATGATATTCCTCATGCTTTGAGAGAGAAAAG AACCACAGTGGTTGCACAACTGAAACAGCTTCAGG CAGAAACAGAACCAATTGTGAAGATGTTTGAAGAT CCAGAAACTACAAGGCAAATGCAGTCAACCAGGG ATGGTAGGATGCTCTTTGACTACCTGGCGGACAAG CATGGTTTTAGGCAGGAATATTTAGATACACTCTAC AGATATGCAAAATTCCAGTACGAATGTGGGAATTA CTCAGGAGCAGCAGAATATCTTTATTTTTTAGAGT GCTGGTTCCAGCAACAGATAGAAATGCTTTAAGTT CACTCTGGGGAAAGCTGGCCTCTGAAATCTTAATG CAGAATTGGGATGCAGCCATGGAAGACCTTACAC GGTTAAAAGAGACCATAGATAATAATTCTGTGAGTT CTCCACTTCAGTCTCTTCAGCAGAGAACATGGCTC ATTCACTGGTCTCTGTTTGTTTTCTTCAATCACCCC AAAGGTCGCGATAATATTATTGACCTCTTCCTTTAT CAGCCACAATATCTTAATGCAATTCAGACAATGTGT CCACACATTCTTCGCTATTTGACTACAGCAGTCATA ACAAACAAGGATGTTCGAAAACGTCGGCAGGTTCT AAAAGATCTAGTTAAAGTTATTCAACAGGAGTCTTA CACATATAAAGACCCAATTACAGAATTTGTTGAATG TTTATATGTTAACTTTGACTTTGATGGGGCTCAGAA AAAGCTGAGGGAATGTGAATCAGTGCTTGTGAATG ACTTCTTCTTGGTGGCTTGTCTTGAGGATTTCA | 9 | WTFLVIPT W* |

TABLE 3A-continued

| SEQ ID | identifier_position | position | modified_RNA | PAP length | PAP |
|---|---|---|---|---|---|
| 784 | NM_0015 68.2_187 | 187 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTGCTATGGATGTATACAAAAACCTTTAT TCTGATGATATTCCTCATGCTTTGAGAGAGAAAAG AACCACAGTGGTTGCACAACTGAAACAGCTTCAGG CAGAAACAGAACCAATTGTGAAGATGTTTGAAGAT CCAGAAACTACAAGGCAAATGCAGTCAACCAGGG ATGGTAGGATGCTCTTTGACTACCTGGCGGACAAG CATGGTTTTAGGCAGGAATATTTAGATACACTCTAC AGATATGCAAAATTCCAGTACGAATGTGGGAATTA CTCAGGAGCAGCAGAATATCTTTATTTTTTTAGAGT GCTGGTTCCAGCAACAGATAGAAATGCTTTAAGTT CACTCTGGGGAAAGCTGGCCTCTGAAATCTTAATG CAGAATTGGGATGCAGCCATGGAAGACCTTACAC GGTTAAAAGAGACCATAGATAATAATTCTGTGAGTT CTCCACTTCAGTCTCTTCAGCAGAGAACATGGCTC ATTCACTGGTCTCTGTTTGTTTTCTTCAATCACCCC AAAGGTCGCGATAATATTATTGACCTCTTCCTTTAT CAGCCACAATATCTTAATGCAATTCAGACAATGTGT CCACACATTCTTCGCTATTTGACTACAGCAGTCATA ACAAACAAGGATGTTCGAAAACGTCGGCAGGTTCT AAAAGATCTAGTTAAAGTTATTCAACAGGAGTCTTA CACATATAAAGACCCAATTACAGAATTTGTTGAATG TTTATATGTTAACTTTGACTTTGATGGGGCTCAGAA AAAGCTGAGGGAATGTGAATCAGTGCTTGTGAATG ACTTCTTCTTGGTGGCTTGTCTTGAGGATTTCA | 17 | LLWMYTKT FILMIFLML* |
| 785 | NM_0015 68.2_237 | 237 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTGAGAGAGAAAAG AACCACAGTGGTTGCACAACTGAAACAGCTTCAGG CAGAAACAGAACCAATTGTGAAGATGTTTGAAGAT CCAGAAACTACAAGGCAAATGCAGTCAACCAGGG ATGGTAGGATGCTCTTTGACTACCTGGCGGACAAG CATGGTTTTAGGCAGGAATATTTAGATACACTCTAC AGATATGCAAAATTCCAGTACGAATGTGGGAATTA CTCAGGAGCAGCAGAATATCTTTATTTTTTTAGAGT GCTGGTTCCAGCAACAGATAGAAATGCTTTAAGTT CACTCTGGGGAAAGCTGGCCTCTGAAATCTTAATG CAGAATTGGGATGCAGCCATGGAAGACCTTACAC GGTTAAAAGAGACCATAGATAATAATTCTGTGAGTT CTCCACTTCAGTCTCTTCAGCAGAGAACATGGCTC ATTCACTGGTCTCTGTTTGTTTTCTTCAATCACCCC AAAGGTCGCGATAATATTATTGACCTCTTCCTTTAT CAGCCACAATATCTTAATGCAATTCAGACAATGTGT CCACACATTCTTCGCTATTTGACTACAGCAGTCATA ACAAACAAGGATGTTCGAAAACGTCGGCAGGTTCT AAAAGATCTAGTTAAAGTTATTCAACAGGAGTCTTA CACATATAAAGACCCAATTACAGAATTTGTTGAATG TTTATATGTTAACTTTGACTTTGATGGGGCTCAGAA AAAGCTGAGGGAATGTGAATCAGTGCTTGTGAATG ACTTCTTCTTGGTGGCTTGTCTTGAGGATTTCA | 0 | * |
| 786 | NM_0015 68.2_301 | 301 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGAT CCAGAAACTACAAGGCAAATGCAGTCAACCAGGG ATGGTAGGATGCTCTTTGACTACCTGGCGGACAAG CATGGTTTTAGGCAGGAATATTTAGATACACTCTAC AGATATGCAAAATTCCAGTACGAATGTGGGAATTA CTCAGGAGCAGCAGAATATCTTTATTTTTTTAGAGT GCTGGTTCCAGCAACAGATAGAAATGCTTTAAGTT CACTCTGGGGAAAGCTGGCCTCTGAAATCTTAATG CAGAATTGGGATGCAGCCATGGAAGACCTTACAC GGTTAAAAGAGACCATAGATAATAATTCTGTGAGTT CTCCACTTCAGTCTCTTCAGCAGAGAACATGGCTC | 1 | M* |

TABLE 3A-continued

| SEQ ID | identifier_ position | position | modified_RNA | PAP length | PAP |
|---|---|---|---|---|---|
| | | | ATTCACTGGTCTCTGTTTGTTTTCTTCAATCACCCC<br>AAAGGTCGCGATAATATTATTGACCTCTTCCTTTAT<br>CAGCCACAATATCTTAATGCAATTCAGACAATGTGT<br>CCACACATTCTTCGCTATTTGACTACAGCAGTCATA<br>ACAAACAAGGATGTTCGAAAACGTCGGCAGGTTCT<br>AAAAGATCTAGTTAAAGTTATTCAACAGGAGTCTTA<br>CACATATAAAGACCCAATTACAGAATTTGTTGAATG<br>TTTATATGTTAACTTTGACTTTGATGGGGCTCAGAA<br>AAAGCTGAGGGAATGTGAATCAGTGCTTGTGAATG<br>ACTTCTTCTTGGTGGCTTGTCTTGAGGATTTCA | | |
| 787 | NM_0015<br>68.2_313 | 313 | GAGCACAGACTCCCTTTTCTTTGGCAAGATGGCGG<br>AGTACGACTTGACTACTCGCATCGCGCACTTTTTG<br>GATCGGCATCTAGTCTTTCCGCTTCTTGAATTTCTC<br>TCTGTAAAGGAGATATATAATGAAAAGGAATTATTART<br>CAAGGTAAATTGGACCTTCTTAGTGATACCAACAT<br>GGTAGACTTTGCTATGGATGTATACAAAAACCTTTA<br>TTCTGATGATATTCCTCATGCTTTGAGAGAGAAAA<br>GAACCACAGTGGTTGCACAACTGAAACAGCTTCAG<br>GCAGAAACAGAACCAATTGTGAAGATGTTGAAGAT<br>CCAGAAACTACAAGGCAAATGCAGTCAACCAGGG<br>ATGGTAGGATGCTCTTTGACTACCTGGCGGACAAG<br>CATGGTTTTAGGCAGGAATATTTAGATACACTCTA<br>AGATATGCAAAATTCCAGTACGAATGTGGGAATTA<br>CTCAGGAGCAGCAGAATATCTTTATTTTTTAGAGT<br>GCTGGTTCCAGCAACAGATAGAAATGCTTTAAGTT<br>CACTCTGGGGAAAGCTGGCCTCTGAAATCTTAATG<br>CAGAATTGGGATGCAGCCATGGAAGACCTTACAC<br>GGTTAAAAGAGACCATAGATAATAATTCTGTGAGTT<br>CTCCACTTCAGTCTCTTCAGCAGAGAACATGGCTC<br>ATTCACTGGTCTCTGTTTGTTTTCTTCAATCACCCC<br>AAAGGTCGCGATAATATTATTGACCTCTTCCTTTAT<br>CAGCCACAATATCTTAATGCAATTCAGACAATGTGT<br>CCACACATTCTTCGCTATTTGACTACAGCAGTCATA<br>ACAAACAAGGATGTTCGAAAACGTCGGCAGGTTCT<br>AAAAGATCTAGTTAAAGTTATTCAACAGGAGTCTTA<br>CACATATAAAGACCCAATTACAGAATTTGTTGAATG<br>TTTATATGTTAACTTTGACTTTGATGGGGCTCAGAA<br>AAAGCTGAGGGAATGTGAATCAGTGCTTGTGAATG<br>ACTTCTTCTTGGTGGCTTGTCTTGAGGATTTCA | 33 | LKIQKLQG<br>KCSQPGM<br>VGCSLTTW<br>SMVLGR<br>NI* |
| 788 | NM_0015<br>68.2_353 | 353 | GAGCACAGACTCCCTTTTCTTTGGCAAGATGGCGG<br>AGTACGACTTGACTACTCGCATCGCGCACTTTTTG<br>GATCGGCATCTAGTCTTTCCGCTTCTTGAATTTCTC<br>TCTGTAAAGGAGATATATAATGAAAAGGAATTATTA<br>CAAGGTAAATTGGACCTTCTTAGTGATACCAACAT<br>GGTAGACTTTGCTATGGATGTATACAAAAACCTTTA<br>TTCTGATGATATTCCTCATGCTTTGAGAGAGAAAA<br>GAACCACAGTGGTTGCACAACTGAAACAGCTTCAG<br>GCAGAAACAGAACCAATTGTGAAGATGTTTGAAGA<br>TCCAGAAACTACAAGGCAAATGCAGTCAACCAGGA<br>TGGTAGGATGCTCTTTGACTACCTGGCGGACAAGC<br>ATGGTTTTAGGCAGGAATATTTAGATACACTCTACA<br>GATATGCAAAATTCCAGTACGAATGTGGGAATTAC<br>TCAGGAGCAGCAGAATATCTTTATTTTTTAGAGTG<br>CTGGTTCCAGCAACAGATAGAAATGCTTTAAGTTC<br>ACTCTGGGGAAAGCTGGCCTCTGAAATCTTAATGC<br>AGAATTGGGATGCAGCCATGGAAGACCTTACACG<br>GTTAAAAGAGACCATAGATAATAATTCTGTGAGTTC<br>TCCACTTCAGTCTCTTCAGCAGAGAACATGGCTCA<br>TTCACTGGTCTCTGTTTGTTTTCTTCAATCACCCCA<br>AAGGTCGCGATAATATTATTGACCTCTTCCTTTATC<br>AGCCACAATATCTTAATGCAATTCAGACAATGTGTC<br>CACACATTCTTCGCTATTTGACTACAGCAGTCATAA<br>CAAACAAGGATGTTCGAAAACGTCGGCAGGTTCTA<br>AAAGATCTAGTTAAAGTTATTCAACAGGAGTCTTAC<br>ACATATAAAGACCCAATTACAGAATTTGTTGAATGT<br>TTATATGTTAACTTTGACTTTGATGGGGCTCAGAAA<br>AAGCTGAGGGAATGTGAATCAGTGCTTGTGAATGA<br>CTTCTTCTTGGTGGCTTGTCTTGAGGATTTCA | 19 | MVGCSLTT<br>WRTSMVL<br>GRNI* |
| 789 | NM_0015<br>68.2_370 | 370 | GAGCACAGACTCCCTTTTCTTTGGCAAGATGGCGG<br>AGTACGACTTGACTACTCGCATCGCGCACTTTTTG<br>GATCGGCATCTAGTCTTTCCGCTTCTTGAATTTCTC<br>TCTGTAAAGGAGATATATAATGAAAAGGAATTATTA<br>CAAGGTAAATTGGACCTTCTTAGTGATACCAACAT<br>GGTAGACTTTGCTATGGATGTATACAAAAACCTTTA<br>TTCTGATGATATTCCTCATGCTTTGAGAGAGAAAA<br>GAACCACAGTGGTTGCACAACTGAAACAGCTTCAG<br>GCAGAAACAGAACCAATTGTGAAGATGTTGAAGA | 14 | LTTWRTSM<br>VLGRNI* |

TABLE 3A-continued

| SEQ ID | identifier_position | position | modified_RNA | PAP length | PAP |
|---|---|---|---|---|---|
| | | | TCCAGAAACTACAAGGCAAATGCAGTCAACCAGG GATGGTAGGATGCTCTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTAGA GTGCTGGTTCCAGCAACAGATAGAAATGCTTTAAG TTCACTCTGGGGAAAGCTGGCCTCTGAAATCTTAA TGCAGAATTGGGATGCAGCCATGGAAGACCTTACA CGGTTAAAAGAGACCATAGATAATAATTCTGTGAG TTCTCCACTTCAGTCTCTTCAGCAGAGAACATGGC TCATTCACTGGTCTCTGTTTGTTTTCTTCAATCACC CCAAAGGTCGCGATAATATTATTGACCTCTTCCTTT ATCAGCCACAATATCTTAATGCAATTCAGACAATGT GTCCACACATTCTTCGCTATTTGACTACAGCAGTC ATAACAAACAAGGATGTTCGAAAACGTCGGCAGGT TCTAAAAGATCTAGTTAAAGTTATTCAACAGGAGTC TTACACATATAAAGACCCAATTACAGAATTTGTTGA ATGTTTATATGTTAACTTTGACTTTGATGGGGCTCA GAAAAAGCTGAGGGAATGTGAATCAGTGCTTGTGA ATGACTTCTTCTTGGTGGCTTGTCTTGAGGATTTCA | | |
| 790 | NM_0015 68.2_550 | 550 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGA TCCAGAAACTACAAGGCAAATGCAGTCAACCAGG GATGGTAGGATGCTCTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTAGA GTGCTGGTTCCAGCAACAGATAGAAATGCTTTAAG TTCACTCTGGGGAAAGCTGGCTCTGAAATCTTAAT GCAGAATTGGGATGCAGCCATGGAAGACCTTACA CGGTTAAAAGAGACCATAGATAATAATTCTGTGAG TTCTCCACTTCAGTCTCTTCAGCAGAGAACATGGC TCATTCACTGGTCTCTGTTTGTTTTCTTCAATCACC CCAAAGGTCGCGATAATATTATTGACCTCTTCCTTT ATCAGCCACAATATCTTAATGCAATTCAGACAATGT GTCCACACATTCTTCGCTATTTGACTACAGCAGTC ATAACAAACAAGGATGTTCGAAAACGTCGGCAGGT TCTAAAAGATCTAGTTAAAGTTATTCAACAGGAGTC TTACACATATAAAGACCCAATTACAGAATTTGTTGA ATGTTTATATGTTAACTTTGACTTTGATGGGGCTCA GAAAAAGCTGAGGGAATGTGAATCAGTGCTTGTGA ATGACTTCTTCTTGGTGGCTTGTCTTGAGGATTTCA | 3 | LKS* |
| 791 | NM_0015 68.2_572 | 572 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGA TCCAGAAACTACAAGGCAAATGCAGTCAACCAGG GATGGTAGGATGCTCTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTAGA GTGCTGGTTCCAGCAACAGATAGAAATGCTTTAAG TTCACTCTGGGGAAAGCTGGCCTCTGAAATCTTAA TGCAGAATGGGATGCAGCCATGGAAGACCTTACA CGGTTAAAAGAGACCATAGATAATAATTCTGTGAG TTCTCCACTTCAGTCTCTTCAGCAGAGAACATGGC TCATTCACTGGTCTCTGTTTGTTTTCTTCAATCACC CCAAAGGTCGCGATAATATTATTGACCTCTTCCTTT ATCAGCCACAATATCTTAATGCAATTCAGACAATGT GTCCACACATTCTTCGCTATTTGACTACAGCAGTC ATAACAAACAAGGATGTTCGAAAACGTCGGCAGGT TCTAAAAGATCTAGTTAAAGTTATTCAACAGGAGTC TTACACATATAAAGACCCAATTACAGAATTTGTTGA ATGTTTATATGTTAACTTTGACTTTGATGGGGCTCA | 10 | GMQPWKT LNG* |

TABLE 3A-continued

| SEQ ID | identifier_position | position | modified_RNA | PAP length | PAP |
|---|---|---|---|---|---|
| 792 | NM_0015 68.2_668 | 668 | GAAAAAGCTGAGGGAATGTGAATCAGTGCTTGTGA ATGACTTCTTCTTGGTGGCTTGTCTTGAGGATTTCA GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGA TCCAGAAACTACAAGGCAAATGCAGTCAACCAGG GATGGTAGGATGCTCTTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTAGA GTGCTGGTTCCAGCAACAGATAGAAATGCTTTAAG TTCACTCTGGGGAAAGCTGGCCTCTGAAATCTTAA TGCAGAATTGGGATGCAGCCATGGAAGACCTTACA CGGTTAAAAGAGACCATAGATAATAATTCTGTGAG TTCTCCACTTCAGTCTCTTCAGCAGAGAACATGGT CATTCACTGGTCTCTGTTTGTTTTCTTCAATCACCC CAAAGGTCGCGATAATATTATTGACCTCTTCCTTTA TCAGCCACAATATCTTAATGCAATTCAGACAATGTG TCCACACATTCTTCGCTATTTGACTACAGCAGTCAT AACAAACAAGGATGTTCGAAAACGTCGGCAGGTTC TAAAAGATCTAGTTAAAGTTATTCAACAGGAGTCTT ACACATATAAAGACCCAATTACAGAATTTGTTGAAT GTTTATATGTTAACTTTGACTTTGATGGGGCTCAGA AAAAGCTGAGGGAATGTGAATCAGTGCTTGTGAAT GACTTCTTCTTGGTGGCTTGTCTTGAGGATTTCA | 43 | SFTGLCLF SSITPKVAII LLTSSFISH NILMQFRQ CVHTFFAI* |
| 793 | NM_0015 68.2_688 | 688 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGA TCCAGAAACTACAAGGCAAATGCAGTCAACCAGG GATGGTAGGATGCTCTTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTAGA GTGCTGGTTCCAGCAACAGATAGAAATGCTTTAAG TTCACTCTGGGGAAAGCTGGCCTCTGAAATCTTAA TGCAGAATTGGGATGCAGCCATGGAAGACCTTACA CGGTTAAAAGAGACCATAGATAATAATTCTGTGAG TTCTCCACTTCAGTCTCTTCAGCAGAGAACATGGC TCATTCACTGGTCTCTGTTTGTTTTCTTCAATCACCC CAAAGGTCGCGATAATATTATTGACCTCTTCCTTTA TCAGCCACAATATCTTAATGCAATTCAGACAATGTG TCCACACATTCTTCGCTATTTGACTACAGCAGTCAT AACAAACAAGGATGTTCGAAAACGTCGGCAGGTTC TAAAAGATCTAGTTAAAGTTATTCAACAGGAGTCTT ACACATATAAAGACCCAATTACAGAATTTGTTGAAT GTTTATATGTTAACTTTGACTTTGATGGGGCTCAGA AAAAGCTGAGGGAATGTGAATCAGTGCTTGTGAAT GACTTCTTCTTGGTGGCTTGTCTTGAGGATTTCA | 37 | LFSSITPKV AIILLTSSFI SHNILMQF RQCVHTFF AI* |
| 794 | NM_0015 68.2_69 | 69 | GAGCACAGACTCCCTTTTCTTTGGCAAGATGGCGG AGTACGACTTGACTACTCGCATCGCGCACTTTTGG ATCGGCATCTAGTCTTTCCGCTTCTTGAATTTCTCT CTGTAAAGGAGATATATAATGAAAAGGAATTATTAC AAGGTAAATTGGACCTTCTTAGTGATACCAACATG GTAGACTTTGCTATGGATGTATACAAAAACCTTTAT TCTGATGATATTCCTCATGCTTTGAGAGAGAAAAG AACCACAGTGGTTGCACAACTGAAACAGCTTCAGG CAGAAACAGAACCAATTGTGAAGATGTTTGAAGAT CCAGAAACTACAAGGCAAATGCAGTCAACCAGGG ATGGTAGGATGCTCTTTGACTACCTGGCGGACAAG CATGGTTTTAGGCAGGAATATTTAGATACACTCTAC AGATATGCAAAATTCCAGTACGAATGTGGGAATTA CTCAGGAGCAGCAGAATATCTTTATTTTTTAGAGT GCTGGTTCCAGCAACAGATAGAAATGCTTTAAGTT CACTCTGGGGAAAGCTGGCCTCTGAAATCTTAATG CAGAATTGGGATGCAGCCATGGAAGACCTTACAC | 4 | WIGI* |

TABLE 3A-continued

| SEQ ID | identifier_position | position | modified_RNA | PAP length | PAP |
|---|---|---|---|---|---|
| | | | GGTTAAAAGAGACCATAGATAATAATTCTGTGAGTT CTCCACTTCAGTCTCTTCAGCAGAGAACATGGCTC ATTCACTGGTCTCTGTTTGTTTTCTTCAATCACCCC AAAGGTCGCGATAATATTATTGACCTCTTCCTTTAT CAGCCACAATATCTTAATGCAATTCAGACAATGTGT CCACACATTCTTCGCTATTTGACTACAGCAGTCATA ACAAACAAGGATGTTCGAAAACGTCGGCAGGTTCT AAAAGATCTAGTTAAAGTTATTCAACAGGAGTCTTA CACATATAAAGACCCAATTACAGAATTTGTTGAATG TTTATATGTTAACTTTGACTTTGATGGGGCTCAGAA AAAGCTGAGGGAATGTGAATCAGTGCTTGTGAATG ACTTCTTCTTGGTGGCTTGTCTTGAGGATTTCA | | |
| 795 | NM_0015 68.2_913 | 913 | GAGCACAGACTCCCTTTTCTTTGGCAAGATGGCGG AGTACGACTTGACTACTCGCATCGCGCACTTTTTG GATCGGCATCTAGTCTTTCCGCTTCTTGAATTTCTC TCTGTAAAGGAGATATATAATGAAAAGGAATTATTA CAAGGTAAATTGGACCTTCTTAGTGATACCAACAT GGTAGACTTTGCTATGGATGTATACAAAAACCTTTA TTCTGATGATATTCCTCATGCTTTGAGAGAGAAAA GAACCACAGTGGTTGCACAACTGAAACAGCTTCAG GCAGAAACAGAACCAATTGTGAAGATGTTTGAAGA TCCAGAAACTACAAGGCAAATGCAGTCAACCAGG GATGGTAGGATGCTCTTTGACTACCTGGCGGACAA GCATGGTTTTAGGCAGGAATATTTAGATACACTCT ACAGATATGCAAAATTCCAGTACGAATGTGGGAAT TACTCAGGAGCAGCAGAATATCTTTATTTTTTTAGA GTGCTGGTTCCAGCAACAGATAGAAATGCTTTAAG TTCACTCTGGGGAAAGCTGGCCTCTGAAATCTTAA TGCAGAATTGGGATGCAGCCATGGAAGACCTTACA CGGTTAAAAGAGACCATAGATAATAATTCTGTGAG TTCTCCACTTCAGTCTCTTCAGCAGAGAACATGGC TCATTCACTGGTCTCTGTTTGTTTTCTTCAATCACC CCAAAGGTCGCGATAATATTATTGACCTCTTCCTTT ATCAGCCACAATATCTTAATGCAATTCAGACAATGT GTCCACACATTCTTCGCTATTTGACTACAGCAGTC ATAACAAACAAGGATGTTCGAAAACGTCGGCAGGT TCTAAAAGATCTAGTTAAAGTTATTCAACAGGAGTC TTACACATATAAAGACCCAATTACAGAATTGTTGAA TGTTTATATGTTAACTTTGACTTTGATGGGGCTCAG AAAAAGCTGAGGGAATGTGAATCAGTGCTTGTGAA TGACTTCTTCTTGGTGGCTTGTCTTGAGGATTTCA | 17 | LLNVYMLT LTLMGLRK S* |
| 796 | NM_0016 14.2_1004 | 1004 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA CCCGGGCATTGCGACAGGATGCAGAAGGAGATC | 14 | TGCRRRS PPWRPAP* |
| 797 | NM_0016 14.2_1032 | 1032 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG | 5 | WRPAP* |

TABLE 3A-continued

| SEQ ID | identifier_position | position | modified_RNA | PAP length | PAP |
|---|---|---|---|---|---|
| | | | GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA CCCGGGCATTGCCGACAGGATGCAGAAGGAGAT | | |
| 798 | NM_0016 14.2_104 | 104 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT GACAATGGCTCCGGCATGTGCAAAGCTGGTTTTGC TGGGGACGACGCTCCCCGAGCCGTGTTTCCTTCC ATCGTCGGGCGCCCCAGACACCAGGGCGTCATGG TGGGCATGGGCCAGAAGGACTCCTACGTGGGCGA CGAGGCCCAGAGCAAGCGTGGCATCCTGACCCTG AAGTACCCCATTGAGCATGGCATCGTCACCAACTG GGACGACATGGAGAAGATCTGGCACCACACCTTC TACAACGAGCTGCGCGTGGCCCCGGAGGAGCAC CCAGTGCTGCTGACCGAGGCCCCCCTGAACCCCA AGGCCAACAGAGAGAAGATGACTCAGATTATGTTT GAGACCTTCAACACCCCGGCCATGTACGTGGCCA TCCAGGCCGTGCTGTCCCTCTACGCCTCTGGGCG CACCACTGGCATTGTCATGGACTCTGGAGACGGG GTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 55 | MTMAPAC AKLVLLGT TLPEPCFL PSSGAPDT RASWWAW ARRTPTW ATRPRASV AS* |
| 799 | NM_0016 14.2_111 5 | 1115 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA | 41 | HCPPSSRC GLASRSTT SRAPPSST ANASKRTQ QMRSICCM G* |

TABLE 3A-continued

| SEQ ID | identifier_position | position | modified_RNA | PAP length | PAP |
|---|---|---|---|---|---|
| 800 | NM_0016 14.2_117 5 | 1175 | CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA CCCGGGCATTGCCGACAGGATGCAGAAGGAGAT GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA CCCGGGCATTGCCGACAGGATGCAGAAGGAGAT | 21 | PSSTANAS KRTQQMR SIGCMG* |
| 801 | NM_0016 14.2_119 0 | 1190 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA CCCGGGCATTGCCGACAGGATGCAGAAGGAGAT | 16 | NASKRTQ QMRSICCM G* |
| 802 | NM_0016 14.2_137 | 137 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTGC TGGGGACGACGCTCCCCGAGCCGTGTTTCCTTCC ATCGTCGGGCGCCCCAGACACCAGGGCGTCATGG TGGGCATGGGCCAGAAGGACTCCTACGTGGGCGA CGAGGCCCAGAGCAAGCGTGGCATCCTGACCCTG AAGTACCCCATTGAGCATGGCATCGTCACCAACTG GGACGACATGGAGAAGATCTGGCACCACACCTTC TACAACGAGCTGCGCGTGGCCCCGGAGGAGCAC | 44 | LLGTTLPE PCFLPSSG APDTRAS WWAWARR TPTWATRP RASVAS* |

TABLE 3A-continued

| SEQ ID | identifier_position | position | modified_RNA | PAP length | PAP |
|---|---|---|---|---|---|
| | | | CCAGTGCTGCTGACCGAGGCCCCCCTGAACCCCA<br>AGGCCAACAGAGAGAAGATGACTCAGATTATGTTT<br>GAGACCTTCAACACCCCGGCCATGTACGTGGCCA<br>TCCAGGCCGTGCTGTCCCTCTACGCCTCTGGGCG<br>CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | | |
| 803 | NM_0016<br>14.2_163 | 163 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGGTTTCCTTCC<br>ATCGTCGGGCGCCCCAGACACCAGGGCGTCATGG<br>TGGGCATGGGCCAGAAGGACTCCTACGTGGGCGA<br>CGAGGCCCAGAGCAAGCGTGGCATCCTGACCCTG<br>AAGTACCCCATTGAGCATGGCATCGTCACCAACTG<br>GGACGACATGGAGAAGATCTGGCACCACACCTTC<br>TACAACGAGCTGCGCGTGGCCCCGGAGGAGCAC<br>CCAGTGCTGCTGACCGAGGCCCCCCTGAACCCCA<br>AGGCCAACAGAGAGAAGATGACTCAGATTATGTTT<br>GAGACCTTCAACACCCCGGCCATGTACGTGGCCA<br>TCCAGGCCGTGCTGTCCCTCTACGCCTCTGGGCG<br>CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 35 | GFLPSSGA<br>PDTRASW<br>WAWARRT<br>PTWATRP<br>RASVAS* |
| 804 | NM_0016<br>14.2_199 | 199 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGCGTCATGG<br>TGGGCATGGGCCAGAAGGACTCCTACGTGGGCGA<br>CGAGGCCCAGAGCAAGCGTGGCATCCTGACCCTG<br>AAGTACCCCATTGAGCATGGCATCGTCACCAACTG<br>GGACGACATGGAGAAGATCTGGCACCACACCTTC<br>TACAACGAGCTGCGCGTGGCCCCGGAGGAGCAC<br>CCAGTGCTGCTGACCGAGGCCCCCCTGAACCCCA<br>AGGCCAACAGAGAGAAGATGACTCAGATTATGTTT<br>GAGACCTTCAACACCCCGGCCATGTACGTGGCCA<br>TCCAGGCCGTGCTGTCCCTCTACGCCTCTGGGCG<br>CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC | 23 | ASWWAWA<br>RRTPTWAT<br>RPRASVAS* |

TABLE 3A-continued

| SEQ ID | identifier_position | position | modified_RNA | PAP length | PAP |
|---|---|---|---|---|---|
| 805 | NM_0016 14.2_249 | 249 | AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCAGAGCAAGCGTGGCATCCTGACCCT GAAGTACCCCATTGAGCATGGCATCGTCACCAACT GGGACGACATGGAGAAGATCTGGCACCACACCTT CTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGCACCACCATGTA | 6 | RASVAS* |
| 806 | NM_0016 14.2_367 | 367 | CCCGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCGGAGGAGCAC CCAGTGCTGCTGACCGAGGCCCCCCTGAACCCCA AGGCCAACAGAGAGAAGATGACTCAGATTATGTTT GAGACCTTCAACACCCCGGCCATGTACGTGGCCA TCCAGGCCGTGCTGTCCCTCTACGCCTCTGGGCG CACCACTGGCATTGTCATGGACTCTGGAGACGGG GTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 7 | RRSTQCC* |
| 807 | NM_0016 14.2_402 | 402 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCCA AGGCCAACAGAGAGAAGATGACTCAGATTATGTTT GAGACCTTCAACACCCCGGCCATGTACGTGGCCA TCCAGGCCGTGCTGTCCCTCTACGCCTCTGGGCG | 0 | * |

TABLE 3A-continued

| SEQ ID | identifier_position | position | modified_RNA | PAP length | PAP |
|---|---|---|---|---|---|
| | | | CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | | |
| 808 | NM_0016<br>14.2_416 | 416 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCAACAGAGAGAAGATGACTCAGATTATGTTT<br>GAGACCTTCAACACCCCGGCCATGTACGTGGCCA<br>TCCAGGCCGTGCTGTCCCTCTACGCCTCTGGGCG<br>CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 4 | TERR* |
| 809 | NM_0016<br>14.2_446 | 446 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>GAGACCTTCAACACCCCGGCCATGTACGTGGCCA<br>TCCAGGCCGTGCTGTCCCTCTACGCCTCTGGGCG<br>CACCACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 61 | LRPSTPRP<br>CTWPSRP<br>CCPSTPLG<br>APLALSWT<br>LETGSPTR<br>CPSTRATP<br>SPTPSCV<br>WTWLAGT* |

TABLE 3A-continued

| SEQ ID | identifier_position | position | modified_RNA | PAP length | PAP |
|---|---|---|---|---|---|
| 810 | NM_0016 14.2_467 | 467 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCCA TCCAGGCCGTGCTGTCCCTCTACGCCTCTGGGCG CACCACTGGCATTGTCATGGACTCTGGAGACGGG GTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 53 | CTWPSRP CCPSTPLG APLALSWT LETGSPTR CPSTRATP SPTPSCV WTWLAGT* |
| 811 | NM_0016 14.2_479 | 479 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCA TCCAGGCCGTGCTGTCCCTCTACGCCTCTGGGCG CACCACTGGCATTGTCATGGACTCTGGAGACGGG GTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 49 | SRPCCPST PLGAPLAL SWTLETGS PTRCPSTR ATPSPTPS CVWTWLA GT* |
| 812 | NM_0016 14.2_488 | 488 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCGTGCTGTCCCTCTACGCCTCTGGGCG CACCACTGGCATTGTCATGGACTCTGGAGACGGG GTCACCCACACGGTGCCCATCTACGAGGGCTACG | 46 | CCPSTPLG APLALSWT LETGSPTR CPSTRATP SPTPSCV WTWLAGT* |

TABLE 3A-continued

| SEQ ID | identifier_position | position | modified_RNA | PAP length | PAP |
|---|---|---|---|---|---|
| | | | CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | | |
| 813 | NM_0016<br>14.2_518 | 518 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACACTGGCATTGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 36 | LALSWTLE<br>TGSPTRCP<br>STRATPSP<br>TPSCVWT<br>WLAGT* |
| 814 | NM_0016<br>14.2_527 | 527 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATGTCATGGACTCTGGAGACGGG<br>GTCACCCACACGGTGCCCATCTACGAGGGCTACG<br>CCCTCCCCCACGCCATCCTGCGTCTGGACCTGGC<br>TGGCCGGGACCTGACCGACTACCTCATGAAGATC<br>CTCACTGAGCGAGGCTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 34 | MSWTLET<br>GSPTRCPS<br>TRATPSPT<br>PSCVWTW<br>LAGT* |
| 815 | NM_0016<br>14.2_555 | 555 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG | 24 | TRCPSTRA<br>TPSPTPSC<br>VWTWLAG<br>T* |

TABLE 3A-continued

| SEQ ID | identifier_position | position | modified_RNA | PAP length | PAP |
|---|---|---|---|---|---|
| | | | CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | | |
| 816 | NM_0016 14.2_566 | 566 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 20 | STRATPSP TPSCVWT WLAGT* |
| 817 | NM_0016 14.2_593 | 593 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCAGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA | 12 | QPSCVWT WLAGT* |

TABLE 3A-continued

| SEQ ID | identifier_ position | position | modified_RNA | PAP length | PAP |
|---|---|---|---|---|---|
| 818 | NM_0016 14.2_616 | 616 | GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 4 | VAGT* |
| 819 | NM_0016 14.2_621 | 621 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 2 | GT* |
| 820 | NM_0016 14.2_627 | 627 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC | 0 | * |

TABLE 3A-continued

| SEQ ID | identifier_position | position | modified_RNA | PAP length | PAP |
|---|---|---|---|---|---|
| | | | TGAAGTACCCCATTGAGCATGGCATCGTCACCAAC | | |
| | | | TGGGACGACATGGAGAAGATCTGGCACCACACCT | | |
| | | | TCTACAACGAGCTGCGCGTGGCCCCGGAGGAGCA | | |
| | | | CCCAGTGCTGCTGACCGAGGCCCCCCTGAACCCC | | |
| | | | AAGGCCAACAGAGAGAAGATGACTCAGATTATGTT | | |
| | | | TGAGACCTTCAACACCCCGGCCATGTACGTGGCC | | |
| | | | ATCCAGGCCGTGCTGTCCCTCTACGCCTCTGGGC | | |
| | | | GCACCACTGGCATTGTCATGGACTCTGGAGACGG | | |
| | | | GGTCACCCACACGGTGCCCATCTACGAGGGCTAC | | |
| | | | GCCCTCCCCCACGCCATCCTGCGTCTGGACCTGG | | |
| | | | CTGGCCGGGACTGACCGACTACCTCATGAAGATC | | |
| | | | CTCACTGAGCGAGGCTACAGCTTCACCACCACGG | | |
| | | | CCGAGCGGGAAATCGTGCGCGACATCAAGGAGAA | | |
| | | | GCTGTGCTACGTCGCCCTGGACTTCGAGCAGGAG | | |
| | | | ATGGCCACCGCCGCATCCTCCTCTTCTCTGGAGAA | | |
| | | | GAGCTACGAGCTGCCCGATGGCCAGGTCATCACC | | |
| | | | ATTGGCAATGAGCGGTTCCGGTGTCCGGAGGCGC | | |
| | | | TGTTCCAGCCTTCCTTCCTGGGTATGGAATCTTGC | | |
| | | | GGCATCCACGAGACCACCTTCAACTCCATCATGAA | | |
| | | | GTGTGACGTGGACATCCGCAAAGACCTGTACGCC | | |
| | | | AACACGGTGCTGTCGGGCGGCACCACCATGTACC | | |
| | | | CGGGCATTGCCGACAGGATGCAGAAGGAGATC | | |
| 821 | NM_0016 14.2_632 | 632 | GTCTCAGTCGCCGCTGCCAGCTCTCGCACTCTGTT | 3 | TTS* |
| | | | CTTCCGCCGCTCCGCCGTCGCGTTTCTCTGCCGG | | |
| | | | TCGCAATGGAAGAAGAGATCGCCGCGCTGGTCAT | | |
| | | | TGACAATGGCTCCGGCATGTGCAAAGCTGGTTTTG | | |
| | | | CTGGGGACGACGCTCCCCGAGCCGTGTTTCCTTC | | |
| | | | CATCGTCGGGCGCCCCAGACACCAGGGCGTCATG | | |
| | | | GTGGGCATGGGCCAGAAGGACTCCTACGTGGGC | | |
| | | | GACGAGGCCCAGAGCAAGCGTGGCATCCTGACCC | | |
| | | | TGAAGTACCCCATTGAGCATGGCATCGTCACCAAC | | |
| | | | TGGGACGACATGGAGAAGATCTGGCACCACACCT | | |
| | | | TCTACAACGAGCTGCGCGTGGCCCCGGAGGAGCA | | |
| | | | CCCAGTGCTGCTGACCGAGGCCCCCCTGAACCCC | | |
| | | | AAGGCCAACAGAGAGAAGATGACTCAGATTATGTT | | |
| | | | TGAGACCTTCAACACCCCGGCCATGTACGTGGCC | | |
| | | | ATCCAGGCCGTGCTGTCCCTCTACGCCTCTGGGC | | |
| | | | GCACCACTGGCATTGTCATGGACTCTGGAGACGG | | |
| | | | GGTCACCCACACGGTGCCCATCTACGAGGGCTAC | | |
| | | | GCCCTCCCCCACGCCATCCTGCGTCTGGACCTGG | | |
| | | | CTGGCCGGGACCTGACGACTACCTCATGAAGATC | | |
| | | | CTCACTGAGCGAGGCTACAGCTTCACCACCACGG | | |
| | | | CCGAGCGGGAAATCGTGCGCGACATCAAGGAGAA | | |
| | | | GCTGTGCTACGTCGCCCTGGACTTCGAGCAGGAG | | |
| | | | ATGGCCACCGCCGCATCCTCCTCTTCTCTGGAGAA | | |
| | | | GAGCTACGAGCTGCCCGATGGCCAGGTCATCACC | | |
| | | | ATTGGCAATGAGCGGTTCCGGTGTCCGGAGGCGC | | |
| | | | TGTTCCAGCCTTCCTTCCTGGGTATGGAATCTTGC | | |
| | | | GGCATCCACGAGACCACCTTCAACTCCATCATGAA | | |
| | | | GTGTGACGTGGACATCCGCAAAGACCTGTACGCC | | |
| | | | AACACGGTGCTGTCGGGCGGCACCACCATGTACC | | |
| | | | CGGGCATTGCCGACAGGATGCAGAAGGAGATC | | |
| 822 | NM_0016 14.2_635 | 635 | GTCTCAGTCGCCGCTGCCAGCTCTCGCACTCTGTT | 2 | TS* |
| | | | CTTCCGCCGCTCCGCCGTCGCGTTTCTCTGCCGG | | |
| | | | TCGCAATGGAAGAAGAGATCGCCGCGCTGGTCAT | | |
| | | | TGACAATGGCTCCGGCATGTGCAAAGCTGGTTTTG | | |
| | | | CTGGGGACGACGCTCCCCGAGCCGTGTTTCCTTC | | |
| | | | CATCGTCGGGCGCCCCAGACACCAGGGCGTCATG | | |
| | | | GTGGGCATGGGCCAGAAGGACTCCTACGTGGGC | | |
| | | | GACGAGGCCCAGAGCAAGCGTGGCATCCTGACCC | | |
| | | | TGAAGTACCCCATTGAGCATGGCATCGTCACCAAC | | |
| | | | TGGGACGACATGGAGAAGATCTGGCACCACACCT | | |
| | | | TCTACAACGAGCTGCGCGTGGCCCCGGAGGAGCA | | |
| | | | CCCAGTGCTGCTGACCGAGGCCCCCCTGAACCCC | | |
| | | | AAGGCCAACAGAGAGAAGATGACTCAGATTATGTT | | |
| | | | TGAGACCTTCAACACCCCGGCCATGTACGTGGCC | | |
| | | | ATCCAGGCCGTGCTGTCCCTCTACGCCTCTGGGC | | |
| | | | GCACCACTGGCATTGTCATGGACTCTGGAGACGG | | |
| | | | GGTCACCCACACGGTGCCCATCTACGAGGGCTAC | | |
| | | | GCCCTCCCCCACGCCATCCTGCGTCTGGACCTGG | | |
| | | | CTGGCCGGGACCTGACCGATACCTCATGAAGATC | | |
| | | | CTCACTGAGCGAGGCTACAGCTTCACCACCACGG | | |
| | | | CCGAGCGGGAAATCGTGCGCGACATCAAGGAGAA | | |
| | | | GCTGTGCTACGTCGCCCTGGACTTCGAGCAGGAG | | |
| | | | ATGGCCACCGCCGCATCCTCCTCTTCTCTGGAGAA | | |
| | | | GAGCTACGAGCTGCCCGATGGCCAGGTCATCACC | | |
| | | | ATTGGCAATGAGCGGTTCCGGTGTCCGGAGGCGC | | |

TABLE 3A-continued

| SEQ ID | identifier_ position | position | modified_RNA | PAP length | PAP |
|---|---|---|---|---|---|
| 823 | NM_0016 14.2_639 | 639 | TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 1 | S* |
| 824 | NM_0016 14.2_651 | 651 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 90 | SLSEATAS PPRPSGKS CATSRRSC ATSPWTSS RRWPPPH PPLLWRRA TSCPMARS SPLAMSGS GVRRRCS SLPSWVW NLAASTRP PSTPS* |
| 825 | NM_0016 14.2_665 | 665 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC | 85 | TASPPRPS GKSCATSR RSCATSP WTSSRRW PPPHPPLL WRRATSC PMARSSPL AMSGSGV RRRCSSLP SWVWNLA ASTRPPST PS* |

TABLE 3A-continued

| SEQ ID | identifier_position | position | modified_RNA | PAP length | PAP |
|---|---|---|---|---|---|
| | | | AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGTACAGCTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | | |
| 826 | NM_0016 14.2_671 | 671 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGTACAGTTCACCACCACGG<br>CCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC<br>AACACGGTGCTGTCGGGCGGCACCACCATGTACC<br>CGGGCATTGCCGACAGGATGCAGAAGGAGATC | 83 | SPPRPSGK<br>SCATSRRS<br>CATSPWTS<br>SRRWPPP<br>HPPLLWRR<br>ATSCPMAR<br>SSPLAMSG<br>SGVRRRC<br>SSLPSWV<br>WNLAASTR<br>PPSTPS* |
| 827 | NM_0016 14.2_686 | 686 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGTACAGCTTCACCACCACGG<br>GCGAGCGGGAAATCGTGCGCGACATCAAGGAGAA<br>GCTGTGCTACGTCGCCCTGGACTTCGAGCAGGAG<br>ATGGCCACCGCCGCATCCTCCTCTTCTCTGGAGAA<br>GAGCTACGAGCTGCCCGATGGCCAGGTCATCACC<br>ATTGGCAATGAGCGGTTCCGGTGTCCGGAGGCGC<br>TGTTCCAGCCTTCCTTCCTGGGTATGGAATCTTGC<br>GGCATCCACGAGACCACCTTCAACTCCATCATGAA<br>GTGTGACGTGGACATCCGCAAAGACCTGTACGCC | 78 | SGKSCATS<br>RRSCATSP<br>WTSSRRW<br>PPPHPPLL<br>WRRATSC<br>PMARSSPL<br>AMSGSGV<br>RRRCSSLP<br>SWVWNLA<br>ASTRPPST<br>PS* |

TABLE 3A-continued

| SEQ ID | identifier_position | position | modified_RNA | PAP length | PAP |
|---|---|---|---|---|---|
| 828 | NM_0016 14.2_707 | 707 | AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGAATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC | 72 | ESRRSCAT SPWTSSR RWPPPHP PLLWRRAT SCPMARS SPLAMSGS GVRRRCS SLPSWVW NLAASTRP PSTPS* |
| 829 | NM_0016 14.2_712 | 712 | AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC | 70 | RRSCATSP WTSSRRW PPPHPPLL WRRATSC PMARSSPL AMSGSGV RRRCSSLP SWVWNLA ASTRPPST PS* |
| 830 | NM_0016 14.2_735 | 735 | AACACGGTGCTGTCGGGCGGCACCACCATGTACC CGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC | 62 | WTSSRRW PPPHPPLL WRRATSC PMARSSPL AMSGSGV RRRCSSLP SWVWNLA ASTRPPST PS* |

TABLE 3A-continued

| SEQ ID | identifier_ position | position | modified_RNA | PAP length | PAP |
|---|---|---|---|---|---|
| | | | GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | | |
| 831 | NM_0016 14.2_76 | 76 | GTCTCAGTCGCCGCTGCCAGCTCTCGCACTCTGTT CTTCCGCCGCTCCGCCGTCGCGTTTCTCTGCCGG TCGCAAGGAAGAAGAGATCGCCGCGCTGGTCATT GACAATGGCTCCGGCATGTGCAAAGCTGGTTTTGC TGGGGACGACGCTCCCCGAGCCGTGTTTCCTTCC ATCGTCGGGCGCCCCAGACACCAGGGCGTCATGG TGGGCATGGGCCAGAAGGACTCCTACGTGGGCGA CGAGGCCCAGAGCAAGCGTGGCATCCTGACCCTG AAGTACCCCATTGAGCATGGCATCGTCACCAACTG GGACGACATGGAGAAGATCTGGCACCACACCTTC TACAACGAGCTGCGCGTGGCCCCGGAGGAGCAC CCAGTGCTGCTGACCGAGGCCCCCCTGAACCCCA AGGCCAACAGAGAGAAGATGACTCAGATTATGTTT GAGACCTTCAACACCCCGGCCATGTACGTGGCCA TCCAGGCCGTGCTGTCCCTCTACGCCTCTGGGCG CACCACTGGCATTGTCATGGACTCTGGAGACGGG GTCACCCACACGGTGCCCATCTACGAGGGCTACG CCCTCCCCCACGCCATCCTGCGTCTGGACCTGGC TGGCCGGGACCTGACCGACTACCTCATGAAGATC CTCACTGAGCGAGGCTACAGCTTCACCACCACGG CCGAGCGGGAAATCGTGCGCGACATCAAGGAGAA GCTGTGCTACGTCGCCCTGGACTTCGAGCAGGAG ATGGCCACCGCCGCATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 64 | RKKRSPR WSLTMAP ACAKLVLL GTTLPEPC FLPSSGAP DTRASWW AWARRTP TWATRPR ASVAS* |
| 832 | NM_0016 14.2_766 | 766 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGATCCTCCTCTTCTCTGGAGAA GAGCTACGAGCTGCCCGATGGCCAGGTCATCACC ATTGGCAATGAGCGGTTCCGGTGTCCGGAGGCGC TGTTCCAGCCTTCCTTCCTGGGTATGGAATCTTGC GGCATCCACGAGACCACCTTCAACTCCATCATGAA GTGTGACGTGGACATCCGCAAAGACCTGTACGCC AACACGGTGCTGTCGGGCGGCACCACCATGTACC CGGGCATTGCCGACAGGATGCAGAAGGAGATC | 52 | DPPLLWRR ATSCPMAR SSPLAMSG SGVRRRC SSLPSWV WNLAASTR PPSTPS* |

TABLE 3A-continued

| SEQ ID | identifier_position | position | modified_RNA | PAP length | PAP |
|---|---|---|---|---|---|
| 833 | NM_0016 14.2_787 | 787 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AGAGCTACGAGCTGCCCGATGGCCAGGTCATCAC CATTGGCAATGAGCGGTTCCGGTGTCCGGAGGCG CTGTTCCAGCCTTCCTTCCTGGGTATGGAATCTTG CGGCATCCACGAGACCACCTTCAACTCCATCATGA AGTGTGACGTGGACATCCGCAAAGACCTGTACGC CAACACGGTGCTGTCGGGCGGCACCACCATGTAC CCGGGCATTGCCGACAGGATGCAGAAGGAGATC | 45 | RATSCPMA RSSPLAMS GSGVRRR CSSLPSWV WNLAASTR PPSTPS* |
| 834 | NM_0016 14.2_803 | 803 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCAC CATTGGCAATGAGCGGTTCCGGTGTCCGGAGGCG CTGTTCCAGCCTTCCTTCCTGGGTATGGAATCTTG CGGCATCCACGAGACCACCTTCAACTCCATCATGA AGTGTGACGTGGACATCCGCAAAGACCTGTACGC CAACACGGTGCTGTCGGGCGGCACCACCATGTAC CCGGGCATTGCCGACAGGATGCAGAAGGAGATC | 39 | MARSSPLA MSGSGVR RRCSSLPS WVWNLAA STRPPSTP S* |
| 835 | NM_0016 14.2_824 | 824 | GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC | 33 | MAMSGSG VRRRCSSL PSWVWNL AASTRPPS TPS* |

TABLE 3A-continued

| SEQ ID | identifier_position | position | modified_RNA | PAP length | PAP |
|---|---|---|---|---|---|
| | | | GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA<br>AGCTGTGCTACGTCGCCCTGGACTTCGAGCAGGA<br>GATGGCCACCGCCGCATCCTCCTCTTCTCTGGAG<br>AAGAGCTACGAGCTGCCCGATGGCCAGGTCATCA<br>CCATGGCAATGAGCGGTTCCGGTGTCCGGAGGCG<br>CTGTTCCAGCCTTCCTTCCTGGGTATGGAATCTTG<br>CGGCATCCACGAGACCACCTTCAACTCCATCATGA<br>AGTGTGACGTGGACATCCGCAAAGACCTGTACGC<br>CAACACGGTGCTGTCGGGCGGCACCACCATGTAC<br>CCGGGCATTGCCGACAGGATGCAGAAGGAGATC | | |
| 836 | NM_0016<br>14.2_827 | 827 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA<br>AGCTGTGCTACGTCGCCCTGGACTTCGAGCAGGA<br>GATGGCCACCGCCGCATCCTCCTCTTCTCTGGAG<br>AAGAGCTACGAGCTGCCCGATGGCCAGGTCATCA<br>CCATTGGAATGAGCGGTTCCGGTGTCCGGAGGCG<br>CTGTTCCAGCCTTCCTTCCTGGGTATGGAATCTTG<br>CGGCATCCACGAGACCACCTTCAACTCCATCATGA<br>AGTGTGACGTGGACATCCGCAAAGACCTGTACGC<br>CAACACGGTGCTGTCGGGCGGCACCACCATGTAC<br>CCGGGCATTGCCGACAGGATGCAGAAGGAGATC | 31 | MSGSGVR<br>RRCSSLPS<br>WVWNLAA<br>STRPPSTP<br>S* |
| 837 | NM_0016<br>14.2_838 | 838 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA<br>AGCTGTGCTACGTCGCCCTGGACTTCGAGCAGGA<br>GATGGCCACCGCCGCATCCTCCTCTTCTCTGGAG<br>AAGAGCTACGAGCTGCCCGATGGCCAGGTCATCA<br>CCATTGGCAATGAGCGGTCCGGTGTCCGGAGGCG<br>CTGTTCCAGCCTTCCTTCCTGGGTATGGAATCTTG<br>CGGCATCCACGAGACCACCTTCAACTCCATCATGA<br>AGTGTGACGTGGACATCCGCAAAGACCTGTACGC<br>CAACACGGTGCTGTCGGGCGGCACCACCATGTAC<br>CCGGGCATTGCCGACAGGATGCAGAAGGAGATC | 28 | SGVRRRC<br>SSLPSWV<br>WNLAASTR<br>PPSTPS* |
| 838 | NM_0016<br>14.2_893 | 893 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG | 9 | STRPPSTP<br>S* |

TABLE 3A-continued

| SEQ ID | identifier_position | position | modified_RNA | PAP length | PAP |
|---|---|---|---|---|---|
| | | | CTGGGGACGACGCTCCCCGAGCCGTGTTTCCTTC<br>CATCGTCGGGCGCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA<br>AGCTGTGCTACGTCGCCCTGGACTTCGAGCAGGA<br>GATGGCCACCGCCGCATCCTCCTCTTCTCTGGAG<br>AAGAGCTACGAGCTGCCCGATGGCCAGGTCATCA<br>CCATTGGCAATGAGCGGTTCCGGTGTCCGGAGGC<br>GCTGTTCCAGCCTTCCTTCCTGGGTATGGAATCTT<br>GCGGATCCACGAGACCACCTTCAACTCCATCATGA<br>AGTGTGACGTGGACATCCGCAAAGACCTGTACGC<br>CAACACGGTGCTGTCGGGCGGCACCACCATGTAC<br>CCGGGCATTGCCGACAGGATGCAGAAGGAGATC | | |
| 839 | NM_0016 14.2_905 | 905 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA<br>AGCTGTGCTACGTCGCCCTGGACTTCGAGCAGGA<br>GATGGCCACCGCCGCATCCTCCTCTTCTCTGGAG<br>AAGAGCTACGAGCTGCCCGATGGCCAGGTCATCA<br>CCATTGGCAATGAGCGGTTCCGGTGTCCGGAGGC<br>GCTGTTCCAGCCTTCCTTCCTGGGTATGGAATCTT<br>GCGGCATCCACGAGACACCTTCAACTCCATCATGA<br>AGTGTGACGTGGACATCCGCAAAGACCTGTACGC<br>CAACACGGTGCTGTCGGGCGGCACCACCATGTAC<br>CCGGGCATTGCCGACAGGATGCAGAAGGAGATC | 5 | PSTPS* |
| 840 | NM_0016 14.2_913 | 913 | GTCTCAGTCGCCGCTGCCAGCTCTCGCACTCTGTT<br>CTTCCGCCGCTCCGCCGTCGCGTTTCTCTGCCGG<br>TCGCAATGGAAGAAGAGATCGCCGCGCTGGTCAT<br>TGACAATGGCTCCGGCATGTGCAAAGCTGGTTTTG<br>CTGGGGACGACGCTCCCCGAGCCGTGTTTCCTTC<br>CATCGTCGGGCGCCCAGACACCAGGGCGTCATG<br>GTGGGCATGGGCCAGAAGGACTCCTACGTGGGC<br>GACGAGGCCCAGAGCAAGCGTGGCATCCTGACCC<br>TGAAGTACCCCATTGAGCATGGCATCGTCACCAAC<br>TGGGACGACATGGAGAAGATCTGGCACCACACCT<br>TCTACAACGAGCTGCGCGTGGCCCCGGAGGAGCA<br>CCCAGTGCTGCTGACCGAGGCCCCCCTGAACCCC<br>AAGGCCAACAGAGAGAAGATGACTCAGATTATGTT<br>TGAGACCTTCAACACCCCGGCCATGTACGTGGCC<br>ATCCAGGCCGTGCTGTCCCTCTACGCCTCTGGGC<br>GCACCACTGGCATTGTCATGGACTCTGGAGACGG<br>GGTCACCCACACGGTGCCCATCTACGAGGGCTAC<br>GCCCTCCCCCACGCCATCCTGCGTCTGGACCTGG<br>CTGGCCGGGACCTGACCGACTACCTCATGAAGAT<br>CCTCACTGAGCGAGGCTACAGCTTCACCACCACG<br>GCCGAGCGGGAAATCGTGCGCGACATCAAGGAGA | 3 | TPS* |

TABLE 3A-continued

| SEQ ID | identifier_position | position | modified_RNA | PAP length | PAP |
|---|---|---|---|---|---|
| 841 | NM_0016 14.2_980 | 980 | AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCACTCCATCATGA AGTGTGACGTGGACATCCGCAAAGACCTGTACGC CAACACGGTGCTGTCGGGCGGCACCACCATGTAC CCGGGCATTGCCGACAGGATGCAGAAGGAGATC GTCTCAGTCGCCGCTGCCAGCTCTCGCACTCTGTT CTTCCGCCGCTCCGCCGTCGCGTTTCTCTGCCGG TCGCAATGGAAGAAGAGATCGCCGCGCTGGTCAT TGACAATGGCTCCGGCATGTGCAAAGCTGGTTTTG CTGGGGACGACGCTCCCCGAGCCGTGTTTCCTTC CATCGTCGGGCGCCCCAGACACCAGGGCGTCATG GTGGGCATGGGCCAGAAGGACTCCTACGTGGGC GACGAGGCCCAGAGCAAGCGTGGCATCCTGACCC TGAAGTACCCCATTGAGCATGGCATCGTCACCAAC TGGGACGACATGGAGAAGATCTGGCACCACACCT TCTACAACGAGCTGCGCGTGGCCCCGGAGGAGCA CCCAGTGCTGCTGACCGAGGCCCCCCTGAACCCC AAGGCCAACAGAGAGAAGATGACTCAGATTATGTT TGAGACCTTCAACACCCCGGCCATGTACGTGGCC ATCCAGGCCGTGCTGTCCCTCTACGCCTCTGGGC GCACCACTGGCATTGTCATGGACTCTGGAGACGG GGTCACCCACACGGTGCCCATCTACGAGGGCTAC GCCCTCCCCCACGCCATCCTGCGTCTGGACCTGG CTGGCCGGGACCTGACCGACTACCTCATGAAGAT CCTCACTGAGCGAGGCTACAGCTTCACCACCACG GCCGAGCGGGAAATCGTGCGCGACATCAAGGAGA AGCTGTGCTACGTCGCCCTGGACTTCGAGCAGGA GATGGCCACCGCCGCATCCTCCTCTTCTCTGGAG AAGAGCTACGAGCTGCCCGATGGCCAGGTCATCA CCATTGGCAATGAGCGGTTCCGGTGTCCGGAGGC GCTGTTCCAGCCTTCCTTCCTGGGTATGGAATCTT GCGGCATCCACGAGACCACCTTCAACTCCATCATG AAGTGTGACGTGGACATCCGCAAAGACCTGTACG CCAACACGGTGCTGTCGGGCGGACCACCATGTAC CCGGGCATTGCCGACAGGATGCAGAAGGAGATC | 22 | PPCTRALP TGCRRRS PPWRPAP* |
| 842 | NM_0016 28.2_152 | 152 | ACGGGCTATTTAAAGGTACGCGCCGCGGCCAAGG CCGCACCGTACTGGGCGGGGGTCTGGGGAGCGC AGCAGCCATGGCAAGCCGTCTCCTGCTCAACAAC GGCGCCAAGATGCCCATCCTGGGGTTGGGTACCT GGAAGTCCCCTCCAGGCAGGTGACTGAGGCCGTG AAGGTGGCCATTGACGTCGGGTACCGCCACATCG ACTGTGCCCATGTGTACCAGAATGAGAATGAGGTG GGGGTGGCCATTCAGGAGAAGCTCAGGGAGCAG GTGGTGAAGCGTGAGGAGCTCTTCATCGTCAGCA AGCTGTGGTGCACGTACCATGAGAAGGGGCCTGGT GAAAGGAGCCTGCCAGAAGACACTCAGCGACCTG AAGCTGGACTACCTGGACCTCTACCTTATTCACTG GCCGACTGGCTTTAAGCCTGGGAAGGAATTTTTCC CATTGGATGAGTCGGGCAATGTGGTTCCCAGTGA CACCAACATTCTGGACACGTGGGCGGCCATGGAA GAGCTGGTGGATGAAGGGCTGGTGAAAGCTATTG GCATCTCCAACTTCAACCATCTCCAGGTGGAGATG ATCTTAAACAAACCTGGCTTGAAGTATAAGCCTGC AGTTAACCAGATTGAGTGCCACCCATATCTCACTC AGGAGAAGTTAATCCAGTACTGCCAGTCCAAAGGC ATCGTGGTGACCGCCTACAGCCCCCTCGGCTCTC CTGACAGGCCCTGGGCCAAGCCCGAGGACCCTTC TCTCCTGGAGGATCCCAGGATCAAGGCGATCGCA GCCAAGCACAATAAAAACTACAGCCCAGGTCCTGAT CCGGTTCCCCATGCAGAGGAACTTGGTGGTGATC CCCAAGTCTGTGACACCAGAACGCATTGCTGAGAA CTTTAAGGTCTTTGACTTTGAACTGAGCAGCCAGG ATATGACCACCTTACTCAGCTACAACAGGAACTGG AGGGTCTGTGCCTTGTTGAGCTGTACCTCCCACAA GGATTACCCCTTCCATGAAGAGTTTTGA | 1 | R* |
| 843 | NM_0016 28.2_506 | 506 | ACGGGCTATTTAAAGGTACGCGCCGCGGCCAAGG CCGCACCGTACTGGGCGGGGGTCTGGGGAGCGC AGCAGCCATGGCAAGCCGTCTCCTGCTCAACAAC GGCGCCAAGATGCCCATCCTGGGGTTGGGTACCT GGAAGTCCCCTCCAGGCAGGTGACTGAGGCCGT GAAGGTGGCCATTGACGTCGGGTACCGCCACATC GACTGTGCCCATGTGTACCAGAATGAGAATGAGGT GGGGGTGGCCATTCAGGAGAAGCTCAGGGAGCA | 9 | WKSWWM KGW* |

TABLE 3A-continued

| SEQ ID | identifier_position | position | modified_RNA | PAP length | PAP |
|---|---|---|---|---|---|
| | | | GGTGGTGAAGCGTGAGGAGCTCTTCATCGTCAGC<br>AAGCTGTGGTGCACGTACCATGAGAAGGGCCTGG<br>TGAAAGGAGCCTGCCAGAAGACACTCAGCGACCT<br>GAAGCTGGACTACCTGGACCTCTACCTTATTCACT<br>GGCCGACTGGCTTTAAGCCTGGGAAGGAATTTTTC<br>CCATTGGATGAGTCGGGCAATGTGGTTCCCAGTG<br>ACACCAACATTCTGGACACGTGGGCGGCATGGAA<br>GAGCTGGTGGATGAAGGGCTGGTGAAAGCTATTG<br>GCATCTCCAACTTCAACCATCTCCAGGTGGAGATG<br>ATCTTAAACAAACCTGGCTTGAAGTATAAGCCTGC<br>AGTTAACCAGATTGAGTGCCACCCATATCTCACTC<br>AGGAGAAGTTAATCCAGTACTGCCAGTCCAAAGGC<br>ATCGTGGTGACCGCCTACAGCCCCTCGGCTCTC<br>CTGACAGGCCCTGGGCCAAGCCCGAGGACCCTTC<br>TCTCCTGGAGGATCCCAGGATCAAGGCGATCGCA<br>GCCAAGCACAATAAAACTACAGCCCAGGTCCTGAT<br>CCGGTTCCCCATGCAGAGGAACTTGGTGGTGATC<br>CCCAAGTCTGTGACACCAGAACGCATTGCTGAGAA<br>CTTTAAGGTCTTTGACTTTGAACTGAGCAGCCAGG<br>ATATGACCACCTTACTCAGCTACAACAGGAACTGG<br>AGGGTCTGTGCCTTGTTGAGCTGTACCTCCCACAA<br>GGATTACCCCTTCCATGAAGAGTTTTGA | | |
| 844 | NM_0016<br>28.2_675 | 675 | ACGGGCTATTTAAAGGTACGCGCCGCGGCCAAGG<br>CCGCACCGTACTGGGCGGGGGTCTGGGGAGCGC<br>AGCAGCCATGGCAAGCCGTCTCCTGCTCAACAAC<br>GGCGCCAAGATGCCCATCCTGGGGTTGGGTACCT<br>GGAAGTCCCCTCCAGGGCAGGTGACTGAGGCCGT<br>GAAGGTGGCCATTGACGTCGGGTACCGCCACATC<br>GACTGTGCCCATGTGTACCAGAATGAGAATGAGGT<br>GGGGGTGGCCATTCAGGAGAAGCTCAGGGAGCA<br>GGTGGTGAAGCGTGAGGAGCTCTTCATCGTCAGC<br>AAGCTGTGGTGCACGTACCATGAGAAGGGCCTGG<br>TGAAAGGAGCCTGCCAGAAGACACTCAGCGACCT<br>GAAGCTGGACTACCTGGACCTCTACCTTATTCACT<br>GGCCGACTGGCTTTAAGCCTGGGAAGGAATTTTTC<br>CCATTGGATGAGTCGGGCAATGTGGTTCCCAGTG<br>ACACCAACATTCTGGACACGTGGGCGGCCATGGA<br>AGAGCTGGTGGATGAAGGGCTGGTGAAAGCTATT<br>GGCATCTCCAACTTCAACCATCTCCAGGTGGAGAT<br>GATCTTAAACAAACCTGGCTTGAAGTATAAGCCTG<br>CAGTTAACCAGATTGAGTGCCACCCATATCTCACT<br>CAGGAGAAGTTAATCCAGTACTGCAGTCCAAAGGC<br>ATCGTGGTGACCGCCTACAGCCCCTCGGCTCTC<br>CTGACAGGCCCTGGGCCAAGCCCGAGGACCCTTC<br>TCTCCTGGAGGATCCCAGGATCAAGGCGATCGCA<br>GCCAAGCACAATAAAACTACAGCCCAGGTCCTGAT<br>CCGGTTCCCCATGCAGAGGAACTTGGTGGTGATC<br>CCCAAGTCTGTGACACCAGAACGCATTGCTGAGAA<br>CTTTAAGGTCTTTGACTTTGAACTGAGCAGCCAGG<br>ATATGACCACCTTACTCAGCTACAACAGGAACTGG<br>AGGGTCTGTGCCTTGTTGAGCTGTACCTCCCACAA<br>GGATTACCCCTTCCATGAAGAGTTTTGA | 6 | SPKASW* |
| 845 | NM_0016<br>28.2_701 | 701 | ACGGGCTATTTAAAGGTACGCGCCGCGGCCAAGG<br>CCGCACCGTACTGGGCGGGGGTCTGGGGAGCGC<br>AGCAGCCATGGCAAGCCGTCTCCTGCTCAACAAC<br>GGCGCCAAGATGCCCATCCTGGGGTTGGGTACCT<br>GGAAGTCCCCTCCAGGGCAGGTGACTGAGGCCGT<br>GAAGGTGGCCATTGACGTCGGGTACCGCCACATC<br>GACTGTGCCCATGTGTACCAGAATGAGAATGAGGT<br>GGGGGTGGCCATTCAGGAGAAGCTCAGGGAGCA<br>GGTGGTGAAGCGTGAGGAGCTCTTCATCGTCAGC<br>AAGCTGTGGTGCACGTACCATGAGAAGGGCCTGG<br>TGAAAGGAGCCTGCCAGAAGACACTCAGCGACCT<br>GAAGCTGGACTACCTGGACCTCTACCTTATTCACT<br>GGCCGACTGGCTTTAAGCCTGGGAAGGAATTTTTC<br>CCATTGGATGAGTCGGGCAATGTGGTTCCCAGTG<br>ACACCAACATTCTGGACACGTGGGCGGCCATGGA<br>AGAGCTGGTGGATGAAGGGCTGGTGAAAGCTATT<br>GGCATCTCCAACTTCAACCATCTCCAGGTGGAGAT<br>GATCTTAAACAAACCTGGCTTGAAGTATAAGCCTG<br>CAGTTAACCAGATTGAGTGCCACCCATATCTCACT<br>CAGGAGAAGTTAATCCAGTACTGCCAGTCCAAAGG<br>CATCGTGGTGACCGCCTACAGCCCCTCGGCTCTC<br>CTGACAGGCCCTGGGCCAAGCCCGAGGACCCTTC<br>TCTCCTGGAGGATCCCAGGATCAAGGCGATCGCA<br>GCCAAGCACAATAAAACTACAGCCCAGGTCCTGAT<br>CCGGTTCCCCATGCAGAGGAACTTGGTGGTGATC | 39 | TAPSALLT<br>GPGPSPRT<br>LLSWRIPG<br>SRRSQPST<br>IKLQPRS* |

TABLE 3A-continued

| SEQ ID | identifier_position | position | modified_RNA | PAP length | PAP |
|---|---|---|---|---|---|
| 846 | NM_0016 28.2_716 | 716 | CCCAAGTCTGTGACACCAGAACGCATTGCTGAGAA CTTTAAGGTCTTTGACTTTGAACTGAGCAGCCAGG ATATGACCACCTTACTCAGCTACAACAGGAACTGG AGGGTCTGTGCCTTGTTGAGCTGTACCTCCCACAA GGATTACCCCTTCCATGAAGAGTTTTGA ACGGGCTATTTAAAGGTACGCGCCGCGGCCAAGG CCGCACCGTACTGGGCGGGGGTCTGGGGAGCGC AGCAGCCATGGCAAGCCGTCTCCTGCTCAACAAC GGCGCCAAGATGCCCATCCTGGGGTTGGGTACCT GGAAGTCCCCTCCAGGGCAGGTGACTGAGGCCGT GAAGGTGGCCATTGACGTCGGGTACCGCCACATC GACTGTGCCCATGTGTACCAGAATGAGAATGAGGT GGGGGTGGCCATTCAGGAGAAGCTCAGGGAGCA GGTGGTGAAGCGTGAGGAGCTCTTCATCGTCAGC AAGCTGTGGTGCACGTACCATGAGAAGGGCCTGG TGAAAGGAGCCTGCCAGAAGACACTCAGCGACCT GAAGCTGGACTACCTGGACCTCTACCTTATTCACT GGCCGACTGGCTTTAAGCCTGGGAAGGAATTTTTC CCATTGGATGAGTCGGGCAATGTGGTTCCCAGTG ACACCAACATTCTGGACACGTGGGCGGCCATGGA AGAGCTGGTGGATGAAGGGCTGGTGAAAGCTATT GGCATCTCCAACTTCAACCATCTCCAGGTGGAGAT GATCTTAAACAAACCTGGCTTGAAGTATAAGCCTG CAGTTAACCAGATTGAGTGCCACCCATATCTCACT CAGGAGAAGTTAATCCAGTACTGCCAGTCCAAAGG CATCGTGGTGACCGCCTACAGCCCCCTCGGTCTC CTGACAGGCCCTGGGCCAAGCCCGAGGACCCTTC TCTCCTGGAGGATCCCAGGATCAAGGCGATCGCA GCCAAGCACAATAAAACTACAGCCCAGGTCCTGAT CCGGTTCCCCATGCAGAGGAACTTGGTGGTGATC CCCAAGTCTGTGACACCAGAACGCATTGCTGAGAA CTTTAAGGTCTTTGACTTTGAACTGAGCAGCCAGG ATATGACCACCTTACTCAGCTACAACAGGAACTGG AGGGTCTGTGCCTTGTTGAGCTGTACCTCCCACAA GGATTACCCCTTCCATGAAGAGTTTTGA | 34 | LLTGPGPS PRTLLSWR IPGSRRSQ PSTIKLQP RS* |
| 847 | NM_0016 41.2_419 | 419 | CAGACAGACCAATCACGCGCATTCTTCGGCCACG ACAAGCGCGCCTCTGATCACGTGACCAGGTCCGC TACCCACGTGGGGGCTCAGCGTGCACCCTTCTTT GTGCTCGGGTTAGGAGGAGCTAGGCTGCCATCGG GCCGGTGCAGATACGGGGTTGCTCTTTTGCTCATA AGAGGGGCTTCGCTGGCAGTCTGAACGGCAAGCT TGAGTCAGGACCCTTAATTAAGATCCTCAATTGGC TGGAGGGCAGATCTCGCGAGTAGGGCAACGCGGT AAAAATATTGCTTCGGTGGGTGACGCGGTACAGCT GCCCAAGGGCGTTCGTAACGGGAATGCCGAAGCG TGGGAAAAAGGGAGCGGTGGCGGAAGACGGGGA TGAGCTCAGGACAGAGCCAGAGGCCAAGAAGAGT AAGACGGCGCAAAGAAAAATGACAAAGAGGCAGC AGGAGAGGGCCCAGCCCTGTATGAGGACCCCCCA GATCAGAAAACCTCACCCAGTGGCAAACCTGCCA CACTCAAGATCTGCTCTTGGAATGTGGATGGGCTT CGAGCCTGGATTAAGAAGAAAGGGATTAGATTGGGT AAAGGAAGAAGCCCCAGATATACTGTGCCTTCAAG AGACCAAATGTTCAGAGAACAAACTACCAGCTGAA CTTCAGGAGCTGCCTGGACTCTCTCATCAATACTG GTCAGCTCCTTCGGACAAGGAAGGGTACAGTGGC GTGGGCCTGCTTTCCCGCCAGTGCCCACTCAAAG TTTCTTACGGCATAGGCGATGAGGAGCATGATCAG GAAGGCCGGGTGATTGTGGCTGAATTTGACTCGTT TGTGCTGGTAACAGCATATGTACCTAATGCAGGCC GAGGTCTGGTACGACTGGAGTACCGGCAGCGCTG GGATGAAGCCTTTCGCAAGTTCCTGAAGGGCCTG GCTTCCCGAAAGCCCCTTGTGCTGTGTGGAGACC TCAATGTGGCACATGAAGAAATTGACCTTCGCAAC CCCAAGGGGAACAAAAAGAATGCTGGC | 51 | QRKMTKR QQERAQP CMRTPQIR KPHPVANL PHSRSALG MWMGFEP GLRRKD* |
| 848 | NM_0016 41.2_579 | 579 | CAGACAGACCAATCACGCGCATTCTTCGGCCACG ACAAGCGCGCCTCTGATCACGTGACCAGGTCCGC TACCCACGTGGGGGCTCAGCGTGCACCCTTCTTT GTGCTCGGGTTAGGAGGAGCTAGGCTGCCATCGG GCCGGTGCAGATACGGGGTTGCTCTTTTGCTCATA AGAGGGGCTTCGCTGGCAGTCTGAACGGCAAGCT TGAGTCAGGACCCTTAATTAAGATCCTCAATTGGC TGGAGGGCAGATCTCGCGAGTAGGGCAACGCGGT AAAAATATTGCTTCGGTGGGTGACGCGGTACAGCT GCCCAAGGGCGTTCGTAACGGGAATGCCGAAGCG TGGGAAAAAGGGAGCGGTGGCGGAAGACGGGGA TGAGCTCAGGACAGAGCCAGAGGCCAAGAAGAGT | 1 | G* |

TABLE 3A-continued

| SEQ ID | identifier_position | position | modified_RNA | PAP length | PAP |
|---|---|---|---|---|---|
| | | | AAGACGGCCGCAAAGAAAAATGACAAAGAGGCAG<br>CAGGAGAGGGCCCAGCCCTGTATGAGGACCCCCC<br>AGATCAGAAAACCTCACCCAGTGGCAAACCTGCCA<br>CACTCAAGATCTGCTCTTGGAATGTGGATGGGCTT<br>CGAGCCTGGATTAAGAAGAAAGGATTAGATGGGTA<br>AAGGAAGAAGCCCCAGATATACTGTGCCTTCAAGA<br>GACCAAATGTTCAGAGAACAAACTACCAGCTGAAC<br>TTCAGGAGCTGCCTGGACTCTCTCATCAATACTGG<br>TCAGCTCCTTCGGACAAGGAAGGGTACAGTGGCG<br>TGGGCCTGCTTTCCCGCCAGTGCCCACTCAAAGTT<br>TCTTACGGCATAGGCGATGAGGAGCATGATCAGG<br>AAGGCCGGGTGATTGTGGCTGAATTTGACTCGTTT<br>GTGCTGGTAACAGCATATGTACCTAATGCAGGCCG<br>AGGTCTGGTACGACTGGAGTACCGGCAGCGCTGG<br>GATGAAGCCTTTCGCAAGTTCCTGAAGGGCCTGG<br>CTTCCCGAAAGCCCCTTGTGCTGTGTGGAGACCTC<br>AATGTGGCACATGAAGAAATTGACCTTCGCAACCC<br>CAAGGGGAACAAAAAGAATGCTGGC | | |
| 849 | NM_0016<br>58.3_182 | 182 | CCTTACCCGGCGTGCCCCGCGCCCGGAGGCGCT<br>GACGTGGCCGCCGTCAGAGCCGCCATCTTGTGGG<br>AGCAAAACCAACGCCTGGCTCGGAGCAGCAGCCT<br>CTGAGGTGTCCCTGGCCAGTGTCCTTCCACCTGTC<br>CACAAGCATGGGGAACATCTTCGCCAACCTCTTCA<br>AGGGCCTTTTGGCAAAAAAGAAATGCGCATCCTCA<br>TGGTGGGCCTGGATGCTGCAGGGAAGACCACGAT<br>CCTCTACAAGCTTAAGCTGGGTGAGATCGTGACCA<br>CCATTCCCACCATAGGCTTCAACGTGGAAACCGTG<br>GAGTACAAGAACATCAGCTTCACTGTGTGGGACGT<br>GGGTGGCCAGGACAAGATCCGGCCCTGTGGCG<br>CCACTACTTCCAGAACACACAAGGCCTGATCTTCG<br>TGGTGGACAGCAATGACAGAGAGCGTGTGAACGA<br>GGCCCGTGAGGAGCTCATGAGGATGCTGGCCGA<br>GGACGAGCTCCGGGATGCTGTCCTCCTGGTGTTC<br>GCCAACAAGCAGGACCTCCCCAACGCCATGAATG<br>CGGCCGAGATCACAGACAAGCTGGGGCTGCACTC<br>ACTACGCCACAGGAACTGGTACATTCAGGCCACCT<br>GCGCCACCAGCGGCGACGGGCTCTATGAAGGACT<br>GGACTGGCTGTCCAATCAGCTCCGGAACCAGAAG<br>TGAACGCGACCCCCCTCCCTCTCACTCCTCTTGCC<br>CTCTGCTTTACTCTCATGTGGCAAACGTGCGGCTC<br>GTGGTGTGAGTGCCAGAAGCTGCCTCCGTGGTTT<br>GGTCACCGTGTGCATCGCACCGTGCTGTAAATGT<br>GGCAGACGCAGCCTGCGGCCAGGCTTTTTATTTAA<br>TGTAAATAGTTTTTGTTTCCAATGAGGCAGTTTCTG<br>GTACTCCTATGCAATATTACTCAGCTTTTTTTATTGT<br>AAAAAGAAAAATCAACTCACTGTTCAGTGCTGAGA<br>GGGGATGTAGGCCCATGGGCACCTGGCCTCCAG<br>GAGTCGCTGTGTTGGGAGAGCCGGC | 30 | LAKKKCAS<br>SWWAWML<br>QGRPRSS<br>TSLSWVRS* |
| 850 | NM_0016<br>58.3_554 | 554 | CCTTACCCGGCGTGCCCCGCGCCCGGAGGCGCT<br>GACGTGGCCGCCGTCAGAGCCGCCATCTTGTGGG<br>AGCAAAACCAACGCCTGGCTCGGAGCAGCAGCCT<br>CTGAGGTGTCCCTGGCCAGTGTCCTTCCACCTGTC<br>CACAAGCATGGGGAACATCTTCGCCAACCTCTTCA<br>AGGGCCTTTTGGCAAAAAAGAAATGCGCATCCTC<br>ATGGTGGGCCTGGATGCTGCAGGGAAGACCACGA<br>TCCTCTACAAGCTTAAGCTGGGTGAGATCGTGACC<br>ACCATTCCCACCATAGGCTTCAACGTGGAAACCGT<br>GGAGTACAAGAACATCAGCTTCACTGTGTGGGAC<br>GTGGGTGGCCAGGACAAGATCCGGCCCCTGTGG<br>CGCCACTACTTCCAGAACACACAAGGCCTGATCTT<br>CGTGGTGGACAGCAATGACAGAGAGCGTGTGAAC<br>GAGGCCCGTGAGGAGCTCATGAGGATGCTGGCC<br>GAGGACGAGCTCCGGGATGCTGTCCTCCTGGTGT<br>TCGCCAACAAGCAGGACCTCCCCAACGCCATGAA<br>TGCGGCGAGATCACAGACAAGCTGGGGCTGCACT<br>CACTACGCCACAGGAACTGGTACATTCAGGCCAC<br>CTGCGCCACCAGCGGCGACGGGCTCTATGAAGGA<br>CTGGACTGGCTGTCCAATCAGCTCCGGAACCAGA<br>AGTGAACGCGACCCCCTCCCTCTCACTCCTCTTG<br>CCCTCTGCTTTACTCTCATGTGGCAAACGTGCGGC<br>TCGTGGTGTGAGTGCCAGAAGCTGCCTCCGTGGT<br>TTGGTCACCGTGTGCATCGCACCGTGCTGTAAATG<br>TGGCAGACGCAGCCTGCGGCCAGGCTTTTTATTTA<br>ATGTAAATAGTTTTTGTTTCCAATGAGGCAGTTTCT<br>GGTACTCCTATGCAATATTACTCAGCTTTTTTTATT<br>GTAAAAAGAAAAATCAACTCACTGTTCAGTGCTGA | 69 | RSQTSWG<br>CTHYATGT<br>GTFRPPAP<br>PAATGSMK<br>DWTGCPIS<br>SGTRSERD<br>PPPSHSSC<br>PLLYSHVA<br>NVRLVV* |

TABLE 3A-continued

| SEQ ID | identifier_position | position | modified_RNA | PAP length | PAP |
|---|---|---|---|---|---|
| 851 | NM_0016 60.2_249 | 249 | GAGGGGATGTAGGCCCATGGGCACCTGGCCTCCA GGAGTCGCTGTGTTGGGAGAGCCGGC CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTGGCAAGAAGCAGATGCGCATTTTGATGGTT GGATTGGATGCTGCTGGCAAGACAACCATTCTGTA TAAACTGAAGTTAGGGGAGATAGTCACCACCATTC CTACCATTGGTTTTAATGTGGAAACAGTAGAATATA AGAACATTTGTTTCACAGTATGGGATGTTGGTGGT CAAGATAGAATTAGGCCTCTCTGGAAGCATTACTT CCAGAATACCCAGGGTCTTATTTTTGTGGTAGATA GCAACGATCGTGAAAGAATTCAGGAAGTAGCAGAT GAGCTGCAGAAAATGCTTCTGGTAGATGAATTGAG AGATGCAGTGCTGCTACTTTTTGCAAACAAACAGG ATTTGCCAAATGCTATGGCCATCAGTGAAATGACA GATAAACTAGGGCTTCAGTCTCTTCGTAACAGAAC ATGGTATGTTCAAGCCACTTGTGCAACACAAGGAA CTGGTCTGTATGAAGGACTTGACTGGCTGTCAAAT GAGCTTTCAAAACGTTAAATGAAATTGGATATCTAA CCAAGGACATGTTTGATAAAATTGGTCTAGGCTTG TTACAACAAAATTAGTTTGTATCTTGGTTATTAAAC AGTATCTGGGACTGGTTTGGGCAGAATATTAAACT TATTTTGTTGCCAATTATTGTTTACCGAGTATAATG TTGCTATTTAGCAATGTGCTTGGTTTTAAAGAAATT CTCCTTGGGAAAAAAGTATCCTCTTTTAATTTTACT TCCCATAAGCGTAAATGCCTGGACATAGCTCTTGT GAACC | 8 | LARSRCAF* |
| 852 | NM_0016 60.2_272 | 272 | CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTGGCAAGAAGCAGATGCGCATTTTGATGGTT GGATTGGATGCTGCTGGCAAGACAACCATTCTGTA TAAACTGAAGTTAGGGGAGATAGTCACCACCATTC CTACCATTGGTTTTAATGTGGAAACAGTAGAATATA AGAACATTTGTTTCACAGTATGGGATGTTGGTGGT CAAGATAGAATTAGGCCTCTCTGGAAGCATTACTT CCAGAATACCCAGGGTCTTATTTTTGTGGTAGATA GCAACGATCGTGAAAGAATTCAGGAAGTAGCAGAT GAGCTGCAGAAAATGCTTCTGGTAGATGAATTGAG AGATGCAGTGCTGCTACTTTTTGCAAACAAACAGG ATTTGCCAAATGCTATGGCCATCAGTGAAATGACA GATAAACTAGGGCTTCAGTCTCTTCGTAACAGAAC ATGGTATGTTCAAGCCACTTGTGCAACACAAGGAA CTGGTCTGTATGAAGGACTTGACTGGCTGTCAAAT GAGCTTTCAAAACGTTAAATGAAATTGGATATCTAA CCAAGGACATGTTTGATAAAATTGGTCTAGGCTTG TTACAACAAAATTAGTTTGTATCTTGGTTATTAAAC AGTATCTGGGACTGGTTTGGGCAGAATATTAAACT TATTTTGTTGCCAATTATTGTTTACCGAGTATAATG TTGCTATTTAGCAATGTGCTTGGTTTTAAAGAAATT CTCCTTGGGAAAAAAGTATCCTCTTTTAATTTTACT TCCCATAAGCGTAAATGCCTGGACATAGCTCTTGT GAACC | 0 | * |
| 853 | NM_0016 60.2_357 | 357 | CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTGGCAAGAAGCAGATGCGCATTTTGATGGT TGGATTGGATGCTGCTGGCAAGACAACCATTCTGT ATAAACTGAAGTTAGGGGAGATAGTCACCACCATT CCTACCATTGGTTTTAATGTGGAAACAGTAGAATATA AGAACATTTGTTTCACAGTATGGGATGTTGGTGGT CAAGATAGAATTAGGCCTCTCTGGAAGCATTACTT CCAGAATACCCAGGGTCTTATTTTTGTGGTAGATA GCAACGATCGTGAAAGAATTCAGGAAGTAGCAGAT | 7 | MVLMWKQ* |

TABLE 3A-continued

| SEQ ID | identifier_ position | position | modified_RNA | PAP length | PAP |
|---|---|---|---|---|---|
| | | | GAGCTGCAGAAAATGCTTCTGGTAGATGAATTGAG AGATGCAGTGCTGCTACTTTTTGCAAACAAACAGG ATTTGCCAAATGCTATGGCCATCAGTGAAATGACA GATAAACTAGGGCTTCAGTCTCTTCGTAACAGAAC ATGGTATGTTCAAGCCACTTGTGCAACACAAGGAA CTGGTCTGTATGAAGGACTTGACTGGCTGTCAAAT GAGCTTTCAAAACGTTAAATGAAATTGGATATCTAA CCAAGGACATGTTTGATAAAATTGGTCTAGGCTTG TTACAACAAAATTAGTTTGTATCTTGGTTATTAAAC AGTATCTGGGACTGGTTTGGGCAGAATATTAAACT TATTTTGTTGCCAATTATTGTTTACCGAGTATAATG TTGCTATTTAGCAATGTGCTTGGTTTTAAAGAAATT CTCCTTGGGAAAAAAGTATCCTCTTTTAATTTTACT TCCCATAAGCGTAAATGCCTGGACATAGCTCTTGT GAACC | | |
| 854 | NM_0016 60.2_414 | 414 | CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTTGGCAAGAAGCAGATGCGCATTTTGATGGT TGGATTGGATGCTGCTGGCAAGACAACCATTCTGT ATAAACTGAAGTTAGGGGAGATAGTCACCACCATT CCTACCATTGGTTTTAATGTGGAAACAGTAGAATAT AAGAACATTTGTTTCACAGTATGGGATGTGGTGGT CAAGATAGAATTAGGCCTCTCTGGAAGCATTACTT CCAGAATACCCAGGGTCTTATTTTTGTGGTAGATA GCAACGATCGTGAAAGAATTCAGGAAGTAGCAGAT GAGCTGCAGAAAATGCTTCTGGTAGATGAATTGAG AGATGCAGTGCTGCTACTTTTTGCAAACAAACAGG ATTTGCCAAATGCTATGGCCATCAGTGAAATGACA GATAAACTAGGGCTTCAGTCTCTTCGTAACAGAAC ATGGTATGTTCAAGCCACTTGTGCAACACAAGGAA CTGGTCTGTATGAAGGACTTGACTGGCTGTCAAAT GAGCTTTCAAAACGTTAAATGAAATTGGATATCTAA CCAAGGACATGTTTGATAAAATTGGTCTAGGCTTG TTACAACAAAATTAGTTTGTATCTTGGTTATTAAAC AGTATCTGGGACTGGTTTGGGCAGAATATTAAACT TATTTTGTTGCCAATTATTGTTTACCGAGTATAATG TTGCTATTTAGCAATGTGCTTGGTTTTAAAGAAATT CTCCTTGGGAAAAAAGTATCCTCTTTTAATTTTACT TCCCATAAGCGTAAATGCCTGGACATAGCTCTTGT GAACC | 23 | VVKIELGLS GSITSRIPR VLFLW* |
| 855 | NM_0016 60.2_480 | 480 | CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTTGGCAAGAAGCAGATGCGCATTTTGATGGT TGGATTGGATGCTGCTGGCAAGACAACCATTCTGT ATAAACTGAAGTTAGGGGAGATAGTCACCACCATT CCTACCATTGGTTTTAATGTGGAAACAGTAGAATAT AAGAACATTTGTTTCACAGTATGGGATGTTGGTGG TCAAGATAGAATTAGGCCTCTCTGGAAGCATTACT TCCAGAATACCCAGGGTCTTATTTTTGTGGTAGATA GCAACGATCGTGAAAGAATTCAGGAAGTAGCAGAT GAGCTGCAGAAAATGCTTCTGGTAGATGAATTGAG AGATGCAGTGCTGCTACTTTTTGCAAACAAACAGG ATTTGCCAAATGCTATGGCCATCAGTGAAATGACA GATAAACTAGGGCTTCAGTCTCTTCGTAACAGAAC ATGGTATGTTCAAGCCACTTGTGCAACACAAGGAA CTGGTCTGTATGAAGGACTTGACTGGCTGTCAAAT GAGCTTTCAAAACGTTAAATGAAATTGGATATCTAA CCAAGGACATGTTTGATAAAATTGGTCTAGGCTTG TTACAACAAAATTAGTTTGTATCTTGGTTATTAAAC AGTATCTGGGACTGGTTTGGGCAGAATATTAAACT TATTTTGTTGCCAATTATTGTTTACCGAGTATAATG TTGCTATTTAGCAATGTGCTTGGTTTTAAAGAAATT CTCCTTGGGAAAAAAGTATCCTCTTTTAATTTTACT TCCCATAAGCGTAAATGCCTGGACATAGCTCTTGT GAACC | 2 | LW* |

TABLE 3A-continued

| SEQ ID | identifier_ position | position | modified_RNA | PAP length | PAP |
|---|---|---|---|---|---|
| 856 | NM_0016 60.2_582 | 582 | CCGCGCCAGTCGCCTAGCAGGTCCTCTACCGGCT TATTCCTGTGCCGGATCTTCATCGGCACAGGGGC CACTGAGACGTTTCTGCCTCCCTCTTTCTTCCTCC GCTCTTTCTCTTCCCTCTCGTTTAGTTTGCCTGGAG CTTGAAAGGAGAAAGCACGGGGTCGCCCCAAACC CCTTCTGCTTCTGCCCATCACAAGTGCCACTACCG CCATGGGCCTCACTATCTCCTCCCTCTTCTCCCGA CTATTTGGCAAGAAGCAGATGCGCATTTTGATGGT TGGATTGGATGCTGCTGGCAAGACAACCATTCTGT ATAAACTGAAGTTAGGGGAGATAGTCACCACCATT CCTACCATTGGTTTTAATGTGGAAACAGTAGAATAT AAGAACATTTGTTTCACAGTATGGGATGTTGGTGG TCAAGATAGAATTAGGCCTCTCTGGAAGCATTACT TCCAGAATACCCAGGGTCTTATTTTTGTGGTAGATA GCAACGATCGTGAAAGAATTCAGGAAGTAGCAGAT GAGCTGCAGAAAATGCTTCTGGTAGATGAATTGAG AGATGCAGTGCTGCTACTTTTGCAAACAAACAGGA TTTGCCAAATGCTATGGCCATCAGTGAAATGACAG ATAAACTAGGGCTTCAGTCTCTTCGTAACAGAACA TGGTATGTTCAAGCCACTTGTGCAACACAAGGAAC TGGTCTGTATGAAGGACTTGACTGGCTGTCAAATG AGCTTTCAAAACGTTAAATGAAATTGGATATCTAAC CAAGGACATGTTTGATAAAATTGGTCTAGGCTTGTT ACAACAAAATTAGTTTGTATCTTGGTTATTAAACAG TATCTGGGACTGGTTTGGGCAGAATATTAAACTTAT TTTGTTGCCAATTATTGTTTACCGAGTATAATGTTG CTATTTAGCAATGTGCTTGGTTTTAAAGAAATTCTC CTTGGGAAAAAAGTATCCTCTTTTAATTTTACTTCC CATAAGCGTAAATGCCTGGACATAGCTCTTGTGAA CC | 15 | LQTNRICQ MLWPSVK* |
| 857 | NM_0016 64.2_306 | 306 | GTGGATGAGCTGTGAGTGCGCGCGCGTGCGCGG GGCCGCGACCTGTGCCGGCTCGAGCCCGCTGGG CACTCGGAGGCGCGCACGTCGTTCCCCGCCCTCC CGCCGCCGCCCGCCCTCGCTCTCTCGCGCTACCC TCCCGCCGCCCGCGGTCCTCCGTCGGTTCTCTCG TTAGTCCACGGTCTGGTCTTCAGCTACCCGCCTTC GTCTCCGAGTTTGCGACTCGCGGACCGGCGTCCC CGGCGCGAAGAGGCTGGACTCGGATTCGTTGCCT GAGCAATGGCTGCCATCCGGAAGAAACTGGTGAT GTTGGTGATGGAGCCTGTGGAAAGACATGCTTGCT CATAGTCTTCAGCAAGGACCAGTTCCCAGAGGTGT ATGTGCCCACAGTGTTTGAGAACTATGTGGCAGAT ATCGAGGTGGATGGAAAGCAGGTAGAGTTGGCTT TGTGGGACACAGCTGGGCAGGAAGATTATGATCG CCTGAGGCCCCTCTCCTACCCAGATACCGATGTTA TACTGATGTGTTTTTCCATCGACAGCCCTGATAGTT TAGAAAACATCCCAGAAAAGTGGACCCCAGAAGTC AAGCATTTCTGTCCCAACGTGCCCATCATCCTGGT TGGGAATAAGAAGGATCTTCGGAATGATGAGCACA CAAGGCGGGAGCTAGCCAAGATGAAGCAGGAGCC GGTGAAACCTGAAGAAGGCAGAGATATGGCAAAC AGGATTGGCGCTTTTGGGTACATGGAGTGTTCAGC AAAGACCAAAGATGGAGTGAGAGAGGTTTTTGAAA TGGCTACGAGAGCTGCTCTGCAAGCTAGACGTGG GAAGAAAAAATCTGGGTGCCTTGTCTTGTGAAACC TTGCTGCAAGCACAGCCCTTATGCGGTTAATTTTG AAGTGCTGTTTATTAATCTTAGTGTATGATTACTGG CCTTTTTCATTTATCTATAATTTACCTAAGATTACAA ATCAGAAGTCATCTTGCTACCAGTATTTAGAAGCC AACTATGATTATTAACGATG | 13 | MLVMEPVE RHACS* |
| 858 | NM_0016 64.2_309 | 309 | GTGGATGAGCTGTGAGTGCGCGCGCGTGCGCGG GGCCGCGACCTGTGCCGGCTCGAGCCCGCTGGG CACTCGGAGGCGCGCACGTCGTTCCCCGCCCTCC CGCCGCCGCCCGCCCTCGCTCTCTCGCGCTACCC TCCCGCCGCCCGCGGTCCTCCGTCGGTTCTCTCG TTAGTCCACGGTCTGGTCTTCAGCTACCCGCCTTC GTCTCCGAGTTTGCGACTCGCGGACCGGCGTCCC CGGCGCGAAGAGGCTGGACTCGGATTCGTTGCCT GAGCAATGGCTGCCATCCGGAAGAAACTGGTGAT TGTGGTGATGGAGCCTGTGGAAAGACATGCTTGCT CATAGTCTTCAGCAAGGACCAGTTCCCAGAGGTGT ATGTGCCCACAGTGTTTGAGAACTATGTGGCAGAT ATCGAGGTGGATGGAAAGCAGGTAGAGTTGGCTT TGTGGGACACAGCTGGGCAGGAAGATTATGATCG CCTGAGGCCCCTCTCCTACCCAGATACCGATGTTA TACTGATGTGTTTTTCCATCGACAGCCCTGATAGTT TAGAAAACATCCCAGAAAAGTGGACCCCAGAAGTC | 11 | VMEPVER HAGS* |

TABLE 3A-continued

| SEQ ID | identifier_position | position | modified_RNA | PAP length | PAP |
|---|---|---|---|---|---|
| | | | AAGCATTTCTGTCCCAACGTGCCCATCATCCTGGT TGGGAATAAGAAGGATCTTCGGAATGATGAGCACA CAAGGCGGGAGCTAGCCAAGATGAAGCAGGAGCC GGTGAAACCTGAAGAAGGCAGAGATATGGCAAAC AGGATTGGCGCTTTTGGGTACATGGAGTGTTCAGC AAAGACCAAAGATGGAGTGAGAGAGGTTTTTGAAA TGGCTACGAGAGCTGCTCTGCAAGCTAGACGTGG GAAGAAAAAATCTGGGTGCCTTGTCTTGTGAAACC TTGCTGCAAGCACAGCCCTTATGCGGTTAATTTTG AAGTGCTGTTTATTAATCTTAGTGTATGATTACTGG CCTTTTTCATTTATCTATAATTTACCTAAGATTACAA ATCAGAAGTCATCTTGCTACCAGTATTTAGAAGCC AACTATGATTATTAACGATG | | |
| 859 | NM_0016 64.2_393 | 393 | GTGGATGAGCTGTGAGTGCGCGCGCGTGCGCGG GGCCGCGACCTGTGCCGGCTCGAGCCCGCTGGG CACTCGGAGGCGCGCACGTCGTTCCCCGCCCTCC CGCCGCCGCCCGCCCTCGCTCTCTCGCGCTACCC TCCCGCCGCCCGCGGTCCTCCGTCGGTTCTCTCG TTAGTCCACGGTCTGGTCTTCAGCTACCCGCCTTC GTCTCCGAGTTTGCGACTCGCGGACCGGCGTCCC CGGCGCGAAGAGGCTGGACTCGGATTCGTTGCCT GAGCAATGGCTGCCATCCGGAAGAAACTGGTGAT TGTTGGTGATGGAGCCTGTGGAAAGACATGCTTGC TCATAGTCTTCAGCAAGGACCAGTTCCCAGAGGTG TATGTGCCCACAGTGTTGAGAACTATGTGGCAGAT ATCGAGGTGGATGGAAAGCAGGTAGAGTTGGCTT TGTGGGACACAGCTGGGCAGGAAGATTATGATCG CCTGAGGCCCCTCTCCTACCCAGATACCGATGTTA TACTGATGTGTTTTTCCATCGACAGCCCTGATAGTT TAGAAAACATCCCAGAAAAGTGGACCCCAGAAGTC AAGCATTTCTGTCCCAACGTGCCCATCATCCTGGT TGGGAATAAGAAGGATCTTCGGAATGATGAGCACA CAAGGCGGGAGCTAGCCAAGATGAAGCAGGAGCC GGTGAAACCTGAAGAAGGCAGAGATATGGCAAAC AGGATTGGCGCTTTTGGGTACATGGAGTGTTCAGC AAAGACCAAAGATGGAGTGAGAGAGGTTTTTGAAA TGGCTACGAGAGCTGCTCTGCAAGCTAGACGTGG GAAGAAAAAATCTGGGTGCCTTGTCTTGTGAAACC TTGCTGCAAGCACAGCCCTTATGCGGTTAATTTTG AAGTGCTGTTTATTAATCTTAGTGTATGATTACTGG CCTTTTTCATTTATCTATAATTTACCTAAGATTACAA ATCAGAAGTCATCTTGCTACCAGTATTTAGAAGCC AACTATGATTATTAACGATG | 14 | LRTMWQIS RWMESR* |
| 860 | NM_0016 64.2_446 | 446 | GTGGATGAGCTGTGAGTGCGCGCGCGTGCGCGG GGCCGCGACCTGTGCCGGCTCGAGCCCGCTGGG CACTCGGAGGCGCGCACGTCGTTCCCCGCCCTCC CGCCGCCGCCCGCCCTCGCTCTCTCGCGCTACCC TCCCGCCGCCCGCGGTCCTCCGTCGGTTCTCTCG TTAGTCCACGGTCTGGTCTTCAGCTACCCGCCTTC GTCTCCGAGTTTGCGACTCGCGGACCGGCGTCCC CGGCGCGAAGAGGCTGGACTCGGATTCGTTGCCT GAGCAATGGCTGCCATCCGGAAGAAACTGGTGAT TGTTGGTGATGGAGCCTGTGGAAAGACATGCTTGC TCATAGTCTTCAGCAAGGACCAGTTCCCAGAGGTG TATGTGCCCACAGTGTTTGAGAACTATGTGGCAGA TATCGAGGTGGATGGAAAGCAGGTAGAGTTGGCT TGTGGGACACAGCTGGGCAGGAAGATTATGATCG CCTGAGGCCCCTCTCCTACCCAGATACCGATGTTA TACTGATGTGTTTTTCCATCGACAGCCCTGATAGTT TAGAAAACATCCCAGAAAAGTGGACCCCAGAAGTC AAGCATTTCTGTCCCAACGTGCCCATCATCCTGGT TGGGAATAAGAAGGATCTTCGGAATGATGAGCACA CAAGGCGGGAGCTAGCCAAGATGAAGCAGGAGCC GGTGAAACCTGAAGAAGGCAGAGATATGGCAAAC AGGATTGGCGCTTTTGGGTACATGGAGTGTTCAGC AAAGACCAAAGATGGAGTGAGAGAGGTTTTTGAAA TGGCTACGAGAGCTGCTCTGCAAGCTAGACGTGG GAAGAAAAAATCTGGGTGCCTTGTCTTGTGAAACC TTGCTGCAAGCACAGCCCTTATGCGGTTAATTTTG AAGTGCTGTTTATTAATCTTAGTGTATGATTACTGG CCTTTTTCATTTATCTATAATTTACCTAAGATTACAA ATCAGAAGTCATCTTGCTACCAGTATTTAGAAGCC AACTATGATTATTAACGATG | 12 | CGTQLGR KIMIA* |
| 861 | NM_0016 64.2_542 | 542 | GTGGATGAGCTGTGAGTGCGCGCGCGTGCGCGG GGCCGCGACCTGTGCCGGCTCGAGCCCGCTGGG CACTCGGAGGCGCGCACGTCGTTCCCCGCCCTCC CGCCGCCGCCCGCCCTCGCTCTCTCGCGCTACCC | 3 | LIV* |

TABLE 3A-continued

| SEQ ID | identifier_position | position | modified_RNA | PAP length | PAP |
|---|---|---|---|---|---|
| | | | TCCCGCCGCCCGCGGTCCTCCGTCGGTTCTCTCG<br>TTAGTCCACGGTCTGGTCTTCAGCTACCCGCCTTC<br>GTCTCCGAGTTTGCGACTCGCGGACCGGCGTCCC<br>CGGCGCGAAGAGGCTGGACTCGGATTCGTTGCCT<br>GAGCAATGGCTGCCATCCGGAAGAAACTGGTGAT<br>TGTTGGTGATGGAGCCTGTGGAAAGACATGCTTGC<br>TCATAGTCTTCAGCAAGGACCAGTTCCCAGAGGTG<br>TATGTGCCCACAGTGTTTGAGAACTATGTGGCAGA<br>TATCGAGGTGGATGGAAAGCAGGTAGAGTTGGCT<br>TTGTGGGACACAGCTGGGCAGGAAGATTATGATC<br>GCCTGAGGCCCCTCTCCTACCCAGATACCGATGTT<br>ATACTGATGTGTTTTTCCATCGACAGCCTGATAGTT<br>TAGAAAACATCCCAGAAAAGTGGACCCCAGAAGTC<br>AAGCATTTCTGTCCCAACGTGCCCATCATCCTGGT<br>TGGGAATAAGAAGGATCTTCGGAATGATGAGCACA<br>CAAGGCGGGAGCTAGCCAAGATGAAGCAGGAGCC<br>GGTGAAACCTGAAGAAGGCAGAGATATGGCAAAC<br>AGGATTGGCGCTTTTGGGTACATGGAGTGTTCAGC<br>AAAGACCAAAGATGGAGTGAGAGAGGTTTTTGAAA<br>TGGCTACGAGAGCTGCTCTGCAAGCTAGACGTGG<br>GAAGAAAAAATCTGGGTGCCTTGTCTTGTGAAACC<br>TTGCTGCAAGCACAGCCCTTATGCGGTTAATTTTG<br>AAGTGCTGTTTATTAATCTTAGTGTATGATTACTGG<br>CCTTTTTCATTTATCTATAATTTACCTAAGATTACAA<br>ATCAGAAGTCATCTTGCTACCAGTATTTAGAAGCC<br>AACTATGATTATTAACGATG | | |
| 862 | NM_0016<br>64.2_738 | 738 | GTGGATGAGCTGTGAGTGCGCGCGCGTGCGCGG<br>GGCCGCGACCTGTGCCGGCTCGAGCCCGCTGGG<br>CACTCGGAGGCGCGCACGTCGTTCCCCGCCCTCC<br>CGCCGCCGCCCGCCCTCGCTCTCTCGCGCTACCC<br>TCCCGCCGCCCGCGGTCCTCCGTCGGTTCTCTCG<br>TTAGTCCACGGTCTGGTCTTCAGCTACCCGCCTTC<br>GTCTCCGAGTTTGCGACTCGCGGACCGGCGTCCC<br>CGGCGCGAAGAGGCTGGACTCGGATTCGTTGCCT<br>GAGCAATGGCTGCCATCCGGAAGAAACTGGTGAT<br>TGTTGGTGATGGAGCCTGTGGAAAGACATGCTTGC<br>TCATAGTCTTCAGCAAGGACCAGTTCCCAGAGGTG<br>TATGTGCCCACAGTGTTTGAGAACTATGTGGCAGA<br>TATCGAGGTGGATGGAAAGCAGGTAGAGTTGGCT<br>TTGTGGGACACAGCTGGGCAGGAAGATTATGATC<br>GCCTGAGGCCCCTCTCCTACCCAGATACCGATGTT<br>ATACTGATGTGTTTTTCCATCGACAGCCCTGATAGT<br>TTAGAAAACATCCCAGAAAAGTGGACCCCAGAAGT<br>CAAGCATTTCTGTCCCAACGTGCCCATCATCCTGG<br>TTGGGAATAAGAAGGATCTTCGGAATGATGAGCAC<br>ACAAGGCGGGAGCTAGCCAAGATGAAGCAGGAGC<br>CGGTGAAACCTGAAGAAGGCAGAGATATGGCAAA<br>CAGGATTGGCGCTTTGGGTACATGGAGTGTTCAG<br>CAAAGACCAAAGATGGAGTGAGAGAGGTTTTTGAA<br>ATGGCTACGAGAGCTGCTCTGCAAGCTAGACGTG<br>GGAAGAAAAAATCTGGGTGCCTTGTCTTGTGAAAC<br>CTTGCTGCAAGCACAGCCCTTATGCGGTTAATTTT<br>GAAGTGCTGTTTATTAATCTTAGTGTATGATTACTG<br>GCCTTTTTCATTTATCTATAATTTACCTAAGATTACA<br>AATCAGAAGTCATCTTGCTACCAGTATTTAGAAGC<br>CAACTATGATTATTAACGATG | 13 | LGTWSVQ<br>QRPKME* |
| 863 | NM_0016<br>75.2_130<br>9 | 1309 | TTTCTACTTTGCCCGCCCACAGATGTAGTTTTCTCT<br>GCGCGTGTGCGTTTTCCCTCCTCCCCGCCCTCAG<br>GGTCCACGGCCACCATGGCGTATTAGGGGCAGCA<br>GTGCCTGCGGCAGCATTGGCCTTTGCAGCGGCGG<br>CAGCAGCACCAGGCTCTGCAGCGGCAACCCCCAG<br>CGGCTTAAGCCATGGCGTGAGTACCGGGGCGGGT<br>CGTCCAGCTGTGCTCCTGGGGCCGGCGCGGGTTT<br>TGGATTGGTGGGGTGCGGCCTGGGGCCAGGGCG<br>GTGCCGCCAAGGGGGAAGCGATTAACGAGCGCC<br>CGGGACGCGTGGTCTTTGCTTGGGTGTCCCCGAG<br>ACGCTCGCGTGCCTGGGATCGGGAAAGCGTAGTC<br>GGGTGCCCGGACTGCTTCCCCAGGAGCCCTACAG<br>CCCTCGGACCCCGAGCCCCGCAAGGGTCCCAGG<br>GGTCTTGGCTGTTGCCCCACGAAACGTGGCAGGA<br>ACCAAGATGGCGGCGGCAGGGCGGCGGCGCGGG<br>CGTGAGTCAAGGGCGGGCGGTGGGCGGGGCGCG<br>GCCGCCCTGGCCGTATTTGGACGTGGGGACGGAG<br>CGCTTTCCTCTTGGCGGCCGGTGGAAGAATCCCC<br>TGGTCTCCGTGAGCGTCCATTTTGTGGAACCTGAG<br>TTGCAAGCAGGGAGGGGCAAATACAACTGCCCTG<br>TTCCCGATTCTCTAGATGGCCGATCTAGAGAAGTC | 5 | ISQKV* |

TABLE 3A-continued

| SEQ ID | identifier_position | position | modified_RNA | PAP length | PAP |
|---|---|---|---|---|---|
| 864 | NM_0016 75.2_138 7 | 1387 | CCGCCTCATAAGTGGAAGGATGAAATTCTCAGAAC AGCTAACCTCTAATGGGAGTTGGCTTCTGATTCTC ATTCAGGCTTCTCACGGCATTCAGCAGCAGCGTTG CTGTAACCGACAAAGACACCTTCGAATTAAGCACA TTCCTCGATTCCAGCAAAGCACCGCAACATGACCG AAATGAGCTTCCTGAGCAGCGAGGTGTTGGTGGG GGACTTGATGTCCCCCTTCGACCAGTCGGGTTTG GGGGCTGAAGAAAGCCTAGGTCTCTTAGATGATTA CCTGGAGGTGGCCAAGCACTTCAAACCTCATG TTTCTACTTTGCCCGCCCACAGATGTAGTTTTCTCT GCGCGTGTGCGTTTTCCCTCCTCCCCGCCCTCAG GGTCCACGGCCACCATGGCGTATTAGGGGCAGCA GTGCCTGCGGCAGCATTGGCCTTTGCAGCGGCGG CAGCAGCACCAGGCTCTGCAGCGGCAACCCCCAG CGGCTTAAGCCATGGCGTGAGTACCGGGGCGGGT CGTCCAGCTGTGCTCCTGGGGCCGGCGCGGGTTT TGGATTGGTGGGGTGCGGCCTGGGGCCAGGGCG GTGCCGCCAAGGGGGAAGCGATTTAACGAGCGCC CGGGACGCGTGGTCTTTGCTTGGGTGTCCCCGAG ACGCTCGCGTGCCTGGGATCGGGAAAGCGTAGTC GGGTGCCCGGACTGCTTCCCCAGGAGCCCTACAG CCCTCGGACCCCGAGCCCCGCAAGGGTCCCAGG GGTCTTGGCTGTTGCCCCACGAAACGTGGCAGGA ACCAAGATGGCGGCGGCAGGGCGGCGGCGCGGG CGTGAGTCAAGGGCGGGCGGTGGGCGGGGCGCG GCCGCCCTGGCCGTATTTGGACGTGGGGACGGAG CGCTTTCCTCTTGGCGGCCGGTGGAAGAATCCCC TGGTCTCCGTGAGCGTCCATTTTGTGGAACCTGAG TTGCAAGCAGGGAGGGGCAAATACAACTGCCCTG TTCCCGATTCTCTAGATGGCCGATCTAGAGAAGTC CCGCCTCATAAGTGGAAGGATGAAATTCTCAGAAC AGCTAACCTCTAATGGGAGTTGGCTTCTGATTCTC ATTCAGGCTTCTCACGGCATTCAGCAGCAGCGTTG CTGTAACCGACAAAGACACCTTCGAATTAAGCACA TTCCTCGATTCCAGCAAAGCACCGCAACATGACCG AAATGAGCTTCCTGAGCAGCGAGGTGTTGGTGGG GGACTTGATGTCCCCCTTCGACCAGTCGGGTTTG GGGGCTGAAGAAAGCCTAGGTCTCTTAGATGATTA CCTGGAGGTGGCCAAGCACTTCAAACCTCATG | 11 | SCPPLQIIP LV* |
| 865 | NM_0016 86.3_111 3 | 1113 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCTCCGGGGCCTTGCGGAGACTCACCC CTTCAGCGTCGCTGCCCCAGCTCAGCTCTTACTG CGGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATTGCTATG GATGGTACAGAAGGCTTGGTTAGAGGCCAGAAAG TACTGGATTCTGGTGCACCAATCAAAATTCCTGTT GGTCCTGAGACTTTGGGCAGAATCATGAATGTCAT TGGAGAACCTATTGATGAAAGAGGTCCCATCAAAA CCAAACAATTTGCTCCCATTCATGCTGAGGCTCCA GAGTTCATGGAAATGAGTGTTGAGCAGGAAATTCT GGTGACTGGTATCAAGGTTGTCGATCTGCTAGCTC CCTATGCCAAGGGTGGCAAAATTGGGCTTTTTGGT GGTGCTGGAGTTGGCAAGACTGTACTGATCATGG AGTTAATCAACAATGTCGCCAAAGCCCATGGTGGT TACTCTGTGTTTGCTGGTGTTGGTGAGAGGACCCG TGAAGGCAATGATTTATACCATGAAATGATTGAATC TGGTGTTATCAACTTAAAAGATGCCACCTCTAAGG TAGCGCTGGTATATGGTCAAATGAATGAACCACCT GGTGCTCGTGCCCGGGTAGCTCTGACTGGGCTGA CTGTGGCTGAATACTTCAGAGACCAAGAAGGTCAA GATGTACTGCTATTTATTGATA | 30 | LTWVLCRK ELPLPRRD LSPLYRLS MCLLMT* |
| 866 | NM_0016 86.3_158 9 | 1589 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCTCCGGGGCCTTGCGGAGACTCACCC CTTCAGCGTCGCTGCCCCAGCTCAGCTCTTACTG CGGGGCCGCTCCGACGGCGGTCCATCCTGTCAGG GACTATGCGGCGCAAACATCTCCTTCGCCAAAAGC | 74 | WQVNMTIS QNRPSIW WDPLKKL WQKLISWL KSIHREGS LSSVLSLSL PLTQKASF FCVGCTRA |

TABLE 3A-continued

| SEQ ID | identifier_position | position | modified_RNA | PAP length | PAP |
|---|---|---|---|---|---|
| | | | AGGCGCCGCCACCGGGCGCATCGTGGCGGTCATT<br>GGCGCAGTGGTGGACGTCCAGTTTGATGAGGGAC<br>TACCACCAATTCTAAATGCCCTGGAAGTGCAAGGC<br>AGGGAGACCAGACTGGTTTTGGAGGTGGCCCAGC<br>ATTTGGGTGAGAGCACAGTAAGGACTATTGCTATG<br>GATGGTACAGAAGGCTTGGTTAGAGGCCAGAAAG<br>TACTGGATTCTGGTGCACCAATCAAAATTCCTGTT<br>GGTCCTGAGACTTTGGGCAGAATCATGAATGTCAT<br>TGGAGAACCTATTGATGAAAGAGGTCCCATCAAAA<br>CCAAACAATTTGCTCCCATTCATGCTGAGGCTCCA<br>GAGTTCATGGAAATGAGTGTTGAGCAGGAAATTCT<br>GGTGACTGGTATCAAGGTTGTCGATCTGCTAGCTC<br>CCTATGCCAAGGGTGGCAAAATTGGGCTTTTTGGT<br>GGTGCTGGAGTTGGCAAGACTGTACTGATCATGG<br>AGTTAATCAACAATGTCGCCAAAGCCCATGGTGGT<br>TACTCTGTGTTTGCTGGTGTTGGTGAGAGGACCCG<br>TGAAGGCAATGATTTATACCATGAAATGATTGAATC<br>TGGTGTTATCAACTTAAAAGATGCCACCTCTAAGG<br>TAGCGCTGGTATATGGTCAAATGAATGAACCACCT<br>GGTGCTCGTGCCCGGGTAGCTCTGACTGGGCTGA<br>CTGTGGCTGAATACTTCAGAGACCAAGAAGGTCAA<br>GATGTACTGCTATTTATTGATA | | LIEDIFFLN<br>SI* |
| 867 | NM_0016<br>86.3_188 | 188 | AGTTCACCCAATGGACCTGCCTACTGCAGCGTAG<br>GCCTCGCCTCAACGGCAGGAGAGCAGGCGGCTG<br>CGGTTGCTGCAGCCTTCAGTCTCCACCCGGACTA<br>CGCCATGTTGGGGTTTGTGGGTCGGGTGGCCGCT<br>GCTCCGGCCTCCGGGGCCTTGCGGAGACTCACCC<br>CTTCAGCGTCGCTGCCCCAGCTCAGCTCTTACTGC<br>GGGCCGCTCCGACGGCGGTCCATCCTGTCAGGGA<br>CTATGCGGCGCAAACATCTCCTTCGCCAAAAGCAG<br>GCGCCGCCACCGGGCGCATCGTGGCGGTCATTG<br>GCGCAGTGGTGGACGTCCAGTTTGATGAGGGACT<br>ACCACCAATTCTAAATGCCCTGGAAGTGCAAGGCA<br>GGGAGACCAGACTGGTTTTGGAGGTGGCCCAGCA<br>TTTGGGTGAGAGCACAGTAAGGACTATTGCTATGG<br>ATGGTACAGAAGGCTTGGTTAGAGGCCAGAAAGT<br>ACTGGATTCTGGTGCACCAATCAAAATTCCTGTTG<br>GTCCTGAGACTTTGGGCAGAATCATGAATGTCATT<br>GGAGAACCTATTGATGAAAGAGGTCCCATCAAAAC<br>CAAACAATTTGCTCCCATTCATGCTGAGGCTCCAG<br>AGTTCATGGAAATGAGTGTTGAGCAGGAAATTCTG<br>GTGACTGGTATCAAGGTTGTCGATCTGCTAGCTCC<br>CTATGCCAAGGGTGGCAAAATTGGGCTTTTTGGTG<br>GTGCTGGAGTTGGCAAGACTGTACTGATCATGGA<br>GTTAATCAACAATGTCGCCAAAGCCCATGGTGGTT<br>ACTCTGTGTTTGCTGGTGTTGGTGAGAGGACCCGT<br>GAAGGCAATGATTTATACCATGAAATGATTGAATCT<br>GGTGTTATCAACTTAAAAGATGCCACCTCTAAGGT<br>AGCGCTGGTATATGGTCAAATGAATGAACCACCTG<br>GTGCTCGTGCCCGGGTAGCTCTGACTGGGCTGAC<br>TGTGGCTGAATACTTCAGAGACCAAGAAGGTCAAG<br>ATGTACTGCTATTTATTGATAA | 55 | QLSSYCGP<br>LRRRSILS<br>GTMRRKH<br>LLRQKQAP<br>PPGASWR<br>SLAQWWT<br>SSLMRDYH<br>QF* |
| 868 | NM_0016<br>86.3_282 | 282 | AGTTCACCCAATGGACCTGCCTACTGCAGCGTAG<br>GCCTCGCCTCAACGGCAGGAGAGCAGGCGGCTG<br>CGGTTGCTGCAGCCTTCAGTCTCCACCCGGACTA<br>CGCCATGTTGGGGTTTGTGGGTCGGGTGGCCGCT<br>GCTCCGGCCTCCGGGGCCTTGCGGAGACTCACCC<br>CTTCAGCGTCGCTGCCCCAGCTCAGCTCTTACTG<br>CGGGCCGCTCCGACGGCGGTCCATCCTGTCAGG<br>GACTATGCGGCGCAAACATCTCCTTCGCCAAAAGC<br>AGGCGCCGCACCGGGCGCATCGTGGCGGTCATT<br>GGCGCAGTGGTGGACGTCCAGTTTGATGAGGGAC<br>TACCACCAATTCTAAATGCCCTGGAAGTGCAAGGC<br>AGGGAGACCAGACTGGTTTTGGAGGTGGCCCAGC<br>ATTTGGGTGAGAGCACAGTAAGGACTATTGCTATG<br>GATGGTACAGAAGGCTTGGTTAGAGGCCAGAAAG<br>TACTGGATTCTGGTGCACCAATCAAAATTCCTGTT<br>GGTCCTGAGACTTTGGGCAGAATCATGAATGTCAT<br>TGGAGAACCTATTGATGAAAGAGGTCCCATCAAAA<br>CCAAACAATTTGCTCCCATTCATGCTGAGGCTCCA<br>GAGTTCATGGAAATGAGTGTTGAGCAGGAAATTCT<br>GGTGACTGGTATCAAGGTTGTCGATCTGCTAGCTC<br>CCTATGCCAAGGGTGGCAAAATTGGGCTTTTTGGT<br>GGTGCTGGAGTTGGCAAGACTGTACTGATCATGG<br>AGTTAATCAACAATGTCGCCAAAGCCCATGGTGGT<br>TACTCTGTGTTTGCTGGTGTTGGTGAGAGGACCCG<br>TGAAGGCAATGATTTATACCATGAAATGATTGAATC | 23 | PGASWRS<br>LAQWWTS<br>SLMRDYH<br>QF* |

TABLE 3A-continued

| SEQ ID | identifier_position | position | modified_RNA | PAP length | PAP |
|---|---|---|---|---|---|
| | | | TGGTGTTATCAACTTAAAAGATGCCACCTCTAAGG<br>TAGCGCTGGTATATGGTCAAATGAATGAACCACCT<br>GGTGCTCGTGCCCGGGTAGCTCTGACTGGGCTGA<br>CTGTGGCTGAATACTTCAGAGACCAAGAAGGTCAA<br>GATGTACTGCTATTTATTGATAA | | |
| 869 | NM_0016<br>86.3_306 | 306 | AGTTCACCCAATGGACCTGCCTACTGCAGCGTAG<br>GCCTCGCCTCAACGGCAGGAGAGCAGGCGGCTG<br>CGGTTGCTGCAGCCTTCAGTCTCCACCCGGACTA<br>CGCCATGTTGGGGTTTGTGGGTCGGGTGGCCGCT<br>GCTCCGGCCTCCGGGGCCTTGCGGAGACTCACCC<br>CTTCAGCGTCGCTGCCCCCAGCTCAGCTCTTACTG<br>CGGGCCGCTCCGACGGCGGTCCATCCTGTCAGG<br>GACTATGCGGCGCAAACATCTCCTTCGCCAAAAGC<br>AGGCGCCGCCACCGGGCGCATCGTGGCGGTCAT<br>GGCGCAGTGGTGGACGTCCAGTTTGATGAGGGAC<br>TACCACCAATTCTAAATGCCCTGGAAGTGCAAGGC<br>AGGGAGACCAGACTGGTTTTGGAGGTGGCCCAGC<br>ATTTGGGTGAGAGCACAGTAAGGACTATTGCTATG<br>GATGGTACAGAAGGCTTGGTTAGAGGCCAGAAAG<br>TACTGGATTCTGGTGCACCAATCAAAATTCCTGTT<br>GGTCCTGAGACTTTGGGCAGAATCATGAATGTCAT<br>TGGAGAACCTATTGATGAAAGAGGTCCCATCAAAA<br>CCAAACAATTTGCTCCCATTCATGCTGAGGCTCCA<br>GAGTTCATGGAAATGAGTGTTGAGCAGGAAATTCT<br>GGTGACTGGTATCAAGGTTGTCGATCTGCTAGCTC<br>CCTATGCCAAGGGTGGCAAAATTGGGCTTTTTGGT<br>GGTGCTGGAGTTGGCAAGACTGTACTGATCATGG<br>AGTTAATCAACAATGTCGCCAAAGCCCATGGTGGT<br>TACTCTGTGTTTGCTGGTGTTGGTGAGAGGACCCG<br>TGAAGGCAATGATTTATACCATGAAATGATTGAATC<br>TGGTGTTATCAACTTAAAAGATGCCACCTCTAAGG<br>TAGCGCTGGTATATGGTCAAATGAATGAACCACCT<br>GGTGCTCGTGCCCGGGTAGCTCTGACTGGGCTGA<br>CTGTGGCTGAATACTTCAGAGACCAAGAAGGTCAA<br>GATGTACTGCTATTTATTGATAA | 16 | MAQWWTS<br>SLMRDYH<br>QF* |
| 870 | NM_0016<br>86.3_330 | 330 | AGTTCACCCAATGGACCTGCCTACTGCAGCGTAG<br>GCCTCGCCTCAACGGCAGGAGAGCAGGCGGCTG<br>CGGTTGCTGCAGCCTTCAGTCTCCACCCGGACTA<br>CGCCATGTTGGGGTTTGTGGGTCGGGTGGCCGCT<br>GCTCCGGCCTCCGGGGCCTTGCGGAGACTCACCC<br>CTTCAGCGTCGCTGCCCCCAGCTCAGCTCTTACTG<br>CGGGCCGCTCCGACGGCGGTCCATCCTGTCAGG<br>GACTATGCGGCGCAAACATCTCCTTCGCCAAAAGC<br>AGGCGCCGCCACCGGGCGCATCGTGGCGGTCATT<br>GGCGCAGTGGTGGACGTCCAGTTTGATGAGGGACT<br>ACCACCAATTCTAAATGCCCTGGAAGTGCAAGGCA<br>GGGAGACCAGACTGGTTTTGGAGGTGGCCCAGCA<br>TTTGGGTGAGAGCACAGTAAGGACTATTGCTATGG<br>ATGGTACAGAAGGCTTGGTTAGAGGCCAGAAAGT<br>ACTGGATTCTGGTGCACCAATCAAAATTCCTGTTG<br>GTCCTGAGACTTTGGGCAGAATCATGAATGTCATT<br>GGAGAACCTATTGATGAAAGAGGTCCCATCAAAAC<br>CAAACAATTTGCTCCCATTCATGCTGAGGCTCCAG<br>AGTTCATGGAAATGAGTGTTGAGCAGGAAATTCTG<br>GTGACTGGTATCAAGGTTGTCGATCTGCTAGCTCC<br>CTATGCCAAGGGTGGCAAAATTGGGCTTTTTGGTG<br>GTGCTGGAGTTGGCAAGACTGTACTGATCATGGA<br>GTTAATCAACAATGTCGCCAAAGCCCATGGTGGTT<br>ACTCTGTGTTTGCTGGTGTTGGTGAGAGGACCCGT<br>GAAGGCAATGATTTATACCATGAAATGATTGAATCT<br>GGTGTTATCAACTTAAAAGATGCCACCTCTAAGGT<br>AGCGCTGGTATATGGTCAAATGAATGAACCACCTG<br>GTGCTCGTGCCCGGGTAGCTCTGACTGGGCTGAC<br>TGTGGCTGAATACTTCAGAGACCAAGAAGGTCAAG<br>ATGTACTGCTATTTATTGATAA | 8 | LMRDYHQ<br>F* |
| 871 | NM_0016<br>86.3_379 | 379 | AGTTCACCCAATGGACCTGCCTACTGCAGCGTAG<br>GCCTCGCCTCAACGGCAGGAGAGCAGGCGGCTG<br>CGGTTGCTGCAGCCTTCAGTCTCCACCCGGACTA<br>CGCCATGTTGGGGTTTGTGGGTCGGGTGGCCGCT<br>GCTCCGGCCTCCGGGGCCTTGCGGAGACTCACCC<br>CTTCAGCGTCGCTGCCCCCAGCTCAGCTCTTACTG<br>CGGGCCGCTCCGACGGCGGTCCATCCTGTCAGG<br>GACTATGCGGCGCAAACATCTCCTTCGCCAAAAGC<br>AGGCGCCGCCACCGGGCGCATCGTGGCGGTCATT<br>GGCGCAGTGGTGGACGTCCAGTTTGATGAGGGAC<br>TACCACCAATTCTAAATGCCCTGGAAGTGCAAGGC<br>AGGGAGACCAGACTGGTTTTGGAGGTGGCCCAGCA | 16 | RPDWFWR<br>WPSIWVRA<br>Q* |

TABLE 3A-continued

| SEQ ID | identifier_position | position | modified_RNA | PAP length | PAP |
|---|---|---|---|---|---|
| | | | TTTGGGTGAGAGCACAGTAAGGACTATTGCTATGG ATGGTACAGAAGGCTTGGTTAGAGGCCAGAAAGT ACTGGATTCTGGTGCACCAATCAAAATTCCTGTTG GTCCTGAGACTTTGGGCAGAATCATGAATGTCATT GGAGAACCTATTGATGAAAGAGGTCCCATCAAAAC CAAACAATTTGCTCCCATTCATGCTGAGGCTCCAG AGTTCATGGAAATGAGTGTTGAGCAGGAAATTCTG GTGACTGGTATCAAGGTTGTCGATCTGCTAGCTCC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | | |
| 872 | NM_0016 86.3_395 | 395 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCAGCTCAGCTCTTACTG CGGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGCA TTTGGGTGAGAGCACAGTAAGGACTATTGCTATGG ATGGTACAGAAGGCTTGGTTAGAGGCCAGAAAGT ACTGGATTCTGGTGCACCAATCAAAATTCCTGTTG GTCCTGAGACTTTGGGCAGAATCATGAATGTCATT GGAGAACCTATTGATGAAAGAGGTCCCATCAAAAC CAAACAATTTGCTCCCATTCATGCTGAGGCTCCAG AGTTCATGGAAATGAGTGTTGAGCAGGAAATTCTG GTGACTGGTATCAAGGTTGTCGATCTGCTAGCTCC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | 11 | WRWPSIW VRAQ* |
| 873 | NM_0016 86.3_438 | 438 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCAGCTCAGCTCTTACTG CGGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATGCTATGG ATGGTACAGAAGGCTTGGTTAGAGGCCAGAAAGT ACTGGATTCTGGTGCACCAATCAAAATTCCTGTTG GTCCTGAGACTTTGGGCAGAATCATGAATGTCATT GGAGAACCTATTGATGAAAGAGGTCCCATCAAAAC CAAACAATTTGCTCCCATTCATGCTGAGGCTCCAG AGTTCATGGAAATGAGTGTTGAGCAGGAAATTCTG GTGACTGGTATCAAGGTTGTCGATCTGCTAGCTCC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC | 34 | MLWMVQK AWLEARKY WILVHQSK FLLVLRLW AES* |

TABLE 3A-continued

| SEQ ID | identifier_position | position | modified_RNA | PAP length | PAP |
|---|---|---|---|---|---|
| 874 | NM_0016 86.3_513 | 513 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCAGCTCAGCTCTTACTG CGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATTGCTATG GATGGTACAGAAGGCTTGGTTAGAGGCCAGAAAG TACTGGATTCTGGTGCACCAATCAAAATTCCTGTG GTCCTGAGACTTTGGGCAGAATCATGAATGTCATT GGAGAACCTATTGATGAAAGAGGTCCCATCAAAAC CAAACAATTTGCTCCCATTCATGCTGAGGCTCCAG AGTTCATGGAAATGAGTGTTGAGCAGGAAATTCTG GTGACTGGTATCAAGGTTGTCGATCTGCTAGCTCC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | 8 | VLRLWAES* |
| 875 | NM_0016 86.3_585 | 585 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCAGCTCAGCTCTTACTG CGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATTGCTATG GATGGTACAGAAGGCTTGGTTAGAGGCCAGAAAG TACTGGATTCTGGTGCACCAATCAAAATTCCTGTT GGTCCTGAGACTTTGGGCAGAATCATGAATGTCAT TGGAGAACCTATTGATGAAAGAGGTCCCATCAAAA CAAACAATTTGCTCCCATTCATGCTGAGGCTCCAG AGTTCATGGAAATGAGTGTTGAGCAGGAAATTCTG GTGACTGGTATCAAGGTTGTCGATCTGCTAGCTCC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | 15 | NNLLPFML RLQSSWK* |
| 876 | NM_0016 86.3_682 | 682 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCAGCTCAGCTCTTACTG CGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATTGCTATG GATGGTACAGAAGGCTTGGTTAGAGGCCAGAAAG TACTGGATTCTGGTGCACCAATCAAAATTCCTGTT | 0 | * |

TABLE 3A-continued

| SEQ ID | identifier_position | position | modified_RNA | PAP length | PAP |
|---|---|---|---|---|---|
| | | | GGTCCTGAGACTTTGGGCAGAATCATGAATGTCAT TGGAGAACCTATTGATGAAAGAGGTCCCATCAAAA CCAAACAATTTGCTCCCATTCATGCTGAGGCTCCA GAGTTCATGGAAATGAGTGTTGAGCAGGAAATTCT GGTGACTGGTATCAAGGTTGTCGATCTGCTAGCTC CTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | | |
| 877 | NM_0016 86.3_720 | 720 | AGTTCACCCAATGGACCTGCCTACTGCAGCGTAG GCCTCGCCTCAACGGCAGGAGAGCAGGCGGCTG CGGTTGCTGCAGCCTTCAGTCTCCACCCGGACTA CGCCATGTTGGGGTTTGTGGGTCGGGTGGCCGCT GCTCCGGCCTCCGGGGCCTTGCGGAGACTCACCC CTTCAGCGTCGCTGCCCCCAGCTCAGCTCTTACTG CGGGCCGCTCCGACGGCGGTCCATCCTGTCAGG GACTATGCGGCGCAAACATCTCCTTCGCCAAAAGC AGGCGCCGCCACCGGGCGCATCGTGGCGGTCATT GGCGCAGTGGTGGACGTCCAGTTTGATGAGGGAC TACCACCAATTCTAAATGCCCTGGAAGTGCAAGGC AGGGAGACCAGACTGGTTTTGGAGGTGGCCCAGC ATTTGGGTGAGAGCACAGTAAGGACTATTGCTATG GATGGTACAGAAGGCTTGGTTAGAGGCCAGAAAG TACTGGATTCTGGTGCACCAATCAAAATTCCTGTT GGTCCTGAGACTTTGGGCAGAATCATGAATGTCAT TGGAGAACCTATTGATGAAAGAGGTCCCATCAAAA CCAAACAATTTGCTCCCATTCATGCTGAGGCTCCA GAGTTCATGGAAATGAGTGTTGAGCAGGAAATTCT GGTGACTGGTATCAAGGTTGTCGATCTGCTAGCTC CCTATGCCAAGGGTGGCAAAATTGGGCTTTTTGGTG GTGCTGGAGTTGGCAAGACTGTACTGATCATGGA GTTAATCAACAATGTCGCCAAAGCCCATGGTGGTT ACTCTGTGTTTGCTGGTGTTGGTGAGAGGACCCGT GAAGGCAATGATTTATACCATGAAATGATTGAATCT GGTGTTATCAACTTAAAAGATGCCACCTCTAAGGT AGCGCTGGTATATGGTCAAATGAATGAACCACCTG GTGCTCGTGCCCGGGTAGCTCTGACTGGGCTGAC TGTGGCTGAATACTTCAGAGACCAAGAAGGTCAAG ATGTACTGCTATTTATTGATAA | 10 | LVVLELAR LY* |
| 878 | NM_0016 88.4_454 | 454 | ACTCCCGGGCCGCCGGGGGCACTAGGGGGGGTG GGGTTTCCTTCCGCATCTCCACGGTTCCAACTCCA ACCTAGACTCAAACTGGACGCCGGCCGGAGACTC CGCTCCGGCAGCAAACCCCACGTGGTGCACCTCT GAGCCTCCGCCCCTCTCCCGAGGGAACCGCAACT CTACTTCTCGCGAGAATTGCTTCTATGGCTCCATC CTGCTTTCCGGCTGTCGCCCTCATGCGATAGGCTC TCAGCGTTACTTGACTCTTCTCGCGATAATTTTTTT TAAAAATCTCCCAAGGAAAGTTGAAGGAAGAGTAC AAAATTTTCATCTCGCGAGACTTGTGAGCGGCCAT CTTGGTCCTGCCCTGACAGATTCTCCTATCGGGGT CACAGGGACGCTAAGATTGCTACCTGGACTTTCGT TGACCATGCTGTCCCGGGTGGTACTTTCCGCCGC CGCACAGCGGCCCCCTCTCTGAAGAATGCAGCCT TCCTAGGTCCAGGGGTATTGCAGGCAACAAGGAC CTTTCATACAGGGCAGCCACACCTTGTCCCTGTAC CACCTCTTCCTGAATACGGAGGAAAAGTTCGTTAT GGACTGATCCCTGAGGAATTCTTCCAGTTTCTTTAT CCTAAAACTGGTGTAACAGGACCCTATGTACTCGG AACTGGGCTTATCTTGTACGCTTATCCAAAGAAAT ATATGTGATTAGCGCAGAGACCTTCACTGCCCTAT CAGTACTAGGTGTAATGGTCTATGGAATTAAAAAAT ATGGTCCCTTTGTTGCAGACTTTGCTGATAAACTCA ATGAGCAAAAACTTGCCCAACTAGAAGAGGCGAA GCAGGCTTCCATCCAACACATCCAGAATGCAATTG ATACGGAGAAGTCACAACAGGCACTGGTTCAGAA GCGCCATTACCTTTTTGATGTGCAAAGGAATAACA TTGCTATGGCTTTGGAAGTTACTTACCGGGAACGA CTGTATAGAGTATATAAGGAAGTAAAGAATCGCCT GGACTATCATATAT | 5 | QRPPL* |

| SEQ ID | identifier_position | position | modified_RNA | PAP length | PAP |
|---|---|---|---|---|---|
| 879 | NM_0016 88.4_500 | 500 | ACTCCCGGGCCGCCGGGGGCACTAGGGGGGGTG GGGTTTCCTTCCGCATCTCCACGGTTCCAACTCCA ACCTAGACTCAAACTGGACGCCGGCCGGAGACTC CGCTCCGGCAGCAAACCCCACGTGGTGCACCTCT GAGCCTCCGCCCCTCTCCCGAGGGAACCGCAACT CTACTTCTCGCGAGAATTGCTTCTATGGCTCCATC CTGCTTTCCGGCTGTCGCCCTCATGCGATAGGCTC TCAGCGTTACTTGACTCTTCTCGCGATAATTTTTTT TAAAAATCTCCCAAGGAAAGTTGAAGGAAGAGTAC AAAATTTTCATCTCGCGAGACTTGTGAGCGGCCAT CTTGGTCCTGCCCTGACAGATTCTCCTATCGGGGT CACAGGGACGCTAAGATTGCTACCTGGACTTTCGT TGACCATGCTGTCCCGGGTGGTACTTTCCGCCGC CGCCACAGCGGCCCCCTCTCTGAAGAATGCAGCC TTCCTAGGTCCAGGGTATTGCAGGCAACAAGGAC CTTTCATACAGGGCAGCCACACCTTGTCCCTGTAC CACCTCTTCCTGAATACGGAGGAAAAGTTCGTTAT GGACTGATCCCTGAGGAATTCTTCCAGTTTCTTTAT CCTAAAACTGGTGTAACAGGACCCTATGTACTCGG AACTGGGCTTATCTTGTACGCTTTATCCAAAGAAAT ATATGTGATTAGCGCAGAGACCTTCACTGCCCTAT CAGTACTAGGTGTAATGGTCTATGGAATTAAAAAAT ATGGTCCCTTTGTTGCAGACTTTGCTGATAAACTCA ATGAGCAAAAACTTGCCCAACTAGAAGAGGCGAA GCAGGCTTCCATCCAACACATCCAGAATGCAATTG ATACGGAGAAGTCACAACAGGCACTGGTTCAGAA GCGCCATTACCTTTTTGATGTGCAAAGGAATAACA TTGCTATGGCTTTGGAAGTTACTTACCGGGAACGA CTGTATAGAGTATATAAGGAAGTAAAGAATCGCCT GGACTATCATATAT | 31 | YCRQQGP FIQGSHTL SLYHLFLN TEEKFVMD* |
| 880 | NM_0016 88.4_790 | 790 | ACTCCCGGGCCGCCGGGGGCACTAGGGGGGGTG GGGTTTCCTTCCGCATCTCCACGGTTCCAACTCCA ACCTAGACTCAAACTGGACGCCGGCCGGAGACTC CGCTCCGGCAGCAAACCCCACGTGGTGCACCTCT GAGCCTCCGCCCCTCTCCCGAGGGAACCGCAACT CTACTTCTCGCGAGAATTGCTTCTATGGCTCCATC CTGCTTTCCGGCTGTCGCCCTCATGCGATAGGCTC TCAGCGTTACTTGACTCTTCTCGCGATAATTTTTTT TAAAAATCTCCCAAGGAAAGTTGAAGGAAGAGTAC AAAATTTTCATCTCGCGAGACTTGTGAGCGGCCAT CTTGGTCCTGCCCTGACAGATTCTCCTATCGGGGT CACAGGGACGCTAAGATTGCTACCTGGACTTTCGT TGACCATGCTGTCCCGGGTGGTACTTTCCGCCGC CGCCACAGCGGCCCCCTCTCTGAAGAATGCAGCC TTCCTAGGTCCAGGGGTATTGCAGGCAACAAGGA CCTTTCATACAGGGCAGCCACACCTTGTCCCTGTA CCACCTCTTCCTGAATACGGAGGAAAAGTTCGTTA TGGACTGATCCCTGAGGAATTCTTCCAGTTTCTTTA TCCTAAAACTGGTGTAACAGGACCCTATGTACTCG GAACTGGGCTTATCTTGTACGCTTTATCCAAAGAA ATATATGTGATTAGCGCAGAGACCTTCACTGCCCT ATCAGTACTAGGTGTAATGGTCTATGGAATTAAAAA ATATGGTCCCTTTGTTGCAGACTTGCTGATAAACTC AATGAGCAAAAACTTGCCCAACTAGAAGAGGCGAA GCAGGCTTCCATCCAACACATCCAGAATGCAATTG ATACGGAGAAGTCACAACAGGCACTGGTTCAGAA GCGCCATTACCTTTTTGATGTGCAAAGGAATAACA TTGCTATGGCTTTGGAAGTTACTTACCGGGAACGA CTGTATAGAGTATATAAGGAAGTAAAGAATCGCCT GGACTATCATATAT | 12 | LLINSMSK NLPN* |
| 881 | NM_0016 88.4_954 | 954 | ACTCCCGGGCCGCCGGGGGCACTAGGGGGGGTG GGGTTTCCTTCCGCATCTCCACGGTTCCAACTCCA ACCTAGACTCAAACTGGACGCCGGCCGGAGACTC CGCTCCGGCAGCAAACCCCACGTGGTGCACCTCT GAGCCTCCGCCCCTCTCCCGAGGGAACCGCAACT CTACTTCTCGCGAGAATTGCTTCTATGGCTCCATC CTGCTTTCCGGCTGTCGCCCTCATGCGATAGGCTC TCAGCGTTACTTGACTCTTCTCGCGATAATTTTTTT TAAAAATCTCCCAAGGAAAGTTGAAGGAAGAGTAC AAAATTTTCATCTCGCGAGACTTGTGAGCGGCCAT CTTGGTCCTGCCCTGACAGATTCTCCTATCGGGGT CACAGGGACGCTAAGATTGCTACCTGGACTTTCGT TGACCATGCTGTCCCGGGTGGTACTTTCCGCCGC CGCCACAGCGGCCCCCTCTCTGAAGAATGCAGCC TTCCTAGGTCCAGGGGTATTGCAGGCAACAAGGA CCTTTCATACAGGGCAGCCACACCTTGTCCCTGTA CCACCTCTTCCTGAATACGGAGGAAAAGTTCGTTA | 15 | WKLLTGND CIEYRK* |

TABLE 3A-continued

| SEQ ID | identifier_position | position | modified_RNA | PAP length | PAP |
|---|---|---|---|---|---|
| | | | TGGACTGATCCCTGAGGAATTCTTCCAGTTTCTTTA TCCTAAAACTGGTGTAACAGGACCCTATGTACTCG GAACTGGGCTTATCTTGTACGCTTTATCCAAAGAA ATATATGTGATTAGCGCAGAGACCTTCACTGCCCT ATCAGTACTAGGTGTAATGGTCTATGGAATTAAAAA ATATGGTCCCTTTGTTGCAGACTTTGCTGATAAACT CAATGAGCAAAAACTTGCCCAACTAGAAGAGGCGA AGCAGGCTTCCATCCAACACATCCAGAATGCAATT GATACGGAGAAGTCACAACAGGCACTGGTTCAGA AGCGCCATTACCTTTTTGATGTGCAAAGGAATAAC ATTGCTATGGCTTGGAAGTTACTTACCGGGAACGA CTGTATAGAGTATATAAGGAAGTAAAGAATCGCCT GGACTATCATATAT | | |
| 882 | NM_0016 89.4_468 | 468 | CTTCATCCGGGTGCTGCGGCGCGAATAAGAGCCG GACCGCGCTTGCGCATTGAGTCCCACTCCTTCGA CCTCTGCCGCAGCCCGTGCCGCCGCCGCCTCCTG GGAAGAGAGGAAGCGGGAGAGGAGCCCACGTCG CCTGTCACCCAATATCTCCAGCCGCGCAGTCCCG AAGAGTGTAAGATGTTCGCCTGCGCCAAGCTCGC CTGCACCCCCTCTCTGATCCGAGCTGGATCCAGA GTTGCATACAGACCAATTTCTGCATCAGTGTTATCT CGACCAGAGGCTAGTAGGACTGGAGAGGGCTCTA CGGTATTTAATGGGGCCCAGAATGGTGTGTCTCAG CTAATCCAAAGGGAGTTTCAGACCAGTGCAATCAG CAGAGACATTGATACTGCTGCCAAATTTATTGGTG CAGGTGCTGCAACAGTAGGAGTGGCTGGTTCTGG TGCTGGTATTGGAACAGTCTTGGCAGCCTTATCAT TGGTTATGCCAGAAACCCTTCGCTGAAGCAGCAG CTGTTCTCATATGCTATCCTGGGATTTGCCTTGTCT GAAGCTATGGGTCTCTTTTGTTTGATGGTTGCTTTC TTGATTTTGTTTGCCATGTAACAAATTACTGCTTGA CATGTTGGCATTCATATTAATTACGGATGTAATTCT GTGTATCTTACTGTGACTCCGAAAACTGTAGTATTG GTGTCATGGGAATGTACGTTATTTCCAAAGTCATTT CATTAAAGATGAAAACTTTAATTTCTTCTGTGATTT GTACTTACACTAAGTTTAGATTATCACAAAGAAGAA CGTGCATTCAGGCAGATGCTGTCCCATTCAGAGG AAGCTACAGCAGTTGCTCCACTGATGAAAAATATT CCAATGTAATTTTTATGGGAATTCTTTTATATAGTGT TCTGCATATTGTAATTCATAGGGCTTTTGTTTATTC ATATAAAGGATAAATATTTGGGTGTTTTGAGCTTCT ATAAAAATATGATTAATTAAAGGTAGTTAATACTCAA GATGGTC | 13 | LAALSLVM PETLR* |
| 883 | NM_0016 89.4_596 | 596 | CTTCATCCGGGTGCTGCGGCGCGAATAAGAGCCG GACCGCGCTTGCGCATTGAGTCCCACTCCTTCGA CCTCTGCCGCAGCCCGTGCCGCCGCCGCCTCCTG GGAAGAGAGGAAGCGGGAGAGGAGCCCACGTCG CCTGTCACCCAATATCTCCAGCCGCGCAGTCCCG AAGAGTGTAAGATGTTCGCCTGCGCCAAGCTCGC CTGCACCCCCTCTCTGATCCGAGCTGGATCCAGA GTTGCATACAGACCAATTTCTGCATCAGTGTTATCT CGACCAGAGGCTAGTAGGACTGGAGAGGGCTCTA CGGTATTTAATGGGGCCCAGAATGGTGTGTCTCAG CTAATCCAAAGGGAGTTTCAGACCAGTGCAATCAG CAGAGACATTGATACTGCTGCCAAATTTATTGGTG CAGGTGCTGCAACAGTAGGAGTGGCTGGTTCTGG TGCTGGTATTGGAACAGTCTTTGGCAGCCTTATCA TTGGTTATGCCAGAAACCCTTCGCTGAAGCAGCAG CTGTTCTCATATGCTATCCTGGGATTTGCCTTGTCT GAAGCTATGGGTCTCTTTTGTTTGATGGTTGCTTTC TTGATTTGTTTGCCATGTAACAAATTACTGCTTGAC ATGTTGGCATTCATATTAATTACGGATGTAATTCTG TGTATCTTACTGTGACTCCGAAAACTGTAGTATTGG TGTCATGGGAATGTACGTTATTTCCAAAGTCATTTC ATTAAAGATGAAAACTTTAATTTCTTCTGTGATTTGT ACTTACACTAAGTTTAGATTATCACAAAGAAGAACG TGCATTCAGGCAGATGCTGTCCCATTCAGAGGAAG CTACAGCAGTTGCTCCACTGATGAAAAATATTCCA ATGTAATTTTTATGGGAATTCTTTTATATAGTGTTCT GCATATTGTAATTCATAGGGCTTTTGTTTATTCATA TAAAGGATAAATATTTGGGTGTTTTGAGCTTCTATA AAATATGATTAATTAAAGGTAGTTAATACTCAAGAT GGTC | 26 | CLPCNKLL LDMLAFILI TDVILCILL* |
| 884 | NM_0017 43.3_128 | 128 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTGACAAAGATGG | 8 | LTKMVMEL* |

TABLE 3A-continued

| SEQ ID | identifier_position | position | modified_RNA | PAP length | PAP |
|---|---|---|---|---|---|
| | | | TGATGGAACTATAACAACAAAGGAATTGGGAACTG<br>TAATGAGATCTCTTGGGCAGAATCCCACAGAAGCA<br>GAGTTACAGGACATGATTAATGAAGTAGATGCTGA<br>TGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTTGATGAAATGATCAGGGAAGC<br>AGATATTGATGGTGATGGTCAAGTAAACTATGAAG<br>AGTTTGTACAAATGATGACAGCAAAGTGAAGACCT<br>TGTACAGAATGTGTTAAATTCTTGTACAAAATTGT<br>TTATTTGCCTTTTCTTTGTTTGTAACTTATCTGTAAA<br>AGGTTTCTCCCTACTGTCAAAAAAATATGCATGTAT<br>AGTAATTAGGACTTCATTCCTCCATGTTTTCTTCCC<br>TTATCTTACTGTCATTGTCCTAAAACCTTATTTTAGA<br>AAAATTGATCAAGTAACATGTTGCATGTGGCTTACTC<br>TGGATATATCTAAGCCCTTCTGCACATCTAAACTTA<br>GATGGAGTTGGTCAAATGAGGGAACATCTGGGTTA<br>TGCCTTTTTAAAGTAGTTTTCTTTAGGAACTGTCA<br>GCATGTTGTTGTTGAAGTGTGGAGTTGTAACTCTG<br>CGTGGACTATGGACAGTCAACAATATGTACTTAAA<br>AGTTGCACTATTGCAAAACGGGTGTATTATCCAGG<br>TACTCGTACACTATTTTTTTGTACTGCTGGTCCTGT<br>ACCAGAAACATTTTCTTTTATTGTTACTTGCTTTT | | |
| 885 | NM_0017 43.3_166 | 166 | AGTCCGAGTGGAGAGAGCGAGCTGAGTGGTTGTG<br>TGGTCGCGTCTCGGAAACCGGTAGCGCTTGCAGC<br>ATGGCTGACCAACTGACTGAAGAGCAGATTGCAG<br>AATTCAAAGAAGCTTTTTCACTATTTGACAAAGATG<br>GTGATGGAACTATAACAACAAAGGAATGGGAACTG<br>TAATGAGATCTCTTGGGCAGAATCCCACAGAAGCA<br>GAGTTACAGGACATGATTAATGAAGTAGATGCTGA<br>TGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTTGATGAAATGATCAGGGAAGC<br>AGATATTGATGGTGATGGTCAAGTAAACTATGAAG<br>AGTTTGTACAAATGATGACAGCAAAGTGAAGACCT<br>TGTACAGAATGTGTTAAATTCTTGTACAAAATTGT<br>TTATTTGCCTTTTCTTTGTTTGTAACTTATCTGTAAA<br>AGGTTTCTCCCTACTGTCAAAAAAATATGCATGTAT<br>AGTAATTAGGACTTCATTCCTCCATGTTTTCTTCCC<br>TTATCTTACTGTCATTGTCCTAAAACCTTATTTTAGA<br>AAAATTGATCAAGTAACATGTTGCATGTGGCTTACTC<br>TGGATATATCTAAGCCCTTCTGCACATCTAAACTTA<br>GATGGAGTTGGTCAAATGAGGGAACATCTGGGTTA<br>TGCCTTTTTAAAGTAGTTTTCTTTAGGAACTGTCA<br>GCATGTTGTTGTTGAAGTGTGGAGTTGTAACTCTG<br>CGTGGACTATGGACAGTCAACAATATGTACTTAAA<br>AGTTGCACTATTGCAAAACGGGTGTATTATCCAGG<br>TACTCGTACACTATTTTTTTGTACTGCTGGTCCTGT<br>ACCAGAAACATTTTCTTTTATTGTTACTTGCTTTT | 3 | WEL* |
| 886 | NM_0017 43.3_188 | 188 | AGTCCGAGTGGAGAGAGCGAGCTGAGTGGTTGTG<br>TGGTCGCGTCTCGGAAACCGGTAGCGCTTGCAGC<br>ATGGCTGACCAACTGACTGAAGAGCAGATTGCAG<br>AATTCAAAGAAGCTTTTTCACTATTTGACAAAGATG<br>GTGATGGAACTATAACAACAAAGGAATTGGGAACT<br>GTAATGAGATCTCTGGGCAGAATCCCACAGAAGCA<br>GAGTTACAGGACATGATTAATGAAGTAGATGCTGA<br>TGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTTGATGAAATGATCAGGGAAGC<br>AGATATTGATGGTGATGGTCAAGTAAACTATGAAG<br>AGTTTGTACAAATGATGACAGCAAAGTGAAGACCT<br>TGTACAGAATGTGTTAAATTCTTGTACAAAATTGT<br>TTATTTGCCTTTTCTTTGTTTGTAACTTATCTGTAAA<br>AGGTTTCTCCCTACTGTCAAAAAAATATGCATGTAT<br>AGTAATTAGGACTTCATTCCTCCATGTTTTCTTCCC<br>TTATCTTACTGTCATTGTCCTAAAACCTTATTTTAGA<br>AAAATTGATCAAGTAACATGTTGCATGTGGCTTACTC<br>TGGATATATCTAAGCCCTTCTGCACATCTAAACTTA<br>GATGGAGTTGGTCAAATGAGGGAACATCTGGGTTA | 10 | RIPQKQSY RT* |

TABLE 3A-continued

| SEQ ID | identifier_position | position | modified_RNA | PAP length | PAP |
|---|---|---|---|---|---|
| 887 | NM_0017 43.3_260 | 260 | TGCCTTTTTTAAAGTAGTTTTCTTTAGGAACTGTCA GCATGTTGTTGTTGAAGTGTGGAGTTGTAACTCTG CGTGGACTATGGACAGTCAACAATATGTACTTAAA AGTTGCACTATTGCAAAACGGGTGTATTATCCAGG TACTCGTACACTATTTTTTTGTACTGCTGGTCCTGT ACCAGAAACATTTTCTTTTATTGTTACTTGCTTTT AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTTGGAGAGAAGTTA ACAGATGAAGAAGTTGATGAAATGATCAGGGAAGC AGATATTGATGGTGATGGTCAAGTAAACTATGAAG AGTTTGTACAAATGATGACAGCAAAGTGAAGACCT TGTACAGAATGTGTTAAATTTCTTGTACAAAATTGT TTATTTGCCTTTTCTTTGTTTGTAACTTATCTGTAAA AGGTTTCTCCCTACTGTCAAAAAAATATGCATGTAT AGTAATTAGGACTTCATTCCTCCATGTTTTCTTCCC TTATCTTACTGTCATTGTCCTAAAACCTTATTTTAGA AAATTGATCAAGTAACATGTTGCATGTGGCTTACTC TGGATATATCTAAGCCCTTCTGCACATCTAAACTTA GATGGAGTTGGTCAAATGAGGGAACATCTGGGTTA TGCCTTTTTTAAAGTAGTTTTCTTTAGGAACTGTCA GCATGTTGTTGTTGAAGTGTGGAGTTGTAACTCTG CGTGGACTATGGACAGTCAACAATATGTACTTAAA AGTTGCACTATTGCAAAACGGGTGTATTATCCAGG TACTCGTACACTATTTTTTTGTACTGCTGGTCCTGT ACCAGAAACATTTTCTTTTATTGTTACTTGCTTTT | 6 | MTSLNF* |
| 888 | NM_0017 43.3_347 | 347 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTGAT AAGGATGGCAATGGCTATATTAGTGCTGCAGAACT TCGCCATGTGATGACAAACCTTGGAGAGAAGTTAA CAGATGAAGAAGTTGATGAAATGATCAGGGAAGCA GATATTGATGGTGATGGTCAAGTAAACTATGAAGA GTTTGTACAAATGATGACAGCAAAGTGAAGACCTT GTACAGAATGTGTTAAATTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | 16 | LIRMAMAIL VLQNFAM* |
| 889 | NM_0017 43.3_365 | 365 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAACT TCGCCATGTGATGACAAACCTTGGAGAGAAGTTAA CAGATGAAGAAGTTGATGAAATGATCAGGGAAGCA | 9 | ILVLQNFA M* |

TABLE 3A-continued

| SEQ ID | identifier_position | position | modified_RNA | PAP length | PAP |
|---|---|---|---|---|---|
| | | | GATATTGATGGTGATGGTCAAGTAAACTATGAAGA GTTTGTACAAATGATGACAGCAAAGTGAAGACCTT GTACAGAATGTGTTAAATTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | | |
| 890 | NM_0017 43.3_405 | 405 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACTTGGAGAGAAGTTAA CAGATGAAGAAGTTGATGAAATGATCAGGGAAGCA GATATTGATGGTGATGGTCAAGTAAACTATGAAGA GTTTGTACAAATGATGACAGCAAAGTGAAGACCTT GTACAGAATGTGTTAAATTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | 3 | ERS* |
| 891 | NM_0017 43.3_407 | 407 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTGGAGAGAAGTTAA CAGATGAAGAAGTTGATGAAATGATCAGGGAAGCA GATATTGATGGTGATGGTCAAGTAAACTATGAAGA GTTTGTACAAATGATGACAGCAAAGTGAAGACCTT GTACAGAATGTGTTAAATTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | 3 | ERS* |
| 892 | NM_0017 43.3_434 | 434 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG | 2 | MK* |

TABLE 3A-continued

| SEQ ID | identifier_position | position | modified_RNA | PAP length | PAP |
|---|---|---|---|---|---|
| | | | AATTCAAAGAAGCTTTTTCACTATTTGACAAAGATG<br>GTGATGGAACTATAACAACAAAGGAATTGGGAACT<br>GTAATGAGATCTCTTGGGCAGAATCCCACAGAAGC<br>AGAGTTACAGGACATGATTAATGAAGTAGATGCTG<br>ATGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTGATGAAATGATCAGGGAAGCA<br>GATATTGATGGTGATGGTCAAGTAAACTATGAAGA<br>GTTTGTACAAATGATGACAGCAAAGTGAAGACCTT<br>GTACAGAATGTGTTAAATTTCTTGTACAAAATTGTT<br>TATTTGCCTTTTCTTTGTTTGTAACTTATCTGTAAAA<br>GGTTTCTCCCTACTGTCAAAAAAATATGCATGTATA<br>GTAATTAGGACTTCATTCCTCCATGTTTTCTTCCCT<br>TATCTTACTGTCATTGTCCTAAAACCTTATTTTAGAA<br>AATTGATCAAGTAACATGTTGCATGTGGCTTACTCT<br>GGATATATCTAAGCCCTTCTGCACATCTAAACTTAG<br>ATGGAGTTGGTCAAATGAGGGAACATCTGGGTTAT<br>GCCTTTTTTAAAGTAGTTTTCTTTAGGAACTGTCAG<br>CATGTTGTTGTTGAAGTGTGGAGTTGTAACTCTGC<br>GTGGACTATGGACAGTCAACAATATGTACTTAAAA<br>GTTGCACTATTGCAAAACGGGTGTATTATCCAGGT<br>ACTCGTACACTATTTTTTTGTACTGCTGGTCCTGTA<br>CCAGAAACATTTTCTTTTATTGTTACTTGCTTTT | | |
| 893 | NM_0017<br>43.3_461 | 461 | AGTCCGAGTGGAGAGAGCGAGCTGAGTGGTTGTG<br>TGGTCGCGTCTCGGAAACCGGTAGCGCTTGCAGC<br>ATGGCTGACCAACTGACTGAAGAGCAGATTGCAG<br>AATTCAAAGAAGCTTTTTCACTATTTGACAAAGATG<br>GTGATGGAACTATAACAACAAAGGAATTGGGAACT<br>GTAATGAGATCTCTTGGGCAGAATCCCACAGAAGC<br>AGAGTTACAGGACATGATTAATGAAGTAGATGCTG<br>ATGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTTGATGAAATGATCAGGGAAGC<br>AGATATGATGGTGATGGTCAAGTAAACTATGAAGA<br>GTTTGTACAAATGATGACAGCAAAGTGAAGACCTT<br>GTACAGAATGTGTTAAATTTCTTGTACAAAATTGTT<br>TATTTGCCTTTTCTTTGTTTGTAACTTATCTGTAAAA<br>GGTTTCTCCCTACTGTCAAAAAAATATGCATGTATA<br>GTAATTAGGACTTCATTCCTCCATGTTTTCTTCCCT<br>TATCTTACTGTCATTGTCCTAAAACCTTATTTTAGAA<br>AATTGATCAAGTAACATGTTGCATGTGGCTTACTCT<br>GGATATATCTAAGCCCTTCTGCACATCTAAACTTAG<br>ATGGAGTTGGTCAAATGAGGGAACATCTGGGTTAT<br>GCCTTTTTTAAAGTAGTTTTCTTTAGGAACTGTCAG<br>CATGTTGTTGTTGAAGTGTGGAGTTGTAACTCTGC<br>GTGGACTATGGACAGTCAACAATATGTACTTAAAA<br>GTTGCACTATTGCAAAACGGGTGTATTATCCAGGT<br>ACTCGTACACTATTTTTTTGTACTGCTGGTCCTGTA<br>CCAGAAACATTTTCTTTTATTGTTACTTGCTTTT | 6 | MMVMVK* |
| 894 | NM_0017<br>43.3_482 | 482 | AGTCCGAGTGGAGAGAGCGAGCTGAGTGGTTGTG<br>TGGTCGCGTCTCGGAAACCGGTAGCGCTTGCAGC<br>ATGGCTGACCAACTGACTGAAGAGCAGATTGCAG<br>AATTCAAAGAAGCTTTTTCACTATTTGACAAAGATG<br>GTGATGGAACTATAACAACAAAGGAATTGGGAACT<br>GTAATGAGATCTCTTGGGCAGAATCCCACAGAAGC<br>AGAGTTACAGGACATGATTAATGAAGTAGATGCTG<br>ATGGTAATGGCACAATTGACTTCCCTGAATTTCTGA<br>CAATGATGGCAAGAAAAATGAAAGACACAGACAGT<br>GAAGAAGAAATTAGAGAAGCATTCCGTGTGTTTGA<br>TAAGGATGGCAATGGCTATATTAGTGCTGCAGAAC<br>TTCGCCATGTGATGACAAACCTTGGAGAGAAGTTA<br>ACAGATGAAGAAGTTGATGAAATGATCAGGGAAGC<br>AGATATTGATGGTGATGGTCAAGTAAATATGAAGA<br>GTTTGTACAAATGATGACAGCAAAGTGAAGACCTT<br>GTACAGAATGTGTTAAATTTCTTGTACAAAATTGTT<br>TATTTGCCTTTTCTTTGTTTGTAACTTATCTGTAAAA<br>GGTTTCTCCCTACTGTCAAAAAAATATGCATGTATA<br>GTAATTAGGACTTCATTCCTCCATGTTTTCTTCCCT<br>TATCTTACTGTCATTGTCCTAAAACCTTATTTTAGAA<br>AATTGATCAAGTAACATGTTGCATGTGGCTTACTCT<br>GGATATATCTAAGCCCTTCTGCACATCTAAACTTAG | 6 | MKSLYK* |

TABLE 3A-continued

| SEQ ID | identifier_position | position | modified_RNA | PAP length | PAP |
|---|---|---|---|---|---|
| 895 | NM_0017 43.3_494 | 494 | ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTTGGAGAGAAGTTA ACAGATGAAGAAGTTGATGAAATGATCAGGGAAGC AGATATTGATGGTGATGGTCAAGTAAACTATGAAG AGTTGTACAAATGATGACAGCAAAGTGAAGACCTT GTACAGAATGTGTTAAATTTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG | 3 | LYK* |
| 896 | NM_0017 43.3_511 | 511 | ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTTGGAGAGAAGTTA ACAGATGAAGAAGTTGATGAAATGATCAGGGAAGC AGATATTGATGGTGATGGTCAAGTAAACTATGAAG AGTTTGTACAAATGATGACAGAAAGTGAAGACCTT GTACAGAATGTGTTAAATTTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | 24 | ESEDLVQN VLNFLYKIV YLPFLCL* |
| 897 | NM_0017 43.3_514 | 514 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATTGCAG AATTCAAAGAAGCTTTTTCACTATTTGACAAAGATG GTGATGGAACTATAACAACAAAGGAATTGGGAACT GTAATGAGATCTCTTGGGCAGAATCCCACAGAAGC AGAGTTACAGGACATGATTAATGAAGTAGATGCTG ATGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTTGGAGAGAAGTTA | 23 | SEDLVQNV LNFLYKIVY LPFLCL* |

TABLE 3A-continued

| SEQ ID | identifier_ position | position | modified_RNA | PAP length | PAP |
|---|---|---|---|---|---|
| | | | ACAGATGAAGAAGTTGATGAAATGATCAGGGAAGC AGATATTGATGGTGATGGTCAAGTAAACTATGAAG AGTTTGTACAAATGATGACAGCAAGTGAAGACCTT GTACAGAATGTGTTAAATTTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | | |
| 898 | NM_0017 43.3_73 | 73 | AGTCCGAGTGGAGAGAGCGAGCTGAGTGGTTGTG TGGTCGCGTCTCGGAAACCGGTAGCGCTTGCAGC ATGGTGACCAACTGACTGAAGAGCAGATTGCAGAA TTCAAAGAAGCTTTTTCACTATTTGACAAAGATGGT GATGGAACTATAACAACAAAGGAATTGGGAACTGT AATGAGATCTCTTGGGCAGAATCCCACAGAAGCAG AGTTACAGGACATGATTAATGAAGTAGATGCTGAT GGTAATGGCACAATTGACTTCCCTGAATTTCTGAC AATGATGGCAAGAAAAATGAAAGACACAGACAGTG AAGAAGAAATTAGAGAAGCATTCCGTGTGTTTGAT AAGGATGGCAATGGCTATATTAGTGCTGCAGAACT TCGCCATGTGATGACAAACCTTGGAGAGAAGTTAA CAGATGAAGAAGTTGATGAAATGATCAGGGAAGCA GATATTGATGGTGATGGTCAAGTAAACTATGAAGA GTTTGTACAAATGATGACAGCAAAGTGAAGACCTT GTACAGAATGTGTTAAATTTCTTGTACAAAATTGTT TATTTGCCTTTTCTTTGTTTGTAACTTATCTGTAAAA GGTTTCTCCCTACTGTCAAAAAAATATGCATGTATA GTAATTAGGACTTCATTCCTCCATGTTTTCTTCCCT TATCTTACTGTCATTGTCCTAAAACCTTATTTTAGAA AATTGATCAAGTAACATGTTGCATGTGGCTTACTCT GGATATATCTAAGCCCTTCTGCACATCTAAACTTAG ATGGAGTTGGTCAAATGAGGGAACATCTGGGTTAT GCCTTTTTTAAAGTAGTTTTCTTTAGGAACTGTCAG CATGTTGTTGTTGAAGTGTGGAGTTGTAACTCTGC GTGGACTATGGACAGTCAACAATATGTACTTAAAA GTTGCACTATTGCAAAACGGGTGTATTATCCAGGT ACTCGTACACTATTTTTTTGTACTGCTGGTCCTGTA CCAGAAACATTTTCTTTTATTGTTACTTGCTTTT | 3 | VTN* |
| 899 | NM_0017 43.3_98 | 98 | AGTCCGAGTGGAGAGAGCGAGCTGAGTGGTTGTG TGGTCGCGTCTCGGAAACCGGTAGCGCTTGCAGC ATGGCTGACCAACTGACTGAAGAGCAGATGCAGA ATTCAAAGAAGCTTTTTCACTATTTGACAAAGATGG TGATGGAACTATAACAACAAAGGAATTGGGAACTG TAATGAGATCTCTTGGGCAGAATCCCACAGAAGCA GAGTTACAGGACATGATTAATGAAGTAGATGCTGA TGGTAATGGCACAATTGACTTCCCTGAATTTCTGA CAATGATGGCAAGAAAAATGAAAGACACAGACAGT GAAGAAGAAATTAGAGAAGCATTCCGTGTGTTTGA TAAGGATGGCAATGGCTATATTAGTGCTGCAGAAC TTCGCCATGTGATGACAAACCTTGGAGAGAAGTTA ACAGATGAAGAAGTTGATGAAATGATCAGGGAAGC AGATATTGATGGTGATGGTCAAGTAAACTATGAAG AGTTTGTACAAATGATGACAGCAAAGTGAAGACCT TGTACAGAATGTGTTAAATTTCTTGTACAAAATTGT TTATTTGCCTTTTCTTTGTTTGTAACTTATCTGTAAA AGGTTTCTCCCTACTGTCAAAAAAATATGCATGTAT AGTAATTAGGACTTCATTCCTCCATGTTTTCTTCCC TTATCTTACTGTCATTGTCCTAAAACCTTATTTTAGA AAATTGATCAAGTAACATGTTGCATGTGGCTTACTC TGGATATATCTAAGCCCTTCTGCACATCTAAACTTA GATGGAGTTGGTCAAATGAGGGAACATCTGGGTTA TGCCTTTTTTAAAGTAGTTTTCTTTAGGAACTGTCA GCATGTTGTTGTTGAAGTGTGGAGTTGTAACTCTG CGTGGACTATGGACAGTCAACAATATGTACTTAAAA AGTTGCACTATTGCAAAACGGGTGTATTATCCAGG TACTCGTACACTATTTTTTTGTACTGCTGGTCCTGT ACCAGAAACATTTTCTTTTATTGTTACTTGCTTTT | 18 | MQNSKKLF HYLTKMVM EL* |

TABLE 3A-continued

| SEQ ID | identifier_ position | position | modified_RNA | PAP length | PAP |
|---|---|---|---|---|---|
| 900 | NM_0017 47.2_369 | 369 | GACGGCCTGGCATACCCACTGCCCACCCCAGTGA CTGCTCTTCTGCTTCAGGCCTGCTGGCCTCCCAGC ACTGCCTGCCCCTCCCTGTCGGGGGACATCGCCT CCACACCGGCTGGGGAAGGAGCCCAGGGGTGGG GCTGGTGGGTGGGGCTGGTGGTTGGGGCAGCCA GAGAAGTAAGAGGGAAGTGAGAAGCCGGGTGGG GCAGGCTGGAAGGAAGACGAACCTACGAAGCAGA GATCTGAAGACAGCATGTACACAGCCATTCCCCAG AGTGGCTCTCCATTCCCAGGCTCAGTGCAGGATC CAGGCCTGCATGTGTGGCGGGTGGAGAAGCTGAA GCCGGTGCCTGTGGCGCAAGAGAACCAGGCGTCT TCTTCTCGGGGGACTCCTACCTAGTGCTGCACAAT GGCCCAGAAGAGGTTTCCCATCTGCACCTGTGGA TAGGCCAGCAGTCATCCCGGGATGAGCAGGGGG CCTGTGCCGTGCTGGCTGTGCACCTCAACACGCT GCTGGGAGAGCGGCCTGTGCAGCACCGCGAGGT GCAGGGCAATGAGTCTGACCTCTTCATGAGCTACT TCCCACGGGGCCTCAAGTACCAGGAAGGTGGTGT GGAGTCAGCATTTCACAAGACCTCCACAGGAGCC CCAGCTGCCATCAAGAAACTCTACCAGGTGAAGG GGAAGAAGAACATCCGTGCCACCGAGCGGGCACT GAACTGGGACAGCTTCAACACTGGGGACTGCTTC ATCCTGGACCTGGGCCAGAACATCTTCGCCTGGT GTGGTGGAAAGTCCAACATCCTGGAACGCAACAA GGCGAGGGACCTGGCCCTGGCCATCCGGGACAG TGAGCGACAGGGCAAGGCCCAGGTGGAGATTGTC ACTGATGGGGAGGAGCCTGCTGAGATGATCCAGG TCCTGGGCCCCAAGCCTGCTCTGAAGGAGGGCAA CCCTGAGGAAGACCTCACAGCTGACAAGGCAAAT GCCCAGGCCGCAGCTCTGTATAAGGTCTCTGATG CCACTG | 9 | ASSSRGTP T* |
| 901 | NM_0017 62.3_565 | 565 | AGCGGGCGCCGGACGACCTGTGGCCCAATGGCG GCGGCGCGCGGGCACGCTGGGGGCCGGCCAGA CGGGCCGACTTTTCCAGAAGACCCGGATAGTTCCT CCCGGCCACGCCGCGCCGGCTCTGGGCACTCAG CATCGTTTCCTTTTCCTCCGCTGGAGCAGCTATGG CGGCGGTGAAGACCCTGAACCCCAAGGCCGAGGT GGCCCGAGCGCAGGCGGCGCTGGCGGTCAACAT CAGCGCAGCGCGGGGTCTGCAGGACGTGCTAAG GACCAACCTGGGGCCCAAGGGCACCATGAAGATG CTCGTTTCTGGCGCTGGAGACATCAAACTTACTAA AGACGGCAATGTGCTGCTTCACGAAATGCAAATTC AACACCCAACAGCTTCCTTAATAGCAAAGGTAGCA ACAGCCCAGGATGATATAACTGGTGATGGTACGAC TTCTAATGTCCTAATCATTGGAGAGCTGCTGAAAC AGGCGGATCTCTACATTTCTGAAGGCCTTCATCCT AGAATAATCACTGAAGGATTTGAAGCTGCAAAGGA AAAGGCCCTTCAGTTTTGGAAGAAGTCAAAGTAAG CAGAGAGATGGACAGGGAAACACTTATAGATGTG GCCAGAACATCTCTTCGTACTAAAGTTCATGCTGA ACTTGCAGATGTCTTAACAGAGGCTGTAGTGGACT CCATTTTGGCCATTAAAAAGCAAGATGAACCTATT GATCTCTTCATGATTGAGATCATGGAGATGAAACA TAAATCTGAAACTGATACAAGCTTAATCAGAGGGC TTGTTTTGGACCACGGAGCACGGCATCCTGATATG AAGAAAAGGGTGGAGGATGCATACATCCTCACTTG TAACGTGTCATTAGAGTATGAGAAAACAGAAGTGA ATTCTGGCTTTTTTTACAAGAGTGCAGAAGAGAGA GAAAAACTCGTGAAAGCTGAAAGAAAATTCATTGA AGATAGGGTTAAAAAAATAATAGAACTGAAAAGGA AAGTCTGTGGCGATTCAGATAAA | 5 | WKKSK* |
| 902 | NM_0017 80.4_790 | 790 | CAGCTGTTACCGCGTCACATGAGGGAGGCCGGCG GCCACTCGGCGGGGAGGGGACCGTGGCTGGAG CCCGGGGCGGGGCCGCGCGGCAGGCGGGGCGG GAGCCGGGGGGCGCAGCTAGAGAGCCCCGGAGC CGCGGCGGGAGAGGAACGCGCAGCCAGCCTTGG GAAGCCCAGGCCCGGCAGCCATGGCGGTGGAAG GAGGAATGAAATGTGTGAAGTTCTTGCTCTACGTC CTCCTGCTGGCCTTTTGCGCCTGTGCAGTGGGAC TGATTGCCGTGGGTGTCGGGGCACAGCTTGTCCT GAGTCAGACCATAATCCAGGGGGCTACCCCTGGC TCTCTGTTGCCAGTGGTCATCATCGCAGTGGGTGT CTTCCTCTTCCTGGTGGCTTTTGTGGGCTGCTGCG GGGCCTGCAAGGAGAACTATTGTCTTATGATCACG TTTGCCATCTTTCTGTCTCTTATCATGTTGGTGGAG GTGGCCGCAGCCATTGCTGGCTATGTGTTTAGAGA TAAGGTGATGTCAGAGTTTAATAACAACTTCCGGC | 4 | MCWW* |

TABLE 3A-continued

| SEQ ID | identifier_position | position | modified_RNA | PAP length | PAP |
|---|---|---|---|---|---|
| | | | AGCAGATGGAGAATTACCCGAAAAACAACCACACT GCTTCGATCCTGGACAGGATGCAGGCAGATTTTAA GTGCTGTGGGGCTGCTAACTACACAGATTGGGAG AAAATCCCTTCCATGTCGAAGAACCGAGTCCCCGA CTCCTGCTGCATTAATGTTACTGTGGGCTGTGGGA TTAATTTCAACGAGAAGGCGATCCATAAGGAGGGC TGTGTGGAGAAGATTGGGGGCTGGCTGAGGAAAA TGTGCTGGTGGTAGCTGCAGCAGCCCTTGGAATT GCTTTTGTCGAGGTTTTGGGAATTGTCTTTGCCTG CTGCCTCGTGAAGAGTATCAGAAGTGGCTACGAG GTGATGTAGGGGTCTGGTCTCCTCAGCCTCCTCAT CTGGGGGAGTGGAATAGTATCCTCCAGGTTTTTCA ATTAAACGGATTATTTTTTCAGACCGAAAAGAGATG GTCTGAGTTTGTCTTAGAAAAAAAAA | | |
| 903 | NM_0017 80.4_841 | 841 | CAGCTGTTACCGCGTCACATGAGGGAGGCCGGCG GCCACTCGGCGGGGGAGGGGACCGTGGCTGGAG CCCGGGGCGGGGCCGCGCGGCAGGCGGGGCGG GAGCCGGGGGGCGCAGCTAGAGAGCCCCGGAGC CGCGGCGGGAGAGGAACGCGCAGCCAGCCTTGG GAAGCCCAGGCCCGGCAGCCATGGCGGTGGAAG GAGGAATGAAATGTGTGAAGTTCTTGCTCTACGTC CTCCTGCTGGCCTTTTGCGCCTGTGCAGTGGGAC TGATTGCCGTGGGTGTCGGGGCACAGCTTGTCCT GAGTCAGACCATAATCCAGGGGGCTACCCCTGGC TCTCTGTTGCCAGTGGTCATCATCGCAGTGGGTGT CTTCCTCTTCCTGGTGGCTTTTGTGGGCTGCTGCG GGGCCTGCAAGGAGAACTATTGTCTTATGATCACG TTTGCCATCTTTCTGTCTCTTATCATGTTGGTGGAG GTGGCCGCAGCCATTGCTGGCTATGTGTTTAGAGA TAAGGTGATGTCAGAGTTTAATAACAACTTCCGGC AGCAGATGGAGAATTACCCGAAAAACAACCACACT GCTTCGATCCTGGACAGGATGCAGGCAGATTTTAA GTGCTGTGGGGCTGCTAACTACACAGATTGGGAG AAAATCCCTTCCATGTCGAAGAACCGAGTCCCCGA CTCCTGCTGCATTAATGTTACTGTGGGCTGTGGGA TTAATTTCAACGAGAAGGCGATCCATAAGGAGGGC TGTGTGGAGAAGATTGGGGGCTGGCTGAGGAAAA ATGTGCTGGTGGTAGCTGCAGCAGCCCTTGGAATT GCTTTTGTCGAGGTTTGGGAATTGTCTTTGCCTGC TGCCTCGTGAAGAGTATCAGAAGTGGCTACGAGG TGATGTAGGGGTCTGGTCTCCTCAGCCTCCTCATC TGGGGGAGTGGAATAGTATCCTCCAGGTTTTTCAA TTAAACGGATTATTTTTTCAGACCGAAAAGAGATG GTCTGAGTTTGTCTTAGAAAAAAAAA | 9 | WELSLPAA S* |
| 904 | NM_0017 88.4_145 3 | 1453 | AGCCTCGTCTGAGGGGGCGGGGGACGGAGGAGG GAGCGGGAGTCGAGCGAGAGCCTGTGGAGGAGT CCGCCTGCTGTAGCGTCGTAAGCAAGGCAGCTA CGCCGGGCGGCTACGCTGCGGAATCGGCGTAGG CGCCTTTGGAGAATCGGCGGGCTGCGCTCCGCTG GGGCTGGTCGCGGAGGGGGGGAGGGGATGTCGG TCAGTGCGAGATCCGCTGCTGCTGAGGAGAGGAG CGTCAACAGCAGCACCATGGTAGCTCAACAGAAG AACCTTGAAGGCTATGTGGGATTTGCCAATCTCCC AAATCAAGTATACAGAAAATCGGTGAAGAGAGGTT TTGAATTCACGCTTATGGTAGTGGGTGAATCTGGA TTGGGAAAGTCGACATTAATCAACTCATTATTCCTC ACAGATTTGTATTCTCCAGAGTATCAGGTCCTTCT CATAGAATTAAAAAGACTGTACAGGTGGAACAATC CAAAGTTTTAATCAAAGAAGGTGGTGTTCAGTTGC TGCTCACAATAGTTGATACCCCAGGATTTGGAGAT GCAGTGGATAATAGTAATTGCTGGCAGCCTGTTAT CGACTACATTGATAGTAAATTTGAGGACTACCTAAA TGCAGAATCACGAGTGAACAGACGTCAGATGCCT GATAACAGGGTGCAGTGTTGTTTATACTTCATTGCT CCTTCAGGACATGGACTTAAACCATTGGATATTGA GTTTATGAAGCGTTTGCATGAAAAAGTGAATATCAT CCCACTTATTGCCAAAGCAGACACACTCACACCAG AGGAATGCCAACAGTTTAAAAAAACAGATAATGAAA GAAATCCAAGAACATAAAATTAAAATATACGAATTT CCAGAAACAGATGATGAAGAAGAAAATAAACTTGT TAAAAAGATAAAGGACCGTTTACCTCTTGCTGTGG TAGGTAGTAATACTATCATTGAAGTTAATGGCAAAA GGGTCAGAGGAAGGCAGTATCCTTGGGGTGTTGC TGAAGTTGAAAATGGT | 28 | HRTLQEP WKRTRRK GRSFKLSI DHQLTY* |
| 905 | NM_0018 31.2_453 | 453 | CTTTCCGCGGCATTCTTTGGGCGTGAGTCATGCAG GTTTGCAGCCAGCCCCAAAGGGGGTGTGTGCGCG AGCAGAGCGCTATAAATACGGCGCCTCCCAGTGC | 5 | NQRQS* |

TABLE 3A-continued

| SEQ ID | identifier_position | position | modified_RNA | PAP length | PAP |
|---|---|---|---|---|---|
| | | | CCACAACGCGGCGTCGCCAGGAGGAGCGCGCGG | | |
| | | | GCACAGGGTGCCGCTGACCGAGGCGTGCAAAGA | | |
| | | | CTCCAGAATTGGAGGCATGATGAAGACTCTGCTGC | | |
| | | | TGTTTGTGGGGCTGCTGCTGACCTGGGAGAGTGG | | |
| | | | GCAGGTCCTGGGGGACCAGACGGTCTCAGACAAT | | |
| | | | GAGCTCCAGGAAATGTCCAATCAGGGAAGTAAGTA | | |
| | | | CGTCAATAAGGAAATTCAAAATGCTGTCAACGGGG | | |
| | | | TGAAACAGATAAAGACTCTCATAGAAAAAACAAAC | | |
| | | | GAAGAGCGCAAGACACTGCTCAGCAACCTAGAAG | | |
| | | | AAGCCAAGAAGAAGAAAGAGGATGCCCTAAATGA | | |
| | | | GACCAGGAATCAGAGACAAAGCTGAAGGAGCTCC | | |
| | | | CAGGAGTGTGCAATGAGACCATGATGGCCCTCTG | | |
| | | | GGAAGAGTGTAAGCCCTGCCTGAAACAGACCTGC | | |
| | | | ATGAAGTTCTACGCACGCGTCTGCAGAAGTGGCT | | |
| | | | CAGGCCTGGTTGGCCGCCAGCTTGAGGAGTTCCT | | |
| | | | GAACCAGAGCTCGCCCTTCTACTTCTGGATGAATG | | |
| | | | GTGACCGCATCGACTCCCTGCTGGAGAACGACCG | | |
| | | | GCAGCAGACGCACATGCTGGATGTCATGCAGGAC | | |
| | | | CACTTCAGCCGCGCGTCCAGCATCATAGACGAGC | | |
| | | | TCTTCCAGGACAGGTTCTTCACCCGGGAGCCCCA | | |
| | | | GGATACCTACCACTACCTGCCCTTCAGCCTGCCCC | | |
| | | | ACCGGAGGCCTCACTTCTTCTTTCCCAAGTCCCGC | | |
| | | | ATCGTCCGCAGCTTGATGCCCTTCTCTCCGTACGA | | |
| | | | GCCCCTGAACTTCCACGCCATGTTCCAGCCCTTCC | | |
| | | | TTGAGATGATACACGAGGCTCAGCAGGCCATGGA | | |
| | | | CATCCACTTCCATAGCCCGGCCTTCCAGCACCCG | | |
| | | | CCAACAGAATTCATACGAGAAGGCGACGAT | | |
| 906 | NM_0018 31.2_737 | 737 | CTTTCCGCGGCATTCTTTGGGCGTGAGTCATGCAG | 2 | AS* |
| | | | GTTTGCAGCCAGCCCCAAAGGGGGTGTGTGCGCG | | |
| | | | AGCAGAGCGCTATAAATACGGCGCCTCCCAGTGC | | |
| | | | CCACAACGCGGCGTCGCCAGGAGGAGCGCGCGG | | |
| | | | GCACAGGGTGCCGCTGACCGAGGCGTGCAAAGA | | |
| | | | CTCCAGAATTGGAGGCATGATGAAGACTCTGCTGC | | |
| | | | TGTTTGTGGGGCTGCTGCTGACCTGGGAGAGTGG | | |
| | | | GCAGGTCCTGGGGGACCAGACGGTCTCAGACAAT | | |
| | | | GAGCTCCAGGAAATGTCCAATCAGGGAAGTAAGTA | | |
| | | | CGTCAATAAGGAAATTCAAAATGCTGTCAACGGGG | | |
| | | | TGAAACAGATAAAGACTCTCATAGAAAAAACAAAC | | |
| | | | GAAGAGCGCAAGACACTGCTCAGCAACCTAGAAG | | |
| | | | AAGCCAAGAAGAAGAAAGAGGATGCCCTAAATGA | | |
| | | | GACCAGGGAATCAGAGACAAAGCTGAAGGAGCTC | | |
| | | | CCAGGAGTGTGCAATGAGACCATGATGGCCCTCT | | |
| | | | GGGAAGAGTGTAAGCCCTGCCTGAAACAGACCTG | | |
| | | | CATGAAGTTCTACGCACGCGTCTGCAGAAGTGGC | | |
| | | | TCAGGCCTGGTTGGCCGCCAGCTTGAGGAGTTCC | | |
| | | | TGAACCAGAGCTCGCCCTTCTACTTCTGGATGAAT | | |
| | | | GGTGACCGCATCGACTCCCTGCTGGAGAACGACC | | |
| | | | GGCAGCAGACGCACATGCTGGATGTCATGCAGGA | | |
| | | | CCACTTCAGCCGCGCGTCAGCATCATAGACGAGC | | |
| | | | TCTTCCAGGACAGGTTCTTCACCCGGGAGCCCCA | | |
| | | | GGATACCTACCACTACCTGCCCTTCAGCCTGCCCC | | |
| | | | ACCGGAGGCCTCACTTCTTCTTTCCCAAGTCCCGC | | |
| | | | ATCGTCCGCAGCTTGATGCCCTTCTCTCCGTACGA | | |
| | | | GCCCCTGAACTTCCACGCCATGTTCCAGCCCTTCC | | |
| | | | TTGAGATGATACACGAGGCTCAGCAGGCCATGGA | | |
| | | | CATCCACTTCCATAGCCCGGCCTTCCAGCACCCG | | |
| | | | CCAACAGAATTCATACGAGAAGGCGACGAT | | |
| 907 | NM_0018 61.2_180 | 180 | CGACGTTCGCAGCGCTACCCTTTTCCGCTCCACG | 3 | YLA* |
| | | | GTGACCTCCGTGCGGCCGGGTGCGGGCGGAGTC | | |
| | | | TTCCTCGATCCCGTGGTGCTCCGGGCGCGGCCT | | |
| | | | TGCTCTCTTCCGGTCGCGGGACACCGGGTGTAGA | | |
| | | | GGGCGGTCGCGGCGGGCAGTGGCGGCAGAATGT | | |
| | | | TGGCTACCAGGTATTTAGCCTAGTTGGCAAGCGAG | | |
| | | | CAATTTCCACCTCTGTGTGTGTACGAGCTCATGAA | | |
| | | | AGTGTTGTGAAGAGCGAAGACTTTTCGCTCCCAGC | | |
| | | | TTATATGGATCGGCGTGACCACCCCTTGCCGGAG | | |
| | | | GTGGCCCATGTCAAGCACCTGTCTGCCAGCCAGA | | |
| | | | AGGCACTGAAGGAGAAGGAGAAGGCCTCCTGGAG | | |
| | | | CAGCCTCTCCATGGATGAGAAAGTCGAGTTGTATC | | |
| | | | GCATTAAGTTCAAGGAGAGCTTTGCTGAGATGAAC | | |
| | | | AGGGGCTCGAACGAGTGGAAGACGGTTGTGGGC | | |
| | | | GGTGCCATGTTCTTCATCGGTTTCACCGCGCTCGT | | |
| | | | TATCATGTGGCAGAAGCACTATGTGTACGGCCCCC | | |
| | | | TCCCGCAAAGCTTTGACAAAGAGTGGGTGGCCAA | | |
| | | | GCAGACCAAGAGGATGCTGGACATGAAGGTGAAC | | |
| | | | CCCATCCAGGGCTTAGCCTCCAAGTGGGACTACG | | |
| | | | AAAAGAACGAGTGGAAGAAGTGAGAGATGCTGGC | | |

TABLE 3A-continued

| SEQ ID | identifier_position | position | modified_RNA | PAP length | PAP |
|---|---|---|---|---|---|
| | | | CTGCGCCTGCACCTGCGCCTGGCTCTGTCACCGC CATGCAACTCCATGCCTATTTACTGGAAACCTGTTA TGCCAAACAGTTGTACCACTGCTAATAAATGACCA GTTTACCTGAAA | | |
| 908 | NM_0018 61.2_549 | 549 | CGACGTTCGCAGCGCTACCCTTTTCCGCTCCACG GTGACCTCCGTGCGGCCGGGTGCGGGCGGAGTC TTCCTCGATCCCGTGGTGCTCCGCGGCGCGGCCT TGCTCTCTTCCGGTCGCGGGACACCGGGTGTAGA GGGCGGTCGCGGCGGGCAGTGGCGGCAGAATGT TGGCTACCAGGGTATTTAGCCTAGTTGGCAAGCGA GCAATTTCCACCTCTGTGTGTGTACGAGCTCATGA AAGTGTTGTGAAGAGCGAAGACTTTTCGCTCCCAG CTTATATGGATCGGCGTGACCACCCCTTGCCGGA GGTGGCCCATGTCAAGCACCTGTCTGCCAGCCAG AAGGCACTGAAGGAGAAGGAGAAGGCCTCCTGGA GCAGCCTCTCCATGGATGAGAAAGTCGAGTTGTAT CGCATTAAGTTCAAGGAGAGCTTTGCTGAGATGAA CAGGGGCTCGAACGAGTGGAAGACGGTTGTGGG CGGTGCCATGTTCTTCATCGGTTTCACCGCGCTCG TTATCATGTGGCAGAAGCACTATGTGTACGGCCCC TCCCGCAAAGCTTTGACAAAGAGTGGGTGGCCAA GCAGACCAAGAGGATGCTGGACATGAAGGTGAAC CCCATCCAGGGCTTAGCCTCCAAGTGGGACTACG AAAAGAACGAGTGGAAGAAGTGAGAGATGCTGGC CTGCGCCTGCACCTGCGCCTGGCTCTGTCACCGC CATGCAACTCCATGCCTATTTACTGGAAACCTGTTA TGCCAAACAGTTGTACCACTGCTAATAAATGACCA GTTTACCTGAAA | 19 | SRKALTKS GWPSRPR GCWT* |
| 909 | NM_0018 61.2_628 | 628 | CGACGTTCGCAGCGCTACCCTTTTCCGCTCCACG GTGACCTCCGTGCGGCCGGGTGCGGGCGGAGTC TTCCTCGATCCCGTGGTGCTCCGCGGCGCGGCCT TGCTCTCTTCCGGTCGCGGGACACCGGGTGTAGA GGGCGGTCGCGGCGGGCAGTGGCGGCAGAATGT TGGCTACCAGGGTATTTAGCCTAGTTGGCAAGCGA GCAATTTCCACCTCTGTGTGTGTACGAGCTCATGA AAGTGTTGTGAAGAGCGAAGACTTTTCGCTCCCAG CTTATATGGATCGGCGTGACCACCCCTTGCCGGA GGTGGCCCATGTCAAGCACCTGTCTGCCAGCCAG AAGGCACTGAAGGAGAAGGAGAAGGCCTCCTGGA GCAGCCTCTCCATGGATGAGAAAGTCGAGTTGTAT CGCATTAAGTTCAAGGAGAGCTTTGCTGAGATGAA CAGGGGCTCGAACGAGTGGAAGACGGTTGTGGG CGGTGCCATGTTCTTCATCGGTTTCACCGCGCTCG TTATCATGTGGCAGAAGCACTATGTGTACGGCCCC CTCCCGCAAAGCTTTGACAAAGAGTGGGTGGCCA AGCAGACCAAGAGGATGCTGGACATGAAGGTGAA CCCCATCCAGGCTTAGCCTCCAAGTGGGACTACG AAAAGAACGAGTGGAAGAAGTGAGAGATGCTGGC CTGCGCCTGCACCTGCGCCTGGCTCTGTCACCGC CATGCAACTCCATGCCTATTTACTGGAAACCTGTTA TGCCAAACAGTTGTACCACTGCTAATAAATGACCA GTTTACCTGAAA | 1 | A* |
| 910 | NM_0018 78.2_537 | 537 | AGCTTTGGGGTTGTCCCTGGACTTGTCTTGGTTCC AGAACCTGACGACCCGGCGACGGCGACGTCTCTT TTGACTAAAAGACAGTGTCCAGTGCTCCAGCCTAG GAGTCTACGGGGACCGCCTCCCGCGCCGCCACC ATGCCCAACTTCTCTGGCAACTGGAAAATCATCCG ATCGGAAAACTTCGAGGAATTGCTCAAAGTGCTGG GGGTGAATGTGATGCTGAGGAAGATTGCTGTGGC TGCAGCGTCCAAGCCAGCAGTGGAGATCAAACAG GAGGGAGACACTTTCTACATCAAAACCTCCACCAC CGTGCGCACCACAGAGATTAACTTCAAGGTTGGG GAGGAGTTTGAGGAGCAGACTGTGGATGGGAGGC CCTGTAAGAGCCTGGTGAAATGGGAGAGTGAGAA TAAAAATGGTCTGTGAGCAGAAGCTCCTGAAGGGA GAGGGCCCCAAGACCTCGTGGACCAGAGAACTGA CCAACGATGGGGAACTGATCCTGACCATGACGGC GGATGACGTTGTGTGCACCAGGTCTACGTCCGAG AGTGAGTGGCCACAGGTAGAACCGCGGCCGAAGC CCACCACTGGCCATGCTACCGCCCTGCTTCACT GCCCCCTCCGTCCCACCCCCTCCTTCTAGGATAG CGCTCCCCTTACCCCAGTCACTTCTGGGGGTCACT GGGATGCCTCTTGCAGGGTCTTGCTTTCTTTGACC TCTTCTCTCCTCCCCTACACCAACAAAGAGGAATG GCTGCAAGAGCCCAGATCACCCATTCCGGGTTCA CTCCCCGCCTCCCCAAGTCAGCAGTCCTAGCCCC AAACCAGCCCAGAGCAGGGTCTCTCTAAAGGGGA | 37 | STSESEWP QVEPRPKP TTGHANRP ASLPPPSH PLLLG* |

TABLE 3A-continued

| SEQ ID | identifier_position | position | modified_RNA | PAP length | PAP |
|---|---|---|---|---|---|
| | | | CTTGAGGGCCTGAGCAGGAAAGACTGGCCCTCTA GCTTCTACCCTTTGTCCCTGTAGCCTATACAGTTTA GAATATTTATTTGTTAATTTTATTAAAATGCTTTAAA AAAA | | |
| 911 | NM_0019 03.2_122 4 | 1224 | CCATTTCCTCCTCCTAGCCGGACTGGAGGGAGAC AAAGCAGCGCCCGTCTGCTTCGGGCCTCTGGAAT TTAGCGCTCGCCCAGCTAGCCGCAGAAATGACTG CTGTCCATGCAGGCAACATAAACTTCAAGTGGGAT CCTAAAAGTCTAGAGATCAGGACTCTGGCAGTTGA GAGACTGTTGGAGCCTCTTGTTACACAGGTTACAA CCCTTGTAAACACCAATAGTAAAGGGCCCTCTAAT AAGAAGAGAGGTCGTTCTAAGAAGGCCCATGTTTT GGCTGCATCTGTTGAACAAGCAACTGAGAATTTCT TGGAGAAGGGGGATAAAATTGCGAAGGAGAGCCA GTTTCTCAAGGAGGAGCTTGTGGCTGCTGTAGAAG ATGTTCGAAAACAAGGTGATTTGATGAAGGCTGCT GCAGGAGAGTTCGCAGATGATCCCTGCTCTTCTGT GAAGCGAGGCAACATGGTTCGGGCAGCTCGAGCT TTGCTCTCTGCTGTTACCCGGTTGCTGATTTTGGC TGACATGGCAGATGTCTACAAATTACTTGTTCAGCT GAAAGTTGTGGAAGATGGTATCTTGAAGTTGAGGA ATGCTGGCAATGAACAAGACTTAGGAATCCAGTAT AAAGCCCTAAAACCTGAAGTGGATAAGCTGAACAT TATGGCAGCCAAAAGACAACAGGAATTGAAAGATG TTGGCCATCGTGATCAGATGGCTGCAGCTAGAGG AATCCTGCAGAAGAACGTTCCGATCCTCTATACTG CATCCCAGGCATGCCTACAGCACCCTGATGTCGC AGCCTATAAGGCCAACAGGGACCTGATATACAAGC AGCTGCAGCAGGCGGTCACAGGCATTTCCAATGC AGCCCAGGCCACTGCCTCAGACGATGCCTCACAG CACCAGGGTGGAGGAGGAGGAGAACTGGCATATG CACTCAATAACTTTGACAAACAAATCATTGTGGACC CCTTGAGCTTCAGCGAGGAGCGCTTTAGGCCTTC CCTGGAGGAGCGTCTGGA | 27 | TCVDSSAK LSWTTFQI LSWKPMF HFWY* |
| 912 | NM_0019 08.3_470 | 470 | GGGGCGGGGCCGGGAGGGTACTTAGGGCCGGG GCTGGCCCAGGCTACGGCGGCTGCAGGGCTCCG GCAACCGCTCCGGCAACGCCAACCGCTCCGCTGC GCGCAGGCTGGGCTGCAGGCTCTCGGCTGCAGC GCTGGGTGGATCTAGGATCCGGCTTCCAACATGT GGCAGCTCTGGGCCTCCCTCTGCTGCCTGCTGGT GTTGGCCAATGCCCGGAGCAGGCCCTCTTTCCAT CCCCTGTCGGATGAGCTGGTCAACTATGTCAACAA ACGGAATACCACGTGGCAGGCCGGGCACAACTTC TACAACGTGGACATGAGCTACTTGAAGAGGCTATG TGGTACCTTCCTGGGTGGGCCCAAGCCACCCCAG AGAGTTATGTTTACCGAGGACCTGAAGCTGCCTGC AAGCTTCGATGCACGGGAACAATGGCCACAGTGT CCCACCATCAAAGAGATCAGAGACCAGGCTCCTG TGGCTCCTGCTGGGCCTTCGGGGCTGTGGAAGCC ATCTCTGACCGGATCTGCATCCACACCAATGCGCA CGTCAGCGTGGAGGTGTCGGCGGAGGACCTGCTC ACATGCTGTGGCAGCATGTGTGGGGACGGCTGTA ATGGTGGCTATCCTGCTGAAGCTTGGAACTTCTGG ACAAGAAAAGGCCTGGTTTCTGGTGGCCTCTATGA ATCCCATGTAGGGTGCAGACCGTACTCCATCCCTC CCTGTGAGCACCACGTCAACGGCTCCCGGCCCCC ATGCACGGGGAGGGAGATACCCCAAGTGTAGC AAGATCTGTGAGCCTGGCTACAGCCCGACCTACA AACAGGACAAGCACTACGGATACAATTCCTACAGC GTCTCCAATAGCGAGAAGGACATCATGGCCGAGA TCTACAAAAACGGCCCCGTGGAGGGAGCTTTCTCT GTGTATTCGGACTTCCTGCTCTACAAGTCAGGAGT GTACCAACACGTCACCGGAGAGATGATGGGTGGC CATGGCATCCGATCCTGGGCTGGGGAGTGGA | 74 | APVAPAGP SGLWKPSL TGSASTPM RTSAWRC RRRTCSHA VAACVGTA VMVAILLKL GTSGQEK AWFLVAS MNPM* |
| 913 | NM_0019 48.3_558 | 558 | GTTTTGGCGCGCTCCCTGCGGCGACGCTCATCGT GCGCTCTCCTCTTCCCCCGGTGGTCTCCTCGCTC GCCTTCTGGCTCTGCCATGCCCTGCTCTGAAGAGA CACCCGCCATTTCACCCAGTAAGCGGGCCCGGCC TGCGGAGGTGGGCGGCATGCAGCTCCGCTTTGCC CGGCTCTCCGAGCACGCCACGGCCCCCACCCGG GGCTCCGCGCGCGCCGCGGGCTACGACCTGTAC AGTGCCTATGATTACACAATACCACCTATGGAGAA AGCTGTTGTGAAAACGGACATTCAGATAGCGCTCC CTTCTGGGTGTTATGGAAGAGTGGCTCCACGGTCA GGCTTGGCTGCAAAACACTTTATTGATGTAGGAGC TGGTGTCATAGATGAAGATTATAGAGGGAAATGTTG GTGTTGTACTGTTTAATTTGGCAAAGAAAAGTTTG | 22 | LVPLERIKI YAKNRKQE VIPFS* |

TABLE 3A-continued

| SEQ ID | identifier_ position | position | modified_RNA | PAP length | PAP |
|---|---|---|---|---|---|
| | | | AAGTCAAAAAAGGTGATCGAATTGCACAGCTCATT TGCGAACGGATTTTTTATCCAGAAATAGAAGAAGT TCAAGCCTTGGATGACACCGAAAGGGGTTCAGGA GGTTTGGTTCCACTGGAAAGAATTAAAATTTATGC CAAGAACAGAAAACAAGAAGTCATACCTTTTTCTTA AAAAAAAAAAAAAAGTTTTTGCTTCAAGTGTTTTGG TGTTTTGCACTTCTGTAAACTTACTAGCTTTACCTT CTAAAAGTACTGCATTTTTTACTTTTTTTTATGATCA AGGAAAAGATCATTAAAAAAAAAACACAAAGAAGTTT TTCTTTGTGTTTGGATCAAAAAGAAACTTTGTTTTT CCGCAATTGAAGGTTGTATGTAAATCTGCTTTGTG GTGACCTGATGTAAACAGTGTCTTCTTAAAATCAAA TGTAAATCAATTACAGATTAAAAAAAAAAAGCCTGTA TTTAACTCATATGATCTCCCTTCAGCAACTTATTTT GCTTTAATTGCTTTAAATCTTAAGCAATATTTTTTAT TCAGTAAACAAATTCTTTCACAAGGTACAAAATCTT GCAT | | |
| 914 | NM_0019 60.2_325 | 325 | CCCTTTCATCAGTCTTCCCGCGTCCGCCGATTCCT CCTCCTTGGTCGCCGCGTCCTTGGCTGGCGTCAG AAAAATGGCTACAAACTTCCTAGCACATGAGAAGA TCTGGTTCGACAAGTTCAAATATGACGACGCAGAA AGGAGATTCTACGAGCAGATGAACGGGCCTGTGG CAGGTGCCTCCCGCCAGGAGAACGGCGCCAGCG TGATCCTCCGTGACATTGCGAGAGCCAGAGAGAA CATCCAGAAATCCCTGGCTGGAAGCTCAGGCCCC GGGGCCTCCAGCGGCACCAGCGGAGACCACGGT GAGCTCGTCGTCCGGATGCCAGTCTGGAAGTGGA GAACCAGAGTCTGCGTGGCGTGGTACAGGAGCTG CAGCAGGCCATCTCCAAGCTGGAGGCCCGGCTGA ACGTGCTGGAGAAGAGCTCGCCTGGCCACCGGG CCACGGCCCACAGACCCAGCACGTATCTCCCAT GCGCCAAGTGGAGCCCCCAGCCAAGAAGCCAGC CACACCAGCAGAGGATGACGAGGATGATGACATT GACCTGTTTGGCAGTGACAATGAGGAGGAGGACA AGGAGGCGGCACAGCTGCGGGAGGAGCGGCTAC GGCAGTACGCGGAGAAGAAGGCCAAGAAGCCTGC ACTGGTGGCCAAGTCCTCCATCCTGCTGGATGTCA AGCCTTGGGATGATGAGACGGACATGGCCCAGCT GGAGGCCTGTGTGCGCTCTATCCAGCTGGACGGG CTGGTCTGGGGGGCTTCCAAGCTGGTGCCCGTGG GCTACGGTATCCGGAAGCTACAGATTCAGTGTGTG GTGGAGGACGACAAGGTGGGGACAGACTTGCTGG AGGAGGAGATCACCAAGTTTGAGGAGCACGTGCA GAGTGTCGATATCGCAGCTTTCAACAAGATCTGAA GCCTGAGTGTGTGTACGTGCGCGCGTGCGTGAGG CCCTGCCACGATTAAAGACTGAGACCGGCAAAAAA AAAAA | 28 | MPVWKWR TRVCVAW YRSCSRPS PSWRPG* |
| 915 | NM_0019 60.2_453 | 453 | CCCTTTCATCAGTCTTCCCGCGTCCGCCGATTCCT CCTCCTTGGTCGCCGCGTCCTTGGCTGGCGTCAG AAAAATGGCTACAAACTTCCTAGCACATGAGAAGA TCTGGTTCGACAAGTTCAAATATGACGACGCAGAA AGGAGATTCTACGAGCAGATGAACGGGCCTGTGG CAGGTGCCTCCCGCCAGGAGAACGGCGCCAGCG TGATCCTCCGTGACATTGCGAGAGCCAGAGAGAA CATCCAGAAATCCCTGGCTGGAAGCTCAGGCCCC GGGGCCTCCAGCGGCACCAGCGGAGACCACGGT GAGCTCGTCGTCCGGATTGCCAGTCTGGAAGTGG AGAACCAGAGTCTGCGTGGCGTGGTACAGGAGCT GCAGCAGGCCATCTCCAAGCTGGAGGCCCGGCTG AACGTGCTGGAGAAGAGCTCGCCTGGCCACCGGG CCACGGCCCACAGACCCAGCACGTATCTCCCATG CGCCAAGTGGAGCCCCCAGCCAAGAAGCCAGCCA CACCAGCAGAGGATGACGAGGATGATGACATTGA CCTGTTTGGCAGTGACAATGAGGAGGAGGACAAG GAGGCGGCACAGCTGCGGGAGGAGCGGCTACGG CAGTACGCGGAGAAGAAGGCCAAGAAGCCTGCAC TGGTGGCCAAGTCCTCCATCCTGCTGGATGTCAAG CCTTGGGATGATGAGACGGACATGGCCCAGCTGG AGGCCTGTGTGCGCTCTATCCAGCTGGACGGGCT GGTCTGGGGGGCTTCCAAGCTGGTGCCCGTGGG CTACGGTATCCGGAAGCTACAGATTCAGTGTGTGG TGGAGGACGACAAGGTGGGGACAGACTTGCTGGA GGAGGAGATCACCAAGTTTGAGGAGCACGTGCAG AGTGTCGATATCGCAGCTTTCAACAAGATCTGAAG CCTGAGTGTGTGTACGTGCGCGCGTGCGTGAGGC CCTGCCACGATTAAAGACTGAGACCGGCAAAAAAA AAAA | 157 | HRPSTYLP CAKWSPQ PRSQPHQ QRMTRMM TLTCLAVT MRRRTRR RHSCGRS GYGSTRR RRPRSLH WWPSPPS CWMSSLG MMRRTWP SWRPVCA LSSWTGW SGGLPSW CPWATVS GSYRFSV WWRTTRW GQTCWRR RSPSLRST CRVSISQL STRSEA* |

TABLE 3A-continued

| SEQ ID | identifier_ position | position | modified_RNA | PAP length | PAP |
|---|---|---|---|---|---|
| 916 | NM_0019 61.3_231 | 231 | CTCTTCCGCCGTCGTCGCCGCCATCCTCGGCGCG ACTCGCTTCTTTCGGTTCTACCTGGGAGAATCCAC CGCCATCCGCCACCATGGTGAACTTCACGGTAGA CCAGATCCGCGCCATCATGGACAAGAAGGCCAAC ATCCGCAACATGTCTGTCATCGCCCACGTGGACCA TGGCAAGTCCACGCTGACAGACTCCCTGGTGTGC AAGGCGGGCATCATCGCCTCGGCCGGGCCGGGG AGACACGCTTCACTGATACCCGGAAGGACGAGCA GGAGCGTTGCATCACCATCAAGTCAACTGCCATCT CCCTCTTCTACGAGCTCTCGGAGAATGACTTGAAC TTCATCAAGCAGAGCAAGGACGGTGCCGGCTTCC TCATCAACCTCATTGACTCCCCCGGGCATGTCGAC TTCTCCTCGGAGGTGACTGCTGCCCTCCGAGTCA CCGATGGCGCATTGGTGGTGGTGGACTGCGTGTC AGGCGTGTGCGTGCAGACGGAGACAGTGCTGCG GCAGGCCATTGCCGAGCGCATCAAGCCTGTGCTG ATGATGAACAAGATGGACCGCGCCCTGCTGGAGC TGCAGCTGGAGCCCGAGGAGCTCTACCAGACTTT CCAGCGCATCGTGGAGAACGTGAACGTCATCATC TCCACCTACGGCGAGGGCGAGAGCGGCCCCATG GGCAACATCATGATCGATCCTGTCCTCGGTACCGT GGGCTTTGGGTCTGGCCTCCACGGGTGGGCCTTC ACCCTGAAGCAGTTTGCCGAGATGTATGTGGCCAA GTTCGCCGCCAAGGGGGAGGGCCAGTTGGGGCC TGCCGAGCGGGCCAAGAAAGTAGAGGACATGATG AAGAAGCTGTGGGGTGACAGGTACTTTGACCCAG CCAACGGCAAGTTCAGCAAGTCAGCCACCAGCCC CGAAGGGAAGAAGCTGCCACGCACCTTCTGCCAG CTGATCCTGGACCCCATCTTCAAGGTGTTTGATGC GATCATGAATTTCAAGAAAGAGGAGACAGCAAAA | 36 | GPGRHASL IPGRTSRS VASPSSQL PSPSSTSS RRMT* |
| 917 | NM_0019 67.3_198 | 198 | GCTGTCTTTTCAGTCGGGCGCTGAGTGGTTTTTCG GATCATGTCTGGTGGCTCCGCGGATTATAACAGAG AACATGGCGGCCCAGAGGGAATGGACCCCGATGG TGTCATCGAGAGCAACTGGAATGAGATTGTTGATA ACTTTGATGATATGAATTTAAAGGAGTCTCTCCTTC GTGGCATCTATGCTTACGGTTTGAGAAGCCTTCCG CTATTCAGCAGAGAGCTATTATTCCCTGTATTAAAG GGTATGATGTGATTGCTCAAGCTCAGTCAGGTACT GGCAAGACAGCCACATTTGCTATTTCCATCCTGCA ACAGTTGGAGATTGAGTTCAAGGAGACCCAAGCA CTAGTATTGGCCCCCACCAGAGAACTGGCTCAACA GATCCAAAAGGTAATTCTGGCACTTGGAGACTATA TGGGAGCCACTTGTCATGCCTGCATTGGTGGAACA AATGTTCGAAATGAAATGCAAAAACTGCAGGCTGA AGCACCACATATTGTTGTTGGTACACCCGGGAGAG TGTTTGATATGTTAAACAGAAGATACCTTTCTCCAA AATGGATCAAAATGTTTGTTTTGGATGAAGCAGAT GAAATGTTGAGCCGTGGTTTTAAGGATCAAATCTA TGAGATTTTCCAAAAACTAAACACAAGTATTCAGGT TGTGTTGCTTTCTGCCACAATGCCAACTGATGTGT TGGAAGTGACCAAAAAAATTCATGAGAGATCCAATT CGAATTCTGGTGAAAAAGGAAGAATTGACCCTTGA AGGAATCAAACAGTTTTATATTAATGTTGAGAGAGA GGAATGGAAGTTGGATACACTTTGTGACTTGTACG AGACACTGACCATTACACAGGCTGTTATTTTTCTCA ATACGAGGCGCAAGGTGGACTGGCTGACTGAGAA GATGCATGCCAGAGACTTCACAGTTTCTGCTCTGC ATGGTGACATGGACCAGAAGGAGAGAGATGTTAT CATGAGGGAATTCCGGTCAGGGTCAAGTCGTGTT CTGATCAC | 20 | LRSLPLFS RELLFPVL KGMM* |
| 918 | NM_0019 67.3_531 | 531 | GCTGTCTTTTCAGTCGGGCGCTGAGTGGTTTTTCG GATCATGTCTGGTGGCTCCGCGGATTATAACAGAG AACATGGCGGCCCAGAGGGAATGGACCCCGATGG TGTCATCGAGAGCAACTGGAATGAGATTGTTGATA ACTTTGATGATATGAATTTAAAGGAGTCTCTCCTTC GTGGCATCTATGCTTACGGTTTTGAGAAGCCTTCC GCTATTCAGCAGAGAGCTATTATTCCCTGTATTAAA GGGTATGATGTGATTGCTCAAGCTCAGTCAGGTAC TGGCAAGACAGCCACATTTGCTATTTCCATCCTGC AACAGTTGGAGATTGAGTTCAAGGAGACCCAAGCA CTAGTATTGGCCCCCACCAGAGAACTGGCTCAACA GATCCAAAAGGTAATTCTGGCACTTGGAGACTATA TGGGAGCCACTTGTCATGCCTGCATTGGTGGAACA AATGTTCGAAATGAAATGCAAAAACTGCAGGCTGA AGCACCACATATTGTTGTTGGTACACCCGGGAGAG TGTTTGATATGTTAAACAGAAGATACCTTTCTCCAAA ATGGATCAAAATGTTTGTTTTGGATGAAGCAGATG | 3 | LIC* |

TABLE 3A-continued

| SEQ ID | identifier_position | position | modified_RNA | PAP length | PAP |
|---|---|---|---|---|---|
| | | | AAATGTTGAGCCGTGGTTTTAAGGATCAAATCTAT GAGATTTTCCAAAAACTAAACACAAGTATTCAGGTT GTGTTGCTTTCTGCCACAATGCCAACTGATGTGTT GGAAGTGACCAAAAAATTCATGAGAGATCCAATTC GAATTCTGGTGAAAAAGGAAGAATTGACCCTTGAA GGAATCAAACAGTTTTATATTAATGTTGAGAGAGA GGAATGGAAGTTGGATACACTTTGTGACTTGTACG AGACACTGACCATTACACAGGCTGTTATTTTTCTCA ATACGAGGCGCAAGGTGGACTGGCTGACTGAGAA GATGCATGCCAGAGACTTCACAGTTTCTGCTCTGC ATGGTGACATGGACCAGAAGGAGAGAGATGTTAT CATGAGGGAATTCCGGTCAGGGTCAAGTCGTGTT CTGATCAC | | |
| 919 | NM_0019 68.2_103 9 | 1039 | CGGGGCCCGGAGTGGCTTCCCTGGCTGGCATCTG GACTTAGGCTATTTCCGTGCACGTAAAAGCGGAAT ATTGGAACGGTTGCACAGAACTTCCAAATAATTTTT ACCGCCACGCAAGATTTAGCCCTGAGGTCTTAATC TCAGGATTTGGGACAGTAAAAGCTGTCGTCCCTCC CCCTCGTCCAGCCGGTGGCAAGCGGGTACTGCGG GCGGTTCCGTCCGTCCCCTTTCGCAGAAATGGCA ACGAATGACCACCAGCATTAGCTGAGCCAGGGGA CGTGGGAGGGTTGATTGCCTAAACGACTCTGCATC GCCGCCTCTTTTTGAAACTAAGAGAAAATGGTGGG AGATCAAAAGAAAACTAAATAAACACACAGGCAAC TTGTCCTGGGACCTCAACTAAGCAAATGAAGCCTT ATTGTGTGTGCTGAGCCTGCAGTTCCCAACCTTCC GGGGAAGATGGGAGGACAGGGCGACAAAGGGCA CAGTAGGCTTGCCTGGCAGTAAGTGTGACCGCAG CTATCCAGGCGGAAGAGCAGAGGACTGAAACCAC CCTCCAGCAAGCGAGTGTCCGCCGCGTTGAGAAC CGCGCACCCTACCCATCGGCCACGTGACCAGTCC TTTTTAAAAAAAAATTTCTTTACCTTAAAAAAAAAAAA AAAAAAAAAAGGTGGGGAGAGACTCCACTTCCC AGAAGCCTCTCGTTACTCACGCAGCCGCAGTCTTG CGCAGGTGCCGCCAGGGCCAAACGGACATATCCG TCACGTGGCCAGAAGCTGGCCAATCCGGTTTGAA TCTCATTTTTTTCCTCTTACCCCCCCTTCTGGAGCG GTTGTGCGATCAGATCGATCTAAGATGGCGACTGT CGAACCGGAAACCACCCCTACTCCTAATCCCCCG ACTACAGAAGAGGAGAAAACGGAATCTAATCAGGA GGTTGCTAACCCAGAACACTATATTAAACATCCCC TACAGAACAGATGGGCACTCTGGTTTTTTAAAAAT GATAAAAGCAAAACTTGGC | 0 | * |
| 920 | NM_0019 68.2_107 2 | 1072 | CGGGGCCCGGAGTGGCTTCCCTGGCTGGCATCTG GACTTAGGCTATTTCCGTGCACGTAAAAGCGGAAT ATTGGAACGGTTGCACAGAACTTCCAAATAATTTTT ACCGCCACGCAAGATTTAGCCCTGAGGTCTTAATC TCAGGATTTGGGACAGTAAAAGCTGTCGTCCCTCC CCCTCGTCCAGCCGGTGGCAAGCGGGTACTGCGG GCGGTTCCGTCCGTCCCCTTTCGCAGAAATGGCA ACGAATGACCACCAGCATTAGCTGAGCCAGGGGA CGTGGGAGGGTTGATTGCCTAAACGACTCTGCATC GCCGCCTCTTTTTGAAACTAAGAGAAAATGGTGGG AGATCAAAAGAAAACTAAATAAACACACAGGCAAC TTGTCCTGGGACCTCAACTAAGCAAATGAAGCCTT ATTGTGTGTGCTGAGCCTGCAGTTCCCAACCTTCC GGGGAAGATGGGAGGACAGGGCGACAAAGGGCA CAGTAGGCTTGCCTGGCAGTAAGTGTGACCGCAG CTATCCAGGCGGAAGAGCAGAGGACTGAAACCAC CCTCCAGCAAGCGAGTGTCCGCCGCGTTGAGAAC CGCGCACCCTACCCATCGGCCACGTGACCAGTCC TTTTTAAAAAAAAATTTCTTTACCTTAAAAAAAAAAAA AAAAAAAAAAGGTGGGGAGAGACTCCACTTCCC AGAAGCCTCTCGTTACTCACGCAGCCGCAGTCTTG CGCAGGTGCCGCCAGGGCCAAACGGACATATCCG TCACGTGGCCAGAAGCTGGCCAATCCGGTTTGAA TCTCATTTTTTTCCTCTTACCCCCCCTTCTGGAGCG GTTGTGCGATCAGATCGATCTAAGATGGCGACTGT CGAACCGGAAACCACCCCTACTCCTAATCCCCCG ACTACAGAAGAGGAGAAAACGGAATCTAATCAGGA GGTTGCTAACCCAGAACACTATATTAAACATCCCC TACAGAACAGATGGGCACTCTGGTTTTTTAAAAAT GATAAAAGCAAAACTTGGC | 12 | GLCTTISS CLVI* |
| 921 | NM_0019 68.2_124 3 | 1243 | CGGGGCCCGGAGTGGCTTCCCTGGCTGGCATCTG GACTTAGGCTATTTCCGTGCACGTAAAAGCGGAAT ATTGGAACGGTTGCACAGAACTTCCAAATAATTTTT ACCGCCACGCAAGATTTAGCCCTGAGGTCTTAATC | 1 | G* |

TABLE 3A-continued

| SEQ ID | identifier_position | position | modified_RNA | PAP length | PAP |
|---|---|---|---|---|---|
| | | | TCAGGATTTGGGACAGTAAAAGCTGTCGTCCCTCC CCCTCGTCCAGCCGGTGGCAAGCGGGTACTGCGG GCGGTTCCGTCCGTCCCCTTTCGCAGAAATGGCA ACGAATGACCACCAGCATTAGCTGAGCCAGGGGA CGTGGGAGGGTTGATTGCCTAAACGACTCTGCATC GCCGCCTCTTTTTGAAACTAAGAGAAAATGGTGGG AGATCAAAAGAAAACTAAATAAACACACAGGCAAC TTGTCCTGGGACCTCAACTAAGCAAATGAAGCCTT ATTGTGTGTGCTGAGCCTGCAGTTCCCAACCTTCC GGGGAAGATGGGAGGACAGGGCGACAAAGGGCA CAGTAGGCTTGCCTGGCAGTAAGTGTGACCGCAG CTATCCAGGCGGAAGAGCAGAGGACTGAAACCAC CCTCCAGCAAGCGAGTGTCCGCCGCGTTGAGAAC CGCGCACCCTACCCATCGGCCACGTGACCAGTCC TTTTTAAAAAAAATTTCTTTACCTTAAAAAAAAAAAA AAAAAAAAAAAGGTGGGGAGAGACTCCACTTCCC AGAAGCCTCTCGTTACTCACGCAGCCGCAGTCTTG CGCAGGTGCCGCCAGGGCCAAACGGACATATCCG TCACGTGGCCAGAAGCTGGCCAATCCGGTTTGAA TCTCATTTTTTTCCTCTTACCCCCCCTTCTGGAGCG GTTGTGCGATCAGATCGATCTAAGATGGCGACTGT CGAACCGGAAACCACCCCTACTCCTAATCCCCCG ACTACAGAAGAGGAGAAAACGGAATCTAATCAGGA GGTTGCTAACCCAGAACACTATATTAAACATCCCC TACAGAACAGATGGGCACTCTGGTTTTTTAAAAAT GATAAAAGCAAAACTTGGC | | |
| 922 | NM_0019 68.2_126 9 | 1269 | CGGGGCCCGGAGTGGCTTCCCTGGCTGGCATCTG GACTTAGGCTATTTCCGTGCACGTAAAAGCGGAAT ATTGGAACGGTTGCACAGAACTTCCAAATAATTTTT ACCGCCACGCAAGATTTAGCCCTGAGGTCTTAATC TCAGGATTTGGGACAGTAAAAGCTGTCGTCCCTCC CCCTCGTCCAGCCGGTGGCAAGCGGGTACTGCGG GCGGTTCCGTCCGTCCCCTTTCGCAGAAATGGCA ACGAATGACCACCAGCATTAGCTGAGCCAGGGGA CGTGGGAGGGTTGATTGCCTAAACGACTCTGCATC GCCGCCTCTTTTTGAAACTAAGAGAAAATGGTGGG AGATCAAAAGAAAACTAAATAAACACACAGGCAAC TTGTCCTGGGACCTCAACTAAGCAAATGAAGCCTT ATTGTGTGTGCTGAGCCTGCAGTTCCCAACCTTCC GGGGAAGATGGGAGGACAGGGCGACAAAGGGCA CAGTAGGCTTGCCTGGCAGTAAGTGTGACCGCAG CTATCCAGGCGGAAGAGCAGAGGACTGAAACCAC CCTCCAGCAAGCGAGTGTCCGCCGCGTTGAGAAC CGCGCACCCTACCCATCGGCCACGTGACCAGTCC TTTTTAAAAAAAATTTCTTTACCTTAAAAAAAAAAAA AAAAAAAAAAAGGTGGGGAGAGACTCCACTTCCC AGAAGCCTCTCGTTACTCACGCAGCCGCAGTCTTG CGCAGGTGCCGCCAGGGCCAAACGGACATATCCG TCACGTGGCCAGAAGCTGGCCAATCCGGTTTGAA TCTCATTTTTTTCCTCTTACCCCCCCTTCTGGAGCG GTTGTGCGATCAGATCGATCTAAGATGGCGACTGT CGAACCGGAAACCACCCCTACTCCTAATCCCCCG ACTACAGAAGAGGAGAAAACGGAATCTAATCAGGA GGTTGCTAACCCAGAACACTATATTAAACATCCCC TACAGAACAGATGGGCACTCTGGTTTTTTAAAAAT GATAAAAGCAAAACTTGGC | 25 | MENLLMTT VMMYVALL LMLELKVIR* |
| 923 | NM_0019 68.2_147 9 | 1479 | CGGGGCCCGGAGTGGCTTCCCTGGCTGGCATCTG GACTTAGGCTATTTCCGTGCACGTAAAAGCGGAAT ATTGGAACGGTTGCACAGAACTTCCAAATAATTTTT ACCGCCACGCAAGATTTAGCCCTGAGGTCTTAATC TCAGGATTTGGGACAGTAAAAGCTGTCGTCCCTCC CCCTCGTCCAGCCGGTGGCAAGCGGGTACTGCGG GCGGTTCCGTCCGTCCCCTTTCGCAGAAATGGCA ACGAATGACCACCAGCATTAGCTGAGCCAGGGGA CGTGGGAGGGTTGATTGCCTAAACGACTCTGCATC GCCGCCTCTTTTTGAAACTAAGAGAAAATGGTGGG AGATCAAAAGAAAACTAAATAAACACACAGGCAAC TTGTCCTGGGACCTCAACTAAGCAAATGAAGCCTT ATTGTGTGTGCTGAGCCTGCAGTTCCCAACCTTCC GGGGAAGATGGGAGGACAGGGCGACAAAGGGCA CAGTAGGCTTGCCTGGCAGTAAGTGTGACCGCAG CTATCCAGGCGGAAGAGCAGAGGACTGAAACCAC CCTCCAGCAAGCGAGTGTCCGCCGCGTTGAGAAC CGCGCACCCTACCCATCGGCCACGTGACCAGTCC TTTTTAAAAAAAATTTCTTTACCTTAAAAAAAAAAAA AAAAAAAAAAAGGTGGGGAGAGACTCCACTTCCC AGAAGCCTCTCGTTACTCACGCAGCCGCAGTCTTG | 104 | PPLKIGLLF KKTPSEYS HRRLRQAI EIWELNQS LFKKQSGL HLNLISILM LLRYKRSLI RLCLVLLC SFFFFFLA RVSTIPIKE LQYTSPESI NVFLAHSVI VQ* |

TABLE 3A-continued

| SEQ ID | identifier_position | position | modified_RNA | PAP length | PAP |
|---|---|---|---|---|---|
| | | | CGCAGGTGCCGCCAGGGCCAAACGGACATATCCG<br>TCACGTGGCCAGAAGCTGGCCAATCCGGTTTGAA<br>TCTCATTTTTTTCCTCTTACCCCCCCTTCTGGAGCG<br>GTTGTGCGATCAGATCGATCTAAGATGGCGACTGT<br>CGAACCGGAAACCACCCCTACTCCTAATCCCCCG<br>ACTACAGAAGAGGAGAAAACGGAATCTAATCAGGA<br>GGTTGCTAACCCAGAACACTATATTAAACATCCCC<br>TACAGAACAGATGGGCACTCTGGTTTTTAAAAAT<br>GATAAAAGCAAAACTTGGC | | |
| 924 | NM_0019<br>70.3_214 | 214 | GCGGCGGCGGCGGTAGAGGCGGCGGCGGCGGC<br>GGCAGCGGGCTCGGAGGCAGCGGTTGGGCTCGC<br>GGCGAGCGGACGGGGTCGAGTCAGTGCGTTCGC<br>GCGAGTTGGAATCGAAGCCTCTTAAAATGGCAGAT<br>GACTTGGACTTCGAGACAGGAGATGCAGGGGCCT<br>CAGCCACCTTCCCAATGCAGTGCTCAGCATTACGT<br>AAGAATGGCTTGTGGTGCTCAAAGGCCGGCCATG<br>TAAGATCGTCGAGATGTCTACTTCGAAGACTGGCA<br>AGCACGGCCACGCCAAGGTCCATCTGGTTGGTAT<br>TGACATCTTTACTGGGAAGAAATATGAAGATATCT<br>GCCCGTCAACTCATAATATGGATGTCCCCAACATC<br>AAAAGGAATGACTTCCAGCTGATTGGCATCCAGGA<br>TGGGTACCTATCACTGCTCCAGGACAGCGGGGAG<br>GTACGAGAGGACCTTCGTCTCCCTGAGGGAGACC<br>TTGGCAAGGAGATTGAGCAGAAGTACGACTGTGG<br>AGAAGAGATCCTGATCACGGTGCTGTCTGCCATGA<br>CAGAGGAGGCAGCTGTTGCAATCAAGGCCATGGC<br>AAAATAACTGGCTCCCAGGATGGCGGTGGTGGCA<br>GCAGTGATCCTCTGAACCTGCAGAGGCCCCCTCC<br>CCGAGCCTGGCCTGGCTCTGGCCCGGTCCTAAGC<br>TGGACTCCTCCTACACAATTTATTTGACGTTTTATT<br>TTGGTTTTCCCCACCCCCTCAATCTGTCGGGGAGC<br>CCCTGCCCTTCACCTAGCTCCCTTGGCCAGGAGC<br>GAGCGAAGCTGTGGCCTTGGTGAAGCTGCCCTCC<br>TCTTCTCCCCTCACACTACAGCCCTGGTGGGGGA<br>GAAGGGGGTGGGTGCTGCTTGTGGTTTAGTCTTTT<br>TTTTTTTTTTTTTTTTTTTTTAAATTCAATCTGGAAT<br>CAGAAAGCGGTGGATTCTGGCAAATGGTCCTTGT<br>GCCCTCCCCACTCATCCCTGGTCTGGTCCCCTGTT<br>GCCCATAGCCCTTTACCCTGAGCACC | 61 | LWCSKAG<br>HVRSSRCL<br>LRRLASTA<br>TPRSIWLV<br>LTSLLGRN<br>MKISARQLI<br>IWMSPTSK<br>GMTSS* |
| 925 | NM_0019<br>85.2_680 | 680 | GCAGAGAGGGGCGCGGGGGGCGGGGGTGGTGG<br>GGCTTCTGGACTGAGCCGCTGAGGGTGCGGGCTG<br>ACCCTGTAAGTGGCTGCGGCGGGAAGATGGCGGA<br>GCTGCGCGTGCTCGTAGCTGTCAAGAGGGTCATC<br>GACTACGCCGTGAAGATCCGAGTGAAGCCTGACA<br>GGACCGGTGTGGTCACGGATGGTGTGAAGCACTC<br>CATGAACCCCTTCTGTGAGATCGCGGTGGAGGAG<br>GCTGTGCGGCTCAAGGAGAAGAAGCTGGTGAAGG<br>AGGTCATCGCCGTCAGCTGTGGGCCTGCACAGTG<br>CCAGGAGACGATTCGTACCGCCCTGGCCATGGGT<br>GCAGACCGAGGTATCCACGTGGAGGTGCCCCCAG<br>CAGAAGCAGAACGCTTGGGTCCCCTGCAGGTGGC<br>TCGGGTCCTGGCCAAGCTGGCAGAGAAGGAGAAG<br>GTGGACCTGGTGCTGCTGGGCAAACAGGCCATCG<br>ATGATGACTGTAACCAGACAGGGCAGATGACAGC<br>TGGATTTCTTGACTGGCCACAGGGCACATTCGCCT<br>CCCAGGTGACGCTGGAGGGGGACAAGTTGAAAGT<br>GGAGCGGGAGATCGATGGGGGCCTGGAGACCCT<br>GCGCCTGAAGCTGCCAGCTGTGGTGACAGCTGAC<br>CTGAGGCTCAACGAGCCCCGCTACGCCACGCTGC<br>CAACATCATGAAAGCCAAGAAGAAGAAGATCGAG<br>GTGATCAAGCCTGGGGACCTGGGTGTGGACCTGA<br>CCTCCAAGCTCTCTGTGATCAGTGTGGAGGACCC<br>GCCCCAGCGCACGGCCGGCGTCAAGGTGGAGAC<br>CACTGAGGACCTGGTGGCCAAGCTGAAGGAGATT<br>GGGCGGATTTGAGCCCCTCCCAGAGATGGCAATA<br>AAACTGACTCTCAACATCTATCTCTGTTAACTTAAA<br>AAAAAAAAAAAAAAA | 2 | TS* |
| 926 | NM_0020<br>04.2_332 | 332 | GGAACAGGATGCCCCTGTCCCGCTGGTTGAGATC<br>TGTGGGGGTCTTCCTGCTGCCAGCCCCCTACTGG<br>GCACCCCGGGAGAGGTGGCTGGGTTCCCTACGG<br>CGGCCCTCCCTGGTGCACGGGTACCCAGTCCTGG<br>CCTGGCACAGTGCCCGCTGCTGGTGCCAAGCGTG<br>GACAGAGGAACCTCGAGCCCTTTGCTCCTCCCTCA<br>GAATGAACGGAGACCAGAATTCAGATGTTTATGCC<br>CAAGAAAAGCAGGATTTCGTTCAGCACTTCTCCCA<br>GATCGTTAGGGTGCTGACTGAGGATGAGATGGGG<br>CACCCAGAGATAGGAGATGCTATGCCCGGCTCAA | 20 | MPGSRRS<br>WSTMPLE<br>ASITGV* |

TABLE 3A-continued

| SEQ ID | identifier_position | position | modified_RNA | PAP length | PAP |
|---|---|---|---|---|---|
| | | | GGAGGTCCTGGAGTACAATGCCATTGGAGGCAAG<br>TATAACCGGGGTTTGACGGTGGTAGTAGCATTCCG<br>GGAGCTGGTGGAGCCAAGGAAACAGGATGCTGAT<br>AGTCTCCAGCGGGCCTGGACTGTGGGCTGGTGTG<br>TGGAACTGCTGCAAGCTTTCTTCCTGGTGGCAGAT<br>GACATCATGGATTCATCCCTTACCCGCCGGGGAC<br>AGATCTGCTGGTATCAGAAGCCGGGCGTGGGTTT<br>GGATGCCATCAATGATGCTAACCTCCTGGAAGCAT<br>GTATCTACCGCCTGCTGAAGCTCTATTGCCGGGAG<br>CAGCCCTATTACCTGAACCTGATCGAGCTCTTCCT<br>GCAGAGTTCCTATCAGACTGAGATTGGGCAGACC<br>CTGGACCTCCTCACAGCCCCCAGGGCAATGTGG<br>ATCTTGTCAGATTCACTGAAAAGAGGTACAAATCTA<br>TTGTCAAGTACAAGACAGCTTTCTACTCCTTCTACC<br>TTCCTATAGCTGCAGCCATGTACATGGCAGGAATT<br>GATGGCGAGAAGGAGCACGCCAATGCCAAGAAGA<br>TCCTGCTGGAGATGGGGGAGTTCTTTCAGATTCAG<br>GATGATTACCTTGACCTCTTTGGGGACCCCAGTGT<br>GACCGGCAAAATTGGCACTGACATCCAGGACAAC<br>AAATGCAGCTGGCTGGTGGTTCAG | | |
| 927 | NM_0020<br>04.2_583 | 583 | GGAACAGGATGCCCCTGTCCCGCTGGTTGAGATC<br>TGTGGGGGTCTTCCTGCTGCCAGCCCCCTACTGG<br>GCACCCCGGGAGAGGTGGCTGGGTTCCCTACGG<br>CGGCCCTCCCTGGTGCACGGGTACCCAGTCCTGG<br>CCTGGCACAGTGCCCGCTGCTGGTGCCAAGCGTG<br>GACAGAGGAACCTCGAGCCCTTTGCTCCTCCCTCA<br>GAATGAACGGAGACCAGAATTCAGATGTTTATGCC<br>CAAGAAAAGCAGGATTTCGTTCAGCACTTCTCCCA<br>GATCGTTAGGGTGCTGACTGAGGATGAGATGGGG<br>CACCCAGAGATAGGAGATGCTATTGCCCGGCTCA<br>AGGAGGTCCTGGAGTACAATGCCATTGGAGGCAA<br>GTATAACCGGGGTTTGACGGTGGTAGTAGCATTCC<br>GGGAGCTGGTGGAGCCAAGGAAACAGGATGCTGA<br>TAGTCTCCAGCGGGCCTGGACTGTGGGCTGGTGT<br>GTGGAACTGCTGCAAGCTTTCTTCCTGGTGGCAGA<br>TGACATCATGGATTCATCCCTTACCCGCCGGGGAC<br>AGATCTGCTGGTATCAGAAGCCGGGCGTGGGTTG<br>GATGCCATCAATGATGCTAACCTCCTGGAAGCATG<br>TATCTACCGCCTGCTGAAGCTCTATTGCCGGGAGC<br>AGCCCTATTACCTGAACCTGATCGAGCTCTTCCTG<br>CAGAGTTCCTATCAGACTGAGATTGGGCAGACCCT<br>GGACCTCCTCACAGCCCCCAGGGCAATGTGGAT<br>CTTGTCAGATTCACTGAAAAGAGGTACAAATCTATT<br>GTCAAGTACAAGACAGCTTTCTACTCCTTCTACCTT<br>CCTATAGCTGCAGCCATGTACATGGCAGGAATTGA<br>TGGCGAGAAGGAGCACGCCAATGCCAAGAAGATC<br>CTGCTGGAGATGGGGGAGTTCTTTCAGATTCAGGA<br>TGATTACCTTGACCTCTTTGGGGACCCCAGTGTGA<br>CCGGCAAAATTGGCACTGACATCCAGGACAACAAA<br>TGCAGCTGGCTGGTGGTTCAG | 17 | WMPSMML<br>TSWKHVST<br>AC* |
| 928 | NM_0020<br>04.2_630 | 630 | GGAACAGGATGCCCCTGTCCCGCTGGTTGAGATC<br>TGTGGGGGTCTTCCTGCTGCCAGCCCCCTACTGG<br>GCACCCCGGGAGAGGTGGCTGGGTTCCCTACGG<br>CGGCCCTCCCTGGTGCACGGGTACCCAGTCCTGG<br>CCTGGCACAGTGCCCGCTGCTGGTGCCAAGCGTG<br>GACAGAGGAACCTCGAGCCCTTTGCTCCTCCCTCA<br>GAATGAACGGAGACCAGAATTCAGATGTTTATGCC<br>CAAGAAAAGCAGGATTTCGTTCAGCACTTCTCCCA<br>GATCGTTAGGGTGCTGACTGAGGATGAGATGGGG<br>CACCCAGAGATAGGAGATGCTATTGCCCGGCTCA<br>AGGAGGTCCTGGAGTACAATGCCATTGGAGGCAA<br>GTATAACCGGGGTTTGACGGTGGTAGTAGCATTCC<br>GGGAGCTGGTGGAGCCAAGGAAACAGGATGCTGA<br>TAGTCTCCAGCGGGCCTGGACTGTGGGCTGGTGT<br>GTGGAACTGCTGCAAGCTTTCTTCCTGGTGGCAGA<br>TGACATCATGGATTCATCCCTTACCCGCCGGGGAC<br>AGATCTGCTGGTATCAGAAGCCGGGCGTGGGTTT<br>GGATGCCATCAATGATGCTAACCTCCTGGAAGCAT<br>GTATCTACCGCCTGCTGAAGCTCTATTGCCGGGAGC<br>AGCCCTATTACCTGAACCTGATCGAGCTCTTCCTG<br>CAGAGTTCCTATCAGACTGAGATTGGGCAGACCCT<br>GGACCTCCTCACAGCCCCCAGGGCAATGTGGAT<br>CTTGTCAGATTCACTGAAAAGAGGTACAAATCTATT<br>GTCAAGTACAAGACAGCTTTCTACTCCTTCTACCTT<br>CCTATAGCTGCAGCCATGTACATGGCAGGAATTGA<br>TGGCGAGAAGGAGCACGCCAATGCCAAGAAGATC<br>CTGCTGGAGATGGGGGAGTTCTTTCAGATTCAGGA | 1 | C* |

TABLE 3A-continued

| SEQ ID | identifier_position | position | modified_RNA | PAP length | PAP |
|---|---|---|---|---|---|
| | | | TGATTACCTTGACCTCTTTGGGGACCCCAGTGTGA CCGGCAAAATTGGCACTGACATCCAGGACAACAAA TGCAGCTGGCTGGTGGTTCAG | | |
| 929 | NM_0020 04.2_744 | 744 | GGAACAGGATGCCCCTGTCCCGCTGGTTGAGATC TGTGGGGGTCTTCCTGCTGCCAGCCCCCTACTGG GCACCCGGGAGAGGTGGCTGGGTTCCCTACGG CGGCCCTCCCTGGTGCACGGGTACCCAGTCCTGG CCTGGCACAGTGCCCGCTGCTGGTGCCAAGCGTG GACAGAGGAACCTCGAGCCCTTTGCTCCTCCCTCA GAATGAACGGAGACCAGAATTCAGATGTTTATGCC CAAGAAAAGCAGGATTTCGTTCAGCACTTCTCCCA GATCGTTAGGGTGCTGACTGAGGATGAGATGGGG CACCCAGAGATAGGAGATGCTATTGCCCGGCTCA AGGAGGTCCTGGAGTACAATGCCATTGGAGGCAA GTATAACCGGGGTTTGACGGTGGTAGTAGCATTCC GGGAGCTGGTGGAGCCAAGGAAACAGGATGCTGA TAGTCTCCAGCGGGCCTGGACTGTGGGCTGGTGT GTGGAACTGCTGCAAGCTTTCTTCCTGGTGGCAGA TGACATCATGGATTCATCCCTTACCCGCCGGGGAC AGATCTGCTGGTATCAGAAGCCGGGCGTGGGTTT GGATGCCATCAATGATGCTAACCTCCTGGAAGCAT GTATCTACCGCCTGCTGAAGCTCTATTGCCGGGAG CAGCCCTATTACCTGAACCTGATCGAGCTCTTCCT GCAGAGTTCCTATCAGACTGAGATTGGGCAGACC CTGGACCTCCTCACAGCCCCCAGGGCAATGTGGA TCTTGTCAGATTCACTGAAAAGAGGTACAAATCTAT TGTCAAGTACAAGACAGCTTTCTACTCCTTCTACCT TCCTATAGCTGCAGCCATGTACATGGCAGGAATTG ATGGCGAGAAGGAGCACGCCAATGCCAAGAAGAT CCTGCTGGAGATGGGGGAGTTCTTTCAGATTCAG GATGATTACCTTGACCTCTTTGGGGACCCCAGTGT GACCGGCAAAATTGGCACTGACATCCAGGACAAC AAATGCAGCTGGCTGGTGGTTCAG | 30 | RAMWILSD SLKRGTNL LSSTRQLS TPSTFL* |
| 930 | NM_0020 04.2_748 | 748 | GGAACAGGATGCCCCTGTCCCGCTGGTTGAGATC TGTGGGGGTCTTCCTGCTGCCAGCCCCCTACTGG GCACCCGGGAGAGGTGGCTGGGTTCCCTACGG CGGCCCTCCCTGGTGCACGGGTACCCAGTCCTGG CCTGGCACAGTGCCCGCTGCTGGTGCCAAGCGTG GACAGAGGAACCTCGAGCCCTTTGCTCCTCCCTCA GAATGAACGGAGACCAGAATTCAGATGTTTATGCC CAAGAAAAGCAGGATTTCGTTCAGCACTTCTCCCA GATCGTTAGGGTGCTGACTGAGGATGAGATGGGG CACCCAGAGATAGGAGATGCTATTGCCCGGCTCA AGGAGGTCCTGGAGTACAATGCCATTGGAGGCAA GTATAACCGGGGTTTGACGGTGGTAGTAGCATTCC GGGAGCTGGTGGAGCCAAGGAAACAGGATGCTGA TAGTCTCCAGCGGGCCTGGACTGTGGGCTGGTGT GTGGAACTGCTGCAAGCTTTCTTCCTGGTGGCAGA TGACATCATGGATTCATCCCTTACCCGCCGGGGAC AGATCTGCTGGTATCAGAAGCCGGGCGTGGGTTT GGATGCCATCAATGATGCTAACCTCCTGGAAGCAT GTATCTACCGCCTGCTGAAGCTCTATTGCCGGGAG CAGCCCTATTACCTGAACCTGATCGAGCTCTTCCT GCAGAGTTCCTATCAGACTGAGATTGGGCAGACC CTGGACCTCCTCACAGCCCCCAGGGCAATGTGGA TCTTGTCAGATTCACTGAAAAGAGGTACAAATCTAT TGTCAAGTACAAGACAGCTTTCTACTCCTTCTACCT TCCTATAGCTGCAGCCATGTACATGGCAGGAATTG ATGGCGAGAAGGAGCACGCCAATGCCAAGAAGAT CCTGCTGGAGATGGGGGAGTTCTTTCAGATTCAG GATGATTACCTTGACCTCTTTGGGGACCCCAGTGT GACCGGCAAAATTGGCACTGACATCCAGGACAAC AAATGCAGCTGGCTGGTGGTTCAG | 29 | AMWILSDS LKRGTNLL SSTRQLST PSTFL* |
| 931 | NM_0020 46.3_100 5 | 1005 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG | 67 | MPSTTTLS SSFPGMTT NLATATGW WTSWPTW PPRSKTPG PPAPARAQ EEERDPHC WGVPATLS PPPH* |

| SEQ ID | identifier_position | position | modified_RNA | PAP length | PAP |
|---|---|---|---|---|---|
| | | | CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCCACTGCCAACGTGTCAGT GGTGGACCTGACCTGCCGTCTAGAAAAACCTGCC AAATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATGCCCTCAACGACCACTTTGT | | |
| 932 | NM_0020 46.3_109 0 | 1090 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCCACTGCCAACGTGTCAGT GGTGGACCTGACCTGCCGTCTAGAAAAACCTGCC AAATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTG | 38 | TWPPRSKT PGPPAPAR AQEEERDP HCWGVPA TLSPPPH* |
| 933 | NM_0020 46.3_135 | 135 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTGGTC GTATTGGGCGCCTGGTCACCAGGGCTGCTTTTAAC TCTGGTAAAGTGGATATTGTTGCCATCAATGACCC CTTCATTGACCTCAACTACATGGTTTACATGTTCCA ATATGATTCCACCCATGGCAAATTCCATGGCACCG TCAAGGCTGAGAACGGGAAGCTTGTCATCAATGG AAATCCCATCACCATCTTCCAGGAGCGAGATCCCT CCAAAATCAAGTGGGGCGATGCTGGCGCTGAGTA CGTCGTGGAGTCCACTGGCGTCTTCACCACCATG GAGAAGGCTGGGGCTCATTTGCAGGGGGGAGCC AAAAGGGTCATCATCTCTGCCCCCTCTGCTGATGC CCCCATGTTCGTCATGGGTGTGAACCATGAGAAGT ATGACAACAGCCTCAAGATCATCAGCAATGCCTCC TGCACCACCAACTGCTTAGCACCCCTGGCCAAGG TCATCCATGACAACTTTGGTATCGTGGAAGGACTC ATGACCACAGTCCATGCCATCACTGCCACCCAGAA GACTGTGGATGGCCCCTCCGGGAAACTGTGGCGT GATGGCCGCGGGGCTCTCCAGAACATCATCCCTG CCTCTACTGGCGCTGCCAAGGCTGTGGGCAAGGT CATCCCTGAGCTGAACGGGAAGCTCACTGGCATG GCCTTCCGTGTCCCCACTGCCAACGTGTCAGTGG TGGACCTGACCTGCCGTCTAGAAAAACCTGCCAAA TATGATGACATCAAGAAGGTGGTGAAGCAGGCGT CGGAGGGCCCCCTCAAGGGCATCCTGGGCTACAC TGAGCACCAGGTGGTCTCCTCTGACTTCAACAGCG ACACCCACTCCTCCACCTTTGACGCTGGGGCTGG CATTGCCCTCAACGACCACTTTGT | 124 | LVVLGAWS PGLLLTLV KWILLPSM TPSLTSTT WFTCSNMI PPMANSM APSRLRTG SLSSMEIP SPSSRSEI PPKSSGA MLALSTSW SPLASSPP WRRLGLIC RGEPKGS SSLPPLLM PPCSSWV* |

TABLE 3A-continued

| SEQ ID | identifier_ position | position | modified_RNA | length PAP | PAP |
|---|---|---|---|---|---|
| 934 | NM_0020 46.3_144 | 144 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCCACTGCCAACGTGTCAGT GGTGGACCTGACCTGCCGTCTAGAAAAACCTGCC AAATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 121 | MGAWSPG LLLTLVKWI LLPSMTPS LTSTTWFT CSNMIPPM ANSMAPS RLRTGSLS SMEIPSPS SRSEIPPK SSGAMLAL STSWSPLA SSPPWRR LGLICRGE PKGSSSLP PLLMPPCS SWV* |
| 935 | NM_0020 46.3_163 | 163 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATGGGCGCCTGGTCACCAGGGCTGCTTTTAAC TCTGGTAAAGTGGATATTGTTGCCATCAATGACCC CTTCATTGACCTCAACTACATGGTTTACATGTTCCA ATATGATTCCACCCATGGCAAATTCCATGGCACCG TCAAGGCTGAGAACGGGAAGCTTGTCATCAATGG AAATCCCATCACCATCTTCCAGGAGCGAGATCCCT CCAAAATCAAGTGGGGCGATGCTGGCGCTGAGTA CGTCGTGGAGTCCACTGGCGTCTTCACCACCATG GAGAAGGCTGGGGCTCATTTGCAGGGGGGAGCC AAAAGGGTCATCATCTCTGCCCCCTCTGCTGATGC CCCCATGTTCGTCATGGGTGTGAACCATGAGAAGT ATGACAACAGCCTCAAGATCATCAGCAATGCCTCC TGCACCACCAACTGCTTAGCACCCCTGGCCAAGG TCATCCATGACAACTTTGGTATCGTGGAAGGACTC ATGACCACAGTCCATGCCATCACTGCCACCCAGAA GACTGTGGATGGCCCCTCCGGGAAACTGTGGCGT GATGGCCGCGGGGCTCTCCAGAACATCATCCCTG CCTCTACTGGCGCTGCCAAGGCTGTGGGCAAGGT CATCCCTGAGCTGAACGGGAAGCTCACTGGCATG GCCTTCCGTGTCCCCACTGCCAACGTGTCAGTGG TGGACCTGACCTGCCGTCTAGAAAAACCTGCCAAA TATGATGACATCAAGAAGGTGGTGAAGCAGGCGT CGGAGGGCCCCCTCAAGGGCATCCTGGGCTACAC TGAGCACCAGGTGGTCTCCTCTGACTTCAACAGCG ACACCCACTCCTCCACCTTTGACGCTGGGGCTGG CATTGCCCTCAACGACCACTTTGT | 114 | LLLTLVKWI LLPSMTPS LTSTTWFT CSNMIPPM ANSMAPS RLRTGSLS SMEIPSPS SRSEIPPK SSGAMLAL STSWSPLA SSPPWRR LGLICRGE PKGSSSLP PLLMPPCS SWV* |
| 936 | NM_0020 46.3_192 | 192 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATGTTGCCATCAATGACCC CTTCATTGACCTCAACTACATGGTTTACATGTTCCA ATATGATTCCACCCATGGCAAATTCCATGGCACCG TCAAGGCTGAGAACGGGAAGCTTGTCATCAATGG AAATCCCATCACCATCTTCCAGGAGCGAGATCCCT CCAAAATCAAGTGGGGCGATGCTGGCGCTGAGTA CGTCGTGGAGTCCACTGGCGTCTTCACCACCATG GAGAAGGCTGGGGCTCATTTGCAGGGGGGAGCC AAAAGGGTCATCATCTCTGCCCCCTCTGCTGATGC CCCCATGTTCGTCATGGGTGTGAACCATGAGAAGT ATGACAACAGCCTCAAGATCATCAGCAATGCCTCC TGCACCACCAACTGCTTAGCACCCCTGGCCAAGG | 105 | MLPSMTPS LTSTTWFT CSNMIPPM ANSMAPS RLRTGSLS SMEIPSPS SRSEIPPK SSGAMLAL STSWSPLA SSPPWRR LGLICRGE PKGSSSLP PLLMPPCS SWV* |

TABLE 3A-continued

| SEQ ID | identifier_position | position | modified_RNA | PAP length | PAP |
|---|---|---|---|---|---|
| | | | TCATCCATGACAACTTTGGTATCGTGGAAGGACTC<br>ATGACCACAGTCCATGCCATCACTGCCACCCAGAA<br>GACTGTGGATGGCCCCTCCGGGAAACTGTGGCGT<br>GATGGCCGCGGGGCTCTCCAGAACATCATCCCTG<br>CCTCTACTGGCGCTGCCAAGGCTGTGGGCAAGGT<br>CATCCCTGAGCTGAACGGGAAGCTCACTGGCATG<br>GCCTTCCGTGTCCCCACTGCCAACGTGTCAGTGG<br>TGGACCTGACCTGCCGTCTAGAAAAACCTGCCAAA<br>TATGATGACATCAAGAAGGTGGTGAAGCAGGCGT<br>CGGAGGGCCCCCTCAAGGGCATCCTGGGCTACAC<br>TGAGCACCAGGTGGTCTCCTCTGACTTCAACAGCG<br>ACACCCACTCCTCCACCTTTGACGCTGGGGCTGG<br>CATTGCCCTCAACGACCACTTTGT | | |
| 937 | NM_0020<br>46.3_195 | 195 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTGCCATCAATGACCC<br>CTTCATTGACCTCAACTACATGGTTTACATGTTCCA<br>ATATGATTCCACCCATGGCAAATTCCATGGCACCG<br>TCAAGGCTGAGAACGGGAAGCTTGTCATCAATGG<br>AAATCCCATCACCATCTTCCAGGAGCGAGATCCCT<br>CCAAAATCAAGTGGGGCGATGCTGGCGCTGAGTA<br>CGTCGTGGAGTCCACTGGCGTCTTCACCACCATG<br>GAGAAGGCTGGGGCTCATTTGCAGGGGGGAGCC<br>AAAAGGGTCATCATCTCTGCCCCCTCTGCTGATGC<br>CCCCATGTTCGTCATGGGTGTGAACCATGAGAAGT<br>ATGACAACAGCCTCAAGATCATCAGCAATGCCTCC<br>TGCACCACCAACTGCTTAGCACCCCTGGCCAAGG<br>TCATCCATGACAACTTTGGTATCGTGGAAGGACTC<br>ATGACCACAGTCCATGCCATCACTGCCACCCAGAA<br>GACTGTGGATGGCCCCTCCGGGAAACTGTGGCGT<br>GATGGCCGCGGGGCTCTCCAGAACATCATCCCTG<br>CCTCTACTGGCGCTGCCAAGGCTGTGGGCAAGGT<br>CATCCCTGAGCTGAACGGGAAGCTCACTGGCATG<br>GCCTTCCGTGTCCCCACTGCCAACGTGTCAGTGG<br>TGGACCTGACCTGCCGTCTAGAAAAACCTGCCAAA<br>TATGATGACATCAAGAAGGTGGTGAAGCAGGCGT<br>CGGAGGGCCCCCTCAAGGGCATCCTGGGCTACAC<br>TGAGCACCAGGTGGTCTCCTCTGACTTCAACAGCG<br>ACACCCACTCCTCCACCTTTGACGCTGGGGCTGG<br>CATTGCCCTCAACGACCACTTTGT | 103 | PSMTPSLT<br>STTWFTCS<br>NMIPPMAN<br>SMAPSRLR<br>TGSLSSME<br>IPSPSSRS<br>EIPPKSSG<br>AMLALSTS<br>WSPLASSP<br>PWRRLGLI<br>CRGEPKG<br>SSSLPPLL<br>MPPCSSW<br>V* |
| 938 | NM_0020<br>46.3_216 | 216 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATGACCTCAACTACATGGTTTACATGTTCCA<br>ATATGATTCCACCCATGGCAAATTCCATGGCACCG<br>TCAAGGCTGAGAACGGGAAGCTTGTCATCAATGG<br>AAATCCCATCACCATCTTCCAGGAGCGAGATCCCT<br>CCAAAATCAAGTGGGGCGATGCTGGCGCTGAGTA<br>CGTCGTGGAGTCCACTGGCGTCTTCACCACCATG<br>GAGAAGGCTGGGGCTCATTTGCAGGGGGGAGCC<br>AAAAGGGTCATCATCTCTGCCCCCTCTGCTGATGC<br>CCCCATGTTCGTCATGGGTGTGAACCATGAGAAGT<br>ATGACAACAGCCTCAAGATCATCAGCAATGCCTCC<br>TGCACCACCAACTGCTTAGCACCCCTGGCCAAGG<br>TCATCCATGACAACTTTGGTATCGTGGAAGGACTC<br>ATGACCACAGTCCATGCCATCACTGCCACCCAGAA<br>GACTGTGGATGGCCCCTCCGGGAAACTGTGGCGT<br>GATGGCCGCGGGGCTCTCCAGAACATCATCCCTG<br>CCTCTACTGGCGCTGCCAAGGCTGTGGGCAAGGT<br>CATCCCTGAGCTGAACGGGAAGCTCACTGGCATG<br>GCCTTCCGTGTCCCCACTGCCAACGTGTCAGTGG<br>TGGACCTGACCTGCCGTCTAGAAAAACCTGCCAAA<br>TATGATGACATCAAGAAGGTGGTGAAGCAGGCGT<br>CGGAGGGCCCCCTCAAGGGCATCCTGGGCTACAC<br>TGAGCACCAGGTGGTCTCCTCTGACTTCAACAGCG<br>ACACCCACTCCTCCACCTTTGACGCTGGGGCTGG<br>CATTGCCCTCAACGACCACTTTGT | 97 | MTSTTWFT<br>CSNMIPPM<br>ANSMAPS<br>RLRTGSLS<br>SMEIPSPS<br>SRSEIPPK<br>SSGAMLAL<br>STSWSPLA<br>SSPPWRR<br>LGLICRGE<br>PKGSSSLP<br>PLLMPPCS<br>SWV* |
| 939 | NM_0020<br>46.3_303 | 303 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT | 67 | SSMEIPSP<br>SSRSEIPP<br>KSSGAMLA<br>LSTSWSPL |

TABLE 3A-continued

| SEQ ID | identifier_ position | position | modified_RNA | PAP length | PAP |
|---|---|---|---|---|---|
| | | | CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTGTCATCAATGG<br>AAATCCCATCACCATCTTCCAGGAGCGAGATCCCT<br>CCAAAAATCAAGTGGGGCGATGCTGGCGCTGAGTA<br>CGTCGTGGAGTCCACTGGCGTCTTCACCACCATG<br>GAGAAGGCTGGGGCTCATTTGCAGGGGGGAGCC<br>AAAAGGGTCATCATCTCTGCCCCCTCTGCTGATGC<br>CCCCATGTTCGTCATGGGTGTGAACCATGAGAAGT<br>ATGACAACAGCCTCAAGATCATCAGCAATGCCTCC<br>TGCACCACCAACTGCTTAGCACCCCTGGCCAAGG<br>TCATCCATGACAACTTTGGTATCGTGGAAGGACTC<br>ATGACCACAGTCCATGCCATCACTGCCACCCAGAA<br>GACTGTGGATGGCCCCTCCGGGAAACTGTGGCGT<br>GATGGCCGCGGGGCTCTCCAGAACATCATCCCTG<br>CCTCTACTGGCGCTGCCAAGGCTGTGGGCAAGGT<br>CATCCCTGAGCTGAACGGGAAGCTCACTGGCATG<br>GCCTTCCGTGTCCCCACTGCCAACGTGTCAGTGG<br>TGGACCTGACCTGCCGTCTAGAAAAACCTGCCAAA<br>TATGATGACATCAAGAAGGTGGTGAAGCAGGCGT<br>CGGAGGGCCCCCTCAAGGGCATCCTGGGCTACAC<br>TGAGCACCAGGTGGTCTCCTCTGACTTCAACAGCG<br>ACACCCACTCCTCCACCTTTGACGCTGGGGCTGG<br>CATTGCCCTCAACGACCACTTTGT | | ASSPPWR<br>RLGLICRG<br>EPKGSSSL<br>PPLLMPPC<br>SSWV* |
| 940 | NM_0020<br>46.3_532 | 532 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCTCAAGATCATCAGCAATGCCTC<br>CTGCACCACCAACTGCTTAGCACCCCTGGCCAAG<br>GTCATCCATGACAACTTTGGTATCGTGGAAGGACT<br>CATGACCACAGTCCATGCCATCACTGCCACCCAGA<br>AGACTGTGGATGGCCCCTCCGGGAAACTGTGGCG<br>TGATGGCCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 13 | SRSSAMPP<br>APPTA* |
| 941 | NM_0020<br>46.3_561 | 561 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAAG<br>GTCATCCATGACAACTTTGGTATCGTGGAAGGACT<br>CATGACCACAGTCCATGCCATCACTGCCACCCAGA<br>AGACTGTGGATGGCCCCTCCGGGAAACTGTGGCG<br>TGATGGCCGCGGGGCTCTCCAGAACATCATCCCT<br>GCCTCTACTGGCGCTGCCAAGGCTGTGGGCAAGG | 3 | PTA* |

TABLE 3A-continued

| SEQ ID | identifier_position | position | modified_RNA | PAP length | PAP |
|---|---|---|---|---|---|
| | | | TCATCCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | | |
| 942 | NM_0020 46.3_564 | 564 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACAACTGCTTAGCACCCCTGGCCAAG GTCATCCATGACAACTTTGGTATCGTGGAAGGACT CATGACCACAGTCCATGCCATCACTGCCACCCAGA AGACTGTGGATGGCCCCTCCGGGAAACTGTGGCG TGATGGCCGCGGGGCTCTCCAGAACATCATCCCT GCCTCTACTGGCGCTGCCAAGGCTGTGGGCAAGG TCATCCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 2 | TA* |
| 943 | NM_0020 46.3_570 | 570 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGTTAGCACCCCTGGCCAAG GTCATCCATGACAACTTTGGTATCGTGGAAGGACT CATGACCACAGTCCATGCCATCACTGCCACCCAGA AGACTGTGGATGGCCCCTCCGGGAAACTGTGGCG TGATGGCCGCGGGGCTCTCCAGAACATCATCCCT GCCTCTACTGGCGCTGCCAAGGCTGTGGGCAAGG TCATCCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 0 | * |
| 944 | NM_0020 46.3_585 | 585 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG | 13 | RSSMTTLV SWKDS* |

TABLE 3A-continued

| SEQ ID | identifier_position | position | modified_RNA | PAP length | PAP |
|---|---|---|---|---|---|
| | | | GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCAAG<br>GTCATCCATGACAACTTTGGTATCGTGGAAGGACT<br>CATGACCACAGTCCATGCCATCACTGCCACCCAGA<br>AGACTGTGGATGGCCCCTCCGGGAAACTGTGGCG<br>TGATGGCCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | | |
| 945 | NM_0020<br>46.3_606 | 606 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCAA<br>GGTCATCCATGACAACTTGGTATCGTGGAAGGACT<br>CATGACCACAGTCCATGCCATCACTGCCACCCAGA<br>AGACTGTGGATGGCCCCTCCGGGAAACTGTGGCG<br>TGATGGCCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 7 | LVSWKDS* |
| 946 | NM_0020<br>46.3_630 | 630 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCAA<br>GGTCATCCATGACAACTTTGGTATCGTGGAAGGAC<br>TCATGACACAGTCCATGCCATCACTGCCACCCAGA<br>AGACTGTGGATGGCCCCTCCGGGAAACTGTGGCG<br>TGATGGCCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC | 47 | QSMPSLPP<br>RRLWMAP<br>PGNCGVM<br>AAGLSRTS<br>SLPLLALP<br>RLWARSSL<br>S* |

TABLE 3A-continued

| SEQ ID | identifier_position | position | modified_RNA | PAP length | PAP |
|---|---|---|---|---|---|
| | | | GTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTTGT | | |
| 947 | NM_0020 46.3_651 | 651 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAGCTTGTCATCAATGGAAATCCCATCACCATCTTCCAGGAGCGAGATCCCTCCAAAATCAAGTGGGGCGATGCTGGCGCTGAGTACGTCGTGGAGTCCACTGGCGTCTTCACCACCATGGAGAAGGCTGGGGCTCATTTGCAGGGGGGAGCCAAAAGGGTCATCATCTCTGCCCCCTCTGCTGATGCCCCCATGTTCGTCATGGGTGTGAACCATGAGAAGTATGACAACAGCCTCAAGATCATCAGCAATGCCTCCTGCACCACCAACTGCTTAGCACCCCTGGCCAAGGTCATCCATGACAACTTTGGTATCGTGGAAGGACTCATGACCACAGTCCATGCCATCACTGCACCCAGAAGACTGTGGATGGCCCCTCCGGGAAACTGTGGCGTGATGGCCGCGGGGCTCTCCAGAACATCATCCCTGCCTCTACTGGCGCTGCCAAGGCTGTGGGCAAGGTCATCCCTGAGCTGAACGGGAAGCTCACTGGCATGGCCTTCCGTGTCCCCACTGCCAACGTGTCAGTGGTGGACCTGACCTGCCGTCTAGAAAAACCTGCCAATATGATGACATCAAGAAGGTGGTGAAGCAGGCGTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTTGT | 40 | PRRLWMAPPGNCGVMAAGLSRTSSLPLLALPRLWARSSLS* |
| 948 | NM_0020 46.3_655 | 655 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAGCTTGTCATCAATGGAAATCCCATCACCATCTTCCAGGAGCGAGATCCCTCCAAAATCAAGTGGGGCGATGCTGGCGCTGAGTACGTCGTGGAGTCCACTGGCGTCTTCACCACCATGGAGAAGGCTGGGGCTCATTTGCAGGGGGGAGCCAAAAGGGTCATCATCTCTGCCCCCTCTGCTGATGCCCCCATGTTCGTCATGGGTGTGAACCATGAGAAGTATGACAACAGCCTCAAGATCATCAGCAATGCCTCCTGCACCACCAACTGCTTAGCACCCCTGGCCAAGGTCATCCATGACAACTTTGGTATCGTGGAAGGACTCATGACCACAGTCCATGCCATCACTGCACCCAGAAGACTGTGGATGGCCCCTCCGGGAAACTGTGGCGTGATGGCCGCGGGGCTCTCCAGAACATCATCCCTGCCTCTACTGGCGCTGCCAAGGCTGTGGGCAAGGTCATCCCTGAGCTGAACGGGAAGCTCACTGGCATGGCCTTCCGTGTCCCCACTGCCAACGTGTCAGTGGTGGACCTGACCTGCCGTCTAGAAAAACCTGCCAATATGATGACATCAAGAAGGTGGTGAAGCAGGCGTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTTGT | 39 | RRLWMAPPGNCGVMAAGLSRTSSLPLLALPRLWARSSLS* |
| 949 | NM_0020 46.3_675 | 675 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAGCTTGTCATCAATGGAAATCCCATCACCATCTTCCAGGAGCGAGATCCCTCCAAAATCAAGTGGGGCGATGCTGGCGCTGAGTACGTCGTGGAGTCCACTGGCGTCTTCACCACCATGGAGAAGGCTGGGGCTCATTTGCAGGGGGGAGC | 32 | PGNCGVMAAGLSRTSSLPLLALPRLWARSSLS* |

TABLE 3A-continued

| SEQ ID | identifier_position | position | modified_RNA | PAP length | PAP |
|---|---|---|---|---|---|
| | | | CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAA<br>GGTCATCCATGACAACTTTGGTATCGTGGAAGGAC<br>TCATGACCACAGTCCATGCCATCACTGCCACCCAG<br>AAGACTGTGGATGGCCCTCCGGGAAACTGTGGCG<br>TGATGGCCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | | |
| 950 | NM_0020<br>46.3_700 | 700 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAA<br>GGTCATCCATGACAACTTTGGTATCGTGGAAGGAC<br>TCATGACCACAGTCCATGCCATCACTGCCACCCAG<br>AAGACTGTGGATGGCCCTCCGGGAAACTGTGGC<br>GTGATGGCGCGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 24 | AGLSRTSS<br>LPLLALPRL<br>WARSSLS* |
| 951 | NM_0020<br>46.3_702 | 702 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAA<br>GGTCATCCATGACAACTTTGGTATCGTGGAAGGAC<br>TCATGACCACAGTCCATGCCATCACTGCCACCCAG<br>AAGACTGTGGATGGCCCTCCGGGAAACTGTGGC<br>GTGATGGCCGGGGGCTCTCCAGAACATCATCCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 22 | LSRTSSLP<br>LLALPRLW<br>ARSSLS* |

TABLE 3A-continued

| SEQ ID | identifier_position | position | modified_RNA | PAP length | PAP |
|---|---|---|---|---|---|
| 952 | NM_0020 46.3_706 | 706 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCTCCGGGAAACTGTGGC GTGATGGCCGCGGGCTCTCCAGAACATCATCCCT GCCTCTACTGGCGCTGCCAAGGCTGTGGGCAAGG TCATCCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 22 | LSRTSSLP LLALPRLW ARSSLS* |
| 953 | NM_0020 46.3_707 | 707 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCTCCGGGAAACTGTGGC GTGATGGCCGCGGGGTCTCCAGAACATCATCCCT GCCTCTACTGGCGCTGCCAAGGCTGTGGGCAAGG TCATCCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 22 | VSRTSSLP LLALPRLW ARSSLS* |
| 954 | NM_0020 46.3_725 | 725 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA | 16 | LPLLALPRL WARSSLS* |

TABLE 3A-continued

| SEQ ID | identifier_position | position | modified_RNA | PAP length | PAP |
|---|---|---|---|---|---|
| | | | GGTCATCCATGACAACTTTGGTATCGTGGAAGGAC<br>TCATGACCACAGTCCATGCCATCACTGCCACCCAG<br>AAGACTGTGGATGGCCCCTCCGGGAAACTGTGGC<br>GTGATGGCCGCGGGGCTCTCCAGAACATCATCCT<br>GCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | | |
| 955 | NM_0020<br>46.3_729 | 729 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAA<br>GGTCATCCATGACAACTTTGGTATCGTGGAAGGAC<br>TCATGACCACAGTCCATGCCATCACTGCCACCCAG<br>AAGACTGTGGATGGCCCCTCCGGGAAACTGTGGC<br>GTGATGGCCGCGGGGCTCTCCAGAACATCATCCC<br>TGCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 14 | LLALPRLW<br>ARSSLS* |
| 956 | NM_0020<br>46.3_744 | 744 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT<br>CGTATTGGGCGCCTGGTCACCAGGGCTGCTTTTAA<br>CTCTGGTAAAGTGGATATTGTTGCCATCAATGACC<br>CCTTCATTGACCTCAACTACATGGTTTACATGTTCC<br>AATATGATTCCACCCATGGCAAATTCCATGGCACC<br>GTCAAGGCTGAGAACGGGAAGCTTGTCATCAATG<br>GAAATCCCATCACCATCTTCCAGGAGCGAGATCCC<br>TCCAAAATCAAGTGGGGCGATGCTGGCGCTGAGT<br>ACGTCGTGGAGTCCACTGGCGTCTTCACCACCAT<br>GGAGAAGGCTGGGGCTCATTTGCAGGGGGGAGC<br>CAAAAGGGTCATCATCTCTGCCCCCTCTGCTGATG<br>CCCCCATGTTCGTCATGGGTGTGAACCATGAGAA<br>GTATGACAACAGCCTCAAGATCATCAGCAATGCCT<br>CCTGCACCACCAACTGCTTAGCACCCCTGGCCAA<br>GGTCATCCATGACAACTTTGGTATCGTGGAAGGAC<br>TCATGACCACAGTCCATGCCATCACTGCCACCCAG<br>AAGACTGTGGATGGCCCCTCCGGGAAACTGTGGC<br>GTGATGGCCGCGGGGCTCTCCAGAACATCATCCC<br>TGCCTCTACTGGCGCTGCCAAGGCTGTGGGCAAGG<br>TCATCCCTGAGCTGAACGGGAAGCTCACTGGCAT<br>GGCCTTCCGTGTCCCCACTGCCAACGTGTCAGTG<br>GTGGACCTGACCTGCCGTCTAGAAAAACCTGCCA<br>AATATGATGACATCAAGAAGGTGGTGAAGCAGGC<br>GTCGGAGGGCCCCCTCAAGGGCATCCTGGGCTAC<br>ACTGAGCACCAGGTGGTCTCCTCTGACTTCAACAG<br>CGACACCCACTCCTCCACCTTTGACGCTGGGGCT<br>GGCATTGCCCTCAACGACCACTTTGT | 9 | RLWARSSL<br>S* |
| 957 | NM_0020<br>46.3_758 | 758 | AAATTGAGCCCGCAGCCTCCCGCTTCGCTCTCTGC<br>TCCTCCTGTTCGACAGTCAGCCGCATCTTCTTTTG<br>CGTCGCCAGCCGAGCCACATCGCTCAGACACCAT<br>GGGGAAGGTGAAGGTCGGAGTCAACGGATTTGGT | 5 | RSSLS* |

TABLE 3A-continued

| SEQ ID | identifier_ position | position | modified_RNA | PAP length | PAP |
|---|---|---|---|---|---|
| | | | CGTATTGGGCGCCTGGTCACCAGGGCTGCTTTTAA | | |
| | | | CTCTGGTAAAGTGGATATTGTTGCCATCAATGACC | | |
| | | | CCTTCATTGACCTCAACTACATGGTTTACATGTTCC | | |
| | | | AATATGATTCCACCCATGGCAAATTCCATGGCACC | | |
| | | | GTCAAGGCTGAGAACGGGAAGCTTGTCATCAATG | | |
| | | | GAAATCCCATCACCATCTTCCAGGAGCGAGATCCC | | |
| | | | TCCAAAATCAAGTGGGGCGATGCTGGCGCTGAGT | | |
| | | | ACGTCGTGGAGTCCACTGGCGTCTTCACCACCAT | | |
| | | | GGAGAAGGCTGGGGCTCATTTGCAGGGGGGAGC | | |
| | | | CAAAAGGGTCATCATCTCTGCCCCCTCTGCTGATG | | |
| | | | CCCCCATGTTCGTCATGGGTGTGAACCATGAGAA | | |
| | | | GTATGACAACAGCCTCAAGATCATCAGCAATGCCT | | |
| | | | CCTGCACCACCAACTGCTTAGCACCCCTGGCCAA | | |
| | | | GGTCATCCATGACAACTTTGGTATCGTGGAAGGAC | | |
| | | | TCATGACCACAGTCCATGCCATCACTGCCACCCAG | | |
| | | | AAGACTGTGGATGGCCCCTCCGGGAAACTGTGGC | | |
| | | | GTGATGGCCGCGGGGCTCTCCAGAACATCATCCC | | |
| | | | TGCCTCTACTGGCGCTGCCAAGGCTGTGGGCAGG | | |
| | | | TCATCCCTGAGCTGAACGGGAAGCTCACTGGCAT | | |
| | | | GGCCTTCCGTGTCCCCACTGCCAACGTGTCAGTG | | |
| | | | GTGGACCTGACCTGCCGTCTAGAAAAACCTGCCA | | |
| | | | AATATGATGACATCAAGAAGGTGGTGAAGCAGGC | | |
| | | | GTCGGAGGGCCCCCTCAAGGGCATCCTGGGCTAC | | |
| | | | ACTGAGCACCAGGTGGTCTCCTCTGACTTCAACAG | | |
| | | | CGACACCCACTCCTCCACCTTTGACGCTGGGGCT | | |
| | | | GGCATTGCCCTCAACGACCACTTTGT | | |
| 958 | NM_0020 46.3_760 | 760 | AAATTGAGCCCGCAGCCTCCCGCTTCGCTCTCTGC | 4 | SSLS* |
| | | | TCCTCCTGTTCGACAGTCAGCCGCATCTTCTTTTG | | |
| | | | CGTCGCCAGCCGAGCCACATCGCTCAGACACCAT | | |
| | | | GGGGAAGGTGAAGGTCGGAGTCAACGGATTTGGT | | |
| | | | CGTATTGGGCGCCTGGTCACCAGGGCTGCTTTTAA | | |
| | | | CTCTGGTAAAGTGGATATTGTTGCCATCAATGACC | | |
| | | | CCTTCATTGACCTCAACTACATGGTTTACATGTTCC | | |
| | | | AATATGATTCCACCCATGGCAAATTCCATGGCACC | | |
| | | | GTCAAGGCTGAGAACGGGAAGCTTGTCATCAATG | | |
| | | | GAAATCCCATCACCATCTTCCAGGAGCGAGATCCC | | |
| | | | TCCAAAATCAAGTGGGGCGATGCTGGCGCTGAGT | | |
| | | | ACGTCGTGGAGTCCACTGGCGTCTTCACCACCAT | | |
| | | | GGAGAAGGCTGGGGCTCATTTGCAGGGGGGAGC | | |
| | | | CAAAAGGGTCATCATCTCTGCCCCCTCTGCTGATG | | |
| | | | CCCCCATGTTCGTCATGGGTGTGAACCATGAGAA | | |
| | | | GTATGACAACAGCCTCAAGATCATCAGCAATGCCT | | |
| | | | CCTGCACCACCAACTGCTTAGCACCCCTGGCCAA | | |
| | | | GGTCATCCATGACAACTTTGGTATCGTGGAAGGAC | | |
| | | | TCATGACCACAGTCCATGCCATCACTGCCACCCAG | | |
| | | | AAGACTGTGGATGGCCCCTCCGGGAAACTGTGGC | | |
| | | | GTGATGGCCGCGGGGCTCTCCAGAACATCATCCC | | |
| | | | TGCCTCTACTGGCGCTGCCAAGGCTGTGGGCAAG | | |
| | | | TCATCCCTGAGCTGAACGGGAAGCTCACTGGCAT | | |
| | | | GGCCTTCCGTGTCCCCACTGCCAACGTGTCAGTG | | |
| | | | GTGGACCTGACCTGCCGTCTAGAAAAACCTGCCA | | |
| | | | AATATGATGACATCAAGAAGGTGGTGAAGCAGGC | | |
| | | | GTCGGAGGGCCCCCTCAAGGGCATCCTGGGCTAC | | |
| | | | ACTGAGCACCAGGTGGTCTCCTCTGACTTCAACAG | | |
| | | | CGACACCCACTCCTCCACCTTTGACGCTGGGGCT | | |
| | | | GGCATTGCCCTCAACGACCACTTTGT | | |
| 959 | NM_0020 46.3_767 | 767 | AAATTGAGCCCGCAGCCTCCCGCTTCGCTCTCTGC | 2 | LS* |
| | | | TCCTCCTGTTCGACAGTCAGCCGCATCTTCTTTTG | | |
| | | | CGTCGCCAGCCGAGCCACATCGCTCAGACACCAT | | |
| | | | GGGGAAGGTGAAGGTCGGAGTCAACGGATTTGGT | | |
| | | | CGTATTGGGCGCCTGGTCACCAGGGCTGCTTTTAA | | |
| | | | CTCTGGTAAAGTGGATATTGTTGCCATCAATGACC | | |
| | | | CCTTCATTGACCTCAACTACATGGTTTACATGTTCC | | |
| | | | AATATGATTCCACCCATGGCAAATTCCATGGCACC | | |
| | | | GTCAAGGCTGAGAACGGGAAGCTTGTCATCAATG | | |
| | | | GAAATCCCATCACCATCTTCCAGGAGCGAGATCCC | | |
| | | | TCCAAAATCAAGTGGGGCGATGCTGGCGCTGAGT | | |
| | | | ACGTCGTGGAGTCCACTGGCGTCTTCACCACCAT | | |
| | | | GGAGAAGGCTGGGGCTCATTTGCAGGGGGGAGC | | |
| | | | CAAAAGGGTCATCATCTCTGCCCCCTCTGCTGATG | | |
| | | | CCCCCATGTTCGTCATGGGTGTGAACCATGAGAA | | |
| | | | GTATGACAACAGCCTCAAGATCATCAGCAATGCCT | | |
| | | | CCTGCACCACCAACTGCTTAGCACCCCTGGCCAA | | |
| | | | GGTCATCCATGACAACTTTGGTATCGTGGAAGGAC | | |
| | | | TCATGACCACAGTCCATGCCATCACTGCCACCCAG | | |
| | | | AAGACTGTGGATGGCCCCTCCGGGAAACTGTGGC | | |
| | | | GTGATGGCCGCGGGGCTCTCCAGAACATCATCCC | | |

TABLE 3A-continued

| SEQ ID | identifier_position | position | modified_RNA | PAP length | PAP |
|---|---|---|---|---|---|
| | | | TGCCTCTACTGGCGCTGCCAAGGCTGTGGGCAAG GTCATCCTGAGCTGAACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | | |
| 960 | NM_0020 46.3_776 | 776 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGACGGGAAGCTCACTGGCAT GGCCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 20 | TGSSLAWP SVSPLPTC QWWT* |
| 961 | NM_0020 46.3_798 | 798 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCTTCCGTGTCCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 12 | SVSPLPTC QWWT* |
| 962 | NM_0020 46.3_810 | 810 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC | 8 | LPTCQWW T* |

TABLE 3A-continued

| SEQ ID | identifier_ position | position | modified_RNA | PAP length | PAP |
|---|---|---|---|---|---|
| | | | GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCACTGCCAACGTGTCAGTG GTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | | |
| 963 | NM_0020 46.3_855 | 855 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCCACTGCCAACGTGTCAGT GGTGGACCTGACCTGCCGTCTAGAAAAACCTGCCA AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | 11 | NLPNMMT SRRW* |
| 964 | NM_0020 46.3_857 | 857 | AAATTGAGCCCGCAGCCTCCCGCTTCGCTCTCTGC TCCTCCTGTTCGACAGTCAGCCGCATCTTCTTTTG CGTCGCCAGCCGAGCCACATCGCTCAGACACCAT GGGGAAGGTGAAGGTCGGAGTCAACGGATTTGGT CGTATTGGGCGCCTGGTCACCAGGGCTGCTTTTAA CTCTGGTAAAGTGGATATTGTTGCCATCAATGACC CCTTCATTGACCTCAACTACATGGTTTACATGTTCC AATATGATTCCACCCATGGCAAATTCCATGGCACC GTCAAGGCTGAGAACGGGAAGCTTGTCATCAATG GAAATCCCATCACCATCTTCCAGGAGCGAGATCCC TCCAAAATCAAGTGGGGCGATGCTGGCGCTGAGT ACGTCGTGGAGTCCACTGGCGTCTTCACCACCAT GGAGAAGGCTGGGGCTCATTTGCAGGGGGGAGC CAAAAGGGTCATCATCTCTGCCCCCTCTGCTGATG CCCCCATGTTCGTCATGGGTGTGAACCATGAGAA GTATGACAACAGCCTCAAGATCATCAGCAATGCCT CCTGCACCACCAACTGCTTAGCACCCCTGGCCAA GGTCATCCATGACAACTTTGGTATCGTGGAAGGAC TCATGACCACAGTCCATGCCATCACTGCCACCCAG AAGACTGTGGATGGCCCCTCCGGGAAACTGTGGC GTGATGGCCGCGGGGCTCTCCAGAACATCATCCC TGCCTCTACTGGCGCTGCCAAGGCTGTGGGCAAG GTCATCCCTGAGCTGAACGGGAAGCTCACTGGCA TGGCCTTCCGTGTCCCCACTGCCAACGTGTCAGT GGTGGACCTGACCTGCCGTCTAGAAAAACCTGCCA | 10 | LPNMMTS RRW* |

TABLE 3A-continued

| SEQ ID | identifier_ position | position | modified_RNA | PAP length | PAP |
|---|---|---|---|---|---|
| | | | AATATGATGACATCAAGAAGGTGGTGAAGCAGGC GTCGGAGGGCCCCCTCAAGGGCATCCTGGGCTAC ACTGAGCACCAGGTGGTCTCCTCTGACTTCAACAG CGACACCCACTCCTCCACCTTTGACGCTGGGGCT GGCATTGCCCTCAACGACCACTTTGT | | |
| 965 | NM_0020 79.1_176 | 176 | TCTCTTGATTCCTAGTCTCTCGATATGGCACCTCC GTCAGTCTTTGCCGAGGTTCCGCAGGCCCAGCCT GTCCTGGTCTTCAAGCTCACTGCCGACTTCAGGGA GGATCCGGACCCCCGCAAGGTCAACCTGGGAGTG GGAGCATATCGCACGGATGACTGCCATCCCTGGG TTTGCCAGTAGTGAAGAAAGTGGAGCAGAAGATTG CTAATGACAATAGCCTAAATCACGAGTATCTGCCA ATCCTGGGCCTGGCTGAGTTCCGGAGCTGTGCTT CTCGTCTTGCCCTTGGGGATGACAGCCCAGCACT CAAGGAGAAGCGGGTAGGAGGTGTGCAATCTTTG GGGGGAACAGGTGCACTTCGAATTGGAGCTGATT TCTTAGCGCGTTGGTACAATGGAACAAACAACAAG AACACACCTGTCTATGTGTCCTCACCAACCTGGGA GAATCACAATGCTGTGTTTTCCGCTGCTGGTTTTAA AGACATTCGGTCCTATCGCTACTGGGATGCAGAGA AGAGAGGATTGGACCTCCAGGGCTTCCTGAATGA TCTGGAGAATGCTCCTGAGTTCTCCATTGTTGTCC TCCACGCCTGTGCACACAACCCAACTGGGATTGA CCCAACTCCGGAGCAGTGGAAGCAGATTGCTTCT GTCATGAAGCACCGGTTTCTGTTCCCCTTCTTTGA CTCAGCCTATCAGGGCTTCGCATCTGGAAACCTGG AGAGAGATGCCTGGGCCATTCGCTATTTTGTGTCT GAAGGCTTCGAGTTCTTCTGTGCCCAGTCCTTCTC CAAGAACTTCGGGCTCTACAATGAGAGAGTCGGG AATCTGACTGTGGTTGGAAAAGAACCTGAGAGCAT CCTGCAAGTCCTTTCCCAGATGGAGAAGATCGTGC GGATTACTTGGTCCAATCCCCCCGCCCAGGGAGC ACGAATTGTGGCCAGCACCCTCTCTAACCCTGAGC TCTTTGAGGAATGGACAGGTAATGTGAAGACAATG GCTGACCGGATTCTGACCAT | 2 | CQ* |
| 966 | NM_0020 80.2_142 | 142 | TCTGGCCCAGGGAAGTCCCTGTCCTTACCTTCAGC AGGAGCCGGTTCCCTGTGTGTGTGTCCGCTCGCC CTCTGCTCCGTCCTGCGGCTGCCCACTGCCCTCC TACGGTCCACCATGGCCCTGCTGCACTCCGGCCG CGTCTCCCCGGGATCGCCGCCGCCTTCCACCCGG GCCTCGCCGCCGCGGCCTCTGCCAGAGCCAGCTC CTGGTGGACCCATGTGGAAATGGGACCTCCAGAT CCCATTCTGGGAGTCACTGAAGCCTTTAAGAGGGA CACCAATAGCAAAAAGATGAATCTGGGAGTTGGTG CCTACCGGGATGATAATGGAAAGCCTTACGTTCTG CCTAGCGTCCGCAAGGCAGAGGCCCAGATTGCCG CAAAAAAATTTGGACAAGGAATACCTGCCCATTGGG GGACTGGCTGAATTTTGCAAGGCATCTGCAGAACT AGCCCTGGGTGAGAACAGCGAAGTCTTGAAGAGT GGCCGGTTTGTCACTGTGCAGACCATTTCTGGAAC TGGAGCCTTAAGGATCGGAGCCAGTTTTCTGCAAA GATTTTTTAAGTTCAGCCGAGATGTCTTTCTGCCCA AACCAACCTGGGGAAACCACACACCCATCTTCAG GGATGCTGGCATGCAGCTACAAGGTTATCGGTATT ATGACCCCAAGACTTGCGGTTTTGACTTCACAGGC GCTGTGGAGGATATTTCAAAAATACCAGAGCAGAG TGTTCTTCTTCTGCATGCCTGCGCCCACAATCCCA CGGGAGTGGACCCGCGTCCGGAACAGTGGAAGG AAATAGCAACAGTGGTGAAGAAAAGGAATCTCTTT GCGTTCTTTGACATGGCCTACCAAGGCTTTGCCAG TGGTGATGGTGATAAGGATGCCTGGGCTGTGCGC CACTTCATCGAACAGGGCATTAATGTTTGCCTCTG CCAATCATATGCCAAGAACATGGGCTTATATGGTG AGCGTGTAGGAGCCTTCACTATGGTCTGCAAAGAT GCGGATGAAGCCAAAAGGGT | 50 | SPGSPPPS TRASPPRP LPEPAPGG PMWKWDL QIPFWESL KPLRGTPI AKR* |
| 967 | NM_0020 80.2_162 | 162 | TCTGGCCCAGGGAAGTCCCTGTCCTTACCTTCAGC AGGAGCCGGTTCCCTGTGTGTGTGTCCGCTCGCC CTCTGCTCCGTCCTGCGGCTGCCCACTGCCCTCC TACGGTCCACCATGGCCCTGCTGCACTCCGGCCG CGTCCTCCCCGGGATCGCCGCCGCTTCCACCCGG GCCTCGCCGCCGCGGCCTCTGCCAGAGCCAGCTC CTGGTGGACCCATGTGGAAATGGGACCTCCAGAT CCCATTCTGGGAGTCACTGAAGCCTTTAAGAGGGA CACCAATAGCAAAAAGATGAATCTGGGAGTTGGTG CCTACCGGGATGATAATGGAAAGCCTTACGTTCTG CCTAGCGTCCGCAAGGCAGAGGCCCAGATTGCCG CAAAAAAATTTGGACAAGGAATACCTGCCCATTGGG | 43 | STRASPPR PLPEPAPG GPMWKWD LQIPFWES LKPLRGTPI AKR* |

TABLE 3A-continued

| SEQ ID | identifier_ position | position | modified_RNA | PAP length | PAP |
|---|---|---|---|---|---|
| | | | GGACTGGCTGAATTTTGCAAGGCATCTGCAGAACT AGCCCTGGGTGAGAACAGCGAAGTCTTGAAGAGT GGCCGGTTTGTCACTGTGCAGACCATTTCTGGAAC TGGAGCCTTAAGGATCGGAGCCAGTTTTCTGCAAA GATTTTTTAAGTTCAGCCGAGATGTCTTTCTGCCCA AACCAACCTGGGGAAACCACACACCCATCTTCAG GGATGCTGGCATGCAGCTACAAGGTTATCGGTATT ATGACCCCAAGACTTGCGGTTTTGACTTCACAGGC GCTGTGGAGGATATTTCAAAAATACCAGAGCAGAG TGTTCTTCTTCTGCATGCCTGCGCCCACAATCCCA CGGGAGTGGACCCGCGTCCGGAACAGTGGAAGG AAATAGCAACAGTGGTGAAGAAAAGGAATCTCTTT GCGTTCTTTGACATGGCCTACCAAGGCTTTGCCAG TGGTGATGGTGATAAGGATGCCTGGGCTGTGCGC CACTTCATCGAACAGGGCATTAATGTTTGCCTCTG CCAATCATATGCCAAGAACATGGGCTTATATGGTG AGCGTGTAGGAGCCTTCACTATGGTCTGCAAAGAT GCGGATGAAGCCAAAAGGGT | | |
| 968 | NM_0020 87.2_143 9 | 1439 | GGCGAGAGGAAGCAGGGAGGAGAGTGATTTGAGT AGAAAAGAAACACAGCATTCCAGGCTGGCCCCAC CTCTATATTGATAAGTAGCCAATGGGAGCGGGTAG CCCTGATCCCTGGCCAATGGAAACTGAGGTAGGC GGGTCATCGCGCTGGGGTCTGTAGTCTGAGCGCT ACCCGGTTGCTGCTGCCCAAGGACCGCGGAGTCG GACGCAGGCAGACCATGTGGACCCTGGTGAGCTG GGTGGCCTTAACAGCAGGGCTGGTGGCTGGAACG CGGTGCCCAGATGGTCAGTTCTGCCCTGTGGCCT GCTGCCTGGACCCCGGAGGAGCCAGCTACAGCTG CTGCCGTCCCCTTCTGGACAAATGGCCCACAACA CTGAGCAGGCATCTGGGTGGCCCCTGCCAGGTTG ATGCCCACTGCTCTGCCGGCCACTCCTGCATCTTT ACCGTCTCAGGGACTTCCAGTTGCTGCCCCTTCCC AGAGGCCGTGGCATGCGGGGATGGCCATCACTGC TGCCCACGGGGCTTCCACTGCAGTGCAGACGGGC GATCCTGCTTCCAAAGATCAGGTAACAACTCCGTG GGTGCCATCCAGTGCCCTGATAGTCAGTTCGAATG CCCGGACTTCTCCACGTGCTGTGTTATGGTCGATG GCTCCTGGGGGTGCTGCCCCATGCCCCAGGCTTC CTGCTGTGAAGACAGGGTGCACTGCTGTCCGCAC GGTGCCTTCTGCGACCTGGTTCACACCCGCTGCA TCACACCCACGGGCACCCACCCCCTGGCAAAGAA GCTCCCTGCCCAGAGGACTAACAGGGCAGTGGCC TTGTCCAGCTCGGTCATGTGTCCGGACGCACGGT CCCGGTGCCCTGATGGTTCTACCTGCTGTGAGCT GCCCAGTGGGAAGTATGGCTGCTGCCCAATGCCC AACGCCACCTGCTGCTCCGATCACCTGCACTGCT GCCCCCAAGACACTGTGTGTGACCTGATCCAGAG TAAGTGCCTCTCCAAGGAGAACGCTACCACGG | 4 | ATRV* |
| 969 | NM_0020 87.2_186 5 | 1865 | GGCGAGAGGAAGCAGGGAGGAGAGTGATTTGAGT AGAAAAGAAACACAGCATTCCAGGCTGGCCCCAC CTCTATATTGATAAGTAGCCAATGGGAGCGGGTAG CCCTGATCCCTGGCCAATGGAAACTGAGGTAGGC GGGTCATCGCGCTGGGGTCTGTAGTCTGAGCGCT ACCCGGTTGCTGCTGCCCAAGGACCGCGGAGTCG GACGCAGGCAGACCATGTGGACCCTGGTGAGCTG GGTGGCCTTAACAGCAGGGCTGGTGGCTGGAACG CGGTGCCCAGATGGTCAGTTCTGCCCTGTGGCCT GCTGCCTGGACCCCGGAGGAGCCAGCTACAGCTG CTGCCGTCCCCTTCTGGACAAATGGCCCACAACA CTGAGCAGGCATCTGGGTGGCCCCTGCCAGGTTG ATGCCCACTGCTCTGCCGGCCACTCCTGCATCTTT ACCGTCTCAGGGACTTCCAGTTGCTGCCCCTTCCC AGAGGCCGTGGCATGCGGGGATGGCCATCACTGC TGCCCACGGGGCTTCCACTGCAGTGCAGACGGGC GATCCTGCTTCCAAAGATCAGGTAACAACTCCGTG GGTGCCATCCAGTGCCCTGATAGTCAGTTCGAATG CCCGGACTTCTCCACGTGCTGTGTTATGGTCGATG GCTCCTGGGGGTGCTGCCCCATGCCCCAGGCTTC CTGCTGTGAAGACAGGGTGCACTGCTGTCCGCAC GGTGCCTTCTGCGACCTGGTTCACACCCGCTGCA TCACACCCACGGGCACCCACCCCCTGGCAAAGAA GCTCCCTGCCCAGAGGACTAACAGGGCAGTGGCC TTGTCCAGCTCGGTCATGTGTCCGGACGCACGGT CCCGGTGCCCTGATGGTTCTACCTGCTGTGAGCT GCCCAGTGGGAAGTATGGCTGCTGCCCAATGCCC AACGCCACCTGCTGCTCCGATCACCTGCACTGCT | 35 | ASVVLIGAT AVLLASAA QPGVPSV CAGRPRA GTPL* |

TABLE 3A-continued

| SEQ ID | identifier_position | position | modified_RNA | PAP length | PAP |
|---|---|---|---|---|---|
| 970 | NM_0020 87.2_1925 | 1925 | GCCCCCAAGACACTGTGTGTGACCTGATCCAGAG TAAGTGCCTCTCCAAGGAGAACGCTACCACGG GGCGAGAGGAAGCAGGGAGGAGAGTGATTTGAGT AGAAAAGAAACACAGCATTCCAGGCTGGCCCCAC CTCTATATTGATAAGTAGCCAATGGGAGCGGGTAG CCCTGATCCCTGGCCAATGGAAACTGAGGTAGGC GGGTCATCGCGCTGGGGTCTGTAGTCTGAGCGCT ACCCGGTTGCTGCTGCCCAAGGACCGCGGAGTCG GACGCAGGCAGACCATGTGGACCCTGGTGAGCTG GGTGGCCTTAACAGCAGGGCTGGTGGCTGGAACG CGGTGCCCAGATGGTCAGTTCTGCCCTGTGGCCT GCTGCCTGGACCCCGGAGGAGCCAGCTACAGCTG CTGCCGTCCCCTTCTGGACAAATGGCCCACAACA CTGAGCAGGCATCTGGGTGGCCCCTGCCAGGTTG ATGCCCACTGCTCTGCCGGCCACTCCTGCATCTTT ACCGTCTCAGGGACTTCCAGTTGCTGCCCCTTCCC AGAGGCCGTGGCATGCGGGGATGGCCATCACTGC TGCCCACGGGGCTTCCACTGCAGTGCAGACGGGC GATCCTGCTTCCAAAGATCAGGTAACAACTCCGTG GGTGCCATCCAGTGCCCTGATAGTCAGTTCGAATG CCCGGACTTCTCCACGTGCTGTGTTATGGTCGATG GCTCCTGGGGGTGCTGCCCCATGCCCCAGGCTTC CTGCTGTGAAGACAGGGTGCACTGCTGTCCGCAC GGTGCCTTCTGCGACCTGGTTCACACCCGCTGCA TCACACCCACGGGCACCCACCCCCTGGCAAAGAA GCTCCCTGCCCAGAGGACTAACAGGGCAGTGGCC TTGTCCAGCTCGGTCATGTGTCCGGACGCACGGT CCCGGTGCCCTGATGGTTCTACCTGCTGTGAGCT GCCCAGTGGGAAGTATGGCTGCTGCCCAATGCCC AACGCCACCTGCTGCTCCGATCACCTGCACTGCT GCCCCCAAGACACTGTGTGTGACCTGATCCAGAG TAAGTGCCTCTCCAAGGAGAACGCTACCACGG | 15 | VPSVCAGR PRAGTPL* |
| 971 | NM_0020 87.2_736 | 736 | GGCGAGAGGAAGCAGGGAGGAGAGTGATTTGAGT AGAAAAGAAACACAGCATTCCAGGCTGGCCCCAC CTCTATATTGATAAGTAGCCAATGGGAGCGGGTAG CCCTGATCCCTGGCCAATGGAAACTGAGGTAGGC GGGTCATCGCGCTGGGGTCTGTAGTCTGAGCGCT ACCCGGTTGCTGCTGCCCAAGGACCGCGGAGTCG GACGCAGGCAGACCATGTGGACCCTGGTGAGCTG GGTGGCCTTAACAGCAGGGCTGGTGGCTGGAACG CGGTGCCCAGATGGTCAGTTCTGCCCTGTGGCCT GCTGCCTGGACCCCGGAGGAGCCAGCTACAGCTG CTGCCGTCCCCTTCTGGACAAATGGCCCACAACA CTGAGCAGGCATCTGGGTGGCCCCTGCCAGGTTG ATGCCCACTGCTCTGCCGGCCACTCCTGCATCTTT ACCGTCTCAGGGACTTCCAGTTGCTGCCCCTTCCC AGAGGCCGTGGCATGCGGGGATGGCCATCACTGC TGCCCACGGGGCTTCCACTGCAGTGCAGACGGGC GATCCTGCTTCCAAAGATCAGGTAACAACTCCGTG GGTGCCATCCAGTGCCCTGATAGTCAGTTCGAATG CCCGGACTTCTCCACGTGCTGTGTTATGGTCGATG GCTCCTGGGGGTGCTGCCCCATGCCCCAGGCTTC CTGCTGTGAAGACAGGGTGCACTGCTGTCCGCAC GGTGCCTTCTGCGACCTGGTTCACACCCGCTGCAT CACACCCACGGGCACCCACCCCCTGGCAAAGAAG CTCCCTGCCCAGAGGACTAACAGGGCAGTGGCCT TGTCCAGCTCGGTCATGTGTCCGGACGCACGGTC CCGGTGCCCTGATGGTTCTACCTGCTGTGAGCTG CCCAGTGGGAAGTATGGCTGCTGCCCAATGCCCA ACGCCACCTGCTGCTCCGATCACCTGCACTGCTG CCCCCAAGACACTGTGTGTGACCTGATCCAGAGTA AGTGCCTCTCCAAGGAGAACGCTACCACGGA | 82 | WFTPAASH PRAPTPW QRSSLPRG LTGQWPC PARSCVRT HGPGALM VLPAVSCP VGSMAAA QCPTPPAA PITCTAAPK TLCVT* |
| 972 | NM_0020 87.2_778 | 778 | GGCGAGAGGAAGCAGGGAGGAGAGTGATTTGAGT AGAAAAGAAACACAGCATTCCAGGCTGGCCCCAC CTCTATATTGATAAGTAGCCAATGGGAGCGGGTAG CCCTGATCCCTGGCCAATGGAAACTGAGGTAGGC GGGTCATCGCGCTGGGGTCTGTAGTCTGAGCGCT ACCCGGTTGCTGCTGCCCAAGGACCGCGGAGTCG GACGCAGGCAGACCATGTGGACCCTGGTGAGCTG GGTGGCCTTAACAGCAGGGCTGGTGGCTGGAACG CGGTGCCCAGATGGTCAGTTCTGCCCTGTGGCCT GCTGCCTGGACCCCGGAGGAGCCAGCTACAGCTG CTGCCGTCCCCTTCTGGACAAATGGCCCACAACA CTGAGCAGGCATCTGGGTGGCCCCTGCCAGGTTG ATGCCCACTGCTCTGCCGGCCACTCCTGCATCTTT ACCGTCTCAGGGACTTCCAGTTGCTGCCCCTTCCC AGAGGCCGTGGCATGCGGGGATGGCCATCACTGC | 68 | WQRSSLP RGLTGQW PCPARSCV RTHGPGAL MVLPAVSC PVGSMAA AQCPTPPA APITCTAAP KTLCVT* |

TABLE 3A-continued

| SEQ ID | identifier_position | position | modified_RNA | PAP length | PAP |
|---|---|---|---|---|---|
| | | | TGCCCACGGGGCTTCCACTGCAGTGCAGACGGGC<br>GATCCTGCTTCCAAAGATCAGGTAACAACTCCGTG<br>GGTGCCATCCAGTGCCCTGATAGTCAGTTCGAATG<br>CCCGGACTTCTCCACGTGCTGTGTTATGGTCGATG<br>GCTCCTGGGGGTGCTGCCCCATGCCCCAGGCTTC<br>CTGCTGTGAAGACAGGGTGCACTGCTGTCCGCAC<br>GGTGCCTTCTGCGACCTGGTTCACACCCGCTGCA<br>TCACACCCACGGGCACCCACCCCTGGCAAAGAAG<br>CTCCCTGCCCAGAGGACTAACAGGGCAGTGGCCT<br>TGTCCAGCTCGGTCATGTGTCCGGACGCACGGTC<br>CCGGTGCCCTGATGGTTCTACCTGCTGTGAGCTG<br>CCCAGTGGGAAGTATGGCTGCTGCCCAATGCCCA<br>ACGCCACCTGCTGCTCCGATCACCTGCACTGCTG<br>CCCCCAAGACACTGTGTGTGACCTGATCCAGAGTA<br>AGTGCCTCTCCAAGGAGAACGCTACCACGGA | | |
| 973 | NM_0020<br>87.2_866 | 866 | GGCGAGAGGAAGCAGGGAGGAGAGTGATTTGAGT<br>AGAAAAGAAACACAGCATTCCAGGCTGGCCCCAC<br>CTCTATATTGATAAGTAGCCAATGGGAGCGGGTAG<br>CCCTGATCCCTGGCCAATGGAAACTGAGGTAGGC<br>GGGTCATCGCGCTGGGGTCTGTAGTCTGAGCGCT<br>ACCCGGTTGCTGCTGCCCAAGGACCGCGGAGTCG<br>GACGCAGGCAGACCATGTGGACCCTGGTGAGCTG<br>GGTGGCCTTAACAGCAGGGCTGGTGGCTGGAACG<br>CGGTGCCCAGATGGTCAGTTCTGCCCTGTGGCCT<br>GCTGCCTGGACCCCGGAGGAGCCAGCTACAGCTG<br>CTGCCGTCCCCTTCTGGACAAATGGCCCACAACA<br>CTGAGCAGGCATCTGGGTGGCCCCTGCCAGGTTG<br>ATGCCCACTGCTCTGCCGGCCACTCCTGCATCTTT<br>ACCGTCTCAGGGACTTCCAGTTGCTGCCCCTTCCC<br>AGAGGCCGTGGCATGCGGGGATGGCCATCACTGC<br>TGCCCACGGGGCTTCCACTGCAGTGCAGACGGGC<br>GATCCTGCTTCCAAAGATCAGGTAACAACTCCGTG<br>GGTGCCATCCAGTGCCCTGATAGTCAGTTCGAATG<br>CCCGGACTTCTCCACGTGCTGTGTTATGGTCGATG<br>GCTCCTGGGGGTGCTGCCCCATGCCCCAGGCTTC<br>CTGCTGTGAAGACAGGGTGCACTGCTGTCCGCAC<br>GGTGCCTTCTGCGACCTGGTTCACACCCGCTGCA<br>TCACACCCACGGGCACCCACCCCCTGGCAAAGAA<br>GCTCCCTGCCCAGAGGACTAACAGGGCAGTGGCC<br>TTGTCCAGCTCGGTCATGTGTCCGGACGCACGGT<br>CCCGGTGCCTGATGGTTCTACCTGCTGTGAGCTG<br>CCCAGTGGGAAGTATGGCTGCTGCCCAATGCCCA<br>ACGCCACCTGCTGCTCCGATCACCTGCACTGCTG<br>CCCCCAAGACACTGTGTGTGACCTGATCCAGAGTA<br>AGTGCCTCTCCAAGGAGAACGCTACCACGGA | 39 | LMVLPAVS<br>CPVGSMA<br>AAQCPTPP<br>AAPITCTAA<br>PKTLCVT* |
| 974 | NM_0021<br>06.3_356 | 356 | ATTGGTGGGATGAGCAATCCGAGTTCCCGGATGA<br>GGGAACATTCTGCAGTATAAAGGGAGCAGGGAAG<br>GCGGGAGACAGCGCAGTTTGAATCGCGGTGCGAC<br>GAAGGAGTAGGTGGTGGGATCTCACCGTGGGTCC<br>GATTAGCCTTTTCTCTGCCTTGCTTGCTTGAGCTTC<br>AGCGGAATTCGAAATGGCTGGCGGTAAGGCTGGA<br>AAGGACTCCGGAAAGGCCAAGACAAAGGCGGTTT<br>CCCGCTCGCAGAGAGCCGGCTTGCAGTTCCCAGT<br>GGGCCGTATTCATCGACACCTAAAATCTAGGACGA<br>CCAGTCATGGACGTGTGGGCGCGACTGCCGCTGT<br>GTACAGCGCAGCATCCTGGAGTACCTCACCGCAG<br>AGGTACTTGAACTGGCAGGAAATGCATCAAAAGAC<br>TTAAAGGTAAAGCGTATTACCCCTCGTCACTTGCA<br>ACTTGCTATTCGTGGAGATGAAGAATTGGATTCTC<br>TCATCAAGGCTACAATTGCTGGTGGTGGTGTCATT<br>CCACACATCCACAAATCTCTGATTGGGAAGAAAGG<br>ACAACAGAAGACTGTCTAAAGGATGCCTGGATTCC<br>TTGTTATCTCAGGACTCTAAATACTCTAACAGCTGT<br>CCAGTGTTGGTGATTCCAGTGGACTGTATCTCTGT<br>GAAAAACACAATTTTGCCTTTTTGTAATTCTATTTGA<br>GCAAGTTGGAAGTTTAATTAGCTTTCCAACCAACC<br>AAATTTCTGCATTCGAGTCTTAACCATATTTAAGTG<br>TTACTGTGGCTTCAAAGAAGCTATTGATTCTGAAGT<br>AGTGGGTTTTGATTGAGTTGACTGTTTTTAAAAAAC<br>TGTTTGGATTTTAATTGTGATGCAGAAGTTATAGTA<br>ACAAACATTTGGTTTTGTACAGACATTATTTCCACT<br>CTGGTGGATAAGTTCAATAAAGGTCATATCCCAAA<br>CAAAA | 19 | SWSTSPQ<br>RYLNWQE<br>MHQKT* |
| 975 | NM_0021<br>06.3_475 | 475 | ATTGGTGGGATGAGCAATCCGAGTTCCCGGATGA<br>GGGAACATTCTGCAGTATAAAGGGAGCAGGGAAG<br>GCGGGAGACAGCGCAGTTTGAATCGCGGTGCGAC<br>GAAGGAGTAGGTGGTGGGATCTCACCGTGGGTCC | 21 | WILSSRLQ<br>LLVVVSFH<br>TSTNL* |

TABLE 3A-continued

| SEQ ID | identifier_position | position | modified_RNA | PAP length | PAP |
|---|---|---|---|---|---|
| | | | GATTAGCCTTTTCTCTGCCTTGCTTGCTTGAGCTTC AGCGGAATTCGAAATGGCTGGCGGTAAGGCTGGA AAGGACTCCGGAAAGGCCAAGACAAAGGCGGTTT CCCGCTCGCAGAGAGCCGGCTTGCAGTTCCCAGT GGGCCGTATTCATCGACACCTAAAATCTAGGACGA CCAGTCATGGACGTGTGGGCGCGACTGCCGCTGT GTACAGCGCAGCCATCCTGGAGTACCTCACCGCA GAGGTACTTGAACTGGCAGGAAATGCATCAAAAGA CTTAAAGGTAAAGCGTATTACCCCTCGTCACTTGC AACTTGCTATTCGTGGAGATGAAGAATGGATTCTC TCATCAAGGCTACAATTGCTGGTGGTGGTGTCATT CCACACATCCACAAATCTCTGATTGGGAAGAAAGG ACAACAGAAGACTGTCTAAAGGATGCCTGGATTCC TTGTTATCTCAGGACTCTAAATACTCTAACAGCTGT CCAGTGTTGGTGATTCCAGTGGACTGTATCTCTGT GAAAAACACAATTTTGCCTTTTTGTAATTCTATTTGA GCAAGTTGGAAGTTTAATTAGCTTTCCAACCAACC AAATTTCTGCATTCGAGTCTTAACCATATTTAAGTG TTACTGTGGCTTCAAAGAAGCTATTGATTCTGAAGT AGTGGGTTTTGATTGAGTTGACTGTTTTTAAAAAAC TGTTTGGATTTTAATTGTGATGCAGAAGTTATAGTA ACAAACATTTGGTTTTGTACAGACATTATTTCCACT CTGGTGGATAAGTTCAATAAAGGTCATATCCCAAA CAAAA | | |
| 976 | NM_0021 16.5_106 4 | 1064 | ATGGCCGTCATGGCGCCCCGAACCCTCCTCCTGC TACTCTCGGGGGCCCTGGCCCTGACCCAGACCTG GGCGGGCTCCCACTCCATGAGGTATTTCTTCACAT CCGTGTCCCGGCCCGGCCGCGGGGAGCCCCGCT TCATCGCCGTGGGCTACGTGGACGACACGCAGTT CGTGCGGTTCGACAGCGACGCCGCGAGCCAGAG GATGGAGCCGCGGGCGCCGTGGATAGAGCAGGA GGGGCCGGAGTATTGGGACCAGGAGACACGGAAT GTGAAGGCCCAGTCACAGACTGACCGAGTGGACC TGGGGACCCTGCGCGGCTACTACAACCAGAGCGA GGCCGGTTCTCACACCATCCAGATAATGTATGGCT GCGACGTGGGGTCGGACGGGCGCTTCCTCCGCG GTACCGGCAGGACGCCTACGACGGCAAGGATTA CATCGCCCTGAACGAGGACCTGCGCTCTTGGACC GCGGCGGACATGGCGGCTCAGATCACCAAGCGCA AGTGGGAGGCGGCCCATGAGGCGGAGCAGTTGA GAGCCTACCTGGATGGCACGTGCGTGGAGTGGCT CCGCAGATACCTGGAGAACGGGAAGGAGACGCTG CAGCGCACGGACCCCCCCAAGACACATATGACCC ACCACCCCATCTCTGACCATGAGGCCACCCTGAG GTGCTGGGCCCTGGGCTTCTACCCTGCGGAGATC ACACTGACCTGGCAGCGGGATGGGGAGGACCAG ACCCAGGACACGGAGCTCGTGGAGACCAGGCCTG CAGGGGATGGAACCTTCCAGAAGTGGGCGGCTGT GGTGGTGCCTTCTGGAGAGGAGCAGAGATACACC TGCCATGTGCAGCATGAGGGTCTGCCCAAGCCCC TCACCCTGAGATGGGAGCTGTCTTCCCAGCCCAC CATCCCCATCGTGGGCATCATTGCTGGCCTGGTTC TCCTTGGAGCTGTGATCACTGGAGCTGTGGTCGCT GCCGTGATGTGGAGGAGGAAGAGCTCAGATAGAA AAGGAG | 30 | ALMCPSQL VKCETAAL CGTERQEL FLPFPL* |
| 977 | NM_0021 16.5_523 | 523 | ATGGCCGTCATGGCGCCCCGAACCCTCCTCCTGC TACTCTCGGGGGCCCTGGCCCTGACCCAGACCTG GGCGGGCTCCCACTCCATGAGGTATTTCTTCACAT CCGTGTCCCGGCCCGGCCGCGGGGAGCCCCGCT TCATCGCCGTGGGCTACGTGGACGACACGCAGTT CGTGCGGTTCGACAGCGACGCCGCGAGCCAGAG GATGGAGCCGCGGGCGCCGTGGATAGAGCAGGA GGGGCCGGAGTATTGGGACCAGGAGACACGGAAT GTGAAGGCCCAGTCACAGACTGACCGAGTGGACC TGGGGACCCTGCGCGGCTACTACAACCAGAGCGA GGCCGGTTCTCACACCATCCAGATAATGTATGGCT GCGACGTGGGGTCGGACGGGCGCTTCCTCCGCG GTACCGGCAGGACGCCTACGACGGCAAGGATTA CATCGCCCTGAACGAGGACCTGCGCTCTTGGACC GCGGCGGACATGGCGGCTCAGATCACCAAGCGCA AGTGGGAGGCGGCCATGAGGCGGAGCAGTTGAG AGCCTACCTGGATGGCACGTGCGTGGAGTGGCTC CGCAGATACCTGGAGAACGGGAAGGAGACGCTGC AGCGCACGGACCCCCCCAAGACACATATGACCCA CCACCCCATCTCTGACCATGAGGCCACCCTGAGG TGCTGGGCCCTGGGCTTCTACCCTGCGGAGATCA CACTGACCTGGCAGCGGGATGGGGAGGACCAGA CCCAGGACACGGAGCTCGTGGAGACCAGGCCTG | 5 | MRRSS* |

TABLE 3A-continued

| SEQ ID | identifier_position | position | modified_RNA | PAP length | PAP |
|---|---|---|---|---|---|
| | | | CAGGGGATGGAACCTTCCAGAAGTGGGCGGCTGT GGTGGTGCCTTCTGGAGAGGAGCAGAGATACACC TGCCATGTGCAGCATGAGGGTCTGCCCAAGCCCC TCACCCTGAGATGGGAGCTGTCTTCCCAGCCCAC CATCCCCATCGTGGGCATCATTGCTGGCCTGGTTC TCCTTGGAGCTGTGATCACTGGAGCTGTGGTCGCT GCCGTGATGTGGAGGAGGAAGAGCTCAGATAGAA AAGGAGG | | |
| 978 | NM_002117.4_530 | 530 | GGCCGAGATGCGGGTCATGGCGCCCCGAGCCCT CCTCCTGCTGCTCTCGGGAGGCCTGGCCCTGACC GAGACCTGGGCCTGCTCCCACTCCATGAGGTATTT CGACACCGCCGTGTCCCGGCCCGGCCGCGGAGA GCCCCGCTTCATCTCAGTGGGCTACGTGGACGAC ACGCAGTTCGTGCGGTTCGACAGCGACGCCGCGA GTCCGAGAGGGGAGCCGCGGGCGCCGTGGGTGG AGCAGGAGGGGCCGGAGTATTGGGACCGGGAGA CACAGAAGTACAAGCGCCAGGCACAGGCTGACCG AGTGAGCCTGCGGAACCTGCGCGGCTACTACAAC CAGAGCGAGGACGGGTCTCACACCCTCCAGAGGA TGTCTGGCTGCGACCTGGGGCCCGACGGGCGCC TCCTCCGCGGGTATGACCAGTCCGCCTACGACGG CAAGGATTACATCGCCCTGAACGAGGACCTGCGC TCCTGGACCGCCGCGGACACCGCGGCTCAGATCA CCCAGCGCAAGTTGGAGGCGGCCGTGCGGCGGA GCAGCTGAGAGCCTACCTGGAGGGCACGTGCGTG GAGTGGCTCCGCAGATACCTGGAGAACGGGAAGG AGACGCTGCAGCGCGCAGAACCCCCAAAGACACA CGTGACCCACCACCCCCTCTCTGACCATGAGGCC ACCCTGAGGTGCTGGGCCCTGGGCTTCTACCCTG CGGAGATCACACTGACCTGGCAGCGGGATGGGGA GGACCAGACCCAGGACACCGAGCTTGTGGAGACC AGGCCAGCAGGAGATGGAACCTTCCAGAAGTGGG CAGCTGTGGTGGTGCCTTCTGGACAAGAGCAGAG ATACACGTGCCATATGCAGCACGAGGGGCTGCAA GAGCCCCTCACCCTGAGCTGGGAGCCATCTTCCC AGCCCACCATCCCCATCATGGGCATCGTTGCTGG CCTGGCTGTCCTGGTTGTCCTAGCTGTCCTTGGAG CTGTGGTCACCGCTATGATGTGTAGGAGGAAGAG CTCAGGTG | 5 | VRRSS* |
| 979 | NM_002128.4_220 | 220 | TGGAGAGTAATGTTACAGAGCGGAGAGAGTGAGG AGGCTGCGTCTGGCTCCCGCTCTCACAGCCATTG CAGTACATTGAGCTCCATAGAGACAGCGCCGGGG CAAGTGAGAGCCGGACGGGCACTGGGCGACTCT GTGCCTCGCTGAGGAAAAATAACTAAACATGGGCA AAGGAGATCCTAAGAAGCCGAGAGGCAAAATGTC ATCATATGCATTTTTGTGCAAACTTGTCGGGAGGA GCATAAGAAGAAGCACCCAGATGCTTCAGTCAACT TCTCAGAGTTTTCTAAGAAGTGCTCAGAGAGGTGG AAGACCATGTCTGCTAAAGAGAAAGGAAAATTTGA AGATATGGCAAAAGCGGACAAGGCCCGTTATGAA AGAGAAATGAAAACCTATATCCCTCCCAAAGGGGA GACAAAAAAGAAGTTCAAGGATCCCAATGCACCCA AGAGGCCTCCTTCGGCCTTCTTCCTCTTCTGCTCT GAGTATCGCCCAAAAATCAAAGGAGAACATCCTGG CCTGTCCATTGGTGATGTTGCGAAGAAACTGGGA GAGATGTGGAATAACACTGCTGCAGATGACAAGCA GCCTTATGAAAAGAAGGCTGCGAAGCTGAAGGAA AAATACGAAAAGGATATTGCTGCATATCGAGCTAA AGGAAAGCCTGATGCAGCAAAAAAGGGAGTTGTC AAGGCTGAAAAAAGCAAGAAAAAGAAGGAAGAGG AGGAAGATGAGGAAGATGAAGAGGATGAGGAGGA GGAGGAAGATGAAGAAGATGAAGATGAAGAAGAA GATGATGATGATGAATAAGTTGGTTCTAGCGCAGT TTTTTTTTTCTTGTCTATAAAGCATTTAACCCCCCTG TACACAACTCACTCCTTTTAAAGAAAAAAATTGAAA TGTAAGGCTGTGTAAGATTTGTTTTTAAACTGTACA GTGTCTTTTTTTGTATAGTTAACACACTACCGAATG TGTCTTTAGATAGCCCTGTCCTGGTGGTATTTTCAA TAGCCACTAACCTTGC | 56 | LCKLVGRS IRRSTQML QSTSQSFL RSAQRGG RPCLLKRK ENLKIWQK RTRPVMKE K* |
| 980 | NM_002128.4_466 | 466 | TGGAGAGTAATGTTACAGAGCGGAGAGAGTGAGG AGGCTGCGTCTGGCTCCCGCTCTCACAGCCATTG CAGTACATTGAGCTCCATAGAGACAGCGCCGGGG CAAGTGAGAGCCGGACGGGCACTGGGCGACTCT GTGCCTCGCTGAGGAAAAATAACTAAACATGGGCA AAGGAGATCCTAAGAAGCCGAGAGGCAAAATGTC ATCATATGCATTTTTGTGCAAACTTGTCGGGAGG AGCATAAGAAGAAGCACCCAGATGCTTCAGTCAAC | 49 | SSSSALSIA QKSKENIL ACPLVMLR RNWERCGI TLLQMTSS LMKRRLRS* |

TABLE 3A-continued

| SEQ ID | identifier_position | position | modified_RNA | PAP length | PAP |
|---|---|---|---|---|---|
| | | | TTCTCAGAGTTTTCTAAGAAGTGCTCAGAGAGGTG GAAGACCATGTCTGCTAAAGAGAAAGGAAAATTTG AAGATATGGCAAAAGCGGACAAGGCCCGTTATGA AAGAGAAATGAAAACCTATATCCCTCCCAAAGGGG AGACAAAAAAGAAGTTCAAGGATCCCAATGCACCC AAGAGGCCTCCTTCGGCTTCTTCCTCTTCTGCTCT GAGTATCGCCCAAAAATCAAAGGAGAACATCCTGG CCTGTCCATTGGTGATGTTGCGAAGAAACTGGGA GAGATGTGGAATAACACTGCTGCAGATGACAAGCA GCCTTATGAAAAGAAGGCTGCGAAGCTGAAGGAA AAATACGAAAAGGATATTGCTGCATATCGAGCTAA AGGAAAGCCTGATGCAGCAAAAAAGGGAGTTGTC AAGGCTGAAAAAAGCAAGAAAAAGAAGGAAGAGG AGGAAGATGAGGAAGATGAAGAGGATGAGGAGGA GGAGGAAGATGAAGAAGATGAAGATGAAGAAGAA GATGATGATGATGAATAAGTTGGTTCTAGCGCAGT TTTTTTTTTCTTGTCTATAAAGCATTTAACCCCCCTG TACACAACTCACTCCTTTTAAAGAAAAAAATTGAAA TGTAAGGCTGTGTAAGATTTGTTTTTAAACTGTACA GTGTCTTTTTTTGTATAGTTAACACACTACCGAATG TGTCTTTAGATAGCCCTGTCCTGGTGGTATTTTCAA TAGCCACTAACCTTGC | | |
| 981 | NM_0021 28.4_495 | 495 | TGGAGAGTAATGTTACAGAGCGGAGAGAGTGAGG AGGCTGCGTCTGGCTCCCGCTCTCACAGCCATTG CAGTACATTGAGCTCCATAGAGACAGCGCCGGGG CAAGTGAGAGCCGGACGGGCACTGGGCGACTCT GTGCCTCGCTGAGGAAAAATAACTAAACATGGGCA AAGGAGATCCTAAGAAGCCGAGAGGCAAAATGTC ATCATATGCATTTTTTGTGCAAACTTGTCGGGAGG AGCATAAGAAGAAGCACCCAGATGCTTCAGTCAAC TTCTCAGAGTTTTCTAAGAAGTGCTCAGAGAGGTG GAAGACCATGTCTGCTAAAGAGAAAGGAAAATTTG AAGATATGGCAAAAGCGGACAAGGCCCGTTATGA AAGAGAAATGAAAACCTATATCCCTCCCAAAGGGG AGACAAAAAAGAAGTTCAAGGATCCCAATGCACCC AAGAGGCCTCCTTCGGCTTCTTCCTCTTCTGCTC TGAGTATCGCCAAAAATCAAAGGAGAACATCCTGG CCTGTCCATTGGTGATGTTGCGAAGAAACTGGGA GAGATGTGGAATAACACTGCTGCAGATGACAAGCA GCCTTATGAAAAGAAGGCTGCGAAGCTGAAGGAA AAATACGAAAAGGATATTGCTGCATATCGAGCTAA AGGAAAGCCTGATGCAGCAAAAAAGGGAGTTGTC AAGGCTGAAAAAAGCAAGAAAAAGAAGGAAGAGG AGGAAGATGAGGAAGATGAAGAGGATGAGGAGGA GGAGGAAGATGAAGAAGATGAAGATGAAGAAGAA GATGATGATGATGAATAAGTTGGTTCTAGCGCAGT TTTTTTTTTCTTGTCTATAAAGCATTTAACCCCCCTG TACACAACTCACTCCTTTTAAAGAAAAAAATTGAAA TGTAAGGCTGTGTAAGATTTGTTTTTAAACTGTACA GTGTCTTTTTTTGTATAGTTAACACACTACCGAATG TGTCTTTAGATAGCCCTGTCCTGGTGGTATTTTCAA TAGCCACTAACCTTGC | 40 | QKSKENIL ACPLVMLR RNWERCGI TLLQMTSS LMKRRLRS* |
| 982 | NM_0021 28.4_521 | 521 | TGGAGAGTAATGTTACAGAGCGGAGAGAGTGAGG AGGCTGCGTCTGGCTCCCGCTCTCACAGCCATTG CAGTACATTGAGCTCCATAGAGACAGCGCCGGGG CAAGTGAGAGCCGGACGGGCACTGGGCGACTCT GTGCCTCGCTGAGGAAAAATAACTAAACATGGGCA AAGGAGATCCTAAGAAGCCGAGAGGCAAAATGTC ATCATATGCATTTTTTGTGCAAACTTGTCGGGAGG AGCATAAGAAGAAGCACCCAGATGCTTCAGTCAAC TTCTCAGAGTTTTCTAAGAAGTGCTCAGAGAGGTG GAAGACCATGTCTGCTAAAGAGAAAGGAAAATTTG AAGATATGGCAAAAGCGGACAAGGCCCGTTATGA AAGAGAAATGAAAACCTATATCCCTCCCAAAGGGG AGACAAAAAAGAAGTTCAAGGATCCCAATGCACCC AAGAGGCCTCCTTCGGCTTCTTCCTCTTCTGCTC TGAGTATCGCCCAAAAATCAAAGGAGAACATCCTG GCTGTCCATTGGTGATGTTGCGAAGAAACTGGGA GAGATGTGGAATAACACTGCTGCAGATGACAAGCA GCCTTATGAAAAGAAGGCTGCGAAGCTGAAGGAA AAATACGAAAAGGATATTGCTGCATATCGAGCTAA AGGAAAGCCTGATGCAGCAAAAAAGGGAGTTGTC AAGGCTGAAAAAAGCAAGAAAAAGAAGGAAGAGG AGGAAGATGAGGAAGATGAAGAGGATGAGGAGGA GGAGGAAGATGAAGAAGATGAAGATGAAGAAGAA GATGATGATGATGAATAAGTTGGTTCTAGCGCAGT TTTTTTTTTCTTGTCTATAAAGCATTTAACCCCCCTG | 31 | CPLVMLRR NWERCGIT LLQMTSSL MKRRLRS* |

TABLE 3A-continued

| SEQ ID | identifier_ position | position | modified_RNA | PAP length | PAP |
|---|---|---|---|---|---|
| | | | TACACAACTCACTCCTTTTAAAGAAAAAAATTGAAA TGTAAGGCTGTGTAAGATTTGTTTTTAAACTGTACA GTGTCTTTTTTTGTATAGTTAACACACTACCGAATG TGTCTTTAGATAGCCCTGTCCTGGTGGTATTTTCAA TAGCCACTAACCTTGC | | |
| 983 | NM_0021 28.4_591 | 591 | TGGAGAGTAATGTTACAGAGCGGAGAGAGTGAGG AGGCTGCGTCTGGCTCCCGCTCTCACAGCCATTG CAGTACATTGAGCTCCATAGAGACAGCGCCGGGG CAAGTGAGAGCCGGACGGGCACTGGGCGACTCT GTGCCTCGCTGAGGAAAAATAACTAAACATGGGCA AAGGAGATCCTAAGAAGCCGAGAGGCAAAATGTC ATCATATGCATTTTTTGTGCAAACTTGTCGGGAGG AGCATAAGAAGAAGCACCCAGATGCTTCAGTCAAC TTCTCAGAGTTTTCTAAGAAGTGCTCAGAGAGGTG GAAGACCATGTCTGCTAAAGAGAAAGGAAAATTTG AAGATATGGCAAAAGCGGACAAGGCCCGTTATGA AAGAGAAATGAAAACCTATATCCCTCCCAAAGGGG AGACAAAAAAGAAGTTCAAGGATCCCAATGCACCC AAGAGGCCTCCTTCGGCCTTCTTCCTCTTCTGCTC TGAGTATCGCCCAAAAATCAAAGGAGAACATCCTG GCCTGTCCATTGGTGATGTTGCGAAGAAACTGGG AGAGATGTGGAATAACACTGCTGCAGATGACAAGC AGCTTATGAAAAGAAGGCTGCGAAGCTGAAGGAA AAATACGAAAAGGATATTGCTGCATATCGAGCTAA AGGAAAGCCTGATGCAGCAAAAAAGGGAGTTGTC AAGGCTGAAAAAAGCAAGAAAAAAGAAGGAAGAGG AGGAAGATGAGGAAGATGAAGAGGATGAGGAGGA GGAGGAAGATGAAGAAGATGAAGATGAAGAAGAA GATGATGATGATGAATAAGTTGGTTCTAGCGCAGT TTTTTTTTTCTTGTCTATAAAGCATTTAACCCCCCTG TACACAACTCACTCCTTTTAAAGAAAAAAATTGAAA TGTAAGGCTGTGTAAGATTTGTTTTTAAACTGTACA GTGTCTTTTTTTGTATAGTTAACACACTACCGAATG TGTCTTTAGATAGCCCTGTCCTGGTGGTATTTTCAA TAGCCACTAACCTTGC | 8 | LMKRRLRS* |
| 984 | NM_0021 29.2_506 | 506 | GATGTGGCCCGTGGCCTAGCTCGTCAAGTTGCCG TGGCGCGGAGAACTCTGCAAAACAAGAGGCTGAG GATTGCGTTAGAGATAAACCAGTTCACGCCGGAG CCCCGTGAGGGAAGCGTCTCCGTTGGGTCCGGCC GCTCTGCGGGACTCTGAGGAAAAGCTCGCACCAG GTGGACGCGGATCTGTCAACATGGGTAAAGGAGA CCCCAACAAGCCGCGGGGCAAAATGTCCTCGTAC GCCTTCTTCGTGCAGACCTGCCGGGAAGAGCACA AGAAGAAACACCCGGACTCTTCCGTCAATTTCGCG GAATTCTCCAAGAAGTGTTCGGAGAGATGGAAGAC CATGTCTGCAAAGGAGAAGTCGAAGTTTGAAGATA TGGCAAAAAGTGACAAAGCTCGCTATGACAGGGA GATGAAAAATTACGTTCCTCCCAAAGGTGATAAGA AGGGGAAGAAAAAGGACCCCAATGCTCCTAAAAG GCCACCATCTGCCTTCTTCCTGTTTGCTCTGAACA TCGCCCAAAGATCAAAAGTGAACACCCTGGCCTAT CCATTGGGGATACTGCAAAGAAATTGGGTGAAATG TGGTCTGAGCAGTCAGCCAAAGATAAACAACCATA TGAACAGAAAGCAGCTAAGCTAAAGGAGAAATATG AAAAGGATATTGCTGCATATCGTGCCAAGGGCAAA AGTGAAGCAGGAAAGAAGGGCCCTGGCAGGCCAA CAGGCTCAAAGAAGAAGAACGAACCAGAAGATGA GGAGGAGGAGGAGGAAGAAGAAGATGAAGATGAG GAGGAAGAGGATGAAGATGAAGAATAAATGGCTAT CCTTTAATGATGCGTGTGGAATGTGTGTGTGTGCT CAGGCAATTATTTTGCTAAGAATGTGAATTCAAGTG CAGCTCAATACTAGCTTCAGTATAAAAACTGTACA GATTTTTGTATAGCTGATAAGATTCTCTGTAGAGAA AATACTTTTAAAAAATGCAGGTTGTAGCTTTTTGAT GGGCTACTCATACAGTTAG | 45 | ALNIAQRS KVNTLAYP LGILQRNW VKCGLSSQ PKINNHMN RKQLS* |
| 985 | NM_0021 39.2_644 | 644 | GGTCCTTCAGCCTCGTTCCCGGGCAGTATAAAGTT TGCTGTCTCCTTTGTTCGCCCTCGTTGCGCAGTAG TGCTAGCGGCTTCGCGGTTCGGTCCTCGCACCCG GCAGCCGCCACTGGTGCTGAGCTGCTAGGAAGCC CCTATCGCCGAGCTCGTTGGAGCTTGAACCCATTG TCACCCCTCCGACTCACCGGCCCAAAAAAAAAAAA ACATGGTTGAAGCAGATCGCCCAGGAAAGCTCTTC ATTGGTGGGCTTAATACGGAAACAAATGAGAAAGC TCTTGAAGCAGTATTTGGCAAATATGGACGAATAG TGGAAGTACTCTTGATGAAAGACCGTGAAACCAAC AAATCAAGAGGATTTGCTTTTGTCACCTTTGAAAGC CCAGCAGACGCTAAGGATGCAGCCAGAGACATGA | 4 | DHSQ* |

| SEQ ID | identifier_position | position | modified_RNA | PAP length | PAP |
|---|---|---|---|---|---|
| | | | ATGGAAAGTCATTAGATGGAAAAGCCATCAAGGTG GAACAAGCCACCAAACCATCATTTGAAAGTGGTAG ACGTGGACCGCCTCCACCTCCAAGAAGTAGAGGC CCTCCAAGAGGTCTTAGAGGTGGAAGAGGAGGAA GTGGAGGAACCAGGGGACCTCCCTCACGGGGAG GACACATGGATGACGGTGGATATTCCATGAATTTT AACATGAGTTCTTCCAGGGACCACTCCCAGTAAAA AGAGGACCACCACCAAGAAGTGGGGGTCCTCCTC CTAAGAGATCTGCACCTTCAGGACCAGTTCGCAGT AGCAGTGGAATGGGAGGAAGAGCTCCTGTATCAC GTGGAAGAGATAGTTATGGAGGTCCACCTCGAAG GGAACCGCTGCCCTCTCGTAGAGATGTTTATTTGT CCCCAAGAGATGATGGGTATTCTACTAAAGACAGC TATTCAAGCAGAGATTACCCAAGTTCTCGTGATAC TAGAGATTATGCACCACCACCACGAGATTATACTT ACCGTGATTATGGTCATTCCAGTTCACGTGATGAC TATCCATCAAGAGGATATAGCGATAGAGATGGATA TGGTCGTGATCGTGACTA | | |
| 986 | NM_0021 56.4_186 | 186 | ACGCGGTGCCGCGGGGCGGGAGTAGAGGCGGAG GGAGGGGACACGGGCTCATTGCGGTGTGCGCCCT GCACTCTGTCCCTCACTCGCCGCCGACGACCTGT CTCGCCGAGCGCACGCCTTGCCGCCGCCCCGCA GAAATGCTTCGGTTACCCACAGTCTTTCGCCAGAT GAGACCGGTGTCCAGGTACTGGCTCCTCATCTCA CTCGGGCTTATGCCAAAGATGTAAAATTTGGTGCA GATGCCCGAGCCTTAATGCTTCAAGGTGTAGACCT TTTAGCCGATGCTGTGGCCGTTACAATGGGGCCAA AGGGAAGAACAGTGATTATTGAGCAGAGTTGGGG AAGTCCCAAAGTAACAAAAGATGGTGTGACTGTTG CAAAGTCAATTGACTTAAAAGATAAATACAAAAACA TTGGAGCTAAACTTGTTCAAGATGTTGCCAATAAC ACAAATGAAGAAGCTGGGGATGGCACTACCACTG CTACTGTACTGGCACGCTCTATAGCCAAGGAAGG CTTCGAGAAGATTAGCAAAGGTGCTAATCCAGTGG AAATCAGGAGAGGTGTGATGTTAGCTGTTGATGCT GTAATTGCTGAACTTAAAAAGCAGTCTAAACCTGT GACCACCCCTGAAGAAATTGCACAGGTTGCTACGA TTTCTGCAAACGGAGACAAAGAAATTGGCAATATC ATCTCTGATGCAATGAAAAAAGTTGGAAGAAAGGG TGTCATCACAGTAAAGGATGGAAAAACACTGAATG ATGAATTAGAAATTATTGAAGGCATGAAGTTTGATC GAGGCTATATTTCTCCATACTTTATTAATACATCAA AAGGTCAGAAATGTGAATTCCAGGATGCCTATGTT CTGTTGAGTGAAAAGAAAATTTCTAGTATCCAGTC CATTGTACCTGCTCTTGAAATTGCCAATGCTCACC GTAAGCCTTTGGTCATAATCGCTGAAGATGTTGAT GGAGAAGCTCTAAGTACACTCGTCTTGAATAGGCT AAAGGTTGGTCTTCAG | 13 | YWLLISLGL MPKM* |
| 987 | NM_0021 56.4_233 | 233 | ACGCGGTGCCGCGGGGCGGGAGTAGAGGCGGAG GGAGGGGACACGGGCTCATTGCGGTGTGCGCCCT GCACTCTGTCCCTCACTCGCCGCCGACGACCTGT CTCGCCGAGCGCACGCCTTGCCGCCGCCCCGCA GAAATGCTTCGGTTACCCACAGTCTTTCGCCAGAT GAGACCGGTGTCCAGGGTACTGGCTCCTCATCTC ACTCGGGCTTATGCCAAAGATGTAAAATTTGGTGCA GATGCCCGAGCCTTAATGCTTCAAGGTGTAGACCT TTTAGCCGATGCTGTGGCCGTTACAATGGGGCCAA AGGGAAGAACAGTGATTATTGAGCAGAGTTGGGG AAGTCCCAAAGTAACAAAAGATGGTGTGACTGTTG CAAAGTCAATTGACTTAAAAGATAAATACAAAAACA TTGGAGCTAAACTTGTTCAAGATGTTGCCAATAAC ACAAATGAAGAAGCTGGGGATGGCACTACCACTG CTACTGTACTGGCACGCTCTATAGCCAAGGAAGG CTTCGAGAAGATTAGCAAAGGTGCTAATCCAGTGG AAATCAGGAGAGGTGTGATGTTAGCTGTTGATGCT GTAATTGCTGAACTTAAAAAGCAGTCTAAACCTGT GACCACCCCTGAAGAAATTGCACAGGTTGCTACGA TTTCTGCAAACGGAGACAAAGAAATTGGCAATATC ATCTCTGATGCAATGAAAAAAGTTGGAAGAAAGGG TGTCATCACAGTAAAGGATGGAAAAACACTGAATG ATGAATTAGAAATTATTGAAGGCATGAAGTTTGATC GAGGCTATATTTCTCCATACTTTATTAATACATCAA AAGGTCAGAAATGTGAATTCCAGGATGCCTATGTT CTGTTGAGTGAAAAGAAAATTTCTAGTATCCAGTC CATTGTACCTGCTCTTGAAATTGCCAATGCTCACC GTAAGCCTTTGGTCATAATCGCTGAAGATGTTGAT | 7 | LVQMPEP* |

| SEQ ID | identifier_position | position | modified_RNA | PAP length | PAP |
|---|---|---|---|---|---|
| 988 | NM_0021 57.1_91 | 91 | GGAGAAGCTCTAAGTACACTCGTCTTGAATAGGCTAAAGGTTGGTCTTCAG GCTACACTAGAGCAGAGTACGAGTCTGAGGCGGA GGGAGTAATGGCAGGACAAGCGTTTAGAAAGTTTC TTCCACTCTTTGACCGAGTATGGTTGAAAGGAGTG CTGCTGAAACTGTAACCAAAGGAGGCATTATGCTT CCAGAAAAATCTCAAGGAAAAGTATTGCAAGCAAC AGTAGTCGCTGTTGGATCGGGTTCTAAAGGAAAG GGTGGAGAGATTCAACCAGTTAGCGTGAAAGTTG GAGATAAAGTTCTTCTCCCAGAATATGGAGGCACC AAAGTAGTTCTAGATGACAAGGATTATTTCCTATTT AGAGATGGTGACATTCTTGGAAAGTACGTAGACTG AAATAAGTCACTATTGAAATGGCATCAACATGATG CTGCCCATTCCACTCGAAGTTCTGAAATCTTTCGTCA TGTAAATAATTTCCATATTTCTCTTTTATAATAAACT AATGATAACTAATGACATCCAGTGTCTCCAAAATTG TTTCCTTGTACTGATATAAACACTTCCAAATAAAAA TATGTAAAT | 9 | WLKGVLLKL* |
| 989 | NM_0022 12.2_119 | 119 | AACGGAAACCTTTTTAGGGAGTCCAAGGTACAGTC GCCGCGTGCGGAGCTTGTTACTGGTTACTTGGCC TCATGGCGGTCCGAGCTTCGTTCGAGAACAACTGT GAGATCGGCTGCTTGCCAAGCTCACCAACACCTA CTGTCTGGTAGCGATCGGAGGCTCAGAGAACTTCT ACAGTGTGTTCGAGGGCGAGCTCTCCGATACCAT CCCCGTGGTGCACGCGTCTATCGCCGGCTGCCGC ATCATCGGGCGCATGTGTGTGGGGAACAGGCACG GTCTCCTGGTACCCAACAATACCACCGACCAGGA GCTGCAACACATTCGCAACAGCCTCCCAGACACA GTGCAGATTAGGCGGGTGGAGGAGCGGCTCTCAG CCTTGGGCAATGTCACCACCTGCAATGACTACGTG GCCTTGGTCCACCCAGACTTGGACAGGGAGACAG AAGAAATTCTGGCAGATGTGCTCAAGGTGGAAGTC TTCAGACAGACAGTGGCCGACCAGGTGCTAGTAG GAAGCTACTGTGTCTTCAGCAATCAGGGAGGGCT GGTGCATCCCAAGACTTCAATTGAAGACCAGGATG AGCTGTCCTCTCTTCTTCAAGTCCCCCTTGTGGCG GGGACTGTGAACCGAGGCAGTGAGGTGATTGCTG CTGGGATGGTGGTGAATGACTGGTGTGCCTTCTGT GGCCTGGACACAACCAGCACAGAGCTGTCAGTGG TGGAGAGTGTCTTCAAGCTGAATGAAGCCCAGCCT AGCACCATTGCCACCAGCATGCGGGATTCCCTCAT TGACAGCCTCACCTGAGTCACCTTCCAAGTTGTTC CATGGGCTCCTGGCTCTGGACTGTGGCCAACCTT CTCCACATTCCGCCCAATCTGTACCGGATGCTGGC AGGGAGGTGGCAGAGAGCTCACTGGGACTGAGG GGCTGGGCACCCAACCCTTTTCCACCTGTGCTTAT CGCCTGGATCTATCATTACTGCAAAAACCTGCTCT GTTGTGCTGGCTGGCAGGCCCTGTG | 10 | LPSSPTPTVW* |
| 990 | NM_0022 65.4_1506 | 1506 | CTCCCTCGCTCCCTCCCTGCGCGCCGCCTCTCAC TCACAGCCTCCCTTCCTTCTTTCTCCCTCCGCCTC CCGAGCACCAGCGCGCTCTGAGCTGCCCCCAGG GTCCCTCCCCCGCCGCCAGCAGCCCATTTGGAGG GAGGAAGTAAGGGAAGAGGAGAGGAAGGGGAGC CGGACCGACTACCCAGACAGAGCCGGTGAATGGG TTTGTGGTGACCCCCGCCCCCCACCCCACCCTCC CTTCCCACCCGACCCCCAACCCCCATCCCCAGTTC GAGCCGCCGCCCGAAAGGCCGGGCCGTCGTCTT AGGAGGAGTCGCCGCCGCCGCCACCTCCGCCAT GGAGCTGATCACCATTCTCGAGAAGACCGTGTCTC CCGATCGGCTGGAGCTGGAAGCGGCGCAGAAGTT CCTGGAGCGTGCGGCCGTGGAGAACCTGCCCACT TTCCTTGTGGAACTGTCCAGAGTGCTGGCAAATCC AGGAAACAGTCAGGTTGCCAGAGTTGCAGCTGGT CTACAAATCAAGAACTCTTTGACATCTAAAGATCCA GATATCAAGGCACAATATCAGCAGAGGTGGCTTGC TATTGATGCTAATGCTCGACGAGAAGTCAAGAACT ATGTTTTGCAGACATTGGGTACAGAAACTTACCGG CCTAGTTCTGCCTCACAGTGTGTGGCTGGTATTGC TTGTGCAGAGATCCCAGTAAACCAGTGGCCAGAA CTCATTCCTCAGCTGGTGGCCAATGTCACAAACCC CAACAGCACAGAGCACATGAAGGAGTCGACATTG GAAGCCATCGGTTATATTTGCCAAGATATAGACCC AGAGCAGCTACAAGATAAATCCAATGAGATTCTGA CTGCCATAATCCAGGGGATGAGGAAAGAAGAGCC TAGTAATAATGTGAAGCTAGCTGCTACGAATGCAC TCCTGAACTCATTGGAGTTCACCAAAAGCAAACTTT | 15 | LVVSWKDQSPVSSNH* |

TABLE 3A-continued

| SEQ ID | identifier_position | position | modified_RNA | PAP length | PAP |
|---|---|---|---|---|---|
| 991 | NM_0022 65.4_1941 | 1941 | GATAAAGAGTCTGAAAGGCACTTTATTATGCAGGT<br>GGTCTGTGAAGCCACACAGTGTCCAG<br>CTCCCTCGCTCCCTCCCTGCGCGCCGCCTCTCAC<br>TCACAGCCTCCCTTCCTTCTTTCTCCCTCCGCCTC<br>CCGAGCACCAGCGCGCTCTGAGCTGCCCCCAGG<br>GTCCCTCCCCCGCCGCCAGCAGCCCATTTGGAGG<br>GAGGAAGTAAGGGAAGAGGAGAGGAAGGGGAGC<br>CGGACCGACTACCCAGACAGAGCCGGTGAATGGG<br>TTTGTGGTGACCCCCGCCCCCCACCCCACCCTCC<br>CTTCCCACCCGACCCCCAACCCCCATCCCCAGTTC<br>GAGCCGCCGCCCGAAAGGCCGGGCCGTCGTCTT<br>AGGAGGAGTCGCCGCCGCCGCCACCTCCGCCAT<br>GGAGCTGATCACCATTCTCGAGAAGACCGTGTCTC<br>CCGATCGGCTGGAGCTGGAAGCGGCGCAGAAGTT<br>CCTGGAGCGTGCGGCCGTGGAGAACCTGCCCACT<br>TTCCTTGTGGAACTGTCCAGAGTGCTGGCAAATCC<br>AGGAAACAGTCAGGTTGCCAGAGTTGCAGCTGGT<br>CTACAAATCAAGAACTCTTTGACATCTAAAGATCCA<br>GATATCAAGGCACAATATCAGCAGAGGTGGCTTGC<br>TATTGATGCTAATGCTCGACGAGAAGTCAAGAACT<br>ATGTTTTGCAGACATTGGGTACAGAAACTTACCGG<br>CCTAGTTCTGCCTCACAGTGTGTGGCTGGTATTGC<br>TTGTGCAGAGATCCCAGTAAACCAGTGGCCAGAA<br>CTCATTCCTCAGCTGGTGGCCAATGTCACAAACCC<br>CAACAGCACAGAGCACATGAAGGAGTCGACATTG<br>GAAGCCATCGGTTATATTTGCCAAGATATAGACCC<br>AGAGCAGCTACAAGATAAATCCAATGAGATTCTGA<br>CTGCCATAATCCAGGGGATGAGGAAAGAAGAGCC<br>TAGTAATAATGTGAAGCTAGCTGCTACGAATGCAC<br>TCCTGAACTCATTGGAGTTCACCAAAGCAAACTTT<br>GATAAAGAGTCTGAAAGGCACTTTATTATGCAGGT<br>GGTCTGTGAAGCCACACAGTGTCCAG | 1 | M* |
| 992 | NM_0022 65.4_2660 | 2660 | CTCCCTCGCTCCCTCCCTGCGCGCCGCCTCTCAC<br>TCACAGCCTCCCTTCCTTCTTTCTCCCTCCGCCTC<br>CCGAGCACCAGCGCGCTCTGAGCTGCCCCCAGG<br>GTCCCTCCCCCGCCGCCAGCAGCCCATTTGGAGG<br>GAGGAAGTAAGGGAAGAGGAGAGGAAGGGGAGC<br>CGGACCGACTACCCAGACAGAGCCGGTGAATGGG<br>TTTGTGGTGACCCCCGCCCCCCACCCCACCCTCC<br>CTTCCCACCCGACCCCCAACCCCCATCCCCAGTTC<br>GAGCCGCCGCCCGAAAGGCCGGGCCGTCGTCTT<br>AGGAGGAGTCGCCGCCGCCGCCACCTCCGCCAT<br>GGAGCTGATCACCATTCTCGAGAAGACCGTGTCTC<br>CCGATCGGCTGGAGCTGGAAGCGGCGCAGAAGTT<br>CCTGGAGCGTGCGGCCGTGGAGAACCTGCCCACT<br>TTCCTTGTGGAACTGTCCAGAGTGCTGGCAAATCC<br>AGGAAACAGTCAGGTTGCCAGAGTTGCAGCTGGT<br>CTACAAATCAAGAACTCTTTGACATCTAAAGATCCA<br>GATATCAAGGCACAATATCAGCAGAGGTGGCTTGC<br>TATTGATGCTAATGCTCGACGAGAAGTCAAGAACT<br>ATGTTTTGCAGACATTGGGTACAGAAACTTACCGG<br>CCTAGTTCTGCCTCACAGTGTGTGGCTGGTATTGC<br>TTGTGCAGAGATCCCAGTAAACCAGTGGCCAGAA<br>CTCATTCCTCAGCTGGTGGCCAATGTCACAAACCC<br>CAACAGCACAGAGCACATGAAGGAGTCGACATTG<br>GAAGCCATCGGTTATATTTGCCAAGATATAGACCC<br>AGAGCAGCTACAAGATAAATCCAATGAGATTCTGA<br>CTGCCATAATCCAGGGGATGAGGAAAGAAGAGCC<br>TAGTAATAATGTGAAGCTAGCTGCTACGAATGCAC<br>TCCTGAACTCATTGGAGTTCACCAAAGCAAACTTT<br>GATAAAGAGTCTGAAAGGCACTTTATTATGCAGGT<br>GGTCTGTGAAGCCACACAGTGTCCAG | 1 | D* |
| 993 | NM_0022 65.4_876 | 876 | CTCCCTCGCTCCCTCCCTGCGCGCCGCCTCTCAC<br>TCACAGCCTCCCTTCCTTCTTTCTCCCTCCGCCTC<br>CCGAGCACCAGCGCGCTCTGAGCTGCCCCCAGG<br>GTCCCTCCCCCGCCGCCAGCAGCCCATTTGGAGG<br>GAGGAAGTAAGGGAAGAGGAGAGGAAGGGGAGC<br>CGGACCGACTACCCAGACAGAGCCGGTGAATGGG<br>TTTGTGGTGACCCCCGCCCCCCACCCCACCCTCC<br>CTTCCCACCCGACCCCCAACCCCCATCCCCAGTTC<br>GAGCCGCCGCCCGAAAGGCCGGGCCGTCGTCTT<br>AGGAGGAGTCGCCGCCGCCGCCACCTCCGCCAT<br>GGAGCTGATCACCATTCTCGAGAAGACCGTGTCTC<br>CCGATCGGCTGGAGCTGGAAGCGGCGCAGAAGTT<br>CCTGGAGCGTGCGGCCGTGGAGAACCTGCCCACT<br>TTCCTTGTGGAACTGTCCAGAGTGCTGGCAAATCC<br>AGGAAACAGTCAGGTTGCCAGAGTTGCAGCTGGT | 0 | * |

TABLE 3A-continued

| SEQ ID | identifier_position | position | modified_RNA | PAP length | PAP |
|---|---|---|---|---|---|
| | | | CTACAAATCAAGAACTCTTTGACATCTAAAGATCCA GATATCAAGGCACAATATCAGCAGAGGTGGCTTGC TATTGATGCTAATGCTCGACGAGAAGTCAAGAACT ATGTTTTGCAGACATTGGGTACAGAAACTTACCGG CCTAGTTCTGCCTCACAGTGTGTGGCTGGTATTGC TTGTGCAGAGATCCCAGTAAACCAGTGGCCAGAA CTCATTCCTCAGCTGGTGGCCAATGTCACAAACCC CAACAGCACAGAGCACATGAAGGAGTCGACATTG GAAGCCATCGGTTATATTTGCCAAGATATAGACCC AGAGCAGCTACAAGATAAATCCAATGAGATTCTGA CTGCCATAATCCAGGGATGAGGAAAGAAGAGCCT AGTAATAATGTGAAGCTAGCTGCTACGAATGCACT CCTGAACTCATTGGAGTTCACCAAAGCAAACTTTG ATAAAGAGTCTGAAAGGCACTTTATTATGCAGGTG GTCTGTGAAGCCACACAGTGTCCAGA | | |
| 994 | NM_0022 66.2_347 | 347 | GCCACACGGTCTTTGAGCTGAGTCGAGGTGGACC CTTTGAACGCAGTCGCCCTACAGCCGCTGATTCCC CCCGCATCGCCTCCCGTGGAAGCCCAGGCCCGCT TCGCAGCTTTCTCCCTTTGTCTCATAACCATGTCCA CCAACGAGAATGCTAATACACCAGCTGCCCGTCTT CACAGATTCAAGAACAAGGGAAAAGACAGTACAGA AATGAGGCGTCGCAGAATAGAGGTCAATGTGGAG CTGAGGAAAGCTAAGAAGGATGACCAGATGCTGA AGAGGAGAAATGTAAGCTCATTTCCTGATGATGCT ACTTCTCCGCTGCAGGAAAACCGCAACAACCAGG CACTGTAAATTGGTCTGTTGATGACATTGTCAAAG GCATAAATAGCAGCAATGTGGAAAATCAGCTCCAA GCTACTCAAGCTGCCAGGAAACTACTTTCCAGAGA AAAACAGCCCCCATAGACAACATAATCCGGGCTG GTTTGATTCCGAAATTTGTGTCCTTCTTGGGCAGA ACTGATTGTAGTCCCATTCAGTTTGAATCTGCTTGG GCACTCACTAACATTGCTTCTGGGACATCAGAACA AACCAAGGCTGTGGTAGATGGAGGTGCCATCCCA GCATTCATTTCTCTGTTGGCATCTCCCCATGCTCA CATCAGTGAACAAGCTGTCTGGGCTCTAGGAAACA TTGCAGGTGATGGCTCAGTGTTCCGAGACTTGGTT ATTAAGTACGGTGCAGTTGACCCACTGTTGGCTCT CCTTGCAGTTCCTGATATGTCATCTTTAGCATGTG GCTACTTACGTAATCTTACCTGGACACTTTCTAATC TTTGCCGCAACAAGAATCCTGCACCCCCGATAGAT GCTGTTGAGCAGATTCTTCCTACCTTAGTTCGGCT CCTGCATCATGATGATCCAGAAGTATTAGCAGATA CCTGCTGGGCTATTTCCTACCTTACTGATGGTCCA AATGAACGAATTGGCATGGTGGTGAAAACAGGAGT TGTGCCCCAACT | 2 | AL* |
| 995 | NM_0022 66.2_465 | 465 | GCCACACGGTCTTTGAGCTGAGTCGAGGTGGACC CTTTGAACGCAGTCGCCCTACAGCCGCTGATTCCC CCCGCATCGCCTCCCGTGGAAGCCCAGGCCCGCT TCGCAGCTTTCTCCCTTTGTCTCATAACCATGTCCA CCAACGAGAATGCTAATACACCAGCTGCCCGTCTT CACAGATTCAAGAACAAGGGAAAAGACAGTACAGA AATGAGGCGTCGCAGAATAGAGGTCAATGTGGAG CTGAGGAAAGCTAAGAAGGATGACCAGATGCTGA AGAGGAGAAATGTAAGCTCATTTCCTGATGATGCT ACTTCTCCGCTGCAGGAAAACCGCAACAACCAGG GCACTGTAAATTGGTCTGTTGATGACATTGTCAAA GGCATAAATAGCAGCAATGTGGAAAATCAGCTCCA AGCTACTCAAGCTGCCAGGAAACTACTTTCCAGAG AAAAACAGCCCCCATAGACAACATAATCCGGGCTG GTTTGATTCCGAAATTTGTGTCCTTCTTGGGCAGA ACTGATTGTAGTCCCATTCAGTTTGAATCTGCTTGG GCACTCACTAACATTGCTTCTGGGACATCAGAACA AACCAAGGCTGTGGTAGATGGAGGTGCCATCCCA GCATTCATTTCTCTGTTGGCATCTCCCCATGCTCA CATCAGTGAACAAGCTGTCTGGGCTCTAGGAAACA TTGCAGGTGATGGCTCAGTGTTCCGAGACTTGGTT ATTAAGTACGGTGCAGTTGACCCACTGTTGGCTCT CCTTGCAGTTCCTGATATGTCATCTTTAGCATGTG GCTACTTACGTAATCTTACCTGGACACTTTCTAATC TTTGCCGCAACAAGAATCCTGCACCCCCGATAGAT GCTGTTGAGCAGATTCTTCCTACCTTAGTTCGGCT CCTGCATCATGATGATCCAGAAGTATTAGCAGATA CCTGCTGGGCTATTTCCTACCTTACTGATGGTCCA AATGAACGAATTGGCATGGTGGTGAAAACAGGAGT TGTGCCCCAACT | 0 | * |

TABLE 3A-continued

| SEQ ID | identifier_position | position | modified_RNA | PAP length | PAP |
|---|---|---|---|---|---|
| 996 | NM_0022 73.2_109 7 | 1097 | ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT GGGAGGCATCACCGCAGTTACGGTCAACCAGAGC CTGCTGAGCCCCCTTGTCCTGGAGGTGGACCCCA ACATCCAGGCCGTGCGCACCCAGGAGAAGGAGCA GATCAAGACCCTCAACAACAAGTTTGCCTCCTTCA TAGACAAGGTACGGTTCCTGGAGCAGCAGAACAA GATGCTGGAGACCAAGTGGAGCCTCCTGCAGCAG CAGAAGACGGCTCGAAGCAACATGGACAACATGT TCGAGAGCTACATCAACAACCTTAGGCGGCAGCT GGAGACTCTGGGCCAGGAGAAGCTGAAGCTGGAG GCGGAGCTTGGCAACATGCAGGGGCTGGTGGAG GACTTCAAGAACAAGTATGAGGATGAGATCAATAA GCGTACAGAGATGGAGAACGAATTTGTCCTCATCA AGAAGGATGTGGATGAAGCTTACATGAACAAGGTA GAGCTGGAGTCTCGCCTGGAAGGGCTGACCGACG AGATCAACTTCCTCAGGCAGCTATATGAAGAGGAG ATCCGGGAGCTGCAGTCCCAGATCTCGGACACAT CTGTGGTGCTGTCCATGGACAACAGCCGCTCCCT GGACATGGACAGCATCATTGCTGAGGTCAAGGCA CAGTACGAGGATATTGCCAACCGCAGCCGGGCTG AGGCTGAGAGCATGTACCAGATCAAGTATGAGGA GCTGCAGAGCCTGGCTGGGAAGCACGGGGATGA CCTGCGGCGCACAAAGACTGAGATCTCTGAGAT | 42 | LQMPSSVE SWPLRMP TPSCPSW RPPCSGPS RTWRGSC VSTRS* |
| 997 | NM_0022 73.2_117 3 | 1173 | ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT GGGAGGCATCACCGCAGTTACGGTCAACCAGAGC CTGCTGAGCCCCCTTGTCCTGGAGGTGGACCCCA ACATCCAGGCCGTGCGCACCCAGGAGAAGGAGCA GATCAAGACCCTCAACAACAAGTTTGCCTCCTTCA TAGACAAGGTACGGTTCCTGGAGCAGCAGAACAA GATGCTGGAGACCAAGTGGAGCCTCCTGCAGCAG CAGAAGACGGCTCGAAGCAACATGGACAACATGT TCGAGAGCTACATCAACAACCTTAGGCGGCAGCT GGAGACTCTGGGCCAGGAGAAGCTGAAGCTGGAG GCGGAGCTTGGCAACATGCAGGGGCTGGTGGAG GACTTCAAGAACAAGTATGAGGATGAGATCAATAA GCGTACAGAGATGGAGAACGAATTTGTCCTCATCA AGAAGGATGTGGATGAAGCTTACATGAACAAGGTA GAGCTGGAGTCTCGCCTGGAAGGGCTGACCGACG AGATCAACTTCCTCAGGCAGCTATATGAAGAGGAG ATCCGGGAGCTGCAGTCCCAGATCTCGGACACAT CTGTGGTGCTGTCCATGGACAACAGCCGCTCCCT GGACATGGACAGCATCATTGCTGAGGTCAAGGCA CAGTACGAGGATATTGCCAACCGCAGCCGGGCTG AGGCTGAGAGCATGTACCAGATCAAGTATGAGGA GCTGCAGAGCCTGGCTGGGAAGCACGGGGATGA CCTGCGGCGCACAAAGACTGAGATCTCTGAGAT | 17 | CSGPSRT WRGSCVS TRS* |
| 998 | NM_0022 73.2_118 4 | 1184 | ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT GGGAGGCATCACCGCAGTTACGGTCAACCAGAGC CTGCTGAGCCCCCTTGTCCTGGAGGTGGACCCCA ACATCCAGGCCGTGCGCACCCAGGAGAAGGAGCA GATCAAGACCCTCAACAACAAGTTTGCCTCCTTCA TAGACAAGGTACGGTTCCTGGAGCAGCAGAACAA GATGCTGGAGACCAAGTGGAGCCTCCTGCAGCAG CAGAAGACGGCTCGAAGCAACATGGACAACATGT TCGAGAGCTACATCAACAACCTTAGGCGGCAGCT GGAGACTCTGGGCCAGGAGAAGCTGAAGCTGGAG | 13 | SRTWRGS CVSTRS* |

TABLE 3A-continued

| SEQ ID | identifier_position | position | modified_RNA | PAP length | PAP |
|---|---|---|---|---|---|
| | | | GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT<br>GGACATGGACAGCATCATTGCTGAGGTCAAGGCA<br>CAGTACGAGGATATTGCCAACCGCAGCCGGGCTG<br>AGGCTGAGAGCATGTACCAGATCAAGTATGAGGA<br>GCTGCAGAGCCTGGCTGGGAAGCACGGGGATGA<br>CCTGCGGCGCACAAAGACTGAGATCTCTGAGAT | | |
| 999 | NM_0022<br>73.2_124<br>5 | 1245 | ATTCCTGAGAGCTCTCCTCACCAAGAAGCAGCTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT<br>GGACATGGACAGCATCATTGCTGAGGTCAAGGCA<br>CAGTACGAGGATATTGCCAACCGCAGCCGGGCTG<br>AGGCTGAGAGCATGTACCAGATCAAGTATGAGGA<br>GCTGCAGAGCCTGGCTGGGAAGCACGGGGATGA<br>CCTGCGGCGCACAAAGACTGAGATCTCTGAGAT | 25 | WTSRSPPT<br>GSCWRAR<br>RAGWSLG<br>CRT* |
| 1000 | NM_0022<br>73.2_137<br>3 | 1373 | ATTCCTGAGAGCTCTCCTCACCAAGAAGCAGCTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT<br>GGACATGGACAGCATCATTGCTGAGGTCAAGGCA<br>CAGTACGAGGATATTGCCAACCGCAGCCGGGCTG<br>AGGCTGAGAGCATGTACCAGATCAAGTATGAGGA<br>GCTGCAGAGCCTGGCTGGGAAGCACGGGGATGA<br>CCTGCGGCGCACAAAGACTGAGATCTCTGAGAT | 36 | MGASQAP<br>ASATAWAP<br>ALALARAP<br>APSAAPAP<br>PGPWL* |
| 1001 | NM_0022<br>73.2_1398 | 1398 | ATTCCTGAGAGCTCTCCTCACCAAGAAGCAGCTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC | 28 | SATAWAPA<br>LALARAPA<br>PSAAPAPP<br>GPWL* |

TABLE 3A-continued

| SEQ ID | identifier_position | position | modified_RNA | PAP length | PAP |
|---|---|---|---|---|---|
| | | | TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT<br>GGACATGGACAGCATCATTGCTGAGGTCAAGGCA<br>CAGTACGAGGATATTGCCAACCGCAGCCGGGCTG<br>AGGCTGAGAGCATGTACCAGATCAAGTATGAGGA<br>GCTGCAGAGCCTGGCTGGGAAGCACGGGGATGA<br>CCTGCGGCGCACAAAGACTGAGATCTCTGAGAT | | |
| 1002 | NM_0022 73.2_1473 | 1473 | ATTCCTGAGAGCTCTCCTCACCAAGAAGCAGCTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT<br>GGACATGGACAGCATCATTGCTGAGGTCAAGGCA<br>CAGTACGAGGATATTGCCAACCGCAGCCGGGCTG<br>AGGCTGAGAGCATGTACCAGATCAAGTATGAGGA<br>GCTGCAGAGCCTGGCTGGGAAGCACGGGGATGA<br>CCTGCGGCGCACAAAGACTGAGATCTCTGAGAT | 3 | PWL* |
| 1003 | NM_0022 73.2_401 | 401 | ATTCCTGAGAGCTCTCCTCACCAAGAAGCAGCTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCAT<br>AGACAAGGTACGGTTCCTGGAGCAGCAGAACAAG<br>ATGCTGGAGACCAAGTGGAGCCTCCTGCAGCAGC<br>AGAAGACGGCTCGAAGCAACATGGACAACATGTT<br>CGAGAGCTACATCAACAACCTTAGGCGGCAGCTG<br>GAGACTCTGGGCCAGGAGAAGCTGAAGCTGGAGG<br>CGGAGCTTGGCAACATGCAGGGGCTGGTGGAGG<br>ACTTCAAGAACAAGTATGAGGATGAGATCAATAAG<br>CGTACAGAGATGGAGAACGAATTTGTCCTCATCAA<br>GAAGGATGTGGATGAAGCTTACATGAACAAGGTAG | 4 | LPPS* |

TABLE 3A-continued

| SEQ ID | identifier_position | position | modified_RNA | PAP length | PAP |
|---|---|---|---|---|---|
| 1004 | NM_0022 73.2_490 | 490 | AGCTGGAGTCTCGCCTGGAAGGGCTGACCGACGA GATCAACTTCCTCAGGCAGCTATATGAAGAGGAGA TCCGGGAGCTGCAGTCCCAGATCTCGGACACATC TGTGGTGCTGTCCATGGACAACAGCCGCTCCCTG GACATGGACAGCATCATTGCTGAGGTCAAGGCAC AGTACGAGGATATTGCCAACCGCAGCCGGGCTGA GGCTGAGAGCATGTACCAGATCAAGTATGAGGAG CTGCAGAGCCTGGCTGGGAAGCACGGGGATGAC CTGCGGCGCACAAAGACTGAGATCTCTGAGATG ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT GGGAGGCATCACCGCAGTTACGGTCAACCAGAGC CTGCTGAGCCCCCTTGTCCTGGAGGTGGACCCCA ACATCCAGGCCGTGCGCACCCAGGAGAAGGAGCA GATCAAGACCCTCAACAACAAGTTTGCCTCCTTCA TAGACAAGGTACGGTTCCTGGAGCAGCAGAACAA GATGCTGGAGACCAAGTGGAGCCTCCTGCAGCAG CAGAAGACGGTCGAAGCAACATGGACAACATGTT CGAGAGCTACATCAACAACCTTAGGCGGCAGCTG GAGACTCTGGGCCAGGAGAAGCTGAAGCTGGAGG CGGAGCTTGGCAACATGCAGGGGCTGGTGGAGG ACTTCAAGAACAAGTATGAGGATGAGATCAATAAG CGTACAGAGATGGAGAACGAATTTGTCCTCATCAA GAAGGATGTGGATGAAGCTTACATGAACAAGGTAG AGCTGGAGTCTCGCCTGGAAGGGCTGACCGACGA GATCAACTTCCTCAGGCAGCTATATGAAGAGGAGA TCCGGGAGCTGCAGTCCCAGATCTCGGACACATC TGTGGTGCTGTCCATGGACAACAGCCGCTCCCTG GACATGGACAGCATCATTGCTGAGGTCAAGGCAC AGTACGAGGATATTGCCAACCGCAGCCGGGCTGA GGCTGAGAGCATGTACCAGATCAAGTATGAGGAG CTGCAGAGCCTGGCTGGGAAGCACGGGGATGAC CTGCGGCGCACAAAGACTGAGATCTCTGAGATG | 27 | VEATWTTC SRATSTTL GGSWRLW ARRS* |
| 1005 | NM_0022 73.2_590 | 590 | ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT GGGAGGCATCACCGCAGTTACGGTCAACCAGAGC CTGCTGAGCCCCCTTGTCCTGGAGGTGGACCCCA ACATCCAGGCCGTGCGCACCCAGGAGAAGGAGCA GATCAAGACCCTCAACAACAAGTTTGCCTCCTTCA TAGACAAGGTACGGTTCCTGGAGCAGCAGAACAA GATGCTGGAGACCAAGTGGAGCCTCCTGCAGCAG CAGAAGACGGTCGAAGCAACATGGACAACATGT TCGAGAGCTACATCAACAACCTTAGGCGGCAGCT GGAGACTCTGGGCCAGGAGAAGCTGAAGCTGGAG GCGGAGCTGGCAACATGCAGGGGCTGGTGGAGG ACTTCAAGAACAAGTATGAGGATGAGATCAATAAG CGTACAGAGATGGAGAACGAATTTGTCCTCATCAA GAAGGATGTGGATGAAGCTTACATGAACAAGGTAG AGCTGGAGTCTCGCCTGGAAGGGCTGACCGACGA GATCAACTTCCTCAGGCAGCTATATGAAGAGGAGA TCCGGGAGCTGCAGTCCCAGATCTCGGACACATC TGTGGTGCTGTCCATGGACAACAGCCGCTCCCTG GACATGGACAGCATCATTGCTGAGGTCAAGGCAC AGTACGAGGATATTGCCAACCGCAGCCGGGCTGA GGCTGAGAGCATGTACCAGATCAAGTATGAGGAG CTGCAGAGCCTGGCTGGGAAGCACGGGGATGAC CTGCGGCGCACAAAGACTGAGATCTCTGAGATG | 39 | ATCRGWW RTSRTSMR MRS SVQR WRTNLSSS RRMWMKL T* |
| 1006 | NM_0022 73.2_605 | 605 | ATTCCTGAGAGCTCTCCTCACCAAGAAGCAGCTTC TCCGCTCCTTCTAGGATCTCCGCCTGGTTCGGCCC GCCTGCCTCCACTCCTGCCTCTACCATGTCCATCA GGGTGACCCAGAAGTCCTACAAGGTGTCCACCTC TGGCCCCCGGGCCTTCAGCAGCCGCTCCTACACG AGTGGGCCCGGTTCCCGCATCAGCTCCTCGAGCT TCTCCCGAGTGGGCAGCAGCAACTTTCGCGGTGG CCTGGGCGGCGGCTATGGTGGGGCCAGCGGCAT | 34 | WWRTSRT SMRMRSIS VQRWRTN LSSSRRM WMKLT* |

TABLE 3A-continued

| SEQ ID | identifier_position | position | modified_RNA | PAP length | PAP |
|---|---|---|---|---|---|
| | | | GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGCTGGTGGAGG<br>ACTTCAAGAACAAGTATGAGGATGAGATCAATAAG<br>CGTACAGAGATGGAGAACGAATTTGTCCTCATCAA<br>GAAGGATGTGGATGAAGCTTACATGAACAAGGTAG<br>AGCTGGAGTCTCGCCTGGAAGGGCTGACCGACGA<br>GATCAACTTCCTCAGGCAGCTATATGAAGAGGAGA<br>TCCGGGAGCTGCAGTCCCAGATCTCGGACACATC<br>TGTGGTGCTGTCCATGGACAACAGCCGCTCCCTG<br>GACATGGACAGCATCATTGCTGAGGTCAAGGCAC<br>AGTACGAGGATATTGCCAACCGCAGCCGGGCTGA<br>GGCTGAGAGCATGTACCAGATCAAGTATGAGGAG<br>CTGCAGAGCCTGGCTGGGAAGCACGGGGATGAC<br>CTGCGGCGCACAAAGACTGAGATCTCTGAGATG | | |
| 1007 | NM_0022<br>73.2_674 | 674 | ATTCCTGAGAGCTCTCCTCACCAAGAAGCAGTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCAA<br>GAAGGATGTGGATGAAGCTTACATGAACAAGGTAG<br>AGCTGGAGTCTCGCCTGGAAGGGCTGACCGACGA<br>GATCAACTTCCTCAGGCAGCTATATGAAGAGGAGA<br>TCCGGGAGCTGCAGTCCCAGATCTCGGACACATC<br>TGTGGTGCTGTCCATGGACAACAGCCGCTCCCTG<br>GACATGGACAGCATCATTGCTGAGGTCAAGGCAC<br>AGTACGAGGATATTGCCAACCGCAGCCGGGCTGA<br>GGCTGAGAGCATGTACCAGATCAAGTATGAGGAG<br>CTGCAGAGCCTGGCTGGGAAGCACGGGGATGAC<br>CTGCGGCGCACAAAGACTGAGATCTCTGAGATG | 12 | LSSSRRM<br>WMKLT* |
| 1008 | NM_0022<br>73.2_918 | 918 | ATTCCTGAGAGCTCTCCTCACCAAGAAGCAGTTC<br>TCCGCTCCTTCTAGGATCTCCGCCTGGTTCGGCCC<br>GCCTGCCTCCACTCCTGCCTCTACCATGTCCATCA<br>GGGTGACCCAGAAGTCCTACAAGGTGTCCACCTC<br>TGGCCCCCGGGCCTTCAGCAGCCGCTCCTACACG<br>AGTGGGCCCGGTTCCCGCATCAGCTCCTCGAGCT<br>TCTCCCGAGTGGGCAGCAGCAACTTTCGCGGTGG<br>CCTGGGCGGCGGCTATGGTGGGGCCAGCGGCAT<br>GGGAGGCATCACCGCAGTTACGGTCAACCAGAGC<br>CTGCTGAGCCCCCTTGTCCTGGAGGTGGACCCCA<br>ACATCCAGGCCGTGCGCACCCAGGAGAAGGAGCA<br>GATCAAGACCCTCAACAACAAGTTTGCCTCCTTCA<br>TAGACAAGGTACGGTTCCTGGAGCAGCAGAACAA<br>GATGCTGGAGACCAAGTGGAGCCTCCTGCAGCAG<br>CAGAAGACGGCTCGAAGCAACATGGACAACATGT<br>TCGAGAGCTACATCAACAACCTTAGGCGGCAGCT<br>GGAGACTCTGGGCCAGGAGAAGCTGAAGCTGGAG<br>GCGGAGCTTGGCAACATGCAGGGGCTGGTGGAG<br>GACTTCAAGAACAAGTATGAGGATGAGATCAATAA<br>GCGTACAGAGATGGAGAACGAATTTGTCCTCATCA<br>AGAAGGATGTGGATGAAGCTTACATGAACAAGGTA<br>GAGCTGGAGTCTCGCCTGGAAGGGCTGACCGACG<br>AGATCAACTTCCTCAGGCAGCTATATGAAGAGGAG<br>ATCCGGGAGCTGCAGTCCCAGATCTCGGACACAT<br>CTGTGGTGCTGTCCATGGACAACAGCCGCTCCCT | 35 | GLRLRACT<br>RSSMRSC<br>RAWLGST<br>GMTCGAQ<br>RLRSLR* |

TABLE 3A-continued

| SEQ ID | identifier_ position | position | modified_RNA | PAP length | PAP |
|---|---|---|---|---|---|
| | | | GGACATGGACAGCATCATTGCTGAGGTCAAGGCA CAGTACGAGGATATTGCCAACCGCAGCGGGCTGA GGCTGAGAGCATGTACCAGATCAAGTATGAGGAG CTGCAGAGCCTGGCTGGGAAGCACGGGGATGAC CTGCGGCGCACAAAGACTGAGATCTCTGAGATG ATCCGGGAGCTGCAGTCCCAGATCTCGGACACAT CTGTGGTGCTGTCCATGGACAACAGCCGCTCCCT GGACATGGACAGCATCATTGCTGAGGTCAAGGCA CAGTACGAGGATATTGCCAACCGCAGCGGGCTGA GGCTGAGAGCATGTACCAGATCAAGTATGAGGAG CTGCAGAGCCTGGCTGGGAAGCACGGGGATGAC CTGCGGCGCACAAAGACTGAGATCTCTGAGATG | | |
| 1009 | NM_0022 76.4_454 | 454 | AGATATCCGCCCCTGACACCATTCCTCCCTTCCCC CCTCCACCGGCCGCGGGCATAAAAGGCGCCAGGT GAGGGCCTCGCCGCTCCTCCCGCGAATCGCAGCT TCTGAGACCAGGGTTGCTCCGTCCGTGCTCCGCC TCGCCATGACTTCCTACAGCTATCGCCAGTCGTCG GCCACGTCGTCCTTCGGAGGCCTGGGCGGCGGC TCCGTGCGTTTTGGGCCGGGGGTCGCCTTTCGCG CGCCCAGCATTCACGGGGGCTCCGGCGGCCGCG GCGTATCCGTGTCCTCCGCCCGCTTTGTGTCCTCG TCCTCCTCGGGGGCCTACGGCGGCGGCTACGGC GGCGTCCTGACCGCGTCCGACGGGCTGCTGGCG GGCAACGAGAAGCTAACCATGCAGAACCTCAACG ACCGCCTGGCCTCCTACCTGGACAAGGTGCGCGC CCTGGAGGCGGCAACGGCGAGCTAGAGGTGAAG ATCCGCGACTGGTACCAGAAGCAGGGGCCTGGGC CCTCCCGCGACTACAGCCACTACTACACGACCATC CAGGACCTGCGGGACAAGATTCTTGGTGCCACCA TTGAGAACTCCAGGATTGTCCTGCAGATCGACAAT GCCCGTCTGGCTGCAGATGACTTCCGAACCAAGTT TGAGACGGAACAGGCTCTGCGCATGAGCGTGGAG GCCGACATCAACGGCCTGCGCAGGGTGCTGGATG AGCTGACCCTGGCCAGGACCGACCTGGAGATGCA GATCGAAGGCCTGAAGGAAGAGCTGGCCTACCTG AAGAAGAACCATGAGGAGGAAATCAGTACGCTGA GGGGCCAAGTGGGAGGCCAGGTCAGTGTGGAGG TGGATTCCGCTCCGGGCACCGATCTCGCCAAGAT CCTGAGTGACATGCGAAGCCAATATGAGGTCATG GCCGAGCAGAACCGGAAGGATGCTGAAGCCTGGT TCACCAGCCGGACTGAAGAATTGAACCGGGAGGT CGCTGGCCACACGGAGCAGCTCCAGATGAGCAGG TCCG | 3 | TAS* |
| 1010 | NM_0022 76.4_698 | 698 | AGATATCCGCCCCTGACACCATTCCTCCCTTCCCC CCTCCACCGGCCGCGGGCATAAAAGGCGCCAGGT GAGGGCCTCGCCGCTCCTCCCGCGAATCGCAGCT TCTGAGACCAGGGTTGCTCCGTCCGTGCTCCGCC TCGCCATGACTTCCTACAGCTATCGCCAGTCGTCG GCCACGTCGTCCTTCGGAGGCCTGGGCGGCGGC TCCGTGCGTTTTGGGCCGGGGGTCGCCTTTCGCG CGCCCAGCATTCACGGGGGCTCCGGCGGCCGCG GCGTATCCGTGTCCTCCGCCCGCTTTGTGTCCTCG TCCTCCTCGGGGGCCTACGGCGGCGGCTACGGC GGCGTCCTGACCGCGTCCGACGGGCTGCTGGCG GGCAACGAGAAGCTAACCATGCAGAACCTCAACG ACCGCCTGGCCTCCTACCTGGACAAGGTGCGCGC CCTGGAGGCGGCCAACGGCGAGCTAGAGGTGAA GATCCGCGACTGGTACCAGAAGCAGGGGCCTGG GCCCTCCCGCGACTACAGCCACTACTACACGACC ATCCAGGACCTGCGGGACAAGATTCTTGGTGCCA CCATTGAGAACTCCAGGATTGTCCTGCAGATCGAC AATGCCCGTCTGGCTGCAGATGACTTCCGAACCAA GTTTGAGACGGAACAGGCTCTGCGCATGAGCGTG GAGGCCGACATCAACGGCTGCGCAGGGTGCTGG ATGAGCTGACCCTGGCCAGGACCGACCTGGAGAT GCAGATCGAAGGCCTGAAGGAAGAGCTGGCCTAC CTGAAGAAGAACCATGAGGAGGAAATCAGTACGC TGAGGGGCCAAGTGGGAGGCCAGGTCAGTGTGG AGGTGGATTCCGCTCCGGGCACCGATCTCGCCAA GATCCTGAGTGACATGCGAAGCCAATATGAGGTCA TGGCCGAGCAGAACCGGAAGGATGCTGAAGCCTG GTTCACCAGCCGGACTGAAGAATTGAACCGGGAG GTCGCTGGCCACACGGAGCAGCTCCAGATGAGCA GGTCCG | 7 | CAGCWMS* |
| 1011 | NM_0022 95.4_100 | 100 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTGATGT | 4 | MSCK* |

TABLE 3A-continued

| SEQ ID | identifier_ position | position | modified_RNA | PAP length | PAP |
|---|---|---|---|---|---|
| | | | CCTGCAAATGAAGGAGGAGGATGTCCTTAAGTTCC<br>TTGCAGCAGGAACCCACTTAGGTGGCACCAATCTT<br>GACTTCCAGATGGAACAGTACATCTATAAAAGGAA<br>AAGTGATGGCATCTATATCATAAATCTCAAGAGGA<br>CCTGGGAGAAGCTTCTGCTGGCAGCTCGTGCAAT<br>TGTTGCCATTGAAAACCCTGCTGATGTCAGTGTTA<br>TATCCTCCAGGAATACTGGCCAGAGGGCTGTGCT<br>GAAGTTTGCTGCTGCCACTGGAGCCACTCCAATTG<br>CTGGCCGCTTCACTCCTGGAACCTTCACTAACCAG<br>ATCCAGGCAGCCTTCCGGGAGCCACGGCTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA<br>AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | | |
| 1012 | NM_0022<br>95.4_206 | 206 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGA~GGAACAGTACATCTATAAAGGAA<br>AAGTGATGGCATCTATATCATAAATCTCAAGAGGA<br>CCTGGGAGAAGCTTCTGCTGGCAGCTCGTGCAAT<br>TGTTGCCATTGAAAACCCTGCTGATGTCAGTGTTA<br>TATCCTCCAGGAATACTGGCCAGAGGGCTGTGCT<br>GAAGTTTGCTGCTGCCACTGGAGCCACTCCAATTG<br>CTGGCCGCTTCACTCCTGGAACCTTCACTAACCAG<br>ATCCAGGCAGCCTTCCGGGAGCCACGGCTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA<br>AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | 8 | GKVMASIS* |
| 1013 | NM_0022<br>95.4_280 | 280 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAGGA<br>AAAGTGATGGCATCTATATCATAAATCTCAAGAGG<br>ACCTGGGAGAAGCTTCTGCTGGCAGCTCGTGCAA<br>TGTTGCCATTGAAAACCCTGCTGATGTCAGTGTTA<br>TATCCTCCAGGAATACTGGCCAGAGGGCTGTGCT<br>GAAGTTTGCTGCTGCCACTGGAGCCACTCCAATTG<br>CTGGCCGCTTCACTCCTGGAACCTTCACTAACCAG<br>ATCCAGGCAGCCTTCCGGGAGCCACGGCTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT | 23 | MLPLKTLL<br>MSVLYPPG<br>ILARGLC* |

TABLE 3A-continued

| SEQ ID | identifier_position | position | modified_RNA | PAP length | PAP |
|---|---|---|---|---|---|
| | | | ACAGAGATCCTGAAGAGATTGAAAAAGAAGAGCAG GCTGCTGCTGAGAAGGCAGTGACCAAGGAGGAAT TTCAGGGTGAATGGACTGCTCCCGCTCCTGAGTTC ACTGCTACTCAGCCTGAGGTTGCAGACTGGTCTGA AGGTGTACAGGTGCCCTCTGTGCCTATTCAGCAAT TCCCTACTGAAGACTGGAGCGCTCAGCCTGCCAC GGAAGACTGGTCTGCAGCTCCCACTGCTCAGGCC ACTGAATGGGTAGGAGCAACCACTGACTGGTCTTA AGCTGTTCTTGCATAGGCTCTTAAGCAGCATGGAA AAATGGTTGATGGAAAAT | | |
| 1014 | NM_0022 95.4_283 | 283 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTGCCATTGAAAACCCTGCTGATGTCAGTGTTA TATCCTCCAGGAATACTGGCCAGAGGGCTGTGCT GAAGTTTGCTGCTGCCACTGGAGCCACTCCAATTG CTGGCCGCTTCACTCCTGGAACCTTCACTAACCAG ATCCAGGCAGCCTTCCGGGAGCCACGGCTTCTTG TGGTTACTGACCCCAGGGCTGACCACCAGCCTCT CACGGAGGCATCTTATGTTAACCTACCTACCATTG CGCTGTGTAACACAGATTCTCCTCTGCGCTATGTG GACATTGCCATCCCATGCAACAACAAGGGAGCTCA CTCAGTGGGTTTGATGTGGTGGATGCTGGCTCGG GAAGTTCTGCGCATGCGTGGCACCATTTCCCGTGA ACACCCATGGGAGGTCATGCCTGATCTGTACTTCT ACAGAGATCCTGAAGAGATTGAAAAAGAAGAGCAG GCTGCTGCTGAGAAGGCAGTGACCAAGGAGGAAT TTCAGGGTGAATGGACTGCTCCCGCTCCTGAGTTC ACTGCTACTCAGCCTGAGGTTGCAGACTGGTCTGA AGGTGTACAGGTGCCCTCTGTGCCTATTCAGCAAT TCCCTACTGAAGACTGGAGCGCTCAGCCTGCCAC GGAAGACTGGTCTGCAGCTCCCACTGCTCAGGCC ACTGAATGGGTAGGAGCAACCACTGACTGGTCTTA AGCTGTTCTTGCATAGGCTCTTAAGCAGCATGGAA AAATGGTTGATGGAAAAT | 21 | PLKTLLMS VLYPPGILA RGLC* |
| 1015 | NM_0022 95.4_355 | 355 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTGCTGCTGCCACTGGAGCCACTCCAATTG CTGGCCGCTTCACTCCTGGAACCTTCACTAACCAG ATCCAGGCAGCCTTCCGGGAGCCACGGCTTCTTG TGGTTACTGACCCCAGGGCTGACCACCAGCCTCT CACGGAGGCATCTTATGTTAACCTACCTACCATTG CGCTGTGTAACACAGATTCTCCTCTGCGCTATGTG GACATTGCCATCCCATGCAACAACAAGGGAGCTCA CTCAGTGGGTTTGATGTGGTGGATGCTGGCTCGG GAAGTTCTGCGCATGCGTGGCACCATTTCCCGTGA ACACCCATGGGAGGTCATGCCTGATCTGTACTTCT ACAGAGATCCTGAAGAGATTGAAAAAGAAGAGCAG GCTGCTGCTGAGAAGGCAGTGACCAAGGAGGAAT TTCAGGGTGAATGGACTGCTCCCGCTCCTGAGTTC ACTGCTACTCAGCCTGAGGTTGCAGACTGGTCTGA AGGTGTACAGGTGCCCTCTGTGCCTATTCAGCAAT TCCCTACTGAAGACTGGAGCGCTCAGCCTGCCAC GGAAGACTGGTCTGCAGCTCCCACTGCTCAGGCC ACTGAATGGGTAGGAGCAACCACTGACTGGTCTTA AGCTGTTCTTGCATAGGCTCTTAAGCAGCATGGAA AAATGGTTGATGGAAAAT | 83 | LLLPLEPLQ LLAASLLEP SLTRSRQP SGSHGFL WLLTPGLT TSLSRRHL MLTYLPLR CVTQILLCA MWTLPSH ATTRELTQ WV* |
| 1016 | NM_0022 95.4_389 | 389 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGA-GGAACAGTACATCTATAAAAGGA AAAGTGATGGCATCTATATCATAAATCTCAAGAGG | 71 | ASLLEPSL TRSRQPS GSHGFLW LLTPGLTT SLSRRHLM LTYLPLRC VTQILLCA |

TABLE 3A-continued

| SEQ ID | identifier_position | position | modified_RNA | length PAP | PAP |
|---|---|---|---|---|---|
| | | | ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGCTGTGC<br>TGAAGTTTGCTGCTGCCACTGGAGCCACTCCAATT<br>GCTGGCGCTTCACTCCTGGAACCTTCACTAACCAG<br>ATCCAGGCAGCCTTCCGGGAGCCACGGCTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA<br>AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | | MWTLPSH<br>ATTRELTQ<br>WV* |
| 1017 | NM_0022<br>95.4_430 | 430 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCTTCCGGGAGCCACGGCTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA<br>AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | 57 | SGSHGFL<br>WLLTPGLT<br>TSLSRRHL<br>MLTYLPLR<br>CVTQILLCA<br>MWTLPSH<br>ATTRELTQ<br>WV* |
| 1018 | NM_0022<br>95.4_446 | 446 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGTTCTTG<br>TGGTTACTGACCCCAGGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA | 52 | FLWLLTPG<br>LTTSLSRR<br>HLMLTYLP<br>LRCVTQILL<br>CAMWTP<br>SHATTREL<br>TQWV* |

TABLE 3A-continued

| SEQ ID | identifier_position | position | modified_RNA | PAP length | PAP |
|---|---|---|---|---|---|
| | | | AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | | |
| 1019 | NM_0022<br>95.4_470 | 470 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGCTGACCACCAGCCTCT<br>CACGGAGGCATCTTATGTTAACCTACCTACCATTG<br>CGCTGTGTAACACAGATTCTCCTCTGCGCTATGTG<br>GACATTGCCATCCCATGCAACAACAAGGGAGCTCA<br>CTCAGTGGGTTTGATGTGGTGGATGCTGGCTCGG<br>GAAGTTCTGCGCATGCGTGGCACCATTTCCCGTGA<br>ACACCCATGGGAGGTCATGCCTGATCTGTACTTCT<br>ACAGAGATCCTGAAGAGATTGAAAAAGAAGAGCAG<br>GCTGCTGCTGAGAAGGCAGTGACCAAGGAGGAAT<br>TTCAGGGTGAATGGACTGCTCCCGCTCCTGAGTTC<br>ACTGCTACTCAGCCTGAGGTTGCAGACTGGTCTGA<br>AGGTGTACAGGTGCCCTCTGTGCCTATTCAGCAAT<br>TCCCTACTGAAGACTGGAGCGCTCAGCCTGCCAC<br>GGAAGACTGGTCTGCAGCTCCCACTGCTCAGGCC<br>ACTGAATGGGTAGGAGCAACCACTGACTGGTCTTA<br>AGCTGTTCTTGCATAGGCTCTTAAGCAGCATGGAA<br>AAATGGTTGATGGAAAAT | 44 | LTTSLSRR<br>HLMLTYLP<br>LRCVTQILL<br>CAMWTLP<br>SHATTREL<br>TQWV* |
| 1020 | NM_0022<br>95.4_565 | 565 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGGCTGACCACCAGCCTC<br>TCACGGAGGCATCTTATGTTAACCTACCTACCATT<br>GCGCTGTGTAACACAGATTCTCCTCTGCGCTATGT<br>GGACATTGCATCCCATGCAACAACAAGGGAGCTC<br>ACTCAGTGGGTTTGATGTGGTGGATGCTGGCTCG<br>GGAAGTTCTGCGCATGCGTGGCACCATTTCCCGT<br>GAACACCCATGGGAGGTCATGCCTGATCTGTACTT<br>CTACAGAGATCCTGAAGAGATTGAAAAAGAAGAGC<br>AGGCTGCTGCTGAGAAGGCAGTGACCAAGGAGGA<br>ATTTCAGGGTGAATGGACTGCTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | 12 | SHATTREL<br>TQWV* |
| 1021 | NM_0022<br>95.4_577 | 577 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT | 9 | KTRELTQW<br>V* |

TABLE 3A-continued

| SEQ ID | identifier_position | position | modified_RNA | PAP length | PAP |
|---|---|---|---|---|---|
| | | | GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAAAACAAGGGAGCTC ACTCAGTGGGTTTGATGTGGTGGATGCTGGCTCG GGAAGTTCTGCGCATGCGTGGCACCATTTCCCGT GAACACCCATGGGAGGTCATGCCTGATCTGTACTT CTACAGAGATCCTGAAGAGATTGAAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | | |
| 1022 | NM_0022 95.4_603 | 603 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTGATGTGGTGGATGCTGGCTCG GGAAGTTCTGCGCATGCGTGGCACCATTTCCCGT GAACACCCATGGGAGGTCATGCCTGATCTGTACTT CTACAGAGATCCTGAAGAGATTGAAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | 0 | * |
| 1023 | NM_0022 95.4_621 | 621 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTTGATGTGGTGGATGCTGGTCG GGAAGTTCTGCGCATGCGTGGCACCATTTCCCGT GAACACCCATGGGAGGTCATGCCTGATCTGTACTT CTACAGAGATCCTGAAGAGATTGAAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC | 43 | VGKFCACV APFPVNTH GRSCLICT STEILKRLK KKSRLLLR RQ* |

TABLE 3A-continued

| SEQ ID | identifier_position | position | modified_RNA | PAP length | PAP |
|---|---|---|---|---|---|
| 1024 | NM_0022 95.4_631 | 631 | TTAAGCTGTTCTTGCATAGGCTCTTAAGCAGCATG GAAAAATGGTTGATGGAAAAT CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTTGATGTGGTGGATGCTGGCTC GGGAAGTCTGCGCATGCGTGGCACCATTTCCCGT GAACACCCATGGGAGGTCATGCCTGATCTGTACTT CTACAGAGATCCTGAAGAGATTGAAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | 39 | CACVAPFP VNTHGRS CLICTSTEI LKRLKKKS RLLLRRQ* |
| 1025 | NM_0022 95.4_646 | 646 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGA-GGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTTGATGTGGTGGATGCTGGCTC GGGAAGTTCTGCGCATGCGTGGACCATTTCCCGT GAACACCCATGGGAGGTCATGCCTGATCTGTACTT CTACAGAGATCCTGAAGAGATTGAAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | 34 | PFPVNTHG RSCLICTST EILKRLKKK SRLLLRRQ |
| 1026 | NM_0022 95.4_666 | 666 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT | 28 | HGRSCLIC TSTEILKRL KKKSRLLL RRQ* |

TABLE 3A-continued

| SEQ ID | identifier_position | position | modified_RNA | PAP length | PAP |
|---|---|---|---|---|---|
| | | | GCGCTGTGTAACACAGATTCTCCTCTGCGCTATGT<br>GGACATTGCCATCCCATGCAACAACAAGGGAGCT<br>CACTCAGTGGGTTTGATGTGGTGGATGCTGGCTC<br>GGGAAGTTCTGCGCATGCGTGGCACCATTTCCCG<br>TGAACACCATGGGAGGTCATGCCTGATCTGTACTT<br>CTACAGAGATCCTGAAGAGATTGAAAAAGAAGAGC<br>AGGCTGCTGCTGAGAAGGCAGTGACCAAGGAGGA<br>ATTTCAGGGTGAATGGACTGCTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | | |
| 1027 | NM_0022<br>95.4_681 | 681 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGGCTGACCACCAGCCTC<br>TCACGGAGGCATCTTATGTTAACCTACCTACCATT<br>GCGCTGTGTAACACAGATTCTCCTCTGCGCTATGT<br>GGACATTGCCATCCCATGCAACAACAAGGGAGCT<br>CACTCAGTGGGTTTGATGTGGTGGATGCTGGCTC<br>GGGAAGTTCTGCGCATGCGTGGCACCATTTCCCG<br>TGAACACCCATGGGAGGTCATGCTGATCTGTACTT<br>CTACAGAGATCCTGAAGAGATTGAAAAAGAAGAGC<br>AGGCTGCTGCTGAGAAGGCAGTGACCAAGGAGGA<br>ATTTCAGGGTGAATGGACTGCTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | 23 | LICTSTEIL<br>KRLKKKSR<br>LLLRRQ* |
| 1028 | NM_0022<br>95.4_705 | 705 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGGCTGACCACCAGCCTC<br>TCACGGAGGCATCTTATGTTAACCTACCTACCATT<br>GCGCTGTGTAACACAGATTCTCCTCTGCGCTATGT<br>GGACATTGCCATCCCATGCAACAACAAGGGAGCT<br>CACTCAGTGGGTTTGATGTGGTGGATGCTGGCTC<br>GGGAAGTTCTGCGCATGCGTGGCACCATTTCCCG<br>TGAACACCCATGGGAGGTCATGCCTGATCTGTACT<br>TCTACAGAGATCTGAAGAGATTGAAAAAGAAGAGC<br>AGGCTGCTGCTGAGAAGGCAGTGACCAAGGAGGA<br>ATTTCAGGGTGAATGGACTGCTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | 15 | LKRLKKKS<br>RLLLRRQ* |

TABLE 3A-continued

| SEQ ID | identifier_position | position | modified_RNA | PAP length | PAP |
|---|---|---|---|---|---|
| 1029 | NM_0022 95.4_721 | 721 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTTGATGTGGTGGATGCTGGCTC GGGAAGTTCTGCGCATGCGTGGCACCATTTCCCG TGAACACCCATGGGAGGTCATGCCTGATCTGTACT TCTACAGAGATCCTGAAGAGATTGAAAAGAAGAGC AGGCTGCTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | 9 | KSRLLLRR Q* |
| 1030 | NM_0022 95.4_735 | 735 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT CACTCAGTGGGTTTGATGTGGTGGATGCTGGCTC GGGAAGTTCTGCGCATGCGTGGCACCATTTCCCG TGAACACCCATGGGAGGTCATGCCTGATCTGTACT TCTACAGAGATCCTGAAGAGATTGAAAAGAAGAG CAGGCTGTGCTGAGAAGGCAGTGACCAAGGAGGA ATTTCAGGGTGAATGGACTGCTCCCGCTCCTGAGT TCACTGCTACTCAGCCTGAGGTTGCAGACTGGTCT GAAGGTGTACAGGTGCCCTCTGTGCCTATTCAGCA ATTCCCTACTGAAGACTGGAGCGCTCAGCCTGCC ACGGAAGACTGGTCTGCAGCTCCCACTGCTCAGG CCACTGAATGGGTAGGAGCAACCACTGACTGGTC TTAAGCTGTTCTTGCATAGGCTCTTAAGCAGCATG GAAAAATGGTTGATGGAAAAT | 5 | VLRRQ* |
| 1031 | NM_0022 95.4_766 | 766 | CGCCTGTCTTTTCCGTGCTACCTGCAGAGGGGTC CATACGGCGTTGTTCTGGATTCCCGTCGTAACTTA AAGGGAAATTTTCACAATGTCCGGAGCCCTTGATG TCCTGCAAATGAAGGAGGAGGATGTCCTTAAGTTC CTTGCAGCAGGAACCCACTTAGGTGGCACCAATCT TGACTTCCAGATGGAACAGTACATCTATAAAAGGA AAAGTGATGGCATCTATATCATAAATCTCAAGAGG ACCTGGGAGAAGCTTCTGCTGGCAGCTCGTGCAA TTGTTGCCATTGAAAACCCTGCTGATGTCAGTGTT ATATCCTCCAGGAATACTGGCCAGAGGGCTGTGC TGAAGTTTGCTGCTGCCACTGGAGCCACTCCAATT GCTGGCCGCTTCACTCCTGGAACCTTCACTAACCA GATCCAGGCAGCCTTCCGGGAGCCACGGCTTCTT GTGGTTACTGACCCCAGGGCTGACCACCAGCCTC TCACGGAGGCATCTTATGTTAACCTACCTACCATT GCGCTGTGTAACACAGATTCTCCTCTGCGCTATGT GGACATTGCCATCCCATGCAACAACAAGGGAGCT | 60 | RVNGLLPL LSSLLLSLR LQTGLKVY RCPLCLFS NSLLKTGA LSLPRKTG LQLPLLRP LNG* |

TABLE 3A-continued

| SEQ ID | identifier_position | position | modified_RNA | PAP length | PAP |
|---|---|---|---|---|---|
| | | | CACTCAGTGGGTTTGATGTGGTGGATGCTGGCTC<br>GGGAAGTTCTGGGCATGCGTGGCACCATTTCCCG<br>TGAACACCCATGGGAGGTCATGCCTGATCTGTACT<br>TCTACAGAGATCCTGAAGAGATTGAAAAAGAAGAG<br>CAGGCTGCTGCTGAGAAGGCAGTGACCAAGGAGG<br>AATTCAGGGTGAATGGACTGCTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | | |
| 1032 | NM_0022 95.4_783 | 783 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGATGGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGGCTGACCACCAGCCTC<br>TCACGGAGGCATCTTATGTTAACCTACCTACCATT<br>GCGCTGTGTAACACAGATTCTCCTCTGCGCTATGT<br>GGACATTGCCATCCCATGCAACAACAAGGGAGCT<br>CACTCAGTGGGTTTGATGTGGTGGATGCTGGCTC<br>GGGAAGTTCTGCGCATGCGTGGCACCATTTCCCG<br>TGAACACCCATGGGAGGTCATGCCTGATCTGTACT<br>TCTACAGAGATCCTGAAGAGATTGAAAAAGAAGAG<br>CAGGCTGCTGCTGAGAAGGCAGTGACCAAGGAGG<br>AATTTCAGGGTGAATGGACTGTCCCGCTCCTGAGT<br>TCACTGCTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | 55 | VPLLSSLLL<br>SLRLQTGL<br>KVYRCPLC<br>LFSNSLLK<br>TGALSLPR<br>KTGLQLPL<br>LRPLNG* |
| 1033 | NM_0022 95.4_804 | 804 | CGCCTGTCTTTTCCGTGCTACCTGCAGAGGGGTC<br>CATACGGCGTTGTTCTGGATTCCCGTCGTAACTTA<br>AAGGGAAATTTTCACAATGTCCGGAGCCCTTGATG<br>TCCTGCAAATGAAGGAGGAGGATGTCCTTAAGTTC<br>CTTGCAGCAGGAACCCACTTAGGTGGCACCAATCT<br>TGACTTCCAGA-GGAACAGTACATCTATAAAAGGA<br>AAAGTGATGGCATCTATATCATAAATCTCAAGAGG<br>ACCTGGGAGAAGCTTCTGCTGGCAGCTCGTGCAA<br>TTGTTGCCATTGAAAACCCTGCTGATGTCAGTGTT<br>ATATCCTCCAGGAATACTGGCCAGAGGGCTGTGC<br>TGAAGTTTGCTGCTGCCACTGGAGCCACTCCAATT<br>GCTGGCCGCTTCACTCCTGGAACCTTCACTAACCA<br>GATCCAGGCAGCCTTCCGGGAGCCACGGCTTCTT<br>GTGGTTACTGACCCCAGGGCTGACCACCAGCCTC<br>TCACGGAGGCATCTTATGTTAACCTACCTACCATT<br>GCGCTGTGTAACACAGATTCTCCTCTGCGCTATGT<br>GGACATTGCCATCCCATGCAACAACAAGGGAGCT<br>CACTCAGTGGGTTTGATGTGGTGGATGCTGGCTC<br>GGGAAGTTCTGCGCATGCGTGGCACCATTTCCCG<br>TGAACACCCATGGGAGGTCATGCCTGATCTGTACT<br>TCTACAGAGATCCTGAAGAGATTGAAAAAGAAGAG<br>CAGGCTGCTGCTGAGAAGGCAGTGACCAAGGAGG<br>AATTTCAGGGTGAATGGACTGCTCCCGCTCCTGAG<br>TTCACTGTACTCAGCCTGAGGTTGCAGACTGGTCT<br>GAAGGTGTACAGGTGCCCTCTGTGCCTATTCAGCA<br>ATTCCCTACTGAAGACTGGAGCGCTCAGCCTGCC<br>ACGGAAGACTGGTCTGCAGCTCCCACTGCTCAGG<br>CCACTGAATGGGTAGGAGCAACCACTGACTGGTC<br>TTAAGCTGTTCTTGCATAGGCTCTTAAGCAGCATG<br>GAAAAATGGTTGATGGAAAAT | 48 | VLSLRLQT<br>GLKVYRCP<br>LCLFSNSL<br>LKTGALSL<br>PRKTGLQL<br>PLLRPLNG* |
| 1034 | NM_0022 98.2_227 | 227 | TTTTTCTTTCCTGGCTGATGATTTGTCATTCTAGTC<br>ACTTCCTGCCTTGTGACCACACACCCAGGCTTGAC<br>AAAGCTGTTCTGCAGATCAGAAAGAAGGGGTTCCT<br>GGTCATACACCAGTACTACCAAGGACAGCTTTTTT | 16 | LPKLILMA<br>MDTSASM<br>S* |

TABLE 3A-continued

| SEQ ID | identifier_position | position | modified_RNA | PAP length | PAP |
|---|---|---|---|---|---|
| | | | CCTGCAAGATCTGTTACCTAAAGCAATAAAAAATG GCCAGAGGATCAGTGTCCGATGAGGAAATGATGG AGCTCAGAGAAGCTTTGCCAAAGTTGATACTGATG GCAATGGATACATCAGCTTCAATGAGTTGAATGAC TTGTTCAAGGCTGCTTGCTTGCCTTTGCCTGGGTA TAGAGTACGAGAAATTACAGAAAACCTGATGGCTA CAGGTGATCTGGACCAAGATGGAAGGATCAGCTTT GATGAGTTTATCAAGATTTTCCATGGCCTAAAAAG CACAGATGTTGCCAAGACCTTTAGAAAAGCAATCA ATAAGAAGGAAGGGATTTGTGCAATCGGTGGTACT TCAGAGCAGTCTAGCGTTGGCACCCAACACTCCTA TTCAGAGGAAGAAAAGTATGCCTTTGTCAACTGGA TAAACAAAGCCCTGGAAAATGATCCTGATTGTCGG CATGTCATCCCAATGAACCCAAACACGAATGATCT CTTTAATGCTGTTGGAGATGGCATTGTCCTTTGTAA AATGATCAACCTGTCAGTGCCAGACACAATTGATG AAAGAACAATCAACAAAAAGAAGCTAACCCCTTTC ACCATTCAGGAAAATCTGAACTTGGCTCTGAACTC TGCCTCAGCCATCGGGTGCCATGTGGTCAACATA GGGGCTGAGGACCTGAAGGAGGGGAAGCCTTATC TGGTCCTGGGACTTCTGTGGCAAGTCATCAAGATT GGGTTGTTTGCTGACATTGAACTCAGCAGAAATGA AGCTCTGATTGCTCTTTTGAGAGAAGGTGAGAGCC TGGAGGATTTGATGAAACTCTCCCCTGAAGAGCTC TTGCTGAGGTGGGCTAATTACCACCTGGAAAATGC AGGCTGCAAC | | |
| 1035 | NM_002300.4_125 | 125 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATGCACCAGTTGCGGA AGAAGAGGCAACAGTTCCAAACAATAAGATCACTG TAGTGGGTGTTGGACAAGTTGGTATGGCGTGTGCT ATCAGCATTCTGGGAAAGTCTCTGGCTGATGAACT TGCTCTTGTGGATGTTTTGGAAGATAAGCTTAAAG GAGAAATGATGGATCTGCAGCATGGGAGCTTATTT CTTCAGACACCTAAAATTGTGGCAGATAAAGATTAT TCTGTGACCGCCAATTCTAAGATTGTAGTGGTAAC TGCAGGAGTCCGTCAGCAAGAAGGGGAGAGTCGG CTCAATCTGGTGCAGAGAAATGTTAATGTCTTCAA ATTCATTATTCCTCAGATCGTCAAGTACAGTCCTGA TTGCATCATAATTGTGGTTTCCAACCCAGTGGACA TTCTTACGTATGTTACCTGGAAACTAAGTGGATTAC CCAAACACCGCGTGATTGGAAGTGGATGTAATCTG GATTCTGCTAGATTTCGCTACCTTATGGCTGAAAAA CTTGGCATTCATCCCAGCAGCTGCCATGGATGGAT TTTGGGGGAACATGGCGACTCAAGTGTGGCTGTG TGGAGTGGTGTGAATGTGGCAGGTGTTTCTCTCCA GGAATTGAATCCAGAAATGGGAACTGACAATGATA GTGAAAATTGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | 17 | MHQLRKK RQQFQTIR SL* |
| 1036 | NM_002300.4_185 | 185 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTGGACAAGTTGGTATGGCGTGTGC TATCAGCATTCTGGGAAAGTCTCTGGCTGATGAAC TTGCTCTTGTGGATGTTTTGGAAGATAAGCTTAAAG GAGAAATGATGGATCTGCAGCATGGGAGCTTATTT CTTCAGACACCTAAAATTGTGGCAGATAAAGATTAT TCTGTGACCGCCAATTCTAAGATTGTAGTGGTAAC TGCAGGAGTCCGTCAGCAAGAAGGGGAGAGTCGG CTCAATCTGGTGCAGAGAAATGTTAATGTCTTCAA ATTCATTATTCCTCAGATCGTCAAGTACAGTCCTGA TTGCATCATAATTGTGGTTTCCAACCCAGTGGACA TTCTTACGTATGTTACCTGGAAACTAAGTGGATTAC CCAAACACCGCGTGATTGGAAGTGGATGTAATCTG GATTCTGCTAGATTTCGCTACCTTATGGCTGAAAAA CTTGGCATTCATCCCAGCAGCTGCCATGGATGGAT TTTGGGGGAACATGGCGACTCAAGTGTGGCTGTG TGGAGTGGTGTGAATGTGGCAGGTGTTTCTCTCCA | 33 | DKLVWRVL SAFWESL WLMNLLL WMFWKISL KEK* |

TABLE 3A-continued

| SEQ ID | identifier_position | position | modified_RNA | PAP length | PAP |
|---|---|---|---|---|---|
| | | | GGAATTGAATCCAGAAATGGGAACTGACAATGATA<br>GTGAAAATTGGAAGGAAGTGCATAAGATGGTGGTT<br>GAAAGTGCCTATGAAGTCATCAAGCTAAAAGGATA<br>TACCAACTGGGCTATTGGATTAAGTGTGGCTGATC<br>TTATTGAATCCATGTTGAAAAATCTATCCAGGATTC<br>ATCCCGTGTCAACAATGGTAAAGGGGATGTATGGC<br>ATTGAGAATGAAGTCTTCCTGAGCCTTCCATGTAT<br>CCTCAATGCCCGGGGATTAACCAGCGTTATCAACC<br>AGAAGCTA | | |
| 1037 | NM_0023<br>00.4_262 | 262 | CTTGCAGAGCCGGCGCCGGAGGAGACGCACGCA<br>GCTGACTTTGTCTTCTCCGCACGACTGTTACAGAG<br>GTCTCCAGAGCCTTCTCTCCTGTGCAAAATGGC<br>AACTCTTAAGGAAAAACTCATTGCACCAGTTGCGG<br>AAGAAGAGGCAACAGTTCCAAACAATAAGATCACT<br>GTAGTGGGTGTTGGACAAGTTGGTATGGCGTGTG<br>CTATCAGCATTCTGGGAAAGTCTCTGGCTGATGAA<br>CTTGCTCTTGTGGATGTTTGGAAGATAAGCTTAAA<br>GGAGAAATGATGGATCTGCAGCATGGGAGCTTATT<br>TCTTCAGACACCTAAAATTGTGGCAGATAAAGATTA<br>TTCTGTGACCGCCAATTCTAAGATTGTAGTGGTAA<br>CTGCAGGAGTCCGTCAGCAAGAAGGGGAGAGTCG<br>GCTCAATCTGGTGCAGAGAAATGTTAATGTCTTCA<br>AATTCATTATTCCTCAGATCGTCAAGTACAGTCCTG<br>ATTGCATCATAATTGTGGTTTCCAACCCAGTGGAC<br>ATTCTTACGTATGTTACCTGGAAACTAAGTGGATTA<br>CCCAAACACCGCGTGATTGGAAGTGGATGTAATCT<br>GGATTCTGCTAGATTTCGCTACCTTATGGCTGAAA<br>AACTTGGCATTCATCCCAGCAGCTGCCATGGATGG<br>ATTTTGGGGGAACATGGCGACTCAAGTGTGGCTGT<br>GTGGAGTGGTGTGAATGTGGCAGGTGTTTCTCTCC<br>AGGAATTGAATCCAGAAATGGGAACTGACAATGAT<br>AGTGAAAATTGGAAGGAAGTGCATAAGATGGTGGT<br>TGAAAGTGCCTATGAAGTCATCAAGCTAAAAGGAT<br>ATACCAACTGGGCTATTGGATTAAGTGTGGCTGAT<br>CTTATTGAATCCATGTTGAAAAATCTATCCAGGATT<br>CATCCCGTGTCAACAATGGTAAAGGGGATGTATGG<br>CATTGAGAATGAAGTCTTCCTGAGCCTTCCATGTA<br>TCCTCAATGCCCGGGGATTAACCAGCGTTATCAAC<br>CAGAAGCTA | 8 | WKISLKEK* |
| 1038 | NM_0023<br>00.4_332 | 332 | CTTGCAGAGCCGGCGCCGGAGGAGACGCACGCA<br>GCTGACTTTGTCTTCTCCGCACGACTGTTACAGAG<br>GTCTCCAGAGCCTTCTCTCCTGTGCAAAATGGC<br>AACTCTTAAGGAAAAACTCATTGCACCAGTTGCGG<br>AAGAAGAGGCAACAGTTCCAAACAATAAGATCACT<br>GTAGTGGGTGTTGGACAAGTTGGTATGGCGTGTG<br>CTATCAGCATTCTGGGAAAGTCTCTGGCTGATGAA<br>CTTGCTCTTGTGGATGTTTTGGAAGATAAGCTTAAA<br>GGAGAAATGATGGATCTGCAGCATGGGAGCTTATT<br>TCTTCAGACACCTAAAATGTGGCAGATAAAGATTAT<br>TCTGTGACCGCCAATTCTAAGATTGTAGTGGTAAC<br>TGCAGGAGTCCGTCAGCAAGAAGGGGAGAGTCGG<br>CTCAATCTGGTGCAGAGAAATGTTAATGTCTTCAA<br>ATTCATTATTCCTCAGATCGTCAAGTACAGTCCTGA<br>TTGCATCATAATTGTGGTTTCCAACCCAGTGGACA<br>TTCTTACGTATGTTACCTGGAAACTAAGTGGATTAC<br>CCAAACACCGCGTGATTGGAAGTGGATGTAATCTG<br>GATTCTGCTAGATTTCGCTACCTTATGGCTGAAAAA<br>CTTGGCATTCATCCCAGCAGCTGCCATGGATGGAT<br>TTTGGGGGAACATGGCGACTCAAGTGTGGCTGTG<br>TGGAGTGGTGTGAATGTGGCAGGTGTTTCTCTCCA<br>GGAATTGAATCCAGAAATGGGAACTGACAATGATA<br>GTGAAAATTGGAAGGAAGTGCATAAGATGGTGGTT<br>GAAAGTGCCTATGAAGTCATCAAGCTAAAAGGATA<br>TACCAACTGGGCTATTGGATTAAGTGTGGCTGATC<br>TTATTGAATCCATGTTGAAAAATCTATCCAGGATTC<br>ATCCCGTGTCAACAATGGTAAAGGGGATGTATGGC<br>ATTGAGAATGAAGTCTTCCTGAGCCTTCCATGTAT<br>CCTCAATGCCCGGGGATTAACCAGCGTTATCAACC<br>AGAAGCTA | 8 | MWQIKIIL* |
| 1039 | NM_0023<br>00.4_362 | 362 | CTTGCAGAGCCGGCGCCGGAGGAGACGCACGCA<br>GCTGACTTTGTCTTCTCCGCACGACTGTTACAGAG<br>GTCTCCAGAGCCTTCTCTCCTGTGCAAAATGGC<br>AACTCTTAAGGAAAAACTCATTGCACCAGTTGCGG<br>AAGAAGAGGCAACAGTTCCAAACAATAAGATCACT<br>GTAGTGGGTGTTGGACAAGTTGGTATGGCGTGTG<br>CTATCAGCATTCTGGGAAAGTCTCTGGCTGATGAA<br>CTTGCTCTTGTGGATGTTTGGAAGATAAGCTTAAA | 4 | ILRL* |

| SEQ ID | identifier_position | position | modified_RNA | PAP length | PAP |
|---|---|---|---|---|---|
| | | | GGAGAAATGATGGATCTGCAGCATGGGAGCTTATT<br>TCTTCAGACACCTAAAATTGTGGCAGATAAAGATTA<br>TTCTGTGACCGCAATTCTAAGATTGTAGTGGTAACT<br>GCAGGAGTCCGTCAGCAAGAAGGGGAGAGTCGG<br>CTCAATCTGGTGCAGAGAAATGTTAATGTCTTCAA<br>ATTCATTATTCCTCAGATCGTCAAGTACAGTCCTGA<br>TTGCATCATAATTGTGGTTTCCAACCCAGTGGACA<br>TTCTTACGTATGTTACCTGGAAACTAAGTGGATTAC<br>CCAAACACCGCGTGATTGGAAGTGGATGTAATCTG<br>GATTCTGCTAGATTTCGCTACCTTATGGCTGAAAAA<br>CTTGGCATTCATCCCAGCAGCTGCCATGGATGGAT<br>TTTGGGGGAACATGGCGACTCAAGTGTGGCTGTG<br>TGGAGTGGTGTGAATGTGGCAGGTGTTTCTCTCCA<br>GGAATTGAATCCAGAAATGGGAACTGACAATGATA<br>GTGAAAATTGGAAGGAAGTGCATAAGATGGTGGTT<br>GAAAGTGCCTATGAAGTCATCAAGCTAAAAGGATA<br>TACCAACTGGGCTATTGGATTAAGTGTGGCTGATC<br>TTATTGAATCCATGTTGAAAAATCTATCCAGGATTC<br>ATCCCGTGTCAACAATGGTAAAGGGGATGTATGGC<br>ATTGAGAATGAAGTCTTCCTGAGCCTTCCATGTAT<br>CCTCAATGCCCGGGGATTAACCAGCGTTATCAACC<br>AGAAGCTA | | |
| 1040 | NM_0023<br>00.4_374 | 374 | CTTGCAGAGCCGGCGCCGGAGGAGACGCACGCA<br>GCTGACTTTGTCTTCTCCGCACGACTGTTACAGAG<br>GTCTCCAGAGCCTTCTCTCTCCTGTGCAAAATGGC<br>AACTCTTAAGGAAAAACTCATTGCACCAGTTGCGG<br>AAGAAGAGGCAACAGTTCCAAACAATAAGATCACT<br>GTAGTGGGTGTTGGACAAGTTGGTATGGCGTGTG<br>CTATCAGCATTCTGGGAAAGTCTCTGGCTGATGAA<br>CTTGCTCTTGTGGATGTTTTGGAAGATAAGCTTAAA<br>GGAGAAATGATGGATCTGCAGCATGGGAGCTTATT<br>TCTTCAGACACCTAAAATTGTGGCAGATAAAGATTA<br>TTCTGTGACCGCCAATTCTAAGATGTAGTGGTAAC<br>TGCAGGAGTCCGTCAGCAAGAAGGGGAGAGTCGG<br>CTCAATCTGGTGCAGAGAAATGTTAATGTCTTCAA<br>ATTCATTATTCCTCAGATCGTCAAGTACAGTCCTGA<br>TTGCATCATAATTGTGGTTTCCAACCCAGTGGACA<br>TTCTTACGTATGTTACCTGGAAACTAAGTGGATTAC<br>CCAAACACCGCGTGATTGGAAGTGGATGTAATCTG<br>GATTCTGCTAGATTTCGCTACCTTATGGCTGAAAAA<br>CTTGGCATTCATCCCAGCAGCTGCCATGGATGGAT<br>TTTGGGGGAACATGGCGACTCAAGTGTGGCTGTG<br>TGGAGTGGTGTGAATGTGGCAGGTGTTTCTCTCCA<br>GGAATTGAATCCAGAAATGGGAACTGACAATGATA<br>GTGAAAATTGGAAGGAAGTGCATAAGATGGTGGTT<br>GAAAGTGCCTATGAAGTCATCAAGCTAAAAGGATA<br>TACCAACTGGGCTATTGGATTAAGTGTGGCTGATC<br>TTATTGAATCCATGTTGAAAAATCTATCCAGGATTC<br>ATCCCGTGTCAACAATGGTAAAGGGGATGTATGGC<br>ATTGAGAATGAAGTCTTCCTGAGCCTTCCATGTAT<br>CCTCAATGCCCGGGGATTAACCAGCGTTATCAACC<br>AGAAGCTA | 1 | M* |
| 1041 | NM_0023<br>00.4_492 | 492 | CTTGCAGAGCCGGCGCCGGAGGAGACGCACGCA<br>GCTGACTTTGTCTTCTCCGCACGACTGTTACAGAG<br>GTCTCCAGAGCCTTCTCTCTCCTGTGCAAAATGGC<br>AACTCTTAAGGAAAAACTCATTGCACCAGTTGCGG<br>AAGAAGAGGCAACAGTTCCAAACAATAAGATCACT<br>GTAGTGGGTGTTGGACAAGTTGGTATGGCGTGTG<br>CTATCAGCATTCTGGGAAAGTCTCTGGCTGATGAA<br>CTTGCTCTTGTGGATGTTTTGGAAGATAAGCTTAAA<br>GGAGAAATGATGGATCTGCAGCATGGGAGCTTATT<br>TCTTCAGACACCTAAAATTGTGGCAGATAAAGATTA<br>TTCTGTGACCGCCAATTCTAAGATTGTAGTGGTAA<br>CTGCAGGAGTCCGTCAGCAAGAAGGGGAGAGTCG<br>GCTCAATCTGGTGCAGAGAAATGTTAATGTCTTCA<br>AATTCATTATTCCTCAGATCGTCAAGTACAGTCCTG<br>ATGCATCATAATTGTGGTTTCCAACCCAGTGGACA<br>TTCTTACGTATGTTACCTGGAAACTAAGTGGATTAC<br>CCAAACACCGCGTGATTGGAAGTGGATGTAATCTG<br>GATTCTGCTAGATTTCGCTACCTTATGGCTGAAAAA<br>CTTGGCATTCATCCCAGCAGCTGCCATGGATGGAT<br>TTTGGGGGAACATGGCGACTCAAGTGTGGCTGTG<br>TGGAGTGGTGTGAATGTGGCAGGTGTTTCTCTCCA<br>GGAATTGAATCCAGAAATGGGAACTGACAATGATA<br>GTGAAAATTGGAAGGAAGTGCATAAGATGGTGGTT<br>GAAAGTGCCTATGAAGTCATCAAGCTAAAAGGATA<br>TACCAACTGGGCTATTGGATTAAGTGTGGCTGATC | 2 | AS* |

TABLE 3A-continued

| SEQ ID | identifier_position | position | modified_RNA | PAP length | PAP |
|---|---|---|---|---|---|
| | | | TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | | |
| 1042 | NM_0023 00.4_503 | 503 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATGTGGTTTCCAACCCAGTGGACA TTCTTACGTATGTTACCTGGAAACTAAGTGGATTAC CCAAACACCGCGTGATTGGAAGTGGATGTAATCTG GATTCTGCTAGATTTCGCTACCTTATGGCTGAAAAA CTTGGCATTCATCCCAGCAGCTGCCATGGATGGAT TTTGGGGGAACATGGCGACTCAAGTGTGGCTGTG TGGAGTGGTGTGAATGTGGCAGGTGTTTCTCTCCA GGAATTGAATCCAGAAATGGGAACTGACAATGATA GTGAAAATTGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | 16 | MWFPTQW TFLRMLPG N* |
| 1043 | NM_0023 00.4_572 | 572 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGGTGATTGGAAGTGGATGTAATCTG GATTCTGCTAGATTTCGCTACCTTATGGCTGAAAAA CTTGGCATTCATCCCAGCAGCTGCCATGGATGGAT TTTGGGGGAACATGGCGACTCAAGTGTGGCTGTG TGGAGTGGTGTGAATGTGGCAGGTGTTTCTCTCCA GGAATTGAATCCAGAAATGGGAACTGACAATGATA GTGAAAATTGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | 0 | * |
| 1044 | NM_0023 00.4_578 | 578 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG | 45 | MEVDVIWI LLDFATLW LKNLAFIPA AAMDGFW GNMATQV WLCGVV* |

TABLE 3A-continued

| SEQ ID | identifier_ position | position | modified_RNA | PAP length | PAP |
|---|---|---|---|---|---|
| | | | GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATGGAAGTGGATGTAATCT GGATTCTGCTAGATTTCGCTACCTTATGGCTGAAA AACTTGGCATTCATCCCAGCAGCTGCCATGGATGG ATTTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA TCCTCAATGCCCGGGGATTAACCAGCGTTATCAAC CAGAAGCTA | | |
| 1045 | NM_0023 00.4_592 | 592 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTATCTG GATTCTGCTAGATTTCGCTACCTTATGGCTGAAAAA CTTGGCATTCATCCCAGCAGCTGCCATGGATGGAT TTTGGGGGAACATGGCGACTCAAGTGTGGCTGTG TGGAGTGGTGTGAATGTGGCAGGTGTTTCTCTCCA GGAATTGAATCCAGAAATGGGAACTGACAATGATA GTGAAAATTGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | 40 | IWILLDFAT LWLKNLAFI PAAAMDG FWGNMAT QVWLCGV V* |
| 1046 | NM_0023 00.4_604 | 604 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTAATCT GGATTCTGTAGATTTCGCTACCTTATGGCTGAAAA ACTTGGCATTCATCCCAGCAGCTGCCATGGATGGA TTTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA | 36 | VDFATLWL KNLAFIPAA AMDGFWG NMATQVW LCGVV* |

TABLE 3A-continued

| SEQ ID | identifier_position | position | modified_RNA | PAP length | PAP |
|---|---|---|---|---|---|
| | | | TCCTCAATGCCCGGGGATTAACCAGCGTTATCAACCAGAAGCTA | | |
| 1047 | NM_0023 00.4_618 | 618 | CTTGCAGAGCCGGCGCCGGAGGAGACGCACGCAGCTGACTTTGTCTTCTCCGCACGACTGTTACAGAGGTCTCCAGAGCCTTCTCTCTCCTGTGCAAAATGGCAACTCTTAAGGAAAAACTCATTGCACCAGTTGCGGAAGAAGAGGCAACAGTTCCAAACAATAAGATCACTGTAGTGGGTGTTGGACAAGTTGGTATGGCGTGTGCTATCAGCATTCTGGGAAAGTCTCTGGCTGATGAACTTGCTCTTGTGGATGTTTTGGAAGATAAGCTTAAAGGAGAAATGATGGATCTGCAGCATGGGAGCTTATTTCTTCAGACACCTAAAATTGTGGCAGATAAAGATTATTCTGTGACCGCCAATTCTAAGATTGTAGTGGTAACTGCAGGAGTCCGTCAGCAAGAAGGGGAGAGTCGGCTCAATCTGGTGCAGAGAAATGTTAATGTCTTCAAATTCATTATTCCTCAGATCGTCAAGTACAGTCCTGATTGCATCATAATTGTGGTTTCCAACCCAGTGGACATTCTTACGTATGTTACCTGGAAACTAAGTGGATTACCCAAACACCGCGTGATTGGAAGTGGATGTAATCTGGATTCTGCTAGATTTCGCTACTTATGGCTGAAAAACTTGGCATTCATCCCAGCAGCTGCCATGGATGGATTTTGGGGGAACATGGCGACTCAAGTGTGGCTGTGTGGAGTGGTGTGAATGTGGCAGGTGTTTCTCTCCAGGAATTGAATCCAGAAATGGGAACTGACAATGATAGTGAAAATTGGAAGGAAGTGCATAAGATGGTGGTTGAAAGTGCCTATGAAGTCATCAAGCTAAAAGGATATACCAACTGGGCTATTGGATTAAGTGTGGCTGATCTTATTGAATCCATGTTGAAAAATCTATCCAGGATTCATCCCGTGTCAACAATGGTAAAGGGGATGTATGGCATTGAGAATGAAGTCTTCCTGAGCCTTCCATGTATCCTCAATGCCCGGGGATTAACCAGCGTTATCAACCAGAAGCTA | 30 | WLKNLAFI PAAAMDG FWGNMAT QVWLCGV V* |
| 1048 | NM_0023 00.4_625 | 625 | CTTGCAGAGCCGGCGCCGGAGGAGACGCACGCAGCTGACTTTGTCTTCTCCGCACGACTGTTACAGAGGTCTCCAGAGCCTTCTCTCTCCTGTGCAAAATGGCAACTCTTAAGGAAAAACTCATTGCACCAGTTGCGGAAGAAGAGGCAACAGTTCCAAACAATAAGATCACTGTAGTGGGTGTTGGACAAGTTGGTATGGCGTGTGCTATCAGCATTCTGGGAAAGTCTCTGGCTGATGAACTTGCTCTTGTGGATGTTTTGGAAGATAAGCTTAAAGGAGAAATGATGGATCTGCAGCATGGGAGCTTATTTCTTCAGACACCTAAAATTGTGGCAGATAAAGATTATTCTGTGACCGCCAATTCTAAGATTGTAGTGGTAACTGCAGGAGTCCGTCAGCAAGAAGGGGAGAGTCGGCTCAATCTGGTGCAGAGAAATGTTAATGTCTTCAAATTCATTATTCCTCAGATCGTCAAGTACAGTCCTGATTGCATCATAATTGTGGTTTCCAACCCAGTGGACATTCTTACGTATGTTACCTGGAAACTAAGTGGATTACCCAAACACCGCGTGATTGGAAGTGGATGTAATCTGGATTCTGCTAGATTTCGCTACCTTATGGTGAAAAACTTGGCATTCATCCCAGCAGCTGCCATGGATGGATTTTGGGGGAACATGGCGACTCAAGTGTGGCTGTGTGGAGTGGTGTGAATGTGGCAGGTGTTTCTCTCCAGGAATTGAATCCAGAAATGGGAACTGACAATGATAGTGAAAATTGGAAGGAAGTGCATAAGATGGTGGTTGAAAGTGCCTATGAAGTCATCAAGCTAAAAGGATATACCAACTGGGCTATTGGATTAAGTGTGGCTGATCTTATTGAATCCATGTTGAAAAATCTATCCAGGATTCATCCCGTGTCAACAATGGTAAAGGGGATGTATGGCATTGAGAATGAAGTCTTCCTGAGCCTTCCATGTATCCTCAATGCCCGGGGATTAACCAGCGTTATCAACCAGAAGCTA | 29 | VKNLAFIPA AAMDGFW GNMATQV WLCGVV* |
| 1049 | NM_0023 00.4_638 | 638 | CTTGCAGAGCCGGCGCCGGAGGAGACGCACGCAGCTGACTTTGTCTTCTCCGCACGACTGTTACAGAGGTCTCCAGAGCCTTCTCTCTCCTGTGCAAAATGGCAACTCTTAAGGAAAAACTCATTGCACCAGTTGCGGAAGAAGAGGCAACAGTTCCAAACAATAAGATCACTGTAGTGGGTGTTGGACAAGTTGGTATGGCGTGTGCTATCAGCATTCTGGGAAAGTCTCTGGCTGATGAACTTGCTCTTGTGGATGTTTTGGAAGATAAGCTTAAAGGAGAAATGATGGATCTGCAGCATGGGAGCTTATTTCTTCAGACACCTAAAATTGTGGCAGATAAAGATTATTCTGTGACCGCCAATTCTAAGATTGTAGTGGTAACTGCAGGAGTCCGTCAGCAAGAAGGGGAGAGTCGGCTCAATCTGGTGCAGAGAAATGTTAATGTCTTCAAATTCATTATTCCTCAGATCGTCAAGTACAGTCCTGATTGCATCATAATTGTGGTTTCCAACCCAGTGGAC | 24 | FIPAAAMD GFWGNMA TQVWLCG VV* |

TABLE 3A-continued

| SEQ ID | identifier_position | position | modified_RNA | PAP length | PAP |
|---|---|---|---|---|---|
| | | | ATTCTTACGTATGTTACCTGGAAACTAAGTGGATTA CCCAAACACCGCGTGATTGGAAGTGGATGTAATCT GGATTCTGCTAGATTTCGCTACCTTATGGCTGAAA AACTTGGATTCATCCCAGCAGCTGCCATGGATGGA TTTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA TCCTCAATGCCCGGGGATTAACCAGCGTTATCAAC CAGAAGCTA | | |
| 1050 | NM_0023 00.4_657 | 657 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTAATCT GGATTCTGCTAGATTTCGCTACCTTATGGCTGAAA AACTTGGCATTCATCCCAGCAGCTGCATGGATGGA TTTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA TCCTCAATGCCCGGGGATTAACCAGCGTTATCAAC CAGAAGCTA | 18 | MDGFWGN MATQVWL CGVV* |
| 1051 | NM_0023 00.4_670 | 670 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTAATCT GGATTCTGCTAGATTTCGCTACCTTATGGCTGAAA AACTTGGCATTCATCCCAGCAGCTGCCATGGATGG ATTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA TCCTCAATGCCCGGGGATTAACCAGCGTTATCAAC CAGAAGCTA | 14 | WGNMATQ VWLCGW* |

TABLE 3A-continued

| SEQ ID | identifier_position | position | modified_RNA | PAP length | PAP |
|---|---|---|---|---|---|
| 1052 | NM_002300.4_683 | 683 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTAATCT GGATTCTGCTAGATTTCGCTACCTTATGGCTGAAA AACTTGGCATTCATCCCAGCAGCTGCCATGGATGG ATTTTGGGGAACATGGGACTCAAGTGTGGCTGT GTGGAGTGGTGTGAATGTGGCAGGTGTTTCTCTCC AGGAATTGAATCCAGAAATGGGAACTGACAATGAT AGTGAAAATTGGAAGGAAGTGCATAAGATGGTGGT TGAAAGTGCCTATGAAGTCATCAAGCTAAAAGGAT ATACCAACTGGGCTATTGGATTAAGTGTGGCTGAT CTTATTGAATCCATGTTGAAAAATCTATCCAGGATT CATCCCGTGTCAACAATGGTAAAGGGGATGTATGG CATTGAGAATGAAGTCTTCCTGAGCCTTCCATGTA TCCTCAATGCCCGGGGATTAACCAGCGTTATCAAC CAGAAGCTA | 9 | TQVWLCG VV* |
| 1053 | NM_002300.4_766 | 766 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCCTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGCGTGATTGGAAGTGGATGTAATCT GGATTCTGCTAGATTTCGCTACCTTATGGCTGAAA AACTTGGCATTCATCCCAGCAGCTGCCATGGATGG ATTTTGGGGAACATGGCGACTCAAGTGTGGCTGT GTGGAGTGGTGTGAATGTGGCAGGTGTTTCTCTCC AGGAATTGAATCCAGAAATGGGAACTGACATGATA GTGAAAATTGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | 22 | MIVKIGRK CIRWWLKV PMKSSS* |
| 1054 | NM_002300.4_780 | 780 | CTTGCAGAGCCGGCGCCGGAGGAGACGCACGCA GCTGACTTTGTCTTCTCCGCACGACTGTTACAGAG GTCTCCAGAGCCTTCTCTCTCCTGTGCAAAATGGC AACTCTTAAGGAAAAACTCATTGCACCAGTTGCGG AAGAAGAGGCAACAGTTCCAAACAATAAGATCACT GTAGTGGGTGTTGGACAAGTTGGTATGGCGTGTG CTATCAGCATTCTGGGAAAGTCTCTGGCTGATGAA CTTGCTCTTGTGGATGTTTTGGAAGATAAGCTTAAA GGAGAAATGATGGATCTGCAGCATGGGAGCTTATT TCTTCAGACACCTAAAATTGTGGCAGATAAAGATTA TTCTGTGACCGCCAATTCTAAGATTGTAGTGGTAA CTGCAGGAGTCCGTCAGCAAGAAGGGGAGAGTCG GCTCAATCTGGTGCAGAGAAATGTTAATGTCTTCA AATTCATTATTCGTCAGATCGTCAAGTACAGTCCTG ATTGCATCATAATTGTGGTTTCCAACCCAGTGGAC ATTCTTACGTATGTTACCTGGAAACTAAGTGGATTA CCCAAACACCGGGTGATTGGAAGTGGATGTAATCT | 17 | GRKCIRW WLKVPMK SSS* |

TABLE 3A-continued

| SEQ ID | identifier_position | position | modified_RNA | PAP length | PAP |
|---|---|---|---|---|---|
| | | | GGATTCTGCTAGATTTCGCTACCTTATGGCTGAAA AACTTGGCATTCATCCCAGCAGCTGCCATGGATGG ATTTTGGGGGAACATGGCGACTCAAGTGTGGCTGT GTGGAGTGGTGTGAATGTGGCAGGTGTTTCTCTCC AGGAATTGAATCCAGAAATGGGAACTGACAATGAT AGTGAAAATGGAAGGAAGTGCATAAGATGGTGGTT GAAAGTGCCTATGAAGTCATCAAGCTAAAAGGATA TACCAACTGGGCTATTGGATTAAGTGTGGCTGATC TTATTGAATCCATGTTGAAAAATCTATCCAGGATTC ATCCCGTGTCAACAATGGTAAAGGGGATGTATGGC ATTGAGAATGAAGTCTTCCTGAGCCTTCCATGTAT CCTCAATGCCCGGGGATTAACCAGCGTTATCAACC AGAAGCTA | | |
| 1055 | NM_0023 05.3_259 | 259 | AGTTAAAAGGGTGGGAGCGTCCGGGGGCCCATCT CTCTCGGGTGGAGTCTTCTGACAGCTGGTGCGCC TGCCCGGGAACATCCTCCTGGACTCAATCATGGCT TGTGGTCTGGTCGCCAGCAACCTGAATCTCAAACC TGGAGAGTGCCTTCGAGTGCGAGGCGAGGTGGCT CCTGACGCTAAGAGCTTCGTGCTGAACCTGGGCA AAGACAGCAACAACCTGTGCCTGCACTTCAACCCT CGCTTCAACGCCCACGGGACGCCAACACCATCGT GTGCAACAGCAAGGACGGCGGGGCCTGGGGGAC CGAGCAGCGGGAGGCTGTCTTTCCCTTCCAGCCT GGAAGTGTTGCAGAGGTGTGCATCACCTTCGACC AGGCCAACCTGACCGTCAAGCTGCCAGATGGATA CGAATTCAAGTTCCCCAACCGCCTCAACCTGGAG GCCATCAACTACATGGCAGCTGACGGTGACTTCAA GATCAAATGTGTGGCCTTTGACTGAAATCAGCCAG CCCATGGCCCCCAATAAAGGCAGCTGCCTCTGCT CCCTCTGA | 42 | TPTPSCAT ARTAGPG GPSSGRLS FPSSLEVL QRCASPST RPT* |
| 1056 | NM_0023 37.1_782 | 782 | TGAGCGGGGGATGATGGCGCCGCGGAGGGTCAG GTCGTTTCTGCGCGGGCTCCCGGCGCTGCTACTG CTGCTGCTCTTCCTCGGGCCCTGGCCCGCTGCGA GCCACGGCGGCAAGTACTCGCGGGAGAAGAACCA GCCCAAGCCGTCCCCGAAACGCGAGTCCGGAGA GGAGTTCCGCATGGAGAAGTTGAACCAGCTGTGG GAGAAGGCCCAGCGACTGCATCTTCCTCCCGTGA GGCTGGCCGAGCTCCACGCTGATCTGAAGATACA GGAGAGGGACGAACTCGCCTGGAAGAAACTAAAG CTTGACGGCTTGGACGAAGATGGGGAGAAGGAAG CGAGACTCATACGCAACCTCAATGTCATCTTGGCC AAGTATGGTCTGGACGGAAAGAAGGACGCTCGGC AGGTGACCAGCAACTCCCTCAGTGGCACCCAGGA AGACGGGCTGGATGACCCCAGGCTGGAAAAGCTG TGGCACAAGGCGAAGACCTCTGGGAAATTCTCCG GCGAAGAACTGGACAAGCTCTGGCGGGAGTTCCT GCATCACAAAGAGAAAGTTCACGAGTACAACGTCC TGCTGGAGACCCTGAGCAGGACCGAAGAAATCCA CGAGAACGTCATTAGCCCCTCGGACCTGAGCGAC ATCAAGGGCAGCGTCCTGCACAGCAGGCACACGG AGCTGAAGGAGAAGCTGCGCAGCATCAACCAGGG CCTGGACCGCCTGCGCAGGGTCAGCCACCAGGG CTACAGCACTGAGGCTGAGTTCGAGGAGCCCAGG TGATTGACCTGTGGGACCTGGCGCAGTCCGCCAA CCTCACGGACAAGGAGCTGGAGGCGTTCCGGGA GGAGCTCAAGCACTTCGAAGCCAAAATCGAGAAG CACAACCACTACCAGAAGCAGCTGGAGATTGCGC ACGAGAAGCTGAGGCACGCAGAGAGCGTGGGCG ACGGCGAGCGTGTGAGCCGCAGCCGCGAGAAGC ACGCCCTGCTGGAGGGGCGGACCAAGGAGCTGG GCTACACGG | 0 | * |
| 1057 | NM_0023 55.2_370 | 370 | TTCCGGTTCCCAGAGTGGGGCACAGCGAGGCGCT AGGGGGAACGCTGGCCTCTGAAACTAGCTCTGGG ACCGGGGTCTGCGGCCGGCCCCTAGCTGGCCCC GTCTCCCATCCCCAGAAGGGTATTCACTGGGGATT CTGAGCTTTGGCTACTCCAGTTTCCCACGACACGA TGTTCCCTTTCTACAGCTGCTGGAGGACTGGACTG CTACTACTACTCCTGGCTGTGGCAGTGAGAGAATC CTGGCAGACAGAAGAAAAAACTTGCGACTTGGTAG GAGAAAAGGGTAAAGAGTCAGAGAAAGAGTTGGC TCTAGTGAAGAGGCTGAAACCACTGTTTAATAAAA GCTTTGAGAGCACTGTGGGCCAGGTTCAGACACA TACATCTACATCTTCAGGGTGTGCCGGGAAGCTGG CAACCACACTTCTGGGGCAGGCCTGGTGCAAATC AACAAAAGTAATGGGAAGGAGACAGTGGTAGGGA GACTCAACGAGACTCACATCTTCAACGGAAGTAAT | 36 | VQTHTSTS SGCAGKLA TTLLGQAW CKSTKVM GRRQW* |

TABLE 3A-continued

| SEQ ID | identifier_ position | position | modified_RNA | PAP length | PAP |
|---|---|---|---|---|---|
| | | | TGGATCATGCTGATCTATAAAGGGGGTGATGAATA TGACAACCACTGTGGCAAGGAGCAGCGTCGTGCA GTGGTGATGATCTCCTGCAATCGACACACCCTAGC GGACAATTTTAACCCTGTGTCTGAGGAGCGTGGCA AAGTCCAAGATTGTTTCTACCTCTTTGAGATGGATA GCAGCCTGGCCTGTTCACCAGAGATCTCCCACCT CAGTGTGGGTTCCATCTTACTTGTCACGTTTGCAT CACTGGTTGCTGTTTATGTTGTTGGGGGGTTCCTA TACCAGCGACTGGTAGTGGGAGCCAAAGGAATGG AGCAGTTTCCCCACTTAGCCTTCTGGCAGGATCTT GGCAACCTGGTAGCAGATGGCTGTGACTTTGTCTG CCGTTCTAAACCTCGAAATGTGCCTGCAGCATATC GTGGTGTGGGGGATGACCAGCTGGGGGAGGAGT CAGAAGAAAGGGATGACCATTTATTACCAATGTAG ATTGCACTTTATATGTCCAGC | | |
| 1058 | NM_0024 15.1_412 | 412 | ACCACAGTGGTGTCCGAGAAGTCAGGCACGTAGC TCAGCGGCGGCCGCGGCGCGTGCGTCTGTGCCT CTGCGCGGGTCTCCTGGTCCTTCTGCCATCATGC CGATGTTCATCGTAAACACCAACGTGCCCCGCGC CTCCGTGCCGGACGGGTTCCTCTCCGAGCTCACC CAGCAGCTGGCGCAGGCCACCGGCAAGCCCCCC CAGTACATCGCGGTGCACGTGGTCCCGGACCAGC TCATGGCCTTCGGCGGCTCCAGCGAGCCGTGCGC GCTCTGCAGCCTGCACAGCATCGGCAAGATCGGC GGCGCGCAGAACCGCTCCTACAGCAAGCTGCTGT GCGGCCTGCTGGCCGAGCGCCTGCGCATCAGCC CGGACAGGGTCTACATCAACTATTACGACATGAAC GCGGCAATGTGGGCTGGAACAACTCCACCTTCGC CTAAGAGCCGCAGGGACCCACGCTGTCTGCGCTG GCTCCACCCGGGAACCCGCCGCACGCTGTGTTCT AGGCCCGCCCACCCCAACCTTCTGGTGGGGAGAA ATAAACGGTTTAGAGACT | 48 | MWAGTTP PSPKSRRD PRCLRWL HPGTRRTL CSRPAHPN LLVGRNKR FRD* |
| 1059 | NM_0024 89.2_186 | 186 | GGGTCCTTCAGGTAGGAGGTCCTGGGTGACTTTG GAAGTCCGTAGTGTCTCATTGCAGATAATTTTTAGC TTAGGGCCTGGTGGCTAGGTCGGTTCTCTCCTTTC CAGTCGGAGACCTCTGCCGCAAACATGCTCCGCC AGATCATCGGTCAGGCCAAGAAGCATCCGAGCTT GATCCCCCTCTTGTATTTATTGGAACTGGAGCTAC TGGAGCAACACTGTATCTCTTGCGTCTGGCATTGT TCAATCCAGATGTTTGTTGGGACAGAAATAACCCA GAGCCCTGGAACAAACTGGGTCCCAATGATCAATA CAAGTTCTACTCAGTGAATGTGGATTACAGCAAGC TGAAGAAGGAACGTCCAGATTTCTAAATGAAATGT TTCACTATAACGCTGCTTTAGAATGAAGGTCTTCCA GAAGCCACATCCGCACAATTTTCCACTTAACCAGG AAATATTTCTCCTCTAAATGCATGAAATCATGTTGG AGATCTCTATTGTAATCTCTATTGGAGATTACAATG ATTAAATCAATAAATAACTGAAACTTGATATGTGTC ACTTTTTTATGCTGAAAGTATGCTCTGAACTTTAGA GTATAGGAAATTAACTATTAGAATTTAAAGAATTTC TTGAATTTCTGTAGTTTGAAAATACGACTTTAAGCT GCTTTAGTAAAACACTTCCATTTTGTGTATAGACTG TTGGTAACTTCACTAGAGCATACATAACAACTGGA ACTGGAAATTATACAAAAGTAAATTGGGAAGGATA CTCCAGCATCTGACACTGGCAAAATGGAAACCTTT GAGTTTCTCTT | 48 | LYLLELELL EQHCISCV WHCSIQMF VGTEITQS PGTNWVP MINTSSTQ* |
| 1060 | NM_0024 89.2_242 | 242 | GGGTCCTTCAGGTAGGAGGTCCTGGGTGACTTTG GAAGTCCGTAGTGTCTCATTGCAGATAATTTTTAGC TTAGGGCCTGGTGGCTAGGTCGGTTCTCTCCTTTC CAGTCGGAGACCTCTGCCGCAAACATGCTCCGCC AGATCATCGGTCAGGCCAAGAAGCATCCGAGCTT GATCCCCCTCTTGTATTTATTGGAACTGGAGCTA CTGGAGCAACACTGTATCTCTTGCGTCTGGCATGT TCAATCCAGATGTTTGTTGGGACAGAAATAACCCA GAGCCCTGGAACAAACTGGGTCCCAATGATCAATA CAAGTTCTACTCAGTGAATGTGGATTACAGCAAGC TGAAGAAGGAACGTCCAGATTTCTAAATGAAATGT TTCACTATAACGCTGCTTTAGAATGAAGGTCTTCCA GAAGCCACATCCGCACAATTTTCCACTTAACCAGG AAATATTTCTCCTCTAAATGCATGAAATCATGTTGG AGATCTCTATTGTAATCTCTATTGGAGATTACAATG ATTAAATCAATAAATAACTGAAACTTGATATGTGTC ACTTTTTTATGCTGAAAGTATGCTCTGAACTTTAGA GTATAGGAAATTAACTATTAGAATTTAAAGAATTTC TTGAATTTCTGTAGTTTGAAAATACGACTTTAAGCT GCTTTAGTAAAACACTTCCATTTTGTGTATAGACTG TTGGTAACTTCACTAGAGCATACATAACAACTGGA | 29 | CSIQMFVG TEITQSPG TNWVPMIN TSSTQ* |

TABLE 3A-continued

| SEQ ID | identifier_position | position | modified_RNA | PAP length | PAP |
|---|---|---|---|---|---|
| | | | ACTGGAAATTATACAAAAGTAAATTGGGAAGGATACTCCAGCATCTGACACTGGCAAAATGGAAACCTTTGAGTTTCTCTT | | |
| 1061 | NM_0024 90.3_372 | 372 | GAGAGCCTCAGAGTCATCCTCCCGCCCACCCAGCATACAGGCGGGGCGTTCCTCCTTAGCCAATGGGAAAAGACATTCGCCCGCGGTCCGCACGCGCTGCTTGCAAAGGGGTGGGGTTGTGGAGTGGATGCTTTGGCAAGATGGCGGGGAGCGGCGTCCGCCAAGCTACTTCTACCGCCAGCACCTTCGTGAAGCCCATTTTCAGTCGGGACATGAACGAGGCCAAGCGGAGGGTGCGCGAGCTCTACCGCGCCTGGTATCGGGAGGTGCCGAACACTGTGCACCAATTCCAGCTGGACATCACTGTGAAAATGGGACGGGATAAAGTCCGAGAAATGTTTATGAAGAATGCCCATGTCACAGACCCCAGGTGGTTGATCTTCTGGTCATTAAGGGAAAGATCGAACTGGAAGAAACAATTAAAGTATGGAAGCAGCGGACACATGTTATGCGGTTCTTCCATGAAACAGAAGCGCCAAGGCCAAAGGATTTCCTATCCAAGTTCTATGTTGGCACGATCCATGAAGTCATTCAGTGGAAAGATGCACGTTGATACTATTTTAGAGCACAAATAAACTCACTATACAATGGTCACTTTGTGATAGAATTCCATTGATGAACCAATTTTCTGCAGCCTCTTTTTGCCTGAGCAAGTGGGACCTTGGTATACACATCACCTGTTCTTTCCCTTTTCTTGAAATGTGGTGTTTGCTGTAAATTGGATTGAATTATTTTTCTCAGAGCCTTGCATGTCAGTAAACAGGAAGGAAGGAGGCCATCTGTTCAAAAATTGTGACATTGGGCATGAGGCTGGACGACTTGTTAATGTAGTTGTTTCTATAGCCCCTATGATTAGACACTTCAGTGTCAGGGCACAGATTATCTAAAATTAGCCAGCTCTTCCTGTCAGGGATCAGGGCAGCACTAACAGGCGCAAAAGTAGAGCTGTCAAGATGGGCTAGTTTTCCTTGGGTTCTGAAGAAAATGGATGTGCAAAGGCTTGGCTCCGCTACTTGTAACAAG | 60 | WLIFWSLRERSNWKKQLKYGSSGHMLCGSSMKQKRQGQRISYPSSMLATIHEVIQWKDAR* |
| 1062 | NM_0024 92.2_116 | 116 | CTCCCTTCTTCCTCCTGCCCGTAGTAGCCATGGCGGCCATGAGTTTGTTGCGGCGGGTTTCGGTTACTGCGGTGGCAGCTCTGTCTGGCCGGCCCCTTGGCACTCGCCTCGGATTGGGGGCTTCCTCACTCGTGGCTTCCGAAGGCTGCTGCTCCTGTTCGACACAGTGGAGACCATGGGAAAAGACTATTTGTCATCAGACCTTCTAGATTCTATGACAGGCGTTTTTTGAAGTTATTGAGATTCTACATTGCATTGACTGGGATTCCAGTAGCAATTTTCATAACTCTGGTGAATGTATTCATTGGTCAAGCTGAACTAGCAGAAATTCCAGAAGGCTATGTCCCAGAACACTGGGAATATTATAAGCATCCCATATCAAGATGGATTGCCCGTAATTTCTATGATAGTCCTGAAAAGATATATGAAAGAACAATGGCCGTCCTTCAGATTGAAGCTGAAAAGGCTGAATTACGGGTAAAGGAGCTGGAAGTGCGAAAATTGATGCATGTGAGAGGAGATGGACCCTGGTATTACTATGAGACAATTGACAAGGAACTTATTGATCATTCTCCGAAAGCAACTCCTGACAATTAAGCATTTTTTTCTCCAAATACAAAGTATATTCTCTTTATTGGAAAATAAATTAATAAATATATTCTGTATTTTTGCTCTCCGTGAAAAACAAAAGAGCCTCTGACATTACTGTCTCTCAGTGTTGGTTCAGATTGAGGCTTTTGTTTGAGGAGTTTGGCTTCCAGTCCCCAAAGAAGGTTTAAAATGTACTAATAAAAACTGGAGAAATAGGAATTTTGTGAACTCCTAAAATTGTAGCAACTTTGAAAGGTTAGTGTTTTATTTACCTGACAAATGGAAGTTATAGAAGTCTAATAATGTTAAGCACCAGTAATTATAGTATTTTGTACAAATGCCTGTACTGTAGATGTCTGTATTATTGAGGGGCAACTCAGGATTTTAAGTTCCATAAAGTATTGAACCAACTCTAAAATGTTAACTCCTTAAT | 39 | LGASSLVAFRRLLLLFDTVETMGKDYLSSDLLDSMTGVF* |
| 1063 | NM_0024 92.2_194 | 194 | CTCCCTTCTTCCTCCTGCCCGTAGTAGCCATGGCGGCCATGAGTTTGTTGCGGCGGGTTTCGGTTACTGCGGTGGCAGCTCTGTCTGGCCGGCCCCTTGGCACTCGCCTCGGATTGGGGGCTTCCTCACTCGTGGCTTCCGAAGGCTGCTGCTCCTGTTCGACACAGTGGAGACCATGGGAAAAGACTATTGTCATCAGACCTTCTAGATTCTATGACAGGCGTTTTTTGAAGTTATTGAGATTCTACATTGCATTGACTGGGATTCCAGTAGCAATTTTCATAACTCTGGTGAATGTATTCATTGGTCAAGCTGAACTAGCAGAAATTCCAGAAGGCTATGTCCCAGAACACTGGGAATATTATAAGCATCCCATATCAAGATGGATTGCCCGTAATTTCTATGATAGTCCTGAAAAGATATATGAAAGAACAATGGCCGTCCTTCAGATTGAAGCTGAAAAGGCTGAATTACGGGTAAAGGAGCTGGAAGTGCGAAAATTGATGCATGTGAGAGGAGATG | 13 | LSSDLLDSMTGVF* |

TABLE 3A-continued

| SEQ ID | identifier_position | position | modified_RNA | PAP length | PAP |
|---|---|---|---|---|---|
| | | | GACCCTGGTATTACTATGAGACAATTGACAAGGAA CTTATTGATCATTCTCCGAAAGCAACTCCTGACAAT TAAGCATTTTTTCTCCAAATACAAAGTATATTCTCT TTATTGGAAAATAAATTAATAAATATATTCTGTATTT TTGCTCTCCGTGAAAAACAAAAGAGCCTCTGACAT TACTGTCTCTCAGTGTTGGTTCAGATTGAGGCTTTT GTTTGAGGAGTTTGGCTTCCAGTCCCCAAAGAAGG TTTAAAATGTACTAATAAAAACTGGAGAAATAGGAA TTTGTGAACTCCTAAAATTGTAGCAACTTTGAAAGG TTAGTGTTTTATTTACCTGACAAATGGAAGTTATAG AAGTCTAATAATGTTAAGCACCAGTAATTATAGTAT TTTGTACAAATGCCTGTACTGTAGATGTCTGTATTA TTGAGGGGCAACTCAGGATTTTAAGTTCCATAAAG TATTGAACCAACTCTAAAATGTTAACTCCTTAAT | | |
| 1064 | NM_0024 92.2_232 | 232 | CTCCCTTCTTCCTCCTGCCCGTAGTAGCCATGGCG GCCATGAGTTTGTTGCGGCGGGTTTCGGTTACTGC GGTGGCAGCTCTGTCTGGCCGGCCCCTTGGCACT CGCCTCGGATTTGGGGGCTTCCTCACTCGTGGCT TTCCGAAGGCTGCTGCTCCTGTTCGACACAGTGGA GACCATGGGAAAAGACTATTTGTCATCAGACCTTC TAGATTCTATGACAGGCGTTTTTGAAGTTATTGAGA TTCTACATTGCATTGACTGGGATTCCAGTAGCAATT TTCATAACTCTGGTGAATGTATTCATTGGTCAAGCT GAACTAGCAGAAATTCCAGAAGGCTATGTCCCAGA ACACTGGGAATATTATAAGCATCCCATATCAAGAT GGATTGCCCGTAATTTCTATGATAGTCCTGAAAAG ATATATGAAAGAACAATGGCCGTCCTTCAGATTGA AGCTGAAAAGGCTGAATTACGGGTAAAGGAGCTG GAAGTGCGAAAATTGATGCATGTGAGAGGAGATG GACCCTGGTATTACTATGAGACAATTGACAAGGAA CTTATTGATCATTCTCCGAAAGCAACTCCTGACAAT TAAGCATTTTTTCTCCAAATACAAAGTATATTCTCT TTATTGGAAAATAAATTAATAAATATATTCTGTATTT TTGCTCTCCGTGAAAAACAAAAGAGCCTCTGACAT TACTGTCTCTCAGTGTTGGTTCAGATTGAGGCTTTT GTTTGAGGAGTTTGGCTTCCAGTCCCCAAAGAAGG TTTAAAATGTACTAATAAAAACTGGAGAAATAGGAA TTTGTGAACTCCTAAAATTGTAGCAACTTTGAAAGG TTAGTGTTTTATTTACCTGACAAATGGAAGTTATAG AAGTCTAATAATGTTAAGCACCAGTAATTATAGTAT TTTGTACAAATGCCTGTACTGTAGATGTCTGTATTA TTGAGGGGCAACTCAGGATTTTAAGTTCCATAAAG TATTGAACCAACTCTAAAATGTTAACTCCTTAAT | 0 | * |
| 1065 | NM_0024 92.2_254 | 254 | CTCCCTTCTTCCTCCTGCCCGTAGTAGCCATGGCG GCCATGAGTTTGTTGCGGCGGGTTTCGGTTACTGC GGTGGCAGCTCTGTCTGGCCGGCCCCTTGGCACT CGCCTCGGATTTGGGGGCTTCCTCACTCGTGGCT TTCCGAAGGCTGCTGCTCCTGTTCGACACAGTGGA GACCATGGGAAAAGACTATTTGTCATCAGACCTTC TAGATTCTATGACAGGCGTTTTTGAAGTTATTGAG ATTCTACATGCATTGACTGGGATTCCAGTAGCAATT TTCATAACTCTGGTGAATGTATTCATTGGTCAAGCT GAACTAGCAGAAATTCCAGAAGGCTATGTCCCAGA ACACTGGGAATATTATAAGCATCCCATATCAAGAT GGATTGCCCGTAATTTCTATGATAGTCCTGAAAAG ATATATGAAAGAACAATGGCCGTCCTTCAGATTGA AGCTGAAAAGGCTGAATTACGGGTAAAGGAGCTG GAAGTGCGAAAATTGATGCATGTGAGAGGAGATG GACCCTGGTATTACTATGAGACAATTGACAAGGAA CTTATTGATCATTCTCCGAAAGCAACTCCTGACAAT TAAGCATTTTTTCTCCAAATACAAAGTATATTCTCT TTATTGGAAAATAAATTAATAAATATATTCTGTATTT TTGCTCTCCGTGAAAAACAAAAGAGCCTCTGACAT TACTGTCTCTCAGTGTTGGTTCAGATTGAGGCTTTT GTTTGAGGAGTTTGGCTTCCAGTCCCCAAAGAAGG TTTAAAATGTACTAATAAAAACTGGAGAAATAGGAA TTTGTGAACTCCTAAAATTGTAGCAACTTTGAAAGG TTAGTGTTTTATTTACCTGACAAATGGAAGTTATAG AAGTCTAATAATGTTAAGCACCAGTAATTATAGTAT TTTGTACAAATGCCTGTACTGTAGATGTCTGTATTA TTGAGGGGCAACTCAGGATTTTAAGTTCCATAAAG TATTGAACCAACTCTAAAATGTTAACTCCTTAAT | 2 | MH* |
| 1066 | NM_0024 92.2_308 | 308 | CTCCCTTCTTCCTCCTGCCCGTAGTAGCCATGGCG GCCATGAGTTTGTTGCGGCGGGTTTCGGTTACTGC GGTGGCAGCTCTGTCTGGCCGGCCCCTTGGCACT CGCCTCGGATTTGGGGGCTTCCTCACTCGTGGCT TTCCGAAGGCTGCTGCTCCTGTTCGACACAGTGGA | 5 | MVKLN* |

TABLE 3A-continued

| SEQ ID | identifier_position | position | modified_RNA | PAP length | PAP |
|---|---|---|---|---|---|
| | | | GACCATGGGAAAAGACTATTTGTCATCAGACCTTC<br>TAGATTCTATGACAGGCGTTTTTTGAAGTTATTGAG<br>ATTCTACATTGCATTGACTGGGATTCCAGTAGCAAT<br>TTTCATAACTCTGGTGAATGTATTCATGGTCAAGCT<br>GAACTAGCAGAAATTCCAGAAGGCTATGTCCCAGA<br>ACACTGGGAATATTATAAGCATCCCATATCAAGAT<br>GGATTGCCCGTAATTTCTATGATAGTCCTGAAAAG<br>ATATATGAAAGAACAATGGCCGTCCTTCAGATTGA<br>AGCTGAAAAGGCTGAATTACGGGTAAAGGAGCTG<br>GAAGTGCGAAAATTGATGCATGTGAGAGGAGATG<br>GACCCTGGTATTACTATGAGACAATTGACAAGGAA<br>CTTATTGATCATTCTCCGAAAGCAACTCCTGACAAT<br>TAAGCATTTTTTCTCCAAATACAAAGTATATTCTCT<br>TTATTGGAAAATAAATTAATAAATATATTCTGTATTT<br>TTGCTCTCCGTGAAAAACAAAAGAGCCTCTGACAT<br>TACTGTCTCTCAGTGTTGGTTCAGATTGAGGCTTTT<br>GTTTGAGGAGTTTGGCTTCCAGTCCCCAAAGAAGG<br>TTTAAAATGTACTAATAAAAACTGGAGAAATAGGAA<br>TTTGTGAACTCCTAAAATTGTAGCAACTTTGAAAGG<br>TTAGTGTTTATTTACCTGACAAATGGAAGTTATAG<br>AAGTCTAATAATGTTAAGCACCAGTAATTATAGTAT<br>TTTGTACAAATGCCTGTACTGTAGATGTCTGTATTA<br>TTGAGGGGCAACTCAGGATTTTAAGTTCCATAAAG<br>TATTGAACCAACTCTAAAATGTTAACTCCTTAAT | | |
| 1067 | NM_0024<br>92.2_443 | 443 | CTCCCTTCTTCCTCCTGCCCGTAGTAGCCATGGCG<br>GCCATGAGTTTGTTGCGGCGGGTTTCGGTTACTGC<br>GGTGGCAGCTCTGTCTGGCCGGCCCCTTGGCACT<br>CGCCTCGGATTTGGGGGCTTCCTCACTCGTGGCT<br>TTCCGAAGGCTGCTGCTCCTGTTCGACACAGTGGA<br>GACCATGGGAAAAGACTATTTGTCATCAGACCTTC<br>TAGATTCTATGACAGGCGTTTTTTGAAGTTATTGAG<br>ATTCTACATTGCATTGACTGGGATTCCAGTAGCAAT<br>TTTCATAACTCTGGTGAATGTATTCATTGGTCAAGC<br>TGAACTAGCAGAAATTCCAGAAGGCTATGTCCCAG<br>AACACTGGGAATATTATAAGCATCCCATATCAAGAT<br>GGATTGCCCGTAATTTCTATGATAGTCCTGAAAAG<br>ATATATGAAAGAACAATGGCCGTCCTTCAGATTGAA<br>GCTGAAAAGGCTGAATTACGGGTAAAGGAGCTGG<br>AAGTGCGAAAATTGATGCATGTGAGAGGAGATGG<br>ACCCTGGTATTACTATGAGACAATTGACAAGGAAC<br>TTATTGATCATTCTCCGAAAGCAACTCCTGACAATT<br>AAGCATTTTTTCTCCAAATACAAAGTATATTCTCTT<br>TATTGGAAAATAAATTAATAAATATATTCTGTATTTT<br>TGCTCTCCGTGAAAAACAAAAGAGCCTCTGACATT<br>ACTGTCTCTCAGTGTTGGTTCAGATTGAGGCTTTT<br>GTTTGAGGAGTTTGGCTTCCAGTCCCCAAAGAAGG<br>TTTAAAATGTACTAATAAAAACTGGAGAAATAGGAA<br>TTTGTGAACTCCTAAAATTGTAGCAACTTTGAAAGG<br>TTAGTGTTTATTTACCTGACAAATGGAAGTTATAG<br>AAGTCTAATAATGTTAAGCACCAGTAATTATAGTAT<br>TTTGTACAAATGCCTGTACTGTAGATGTCTGTATTA<br>TTGAGGGGCAACTCAGGATTTTAAGTTCCATAAAG<br>TATTGAACCAACTCTAAAATGTTAACTCCTTAAT | 12 | SFRLKLKR<br>LNYG* |
| 1068 | NM_0024<br>92.2_96 | 96 | CTCCCTTCTTCCTCCTGCCCGTAGTAGCCATGGCG<br>GCCATGAGTTTGTTGCGGCGGGTTTCGGTTACTGC<br>GGTGGCAGCTCTGTCTGGCCGGCCCCTTGGCACTC<br>GCCTCGGATTTGGGGGCTTCCTCACTCGTGGCTTT<br>CCGAAGGCTGCTGCTCCTGTTCGACACAGTGGAG<br>ACCATGGGAAAAGACTATTTGTCATCAGACCTTCT<br>AGATTCTATGACAGGCGTTTTTTGAAGTTATTGAGA<br>TTCTACATTGCATTGACTGGGATTCCAGTAGCAATT<br>TTCATAACTCTGGTGAATGTATTCATTGGTCAAGCT<br>GAACTAGCAGAAATTCCAGAAGGCTATGTCCCAGA<br>ACACTGGGAATATTATAAGCATCCCATATCAAGAT<br>GGATTGCCCGTAATTTCTATGATAGTCCTGAAAAG<br>ATATATGAAAGAACAATGGCCGTCCTTCAGATTGA<br>AGCTGAAAAGGCTGAATTACGGGTAAAGGAGCTG<br>GAAGTGCGAAAATTGATGCATGTGAGAGGAGATG<br>GACCCTGGTATTACTATGAGACAATTGACAAGGAA<br>CTTATTGATCATTCTCCGAAAGCAACTCCTGACAAT<br>TAAGCATTTTTTCTCCAAATACAAAGTATATTCTCT<br>TTATTGGAAAATAAATTAATAAATATATTCTGTATTT<br>TTGCTCTCCGTGAAAAACAAAAGAGCCTCTGACAT<br>TACTGTCTCTCAGTGTTGGTTCAGATTGAGGCTTTT<br>GTTTGAGGAGTTTGGCTTCCAGTCCCCAAAGAAGG<br>TTTAAAATGTACTAATAAAAACTGGAGAAATAGGAA<br>TTTGTGAACTCCTAAAATTGTAGCAACTTTGAAAGG | 44 | ALASDLGA<br>SSLVAFRR<br>LLLLFDTVE<br>TMGKDYLS<br>SDLLDSMT<br>GVF* |

TABLE 3A-continued

| SEQ ID | identifier_position | position | modified_RNA | PAP length | PAP |
|---|---|---|---|---|---|
| 1069 | NM_0024 95.1_96 | 96 | TTAGTGTTTTATTTACCTGACAAATGGAAGTTATAG AAGTCTAATAATGTTAAGCACCAGTAATTATAGTAT TTTGTACAAATGCCTGTACTGTAGATGTCTGTATTA TTGAGGGGCAACTCAGGATTTTAAGTTCCATAAAG TATTGAACCAACTCTAAAATGTTAACTCCTTAAT GCAGCAAGATGGCGGCGGTCTCAATGTCAGTGGT ACTGAGGCAGACGTTGTGGCGGAGAAGGGCAGTG GCTGTAGCTGCCCTTTCCGTTTCCAGGTTCCGACC AGGTCGTTGAGGACTTCCACATGGAGATTGGCAC AGGACCAGACTCAAGACACACAACTCATAACAGTT GATGAAAAATTGGATATCACTACTTTAACTGGCGTT CCAGAAGAGCATATAAAAACTAGAAAAGTCAGGAT CTTTGTTCCTGCTCGCAATAACATGCAGTCTGGAG TAAACAACACAAAGAAATGGAAGATGGAGTTTGAT ACCAGGGAGCGATGGGAAAATCCTTTGATGGGTT GGGCATCAACGGCTGATCCCTTATCCAACATGGTT CTAACCTTCAGTACTAAAGAAGATGCAGTTTCCTTT GCAGAAAAAAATGGATGGAGCTATGACATTGAAGA GAGGAAGGTTCCAAAACCCAAGTCCAAGTCTTATG GTGCAAACTTTTCTTGGAACAAAAGAACAAGAGTA TCCACAAAATAGGTTGGCACTGACTATATCTCTGC TTGACTGTGAATAAAGTCAGCTATGCAGTATTTATA GTCCATGTATAATAAATACATCTCTTAATCTCCTAA TAAATTGGACCTTTAAACTACAAAAAAAAAAAAAA A | 5 | FRPGR* |
| 1070 | NM_0025 20.5_216 | 216 | GGGAAGCGCTCGCGAGATCTTCAGGGTCTATATAT AAGCGCGGGGAGCCTGCGTCCTTTCCCTGGTGTG ATTCCGTCCTGCGCGGTTGTTCTCTGGAGCAGCGT TCTTTTATCTCCGTCCGCCTTCTCTCCTACCTAAGT GCGTGCCGCCACCCGATGGAAGATTCGATGGACA TGGACATGAGCCCCCTGAGGCCCCAGAACTATCT TTTCGGTGTGAACTAAAGGCCGACAAAGATTATCA CTTTAAGGTGGATAATGATGAAAATGAGCACCAGT TATCTTTAAGAACGGTCAGTTTAGGGGCTGGTGCA AAGGATGAGTTGCACATTGTTGAAGCAGAGGCAAT GAATTACGAAGGCAGTCCAATTAAAGTAACACTGG CAACTTTGAAAATGTCTGTACAGCCAACGGTTTCC CTTGGGGGCTTTGAAATAACACCACCAGTGGTCTT AAGGTTGAAGTGTGGTTCAGGGCCAGTGCATATTA GTGGACAGCACTTAGTAGCTGTGGAGGAAGATGC AGAGTCAGAAGATGAAGAGGAGGAGGATGTGAAA CTCTTAAGTATATCTGGAAAGCGGTCTGCCCCTGG AGGTGGTAGCAAGGTTCCACAGAAAAAAGTAAAAC TTGCTGCTGATGAAGATGATGACGATGATGATGAA GAGGATGATGATGAAGATGATGATGATGATGATTT TGATGATGAGGAAGCTGAAGAAAAAGCGCCAGTG AAGAAATCTATACGAGATACTCCAGCCAAAAATGC ACAAAAGTCAAATCAGAATGGAAAAGACTCAAAAC CATCATCAACACCAAGATCAAAAGGACAAGAATCC TTCAAGAAACAGGAAAAAACTCCTAAAACACCAAA AGGACCTAGTTCTGTAGAAGACATTAAAGCAAAAA TGCAAGCAAGTATAGAAAAAGGTGGTTCTCTTCCC AAAGTGGAAGCCAAATTCATCAATTATGTGAAGAA TTGCTTCCGGATGACTGACCAAGAGGCTATTCAAG ATCTCTGGCAGTGG | 2 | VN* |
| 1071 | NM_0025 20.5_332 | 332 | GGGAAGCGCTCGCGAGATCTTCAGGGTCTATATAT AAGCGCGGGGAGCCTGCGTCCTTTCCCTGGTGTG ATTCCGTCCTGCGCGGTTGTTCTCTGGAGCAGCGT TCTTTTATCTCCGTCCGCCTTCTCTCCTACCTAAGT GCGTGCCGCCACCCGATGGAAGATTCGATGGACA TGGACATGAGCCCCCTGAGGCCCCAGAACTATCT TTTCGGTTGTGAACTAAAGGCCGACAAAGATTATC ACTTTAAGGTGGATAATGATGAAAATGAGCACCAG TTATCTTTAAGAACGGTCAGTTTAGGGGCTGGTGC AAAGGATGAGTTGCACATGTTGAAGCAGAGGCAAT GAATTACGAAGGCAGTCCAATTAAAGTAACACTGG CAACTTTGAAAATGTCTGTACAGCCAACGGTTTCC CTTGGGGGCTTTGAAATAACACCACCAGTGGTCTT AAGGTTGAAGTGTGGTTCAGGGCCAGTGCATATTA GTGGACAGCACTTAGTAGCTGTGGAGGAAGATGC AGAGTCAGAAGATGAAGAGGAGGAGGATGTGAAA CTCTTAAGTATATCTGGAAAGCGGTCTGCCCCTGG AGGTGGTAGCAAGGTTCCACAGAAAAAAGTAAAAC TTGCTGCTGATGAAGATGATGACGATGATGATGAA GAGGATGATGATGAAGATGATGATGATGATGATTT TGATGATGAGGAAGCTGAAGAAAAAGCGCCAGTG AAGAAATCTATACGAGATACTCCAGCCAAAAATGC | 6 | MLKQRQ* |

TABLE 3A-continued

| SEQ ID | identifier_position | position | modified_RNA | PAP length | PAP |
|---|---|---|---|---|---|
| | | | ACAAAAGTCAAATCAGAATGGAAAAGACTCAAAAC<br>CATCATCAACACCAAGATCAAAAGGACAAGAATCC<br>TTCAAGAAACAGGAAAAAACTCCTAAAACACCAAA<br>AGGACCTAGTTCTGTAGAAGACATTAAAGCAAAAA<br>TGCAAGCAAGTATAGAAAAAGGTGGTTCTCTTCCC<br>AAAGTGGAAGCCAAATTCATCAATTATGTGAAGAA<br>TTGCTTCCGGATGACTGACCAAGAGGCTATTCAAG<br>ATCTCTGGCAGTGG | | |
| 1072 | NM_0025 20.5_412 | 412 | GGGAAGCGCTCGCGAGATCTTCAGGGTCTATATAT<br>AAGCGCGGGGAGCCTGCGTCCTTTCCCTGGTGTG<br>ATTCCGTCCTGCGCGGTTGTTCTCTGGAGCAGCGT<br>TCTTTTATCTCCGTCCGCCTTCTCTCCTACCTAAGT<br>GCGTGCCGCCACCCGATGGAAGATTCGATGGACA<br>TGGACATGAGCCCCCTGAGGCCCCAGAACTATCT<br>TTTCGGTTGTGAACTAAAGGCCGACAAAGATTATC<br>ACTTTAAGGTGGATAATGATGAAAATGAGCACCAG<br>TTATCTTTAAGAACGGTCAGTTTAGGGGCTGGTGC<br>AAAGGATGAGTTGCACATTGTTGAAGCAGAGGCAA<br>TGAATTACGAAGGCAGTCCAATTAAAGTAACACTG<br>GCAACTTTGAAAATGTCTGTACAGCCAAGGTTTCC<br>CTTGGGGGCTTTGAAATAACACCACCAGTGGTCTT<br>AAGGTTGAAGTGTGGTTCAGGGCCAGTGCATATTA<br>GTGGACAGCACTTAGTAGCTGTGGAGGAAGATGC<br>AGAGTCAGAAGATGAAGAGGAGGAGGATGTGAAA<br>CTCTTAAGTATATCTGGAAAGCGGTCTGCCCCTGG<br>AGGTGGTAGCAAGGTTCCACAGAAAAAAGTAAAAC<br>TTGCTGCTGATGAAGATGATGACGATGATGATGAA<br>GAGGATGATGATGAAGATGATGATGATGATGATTT<br>TGATGATGAGGAAGCTGAAGAAAAAGCGCCAGTG<br>AAGAAATCTATACGAGATACTCCAGCCAAAAAATGC<br>ACAAAAGTCAAATCAGAATGGAAAAGACTCAAAAC<br>CATCATCAACACCAAGATCAAAAGGACAAGAATCC<br>TTCAAGAAACAGGAAAAAACTCCTAAAACACCAAA<br>AGGACCTAGTTCTGTAGAAGACATTAAAGCAAAAA<br>TGCAAGCAAGTATAGAAAAAGGTGGTTCTCTTCCC<br>AAAGTGGAAGCCAAATTCATCAATTATGTGAAGAA<br>TTGCTTCCGGATGACTGACCAAGAGGCTATTCAAG<br>ATCTCTGGCAGTGG | 8 | RFPLGALK* |
| 1073 | NM_0025 20.5_431 | 431 | GGGAAGCGCTCGCGAGATCTTCAGGGTCTATATAT<br>AAGCGCGGGGAGCCTGCGTCCTTTCCCTGGTGTG<br>ATTCCGTCCTGCGCGGTTGTTCTCTGGAGCAGCGT<br>TCTTTTATCTCCGTCCGCCTTCTCTCCTACCTAAGT<br>GCGTGCCGCCACCCGATGGAAGATTCGATGGACA<br>TGGACATGAGCCCCCTGAGGCCCCAGAACTATCT<br>TTTCGGTTGTGAACTAAAGGCCGACAAAGATTATC<br>ACTTTAAGGTGGATAATGATGAAAATGAGCACCAG<br>TTATCTTTAAGAACGGTCAGTTTAGGGGCTGGTGC<br>AAAGGATGAGTTGCACATTGTTGAAGCAGAGGCAA<br>TGAATTACGAAGGCAGTCCAATTAAAGTAACACTG<br>GCAACTTTGAAAATGTCTGTACAGCCAACGGTTTC<br>CCTTGGGGGCTTGAAATAACACCACCAGTGGTCTT<br>AAGGTTGAAGTGTGGTTCAGGGCCAGTGCATATTA<br>GTGGACAGCACTTAGTAGCTGTGGAGGAAGATGC<br>AGAGTCAGAAGATGAAGAGGAGGAGGATGTGAAA<br>CTCTTAAGTATATCTGGAAAGCGGTCTGCCCCTGG<br>AGGTGGTAGCAAGGTTCCACAGAAAAAAGTAAAAC<br>TTGCTGCTGATGAAGATGATGACGATGATGATGAA<br>GAGGATGATGATGAAGATGATGATGATGATGATTT<br>TGATGATGAGGAAGCTGAAGAAAAAGCGCCAGTG<br>AAGAAATCTATACGAGATACTCCAGCCAAAAAATGC<br>ACAAAAGTCAAATCAGAATGGAAAAGACTCAAAAC<br>CATCATCAACACCAAGATCAAAAGGACAAGAATCC<br>TTCAAGAAACAGGAAAAAACTCCTAAAACACCAAA<br>AGGACCTAGTTCTGTAGAAGACATTAAAGCAAAAA<br>TGCAAGCAAGTATAGAAAAAGGTGGTTCTCTTCCC<br>AAAGTGGAAGCCAAATTCATCAATTATGTGAAGAA<br>TTGCTTCCGGATGACTGACCAAGAGGCTATTCAAG<br>ATCTCTGGCAGTGG | 2 | LK* |
| 1074 | NM_0025 20.5_558 | 558 | GGGAAGCGCTCGCGAGATCTTCAGGGTCTATATAT<br>AAGCGCGGGGAGCCTGCGTCCTTTCCCTGGTGTG<br>ATTCCGTCCTGCGCGGTTGTTCTCTGGAGCAGCGT<br>TCTTTTATCTCCGTCCGCCTTCTCTCCTACCTAAGT<br>GCGTGCCGCCACCCGATGGAAGATTCGATGGACA<br>TGGACATGAGCCCCCTGAGGCCCCAGAACTATCT<br>TTTCGGTTGTGAACTAAAGGCCGACAAAGATTATC<br>ACTTTAAGGTGGATAATGATGAAAATGAGCACCAG<br>TTATCTTTAAGAACGGTCAGTTTAGGGGCTGGTGC | 1 | S* |

| SEQ ID | identifier_position | position | modified_RNA | PAP length | PAP |
|---|---|---|---|---|---|
| | | | AAAGGATGAGTTGCACATTGTTGAAGCAGAGGCAA<br>TGAATTACGAAGGCAGTCCAATTAAAGTAACACTG<br>GCAACTTTGAAAATGTCTGTACAGCCAACGGTTTC<br>CCTTGGGGGCTTTGAAATAACACCACCAGTGGTCT<br>TAAGGTTGAAGTGTGGTTCAGGGCCAGTGCATATT<br>AGTGGACAGCACTTAGTAGCTGTGGAGGAAGATG<br>CAGAGTCAGAAGATGAAGAGGAGGAGGATGTGAA<br>ATCTTAAGTATATCTGGAAAGCGGTCTGCCCCTGG<br>AGGTGGTAGCAAGGTTCCACAGAAAAAAGTAAAAC<br>TTGCTGCTGATGAAGATGATGACGATGATGATGAA<br>GAGGATGATGATGAAGATGATGATGATGATGATTT<br>TGATGATGAGGAAGCTGAAGAAAAAGCGCCAGTG<br>AAGAAATCTATACGAGATACTCCAGCCAAAAATGC<br>ACAAAAGTCAAATCAGAATGGAAAAGACTCAAAAC<br>CATCATCAACACCAAGATCAAAAGGACAAGAATCC<br>TTCAAGAAACAGGAAAAAACTCCTAAAACACCAAA<br>AGGACCTAGTTCTGTAGAAGACATTAAAGCAAAAA<br>TGCAAGCAAGTATAGAAAAAGGTGGTTCTCTTCCC<br>AAAGTGGAAGCCAAATTCATCAATTATGTGAAGAA<br>TTGCTTCCGGATGACTGACCAAGAGGCTATTCAAG<br>ATCTCTGGCAGTGG | | |
| 1075 | NM_0025<br>20.5_589 | 589 | GGGAAGCGCTCGCGAGATCTTCAGGGTCTATATAT<br>AAGCGCGGGGAGCCTGCGTCCTTTCCCTGGTGTG<br>ATTCCGTCCTGCGCGGTTGTTCTCTGGAGCAGCGT<br>TCTTTTATCTCCGTCCGCCTTCTCTCCTACCTAAGT<br>GCCGTGCCGCCACCCGATGGAAGATTCGATGGACA<br>TGGACATGAGCCCCCTGAGGCCCCAGAACTATCT<br>TTTCGGTTGTGAACTAAAGGCCGACAAAGATTATC<br>ACTTTAAGGTGGATAATGATGAAAATGAGCACCAG<br>TTATCTTTAAGAACGGTCAGTTTAGGGGCTGGTGC<br>AAAGGATGAGTTGCACATTGTTGAAGCAGAGGCAA<br>TGAATTACGAAGGCAGTCCAATTAAAGTAACACTG<br>GCAACTTTGAAAATGTCTGTACAGCCAACGGTTTC<br>CCTTGGGGGCTTTGAAATAACACCACCAGTGGTCT<br>TAAGGTTGAAGTGTGGTTCAGGGCCAGTGCATATT<br>AGTGGACAGCACTTAGTAGCTGTGGAGGAAGATG<br>CAGAGTCAGAAGATGAAGAGGAGGAGGATGTGAA<br>ACTCTTAAGTATATCTGGAAAGCGGTCTGCCCTGG<br>AGGTGGTAGCAAGGTTCCACAGAAAAAAGTAAAAC<br>TTGCTGCTGATGAAGATGATGACGATGATGATGAA<br>GAGGATGATGATGAAGATGATGATGATGATGATTT<br>TGATGATGAGGAAGCTGAAGAAAAAGCGCCAGTG<br>AAGAAATCTATACGAGATACTCCAGCCAAAAATGC<br>ACAAAAGTCAAATCAGAATGGAAAAGACTCAAAAC<br>CATCATCAACACCAAGATCAAAAGGACAAGAATCC<br>TTCAAGAAACAGGAAAAAACTCCTAAAACACCAAA<br>AGGACCTAGTTCTGTAGAAGACATTAAAGCAAAAA<br>TGCAAGCAAGTATAGAAAAAGGTGGTTCTCTTCCC<br>AAAGTGGAAGCCAAATTCATCAATTATGTGAAGAA<br>TTGCTTCCGGATGACTGACCAAGAGGCTATTCAAG<br>ATCTCTGGCAGTGG | 11 | LEVVARFH<br>RKK* |
| 1076 | NM_0025<br>68.3_1014 | 1014 | CCCTTCTCCCCGGCGGTTAGTGCTGAGAGTGCGG<br>AGTGTGTGCTCCGGGCTCGGAACACACATTTATTA<br>TTAAAAAAATCCAAAAAAAAATCTAAAAAAAATCTTTTAA<br>AAAACCCCAAAAAAAATTTACAAAAAATCCGCGTCTC<br>CCCCGCCGGAGACTTTTATTTTTTTTCTTCCTCTTT<br>TATAAAATAACCCGGTGAAGCAGCCGAGACCGAC<br>CCGCCCGCCCGCGGCCCCGCAGCAGCTCCAAGA<br>AGGAACCAAGAGACCGAGGCCTTCCCGCTGCCCG<br>GACCCGACACCGCCACCCTCGCTCCCCGCCGGCA<br>GCCGGCAGCCAGCGGCAGTGGATCGACCCCGTT<br>CTGCGGCCGTTGAGTAGTTTTCAATTCCGGTTGAT<br>TTTTGTCCCTCTGCGCTTGCTCCCCGCTCCCCTCC<br>CCCCGGCTCCGGCCCCAGCCCCGGCACTCGCT<br>CTCCTCCTCTCACGGAAAGGTCGCGGCCTGTGGC<br>CCTGCGGGCAGCCGTGCCGAGATGAACCCCAGTG<br>CCCCCAGCTACCCCATGGCCTCGCTCTACGTGGG<br>GGACCTCCACCCCGACGTGACCGAGGCGATGCTC<br>TACGAGAAGTTCAGCCCGGCCGGGCCCATCCTCT<br>CCATCCGGGTCTGCAGGGACATGATCACCCGCCG<br>CTCCTTGGGCTACGCGTATGTGAACTTCCAGCAGC<br>CGGCGGACGCGGAGCGTGCTTTGGACACCATGAA<br>TTTTGATGTTATAAAGGGCAAGCCAGTACGCATCA<br>TGTGGTCTCAGCGTGATCCATCACTTCGCAAAAGT<br>GGAGTAGGCAACATATTCATTAAAAATCTGGACAA<br>ATCCATTGATAATAAAGCACTGTATGATACATTTTC<br>TGCTTTTGGTAACATCCTTTCATGTAAGGTGGTTTG | 47 | DDLSLVKN<br>EKLNLELG<br>QKNSPMFT<br>SRILEKTW<br>MMSALRIS<br>LASLGLP* |

TABLE 3A-continued

| SEQ ID | identifier_position | position | modified_RNA | PAP length | PAP |
|---|---|---|---|---|---|
| | | | TGATGAAAATGGTTCCAAGGGCTATGGATTTGTAC ACTTTGAGACGCAGGAAGCAGCTGAAAGAGCTATT GAAAAAATGAATGGAATGCTCCTAAATGATCGCAA AGTATTTGTGGACGATTTAA | | |
| 1077 | NM_0025 68.3_1098 | 1098 | CCCTTCTCCCCGGCGGTTAGTGCTGAGAGTGCGG AGTGTGTGCTCCGGGCTCGGAACACACATTTATTA TTAAAAAATCCAAAAAAAATCTAAAAAAAATCTTTTAA AAAACCCCAAAAAAATTTACAAAAAATCCGCGTCTC CCCCGCCGGAGACTTTTATTTTTTTTCTTCCTCTTT TATAAAATAACCCGGTGAAGCAGCCGAGACCGAC CCGCCCGCCCGCGGCCCCGCAGCAGCTCCAAGA AGGAACCAAGAGACCGAGGCCTTCCCGCTGCCCG GACCCGACACCGCCACCCTCGCTCCCCGCCGGCA GCCGGCAGCCAGCGGCAGTGGATCGACCCCGTT CTGCGGCCGTTGAGTAGTTTTCAATTCCGGTTGAT TTTTGTCCCTCTGCGCTTGCTCCCCGCTCCCCTCC CCCCGGCTCCGGCCCCCAGCCCCGGCACTCGCT CTCCTCCTCTCACGGAAAGGTCGCGGCCTGTGGC CCTGCGGGCAGCCGTGCCGAGATGAACCCCAGTG CCCCCAGCTACCCCATGGCCTCGCTCTACGTGGG GGACCTCCACCCCGACGTGACCGAGGCGATGCTC TACGAGAAGTTCAGCCCGGCCGGGCCCATCCTCT CCATCCGGGTCTGCAGGGACATGATCACCCGCCG CTCCTTGGGCTACGCGTATGTGAACTTCCAGCAGC CGGCGGACGCGGAGCGTGCTTTGGACACCATGAA TTTTGATGTTATAAAGGGCAAGCCAGTACGCATCA TGTGGTCTCAGCGTGATCCATCACTTCGCAAAAGT GGAGTAGGCAACATATTCATTAAAAATCTGGACAA ATCCATTGATAATAAAGCACTGTATGATACATTTTC TGCTTTTGGTAACATCCTTTCATGTAAGGTGGTTTG TGATGAAAATGGTTCCAAGGGCTATGGATTTGTAC ACTTTGAGACGCAGGAAGCAGCTGAAAGAGCTATT GAAAAAATGAATGGAATGCTCCTAAATGATCGCAA AGTATTTGTTGGACGATTTA | 20 | LEKTWMM SALRISLAS LGLP* |
| 1078 | NM_0025 68.3_1203 | 1203 | CCCTTCTCCCCGGCGGTTAGTGCTGAGAGTGCGG AGTGTGTGCTCCGGGCTCGGAACACACATTTATTA TTAAAAAATCCAAAAAAAATCTAAAAAAAATCTTTTAA AAAACCCCAAAAAAATTTACAAAAAATCCGCGTCTC CCCCGCCGGAGACTTTTATTTTTTTTCTTCCTCTTT TATAAAATAACCCGGTGAAGCAGCCGAGACCGAC CCGCCCGCCCGCGGCCCCGCAGCAGCTCCAAGA AGGAACCAAGAGACCGAGGCCTTCCCGCTGCCCG GACCCGACACCGCCACCCTCGCTCCCCGCCGGCA GCCGGCAGCCAGCGGCAGTGGATCGACCCCGTT CTGCGGCCGTTGAGTAGTTTTCAATTCCGGTTGAT TTTTGTCCCTCTGCGCTTGCTCCCCGCTCCCCTCC CCCCGGCTCCGGCCCCCAGCCCCGGCACTCGCT CTCCTCCTCTCACGGAAAGGTCGCGGCCTGTGGC CCTGCGGGCAGCCGTGCCGAGATGAACCCCAGTG CCCCCAGCTACCCCATGGCCTCGCTCTACGTGGG GGACCTCCACCCCGACGTGACCGAGGCGATGCTC TACGAGAAGTTCAGCCCGGCCGGGCCCATCCTCT CCATCCGGGTCTGCAGGGACATGATCACCCGCCG CTCCTTGGGCTACGCGTATGTGAACTTCCAGCAGC CGGCGGACGCGGAGCGTGCTTTGGACACCATGAA TTTTGATGTTATAAAGGGCAAGCCAGTACGCATCA TGTGGTCTCAGCGTGATCCATCACTTCGCAAAAGT GGAGTAGGCAACATATTCATTAAAAATCTGGACAA ATCCATTGATAATAAAGCACTGTATGATACATTTTC TGCTTTTGGTAACATCCTTTCATGTAAGGTGGTTTG TGATGAAAATGGTTCCAAGGGCTATGGATTTGTAC ACTTTGAGACGCAGGAAGCAGCTGAAAGAGCTATT GAAAAAATGAATGGAATGCTCCTAAATGATCGCAA AGTATTTGTTGGACGATTTA | 3 | LDL* |
| 1079 | NM_0025 68.3_1293 | 1293 | CCCTTCTCCCCGGCGGTTAGTGCTGAGAGTGCGG AGTGTGTGCTCCGGGCTCGGAACACACATTTATTA TTAAAAAATCCAAAAAAAATCTAAAAAAAATCTTTTAA AAAACCCCAAAAAAATTTACAAAAAATCCGCGTCTC CCCCGCCGGAGACTTTTATTTTTTTTCTTCCTCTTT TATAAAATAACCCGGTGAAGCAGCCGAGACCGAC CCGCCCGCCCGCGGCCCCGCAGCAGCTCCAAGA AGGAACCAAGAGACCGAGGCCTTCCCGCTGCCCG GACCCGACACCGCCACCCTCGCTCCCCGCCGGCA GCCGGCAGCCAGCGGCAGTGGATCGACCCCGTT CTGCGGCCGTTGAGTAGTTTTCAATTCCGGTTGAT TTTTGTCCCTCTGCGCTTGCTCCCCGCTCCCCTCC CCCCGGCTCCGGCCCCCAGCCCCGGCACTCGCT | 19 | VELRKRW NG RRNLSA NLNR* |

TABLE 3A-continued

| SEQ ID | identifier_position | position | modified_RNA | PAP length | PAP |
|---|---|---|---|---|---|
| | | | CTCCTCCTCTCACGGAAAGGTCGCGGCCTGTGGC<br>CCTGCGGGCAGCCGTGCCGAGATGAACCCCAGTG<br>CCCCCAGCTACCCCATGGCCTCGCTCTACGTGGG<br>GGACCTCCACCCCGACGTGACCGAGGCGATGCTC<br>TACGAGAAGTTCAGCCCGGCCGGGCCCATCCTCT<br>CCATCCGGGTCTGCAGGGACATGATCACCCGCCG<br>CTCCTTGGGCTACGCGTATGTGAACTTCCAGCAGC<br>CGGCGGACGCGGAGCGTGCTTTGGACACCATGAA<br>TTTTGATGTTATAAAGGGCAAGCCAGTACGCATCA<br>TGTGGTCTCAGCGTGATCCATCACTTCGCAAAAGT<br>GGAGTAGGCAACATATTCATTAAAAATCTGGACAA<br>ATCCATTGATAATAAAGCACTGTATGATACATTTTC<br>TGCTTTTGGTAACATCCTTTCATGTAAGGTGGTTTG<br>TGATGAAAATGGTTCCAAGGGCTATGGATTTGTAC<br>ACTTTGAGACGCAGGAAGCAGCTGAAAGAGCTATT<br>GAAAAAATGAATGGAATGCTCCTAAATGATCGCAA<br>AGTATTTGTTGGACGATTTA | | |
| 1080 | NM_0025<br>68.3_1382 | 1382 | CCCTTCTCCCCGGCGGTTAGTGCTGAGAGTGCGG<br>AGTGTGTGCTCCGGGCTCGGAACACACATTTATTA<br>TTAAAAAATCCAAAAAAAAATCTAAAAAAATCTTTTAA<br>AAAACCCCAAAAAAATTTACAAAAAATCCGCGTCTC<br>CCCCGCCGGAGACTTTTATTTTTTTTCTTCCTCTTT<br>TATAAAATAACCCGGTGAAGCAGCCGAGACCGAC<br>CCGCCCGCCCGCGGCCCCGCAGCAGCTCCAAGA<br>AGGAACCAAGAGACCGAGGCCTTCCCGCTGCCCG<br>GACCCGACACCGCCACCCTCGCTCCCCGCCGGCA<br>GCCGGCAGCCAGCGGCAGTGGATCGACCCCGTT<br>CTGCGGCCGTTGAGTAGTTTTCAATTCCGGTTGAT<br>TTTTGTCCCTCTGCGCTTGCTCCCCGCTCCCCTCC<br>CCCCGGCTCCGGCCCCAGCCCCGGCACTCGCT<br>CTCCTCCTCTCACGGAAAGGTCGCGGCCTGTGGC<br>CCTGCGGGCAGCCGTGCCGAGATGAACCCCAGTG<br>CCCCCAGCTACCCCATGGCCTCGCTCTACGTGGG<br>GGACCTCCACCCCGACGTGACCGAGGCGATGCTC<br>TACGAGAAGTTCAGCCCGGCCGGGCCCATCCTCT<br>CCATCCGGGTCTGCAGGGACATGATCACCCGCCG<br>CTCCTTGGGCTACGCGTATGTGAACTTCCAGCAGC<br>CGGCGGACGCGGAGCGTGCTTTGGACACCATGAA<br>TTTTGATGTTATAAAGGGCAAGCCAGTACGCATCA<br>TGTGGTCTCAGCGTGATCCATCACTTCGCAAAAGT<br>GGAGTAGGCAACATATTCATTAAAAATCTGGACAA<br>ATCCATTGATAATAAAGCACTGTATGATACATTTTC<br>TGCTTTTGGTAACATCCTTTCATGTAAGGTGGTTTG<br>TGATGAAAATGGTTCCAAGGGCTATGGATTTGTAC<br>ACTTTGAGACGCAGGAAGCAGCTGAAAGAGCTATT<br>GAAAAAATGAATGGAATGCTCCTAAATGATCGCAA<br>AGTATTTGTTGGACGATTTA | 5 | VLIFM* |
| 1081 | NM_0025<br>68.3_1509 | 1509 | CCCTTCTCCCCGGCGGTTAGTGCTGAGAGTGCGG<br>AGTGTGTGCTCCGGGCTCGGAACACACATTTATTA<br>TTAAAAAATCCAAAAAAAAATCTAAAAAAATCTTTTAA<br>AAAACCCCAAAAAAATTTACAAAAAATCCGCGTCTC<br>CCCCGCCGGAGACTTTTATTTTTTTTCTTCCTCTTT<br>TATAAAATAACCCGGTGAAGCAGCCGAGACCGAC<br>CCGCCCGCCCGCGGCCCCGCAGCAGCTCCAAGA<br>AGGAACCAAGAGACCGAGGCCTTCCCGCTGCCCG<br>GACCCGACACCGCCACCCTCGCTCCCCGCCGGCA<br>GCCGGCAGCCAGCGGCAGTGGATCGACCCCGTT<br>CTGCGGCCGTTGAGTAGTTTTCAATTCCGGTTGAT<br>TTTTGTCCCTCTGCGCTTGCTCCCCGCTCCCCTCC<br>CCCCGGCTCCGGCCCCAGCCCCGGCACTCGCT<br>CTCCTCCTCTCACGGAAAGGTCGCGGCCTGTGGC<br>CCTGCGGGCAGCCGTGCCGAGATGAACCCCAGTG<br>CCCCCAGCTACCCCATGGCCTCGCTCTACGTGGG<br>GGACCTCCACCCCGACGTGACCGAGGCGATGCTC<br>TACGAGAAGTTCAGCCCGGCCGGGCCCATCCTCT<br>CCATCCGGGTCTGCAGGGACATGATCACCCGCCG<br>CTCCTTGGGCTACGCGTATGTGAACTTCCAGCAGC<br>CGGCGGACGCGGAGCGTGCTTTGGACACCATGAA<br>TTTTGATGTTATAAAGGGCAAGCCAGTACGCATCA<br>TGTGGTCTCAGCGTGATCCATCACTTCGCAAAAGT<br>GGAGTAGGCAACATATTCATTAAAAATCTGGACAA<br>ATCCATTGATAATAAAGCACTGTATGATACATTTTC<br>TGCTTTTGGTAACATCCTTTCATGTAAGGTGGTTTG<br>TGATGAAAATGGTTCCAAGGGCTATGGATTTGTAC<br>ACTTTGAGACGCAGGAAGCAGCTGAAAGAGCTATT<br>GAAAAAATGAATGGAATGCTCCTAAATGATCGCAA<br>AGTATTTGTTGGACGATTTA | 18 | LVLYVSPP<br>QKKPLKQL<br>QK* |

TABLE 3A-continued

| SEQ ID | identifier_position | position | modified_RNA | PAP length | PAP |
|---|---|---|---|---|---|
| 1082 | NM_002568.3_870 | 870 | CCCTTCTCCCCGGCGGTTAGTGCTGAGAGTGCGG AGTGTGTGCTCCGGGCTCGGAACACACATTTATTA TTAAAAAATCCAAAAAAAATCTAAAAAAATCTTTTAA AAAACCCCAAAAAAATTTACAAAAAATCCGCGTCTC CCCCGCCGGAGACTTTTATTTTTTTTCTTCCTCTTT TATAAAATAACCCGGTGAAGCAGCCGAGACCGAC CCGCCCGCCCGCGGCCCCGCAGCAGCTCCAAGA AGGAACCAAGAGACCGAGGCCTTCCCGCTGCCCG GACCCGACACCGCCACCCTCGCTCCCCGCCGGCA GCCGGCAGCCAGCGGCAGTGGATCGACCCCGTT CTGCGGCCGTTGAGTAGTTTTCAATTCCGGTTGAT TTTTGTCCCTCTGCGCTTGCTCCCCGCTCCCCTCC CCCCGGCTCCGGCCCCCAGCCCCGGCACTCGCT CTCCTCCTCTCACGGAAAGGTCGCGGCCTGTGGC CCTGCGGGCAGCCGTGCCGAGATGAACCCCAGTG CCCCCAGCTACCCCATGGCCTCGCTCTACGTGGG GGACCTCCACCCCGACGTGACCGAGGCGATGCTC TACGAGAAGTTCAGCCCGGCCGGGCCCATCCTCT CCATCCGGGTCTGCAGGGACATGATCACCCGCCG CTCCTTGGGCTACGCGTATGTGAACTTCCAGCAGC CGGCGGACGCGGAGCGTGCTTTGGACACCATGAA TTTTGATGTTATAAAGGGCAAGCCAGTACGCATCA TGTGGTCTCAGCGTGATCCATCACTTCGCAAAAGT GGAGTAGGCAACATATTCATTAAAAATCTGGACAA ATCCATTGATAATAAAGCACTGTATGATACATTTTC TGCTTTGGTAACATCCTTTCATGTAAGGTGGTTTGT GATGAAAATGGTTCCAAGGGCTATGGATTTGTACA CTTTGAGACGCAGGAAGCAGCTGAAAGAGCTATT GAAAAAATGAATGGAATGCTCCTAAATGATCGCAA AGTATTTGTTGGACGATTTAA | 36 | LVTSFHVR WFVMKMV PRAMDLYT LRRRKQLK ELLKK* |
| 1083 | NM_002568.3_898 | 898 | CCCTTCTCCCCGGCGGTTAGTGCTGAGAGTGCGG AGTGTGTGCTCCGGGCTCGGAACACACATTTATTA TTAAAAAATCCAAAAAAAATCTAAAAAAATCTTTTAA AAAACCCCAAAAAAATTTACAAAAAATCCGCGTCTC CCCCGCCGGAGACTTTTATTTTTTTTCTTCCTCTTT TATAAAATAACCCGGTGAAGCAGCCGAGACCGAC CCGCCCGCCCGCGGCCCCGCAGCAGCTCCAAGA AGGAACCAAGAGACCGAGGCCTTCCCGCTGCCCG GACCCGACACCGCCACCCTCGCTCCCCGCCGGCA GCCGGCAGCCAGCGGCAGTGGATCGACCCCGTT CTGCGGCCGTTGAGTAGTTTTCAATTCCGGTTGAT TTTTGTCCCTCTGCGCTTGCTCCCCGCTCCCCTCC CCCCGGCTCCGGCCCCCAGCCCCGGCACTCGCT CTCCTCCTCTCACGGAAAGGTCGCGGCCTGTGGC CCTGCGGGCAGCCGTGCCGAGATGAACCCCAGTG CCCCCAGCTACCCCATGGCCTCGCTCTACGTGGG GGACCTCCACCCCGACGTGACCGAGGCGATGCTC TACGAGAAGTTCAGCCCGGCCGGGCCCATCCTCT CCATCCGGGTCTGCAGGGACATGATCACCCGCCG CTCCTTGGGCTACGCGTATGTGAACTTCCAGCAGC CGGCGGACGCGGAGCGTGCTTTGGACACCATGAA TTTTGATGTTATAAAGGGCAAGCCAGTACGCATCA TGTGGTCTCAGCGTGATCCATCACTTCGCAAAAGT GGAGTAGGCAACATATTCATTAAAAATCTGGACAA ATCCATTGATAATAAAGCACTGTATGATACATTTTC TGCTTTTGGTAACATCCTTTCATGTAAGGTGGTTGT GATGAAAATGGTTCCAAGGGCTATGGATTTGTACA CTTTGAGACGCAGGAAGCAGCTGAAAGAGCTATT GAAAAAATGAATGGAATGCTCCTAAATGATCGCAA AGTATTTGTTGGACGATTTAA | 26 | VMKMVPR AMDLYTLR RRKQLKEL LKK* |
| 1084 | NM_002627.3390 | 390 | GCACCCGGACGTGCGGCTCCCCTCGGCCTCCTCG CCATGGACGCGGACGACTCCCGGGCCCCCAAGG GCTCCTTGCGGAAGTTCCTGGAGCACCTCTCCGG GGCCGGCAAGGCCATCGGCGTGCTGACCAGCGG CGGGGATGCTCAAGGTATGAACGCTGCCGTCCGT GCCGTGGTGCGCATGGGTATCTACGTGGGGGCCA AGGTGTACTTCATCTACGAGGGCTACCAGGGCAT GGTGGACGGAGGCTCAAACATCGCAGAGGCCGAC TGGGAGAGTGTCTCCAGCATCCTGCAAGTGGGCG GGACGATCATTGGCAGTGCGCGGTGCCAGGCCTT CCGCACGCGGGAAGGCCGCCTGAAGGCTGCTTG CAACCTGCTGCAGCGCGGATCACCAACCTGTGTG TGATCGGCGGGGACGGGAGCCTCACCGGGGCCA ACCTCTTCCGGAAGGAGTGGAGTGGGCTGCTGGA GGAGCTGGCCAGGAACGGCCAGATCGATAAGGAG GCCGTGCAGAAGTACGCCTACCTCAACGTGGTGG GCATGGTGGGCTCCATCGACAATGATTTCTGCGG | 5 | SPTCV* |

TABLE 3A-continued

| SEQ ID | identifier_position | position | modified_RNA | PAP length | PAP |
|---|---|---|---|---|---|
| | | | CACCGACATGACCATCGGCACGGACTCCGCCCTG<br>CACAGGATCATCGAGGTCGTCGACGCCATCATGA<br>CCACGGCCCAGAGCCACCAGAGGACCTTCGTTCT<br>GGAGGTGATGGGACGACACTGTGGGTACCTGGCC<br>CTGGTGAGTGCCTTGGCCTGCGGTGCGGACTGGG<br>TGTTCCTTCCAGAATCTCCACCAGAGGAAGGCTGG<br>GAGGAGCAGATGTGTGTCAAACTCTCGGAGAACC<br>GTGCCCGGAAAAAAAGGCTGAATATTATTATTGTG<br>GCTGAAGGAGCAATTGATACCCAAAATAAACCCAT<br>CACCTCTGAGAAAATCAAAGAGCTTGTCGTCACGC<br>AGCTGGGCTATGACACACGTGTGACCATCCTCGG<br>GCACGTGCAGAGAGGAGGGACCCCTTCGGCATTC<br>GACAGGATCTTGGCCAGCCGCATGGGAGTGGAGG<br>CAGT | | |
| 1085 | NM_0026<br>29.2_161 | 161 | GCTAATCCCAGTCGGTGCCGCATCCCCAGCCCGC<br>CGCCATGGCCGCCTACAAACTGGTGCTGATCCGG<br>CACGGCGAGAGCGCATGGAACCTGGAGAACCGCT<br>TCAGCGGCTGGTACGACGCCGACCTGAGCCCGG<br>CGGGGCCACGAGGAGGCGAAGCGCGGGGGCAGG<br>CGCTACGAGATGCTGGCTATGAGTTTGACATCTGC<br>TTCACCTCAGTGCAGAAGAGAGCGATCCGGACCC<br>TCTGGACAGTGCTAGATGCCATTGATCAGATGTG<br>CTGCCAGTGGTGAGGACTTGGCGCCTCAATGAGC<br>GGCACTATGGGGGTCTAACCGGTCTCAATAAAGC<br>AGAAACTGCTGCAAAGCATGGTGAGGCCCAGGTG<br>AAGATCTGGAGGCGCTCCTATGATGTCCCACCAC<br>CTCCGATGGAGCCCGACCATCCTTTCTACAGCAAC<br>ATCAGTAAGGATCGCAGGTATGCAGACCTCACAGA<br>AGATCAGCTACCCTCCTGTGAGAGTCTGAAGGATA<br>CTATTGCCAGAGCTCTGCCCTTCTGGAATGAAGAA<br>ATAGTTCCCCAGATCAAGGAGGGGAAACGTGTACT<br>GATTGCAGCCCATGGCAACAGCCTCCGGGGCATT<br>GTCAAGCATCTGGAGGGTCTCTCTGAAGAGGCTAT<br>CATGGAGCTGAACCTGCCGACTGGTATTCCCATTG<br>TCTATGAATTGGACAAGAACTTGAAGCCTATCAAG<br>CCCATGCAGTTTCTGGGGGATGAAGAGACGGTGC<br>GCAAAGCCATGGAAGCTGTGGCTGCCCAGGGCAA<br>GGCCAAGAAGTGAAGGCCGGCGGGGAGGATACT<br>GTCCCCAGGAGCACCCTCCCTGCCCGTCTTGTCC<br>CTCTGCCCCTCCCACCTGCACATGTCACACTGACC<br>ACATCTGTAGACATCTTGAGTTGTAGCTGCAGACG<br>GGGACCAGTGGCTCCCATTTTCATTTTAGCCATTTT<br>GTCGCCTGCACCCACTCCCTTCATACAATCTAGTC<br>AGAATAGCAGTTCTAGAGCACAGGTTC | 28 | RRYEMLA<br>MSLTSASP<br>QCRRERS<br>GPSGQC* |
| 1086 | NM_0026<br>29.2_409 | 409 | GCTAATCCCAGTCGGTGCCGCATCCCCAGCCCGC<br>CGCCATGGCCGCCTACAAACTGGTGCTGATCCGG<br>CACGGCGAGAGCGCATGGAACCTGGAGAACCGCT<br>TCAGCGGCTGGTACGACGCCGACCTGAGCCCGG<br>CGGGCCACGAGGAGGCGAAGCGCGGCGGGCAG<br>GCGCTACGAGATGCTGGCTATGAGTTTGACATCTG<br>CTTCACCTCAGTGCAGAAGAGAGCGATCCGGACC<br>CTCTGGACAGTGCTAGATGCCATTGATCAGATGTG<br>GCTGCCAGTGGTGAGGACTTGGCGCCTCAATGAG<br>CGGCACTATGGGGGTCTAACCGGTCTCAATAAAG<br>CAGAAACTGCTGCAAAGCATGGTGAGGCCCAGGT<br>GAAGATCTGGAGGCGCTCCTATGATGTCCCACCA<br>CTCCGATGGAGCCCGACCATCCTTTCTACAGCAAC<br>ATCAGTAAGGATCGCAGGTATGCAGACCTCACAGA<br>AGATCAGCTACCCTCCTGTGAGAGTCTGAAGGATA<br>CTATTGCCAGAGCTCTGCCCTTCTGGAATGAAGAA<br>ATAGTTCCCCAGATCAAGGAGGGGAAACGTGTACT<br>GATTGCAGCCCATGGCAACAGCCTCCGGGGCATT<br>GTCAAGCATCTGGAGGGTCTCTCTGAAGAGGCTAT<br>CATGGAGCTGAACCTGCCGACTGGTATTCCCATTG<br>TCTATGAATTGGACAAGAACTTGAAGCCTATCAAG<br>CCCATGCAGTTTCTGGGGGATGAAGAGACGGTGC<br>GCAAAGCCATGGAAGCTGTGGCTGCCCAGGGCAA<br>GGCCAAGAAGTGAAGGCCGGCGGGGAGGATACT<br>GTCCCCAGGAGCACCCTCCCTGCCCGTCTTGTCC<br>CTCTGCCCCTCCCACCTGCACATGTCACACTGACC<br>ACATCTGTAGACATCTTGAGTTGTAGCTGCAGACG<br>GGGACCAGTGGCTCCCATTTTCATTTTAGCCATTTT<br>GTCGCCTGCACCCACTCCCTTCATACAATCTAGTC<br>AGAATAGCAGTTCTAGAGCACAGGTTC | 32 | LRWSPTIL<br>STATSVRIA<br>GMQTSQKI<br>SYPPVRV* |
| 1087 | NM_0026<br>29.2_426 | 426 | GCTAATCCCAGTCGGTGCCGCATCCCCAGCCCGC<br>CGCCATGGCCGCCTACAAACTGGTGCTGATCCGG<br>CACGGCGAGAGCGCATGGAACCTGGAGAACCGCT | 26 | ILSTATSVR<br>IAGMQTSQ<br>KISYPPVR |

TABLE 3A-continued

| SEQ ID | identifier_position | position | modified_RNA | PAP length | PAP |
|---|---|---|---|---|---|
| | | | TCAGCGGCTGGTACGACGCCGACCTGAGCCCGG<br>CGGGCCACGAGGAGGCGAAGCGCGGCGGGCAG<br>GCGCTACGAGATGCTGGCTATGAGTTTGACATCTG<br>CTTCACCTCAGTGCAGAAGAGAGCGATCCGGACC<br>CTCTGGACAGTGCTAGATGCCATTGATCAGATGTG<br>GCTGCCAGTGGTGAGGACTTGGCGCCTCAATGAG<br>CGGCACTATGGGGGTCTAACCGGTCTCAATAAAG<br>CAGAAACTGCTGCAAAGCATGGTGAGGCCCAGGT<br>GAAGATCTGGAGGCGCTCCTATGATGTCCCACCA<br>CCTCCGATGGAGCCCGACATCCTTTCTACAGCAAC<br>ATCAGTAAGGATCGCAGGTATGCAGACCTCACAGA<br>AGATCAGCTACCCTCCTGTGAGAGTCTGAAGGATA<br>CTATTGCCAGAGCTCTGCCCTTCTGGAATGAAGAA<br>ATAGTTCCCCAGATCAAGGAGGGGAAACGTGTACT<br>GATTGCAGCCCATGGCAACAGCCTCCGGGGCATT<br>GTCAAGCATCTGGAGGGTCTCTCTGAAGAGGCTAT<br>CATGGAGCTGAACCTGCCGACTGGTATTCCCATTG<br>TCTATGAATTGGACAAGAACTTGAAGCCTATCAAG<br>CCCATGCAGTTTCTGGGGGATGAAGAGACGGTGC<br>GCAAAGCCATGGAAGCTGTGGCTGCCCAGGGCAA<br>GGCCAAGAAGTGAAGGCCGGCGGGGAGGATACT<br>GTCCCCAGGAGCACCCTCCCTGCCCGTCTTGTCC<br>CTCTGCCCCTCCCACCTGCACATGTCACACTGACC<br>ACATCTGTAGACATCTTGAGTTGTAGCTGCAGACG<br>GGGACCAGTGGCTCCCATTTTCATTTTAGCCATTTT<br>GTCGCCTGCACCCACTCCCTTCATACAATCTAGTC<br>AGAATAGCAGTTCTAGAGCACAGGTTC | | V* |
| 1088 | NM_0026<br>29.2_486 | 486 | GCTAATCCCAGTCGGTGCCGCATCCCCAGCCCGC<br>CGCCATGGCCGCCTACAAACTGGTGCTGATCCGG<br>CACGGCGAGAGCGCATGGAACCTGGAGAACCGCT<br>TCAGCGGCTGGTACGACGCCGACCTGAGCCCGG<br>CGGGCCACGAGGAGGCGAAGCGCGGCGGGCAG<br>GCGCTACGAGATGCTGGCTATGAGTTTGACATCTG<br>CTTCACCTCAGTGCAGAAGAGAGCGATCCGGACC<br>CTCTGGACAGTGCTAGATGCCATTGATCAGATGTG<br>GCTGCCAGTGGTGAGGACTTGGCGCCTCAATGAG<br>CGGCACTATGGGGGTCTAACCGGTCTCAATAAAG<br>CAGAAACTGCTGCAAAGCATGGTGAGGCCCAGGT<br>GAAGATCTGGAGGCGCTCCTATGATGTCCCACCA<br>CCTCCGATGGAGCCCGACCATCCTTTCTACAGCAA<br>CATCAGTAAGGATCGCAGGTATGCAGACCTCACA<br>GAAGATCAGTACCCTCCTGTGAGAGTCTGAAGGAT<br>ACTATTGCCAGAGCTCTGCCCTTCTGGAATGAAGA<br>AATAGTTCCCCAGATCAAGGAGGGGAAACGTGTA<br>CTGATTGCAGCCCATGGCAACAGCCTCCGGGGCA<br>TTGTCAAGCATCTGGAGGGTCTCTCTGAAGAGGCT<br>ATCATGGAGCTGAACCTGCCGACTGGTATTCCCAT<br>TGTCTATGAATTGGACAAGAACTTGAAGCCTATCA<br>AGCCCATGCAGTTTCTGGGGGATGAAGAGACGGT<br>GCGCAAAGCCATGGAAGCTGTGGCTGCCCAGGGC<br>AAGGCCAAGAAGTGAAGGCCGGCGGGGAGGATA<br>CTGTCCCCAGGAGCACCCTCCCTGCCCGTCTTGT<br>CCCTCTGCCCCTCCCACCTGCACATGTCACACTGA<br>CCACATCTGTAGACATCTTGAGTTGTAGCTGCAGA<br>CGGGGACCAGTGGCTCCCATTTTCATTTTAGCCAT<br>TTTGTCGCCTGCACCCACTCCCTTCATACAATCTA<br>GTCAGAATAGCAGTTCTAGAGCACAGGTTC | 6 | YPPVRV* |
| 1089 | NM_0026<br>29.2_594 | 594 | GCTAATCCCAGTCGGTGCCGCATCCCCAGCCCGC<br>CGCCATGGCCGCCTACAAACTGGTGCTGATCCGG<br>CACGGCGAGAGCGCATGGAACCTGGAGAACCGCT<br>TCAGCGGCTGGTACGACGCCGACCTGAGCCCGG<br>CGGGCCACGAGGAGGCGAAGCGCGGCGGGCAG<br>GCGCTACGAGATGCTGGCTATGAGTTTGACATCTG<br>CTTCACCTCAGTGCAGAAGAGAGCGATCCGGACC<br>CTCTGGACAGTGCTAGATGCCATTGATCAGATGTG<br>GCTGCCAGTGGTGAGGACTTGGCGCCTCAATGAG<br>CGGCACTATGGGGGTCTAACCGGTCTCAATAAAG<br>CAGAAACTGCTGCAAAGCATGGTGAGGCCCAGGT<br>GAAGATCTGGAGGCGCTCCTATGATGTCCCACCA<br>CCTCCGATGGAGCCCGACCATCCTTTCTACAGCAA<br>CATCAGTAAGGATCGCAGGTATGCAGACCTCACA<br>GAAGATCAGCTACCCTCCTGTGAGAGTCTGAAGG<br>ATACTATTGCCAGAGCTCTGCCCTTCTGGAATGAA<br>GAAATAGTTCCCCAGATCAAGGAGGGGAAACGTG<br>TACTGATTGCAGCCATGGCAACAGCCTCCGGGGC<br>ATTGTCAAGCATCTGGAGGGTCTCTCTGAAGAGGC<br>TATCATGGAGCTGAACCTGCCGACTGGTATTCCCA | 22 | MATASGAL<br>SSIWRVSL<br>KRLSWS* |

TABLE 3A-continued

| SEQ ID | identifier_ position | position | modified_RNA | PAP length | PAP |
|---|---|---|---|---|---|
| | | | TTGTCTATGAATTGGACAAGAACTTGAAGCCTATC AAGCCCATGCAGTTTCTGGGGGATGAAGAGACGG TGCGCAAAGCCATGGAAGCTGTGGCTGCCCAGGG CAAGGCCAAGAAGTGAAGGCCGGCGGGGAGGAT ACTGTCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | | |
| 1090 | NM_0026 29.2_606 | 606 | GCTAATCCCAGTCGGTGCCGCATCCCCAGCCCGC CGCCATGGCCGCCTACAAACTGGTGCTGATCCGG CACGGCGAGAGCGCATGGAACCTGGAGAACCGCT TCAGCGGCTGGTACGACGCCGACCTGAGCCCGG CGGGCCACGAGGAGGCGAAGCGCGGCGGGCAG GCGCTACGAGATGCTGGCTATGAGTTTGACATCTG CTTCACCTCAG'GCAGAAGAGAGCGATCCGGACC CTCTGGACAGTGCTAGATGCCATTGATCAGATGTG GCTGCCAGTGGTGAGGACTTGGCGCCTCAATGAG CGGCACTATGGGGGTCTAACCGGTCTCAATAAAG CAGAAACTGCTGCAAAGCATGGTGAGGCCCAGGT GAAGATCTGGAGGCGCTCCTATGATGTCCCACCA CCTCCGATGGAGCCCGACCATCCTTTCTACAGCAA CATCAGTAAGGATCGCAGGTATGCAGACCTCACA GAAGATCAGCTACCCTCCTGTGAGAGTCTGAAGG ATACTATTGCCAGAGCTCTGCCCTTCTGGAATGAA GAAATAGTTCCCCAGATCAAGGAGGGGAAACGTG TACTGATTGCAGCCCATGGCAACAGCTCCGGGGC ATTGTCAAGCATCTGGAGGGTCTCTCTGAAGAGGC TATCATGGAGCTGAACCTGCCGACTGGTATTCCA TTGTCTATGAATTGGACAAGAACTTGAAGCCTATC AAGCCCATGCAGTTTCTGGGGGATGAAGAGACGG TGCGCAAAGCCATGGAAGCTGTGGCTGCCCAGGG CAAGGCCAAGAAGTGAAGGCCGGCGGGGAGGAT ACTGTCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | 18 | SGALSSIW RVSLKRLS WS* |
| 1091 | NM_0026 29.2670 | 670 | GCTAATCCCAGTCGGTGCCGCATCCCCAGCCCGC CGCCATGGCCGCCTACAAACTGGTGCTGATCCGG CACGGCGAGAGCGCATGGAACCTGGAGAACCGCT TCAGCGGCTGGTACGACGCCGACCTGAGCCCGG CGGGCCACGAGGAGGCGAAGCGCGGCGGGCAG GCGCTACGAGATGCTGGCTATGAGTTTGACATCTG CTTCACCTCAGTGCAGAAGAGAGCGATCCGGACC CTCTGGACAGTGCTAGATGCCATTGATCAGATGTG GCTGCCAGTGGTGAGGACTTGGCGCCTCAATGAG CGGCACTATGGGGGTCTAACCGGTCTCAATAAAG CAGAAACTGCTGCAAAGCATGGTGAGGCCCAGGT GAAGATCTGGAGGCGCTCCTATGATGTCCCACCA CCTCCGATGGAGCCCGACCATCCTTTCTACAGCAA CATCAGTAAGGATCGCAGGTATGCAGACCTCACA GAAGATCAGCTACCCTCCTGTGAGAGTCTGAAGG ATACTATTGCCAGAGCTCTGCCCTTCTGGAATGAA GAAATAGTTCCCCAGATCAAGGAGGGGAAACGTG TACTGATTGCAGCCCATGGCAACAGCTCCGGGGC CATTGTCAAGCATCTGGAGGGTCTCTCTGAAGAGG CTATCATGGAGCTGAACCTGCGACTGGTATTCCCA TTGTCTATGAATTGGACAAGAACTTGAAGCCTATC AAGCCCATGCAGTTTCTGGGGGATGAAGAGACGG TGCGCAAAGCCATGGAAGCTGTGGCTGCCCAGGG CAAGGCCAAGAAGTGAAGGCCGGCGGGGAGGAT ACTGTCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | 13 | RLVFPLSM NWTRT* |
| 1092 | NM_0026 29.2_683 | 683 | GCTAATCCCAGTCGGTGCCGCATCCCCAGCCCGC CGCCATGGCCGCCTACAAACTGGTGCTGATCCGG CACGGCGAGAGCGCATGGAACCTGGAGAACCGCT TCAGCGGCTGGTACGACGCCGACCTGAGCCCGG CGGGCCACGAGGAGGCGAAGCGCGGCGGGCAG GCGCTACGAGATGCTGGCTATGAGTTTGACATCTG CTTCACCTCAGTGCAGAAGAGAGCGATCCGGACC | 8 | LSMNWTR T* |

TABLE 3A-continued

| SEQ ID | identifier_position | position | modified_RNA | PAP length | PAP |
|---|---|---|---|---|---|
| | | | CTCTGGACAGTGCTAGATGCCATTGATCAGATGTG GCTGCCAGTGGTGAGGACTTGGCGCCTCAATGAG CGGCACTATGGGGGTCTAACCGGTCTCAATAAAG CAGAAACTGCTGCAAAGCATGGTGAGGCCCAGGT GAAGATCTGGAGGCGCTCCTATGATGTCCCACCA CCTCCGATGGAGCCCGACCATCCTTTCTACAGCAA CATCAGTAAGGATCGCAGGTATGCAGACCTCACA GAAGATCAGCTACCCTCCTGTGAGAGTCTGAAGG ATACTATTGCCAGAGCTCTGCCCTTCTGGAATGAA GAAATAGTTCCCCAGATCAAGGAGGGGAAACGTG TACTGATTGCAGCCCATGGCAACAGCCTCCGGGG CATTGTCAAGCATCTGGAGGGTCTCTCTGAAGAGG CTATCATGGAGCTGAACCTGCCGACTGGTATTCCA TTGTCTATGAATTGGACAAGAACTTGAAGCCTATC AAGCCCATGCAGTTTCTGGGGGATGAAGAGACGG TGCGCAAAGCCATGGAAGCTGTGGCTGCCCAGGG CAAGGCCAAGAAGTGAAGGCCGGCGGGGAGGAT ACTGTCCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | | |
| 1093 | NM_0026 29.2_686 | 686 | GCTAATCCCAGTCGGTGCCGCATCCCCAGCCCGC CGCCATGGCCGCCTACAAACTGGTGCTGATCCGG CACGGCGAGAGCGCATGGAACCTGGAGAACCGCT TCAGCGGCTGGTACGACGCCGACCTGAGCCCGG CGGGGCCACGAGGAGGCGAAGCGCGGCGGGCAG GCGCTACGAGATGCTGGCTATGAGTTTGACATCTG CTTCACCTCAGTGCAGAAGAGAGCGATCCGGACC CTCTGGACAGTGCTAGATGCCATTGATCAGATGTG GCTGCCAGTGGTGAGGACTTGGCGCCTCAATGAG CGGCACTATGGGGGTCTAACCGGTCTCAATAAAG CAGAAACTGCTGCAAAGCATGGTGAGGCCCAGGT GAAGATCTGGAGGCGCTCCTATGATGTCCCACCA CCTCCGATGGAGCCCGACCATCCTTTCTACAGCAA CATCAGTAAGGATCGCAGGTATGCAGACCTCACA GAAGATCAGCTACCCTCCTGTGAGAGTCTGAAGG ATACTATTGCCAGAGCTCTGCCCTTCTGGAATGAA GAAATAGTTCCCCAGATCAAGGAGGGGAAACGTG TACTGATTGCAGCCCATGGCAACAGCCTCCGGGG CATTGTCAAGCATCTGGAGGGTCTCTCTGAAGAGG CTATCATGGAGCTGAACCTGCCGACTGGTATTCCC ATGTCTATGAATTGGACAAGAACTTGAAGCCTATC AAGCCCATGCAGTTTCTGGGGGATGAAGAGACGG TGCGCAAAGCCATGGAAGCTGTGGCTGCCCAGGG CAAGGCCAAGAAGTGAAGGCCGGCGGGGAGGAT ACTGTCCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | 8 | MSMNWTR T* |
| 1094 | NM_0026 29.2_787 | 787 | GCTAATCCCAGTCGGTGCCGCATCCCCAGCCCGC CGCCATGGCCGCCTACAAACTGGTGCTGATCCGG CACGGCGAGAGCGCATGGAACCTGGAGAACCGCT TCAGCGGCTGGTACGACGCCGACCTGAGCCCGG CGGGGCCACGAGGAGGCGAAGCGCGGCGGGCAG GCGCTACGAGATGCTGGCTATGAGTTTGACATCTG CTTCACCTCAGTGCAGAAGAGAGCGATCCGGACC CTCTGGACAGTGCTAGATGCCATTGATCAGATGTG GCTGCCAGTGGTGAGGACTTGGCGCCTCAATGAG CGGCACTATGGGGGTCTAACCGGTCTCAATAAAG CAGAAACTGCTGCAAAGCATGGTGAGGCCCAGGT GAAGATCTGGAGGCGCTCCTATGATGTCCCACCA CCTCCGATGGAGCCCGACCATCCTTTCTACAGCAA CATCAGTAAGGATCGCAGGTATGCAGACCTCACA GAAGATCAGCTACCCTCCTGTGAGAGTCTGAAGG ATACTATTGCCAGAGCTCTGCCCTTCTGGAATGAA GAAATAGTTCCCCAGATCAAGGAGGGGAAACGTG TACTGATTGCAGCCCATGGCAACAGCCTCCGGGG CATTGTCAAGCATCTGGAGGGTCTCTCTGAAGAGG CTATCATGGAGCTGAACCTGCCGACTGGTATTCCC ATTGTCTATGAATTGGACAAGAACTTGAAGCCTAT CAAGCCCATGCAGTTTCTGGGGGATGAAGAGACG GTGCGCAAAGCCATGGAAGCTGTGGCTGCCCAGG CAAGGCCAAGAAGTGAAGGCCGGCGGGGAGGAT | 43 | ARPRSEG RRGGYCP QEHPPCPS CPSAPPTC TCHTDHIC RHLEL* |

TABLE 3A-continued

| SEQ ID | identifier_ position | position | modified_RNA | PAP length | PAP |
|---|---|---|---|---|---|
| | | | ACTGTCCCCAGGAGCACCCTCCCTGCCCGTCTTG TCCCTCTGCCCCTCCCACCTGCACATGTCACACTG ACCACATCTGTAGACATCTTGAGTTGTAGCTGCAG ACGGGGACCAGTGGCTCCCATTTTCATTTTAGCCA TTTTGTCGCCTGCACCCACTCCCTTCATACAATCTA GTCAGAATAGCAGTTCTAGAGCACAGGTTC | | |
| 1095 | NM_0026 31.2_171 | 171 | GGCCGCAGTTTCTGGAGGGAGCCGCTGCGGGTCT TTCCCTCACTCGTCCTCCGCGCGTCGCCGCTCTTC GGTTCTGCTCTGTCCGCCGCCATGGCCCAAGCTG ACATCGCGCTGATCGGATTGGCCGTCATGGGCCA GAACTTAATTCTGAACATGAATGACCACGGCTTGT GGTCTGTGCTTTTAATAGGACTGTCTCCAAAGTTG ATGATTTCTTGGCCAATGAGGCAAAGGGAACCAAA GTGGTGGGTGCCCAGTCCCTGAAAGAGATGGTCT CCAAGCTGAAGAAGCCCCGGCGGATCATCCTCCT GGTGAAGGCTGGGCAAGCTGTGGATGATTTCATC GAGAAATTGGTACCATTGTTGGATACTGGTGACAT CATCATTGACGGAGGAAATTCTGAATATAGGGACA CCACAAGACGGTGCCGAGACCTCAAGGCCAAGGG AATTTTATTTGTGGGGAGCGGAGTCAGTGGTGGAG AGGAAGGGGCCCGGTATGGCCCATCGCTCATGCC AGGAGGGAACAAAGAAGCGTGGCCCCACATCAAG ACCATCTTCCAAGGCATTGCTGCAAAAGTGGGAAC TGGAGAACCCTGCTGTGACTGGGTGGGAGATGAG GGAGCAGGCCACTTCGTGAAGATGGTGCACAACG GGATAGAGTATGGGGACATGCAGCTGATCTGTGA GGCATACCACCTGATGAAAGACGTGCTGGGCATG GCGCAGGACGAGATGGCCCAGGCCTTTGAGGATT GGAATAAGACAGAGCTAGACTCATTCCTGATTGAA ATCACAGCCAATATTCTCAAGTTCCAAGACACCGA TGGCAAACACCTGCTGCCAAAGATCAGGGACAGC GCGGGGCAGAAGGGCACAGGGAAGTGGACCGCC ATCTCCGCCCTGGAATACGGCGTACCCGTCACCC TCATTGGAGAAGCTGTCTTTGCTCGGTGCTTATCA TCTCTGAAGGATGAGAGAATTCAAGCTAGCAAAAA GCTGAAGGGTCCCCAGAAGTTCCAGTT | 31 | LWSVLLIGL SPKLMISW PMRQREP KWWVPSP* |
| 1096 | NM_0026 31.2_544 | 544 | GGCCGCAGTTTCTGGAGGGAGCCGCTGCGGGTCT TTCCCTCACTCGTCCTCCGCGCGTCGCCGCTCTTC GGTTCTGCTCTGTCCGCCGCCATGGCCCAAGCTG ACATCGCGCTGATCGGATTGGCCGTCATGGGCCA GAACTTAATTCTGAACATGAATGACCACGGCTTTG TGGTCTGTGCTTTTAATAGGACTGTCTCCAAAGTT GATGATTTCTTGGCCAATGAGGCAAAGGGAACCAA AGTGGTGGGTGCCCAGTCCCTGAAAGAGATGGTC TCCAAGCTGAAGAAGCCCCGGCGGATCATCCTCC TGGTGAAGGCTGGGCAAGCTGTGGATGATTTCATC GAGAAATTGGTACCATTGTTGGATACTGGTGACAT CATCATTGACGGAGGAAATTCTGAATATAGGGACA CCACAAGACGGTGCCGAGACCTCAAGGCCAAGGG AATTTTATTTGTGGGGAGCGGAGTCAGTGGTGGAG AGGAAGGGGCCCGGTATGGCCCATCGCTCATGCC AGGAGGGAACAAAGAAGCGTGGCCCCACATCAAGA CCATCTTCCAAGGCATTGCTGCAAAAGTGGGAACT GGAGAACCCTGCTGTGACTGGGTGGGAGATGAGG GAGCAGGCCACTTCGTGAAGATGGTGCACAACGG GATAGAGTATGGGGACATGCAGCTGATCTGTGAG GCATACCACCTGATGAAAGACGTGCTGGGCATGG CGCAGGACGAGATGGCCCAGGCCTTTGAGGATTG GAATAAGACAGAGCTAGACTCATTCCTGATTGAAA TCACAGCCAATATTCTCAAGTTCCAAGACACCGAT GGCAAACACCTGCTGCCAAAGATCAGGGACAGCG CGGGGCAGAAGGGCACAGGGAAGTGGACCGCCA TCTCCGCCCTGGAATACGGCGTACCCGTCACCCT CATTGGAGAAGCTGTCTTTGCTCGGTGCTTATCAT CTCTGAAGGATGAGAGAATTCAAGCTAGCAAAAAG CTGAAGGGTCCCCAGAAGTTCCAGTT | 31 | TSRPSSKA LLQKWELE NPAVTGW EMREQAT S* |
| 1097 | NM_0026 34.2_217 | 217 | AGTATGTGTGGTTGGGGAATTCATGTGGAGGTCAG AGTGGAAGCAGGTGTGAGAGGGTCCAGCAGAAGG AAACATGGCTGCCAAAGTGTTTGAGTCCATTGGCA AGTTTGGCCTGGCCTTAGCTGTTGCAGGAGGCGT GGTGAACTCTGCCTTATATAATGTGGATGCTGGGC ACAGAGCTGTCATCTTTGACCGATTCCGTGGAGTG CAGGACATGTGGTAGGGGAAGGGACTCATTTTCT CATCCCGTGGGTACAGAAACCAATTATCTTTGACT GCCGTTCTCGACCACGTAATGTGCCAGTCATCACT GGTAGCAAAGATTTACAGAATGTCAACATCACACT GCGCATCCTCTTCCGGCCTGTCGCCAGCCAGCTT | 2 | MW* |

TABLE 3A-continued

| SEQ ID | identifier_position | position | modified_RNA | PAP length | PAP |
|---|---|---|---|---|---|
| | | | CCTCGCATCTTCACCAGCATCGGAGAGGACTATGA<br>TGAGCGTGTGCTGCCGTCCATCACAACTGAGATCC<br>TCAAGTCAGTGGTGGCTCGCTTTGATGCTGGAGAA<br>CTAATCACCCAGAGAGAGCTGGTCTCCAGGCAGG<br>TGAGCGACGACCTTACAGAGCGAGCCGCCACCTT<br>TGGGCTCATCCTGGATGACGTGTCCTTGACACATC<br>TGACCTTCGGGAAGGAGTTCACAGAAGCGGTGGA<br>AGCCAAACAGGTGGCTCAGCAGGAAGCAGAGAGG<br>GCCAGATTTGTGGTGGAAAAGGCTGAGCAACAGA<br>AAAAGGCGGCCATCATCTCTGCTGAGGGCGACTC<br>CAAGGCAGCTGAGCTGATTGCCAACTCACTGGCC<br>ACTGCAGGGGATGGCCTGATCGAGCTGCGCAAGC<br>TGGAAGCTGCAGAGGACATCGCGTACCAGCTCTC<br>ACGCTCTCGGAACATCACCTACCTGCCAGCGGGG<br>CAGTCCGTGCTCCTCCAGCTGCCCCAGTGAGGGC<br>CCACCCTGCCTGCACCTCCGCGGGCTGACTGGGC<br>CACAGCCCCGATGATTCTTAACACAGCCTTCCTTC<br>TGCTCCCACCCCAGAAATCACTGTGAAATTTCATG<br>ATTGGCTTAAAGTGAAGGAAATAAA | | |
| 1098 | NM_0026<br>34.2_703 | 703 | AGTATGTGTGGTTGGGGAATTCATGTGGAGGTCAG<br>AGTGGAAGCAGGTGTGAGAGGGTCCAGCAGAAGG<br>AAACATGGCTGCCAAAGTGTTTGAGTCCATTGGCA<br>AGTTTGGCCTGGCCTTAGCTGTTGCAGGAGGCGT<br>GGTGAACTCTGCCTTATATAATGTGGATGCTGGGC<br>ACAGAGCTGTCATCTTTGACCGATTCCGTGGAGTG<br>CAGGACATTGTGGTAGGGGAAGGGACTCATTTTCT<br>CATCCCGTGGGTACAGAAACCAATTATCTTTGACT<br>GCCGTTCTCGACCACGTAATGTGCCAGTCATCACT<br>GGTAGCAAAGATTTACAGAATGTCAACATCACACT<br>GCGCATCCTCTTCCGGCCTGTCGCCAGCCAGCTT<br>CCTCGCATCTTCACCAGCATCGGAGAGGACTATGA<br>TGAGCGTGTGCTGCCGTCCATCACAACTGAGATCC<br>TCAAGTCAGTGGTGGCTCGCTTTGATGCTGGAGAA<br>CTAATCACCCAGAGAGAGCTGGTCTCCAGGCAGG<br>TGAGCGACGACCTTACAGAGCGAGCCGCCACCTT<br>TGGGCTCATCCTGGATGACGTGTCCTTGACACATC<br>TGACCTTCGGGAAGGAGTTCACAGAAGCGGTGGA<br>AGCCAAACAGGTGGCTCAGCAGGAAGCAGAGAGG<br>GCCAGATTTGTGGTGGAAAAGGCTGAGCAACAGA<br>AAAAGGCGGCATCATCTCTGCTGAGGGCGACTCC<br>AAGGCAGCTGAGCTGATTGCCAACTCACTGGCCA<br>CTGCAGGGGATGGCCTGATCGAGCTGCGCAAGCT<br>GGAAGCTGCAGAGGACATCGCGTACCAGCTCTCA<br>CGCTCTCGGAACATCACCTACCTGCCAGCGGGGC<br>AGTCCGTGCTCCTCCAGCTGCCCCAGTGAGGGCC<br>CACCCTGCCTGCACCTCCGCGGGCTGACTGGGCC<br>ACAGCCCCGATGATTCTTAACACAGCCTTCCTTCT<br>GCTCCCACCCCAGAAATCACTGTGAAATTTCATGA<br>TTGGCTTAAAGTGAAGGAAATAAA | 12 | SSLLRATP<br>RQLS* |
| 1099 | NM_0026<br>54.3_1405 | 1405 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCCACGGAAAGCTTTGCTTCTGACCC<br>CATCCTCTACCGGCCCGTTGCTGTGGCTCTAGCA<br>CTAAAGGACCTGAGATCCGAACTGGGCTCATCAA<br>GGGCAGCGGCACTGCAGAGGTGGAGCTGAAGAA<br>GGGAGCCACTCTCAAAATCACGCTGGATAACGCC<br>TACATGGAAAAGTGTGACGAGAACATCCTGTGGCT<br>GGACTACAAGAACATCTGCAAGGTGGTGGAAGTG<br>GGCAGCAAGATCTACGTGGATGATGGGCTTATTTC<br>TCTCCAGGTGAAGCAGAAAGGTGCCGACTTCCTG<br>GTGACGGAGGTGGAAAATGGTGGCTCCTTGGGCA<br>GCAAGAAGGGTGTGAACCTTCCTGGGGCTGCTGT<br>GGACTTGCCTGCTGTGTCGGAGAAGGACATCCAG<br>GATCTGAAGTTTGGGGTCGAGCAGGATGTTGATAT | 39 | STTCNYLR<br>NSAAWRP<br>LPATPQKP<br>PPWVPWR<br>PPSSAAVG<br>P* |

TABLE 3A-continued

| SEQ ID | identifier_position | position | modified_RNA | PAP length | PAP |
|---|---|---|---|---|---|
| 1100 | NM_0026 54.3_1465 | 1465 | GGTGTTTGCGTCATTCATCCGCAAGGCATCTGATG TCCATGAAGTTAGGAAGGTCCTGGGAGAGAAG CGCCGCGCTTCCTCCTGAAGGTGACTGCGCCCGC GGGGACGCAGGGGGCGGGGCCCGGGTCGCCCG GAGCCGGGATTGGGCAGAGGGCGGGGCGGCGGA GGGATTGCGGCGGCCCGCAGCGGGATAACCTTGA GGCTGAGGCAGTGGCTCCTTGCACAGCAGCTGCA CGCGCCGTGGCTCCGGATCTCTTCGTCTTTGCAG CGTAGCCCGAGTCGGTCAGCGCCGGAGGACCTCA GCAGCCATGTCGAAGCCCCATAGTGAAGCCGGGA CTGCCTTCATTCAGACCCAGCAGCTGCACGCAGC CATGGCTGACACATTCCTGGAGCACATGTGCCGC CTGGACATTGATTCACCACCCATCACAGCCCGGAA CACTGGCATCATCTGTACCATTGGCCCAGCTTCCC GATCAGTGGAGACGTTGAAGGAGATGATTAAGTCT GGAATGAATGTGGCTCGTCTGAACTTCTCTCATGG AACTCATGAGTACCATGCGGAGACCATCAAGAATG TGCGCACAGCCACGGAAAGCTTTGCTTCTGACCC CATCCTCTACCGGCCCGTTGCTGTGGCTCTAGACA CTAAAGGACCTGAGATCCGAACTGGGCTCATCAA GGGCAGCGGCACTGCAGAGGTGGAGCTGAAGAA GGGAGCCACTCTCAAAATCACGCTGGATAACGCC TACATGGAAAAGTGTGACGAGAACATCCTGTGGCT GGACTACAAGAACATCTGCAAGGTGGTGGAAGTG GGCAGCAAGATCTACGTGGATGATGGGCTTATTTC TCTCCAGGTGAAGCAGAAAGGTGCCGACTTCCTG GTGACGGAGGTGGAAAATGGTGGCTCCTTGGGCA GCAAGAAGGGTGTGAACCTTCCTGGGGCTGCTGT GGACTTGCCTGCTGTGTCGGAGAAGGACATCCAG GATCTGAAGTTTGGGGTCGAGCAGGATGTTGATAT GGTGTTTGCGTCATTCATCCGCAAGGCATCTGATG TCCATGAAGTTAGGAAGGTCCTGGGAGAGAAG CGCCGCGCTTCCTCCTGAAGGTGACTGCGCCCGC | 19 | QKPPPWV PWRPPSS AAVGP* |
| 1101 | NM_0026 54.3_1567 | 1567 | GGGGACGCAGGGGGCGGGGCCCGGGTCGCCCG GAGCCGGGATTGGGCAGAGGGCGGGGCGGCGGA GGGATTGCGGCGGCCCGCAGCGGGATAACCTTGA GGCTGAGGCAGTGGCTCCTTGCACAGCAGCTGCA CGCGCCGTGGCTCCGGATCTCTTCGTCTTTGCAG CGTAGCCCGAGTCGGTCAGCGCCGGAGGACCTCA GCAGCCATGTCGAAGCCCCATAGTGAAGCCGGGA CTGCCTTCATTCAGACCCAGCAGCTGCACGCAGC CATGGCTGACACATTCCTGGAGCACATGTGCCGC CTGGACATTGATTCACCACCCATCACAGCCCGGAA CACTGGCATCATCTGTACCATTGGCCCAGCTTCCC GATCAGTGGAGACGTTGAAGGAGATGATTAAGTCT GGAATGAATGTGGCTCGTCTGAACTTCTCTCATGG AACTCATGAGTACCATGCGGAGACCATCAAGAATG TGCGCACAGCCACGGAAAGCTTTGCTTCTGACCC CATCCTCTACCGGCCCGTTGCTGTGGCTCTAGACA CTAAAGGACCTGAGATCCGAACTGGGCTCATCAA GGGCAGCGGCACTGCAGAGGTGGAGCTGAAGAA GGGAGCCACTCTCAAAATCACGCTGGATAACGCC TACATGGAAAAGTGTGACGAGAACATCCTGTGGCT GGACTACAAGAACATCTGCAAGGTGGTGGAAGTG GGCAGCAAGATCTACGTGGATGATGGGCTTATTTC TCTCCAGGTGAAGCAGAAAGGTGCCGACTTCCTG GTGACGGAGGTGGAAAATGGTGGCTCCTTGGGCA GCAAGAAGGGTGTGAACCTTCCTGGGGCTGCTGT GGACTTGCCTGCTGTGTCGGAGAAGGACATCCAG GATCTGAAGTTTGGGGTCGAGCAGGATGTTGATAT GGTGTTTGCGTCATTCATCCGCAAGGCATCTGATG TCCATGAAGTTAGGAAGGTCCTGGGAGAGAAG CGCCGCGCTTCCTCCTGAAGGTGACTGCGCCCGC | 10 | DTAHVPPS LL* |
| 1102 | NM_0026 54.3_1578 | 1578 | GGGGACGCAGGGGGCGGGGCCCGGGTCGCCCG GAGCCGGGATTGGGCAGAGGGCGGGGCGGCGGA GGGATTGCGGCGGCCCGCAGCGGGATAACCTTGA GGCTGAGGCAGTGGCTCCTTGCACAGCAGCTGCA CGCGCCGTGGCTCCGGATCTCTTCGTCTTTGCAG CGTAGCCCGAGTCGGTCAGCGCCGGAGGACCTCA GCAGCCATGTCGAAGCCCCATAGTGAAGCCGGGA CTGCCTTCATTCAGACCCAGCAGCTGCACGCAGC CATGGCTGACACATTCCTGGAGCACATGTGCCGC CTGGACATTGATTCACCACCCATCACAGCCCGGAA CACTGGCATCATCTGTACCATTGGCCCAGCTTCCC GATCAGTGGAGACGTTGAAGGAGATGATTAAGTCT GGAATGAATGTGGCTCGTCTGAACTTCTCTCATGG AACTCATGAGTACCATGCGGAGACCATCAAGAATG | 7 | HVPPSLL* |

TABLE 3A-continued

| SEQ ID | identifier_position | position | modified_RNA | PAP length | PAP |
|---|---|---|---|---|---|
| | | | TGCGCACAGCCACGGAAAAGCTTTGCTTCTGACCC<br>CATCCTCTACCGGCCCGTTGCTGTGGCTCTAGACA<br>CTAAAGGACCTGAGATCCGAACTGGGCTCATCAA<br>GGGCAGCGGCACTGCAGAGGTGGAGCTGAAGAA<br>GGGAGCCACTCTCAAAATCACGCTGGATAACGCC<br>TACATGGAAAAGTGTGACGAGAACATCCTGTGGCT<br>GGACTACAAGAACATCTGCAAGGTGGTGGAAGTG<br>GGCAGCAAGATCTACGTGGATGATGGGCTTATTTC<br>TCTCCAGGTGAAGCAGAAAGGTGCCGACTTCCTG<br>GTGACGGAGGTGGAAAATGGTGGCTCCTTGGGCA<br>GCAAGAAGGGTGTGAACCTTCCTGGGGCTGCTGT<br>GGACTTGCCTGCTGTGTCGGAGAAGGACATCCAG<br>GATCTGAAGTTTGGGGTCGAGCAGGATGTTGATAT<br>GGTGTTTGCGTCATTCATCCGCAAGGCATCTGATG<br>TCCATGAAGTTAGGAAGGTCCTGGGAGAGAAG | | |
| 1103 | NM_0026<br>54.3_934 | 934 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCCACGGAAAAGCTTTGCTTCTGACCC<br>CATCCTCTACCGGCCCGTTGCTGTGGCTCTAGACA<br>CTAAAGGACCTGAGATCCGAACTGGGCTCATCAA<br>GGGCAGCGGCACTGCAGAGGTGGAGCTGAAGAA<br>GGGAGCCACTCTCAAAATCACGCTGGATAACGCC<br>TACATGGAAAAGTGTGACGAGAACATCCTGTGGCT<br>GGACTACAAGAACATCTGCAAGGTGGTGGAAGTG<br>GGCAGCAAGATCTACGTGGATGATGGGCTTATTTC<br>TCTCCAGGTGAAGCAGAAAGGTGCCGACTTCCTG<br>GTGACGGAGGTGGAAAATGGTGGCTCCTTGGGCA<br>GCAAGAAGGGTGTGAACCTTCCTGGGGCTGCTGT<br>GGACTTGCCTGCTGTGTCGGAGAAGGACATCCAG<br>GATCTGAAGTTGGGGTCGAGCAGGATGTTGATAT<br>GGTGTTTGCGTCATTCATCCGCAAGGCATCTGATG<br>TCCATGAAGTTAGGAAGGTCCTGGGAGAGAAGG | 66 | LGSSRMLI<br>WCLRHSS<br>ARHLMSM<br>KLGRSWE<br>RRERTSRL<br>SAKSRIMR<br>GFGGLMK<br>SWRPVMG<br>SWWLVVI* |
| 1104 | NM_0027<br>08.3_194 | 194 | GCGGGGCCGCGGGCCGGGGGCGGACTGGGGCG<br>GGCGGAAGGAGAGCCAGGCCGGAAGGAGGCTGC<br>CGGAGGGCGGGAGGCAGGAGCGGGCCAGGAGCT<br>GCTGGGCTGGAGCGGCGGCGCCGCCATGTCCGA<br>CAGCGAGAAGCTCAACCTGGACTCGATCATCGGG<br>CGCCTGCTGGAAGTGCAGGGCTCGCGGCTGGCA<br>AGAATGTACAGCTGACAGAGAACGAGATCCGCGG<br>TCTGTGCCTGAAATCCCGGGAGATTTTTCTGAGCC<br>AGCCCATTCTTCTGGAGCTGGAGGCACCCCTCAA<br>GATCTGCGGTGACATACACGGCCAGTACTACGAC<br>CTTCTGCGACTATTTGAGTATGGCGGTTTCCCTCC<br>CGAGAGCAACTACCTCTTTCTGGGGGACTATGTGG<br>ACAGGGGCAAGCAGTCCTTGGAGACCATCTGCCT<br>GCTGCTGGCCTATAAGATCAAGTACCCCGAGAACT<br>TCTTCCTGCTCCGTGGGAACCACGAGTGTGCCAG<br>CATCAACCGCATCTATGGTTTCTACGATGAGTGCA<br>AGAGACGCTACAACATCAAACTGTGGAAAACCTTC<br>ACTGACTGCTTCAACTGCCTGCCCATCGCGGCCAT<br>AGTGGACGAAAAGATCTTCTGCTGCCACGGAGGC<br>CTGTCCCCGGACCTGCAGTCTATGGAGCAGATTC<br>GGCGGATCATGCGGCCCACAGATGTGCCTGACCA<br>GGGCCTGCTGTGTGACCTGCTGTGGTCTGACCCT<br>GACAAGGACGTGCAGGGCTGGGGCGAGAACGAC<br>CGTGGCGTCTCTTTTACCTTTGGAGCCGAGGTGGT<br>GGCCAAGTTCCTCCACAAGCACGACTTGGACCTC<br>ATCTGCCGAGCACACCAGGTGGTAGAAGACGGCT<br>ACGAGTTCTTTGCCAAGCGGCAGCTGGTGACACTT<br>TTCTCAGCTCCCAACTACTGTGGCGAGTTTGACAA<br>TGCTGGCGCCATGATGAGTGTGGACGAGACCCTC<br>ATGTGCTCTTTCCAGATCCTCAAGCCCGCCGACAA | 6 | LARMYS* |

TABLE 3A-continued

| SEQ ID | identifier_position | position | modified_RNA | PAP length | PAP |
|---|---|---|---|---|---|
| 1105 | NM_002708.3_612 | 612 | GCGGGGCCGCGGGCCGGGGGCGGACTGGGGCG GGCGGAAGGAGAGCCAGGCCGGAAGGAGGCTGC CGGAGGGCGGGAGGCAGGAGCGGGCCAGGAGCT GCTGGGCTGGAGCGGCGGCGCCGCCATGTCCGA CAGCGAGAAGCTCAACCTGGACTCGATCATCGGG CGCCTGCTGGAAGTGCAGGGCTCGCGGCCTGGC AAGAATGTACAGCTGACAGAGAACGAGATCCGCG GTCTGTGCCTGAAATCCCGGGAGATTTTTCTGAGC CAGCCCATTCTTCTGGAGCTGGAGGCACCCCTCA AGATCTGCGGTGACATACACGGCCAGTACTACGA CCTTCTGCGACTATTTGAGTATGGCGGTTTCCCTC CCGAGAGCAACTACCTCTTTCTGGGGGACTATGTG GACAGGGGCAAGCAGTCCTTGGAGACCATCTGCC TGCTGCTGGCCTATAAGATCAAGTACCCCGAGAAC TTCTTCCTGCTCCGTGGGAACCACGAGTGTGCCA GCATCAACCGCATCTATGGTTTCTACGATGAGTGC AAGAGACGCTACAACATCAAACTGTGGAAAACCTT CACTGACTGCTTCAACTGCCTGCCCATCGCGGCAT AGTGGACGAAAAGATCTTCTGCTGCCACGGAGGC CTGTCCCCGGACCTGCAGTCTATGGAGCAGATTC GGCGGATCATGCGGCCCACAGATGTGCCTGACCA GGGCCTGCTGTGTGACCTGCTGTGGTCTGACCCT GACAAGGACGTGCAGGGCTGGGGCGAGAACGAC CGTGGCGTCTCTTTTACCTTTGGAGCCGAGGTGGT GGCCAAGTTCCTCCACAAGCACGACTTGGACCTC ATCTGCCGAGCACACCAGGTGGTAGAAGACGGCT ACGAGTTCTTTGCCAAGCGGCAGCTGGTGACACTT TTCTCAGCTCCCAACTACTGTGGCGAGTTTGACAA TGCTGGCGCCATGATGAGTGTGGACGAGACCCTC ATGTGCTCTTTCCAGATCCTCAAGCCCGCCGACAA | 0 | * |
| 1106 | NM_002708.3_699 | 699 | GCGGGGCCGCGGGCCGGGGGCGGACTGGGGCG GGCGGAAGGAGAGCCAGGCCGGAAGGAGGCTGC CGGAGGGCGGGAGGCAGGAGCGGGCCAGGAGCT GCTGGGCTGGAGCGGCGGCGCCGCCATGTCCGA CAGCGAGAAGCTCAACCTGGACTCGATCATCGGG CGCCTGCTGGAAGTGCAGGGCTCGCGGCCTGGC AAGAATGTACAGCTGACAGAGAACGAGATCCGCG GTCTGTGCCTGAAATCCCGGGAGATTTTTCTGAGC CAGCCCATTCTTCTGGAGCTGGAGGCACCCCTCA AGATCTGCGGTGACATACACGGCCAGTACTACGA CCTTCTGCGACTATTTGAGTATGGCGGTTTCCCTC CCGAGAGCAACTACCTCTTTCTGGGGGACTATGTG GACAGGGGCAAGCAGTCCTTGGAGACCATCTGCC TGCTGCTGGCCTATAAGATCAAGTACCCCGAGAAC TTCTTCCTGCTCCGTGGGAACCACGAGTGTGCCA GCATCAACCGCATCTATGGTTTCTACGATGAGTGC AAGAGACGCTACAACATCAAACTGTGGAAAACCTT CACTGACTGCTTCAACTGCCTGCCCATCGCGGCC ATAGTGGACGAAAAGATCTTCTGCTGCCACGGAG GCCTGTCCCCGGACCTGCAGTCTATGGAGCAGAT TCGGCGGATCATGCGGCCCACAGATGTGCCTGACC AGGGCCTGCTGTGTGACCTGCTGTGGTCTGACCC TGACAAGGACGTGCAGGGCTGGGGCGAGAACGA CCGTGGCGTCTCTTTTACCTTTGGAGCCGAGGTG GTGGCCAAGTTCCTCCACAAGCACGACTTGGACC TCATCTGCCGAGCACACCAGGTGGTAGAAGACGG CTACGAGTTCTTTGCCAAGCGGCAGCTGGTGACA CTTTTCTCAGCTCCCAACTACTGTGGCGAGTTTGA CAATGCTGGCGCCATGATGAGTGTGGACGAGACC CTCATGTGCTCTTTCCAGATCCTCAAGCCCGCCGA CAA | 58 | QMCLTRA CCVTCCGL TLTRTCRA GARTTVAS LLPLEPRW WPSSSTST TWTSSAEH TRW* |
| 1107 | NM_002778.2_1560 | 1560 | GGGGTTAGCGCCTGCGCTCTGGACGGCTTTGGGG CAGGGCAGATTTATATCTGCGGGGGATCAGCTGA CGCTCCGCATTGCAGACTGCGGAGTCAGACGGCG CTATGTACGCCCTCTTCCTCCTGGCCAGCCTCCTG GGCGCGGCTCTAGCCGGCCCGGTCCTTGGACTGA AAGAATGCACCAGGGGCTCGGCAGTGTGGTGCCA GAATGTGAAGACGGCGTCCGACTGCGGGGCAGTG AAGCACTGCCTGCAGACCGTTTGGAACAAGCCAA CAGTGAAATCCCTTCCCTGCGACATATGCAAAGAC GTTGTCACCGCAGCTGGTGATATGCTGAAGGACA ATGCCACTGAGGAGGAGATCCTTGTTTACTTGGAG AAGACCTGTGACTGGCTTCCGAAACCGAACATGTC TGCTTCATGCAAGGAGATAGTGGACTCCTACCTCC CTGTCATCCTGGACATCATTAAAGGAGAAATGAGC CGTCCTGGGGAGGTGTGCTCTGCTCTCAACCTCT GCGAGTCTCTCCAGAAGCACCTAGCAGAGCTGAA | 72 | ISPCWELR SVYGAQAT GARTQRQ QPSAMLSS IANAMCGT RRRNIPSW QKPQHWF FSTCVSGG MNAQICLT LL* |

TABLE 3A-continued

| SEQ ID | identifier_ position | position | modified_RNA | PAP length | PAP |
|---|---|---|---|---|---|
| | | | TCACCAGAAGCAGCTGGAGTCCAATAAGATCCCA<br>GAGCTGGACATGACTGAGGTGGTGGCCCCCTTCA<br>TGGCCAACATCCCTCTCCTCCTCTACCCTCAGGAC<br>GGCCCCCGCAGCAAGCCCCAGCCAAAGGATAATG<br>GGGACGTTTGCCAGGACTGCATTCAGATGGTGAC<br>TGACATCCAGACTGCTGTACGGACCAACTCCACCT<br>TTGTCCAGGCCTTGGTGGAACATGTCAAGGAGGA<br>GTGTGACCGCCTGGGCCCTGGCATGGCCGACATA<br>TGCAAGAACTATATCAGCCAGTATTCTGAAATTGCT<br>ATCCAGATGATGATGCACATGCAACCCAAGGAGAT<br>CTGTGCGCTGGTTGGGTTCTGTGATGAGGTGAAA<br>GAGATGCCCATGCAGACTCTGGTCCCCGCCAAAG<br>TGGCCTCCAAGAATGTCATCCCTGCCCTGGAACTG<br>GTGGAGCCCATTAAGAAGCACGAGGT | | |
| 1108 | NM_0027 78.2_157 | 157 | GGGGTTAGCGCCTGCGCTCTGGACGGCTTTGGGG<br>CAGGGCAGATTTATATCTGCGGGGGATCAGCTGA<br>CGCTCCGCATTGCAGACTGCGGAGTCAGACGGCG<br>CTATGTACGCCCTCTTCCTCCTGGCCAGCCTCCTG<br>GGCGCGGCTCTAGCCGGCCGGTCCTTGGACTGAA<br>AGAATGCACCAGGGGCTCGGCAGTGTGGTGCCAG<br>AATGTGAAGACGGCGTCCGACTGCGGGGCAGTGA<br>AGCACTGCCTGCAGACCGTTTGGAACAAGCCAAC<br>AGTGAAATCCCTTCCCTGCGACATATGCAAAGACG<br>TTGTCACCGCAGCTGGTGATATGCTGAAGGACAAT<br>GCCACTGAGGAGGAGATCCTTGTTTACTTGGAGAA<br>GACCTGTGACTGGCTTCCGAAACCGAACATGTCTG<br>CTTCATGCAAGGAGATAGTGGACTCCTACCTCCCT<br>GTCATCCTGGACATCATTAAAGGAGAAATGAGCCG<br>TCCTGGGGAGGTGTGCTCTGCTCTCAACCTCTGC<br>GAGTCTCTCCAGAAGCACCTAGCAGAGCTGAATCA<br>CCAGAAGCAGCTGGAGTCCAATAAGATCCCAGAG<br>CTGGACATGACTGAGGTGGTGGCCCCCTTCATGG<br>CCAACATCCCTCTCCTCCTCTACCCTCAGGACGGC<br>CCCCGCAGCAAGCCCCAGCCAAAGGATAATGGGG<br>ACGTTTGCCAGGACTGCATTCAGATGGTGACTGAC<br>ATCCAGACTGCTGTACGGACCAACTCCACCTTTGT<br>CCAGGCCTTGGTGGAACATGTCAAGGAGGAGTGT<br>GACCGCCTGGGCCCTGGCATGGCCGACATATGCA<br>AGAACTATATCAGCCAGTATTCTGAAATTGCTATCC<br>AGATGATGATGCACATGCAACCCAAGGAGATCTGT<br>GCGCTGGTTGGGTTCTGTGATGAGGTGAAAGAGA<br>TGCCCATGCAGACTCTGGTCCCCGCCAAAGTGGC<br>CTCCAAGAATGTCATCCCTGCCCTGGAACTGGTGG<br>AGCCCATTAAGAAGCACGAGGTC | 4 | RSLD* |
| 1109 | NM_0027 78.2_187 | 187 | GGGGTTAGCGCCTGCGCTCTGGACGGCTTTGGGG<br>CAGGGCAGATTTATATCTGCGGGGGATCAGCTGA<br>CGCTCCGCATTGCAGACTGCGGAGTCAGACGGCG<br>CTATGTACGCCCTCTTCCTCCTGGCCAGCCTCCTG<br>GGCGCGGCTCTAGCCGGCCGGTCCTTGGACTGAA<br>AAGAATGCACCAGGGGCTCGGCAGTGTGGTGCCAG<br>AATGTGAAGACGGCGTCCGACTGCGGGGCAGTGA<br>AGCACTGCCTGCAGACCGTTTGGAACAAGCCAAC<br>AGTGAAATCCCTTCCCTGCGACATATGCAAAGACG<br>TTGTCACCGCAGCTGGTGATATGCTGAAGGACAAT<br>GCCACTGAGGAGGAGATCCTTGTTTACTTGGAGAA<br>GACCTGTGACTGGCTTCCGAAACCGAACATGTCTG<br>CTTCATGCAAGGAGATAGTGGACTCCTACCTCCCT<br>GTCATCCTGGACATCATTAAAGGAGAAATGAGCCG<br>TCCTGGGGAGGTGTGCTCTGCTCTCAACCTCTGC<br>GAGTCTCTCCAGAAGCACCTAGCAGAGCTGAATCA<br>CCAGAAGCAGCTGGAGTCCAATAAGATCCCAGAG<br>CTGGACATGACTGAGGTGGTGGCCCCCTTCATGG<br>CCAACATCCCTCTCCTCCTCTACCCTCAGGACGGC<br>CCCCGCAGCAAGCCCCAGCCAAAGGATAATGGGG<br>ACGTTTGCCAGGACTGCATTCAGATGGTGACTGAC<br>ATCCAGACTGCTGTACGGACCAACTCCACCTTTGT<br>CCAGGCCTTGGTGGAACATGTCAAGGAGGAGTGT<br>GACCGCCTGGGCCCTGGCATGGCCGACATATGCA<br>AGAACTATATCAGCCAGTATTCTGAAATTGCTATCC<br>AGATGATGATGCACATGCAACCCAAGGAGATCTGT<br>GCGCTGGTTGGGTTCTGTGATGAGGTGAAAGAGA<br>TGCCCATGCAGACTCTGGTCCCCGCCAAAGTGGC<br>CTCCAAGAATGTCATCCCTGCCCTGGAACTGGTGG<br>AGCCCATTAAGAAGCACGAGGTC | 8 | ARQCGAR M* |
| 1110 | NM_0027 78.2_623 | 623 | GGGGTTAGCGCCTGCGCTCTGGACGGCTTTGGGG<br>CAGGGCAGATTTATATCTGCGGGGGATCAGCTGA<br>CGCTCCGCATTGCAGACTGCGGAGTCAGACGGCG | 31 | TSLSSSTL RTAPAASP SQRIMGTF |

TABLE 3A-continued

| SEQ ID | identifier_position | position | modified_RNA | length PAP | PAP |
|---|---|---|---|---|---|
| | | | CTATGTACGCCCTCTTCCTCCTGGCCAGCCTCCTG GGGCGCGGCTCTAGCCGGCCCGGTCCTTGGACTGA AAGAATGCACCAGGGGCTCGGCAGTGTGGTGCCA GAATGTGAAGACGGCGTCCGACTGCGGGGCAGTG AAGCACTGCCTGCAGACCGTTTGGAACAAGCCAA CAGTGAAATCCCTTCCCTGCGACATATGCAAAGAC GTTGTCACCGCAGCTGGTGATATGCTGAAGGACA ATGCCACTGAGGAGGAGATCCTTGTTTACTTGGAG AAGACCTGTGACTGGCTTCCGAAACCGAACATGTC TGCTTCATGCAAGGAGATAGTGGACTCCTACCTCC CTGTCATCCTGGACATCATTAAAGGAGAAATGAGC CGTCCTGGGGAGGTGTGCTCTGCTCTCAACCTCT GCGAGTCTCTCCAGAAGCACCTAGCAGAGCTGAA TCACCAGAAGCAGCTGGAGTCCAATAAGATCCCA GAGCTGGACATGACTGAGGTGGTGGCCCCCTTCA TGGCAACATCCCTCTCCTCCTCTACCCTCAGGACG GCCCCCGCAGCAAGCCCCAGCCAAAGGATAATGG GGACGTTTGCCAGGACTGCATTCAGATGGTGACT GACATCCAGACTGCTGTACGGACCAACTCCACCTT TGTCCAGGCCTTGGTGGAACATGTCAAGGAGGAG TGTGACCGCCTGGGCCCTGGCATGGCCGACATAT GCAAGAACTATATCAGCCAGTATTCTGAAATTGCT ATCCAGATGATGATGCACATGCAACCCAAGGAGAT CTGTGCGCTGGTTGGGTTCTGTGATGAGGTGAAA GAGATGCCCATGCAGACTCTGGTCCCCGCCAAAG TGGCCTCCAAGAATGTCATCCCTGCCCTGGAACTG GTGGAGCCCATTAAGAAGCACGAGGTC | | ARTAFRW* |
| 1111 | NM_0027 78.2_660 | 660 | GGGGTTAGCGCCTGCGCTCTGGACGGCTTTGGGG CAGGGCAGATTTATATCTGCGGGGGATCAGCTGA CGCTCCGCATTGCAGACTGCGGAGTCAGACGGCG CTATGTACGCCCTCTTCCTCCTGGCCAGCCTCCTG GGGCGCGGCTCTAGCCGGCCCGGTCCTTGGACTGA AAGAATGCACCAGGGGCTCGGCAGTGTGGTGCCA GAATGTGAAGACGGCGTCCGACTGCGGGGCAGTG AAGCACTGCCTGCAGACCGTTTGGAACAAGCCAA CAGTGAAATCCCTTCCCTGCGACATATGCAAAGAC GTTGTCACCGCAGCTGGTGATATGCTGAAGGACA ATGCCACTGAGGAGGAGATCCTTGTTTACTTGGAG AAGACCTGTGACTGGCTTCCGAAACCGAACATGTC TGCTTCATGCAAGGAGATAGTGGACTCCTACCTCC CTGTCATCCTGGACATCATTAAAGGAGAAATGAGC CGTCCTGGGGAGGTGTGCTCTGCTCTCAACCTCT GCGAGTCTCTCCAGAAGCACCTAGCAGAGCTGAA TCACCAGAAGCAGCTGGAGTCCAATAAGATCCCA GAGCTGGACATGACTGAGGTGGTGGCCCCCTTCA TGGCCAACATCCCTCTCCTCCTCTACCCTCAGGAC GGCCCCCGCAGCAAGCCCCAGCCAAAGGATAATGG GGACGTTTGCCAGGACTGCATTCAGATGGTGACT GACATCCAGACTGCTGTACGGACCAACTCCACCTT TGTCCAGGCCTTGGTGGAACATGTCAAGGAGGAG TGTGACCGCCTGGGCCCTGGCATGGCCGACATAT GCAAGAACTATATCAGCCAGTATTCTGAAATTGCT ATCCAGATGATGATGCACATGCAACCCAAGGAGAT CTGTGCGCTGGTTGGGTTCTGTGATGAGGTGAAA GAGATGCCCATGCAGACTCTGGTCCCCGCCAAAG TGGCCTCCAAGAATGTCATCCCTGCCCTGGAACTG GTGGAGCCCATTAAGAAGCACGAGGTC | 19 | AASPSQRI MGTFARTA FRW* |
| 1112 | NM_0027 78.2_676 | 676 | GGGGTTAGCGCCTGCGCTCTGGACGGCTTTGGGG CAGGGCAGATTTATATCTGCGGGGGATCAGCTGA CGCTCCGCATTGCAGACTGCGGAGTCAGACGGCG CTATGTACGCCCTCTTCCTCCTGGCCAGCCTCCTG GGCGCGGCTCTAGCCGGCCCGGTCCTTGGACTGA AAGAATGCACCAGGGGCTCGGCAGTGTGGTGCCA GAATGTGAAGACGGCGTCCGACTGCGGGGCAGTG AAGCACTGCCTGCAGACCGTTTGGAACAAGCCAA CAGTGAAATCCCTTCCCTGCGACATATGCAAAGAC GTTGTCACCGCAGCTGGTGATATGCTGAAGGACA ATGCCACTGAGGAGGAGATCCTTGTTTACTTGGAG AAGACCTGTGACTGGCTTCCGAAACCGAACATGTC TGCTTCATGCAAGGAGATAGTGGACTCCTACCTCC CTGTCATCCTGGACATCATTAAAGGAGAAATGAGC CGTCCTGGGGAGGTGTGCTCTGCTCTCAACCTCT GCGAGTCTCTCCAGAAGCACCTAGCAGAGCTGAA TCACCAGAAGCAGCTGGAGTCCAATAAGATCCCA GAGCTGGACATGACTGAGGTGGTGGCCCCCTTCA TGGCCAACATCCCTCTCCTCCTCTACCCTCAGGAC GGCCCCCGCAGCAAGCCCCAGCCAAAGGATAATGG | 14 | QRIMGTFA RTAFRW* |

TABLE 3A-continued

| SEQ ID | identifier_ position | position | modified_RNA | PAP length | PAP |
|---|---|---|---|---|---|
| | | | GGACGTTTGCCAGGACTGCATTCAGATGGTGACTGACATCCAGACTGCTGTACGGACCAACTCCACCTTTGTCCAGGCCTTGGTGGAACATGTCAAGGAGGAGTGTGACCGCCTGGGCCCTGGCATGGCCGACATATGCAAGAACTATATCAGCCAGTATTCTGAAATTGCTATCCAGATGATGATGCACATGCAACCCAAGGAGATCTGTGCGCTGGTTGGGTTCTGTGATGAGGTGAAAGAGATGCCCATGCAGACTCTGGTCCCCGCCAAAGTGGCCTCCAAGAATGTCATCCCTGCCCTGGAACTGGTGGAGCCCATTAAGAAGCACGAGGTC | | |
| 1113 | NM_0027 86.2_153 | 153 | AAACTCCCGCAGACTTCTCTGTAGATCGCTGAGCGATACTTTCGGCAGCACCTCCTTGATTCTCAGTTTTGCTGGAGGCCGCAACCAGGCCCGCGCCGCCACCATGTTTCGAAATCAGTATGACAATGATGTCACTGTTTGGAGCCCCCAGGGCAGGATTCATCAAATTGAATATGCAATGGAAGCTGTTAAACAAGGTTCAGCCACAGTTGGTCTGAAATCAAAAACTCATGCAGTTTTGGTTGCATTGAAAAGGGCGCAATCAGAGCTTGCAGCTCATCAGAAAAAAATTCTCCATGTTGACAACCATATTGGTATCTCAATTGCGGGGCTTACTGCTGATGCTAGACTGTTATGTAATTTTATGCGTCAGGAGTGTTTGGATTCCAGATTTGTATTCGATAGACCACTGCCTGTGTCTCGTCTTGTATCTCTAATTGGAAGCAAGACCCAGATACCAACACAACGATATGGCCGGAGACCATATGGTGTTGGTCTCCTTATTGCTGGTTATGATGATATGGGCCCTCACATTTTCCAAACCTGTCCATCTGCTAACTATTTTGACTGCAGAGCCATGTCCATTGGAGCCCGTTCCCAATCAGCTCGTACTTACTTGGAGAGACATATGTCTGAATTTATGGAGTGTAATTTAAATGAACTAGTTAAACATGGTCTGCGTGCCTTAAGAGAGACGCTTCCTGCAGAACAGGACCTGACTACAAAGAATGTTTCCATTGGAATTGTTGGTAAAGACTTGGAGTTTACAATCTATGATGATGATGATGTGTCTCCATTCCTGGAAGGTCTTGAAGAAAGACCACAGAGAAAGGCACAGCCTGCTCAACCTGCTGATGAACCTGCAGAAAAGGCTGATGAACCAATGGAACATTAAGTGATAAGCCAGTCTATATATGTATTATCAAATATGTAAGAATACAGGCACCACATACTGATGACAATAATCTATACTTTGAACCAAAAGTTGCAGAGTGGTGGAATGCTATGTTTTAGGAATCAGTCCA | 21 | AGFIKLNMQWKLLNKVQPQLV* |
| 1114 | NM_0027 86.2_240 | 240 | AAACTCCCGCAGACTTCTCTGTAGATCGCTGAGCGATACTTTCGGCAGCACCTCCTTGATTCTCAGTTTTGCTGGAGGCCGCAACCAGGCCCGCGCCGCCACCATGTTTCGAAATCAGTATGACAATGATGTCACTGTTTGGAGCCCCCAGGGCAGGATTCATCAAATTGAATATGCAATGGAAGCTGTTAAACAAGGTTCAGCCACAGTTGGTCTGAAATCAAAAACTCATGCAGTTTTGGTTGCATTGAAAAGGGCGCAATCAGAGCTTGCAGCTCATCAGAAAAAAATTCTCCATGTTGACAACCATATTGGTATCTCAATTGCGGGGCTTACTGCTGATGCTAGACTGTTATGTAATTTTATGCGTCAGGAGTGTTTGGATTCCAGATTTGTATTCGATAGACCACTGCCTGTGTCTCGTCTTGTATCTCTAATTGGAAGCAAGACCCAGATACCAACACAACGATATGGCCGGAGACCATATGGTGTTGGTCTCCTTATTGCTGGTTATGATGATATGGGCCCTCACATTTTCCAAACCTGTCCATCTGCTAACTATTTTGACTGCAGAGCCATGTCCATTGGAGCCCGTTCCCAATCAGCTCGTACTTACTTGGAGAGACATATGTCTGAATTTATGGAGTGTAATTTAAATGAACTAGTTAAACATGGTCTGCGTGCCTTAAGAGAGACGCTTCCTGCAGAACAGGACCTGACTACAAAGAATGTTTCCATTGGAATTGTTGGTAAAGACTTGGAGTTTACAATCTATGATGATGATGATGTGTCTCCATTCCTGGAAGGTCTTGAAGAAAGACCACAGAGAAAGGCACAGCCTGCTCAACCTGCTGATGAACCTGCAGAAAAGGCTGATGAACCAATGGAACATTAAGTGATAAGCCAGTCTATATATGTATTATCAAATATGTAAGAATACAGGCACCACATACTGATGACAATAATCTATACTTTGAACCAAAAGTTGCAGAGTGGTGGAATGCTATGTTTTAGGAATCAGTCCA | 3 | WLH* |
| 1115 | NM_0027 86.2_313 | 313 | AAACTCCCGCAGACTTCTCTGTAGATCGCTGAGCGATACTTTCGGCAGCACCTCCTTGATTCTCAGTTTTGCTGGAGGCCGCAACCAGGCCCGCGCCGCCACCATGTTTCGAAATCAGTATGACAATGATGTCACTGTTTGGAGCCCCCAGGGCAGGATTCATCAAATTGAATATGCAATGGAAGCTGTTAAACAAGGTTCAGCCACAGTTGGTCTGAAATCAAAAACTCATGCAGTTTTGGTTG | 41 | MVSQLRGLLLMLDCYVILCVRSVWIPDLYSIDHCLCLVLYL* |

TABLE 3A-continued

| SEQ ID | identifier_position | position | modified_RNA | PAP length | PAP |
|---|---|---|---|---|---|
| | | | CATTGAAAAGGGCGCAATCAGAGCTTGCAGCTCAT<br>CAGAAAAAAATTCTCCATGTTGACAACCATATGGTA<br>TCTCAATTGCGGGGCTTACTGCTGATGCTAGACTG<br>TTATGTAATTTTATGCGTCAGGAGTGTTTGGATTCC<br>AGATTTGTATTCGATAGACCACTGCCTGTGTCTCG<br>TCTTGTATCTCTAATTGGAAGCAAGACCCAGATAC<br>CAACACAACGATATGGCCGGAGACCATATGGTGTT<br>GGTCTCCTTATTGCTGGTTATGATGATATGGGCCC<br>TCACATTTTCCAAACCTGTCCATCTGCTAACTATTT<br>TGACTGCAGAGCCATGTCCATTGGAGCCCGTTCC<br>CAATCAGCTCGTACTTACTTGGAGAGACATATGTC<br>TGAATTTATGGAGTGTAATTTAAATGAACTAGTTAA<br>ACATGGTCTGCGTGCCTTAAGAGAGACGCTTCCTG<br>CAGAACAGGACCTGACTACAAAGAATGTTTCCATT<br>GGAATTGTTGGTAAAGACTTGGAGTTTACAATCTAT<br>GATGATGATGATGTGTCTCCATTCCTGGAAGGTCT<br>TGAAGAAAGACCACAGAGAAAGGCACAGCCTGCT<br>CAACCTGCTGATGAACCTGCAGAAAAGGCTGATGA<br>ACCAATGGAACATTAAGTGATAAGCCAGTCTATAT<br>ATGTATTATCAAATATGTAAGAATACAGGCACCACA<br>TACTGATGACAATAATCTATACTTTGAACCAAAAGT<br>TGCAGAGTGGTGGAATGCTATGTTTTAGGAATCAG<br>TCCA | | |
| 1116 | NM_0027<br>86.2_381 | 381 | AAACTCCCGCAGACTTCTCTGTAGATCGCTGAGCG<br>ATACTTTCGGCAGCACCTCCTTGATTCTCAGTTTTG<br>CTGGAGGCCGCAACCAGGCCCGCGCCGCCACCA<br>TGTTTCGAAATCAGTATGACAATGATGTCACTGTTT<br>GGAGCCCCCAGGGCAGGATTCATCAAATTGAATAT<br>GCAATGGAAGCTGTTAAACAAGGTTCAGCCACAGT<br>TGGTCTGAAATCAAAAACTCATGCAGTTTTGGTTG<br>CATTGAAAAGGGCGCAATCAGAGCTTGCAGCTCAT<br>CAGAAAAAAATTCTCCATGTTGACAACCATATTGGT<br>ATCTCAATTGCGGGGCTTACTGCTGATGCTAGACT<br>GTTATGTAATTTTATGCGTCAGGAGTGTTGGATTCC<br>AGATTTGTATTCGATAGACCACTGCCTGTGTCTCG<br>TCTTGTATCTCTAATTGGAAGCAAGACCCAGATAC<br>CAACACAACGATATGGCCGGAGACCATATGGTGTT<br>GGTCTCCTTATTGCTGGTTATGATGATATGGGCCC<br>TCACATTTTCCAAACCTGTCCATCTGCTAACTATTT<br>TGACTGCAGAGCCATGTCCATTGGAGCCCGTTCC<br>CAATCAGCTCGTACTTACTTGGAGAGACATATGTC<br>TGAATTTATGGAGTGTAATTTAAATGAACTAGTTAA<br>ACATGGTCTGCGTGCCTTAAGAGAGACGCTTCCTG<br>CAGAACAGGACCTGACTACAAAGAATGTTTCCATT<br>GGAATTGTTGGTAAAGACTTGGAGTTTACAATCTAT<br>GATGATGATGATGTGTCTCCATTCCTGGAAGGTCT<br>TGAAGAAAGACCACAGAGAAAGGCACAGCCTGCT<br>CAACCTGCTGATGAACCTGCAGAAAAGGCTGATGA<br>ACCAATGGAACATTAAGTGATAAGCCAGTCTATAT<br>ATGTATTATCAAATATGTAAGAATACAGGCACCACA<br>TACTGATGACAATAATCTATACTTTGAACCAAAAGT<br>TGCAGAGTGGTGGAATGCTATGTTTTAGGAATCAG<br>TCCA | 18 | WIPDLYSID<br>HCLCLVLY<br>L* |
| 1117 | NM_0027<br>86.2_394 | 394 | AAACTCCCGCAGACTTCTCTGTAGATCGCTGAGCG<br>ATACTTTCGGCAGCACCTCCTTGATTCTCAGTTTTG<br>CTGGAGGCCGCAACCAGGCCCGCGCCGCCACCA<br>TGTTTCGAAATCAGTATGACAATGATGTCACTGTTT<br>GGAGCCCCCAGGGCAGGATTCATCAAATTGAATAT<br>GCAATGGAAGCTGTTAAACAAGGTTCAGCCACAGT<br>TGGTCTGAAATCAAAAACTCATGCAGTTTTGGTTG<br>CATTGAAAAGGGCGCAATCAGAGCTTGCAGCTCAT<br>CAGAAAAAAATTCTCCATGTTGACAACCATATTGGT<br>ATCTCAATTGCGGGGCTTACTGCTGATGCTAGACT<br>GTTATGTAATTTTATGCGTCAGGAGTGTTTGGATTC<br>CAGATTGTATTCGATAGACCACTGCCTGTGTCTCG<br>TCTTGTATCTCTAATTGGAAGCAAGACCCAGATAC<br>CAACACAACGATATGGCCGGAGACCATATGGTGTT<br>GGTCTCCTTATTGCTGGTTATGATGATATGGGCCC<br>TCACATTTTCCAAACCTGTCCATCTGCTAACTATTT<br>TGACTGCAGAGCCATGTCCATTGGAGCCCGTTCC<br>CAATCAGCTCGTACTTACTTGGAGAGACATATGTC<br>TGAATTTATGGAGTGTAATTTAAATGAACTAGTTAA<br>ACATGGTCTGCGTGCCTTAAGAGAGACGCTTCCTG<br>CAGAACAGGACCTGACTACAAAGAATGTTTCCATT<br>GGAATTGTTGGTAAAGACTTGGAGTTTACAATCTAT<br>GATGATGATGATGTGTCTCCATTCCTGGAAGGTCT<br>TGAAGAAAGACCACAGAGAAAGGCACAGCCTGCT | 14 | LYSIDHCL<br>CLVLYL* |

TABLE 3A-continued

| SEQ ID | identifier_position | position | modified_RNA | PAP length | PAP |
|---|---|---|---|---|---|
| | | | CAACCTGCTGATGAACCTGCAGAAAAGGCTGATGAACCAATGGAACATTAAGTGATAAGCCAGTCTATATATGTATTATCAAATATGTAAGAATACAGGCACCACATACTGATGACAATAATCTATACTTTGAACCAAAAGTTGCAGAGTGGTGGAATGCTATGTTTTAGGAATCAGTCCA | | |
| 1118 | NM_002786.2_493 | 493 | AAACTCCCGCAGACTTCTCTGTAGATCGCTGAGCGATACTTTCGGCAGCACCTCCTTGATTCTCAGTTTTGCTGGAGGCCGCAACCAGGCCCGCGCCGCCACCATGTTTCGAAATCAGTATGACAATGATGTCACTGTTTGGAGCCCCCAGGGCAGGATTCATCAAATTGAATATGCAATGGAAGCTGTTAAACAAGGTTCAGCCACAGTTGGTCTGAAATCAAAAACTCATGCAGTTTTGGTTGCATTGAAAAGGGCGCAATCAGAGCTTGCAGCTCATCAGAAAAAAATTCTCCATGTTGACAACCATATTGGTATCTCAATTGCGGGGCTTACTGCTGATGCTAGACTGTTATGTAATTTTATGCGTCAGGAGTGTTTGGATTCCAGATTTGTATTCGATAGACCACTGCCTGTGTCTCGTCTTGTATCTCTAATTGGAAGCAAGACCCAGATACCAACACAACGATATGGCCGGAGACCATATGGTGTGGTCTCCTTATTGCTGGTTATGATGATATGGGCCCTCACATTTTCCAAACCTGTCCATCTGCTAACTATTTTGACTGCAGAGCCATGTCCATTGGAGCCCGTTCCCAATCAGCTCGTACTTACTTGGAGAGACATATGTCTGAATTTATGGAGTGTAATTTAAATGAACTAGTTAAACATGGTCTGCGTGCCTTAAGAGAGACGCTTCCTGCAGAACAGGACCTGACTACAAAGAATGTTTCCATTGGAATTGTTGGTAAAGACTTGGAGTTTACAATCTATGATGATGATGTGTCTCCATTCCTGGAAGGTCTTGAAGAAAGACCACAGAGAAAGGCACAGCCTGCTCAACCTGCTGATGAACCTGCAGAAAAGGCTGATGAACCAATGGAACATTAAGTGATAAGCCAGTCTATATATGTATTATCAAATATGTAAGAATACAGGCACCACATACTGATGACAATAATCTATACTTTGAACCAAAAGTTGCAGAGTGGTGGAATGCTATGTTTTAGGAATCAGTCCA | 53 | VSLLLVMMIWALTFSKPVHLLTILTAEPCPLEPVPNQLVLTWRDICLNLWSVI* |
| 1119 | NM_002791.1_136 | 136 | GCGGCTGGTACCCCGGAAGCAGTCGCTGCAACTTCCGGGAGGTGCTTGTGTGCCTGGTGCGGGAGCTACGGGGCCCAGGGATTGTGTTTAAAGTAGTGCTTCTACCAACATGTCCCGTGGTTCCAGCGCCGGTTTGACCGCCACATTACCATTTTTTCACCCGAGGGTCGGCTCTACCAAGTAGAATATGCTTTTAAGGCTATTAACCAGGGTGGCCTTACATCAGTAGCTGTCAGAGGGAAAGACTGTGCAGTAATTGTCACACAGAAGAAAGTACCTGACAAATTATTGGATTCCAGCACAGTGACTCACTTATTCAAGATAACTGAAAACATTGGTTGTGTGATGACCGGAATGACAGCTGACAGCAGATCCCAGGTACAGAGGGCACGCTATGAGGCAGCTAACTGGAAATACAAGTATGGCTATGAGATTCCTGTGGACATGCTGTGTAAAAGAATTGCCGATATTTCTCAGGTCTACACACAGAATGCTGAAATGAGGCCTCTTGGTTGTTGTATGATTTTAATTGGTATAGATGAAGAGCAAGGCCTCAGGTATATAAGTGTGATCCTGCAGGTTACTACTGTGGGTTTAAAGCCACTGCAGCGGGAGTTAAACAAACTGAGTCAACCAGCTTCCTTGAAAAAAAAAGTGAAGAAGAAATTTGATTGGACATTTGAACAGACAGTGGAAACTGCAATTACATGCCTGTCTACTGTTCTATCAATTGATTTCAAACCTTCAGAAATAGAAGTTGGAGTAGTGACAGTTGAAAATCCTAAATTCAGGATTCTTACAGAAGCAGAGATTGATGCTCACCTTGTTGCTCTAGCAGAGAGAGACTAAACATTGTCGTTAGTTTACCAGATCCGTGATGCCACTTACCTGTGTGTTTGGTAACAACAAACCAACATCATGGAGGTCCCTGGATTGAAAAAGGAGCCTCTCCCACTCCTCCTACCACCGAAGTGGTTAGGACTCTATATAAATAAAAACAAGGCTTTTGGAAAATAAAAAAAAAA | 16 | LTATLPFFHPRVGSTK* |
| 1120 | NM_002791.1_213 | 213 | GCGGCTGGTACCCCGGAAGCAGTCGCTGCAACTTCCGGGAGGTGCTTGTGTGCCTGGTGCGGGAGCTACGGGGCCCAGGGATTGTGTTTAAAGTAGTGCTTCTACCAACATGTCCCGTGGTTCCAGCGCCGGTTTGACCGCCACATTACCATTTTTTCACCCGAGGGTCGGCTCTACCAAGTAGAATATGCTTTTAAGGCTATTAACCAGGTGGCCTTACATCAGTAGCTGTCAGAGGGAAAGACTGTGCAGTAATTGTCACACAGAAGAAAGTACCTGACAAATTATTGGATTCCAGCACAGTGACTCACTTATTCAAGATAACTGAAAACATTGGTTGTGTGATGACCGGAATGACAGCTGACAGCAGATCCCAGGTACA | 5 | VALHQ* |

TABLE 3A-continued

| SEQ ID | identifier_position | position | modified_RNA | PAP length | PAP |
|---|---|---|---|---|---|
| | | | GAGGGCACGCTATGAGGCAGCTAACTGGAAATAC AAGTATGGCTATGAGATTCCTGTGGACATGCTGTG TAAAAGAATTGCCGATATTTCTCAGGTCTACACACA GAATGCTGAAATGAGGCCTCTTGGTTGTTGTATGA TTTTAATTGGTATAGATGAAGAGCAAGGCCCTCAG GTATATAAGTGTGATCCTGCAGGTTACTACTGTGG GTTTAAAGCCACTGCAGCGGGAGTTAAACAAACTG AGTCAACCAGCTTCCTTGAAAAAAAAGTGAAGAAG AAATTTGATTGGACATTTGAACAGACAGTGGAAAC TGCAATTACATGCCTGTCTACTGTTCTATCAATTGA TTTCAAACCTTCAGAAATAGAAGTTGGAGTAGTGA CAGTTGAAAATCCTAAATTCAGGATTCTTACAGAAG CAGAGATTGATGCTCACCTTGTTGCTCTAGCAGAG AGAGACTAAACATTGTCGTTAGTTTACCAGATCCG TGATGCCACTTACCTGTGTGTTTGGTAACAACAAA CCAACATCATGGAGGTCCCTGGATTGAAAAAGGA GCCTCTCCCACTCCTCCTACCACCGAAGTGGTTAG GACTCTATATAAATAAAAACAAGGCTTTTGGAAAAT AAAAAAAAA | | |
| 1121 | NM_0027 91.1_291 | 291 | GCGGCTGGTACCCCGGAAGCAGTCGCTGCAACTT CCGGGAGGTGCTTGTGTGCCTGGTGCGGGAGCTA CGGGGCCCAGGGATTGTGTTTAAAGTAGTGCTTCT ACCAACATGTCCCGTGGTTCCAGCGCCGGTTTTGA CCGCCACATTACCATTTTTTCACCCGAGGGTCGGC TCTACCAAGTAGAATATGCTTTTAAGGCTATTAACC AGGGTGGCCTTACATCAGTAGCTGTCAGAGGGAA AGACTGTGCAGTAATTGTCACACAGAAGAAAGTAC CTGACAAATTATGGATTCCAGCACAGTGACTCACT TATTCAAGATAACTGAAAACATTGGTTGTGTGATGA CCGGAATGACAGCTGACAGCAGATCCCAGGTACA GAGGGCACGCTATGAGGCAGCTAACTGGAAATAC AAGTATGGCTATGAGATTCCTGTGGACATGCTGTG TAAAAGAATTGCCGATATTTCTCAGGTCTACACACA GAATGCTGAAATGAGGCCTCTTGGTTGTTGTATGA TTTTAATTGGTATAGATGAAGAGCAAGGCCCTCAG GTATATAAGTGTGATCCTGCAGGTTACTACTGTGG GTTTAAAGCCACTGCAGCGGGAGTTAAACAAACTG AGTCAACCAGCTTCCTTGAAAAAAAAGTGAAGAAG AAATTTGATTGGACATTTGAACAGACAGTGGAAAC TGCAATTACATGCCTGTCTACTGTTCTATCAATTGA TTTCAAACCTTCAGAAATAGAAGTTGGAGTAGTGA CAGTTGAAAATCCTAAATTCAGGATTCTTACAGAAG CAGAGATTGATGCTCACCTTGTTGCTCTAGCAGAG AGAGACTAAACATTGTCGTTAGTTTACCAGATCCG TGATGCCACTTACCTGTGTGTTTGGTAACAACAAA CCAACATCATGGAGGTCCCTGGATTGAAAAAGGA GCCTCTCCCACTCCTCCTACCACCGAAGTGGTTAG GACTCTATATAAATAAAAACAAGGCTTTTGGAAAAT AAAAAAAAA | 5 | WIPAQ* |
| 1122 | NM_0027 93.2_176 | 176 | AAGGCAGCCATCTCGCCGTGAGACAGCAAGTGTC GCGCAGCCGTGCGATGTTGTCCTCTACAGCCATG TATTCGGCTCCTGGACAGAGACTTGGGGATGGAAC CGCACAGAGCCGCGGGCCCTTTGCAGCTGCGATT TTCGCCCTACGTTTTCAACGGAGGTACTATACTGG CAATGCTGGAGAAGATTTTGCAATTGTTGCTTCTG ATACTCGATTGAGTGAAGGGTTTTCAATTCATACG CGGGATAGCCCCAAATGTTACAAATTAACAGACAA AACAGTCATTGGATGCAGCGGTTTTCATGGAGACT GTCTTACGCTGACAAAGATTATTGAAGCAAGACTA AAGATGTATAAGCATTCCAATAATAAGGCCATGAC TACGGGGGCAATTGCTGCAATGCTGTCTACAATCC TGTATTCAAGGCGCTTCTTTCCATACTATGTTTACA ACATCATCGGTGGACTTGATGAAGAAGGAAAGGG GGCTGTATACAGCTTTGATCCAGTAGGGTCTTACC AGAGAGACTCCTTCAAGGCTGGAGGCTCAGCAAG TGCCATGCTACAGCCCCTGCTTGACAACCAGGTTG GTTTTAAGAACATGCAGAATGTGGAGCATGTTCCG CTGTCCTTGGACAGAGCCATGCGGCTGGTGAAAG ATGTCTTCATTTCTGCGGCTGAGAGAGATGTGTAC ACTGGGGACGCACTCCGGATCTGCATAGTGACCA AAGAGGGCATCAGGGAGGAAACTGTTTCCTTAAG GAAGGACTGATCTGTGTGCTCTTATCACCAATCAG TTCAGACCTGGTTGATTTGTACTTTGGAACTGTAC CTTGGATGGTTTTGTTTATTAAAAGAGAAACCTGAA GT | 14 | MLEKILQLL LLILD* |

TABLE 3A-continued

| SEQ ID | identifier_position | position | modified_RNA | PAP length | PAP |
|---|---|---|---|---|---|
| 1123 | NM_0027 93.2_191 | 191 | AAGGCAGCCATCTCGCCGTGAGACAGCAAGTGTC GCGCAGCCGTGCGATGTTGTCCTCTACAGCCATG TATTCGGCTCCTGGCAGAGACTTGGGGATGGAAC CGCACAGAGCCGCGGGCCCTTTGCAGCTGCGATT TTCGCCCTACGTTTTCAACGGAGGTACTATACTGG CAATTGCTGGAGAAGATTTGCAATTGTTGCTTCTG ATACTCGATTGAGTGAAGGGTTTTCAATTCATACG CGGGATAGCCCCAAATGTTACAAATTAACAGACAA AACAGTCATTGGATGCAGCGGTTTTCATGGAGACT GTCTTACGCTGACAAAGATTATTGAAGCAAGACTA AAGATGTATAAGCATTCCAATAATAAGGCCATGAC TACGGGGGCAATTGCTGCAATGCTGTCTACAATCC TGTATTCAAGGCGCTTCTTTCCATACTATGTTTACA ACATCATCGGTGGACTTGATGAAGAAGGAAAGGG GGCTGTATACAGCTTTGATCCAGTAGGGTCTTACC AGAGAGACTCCTTCAAGGCTGGAGGCTCAGCAAG TGCCATGCTACAGCCCCTGCTTGACAACCAGGTTG GTTTTAAGAACATGCAGAATGTGGAGCATGTTCCG CTGTCCTTGGACAGAGCCATGCGGCTGGTGAAAG ATGTCTTCATTTCTGCGGCTGAGAGAGATGTGTAC ACTGGGGACGCACTCCGGATCTGCATAGTGACCA AAGAGGGCATCAGGGAGGAAACTGTTTCCTTAAG GAAGGACTGATCTGTGTGCTCTTATCACCAATCAG TTCAGACCTGGTTGATTTTGTACTTTGGAACTGTAC CTTGGATGGTTTTGTTTATTAAAAGAGAAACCTGAA GT | 9 | LQLLLLILD* |
| 1124 | NM_0027 93.2_200 | 200 | AAGGCAGCCATCTCGCCGTGAGACAGCAAGTGTC GCGCAGCCGTGCGATGTTGTCCTCTACAGCCATG TATTCGGCTCCTGGCAGAGACTTGGGGATGGAAC CGCACAGAGCCGCGGGCCCTTTGCAGCTGCGATT TTCGCCCTACGTTTTCAACGGAGGTACTATACTGG CAATTGCTGGAGAAGATTTTGCAATTGTGCTTCTG ATACTCGATTGAGTGAAGGGTTTTCAATTCATACG CGGGATAGCCCCAAATGTTACAAATTAACAGACAA AACAGTCATTGGATGCAGCGGTTTTCATGGAGACT GTCTTACGCTGACAAAGATTATTGAAGCAAGACTA AAGATGTATAAGCATTCCAATAATAAGGCCATGAC TACGGGGGCAATTGCTGCAATGCTGTCTACAATCC TGTATTCAAGGCGCTTCTTTCCATACTATGTTTACA ACATCATCGGTGGACTTGATGAAGAAGGAAAGGG GGCTGTATACAGCTTTGATCCAGTAGGGTCTTACC AGAGAGACTCCTTCAAGGCTGGAGGCTCAGCAAG TGCCATGCTACAGCCCCTGCTTGACAACCAGGTTG GTTTTAAGAACATGCAGAATGTGGAGCATGTTCCG CTGTCCTTGGACAGAGCCATGCGGCTGGTGAAAG ATGTCTTCATTTCTGCGGCTGAGAGAGATGTGTAC ACTGGGGACGCACTCCGGATCTGCATAGTGACCA AAGAGGGCATCAGGGAGGAAACTGTTTCCTTAAG GAAGGACTGATCTGTGTGCTCTTATCACCAATCAG TTCAGACCTGGTTGATTTTGTACTTTGGAACTGTAC CTTGGATGGTTTTGTTTATTAAAAGAGAAACCTGAA GT | 5 | LLILD* |
| 1125 | NM_0027 93.2_287 | 287 | AAGGCAGCCATCTCGCCGTGAGACAGCAAGTGTC GCGCAGCCGTGCGATGTTGTCCTCTACAGCCATG TATTCGGCTCCTGGCAGAGACTTGGGGATGGAAC CGCACAGAGCCGCGGGCCCTTTGCAGCTGCGATT TTCGCCCTACGTTTTCAACGGAGGTACTATACTGG CAATTGCTGGAGAAGATTTTGCAATTGTTGCTTCTG ATACTCGATTGAGTGAAGGGTTTTCAATTCATACG CGGGATAGCCCCAAATGTTACAAATTAACAGACAA AACAGTCATGGATGCAGCGGTTTTCATGGAGACTG TCTTACGCTGACAAAGATTATTGAAGCAAGACTAA AGATGTATAAGCATTCCAATAATAAGGCCATGACT ACGGGGGCAATTGCTGCAATGCTGTCTACAATCCT GTATTCAAGGCGCTTCTTTCCATACTATGTTTACAA CATCATCGGTGGACTTGATGAAGAAGGAAAGGGG GCTGTATACAGCTTTGATCCAGTAGGGTCTTACCA GAGAGACTCCTTCAAGGCTGGAGGCTCAGCAAGT GCCATGCTACAGCCCCTGCTTGACAACCAGGTTG GTTTTAAGAACATGCAGAATGTGGAGCATGTTCCG CTGTCCTTGGACAGAGCCATGCGGCTGGTGAAAG ATGTCTTCATTTCTGCGGCTGAGAGAGATGTGTAC ACTGGGGACGCACTCCGGATCTGCATAGTGACCA AAGAGGGCATCAGGGAGGAAACTGTTTCCTTAAG GAAGGACTGATCTGTGTGCTCTTATCACCAATCAG TTCAGACCTGGTTGATTTTGTACTTTGGAACTGTAC | 12 | MDAAVFM ETVLR* |

TABLE 3A-continued

| SEQ ID | identifier_position | position | modified_RNA | PAP length | PAP |
|---|---|---|---|---|---|
| | | | CTTGGATGGTTTTGTTTATTAAAAGAGAAACCTGAAGT | | |
| 1126 | NM_002793.2_679 | 679 | AAGGCAGCCATCTCGCCGTGAGACAGCAAGTGTCGCGCAGCCGTGCGATGTTGTCCTCTACAGCCATGTATTCGGCTCCTGGCAGAGACTTGGGGATGGAACCGCACAGAGCCGCGGGCCCTTTGCAGCTGCGATTTTCGCCCTACGTTTTCAACGGAGGTACTATACTGGCAATTGCTGGAGAAGATTTTGCAATTGTTGCTTCTGATACTCGATTGAGTGAAGGGTTTTCAATTCATACGCGGGATAGCCCCAAATGTTACAAATTAACAGACAAAACAGTCATTGGATGCAGCGGTTTTCATGGAGACTGTCTTACGCTGACAAAGATTATTGAAGCAAGACTAAAGATGTATAAGCATTCCAATAATAAGGCCATGACTACGGGGGCAATTGCTGCAATGCTGTCTACAATCCTGTATTCAAGGCGCTTCTTTCCATACTATGTTTACAACATCATCGGTGGACTTGATGAAGAAGGAAAGGGGGCTGTATACAGCTTTGATCCAGTAGGGTCTTACCAGAGAGACTCCTTCAAGGCTGGAGGCTCAGCAAGTGCCATGCTACAGCCCCTGCTTGACAACCAGGTTGGTTTTAAGAACATGCAGAATGTGGAGCATGTTCCGCTGTCCTTGGACAGAGCCATGCGGCTGGTGAAAGATGTCTTCATTTCTGCGGTGAGAGAGATGTGTACACTGGGGACGCACTCCGGATCTGCATAGTGACCAAAGAGGGCATCAGGGAGGAAACTGTTTCCTTAAGGAAGGACTGATCTGTGTGCTCTTATCACCAATCAGTTCAGACCTGGTTGATTTTGTACTTTGGAACTGTACCTTGGATGGTTTTGTTTATTAAAAGAGAAACCTGAAGT | 14 | VREMCTLGTHSGSA* |
| 1127 | NM_002796.2_441 | 441 | TTTTTTCTGCTACCGTGACTAAGATGGAAGCGTTTTTGGGGTCGCGGTCCGGACTTTGGGCGGGGGGTCCGGCCCCAGGACAGTTTTACCGCATTCCGTCCACTCCCGATTCCTTCATGGATCCGGCGTCTGCACTTTACAGAGGTCCAATCACGCGGACCCAGAACCCCATGGTGACCGGGACCTCAGTCCTCGGCGTTAAGTTCGAGGGCGGAGTGGTGATTGCCGCAGACATGCTGGGATCCTACGGCTCCTTGGCTCGTTTCCGCAACATCTCTCGCATTATGCGAGTCAACAACAGTACCATGCTGGGTGCCTCTGGCGACTACGCTGATTTCCAGTATTTGAAGCAAGTTCTCGGCCAGATGGTGATTGATGAGGAGCTTCTGGGAGATGGACACAGCTATAGTCCTAGAGCTATTCATTCATGGCTGACCAGGCCATGTACAGCCGGCGCTCGAAGATGAACCCTTTGTGGAACACCATGGTCATCGGAGGCTATGCTGATGGAGAGAGCTTCCTCGGTTATGTGGACATGCTTGGTGTAGCCTATGAAGCCCTTCGCTGGCCACTGGTTATGGTGCATACTTGGCTCAGCCTCTGCTGCGAGAAGTTCTGGAGAAGCAGCCAGTGCTAAGCCAGACCGAGGCCCGCGACTTAGTAGAACGCTGCATGCGAGTGCTGTACTACCGAGATGCCCGTTCTTACAACCGGTTTCAAATCGCCACTGTCACCGAAAAAGGTGTTGAAATAGAGGGACCATTGTCTACAGAGACCAACTGGGATATTGCCCACATGATCAGTGGCTTTGAATGAAATACAGATGCATTATCCAGAACTGAAGTTGCCCTACTTTTAACTTTGAACTTGGCTAGTTCAAAGATAGACTCTTCTTTTGTAAAGTAAATAAATTCTTCAAAATG | 8 | PCTAGARR* |
| 1128 | NM_002796.2_654 | 654 | TTTTTTCTGCTACCGTGACTAAGATGGAAGCGTTTTTGGGGTCGCGGTCCGGACTTTGGGCGGGGGGTCCGGCCCCAGGACAGTTTTACCGCATTCCGTCCACTCCCGATTCCTTCATGGATCCGGCGTCTGCACTTTACAGAGGTCCAATCACGCGGACCCAGAACCCCATGGTGACCGGGACCTCAGTCCTCGGCGTTAAGTTCGAGGGCGGAGTGGTGATTGCCGCAGACATGCTGGGATCCTACGGCTCCTTGGCTCGTTTCCGCAACATCTCTCGCATTATGCGAGTCAACAACAGTACCATGCTGGGTGCCTCTGGCGACTACGCTGATTTCCAGTATTTGAAGCAAGTTCTCGGCCAGATGGTGATTGATGAGGAGCTTCTGGGAGATGGACACAGCTATAGTCCTAGAGCTATTCATTCATGGCTGACCAGGCCATGTACAGCCGGCGCTCGAAGATGAACCCTTTGTGGAACACCATGGTCATCGGAGGCTATGCTGATGGAGAGAGCTTCCTCGGTTATGTGGACATGCTTGGTGTAGCCTATGAAGCCCTTCGCTGGCCACTGGTTATGGTGCATACTTGGCTCAGCCTCTGCTGCGAGAAGTTCTGGAGAAGCAGCCAGTGCTAAGCCAGACCGAGGCCCGCGACTTAGTAGAACGCTGCATGCGAGTGCTGTACTACCGAGATGCCCGTTCTTACAACCGGTTTCAAATCGCCACTGTCACCGAAAAAGGTGTTGAAATAGAGGGA | 2 | AT* |

TABLE 3A-continued

| SEQ ID | identifier_position | position | modified_RNA | PAP length | PAP |
|---|---|---|---|---|---|
| | | | CCATTGTCTACAGAGACCAACTGGGATATTGCCCA CATGATCAGTGGCTTTGAATGAAATACAGATGCAT TATCCAGAACTGAAGTTGCCCTACTTTTAACTTTGA ACTTGGCTAGTTCAAAGATAGACTCTTCTTTTGTAA AGTAAATAAATTCTTCAAAATG | | |
| 1129 | NM_0027 97.2_118 | 118 | CTTTCTGCCCACACTAGACATGGCGCTTGCCAGCG TGTTGGAGAGACCGCTACCGGTGAACCAGCGCGG GTTTTTCGGACTTGGGGGTCGTGCAGATCTGCTG GATCTAGGTCCAGGAGTCTCAGTGATGGTCTGAG CCTGGCCGCGCCAGGCTGGGGTGTCCCAGAAGA GCCAGGAATCGAAATGCTTCATGGAACAACCACCC TGGCCTTCAAGTTCCGCCATGGAGTCATAGTTGCA GCTGACTCCAGGGCTACAGCGGGTGCTTACATTG CCTCCCAGACGGTGAAGAAGGTGATAGAGATCAA CCCATACCTGCTAGGCACCATGGCTGGGGCGCA GCGGATTGCAGCTTCTGGGAACGGCTGTTGGCTC GGCAATGTCGAATCTATGAGCTTCGAAATAAGGAA CGCATCTCTGTAGCAGCTGCCTCCAAACTGCTTGC CAACATGGTGTATCAGTACAAAGGCATGGGGCTGT CCATGGGCACCATGATCTGTGGCTGGGATAAGAG AGGCCCTGGCCTCTACTACGTGGACAGTGAAGGG AACCGGATTTCAGGGGCCACCTTCTCTGTAGGTTC TGGCTCTGTGTATGCATATGGGGTCATGGATCGG GGCTATTCCTATGACCTGGAAGTGGAGCAGGCCT ATGATCTGGCCCGTCGAGCCATCTACCAAGCCAC CTACAGAGATGCCTACTCAGGAGGTGCAGTCAAC CTCTACCACGTGCGGGAGGATGGCTGGATCCGAG TCTCCAGTGACAATGTGGCTGATCTACATGAGAAG TATAGTGGCTC'ACCCCCTGAAAGAGGGTGGATG CAGCTGCTTGTGTTTCTTGGGGTGACTGTCATTGG TAATACGGACACAGTGACCCATCCTCCATCCTATT TATAGTGGAAGGGCCTTCAATTGTATCAGTACTTTT TTTTAAGCTCTGGCACATTGACCTCTATGTGTTACC AGTCATTAATGAGCTGCTGCAGAGGTGACTATTTG TTTTACTTTCTTGGATGTTAAACA | 5 | VSVMV* |
| 1130 | NM_0027 97.2_254 | 254 | CTTTCTGCCCACACTAGACATGGCGCTTGCCAGCG TGTTGGAGAGACCGCTACCGGTGAACCAGCGCGG GTTTTTCGGACTTGGGGGTCGTGCAGATCTGCTG GATCTAGGTCCAGGGAGTCTCAGTGATGGTCTGA GCCTGGCCGCGCCAGGCTGGGGTGTCCCAGAAG AGCCAGGAATCGAAATGCTTCATGGAACAACCACC CTGGCCTTCAAGTTCCGCCATGGAGTCATAGTTGC AGCTGACTCCAGGCTACAGCGGGTGCTTACATTG CCTCCCAGACGGTGAAGAAGGTGATAGAGATCAA CCCATACCTGCTAGGCACCATGGCTGGGGCGCA GCGGATTGCAGCTTCTGGGAACGGCTGTTGGCTC GGCAATGTCGAATCTATGAGCTTCGAAATAAGGAA CGCATCTCTGTAGCAGCTGCCTCCAAACTGCTTGC CAACATGGTGTATCAGTACAAAGGCATGGGGCTGT CCATGGGCACCATGATCTGTGGCTGGGATAAGAG AGGCCCTGGCCTCTACTACGTGGACAGTGAAGGG AACCGGATTTCAGGGGCCACCTTCTCTGTAGGTTC TGGCTCTGTGTATGCATATGGGGTCATGGATCGG GGCTATTCCTATGACCTGGAAGTGGAGCAGGCCT ATGATCTGGCCCGTCGAGCCATCTACCAAGCCAC CTACAGAGATGCCTACTCAGGAGGTGCAGTCAAC CTCTACCACGTGCGGGAGGATGGCTGGATCCGAG TCTCCAGTGACAATGTGGCTGATCTACATGAGAAG TATAGTGGCTCTACCCCCTGAAAGAGGGTGGATG CAGCTGCTTGTGTTTCTTGGGGTGACTGTCATTGG TAATACGGACACAGTGACCCATCCTCCATCCTATT TATAGTGGAAGGGCCTTCAATTGTATCAGTACTTTT TTTTAAGCTCTGGCACATTGACCTCTATGTGTTACC AGTCATTAATGAGCTGCTGCAGAGGTGACTATTTG TTTTACTTTCTTGGATGTTAAACA | 11 | LQRVLTLP PRR* |
| 1131 | NM_0028 02.2_589 | 589 | AGTGGTGGAGGAACTTCCGGCAGCGGCAGCTCAA GTGGCCAAGGCAAGATGGGTCAAAGTCAGAGTGG TGGTCATGGTCCTGGAGGTGGCAAGAAGGATGAC AAGGACAAGAAAAAGAAATATGAACCTCCTGTACC AACTAGAGTGGGGAAAAAGAAGAAGAAAACAAAG GGACCAGATGCTGCCAGCAAACTGCCACTGGTGA CACCTCACACTCAGTGCCGGTTAAAATTACTGAAG TTAGAGAGAATTAAAGACTATCTTCTCATGGAGGA AGAATTCATTAGAAATCAGGAACAAATGAAACCATT AGAAGAAAGCAAGAGGAGGAAAGATCAAAAGTG GATGATCTGAGGGGGACCCCGATGTCAGTAGGAA CCTTGGAAGAGATCATTGATGACAATCATGCCATC | 35 | RRPMQILG GWTTKFR KLRNLWSF LSPILNIMK RWV* |

TABLE 3A-continued

| SEQ ID | identifier_position | position | modified_RNA | PAP length | PAP |
|---|---|---|---|---|---|
| | | | GTGTCTACATCTGTGGGCTCAGAACACTACGTCAG<br>CATTCTTTCATTTGTAGACAAGGATCTGCTGGAAC<br>CTGGCTGCTCGGTCCTGCTCAACCACAAGGTGCA<br>TGCCGTGATAGGGGTGCTGATGGATGACACGGAT<br>CCCCTGGTCACAGTGATGAAGGTAGAAAAGGCCC<br>CCAGGAGACCTATGCAGATATTGGGGGGTTGGAC<br>AACCAAATTCAGGAAATTAAGGAATCTGTGGAGCT<br>TCCTCTCACCCATCCTGAATATTATGAAGAGATGG<br>GTATAAAGCCTCCTAAGGGGGTCATTCTCTATGGT<br>CCACCTGGCACAGGTAAAACCTTGTTAGCCAAAGC<br>AGTAGCAAACCAAACCTCAGCCACTTTCTTGAGAG<br>TGGTTGGCTCTGAACTTATTCAGAAGTACCTAGGT<br>GATGGGCCCAAACTCGTACGGGAATTGTTCCGAG<br>TTGCTGAAGAACATGCACCGTCCATCGTGTTTATT<br>GATGAAATTGACGCCATTGGGACAAAAAGATATGA<br>CTCCAATTCTGGTGGTGAGAGAGAAATTCAGCGAA<br>CAATGTTGGAACTGCTGAACCAGTTGGATGGATTT<br>GATTCTAGGGGAGATGTGAA | | |
| 1132 | NM_0028<br>02.2_609 | 609 | AGTGGTGGAGGAACTTCCGGCAGCGGCAGCTCAA<br>GTGGCCAAGGCAAGATGGGTCAAAGTCAGAGTGG<br>TGGTCATGGTCCTGGAGGTGGCAAGAAGGATGAC<br>AAGGACAAGAAAAAGAAATATGAACCTCCTGTACC<br>AACTAGAGTGGGGAAAAAGAAGAAGAAAACAAAG<br>GGACCAGATGCTGCCAGCAAACTGCCACTGGTGA<br>CACCTCACACTCAGTGCCGGTTAAAATTACTGAAG<br>TTAGAGAGAATTAAAGACTATCTTCTCATGGAGGA<br>AGAATTCATTAGAAATCAGGAACAAATGAAACCATT<br>AGAAGAAAAGCAAGAGGAGGAAAGATCAAAAGTG<br>GATGATCTGAGGGGGACCCCGATGTCAGTAGGAA<br>CCTTGGAAGAGATCATTGATGACAATCATGCCATC<br>GTGTCTACATCTGTGGGCTCAGAACACTACGTCAG<br>CATTCTTTCATTTGTAGACAAGGATCTGCTGGAAC<br>CTGGCTGCTCGGTCCTGCTCAACCACAAGGTGCA<br>TGCCGTGATAGGGGTGCTGATGGATGACACGGAT<br>CCCCTGGTCACAGTGATGAAGGTAGAAAAGGCCC<br>CCAGGAGACCTATGCAGATATTGGGGGGTTGGAC<br>AACCAAATTCAGGAAATTAAGGAATCTGTGGAGCT<br>TCCTCTCACCCATCCTGAATATTATGAAGAGATGG<br>GTATAAAGCCTCCTAAGGGGGTCATTCTCTATGGT<br>CCACCTGGCACAGGTAAAACCTTGTTAGCCAAAGC<br>AGTAGCAAACCAAACCTCAGCCACTTTCTTGAGAG<br>TGGTTGGCTCTGAACTTATTCAGAAGTACCTAGGT<br>GATGGGCCCAAACTCGTACGGGAATTGTTCCGAG<br>TTGCTGAAGAACATGCACCGTCCATCGTGTTTATT<br>GATGAAATTGACGCCATTGGGACAAAAAGATATGA<br>CTCCAATTCTGGTGGTGAGAGAGAAATTCAGCGAA<br>CAATGTTGGAACTGCTGAACCAGTTGGATGGATTT<br>GATTCTAGGGGAGATGTGAA | 29 | MGGWTTK<br>FRKLRNLW<br>SFLSPILNI<br>MKRWV* |
| 1133 | NM_0028<br>03.2_160 | 160 | GAAGACACCACCGGAAGCAAGGAAGGTGCTGTGT<br>AATCATTAAGGAGCGGAGGCTTTTGGAGCTGCTAA<br>AATGCCGGATTACCTCGGTGCCGATCAGCGGAAG<br>ACCAAAGAGGATGAGAAGGACGACAAGCCCATCC<br>GAGCTCTGGATGAGGGGGATATGCCTTGTTGAAA<br>ACTTATGGTCAGAGCACTTACTCTAGGCAGATCAA<br>GCAAGTTGAAGATGACATTCAGCAACTTCTCAAGA<br>AAATTAATGAGCTCACTGGTATTAAAGAATCTGACA<br>CTGGCCTGGCCCCACCAGCACTCTGGGATTTGGC<br>TGCAGATAAGCAGACACTCCAGAGTGAACAGCCTT<br>TACAGGTTGCCAGGTGTACAAAGATAATCAATGCT<br>GATTCGGAGGACCCAAAATACATTATCAACGTAAA<br>GCAGTTTGCCAAGTTTGTGGTGGACCTTAGTGATC<br>AGGTGGCACCTACTGACATTGAAGAAGGGATGAG<br>AGTGGGCGTGGATAGAAATAAATATCAAATTCACA<br>TTCCATTGCCTCCTAAGATTGACCCAACAGTTACC<br>ATGATGCAGGTGGAAGAGAAACCTGATGTCACATA<br>CAGTGATGTTGGTGGCTGTAAGGAACAGATTGAGA<br>AACTGCGAGAAGTAGTTGAAACCCCATTACTTCAT<br>CCAGAGAGGTTTGTGAACCTTGGCATTGAGCCTCC<br>CAAGGGCGTGCTGCTCTTTGGTCCACCCGGTACA<br>GGCAAGACACTCTGTGCGCGGGCAGTTGCTAATC<br>GGACTGATGCGTGCTTCATTCGAGTTATTGGATCT<br>GAGCTTGTACAGAAATACGTCGGTGAGGGGGCTC<br>GAATGGTTCGTGAACTCTTTGAAATGGCCAGAACA<br>AAAAAAGCCTGCCTTATCTTCTTTGATGAAATTGAT<br>GCTATTGGAGGGGCTCGTTTTGATGATGGTGCTG<br>GAGGTGACAATGAAGTGCAGAGAACAATGTTGGA<br>ACTGATCAATCAGCTTGATGGTTTTGATCCTCGAG<br>GCAATATTAAAGTGCTGA | 3 | MPC* |

TABLE 3A-continued

| SEQ ID | identifier_position | position | modified_RNA | PAP length | PAP |
|---|---|---|---|---|---|
| 1134 | NM_0028 03.2_309 | 309 | GAAGACACCACCGGAAGCAAGGAAGGTGCTGTGT AATCATTAAGGAGCGGAGGCTTTTGGAGCTGCTAA AATGCCGGATTACCTCGGTGCCGATCAGCGGAAG ACCAAAGAGGATGAGAAGGACGACAAGCCCATCC GAGCTCTGGATGAGGGGGATATTGCCTTGTTGAAA ACTTATGGTCAGAGCACTTACTCTAGGCAGATCAA GCAAGTTGAAGATGACATTCAGCAACTTCTCAAGA AAATTAATGAGCTCACTGGTATTAAAGAATCTGACA CTGGCCTGGCCCCACCAGCACTCTGGGATTGGCT GCAGATAAGCAGACACTCCAGAGTGAACAGCCTTT ACAGGTTGCCAGGTGTACAAAGATAATCAATGCTG ATTCGGAGGACCCAAAATACATTATCAACGTAAAG CAGTTTGCCAAGTTTGTGGTGGACCTTAGTGATCA GGTGGCACCTACTGACATTGAAGAAGGGATGAGA GTGGGCGTGGATAGAAATAAATATCAAATTCACAT TCCATTGCCTCCTAAGATTGACCCAACAGTTACCA TGATGCAGGTGGAAGAGAAACCTGATGTCACATAC AGTGATGTTGGTGGCTGTAAGGAACAGATTGAGAA ACTGCGAGAAGTAGTTGAAACCCCATTACTTCATC CAGAGAGGTTTGTGAACCTTGGCATTGAGCCTCCC AAGGGCGTGCTGCTCTTTGGTCCACCCGGTACAG GCAAGACACTCTGTGCGCGGGCAGTTGCTAATCG GACTGATGCGTGCTTCATTCGAGTTATTGGATCTG AGCTTGTACAGAAATACGTCGGTGAGGGGCTCG AATGGTTCGTGAACTCTTTGAAATGGCCAGAACAA AAAAAGCCTGCCTTATCTTCTTTGATGAAATTGATG CTATTGGAGGGGCTCGTTTTGATGATGGTGCTGGA GGTGACAATGA\GTGCAGAGAACAATGTTGGAACT GATCAATCAGCTTGATGGTTTTGATCCTCGAGGCA ATATTAAAGTGCTGA | 21 | WLQISRHS RVNSLYRL PGVQR* |
| 1135 | NM_0028 03.2_673 | 673 | GAAGACACCACCGGAAGCAAGGAAGGTGCTGTGT AATCATTAAGGAGCGGAGGCTTTTGGAGCTGCTAA AATGCCGGATTACCTCGGTGCCGATCAGCGGAAG ACCAAAGAGGATGAGAAGGACGACAAGCCCATCC GAGCTCTGGATGAGGGGGATATTGCCTTGTTGAAA ACTTATGGTCAGAGCACTTACTCTAGGCAGATCAA GCAAGTTGAAGATGACATTCAGCAACTTCTCAAGA AAATTAATGAGCTCACTGGTATTAAAGAATCTGACA CTGGCCTGGCCCCACCAGCACTCTGGGATTTGGC TGCAGATAAGCAGACACTCCAGAGTGAACAGCCTT TACAGGTTGCCAGGTGTACAAAGATAATCAATGCT GATTCGGAGGACCCAAAATACATTATCAACGTAAA GCAGTTTGCCAAGTTTGTGGTGGACCTTAGTGATC AGGTGGCACCTACTGACATTGAAGAAGGGATGAG AGTGGGCGTGGATAGAAATAAATATCAAATTCACA TTCCATTGCCTCCTAAGATTGACCCAACAGTTACC ATGATGCAGGTGGAAGAGAAACCTGATGTCACATA CAGTGATGTTGGTGGCTGTAAGGAACAGATTGAGA AACTGCGAGAAGTAGTTGAAACCCCATTACTTCAT CCAGAGAGGTTTGTGAACCTTGGCATTGAGCCTCC CAAGGGCGTGCTGCTCTTTGGTCCACCCGGTACA GGCAAGACACTCTGTGCGCGGGCAGTTGCTAATC GGACTGATGCGTGCTTCATTCGAGTTATTGGATCT GAGCTTGTACAGAAATACGTCGGTGAGGGGCTC GAATGGTTCGTGAACTCTTTGAAATGGCCAGAACA AAAAAAGCCTGCCTTATCTTCTTTGATGAAATTGAT GCTATTGGAGGGGCTCGTTTTGATGATGGTGCTG GAGGTGACAATGAAGTGCAGAGAACAATGTTGGA ACTGATCAATCAGCTTGATGGTTTTGATCCTCGAG GCAATATTAAAGTGCTGA | 1 | L* |
| 1136 | NM_0028 04.4_689 | 689 | GTGGCCAGGGGTTGGTCTTTGGAATCGGAGAGGC AGATTCGCTGCTCCGCAGCACGGCCGGAGCTGGT CGGGTCAAGAGTCGGGATTTGTGGGGAGAGGTTT TCCACTGGTCAAGAGAAGGCTTTAAGAAAGACGGT ATTAATCTCCCGTTGCGGCTCCCGCCTGGTCCCAT CTTCTGCCCGCTCCTCCAGGAAATGAATCTGCTGC CGAATATTGAGAGTCCAGTGACTCGGCAGGAGAA GATGGCGACCGTGTGGGATGAGGCCGAGCAAGAT GGAATTGGGGAGGAGGTGCTCAAGATGTCCACGG AGGAGATCATCCAGCGCACACGGCTGCTGGACAG TGAGATCAAGATCATGAAGAGTGAAGTGTTGAGAG TCACCCATGAGCTCCAAGCCATGAAGGACAAGATA AAAGAGAACAGTGAGAAAATCAAAGTGAACAAGAC CCTGCCGTACCTTGTCTCCAACGTCATCGAGCTCC TGGATGTTGATCCTAATGACCAAGAGGAGGATGGT GCCAATATTGACCTGGACTCCCAGAGGAAGGGCA AGTGTGCTGTGATCAAAACCTCTACACGACAGACG | 6 | QSMTRG* |

TABLE 3A-continued

| SEQ ID | identifier_ position | position | modified_RNA | PAP length | PAP |
|---|---|---|---|---|---|
| | | | TACTTCCTTCCTGTGATTGGGTTGGTGGATGCTGA<br>AAAGCTAAAGCCAGGAGACCTGGTGGGTGTGAAC<br>AAAGACTCCTATCTGATCCTGGAGACGCTGCCACA<br>GAGTATGACTCGCGGGTGAAGGCCATGGAGGTAG<br>ACGAGAGGCCCACGGAGCAATACAGTGACATTGG<br>GGGTTTGGACAAGCAGATCCAGGAGCTGGTGGAG<br>GCCATTGTCTTGCCAATGAACCACAAGGAGAAGTT<br>TGAGAACTTGGGGATCCAACCTCCAAAAGGGGTG<br>CTGATGTATGGGCCCCAGGGACGGGGAAGACCC<br>TCCTGGCCCGGGCCTGTGCCGCACAGACTAAGGC<br>CACCTTCCTAAAGCTGGCTGGCCCCAGCTGGTG<br>CAGATGTTCATTGGAGATGGTGCCAAGCTAGTCCG<br>GGATGCCTTTGCCCTGGCCAAGGAG | | |
| 1137 | NM_0028<br>04.4_884 | 884 | GTGGCCAGGGGTTGGTCTTTGGAATCGGAGAGGC<br>AGATTCGCTGCTCCGCAGCACGGCCGGAGCTGGT<br>CGGGTCAAGAGTCGGATTTGTGGGGAGAGGTTT<br>TCCACTGGTCAAGAGAAGGCTTTAAGAAAGACGGT<br>ATTAATCTCCCGTTGCGGCTCCCGCCTGGTCCCAT<br>CTTCTGCCCGCTCCTCCAGGAAATGAATCTGCTGC<br>CGAATATTGAGAGTCCAGTGACTCGGCAGGAGAA<br>GATGGCGACCGTGTGGGATGAGGCCGAGCAAGAT<br>GGAATTGGGGAGGAGGTGCTCAAGATGTCCACGG<br>AGGAGATCATCCAGCGCACACGGCTGCTGGACAG<br>TGAGATCAAGATCATGAAGAGTGAAGTGTTGAGAG<br>TCACCCATGAGCTCCAAGCCATGAAGGACAAGATA<br>AAAGAGAACAGTGAGAAAATCAAAGTGAACAAGAC<br>CCTGCCGTACCTTGTCTCCAACGTCATCGAGCTCC<br>TGGATGTTGATCCTAATGACCAAGAGGAGGATGGT<br>GCCAATATTGACCTGGACTCCCAGAGGAAGGGCA<br>AGTGTGCTGTGATCAAAACCTCTACACGACAGACG<br>TACTTCCTTCCTGTGATTGGGTTGGTGGATGCTGA<br>AAAGCTAAAGCCAGGAGACCTGGTGGGTGTGAAC<br>AAAGACTCCTATCTGATCCTGGAGACGCTGCCCAC<br>AGAGTATGACTCGCGGGTGAAGGCCATGGAGGTA<br>GACGAGAGGCCCACGGAGCAATACAGTGACATTG<br>GGGGTTTGGACAAGCAGATCCAGGAGCTGGTGGA<br>GGCCATTGTCTTGCCAATGAACCACAAGGAGAAGT<br>TTGAGAACTTGGGGATCCAACCTCCAAAAGGGGT<br>GCTGATGTATGGGCCCCAGGACGGGGAAGACCC<br>TCCTGGCCCGGGCCTGTGCCGCACAGACTAAGGC<br>CACCTTCCTAAAGCTGGCTGGCCCCAGCTGGTG<br>CAGATGTTCATTGGAGATGGTGCCAAGCTAGTCCG<br>GGATGCCTTTGCCCTGGCCAAGGAG | 18 | RGRPSWP<br>GPVPHRLR<br>PPS* |
| 1138 | NM_0028<br>08.3_396 | 396 | TGCGCGCGCAGCGGGCCGGCAGTGGCGGCGGAG<br>ATGGAGGAGGGAGGCCGGGACAAGGCGCCGGTG<br>CAGCCCCAGCAGTCTCCAGCGGCGGCCCCCGGC<br>GGCACGGACGAGAAGCCGAGCGGCAAGGAGCGG<br>CGGGATGCCGGGGACAAGGACAAAGAACAGGAG<br>CTGTCTGAAGAGGATAAACAGCTTCAAGATGAACT<br>GGAGATGCTCGTGGAACGACTAGGGGAGAAGGAT<br>ACATCCCTGTATCGACCAGCGCTGGAGGAATTGC<br>GAAGGCAGATTCGTTCTTCTACAACTTCCATGACTT<br>CAGTGCCCAAGCCTCTCAAATTTCTGCGTCCACAC<br>TATGGCAAACTGAAGGAAATCTATGAGAACATGGC<br>CCCTGGGGAGAATAAGCGTTTGCTGCTGACATCAT<br>CTCCGTTTTGGCCATGACCATGAGTGGGGAGCGT<br>GAGTGCCTCAAGTATCGGCTAGTGGGCTCCCAGG<br>AGGAATTGGCATCATGGGGTCATGAGTATGTCAG<br>GCATCTGGCAGGAGAAGTGGCTAAGGAGTGGCAG<br>GAGCTGGATGACGCAGAGAAGGTCCAGCGGGAG<br>CCTCTGCTCACTCTGGTGAAGGAAATCGTCCCCTA<br>TAACATGGCCCACAATGCAGAGCATGAGGCTTGC<br>GACCTGCTTATGGAAATTGAGCAGGTGGACATGCT<br>GGAGAAGGACATTGATGAAAATGCATATGCAAAGG<br>TCTGCCTTTATCTCACCAGTTGTGTGAATTACGTGC<br>CTGAGCCTGAGAACTCAGCCCTACTGCGTTGTGC<br>CCTGGGTGTGTTCCGAAAGTTTAGCCGCTTCCCTG<br>AAGCTCTGAGATTGGCATTGATGCTCAATGACATG<br>GAGTTGGTAGAAGACATCTTCACCTCCTGCAAGGA<br>TGTGGTAGTACAGAAACAGATGGCATTCATGCTAG<br>GCCGGCATGGGGTGTTCCTGGAGCTGAGTGAAGA<br>TGTCGAGGAGTATGAGGACCTGACAGAGATCATG<br>TCCAATGTACAGCTCAACAGCAACTTCTT | 10 | LLLTSSPF<br>WP* |
| 1139 | NM_0028<br>10.2_171 | 171 | AATTGGAGGAGTTGTTGTTAGGCCGTCCCGGAGA<br>CCCGGTCGGGAGGGAGGAAGGTGGCAAGATGGT<br>GTTGGAAAGCACTATGGTGTGTGTGGACAACAGT<br>GAGTATATGCGGAATGGAGACTTCTTACCCCACCAG | 24 | VIQRPAAT<br>LRTTWALS<br>HWLMTVK<br>C* |

TABLE 3A-continued

| SEQ ID | identifier_position | position | modified_RNA | PAP length | PAP |
|---|---|---|---|---|---|
| | | | GCTGCAGGCCCAGCAGGATGCTGTCAACATAGTT<br>GTCATTCAAAGACCCGCAGCAACCCTGAGAACAAC<br>GTGGGCCTTATCACACTGGCTAATGACTGTGAAGT<br>GCTGACCACACTCACCCCAGACACTGGCCGTATC<br>CTGTCCAAGCTACATACTGTCCAACCCAAGGGCAA<br>GATCACCTTCTGCACGGGCATCCGCGTGGCCCAT<br>CTGGCTCTGAAGCACCGACAAGGCAAGAATCACA<br>AGATGCGCATCATTGCCTTTGTGGGAAGCCCAGTG<br>GAGGACAATGAGAAGGATCTGGTGAAACTGGCTA<br>AACGCCTCAAGAAGGAGAAAGTAAATGTTGACATT<br>ATCAATTTTGGGGAAGAGGAGGTGAACACAGAAAA<br>GCTGACAGCCTTTGTAAACACGTTGAATGGCAAAG<br>ATGGAACCGGTTCTCATCTGGTGACAGTGCCTCCT<br>GGGCCCAGTTTGGCTGATGCTCTCATCAGTTCTCC<br>GATTTTGGCTGGTGAAGGTGGTGCCATGCTGGGT<br>CTTGGTGCCAGTGACTTTGAATTTGGAGTAGATCC<br>CAGTGCTGATCCTGAGCTGGCCTTGGCCCTTCGT<br>GTATCTATGGAAGAGCAGCGGCAGCGGCAGGAGG<br>AGGAGGCCCGGCGGGCAGCTGCAGCTTCTGCTG<br>CTGAGGCCGGGATTGCTACGACTGGGACTGAAGA<br>CTCAGACGATGCCCTGCTGAAGATGACCATCAGC<br>CAGCAAGAGTTTGGCCGCACTGGGCTTCCTGACC<br>TAAGCAGTATGACTGAGGAAGAGCAGATTGCTTAT<br>GCCATGCAGATGTCCCTGCAGGGAGCAGAGTTTG<br>GCCAGGCGGAATCAGCAGACATTGATGCCAGCTC<br>AGCTATGGACACATCTGAGCCAGCCAAG | | |
| 1140 | NM_0028 11.3_397 | 397 | AAGAAGGAGGCCGCGCGAGGGCTGACGAACCGG<br>AAGAAGAGGAACTGGGCCTGAAAGGGTACCGGTG<br>ACCGCTACTGCTGCCGGTGTTTGCGTGTGGCAGG<br>GAGCCAGGCCTGGCGAGCGGGGTGTCGCGAT<br>GCCGGAGCTGGCAGTGCAGAAGGTGGTGGTCCA<br>CCCCCTGGTGCTGCTCAGTGTGGTGGATCATTTCA<br>ACCGAATCGGCAAGGTTGGAAACCAGAAGCGTGT<br>TGTTGGTGTGCTTTTGGGGTCATGGCAAAAGAAAG<br>TACTTGATGTATCGAACAGTTTTGCAGTTCCTTTTG<br>ATGAAGATGACAAAGACGATTCTGTATGGTTTTTA<br>GACCATGATTATTTGGAAAACATGTATGGAATGTTT<br>AAGAAAGTCAATGCCAGGAAAGAATAGTTGGCTGG<br>TACCACACAGGCCCTAAACTACACAAGAATGACAT<br>TGCCATCAACGAACTCATGAAAAGATACTGTCCTA<br>ATTCCGTATTGGTCATCATTGATGTGAAGCCGAAG<br>GACCTAGGGCTGCCTACAGAAGCGTACATTTCAGT<br>GGAAGAAGTCCATGATGATGGAACTCCAACCTCGA<br>AAACATTTGAACACGTGACCAGTGAAATTGGAGCA<br>GAGGAAGCTGAGGAAGTTGGAGTTGAACACTTGTT<br>ACGAGATATCAAAGACACGACGGTGGGCACTCTG<br>TCCCAGCGGATCACAAACCAGGTCCATGGTTTGAA<br>GGGACTGAACTCCAAGCTTCTGGATATCAGGAGCT<br>ACCTGGAAAAAGTCGCCACAGGCAAGCTGCCCAT<br>CAACCACCAGATCATCTACCAGCTGCAGGACGTCT<br>TCAACCTGCTGCCAGATGTCAGCCTGCAGGAGTTC<br>GTCAAGGCCTTTTACCTGAAGACCAATGACCAGAT<br>GGTGGTAGTGTACTTGGCCTCGCTGATCCGTTCC<br>GTGGTCGCCCTGCACAACCTCATCAACAACAAGAT<br>TGCCAACCGGGATGCAGAGAAGAAAGAAGGGCAG<br>GAGAAAGAAGAGAGCAAAAA | 2 | KE* |
| 1141 | NM_0028 13.4_509 | 509 | CGCGTTCGCGGACGGCTGTGGTGTTTTGGCGCAT<br>GGGCGGAGCCGTAGTTACGGTCGACTGGGGCGT<br>CGTCCCTAGCCCGGGAGCCGGGTCTCTGGAGTCG<br>CGGCCCGGGGTTCACGATGTCCGACGAGGAAGC<br>GAGGCAGAGCGGAGGCTCCTCGCAGGCCGGCGT<br>CGTGACTGTCAGCGACGTCCAGGAGCTGATGCGG<br>CGCAAGGAGGAGATAGAAGCGCAGATCAAGGCCA<br>ACTATGACGTGCTGGAAAGCCAAAAAGGCATTGG<br>GATGAACGAGCCGCTGGTGGACTGTGAGGGCTAC<br>CCCCGGTCAGACGTGGACCTGTACCAAGTCCGCA<br>CCGCCAGGCACAACATCATATGCCTGCAGAATGAT<br>CACAAGGCAGTGATGAAGCAGGTGGAGGAGGCCC<br>TGCACCAGCTGCACGCTCGCGACAAGGAGAAGCA<br>GGCCCGGGACATGGCTGAGGCCCACAAAGAGGC<br>CATGAGCCGCAAACTGGGTCAGAGTGAGAGCCAG<br>GCCCTCCACGGGCCTTCGCCAAAGTGAACAGCAT<br>CAGCCCCGGCTCCCCAGCCAGCATCGCGGGTCTG<br>CAAGTGGATGATGAGATTGTGGAGTTCGGCTCTGT<br>GAACACCCCAGAACTTCCAGTCACTGCATAACATTG<br>GCAGTGTGGTGCAGCACAGTGAGGGGAAGCCCCT<br>GAATGTGACAGTGATCCGCAGGGGGGAAAAACAC | 8 | ALHGPSPK* |

TABLE 3A-continued

| SEQ ID | identifier_position | position | modified_RNA | PAP length | PAP |
|---|---|---|---|---|---|
| | | | CAGCTTAGACTTGTTCCAACACGCTGGGCAGGAAA<br>AGGACTGCTGGGCTGCAACATTATTCCTCTGCAAA<br>GATGATTGTCCCTGGGGAACAGTAACAGGAAAGC<br>ATCTTCCCTTGCCCTGGACTTGGGTCTAGGGATTT<br>CCAACTTGTCTTCTCTCCCTGAAGCATAAGGATCT<br>GGAAGAGGCTTGTAACCTGAACTTCTGTGTGGTGG<br>CAGTACTGTGGCCCACCAGTGTAATCTCCCTGGAT<br>TAAGGCATTCTTAAAAACTTAGGCTTGGCCTCTTTC<br>ACAAATTAGGCCACGGCCCTAAATAGGAATT | | |
| 1142 | NM_002815.2_426 | 426 | CGTCGGCGGCCGCGGCCGGGGACGGTGTGAGAG<br>CGGTAAGATGGCGGCGGCGGCGGTGGTGGAGTT<br>CCAGAGAGCCCAGTCTCTACTCAGCACCGACCGG<br>GAGGCCTCCATCGACATCCTCCACTCCATCGTGAA<br>GCGTGACATTCAGGAAAACGATGAAGAGGCAGTG<br>CAAGTCAAAGAGCAGAGCATCCTGGAACTGGGAT<br>CTCTCCTGGCAAAGACTGGACAAGCTGCAGAGCT<br>TGGAGGACTCCTGAAGTATGTACGACCCTTCTTGA<br>ATTCCATCAGCAAGGCTAAAGCAGCTCGCCTGGTC<br>CGATCTCTTCTTGATCTGTTTCTTGATATGGAAGCA<br>GCTACAGGGCAGGAGGTCGAGCTGTGTTTAGAGT<br>GCATCGAATGGGCCAAGTCAGAGAAAAGAACTTTC<br>TTACGCCAAGCTTGGAGGCAAGACTGGTGTCTTTG<br>TACTTTGATACCAAGAGGTACCAGGAAGCATTGCA<br>TTTGGGTTCTCAGCTGCTGCGGGAGTTGAAAAAGA<br>TGGACGACAAAGCTCTTTTGGTGGAAGTACAGCTT<br>TTAGAAAGCAAAACATACCATGCCCTGAGCAACCT<br>GCCGAAAGCCCGAGCTGCCTTAACTTCTGCTCGA<br>ACCACAGCAAATGCCATCTACTGCCCCCCTAAATT<br>GCAGGCCACCTTGGACATGCAGTCGGGTATTATC<br>CATGCAGCAGAAGAGAAGGACTGGAAAACTGCGT<br>ACTCATACTTCTATGAGGCATTTGAGGGTTATGACT<br>CCATCGACAGCCCCAAGGCCATCACATCTCTGAA<br>GTACATGTTGCTGTGCAAAATCATGCTCAACACCC<br>CAGAAGATGTCCAGGCTTTGGTGAGCGGGAAGCT<br>TGCACTTCGGTATGCAGGGAGGCAGACAGAAGCA<br>TTAAAATGCGTGGCTCAGGCTAGCAAGAACAGATC<br>ACTGGCAGATTTTGAAAAGGCTCTGACAGATTACC<br>GGGCAGAGCTCCGGGATGACCCAATCATCAGCAC<br>ACACTTGGCCAAGTTGTATGATA | 28 | WRQDWCL<br>CTLIPRGT<br>RKHCIWVL<br>SCCGS* |
| 1143 | NM_002815.2_537 | 537 | CGTCGGCGGCCGCGGCCGGGGACGGTGTGAGAG<br>CGGTAAGATGGCGGCGGCGGCGGTGGTGGAGTT<br>CCAGAGAGCCCAGTCTCTACTCAGCACCGACCGG<br>GAGGCCTCCATCGACATCCTCCACTCCATCGTGAA<br>GCGTGACATTCAGGAAAACGATGAAGAGGCAGTG<br>CAAGTCAAAGAGCAGAGCATCCTGGAACTGGGAT<br>CTCTCCTGGCAAAGACTGGACAAGCTGCAGAGCT<br>TGGAGGACTCCTGAAGTATGTACGACCCTTCTTGA<br>ATTCCATCAGCAAGGCTAAAGCAGCTCGCCTGGTC<br>CGATCTCTTCTTGATCTGTTTCTTGATATGGAAGCA<br>GCTACAGGGCAGGAGGTCGAGCTGTGTTTAGAGT<br>GCATCGAATGGGCCAAGTCAGAGAAAAGAACTTTC<br>TTACGCCAAGCTTGGAGGCAAGACTGGTGTCTTT<br>GTACTTTGATACCAAGAGGTACCAGGAAGCATTGC<br>ATTTGGGTTCTCAGCTGCTGCGGGAGTTGAAAAAG<br>ATGGACGACAAAGCTCTTTTGGTGGAAGTACAGCTT<br>TTAGAAAGCAAAACATACCATGCCCTGAGCAACCT<br>GCCGAAAGCCCGAGCTGCCTTAACTTCTGCTCGA<br>ACCACAGCAAATGCCATCTACTGCCCCCCTAAATT<br>GCAGGCCACCTTGGACATGCAGTCGGGTATTATC<br>CATGCAGCAGAAGAGAAGGACTGGAAAACTGCGT<br>ACTCATACTTCTATGAGGCATTTGAGGGTTATGACT<br>CCATCGACAGCCCCAAGGCCATCACATCTCTGAA<br>GTACATGTTGCTGTGCAAAATCATGCTCAACACCC<br>CAGAAGATGTCCAGGCTTTGGTGAGCGGGAAGCT<br>TGCACTTCGGTATGCAGGGAGGCAGACAGAAGCA<br>TTAAAATGCGTGGCTCAGGCTAGCAAGAACAGATC<br>ACTGGCAGATTTTGAAAAGGCTCTGACAGATTACC<br>GGGCAGAGCTCCGGGATGACCCAATCATCAGCAC<br>ACACTTGGCCAAGTTGTATGATA | 6 | WWKYSF* |
| 1144 | NM_002817.2_223 | 223 | AGCATTTCCGGCAGCCATCCCCGCGGTGCTGACA<br>TCCCGGTTGTTCTTCTGTGCCGGGGGTCTTCCTGC<br>TGTCATGAAGGACGTACCGGGCTTCCTACAGCAG<br>AGCCAGAGCTCCGGGCCCGGGCAGCCCGCTGTG<br>TGGCACCGTCTGGAGGAGCTCTACACGAAGAAGT<br>TGTGGCATCAGCTGACACTTCAGGTGCTTGATTTT<br>GTGCAGGATCCGTGCTTGCCCAAGGAGATGGTCT<br>CATTAAGCTTTATGAAAACTTTATCAGTGAATTTGA | 21 | LPKEMVSL<br>SFMKTLSV<br>NLNTG* |

TABLE 3A-continued

| SEQ ID | identifier_ position | position | modified_RNA | PAP length | PAP |
|---|---|---|---|---|---|
| | | | ACACAGGGTGAATCCTCTGTCCCTCGTGGAAATCA<br>TTCTTCACGTAGTTAGACAGATGACTGATCCTAATG<br>TGGCTCTTACTTTTCTGGAAAAGACTCGTGAGAAG<br>GTGAAAAGTAGTGATGAGGCAGTGATCCTGTGTAA<br>AACAGCAATTGGAGCTCTAAAATTAAACATCGGGG<br>ACCTACAGGTTACAAAGGAAACAATTGAAGATGTT<br>GAAGAAATGCTCAACAACCTTCCTGGTGTGACATC<br>GGTTCACAGTCGTTTCTATGATCTCTCCAGTAAATA<br>CTATCAAACAATCGGAAACCACGCGTCCTACTACA<br>AAGATGCTCTGCGGTTTTTGGGCTGTGTTGACATC<br>AAGGATCTACCAGTGTCTGAGCAGCAGGAGAGAG<br>CCTTCACGCTGGGGCTAGCAGGACTTCTCGGCGA<br>GGGAGTTTTTAACTTTGGAGAACTCCTCATGCACC<br>CTGTGCTGGAGTCCCTGAGGAATACTGACCGGCA<br>GTGGCTGATTGACACCCTCTATGCCTTCAACAGTG<br>GCAACGTAGAGCGGTTCCAGACTCTGAAGACTGC<br>CTGGGGCCAGCAGCCTGATTTAGCAGCTAATGAA<br>GCCCAGCTTCTGAGGAAAATTCAGTTGTTGTGCCT<br>CATGGAGATGACTTTCACACGACCTGCCAATCACA<br>GACAACTCACTTTTGAAGAAATTGCCAAAAGTGCT<br>AAAATCACAGTGAATGAGGTGGAGCTTCTGGTGAT<br>GAAGGCCCTTTCGGTGG | | |
| 1145 | NM_0028 17.2_586 | 586 | AGCATTTCCGGCAGCCATCCCCGCGGTGCTGACA<br>TCCCGGTTGTTCTTCTGTGCCGGGGGTCTTCCTGC<br>TGTCATGAAGGACGTACCGGGCTTCCTACAGCAG<br>AGCCAGAGCTCCGGGCCCGGGCAGCCCGCTGTG<br>TGGCACCGTCTGGAGGAGCTCTACACGAAGAAGT<br>TGTGGCATCAGCTGACACTTCAGGTGCTTGATTTT<br>GTGCAGGATCCGTGCTTTGCCCAAGGAGATGGTC<br>TCATTAAGCTTTATGAAAACTTTATCAGTGAATTTG<br>AACACAGGGTGAATCCTCTGTCCCTCGTGGAAATC<br>ATTCTTCACGTAGTTAGACAGATGACTGATCCTAAT<br>GTGGCTCTTACTTTTCTGGAAAAGACTCGTGAGAA<br>GGTGAAAAGTAGTGATGAGGCAGTGATCCTGTGTA<br>AAACAGCAATTGGAGCTCTAAAATTAAACATCGGG<br>GACCTACAGGTTACAAAGGAAACAATTGAAGATGT<br>TGAAGAAATGCTCAACAACCTTCCTGGTGTGACAT<br>CGGTTCACAGTCGTTTCTATGATCTCTCCAGTAAAT<br>ACTATCAAACAATCGGAAACCACGCGTCTACTACA<br>AAGATGCTCTGCGGTTTTTGGGCTGTGTTGACATC<br>AAGGATCTACCAGTGTCTGAGCAGCAGGAGAGAG<br>CCTTCACGCTGGGGCTAGCAGGACTTCTCGGCGA<br>GGGAGTTTTTAACTTTGGAGAACTCCTCATGCACC<br>CTGTGCTGGAGTCCCTGAGGAATACTGACCGGCA<br>GTGGCTGATTGACACCCTCTATGCCTTCAACAGTG<br>GCAACGTAGAGCGGTTCCAGACTCTGAAGACTGC<br>CTGGGGCCAGCAGCCTGATTTAGCAGCTAATGAA<br>GCCCAGCTTCTGAGGAAAATTCAGTTGTTGTGCCT<br>CATGGAGATGACTTTCACACGACCTGCCAATCACA<br>GACAACTCACTTTTGAAGAAATTGCCAAAAGTGCT<br>AAAATCACAGTGAATGAGGTGGAGCTTCTGGTGAT<br>GAAGGCCCTTTCGGTGG | 30 | TTKMLCGF WAVLTSRI YQCLSSRR EPSRWG* |
| 1146 | NM_0028 17.2_612 | 612 | AGCATTTCCGGCAGCCATCCCCGCGGTGCTGACA<br>TCCCGGTTGTTCTTCTGTGCCGGGGGTCTTCCTGC<br>TGTCATGAAGGACGTACCGGGCTTCCTACAGCAG<br>AGCCAGAGCTCCGGGCCCGGGCAGCCCGCTGTG<br>TGGCACCGTCTGGAGGAGCTCTACACGAAGAAGT<br>TGTGGCATCAGCTGACACTTCAGGTGCTTGATTTT<br>GTGCAGGATCCGTGCTTTGCCCAAGGAGATGGTC<br>TCATTAAGCTTTATGAAAACTTTATCAGTGAATTTG<br>AACACAGGGTGAATCCTCTGTCCCTCGTGGAAATC<br>ATTCTTCACGTAGTTAGACAGATGACTGATCCTAAT<br>GTGGCTCTTACTTTTCTGGAAAAGACTCGTGAGAA<br>GGTGAAAAGTAGTGATGAGGCAGTGATCCTGTGTA<br>AAACAGCAATTGGAGCTCTAAAATTAAACATCGGG<br>GACCTACAGGTTACAAAGGAAACAATTGAAGATGT<br>TGAAGAAATGCTCAACAACCTTCCTGGTGTGACAT<br>CGGTTCACAGTCGTTTCTATGATCTCTCCAGTAAAT<br>ACTATCAAACAATCGGAAACCACGCGTCCTACTAC<br>AAAGATGCTCTGCGGTTTTGGGCTGTGTTGACATC<br>AAGGATCTACCAGTGTCTGAGCAGCAGGAGAGAG<br>CCTTCACGCTGGGGCTAGCAGGACTTCTCGGCGA<br>GGGAGTTTTTAACTTTGGAGAACTCCTCATGCACC<br>CTGTGCTGGAGTCCCTGAGGAATACTGACCGGCA<br>GTGGCTGATTGACACCCTCTATGCCTTCAACAGTG<br>GCAACGTAGAGCGGTTCCAGACTCTGAAGACTGC<br>CTGGGGCCAGCAGCCTGATTTAGCAGCTAATGAA | 22 | WAVLTSRI YQCLSSRR EPSRWG* |

TABLE 3A-continued

| SEQ ID | identifier_position | position | modified_RNA | PAP length | PAP |
|---|---|---|---|---|---|
| | | | GCCCAGCTTCTGAGGAAAATTCAGTTGTTGTGCCT<br>CATGGAGATGACTTTCACACGACCTGCCAATCACA<br>GACAACTCACTTTTGAAGAAATTGCCAAAAGTGCT<br>AAAATCACAGTGAATGAGGTGGAGCTTCTGGTGAT<br>GAAGGCCCTTTCGGTGG | | |
| 1147 | NM_002887.3_371 | 371 | TCCGCTTCCGTCCACTTGGCGAGTGAGACGCTGA<br>TGGGAGGATGGACGTACTGGTGTCTGAGTGCTCC<br>GCGCGGCTGCTGCAGCAGGAAGAAGAGATTAAAT<br>CTCTGACTGCTGAAATTGACCGGTTGAAAAACTGT<br>GGCTGTTTAGGAGCTTCTCCAAATTTGGAGCAGTT<br>ACAAGAAGAAAATTTAAAATTAAAGTATCGACTGAA<br>TATTCTTCGAAAGAGTCTTCAGGCAGAAAGGAACA<br>AACCAACTAAAAATATGATTAACATTATTAGCCGCC<br>TACAAGAGGTCTTTGGTCATGCAATTAAGGCTGCA<br>TATCCAGATTTGGAAAATCCTCCTCTGCTAGTGAC<br>ACCAAGTCAGCAGGCCAAGTTGGGGACTATCAGT<br>GTAATAGTGCTATGGGTATTTCTCAGATGCTCAAA<br>ACCAAGGAACAGAAAGTTAATCCAAGAGAAATTGC<br>TGAAAACATTACCAAACACCTCCCAGACAATGAAT<br>GTATTGAAAAAGTTGAAATTGCTGGTCCTGGTTTTA<br>TTAATGTCCACTTAAGAAAGGATTTTGTATCAGAAC<br>AATTGACCAGTCTTCTAGTGAATGGAGTTCAACTA<br>CCTGCTCTGGGAGAGAATAAAAAGGTTATAGTTGA<br>CTTTTCCTCCCCTAATATAGCTAAAGAGATGCATGT<br>AGGCCACCTGAGGTCAACTATCATAGGAGAGAGT<br>ATAAGCCGCCTCTTTGAATTTGCAGGGTATGACGT<br>GCTCAGGTTAAATCATGTAGGAGACTGGGGGACC<br>CAGTTTGGCATGCTCATCGCTCACCTGCAAGACAA<br>ATTTCCAGATTATCTAACAGTTTCACCTCCTATTGG<br>GGATCTTCAGGTCTTTTATAAGGAATCTAAGAAGA<br>GGTTTGATACTGAGGAGGAATTTAAGAAGCGAGCA<br>TATCAGTGTGTAGTTCTGCTCCAGGGTAAAAACCC<br>AGATATTACAAAAGCTTGGAAGCTTATCTGTGATGT<br>CTCCCGCCAAGAGTTAAATAAAATCTATGATGCATT<br>GGACGTC | 56 | LGTISVIVL<br>WVFLRCSK<br>PRNRKLIQ<br>EKLLKTLP<br>NTSQTMN<br>VLKKLKLLV<br>LVLLMST* |
| 1148 | NM_002887.3_551 | 551 | TCCGCTTCCGTCCACTTGGCGAGTGAGACGCTGA<br>TGGGAGGATGGACGTACTGGTGTCTGAGTGCTCC<br>GCGCGGCTGCTGCAGCAGGAAGAAGAGATTAAAT<br>CTCTGACTGCTGAAATTGACCGGTTGAAAAACTGT<br>GGCTGTTTAGGAGCTTCTCCAAATTTGGAGCAGTT<br>ACAAGAAGAAAATTTAAAATTAAAGTATCGACTGAA<br>TATTCTTCGAAAGAGTCTTCAGGCAGAAAGGAACA<br>AACCAACTAAAAATATGATTAACATTATTAGCCGCC<br>TACAAGAGGTCTTTGGTCATGCAATTAAGGCTGCA<br>TATCCAGATTTGGAAAATCCTCCTCTGCTAGTGAC<br>ACCAAGTCAGCAGGCCAAGTTTGGGGACTATCAG<br>TGTAATAGTGCTATGGGTATTTCTCAGATGCTCAAA<br>ACCAAGGAACAGAAAGTTAATCCAAGAGAAATTGC<br>TGAAAACATTACCAAACACCTCCCAGACAATGAAT<br>GTATTGAAAAAGTTGAAATTGCTGGTCCTGGTTTTA<br>TTAATGTCCACTTAAGAAAGGATTTGTATCAGAACA<br>ATTGACCAGTCTTCTAGTGAATGGAGTTCAACTAC<br>CTGCTCTGGGAGAGAATAAAAAGGTTATAGTTGAC<br>TTTTCCTCCCCTAATATAGCTAAAGAGATGCATGTA<br>GGCCACCTGAGGTCAACTATCATAGGAGAGAGTAT<br>AAGCCGCCTCTTTGAATTTGCAGGGTATGACGTGC<br>TCAGGTTAAATCATGTAGGAGACTGGGGGACCCA<br>GTTTGGCATGCTCATCGCTCACCTGCAAGACAAAT<br>TTCCAGATTATCTAACAGTTTCACCTCCTATTGGGG<br>ATCTTCAGGTCTTTTATAAGGAATCTAAGAAGAGGT<br>TTGATACTGAGGAGGAATTTAAGAAGCGAGCATAT<br>CAGTGTGTAGTTCTGCTCCAGGGTAAAAACCCAGA<br>TATTACAAAAGCTTGGAAGCTTATCTGTGATGTCTC<br>CGCCAAGAGTTAAATAAAATCTATGATGCATTGGA<br>ACGTC | 5 | LYQNN* |
| 1149 | NM_002948.2_318 | 318 | CCTTTCCGTCTGGCGGCAGCCATCAGGTAAGCCA<br>AGATGGGTGCATACAAGTACATCCAGGAGCTATG<br>GAGAAAGAAGCAGTCTGATGTCATGCGCTTTCTTC<br>TGAGGGTCCGCTGCTGGCAGTACCGCCAGCTCTC<br>TGCTCTCCACAGGGCTCCCCGCCCCACCCGGCCT<br>GATAAAGCGCGCCGACTGGGCTACAAGGCCAAGC<br>AAGGTTACGTTATATATAGGATTCGTGTTCGCCGT<br>GGTGGCCGAAAACGCCCAGTTCCTAAGGGTGCAA<br>CTTACGGCAAGCCTGTCCATCATGGTGTTAACCAG<br>CTAAAGTTGCTCGAAGCCTTCAGTCCGTTGCAGAG<br>GAGCGAGCTGGACGCCACTGTGGGGCTCTGAGA<br>GTCCTGAATTCTTACTGGGTTGGTGAAGATTCCAC | 19 | LLEAFSPL<br>QRSELDAT<br>VGL* |

TABLE 3A-continued

| SEQ ID | identifier_position | position | modified_RNA | PAP length | PAP |
|---|---|---|---|---|---|
| | | | ATACAAATTTTTTGAGGTTATCCTCATTGATCCATT<br>CCATAAAGCTATCAGAAGAAATCCTGACACCCAGT<br>GGATCACCAAACCAGTCCACAAGCACAGGGAGAT<br>GCGTGGGCTGACATCTGCAGGCCGAAAGAGCCGT<br>GGCCTTGGAAAGGGCCACAAGTTCCACCACACTA<br>TTGGTGGCTCTCGCCGGGCAGCTTGGAGAAGGCG<br>CAATACTCTCCAGCTCCACCGTTACCGCTAATATA<br>AGTAAAGTTTGTAAAATTCATACTTAATAAACAATTT<br>AGGACAGTCATGTCTGCTTACAGGTGTTATTTGTC<br>TGTTAAAACTAGTCTGCAGATGTTTCTTGAATGCTT<br>TGTCAAATTAAGAAAGTTAAAGTGCAATAATGTTTG<br>AAGACAATAAGTGGTGGTGTATCTTGTTTCTAATAA<br>GATAAACTTTTTTGTCTTTGCTTTATCTTATTAGGGA<br>GTTGTATGTCAGTGTATAAAACATACTGTGTGGTAT<br>AACAGGCTTAATAAATTCTTTAAAAGGAGAGAACT<br>GAAACTAGCCCTGTAGATTTGTCTGGTGCATGTGA<br>TGAAACCTGCAGCTTTATCGGAGTGATGGCAATGC<br>TCTGCTGGTTTA | | |
| 1150 | NM_0029<br>48.2_426 | 426 | CCTTTCCGTCTGGCGGCAGCCATCAGGTAAGCCA<br>AGATGGGTGCATACAAGTACATCCAGGAGCTATG<br>GAGAAAGAAGCAGTCTGATGTCATGCGCTTTCTTC<br>TGAGGGTCCGCTGCTGGCAGTACCGCCAGCTCTC<br>TGCTCTCCACAGGGCTCCCCGCCCCACCCGGCCT<br>GATAAAGCGCGCCGACTGGGCTACAAGGCCAAGC<br>AAGGTTACGTTATATATAGGATTCGTGTTCGCCGT<br>GGTGGCCGAAAACGCCCAGTTCCTAAGGGTGCAA<br>CTTACGGCAAGCCTGTCCATCATGGTGTTAACCAG<br>CTAAAGTTTGCTCGAAGCCTTCAGTCCGTTGCAGA<br>GGAGCGAGCTGGACGCCACTGTGGGGCTCTGAG<br>AGTCCTGAATTCTTACTGGGTTGGTGAAGATTCCA<br>CATACAAATTTTTGAGGTTATCCTCATTGATCCATT<br>CCATAAAGCTATCAGAAGAAATCCTGACACCCAGT<br>GGATCACCAAACCAGTCCACAAGCACAGGGAGAT<br>GCGTGGGCTGACATCTGCAGGCCGAAAGAGCCGT<br>GGCCTTGGAAAGGGCCACAAGTTCCACCACACTA<br>TTGGTGGCTCTCGCCGGGCAGCTTGGAGAAGGCG<br>CAATACTCTCCAGCTCCACCGTTACCGCTAATATA<br>AGTAAAGTTTGTAAAATTCATACTTAATAAACAATTT<br>AGGACAGTCATGTCTGCTTACAGGTGTTATTTGTC<br>TGTTAAAACTAGTCTGCAGATGTTTCTTGAATGCTT<br>TGTCAAATTAAGAAAGTTAAAGTGCAATAATGTTTG<br>AAGACAATAAGTGGTGGTGTATCTTGTTTCTAATAA<br>GATAAACTTTTTTGTCTTTGCTTTATCTTATTAGGGA<br>GTTGTATGTCAGTGTATAAAACATACTGTGTGGTAT<br>AACAGGCTTAATAAATTCTTTAAAAGGAGAGAACT<br>GAAACTAGCCCTGTAGATTTGTCTGGTGCATGTGA<br>TGAAACCTGCAGCTTTATCGGAGTGATGGCAATGC<br>TCTGCTGGTTTA | 34 | LRLSSLIHS<br>IKLSEEILT<br>PSGSPNQ<br>STSTGRCV<br>G* |
| 1151 | NM_0029<br>48.2_541 | 541 | CCTTTCCGTCTGGCGGCAGCCATCAGGTAAGCCA<br>AGATGGGTGCATACAAGTACATCCAGGAGCTATG<br>GAGAAAGAAGCAGTCTGATGTCATGCGCTTTCTTC<br>TGAGGGTCCGCTGCTGGCAGTACCGCCAGCTCTC<br>TGCTCTCCACAGGGCTCCCCGCCCCACCCGGCCT<br>GATAAAGCGCGCCGACTGGGCTACAAGGCCAAGC<br>AAGGTTACGTTATATATAGGATTCGTGTTCGCCGT<br>GGTGGCCGAAAACGCCCAGTTCCTAAGGGTGCAA<br>CTTACGGCAAGCCTGTCCATCATGGTGTTAACCAG<br>CTAAAGTTTGCTCGAAGCCTTCAGTCCGTTGCAGA<br>GGAGCGAGCTGGACGCCACTGTGGGGCTCTGAG<br>AGTCCTGAATTCTTACTGGGTTGGTGAAGATTCCA<br>CATACAAATTTTTGAGGTTATCCTCATTGATCCAT<br>TCCATAAAGCTATCAGAAGAAATCCTGACACCCAG<br>TGGATCACCAAACCAGTCCACAAGCACAGGGAGA<br>TGCGTGGGCTGACATCTGCAGGCGAAAGAGCCGT<br>GGCCTTGGAAAGGGCCACAAGTTCCACCACACTA<br>TTGGTGGCTCTCGCCGGGCAGCTTGGAGAAGGCG<br>CAATACTCTCCAGCTCCACCGTTACCGCTAATATA<br>AGTAAAGTTTGTAAAATTCATACTTAATAAACAATTT<br>AGGACAGTCATGTCTGCTTACAGGTGTTATTTGTC<br>TGTTAAAACTAGTCTGCAGATGTTTCTTGAATGCTT<br>TGTCAAATTAAGAAAGTTAAAGTGCAATAATGTTTG<br>AAGACAATAAGTGGTGGTGTATCTTGTTTCTAATAA<br>GATAAACTTTTTTGTCTTTGCTTTATCTTATTAGGGA<br>GTTGTATGTCAGTGTATAAAACATACTGTGTGGTAT<br>AACAGGCTTAATAAATTCTTTAAAAGGAGAGAACT<br>GAAACTAGCCCTGTAGATTTGTCTGGTGCATGTGA | 46 | ERAVALER<br>ATSSTTLL<br>VALAGQLG<br>EGAILSSST<br>VTANISKV<br>CKIHT* |

TABLE 3A-continued

| SEQ ID | identifier_position | position | modified_RNA | PAP length | PAP |
|---|---|---|---|---|---|
| 1152 | NM_0029 48.2_556 | 556 | CCTTTCCGTCTGGCGGCAGCCATCAGGTAAGCCA AGATGGGTGCATACAAGTACATCCAGGAGCTATG GAGAAAGAAGCAGTCTGATGTCATGCGCTTTCTTC TGAGGGTCCGCTGCTGGCAGTACCGCCAGCTCTC TGCTCTCCACAGGGCTCCCCGCCCCACCCGGCCT GATAAAGCGCGCCGACTGGGCTACAAGGCCAAGC AAGGTTACGTTATATATAGGATTCGTGTTCGCCGT GGTGGCCGAAAACGCCCAGTTCCTAAGGGTGCAA CTTACGGCAAGCCTGTCCATCATGGTGTTAACCAG CTAAAGTTTGCTCGAAGCCTTCAGTCCGTTGCAGA GGAGCGAGCTGGACGCCACTGTGGGGCTCTGAG AGTCCTGAATTCTTACTGGGTTGGTGAAGATTCCA CATACAAATTTTTTGAGGTTATCCTCATTGATCCAT TCCATAAAGCTATCAGAAGAAATCCTGACACCCAG TGGATCACCAAACCAGTCCACAAGCACAGGGAGA TGCGTGGGCTGACATCTGCAGGCCGAAAGAGCCG TGGCTTGGAAAGGGCCACAAGTTCCACCACACTAT TGGTGGCTCTCGCCGGGCAGCTTGGAGAAGGCGC AATACTCTCCAGCTCCACCGTTACCGCTAATATAA GTAAAGTTTGTAAAATTCATACTTAATAAACAATTTA GGACAGTCATGTCTGCTTACAGGTGTTATTTGTCT GTTAAAACTAGTCTGCAGATGTTTCTTGAATGCTTT GTCAAATTAAGAAAGTTAAAGTGCAATAATGTTTGA AGACAATAAGTGGTGGTGTATCTTGTTTCTAATAAG ATAAACTTTTTTGTCTTTGCTTTATCTTATTAGGGAG TTGTATGTCAGTGTATAAAACATACTGTGTGGTATA ACAGGCTTAATAAATTCTTTAAAAGGAGAGAACTG AAACTAGCCCTGTAGATTTGTCTGGTGCATGTGAT GAAACCTGCAGCTTTATCGGAGTGATGGCAATGCT CTGCTGGTTTA | 40 | ERATSSTT LLVALAGQ LGEGAILS SSTVTANIS KVCKIHT* |
| 1153 | NM_0029 48.2_588 | 588 | CCTTTCCGTCTGGCGGCAGCCATCAGGTAAGCCA AGATGGGTGCATACAAGTACATCCAGGAGCTATG GAGAAAGAAGCAGTCTGATGTCATGCGCTTTCTTC TGAGGGTCCGCTGCTGGCAGTACCGCCAGCTCTC TGCTCTCCACAGGGCTCCCCGCCCCACCCGGCCT GATAAAGCGCGCCGACTGGGCTACAAGGCCAAGC AAGGTTACGTTATATATAGGATTCGTGTTCGCCGT GGTGGCCGAAAACGCCCAGTTCCTAAGGGTGCAA CTTACGGCAAGCCTGTCCATCATGGTGTTAACCAG CTAAAGTTTGCTCGAAGCCTTCAGTCCGTTGCAGA GGAGCGAGCTGGACGCCACTGTGGGGCTCTGAG AGTCCTGAATTCTTACTGGGTTGGTGAAGATTCCA CATACAAATTTTTTGAGGTTATCCTCATTGATCCAT TCCATAAAGCTATCAGAAGAAATCCTGACACCCAG TGGATCACCAAACCAGTCCACAAGCACAGGGAGA TGCGTGGGCTGACATCTGCAGGCCGAAAGAGCCG TGGCCTTGGAAAGGGCCACAAGTTCCACCACACT ATGGTGGCTCTCGCCGGGCAGCTTGGAGAAGGCG CAATACTCTCCAGCTCCACCGTTACCGCTAATATA AGTAAAGTTTGTAAAATTCATACTTAATAAACAATTT AGGACAGTCATGTCTGCTTACAGGTGTTATTTGTC TGTTAAAACTAGTCTGCAGATGTTTCTTGAATGCTT TGTCAAATTAAGAAAGTTAAAGTGCAATAATGTTTG AAGACAATAAGTGGTGGTGTATCTTGTTTCTAATAA GATAAACTTTTTGTCTTTGCTTTATCTTATTAGGGA GTTGTATGTCAGTGTATAAAACATACTGTGTGGTAT AACAGGCTTAATAAATTCTTTAAAAGGAGAGAACT GAAACTAGCCCTGTAGATTTGTCTGGTGCATGTGA TGAAACCTGCAGCTTTATCGGAGTGATGGCAATGC TCTGCTGGTTTA | 31 | MVALAGQL GEGAILSS STVTANISK VCKIHT* |
| 1154 | NM_0029 48.2_623 | 623 | CCTTTCCGTCTGGCGGCAGCCATCAGGTAAGCCA AGATGGGTGCATACAAGTACATCCAGGAGCTATG GAGAAAGAAGCAGTCTGATGTCATGCGCTTTCTTC TGAGGGTCCGCTGCTGGCAGTACCGCCAGCTCTC TGCTCTCCACAGGGCTCCCCGCCCCACCCGGCCT GATAAAGCGCGCCGACTGGGCTACAAGGCCAAGC AAGGTTACGTTATATATAGGATTCGTGTTCGCCGT GGTGGCCGAAAACGCCCAGTTCCTAAGGGTGCAA CTTACGGCAAGCCTGTCCATCATGGTGTTAACCAG CTAAAGTTTGCTCGAAGCCTTCAGTCCGTTGCAGA GGAGCGAGCTGGACGCCACTGTGGGGCTCTGAG AGTCCTGAATTCTTACTGGGTTGGTGAAGATTCCA CATACAAATTTTTTGAGGTTATCCTCATTGATCCAT TCCATAAAGCTATCAGAAGAAATCCTGACACCCAG TGGATCACCAAACCAGTCCACAAGCACAGGGAGA | 19 | ILSSSTVTA NISKVCKIH T* |

TABLE 3A-continued

| SEQ ID | identifier_position | position | modified_RNA | PAP length | PAP |
|---|---|---|---|---|---|
| | | | TGCGTGGGCTGACATCTGCAGGCCGAAAGAGCCG TGGCCTTGGAAAGGGCCACAAGTTCCACCACACT ATTGGTGGCTCTCGCCGGGCAGCTTGGAGAAGGC GCATACTCTCCAGCTCCACCGTTACCGCTAATATA AGTAAAGTTTGTAAAATTCATACTTAATAAACAATTT AGGACAGTCATGTCTGCTTACAGGTGTTATTTGTC TGTTAAAACTAGTCTGCAGATGTTTCTTGAATGCTT TGTCAAATTAAGAAAGTTAAAGTGCAATAATGTTTG AAGACAATAAGTGGTGGTGTATCTTGTTTCTAATAA GATAAACTTTTTTGTCTTTGCTTTATCTTATTAGGGA GTTGTATGTCAGTGTATAAAACATACTGTGTGGTAT AACAGGCTTAATAAATTCTTTAAAAGGAGAGAACT GAAACTAGCCCTGTAGATTTGTCTGGTGCATGTGA TGAAACCTGCAGCTTTATCGGAGTGATGGCAATGC TCTGCTGGTTTA | | |
| 1155 | NM_0029 48.2_648 | 648 | CCTTTCCGTCTGGCGGCAGCCATCAGGTAAGCCA AGATGGGTGCATACAAGTACATCCAGGAGCTATG GAGAAAGAAGCAGTCTGATGTCATGCGCTTTCTTC TGAGGGTCCGCTGCTGGCAGTACCGCCAGCTCTC TGCTCTCCACAGGGCTCCCCGCCCCACCCGGCCT GATAAAGCGCGCCGACTGGGCTACAAGGCCAAGC AAGGTTACGTTATATATAGGATTCGTGTTCGCCGT GGTGGCCGAAAACGCCCAGTTCCTAAGGGTGCAA CTTACGGCAAGCCTGTCCATCATGGTGTTAACCAG CTAAAGTTTGCTCGAAGCCTTCAGTCCGTTGCAGA GGAGCGAGCTGGACGCCACTGTGGGGCTCTGAG AGTCCTGAATTCTTACTGGGTTGGTGAAGATTCCA CATACAAATTTTTTGAGGTTATCCTCATTGATCCAT TCCATAAAGCTATCAGAAGAAATCCTGACACCCAG TGGATCACCAAACCAGTCCACAAGCACAGGGAGA TGCGTGGGCTGACATCTGCAGGCCGAAAGAGCCG TGGCCTTGGAAAGGGCCACAAGTTCCACCACACT ATTGGTGGCTCTCGCCGGGCAGCTTGGAGAAGGC GCAATACTCTCCAGCTCCACCGTTACCGTAATATA AGTAAAGTTTGTAAAATTCATACTTAATAAACAATTT AGGACAGTCATGTCTGCTTACAGGTGTTATTTGTC TGTTAAAACTAGTCTGCAGATGTTTCTTGAATGCTT TGTCAAATTAAGAAAGTTAAAGTGCAATAATGTTTG AAGACAATAAGTGGTGGTGTATCTTGTTTCTAATAA GATAAACTTTTTTGTCTTTGCTTTATCTTATTAGGGA GTTGTATGTCAGTGTATAAAACATACTGTGTGGTAT AACAGGCTTAATAAATTCTTTAAAAGGAGAGAACT GAAACTAGCCCTGTAGATTTGTCTGGTGCATGTGA TGAAACCTGCAGCTTTATCGGAGTGATGGCAATGC TCTGCTGGTTTA | 10 | NISKVCKIH T* |
| 1156 | NM_0029 51.2_693 | 693 | TTCCAGCGTTGCGAGACGGTCGGTTCCAAGTGGG CCTGGGCGCGGGGGAGAGGCGGGTCTGTCCTCG GGAACTGCAAGGCCCTGTGAGCGGGAGGACTGG GATCCCGGCCGCGGCTGCTGGAAGCGTCGAAGCT CAGCGGGCCGCGGACATGACCTGTGCTTAGAACT CATCCTGGCCCGCAGAGCCTGCCGCGAGTCCCTG GCGTCCCTGTGGCGGGCTCTTGGAGCCACTTTC CCGAGCGGAAGTCAGCCCGCGGCTCGGACTCCG GCGGGACCTGCTCGGAGGAATGGCGCCGCCGGG TTCAAGCACTGTCTTCCTGTTGGCCCTGACAATCA TAGCCAGCACCTGGGCTCTGACGCCCACTCACTA CCTCACCAAGCATGACGTGGAGAGACTAAAAGCC TCGCTGGATCGCCCTTTCACAAATTTGGAATCTGC CTTCTACTCCATCGTGGGACTCAGCAGCCTTGGTG CTCAGGTGCCAGATGCAAAGAAAGCATGTACCTAC ATCAGATCTAACCTTGATCCCAGCAATGTGGATTC CCTCTTCTACGCTGCCCAGGCCAGCCAGGCCCTC TCAGGATGTGAGATCTCTATTTCAAATGAGACCAA AGATCTGCTTCTGGCAGCTGTCAGTGAGGACTCAT CTGTTACCCAGATCTACCATGCAGTTGCAGCTCTA AGTGGCTTGGCCTTCCCTTGGCATCCCAAGAAGCA CTCAGTGCCCTTACTGCTCGTCTCAGCAAGGAGGA GACTGTGCTGGCAACAGTCCAGGCTCTGCAGACA GCATCCCACCTGTCCCAGCAGGCTGACCTGAGGA GCATCGTGGAGGAGATTGAGGACCTTGTTGCTCG CCTGGATGAACTCGGGGGCGTGTATCTCCAGTTT GAAGAAGGACTGGAAACAACAGCGTTATTTGTGGC TGCCACCTACAAGCTCATGGATCATGTGGGGACT GAGCCATCCATTAAGGAGGATCAGGTCATCCAGCT GATGAACGCGATCTTCAGCAAGAAGAACTT | 42 | LAFPWHPK KHSVPLLL VSARRRLC WQQSRLC RQHPTCPS RLT* |

TABLE 3A-continued

| SEQ ID | identifier_position | position | modified_RNA | PAP length | PAP |
|---|---|---|---|---|---|
| 1157 | NM_0029<br>52.3_123 | 123 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCGGGGCCGGGGTC<br>GCGGCCGTGGACGGGGCCGGGGCCGAGGCCGC<br>GGAGCTCGCGGAGGCAAGGCCGAGGATAAGGAG<br>TGGATGCCCGTCACCAAGTTGGGCCGCTTGGTCA<br>AGGACATGAAGATCAAGTCCCTGGAGGAGATCTAT<br>CTCTTCTCCCTGCCTATTAAGGAATCAGAGATCATT<br>GATTTCTTCCTGGGGGCCTCTCTCAAGGATGAGGT<br>TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 39 | GAGVAAV<br>DGAGAEA<br>AELAEARP<br>RIRSGCPS<br>PSWAAWS<br>RT* |
| 1158 | NM_0029<br>52.3_141 | 141 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCGTGGACGGGGCCGGGGCCGAGGCCGC<br>GGAGCTCGCGGAGGCAAGGCCGAGGATAAGGAG<br>TGGATGCCCGTCACCAAGTTGGGCCGCTTGGTCA<br>AGGACATGAAGATCAAGTCCCTGGAGGAGATCTAT<br>CTCTTCTCCCTGCCTATTAAGGAATCAGAGATCATT<br>GATTTCTTCCTGGGGGCCTCTCTCAAGGATGAGGT<br>TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 33 | VDGAGAE<br>AAELAEAR<br>PRIRSGCP<br>SPSWAAW<br>SRT* |
| 1159 | NM_0029<br>52.3_167 | 167 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>GGAGCTCGCGGAGGCAAGGCCGAGGATAAGGAG<br>TGGATGCCCGTCACCAAGTTGGGCCGCTTGGTCA<br>AGGACATGAAGATCAAGTCCCTGGAGGAGATCTAT<br>CTCTTCTCCCTGCCTATTAAGGAATCAGAGATCATT<br>GATTTCTTCCTGGGGGCCTCTCTCAAGGATGAGGT<br>TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT | 24 | ELAEARPR<br>IRSGCPSP<br>SWAAWSR<br>T* |

TABLE 3A-continued

| SEQ ID | identifier_ position | position | modified_RNA | PAP length | PAP |
|---|---|---|---|---|---|
| | | | GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1160 | NM_0029 52.3_184 | 184 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAGGCCGAGGATAAGGAG TGGATGCCCGTCACCAAGTTGGGCCGCTTGGTCA AGGACATGAAGATCAAGTCCCTGGAGGAGATCTAT CTCTTCTCCCTGCCTATTAAGGAATCAGAGATCATT GATTTCTTCCTGGGGGCCTCTCTCAAGGATGAGGT TTTGAAGATTATGCCAGTGCAGAAGCAGACCCGTG CCGGCCAGCGCACCAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 19 | RPRIRSGC PSPSWAA WSRT* |
| 1161 | NM_0029 52.3_196 | 196 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAGGAG TGGATGCCCGTOACCAAGTTGGGCCGCTTGGTCA AGGACATGAAGATCAAGTCCCTGGAGGAGATCTAT CTCTTCTCCCTGCCTATTAAGGAATCAGAGATCATT GATTTCTTCCTGGGGGCCTCTCTCAAGGATGAGGT TTTGAAGATTATGCCAGTGCAGAAGCAGACCCGTG CCGGCCAGCGCACCAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 15 | RSGCPSPS WAAWSRT* |
| 1162 | NM_0029 52.3_220 | 220 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTGGGCCGCTTGGTCA AGGACATGAAGATCAAGTCCCTGGAGGAGATCTAT CTCTTCTCCCTGCCTATTAAGGAATCAGAGATCATT GATTTCTTCCTGGGGGCCTCTCTCAAGGATGAGGT | 7 | WAAWSRT |

TABLE 3A-continued

| SEQ ID | identifier_position | position | modified_RNA | PAP length | PAP |
|---|---|---|---|---|---|
| | | | TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | | |
| 1163 | NM_0029 52.3_223 | 223 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGCCGCTTGGTCA<br>AGGACATGAAGATCAAGTCCCTGGAGGAGATCTAT<br>CTCTTCTCCCTGCCTATTAAGGAATCAGAGATCATT<br>GATTTCTTCCTGGGGGCCTCTCTCAAGGATGAGGT<br>TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 6 | AAWSRT* |
| 1164 | NM_0029 52.3_255 | 255 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTAT<br>CTCTTCTCCCTGCCTATTAAGGAATCAGAGATCATT<br>GATTTCTTCCTGGGGGCCTCTCTCAAGGATGAGGT<br>TTTGAAGATTATGCCAGTGCAGAAGCAGACCCGTG<br>CCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 29 | WRRSISSP<br>CLLRNQRS<br>LISSWGPL<br>SRMRF* |

TABLE 3A-continued

| SEQ ID | identifier_ position | position | modified_RNA | PAP length | PAP |
|---|---|---|---|---|---|
| 1165 | NM_0029 52.3_305 | 305 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT GATTTCTTCCTGGGGGCCTCTCTCAAGGATGAGGT TTTGAAGATTATGCCAGTGCAGAAGCAGACCCGTG CCGGCCAGCGCACCAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 13 | MISSWGPL SRMRF* |
| 1166 | NM_0029 52.3_321 | 321 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGCCTCTCTCAAGGATGAGGT TTTGAAGATTATGCCAGTGCAGAAGCAGACCCGTG CCGGCCAGCGCACCAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 7 | PLSRMRF* |
| 1167 | NM_0029 52.3_343 | 343 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTGAAGATTATGCCAGTGCAGAAGCAGACCCGTG CCGGCCAGCGCACCAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT | 0 | * |

TABLE 3A-continued

| SEQ ID | identifier_position | position | modified_RNA | PAP length | PAP |
|---|---|---|---|---|---|
| | | | GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1168 | NM_0029 52.3_381 | 381 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCAGCGCACAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 64 | SAPGSRHL LLSGTTMA TSVWVLSA PRRWPPP SVGPSSW PSSPSSPC AEATGGTR SASPTLSL AR* |
| 1169 | NM_0029 52.3_389 | 389 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCAGCGCACAGGTTCAAGGCATTTGTTGC TATCGGGGACTACAATGGCCACGTCGGTCTGGGT GTTAAGTGCTCCAAGGAGGTGGCCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 61 | GSRHLLLS GTTMATSV WVLSAPR RWPPPSV GPSSWPS SPSSPCAE ATGGTRSA SPTLSLAR* |
| 1170 | NM_0029 52.3_404 | 404 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT | 57 | LLLSGTTM ATSVWVLS APRRWPP PSVGPSS WPSSPSS PCAEATGG TRSASPTL SLAR* |

TABLE 3A-continued

| SEQ ID | identifier_ position | position | modified_RNA | PAP length | PAP |
|---|---|---|---|---|---|
| | | | TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAA<br>A | | |
| 1171 | NM_0029<br>52.3_407 | 407 | CTTCTTTTCCGACAAAACACCAAATGGCGGATGAC<br>GCCGGTGCAGCGGGGGGGCCCGGGGGCCCTGGT<br>GGGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTGC<br>TATCGGGGACTACAATGGCCACGTCGGTCTGGGT<br>GTTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAA<br>A | 55 | LSGTTMAT<br>SVWVLSAP<br>RRWPPPS<br>VGPSSWP<br>SSPSSPCA<br>EATGGTRS<br>ASPTLSLA<br>R* |
| 1172 | NM_0029<br>52.3_446 | 446 | CTTCTTTTCCGACAAAACACCAAATGGCGGATGAC<br>GCCGGTGCAGCGGGGGGGCCCGGGGGCCCTGGT<br>GGGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTAAGTGCTCCAAGGAGGTGGCCACCGCCATCC<br>GTGGGGCCATCATCCTGGCCAAGCTCTCCATCGT<br>CCCCGTGCGCAGAGGCTACTGGGGGAACAAGATC<br>GGCAAGCCCCACACTGTCCCTTGCAAGGTGACAG<br>GCCGCTGCGGCTCTGTGCTGGTACGCCTCATCCC<br>TGCACCCAGGGGCACTGGCATCGTCTCCGCACCT<br>GTGCCTAAGAAGCTGCTCATGATGGCTGGTATCGA<br>TGACTGCTACACCTCAGCCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT | 42 | SAPRRWP<br>PPSVGPSS<br>WPSSPSS<br>PCAEATGG<br>TRSASPTL<br>SLAR* |

TABLE 3A-continued

| SEQ ID | identifier_position | position | modified_RNA | PAP length | PAP |
|---|---|---|---|---|---|
| | | | AAAGTGAATTAAGCGTGAAAAAAAAAAAAAAAAAAAA | | |
| 1173 | NM_0029 52.3_467 | 467 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 35 | PPSVGPSS WPSSPSS PCAEATGG TRSASPTL SLAR* |
| 1174 | NM_0029 52.3_470 | 470 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 34 | PSVGPSS WPSSPSS PCAEATGG TRSASPTL SLAR* |
| 1175 | NM_0029 52.3_473 | 473 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCACCGCCATCC GTGGGGCCATCATCCTGGCCAAGCTCTCCATCGT CCCCGTGCGCAGAGGCTACTGGGGGAACAAGATC GGCAAGCCCCACACTGTCCCTTGCAAGGTGACAG | 33 | SVGPSSW PSSPSSPC AEATGGTR SASPTLSL AR* |

TABLE 3A-continued

| SEQ ID | identifier_ position | position | modified_RNA | PAP length | PAP |
|---|---|---|---|---|---|
| | | | GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | | |
| 1176 | NM_0029 52.3_497 | 497 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCAAGCTCTCCATCGT CCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 25 | SSPSSPCA EATGGTRS ASPTLSLA R* |
| 1177 | NM_0029 52.3_515 | 515 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCGTGCGCAGAGGCTACTGGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 19 | CAEATGGT RSASPTLS LAR* |
| 1178 | NM_0029 52.3_536 | 536 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC | 12 | TRSASPTL SLAR* |

TABLE 3A-continued

| SEQ ID | identifier_position | position | modified_RNA | PAP length | PAP |
|---|---|---|---|---|---|
| | | | AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGAACAAGATC GGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1179 | NM_0029 52.3_548 | 548 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGAACAAGAT CGGAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 8 | SPTLSLAR* |
| 1180 | NM_0029 52.3_555 | 555 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGAACAAGAT CGGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT | 6 | TLSLAR* |

TABLE 3A-continued

| SEQ ID | identifier_ position | position | modified_RNA | PAP length | PAP |
|---|---|---|---|---|---|
| | | | AAAGTGAATTAAGCGTGAAAAAAAAAAAAAAAAAAA A | | |
| 1181 | NM_0029 52.3_557 | 557 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCAACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 6 | QLSLAR* |
| 1182 | NM_0029 52.3_565 | 565 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACAG GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 3 | LAR* |
| 1183 | NM_0029 52.3_571 | 571 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAGGTGACAG | 1 | R* |

TABLE 3A-continued

| SEQ ID | identifier_position | position | modified_RNA | PAP length | PAP |
|---|---|---|---|---|---|
| | | | GCCGCTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | | |
| 1184 | NM_0029 52.3_584 | 584 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGTGCGGCTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 27 | AALCWYAS SLHPGALA SSPHLCLR SCS* |
| 1185 | NM_0029 52.3_590 | 590 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAAA A | 25 | LCWYASSL HPGALASS PHLCLRSC S* |
| 1186 | NM_0029 52.3613 | 613 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC | 18 | LH PGALAS SPHLCLRS CS* |

TABLE 3A-continued

| SEQ ID | identifier_position | position | modified_RNA | PAP length | PAP |
|---|---|---|---|---|---|
| | | | AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC TGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | | |
| 1187 | NM_0029 52.3616 | 616 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 17 | DPGALASS PHLCLRSC S* |
| 1188 | NM_0029 52.3620 | 620 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC | 15 | GALASSPH LCLRSCS* |

TABLE 3A-continued

| SEQ ID | identifier_position | position | modified_RNA | PAP length | PAP |
|---|---|---|---|---|---|
| | | | TGTGGCTACAACATAGGGTTTTTATACAAGAAAAAT AAAGTGAATTAAGCGTGAAAAAAAAAAAAAAAAAAA A | | |
| 1189 | NM_0029 52.3_625 | 625 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCC CTGCACCCAGGGGCACTGGCATCGTCTCCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 14 | ALASSPHL CLRSCS* |
| 1190 | NM_0029 52.3_641 | 641 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCC CTGCACCCAGGGGCACTGGCATCGTCTCGCACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 8 | HLCLRSCS* |
| 1191 | NM_0029 52.3_643 | 643 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT | 8 | DLCLRSCS* |

TABLE 3A-continued

| SEQ ID | identifier_position | position | modified_RNA | PAP length | PAP |
|---|---|---|---|---|---|
| | | | CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGACCT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1192 | NM_0029 52.3_646 | 646 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACT GTGCCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 7 | LCLRSCS* |
| 1193 | NM_0029 52.3_652 | 652 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCTAAGAAGCTGCTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 5 | LRSCS* |
| 1194 | NM_0029 52.3_663 | 663 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA | 1 | S* |

TABLE 3A-continued

| SEQ ID | identifier_position | position | modified_RNA | PAP length | PAP |
|---|---|---|---|---|---|
| | | | GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGTCATGATGGCTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | | |
| 1195 | NM_0029 52.3_673 | 673 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGTCATGATGGTGGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 34 | VVSMTATP QPGAALPP WATSPRP PLMPFLRP TAT* |
| 1196 | NM_0029 52.3_676 | 676 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCA7CATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGTCATGATGGCTGTATCGA TGACTGCTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA | 33 | VSMTATPQ PGAALPP WATSPRP PLMPFLRP TAT* |

TABLE 3A-continued

| SEQ ID | identifier_position | position | modified_RNA | PAP length | PAP |
|---|---|---|---|---|---|
| | | | CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1197 | NM_0029 52.3_689 | 689 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGCTCATGATGGCTGGTATCG ATGACTGTACACCTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 28 | TPQPGAAL PPWATSP RPPLMPFL RPTAT* |
| 1198 | NM_0029 52.3_695 | 695 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACTCAGCCCGGGGCTGCACTGCC ACCCTGGGCAACTTCGCCAAGGCCACCTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 26 | QPGAALPP WATSPRP PLMPFLRP TAT* |
| 1199 | NM_0029 52.3_702 | 702 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG | 24 | GAALPPW ATSPRPPL MPFLRPTA T* |

TABLE 3A-continued

| SEQ ID | identifier_position | position | modified_RNA | PAP length | PAP |
|---|---|---|---|---|---|
| | | | TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCGGGGCTGCACTGCC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | | |
| 1200 | NM_0029<br>52.3_716 | 716 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTTAAGTGCTCCAAGGAGGTGGCCACCGCCATC<br>CGTGGGGCCATCATCCTGGCCAAGCTCTCCATCG<br>TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCCGGGGCTGCACTGC<br>ACCCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 19 | PWATSPR<br>PPLMPFLR<br>PTAT* |
| 1201 | NM_0029<br>52.3_720 | 720 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTTAAGTGCTCCAAGGAGGTGGCCACCGCCATC<br>CGTGGGGCCATCATCCTGGCCAAGCTCTCCATCG<br>TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCCGGGGCTGCACTGC<br>CACCTGGGCAACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAAA<br>A | 18 | WATSPRP<br>PLMPFLRP<br>TAT* |
| 1202 | NM_0029<br>52.3_727 | 727 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG | 16 | TSPRPPLM<br>PFLRPTAT* |

TABLE 3A-continued

| SEQ ID | identifier_position | position | modified_RNA | PAP length | PAP |
|---|---|---|---|---|---|
| | | | CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTTAAGTGCTCCAAGGAGGTGGCCACCGCCATC<br>CGTGGGGCCATCATCCTGGCCAAGCTCTCCATCG<br>TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCCGGGGCTGCACTGC<br>CACCCTGGGCACTTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAA<br>A | | |
| 1203 | NM_0029<br>52.3_728 | 728 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTTAAGTGCTCCAAGGAGGTGGCCACCGCCATC<br>CGTGGGGCCATCATCCTGGCCAAGCTCTCCATCG<br>TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCCGGGGCTGCACTGC<br>CACCCTGGGCAATTCGCCAAGGCCACCTTTGATG<br>CCATTTCTAAGACCTACAGCTACCTGACCCCCGAC<br>CTCTGGAAGGAGACTGTATTCACCAAGTCTCCCTA<br>TCAGGAGTTCACTGACCACCTCGTCAAGACCCACA<br>CCAGAGTCTCCGTGCAGCGGACTCAGGCTCCAGC<br>TGTGGCTACAACATAGGGTTTTTATACAAGAAAAAT<br>AAAGTGAATTAAGCGTGAAAAAAAAAAAAAAAAAA<br>A | 15 | SPRPPLMP<br>FLRPTAT* |
| 1204 | NM_0029<br>52.3_740 | 740 | CTTCTTTTCCGACAAAACACCAAATGGCGGATGAC<br>GCCGGTGCAGCGGGGGGGCCCGGGGGCCCTGGT<br>GGCCCTGGGATGGGGAACCGCGGTGGCTTCCGC<br>GGAGGTTTCGGCAGTGGCATCCGGGGCCGGGGT<br>CGCGGCCGTGGACGGGGCCGGGGCCGAGGCCG<br>CGGAGCTCGCGGAGGCAAGGCCGAGGATAAGGA<br>GTGGATGCCCGTCACCAAGTTGGGCCGCTTGGTC<br>AAGGACATGAAGATCAAGTCCCTGGAGGAGATCTA<br>TCTCTTCTCCCTGCCTATTAAGGAATCAGAGATCAT<br>TGATTTCTTCCTGGGGGCCTCTCTCAAGGATGAGG<br>TTTTGAAGATTATGCCAGTGCAGAAGCAGACCCGT<br>GCCGGCCAGCGCACCAGGTTCAAGGCATTTGTTG<br>CTATCGGGGACTACAATGGCCACGTCGGTCTGGG<br>TGTTAAGTGCTCCAAGGAGGTGGCCACCGCCATC<br>CGTGGGGCCATCATCCTGGCCAAGCTCTCCATCG<br>TCCCCGTGCGCAGAGGCTACTGGGGGAACAAGAT<br>CGGCAAGCCCCACACTGTCCCTTGCAAGGTGACA<br>GGCCGCTGCGGCTCTGTGCTGGTACGCCTCATCC<br>CTGCACCCAGGGGCACTGGCATCGTCTCCGCACC<br>TGTGCCTAAGAAGCTGCTCATGATGGCTGGTATCG<br>ATGACTGCTACACCTCAGCCCGGGGCTGCACTGC<br>CACCCTGGGCAACTTCGCCAAGGCACCTTTGATG<br>CCATTTCTAAGACCTACAGCTACCTGACCCCCGAC<br>CTCTGGAAGGAGACTGTATTCACCAAGTCTCCCTA | 11 | PLMPFLRP<br>TAT* |

TABLE 3A-continued

| SEQ ID | identifier_position | position | modified_RNA | PAP length | PAP |
|---|---|---|---|---|---|
| | | | TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | | |
| 1205 | NM_0029 52.3_743 | 743 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACCTCAGCCCGGGGCTGCACTGC CACCCTGGGCAACTTCGCCAAGGCCACTTTGATG CCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 10 | LMPFLRPT AT* |
| 1206 | NM_0029 52.3_752 | 752 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGCTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACCTCAGCCCGGGGCTGCACTGC CACCCTGGGCAACTTCGCCAAGGCCACCTTTGAT GCATTTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAA A | 7 | FLRPTAT* |
| 1207 | NM_0029 52.3_756 | 756 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC | 6 | LRPTAT* |

TABLE 3A-continued

| SEQ ID | identifier_ position | position | modified_RNA | PAP length | PAP |
|---|---|---|---|---|---|
| | | | CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACCTCAGCCCGGGGCTGCACTGC CACCCTGGGCAACTTCGCCAAGGCCACCTTTGAT GCCATTCTAAGACCTACAGCTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | | |
| 1208 | NM_0029 52.3_770 | 770 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACCTCAGCCCGGGGCTGCACTGC CACCCTGGGCAACTTCGCCAAGGCCACCTTTGAT GCCATTCTAAGACCTACAGTACCTGACCCCCGAC CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 1 | T* |
| 1209 | N 0_029 52.3_786 | 786 | CTTCTTTTCCGACAAAACACCAAATGGCGGATGAC GCCGGTGCAGCGGGGGGGCCCGGGGGCCCTGGT GGCCCTGGGATGGGGAACCGCGGTGGCTTCCGC GGAGGTTTCGGCAGTGGCATCCGGGGCCGGGGT CGCGGCCGTGGACGGGGCCGGGGCCGAGGCCG CGGAGCTCGCGGAGGCAAGGCCGAGGATAAGGA GTGGATGCCCGTCACCAAGTTGGGCCGCTTGGTC AAGGACATGAAGATCAAGTCCCTGGAGGAGATCTA TCTCTTCTCCCTGCCTATTAAGGAATCAGAGATCAT TGATTTCTTCCTGGGGGCCTCTCTCAAGGATGAGG TTTTGAAGATTATGCCAGTGCAGAAGCAGACCCGT GCCGGCCAGCGCACCAGGTTCAAGGCATTTGTTG CTATCGGGGACTACAATGGCCACGTCGGTCTGGG TGTTAAGTGCTCCAAGGAGGTGGCCACCGCCATC CGTGGGGCCATCATCCTGGCCAAGCTCTCCATCG TCCCCGTGCGCAGAGGCTACTGGGGGAACAAGAT CGGCAAGCCCCACACTGTCCCTTGCAAGGTGACA GGCCGCTGCGGTCTGTGCTGGTACGCCTCATCC CTGCACCCAGGGGCACTGGCATCGTCTCCGCACC TGTGCCTAAGAAGCTGCTCATGATGGCTGGTATCG ATGACTGCTACACCTCAGCCCGGGGCTGCACTGC CACCCTGGGCAACTTCGCCAAGGCCACCTTTGAT GCCATTCTAAGACCTACAGCTACCTGACCCCCGA CTCTGGAAGGAGACTGTATTCACCAAGTCTCCCTA TCAGGAGTTCACTGACCACCTCGTCAAGACCCACA CCAGAGTCTCCGTGCAGCGGACTCAGGCTCCAGC TGTGGCTACAACATAGGGTTTTTATACAAGAAAAAT AAAGTGAATTAAGCGTGAAAAAAAAAAAAAAAAAAA A | 46 | SGRRLYSP SLPIRSSLT TSSRPTPE SPCSGLRL QLWLQHR VFIQEK* |
| 1210 | NM_0029 66.2_769 | 769 | AAGTAATTCCTAGACCCGTAGGTGGCCGCAGAGC CGGTTACCTCTGGTTCTGCGCCAGCGTGCCCCAC CCGCAGGACGGCCGGGTTCTTTGATTTGTACACTT TCTAAAAACCAAACCCGAGAGGAAGGGCAGGCTCA | 1 | L* |

TABLE 3A-continued

| SEQ ID | identifier_position | position | modified_RNA | PAP length | PAP |
|---|---|---|---|---|---|
| | | | GGGTGGGGATGCCCTGAAATATTCGAGAGCAGGA<br>CCGTTTCTACTGAAGAGAAGTTTACAAGAACGCTC<br>TGTCTGGGGCGGGCGAGGCCTCTGCGAGGCGGG<br>TCCGGGAGCGAGGGCAGGGCGTGGGCCGCGCGC<br>CCGGGGTCGGGGGAGTCGGGGGCAGGAAGAGG<br>GGGAGGAGACAGGGCTGGGGGAGCGCCCTGCCG<br>AGCGCCCGCCAGGCTCCTCCCGCTCCCGCGCCG<br>CCTCCCTCTACCCACCCGCCGCACGTACTAAGGA<br>AGGCGCACAGCCCGCCGCGCTCGCCTCTCCGCC<br>CCGCGTCCAGCTCGCCCAGCTCGCCCAGCGTCCG<br>CCGCGCCTCGGCCAAGGCTTCAACGGACCACACC<br>AAAATGCCATCTCAAATGGAACACGCCATGGAAAC<br>CATGATGTTTACATTTCACAAATTCGCTGGGGATAA<br>AGGCTACTTAACAAAGGAGGACCTGAGAGTACTCA<br>TGGAAAAGGAGTTCCCTGGATTTTTGGAAAATCAA<br>AAAGACCCTCTGGCTGTGGACAAAATAATGAAGGA<br>CCTGGACCAGTGTAGAGATGGCAAAGTGGGCTTC<br>CAGAGCTTCTTTTCCCTAATTGCGGGCCTCACCAT<br>TGCATGCAATGACTATTTGTAGTACACATGAAGCA<br>GAAGGGAAAGAAGTAGGCAGAAATGAGCAGTTCG<br>CTCCTCCCTGATAAGAGTTGTCCCAAAGGGTCGCT<br>TAAGGAATCTGCCCCACAGCTTCCCCCATAGAAGG<br>ATTTCATGAGCAGATCAGGACACTTAGCAAATGTA<br>AAAATAAAATCTAACTCTCATTTGACAAGCAGAGAA<br>AGAAAAGTTAAATACCAGATAAGCTTTTGATTTTTG<br>TATTGTTTGCATCCCCTTGCCCTCAATA | | |
| 1211 | NM_0029<br>79.3_1426 | 1426 | ACGCGCCTGTGTTGCCGCCCGCGGCCCTGGCTTC<br>GGGCTTCAGGGAGCTCTGGTGCAGTCTCCGCCTG<br>TCAGTGCCGGCAGTCGTCCGCGGCGCCCGCCCC<br>GGTCCCGCACTGGTGCAGCCATGTCCTCTTCCCC<br>GTGGGAGCCTGCGACCCTGCGCCGGGTGTTCGTG<br>GTGGGGGTTGGCATGACCAAGTTTGTGAAGCCTG<br>GAGCTGAGAATTCAAGAGACTACCCTGACTTGGCA<br>GAAGAAGCAGGCAAGAAGGCTTTAGCTGATGCAC<br>AGATCCCTTATTCAGCAGTGGACCAGGCATGTGTT<br>GGCTATGTTTTTGGTGACTCTACCTGTGGGCAGAG<br>GGCTATCTATCACAGTTTGGGAATGACTGGAATTC<br>CTATAATCAATGTCAACAATAACTGTGCTACTGGTT<br>CTACTGCTTTGTTTATGGCCCGCCAGCTGATTCAG<br>GGTGGTGTGGCAGAATGTGTCTTGGCTCTTGGGTT<br>TGAGAAGATGAGTAAGGGAAGCCTTGGAATAAAAT<br>TTTCAGATAGAACCATTCCCACTGATAAGCATGTT<br>GACCTCCTGATCAATAAGTATGGATTGTCTGCTCA<br>CCCAGTTGCTCCTCAGATGTTTGGGTATGCTGGAA<br>AAGAACATATGGAAAAATATGGAACAAAAATTGAA<br>CACTTTGCAAAAATTGGATGGAAAAATCATAAACAT<br>TCAGTTAATAACCCGTATTCCCAGTTCCAAGATGA<br>ATACAGTTTAGATGAAGTGATGGCATCTAAAGAAG<br>TTTTTGATTTTTTGACTATCTTACAATGTTGTCCCAC<br>TTCAGATGGTGCTGCAGCAGCAATTTTGGCCAGTG<br>AAGCATTTGTACAGAAGTATGGCCTGCAATCCAAA<br>GCTGTGGAAATTTTGGCACAAGAAATGATGACTGA<br>TTTGCCAAGCTCGTTTGAAGAAAAAAGCATTATTAA<br>AATGGTTGGCTTTGATATGAGTAAAGAAGCTGCAA<br>GAAAATGCTATGAGAAATCTGGCCTGACACCAAAT<br>GATATTGACGTA | 16 | FLRRLRRN<br>LKRKGNSL* |
| 1212 | NM_0029<br>79.3_1441 | 1441 | ACGCGCCTGTGTTGCCGCCCGCGGCCCTGGCTTC<br>GGGCTTCAGGGAGCTCTGGTGCAGTCTCCGCCTG<br>TCAGTGCCGGCAGTCGTCCGCGGCGCCCGCCCC<br>GGTCCCGCACTGGTGCAGCCATGTCCTCTTCCCC<br>GTGGGAGCCTGCGACCCTGCGCCGGGTGTTCGTG<br>GTGGGGGTTGGCATGACCAAGTTTGTGAAGCCTG<br>GAGCTGAGAATTCAAGAGACTACCCTGACTTGGCA<br>GAAGAAGCAGGCAAGAAGGCTTTAGCTGATGCAC<br>AGATCCCTTATTCAGCAGTGGACCAGGCATGTGTT<br>GGCTATGTTTTTGGTGACTCTACCTGTGGGCAGAG<br>GGCTATCTATCACAGTTTGGGAATGACTGGAATTC<br>CTATAATCAATGTCAACAATAACTGTGCTACTGGTT<br>CTACTGCTTTGTTTATGGCCCGCCAGCTGATTCAG<br>GGTGGTGTGGCAGAATGTGTCTTGGCTCTTGGGTT<br>TGAGAAGATGAGTAAGGGAAGCCTTGGAATAAAAT<br>TTTCAGATAGAACCATTCCCACTGATAAGCATGTT<br>GACCTCCTGATCAATAAGTATGGATTGTCTGCTCA<br>CCCAGTTGCTCCTCAGATGTTTGGGTATGCTGGAA<br>AAGAACATATGGAAAAATATGGAACAAAAATTGAA<br>CACTTTGCAAAAATTGGATGGAAAAATCATAAACAT<br>TCAGTTAATAACCCGTATTCCCAGTTCCAAGATGA | 12 | MRRNLKR<br>KG NSL* |

TABLE 3A-continued

| SEQ ID | identifier_position | position | modified_RNA | PAP length | PAP |
|---|---|---|---|---|---|
| | | | ATACAGTTTAGATGAAGTGATGGCATCTAAAGAAG TTTTTGATTTTTTGACTATCTTACAATGTTGTCCCAC TTCAGATGGTGCTGCAGCAGCAATTTTGGCCAGTG AAGCATTTGTACAGAAGTATGGCCTGCAATCCAAA GCTGTGGAAATTTTGGCACAAGAAATGATGACTGA TTTGCCAAGCTCGTTTGAAGAAAAAAGCATTATTAA AATGGTTGGCTTTGATATGAGTAAAGAAGCTGCAA GAAAATGCTATGAGAAATCTGGCCTGACACCAAAT GATATTGACGTA | | |
| 1213 | NM_0029 79.3_1474 | 1474 | ACGCGCCTGTGTTGCCGCCCGCGGCCCTGGCTTC GGGCTTCAGGGAGCTCTGGTGCAGTCTCCGCCTG TCAGTGCCGGCAGTCGTCCGCGGCGCCCGCCCC GGTCCCGCACTGGTGCAGCCATGTCCTCTTCCCC GTGGGAGCCTGCGACCCTGCGCCGGGTGTTCGTG GTGGGGGTTGGCATGACCAAGTTTGTGAAGCCTG GAGCTGAGAATTCAAGAGACTACCCTGACTTGGCA GAAGAAGCAGGCAAGAAGGCTTTAGCTGATGCAC AGATCCCTTATTCAGCAGTGGACCAGGCATGTGTT GGCTATGTTTTTGGTGACTCTACCTGTGGGCAGAG GGCTATCTATCACAGTTTGGGAATGACTGGAATTC CTATAATCAATGTCAACAATAACTGTGCTACTGGTT CTACTGCTTTGTTTATGGCCCGCCAGCTGATTCAG GGTGGTGTGGCAGAATGTGTCTTGGCTCTTGGGTT TGAGAAGATGAGTAAGGGAAGCCTTGGAATAAAAT TTTCAGATAGAACCATTCCCACTGATAAGCATGTT GACCTCCTGATCAATAAGTATGGATTGTCTGCTCA CCCAGTTGCTCCTCAGATGTTTGGGTATGCTGGAA AAGAACATATGGAAAAATATGGAACAAAAATTGAA CACTTTGCAAAAATTGGATGGAAAAATCATAAACAT TCAGTTAATAACCCGTATTCCCAGTTCCAAGATGA ATACAGTTTAGATGAAGTGATGGCATCTAAAGAAG TTTTTGATTTTTTGACTATCTTACAATGTTGTCCCAC TTCAGATGGTGCTGCAGCAGCAATTTTGGCCAGTG AAGCATTTGTACAGAAGTATGGCCTGCAATCCAAA GCTGTGGAAATTTTGGCACAAGAAATGATGACTGA TTTGCCAAGCTCGTTTGAAGAAAAAAGCATTATTAA AATGGTTGGCTTTGATATGAGTAAAGAAGCTGCAA GAAAATGCTATGAGAAATCTGGCCTGACACCAAAT GATATTGACGTA | 1 | L* |
| 1214 | NM_0029 79.3_14.89 | 1498 | ACGCGCCTGTGTTGCCGCCCGCGGCCCTGGCTTC GGGCTTCAGGGAGCTCTGGTGCAGTCTCCGCCTG TCAGTGCCGGCAGTCGTCCGCGGCGCCCGCCCC GGTCCCGCACTGGTGCAGCCATGTCCTCTTCCCC GTGGGAGCCTGCGACCCTGCGCCGGGTGTTCGTG GTGGGGGTTGGCATGACCAAGTTTGTGAAGCCTG GAGCTGAGAATTCAAGAGACTACCCTGACTTGGCA GAAGAAGCAGGCAAGAAGGCTTTAGCTGATGCAC AGATCCCTTATTCAGCAGTGGACCAGGCATGTGTT GGCTATGTTTTTGGTGACTCTACCTGTGGGCAGAG GGCTATCTATCACAGTTTGGGAATGACTGGAATTC CTATAATCAATGTCAACAATAACTGTGCTACTGGTT CTACTGCTTTGTTTATGGCCCGCCAGCTGATTCAG GGTGGTGTGGCAGAATGTGTCTTGGCTCTTGGGTT TGAGAAGATGAGTAAGGGAAGCCTTGGAATAAAAT TTTCAGATAGAACCATTCCCACTGATAAGCATGTT GACCTCCTGATCAATAAGTATGGATTGTCTGCTCA CCCAGTTGCTCCTCAGATGTTTGGGTATGCTGGAA AAGAACATATGGAAAAATATGGAACAAAAATTGAA CACTTTGCAAAAATTGGATGGAAAAATCATAAACAT TCAGTTAATAACCCGTATTCCCAGTTCCAAGATGA ATACAGTTTAGATGAAGTGATGGCATCTAAAGAAG TTTTTGATTTTTTGACTATCTTACAATGTTGTCCCAC TTCAGATGGTGCTGCAGCAGCAATTTTGGCCAGTG AAGCATTTGTACAGAAGTATGGCCTGCAATCCAAA GCTGTGGAAATTTTGGCACAAGAAATGATGACTGA TTTGCCAAGCTCGTTTGAAGAAAAAAGCATTATTAA AATGGTTGGCTTTGATATGAGTAAAGAAGCTGCAA GAAAATGCTATGAGAAATCTGGCCTGACACCAAAT GATATTGACGTA | 4 | LPSR* |
| 1215 | NM_0029 79.3_1521 | 1521 | ACGCGCCTGTGTTGCCGCCCGCGGCCCTGGCTTC GGGCTTCAGGGAGCTCTGGTGCAGTCTCCGCCTG TCAGTGCCGGCAGTCGTCCGCGGCGCCCGCCCC GGTCCCGCACTGGTGCAGCCATGTCCTCTTCCCC GTGGGAGCCTGCGACCCTGCGCCGGGTGTTCGTG GTGGGGGTTGGCATGACCAAGTTTGTGAAGCCTG GAGCTGAGAATTCAAGAGACTACCCTGACTTGGCA GAAGAAGCAGGCAAGAAGGCTTTAGCTGATGCAC | 11 | LGVKRPPG WWM* |

TABLE 3A-continued

| SEQ ID | identifier_position | position | modified_RNA | PAP length | PAP |
|---|---|---|---|---|---|
| | | | AGATCCCTTATTCAGCAGTGGACCAGGCATGTGTT<br>GGCTATGTTTTGGTGACTCTACCTGTGGGCAGAG<br>GGCTATCTATCACAGTTTGGGAATGACTGGAATTC<br>CTATAATCAATGTCAACAATAACTGTGCTACTGGTT<br>CTACTGCTTTGTTTATGGCCCGCCAGCTGATTCAG<br>GGTGGTGTGGCAGAATGTGTCTTGGCTCTTGGGTT<br>TGAGAAGATGAGTAAGGGAAGCCTTGGAATAAAAT<br>TTTCAGATAGAACCATTCCCACTGATAAGCATGTT<br>GACCTCCTGATCAATAAGTATGGATTGTCTGCTCA<br>CCCAGTTGCTCCTCAGATGTTTGGGTATGCTGGAA<br>AAGAACATATGGAAAAATATGGAACAAAAATTGAA<br>CACTTTGCAAAAATTGGATGGAAAAATCATAAACAT<br>TCAGTTAATAACCCGTATTCCCAGTTCCAAGATGA<br>ATACAGTTTAGATGAAGTGATGGCATCTAAAGAAG<br>TTTTTGATTTTTTGACTATCTTACAATGTTGTCCCAC<br>TTCAGATGGTGCTGCAGCAGCAATTTTGGCCAGTG<br>AAGCATTTGTACAGAAGTATGGCCTGCAATCCAAA<br>GCTGTGGAAATTTTGGCACAAGAAATGATGACTGA<br>TTTGCCAAGCTCGTTTGAAGAAAAAAGCATTATTAA<br>AATGGTTGGCTTTGATATGAGTAAAGAAGCTGCAA<br>GAAAATGCTATGAGAAATCTGGCCTGACACCAAAT<br>GATATTGACGTA | | |
| 1216 | NM_002979.3_1672 | 1672 | ACGCGCCTGTGTTGCCGCCCGCGGCCCTGGCTTC<br>GGGCTTCAGGGAGCTCTGGTGCAGTCTCCGCCTG<br>TCAGTGCCGGCAGTCGTCCGCGGCGCCCGCCCC<br>GGTCCCGCACTGGTGCAGCCATGTCCTCTTCCCC<br>GTGGGAGCCTGCGACCCTGCGCCGGGTGTTCGTG<br>GTGGGGGTTGGCATGACCAAGTTTGTGAAGCCTG<br>GAGCTGAGAATTCAAGAGACTACCCTGACTTGGCA<br>GAAGAAGCAGGCAAGAAGGCTTTAGCTGATGCAC<br>AGATCCCTTATTCAGCAGTGGACCAGGCATGTGTT<br>GGCTATGTTTTGGTGACTCTACCTGTGGGCAGAG<br>GGCTATCTATCACAGTTTGGGAATGACTGGAATTC<br>CTATAATCAATGTCAACAATAACTGTGCTACTGGTT<br>CTACTGCTTTGTTTATGGCCCGCCAGCTGATTCAG<br>GGTGGTGTGGCAGAATGTGTCTTGGCTCTTGGGTT<br>TGAGAAGATGAGTAAGGGAAGCCTTGGAATAAAAT<br>TTTCAGATAGAACCATTCCCACTGATAAGCATGTT<br>GACCTCCTGATCAATAAGTATGGATTGTCTGCTCA<br>CCCAGTTGCTCCTCAGATGTTTGGGTATGCTGGAA<br>AAGAACATATGGAAAAATATGGAACAAAAATTGAA<br>CACTTTGCAAAAATTGGATGGAAAAATCATAAACAT<br>TCAGTTAATAACCCGTATTCCCAGTTCCAAGATGA<br>ATACAGTTTAGATGAAGTGATGGCATCTAAAGAAG<br>TTTTTGATTTTTTGACTATCTTACAATGTTGTCCCAC<br>TTCAGATGGTGCTGCAGCAGCAATTTTGGCCAGTG<br>AAGCATTTGTACAGAAGTATGGCCTGCAATCCAAA<br>GCTGTGGAAATTTTGGCACAAGAAATGATGACTGA<br>TTTGCCAAGCTCGTTTGAAGAAAAAAGCATTATTAA<br>AATGGTTGGCTTTGATATGAGTAAAGAAGCTGCAA<br>GAAAATGCTATGAGAAATCTGGCCTGACACCAAAT<br>GATATTGACGTA | 5 | SFKAN* |
| 1217 | NM_002979.3_1689 | 1689 | ACGCGCCTGTGTTGCCGCCCGCGGCCCTGGCTTC<br>GGGCTTCAGGGAGCTCTGGTGCAGTCTCCGCCTG<br>TCAGTGCCGGCAGTCGTCCGCGGCGCCCGCCCC<br>GGTCCCGCACTGGTGCAGCCATGTCCTCTTCCCC<br>GTGGGAGCCTGCGACCCTGCGCCGGGTGTTCGTG<br>GTGGGGGTTGGCATGACCAAGTTTGTGAAGCCTG<br>GAGCTGAGAATTCAAGAGACTACCCTGACTTGGCA<br>GAAGAAGCAGGCAAGAAGGCTTTAGCTGATGCAC<br>AGATCCCTTATTCAGCAGTGGACCAGGCATGTGTT<br>GGCTATGTTTTGGTGACTCTACCTGTGGGCAGAG<br>GGCTATCTATCACAGTTTGGGAATGACTGGAATTC<br>CTATAATCAATGTCAACAATAACTGTGCTACTGGTT<br>CTACTGCTTTGTTTATGGCCCGCCAGCTGATTCAG<br>GGTGGTGTGGCAGAATGTGTCTTGGCTCTTGGGTT<br>TGAGAAGATGAGTAAGGGAAGCCTTGGAATAAAAT<br>TTTCAGATAGAACCATTCCCACTGATAAGCATGTT<br>GACCTCCTGATCAATAAGTATGGATTGTCTGCTCA<br>CCCAGTTGCTCCTCAGATGTTTGGGTATGCTGGAA<br>AAGAACATATGGAAAAATATGGAACAAAAATTGAA<br>CACTTTGCAAAAATTGGATGGAAAAATCATAAACAT<br>TCAGTTAATAACCCGTATTCCCAGTTCCAAGATGA<br>ATACAGTTTAGATGAAGTGATGGCATCTAAAGAAG<br>TTTTTGATTTTTTGACTATCTTACAATGTTGTCCCAC<br>TTCAGATGGTGCTGCAGCAGCAATTTTGGCCAGTG<br>AAGCATTTGTACAGAAGTATGGCCTGCAATCCAAA | 0 | * |

TABLE 3A-continued

| SEQ ID | identifier_position | position | modified_RNA | PAP length | PAP |
|---|---|---|---|---|---|
| | | | GCTGTGGAAATTTTGGCACAAGAAATGATGACTGA TTTGCCAAGCTCGTTTGAAGAAAAAAGCATTATTAA AATGGTTGGCTTTGATATGAGTAAAGAAGCTGCAA GAAAATGCTATGAGAAATCTGGCCTGACACCAAAT GATATTGACGTA | | |
| 1218 | NM_0030 02.1_209 | 209 | CCAGGAACGAGATGGCGGTTCTCTGGAGGCTGAG TGCCGTTTGCGGTGCCCTAGGAGGCCGAGCTCTG TTGCTTCGAACTCCAGTGGTCAGACCTGCTCATAT CTCAGCATTTCTTCAGGACCGACCTATCCCAGAAT GGTGTGGAGTGCAGCACATACACTTGTCACCGAG CCACCATTCTGGCTCCAAGGCTGCATCTCTCCACT GACTAGCGAGAGGGTTGTCAGTGTTTTGCTCCTGG GTCTGCTTCCGGCTGCTTATTTGAATCCTTGCTCT GCGATGGACTATTCCCTGGCTGCAGCCCTCACTCT TCATGGTCACTGGGGCCTTGGACAAGTTGTTACTG ACTATGTTCATGGGGATGCCTTGCAGAAAGCTGCC AAGGCAGGGCTTTTGGCACTTTCAGCTTTAACCTT TGCTGGGCTTTGCTATTTCAACTATCACGATGTGG GCATCTGCAAAGCTGTTGCCATGCTGTGGAAGCTC TGACCTTTTTGACTTCATACTTTGAAGAATTGATGT ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | 0 | * |
| 1219 | NM_0030 02.1_235 | 235 | CCAGGAACGAGATGGCGGTTCTCTGGAGGCTGAG TGCCGTTTGCGGTGCCCTAGGAGGCCGAGCTCTG TTGCTTCGAACTCCAGTGGTCAGACCTGCTCATAT CTCAGCATTTCTTCAGGACCGACCTATCCCAGAAT GGTGTGGAGTGCAGCACATACACTTGTCACCGAG CCACCATTCTGGCTCCAAGGCTGCATCTCTCCACT GGACTAGCGAGAGGGTTGTCAGTGTTTGCTCCTG GGTCTGCTTCCGGCTGCTTATTTGAATCCTTGCTC TGCGATGGACTATTCCCTGGCTGCAGCCCTCACTC TTCATGGTCACTGGGGCCTTGGACAAGTTGTTACT GACTATGTTCATGGGGATGCCTTGCAGAAAGCTGC CAAGGCAGGGCTTTTGGCACTTTCAGCTTTAACCT TTGCTGGGCTTTGCTATTTCAACTATCACGATGTG GGCATCTGCAA*GCTGTTGCCATGCTGTGGAAGCT CTGACCTTTTTGACTTCATACTTTGAAGAATTGATG TATGCCTCTTTGCCTCTGCTTTGTCATGCCATTAAG CTCACAATAAGGAAGAAATAACAGATAAGTCCATT GGTGGACAGCCTTCTTCTCTTAATCACAAGATTATT TTCAGAATTTAATCTTTGAGGAAAAGGTTTGAGAG GAATTATATCTAAGTTGTGAGACTGAGTTCTATATT CTGGTGAGTTAATGGGGTTGCCTCCCAGCTTCTTA TAAGACTCACAGTATAACTAAACATGATATATCAGC TTTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | 10 | CSWVCFR LLI* |
| 1220 | NM_0030 02.1_328 | 328 | CCAGGAACGAGATGGCGGTTCTCTGGAGGCTGAG TGCCGTTTGCGGTGCCCTAGGAGGCCGAGCTCTG TTGCTTCGAACTCCAGTGGTCAGACCTGCTCATAT CTCAGCATTTCTTCAGGACCGACCTATCCCAGAAT GGTGTGGAGTGCAGCACATACACTTGTCACCGAG CCACCATTCTGGCTCCAAGGCTGCATCTCTCCACT GGACTAGCGAGAGGGTTGTCAGTGTTTTGCTCCTG GGTCTGCTTCCGGCTGCTTATTTGAATCCTTGCTC TGCGATGGACTATTCCCTGGCTGCAGCCCTCACTC TTCATGGTCACTGGGCCTTGGACAAGTTGTTACTG ACTATGTTCATGGGGATGCCTTGCAGAAAGCTGCC AAGGCAGGGCTTTTGGCACTTTCAGCTTTAACCTT | 28 | ALDKLLLT MFMGMPC RKLPRQGF WHFQL* |

TABLE 3A-continued

| SEQ ID | identifier_ position | position | modified_RNA | PAP length | PAP |
|---|---|---|---|---|---|
| | | | TGCTGGGCTTTGCTATTTCAACTATCACGATGTGG GCATCTGCAAAGCTGTTGCCATGCTGTGGAAGCTC TGACCTTTTTGACTTCATACTTTGAAGAATTGATGT ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | | |
| 1221 | NM_0030 02.1_341 | 341 | CCAGGAACGAGATGGCGGTTCTCTGGAGGCTGAG TGCCGTTTGCGGTGCCCTAGGAGGCCGAGCTCTG TTGCTTCGAACTCCAGTGGTCAGACCTGCTCATAT CTCAGCATTTCTTCAGGACCGACCTATCCCAGAAT GGTGTGGAGTGCAGCACATACACTTGTCACCGAG CCACCATTCTGGCTCCAAGGCTGCATCTCTCCACT GGACTAGCGAGAGGGTTGTCAGTGTTTTGCTCCTG GGTCTGCTTCCGGCTGCTTATTTGAATCCTTGCTC TGCGATGGACTATTCCCTGGCTGCAGCCCTCACTC TTCATGGTCACTGGGGCCTTGGACAAGTGTTACTG ACTATGTTCATGGGGATGCCTTGCAGAAAGCTGCC AAGGCAGGGCTTTTGGCACTTTCAGCTTTAACCTT TGCTGGGCTTTGCTATTTCAACTATCACGATGTGG GCATCTGCAAAGCTGTTGCCATGCTGTGGAAGCTC TGACCTTTTTGACTTCATACTTTGAAGAATTGATGT ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | 23 | LLTMFMG MPCRKLPR QGFWHFQ L* |
| 1222 | NM_0030 02.1_383 | 383 | CCAGGAACGAGATGGCGGTTCTCTGGAGGCTGAG TGCCGTTTGCGGTGCCCTAGGAGGCCGAGCTCTG TTGCTTCGAACTCCAGTGGTCAGACCTGCTCATAT CTCAGCATTTCTTCAGGACCGACCTATCCCAGAAT GGTGTGGAGTGCAGCACATACACTTGTCACCGAG CCACCATTCTGGCTCCAAGGCTGCATCTCTCCACT GGACTAGCGAGAGGGTTGTCAGTGTTTTGCTCCTG GGTCTGCTTCCGGCTGCTTATTTGAATCCTTGCTC TGCGATGGACTATTCCCTGGCTGCAGCCCTCACTC TTCATGGTCACTGGGGCCTTGGACAAGTTGTTACT GACTATGTTCATGGGGATGCCTTGCAGAAAGCTGC AAGGCAGGGCTTTTGGCACTTTCAGCTTTAACCTT TGCTGGGCTTTGCTATTTCAACTATCACGATGTGG GCATCTGCAAAGCTGTTGCCATGCTGTGGAAGCTC TGACCTTTTTGACTTCATACTTTGAAGAATTGATGT ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG | 9 | RQGFWHF QL* |

TABLE 3A-continued

| SEQ ID | identifier_position | position | modified_RNA | PAP length | PAP |
|---|---|---|---|---|---|
| | | | GGAAATTTTAAAATTAGGAAATGCTGATAGCTCATATT | | |
| 1223 | NM_003002.1_397 | 397 | CCAGGAACGAGATGGCGGTTCTCTGGAGGCTGAGTGCCGTTTGCGGTGCCCTAGGAGGCCGAGCTCTGTTGCTTCGAACTCCAGTGGTCAGACCTGCTCATATCTCAGCATTTCTTCAGGACCGACCTATCCCAGAATGGTGTGGAGTGCAGCACATACACTTGTCACCGAGCCACCATTCTGGCTCCAAGGCTGCATCTCTCCACTGGACTAGCGAGAGGGTTGTCAGTGTTTTGCTCCTGGGTCTGCTTCCGGCTGCTTATTTGAATCCTTGCTCTGCGATGGACTATTCCCTGGCTGCAGCCCTCACTCTTCATGGTCACTGGGGCCTTGGACAAGTTGTTACTGACTATGTTCATGGGGATGCCTTGCAGAAAGCTGCCAAGGCAGGGCTTTGGCACTTTCAGCTTTAACCTTTGCTGGGCTTTGCTATTTCAACTATCACGATGTGGGCATCTGCAAAGCTGTTGCCATGCTGTGGAAGCTCTGACCTTTTTGACTTCATACTTTGAAGAATTGATGTATGCCTCTTTGCCTCTGCTTTGTCATGCCATTAAGCTCACAATAAGGAAGAAATAACAGATAAGTCCATTGGTGGACAGCCTTCTTCTCTTAATCACAAGATTATTTTCAGAATTTAATCTTTGAGGAAAAGGTTTGAGAGGAATTATATCTAAGTTGTGAGACTGAGTTCTATATTCTGGTGAGTTAATGGGGTTGCCTCCCAGCTTCTTATAAGACTCACAGTATAACTAAACATGATATATCAGCTTTTGCCTTTCAATTTATCAATCTCTTAAAGAGAATCCAACTTTATTACGATTAGTATATGATCAAACTTCCATATTTGCCTTGGGAATAATGGACAAAGGGAAATACTCTTAATTCATGAATAAAAACTTTGCAGAAAATTAGACAGTGTTTAATTTTCGAAAACTTCCCTCTCTAGACAGTAGATACCACCTACTGATGGTTACATATACTAGGGAAATTTTAAAATTAGGAAATGCTGATAGCTCATATT | 5 | WHFQL* |
| 1224 | NM_003002.1_399 | 399 | CCAGGAACGAGATGGCGGTTCTCTGGAGGCTGAGTGCCGTTTGCGGTGCCCTAGGAGGCCGAGCTCTGTTGCTTCGAACTCCAGTGGTCAGACCTGCTCATATCTCAGCATTTCTTCAGGACCGACCTATCCCAGAATGGTGTGGAGTGCAGCACATACACTTGTCACCGAGCCACCATTCTGGCTCCAAGGCTGCATCTCTCCACTGGACTAGCGAGAGGGTTGTCAGTGTTTTGCTCCTGGGTCTGCTTCCGGCTGCTTATTTGAATCCTTGCTCTGCGATGGACTATTCCCTGGCTGCAGCCCTCACTCTTCATGGTCACTGGGGCCTTGGACAAGTTGTTACTGACTATGTTCATGGGGATGCCTTGCAGAAAGCTGCCAAGGCAGGGCTTTTGCACTTTCAGCTTTAACCTTTGCTGGGCTTTGCTATTTCAACTATCACGATGTGGGCATCTGCAAAGCTGTTGCCATGCTGTGGAAGCTCTGACCTTTTTGACTTCATACTTTGAAGAATTGATGTATGCCTCTTTGCCTCTGCTTTGTCATGCCATTAAGCTCACAATAAGGAAGAAATAACAGATAAGTCCATTGGTGGACAGCCTTCTTCTCTTAATCACAAGATTATTTTCAGAATTTAATCTTTGAGGAAAAGGTTTGAGAGGAATTATATCTAAGTTGTGAGACTGAGTTCTATATTCTGGTGAGTTAATGGGGTTGCCTCCCAGCTTCTTATAAGACTCACAGTATAACTAAACATGATATATCAGCTTTTGCCTTTCAATTTATCAATCTCTTAAAGAGAATCCAACTTTATTACGATTAGTATATGATCAAACTTCCATATTTGCCTTGGGAATAATGGACAAAGGGAAATACTCTTAATTCATGAATAAAAACTTTGCAGAAAATTAGACAGTGTTTAATTTTCGAAAACTTCCCTCTCTAGACAGTAGATACCACCTACTGATGGTTACATATACTAGGGAAATTTTAAAATTAGGAAATGCTGATAGCTCATATT | 4 | HFQL* |
| 1225 | NM_003002.1_429 | 429 | CCAGGAACGAGATGGCGGTTCTCTGGAGGCTGAGTGCCGTTTGCGGTGCCCTAGGAGGCCGAGCTCTGTTGCTTCGAACTCCAGTGGTCAGACCTGCTCATATCTCAGCATTTCTTCAGGACCGACCTATCCCAGAATGGTGTGGAGTGCAGCACATACACTTGTCACCGAGCCACCATTCTGGCTCCAAGGCTGCATCTCTCCACTGGACTAGCGAGAGGGTTGTCAGTGTTTTGCTCCTGGGTCTGCTTCCGGCTGCTTATTTGAATCCTTGCTCTGCGATGGACTATTCCCTGGCTGCAGCCCTCACTCTTCATGGTCACTGGGGCCTTGGACAAGTTGTTACTGACTATGTTCATGGGGATGCCTTGCAGAAAGCTGCCAAGGCAGGGCTTTTGCACTTTCAGCTTTAACCTTTGCTGGGCTTGCTATTTCAACTATCACGATGTGGGCATCTGCAAAGCTGTTGCCATGCTGTGGAAGCTCTGACCTTTTTGACTTCATACTTTGAAGAATTGATGT | 27 | AISTITMWASAKLLPCCGSSDLFDFIL* |

TABLE 3A-continued

| SEQ ID | identifier_position | position | modified_RNA | PAP length | PAP |
|---|---|---|---|---|---|
| | | | ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | | |
| 1226 | NM_0030 02.1_70 | 70 | CCAGGAACGAGATGGCGGTTCTCTGGAGGCTGAG TGCCGTTTGCGGTGCCCTAGGAGGCCGAGCTCTG TGCTTCGAACTCCAGTGGTCAGACCTGCTCATATC TCAGCATTTCTTCAGGACCGACCTATCCCAGAATG GTGTGGAGTGCAGCACATACACTTGTCACCGAGC CACCATTCTGGCTCCAAGGCTGCATCTCTCCACTG GACTAGCGAGAGGGTTGTCAGTGTTTTGCTCCTGG GTCTGCTTCCGGCTGCTTATTTGAATCCTTGCTCT GCGATGGACTATTCCCTGGCTGCAGCCCTCACTCT TCATGGTCACTGGGGCCTTGGACAAGTTGTTACTG ACTATGTTCATGGGGATGCCTTGCAGAAAGCTGCC AAGGCAGGGCTTTTGGCACTTTCAGCTTTAACCTT TGCTGGGCTTTGCTATTTCAACTATCACGATGTGG GCATCTGCAAAGCTGTTGCCATGCTGTGGAAGCTC TGACCTTTTTGACTTCATACTTTGAAGAATTGATGT ATGCCTCTTTGCCTCTGCTTTGTCATGCCATTAAGC TCACAATAAGGAAGAAATAACAGATAAGTCCATTG GTGGACAGCCTTCTTCTCTTAATCACAAGATTATTT TCAGAATTTAATCTTTGAGGAAAAGGTTTGAGAGG AATTATATCTAAGTTGTGAGACTGAGTTCTATATTC TGGTGAGTTAATGGGGTTGCCTCCCAGCTTCTTAT AAGACTCACAGTATAACTAAACATGATATATCAGCT TTTGCCTTTCAATTTATCAATCTCTTAAAGAGAATC CAACTTTATTACGATTAGTATATGATCAAACTTCCA TATTTGCCTTGGGAATAATGGACAAAGGGAAATAC TCTTAATTCATGAATAAAAACTTTGCAGAAAATTAG ACAGTGTTTAATTTTCGAAAACTTCCCTCTCTAGAC AGTAGATACCACCTACTGATGGTTACATATACTAG GGAAATTTTAAAATTAGGAAATGCTGATAGCTCATA TT | 65 | CFELQWS DLLISQHFF RTDLSQNG VECSTYTC HRATILAP RLHLSTGL ARGLSVFC SWVCFRLL I* |
| 1227 | NM_0030 17.3_118 | 118 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATGGACTGTAAGGTTTATGTAGGC AATCTTGGAAACAATGGCAACAAGACGGAATTGGA ACGGGCTTTTGGCTACTATGGACCACTCCGAAGTG TGTGGGTTGCTAGAAACCCACCCGGCTTTGCTTTT GTTGAATTTGAAGATCCCCGAGATGCAGCTGATGC AGTCCGAGAGCTAGATGGAAGAACACTATGTGGC TGCCGTGTAAGAGTGGAACTGTCGAATGGTGAAAA AAGAAGTAGAAATCGTGGCCCACCTCCCTCTTGG GGTCGTCGCCCTCGAGATGATTATCGTAGGAGGA GTCCTCCACCTCGTCGCAGATCTCCAAGAAGGAG AAGCTTCTCTCGCAGCCGGAGCAGGTCCCTTTCTA GAGATAGGAGAAGAGAGAGATCGCTGTCTCGGGA GAGAAATCACAAGCCGTCCCGATCCTTCTCTAGGT CTCGTAGTCGATCTAGGTCAAATGAAAGGAAATAG AAGACAGTTTGCAAGAGAAGTGGTGTACAGGAAAT TACTTCATTTGACAGGAGTATGTACAGAAAATTCAA GTTTTGTTTGAGACTTCATAAGCTTGGTGCATTTTT AAGATGTTTTAGCTGTTCAAATCTGTTTGTCTCTTG AAACAGTGACACAAAGGTGTAATTCTCTATGGTTT GAAATGGATCATACGAGGCATGTAATACCAAGAAT TGTTACTTTACAATGTTCCCTTAAGCAAAATTGAAT TTGCTTTGAACTTTTAGTTATGCACAGACTGATAAT AAACCTCTAAACCTGCCCAGCGGAAGTGTGTTTTT TTTAAAATTTAAATACAGAAACAACTGGCAAAAATG AACTAAGATTTACTTTTTTTTCCATAGCTGGGATAT AGGCTGCAGCTATAGTTGAACAAGCAGTCTTTAAA AACTGCTG | 6 | WTVRFM* |

TABLE 3A-continued

| SEQ ID | identifier_position | position | modified_RNA | PAP length | PAP |
|---|---|---|---|---|---|
| 1228 | NM_003017.3_172 | 172 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATTGGACTGTAAGGTTTATGTAGG CAATCTTGGAAACAATGGCAACAAGACGGAATGGA ACGGGCTTTTGGCTACTATGGACCACTCCGAAGTG TGTGGGTTGCTAGAAACCCACCCGGCTTTGCTTTT GTTGAATTTGAAGATCCCCGAGATGCAGCTGATGC AGTCCGAGAGCTAGATGGAAGAACACTATGTGGC TGCCGTGTAAGAGTGGAACTGTCGAATGGTGAAAA AAGAAGTAGAAATCGTGGCCCACCTCCCTCTTGG GGTCGTCGCCCTCGAGATGATTATCGTAGGAGGA GTCCTCCACCTCGTCGCAGATCTCCAAGAAGGAG AAGCTTCTCTCGCAGCCGGAGCAGGTCCCTTTCTA GAGATAGGAGAAGAGAGAGATCGCTGTCTCGGGA GAGAAATCACAAGCCGTCCCGATCCTTCTCTAGGT CTCGTAGTCGATCTAGGTCAAATGAAAGGAAATAG AAGACAGTTTGCAAGAGAAGTGGTGTACAGGAAAT TACTTCATTTGACAGGAGTATGTACAGAAAATTCAA GTTTTGTTTGAGACTTCATAAGCTTGGTGCATTTTT AAGATGTTTTAGCTGTTCAAATCTGTTTGTCTCTTG AAACAGTGACACAAAGGTGTAATTCTCTATGGTTT GAAATGGATCATACGAGGCATGTAATACCAAGAAT TGTTACTTTACAATGTTCCCTTAAGCAAAATTGAAT TTGCTTTGAACTTTTAGTTATGCACAGACTGATAAT AAACCTCTAAACCTGCCCAGCGGAAGTGTGTTTT TTTTAAATTTAAATACAGAAACAACTGGCAAAAATG AACTAAGATTTACTTTTTTTTCCATAGCTGGGATAT AGGCTGCAGCTATAGTTGAACAAGCAGTCTTTAAA AACTGCTG | 40 | WNGLLAT MDHSEVC GLLETHPA LLLLNLKIP EMQLMQS ES* |
| 1229 | NM_003017.3_185 | 185 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATTGGACTGTAAGGTTTATGTAGG CAATCTTGGAAACAATGGCAACAAGACGGAATTGG AACGGGCTTTGGCTACTATGGACCACTCCGAAGT GTGTGGGTTGCTAGAAACCCACCCGGCTTTGCTTT TGTTGAATTTGAAGATCCCCGAGATGCAGCTGATG CAGTCCGAGAGCTAGATGGAAGAACACTATGTGG CTGCCGTGTAAGAGTGGAACTGTCGAATGGTGAA AAAAGAAGTAGAAATCGTGGCCCACCTCCCTCTTG GGGTCGTCGCCCTCGAGATGATTATCGTAGGAGG AGTCCTCCACCTCGTCGCAGATCTCCAAGAAGGA GAAGCTTCTCTCGCAGCCGGAGCAGGTCCCTTTCT AGAGATAGGAGAAGAGAGAGATCGCTGTCTCGGG AGAGAAATCACAAGCCGTCCCGATCCTTCTCTAGG TCTCGTAGTCGATCTAGGTCAAATGAAAGGAAATA GAAGACAGTTTGCAAGAGAAGTGGTGTACAGGAA ATTACTTCATTTGACAGGAGTATGTACAGAAAATTC AAGTTTTGTTTGAGACTTCATAAGCTTGGTGCATTT TTAAGATGTTTTAGCTGTTCAAATCTGTTTGTCTCT TGAAACAGTGACACAAAGGTGTAATTCTCTATGGT TTGAAATGGATCATACGAGGCATGTAATACCAAGA ATTGTTACTTTACAATGTTCCCTTAAGCAAAATTGA ATTTGCTTTGAACTTTTAGTTATGCACAGACTGATA ATAAACCTCTAAACCTGCCCAGCGGAAGTGTGTTT TTTTTTAAATTTAAATACAGAAACAACTGGCAAAAA TGAACTAAGATTTACTTTTTTTTCCATAGCTGGGAT ATAGGCTGCAGCTATAGTTGAACAAGCAGTCTTTA AAAACTGCTG | 36 | LATMDHSE VCGLLETH PALLLLNLK IPEMQLMQ SES* |
| 1230 | NM_003017.3_218 | 218 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATTGGACTGTAAGGTTTATGTAGG CAATCTTGGAAACAATGGCAACAAGACGGAATTGG AACGGGCTTTTGGCTACTATGGACCACTCCGAAGT GTGTGGGTGCTAGAAACCCACCCGGCTTTGCTTTT GTTGAATTTGAAGATCCCCGAGATGCAGCTGATGC AGTCCGAGAGCTAGATGGAAGAACACTATGTGGC TGCCGTGTAAGAGTGGAACTGTCGAATGGTGAAAA AAGAAGTAGAAATCGTGGCCCACCTCCCTCTTGG GGTCGTCGCCCTCGAGATGATTATCGTAGGAGGA GTCCTCCACCTCGTCGCAGATCTCCAAGAAGGAG AAGCTTCTCTCGCAGCCGGAGCAGGTCCCTTTCTA GAGATAGGAGAAGAGAGAGATCGCTGTCTCGGGA GAGAAATCACAAGCCGTCCCGATCCTTCTCTAGGT CTCGTAGTCGATCTAGGTCAAATGAAAGGAAATAG | 24 | LETHPALLL LNLKIPEM QLMQSES* |

TABLE 3A-continued

| SEQ ID | identifier_position | position | modified_RNA | PAP length | PAP |
|---|---|---|---|---|---|
| | | | AAGACAGTTTGCAAGAGAAGTGGTGTACAGGAAAT<br>TACTTCATTTGACAGGAGTATGTACAGAAAATTCAA<br>GTTTTGTTTGAGACTTCATAAGCTTGGTGCATTTTT<br>AAGATGTTTTAGCTGTTCAAATCTGTTTGTCTCTTG<br>AAACAGTGACACAAAGGTGTAATTCTCTATGGTTT<br>GAAATGGATCATACGAGGCATGTAATACCAAGAAT<br>TGTTACTTTACAATGTTCCCTTAAGCAAAATTGAAT<br>TTGCTTTGAACTTTTAGTTATGCACAGACTGATAAT<br>AAACCTCTAAACCTGCCCAGCGGAAGTGTGTTTTT<br>TTTTAAATTTAAATACAGAAACAACTGGCAAAAATG<br>AACTAAGATTTACTTTTTTTTCCATAGCTGGGATAT<br>AGGCTGCAGCTATAGTTGAACAAGCAGTCTTTAAA<br>AACTGCTG | | |
| 1231 | NM_0030 17.3_245 | 245 | GAGAGAGTTGGTTGGTGTTGGGCCGGAGGAAAGC<br>GGGAAGACTCATCGGAGCGTGTGGATTTGAGCCG<br>CCGCATTTTTTAACCCTAGATCTCGAAATGCATCGT<br>GATTCCTGTCCATTGGACTGTAAGGTTTATGTAGG<br>CAATCTTGGAAACAATGGCAACAAGACGGAATTGG<br>AACGGGCTTTTGGCTACTATGGACCACTCCGAAGT<br>GTGTGGGTTGCTAGAAACCCACCCGGCTTTGCTTT<br>GTTGAATTTGAAGATCCCCGAGATGCAGCTGATGC<br>AGTCCGAGAGCTAGATGGAAGAACACTATGTGGC<br>TGCCGTGTAAGAGTGGAACTGTCGAATGGTGAAAA<br>AAGAAGTAGAAATCGTGGCCCACCTCCCTCTTGG<br>GGTCGTCGCCCTCGAGATGATTATCGTAGGAGGA<br>GTCCTCCACCTCGTCGCAGATCTCCAAGAAGGAG<br>AAGCTTCTCTCGCAGCCGGAGCAGGTCCCTTTCTA<br>GAGATAGGAGAAGAGAGAGATCGCTGTCTCGGGA<br>GAGAAATCACAAGCCGTCCCGATCCTTCTCTAGGT<br>CTCGTAGTCGATCTAGGTCAAATGAAAGGAAATAG<br>AAGACAGTTTGCAAGAGAAGTGGTGTACAGGAAAT<br>TACTTCATTTGACAGGAGTATGTACAGAAAATTCAA<br>GTTTTGTTTGAGACTTCATAAGCTTGGTGCATTTTT<br>AAGATGTTTTAGCTGTTCAAATCTGTTTGTCTCTTG<br>AAACAGTGACACAAAGGTGTAATTCTCTATGGTTT<br>GAAATGGATCATACGAGGCATGTAATACCAAGAAT<br>TGTTACTTTACAATGTTCCCTTAAGCAAAATTGAAT<br>TTGCTTTGAACTTTTAGTTATGCACAGACTGATAAT<br>AAACCTCTAAACCTGCCCAGCGGAAGTGTGTTTTT<br>TTTTAAATTTAAATACAGAAACAACTGGCAAAAATG<br>AACTAAGATTTACTTTTTTTTCCATAGCTGGGATAT<br>AGGCTGCAGCTATAGTTGAACAAGCAGTCTTTAAA<br>AACTGCTG | 16 | LLNLKIPEM QLMQSES* |
| 1232 | NM_0030 17.3_370 | 370 | GAGAGAGTTGGTTGGTGTTGGGCCGGAGGAAAGC<br>GGGAAGACTCATCGGAGCGTGTGGATTTGAGCCG<br>CCGCATTTTTTAACCCTAGATCTCGAAATGCATCGT<br>GATTCCTGTCCATTGGACTGTAAGGTTTATGTAGG<br>CAATCTTGGAAACAATGGCAACAAGACGGAATTGG<br>AACGGGCTTTTGGCTACTATGGACCACTCCGAAGT<br>GTGTGGGTTGCTAGAAACCCACCCGGCTTTGCTTT<br>TGTTGAATTTGAAGATCCCCGAGATGCAGCTGATG<br>CAGTCCGAGAGCTAGATGGAAGAACACTATGTGG<br>CTGCCGTGTAAGAGTGGAACTGTCGAATGGTGAA<br>AAAAGAAGTAGAAATCGTGGCCACCTCCCTCTTGG<br>GGTCGTCGCCCTCGAGATGATTATCGTAGGAGGA<br>GTCCTCCACCTCGTCGCAGATCTCCAAGAAGGAG<br>AAGCTTCTCTCGCAGCCGGAGCAGGTCCCTTTCTA<br>GAGATAGGAGAAGAGAGAGATCGCTGTCTCGGGA<br>GAGAAATCACAAGCCGTCCCGATCCTTCTCTAGGT<br>CTCGTAGTCGATCTAGGTCAAATGAAAGGAAATAG<br>AAGACAGTTTGCAAGAGAAGTGGTGTACAGGAAAT<br>TACTTCATTTGACAGGAGTATGTACAGAAAATTCAA<br>GTTTTGTTTGAGACTTCATAAGCTTGGTGCATTTTT<br>AAGATGTTTTAGCTGTTCAAATCTGTTTGTCTCTTG<br>AAACAGTGACACAAAGGTGTAATTCTCTATGGTTT<br>GAAATGGATCATACGAGGCATGTAATACCAAGAAT<br>TGTTACTTTACAATGTTCCCTTAAGCAAAATTGAAT<br>TTGCTTTGAACTTTTAGTTATGCACAGACTGATAAT<br>AAACCTCTAAACCTGCCCAGCGGAAGTGTGTTTTT<br>TTTTAAATTTAAATACAGAAACAACTGGCAAAAATG<br>AACTAAGATTTACTTTTTTTTCCATAGCTGGGATAT<br>AGGCTGCAGCTATAGTTGAACAAGCAGTCTTTAAA<br>AACTGCTG | 100 | HLPLGVVA LEMIIVGGV LHLVADLQ EGEASLAA GAGPFLEI GEERDRCL GREITSRP DPSLGLVV DLGQMKG NRRQFAR EVVYRKLL HLTGVCTE NSSFV* |
| 1233 | NM_0030 17.3_468 | 468 | GAGAGAGTTGGTTGGTGTTGGGCCGGAGGAAAGC<br>GGGAAGACTCATCGGAGCGTGTGGATTTGAGCCG<br>CCGCATTTTTTAACCCTAGATCTCGAAATGCATCGT<br>GATTCCTGTCCATTGGACTGTAAGGTTTATGTAGG | 67 | GAGPFLEI GEERDRCL GREITSRP DPSLGLVV |

TABLE 3A-continued

| SEQ ID | identifier_ position | position | modified_RNA | PAP length | PAP |
|---|---|---|---|---|---|
| | | | CAATCTTGGAAACAATGGCAACAAGACGGAATTGG AACGGGCTTTTGGCTACTATGGACCACTCCGAAGT GTGTGGGTTGCTAGAAACCCACCCGGCTTTGCTTT TGTTGAATTTGAAGATCCCCGAGATGCAGCTGATG CAGTCCGAGAGCTAGATGGAAGAACACTATGTGG CTGCCGTGTAAGAGTGGAACTGTCGAATGGTGAA AAAAGAAGTAGAAATCGTGGCCCACCTCCCTCTTG GGGTCGTCGCCCTCGAGATGATTATCGTAGGAGG AGTCCTCCACCTCGTCGCAGATCTCCAAGAAGGA GAAGCTTCTCTCGCAGCGGAGCAGGTCCCTTTCTA GAGATAGGAGAAGAGAGAGATCGCTGTCTCGGGA GAGAAATCACAAGCCGTCCCGATCCTTCTCTAGGT CTCGTAGTCGATCTAGGTCAAATGAAAGGAAATAG AAGACAGTTTGCAAGAGAAGTGGTGTACAGGAAAT TACTTCATTTGACAGGAGTATGTACAGAAAATTCAA GTTTTGTTTGAGACTTCATAAGCTTGGTGCATTTTT AAGATGTTTTAGCTGTTCAAATCTGTTTGTCTCTTG AAACAGTGACACAAAGGTGTAATTCTCTATGGTTT GAAATGGATCATACGAGGCATGTAATACCAAGAAT TGTTACTTTACAATGTTCCCTTAAGCAAAATTGAAT TTGCTTTGAACTTTTAGTTATGCACAGACTGATAAT AAACCTCTAAACCTGCCCAGCGGAAGTGTGTTTTT TTTTAAATTTAAATACAGAAACAACTGGCAAAAATG AACTAAGATTTACTTTTTTTTCCATAGCTGGGATAT AGGCTGCAGCTATAGTTGAACAAGCAGTCTTTAAA AACTGCTG | | DLGQMKG NRRQFAR EVVYRKLL HLTGVCTE NSSFV* |
| 1234 | NM_0030 17.3_510 | 510 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATTGGACTGTAAGGTTTATGTAGG CAATCTTGGAAACAATGGCAACAAGACGGAATTGG AACGGGCTTTTGGCTACTATGGACCACTCCGAAGT GTGTGGGTTGCTAGAAACCCACCCGGCTTTGCTTT TGTTGAATTTGAAGATCCCCGAGATGCAGCTGATG CAGTCCGAGAGCTAGATGGAAGAACACTATGTGG CTGCCGTGTAAGAGTGGAACTGTCGAATGGTGAA AAAAGAAGTAGAAATCGTGGCCCACCTCCCTCTTG GGGTCGTCGCCCTCGAGATGATTATCGTAGGAGG AGTCCTCCACCTCGTCGCAGATCTCCAAGAAGGA GAAGCTTCTCTCGCAGCGGAGCAGGTCCCTTTCT AGAGATAGGAGAAGAGAGAGATCGTGTCTCGGGA GAGAAATCACAAGCCGTCCCGATCCTTCTCTAGGT CTCGTAGTCGATCTAGGTCAAATGAAAGGAAATAG AAGACAGTTTGCAAGAGAAGTGGTGTACAGGAAAT TACTTCATTTGACAGGAGTATGTACAGAAAATTCAA GTTTTGTTTGAGACTTCATAAGCTTGGTGCATTTTT AAGATGTTTTAGCTGTTCAAATCTGTTTGTCTCTTG AAACAGTGACACAAAGGTGTAATTCTCTATGGTTT GAAATGGATCATACGAGGCATGTAATACCAAGAAT TGTTACTTTACAATGTTCCCTTAAGCAAAATTGAAT TTGCTTTGAACTTTTAGTTATGCACAGACTGATAAT AAACCTCTAAACCTGCCCAGCGGAAGTGTGTTTTT TTTTAAATTTAAATACAGAAACAACTGGCAAAAATG AACTAAGATTTACTTTTTTTTCCATAGCTGGGATAT AGGCTGCAGCTATAGTTGAACAAGCAGTCTTTAAA AACTGCTG | 53 | CLGREITS RPDPSLGL VVDLGQM KGNRRQF AREVVYRK LLHLTGVC TENSSFV* |
| 1235 | NM_0030 17.3_540 | 540 | GAGAGAGTTGGTTGGTGTTGGGCCGGAGGAAAGC GGGAAGACTCATCGGAGCGTGTGGATTTGAGCCG CCGCATTTTTTAACCCTAGATCTCGAAATGCATCGT GATTCCTGTCCATTGGACTGTAAGGTTTATGTAGG CAATCTTGGAAACAATGGCAACAAGACGGAATTGG AACGGGCTTTTGGCTACTATGGACCACTCCGAAGT GTGTGGGTTGCTAGAAACCCACCCGGCTTTGCTTT TGTTGAATTTGAAGATCCCCGAGATGCAGCTGATG CAGTCCGAGAGCTAGATGGAAGAACACTATGTGG CTGCCGTGTAAGAGTGGAACTGTCGAATGGTGAA AAAAGAAGTAGAAATCGTGGCCCACCTCCCTCTTG GGGTCGTCGCCCTCGAGATGATTATCGTAGGAGG AGTCCTCCACCTCGTCGCAGATCTCCAAGAAGGA GAAGCTTCTCTCGCAGCCGGAGCAGGTCCCTTTCT AGAGATAGGAGAAGAGAGAGATCGCTGTCTCGGG AGAGAAATCACAAGCCGTCCCGATCCTTCTCTAGGT CTCGTAGTCGATCTAGGTCAAATGAAAGGAAATAG AAGACAGTTTGCAAGAGAAGTGGTGTACAGGAAAT TACTTCATTTGACAGGAGTATGTACAGAAAATTCAA GTTTTGTTTGAGACTTCATAAGCTTGGTGCATTTTT AAGATGTTTTAGCTGTTCAAATCTGTTTGTCTCTTG | 43 | DPSLGLVV DLGQMKG NRRQFAR EVVYRKLL HLTGVCTE NSSFV* |

TABLE 3A-continued

| SEQ ID | identifier_ position | position | modified_RNA | PAP length | PAP |
|---|---|---|---|---|---|
| | | | AAACAGTGACACAAAGGTGTAATTCTCTATGGTTT GAAATGGATCATACGAGGCATGTAATACCAAGAAT TGTTACTTTACAATGTTCCCTTAAGCAAAATTGAAT TTGCTTTGAACTTTTAGTTATGCACAGACTGATAAT AAACCTCTAAACCTGCCCAGCGGAAGTGTGTTTTT TTTTAAATTTAAATACAGAAACAACTGGCAAAAATG AACTAAGATTTACTTTTTTTTCCATAGCTGGGATAT AGGCTGCAGCTATAGTTGAACAAGCAGTCTTTAAA AACTGCTG | | |
| 1236 | NM_0030 88.2_947 | 947 | GCTGCGGAGGGTGCGTGCGGGCCGCGGCAGCCG AACAAAGGAGCAGGGGCGCCGCCGCAGGGACCC GCCACCCACCTCCCGGGGCCGCGCAGCGGCCTC TCGTCTACTGCCACCATGACCGCCAACGGCACAG CCGAGGCGGTGCAGATCCAGTTCGGCCTCATCAA CTGCGGCAACAAGTACCTGACGGCCGAGGCGTTC GGGTTCAAGGTGAACGCGTCCGCCAGCAGCCTGA AGAAGAAGCAGATCTGGACGCTGGAGCAGCCCCC TGACGAGGCGGGCAGCGCGGCCGTGTGCCTGCG CAGCCACCTGGGCCGCTACCTGGCGGCGGACAA GGACGGCAACGTGACCTGCGAGCGCGAGGTGCC CGGTCCCGACTGCCGTTTCCTCATCGTGGCGCAC GACGACGGTCGCTGGTCGCTGCAGTCCGAGGCG CACCGGCGCTACTTCGGCGGCACCGAGGACCGC CTGTCCTGCTTCGCGCAGACGGTGTCCCCCGCCG AGAAGTGGAGCGTGCACATCGCCATGCACCCTCA GGTCAACATCTACAGCGTCACCCGTAAGCGCTAC GCGCACCTGAGCGCGCGGCCGGCCGACGAGATC GCCGTGGACCGCGACGTGCCCTGGGGCGTCGAC TCGCTCATCACCCTCGCCTTCCAGGACCAGCGCTA CAGCGTGCAGACCGCCGACCACCGCTTCCTGCGC CACGACGGGCGCCTGGTGGCGCGCCCCGAGCCG GCCACTGGCTACACGCTGGAGTTCCGCTCCGGCA AGGTGGCCTTCCGCGACTGCGAGGGCCGTTACCT GGCGCCGTCGGGGCCCAGCGGCACGCTCAAGGC GGGCAAGGCCACCAAGGTGGGCAAGGACGAGCT CTTTGCTCTGGAGCAGAGCTGCGCCCAGGTCGTG CTGCAGGCGGCCAACGAGAGGAACGTGTCCACGC GCCAGGTATGGACCTGTCTGCCAATCAGGACGAG GAGACCGACCAGGAGACCTTCCAGCTGGAGATCG ACCGCGACACCAAAAA | 39 | VWTCLPIR TRRPTRRP SSWRSTAT PKSVPSVP TRASTGR* |
| 1237 | NM_0030 91.3_696 | 696 | AACTCCAGGGCTAGTGAGCTGGACCGGAAGTAGG TTTCTACCCGACCGCATTTTACGTGGTGCTGCATT TCCGGTAGCGGCGGCGGGAAATCGGCTGTGGGA GAGAGGCTAGGCCTCTGAGGAGGCGAATCCGGC GGGTATCAGAGCCATCAGAACCGCCACCATGACG GTGGGCAAGAGCAGCAAGATGCTGCAGCATATTG ATTACAGGATGAGGTGCATCCTGCAGGACGGCCG GATCTTCATTGGCACCTTCAAGGCTTTTGACAAGC ACATGAATTTGATCCTCTGTGACTGTGATGAGTTCA GAAAGATCAAGCCAAAGAACTCCAAACAAGCAGAA AGGGAAGAGAAGCGAGTCCTCGGTCTGGTGCTGC TGCGAGGGGAGAATCTGGTCTCAATGACAGTAGA GGGACCTCCTCCCAAAGATACTGGTATTGCTCGAG TTCCACTTGCTGGAGCTGCCGGGGGCCCAGGGAT CGGCAGGGCTGCTGGCAGAGGAATCCCAGCTGG GGTTCCCATGCCCCAGGCTCCTGCAGGACTTGCT GGGCCAGTCCGTGGGGTTGGCGGGCCATCCCAA CAGGTGATGACCCCACAAGGAAGAGGTACTGTTG CAGCCGCTGCAGCTGCTGCCACAGCCAGTATTGC CGGGGCTCCAACCCAGTACCCACCTGGCCGTGGG GGTCCTCCCCCACTATGGGCCGAGGAGCACCCCC TCCAGGCATGATGGGCCCACCTCCTGGTATGAGA CCTCCTATGGGTCCCCCAATGGGGATCCCCCCTG GAAGAGGGACTCCAATGGGCATGCCCCCTCCGGG AATGCGGCCTCCTCCCCCTGGGATGCGAGGCCTT CTTTGACCCTTGGCCACAGAGTATGGAAGTAGCTC CGCAGAGGCGTGGGCTCGATTCCTCAGGGCCACG TTACCACAGACCTGTTTGTTTCTTATGCTGTTGTTC GTGGAGTCTCATGGGATTGTCTGGTTTCCCTTACA GGGCCCCCTCCCCGGGAATGCGCCCACCAAG | 10 | LWAEEHPL QA* |
| 1238 | NM_0030 91.3_768 | 768 | AACTCCAGGGCTAGTGAGCTGGACCGGAAGTAGG TTTCTACCCGACCGCATTTTACGTGGTGCTGCATT TCCGGTAGCGGCGGCGGGAAATCGGCTGTGGGA GAGAGGCTAGGCCTCTGAGGAGGCGAATCCGGC GGGTATCAGAGCCATCAGAACCGCCACCATGACG GTGGGCAAGAGCAGCAAGATGCTGCAGCATATTG ATTACAGGATGAGGTGCATCCTGCAGGACGGCCG | 114 | QWGSPLE EGLQWAC PLRECGLL PLGCEAFF DPWPQSM EVAPQRR GLDSSGPR |

TABLE 3A-continued

| SEQ ID | identifier_position | position | modified_RNA | PAP length | PAP |
|---|---|---|---|---|---|
| | | | GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACCTATGGGCCGAGGAGCACCCC<br>CTCCAGGCATGATGGGCCCACCTCCTGGTATGAG<br>ACCTCCTATGGGTCCCCAATGGGGATCCCCCTG<br>GAAGAGGGACTCCAATGGGCATGCCCCCTCCGGG<br>AATGCGGCCTCCTCCCCCTGGGATGCGAGGCCTT<br>CTTTGACCCTTGGCCACAGAGTATGGAAGTAGCTC<br>CGCAGAGGCGTGGGCTCGATTCCTCAGGGCCACG<br>TTACCACAGACCTGTTTGTTTCTTATGCTGTTGTTC<br>GTGGAGTCTCATGGGATTGTCTGGTTTCCCTTACA<br>GGGCCCCCTCCCCCGGGAATGCGCCCACCAAG | | YHRPVCFL<br>CCCSWSL<br>MGLSGFPY<br>RAPSPGNA<br>PTKALDSS<br>WPSSAPCL<br>FPVRLYIVL<br>LSPCGL* |
| 1239 | NM_003091.3_783 | 783 | AACTCCAGGGCTAGTGAGCTGGACCGGAAGTAGG<br>TTTCTACCCGACCGCATTTTACGTGGTGCTGCATT<br>TCCGGTAGCGCCGCGGGAAATCGGCTGTGGGA<br>GAGAGGCTAGGCCTCTGAGGAGGCGAATCCGGC<br>GGGTATCAGAGCCATCAGAACCGCCACCATGACG<br>GTGGGCAAGAGCAGCAAGATGCTGCAGCATATTG<br>ATTACAGGATGAGGTGCATCCTGCAGGACGGCCG<br>GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACCTATGGGCCGAGGAGCACCCC<br>CTCCAGGCATGATGGGCCCACCTCCTGGTATGAG<br>ACCTCCTATGGGTCCCCAATGGGGATCCCCCTG<br>GAAGAGGGACTCCAATGGGCATGCCCCCTCCGGG<br>AATGCGGCCTCCTCCCCCTGGGATGCGAGGCCTT<br>CTTTGACCCTTGGCCACAGAGTATGGAAGTAGCTC<br>CGCAGAGGCGTGGGCTCGATTCCTCAGGGCCACG<br>TTACCACAGACCTGTTTGTTTCTTATGCTGTTGTTC<br>GTGGAGTCTCATGGGATTGTCTGGTTTCCCTTACA<br>GGGCCCCCTCCCCCGGGAATGCGCCCACCAAG | 109 | LEEGLQW<br>ACPLRECG<br>LLPLGCEA<br>FFDPWPQ<br>SMEVAPQ<br>RRGLDSS<br>GPRYHRP<br>VCFLCCCS<br>WSLMGLS<br>GFPYRAPS<br>PGNAPTKA<br>LDSSWPSS<br>APCLFPVR<br>LYIVLLSPC<br>GL* |
| 1240 | NM_003118.2_664 | 664 | GTTGCCTGTCTCTAAACCCCTCCACATTCCCGCGG<br>TCCTTCAGACTGCCCGGAGAGCGCGCTCTGCCTG<br>CCGCCTGCCTGCCTGCCACTGAGGGTTCCCAGCA<br>CCATGAGGGCCTGGATCTTCTTTCTCCTTTGCCTG<br>GCCGGGAGGGCCTTGGCAGCCCCTCAGCAAGAA<br>GCCCTGCCTGATGAGACAGAGGTGGTGGAAGAAA<br>CTGTGGCAGAGGTGACTGAGGTATCTGTGGGAGC<br>TAATCCTGTCCAGGTGGAAGTAGGAGAATTTGATG<br>ATGGTGCAGAGGAAACCGAAGAGGAGGTGGTGGC<br>GGAAAATCCCTGCCAGAACCACCACTGCAAACAC<br>GGCAAGGTGTGCGAGCTGGATGAGAACAACACCC<br>CCATGTGCGTGTGCCAGGACCCCACCAGCTGCCC<br>AGCCCCCATTGGCGAGTTTGAGAAGGTGTGCAGC<br>AATGACAACAAGACCTTCGACTCTTCCTGCCACTT<br>CTTTGCCACAAAGTGCACCCTGGAGGGCACCAAG<br>AAGGGCCACAAGCTCCACCTGGACTACATCGGGC<br>CTTGCAAATACATCCCCCCTTGCCTGGACTCTGAG<br>CTGACCGAATTCCCCCTGCGCATGCGGGACTGGC<br>TCAAGAACGTCCTGGTCACCCTGTATGAGAGGGAT<br>GAGGACAACAACTTCTGACTGAGAAGCAGAAGCT<br>GCGGGTGAAGAAGATCCATGAGAATGAGAAGCGC<br>CTGGAGGCAGGAGACCACCCCGTGGAGCTGCTG<br>GCCCGGGACTTCGAGAAGAACTATAACATGTACAT<br>CTTCCCTGTACACTGGCAGTTCGGCCAGCTGGAC | 1 | F* |

TABLE 3A-continued

| SEQ ID | identifier_ position | position | modified_RNA | PAP length | PAP |
|---|---|---|---|---|---|
| | | | CAGCACCCCATTGACGGGTACCTCTCCCACACCG AGCTGGCTCCACTGCGTGCTCCCCTCATCCCCAT GGAGCATTGCACCACCCGCTTTTTCGAGACCTGTG ACCTGGACAATGACAAGTACATCGCCCTGGATGA GTGGGCCGGCTGCTTCGGCATCAAGCAGAAGGAT ATCGACAAGGATCTTGTGATCTAAATCCACTC | | |
| 1241 | NM_0031 33.4_154 | 154 | GCCATCTTGGGGCTGCTGGGACTCGCGTCGGTTG GCGACTCCCGGACGTAGGTAGTTTGTTGGGCCGG GTTCTGAGGCCTTGCTTCTCTTTACTTTTCCACTCT AGGCCACGATGCCGCAGTACCAGACCTGGGAGGA GTTCAGCCGCGCTGCCGAGAAGCTTTACCTCGCTG ACCCTATGAAGGCACGTGTGGTTCTCAAATATAGG CATTCTGATGGGAACTTGTGTGTTAAAGTAACAGA TGATTTAGTTTGTTTGGTGTATAAAACAGACCAAGC TCAAGATGTAAAGAAGATTGAGAAATTCCACAGTC AACTAATGCGACTTATGGTAGCCAAGGAAGCCCG CAATGTTACCATGGAAACTGAGTGAATGGTTTGAA ATGAAGACTTTGTCGTGTACTTAGGAAGTAAATATC TTTTGAATTAGAGAAAGTGTTGGGACAGAAAGTAC TTTATGTAACTAAGTGGGCTGTTCAGAAGCTTAGA GGTCATTTTTTGTAATTTTCTTTTTAATTACTTTAGA GAGCTAGGGATGCAAATGTTTTCAGTTAGAAAGCC TTTATTTACTTTTGGAAATTGAACAAGAAATGCATC TGTCTTAGAAACTGGAGATTATTTGATGTTAGGTAA AACATGTAATTGTTTCTCTGGCAAATTTGTATCAGT AATTTGAAAATGAGATATTAGGAAAAACCAATTCTT CTTAAATTTAGTTCATCTTTCTTTAAAAGAACATTAA ATGTAACCATTTTGTCAGATCCATGTATTTTGGAGC ATAAAATGTATGCTGTTGTGACCAATAAATATAAAA TATGGTAATTGGAATTAACTCCACACCATAGTATGC ATTGTTATACATACTGTGTACCTAATTATGTATAGC AGTGTAGTCTCAATTATATCTGAAAGTAATTGTGAC TAACAAGTATGCTTTGCCTTATTTCCACATTTAAAC TACCTGTTAATATAAGGGATTTGTAGTATCAGCTTG TTGAGCAATGACTTTGAATCTAGTTTTCAGT | 8 | RSFTSLTL* |
| 1242 | NM_0031 33.4_254 | 254 | GCCATCTTGGGGCTGCTGGGACTCGCGTCGGTTG GCGACTCCCGGACGTAGGTAGTTTGTTGGGCCGG GTTCTGAGGCCTTGCTTCTCTTTACTTTTCCACTCT AGGCCACGATGCCGCAGTACCAGACCTGGGAGGA GTTCAGCCGCGCTGCCGAGAAGCTTTACCTCGCT GACCCTATGAAGGCACGTGTGGTTCTCAAATATAG GCATTCTGATGGGAACTTGTGTGTTAAAGTAACAG ATGATTTAGTTGTTTGGTGTATAAAACAGACCAAGC TCAAGATGTAAAGAAGATTGAGAAATTCCACAGTC AACTAATGCGACTTATGGTAGCCAAGGAAGCCCG CAATGTTACCATGGAAACTGAGTGAATGGTTTGAA ATGAAGACTTTGTCGTGTACTTAGGAAGTAAATATC TTTTGAATTAGAGAAAGTGTTGGGACAGAAAGTAC TTTATGTAACTAAGTGGGCTGTTCAGAAGCTTAGA GGTCATTTTTTGTAATTTTCTTTTTAATTACTTTAGA GAGCTAGGGATGCAAATGTTTTCAGTTAGAAAGCC TTTATTTACTTTTGGAAATTGAACAAGAAATGCATC TGTCTTAGAAACTGGAGATTATTTGATGTTAGGTAA AACATGTAATTGTTTCTCTGGCAAATTTGTATCAGT AATTTGAAAATGAGATATTAGGAAAAACCAATTCTT CTTAAATTTAGTTCATCTTTCTTTAAAAGAACATTAA ATGTAACCATTTTGTCAGATCCATGTATTTTGGAGC ATAAAATGTATGCTGTTGTGACCAATAAATATAAAA TATGGTAATTGGAATTAACTCCACACCATAGTATGC ATTGTTATACATACTGTGTACCTAATTATGTATAGC AGTGTAGTCTCAATTATATCTGAAAGTAATTGTGAC TAACAAGTATGCTTTGCCTTATTTCCACATTTAAAC TACCTGTTAATATAAGGGATTTGTAGTATCAGCTTG TTGAGCAATGACTTTGAATCTAGTTTTCAGT | 11 | VWCIKQTK LKM* |
| 1243 | NM_0031 33.4_258 | 258 | GCCATCTTGGGGCTGCTGGGACTCGCGTCGGTTG GCGACTCCCGGACGTAGGTAGTTTGTTGGGCCGG GTTCTGAGGCCTTGCTTCTCTTTACTTTTCCACTCT AGGCCACGATGCCGCAGTACCAGACCTGGGAGGA GTTCAGCCGCGCTGCCGAGAAGCTTTACCTCGCT GACCCTATGAAGGCACGTGTGGTTCTCAAATATAG GCATTCTGATGGGAACTTGTGTGTTAAAGTAACAG ATGATTTAGTTTGTTTGGTGTATAAAACAGACCAAGC TCAAGATGTAAAGAAGATTGAGAAATTCCACAGTC AACTAATGCGACTTATGGTAGCCAAGGAAGCCCG CAATGTTACCATGGAAACTGAGTGAATGGTTTGAA ATGAAGACTTTGTCGTGTACTTAGGAAGTAAATATC TTTTGAATTAGAGAAAGTGTTGGGACAGAAAGTAC | 10 | WCIKQTKL KM* |

TABLE 3A-continued

| SEQ ID | identifier_position | position | modified_RNA | length PAP | PAP |
|---|---|---|---|---|---|
| | | | TTTATGTAACTAAGTGGGCTGTTCAGAAGCTTAGA GGTCATTTTTTGTAATTTTCTTTTTAATTACTTTAGA GAGCTAGGGATGCAAATGTTTTCAGTTAGAAAGCC TTTATTTACTTTTGGAAATTGAACAAGAAATGCATC TGTCTTAGAAACTGGAGATTATTTGATGTTAGGTAA AACATGTAATTGTTTCTCTGGCAAATTTGTATCAGT AATTTGAAAATGAGATATTAGGAAAAACCAATTCTT CTTAAATTTAGTTCATCTTTCTTTAAAAGAACATTAA ATGTAACCATTTTGTCAGATCCATGTATTTTGGAGC ATAAAATGTATGCTGTTGTGACCAATAAATATAAAA TATGGTAATTGGAATTAACTCCACACCATAGTATGC ATTGTTATACATACTGTGTACCTAATTATGTATAGC AGTGTAGTCTCAATTATATCTGAAAGTAATTGTGAC TAACAAGTATGCTTTGCCTTATTTCCACATTTAAAC TACCTGTTAATATAAGGGATTTGTAGTATCAGCTTG TTGAGCAATGACTTTGAATCTAGTTTTCAGT | | |
| 1244 | NM_0031 33.4_298 | 298 | GCCATCTTGGGGCTGCTGGGACTCGCGTCGGTTG GCGACTCCCGGACGTAGGTAGTTTGTTGGGCGG GTTCTGAGGCCTTGCTTCTCTTTACTTTTCCACTCT AGGCCACGATGCCGCAGTACCAGACCTGGGAGGA GTTCAGCCGCGCTGCCGAGAAGCTTTACCTCGCT GACCCTATGAAGGCACGTGTGGTTCTCAAATATAG GCATTCTGATGGGAACTTGTGTGTTAAAGTAACAG ATGATTTAGTTTGTTTGGTGTATAAAACAGACCAAG CTCAAGATGTAAAGAAGATGAGAAATTCCACAGTC AACTAATGCGACTTATGGTAGCCAAGGAAGCCCG CAATGTTACCATGGAAACTGAGTGAATGGTTTGAA ATGAAGACTTTGTCGTGTACTTAGGAAGTAAATATC TTTTGAATTAGAGAAAGTGTTGGGACAGAAAGTAC TTTATGTAACTAAGTGGGCTGTTCAGAAGCTTAGA GGTCATTTTTTGTAATTTTCTTTTTAATTACTTTAGA GAGCTAGGGATGCAAATGTTTTCAGTTAGAAAGCC TTTATTTACTTTTGGAAATTGAACAAGAAATGCATC TGTCTTAGAAACTGGAGATTATTTGATGTTAGGTAA AACATGTAATTGTTTCTCTGGCAAATTTGTATCAGT AATTTGAAAATGAGATATTAGGAAAAACCAATTCTT CTTAAATTTAGTTCATCTTTCTTTAAAAGAACATTAA ATGTAACCATTTTGTCAGATCCATGTATTTTGGAGC ATAAAATGTATGCTGTTGTGACCAATAAATATAAAA TATGGTAATTGGAATTAACTCCACACCATAGTATGC ATTGTTATACATACTGTGTACCTAATTATGTATAGC AGTGTAGTCTCAATTATATCTGAAAGTAATTGTGAC TAACAAGTATGCTTTGCCTTATTTCCACATTTAAAC TACCTGTTAATATAAGGGATTTGTAGTATCAGCTTG TTGAGCAATGACTTTGAATCTAGTTTTCAGT | 7 | MRNSTVN* |
| 1245 | NM_0031 42.3_182 | 182 | GGAGCGCTTTAGGCTGGCCGGCGGCGCTGGGAG GTGGAGTCGTTGCTGTTGCTGTTTGTGAGCCTGTG GCGCGGCTTCTGTGGGCCGGAACCTTAAAGATAG CCGCAATGGCTGAAAATGGTGATAATGAAAAGATG GCTGCCCTGGAGGCCAAAATCTGTCATCAAATTGA GTATTATTTGGCGACTTCAATTTGCCACGGGACAA GTTTCTAAAGGAACAGATAAAACTGGATGAAGGCT GGGTACCTTTGGAGATAATGATAAAATTCAACAGG TTGAACCGTCTAACAACAGACTTTAATGTAATTGTG GAAGCATTGAGCAAATCCAAGGCAGAACTCATGGA AATCAGTGAAGATAAAACTAAAATCAGAAGGTCTC CAAGCAAACCCCTACCTGAAGTGACTGATGAGTAT AAAAATGATGTAAAAAACAGATCTGTTTATATTAAA GGCTTCCCAACTGATGCAACTCTTGATGACATAAA AGAATGGTTAGAAGATAAAGGTCAAGTACTAAATA TTCAGATGAGAAGAACATTGCATAAAGCATTTAAG GGATCAATTTTTGTTGTGTTTGATAGCATTGAATCT GCTAAGAAATTTGTAGAGACCCCTGGCCAGAAGTA CAAAGAAACAGACCTGCTAATACTTTTCAAGGACG ATTACTTTGCCAAAAAAAATGAAGAAAGAAAACAAA ATAAAGTGGAAGCTAAATTAAGAGCTAAACAGGAG CAAGAAGCAAAACAAAAGTTAGAAGAAGATGCTGA AATGAAATCTCTAGAAGAAAAGATTGGATGCTTGC TGAAATTTTCGGGTGATTTAGATGATCAGACCTGTA GAGAAGATTTACACATACTTTTCTCAAATCATGGTG AAATAAAATGGATAGACTTCGTCAGAGGAGCAAAA GAGGGGATAATTCTATTTAAGAAAAAGCCAAGGA AGCATTGGGTAAAGCCAAAGATGCAAATAATGGTA ACCTACAATTAAGGAACAAAGAAGTGACTTGGGAA GTACTA | 11 | LATSICHG TSF* |

TABLE 3A-continued

| SEQ ID | identifier_position | position | modified_RNA | PAP length | PAP |
|---|---|---|---|---|---|
| 1246 | NM_003143.1_117 | 117 | CCTGCGTGGCTGGGCTGCTCGGGTTAGATCGTCA GGAAAAGCCTAAAGATTAGACTGTAAGAAAAGAAA ATAGAAGCCATGTTTCGAAGACCTGTATTACAGGT ACTTCGTCAGTTGTAAGACATGAGTCCGAAACAAC TACCAGTTTGGTTCTTGAAAGATCCCTGAATCGTG TGCACTTACTTGGGCGAGTGGGTCAGGACCCTGT CTTGAGACAGGTGGAAGGAAAAAATCCAGTCACAA TATTTTCTCTAGCAACTAATGAGATGTGGCGATCA GGGGATAGTGAAGTTTACCAACTGGGTGATGTCA GTCAAAAGACAACATGGCACAGAATATCAGTATTC CGGCCAGGCCTCAGAGACGTGGCATATCAATATG TGAAAAAGGGGTCTCGAATTTATTTGGAAGGGAAA ATAGACTATGGTGAATACATGGATAAAAATAATGTG AGGCGACAAGCAACAACAATCATAGCTGATAATAT TATATTTCTGAGTGACCAGACGAAAGAGAAGGAGT AGAAAGGATGATTCTTCTTTGGCCATCATTTGGTAC AGTCTCATTTCCAAGTCATGTATAATCTTTATGGCT TCCAAGGACAAGAATTAAAATACTCTTTTACGT | 1 | L* |
| 1247 | NM_003143.1_149 | 149 | CCTGCGTGGCTGGGCTGCTCGGGTTAGATCGTCA GGAAAAGCCTAAAGATTAGACTGTAAGAAAAGAAA ATAGAAGCCATGTTTCGAAGACCTGTATTACAGGT ACTTCGTCAGTTTGTAAGACATGAGTCCGAAACAA CTACCAGTTGGTTCTTGAAAGATCCCTGAATCGTG TGCACTTACTTGGGCGAGTGGGTCAGGACCCTGT CTTGAGACAGGTGGAAGGAAAAAATCCAGTCACAA TATTTTCTCTAGCAACTAATGAGATGTGGCGATCA GGGGATAGTGAAGTTTACCAACTGGGTGATGTCA GTCAAAAGACAACATGGCACAGAATATCAGTATTC CGGCCAGGCCTCAGAGACGTGGCATATCAATATG TGAAAAAGGGGTCTCGAATTTATTTGGAAGGGAAA ATAGACTATGGTGAATACATGGATAAAAATAATGTG AGGCGACAAGCAACAACAATCATAGCTGATAATAT TATATTTCTGAGTGACCAGACGAAAGAGAAGGAGT AGAAAGGATGATTCTTCTTTGGCCATCATTTGGTAC AGTCTCATTTCCAAGTCATGTATAATCTTTATGGCT TCCAAGGACAAGAATTAAAATACTCTTTTACGT | 6 | WFLKDP* |
| 1248 | NM_003143.1_446 | 446 | CCTGCGTGGCTGGGCTGCTCGGGTTAGATCGTCA GGAAAAGCCTAAAGATTAGACTGTAAGAAAAGAAA ATAGAAGCCATGTTTCGAAGACCTGTATTACAGGT ACTTCGTCAGTTTGTAAGACATGAGTCCGAAACAA CTACCAGTTTGGTTCTTGAAAGATCCCTGAATCGT GTGCACTTACTTGGGCGAGTGGGTCAGGACCCTG TCTTGAGACAGGTGGAAGGAAAAAATCCAGTCACA ATATTTTCTCTAGCAACTAATGAGATGTGGCGATCA GGGGATAGTGAAGTTTACCAACTGGGTGATGTCA GTCAAAAGACAACATGGCACAGAATATCAGTATTC CGGCCAGGCCTCAGAGACGTGGCATATCAATATG TGAAAAAGGGGTCTCGAATTTATTTGGAAGGGAAA ATAGACTATGGTGAATACATGGATAAAATAATGTGA GGCGACAAGCAACAACAATCATAGCTGATAATATT ATATTTCTGAGTGACCAGACGAAAGAGAAGGAGTA GAAAGGATGATTCTTCTTTGGCCATCATTTGGTACA GTCTCATTTCCAAGTCATGTATAATCTTTATGGCTT CCAAGGACAAGAATTAAAATACTCTTTTACGT | 2 | IM* |
| 1249 | NM_003145.3_151 | 151 | AGTGCTTATTTCCGGTCTTTCGGATGCTGACGCTC TCTTCCTGTCTTTGTGGCTCCGGAAAGGCGTTTGG GATGCCAACGATGAGGCTGCTGTCATTTGTGGTGT TGGCTCTATTTGCTGTCACTCAAGCAGAGGAAGGA GCCAGGCTTTGGCTTCCAAATCACTGCTGAACAGA TACGCCGTGGAGGGACGAGACCTGACCTTGCAGT ACAACATCTACAATGTTGGCTCAAGTGCTGCATTA GACGTGGAACTATCTGATGATTCCTTCCCTCCAGA AGACTTTGGCATTGTGTCTGGAATGCTCAATGTCA AATGGGACCGGATTGCCCCTGCTAGCAATGTCTCC CACACTGTGGTCCTGCGCCCTCTCAAGGCTGGTTA TTTCAACTTCACCTCGGCAACAATTACTTACCTGGC CCAGGAGGATGGGCCCGTTGTGATTGGCTCTACC AGTGCACCTGGACAGGGAGGAATCCTGGCTCAGC GGGAGTTTGACAGGCGATTCTCCCCTCATTTTCTG GACTGGGCAGCCTTTGGGGTCATGACCCTTCCCT CCATCGGCATCCCCTGCTATTGTGGTACTCCAGC AAGAGGAAATATGACACTCCCAAAAACGAAGAAGA CTGATTGGGGCTTCCACAGCCCTCCTCTCCCAAGA AATCCAGGCTCCTCTCCCAAGAAATCCAGGTGCTT TCCAGACTCCAAAGGGTATCTTAAATGCAATCTCTT CTCTCTTAGCCCTTGGCCACTTTCTCCTGGATCCT GCCCTGCTCTCAGCCATAGTGAAGGACCAGCCCT | 6 | WLPNHC* |

| SEQ ID | identifier_position | position | modified_RNA | PAP length | PAP |
|---|---|---|---|---|---|
| | | | AGGAGTCTGCGAGAGCCTCCTTGGTTCCATCGTG AAGCCATAAACAGGAATGCCTTTGGCAATAGCCTT GAGCCTAGAGGGCCCTCTGATGCCCCACTGAGGT GCTGTTGGTTTATTGCTGGCAACGTGAATTCTCTC AGGGGTCTAGGAGGGGCATTTTGGAGACTGCCTG ACACCACCCCTATCCCCTGCCTCCCCCTCTCAGAA GAGGGTGGAAGATGA | | |
| 1250 | NM_0031 45.3_531 | 531 | AGTGCTTATTTCCGGTCTTTCGGATGCTGACGCTC TCTTCCTGTCTTTGTGGCTCCGGAAAGGCGTTTGG GATGCCAACGATGAGGCTGCTGTCATTTGTGGTGT TGGCTCTATTTGCTGTCACTCAAGCAGAGGAAGGA GCCAGGCTTTTGGCTTCCAAATCACTGCTGAACAG ATACGCCGTGGAGGGACGAGACCTGACCTTGCAG TACAACATCTACAATGTTGGCTCAAGTGCTGCATT AGACGTGGAACTATCTGATGATTCCTTCCCTCCAG AAGACTTTGGCATTGTGTCTGGAATGCTCAATGTC AAATGGGACCGGATTGCCCCTGCTAGCAATGTCTC CCACACTGTGGTCCTGCGCCCTCTCAAGGCTGGT TATTTCAACTTCACCTCGGCAACAATTACTTACCTG GCCCAGGAGGATGGGCCCGTTGTGATTGGCTCTA CCAGTGCACCTGGACAGGGAGGAATCCTGGCTCA GCGGGAGTTTGACAGGCGATTCTCCCCTCATTTTC TGGACTGGCAGCCTTTGGGGTCATGACCCTTCCCT CCATCGGCATCCCCCTGCTATTGTGGTACTCCAGC AAGAGGAAATATGACACTCCCAAAACGAAGAAGAA CTGATTGGGGCTTCCACAGCCCTCCTCTCCCAAGA AATCCAGGCTCCTCTCCCAAGAAATCCAGGTGCTT TCCAGACTCCAAAGGGTATCTTAAATGCAATCTCTT CTCTCTTAGCCCTTGGCCACTTTCTCCTGGATCCT GCCCTGCTCTCAGCCATAGTGAAGGACCAGCCCT AGGAGTCTGCGAGAGCCTCCTTGGTTCCATCGTG AAGCCATAAACAGGAATGCCTTTGGCAATAGCCTT GAGCCTAGAGGGCCCTCTGATGCCCCACTGAGGT GCTGTTGGTTTATTGCTGGCAACGTGAATTCTCTC AGGGGTCTAGGAGGGGCATTTTGGAGACTGCCTG ACACCACCCCTATCCCCTGCCTCCCCCTCTCAGAA GAGGGTGGAAGATGA | 5 | QPLGS* |
| 1251 | NM_0031 92.2_352 | 352 | CGCGTTGGTGGGAGGCCTCACGGACAGCGCGCC CGGAGGAAGGAAGACAAGAGAGAGGAAGCTTGAA GCCAATATGGAGTCCGTCAGTTGCTCCGCTGCTG CTGTCAGGACCGGAGACATGGAGTCCCAGCGGGA CCTGAGCCTGGTGCCTGAGCGGCTTCAGAGACGC GAACAAGAACGGCAGCTGGAAGTTGAAAGGCGGA AACAAAAGCGGCAGAACCAGGAGGTAGAGAAGGA GAACAGCCACTTTTTCGTCGCCACCTTTGCTCGGG AGCGAGCGGCCGTGGAAGAGCTTCTGGAGCGCG CGGAGTCGGTCGAGCGGCTGGAGGAGGCGGCCT CTCGGCTCCAGGGCTGCAGAAACTAATCAACGAC TCAGTTTTTTTCCTAGCCGCTTACGACCTGCGGCA GGGACAAGAGGCGCTGGCGCGGCTGCAGGCGGC CTTGGCCGAGCGGCGCCGGGGGCTGCAGCCCAA GAAGCGTTTCGCTTTCAAGACCCGGGGAAAGGAT GCTGCTTCGTCTACCAAAGTAGACGCGGCTCCTG GCATCCCCCCGGCAGTTGAAAGCATACAGGACTC CCCGCTGCCCAAGAAGGCGGAAGGAGACCTCGG CCCCAGCTGGGTCTGCGGTTTCTCCAACCTGGAG TCCCAAGTCTTGGAGAAGAGAGCCAGCGAGTTGC ACCAGCGCGACGTTCTTTTGACCGAACTGAGCAAC TGCACGGTCAGACTGTATGGAAATCCCAACACCCT GCGGCTAACCAAGGCCCACAGCTGCAAGCTGCTC TGCGGTCCGGTGTCTACCTCTGTTTTCCTGGAGGA CTGCAGTGACTGCGTGCTGGCAGTGGCCTGCCAA CAGCTCCGCATACACAGTACGAAAGACACCCGCA TCTTCCTGCAGGTGACCAGCAGGGCCATCGTGGA GGACTGCAGTGGGATCCAGTTCGCCCCTTACACC TGGAGCTACCCGGAGATCGACAAGGACTTCGAGA GCTCTGGTTTAGATAGGAGCAAAAATAACTGGAAC GATG | 3 | CRN* |
| 1252 | NM_0031 92.2_613 | 613 | CGCGTTGGTGGGAGGCCTCACGGACAGCGCGCC CGGAGGAAGGAAGACAAGAGAGAGGAAGCTTGAA GCCAATATGGAGTCCGTCAGTTGCTCCGCTGCTG CTGTCAGGACCGGAGACATGGAGTCCCAGCGGGA CCTGAGCCTGGTGCCTGAGCGGCTTCAGAGACGC GAACAAGAACGGCAGCTGGAAGTTGAAAGGCGGA AACAAAAGCGGCAGAACCAGGAGGTAGAGAAGGA GAACAGCCACTTTTTCGTCGCCACCTTTGCTCGGG AGCGAGCGGCCGTGGAAGAGCTTCTGGAGCGCG | 27 | AGSAVSPT WSPKSWR REPASCTS ATFF* |

TABLE 3A-continued

| SEQ ID | identifier_position | position | modified_RNA | PAP length | PAP |
|---|---|---|---|---|---|
| | | | CGGAGTCGGTCGAGCGGCTGGAGGAGGCGGCCT CTCGGCTCCAGGGGCTGCAGAAACTAATCAACGA CTCAGTTTTTTTCCTAGCCGCTTACGACCTGCGGC AGGGACAAGAGGCGCTGGCGCGGCTGCAGGCGG CCTTGGCCGAGCGGCGCCGGGGGCTGCAGCCCA AGAAGCGTTTCGCTTTCAAGACCCGGGGAAAGGA TGCTGCTTCGTCTACCAAAGTAGACGCGGCTCCTG GCATCCCCCGGCAGTTGAAAGCATACAGGACTC CCCGCTGCCCAAGAAGGCGGAAGGAGACCTCGG CCCAGCTGGGTCTGCGGTTTCTCCAACCTGGAGT CCCAAGTCTTGGAGAAGAGAGCCAGCGAGTTGCA CCAGCGCGACGTTCTTTTGACCGAACTGAGCAACT GCACGGTCAGACTGTATGGAAATCCCAACACCCT GCGGCTAACCAAGGCCCACAGCTGCAAGCTGCTC TGCGGTCCGGTGTCTACCTCTGTTTTCCTGGAGGA CTGCAGTGACTGCGTGCTGGCAGTGGCCTGCCAA CAGCTCCGCATACACAGTACGAAAGACACCCGCA TCTTCCTGCAGGTGACCAGCAGGGCCATCGTGGA GGACTGCAGTGGGATCCAGTTCGCCCCTTACACC TGGAGCTACCCGGAGATCGACAAGGACTTCGAGA GCTCTGGTTTAGATAGGAGCAAAAATAACTGGAAC GATG | | |
| 1253 | NM_003217.2_448 | 448 | GAGAGGCGAACGCCGGGTAAAAGATCGGGAGCG GAAGTGGGCGAGTCAGAGCACATCCGGTGTTAGA AGCGCTGGTAGGCCTTGGAGAGGCGGGTTAGGAA GAGTGGAGACTGCTGCACGGACTCTGGAACCATG AACATATTTGATCGAAAGATCAACTTTGATGCGCTT TTAAAATTTTCTCATATAACCCCGTCAACGCAGCAG CACCTGAAGAAGGTCTATGCAAGTTTTGCCCTTTG TATGTTTGTGGCGGCTGCAGGGGCCTATGTCCATA TGGTCACTCATTTCATTCAGGCTGGCCTGCTGTCT GCCTTGGGCTCCCTGATATTGATGATTTGGCTGAT GGCAACACCTCATAGCCATGAAACTGAACAGAAAA GACTGGGACTTCTTGCTGGATTTGCATTCCTTACA GGAGTTGGCCTGGGCCCTGCCCTGGAGTTTGTAT TGCTGTCAACCCCAGCATCCTTCCCACTGCTTTCA TGGGCACGGCAATGATCTTTACCTGCTTCACCCTC AGTGCACTCTATGCCAGGCGCCGTAGCTACCTCTT TCTGGGAGGTATCTTGATGTCAGCCCTGAGCTTGT TGCTTTTGTCTTCCCTGGGGAATGTTTTCTTTGGAT CCATTTGGCTTTTCCAGGCAAACCTGTATGTGGGA CTGGTGGTCATGTGTGGCTTCGTCCTTTTTGATAC TCAACTCATTATTGAAAAGGCCGAACATGGAGATC AAGATTATATCTGGCACTGCATTGATCTCTTCTTAG ATTTCATTACTGTCTTCAGAAAACTCATGATGATCC TGGCCATGAATGAAAAGGATAAGAAGAAAGAGAAG AAATGAAGTGACCATCCAGCCTTTCCCAATTAGAC TTCCTCTCCTTCCACCCCTCATTTCCTTTTTGCACA CATTACAGGTGGTGTGTTCTGTGATAATGAAAAGC ATCAGAAAAGCTTTTGTACTTTGTGGTTTCCTCTAT TTTGAATTTTTTGATCAAAAAACTGATTAGCAGAAT ATAGTTT | 17 | VLLSTPAS FPLLSWAR Q* |
| 1254 | NM_003217.2_599 | 599 | GAGAGGCGAACGCCGGGTAAAAGATCGGGAGCG GAAGTGGGCGAGTCAGAGCACATCCGGTGTTAGA AGCGCTGGTAGGCCTTGGAGAGGCGGGTTAGGAA GAGTGGAGACTGCTGCACGGACTCTGGAACCATG AACATATTTGATCGAAAGATCAACTTTGATGCGCTT TTAAAATTTTCTCATATAACCCCGTCAACGCAGCAG CACCTGAAGAAGGTCTATGCAAGTTTTGCCCTTTG TATGTTTGTGGCGGCTGCAGGGGCCTATGTCCATA TGGTCACTCATTTCATTCAGGCTGGCCTGCTGTCT GCCTTGGGCTCCCTGATATTGATGATTTGGCTGAT GGCAACACCTCATAGCCATGAAACTGAACAGAAAA GACTGGGACTTCTTGCTGGATTTGCATTCCTTACA GGAGTTGGCCTGGGCCCTGCCCTGGAGTTTTGTA TTGCTGTCAACCCCAGCATCCTTCCCACTGCTTTC ATGGGCACGGCAATGATCTTTACCTGCTTCACCCT CAGTGCACTCTATGCCAGGCGCCGTAGCTACCTCT TTCTGGGAGGTATCTTGATGTCAGCCCTGAGCTTG TTGCTTTGTCTTCCCTGGGGAATGTTTTCTTTGGAT CCATTTGGCTTTTCCAGGCAAACCTGTATGTGGGA CTGGTGGTCATGTGTGGCTTCGTCCTTTTTGATAC TCAACTCATTATTGAAAAGGCCGAACATGGAGATC AAGATTATATCTGGCACTGCATTGATCTCTTCTTAG ATTTCATTACTGTCTTCAGAAAACTCATGATGATCC TGGCCATGAATGAAAAGGATAAGAAGAAAGAGAAG AAATGAAGTGACCATCCAGCCTTTCCCAATTAGAC | 56 | CLPWGMF SLDPFGFS RQTCMWD WWSCVAS SFLILNSLL KRPNMEIKI ISGTALISS* |

TABLE 3A-continued

| SEQ ID | identifier_ position | position | modified_RNA | PAP length | PAP |
|---|---|---|---|---|---|
| | | | TTCCTCTCCTTCCACCCCTCATTTCCTTTTTGCACA CATTACAGGTGGTGTGTTCTGTGATAATGAAAAGC ATCAGAAAAGCTTTTGTACTTTGTGGTTTCCTCTAT TTTGAATTTTTTGATCAAAAAAACTGATTAGCAGAAT ATAGTTT | | |
| 1255 | NM_0032 54.2_777 | 777 | TTTCGTCGGCCCGCCCCTTGGCTTCTGCACTGATG GTGGGTGGATGAGTAATGCATCCAGGAAGCCTGG AGGCCTGTGGTTTCCGCACCCGCTGCCACCCCCG CCCCTAGCGTGGACATTTATCCTCTAGCGCTCAGG CCCTGCCGCCATCGCCGCAGATCCAGCGCCCAGA GAGACACCAGAGAACCCACCATGGCCCCCTTTGA GCCCCTGGCTTCTGGCATCCTGTTGTTGCTGTGGC TGATAGCCCCCAGCAGGGCCTGCACCTGTGTCCC ACCCCACCCACAGACGGCCTTCTGCAATTCCGAC CTCGTCATCAGGGCCAAGTTCGTGGGGACACCAG AAGTCAACCAGACCACCTTATACCAGCGTTATGAG ATCAAGATGACCAAGATGTATAAAGGGTTCCAAGC CTTAGGGGATGCCGCTGACATCCGGTTCGTCTACA CCCCCGCCATGGAGAGTGTCTGCGGATACTTCCA CAGGTCCCACAACCGCAGCGAGGAGTTTCTCATT GCTGGAAAACTGCAGGATGGACTCTTGCACATCAC TACCTGCAGTTTTGTGGCTCCCTGGAACAGCCTGA GCTTAGCTCAGCGCCGGGGCTTCACCAAGACCTA CACTGTTGGCTGTGAGGAATGCACAGTGTTTCCCT GTTTATCCATCCCCTGCAAACTGCAGAGTGGCACT CATTGCTTGTGGACGGACCAGCTCCTCCAAGGCT CTGAAAAGGGCTTCCAGTCCCGTCACCTTGCCTGC CTGCCTCGGGAGCCAGGCTGTGCACCTGGCAGTC CCTGCGGTCCCAGATAGCCTGAATCCTGCCCGGA GTGGAAGCTGAAGCCTGCACAGTGTCCACCCTGT TCCCACTCCCATCTTTCTTCCGGACAATGAAATAAA GAGTTACCACCCAGCAGAAAAAAAAAAAAAAAAA | 10 | CAPGSPC GPR* |
| 1256 | NM_0032 95.2_309 | 309 | CCCCCCGAGCGCCGCTCCGGCTGCACCGCGCTC GCTCCGAGTTTCAGGCTCGTGCTAAGCTAGCGCC GTCGTCGTCTCCCTTCAGTCGCCATCATGATTATC TACCGGGACCTCATCAGCCACGATGAGATGTTCTC CGACATCTACAAGATCCGGGAGATCGCGGACGGG TTGTGCCTGGAGGTGGAGGGGAAGATGGTCAGTA GGACAGAAGGTAACATTGATGACTCGCTCATTGGT GGAAATGCCTCCGCTGAAGGCCCCGAGGGCGAA GGTACCGAAAGCACAGTAATCACTGGTGTCGATAT GTCATGAACCATCACCTGCAGGAAACAAGTTTCAC AAAAGAAGCCTACAAGAAGTACATCAAAGATTACA TGAAATCAATCAAAGGGAAACTTGAAGAACAGAGA CCAGAAAGAGTAAAACCTTTTATGACAGGGGCTGC AGAACAAATCAAGCACATCCTTGCTAATTTCAAAAA CTACCAGTTCTTTATTGGTGAAAACATGAATCCAGA TGGCATGGTTGCTCTATTGGACTACCGTGAGGATG GTGTGACCCCATATATGATTTTCTTTAAGGATGGTT TAGAAATGGAAAAATGTTAACAAATGTGGCAATTAT TTTGGATCTATCACCTGTCATCATAACTGGCTTCTG CTTGTCATCCACACAACACCAGGACTTAAGACAAA TGGGACTGATGTCATCTTGAGCTCTTCATTTATTTT GACTGTGATTTATTTGGAGTGGAGGCATTGTTTTTA AGAAAAAACATGTCATGTAGGTTGTCTAAAAAATAAAA TGCATTTAAACTCATTTGAGAG | 2 | MS* |
| 1257 | NM_0032 95.2_429 | 429 | CCCCCCGAGCGCCGCTCCGGCTGCACCGCGCTC GCTCCGAGTTTCAGGCTCGTGCTAAGCTAGCGCC GTCGTCGTCTCCCTTCAGTCGCCATCATGATTATC TACCGGGACCTCATCAGCCACGATGAGATGTTCTC CGACATCTACAAGATCCGGGAGATCGCGGACGGG TTGTGCCTGGAGGTGGAGGGGAAGATGGTCAGTA GGACAGAAGGTAACATTGATGACTCGCTCATTGGT GGAAATGCCTCCGCTGAAGGCCCCGAGGGCGAA GGTACCGAAAGCACAGTAATCACTGGTGTCGATAT TGTCATGAACCATCACCTGCAGGAAACAAGTTTCA CAAAAGAAGCCTACAAGAAGTACATCAAAGATTAC ATGAAATCAATCAAAGGGAAACTTGAAGAACAGAG ACCAGAAAGAGTAAACCTTTTATGACAGGGGCTGC AGAACAAATCAAGCACATCCTTGCTAATTTCAAAAA CTACCAGTTCTTTATTGGTGAAAACATGAATCCAGA TGGCATGGTTGCTCTATTGGACTACCGTGAGGATG GTGTGACCCCATATATGATTTTCTTTAAGGATGGTT TAGAAATGGAAAAATGTTAACAAATGTGGCAATTAT TTTGGATCTATCACCTGTCATCATAACTGGCTTCTG CTTGTCATCCACACAACACCAGGACTTAAGACAAA TGGGACTGATGTCATCTTGAGCTCTTCATTTATTTT | 3 | NLL* |

TABLE 3A-continued

| SEQ ID | identifier_position | position | modified_RNA | PAP length | PAP |
|---|---|---|---|---|---|
| | | | GACTGTGATTTATTTGGAGTGGAGGCATTGTTTTTA AGAAAAACATGTCATGTAGGTTGTCTAAAAATAAAA TGCATTTAAACTCATTTGAGAG | | |
| 1258 | NM_0032 95.2_501 | 501 | CCCCCCGAGCGCCGCTCCGGCTGCACCGCGCTC GCTCCGAGTTTCAGGCTCGTGCTAAGCTAGCGCC GTCGTCGTCTCCCTTCAGTCGCCATCATGATTATC TACCGGGACCTCATCAGCCACGATGAGATGTTCTC CGACATCTACAAGATCCGGGAGATCGCGGACGGG TTGTGCCTGGAGGTGGAGGGGAAGATGGTCAGTA GGACAGAAGGTAACATTGATGACTCGCTCATTGGT GGAAATGCCTCCGCTGAAGGCCCCGAGGGCGAA GGTACCGAAAGCACAGTAATCACTGGTGTCGATAT TGTCATGAACCATCACCTGCAGGAAACAAGTTTCA CAAAAGAAGCCTACAAGAAGTACATCAAAGATTAC ATGAAATCAATCAAAGGGAAACTTGAAGAACAGAG ACCAGAAAGAGTAAAACCTTTTATGACAGGGGCTG CAGAACAAATCAAGCACATCCTTGCTAATTTCAAAA ACTACCAGTTCTTTATGGTGAAAACATGAATCCAG ATGGCATGGTTGCTCTATTGGACTACCGTGAGGAT GGTGTGACCCCATATATGATTTTCTTTAAGGATGGT TTAGAAATGGAAAAATGTTAACAAATGTGGCAATTA TTTTGGATCTATCACCTGTCATCATAACTGGCTTCT GCTTGTCATCCACACAACACCAGGACTTAAGACAA ATGGGACTGATGTCATCTTGAGCTCTTCATTTATTT TGACTGTGATTTATTTGGAGTGGAGGCATTGTTTTT AAGAAAAACATGTCATGTAGGTTGTCTAAAAATAAA ATGCATTTAAACTCATTTGAGAG | 4 | MVKT* |
| 1259 | NM_0032 95.2_539 | 539 | CCCCCCGAGCGCCGCTCCGGCTGCACCGCGCTC GCTCCGAGTTTCAGGCTCGTGCTAAGCTAGCGCC GTCGTCGTCTCCCTTCAGTCGCCATCATGATTATC TACCGGGACCTCATCAGCCACGATGAGATGTTCTC CGACATCTACAAGATCCGGGAGATCGCGGACGGG TTGTGCCTGGAGGTGGAGGGGAAGATGGTCAGTA GGACAGAAGGTAACATTGATGACTCGCTCATTGGT GGAAATGCCTCCGCTGAAGGCCCCGAGGGCGAA GGTACCGAAAGCACAGTAATCACTGGTGTCGATAT TGTCATGAACCATCACCTGCAGGAAACAAGTTTCA CAAAAGAAGCCTACAAGAAGTACATCAAAGATTAC ATGAAATCAATCAAAGGGAAACTTGAAGAACAGAG ACCAGAAAGAGTAAAACCTTTTATGACAGGGGCTG CAGAACAAATCAAGCACATCCTTGCTAATTTCAAAA ACTACCAGTTCTTTATTGGTGAAAACATGAATCCAG ATGGCATGGTTGCTCTATGGACTACCGTGAGGATG GTGTGACCCCATATATGATTTTCTTTAAGGATGGTT TAGAAATGGAAAAATGTTAACAAATGTGGCAATTAT TTTGGATCTATCACCTGTCATCATAACTGGCTTCTG CTTGTCATCCACACAACACCAGGACTTAAGACAAA TGGGACTGATGTCATCTTGAGCTCTTCATTTATTTT GACTGTGATTTATTTGGAGTGGAGGCATTGTTTTTA AGAAAAACATGTCATGTAGGTTGTCTAAAAATAAAA TGCATTTAAACTCATTTGAGAG | 7 | WTTVRMV* |
| 1260 | NM_0032 99.1_155 8 | 1558 | GTGGGCGGACCGCGCGGCTGGAGGTGTGAGGAT CCGAACCCAGGGGTGGGGGGTGGAGGCGGCTCC TGCGATCGAAGGGGACTTGAGACTCACCGGCCGC ACGCCATGAGGGCCCTGTGGGTGCTGGGCCTCTG CTGCGTCCTGCTGACCTTCGGGTCGGTCAGAGCT GACGATGAAGTTGATGTGGATGGTACAGTAGAAGA GGATCTGGGTAAAAGTAGAGAAGGATCAAGGACG GATGATGAAGTAGTACAGAGAGAGGAAGAAGCTAT TCAGTTGGATGGATTAAATGCATCACAAATAAGAG AACTTAGAGAGAAGTCGGAAAAGTTTGCCTTCCAA GCCGAAGTTAACAGAATGATGAAACTTATCATCAA TTCATTGTATAAAAATAAAGAGATTTTCCTGAGAGA ACTGATTTCAAATGCTTCTGATGCTTTAGATAAGAT AAGGCTAATATCACTGACTGATGAAAATGCTCTTTC TGGAAATGAGGAACTAACAGTCAAAATTAAGTGTG ATAAGGAGAAGAACCTGCTGCATGTCACAGACACC GGTGTAGGAATGACCAGAGAAGAGTTGGTTAAAAA CCTTGGTACCATAGCCAAATCTGGGACAAGCGAGT TTTTAAACAAAATGACTGAAGCACAGGAAGATGGC CAGTCAACTTCTGAATTGATTGGCCAGTTTGGTGT CGGTTTCTATTCCGCCTTCCTTGTAGCAGATAAGG TTATTGTCACTTCAAAACACAACAACGATACCCAG CACATCTGGGAGTCTGACTCCAATGAATTTTCTGT AATTGCTGACCCAAGAGGAAACACTCTAGGACGG GGAACGACAATTACCCTTGTCTTAAAAGAAGAAGC ATCTGATTACCTTGAATTGGATACAATTAAAAATCT | 11 | GKNLVPTS SLV* |

TABLE 3A-continued

| SEQ ID | identifier_position | position | modified_RNA | PAP length | PAP |
|---|---|---|---|---|---|
| | | | CGTCAAAAAATATTCACAGTTCATAAACTTTCCTAT TTATGTATGGAGCAGCAAGACTGAAACTGTTGAGG AGCCCATGGAGGAAGAAGAAGCAGCCAAAGAAGA GAAAGAAGAATCTG | | |
| 1261 | NM_003321.3_533 | 533 | CTTCTGTGCGCTCGGGCTCCTGGTCCCGGCTCCC CGGTTACCGGGGCGCGAGTATGACCACAATGGCG GCCGCCACCCTGCTGCGCGCGACGCCCCACTTCA GCGGTCTCGCCGCCGGCCGGACCTTCCTGCTGCA GGGTCTGTTGCGGCTGCTGAAAGCCCCGGCATTG CCTCTCTTGTGCCGCGGCCTGGCCGTGGAGGCCA AGAAGACTTACGTGCGCGACAAGCCACATGTGAAT GTGGGTACCATCGGCCATGTGGACCACGGGAAGA CCACGCTGACTGCAGCCATCACGAAGATTCTAGCT GAGGGAGGTGGGGCTAAGTTCAAGAAGTACGAGG AGATTGACAATGCCCCGGAGGAGCGAGCTCGGGG TATCACCATCAATGCGGCTCATGTGGAGTATAGCA CTGCCGCCCGCCACTACGCCCACACAGACTGCCC GGGTCATGCAGATTATGTTAAGAATATGATCACAG GCACTGCACCCCTCGACGGCTGCATCCTGGTGGT AGCAGCCAATGACGGCCCATGCCCCAGACCCGAG AGCACTTATTACTGGCCAGACAGATTGGGGTGGA GCATGTGGTGGTATGTGAACAAGGCTGACGCT GTCCAGGACTCTGAGATGGTGGAACTGGTGGAAC TGGAGATCCGGGAGCTGCTCACCGAGTTTGGCTA TAAAGGGGAGGAGACCCCAGTCATCGTAGGCTCT GCTCTCTGTGCCCTTGAGGGTCGGGACCCTGAGT TAGGCCTGAAGTCTGTGCAGAAGCTACTGGATGCT GTGGACACTTACATCCCAGTGCCCGCCCGGGACC TGGAGAAGCCTTTCCTGCTGCCTGTGGAGGCGGT GTACTCCGTCCCTGGCCGTGGCCACCGTGGTGACA GGTACACTAGAGCGTGGCATTTTAAAGAAGGGGAG ACGAGTGTGAGCTCCTAGGACATAGCAAGAACATC CGCACTGTGGTGACAGGCATTGAGATGTTCCACAA GAGCCTGGAGAGGGCCGAGGCCGGAGATAAC | 22 | CPRPESTY YWPDRLG WSMWWC M* |
| 1262 | NM_003347.2_194 | 194 | GCTCCAGGAAGTGCGGGGGCTCCAGCCGCCCGG CCGGCCGCGATGCATTCTGGGGAAGGAGCAGCAC CAAATCCAAGATGGCGGCCAGCAGGAGGCTGATG AAGGAGCTTGAAGAAATCCGCAAATGTGGGATGAA AACTTCCGTAACATCCAGGTTGATGAAGCTAATTT ATTGACTTGGCAAGGGCTTATGTTCCTGACAACCC TCCATATGATAAGGGAGCCTTCAGAATCGAAATCA ACTTTCCAGCAGAGTACCCATTCAAACCACCGAAG ATCACATTTAAAACAAAGATCTATCACCCAAACATC GACGAAAAGGGGCAGGTCTGTCTGCCAGTAATTA GTGCCGAAAACTGGAAGCCAGCAACCAAAACCGA CCAAGTAATCCAGTCCCTCATAGCACTGGTGAATG ACCCCCAGCCTGAGCACCCGCTTCGGGCTGACCT AGCTGAAGAATACTCTAAGGACCGTAAAAAATTCT GTAAGAATGCTGAAGAGTTTACAAAGAAATATGGG GAAAAAGCGACCTGTGGACTAAAATCTGCCACGATT GGTTCCAGCAAGTGTGAGCAGAGACCCCGTGCAG TGCATTCAGACACCCCGCAAAGCAGGACTCTGTG GAAATTGACACGTGCCACCGCCTGGCGTTCGCTT GTGGCAGTTACTAACTTTCTACAGTTTTCTTAATCA AAAGTGGTCTAGGTAACCTGTAAAGAAAGGATTAA AAATTTAAGATGTTCTAGTTCTGCTCTCTTTGTTTTA AAAATCACTGCTTCAATCTACTTCAAAAGAATGGTG TTTCTTTTCTTGTCCAATTTTATCCAAAATCTTCAAG TTACATTTAACCCATAAGGTTTAAAAAAAAAGGAAAA AAAACGGTTGTGGTTCCCTTTCTTCCCTACCCTTG CCACTCCCACTTTCTGGCACCGAGTTTATTTTTCAC TTACTTACTTCCCCAGACCCCGGGCTCGCCTCCAC AAAGGAGAAGAGACTGCCCTGGCGGTCCTGGTGG CTTTTCTTAG | 50 | MFLTTLHM IREPSESK STFQQSTH SNHRRSHL KQRSITQT STKRGRSV CQ* |
| 1263 | NM_003350.2_174 | 174 | CGCGTCGGGCTGCAGGAGAAGATGGCGGTCTCCA CAGGAGTTAAAGTTCCTCGTAATTTTCGCTTGTTG GAAGAACTTGAAGAAGGACAAAAAGGAGTAGGCG ACGGTACAGTTAGCTGGGGCCTTGAAGATGATGA AGATATGACACTTACAAGGTGGACAGGCATGATTA TGGGCCACCAAGGACAAATTATGAAAACAGAATAT ATAGCCTGAAAGTAGAATGTGGACCTAAATACCCA GAAGCTCCTCCGTCAGTTAGATTTGTAACAAAAATT AATATGAACGGAATAAATAATTCCAGTGGGATGGT GGATGCCCGGAGCATACCAGTGTTAGCAAAATGG CAAAAATTCATATAGCATTAAAGTTGTACTTCAAGAG CTAAGACGTCTAATGATGTCCAAAGAAAATATGAA GCTTCCACAGCCACCAGAAGGACAAACATACAACA | 14 | MGHQGQI MKTEYIA* |

TABLE 3A-continued

| SEQ ID | identifier_position | position | modified_RNA | PAP length | PAP |
|---|---|---|---|---|---|
| | | | ATTAATTTTAGTGGATCTCAAACTTGTCTTAAATCA<br>ACAACCTTCTACTCATGTTAATGTCTTGATTAAATA<br>TCACAATGCAAAATACACATTAAGTAAAAGAATTCC<br>AGCTGGTAAACATGACCTGGACATTTGTAAGAATA<br>TATTTAATATATGTACACCCATTATGTTTTCAGGTAA<br>CAGGAGGAAAAATGCAGCACAATTTTTTTTCTCTTG<br>AAAGGCACTGTCATTTAAACATAAACCTGGAGTAC<br>TCGAAATAGAATTCAGGTTTACAAGATGAAAGCGT<br>GTGGAGAAGTGTCAGATGGCAGTGGAAGCATGTG<br>TGTTTCTAAAAAGTAAAAATCTCAAGAAAACAGAAA<br>TGGCATGCTTTACCCATCTTACTTAGTGAAAGAGA<br>GCTGCAGTTGAAATTGTTTAAAAAGTAGCAGGTAC<br>AATGAATATTGTCACAGATGTGTTAATTTTTGAAGC<br>AATGTGGGTGCTGACTACTAGTAGTATCAAAAATA<br>TGTTCAGGATTGTTTTGATACCTGTATTTATAATAA<br>AAAATGTTGGGGGGAGTTGATGAATTCCTGTTAAA<br>AGC | | |
| 1264 | NM_0033<br>50.2_267 | 267 | CGCGTCGGGCTGCAGGAGAAGATGGCGGTCTCCA<br>CAGGAGTTAAAGTTCCTCGTAATTTTCGCTTGTTG<br>GAAGAACTTGAAGAAGGACAAAAAGGAGTAGGCG<br>ACGGTACAGTTAGCTGGGGCCTTGAAGATGATGA<br>AGATATGACACTTACAAGGTGGACAGGCATGATTA<br>TTGGGCCACCAAGGACAAATTATGAAAACAGAATA<br>TATAGCCTGAAAGTAGAATGTGGACCTAAATACCC<br>AGAAGCTCCTCCGTCAGTTAGATTGTAACAAAAAT<br>TAATATGAACGGAATAAATAATTCCAGTGGGATGG<br>TGGATGCCCGGAGCATACCAGTGTTAGCAAAATG<br>GCAAAATTCATATAGCATTAAAGTTGTACTTCAAGA<br>GCTAAGACGTCTAATGATGTCCAAAGAAAATATGA<br>AGCTTCCACAGCCACCAGAAGGACAAACATACAAC<br>AATTAATTTTAGTGGATCTCAAACTTGTCTTAAATC<br>AACAACCTTCTACTCATGTTAATGTCTTGATTAAAT<br>ATCACAATGCAAAATACACATTAAGTAAAAGAATTC<br>CAGCTGGTAAACATGACCTGGACATTTGTAAGAAT<br>ATATTTAATATATGTACACCCATTATGTTTTCAGGTA<br>ACAGGAGGAAAAATGCAGCACAATTTTTTTTCTCTT<br>GAAAGGCACTGTCATTTAAACATAAACCTGGAGTA<br>CTCGAAATAGAATTCAGGTTTACAAGATGAAAGCG<br>TGTGGAGAAGTGTCAGATGGCAGTGGAAGCATGT<br>GTGTTTCTAAAAAGTAAAAATCTCAAGAAAACAGAA<br>ATGGCATGCTTTACCCATCTTACTTAGTGAAAGAG<br>AGCTGCAGTTGAAATTGTTTAAAAAGTAGCAGGTA<br>CAATGAATATTGTCACAGATGTGTTAATTTTTGAAG<br>CAATGTGGGTGCTGACTACTAGTAGTATCAAAAAT<br>ATGTTCAGGATTGTTTTGATACCTGTATTTATAATA<br>AAAAATGTTGGGGGGAGTTGATGAATTCCTGTTAA<br>AAGC | 1 | L* |
| 1265 | NM_0033<br>50.2_288 | 288 | CGCGTCGGGCTGCAGGAGAAGATGGCGGTCTCCA<br>CAGGAGTTAAAGTTCCTCGTAATTTTCGCTTGTTG<br>GAAGAACTTGAAGAAGGACAAAAAGGAGTAGGCG<br>ACGGTACAGTTAGCTGGGGCCTTGAAGATGATGA<br>AGATATGACACTTACAAGGTGGACAGGCATGATTA<br>TTGGGCCACCAAGGACAAATTATGAAAACAGAATA<br>TATAGCCTGAAAGTAGAATGTGGACCTAAATACCC<br>AGAAGCTCCTCCGTCAGTTAGATTTGTAACAAAAA<br>TTAATATGAAGGAATAAATAATTCCAGTGGGATGG<br>TGGATGCCCGGAGCATACCAGTGTTAGCAAAATG<br>GCAAAATTCATATAGCATTAAAGTTGTACTTCAAGA<br>GCTAAGACGTCTAATGATGTCCAAAGAAAATATGA<br>AGCTTCCACAGCCACCAGAAGGACAAACATACAAC<br>AATTAATTTTAGTGGATCTCAAACTTGTCTTAAATC<br>AACAACCTTCTACTCATGTTAATGTCTTGATTAAAT<br>ATCACAATGCAAAATACACATTAAGTAAAAGAATTC<br>CAGCTGGTAAACATGACCTGGACATTTGTAAGAAT<br>ATATTTAATATATGTACACCCATTATGTTTTCAGGTA<br>ACAGGAGGAAAAATGCAGCACAATTTTTTTTCTCTT<br>GAAAGGCACTGTCATTTAAACATAAACCTGGAGTA<br>CTCGAAATAGAATTCAGGTTTACAAGATGAAAGCG<br>TGTGGAGAAGTGTCAGATGGCAGTGGAAGCATGT<br>GTGTTTCTAAAAAGTAAAAATCTCAAGAAAACAGAA<br>ATGGCATGCTTTACCCATCTTACTTAGTGAAAGAG<br>AGCTGCAGTTGAAATTGTTTAAAAAGTAGCAGGTA<br>CAATGAATATTGTCACAGATGTGTTAATTTTTGAAG<br>CAATGTGGGTGCTGACTACTAGTAGTATCAAAAAT<br>ATGTTCAGGATTGTTTTGATACCTGTATTTATAATA<br>AAAAATGTTGGGGGGAGTTGATGAATTCCTGTTAA<br>AAGC | 2 | KE* |

TABLE 3A-continued

| SEQ ID | identifier_position | position | modified_RNA | PAP length | PAP |
|---|---|---|---|---|---|
| 1266 | NM_003350.2_431 | 431 | CGCGTCGGGCTGCAGGAGAAGATGGCGGTCTCCA CAGGAGTTAAAGTTCCTCGTAATTTTCGCTTGTTG GAAGAACTTGAAGAAGGACAAAAAGGAGTAGGCG ACGGTACAGTTAGCTGGGGCCTTGAAGATGATGA AGATATGACACTTACAAGGTGGACAGGCATGATTA TTGGGCCACCAAGGACAAATTATGAAAACAGAATA TATAGCCTGAAAGTAGAATGTGGACCTAAATACCC AGAAGCTCCTCCGTCAGTTAGATTTGTAACAAAAA TTAATATGAACGGAATAAATAATTCCAGTGGGATG GTGGATGCCCGGAGCATACCAGTGTTAGCAAAAT GGCAAAATTCATATAGCATTAAAGTTGTACTTCAAG AGCTAAGACGTCTAATGATGTCCAAAGAAAATATG AAGCTTCCACAGCACCAGAAGGACAAACATACAAC AATTAATTTTAGTGGATCTCAAACTTGTCTTAAATC AACAACCTTCTACTCATGTTAATGTCTTGATTAAAT ATCACAATGCAAAATACACATTAAGTAAAAGAATTC CAGCTGGTAAACATGACCTGGACATTTGTAAGAAT ATATTTAATATATGTACACCCATTATGTTTTCAGGTA ACAGGAGGAAAAATGCAGCACAATTTTTTTTCTCTT GAAAGGCACTGTCATTTAAACATAAACCTGGAGTA CTCGAAATAGAATTCAGGTTTACAAGATGAAAGCG TGTGGAGAAGTGTCAGATGGCAGTGGAAGCATGT GTGTTTCTAAAAAGTAAAAATCTCAAGAAAACAGAA ATGGCATGCTTTACCCATCTTACTTAGTGAAAGAG AGCTGCAGTTGAAATTGTTTAAAAAGTAGCAGGTA CAATGAATATTGTCACAGATGTGTTAATTTTTGAAG CAATGTGGGTGCTGACTACTAGTAGTATCAAAAAT ATGTTCAGGATTGTTTTGATACCTGTATTTATAATA AAAAATGTTGGGGGGAGTTGATGAATTCCTGTTAA AAGC | 26 | HQKDKHTT INFSGSQT CLKSTTFY SC* |
| 1267 | NM_003350.2_68 | 68 | CGCGTCGGGCTGCAGGAGAAGATGGCGGTCTCCA CAGGAGTTAAAGTTCCTCGTAATTTTCGCTTGTGG AAGAACTTGAAGAAGGACAAAAAGGAGTAGGCGA CGGTACAGTTAGCTGGGGCCTTGAAGATGATGAA GATATGACACTTACAAGGTGGACAGGCATGATTAT TGGGCCACCAAGGACAAATTATGAAAACAGAATAT ATAGCCTGAAAGTAGAATGTGGACCTAAATACCCA GAAGCTCCTCCGTCAGTTAGATTTGTAACAAAAATT AATATGAACGGAATAAATAATTCCAGTGGGATGGT GGATGCCCGGAGCATACCAGTGTTAGCAAAATGG CAAAATTCATATAGCATTAAAGTTGTACTTCAAGAG CTAAGACGTCTAATGATGTCCAAAGAAAATATGAA GCTTCCACAGCACCAGAAGGACAAACATACAACA ATTAATTTTAGTGGATCTCAAACTTGTCTTAAATCA ACAACCTTCTACTCATGTTAATGTCTTGATTAAATA TCACAATGCAAAATACACATTAAGTAAAAGAATTCC AGCTGGTAAACATGACCTGGACATTTGTAAGAATA TATTTAATATATGTACACCCATTATGTTTTCAGGTAA CAGGAGGAAAAATGCAGCACAATTTTTTTTCTCTTG AAAGGCACTGTCATTTAAACATAAACCTGGAGTAC TCGAAATAGAATTCAGGTTTACAAGATGAAAGCGT GTGGAGAAGTGTCAGATGGCAGTGGAAGCATGTG TGTTTCTAAAAAGTAAAAATCTCAAGAAAACAGAAA TGGCATGCTTTACCCATCTTACTTAGTGAAAGAGA GCTGCAGTTGAAATTGTTTAAAAAGTAGCAGGTAC AATGAATATTGTCACAGATGTGTTAATTTTTGAAGC AATGTGGGTGCTGACTACTAGTAGTATCAAAAATA TGTTCAGGATTGTTTTGATACCTGTATTTATAATAA AAAATGTTGGGGGGAGTTGATGAATTCCTGTTAAA AGC | 10 | WKNLKKD KKE* |
| 1268 | NM_003365.2_121 | 121 | CAGTCTACGCTTGCGCGGCGCAACAGGGCCGACT GCAGCTGGAAGATGGCGGCGTCCGTGGTCTGTCG GGCCGCTACCGCGGGGCACAAGTGCTATTGCGC GCCCGCCGCTCGCCGGCCTGCTGCGGACGCCAG CCTTGCGGAGTACGGCAACCTTCGCTCAGGCGCT CCAGTTCGTGCCGGAGACGCAGGTTAGCCTGCTG GACAACGGCCTGCGTGTGGCCTCCGAGCAGTCCT CTCAGCCCACTTGCACGGTGGGAGTGTGGATTGA TGTTGGCAGCCGTTTTGAGACTGAGAAGAATAATG GGGCAGGCTACTTTTTGGAGCATCTGGCTTTCAAG GGAACAAAGAATCGGCCTGGCAGTGCCCTGGAGA AGGAGGTGGAGAGCATGGGGGCCCATCTTAATGC CTACAGCACCCGGGAGCACACAGCTTACTACATCA AGGCGCTGTCCAAGGATCTGCCGAAAGCTGTGGA GCTCCTGGGTGACATTGTGCAGAACTGTAGTCTGG AAGACTCACAGATTGAGAAGGAACGTGATGTGATC CTGCGGGAGATGCAGGAGAATGATGCATCTATGC | 141 | CCGRQPC GVRQPSLR RSSSCRR RRLACWTT ACVWPPS SPLSPLAR WECGLML AAVLRLRRI MGQATFW SIWLSREQ RIGLAVPW RRRWRAW GPILMPTA PGSTQLTT SRRCPRIC RKLWSSW VTLCRTVV |

TABLE 3A-continued

| SEQ ID | identifier_position | position | modified_RNA | PAP length | PAP |
|---|---|---|---|---|---|
| | | | GAGATGTGGTCTTTAACTACCTGCATGCCACAGCA TTCCAGGGCACACCTCTAGCCCAGGCTGTGGAGG GGCCCAGTGAGAATGTCAGGAAGCTGTCTCGTGC AGACTTGACCGAGTACCTCAGCACACATTACAAGG CCCCTCGAATGGTGCTGGCAGCAGCTGGAGGAGT GGAGCACCAGCAACTGTTAGACCTCGCCCAGAAG CACCTCGGTGGCATCCCATGGACATATGCAGAGG ACGCTGTGCCCACTCTTACTCCATGCCGCTTCACT GGCAGTGAGATCCGCCACCGTGATGATGCTCTAC CTTTTGCCCACGTGGCCATTGCAGTAGAGGGTCCT GGCTGGGCCAGCCCGGACAATGTGGCCTTGCAAG TGGCCAATGCCATCATCGGCCACTATGACTGCACT TATGGTGGTGGCGTGCACCTGTCCAGCCC | | WKTHRLR RNVM* |
| 1269 | NM_0033 65.2_288 | 288 | CAGTCTACGCTTGCGCGGCGCAACAGGGCCGACT GCAGCTGGAAGATGGCGGCGTCCGTGGTCTGTCG GGCCGCTACCGCCGGGGCACAAGTGCTATTGCGC GCCCGCCGCTCGCCGGCCCTGCTGCGGACGCCA GCCTTGCGGAGTACGGCAACCTTCGCTCAGGCGC TCCAGTTCGTGCCGGAGACGCAGGTTAGCCTGCT GGACAACGGCCTGCGTGTGGCCTCCGAGCAGTCC TCTCAGCCCACTTGCACGGTGGGAGTGTGGATTG ATGTTGGCAGCCGTTTGAGACTGAGAAGAATAATG GGGCAGGCTACTTTTTGGAGCATCTGGCTTTCAAG GGAACAAAGAATCGGCCTGGCAGTGCCCTGGAGA AGGAGGTGGAGAGCATGGGGGCCCATCTTAATGC CTACAGCACCCGGGAGCACACAGCTTACTACATCA AGGCGCTGTCCAAGGATCTGCCGAAAGCTGTGGA GCTCCTGGGTGACATTGTGCAGAACTGTAGTCTGG AAGACTCACAGATTGAGAAGGAACGTGATGTGATC CTGCGGGAGATGCAGGAGAATGATGCATCTATGC GAGATGTGGTCTTTAACTACCTGCATGCCACAGCA TTCCAGGGCACACCTCTAGCCCAGGCTGTGGAGG GGCCCAGTGAGAATGTCAGGAAGCTGTCTCGTGC AGACTTGACCGAGTACCTCAGCACACATTACAAGG CCCCTCGAATGGTGCTGGCAGCAGCTGGAGGAGT GGAGCACCAGCAACTGTTAGACCTCGCCCAGAAG CACCTCGGTGGCATCCCATGGACATATGCAGAGG ACGCTGTGCCCACTCTTACTCCATGCCGCTTCACT GGCAGTGAGATCCGCCACCGTGATGATGCTCTAC CTTTTGCCCACGTGGCCATTGCAGTAGAGGGTCCT GGCTGGGCCAGCCCGGACAATGTGGCCTTGCAAG TGGCCAATGCCATCATCGGCCACTATGACTGCACT TATGGTGGTGGCGTGCACCTGTCCAGCCC | 86 | LRLRRIMG QATFWSIW LSREQRIG LAVPWRR RWRAWGP ILMPTAPG STQLTTSR RCPRICRK LWSSWVT LCRTVVWK THRLRRNV M* |
| 1270 | NM_0033 65.2_323 | 323 | CAGTCTACGCTTGCGCGGCGCAACAGGGCCGACT GCAGCTGGAAGATGGCGGCGTCCGTGGTCTGTCG GGCCGCTACCGCCGGGGCACAAGTGCTATTGCGC GCCCGCCGCTCGCCGGCCCTGCTGCGGACGCCA GCCTTGCGGAGTACGGCAACCTTCGCTCAGGCGC TCCAGTTCGTGCCGGAGACGCAGGTTAGCCTGCT GGACAACGGCCTGCGTGTGGCCTCCGAGCAGTCC TCTCAGCCCACTTGCACGGTGGGAGTGTGGATTG ATGTTGGCAGCCGTTTTGAGACTGAGAAGAATAAT GGGGCAGGCTACTTTTGGAGCATCTGGCTTTCAAG GGAACAAAGAATCGGCCTGGCAGTGCCCTGGAGA AGGAGGTGGAGAGCATGGGGGCCCATCTTAATGC CTACAGCACCCGGGAGCACACAGCTTACTACATCA AGGCGCTGTCCAAGGATCTGCCGAAAGCTGTGGA GCTCCTGGGTGACATTGTGCAGAACTGTAGTCTGG AAGACTCACAGATTGAGAAGGAACGTGATGTGATC CTGCGGGAGATGCAGGAGAATGATGCATCTATGC GAGATGTGGTCTTTAACTACCTGCATGCCACAGCA TTCCAGGGCACACCTCTAGCCCAGGCTGTGGAGG GGCCCAGTGAGAATGTCAGGAAGCTGTCTCGTGC AGACTTGACCGAGTACCTCAGCACACATTACAAGG CCCCTCGAATGGTGCTGGCAGCAGCTGGAGGAGT GGAGCACCAGCAACTGTTAGACCTCGCCCAGAAG CACCTCGGTGGCATCCCATGGACATATGCAGAGG ACGCTGTGCCCACTCTTACTCCATGCCGCTTCACT GGCAGTGAGATCCGCCACCGTGATGATGCTCTAC CTTTTGCCCACGTGGCCATTGCAGTAGAGGGTCCT GGCTGGGCCAGCCCGGACAATGTGGCCTTGCAAG TGGCCAATGCCATCATCGGCCACTATGACTGCACT TATGGTGGTGGCGTGCACCTGTCCAGCCC | 74 | WSIWLSRE QRIGLAVP WRRRWRA WGPILMPT APGSTQLT TSRRCPRI CRKLWSS WVTLCRTV VWKTHRL RRNVM* |
| 1271 | NM_0033 74.1_145 | 145 | GCCGCTCGCTCGGCTCCGCTCCCTGGCTCGGCTC CCTGCCTCCGCGTCGCAGCCCCCGCCGTAGCCGC CTCCGAGCCCGCCGCCACATCCTCTGAGAAGATG GCTGTGCCACCCACGTATGCCGATCTTGGCAAATC | 10 | MSSPRAM DLA* |

TABLE 3A-continued

| SEQ ID | identifier_position | position | modified_RNA | PAP length | PAP |
|---|---|---|---|---|---|
| | | | TGCCAGGATGTCTTCACCAAGGGCTATGGATTTGG<br>CTTAATAAAGCTTGATTTGAAAACAAAATCTGAGAA<br>TGGATTGGAATTTACAAGCTCAGGCTCAGCCAACA<br>CTGAGACCACCAAAGTGACGGGCAGTCTGGAAAC<br>CAAGTACAGATGGACTGAGTACGGCCTGACGTTTA<br>CAGAGAAATGGAATACCGACAATACACTAGGCACC<br>GAGATTACTGTGGAAGATCAGCTTGCACGTGGACT<br>GAAGCTGACCTTCGATTCATCCTTCTCACCTAACA<br>CTGGGAAAAAAAATGCTAAAATCAAGACAGGGTAC<br>AAGCGGGAGCACATTAACCTGGGCTGCGACATGG<br>ATTTCGACATTGCTGGGCCTTCCATCCGGGGTGCT<br>CTGGTGCTAGGTTACGAGGGCTGGCTGGCCGGCT<br>ACCAGATGAATTTTGAGACTGCAAAATCCCGAGTG<br>ACCCAGAGCAACTTTGCAGTTGGCTACAAGACTGA<br>TGAATTCCAGCTTCACACTAATGTGAATGACGGGA<br>CAGAGTTTGGCGGCTCCATTTACCAGAAAGTGAAC<br>AAGAAGTTGGAGACCGCTGTCAATCTTGCCTGGAC<br>AGCAGGAAACAGTAACACGCGCTTCGGAATAGCA<br>GCCAAGTATCAGATTGACCCTGACGCCTGCTTCTC<br>GGCTAAAGTGAACAACTCCAGCCTGATAGGTTTAG<br>GATACACTCAGACTCTAAAGCCAGGTATTAAACTG<br>ACACTGTCAGCTCTTCTGGATGGCAAGAACGTCAA<br>TGCTGGTGGCCACAAGCTTGGTCTAGGACTGGAA<br>TTTCAAGCATAAATGAATACTGTACAATTGTTTAAT<br>TTTAAACTATTTTGCAGCATAGCTACCTTCAGAATT<br>TAGTGTATCTTTA | | |
| 1272 | NM_0033<br>74.1_669 | 669 | GCCGCTCGCTCGGCTCCGCTCCCTGGCTCGGCTC<br>CCTGCCTCCGCGTCGCAGCCCCGCCGTAGCCGC<br>CTCCGAGCCCGCCGCCACATCCTCTGAGAAGATG<br>GCTGTGCCACCCACGTATGCCGATCTTGGCAAATC<br>TGCCAGGGATGTCTTCACCAAGGGCTATGGATTTG<br>GCTTAATAAAGCTTGATTTGAAAACAAAATCTGAGA<br>ATGGATTGGAATTTACAAGCTCAGGCTCAGCCAAC<br>ACTGAGACCACCAAAGTGACGGGCAGTCTGGAAA<br>CCAAGTACAGATGGACTGAGTACGGCCTGACGTTT<br>ACAGAGAAATGGAATACCGACAATACACTAGGCAC<br>CGAGATTACTGTGGAAGATCAGCTTGCACGTGGA<br>CTGAAGCTGACCTTCGATTCATCCTTCTCACCTAA<br>CACTGGGAAAAAAAATGCTAAAATCAAGACAGGGT<br>ACAAGCGGGAGCACATTAACCTGGGCTGCGACAT<br>GGATTTCGACATTGCTGGGCCTTCCATCCGGGGT<br>GCTCTGGTGCTAGGTTACGAGGGCTGGCTGGCCG<br>GCTACCAGATGAATTTTGAGACTGCAAAATCCCGA<br>GTGACCCAGAGCAACTTTGCAGTTGGCTACAAGAC<br>TGATGAATTCCAGCTTCACACTAATGTGAATGACG<br>GGACAGAGTTTGGCGGCTCCATTTACCAGAAAGTG<br>AACAAGAAGTTGGAGACCGCTGTCAATCTTGCCTG<br>GACAGCAGGAAACAGTAACACGCGCTTCGGAATA<br>GCAGCCAAGTATCAGATTGACCCTGACGCCTGCTT<br>CTCGGCTAAAGTGAACAACTCCAGCCTGATAGGTT<br>TAGGATACACTCAGACTCTAAAGCCAGGTATTAAA<br>CTGACACTGTCAGCTCTTCTGGATGGCAAGAACGT<br>CAATGCTGGTGGCCACAAGCTTGGTCTAGGACTG<br>GAATTTCAAGCATAAATGAATACTGTACAATTGTTT<br>AATTTTAAACTATTTTGCAGCATAGCTACCTTCAGA<br>ATTTAGTGTATCTTTA | 8 | LAAPFTRK* |
| 1273 | NM_0033<br>75.2_624 | 624 | GGTTGCGGCGGGCGGAACGGTGTCTCCTTCACTT<br>CGCCCTCCAGCTGCTGCAGCTGCAGCCCGACCGC<br>GAGCGTGCCAAGCGGCTTCAGCAGCTAGCGGAGC<br>GGTGGCGGCGGCCCCCCTCAGGACACCACCAGA<br>TTCCCCTCTTCCCGCGGCCTCGCCATGGCGACCC<br>ACGGACAGACTTGCGCGCGTCCAATGTGTATTCCT<br>CCATCATATGCTGACCTTGGCAAAGCTGCCAGAGA<br>TATTTTCAACAAAGGATTTGGTTTTGGGTTGGTGAA<br>ACTGGATGTGAAAACAAAGTCTTGCAGTGGCGTG<br>GAATTTTCAACGTCCGGTTCATCTAATACAGACACT<br>GGTAAAGTTACTGGGACCTTGGAGACCAAATACAA<br>GTGGTGTGAGTATGGTCTGACTTTCACAGAAAAGT<br>GGAACACTGATAACACTCTGGGAACAGAAATCGCA<br>ATTGAAGACCAGATTTGTCAAGGTTTGAAACTGAC<br>ATTTGATACTACCTTCTCACCAAACACAGGAAAGA<br>AAAGTGGTAAAATCAAGTCTTCTTACAAGAGGGAG<br>TGTATAAACCTTGGTTGTGATGTTGACTTTGATTTT<br>GCTGGACCTGCAATCCATGGTTCAGCTGTCTTGGT<br>TATGAGGGCTGGCTTGCTGGCTACCAGATGACCTT<br>TGACAGTGCCAAATCAAAGCTGACAAGGAATAACT<br>TTGCAGTGGGCTACAGGACTGGGGACTTCCAGCT | 11 | LVMRAGLL<br>ATR* |

TABLE 3A-continued

| SEQ ID | identifier_ position | position | modified_RNA | PAP length | PAP |
|---|---|---|---|---|---|
| | | | ACACACTAATGTCAACGATGGGACAGAATTTGGAG GATCAATTTATCAGAAAGTTTGTGAAGATCTTGACA CTTCAGTAAACCTTGCTTGGACATCAGGTACCAAC TGCACTCGTTTTGGCATTGCAGCTAAATATCAGTT GGATCCCACTGCTTCCATTTCTGCAAAAGTCAACA ACTCTAGCTTAATTGGAGTAGGCTATACTCAGACT CTGAGGCCTGGTGTGAAGCTTACACTCTCTGCTCT GGTAGATGGGAAGAGCATTAATGCTGGAGGCCAC AAGGTTGGGCTCGC | | |
| 1274 | NM_0033 80.2_1030 | 1030 | GTCCCCGCGCCAGAGACGCAGCCGCGCTCCAC CACCCACACCCACCGCGCCCTCGTTCGCCTCTTCT CCGGGGAGCCAGTCCGCGCCACCGCCGCCGCCCA GGCCATCGCCACCCTCCGCAGCCATGTCCACCAG GTCCGTGTCCTCGTCCTCCTACCGCAGGATGTTCG GCGGCCCGGGCACCGCGAGCCGGCCGAGCTCCA GCCGGAGCTACGTGACTACGTCCACCCGCACCTA CAGCCTGGGCAGCGCGCTGCGCCCCAGCACCAG CCGCAGCCTCTACGCCTCGTCCCCGGGCGGCGTG TATGCCACGCGCTCCTCTGCCGTGCGCCTGCGGA GCAGCGTGCCCGGGGTGCGGCTCCTGCAGGACT CGGTGGACTTCTCGCTGGCCGACGCCATCAACAC CGAGTTCAAGAACACCCGCACCAACGAGAAGGTG GAGCTGCAGGAGCTGAATGACCGCTTCGCCAACT ACATCGACAAGGTGCGCTTCCTGGAGCAGCAGAA TAAGATCCTGCTGGCCGAGCTCGAGCAGCTCAAG GGCCAAGGCAAGTCGCGCCTGGGGGACCTCTAC GAGGAGGAGATGCGGGAGCTGCGCCGGCAGGTG GACCAGCTAACCAACGACAAAGCCCGCGTCGAGG TGGAGCGCGACAACCTGGCCGAGGACATCATGCG CCTCCGGGAGAAATTGCAGGAGGAGATGCTTCAG AGAGAGGAAGCCGAAAACACCCTGCAATCTTTCAG ACAGGATGTTGACAATGCGTCTCTGGCACGTCTTG ACCTTGAACGCAAAGTGGAATCTTTGCAAGAAGAG ATTGCCTTTTTGAAGAAACTCCACGAAGAGGAAAT CCAGGAGCTGCAGGCTCAGATTCAGGAACAGCAT GTCCAAATCGATGTGGATGTTTCCAAGCCTGACCT CACGGCTGCCCTGCGTGACGTACGTCAGCAATAT GAAAGTGTGGCTGCCAAGAACCTGCAGGAGGCAG AAGAATGGTACAAATCCAAGTTTGCTGACCTCTCT GAG | 69 | TGTMTPCA RQSRSPLS TGDRCSPS PVKWMPL KEPMSPW NARCVKW KRTLPLKLL TTKTLLAA CRMRFRI* |
| 1275 | NM_0033 80.2_622 | 622 | GTCCCCGCGCCAGAGACGCAGCCGCGCTCCAC CACCCACACCCACCGCGCCCTCGTTCGCCTCTTCT CCGGGGAGCCAGTCCGCGCCACCGCCGCCGCCCA GGCCATCGCCACCCTCCGCAGCCATGTCCACCAG GTCCGTGTCCTCGTCCTCCTACCGCAGGATGTTCG GCGGCCCGGGCACCGCGAGCCGGCCGAGCTCCA GCCGGAGCTACGTGACTACGTCCACCCGCACCTA CAGCCTGGGCAGCGCGCTGCGCCCCAGCACCAG CCGCAGCCTCTACGCCTCGTCCCCGGGCGGCGTG TATGCCACGCGCTCCTCTGCCGTGCGCCTGCGGA GCAGCGTGCCCGGGGTGCGGCTCCTGCAGGACT CGGTGGACTTCTCGCTGGCCGACGCCATCAACAC CGAGTTCAAGAACACCCGCACCAACGAGAAGGTG GAGCTGCAGGAGCTGAATGACCGCTTCGCCAACT ACATCGACAAGGTGCGCTTCCTGGAGCAGCAGAA TAAGATCCTGCTGGCCGAGCTCGAGCAGCTCAAG GGCCAAGGCAAGTCGCGCCTGGGGGACCTCTAC GAGGAGGAGATGCGGGAGCTGCGCCGGCAGGTG GACCAGCTAACCAAGACAAAGCCCGCGTCGAGGT GGAGCGCGACAACCTGGCCGAGGACATCATGCGC CTCCGGGAGAAATTGCAGGAGGAGATGCTTCAGA GAGAGGAAGCCGAAAACACCCTGCAATCTTTCAGA CAGGATGTTGACAATGCGTCTCTGGCACGTCTTGA CCTTGAACGCAAAGTGGAATCTTTGCAAGAAGAGA TTGCCTTTTTGAAGAAACTCCACGAAGAGGAAATC CAGGAGCTGCAGGCTCAGATTCAGGAACAGCATG TCCAAATCGATGTGGATGTTTCCAAGCCTGACCTC ACGGCTGCCCTGCGTGACGTACGTCAGCAATATG AAAGTGTGGCTGCCAAGAACCTGCAGGAGGCAGA AGAATGGTACAAATCCAAGTTTGCTGACCTCTCTG AGG | 68 | KTKPASR WSATTWP RTSCASGR NCRRRCF RERKPKTP CNLSDRML TMRLWHV LTLNAKWN LCKKRLPF* |
| 1276 | NM_0033 80.2_652 | 652 | GTCCCCGCGCCAGAGACGCAGCCGCGCTCCAC CACCCACACCCACCGCGCCCTCGTTCGCCTCTTCT CCGGGGAGCCAGTCCGCGCCACCGCCGCCGCCCA GGCCATCGCCACCCTCCGCAGCCATGTCCACCAG GTCCGTGTCCTCGTCCTCCTACCGCAGGATGTTCG GCGGCCCGGGCACCGCGAGCCGGCCGAGCTCCA | 58 | ETWPRTS CASGRNC RRRCFRE RKPKTPCN LSDRMLTM RLWHVLTL |

TABLE 3A-continued

| SEQ ID | identifier_position | position | modified_RNA | length PAP | PAP |
|---|---|---|---|---|---|
| | | | GCCGGAGCTACGTGACTACGTCCACCCGCACCTA CAGCCTGGGCAGCGCGCTGCGCCCCAGCACCAG CCGCAGCCTCTACGCCTCGTCCCCGGGCGGCGTG TATGCCACGCGCTCCTCTGCCGTGCGCCTGCGGA GCAGCGTGCCCGGGGTGCGGCTCCTGCAGGACT CGGTGGACTTCTCGCTGGCCGACGCCATCAACAC CGAGTTCAAGAACACCCGCACCAACGAGAAGGTG GAGCTGCAGGAGCTGAATGACCGCTTCGCCAACT ACATCGACAAGGTGCGCTTCCTGGAGCAGCAGAA TAAGATCCTGCTGGCCGAGCTCGAGCAGCTCAAG GGCCAAGGCAAGTCGCGCCTGGGGGACCTCTAC GAGGAGGAGATGCGGGAGCTGCGCCGGCAGGTG GACCAGCTAACCAACGACAAAGCCCGCGTCGAGG TGGAGCGCGAAACCTGGCCGAGGACATCATGCGC CTCCGGGAGAAATTGCAGGAGGAGATGCTTCAGA GAGAGGAAGCCGAAAACACCCTGCAATCTTTCAGA CAGGATGTTGACAATGCGTCTCTGGCACGTCTTGA CCTTGAACGCAAAGTGGAATCTTTGCAAGAAGAGA TTGCCTTTTTGAAGAAACTCCACGAAGAGGAAATC CAGGAGCTGCAGGCTCAGATTCAGGAACAGCATG TCCAAATCGATGTGGATGTTTCCAAGCCTGACCTC ACGGCTGCCCTGCGTGACGTACGTCAGCAATATG AAAGTGTGGCTGCCAAGAACCTGCAGGAGGCAGA AGAATGGTACAAATCCAAGTTTGCTGACCTCTCTG AGG | | NAKWNLC KKRLPF* |
| 1277 | NM_0033 80.2_804 | 804 | GTCCCCGCGCCAGAGACGCAGCCGCGCTCCCAC CACCCACACCCACCGCGCCCTCGTTCGCCTCTTCT CCGGGAGCCAGTCCGCGCCACCGCCGCCGCCCA GGCCATCGCCACCCTCCGCAGCCATGTCCACCAG GTCCGTGTCCTCGTCCTCCTACCGCAGGATGTTCG GCGGCCCGGGCACCGCGAGCCGGCCGAGCTCCA GCCGGAGCTACGTGACTACGTCCACCCGCACCTA CAGCCTGGGCAGCGCGCTGCGCCCCAGCACCAG CCGCAGCCTCTACGCCTCGTCCCCGGGCGGCGTG TATGCCACGCGCTCCTCTGCCGTGCGCCTGCGGA GCAGCGTGCCCGGGGTGCGGCTCCTGCAGGACT CGGTGGACTTCTCGCTGGCCGACGCCATCAACAC CGAGTTCAAGAACACCCGCACCAACGAGAAGGTG GAGCTGCAGGAGCTGAATGACCGCTTCGCCAACT ACATCGACAAGGTGCGCTTCCTGGAGCAGCAGAA TAAGATCCTGCTGGCCGAGCTCGAGCAGCTCAAG GGCCAAGGCAAGTCGCGCCTGGGGGACCTCTAC GAGGAGGAGATGCGGGAGCTGCGCCGGCAGGTG GACCAGCTAACCAACGACAAAGCCCGCGTCGAGG TGGAGCGCGACAACCTGGCCGAGGACATCATGCG CCTCCGGGAGAAATTGCAGGAGGAGATGCTTCAG AGAGAGGAAGCCGAAAACACCCTGCAATCTTTCAG ACAGGATGTTGACAATGCGTCTCTGGCACGTCTTG ACCTTGAACGCAAAGTGGAATCTTGCAAGAAGAGA TTGCCTTTTTGAAGAAACTCCACGAAGAGGAAATC CAGGAGCTGCAGGCTCAGATTCAGGAACAGCATG TCCAAATCGATGTGGATGTTTCCAAGCCTGACCTC ACGGCTGCCCTGCGTGACGTACGTCAGCAATATG AAAGTGTGGCTGCCAAGAACCTGCAGGAGGCAGA AGAATGGTACAAATCCAAGTTTGCTGACCTCTCTG AGG | 7 | CKKRLPF* |
| 1278 | NM_0033 80.2_817 | 817 | GTCCCCGCGCCAGAGACGCAGCCGCGCTCCCAC CACCCACACCCACCGCGCCCTCGTTCGCCTCTTCT CCGGGAGCCAGTCCGCGCCACCGCCGCCGCCCA GGCCATCGCCACCCTCCGCAGCCATGTCCACCAG GTCCGTGTCCTCGTCCTCCTACCGCAGGATGTTCG GCGGCCCGGGCACCGCGAGCCGGCCGAGCTCCA GCCGGAGCTACGTGACTACGTCCACCCGCACCTA CAGCCTGGGCAGCGCGCTGCGCCCCAGCACCAG CCGCAGCCTCTACGCCTCGTCCCCGGGCGGCGTG TATGCCACGCGCTCCTCTGCCGTGCGCCTGCGGA GCAGCGTGCCCGGGGTGCGGCTCCTGCAGGACT CGGTGGACTTCTCGCTGGCCGACGCCATCAACAC CGAGTTCAAGAACACCCGCACCAACGAGAAGGTG GAGCTGCAGGAGCTGAATGACCGCTTCGCCAACT ACATCGACAAGGTGCGCTTCCTGGAGCAGCAGAA TAAGATCCTGCTGGCCGAGCTCGAGCAGCTCAAG GGCCAAGGCAAGTCGCGCCTGGGGGACCTCTAC GAGGAGGAGATGCGGGAGCTGCGCCGGCAGGTG GACCAGCTAACCAACGACAAAGCCCGCGTCGAGG TGGAGCGCGACAACCTGGCCGAGGACATCATGCG CCTCCGGGAGAAATTGCAGGAGGAGATGCTTCAG | 3 | MPF* |

TABLE 3A-continued

| SEQ ID | identifier_position | position | modified_RNA | PAP length | PAP |
|---|---|---|---|---|---|
| | | | AGAGAGGAAGCCGAAAACACCCTGCAATCTTTCAG ACAGGATGTTGACAATGCGTCTCTGGCACGTCTTG ACCTTGAACGCAAAGTGGAATCTTTGCAAGAAGAG ATGCCTTTTTGAAGAAACTCCACGAAGAGGAAATC CAGGAGCTGCAGGCTCAGATTCAGGAACAGCATG TCCAAATCGATGTGGATGTTTCCAAGCCTGACCTC ACGGCTGCCCTGCGTGACGTACGTCAGCAATATG AAAGTGTGGCTGCCAAGAACCTGCAGGAGGCAGA AGAATGGTACAAATCCAAGTTTGCTGACCTCTCTG AGG | | |
| 1279 | NM_003418.2_236 | 236 | AATTCCAAACAGCCTCTACCTTGCGAGCCGTCTTC CCCAGGCCTGCGTCCGAGTCTCCGCCGCTGCGG GCCCGCTCCGACGCGGAAGATCTGACTGCAGCCA TGAGCAGCAATGAGTGCTTCAAGTGTGGACGATCT GGCCACTGGGCCCGGGAATGTCCTACTGGTGGAG GCCGTGGTCGTGGAATGAGAAGCCGTGGCAGAG GTGGTTTTACCTCGGATAGAGGTTTCCAGTTGTTT CCTCGTCTCTTCCAGATATTTGTTATCGCTGTGGT GAGTCTGGTCATCTTGCCAAGGATTGTGATCTTCA GGAGGATGCCTGCTATAACTGCGGTAGAGGTGGC CACATTGCCAAGGACTGCAAGGAGCCCAAGAGAG AGCGAGAGCAATGCTGCTACAACTGTGGCAAACC AGGCCATCTGGCTCGTGACTGCGACCATGCAGAT GAGCAGAAATGCTATTCTTGTGGAGAATTCGGACA CATTCAAAAAGACTGCACCAAAGTGAAGTGCTATA GGTGTGGTGAAACTGGTCATGTAGCCATCAACTGC AGCAAGACAAGTGAAGTCAACTGTTACCGCTGTGG CGAGTCAGGGCACCTTGCACGGGAATGCACAATT GAGGCTACAGCCTAATTATTTTCCTTTGTCGCCCC TCCTTTTTCTGATTGATGGTTGTATTATTTTCTCTGA ATCCTCTTCACTGGCCAAAGGTTGGCAGATAGAGG CAACTCCCAGGCCAGTGAGCTTTACTTGCCGTGTA AAAGGAGGAAAGGGGTGGAAAAAAACCGACTTTC TGCATTTAACTACAAAAAAAGTTTATGTTTAGTTTG GTAGAGGTGTTATGTATAATGCTTTGTTAAAGAACC CCCTTTCCGTGCCACTGGTGAATAGGGATTGATGA ATGGGAAGAGTTGAGTCAGACCAGTAAGCCCGTC CTGGGTTCCTTGAACATGTTCCCATGTAGGAGGTA AAACCAATTCTGGAAGTGTCTATGAACTTCCATAAA TAACTTTAATTTTAGTA | 90 | LFPRLFQIF VIAVVSLVI LPRIVIFRR MPAITAVE VATLPRTA RSPRESES NAATTVAN QAIWLVTA TMQMSRN AILVENSDT FKKTAPK* |
| 1280 | NM_003418.2_261 | 261 | AATTCCAAACAGCCTCTACCTTGCGAGCCGTCTTC CCCAGGCCTGCGTCCGAGTCTCCGCCGCTGCGG GCCCGCTCCGACGCGGAAGATCTGACTGCAGCCA TGAGCAGCAATGAGTGCTTCAAGTGTGGACGATCT GGCCACTGGGCCCGGGAATGTCCTACTGGTGGAG GCCGTGGTCGTGGAATGAGAAGCCGTGGCAGAG GTGGTTTTACCTCGGATAGAGGTTTCCAGTTGTTT CCTCGTCTCTTCCAGATATTGTTATCGCTGTGGTG AGTCTGGTCATCTTGCCAAGGATTGTGATCTTCAG GAGGATGCCTGCTATAACTGCGGTAGAGGTGGCC ACATTGCCAAGGACTGCAAGGAGCCCAAGAGAGA GCGAGAGCAATGCTGCTACAACTGTGGCAAACCA GGCCATCTGGCTCGTGACTGCGACCATGCAGATG AGCAGAAATGCTATTCTTGTGGAGAATTCGGACAC ATTCAAAAAGACTGCACCAAAGTGAAGTGCTATAG GTGTGGTGAAACTGGTCATGTAGCCATCAACTGCA GCAAGACAAGTGAAGTCAACTGTTACCGCTGTGG CGAGTCAGGGCACCTTGCACGGGAATGCACAATT GAGGCTACAGCCTAATTATTTTCCTTTGTCGCCCC TCCTTTTTCTGATTGATGGTTGTATTATTTTCTCTGA ATCCTCTTCACTGGCCAAAGGTTGGCAGATAGAGG CAACTCCCAGGCCAGTGAGCTTTACTTGCCGTGTA AAAGGAGGAAAGGGGTGGAAAAAAACCGACTTTC TGCATTTAACTACAAAAAAAGTTTATGTTTAGTTTG GTAGAGGTGTTATGTATAATGCTTTGTTAAAGAACC CCCTTTCCGTGCCACTGGTGAATAGGGATTGATGA ATGGGAAGAGTTGAGTCAGACCAGTAAGCCCGTC CTGGGTTCCTTGAACATGTTCCCATGTAGGAGGTA AAACCAATTCTGGAAGTGTCTATGAACTTCCATAAA TAACTTTAATTTTAGTA | 81 | VIAVVSLVI LPRIVIFRR MPAITAVE VATLPRTA RSPRESES NAATTVAN QAIWLVTA TMQMSRN AILVENSDT FKKTAPK* |
| 1281 | NM_003610.3_371 | 371 | AGCAGTCGCTTAGTAACTTGCAGCGGCTACATCAA CTTTGGACCAATTCGCAAACTGCTGGTGTAAAGCG TTTTTGCGCATGTGCTGTCGCCTTGCGGGAAAAGG AGCCTTTTCTTCGACGATTTCCGGGCGACGCAGG AAGTGGCTCCAGGGCGCACGCGCGTTGTTTCCGC GGTAGTCAGGGCAGTTTCTACCGCAGGCTTAAGG AGGCTTCGGGCTCCTGGGATTTCTGTCCGCGCTC | 19 | LEPVGPAC LAVQLQTIT IP* |

TABLE 3A-continued

| SEQ ID | identifier_position | position | modified_RNA | PAP length | PAP |
|---|---|---|---|---|---|
| | | | CTGGCCCTCGTCCTTCGCGCCAGAGCAGGTTCGC<br>AAACTCCTCAGACCCTTCTGCTCCCGGCCGCCGC<br>TTTCCGCCGGGGCGAGACCCCCAGGTTCAAAATG<br>AGCCTGTTTGGAACAACCTCAGGTTTGGAACCAGT<br>GGGACCAGCATGTTTGGCAGTGCAACTACAGACA<br>ATCACAATCCCATGAAGGATATTGAAGTAACATCAT<br>CTCCTGATGATAGCATTGGTTGTCTGTCTTTTAGCC<br>CACCAACCTTGCCGGGGAACTTTCTTATTGCAGGA<br>TCATGGGCTAATGATGTTCGCTGCTGGGAAGTTCA<br>AGACAGTGGACAGACCATTCCAAAAGCCCAGCAG<br>ATGCACACTGGGCCTGTGCTTGATGTCTGCTGGA<br>GTGACGATGGGAGCAAAGTGTTTACGGCATCGTG<br>TGATAAAACTGCCAAAATGTGGGACCTCAGCAGTA<br>ACCAAGCGATACAGATCGCACAGCATGATGCTCCT<br>GTTAAAACCATCCATTGGATCAAAGCTCCAAACTA<br>CAGCTGTGTGATGACTGGGAGCTGGGATAAGACT<br>TTAAAGTTTTGGGATACTCGATCGTCAAATCCTATG<br>ATGGTTTTGCAACTCCCTGAAAGGTGTTACTGTGC<br>TGACGTGATATACCCCATGGCTGTGGTGGCAACTG<br>CAGAGAGGGGCCTGATTGTCTATCAGCTAGAGAAT<br>CAACCTTCTGAATTCAGGAGGATAGAATCTCCACT<br>GAAACATCAGCATCGGTGTGTGGCTATTTTTAAAG<br>ACAAACAGAACAAGCCT | | |
| 1282 | NM_0037<br>39.4_325 | 325 | GCCCATTGTTTTTGTAATCTCTGAGGAGAAGCAGC<br>AGCAAACATTTGCTAGTCAGACAAGTGACAGGGAA<br>TGGATTCCAAACACCAGTGTGTAAAGCTAAATGAT<br>GGCCACTTCATGCCTGTATTGGGATTTGGCACCTA<br>TGCACCTCCAGAGGTTCCGAGAAGTAAAGCTTTGG<br>AGGTCACAAAATTAGCAATAGAAGCTGGGTTCCGC<br>CATATAGATTCTGCTCATTTATACAATAATGAGGAG<br>CAGGTTGGACTGGCCATCCGAAGCAAGATTGCAG<br>ATGGCAGTGTGAAGAGAGAAGACATATTCTACACT<br>TCAAAGCTTGGTCCACTTTTCATCGACCAGAGTTG<br>GTCCGACCAGCCTTGGAAAAACTCACTGAAGAAAG<br>CTCAATTGGACTATGTTGACCTCTATCTTATTCATT<br>CTCCAATGTCTCTAAAGCCAGGTGAGGAACTTTCA<br>CCAACAGATGAAAATGGAAAAGTAATATTTGACATA<br>GTGGATCTCTGTACCACCTGGGAGGCCATGGAGA<br>AGTGTAAGGATGCAGGATTGGCCAAGTCCATTGG<br>GGTGTCAAACTTCAACCGCAGGCAGCTGGAGATG<br>ATCCTCAACAAGCCAGGACTCAAGTACAAGCCTGT<br>CTGCAACCAGGTAGAATGTCATCCGTATTTCAACC<br>GGAGTAAATTGCTAGATTTCTGCAAGTCGAAAGAT<br>ATTGTTCTGGTTGCCTATAGTGCTCTGGGATCTCA<br>ACGAGACAAACGATGGGTGGACCCGAACTCCCCG<br>GTGCTCTTGGAGGACCCAGTCCTTTGTGCCTTGGC<br>AAAAAAGCACAAGCGAACCCCAGCCCTGATTGCC<br>CTGCGCTACCAGCTGCAGCGTGGGGTTGTGGTCC<br>TGGCCAAGAGCTACAATGAGCAGCGCATCAGACA<br>GAACGTGCAGGTTTTTGAGTTCCAGTTGACTGCAG<br>AGGACATGAAAGCCATAGATGGCCTAGACAGAAAT<br>CTCCACTATTTTAACAGTGATAGTTTTGCTAGCCAC<br>CCTAATTATCCATA | 17 | GPLFIDQS<br>WSDQPWK<br>TH* |
| 1283 | NM_0037<br>51.3_145<br>3 | 1453 | TAGCCGTCGCGGCGCGCGGTGCGGCCTGGGAGA<br>GTCGGAAGCGCGGCGGCCGCGGAGCCCTGCGAG<br>TAGGCAGCGTTGGGCCCATGCAGGACGCGGAGAA<br>CGTGGCGGTGCCCGAGGCGGCCGAGGAGCGCGC<br>CGAGCCCGGCCAGCAGCAGCCGGCCGCCGAGCC<br>GCCGCCAGCCGAGGGGCTGCTGCGGCCCGCGGG<br>GCCCGGCGCTCCGGAGGCCGCGGGGACCGAGGC<br>CTCCAGTGAGGAGGTGGGGATCGCGGAGGCCGGG<br>GCCGGAGTCCGAGGTGAGGACCGAGCCGGCGGC<br>CGAGGCAGAGGCGGCCTCCGGCCCGTCCGAGTC<br>GCCCTCGCCGCCGGCCGCCGAGGAGCTGCCCGG<br>GTCGCATGCTGAGCCCCCTGTCCCGGCACAGGGC<br>GAGGCCCCAGGAGAGCAGGCTCGGGACGAGCGC<br>TCCGACAGCCGGGCCCAGGCGGTGTCCGAGGAC<br>GCGGGAGGAAACGAGGGCAGAGCGGCCGAGGCC<br>GAACCCCGGGCGCTGGAGAACGGCGACGCGGAC<br>GAGCCCTCCTTCAGCGACCCCGAGGACTTCGTGG<br>ACGACGTGAGCGAGGAAGAATTACTGGGAGATGT<br>ACTCAAAGATCGGCCCCAGGAAGCAGATGGAATC<br>GATTCGGTGATTGTAGTGGACAATGTCCCTCAGGT<br>GGGACCCGACCGACTTGAGAAACTCAAAAATGTCA<br>TCCACAAGATCTTTTCCAAGTTTGGGAAAATCACAA<br>ATGATTTTTATCCTGAAGAGGATGGGAAGACAAAA<br>GGGTATATTTTCCTGGAGTACGCGTCCCCTGCCCA | 5 | WTRRV* |

TABLE 3A-continued

| SEQ ID | identifier_ position | position | modified_RNA | PAP length | PAP |
|---|---|---|---|---|---|
| | | | CGCTGTGGATGCTGTGAAGAACGCCGACGGCTAC AAGCTTGACAAGCAGCACACATTCCGGGTCAACCT CTTTACGGATTTTGACAAGTATATGACGATCAGTG ACGAGTGGGATATTCCAGAGAAACAGCCTTTCAAA GACCTGGGGAACTTACGTTACTGGCTTGAAGAGG CAGAATGCAGAGATCAGTACAGTGTGATTTTTGAG AGTGGAGA | | |
| 1284 | NM_0037 52.3_449 | 449 | CTTCTCTCTCGGCGTTTCCGCTGTCAGGGCCCTGC GGTGTGACTCGCGGGCTCAGCTGGTCCGGCCGTA GCACCTCCGCGCCGTCGCCATGTCGCGGTTTTTC ACCACCGGTTCGGACAGCGAGTCCGAGTCGTCCT TGTCCGGGGAGGAGCTCGTCACCAAACCTGTCGG AGGCAACTATGGCAAACAGCCATTGTTGCTGAGC GAGGATGAAGAAGATACCAAGAGAGTTGTCCGCA GTGCCAAGGACAAGAGGTTTGAGGAGCTGACCAA CCTTATCCGGACCATCCGTAATGCCATGAAGATTC GTGATGTCACCAAGTGCCTGGAAGAGTTTGAGCTC CTGGGAAAAGCATATGGGAAGGCCAAAAGCATTG TGGACAAAGAAGGTGTCCCCCGGTTCTATATCCGC ATCCTGGCTGACCTAGAGGACTATCTTAATGAGCT TGGGAAGATAAGGAAGGGAAGAAGAAGATGAACA AGAACAATGCCAAGGCTCTGAGCACCTTGCGTCA GAAGATCCGAAAATACAACCGTGATTTCGAGTCCC ATATCACAAGCTACAAGCAGAACCCCGAGCAGTCT GCGGATGAAGATGCTGAGAAAAATGAGGAGGATT CAGAAGGCTCTTCAGATGAGGATGAGGATGAGGA CGGAGTCAGTGCTGCAACTTTCTTGAAGAAGAAAT CAGAAGCTCCTTCTGGGGAGAGTCGCAAGTTCCT CAAAAAGATGGATGATGAAGATGAGGACTCAGAAG ATTCCGAAGATGATGAAGACTGGGACACAGGTTCC ACATCTTCCGATTCCGACTCAGAGGAGGAAGAAG GGAAACAAACCGCGCTGGCCTCAAGATTTCTTAAA AAGGCACCCACCACAGATGAGGACAAGAAGGCAG CCGAGAAGAAACGGGAGGACAAAGCTAAGAAGAA GCACGACAGGAAATCCAAGCGCCTGGATGAGGAG GAGGAGGACAATGAAGGCGGGGAGTGGGAAAGG GTCCGGGGCGGAGTGCCGTTGGTTAAGG | 9 | GKIRKGRR R* |
| 1285 | NM_0037 53.3_354 | 354 | GGGAGAGCAGTTTACGACAGCGCCGGTCGTGTTT ACGGCGGCGCCCGCTGCGCGCGCATGTTTCCTCT TTTCCTGGTTTCTCAAGAGTGCTGCTGCTAACGCG GTCCCCGGCACGCACCATCTGTTGCCATCCCGGC CGGCCGAGGCCATTGCAGATTTTGGAAGATGGCA AAGTTCATGACACCCGTGATCCAGGACAACCCCTC AGGCTGGGGTCCCTGTGCGGTTCCCGAGCAGTTT CGGGATATGCCCTACCAGCCGTTCAGCAAAGGAG ATCGGCTAGGAAAGGTTGCAGACTGGACAGGAGC CACATACCAAGATAAGAGGTACACAAATAAGTACT CCTCTCAGTTGGTGGTGGAAGTCAATATGCTTATT TCCATGAGGAGGATGAAAGTAGCTTCCAGCTGGT GGATACAGCGCGCACACAGAAGACGGCCTACCAG CGGAATCGAATGAGATTTGCCCAGAGGAACCTCC GCAGAGACAAAGATCGTCGGAACATGTTGCAGTTC AACCTGCAGATCCTGCCTAAGAGTGCCAAACAGAA AGAGAGAGAACGCATTCGACTGCAGAAAAAGTTCC AGAAACAATTTGGGGTTAGGCAGAAATGGGATCAG AAATCACAGAAACCCCGAGACTCTTCAGTTGAAGT TCGTAGTGATTGGGAAGTGAAAGAGGAAATGGATT TTCCTCAGTTGATGAAGATGCGCTACTTGGAAGTA TCAGAGCCACAGGACATTGAGTGTTGTGGGGCCC TAGAATACTACGACAAAGCCTTTGACCGCATCACC ACGAGGAGTGAGAAGCCACTGCGGAGCATCAAGC GCATCTTCCACACTGTCACCACCACAGACGACCCT GTCATCCGCAAGCTGGCAAAAACTCAGGGGAATG TGTTTGCCACTGATGCCATCCTGGCCACGCTGATG AGCTGTACCCGCTCAGTGTATTCCTGGGATATTGT CGTCCAGAGAGTTGGGTCCAAACTCTTCTTTGACA AGAGAGAGACAACTCTGACTTTGA | 35 | LVVEVNML ISMRRMKV ASSWWIQ RAHRRRPT SGIE* |
| 1286 | NM_0037 53.3_441 | 441 | GGGAGAGCAGTTTACGACAGCGCCGGTCGTGTTT ACGGCGGCGCCCGCTGCGCGCGCATGTTTCCTCT TTTCCTGGTTTCTCAAGAGTGCTGCTGCTAACGCG GTCCCCGGCACGCACCATCTGTTGCCATCCCGGC CGGCCGAGGCCATTGCAGATTTTGGAAGATGGCA AAGTTCATGACACCCGTGATCCAGGACAACCCCTC AGGCTGGGGTCCCTGTGCGGTTCCCGAGCAGTTT CGGGATATGCCCTACCAGCCGTTCAGCAAAGGAG ATCGGCTAGGAAAGGTTGCAGACTGGACAGGAGC CACATACCAAGATAAGAGGTACACAAATAAGTACT | 5 | TSGIE* |

TABLE 3A-continued

| SEQ ID | identifier_position | position | modified_RNA | PAP length | PAP |
|---|---|---|---|---|---|
| | | | CCTCTCAGTTTGGTGGTGGAAGTCAATATGCTTAT TTCCATGAGGAGGATGAAAGTAGCTTCCAGCTGGT GGATACAGCGCGCACACAGAAGACGGCTACCAGC GGAATCGAATGAGATTTGCCCAGAGGAACCTCCG CAGAGACAAAGATCGTCGGAACATGTTGCAGTTCA ACCTGCAGATCCTGCCTAAGAGTGCCAAACAGAAA GAGAGAGAACGCATTCGACTGCAGAAAAAGTTCCA GAAACAATTTGGGGTTAGGCAGAAATGGGATCAGA AATCACAGAAACCCCGAGACTCTTCAGTTGAAGTT CGTAGTGATTGGGAAGTGAAAGAGGAAATGGATTT TCCTCAGTTGATGAAGATGCGCTACTTGGAAGTAT CAGAGCCACAGGACATTGAGTGTTGTGGGGCCCT AGAATACTACGACAAAGCCTTTGACCGCATCACCA CGAGGAGTGAGAAGCCACTGCGGAGCATCAAGCG CATCTTCCACACTGTCACCACCACAGACGACCCTG TCATCCGCAAGCTGGCAAAAACTCAGGGGAATGT GTTTGCCACTGATGCCATCCTGGCCACGCTGATGA GCTGTACCCGCTCAGTGTATTCCTGGGATATTGTC GTCCAGAGAGTTGGGTCCAAACTCTTCTTTGACAA GAGAGACAACTCTGACTTTGA | | |
| 1287 | NM_0037 53.3_597 | 597 | GGGAGAGCAGTTTACGACAGCGCCGGTCGTGTTT ACGGCGGCGCCCGCTGCGCGCGCATGTTTCCTCT TTTCCTGGTTTCTCAAGAGTGCTGCTGCTAACGCG GTCCCCGGCACGCACCATCTGTTGCCATCCCGGC CGGCCGAGGCCATTGCAGATTTTGGAAGATGGCA AAGTTCATGACACCCGTGATCCAGGACAACCCCTC AGGCTGGGGTCCCTGTGCGGTTCCCGAGCAGTTT CGGGATATGCCCTACCAGCCGTTCAGCAAAGGAG ATCGGCTAGGAAAGGTTGCAGACTGGACAGGAGC CACATACCAAGATAAGAGGTACACAAATAAGTACT CCTCTCAGTTTGGTGGTGGAAGTCAATATGCTTAT TTCCATGAGGAGGATGAAAGTAGCTTCCAGCTGGT GGATACAGCGCGCACACAGAAGACGGCCTACCAG CGGAATCGAATGAGATTTGCCCAGAGGAACCTCC GCAGAGACAAAGATCGTCGGAACATGTTGCAGTTC AACCTGCAGATCCTGCCTAAGAGTGCCAAACAGAA AGAGAGAGAACGCATTCGACTGCAGAAAAAGTTCC AGAAACAATTTGGGGTTAGGCAGAAATGGGATCAG AAATCACAGAAACCCCGAGACTCTTCAGTTGAAGT TCGTAGTGATTGGGAAGTGAAAGAGGAAATGGATT TTCCTCAGTTGATGAAGATGCGCTACTTGGAAGTA TCAGAGCCACAGGACATTGAGTGTTGTGGGGCCC TAGAATACTACGACAAAGCCTTTGACCGCATCACC ACGAGGAGTGAGAAGCCACTGCGGAGCATCAAGC GCATCTTCCACACTGTCACCACCACAGACGACCCT GTCATCCGCAAGCTGGCAAAAACTCAGGGGAATG TGTTTGCCACTGATGCCATCCTGGCCACGCTGATG AGCTGTACCCGCTCAGTGTATTCCTGGGATATTGT CGTCCAGAGAGTTGGGTCCAAACTCTTCTTTGACA AGAGAGACAACTCTGACTTTGA | 26 | LGLGRNGI RNHRNPET LQLKFVVIG K* |
| 1288 | NM_0037 54.2_101 | 101 | ATTTCCGCTTCCGCCTCCTTCTTTCTCGACAAGAT GGCCACACCGGCGGTACCAGTAAGTGCTCCTCCG GCCACGCCAACCCCAGTCCCGGCGGCGGCCCAG CCTCAGTTCCAGCGCCAACGCCAGCACCGGCTGC GGCTCCGGTTCCCGCTGCGGCTCCAGCCTCATCC TCAGACCCTGCGGCAGCAGCGGCTGCAACTGCGG CTCCTGGCCAGACCCCGGCCTCAGCGCAAGCTCC AGCGCAGACCCCAGCGCCCGCTCTGCCTGGTCCT GCTCTTCCAGGGGCCCTTCCCCGGCGGCCGCGTGG TCAGGCTGCACCCAGTCATTTTGGCCTCCATTGTG GACAGCTACGAGAGACGCAACGAGGGTGCTGCCC GAGTTATCGGGACCCTGTTGGGAACTGTCGACAA ACACTCAGTGGAGGTCACCAATTGCTTTTCAGTGC CGCACAATGAGTCAGAAGATGAAGTGGCTGTTGA CATGGAATTTGCTAAGAATATGTATGAACTGCATAA AAAAGTTTCTCCAAATGAGCTCATCCTGGGCTGGT ACGCTACGGGCCATGACATCACAGAGCACTCTGT GCTGATCCACGAGTACTACAGCCGAGAGGCCCCC AACCCCATCCACCTCACTGTGGACACAAGTCTCCA GAACGGCCGCATGAGCATCAAAGCCTACGTCAGC ACTTTAATGGGAGTCCCTGGGAGGACCATGGGAG TGATGTTCACGCCTCTGACAGTGAAATACGCGTAC TACGACACTGAACGCATCGGAGTTGACCTGATCAT GAAGACCTGCTTTAGCCCCAACAGAGTGATTGGAC TCTCAAGTGACTTGCAGCAAGTAGGAGGGGCATC AGCTCGCATCCAGGATGCCCTGAGTACAGTGTTG CAATATGCAGAGGATGTACTGTCTGGAAAGGTGTC | 162 | QPQFQRQ RQHRLRLR FPLRLQPH PQTLRQQ RLQLRLLA RPRPQRKL QRRPQRP LCLVLLFQ GPSPAAA WSGCTQS FWPPLWT ATRDATRV LPELSGPC WELSTNTQ WRSPIAFQ CRTMSQK MKWLLTW NLLRICMN CIKKFLQM SSSWAGTL RAMTSQST LC* |

TABLE 3A-continued

| SEQ ID | identifier_ position | position | modified_RNA | PAP length | PAP |
|---|---|---|---|---|---|
| 1289 | NM_0037 56.2_229 | 229 | AGCTGACAATACTGTGGGCCGCTTCCTGATGAGC CTGGTTAACCAAGTACCGAAAATAGTTCCCGATGA CTTTGAGACCATGCTCAACAGCAACAT CTCTTTCTTCCTGTCTGCTTGGAAAGATGGCGTCC CGCAAGGAAGGTACCGGCTCTACTGCCACCTCTT CCAGCTCCACCGCCGGCGCAGCAGGGAAAGGCA AAGGCAAAGGCGGCTCGGGAGATTCAGCCGTGAA GCAAGTGCAGATAGATGGCCTTGTGGTATTAAAGA TAATCAAACATTATCAAGAAGAAGGACAAGGAACT GAAGTTGTTCAAGGAGTGCTTTGGGTCTGGTTGTA GAAGATCGGCTTGAAATTACCAACTGCTTTCCTTTC CCTCAGCACACAGAGGATGATGCTGACTTTGATGA AGTCCAATATCAGATGGAAATGATGCGGAGCCTTC GCCATGTAAACATTGATCATCTTCACGTGGGCTGG TATCAGTCCACATACTATGGCTCATTCGTTACCCG GGCACTCCTGGACTCTCAGTTTAGTTACCAGCATG CCATTGAAGAATCTGTCGTTCTCATTTATGATCCCA TAAAAAACTGCCCAAGGATCTCTCTCACTAAAGGCA TACAGACTGACTCCTAAACTGATGGAAGTTTGTAA AGAAAAGGATTTTTCCCCTGAAGCATTGAAAAAAG CAAATATCACCTTTGAGTACATGTTTGAAGAAGTG CCGATTGTAATTAAAAATTCACATCTGATCAATGTC CTAATGTGGGAACTTGAAAAGAAGTCAGCTGTTGC AGATAAACATGAATTGCTCAGCCTTGCCAGCAGCA ATCATTTGGGGAAGAATCTACAGTTGCTGATGGAC AGAGTGGATGAAATGAGCCAAGATATAGTTAAATA CAACACATACATGAGGAATACTAGTAAACAACAGC AGCAGAAACATCAGTATCAGCAGCGTCGCCAGCA GGAGAATATGCAGCGCCAGAGCCGAGGAGAACCC CCGCTCCCTGAGGAGGACCTGTCCAAACTCTTCAA ACCACCACAGCCGCCTGCCAGGATGGACTCGCTG CTCATTGCAGGCCAGATAAACACTTACTGCCAGAA CATCAAGGAGTTC | 4 | WVWL* |
| 1290 | NM_0037 56.2_555 | 555 | CTCTTTCTTCCTGTCTGCTTGGAAAGATGGCGTCC CGCAAGGAAGGTACCGGCTCTACTGCCACCTCTT CCAGCTCCACCGCCGGCGCAGCAGGGAAAGGCA AAGGCAAAGGCGGCTCGGGAGATTCAGCCGTGAA GCAAGTGCAGATAGATGGCCTTGTGGTATTAAAGA TAATCAAACATTATCAAGAAGAAGGACAAGGAACT GAAGTTGTTCAAGGAGTGCTTTTGGGTCTGGTTGT AGAAGATCGGCTTGAAATTACCAACTGCTTTCCTTT CCCTCAGCACACAGAGGATGATGCTGACTTTGATG AAGTCCAATATCAGATGGAAATGATGCGGAGCCTT CGCCATGTAAACATTGATCATCTTCACGTGGGCTG GTATCAGTCCACATACTATGGCTCATTCGTTACCC GGGCACTCCTGGACTCTCAGTTTAGTTACCAGCAT GCCATTGAAGAATCTGTCGTTCTCATTTATGATCCC ATAAAAAACTGCCCAAGGATCTCTCTCACTAAAGGC ATACAGACTGACTCCTAAACTGATGGAAGTTGTAA AGAAAAGGATTTTTCCCCTGAAGCATTGAAAAAAG CAAATATCACCTTTGAGTACATGTTTGAAGAAGTG CCGATTGTAATTAAAAATTCACATCTGATCAATGTC CTAATGTGGGAACTTGAAAAGAAGTCAGCTGTTGC AGATAAACATGAATTGCTCAGCCTTGCCAGCAGCA ATCATTTGGGGAAGAATCTACAGTTGCTGATGGAC AGAGTGGATGAAATGAGCCAAGATATAGTTAAATA CAACACATACATGAGGAATACTAGTAAACAACAGC AGCAGAAACATCAGTATCAGCAGCGTCGCCAGCA GGAGAATATGCAGCGCCAGAGCCGAGGAGAACCC CCGCTCCCTGAGGAGGACCTGTCCAAACTCTTCAA ACCACCACAGCCGCCTGCCAGGATGGACTCGCTG CTCATTGCAGGCCAGATAAACACTTACTGCCAGAA CATCAAGGAGTTC | 10 | VKKRIFPLK H* |
| 1291 | NM_0037 56.2_598 | 598 | CTCTTTCTTCCTGTCTGCTTGGAAAGATGGCGTCC CGCAAGGAAGGTACCGGCTCTACTGCCACCTCTT CCAGCTCCACCGCCGGCGCAGCAGGGAAAGGCA AAGGCAAAGGCGGCTCGGGAGATTCAGCCGTGAA GCAAGTGCAGATAGATGGCCTTGTGGTATTAAAGA TAATCAAACATTATCAAGAAGAAGGACAAGGAACT GAAGTTGTTCAAGGAGTGCTTTTGGGTCTGGTTGT AGAAGATCGGCTTGAAATTACCAACTGCTTTCCTTT CCCTCAGCACACAGAGGATGATGCTGACTTTGATG AAGTCCAATATCAGATGGAAATGATGCGGAGCCTT CGCCATGTAAACATTGATCATCTTCACGTGGGCTG GTATCAGTCCACATACTATGGCTCATTCGTTACCC GGGCACTCCTGGACTCTCAGTTTAGTTACCAGCAT GCCATTGAAGAATCTGTCGTTCTCATTTATGATCCC | 13 | ISPLSTCLK KCRL* |

TABLE 3A-continued

| SEQ ID | identifier_position | position | modified_RNA | PAP length | PAP |
|---|---|---|---|---|---|
| | | | ATAAAAACTGCCCAAGGATCTCTCTCACTAAAGGC ATACAGACTGACTCCTAAACTGATGGAAGTTTGTA AAGAAAAGGATTTTTCCCCTGAAGCATTGAAAAAA GCAATATCACCTTTGAGTACATGTTTGAAGAAGTG CCGATTGTAATTAAAAATTCACATCTGATCAATGTC CTAATGTGGGAACTTGAAAAGAAGTCAGCTGTTGC AGATAAACATGAATTGCTCAGCCTTGCCAGCAGCA ATCATTTGGGGAAGAATCTACAGTTGCTGATGGAC AGAGTGGATGAAATGAGCCAAGATATAGTTAAATA CAACACATACATGAGGAATACTAGTAAACAACAGC AGCAGAAACATCAGTATCAGCAGCGTCGCCAGCA GGAGAATATGCAGCGCCAGAGCCGAGGAGAACCC CCGCTCCCTGAGGAGGACCTGTCCAAACTCTTCAA ACCACCACAGCCGCCTGCCAGGATGGACTCGCTG CTCATTGCAGGCCAGATAAACACTTACTGCCAGAA CATCAAGGAGTTC | | |
| 1292 | NM_0037 57.2_375 | 375 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTGACTT TGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACC AGTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 21 | LTLGATSS CSPRTSR WATSAL* |
| 1293 | NM_0037 57.2_435 | 435 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGAC CTGCGGGATCCGAGCCAGATTGACAACAATGAGC CCTACATGAAGATCCCTTGCAATGACTCTAAAATC ACCAGTGCTGTTTGGGGACCCCTGGGGGAGTGCA TCATCGCTGGCCATGAGAGTGGAGAGCTCAACCA GTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 1 | L* |

TABLE 3A-continued

| SEQ ID | identifier_position | position | modified_RNA | PAP length | PAP |
|---|---|---|---|---|---|
| 1294 | NM_0037 57.2_447 | 447 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTGAC CTGCGGGATCCGAGCCAGATTGACAACAATGAGC CCTACATGAAGATCCCTTGCAATGACTCTAAAATC ACCAGTGCTGTTTGGGGACCCCTGGGGGAGTGCA TCATCGCTGGCCATGAGAGTGGAGAGCTCAACCA GTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 15 | LTCGIRAR LTTMSPT* |
| 1295 | NM_0037 57.2_532 | 532 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTGGGGACCCCTGGGGGAGTGCA TCATCGCTGGCCATGAGAGTGGAGAGCTCAACCA GTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 28 | GDPWGSA SSLAMRVE SSTSIVPSL ERCW* |
| 1296 | NM_0037 57.2_565 | 565 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCATGAGAGTGGAGAGCTCAACCA | 17 | MRVESSTS IVPSLERC W* |

TABLE 3A-continued

| SEQ ID | identifier_ position | position | modified_RNA | PAP length | PAP |
|---|---|---|---|---|---|
| | | | GTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | | |
| 1297 | NM_0037 57.2_586 | 586 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACA GTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 10 | SIVPSLER CW* |
| 1298 | NM_0037 57.2_614 | 614 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACC AGTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCAC AACTCTTGAACATCAGAAGACTTTCCGGACAGAAC GTCCTGTCAACTCAGCTGCCCTCTCCCCCAACTAT GACCATGTGGTCCTGGGCGGTGGTCAGGAAGCCA TGGATGTAACCACAACCTCCACCAGGATTGGCAAG TTTGAGGCCAGGTTCTTCCATTTGGCCTTTGAAGA AGAGTTTGGAAGAGTCAAGGGTCACTTTGGACCTA TCAACAGTGTTGCCTTCCATCCTGATGGCAAGAGC TACAGCAGCGGCGGCGAAGATGGTTACGTCCGTA TCCATTACTTCGACCCACAGTA | 1 | W* |
| 1299 | NM_0037 57.2_667 | 667 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG | 1 | T* |

TABLE 3A-continued

| SEQ ID | identifier_ position | position | modified_RNA | PAP length | PAP |
|---|---|---|---|---|---|
| | | | ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACC AGTATAGTGCCAAGTCTGGAGAGGTGTTGGTGAAT GTTAAGGAGCACTCCCGGCAGATCAACGACATCC AGTTATCCAGGACATGACCATGTTTGTGACCGCGT CCAAGGACAACACAGCCAAGCTTTTTGACTCCACA ACTCTTGAACATCAGAAGACTTTCCGGACAGAACG TCCTGTCAACTCAGCTGCCCTCTCCCCCAACTATG ACCATGTGGTCCTGGGCGGTGGTCAGGAAGCCAT GGATGTAACCACAACCTCCACCAGGATTGGCAAGT TTGAGGCCAGGTTCTTCCATTTGGCCTTTGAAGAA GAGTTTGGAAGAGTCAAGGGTCACTTTGGACCTAT CAACAGTGTTGCCTTCCATCCTGATGGCAAGAGCT ACAGCAGCGGCGGCGAAGATGGTTACGTCCGTAT CCATTACTTCGACCCACACAGTA | | |
| 1300 | NM_0037 57.2_693 | 693 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACC AGTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCAAGGACAACACAGCCAAGCTTTTTGACTCCACA ACTCTTGAACATCAGAAGACTTTCCGGACAGAACG TCCTGTCAACTCAGCTGCCCTCTCCCCCAACTATG ACCATGTGGTCCTGGGCGGTGGTCAGGAAGCCAT GGATGTAACCACAACCTCCACCAGGATTGGCAAGT TTGAGGCCAGGTTCTTCCATTTGGCCTTTGAAGAA GAGTTTGGAAGAGTCAAGGGTCACTTTGGACCTAT CAACAGTGTTGCCTTCCATCCTGATGGCAAGAGCT ACAGCAGCGGCGGCGAAGATGGTTACGTCCGTAT CCATTACTTCGACCCACACAGTA | 47 | RTTQPSFL TPQLLNIR RLSGQNVL STQLPSPP TMTMWSW AWRKPW M* |
| 1301 | NM_0037 57.2_708 | 708 | ATAATCCGGAAGTGACCTCGAAACCTTTTCCGGTC TTACTCACGTTGCGGCCTTCCTCGCGTCACAGCCG GGATGAAGCCGATCCTACTGCAGGGCCATGAGCG GTCCATTACGCAGATTAAGTATAACCGCGAAGGAG ACCTCCTCTTTACTGTGGCCAAGGACCCTATCGTC AATGTATGGTACTCTGTGAATGGTGAGAGGCTGG GCACCTACATGGGCCATACCGGAGCTGTGTGGTG TGTGGACGCTGACTGGGACACCAAGCATGTCCTC ACTGGCTCAGCTGACAACAGCTGTCGTCTCTGGG ACTGTGAAACAGGAAAGCAGCTGGCCCTTCTCAA GACCAATTCGGCTGTCCGGACCTGCGGTTTTGACT TTGGGGGCAACATCATCATGTTCTCCACGGACAAG CAGATGGGCTACCAGTGCTTTGTGAGCTTTTTTGA CCTGCGGGATCCGAGCCAGATTGACAACAATGAG CCCTACATGAAGATCCCTTGCAATGACTCTAAAAT CACCAGTGCTGTTTGGGGACCCCTGGGGGAGTGC ATCATCGCTGGCCATGAGAGTGGAGAGCTCAACC AGTATAGTGCCAAGTCTGGAGAGGTGTTGGTGAAT GTTAAGGAGCACTCCCGGCAGATCAACGACATCC AGTTATCCAGGGACATGACCATGTTTGTGACCGCG TCCAAGGACAACACAGCCAAGCTTTTTGACTCCACA | 42 | SFLTPQLL NIRRLSGQ NVLSTQLP SPPTMTM WSWAVVR KPWM* |

TABLE 3A-continued

| SEQ ID | identifier_position | position | modified_RNA | PAP length | PAP |
|---|---|---|---|---|---|
| | | | ACTCTTGAACATCAGAAGACTTTCCGGACAGAACG TCCTGTCAACTCAGCTGCCCTCTCCCCCAACTATG ACCATGTGGTCCTGGGCGGTGGTCAGGAAGCCAT GGATGTAACCACAACCTCCACCAGGATTGGCAAGT TTGAGGCCAGGTTCTTCCATTTGGCCTTTGAAGAA GAGTTTGGAAGAGTCAAGGGTCACTTTGGACCTAT CAACAGTGTTGCCTTCCATCCTGATGGCAAGAGCT ACAGCAGCGGCGGCGAAGATGGTTACGTCCGTAT CCATTACTTCGACCCACAGTA | | |
| 1302 | NM_0038 49.2_420 | 420 | TTTCTAGGAAGGAGCCGAGTTATTATCTGCCTCTC CGATAGGATGCCTCTTTGTCTTCACCTGCCATTCC CGCTGTTTCGTGAAGAATCCTCTGTAAAGGGAAAT TTGTTCAGGCGACTGCTGTGGCCACCCTCTGCCTC CTCCGGCCTCTGCCCCTGGGAGGTCCCCGGGGG CCTGGGAGTGTCATTGGCGTATGACCGCAACCCTT GCCGCTGCCGCTGACATCGCTACCATGGTCTCCG GCAGCAGCGGCCTCGCCGCCGCCCGTCTCCTGTC GCGCAGCTTCCTCCTGCCGCAGAATGGAATTCGG CATTGTTCCTACACAGCTTCTCGGCAACATCTCTAT GTTGATAAAAATACAAAGATTATTTGCCAGGGTTTC ACTGGCAAACAGGGCACCTTTCACAGCCAGCAGG CATGGAATATGGCACCAAACTCGTTGGAGGAACCA CTCCAGGGAAAGGAGGCCAGACACATCTGGGCTT ACCTGTCTTTAATACTGTGAAGGAGGCCAAAGAAC AGACAGGAGCAACGGCTTCTGTCATTTATGTTCCT CCGCCTTTTGCTGCTGCTGCCATTAATGAAGCTAT TGAGGCAGAAATTCCCTTGGTTGTGTGTATCACTG AAGGAATTCCCCAGCAGGACATGGTACGAGTCAA GCACAAACTGCTGCGCCAGGAAAAGACAAGGCTA ATTGGGCCCAACTGCCCTGGAGTCATCAATCCTGG AGAATGTAAAATTGGCATCATGCCTGGCCATATTC ACAAAAAAGGAAGGATTGGCATTGTGTCCAGATCT GGCACCCTGACTTATGAAGCAGTTCACCAAACAAC GCAAGTTGGATTGGGGCAGTCTTTGTGCGTTGGC ATTGGAGGTGATCCTTTTAATGGAACAGATTTTATT GACTGCCTCGAAATCTTTTTGAACGATTCTGCCAC AGAAGGCATCATATTGATTGGTGAAATTGGTGGTA ATGCAGAAGAGAATGCTGCAGAATTTTTGAAGCAA CATAATTCAGGTCCAA | 28 | WNMAPNS LEEPLQGK EARNIWAY LSLIL* |
| 1303 | NM_0038 49.2_460 | 460 | TTTCTAGGAAGGAGCCGAGTTATTATCTGCCTCTC CGATAGGATGCCTCTTTGTCTTCACCTGCCATTCC CGCTGTTTCGTGAAGAATCCTCTGTAAAGGGAAAT TTGTTCAGGCGACTGCTGTGGCCACCCTCTGCCTC CTCCGGCCTCTGCCCCTGGGAGGTCCCCGGGGG CCTGGGAGTGTCATTGGCGTATGACCGCAACCCTT GCCGCTGCCGCTGACATCGCTACCATGGTCTCCG GCAGCAGCGGCCTCGCCGCCGCCCGTCTCCTGTC GCGCAGCTTCCTCCTGCCGCAGAATGGAATTCGG CATTGTTCCTACACAGCTTCTCGGCAACATCTCTAT GTTGATAAAAATACAAAGATTATTTGCCAGGGTTTC ACTGGCAAACAGGGCACCTTTCACAGCCAGCAGG CATGGAATATGGCACCAAACTCGTTGGAGGAACC ACTCCAGGAAAGGAGGCCAGACACATCTGGGCTT ACCTGTCTTTAATACTGTGAAGGAGGCCAAAGAAC AGACAGGAGCAACGGCTTCTGTCATTTATGTTCCT CCGCCTTTTGCTGCTGCTGCCATTAATGAAGCTAT TGAGGCAGAAATTCCCTTGGTTGTGTGTATCACTG AAGGAATTCCCCAGCAGGACATGGTACGAGTCAA GCACAAACTGCTGCGCCAGGAAAAGACAAGGCTA ATTGGGCCCAACTGCCCTGGAGTCATCAATCCTGG AGAATGTAAAATTGGCATCATGCCTGGCCATATTC ACAAAAAAGGAAGGATTGGCATTGTGTCCAGATCT GGCACCCTGACTTATGAAGCAGTTCACCAAACAAC GCAAGTTGGATTGGGGCAGTCTTTGTGCGTTGGC ATTGGAGGTGATCCTTTTAATGGAACAGATTTTATT GACTGCCTCGAAATCTTTTTGAACGATTCTGCCAC AGAAGGCATCATATTGATTGGTGAAATTGGTGGTA ATGCAGAAGAGAATGCTGCAGAATTTTTGAAGCAA CATAATTCAGGTCCAA | 13 | EARNIWAY LSLIL* |
| 1304 | NM_0038 59.1_222 | 222 | ATGGCCTCCTTGGAAGTCAGTCGTAGTCCTCGCAG GTCTCGGCGGGAGCTGGAAGTGCGCAGTCCACGA CAGAACAAATATTCGGTGCTTTTACCTACCTACAAC GAGCGCGAGAACCTGCCGCTCATCGTGTGGCTGC TGGTGAAAAGCTTCTCCGAGAGTGGAATCAACTAT GAAATTATAATCATAGATGATGGAAGCCCAGATGG AACAAGGGATGTGCTGAACAGTTGGAGAAGATCTA TGGGTCAGACAGAATTCTTCTAAGACCACGAGAGA | 14 | LNSWRRS MGQTEFF* |

TABLE 3A-continued

| SEQ ID | identifier_position | position | modified_RNA | PAP length | PAP |
|---|---|---|---|---|---|
| | | | AAAAGTTGGGACTAGGAACTGCATATATTCATGGA<br>ATGAAACATGCCACAGGAAACTACATCATTATTATG<br>GATGCTGATCTCTCACACCATCCAAAATTTATTCCT<br>GAATTTATTAGGAAGCAAAAGGAGGGTAATTTTGA<br>TATTGTCTCTGGAACTCGCTACAAAGGAAATGGAG<br>GTGTATATGGCTGGGATTTGAAAAGAAAAATAATC<br>AGCCGTGGGGCCAATTTTTTAACTCAGATCTTGCT<br>GAGACCAGGAGCATCTGATTTAACAGGAAGTTTCA<br>GATTATACCGAAAAGAAGTTCTAGAGAAATTAATAG<br>AAAAATGTGTTTCTAAAGGCTACGTCTTCCAGATG<br>GAGATGATTGTTCGGGCAAGACAGTTGAATTATAC<br>TATTGGCGAGGTTCCAATATCATTTGTGGATCGTG<br>TTTATGGTGAATCCAAGTTGGGAGGAAATGAAATA<br>GTATCTTTCTTGAAAGGATTATTGACTCTTTTTGCT<br>ACTACATAAAAGAAAGATACTCATTTATAGTTACGT<br>TCATTTCAGGTTAAACATGAAAGAAGCCTGGTTAC<br>TGATTTGTATAAAATGTACTCTTAAAGTATAAAATAT<br>AAGGTAAGGTAAATTTCATGCATCTTTTTATGAAGA<br>CCACCTATTTTATATTTCAAATTAAATAATTTTAAAG<br>TTGCTGGCCTAATGAGCAATGTTCTCAATTTTCGTT<br>TTCATTTTGCTGTATTGAGACCTATAAATAAATG | | |
| 1305 | NM_003859.1420 | 420 | ATGGCCTCCTTGGAAGTCAGTCGTAGTCCTCGCAG<br>GTCTCGGCGGGAGCTGGAAGTGCGCAGTCCACGA<br>CAGAACAAATATTCGGTGCTTTTACCTACCTACAAC<br>GAGCGCGAGAACCTGCCGCTCATCGTGTGGCTGC<br>TGGTGAAAAGCTTCTCCGAGAGTGGAATCAACTAT<br>GAAATTATAATCATAGATGATGGAAGCCCAGATGG<br>AACAAGGGATGTTGCTGAACAGTTGGAGAAGATCT<br>ATGGGTCAGACAGAATTCTTCTAAGACCACGAGAG<br>AAAAAGTTGGGACTAGGAACTGCATATATTCATGG<br>AATGAAACATGCCACAGGAAACTACATCATTATTAT<br>GGATGCTGATCTCTCACACCATCCAAAATTTATTCC<br>TGAATTTATTAGGAAGCAAAAGGAGGGTAATTTGA<br>TATTGTCTCTGGAACTCGCTACAAAGGAAATGGAG<br>GTGTATATGGCTGGGATTTGAAAAGAAAAATAATC<br>AGCCGTGGGGCCAATTTTTTAACTCAGATCTTGCT<br>GAGACCAGGAGCATCTGATTTAACAGGAAGTTTCA<br>GATTATACCGAAAAGAAGTTCTAGAGAAATTAATAG<br>AAAAATGTGTTTCTAAAGGCTACGTCTTCCAGATG<br>GAGATGATTGTTCGGGCAAGACAGTTGAATTATAC<br>TATTGGCGAGGTTCCAATATCATTTGTGGATCGTG<br>TTTATGGTGAATCCAAGTTGGGAGGAAATGAAATA<br>GTATCTTTCTTGAAAGGATTATTGACTCTTTTTGCT<br>ACTACATAAAAGAAAGATACTCATTTATAGTTACGT<br>TCATTTCAGGTTAAACATGAAAGAAGCCTGGTTAC<br>TGATTTGTATAAAATGTACTCTTAAAGTATAAAATAT<br>AAGGTAAGGTAAATTTCATGCATCTTTTTATGAAGA<br>CCACCTATTTTATATTTCAAATTAAATAATTTTAAAG<br>TTGCTGGCCTAATGAGCAATGTTCTCAATTTTCGTT<br>TTCATTTTGCTGTATTGAGACCTATAAATAAATG | 19 | LILSLELAT<br>KEMEVYM<br>AGI* |
| 1306 | NM_003900.3_372 | 372 | CGACCGGGACGGCCCGTTTTCCGCCAGCTCGCCG<br>CTCGCTATGGCGTCGCTCACCGTGAAGGCCTACC<br>TTCTGGGCAAGGAGGACGCGGCGCGCGAGATTC<br>GCCGCTTCAGCTTCTGCTGCAGCCCCGAGCCTGA<br>GGCGGAAGCCGAGGCTGCGGCGGGTCCGGGACC<br>CTGCGAGCGGCTGCTGAGCGGGTGGCCGCCCT<br>GTTCCCCGCGCTGCGGCCTGGCGGCTTCCAGGC<br>GCACTACCGCGATGAGGACGGGGACTTGGTTGCC<br>TTTTCCAGTGACGAGGAATTGACAATGGCCATGTC<br>CTACGTGAAGGATGACATCTTCCGAATCTACATTA<br>AAGAGAAAAAAGAGTGCCGGCGGGACCACCGCCA<br>CCGTGTGCTCAGGAGGCGCCCCGCAACATGGTGC<br>ACCCCAATGTGATCTGCGATGGCTGCAATGGGCC<br>TGTGGTAGGAACCCGCTACAAGTGCAGCGTCTGC<br>CCAGACTACGACTTGTGTAGCGTCTGCGAGGGAA<br>AGGGCTTGCACCGGGGGCACACCAAGCTCGCATT<br>CCCCAGCCCCTTCGGGCACCTGTCTGAGGGCTTC<br>TCGCACAGCCGCTGGCTCCGGAAGGTGAAACACG<br>GACACTTCGGGTGGCCAGGATGGGAAATGGGTCC<br>ACCAGGAAACTGGAGCCCACGTCCTCCTCGTGCA<br>GGGGAGGCCCGCCCTGGCCCCACGGCAGAATCA<br>GCTTCTGGTCCATCGGAGGATCCGAGTGTGAATTT<br>CCTGAAGAACGTTGGGGAGAGTGTGGCAGCTGCC<br>CTTAGCCCTCTGGGCATTGAAGTTGATATCGATGT<br>GGAGCACGGAGGGAAAAGAAGCCGCCTGACCCC<br>CGTCTCTCCAGAGAGTTCCAGCACAGAGGAGAAG<br>AGCAGCTCACAGCCAAGCAGCTGCTGCTCTGACC | 15 | HRVLRRRP<br>ATWCTPM* |

TABLE 3A-continued

| SEQ ID | identifier_position | position | modified_RNA | PAP length | PAP |
|---|---|---|---|---|---|
| | | | CCAGCAAGCCGGGTGGGAATGTTGAGGGCGCCA CGCAGTCTCTGGCGGAGCAGATGAGGAAGATCGC CTTGGAGTCCGAGGGGCGCCCTGAGGAACAGATG GAGTCGG | | |
| 1307 | NM_0039 45.3_255 | 255 | AGGCGGGGCTTGCACACGCTGGTCACGCGGTCA GCTATTGACACTTCCTGGTGGGATCCGAGTGAGG CGACGGGGTAGGGGTTGGCGCTCAGGCGGCGAC CATGGCGTATCACGGCCTCACTGTGCCTCTCATTG TGATGAGCGTGTTCTGGGGCTTCGTCGGCTTCTTG GTGCCTTGGTTCATCCCTAAGGGTCCTAACCGGG GAGTTATCATTACCATGTTGGTGACCTGTTCAGTTT GCTGCTATCTCTTTGGCTGATTGCAATTCTGGCCC AACTCAACCCTCTCTTTGGACCGCAATTGAAAAAT GAAACCATCTGGTATCTGAAGTATCATTGGCCTTG AGGAAGAAGACATGCTCTACAGTGCTCAGTCTTTG AGGTCACGAGAAGAGAATGCCTTCTAGATGCAAAA TCACCTCCAAACCAGACCACTTTTCTTGACTTGCCT GTTTTGGCCATTAGCTGCCTTAAACGTTAACAGCA CATTTGAATGCCTTATTCTACAATGCAGCGTGTTTT CCTTTGCCTTTTTGCACTTTGGTGAATTACGTGCC TCCATAACCTGAACTGTGCCGACTCCACAAAACGA TTATGTACTCTTCTGAGATAGAAGATGCTGTTCTTC TGAGAGATACGTTACTCTCTCCTTGGAATCTGTGG ATTTGAAGATGGCTCCTGCCTTCTCACGTGGGAAT CAGTGAAGTGTTTAGAAACTGCTGCAAGACAAACA AGACTCCAGTGGGGTGGTCAGTAGGAGAGCACGT TCAGAGGGAAGAGCCATCTCAACAGAATCGCACC AAACTATACTTTCAGGATGAATTTCTTCTTTCTGCC ATCTTTTGGAATAAATATTTTCCTCCTTTCTATGGAA ATCTGGAAAAAAAAAAAA | 1 | G* |
| 1308 | NM_0040 39.2_154 | 154 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCAAGTGCATATGGGTCTGTCAA AGCCTATACTAACTTGATGCTGAGCGGGATGCTTT GAACATTGAAACAGCCATCAAGACCAAAGGTGTGG ATGAGGTCACCATTGTCAACATTTTGACCAACCGC AGCAATGCACAGAGACAGGATATTGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGACACTA | 7 | LMLSGML* |
| 1309 | NM_0040 39.2_174 | 174 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCAAGTGCATATGGGTCTGTCAA AGCCTATACTAACTTTGATGCTGAGCGGGATGCTT GAACATTGAAACAGCCATCAAGACCAAAGGTGTGG ATGAGGTCACCATTGTCAACATTTTGACCAACCGC AGCAATGCACAGAGACAGGATATTGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA | 0 | * |

TABLE 3A-continued

| SEQ ID | identifier_position | position | modified_RNA | PAP length | PAP |
|---|---|---|---|---|---|
| | | | GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGACACTA | | |
| 1310 | NM_0040 39.2_223 | 223 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATGTCAACATTTTGACCAACCGC AGCAATGCACAGAGACAGGATATTGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGACACTA | 4 | MSTF* |
| 1311 | NM_0040 39.2_234 | 234 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTGACCAACCGC AGCAATGCACAGAGACAGGATATTGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGACACTA | 0 | * |
| 1312 | NM_0040 39.2_268 | 268 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA | 16 | MPSPTRE GPKRNLH QH* |

TABLE 3A-continued

| SEQ ID | identifier_position | position | modified_RNA | PAP length | PAP |
|---|---|---|---|---|---|
| | | | AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGCACTA | | |
| 1313 | NM_0040 39.2_354 | 354 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTGGGCCTATTGAAGACACCTGCTCAGTAT GACGCTTCTGAGCTAAAAGCTTCCATGAAGGGGCT GGGAACCGACGAGGACTCTCTCATTGAGATCATCT GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGCACTA | 3 | WAY* |
| 1314 | NM_0040 39.2_454 | 454 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGTCCAGAACCAACCAGGAGCTGCAGGAAATTAAC AGAGTCTACAAGGAAATGTACAAGACTGATCTGGA GAAGGACATTATTTCGGACACATCTGGTGACTTCC GCAAGCTGATGGTTGCCCTGGCAAAGGGTAGAAG AGCAGAGGATGGCTCTGTCATTGATTATGAACTGA TTGACCAAGATGCTCGGGATCTCTATGACGCTGGA GTGAAGAGGAAAGGAACTGATGTTCCCAAGTGGA TCAGCATCATGACCGAGCGGAGCGTGCCCCACCT | 36 | PEPTRSCR KLTESTRK CTRLIWRR TLFRTHLV TSAS* |

TABLE 3A-continued

| SEQ ID | identifier_position | position | modified_RNA | PAP length | PAP |
|---|---|---|---|---|---|
| | | | CCAGAAAGTATTTGATAGGTACAAGAGTTACAGCC<br>CTTATGACATGTTGGAAAGCATCAGGAAAGAGGTT<br>AAAGGAGACCTGGAAAATGCTTTCCTGAACCTGGT<br>TCAGTGCATTCAGAACAAGCCCCTGTATTTTGCTG<br>ATCGGCTGTATGACTCCATGAAGGGCAAGGGGAC<br>GCGAGATAAGGTCCTGATCAGAATCATGGTCTCCC<br>GCAGTGAAGTGGACATGTTGAAAATTAGGTCTGAA<br>TTCAAGAGAAAGTACGGCAAGTCCCTGTACTATTA<br>TATCCAGCAAGACACTA | | |
| 1315 | NM_0040<br>39.2_559 | 559 | GCTCAGCATTTGGGGACGCTCTCAGCTCTCGGCG<br>CACGGCCCAGCTTCCTTCAAAATGTCTACTGTTCA<br>CGAAATCCTGTGCAAGCTCAGCTTGGAGGGTGAT<br>CACTCTACACCCCCAAGTGCATATGGGTCTGTCAA<br>AGCCTATACTAACTTTGATGCTGAGCGGGATGCTT<br>TGAACATTGAAACAGCCATCAAGACCAAAGGTGTG<br>GATGAGGTCACCATTGTCAACATTTTGACCAACCG<br>CAGCAATGCACAGAGACAGGATATTGCCTTCGCCT<br>ACCAGAGAAGGACCAAAAAGGAACTTGCATCAGC<br>ACTGAAGTCAGCCTTATCTGGCCACCTGGAGACG<br>GTGATTTTGGGCCTATTGAAGACACCTGCTCAGTA<br>TGACGCTTCTGAGCTAAAAGCTTCCATGAAGGGGC<br>TGGGAACCGACGAGGACTCTCTCATTGAGATCATC<br>TGCTCCAGAACCAACCAGGAGCTGCAGGAAATTAA<br>CAGAGTCTACAAGGAAATGTACAAGACTGATCTGG<br>AGAAGGACATTATTTCGGACACATCTGGTGACTTC<br>CGAAGCTGATGGTTGCCCTGGCAAAGGGTAGAAG<br>AGCAGAGGATGGCTCTGTCATTGATTATGAACTGA<br>TTGACCAAGATGCTCGGGATCTCTATGACGCTGGA<br>GTGAAGAGGAAAGGAACTGATGTTCCCAAGTGGA<br>TCAGCATCATGACCGAGCGGAGCGTGCCCCACCT<br>CCAGAAAGTATTTGATAGGTACAAGAGTTACAGCC<br>CTTATGACATGTTGGAAAGCATCAGGAAAGAGGTT<br>AAAGGAGACCTGGAAAATGCTTTCCTGAACCTGGT<br>TCAGTGCATTCAGAACAAGCCCCTGTATTTTGCTG<br>ATCGGCTGTATGACTCCATGAAGGGCAAGGGGAC<br>GCGAGATAAGGTCCTGATCAGAATCATGGTCTCCC<br>GCAGTGAAGTGGACATGTTGAAAATTAGGTCTGAA<br>TTCAAGAGAAAGTACGGCAAGTCCCTGTACTATTA<br>TATCCAGCAAGACACTA | 1 | S* |
| 1316 | NM_0040<br>39.2_582 | 582 | GCTCAGCATTTGGGGACGCTCTCAGCTCTCGGCG<br>CACGGCCCAGCTTCCTTCAAAATGTCTACTGTTCA<br>CGAAATCCTGTGCAAGCTCAGCTTGGAGGGTGAT<br>CACTCTACACCCCCAAGTGCATATGGGTCTGTCAA<br>AGCCTATACTAACTTTGATGCTGAGCGGGATGCTT<br>TGAACATTGAAACAGCCATCAAGACCAAAGGTGTG<br>GATGAGGTCACCATTGTCAACATTTTGACCAACCG<br>CAGCAATGCACAGAGACAGGATATTGCCTTCGCCT<br>ACCAGAGAAGGACCAAAAAGGAACTTGCATCAGC<br>ACTGAAGTCAGCCTTATCTGGCCACCTGGAGACG<br>GTGATTTTGGGCCTATTGAAGACACCTGCTCAGTA<br>TGACGCTTCTGAGCTAAAAGCTTCCATGAAGGGGC<br>TGGGAACCGACGAGGACTCTCTCATTGAGATCATC<br>TGCTCCAGAACCAACCAGGAGCTGCAGGAAATTAA<br>CAGAGTCTACAAGGAAATGTACAAGACTGATCTGG<br>AGAAGGACATTATTTCGGACACATCTGGTGACTTC<br>CGCAAGCTGATGGTTGCCCTGGCAAGGGTAGAAG<br>AGCAGAGGATGGCTCTGTCATTGATTATGAACTGA<br>TTGACCAAGATGCTCGGGATCTCTATGACGCTGGA<br>GTGAAGAGGAAAGGAACTGATGTTCCCAAGTGGA<br>TCAGCATCATGACCGAGCGGAGCGTGCCCCACCT<br>CCAGAAAGTATTTGATAGGTACAAGAGTTACAGCC<br>CTTATGACATGTTGGAAAGCATCAGGAAAGAGGTT<br>AAAGGAGACCTGGAAAATGCTTTCCTGAACCTGGT<br>TCAGTGCATTCAGAACAAGCCCCTGTATTTTGCTG<br>ATCGGCTGTATGACTCCATGAAGGGCAAGGGGAC<br>GCGAGATAAGGTCCTGATCAGAATCATGGTCTCCC<br>GCAGTGAAGTGGACATGTTGAAAATTAGGTCTGAA<br>TTCAAGAGAAAGTACGGCAAGTCCCTGTACTATTA<br>TATCCAGCAAGACACTA | 14 | RVEEQRM<br>ALSLIMN* |
| 1317 | NM_0040<br>39.2_604 | 604 | GCTCAGCATTTGGGGACGCTCTCAGCTCTCGGCG<br>CACGGCCCAGCTTCCTTCAAAATGTCTACTGTTCA<br>CGAAATCCTGTGCAAGCTCAGCTTGGAGGGTGAT<br>CACTCTACACCCCCAAGTGCATATGGGTCTGTCAA<br>AGCCTATACTAACTTTGATGCTGAGCGGGATGCTT<br>TGAACATTGAAACAGCCATCAAGACCAAAGGTGTG<br>GATGAGGTCACCATTGTCAACATTTTGACCAACCG<br>CAGCAATGCACAGAGACAGGATATTGCCTTCGCCT<br>ACCAGAGAAGGACCAAAAAGGAACTTGCATCAGC | 6 | LSLIMN* |

TABLE 3A-continued

| SEQ ID | identifier_ position | position | modified_RNA | PAP length | PAP |
|---|---|---|---|---|---|
| | | | ACTGAAGTCAGCCTTATCTGGCCACCTGGAGACG GTGATTTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGTCTGTCATTGATTATGAACTGA TTGACCAAGATGCTCGGGATCTCTATGACGCTGGA GTGAAGAGGAAAGGAACTGATGTTCCCAAGTGGA TCAGCATCATGACCGAGCGGAGCGTGCCCCACCT CCAGAAAGTATTTGATAGGTACAAGAGTTACAGCC CTTATGACATGTTGGAAAGCATCAGGAAAGAGGTT AAAGGAGACCTGGAAAATGCTTTCCTGAACCTGGT TCAGTGCATTCAGAACAAGCCCCTGTATTTTGCTG ATCGGCTGTATGACTCCATGAAGGGCAAGGGGAC GCGAGATAAGGTCCTGATCAGAATCATGGTCTCCC GCAGTGAAGTGGACATGTTGAAAATTAGGTCTGAA TTCAAGAGAAAGTACGGCAAGTCCCTGTACTATTA TATCCAGCAAGACACTA | | |
| 1318 | NM_0040 39.2_685 | 685 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTCCCAAGTGGA TCAGCATCATGACCGAGCGGAGCGTGCCCCACCT CCAGAAAGTATTTGATAGGTACAAGAGTTACAGCC CTTATGACATGTTGGAAAGCATCAGGAAAGAGGTT AAAGGAGACCTGGAAAATGCTTTCCTGAACCTGGT TCAGTGCATTCAGAACAAGCCCCTGTATTTTGCTG ATCGGCTGTATGACTCCATGAAGGGCAAGGGGAC GCGAGATAAGGTCCTGATCAGAATCATGGTCTCCC GCAGTGAAGTGGACATGTTGAAAATTAGGTCTGAA TTCAAGAGAAAGTACGGCAAGTCCCTGTACTATTA TATCCAGCAAGACACTA | 5 | SGSAS* |
| 1319 | NM_0040 39.2_709 | 709 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACCT CCAGAAAGTATTTGATAGGTACAAGAGTTACAGCC CTTATGACATGTTGGAAAGCATCAGGAAAGAGGTT AAAGGAGACCTGGAAAATGCTTTCCTGAACCTGGT TCAGTGCATTCAGAACAAGCCCCTGTATTTTGCTG ATCGGCTGTATGACTCCATGAAGGGCAAGGGGAC | 38 | SGACPTSR KYLIGTRVT ALMTCWK ASGKRLKE TWKMLS* |

TABLE 3A-continued

| SEQ ID | identifier_position | position | modified_RNA | PAP length | PAP |
|---|---|---|---|---|---|
| | | | GCGAGATAAGGTCCTGATCAGAATCATGGTCTCCC GCAGTGAAGTGGACATGTTGAAAATTAGGTCTGAA TTCAAGAGAAAGTACGGCAAGTCCCTGTACTATTA TATCCAGCAAGACACTA | | |
| 1320 | NM_0040 39.2_725 | 725 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGCTCCAGAACCAACCAGGACTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCACCT CCAGAAAGTATTTGATAGGTACAAGAGTTACAGCC CTTATGACATGTTGGAAAGCATCAGGAAAGAGGTT AAAGGAGACCTGGAAAATGCTTTCCTGAACCTGGT TCAGTGCATTCAGAACAAGCCCCTGTATTTTGCTG ATCGGCTGTATGACTCCATGAAGGGCAAGGGGAC GCGAGATAAGGTCCTGATCAGAATCATGGTCTCCC GCAGTGAAGTGGACATGTTGAAAATTAGGTCTGAA TTCAAGAGAAAGTACGGCAAGTCCCTGTACTATTA TATCCAGCAAGACACTA | 33 | TSRKYLIGT RVTALMTC WKASGKR LKETWKML S* |
| 1321 | NM_0040 39.2_765 | 765 | GCTCAGCATTTGGGGACGCTCTCAGCTCTCGGCG CACGGCCCAGCTTCCTTCAAAATGTCTACTGTTCA CGAAATCCTGTGCAAGCTCAGCTTGGAGGGTGAT CACTCTACACCCCCAAGTGCATATGGGTCTGTCAA AGCCTATACTAACTTTGATGCTGAGCGGGATGCTT TGAACATTGAAACAGCCATCAAGACCAAAGGTGTG GATGAGGTCACCATTGTCAACATTTTGACCAACCG CAGCAATGCACAGAGACAGGATATTGCCTTCGCCT ACCAGAGAAGGACCAAAAAGGAACTTGCATCAGC ACTGAAGTCAGCCTTATCTGGCCACCTGGAGACG GTGATTTTGGGCCTATTGAAGACACCTGCTCAGTA TGACGCTTCTGAGCTAAAAGCTTCCATGAAGGGGC TGGGAACCGACGAGGACTCTCTCATTGAGATCATC TGCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CTTATGACATGTTGGAAAGCATCAGGAAAGAGGTT AAAGGAGACCTGGAAAATGCTTTCCTGAACCTGGT TCAGTGCATTCAGAACAAGCCCCTGTATTTTGCTG ATCGGCTGTATGACTCCATGAAGGGCAAGGGGAC GCGAGATAAGGTCCTGATCAGAATCATGGTCTCCC GCAGTGAAGTGGACATGTTGAAAATTAGGTCTGAA TTCAAGAGAAAGTACGGCAAGTCCCTGTACTATTA TATCCAGCAAGACACTA | 20 | LMTCWKA SGKRLKET WKMLS* |
| 1322 | NM_0040 39.2_93 | 93 | GCTCAGCATTTGGGGACGCTCTCAGCTCTCGGCG CACGGCCCAGCTTCCTTCAAAATGTCTACTGTTCA CGAAATCCTGTGCAAGCTCAGCTGGAGGTGATC ACTCTACACCCCCAAGTGCATATGGGTCTGTCAAA GCCTATACTAACTTTGATGCTGAGCGGGATGCTTT GAACATTGAAACAGCCATCAAGACCAAAGGTGTGG ATGAGGTCACCATTGTCAACATTTTGACCAACCGC AGCAATGCACAGAGACAGGATATTGCCTTCGCCTA CCAGAGAAGGACCAAAAAGGAACTTGCATCAGCA CTGAAGTCAGCCTTATCTGGCCACCTGGAGACGG TGATTTTGGGCCTATTGAAGACACCTGCTCAGTAT GACGCTTCTGAGCTAAAAGCTTCCATGAAGGGGCT GGGAACCGACGAGGACTCTCTCATTGAGATCATCT | 27 | WRVITLHP QVHMGLS KPILTLMLS GML* |

TABLE 3A-continued

| SEQ ID | identifier_position | position | modified_RNA | PAP length | PAP |
|---|---|---|---|---|---|
| | | | GCTCCAGAACCAACCAGGAGCTGCAGGAAATTAA CAGAGTCTACAAGGAAATGTACAAGACTGATCTGG AGAAGGACATTATTTCGGACACATCTGGTGACTTC CGCAAGCTGATGGTTGCCCTGGCAAAGGGTAGAA GAGCAGAGGATGGCTCTGTCATTGATTATGAACTG ATTGACCAAGATGCTCGGGATCTCTATGACGCTGG AGTGAAGAGGAAAGGAACTGATGTTCCCAAGTGG ATCAGCATCATGACCGAGCGGAGCGTGCCCCACC TCCAGAAAGTATTTGATAGGTACAAGAGTTACAGC CCTTATGACATGTTGGAAAAGCATCAGGAAAGAGGT TAAAGGAGACCTGGAAAATGCTTTCCTGAACCTGG TTCAGTGCATTCAGAACAAGCCCCTGTATTTTGCT GATCGGCTGTATGACTCCATGAAGGGCAAGGGGA CGCGAGATAAGGTCCTGATCAGAATCATGGTCTCC CGCAGTGAAGTGGACATGTTGAAAATTAGGTCTGA ATTCAAGAGAAAGTACGGCAAGTCCCTGTACTATT ATATCCAGCAAGACACTA | | |
| 1323 | NM_0040 48.2_193 | 193 | AATATAAGTGGAGGCGTCGCGCTGGCGGGCATTC CTGAAGCTGACAGCATTCGGGCCGAGATGTCTCG CTCCGTGGCCTTAGCTGTGCTCGCGCTACTCTCTC TTTCTGGCCTGGAGGCTATCCAGCGTACTCCAAAG ATTCAGGTTTACTCACGTCATCCAGCAGAGAATGG AAAGTCAAATTTCCTGAATGCTATGTGTCTGGGTTT CATCCATCCGACATTGAAGTTGACTTACTGAAGAA TGGAGAGAGAATTGAAAAAGTGGAGCATTCAGACT TGTCTTTCAGCAAGGACTGGTCTTTCTATCTCTTGT ACTACACTGAATTCACCCCCACTGAAAAAGATGAG TATGCCTGCCGTGTGAACCATGTGACTTTGTCACA GCCCAAGATAGTTAAGTGGGATCGAGACATGTAAG CAGCATCATGGAGGTTTGAAGATGCCGCATTTGGA TTGGATGAATTCCAAATTCTGCTTGCTTGCTTTTTA ATATTGATATGCTTATACACTTACACTTTATGCACA AAATGTAGGGTTATAATAATGTTAACATGGACATGA TCTTCTTTATAATTCTACTTTGAGTGCTGTCTCCAT GTTTGATGTATCTGAGCAGGTTGCTCCACAGGTAG CTCTAGGAGGGCTGGCAACTTAGAGGTGGGGAGC AGAGAATTCTCTTATCCAACATCAACATCTTGGTCA GATTTGAACTCTTCAATCTCTTGCACTCAAAGCTTG TTAAGATAGTTAAGCGTGCATAAGTTAACTTCCAAT TTACATACTCTGCTTAGAATTTGGGGGAAAATTTAG AAATATAATTGACAGGATTATTGGAAATTTGTTATA ATGAATGAAACATTTTGTCATATAAGATTCATATTTA CTTCTTATACATTTGATAAAGTAAGGCATGGTTGTG GTTAATCTGGTTTATTTTTGTTCCACAAGTTAAATAA ATCATAAAACTTGATGTGTTATCTCTTA | 15 | AMCLGFIH PTLKLTY* |
| 1324 | NM_0040 48.2_258 | 258 | AATATAAGTGGAGGCGTCGCGCTGGCGGGCATTC CTGAAGCTGACAGCATTCGGGCCGAGATGTCTCG CTCCGTGGCCTTAGCTGTGCTCGCGCTACTCTCTC TTTCTGGCCTGGAGGCTATCCAGCGTACTCCAAAG ATTCAGGTTTACTCACGTCATCCAGCAGAGAATGG AAAGTCAAATTTCCTGAATTGCTATGTGTCTGGGTT TCATCCATCCGACATTGAAGTTGACTTACTGAAGA ATGGAGAGAGAATGAAAAAGTGGAGCATTCAGACT TGTCTTTCAGCAAGGACTGGTCTTTCTATCTCTTGT ACTACACTGAATTCACCCCCACTGAAAAAGATGAG TATGCCTGCCGTGTGAACCATGTGACTTTGTCACA GCCCAAGATAGTTAAGTGGGATCGAGACATGTAAG CAGCATCATGGAGGTTTGAAGATGCCGCATTTGGA TTGGATGAATTCCAAATTCTGCTTGCTTGCTTTTTA ATATTGATATGCTTATACACTTACACTTTATGCACA AAATGTAGGGTTATAATAATGTTAACATGGACATGA TCTTCTTTATAATTCTACTTTGAGTGCTGTCTCCAT GTTTGATGTATCTGAGCAGGTTGCTCCACAGGTAG CTCTAGGAGGGCTGGCAACTTAGAGGTGGGGAGC AGAGAATTCTCTTATCCAACATCAACATCTTGGTCA GATTTGAACTCTTCAATCTCTTGCACTCAAAGCTTG TTAAGATAGTTAAGCGTGCATAAGTTAACTTCCAAT TTACATACTCTGCTTAGAATTTGGGGGAAAATTTAG AAATATAATTGACAGGATTATTGGAAATTTGTTATA ATGAATGAAACATTTTGTCATATAAGATTCATATTTA CTTCTTATACATTTGATAAAGTAAGGCATGGTTGTG GTTAATCTGGTTTATTTTTGTTCCACAAGTTAAATAA ATCATAAAACTTGATGTGTTATCTCTTA | 36 | MKKWSIQT CLSARTGL SISCTTLNS PPLKKMSM PAV* |
| 1325 | NM_0040 48.2_380 | 380 | AATATAAGTGGAGGCGTCGCGCTGGCGGGCATTC CTGAAGCTGACAGCATTCGGGCCGAGATGTCTCG CTCCGTGGCCTTAGCTGTGCTCGCGCTACTCTCTC TTTCTGGCCTGGAGGCTATCCAGCGTACTCCAAAG | 5 | CHSPR* |

TABLE 3A-continued

| SEQ ID | identifier_position | position | modified_RNA | PAP length | PAP |
|---|---|---|---|---|---|
| | | | ATTCAGGTTTACTCACGTCATCCAGCAGAGAATGG AAAGTCAAATTTCCTGAATTGCTATGTGTCTGGGTT TCATCCATCCGACATTGAAGTTGACTTACTGAAGA ATGGAGAGAGAATTGAAAAAGTGGAGCATTCAGAC TTGTCTTTCAGCAAGGACTGGTCTTTCTATCTCTTG TACTACACTGAATTCACCCCCACTGAAAAAGATGA GTATGCCTGCCGTGTGAACCATGTGACTTGTCACA GCCCAAGATAGTTAAGTGGGATCGAGACATGTAAG CAGCATCATGGAGGTTTGAAGATGCCGCATTTGGA TTGGATGAATTCCAAATTCTGCTTGCTTGCTTTTTA ATATTGATATGCTTATACACTTACACTTTATGCACA AAATGTAGGGTTATAATAATGTTAACATGGACATGA TCTTCTTTATAATTCTACTTTGAGTGCTGTCTCCAT GTTTGATGTATCTGAGCAGGTTGCTCCACAGGTAG CTCTAGGAGGGCTGGCAACTTAGAGGTGGGGAGC AGAGAATTCTCTTATCCAACATCAACATCTTGGTCA GATTTGAACTCTTCAATCTCTTGCACTCAAAGCTTG TTAAGATAGTTAAGCGTGCATAAGTTAACTTCCAAT TTACATACTCTGCTTAGAATTTGGGGGAAAATTTAG AAATATAATTGACAGGATTATTGGAAATTTGTTATA ATGAATGAAACATTTTGTCATATAAGATTCATATTTA CTTCTTATACATTTGATAAAGTAAGGCATGGTTGTG GTTAATCTGGTTTATTTTTGTTCCACAAGTTAAATAA ATCATAAAACTTGATGTGTTATCTCTTA | | |
| 1326 | NM_0040 52.2_549 | 549 | CCTCCGCTCAGTCCGGGAGCGCACGTGGGCCGC GGCGCTCCGACCTCCGCTTTCCCACCGCCCGCAG CTGAAGCACATCCCGCAGCCCGGCGCGGACTCCG ATCGCCGCAGTTGCCCTCTGGCGCCATGTCGCAG AACGGAGCGCCCGGGATGCAGGAGGAGAGCCTG CAGGGCTCCTGGGTAGAACTGCACTTCAGCAATAA TGGGAACGGGGGCAGCGTTCCAGCCTCGGTTTCT ATTTATAATGGAGACATGGAAAAAATACTGCTGGA CGCACAGCATGAGTCTGGACGGAGTAGCTCCAAG AGCTCTCACTGTGACAGCCCACCTCGCTCGCAGA CACCACAAGATACCAACAGGGCTTCTGAAACAGAT ACCCATAGCATTGGAGAGAAAAACAGCTCACAGTC TGAGGAAGATGATATTGAAAGAAGGAAAGAAGTTG AAAGCATCTTGAAGAAAAACTCAGATTGGATATGG GATTGGTCAAGTCGGCCGGAAAATATTCCCCCCAA GGAGTTCCTCTTTAAACACCCGAAGCGCACGGCA CCCTCAGCATGAGGAACACGAGCGTCATGAAGAA AGGGGGCATATTCTCTGCAGAATTTCTGAAAGTTT TCCTTCCATCTCTGCTGCTCTCTCATTTGCTGGCC ATCGGATTGGGGATCTATATTGGAAGGCGTCTGAC AACCTCCACCAGCACCTTTTGATGAAGAACTGGAG TCTGACTTGGTTCGTTAGTGGATTACTTCTGAGCTT GCAACATAGCTCACTGAAGAGCTGTTAGATCCTGG GGTGGCCACGTCACTTGTGTTTATTTGTTCTGTAAA TGCTGCGTTCCTAATTTAGTAAAATAAAAGAATAGA CACTAAAATCATGTTGATCTATAATTACACCTATGG GATCAATAAGCATGTCAGACTGATTAATGTCTACT GTGAAAATTTGGTAGTAAATTTTCATTTGATATTAG ATATAAATATCTGAATATAAATAATTTTAATATACTA GTCATGATGTGTGT | 3 | PSA* |
| 1327 | NM_0040 68.3_472 | 472 | GGCGGCGGCACTGCGGTGAAAGCCGAGGCAGCG GGCAGACGAGCAGGGGGCGGGCGGACATCTTGG GATCGGAGAGTGGCCGGGCCGGCAGAGCAGGG GGCCGAGGACACCAGGTCTGTTCTCAGAGCGATG GGCCGCGGAGACTGATCTGCCGCCATGATTGGAG GCTTATTCATCTATAATCACAAGGGGGAGGTGCTC ATCTCCCGAGTCTACCGAGATGACATCGGGAGGA ACGCAGTGGATGCCTTTCGGGTCAATGTTATCCAT GCCCGGCAGCAGGTGCGCAGCCCCGTCACCAAC ATTGCTCGCACCAGCTTCTTCCACGTTAAGCGGTC CAACATTTGGCTGGCAGCAGTCACCAAGCAGAAT GTCAACGCTGCCATGGTCTTCGAATTCCTCTATAA GATGTGTGACGTGATGGCTGCCTACTTTGGCAAGA TCAGCGAGGAAAAACATCAAGAACAATTTGTGCTCA TATATGAGCTGCTGGATGAGATTCTAGACTTTGGC TACCCACAGAATTCCGAGACAGGCGCGCTGAAAA CCTTCATCACGCAGCAGGGCATCAAGAGTCAGCA TCAGACAAAAGAAGAGCAGTCACAGATCACCAGC CAGGTAACTGGGCAGATTGGCTGGCGGCGAGAG GGTATCAAGTATCGTCGGAATGAGCTCTTCCTGGA TGTGCTGGAGAGTGTGAACCTGCTCATGTCCCCAC AAGGGCAGGTGCTGAGTGCCCATGTGTCGGGCCG GGTGGTGATGAAGAGCTACCTGAGTGGCATGCCT | 11 | LCSYMSC WMRF* |

TABLE 3A-continued

| SEQ ID | identifier_ position | position | modified_RNA | PAP length | PAP |
|---|---|---|---|---|---|
| | | | GAATGCAAGTTTGGGATGAATGACAAGATTGTTAT<br>TGAAAAGCAGGGCAAAGGCACAGCTGATGAAACA<br>AGCAAGAGCGGGAAGCAATCAATTGCCATTGATGA<br>CTGCACCTTCCACCAGTGTGTGCGACTCAGCAAGT<br>TTGACTCTGAACGCAGCATCAGCTTTATCCCGCCA<br>GATGGAGAGTTTGAGCTTATGAGGTATCGCACAAC<br>CAAGGACATCATCCTTCCCTTCCGGGTGA | | |
| 1328 | NM_0040 68.3_511 | 511 | GGCGGCGGCACTGCGGTGAAAGCCGAGGCAGCG<br>GGCAGACGAGCAGGGGGCGGGCGGACATCTTGG<br>GATCCGGAGAGTGGCCGGGCCGGCAGAGCAGGG<br>GGCCGAGGACACCAGGTCTGTTCTCAGAGCGATG<br>GGCCGCGGAGACTGATCTGCCGCCATGATTGGAG<br>GCTTATTCATCTATAATCACAAGGGGGAGGTGCTC<br>ATCTCCCGAGTCTACCGAGATGACATCGGGAGGA<br>ACGCAGTGGATGCCTTTCGGGTCAATGTTATCCAT<br>GCCCGGCAGCAGGTGCGCAGCCCCGTCACCAAC<br>ATTGCTCGCACCAGCTTCTTCCACGTTAAGCGGTC<br>CAACATTTGGCTGGCAGCAGTCACCAAGCAGAAT<br>GTCAACGCTGCCATGGTCTTCGAATTCCTCTATAA<br>GATGTGTGACGTGATGGCTGCCTACTTTGGCAAGA<br>TCAGCGAGGAAAACATCAAGAACAATTTTGTGCTC<br>ATATATGAGCTGCTGGATGAGATTCTAGACTTGGC<br>TACCCACAGAATTCCGAGACAGGCGCGCTGAAAA<br>CCTTCATCACGCAGCAGGGCATCAAGAGTCAGCA<br>TCAGACAAAAGAAGAGCAGTCACAGATCACCAGC<br>CAGGTAACTGGGCAGATTGGCTGGCGGCGAGAG<br>GGTATCAAGTATCGTCGGAATGAGCTCTTCCTGGA<br>TGTGCTGGAGAGTGTGAACCTGCTCATGTCCCCAC<br>AAGGGCAGGTGCTGAGTGCCCATGTGTCGGGCCG<br>GGTGGTGATGAAGAGCTACCTGAGTGGCATGCCT<br>GAATGCAAGTTTGGGATGAATGACAAGATTGTTAT<br>TGAAAAGCAGGGCAAAGGCACAGCTGATGAAACA<br>AGCAAGAGCGGGAAGCAATCAATTGCCATTGATGA<br>CTGCACCTTCCACCAGTGTGTGCGACTCAGCAAGT<br>TTGACTCTGAACGCAGCATCAGCTTTATCCCGCCA<br>GATGGAGAGTTTGAGCTTATGAGGTATCGCACAAC<br>CAAGGACATCATCCTTCCCTTCCGGGTGA | 11 | LATHRIPR QAR* |
| 1329 | NM_0040 68.3_634 | 634 | GGCGGCGGCACTGCGGTGAAAGCCGAGGCAGCG<br>GGCAGACGAGCAGGGGGCGGGCGGACATCTTGG<br>GATCCGGAGAGTGGCCGGGCCGGCAGAGCAGGG<br>GGCCGAGGACACCAGGTCTGTTCTCAGAGCGATG<br>GGCCGCGGAGACTGATCTGCCGCCATGATTGGAG<br>GCTTATTCATCTATAATCACAAGGGGGAGGTGCTC<br>ATCTCCCGAGTCTACCGAGATGACATCGGGAGGA<br>ACGCAGTGGATGCCTTTCGGGTCAATGTTATCCAT<br>GCCCGGCAGCAGGTGCGCAGCCCCGTCACCAAC<br>ATTGCTCGCACCAGCTTCTTCCACGTTAAGCGGTC<br>CAACATTTGGCTGGCAGCAGTCACCAAGCAGAAT<br>GTCAACGCTGCCATGGTCTTCGAATTCCTCTATAA<br>GATGTGTGACGTGATGGCTGCCTACTTTGGCAAGA<br>TCAGCGAGGAAAACATCAAGAACAATTTTGTGCTC<br>ATATATGAGCTGCTGGATGAGATTCTAGACTTTGG<br>CTACCCACAGAATTCCGAGACAGGCGCGCTGAAAA<br>ACCTTCATCACGCAGCAGGGCATCAAGAGTCAGC<br>ATCAGACAAAAGAAGAGCAGTCACAGATCACCAGC<br>CAGGTAACTGGGCAGATGGCTGGCGGCGAGAGG<br>GTATCAAGTATCGTCGGAATGAGCTCTTCCTGGAT<br>GTGCTGGAGAGTGTGAACCTGCTCATGTCCCCAC<br>AAGGGCAGGTGCTGAGTGCCCATGTGTCGGGCCG<br>GGTGGTGATGAAGAGCTACCTGAGTGGCATGCCT<br>GAATGCAAGTTTGGGATGAATGACAAGATTGTTAT<br>TGAAAAGCAGGGCAAAGGCACAGCTGATGAAACA<br>AGCAAGAGCGGGAAGCAATCAATTGCCATTGATGA<br>CTGCACCTTCCACCAGTGTGTGCGACTCAGCAAGT<br>TTGACTCTGAACGCAGCATCAGCTTTATCCCGCCA<br>GATGGAGAGTTTGAGCTTATGAGGTATCGCACAAC<br>CAAGGACATCATCCTTCCCTTCCGGGTGA | 22 | MAGGERV SSIVGMSS SWMCWRV* |
| 1330 | NM_0040 92.2_149 | 149 | GCGGGAGCGAGCCCTGAAAGGCTATAGGCGAGGG<br>GGCGGCTCCGCGGGGCCGGGCGAGGAGTCCAGA<br>GAGCCATGGCCGCCCTGCGTGTCCTGCTGTCCTG<br>CGCCCGCGGCCCGCTGAGGCCCCCGGTTCGCTG<br>TCCCGCCTGGCGTCCTTCGCCTCGGGTGCTAACT<br>TTGAGTACATCATCGCAGAAAAAAGAGGGAAGAAT<br>AACACCGTGGGGTTGATCCAACTGAACCGCCCCA<br>AGGCCCTCAATGCACTTTGCGATGGCCTGATTGAC<br>GAGCTCAACCAGGCCCTGAAGATCTTCGAGGAGG<br>ACCCGGCCGTGGGGGCCATTGTCCTCACCGGCG | 22 | SPRVLTLS TSSQKKEG RITPWG* |

TABLE 3A-continued

| SEQ ID | identifier_position | position | modified_RNA | PAP length | PAP |
|---|---|---|---|---|---|
| | | | GGGATAAGGCCTTTGCAGCTGGAGCTGATATCAA<br>GGAAATGCAGAACCTGAGTTTCCAGGACTGTTACT<br>CCAGCAAGTTCTTGAAGCACTGGGACCACCTCAC<br>CCAGGTCAAGAAGCCAGTCATCGCTGCTGTCAAT<br>GGCTATGCCTTTGGCGGGGGCTGTGAGCTTGCCA<br>TGATGTGTGATATCATCTATGCCGGTGAGAAGGCC<br>CAGTTTGCACAGCCGGAGATCTTAATAGGAACCAT<br>CCCAGGTGCGGGCGGCACCCAGAGACTCACCCG<br>TGCTGTTGGGAAGTCGCTGGCGATGGAGATGGTC<br>CTCACCGGTGACCGGATCTCAGCCCAGGACGCCA<br>AGCAAGCAGGTCTTGTCAGCAAGATTTGTCCTGTT<br>GAGACACTGGTGGAAGAAGCCATCCAGTGTGCAG<br>AAAAAATTGCCAGCAATTCTAAAATTGTAGTAGCGA<br>TGGCCAAAGAATCAGTGAATGCAGCTTTTGAAATG<br>ACATTAACAGAAGGAAGTAAGTTGGAGAAGAAACT<br>CTTTTATTCAACCTTTGCCACTGATGACCGGAAAG<br>AAGGGATGACCGCGTTTGTGGAAAAGAGAAAGGC<br>CAACTTCAAAGACCAGTGAGAACCAGCTGCCCCT<br>GCTTCACACCTCTGCTTGGAGAGGACAAGTGCAG<br>CCTGTCAGTTTTAGAAGCAAGTAAATCATCCT | | |
| 1331 | NM_0041<br>81.3_323 | 323 | CCTGGGCGGCTCCGCTAGCTGTTTTTCGTCTTCCC<br>TAGGCTATTTCTGCCGGGCGCTCCGCGAAGATGC<br>AGCTCAAGCCGATGGAGATCAACCCCGAGATGCT<br>GAACAAAGTGCTGTCCCGGCTGGGGGTCGCCGG<br>CCAGTGGCGCTTCGTGGACGTGCTGGGGCTGGAA<br>GAGGAGTCTCTGGGCTCGGTGCCAGCGCCTGCCT<br>GCGCGCTGCTGCTGCTGTTTCCCCTCACGGCCCA<br>GCATGAGAACTTCAGGAAAAAGCAGATTGAAGAGC<br>TGAAGGGACAAGAAGTTAGTCCTAAAGTGTACTTC<br>ATGAAGCAGACCATGGGAATTCCTGTGGCACAATC<br>GGACTTATTCACGCAGTGGCCAATAATCAAGACAA<br>ACTGGGATTTGAGGATGGATCAGTTCTGAAACAGT<br>TTCTTTCTGAAACAGAGAAAATGTCCCCTGAAGAC<br>AGAGCAAAATGCTTTGAAAAGAATGAGGCCATACA<br>GGCAGCCCATGATGCCGTGGCACAGGAAGGCCAA<br>TGTCGGGTAGATGACAAGGTGAATTTCCATTTTATT<br>CTGTTTAACAACGTGGATGGCCACCTCTATGAACT<br>TGATGGACGAATGCCTTTTCCGGTGAACCATGGCG<br>CCAGTTCAGAGGACACCCTGCTGAAGGACGCTGC<br>CAAGGTCTGCAGAGAATTCACCGAGCGTGAGCAA<br>GGAGAAGTCCGCTTCTCTGCCGTGGCTCTCTGCA<br>AGGCAGCCTAATGCTCTGTGGGAGGGACTTTGCT<br>GATTTCCCCTCTTCCCTTCAACATGAAAATATATAC<br>CCCCCCATGCAGTCTAAAATGCTTCAGTACTTGTG<br>AAACACAGCTGTTCTTCTGTTCTGCAGACACGCCT<br>TCCCCTCAGCCACACCCAGGCACTTAAGCACAAG<br>CAGAGTGCACAGCTGTCCACTGGGCCATTGTGGT<br>GTGAGCTTCAGATGGTGAAGCATTCTCCCCAGTGT<br>ATGTCTTGTATCCGATATCTAACGCTTTAAATGGCT<br>ACTTTGGTTTCTGTCTGTAA | 28 | MGIPVAQS<br>DLFTQWPII<br>KTNWDLR<br>MDQF* |
| 1332 | NM_0041<br>81.3_576 | 576 | CCTGGGCGGCTCCGCTAGCTGTTTTTCGTCTTCCC<br>TAGGCTATTTCTGCCGGGCGCTCCGCGAAGATGC<br>AGCTCAAGCCGATGGAGATCAACCCCGAGATGCT<br>GAACAAAGTGCTGTCCCGGCTGGGGGTCGCCGG<br>CCAGTGGCGCTTCGTGGACGTGCTGGGGCTGGAA<br>GAGGAGTCTCTGGGCTCGGTGCCAGCGCCTGCCT<br>GCGCGCTGCTGCTGCTGTTTCCCCTCACGGCCCA<br>GCATGAGAACTTCAGGAAAAAGCAGATTGAAGAGC<br>TGAAGGGACAAGAAGTTAGTCCTAAAGTGTACTTC<br>ATGAAGCAGACCATTGGGAATTCCTGTGGCACAAT<br>CGGACTTATTCACGCAGTGGCCAATAATCAAGACA<br>AACTGGGATTTGAGGATGGATCAGTTCTGAAACAG<br>TTTCTTTCTGAAACAGAGAAAATGTCCCCTGAAGA<br>CAGAGCAAAATGCTTTGAAAAGAATGAGGCCATAC<br>AGGCAGCCCATGATGCCGTGGCACAGGAAGGCCA<br>ATGTCGGGTAGATGACAAGGTGAATTTCCATTTTAT<br>TCTGTTTAACAACGTGGATGGCCACCTCTATGAACT<br>TGATGGACGAATGCCTTTTCCGGTGAACCATGGCG<br>CCAGTTCAGAGGACACCCTGCTGAAGGACGCTGC<br>CAAGGTCTGCAGAGAATTCACCGAGCGTGAGCAA<br>GGAGAAGTCCGCTTCTCTGCCGTGGCTCTCTGCA<br>AGGCAGCCTAATGCTCTGTGGGAGGGACTTTGCT<br>GATTTCCCCTCTTCCCTTCAACATGAAAATATATAC<br>CCCCCCATGCAGTCTAAAATGCTTCAGTACTTGTG<br>AAACACAGCTGTTCTTCTGTTCTGCAGACACGCCT<br>TCCCCTCAGCCACACCCAGGCACTTAAGCACAAG<br>CAGAGTGCACAGCTGTCCACTGGGCCATTGTGGT | 12 | TSMNLMD<br>ECLFR* |

TABLE 3A-continued

| SEQ ID | identifier_position | position | modified_RNA | PAP length | PAP |
|---|---|---|---|---|---|
| 1333 | NM_0041 92.2_532 | 532 | GTGAGCTTCAGATGGTGAAGCATTCTCCCCAGTGT ATGTCTTGTATCCGATATCTAACGCTTTAAATGGCT ACTTTGGTTTCTGTCTGTAA GTGGCCTCGCGGAGGCGGGACTCTGGCCGCCTG TTTTTTTTGCAGCCGCGCTGCGCGCACCGCGGGC TCCGGGCTCAGAAGTGCGGACGCCCGGCTCCCG GCGTGGACGCCATGGTGCTGTGCCCGGTGATTGG GAAGCTGCTGCACAAGCGCGTGGTGCTGGCCAGC GCCTCCCCACGCCGTCAGGAGATCCTCAGCAACG CGGGTCTCAGGTTTGAGGTGGTCCCCTCCAAGTTT AAAGAGAAGCTGGACAAAGCCTCCTTCGCTACTCC GTATGGGTACGCCATGGAGACCGCCAAGCAGAAG GCCCTGGAGGTGGCCAACCGGCTGTACCAGAAAG ACCTGCGGGCCCCCGACGTGGTCATTGGAGCGGA CACGATCGTGACAGTCGGGGGGCTGATTCTGGAG AAGCCGGTGGACAAGCAGGACGCCTACAGGATGC TGTCCCGGTTGAGTGGGAGAGAACACAGCGTGTT CACAGGTGTCGCGATCGTCCACTGCTCCAGCAAA GACCATCAGCTGGACACCAGGTCTCGGAATTCTAC GAGGAAACGAAGGTGAAGTTCTCGGAGCTGTCCG AGGAGCTGCTCTGGGAATACGTCCACAGCGGGGA GCCCATGGACAAAGCTGGCGGCTACGGGATCCAG GCCCTGGGCGGCATGCTGGTGGAGTCCGTACACG GGGACTTTCTGAACGTGGTGGGATTCCCGCTGAA CCACTTCTGCAAGCAGCTGGTGAAGCTCTACTACC CGCCCCGTCCGGAGGACCTGCGGCGGAGTGTCA AGCACGACTCCATCCCGGCCGCGGACACCTTCGA AGACCTCAGTGACGTGGAGGGGGGCGGCTCGGA GCCCACTCAGAGGGACGCGGGCAGCCGCGATGA GAAGGCCGAGGCGGGAGAGGCGGGACAGGCCAC GGCAGAGGCTGAGTGTCACAGGACTCGGGAGACC CTGCCTCCGTTCCCGACACGCCTCCTGGAGCTGA TTGAGGGCTTTATGCTATCCAAGGGCCTGCTCACC GCTTG | 9 | SRNSTRKR R* |
| 1334 | NM_0042 18.2_611 | 611 | GGACAATGGGGACCCGGGACGACGAGTACGACTA CCTATTCAAAGTGGTGCTCATCGGGGACTCAGGC GTGGGCAAGAGCAACCTGCTGTCGCGCTTCACCC GCAACGAGTTCAACCTGGAGAGCAAGAGCACCAT CGGCGTGGAGTTCGCCACCCGCAGCATCCAGGTG GACGGCAAGACCATCAAGGCGCAGATCTGGGACA CCGCTGGCCAGGAGCGCTACCGCCGCATCACCTC CGCGTACTACCGTGGTGCAGTGGGCGCCCTGCTG GTGTACGACATCGCCAAGCACCTGACCTATGAGAA CGTGGAGCGCTGGCTGAAGGAGCTGCGGGACCA CGCAGACAGCAACATCGTCATCATGCTGGTGGGC AACAAGAGTGACCTGCGCCACCTGCGGGCTGTGC CAACTGACGAGGCCCGCGCCTTCGCAGAAAAGAA CAACTTGTCCTTCATCGAGACCTCAGCCTTGGATT CCACTAACGTAGAGGAAGCATTCAAGAACATCCTC ACAGAGATCTACCGCATCGTGTCACAGAAACAGAT CGCAGACCGCGCTGCCCACGACGAGTCCCCGGG GAACAACGTGGTGGACATCAGCGTGCCGCCACCA CGGACGGACAGAAGCCCAACAAGCTGCAGTGCTG CCAGAACCTGTGACCCCTGCGTCCTCCACCCAGC GTGCGTGCACGTCCTCC | 28 | PRTDRSPT SCSAARTC DPCVLHPA CVHVL |
| 1335 | NM_0042 19.2_183 | 183 | GCGGCCTCAGATGAATGCGGCTGTTAAGACCTGC AATAATCCAGAATGGCTACTCTGATCTATGTTGATA AGGAAAATGGAGAACCAGGCACCCGTGTGGTTGC TAAGGATGGGCTGAAGCTGGGGTCTGGACCTTCA ATCAAAGCCTTAGATGGGAGATCTCAAGTTTCAAC ACCACGTTTGGCAAAACGTTCGATGCCCCACCAG CCTTACCTAAAGCTACTAGAAAGGCTTTGGGAACT GTCAACAGAGCTACAGAAAAGTCTGTAAAGACCAA GGGACCCCTCAAACAAAAACAGCCAAGCTTTTCTG CCAAAAAGATGACTGAGAAGACTGTTAAAGCAAAA AGCTCTGTTCCTGCCTCAGATGATGCCTATCCAGA AATAGAAAAATTCTTTCCCTTCAATCCTCTAGACTT TGAGAGTTTTGACCTGCCTGAAGAGCACCAGATTG CGCACCTCCCCTTGAGTGGAGTGCCTCTCATGATC CTTGACGAGGAGAGAGAGCTTGAAAAGCTGTTTCA GCTGGGCCCCCCTTCACCTGTGAAGATGCCCTCT CCACCATGGGAATCCAATCTGTTGCAGTCTCCTTC AAGCATTCTGTCGACCCTGGATGTTGAATTGCCAC CTGTTTGCTGTGACATAGATATTTAAATTTCTTAGT GCTTCAGAGTTTGTGTGTATTTGTATTAATAAAGCA TTCTTCAACAGAAAAAAAAAAAAAAAAAA | 29 | LAKRSMPH QPYLKLLE RLWELSTE LQKSL* |

TABLE 3A-continued

| SEQ ID | identifier_position | position | modified_RNA | PAP length | PAP |
|---|---|---|---|---|---|
| 1336 | NM_0042 19.2_236 | 236 | GCGGCCTCAGATGAATGCGGCTGTTAAGACCTGC AATAATCCAGAATGGCTACTCTGATCTATGTTGATA AGGAAAATGGAGAACCAGGCACCCGTGTGGTTGC TAAGGATGGGCTGAAGCTGGGGTCTGGACCTTCA ATCAAAGCCTTAGATGGGAGATCTCAAGTTTCAAC ACCACGTTTTGGCAAAACGTTCGATGCCCCACCAG CCTTACCTAAAGCTACTAGAAAGGCTTGGGAACTG TCAACAGAGCTACAGAAAAGTCTGTAAAGACCAAG GGACCCCTCAAACAAAAACAGCCAAGCTTTTCTGC CAAAAAGATGACTGAGAAGACTGTTAAAGCAAAAA GCTCTGTTCCTGCCTCAGATGATGCCTATCCAGAA ATAGAAAAATTCTTTCCCTTCAATCCTCTAGACTTT GAGAGTTTTGACCTGCCTGAAGAGCACCAGATTGC GCACCTCCCCTTGAGTGGAGTGCCTCTCATGATCC TTGACGAGGAGAGAGAGCTTGAAAAGCTGTTTCAG CTGGGCCCCCCTTCACCTGTGAAGATGCCCTCTC CACCATGGGAATCCAATCTGTTGCAGTCTCCTTCA AGCATTCTGTCGACCCTGGATGTTGAATTGCCACC TGTTTGCTGTGACATAGATATTTAAATTTCTTAGTG CTTCAGAGTTTGTGTGTATTTGTATTAATAAAGCAT TCTTCAACAGAAAAAAAAAAAAAAAAAA | 11 | WELSTELQ KSL* |
| 1337 | NM_0042 31.2_393 | 393 | GGCGGAGGCGGGGTTTCAGTGGCTTCTGGTGCTC TAGGGTGAGCTCTGCCCGGCTGCAGGGATGGCG GGGAGGGGTAAGCTCATCGCAGTGATCGGAGACG AGGACACGGTGACTGGTTTCCTGCTGGGCGGCAT AGGGGAGCTTAACAAGAACCGCCATCCCAATTTCC TGGTGGTGGAGAAGGATACAACCATCAATGAGATC GAAGACACTTTCCGGCAATTTCTAAACCGGGATGA CATTGGCATCATCCTCATCAACCAGTACATCGCAG AGATGGTGCGGCATGCCCTGGACGCCCACCAGCA GTCCATCCCCGCTGTCCTGGAGATCCCCTCCAAG GAGCACCCATATGACGCCGCCAAGGACTCCATCC TGCGCAGGGCCAGGGCATGTTCACTGCCGAAGAC CTGCGCTAGGGGACTCCTCATAGCCCTCAGCCCT TCCCTCGTTTCCAGGCCTCTCCCCAGGCTTGCCAT CAGCCTTCTTTACTTTTTGAGCCTCTGATTTCCAAT TCCCTGCTCCTTCCCACTCCATTAAGAGGCTAGGT GAGGCGCTTCTAGGTTGCTGGGGCTCTGCTGGTT AAGGAACAGGAAGCCTGACCATCTCCCTCCACTAC CTCTTCCCTGTGCTGTTACACAGTGTCATTGTTGAT GTTAAATTAAAGTCATATTCTTGCTTCTCTCCAG | 38 | ACSLPKTC ARGLLIALS PSLVSRPL PRLAISLLY FLSL* |
| 1338 | NM_0042 61.3_361 | 361 | GGAGAAGAAGGCGGGGCTAAAACTGGCGAAGGC GTGGCTTCTTGGCTGCTTGACGAAGTGTCGTGAAT AAAAGAAAGGAGACCGCAGAAGTAAAGAAGTGGG GAGTTTAGGCAAGTGCCTGATTTGGGTAATCGAAA GCACCCAGTGATTGTATTTGATGACTTTTAAGCTTT CATATGCCGTTATTTAATACCTGTCACTTCCAAATG AGAGATGTAAGGGCAACGGCCGTTAGCGTTCTGT TTTGGATCAGGCTCTGGAGTGGACGCCCCTAGCTT AGGGGTCCTTCTAGGCAGCCAGAAACCTGCGGAA AATGGTAGCGATGGCGGCTGGGCCGAGTGGGTGT CTGGTGCCGGCGTTGGGCTACGGTTGTTGTTGGC GACTGTGCTTCAAGCGGTGTCTGCTTTTGGGGCA GAGTTTTCATCGGAGGCATGCAGAGAGTTAGGCTT TTCTAGCAACTTGCTTTGCAGCTCTTGTGATCTTCT CGGACAGTTCAACCTGCTTCAGCTGGATCCTGATT GCAGAGGATGCTGTCAGGAGGAAGCACAATTTGA AACCAAAAAGCTGTATGCAGGAGCTATTCTTGAAG TTTGTGGATGAAAATTGGGAAGGTTCCCTCAAGTC CAAGCTTTTGTTAGGAGTGATAAACCCAAACTGTT CAGAGGACTGCAAATCAAGTATGTCCGTGGTTCAG ACCCTGTATTAAAGCTTTTGGACGACAATGGGAAC ATTGCTGAAGAACTGAGCATTCTCAAATGGAACAC AGACAGTGTAGAAGAATTCCTGAGTGAAAAGTTGG AACGCATATAAATCTTGCTTAAATTTTGTCCTATCC TTTTGTTACCTTATCAAATGAAATATTACAGCACCT AGAAAATAATTTAGTTTTGCTTGCTTCCATTGATCA GTCTTTTACTTGAGGCATTAAATATCTAATTAAATC GTGAAATGGCAGTATAGTCCATGATATCTAAGGAG TTGGCAAGCTTAACAAAACCCATTTTTTATAAATGT CCATCCTCCT | 28 | LGYGCCW RLCFKRCL LLGQSFHR RHAES* |
| 1339 | NM_0042 61.3_378 | 378 | GGAGAAGAAGGCGGGGCTAAAACTGGCGAAGGC GTGGCTTCTTGGCTGCTTGACGAAGTGTCGTGAAT AAAAGAAAGGAGACCGCAGAAGTAAAGAAGTGGG GAGTTTAGGCAAGTGCCTGATTTGGGTAATCGAAA GCACCCAGTGATTGTATTTGATGACTTTTAAGCTTT CATATGCCGTTATTTAATACCTGTCACTTCCAAATG | 22 | WRLCFKR CLLLGQSF HRRHAES* |

TABLE 3A-continued

| SEQ ID | identifier_position | position | modified_RNA | length PAP | PAP |
|---|---|---|---|---|---|
| | | | AGAGATGTAAGGGCAACGGCCGTTAGCGTTCTGT<br>TTTGGATCAGGCTCTGGAGTGGACGCCCCTAGCTT<br>AGGGGTCCTTCTAGGCAGCCAGAAACCTGCGGAA<br>AATGGTAGCGATGGCGGCTGGGCCGAGTGGGTGT<br>CTGGTGCCGGCGTTTGGGCTACGGTTGTTGTGGC<br>GACTGTGCTTCAAGCGGTGTCTGCTTTTGGGGCA<br>GAGTTTTCATCGGAGGCATGCAGAGAGTTAGGCTT<br>TTCTAGCAACTTGCTTTGCAGCTCTTGTGATCTTCT<br>CGGACAGTTCAACCTGCTTCAGCTGGATCCTGATT<br>GCAGAGGATGCTGTCAGGAGGAAGCACAATTTGA<br>AACCAAAAAGCTGTATGCAGGAGCTATTCTTGAAG<br>TTTGTGGATGAAAATTGGGAAGGTTCCCTCAAGTC<br>CAAGCTTTTGTTAGGAGTGATAAACCCAAACTGTT<br>CAGAGGACTGCAAATCAAGTATGTCCGTGGTTCAG<br>ACCCTGTATTAAAGCTTTTGGACGACAATGGGAAC<br>ATTGCTGAAGAACTGAGCATTCTCAAATGGAACAC<br>AGACAGTGTAGAAGAATTCCTGAGTGAAAAGTTGG<br>AACGCATATAAATCTTGCTTAAATTTTGTCCTATCC<br>TTTTGTTACCTTATCAAATGAAATATTACAGCACCT<br>AGAAAATAATTTAGTTTTGCTTGCTTCCATTGATCA<br>GTCTTTTACTTGAGGCATTAAATATCTAATTAAATC<br>GTGAAATGGCAGTATAGTCCATGATATCTAAGGAG<br>TTGGCAAGCTTAACAAAACCCATTTTTTATAAATGT<br>CCATCCTCCT | | |
| 1340 | NM_0042<br>61.3_409 | 409 | GGAGAAGAAGGCGGGGCTAAAACTGGCGAAGGC<br>GTGGCTTCTTGGCTGCTTGACGAAGTGTCGTGAAT<br>AAAAGAAAGGAGACCGCAGAAGTAAAGAAGTGGG<br>GAGTTTAGGCAAGTGCCTGATTTGGGTAATCGAAA<br>GCACCCAGTGATTGTATTTGATGACTTTTAAGCTTT<br>CATATGCCGTTATTTAATACCTGTCACTTCCAAATG<br>AGAGATGTAAGGGCAACGGCCGTTAGCGTTCTGT<br>TTTGGATCAGGCTCTGGAGTGGACGCCCCTAGCTT<br>AGGGGTCCTTCTAGGCAGCCAGAAACCTGCGGAA<br>AATGGTAGCGATGGCGGCTGGGCCGAGTGGGTGT<br>CTGGTGCCGGCGTTTGGGCTACGGTTGTTGTTGG<br>CGACTGTGCTTCAAGCGGTGTCTGCTTTTGGGGCA<br>GAGTTTTCATCGGAGGCATGCAGAGAGTTAGGCTT<br>TTCTAGCAACTTGCTTTGCAGCTCTTGTGATCTTCT<br>CGGACAGTTCAACCTGCTTCAGCTGGATCCTGATT<br>GCAGAGGATGCTGTCAGGAGGAAGCACAATTTGA<br>AACCAAAAAGCTGTATGCAGGAGCTATTCTTGAAG<br>TTTGTGGATGAAAATTGGGAAGGTTCCCTCAAGTC<br>CAAGCTTTTGTTAGGAGTGATAAACCCAAACTGTT<br>CAGAGGACTGCAAATCAAGTATGTCCGTGGTTCAG<br>ACCCTGTATTAAAGCTTTTGGACGACAATGGGAAC<br>ATTGCTGAAGAACTGAGCATTCTCAAATGGAACAC<br>AGACAGTGTAGAAGAATTCCTGAGTGAAAAGTTGG<br>AACGCATATAAATCTTGCTTAAATTTTGTCCTATCC<br>TTTTGTTACCTTATCAAATGAAATATTACAGCACCT<br>AGAAAATAATTTAGTTTTGCTTGCTTCCATTGATCA<br>GTCTTTTACTTGAGGCATTAAATATCTAATTAAATC<br>GTGAAATGGCAGTATAGTCCATGATATCTAAGGAG<br>TTGGCAAGCTTAACAAAACCCATTTTTTATAAATGT<br>CCATCCTCCT | 12 | LGQSFHRR<br>HAES* |
| 1341 | NM_0042<br>61.3_593 | 593 | GGAGAAGAAGGCGGGGCTAAAACTGGCGAAGGC<br>GTGGCTTCTTGGCTGCTTGACGAAGTGTCGTGAAT<br>AAAAGAAAGGAGACCGCAGAAGTAAAGAAGTGGG<br>GAGTTTAGGCAAGTGCCTGATTTGGGTAATCGAAA<br>GCACCCAGTGATTGTATTTGATGACTTTTAAGCTTT<br>CATATGCCGTTATTTAATACCTGTCACTTCCAAATG<br>AGAGATGTAAGGGCAACGGCCGTTAGCGTTCTGT<br>TTTGGATCAGGCTCTGGAGTGGACGCCCCTAGCTT<br>AGGGGTCCTTCTAGGCAGCCAGAAACCTGCGGAA<br>AATGGTAGCGATGGCGGCTGGGCCGAGTGGGTGT<br>CTGGTGCCGGCGTTTGGGCTACGGTTGTTGTTGG<br>CGACTGTGCTTCAAGCGGTGTCTGCTTTTGGGGCA<br>GAGTTTTCATCGGAGGCATGCAGAGAGTTAGGCTT<br>TTCTAGCAACTTGCTTTGCAGCTCTTGTGATCTTCT<br>CGGACAGTTCAACCTGCTTCAGCTGGATCCTGATT<br>GCAGAGGATGCTGTCAGGAGGAAGCACAATTTGA<br>AACCAAAAAGCTGTATGCAGGAGCTATTCTTGAAG<br>TTGTGGATGAAAATTGGGAAGGTTCCCTCAAGTCC<br>AAGCTTTTGTTAGGAGTGATAAACCCAAACTGTTC<br>AGAGGACTGCAAATCAAGTATGTCCGTGGTTCAGA<br>CCCTGTATTAAAGCTTTTGGACGACAATGGGAACA<br>TTGCTGAAGAACTGAGCATTCTCAAATGGAACACA<br>GACAGTGTAGAAGAATTCCTGAGTGAAAAGTTGGA | 37 | VDENWEG<br>SLKSKLLL<br>GVINPNCS<br>EDCKSSM<br>SVVQTLY* |

TABLE 3A-continued

| SEQ ID | identifier_ position | position | modified_RNA | PAP length | PAP |
|---|---|---|---|---|---|
| | | | ACGCATATAAATCTTGCTTAAATTTTGTCCTATCCT TTTGTTACCTTATCAAATGAAATATTACAGCACCTA GAAAATAATTTAGTTTTGCTTGCTTCCATTGATCAG TCTTTTACTTGAGGCATTAAATATCTAATTAAATCGT GAAATGGCAGTATAGTCCATGATATCTAAGGAGTT GGCAAGCTTAACAAAACCCATTTTTTATAAATGTCC ATCCTCCT | | |
| 1342 | NM_0042 61.3_606 | 606 | GGAGAAGAAGGCGGGGCTAAAACTGGCGAAGGC GTGGCTTCTTGGCTGCTTGACGAAGTGTCGTGAAT AAAAGAAAGGAGACCGCAGAAGTAAAGAAGTGGG GAGTTTAGGCAAGTGCCTGATTTGGGTAATCGAAA GCACCCAGTGATTGTATTTGATGACTTTTAAGCTTT CATATGCCGTTATTTAATACCTGTCACTTCCAAATG AGAGATGTAAGGGCAACGGCCGTTAGCGTTCTGT TTTGGATCAGGCTCTGGAGTGGACGCCCCTAGCTT AGGGGTCCTTCTAGGCAGCCAGAAACCTGCGGAA AATGGTAGCGATGGCGGCTGGGCCGAGTGGGTGT CTGGTGCCGGCGTTTGGGCTACGGTTGTTGTTGG CGACTGTGCTTCAAGCGGTGTCTGCTTTTGGGGCA GAGTTTTCATCGGAGGCATGCAGAGAGTTAGGCTT TTCTAGCAACTTGCTTTGCAGCTCTTGTGATCTTCT CGGACAGTTCAACCTGCTTCAGCTGGATCCTGATT GCAGAGGATGCTGTCAGGAGGAAGCACAATTTGA AACCAAAAAGCTGTATGCAGGAGCTATTCTTGAAG TTTGTGGATGAAAATGGGAAGGTTCCCTCAAGTCC AAGCTTTTGTTAGGAGTGATAAACCCAAACTGTTC AGAGGACTGCAAATCAAGTATGTCCGTGGTTCAGA CCCTGTATTAAAGCTTTTGGACGACAATGGGAACA TTGCTGAAGAACTGAGCATTCTCAAATGGAACACA GACAGTGTAGAAGAATTCCTGAGTGAAAAGTTGGA ACGCATATAAATCTTGCTTAAATTTTGTCCTATCCT TTTGTTACCTTATCAAATGAAATATTACAGCACCTA GAAAATAATTTAGTTTTGCTTGCTTCCATTGATCAG TCTTTTACTTGAGGCATTAAATATCTAATTAAATCGT GAAATGGCAGTATAGTCCATGATATCTAAGGAGTT GGCAAGCTTAACAAAACCCATTTTTTATAAATGTCC ATCCTCCT | 33 | WEGSLKS KLLLGVINP NCSEDCKS SMSVVQTL Y* |
| 1343 | NM_0042 61.3_634 | 634 | GGAGAAGAAGGCGGGGCTAAAACTGGCGAAGGC GTGGCTTCTTGGCTGCTTGACGAAGTGTCGTGAAT AAAAGAAAGGAGACCGCAGAAGTAAAGAAGTGGG GAGTTTAGGCAAGTGCCTGATTTGGGTAATCGAAA GCACCCAGTGATTGTATTTGATGACTTTTAAGCTTT CATATGCCGTTATTTAATACCTGTCACTTCCAAATG AGAGATGTAAGGGCAACGGCCGTTAGCGTTCTGT TTTGGATCAGGCTCTGGAGTGGACGCCCCTAGCTT AGGGGTCCTTCTAGGCAGCCAGAAACCTGCGGAA AATGGTAGCGATGGCGGCTGGGCCGAGTGGGTGT CTGGTGCCGGCGTTTGGGCTACGGTTGTTGTTGG CGACTGTGCTTCAAGCGGTGTCTGCTTTTGGGGCA GAGTTTTCATCGGAGGCATGCAGAGAGTTAGGCTT TTCTAGCAACTTGCTTTGCAGCTCTTGTGATCTTCT CGGACAGTTCAACCTGCTTCAGCTGGATCCTGATT GCAGAGGATGCTGTCAGGAGGAAGCACAATTTGA AACCAAAAAGCTGTATGCAGGAGCTATTCTTGAAG TTTGTGGATGAAAATGGGAAGGTTCCCTCAAGTC CAAGCTTTGTTAGGAGTGATAAACCCAAACTGTTC AGAGGACTGCAAATCAAGTATGTCCGTGGTTCAGA CCCTGTATTAAAGCTTTTGGACGACAATGGGAACA TTGCTGAAGAACTGAGCATTCTCAAATGGAACACA GACAGTGTAGAAGAATTCCTGAGTGAAAAGTTGGA ACGCATATAAATCTTGCTTAAATTTTGTCCTATCCT TTTGTTACCTTATCAAATGAAATATTACAGCACCTA GAAAATAATTTAGTTTTGCTTGCTTCCATTGATCAG TCTTTTACTTGAGGCATTAAATATCTAATTAAATCGT GAAATGGCAGTATAGTCCATGATATCTAAGGAGTT GGCAAGCTTAACAAAACCCATTTTTTATAAATGTCC ATCCTCCT | 24 | LLGVINPN CSEDCKSS MSVVQTLY |
| 1344 | NM_0042 61.3_714 | 714 | GGAGAAGAAGGCGGGGCTAAAACTGGCGAAGGC GTGGCTTCTTGGCTGCTTGACGAAGTGTCGTGAAT AAAAGAAAGGAGACCGCAGAAGTAAAGAAGTGGG GAGTTTAGGCAAGTGCCTGATTTGGGTAATCGAAA GCACCCAGTGATTGTATTTGATGACTTTTAAGCTTT CATATGCCGTTATTTAATACCTGTCACTTCCAAATG AGAGATGTAAGGGCAACGGCCGTTAGCGTTCTGT TTTGGATCAGGCTCTGGAGTGGACGCCCCTAGCTT AGGGGTCCTTCTAGGCAGCCAGAAACCTGCGGAA AATGGTAGCGATGGCGGCTGGGCCGAGTGGGTGT | 10 | WTTMGTLL KN* |

TABLE 3A-continued

| SEQ ID | identifier_position | position | modified_RNA | PAP length | PAP |
|---|---|---|---|---|---|
| | | | CTGGTGCCGGCGTTTGGGCTACGGTTGTTGTTGG CGACTGTGCTTCAAGCGGTGTCTGCTTTTGGGGCA GAGTTTTCATCGGAGGCATGCAGAGAGTTAGGCTT TTCTAGCAACTTGCTTTGCAGCTCTTGTGATCTTCT CGGACAGTTCAACCTGCTTCAGCTGGATCCTGATT GCAGAGGATGCTGTCAGGAGGAAGCACAATTTGA AACCAAAAAGCTGTATGCAGGAGCTATTCTTGAAG TTTGTGGATGAAAATTGGGAAGGTTCCCTCAAGTC CAAGCTTTTGTTAGGAGTGATAAACCCAAACTGTT CAGAGGACTGCAAATCAAGTATGTCCGTGGTTCAG ACCCTGTATTAAAGCTTTGGACGACAATGGGAACA TTGCTGAAGAACTGAGCATTCTCAAATGGAACACA GACAGTGTAGAAGAATTCCTGAGTGAAAAGTTGGA ACGCATATAAATCTTGCTTAAATTTTGTCCTATCCT TTTGTTACCTTATCAAATGAAATATTACAGCACCTA GAAAATAATTTAGTTTTGCTTGCTTCCATTGATCAG TCTTTTACTTGAGGCATTAAATATCTAATTAAATCGT GAAATGGCAGTATAGTCCATGATATCTAAGGAGTT GGCAAGCTTAACAAAACCCATTTTTATAAATGTCC ATCCTCCT | | |
| 1345 | NM_004264.3_88 | 88 | GTTTTGGCGTCCGTTTGCTGCGGTAGGAACATGG CGGATCGGCTCACGCAGCTTCAGGACGCTGTGAA TTCGCTTGCAGATCAGTTTGTAATGCCATTGGAGT ATTGCAGCAATGTGGTCCTCCTGCCTCTTTCAATA ATATTCAGACAGCAATTAACAAAGACCAGCCAGCT AACCCTACAGAAGAGTATGCCCAGCTTTTTGCAGC ACTGATTGCACGAACAGCAAAAGACATTGATGTTT TGATAGATTCCTTACCCAGTGAAGAATCTACAGCT GCTTTACAGGCTGCTAGCTTGTATAAGCTAGAAGA AGAAAAACCATGAAGCTGCTACATGTCTGGAGGATG TTGTTTATCGAGGAGACATGCTTCTGGAGAAGATA CAAAGCGCACTTGCTGATATTGCACAGTCACAGCT GAAGACAAGAAGTGGTACCCATAGCCAGTCTCTTC CAGACTCATAGCATCAGTGGATACCATGTGGCTGA GAAAAGAACTGTTTGAGTGCCATTAAGAATTCTGC ATCAGACTTAGATACAAGCCTTACCAACAATTACA GAAACATTAAACACTATGACACATTACCTTTTTAGC TATTTTAATAGTCTTCTATTTTCACTCTTGATAAGC TTATAAAATCATGATTGAATCAGCTTTAAAGCATCA TACCATCATTTTTTAACTGAGTGAAATTATTAAGGC ATGTAATACATTAATGAACATAATATAAGGAAACAT ATGTAAAATTCTGTTATGACATAATTTATGTCTCCAT TTTGTTGTATTGGCCAGTACTTTTACAAATCAAAAC ATCTCTCAAGCCAAAGGAGAAGACAGTAAGAACAG ACATAAGGGACATTTTAGTTTAGGCTAGTGTCCTG CCTCTTAGAGGTGGCATTGTGTAAATCTGAGCTTT GAGCAAGAAAGTTTTGGAAATTGTGTTGCTTTTAA GAAATAGAGTTAGTGTGGCTGGATAAGAAAGTCAC ATTTATGCAAATGTTTCTTCTGCTAGAACCTCATAC C | 41 | VMPLEYCS NVVLLPLSI IFRQQLTK TSQLTLQK SMPSFLQH* |
| 1346 | NM_004309.3_134 | 134 | GGGCGGCCGACGACGTTCGTCATTTAGTGCGGGA GGGATCCTGAACCGCGCGGCCGAACCCTCCGGT GTCCCGACCCAGGCTAAGCTTGAGCATGGCTGAG CAGGAGCCCACAGCCGAGCAGCTGGCCCAGATG CAGCGGAGAACGAGGAGGATGAGCACTCGGTCAA CTACAAGCCCCGGCCCAGAAGAGCATCCAGGAG ATCCAGGAGCTGGACAAGGACGACGAGAGCCTGC GAAAGTACAAGGAGGCCCTGCTGGGCCGCGTGG CCGTTTCCGCAGACCCCAACGTCCCCAACGTCGT GGTGACTGGCCTGACCCTGGTGTGCAGCTCGGCC CCGGGCCCCTGGAGCTGGACCTGACGGGCGAC CTGGAGAGCTTCAAGAAGCAGTCGTTTGTGCTGAA GGAGGGTGTGGAGTACCGGATAAAAATCTCTTTCC GGGTTAACCGAGAGATAGTGTCCGGCATGAAGTA CATCCAGCATACGTACAGGAAAGGCGTCAAGATTG ACAAGACTGACTACATGGTAGGCAGCTATGGGCC CCGGGCCGAGGAGTACAGAGTTCCTGACCCCCGTG GAGGAGGCACCCAAGGGTATGCTGGCCCGGGGC AGCTACAGCATCAAGTCCCGCTTCACAGACGACG ACAAGACCGACCACCTGTCCTGGGAGTGGAATCT CACCATCAAGAAGGACTGGAAGGACTGAGCCCAG CCAGAGGCGGGCAGGGCAGACTGACGGACGGAC GACGGACAGGCGGATGTGTCCCCCCCAGCCCCTC CCCTCCCCATACCAAAGTGCTGACAGGCCCTCCG TGCCCCTCCCACCCTGGTCCGCCTCCCTGGCCTG GCTCAACCGAGTGCCTCCGACCCCCTCCTCAGC CCTCCCCCACCCACAGGCCCCAGCCTCCTCGGTCT | 58 | MQRRTRR MSTRSTTS PRPRRASR RSRSWTR TTRACEST RRPCWAA WPFPQTPT SPTSW* |

TABLE 3A-continued

| SEQ ID | identifier_position | position | modified_RNA | PAP length | PAP |
|---|---|---|---|---|---|
| | | | CCTGTCTCGTTGCTGCTTCTGCCTGTGCTGTGGGG GAGAGAGGCCGCAGCCAGGCCTCTGCTGCCCTTT CTGTGCCCCCAGGTTCTATCTCCCCGTCACACCC GAGGC | | |
| 1347 | NM_0043 09.3_340 | 340 | GGGCGGCCGACGACGTTCGTCATTTAGTGCGGGA GGGATCCTGAACCGCGCGGCCGAACCCTCCGGT GTCCCGACCCAGGCTAAGCTTGAGCATGGCTGAG CAGGAGCCCACAGCCGAGCAGCTGGCCCAGATTG CAGCGGAGAACGAGGAGGATGAGCACTCGGTCAA CTACAAGCCCCCGGCCCAGAAGAGCATCCAGGAG ATCCAGGAGCTGGACAAGGACGACGAGAGCCTGC GAAAGTACAAGGAGGCCCTGCTGGGCCGCGTGG CCGTTTCCGCAGACCCCAACGTCCCCAACGTCGT GGTGACTGGCCTGACCCTGGTGTGCAGCTCGGCC CGGGCCCCCTGGAGCTGGACCTGACGGGCGACC TGGAGAGCTTCAAGAAGCAGTCGTTTGTGCTGAAG GAGGGTGTGGAGTACCGGATAAAAATCTCTTTCCG GGTTAACCGAGAGATAGTGTCCGGCATGAAGTAC ATCCAGCATACGTACAGGAAAGGCGTCAAGATTGA CAAGACTGACTACATGGTAGGCAGCTATGGGCCC CGGGCCGAGGAGTACGAGTTCCTGACCCCCGTGG AGGAGGCACCCAAGGGTATGCTGGCCCGGGGCA GCTACAGCATCAAGTCCCGCTTCACAGACGACGA CAAGACCGACCACCTGTCCTGGGAGTGGAATCTC ACCATCAAGAAGGACTGGAAGGACTGAGCCCAGC CAGAGGCGGGCAGGGCAGACTGACGGACGGACG ACGGACAGGCGGATGTGTCCCCCCAGCCCCTCC CCTCCCCATACCAAAGTGCTGACAGGCCCTCCGT GCCCCTCCCACCCTGGTCCGCCTCCCTGGCCTGG CTCAACCGAGTGCCTCCGACCCCCCTCCTCAGCC CTCCCCCACCCACAGGCCCAGCCTCCTCGGTCTC CTGTCTCGTTGCTGCTTCTGCCTGTGCTGTGGGG GAGAGAGGCCGCAGCCAGGCCTCTGCTGCCCTTT CTGTGCCCCCAGGTTCTATCTCCCCGTCACACCC GAGGC | 7 | RAPWSWT* |
| 1348 | NM_0043 09.3_372 | 372 | GGGCGGCCGACGACGTTCGTCATTTAGTGCGGGA GGGATCCTGAACCGCGCGGCCGAACCCTCCGGT GTCCCGACCCAGGCTAAGCTTGAGCATGGCTGAG CAGGAGCCCACAGCCGAGCAGCTGGCCCAGATTG CAGCGGAGAACGAGGAGGATGAGCACTCGGTCAA CTACAAGCCCCCGGCCCAGAAGAGCATCCAGGAG ATCCAGGAGCTGGACAAGGACGACGAGAGCCTGC GAAAGTACAAGGAGGCCCTGCTGGGCCGCGTGG CCGTTTCCGCAGACCCCAACGTCCCCAACGTCGT GGTGACTGGCCTGACCCTGGTGTGCAGCTCGGCC CCGGGCCCCCTGGAGCTGGACCTGACGGGCGAC TGGAGAGCTTCAAGAAGCAGTCGTTTGTGCTGAAG GAGGGTGTGGAGTACCGGATAAAAATCTCTTTCCG GGTTAACCGAGAGATAGTGTCCGGCATGAAGTAC ATCCAGCATACGTACAGGAAAGGCGTCAAGATTGA CAAGACTGACTACATGGTAGGCAGCTATGGGCCC CGGGCCGAGGAGTACGAGTTCCTGACCCCCGTGG AGGAGGCACCCAAGGGTATGCTGGCCCGGGGCA GCTACAGCATCAAGTCCCGCTTCACAGACGACGA CAAGACCGACCACCTGTCCTGGGAGTGGAATCTC ACCATCAAGAAGGACTGGAAGGACTGAGCCCAGC CAGAGGCGGGCAGGGCAGACTGACGGACGGACG ACGGACAGGCGGATGTGTCCCCCCAGCCCCTCC CCTCCCCATACCAAAGTGCTGACAGGCCCTCCGT GCCCCTCCCACCCTGGTCCGCCTCCCTGGCCTGG CTCAACCGAGTGCCTCCGACCCCCCTCCTCAGCC CTCCCCCACCCACAGGCCCAGCCTCCTCGGTCTC CTGTCTCGTTGCTGCTTCTGCCTGTGCTGTGGGG GAGAGAGGCCGCAGCCAGGCCTCTGCTGCCCTTT CTGTGCCCCCAGGTTCTATCTCCCCGTCACACCC GAGGC | 10 | WRASRSS RLC* |
| 1349 | NM_0043 09.3_551 | 551 | GGGCGGCCGACGACGTTCGTCATTTAGTGCGGGA GGGATCCTGAACCGCGCGGCCGAACCCTCCGGT GTCCCGACCCAGGCTAAGCTTGAGCATGGCTGAG CAGGAGCCCACAGCCGAGCAGCTGGCCCAGATTG CAGCGGAGAACGAGGAGGATGAGCACTCGGTCAA CTACAAGCCCCCGGCCCAGAAGAGCATCCAGGAG ATCCAGGAGCTGGACAAGGACGACGAGAGCCTGC GAAAGTACAAGGAGGCCCTGCTGGGCCGCGTGG CCGTTTCCGCAGACCCCAACGTCCCCAACGTCGT GGTGACTGGCCTGACCCTGGTGTGCAGCTCGGCC CCGGGCCCCCTGGAGCTGGACCTGACGGGCGAC | 5 | RSTSS* |

TABLE 3A-continued

| SEQ ID | identifier_position | position | modified_RNA | PAP length | PAP |
|---|---|---|---|---|---|
| | | | CTGGAGAGCTTCAAGAAGCAGTCGTTTGTGCTGAA GGAGGGTGTGGAGTACCGGATAAAAATCTCTTTCC GGGTTAACCGAGAGATAGTGTCCGGCATGAAGTA CATCCAGCATACGTACAGGAAAGGCGTCAAGATTG ACAAGACTGACTACATGGTAGGCAGCTATGGGCC CCGGGCGAGGAGTACGAGTTCCTGACCCCCGTGG AGGAGGCACCCAAGGGTATGCTGGCCCGGGGCA GCTACAGCATCAAGTCCCGCTTCACAGACGACGA CAAGACCGACCACCTGTCCTGGGAGTGGAATCTC ACCATCAAGAAGGACTGGAAGGACTGAGCCCAGC CAGAGGCGGGCAGGGCAGACTGACGGACGGACG ACGGACAGGCGGATGTGTCCCCCCCAGCCCCTCC CCTCCCCATACCAAAGTGCTGACAGGCCCTCCGT GCCCCTCCCACCCTGGTCCGCCTCCCTGGCCTGG CTCAACCGAGTGCCTCCGACCCCCCTCCTCAGCC CTCCCCCACCCACAGGCCCAGCCTCCTCGGTCTC CTGTCTCGTTGCTGCTTCTGCCTGTGCTGTGGGG GAGAGAGGCCGCAGCCAGGCCTCTGCTGCCCTTT CTGTGCCCCCCAGGTTCTATCTCCCCGTCACACCC GAGGC | | |
| 1350 | NM_0043 43.2_206 | 206 | GTCCGTACTGCAGAGCCGCTGCCGGAGGGTCGTT TTAAAGGGCCGCGTTGCCGCCCCCTCGGCCCGCC ATGCTGCTATCCGTGCCGCTGCTGCTCGGCCTCC TCGGCCTGGCCGTCGCCGAGCCCGCCGTCTACTT CAAGGAGCAGTTTCTGGACGGAGACGGGTGGACT TCCCGCTGGATCGAATCCAAACACAAGTCAGATTT GGCAAATTCGTTCTCAGTTCCGGCAAGTTCTACGG TGACGAGGAGAAAGATAAAGGTTTGCAGACAAGC CAGGATGCACGCTTTTATGCTCTGTCGGCCAGTTT CGAGCCTTTCAGCAACAAAGGCCAGACGCTGGTG GTGCAGTTCACGGTGAAACATGAGCAGAACATCG ACTGTGGGGGCGGCTATGTGAAGCTGTTTCCTAAT AGTTTGGACCAGACAGACATGCACGGAGACTCAG AATACAACATCATGTTTGGTCCCGACATCTGTGGC CCTGGCACCAAGAAGGTTCATGTCATCTTCAACTA CAAGGGCAAGAACGTGCTGATCAACAAGGACATC CGTTGCAAGGATGATGAGTTTACACACCTGTACAC ACTGATTGTGCGGCCAGACAACACCTATGAGGTG AAGATTGACAACAGCCAGGTGGAGTCCGGCTCCT TGGAAGACGATTGGGACTTCCTGCCACCCAAGAA GATAAAGGATCCTGATGCTTCAAAACCGGAAGACT GGGATGAGCGGGCCAAGATCGATGATCCCACAGA CTCCAAGCCTGAGGACTGGGACAAGCCCGAGCAT ATCCCTGACCCTGATGCTAAGAAGCCCGAGGACT GGGATGAAGAGATGGACGGAGAGTGGGAACCCC CAGTGATTCAGAACCCTGAGTACAAGGGTGAGTG GAAGCCCCGGCAGATCGACAACCCAGATTACAAG GGCACTTGGATCCACCCAGAAATTGACAACCCCG AGTATTCTCCCGATCCCAGTATCTATGCCTATGATA ACTTTGGCGTGCTGGGCCTGGACCTCTGG | 51 | LANSFSVP ASSTVTRR KIKVCRQA RMHAFML CRPVSSLS ATKARRW WCSSR* |
| 1351 | NM_0043 43.2_464 | 464 | GTCCGTACTGCAGAGCCGCTGCCGGAGGGTCGTT TTAAAGGGCCGCGTTGCCGCCCCCTCGGCCCGCC ATGCTGCTATCCGTGCCGCTGCTGCTCGGCCTCC TCGGCCTGGCCGTCGCCGAGCCCGCCGTCTACTT CAAGGAGCAGTTTCTGGACGGAGACGGGTGGACT TCCCGCTGGATCGAATCCAAACACAAGTCAGATTT TGGCAAATTCGTTCTCAGTTCCGGCAAGTTCTACG GTGACGAGGAGAAAGATAAAGGTTTGCAGACAAG CCAGGATGCACGCTTTTATGCTCTGTCGGCCAGTT TCGAGCCTTTCAGCAACAAAGGCCAGACGCTGGT GGTGCAGTTCACGGTGAAACATGAGCAGAACATC GACTGTGGGGGCGGCTATGTGAAGCTGTTTCCTA ATAGTTTGGACCAGACAGACATGCACGGAGACTCA GAATACAACATCATGTTTGGTCCCGACATCTGTGGC CCTGGCACCAAGAAGGTTCATGTCATCTTCAACTA CAAGGGCAAGAACGTGCTGATCAACAAGGACATC CGTTGCAAGGATGATGAGTTTACACACCTGTACAC ACTGATTGTGCGGCCAGACAACACCTATGAGGTG AAGATTGACAACAGCCAGGTGGAGTCCGGCTCCT TGGAAGACGATTGGGACTTCCTGCCACCCAAGAA GATAAAGGATCCTGATGCTTCAAAACCGGAAGACT GGGATGAGCGGGCCAAGATCGATGATCCCACAGA CTCCAAGCCTGAGGACTGGGACAAGCCCGAGCAT ATCCCTGACCCTGATGCTAAGAAGCCCGAGGACT GGGATGAAGAGATGGACGGAGAGTGGGAACCCC CAGTGATTCAGAACCCTGAGTACAAGGGTGAGTG GAAGCCCCGGCAGATCGACAACCCAGATTACAAG | 24 | LVPTSVAL APRRFMSS STTRARTC* |

TABLE 3A-continued

| SEQ ID | identifier_ position | position | modified_RNA | PAP length | PAP |
|---|---|---|---|---|---|
| 1352 | NM_0043 43.2_601 | 601 | GGCACTTGGATCCACCCAGAAATTGACAACCCCG AGTATTCTCCCGATCCCAGTATCTATGCCTATGATA ACTTTGGCGTGCTGGGCCTGGACCTCTGG GTCCGTACTGCAGAGCCGCTGCCGGAGGGTCGTT TTAAAGGGCCGCGTTGCCGCCCCCTCGGCCCGCC ATGCTGCTATCCGTGCCGCTGCTGCTCGGCCTCC TCGGCCTGGCCGTCGCCGAGCCCGCCGTCTACTT CAAGGAGCAGTTTCTGGACGGAGACGGGTGGACT TCCCGCTGGATCGAATCCAAACACAAGTCAGATTT TGGCAAATTCGTTCTCAGTTCCGGCAAGTTCTACG GTGACGAGGAGAAAGATAAAGGTTTGCAGACAAG CCAGGATGCACGCTTTTATGCTCTGTCGGCCAGTT TCGAGCCTTTCAGCAACAAAGGCCAGACGCTGGT GGTGCAGTTCACGGTGAAACATGAGCAGAACATC GACTGTGGGGGCGGCTATGTGAAGCTGTTTCCTA ATAGTTTGGACCAGACAGACATGCACGGAGACTCA GAATACAACATCATGTTTGGTCCCGACATCTGTGG CCCTGGCACCAAGAAGGTTCATGTCATCTTCAACT ACAAGGGCAAGAACGTGCTGATCAACAAGGACAT CCGTTGCAAGGATGATGAGTTTACACACCTGTACA CACTGATTGTGCGGCAGACAACACCTATGAGGTG AAGATTGACAACAGCCAGGTGGAGTCCGGCTCCT TGGAAGACGATTGGGACTTCCTGCCACCCAAGAA GATAAAGGATCCTGATGCTTCAAAACCGGAAGACT GGGATGAGCGGGCCAAGATCGATGATCCCACAGA CTCCAAGCCTGAGGACTGGGACAAGCCCGAGCAT ATCCCTGACCCTGATGCTAAGAAGCCCGAGGACT GGGATGAAGAGATGGACGGAGAGTGGGAACCCC CAGTGATTCAGAACCCTGAGTACAAGGGTGAGTG GAAGCCCCGGCAGATCGACAACCCAGATTACAAG GGCACTTGGATCCACCCAGAAATTGACAACCCCG AGTATTCTCCCGATCCCAGTATCTATGCCTATGATA ACTTTGGCGTGCTGGGCCTGGACCTCTGG | 6 | QTTPMR* |
| 1353 | NM_0043 43.2_666 | 666 | GTCCGTACTGCAGAGCCGCTGCCGGAGGGTCGTT TTAAAGGGCCGCGTTGCCGCCCCCTCGGCCCGCC ATGCTGCTATCCGTGCCGCTGCTGCTCGGCCTCC TCGGCCTGGCCGTCGCCGAGCCCGCCGTCTACTT CAAGGAGCAGTTTCTGGACGGAGACGGGTGGACT TCCCGCTGGATCGAATCCAAACACAAGTCAGATTT TGGCAAATTCGTTCTCAGTTCCGGCAAGTTCTACG GTGACGAGGAGAAAGATAAAGGTTTGCAGACAAG CCAGGATGCACGCTTTTATGCTCTGTCGGCCAGTT TCGAGCCTTTCAGCAACAAAGGCCAGACGCTGGT GGTGCAGTTCACGGTGAAACATGAGCAGAACATC GACTGTGGGGGCGGCTATGTGAAGCTGTTTCCTA ATAGTTTGGACCAGACAGACATGCACGGAGACTCA GAATACAACATCATGTTTGGTCCCGACATCTGTGG CCCTGGCACCAAGAAGGTTCATGTCATCTTCAACT ACAAGGGCAAGAACGTGCTGATCAACAAGGACAT CCGTTGCAAGGATGATGAGTTTACACACCTGTACA CACTGATTGTGCGGCAGACAACACCTATGAGGT GAAGATTGACAACAGCCAGGTGGAGTCCGGCTCC TTGGAAGACGATTGGGACTTCCTGCCACCCAAGAA GATAAAGGATCCTGATGCTTCAAAACCGGAAGACT GGGATGAGCGGGCCAAGATCGATGATCCCACAGA CTCCAAGCCTGAGGACTGGGACAAGCCCGAGCAT ATCCCTGACCCTGATGCTAAGAAGCCCGAGGACT GGGATGAAGAGATGGACGGAGAGTGGGAACCCC CAGTGATTCAGAACCCTGAGTACAAGGGTGAGTG GAAGCCCCGGCAGATCGACAACCCAGATTACAAG GGCACTTGGATCCACCCAGAAATTGACAACCCCG AGTATTCTCCCGATCCCAGTATCTATGCCTATGATA ACTTTGGCGTGCTGGGCCTGGACCTCTGG | 8 | GTSCHPR R* |
| 1354 | NM_0043 55.2_368 | 368 | CAGGGTCCCAGATGCACAGGAGGAAGCAGGA GCTGTCGGGAAGATCAGAAGCCAGTCATGGATGA CCAGCGCGACCTTATCTCCAACAATGAGCAACTGC CCATGCTGGGCCGGCGCCCTGGGGCCCCGGAGA GCAAGTGCAGCCGCGGAGCCCTGTACACAGGCTT TTCCATCCTGGTGACTCTGCTCCTCGCTGGCCAGG CCACCACCGCCTACTTCCTGTACCAGCAGCAGGG CCGGCTGGACAAACTGACAGTCACCTCCCAGAAC CTGCAGCTGGAGAACCTGCGCATGAAGCTTCCA AGCCTCCCAAGCCTGTGAGCAAGATGCGCATGGC CACCCCGCTGCTGATGCAGGCGCTGCCATGGGAG CCCTGCCCCAGGGGCCCATGCAGAATGCCACCAA GTATGGCAACATGACAGAGGACCATGTGATGCAC CTGCTCCAGAATGCTGACCCCCTGAAGGTGTACC | 17 | WEPCPRG PCRMPPS MAT* |

TABLE 3A-continued

| SEQ ID | identifier_position | position | modified_RNA | PAP length | PAP |
|---|---|---|---|---|---|
| | | | CGCCACTGAAGGGGAGCTTCCCGGAGAACCTGAG<br>ACACCTTAAGAACACCATGGAGACCATAGACTGGA<br>AGGTCTTTGAGAGCTGGATGCACCATTGGCTCCTG<br>TTTGAAATGAGCAGGCACTCCTTGGAGCAAAAGCC<br>CACTGACGCTCCACCGAAAGAGTCACTGGAACTG<br>GAGGACCCGTCTTCTGGGCTGGGTGTGACCAAGC<br>AGGATCTGGGCCCAGTCCCCATGTGAGAGCAGCA<br>GAGGCGGTCTTCAACATCCTGCCAGCCCCACACA<br>GCTACAGCTTTCTTGCTCCCTTCAGCCCCCAGCCC<br>CTCCCCCATCTCCCACCCTGTACCTCATCCCATGA<br>GACCCTGGTGCCTGGCTCTTTCGTCACCCTTGGAC<br>AAGACAAACCAAGTCGGAACAGCAGATAACAATGC<br>AGCAAGGCCCTGCTGCCCAATCTCCATCTGTCAAC<br>AGGGGCGTGAGGTCCCAGGAAGTGGCCAAAAGCT<br>AGACAGATCCCCGTTCCTGACATCACAGCAGCCTC<br>CAACACAAGGCTCCAAGACCTAGGCTCAT | | |
| 1355 | NM_0043 96.2_218 | 218 | ACCTCATTCATTTCTACCGGTCTCTAGTAGTGCAG<br>CTTCGGCTGGTGTCATCGGTGTCCTTCCTCCGCTG<br>CCGCCCCCGCAAGGCTTCGCCGTCATCGAGGCCA<br>TTTCCAGCGACTTGTCGCACGCTTTTCTATATACTT<br>CGTTCCCCGCCAACCGCAACCATTGACGCCATGT<br>CGGGTTATTCGAGTGACCGAGACCGCGGCCGGGA<br>CCGAGGGTTGGTGCACCTCGATTTGGAGGAAGTA<br>GGGCAGGGCCCTTATCTGGAAAGAAGTTTGGAAA<br>CCCTGGGGAGAAATTAGTTAAAAAGAAGTGGAATC<br>TTGATGAGCTGCCTAAATTTGAGAAGAATTTTTATC<br>AAGAGCACCCTGATTTGGCTAGGCGCACAGCACA<br>AGAGGTGGAAACATACAGAAGAAGCAAGGAAATTA<br>CAGTTAGAGGTCACAACTGCCCGAAGCCAGTTCTA<br>AATTTTTATGAAGCCAATTTCCCTGCAAATGTCATG<br>GATGTTATTGCAAGACAGAATTTCACTGAACCCAC<br>TGCTATTCAAGCTCAGGGATGGCCAGTTGCTCTAA<br>GTGGATTGGATATGGTTGGAGTGGCACAGACTGG<br>ATCTGGGAAAACATTGTCTTATTTGCTTCCTGCCAT<br>TGTCCACATCAATCATCAGCCATTCCTAGAGAGAG<br>GCGATGGGCCTATTTGTTTGGTGCTGGCACCAACT<br>CGGGAACTGGCCCAACAGGTGCAGCAAGTAGCTG<br>CTGAATATTGTAGAGCATGTCGCTTGAAGTCTACTT<br>GTATCTACGGTGGTGCTCCTAAGGGACCACAAATA<br>CGTGATTTGGAGAGAGGTGTGGAAATCTGTATTGC<br>AACACCTGGAAGACTGATTGACTTTTTAGAGTGTG<br>GAAAAACCAATCTGAGAAGAACAACCTACCTTGTC<br>CTTGATGAAGCAGATAGAATGCTTGATATGGGCTT<br>TGAACCCCAAATAAGGAAGATTGTGGATCAAATAA<br>GACCTGATAGGCAAACTCTAATGTGGAGTGCGACT<br>TGGCCAAAAGAA | 25 | LVHLDLEE<br>VGQGPYLE<br>RSLETLGR<br>N* |
| 1356 | NM_0044 50.1_168 | 168 | GCGGCGTTGTAGTTAAGCTCGTGTAACGGCGGCG<br>GTGTCGGCAGCTGCTGTAGCGAAGAGAGTTTGGC<br>GCGATGTCTCACACCATTTTGCTGGTACAGCCTAC<br>CAAGAGGCCAGAAGGCAGAACTTATGCTGACTAC<br>GAATCTGTGAATGAATGCATGGAAGGTGTTGTAAA<br>ATGTATGAAGAACATCTGAAAAGAATGAATCCCAA<br>CAGTCCCTCTATCACATATGACATCAGTCAGTTGTT<br>TGATTTCATCGATGATCTGGCAGACCTCAGCTGCC<br>TGGTTTACCGAGCTGATACCCAGACATACCAGCCT<br>TATAACAAAGACTGGATTAAAGAGAAGATCTACGT<br>GCTCCTTCGTCGGCAGGCCCAACAGGCTGGGAAA<br>TAATTGTGTTGGAAGCACTGGGGGGGTTGGGGTG<br>GGCTTGGAACACAGGTGTGTACAGCGTGCTGTAG<br>TGGAAGTTTTGTATCATAGTAATCCTGTTTCCACTT<br>TGTTATACTCTAGCCAAGATTGACTGTATTAGATGA<br>AATGTGAGGATCTTGTTCAATCGGAAACCCCCGTT<br>ACCTCCTCTTTTCTTTCTCTTTCTTTTTTTTTTTTT<br>ACTTAAACATTTTTATGATGATTTAGATGGAAGTTG<br>TTCTTCGTCACTTAATGTTGGTTCCAGTCCTTCAAC<br>TGTTCATATCTACTTTATAACATTCACATACTAACC<br>CTTCTTCAAGATGGGGTGGGGGGTGGAAATGCAG<br>TTTAGCCATGTCCTCAAGATAAAGTCTTGGTAAAAA<br>TAAATAAATGTCCTTTAGTTATAAAAAAAAAAAAAAA<br>WA | 7 | VKCMKNI* |
| 1357 | NM_0044 62.3_608 | 608 | GGGCGGAGCGGCGGGCGGGGCGTCGCCGTACTAG<br>GCCTGCCCCCTGTCCGGCCAGCCCCTCGAAGCAC<br>CTACTCCACAGGTCCAGCCGGCCGGTGAGCGCCT<br>GGGGACCGCAGAGGTGAGAGTCGCGCCCGGGAG<br>TCCGCCGCCTGCGCCAGGATGGAGTTCGTGAAAT<br>GCCTTGGCCACCCCGAAGAGTTCTACAACCTGGT<br>GCGCTTCCGGATCGGGGGCAAGCGGAAGGTGAT | 10 | MGWQSFW<br>ISM* |

TABLE 3A-continued

| SEQ ID | identifier_position | position | modified_RNA | PAP length | PAP |
|---|---|---|---|---|---|
| | | | GCCCAAGATGGACCAGGACTCGCTCAGCAGCAGC<br>CTGAAAACTTGCTACAAGTATCTCAATCAGACCAG<br>TCGCAGTTTCGCAGCTGTTATCCAGGCGCTGGATG<br>GGGAAATGCGCAACGCAGTGTGCATATTTTATCTG<br>GTTCTCCGAGCTCTGGACACACTGGAAGATGACAT<br>GACCATCAGTGTGGAAAAGAAGGTCCCGCTGTTA<br>CACAACTTTCACTCTTTCCTTTACCAACCAGACTGG<br>CGGTTCATGGAGAGCAAGGAGAAGGATCGCCAGG<br>TGCTGGAGGACTTCCCAACGATCTCCCTTGAGTTT<br>AGAAATCTGGCTGAGAAATACCAAACAGTGATTGC<br>CGACATTTGCCGGAGAATGGGCATGGGATGGCAG<br>AGTTTTTGGATAAGCATGTGACCTCTGAACAGGAG<br>TGGGACAAGTACTGCCACTATGTTGCTGGGCTGGT<br>CGGAATTGGCCTTTCCCGTCTTTTCTCAGCCTCAG<br>AGTTTGAAGACCCCTTAGTTGGTGAAGATACAGAA<br>CGTGCCAACTCTATGGGCCTGTTTTGCAGAAAAC<br>AAACATCATCCGTGACTATCTGGAAGACCAGCAAG<br>GAGGAAGAGAGTTCTGGCCTCAAGAGGTTTGGAG<br>CAGGTATGTTAAGAAGTTAGGGGATTTTGCTAAGC<br>CGGAGAATATTGACTTGGCCGTGCAGTGCCTGAAT<br>GAACTTATAACCAATGCACTGCACCACATCCCAGA<br>TGTCATCACCTACCTTTCGAGACTCAGAAACCAGA<br>GTGTGTTTAACTTCTGTGCTATT | | |
| 1358 | NM_0044<br>62.3_625 | 625 | GGCGGAGCGGCGGGCGGGGCGTCGCCGTACTAG<br>GCCTGCCCCCTGTCCGGCCAGCCCCTCGAAGCAC<br>CTACTCCACAGGTCCAGCCGGCCGGTGAGCGCCT<br>GGGGACCGCAGAGGTGAGAGTCGCGCCCGGGAG<br>TCCGCCGCCTGCGCCAGGATGGAGTTCGTGAAAT<br>GCCTTGGCCACCCCGAAGAGTTCTACAACCTGGT<br>GCGCTTCCGGATCGGGGGCAAGCGGAAGGTGAT<br>GCCCAAGATGGACCAGGACTCGCTCAGCAGCAGC<br>CTGAAAACTTGCTACAAGTATCTCAATCAGACCAG<br>TCGCAGTTTCGCAGCTGTTATCCAGGCGCTGGATG<br>GGGAAATGCGCAACGCAGTGTGCATATTTTATCTG<br>GTTCTCCGAGCTCTGGACACACTGGAAGATGACAT<br>GACCATCAGTGTGGAAAAGAAGGTCCCGCTGTTA<br>CACAACTTTCACTCTTTCCTTTACCAACCAGACTGG<br>CGGTTCATGGAGAGCAAGGAGAAGGATCGCCAGG<br>TGCTGGAGGACTTCCCAACGATCTCCCTTGAGTTT<br>AGAAATCTGGCTGAGAAATACCAAACAGTGATTGC<br>CGACATTTGCCGGAGAATGGGCATTGGGATGGCA<br>GAGTTTTTGGATAAGCATGTGACCTCTGAACAGGAG<br>TGGGACAAGTACTGCCACTATGTTGCTGGGCTGGT<br>CGGAATTGGCCTTTCCCGTCTTTTCTCAGCCTCAG<br>AGTTTGAAGACCCCTTAGTTGGTGAAGATACAGAA<br>CGTGCCAACTCTATGGGCCTGTTTTGCAGAAAAC<br>AAACATCATCCGTGACTATCTGGAAGACCAGCAAG<br>GAGGAAGAGAGTTCTGGCCTCAAGAGGTTTGGAG<br>CAGGTATGTTAAGAAGTTAGGGGATTTTGCTAAGC<br>CGGAGAATATTGACTTGGCCGTGCAGTGCCTGAAT<br>GAACTTATAACCAATGCACTGCACCACATCCCAGA<br>TGTCATCACCTACCTTTCGAGACTCAGAAACCAGA<br>GTGTGTTTAACTTCTGTGCTATT | 4 | WISM* |
| 1359 | NM_0044<br>62.3_858 | 858 | GGCGGAGCGGCGGGCGGGGCGTCGCCGTACTAG<br>GCCTGCCCCCTGTCCGGCCAGCCCCTCGAAGCAC<br>CTACTCCACAGGTCCAGCCGGCCGGTGAGCGCCT<br>GGGGACCGCAGAGGTGAGAGTCGCGCCCGGGAG<br>TCCGCCGCCTGCGCCAGGATGGAGTTCGTGAAAT<br>GCCTTGGCCACCCCGAAGAGTTCTACAACCTGGT<br>GCGCTTCCGGATCGGGGGCAAGCGGAAGGTGAT<br>GCCCAAGATGGACCAGGACTCGCTCAGCAGCAGC<br>CTGAAAACTTGCTACAAGTATCTCAATCAGACCAG<br>TCGCAGTTTCGCAGCTGTTATCCAGGCGCTGGATG<br>GGGAAATGCGCAACGCAGTGTGCATATTTTATCTG<br>GTTCTCCGAGCTCTGGACACACTGGAAGATGACAT<br>GACCATCAGTGTGGAAAAGAAGGTCCCGCTGTTA<br>CACAACTTTCACTCTTTCCTTTACCAACCAGACTGG<br>CGGTTCATGGAGAGCAAGGAGAAGGATCGCCAGG<br>TGCTGGAGGACTTCCCAACGATCTCCCTTGAGTTT<br>AGAAATCTGGCTGAGAAATACCAAACAGTGATTGC<br>CGACATTTGCCGGAGAATGGGCATTGGGATGGCA<br>GAGTTTTTGGATAAGCATGTGACCTCTGAACAGGA<br>GTGGGACAAGTACTGCCACTATGTTGCTGGGCTG<br>GTCGGAATTGGCCTTTCCCGTCTTTTCTCAGCCTC<br>AGAGTTTGAAGACCCCTTAGTTGGTGAAGATACAG<br>AACGTGCCAACTCTATGGGCCTGTTTTGCAGAAA<br>ACAAACATCATCCGTGACTATCTGGAAGACCAGCA | 7 | GAGMLRS* |

TABLE 3A-continued

| SEQ ID | identifier_position | position | modified_RNA | PAP length | PAP |
|---|---|---|---|---|---|
| | | | AGGAGGAAGAGAGTTCTGGCCTCAAGAGGTTGGA GCAGGTATGTTAAGAAGTTAGGGGATTTTGCTAAG CCGGAGAATATTGACTTGGCCGTGCAGTGCCTGA ATGAACTTATAACCAATGCACTGCACCACATCCCA GATGTCATCACCTACCTTTCGAGACTCAGAAACCA GAGTGTGTTTAACTTCTGTGCTATT | | |
| 1360 | NM_0044 93.2_462 | 462 | ATCCCCATCCCGTGGAGTGGCCGGCGACAAGATG GCAGCAGCGTGTCGGAGCGTGAAGGGCCTGGTG GCGGTAATAACCGGAGGAGCCTCGGGCCTGGGC CTGGCCACGGCGGAGCGACTTGTGGGGCAGGGA GCCTCTGCTGTGCTTCTGGACCTGCCCAACTCGG GTGGGGAGGCCCAAGCCAAGAAGTTAGGAAACAA CTGCGTTTTCGCCCCAGCCGACGTGACCTCTGAG AAGGATGTGCAAACAGCTCTGGCTCTAGCAAAAG GAAAGTTTGGCCGTGTGGATGTAGCTGTCAACTGT GCAGGCATCGCGGTGGCTAGCAAGACGTACAACT TAAAGAAGGGCCAGACCCATACCTTGGAAGACTTC CAGCGAGTTCTTGATGTGAATCTCATGGGCACCTT CAATGTGATCCGCCTGGTGGCTGGTGAGATGGGC CAGAATGAACCAGACCAGGAGGCCAACGTGGGGT CATCATCAACACTGCCAGTGTGGCTGCCTTCGAGG GTCAGGTTGGACAAGCTGCATACTCTGCTTCCAAG GGGGGAATAGTGGGCATGACACTGCCCATTGCTC GGGATCTGGCTCCCATAGGTATCCGGGTGATGAC CATTGCCCCAGGTCTGTTTGGCACCCCACTGCTGA CCAGCCTCCAGAGAAAGTGTGCAACTTCTTGGC CAGCCAAGTGCCCTTCCCTAGCCGACTGGGTGAC CCTGCTGAGTATGCTCACCTCGTACAGGCATCAT CGAGAACCCATTCCTCAATGGAGAGGTCATCCGG CTGGATGGGGCCATTCGTATGCAGCCTTGAAGGG AGAAGGCAGAGAAAACACACGCTCCTCTGCCCTT CCTTTCCCTGGGGTACTACTCTCCAGCTTGGGAGG AAGCCCAGTAGCCATTTTGTAACTGCCTACCAGTC GCCCTCTGTGCCTAATAAAGTCTCTTTTTCTCACAG AG | 31 | EANVGSSS TLPVWLPS RVRLDKLH TLLPRGE* |
| 1361 | NM_0045 00.3_304 | 304 | AGGAATGGGGCGGGGACTAGGCCTTCGCCTCGG CGGCAGAGGAGACTCGGGGGCCATTTTGTGAAGA GACGAAGACTGAGCGGTTGTGGCCGCGTTGCCGA CCTCCAGCAGCAGTCGGCTTCTCTACGCAGAACC CGGGAGTAGGAGACTCAGAATCGAATCTCTTCTCC CTCCCCTTCTTGTGAGATTTTTTTGATCTTCAGCTA CATTTTCGGCTTTGTGAGAAACCTTACCATCAAACA CGATGGCCAGCAACGTTACCAACAAGACAGATCCT CGCTCCATGAACTCCCGTGTATTCATGGGAATCTC AACACTCTTGTGGTCAAGAAATCTGATGTGGAGGC AATCTTTTCGAAGTATGGCAAAATTGTGGGCTGCT CTGTTCATAAGGGCTTTGCCTTCGTTCAGTATGTTA ATGAGAGAAATGCCCGGGCTGCTGTAGCAGGAGA GGATGGCAGAATGATTGCTGGCCAGGTTTTAGATA TTAACCTGGCTGCAGAGCCAAAAGTGAACCGAGG AAAAGCAGGTGTGAAACGATCTGCAGCGGAGATG TACGGCTCCTCTTTTGACTTGGACTATGACTTTCAA CGGGACTATTATGATAGGATGTACAGTTACCCAGC ACGTGTACCTCCTCCTCCTCCTATTGCTCGGGCTG TAGTGCCCTCGAAACGTCAGCGTGTATCAGGAAAC ACTTCACGAAGGGGCAAAAGTGGCTTCAATTCTAA GAGTGGACAGCGGGGATCTTCCAAGTCTGGAAAG TTGAAAGGAGATGACCTTCAGGCCATTAAGAAGGA GCTGACCCAGATAAAACAAAAAGTGGATTCTCTCC TGGAAAACCTGGAAAAAATTGAAAAGGAACAGAGC AAACAAGCAGTAGAGATGAAGAATGATAAGTCAGA AGAGGAGCAGAGCAGCAGCTCCGTGAAGAAAGAT GAGACTAATGTGAAGATGGAGTCTGAGGGGGGTG CAGATGACTCTGCTGAGGAGGGGGACCTACTGGA TGATGATGATAATGAAG | 47 | MGISTLLW SRNLMWR QSFRSMA KLWAALFI RALPSFSM LMREMPG LL* |
| 1362 | NM_0045 00.3_373 | 373 | AGGAATGGGGCGGGGACTAGGCCTTCGCCTCGG CGGCAGAGGAGACTCGGGGGCCATTTTGTGAAGA GACGAAGACTGAGCGGTTGTGGCCGCGTTGCCGA CCTCCAGCAGCAGTCGGCTTCTCTACGCAGAACC CGGGAGTAGGAGACTCAGAATCGAATCTCTTCTCC CTCCCCTTCTTGTGAGATTTTTTTGATCTTCAGCTA CATTTTCGGCTTTGTGAGAAACCTTACCATCAAACA CGATGGCCAGCAACGTTACCAACAAGACAGATCCT CGCTCCATGAACTCCCGTGTATTCATTGGGAATCT CAACACTCTTGTGGTCAAGAAATCTGATGTGGAGG CAATCTTTTCGAAGTATGGCAAAATGTGGGCTGCT CTGTTCATAAGGGCTTTGCCTTCGTTCAGTATGTTA | 24 | MWAALFIR ALPSFSML MREMPGL L* |

TABLE 3A-continued

| SEQ ID | identifier_position | position | modified_RNA | PAP length | PAP |
|---|---|---|---|---|---|
| | | | ATGAGAGAAATGCCCGGGCTGCTGTAGCAGGAGA<br>GGATGGCAGAATGATTGCTGGCCAGGTTTTAGATA<br>TTAACCTGGCTGCAGAGCCAAAAGTGAACCGAGG<br>AAAAGCAGGTGTGAAACGATCTGCAGCGGAGATG<br>TACGGCTCCTCTTTTGACTTGGACTATGACTTTCAA<br>CGGGACTATTATGATAGGATGTACAGTTACCCAGC<br>ACGTGTACCTCCTCCTCCTCCTATTGCTCGGGCTG<br>TAGTGCCCTCGAAACGTCAGCGTGTATCAGGAAAC<br>ACTTCACGAAGGGGCAAAAGTGGCTTCAATTCTAA<br>GAGTGGACAGCGGGGATCTTCCAAGTCTGGAAAG<br>TTGAAAGGAGATGACCTTCAGGCCATTAAGAAGGA<br>GCTGACCCAGATAAAACAAAAAGTGGATTCTCTCC<br>TGGAAAAACCTGGAAAAAATTGAAAAGGAACAGAGC<br>AAACAAGCAGTAGAGATGAAGAATGATAAGTCAGA<br>AGAGGAGCAGAGCAGCAGCTCCGTGAAGAAAGAT<br>GAGACTAATGTGAAGATGGAGTCTGAGGGGGGTG<br>CAGATGACTCTGCTGAGGAGGGGGACCTACTGGA<br>TGATGATGATAATGAAG | | |
| 1363 | NM_004500.3_400 | 400 | AGGAATGGGGCGGGGACTAGGCCTTCGCCTCGG<br>CGGCAGAGGAGACTCGGGGGCCATTTTGTGAAGA<br>GACGAAGACTGAGCGGTTGTGGCCGCGTTGCCGA<br>CCTCCAGCAGCAGTCGGCTTCTCTACGCAGAACC<br>CGGGAGTAGGAGACTCAGAATCGAATCTCTTCTCC<br>CTCCCCTTCTTGTGAGATTTTTTTGATCTTCAGCTA<br>CATTTTCGGCTTTGTGAGAAACCTTACCATCAAACA<br>CGATGGCCAGCAACGTTACCAACAAGACAGATCCT<br>CGCTCCATGAACTCCCGTGTATTCATTGGGAATCT<br>CAACACTCTTGTGGTCAAGAAATCTGATGTGGAGG<br>CAATCTTTTCGAAGTATGGCAAAATTGTGGGCTGC<br>TCTGTTCATAAGGGCTTTGCCTTCGTTCAGTATGTTA<br>ATGAGAGAAATGCCCGGGCTGCTGTAGCAGGAGA<br>GGATGGCAGAATGATTGCTGGCCAGGTTTTAGATA<br>TTAACCTGGCTGCAGAGCCAAAAGTGAACCGAGG<br>AAAAGCAGGTGTGAAACGATCTGCAGCGGAGATG<br>TACGGCTCCTCTTTTGACTTGGACTATGACTTTCAA<br>CGGGACTATTATGATAGGATGTACAGTTACCCAGC<br>ACGTGTACCTCCTCCTCCTCCTATTGCTCGGGCTG<br>TAGTGCCCTCGAAACGTCAGCGTGTATCAGGAAAC<br>ACTTCACGAAGGGGCAAAAGTGGCTTCAATTCTAA<br>GAGTGGACAGCGGGGATCTTCCAAGTCTGGAAAG<br>TTGAAAGGAGATGACCTTCAGGCCATTAAGAAGGA<br>GCTGACCCAGATAAAACAAAAAGTGGATTCTCTCC<br>TGGAAAAACCTGGAAAAAATTGAAAAGGAACAGAGC<br>AAACAAGCAGTAGAGATGAAGAATGATAAGTCAGA<br>AGAGGAGCAGAGCAGCAGCTCCGTGAAGAAAGAT<br>GAGACTAATGTGAAGATGGAGTCTGAGGGGGGTG<br>CAGATGACTCTGCTGAGGAGGGGGACCTACTGGA<br>TGATGATGATAATGAAG | 15 | LPSFSMLM<br>REMPGLL* |
| 1364 | NM_004500.3_483 | 483 | AGGAATGGGGCGGGGACTAGGCCTTCGCCTCGG<br>CGGCAGAGGAGACTCGGGGGCCATTTTGTGAAGA<br>GACGAAGACTGAGCGGTTGTGGCCGCGTTGCCGA<br>CCTCCAGCAGCAGTCGGCTTCTCTACGCAGAACC<br>CGGGAGTAGGAGACTCAGAATCGAATCTCTTCTCC<br>CTCCCCTTCTTGTGAGATTTTTTTGATCTTCAGCTA<br>CATTTTCGGCTTTGTGAGAAACCTTACCATCAAACA<br>CGATGGCCAGCAACGTTACCAACAAGACAGATCCT<br>CGCTCCATGAACTCCCGTGTATTCATTGGGAATCT<br>CAACACTCTTGTGGTCAAGAAATCTGATGTGGAGG<br>CAATCTTTTCGAAGTATGGCAAAATTGTGGGCTGC<br>TCTGTTCATAAGGGCTTTGCCTTCGTTCAGTATGTT<br>AATGAGAGAAATGCCCGGGCTGCTGTAGCAGGAG<br>AGGATGGCAGAATGATTGCTGGCCAGGTTTAGATA<br>TTAACCTGGCTGCAGAGCCAAAAGTGAACCGAGG<br>AAAAGCAGGTGTGAAACGATCTGCAGCGGAGATG<br>TACGGCTCCTCTTTTGACTTGGACTATGACTTTCAA<br>CGGGACTATTATGATAGGATGTACAGTTACCCAGC<br>ACGTGTACCTCCTCCTCCTCCTATTGCTCGGGCTG<br>TAGTGCCCTCGAAACGTCAGCGTGTATCAGGAAAC<br>ACTTCACGAAGGGGCAAAAGTGGCTTCAATTCTAA<br>GAGTGGACAGCGGGGATCTTCCAAGTCTGGAAAG<br>TTGAAAGGAGATGACCTTCAGGCCATTAAGAAGGA<br>GCTGACCCAGATAAAACAAAAAGTGGATTCTCTCC<br>TGGAAAAACCTGGAAAAAATTGAAAAGGAACAGAGC<br>AAACAAGCAGTAGAGATGAAGAATGATAAGTCAGA<br>AGAGGAGCAGAGCAGCAGCTCCGTGAAGAAAGAT<br>GAGACTAATGTGAAGATGGAGTCTGAGGGGGGTG | 0 | * |

TABLE 3A-continued

| SEQ ID | identifier_position | position | modified_RNA | PAP length | PAP |
|---|---|---|---|---|---|
| | | | CAGATGACTCTGCTGAGGAGGGGGACCTACTGGA<br>TGATGATGATAATGAAG | | |
| 1365 | NM_0045<br>00.3_562 | 562 | AGGAATGGGGCGGGGACTAGGCCTTCGCCTCGG<br>CGGCAGAGGAGACTCGGGGGCCATTTTGTGAAGA<br>GACGAAGACTGAGCGGTTGTGGCCGCGTTGCCGA<br>CCTCCAGCAGCAGTCGGCTTCTCTACGCAGAACC<br>CGGGAGTAGGAGACTCAGAATCGAATCTCTTCTCC<br>CTCCCCTTCTTGTGAGATTTTTTTGATCTTCAGCTA<br>CATTTTCGGCTTTGTGAGAAACCTTACCATCAAACA<br>CGATGGCCAGCAACGTTACCAACAAGACAGATCCT<br>CGCTCCATGAACTCCCGTGTATTCATTGGGAATCT<br>CAACACTCTTGTGGTCAAGAAATCTGATGTGGAGG<br>CAATCTTTTCGAAGTATGGCAAAATTGTGGGCTGC<br>TCTGTTCATAAGGGCTTTGCCTTCGTTCAGTATGTT<br>AATGAGAGAAATGCCCGGGCTGCTGTAGCAGGAG<br>AGGATGGCAGAATGATTGCTGGCCAGGTTTTAGAT<br>ATTAACCTGGCTGCAGAGCCAAAAGTGAACCGAG<br>GAAAAGCAGGTGTGAAACGATCTGCAGCGGAGAT<br>GTACGGTCCTCTTTTGACTTGGACTATGACTTTCAA<br>CGGGACTATTATGATAGGATGTACAGTTACCCAGC<br>ACGTGTACCTCCTCCTCCTCCTATTGCTCGGGCTG<br>TAGTGCCCTCGAAACGTCAGCGTGTATCAGGAAAC<br>ACTTCACGAAGGGGCAAAAGTGGCTTCAATTCTAA<br>GAGTGGACAGCGGGGATCTTCCAAGTCTGGAAAG<br>TTGAAAGGAGATGACCTTCAGGCCATTAAGAAGGA<br>GCTGACCCAGATAAAACAAAAAGTGGATTCTCTCC<br>TGGAAAACCTGGAAAAAATTGAAAAGGAACAGAGC<br>AAACAAGCAGTAGAGATGAAGAATGATAAGTCAGA<br>AGAGGAGCAGAGCAGCAGCTCCGTGAAGAAAGAT<br>GAGACTAATGTGAAGATGGAGTCTGAGGGGGGTG<br>CAGATGACTCTGCTGAGGAGGGGGACCTACTGGA<br>TGATGATGATAATGAAG | 33 | PLLTWTMT<br>FNGTIMIG<br>CTVTQHVY<br>LLLLLLLGL* |
| 1366 | NM_0045<br>01.3_173<br>0 | 1730 | CTCGCGCCAGGCGAGTCTCCGCGTCTCCCTCGCG<br>AACTCGGTGAAAGGAATTGGCGCCGTTCGACACC<br>AGGCGGATCCGCTCTGCAGCACGAACCCATCTCC<br>AGCCGCAGCCGCAGCCGCCGCCCGGGCCGAGGA<br>GCAGCCGCAGCAGCCGCCACCAGTGGCCGAGTG<br>AGCGGAGCCGAGTTTGAGGCAGCGCCTAGCGGT<br>GAATCGGGGCCCTCACCATGAGTTCCTCGCCTGTT<br>AATGTAAAAAAGCTGAAGGTGTCGGAGCTGAAAGA<br>GGAGCTCAAGAAGCGACGCCTTTCTGACAAGGGT<br>CTCAAGGCCGAGCTCATGGAGCGACTCCAGGCTG<br>CGCTGGACGACGAGGAGGCCGGGGGCCGCCCCG<br>CCATGGAGCCCGGGAACGGCAGCCTAGACCTGG<br>GCGGGGATTCCGCTGGGCGCTCGGGAGCAGGCC<br>TCGAGCAGGAGGCCGCGGCCGGCGGCGATGAAG<br>AGGAGGAGGAAGAGGAAGAGGAGGAGGAAGGAA<br>TCTCCGCTCTGGACGGCGACCAGATGGAGCTAGG<br>AGAGGAGAACGGGGCCGCGGGGCGGCCGACTC<br>GGGCCCGATGGAGGAGGAGGAGGCCGCCTCGGA<br>AGACGAGAACGGCGACGATCAGGGTTTCCAGGAA<br>GGGGAAGATGAGCTCGGGGACGAAGAGGAAGGC<br>GCGGGCGACGAGAACGGGCACGGGGAGCAGCAG<br>CCTCAACCGCCGGCGACGCAGCAGCAACAGCCCC<br>AACAGCAGCGCGGGGCCGCCAAGGAGGCCGCGG<br>GGAAGAGCAGCGGCCCCACCTCGCTGTTCGCGGT<br>GACGGTGGCGCCGCCCGGGGCGAGGCAGGGCCA<br>GCAGCAGGCGGGAGGGGACGGCAAAACAGAACA<br>GAAAGGCGGAGATAAAAAGAGGGGTGTTAAAAGA<br>CCACGAGAAGATCATGGCCGTGGATATTTTGAGTA<br>CATTGAAGAGAACAAGTATAGCAGAGCCAAATCTC<br>CTCAGCCACCTGTTGAAGAAGAAGATGAACACTTC<br>GATGACACAGTGGT | 13 | NITFLAQIL<br>LWIR* |
| 1367 | NM_0045<br>08.2_361 | 361 | CTCAGGTTCCCGGTGCTTCGCGCGTCTGCCGTTG<br>TCACAGGCCAGGGAGGTGGCACCACCAGGCGAA<br>GCTTGGCGAGATTGTGTCGTCAAGCGCGTACGGG<br>CGCCAATTGGCCGGGCGATGTGGCGTGGACTGGC<br>GCTGGCGCGAGCGATTGGCTGCGCGGCCCGGGG<br>GCGGGGCCAGTGGGCGGTGCGCGCCGCAGACTG<br>TGCTCAAAGCGGGCGCCATCCGGGACCGGCGGTT<br>GTCTGTGGCCGGAGGCTGATCAGTGTTCTAGAAC<br>AGATCAGACATTTTGTAATGATGCCTGAAATAAACA<br>CTAACCACCTCGACAAGCAACAGGTTCAACTCCTG<br>GCAGAGATGTGTATCCTTATGATGAAAATGACAAT<br>AAAATTGGAGCTGAGACCAAGAAGAATTGTCACCT<br>GAACGAGAACATTGAGAAAGGATTATTGCATCGAG<br>CTTTTAGTGTCTTCTTATTCAACACCGAAAATAAGC | 17 | MMKMTIKL<br>ELRPRRIV<br>T* |

TABLE 3A-continued

| SEQ ID | identifier_position | position | modified_RNA | PAP length | PAP |
|---|---|---|---|---|---|
| | | | TTCTGCTACAGCAAAGATCAGATGCTAAGATTACC TTTCCAGGTTGTTTTACGAATACGTGTTGTAGTCAT CCATTAAGCAATCCAGCCGAGCTTGAGGAAAGTGA CGCCCTTGGAGTGAGGCGAGCAGCACAGAGACG GCTGAAAGCTGAGCTAGGAATTCCCTTGGAAGAG GTTCCTCCAGAAGAAATTAATTATTTAACACGAATT CACTACAAAGCTCAGTCTGATGGTATCTGGGGTGA ACATGAAATTGATTACATTTTGTTGGTGAGGAAGAA TGTAACTTTGAATCCAGATCCCAATGAGATTAAAAG CTATTGTTATGTGTCAAAGGAAGAACTAAAAGAACT TCTGAAAAAAGCAGCCAGTGGTGAAATTAAGATAA CGCCATGGTTTAAAATTATTGCAGCGACTTTTCTCT TTAAATGGTGGGATAACTTAAATCATTTGAATCAGT TGTTGACCATGAGAAAATATACAGAATGTGAATAT GTAGGTAAATGATTACAGAAAAATTTATCTGCTTAA CAAACTTAGAAT | | |
| 1368 | NM_0045 08.2_382 | 382 | CTCAGGTTCCCGGTGCTTCGCGCGTCTGCCGTTG TCACAGGCCAGGGAGGTGGCACCACCAGGCGAA GCTTGGCGAGATTGTGTCGTCAAGCGCGTACGGG CGCCAATTGGCCGGGCGATGTGGCGTGGACTGGC GCTGGCGCGAGCGATTGGCTGCGCGGCCCGGGG GCGGGGCCAGTGGGCGGTGCGCGCCGCAGACTG TGCTCAAAGCGGGCGCCATCCGGGACCGGCGGTT GTCTGTGGCCGGAGGCTGATCAGTGTTCTAGAAC AGATCAGACATTTTGTAATGATGCCTGAAATAAACA CTAACCACCTCGACAAGCAACAGGTTCAACTCCTG GCAGAGATGTGTATCCTTATTGATGAAAATGACAA TAAAATGGAGCTGAGACCAAGAAGAATTGTCACCT GAACGAGAACATTGAGAAAGGATTATTGCATCGAG CTTTTAGTGTCTTCTTATTCAACACCGAAAATAAGC TTCTGCTACAGCAAAGATCAGATGCTAAGATTACC TTTCCAGGTTGTTTTACGAATACGTGTTGTAGTCAT CCATTAAGCAATCCAGCCGAGCTTGAGGAAAGTGA CGCCCTTGGAGTGAGGCGAGCAGCACAGAGACG GCTGAAAGCTGAGCTAGGAATTCCCTTGGAAGAG GTTCCTCCAGAAGAAATTAATTATTTAACACGAATT CACTACAAAGCTCAGTCTGATGGTATCTGGGGTGA ACATGAAATTGATTACATTTTGTTGGTGAGGAAGAA TGTAACTTTGAATCCAGATCCCAATGAGATTAAAAG CTATTGTTATGTGTCAAAGGAAGAACTAAAAGAACT TCTGAAAAAAGCAGCCAGTGGTGAAATTAAGATAA CGCCATGGTTTAAAATTATTGCAGCGACTTTTCTCT TTAAATGGTGGGATAACTTAAATCATTTGAATCAGT TGTTGACCATGAGAAAATATACAGAATGTGAATAT GTAGGTAAATGATTACAGAAAAATTTATCTGCTTAA CAAACTTAGAAT | 10 | MELRPRRI VT* |
| 1369 | NM_0045 15.2_120 | 120 | GGCAAGACGCCTCTTCAGTTGTCTGCTACTCAGAG GAAGGGGCGGTTGGTGCGGCCTCCATTGTTCGTG TTTTAAGGCGCCATGAGGGGTGACAGAGGCCGTG GTCGTGGTGGGCGCTTGGTTCCAGAGGAGGCCCA GGAGGAGGGTTCAGGCCCTTTGTACCACATATCC CATTTGACTTCTATTTGTGTGAAATGGCCTTTCCCC GGGTCAAGCCAGCACCTGATGAAACTTCCTTCAGT GAGGCCTTGCTGAAGAGGAATCAGGACCTGGCTC CCAATTCTGCTGAACAGGCATCTATCCTTTCTCTG GTGACAAAAATAAACAATGTGATTGATAATCTGATT GTGGCTCCAGGGACATTTGAAGTGCAAATTGAAGA AGTTCGACAGGTGGGATCCTATAAAAAGGGGACA ATGACTACAGGACACAATGTGGCTGACCTGGTGG TGATACTCAAGATTCTGCCAACGTTGGAAGCTGTT GCTGCCCTGGGGAACAAAGTCGTGGAAAGCCTAA GAGCACAGGATCCTTCTGAAGTTTTAACCATGCTG ACCAACGAAACTGGCTTTGAAATCAGTTCTTCTGA TGCTACAGTGAAGATTCTCATTACAACAGTGCCAC CCAATCTTCGAAAACTGGATCCAGAACTCCATTTG GATATCAAAGTATTGCAGAGTGCCTTAGCAGCCAT CCGACATGCCCGCTGGTTCGAGGAAAATGCTTCTC AGTCCACAGTTAAAGTTCTCATCAGACTACTGAAG GACTTGAGGATTCGTTTTCCTGGCTTTGAGCCCCT CACACCCTGGATCCTTGACCTACTAGGCCATTATG CTGTGATGAACAACCCCACCAGACAGCCTTTGGC CCTAAACGTTGCATACAGGCGCTGCTTGCAGATTC TGGCTGCAGGACTGTTCCTGCCAGGTTCAGTGGG TATCACTGACCCCTGTGAGAGTGGCAACTTTAGAG TACACACAGTCATGACCCTAGAACAGCAGGACATG GTCTGCTATACAGCTCA | 45 | LVPEEAQE EGSGPLYH ISHLTSICV KWPFPGS SQHLMKLP SVRPC* |

TABLE 3A-continued

| SEQ ID | identifier_position | position | modified_RNA | PAP length | PAP |
|---|---|---|---|---|---|
| 1370 | NM_0045 15.2_159 | 159 | GGCAAGACGCCTCTTCAGTTGTCTGCTACTCAGAG GAAGGGGCGGTTGGTGCGGCCTCCATTGTTCGTG TTTTAAGGCGCCATGAGGGGTGACAGAGGCCGTG GTCGTGGTGGGCGCTTTGGTTCCAGAGGAGGCCC AGGAGGAGGGTTCAGGCCCTTGTACCACATATCC CATTTGACTTCTATTTGTGTGAAATGGCCTTTCCCC GGGTCAAGCCAGCACCTGATGAAACTTCCTTCAGT GAGGCCTTGCTGAAGAGGAATCAGGACCTGGCTC CCAATTCTGCTGAACAGGCATCTATCCTTTCTCTG GTGACAAAAATAAACAATGTGATTGATAATCTGATT GTGGCTCCAGGGACATTTGAAGTGCAAATTGAAGA AGTTCGACAGGTGGGATCCTATAAAAAGGGGACA ATGACTACAGGACACAATGTGGCTGACCTGGTGG TGATACTCAAGATTCTGCCAACGTTGGAAGCTGTT GCTGCCCTGGGGAACAAAGTCGTGGAAAGCCTAA GAGCACAGGATCCTTCTGAAGTTTTAACCATGCTG ACCAACGAAACTGGCTTTGAAATCAGTTCTTCTGA TGCTACAGTGAAGATTCTCATTACAACAGTGCCAC CCAATCTTCGAAAACTGGATCCAGAACTCCATTTG GATATCAAAGTATTGCAGAGTGCCTTAGCAGCCAT CCGACATGCCCGCTGGTTCGAGGAAAATGCTTCTC AGTCCACAGTTAAAGTTCTCATCAGACTACTGAAG GACTTGAGGATTCGTTTTCCTGGCTTTGAGCCCCT CACACCCTGGATCCTTGACCTACTAGGCCATTATG CTGTGATGAACAACCCCACCAGACAGCCTTTGGC CCTAAACGTTGCATACAGGCGCTGCTTGCAGATTC TGGCTGCAGGACTGTTCCTGCCAGGTTCAGTGGG TATCACTGACCCCTGTGAGAGTGGCAACTTTAGAG TACACACAGTCATGACCCTAGAACAGCAGGACATG GTCTGCTATACAGCTCA | 32 | LYHISHLTS ICVKWPFP GSSQHLM KLPSVRPC* |
| 1371 | NM_0045 15.2_188 | 188 | GGCAAGACGCCTCTTCAGTTGTCTGCTACTCAGAG GAAGGGGCGGTTGGTGCGGCCTCCATTGTTCGTG TTTTAAGGCGCCATGAGGGGTGACAGAGGCCGTG GTCGTGGTGGGCGCTTTGGTTCCAGAGGAGGCCC AGGAGGAGGGTTCAGGCCCTTTGTACCACATATC CCATTTGACTTCTATTGTGTGAAATGGCCTTTCCCC GGGTCAAGCCAGCACCTGATGAAACTTCCTTCAGT GAGGCCTTGCTGAAGAGGAATCAGGACCTGGCTC CCAATTCTGCTGAACAGGCATCTATCCTTTCTCTG GTGACAAAAATAAACAATGTGATTGATAATCTGATT GTGGCTCCAGGGACATTTGAAGTGCAAATTGAAGA AGTTCGACAGGTGGGATCCTATAAAAAGGGGACA ATGACTACAGGACACAATGTGGCTGACCTGGTGG TGATACTCAAGATTCTGCCAACGTTGGAAGCTGTT GCTGCCCTGGGGAACAAAGTCGTGGAAAGCCTAA GAGCACAGGATCCTTCTGAAGTTTTAACCATGCTG ACCAACGAAACTGGCTTTGAAATCAGTTCTTCTGA TGCTACAGTGAAGATTCTCATTACAACAGTGCCAC CCAATCTTCGAAAACTGGATCCAGAACTCCATTTG GATATCAAAGTATTGCAGAGTGCCTTAGCAGCCAT CCGACATGCCCGCTGGTTCGAGGAAAATGCTTCTC AGTCCACAGTTAAAGTTCTCATCAGACTACTGAAG GACTTGAGGATTCGTTTTCCTGGCTTTGAGCCCCT CACACCCTGGATCCTTGACCTACTAGGCCATTATG CTGTGATGAACAACCCCACCAGACAGCCTTTGGC CCTAAACGTTGCATACAGGCGCTGCTTGCAGATTC TGGCTGCAGGACTGTTCCTGCCAGGTTCAGTGGG TATCACTGACCCCTGTGAGAGTGGCAACTTTAGAG TACACACAGTCATGACCCTAGAACAGCAGGACATG GTCTGCTATACAGCTCA | 22 | CVKWPFP GSSQHLM KLPSVRPC* |
| 1372 | NM_0045 15.2_348 | 348 | GGCAAGACGCCTCTTCAGTTGTCTGCTACTCAGAG GAAGGGGCGGTTGGTGCGGCCTCCATTGTTCGTG TTTTAAGGCGCCATGAGGGGTGACAGAGGCCGTG GTCGTGGTGGGCGCTTTGGTTCCAGAGGAGGCCC AGGAGGAGGGTTCAGGCCCTTGTACCACATATC CCATTTGACTTCTATTTGTGTGAAATGGCCTTTCCC CGGGTCAAGCCAGCACCTGATGAAACTTCCTTCAG TGAGGCCTTGCTGAAGAGGAATCAGGACCTGGCT CCCAATTCTGCTGAACAGGCATCTATCCTTTCTCT GGTGACAAAAATAAACAATGTGATTGATAATCTGAT GTGGCTCCAGGGACATTTGAAGTGCAAATTGAAGA AGTTCGACAGGTGGGATCCTATAAAAAGGGGACA ATGACTACAGGACACAATGTGGCTGACCTGGTGG TGATACTCAAGATTCTGCCAACGTTGGAAGCTGTT GCTGCCCTGGGGAACAAAGTCGTGGAAAGCCTAA GAGCACAGGATCCTTCTGAAGTTTTAACCATGCTG ACCAACGAAACTGGCTTTGAAATCAGTTCTTCTGA | 24 | MWLQGHL KCKLKKFD RWDPIKRG Q* |

TABLE 3A-continued

| SEQ ID | identifier_position | position | modified_RNA | PAP length | PAP |
|---|---|---|---|---|---|
| | | | TGCTACAGTGAAGATTCTCATTACAACAGTGCCAC<br>CCAATCTTCGAAAACTGGATCCAGAACTCCATTTG<br>GATATCAAAGTATTGCAGAGTGCCTTAGCAGCCAT<br>CCGACATGCCCGCTGGTTCGAGGAAAATGCTTCTC<br>AGTCCACAGTTAAAGTTCTCATCAGACTACTGAAG<br>GACTTGAGGATTCGTTTTCCTGGCTTTGAGCCCCT<br>CACACCCTGGATCCTTGACCTACTAGGCCATTATG<br>CTGTGATGAACAACCCCACCAGACAGCCTTTGGC<br>CCTAAACGTTGCATACAGGCGCTGCTTGCAGATTC<br>TGGCTGCAGGACTGTTCCTGCCAGGTTCAGTGGG<br>TATCACTGACCCCTGTGAGAGTGGCAACTTTAGAG<br>TACACACAGTCATGACCCTAGAACAGCAGGACATG<br>GTCTGCTATACAGCTCA | | |
| 1373 | NM_0045<br>15.2_360 | 360 | GGCAAGACGCCTCTTCAGTTGTCTGCTACTCAGAG<br>GAAGGGGCGGTTGGTGCGGCCTCCATTGTTCGTG<br>TTTTAAGGCGCCATGAGGGGTGACAGAGGCCGTG<br>GTCGTGGTGGGCGCTTTGGTTCCAGAGGAGGCCC<br>AGGAGGAGGGTTCAGGCCCTTTGTACCACATATC<br>CCATTTGACTTCTATTTGTGTGAAATGGCCTTTCCC<br>CGGGTCAAGCCAGCACCTGATGAAACTTCCTTCAG<br>TGAGGCCTTGCTGAAGAGGAATCAGGACCTGGCT<br>CCCAATTCTGCTGAACAGGCATCTATCCTTTCTCT<br>GGTGACAAAAATAAACAATGTGATTGATAATCTGAT<br>TGTGGCTCCAGGACATTTGAAGTGCAAATTGAAGA<br>AGTTCGACAGGTGGGATCCTATAAAAAGGGGACA<br>ATGACTACAGGACACAATGTGGCTGACCTGGTGG<br>TGATACTCAAGATTCTGCCAACGTTGGAAGCTGTT<br>GCTGCCCTGGGGAACAAAGTCGTGGAAAGCCTAA<br>GAGCACAGGATCCTTCTGAAGTTTTAACCATGCTG<br>ACCAACGAAACTGGCTTTGAAATCAGTTCTTCTGA<br>TGCTACAGTGAAGATTCTCATTACAACAGTGCCAC<br>CCAATCTTCGAAAACTGGATCCAGAACTCCATTTG<br>GATATCAAAGTATTGCAGAGTGCCTTAGCAGCCAT<br>CCGACATGCCCGCTGGTTCGAGGAAAATGCTTCTC<br>AGTCCACAGTTAAAGTTCTCATCAGACTACTGAAG<br>GACTTGAGGATTCGTTTTCCTGGCTTTGAGCCCCT<br>CACACCCTGGATCCTTGACCTACTAGGCCATTATG<br>CTGTGATGAACAACCCCACCAGACAGCCTTTGGC<br>CCTAAACGTTGCATACAGGCGCTGCTTGCAGATTC<br>TGGCTGCAGGACTGTTCCTGCCAGGTTCAGTGGG<br>TATCACTGACCCCTGTGAGAGTGGCAACTTTAGAG<br>TACACACAGTCATGACCCTAGAACAGCAGGACATG<br>GTCTGCTATACAGCTCA | 19 | HLKCKLKK<br>FDRWDPIK<br>RGQ* |
| 1374 | NM_0045<br>15.2_659 | 659 | GGCAAGACGCCTCTTCAGTTGTCTGCTACTCAGAG<br>GAAGGGGCGGTTGGTGCGGCCTCCATTGTTCGTG<br>TTTTAAGGCGCCATGAGGGGTGACAGAGGCCGTG<br>GTCGTGGTGGGCGCTTTGGTTCCAGAGGAGGCCC<br>AGGAGGAGGGTTCAGGCCCTTTGTACCACATATC<br>CCATTTGACTTCTATTTGTGTGAAATGGCCTTTCCC<br>CGGGTCAAGCCAGCACCTGATGAAACTTCCTTCAG<br>TGAGGCCTTGCTGAAGAGGAATCAGGACCTGGCT<br>CCCAATTCTGCTGAACAGGCATCTATCCTTTCTCT<br>GGTGACAAAAATAAACAATGTGATTGATAATCTGAT<br>TGTGGCTCCAGGGACATTTGAAGTGCAAATTGAAG<br>AAGTTCGACAGGTGGGATCCTATAAAAAGGGGAC<br>AATGACTACAGGACACAATGTGGCTGACCTGGTG<br>GTGATACTCAAGATTCTGCCAACGTTGGAAGCTGT<br>TGCTGCCCTGGGGAACAAAGTCGTGGAAAGCCTA<br>AGAGCACAGGATCCTTCTGAAGTTTTAACCATGCT<br>GACCAACGAAACTGGCTTTGAAATCAGTTCTTCTG<br>ATGCTACAGTGAAGATTCTCATTACAACAGTGCCA<br>CCCAATCTTCGAAAACTGGATCCAGAACTCCATTG<br>GATATCAAAGTATTGCAGAGTGCCTTAGCAGCCAT<br>CCGACATGCCCGCTGGTTCGAGGAAAATGCTTCTC<br>AGTCCACAGTTAAAGTTCTCATCAGACTACTGAAG<br>GACTTGAGGATTCGTTTTCCTGGCTTTGAGCCCCT<br>CACACCCTGGATCCTTGACCTACTAGGCCATTATG<br>CTGTGATGAACAACCCCACCAGACAGCCTTTGGC<br>CCTAAACGTTGCATACAGGCGCTGCTTGCAGATTC<br>TGGCTGCAGGACTGTTCCTGCCAGGTTCAGTGGG<br>TATCACTGACCCCTGTGAGAGTGGCAACTTTAGAG<br>TACACACAGTCATGACCCTAGAACAGCAGGACATG<br>GTCTGCTATACAGCTCA | 9 | WISKYCRV<br>P* |
| 1375 | NM_045<br>44.2_421 | 421 | GGCAGCGCGCCGGCCGCGAGAGAGGGCCCCGTC<br>GCGACCGCGTCCCCTTGGGTCCTTGATCCTGAGC<br>TGACCGGGTAGCCATGGCCTTGCGGCTCCTGAAG<br>CTGGCAGCGACGTCCGCGTCCGCCCGGGTCGTG | 37 | WRNFTMIR<br>EAMMATVT<br>ACSPGCTA<br>VACCSTQ |

TABLE 3A-continued

| SEQ ID | identifier_position | position | modified_RNA | PAP length | PAP |
|---|---|---|---|---|---|
| | | | GCGGCGGGCGCCCAGCGCGTGAGAGGAATTCAT<br>AGCAGTGTGCAGTGCAAACTGCGCTATGGAATGT<br>GGCATTTCCTACTTGGGGATAAAGCAAGCAAAAGA<br>CTGACAGAACGCAGCAGAGTGATAACTGTAGATG<br>GCAATATATGTACTGGAAAAGGCAAACTTGCAAAA<br>GAAATAGCAGAGAAACTAGGCTTCAAGCACTTTCC<br>TGAAGCGGGGATTCATTATCCAGACAGTACCACAG<br>GAGATGGGAAGCCCCTCGCCACCGACTATAATGG<br>CAACTGTAGTTGGAGAAATTTTACGATGATCCGAG<br>AAGCAATGATGGCAACAGTTACCGCCTGCAGTCCT<br>GGTTGTACAGCAGTCGCCTGCTGCAGTACTCAGAT<br>GCCTTGGAGCACTTGCTGACCACAGGACAAGGTG<br>TTGTGTTGGAGCGCTCCATCTTCAGTGACTTTGTG<br>TTCCTGGAGGCGATGTACAACCAGGGATTCATCC<br>GAAAGCAGTGTGTGGACCACTACAACGAGGTGAA<br>GAGCGTCACCATCTGCGATTACCTGCCCCCCCAC<br>CTGGTGATTTACATCGATGTGCCCGTTCCAGAGGT<br>CCAGAGGCGGATTCAGAAGAAAGGAGATCCACAT<br>GAAATGAAGATCACCTCTGCCTATCTACAGGACAT<br>TGAGAATGCCTATAAGAAAACCTTTCTCCCTGAGA<br>TGAGTGAAAAATGTGAGGTTTTACAATATTCTGCAA<br>GGGAAGCTCAAGATTCAAAAAAGGTGGTAGAGGA<br>CATTGAATACCTGAAGTTCGATAAAGGGCCGTGGC<br>TCAAGCAGGACAATCGCACTTTATACCACCTGCGA<br>TTACTGGTTCAGGATAAGTTTGAGGTGCTGAATTA<br>CACAAGCATTCCTATCTTTCTCCCG | | MPWSTC* |
| 1376 | NM_0045<br>50.3_108<br>1 | 1081 | GCCCCAGGAGAGGCAGAGAGTGAGGGAAAGGGC<br>CTGGCCGGCATGCACAGATAGGATCACGGTCCTG<br>GGAGAATTCCTGCTCTTATAGTCTAACCTACCATG<br>GCTTCTCTTTTCTCAAGGCTCCCTCATGCTGCCCT<br>TTGGCCCTAGTGGCTGGTTTCCAGGGCTGAGGGG<br>ACTGAGTGAGCTGCCTGAGAAAAGAGGGTAGGGA<br>ACAGAAAAGCCAGCCAGGAGCTGTGGGAGGAAAC<br>GCCCTCAGTAAAGATGACCGCGGTCACTGTTATCT<br>AAACGCAAGTGAAGCCGAGTCACAGGACCCGGAT<br>GTTGTCAGTTCGACGGTAAACGACCCTGCCAGCTT<br>CCAAGAGGGCGGCTTCACTGTGCGAATAGGTGAG<br>AAGCCAAGAAGGAGGCGCGCTGGAGTTACTTCCG<br>CCCGGTTCTCCTTCCCGCAGTCTGCAGCCGGAGT<br>AAGATGGCGGCGCTGAGGGCTTTGTGCGGCTTCC<br>GGGGCGTCGCGGCCCAGGTGCTGCGGCCTGGGG<br>CTGGAGTCCGATTGCCGATTCAGCCCAGCAGAGG<br>TGTTCGGCAGTGGCAGCCAGATGTGGAATGGGCA<br>CAGCAGTTTGGGGGAGCTGTTATGTACCCAAGCA<br>AAGAAACAGCCCACTGGAAGCCTCCACCTTGGAAT<br>GATGTGGACCCTCCAAAGGACACAATTGTGAAGAA<br>CATTACCCTGAACTTTGGGCCCCAACACCCAGCAG<br>CGCATGGTGTCCTGCGACTAGTGATGGAATTGAGT<br>GGGGAGATGGTGCGGAAGTGTGATCCTCACATCG<br>GGCTCCTGCACCGAGGCACTGAGAAGCTCATTGA<br>ATACAAGACCTATCTTCAGGGCCCTTCCATACTTTGA<br>CCGGCTAGACTATGTGTCCATGATGTGTAACGAAC<br>AGGCCTATTCTCTAGCTGTGGAGAAGTTGCTAAAC<br>ATCCGGCCTCCTCCTCGGGCACAGTGGATCCGAG<br>TGCTGTTTGGAGAAATCACACGTTTGTTGAACCAC<br>ATCATGGCTGTGACCACACATGCCCTG | 51 | LSSTSECL<br>EPECMLLI<br>SGQEECT<br>RTYPLGLW<br>MTFISFLRT<br>SLFGLMS<br>WRSC* |
| 1377 | NM_0045<br>50.3_113<br>4 | 1134 | GCCCCAGGAGAGGCAGAGAGTGAGGGAAAGGGC<br>CTGGCCGGCATGCACAGATAGGATCACGGTCCTG<br>GGAGAATTCCTGCTCTTATAGTCTAACCTACCATG<br>GCTTCTCTTTTCTCAAGGCTCCCTCATGCTGCCCT<br>TTGGCCCTAGTGGCTGGTTTCCAGGGCTGAGGGG<br>ACTGAGTGAGCTGCCTGAGAAAAGAGGGTAGGGA<br>ACAGAAAAGCCAGCCAGGAGCTGTGGGAGGAAAC<br>GCCCTCAGTAAAGATGACCGCGGTCACTGTTATCT<br>AAACGCAAGTGAAGCCGAGTCACAGGACCCGGAT<br>GTTGTCAGTTCGACGGTAAACGACCCTGCCAGCTT<br>CCAAGAGGGCGGCTTCACTGTGCGAATAGGTGAG<br>AAGCCAAGAAGGAGGCGCGCTGGAGTTACTTCCG<br>CCCGGTTCTCCTTCCCGCAGTCTGCAGCCGGAGT<br>AAGATGGCGGCGCTGAGGGCTTTGTGCGGCTTCC<br>GGGGCGTCGCGGCCCAGGTGCTGCGGCCTGGGG<br>CTGGAGTCCGATTGCCGATTCAGCCCAGCAGAGG<br>TGTTCGGCAGTGGCAGCCAGATGTGGAATGGGCA<br>CAGCAGTTTGGGGGAGCTGTTATGTACCCAAGCA<br>AAGAAACAGCCCACTGGAAGCCTCCACCTTGGAAT<br>GATGTGGACCCTCCAAAGGACACAATTGTGAAGAA<br>CATTACCCTGAACTTTGGGCCCCAACACCCAGCAG | 33 | QEECTRTY<br>PLGLWMTF<br>ISFLRTSLF<br>GLMSWRS<br>C* |

TABLE 3A-continued

| SEQ ID | identifier_position | position | modified_RNA | PAP length | PAP |
|---|---|---|---|---|---|
| | | | CGCATGGTGTCCTGCGACTAGTGATGGAATTGAGT GGGGAGATGGTGCGGAAGTGTGATCCTCACATCG GGCTCCTGCACCGAGGCACTGAGAAGCTCATTGA ATACAAGACCTATCTTCAGGCCCTTCCATACTTTGA CCGGCTAGACTATGTGTCCATGATGTGTAACGAAC AGGCCTATTCTCTAGCTGTGGAGAAGTTGCTAAAC ATCCGGCCTCCTCCTCGGGCACAGTGGATCCGAG TGCTGTTTGGAGAAATCACACGTTTGTTGAACCAC ATCATGGCTGTGACCACACATGCCCTG | | |
| 1378 | NM_0045 50.3_589 | 589 | GCCCCAGGAGAGGCAGAGAGTGAGGGAAAGGGC CTGGCCGGCATGCACAGATAGGATCACGGTCCTG GGAGAATTCCTGCTCTTATAGTCTAACCTACCATG GCTTCTCTTTTCTCAAGGCTCCCTCATGCTGCCCT TTGGCCCTAGTGGCTGGTTTCCAGGGCTGAGGGG ACTGAGTGAGCTGCCTGAGAAAAGAGGGTAGGGA ACAGAAAAGCCAGCCAGGAGCTGTGGGAGGAAAC GCCCTCAGTAAAGATGACCGCGGTCACTGTTATCT AAACGCAAGTGAAGCCGAGTCACAGGACCCGGAT GTTGTCAGTTCGACGGTAAACGACCCTGCCAGCTT CCAAGAGGGCGGCTTCACTGTGCGAATAGGTGAG AAGCCAAGAAGGAGGCGCGCTGGAGTTACTTCCG CCCCGGTTCTCCTTCCCGCAGTCTGCAGCCGGAGT AAGATGGCGGCGCTGAGGGCTTTGTGCGGCTTCC GGGGCGTCGCGGCCCAGGTGCTGCGGCCTGGGG CTGGAGTCCGATTGCCGATTCAGCCCAGCAGAGG TGTTCGGCAGTGGCAGCCAGATGTGGAATGGGCA CAGCAGTTTGGGGGAGCTGTTATGTACCCAAGCAA AGAAACAGCCCACTGGAAGCCTCCACCTTGGAAT GATGTGGACCCTCCAAAGGACACAATTGTGAAGAA CATTACCCTGAACTTTGGGCCCAACACCCAGCAG CGCATGGTGTCCTGCGACTAGTGATGGAATTGAGT GGGGAGATGGTGCGGAAGTGTGATCCTCACATCG GGCTCCTGCACCGAGGCACTGAGAAGCTCATTGA ATACAAGACCTATCTTCAGGCCCTTCCATACTTTGA CCGGCTAGACTATGTGTCCATGATGTGTAACGAAC AGGCCTATTCTCTAGCTGTGGAGAAGTTGCTAAAC ATCCGGCCTCCTCCTCGGGCACAGTGGATCCGAG TGCTGTTTGGAGAAATCACACGTTTGTTGAACCAC ATCATGGCTGTGACCACACATGCCCTGG | 30 | LGELLCTQ AKKQPTGS LHLGMMW TLQRTQL* |
| 1379 | NM_0045 50.3_970 | 970 | GCCCCAGGAGAGGCAGAGAGTGAGGGAAAGGGC CTGGCCGGCATGCACAGATAGGATCACGGTCCTG GGAGAATTCCTGCTCTTATAGTCTAACCTACCATG GCTTCTCTTTTCTCAAGGCTCCCTCATGCTGCCCT TTGGCCCTAGTGGCTGGTTTCCAGGGCTGAGGGG ACTGAGTGAGCTGCCTGAGAAAAGAGGGTAGGGA ACAGAAAAGCCAGCCAGGAGCTGTGGGAGGAAAC GCCCTCAGTAAAGATGACCGCGGTCACTGTTATCT AAACGCAAGTGAAGCCGAGTCACAGGACCCGGAT GTTGTCAGTTCGACGGTAAACGACCCTGCCAGCTT CCAAGAGGGCGGCTTCACTGTGCGAATAGGTGAG AAGCCAAGAAGGAGGCGCGCTGGAGTTACTTCCG CCCCGGTTCTCCTTCCCGCAGTCTGCAGCCGGAGT AAGATGGCGGCGCTGAGGGCTTTGTGCGGCTTCC GGGGCGTCGCGGCCCAGGTGCTGCGGCCTGGGG CTGGAGTCCGATTGCCGATTCAGCCCAGCAGAGG TGTTCGGCAGTGGCAGCCAGATGTGGAATGGGCA CAGCAGTTTGGGGGAGCTGTTATGTACCCAAGCA AAGAAACAGCCCACTGGAAGCCTCCACCTTGGAAT GATGTGGACCCTCCAAAGGACACAATTGTGAAGAA CATTACCCTGAACTTTGGGCCCAACACCCAGCAG CGCATGGTGTCCTGCGACTAGTGATGGAATTGAGT GGGGAGATGGTGCGGAAGTGTGATCCTCACATCG GGCTCCTGCACCGAGGCACTGAGAAGCTCATTGA ATACAAGACCTATCTTCAGGCCCTTCCATACTTTGA CCGGCTAGACTATGTGTCCATGATGTGTAACGAAC AGGCCTATTCTCTAGCTGTGGAGAAGTTGCTAAAC ATCCGGCCTCCTCCTCGGGCACAGTGGATCCGAG TGCTGTTTGGAGAAATCACACGTTTGTTGAACCAC TCATGGCTGTGACCACACATGCCCTGG | 7 | LEKSHVC* |
| 1380 | NM_0045 51.1_195 | 195 | CATCTGAGTAACATGGCGGCGGCGGTAGCCA GGCTGTGGTGGCGCGGGATCTTGGGGGCCTCGG CGCTGACCAGGGGGACTGGGCGACCCTCCGTTCT GTTGCTGCCGGTGAGGCGGGAGAGCGCCGGGGC CGACACGCGCCCCACTGTCAGACCACGGAATGAT GTGGCCCACAAGCAGCTCTCAGCTTTGGAGAGTA TGTGGCTGAAATCTTGCCCAAGTATGTCCAACAAG TTCAGGTGTCCTGCTTCAATGAGTTAGAGGTCTGT | 23 | LESMWLKS CPSMSNKF RCPASMS* |

TABLE 3A-continued

| SEQ ID | identifier_ position | position | modified_RNA | PAP length | PAP |
|---|---|---|---|---|---|
| | | | ATCCATCCTGATGGCGTCATCCCAGTGCTGACTTT CCTCAGGGATCACACCAATGCACAGTTCAAATCTC TGGTTGACTTGACAGCAGTGGACGTCCCAACTCG GCAAAACCGTTTTGAGATTGTCTACAACCTGTTGT CTCTGCGCTTCAACTCACGGATCCGTGTGAAGACC TACACAGATGAGCTGACGCCCATTGAGTCTGCTGT CTCTGTGTTCAAGGCAGCCAACTGGTATGAAAGG GAGATCTGGGACATGTTTGGAGTCTTCTTTGCTAA CCACCCTGATCTAAGAAGGATCCTGACAGATTATG GCTTCGAGGGACATCCTTTCCGGAAAGACTTTCCT CTATCTGGCTATGTTGAGTTACGTTATGATGATGAA GTGAAGCGGGTGGTGGCAGAGCCGGTGGAGTTG GCCCAAGAGTTCCGCAAATTTGACCTGAACAGCCC CTGGGAGGCTTTCCCAGTCTATCGCCAACCCCCG GAGAGTCTCAAGCTTGAAGCCGGAGACAAGAAGC CTGATGCCAAGTAGCTCCAGGGAACGCATGTGGA TCCTAGACAGCGCCTTATCTATGATTGAGTGTCCG TGTAAATAAATTCCTACTTAGACTTAAAAAAAAAAA A | | |
| 1381 | NM_0045 51.181 | 81 | CATCTGAGTAACATGGCGGCGGCGGCGGTAGCCA GGCTGTGGTGGCGCGGGATCTTGGGGGCCTCGG CGCTGACCAGGGGACTGGGCGACCCTCCGTTCTG TTGCTGCCGGTGAGGCGGGAGAGCGCCGGGGCC GACACGCGCCCCACTGTCAGACCACGGAATGATG TGGCCCACAAGCAGCTCTCAGCTTTTGGAGAGTAT GTGGCTGAAATCTTGCCCAAGTATGTCCAACAAGT TCAGGTGTCCTGCTTCAATGAGTTAGAGGTCTGTA TCCATCCTGATGGCGTCATCCCAGTGCTGACTTTC CTCAGGGATCACACCAATGCACAGTTCAAATCTCT GGTTGACTTGACAGCAGTGGACGTCCCAACTCGG CAAAACCGTTTTGAGATTGTCTACAACCTGTTGTCT CTGCGCTTCAACTCACGGATCCGTGTGAAGACCTA CACAGATGAGCTGACGCCCATTGAGTCTGCTGTCT CTGTGTTCAAGGCAGCCAACTGGTATGAAAGGGA GATCTGGGACATGTTTGGAGTCTTCTTTGCTAACC ACCCTGATCTAAGAAGGATCCTGACAGATTATGGC TTCGAGGGACATCCTTTCCGGAAAGACTTTCCTCT ATCTGGCTATGTTGAGTTACGTTATGATGATGAAGT GAAGCGGGTGGTGGCAGAGCCGGTGGAGTTGGC CCAAGAGTTCCGCAAATTTGACCTGAACAGCCCCT GGGAGGCTTTCCCAGTCTATCGCCAACCCCCGGA GAGTCTCAAGCTTGAAGCCGGAGACAAGAAGCCT GATGCCAAGTAGCTCCAGGGAACGCATGTGGATC CTAGACAGCGCCTTATCTATGATTGAGTGTCCGTG TAAATAAATTCCTACTTAGACTTAAAAAAAAAAAAA | 10 | LGDPPFCC CR* |
| 1382 | NM_0045 59.3_732 | 732 | GGGCTTATCCCGCCTGTCCCGCCATTCTCGCTAGT TCGATCGGTAGCGGGAGCGGAGAGCGGACCCCA GAGAGCCCTGAGCAGCCCCACCGCCGCCGCCGG CCTAGTTACCATCACACCCCGGGAGGAGCCGCAG CTGCCGCAGCCGGCCCCAGTCACCATCACCGCAA CCATGAGCAGCGAGGCCGAGACCCAGCAGCCGC CCGCCGCCCCCCCGCCGCCCCCGCCCTCAGCG CCGCCGACACCAAGCCCGGCACTACGGGCAGCG GCGCAGGGAGCGGTGGCCCGGGCGGCCTCACAT CGGCGGCGCCTGCCGGCGGGGACAAGAAGGTCA TCGCAACGAAGGTTTTGGGAACAGTAAAATGGTTC AATGTAAGGAACGGATATGGTTTCATCAACAGGAA TGACACCAAGGAAGATGTATTTGTACACCAGACTG CCATAAAGAAGAATAACCCCAGGAAGTACCTTCGC AGTGTAGGAGATGGAGAGACTGTGGAGTTTGATG TTGTTGAAGGAGAAAAGGGTGCGGAGGCAGCAAA TGTTACAGGTCCTGGTGGTGTTCCAGTTCAAGGCA GTAAATATGCAGCAGACCGTAACCATTATAGACGC TATCCACGTCGTAGGGGTCCTCCACGCAATTACCA GCAAAATTACCAGAATAGTGAGAGTGGGGAAAAGA ACGAGGGATCGGAGAGTGCTCCCGAAGGCCAGG CCCAACAACGCCGGCCTACCGCAGGCGAAGGTTC CCACCTTACTACATGCGGAGACCCTATGGGCGTC GACCACAGTATTCCAACCCTCCTGTGCAGGGAGA AGTGATGGAGGGTGCTGACAACCAGGGTGCAGGA GAACAAGGTAGACCAGTGAGGCAGAATATGTATC GGGGATATAGACCACGATTCCGCAGGGGCCCTCC TCGCCAAAGACAGCCTAGAGAGGACGGCAATGAA GAAGATAAAGAAAATCAAGGAGATGAGACCCAAG GTCAGCAGCCACCTCAACGTCGGTACCGCCGCAA CTT | 29 | TAGEGSHL TTCGDPM GVDHSIPT LLCREK* |

TABLE 3A-continued

| SEQ ID | identifier_position | position | modified_RNA | PAP length | PAP |
|---|---|---|---|---|---|
| 1383 | NM_004559.3_845 | 845 | GGGCTTATCCCGCCTGTCCCGCCATTCTCGCTAGTTCGATCGGTAGCGGGAGCGGAGAGCGGACCCCAGAGAGCCCTGAGCAGCCCCACCGCCGCCGCGGCCTAGTTACCATCACACCCCGGGAGGAGCCGCAGCTGCCGCAGCCGGCCCCAGTCACCATCACCGCAACCATGAGCAGCGAGGCCGAGACCCAGCAGCCGCCCGCCGCCCCCCCGCCGCCCCCGCCCTCAGCGCCGCCGACACCAAGCCCGGCACTACGGGCAGCGGCGCAGGGAGCGGTGGCCCGGGCGGCCTCACATCGGCGGCGCCTGCCGGCGGGGACAAGAAGGTCATCGCAACGAAGGTTTTGGGAACAGTAAAATGGTTCAATGTAAGGAACGGATATGGTTTCATCAACAGGAATGACACCAAGGAAGATGTATTTGTACACCAGACTGCCATAAAGAAGAATAACCCCAGGAAGTACCTTCGCAGTGTAGGAGATGGAGAGACTGTGGAGTTTGATGTTGTTGAAGGAGAAAAGGGTGCGGAGGCAGCAAATGTTACAGGTCCTGGTGGTGTTCCAGTTCAAGGCAGTAAATATGCAGCAGACCGTAACCATTATAGACGCTATCCACGTCGTAGGGGTCCTCCACGCAATTACCAGCAAAATTACCAGAATAGTGAGAGTGGGGAAAAGAACGAGGGATCGGAGAGTGCTCCCGAAGGCCAGGCCCAACAACGCCGGCCCTACCGCAGGCGAAGGTTCCCACCTTACTACATGCGGAGACCCTATGGGCGTCGACCACAGTATTCCAACCCTCCTGTGCAGGGAGAAGTGATGGAGGGTGCTGACAACCAGGTGCAGGAGAACAAGGTAGACCAGTGAGGCAGAATATGTATCGGGGATATAGACCACGATTCCGCAGGGGCCCTCCTCGCCAAAGACAGCCTAGAGAGGACGGCAATGAAGAAGATAAAGAAAATCAAGGAGATGAGACCCAAGGTCAGCAGCCACCTCAACGTCGGTACCGCCGCAACTT | 8 | VQENKVDQ* |
| 1384 | NM_004596.3_646 | 646 | CTTTGTGGTTTGGTCTCAGGGAAGTAGCAGGCGCCGGTTGAGAGAACTACGGCCCTGTCGGAAGGTAACCTCCGGTGCAAACGACCATCGGCGGCAGGCGAGCGGTACGCTTGGCGTCCGGGCCTTCCTGGGCCCGTCTGAGGAAACTTGCTGCTCGAGGCCAGGCTGCCTAGGACCTGTCCCTTTTTTCTATACTGGCTCCCACATCCGGGTTTTTTCTCCGGGACGGCCCTTCGGATGCTTGGGCCAATGGGAATCGCCATTTAGGGTGCTCCGCCCACCGGGTCGCGTAGAGCATCCTGGAAGTCGTAGTAAATCTCTCGAGAGTTCTCTCCGCACGCGGGCTGGAGAAGCGGGTCCTACGCACGCTTTGTTGTCGCGCTTTGCCTCCGTCCTTCCCCCTACTCCCGCCTTACCTGACTTCCTTTTCGGAGGAAGATCCTTGAGCAGCCGACGTTGGGACAAAGGATTTGGAGAAACCCAGGGCTAAAGTCACGTTTTTCCTCCTTTAAGACTTACCTCAACACTTCACTCCATGGCAGTTCCCGAGACCCGCCCTAACCACACTATTTATATCAACAACCTCAATGAGAAGATCAAGAAGGATGAGCTAAAAAAGTCCCTGTACGCCATCTTCTCCCAGTTGGCCAGATCCTGGATATCCTGGTATCACGGAGCCTGAAGATGAGGGGCCAGGCCTTTGTCATCTTCAAGGAGGTCAGCAGCGCCACCAACGCCCTGCGCTCCATGCAGGGTTTCCCTTTCTATGACAAACCTATGCGTATCCAGTATGCCAAGACCGACTCAGATATCATTGCCAAGATGAAAGGCACCTTCGTGGAGCGGGACCGCAAGCGGGAGAAGAGGAAGCCCAAGAGCCAGGAGACCCCGGCCACCAAGAAGGCTGTGCAAGGCGGGGGAGCCACCCCCGTGGTGGGGGCTGTCCAGGGGCCTGTCCCGGGCATGCCGCCGATGACTCAGGCGCCCCGCATTATGCACCACATGCCGGGCCAGCCGCCCTACA | 12 | LARSWISWYHGA* |
| 1385 | NM_004596.3_703 | 703 | CTTTGTGGTTTGGTCTCAGGGAAGTAGCAGGCGCCGGTTGAGAGAACTACGGCCCTGTCGGAAGGTAACCTCCGGTGCAAACGACCATCGGCGGCAGGCGAGCGGTACGCTTGGCGTCCGGGCCTTCCTGGGCCCGTCTGAGGAAACTTGCTGCTCGAGGCCAGGCTGCCTAGGACCTGTCCCTTTTTTCTATACTGGCTCCCACATCCGGGTTTTTTCTCCGGGACGGCCCTTCGGATGCTTGGGCCAATGGGAATCGCCATTTAGGGTGCTCCGCCCACCGGGTCGCGTAGAGCATCCTGGAAGTCGTAGTAAATCTCTCGAGAGTTCTCTCCGCACGCGGGCTGGAGAAGCGGGTCCTACGCACGCTTTGTTGTCGCGCTTTGCCTCCGTCCTTCCCCCTACTCCCGCCTTACCTGACTTCCTTTTCGGAGGAAGATCCTTGAGCAGCCGACGTTGGGACAAAGGATTTGGAGAAACCCAGGGCTAAAGTCACGTTTTTCCTCCTTTAAGACTTACCTCAACACTTCACTCCATGGCAGTTCCCGAG | 41 | LSSSRRSAAPPTPCAPCRVSLSMTNLCVSSMPRPTQISLPR* |

TABLE 3A-continued

| SEQ ID | identifier_position | position | modified_RNA | PAP length | PAP |
|---|---|---|---|---|---|
| | | | ACCCGCCCTAACCACACTATTTATATCAACAACCT CAATGAGAAGATCAAGAAGGATGAGCTAAAAAAGT CCCTGTACGCCATCTTCTCCCAGTTTGGCCAGATC CTGGATATCCTGGTATCACGGAGCCTGAAGATGA GGGGCCAGGCCTTGTCATCTTCAAGGAGGTCAGC AGCGCCACCAACGCCCTGCGCTCCATGCAGGGTT TCCCTTTCTATGACAAACCTATGCGTATCCAGTATG CCAAGACCGACTCAGATATCATTGCCAAGATGAAA GGCACCTTCGTGGAGCGGGACCGCAAGCGGGAG AAGAGGAAGCCCAAGAGCCAGGAGACCCCGGCC ACCAAGAAGGCTGTGCAAGGCGGGGGAGCCACC CCCGTGGTGGGGGCTGTCCAGGGGCCTGTCCCG GGCATGCCGCCGATGACTCAGGCGCCCCGCATTA TGCACCACATGCCGGGCCAGCCGCCCTACA | | |
| 1386 | NM_0046 40.5_121 5 | 1215 | CTCAGCTAGGGCCTGCCGGTTCCTAGTGCGTGCC CAGCAGTCCTCAGGTCACCTTCACTACCGGGCCA AGGACCCCGTGGGAACTCGCAGCCTTCGCCACAC TCGTTCCTCGCGCATCCATGGAGGGGTGCCTACA GAGAAGACCTGCGTGGCAAAAACCTAAACGAAGA GATGAGGGGCATGGAGAGGAGTAGGATAAGAGAA TAAAGATAACAGTGGGGGGGAGACGTTAGTTTCCT TTATATCTTTTGTTACTGGCGGTAGCAGTGAAGTTA GAAACGGTTTTAAAACAAATTTCAGACAGGCATTTT CCAAAGGCAAGCCTGGAGCGCACGGATCTGTATA ACCGCGGAAGGCCCTGTTTCCGGTCCCTTGCGCC TGCGCTCTTGCAGCCAAGAAGGCGGGAGGCTGGA GTAGAGGGAAGCCTGCAACCGGAAGTGAAGGCAG ATTTCCCTCCTTCGTCGCTGTTGCTGCCGCCATAC GCGCTCTCCCTGTTTAGCTCTTCTGTTAGAAATAGT ATCTTTGTTTTCCTTTGCTGTTCCTCAATCCCCTAC TCTTCACCCCTTGTTTTCACCTATTTTGCGAGAACC CATCCAGATCCCCCTTCCCTTCTTCCCCTGCCGGC CCAGTTATGGCAGAGAACGATGTGGACAATGAGC TCTTGGACTATGAAGATGATGAGGTGGAGACAGCA GCTGGGGGAGATGGGGCTGAGGCCCCTGCCAAG AAGGATGTCAAGGGCTCCTATGTCTCCATCCACAG CTCTGGCTTTCGTGACTTCCTGCTCAAGCCAGAGT TGCTCCGGGCCATTGTCGACTGTGGCTTTGAGCAT CCGTCAGAAGTCCAGCATGAGTGCATCCCTCAGG CCATTCTGGGAATGGATGTCCTGTGCCAGGCCAA GTCGGGCATGGGAAAGACAGCAGTGTTTGTCTTG GCCACACTGCAACAGCTGGAGCCAGTTACTGGGC AGGTGTCTGTACTGGTGATGTGTCACACTCGGGA GTTGGCTTTTCAGATCAGCAAG | 22 | WMNVIRCL NSSTCVG MSRKFFA* |
| 1387 | NM_0046 40.5_928 | 928 | CTCAGCTAGGGCCTGCCGGTTCCTAGTGCGTGCC CAGCAGTCCTCAGGTCACCTTCACTACCGGGCCA AGGACCCCGTGGGAACTCGCAGCCTTCGCCACAC TCGTTCCTCGCGCATCCATGGAGGGGTGCCTACA GAGAAGACCTGCGTGGCAAAAACCTAAACGAAGA GATGAGGGGCATGGAGAGGAGTAGGATAAGAGAA TAAAGATAACAGTGGGGGGGAGACGTTAGTTTCCT TTATATCTTTTGTTACTGGCGGTAGCAGTGAAGTTA GAAACGGTTTTAAAACAAATTTCAGACAGGCATTTT CCAAAGGCAAGCCTGGAGCGCACGGATCTGTATA ACCGCGGAAGGCCCTGTTTCCGGTCCCTTGCGCC TGCGCTCTTGCAGCCAAGAAGGCGGGAGGCTGGA GTAGAGGGAAGCCTGCAACCGGAAGTGAAGGCAG ATTTCCCTCCTTCGTCGCTGTTGCTGCCGCCATAC GCGCTCTCCCTGTTTAGCTCTTCTGTTAGAAATAGT ATCTTTGTTTTCCTTTGCTGTTCCTCAATCCCCTAC TCTTCACCCCTTGTTTTCACCTATTTTGCGAGAACC CATCCAGATCCCCCTTCCCTTCTTCCCCTGCCGGC CCAGTTATGGCAGAGAACGATGTGGACAATGAGC TCTTGGACTATGAAGATGATGAGGTGGAGACAGCA GCTGGGGGAGATGGGGCTGAGGCCCCTGCCAAG AAGGATGTCAAGGGCTCCTATGTCTCCATCCACAG CTCTGGCTTTCGTGACTTCCTGCTCAAGCCAGAGT TGCTCCGGGCCATTGTCGACTGTGGCTTTGAGCAT CCGTCAGAAGTCCAGCATGAGTGCATCCCTCAGG CCATTCTGGGAATGGATGTCCTGTGCCAGGCCAA GTCGGGCATGGGAAAGACAGCAGTGTTTGTCTTGG CCACACTGCAACAGCTGGAGCCAGTTACTGGGCA GGTGTCTGTACTGGTGATGTGTCACACTCGGGAGT TGGCTTTTCAGATCAGCAAGG | 19 | LSWPHCN SWSQLLG RCLYW* |
| 1388 | NM_0046 51.3_796 | 796 | ATGGCAGTAGCCCCGCGACTGTTTGGGGGGCTCT GCTTCCGTTTCGGGACCAGAATCGGAAGTGGC TGTTGAGGGGCGTCTTCCAATCTCGCACAGCTGC | 4 | RLGS* |

TABLE 3A-continued

| SEQ ID | identifier_position | position | modified_RNA | PAP length | PAP |
|---|---|---|---|---|---|
| | | | GTTGGCTGTAGAAGAGAACGGACGGCGATGGCGA<br>CGGTCGCAGCAAATCCAGCTGCTGCTGCGGCGGC<br>TGTGGCGGCGGCAGCGGCGGTGACTGAGGATAG<br>AGAGCCACAGCACGAGGAGCTGCCAGGCCTGGA<br>CAGCCAGTGGCGCCAGATAGAAAACGGCGAGAGT<br>GGGCGAGAACGTCCACTGCGGGCCGGCGAAAGC<br>TGGTTCCTTGTGGAGAAGCACTGGTATAAGCAGTG<br>GGAGGCATACGTGCAGGGAGGGGACCAGGACTC<br>CAGCACCTTCCCTGGCTGCATCAACAATGCCACAC<br>TCTTTCAAGATGAGATAAACTGGCGCCTCAAGGAG<br>GGACTGGTGGAAGGCGAGGATTATGTGCTGCTCC<br>CAGCAGCTGCTTGGCATTACCTGGTCAGCTGGTAT<br>GGTCTAGAGCATGGCCAGCCACCCATTGAACGCA<br>AGGTCATAGAGCTGCCCAACATCCAGAAGGTCGA<br>AGTGTACCCAGTAGAACTGCTGCTTGTCCGGCACA<br>ATGATTTGGGCAAATCTCACACTGTTCAGTTCAGC<br>CATACCGATTCTATTGGCCTAGTATTGCGCACAGC<br>TCGGGAGCGGTTTCTGGTGGAGCCCCAGGAAGAC<br>ACTCGGCTTTGGGCCAAGAACTCAGAAGGCTCTTT<br>GGATAGGTTGTATGACACACACATCACGGTTCTCG<br>ATGCGGCCTTGAGACTGGGCAGTTGATCATCATG<br>GAGACCCGCAAGAAAGATGGCACTTGGCCCAGCG<br>CACAGCTGCATGTCATGAACAACAACATGTCGGAA<br>GAGGATGAGGACTTCAAGGGTCAGCCAGGCATCT<br>GTGGCCTCACCAATCTGGGCAACACGTGCTTCATG<br>AACTCGGCCCTGCAGTGCCTCAGCAATGTGCCAC<br>AGCTCACCGAGTACTTCCTCAACAACTGCTA | | |
| 1389 | NM_0047<br>18.2_129 | 129 | CTTCTCTGGGGCGGTCGCGTTGGCAGCGGATGCG<br>GGAAGCCGGACTCTGGGCGTCATGTACTACAAGT<br>TTAGTGGCTTCACGCAGAAGTTGGCAGGAGCATG<br>GGCTTCGGAGGCCTATAGCCCGCAGGATTAAAGC<br>CTGTGGTTTCCACAGAAGCACCACCTATCATATTT<br>GCCACACCAACTAAACTGACCTCCGATTCCACAGT<br>GTATGATTATGCTGGGAAAAACAAAGTTCCAGAGC<br>TACAAAAGTTTTTCCAGAAAGCTGATGGTGTGCCC<br>GTCTACCTGAAACGAGGCCTGCCTGACCAAATGCT<br>TTACCGGACCACCATGGCGCTGACTGTGGGAGGG<br>ACCATCTACTGCCTGATCGCCCTCTACATGGCTTC<br>GCAGCCCAAAAACAAATGAGTTAGGCTGCAGAGG<br>ACTGGTTTGTTTTTGGCATAAACCCTTTGAAGTTC<br>CTTTTTCATTGTTAAATTAAAATTTTTTTTTTACTTG<br>GATGGCTTAACATTTTTGCAAGAAAAATAGGAAGA<br>TATGAAGATGATGTTTTGGTTTGTTTATGAAATGCA<br>TATGGCTTGTCAGAGCTCATTCGACAGTTAAAGCC<br>ATTGTTTAAAGAAATGGTGCTTTGCTCTGTGTTTGT<br>GCTCCTGATTTCCCTGGAGGTTCTGGATGAAGGCT<br>GAACACAGGCTTGTTAATGTCAGTCTGTGCTGAGG<br>ACCTCAGGGACTTGAGGTTGCATTTTTGAGCATGG<br>GGTGCAGGAGCCTTTCTGGATTTGGATGTGGCTAT<br>GGAAAGAACACAGAAGCCAAGGTCATGTGCATGA<br>AATGAGGAGTTTGAGTTAGTCACCTCGGGGATTTT<br>TTCCATTTTGCAGTAAAATGTTAAATTAATGTAGCC<br>TGCCTCTATTTGTTGGGCAGGTAATTTCAAAGGGT<br>TATTTGCCTCATCTCCTATCTTTAGTGAAATCTTAT<br>GTGTAATTATTCCACCGTGGGAACAGAGAATACCT<br>GTTTAGTGTTGCACTTTAGACTGGTGTCTGTTTTGT<br>TAATGCA | 1 | D* |
| 1390 | NM_0048<br>59.3_540<br>8 | 5408 | AGACTGGCGAAAGTGATGAGTCTAAAAAAGTAGTC<br>CCTCCGGTTCCTCTGTTTCCCCCCATGTGGCGTCA<br>GGAAGCGAGGCACCGGGCGCACTGCGCCCCGAA<br>TTCCTGCGCCCGCCGCGCGCGGCGCTCCGTGGA<br>GGGGTACATAAGGCGGAGGGGGTGAGGCGACTG<br>GGCGGAGTTCTGTCGCCGGGATCCTTCCGCTGGG<br>CTCAGCCGTTTCCGGAGTCTGCGCTGCGCCCGGT<br>TCCGCCATTGCGGCTCTCCTGGCCCCTGGAGCCT<br>CCGCCCCCGACCCGAGCTCTTTCGTCTGCCTGCC<br>AGTTTCCTGCGTCCCCGGAGAGGATCCTGCTGAG<br>CCCAGCCTCCCCCCTCCCCTTCTCCTCCTCTCCCT<br>TGGAGAGCCCGGGCAGCCACTGCCCCGCAGCCC<br>CAGTGACAGGAGGAGACCATAACCCCCGACAGCG<br>CCATGGCCCAGATTCTGCCAATTCGTTTTCAGGAG<br>CATCTCCAGCTCCAGAACCTGGGTATCAACCCAGC<br>AAACATTGGCTTCAGTACCCTGACTATGGAGTCTG<br>ACAAAATTCATCTGCATTAGAGAAAAAGTAGGAGAG<br>CAGGCCCAGGTGGTAATCATTGATATGAATGACCC<br>AAGTAATCCAATTCGAAGACCAATTTCAGCAGACA<br>GCGCCATCATGAATCCAGCTAGCAAAGTAATTGCA | 25 | LMVIPHH<br>RMDSHSLA<br>LGTACEMK<br>R* |

TABLE 3A-continued

| SEQ ID | identifier_position | position | modified_RNA | PAP length | PAP |
|---|---|---|---|---|---|
| | | | CTGAAAGCTGGGAAAACTCTTCAGATTTTTAACATT GAAATGAAAAGTAAAATGAAGGCTCATACCATGAC TGATGATGTCACCTTTTGGAAATGGATCTCTTTGAA TACGGTTGCTCTTGTTACGGATAATGCAGTTTATCA CTGGAGTATGGAAGGAGAGTCTCAGCCAGTGAAA ATGTTTGATCGCCATTCTAGCCTTGCAGGGTGCCA GATTATCAATTACCGTACAGATGCAAAACAAAAGT GGTTACTTCTGACTGGTATATCTGCACAGCAAAAT CGTGTGGTGGGAGCTATGCAGCTATATTCTGTAGA TAGGAAAGTGTCTCAGCCCAT | | |
| 1391 | NM_0048 88.3_431 | 431 | GTGACAACGGGGGCGAAGCGCAGGCGCAAGGAG CAAGCGCAGATTGTGGGCGGCTGTGTCAGCTGAC CCAAGGGGCCTTCGAGGTGCCTTAGGCCGCTTGC CTTGCTCTCAGAATCGCTGCCGCCATGGCTAGTCA GTCTCAGGGGATTCAGCAGCTGCTGCAGGCCGAG AAGCGGGCAGCCGAGAAGGTGTCCGAGGCCCGC AAAAGAAAGAACCGGAGGCTGAAGCAGGCCAAAG AAGAAGCTCAGGCTGAAATTGAACAGTACCGCCTG CAGAGGGAGAAAGAATTCAAGGCCAAGGAAGCTG CGGCATTGGGATCCCGTGGCAGTTGCAGCACTGA AGTGGAGAAGGAGACCCAGGAGAAGATGACCATC CTCCAGACATACTTCCGGCAGAACAGGGATGAAG TCTTGGACAACCTCTTGGCTTTGTCTGTGACATTC GGCCAGAAATCCATGAAAACTACCGCATAAATGGA TAGAAGAGAGAAGCACCTGTGCTGTGGAGTGGCA TTTTAGATGCCCTCACGAATATGAAGCTTAGCACA GCTCTAGTTACATTCTTATGATATGGCATTAAATTA TTTCCATATATTATATAATAGGTCCTTCCACTTTTTG GAGAGTAGCAAATCTAGCTTTTTTGTACAGACTTA GAAATTATCTAAAGATTTCATCTTTTTACCTCATATT TCTTAGGAATTTAATGGTTATATGTTGTCTTTTTTTC CTATGTCTTTTGGCTCAAGCAACATGTATATCAGTG TTGACTTTTTCTTTCTTAGATCTAGTTTAAAAAAAAA AAAAACCACATAACAATTCTTTGAAGAAAGGAAGG GATTAAATAATTTTTTTCCCTAACACTTTCTTGAAG GTCAGGGGCTTTATCTATGAAAAAGTAGTAAATAG TTCTTTGTAACCTGTGTGAAGCAGCAGCCAGCCTT AAAGTAGTCCATTCTTGCTAATGGTTAGAACAGTG AATACTAGTGGAATTGTTTGGGCTGCTTTTAGTTTC TCTTAATCAA | 14 | LSVTFGQK SMKTTA* |
| 1392 | NM_0049 05.2_115 | 115 | GAACCAACCGGTTGCTTGCTGTCCCAGCGGCGCC CCCTCATCACCGTCGCCATGCCCGGAGGTCTGCT TCTCGGGGACGTGGCTCCCAACTTTGAGGCCAAT ACCACCGTCGGCGCATCCGTTTCCACGACTTTCTG GGAGACTCATGGGGCATTCTCTTCTCCCACCCTCG GGACTTTACCCCAGTGTGCACCACAGAGCTTGGC AGAGCTGCAAAGCTGGCACCAGAATTTGCCAAGA GGAATGTTAAGTTGATTGCCCTTTCAATAGACAGT GTTGAGGACCATCTTGCCTGGAGCAAGGATATCAA TGCTTACAATTGTGAAGAGCCCACAGAAAAGTTAC CTTTTCCCATCATCGATGATAGGAATCGGGAGCTT GCCATCCTGTTGGGCATGCTGGATCCAGCAGAGA AGGATGAAAAGGGCATGCCTGTGACAGCTCGTGT GGTGTTTGTTTTTGGTCCTGATAAGAAGCTGAAGC TGTCTATCCTCTACCCAGCTACCACTGGCAGGAAC TTTGATGAGATTCTCAGGGTAGTCATCTCTCTCCA GCTGACAGCAGAAAAAAGGGTTGCCACCCCAGTT GATTGGAAGGATGGGGATAGTGTGATGGTCCTTC CAACCATCCCTGAAGAAGAAGCCAAAAAACTTTTC CCGAAAGGAGTCTTCACCAAAGAGCTCCCATCTG GCAAGAAATACCTCCGCTACACACCCCAGCCTTAA GTCTCTTGGAGAAGCTGGTGCTGTGAGCCAGAGG ATGTCAGCTGCCAATTGTGTTTTCCTGCAGCAATT CCATAAACACATCCTGGTGTCATCACAGCCAAGGT TTTTAGGTTGCTATACCAATGGCTTATTAAATGAAA ATGGCACTAAAAGTTTCTTGAGATTCTTTATACTCT CTGCCTTCAGCAATCAATTCCATTCATACATCAGCA CTCTGCTGGTTCTGTTTGAAATATGTTCTGTATTTA AAACTCAAATCTTGTTGGATCTCTGCAGGGCTTGT GACCAATGAAGTCATA | 46 | ASVSTTFW ETHGAFSS PTLGTLPQ CAPQSLAE LQSWHQN LPRGMLS* |
| 1393 | NM_0049 05.2_204 | 204 | GAACCAACCGGTTGCTTGCTGTCCCAGCGGCGCC CCCTCATCACCGTCGCCATGCCCGGAGGTCTGCT TCTCGGGGACGTGGCTCCCAACTTTGAGGCCAAT ACCACCGTCGGCCGCATCCGTTTCCACGACTTTCT GGGAGACTCATGGGGCATTCTCTTCTCCCACCCTC GGGACTTTACCCCAGTGTGCACCACAGAGCTTGGC AGAGCTGCAAAGCTGGCACCAGAATTTGCCAAGA | 16 | AELQSWH QNLPRGM LS* |

TABLE 3A-continued

| SEQ ID | identifier_position | position | modified_RNA | PAP length | PAP |
|---|---|---|---|---|---|
| | | | GGAATGTTAAGTTGATTGCCCTTTCAATAGACAGT GTTGAGGACCATCTTGCCTGGAGCAAGGATATCAA TGCTTACAATTGTGAAGAGCCCACAGAAAAGTTAC CTTTTCCCATCATCGATGATAGGAATCGGGAGCTT GCCATCCTGTTGGGCATGCTGGATCCAGCAGAGA AGGATGAAAAGGGCATGCCTGTGACAGCTCGTGT GGTGTTTGTTTTTGGTCCTGATAAGAAGCTGAAGC TGTCTATCCTCTACCCAGCTACCACTGGCAGGAAC TTTGATGAGATTCTCAGGGTAGTCATCTCTCTCCA GCTGACAGCAGAAAAAAGGGTTGCCACCCCAGTT GATTGGAAGGATGGGGATAGTGTGATGGTCCTTC CAACCATCCCTGAAGAAGAAGCCAAAAAACTTTTC CCGAAAGGAGTCTTCACCAAAGAGCTCCCATCTG GCAAGAAATACCTCCGCTACACACCCCAGCCTTAA GTCTCTTGGAGAAGCTGGTGCTGTGAGCCAGAGG ATGTCAGCTGCCAATTGTGTTTTCCTGCAGCAATT CCATAAACACATCCTGGTGTCATCACAGCCAAGGT TTTTAGGTTGCTATACCAATGGCTTATTAAATGAAA ATGGCACTAAAAGTTTCTTGAGATTCTTTATACTCT CTGCCTTCAGCAATCAATTCCATTCATACATCAGCA CTCTGCTGGTTCTGTTTGAAATATGTTCTGTATTTA AAACTCAAATCTTGTTGGATCTCTGCAGGGCTTGT GACCAATGAAGTCATA | | |
| 1394 | NM_0049 05.2_234 | 234 | GAACCAACCGGTTGCTTGCTGTCCCAGCGGCGCC CCCTCATCACCGTCGCCATGCCCGGAGGTCTGCT TCTCGGGGACGTGGCTCCCAACTTTGAGGCCAAT ACCACCGTCGGCCGCATCCGTTTCCACGACTTTCT GGGAGACTCATGGGGCATTCTCTTCTCCCACCCTC GGGACTTTACCCCAGTGTGCACCACAGAGCTTGG CAGAGCTGCAAAGCTGGCACCAGAATTGCCAAGA GGAATGTTAAGTTGATTGCCCTTTCAATAGACAGT GTTGAGGACCATCTTGCCTGGAGCAAGGATATCAA TGCTTACAATTGTGAAGAGCCCACAGAAAAGTTAC CTTTTCCCATCATCGATGATAGGAATCGGGAGCTT GCCATCCTGTTGGGCATGCTGGATCCAGCAGAGA AGGATGAAAAGGGCATGCCTGTGACAGCTCGTGT GGTGTTTGTTTTTGGTCCTGATAAGAAGCTGAAGC TGTCTATCCTCTACCCAGCTACCACTGGCAGGAAC TTTGATGAGATTCTCAGGGTAGTCATCTCTCTCCA GCTGACAGCAGAAAAAAGGGTTGCCACCCCAGTT GATTGGAAGGATGGGGATAGTGTGATGGTCCTTC CAACCATCCCTGAAGAAGAAGCCAAAAAACTTTTC CCGAAAGGAGTCTTCACCAAAGAGCTCCCATCTG GCAAGAAATACCTCCGCTACACACCCCAGCCTTAA GTCTCTTGGAGAAGCTGGTGCTGTGAGCCAGAGG ATGTCAGCTGCCAATTGTGTTTTCCTGCAGCAATT CCATAAACACATCCTGGTGTCATCACAGCCAAGGT TTTTAGGTTGCTATACCAATGGCTTATTAAATGAAA ATGGCACTAAAAGTTTCTTGAGATTCTTTATACTCT CTGCCTTCAGCAATCAATTCCATTCATACATCAGCA CTCTGCTGGTTCTGTTTGAAATATGTTCTGTATTTA AAACTCAAATCTTGTTGGATCTCTGCAGGGCTTGT GACCAATGAAGTCATA | 7 | LPRGMLS* |
| 1395 | NM_0049 05.2_258 | 258 | GAACCAACCGGTTGCTTGCTGTCCCAGCGGCGCC CCCTCATCACCGTCGCCATGCCCGGAGGTCTGCT TCTCGGGGACGTGGCTCCCAACTTTGAGGCCAAT ACCACCGTCGGCCGCATCCGTTTCCACGACTTTCT GGGAGACTCATGGGGCATTCTCTTCTCCCACCCTC GGGACTTTACCCCAGTGTGCACCACAGAGCTTGG CAGAGCTGCAAAGCTGGCACCAGAATTTGCCAAG AGGAATGTTAAGTTGATGCCCTTTCAATAGACAGT GTTGAGGACCATCTTGCCTGGAGCAAGGATATCAA TGCTTACAATTGTGAAGAGCCCACAGAAAAGTTAC CTTTTCCCATCATCGATGATAGGAATCGGGAGCTT GCCATCCTGTTGGGCATGCTGGATCCAGCAGAGA AGGATGAAAAGGGCATGCCTGTGACAGCTCGTGT GGTGTTTGTTTTTGGTCCTGATAAGAAGCTGAAGC TGTCTATCCTCTACCCAGCTACCACTGGCAGGAAC TTTGATGAGATTCTCAGGGTAGTCATCTCTCTCCA GCTGACAGCAGAAAAAAGGGTTGCCACCCCAGTT GATTGGAAGGATGGGGATAGTGTGATGGTCCTTC CAACCATCCCTGAAGAAGAAGCCAAAAAACTTTTC CCGAAAGGAGTCTTCACCAAAGAGCTCCCATCTG GCAAGAAATACCTCCGCTACACACCCCAGCCTTAA GTCTCTTGGAGAAGCTGGTGCTGTGAGCCAGAGG ATGTCAGCTGCCAATTGTGTTTTCCTGCAGCAATT CCATAAACACATCCTGGTGTCATCACAGCCAAGGT | 4 | MPFQ* |

TABLE 3A-continued

| SEQ ID | identifier_position | position | modified_RNA | PAP length | PAP |
|---|---|---|---|---|---|
| | | | TTTTAGGTTGCTATACCAATGGCTTATTAAATGAAA<br>ATGGCACTAAAAGTTTCTTGAGATTCTTTATACTCT<br>CTGCCTTCAGCAATCAATTCCATTCATACATCAGCA<br>CTCTGCTGGTTCTGTTTGAAATATGTTCTGTATTTA<br>AAACTCAAATCTTGTTGGATCTCTGCAGGGCTTGT<br>GACCAATGAAGTCATA | | |
| 1396 | NM_0049<br>05.2_322 | 322 | GAACCAACCGGTTGCTTGCTGTCCCAGCGGCGCC<br>CCCTCATCACCGTCGCCATGCCCGGAGGTCTGCT<br>TCTCGGGGACGTGGCTCCCAACTTTGAGGCCAAT<br>ACCACCGTCGGCCGCATCCGTTTCCACGACTTTCT<br>GGGAGACTCATGGGGCATTCTCTTCTCCCACCCTC<br>GGGACTTTACCCCAGTGTGCACCACAGAGCTTGG<br>CAGAGCTGCAAAGCTGGCACCAGAATTTGCCAAG<br>AGGAATGTTAAGTTGATTGCCCTTTCAATAGACAG<br>TGTTGAGGACCATCTTGCCTGGAGCAAGGATATCA<br>ATGCTTACAATGTGAAGAGCCCACAGAAAAGTTAC<br>CTTTTCCCATCATCGATGATAGGAATCGGGAGCTT<br>GCCATCCTGTTGGGCATGCTGGATCCAGCAGAGA<br>AGGATGAAAAGGGCATGCCTGTGACAGCTCGTGT<br>GGTGTTTGTTTTTGGTCCTGATAAGAAGCTGAAGC<br>TGTCTATCCTCTACCCAGCTACCACTGGCAGGAAC<br>TTTGATGAGATTCTCAGGGTAGTCATCTCTCTCCA<br>GCTGACAGCAGAAAAAAGGGTTGCCACCCCAGTT<br>GATTGGAAGGATGGGGATAGTGTGATGGTCCTTC<br>CAACCATCCCTGAAGAAGAAGCCAAAAAACTTTTC<br>CCGAAAGGAGTCTTCACCAAAGAGCTCCCATCTG<br>GCAAGAAATACCTCCGCTACACACCCCAGCCTTAA<br>GTCTCTTGGAGAAGCTGGTGCTGTGAGCCAGAGG<br>ATGTCAGCTGCCAATTGTGTTTTCCTGCAGCAATT<br>CCATAAACACATCCTGGTGTCATCACAGCCAAGGT<br>TTTTAGGTTGCTATACCAATGGCTTATTAAATGAAA<br>ATGGCACTAAAAGTTTCTTGAGATTCTTTATACTCT<br>CTGCCTTCAGCAATCAATTCCATTCATACATCAGCA<br>CTCTGCTGGTTCTGTTTGAAATATGTTCTGTATTTA<br>AAACTCAAATCTTGTTGGATCTCTGCAGGGCTTGT<br>GACCAATGAAGTCATA | 38 | VKSPQKSY<br>LFPSSMIGI<br>GSLPSCW<br>ACWIQQR<br>RMKRACL* |
| 1397 | NM_0049<br>05.2_392 | 392 | GAACCAACCGGTTGCTTGCTGTCCCAGCGGCGCC<br>CCCTCATCACCGTCGCCATGCCCGGAGGTCTGCT<br>TCTCGGGGACGTGGCTCCCAACTTTGAGGCCAAT<br>ACCACCGTCGGCCGCATCCGTTTCCACGACTTTCT<br>GGGAGACTCATGGGGCATTCTCTTCTCCCACCCTC<br>GGGACTTTACCCCAGTGTGCACCACAGAGCTTGG<br>CAGAGCTGCAAAGCTGGCACCAGAATTTGCCAAG<br>AGGAATGTTAAGTTGATTGCCCTTTCAATAGACAG<br>TGTTGAGGACCATCTTGCCTGGAGCAAGGATATCA<br>ATGCTTACAATTGTGAAGAGCCCACAGAAAAGTTA<br>CCTTTTCCCATCATCGATGATAGGAATCGGGAGCT<br>TGCCATCCTGTGGGCATGCTGGATCCAGCAGAGA<br>AGGATGAAAAGGGCATGCCTGTGACAGCTCGTGT<br>GGTGTTTGTTTTTGGTCCTGATAAGAAGCTGAAGC<br>TGTCTATCCTCTACCCAGCTACCACTGGCAGGAAC<br>TTTGATGAGATTCTCAGGGTAGTCATCTCTCTCCA<br>GCTGACAGCAGAAAAAAGGGTTGCCACCCCAGTT<br>GATTGGAAGGATGGGGATAGTGTGATGGTCCTTC<br>CAACCATCCCTGAAGAAGAAGCCAAAAAACTTTTC<br>CCGAAAGGAGTCTTCACCAAAGAGCTCCCATCTG<br>GCAAGAAATACCTCCGCTACACACCCCAGCCTTAA<br>GTCTCTTGGAGAAGCTGGTGCTGTGAGCCAGAGG<br>ATGTCAGCTGCCAATTGTGTTTTCCTGCAGCAATT<br>CCATAAACACATCCTGGTGTCATCACAGCCAAGGT<br>TTTTAGGTTGCTATACCAATGGCTTATTAAATGAAA<br>ATGGCACTAAAAGTTTCTTGAGATTCTTTATACTCT<br>CTGCCTTCAGCAATCAATTCCATTCATACATCAGCA<br>CTCTGCTGGTTCTGTTTGAAATATGTTCTGTATTTA<br>AAACTCAAATCTTGTTGGATCTCTGCAGGGCTTGT<br>GACCAATGAAGTCATA | 15 | WACWIQQ<br>RRMKRAC<br>L* |
| 1398 | NM_0049<br>05.2_456 | 456 | GAACCAACCGGTTGCTTGCTGTCCCAGCGGCGCC<br>CCCTCATCACCGTCGCCATGCCCGGAGGTCTGCT<br>TCTCGGGGACGTGGCTCCCAACTTTGAGGCCAAT<br>ACCACCGTCGGCCGCATCCGTTTCCACGACTTTCT<br>GGGAGACTCATGGGGCATTCTCTTCTCCCACCCTC<br>GGGACTTTACCCCAGTGTGCACCACAGAGCTTGG<br>CAGAGCTGCAAAGCTGGCACCAGAATTTGCCAAG<br>AGGAATGTTAAGTTGATTGCCCTTTCAATAGACAG<br>TGTTGAGGACCATCTTGCCTGGAGCAAGGATATCA<br>ATGCTTACAATTGTGAAGAGCCCACAGAAAAGTTA<br>CCTTTTCCCATCATCGATGATAGGAATCGGGAGCT | 8 | LFLVLIRS* |

TABLE 3A-continued

| SEQ ID | identifier_position | position | modified_RNA | PAP length | PAP |
|---|---|---|---|---|---|
| | | | TGCCATCCTGTTGGGCATGCTGGATCCAGCAGAG<br>AAGGATGAAAAGGGCATGCCTGTGACAGCTCGTG<br>TGGTGTTGTTTTTGGTCCTGATAAGAAGCTGAAGC<br>TGTCTATCCTCTACCCAGCTACCACTGGCAGGAAC<br>TTTGATGAGATTCTCAGGGTAGTCATCTCTCTCCA<br>GCTGACAGCAGAAAAAAGGGTTGCCACCCCAGTT<br>GATTGGAAGGATGGGGATAGTGTGATGGTCCTTC<br>CAACCATCCCTGAAGAAGAAGCCAAAAAACTTTTC<br>CCGAAAGGAGTCTTCACCAAAGAGCTCCCATCTG<br>GCAAGAAATACCTCCGCTACACACCCCAGCCTTAA<br>GTCTCTTGGAGAAGCTGGTGCTGTGAGCCAGAGG<br>ATGTCAGCTGCCAATTGTGTTTCCTGCAGCAATT<br>CCATAAACACATCCTGGTGTCATCACAGCCAAGGT<br>TTTTAGGTTGCTATACCAATGGCTTATTAAATGAAA<br>ATGGCACTAAAAGTTTCTTGAGATTCTTTATACTCT<br>CTGCCTTCAGCAATCAATTCCATTCATACATCAGCA<br>CTCTGCTGGTTCTGTTTGAAATATGTTCTGTATTTA<br>AAACTCAAATCTTGTTGGATCTCTGCAGGGCTTGT<br>GACCAATGAAGTCATA | | |
| 1399 | NM_0049 05.2_592 | 592 | GAACCAACCGGTTGCTTGCTGTCCCAGCGGCGCC<br>CCCTCATCACCGTCGCCATGCCCGGAGGTCTGCT<br>TCTCGGGGACGTGGCTCCCAACTTTGAGGCCAAT<br>ACCACCGTCGGCCGCATCCGTTTCCACGACTTTCT<br>GGGAGACTCATGGGGCATTCTCTTCTCCCACCCTC<br>GGGACTTTACCCCAGTGTGCACCACAGAGCTTGG<br>CAGAGCTGCAAAGCTGGCACCAGAATTTGCCAAG<br>AGGAATGTTAAGTTGATTGCCCTTTCAATAGACAG<br>TGTTGAGGACCATCTTGCCTGGAGCAAGGATATCA<br>ATGCTTACAATTGTGAAGAGCCCACAGAAAAGTTA<br>CCTTTTCCCATCATCGATGATAGGAATCGGGAGCT<br>TGCCATCCTGTTGGGCATGCTGGATCCAGCAGAG<br>AAGGATGAAAAGGGCATGCCTGTGACAGCTCGTG<br>TGGTGTTTGTTTTTGGTCCTGATAAGAAGCTGAAG<br>CTGTCTATCCTCTACCAGCTACCACTGGCAGGAA<br>CTTTGATGAGATTCTCAGGGTAGTCATCTCTCTCC<br>AGCTGACAGCAGAAAAAAGGGTTGCCACCCCAGT<br>TGATGGAAGGATGGGGATAGTGTGATGGTCCTTC<br>CAACCATCCCTGAAGAAGAAGCCAAAAAACTTTTC<br>CCGAAAGGAGTCTTCACCAAAGAGCTCCCATCTG<br>GCAAGAAATACCTCCGCTACACACCCCAGCCTTAA<br>GTCTCTTGGAGAAGCTGGTGCTGTGAGCCAGAGG<br>ATGTCAGCTGCCAATTGTGTTTCCTGCAGCAATT<br>CCATAAACACATCCTGGTGTCATCACAGCCAAGGT<br>TTTTAGGTTGCTATACCAATGGCTTATTAAATGAAA<br>ATGGCACTAAAAGTTTCTTGAGATTCTTTATACTCT<br>CTGCCTTCAGCAATCAATTCCATTCATACATCAGCA<br>CTCTGCTGGTTCTGTTTGAAATATGTTCTGTATTTA<br>AAACTCAAATCTTGTTGGATCTCTGCAGGGCTTGT<br>GACCAATGAAGTCATA | 6 | GRMGIV* |
| 1400 | NM_0049 05.2_627 | 627 | GAACCAACCGGTTGCTTGCTGTCCCAGCGGCGCC<br>CCCTCATCACCGTCGCCATGCCCGGAGGTCTGCT<br>TCTCGGGGACGTGGCTCCCAACTTTGAGGCCAAT<br>ACCACCGTCGGCCGCATCCGTTTCCACGACTTTCT<br>GGGAGACTCATGGGGCATTCTCTTCTCCCACCCTC<br>GGGACTTTACCCCAGTGTGCACCACAGAGCTTGG<br>CAGAGCTGCAAAGCTGGCACCAGAATTTGCCAAG<br>AGGAATGTTAAGTTGATTGCCCTTTCAATAGACAG<br>TGTTGAGGACCATCTTGCCTGGAGCAAGGATATCA<br>ATGCTTACAATTGTGAAGAGCCCACAGAAAAGTTA<br>CCTTTTCCCATCATCGATGATAGGAATCGGGAGCT<br>TGCCATCCTGTTGGGCATGCTGGATCCAGCAGAG<br>AAGGATGAAAAGGGCATGCCTGTGACAGCTCGTG<br>TGGTGTTTGTTTTTGGTCCTGATAAGAAGCTGAAG<br>CTGTCTATCCTCTACCCAGCTACCACTGGCAGGAA<br>CTTTGATGAGATTCTCAGGGTAGTCATCTCTCTCC<br>AGCTGACAGCAGAAAAAAGGGTTGCCACCCCAGT<br>TGATTGGAAGGATGGGGATAGTGTGATGGTCCTTC<br>CAACATCCCTGAAGAAGAAGCCAAAAAACTTTTCC<br>CGAAAGGAGTCTTCACCAAAGAGCTCCCATCTGG<br>CAAGAAATACCTCCGCTACACACCCCAGCCTTAAG<br>TCTCTTGGAGAAGCTGGTGCTGTGAGCCAGAGGA<br>TGTCAGCTGCCAATTGTGTTTCCTGCAGCAATTC<br>CATAAACACATCCTGGTGTCATCACAGCCAAGGTT<br>TTTAGGTTGCTATACCAATGGCTTATTAAATGAAAA<br>TGGCACTAAAAGTTTCTTGAGATTCTTTATACTCTC<br>TGCCTTCAGCAATCAATTCCATTCATACATCAGCAC<br>TCTGCTGGTTCTGTTTGAAATATGTTCTGTATTTAA | 129 | SLKKKPKN<br>FSRKESSP<br>KSSHLARN<br>TSATHPSL<br>KSLGEAGA<br>VSQRMSA<br>ANCVFLQQ<br>FHKHILVSS<br>QPRFLGCY<br>TNGLLNEN<br>GTKSFLRF<br>FILSAFSNQ<br>FHSYISTLL<br>VLFEICSVF<br>KTQILLDLC<br>RACDQ* |

TABLE 3A-continued

| SEQ ID | identifier_position | position | modified_RNA | PAP length | PAP |
|---|---|---|---|---|---|
| 1401 | NM_0049 25.3_470 | 470 | AACTCAAATCTTGTTGGATCTCTGCAGGGCTTGTGACCAATGAAGTCATACTCGCTGCGCCACCGCCTCCCGCCACCCCTGCCCGCCCGACAGCGCCGCCGCCTGCCCCGCCATGGGTCGACAGAAGGAGCTGGTGTCCCGCTGCGGGGAGATGCTCCACATCCGCTACCGGCTGCTCCGACAGGCGCTGGCCGAGTGCCTGGGGACCCTCATCCTGGTGATGTTTGGCTGTGGCTCCGTGGCCCAGGTTGTGCTCAGCCGGGGCACCCACGGTGGTTTCCTCACCATCAACCTGGCCTTTGGCTTTGCTGTCACTCTGGGCATCCTCATCGCTGGCCAGGTCTCTGGGGCCCACCTGAACCCTGCCGTGACCTTTGCCATGTGCTTCCTGGCTCGTGAGCCCTGGATCAAGCTGCCCATCTACACCCTGGCACAGACGCTGGGAGCCTTCTTGGGTGCTGGAATAGTTTTTGGGCTGTATTATGATGCAATCTGGCACTTCGCCGACAACCAGCTTTTGTTTCGGGCCCCAATGGCACAGCCGGCATCTTTGCTACCTACCCCTCTGGACACTTGGATATGATCAATGGCTTCTTTGACCAGTTCATAGGCACAGCCTCCCTTATCGTGTGTGTGCTGGCCATTGTTGACCCCTACAACAACCCCGTCCCCCGAGGCCTGGAGGCCTTCACCGTGGGCCTGGTGGTCCTGGTCATTGGCACCTCCATGGGCTTCAACTCCGGCTATGCCGTCAACCCTGCCCGGGACTTTGGCCCCCGCCTTTTACAGCCCTTGCGGGCTGGGGCTCTGCAGTCTTCACGACCGGCCAGCATTGGTGGTGGGTGCCCATCGTGTCCCCACTCCTGGGCTCCATTGCGGGTGTCTTCGTGTACCAGCTGATGATCGGCTGCCACCTGGAGCAGCCCCACCCTCCAACGAGGAAGAGAATGTGAAGCTGGCCCATGTGAAGCACAAGGAGCAGATCTGAGTGGGCAGGGGCCATCTCCCACTCCGCTGCCCTGGCCTTGAGCATCCACTGACTGTCCAAGGGCCACTCCCAAGAAGCCCCCT | 21 | LFRAPMAQPASLLPTPLDTWI* |
| 1402 | NM_0049 27.2205 | 205 | GCACCGGCGAACCTGCCTGGGCAGGCAGCTCGCGCAGGACGGGGCGGGACCAGACAGTTGCGCGCACAGAAGGCTGGCGTAGCAGGTAAAGATGGCAGCTACCATGTTCCGGGCTACGCTGCGGGGATGGAGAACCGGTGTCCAGCGGGGCTGCGGGCTACGGCTGTTGAGCCAGACCCAGGGCCCTCCAGATTACCCCAGGTTGTGGAGTCTGTGGATGAATATCAGTTTGTGGAGCGCCTGTTACCGGCTACCAGGATCCCAGATCCCCCAAAGCATGAACATTATCCTACCCCTAGTGGCTGGCAGCCTCCCAGAGACCCCCCACCCAACCTGCCTTTACTTTGTACGACGCTCTCGGATGCACAACATCCCCGTCTACAAGGACATCACGCATGGCAACCGGCAGATGACTGTGATCCGGAAAGTGGAAGGGGACATCTGGGCCCTGCAGAAAGACGTGGAAGATTTTCTGAGCCCGCTGCTGGGGAAGACACCTGTCACCCAGGTCAATGAGGTGACAGGTACCCTACGGATCAAGGGCTACTTTGACCAGGAGCTTAAAGCCTGGCTCTTGGAGAAAGGCTTCTGAGGCCCAGCCGAGCAGCCTGCTTGTCAGCATGCCCTGTGGATCAAGTCTAGGGGGCCTCAGGAGGAGGGAGGTGGGTGTTGGAGCCCCTGAGACAGGGGATACAGAAACTAGGGCTAAAGGACTTTGGGGTCAGGCCTTGCTTGCATAAAGGAGAAAACAACTCTATGTACATGCTGGGGGAGAGTGCCTAATGTGGGAGACCAAATAGGGATCACCAGGCTAATGGGGGGCGTCAGCAGCTTTCTCTCCCTCCTATCTTGGCCTGTTCTTTTTTGTTTTTTGAGACGGAGTCTCACTCTGTTGCCCAGGGTGGAGTGCAGTGGCATGATCTTGGCTCACTGCAACTTCCACCTCTGGGATCAAGGGATTCTCCTGCCTCAGCCTCTTGAGTAGCTGGGATTACAGGCGCCCACCACCACAGCCTGCTAATTTT | 69 | LWSLWMNISLWSACYRLPGSQIPQSMNIILPLVAGSLPETPHPTCLTLYDALGCTTSPSTRTSRMATGR* |
| 1403 | NM_0049 90.2_135 | 135 | ATCAGCGAGGGATTCACGGCGAAATGAGACTGTTCGTGAGTGATGGCGTCCCGGGTTGCTTGCCGGTGCTGGCCGCCGCCGGGAGAGCCCGGGGCAGAGCAGAGGTGCTCATCAGCACTGTAGGCCCGGAAGATGTGTGGTCCCGTTCCTGACCCGGCCTAAGGTCCCTGTCTTGCAGCTGGATAGCGGCAACTACCTCTTCTCCACTAGTGCAATCTGCCGATATTTTTTTTGTTATCTGGCTGGGAGCAAGATGACCTCACTAACCAGTGGCTGGAATGGAAGCGACAGAGCTGCAGCCAGCTTTGTCTGCTGCCCTGTACTATTTAGTGGTCCAAGGCAAGAAGGGGGAAGATGTTCTTGGTTCAGTGCGGAGAGCCCTGACTCACATTGACCACAGCTTGAGTCGTCAGAACTGTCCTTTCCTGGCTGGGGAGACAGAATCTCTAGCCGACATTGTTTTGTGGGGAGCCCTATACCCATTACTGCAAGATCCCGCCTACCTCCCTGAGGA | 5 | VWSRS* |

TABLE 3A-continued

| SEQ ID | identifier_position | position | modified_RNA | PAP length | PAP |
|---|---|---|---|---|---|
| | | | GCTGAGTGCCCTGCACAGCTGGTTCCAGACACTG<br>AGTACCCAGGAACCATGTCAGCGAGCTGCAGAGA<br>CTGTACTGAAACAGCAAGGTGTCCTGGCTCTCCG<br>GCCTTACCTCCAAAAGCAGCCCCAGCCCAGCCCC<br>GCTGAGGGAAGGGCTGTCACCAATGAGCCTGAGG<br>AGGAGGAGCTGGCTACCCTATCTGAGGAGGAGAT<br>TGCTATGGCTGTTACTGCTTGGGAGAAGGGCCTA<br>GAAAGTTTGCCCCCGCTGCGGCCCCAGCAGAATC<br>CAGTGTTGCCTGTGGCTGGAGAAAGGAATGTGCT<br>CATCACCAGTGCCCTCCCTTACGTCAACAATGTCC<br>CCCACCTTGGGAACATCATTGGTTGTGTGCTCAGT<br>GCCGATGTCTTTGCCAGGTACTCTCGCCTCCGCCA<br>GTGGAACACCCTCTATCTGTGTGGGACAGATGAGT<br>ATGGTACAGCAACAGAGACCAAGGCTCTGGAGGA<br>GGGACTAACCCCCCAGGAGATCTGCGAC | | |
| 1404 | NM_0049<br>90.2_310 | 310 | ATCAGCGAGGGATTCACGGCGAAATGAGACTGTT<br>CGTGAGTGATGGCGTCCCGGGTTGCTTGCCGGTG<br>CTGGCCGCCGCCGGGAGAGCCCGGGGCAGAGCA<br>GAGGTGCTCATCAGCACTGTAGGCCCGGAAGATT<br>GTGTGGTCCCGTTCCTGACCCGGCCTAAGGTCCC<br>TGTCTTGCAGCTGGATAGCGGCAACTACCTCTTCT<br>CCACTAGTGCAATCTGCCGATATTTTTTTTGTTAT<br>CTGGCTGGGAGCAAGATGACCTCACTAACCAGTG<br>GCTGGAATGGGAAGCGACAGAGCTGCAGCCAGCT<br>TGTCTGCTGCCCTGTACTATTTAGTGGTCCAAGGC<br>AAGAAGGGGGAAGATGTTCTTGGTTCAGTGCGGA<br>GAGCCCTGACTCACATTGACCACAGCTTGAGTCGT<br>CAGAACTGTCCTTTCCTGGCTGGGGAGACAGAAT<br>CTCTAGCCGACATTGTTTGTGGGGAGCCCTATAC<br>CCATTACTGCAAGATCCCGCCTACCTCCCTGAGGA<br>GCTGAGTGCCCTGCACAGCTGGTTCCAGACACTG<br>AGTACCCAGGAACCATGTCAGCGAGCTGCAGAGA<br>CTGTACTGAAACAGCAAGGTGTCCTGGCTCTCCG<br>GCCTTACCTCCAAAAGCAGCCCCAGCCCAGCCCC<br>GCTGAGGGAAGGGCTGTCACCAATGAGCCTGAGG<br>AGGAGGAGCTGGCTACCCTATCTGAGGAGGAGAT<br>TGCTATGGCTGTTACTGCTTGGGAGAAGGGCCTA<br>GAAAGTTTGCCCCCGCTGCGGCCCCAGCAGAATC<br>CAGTGTTGCCTGTGGCTGGAGAAAGGAATGTGCT<br>CATCACCAGTGCCCTCCCTTACGTCAACAATGTCC<br>CCCACCTTGGGAACATCATTGGTTGTGTGCTCAGT<br>GCCGATGTCTTTGCCAGGTACTCTCGCCTCCGCCA<br>GTGGAACACCCTCTATCTGTGTGGGACAGATGAGT<br>ATGGTACAGCAACAGAGACCAAGGCTCTGGAGGA<br>GGGACTAACCCCCCAGGAGATCTGCGAC | 7 | CLLPCTI* |
| 1405 | NM_0049<br>90.2_466 | 466 | ATCAGCGAGGGATTCACGGCGAAATGAGACTGTT<br>CGTGAGTGATGGCGTCCCGGGTTGCTTGCCGGTG<br>CTGGCCGCCGCCGGGAGAGCCCGGGGCAGAGCA<br>GAGGTGCTCATCAGCACTGTAGGCCCGGAAGATT<br>GTGTGGTCCCGTTCCTGACCCGGCCTAAGGTCCC<br>TGTCTTGCAGCTGGATAGCGGCAACTACCTCTTCT<br>CCACTAGTGCAATCTGCCGATATTTTTTTTGTTAT<br>CTGGCTGGGAGCAAGATGACCTCACTAACCAGTG<br>GCTGGAATGGGAAGCGACAGAGCTGCAGCCAGCT<br>TTGTCTGCTGCCCTGTACTATTTAGTGGTCCAAGG<br>CAAGAAGGGGGAAGATGTTCTTGGTTCAGTGCGG<br>AGAGCCCTGACTCACATTGACCACAGCTTGAGTCG<br>TCAGAACTGTCCTTTCCTGGCTGGGGAGACAGAAT<br>CTCTAGCCGACATTGTTTGTGGGGAGCCCTATACC<br>CATTACTGCAAGATCCCGCCTACCTCCCTGAGGAG<br>CTGAGTGCCCTGCACAGCTGGTTCCAGACACTGA<br>GTACCCAGGAACCATGTCAGCGAGCTGCAGAGAC<br>TGTACTGAAACAGCAAGGTGTCCTGGCTCTCCGG<br>CCTTACCTCCAAAAGCAGCCCCAGCCCAGCCCCG<br>CTGAGGGAAGGGCTGTCACCAATGAGCCTGAGGA<br>GGAGGAGCTGGCTACCCTATCTGAGGAGGAGATT<br>GCTATGGCTGTTACTGCTTGGGAGAAGGGCCTAG<br>AAAGTTTGCCCCCGCTGCGGCCCCAGCAGAATCC<br>AGTGTTGCCTGTGGCTGGAGAAAGGAATGTGCTC<br>ATCACCAGTGCCCTCCCTTACGTCAACAATGTCCC<br>CCACCTTGGGAACATCATTGGTTGTGTGCTCAGTG<br>CCGATGTCTTTGCCAGGTACTCTCGCCTCCGCCAG<br>TGGAACACCCTCTATCTGTGTGGGACAGATGAGTA<br>TGGTACAGCAACAGAGACCAAGGCTCTGGAGGAG<br>GGACTAACCCCCCAGGAGATCTGCGAC | 18 | CGEPYTHY<br>CKIPPTSLR<br>S* |

TABLE 3A-continued

| SEQ ID | identifier_position | position | modified_RNA | PAP length | PAP |
|---|---|---|---|---|---|
| 1406 | NM_004990.2_503 | 503 | ATCAGCGAGGGATTCACGGCGAAATGAGACTGTT CGTGAGTGATGGCGTCCCGGGTTGCTTGCCGGTG CTGGCCGCCGCCGGGAGAGCCCGGGGCAGAGCA GAGGTGCTCATCAGCACTGTAGGCCCGGAAGATT GTGTGGTCCCGTTCCTGACCCGGCCTAAGGTCCC TGTCTTGCAGCTGGATAGCGGCAACTACCTCTTCT CCACTAGTGCAATCTGCCGATATTTTTTTTGTTAT CTGGCTGGGAGCAAGATGACCTCACTAACCAGTG GCTGGAATGGGAAGCGACAGAGCTGCAGCCAGCT TTGTCTGCTGCCCTGTACTATTTAGTGGTCCAAGG CAAGAAGGGGGAAGATGTTCTTGGTTCAGTGCGG AGAGCCCTGACTCACATTGACCACAGCTTGAGTCG TCAGAACTGTCCTTTCCTGGCTGGGGAGACAGAAT CTCTAGCCGACATTGTTTTGTGGGGAGCCCTATAC CCATTACTGCAAGATCCCGCTACCTCCCTGAGGAG CTGAGTGCCCTGCACAGCTGGTTCCAGACACTGA GTACCCAGGAACCATGTCAGCGAGCTGCAGAGAC TGTACTGAAACAGCAAGGTGTCCTGGCTCTCCGG CCTTACCTCCAAAAGCAGCCCCAGCCCAGCCCCG CTGAGGGAAGGGCTGTCACCAATGAGCCTGAGGA GGAGGAGCTGGCTACCCTATCTGAGGAGGAGATT GCTATGGCTGTTACTGCTTGGGAGAAGGGCCTAG AAAGTTTGCCCCCGCTGCGGCCCCAGCAGAATCC AGTGTTGCCTGTGGCTGGAGAAAGGAATGTGCTC ATCACCAGTGCCCTCCCTTACGTCAACAATGTCCC CCACCTTGGGAACATCATTGGTTGTGTGCTCAGTG CCGATGTCTTTGCCAGGTACTCTCGCCTCCGCCAG TGGAACACCCTCTATCTGTGTGGGACAGATGAGTA TGGTACAGCAACAGAGACCAAGGCTCTGGAGGAG GGACTAACCCCCAGGAGATCTGCGAC | 5 | TSLRS* |
| 1407 | NM_005000.2_189 | 189 | TGGAGCTAAGCTGTTTCCAGGGTGACAGAGTGGC GACCTCGGTGGTCGATTGAGCAGGTCTGAGAATT GTTCCCAAAGGGTTGTGCGTCACCGAGTCGTTGG CGCTGTCATGGCGGGTGTGCTGAAGAAGACCACT GGCCTTGTGGGATTGGCTGTGTGCAATACTCCTCA CGAGAGGCTAAGAATATGTACACAAAGATTCTTGA TGTTCTTGAGGAAATCCCTAAAAATGCAGCATATA GAAAGTATACAGAACAGATTACAAATGAGAAGCTG GCTATGGTTAAAGCGGAACCAGATGTTAAAAAATT AGAAGACCAACTTCAAGGCGGTCAATTAGAAGAG GTGATTCTTCAGGCTGAACATGAACTAAATCTGGC AAGAAAAATGAGGGAATGGAAACTATGGGAGCCAT TAGTGGAAGAGCCTCCTGCCGATCAGTGGAAATG GCCAATATAATTATTAAGTGACTTTGGTGTGTTCAT GGGAAACTGATGTAATTAAATATTCTGTTATATTAA GAGCGTGTTCTTATTACTGACATTTTGTAATCAAGA AAAGTGATATAGAAAATATGTAGGAGACTGTTAAAA TTGGTGATTATGGTAATATGGTCATGTGAATCAATT TTTGATTTATAAAGTACTCACACAAGTTGTTTCAAA GATGATATTTCTGTGAACAGAGAGGCCATGGGAAG ATTTGAAAATTATTAAAGAAAAAATTCCTACAGATTTT CAATGCAGAGACCATAATCAAAAAGTAAACTTTCTT TAGTAGTATGTTCAATACATCATTTAATTTTTTAAGT TATCCTGAAGAAGGAAAGGTCCTTAATTATTATAGT CTAAACAAATTTATAGATTACTGTTTGAAGTAAATA ATACGAGTGAATATTTTCAAATGTGATAAAATAGCA CAAGTGGCTGGTGATAAAATTTGAAATTATGGTTAA CCTCAGCTGTGATCTTATGTATGTAAAGTGAAATTT AAATAGATAATTATAGGTTGATTACAAAATCCAT | 41 | CTQRFLMF LRKSLKMQ HIESIQNRL QMRSWLW LKRNQMLK N* |
| 1408 | NM_005000.2_453 | 453 | TGGAGCTAAGCTGTTTCCAGGGTGACAGAGTGGC GACCTCGGTGGTCGATTGAGCAGGTCTGAGAATT GTTCCCAAAGGGTTGTGCGTCACCGAGTCGTTGG CGCTGTCATGGCGGGTGTGCTGAAGAAGACCACT GGCCTTGTGGGATTGGCTGTGTGCAATACTCCTCA CGAGAGGCTAAGAATATTGTACACAAAGATTCTTG ATGTTCTTGAGGAAATCCCTAAAAATGCAGCATATA GAAAGTATACAGAACAGATTACAAATGAGAAGCTG GCTATGGTTAAAGCGGAACCAGATGTTAAAAAATT AGAAGACCAACTTCAAGGCGGTCAATTAGAAGAG GTGATTCTTCAGGCTGAACATGAACTAAATCTGGC AAGAAAAATGAGGGAATGGAAACTATGGGAGCCAT TAGTGGAAGAGCCTCCTGCCGATCAGTGGAAATG GCAATATAATTATTAAGTGACTTTGGTGTGTTCATG GGAAACTGATGTAATTAAATATTCTGTTATATTAAG AGCGTGTTCTTATTACTGACATTTTGTAATCAAGAA AAGTGATATAGAAAATATGTAGGAGACTGTTAAAAT TGGTGATTATGGTAATATGGTCATGTGAATCAATTT | 4 | QYNY* |

TABLE 3A-continued

| SEQ ID | identifier_position | position | modified_RNA | PAP length | PAP |
|---|---|---|---|---|---|
| | | | TTGATTTATAAAGTACTCACACAAGTTGTTTCAAAG ATGATATTTCTGTGAACAGAGAGGCCATGGGAAGA TTTGAAAATTATTAAAGAAAAATTCCTACAGATTTTC AATGCAGAGACCATAATCAAAAAGTAAACTTTCTTT AGTAGTATGTTCAATACATCATTTAATTTTTTAAGTT ATCCTGAAGAAGGAAAGGTCCTTAATTATTATAGTC TAAACAAATTTATAGATTACTGTTTGAAGTAAATAAT ACGAGTGAATATTTTCAAATGTGATAAAATAGCACA AGTGGCTGGTGATAAAATTTGAAATTATGGTTAAC CTCAGCTGTGATCTTATGTATGTAAAGTGAAATTTA AATAGATAATTATAGGTTGATTACAAAATCCAT | | |
| 1409 | NM_0050 02.3_187 | 187 | GTGGGAAAAGATGGCGGCTGCCGCACAATCCCGG GTTGTCCGGGTCCTGTCAATGTCACGTTCTGCCAT TACTGCAATAGCCACATCTGTGTGTCACGGCCCAC CCTGTCGCCAGCTTCATCATGCCCTCATGCCTCAT GGGAAAGGTGGACGTTCCTCAGTCAGTGGGATTG TGGCCACTGTGTTGGAGCAACAGGATTCCTGGGG CGATATGTTGTCAACCACCTTGGACGCATGGGGTC ACAGGTAATCATACCCTATCGGTGTGATAAATATG ACATCATGCACCTTCGTCCCATGGGTGACCTGGG CCAGCTTCTGTTTCTGGAATGGGACGCGAGAGATA AAGATTCTATCCGACGAGTAGTACAACACAGCAAT GTGGTCATCAATCTTATTGGACGAGACTGGGAAAC CAAAAACTTTGATTTTGAGGATGTTTTTGTGAAGAT TCCCCAAGCAATTGCTCAACTGTCCAAGGAAGCTG GAGTTGAAAAATTCATTCATGTTTCACATCTGAATG CGAATATTAAAAGCTCTTCTAGATATTTGAGAAATA AGGCTGTTGGAGAGAAAGTAGTGAGAGATGCATTT CCGGAAGCCATTATCGTAAAGCCGTCGGACATCTT TGGAAGAGAGGATAGATTCCTTAATTCTTTTGCAA GTATGCATCGGTTTGGTCCTATACCCCTTGGTTCC TTGGGCTGGAAGACAGTTAAACAACCAGTATATGT CGTAGATGTATCCAAAGGAATTGTTAATGCAGTTA AGGATCCTGATGCCAATGGGAAATCCTTTGCTTTC GTTGGTCCCAGTCGGTACCTCCTTTTCCACCTGGT GAAGTACATCTTTGCTGTGGCTCACAGATTGTTCC TCCCATTCCCCTTGCCGCTTTTTGCCTATCGATGG GTAGCAAGAGTCTTTGAAATAAGCCCATTTGAGCC CTGGATAACAAGGGATAAAGTGGAGCGGATGCAC ATCACAGACATGAAATTGCCTCACCTGCCTGGCTT AGAAGACCTTG | 21 | LEQQDSW GDMLSTTL DAWGHR* |
| 1410 | NM_0050 02.3_433 | 433 | GTGGGAAAAGATGGCGGCTGCCGCACAATCCCGG GTTGTCCGGGTCCTGTCAATGTCACGTTCTGCCAT TACTGCAATAGCCACATCTGTGTGTCACGGCCCAC CCTGTCGCCAGCTTCATCATGCCCTCATGCCTCAT GGGAAAGGTGGACGTTCCTCAGTCAGTGGGATTG TGGCCACTGTGTTGGAGCAACAGGATTCCTGGG GCGATATGTTGTCAACCACCTTGGACGCATGGGGT CACAGGTAATCATACCCTATCGGTGTGATAAATAT GACATCATGCACCTTCGTCCCATGGGTGACCTGG GCCAGCTTCTGTTTCTGGAATGGGACGCGAGAGA TAAAGATTCTATCCGACGAGTAGTACAACACAGCA ATGTGGTCATCAATCTTATTGGACGAGACTGGGAA ACCAAAAACTTTGATTTGAGGATGTTTTTGTGAAGA TTCCCCAAGCAATTGCTCAACTGTCCAAGGAAGCT GGAGTTGAAAAATTCATTCATGTTTCACATCTGAAT GCGAATATTAAAAGCTCTTCTAGATATTTGAGAAAT AAGGCTGTTGGAGAGAAAGTAGTGAGAGATGCATT TCCGGAAGCCATTATCGTAAAGCCGTCGGACATCT TTGGAAGAGAGGATAGATTCCTTAATTCTTTTGCAA GTATGCATCGGTTTGGTCCTATACCCCTTGGTTCC TTGGGCTGGAAGACAGTTAAACAACCAGTATATGT CGTAGATGTATCCAAAGGAATTGTTAATGCAGTTA AGGATCCTGATGCCAATGGGAAATCCTTTGCTTTC GTTGGTCCCAGTCGGTACCTCCTTTTCCACCTGGT GAAGTACATCTTTGCTGTGGCTCACAGATTGTTCC TCCCATTCCCCTTGCCGCTTTTTGCCTATCGATGG GTAGCAAGAGTCTTTGAAATAAGCCCATTTGAGCC CTGGATAACAAGGGATAAAGTGGAGCGGATGCAC ATCACAGACATGAAATTGCCTCACCTGCCTGGCTT AGAAGACCTTG | 5 | LRMFL* |
| 1411 | NM_0050 02.3_445 | 445 | GTGGGAAAAGATGGCGGCTGCCGCACAATCCCGG GTTGTCCGGGTCCTGTCAATGTCACGTTCTGCCAT TACTGCAATAGCCACATCTGTGTGTCACGGCCCAC CCTGTCGCCAGCTTCATCATGCCCTCATGCCTCAT GGGAAAGGTGGACGTTCCTCAGTCAGTGGGATTG TGGCCACTGTGTTGGAGCAACAGGATTCCTGGG | 1 | L* |

TABLE 3A-continued

| SEQ ID | identifier_ position | position | modified_RNA | PAP length | PAP |
|---|---|---|---|---|---|
| | | | GCGATATGTTGTCAACCACCTTGGACGCATGGGGT<br>CACAGGTAATCATACCCTATCGGTGTGATAAATAT<br>GACATCATGCACCTTCGTCCCATGGGTGACCTGG<br>GCCAGCTTCTGTTTCTGGAATGGGACGCGAGAGA<br>TAAAGATTCTATCCGACGAGTAGTACAACACAGCA<br>ATGTGGTCATCAATCTTATTGGACGAGACTGGGAA<br>ACCAAAAACTTTGATTTTGAGGATGTTTTGTGAAGA<br>TTCCCCAAGCAATTGCTCAACTGTCCAAGGAAGCT<br>GGAGTTGAAAAATTCATTCATGTTTCACATCTGAAT<br>GCGAATATTAAAAGCTCTTCTAGATATTTGAGAAAT<br>AAGGCTGTTGGAGAGAAAGTAGTGAGAGATGCATT<br>TCCGGAAGCCATTATCGTAAAGCCGTCGGACATCT<br>TTGGAAGAGAGGATAGATTCCTTAATTCTTTTGCAA<br>GTATGCATCGGTTTGGTCCTATACCCCTTGGTTCC<br>TTGGGCTGGAAGACAGTTAAACAACCAGTATATGT<br>CGTAGATGTATCCAAAGGAATTGTTAATGCAGTTA<br>AGGATCCTGATGCCAATGGGAAATCCTTTGCTTTC<br>GTTGGTCCCAGTCGGTACCTCCTTTTCCACCTGGT<br>GAAGTACATCTTTGCTGTGGCTCACAGATTGTTCC<br>TCCCATTCCCCTTGCCGCTTTTTGCCTATCGATGG<br>GTAGCAAGAGTCTTTGAAATAAGCCCATTTGAGCC<br>CTGGATAACAAGGGATAAAGTGGAGCGGATGCAC<br>ATCACAGACATGAAATTGCCTCACCTGCCTGGCTT<br>AGAAGACCTTG | | |
| 1412 | NM_0050 02.3_568 | 568 | GTGGGAAAAGATGGCGGCTGCCGCACAATCCCGG<br>GTTGTCCGGGTCCTGTCAATGTCACGTTCTGCCAT<br>TACTGCAATAGCCACATCTGTGTGTCACGGCCCAC<br>CCTGTCGCCAGCTTCATCATGCCCTCATGCCTCAT<br>GGGAAAGGTGGACGTTCCTCAGTCAGTGGGATTG<br>TGGCCACTGTGTTTGGAGCAACAGGATTCCTGGG<br>GCGATATGTTGTCAACCACCTTGGACGCATGGGGT<br>CACAGGTAATCATACCCTATCGGTGTGATAAATAT<br>GACATCATGCACCTTCGTCCCATGGGTGACCTGG<br>GCCAGCTTCTGTTTCTGGAATGGGACGCGAGAGA<br>TAAAGATTCTATCCGACGAGTAGTACAACACAGCA<br>ATGTGGTCATCAATCTTATTGGACGAGACTGGGAA<br>ACCAAAAACTTTGATTTTGAGGATGTTTTTGTGAAG<br>ATTCCCCAAGCAATTGCTCAACTGTCCAAGGAAGC<br>TGGAGTTGAAAAATTCATTCATGTTTCACATCTGAA<br>TGCGAATATTAAAAGCTCTTCTAGATATTTGAGAAA<br>TAAGGCTGTGGAGAGAAAGTAGTGAGAGATGCATT<br>TCCGGAAGCCATTATCGTAAAGCCGTCGGACATCT<br>TTGGAAGAGAGGATAGATTCCTTAATTCTTTTGCAA<br>GTATGCATCGGTTTGGTCCTATACCCCTTGGTTCC<br>TTGGGCTGGAAGACAGTTAAACAACCAGTATATGT<br>CGTAGATGTATCCAAAGGAATTGTTAATGCAGTTA<br>AGGATCCTGATGCCAATGGGAAATCCTTTGCTTTC<br>GTTGGTCCCAGTCGGTACCTCCTTTTCCACCTGGT<br>GAAGTACATCTTTGCTGTGGCTCACAGATTGTTCC<br>TCCCATTCCCCTTGCCGCTTTTTGCCTATCGATGG<br>GTAGCAAGAGTCTTTGAAATAAGCCCATTTGAGCC<br>CTGGATAACAAGGGATAAAGTGGAGCGGATGCAC<br>ATCACAGACATGAAATTGCCTCACCTGCCTGGCTT<br>AGAAGACCTTG | 3 | ERK* |
| 1413 | NM_0050 03.2_366 | 366 | GCGCAGTGCATCCTGGGTTGGCGTAGCCATGGCG<br>TCTCGTGTCCTTTCAGCCTATGTCAGCCGCCTGCC<br>CGCGGCCTTTGCGCCGCTGCCCCGGGTCCGGAT<br>GCTGGCCGTGGCCCGGCCTCTCAGCACCGCTCTC<br>TGCTCCGCGGGGACCCAGACGAGGCTCGGGACTT<br>TGCAGCCGGCCTTAGTGCTCGCGCAGGTTCCTGG<br>TAGAGTTACACAGTTGTGCCGCCAGTATAGCGACA<br>TGCCTCCTTTGACGTTAGAGGGCATCCAGGACCGT<br>GTTCTTTACGTATTGAAACTCTATGACAAGATTGAC<br>CCAGAGAAGCTTTCAGTAAATTCTCATTTTATGAAA<br>GACCTGGGCTTAGACAGTTGGACCAAGTGGAGAT<br>TATCATGGCCATGGAAGACGAATTTGGGTTTGAAA<br>TTCCTGATATAGATGCTGAAAAGTTAATGTGTCCAC<br>AAGAAATTGTAGATTACATTGCAGATAAGAAGGAT<br>GTATATGAATAAAGTATCAGACCCTTTGGCTTTGCT<br>GAGAGAGGACTCAGATGATAGTGACGAATGTCTG<br>GCAGTGAGGACACATTTTGGCATTCTTGCTGACTC<br>TGACAGAGTGATTCTGATGGACTTGTATTTAAATTG<br>TATGTGTTTTACTCTTTGAAAATAAATCTATAAAACC<br>AAAAAAAAAAAAAAAAAAAAAAAAAAAAAAAAAAA<br>AAAAAAAAAAAAAAAAAAAAAAAAAAAAAAAAAAA<br>AAAAAAAAAAAAAAAAAAAAAAAAAAAAAAAAAAA<br>AAAAAAAAAAAAAAAAAAAAAAAAAAAA | 20 | WTKWRLS WPWKTNL GLKFLI* |

TABLE 3A-continued

| SEQ ID | identifier_position | position | modified_RNA | PAP length | PAP |
|---|---|---|---|---|---|
| 1414 | NM_005003.2_76 | 76 | GCGCAGTGCATCCTGGGTTGGCGTAGCCATGGCGTCTCGTGTCCTTTCAGCCTATGTCAGCCGCCTGCCCGCGGCTTTGCGCCGCTGCCCCGGGTCCGGATGCTGGCCGTGGCCCGGCCTCTCAGCACCGCTCTCTGCTCCGCGGGGACCCAGACGAGGCTCGGGACTTTGCAGCCGGCCTTAGTGCTCGCGCAGGTTCCTGGTAGAGTTACACAGTTGTGCCGCCAGTATAGCGACATGCCTCCTTTGACGTTAGAGGGCATCCAGGACCGTGTTCTTTACGTATTGAAACTCTATGACAAGATTGACCCAGAGAAGCTTTCAGTAAATTCTCATTTTATGAAAGACCTGGGCTTAGACAGTTTGGACCAAGTGGAGATTATCATGGCCATGGAAGACGAATTTGGGTTTGAAATTCCTGATATAGATGCTGAAAAGTTAATGTGTCCACAAGAAATTGTAGATTACATTGCAGATAAGAAGGATGTATATGAATAAAGTATCAGACCCTTTGGCTTTGCTGAGAGAGGACTCAGATGATAGTGACGAATGTCTGGCAGTGAGGACACATTTTGGCATTCTTGCTGACTCTGACAGAGTGATTCTGATGGACTTGTATTTAAATTGTATGTGTTTTACTCTTTGAAAATAAATCTATAAAACCAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAA | 35 | LRRCPGSGCWPWPGLSAPLSAPRGPRRGSGLCSRP* |
| 1415 | NM_005005.2_619 | 619 | CCCTTCCGGCTGGCCCCGCTCAGTCACCCGCAGCAGGCGTGCAGTTTCCCGGCTCTCCGCGCGGCCGGGGAAGGTCAGCGCGCGTAATGGCGTTCTTGGCGTCGGGACCCTACCTGACCCATCAGCAAAAGGTGTTGCGGCTTTATAAGCGGGCGCTACGCCACCTCGAGTCGTGGTGCGTCCAGAGAGACAAATACCGATACTTTGCTTGTTTGATGAGAGCCCGGTTTGAAGAACATAAGAATGAAAAGGATATGGCGAAGGCCACCCAGCTGCTGAAGGAGGCCGAGGAAGAATTCTGGTACCGTCAGCATCCACAGCCATACATCTTCCCTGACTCTCCTGGGGGCACCTCCTATGAGAGATACGATTGCTACAAGGTCCCAGAATGGTGCTTAGATGACTGGCATCCTTCTGAGAAGGCAATGTATCCTGATTACTTTGCCAAGAGAGAACAGTGGAAGAAACTGCGGAGGGAAAGCTGGGAACGAGAGGTTAAGCAGCTGCAGGAGGAAACGCCACCTGGTGGTCCTTTAACTGAAGCTTTGCCCCCTGCCCGAAAGGAAGGTGATTTGCCCCCACTGTGGTGGTATATTGTGACCAGACCCCGGGAGCGGCCATGTAGAAAGAGAGAGACCTCATCTTTCATGCTTGCAAGTGAAATATGTTACAGAACATGCACTTGCCCTAATAAAAAAATCAGTGAAATGGTCTCTGGTAAAAAAAAAAAAAAAAAA | 37 | CRKRETSSFMLASEICYRTCTCPNKKSVKWSLVKKKKK |
| 1416 | NM_005022.2_199 | 199 | ACAGCGAGCGGAGCCGCGGTCCGGACGGCAGCGCGTGCCCCGAGCTCTCCGCCTCCCCCCGCCCGCCAGCCGAGGCAGCTCGAGCCCAGTCCGCGGCCCCAGCAGCAGCGCCGAGAGCAGCCCCAGTAGCAGCGCCATGGCCGGGTGGAACGCCTACATCGACAACCTCATGGCGGACGGGACCTGTCAGGACGCGGCATCGTGGGCTACAAGGACTCGCCCTCCGTCTGGGCCGCCGTCCCCGGGAAAACGTTCGTCAACATCACGCCAGCTGAGGTGGGTGTCCTGGTTGGCAAAGACCGGTCAAGTTTTTACGTGAATGGGCTGACACTTGGGGGCCAGAAATGTTCGGTGATCCGGGACTCACTGCTGCAGGATGGGGAATTTAGCATGGATCTTCGTACCAAGAGCACCGGTGGGGCCCCACCTTCAATGTCACTGTCACCAAGACTGACAAGACGCTAGTCCTGCTGATGGGCAAAGAAGGTGTCCACGGTGGTTTGATCAACAAGAAATGTTATGAAATGGCCTCCACCTTCGGCGTTCCCAGTACTGACCTCGTCTGTCCCTTCCCCTTCACCGCTCCCCACAGCTTTGCACCCCTTTCCTCCCCATACACACACAAACCATTTTATTTTTTGGGCCATTACCCCATACCCCTTATTGCTGCCAAAACCACATGGGCTGGGGGCCAGGGCTGGATGGACAGACACCTCCCCCTACCCATATCCCTCCCGTGTGTGGTTGGAAAACTTTTGTTTTTTGGGGTTTTTTTTTCTGAATAAAAAAGATTCTACTAACAAAAAAAAAAAAAAAAAAAAAAAAAAAAAAAAAAAAAAAA | 39 | SWATRTRPPSGPPSPGKRSSTSRQLRWVSWLAKTGQVFT* |
| 1417 | NM_005022.2_504 | 504 | ACAGCGAGCGGAGCCGCGGTCCGGACGGCAGCGCGTGCCCCGAGCTCTCCGCCTCCCCCCGCCCGCCAGCCGAGGCAGCTCGAGCCCAGTCCGCGGCCCCAGCAGCAGCGCCGAGAGCAGCCCCAGTAGCAGCGCCATGGCCGGGTGGAACGCCTACATCGACAACCTCATGGCGGACGGGACCTGTCAGGACGCGGCATCGTGGGCTACAAGGACTCGCCCTCCGTCTGGGCC | 0 | * |

TABLE 3A-continued

| SEQ ID | identifier_position | position | modified_RNA | PAP length | PAP |
|---|---|---|---|---|---|
| | | | GCCGTCCCCGGGAAAACGTTCGTCAACATCACGC<br>CAGCTGAGGTGGGTGTCCTGGTTGGCAAAGACCG<br>GTCAAGTTTTTACGTGAATGGGCTGACACTTGGGG<br>GCCAGAAATGTTCGGTGATCCGGGACTCACTGCT<br>GCAGGATGGGGAATTTAGCATGGATCTTCGTACCA<br>AGAGCACCGGTGGGGCCCCCACCTTCAATGTCAC<br>TGTCACCAAGACTGACAAGACGCTAGTCCTGCTGA<br>TGGGCAAAGAAGGTGTCCACGGTGGTTGATCAAC<br>AAGAAATGTTATGAAATGGCCTCCCACCTTCGGCG<br>TTCCCAGTACTGACCTCGTCTGTCCCTTCCCCTTC<br>ACCGCTCCCCACAGCTTTGCACCCCTTTCCTCCCC<br>ATACACACACAAACCATTTTATTTTTTGGGCCATTA<br>CCCCATACCCCTTATTGCTGCCAAAACCACATGGG<br>CTGGGGGCCAGGGCTGGATGGACAGACACCTCC<br>CCCTACCCATATCCCTCCCGTGTGTGGTTGGAAAA<br>CTTTTGTTTTTGGGGTTTTTTTTTTCTGAATAAAAA<br>AGATTCTACTAACAAAAAAAAAAAAAAAAAAAAAAA<br>AAAAAAAAAAAAAAAAAAAA | | |
| 1418 | NM_0050<br>22.2_532 | 532 | ACAGCGAGCGGAGCCGCGGTCCGGACGGCAGCG<br>CGTGCCCCGAGCTCTCCGCCTCCCCCCGCCCGCC<br>AGCCGAGGCAGCTCGAGCCCAGTCCGCGGCCCC<br>AGCAGCAGCGCCGAGAGCAGCCCCAGTAGCAGC<br>GCCATGGCCGGGTGGAACGCCTACATCGACAACC<br>TCATGGCGGACGGGACCTGTCAGGACGCGGCCAT<br>CGTGGGCTACAAGGACTCGCCCTCCGTCTGGGCC<br>GCCGTCCCCGGGAAAACGTTCGTCAACATCACGC<br>CAGCTGAGGTGGGTGTCCTGGTTGGCAAAGACCG<br>GTCAAGTTTTTACGTGAATGGGCTGACACTTGGGG<br>GCCAGAAATGTTCGGTGATCCGGGACTCACTGCT<br>GCAGGATGGGGAATTTAGCATGGATCTTCGTACCA<br>AGAGCACCGGTGGGGCCCCCACCTTCAATGTCAC<br>TGTCACCAAGACTGACAAGACGCTAGTCCTGCTGA<br>TGGGCAAAGAAGGTGTCCACGGTGGTTTGATCAA<br>CAAGAAATGTTATGAAATGGCTCCCACCTTCGGCG<br>TTCCCAGTACTGACCTCGTCTGTCCCTTCCCCTTC<br>ACCGCTCCCCACAGCTTTGCACCCCTTTCCTCCCC<br>ATACACACACAAACCATTTTATTTTTTGGGCCATTA<br>CCCCATACCCCTTATTGCTGCCAAAACCACATGGG<br>CTGGGGGCCAGGGCTGGATGGACAGACACCTCC<br>CCCTACCCATATCCCTCCCGTGTGTGGTTGGAAAA<br>CTTTTGTTTTTGGGGTTTTTTTTTTCTGAATAAAAA<br>AGATTCTACTAACAAAAAAAAAAAAAAAAAAAAAAA<br>AAAAAAAAAAAAAAAAAAAA | 83 | PTFGVPST<br>DLVCPFPF<br>TAPHSFAP<br>LSSPYTHK<br>PFYFLGHY<br>PIPLIAAKT<br>TWAGGQG<br>WMDRHLP<br>LPISLPCVV<br>GKLLFFGV<br>FFF* |
| 1419 | NM_0050<br>34.3_273 | 273 | GCACTGTGCGTCATGTACCAGCGCCGGAAGTTGG<br>TCTCGACACCTGGACTAGCCGGGTTGTATTTGGAA<br>ACGCGGAGTGAGTTTTTCCGTGCTGTGTAGGGGC<br>TAACAATGGACACCCAGAAGGACGTTCAACCTCCA<br>AAGCAGCAACCAATGATATATATCTGTGGAGAGTG<br>TCACACAGAAAATGAAATAAAATCTAGGGATCCAA<br>TCAGATGCAGAGAATGTGGATACAGAATAATGTAC<br>AAGAAAAGGACTAAAAGATTGGTCGTTTTGATGCT<br>CGATGAATGCTGGGAATTCAGAGGAATGTCTTCAC<br>TTATACTTGGATTTGCTCTCTTCCCATTTCTGATTG<br>TTGTATAGCTTTCGATTTTGCTTACAGTAGTTCCCC<br>CTTATCTTCGGGAGATACATTCCAAGGCCCCCAGT<br>GAACTCCTGAAACCTCAAACAGTACCAAACCTTTA<br>TACACTGTTTTTTCCATATATATATACCTATGATAAA<br>GTATAATGTATAAATTAAGCATAGCAAGAGATTAAT<br>AATAATGTAATAGAACAATGATAACATACTATAATA<br>AAAGTTATGTGAATGTGGTTGGTCTCTCTTGCTTTC<br>AAAATATCTTCTTGTACAGTACTCACCTATTTTAGA<br>ATGTGGTTGACTACAGGTAACCAAAACCACAGAAA<br>GGGAAACTTTGGATGAGGGGGGCACTACTGTACT<br>TAGGAATACAACTATATACATATGATTTTATTTTTAA<br>GACCATATTATATTTGGGTATCTACTAATATTTTGTA<br>TAAAGCAATTTTTTGTTCCATTACGTGACTTTTTGTT<br>TTATTGTATATGTAATTTAACACACAATAAAGGGTA<br>AAGTTGCTTCCCCAAACCACACTTTTAATCAAAACC<br>TAGAATCATCTGCAGTCCTTGTTAAAAATGCAGGTT<br>TCTAGAACCCTCTGAAGTTCTGATTAAATAAATTTA<br>TTGCAAACCA | 28 | LMLDECW<br>EFRGMSSL<br>ILGFALFPF<br>LIVV* |
| 1420 | NM_0050<br>53.2_360 | 360 | CCGGAAGTGGTCGGCGCGCGGCGCGGCGCGCCT<br>GGGCGCTAAGATGGCGGCGGCGTGAGTTGCATGT<br>TGTGTGAGGATCCCGGGGCCGCCGCGTCGCTCG<br>GGCCCCGCCATGGCCGTCACCATCACGCTCAAAA<br>CGCTGCAGCAGCAGACCTTCAAGATCCGCATGGA<br>GCCTGACGAGACGGTGAAGGTGCTAAAGGAGAAG | 73 | VPQHPQR<br>PHPQLPQS<br>PLHPSRLP<br>PPQACPIP<br>HLPPERTR<br>AHQRNPP |

TABLE 3A-continued

| SEQ ID | identifier_position | position | modified_RNA | PAP length | PAP |
|---|---|---|---|---|---|
| | | | ATAGAAGCTGAGAAGGGTCGTGATGCCTTCCCCG TGGCTGGACAGAAACTCATCTATGCCGGCAAGATC TTGAGTGACGATGTCCCTATCAGGGACTATCGCAT CGATGAGAAGAACTTTGTGGTCGTCATGGTGACCA AGACCAAAGCCGGCCAGGTACCTCAGCACCCCCA GAGGCCTCACCCACAGCTGCCCCAGAGTCCTCTA CATCCTTCCCGCCTGCCCCCACCTCAGGCATGTC CCATCCCCCACCTGCCGCCAGAGAGGACAAGAGC CCATCAGAGGAATCCGCCCCCACGACGTCCCCAG AGTCTGTGTCAGGCTCTGTTCCCTCTTCAGGTAGC AGCGGGCGAGAGGAAGACGCGGCCTCCACGCTA GTGACGGGCTCTGAGTATGAGACGATGCTGACGG AGATCATGTCCATGGGCTATGAGCGAGAGCGGGT CGTGGCCGCCCTGAGAGCCAGCTACAACAACCCC CACCGAGCCGTGGAGTATCTGCTCACGGGAATTC CTGGGAGCCCCGAGCCGGAACACGGTTCTGTCCA GGAGAGCCAGGTATCGGAGCAGCCGGCCACGGA AGCAGCAGGAGAGAACCCCCTGGAGTTCCTGCGG GACCAGCCCCAGTTCCAGAACATGCGGCAGGTGA TTCAGCAGAACCCTGCGCTGCTGCCCGCCCTGCT CCAGCAGCTGGGCCAGGAGAACCCTCAGCTTTTA CAGCAAATCAGCCGGCACCAGGAGCAGTTCATCC AGATGCTGAACGAGCCCCCTGGGGAGCTGGCGG ACATCTCAGATGTGGAGGGGGAGGTGGGCGCCAT AGGAG | | PRRPQSLC QALFPLQV AAGERKTR PPR* |
| 1421 | NM_0050 53.2_571 | 571 | CCGGAAGTGGTCGGCGCGCGGCGCGGCGCGCCT GGGCGCTAAGATGGCGGCGGCGTGAGTTGCATGT TGTGTGAGGATCCCGGGGCCGCCGCGTCGCTCG GGCCCCGCCATGGCCGTCACCATCACGCTCAAAA CGCTGCAGCAGCAGACCTTCAAGATCCGCATGGA GCCTGACGAGACGGTGAAGGTGCTAAAGGAGAAG ATAGAAGCTGAGAAGGGTCGTGATGCCTTCCCCG TGGCTGGACAGAAACTCATCTATGCCGGCAAGATC TTGAGTGACGATGTCCCTATCAGGGACTATCGCAT CGATGAGAAGAACTTTGTGGTCGTCATGGTGACCA AGACCAAAGCCGGCCAGGGTACCTCAGCACCCCC AGAGGCCTCACCCACAGCTGCCCCAGAGTCCTCT ACATCCTTCCCGCCTGCCCCCACCTCAGGCATGTC CCATCCCCCACCTGCCGCCAGAGAGGACAAGAGC CCATCAGAGGAATCCGCCCCCACGACGTCCCCAG AGTCTGTGTCAGGCTCTGTTCCCTCTTCAGGTAGC AGCGGGCGAGAGGAAGACGCGGCTCCACGCTAG TGACGGGCTCTGAGTATGAGACGATGCTGACGGA GATCATGTCCATGGGCTATGAGCGAGAGCGGGTC GTGGCCGCCCTGAGAGCCAGCTACAACAACCCCC ACCGAGCCGTGGAGTATCTGCTCACGGGAATTCC TGGGAGCCCCGAGCCGGAACACGGTTCTGTCCAG GAGAGCCAGGTATCGGAGCAGCCGGCCACGGAA GCAGCAGGAGAGAACCCCCTGGAGTTCCTGCGGG ACCAGCCCCAGTTCCAGAACATGCGGCAGGTGAT TCAGCAGAACCCTGCGCTGCTGCCCGCCCTGCTC CAGCAGCTGGGCCAGGAGAACCCTCAGCTTTTAC AGCAAATCAGCCGGCACCAGGAGCAGTTCATCCA GATGCTGAACGAGCCCCCTGGGGAGCTGGCGGA CATCTCAGATGTGGAGGGGGAGGTGGGCGCCATA GGAG | 2 | PR* |
| 1422 | NM_0051 47.3_173 | 173 | GATGGCTGCGCGGTGCTCCACACGCTGGTTGCTG GTGGTTGTGGGGACCCCGCGGCTGCCGGCTATAT CGGGTAGAGGGGCCCGGCCGCCCAGGGAGGGC GTGGTGGGGGCATGGCTGAGCCGCAAGCTGAGC GTCCCCGCCTTTGCGTCTTCCCTGACCTCTTGCGG CCCCGAGCGCTGCTGACATTGAGACCTGGTGTCA GCCTCACAGGAACAAAACATTACCCTTTCATTTGTA CTGCCTCCTTCCACACGAGTGCCCCTTTGGCCAAA GAAGATTATTATCAGATATTAGGAGTGCCTCGAAA TGCCAGCCAGAAAGAGATCAAGAAAGCCTATTATC AGCTTGCCAAGAAGTATCACCCTGACACAAATAAG GATGATCCCAAAGCCAAGGAGAAGTTCTCCCAGCT GGCAGAAGCCTATGAGGTTTTGAGTGATGAGGTG AAGAGGAAGCAGTACGATGCCTACGGCTCTGCAG GCTTCGATCCTGGGGCCAGCGGCTCCCAGCATAG CTACTGGAAGGGAGGCCCCACTGTGGACCCCGAG GAGCTGTTCAGGAAGATCTTTGGCGAGTTCTCATC CTCTTCATTTGGAGATTTCCAGACCGTGTTTGATCA GCCTCAGGAATACTTCATGGAGTTGACATTCAATC AAGCTGCAAAGGGGGTCAACAAGGAGTTCACCGT GAACATCATGGACACGTGTGAGCGCTGCAACGGC | 3 | ERC* |

TABLE 3A-continued

| SEQ ID | identifier_position | position | modified_RNA | PAP length | PAP |
|---|---|---|---|---|---|
| | | | AAGGGGAACGAGCCCGGCACCAAGGTGCAGCATT<br>GCCACTACTGTGGCGGCTCCGGCATGGAAACCAT<br>CAACACAGGCCCTTTTGTGATGCGTTCCACGTGTA<br>GGAGATGTGGTGGCCGCGGCTCCATCATCATATC<br>GCCCTGTGTGGTCTGCAGGGGAGCAGGACAAGCC<br>AAGCAGAAAAAGCGAGTGATGATCCCTGTGCCTG<br>CAGGAGTCGAGGATGGCCAGACCGTGAGGATGCC<br>TGTGGGAAAAAGGGAAATTTTCATTACGTTCAGGG<br>TGCAGAAAAGCCCTGTGTTCCGGAGGG | | |
| 1423 | NM_0051 76.5_325 | 325 | CCACGTTACGGATCGGCTTACTCCGCGGAGTTGG<br>CCTCATTTCTGCAGTCGGCGCTCCCTGTAGTTTCT<br>CCTCTCGAACGCCAGGTGGAGCAACCGGCCGGAT<br>ACCGCCACAGCCCTGGCAGGCGGCGCTGTGATG<br>CCTGAGCTGATCCTGTATGTTGCAATCACTCTATC<br>CGTGGCTGAGCGACTCGTTGGCCCGGGTCACGCA<br>TGCGCTGAGCCTTCCTTTCGCTCTTCCCGCTGCTC<br>CGCCCCTCTCTGTCTTCTCTGCAGTGGGAGCAGCT<br>CTCCTGCCACAGCTCCTCACCCCCTGAAAATGTTC<br>GCCTGCTCCAAGTTGTCTCCACTCCCTCCTTGGTC<br>AAGAGCACCTCACAGCTGCTGAGCCGTCCGCTAT<br>CTGCAGTGGTGCTGAAACGACCGGAGATACTGAC<br>AGATGAGAGCCTCAGCAGCTTGGCAGTCTCATGT<br>CCCCTTACCTCACTTGTCTCTAGCCGCAGCTTCCA<br>AACCAGCGCCATTTCAAGGGACATCGACACAGCA<br>GCCAAGTTCATTGGAGCTGGGGCTGCCACAGTTG<br>GGGTGGCTGGTTCTGGGGCTGGGATTGGAACTGT<br>GTTTGGGAGCCTCATCATTGGTTATGCCAGGAACC<br>CTTCTCTGAAGCAACAGCTCTTCTCCTACGCCATT<br>CTGGGCTTTGCCCTCTCGGAGGCCATGGGGCTCT<br>TTTGTCTGATGGTAGCCTTTCTCATCCTCTTTGCCA<br>TGTGAAGGAGCCGTCTCCACCTCCCATAGTTCTCC<br>CGCGTCTGGTTGGCCCCGTGTGTTCCTTTTCCTAT<br>ACCTCCCCAGGCAGCCTGGGGAACGTGGTTGGCT<br>CAGGGTTTGACAGAGAAAAGACAAATAAATACTGT<br>ATTAATAAGATGTTTCTTGAAAAAAAAAAAAAAAA | 14 | LSPLPPWS RAPHSC* |
| 1424 | NM_0051 76.5_589 | 589 | CCACGTTACGGATCGGCTTACTCCGCGGAGTTGG<br>CCTCATTTCTGCAGTCGGCGCTCCCTGTAGTTTCT<br>CCTCTCGAACGCCAGGTGGAGCAACCGGCCGGAT<br>ACCGCCACAGCCCTGGCAGGCGGCGCTGTGATG<br>CCTGAGCTGATCCTGTATGTTGCAATCACTCTATC<br>CGTGGCTGAGCGACTCGTTGGCCCGGGTCACGCA<br>TGCGCTGAGCCTTCCTTTCGCTCTTCCCGCTGCTC<br>CGCCCCTCTCTGTCTTCTCTGCAGTGGGAGCAGCT<br>CTCCTGCCACAGCTCCTCACCCCCTGAAAATGTTC<br>GCCTGCTCCAAGTTTGTCTCCACTCCCTCCTTGGT<br>CAAGAGCACCTCACAGCTGCTGAGCCGTCCGCTA<br>TCTGCAGTGGTGCTGAAACGACCGGAGATACTGA<br>CAGATGAGAGCCTCAGCAGCTTGGCAGTCTCATG<br>TCCCCTTACCTCACTTGTCTCTAGCCGCAGCTTCC<br>AAACCAGCGCCATTTCAAGGGACATCGACACAGC<br>AGCCAAGTTCATTGGAGCTGGGGCTGCCACAGTT<br>GGGGTGGCTGGTTCTGGGGCTGGGATTGGAACTG<br>TGTTTGGGAGCCTCATCATTGGTTATGCCAGGAACC<br>CTTCTCTGAAGCAACAGCTCTTCTCCTACGCCATT<br>CTGGGCTTTGCCCTCTCGGAGGCCATGGGGCTCT<br>TTTGTCTGATGGTAGCCTTTCTCATCCTCTTTGCCA<br>TGTGAAGGAGCCGTCTCCACCTCCCATAGTTCTCC<br>CGCGTCTGGTTGGCCCCGTGTGTTCCTTTTCCTAT<br>ACCTCCCCAGGCAGCCTGGGGAACGTGGTTGGCT<br>CAGGGTTTGACAGAGAAAAGACAAATAAATACTGT<br>ATTAATAAGATGTTTCTTGAAAAAAAAAAAAAAAA | 13 | LGASSLVM PGTLL* |
| 1425 | NM_0051 76.5_692 | 692 | CCACGTTACGGATCGGCTTACTCCGCGGAGTTGG<br>CCTCATTTCTGCAGTCGGCGCTCCCTGTAGTTTCT<br>CCTCTCGAACGCCAGGTGGAGCAACCGGCCGGAT<br>ACCGCCACAGCCCTGGCAGGCGGCGCTGTGATG<br>CCTGAGCTGATCCTGTATGTTGCAATCACTCTATC<br>CGTGGCTGAGCGACTCGTTGGCCCGGGTCACGCA<br>TGCGCTGAGCCTTCCTTTCGCTCTTCCCGCTGCTC<br>CGCCCCTCTCTGTCTTCTCTGCAGTGGGAGCAGCT<br>CTCCTGCCACAGCTCCTCACCCCCTGAAAATGTTC<br>GCCTGCTCCAAGTTTGTCTCCACTCCCTCCTTGGT<br>CAAGAGCACCTCACAGCTGCTGAGCCGTCCGCTA<br>TCTGCAGTGGTGCTGAAACGACCGGAGATACTGA<br>CAGATGAGAGCCTCAGCAGCTTGGCAGTCTCATG<br>TCCCCTTACCTCACTTGTCTCTAGCCGCAGCTTCC<br>AAACCAGCGCCATTTCAAGGGACATCGACACAGC<br>AGCCAAGTTCATTGGAGCTGGGGCTGCCACAGTT | 1 | V* |

TABLE 3A-continued

| SEQ ID | identifier_position | position | modified_RNA | PAP length | PAP |
|---|---|---|---|---|---|
| | | | GGGGTGGCTGGTTCTGGGGCTGGGATTGGAACTG<br>TGTTTGGGAGCCTCATCATTGGTTATGCCAGGAAC<br>CCTTCTCTGAAGCAACAGCTCTTCTCCTACGCCAT<br>TCTGGGCTTTGCCCTCTCGGAGGCCATGGGGCTC<br>TTTGTCTGATGGTAGCCTTTCTCATCCTCTTTGCCA<br>TGTGAAGGAGCCGTCTCCACCTCCCATAGTTCTCC<br>CGCGTCTGGTTGGCCCCGTGTGTTCCTTTTCCTAT<br>ACCTCCCCAGGCAGCCTGGGGAACGTGGTTGGCT<br>CAGGGTTTGACAGAGAAAAGACAAATAAATACTGT<br>ATTAATAAGATGTTTCTTGAAAAAAAAAAAAAAAA | | |
| 1426 | NM_0052<br>16.4_264 | 26<br>4 | AATCCACCTCCCACCAGGGCACTTCCGGCGGCGC<br>TCTCCGCGCCTTATCGCCAAAGCTGCGGCTCTGG<br>ACGCCCAGCCGCGGCGTATCCCGATCACTTCCGG<br>GTAGTGCTCCACGGGCACGAGCCGCGATTGGGCT<br>ACCGTAGATGGGGTACTTCCGGTGTGCAGGTGCT<br>GGGTCCTTCGGCAGGAGGAGGAAGATGGAGCCC<br>AGCACCGCGGCCCGGGCTTGGGCCCTCTTTTGGT<br>TGCTGCTGCCCTTGCTTGGCGCGGTTGCGCCAGC<br>GGACCCCGCACCTTAGTGCTGCTGGACAACCTCA<br>ACGTGCGGGAGACTCATTCGCTTTTCTTCCGGAGC<br>CTGAAGGACCGGGGCTTTGAGCTCACATTCAAGA<br>CCGCTGATGACCCCAGCCTGTCTCTCATAAAGTAT<br>GGGGAATTCCTCTATGACAATCTCATCATTTTCTCC<br>CCTTCGGTAGAAGATTTTGGAGGCAACATCAACGT<br>GGAGACCATCAGTGCCTTTATTGACGGCGGAGGC<br>AGTGTGCTGGTAGCTGCCAGCTCCGACATTGGTG<br>ACCCTCTTCGAGAGCTGGGCAGTGAGTGCGGGAT<br>TGAGTTTGACGAGGAGAAAACGGCTGTCATTGACC<br>ATCACAACTATGACATCTCAGACCTTGGCCAGCAT<br>ACGCTCATCGTGGCTGACACTGAGAACCTGCTGA<br>AGGCCCCAACCATCGTTGGGAAATCATCTCTAAAT<br>CCCATCCTCTTTCGAGGTGTTGGGATGGTGGCCG<br>ATCCTGATAACCCTTTGGTGCTGGACATCCTGACG<br>GGCTCTTCCACCTCTTACTCCTTCTTCCCGGACAA<br>GCCTATCACCCAGTATCCACATGCGGTGGGGAAG<br>AACACCCTCCTCATTGCTGGGCTCCAGGCCAGGA<br>ACAATGCCCGCGTCATCTTCAGCGGCTCCCTCGA<br>CTTCTTCAGCGACTCCTTCTTCAACTCAGCAGTGC<br>AGAAGGCGGCGCCCGGCTCCCAGAGGTATTCCCA<br>GACAGGCAACTATGAACTAGCTGTGGCC | 7 | APADPAP* |
| 1427 | NM_0052<br>16.4_464 | 464 | AATCCACCTCCCACCAGGGCACTTCCGGCGGCGC<br>TCTCCGCGCCTTATCGCCAAAGCTGCGGCTCTGG<br>ACGCCCAGCCGCGGCGTATCCCGATCACTTCCGG<br>GTAGTGCTCCACGGGCACGAGCCGCGATTGGGCT<br>ACCGTAGATGGGGTACTTCCGGTGTGCAGGTGCT<br>GGGTCCTTCGGCAGGAGGAGGAAGATGGAGCCC<br>AGCACCGCGGCCCGGGCTTGGGCCCTCTTTTGGT<br>TGCTGCTGCCCTTGCTTGGCGCGGTTTGCGCCAG<br>CGGACCCCGCACCTTAGTGCTGCTGGACAACCTC<br>AACGTGCGGGAGACTCATTCGCTTTTCTTCCGGAG<br>CCTGAAGGACCGGGGCTTTGAGCTCACATTCAAG<br>ACCGCTGATGACCCCAGCCTGTCTCTCATAAAGTA<br>TGGGGAATTCCTCTATGACAATCTCATCATTTTCTC<br>CCCTTCGGTAGAAGATTTGGAGGCAACATCAACGT<br>GGAGACCATCAGTGCCTTTATTGACGGCGGAGGC<br>AGTGTGCTGGTAGCTGCCAGCTCCGACATTGGTG<br>ACCCTCTTCGAGAGCTGGGCAGTGAGTGCGGGAT<br>TGAGTTTGACGAGGAGAAAACGGCTGTCATTGACC<br>ATCACAACTATGACATCTCAGACCTTGGCCAGCAT<br>ACGCTCATCGTGGCTGACACTGAGAACCTGCTGA<br>AGGCCCCAACCATCGTTGGGAAATCATCTCTAAAT<br>CCCATCCTCTTTCGAGGTGTTGGGATGGTGGCCG<br>ATCCTGATAACCCTTTGGTGCTGGACATCCTGACG<br>GGCTCTTCCACCTCTTACTCCTTCTTCCCGGACAA<br>GCCTATCACCCAGTATCCACATGCGGTGGGGAAG<br>AACACCCTCCTCATTGCTGGGCTCCAGGCCAGGA<br>ACAATGCCCGCGTCATCTTCAGCGGCTCCCTCGA<br>CTTCTTCAGCGACTCCTTCTTCAACTCAGCAGTGC<br>AGAAGGCGGCGCCCGGCTCCCAGAGGTATTCCCA<br>GACAGGCAACTATGAACTAGCTGTGGCC | 21 | LEATSTWR<br>PSVPLLTA<br>EAVCW* |
| 1428 | NM_0052<br>16.4_590 | 590 | AATCCACCTCCCACCAGGGCACTTCCGGCGGCGC<br>TCTCCGCGCCTTATCGCCAAAGCTGCGGCTCTGG<br>ACGCCCAGCCGCGGCGTATCCCGATCACTTCCGG<br>GTAGTGCTCCACGGGCACGAGCCGCGATTGGGCT<br>ACCGTAGATGGGGTACTTCCGGTGTGCAGGTGCT<br>GGGTCCTTCGGCAGGAGGAGGAAGATGGAGCCC<br>AGCACCGCGGCCCGGGCTTGGGCCCTCTTTTGGT | 32 | LTRRKRLS<br>LTITTMTSQ<br>TLASIRSS<br>WLTLRTC* |

TABLE 3A-continued

| SEQ ID | identifier_position | position | modified_RNA | PAP length | PAP |
|---|---|---|---|---|---|
| | | | TGCTGCTGCCCTTGCTTGGCGCGGTTTGCGCCAG CGGACCCCGCACCTTAGTGCTGCTGGACAACCTC AACGTGCGGGAGACTCATTCGCTTTTCTTCCGGAG CCTGAAGGACCGGGGCTTTGAGCTCACATTCAAG ACCGCTGATGACCCCAGCCTGTCTCTCATAAAGTA TGGGGAATTCCTCTATGACAATCTCATCATTTTCTC CCCTTCGGTAGAAGATTTTGGAGGCAACATCAACG TGGAGACCATCAGTGCCTTTATTGACGGCGGAGG CAGTGTGCTGGTAGCTGCCAGCTCCGACATTGGT GACCCTCTTCGAGAGCTGGGCAGTGAGTGCGGGA TTGAGTTGACGAGGAGAAAACGGCTGTCATTGACC ATCACAACTATGACATCTCAGACCTTGGCCAGCAT ACGCTCATCGTGGCTGACACTGAGAACCTGCTGA AGGCCCCAACCATCGTTGGGAAATCATCTCTAAAT CCCATCCTCTTTCGAGGTGTTGGGATGGTGGCCG ATCCTGATAACCCTTTGGTGCTGGACATCCTGACG GGCTCTTCCACCTCTTACTCCTTCTTCCCGGACAA GCCTATCACCCAGTATCCACATGCGGTGGGGAAG AACACCCTCCTCATTGCTGGGCTCCAGGCCAGGA ACAATGCCCGCGTCATCTTCAGCGGCTCCCTCGA CTTCTTCAGCGACTCCTTCTTCAACTCAGCAGTGC AGAAGGCGGCGCCCGGCTCCCAGAGGTATTCCCA GACAGGCAACTATGAACTAGCTGTGGCC | | |
| 1429 | NM_0052 16.4_743 | 743 | AATCCACCTCCCACCAGGGCACTTCCGGCGGCGC TCTCCGCGCCTTATCGCCAAAGCTGCGGCTCTGG ACGCCCAGCCGCGGCGTATCCCGATCACTTCCGG GTAGTGCTCCACGGGCACGAGCCGCGATTGGGCT ACCGTAGATGGGGTACTTCCGGTGTGCAGGTGCT GGGTCCTTCGGCAGGAGGAGGAAGATGGAGCCC AGCACCGCGGCCCGGGCTTGGGCCCTCTTTTGGT TGCTGCTGCCCTTGCTTGGCGCGGTTTGCGCCAG CGGACCCCGCACCTTAGTGCTGCTGGACAACCTC AACGTGCGGGAGACTCATTCGCTTTTCTTCCGGAG CCTGAAGGACCGGGGCTTTGAGCTCACATTCAAG ACCGCTGATGACCCCAGCCTGTCTCTCATAAAGTA TGGGGAATTCCTCTATGACAATCTCATCATTTTCTC CCCTTCGGTAGAAGATTTTGGAGGCAACATCAACG TGGAGACCATCAGTGCCTTTATTGACGGCGGAGG CAGTGTGCTGGTAGCTGCCAGCTCCGACATTGGT GACCCTCTTCGAGAGCTGGGCAGTGAGTGCGGGA TTGAGTTTGACGAGGAGAAAACGGCTGTCATTGAC CATCACAACTATGACATCTCAGACCTTGGCCAGCA TACGCTCATCGTGGCTGACACTGAGAACCTGCTGA AGGCCCCAACCATCGTTGGGAAATCATCTCTAAAT CCCATCCTCTTTCGAGGTGTGGGATGGTGGCCGA TCCTGATAACCCTTTGGTGCTGGACATCCTGACGG GCTCTTCCACCTCTTACTCCTTCTTCCCGGACAAG CCTATCACCCAGTATCCACATGCGGTGGGGAAGA ACACCCTCCTCATTGCTGGGCTCCAGGCCAGGAA CAATGCCCGCGTCATCTTCAGCGGCTCCCTCGACT TCTTCAGCGACTCCTTCTTCAACTCAGCAGTGCAG AAGGCGGCGCCCGGCTCCCAGAGGTATTCCCAGA CAGGCAACTATGAACTAGCTGTGGCC | 13 | WWPILITL WCWTS* |
| 1430 | NM_0053 13.4_871 | 871 | GCCGGGTTTGGGGGTTGGGACCTCCGGCTGCAG GTCCGCCTGGGCCAGACGCGCGAGCGCAAGCAG CGGGTTAGTGGTCGCGCGCCCGACCTCCGCAGTC CCAGCCGAGCCGCGACCCTTCCGGCCGTCCCCAC CCCACCTCGCCGCCATGCGCCTCCGCCGCCTAGC GCTGTTCCCGGGTGTGGCGCTGCTTCTTGCCGCG GCCCGCCTCGCCGCTGCCTCCGACGTGCTAGAAC TCACGGACGACAACTTCGAGAGTCGCATCTCCGA CACGGGCTCTGCGGGCCTCATGCTCGTCGAGTTC TTCGCCCCCTGGTGTGGACACTGCAAGAGACTTG CACCTGAGTATGAAGCTGCAGCTACCAGATTAAAA GGAATAGTCCCATTAGCAAAGGTTGATTGCACTGC CAACACTAACACCTGTAATAAATATGGAGTCAGTG GATATCCAACCCTGAAGATATTTAGAGATGGTGAA GAAGCAGGTGCTTATGATGGACCTAGGACTGCTG ATGGAATTGTCAGCCACTTGAAGAAGCAGGCAGG ACCAGCTTCAGTGCCTCTCAGGACTGAGGAAGAAT TTAAGAAATTCATTAGTGATAAAGATGCCTCTATAG TAGGTTTTTTCGATGATTCATTCAGTGAGGCTCACT CCGAGTTCCTAAAAGCAGCCAGCAACTTGAGGGA TAACTACCGATTTGCACATACGAATGTTGAGTCTCT GGTGAACGAGTATGATGATAATGGAGAGGGTATCA TCTTATTTCGTCCTTCACATCTCACTAACAAGTTTG AGGACAAGACTGTGGCATATACAGAGCAAAAAATG | 6 | LVSALT* |

TABLE 3A-continued

| SEQ ID | identifier_position | position | modified_RNA | PAP length | PAP |
|---|---|---|---|---|---|
| | | | ACCAGTGGCAAAATTAAAAAGTTTATCCAGGAAAA<br>CATTTTGGTATCTGCCCTCACATGACAGAAGACAA<br>TAAAGATTTGATACAGGGCAAGGACTTACTTATTG<br>CTTACTATGATGTGGACTATGAAAAGAACGCTAAA<br>GGTTCCAACTACTGGAGAAACAGGGTAATGATGGT<br>GGCAAAGAAATTCCTGGATG | | |
| 1431 | NM_0053<br>24.3_211 | 211 | GAGCGCAGAGCGGTTTGGTCGTTCGTTGGGCGGT<br>GCTGGTTTTTCGCTCGTCGACTGCGGCTCTTCCTC<br>GGGCAGCGGAAGCGGCGCGGCGGTCGGAGAAGT<br>GGCCTAAAACTTCGGCGTTGGGTGAAAGAAAATG<br>GCCCGAACCAAGCAGACTGCTCGTAAGTCCACCG<br>GTGGGAAAGCCCCCCGCAAACAGCTGGCCACGAA<br>AGCCGCAGGAAAAGCGCTCCCTCTACCGGCGGG<br>GTGAAGAAGCCTCATCGCTACAGGCCCGGGACCG<br>TGGCGCTTCGAGAGATTCGTCGTTATCAGAAGTCG<br>ACCGAGCTGCTCATCCGGAAGCTGCCCTTCCAGA<br>GGTTGGTGAGGGAGATCGCGCAGGATTTCAAAAC<br>CGACCTGAGGTTTCAGAGCGCAGCCATCGGTGCG<br>CTGCAGGAGGCTAGCGAAGCGTACCTGGTGGGTC<br>TGTTCGAAGATACCAACCTGTGTGCCATCCACGCT<br>AAGAGAGTCACCATCATGCCCAAAGACATCCAGTT<br>GGCTCGCCGGATACGGGGAGAGAGAGCTTAAGTG<br>AAGGCAGTTTTTATGGCGTTTTGTAGTAAATTCTGT<br>AAAATACTTTGGTTTAATTTGTGACTTTTTTTGTAAG<br>AAATTGTTTATAATATGTTGCATTTGTACTTAAGTCA<br>TTCCATCTTTCACTCAGGATGAATGCGAAAAGTGA<br>CTGTTCACAGACCTCAGTGATGTGAGCACTGTTGC<br>TCAGGAGTGACAAGTTGCTAATATGCAGAAGGGAT<br>GGGTGATACTTCTTGCTTCTCATGATGCATGTTTCT<br>GTATGTTAATGACTTGTTGGGTAGCTATTAAGGTAC<br>TAGAGTTGATAAATGTGTACAGGGTCCTTTTGCAAT<br>AAAACTGGTTATGACTTGATCCAAGTGTTTAACAAT<br>TGGGGCTGTTAAGTCTGACCATACATCACTGTGAT<br>AGAATGTGGGCTTTTTCAAGGGTGAAGATACAAGT<br>CTTAACCACAGTGTAACTTACAGTTTCCTTTAAAAA<br>AAAAAAAAGTAAA | 9 | GKALPLPA<br>G* |
| 1432 | NM_0053<br>24.3_345 | 345 | GAGCGCAGAGCGGTTTGGTCGTTCGTTGGGCGGT<br>GCTGGTTTTTCGCTCGTCGACTGCGGCTCTTCCTC<br>GGGCAGCGGAAGCGGCGCGGCGGTCGGAGAAGT<br>GGCCTAAAACTTCGGCGTTGGGTGAAAGAAAATG<br>GCCCGAACCAAGCAGACTGCTCGTAAGTCCACCG<br>GTGGGAAAGCCCCCCGCAAACAGCTGGCCACGAA<br>AGCCGCCAGGAAAAGCGCTCCCTCTACCGGCGGG<br>GTGAAGAAGCCTCATCGCTACAGGCCCGGGACCG<br>TGGCGCTTCGAGAGATTCGTCGTTATCAGAAGTCG<br>ACCGAGCTGCTCATCCGGAAGCTGCCCTTCCAGA<br>GGTGGTGAGGGAGATCGCGCAGGATTTCAAAACC<br>GACCTGAGGTTTCAGAGCGCAGCCATCGGTGCGC<br>TGCAGGAGGCTAGCGAAGCGTACCTGGTGGGTCT<br>GTTCGAAGATACCAACCTGTGTGCCATCCACGCTA<br>AGAGAGTCACCATCATGCCCAAAGACATCCAGTTG<br>GCTCGCCGGATACGGGGAGAGAGAGCTTAAGTGA<br>AGGCAGTTTTTATGGCGTTTTGTAGTAAATTCTGTA<br>AAATACTTTGGTTTAATTTGTGACTTTTTTTGTAAGA<br>AATTGTTTATAATATGTTGCATTTGTACTTAAGTCAT<br>TCCATCTTTCACTCAGGATGAATGCGAAAAGTGAC<br>TGTTCACAGACCTCAGTGATGTGAGCACTGTTGCT<br>CAGGAGTGACAAGTTGCTAATATGCAGAAGGGAT<br>GGGTGATACTTCTTGCTTCTCATGATGCATGTTTCT<br>GTATGTTAATGACTTGTTGGGTAGCTATTAAGGTAC<br>TAGAGTTGATAAATGTGTACAGGGTCCTTTTGCAAT<br>AAAACTGGTTATGACTTGATCCAAGTGTTTAACAAT<br>TGGGGCTGTTAAGTCTGACCATACATCACTGTGAT<br>AGAATGTGGGCTTTTTCAAGGGTGAAGATACAAGT<br>CTTAACCACAGTGTAACTTACAGTTTCCTTTAAAAA<br>AAAAAAAAGTAAA | 1 | W* |
| 1433 | NM_0053<br>24.3_400 | 400 | GAGCGCAGAGCGGTTTGGTCGTTCGTTGGGCGGT<br>GCTGGTTTTTCGCTCGTCGACTGCGGCTCTTCCTC<br>GGGCAGCGGAAGCGGCGCGGCGGTCGGAGAAGT<br>GGCCTAAAACTTCGGCGTTGGGTGAAAGAAAATG<br>GCCCGAACCAAGCAGACTGCTCGTAAGTCCACCG<br>GTGGGAAAGCCCCCCGCAAACAGCTGGCCACGAA<br>AGCCGCCAGGAAAAGCGCTCCCTCTACCGGCGGG<br>GTGAAGAAGCCTCATCGCTACAGGCCCGGGACCG<br>TGGCGCTTCGAGAGATTCGTCGTTATCAGAAGTCG<br>ACCGAGCTGCTCATCCGGAAGCTGCCCTTCCAGA<br>GGTTGGTGAGGGAGATCGCGCAGGATTTCAAAAC | 48 | SVRCRRLA<br>KRTWWVC<br>SKIPTCVP<br>STLRESPS<br>CPKTSSWL<br>AGYGEREL<br>K* |

TABLE 3A-continued

| SEQ ID | identifier_ position | position | modified_RNA | PAP length | PAP |
|---|---|---|---|---|---|
| | | | CGACCTGAGGTTTCAGAGCGCAGCATCGGTGCGC<br>TGCAGGAGGCTAGCGAAGCGTACCTGGTGGGTCT<br>GTTCGAAGATACCAACCTGTGTGCCATCCACGCTA<br>AGAGAGTCACCATCATGCCCAAAGACATCCAGTTG<br>GCTCGCCGGATACGGGGAGAGAGAGCTTAAGTGA<br>AGGCAGTTTTTATGGCGTTTTGTAGTAAATTCTGTA<br>AAATACTTTGGTTTAATTTGTGACTTTTTTTTTGTAAGA<br>AATTGTTTATAATATGTTGCATTTGTACTTAAGTCAT<br>TCCATCTTTCACTCAGGATGAATGCGAAAAGTGAC<br>TGTTCACAGACCTCAGTGATGTGAGCACTGTTGCT<br>CAGGAGTGACAAGTTGCTAATATGCAGAAGGGAT<br>GGGTGATACTTCTTGCTTCTCATGATGCATGTTTCT<br>GTATGTTAATGACTTGTTGGGTAGCTATTAAGGTAC<br>TAGAGTTGATAAATGTGTACAGGGTCCTTTTGCAAT<br>AAAACTGGTTATGACTTGATCCAAGTGTTTAACAAT<br>TGGGGCTGTTAAGTCTGACCATACATCACTGTGAT<br>AGAATGTGGGCTTTTTCAAGGGTGAAGATACAAGT<br>CTTAACCACAGTGTAACTTACAGTTTCCTTTAAAAA<br>AAAAAAAAGTAAA | | |
| 1434 | NM_0053<br>24.3_521 | 521 | GAGCGCAGAGCGGTTTGGTCGTTCGTTGGGCGGT<br>GCTGGTTTTTCGCTCGTCGACTGCGGCTCTTCCTC<br>GGGCAGCGGAAGCGGCGCGGCGGTCGGAGAAGT<br>GGCCTAAAACTTCGGCGTTGGGTGAAAGAAAATG<br>GCCCGAACCAAGCAGACTGCTCGTAAGTCCACCG<br>GTGGGAAAGCCCCCCGCAAACAGCTGGCCACGAA<br>AGCCGCCAGGAAAAGCGCTCCCTCTACCGGCGGG<br>GTGAAGAAGCCTCATCGCTACAGGCCCGGGACCG<br>TGGCGCTTCGAGAGATTCGTCGTTATCAGAAGTCG<br>ACCGAGCTGCTCATCCGGAAGCTGCCCTTCCAGA<br>GGTTGGTGAGGGAGATCGCGCAGGATTTCAAAAC<br>CGACCTGAGGTTTCAGAGCGCAGCCATCGGTGCG<br>CTGCAGGAGGCTAGCGAAGCGTACCTGGTGGGTC<br>TGTTCGAAGATACCAACCTGTGTGCCATCCACGCT<br>AAGAGAGTCACCATCATGCCCAAAGACATCCAGTT<br>GGCTCGCGGATACGGGGAGAGAGAGCTTAAGTGA<br>AGGCAGTTTTTATGGCGTTTTGTAGTAAATTCTGTA<br>AAATACTTTGGTTTAATTTGTGACTTTTTTTGTAAGA<br>AATTGTTTATAATATGTTGCATTTGTACTTAAGTCAT<br>TCCATCTTTCACTCAGGATGAATGCGAAAAGTGAC<br>TGTTCACAGACCTCAGTGATGTGAGCACTGTTGCT<br>CAGGAGTGACAAGTTGCTAATATGCAGAAGGGAT<br>GGGTGATACTTCTTGCTTCTCATGATGCATGTTTCT<br>GTATGTTAATGACTTGTTGGGTAGCTATTAAGGTAC<br>TAGAGTTGATAAATGTGTACAGGGTCCTTTTGCAAT<br>AAAACTGGTTATGACTTGATCCAAGTGTTTAACAAT<br>TGGGGCTGTTAAGTCTGACCATACATCACTGTGAT<br>AGAATGTGGGCTTTTTCAAGGGTGAAGATACAAGT<br>CTTAACCACAGTGTAACTTACAGTTTCCTTTAAAAA<br>AAAAAAAAGTAAA | 8 | GYGERELK* |
| 1435 | NM_0053<br>48.3_143<br>7 | 1437 | GCATGCGTAGGCGCGCGGCCGCGGCGGCGGCTG<br>GGGGAGGGTTCTTCCGGAAGGTTCGGGAGGCTTCT<br>GGAAAAAGCGCCGCGCGCTGGGCGGGCCCGTCG<br>CTATATAAGGCAGGCGCGGGGGTGGCGCGTCAGT<br>TGCTTCAGCGTCCCGGTGTGGCTGTGCCGTTGGT<br>CCTGTGCGGTCACTTAGCCAAGATGCCTGAGGAA<br>ACCCAGACCCAAGACCAACCGATGGAGGAGGAGG<br>AGGTTGAGACGTTCGCCTTTCAGGCAGAAATTGCC<br>CAGTTGATGTCATTGATCATCAATACTTTCTACTCG<br>AACAAAGAGATCTTTCTGAGAGAGCTCATTTCAAAT<br>TCATCAGATGCATTGACAAAATCCGGTATGAAAG<br>CTTGACAGATCCCAGTAAATTAGACTCTGGGAAAG<br>AGCTGCATATTAACCTTATACCGAACAAACAAGAT<br>CGAACTCTCACTATTGTGGATACTGGAATTGGAAT<br>GACCAAGGCTGACTTGATCAATAACCTTGGTACTA<br>TCGCCAAGTCTGGGACCAAAGCGTTCATGGAAGC<br>TTTGCAGGCTGGTGCAGATATCTCTATGATTGGCC<br>AGTTCGGTGTTGGTTTTATTCTGCTTATTTGGTTG<br>CTGAGAAAGTAACTGTGATCACCAAACATAACGAT<br>GATGAGCAGTACGCTTGGGAGTCCTCAGCAGGGG<br>GATCATTCACAGTGAGGACAGACACAGGTGAACCT<br>ATGGGTCGTGGAACAAAAGTTATCCTACACCTGAA<br>AGAAGACCAAACTGAGTACTTGGAGGAACGAAGA<br>ATAAAGGAGATTGTGAAGAAACATTCTCAGTTTATT<br>GGATATCCCATTACTCTTTTTGTGGAGAAGGAACG<br>TGATAAAGAAGTAAGCGATGATGAGGCTGAAGAAA<br>AGGAAGACAAAGAAGAAGAAAAAGAAAAAGAAGA<br>GAAAGAGTCGGAAGACAAACCTGAAATTGAAGATG | 5 | WSKNA* |

TABLE 3A-continued

| SEQ ID | identifier_position | position | modified_RNA | PAP length | PAP |
|---|---|---|---|---|---|
| 1436 | NM_0053 48.3_268 | 268 | TTGGTTCTGATGAGGAAGAAGAAAAGAAGGATGGT GACAAGAAGAAGAAGAAG GCATGCGTAGGCGCGCGGCCGCGGCGGCGGCTG GGGAGGGTTCTTCCGGAAGGTTCGGGAGGCTTCT GGAAAAAGCGCCGCGCGCTGGGCGGGCCCGTCG CTATATAAGGCAGGCGCGGGGGTGGCGCGTCAGT TGCTTCAGCGTCCCGGTGTGGCTGTGCCGTTGGT CCTGTGCGGTCACTTAGCCAAGATGCCTGAGGAA ACCCAGACCCAAGACCAACCGATGGAGGAGGAGG AGGTTGAGACGTTCGCCTTTCAGGCAGAAATGCC CAGTTGATGTCATTGATCATCAATACTTTCTACTCG AACAAAGAGATCTTTCTGAGAGAGCTCATTTCAAAT TCATCAGATGCATTGGACAAAATCCGGTATGAAAG CTTGACAGATCCCAGTAAATTAGACTCTGGGAAAG AGCTGCATATTAACCTTATACCGAACAAACAAGAT CGAACTCTCACTATTGTGGATACTGGAATTGGAAT GACCAAGGCTGACTTGATCAATAACCTTGGTACTA TCGCCAAGTCTGGGACCAAAGCGTTCATGGAAGC TTTGCAGGCTGGTGCAGATATCTCTATGATTGGCC AGTTCGGTGTTGGTTTTATTCTGCTTATTTGGTTG CTGAGAAAGTAACTGTGATCACCAAACATAACGAT GATGAGCAGTACGCTTGGGAGTCCTCAGCAGGGG GATCATTCACAGTGAGGACAGACACAGGTGAACCT ATGGGTCGTGGAACAAAAGTTATCCTACACCTGAA AGAAGACCAAACTGAGTACTTGGAGGAACGAAGA ATAAAGGAGATTGTGAAGAAACATTCTCAGTTTATT GGATATCCCATTACTCTTTTTGTGGAGAAGGAACG TGATAAAGAAGTAAGCGATGATGAGGCTGAAGAAA AGGAAGACAAAGAAGAAGAAAAAGAAAAAGAAGA GAAAGAGTCGGAAGACAAACCTGAAATTGAAGATG TTGGTTCTGATGAGGAAGAAGAAAAGAAGGATGGT GACAAGAAGAAGAAGAAGA | 3 | MPS* |
| 1437 | NM_0053 48.3_357 | 357 | GCATGCGTAGGCGCGCGGCCGCGGCGGCGGCTG GGGAGGGTTCTTCCGGAAGGTTCGGGAGGCTTCT GGAAAAAGCGCCGCGCGCTGGGCGGGCCCGTCG CTATATAAGGCAGGCGCGGGGGTGGCGCGTCAGT TGCTTCAGCGTCCCGGTGTGGCTGTGCCGTTGGT CCTGTGCGGTCACTTAGCCAAGATGCCTGAGGAA ACCCAGACCCAAGACCAACCGATGGAGGAGGAGG AGGTTGAGACGTTCGCCTTTCAGGCAGAAATTGCC CAGTTGATGTCATTGATCATCAATACTTTCTACTCG AACAAAGAGATCTTTCTGAGAGAGCTCATTTCAAAT TCATCAGATGCATGGACAAAATCCGGTATGAAAGC TTGACAGATCCCAGTAAATTAGACTCTGGGAAAGA GCTGCATATTAACCTTATACCGAACAAACAAGATC GAACTCTCACTATTGTGGATACTGGAATTGGAATG ACCAAGGCTGACTTGATCAATAACCTTGGTACTAT CGCCAAGTCTGGGACCAAAGCGTTCATGGAAGCT TTGCAGGCTGGTGCAGATATCTCTATGATTGGCCA GTTCGGTGTTGGTTTTATTCTGCTTATTTGGTTGC TGAGAAAGTAACTGTGATCACCAAACATAACGATG ATGAGCAGTACGCTTGGGAGTCCTCAGCAGGGGG ATCATTCACAGTGAGGACAGACACAGGTGAACCTA TGGGTCGTGGAACAAAAGTTATCCTACACCTGAAA GAAGACCAAACTGAGTACTTGGAGGAACGAAGAAT AAAGGAGATTGTGAAGAAACATTCTCAGTTTATTG GATATCCCATTACTCTTTTTGTGGAGAAGGAACGT GATAAAGAAGTAAGCGATGATGAGGCTGAAGAAAA GGAAGACAAAGAAGAAGAAAAAGAAAAAGAAGAG AAAGAGTCGGAAGACAAACCTGAAATTGAAGATGT TGGTTCTGATGAGGAAGAAGAAAAGAAGGATGGT GACAAGAAGAAGAAGAAGA | 8 | WTKSGMK A* |
| 1438 | NM_0053 48.3_463 | 463 | GCATGCGTAGGCGCGCGGCCGCGGCGGCGGCTG GGGAGGGTTCTTCCGGAAGGTTCGGGAGGCTTCT GGAAAAAGCGCCGCGCGCTGGGCGGGCCCGTCG CTATATAAGGCAGGCGCGGGGGTGGCGCGTCAGT TGCTTCAGCGTCCCGGTGTGGCTGTGCCGTTGGT CCTGTGCGGTCACTTAGCCAAGATGCCTGAGGAA ACCCAGACCCAAGACCAACCGATGGAGGAGGAGG AGGTTGAGACGTTCGCCTTTCAGGCAGAAATTGCC CAGTTGATGTCATTGATCATCAATACTTTCTACTCG AACAAAGAGATCTTTCTGAGAGAGCTCATTTCAAAT TCATCAGATGCATTGGACAAAATCCGGTATGAAAG CTTGACAGATCCCAGTAAATTAGACTCTGGGAAAG AGCTGCATATTAACCTTATACCGAACAAACAAGAT CGAACTCTCACTATTGTGGATACTGGAATTGGAATG ACCAAGGCTGACTTGATCAATAACCTTGGTACTAT | 7 | MWILELE* |

TABLE 3A-continued

| SEQ ID | identifier_position | position | modified_RNA | PAP length | PAP |
|---|---|---|---|---|---|
| | | | CGCCAAGTCTGGGACCAAAGCGTTCATGGAAGCT<br>TTGCAGGCTGGTGCAGATATCTCTATGATTGGCCA<br>GTTCGGTGTTGGTTTTATTCTGCTTATTTGGTTGC<br>TGAGAAAGTAACTGTGATCACCAAACATAACGATG<br>ATGAGCAGTACGCTTGGGAGTCCTCAGCAGGGGG<br>ATCATTCACAGTGAGGACAGACACAGGTGAACCTA<br>TGGGTCGTGGAACAAAAGTTATCCTACACCTGAAA<br>GAAGACCAAACTGAGTACTTGGAGGAACGAAGAAT<br>AAAGGAGATTGTGAAGAAACATTCTCAGTTTATTG<br>GATATCCCATTACTCTTTTTGTGGAGAAGGAACGT<br>GATAAAGAAGTAAGCGATGATGAGGCTGAAGAAAA<br>GGAAGACAAAGAAGAAGAAAAAGAAAAAGAAGAG<br>AAAGAGTCGGAAGACAAACCTGAAATTGAAGATGT<br>TGGTTCTGATGAGGAAGAAGAAAAGAAGGATGGT<br>GACAAGAAGAAGAAGAAGA | | |
| 1439 | NM_0053<br>48.3_598 | 598 | GCATGCGTAGGCGCGCGGCCGCGGCGGCGGCTG<br>GGGAGGGTTCTTCCGGAAGGTTCGGGAGGCTTCT<br>GGAAAAAGCGCCGCGCGCTGGGCGGGCCCGTCG<br>CTATATAAGGCAGGCGCGGGGGTGGCGCGTCAGT<br>TGCTTCAGCGTCCCGGTGTGGCTGTGCCGTTGGT<br>CCTGTGCGGTCACTTAGCCAAGATGCCTGAGGAA<br>ACCCAGACCCAAGACCAACCGATGGAGGAGGAGG<br>AGGTTGAGACGTTCGCCTTTCAGGCAGAAATTGCC<br>CAGTTGATGTCATTGATCATCAATACTTTCTACTCG<br>AACAAAGAGATCTTTCTGAGAGAGCTCATTTCAAAT<br>TCATCAGATGCATTGGACAAAATCCGGTATGAAAG<br>CTTGACAGATCCCAGTAAATTAGACTCTGGGAAAG<br>AGCTGCATATTAACCTTATACCGAACAAACAAGAT<br>CGAACTCTCACTATTGTGGATACTGGAATTGGAAT<br>GACCAAGGCTGACTTGATCAATAACCTTGGTACTA<br>TCGCCAAGTCTGGGACCAAAGCGTTCATGGAAGC<br>TTTGCAGGCTGGTGCAGATATCTCTATGATTGGCC<br>AGTTCGGTGTGGTTTTATTCTGCTTATTTGGTTGC<br>TGAGAAAGTAACTGTGATCACCAAACATAACGATG<br>ATGAGCAGTACGCTTGGGAGTCCTCAGCAGGGGG<br>ATCATTCACAGTGAGGACAGACACAGGTGAACCTA<br>TGGGTCGTGGAACAAAAGTTATCCTACACCTGAAA<br>GAAGACCAAACTGAGTACTTGGAGGAACGAAGAAT<br>AAAGGAGATTGTGAAGAAACATTCTCAGTTTATTG<br>GATATCCCATTACTCTTTTTGTGGAGAAGGAACGT<br>GATAAAGAAGTAAGCGATGATGAGGCTGAAGAAAA<br>GGAAGACAAAGAAGAAGAAAAAGAAAAAGAAGAG<br>AAAGAGTCGGAAGACAAACCTGAAATTGAAGATGT<br>TGGTTCTGATGAGGAAGAAGAAAAGAAGGATGGT<br>GACAAGAAGAAGAAGAAGA | 11 | VFILLIWLL<br>RK* |
| 1440 | NM_0053<br>48.3_618 | 618 | GCATGCGTAGGCGCGCGGCCGCGGCGGCGGCTG<br>GGGAGGGTTCTTCCGGAAGGTTCGGGAGGCTTCT<br>GGAAAAAGCGCCGCGCGCTGGGCGGGCCCGTCG<br>CTATATAAGGCAGGCGCGGGGGTGGCGCGTCAGT<br>TGCTTCAGCGTCCCGGTGTGGCTGTGCCGTTGGT<br>CCTGTGCGGTCACTTAGCCAAGATGCCTGAGGAA<br>ACCCAGACCCAAGACCAACCGATGGAGGAGGAGG<br>AGGTTGAGACGTTCGCCTTTCAGGCAGAAATTGCC<br>CAGTTGATGTCATTGATCATCAATACTTTCTACTCG<br>AACAAAGAGATCTTTCTGAGAGAGCTCATTTCAAAT<br>TCATCAGATGCATTGGACAAAATCCGGTATGAAAG<br>CTTGACAGATCCCAGTAAATTAGACTCTGGGAAAG<br>AGCTGCATATTAACCTTATACCGAACAAACAAGAT<br>CGAACTCTCACTATTGTGGATACTGGAATTGGAAT<br>GACCAAGGCTGACTTGATCAATAACCTTGGTACTA<br>TCGCCAAGTCTGGGACCAAAGCGTTCATGGAAGC<br>TTTGCAGGCTGGTGCAGATATCTCTATGATTGGCC<br>AGTTCGGTGTTGGTTTTATTCTGCTTATTGGTTGC<br>TGAGAAAGTAACTGTGATCACCAAACATAACGATG<br>ATGAGCAGTACGCTTGGGAGTCCTCAGCAGGGGG<br>ATCATTCACAGTGAGGACAGACACAGGTGAACCTA<br>TGGGTCGTGGAACAAAAGTTATCCTACACCTGAAA<br>GAAGACCAAACTGAGTACTTGGAGGAACGAAGAAT<br>AAAGGAGATTGTGAAGAAACATTCTCAGTTTATTG<br>GATATCCCATTACTCTTTTTGTGGAGAAGGAACGT<br>GATAAAGAAGTAAGCGATGATGAGGCTGAAGAAAA<br>GGAAGACAAAGAAGAAGAAAAAGAAAAAGAAGAG<br>AAAGAGTCGGAAGACAAACCTGAAATTGAAGATGT<br>TGGTTCTGATGAGGAAGAAGAAAAGAAGGATGGT<br>GACAAGAAGAAGAAGAAGA | 5 | WLLRK* |

TABLE 3A-continued

| SEQ ID | identifier_position | position | modified_RNA | PAP length | PAP |
|---|---|---|---|---|---|
| 1441 | NM_005348.3_808 | 808 | GCATGCGTAGGCGCGCGGCCGCGGCGGCGGCTG GGGAGGGTTCTTCCGGAAGGTTCGGGAGGCTTCT GGAAAAAGCGCCGCGCGCTGGGCGGGCCCGTCG CTATATAAGGCAGGCGCGGGGGTGGCGCGTCAGT TGCTTCAGCGTCCCGGTGTGGCTGTGCCGTTGGT CCTGTGCGGTCACTTAGCCAAGATGCCTGAGGAA ACCCAGACCCAAGACCAACCGATGGAGGAGGAGG AGGTTGAGACGTTCGCCTTTCAGGCAGAAATTGCC CAGTTGATGTCATTGATCATCAATACTTTCTACTCG AACAAAGAGATCTTTCTGAGAGAGCTCATTTCAAAT TCATCAGATGCATTGGACAAAATCCGGTATGAAAG CTTGACAGATCCCAGTAAATTAGACTCTGGGAAAG AGCTGCATATTAACCTTATACCGAACAAACAAGAT CGAACTCTCACTATTGTGGATACTGGAATTGGAAT GACCAAGGCTGACTTGATCAATAACCTTGGTACTA TCGCCAAGTCTGGGACCAAAGCGTTCATGGAAGC TTTGCAGGCTGGTGCAGATATCTCTATGATTGGCC AGTTCGGTGTTGGTTTTTATTCTGCTTATTTGGTTG CTGAGAAAGTAACTGTGATCACCAAACATAACGAT GATGAGCAGTACGCTTGGGAGTCCTCAGCAGGGG GATCATTCACAGTGAGGACAGACACAGGTGAACCT ATGGGTCGTGGAACAAAAGTTATCCTACACCTGAA AGAAGACCAAACTGAGTACTTGGAGGAACGAAGA ATAAAGGAGATGTGAAGAAACATTCTCAGTTTATTG GATATCCCATTACTCTTTTTGTGGAGAAGGAACGT GATAAAGAAGTAAGCGATGATGAGGCTGAAGAAAA GGAAGACAAAGAAGAAGAAAAAGAAAAAGAAGAG AAAGAGTCGGAAGACAAACCTGAAATTGAAGATGT TGGTTCTGATGAGGAAGAAGAAAAGAAGGATGGT GACAAGAAGAAGAAGAAGA | 1 | M* |
| 1442 | NM_005348.3_853 | 853 | GCATGCGTAGGCGCGCGGCCGCGGCGGCGGCTG GGGAGGGTTCTTCCGGAAGGTTCGGGAGGCTTCT GGAAAAAGCGCCGCGCGCTGGGCGGGCCCGTCG CTATATAAGGCAGGCGCGGGGGTGGCGCGTCAGT TGCTTCAGCGTCCCGGTGTGGCTGTGCCGTTGGT CCTGTGCGGTCACTTAGCCAAGATGCCTGAGGAA ACCCAGACCCAAGACCAACCGATGGAGGAGGAGG AGGTTGAGACGTTCGCCTTTCAGGCAGAAATTGCC CAGTTGATGTCATTGATCATCAATACTTTCTACTCG AACAAAGAGATCTTTCTGAGAGAGCTCATTTCAAAT TCATCAGATGCATTGGACAAAATCCGGTATGAAAG CTTGACAGATCCCAGTAAATTAGACTCTGGGAAAG AGCTGCATATTAACCTTATACCGAACAAACAAGAT CGAACTCTCACTATTGTGGATACTGGAATTGGAAT GACCAAGGCTGACTTGATCAATAACCTTGGTACTA TCGCCAAGTCTGGGACCAAAGCGTTCATGGAAGC TTTGCAGGCTGGTGCAGATATCTCTATGATTGGCC AGTTCGGTGTTGGTTTTTATTCTGCTTATTTGGTTG CTGAGAAAGTAACTGTGATCACCAAACATAACGAT GATGAGCAGTACGCTTGGGAGTCCTCAGCAGGGG GATCATTCACAGTGAGGACAGACACAGGTGAACCT ATGGGTCGTGGAACAAAAGTTATCCTACACCTGAA AGAAGACCAAACTGAGTACTTGGAGGAACGAAGA ATAAAGGAGATTGTGAAGAAACATTCTCAGTTTATT GGATATCCCATTACTCTTTTTGTGGAGAAGGAACGT GATAAAGAAGTAAGCGATGATGAGGCTGAAGAAAA GGAAGACAAAGAAGAAGAAAAAGAAAAAGAAGAG AAAGAGTCGGAAGACAAACCTGAAATTGAAGATGT TGGTTCTGATGAGGAAGAAGAAAAAGAAGGATGGT GACAAGAAGAAGAAGAAGA | 9 | LWRRNVIK K* |
| 1443 | NM_005370.4_774 | 774 | GTGCCGGCCAATGGGAGGTGCGCTCGGGCTGCTT CCGGCTCCGCGCTCCGCTCGCCCCTCCCAAGGT CTCCCCGCGACTGGCGGGACGCAGGGGCGGGCG TCGGCCGCGGTGACGCGCAGCGGGCCTGGAGCC AATAAGGGGCGGGCTCGGTGCTGATGGACGGTGC TGGTGGCCAGTGGAGAGGCGCTGGCCGCACTTCC CGTCGGGGAGAGAGTGTAATATGGCGAAGACCTA CGATTACCTGTTCAAGCTGCTGCTGATCGGGGACT CGGGGGTGGGGAAGACCTGTGTCCTGTTCCGCTT CTCCGAGGACGCCTTCAACTCCACTTTTATCTCCA CCATAGGAATTGACTTTAAAATTAGGACCATAGAG CTCGATGGCAAGAGAATTAAACTGCAGATATGGGA CACAGCCGGTCAGGAACGGTTTCGGACGATCACA ACGGCCTACACAGGGGTGCAATGGGCATCATGC TGGTCTACGACATCACCAACGAGAAGTCCTTCGAC AACATCCGGAACTGGATTCGCAACATTGAGGAGCA CGCCTCTGCAGACGTCGAAAAGATGATACTCGGG | 36 | ATRESKSH RTSRRGAA FSDVFFCE EHRLTLSL AQPS* |

TABLE 3A-continued

| SEQ ID | identifier_position | position | modified_RNA | PAP length | PAP |
|---|---|---|---|---|---|
| | | | AACAAGTGTGATGTGAATGACAAGAGACAAGTTTC CAAGGAACGGGGAGAAAAGCTGGCCCTCGACTAT GGAATCAAGTTCATGGAGACCAGCGCGAAGGCCA ACATCAATGTGGAAAATGCATTTTTCACTCTCGCCA GAGATATCAAAGCAAAAATGGACAAAAAATTGGAA GGCAACAGCCCCCAGGGAGCAACCAGGGAGTCAA AATCACACCGGACCAGCAGAAGAGGAGCAGCTTT TTCCGATGTGTTCTTCTGTGAGGAACACCGCCTTA CTCTGAGCCTCGCTCAGCCCAGCTGACTGTGCCT GTTCTGAGTGAGCCCCTCACTCAGCCGGGGCCCT CCCACCTCCAACGCCCCGCCCACGCCGCGGCCA CCGGGCCCACGGCCACCAGAATGCAATTGAGAAA TCGTTTATTTTAGTAACTGTCTGATCTTTT | | |
| 1444 | NM_0053 70.4_785 | 785 | GTGCCGGCCAATGGGAGGTGCGCTCGGGCTGCTT CCGGCTCCGCGCTCCGCTCGCCCCCTCCCAAGGT CTCCCCGCGACTGGCGGGACGCAGGGGCGGGCG TCGGCCGCGGTGACGCGCAGCGGGCCTGGAGCC AATAAGGGGCGGGCTCGGTGCTGATGGACGGTGC TGGTGGCCAGTGGAGAGGCGCTGGCCGCACTTCC CGTCGGGGAGAGAGTGTAATATGGCGAAGACCTA CGATTACCTGTTCAAGCTGCTGCTGATCGGGGACT CGGGGGGTGGGGAAGACCTGTGTCCTGTTCCGCTT CTCCGAGGACGCCTTCAACTCCACTTTTATCTCCA CCATAGGAATTGACTTTAAAATTAGGACCATAGAG CTCGATGGCAAGAGAATTAAACTGCAGATATGGGA CACAGCCGGTCAGGAACGGTTTCGGACGATCACA ACGGCCTACTACAGGGGTGCAATGGGCATCATGC TGGTCTACGACATCACCAACGAGAAGTCCTTCGAC AACATCCGGAACTGGATTCGCAACATTGAGGAGCA CGCCTCTGCAGACGTCGAAAAGATGATACTCGGG AACAAGTGTGATGTGAATGACAAGAGACAAGTTTC CAAGGAACGGGGAGAAAAGCTGGCCCTCGACTAT GGAATCAAGTTCATGGAGACCAGCGCGAAGGCCA ACATCAATGTGGAAAATGCATTTTTCACTCTCGCCA GAGATATCAAAGCAAAAATGGACAAAAAATTGGAA GGCAACAGCCCCCAGGGAGCAACCAGGGAGTCAA AATCACACCGGACCAGCAGAAGAGGAGCAGCTTT TTCCGATGTGTTCTTCTGTGAGGAACACCGCCTTA CTCTGAGCCTCGCTCAGCCCAGCTGACTGTGCCT GTTCTGAGTGAGCCCCTCACTCAGCCGGGGCCCT CCCACCTCCAACGCCCCGCCCACGCCGCGGCCA CCGGGCCCACGGCCACCAGAATGCAATTGAGAAA TCGTTTATTTTAGTAACTGTCTGATCTTTT | 33 | ESKSHRTS RRGAAFSD VFFCEEHR LTLSLAQP S* |
| 1445 | NM_0054 12.4_379 | 379 | CCGAGTTGCGATGCTGTACTTCTCTTTGTTTTGGG CGGCTCGGCCTCTGCAGAGATGTGGGCAGCTGGT CAGGATGGCCATTCGGGCTCAGCACAGCAACGCA GCCCAGACTCAGACTGGGGAAGCAAACAGGGGCT GGACAGGCCAGGAGAGCCTGTCGGACAGTGATCC TGAGATGTGGGAGTTGCTGCAGAGGGAGAAGGAC AGGCAGTGTCGTGGCCTGGAGCTCATTGCCTCAG AGAACTTCTGCAGCCGAGCTGCGCTGGAGGCCCT GGGGTCCTGTCTGAACAACAAGTACTCGGAGGGT TATCCTGGCAAGAGATACTATGGGGGAGCAGAGG TGGTGGATGAAATTGAGCTGCTGTGCCAGCGCCG GGCTTGGAAGCCTTTGACCTGGATCCTGCACAGT GGGGAGTCAATGTCCAGCCCTACTCCGGGTCCCC AGCCAACCTGGCCGTCTACACAGCCCTTCTGCAA CCTCACGACCGGATCATGGGGCTGGACCTGCCCG ATGGGGGCCATCTCACCCACGGCTACATGTCTGA CGTCAAGCGGATATCAGCCACGTCCATCTTCTTCG AGTCTATGCCCTATAAGCTCAACCCCAAAACTGGC CTCATTGACTACAACCAGCTGGCACTGACTGCTCG ACTTTTCCGGCCACGGCTCATCATAGCTGGCACCA GCGCCTATGCTCGCCTCATTGACTACGCCCGCAT GAGAGAGGTGTGTGATGAAGTCAAAGCACACCTG CTGGCAGACATGGCCCACATCAGTGGCCTGGTGG CTGCCAAGGTGATTCCCTCGCCTTTCAAGCACGCG GACATCGTCACCACCACTACTCACAAGACTCTTCG AGGGGCCAGGTCAGGGCTCATCTTCTACCGGAAA GGGGTGAAGGCTGTGGACCCCAAGACTGGCCGG GAGATCCCTTACACATTTGAGGACCGAATCAACTT TGCCGTGTTCCCATCCCTGCAGGGGGGCCCCCAC AATCATGCCATTGCTGCAGTAGCTGTGGCCC | 87 | WKPLTWIL HSGESMS SPTPGPQP TWPSTQPF CNLTTGS WGWTCPM GAISPTAT CLTSSGYQ PRPSSSSL CPISSTPKL ASLTTTSW H* |
| 1446 | NM_0054 12.4_452 | 452 | CCGAGTTGCGATGCTGTACTTCTCTTTGTTTTGGG CGGCTCGGCCTCTGCAGAGATGTGGGCAGCTGGT CAGGATGGCCATTCGGGCTCAGCACAGCAACGCA GCCCAGACTCAGACTGGGGAAGCAAACAGGGGCT | 63 | WPSTQPF CNLTTGS WGWTCPM GAISPTAT |

TABLE 3A-continued

| SEQ ID | identifier_ position | position | modified_RNA | PAP length | PAP |
|---|---|---|---|---|---|
| | | | GGACAGGCCAGGAGAGCCTGTCGGACAGTGATCC<br>TGAGATGTGGGAGTTGCTGCAGAGGGAGAAGGAC<br>AGGCAGTGTCGTGGCCTGGAGCTCATTGCCTCAG<br>AGAACTTCTGCAGCCGAGCTGCGCTGGAGGCCCT<br>GGGGTCCTGTCTGAACAACAAGTACTCGGAGGGT<br>TATCCTGGCAAGAGATACTATGGGGGAGCAGAGG<br>TGGTGGATGAAATTGAGCTGCTGTGCCAGCGCCG<br>GGCCTTGGAAGCCTTTGACCTGGATCCTGCACAGT<br>GGGGAGTCAATGTCCAGCCCTACTCCGGGTCCCC<br>AGCCAACTGGCCGTCTACACAGCCCTTCTGCAAC<br>CTCACGACCGGATCATGGGGCTGGACCTGCCCGA<br>TGGGGGCCATCTCACCCACGGCTACATGTCTGAC<br>GTCAAGCGGATATCAGCCACGTCCATCTTCTTCGA<br>GTCTATGCCCTATAAGCTCAACCCCAAAACTGGCC<br>TCATTGACTACAACCAGCTGGCACTGACTGCTCGA<br>CTTTTCCGGCCACGGCTCATCATAGCTGGCACCAG<br>CGCCTATGCTCGCCTCATTGACTACGCCCGCATGA<br>GAGAGGTGTGTGATGAAGTCAAAGCACACCTGCT<br>GGCAGACATGGCCCACATCAGTGGCCTGGTGGCT<br>GCCAAGGTGATTCCCTCGCCTTTCAAGCACGCGG<br>ACATCGTCACCACCACTACTCACAAGACTCTTCGA<br>GGGGCCAGGTCAGGGCTCATCTTCTACCGGAAAG<br>GGGTGAAGGCTGTGGACCCCAAGACTGGCCGGG<br>AGATCCCTTACACATTTGAGGACCGAATCAACTTT<br>GCCGTGTTCCCATCCCTGCAGGGGGGCCCCCACA<br>ATCATGCCATTGCTGCAGTAGCTGTGGCCC | | CLTSSGYQ<br>PRPSSSSL<br>CPISSTPKL<br>ASLTTTSW<br>H* |
| 1447 | NM_0054 12.4_457 | 457 | CCGAGTTGCGATGCTGTACTTCTCTTTGTTTTGGG<br>CGGCTCGGCCTCTGCAGAGATGTGGGCAGCTGGT<br>CAGGATGGCCATTCGGGCTCAGCACAGCAACGCA<br>GCCCAGACTCAGACTGGGGAAGCAAACAGGGGCT<br>GGACAGGCCAGGAGAGCCTGTCGGACAGTGATCC<br>TGAGATGTGGGAGTTGCTGCAGAGGGAGAAGGAC<br>AGGCAGTGTCGTGGCCTGGAGCTCATTGCCTCAG<br>AGAACTTCTGCAGCCGAGCTGCGCTGGAGGCCCT<br>GGGGTCCTGTCTGAACAACAAGTACTCGGAGGGT<br>TATCCTGGCAAGAGATACTATGGGGGAGCAGAGG<br>TGGTGGATGAAATTGAGCTGCTGTGCCAGCGCCG<br>GGCCTTGGAAGCCTTTGACCTGGATCCTGCACAGT<br>GGGGAGTCAATGTCCAGCCCTACTCCGGGTCCCC<br>AGCCAACCTGGCGTCTACACAGCCCTTCTGCAAC<br>CTCACGACCGGATCATGGGGCTGGACCTGCCCGA<br>TGGGGGCCATCTCACCCACGGCTACATGTCTGAC<br>GTCAAGCGGATATCAGCCACGTCCATCTTCTTCGA<br>GTCTATGCCCTATAAGCTCAACCCCAAAACTGGCC<br>TCATTGACTACAACCAGCTGGCACTGACTGCTCGA<br>CTTTTCCGGCCACGGCTCATCATAGCTGGCACCAG<br>CGCCTATGCTCGCCTCATTGACTACGCCCGCATGA<br>GAGAGGTGTGTGATGAAGTCAAAGCACACCTGCT<br>GGCAGACATGGCCCACATCAGTGGCCTGGTGGCT<br>GCCAAGGTGATTCCCTCGCCTTTCAAGCACGCGG<br>ACATCGTCACCACCACTACTCACAAGACTCTTCGA<br>GGGGCCAGGTCAGGGCTCATCTTCTACCGGAAAG<br>GGGTGAAGGCTGTGGACCCCAAGACTGGCCGGG<br>AGATCCCTTACACATTTGAGGACCGAATCAACTTT<br>GCCGTGTTCCCATCCCTGCAGGGGGGCCCCCACA<br>ATCATGCCATTGCTGCAGTAGCTGTGGCCC | 61 | STQPFCNL<br>TTGSWGW<br>TCPMGAIS<br>PTATCLTS<br>SGYQPRP<br>SSSSLCPIS<br>STPKLASL<br>TTTSWH* |
| 1448 | NM_0054 12.4_480 | 480 | CCGAGTTGCGATGCTGTACTTCTCTTTGTTTTGGG<br>CGGCTCGGCCTCTGCAGAGATGTGGGCAGCTGGT<br>CAGGATGGCCATTCGGGCTCAGCACAGCAACGCA<br>GCCCAGACTCAGACTGGGGAAGCAAACAGGGGCT<br>GGACAGGCCAGGAGAGCCTGTCGGACAGTGATCC<br>TGAGATGTGGGAGTTGCTGCAGAGGGAGAAGGAC<br>AGGCAGTGTCGTGGCCTGGAGCTCATTGCCTCAG<br>AGAACTTCTGCAGCCGAGCTGCGCTGGAGGCCCT<br>GGGGTCCTGTCTGAACAACAAGTACTCGGAGGGT<br>TATCCTGGCAAGAGATACTATGGGGGAGCAGAGG<br>TGGTGGATGAAATTGAGCTGCTGTGCCAGCGCCG<br>GGCCTTGGAAGCCTTTGACCTGGATCCTGCACAGT<br>GGGGAGTCAATGTCCAGCCCTACTCCGGGTCCCC<br>AGCCAACCTGGCCGTCTACACAGCCCTTCTGCAA<br>CTCACGACCGGATCATGGGGCTGGACCTGCCCGA<br>TGGGGGCCATCTCACCCACGGCTACATGTCTGAC<br>GTCAAGCGGATATCAGCCACGTCCATCTTCTTCGA<br>GTCTATGCCCTATAAGCTCAACCCCAAAACTGGCC<br>TCATTGACTACAACCAGCTGGCACTGACTGCTCGA<br>CTTTTCCGGCCACGGCTCATCATAGCTGGCACCAG<br>CGCCTATGCTCGCCTCATTGACTACGCCCGCATGA | 54 | LTTGSWG<br>WTCPMGAI<br>SPTATCLT<br>SSGYQPR<br>PSSSSLCPI<br>SSTPKLAS<br>LTTTSWH* |

TABLE 3A-continued

| SEQ ID | identifier_position | position | modified_RNA | PAP length | PAP |
|---|---|---|---|---|---|
| | | | GAGAGGTGTGTGATGAAGTCAAAGCACACCTGCT<br>GGCAGACATGGCCCACATCAGTGGCCTGGTGGCT<br>GCCAAGGTGATTCCCTCGCCTTTCAAGCACGCGG<br>ACATCGTCACCACCACTACTCACAAGACTCTTCGA<br>GGGGCCAGGTCAGGGCTCATCTTCTACCGGAAAG<br>GGGTGAAGGCTGTGGACCCCAAGACTGGCCGGG<br>AGATCCCTTACACATTTGAGGACCGAATCAACTTT<br>GCCGTGTTCCCATCCCTGCAGGGGGGCCCCCACA<br>ATCATGCCATTGCTGCAGTAGCTGTGGCCC | | |
| 1449 | NM_0054<br>12.4_535 | 535 | CCGAGTTGCGATGCTGTACTTCTCTTTGTTTTGGG<br>CGGCTCGGCCTCTGCAGAGATGTGGGCAGCTGGT<br>CAGGATGGCCATTCGGGCTCAGCACAGCAACGCA<br>GCCCAGACTCAGACTGGGGAAGCAAACAGGGGCT<br>GGACAGGCCAGGAGAGCCTGTCGGACAGTGATCC<br>TGAGATGTGGGAGTTGCTGCAGAGGGAGAAGGAC<br>AGGCAGTGTCGTGGCCTGGAGCTCATTGCCTCAG<br>AGAACTTCTGCAGCCGAGCTGCGCTGGAGGCCCT<br>GGGGTCCTGTCTGAACAACAAGTACTCGGAGGGT<br>TATCCTGGCAAGAGATACTATGGGGGAGCAGAGG<br>TGGTGGATGAAATTGAGCTGCTGTGCCAGCGCCG<br>GGCCTTGGAAGCCTTTGACCTGGATCCTGCACAGT<br>GGGGAGTCAATGTCCAGCCCTACTCCGGGTCCCC<br>AGCCAACCTGGCCGTCTACACAGCCCTTCTGCAA<br>CCTCACGACCGGATCATGGGGCTGGACCTGCCCG<br>ATGGGGGCCATCTCACCCACGGTACATGTCTGAC<br>GTCAAGCGGATATCAGCCACGTCCATCTTCTTCGA<br>GTCTATGCCCTATAAGCTCAACCCCAAAACTGGCC<br>TCATTGACTACAACCAGCTGGCACTGACTGCTCGA<br>CTTTTCCGGCCACGGCTCATCATAGCTGGCACCAG<br>CGCCTATGCTCGCCTCATTGACTACGCCCGCATGA<br>GAGAGGTGTGTGATGAAGTCAAAGCACACCTGCT<br>GGCAGACATGGCCCACATCAGTGGCCTGGTGGCT<br>GCCAAGGTGATTCCCTCGCCTTTCAAGCACGCGG<br>ACATCGTCACCACCACTACTCACAAGACTCTTCGA<br>GGGGCCAGGTCAGGGCTCATCTTCTACCGGAAAG<br>GGGTGAAGGCTGTGGACCCCAAGACTGGCCGGG<br>AGATCCCTTACACATTTGAGGACCGAATCAACTTT<br>GCCGTGTTCCCATCCCTGCAGGGGGGCCCCCACA<br>ATCATGCCATTGCTGCAGTAGCTGTGGCCC | 35 | TCLTSSGY<br>QPRPSSSS<br>LCPISSTPK<br>LASLTTTS<br>WH* |
| 1450 | NM_0054<br>12.4_565 | 565 | CCGAGTTGCGATGCTGTACTTCTCTTTGTTTTGGG<br>CGGCTCGGCCTCTGCAGAGATGTGGGCAGCTGGT<br>CAGGATGGCCATTCGGGCTCAGCACAGCAACGCA<br>GCCCAGACTCAGACTGGGGAAGCAAACAGGGGCT<br>GGACAGGCCAGGAGAGCCTGTCGGACAGTGATCC<br>TGAGATGTGGGAGTTGCTGCAGAGGGAGAAGGAC<br>AGGCAGTGTCGTGGCCTGGAGCTCATTGCCTCAG<br>AGAACTTCTGCAGCCGAGCTGCGCTGGAGGCCCT<br>GGGGTCCTGTCTGAACAACAAGTACTCGGAGGGT<br>TATCCTGGCAAGAGATACTATGGGGGAGCAGAGG<br>TGGTGGATGAAATTGAGCTGCTGTGCCAGCGCCG<br>GGCCTTGGAAGCCTTTGACCTGGATCCTGCACAGT<br>GGGGAGTCAATGTCCAGCCCTACTCCGGGTCCCC<br>AGCCAACCTGGCCGTCTACACAGCCCTTCTGCAA<br>CCTCACGACCGGATCATGGGGCTGGACCTGCCCG<br>ATGGGGGCCATCTCACCCACGGTACATGTCTGA<br>CGTCAAGCGGATATCAGCACGTCCATCTTCTTCGA<br>GTCTATGCCCTATAAGCTCAACCCCAAAACTGGCC<br>TCATTGACTACAACCAGCTGGCACTGACTGCTCGA<br>CTTTTCCGGCCACGGCTCATCATAGCTGGCACCAG<br>CGCCTATGCTCGCCTCATTGACTACGCCCGCATGA<br>GAGAGGTGTGTGATGAAGTCAAAGCACACCTGCT<br>GGCAGACATGGCCCACATCAGTGGCCTGGTGGCT<br>GCCAAGGTGATTCCCTCGCCTTTCAAGCACGCGG<br>ACATCGTCACCACCACTACTCACAAGACTCTTCGA<br>GGGGCCAGGTCAGGGCTCATCTTCTACCGGAAAG<br>GGGTGAAGGCTGTGGACCCCAAGACTGGCCGGG<br>AGATCCCTTACACATTTGAGGACCGAATCAACTTT<br>GCCGTGTTCCCATCCCTGCAGGGGGGCCCCCACA<br>ATCATGCCATTGCTGCAGTAGCTGTGGCCC | 25 | RPSSSSLC<br>PISSTPKLA<br>SLTTTSWH* |
| 1451 | NM_0054<br>39.1_343 | 343 | GCCGAGGGGGCGTACGGAGGTGGCAGCTGTGG<br>GAGGAGGCGGCGTGGAAGGCCGAGGAGCTCAAG<br>CCCGGACCAATCCCCACGTTCCGGGCCGCGACCC<br>TGACCCTGCAGCGTACCGGGAAGCGAAACCGGCC<br>GGATGGGCCGCTGAGCCCGAATCGGGCACTGTGT<br>GGAGCCCCCTGGAGCTGAGATCAGGATGTTCCGC<br>TTCATGAGGGACGTGGAGCCTGAGGATCCCATGT<br>TCCTGATGGATCCCTTTGCTATTCACCGTCAGCAT | 31 | PGLPAAGC<br>SRLELSPP<br>LGCWECR<br>VVSWTCL<br>G* |

TABLE 3A-continued

| SEQ ID | identifier_position | position | modified_RNA | PAP length | PAP |
|---|---|---|---|---|---|
| | | | ATGAGCCGTATGTTGTCAGGTGGCTTTGGATATAG | | |
| | | | CCCCTTCCTCAGCATCACAGATGGCAACATGCCAG | | |
| | | | GACCAGGCCTGCCAGCCGCCGGATGCAGCAGGC | | |
| | | | TGGAGCTGTCTCCCCCTTTGGGATGCTGGGAATGT | | |
| | | | CGGGTGGTTTCATGGACATGTTTGGGATGATGAAT | | |
| | | | GACATGATTGGAAACATGGAACACATGACAGCTGG | | |
| | | | AGGCAATTGCCAGACCTTCTCATCTTCCACTGTCA | | |
| | | | TCTCCTACTCCAATACGGGTGATGGTGCCCCCAAG | | |
| | | | GTCTACCAAGAGACATCAGAGATGCGCTCGGCAC | | |
| | | | CAGGCGGGATCCGGGAGACACGGAGGACTGTTC | | |
| | | | GGGATTCAGACAGTGGACTGGAGCAGATGTCCAT | | |
| | | | TGGGCATCACATCCGGGACAGGGCTCACATCCTC | | |
| | | | CAGCGCTCCCGAAACCATCGCACGGGGGACCAG | | |
| | | | GAGGAGCGGCAGGACTATATCAACCTGGATGAGA | | |
| | | | GTGAGGCCGCAGCGTTTGATGACGAGTGGCGGC | | |
| | | | GGGAGACCTCCCGATTCCGGCAGCAGCGTCCCCT | | |
| | | | GGAGTTTCGGCGGCTTGAGTCCTCAGGGGCTGGG | | |
| | | | GGACGAAGGGCGGAGGGGCCTCCCCGCCTGGCC | | |
| | | | ATCCAGGGACCTGAGGACTCCCCTTCCCGACAGT | | |
| | | | CCCGCCGCTATGACTGGTGAGGCCCCGGGCCCTC | | |
| | | | AGCCTCTCTTGTACAGGCTGAGAGGCTGAGAAATC | | |
| | | | ATCCCCTGAATAACTTTTTCCTCTCGATTCCCATCC | | |
| 1452 | NM_005439.1433 | 433 | GCCGAGGGGGGCGTACGGAGGTGGCAGCTGTGG | 2 | LG* |
| | | | GAGGAGGCGGCGTGGAAGGCCGAGGAGCTCAAG | | |
| | | | CCCGGACCAATCCCCACGTTCCGGGCCGCGACCC | | |
| | | | TGACCCTGCAGCGTACCGGGAAGCGAAACCGGCC | | |
| | | | GGATGGGCCGCTGAGCCCGAATCGGGCACTGTGT | | |
| | | | GGAGCCCCTGGAGCTGAGATCAGGATGTTCCGC | | |
| | | | TTCATGAGGGACGTGGAGCCTGAGGATCCCATGT | | |
| | | | TCCTGATGGATCCCTTTGCTATTCACCGTCAGCAT | | |
| | | | ATGAGCCGTATGTTGTCAGGTGGCTTTGGATATAG | | |
| | | | CCCCTTCCTCAGCATCACAGATGGCAACATGCCAG | | |
| | | | GGACCAGGCCTGCCAGCCGCCGGATGCAGCAGG | | |
| | | | CTGGAGCTGTCTCCCCCTTTGGGATGCTGGGAAT | | |
| | | | GTCGGGTGGTTTCATGGACATGTTTGGGATGATGAA | | |
| | | | TGACATGATTGGAAACATGGAACACATGACAGCTG | | |
| | | | GAGGCAATTGCCAGACCTTCTCATCTTCCACTGTC | | |
| | | | ATCTCCTACTCCAATACGGGTGATGGTGCCCCCAA | | |
| | | | GGTCTACCAAGAGACATCAGAGATGCGCTCGGCA | | |
| | | | CCAGGCGGGATCCGGGAGACACGGAGGACTGTT | | |
| | | | CGGGATTCAGACAGTGGACTGGAGCAGATGTCCA | | |
| | | | TTGGGCATCACATCCGGGACAGGGCTCACATCCT | | |
| | | | CCAGCGCTCCCGAAACCATCGCACGGGGGACCAG | | |
| | | | GAGGAGCGGCAGGACTATATCAACCTGGATGAGA | | |
| | | | GTGAGGCCGCAGCGTTTGATGACGAGTGGCGGC | | |
| | | | GGGAGACCTCCCGATTCCGGCAGCAGCGTCCCCT | | |
| | | | GGAGTTTCGGCGGCTTGAGTCCTCAGGGGCTGGG | | |
| | | | GGACGAAGGGCGGAGGGGCCTCCCCGCCTGGCC | | |
| | | | ATCCAGGGACCTGAGGACTCCCCTTCCCGACAGT | | |
| | | | CCCGCCGCTATGACTGGTGAGGCCCCGGGCCCTC | | |
| | | | AGCCTCTCTTGTACAGGCTGAGAGGCTGAGAAATC | | |
| | | | ATCCCCTGAATAACTTTTTCCTCTCGATTCCCATCC | | |
| 1453 | NM_005471.3_129 | 129 | GCAGTCGCTGCAGCCGCCGCGGGAGGCGTCGT | 21 | QRSTSPW GSPLGVPH LAATRS* |
| | | | GACAAGATGAAGCTCATCATCCTGGAGCACTATTC | | |
| | | | TCAGGCGAGCGAGTGGGCGGCTAAATACATCAGG | | |
| | | | AACCGCATCATCCAGTTTAACCCAGGCCAGAGAAG | | |
| | | | TACTTCACCCTGGGGCTCCCCACTGGGAGTACCC | | |
| | | | CACTTGGCTGCTACAAGAAGCTGATTGAATACTAT | | |
| | | | AAGAATGGGGACCTGTCCTTTAAATATGTGAAGAC | | |
| | | | CTTCAACATGGATGAGTACGTGGGCCTTCCTCGAG | | |
| | | | ACCACCCGGAGAGTTACCACTCCTTCATGTGGAAC | | |
| | | | AACTTCTTCAAGCACATTGACATCCACCCAGAAAA | | |
| | | | CACCCACATTCTGGATGGGAATGCAGTCGACCTAC | | |
| | | | AGGCAGAATGTGATGCCTTTGAAGAGAAGATCAAG | | |
| | | | GCTGCAGGTGGGATCGAGCTATTTGTTGGAGGCA | | |
| | | | TCGGCCCTGATGGACACATTGCCTTCAACGAGCC | | |
| | | | AGGCTCCAGTCTGGTGTCCAGGACCCGTGTGAAG | | |
| | | | ACGCTGGCCATGGATACCATCCTGGCCAATGCTA | | |
| | | | GGTTCTTCGATGGAGAACTCACCAAGGTGCCCAC | | |
| | | | CATGGCCTTGACGGTGGGGGTGGGCACTGTCATG | | |
| | | | GATGCTAGAGAGGTGATGATCCTTATCACAGGTGC | | |
| | | | TCACAAGGCATTTGCTCTGTACAAGGCCATCGAGG | | |
| | | | AGGGAGTGAACCACATGTGGACCGTGTCTGCCTT | | |
| | | | CCAGCAGCATCCCCGCACCGTGTTTGTGTGTGAC | | |
| | | | GAGGATGCCACCTTGGAGCTGAAAGTGAAGACTG | | |
| | | | TCAAGTATTTCAAAGGGTTTAATGCTTGTTCATAACA | | |
| | | | AGTTGGTGGACCCCTTGTACAGTATCAAAGAGAAA | | |

TABLE 3A-continued

| SEQ ID | identifier_position | position | modified_RNA | PAP length | PAP |
|---|---|---|---|---|---|
| | | | GAAACTGAGAAAAGCCAATCTTCGAAGAAACCATA | | |
| | | | CAGCGATTAGCCTGTGCTGGGACCTAGTGTCAAGT | | |
| | | | ACCCATAGGGAAAGGCAGGTCTTTCTGGAAATTGT | | |
| | | | CTTTAGAAGAAAGAATTGTATTTCTTTAATCTAGTAT | | |
| | | | GGTTACTCCAGATAAGTGG | | |
| 1454 | NM_0055 00.1_454 | 454 | TTGGCTTGAGCGGGACCGGAGCTTGAGGCAGGAA GAGCCGGCGCCATGGTGGAGAAGGAGGAGGCTG GCGGCGGCATTAGCGAGGAGGAGGCGGCACAGT ATGACCGGCAGATCCGCCTGTGGGGACTGGAGGC CCAGAAACGGCTGCGGGCCTCTCGGGTGCTTCTT GTCGGCTTGAAAGGACTTGGGGCTGAAATTGCCA AGAATCTCATCTTGGCAGGAGTGAAAGGACTGACC ATGCTGGATCACGAACAGGTAACTCCAGAAGATCC CGGAGCTCAGTTCTTGATTCGTACTGGGTCTGTTG GCCGAAATAGGGCTGAAGCCTCTTTGGAGCGAGC TCAGAATCTCAACCCCATGGTGGATGTGAAGGTG GACACTGAGGATATAGAGAAGAAACCAGAGTCATT TTTCACTCAATTCGATGCTGTGTGTCTGACTTGCTG CTCCAGGATGTCATAGTTAAAGTTGACCAGATCTG TCACAAAAATAGCATCAAGTTCTTTACAGGAGATGT TTTTGGCTACCATGGATACACATTTGCCAATCTAG GAGAGCATGAGTTTGTAGAGGAGAAAACTAAAGTT GCCAAAGTTAGCCAAGGAGTAGAAGATGGGCCCG ACACCAAGAGAGCAAAACTTGATTCTTCTGAGACA ACGATGGTCAAAAAGAAGGTGGTCTTCTGCCCTGT TAAAGAAGCCCTGGAGGTGGACTGGAGCAGTGAG AAAGCAAAGGCTGCTCTGAAGCGCACGACCTCCG ACTACTTTCTCCTTCAAGTGCTCTTAAAGTTCCGTA CAGATAAAGGAAGAGATCCCAGTTCTGATACATAT GAGGAAGATTCTGAGTTGTTGCTCCAGATACGAAA TGATGTGCTTGACTCACTGGGTATTAGTCCTGACC TGCTTCCTGAGGACTTTGTCAGGTACTGCTTCTCC GAGATGGCCCCAGTGTGTGCGGTGGTTGGAGGGA TTTTGGCACAGGAAATTGTGAAGGCCCTGTCTCAG CGGGACCCTCCTCACAACAA | 2 | MS* |
| 1455 | NM_0055 00.1_522 | 522 | TTGGCTTGAGCGGGACCGGAGCTTGAGGCAGGAA GAGCCGGCGCCATGGTGGAGAAGGAGGAGGCTG GCGGCGGCATTAGCGAGGAGGAGGCGGCACAGT ATGACCGGCAGATCCGCCTGTGGGGACTGGAGGC CCAGAAACGGCTGCGGGCCTCTCGGGTGCTTCTT GTCGGCTTGAAAGGACTTGGGGCTGAAATTGCCA AGAATCTCATCTTGGCAGGAGTGAAAGGACTGACC ATGCTGGATCACGAACAGGTAACTCCAGAAGATCC CGGAGCTCAGTTCTTGATTCGTACTGGGTCTGTTG GCCGAAATAGGGCTGAAGCCTCTTTGGAGCGAGC TCAGAATCTCAACCCCATGGTGGATGTGAAGGTG GACACTGAGGATATAGAGAAGAAACCAGAGTCATT TTTCACTCAATTCGATGCTGTGTGTCTGACTTGCTG CTCCAGGGATGTCATAGTTAAAGTTGACCAGATCT GTCACAAAAATAGCATCAAGTTCTTTACAGGAGAT GTTTTGGCTACCATGGATACACATTTGCCAATCTA GGAGAGCATGAGTTTGTAGAGGAGAAAACTAAAGT TGCCAAAGTTAGCCAAGGAGTAGAAGATGGGCCC GACACCAAGAGAGCAAAACTTGATTCTTCTGAGAC AACGATGGTCAAAAAGAAGGTGGTCTTCTGCCCTG TTAAAGAAGCCCTGGAGGTGGACTGGAGCAGTGA GAAAGCAAAGGCTGCTCTGAAGCGCACGACCTCC GACTACTTTCTCCTTCAAGTGCTCTTAAAGTTCCGT ACAGATAAAGGAAGAGATCCCAGTTCTGATACATA TGAGGAAGATTCTGAGTTGTTGCTCCAGATACGAA ATGATGTGCTTGACTCACTGGGTATTAGTCCTGAC CTGCTTCCTGAGGACTTTGTCAGGTACTGCTTCTC CGAGATGGCCCCAGTGTGTGCGGTGGTTGGAGGG ATTTTGGCACAGGAAATTGTGAAGGCCCTGTCTCA GCGGGACCCTCCTCACAACAA | 10 | LATMDTHL PI* |
| 1456 | NM_0055 00.1_567 | 567 | TTGGCTTGAGCGGGACCGGAGCTTGAGGCAGGAA GAGCCGGCGCCATGGTGGAGAAGGAGGAGGCTG GCGGCGGCATTAGCGAGGAGGAGGCGGCACAGT ATGACCGGCAGATCCGCCTGTGGGGACTGGAGGC CCAGAAACGGCTGCGGGCCTCTCGGGTGCTTCTT GTCGGCTTGAAAGGACTTGGGGCTGAAATTGCCA AGAATCTCATCTTGGCAGGAGTGAAAGGACTGACC ATGCTGGATCACGAACAGGTAACTCCAGAAGATCC CGGAGCTCAGTTCTTGATTCGTACTGGGTCTGTTG GCCGAAATAGGGCTGAAGCCTCTTTGGAGCGAGC TCAGAATCTCAACCCCATGGTGGATGTGAAGGTG GACACTGAGGATATAGAGAAGAAACCAGAGTCATT | 1 | L* |

TABLE 3A-continued

| SEQ ID | identifier_position | position | modified_RNA | PAP length | PAP |
|---|---|---|---|---|---|
| | | | TTTCACTCAATTCGATGCTGTGTGTCTGACTTGCTG<br>CTCCAGGGATGTCATAGTTAAAGTTGACCAGATCT<br>GTCACAAAAATAGCATCAAGTTCTTTACAGGAGAT<br>GTTTTTGGCTACCATGGATACACATTTGCCAATCTA<br>GGAGAGCATGAGTTGTAGAGGAGAAAACTAAAGTT<br>GCCAAAGTTAGCCAAGGAGTAGAAGATGGGCCCG<br>ACACCAAGAGAGCAAAACTTGATTCTTCTGAGACA<br>ACGATGGTCAAAAAGAAGGTGGTCTTCTGCCCTGT<br>TAAAGAAGCCCTGGAGGTGGACTGGAGCAGTGAG<br>AAAGCAAAGGCTGCTCTGAAGCGCACGACCTCCG<br>ACTACTTTCTCCTTCAAGTGCTCTTAAAGTTCCGTA<br>CAGATAAAGGAAGAGATCCCAGTTCTGATACATAT<br>GAGGAAGATTCTGAGTTGTTGCTCCAGATACGAAA<br>TGATGTGCTTGACTCACTGGGTATTAGTCCTGACC<br>TGCTTCCTGAGGACTTTGTCAGGTACTGCTTCTCC<br>GAGATGGCCCCAGTGTGTGCGGTGGTTGGAGGGA<br>TTTTGGCACAGGAAATTGTGAAGGCCCTGTCTCAG<br>CGGGACCCTCCTCACAACAA | | |
| 1457 | NM_0055<br>07.2_447 | 447 | GGCCGGCGGGAAGACTCCGTTACCCAGCGAGCG<br>AGGCGGCGGCGCAGGGCCAGCGGACTCCATTTC<br>CCGTCGGCTCGCGGTGGGAGCGCCGGAAGCCCG<br>CCCCACCCCTCATTGTGCGGCTCCTACTAAACGGA<br>AGGGGCCGGGAGAGGCCGCGTTCAGTCGGGTCC<br>CGGCAGCGGCTGCAGCGCTCTCGTCTTCTGCGGC<br>TCTCGGTGCCCTCTCCTTTTCGTTTCCGGAAACAT<br>GGCCTCCGGTGTGGCTGTCTCTGATGGTGTCATC<br>AAGGTGTTCAACGACATGAAGGTGCGTAAGTCTTC<br>AACGCCAGAGGAGGTGAAGAAGCGCAAGAAGGC<br>GGTGCTCTTCTGCCTGAGTGAGGACAAGAAGAAC<br>ATCATCCTGGAGGAGGGCAAGGAGATCCTGGTGG<br>GCGATGTGGGCCAGACTGTCGACGACCCCTACGC<br>CACCTTGTCAAGATGCTGCCAGATAAGGACTGCC<br>GCTATGCCCTCTATGATGCAACCTATGAGACCAAG<br>GAGAGCAAGAAGGAGGATCTGGTGTTTATCTTCTG<br>GGCCCCCGAGTCTGCGCCCCTTAAGAGCAAAATG<br>ATTTATGCCAGCTCCAAGGACGCCATCAAGAAGAA<br>GCTGACAGGGATCAAGCATGAATTGCAAGCAAACT<br>GCTACGAGGAGGTCAAGGACCGCTGCACCCTGGC<br>AGAGAAGCTGGGGGGCAGTGCCGTCATCTCCCTG<br>GAGGGCAAGCCTTTGTGAGCCCCTTCTGGCCCCC<br>TGCCTGGAGCATCTGGCAGCCCCACACCTGCCCT<br>TGGGGGTTGCAGGCTGCCCCCTTCCTGCCAGACC<br>GGAGGGGCTGGGGGGATCCCAGCAGGGGGAGG<br>GCAATCCCTTCACCCCAGTTGCCAAACAGACCCCC<br>CACCCCCTGGATTTTCCTTCTCCCTCCATCCCTTG<br>ACGGTTCTGGCCTTCCCAAACTGCTTTTGATCTTTT<br>GATTCCTCTTGGGCTGAAGCAGACCAAGTTCCCCC<br>CAGGCACCCCAGTTGTGGGGGAGCCTGTATTTT | 44 | LSRCCQIR<br>TAAMPSM<br>MQPMRPR<br>RARRRIWC<br>LSSGPPSL<br>RPLRAK* |
| 1458 | NM_0055<br>07.2_672 | 672 | GGCCGGCGGGAAGACTCCGTTACCCAGCGAGCG<br>AGGCGGCGGCGCAGGGCCAGCGGACTCCATTTC<br>CCGTCGGCTCGCGGTGGGAGCGCCGGAAGCCCG<br>CCCCACCCCTCATTGTGCGGCTCCTACTAAACGGA<br>AGGGGCCGGGAGAGGCCGCGTTCAGTCGGGTCC<br>CGGCAGCGGCTGCAGCGCTCTCGTCTTCTGCGGC<br>TCTCGGTGCCCTCTCCTTTTCGTTTCCGGAAACAT<br>GGCCTCCGGTGTGGCTGTCTCTGATGGTGTCATC<br>AAGGTGTTCAACGACATGAAGGTGCGTAAGTCTTC<br>AACGCCAGAGGAGGTGAAGAAGCGCAAGAAGGC<br>GGTGCTCTTCTGCCTGAGTGAGGACAAGAAGAAC<br>ATCATCCTGGAGGAGGGCAAGGAGATCCTGGTGG<br>GCGATGTGGGCCAGACTGTCGACGACCCCTACGC<br>CACCTTTGTCAAGATGCTGCCAGATAAGGACTGCC<br>GCTATGCCCTCTATGATGCAACCTATGAGACCAAG<br>GAGAGCAAGAAGGAGGATCTGGTGTTTATCTTCTG<br>GGCCCCCGAGTCTGCGCCCCTTAAGAGCAAAATG<br>ATTTATGCCAGCTCCAAGGACGCCATCAAGAAGAA<br>GCTGACAGGGATCAAGCATGAATTGCAAGCAAACT<br>GCTACGAGGAGGTCAAGGACCGTGCACCCTGGCA<br>GAGAAGCTGGGGGGCAGTGCCGTCATCTCCCTGG<br>AGGGCAAGCCTTTGTGAGCCCCTTCTGGCCCCCT<br>GCCTGGAGCATCTGGCAGCCCCACACCTGCCCTT<br>GGGGGTTGCAGGCTGCCCCCTTCCTGCCAGACCG<br>GAGGGGCTGGGGGATCCCAGCAGGGGGAGGGC<br>AATCCCTTCACCCCAGTTGCCAAACAGACCCCCCA<br>CCCCCTGGATTTTCCTTCTCCCTCCATCCCTTGAC<br>GGTTCTGGCCTTCCCAAACTGCTTTTGATCTTTTGA | 82 | APWQRSW<br>GAVPSSP<br>WRASLCE<br>PLLAPCLE<br>HLAAPHLP<br>LGVAGCPL<br>PARPEGLG<br>GSQQGEG<br>NPFTPVAK<br>QTPHPLDF<br>PSPSIP* |

TABLE 3A-continued

| SEQ ID | identifier_position | position | modified_RNA | PAP length | PAP |
|---|---|---|---|---|---|
| 1459 | NM_0055 14.5_1064 | 1064 | TTCCTCTTGGGCTGAAGCAGACCAAGTTCCCCCA GGCACCCCAGTTGTGGGGGAGCCTGTATTTT ATGCTGGTCATGGCGCCCCGAACCGTCCTCCTGC TGCTCTCGGCGGCCCTGGCCCTGACCGAGACCTG GGCCGGCTCCCACTCCATGAGGTATTTCTACACCT CCGTGTCCCGGCCCGGCCGCGGGGAGCCCCGCT TCATCTCAGTGGGCTACGTGGACGACACCCAGTTC GTGAGGTTCGACAGCGACGCCGCGAGTCCGAGA GAGGAGCCGCGGGCGCCGTGGATAGAGCAGGAG GGGCCGGAGTATTGGGACCGGAACACACAGATCT ACAAGGCCCAGGCACAGACTGACCGAGAGAGCCT GCGGAACCTGCGCGGCTACTACAACCAGAGCGAG GCCGGGTCTCACACCCTCCAGAGCATGTACGGCT GCGACGTGGGGCCGGACGGGCGCCTCCTCCGCG GGCATGACCAGTACGCCTACGACGGCAAGGATTA CATCGCCCTGAACGAGGACCTGCGCTCCTGGACC GCCGCGGACACGGCGGCTCAGATCACCCAGCGC AAGTGGGAGGCGGCCCGTGAGGCGGAGCAGCGG AGAGCCTACCTGGAGGGCGAGTGCGTGGAGTGG CTCCGCAGATACCTGGAGAACGGGAAGGACAAGC TGGAGCGCGCTGACCCCCCAAAGACACACGTGAC CCACCACCCCATCTCTGACCATGAGGCCACCCTG AGGTGCTGGGCCCTGGGTTTCTACCCTGCGGAGA TCACACTGACCTGGCAGCGGGATGGCGAGGACCA AACTCAGGACACTGAGCTTGTGGAGACCAGACCA GCAGGAGATAGAACCTTCCAGAAGTGGGCAGCTG TGGTGGTGCCTTCTGGAGAAGAGCAGAGATACAC ATGCCATGTACAGCATGAGGGGCTGCCGAAGCCC CTCACCCTGAGATGGGAGCCGTCTTCCCAGTCCA CCGTCCCATCGTGGGCATTGTGCTGGCCTGGC TGTCCTAGCAGTTGTGGTCATCGGAGCTGTGGTC GCTGCTGTGATGTGTAGGAGGAAGAGTTCAGGTG GAAAAGGAG | 16 | ALMCLSQL EKPETAVL* |
| 1460 | NM_0055 16.4_306 | 306 | CGGACTCAAGAAGTTCTCAGGACTCAGAGGCTGG GATCATGGTAGATGGAACCCTCCTTTTACTCCTCT CGGAGGCCCTGGCCCTTACCCAGACCTGGGCGG GCTCCCACTCCTTGAAGTATTTCCACACTTCCGTG TCCCGGCCCGGCCGCGGGGAGCCCCGCTTCATCT CTGTGGGCTACGTGGACGACACCCAGTTCGTGCG CTTCGACAACGACGCCGCGAGTCCGAGGATGGTG CCGCGGGCGCCGTGGATGGAGCAGGAGGGGTCA GAGTATTGGGACCGGGAGACACGGAGCGCCAGG ACACCGCACAGATTTTCCGAGTGAACCTGCGGAC GCTGCGCGGCTACTACAATCAGAGCGAGGCCGGG TCTCACACCCTGCAGTGGATGCATGGCTGCGAGC TGGGGCCCGACGGGCGCTTCCTCCGCGGGTATGA ACAGTTCGCCTACGACGGCAAGGATTATCTCACCC TGAATGAGGACCTGCGCTCCTGGACCGCGGTGGA CACGGCGGCTCAGATCTCCGAGCAAAAGTCAAAT GATGCCTCTGAGGCGGAGCACCAGAGAGCCTACC TGGAAGACACATGCGTGGAGTGGCTCCACAAATA CCTGGAGAAGGGGAAGGAGACGCTGCTTCACCTG GAGCCCCCAAAGACACACGTGACTCACCACCCCA TCTCTGACCATGAGGCCACCCTGAGGTGCTGGGC CCTGGGCTTCTACCCTGCGGAGATCACACTGACCT GGCAGCAGGATGGGGAGGGCCATACCCAGGACA CGGAGCTCGTGGAGACCAGGCCTGCAGGGGATG GAACCTTCCAGAAGTGGGCAGCTGTGGTGGTGCC TTCTGGAGAGGAGCAGAGATACACGTGCCATGTG CAGCATGAGGGGCTACCCGAGCCCGTCACCCTGA GATGGAAGCCGGCTTCCCAGCCCACCATCCCCAT CGTGGGCATCATTGCTGGCCTGGTTCTCCTTGGAT CTGTGGTCTCTGGAGCTGTGGTTGCTGCTGTGATA TGG | 7 | TPHRFSE* |
| 1461 | NM_0055 16.4_680 | 680 | CGGACTCAAGAAGTTCTCAGGACTCAGAGGCTGG GATCATGGTAGATGGAACCCTCCTTTTACTCCTCT CGGAGGCCCTGGCCCTTACCCAGACCTGGGCGG GCTCCCACTCCTTGAAGTATTTCCACACTTCCGTG TCCCGGCCCGGCCGCGGGGAGCCCCGCTTCATCT CTGTGGGCTACGTGGACGACACCCAGTTCGTGCG CTTCGACAACGACGCCGCGAGTCCGAGGATGGTG CCGCGGGCGCCGTGGATGGAGCAGGAGGGGTCA GAGTATTGGGACCGGGAGACACGGAGCGCCAGG GACACCGCACAGATTTTCCGAGTGAACCTGCGGA CGCTGCGCGGCTACTACAATCAGAGCGAGGCCGG GTCTCACACCCTGCAGTGGATGCATGGCTGCGAG CTGGGGCCCGACGGGCGCTTCCTCCGCGGGTAT | 7 | SLTMRPP* |

TABLE 3A-continued

| SEQ ID | identifier_position | position | modified_RNA | PAP length | PAP |
|---|---|---|---|---|---|
| | | | GAACAGTTCGCCTACGACGGCAAGGATTATCTCAC<br>CCTGAATGAGGACCTGCGCTCCTGGACCGCGGTG<br>GACACGGCGGCTCAGATCTCCGAGCAAAAGTCAA<br>ATGATGCCTCTGAGGCGGAGCACCAGAGAGCCTA<br>CCTGGAAGACACATGCGTGGAGTGGCTCCACAAA<br>TACCTGGAGAAGGGGAAGGAGACGCTGCTTCACC<br>TGGAGCCCCCAAAGACACACGTGACTCACCACCC<br>ATCTCTGACCATGAGGCCACCCTGAGGTGCTGGG<br>CCCTGGGCTTCTACCCTGCGGAGATCACACTGAC<br>CTGGCAGCAGGATGGGGAGGGCCATACCCAGGA<br>CACGGAGCTCGTGGAGACCAGGCCTGCAGGGGA<br>TGGAACCTTCCAGAAGTGGGCAGCTGTGGTGGTG<br>CCTTCTGGAGAGGAGCAGAGATACACGTGCCATG<br>TGCAGCATGAGGGGCTACCCGAGCCCGTCACCCT<br>GAGATGGAAGCCGGCTTCCCAGCCCACCATCCCC<br>ATCGTGGGCATCATTGCTGGCCTGGTTCTCCTTGG<br>ATCTGTGGTCTCTGGAGCTGTGGTTGCTGCTGTGA<br>TATGG | | |
| 1462 | NM_0055<br>20.1_246 | 246 | TTTTTTTTTTCGTCTTAGCCACGCAGAAGTCGCGTG<br>TCTAGTTTGTTTCGACGCCGGACCGCGTAAGAGAC<br>GATGATGTTGGGCACGGAAGGTGGAGAGGGATTC<br>GTGGTGAAGGTCCGGGGCTTGCCCTGGTCTTGCT<br>CGGCCGATGAAGTGCAGAGGTTTTTTTCTGACTGC<br>AAAATTCAAAATGGGGCTCAAGGTATTCGTTTCAT<br>CTACACCAGAGAAGGCAGACCAAGTGGCGAGGCT<br>TTGTTGAACTTGAATCAGAAGATGAAGTCAAATTG<br>GCCCTGAAAAAAGACAGAGAAACTATGGGACACA<br>GATATGTTGAAGTATTCAAGTCAAACAACGTTGAAA<br>TGGATTGGGTGTTGAAGCATACTGGTCCAAATAGT<br>CCTGACACGGCCAATGATGGCTTTGTACGGCTTAG<br>AGGACTTCCCTTTGGATGTAGCAAGGAAGAAATTG<br>TTCAGTTCTTCTCAGGGTTGGAAATCGTGCCAAAT<br>GGGATAACATTGCCGGTGGACTTCCAGGGGAGGA<br>GTACGGGGGAGGCCTTCGTGCAGTTTGCTTCACA<br>GGAAATAGCTGAAAAGGCTCTAAAGAAACACAAGG<br>AAAGAATAGGGCACAGGTATATTGAAATCTTTAAG<br>AGCAGTAGAGCTGAAGTTAGAACTCATTATGATCC<br>ACCACGAAAGCTTATGGCCATGCAGCGGCCAGGT<br>CCTTATGACAGACCTGGGGCTGGTAGAGGGTATA<br>ACAGCATTGGCAGAGGAGCTGGCTTTGAGAGGAT<br>GAGGCGTGGTGCTTATGGTGGAGGCTATGGAGGC<br>TATGATGATTACAATGGCTATAATGATGGCTATGG<br>ATTTGGGTCAGATAGATTTGGAAGAGACCTCAATT<br>ACTGTTTTTCAGGAATGTCTGATCACAGATACGGG<br>GATGGTGGCTCTACTTTCCAGAGCACAACAGGACA<br>CTGTGTACACATGCGGGGATTACCTTACAGAGCTA<br>CTGAGAATGACATTTATAATTTTTTTCACCGCTCA<br>ACCCTGTGAGAGTACA | 13 | LLNLNQKM<br>KSNWP* |
| 1463 | NM_0055<br>20.1519 | 519 | TTTTTTTTTTCGTCTTAGCCACGCAGAAGTCGCGTG<br>TCTAGTTTGTTTCGACGCCGGACCGCGTAAGAGAC<br>GATGATGTTGGGCACGGAAGGTGGAGAGGGATTC<br>GTGGTGAAGGTCCGGGGCTTGCCCTGGTCTTGCT<br>CGGCCGATGAAGTGCAGAGGTTTTTTTCTGACTGC<br>AAAATTCAAAATGGGGCTCAAGGTATTCGTTTCAT<br>CTACACCAGAGAAGGCAGACCAAGTGGCGAGGCT<br>TTTGTTGAACTTGAATCAGAAGATGAAGTCAAATTG<br>GCCCTGAAAAAAGACAGAGAAACTATGGGACACA<br>GATATGTTGAAGTATTCAAGTCAAACAACGTTGAAA<br>TGGATTGGGTGTTGAAGCATACTGGTCCAAATAGT<br>CCTGACACGGCCAATGATGGCTTTGTACGGCTTAG<br>AGGACTTCCCTTTGGATGTAGCAAGGAAGAAATTG<br>TTCAGTTCTTCTCAGGGTTGGAAATCGTGCCAAAT<br>GGGATAACATTGCCGGTGGACTTCCAGGGAGGAG<br>TACGGGGGAGGCCTTCGTGCAGTTTGCTTCACAG<br>GAAATAGCTGAAAAGGCTCTAAAGAAACACAAGGA<br>AAGAATAGGGCACAGGTATATTGAAATCTTTAAGA<br>GCAGTAGAGCTGAAGTTAGAACTCATTATGATCCA<br>CCACGAAAGCTTATGGCCATGCAGCGGCCAGGTC<br>CTTATGACAGACCTGGGGCTGGTAGAGGGTATAA<br>CAGCATTGGCAGAGGAGCTGGCTTTGAGAGGATG<br>AGGCGTGGTGCTTATGGTGGAGGCTATGGAGGCT<br>ATGATGATTACAATGGCTATAATGATGGCTATGGA<br>TTTGGGTCAGATAGATTTGGAAGAGACCTCAATTA<br>CTGTTTTTCAGGAATGTCTGATCACAGATACGGGG<br>ATGGTGGCTCTACTTTCCAGAGCACAACAGGACAC<br>TGTGTACACATGCGGGGATTACCTTACAGAGCTAC | 14 | GVRGRPS<br>CSLLHRK* |

TABLE 3A-continued

| SEQ ID | identifier_position | position | modified_RNA | PAP length | PAP |
|---|---|---|---|---|---|
| | | | TGAGAATGACATTTATAATTTTTTTCACCGCTCAA<br>CCCTGTGAGAGTACA | | |
| 1464 | NM_0055<br>54.3337 | 337 | ATATTTCATACCTTTCTAGAAACTGGGTGTGATCTC<br>ACTGTTGGTAAAGCCCAGCCCTTCCCAACCTGCAA<br>GCTCACCTTCCAGGACTGGGCCCAGCCCATGCTC<br>TCCATATATAAGCTGCTGCCCCGAGCCTGATTCCT<br>AGTCCTGCTTCTCTTCCCTCTCTCCTCCAGCCTCT<br>CACACTCTCCTCAGCTCTCTCATCTCCTGGAACCA<br>TGGCCAGCACATCCACCACCATCAGGAGCCACAG<br>CAGCAGCCGCCGGGGTTTCAGTGCCAACTCAGCC<br>AGGCTCCCTGGGGTCAGCCGCTCTGGCTTCAGCA<br>GCGTCTCCGTGTCCCGCTCCAGGGCAGTGGTGGC<br>CTGGGTGGTGCATGTGGAGGAGCTGGCTTTGGCA<br>GCCGCAGTCTGTATGGCCTGGGGGGCTCCAAGAG<br>GATCTCCATTGGAGGGGGCAGCTGTGCCATCAGT<br>GGCGGCTATGGCAGCAGAGCCGGAGGCAGCTAT<br>GGCTTTGGTGGCGCCGGGAGTGGATTTGGTTTCG<br>GTGGTGGAGCCGGCATTGGCTTTGGTCTGGGTGG<br>TGGAGCCGGCCTTGCTGGTGGCTTTGGGGGCCCT<br>GGCTTCCCTGTGTGCCCCCCTGGAGGCATCCAAG<br>AGGTCACCGTCAACCAGAGTCTCCTGACTCCCCTC<br>AACCTGCAAATCGATCCCACCATCCAGCGGGTGC<br>GGGCTGAGGAGCGTGAACAGATCAAGACCCTCAA<br>CAACAAGTTTGCCTCCTTCATCGACAAGGTGCGGT<br>TCCTGGAGCAGCAGAACAAGGTTCTGGAAACAAA<br>GTGGACCCTGCTGCAGGAGCAGGGCACCAAGACT<br>GTGAGGCAGAACCTGGAGCCGTTGTTCGAGCAGT<br>ACATCAACAACCTCAGGAGGCAGCTGGACAGCAT<br>TGTCGGGGAACGGGGCCGCCTGGACTCAGAGCT<br>CAGAGGCATGCAGGACCTGGTGGAGGACTTCAAG<br>AACAAATATGAGGATGAAATCAACAAGCGCACAGC<br>AGCAGAGAATGAATTTGTGACTCTGAAGAAG | 102 | AVVAWVV<br>HVEELALA<br>AAVCMAW<br>GAPRGSPL<br>EGAAVPSV<br>AAMAAEPE<br>AAMALVAP<br>GVDLVSVV<br>EPALALVW<br>VVEPALLV<br>ALGALASL<br>CAPLEASK<br>RSPSTRVS* |
| 1465 | NM_0055<br>63.3_236 | 236 | GCTCTCGGCCAATGCGGAGCCCCGCGCGGAGGT<br>CACGTGCCTCTGTTTGGCGCTTTTGTGCGCGCCC<br>GGGTCTGTTGGTGCTCAGAGTGTGGTCAGGCGGC<br>TCGGACTGAGCAGGACTTTCCTTATCCCAGTTGAT<br>TGTGCAGAATACACTGCCTGTCGCTTGTCTTCTATT<br>CACCATGGCTTCTTCTGATATCCAGGTGAAAGAAC<br>TGGAGAAGCGTGCCTCAGGCCAGGCTTTGAGCTG<br>ATTCTCAGCCCTCGGTCAAAAGAATCTGTTCCAGA<br>ATTCCCCCTTTCCCCTCCAAAGAAGAAGGATCTTT<br>CCCTGGAGGAAATTCAGAAGAAATTAGAAGCTGCA<br>GAAGAAAGACGCAAGTCCCATGAAGCTGAGGTCT<br>TGAAGCAGCTGGCTGAGAAACGAGAGCACGAGAA<br>AGAAGTGCTTCAGAAGGCAATAGAAGAGAACAACA<br>ACTTCAGTAAAATGGCAGAAGAGAAACTGACCCAC<br>AAAATGGAAGCTAATAAAGAGAACCGAGAGGCACA<br>AATGGCTGCCAAACTGGAACGTTTGCGAGAGAAG<br>GATAAGCACATTGAAGAAGTGCGGAAGAACAAAGA<br>ATCCAAAGACCCTGCTGACGAGACTGAAGCTGACT<br>AATTTGTTCTGAGAACTGACTTTCTCCCCATCCCCT<br>TCCTAAATATCCAAAGACTGTACTGGCCAGTGTCA<br>TTTTATTTTTCCCTCCTGACAAATATTTTAGAAGCT<br>AATGTAGGACTGTATAGGTAGATCCAGATCCAGAC<br>TGTAAGATGTTGTTTTAGGGGCTAAAGGGGAGAAA<br>CTGAAAGTGTTTTACTCTTTTTCTAAAGTGTTGGTC<br>TTTCTAATGTAGCTATTTTTCTTGTTGCATCTTTTCT<br>ACTTCAGTACACTTGGTGTACTGGGTTAATGGCTA<br>GTACTGTATTGGCTCTGTGAAAACATATTTGTGAAA<br>AGAGTATGTAGTGGCTTCTTTTGAACTGTTAGATG<br>CTGAATATCTGTTCACTTTTCAATCCCAATTCTGTC<br>CCAATCTT | 2 | LS* |
| 1466 | NM_0055<br>63.3_526 | 526 | GCTCTCGGCCAATGCGGAGCCCCGCGCGGAGGT<br>CACGTGCCTCTGTTTGGCGCTTTTGTGCGCGCCC<br>GGGTCTGTTGGTGCTCAGAGTGTGGTCAGGCGGC<br>TCGGACTGAGCAGGACTTTCCTTATCCCAGTTGAT<br>TGTGCAGAATACACTGCCTGTCGCTTGTCTTCTATT<br>CACCATGGCTTCTTCTGATATCCAGGTGAAAGAAC<br>TGGAGAAGCGTGCCTCAGGCCAGGCTTTTGAGCT<br>GATTCTCAGCCCTCGGTCAAAAGAATCTGTTCCAG<br>AATTCCCCCTTTCCCCTCCAAAGAAGAAGGATCTT<br>TCCCTGGAGGAAATTCAGAAGAAATTAGAAGCTGC<br>AGAAGAAAGACGCAAGTCCCATGAAGCTGAGGTC<br>TTGAAGCAGCTGGCTGAGAAACGAGAGCACGAGA<br>AAGAAGTGCTTCAGAAGGCAATAGAAGAGAACAAC<br>AACTTCAGTAAAATGGCAGAAGAGAAACTGACCCA<br>CAAAATGGAAGCTAATAAAGAGAACCGAGAGGCA | 36 | VPNWNVC<br>ERRISTLKK<br>CGRTKNPK<br>TLLTRLKLT<br>NLF* |

TABLE 3A-continued

| SEQ ID | identifier_position | position | modified_RNA | PAP length | PAP |
|---|---|---|---|---|---|
| | | | CAAATGGTGCCAAACTGGAACGTTTGCGAGAGAA GGATAAGCACATTGAAGAAGTGCGGAAGAACAAA GAATCCAAAGACCCTGCTGACGAGACTGAAGCTG ACTAATTTGTTCTGAGAACTGACTTTCTCCCCATCC CCTTCCTAAATATCCAAAGACTGTACTGGCCAGTG TCATTTTATTTTTTCCCTCCTGACAAATATTTTAGAA GCTAATGTAGGACTGTATAGGTAGATCCAGATCCA GACTGTAAGATGTTGTTTTAGGGGCTAAAGGGGAG AAACTGAAAGTGTTTTACTCTTTTTCTAAAGTGTTG GTCTTTCTAATGTAGCTATTTTTCTTGTTGCATCTTT TCTACTTCAGTACACTTGGTGTACTGGGTTAATGG CTAGTACTGTATTGGCTCTGTGAAAACATATTTGTG AAAAGAGTATGTAGTGGCTTCTTTTGAACTGTTAGA TGCTGAATATCTGTTCACTTTTCAATCCCAATTCTG TCCCAATCTT | | |
| 1467 | NM_0055 63.3_530 | 530 | GCTCTCGGCCAATGCGGAGCCCCGCGCGGAGGT CACGTGCCTCTGTTTGGCGCTTTTGTGCGCGCCC GGGTCTGTTGGTGCTCAGAGTGTGGTCAGGCGGC TCGGACTGAGCAGGACTTTCCTTATCCCAGTTGAT TGTGCAGAATACACTGCCTGTCGCTTGTCTTCTATT CACCATGGCTTCTTCTGATATCCAGGTGAAAGAAC TGGAGAAGCGTGCCTCAGGCCAGGCTTTTGAGCT GATTCTCAGCCCTCGGTCAAAAGAATCTGTTCCAG AATTCCCCCTTTCCCCTCCAAAGAAGAAGGATCTT TCCCTGGAGGAAATTCAGAAGAAATTAGAAGCTGC AGAAGAAAAGACGCAAGTCCCATGAAGCTGAGGTC TTGAAGCAGCTGGCTGAGAAACGAGAGCACGAGA AAGAAGTGCTTCAGAAGGCAATAGAAGAGAACAAC AACTTCAGTAAAATGGCAGAAGAGAAACTGACCCA CAAAATGGAAGCTAATAAAGAGAACCGAGAGGCA CAAATGGCTGCAAACTGGAACGTTTGCGAGAGAA GGATAAGCACATTGAAGAAGTGCGGAAGAACAAA GAATCCAAAGACCCTGCTGACGAGACTGAAGCTG ACTAATTTGTTCTGAGAACTGACTTTCTCCCCATCC CCTTCCTAAATATCCAAAGACTGTACTGGCCAGTG TCATTTTATTTTTTCCCTCCTGACAAATATTTTAGAA GCTAATGTAGGACTGTATAGGTAGATCCAGATCCA GACTGTAAGATGTTGTTTTAGGGGCTAAAGGGGAG AAACTGAAAGTGTTTTACTCTTTTTCTAAAGTGTTG GTCTTTCTAATGTAGCTATTTTTCTTGTTGCATCTTT TCTACTTCAGTACACTTGGTGTACTGGGTTAATGG CTAGTACTGTATTGGCTCTGTGAAAACATATTTGTG AAAAGAGTATGTAGTGGCTTCTTTTGAACTGTTAGA TGCTGAATATCTGTTCACTTTTCAATCCCAATTCTG TCCCAATCTT | 34 | NWNVCER RISTLKKC GRTKNPKT LLTRLKLTN LF* |
| 1468 | NM_0055 63.3_544 | 544 | GCTCTCGGCCAATGCGGAGCCCCGCGCGGAGGT CACGTGCCTCTGTTTGGCGCTTTTGTGCGCGCCC GGGTCTGTTGGTGCTCAGAGTGTGGTCAGGCGGC TCGGACTGAGCAGGACTTTCCTTATCCCAGTTGAT TGTGCAGAATACACTGCCTGTCGCTTGTCTTCTATT CACCATGGCTTCTTCTGATATCCAGGTGAAAGAAC TGGAGAAGCGTGCCTCAGGCCAGGCTTTTGAGCT GATTCTCAGCCCTCGGTCAAAAGAATCTGTTCCAG AATTCCCCCTTTCCCCTCCAAAGAAGAAGGATCTT TCCCTGGAGGAAATTCAGAAGAAATTAGAAGCTGC AGAAGAAAAGACGCAAGTCCCATGAAGCTGAGGTC TTGAAGCAGCTGGCTGAGAAACGAGAGCACGAGA AAGAAGTGCTTCAGAAGGCAATAGAAGAGAACAAC AACTTCAGTAAAATGGCAGAAGAGAAACTGACCCA CAAAATGGAAGCTAATAAAGAGAACCGAGAGGCA CAAATGGCTGCAAACTGGAACGTTTGCGAGAGAA GGATAAGCACATTGAAGAAGTGCGGAAGAACAAA GAATCCAAAGACCCTGCTGACGAGACTGAAGCTG ACTAATTTGTTCTGAGAACTGACTTTCTCCCCATCC CCTTCCTAAATATCCAAAGACTGTACTGGCCAGTG TCATTTTATTTTTTCCCTCCTGACAAATATTTTAGAA GCTAATGTAGGACTGTATAGGTAGATCCAGATCCA GACTGTAAGATGTTGTTTTAGGGGCTAAAGGGGAG AAACTGAAAGTGTTTTACTCTTTTTCTAAAGTGTTG GTCTTTCTAATGTAGCTATTTTTCTTGTTGCATCTTT TCTACTTCAGTACACTTGGTGTACTGGGTTAATGG CTAGTACTGTATTGGCTCTGTGAAAACATATTTGTG AAAAGAGTATGTAGTGGCTTCTTTTGAACTGTTAGA TGCTGAATATCTGTTCACTTTTCAATCCCAATTCTG TCCCAATCTT | 30 | CERRISTL KKCGRTKN PKTLLTRL KLTNLF* |

TABLE 3A-continued

| SEQ ID | identifier_position | position | modified_RNA | PAP length | PAP |
|---|---|---|---|---|---|
| 1469 | NM_0055 66.1_175 | 175 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT GGGGTTGGTGCTGTTGGCATGGCCTGTGCCATCA GTATCTTAATGAAGGACTTGGCAGATGAACTTGCT CTTGTTGATGTCATCGAAGACAAATTGAAGGGAGA GATGATGGATCTCCAACATGGCAGCCTTTTCCTTA GAACACCAAAGATTGTCTCTGGCAAAGACTATAAT GTAACTGCAAACTCCAAGCTGGTCATTATCACGGC TGGGGCACGTCAGCAAGAGGGAGAAAGCCGTCTT AATTTGGTCCAGCGTAACGTGAACATATTTAAATTC ATCATTCCTAATGTTGTAAAATACAGCCCGAACTG CAAGTTGCTTATTGTTTCAAATCCAGTGGATATCTT GACCTACGTGGCTTGGAAGATAAGTGGTTTTCCCA AAAACCGTGTTATTGGAAGTGGTTGCAATCTGGAT TCAGCCCGATTCCGTTACCTGATGGGGGAAAGGC TGGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | 12 | LVLLAWPV PSVS* |
| 1470 | NM_0055 66.1_250 | 250 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTGATGTCATCGAAGACAAATTGAAGGGAGA GATGATGGATCTCCAACATGGCAGCCTTTTCCTTA GAACACCAAAGATTGTCTCTGGCAAAGACTATAAT GTAACTGCAAACTCCAAGCTGGTCATTATCACGGC TGGGGCACGTCAGCAAGAGGGAGAAAGCCGTCTT AATTTGGTCCAGCGTAACGTGAACATATTTAAATTC ATCATTCCTAATGTTGTAAAATACAGCCCGAACTG CAAGTTGCTTATTGTTTCAAATCCAGTGGATATCTT GACCTACGTGGCTTGGAAGATAAGTGGTTTTCCCA AAAACCGTGTTATTGGAAGTGGTTGCAATCTGGAT TCAGCCCGATTCCGTTACCTGATGGGGGAAAGGC TGGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | 6 | MSSKTN* |
| 1471 | NM_0055 66.1_270 | 270 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATGAAGGGAGA GATGATGGATCTCCAACATGGCAGCCTTTTCCTTA GAACACCAAAGATTGTCTCTGGCAAAGACTATAAT GTAACTGCAAACTCCAAGCTGGTCATTATCACGGC TGGGGCACGTCAGCAAGAGGGAGAAAGCCGTCTT AATTTGGTCCAGCGTAACGTGAACATATTTAAATTC ATCATTCCTAATGTTGTAAAATACAGCCCGAACTG CAAGTTGCTTATTGTTTCAAATCCAGTGGATATCTT GACCTACGTGGCTTGGAAGATAAGTGGTTTTCCCA AAAACCGTGTTATTGGAAGTGGTTGCAATCTGGAT | 0 | * |

TABLE 3A-continued

| SEQ ID | identifier_position | position | modified_RNA | PAP length | PAP |
|---|---|---|---|---|---|
| | | | TCAGCCCGATTCCGTTACCTGATGGGGGAAAGGC<br>TGGGAGTTCACCCATTAAGCTGTCATGGGTGGGTC<br>CTTGGGGAACATGGAGATTCCAGTGTGCCTGTATG<br>GAGTGGAATGAATGTTGCTGGTGTCTCTCTGAAGA<br>CTCTGCACCCAGATTTAGGGACTGATAAAGATAAG<br>GAACAGTGGAAAGAGGTTCACAAGCAGGTGGTTG<br>AGAGTGCTTATGAGGTGATCAAACTCAAAGGCTAC<br>ACATCCTGGGCTATTGGACTCTCTGTAGCAGATTT<br>GGCAGAGAGTATAATGAAGAATCTTAGGCGGGTG<br>CACCCAGTTTCCACCATGATTAAGGGTCTTTACGG<br>AATAAAGGATGATGTCTTCCTTAGTGTTCCTTGCAT<br>TTTGGGACAGAATGGAATCTCAGACCTTGTGAAGG<br>TGACTCTGACTT | | |
| 1472 | NM_0055<br>66.1_328 | 328 | TGCTGCAGCCGCTGCCGCCGATTCCGGATCTCAT<br>TGCCACGCGCCCCCGACGACCGCCCGACGTGCAT<br>TCCCGATTCCTTTTGGTTCCAAGTCCAATATGGCA<br>ACTCTAAAGGATCAGCTGATTTATAATCTTCTAAAG<br>GAAGAACAGACCCCCCAGAATAAGATTACAGTTGT<br>TGGGGTTGGTGCTGTTGGCATGGCCTGTGCCATC<br>AGTATCTTAATGAAGGACTTGGCAGATGAACTTGC<br>TCTTGTTGATGTCATCGAAGACAAATTGAAGGGAG<br>AGATGATGGATCTCCAACATGGCAGCCTTTTCCTT<br>AGAACACCAAAGATGTCTCTGGCAAAGACTATAAT<br>GTAACTGCAAACTCCAAGCTGGTCATTATCACGGC<br>TGGGGCACGTCAGCAAGAGGGAGAAAGCCGTCTT<br>AATTTGGTCCAGCGTAACGTGAACATATTTAAATTC<br>ATCATTCCTAATGTTGTAAAATACAGCCCGAACTG<br>CAAGTTGCTTATTGTTTCAAATCCAGTGGATATCTT<br>GACCTACGTGGCTTGGAAGATAAGTGGTTTTCCCA<br>AAAACCGTGTTATTGGAAGTGGTTGCAATCTGGAT<br>TCAGCCCGATTCCGTTACCTGATGGGGGAAAGGC<br>TGGGAGTTCACCCATTAAGCTGTCATGGGTGGGTC<br>CTTGGGGAACATGGAGATTCCAGTGTGCCTGTATG<br>GAGTGGAATGAATGTTGCTGGTGTCTCTCTGAAGA<br>CTCTGCACCCAGATTTAGGGACTGATAAAGATAAG<br>GAACAGTGGAAAGAGGTTCACAAGCAGGTGGTTG<br>AGAGTGCTTATGAGGTGATCAAACTCAAAGGCTAC<br>ACATCCTGGGCTATTGGACTCTCTGTAGCAGATTT<br>GGCAGAGAGTATAATGAAGAATCTTAGGCGGGTG<br>CACCCAGTTTCCACCATGATTAAGGGTCTTTACGG<br>AATAAAGGATGATGTCTTCCTTAGTGTTCCTTGCAT<br>TTTGGGACAGAATGGAATCTCAGACCTTGTGAAGG<br>TGACTCTGACTT | 8 | MSLAKTIM* |
| 1473 | NM_0055<br>66.1_423 | 423 | TGCTGCAGCCGCTGCCGCCGATTCCGGATCTCAT<br>TGCCACGCGCCCCCGACGACCGCCCGACGTGCAT<br>TCCCGATTCCTTTTGGTTCCAAGTCCAATATGGCA<br>ACTCTAAAGGATCAGCTGATTTATAATCTTCTAAAG<br>GAAGAACAGACCCCCCAGAATAAGATTACAGTTGT<br>TGGGGTTGGTGCTGTTGGCATGGCCTGTGCCATC<br>AGTATCTTAATGAAGGACTTGGCAGATGAACTTGC<br>TCTTGTTGATGTCATCGAAGACAAATTGAAGGGAG<br>AGATGATGGATCTCCAACATGGCAGCCTTTTCCTT<br>AGAACACCAAAGATTGTCTCTGGCAAAGACTATAA<br>TGTAACTGCAAACTCCAAGCTGGTCATTATCACGG<br>CTGGGGCACGTCAGCAAGAGGGAGAAAGCCGTCT<br>TAATTGGTCCAGCGTAACGTGAACATATTTAAATTC<br>ATCATTCCTAATGTTGTAAAATACAGCCCGAACTG<br>CAAGTTGCTTATTGTTTCAAATCCAGTGGATATCTT<br>GACCTACGTGGCTTGGAAGATAAGTGGTTTTCCCA<br>AAAACCGTGTTATTGGAAGTGGTTGCAATCTGGAT<br>TCAGCCCGATTCCGTTACCTGATGGGGGAAAGGC<br>TGGGAGTTCACCCATTAAGCTGTCATGGGTGGGTC<br>CTTGGGGAACATGGAGATTCCAGTGTGCCTGTATG<br>GAGTGGAATGAATGTTGCTGGTGTCTCTCTGAAGA<br>CTCTGCACCCAGATTTAGGGACTGATAAAGATAAG<br>GAACAGTGGAAAGAGGTTCACAAGCAGGTGGTTG<br>AGAGTGCTTATGAGGTGATCAAACTCAAAGGCTAC<br>ACATCCTGGGCTATTGGACTCTCTGTAGCAGATTT<br>GGCAGAGAGTATAATGAAGAATCTTAGGCGGGTG<br>CACCCAGTTTCCACCATGATTAAGGGTCTTTACGG<br>AATAAAGGATGATGTCTTCCTTAGTGTTCCTTGCAT<br>TTTGGGACAGAATGGAATCTCAGACCTTGTGAAGG<br>TGACTCTGACTT | 5 | WSSVT* |
| 1474 | NM_0055<br>66.1_469 | 469 | TGCTGCAGCCGCTGCCGCCGATTCCGGATCTCAT<br>TGCCACGCGCCCCCGACGACCGCCCGACGTGCAT<br>TCCCGATTCCTTTTGGTTCCAAGTCCAATATGGCA<br>ACTCTAAAGGATCAGCTGATTTATAATCTTCTAAAG | 0 | * |

TABLE 3A-continued

| SEQ ID | identifier_ position | position | modified_RNA | PAP length | PAP |
|---|---|---|---|---|---|
| | | | GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTGTAAAATACAGCCCGAACTG CAAGTTGCTTATTGTTTCAAATCCAGTGGATATCTT GACCTACGTGGCTTGGAAGATAAGTGGTTTTCCCA AAAACCGTGTTATTGGAAGTGGTTGCAATCTGGAT TCAGCCCGATTCCGTTACCTGATGGGGGAAAGGC TGGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | | |
| 1475 | NM_0055 66.1_495 | 495 | TGCTGCAGCCGCTGCCGCCGATTCCGGATCTCAT TGCCACGCGCCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTGCTTATTGTTTCAAATCCAGTGGATATCTT GACCTACGTGGCTTGGAAGATAAGTGGTTTTCCCA AAAACCGTGTTATTGGAAGTGGTTGCAATCTGGAT TCAGCCCGATTCCGTTACCTGATGGGGGAAAGGC TGGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | 10 | CLLFQIQWI S* |
| 1476 | NM_0055 66.1_502 | 502 | TGCTGCAGCCGCTGCCGCCGATTCCGGATCTCAT TGCCACGCGCCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTTGCTTATGTTTCAAATCCAGTGGATATCTT GACCTACGTGGCTTGGAAGATAAGTGGTTTTCCCA AAAACCGTGTTATTGGAAGTGGTTGCAATCTGGAT TCAGCCCGATTCCGTTACCTGATGGGGGAAAGGC TGGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA | 8 | MFQIQWIS* |

TABLE 3A-continued

| SEQ ID | identifier_ position | position | modified_RNA | PAP length | PAP |
|---|---|---|---|---|---|
| | | | CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | | |
| 1477 | NM_0055 66.1_602 | 602 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTTGCTTATTGTTTCAAATCCAGTGGATATCT TGACCTACGTGGCTTGGAAGATAAGTGGTTTTCCC AAAAACCGTGTTATTGGAAGTGGTTGCAATCTGGA TTCAGCCCGATTCCGTTACCTGATGGGGGAAAGGCT GGGAGTTCACCCATTAAGCTGTCATGGGTGGGTC CTTGGGGAACATGGAGATTCCAGTGTGCCTGTATG GAGTGGAATGAATGTTGCTGGTGTCTCTCTGAAGA CTCTGCACCCAGATTTAGGGACTGATAAAGATAAG GAACAGTGGAAAGAGGTTCACAAGCAGGTGGTTG AGAGTGCTTATGAGGTGATCAAACTCAAAGGCTAC ACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | 4 | DSVT* |
| 1478 | NM_0055 66.1_853 | 853 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTTGCTTATTGTTTCAAATCCAGTGGATATCT TGACCTACGTGGCTTGGAAGATAAGTGGTTTTCCC AAAAACCGTGTTATTGGAAGTGGTTGCAATCTGGA TTCAGCCCGATTCCGTTACCTGATGGGGGAAAGG CTGGGAGTTCACCCATTAAGCTGTCATGGGTGGGT CCTTGGGGAACATGGAGATTCCAGTGTGCCTGTAT GGAGTGGAATGAATGTTGCTGGTGTCTCTCTGAAG ACTCTGCACCCAGATTTAGGGACTGATAAAGATAA GGAACAGTGGAAAGAGGTTCACAAGCAGGTGGTT GAGAGTGCTTATGAGGTGATCAAACTCAAAGGCTA CACATCCTGGGCTATTGGACTCTCTGTAGCAGATTT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | 4 | MDSL* |
| 1479 | NM_0055 66.1_873 | 873 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG | 4 | WQRV* |

TABLE 3A-continued

| SEQ ID | identifier_position | position | modified_RNA | PAP length | PAP |
|---|---|---|---|---|---|
| | | | AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTTGCTTATTGTTTCAAATCCAGTGGATATCT TGACCTACGTGGCTTGGAAGATAAGTGGTTTTCCC AAAAACCGTGTTATTGGAAGTGGTTGCAATCTGGA TTCAGCCCGATTCCGTTACCTGATGGGGGAAAGG CTGGGAGTTCACCCATTAAGCTGTCATGGGTGGGT CCTTGGGGAACATGGAGATTCCAGTGTGCCTGTAT GGAGTGGAATGAATGTTGCTGGTGTCTCTCTGAAG ACTCTGCACCCAGATTTAGGGACTGATAAAGATAA GGAACAGTGGAAAGAGGTTCACAAGCAGGTGGTT GAGAGTGCTTATGAGGTGATCAAACTCAAAGGCTA CACATCCTGGGCTATTGGACTCTCTGTAGCAGATT GGCAGAGAGTATAATGAAGAATCTTAGGCGGGTG CACCCAGTTTCCACCATGATTAAGGGTCTTTACGG AATAAAGGATGATGTCTTCCTTAGTGTTCCTTGCAT TTTGGGACAGAATGGAATCTCAGACCTTGTGAAGG TGACTCTGACTT | | |
| 1480 | NM_0055 66.1_981 | 981 | TGCTGCAGCCGCTGCCGCCGATTCCGGATCTCAT TGCCACGCGCCCCGACGACCGCCCGACGTGCAT TCCCGATTCCTTTTGGTTCCAAGTCCAATATGGCA ACTCTAAAGGATCAGCTGATTTATAATCTTCTAAAG GAAGAACAGACCCCCCAGAATAAGATTACAGTTGT TGGGGTTGGTGCTGTTGGCATGGCCTGTGCCATC AGTATCTTAATGAAGGACTTGGCAGATGAACTTGC TCTTGTTGATGTCATCGAAGACAAATTGAAGGGAG AGATGATGGATCTCCAACATGGCAGCCTTTTCCTT AGAACACCAAAGATTGTCTCTGGCAAAGACTATAA TGTAACTGCAAACTCCAAGCTGGTCATTATCACGG CTGGGGCACGTCAGCAAGAGGGAGAAAGCCGTCT TAATTTGGTCCAGCGTAACGTGAACATATTTAAATT CATCATTCCTAATGTTGTAAAATACAGCCCGAACT GCAAGTTGCTTATTGTTTCAAATCCAGTGGATATCT TGACCTACGTGGCTTGGAAGATAAGTGGTTTTCCC AAAAACCGTGTTATTGGAAGTGGTTGCAATCTGGA TTCAGCCCGATTCCGTTACCTGATGGGGGAAAGG CTGGGAGTTCACCCATTAAGCTGTCATGGGTGGGT CCTTGGGGAACATGGAGATTCCAGTGTGCCTGTAT GGAGTGGAATGAATGTTGCTGGTGTCTCTCTGAAG ACTCTGCACCCAGATTTAGGGACTGATAAAGATAA GGAACAGTGGAAAGAGGTTCACAAGCAGGTGGTT GAGAGTGCTTATGAGGTGATCAAACTCAAAGGCTA CACATCCTGGGCTATTGGACTCTCTGTAGCAGATT GGCAGAGAGTATAATGAAGAATCTTAGGCGGGT GCACCCAGTTTCCACCATGATTAAGGGTCTTTACG GAATAAAGGATGATGTCTTCCTTAGTGTTCCTTGCA TTTGGGACAGAATGGAATCTCAGACCTTGTGAAGG TGACTCTGACTT | 9 | WDRMESQ TL* |
| 1481 | NM_0055 67.2_591 | 591 | AATCGAAAGTAGACTCTTTTCTGAAGCATTTCCTGG GATCAGCCTGACCACGCTCCATACTGGGAGAGGC TTCTGGGTCAAAGGACCAGTCTGCAGAGGGATCC TGTGGCTGGAAGCGAGGAGGCTCCACACGGCCGT TGCAGCTACCGCAGCCAGGATCTGGGCATCCAGG CACGGCCATGACCCCTCCGAGGCTCTTCTGGGTG TGGCTGCTGGTTGCAGGAACCCAAGGCGTGAACG ATGGTGACATGCGGCTGGCCGATGGGGGCGCCA CCAACCAGGGCCGCGTGGAGATCTTCTACAGAGG CCAGTGGGGCACTGTGTGTGACAACCTGTGGGAC CTGACTGATGCCAGCGTCGTCTGCCGGGCCCTGG GCTTCGAGAACGCCACCCAGGCTCTGGGCAGAGC TGCCTTCGGGCAAGGATCAGGCCCCATCATGCTG GACGAGGTCCAGTGCACGGGAACCGAGGCCTCAC TGGCCGACTGCAAGTCCCTGGGCTGGCTGAAGAG CAACTGCAGGCACGAGAGAGACGCTGGTGTGGTC TGCACCAATGAAACCAGGAGCACCCACACCCTGG ACCTCTCCAGGAGCTCTCGGAGGCCCTTGGCCAG ATCTTTGACAGCCAGCGGGGCTGCGACCTGTCCA TCAGCGTGAATGTGCAGGGCGAGGACGCCCTGG GCTTCTGTGGCCACACGGTCATCCTGACTGCCAAC CTGGAGGCCCAGGCCCTGTGGAAGGAGCCGGGC AGCAATGTCACCATGAGTGTGGATGCTGAGTGTGT GCCCATGGTCAGGGACCTTCTCAGGTACTTCTACT CCCGAAGGGATTGACATCACCCTGTCGTCAGTCAAG | 21 | SSRRPLAR SLTASGAA TCPSA* |

TABLE 3A-continued

| SEQ ID | identifier_position | position | modified_RNA | PAP length | PAP |
|---|---|---|---|---|---|
| 1482 | NM_005567.2_693 | 693 | TGCTTCCACAAGCTGGCCTCTGCCTATGGGGCCA GGCAGCTGCAGGGCTACTGCGCAAGCCTCTTTGC CATCCTCCTCCCCAGGACCCCTCGTTCCAGATGC CCCTGGACCTGTATGCCTATGCAGTGGCCACAGG GGACGCCCTGCTGGAGAAGCTCTGCCTACAGTTC AATCGAAAGTAGACTCTTTTCTGAAGCATTTCCTGG GATCAGCCTGACCACGCTCCATACTGGGAGAGGC TTCTGGGTCAAAGGACCAGTCTGCAGAGGGATCC TGTGGCTGGAAGCGAGGAGGCTCCACACGGCCGT TGCAGCTACCGCAGCCAGGATCTGGGCATCCAGG CACGGCCATGACCCCTCCGAGGCTCTTCTGGGTG TGGCTGCTGGTTGCAGGAACCCAAGGCGTGAACG ATGGTGACATGCGGCTGGCCGATGGGGGCGCCA CCAACCAGGGCCGCGTGGAGATCTTCTACAGAGG CCAGTGGGGCACTGTGTGTGACAACCTGTGGGAC CTGACTGATGCCAGCGTCGTCTGCCGGGCCCTGG GCTTCGAGAACGCCACCCAGGCTCTGGGCAGAGC TGCCTTCGGGCAAGGATCAGGCCCCATCATGCTG GACGAGGTCCAGTGCACGGGAACCGAGGCCTCAC TGGCCGACTGCAAGTCCCTGGGCTGGCTGAAGAG CAACTGCAGGCACGAGAGAGACGCTGGTGTGGTC TGCACCAATGAAACCAGGAGCACCCACACCCTGG ACCTCTCCAGGGAGCTCTCGGAGGCCCTTGGCCA GATCTTTGACAGCCAGCGGGGCTGCGACCTGTCC ATCAGCGTGAATGTGCAGGGCGAGGACGCCCTGG GCTTCTGTGGCACACGGTCATCCTGACTGCCAACC TGGAGGCCCAGGCCCTGTGGAAGGAGCCGGGCA GCAATGTCACCATGAGTGTGGATGCTGAGTGTGTG CCCATGGTCAGGGACCTTCTCAGGTACTTCTACTC CCGAAGGATTGACATCACCCTGTCGTCAGTCAAGT GCTTCCACAAGCTGGCCTCTGCCTATGGGGCCAG GCAGCTGCAGGGCTACTGCGCAAGCCTCTTTGCC ATCCTCCTCCCCAGGACCCCTCGTTCCAGATGCC CCTGGACCTGTATGCCTATGCAGTGGCCACAGGG GACGCCCTGCTGGAGAAGCTCTGCCTACAGTTC | 4 | TRSS* |
| 1483 | NM_005567.2_713 | 713 | AATCGAAAGTAGACTCTTTTCTGAAGCATTTCCTGG GATCAGCCTGACCACGCTCCATACTGGGAGAGGC TTCTGGGTCAAAGGACCAGTCTGCAGAGGGATCC TGTGGCTGGAAGCGAGGAGGCTCCACACGGCCGT TGCAGCTACCGCAGCCAGGATCTGGGCATCCAGG CACGGCCATGACCCCTCCGAGGCTCTTCTGGGTG TGGCTGCTGGTTGCAGGAACCCAAGGCGTGAACG ATGGTGACATGCGGCTGGCCGATGGGGGCGCCA CCAACCAGGGCCGCGTGGAGATCTTCTACAGAGG CCAGTGGGGCACTGTGTGTGACAACCTGTGGGAC CTGACTGATGCCAGCGTCGTCTGCCGGGCCCTGG GCTTCGAGAACGCCACCCAGGCTCTGGGCAGAGC TGCCTTCGGGCAAGGATCAGGCCCCATCATGCTG GACGAGGTCCAGTGCACGGGAACCGAGGCCTCAC TGGCCGACTGCAAGTCCCTGGGCTGGCTGAAGAG CAACTGCAGGCACGAGAGAGACGCTGGTGTGGTC TGCACCAATGAAACCAGGAGCACCCACACCCTGG ACCTCTCCAGGGAGCTCTCGGAGGCCCTTGGCCA GATCTTTGACAGCCAGCGGGGCTGCGACCTGTCC ATCAGCGTGAATGTGCAGGGCGAGGACGCCCTGG GCTTCTGTGGCACACGGTCATCCTGACTGCAACC TGGAGGCCCAGGCCCTGTGGAAGGAGCCGGGCA GCAATGTCACCATGAGTGTGGATGCTGAGTGTGTG CCCATGGTCAGGGACCTTCTCAGGTACTTCTACTC CCGAAGGATTGACATCACCCTGTCGTCAGTCAAGT GCTTCCACAAGCTGGCCTCTGCCTATGGGGCCAG GCAGCTGCAGGGCTACTGCGCAAGCCTCTTTGCC ATCCTCCTCCCCAGGACCCCTCGTTCCAGATGCC CCTGGACCTGTATGCCTATGCAGTGGCCACAGGG GACGCCCTGCTGGAGAAGCTCTGCCTACAGTTC | 16 | TWRPRPC GRSRAAM SP* |
| 1484 | NM_005594.3_512 | 512 | GCACAGTAAGTACTTTCTGTGCCGCTACTGTCTAT CCGCAGCCATCCGCCTTTCTTTCGGGCTAGGCCG CCCCGGGGACTGAGAGTTAAGGAGAGTTGGAGGC TTTACTGGGCCACAGGGTTCCTACTCGCCCCTGG GCTCCGGACAAAATGGGGTCTGCGGTTGGTGTC CTGGCAAAAGCAGGGTAGAAGGGCTGCGGGGCG GGCCCAGAATCCGAGCCTGCAGAGATGGGAGCAG TTGCAGTGTTGAGGGCGGAAGAGGAGTGCGTCTT GTTTTGGGAACTGCTTCACAGGATCCAGAAAAGGA AATGCCCGGCGAAGCCACAGAAACCGTCCCTGCT ACAGAGCAGGAGTTGCCGCAGCCCCAGGCTGAGA CAGGGTCTGGAACAGAATCTGACAGTGATGAATCA | 53 | NRVGVKR RHGRLCP NWVFGRL QELLESLS GNLRISSL SSQNQMS TRALLQILT* |

TABLE 3A-continued

| SEQ ID | identifier_position | position | modified_RNA | PAP length | PAP |
|---|---|---|---|---|---|
| | | | GTACCAGAGCTTGAAGAACAGGATTCCACCCAGG<br>CAACCACACAACAAGCCCAGCTGGCGGCAGCAGC<br>TGAAATCGATGAAGAACCAGTCAGTAAAGCAAACA<br>GAGTCGGAGTGAAAAGAAGGCACGGAAGGCTATG<br>TCCAAACTGGGTCTTCGGCAGGTTACAGGAGTTAC<br>TAGAGTCACTATCCGGAAATCTAAGAATATCCTCTT<br>TGTCATCACAAAACCAGATGTCTACAAGAGCCCTG<br>CTTCAGATACTTACATAGTTTTTGGGGAAGCCAAG<br>ATCGAAGATTTATCCCAGCAAGCACAACTAGCAGC<br>TGCTGAGAAATTCAAAGTTCAAGGTGAAGCTGTCT<br>CAAACATTCAAGAAAACACACAGACTCCAACTGTA<br>CAAGAGGAGAGTGAAGAGGAAGAGGTCGATGAAA<br>CAGGTGTAGAAGTTAAGGACATAGAATTGGTCATG<br>TCACAAGCAAATGTGTCGAGAGCAAAGGCAGTCC<br>GAGCCCTGAAGAACAACAGTAATGATATTGTAAAT<br>GCGATTATGGAATTAACAATGTAACCATATGGAAG<br>CAACTTTTTTGGTGTCTCAAAGGAGTAACTGCAG<br>CTTGGTTTGAAATTTGTACTGTT | | |
| 1485 | NM_0055<br>94.3_620 | 620 | GCACAGTAAGTACTTTCTGTGCCGCTACTGTCTAT<br>CCGCAGCCATCCGCCTTTCTTTCGGGCTAGGCCG<br>CCCCGGGGACTGAGAGTTAAGGAGAGTTGGAGGC<br>TTTACTGGGCCACAGGGTTCCTACTCGCCCCTGG<br>GCCTCCGGACAAAATGGGGTCTGCGGTTGGTGTC<br>CTGGCAAAAGCAGGGTAGAAGGGCTGCGGGGCG<br>GGCCCAGAATCCGAGCCTGCAGAGATGGGAGCAG<br>TTGCAGTGTTGAGGGCGGAAGAGGAGTGCGTCTT<br>GTTTTGGGAACTGCTTCACAGGATCCAGAAAAGGA<br>AATGCCCGGCGAAGCCACAGAAACCGTCCCTGCT<br>ACAGAGCAGGAGTTGCCGCAGCCCCAGGCTGAGA<br>CAGGGTCTGGAACAGAATCTGACAGTGATGAATCA<br>GTACCAGAGCTTGAAGAACAGGATTCCACCCAGG<br>CAACCACACAACAAGCCCAGCTGGCGGCAGCAGC<br>TGAAATCGATGAAGAACCAGTCAGTAAAGCAAAAC<br>AGAGTCGGAGTGAAAAGAAGGCACGGAAGGCTAT<br>GTCCAAACTGGGTCTTCGGCAGGTTACAGGAGTTA<br>CTAGAGTCACTATCCGGAAATCTAAGAATATCCTC<br>TTGTCATCACAAAACCAGATGTCTACAAGAGCCCT<br>GCTTCAGATACTTACATAGTTTTTGGGGAAGCCAA<br>GATCGAAGATTTATCCCAGCAAGCACAACTAGCAG<br>CTGCTGAGAAATTCAAAGTTCAAGGTGAAGCTGTC<br>TCAAACATTCAAGAAAACACACAGACTCCAACTGT<br>ACAAGAGGAGAGTGAAGAGGAAGAGGTCGATGAA<br>ACAGGTGTAGAAGTTAAGGACATAGAATTGGTCAT<br>GTCACAAGCAAATGTGTCGAGAGCAAAGGCAGTC<br>CGAGCCCTGAAGAACAACAGTAATGATATTGTAAA<br>TGCGATTATGGAATTAACAATGTAACCATATGGAA<br>GCAACTTTTTTGGTGTCTCAAAGGAGTAACTGCA<br>GCTTGGTTTGAAATTTGTACTGTT | 17 | LSSQNQM<br>STRALLQIL<br>T* |
| 1486 | NM_0055<br>94.3_677 | 677 | GCACAGTAAGTACTTTCTGTGCCGCTACTGTCTAT<br>CCGCAGCCATCCGCCTTTCTTTCGGGCTAGGCCG<br>CCCCGGGGACTGAGAGTTAAGGAGAGTTGGAGGC<br>TTTACTGGGCCACAGGGTTCCTACTCGCCCCTGG<br>GCCTCCGGACAAAATGGGGTCTGCGGTTGGTGTC<br>CTGGCAAAAGCAGGGTAGAAGGGCTGCGGGGCG<br>GGCCCAGAATCCGAGCCTGCAGAGATGGGAGCAG<br>TTGCAGTGTTGAGGGCGGAAGAGGAGTGCGTCTT<br>GTTTTGGGAACTGCTTCACAGGATCCAGAAAAGGA<br>AATGCCCGGCGAAGCCACAGAAACCGTCCCTGCT<br>ACAGAGCAGGAGTTGCCGCAGCCCCAGGCTGAGA<br>CAGGGTCTGGAACAGAATCTGACAGTGATGAATCA<br>GTACCAGAGCTTGAAGAACAGGATTCCACCCAGG<br>CAACCACACAACAAGCCCAGCTGGCGGCAGCAGC<br>TGAAATCGATGAAGAACCAGTCAGTAAAGCAAAAC<br>AGAGTCGGAGTGAAAAGAAGGCACGGAAGGCTAT<br>GTCCAAACTGGGTCTTCGGCAGGTTACAGGAGTTA<br>CTAGAGTCACTATCCGGAAATCTAAGAATATCCTC<br>TTTGTCATCACAAAACCAGATGTCTACAAGAGCCC<br>TGCTTCAGATACTTACATAGTTTTTGGGGAAGCCAA<br>GATCGAAGATTTATCCCAGCAAGCACAACTAGCAG<br>CTGCTGAGAAATTCAAAGTTCAAGGTGAAGCTGTC<br>TCAAACATTCAAGAAAACACACAGACTCCAACTGT<br>ACAAGAGGAGAGTGAAGAGGAAGAGGTCGATGAA<br>ACAGGTGTAGAAGTTAAGGACATAGAATTGGTCAT<br>GTCACAAGCAAATGTGTCGAGAGCAAAGGCAGTC<br>CGAGCCCTGAAGAACAACAGTAATGATATTGTAAA<br>TGCGATTATGGAATTAACAATGTAACCATATGGAA | 14 | LGKPRSKI<br>YPSKHN* |

TABLE 3A-continued

| SEQ ID | identifier_position | position | modified_RNA | PAP length | PAP |
|---|---|---|---|---|---|
| 1487 | NM_0055 94.3_926 | 926 | GCAACTTTTTTGGTGTCTCAAAGGAGTAACTGCA GCTTGGTTTGAAATTTGTACTGTT GCACAGTAAGTACTTTCTGTGCCGCTACTGTCTAT CCGCAGCCATCCGCCTTTCTTTCGGGCTAGGCCG CCCCGGGGACTGAGAGTTAAGGAGAGTTGGAGGC TTTACTGGGCCACAGGGTTCCTACTCGCCCCTGG GCCTCCGGACAAAATGGGGTCTGCGGTTGGTGTC CTGGCAAAAGCAGGGTAGAAGGGCTGCGGGGCG GGCCCAGAATCCGAGCCTGCAGAGATGGGAGCAG TTGCAGTGTTGAGGGCGGAAGAGGAGTGCGTCTT GTTTTGGGAACTGCTTCACAGGATCCAGAAAAGGA AATGCCCGGCGAAGCCACAGAAACCGTCCCTGCT ACAGAGCAGGAGTTGCCGCAGCCCCAGGCTGAGA CAGGGTCTGGAACAGAATCTGACAGTGATGAATCA GTACCAGAGCTTGAAGAACAGGATTCCACCCAGG CAACCACACAACAAGCCCAGCTGGCGGCAGCAGC TGAAATCGATGAAGAACCAGTCAGTAAAGCAAAAC AGAGTCGGAGTGAAAAGAAGGCACGGAAGGCTAT GTCCAAACTGGGTCTTCGGCAGGTTACAGGAGTTA CTAGAGTCACTATCCGGAAATCTAAGAATATCCTC TTTGTCATCACAAAACCAGATGTCTACAAGAGCCC TGCTTCAGATACTTACATAGTTTTTGGGGAAGCCA AGATCGAAGATTTATCCCAGCAAGCACAACTAGCA GCTGCTGAGAAATTCAAAGTTCAAGGTGAAGCTGT CTCAAACATTCAAGAAAACACACAGACTCCAACTG TACAAGAGGAGAGTGAAGAGGAAGAGGTCGATGA AACAGGTGTAGAAGTTAAGGACATAGAATTGGTCA TGTCACAAGCAAATGTGTCGAGAGCAAAGGCAGT CCGAGCCCTGAAGAACAACAGTAATGATATGTAAA TGCGATTATGGAATTAACAATGTAACCATATGGAA GCAACTTTTTTGGTGTCTCAAAGGAGTAACTGCA GCTTGGTTTGAAATTTGTACTGTT | 1 | M* |
| 1488 | NM_0056 17.3_179 | 179 | CTCCGCCCCCTCCCACTCTCTCTTTCCGGTGTGGA GTCTGGAGACGACGTGCAGAAATGGCACCTCGAA AGGGGAAGGAAAAGAAGGAAGAACAGGTCATCAG CCTCGGACCTCAGGTGGCTGAAGGAGAGAATGTA TTTGGTGTCTGCCATATCTTTGCATCCTTCAATGAC ACTTTGTCCATGTCACTGATCTTTCTGGCAAGGAA ACCATCTGCCGTGTGACTGGTGGGATGAAGGTAA AGGCAGACCGAGATGAATCCTCACCATATGCTGCT ATGTTGGCTGCCCAGGATGTGGCCCAGAGGTGCA AGGAGCTGGGTATCACCGCCCTACACATCAAACTC CGGGCCACAGGAGGAAATAGGACCAAGACCCCTG GACCTGGGGCCCAGTCGGCCCTCAGAGCCCTTGC CCGCTCGGGTATGAAGATCGGGCGGATTGAGGAT GTCACCCCCATCCCCTCTGACAGCACTCGCAGGA AGGGGGGTCGCCGTGGTCGCCGTCTGTGAACAAG ATTCCTCAAAATATTTTCTGTTAATAAATTGCCTTCA TGTAAACTGTTTCAAAAAAAAA | 15 | LSMSLIFLA RKPSAV* |
| 1489 | NM_0056 17.3_402 | 402 | CTCCGCCCCCTCCCACTCTCTCTTTCCGGTGTGGA GTCTGGAGACGACGTGCAGAAATGGCACCTCGAA AGGGGAAGGAAAAGAAGGAAGAACAGGTCATCAG CCTCGGACCTCAGGTGGCTGAAGGAGAGAATGTA TTTGGTGTCTGCCATATCTTTGCATCCTTCAATGAC ACTTTGTCCATGTCACTGATCTTTCTGGCAAGGAA ACCATCTGCCGTGTGACTGGTGGGATGAAGGTAA AGGCAGACCGAGATGAATCCTCACCATATGCTGCT ATGTTGGCTGCCCAGGATGTGGCCCAGAGGTGCA AGGAGCTGGGTATCACCGCCCTACACATCAAACTC CGGGCCACAGGAGGAAATAGGACCAAGACCCCTG GACCTGGGGCCCAGTCGGCCTCAGAGCCCTTGCC CGCTCGGGTATGAAGATCGGGCGGATTGAGGATG TCACCCCCATCCCCTCTGACAGCACTCGCAGGAA GGGGGGTCGCCGTGGTCGCCGTCTGTGAACAAGA TTCCTCAAAATATTTTCTGTTAATAAATTGCCTTCAT GTAAACTGTTTCAAAAAAAAA | 8 | SEPLPARV* |
| 1490 | NM_0056 25.3_245 | 245 | GGCTGAAGGCGGGGGCGGTGCCATGACGCGCCT CGGGGGCGGTCCTCGGGCGCGCACCGCTCTCTTA CACTCGGGCCTCAGAAGTCCGTGCCAGTGACCGG AGGCGGCGGCGGCGAGCGGTTCCTTGTGGGCTA GAAGAATCCTGCAAAAATGTCTCTCTATCCATCTCT CGAAGACTTGAAGGTAGACAAAGTAATTCAGGCTC AAACTGCTTTTTCTGCAAACCCTGCCAATCCAGCA ATTTGTCAGAAGCTTCTGCTCCTATCCCTCACGAT GGAAATCTCTATCCCAGACTGTATCCAGAGCTCTC TCAATACATGGGGCTGAGTTTAAATGAAGAAGAAA TACGTGCAAATGTGGCCGTGGTTTCTGGTGCACCA | 27 | CQKLLLLS LTMEISIPD CIQSSLNT WG* |

TABLE 3A-continued

| SEQ ID | identifier_position | position | modified_RNA | PAP length | PAP |
|---|---|---|---|---|---|
| | | | CTTCAGGGGCAGTTGGTAGCAAGACCTTCCAGTAT<br>AAACTATATGGTGGCTCCTGTAACTGGTAATGATG<br>TTGGAATTCGTAGAGCAGAAATTAAGCAAGGGATT<br>CGTGAAGTCATTTTGTGTAAGGATCAAGATGGAAA<br>AATTGGACTCAGGCTTAAATCAATAGATAATGGTAT<br>ATTTGTTCAGCTAGTCCAGGCTAATTCTCCAGCCT<br>CATTGGTTGGTCTGAGATTTGGGGACCAAGTACTT<br>CAGATCAATGGTGAAAACTGTGCAGGATGGAGCT<br>CTGATAAAGCGCACAAGGTGCTCAAACAGGCTTTT<br>GGAGAGAAGATTACCATGACCATTCGTGACAGGC<br>CCTTTGAACGGACGATTACCATGCATAAGGATAGC<br>ACTGGACATGTTGGTTTTATCTTTAAAAATGGAAAA<br>ATAACATCCATAGTGAAAGATAGCTCTGCAGCCAG<br>AAATGGTCTTCTCACGGAACATAACATCTGTGAAA<br>TCAATGGACAGAATGTCATTGGATTGAAGGACTCT<br>CAAATTGCAGACATACTGTCAACATCTGGGACTGT<br>AGTTACTATTACAATCATGCCTGCTTTTATCTTTGA<br>ACATATTATTAAGCGGATGGCACCAAGCATTATGA<br>AAAGCCTAATGGA | | |
| 1491 | NM_005628.1_1242 | 1242 | GTAACCGCTACTCCCGGACACCAGACCACCGCCT<br>TCCGTACACAGGGGCCCGCATCCCACCCTCCCGG<br>ACCTAAGAGCCTGGGTCCCCTGTTTCCGGAGGTC<br>CGCTTCCCGGCCCCCAGATTCTGGCATCCCAGCC<br>CTCAGTGTCCAAGACCCAGGCAGCCCGGGTCCCC<br>GCCTCCCGGATCCAGGCGTCCGGGATCTGCGCCA<br>CCAGAACCTAGCCTCCTGCAGACCTCCGCCATCT<br>GGGGGCACTCAACCTCCTGGAGCCAAGGGCCCCA<br>CGTCCCACCCAGAGAAACTCTCGTATTCCCAGCTC<br>CTAGGGCCAAGGAACCCGGGCGCTCCGAACTCCC<br>AGCTTTCGGACATCTGGCACACGGGGCAGAGCAG<br>AGAAGCTCAGCGCCCAGCCTGGGGAATTTAAACA<br>CTCCAGCTTCCAAGAGCCAAGGAACTTCAGTGCTG<br>TGAACTCACAACTCTAAGGAGCCCTCCAAAGTTCC<br>AGTCTCCAGGTGCTGTTACTAACTCAGTCCTAGG<br>AACGTCGGGTCCTGGGAAGGAGCCCAAGCGCTCC<br>CAGCCAGCTTCCAGGCGCTAAGAAACCCCGGTGC<br>TTCCCATCATGGTGGCCGATCCTCCTCGAGACTCC<br>AAGGGGCTCGCAGCGGCGGAGCCCACCGCCAAC<br>GGGGGCCTGGCGCTGGCCTCCATCGAGGACCAA<br>GGCGCGGCAGCAGGCGGCTACTGCGGTTCCCGG<br>GACCAGGTGCGCCGCTGCCTTCGAGCCAACCTGC<br>TTGTGCTGCTGACAGTGGTGGCCGTGGTGGCCGG<br>CGTGGCGCTGGGACTGGGGGTGTCGGGGGCCGG<br>GGGTGCGCTGGCGTTGGGCCCGGAGCGCTTGAG<br>CGCCTTCGTCTTCCCGGGCGAGCTGCTGCTGCGT<br>CTGCTGCGGATGATCATCTTGCCGCTGGTGGTGT<br>GCAGCTTGATCGGCGGCGCCGCCAGCCTGGACC<br>CCGGCGCGCTCGGCCGTCTGGGCGCCTGGGCGC<br>TGCTCTTTTTCCTGGTCACCACGCTGCTGGCGTCG<br>GCGCT | 0 | * |
| 1492 | NM_005702.2_210 | 210 | TGCGGCTGTAATGGCTGCCCCCAGCTGGCGCGGG<br>GCTAGGCTTGTTCAATCGGTGTTAAGAGTCTGGCA<br>GGTGGGCCCTCATGTCGCGAGGGAGCGGGTGAT<br>CCCTTTTTCCTCACTCTTAGGCTTCCAACGGAGGT<br>GCGTGTCCTGCGTCGCGGGGTCCGCTTTCTCTGG<br>TCCCCGCTTGGCCTCGGCTTCTCGCAGTAATGGC<br>CAGGCTCTGCCCTGGACCACTTCCTCGGATTCTCT<br>CAGCCCGACAGTTCGGTGACTCCTTGCGTCCCCG<br>CGGTGTCCATGAACAGAGATGAGCAGGATGTCCT<br>CTTGGTCCATCACCCTGATATGCCTGAGAATTCCC<br>GGGTCCTACGAGTGGTCCTCCTGGGAGCCCCGAA<br>TGCAGGGAAGTCAACACTCTCCAACCAGCTACTG<br>GGCCGAAAGGTGTTCCCTGTTTCCAGGAAGGTGC<br>ATACTACTCGCTGCCAAGCTCTGGGGGTCATCACA<br>GAGAAGGAGACCCAGGTGATTCTACTTGACACAC<br>CTGGCATTATCAGTCCTGGTAAACAGAAGAGGCAT<br>CACCTGGAGCTCTCTTTGTTGGAAGATCCATGGAA<br>GAGCATGGAATCTGCTGATCTTGTTGTGGTTCTTG<br>TGGATGTCTCAGACAAGTGGACACGGAACCAGCT<br>CAGCCCCCAGTTGCTCAGGTGCTTGACCAAGTACT<br>CCCAGATCCCTAGTGTCCTGGTCATGAACAAGGTA<br>GATTGTTTGAAGCAGAAGTCAGTTCTCCTGGAGCT<br>CACGGCAGCCCTCACTGAAGGTGTGGTCAATGGC<br>AAAAAGCTCAAGATGAGGCAGGCCTTCCACTCACA<br>CCCTGGCACCCATTGCCCCAGCCCAGCAGTTAAG<br>GACCCAAACACACAATCTGTGGGAAATCCTCAGAG<br>GATTGGCTGGCCCCACTTCAAGGAGATCTTCATGT | 16 | ALPWTTSS<br>DSLSPTVR* |

TABLE 3A-continued

| SEQ ID | identifier_position | position | modified_RNA | PAP length | PAP |
|---|---|---|---|---|---|
| 1493 | NM_0057 19.2_216 | 216 | TGTCAGCCCTAAGCCAGGAGGACGTGAAAACACT AAAGCAATACCTTCTGACACAGGCCCAGCCAGGG CCCTGGGAGTACCACAGTGCAGTCC CGCTTCCGCCTACCTCGCCCAGGCTGCCAGACCG GAAGCGCTCCGCTGTACCTGGATCCTGCTCCTCT GGGTTGAAACCCGGGCGCCGCCAAGATGCCGGC TTACCACTCTTCTCTCATGGATCCTGATACCAAACT CATCGGAAACATGGCACTGTTGCCTATCAGAAGTC AATTCAAAGGACCTGCCCCCAGAGAGACAAAAGAT ACAGATATGTGGATGAAGCCATCTATTACTTCAAG GCCAATGTCTTCTTCAAAAACTATGAAATTAAGAAT GAAGCTGATAGGACCTTGATATATATAACTCTCTAC ATTTCTGAATGTCTGAAGAAACTGCAAAAGTGCAA TTCCAAAAGCCAAGGTGAGAAAGAAATGTATACGC TGGGAATCACTAATTTTCCCATTCCTGGAGAGCCT GGTTTTCCACTTAACGCAATTTATGCCAAACCTGCA AACAAACAGGAAGATGAAGTGATGAGAGCCTATTT ACAACAGCTAAGGCAAGAGACTGGACTGAGACTTT GTGAGAAAGTTTTCGACCCTCAGAATGATAAACCC AGCAAGTGGTGGACTTGCTTGTGAAGAGACAGTT CATGAACAAGAGTCTTTCAGGACCTGGACAGTGAA GGGAGCCCGGGCAGCCACCGTCTCCAGAGCCCT GGGCAGCATTTTCCAGCAAGATGTACACAATCTTT TGCCTTTATTTCGTAAAGTTTTATACAGAAGAGAGA AGAGCATGTCTTTACTTGAAAAACTCTTGATCAAGA ATTTGGGTGGGAGAAAAGAAAGTGGGTTATCAAG GGTGATTTGAAATTTTCTGCAGCATTAAAGCTGGC GCTTAATAAGAATAAGTAATAATAAAGAAATTTCTA ACATTCC | 27 | MWMKPSIT SRPMSSSK TMKLRMKL IGP* |
| 1494 | NM_0057 19.2_582 | 582 | CGCTTCCGCCTACCTCGCCCAGGCTGCCAGACCG GAAGCGCTCCGCTGTACCTGGATCCTGCTCCTCT GGGTTGAAACCCGGGCGCCGCCAAGATGCCGGC TTACCACTCTTCTCTCATGGATCCTGATACCAAACT CATCGGAAACATGGCACTGTTGCCTATCAGAAGTC AATTCAAAGGACCTGCCCCCAGAGAGACAAAAGAT ACAGATATTGTGGATGAAGCCATCTATTACTTCAA GGCCAATGTCTTCTTCAAAAACTATGAAATTAAGAA TGAAGCTGATAGGACCTTGATATATATAACTCTCTA CATTTCTGAATGTCTGAAGAAACTGCAAAAGTGCA ATTCCAAAAGCCAAGGTGAGAAAGAAATGTATACG CTGGGAATCACTAATTTTCCCATTCCTGGAGAGCC TGGTTTTCCACTTAACGCAATTTATGCCAAACCTGC AAACAAACAGGAAGATGAAGTGATGAGAGCCTATT TACAACAGCTAAGGCAAGAGACTGGACTGAGACTT TGTGAGAAAGTTTTCGACCCTCAGAATGATAAACC CAGCAAGTGGTGGACTTGCTTGTGAAGAGACAGTT CATGAACAAGAGTCTTTCAGGACCTGGACAGTGAA GGGAGCCCGGGCAGCCACCGTCTCCAGAGCCCT GGGCAGCATTTTCCAGCAAGATGTACACAATCTTT TGCCTTTATTTCGTAAAGTTTTATACAGAAGAGAGA AGAGCATGTCTTTACTTGAAAAACTCTTGATCAAGA ATTTGGGTGGGAGAAAAGAAAGTGGGTTATCAAG GGTGATTTGAAATTTTCTGCAGCATTAAAGCTGGC GCTTAATAAGAATAAGTAATAATAAAGAAATTTCTA ACATTCC | 1 | L* |
| 1495 | NM_0057 19.2_605 | 605 | CGCTTCCGCCTACCTCGCCCAGGCTGCCAGACCG GAAGCGCTCCGCTGTACCTGGATCCTGCTCCTCT GGGTTGAAACCCGGGCGCCGCCAAGATGCCGGC TTACCACTCTTCTCTCATGGATCCTGATACCAAACT CATCGGAAACATGGCACTGTTGCCTATCAGAAGTC AATTCAAAGGACCTGCCCCCAGAGAGACAAAAGAT ACAGATATTGTGGATGAAGCCATCTATTACTTCAA GGCCAATGTCTTCTTCAAAAACTATGAAATTAAGAA TGAAGCTGATAGGACCTTGATATATATAACTCTCTA CATTTCTGAATGTCTGAAGAAACTGCAAAAGTGCA ATTCCAAAAGCCAAGGTGAGAAAGAAATGTATACG CTGGGAATCACTAATTTTCCCATTCCTGGAGAGCC TGGTTTTCCACTTAACGCAATTTATGCCAAACCTGC AAACAAACAGGAAGATGAAGTGATGAGAGCCTATT TACAACAGCTAAGGCAAGAGACTGGACTGAGACTT TGTGAGAAAGTTTTCGACCCTCAGAATGATAAACC CAGCAAGTGGTGGACTTGCTTGTGAAGAGACAGT TCATGAACAGAGTCTTTCAGGACCTGGACAGTGAA GGGAGCCCGGGCAGCCACCGTCTCCAGAGCCCT GGGCAGCATTTTCCAGCAAGATGTACACAATCTTT TGCCTTTATTTCGTAAAGTTTTATACAGAAGAGAGA AGAGCATGTCTTTACTTGAAAAACTCTTGATCAAGA | 36 | RVFQDLDS EGSPGSH RLQSPGQ HFPARCTQ SFAFIS* |

TABLE 3A-continued

| SEQ ID | identifier_position | position | modified_RNA | PAP length | PAP |
|---|---|---|---|---|---|
| | | | ATTTGGGTGGGAGAAAAGAAAGTGGGTTATCAAG GGTGATTTGAAATTTTCTGCAGCATTAAAGCTGGC GCTTAATAAGAATAAGTAATAATAAAGAAATTTCTA ACATTCC | | |
| 1496 | NM_0057 24.4_525 | 525 | GTTGCCAGGGAGCGGCGCGGGAGCCCTGAGGGG ACTGCGGCGGCTGCGCGGAGGAGCGAGGCACTT GCTGGGGTCGGGGCTGCGCGACGGCGCAGGGGC TGCGGGGAGCGCCGCGCAGGCCGTGCAGTTCCT AGCGAGGAGGCGCCGCCGCCATTGCCGCTCTCTC GGTGAGCGCAGCCCCGCTCTCCGGGCCGGGCCT TCGCGGGCCACCGGCGCCATGGGCCAGTGCGGC ATCACCTCCTCCAAGACCGTGCTGGTCTTTCTCAA CCTCATCTTCTGGGGGCAGCTGGCATTTTATGCT ATGTGGGAGCCTATGTCTTCATCACTTATGATGAC TATGACCACTTCTTTGAAGATGTGTACACGCTCATC CCTGCTGTAGTGATCATAGCTGTAGGAGCCCTGCT TTTCATCATTGGGCTAATTGGCTGCTGTGCCACAA TCCGGGAAAGTCGCTGTGGACTTGCCACGTTTGTC ATCATCCTGCTCTTGGTTTTTGTCACAGAAGTTGTT GTAGTGGTTTGGGATATGTTTACAGAGCAAAGGTG GAAAATGAGGTTGATCGCAGCATTCAGAAAGTGTA TAAGACCTACAATGGAACCAACCCTGATGCTGCTA GCCGGGCTATTGATTATGTACAGAGACAGCTGCAT TGTTGTGGAATTCACAACTACTCAGACTGGGAAAA TACAGATTGGTTCAAAGAAACCAAAAACCAGAGTG TCCCTCTTAGCTGCTGCAGAGAGACTGCCAGCAAT TGTAATGGCAGCCTGGCCCACCCTTCCGACCTCTA TGCTGAGGGGTGTGAGGCTCTAGTAGTGAAGAAG CTACAAGAAATCATGATGCATGTGATCTGGGCCGC ACTGGCATTTGCAGCTATTCAGCTGCTGGGCATGC TGTGTGCTTGCATCGTGTTGTGCAGAAGGAGTAGA GATCCTGCTTACGAGCTCCTCATCACTGGCGGAAC CTATGCATAGTTGACAACTCAAGCCTGAGCTTTTT GGTCTTGTTCTGATTTGGAAG | 97 | WDMFTEQ RWKMRLIA AFRKCIRP TMEPTLML LAGLLIMY RDSCIVVE FTTTQTGKI QIGSKKPK TRVSLLAA AERLPAIV MAAWPTL PTSMLRGV RL* |
| 1497 | NM_0057 29.3_167 | 167 | GCGGGACTCGGCCTTCTGGGCGCGCGCGACGTC AGTTTGAGTTCTGTGTTCTCCCCGCCCGTGTCCCG CCCGACCCGCGCCCGCGATGCTGGCGCTGCGCT GCGGCTCCCGCTGGCTCGGCCTGCTCTCCGTCCC GCGCTCCGTGCCGCTGCGCCTCCCCGCGGCCGC GCCTGCAGCAAGGGCTCCGGCGACCCGTCCTCTT CCTCCTCCTCCGGGAACCCGCTCGTGTACCTGGA CGTGGACGCCAACGGGAAGCCGCTCGGCCGCGT GGTGCTGGAGCTGAAGGCAGATGTCGTCCCAAAG ACAGCTGAGAACTTCAGAGCCCTGTGCACTGGTG AGAAGGGCTTCGGCTACAAAGGCTCCACCTTCCA CAGGGTGATCCCTTCCTTCATGTGCCAGGCGGGC GACTTCACCAACCACAATGGCACAGGCGGGAAGT CCATCTACGGAAGCCGCTTTCCTGACGAGAACTTT ACACTGAAGCACGTGGGGCCAGGTGTCCTGTCCA TGGCTAATGCTGGTCCTAACACCAACGGCTCCCA GTTCTTCATCTGCACCATAAAGACAGACTGGTTGG ATGGCAAGCATGTTGTGTTCGGTCACGTCAAAGAG GGCATGGACGTCGTGAAGAAAATAGAATCTTTCGG CTCTAAGAGTGGGAGGACATCCAAGAAGATTGTCA TCACAGACTGTGGCCAGTTGAGCTAATCTGTGGCC AGGGTGCTGGCATGGTGGCAGCTGCAAATGTCCA TGCACCCAGGTGGCCGCGTTGGGCTGTCAGCCAA GGTGCCTGAAACGATACGTGTGCCCACTCCACTGT CACAGTGTGCCTGAGGAAGGCTGCTAGGGATGTT AGACCTCGGCCAGGACCCACCACATTGCTTCCTAA TACCCACCCTTCCTCACGACCTCATTTCTGGGCAT CTTTGTGGACATGATGTCACCCACCCCTTGTCAAG CATTGCCTGTGATTGCCCAGCCCAGATTCATCTGT GCCTTGGACATGGTGATGGTGATGGGTTGC | 38 | APAARAPA TRPLPPPP GTRSCTW TWTPTGS RSAAWCW S* |
| 1498 | NM_0057 42.2_450 | 450 | GGCCCGCCCCCGCGCGGCCGCCCCTCGGACCAC CGGACTGGCCTGGGGCGGGACGTGGGCGCGGG GGCGCGGCGTGCGGCACGCTGCAGGGCTGAAGC GGCCGGCGGCGGTGGGGACTGCACGTAGCCCGGC GCTCGGCATGGCTCTCCTGGTGCTCGGTCTGGTG AGCTGTACCTTCTTTCTGGCAGTGAATGGTCTGTA TTCCTCTAGTGATGATGTGATCGAATTAACTCCATC GAATTTCAACCGAGAAGTTATTCAGAGTGATAGTTT GTGGCTTGTAGAATTCTATGCTCCATGGTGTGGTC ACTGTCAAAGATTAACACCAGAATGGAAGAAAGCA GCAACTGCATTAAAAGATGTTGTCAAAGTTGGTGC AGTTGATGCAGATAAGCATCATTCCCTAGGAGGTC AGTATGGTGTTCAGGGATTTCCTACCATTAAGATTT | 20 | LDPTKTDQ KITKVAELV KPL* |

TABLE 3A-continued

| SEQ ID | identifier_position | position | modified_RNA | PAP length | PAP |
|---|---|---|---|---|---|
| | | | TGGATCCAACAAAAACAGACCAGAAGATTACCAAG<br>GTGGCAGAACTGGTGAAGCCATTGTAGATGCTGC<br>GCTGAGTGCTCTGCGCCAGCTCGTGAAGGATCGC<br>CTCGGGGGACGGAGCGGAGGATACAGTTCTGGAA<br>AACAAGGCAGAAGTGATAGTTCAAGTAAGAAGGAT<br>GTGATTGAGCTGACAGACGACAGCTTTGATAAGAA<br>TGTTCTGGACAGTGAAGATGTTTGGATGGTTGAGT<br>TCTATGCTCCTTGGTGTGGACACTGCAAAAACCTA<br>GAGCCAGAGTGGGCTGCCGCAGCTTCAGAAGTAA<br>AAGAGCAGACGAAAGGAAAAGTGAAACTGGCAGC<br>TGTGGATGCTACAGTCAATCAGGTTCTGGCCTCCC<br>GATACGGGATTAGAGGATTTCCTACAATCAAGATA<br>TTTCAGAAAGGCGAGTCTCCTGTGGATTATGACGG<br>TGGGCGGACAAGATCCGACATCGTGTCCCGGGCC<br>CTTGATTTGTTTTCTGATAACGCCCCACCTCCTGA<br>GCTGCTTGAGATTATCAACGAGGACATTGCCAAGA<br>GGACGTGTGAGGAGCACCAGCT | | |
| 1499 | NM_0057<br>45.6_194 | 194 | CTTCCGGTTTCCGGCCGCGGTATGAGGGGCGGG<br>GCCGGGGCTGCTGTGGGAGAGTTCGGTTGCTGCG<br>GCGGGGCCTGCACGTTGACTGTGGGAAACTCGGA<br>AACAAGCTCACATCTTCCTGTGGGAAACCTTCTAG<br>CAACAGGATGAGTCTGCAGTGGACTGCAGTTGCC<br>ACCTTCCTCTATGCGGAGGTCTTGTTGTGTTGCTT<br>CTCTGCATTCCCTTCATTTCTCCTAAAAGATGGCAG<br>AAGATTTTCAAGTCCCGGCTGGTGGAGTTGTTAGT<br>GTCCTATGGCAACACCTTCTTTGTGGTTCTCATTGT<br>CATCCTTGTGCTGTTGGTCATCGATGCCGTGCGCG<br>AAATTCGGAAGTATGATGATGTGACGGAAAAGGTG<br>AACCTCCAGAACAATCCCGGGGCCATGGAGCACT<br>TCCACATGAAGCTTTTCCGTGCCCAGAGGAATCTC<br>TACATTGCTGGCTTTTCCTTGCTGCTGTCCTTCCTG<br>CTTAGACGCCTGGTGACTCTCATTTCGCAGCAGGC<br>CACGCTGCTGGCCTCCAATGAAGCCTTTAAAAAGC<br>AGGCGGAGAGTGCTAGTGAGGCGGCCAAGAAGTA<br>CATGGAGGAGAATGACCAGCTCAAGAAGGGAGCT<br>GCTGTTGACGGAGGCAAGTTGGATGTCGGGAATG<br>CTGAGGTGAAGTTGGAGGAAGAGAACAGGAGCCT<br>GAAGGCTGACCTGCAGAAGCTAAAGGACGAGCTG<br>GCCAGCACTAAGCAAAAACTAGAGAAAGCTGAAAA<br>CCAGGTTCTGGCCATGCGGAAGCAGTCTGAGGGC<br>CTCACCAAGGAGTACGACCGCTTGCTGGAGGAGC<br>ACGCAAAGCTGCAGGCTGCAGTAGATGGTCCCAT<br>GGACAAGAAGGAAGAGTAAGGGCCTCCTTCCTCC<br>CCTGCCTGCAGCTGGCTTCCACCTGGCACGTGCC<br>TGCTGCTTCCTGAGAGCCCGGCCTCTCCCTCCAG<br>TACTTCTGTTTGTGCCCTTCTGCTTCCCCCATTCCC<br>TTCCACAGCTCATAGCTCGTCA | 27 | LLCCFSAF<br>PSFLLKDG<br>RRFSSPG<br>WWSC* |
| 1500 | NM_0057<br>45.6_271 | 271 | CTTCCGGTTTCCGGCCGCGGTATGAGGGGCGGG<br>GCCGGGGCTGCTGTGGGAGAGTTCGGTTGCTGCG<br>GCGGGGCCTGCACGTTGACTGTGGGAAACTCGGA<br>AACAAGCTCACATCTTCCTGTGGGAAACCTTCTAG<br>CAACAGGATGAGTCTGCAGTGGACTGCAGTTGCC<br>ACCTTCCTCTATGCGGAGGTCTTTGTTGTGTTGCT<br>TCTCTGCATTCCCTTCATTTCTCCTAAAAGATGGCA<br>GAAGATTTTCAAGTCCCGGCTGGTGGAGTGTTAGT<br>GTCCTATGGCAACACCTTCTTTGTGGTTCTCATTGT<br>CATCCTTGTGCTGTTGGTCATCGATGCCGTGCGCG<br>AAATTCGGAAGTATGATGATGTGACGGAAAAGGTG<br>AACCTCCAGAACAATCCCGGGGCCATGGAGCACT<br>TCCACATGAAGCTTTTCCGTGCCCAGAGGAATCTC<br>TACATTGCTGGCTTTTCCTTGCTGCTGTCCTTCCTG<br>CTTAGACGCCTGGTGACTCTCATTTCGCAGCAGGC<br>CACGCTGCTGGCCTCCAATGAAGCCTTTAAAAAGC<br>AGGCGGAGAGTGCTAGTGAGGCGGCCAAGAAGTA<br>CATGGAGGAGAATGACCAGCTCAAGAAGGGAGCT<br>GCTGTTGACGGAGGCAAGTTGGATGTCGGGAATG<br>CTGAGGTGAAGTTGGAGGAAGAGAACAGGAGCCT<br>GAAGGCTGACCTGCAGAAGCTAAAGGACGAGCTG<br>GCCAGCACTAAGCAAAAACTAGAGAAAGCTGAAAA<br>CCAGGTTCTGGCCATGCGGAAGCAGTCTGAGGGC<br>CTCACCAAGGAGTACGACCGCTTGCTGGAGGAGC<br>ACGCAAAGCTGCAGGCTGCAGTAGATGGTCCCAT<br>GGACAAGAAGGAAGAGTAAGGGCCTCCTTCCTCC<br>CCTGCCTGCAGCTGGCTTCCACCTGGCACGTGCC<br>TGCTGCTTCCTGAGAGCCCGGCCTCTCCCTCCAG<br>TACTTCTGTTTGTGCCCTTCTGCTTCCCCCATTCCC<br>TTCCACAGCTCATAGCTCGTCA | 1 | C* |

TABLE 3A-continued

| SEQ ID | identifier_position | position | modified_RNA | PAP length | PAP |
|---|---|---|---|---|---|
| 1501 | NM_0057 45.6_299 | 299 | CTTCCGGTTTCCGGCCGCGGTATGAGGGGCGGG GCCGGGGCTGCTGTGGGAGAGTTCGGTTGCTGCG GCGGGGCCTGCACGTTGACTGTGGGAAACTCGGA AACAAGCTCACATCTTCCTGTGGGAAACCTTCTAG CAACAGGATGAGTCTGCAGTGGACTGCAGTTGCC ACCTTCCTCTATGCGGAGGTCTTTGTTGTGTTGCT TCTCTGCATTCCCTTCATTTCTCCTAAAAGATGGCA GAAGATTTTCAAGTCCCGGCTGGTGGAGTTGTTAG TGTCCTATGGCAACACCTTCTTGTGGTTCTCATTGT CATCCTTGTGCTGTTGGTCATCGATGCCGTGCGCG AAATTCGGAAGTATGATGATGTGACGGAAAAGGTG AACCTCCAGAACAATCCCGGGGCCATGGAGCACT TCCACATGAAGCTTTTCCGTGCCCAGAGGAATCTC TACATTGCTGGCTTTTCCTTGCTGCTGTCCTTCCTG CTTAGACGCCTGGTGACTCTCATTTCGCAGCAGGC CACGCTGCTGGCCTCCAATGAAGCCTTTAAAAAGC AGGCGGAGAGTGCTAGTGAGGCGGCCAAGAAGTA CATGGAGGAGAATGACCAGCTCAAGAAGGGAGCT GCTGTTGACGGAGGCAAGTTGGATGTCGGGAATG CTGAGGTGAAGTTGGAGGAAGAGAACAGGAGCCT GAAGGCTGACCTGCAGAAGCTAAAGGACGAGCTG GCCAGCACTAAGCAAAAACTAGAGAAAGCTGAAAA CCAGGTTCTGGCCATGCGGAAGCAGTCTGAGGGC CTCACCAAGGAGTACGACCGCTTGCTGGAGGAGC ACGCAAAGCTGCAGGCTGCAGTAGATGGTCCCAT GGACAAGAAGGAAGAGTAAGGGCCTCCTTCCTCC CCTGCCTGCAGCTGGCTTCCACCTGGCACGTGCC TGCTGCTTCCTGAGAGCCCGGCCTCTCCCTCCAG TACTTCTGTTTGTGCCCTTCTGCTTCCCCCATTCCC TTCCACAGCTCATAGCTCGTCA | 24 | LWFSLSSL CCWSSMP CAKFGSM MM* |
| 1502 | NM_0057 45.6_584 | 584 | CTTCCGGTTTCCGGCCGCGGTATGAGGGGCGGG GCCGGGGCTGCTGTGGGAGAGTTCGGTTGCTGCG GCGGGGCCTGCACGTTGACTGTGGGAAACTCGGA AACAAGCTCACATCTTCCTGTGGGAAACCTTCTAG CAACAGGATGAGTCTGCAGTGGACTGCAGTTGCC ACCTTCCTCTATGCGGAGGTCTTTGTTGTGTTGCT TCTCTGCATTCCCTTCATTTCTCCTAAAAGATGGCA GAAGATTTTCAAGTCCCGGCTGGTGGAGTTGTTAG TGTCCTATGGCAACACCTTCTTTGTGGTTCTCATTG TCATCCTTGTGCTGTTGGTCATCGATGCCGTGCGC GAAATTCGGAAGTATGATGATGTGACGGAAAAGGT GAACCTCCAGAACAATCCCGGGGCCATGGAGCAC TTCCACATGAAGCTTTTCCGTGCCCAGAGGAATCT CTACATTGCTGGCTTTTCCTTGCTGCTGTCCTTCCT GCTTAGACGCCTGGTGACTCTCATTTCGCAGCAGG CCACGCTGCTGGCCTCCAATGAAGCCTTTAAAAAG CAGGCGGAGAGTGCTAGTGAGGCGGCAAGAAGTA CATGGAGGAGAATGACCAGCTCAAGAAGGGAGCT GCTGTTGACGGAGGCAAGTTGGATGTCGGGAATG CTGAGGTGAAGTTGGAGGAAGAGAACAGGAGCCT GAAGGCTGACCTGCAGAAGCTAAAGGACGAGCTG GCCAGCACTAAGCAAAAACTAGAGAAAGCTGAAAA CCAGGTTCTGGCCATGCGGAAGCAGTCTGAGGGC CTCACCAAGGAGTACGACCGCTTGCTGGAGGAGC ACGCAAAGCTGCAGGCTGCAGTAGATGGTCCCAT GGACAAGAAGGAAGAGTAAGGGCCTCCTTCCTCC CCTGCCTGCAGCTGGCTTCCACCTGGCACGTGCC TGCTGCTTCCTGAGAGCCCGGCCTCTCCCTCCAG TACTTCTGTTTGTGCCCTTCTGCTTCCCCCATTCCC TTCCACAGCTCATAGCTCGTCA | 27 | RSTWRRM TSSRRELL LTEASWM SGMLR* |
| 1503 | NM_0057 62.2_157 9 | 1579 | GGCGCGCGGGCGAGCGGTTGTGCTTGTGCTTGTG GCGCGTGGTGCGGGTTTCGGCGGCGGCTGAGGA AGAAGCGCGGGCGGCGCCTTCGGGAGGCGAGCA GGCAGCAGTTGGCCGTGCCGTAGCAGCGTCCCGC GCGCGGCGGGCAGCGGCCCAGGAGGCGCGTGG CGGCGCTCGGCCTCGCGGCGGCGGCGGCGGCAG CGGCCCAGCAGTTGGCGGCGAGCGCGTCTGCGC CTGCGCGGCGGGCCCCGCGCCCCTCCTCCCCCC CTGGGCGCCCCGGCGGCGTGTGAATGGCGGCC TCCGCGGCGGCAGCCTCGGCAGCAGCGGCCTCG GCCGCCTCTGGCAGCCCGGGCCCGGGCGAGGGC TCCGCTGGCGGCGAAAAGCGCTCCACCGCCCTT CGGCCGCAGCCTCGGCCTCTGCCTCAGCCGCGG CGTCGTCGCCCGCGGGGGCGGCGCCGAGGCGC TGGAGCTGCTGGAGCACTGCGGCGTGTGCAGAGA GCGCCTGCGACCCGAGAGGGAGCCCCGCCTGCT GCCCTGTTTGCACTCGGCCTGTAGTGCCTGCTTAG | 0 | * |

TABLE 3A-continued

| SEQ ID | identifier_position | position | modified_RNA | PAP length | PAP |
|---|---|---|---|---|---|
| | | | GGCCCGCGGCCCCCGCCGCCGCCAACAGCTCGG GGGACGGCGGGGCGGCGGGCGACGGCACCGTG GTGGACTGTCCCGTGTGCAAGCAACAGTGCTTCTC CAAAGACATCGTGGAGAATTATTTCATGCGTGATA GTGGCAGCAAGGCTGCCACCGACGCCCAGGATG CGAACCAGTGCTGCACTAGCTGTGAGGATAATGC CCCAGCCACCAGCTACTGTGTGGAGTGCTCGGAG CCTCTGTGTGAGACCTGTGTAGAGGCGCACCAGC GGGTGAAGTACACCAAGGACCATACTGTGCGCTC TACTGGGCCAGCCAAGTCTCGGGATGGTGAACGT ACTGTCTATTGCAACGTACACAAGCATGAACCCCT TGTGCTGTTTTGTGAGAGCTGTGATACTCTCACCT GCCGAGACTGCCAGCTCAATGCCCACAAGGACCA CCAGTACCAGTTCTTA | | |
| 1504 | NM_0057 62.2_189 4 | 1894 | GGCGCGCGGGCGAGCGGTTGTGCTTGTGCTTGTG GCGCGTGGTGCGGGTTTCGGCGGCGGCTGAGGA AGAAGCGCGGGCGGCGCCTTCGGGAGGCGAGCA GGCAGCAGTTGGCCGTGCCGTAGCAGCGTCCCGC GCGCGGCGGGCAGCGGCCCAGGAGGCGCGTGG CGGCGCTCGGCCTCGCGGCGGCGGCGGCGGCAG CGGCCCAGCAGTTGGCGGCGAGCGCGTCTGCGC CTGCGCGGCGGGCCCCGCGCCCCTCCTCCCCCC CTGGGCGCCCCGGCGGCGTGTGAATGGCGGCC TCCGCGGCGGCAGCCTCGGCAGCAGCGGCCTCG GCCGCCTCTGGCAGCCCGGGCCCGGGCGAGGGC TCCGCTGGCGGCGAAAAGCGCTCCACCGCCCCTT CGGCCGCAGCCTCGGCCTCTGCCTCAGCCGCGG CGTCGTCGCCCGCGGGGGCGGCGCCGAGGCGC TGGAGCTGCTGGAGCACTGCGGCGTGTGCAGAGA GCGCCTGCGACCCGAGAGGGAGCCCCGCCTGCT GCCCTGTTTGCACTCGGCCTGTAGTGCCTGCTTAG GGCCCGCGGCCCCCGCCGCCGCCAACAGCTCGG GGGACGGCGGGGCGGCGGGCGACGGCACCGTG GTGGACTGTCCCGTGTGCAAGCAACAGTGCTTCTC CAAAGACATCGTGGAGAATTATTTCATGCGTGATA GTGGCAGCAAGGCTGCCACCGACGCCCAGGATG CGAACCAGTGCTGCACTAGCTGTGAGGATAATGC CCCAGCCACCAGCTACTGTGTGGAGTGCTCGGAG CCTCTGTGTGAGACCTGTGTAGAGGCGCACCAGC GGGTGAAGTACACCAAGGACCATACTGTGCGCTC TACTGGGCCAGCCAAGTCTCGGGATGGTGAACGT ACTGTCTATTGCAACGTACACAAGCATGAACCCCT TGTGCTGTTTTGTGAGAGCTGTGATACTCTCACCT GCCGAGACTGCCAGCTCAATGCCCACAAGGACCA CCAGTACCAGTTCTTA | 139 | LRLQEPLV PHPWLAW PLSRRRRR RLPLEPLLL PLRALRPN LCLWLLRR VLVLRVPA WPHLVAAP AQGWRW WLLRVPQP QWAREP WMTVPPF AVSARSQA IWLCATSV SFVSTWTV TCRPCRM YQGRSGA AHSAMCSL T* |
| 1505 | NM_0057 62.2_222 5 | 2225 | GGCGCGCGGGCGAGCGGTTGTGCTTGTGCTTGTG GCGCGTGGTGCGGGTTTCGGCGGCGGCTGAGGA AGAAGCGCGGGCGGCGCCTTCGGGAGGCGAGCA GGCAGCAGTTGGCCGTGCCGTAGCAGCGTCCCGC GCGCGGCGGGCAGCGGCCCAGGAGGCGCGTGG CGGCGCTCGGCCTCGCGGCGGCGGCGGCGGCAG CGGCCCAGCAGTTGGCGGCGAGCGCGTCTGCGC CTGCGCGGCGGGCCCCGCGCCCCTCCTCCCCCC CTGGGCGCCCCGGCGGCGTGTGAATGGCGGCC TCCGCGGCGGCAGCCTCGGCAGCAGCGGCCTCG GCCGCCTCTGGCAGCCCGGGCCCGGGCGAGGGC TCCGCTGGCGGCGAAAAGCGCTCCACCGCCCCTT CGGCCGCAGCCTCGGCCTCTGCCTCAGCCGCGG CGTCGTCGCCCGCGGGGGCGGCGCCGAGGCGC TGGAGCTGCTGGAGCACTGCGGCGTGTGCAGAGA GCGCCTGCGACCCGAGAGGGAGCCCCGCCTGCT GCCCTGTTTGCACTCGGCCTGTAGTGCCTGCTTAG GGCCCGCGGCCCCCGCCGCCGCCAACAGCTCGG GGGACGGCGGGGCGGCGGGCGACGGCACCGTG GTGGACTGTCCCGTGTGCAAGCAACAGTGCTTCTC CAAAGACATCGTGGAGAATTATTTCATGCGTGATA GTGGCAGCAAGGCTGCCACCGACGCCCAGGATG CGAACCAGTGCTGCACTAGCTGTGAGGATAATGC CCCAGCCACCAGCTACTGTGTGGAGTGCTCGGAG CCTCTGTGTGAGACCTGTGTAGAGGCGCACCAGC GGGTGAAGTACACCAAGGACCATACTGTGCGCTC TACTGGGCCAGCCAAGTCTCGGGATGGTGAACGT ACTGTCTATTGCAACGTACACAAGCATGAACCCCT TGTGCTGTTTTGTGAGAGCTGTGATACTCTCACCT GCCGAGACTGCCAGCTCAATGCCCACAAGGACCA CCAGTACCAGTTCTTA | 29 | VSTWTVTC RPCRMYQ GRSGAAH SAMCSLT* |

TABLE 3A-continued

| SEQ ID | identifier_position | position | modified_RNA | PAP length | PAP |
|---|---|---|---|---|---|
| 1506 | NM_0057 62.2_227 3 | 2273 | GGCGCGCGGGCGAGCGGTTGTGCTTGTGCTTGTG GCGCGTGGTGCGGGTTTCGGCGGCGGCTGAGGA AGAAGCGCGGGCGGCGCCTTCGGGAGGCGAGCA GGCAGCAGTTGGCCGTGCCGTAGCAGCGTCCCGC GCGCGGCGGGCAGCGGCCCAGGAGGCGCGTGG CGGCGCTCGGCCTCGCGGCGGCGGCGGCGGCAG CGGCCCAGCAGTTGGCGGCGAGCGCGTCTGCGC CTGCGCGGCGGGCCCCGCGCCCTCCTCCCCCC CTGGGCGCCCCGGCGGCGTGTGAATGGCGGCC TCCGCGGCGGCAGCCTCGGCAGCAGCGGCCTCG GCCGCCTCTGGCAGCCCGGGCCCGGGCGAGGGC TCCGCTGGCGGCGAAAAGCGCTCCACCGCCCCTT CGGCCGCAGCCTCGGCCTCTGCCTCAGCCGCGG CGTCGTCGCCCGCGGGGGCGGCGCCGAGGCGC TGGAGCTGCTGGAGCACTGCGGCGTGTGCAGAGA GCGCCTGCGACCCGAGAGGGAGCCCCGCCTGCT GCCCTGTTTGCACTCGGCCTGTAGTGCCTGCTTAG GGCCCGCGGCCCCCGCCGCCGCCAACAGCTCGG GGGACGGCGGGGCGGCGGGCGACGGCACCGTG GTGGACTGTCCCGTGTGCAAGCAACAGTGCTTCTC CAAAGACATCGTGGAGAATTATTTCATGCGTGATA GTGGCAGCAAGGCTGCCACCGACGCCCAGGATG CGAACCAGTGCTGCACTAGCTGTGAGGATAATGC CCCAGCCACCAGCTACTGTGTGGAGTGCTCGGAG CCTCTGTGTGAGACCTGTGTAGAGGCGCACCAGC GGGTGAAGTACACCAAGGACCATACTGTGCGCTC TACTGGGCCAGCCAAGTCTCGGGATGGTGAACGT ACTGTCTATTGCAACGTACACAAGCATGAACCCCT TGTGCTGTTTTGTGAGAGCTGTGATACTCTCACCT GCCGAGACTGCCAGCTCAATGCCCACAAGGACCA CCAGTACCAGTTCTTA | 13 | RSGAAHSA MCSLT* |
| 1507 | NM_0057 62.2_950 | 950 | GGCGCGCGGGCGAGCGGTTGTGCTTGTGCTTGTG GCGCGTGGTGCGGGTTTCGGCGGCGGCTGAGGA AGAAGCGCGGGCGCGCCTTCGGGAGGCGAGCA GGCAGCAGTTGGCCGTGCCGTAGCAGCGTCCCGC GCGCGGCGGGCAGCGGCCCAGGAGGCGCGTGG CGGCGCTCGGCCTCGCGGCGGCGGCGGCGGCAG CGGCCCAGCAGTTGGCGGCGAGCGCGTCTGCGC CTGCGCGGCGGGCCCCGCGCCCTCCTCCCCCC CTGGGCGCCCCGGCGGCGTGTGAATGGCGGCC TCCGCGGCGGCAGCCTCGGCAGCAGCGGCCTCG GCCGCCTCTGGCAGCCCGGGCCCGGGCGAGGGC TCCGCTGGCGGCGAAAAGCGCTCCACCGCCCCTT CGGCCGCAGCCTCGGCCTCTGCCTCAGCCGCGG CGTCGTCGCCCGCGGGGGCGGCGCCGAGGCGC TGGAGCTGCTGGAGCACTGCGGCGTGTGCAGAGA GCGCCTGCGACCCGAGAGGGAGCCCCGCCTGCT GCCCTGTTTGCACTCGGCCTGTAGTGCCTGCTTAG GGCCCGCGGCCCCCGCCGCCGCCAACAGCTCGG GGGACGGCGGGGCGGCGGGCGACGGCACCGTG GTGGACTGTCCCGTGTGCAAGCAACAGTGCTTCTC CAAAGACATCGTGGAGAATTATTTCATGCGTGATA GTGGCAGCAAGGCTGCCACCGACGCCCAGGATG CGAACCAGTGCTGCACTAGCTGTGAGGATAATGC CCCAGCCACCAGCTACTGTGTGGAGTGCTCGGAG CCTCTGTGTGAGACCTGTGTAGAGGCGCACCAGC GGGTGAAGTACACCAAGGACCATACTGTGCGCTC TACTGGGCCAGCCAAGTCTCGGGATGGTGAACGT ACTGTCTATTGCAACGTACACAAGCATGAACCCCT TGTGCTGTTTTGTGAGAGCTGTGATACTCTCACCTG CCGAGACTGCCAGCTCAATGCCCACAAGGACCAC CAGTACCAGTTCTTAG | 24 | VRAVILSPA ETASSMPT RTTSTSS* |
| 1508 | NM_0057 76.2_179 | 179 | GGTCGCGGCTGTGGCCGGGGGAAGTGAATGGTTT TACCCAGAGGGCCCTGCGCCGCTTTCTCCGCTG GCAACGGCGCCGCTCCCCGCTCCTCCTCCCCAGC CATGGCGTTCACGTTCGCGGCCTTCTGCTACATGC TGGCGCTGCTGCTCACTGCCGCGCTCATCTTCTTC GCCATTGGCACATTATAGCATTTGATGAGCTGAAG ACTGATTACAAGAATCCTATAGACCAGTGTAATAC CCTGAATCCCCTTGTACTCCCAGAGTACCTCATCC ACGCTTTCTTCTGTGTCATGTTTCTTTGTGCAGCAG AGTGGCTTACACTGGGTCTCAATATGCCCCTCTTG GCATATCATATTTGGAGGTATATGAGTAGACCAGT GATGAGTGGCCCAGGACTCTATGACCCTACAACC ATCATGAATGCAGATATTCTAGCATATTGTCAGAAG GAAGGATGGTGCAAATTAGCTTTTTATCTTCTAGCA TTTTTTTACTACCTATATGGCATGATCTATGTTTTG | 3 | GTL* |

TABLE 3A-continued

| SEQ ID | identifier_position | position | modified_RNA | PAP length | PAP |
|---|---|---|---|---|---|
| | | | GTGAGCTCTTAGAACAACACACAGAAGAATTGGTC<br>CAGTTAAGTGCATGCAAAAAGCCACCAAATGAAGG<br>GATTCTATCCAGCAAGATCCTGTCCAAGAGTAGCC<br>TGTGGAATCTGATCAGTTACTTTAAAAAAATGACTCC<br>TTATTTTTAAATGTTTCCACATTTTTGCTTGTGGAA<br>AGACTGTTTTCATATGTTATACTCAGATAAAGATTT<br>TAAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA<br>TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | | |
| 1509 | NM_0057<br>76.2_196 | 196 | GGTCGCGGCTGTGGCCGGGGGAAGTGAATGGTTT<br>TACCCAGAGGGCCCTGCGCCGCCTTTCTCCGCTG<br>GCAACGGCGCCGCTCCCCGCTCCTCCTCCCCAGC<br>CATGGCGTTCACGTTCGCGGCCTTCTGCTACATGC<br>TGGCGCTGCTGCTCACTGCCGCGCTCATCTTCTTC<br>GCCATTTGGCACATTATAGCATTGATGAGCTGAAG<br>ACTGATTACAAGAATCCTATAGACCAGTGTAATAC<br>CCTGAATCCCCTTGTACTCCCAGAGTACCTCATCC<br>ACGCTTTCTTCTGTGTCATGTTTCTTTGTGCAGCAG<br>AGTGGCTTACACTGGGTCTCAATATGCCCCTCTTG<br>GCATATCATATTTGGAGGTATATGAGTAGACCAGT<br>GATGAGTGGCCCAGGACTCTATGACCCTACAACC<br>ATCATGAATGCAGATATTCTAGCATATTGTCAGAAG<br>GAAGGATGGTGCAAATTAGCTTTTTATCTTCTAGCA<br>TTTTTTTACTACCTATATGGCATGATCTATGTTTTG<br>GTGAGCTCTTAGAACAACACACAGAAGAATTGGTC<br>CAGTTAAGTGCATGCAAAAAGCCACCAAATGAAGG<br>GATTCTATCCAGCAAGATCCTGTCCAAGAGTAGCC<br>TGTGGAATCTGATCAGTTACTTTAAAAAAATGACTCC<br>TTATTTTTAAATGTTTCCACATTTTTGCTTGTGGAA<br>AGACTGTTTTCATATGTTATACTCAGATAAAGATTT<br>TAAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA<br>TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | 3 | LMS* |
| 1510 | NM_0057<br>76.2_305 | 305 | GGTCGCGGCTGTGGCCGGGGGAAGTGAATGGTTT<br>TACCCAGAGGGCCCTGCGCCGCCTTTCTCCGCTG<br>GCAACGGCGCCGCTCCCCGCTCCTCCTCCCCAGC<br>CATGGCGTTCACGTTCGCGGCCTTCTGCTACATGC<br>TGGCGCTGCTGCTCACTGCCGCGCTCATCTTCTTC<br>GCCATTTGGCACATTATAGCATTTGATGAGCTGAA<br>GACTGATTACAAGAATCCTATAGACCAGTGTAATA<br>CCCTGAATCCCCTTGTACTCCCAGAGTACCTCATC<br>CACGCTTTCTTCTGTGTCATGTTTCTTGTGCAGCA<br>GAGTGGCTTACACTGGGTCTCAATATGCCCCTCTT<br>GGCATATCATATTTGGAGGTATATGAGTAGACCAG<br>TGATGAGTGGCCCAGGACTCTATGACCCTACAACC<br>ATCATGAATGCAGATATTCTAGCATATTGTCAGAAG<br>GAAGGATGGTGCAAATTAGCTTTTTATCTTCTAGCA<br>TTTTTTTACTACCTATATGGCATGATCTATGTTTTG<br>GTGAGCTCTTAGAACAACACACAGAAGAATTGGTC<br>CAGTTAAGTGCATGCAAAAAGCCACCAAATGAAGG<br>GATTCTATCCAGCAAGATCCTGTCCAAGAGTAGCC<br>TGTGGAATCTGATCAGTTACTTTAAAAAAATGACTCC<br>TTATTTTTAAATGTTTCCACATTTTTGCTTGTGGAA<br>AGACTGTTTTCATATGTTATACTCAGATAAAGATTT<br>TAAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA<br>TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | 22 | VQQSGLH<br>WVSICPSW<br>HIIFGGI* |
| 1511 | NM_0057<br>76.2_362 | 362 | GGTCGCGGCTGTGGCCGGGGGAAGTGAATGGTTT<br>TACCCAGAGGGCCCTGCGCCGCCTTTCTCCGCTG<br>GCAACGGCGCCGCTCCCCGCTCCTCCTCCCCAGC<br>CATGGCGTTCACGTTCGCGGCCTTCTGCTACATGC<br>TGGCGCTGCTGCTCACTGCCGCGCTCATCTTCTTC | 3 | GGI* |

TABLE 3A-continued

| SEQ ID | identifier_position | position | modified_RNA | PAP length | PAP |
|---|---|---|---|---|---|
| | | | GCCATTTGGCACATTATAGCATTTGATGAGCTGAA<br>GACTGATTACAAGAATCCTATAGACCAGTGTAATA<br>CCCTGAATCCCCTTGTACTCCCAGAGTACCTCATC<br>CACGCTTTCTTCTGTGTCATGTTTCTTTGTGCAGCA<br>GAGTGGCTTACACTGGGTCTCAATATGCCCCTCTT<br>GGCATATCATATTGGAGGTATATGAGTAGACCAGT<br>GATGAGTGGCCCAGGACTCTATGACCCTACAACC<br>ATCATGAATGCAGATATTCTAGCATATTGTCAGAAG<br>GAAGGATGGTGCAAATTAGCTTTTTATCTTCTAGCA<br>TTTTTTTACTACCTATATGGCATGATCTATGTTTTG<br>GTGAGCTCTTAGAACAACACACAGAAGAATTGGTC<br>CAGTTAAGTGCATGCAAAAAGCCACCAAATGAAGG<br>GATTCTATCCAGCAAGATCCTGTCCAAGAGTAGCC<br>TGTGGAATCTGATCAGTTACTTTAAAAAAATGACTCC<br>TTATTTTTAAATGTTTCCACATTTTTGCTTGTGGAA<br>AGACTGTTTTCATATGTTATACTCAGATAAAGATTT<br>TAAAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA<br>TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | | |
| 1512 | NM_0057<br>76.2_446 | 446 | GGTCGCGGCTGTGGCCGGGGGAAGTGAATGGTTT<br>TACCCAGAGGGCCCTGCGCCGCCTTTCTCCGCTG<br>GCAACGGCGCCGCTCCCCGCTCCTCCTCCCCAGC<br>CATGGCGTTCACGTTCGCGGCCTTCTGCTACATGC<br>TGGCGCTGCTGCTCACTGCCGCGCTCATCTTCTTC<br>GCCATTTGGCACATTATAGCATTTGATGAGCTGAA<br>GACTGATTACAAGAATCCTATAGACCAGTGTAATA<br>CCCTGAATCCCCTTGTACTCCCAGAGTACCTCATC<br>CACGCTTTCTTCTGTGTCATGTTTCTTTGTGCAGCA<br>GAGTGGCTTACACTGGGTCTCAATATGCCCCTCTT<br>GGCATATCATATTTGGAGGTATATGAGTAGACCAG<br>TGATGAGTGGCCCAGGACTCTATGACCCTACAACC<br>ATCATGAATGCAGATATTCTAGCATATGTCAGAAG<br>GAAGGATGGTGCAAATTAGCTTTTTATCTTCTAGCA<br>TTTTTTTACTACCTATATGGCATGATCTATGTTTTG<br>GTGAGCTCTTAGAACAACACACAGAAGAATTGGTC<br>CAGTTAAGTGCATGCAAAAAGCCACCAAATGAAGG<br>GATTCTATCCAGCAAGATCCTGTCCAAGAGTAGCC<br>TGTGGAATCTGATCAGTTACTTTAAAAAAATGACTCC<br>TTATTTTTAAATGTTTCCACATTTTTGCTTGTGGAA<br>AGACTGTTTTCATATGTTATACTCAGATAAAGATTT<br>TAAAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA<br>TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | 8 | VRRKDGA<br>N* |
| 1513 | NM_0057<br>76.2_525 | 525 | GGTCGCGGCTGTGGCCGGGGGAAGTGAATGGTTT<br>TACCCAGAGGGCCCTGCGCCGCCTTTCTCCGCTG<br>GCAACGGCGCCGCTCCCCGCTCCTCCTCCCCAGC<br>CATGGCGTTCACGTTCGCGGCCTTCTGCTACATGC<br>TGGCGCTGCTGCTCACTGCCGCGCTCATCTTCTTC<br>GCCATTTGGCACATTATAGCATTTGATGAGCTGAA<br>GACTGATTACAAGAATCCTATAGACCAGTGTAATA<br>CCCTGAATCCCCTTGTACTCCCAGAGTACCTCATC<br>CACGCTTTCTTCTGTGTCATGTTTCTTTGTGCAGCA<br>GAGTGGCTTACACTGGGTCTCAATATGCCCCTCTT<br>GGCATATCATATTTGGAGGTATATGAGTAGACCAG<br>TGATGAGTGGCCCAGGACTCTATGACCCTACAACC<br>ATCATGAATGCAGATATTCTAGCATATTGTCAGAAG<br>GAAGGATGGTGCAAATTAGCTTTTTATCTTCTAGCA<br>TTTTTTTACTACCTATATGGCATGATCTATGTTTGG<br>TGAGCTCTTAGAACAACACACAGAAGAATTGGTCC<br>AGTTAAGTGCATGCAAAAAGCCACCAAATGAAGGG<br>ATTCTATCCAGCAAGATCCTGTCCAAGAGTAGCCT<br>GTGGAATCTGATCAGTTACTTTAAAAAAATGACTCCT<br>TATTTTTAAATGTTTCCACATTTTTGCTTGTGGAAA<br>GACTGTTTTCATATGTTATACTCAGATAAAGATTT<br>AAATGGTATTACGTATAAATTAATATAAAATGATTA<br>CCTCTGGTGTTGACAGGTTTGAACTTGCACTTCTT<br>AAGGAACAGCCATAATCCTCTGAATGATGCATTAA | 1 | W* |

TABLE 3A-continued

| SEQ ID | identifier_position | position | modified_RNA | PAP length | PAP |
|---|---|---|---|---|---|
| | | | TTACTGACTGTCCTAGTACATTGGAAGCTTTTGTTT<br>ATAGGAACTTGTAGGGCTCATTTTGGTTTCATTGAA<br>ACAGTATCTAATTATAAATTAGCTGTAGATATCAGG<br>TGCTTCTGATGAAGTGAAAATGTATATCTGACTAGT<br>GGGAAACTTCATGGGTTTCCTCATCTGTCATGTC | | |
| 1514 | NM_0057<br>83.3_277 | 277 | GGCGTCCAAGGTGATATCGCGCGAGGTTCGCAGC<br>CAATAAGGAGGCGGATGTGACGGCCCGTTTGCAG<br>CCGCCGGCAGCTACTGCAAGGCAAAAGCCGGAGT<br>GGACGTGTCTTTTGAAACTGCTGCTCTTTCACTTCT<br>CAGGCGTCACCGAGAGCTCAGCACCCAGGCTGAA<br>CTCTGTACCATTTGGAAGAATGGAAGCTGATGCAT<br>CTGTTGACATGTTTTCCAAAGTCCTGGAGCATCAG<br>CTGCTTCAGACTACCAAACTGGTGGAAGAACATTG<br>GATTCTGAAATTCAAAAACTGGATCAGATGGATGA<br>GGATGAATTGGAACGCCTTAAAGAAAAGAGACTCC<br>AGGCACTAAGGAAAGCTCAACAGCAGAAACAAGA<br>ATGGCTTTCTAAAGGACATGGGGAATACAGAGAAA<br>TCCCTAGTGAAAGAGACTTTTTTCAAGAAGTCAAG<br>GAGAGTGAAAATGTGGTTTGCCATTTCTACAGAGA<br>CTCCACATTCAGGTGTAAAATACTAGACAGACATC<br>TGGCAATATTGTCCAAGAAACACCTCGAGACCAAA<br>TTTTTGAAGCTGAATGTGGAAAAAGCACCTTTCCTT<br>TGTGAGAGACTGCATATCAAAGTCATTCCCACACT<br>AGCACTGCTAAAAGATGGGAAAACACAAGATTATG<br>TTGTTGGGTTTACTGACCTAGGAAATACAGATGAC<br>TTCACCACAGAAACTTTAGAATGGAGGCTCGGTTC<br>TTCTGACATTCTTAATTACAGTGGAAATTTAATGGA<br>GCCACCATTTCAGAACCAAAAGAAATTTGGAACAA<br>ACTTCACAAAGCTGGAAAAGAAAACTATCCGAGGA<br>AAGAAATATGATTCAGACTCTGATGATGATTAGAG<br>CTCAATAATTCTTTGTAAATTGTCTTTTTTTTTCTGC<br>TTCAGATTTAAATGTGTTTTTAAAATTCTATTAATGT<br>CTATACATTGGTCACCTAAATACTCATATTCTCGAG<br>TTTTATACAGTTGTATCACATCGAAAAGTGTCTTTA<br>CTGTT | 26 | WILKFKNW<br>IRWMRMN<br>WNALKKR<br>DSRH* |
| 1515 | NM_0057<br>83.3_322 | 322 | GGCGTCCAAGGTGATATCGCGCGAGGTTCGCAGC<br>CAATAAGGAGGCGGATGTGACGGCCCGTTTGCAG<br>CCGCCGGCAGCTACTGCAAGGCAAAAGCCGGAGT<br>GGACGTGTCTTTTGAAACTGCTGCTCTTTCACTTCT<br>CAGGCGTCACCGAGAGCTCAGCACCCAGGCTGAA<br>CTCTGTACCATTTGGAAGAATGGAAGCTGATGCAT<br>CTGTTGACATGTTTTCCAAAGTCCTGGAGCATCAG<br>CTGCTTCAGACTACCAAACTGGTGGAAGAACATTT<br>GGATTCTGAAATTCAAAAACTGGATCAGATGGATG<br>AGGATGAATTGGAACGCCTTAAAGAAAAGAGACTCC<br>AGGCACTAAGGAAAGCTCAACAGCAGAAACAAGA<br>ATGGCTTTCTAAAGGACATGGGGAATACAGAGAAA<br>TCCCTAGTGAAAGAGACTTTTTTCAAGAAGTCAAG<br>GAGAGTGAAAATGTGGTTTGCCATTTCTACAGAGA<br>CTCCACATTCAGGTGTAAAATACTAGACAGACATC<br>TGGCAATATTGTCCAAGAAACACCTCGAGACCAAA<br>TTTTTGAAGCTGAATGTGGAAAAAGCACCTTTCCTT<br>TGTGAGAGACTGCATATCAAAGTCATTCCCACACT<br>AGCACTGCTAAAAGATGGGAAAACACAAGATTATG<br>TTGTTGGGTTTACTGACCTAGGAAATACAGATGAC<br>TTCACCACAGAAACTTTAGAATGGAGGCTCGGTTC<br>TTCTGACATTCTTAATTACAGTGGAAATTTAATGGA<br>GCCACCATTTCAGAACCAAAAGAAATTTGGAACAA<br>ACTTCACAAAGCTGGAAAAGAAAACTATCCGAGGA<br>AAGAAATATGATTCAGACTCTGATGATGATTAGAG<br>CTCAATAATTCTTTGTAAATTGTCTTTTTTTTTCTGC<br>TTCAGATTTAAATGTGTTTTTAAAATTCTATTAATGT<br>CTATACATTGGTCACCTAAATACTCATATTCTCGAG<br>TTTTATACAGTTGTATCACATCGAAAAGTGTCTTTA<br>CTGTT | 11 | WNALKKR<br>DSRH* |
| 1516 | NM_0057<br>83.3_387 | 387 | GGCGTCCAAGGTGATATCGCGCGAGGTTCGCAGC<br>CAATAAGGAGGCGGATGTGACGGCCCGTTTGCAG<br>CCGCCGGCAGCTACTGCAAGGCAAAAGCCGGAGT<br>GGACGTGTCTTTTGAAACTGCTGCTCTTTCACTTCT<br>CAGGCGTCACCGAGAGCTCAGCACCCAGGCTGAA<br>CTCTGTACCATTTGGAAGAATGGAAGCTGATGCAT<br>CTGTTGACATGTTTTCCAAAGTCCTGGAGCATCAG<br>CTGCTTCAGACTACCAAACTGGTGGAAGAACATTT<br>GGATTCTGAAATTCAAAAACTGGATCAGATGGATG<br>AGGATGAATTGGAACGCCTTAAAGAAAAGAGACTC<br>CAGGCACTAAGGAAAGCTCAACAGCAGAAACAAG<br>AATGGTTTCTAAAGGACATGGGGAATACAGAGAAA | 41 | FLKDMGNT<br>EKSLVKET<br>FFKKSRRV<br>KMWFAIST<br>ETPHSGVK<br>Y* |

TABLE 3A-continued

| SEQ ID | identifier_position | position | modified_RNA | PAP length | PAP |
|---|---|---|---|---|---|
| | | | TCCCTAGTGAAAGAGACTTTTTTCAAGAAGTCAAG GAGAGTGAAAATGTGGTTTGCCATTTCTACAGAGA CTCCACATTCAGGTGTAAAATACTAGACAGACATC TGGCAATATTGTCCAAGAAACACCTCGAGACCAAA TTTTTGAAGCTGAATGTGGAAAAAGCACCTTTCCTT TGTGAGAGACTGCATATCAAAGTCATTCCCACACT AGCACTGCTAAAAGATGGGAAAACACAAGATTATG TTGTTGGGTTTACTGACCTAGGAAATACAGATGAC TTCACCACAGAAACTTTAGAATGGAGGCTCGGTTC TTCTGACATTCTTAATTACAGTGGAAATTTAATGGA GCCACCATTTCAGAACCAAAAGAAATTTGGAACAA ACTTCACAAAGCTGGAAAAGAAAACTATCCGAGGA AAGAAATATGATTCAGACTCTGATGATGATTAGAG CTCAATAATTCTTTGTAAATTGTCTTTTTTTTCTGC TTCAGATTTAAATGTGTTTTTAAAATTCTATTAATGT CTATACATTGGTCACCTAAATACTCATATTCTCGAG TTTTATACAGTTGTATCACATCGAAAAGTGTCTTTA CTGTT | | |
| 1517 | NM_0057 83.3_471 | 471 | GGCGTCCAAGGTGATATCGCGCGAGGTTCGCAGC CAATAAGGAGGCGGATGTGACGGCCCGTTTGCAG CCGCCGGCAGCTACTGCAAGGCAAAAGCCGGAGT GGACGTGTCTTTTGAAACTGCTGCTCTTTCACTTCT CAGGCGTCACCGAGAGCTCAGCACCCAGGCTGAA CTCTGTACCATTTGGAAGAATGGAAGCTGATGCAT CTGTTGACATGTTTTCCAAAGTCCTGGAGCATCAG CTGCTTCAGACTACCAAACTGGTGGAAGAACATTT GGATTCTGAAATTCAAAAACTGGATCAGATGGATG AGGATGAATTGGAACGCCTTAAAGAAAAGAGACTC CAGGCACTAAGGAAAGCTCAACAGCAGAAACAAG AATGGCTTTCTAAAGGACATGGGGAATACAGAGAA ATCCCTAGTGAAAGAGACTTTTTTCAAGAAGTCAA GGAGAGTGAAAATGTGGTTGCCATTTCTACAGAGA CTCCACATTCAGGTGTAAAATACTAGACAGACATC TGGCAATATTGTCCAAGAAACACCTCGAGACCAAA TTTTTGAAGCTGAATGTGGAAAAAGCACCTTTCCTT TGTGAGAGACTGCATATCAAAGTCATTCCCACACT AGCACTGCTAAAAGATGGGAAAACACAAGATTATG TTGTTGGGTTTACTGACCTAGGAAATACAGATGAC TTCACCACAGAAACTTTAGAATGGAGGCTCGGTTC TTCTGACATTCTTAATTACAGTGGAAATTTAATGGA GCCACCATTTCAGAACCAAAAGAAATTTGGAACAA ACTTCACAAAGCTGGAAAAGAAAACTATCCGAGGA AAGAAATATGATTCAGACTCTGATGATGATTAGAG CTCAATAATTCTTTGTAAATTGTCTTTTTTTTCTGC TTCAGATTTAAATGTGTTTTTAAAATTCTATTAATGT CTATACATTGGTCACCTAAATACTCATATTCTCGAG TTTTATACAGTTGTATCACATCGAAAAGTGTCTTTA CTGTT | 13 | AISTETPHS GVKY* |
| 1518 | NM_0057 83.3_562 | 562 | GGCGTCCAAGGTGATATCGCGCGAGGTTCGCAGC CAATAAGGAGGCGGATGTGACGGCCCGTTTGCAG CCGCCGGCAGCTACTGCAAGGCAAAAGCCGGAGT GGACGTGTCTTTTGAAACTGCTGCTCTTTCACTTCT CAGGCGTCACCGAGAGCTCAGCACCCAGGCTGAA CTCTGTACCATTTGGAAGAATGGAAGCTGATGCAT CTGTTGACATGTTTTCCAAAGTCCTGGAGCATCAG CTGCTTCAGACTACCAAACTGGTGGAAGAACATTT GGATTCTGAAATTCAAAAACTGGATCAGATGGATG AGGATGAATTGGAACGCCTTAAAGAAAAGAGACTC CAGGCACTAAGGAAAGCTCAACAGCAGAAACAAG AATGGCTTTCTAAAGGACATGGGGAATACAGAGAA ATCCCTAGTGAAAGAGACTTTTTTCAAGAAGTCAA GGAGAGTGAAAATGTGGTTTGCCATTTCTACAGAG ACTCCACATTCAGGTGTAAAATACTAGACAGACAT CTGGCAATATTGTCCAAGAAACACCTCGAGACCAA ATTTGAAGCTGAATGTGGAAAAAGCACCTTTCCTT TGTGAGAGACTGCATATCAAAGTCATTCCCACACT AGCACTGCTAAAAGATGGGAAAACACAAGATTATG TTGTTGGGTTTACTGACCTAGGAAATACAGATGAC TTCACCACAGAAACTTTAGAATGGAGGCTCGGTTC TTCTGACATTCTTAATTACAGTGGAAATTTAATGGA GCCACCATTTCAGAACCAAAAGAAATTTGGAACAA ACTTCACAAAGCTGGAAAAGAAAACTATCCGAGGA AAGAAATATGATTCAGACTCTGATGATGATTAGAG CTCAATAATTCTTTGTAAATTGTCTTTTTTTTCTGC TTCAGATTTAAATGTGTTTTTAAAATTCTATTAATGT CTATACATTGGTCACCTAAATACTCATATTCTCGAG | 0 | * |

TABLE 3A-continued

| SEQ ID | identifier_position | position | modified_RNA | PAP length | PAP |
|---|---|---|---|---|---|
| | | | TTTTATACAGTTGTATCACATCGAAAAGTGTCTTTA CTGTT | | |
| 1519 | NM_0058 01.3_365 | 365 | CCGCCCCTCTGCCCCAGTCACTGAGCCGCCGCCG AGGATTCAGCAGCCTCCCCCTTGAGCCCCCTCGC TTCCCGACGTTCCGTTCCCCCCTGCCCGCCTTCTC CCGCCACCGCCGCCGCCGCCTTCCGCAGGCCGTT TCCACCGAGGAAAAGGAATCGTATCGTATGTCCGC TATCCAGAACCTCCACTCTTTCGACCCCTTGCTG ATGCAAGTAAGGGTGATGACCTGCTTCCTGCTGGC ACTGAGGATTATATCCATATAAGAATTCAACAGAGA AACGGCAGGAAGACCCTTACTACTGTCCAAGGGA TCGCTGATGATTACGATAAAAAGAAACTAGTGAAG GCGTTTAAGAAAAAGTTGCCTGCAATGGTACTGTA ATTGAGCATCCGGAATATGGAGAAGTAATTCAGCT ACAGGGTGACCAACGCAAGAACATATGCCAGTTC CTCGTAGAGATTGGACTGGCTAAGGACGATCAGC TGAAGGTTCATGGGTTTTAAGTGCTTGTGGCTCAC TGAAGCTTAAGTGAGGATTTCCTTGCAATGAGTAG AATTTCCCTTCTCTCCCTTGTCACAGGTTTAAAAAC CTCACAGCTTGTATAATGTAACCATTTGGGGTCCG CTTTTAACTTGGACTAGTGTAACTCCTTCATGCAAT AAACTGAAAAGAGCCATGCTGTCTAGTCTTGAAGT CCCTCATTTAAACAGAGGTCAAGCAATAGGCGCCT GGCAGTGTCAAGCCTGAAACCAAGCAATACCGTC ATGTTTCAGCCAAGCCCAGAGCCCTAAGATTACAA ACAACTATGGCCGGAACCTCCTCAGCTCTCCCTCT GCAGAGTTCCCTACCCTAAGAGAATGTTACCACCT GAACAGTCCTCGGTGAATCTGAGAGGAGAGGATG GGGTAAGGCAGAAGCACCAGCTGTACTACTAGAA GGGAGCTTTTGGTGGTAGATCCCCTGGTGTCTCCA ACCTGACTAGGTGGACAGAGCTCAAAGAGGCCCT CTTACCGCTAGCGAGG | 6 | LPAMVL* |
| 1520 | NM_0058 04.2_126 | 126 | GGAAGCGCAGCAACTCGTGTCTGAGCGCCCGGC GGAAAAACCGAAGTTGGAAGTGTCTCTTAGCAGCG CGCGGAGAAGAACGGGGAGCCAGCATCATGGCA GAACAGGATGTGGAAAACGATCTTTGGATTACGAT GAAGAGGAAGAGCCCCAGGCTCCTCAAGAGAGCA CACCAGCTCCCCCTAAGAAAGACATCAAGGGATC CTACGTTTCCATCCACAGCTCTGGCTTCCGGGACT TTCTGCTGAAGCCGGAGCTCCTGCGGGCCATCGT GGACTGTGGCTTTGAGCATCCTTCTGAGGTCCAGC ATGAGTGCATTCCCCAGGCCATCCTGGGCATGGA CGTCCTGTGCCAGGCCAAGTCCGGGATGGGCAAG ACAGCGGTCTTCGTGCTGGCCACCCTACAGCAGA TTGAGCCTGTCAACGACAGGTGACGGTCCTGGT CATGTGCCACACGAGGGAGCTGGCCTTCCAGATC AGCAAGGAATATGAGCGCTTTTCCAAGTACATGCC CAGCGTCAAGGTGTCTGTGTTCTTCGGTGGTCTCT CCATCAAGAAGGATGAAGAAGTGTTGAAGAAGAAC TGTCCCCATGTCGTGGTGGGGACCCCGGGCCGCA TCCTGGCGCTCGTGCGGAATAGGAGCTTCAGCCT AAAGAATGTGAAGCACTTTGTGCTGGACGAGTGTG ACAAGATGCTGGAGCAGCTGGACATGCGGCGGGA TGTGCAGGAGATCTTCCGCCTGACACCACACGAG AAGCAGTGCATGATGTTCAGCGCCACCCTGAGCA AGGACATCCGGCCTGTGTGCAGGAAGTTCATGCA GGATCCCATGGAGGTGTTTGTGGACGACGAGACC AAGCTCACGCTGCACGGCCTGCAGCAGTACTACG TCAAACTCAAAGACAGTGAGAAGAACCGCAAGCTC TTTGATCTCTTGGATGTGCTGGAGTTTAACCAGGT GATAATCTTCGTCAAGTCAGTGCAGCGCTGCATGG CCCTGGCCCAGCTCCTCGTGGAGCAGAACT | 40 | WITMKRKS PRLLKRAH QLPLRKTS RDPTFPST ALASGTFC* |
| 1521 | NM_0058 05.3_364 | 364 | GCTTCGCGGCGGAGGCCCGGGCAACTCTTTTGAA TGGAATCGGGCTGATTCATCGCCGGTTTGCAGACA GAGCCGCGTCGGGTGTGCGCCGTGCTGCTGTTG CCTCTGTCTTCGCGTCACCACAGAGGCAAGACAA GGGTCCATATCGCGGCATCCGGCTCCCGCCCGTC TTCAGGAGAGAAAGAAAAAATAAAATATACTTGGG GAAGTTGTACCTGCCAGAATTAGCAAGAGCTTTCT TTAAGAAGACATTTGTCAAACTCAACAAATTGAAGG TTAACACCTTAAGAGTTGTAGTTACTGACCAGAAAT ATGGACAGACTTCTTAGACTTGGAGGAGGTATGCC TGGACTGGGCCAGGGCCACCTACAGATGCTCCTG CAGTGGACACAGCAGAACAAGTCTATATCTCTTCC CTGGCACTGTTAAAAATGTTAAAACATGGCCGTGC TGGAGTTCCAATGAAGTTATGGGTTTGATGCTTG GAGAATTTGTTGATGATTATACCGTCAGAGTGATT | 21 | HLQMLLQ WTQQNKSI SLPWHC* |

TABLE 3A-continued

| SEQ ID | identifier_position | position | modified_RNA | PAP length | PAP |
|---|---|---|---|---|---|
| | | | GATGTGTTTGCTATGCCACAGTCAGGAACAGGTGT<br>CAGTGTGGAGGCAGTTGATCCAGTGTTCCAAGCTA<br>AAATGTTGGATATGTTGAAGCAGACAGGAAGGCC<br>GGAGATGGTTGTTGGTTGGTATCACAGTCACCCTG<br>GCTTTGGTTGTTGGCTTTCTGGTGTGGATATCAAC<br>ACTCAGCAGAGCTTTGAAGCCTTGTCGGAGAGAG<br>CTGTGGCAGTGGTTGTGGATCCCATTCAGAGTGTA<br>AAAGGAAAGGTTGTTATTGATGCCTTCAGATTGAT<br>CAATGCTAATATGATGGTCTTAGGACATGAACCAA<br>GACAAACAACTTCGAATCTGGGTCACTTAAACAAG<br>CCATCTATCCAGGCATTAATTCATGGACTAAACAG<br>ACATTATTACTCCATTACTATTAACTATCGGAAAAA<br>TGAACTGGAACAGAAGATGTTGCTAAATTTGCATA<br>AGAAGAGTTGGATGGAAGGTTTGACACTTCAGGAC<br>TACAGTGAACATT | | |
| 1522 | NM_0058<br>30.2_201 | 201 | GGTTCATTTCGTGTCTCGGCGATGTTTCCTAGAGT<br>CTCGACGTTCCTACCTCTTCGCCCCCTTTCCCGCC<br>ACCCTTTGTCCTCTGGAAGCCCGGAGACATCAGC<br>GGCTGCGATTATGCTACTCACTGTTCGGCACGGAA<br>CAGTCAGGTACCGCAGTTCAGCGCTGTTGGCCCG<br>GACAAAAAATAACATCCAAAGATATTTGGCACTAAC<br>AGTGTGATCTGTAGCAAGAAAGATAAGCAGTCTGT<br>TCGAACTGAGGAGACTTCCAAGGAGACTTCAGAG<br>AGCCAAGACAGTGAAAAGGAAAATACGAAAAAAGA<br>CTTGTTAGGCATTATTAAGGGCATGAAAGTTGAATT<br>AAGCACAGTAAATGTACGAACAACAAAGCCCCCA<br>AAAGAAGACCACTTAAAAGTTTGGAAGCTACACTT<br>GGCAGGCTTCGAAGAGCTACAGAATATGCTCCAAA<br>GAAGAGAATTGAGCCCCTGAGTCCTGAGTTGGTG<br>GCAGCTGCATCTGCTGTGGCAGATTCTCTCCCTTT<br>TGATAAGCAAACAACCAAGTCAGAGCTGCTGAGCC<br>AGCTCCAGCAGCATGAGGAAGAGTCAAGGGCACA<br>GAGAGATGCAAAGCGACCTAAAATTAGTTTCAGTA<br>ACATAATATCAGATATGAAAGTTGCCAGATCTGCTA<br>CAGCTAGAGTTCGTTCAAGACCAGAGCTTCGGATT<br>CAGTTTGATGAAGGCTATGACAATTATCCTGGCCA<br>GGAGAAGACGGATGATCTTAAAAAAAGGAAAAATA<br>TATTCACAGGGAAAAGACTTAATATTTTTGACATGA<br>TGGCAGTTACTAAAGAAGCACCTGAAACAGACACA<br>TCACCTTCACTTTGGAATGTGGAATTTGCTAAGCA<br>GTTAGCCACAGTAAATGAACAACCCCTTCAGAATG<br>GATTTGAAGAGCTGATCCAGTGGACAAAAGAGGG<br>GAAACTATGGGAGTTCCCAATTAACAATGAAGCAG<br>GTTTTGATGATGATGGTTCAGAATTTCATGAACATA<br>TATTTCTGGA | 5 | LALTV* |
| 1523 | NM_0058<br>72.2_110 | 110 | ATAACTGAGTTTACGCAGACGCAGAAAACGCAGG<br>CAAACCTGAGGTCCTCAGAATGGCGGGCACAGGT<br>TTGGTGGCTGGAGAGGTTGTGGTGGATGCGCTGC<br>CGTATTTGATCAAGGTTATGAAGCCCCTGGTGTGC<br>GGGAAGCGGCTGCAGCGCTGGTGGAGGAGGAAA<br>CTCGCAGATACCGACCTACTAAGAACTACCTGAGC<br>TACCTGACAGCCCCGGATTATTCTGCCTTTGAAAC<br>TGACATAATGAGAAATGAATTTGAAAGACTGGCTG<br>CTCGACAACCAATTGAATTGCTCAGTATGAAACGA<br>TATGAGCTTCCAGCCCCCTCCTCTGGTCAAAAAAA<br>TGACATTACTGCATGGCAAGAATGTGTAAACAATT<br>CTATGGCCCAGTTAGAGCATCAAGCAGTTAGAATT<br>GAGAATCTGGAACTAATGTCACAGCATGGATGTAA<br>TGCCTGGAAAGTATACAATGAAAATCTAGTTCATAT<br>GATTGAACACGCACAGAAGGAACTTCAGAAGTTAA<br>GAAAACATATTCAAGATTTAAACTGGCAGAGAAAG<br>AACATGCAACTCACAGCTGGATCTAAATTGAGAGA<br>AATGGAGTCAAATTGGGTATCCCTGGTCAGTAAGA<br>ATTATGAGATTGAACGGACTATTGTTCAGCTAGAA<br>AATGAAATCTATCAAATTAAGCAGCAACATGGAGA<br>GGCAAACAAAGAAAACATCCGGCAAGACTTCTGAA<br>AAGACAATTTAGCAGGTAGAAGAAAAGTTGGGCTT<br>TCACAAAAGGCATCTGAACTTTTAATGAACTTTGAA<br>GGACAACAGCATCTTCCCAAAACCATTGATGTTTA<br>AGTGTTTAGAAATCATAGAAGGTGTAGGCTGCTGT<br>GGTAATTCTATTTGTATATCTCAACAGAATTAAAAT<br>GTCTAGCTTGGTGGTATTTTTATAGCCATAAAAGAA<br>AATCTTTAGGCTTTCAAAATAAGGATGACTTTAGAA<br>TAATATTGTGTCATAGAATTAATTTTCAGCCATGTG<br>GACCATAT | 31 | LIKVMKPLV<br>CGKRLQR<br>WWRRKLA<br>DTDLLRTT* |

TABLE 3A-continued

| SEQ ID | identifier_position | position | modified_RNA | PAP length | PAP |
|---|---|---|---|---|---|
| 1524 | NM_0058 91.2_748 | 748 | GGTGCGCGGGGAGGTGGAGGGCGAGGGGCGGG GCTACCTCAGGTCCCGCCCGCGGCAGGCCTGTGG GCTGCGAGGAGGAGCTTTGCCTAGCTTGCAGGCA GCGCAGGGCAGACGGCGGCAGGAGAAGCAAGAT GAATGCAGGCTCAGATCCTGTGGTCATCGTCTCG GCGGCGCGGACCATCATAGGTTCCTTCAATGGTG CCTTAGCTGCTGTTCCTGTCCAGGACCTGGGCTCC ACTGTCATCAAAGAAGTCTTGAAGAGGGCCACTGT GGCTCCGGAAGATGTGTCTGAGGTCATCTTTGGAC ATGTCTTGGCAGCAGGCTGTGGGCAGAATCCTGTT AGACAAGCCAGTGTGGGTGCAGGAATTCCCTACT CTGTTCCAGCATGGAGCTGCCAGATGATCTGTGG GTCAGGCCTAAAAGCTGTGTGCCTTGCAGTCCAGT CAATAGGGATAGGAGACTCCAGCATTGTGGTTGCA GGAGGCATGGAAAATATGAGCAAGGCTCCTCACTT GGCTTACTTGAGAACAGGAGTAAAGATAGGTGAGA TGCCACTGACTGACAGTATACTCTGTGATGGTCTT ACAGATGCATTTCACAACTGTCATATGGGTATTACA GCTGAAAATGTAGCCAAAAAATGGCAAGTGAGTAG AGAAGATCAGGACAAGGTTGCAGTTCTGTCCCAGA ACAGGACAGAGAATGCACAGAAAGCTGGCCATTTT GACAAAGAGATTGTACCAGTTTGGTGTCAACTAGA AAAGGTCTTATTGAAGTTAAAACAGATGAGTTTCCT CGCCATGGGAGCAACATAGAAGCCATGTCCAAGC TAAAGCCTTACTTTCTTACTGATGGAACGGGAACA GTCACCCCAGCCAATGCTTCAGGAATAAATGATGG TGCTGCAGCTGTCGTTCTTATGAAGAAGTCAGAAG CTGATAAACGTGGGCTTACACCTTTAGCACGGATA GTTTCCTGGTCCCAAGTGGGTGTGGAGCCTTCCAT TATGGGAATAGGACCAATT | 22 | WCQLEKVL LKLKQMSF LAMGAT* |
| 1525 | NM_0059 17.2_394 | 394 | CTGACTCTCTGAGGCTCATTTTGCAGTTGTTGAAAT TGTCCCCGCAGTTTTCAATCATGTCTGAACCAATC AGAGTCCTTGTGACTGGAGCAGCTGGTCAAATTGC ATATTCACTGCTGTACAGTATTGGAAATGGATCTGT CTTTGGTAAAGATCAGCCTATAATTCTTGTGCTGTT GGATATCACCCCCATGATGGGTGTCCTGGACGGT GTCCTAATGGAACTGCAAGACTGTGCCCTTCCCCT CCTGAAAGATGTCATCGCAACAGATAAAGAAGACG TTGCCTTCAAAGACCTGGATGTGGCCATTCTTGTG GGCTCCATGCCAAGAAGGGAAGGCATGGAGAGAA AAGATTTACTGAAAGCAAATGTGAAAATCTTCAAAT CCCAGGTGCAGCCTTAGATAAATACGCCAAGAAGT CAGTTAAGGTTATTGTTGTGGGTAATCCAGCCAAT ACCAACTGCCTGACTGCTTCCAAGTCAGCTCCATC CATCCCCAAGGAGAACTTCAGTTGCTTGACTCGTT TGGATCACAACCGAGCTAAAGCTCAAATTGCTCTT AAACTTGGTGTGACTGCTAATGATGTAAAGAATGT CATTATCTGGGGAAACCATTCCTCGACTCAGTATC CAGATGTCAACCATGCCAAGGTGAAATTGCAAGGA AAGGAAGTTGGTGTTTATGAAGCTCTGAAAGATGA CAGCTGGCTCAAGGGAGAATTTGTCACGACTGTG CAGCAGCGTGGCGCTGCTGTCATCAAGGCTCGAA AACTATCCAGTGCCATGTCTGCTGCAAAAGCCATC TGTGACCACGTCAGGGACATCTGGTTTGGAACCC CAGAGGGAGAGTTTGTGTCCATGGGTGTTATCTCT GATGGCAACTCCTATGGTGTTCCTGATGATCTGCT CTACTCATTCCCTGTTGTAATCAAGAATAAGACCTG GAAGTTTGTTGAAGGTCTCCCTATTAATGATTTCTC ACGTGAGAAGATGGATCTTACTGCAAAGGAACTGA CAGAAGAA | 3 | VQP* |
| 1526 | NM_0059 18.2_150 | 150 | GGCGCTGGGCAGTGTGGAGGTCGTTGGAGTCACT TCCGCGTCACCAGCTCCTGTGCCTGCCAGTCGGT GCCCCTCCCGCTCCAGCCATGCTCTCCGCCCTCG CCCGGCCTGCCAGCGCTGCTCTCCGCCGCAGCTT CAGCACCTCGGCCAGAACAATGCTAAAGTAGCTGT GCTAGGGGCCTCTGGAGGCATCGGGCAGCCACTT TCACTTCTCCTGAAGAACAGCCCCTTGGTGAGCCG CCTGACCCTCTATGATATCGCGCACACACCCGGA GTGGCCGCAGATCTGAGCCACATCGAGACCAAAG CCGCTGTGAAAGGCTACCTCGGACCTGAACAGCT GCCTGACTGCCTGAAAGGTTGTGATGTGGTAGTTA TTCCGGCTGGAGTCCCCAGAAAGCCAGGCATGAC CCGGGACGACCTGTTCAACACCAATGCCACGATT GTGGCCACCCTGACCGCTGCCTGTGCCCAGCACT GCCCGGAAGCCATGATCTGCGTCATTGCCAATCC GGTTAATTCCACCATCCCCATCACAGCAGAAGTTT TCAAGAAGCATGGAGTGTACAACCCCAACAAAATC | 5 | RTMLK* |

TABLE 3A-continued

| SEQ ID | identifier_position | position | modified_RNA | PAP length | PAP |
|---|---|---|---|---|---|
| | | | TTCGGCGTGACGACCCTGGACATCGTCAGAGCCA<br>ACACCTTTGTTGCAGAGCTGAAGGGTTTGGATCCA<br>GCTCGAGTCAACGTCCTGTCATTGGTGGCCATG<br>CTGGGAAGACCATCATCCCCCTGATCTCTCAGTGC<br>ACCCCCAAGGTGGACTTTCCCCAGGACCAGCTGA<br>CAGCACTCACTGGGCGGATCCAGGAGGCCGGCA<br>CGGAGGTGGTCAAGGCTAAAGCCGGAGCAGGCTC<br>TGCCACCCTCTCCATGGCGTATGCCGGCGCCCGC<br>TTTGTCTTCTCCCTTGTGGATGCAATGAATGGAAA<br>GGAAGGTGTTGTGGAATGTTCCTTCGTTAAGTCAC<br>AGGAAACGGAATGTACCTACTTCTCCACACCGCTG<br>CTGCTTGGGAAAAAGGGCATCGAGAAGAACCTGG<br>GCATCGGCAAAGTCTCCTCTTTTGAGGAG | | |
| 1527 | NM_0059<br>18.2_423 | 423 | GGCGCTGGGCAGTGTGGAGGTCGTTGGAGTCACT<br>TCCGCGTCACCAGCTCCTGTGCCTGCCAGTCGGT<br>GCCCCTCCCGCTCCAGCCATGCTCTCCGCCCTCG<br>CCCGGCCTGCCAGCGCTGCTCTCCGCCGCAGCTT<br>CAGCACCTCGGCCCAGAACAATGCTAAAGTAGCT<br>GTGCTAGGGGCCTCTGGAGGCATCGGGCAGCCA<br>CTTTCACTTCTCCTGAAGAACAGCCCCTTGGTGAG<br>CCGCCTGACCCTCTATGATATCGCGCACACACCC<br>GGAGTGGCCGCAGATCTGAGCCACATCGAGACCA<br>AAGCCGCTGTGAAAGGCTACCTCGGACCTGAACA<br>GCTGCCTGACTGCCTGAAAGGTTGTGATGTGGTA<br>GTTATTCCGGCTGGAGTCCCCAGAAAGCCAGGCA<br>TGACCCGGGACGACTGTTCAACACCAATGCCACG<br>ATTGTGGCCACCCTGACCGCTGCCTGTGCCCAGC<br>ACTGCCCGGAAGCCATGATCTGCGTCATTGCCAAT<br>CCGGTTAATTCCACCATCCCCATCACAGCAGAAGT<br>TTTCAAGAAGCATGGAGTGTACAACCCCAACAAAA<br>TCTTCGGCGTGACGACCCTGGACATCGTCAGAGC<br>CAACACCTTTGTTGCAGAGCTGAAGGGTTTGGATC<br>CAGCTCGAGTCAACGTCCCTGTCATTGGTGGCCAT<br>GCTGGGAAGACCATCATCCCCCTGATCTCTCAGTG<br>CACCCCCAAGGTGGACTTTCCCCAGGACCAGCTG<br>ACAGCACTCACTGGGCGGATCCAGGAGGCCGGCA<br>CGGAGGTGGTCAAGGCTAAAGCCGGAGCAGGCTC<br>TGCCACCCTCTCCATGGCGTATGCCGGCGCCCGC<br>TTTGTCTTCTCCCTTGTGGATGCAATGAATGGAAA<br>GGAAGGTGTTGTGGAATGTTCCTTCGTTAAGTCAC<br>AGGAAACGGAATGTACCTACTTCTCCACACCGCTG<br>CTGCTTGGGAAAAAGGGCATCGAGAAGAACCTGG<br>GCATCGGCAAAGTCTCCTCTTTTGAGGAG | 11 | CSTPMPRL<br>WPP* |
| 1528 | NM_0059<br>18.2_467 | 467 | GGCGCTGGGCAGTGTGGAGGTCGTTGGAGTCACT<br>TCCGCGTCACCAGCTCCTGTGCCTGCCAGTCGGT<br>GCCCCTCCCGCTCCAGCCATGCTCTCCGCCCTCG<br>CCCGGCCTGCCAGCGCTGCTCTCCGCCGCAGCTT<br>CAGCACCTCGGCCCAGAACAATGCTAAAGTAGCT<br>GTGCTAGGGGCCTCTGGAGGCATCGGGCAGCCA<br>CTTTCACTTCTCCTGAAGAACAGCCCCTTGGTGAG<br>CCGCCTGACCCTCTATGATATCGCGCACACACCC<br>GGAGTGGCCGCAGATCTGAGCCACATCGAGACCA<br>AAGCCGCTGTGAAAGGCTACCTCGGACCTGAACA<br>GCTGCCTGACTGCCTGAAAGGTTGTGATGTGGTA<br>GTTATTCCGGCTGGAGTCCCCAGAAAGCCAGGCA<br>TGACCCGGGACGACTGTTCAACACCAATGCCAC<br>GATTGTGGCCACCCTGACCGCTGCTGTGCCCAGC<br>ACTGCCCGGAAGCCATGATCTGCGTCATTGCCAAT<br>CCGGTTAATTCCACCATCCCCATCACAGCAGAAGT<br>TTTCAAGAAGCATGGAGTGTACAACCCCAACAAAA<br>TCTTCGGCGTGACGACCCTGGACATCGTCAGAGC<br>CAACACCTTTGTTGCAGAGCTGAAGGGTTTGGATC<br>CAGCTCGAGTCAACGTCCCTGTCATTGGTGGCCAT<br>GCTGGGAAGACCATCATCCCCCTGATCTCTCAGTG<br>CACCCCCAAGGTGGACTTTCCCCAGGACCAGCTG<br>ACAGCACTCACTGGGCGGATCCAGGAGGCCGGCA<br>CGGAGGTGGTCAAGGCTAAAGCCGGAGCAGGCTC<br>TGCCACCCTCTCCATGGCGTATGCCGGCGCCCGC<br>TTTGTCTTCTCCCTTGTGGATGCAATGAATGGAAA<br>GGAAGGTGTTGTGGAATGTTCCTTCGTTAAGTCAC<br>AGGAAACGGAATGTACCTACTTCTCCACACCGCTG<br>CTGCTTGGGAAAAAGGGCATCGAGAAGAACCTGG<br>GCATCGGCAAAGTCTCCTCTTTTGAGGAG | 8 | VPSTARKP* |
| 1529 | NM_0059<br>18.2_575 | 575 | GGCGCTGGGCAGTGTGGAGGTCGTTGGAGTCACT<br>TCCGCGTCACCAGCTCCTGTGCCTGCCAGTCGGT<br>GCCCCTCCCGCTCCAGCCATGCTCTCCGCCCTCG<br>CCCGGCCTGCCAGCGCTGCTCTCCGCCGCAGCTT | 5 | TKSSA* |

TABLE 3A-continued

| SEQ ID | identifier_position | position | modified_RNA | PAP length | PAP |
|---|---|---|---|---|---|
| | | | CAGCACCTCGGCCCAGAACAATGCTAAAGTAGCT GTGCTAGGGGCCTCTGGAGGCATCGGGCAGCCA CTTTCACTTCTCCTGAAGAACAGCCCCTTGGTGAG CCGCCTGACCCTCTATGATATCGCGCACACACCC GGAGTGGCCGCAGATCTGAGCCACATCGAGACCA AAGCCGCTGTGAAAGGCTACCTCGGACCTGAACA GCTGCCTGACTGCCTGAAAGGTTGTGATGTGGTA GTTATTCCGGCTGGAGTCCCCAGAAAGCCAGGCA TGACCCGGGACGACCTGTTCAACACCAATGCCAC GATTGTGGCCACCCTGACCGCTGCCTGTGCCCAG CACTGCCCGGAAGCCATGATCTGCGTCATTGCCA ATCCGGTTAATTCCACCATCCCCATCACAGCAGAA GTTTTCAAGAAGCATGGAGTGTACAACCCAACAAA ATCTTCGGCGTGACGACCCTGGACATCGTCAGAG CCAACACCTTTGTTGCAGAGCTGAAGGGTTTGGAT CCAGCTCGAGTCAACGTCCCTGTCATTGGTGGCC ATGCTGGGAAGACCATCATCCCCCTGATCTCTCAG TGCACCCCCAAGGTGGACTTTCCCCAGGACCAGC TGACAGCACTCACTGGGCGGATCCAGGAGGCCGG CACGGAGGTGGTCAAGGCTAAAGCCGGAGCAGG CTCTGCCACCCTCTCCATGGCGTATGCCGGCGCC CGCTTTGTCTTCTCCCTTGTGGATGCAATGAATGG AAAGGAAGGTGTTGTGGAATGTTCCTTCGTTAAGT CACAGGAAACGGAATGTACCTACTTCTCCACACCG CTGCTGCTTGGGAAAAAGGGCATCGAGAAGAACC TGGGCATCGGCAAAGTCTCCTCTTTTGAGGAG | | |
| 1530 | NM_0059 71.2_398 | 398 | GTTCTCCACAACTGCCAGCAATCCTTCCACCAGGC AAAACACATCATCTAAGGAAAAGAAGTGAGGTTTG CTTAGGGCGTGGCAGCTTCGGATAAACGCAGGAC TCCGCCTGGCAGCCCGATTTCTCCCGGAACCTCT GCTCAGCCTGGTGAACCACACAGGCCAGCGCTCT GACATGCAGAAGGTGACCCTGGGCCTGCTTGTGT TCCTGGCAGGCTTTCCTGTCCTGGACGCCAATGAC CTAGAAGATAAAAACAGTCCTTTCTACTATGACTG GCACAGCCTCCAGGTTGGCGGGCTCATCTGCGCT GGGGTTCTGTGCGCCATGGGCATCATCATCGTCAT GAGTGCAAAATGCAAATGCAAGTTTGGCCAGAAGT CCGGTCACCATCCAGGGAGACTCCACCTCTCATC ACCCCAGGCTGACCCAAAGCTGATGAGGACAGA CCAGCTGAAATTGGGTGGAGGACCGTTCTCTGTC CCCAGGTCCTGTCTCTGCACAGAAACTTGAACTCC AGGATGGAATTCTTCCTCCTCTGCTGGGACTCCTT TGCATGGCAGGGCCTCATCTCACCTCTCGCAAGA GGGTCTCTTTGTTCAATTTTTTTTAATCTAAAATGAT TGTGCCTCTGCCCAAGCAGCCTGGAGACTTCCTAT GTGTGCATTGGGGTGGGGCTTGGGGCACCATGAG AAGGTTGGCGTGCCCTGGAGGCTGACACAGAGGC TGGCACTGAGCCTGCTTGTTGGGAAAAGCCCACA GGCCTGTTCCCTTGTGGCTTGGGACATGGCACAG GCCCGCCCTCTGCCTCCTCAGCCATGGGACCTCA TATGCAATTTGGGATTACTAGTAGCCAAAAGGAA TGAAAGAGAGCTCTAACCAGATGGAACACTGGAAC ATTCCAGTGGACCCTGGACCATTCCAGGAAAACTG GGACATAGGATCGTCCCGCTATGATGGAAGTGTTC AGACAGTTTATAATAGTAAGCCCCTGTGACCCTCT CACTTACCCCGAGACCTCACT | 74 | RLHLSSPQ AQPKADED RPAEIGWR TVLCPQVL SLHRNLNS RMEFFLLC WDSFAWQ GLISPLAR GSLCSIFF NLK* |
| 1531 | NM_0059 97.1_105 | 105 | CTGGTGAGGGGCTGCAGGTGGCGGCGCAGTCTC GGTAGGCGGTATGAGTTTGGCTGGGGGCCGGGC ACCCCGGAAGACCGCTGGGAACCGGCTTTCTGGG CTTTGGAGGCAGAGGAGGAAGATGAGTTCTACCA GACGACTTATGGGGGTTTCACAGAGGAATCCGGA GATGATGAGTATCAAGGGGACCAGTCAGACACAG AGGACGAAGTGGACTCTGACTTTGACATTGATGAA GGGGATGAACCATCCAGTGATGGAGAAGCAGAAG AGCCAAGAAGGAAGCGCCGAGTAGTCACCAAGGC CTATAAGGAACCTCTCAAGAGCTTAAGGCCTCGAA AGGTCAACACCCCGGCTGGTAGCTCTCAGAAGGC GCGAGAAGAGAAGGCACTACTGCCATTAGAACTA CAAGATGACGGCTCTGACAGTCGGAAGTCTATGC GTCAGTCTACAGCTGAGCATACACGACAAACGTTC CTTCGGGTACAGGAGAGGCAGGGCCAGTCAAGAC GGCGAAAGGGGCCCCACTGTGAGCGGCCACTAAC CCAGGAGGAACTGCTCCGGGAGGCCAAGATCACA GAAGAGCTTAATTTACGGTCACTGGAGACATATGA GCGGCTCGAGGCTGATAAAAAGAAGCAGGTTCAT AAGAAGCGGAAGTGCCCCGGGCCCATAATCACCT ATCATTCAGTGACAGTGCCACTTGTTGGGGAGCCA | 63 | WRQRRKM SSTRRLMG VSQRNPE MMSIKGTS QTQRTKW TLTLTLMK GMNHPVM EKQKSQE GSAE* |

TABLE 3A-continued

| SEQ ID | identifier_ position | position | modified_RNA | PAP length | PAP |
|---|---|---|---|---|---|
| 1532 | NM_0059 97.1_540 | 540 | GGCCCCAAGGAAGAGAACGTTGACATAGAAGGAC TTGATCCTGCTCCCTCGGTGTCTGCATTGACTCCT CATGCTGGGACTGGACCCGTCAACCCCCCTGCTC GCTGCTCACGTACCTTCATCACTTTTAGTGATGAT GCAACTTTCGAGGAATGGTTCCCCCAAGGGCGGC CCCCAAAAGTCCCTGTTCGTGAGGTCTGTCCAGTG ACCCATCGTCCAGCCCTATACCGGGACCCTGTTAC AGACATACCCTATGCCACTGCTCGAGCCTTCAAGA TCATTCGTGAGGCTTACAAGAAGTACATTA CTGGTGAGGGGCTGCAGGTGGCGGCGCAGTCTC GGTAGGCGGTATGAGTTTGGCTGGGGGCCGGGC ACCCCGGAAGACCGCTGGGAACCGGCTTTCTGGG CTTTTGGAGGCAGAGGAGGAAGATGAGTTCTACC AGACGACTTATGGGGGTTTCACAGAGGAATCCGG AGATGATGAGTATCAAGGGGACCAGTCAGACACA GAGGACGAAGTGGACTCTGACTTTGACATTGATGA AGGGGATGAACCATCCAGTGATGGAGAAGCAGAA GAGCCAAGAAGGAAGCGCCGAGTAGTCACCAAGG CCTATAAGGAACCTCTCAAGAGCTTAAGGCCTCGA AAGGTCAACACCCCGGCTGGTAGCTCTCAGAAGG CGCGAGAAGAGAAGGCACTACTGCCATTAGAACT ACAAGATGACGGCTCTGACAGTCGGAAGTCTATG CGTCAGTCTACAGCTGAGCATACACGACAAACGTT CCTTCGGGTACAGGAGAGGCAGGGCCAGTCAAGA CGGCGAAAGGGGCCCCACTGTGAGCGGCACTAAC CCAGGAGGAACTGCTCCGGGAGGCCAAGATCACA GAAGAGCTTAATTTACGGTCACTGGAGACATATGA GCGGCTCGAGGCTGATAAAAAGAAGCAGGTTCAT AAGAAGCGGAAGTGCCCCGGGCCCATAATCACCT ATCATTCAGTGACAGTGCCACTTGTTGGGGAGCCA GGCCCCAAGGAAGAGAACGTTGACATAGAAGGAC TTGATCCTGCTCCCTCGGTGTCTGCATTGACTCCT CATGCTGGGACTGGACCCGTCAACCCCCCTGCTC GCTGCTCACGTACCTTCATCACTTTTAGTGATGAT GCAACTTTCGAGGAATGGTTCCCCCAAGGGCGGC CCCCAAAAGTCCCTGTTCGTGAGGTCTGTCCAGTG ACCCATCGTCCAGCCCTATACCGGGACCCTGTTAC AGACATACCCTATGCCACTGCTCGAGCCTTCAAGA TCATTCGTGAGGCTTACAAGAAGTACATTA | 1 | H* |
| 1533 | NM_0059 98.3_319 | 319 | GGCCGTTCTTGCGTAGGGGGCGGGACTAAGGCTG TCAATTGGTCTGTTTTTGTGCCGATCAATGAGATG GGTGCGGTGATTGGCGACTACCTTGAGAGTAGCG GGTTGAGGTGTAAGCCCTGAGGAGGCAGCGTTTT CTGGGCTTCTGTCTGGTTCTCTCTCTCCAGAAGGT TCTGCCGGTTCCCCCAGCTCTGGGTACCCGGCTC TGCATCGCGTCGCCATGATGGGCCATCGTCCAGT GCTCGTGCTCAGCCAGAACACAAAGCGTGAATCC GGAAGAAAAGTTCAATCTGGAAACATCAATGCTGC CAAGACTATGCAGATATCATCCGAACATGTTTGGG ACCCAAGTCCATGATGAAGATGCTTTTGGACCCAA TGGGAGGCATTGTGATGACCAATGATGGCAATGC CATTCTTCGAGAGATTCAAGTCCAGCATCCAGCGG CCAAGTCCATGATCGAAATTAGCCGGACCCAGGAT GAAGAGGTTGGAGATGGGACCACATCAGTAATTAT TCTTGCAGGGGAAATGCTGTCTGTAGCTGAGCACT TCCTGGAGCAGCAGATGCACCCAACAGTGGTGAT CAGTGCTTACCGCAAGGCATTGGATGATATGATCA GCACCCTAAAGAAAATAAGTATCCCAGTCGACATC AGTGACAGTGATATGATGCTGAACATCATCAACAG CTCTATTACTACCAAAGCCATCAGTCGGTGGTCAT CTTTGGCTTGCAACATTGCCCTGGATGCTGTCAAG ATGGTACAGTTTGAGGAGAATGGTCGGAAAGAGAT TGACATAAAAAAATATGCAAGAGTGGAAAAGATAC CTGGAGGCATCATTGAAGACTCCTGTGTCTTGCGT GGAGTCATGATTAACAAGGATGTGACCCATCCACG TATGCGGCGCTATATCAAGAACCCTCGCATTGTGC TGCTGGATTCTTCTCTGGAATACAAGAAAGGAGAA AGCCAGACTGACATTGAGATTACACGAGAGGAGG ACTTCACCCGAATTCTCC | 13 | MQISSEHV WDPSP* |
| 1534 | NM_0059 98.3_342 | 342 | GGCCGTTCTTGCGTAGGGGGCGGGACTAAGGCTG TCAATTGGTCTGTTTTTGTGCCGATCAATGAGATG GGTGCGGTGATTGGCGACTACCTTGAGAGTAGCG GGTTGAGGTGTAAGCCCTGAGGAGGCAGCGTTTT CTGGGCTTCTGTCTGGTTCTCTCTCTCCAGAAGGT TCTGCCGGTTCCCCCAGCTCTGGGTACCCGGCTC TGCATCGCGTCGCCATGATGGGCCATCGTCCAGT GCTCGTGCTCAGCCAGAACACAAAGCGTGAATCC | 5 | WDPSP* |

TABLE 3A-continued

| SEQ ID | identifier_position | position | modified_RNA | PAP length | PAP |
|---|---|---|---|---|---|
| | | | GGAAGAAAAGTTCAATCTGGAAACATCAATGCTGC<br>CAAGACTATTGCAGATATCATCCGAACATGTTGGG<br>ACCCAAGTCCATGATGAAGATGCTTTTGGACCCAA<br>TGGGAGGCATTGTGATGACCAATGATGGCAATGC<br>CATTCTTCGAGAGATTCAAGTCCAGCATCCAGCGG<br>CCAAGTCCATGATCGAAATTAGCCGGACCCAGGAT<br>GAAGAGGTTGGAGATGGGACCACATCAGTAATTAT<br>TCTTGCAGGGGAAATGCTGTCTGTAGCTGAGCACT<br>TCCTGGAGCAGCAGATGCACCCAACAGTGGTGAT<br>CAGTGCTTACCGCAAGGCATTGGATGATATGATCA<br>GCACCCTAAAGAAAATAAGTATCCCAGTCGACATC<br>AGTGACAGTGATATGATGCTGAACATCATCAACAG<br>CTCTATTACTACCAAAGCCATCAGTCGGTGGTCAT<br>CTTTGGCTTGCAACATTGCCCTGGATGCTGTCAAG<br>ATGGTACAGTTTGAGGAGAATGGTCGGAAAGAGAT<br>TGACATAAAAAAATATGCAAGAGTGGAAAAGATAC<br>CTGGAGGCATCATTGAAGACTCCTGTGTCTTGCGT<br>GGAGTCATGATTAACAAGGATGTGACCCATCCACG<br>TATGCGGCGCTATATCAAGAACCCTCGCATTGTGC<br>TGCTGGATTCTTCTCTGGAATACAAGAAAGGAGAA<br>AGCCAGACTGACATTGAGATTACACGAGAGGAGG<br>ACTTCACCCGAATTCTCC | | |
| 1535 | NM_0059<br>98.3_372 | 372 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTGGACCCAA<br>TGGGAGGCATTGTGATGACCAATGATGGCAATGC<br>CATTCTTCGAGAGATTCAAGTCCAGCATCCAGCGG<br>CCAAGTCCATGATCGAAATTAGCCGGACCCAGGAT<br>GAAGAGGTTGGAGATGGGACCACATCAGTAATTAT<br>TCTTGCAGGGGAAATGCTGTCTGTAGCTGAGCACT<br>TCCTGGAGCAGCAGATGCACCCAACAGTGGTGAT<br>CAGTGCTTACCGCAAGGCATTGGATGATATGATCA<br>GCACCCTAAAGAAAATAAGTATCCCAGTCGACATC<br>AGTGACAGTGATATGATGCTGAACATCATCAACAG<br>CTCTATTACTACCAAAGCCATCAGTCGGTGGTCAT<br>CTTTGGCTTGCAACATTGCCCTGGATGCTGTCAAG<br>ATGGTACAGTTTGAGGAGAATGGTCGGAAAGAGAT<br>TGACATAAAAAAATATGCAAGAGTGGAAAAGATAC<br>CTGGAGGCATCATTGAAGACTCCTGTGTCTTGCGT<br>GGAGTCATGATTAACAAGGATGTGACCCATCCACG<br>TATGCGGCGCTATATCAAGAACCCTCGCATTGTGC<br>TGCTGGATTCTTCTCTGGAATACAAGAAAGGAGAA<br>AGCCAGACTGACATTGAGATTACACGAGAGGAGG<br>ACTTCACCCGAATTCTCC | 7 | WTQWEAL* |
| 1536 | NM_0059<br>98.3_391 | 391 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTGGACCCA<br>ATGGGAGGCATGTGATGACCAATGATGGCAATGC<br>CATTCTTCGAGAGATTCAAGTCCAGCATCCAGCGG<br>CCAAGTCCATGATCGAAATTAGCCGGACCCAGGAT<br>GAAGAGGTTGGAGATGGGACCACATCAGTAATTAT<br>TCTTGCAGGGGAAATGCTGTCTGTAGCTGAGCACT<br>TCCTGGAGCAGCAGATGCACCCAACAGTGGTGAT<br>CAGTGCTTACCGCAAGGCATTGGATGATATGATCA<br>GCACCCTAAAGAAAATAAGTATCCCAGTCGACATC<br>AGTGACAGTGATATGATGCTGAACATCATCAACAG<br>CTCTATTACTACCAAAGCCATCAGTCGGTGGTCAT<br>CTTTGGCTTGCAACATTGCCCTGGATGCTGTCAAG<br>ATGGTACAGTTTGAGGAGAATGGTCGGAAAGAGAT<br>TGACATAAAAAAATATGCAAGAGTGGAAAAGATAC<br>CTGGAGGCATCATTGAAGACTCCTGTGTCTTGCGT | 1 | M* |

TABLE 3A-continued

| SEQ ID | identifier_position | position | modified_RNA | PAP length | PAP |
|---|---|---|---|---|---|
| | | | GGAGTCATGATTAACAAGGATGTGACCCATCCACG<br>TATGCGGCGCTATATCAAGAACCCTCGCATTGTGC<br>TGCTGGATTCTTCTCTGGAATACAAGAAAGGAGAA<br>AGCCAGACTGACATTGAGATTACACGAGAGGAGG<br>ACTTCACCCGAATTCTCC | | |
| 1537 | NM_0059<br>98.3_493 | 493 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTTGGACCCA<br>ATGGGAGGCATTGTGATGACCAATGATGGCAATG<br>CCATTCTTCGAGAGATTCAAGTCCAGCATCCAGCG<br>GCCAAGTCCATGATCGAAATTAGCCGGACCCAGG<br>ATGAAGAGGTGGAGATGGGACCACATCAGTAATTA<br>TTCTTGCAGGGGAAATGCTGTCTGTAGCTGAGCAC<br>TTCCTGGAGCAGCAGATGCACCCAACAGTGGTGA<br>TCAGTGCTTACCGCAAGGCATTGGATGATATGATC<br>AGCACCCTAAAGAAAATAAGTATCCCAGTCGACAT<br>CAGTGACAGTGATATGATGCTGAACATCATCAACA<br>GCTCTATTACTACCAAAGCCATCAGTCGGTGGTCA<br>TCTTTGGCTTGCAACATTGCCCTGGATGCTGTCAA<br>GATGGTACAGTTTGAGGAGAATGGTCGGAAAGAG<br>ATTGACATAAAAAAAATATGCAAGAGTGGAAAAGAT<br>ACCTGGAGGCATCATTGAAGACTCCTGTGTCTTGC<br>GTGGAGTCATGATTAACAAGGATGTGACCCATCCA<br>CGTATGCGGCGCTATATCAAGAACCCTCGCATTGT<br>GCTGCTGGATTCTTCTCTGGAATACAAGAAAGGAG<br>AAAGCCAGACTGACATTGAGATTACACGAGAGGA<br>GGACTTCACCCGAATTCTCC | 6 | EMGPHQ* |
| 1538 | NM_0059<br>98.3_601 | 601 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTTGGACCCA<br>ATGGGAGGCATTGTGATGACCAATGATGGCAATG<br>CCATTCTTCGAGAGATTCAAGTCCAGCATCCAGCG<br>GCCAAGTCCATGATCGAAATTAGCCGGACCCAGG<br>ATGAAGAGGTTGGAGATGGGACCACATCAGTAATT<br>ATTCTTGCAGGGGAAATGCTGTCTGTAGCTGAGCA<br>CTTCCTGGAGCAGCAGATGCACCCAACAGTGGTG<br>ATCAGTGCTTACCGAAGGCATTGGATGATATGATC<br>AGCACCCTAAAGAAAATAAGTATCCCAGTCGACAT<br>CAGTGACAGTGATATGATGCTGAACATCATCAACA<br>GCTCTATTACTACCAAAGCCATCAGTCGGTGGTCA<br>TCTTTGGCTTGCAACATTGCCCTGGATGCTGTCAA<br>GATGGTACAGTTTGAGGAGAATGGTCGGAAAGAG<br>ATTGACATAAAAAAAATATGCAAGAGTGGAAAAGAT<br>ACCTGGAGGCATCATTGAAGACTCCTGTGTCTTGC<br>GTGGAGTCATGATTAACAAGGATGTGACCCATCCA<br>CGTATGCGGCGCTATATCAAGAACCCTCGCATTGT<br>GCTGCTGGATTCTTCTCTGGAATACAAGAAAGGAG<br>AAAGCCAGACTGACATTGAGATTACACGAGAGGA<br>GGACTTCACCCGAATTCTCC | 5 | RHWMI* |
| 1539 | NM_0059<br>98.3_609 | 609 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTTGGACCCA<br>ATGGGAGGCATTGTGATGACCAATGATGGCAATG | 3 | WMI* |

TABLE 3A-continued

| SEQ ID | identifier_position | position | modified_RNA | length PAP | PAP |
|---|---|---|---|---|---|
| | | | CCATTCTTCGAGAGATTCAAGTCCAGCATCCAGCG<br>GCCAAGTCCATGATCGAAATTAGCCGGACCCAGG<br>ATGAAGAGGTTGGAGATGGGACCACATCAGTAATT<br>ATTCTTGCAGGGGAAATGCTGTCTGTAGCTGAGCA<br>CTTCCTGGAGCAGCAGATGCACCCAACAGTGGTG<br>ATCAGTGCTTACCGCAAGGCATGGATGATATGATC<br>AGCACCCTAAAGAAAATAAGTATCCCAGTCGACAT<br>CAGTGACAGTGATATGATGCTGAACATCATCAACA<br>GCTCTATTACTACCAAAGCCATCAGTCGGTGGTCA<br>TCTTTGGCTTGCAACATTGCCCTGGATGCTGTCAA<br>GATGGTACAGTTTGAGGAGAATGGTCGGAAAGAG<br>ATTGACATAAAAAAATATGCAAGAGTGGAAAAGAT<br>ACCTGGAGGCATCATTGAAGACTCCTGTGTCTTGC<br>GTGGAGTCATGATTAACAAGGATGTGACCCATCCA<br>CGTATGCGGCGCTATATCAAGAACCCTCGCATTGT<br>GCTGCTGGATTCTTCTCTGGAATACAAGAAAGGAG<br>AAAGCCAGACTGACATTGAGATTACACGAGAGGA<br>GGACTTCACCCGAATTCTCC | | |
| 1540 | NM_0059<br>98.3_775 | 775 | GGCCGTTCTTGCGTAGGGGGCGGGACTAAGGCTG<br>TCAATTGGTCTGTTTTTGTGCCGATCAATGAGATG<br>GGTGCGGTGATTGGCGACTACCTTGAGAGTAGCG<br>GGTTGAGGTGTAAGCCCTGAGGAGGCAGCGTTTT<br>CTGGGCTTCTGTCTGGTTCTCTCTCTCCAGAAGGT<br>TCTGCCGGTTCCCCCAGCTCTGGGTACCCGGCTC<br>TGCATCGCGTCGCCATGATGGGCCATCGTCCAGT<br>GCTCGTGCTCAGCCAGAACACAAAGCGTGAATCC<br>GGAAGAAAAGTTCAATCTGGAAACATCAATGCTGC<br>CAAGACTATTGCAGATATCATCCGAACATGTTTGG<br>GACCCAAGTCCATGATGAAGATGCTTTTGGACCCA<br>ATGGGAGGCATTGTGATGACCAATGATGGCAATG<br>CCATTCTTCGAGAGATTCAAGTCCAGCATCCAGCG<br>GCCAAGTCCATGATCGAAATTAGCCGGACCCAGG<br>ATGAAGAGGTTGGAGATGGGACCACATCAGTAATT<br>ATTCTTGCAGGGGAAATGCTGTCTGTAGCTGAGCA<br>CTTCCTGGAGCAGCAGATGCACCCAACAGTGGTG<br>ATCAGTGCTTACCGCAAGGCATTGGATGATATGAT<br>CAGCACCCTAAAGAAAATAAGTATCCCAGTCGACA<br>TCAGTGACAGTGATATGATGCTGAACATCATCAAC<br>AGCTCTATTACTACCAAAGCCATCAGTCGGTGGTC<br>ATCTTTGGCTTGCAACATTGCCCTGGATGCTGTCA<br>AGATGGTACAGTTGAGGAGAATGGTCGGAAAGAG<br>ATTGACATAAAAAAATATGCAAGAGTGGAAAAGAT<br>ACCTGGAGGCATCATTGAAGACTCCTGTGTCTTGC<br>GTGGAGTCATGATTAACAAGGATGTGACCCATCCA<br>CGTATGCGGCGCTATATCAAGAACCCTCGCATTGT<br>GCTGCTGGATTCTTCTCTGGAATACAAGAAAGGAG<br>AAAGCCAGACTGACATTGAGATTACACGAGAGGA<br>GGACTTCACCCGAATTCTCC | 10 | LRRMVGK<br>RLT* |
| 1541 | NM_0060<br>00.1_131 | 131 | AGTTCTCACTGAGACCTGTCACCCCGACTCAACGT<br>GAGACGCACCGCCCGGACTCACCATGCGTGAATG<br>CATCTCAGTCCACGTGGGGCAGGCAGGTGTCCAG<br>ATGGGCAATGCCTGCTGGGAGCTCTATGCTTGGA<br>ACATGGGATTCAGCCTGATGGGCAGATGCCCAGT<br>GACAAGACCATTGGTGGAGGGGACGACTCCTTCA<br>CCACCTTCTTCTGTGAAACTGGTGCTGGAAAACAC<br>GTACCCCGGGCAGTTTTTGTGGATCTGGAGCCTAC<br>GGTCATTGATGAGATCCGAAATGGCCCATACCGAC<br>AGCTCTTCCACCCAGAGCAGCTCATCACTGGGAAA<br>GAGGATGCTGCCAACAACTATGCCCGTGGTCACT<br>ATACCATTGGCAAGGAGATCATTGACCCAGTGCTG<br>GATCGGATCCGCAAGCTGTCTGACCAGTGCACAG<br>GACTTCAGGGCTTCCTGGTGTTCCACAGCTTTGGT<br>GGGGGCACTGGCTCTGGCTTCACCTCACTCCTGA<br>TGGAGCGGCTCTCTGTTGACTATGGCAAGAAATCC<br>AAGCTGGAATTCTCCATCTACCCAGCCCCCCAGGT<br>GTCTACAGCCGTGGTCGAGCCCTACAACTCTATCC<br>TGACCACCCACACCACCCTGGAGCACTCAGACTG<br>TGCCTTCATGGTGGACAACGAAGCAATCTATGACA<br>TCTGCCGCCGCAACCTAGACATCGAGCGCCCAAC<br>CTACACCAACCTCAATCGCCTCATTAGCCAAATTG<br>TCTCCTCCATCACAGCTTCTCTGCGCTTTGACGGG<br>GCCCTCAATGTGGACCTGACAGAGTTCCAGACCA<br>ACCTGGTGCCCTACCCTCGCATCCACTTCCCCCTG<br>GCCACCTATGCACCAGTCATCTCTGCAGAAAAGGC<br>ATACCACGAGCAGCTGTCGGTGGCAGAGATCACC<br>AATGCCTGCTTTGAGCCTGCCAACCAGATGGTAAA | 128 | AWNMGFS<br>LMGRCPVT<br>RPLVEGTT<br>PSPPSSVK<br>LVLENTYP<br>GQFLWIWS<br>LRSLMRSE<br>MAHTDSSS<br>TQSSSSLG<br>KRMLPTTM<br>PVVTIPLAR<br>RSLTQCWI<br>GSASCLTS<br>AQDFRAS<br>WCSTALV<br>GALALASP<br>HS* |

TABLE 3A-continued

| SEQ ID | identifier_position | position | modified_RNA | PAP length | PAP |
|---|---|---|---|---|---|
| | | | GTGTGATCCCCGGCACGGCAAGTACATGGCCTGC TGCCTGCTGTACCGTGGAGATG | | |
| 1542 | NM_0060 00.1_259 | 259 | AGTTCTCACTGAGACCTGTCACCCCGACTCAACGT GAGACGCACCGCCCGGACTCACCATGCGTGAATG CATCTCAGTCCACGTGGGGCAGGCAGGTGTCCAG ATGGGCAATGCCTGCTGGGAGCTCTATTGCTTGGA ACATGGGATTCAGCCTGATGGGCAGATGCCCAGT GACAAGACCATTGGTGGAGGGGACGACTCCTTCA CCACCTTCTTCTGTGAAACTGGTGCTGGAAAACAC GTACCCCGGGCAGTTTTGTGGATCTGGAGCCTAC GGTCATTGATGAGATCCGAAATGGCCCATACCGAC AGCTCTTCCACCCAGAGCAGCTCATCACTGGGAAA GAGGATGCTGCCAACAACTATGCCCGTGGTCACT ATACCATTGGCAAGGAGATCATTGACCCAGTGCTG GATCGGATCCGCAAGCTGTCTGACCAGTGCACAG GACTTCAGGGCTTCCTGGTGTTCCACAGCTTTGGT GGGGGCACTGGCTCTGGCTTCACCTCACTCCTGA TGGAGCGGCTCTCTGTTGACTATGGCAAGAAATCC AAGCTGGAATTCTCCATCTACCCAGCCCCCCAGGT GTCTACAGCCGTGGTCGAGCCCTACAACTCTATCC TGACCACCCACACCACCCTGGAGCACTCAGACTG TGCCTTCATGGTGGACAACGAAGCAATCTATGACA TCTGCCGCCGCAACCTAGACATCGAGCGCCCAAC CTACACCAACCTCAATCGCCTCATTAGCCAAATTG TCTCCTCCATCACAGCTTCTCTGCGCTTTGACGGG GCCCTCAATGTGGACCTGACAGAGTTCCAGACCA ACCTGGTGCCCTACCCTCGCATCCACTTCCCCCTG GCCACCTATGCACCAGTCATCTCTGCAGAAAAGGC ATACCACGAGCAGCTGTCGGTGGCAGAGATCACC AATGCCTGCTTTGAGCCTGCCAACCAGATGGTAAA GTGTGATCCCCGGCACGGCAAGTACATGGCCTGC TGCCTGCTGTACCGTGGAGATG | 86 | LWIWSLRS LMRSEMA HTDSSSTQ SSSSLGKR MLPTTMPV VTIPLARRS LTQCWIGS ASCLTSAQ DFRASWC STALVGAL ALASPHS* |
| 1543 | NM_0060 09.2_225 | 225 | AGGTTCTCTTACATCGACCGCCTAAGAGTCGCGCT GTAAGAAGCAACAACCTCTCCTCTTCGTCTCCGCC ATCAGCTCGGCAGTCGCGAAGCAGCAACCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATGGGGGAGGAGATGATT CCTTCAACACCTTCTTCAGTGAGACGGGGGCTGG CAAGCATGTGCCCCGGGCAGTGTTTGTAGACTTG GAACCCACAGTCATTGATGAAGTTCGCACTGGCAC CTACCGCCAGCTCTTCCACCCTGAGCAACTTATCA CAGGCAAAGAAGATGCTGCCAATAACTATGCCCGA GGGCACTACACCATTGGCAAGGAGATCATTGACCT CGTGTTGGACCGAATTCGCAAGCTGGCCGACCAG TGCACGGGTCTCCAGGGCTTCTTGGTTTTCCACAG CTTTGGTGGGGGAACTGGTTCTGGGTTCACCTCG CTGCTCATGGAACGTCTCTCAGTTGATTATGGCAA GAAGTCCAAGCTGGAGTTCTCTATTTACCCGGCGC CCCAGGTTTCCACAGCTGTAGTTGAGCCCTACAAC TCCATCCTCACCACCCACACCACCCTGGAGCACTC TGATTGTGCCTTCATGGTAGACAATGAGGCCATCT ATGACATCTGTCGTAGAAACCTCGATATTGAGCGT CCAACCTATACTAACCTGAATAGGTTAATAGGTCA AATTGTGTCCTCCATCACTGCTTCCCTGAGATTTGA TGGAGCCCTGAATGTTGACCTGACAGAATTCCAGA CCAACCTGGTGCCCTATCCCCGCATCCACTTCCCT CTGGCCACATATGCCCCTGTCATCTCTGCTGAGAA AGCCTACCATGAACAGCTTTCTGTAGCAGAGATCA CCAATGCTTGCTTTGAGCCAGCCAACCAGATGGTG AAATGTGACCCTCGCCA | 26 | MGEEMIPS TPSSVRRG LASMCPG QCL* |
| 1544 | NM_0060 09.2_300 | 300 | AGGTTCTCTTACATCGACCGCCTAAGAGTCGCGCT GTAAGAAGCAACAACCTCTCCTCTTCGTCTCCGCC ATCAGCTCGGCAGTCGCGAAGCAGCAACCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATTGGGGGAGGAGATGAT TCCTTCAACACCTTCTTCAGTGAGACGGGGGCTGG CAAGCATGTGCCCCGGGCAGTGTTGTAGACTTGG AACCCACAGTCATTGATGAAGTTCGCACTGGCACC TACCGCCAGCTCTTCCACCCTGAGCAACTTATCAC AGGCAAAGAAGATGCTGCCAATAACTATGCCCGA GGGCACTACACCATTGGCAAGGAGATCATTGACCT CGTGTTGGACCGAATTCGCAAGCTGGCCGACCAG TGCACGGGTCTCCAGGGCTTCTTGGTTTTCCACAG | 1 | L* |

| SEQ ID | identifier_position | position | modified_RNA | PAP length | PAP |
|---|---|---|---|---|---|
| | | | CTTTGGTGGGGGAACTGGTTCTGGGTTCACCTCG<br>CTGCTCATGGAACGTCTCTCAGTTGATTATGGCAA<br>GAAGTCCAAGCTGGAGTTCTCTATTTACCCGGCGC<br>CCCAGGTTTCCACAGCTGTAGTTGAGCCCTACAAC<br>TCCATCCTCACCACCCACACCACCCTGGAGCACTC<br>TGATTGTGCCTTCATGGTAGACAATGAGGCCATCT<br>ATGACATCTGTCGTAGAAACCTCGATATTGAGCGT<br>CCAACCTATACTAACCTGAATAGGTTAATAGGTCA<br>AATTGTGTCCTCCATCACTGCTTCCCTGAGATTTGA<br>TGGAGCCCTGAATGTTGACCTGACAGAATTCCAGA<br>CCAACCTGGTGCCCTATCCCCGCATCCACTTCCCT<br>CTGGCCACATATGCCCCTGTCATCTCTGCTGAGAA<br>AGCCTACCATGAACAGCTTTCTGTAGCAGAGATCA<br>CCAATGCTTGCTTTGAGCCAGCCAACCAGATGGTG<br>AAATGTGACCCTCGCCA | | |
| 1545 | NM_0060<br>09.2_500 | 500 | AGGTTCTCTTACATCGACCGCCTAAGAGTCGCGCT<br>GTAAGAAGCAACAACCTCTCCTCTTCGTCTCCGCC<br>ATCAGCTCGGCAGTCGCGAAGCAGCAACCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAGACGGGGGCTGG<br>CAAGCATGTGCCCCGGGCAGTGTTTGTAGACTTG<br>GAACCCACAGTCATTGATGAAGTTCGCACTGGCAC<br>CTACCGCCAGCTCTTCCACCCTGAGCAACTTATCA<br>CAGGCAAAGAAGATGCTGCCAATAACTATGCCCGA<br>GGGCACTACACCATTGGCAAGGAGATCATTGACCT<br>CGTGTTGGACCGAATTCGCAAGCTGGCCGACCAG<br>TGCACGGGTCTCCAGGCTTCTTGGTTTTCCACAGC<br>TTTGGTGGGGGAACTGGTTCTGGGTTCACCTCGCT<br>GCTCATGGAACGTCTCTCAGTTGATTATGGCAAGA<br>AGTCCAAGCTGGAGTTCTCTATTTACCCGGCGCCC<br>CAGGTTTCCACAGCTGTAGTTGAGCCCTACAACTC<br>CATCCTCACCACCCACACCACCCTGGAGCACTCT<br>GATTGTGCCTTCATGGTAGACAATGAGGCCATCTA<br>TGACATCTGTCGTAGAAACCTCGATATTGAGCGTC<br>CAACCTATACTAACCTGAATAGGTTAATAGGTCAAA<br>TTGTGTCCTCCATCACTGCTTCCCTGAGATTTGAT<br>GGAGCCCTGAATGTTGACCTGACAGAATTCCAGAC<br>CAACCTGGTGCCCTATCCCCGCATCCACTTCCCTC<br>TGGCCACATATGCCCCTGTCATCTCTGCTGAGAAA<br>GCCTACCATGAACAGCTTTCTGTAGCAGAGATCAC<br>CAATGCTTGCTTTGAGCCAGCCAACCAGATGGTGA<br>AATGTGACCCTCGCCA | 47 | ASWFSTAL<br>VGELVLGS<br>PRCSWNV<br>SQLIMARS<br>PSWSSLFT<br>RRPRFPQL* |
| 1546 | NM_0060<br>10.2_168 | 168 | GGCGCGGCGGGTGCGGTTCAGTCGGTCGGCGGC<br>GGCAGCGGAGGAGGAGGAGGAGGAGGAGGATGA<br>GGAGGATGAGGAGGATGTGGGCCACGCAGGGGC<br>TGGCGGTGGCGCTGGCTCTGAGCGTGCTGCCGG<br>GCAGCCGGGCGCTGCGGCCGGGCGACTGCGAAG<br>TTGTATTTCTTATCTGGGAAGATTTTACCAGGACCT<br>CAAAGACAGAGATGTCACATTCTCACCAGCCACTA<br>TTGAAAACGAACTTATAAAGTTCTGCCGGGAAGCA<br>AGAGGCAAAGAGAATCGGTTGTGCTACTATATCGG<br>GGCCACAGATGATGCAGCCACCAAAATCATCAATG<br>AGGTATCAAAGCCTCTGGCCCACCACATCCCTGTG<br>GAGAAGATCTGTGAGAAGCTTAAGAAGAAGGACA<br>GCCAGATATGTGAGCTTAAGTATGACAAGCAGATC<br>GACCTGAGCACAGTGGACCTGAAGAAGCTCCGAG<br>TTAAAGAGCTGAAGAAGATTCTGGATGACTGGGG<br>GGAGACATGCAAAGGCTGTGCAGAAAAGTCTGAC<br>TACATCCGGAAGATAAATGAACTGATGCCTAAATA<br>TGCCCCCAAGGCAGCCAGTGCACGGACCGATTTG<br>TAGTCTGCTCAATCTCTGTTGCACCTGAGGGGGAA<br>AAAACAGTTCAACTGCTTACTCCCAAAACAGCCTTT<br>TTGTAATTTATTTTTTAAGTGGGCTCCTGACAATAC<br>TGTATCAGATGTGAAGCCTGGAGCTTTCCTGATGA<br>TGCTGGCCCTACAGTACCCCCATGAGGGGATTCC<br>CTTCCTTCTGTTGCTGGTGTACTCTAGGACTTCAAA<br>GTGTGTCTGGGATTTTTTTATTAAAGAAAAAAAATT<br>TCTAGCTGTC | 28 | VFLIWEDF<br>TRTSKTEM<br>SHSHQPLL<br>KTNL* |
| 1547 | NM_0060<br>13.2_143 | 143 | CTCTTTCCCTTCGGTGTGCCACTGAAGATCCTGGT<br>GTCGCCATGGGCCGCCGCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTGACCTGGGGCGGAAAAAGGCAAAAGTGGATG<br>AGTTTCCGCTTTGTGGCCACATGGTGTCAGATGAA | 43 | LTWGGKR<br>QKWMSFR<br>FVATWCQ<br>MNMSSCP<br>LKPWRLPE<br>FVPISTW* |

TABLE 3A-continued

| SEQ ID | identifier_ position | position | modified_RNA | PAP length | PAP |
|---|---|---|---|---|---|
| | | | TATGAGCAGCTGTCCTCTGAAGCCCTGGAGGCTG CCCGAATTTGTGCCAATAAGTACATGGTAAAAAGT TGTGGCAAAGATGGCTTCCATATCCGGGTGCGGC TCCACCCCTTCCACGTCATCCGCATCAACAAGATG TTGTCCTGTGCTGGGGCTGACAGGCTCCAAACAG GCATGCGAGGTGCCTTTGGAAAGCCCCAGGGCAC TGTGGCCAGGGTTCACATTGGCCAAGTTATCATGT CCATCCGCACCAAGCTGCAGAACAAGGAGCATGT GATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATG GCTGTGGGGTCAAGTACATCCCCAGTCGTGGCCC TCTGGACAAGTGGCGGGCCCTGCACTCATGAGGG CTTCCAATGTGCTGCCCCCTCTTAATACTCACCA ATAAATTCTACTTCCTGTCCACCTATGTCTTTGTAT CTACATTCTTGACGGGGAAGGAACTTCCTCTGGGA ACCTTTGGGTCATTGCCCTTTCACTTCAGAAACAG GTTGACAACTCAGCCCTGCTCATGAGGCAGCAAA CCCTGCAAAGGGCTGGGACTGGTGGCCTTATGTC AGTTGTCTACTCTGGAGCTTGACTTGGACCTCCCC AGGTCCTAGGCAGTAGGTTGAAAAACACTGAAGTG CTTTTCATGAAGCACAGCTGCAGCAAAGCCTTGCA ATCCCAGGCTGGGGTCAGCCTA | | |
| 1548 | NM_0060 13.2_186 | 186 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAGGCAAAAGTGGAT GAGTTTCCGCTTGTGGCCACATGGTGTCAGATGAA TATGAGCAGCTGTCCTCTGAAGCCCTGGAGGCTG CCCGAATTTGTGCCAATAAGTACATGGTAAAAAGT TGTGGCAAAGATGGCTTCCATATCCGGGTGCGGC TCCACCCCTTCCACGTCATCCGCATCAACAAGATG TTGTCCTGTGCTGGGGCTGACAGGCTCCAAACAG GCATGCGAGGTGCCTTTGGAAAGCCCCAGGGCAC TGTGGCCAGGGTTCACATTGGCCAAGTTATCATGT CCATCCGCACCAAGCTGCAGAACAAGGAGCATGT GATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATG GCTGTGGGGTCAAGTACATCCCCAGTCGTGGCCC TCTGGACAAGTGGCGGGCCCTGCACTCATGAGGG CTTCCAATGTGCTGCCCCCTCTTAATACTCACCA ATAAATTCTACTTCCTGTCCACCTATGTCTTTGTAT CTACATTCTTGACGGGGAAGGAACTTCCTCTGGGA ACCTTTGGGTCATTGCCCTTTCACTTCAGAAACAG GTTGACAACTCAGCCCTGCTCATGAGGCAGCAAA CCCTGCAAAGGGCTGGGACTGGTGGCCTTATGTC AGTTGTCTACTCTGGAGCTTGACTTGGACCTCCCC AGGTCCTAGGCAGTAGGTTGAAAAACACTGAAGTG CTTTTCATGAAGCACAGCTGCAGCAAAGCCTTGCA ATCCCAGGCTGGGGTCAGCCTA | 28 | VATWCQM NMSSCPLK PWRLPEFV PISTW* |
| 1549 | NM_0060 13.2_246 | 246 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAGGCAAAAGTGGAT GAGTTTCCGCTTTGTGGCCACATGGTGTCAGATGA ATATGAGCAGCTGTCCTCTGAAGCCCTGGAGGCT GCCGAATTTGTGCCAATAAGTACATGGTAAAAAGT TGTGGCAAAGATGGCTTCCATATCCGGGTGCGGC TCCACCCCTTCCACGTCATCCGCATCAACAAGATG TTGTCCTGTGCTGGGGCTGACAGGCTCCAAACAG GCATGCGAGGTGCCTTTGGAAAGCCCCAGGGCAC TGTGGCCAGGGTTCACATTGGCCAAGTTATCATGT CCATCCGCACCAAGCTGCAGAACAAGGAGCATGT GATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATG GCTGTGGGGTCAAGTACATCCCCAGTCGTGGCCC TCTGGACAAGTGGCGGGCCCTGCACTCATGAGGG CTTCCAATGTGCTGCCCCCTCTTAATACTCACCA ATAAATTCTACTTCCTGTCCACCTATGTCTTTGTAT CTACATTCTTGACGGGGAAGGAACTTCCTCTGGGA | 8 | EFVPISTW* |

TABLE 3A-continued

| SEQ ID | identifier_position | position | modified_RNA | PAP length | PAP |
|---|---|---|---|---|---|
| | | | ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | | |
| 1550 | NM_0060<br>13.2_252 | 252 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTGTGCCAATAAGTACATGGTAAAAAGT<br>TGTGGCAAAGATGGCTTCCATATCCGGGTGCGGC<br>TCCACCCCTTCCACGTCATCCGCATCAACAAGATG<br>TTGTCCTGTGCTGGGGCTGACAGGCTCCAAACAG<br>GCATGCGAGGTGCCTTTGGAAAGCCCCAGGGCAC<br>TGTGGCCAGGGTTCACATTGGCCAAGTTATCATGT<br>CCATCCGCACCAAGCTGCAGAACAAGGAGCATGT<br>GATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCTCTTAATACTCACCA<br>ATAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | 6 | VPISTW* |
| 1551 | NM_0060<br>13.2_312 | 312 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTGTGCCAATAAGTACATGGTAAAAAG<br>TTGTGGCAAAGATGGCTTCCATATCCGGGTGCGGT<br>CCACCCCTTCCACGTCATCCGCATCAACAAGATGT<br>TGTCCTGTGCTGGGGCTGACAGGCTCCAAACAGG<br>CATGCGAGGTGCCTTTGGAAAGCCCCAGGGCACT<br>GTGGCCAGGGTTCACATTGGCCAAGTTATCATGTC<br>CATCCGCACCAAGCTGCAGAACAAGGAGCATGTG<br>ATTGAGGCCCTGCGCAGGGCCAAGTTCAAGTTTC<br>CTGGCCGCCAGAAGATCCACATCTCAAAGAAGTG<br>GGGCTTCACCAAGTTCAATGCTGATGAATTTGAAG<br>ACATGGTGGCTGAAAAGCGGCTCATCCCAGATGG<br>CTGTGGGGTCAAGTACATCCCCAGTCGTGGCCCT<br>CTGGACAAGTGGCGGGCCCTGCACTCATGAGGGC<br>TTCCAATGTGCTGCCCCCCTCTTAATACTCACCAAT<br>AAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | 57 | STPSTSSA<br>STRCCPVL<br>GLTGSKQA<br>CEVPLESP<br>RALWPGFT<br>LAKLSCPS<br>APSCRTRS<br>M* |
| 1552 | NM_0060<br>13.2_412 | 412 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT | 24 | ALWPGFTL<br>AKLSCPSA<br>PSCRTRS<br>M* |

TABLE 3A-continued

| SEQ ID | identifier_position | position | modified_RNA | PAP length | PAP |
|---|---|---|---|---|---|
| | | | GTTGTCCTGTGCTGGGGCTGACAGGCTCCAAACA<br>GGCATGCGAGGTGCCTTTGGAAAGCCCCAGGCAC<br>TGTGGCCAGGGTTCACATTGGCCAAGTTATCATGT<br>CCATCCGCACCAAGCTGCAGAACAAGGAGCATGT<br>GATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCTCTTAATACTCACCA<br>ATAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | | |
| 1553 | NM_0060<br>13.2_426 | 426 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGCA<br>CTGTGGCCAGGTTCACATTGGCCAAGTTATCATGT<br>CCATCCGCACCAAGCTGCAGAACAAGGAGCATGT<br>GATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCTCTTAATACTCACCA<br>ATAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | 19 | FTLAKLSC<br>PSAPSCRT<br>RSM* |
| 1554 | NM_0060<br>13.2_434 | 434 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGCA<br>CTGTGGCCAGGGTTCACATGGCCAAGTTATCATGT<br>CCATCCGCACCAAGCTGCAGAACAAGGAGCATGT<br>GATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCTCTTAATACTCACCA<br>ATAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC | 17 | MAKLSCPS<br>APSCRTRS<br>M* |

TABLE 3A-continued

| SEQ ID | identifier_position | position | modified_RNA | PAP length | PAP |
|---|---|---|---|---|---|
| | | | AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | | |
| 1555 | NM_0060<br>13.2_438 | 438 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCAAGTTATCATGT<br>CCATCCGCACCAAGCTGCAGAACAAGGAGCATGT<br>GATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCTCTTAATACTCACCA<br>ATAAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | 15 | KLSCPSAP<br>SCRTRSM* |
| 1556 | NM_0060<br>13.2_506 | 506 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCAAGTTCAAGTTTC<br>CTGGCCGCCAGAAGATCCACATCTCAAAGAAGTG<br>GGGCTTCACCAAGTTCAATGCTGATGAATTTGAAG<br>ACATGGTGGCTGAAAAGCGGCTCATCCCAGATGG<br>CTGTGGGGTCAAGTACATCCCCAGTCGTGGCCCT<br>CTGGACAAGTGGCGGGCCCTGCACTCATGAGGGC<br>TTCCAATGTGCTGCCCCCCTCTTAATACTCACCAAT<br>AAAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | 115 | SSSFLAAR<br>RSTSQRS<br>GASPSSML<br>MNLKTWW<br>LKSGSSQ<br>MAVGSSTS<br>PVVALWTS<br>GGPCTHE<br>GFQCAAPL<br>LILTNKFYF<br>LSTYVFVS<br>TFLTGKEL<br>PLGTFGSL<br>PFHFRNRL<br>TTQPCS* |
| 1557 | NM_0060<br>13.2_525 | 525 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCAAGTTATCATG<br>TCCATCCGCACCAAGCTGCAGAACAAGGAGCATG | 109 | ARRSTSQR<br>SGASPSS<br>MLMNLKT<br>WWLKSGS<br>SQMAVGS<br>STSPVVAL<br>WTSGGPC<br>THEGFQCA<br>APLLILTNK<br>FYFLSTYV<br>FVSTFLTG<br>KELPLGTF<br>GSLPFHFR<br>NRLTTQPC |

TABLE 3A-continued

| SEQ ID | identifier_position | position | modified_RNA | length PAP | PAP |
|---|---|---|---|---|---|
| | | | TGATTGAGGCCCTGCGCAGGGCCAAGTTCAAGTTT CCTGGCGCCAGAAGATCCACATCTCAAAGAAGTG GGGCTTCACCAAGTTCAATGCTGATGAATTTGAAG ACATGGTGGCTGAAAAGCGGCTCATCCCAGATGG CTGTGGGGTCAAGTACATCCCCAGTCGTGGCCCT CTGGACAAGTGGCGGGCCCTGCACTCATGAGGGC TTCCAATGTGCTGCCCCCCTCTTAATACTCACCAAT AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | | S* |
| 1558 | NM_0060 13.2_528 | 528 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAGGCAAAAGTGGAT GAGTTTCCGCTTTGTGGCCACATGGTGTCAGATGA ATATGAGCAGCTGTCCTCTGAAGCCCTGGAGGCT GCCCGAATTTGTGCCAATAAGTACATGGTAAAAAG TTGTGGCAAAGATGGCTTCCATATCCGGGTGCGG CTCCACCCCTTCCACGTCATCCGCATCAACAAGAT GTTGTCCTGTGCTGGGGCTGACAGGCTCCAAACA GGCATGCGAGGTGCCTTTGGAAAGCCCCAGGGCA CTGTGGCCAGGGTTCACATTGGCCAAGTTATCATG TCCATCCGCACCAAGCTGCAGAACAAGGAGCATG TGATTGAGGCCCTGCGCAGGGCCAAGTTCAAGTTT CCTGGCCGCAGAAGATCCACATCTCAAAGAAGTG GGGCTTCACCAAGTTCAATGCTGATGAATTTGAAG ACATGGTGGCTGAAAAGCGGCTCATCCCAGATGG CTGTGGGGTCAAGTACATCCCCAGTCGTGGCCCT CTGGACAAGTGGCGGGCCCTGCACTCATGAGGGC TTCCAATGTGCTGCCCCCCTCTTAATACTCACCAAT AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | 108 | RRSTSQRS GASPSSML MNLKTWW LKSGSSQ MAVGSSTS PVVALWTS GGPCTHE GFQCAAPL LILTNKFYF LSTYVFVS TFLTGKEL PLGTFGSL PFHFRNRL TTQPCS* |
| 1559 | NM_0060 13.2_598 | 598 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAGGCAAAAGTGGAT GAGTTTCCGCTTTGTGGCCACATGGTGTCAGATGA ATATGAGCAGCTGTCCTCTGAAGCCCTGGAGGCT GCCCGAATTTGTGCCAATAAGTACATGGTAAAAAG TTGTGGCAAAGATGGCTTCCATATCCGGGTGCGG CTCCACCCCTTCCACGTCATCCGCATCAACAAGAT GTTGTCCTGTGCTGGGGCTGACAGGCTCCAAACA GGCATGCGAGGTGCCTTTGGAAAGCCCCAGGGCA CTGTGGCCAGGGTTCACATTGGCCAAGTTATCATG TCCATCCGCACCAAGCTGCAGAACAAGGAGCATG TGATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGTGAAAAGCGGCTCATCCCAGATGG CTGTGGGGTCAAGTACATCCCCAGTCGTGGCCCT CTGGACAAGTGGCGGGCCCTGCACTCATGAGGGC TTCCAATGTGCTGCCCCCCTCTTAATACTCACCAAT AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | 85 | VKSGSSQ MAVGSSTS PVVALWTS GGPCTHE GFQCAAPL LILTNKFYF LSTYVFVS TFLTGKEL PLGTFGSL PFHFRNRL TTQPCS* |

TABLE 3A-continued

| SEQ ID | identifier_position | position | modified_RNA | PAP length | PAP |
|---|---|---|---|---|---|
| 1560 | NM_0060 13.2_609 | 609 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAAGGCAAAAGTGGAT GAGTTTCCGCTTTGTGGCCACATGGTGTCAGATGA ATATGAGCAGCTGTCCTCTGAAGCCCTGGAGGCT GCCCGAATTTGTGCCAATAAGTACATGGTAAAAAG TTGTGGCAAAGATGGCTTCCATATCCGGGTGCGG CTCCACCCCTTCCACGTCATCCGCATCAACAAGAT GTTGTCCTGTGCTGGGGCTGACAGGCTCCAAACA GGCATGCGAGGTGCCTTTGGAAAGCCCCAGGGCA CTGTGGCCAGGGTTCACATTGGCCAAGTTATCATG TCCATCCGCACCAAGCTGCAGAACAAGGAGCATG TGATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATGG CTGTGGGGTCAAGTACATCCCCAGTCGTGGCCCT CTGGACAAGTGGCGGGCCCTGCACTCATGAGGGC TTCCAATGTGCTGCCCCCCTCTTAATACTCACCAAT AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | 81 | SSQMAVG SSTSPVVA LWTSGGP CTHEGFQ CAAPLLILT NKFYFLST YVFVSTFL TGKELPLG TFGSLPFH FRNRLTTQ PCS* |
| 1561 | NM_0060 13.2_623 | 623 | CTCTTTCCCTTCGGTGTGCCACTGAAGATCCTGGT GTCGCCATGGGCCGCCGCCCCGCCCGTTGTTACC GGTATTGTAAGAACAAGCCGTACCCAAAGTCTCGC TTCTGCCGAGGTGTCCCTGATGCCAAGATTCGCAT TTTTGACCTGGGGCGGAAAAAAGGCAAAAGTGGAT GAGTTTCCGCTTTGTGGCCACATGGTGTCAGATGA ATATGAGCAGCTGTCCTCTGAAGCCCTGGAGGCT GCCCGAATTTGTGCCAATAAGTACATGGTAAAAAG TTGTGGCAAAGATGGCTTCCATATCCGGGTGCGG CTCCACCCCTTCCACGTCATCCGCATCAACAAGAT GTTGTCCTGTGCTGGGGCTGACAGGCTCCAAACA GGCATGCGAGGTGCCTTTGGAAAGCCCCAGGGCA CTGTGGCCAGGGTTCACATTGGCCAAGTTATCATG TCCATCCGCACCAAGCTGCAGAACAAGGAGCATG TGATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATG GTGTGGGGTCAAGTACATCCCCAGTCGTGGCCCT CTGGACAAGTGGCGGGCCCTGCACTCATGAGGGC TTCCAATGTGCTGCCCCCCTCTTAATACTCACCAAT AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | 76 | VGSSTSPV VALWTSG GPCTHEGF QCAAPLLIL TNKFYFLS TYVFVSTF LTGKELPL GTFGSLPF HFRNRLTT QPCS* |
| 1562 | NM_0060 13.2_63 | 63 | CTCTTTCCCTTCGGTGTGCCACTGAAGATCCTGGT GTCGCCATGGGCCGCCGCCCCGCCCGTGTTACCG GTATTGTAAGAACAAGCCGTACCCAAAGTCTCGCT TCTGCCGAGGTGTCCCTGATGCCAAGATTCGCATT TTTGACCTGGGGCGGAAAAAAGGCAAAAGTGGATG AGTTTCCGCTTTGTGGCCACATGGTGTCAGATGAA TATGAGCAGCTGTCCTCTGAAGCCCTGGAGGCTG CCCGAATTTGTGCCAATAAGTACATGGTAAAAAGT TGTGGCAAAGATGGCTTCCATATCCGGGTGCGGC TCCACCCCTTCCACGTCATCCGCATCAACAAGATG TTGTCCTGTGCTGGGGCTGACAGGCTCCAAACAG GCATGCGAGGTGCCTTTGGAAAGCCCCAGGGCAC TGTGGCCAGGGTTCACATTGGCCAAGTTATCATGT CCATCCGCACCAAGCTGCAGAACAAGGAGCATGT GATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA | 69 | VTGIVRTS RTQSLASA EVSLMPRF AFLTWGG KRQKWMS FRFVATWC QMNMSSC PLKPWRLP EFVPISTW* |

TABLE 3A-continued

| SEQ ID | identifier_position | position | modified_RNA | PAP length | PAP |
|---|---|---|---|---|---|
| | | | GACATGGTGGCTGAAAAGCGGCTCATCCCAGATG<br>GCTGTGGGGTCAAGTACATCCCCAGTCGTGGCCC<br>TCTGGACAAGTGGCGGGCCCTGCACTCATGAGGG<br>CTTCCAATGTGCTGCCCCCCTCTTAATACTCACCA<br>ATAAAATTCTACTTCCTGTCCACCTATGTCTTTGTAT<br>CTACATTCTTGACGGGGAAGGAACTTCCTCTGGGA<br>ACCTTTGGGTCATTGCCCTTTCACTTCAGAAACAG<br>GTTGACAACTCAGCCCTGCTCATGAGGCAGCAAA<br>CCCTGCAAAGGGCTGGGACTGGTGGCCTTATGTC<br>AGTTGTCTACTCTGGAGCTTGACTTGGACCTCCCC<br>AGGTCCTAGGCAGTAGGTTGAAAAACACTGAAGTG<br>CTTTTCATGAAGCACAGCTGCAGCAAAGCCTTGCA<br>ATCCCAGGCTGGGGTCAGCCTA | | |
| 1563 | NM_0060<br>13.2_634 | 634 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAGTACATCCCCAGTCGTGGCCCT<br>CTGGACAAGTGGCGGGCCCTGCACTCATGAGGGC<br>TTCCAATGTGCTGCCCCCCTCTTAATACTCACCAAT<br>AAAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | 73 | STSPVVAL<br>WTSGGPC<br>THEGFQCA<br>APLLILTNK<br>FYFLSTYV<br>FVSTFLTG<br>KELPLGTF<br>GSLPFHFR<br>NRLTTQPC<br>S* |
| 1564 | NM_0060<br>13.2_644 | 644 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCAGTCGTGGCCCT<br>CTGGACAAGTGGCGGGCCCTGCACTCATGAGGGC<br>TTCCAATGTGCTGCCCCCCTCTTAATACTCACCAAT<br>AAAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | 69 | VVALWTSG<br>GPCTHEGF<br>QCAAPLLIL<br>TNKFYFLS<br>TYVFVSTF<br>LTGKELPL<br>GTFGSLPF<br>HFRNRLTT<br>QPCS* |
| 1565 | NM_0060<br>13.2_655 | 655 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT | 66 | LWTSGGP<br>CTHEGFQ<br>CAAPLLILT<br>NKFYFLST |

TABLE 3A-continued

| SEQ ID | identifier_position | position | modified_RNA | PAP length | PAP |
|---|---|---|---|---|---|
| | | | TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCT<br>CTGGACAAGTGGCGGGCCCTGCACTCATGAGGGC<br>TTCCAATGTGCTGCCCCCCTCTTAATACTCACCAAT<br>AAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | | YVFVSTFL<br>TGKELPLG<br>TFGSLPFH<br>FRNRLTTQ<br>PCS* |
| 1566 | NM_0060<br>13.2_669 | 669 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGGGGCCCTGCACTCATGAGGGC<br>TTCCAATGTGCTGCCCCCCTCTTAATACTCACCAAT<br>AAATTCTACTTCCTGTCCACCTATGTCTTTGTATCT<br>ACATTCTTGACGGGGAAGGAACTTCCTCTGGGAAC<br>CTTTGGGTCATTGCCCTTTCACTTCAGAAACAGGT<br>TGACAACTCAGCCCTGCTCATGAGGCAGCAAACC<br>CTGCAAAGGGCTGGGACTGGTGGCCTTATGTCAG<br>TTGTCTACTCTGGAGCTTGACTTGGACCTCCCCAG<br>GTCCTAGGCAGTAGGTTGAAAAACACTGAAGTGCT<br>TTTCATGAAGCACAGCTGCAGCAAAGCCTTGCAAT<br>CCCAGGCTGGGGTCAGCCTA | 61 | GPCTHEGF<br>QCAAPLLIL<br>TNKFYFLS<br>TYVFVSTF<br>LTGKELPL<br>GTFGSLPF<br>HFRNRLTT<br>QPCS* |
| 1567 | NM_0060<br>13.2_675 | 675 | CTCTTTCCCTTCGGTGTGCCACTGAAGATCCTGGT<br>GTCGCCATGGGCCGCCGCCCCGCCCGTTGTTACC<br>GGTATTGTAAGAACAAGCCGTACCCAAAGTCTCGC<br>TTCTGCCGAGGTGTCCCTGATGCCAAGATTCGCAT<br>TTTTGACCTGGGGCGGAAAAAGGCAAAAGTGGAT<br>GAGTTTCCGCTTTGTGGCCACATGGTGTCAGATGA<br>ATATGAGCAGCTGTCCTCTGAAGCCCTGGAGGCT<br>GCCCGAATTTGTGCCAATAAGTACATGGTAAAAAG<br>TTGTGGCAAAGATGGCTTCCATATCCGGGTGCGG<br>CTCCACCCCTTCCACGTCATCCGCATCAACAAGAT<br>GTTGTCCTGTGCTGGGGCTGACAGGCTCCAAACA<br>GGCATGCGAGGTGCCTTTGGAAAGCCCCAGGGCA<br>CTGTGGCCAGGGTTCACATTGGCCAAGTTATCATG<br>TCCATCCGCACCAAGCTGCAGAACAAGGAGCATG<br>TGATTGAGGCCCTGCGCAGGGCCAAGTTCAAGTTT<br>CCTGGCCGCCAGAAGATCCACATCTCAAAGAAGT<br>GGGGCTTCACCAAGTTCAATGCTGATGAATTTGAA<br>GACATGGTGGCTGAAAAGCGGCTCATCCCAGATG<br>GCTGTGGGGTCAAGTACATCCCCAGTCGTGGCCC<br>TCTGGACAAGTGGCGGGCCTGCACTCATGAGGGC<br>TTCCAATGTGCTGCCCCCCTCTTAATACTCACCAAT | 59 | CTHEGFQ<br>CAAPLLILT<br>NKFYFLST<br>YVFVSTFL<br>TGKELPLG<br>TFGSLPFH<br>FRNRLTTQ<br>PCS* |

TABLE 3A-continued

| SEQ ID | identifier_position | position | modified_RNA | PAP length | PAP |
|---|---|---|---|---|---|
| | | | AAATTCTACTTCCTGTCCACCTATGTCTTTGTATCT ACATTCTTGACGGGGAAGGAACTTCCTCTGGGAAC CTTTGGGTCATTGCCCTTTCACTTCAGAAACAGGT TGACAACTCAGCCCTGCTCATGAGGCAGCAAACC CTGCAAAGGGCTGGGACTGGTGGCCTTATGTCAG TTGTCTACTCTGGAGCTTGACTTGGACCTCCCCAG GTCCTAGGCAGTAGGTTGAAAAACACTGAAGTGCT TTTCATGAAGCACAGCTGCAGCAAAGCCTTGCAAT CCCAGGCTGGGGTCAGCCTA | | |
| 1568 | NM_0060 13.2_75 | 75 | CTCTTTCCCTTCGGTGTGCCACTGAAGATCCTGGT GTCGCCATGGGCCGCCGCCCGCCCGTTGTTACC GGTATGTAAGAACAAGCCGTACCCAAAGTCTCGCT TCTGCCGAGGTGTCCCTGATGCCAAGATTCGCATT TTTGACCTGGGGCGGAAAAAGGCAAAAGTGGATG AGTTTCCGCTTTGTGGCCACATGGTGTCAGATGAA TATGAGCAGCTGTCCTCTGAAGCCCTGGAGGCTG CCCGAATTTGTGCCAATAAGTACATGGTAAAAAGT TGTGGCAAAGATGGCTTCCATATCCGGGTGCGGC TCCACCCCTTCCACGTCATCCGCATCAACAAGATG TTGTCCTGTGCTGGGGCTGACAGGCTCCAAACAG GCATGCGAGGTGCCTTTGGAAAGCCCCAGGGCAC TGTGGCCAGGGTTCACATTGGCCAAGTTATCATGT CCATCCGCACCAAGCTGCAGAACAAGGAGCATGT GATTGAGGCCCTGCGCAGGGCCAAGTTCAAGTTT CCTGGCCGCCAGAAGATCCACATCTCAAAGAAGT GGGGCTTCACCAAGTTCAATGCTGATGAATTTGAA GACATGGTGGCTGAAAAGCGGCTCATCCCAGATG GCTGTGGGGTCAAGTACATCCCCAGTCGTGGCCC TCTGGACAAGTGGCGGGCCCTGCACTCATGAGGG CTTCCAATGTGCTGCCCCCCTCTTAATACTCACCA ATAAAATTCTACTTCCTGTCCACCTATGTCTTTGTAT CTACATTCTTGACGGGGAAGGAACTTCCTCTGGGA ACCTTTGGGTCATTGCCCTTTCACTTCAGAAACAG GTTGACAACTCAGCCCTGCTCATGAGGCAGCAAA CCCTGCAAAGGGCTGGGACTGGTGGCCTTATGTC AGTTGTCTACTCTGGAGCTTGACTTGGACCTCCCC AGGTCCTAGGCAGTAGGTTGAAAAACACTGAAGTG CTTTTCATGAAGCACAGCTGCAGCAAAGCCTTGCA ATCCCAGGCTGGGGTCAGCCTA | 65 | VRTSRTQS LASAEVSL MPRFAFLT WGGKRQK WMSFRFV ATWCQMN MSSCPLKP WRLPEFVP ISTW* |
| 1569 | NM_0060 23.1_823 | 823 | TGCGTTTAGGGCGAAGACGGAGTTGTAAACTTCTT AAAATTCCTCTCTCGACACTTCGGTAATTCCTCTTT CGAGACTAAAGCTCTTTTTGTATGCGTGTGTGTCA AGCGTATGCCCCGGGATTCTCCTCCGCTTCCTTTT CTCGGTCTTCCTTCTTGCTTTAGGGACCGGAAGAG TCCTTGAACCAAAATAGCTCGGCGGGCACTTCCG GGGCCGGCGCCCAGAGTTCCGGGAGGGTGCAGG CAGGAGAGGGAAAGGCAGCAGCGGCGGCAGCTG GAGGATGAAGAAGGAGCATGTGCTTCACTGCCAG TTCTCCGCGTGGTACCCGTTCTTCCGAGGCGTTAC CATCAAGAGTGTCATTCTTCCACTTCCTCAGAATGT GAAGGATTATTTACTCGATGATGGAACTCTGGTGG TTTCAGGAAGGGATGATCCACCAACACATTCTCAG CCAGACAGTGATGATGAAGCAGAAGAAATACAGTG GTCTGATGATGAGAACACAGCCACGCTTACGGCA CCAGAATTTCCTGAGTTTGCCACTAAAGTCCAGGA ACCTATCAATTCCCTCGGGGGCAGTGTCTTTCCTA AGCTTAATTGGAGTGCCCCAAGGGATGCGTATTG GATAGCAATGAATAGTTCTCTGAAATGTAAAACCCT CAGCGACATCTTTCTGCTTTTCAAGAGTTCCGATTT CATCACTCGTGACTTCACTCAGCCGTTTATTCATTG TACTGATGATTCTCCAGATCCATGTATAGAATATGA GCTCGTTCTCCGAAAATGGTGTGAATTGATTCCTG GGGCTGAGTTTCGATGTTTGTCAAGGAAAACAAGC TTATTGGTATTTCTCAAAGAGACTACACACAATACT ATGATCATATTTCTAAACAAAAGGAAGAAATTCGCA GATGCATACAAGACTTTTTCAAGAAACACATACAGT ACAAATTCTTAGATGAAGACTTTGTGTTCGATATAT ACAGAGACAGTAGGGGGAAGGTGTGGCTCATTGA CTTTAATC | 45 | LSRKTSLL VFLKETTH NTMIIFLNK RKKFADAY KTFSRNTY STNS* |
| 1570 | NM_0060 82.2_111 8 | 1118 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG | 3 | TRW* |

TABLE 3A-continued

| SEQ ID | identifier_position | position | modified_RNA | PAP length | PAP |
|---|---|---|---|---|---|
| | | | GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCC | | |
| 1571 | NM_0060<br>82.2_123<br>2 | 1232 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCC | 40 | SAASSLWI<br>GAPLASRL<br>ASTTSLPL<br>WCLVETW<br>PRYRELCA<br>C* |
| 1572 | NM_0060<br>82.2_125<br>0 | 1250 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT | 35 | LWIGAPLA<br>SRLASTTS<br>LPLWCLVE<br>TWPRYREL<br>CAC* |

TABLE 3A-continued

| SEQ ID | identifier_ position | position | modified_RNA | PAP length | PAP |
|---|---|---|---|---|---|
| | | | CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCC | | |
| 1573 | NM_0060 82.2_132 8 | 1328 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCC | 8 | RYRELCAC* |
| 1574 | NM_0060 82.2_143 0 | 1430 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCC | 69 | LFTGTWVR GWRKASF QRPVKIWL PLRRIMRR LVWILLKE RVRKKERN TNYPFLLA LQHVMLPE FQLQLN* |
| 1575 | NM_0060 82.2_150 3 | 1503 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT | 44 | RRIMRRLV WILLKERV RKKERNTN YPFLLALQ HVMLPEFQ LQLN* |

TABLE 3A-continued

| SEQ ID | identifier_position | position | modified_RNA | PAP length | PAP |
|---|---|---|---|---|---|
| | | | GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCC | | |
| 1576 | NM_0060<br>82.2_152<br>6 | 1526 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCC | 37 | VWILLKER<br>VRKKERNT<br>NYPFLLAL<br>QHVMLPEF<br>QLQLN* |
| 1577 | NM_0060<br>82.2_248 | 248 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTGGCCAGGCTGGTGTCCAGATTGG<br>CAATGCCTGCTGGGAGCTCTACTGCCTGGAACAC<br>GGCATCCAGCCCGATGGCCAGATGCCAAGTGACA<br>AGACCATTGGGGGAGGAGATGACTCCTTCAACAC<br>CTTCTTCAGTGAGACGGGCGCTGGCAAGCACGTG<br>CCCCGGGCTGTGTTTGTAGACTTGGAACCCACAGT<br>CATTGATGAAGTTCGCACTGGCACCTACCGCCAG<br>CTCTTCCACCCTGAGCAGCTCATCACAGGCAAGG<br>AAGATGCTGCCAATAACTATGCCCGAGGGCACTAC<br>ACCATTGGCAAGGAGATCATTGACCTTGTGTTGGA<br>CCGAATTCGCAAGCTGGCTGACCAGTGCACCGGT<br>CTTCAGGGCTTCTTGGTTTTCCACAGCTTTGGTGG<br>GGGAACTGGTTCTGGGTTCACCTCCCTGCTCATG<br>GAACGTCTCTCAGTTGATTATGGCAAGAAGTCCAA<br>GCTGGAGTTCTCCATTTACCCAGCACCCCAGGTTT<br>CCACAGCTGTAGTTGAGCCCTACAACTCCATCCTC<br>ACCACCCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC | 58 | ARLVSRLA<br>MPAGSSTA<br>WNTASSP<br>MARCQVT<br>RPLGEEMT<br>PSTPSSVR<br>RALASTCP<br>GLCL* |

TABLE 3A-continued

| SEQ ID | identifier_position | position | modified_RNA | PAP length | PAP |
|---|---|---|---|---|---|
| | | | CTGAATGTTGACCTGACAGAATTCCAGACCAACCT GGTGCCCTACCCCCGCATCCACTTCCCT | | |
| 1578 | NM_0060 82.2_252 | 252 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCAGGCTGGTGTCCAGATTGG CAATGCCTGCTGGGAGCTCTACTGCCTGGAACAC GGCATCCAGCCCGATGGCCAGATGCCAAGTGACA AGACCATTGGGGGAGGAGATGACTCCTTCAACAC CTTCTTCAGTGAGACGGGCGCTGGCAAGCACGTG CCCCGGGCTGTGTTTGTAGACTTGGAACCCACAGT CATTGATGAAGTTCGCACTGGCACCTACCGCCAG CTCTTCCACCCTGAGCAGCTCATCACAGGCAAGG AAGATGCTGCCAATAACTATGCCCGAGGGCACTAC ACCATTGGCAAGGAGATCATTGACCTTGTGTTGGA CCGAATTCGCAAGCTGGCTGACCAGTGCACCGGT CTTCAGGGCTTCTTGGTTTTCCACAGCTTTGGTGG GGGAACTGGTTCTGGGTTCACCTCCCTGCTCATG GAACGTCTCTCAGTTGATTATGGCAAGAAGTCCAA GCTGGAGTTCTCCATTTACCCAGCACCCCAGGTTT CCACAGCTGTAGTTGAGCCCTACAACTCCATCCTC ACCACCCACACCACCCTGGAGCACTCTGATTGTG CCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 57 | RLVSRLAM PAGSSTA WNTASSP MARCQVT RPLGEEMT PSTPSSVR RALASTCP GLCL* |
| 1579 | NM_0060 82.2_264 | 264 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCAGGCTGGTGTCCAGATTGG CAATGCCTGCTGGGAGCTCTACTGCCTGGAACAC GGCATCCAGCCCGATGGCCAGATGCCAAGTGACA AGACCATTGGGGGAGGAGATGACTCCTTCAACAC CTTCTTCAGTGAGACGGGCGCTGGCAAGCACGTG CCCCGGGCTGTGTTTGTAGACTTGGAACCCACAGT CATTGATGAAGTTCGCACTGGCACCTACCGCCAG CTCTTCCACCCTGAGCAGCTCATCACAGGCAAGG AAGATGCTGCCAATAACTATGCCCGAGGGCACTAC ACCATTGGCAAGGAGATCATTGACCTTGTGTTGGA CCGAATTCGCAAGCTGGCTGACCAGTGCACCGGT CTTCAGGGCTTCTTGGTTTTCCACAGCTTTGGTGG GGGAACTGGTTCTGGGTTCACCTCCCTGCTCATG GAACGTCTCTCAGTTGATTATGGCAAGAAGTCCAA GCTGGAGTTCTCCATTTACCCAGCACCCCAGGTTT CCACAGCTGTAGTTGAGCCCTACAACTCCATCCTC ACCACCCACACCACCCTGGAGCACTCTGATTGTG CCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 53 | RLAMPAGS STAWNTAS SPMARCQ VTRPLGEE MTPSTPSS VRRALAST CPGLCL* |
| 1580 | NM_0060 82.2_269 | 269 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATGG CAATGCCTGCTGGGAGCTCTACTGCCTGGAACAC GGCATCCAGCCCGATGGCCAGATGCCAAGTGACA AGACCATTGGGGGAGGAGATGACTCCTTCAACAC CTTCTTCAGTGAGACGGGCGCTGGCAAGCACGTG CCCCGGGCTGTGTTTGTAGACTTGGAACCCACAGT CATTGATGAAGTTCGCACTGGCACCTACCGCCAG CTCTTCCACCCTGAGCAGCTCATCACAGGCAAGG | 52 | MAMPAGS STAWNTAS SPMARCQ VTRPLGEE MTPSTPSS VRRALAST CPGLCL* |

TABLE 3A-continued

| SEQ ID | identifier_position | position | modified_RNA | PAP length | PAP |
|---|---|---|---|---|---|
| | | | AAGATGCTGCCAATAACTATGCCCGAGGGCACTAC<br>ACCATTGGCAAGGAGATCATTGACCTTGTGTTGGA<br>CCGAATTCGCAAGCTGGCTGACCAGTGCACCGGT<br>CTTCAGGGCTTCTTGGTTTTCCACAGCTTTGGTGG<br>GGGAACTGGTTCTGGGTTCACCTCCCTGCTCATG<br>GAACGTCTCTCAGTTGATTATGGCAAGAAGTCCAA<br>GCTGGAGTTCTCCATTTACCCAGCACCCCAGGTTT<br>CCACAGCTGTAGTTGAGCCCTACAACTCCATCCTC<br>ACCACCCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | | |
| 1581 | NM_0060 82.2_324 | 324 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCAGATGCCAAGTGACA<br>AGACCATTGGGGAGGAGATGACTCCTTCAACAC<br>CTTCTTCAGTGAGACGGGCGCTGGCAAGCACGTG<br>CCCCGGGCTGTGTTTGTAGACTTGGAACCCACAGT<br>CATTGATGAAGTTCGCACTGGCACCTACCGCCAG<br>CTCTTCCACCCTGAGCAGCTCATCACAGGCAAGG<br>AAGATGCTGCCAATAACTATGCCCGAGGGCACTAC<br>ACCATTGGCAAGGAGATCATTGACCTTGTGTTGGA<br>CCGAATTCGCAAGCTGGCTGACCAGTGCACCGGT<br>CTTCAGGGCTTCTTGGTTTTCCACAGCTTTGGTGG<br>GGGAACTGGTTCTGGGTTCACCTCCCTGCTCATG<br>GAACGTCTCTCAGTTGATTATGGCAAGAAGTCCAA<br>GCTGGAGTTCTCCATTTACCCAGCACCCCAGGTTT<br>CCACAGCTGTAGTTGAGCCCTACAACTCCATCCTC<br>ACCACCCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 33 | RCQVTRPL<br>GEEMTPST<br>PSSVRRAL<br>ASTCPGLC<br>L* |
| 1582 | NM_0060 82.2_347 | 347 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCAGATGCCAAGTGAC<br>AAGACCATGGGGGAGGAGATGACTCCTTCAACAC<br>CTTCTTCAGTGAGACGGGCGCTGGCAAGCACGTG<br>CCCCGGGCTGTGTTTGTAGACTTGGAACCCACAGT<br>CATTGATGAAGTTCGCACTGGCACCTACCGCCAG<br>CTCTTCCACCCTGAGCAGCTCATCACAGGCAAGG<br>AAGATGCTGCCAATAACTATGCCCGAGGGCACTAC<br>ACCATTGGCAAGGAGATCATTGACCTTGTGTTGGA<br>CCGAATTCGCAAGCTGGCTGACCAGTGCACCGGT<br>CTTCAGGGCTTCTTGGTTTTCCACAGCTTTGGTGG<br>GGGAACTGGTTCTGGGTTCACCTCCCTGCTCATG<br>GAACGTCTCTCAGTTGATTATGGCAAGAAGTCCAA<br>GCTGGAGTTCTCCATTTACCCAGCACCCCAGGTTT<br>CCACAGCTGTAGTTGAGCCCTACAACTCCATCCTC<br>ACCACCCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 26 | MGEEMTP<br>STPSSVRR<br>ALASTCPG<br>LCL* |

TABLE 3A-continued

| SEQ ID | identifier_position | position | modified_RNA | PAP length | PAP |
|---|---|---|---|---|---|
| 1583 | NM_006082.2_352 | 352 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACAC CTTCTTCAGTGAGACGGGCGCTGGCAAGCACGTG CCCCGGGCTGTGTTTGTAGACTTGGAACCCACAGT CATTGATGAAGTTCGCACTGGCACCTACCGCCAG CTCTTCCACCCTGAGCAGCTCATCACAGGCAAGG AAGATGCTGCCAATAACTATGCCCGAGGGCACTAC ACCATTGGCAAGGAGATCATTGACCTTGTGTTGGA CCGAATTCGCAAGCTGGCTGACCAGTGCACCGGT CTTCAGGGCTTCTTGGTTTTCCACAGCTTTGGTGG GGGAACTGGTTCTGGGTTCACCTCCCTGCTCATG GAACGTCTCTCAGTTGATTATGGCAAGAAGTCCAA GCTGGAGTTCTCCATTTACCCAGCACCCCAGGTTT CCACAGCTGTAGTTGAGCCCTACAACTCCATCCTC ACCACCCACACCACCCTGGAGCACTCTGATTGTG CCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 24 | EEMTPSTP SSVRRALA STCPGLCL* |
| 1584 | NM_006082.2_422 | 422 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTGTAGACTTGGAACCCACAG TCATTGATGAAGTTCGCACTGGCACCTACCGCCAG CTCTTCCACCCTGAGCAGCTCATCACAGGCAAGG AAGATGCTGCCAATAACTATGCCCGAGGGCACTAC ACCATTGGCAAGGAGATCATTGACCTTGTGTTGGA CCGAATTCGCAAGCTGGCTGACCAGTGCACCGGT CTTCAGGGCTTCTTGGTTTTCCACAGCTTTGGTGG GGGAACTGGTTCTGGGTTCACCTCCCTGCTCATG GAACGTCTCTCAGTTGATTATGGCAAGAAGTCCAA GCTGGAGTTCTCCATTTACCCAGCACCCCAGGTTT CCACAGCTGTAGTTGAGCCCTACAACTCCATCCTC ACCACCCACACCACCCTGGAGCACTCTGATTGTG CCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 1 | L* |
| 1585 | NM_006082.2_446 | 446 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG | 106 | MMKFALAP TASSSTLS SSSQARK MLPITMPE GTTPLARR SLTLCWTE FASWLTSA PVFRASWF STALVGEL VLGSPPCS WNVSQLIM ARSPSWS SPFTQHPR FPQL* |

TABLE 3A-continued

| SEQ ID | identifier_position | position | modified_RNA | PAP length | PAP |
|---|---|---|---|---|---|
| | | | GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | | |
| 1586 | NM_0060<br>82.2_474 | 474 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCAG<br>CTCTTCCACCCTGAGCAGCTCATCACAGGCAAGG<br>AAGATGCTGCCAATAACTATGCCCGAGGGCACTAC<br>ACCATTGGCAAGGAGATCATTGACCTTGTGTTGGA<br>CCGAATTCGCAAGCTGGCTGACCAGTGCACCGGT<br>CTTCAGGGCTTCTTGGTTTTCCACAGCTTTGGTGG<br>GGGAACTGGTTCTGGGTTCACCTCCCTGCTCATG<br>GAACGTCTCTCAGTTGATTATGGCAAGAAGTCCAA<br>GCTGGAGTTCTCCATTTACCCAGCACCCCAGGTTT<br>CCACAGCTGTAGTTGAGCCCTACAACTCCATCCTC<br>ACCACCCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 96 | SSSTLSSS<br>SQARKMLP<br>ITMPEGTT<br>PLARRSLT<br>LCWTEFAS<br>WLTSAPVF<br>RASWFSTA<br>LVGELVLG<br>SPPCSWN<br>VSQLIMAR<br>SPSWSSPF<br>TQHPRFPQ<br>L* |
| 1587 | NM_0060<br>82.2_521 | 521 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCAATAACTATGCCCGAGGGCACTA<br>CACCATTGGCAAGGAGATCATTGACCTTGTGTTGG<br>ACCGAATTCGCAAGCTGGCTGACCAGTGCACCGG<br>TCTTCAGGGCTTCTTGGTTTTCCACAGCTTTGGTG<br>GGGGAACTGGTTCTGGGTTCACCTCCCTGCTCAT<br>GGAACGTCTCTCAGTTGATTATGGCAAGAAGTCCA<br>AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 80 | ITMPEGTT<br>PLARRSLT<br>LCWTEFAS<br>WLTSAPVF<br>RASWFSTA<br>LVGELVLG<br>SPPCSWN<br>VSQLIMAR<br>SPSWSSPF<br>TQHPRFPQ<br>L* |
| 1588 | NM_0060<br>82.2_551 | 551 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG | 71 | MARRSLTL<br>CWTEFAS<br>WLTSAPVF<br>RASWFSTA |

TABLE 3A-continued

| SEQ ID | identifier_position | position | modified_RNA | PAP length | PAP |
|---|---|---|---|---|---|
| | | | TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATGGCAAGGAGATCATTGACCTTGTGTTGG ACCGAATTCGCAAGCTGGCTGACCAGTGCACCGG TCTTCAGGGCTTCTTGGTTTTCCACAGCTTTGGTG GGGGAACTGGTTCTGGGTTCACCTCCCTGCTCAT GGAACGTCTCTCAGTTGATTATGGCAAGAAGTCCA AGCTGGAGTTCTCCATTTACCCAGCACCCCAGGTT TCCACAGCTGTAGTTGAGCCCTACAACTCCATCCT CACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCTGAGATTTGATGGAGCC CTGAATGTTGACCTGACAGAATTCCAGACCAACCT GGTGCCCTACCCCCGCATCCACTTCCCT | | LVGELVLG SPPCSWN VSQLIMAR SPSWSSPF TQHPRFPQ L* |
| 1589 | NM_0060 82.2_566 | 566 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTGG ACCGAATTCGCAAGCTGGCTGACCAGTGCACCGG TCTTCAGGGCTTCTTGGTTTTCCACAGCTTTGGTG GGGGAACTGGTTCTGGGTTCACCTCCCTGCTCAT GGAACGTCTCTCAGTTGATTATGGCAAGAAGTCCA AGCTGGAGTTCTCCATTTACCCAGCACCCCAGGTT TCCACAGCTGTAGTTGAGCCCTACAACTCCATCCT CACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCTGAGATTTGATGGAGCC CTGAATGTTGACCTGACAGAATTCCAGACCAACCT GGTGCCCTACCCCCGCATCCACTTCCCT | 66 | MTLCWTEF ASWLTSAP VFRASWFS TALVGELV LGSPPCS WNVSQLIM ARSPSWS SPFTQHPR FPQL* |
| 1590 | NM_0060 82.2_577 | 577 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTGG ACCGAATTCGCAAGCTGGCTGACCAGTGCACCGG TCTTCAGGGCTTCTTGGTTTTCCACAGCTTTGGTG GGGGAACTGGTTCTGGGTTCACCTCCCTGCTCAT GGAACGTCTCTCAGTTGATTATGGCAAGAAGTCCA | 62 | WTEFASW LTSAPVFR ASWFSTAL VGELVLGS PPCSWNV SQLIMARS PSWSSPFT QHPRFPQL* |

TABLE 3A-continued

| SEQ ID | identifier_position | position | modified_RNA | PAP length | PAP |
|---|---|---|---|---|---|
| | | | AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | | |
| 1591 | NM_0060<br>82.2_598 | 598 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGTGACCAGTGCACCGG<br>TCTTCAGGGCTTCTTGGTTTTCCACAGCTTTGGTG<br>GGGGAACTGGTTCTGGGTTCACCTCCCTGCTCAT<br>GGAACGTCTCTCAGTTGATTATGGCAAGAAGTCCA<br>AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 55 | VTSAPVFR<br>ASWFSTAL<br>VGELVLGS<br>PPCSWNV<br>SQLIMARS<br>PSWSSPFT<br>QHPRFPQL* |
| 1592 | NM_0060<br>82.2_628 | 628 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGTGACCAGTGCACCG<br>GTCTTCAGGGCTTCTGGTTTTCCACAGCTTTGGTG<br>GGGGAACTGGTTCTGGGTTCACCTCCCTGCTCAT<br>GGAACGTCTCTCAGTTGATTATGGCAAGAAGTCCA<br>AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 45 | WFSTALVG<br>ELVLGSPP<br>CSWNVSQ<br>LIMARSPS<br>WSSPFTQ<br>HPRFPQL* |
| 1593 | NM_0060<br>82.2_644 | 644 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG | 40 | LVGELVLG<br>SPPCSWN<br>VSQLIMAR<br>SPSWSSPF<br>TQHPRFPQ<br>L* |

TABLE 3A-continued

| SEQ ID | identifier_position | position | modified_RNA | PAP length | PAP |
|---|---|---|---|---|---|
| | | | GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTGGTG<br>GGGGAACTGGTTCTGGGTTCACCTCCCTGCTCAT<br>GGAACGTCTCTCAGTTGATTATGGCAAGAAGTCCA<br>AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | | |
| 1594 | NM_0060<br>82.2_698 | 698 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTGATTATGGCAAGAAGTCCA<br>AGCTGGAGTTCTCCATTTACCCAGCACCCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 21 | IMARSPSW<br>SSPFTQHP<br>RFPQL* |
| 1595 | NM_0060<br>82.2_747 | 747 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCAGGTT<br>TCCACAGCTGTAGTTGAGCCCTACAACTCCATCCT<br>CACCACCCACACCACCCTGGAGCACTCTGATTGT<br>GCCTTCATGGTAGACAATGAGGCCATCTATGACAT | 5 | RFPQL* |

TABLE 3A-continued

| SEQ ID | identifier_position | position | modified_RNA | PAP length | PAP |
|---|---|---|---|---|---|
| 1596 | NM_0060 82.2_753 | 753 | CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TCCACAGCTGTAGTTGAGCCTACAACTCCATCCT CACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 3 | PQL* |
| 1597 | NM_0060 82.2_773 | 773 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TCCACAGCTGTAGTTGAGCCTACAACTCCATCCT CACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 19 | TTPSSPPT PPWSTLIV PSW* |
| 1598 | NM_0060 82.2_779 | 779 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT | 17 | PSSPPTPP WSTLIVPS W* |

TABLE 3A-continued

| SEQ ID | identifier_ position | position | modified_RNA | PAP length | PAP |
|---|---|---|---|---|---|
| | | | GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAATCCATCCT<br>CACCACCCACACCACCCTGGAGCACTCTGATTGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | | |
| 1599 | NM_0060 82.2_795 | 795 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCACACCACCCTGGAGCACTCTGATTGTG<br>CCTTCATGGTAGACAATGAGGCCATCTATGACATC<br>TGTCGTAGAAACCTCGATATCGAGCGCCCAACCTA<br>CACTAACCTTAACCGCCTTATTAGCCAGATTGTGT<br>CCTCCATCACTGCTTCCCTGAGATTTGATGGAGCC<br>CTGAATGTTGACCTGACAGAATTCCAGACCAACCT<br>GGTGCCCTACCCCCGCATCCACTTCCCT | 12 | TPPWSTLI VPSW* |
| 1600 | NM_0060 82.2_819 | 819 | GGCGGCCAGGCCGGGCGCGGAGTGGGCGCGCG<br>GGGCCGGAGGAGGGGCCAGCGACCGCGGCACC<br>GCCTGTGCCCGCCCGCCCCTCCGCAGCCGCTACT<br>TAAGAGGCTCCAGCGCCGGCCCCGCCCTAGTGCG<br>TTACTTACCTCGACTCTTAGCTTGTCGGGGACGGT<br>AACCGGGACCCGGTGTCTGCTCCTGTCGCCTTCG<br>CCTCCTAATCCCTAGCCACTATGCGTGAGTGCATC<br>TCCATCCACGTTGGCCAGGCTGGTGTCCAGATTG<br>GCAATGCCTGCTGGGAGCTCTACTGCCTGGAACA<br>CGGCATCCAGCCCGATGGCCAGATGCCAAGTGAC<br>AAGACCATTGGGGGAGGAGATGACTCCTTCAACA<br>CCTTCTTCAGTGAGACGGGCGCTGGCAAGCACGT<br>GCCCCGGGCTGTGTTTGTAGACTTGGAACCCACA<br>GTCATTGATGAAGTTCGCACTGGCACCTACCGCCA<br>GCTCTTCCACCCTGAGCAGCTCATCACAGGCAAG<br>GAAGATGCTGCCAATAACTATGCCCGAGGGCACT<br>ACACCATTGGCAAGGAGATCATTGACCTTGTGTTG<br>GACCGAATTCGCAAGCTGGCTGACCAGTGCACCG<br>GTCTTCAGGGCTTCTTGGTTTTCCACAGCTTTGGT<br>GGGGGAACTGGTTCTGGGTTCACCTCCCTGCTCA<br>TGGAACGTCTCTCAGTTGATTATGGCAAGAAGTCC<br>AAGCTGGAGTTCTCCATTTACCCAGCACCCCAGGT<br>TTCCACAGCTGTAGTTGAGCCCTACAACTCCATCC<br>TCACCACCCACACCACCCTGGAGCACTCTGATGT<br>GCCTTCATGGTAGACAATGAGGCCATCTATGACAT<br>CTGTCGTAGAAACCTCGATATCGAGCGCCCAACCT<br>ACACTAACCTTAACCGCCTTATTAGCCAGATTGTGT<br>CCTCCATCACTGCTTCCCTGAGATTTGATGGAGCC | 4 | VPSW* |

TABLE 3A-continued

| SEQ ID | identifier_ position | position | modified_RNA | PAP length | PAP |
|---|---|---|---|---|---|
| 1601 | NM_0060 82.2_824 | 824 | CTGAATGTTGACCTGACAGAATTCCAGACCAACCT GGTGCCCTACCCCCGCATCCACTTCCCT GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 2 | SW* |
| 1602 | NM_0060 82.2_845 | 845 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCTTCATGGTAGACAATGAGGCCATCTATGACATC TGTCGTAGAAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 33 | SMTSVVET SISSAQPTL TLTALLARL CPPSLLP* |
| 1603 | NM_0060 82.2_868 | 868 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG | 26 | TSISSAQP TLTLTALLA RLCPPSLL P* |

| SEQ ID | identifier_ position | position | modified_RNA | PAP length | PAP |
|---|---|---|---|---|---|
| | | | GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAACCTCGATATCGAGCGCCCAACCTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | | |
| 1604 | NM_0060 82.2_890 | 890 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACTA CACTAACCTTAACCGCCTTATTAGCCAGATTGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 18 | TLTLTALLA RLCPPSLL P* |
| 1605 | NM_0060 82.2_906 | 906 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACGCCTTATTAGCCAGATTGTGTC CTCCATCACTGCTTCCCTGAGATTTGATGGAGCCC TGAATGTTGACCTGACAGAATTCCAGACCAACCTG GTGCCCTACCCCCGCATCCACTTCCCT | 13 | ALLARLCP PSLLP* |

TABLE 3A-continued

| SEQ ID | identifier_position | position | modified_RNA | PAP length | PAP |
|---|---|---|---|---|---|
| 1606 | NM_0060 82.2_923 | 923 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATGTGT CCTCCATCACTGCTTCCCTGAGATTTGATGGAGCC CTGAATGTTGACCTGACAGAATTCCAGACCAACCT GGTGCCCTACCCCCGCATCCACTTCCCT | 8 | MCPPSLLP* |
| 1607 | NM_0060 82.2_929 | 929 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CTCCATCACTGCTTCCCTGAGATTTGATGGAGCCC TGAATGTTGACCTGACAGAATTCCAGACCAACCTG GTGCCCTACCCCCGCATCCACTTCCCT | 5 | PSLLP* |
| 1608 | NM_0060 82.2_953 | 953 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG | 4 | LMEP* |

TABLE 3A-continued

| SEQ ID | identifier_ position | position | modified_RNA | PAP length | PAP |
|---|---|---|---|---|---|
| | | | GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTGATGGAGCCC TGAATGTTGACCTGACAGAATTCCAGACCAACCTG GTGCCCTACCCCCGCATCCACTTCCCT | | |
| 1609 | NM_0060 82.2_992 | 992 | GGCGGCCAGGCCGGGCGCGGAGTGGGCGCGCG GGGCCGGAGGAGGGGCCAGCGACCGCGGCACC GCCTGTGCCCGCCCGCCCCTCCGCAGCCGCTACT TAAGAGGCTCCAGCGCCGGCCCCGCCCTAGTGCG TTACTTACCTCGACTCTTAGCTTGTCGGGGACGGT AACCGGGACCCGGTGTCTGCTCCTGTCGCCTTCG CCTCCTAATCCCTAGCCACTATGCGTGAGTGCATC TCCATCCACGTTGGCCAGGCTGGTGTCCAGATTG GCAATGCCTGCTGGGAGCTCTACTGCCTGGAACA CGGCATCCAGCCCGATGGCCAGATGCCAAGTGAC AAGACCATTGGGGAGGAGATGACTCCTTCAACA CCTTCTTCAGTGAGACGGGCGCTGGCAAGCACGT GCCCCGGGCTGTGTTTGTAGACTTGGAACCCACA GTCATTGATGAAGTTCGCACTGGCACCTACCGCCA GCTCTTCCACCCTGAGCAGCTCATCACAGGCAAG GAAGATGCTGCCAATAACTATGCCCGAGGGCACT ACACCATTGGCAAGGAGATCATTGACCTTGTGTTG GACCGAATTCGCAAGCTGGCTGACCAGTGCACCG GTCTTCAGGGCTTCTTGGTTTTCCACAGCTTTGGT GGGGGAACTGGTTCTGGGTTCACCTCCCTGCTCA TGGAACGTCTCTCAGTTGATTATGGCAAGAAGTCC AAGCTGGAGTTCTCCATTTACCCAGCACCCCAGGT TTCCACAGCTGTAGTTGAGCCCTACAACTCCATCC TCACCACCCACACCACCCTGGAGCACTCTGATTGT GCCTTCATGGTAGACAATGAGGCCATCTATGACAT CTGTCGTAGAAACCTCGATATCGAGCGCCCAACCT ACACTAACCTTAACCGCCTTATTAGCCAGATTGTGT CCTCCATCACTGCTTCCCTGAGATTTGATGGAGCC CTGAATGTTGACCTGACAGAATTCCAGACAACCTG GTGCCCTACCCCCGCATCCACTTCCCT | 30 | TWCPTPAS TSLWPHM PLSSLLRK PTMNSFL* |
| 1610 | NM_0060 83.3_243 | 243 | ACGCAAAGCAGTGTGGGTTGATTCTGAGGTGCAC TGTGGGAAAGAGCTTGTCGCTGCGGTGTTGCTGTT GGAGACTCGATTGTTGGTGACAGCGAAAGAACGA TAACAAAATGCCGGAGCGAGATAGTGAGCCGTTCT CCAACCCTTTGGCCCCCGATGGCCACGATGTGGA TGATCCTCACTCCTTCCACCAATCAAAACTCACCA ATGAAGACTTCAGGAAACTTCTCATGACCCCCAGG CTGCACCTACCTCTGCACCACCTTCTAAGTCACGT CACCATGAGATGCCAAGGGAGTACAATGAGGATG AAGACCCAGCTGCACGAAGGAGGAAAAAGAAAAG TTATTATGCCAAGCTACGCCAACAAGAAATTGAGA GAGAGAGAGAGCTAGCAGAGAAGTACCGGGATCG TGCCAAGGAACGGAGAGATGGAGTGAACAAAGAT TATGAAGAAACCGAGCTTATCAGCACCACAGCTAA CTATAGGGCTGTTGGCCCCACTGCTGAGGCGGAC AAAATCAGCTGCAGAGAAGAGAAGACAGTTGATCCA GGAGTCCAAATTCTTGGGTGGTGACATGGAACACA CCCATTTGGTGAAAGGCTTGGATTTTGCTCTGCTT CAAAAGGTACGAGCTGAGATTGCCAGCAAAGAGA AGAGGAAGAGGAACTGATGGAAAAGCCCCAGAA AGAAACCAAGAAAAGATGAGGATCCTGAAAATAAAA TTGAATTTAAAACACGTCTGGGCCGCAATGTTTAC CGAATGCTTTTTAAGAGCAAAGCATATGAGCGGAA TGAGTTGTTCCTGCCGGGCCGCATGGCCTATGTG GTAGACCTGGATGATGAGTATGCTGACACAGATAT CCCCACCACTCTTATCCGCAGCAAGGCTGATTGCC CCACCATGGAGGCCCAGACCACACTGACCACAAA TGACATTGTCATTAGCAAGCTGACCCAGATCCTTT CATACCTGAGGCAGGGAACCCGTAACAAGAAGCT TAAGAAGAAGGATAAAGGGAAG | 50 | LHLPLHHL LSHVTMRC QGSTMRM KTQLHEGG KRKVIMPS YANKKLRE RES* |
| 1611 | NM_0060 83.3_497 | 497 | ACGCAAAGCAGTGTGGGTTGATTCTGAGGTGCAC TGTGGGAAAGAGCTTGTCGCTGCGGTGTTGCTGTT GGAGACTCGATTGTTGGTGACAGCGAAAGAACGA TAACAAAATGCCGGAGCGAGATAGTGAGCCGTTCT | 16 | APLLRRTN QLQRRED S* |

TABLE 3A-continued

| SEQ ID | identifier_position | position | modified_RNA | PAP length | PAP |
|---|---|---|---|---|---|
| | | | CCAACCCTTTGGCCCCCGATGGCCACGATGTGGA<br>TGATCCTCACTCCTTCCACCAATCAAAACTCACCA<br>ATGAAGACTTCAGGAAACTTCTCATGACCCCCAGG<br>GCTGCACCTACCTCTGCACCACCTTCTAAGTCACG<br>TCACCATGAGATGCCAAGGGAGTACAATGAGGAT<br>GAAGACCCAGCTGCACGAAGGAGGAAAAAGAAAA<br>GTTATTATGCCAAGCTACGCCAACAAGAAATTGAG<br>AGAGAGAGAGAGCTAGCAGAGAAGTACCGGGATC<br>GTGCCAAGGAACGGAGAGATGGAGTGAACAAAGA<br>TTATGAAGAAACCGAGCTTATCAGCACCACAGCTA<br>ACTATAGGGCTGTGGCCCCACTGCTGAGGCGGAC<br>AAATCAGCTGCAGAGAAGAGAAGACAGTTGATCCA<br>GGAGTCCAAATTCTTGGGTGGTGACATGGAACACA<br>CCCATTTGGTGAAAGGCTTGGATTTTGCTCTGCTT<br>CAAAAGGTACGAGCTGAGATTGCCAGCAAAGAGA<br>AAGAGGAAGAGGAACTGATGGAAAAGCCCCAGAA<br>AGAAACCAAGAAAGATGAGGATCCTGAAAATAAAA<br>TTGAATTTAAAACACGTCTGGGCCGCAATGTTTAC<br>CGAATGCTTTTTAAGAGCAAAGCATATGAGCGGAA<br>TGAGTTGTTCCTGCCGGGCCGCATGGCCTATGTG<br>GTAGACCTGGATGATGAGTATGCTGACACAGATAT<br>CCCCACCACTCTTATCCGCAGCAAGGCTGATTGCC<br>CCACCATGGAGGCCCAGACCACACTGACCACAAA<br>TGACATTGTCATTAGCAAGCTGACCCAGATCCTTT<br>CATACCTGAGGCAGGGAACCCGTAACAAGAAGCT<br>TAAGAAGAAGGATAAAGGGAAG | | |
| 1612 | NM_0060<br>83.3_614 | 614 | ACGCAAAGCAGTGTGGGTTGATTCTGAGGTGCAC<br>TGTGGGAAAGAGCTTGTCGCTGCGGTGTTGCTGTT<br>GGAGACTCGATTGTTGGTGACAGCGAAAGAACGA<br>TAACAAAATGCCGGAGCGAGATAGTGAGCCGTTCT<br>CCAACCCTTTGGCCCCCGATGGCCACGATGTGGA<br>TGATCCTCACTCCTTCCACCAATCAAAACTCACCA<br>ATGAAGACTTCAGGAAACTTCTCATGACCCCCAGG<br>GCTGCACCTACCTCTGCACCACCTTCTAAGTCACG<br>TCACCATGAGATGCCAAGGGAGTACAATGAGGAT<br>GAAGACCCAGCTGCACGAAGGAGGAAAAAGAAAA<br>GTTATTATGCCAAGCTACGCCAACAAGAAATTGAG<br>AGAGAGAGAGAGCTAGCAGAGAAGTACCGGGATC<br>GTGCCAAGGAACGGAGAGATGGAGTGAACAAAGA<br>TTATGAAGAAACCGAGCTTATCAGCACCACAGCTA<br>ACTATAGGGCTGTTGGCCCCACTGCTGAGGCGGA<br>CAAATCAGCTGCAGAGAAGAGAAGACAGTTGATCC<br>AGGAGTCCAAATTCTTGGGTGGTGACATGGAACAC<br>ACCCATTTGGTGAAAGGCTTGGATTTGCTCTGCTT<br>CAAAAGGTACGAGCTGAGATTGCCAGCAAAGAGA<br>AAGAGGAAGAGGAACTGATGGAAAAGCCCCAGAA<br>AGAAACCAAGAAAGATGAGGATCCTGAAAATAAAA<br>TTGAATTTAAAACACGTCTGGGCCGCAATGTTTAC<br>CGAATGCTTTTTAAGAGCAAAGCATATGAGCGGAA<br>TGAGTTGTTCCTGCCGGGCCGCATGGCCTATGTG<br>GTAGACCTGGATGATGAGTATGCTGACACAGATAT<br>CCCCACCACTCTTATCCGCAGCAAGGCTGATTGCC<br>CCACCATGGAGGCCCAGACCACACTGACCACAAA<br>TGACATTGTCATTAGCAAGCTGACCCAGATCCTTT<br>CATACCTGAGGCAGGGAACCCGTAACAAGAAGCT<br>TAAGAAGAAGGATAAAGGGAAG | 20 | LLCFKRYE<br>LRLPAKRK<br>RKRN* |
| 1613 | NM_0060<br>88.5_163 | 163 | ATATAAGCGTTGGCGGAGCGTCGGTTGTAGCACT<br>CTGCGCGCCCGCTCTTCTGCTGCTGTTTGTCTACT<br>TCCTCCTGCTTCCCCGCCGCCGCCGCCGCCATCA<br>TGAGGGAAATCGTGCACTTGCAGGCCGGGCAGTG<br>CGGCAACCAAATCGGCGCCAAGTTTGGGAGGTGA<br>TCAGCGATGAGCACGGCATCGACCCCACGGGCAC<br>CTACCACGGGGACAGCGACCTGCAGCTGGAACGC<br>ATCAACGTGTACTACAATGAGGCCACCGGCGGCA<br>AGTACGTGCCCCGCGCCGTGCTCGTGGATCTGGA<br>GCCCGGCACCATGGACTCCGTGCGCTCGGGGCC<br>CTTCGGGCAGATCTTCCGGCCGGACAACTTCGTTT<br>TCGGTCAGAGTGGTGCTGGGAACAACTGGGCCAA<br>GGGGCACTACACAGAAGGCGCGGAGCTGGTGGA<br>CTCGGTGCTGGATGTTGTGAGAAAGGAGGCTGAG<br>AGCTGTGACTGCCTGCAGGGTTTCCAGCTGACCC<br>ACTCCCTGGGTGGGGGGACTGGGTCTGGGATGG<br>GTACCCTCCTCATCAGCAAGATCCGGGAGGAGTA<br>CCCAGACAGGATCATGAACACGTTAGTGTGGTGC<br>CTTCGCCCAAAGTGTCAGACACAGTGGTGGAGCC<br>CTACAACGCCACCCTCTCAGTCCACCAGCTCGTAG<br>AAAACACAGACGAGACCTACTGCATTGATAACGAA | 2 | GR* |

TABLE 3A-continued

| SEQ ID | identifier_position | position | modified_RNA | PAP length | PAP |
|---|---|---|---|---|---|
| | | | GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | | |
| 1614 | NM_006088.5_342 | 342 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CTTCGGGCAGATCTTCCGGCCGGACAACTTCGTTT TCGGTCAGAGTGGTGCTGGGAACAACTGGGCCAA GGGGCACTACACAGAAGGCGCGGAGCTGGTGGA CTCGGTGCTGGATGTGTGAGAAAGGAGGCTGAG AGCTGTGACTGCCTGCAGGGTTTCCAGCTGACCC ACTCCCTGGGTGGGGGGACTGGGTCTGGGATGG GTACCCTCCTCATCAGCAAGATCCGGGAGGAGTA CCCAGACAGGATCATGAACACGTTTAGTGTGGTGC CTTCGCCCAAAGTGTCAGACACAGTGGTGGAGCC CTACAACGCCACCCTCTCAGTCCACCAGCTCGTAG AAAACACAGACGAGACCTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | 39 | SGRSSGR TTSFSVRV VLGTTGPR GTTQKARS WWTRCW ML* |
| 1615 | NM_006088.5_459 | 459 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CCTTCGGGCAGATCTTCCGGCCGGACAACTTCGTT TTCGGTCAGAGTGGTGCTGGGAACAACTGGGCCA AGGGGCACTACACAGAAGGCGCGGAGCTGGTGG ACTCGGTGCTGGATGTGTGAGAAAGGAGGCTGAG AGCTGTGACTGCCTGCAGGGTTTCCAGCTGACCC ACTCCCTGGGTGGGGGGACTGGGTCTGGGATGG GTACCCTCCTCATCAGCAAGATCCGGGAGGAGTA CCCAGACAGGATCATGAACACGTTTAGTGTGGTGC CTTCGCCCAAAGTGTCAGACACAGTGGTGGAGCC CTACAACGCCACCCTCTCAGTCCACCAGCTCGTAG AAAACACAGACGAGACCTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | 0 | * |
| 1616 | NM_006088.5_621 | 621 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG | 18 | CQTQWWS PTTPPSQS TSS* |

TABLE 3A-continued

| SEQ ID | identifier_ position | position | modified_RNA | PAP length | PAP |
|---|---|---|---|---|---|
| | | | ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CCTTCGGGCAGATCTTCCGGCCGGACAACTTCGTT TTCGGTCAGAGTGGTGCTGGGAACAACTGGGCCA AGGGGCACTACACAGAAGGCGCGGAGCTGGTGG ACTCGGTGCTGGATGTTGTGAGAAAGGAGGCTGA GAGCTGTGACTGCCTGCAGGGTTTCCAGCTGACC CACTCCCTGGGTGGGGGGACTGGGTCTGGGATG GGTACCCTCCTCATCAGCAAGATCCGGGAGGAGT ACCCAGACAGGATCATGAACACGTTTAGTGTGGTG CCTTCGCCCAAAGTGTCAGACACAGTGGTGGAGCC CTACAACGCCACCCTCTCAGTCCACCAGCTCGTAG AAAACACAGACGAGACCTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | | |
| 1617 | NM_0060 88.5_654 | 654 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CCTTCGGGCAGATCTTCCGGCCGGACAACTTCGTT TTCGGTCAGAGTGGTGCTGGGAACAACTGGGCCA AGGGGCACTACACAGAAGGCGCGGAGCTGGTGG ACTCGGTGCTGGATGTTGTGAGAAAGGAGGCTGA GAGCTGTGACTGCCTGCAGGGTTTCCAGCTGACC CACTCCCTGGGTGGGGGGACTGGGTCTGGGATG GGTACCCTCCTCATCAGCAAGATCCGGGAGGAGT ACCCAGACAGGATCATGAACACGTTTAGTGTGGTG CCTTCGCCCAAAGTGTCAGACACAGTGGTGGAGCC CTACAAGCCACCCTCTCAGTCCACCAGCTCGTAG AAAACACAGACGAGACCTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | 9 | KPPSQSTS S* |
| 1618 | NM_0060 88.5_661 | 661 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CCTTCGGGCAGATCTTCCGGCCGGACAACTTCGTT TTCGGTCAGAGTGGTGCTGGGAACAACTGGGCCA AGGGGCACTACACAGAAGGCGCGGAGCTGGTGG ACTCGGTGCTGGATGTTGTGAGAAAGGAGGCTGA GAGCTGTGACTGCCTGCAGGGTTTCCAGCTGACC CACTCCCTGGGTGGGGGGACTGGGTCTGGGATG GGTACCCTCCTCATCAGCAAGATCCGGGAGGAGT ACCCAGACAGGATCATGAACACGTTTAGTGTGGTG CCTTCGCCCAAAGTGTCAGACACAGTGGTGGAGC CCTACAACGCCACCCTCTCAGTCCACCAGCTCGTAG | 6 | SQSTSS* |

TABLE 3A-continued

| SEQ ID | identifier_ position | position | modified_RNA | PAP length | PAP |
|---|---|---|---|---|---|
| | | | AAAACACAGACGAGACCTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | | |
| 1619 | NM_0060 88.5_699 | 699 | ATATAAGCGTTGGCGGAGCGTCGGTTGTAGCACT CTGCGCGCCCGCTCTTCTGCTGCTGTTTGTCTACT TCCTCCTGCTTCCCCGCCGCCGCCGCCGCCATCA TGAGGGAAATCGTGCACTTGCAGGCCGGGCAGTG CGGCAACCAAATCGGCGCCAAGTTTTGGGAGGTG ATCAGCGATGAGCACGGCATCGACCCCACGGGCA CCTACCACGGGGACAGCGACCTGCAGCTGGAACG CATCAACGTGTACTACAATGAGGCCACCGGCGGC AAGTACGTGCCCCGCGCCGTGCTCGTGGATCTGG AGCCCGGCACCATGGACTCCGTGCGCTCGGGGC CCTTCGGGCAGATCTTCCGGCCGGACAACTTCGTT TTCGGTCAGAGTGGTGCTGGGAACAACTGGGCCA AGGGGCACTACACAGAAGGCGCGGAGCTGGTGG ACTCGGTGCTGGATGTTGTGAGAAAGGAGGCTGA GAGCTGTGACTGCCTGCAGGGTTTCCAGCTGACC CACTCCCTGGGTGGGGGGACTGGGTCTGGGATG GGTACCCTCCTCATCAGCAAGATCCGGGAGGAGT ACCCAGACAGGATCATGAACACGTTTAGTGTGGTG CCTTCGCCCAAAGTGTCAGACACAGTGGTGGAGC CCTACAACGCCACCCTCTCAGTCCACCAGCTCGTA GAAAACACAGACGAGACTACTGCATTGATAACGAA GCTCTCTACGACATTTGCTTCAGAACCCTAAAGCT GACCACGCCCACCTATGGTGACCTGAACCACCTG GTGTCTGCTACCATGAGTGGGGTCACCACCTGCC TGCGCTTCCCAGGCCAGCTCAATGCTGACCTGCG GAAGCTGGCTGTGAACATGGTCCCGTTTCCCCGG CTGCACTTCTTCATGCCCGGCTTTGCCCCACTGAC CAGCCGGGGCAGCCAGCAGTACCGGGCGCTGAC CGTGCCCGAGCTCACCCAGCAGATGTTTGATGCC AAGAACATGATGGCTGCCTGCGACCCCCGCCATG G | 15 | TALITKLST TFASEP* |
| 1620 | NM_0060 98.4_154 | 154 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGTGGGTAACCCAGATCGCT ACTACCCCGCAGTTCCCGGACATGATCCTCTCCGC CTCTCGAGATAAGACCATCATCATGTGGAAACTGA CCAGGGATGAGACCAACTATGGAATTCCACAGCG TGCTCTGCGGGGTCACTCCCACTTTGTTAGTGATG TGGTTATCTCCTCAGATGGCCAGTTTGCCCTCTCA GGCTCCTGGGATGGAACCCTGCGCCTCTGGGATC TCACAACGGGCACCACCACGAGGCGATTTGTGGG CCATACCAAGGATGTGCTGAGTGTGGCCTTCTCCT CTGACAACCGGCAGATTGTCTCTGGATCTCGAGAT AAAACCATCAAGCTATGGAATACCCTGGGTGTGTG CAAATACACTGTCCAGGATGAGAGCCACTCAGAGT GGGTGTCTTGTGTCCGCTTCTCGCCCAACAGCAG CAACCCTATCATCGTCTCCTGTGGCTGGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | 1 | G* |
| 1621 | NM_0060 98.4_208 | 208 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC | 10 | LEIRPSSC GN* |

TABLE 3A-continued

| SEQ ID | identifier_ position | position | modified_RNA | PAP length | PAP |
|---|---|---|---|---|---|
| | | | TACTACCCCGCAGTTCCCGGACATGATCCTCTCCG CTCTCGAGATAAGACCATCATCATGTGGAAACTGA CCAGGGATGAGACCAACTATGGAATTCCACAGCG TGCTCTGCGGGGTCACTCCCACTTTGTTAGTGATG TGGTTATCTCCTCAGATGGCCAGTTTGCCCTCTCA GGCTCCTGGGATGGAACCCTGCGCCTCTGGGATC TCACAACGGGCACCACCACGAGGCGATTTGTGGG CCATACCAAGGATGTGCTGAGTGTGGCCTTCTCCT CTGACAACCGGCAGATTGTCTCTGGATCTCGAGAT AAAACCATCAAGCTATGGAATACCCTGGGTGTGTG CAAATACACTGTCCAGGATGAGAGCCACTCAGAGT GGGTGTCTTGTGTCCGCTTCTCGCCCAACAGCAG CAACCCTATCATCGTCTCCTGTGGCTGGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | | |
| 1622 | NM_0060 98.4_248 | 248 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGATGAGACCAACTATGGAATTCCACAGCGT GCTCTGCGGGGTCACTCCCACTTTGTTAGTGATGT GGTTATCTCCTCAGATGGCCAGTTTGCCCTCTCAG GCTCCTGGGATGGAACCCTGCGCCTCTGGGATCT CACAACGGGCACCACCACGAGGCGATTTGTGGGC CATACCAAGGATGTGCTGAGTGTGGCCTTCTCCTC TGACAACCGGCAGATTGTCTCTGGATCTCGAGATA AAACCATCAAGCTATGGAATACCCTGGGTGTGTGC AAATACACTGTCCAGGATGAGAGCCACTCAGAGTG GGTGTCTTGTGTCCGCTTCTCGCCCAACAGCAGCA ACCCTATCATCGTCCTGTGGCTGGGACAAGCTG GTCAAGGTATGGAACCTGGCTAACTGCAAGCTGAA GACCAACCACATTGGCCACACAGGCTATCTGAACA CGGTGACTGTCTCTCCAGATGGATCCCTCTGTGCT TCTGGAGGCAAGGATGGCCAGGCCATGTTATGGG ATCTCAACGAAGGCAAACACCTTTACACGCTAGAT GGTGGGGACATCATCAACGCCCTGTGCTTCAGCC CTAACCGCTACTGGCTGTGTGCTGCCACAGGCCC CAGCATCAAGATCTGGGATTTAGAGGGAAAGATCA TTGTAGATGAACTGAAGCAAGAAGTTATCAGTACC AGCAGCAAGGCAGAACCACCCCAGTGCACCTCCC TGGCCTGGTCTGCTGATGGCCAGACTCTGTTTGCT GGCTACACGGACAACCTGG | 61 | MRPTMEF HSVLCGVT PTLLVMWL SPQMASLP SQAPGME PCASGISQ RAPPRGDL WAIPRMC* |
| 1623 | NM_0060 98.4_301 | 301 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTGTTAGTGATG TGGTTATCTCCTCAGATGGCCAGTTTGCCCTCTCA GGCTCCTGGGATGGAACCCTGCGCCTCTGGGATC TCACAACGGGCACCACCACGAGGCGATTTGTGGG CCATACCAAGGATGTGCTGAGTGTGGCCTTCTCCT CTGACAACCGGCAGATTGTCTCTGGATCTCGAGAT AAAACCATCAAGCTATGGAATACCCTGGGTGTGTG CAAATACACTGTCCAGGATGAGAGCCACTCAGAGT GGGTGTCTTGTGTCCGCTTCTCGCCCAACAGCAG CAACCCTATCATCGTCTCCTGTGGCTGGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT | 44 | LLVMWLSP QMASLPS QAPGMEP CASGISQR APPRGDL WAIPRMC* |

TABLE 3A-continued

| SEQ ID | identifier_position | position | modified_RNA | PAP length | PAP |
|---|---|---|---|---|---|
| | | | GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | | |
| 1624 | NM_0060 98.4_337 | 337 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTGCCCTCTCA GGCTCCTGGGATGGAACCCTGCGCCTCTGGGATC TCACAACGGGCACCACCACGAGGCGATTTGTGGG CCATACCAAGGATGTGCTGAGTGTGGCCTTCTCCT CTGACAACCGGCAGATTGTCTCTGGATCTCGAGAT AAAACCATCAAGCTATGGAATACCCTGGGTGTGTG CAAATACACTGTCCAGGATGAGAGCCACTCAGAGT GGGTGTCTTGTGTCCGCTTCTCGCCCAACAGCAG CAACCCTATCATCGTCTCCTGTGGCTGGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | 32 | LPSQAPG MEPCASGI SQRAPPR GDLWAIPR MC* |
| 1625 | NM_0060 98.4_387 | 387 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAAGGGCACCACCACGAGGCGATTTGTGGG CCATACCAAGGATGTGCTGAGTGTGGCCTTCTCCT CTGACAACCGGCAGATTGTCTCTGGATCTCGAGAT AAAACCATCAAGCTATGGAATACCCTGGGTGTGTG CAAATACACTGTCCAGGATGAGAGCCACTCAGAGT GGGTGTCTTGTGTCCGCTTCTCGCCCAACAGCAG CAACCCTATCATCGTCTCCTGTGGCTGGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | 15 | RAPPRGDL WAIPRMC* |
| 1626 | NM_0060 98.4_397 | 397 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT | 11 | RGDLWAIP RMC* |

TABLE 3A-continued

| SEQ ID | identifier_position | position | modified_RNA | PAP length | PAP |
|---|---|---|---|---|---|
| | | | GTGGTTATCTCCTCAGATGGCCAGTTTGCCCTCTC<br>AGGCTCCTGGGATGGAACCCTGCGCCTCTGGGAT<br>CTCACAACGGGCACCACACGAGGCGATTGTGGG<br>CCATACCAAGGATGTGCTGAGTGTGGCCTTCTCCT<br>CTGACAACCGGCAGATTGTCTCTGGATCTCGAGAT<br>AAAACCATCAAGCTATGGAATACCCTGGGTGTGTG<br>CAAATACACTGTCCAGGATGAGAGCCACTCAGAGT<br>GGGTGTCTTGTGTCCGCTTCTCGCCCAACAGCAG<br>CAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | | |
| 1627 | NM_0060<br>98.4_409 | 409 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACACGAGGCGATTGTGGG<br>CCATACCAAGGATGTGCTGAGTGTGGCCTTCTCCT<br>CTGACAACCGGCAGATTGTCTCTGGATCTCGAGAT<br>AAAACCATCAAGCTATGGAATACCCTGGGTGTGTG<br>CAAATACACTGTCCAGGATGAGAGCCACTCAGAGT<br>GGGTGTCTTGTGTCCGCTTCTCGCCCAACAGCAG<br>CAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 8 | LWAIPRMC* |
| 1628 | NM_0060<br>98.4_442 | 442 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACACGAGGCGATTGTGGG<br>CCATACCAAGGATGTGCTGAGTGTGGCCTTCTCCT<br>CTGACAACCGGCAGATTGTCTCTGGATCTCGAGAT<br>AAAACCATCAAGCTATGGAATACCCTGGGTGTGTG<br>CAAATACACTGTCCAGGATGAGAGCCACTCAGAGT<br>GGGTGTCTTGTGTCCGCTTCTCGCCCAACAGCAG<br>CAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG | 71 | SPLTTGRL<br>SLDLEIKPS<br>SYGIPWVC<br>ANTLSRMR<br>ATQSGCLV<br>SASRPTAA<br>TLSSSPVA<br>GTSWSRY<br>GTWLTAS* |

TABLE 3A-continued

| SEQ ID | identifier_ position | position | modified_RNA | PAP length | PAP |
|---|---|---|---|---|---|
| | | | ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | | |
| 1629 | NM_0060<br>98.4_466 | 466 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATGTCTCTGGATCTCGAGAT<br>AAAACCATCAAGCTATGGAATACCCTGGGTGTGTG<br>CAAATACACTGTCCAGGATGAGAGCCACTCAGAGT<br>GGGTGTCTTGTGTCCGCTTCTCGCCCAACAGCAG<br>CAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 64 | MSLDLEIK<br>PSSYGIPW<br>VCANTLSR<br>MRATQSG<br>CLVSASRP<br>TAATLSSS<br>PVAGTSW<br>SRYGTWLT<br>AS* |
| 1630 | NM_0060<br>98.4_509 | 509 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGTG<br>CAAATACACTGTCCAGGATGAGAGCCACTCAGAGT<br>GGGTGTCTTGTGTCCGCTTCTCGCCCAACAGCAG<br>CAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 49 | WVCANTLS<br>RMRATQS<br>GCLVSASR<br>PTAATLSS<br>SPVAGTS<br>WSRYGTW<br>LTAS* |
| 1631 | NM_0060<br>98.4_571 | 571 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC | 28 | SRPTAATL<br>SSSPVAGT<br>SWSRYGT<br>WLTAS* |

TABLE 3A-continued

| SEQ ID | identifier_ position | position | modified_RNA | PAP length | PAP |
|---|---|---|---|---|---|
| | | | TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGTTCTCGCCCAACAGCA<br>GCAACCCTATCATCGTCTCCTGTGGCTGGGACAAG<br>CTGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | | |
| 1632 | NM_0060 98.4_589 | 589 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GAACCCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 23 | RTLSSSPV AGTSWSR YGTWLTAS* |
| 1633 | NM_0060 98.4_594 | 594 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCTATCATCGTCTCCTGTGGCTGGGACAAGC<br>TGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 21 | LSSSPVAG TSWSRYG TWLTAS* |

TABLE 3A-continued

| SEQ ID | identifier_position | position | modified_RNA | PAP length | PAP |
|---|---|---|---|---|---|
| 1634 | NM_0060 98.4_617 | 617 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGACAAGC TGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | 13 | TSWSRYG TWLTAS* |
| 1635 | NM_0060 98.4_630 | 630 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGGATGGCCAGGCCATGTTAT GGGATCTCAACGAAGGCAAACACCTTTACACGCTA GATGGTGGGGACATCATCAACGCCCTGTGCTTCA GCCCTAACCGCTACTGGCTGTGTGCTGCCACAGG CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCCTGGCCTGGTCTGCTGATGGCCAGACTCTGTT TGCTGGCTACACGGACAACCTGG | 9 | RYGTWLTA S* |
| 1636 | NM_0060 98.4_645 | 645 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA | 4 | VTAS* |

TABLE 3A-continued

| SEQ ID | identifier_position | position | modified_RNA | PAP length | PAP |
|---|---|---|---|---|---|
| | | | GCAACCCTATCATCGTCTCCTGTGGCTGGGACAAG<br>CTGGTCAAGGTATGGAACCTGGTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | | |
| 1637 | NM_0060<br>98.4_652 | 652 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCCTATCATCGTCTCCTGTGGCTGGGACAAG<br>CTGGTCAAGGTATGGAACCTGGCTAACTGAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG<br>CCCCAGCATCAAGATCTGGGATTTAGAGGGAAAG<br>ATCATTGTAGATGAACTGAAGCAAGAAGTTATCAG<br>TACCAGCAGCAAGGCAGAACCACCCCAGTGCACC<br>TCCCTGGCCTGGTCTGCTGATGGCCAGACTCTGTT<br>TGCTGGCTACACGGACAACCTGG | 0 | * |
| 1638 | NM_0060<br>98.4_664 | 664 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCCTATCATCGTCTCCTGTGGCTGGGACAAG<br>CTGGTCAAGGTATGGAACCTGGCTAACTGCAAGCT<br>GAAGACAACCACATTGGCCACACAGGCTATCTGAA<br>CACGGTGACTGTCTCTCCAGATGGATCCCTCTGTG<br>CTTCTGGAGGCAAGGATGGCCAGGCCATGTTATG<br>GGATCTCAACGAAGGCAAACACCTTTACACGCTAG<br>ATGGTGGGGACATCATCAACGCCCTGTGCTTCAG<br>CCCTAACCGCTACTGGCTGTGTGCTGCCACAGGC<br>CCCAGCATCAAGATCTGGGATTTAGAGGGAAAGAT<br>CATTGTAGATGAACTGAAGCAAGAAGTTATCAGTA<br>CCAGCAGCAAGGCAGAACCACCCCAGTGCACCTC<br>CCTGGCCTGGTCTGCTGATGGCCAGACTCTGTTTG<br>CTGGCTACACGGACAACCTGG | 8 | TTLATQAI* |
| 1639 | NM_0060<br>98.4_668 | 668 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC | 7 | TLATQAI* |

TABLE 3A-continued

| SEQ ID | identifier_position | position | modified_RNA | PAP length | PAP |
|---|---|---|---|---|---|
| | | | TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAAGGTATGGAACCTGGCTAACTGCAAGCT GAAGACCAACCACATTGGCCACACAGGCTATCTGAA CACGGTGACTGTCTCTCCAGATGGATCCCTCTGTG CTTCTGGAGGCAAGGATGGCCAGGCCATGTTATG GGATCTCAACGAAGGCAAACACCTTTACACGCTAG ATGGTGGGGACATCATCAACGCCCTGTGCTTCAG CCCTAACCGCTACTGGCTGTGTGCTGCCACAGGC CCCAGCATCAAGATCTGGGATTTAGAGGGAAAGAT CATTGTAGATGAACTGAAGCAAGAAGTTATCAGTA CCAGCAGCAAGGCAGAACCACCCCAGTGCACCTC CCTGGCCTGGTCTGCTGATGGCCAGACTCTGTTTG CTGGCTACACGGACAACCTGG | | |
| 1640 | NM_006098.4_677 | 677 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAAGGTATGGAACCTGGCTAACTGCAAGCT GAAGACCAACCACATTGGCCACACAGGCTATCTGAA CACGGTGACTGTCTCTCCAGATGGATCCCTCTGTG CTTCTGGAGGCAAGGATGGCCAGGCCATGTTATG GGATCTCAACGAAGGCAAACACCTTTACACGCTAG ATGGTGGGGACATCATCAACGCCCTGTGCTTCAG CCCTAACCGCTACTGGCTGTGTGCTGCCACAGGC CCCAGCATCAAGATCTGGGATTTAGAGGGAAAGAT CATTGTAGATGAACTGAAGCAAGAAGTTATCAGTA CCAGCAGCAAGGCAGAACCACCCCAGTGCACCTC CCTGGCCTGGTCTGCTGATGGCCAGACTCTGTTTG CTGGCTACACGGACAACCTGG | 4 | TQAI* |
| 1641 | NM_006098.4_722 | 722 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAAGGTATGGAACCTGGCTAACTGCAAGCT GAAGACCAACCACATTGGCCACACAGGCTATCTGA ACACGGTGACTGTCTCTCCAGATGGATCCCTCTGTG | 24 | SVLLEARM ARPCYGIS TKANTFTR* |

TABLE 3A-continued

| SEQ ID | identifier_ position | position | modified_RNA | PAP length | PAP |
|---|---|---|---|---|---|
| | | | CTTCTGGAGGCAAGGATGGCCAGGCCATGTTATG GGATCTCAACGAAGGCAAACACCTTTACACGCTAG ATGGTGGGGACATCATCAACGCCCTGTGCTTCAG CCCTAACCGCTACTGGCTGTGTGCTGCCACAGGC CCCAGCATCAAGATCTGGGATTTAGAGGGAAAGAT CATTGTAGATGAACTGAAGCAAGAAGTTATCAGTA CCAGCAGCAAGGCAGAACCACCCCAGTGCACCTC CCTGGCCTGGTCTGCTGATGGCCAGACTCTGTTTG CTGGCTACACGGACAACCTGG | | |
| 1642 | NM_0060 98.4_741 | 741 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAGGATGGCCAGGCCATGTTATG GGATCTCAACGAAGGCAAACACCTTTACACGCTAG ATGGTGGGGACATCATCAACGCCCTGTGCTTCAG CCCTAACCGCTACTGGCTGTGTGCTGCCACAGGC CCCAGCATCAAGATCTGGGATTTAGAGGGAAAGAT CATTGTAGATGAACTGAAGCAAGAAGTTATCAGTA CCAGCAGCAAGGCAGAACCACCCCAGTGCACCTC CCTGGCCTGGTCTGCTGATGGCCAGACTCTGTTTG CTGGCTACACGGACAACCTGG | 18 | RMARPCY GISTKANT FTR* |
| 1643 | NM_0060 98.4_743 | 743 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC GTGCTCTGCGGGGTCACTCCCACTTTGTTAGTGAT GTGGTTATCTCCTCAGATGGCCAGTTTGCCCTCTC AGGCTCCTGGGATGGAACCCTGCGCCTCTGGGAT CTCACAACGGGCACCACCACGAGGCGATTTGTGG GCCATACCAAGGATGTGCTGAGTGTGGCCTTCTCC TCTGACAACCGGCAGATTGTCTCTGGATCTCGAGA TAAAACCATCAAGCTATGGAATACCCTGGGTGTGT GCAAATACACTGTCCAGGATGAGAGCCACTCAGA GTGGGTGTCTTGTGTCCGCTTCTCGCCCAACAGCA GCAACCCTATCATCGTCTCCTGTGGCTGGGACAAG CTGGTCAAGGTATGGAACCTGGCTAACTGCAAGCT GAAGACCAACCACATTGGCCACACAGGCTATCTGA ACACGGTGACTGTCTCTCCAGATGGATCCCTCTGT GCTTCTGGAGGCAAGATGGCCAGGCCATGTTATG GGATCTCAACGAAGGCAAACACCTTTACACGCTAG ATGGTGGGGACATCATCAACGCCCTGTGCTTCAG CCCTAACCGCTACTGGCTGTGTGCTGCCACAGGC CCCAGCATCAAGATCTGGGATTTAGAGGGAAAGAT CATTGTAGATGAACTGAAGCAAGAAGTTATCAGTA CCAGCAGCAAGGCAGAACCACCCCAGTGCACCTC CCTGGCCTGGTCTGCTGATGGCCAGACTCTGTTTG CTGGCTACACGGACAACCTGG | 17 | MARPCYGI STKANTFT R* |
| 1644 | NM_0060 98.4_749 | 749 | CTCTCTTTCACTGCAAGGCGGCGGCAGGAGAGGT TGTGGTGCTAGTTTCTCTAAGCCATCCAGTGCCAT CCTCGTCGCTGCAGCGACACACGCTCTCGCCGCC GCCATGACTGAGCAGATGACCCTTCGTGGCACCC TCAAGGGCCACAACGGCTGGGTAACCCAGATCGC TACTACCCCGCAGTTCCCGGACATGATCCTCTCCG CCTCTCGAGATAAGACCATCATCATGTGGAAACTG ACCAGGGATGAGACCAACTATGGAATTCCACAGC | 15 | RPCYGIST KANTFTR* |

TABLE 3A-continued

| SEQ ID | identifier_position | position | modified_RNA | PAP length | PAP |
|---|---|---|---|---|---|
| | | | GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCCTATCATCGTCTCCTGTGGCTGGGACAAG<br>CTGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCAGGCCATGTTATG<br>GGATCTCAACGAAGGCAAACACCTTTACACGCTAG<br>ATGGTGGGGACATCATCAACGCCCTGTGCTTCAG<br>CCCTAACCGCTACTGGCTGTGTGCTGCCACAGGC<br>CCCAGCATCAAGATCTGGGATTTAGAGGGAAAGAT<br>CATTGTAGATGAACTGAAGCAAGAAGTTATCAGTA<br>CCAGCAGCAAGGCAGAACCACCCCAGTGCACCTC<br>CCTGGCCTGGTCTGCTGATGGCCAGACTCTGTTTG<br>CTGGCTACACGGACAACCTGG | | |
| 1645 | NM_0060<br>98.4_754 | 754 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCCTATCATCGTCTCCTGTGGCTGGGACAAG<br>CTGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCAGGCCATGTTATG<br>GGATCTCAACGAAGGCAAACACCTTTACACGCTAG<br>ATGGTGGGGACATCATCAACGCCCTGTGCTTCAG<br>CCCTAACCGCTACTGGCTGTGTGCTGCCACAGGC<br>CCCAGCATCAAGATCTGGGATTTAGAGGGAAAGAT<br>CATTGTAGATGAACTGAAGCAAGAAGTTATCAGTA<br>CCAGCAGCAAGGCAGAACCACCCCAGTGCACCTC<br>CCTGGCCTGGTCTGCTGATGGCCAGACTCTGTTTG<br>CTGGCTACACGGACAACCTGG | 13 | CYGISTKA<br>NTFTR* |
| 1646 | NM_0060<br>98.4_971 | 971 | CTCTCTTTCACTGCAAGGCGGCGGCAGGAGAGGT<br>TGTGGTGCTAGTTTCTCTAAGCCATCCAGTGCCAT<br>CCTCGTCGCTGCAGCGACACACGCTCTCGCCGCC<br>GCCATGACTGAGCAGATGACCCTTCGTGGCACCC<br>TCAAGGGCCACAACGGCTGGGTAACCCAGATCGC<br>TACTACCCCGCAGTTCCCGGACATGATCCTCTCCG<br>CCTCTCGAGATAAGACCATCATCATGTGGAAACTG<br>ACCAGGGATGAGACCAACTATGGAATTCCACAGC<br>GTGCTCTGCGGGGTCACTCCCACTTTGTTAGTGAT<br>GTGGTTATCTCCTCAGATGGCCAGTTTGCCCTCTC<br>AGGCTCCTGGGATGGAACCCTGCGCCTCTGGGAT<br>CTCACAACGGGCACCACCACGAGGCGATTTGTGG<br>GCCATACCAAGGATGTGCTGAGTGTGGCCTTCTCC<br>TCTGACAACCGGCAGATTGTCTCTGGATCTCGAGA<br>TAAAACCATCAAGCTATGGAATACCCTGGGTGTGT<br>GCAAATACACTGTCCAGGATGAGAGCCACTCAGA<br>GTGGGTGTCTTGTGTCCGCTTCTCGCCCAACAGCA<br>GCAACCCTATCATCGTCTCCTGTGGCTGGGACAAG<br>CTGGTCAAGGTATGGAACCTGGCTAACTGCAAGCT<br>GAAGACCAACCACATTGGCCACACAGGCTATCTGA<br>ACACGGTGACTGTCTCTCCAGATGGATCCCTCTGT<br>GCTTCTGGAGGCAAGGATGGCCAGGCATGTTAT<br>GGGATCTCAACGAAGGCAAACACCTTTACACGCTA<br>GATGGTGGGGACATCATCAACGCCCTGTGCTTCA<br>GCCCTAACCGCTACTGGCTGTGTGCTGCCACAGG | 23 | WPGLLMA<br>RLCLLATR<br>TTWCECG<br>R* |

TABLE 3A-continued

| SEQ ID | identifier_position | position | modified_RNA | PAP length | PAP |
|---|---|---|---|---|---|
| | | | CCCCAGCATCAAGATCTGGGATTTAGAGGGAAAG ATCATTGTAGATGAACTGAAGCAAGAAGTTATCAG TACCAGCAGCAAGGCAGAACCACCCCAGTGCACC TCCTGGCCTGGTCTGCTGATGGCCAGACTCTGTTT GCTGGCTACACGGACAACCTGG | | |
| 1647 | NM_0061 35.2_474 | 474 | AGCAGCTCTTAAAGCTTTGGATTCGGCTGTCGTGG AGATAACGGGCACCAGAAAAACTTGTAGGAGTAG CAACAGCTATTTGGTCGGATGGAGGCCAGAAGCC AAGAATAATCGAAACACGCTGCCAGCGCCCATTAG ATGGATGGGAAATGAGTGTAACTCATTGGGAAAGA TATTAGACTTCAAATCACCTAAGGCAAACCCTACTT CCTGGGGCGCGGGCGCGGGCGCTGGCGTTAGGA GACGTCACTCCCGCGCATAACTGACATGGGGCCC TCTTGGTCGGCGTTTCCGGGCGGGTCCTTCCGAC GGCCGCCGCGGTGATTCCATCACTCGGCTTTCTTC CCGGCCTGCCTCGCGCCCGTAGCCGGGCTGGGC CAGAACAGCCCAAGATGGCCGACTTCGATGATCG TGTGTCGGATGAGGAAGGTACGCATAGCTGCT AAATTCATCACTCATGCACCCCAGGGAATTTAAT GAAGTATTCAATGACGTTCGGCTACTACTTAATAAT GACAATCTCCTCAGGGAAGGGGCAGCACATGCAT TTGCCCAGTATAACATGGATCAGTTCACGCCTGTG AAGATAGAAGGATATGAAGATCAGGTCTTAATTAC AGAGCACGGTGACCTGGGTAATAGCAGATTTTTAG ATCCAAGAAACAAAATTTCCTTTAAATTTGACCACT TACGGAAAGAAGCAAGTGACCCCCAGCCAGAAGA AGCAGATGGAGGTCTGAAGTCTTGGAGAGAATCC TGTGACAGTGCTTTAAGAGCCTATGTGAAAGACCA TTATTCCAACGGCTTCTGTACTGTTTATGCTAAAAC TATCGATGGGCAACAGACTATTATTGCATGTATTG AAAGCCACCAGTTTCAGCCTAAAAAACTTCTGGAAT GGTCGTTGGAGATCAGAGTGGAAGTTCACCATCA CACCACCTACAGCCCAGGTGGTTGGCGTGCTTAA GATTCAGGTTCACTATTATGAAGATGGCAATGTTC AGTTGGTTAGTCATAAAGAT | 37 | NLMKYSMT FGYYLIMTI SSGKGQH MHLPSITWI SSRL* |
| 1648 | NM_0061 36.2_327 | 327 | CCCCTCCCTTAGCGGGGGCGCGCGGCGCTGAGG ACCGCACGGAAACGGGGAAGTCAGGTGGCCGCT GCCGCCGCCGCCGCCGCGGTTTGTCGCCAGAAG GAAGATGGCGGATCTGGAGGAGCAGTTGTCTGAT GAAGAGAAGGTGCGTATAGCAGCAAAATTCATCAT TCATGCCCCTCCTGGAGAATTTAATGAGGTTTTCA ATGATGTTCGGTTACTGCTTAATAATGACAATCTTC TCAGGGAAGGAGCAGCCCATGCATTTGCACAGTA TAACTTGGACCAGTTTACTCCAGTAAAAATTGAAG GTTATGAAGATCAGGTATGATAACAGAACATGGCG ACTTGGGAAATGGAAAGTTTTTGGATCCAAAGAAC AGAATCTGTTTTAAATTTGATCACTTAAGGAAGGAG GCAACTGATCCAAGACCCTGTGAAGTAGAAAATGC AGTTGAATCATGGAGAACTTCAGTAGAAACTGCTC TGAGAGCTTACGTAAAAGAACATTACCCGAATGGA GTCTGCACTGTGTATGGCAAAAAAATAGATGGACA GCAAACCATTATTGCATGCATAGAAAGCCATCAGT TCCAAGCAAAAAATTTTTGGAATGGTCGTTGGAGG TCAGAATGGAAGTTTACAATCACTCCTTCAACCACT CAAGTGGTTGGCATCTTGAAAATTCAGGTTCATTAT TATGAAGATGGTAATGTTCAGCTAGTGAGTCATAA AGATATACAAGATTCCCTAACAGTGTCTAATGAAGT GCAAACAGCAAAAGAATTTATAAAGATTGTAGAAG CTGCAGAAAATGAATACCAGACTGCCATCAGTGAG AATTATCAGACAATGTCGGACACTACTTTCAAAGC CTTACGTCGACAGTTGCCAGTTACACGCACTAAGA TTGATTGGAACAAGATCCTTAGCTACAAGATTGGC AAAGAGATGCAGAATGCATAAGATGAACATTGCAT GACCGGATCATTTTAGTGTCTTTGCGTTAAAAAATC ATTGCAAAAGT | 0 | * |
| 1649 | NM_0061 36.2_366 | 366 | CCCCTCCCTTAGCGGGGGCGCGCGGCGCTGAGG ACCGCACGGAAACGGGGAAGTCAGGTGGCCGCT GCCGCCGCCGCCGCCGCGGTTTGTCGCCAGAAG GAAGATGGCGGATCTGGAGGAGCAGTTGTCTGAT GAAGAGAAGGTGCGTATAGCAGCAAAATTCATCAT TCATGCCCCTCCTGGAGAATTTAATGAGGTTTTCA ATGATGTTCGGTTACTGCTTAATAATGACAATCTTC TCAGGGAAGGAGCAGCCCATGCATTTGCACAGTA TAACTTGGACCAGTTTACTCCAGTAAAAATTGAAG GTTATGAAGATCAGGTATTGATAACAGAACATGGC GACTTGGGAAATGGAAAGTTTTTGGATCCAAAGAAC AGAATCTGTTTTAAATTTGATCACTTAAGGAAGGAG | 13 | WIQRTESV LNLIT* |

TABLE 3A-continued

| SEQ ID | identifier_ position | position | modified_RNA | PAP length | PAP |
|---|---|---|---|---|---|
| | | | GCAACTGATCCAAGACCCTGTGAAGTAGAAAATGC AGTTGAATCATGGAGAACTTCAGTAGAAACTGCTC TGAGAGCTTACGTAAAAGAACATTACCCGAATGGA GTCTGCACTGTGTATGGCAAAAAAATAGATGGACA GCAAACCATTATTGCATGCATAGAAAGCCATCAGT TCCAAGCAAAAAATTTTTGGAATGGTCGTTGGAGG TCAGAATGGAAGTTTACAATCACTCCTTCAACCACT CAAGTGGTTGGCATCTTGAAAATTCAGGTTCATTAT TATGAAGATGGTAATGTTCAGCTAGTGAGTCATAA AGATATACAAGATTCCCTAACAGTGTCTAATGAAGT GCAAACAGCAAAAGAATTTATAAAGATTGTAGAAG CTGCAGAAAATGAATACCAGACTGCCATCAGTGAG AATTATCAGACAATGTCGGACACTACTTTCAAAGC CTTACGTCGACAGTTGCCAGTTACACGCACTAAGA TTGATTGGAACAAGATCCTTAGCTACAAGATTGGC AAAGAGATGCAGAATGCATAAGATGAACATTGCAT GACCGGATCATTTTAGTGTCTTTGCGTTAAAAAATC ATTGCAAAAGT | | |
| 1650 | NM_0061 36.2_608 | 608 | CCCCTCCCTTAGCGGGGGCGCGCGGCGCTGAGG ACCGCACGGAAACGGGGAAGTCAGGTGGCCGCT GCCGCCGCCGCCGCCGCGGTTTGTCGCCAGAAG GAAGATGGCGGATCTGGAGGAGCAGTTGTCTGAT GAAGAGAAGGTGCGTATAGCAGCAAAATTCATCAT TCATGCCCCTCCTGGAGAATTTAATGAGGTTTTCA ATGATGTTCGGTTACTGCTTAATAATGACAATCTTC TCAGGGAAGGAGCAGCCCATGCATTTGCACAGTA TAACTTGGACCAGTTTACTCCAGTAAAAATTGAAG GTTATGAAGATCAGGTATTGATAACAGAACATGGC GACTTGGGAAATGGAAAGTTTTTGGATCCAAAGAA CAGAATCTGTTTTAAATTTGATCACTTAAGGAAGGA GGCAACTGATCCAAGACCCTGTGAAGTAGAAAATG CAGTTGAATCATGGAGAACTTCAGTAGAAACTGCT CTGAGAGCTTACGTAAAAGAACATTACCCGAATGG AGTCTGCACTGTGTATGGCAAAAAAATAGATGGAC AGCAAACCATTATTGCATGCATAGAAAGCCATCAG TTCCAAGCAAAAAATTTTGGAATGGTCGTTGGAGG TCAGAATGGAAGTTTACAATCACTCCTTCAACCACT CAAGTGGTTGGCATCTTGAAAATTCAGGTTCATTAT TATGAAGATGGTAATGTTCAGCTAGTGAGTCATAA AGATATACAAGATTCCCTAACAGTGTCTAATGAAGT GCAAACAGCAAAAGAATTTATAAAGATTGTAGAAG CTGCAGAAAATGAATACCAGACTGCCATCAGTGAG AATTATCAGACAATGTCGGACACTACTTTCAAAGC CTTACGTCGACAGTTGCCAGTTACACGCACTAAGA TTGATTGGAACAAGATCCTTAGCTACAAGATTGGC AAAGAGATGCAGAATGCATAAGATGAACATTGCAT GACCGGATCATTTTAGTGTCTTTGCGTTAAAAAATC ATTGCAAAAGT | 23 | GMVVGGQ NGSLQSLL QPLKVVLAS* |
| 1651 | NM_0061 91.2_794 | 794 | GTTTTTCCGGGAGAGACCACGCTTCCCCTCAAGCT CCCCAACGGCTCCGCCTTCCCGCCGGAGCCTGAC CCTTCCCAGAGTGCCCGGCGATTCCGGCGTGCGA GGCCCTTGGAGGGCAAGGCCCCAGGGCCTGGCT TAGGAGCGCGAGAGGCAGGCTGGGAATTGTAGTT CGAAGGCCCTCGAGAGCGGCTAGAGTCTGGCGG CCGAGAGGACTAGTTGTCCCAGCGTGCCCTGCGC CTCAGCCCGCGCGCTCGCAGCTTCTCGCTCTCGC CTGCCTGCCCGCTCCCTTGCTTGCTCGCGCTTTCG CTCGCCCTCTCCTCGAGGATCGAGGGGACTCTGA CCACAGCCTGTGGCTGGGAAGGGAGACAGAGGC GGCGGCGGCTCAGGGGAAACGAGGCTGCAGTGG TGGTAGTAGGAAGATGTCGGGCGAGGACGAGCAA CAGGAGCAAACTATCGCTGAGGACCTGGTCGTGA CCAAGTATAAGATGGGGGGCGACATCGCCAACAG GGTACTTCGGTCCTTGGTGGAAGCATCTAGCTCAG GTGTGTCGGTACTGAGCCTGTGTGAGAAAGGTGA TGCCATGATTATGGAAGAAACAGGGAAAATCTTCA AGAAAGAAAGGAAATGAAGAAAGGTATTGCTTTT CCCACCAGCATTTCGGTAAATAACTGTGTATGTCA CTTCTCCCCTTTGAAGAGCGACCAGGATTATATTC TCAAGGAAGGTGACTTGGTAAAAATTGACCTTGGG GTCCATGTGGATGGCTTCATCGCTAATGTAGCTCA CACTTTGTGGTTGATGTAGCTCAGGGGACCCAAGT AACAGGGAGGAAAGCAGATGTTATTAAGGCAGCT CACCTTTGTGCTGAAGCTGCCCTACGCCTGGTCAA ACCTGGAAATCAGAACACACAAGTGACAGAAGCCT GGAACAAAGTTGCCCACTCATTTAACTGCACGCCA | 4 | LWLM* |

TABLE 3A-continued

| SEQ ID | identifier_position | position | modified_RNA | PAP length | PAP |
|---|---|---|---|---|---|
| 1652 | NM_0063 25.2_158 | 158 | ATAGAAGGTATGCTGTCACACCAGTTGAAGCAGCA TGTCATCGATGGAGAAAAAACCATTATC CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATGGTTGGTGATGGT GGTACTGGAAAAACGACCTTCGTGAAACGTCATTT GACTGGTGAATTTGAGAAGAAGTATGTAGCCACCT TGGGTGTTGAGGTTCATCCCCTAGTGTTCCACACC AACAGAGGACCTATTAAGTTCAATGTATGGGACAC AGCCGGCCAGGAGAAATTCGGTGGACTGAGAGAT GGCTATTATATCCAAGCCCAGTGTGCCATCATAAT GTTTGATGTAACATCGAGAGTTACTTACAAGAATGT GCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATTGGAG ACCCTAACTTGGAATTTGTTGCCATGCCTGCTCTC GCCCCACCAGAAGTTGTCATGGACCCAGCTTTGG CAGCACAGTATGAGCACGACTTAGAGGTTGCTCA GACAACTGCTCTCCCGGATGAGGATGATGACCTG TGAGAATGAAGCTGGAGCCCAGCGTCAGAAGTCT AGTTTTATAGGCAGCTGTCCTGTGATGTCAGCGGT GCAGCGTGTGTGCCACCTCATTATTATCTAGCTAA GCGGAACATGTGCTTTATCTGTGGGATGCTGAAGG AGATGAGTGGGCTTCGGAGTGAATGTGGCAGTTT AAAAAAATAACTTCATTGTTTGGACCTGCATATTTAG CTGTTTGGACGCAGTTGATTCCTTGAGTTTCATATA TAAGACTGCTGCAGTCAC | 12 | WLVMVVLE KRPS* |
| 1653 | NM_0063 25.2_249 | 249 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTGAGGTTCATCCCCTAGTGTTCCACACC AACAGAGGACCTATTAAGTTCAATGTATGGGACAC AGCCGGCCAGGAGAAATTCGGTGGACTGAGAGAT GGCTATTATATCCAAGCCCAGTGTGCCATCATAAT GTTTGATGTAACATCGAGAGTTACTTACAAGAATGT GCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATTGGAG ACCCTAACTTGGAATTTGTTGCCATGCCTGCTCTC GCCCCACCAGAAGTTGTCATGGACCCAGCTTTGG CAGCACAGTATGAGCACGACTTAGAGGTTGCTCA GACAACTGCTCTCCCGGATGAGGATGATGACCTG TGAGAATGAAGCTGGAGCCCAGCGTCAGAAGTCT AGTTTTATAGGCAGCTGTCCTGTGATGTCAGCGGT GCAGCGTGTGTGCCACCTCATTATTATCTAGCTAA GCGGAACATGTGCTTTATCTGTGGGATGCTGAAGG AGATGAGTGGGCTTCGGAGTGAATGTGGCAGTTT AAAAAAATAACTTCATTGTTTGGACCTGCATATTTAG CTGTTTGGACGCAGTTGATTCCTTGAGTTTCATATA TAAGACTGCTGCAGTCAC | 4 | RFIP* |
| 1654 | NM_0063 25.2_319 | 319 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCAGGAGAAATTCGGTGGACTGAGAGAT GGCTATTATATCCAAGCCCAGTGTGCCATCATAAT GTTTGATGTAACATCGAGAGTTACTTACAAGAATGT GCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC | 6 | RRNSVD* |

TABLE 3A-continued

| SEQ ID | identifier_position | position | modified_RNA | PAP length | PAP |
|---|---|---|---|---|---|
| | | | ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATTGGAG ACCCTAACTTGGAATTTGTTGCCATGCCTGCTCTC GCCCCACCAGAAGTTGTCATGGACCCAGCTTTGG CAGCACAGTATGAGCACGACTTAGAGGTTGCTCA GACAACTGCTCTCCCGGATGAGGATGATGACCTG TGAGAATGAAGCTGGAGCCCAGCGTCAGAAGTCT AGTTTTATAGGCAGCTGTCCTGTGATGTCAGCGGT GCAGCGTGTGTGCCACCTCATTATTATCTAGCTAA GCGGAACATGTGCTTTATCTGTGGGATGCTGAAGG AGATGAGTGGGCTTCGGAGTGAATGTGGCAGTTT AAAAAATAACTTCATTGTTTGGACCTGCATATTTAG CTGTTTGGACGCAGTTGATTCCTTGAGTTTCATATA TAAGACTGCTGCAGTCAC | | |
| 1655 | NM_0063 25.2_384 | 384 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATGT GCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATTGGAG ACCCTAACTTGGAATTTGTTGCCATGCCTGCTCTC GCCCCACCAGAAGTTGTCATGGACCCAGCTTTGG CAGCACAGTATGAGCACGACTTAGAGGTTGCTCA GACAACTGCTCTCCCGGATGAGGATGATGACCTG TGAGAATGAAGCTGGAGCCCAGCGTCAGAAGTCT AGTTTTATAGGCAGCTGTCCTGTGATGTCAGCGGT GCAGCGTGTGTGCCACCTCATTATTATCTAGCTAA GCGGAACATGTGCTTTATCTGTGGGATGCTGAAGG AGATGAGTGGGCTTCGGAGTGAATGTGGCAGTTT AAAAAATAACTTCATTGTTTGGACCTGCATATTTAG CTGTTTGGACGCAGTTGATTCCTTGAGTTTCATATA TAAGACTGCTGCAGTCAC | 2 | LM* |
| 1656 | NM_0063 25.2_465 | 465 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATG TGCCTAACTGGCATAGAGATCTGGTACGAGTGTGT GAAAACATCCCCATGTGTTGTGTGGCAACAAAGTG GATATTAAGGACAGGAAAGTGAAGGCGAAATCCAT TGTCTTCCACCGAAAGAAGAATCTTCAGTACTACG ACATTTCTGCCAAAAGTAACTACAACTTTGAAAAGC CCTTCCTCTGGCTTGCTAGGAAGCTCATTGGAGAC CCTAACTTGGAATTTGTTGCCATGCCTGCTCTCGC CCCACCAGAAGTTGTCATGGACCCAGCTTTGGCA GCACAGTATGAGCACGACTTAGAGGTTGCTCAGA CAACTGCTCTCCCGGATGAGGATGATGACCTGTG AGAATGAAGCTGGAGCCCAGCGTCAGAAGTCTAG TTTTATAGGCAGCTGTCCTGTGATGTCAGCGGTGC AGCGTGTGTGCCACCTCATTATTATCTAGCTAAGC GGAACATGTGCTTTATCTGTGGGATGCTGAAGGAG ATGAGTGGGCTTCGGAGTGAATGTGGCAGTTTAAA AAATAACTTCATTGTTTGGACCTGCATATTTAGCTG TTTGGACGCAGTTGATTCCTTGAGTTTCATATATAA GACTGCTGCAGTCAC | 14 | MCCVATK WILRTGK* |

TABLE 3A-continued

| SEQ ID | identifier_position | position | modified_RNA | PAP length | PAP |
|---|---|---|---|---|---|
| 1657 | NM_006325.2_470 | 470 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATG TGCCTAACTGGCATAGAGATCTGGTACGAGTGTGT GAAAACATCCCCATTGTGTGTGTGGCAACAAAGTG GATATTAAGGACAGGAAAGTGAAGGCGAAATCCAT TGTCTTCCACCGAAAGAAGAATCTTCAGTACTACG ACATTTCTGCCAAAAGTAACTACAACTTTGAAAAGC CCTTCCTCTGGCTTGCTAGGAAGCTCATTGGAGAC CCTAACTTGGAATTTGTTGCCATGCCTGCTCTCGC CCCACCAGAAGTTGTCATGGACCCAGCTTTGGCA GCACAGTATGAGCACGACTTAGAGGTTGCTCAGA CAACTGCTCTCCCGGATGAGGATGATGACCTGTG AGAATGAAGCTGGAGCCCAGCGTCAGAAGTCTAG TTTTATAGGCAGCTGTCCTGTGATGTCAGCGGTGC AGCGTGTGTGCCACCTCATTATTATCTAGCTAAGC GGAACATGTGCTTTATCTGTGGGATGCTGAAGGAG ATGAGTGGGCTTCGGAGTGAATGTGGCAGTTTAAA AAATAACTTCATTGTTTGGACCTGCATATTTAGCTG TTTGGACGCAGTTGATTCCTTGAGTTTCATATATAA GACTGCTGCAGTCAC | 12 | CVATKWIL RTGK* |
| 1658 | NM_006325.2_621 | 621 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATG TGCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATGGAGA CCCTAACTTGGAATTTGTTGCCATGCCTGCTCTCG CCCCACCAGAAGTTGTCATGGACCCAGCTTTGGC AGCACAGTATGAGCACGACTTAGAGGTTGCTCAGA CAACTGCTCTCCCGGATGAGGATGATGACCTGTG AGAATGAAGCTGGAGCCCAGCGTCAGAAGTCTAG TTTTATAGGCAGCTGTCCTGTGATGTCAGCGGTGC AGCGTGTGTGCCACCTCATTATTATCTAGCTAAGC GGAACATGTGCTTTATCTGTGGGATGCTGAAGGAG ATGAGTGGGCTTCGGAGTGAATGTGGCAGTTTAAA AAATAACTTCATTGTTTGGACCTGCATATTTAGCTG TTTGGACGCAGTTGATTCCTTGAGTTTCATATATAA GACTGCTGCAGTCAC | 32 | METLTWNL LPCLLSPH QKLSWTQL WQHSMST T* |
| 1659 | NM_006325.2_642 | 642 | CGCCCCTGCTCTCGCGCCGGCGTCGGCTGCGTCT CCGGCGTTTGAATTGCGCTTCCGCCATCTTTCCAG CCTCAGTCGGACGGGCGCGGAGGCGCTTCTGGA AGGAACGCCGCGATGGCTGCGCAGGGAGAGCCC CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATG TGCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA | 25 | LLPCLLSP HQKLSWT QLWQHSM STT* |

TABLE 3A-continued

| SEQ ID | identifier_position | position | modified_RNA | PAP length | PAP |
|---|---|---|---|---|---|
| | | | GCCCTTCCTCTGGCTTGCTAGGAAGCTCATTGGAG<br>ACCCTAACTTGGAATTGTTGCCATGCCTGCTCTCG<br>CCCCACCAGAAGTTGTCATGGACCCAGCTTTGGC<br>AGCACAGTATGAGCACGACTTAGAGGTTGCTCAGA<br>CAACTGCTCTCCCGGATGAGGATGATGACCTGTG<br>AGAATGAAGCTGGAGCCCAGCGTCAGAAGTCTAG<br>TTTTATAGGCAGCTGTCCTGTGATGTCAGCGGTGC<br>AGCGTGTGTGCCACCTCATTATTATCTAGCTAAGC<br>GGAACATGTGCTTTATCTGTGGGATGCTGAAGGAG<br>ATGAGTGGGCTTCGGAGTGAATGTGGCAGTTTAAA<br>AAATAACTTCATTGTTTGGACCTGCATATTTAGCTG<br>TTTGGACGCAGTTGATTCCTTGAGTTTCATATATAA<br>GACTGCTGCAGTCAC | | |
| 1660 | NM_0063<br>25.2_656 | 656 | CGCCCCTGCTCTCGCGCCGGCGTCGGCTGCGTCT<br>CCGGCGTTTGAATTGCGCTTCCGCCATCTTTCCAG<br>CCTCAGTCGGACGGGCGCGGAGGCGCTTCTGGA<br>AGGAACGCCGCGATGGCTGCGCAGGGAGAGCCC<br>CAGGTCCAGTTCAAACTTGTATTGGTTGGTGATGG<br>TGGTACTGGAAAAACGACCTTCGTGAAACGTCATT<br>TGACTGGTGAATTTGAGAAGAAGTATGTAGCCACC<br>TTGGGTGTTGAGGTTCATCCCCTAGTGTTCCACAC<br>CAACAGAGGACCTATTAAGTTCAATGTATGGGACA<br>CAGCCGGCCAGGAGAAATTCGGTGGACTGAGAGA<br>TGGCTATTATATCCAAGCCCAGTGTGCCATCATAA<br>TGTTTGATGTAACATCGAGAGTTACTTACAAGAATG<br>TGCCTAACTGGCATAGAGATCTGGTACGAGTGTGT<br>GAAAACATCCCCATTGTGTTGTGTGGCAACAAAGT<br>GGATATTAAGGACAGGAAAGTGAAGGCGAAATCC<br>ATTGTCTTCCACCGAAAGAAGAATCTTCAGTACTA<br>CGACATTTCTGCCAAAAGTAACTACAACTTTGAAAA<br>GCCCTTCCTCTGGCTTGCTAGGAAGCTCATTGGAG<br>ACCCTAACTTGGAATTTGTTGCCATGCCTGTCTCG<br>CCCCACCAGAAGTTGTCATGGACCCAGCTTTGGC<br>AGCACAGTATGAGCACGACTTAGAGGTTGCTCAGA<br>CAACTGCTCTCCCGGATGAGGATGATGACCTGTG<br>AGAATGAAGCTGGAGCCCAGCGTCAGAAGTCTAG<br>TTTTATAGGCAGCTGTCCTGTGATGTCAGCGGTGC<br>AGCGTGTGTGCCACCTCATTATTATCTAGCTAAGC<br>GGAACATGTGCTTTATCTGTGGGATGCTGAAGGAG<br>ATGAGTGGGCTTCGGAGTGAATGTGGCAGTTTAAA<br>AAATAACTTCATTGTTTGGACCTGCATATTTAGCTG<br>TTTGGACGCAGTTGATTCCTTGAGTTTCATATATAA<br>GACTGCTGCAGTCAC | 20 | VSPHQKLS<br>WTQLWQH<br>SMSTT* |
| 1661 | NM_0063<br>25.2_692 | 692 | CGCCCCTGCTCTCGCGCCGGCGTCGGCTGCGTCT<br>CCGGCGTTTGAATTGCGCTTCCGCCATCTTTCCAG<br>CCTCAGTCGGACGGGCGCGGAGGCGCTTCTGGA<br>AGGAACGCCGCGATGGCTGCGCAGGGAGAGCCC<br>CAGGTCCAGTTCAAACTTGTATTGGTTGGTGATGG<br>TGGTACTGGAAAAACGACCTTCGTGAAACGTCATT<br>TGACTGGTGAATTTGAGAAGAAGTATGTAGCCACC<br>TTGGGTGTTGAGGTTCATCCCCTAGTGTTCCACAC<br>CAACAGAGGACCTATTAAGTTCAATGTATGGGACA<br>CAGCCGGCCAGGAGAAATTCGGTGGACTGAGAGA<br>TGGCTATTATATCCAAGCCCAGTGTGCCATCATAA<br>TGTTTGATGTAACATCGAGAGTTACTTACAAGAATG<br>TGCCTAACTGGCATAGAGATCTGGTACGAGTGTGT<br>GAAAACATCCCCATTGTGTTGTGTGGCAACAAAGT<br>GGATATTAAGGACAGGAAAGTGAAGGCGAAATCC<br>ATTGTCTTCCACCGAAAGAAGAATCTTCAGTACTA<br>CGACATTTCTGCCAAAAGTAACTACAACTTTGAAAA<br>GCCCTTCCTCTGGCTTGCTAGGAAGCTCATTGGAG<br>ACCCTAACTTGGAATTTGTTGCCATGCCTGCTCTC<br>GCCCCACCAGAAGTTGTCATGGACCCAGCTTTGGC<br>AGCACAGTATGAGCACGACTTAGAGGTTGCTCAGA<br>CAACTGCTCTCCCGGATGAGGATGATGACCTGTG<br>AGAATGAAGCTGGAGCCCAGCGTCAGAAGTCTAG<br>TTTTATAGGCAGCTGTCCTGTGATGTCAGCGGTGC<br>AGCGTGTGTGCCACCTCATTATTATCTAGCTAAGC<br>GGAACATGTGCTTTATCTGTGGGATGCTGAAGGAG<br>ATGAGTGGGCTTCGGAGTGAATGTGGCAGTTTAAA<br>AAATAACTTCATTGTTTGGACCTGCATATTTAGCTG<br>TTTGGACGCAGTTGATTCCTTGAGTTTCATATATAA<br>GACTGCTGCAGTCAC | 8 | WQHSMST<br>T* |
| 1662 | NM_0063<br>25.2_737 | 737 | CGCCCCTGCTCTCGCGCCGGCGTCGGCTGCGTCT<br>CCGGCGTTTGAATTGCGCTTCCGCCATCTTTCCAG<br>CCTCAGTCGGACGGGCGCGGAGGCGCTTCTGGA<br>AGGAACGCCGCGATGGCTGCGCAGGGAGAGCCC | 41 | VSRMRMM<br>TCENEAGA<br>QRQKSSFI<br>GSCPVMS |

TABLE 3A-continued

| SEQ ID | identifier_position | position | modified_RNA | PAP length | PAP |
|---|---|---|---|---|---|
| | | | CAGGTCCAGTTCAAACTTGTATTGGTTGGTGATGG TGGTACTGGAAAAACGACCTTCGTGAAACGTCATT TGACTGGTGAATTTGAGAAGAAGTATGTAGCCACC TTGGGTGTTGAGGTTCATCCCCTAGTGTTCCACAC CAACAGAGGACCTATTAAGTTCAATGTATGGGACA CAGCCGGCCAGGAGAAATTCGGTGGACTGAGAGA TGGCTATTATATCCAAGCCCAGTGTGCCATCATAA TGTTTGATGTAACATCGAGAGTTACTTACAAGAATG TGCCTAACTGGCATAGAGATCTGGTACGAGTGTGT GAAAACATCCCCATTGTGTTGTGTGGCAACAAAGT GGATATTAAGGACAGGAAAGTGAAGGCGAAATCC ATTGTCTTCCACCGAAAGAAGAATCTTCAGTACTA CGACATTTCTGCCAAAAGTAACTACAACTTTGAAAA GCCCTTCCTCTGGCTTGCTAGGAAGCTCATTGGAG ACCCTAACTTGGAATTTGTTGCCATGCCTGCTCTC GCCCCACCAGAAGTTGTCATGGACCCAGCTTTGG CAGCACAGTATGAGCACGACTTAGAGGTTGCTCA GACAACTGTCTCCCGGATGAGGATGATGACCTGT GAGAATGAAGCTGGAGCCCAGCGTCAGAAGTCTA GTTTTATAGGCAGCTGTCCTGTGATGTCAGCGGTG CAGCGTGTGTGCCACCTCATTATTATCTAGCTAAG CGGAACATGTGCTTTATCTGTGGGATGCTGAAGGA GATGAGTGGGCTTCGGAGTGAATGTGGCAGTTTA AAAAATAACTTCATTGTTTGGACCTGCATATTTAGC TGTTTGGACGCAGTTGATTCCTTGAGTTTCATATAT AAGACTGCTGCAGTCAC | | AVQRVCHL III* |
| 1663 | NM_0063 35.1_162 | 162 | AGTCAAGATGGAGGAGTACGCGCGAGAGCCTTGC CCATGGCGAATTGTGGATGACTGTGGTGGGGCCT TTACGATGGGTACCATTGGTGGTGGTATCTTTCAA GCAATCAAAGGTTTTCGCAATTCTCCAGTGGGAGT AAACCACAGACTACGAGGGAGTTGACAGCTATTAA AACCAGGGCTCCACAGTTAGGAGGTAGCTTTGCA GTTTGGGGAGGGCTGTTTTCCATGATTGACTGTAG TATGGTTCAAGTCAGAGGAAAGGAAGATCCCTGGA ACTCCATCACAAGTGGTGCCTTAACGGGAGCCATA CTGGCAGCAAGAAATGGACCAGTGGCCATGGTTG GGTCAGCCGCAATGGGTGGCATTCTCCTAGCTTTA ATTGAAGGAGCTGGTATCTTGTTGACAAGATTTGC CTCTGCACAGTTTCCCAATGGTCCTCAGTTTGCAG AAGACCCCTCCCAGTTGCCTTCAACTCAGTTACCT TCCTCACCTTTTGGAGACTATCGACAATATCAGTA GGACTTCTTTCCTAGGATTTCTTTAACAGAACGAGT TGTGGTTCGAGAAGGATTTCAGAAGATCAAGTTAC AGTCTGTTTTTAAAACCATAGGTGGGACAGCTATG GCCAATAGGCTATAAAGAGACATTTAGCACTTTTTT CTATTTAAAGGAACAAGCGGGGAAGGGTGCTAAAA GATAATACGTTTATTTATTCACACTTGAATTGCATTT GTGATCAAAATAAATGTTTAAATCGCTAAAGGAAAA TACAGTAAGTGCTTGAAAGATGAAGGACCAAAAGG CCAAAAAACAGTGAAATATGATCATCATCTCTTGC GGACTTCTCTGCCTGGTTTTGTGTGTTCTGTTATTC AAACAATAAAAAGCTGGTGGAACTTACTCTTTCTTT TAAGATAAGTTGTAGACTTCGATGTTTCATGCTCAT GTACTTCAAATAATGCATGTTTTATAGTTAGTCCCT CATCACTTGAAGTGACTTCTGAGAATTATGCAGAG TCAA | 0 | * |
| 1664 | NM_0063 35.1_182 | 182 | AGTCAAGATGGAGGAGTACGCGCGAGAGCCTTGC CCATGGCGAATTGTGGATGACTGTGGTGGGGCCT TTACGATGGGTACCATTGGTGGTGGTATCTTTCAA GCAATCAAAGGTTTTCGCAATTCTCCAGTGGGAGT AAACCACAGACTACGAGGGAGTTTGACAGCTATTA AAACCAGGGCTCCACAGTTAGGAGGTAGCTTTGCA GTTTGGGGAGGGCTGTTTTCCATGATTGACTGTAG TATGGTTCAAGTCAGAGGAAAGGAAGATCCCTGGA ACTCCATCACAAGTGGTGCCTTAACGGGAGCCATA CTGGCAGCAAGAAATGGACCAGTGGCCATGGTTG GGTCAGCCGCAATGGGTGGCATTCTCCTAGCTTTA ATTGAAGGAGCTGGTATCTTGTTGACAAGATTTGC CTCTGCACAGTTTCCCAATGGTCCTCAGTTTGCAG AAGACCCCTCCCAGTTGCCTTCAACTCAGTTACCT TCCTCACCTTTTGGAGACTATCGACAATATCAGTA GGACTTCTTTCCTAGGATTTCTTTAACAGAACGAGT TGTGGTTCGAGAAGGATTTCAGAAGATCAAGTTAC AGTCTGTTTTTAAAACCATAGGTGGGACAGCTATG GCCAATAGGCTATAAAGAGACATTTAGCACTTTTTT CTATTTAAAGGAACAAGCGGGGAAGGGTGCTAAAA GATAATACGTTTATTTATTCACACTTGAATTGCATTT | 3 | LHS* |

TABLE 3A-continued

| SEQ ID | identifier_position | position | modified_RNA | PAP length | PAP |
|---|---|---|---|---|---|
| | | | GTGATCAAAATAAATGTTTAAATCGCTAAAGGAAAA<br>TACAGTAAGTGCTTGAAAGATGAAGGACCAAAAGG<br>CCAAAAAACAGTGAAATATGATCATCATCTCTTGC<br>GGACTTCTCTGCCTGGTTTTGTGTGTTCTGTTATTC<br>AAACAATAAAAAGCTGGTGGAACTTACTCTTTCTTT<br>TAAGATAAGTTGTAGACTTCGATGTTTCATGCTCAT<br>GTACTTCAAATAATGCATGTTTTATAGTTAGTCCCT<br>CATCACTTGAAGTGACTTCTGAGAATTATGCAGAG<br>TCAA | | |
| 1665 | NM_0063<br>35.1_212 | 212 | AGTCAAGATGGAGGAGTACGCGCGAGAGCCTTGC<br>CCATGGCGAATTGTGGATGACTGTGGTGGGGCCT<br>TTACGATGGGTACCATTGGTGGTGGTATCTTTCAA<br>GCAATCAAAGGTTTTCGCAATTCTCCAGTGGGAGT<br>AAACCACAGACTACGAGGGAGTTTGACAGCTATTA<br>AAACCAGGGCTCCACAGTTAGGAGGTAGCTTTGC<br>AGTTGGGGAGGGCTGTTTTCCATGATTGACTGTAG<br>TATGGTTCAAGTCAGAGGAAAGGAAGATCCCTGGA<br>ACTCCATCACAAGTGGTGCCTTAACGGGAGCCATA<br>CTGGCAGCAAGAAATGGACCAGTGGCCATGGTTG<br>GGTCAGCCGCAATGGGTGGCATTCTCCTAGCTTTA<br>ATTGAAGGAGCTGGTATCTTGTTGACAAGATTTGC<br>CTCTGCACAGTTTCCCAATGGTCCTCAGTTTGCAG<br>AAGACCCCTCCCAGTTGCCTTCAACTCAGTTACCT<br>TCCTCACCTTTTGGAGACTATCGACAATATCAGTA<br>GGACTTCTTTCCTAGGATTTCTTTAACAGAACGAGT<br>TGTGGTTCGAGAAGGATTTCAGAAGATCAAGTTAC<br>AGTCTGTTTTTAAAACCATAGGTGGGACAGCTATG<br>GCCAATAGGCTATAAAGAGACATTTAGCACTTTTTT<br>CTATTTAAAGGAACAAGCGGGGAAGGGTGCTAAAA<br>GATAATACGTTTATTTATTCACACTTGAATTGCATTT<br>GTGATCAAAATAAATGTTTAAATCGCTAAAGGAAAA<br>TACAGTAAGTGCTTGAAAGATGAAGGACCAAAAGG<br>CCAAAAAACAGTGAAATATGATCATCATCTCTTGC<br>GGACTTCTCTGCCTGGTTTTGTGTGTTCTGTTATTC<br>AAACAATAAAAAGCTGGTGGAACTTACTCTTTCTTT<br>TAAGATAAGTTGTAGACTTCGATGTTTCATGCTCAT<br>GTACTTCAAATAATGCATGTTTTATAGTTAGTCCCT<br>CATCACTTGAAGTGACTTCTGAGAATTATGCAGAG<br>TCAA | 6 | GEGCFP* |
| 1666 | NM_0063<br>35.1_317 | 317 | AGTCAAGATGGAGGAGTACGCGCGAGAGCCTTGC<br>CCATGGCGAATTGTGGATGACTGTGGTGGGGCCT<br>TTACGATGGGTACCATTGGTGGTGGTATCTTTCAA<br>GCAATCAAAGGTTTTCGCAATTCTCCAGTGGGAGT<br>AAACCACAGACTACGAGGGAGTTTGACAGCTATTA<br>AAACCAGGGCTCCACAGTTAGGAGGTAGCTTTGC<br>AGTTTGGGGAGGGCTGTTTTCCATGATTGACTGTA<br>GTATGGTTCAAGTCAGAGGAAAGGAAGATCCCTG<br>GAACTCCATCACAAGTGGTGCCTTAACGGGAGCC<br>ATACTGCAGCAAGAAATGGACCAGTGGCCATGGTT<br>GGGTCAGCCGCAATGGGTGGCATTCTCCTAGCTTT<br>AATTGAAGGAGCTGGTATCTTGTTGACAAGATTTG<br>CCTCTGCACAGTTTCCCAATGGTCCTCAGTTTGCA<br>GAAGACCCCTCCCAGTTGCCTTCAACTCAGTTACC<br>TTCCTCACCTTTTGGAGACTATCGACAATATCAGTA<br>GGACTTCTTTCCTAGGATTTCTTTAACAGAACGAGT<br>TGTGGTTCGAGAAGGATTTCAGAAGATCAAGTTAC<br>AGTCTGTTTTTAAAACCATAGGTGGGACAGCTATG<br>GCCAATAGGCTATAAAGAGACATTTAGCACTTTTTT<br>CTATTTAAAGGAACAAGCGGGGAAGGGTGCTAAAA<br>GATAATACGTTTATTTATTCACACTTGAATTGCATTT<br>GTGATCAAAATAAATGTTTAAATCGCTAAAGGAAAA<br>TACAGTAAGTGCTTGAAAGATGAAGGACCAAAAGG<br>CCAAAAAACAGTGAAATATGATCATCATCTCTTGC<br>GGACTTCTCTGCCTGGTTTTGTGTGTTCTGTTATTC<br>AAACAATAAAAAGCTGGTGGAACTTACTCTTTCTTT<br>TAAGATAAGTTGTAGACTTCGATGTTTCATGCTCAT<br>GTACTTCAAATAATGCATGTTTTATAGTTAGTCCCT<br>CATCACTTGAAGTGACTTCTGAGAATTATGCAGAG<br>TCAA | 19 | QQEMDQW<br>PWLGQPQ<br>WVAFS* |
| 1667 | NM_0063<br>35.1_499 | 499 | AGTCAAGATGGAGGAGTACGCGCGAGAGCCTTGC<br>CCATGGCGAATTGTGGATGACTGTGGTGGGGCCT<br>TTACGATGGGTACCATTGGTGGTGGTATCTTTCAA<br>GCAATCAAAGGTTTTCGCAATTCTCCAGTGGGAGT<br>AAACCACAGACTACGAGGGAGTTTGACAGCTATTA<br>AAACCAGGGCTCCACAGTTAGGAGGTAGCTTTGC<br>AGTTTGGGGAGGGCTGTTTTCCATGATTGACTGTA<br>GTATGGTTCAAGTCAGAGGAAAGGAAGATCCCTG | 16 | LETIDNISR<br>TSFLGFL* |

TABLE 3A-continued

| SEQ ID | identifier_position | position | modified_RNA | PAP length | PAP |
|---|---|---|---|---|---|
| | | | GAACTCCATCACAAGTGGTGCCTTAACGGGAGCC<br>ATACTGGCAGCAAGAAATGGACCAGTGGCCATGG<br>TTGGGTCAGCCGCAATGGGTGGCATTCTCCTAGCT<br>TTAATTGAAGGAGCTGGTATCTTGTTGACAAGATTT<br>GCCTCTGCACAGTTTCCCAATGGTCCTCAGTTTGC<br>AGAAGACCCCTCCCAGTTGCCTTCAACTCAGTTAC<br>CTTCCTCACCTTTGGAGACTATCGACAATATCAGTA<br>GGACTTCTTTCCTAGGATTTCTTTAACAGAACGAGT<br>TGTGGTTCGAGAAGGATTTCAGAAGATCAAGTTAC<br>AGTCTGTTTTTAAAAACCATAGGTGGGACAGCTATG<br>GCCAATAGGCTATAAAGAGACATTTAGCACTTTTTT<br>CTATTTAAAGGAACAAGCGGGGAAGGGTGCTAAAA<br>GATAATACGTTTATTTATTCACACTTGAATTGCATTT<br>GTGATCAAAATAAATGTTTAAATCGCTAAAGGAAAA<br>TACAGTAAGTGCTTGAAAGATGAAGGACCAAAAGG<br>CCAAAAAACAGTGAAATATGATCATCATCTCTTGC<br>GGACTTCTCTGCCTGGTTTTGTGTGTTCTGTTATTC<br>AAACAATAAAAAGCTGGTGGAACTTACTCTTTCTTT<br>TAAGATAAGTTGTAGACTTCGATGTTTCATGCTCAT<br>GTACTTCAAATAATGCATGTTTTATAGTTAGTCCCT<br>CATCACTTGAAGTGACTTCTGAGAATTATGCAGAG<br>TCAA | | |
| 1668 | NM_0063<br>35.1_85 | 85 | AGTCAAGATGGAGGAGTACGCGCGAGAGCCTTGC<br>CCATGGCGAATTGTGGATGACTGTGGTGGGGCCT<br>TTACGATGGGTACCATGGTGGTGGTATCTTTCAAG<br>CAATCAAAGGTTTTCGCAATTCTCCAGTGGGAGTA<br>AACCACAGACTACGAGGGAGTTTGACAGCTATTAA<br>AACCAGGGCTCCACAGTTAGGAGGTAGCTTTGCA<br>GTTTGGGGAGGGCTGTTTTCCATGATTGACTGTAG<br>TATGGTTCAAGTCAGAGGAAAGGAAGATCCCTGGA<br>ACTCCATCACAAGTGGTGCCTTAACGGGAGCCATA<br>CTGGCAGCAAGAAATGGACCAGTGGCCATGGTTG<br>GGTCAGCCGCAATGGGTGGCATTCTCCTAGCTTTA<br>ATTGAAGGAGCTGGTATCTTGTTGACAAGATTTGC<br>CTCTGCACAGTTTCCCAATGGTCCTCAGTTTGCAG<br>AAGACCCCTCCCAGTTGCCTTCAACTCAGTTACCT<br>TCCTCACCTTTGGAGACTATCGACAATATCAGTA<br>GGACTTCTTTCCTAGGATTTCTTTAACAGAACGAGT<br>TGTGGTTCGAGAAGGATTTCAGAAGATCAAGTTAC<br>AGTCTGTTTTTAAAAACCATAGGTGGGACAGCTATG<br>GCCAATAGGCTATAAAGAGACATTTAGCACTTTTTT<br>CTATTTAAAGGAACAAGCGGGGAAGGGTGCTAAAA<br>GATAATACGTTTATTTATTCACACTTGAATTGCATTT<br>GTGATCAAAATAAATGTTTAAATCGCTAAAGGAAAA<br>TACAGTAAGTGCTTGAAAGATGAAGGACCAAAAGG<br>CCAAAAAACAGTGAAATATGATCATCATCTCTTGC<br>GGACTTCTCTGCCTGGTTTTGTGTGTTCTGTTATTC<br>AAACAATAAAAAGCTGGTGGAACTTACTCTTTCTTT<br>TAAGATAAGTTGTAGACTTCGATGTTTCATGCTCAT<br>GTACTTCAAATAATGCATGTTTTATAGTTAGTCCCT<br>CATCACTTGAAGTGACTTCTGAGAATTATGCAGAG<br>TCAA | 18 | MVWSFKQ<br>SKVFAILQ<br>WE* |
| 1669 | NM_0063<br>60.3_163 | 163 | GTGGTCTTGCGAGTGGAGTGTCCGCTGTGCCCGG<br>GCCTGCACCATGAGCGTCCCGGCCTTCATCGACA<br>TCAGTGAAGAAGATCAGGCTGCTGAGCTTCGTGCT<br>TATCTGAAATCTAAAGGAGCTGAGATTTCAGAAGA<br>GAACTCGGAAGGTGGACTTCATGTGATTTAGCTCA<br>AATTATTGAAGCCTGTGATGTGTGTCTGAAGGAGG<br>ATGATAAAGATGTTGAAAGTGTGATGAACAGTGTG<br>GTATCCCTACTCTTGATCCTGGAACCAGACAAGCA<br>AGAAGCTTTGATTGAAAGCCTATGTGAAAAGCTGG<br>TCAAATTTCGCGAAGGTGAACGCCCGTCTCTGAGA<br>CTGCAGTTGTTAAGCAACCTTTTCCACGGGATGGA<br>TAAGAATACTCCTGTAAGATACACAGTGTATTGCA<br>GCCTTATTAAAGTGGCAGCATCTTGTGGGGCCATC<br>CAGTACATCCCAACTGAGCTGGATCAAGTTAGAAA<br>ATGGATTTCTGACTGGAATCTCACCACTGAAAAAA<br>AGCACACCCTTTTAAGACTACTTTATGAGGCACTT<br>GTGGATTGTAAGAAGAGTGATGCTGCTTCAAAAGT<br>CATGGTGGAATTGCTCGGAAGTTACACAGAGGAC<br>AATGCTTCCCAGGCTCGAGTTGATGCCCACAGGT<br>GTATTGTACGAGCATTGAAAGATCCAAATGCATTT<br>CTTTTTGACCACCTTCTTACTTTAAAACCAGTCAAG<br>TTTTTGGAAGGCGAGCTTATTCATGATCTTTTAACC<br>ATTTTTGTGAGTGCTAAATTGGCATCATATGTCAAG<br>TTTTATCAGAATAATAAAGACTTCATTGATTCACTT<br>GGCCTGTTACATGAACAGAATATGGCAAAAATGAG | 1 | I* |

TABLE 3A-continued

| SEQ ID | identifier_ position | position | modified_RNA | PAP length | PAP |
|---|---|---|---|---|---|
| | | | ACTACTTACTTTTATGGGAATGGCAGTAGAAAATAA GGAAATTTCTTTTGACACAATGCAGCAAGAACTTC AGATTGGAGCTGATGATGTTGAAGCATTTGTTATT GACGCCGTAAGAACTAAAATGGTCTACTGCAAAAT TGATCAGA | | |
| 1670 | NM_0063 60.3_288 | 288 | GTGGTCTTGCGAGTGGAGTGTCCGCTGTGCCCGG GCCTGCACCATGAGCGTCCCGGCCTTCATCGACA TCAGTGAAGAAGATCAGGCTGCTGAGCTTCGTGCT TATCTGAAATCTAAAGGAGCTGAGATTTCAGAAGA GAACTCGGAAGGTGGACTTCATGTTGATTTAGCTC AAATTATTGAAGCCTGTGATGTGTGTCTGAAGGAG GATGATAAAGATGTTGAAAGTGTGATGAACAGTGT GGTATCCCTACTCTTGATCCTGGAACCAGACAAGC AAGAAGCTTGATTGAAAGCCTATGTGAAAAGCTGG TCAAATTTCGCGAAGGTGAACGCCCGTCTCTGAGA CTGCAGTTGTTAAGCAACCTTTTCCACGGGATGGA TAAGAATACTCCTGTAAGATACACAGTGTATTGCA GCCTTATTAAAGTGGCAGCATCTTGTGGGGCCATC CAGTACATCCCAACTGAGCTGGATCAAGTTAGAAA ATGGATTTCTGACTGGAATCTCACCACTGAAAAAA AGCACACCCTTTTAAGACTACTTTATGAGGCACTT GTGGATTGTAAGAAGAGTGATGCTGCTTCAAAAGT CATGGTGGAATTGCTCGGAAGTTACACAGAGGAC AATGCTTCCCAGGCTCGAGTTGATGCCCACAGGT GTATTGTACGAGCATTGAAAGATCCAAATGCATTT CTTTTTGACCACCTTCTTACTTTAAAACCAGTCAAG TTTTTGGAAGGCGAGCTTATTCATGATCTTTTAACC ATTTTTGTGAGTGCTAAATTGGCATCATATGTCAAG TTTTATCAGAATAATAAAGACTTCATTGATTCACTT GGCCTGTTACATGAACAGAATATGGCAAAAATGAG ACTACTTACTTTTATGGGAATGGCAGTAGAAAATAA GGAAATTTCTTTTGACACAATGCAGCAAGAACTTC AGATTGGAGCTGATGATGTTGAAGCATTTGTTATT GACGCCGTAAGAACTAAAATGGTCTACTGCAAAAT TGATCAGA | 0 | * |
| 1671 | NM_0063 60.3_606 | 606 | GTGGTCTTGCGAGTGGAGTGTCCGCTGTGCCCGG GCCTGCACCATGAGCGTCCCGGCCTTCATCGACA TCAGTGAAGAAGATCAGGCTGCTGAGCTTCGTGCT TATCTGAAATCTAAAGGAGCTGAGATTTCAGAAGA GAACTCGGAAGGTGGACTTCATGTTGATTTAGCTC AAATTATTGAAGCCTGTGATGTGTGTCTGAAGGAG GATGATAAAGATGTTGAAAGTGTGATGAACAGTGT GGTATCCCTACTCTTGATCCTGGAACCAGACAAGC AAGAAGCTTTGATTGAAAGCCTATGTGAAAAGCTG GTCAAATTTCGCGAAGGTGAACGCCCGTCTCTGA GACTGCAGTTGTTAAGCAACCTTTTCCACGGGATG GATAAGAATACTCCTGTAAGATACACAGTGTATTG CAGCCTTATTAAAGTGGCAGCATCTTGTGGGGCCA TCCAGTACATCCCAACTGAGCTGGATCAAGTTAGA AAATGGATTTCTGACTGGAATCTCACCACTGAAAA AAAGCACACCCTTTTAAGACTACTTTATGAGGCAC TTGTGGATTGTAAGAAGAGTGATGCTGCTTCAAAA GTCATGGTGGAATGCTCGGAAGTTACACAGAGGA CAATGCTTCCCAGGCTCGAGTTGATGCCCACAGGT GTATTGTACGAGCATTGAAAGATCCAAATGCATTT CTTTTTGACCACCTTCTTACTTTAAAACCAGTCAAG TTTTTGGAAGGCGAGCTTATTCATGATCTTTTAACC ATTTTTGTGAGTGCTAAATTGGCATCATATGTCAAG TTTTATCAGAATAATAAAGACTTCATTGATTCACTT GGCCTGTTACATGAACAGAATATGGCAAAAATGAG ACTACTTACTTTTATGGGAATGGCAGTAGAAAATAA GGAAATTTCTTTTGACACAATGCAGCAAGAACTTC AGATTGGAGCTGATGATGTTGAAGCATTTGTTATT GACGCCGTAAGAACTAAAATGGTCTACTGCAAAAT TGATCAGA | 24 | CSEVTQRT MLPRLELM PTGVLYEH* |
| 1672 | NM_0063 60.3_667 | 667 | GTGGTCTTGCGAGTGGAGTGTCCGCTGTGCCCGG GCCTGCACCATGAGCGTCCCGGCCTTCATCGACA TCAGTGAAGAAGATCAGGCTGCTGAGCTTCGTGCT TATCTGAAATCTAAAGGAGCTGAGATTTCAGAAGA GAACTCGGAAGGTGGACTTCATGTTGATTTAGCTC AAATTATTGAAGCCTGTGATGTGTGTCTGAAGGAG GATGATAAAGATGTTGAAAGTGTGATGAACAGTGT GGTATCCCTACTCTTGATCCTGGAACCAGACAAGC AAGAAGCTTTGATTGAAAGCCTATGTGAAAAGCTG GTCAAATTTCGCGAAGGTGAACGCCCGTCTCTGA GACTGCAGTTGTTAAGCAACCTTTTCCACGGGATG GATAAGAATACTCCTGTAAGATACACAGTGTATTG | 4 | MYEH* |

TABLE 3A-continued

| SEQ ID | identifier_position | position | modified_RNA | length PAP | PAP |
|---|---|---|---|---|---|
| | | | CAGCCTTATTAAAGTGGCAGCATCTTGTGGGGCCA TCCAGTACATCCCAACTGAGCTGGATCAAGTTAGA AAATGGATTTCTGACTGGAATCTCACCACTGAAAA AAAGCACACCCTTTTAAGACTACTTTATGAGGCAC TTGTGGATTGTAAGAAGAGTGATGCTGCTTCAAAA GTCATGGTGGAATTGCTCGGAAGTTACACAGAGG ACAATGCTTCCCAGGCTCGAGTTGATGCCCACAG GTGTATGTACGAGCATTGAAAGATCCAAATGCATT TCTTTTTGACCACCTTCTTACTTTAAAACCAGTCAA GTTTTTGGAAGGCGAGCTTATTCATGATCTTTTAAC CATTTTTGTGAGTGCTAAATTGGCATCATATGTCAA GTTTTATCAGAATAATAAAGACTTCATTGATTCACT TGGCCTGTTACATGAACAGAATATGGCAAAAATGA GACTACTTACTTTTATGGGAATGGCAGTAGAAAAT AAGGAAATTTCTTTTGACACAATGCAGCAAGAACTT CAGATTGGAGCTGATGATGTTGAAGCATTTGTTATT GACGCCGTAAGAACTAAAATGGTCTACTGCAAAAT TGATCAGA | | |
| 1673 | NM_006360.3_738 | 738 | GTGGTCTTGCGAGTGGAGTGTCCGCTGTGCCCGG GCCTGCACCATGAGCGTCCCGGCCTTCATCGACA TCAGTGAAGAAGATCAGGCTGCTGAGCTTCGTGCT TATCTGAAATCTAAAGGAGCTGAGATTTCAGAAGA GAACTCGGAAGGTGGACTTCATGTTGATTTAGCTC AAATTATTGAAGCCTGTGATGTGTGTCTGAAGGAG GATGATAAAGATGTTGAAAGTGTGATGAACAGTGT GGTATCCCTACTCTTGATCCTGGAACCAGACAAGC AAGAAGCTTTGATTGAAAGCCTATGTGAAAAGCTG GTCAAATTTCGCGAAGGTGAACGCCCGTCTCTGA GACTGCAGTTGTTAAGCAACCTTTTCCACGGGATG GATAAGAATACTCCTGTAAGATACACAGTGTATTG CAGCCTTATTAAAGTGGCAGCATCTTGTGGGGCCA TCCAGTACATCCCAACTGAGCTGGATCAAGTTAGA AAATGGATTTCTGACTGGAATCTCACCACTGAAAA AAAGCACACCCTTTTAAGACTACTTTATGAGGCAC TTGTGGATTGTAAGAAGAGTGATGCTGCTTCAAAA GTCATGGTGGAATTGCTCGGAAGTTACACAGAGG ACAATGCTTCCCAGGCTCGAGTTGATGCCCACAG GTGTATTGTACGAGCATTGAAAGATCCAAATGCAT TTCTTTTTGACCACCTTCTTACTTTAAAACCAGTCA AGTTTTGGAAGGCGAGCTTATTCATGATCTTTTAAC CATTTTTGTGAGTGCTAAATTGGCATCATATGTCAA GTTTTATCAGAATAATAAAGACTTCATTGATTCACT TGGCCTGTTACATGAACAGAATATGGCAAAAATGA GACTACTTACTTTTATGGGAATGGCAGTAGAAAAT AAGGAAATTTCTTTTGACACAATGCAGCAAGAACTT CAGATTGGAGCTGATGATGTTGAAGCATTTGTTATT GACGCCGTAAGAACTAAAATGGTCTACTGCAAAAT TGATCAGA | 9 | WKASLFMI F* |
| 1674 | NM_006367.2_257 | 257 | ATTGCGGAGAGCGGCTGATCGCAGTCCGGAGGTG AGGCGGAACTCTGAGCAGGTGGTCCATTATGGCT GACATGCAAAATCTGGTAGAAAGATTGGAGAGGG CAGTGGGCCGCCTGGAGGCAGTATCTCATACCTC TGACATGCACCGTGGGTATGCAGACAGTCCTTCAA AAGCAGGAGCAGCTCCATATGTGCAGGCATTTGA CTCGCTGCTTGCTGGTCCTGTGGCAGAGTACTTGA AGATCAGTAAAGAGATGGGGGAGACGTGCAGAAA CATGCGGAGATGGTCCACACAGGTTTGAAGTTGG AGCGAGCTCTGTTGGTTACAGCTTCTCAGTGTCAA CAGCCAGCAGAAAATAAGCTTTCCGATTTGTTGGC ACCCATCTCAGAGCAGATCAAAGAAGTGATAACCT TTCGGGAGAAGAACCGAGGCAGCAAGTTGTTTAAT CACCTGTCAGCTGTCAGCGAAAGTATCCAGGCCC TGGGCTGGGTGGCTATGGCTCCCAAGCCTGGCCC TTATGTGAAAGAAATGAATGATGCCGCCATGTTTTA TACAAACCGAGTCCTCAAAGAGTACAAAGATGTGG ATAAGAAGCATGTAGACTGGGTCAAAGCTTATTTA AGTATATGGACAGAGCTGCAGGCTTACATTAAGGA GTTCCATACCACCGGACTGGCCTGGAGCAAAACG GGGCCTGTGGCAAAAGAACTGAGCGGACTGCCAT CTGGACCCTCTGCCGGATCAGGTCCTCCTCCCCC TCCACCAGGCCCCCCTCCTCCCCCAGTCTCTACCA GTTCAGGCTCAGATGAGTCTGCTTCCCGCTCAGCA CTGTTCGCGCAGATTAATCAGGGGGAGAGCATTA CACATGCCCTGAAACATGTATCTGATGACATGAAG ACTCACAAGAACCCTGCCCTGAAGGCTCAGAGTG GTCCAGTACGCAGTGGCCCCAAACCATTCTCTGCA | 15 | MGETCRN MRRWSTQ V* |

TABLE 3A-continued

| SEQ ID | identifier_position | position | modified_RNA | PAP length | PAP |
|---|---|---|---|---|---|
| 1675 | NM_0063 67.2_322 | 322 | CCTAAACCCCAAACCAGCCCATCCCCCAAACGAG CCACAAAGAAGGAGCCAGCTGTA ATTGCGGAGAGCGGCTGATCGCAGTCCGGAGGTG AGGCGGAACTCTGAGCAGGTGGTCCATTATGGCT GACATGCAAAATCTGGTAGAAAGATTGGAGAGGG CAGTGGGCCGCCTGGAGGCAGTATCTCATACCTC TGACATGCACCGTGGGTATGCAGACAGTCCTTCAA AAGCAGGAGCAGCTCCATATGTGCAGGCATTTGA CTCGCTGCTTGCTGGTCCTGTGGCAGAGTACTTGA AGATCAGTAAAGAGATTGGGGGAGACGTGCAGAA ACATGCGGAGATGGTCCACACAGGTTTGAAGTTG GAGCGAGCTCTGTGGTTACAGCTTCTCAGTGTCAA CAGCCAGCAGAAAATAAGCTTTCCGATTTGTTGGC ACCCATCTCAGAGCAGATCAAAGAAGTGATAACCT TTCGGGAGAAGAACCGAGGCAGCAAGTTGTTTAAT CACCTGTCAGCTGTCAGCGAAAGTATCCAGGCCC TGGGCTGGGTGGCTATGGCTCCCAAGCCTGGCCC TTATGTGAAAGAAATGAATGATGCCGCCATGTTTTA TACAAACCGAGTCCTCAAAGAGTACAAAGATGTGG ATAAGAAGCATGTAGACTGGGTCAAAGCTTATTTA AGTATATGGACAGAGCTGCAGGCTTACATTAAGGA GTTCCATACCACCGGACTGGCCTGGAGCAAAACG GGGCCTGTGGCAAAAGAACTGAGCGGACTGCCAT CTGGACCCTCTGCCGGATCAGGTCCTCCTCCCCC TCCACCAGGCCCCCCTCCTCCCCCAGTCTCTACCA GTTCAGGCTCAGATGAGTCTGCTTCCCGCTCAGCA CTGTTCGCGCAGATTAATCAGGGGGAGAGCATTA CACATGCCCTGAAACATGTATCTGATGACATGAAG ACTCACAAGAACCCTGCCCTGAAGGCTCAGAGTG GTCCAGTACGCAGTGGCCCCAAACCATTCTCTGCA CCTAAACCCCAAACCAGCCCATCCCCCAAACGAG CCACAAAGAAGGAGCCAGCTGTA | 28 | WLQLLSVN SQQKISFPI CWHPSQS RSKK* |
| 1676 | NM_0063 67.2_517 | 517 | ATTGCGGAGAGCGGCTGATCGCAGTCCGGAGGTG AGGCGGAACTCTGAGCAGGTGGTCCATTATGGCT GACATGCAAAATCTGGTAGAAAGATTGGAGAGGG CAGTGGGCCGCCTGGAGGCAGTATCTCATACCTC TGACATGCACCGTGGGTATGCAGACAGTCCTTCAA AAGCAGGAGCAGCTCCATATGTGCAGGCATTTGA CTCGCTGCTTGCTGGTCCTGTGGCAGAGTACTTGA AGATCAGTAAAGAGATTGGGGGAGACGTGCAGAA ACATGCGGAGATGGTCCACACAGGTTTGAAGTTG GAGCGAGCTCTGTGGTTACAGCTTCTCAGTGTCA ACAGCCAGCAGAAAATAAGCTTTCCGATTTGTTGG CACCCATCTCAGAGCAGATCAAAGAAGTGATAACC TTTCGGGAGAAGAACCGAGGCAGCAAGTTGTTTAA TCACCTGTCAGCTGTCAGCGAAAGTATCCAGGCC CTGGGCTGGGTGGCTATGGCTCCCAAGCCTGGCC TTATGTGAAAGAAATGAATGATGCCGCCATGTTTTA TACAAACCGAGTCCTCAAAGAGTACAAAGATGTGG ATAAGAAGCATGTAGACTGGGTCAAAGCTTATTTA AGTATATGGACAGAGCTGCAGGCTTACATTAAGGA GTTCCATACCACCGGACTGGCCTGGAGCAAAACG GGGCCTGTGGCAAAAGAACTGAGCGGACTGCCAT CTGGACCCTCTGCCGGATCAGGTCCTCCTCCCCC TCCACCAGGCCCCCCTCCTCCCCCAGTCTCTACCA GTTCAGGCTCAGATGAGTCTGCTTCCCGCTCAGCA CTGTTCGCGCAGATTAATCAGGGGGAGAGCATTA CACATGCCCTGAAACATGTATCTGATGACATGAAG ACTCACAAGAACCCTGCCCTGAAGGCTCAGAGTG GTCCAGTACGCAGTGGCCCCAAACCATTCTCTGCA CCTAAACCCCAAACCAGCCCATCCCCCAAACGAG CCACAAAGAAGGAGCCAGCTGTA | 2 | LM* |
| 1677 | NM_0063 67.2_545 | 545 | ATTGCGGAGAGCGGCTGATCGCAGTCCGGAGGTG AGGCGGAACTCTGAGCAGGTGGTCCATTATGGCT GACATGCAAAATCTGGTAGAAAGATTGGAGAGGG CAGTGGGCCGCCTGGAGGCAGTATCTCATACCTC TGACATGCACCGTGGGTATGCAGACAGTCCTTCAA AAGCAGGAGCAGCTCCATATGTGCAGGCATTTGA CTCGCTGCTTGCTGGTCCTGTGGCAGAGTACTTGA AGATCAGTAAAGAGATTGGGGGAGACGTGCAGAA ACATGCGGAGATGGTCCACACAGGTTTGAAGTTG GAGCGAGCTCTGTGGTTACAGCTTCTCAGTGTCA ACAGCCAGCAGAAAATAAGCTTTCCGATTTGTTGG CACCCATCTCAGAGCAGATCAAAGAAGTGATAACC TTTCGGGAGAAGAACCGAGGCAGCAAGTTGTTTAA TCACCTGTCAGCTGTCAGCGAAAGTATCCAGGCC CTGGGCTGGGTGGCTATGGCTCCCAAGCCTGGCC | 18 | CFIQTESS KSTKMWIR SM* |

TABLE 3A-continued

| SEQ ID | identifier_position | position | modified_RNA | PAP length | PAP |
|---|---|---|---|---|---|
| | | | CTTATGTGAAAGAAATGAATGATGCCGCATGTTTTA TACAAACCGAGTCCTCAAAGAGTACAAAGATGTGG ATAAGAAGCATGTAGACTGGGTCAAAGCTTATTTA AGTATATGGACAGAGCTGCAGGCTTACATTAAGGA GTTCCATACCACCGGACTGGCCTGGAGCAAAACG GGGCCTGTGGCAAAAGAACTGAGCGGACTGCCAT CTGGACCCTCTGCCGGATCAGGTCCTCCTCCCCC TCCACCAGGCCCCCTCCTCCCCCAGTCTCTACCA GTTCAGGCTCAGATGAGTCTGCTTCCCGCTCAGCA CTGTTCGCGCAGATTAATCAGGGGGAGAGCATTA CACATGCCCTGAAACATGTATCTGATGACATGAAG ACTCACAAGAACCCTGCCCTGAAGGCTCAGAGTG GTCCAGTACGCAGTGGCCCCAAACCATTCTCTGCA CCTAAACCCCAAACCAGCCCATCCCCCAAACGAG CCACAAAGAAGGAGCCAGCTGTA | | |
| 1678 | NM_006384.2_169 | 169 | TCTCCCGAATTCGGCACGAGGCGGCGTCTCGAGG CGAGTTGGCGGAGCTGTGCGCGCGGCGGGGCGA TGGGGGGCTCGGGCAGTCGCCTGTCCAAGGAGCT GCTGGCCGAGTACCAGGACTTGACGTTCCTGACG AAGCAGGAGATCCTCCTAGCCCACAGGCGGTTTG TGAGCTGCTTCCCCAGGAGCAGCGGACCGTGGAG TCGTCACTTCGGGCACAAGTGCCCTTCGAGCAGAT TCTCAGCCTTCCAGAGCTCAAGGCCAACCCCTTCA AGGAGCGAATCTGCAGGGTCTTCTCCACATCCCC AGCCAAAGACAGCCTTAGCTTTGAGGACTTCCTGG ATCTCCTCAGTGTGTTCAGTGACACAGCCACGCCA GACATCAAGTCCCATTATGCCTTCCGCATCTTTGA CTTTGATGATGACGGAACCTTGAACAGAGAAGACC TGAGCCGGCTGGTGAACTGCCTCACGGGAGAGG GCGAGGACACACGGCTTAGTGCGTCTGAGATGAA GCAGCTCATCGACAACATCCTGGAGGAGTCTGAC ATTGACAGGGATGGAACCATCAACCTCTCTGAGTT CCAGCACGTCATCTCCCGTTCTCCAGACTTTGCCA GCTCCTTTAAGATTGTCCTGTGACAGCAGCCCCAG CGTGTGTCCTGGCACCCTGTCCAAGAACCTTTCTA CTGCTGAGCTGTGGCCAAGGTCAAGCCTGTGTTG CCAGTGCGGGCCAAGCTGGCCCAGCCTGGAGCT GGCGCTGTGCAGCCTCACCCCGGGCAGGGGCGG CCCTCGTTGTCAGGGGCCTCTCCTCACTGCTGTTGT CATTGCTCCGTTTGTGTTTGTACTAATCAGTAATAA AGGTTTAGAAGTTTGACCCTAAAAAAAAAAAAAAAA AAAAAAAA | 88 | VSCFPRSS GPWSRHF GHKCPSS RFSAFQSS RPTPSRSE SAGSSPHP QPKTALAL RTSWISSV CSVTQPR QTSSPIMP SASLTLMM TEP* |
| 1679 | NM_006407.3_349 | 349 | AAAGCCGACCGAGACGGAGCCGCTGTCAACTCTC CAACTCAGCTCAGCTGATCGGTTGCCGCCGCCGC CGCCGCCAGATTCTGGAGGCGAAGAACGCAAAGC TGAGAACATGGACGTTAATATCGCCCCACTCCGCG CCTGGGACGATTTCTTCCCGGGTTCCGATCGCTTT GCCCGGCCGGACTTCAGGGACATTTCCAAATGGA ACAACCGCGTAGTGAGCAACCTGCTCTATTACCAG ACCAACTACCTGGTGGTGGCTGCCATGATGATTTC CATTGTGGGGTTTCTGAGTCCCTTCAACATGATCC TGGGAGGAATCGTGGTGGTGCTGGTGTTCACAGG GTTGTGTGGGCAGCCCACAATAAAGACGTCCTTC GCCGGATGAAGAAGCGCTACCCCACGACGTTCGT TATGGTGGTCATGTTGGCGAGCTATTTCCTTATCT CCATGTTTGGAGGAGTCATGGTCTTTGTGTTTGGC ATTACTTTTCCTTTGCTGTTGATGTTTATCCATGCA TCGTTGAGACTTCGGAACCTCAAGAACAAACTGGA GAATAAAATGGAAGGAATAGGTTTGAAGAGGACAC CGATGGGCATTGTCCTGGATGCCCTAGAACAGCA GGAAGAAGGCATCAACAGACTCACTGACTATATCA GCAAAGTGAAGGAATAAACATAACTTACCTGAGCT AGGGTTGCAGCAGAAATTGAGTTGCAGCTTGCCCT TGTCCAGACCTATGTTCTGCTTGCGTTTTGAAACA GGAGGTGCACGTACCACCCAATTATCTATGGCAG CATGCATGTATAGGCCGAACTATTATCAGCTCTGA TGTTTCAGAGAGAAGACCTCAGAAACCGAAAGAAA ACCACCACCCTCCTATTGTGTCTGAAGTTTCACGT GTGTTTATGAAATCTAATGGGAAATGGATCACACG ATTTCTTTAAGGGAATTAAAAAAAATAAAAGAATTA CGGCTTTTACAGCAACAATACGATTATCTTATAGGA AAAAAAAAATCATT | 13 | LCGQPTIK TSFAG* |
| 1680 | NM_006409.2_403 | 403 | TCAGCCGCTCCCTCTGGGCTTCCGTCCTCCGCCC GCGCCCGACGGAGCCTGTTCGCGTCGACTGCCCA GAGTCCGCGAATCCTCCGCTCCGAGCCCGTCCGG ACTCCCCCGATCCCAGCTTTCTCTCCTTTGAAAAC ACTAAGAATAATGTCACTGCATCAGTTTTTACTAGA | 5 | GSQPW* |

TABLE 3A-continued

| SEQ ID | identifier_position | position | modified_RNA | PAP length | PAP |
|---|---|---|---|---|---|
| | | | GCCAATCACCTGTCATGCCTGGAACAGGGATCGT<br>ACTCAGATTGCCCTCAGTCCCAATAATCACGAAGT<br>GCACATCTATAAGAAGAACGGGAGCCAGTGGGTG<br>AAAGCTCATGAACTCAAGGAGCACAACGGACACAT<br>CACAGGTATTGACTGGGCTCCCAAGAGCGACCGC<br>ATTGTCACTTGTGGGGCAGACCGCAATGCCTATGT<br>CTGGAGTCAGAAAGATGGTGTTGGAAGCCAACCC<br>TGGTGATCCTGAGAATTAATCGCGCAGCTACTTTT<br>GTGAAGTGGTCCCCCCTAGAGAACAAATTTGCTGT<br>GGGAAGTGGAGCACGACTCATTTCTGTTTGTTACT<br>TTGAGTCTGAAAATGACTGGTGGGTGAGCAAGCA<br>CATTAAAAAGCCGATTCGCTCCACAGTCCTCAGCT<br>TGGATTGGCATCCCAACAACGTTTTGCTGGCAGCA<br>GGATCATGTGACTTCAAATGCAGAGTGTTTTCTGC<br>CTACATTAAAGAAGTGGATGAAAAGCCAGCCAGCA<br>CGCCCTGGGGCAGCAAGATGCCTTTTGGGCAGCT<br>GATGTCAGAGTTTGGTGGCAGTGGCACTGGTGGC<br>TGGGTCCACGGGGTAAGCTTCTCTGCCAGTGGGA<br>GCCGCCTGGCCTGGGTCAGCCACGACAGCACCGT<br>GTCTGTTGCTGATGCCTCAAAAAGTGTGCAGGTCT<br>CGACTCTGAAGACAGAGTTCCTGCCGCTCCTAAGT<br>GTGTCATTTGTCTCAGAGAACAGCGTCGTGGCTGC<br>TGGCCATGACTGCTGCCCAATGCTCTTTAACTACG<br>ATGACCGCGGCTGCCTGACCTTCGTCTCCAAGTTA<br>GATATTCCAAAACAGAGCAT | | |
| 1681 | NM_0064<br>09.2_450 | 450 | TCAGCCGCTCCCTCTGGGCTTCCGTCCTCCGCCC<br>GCGCCCGACGGAGCCTGTTCGCGTCGACTGCCCA<br>GAGTCCGCGAATCCTCCGCTCCGAGCCCGTCCGG<br>ACTCCCCCGATCCCAGCTTTCTCTCCTTTGAAAAC<br>ACTAAGAATAATGTCACTGCATCAGTTTTTACTAGA<br>GCCAATCACCTGTCATGCCTGGAACAGGGATCGT<br>ACTCAGATTGCCCTCAGTCCCAATAATCACGAAGT<br>GCACATCTATAAGAAGAACGGGAGCCAGTGGGTG<br>AAAGCTCATGAACTCAAGGAGCACAACGGACACAT<br>CACAGGTATTGACTGGGCTCCCAAGAGCGACCGC<br>ATTGTCACTTGTGGGGCAGACCGCAATGCCTATGT<br>CTGGAGTCAGAAAGATGGTGTTTGGAAGCCAACC<br>CTGGTGATCCTGAGAATTAATCGCGCAGCTACTTT<br>GTGAAGTGGTCCCCCCTAGAGAACAAATTTGCTGT<br>GGGAAGTGGAGCACGACTCATTTCTGTTTGTTACT<br>TTGAGTCTGAAAATGACTGGTGGGTGAGCAAGCA<br>CATTAAAAAGCCGATTCGCTCCACAGTCCTCAGCT<br>TGGATTGGCATCCCAACAACGTTTTGCTGGCAGCA<br>GGATCATGTGACTTCAAATGCAGAGTGTTTTCTGC<br>CTACATTAAAGAAGTGGATGAAAAGCCAGCCAGCA<br>CGCCCTGGGGCAGCAAGATGCCTTTTGGGCAGCT<br>GATGTCAGAGTTTGGTGGCAGTGGCACTGGTGGC<br>TGGGTCCACGGGGTAAGCTTCTCTGCCAGTGGGA<br>GCCGCCTGGCCTGGGTCAGCCACGACAGCACCGT<br>GTCTGTTGCTGATGCCTCAAAAAGTGTGCAGGTCT<br>CGACTCTGAAGACAGAGTTCCTGCCGCTCCTAAGT<br>GTGTCATTTGTCTCAGAGAACAGCGTCGTGGCTGC<br>TGGCCATGACTGCTGCCCAATGCTCTTTAACTACG<br>ATGACCGCGGCTGCCTGACCTTCGTCTCCAAGTTA<br>GATATTCCAAAACAGAGCAT | 1 | L* |
| 1682 | NM_0064<br>09.2514 | 514 | TCAGCCGCTCCCTCTGGGCTTCCGTCCTCCGCCC<br>GCGCCCGACGGAGCCTGTTCGCGTCGACTGCCCA<br>GAGTCCGCGAATCCTCCGCTCCGAGCCCGTCCGG<br>ACTCCCCCGATCCCAGCTTTCTCTCCTTTGAAAAC<br>ACTAAGAATAATGTCACTGCATCAGTTTTTACTAGA<br>GCCAATCACCTGTCATGCCTGGAACAGGGATCGT<br>ACTCAGATTGCCCTCAGTCCCAATAATCACGAAGT<br>GCACATCTATAAGAAGAACGGGAGCCAGTGGGTG<br>AAAGCTCATGAACTCAAGGAGCACAACGGACACAT<br>CACAGGTATTGACTGGGCTCCCAAGAGCGACCGC<br>ATTGTCACTTGTGGGGCAGACCGCAATGCCTATGT<br>CTGGAGTCAGAAAGATGGTGTTTGGAAGCCAACC<br>CTGGTGATCCTGAGAATTAATCGCGCAGCTACTTT<br>TGTGAAGTGGTCCCCCCTAGAGAACAAATTTGCTG<br>TGGGAAGTGGAGCACGACTCATTTCTGTTGTTACT<br>TTGAGTCTGAAAATGACTGGTGGGTGAGCAAGCA<br>CATTAAAAAGCCGATTCGCTCCACAGTCCTCAGCT<br>TGGATTGGCATCCCAACAACGTTTTGCTGGCAGCA<br>GGATCATGTGACTTCAAATGCAGAGTGTTTTCTGC<br>CTACATTAAAGAAGTGGATGAAAAGCCAGCCAGCA<br>CGCCCTGGGGCAGCAAGATGCCTTTTGGGCAGCT<br>GATGTCAGAGTTTGGTGGCAGTGGCACTGGTGGC | 10 | VTLSLKMT<br>GG* |

TABLE 3A-continued

| SEQ ID | identifier_position | position | modified_RNA | PAP length | PAP |
|---|---|---|---|---|---|
| | | | TGGGTCCACGGGTAAGCTTCTCTGCCAGTGGGA<br>GCCGCCTGGCCTGGGTCAGCCACGACAGCACCGT<br>GTCTGTTGCTGATGCCTCAAAAAGTGTGCAGGTCT<br>CGACTCTGAAGACAGAGTTCCTGCCGCTCCTAAGT<br>GTGTCATTTGTCTCAGAGAACAGCGTCGTGGCTGC<br>TGGCCATGACTGCTGCCCAATGCTCTTTAACTACG<br>ATGACCGCGGCTGCCTGACCTTCGTCTCCAAGTTA<br>GATATTCCAAAACAGAGCAT | | |
| 1683 | NM_0064<br>09.2_614 | 614 | TCAGCCGCTCCCTCTGGGCTTCCGTCCTCCGCCC<br>GCGCCCGACGGAGCCTGTTCGCGTCGACTGCCCA<br>GAGTCCGCGAATCCTCCGCTCCGAGCCCGTCCGG<br>ACTCCCCCGATCCCAGCTTTCTCTCCTTTGAAAAC<br>ACTAAGAATAATGTCACTGCATCAGTTTTTACTAGA<br>GCCAATCACCTGTCATGCCTGGAACAGGGATCGT<br>ACTCAGATTGCCCTCAGTCCCAATAATCACGAAGT<br>GCACATCTATAAGAAGAACGGGAGCCAGTGGGTG<br>AAAGCTCATGAACTCAAGGAGCACAACGGACACAT<br>CACAGGTATTGACTGGGCTCCCAAGAGCGACCGC<br>ATTGTCACTTGTGGGGCAGACCGCAATGCCTATGT<br>CTGGAGTCAGAAAGATGGTGTTTGGAAGCCAACC<br>CTGGTGATCCTGAGAATTAATCGCGCAGCTACTTT<br>TGTGAAGTGGTCCCCCCTAGAGAACAAATTTGCTG<br>TGGGAAGTGGAGCACGACTCATTTCTGTTTGTTAC<br>TTTGAGTCTGAAAATGACTGGTGGGTGAGCAAGCA<br>CATTAAAAAGCCGATTCGCTCCACAGTCCTCAGCT<br>TGGATTGGCATCCCAACAACGTTTGCTGGCAGCA<br>GGATCATGTGACTTCAAATGCAGAGTGTTTTCTGC<br>CTACATTAAAGAAGTGGATGAAAAGCCAGCCAGCA<br>CGCCCTGGGGCAGCAAGATGCCTTTTGGGCAGCT<br>GATGTCAGAGTTTGGTGGCAGTGGCACTGGTGGC<br>TGGGTCCACGGGTAAGCTTCTCTGCCAGTGGGA<br>GCCGCCTGGCCTGGGTCAGCCACGACAGCACCGT<br>GTCTGTTGCTGATGCCTCAAAAAGTGTGCAGGTCT<br>CGACTCTGAAGACAGAGTTCCTGCCGCTCCTAAGT<br>GTGTCATTTGTCTCAGAGAACAGCGTCGTGGCTGC<br>TGGCCATGACTGCTGCCCAATGCTCTTTAACTACG<br>ATGACCGCGGCTGCCTGACCTTCGTCTCCAAGTTA<br>GATATTCCAAAACAGAGCAT | 38 | CWQQDHV<br>TSNAECFL<br>PTLKKWM<br>KSQPARP<br>GAARCLLG<br>S* |
| 1684 | NM_0064<br>29.2_198 | 198 | CAAGCTTCTGGGTATTTCTATTGCGCGAGGCATTG<br>TGGGTTGCTGGGCGGCCCGGTCTCGGAGAAGAG<br>GGGAGAGTGGCGGGCCGCTGAATAAGCTTCCAAA<br>ATGATGCCCACACCAGTTATCCTATTGAAAGAGGG<br>GACTGATAGCTCCCAAGGCATCCCCCAGCTTGTG<br>AGTAACATCAGTGCCTGCCAGGTGATGCTGAGGC<br>TGTAAGAACTACCCTGGGTCCCCGTGGCATGGAC<br>AAGCTTATTGTAGATGGCAGAGGCAAAGCAACAAT<br>TTCTAATGATGGGGCCACAATTCTGAAACTTCTTGA<br>TGTTGTCCATCCTGCAGCAAAGACTTTGGTAGACA<br>TTGCCAAATCCCAAGATGCTGAGGTGGGTGATGG<br>CACCACCTCAGTGACCTTGCTGGCTGCAGAGTTTC<br>TGAAGCAGGTGAAACCCTATGTGGAGGAAGGTTTA<br>CACCCCCAGATCATCATTCGAGCTTTCCGCACAGC<br>CACCCAGCTGGCAGTTAACAAGATCAAAGAGATTG<br>CTGTGACCGTGAAGAAGGCAGATAAAGTGGAGCA<br>GAGGAAGCTGCTGGAAAAGTGTGCCATGACCGCT<br>CTGAGCTCCAAGCTGATCTCCCAGCAGAAAGCTTT<br>CTTTGCTAAGATGGTGGTGGATGCAGTGATGATGC<br>TCGATGATTTGCTGCAGCTTAAAATGATTGGAATC<br>AAGAAGGTACAGGGTGGAGCCCTCGAGGATTCTC<br>AGCTGGTAGCTGGTGTTGCATTCAAGAAGACTTTC<br>TCTTACGCTGGGTTTGAAATGCAACCCAAAAAGTA<br>CCACAATCCCAAGATTGCCCTTTTGAATGTCGAGC<br>TCGAGTTGAAAGCTGAGAAAGACAATGCTGAGATA<br>AGAGTCCACACAGTTGAGGATTATCAGGCAATTGT<br>TGATGCTGAGTGGAACATTCTCTATGACAAGTTAG<br>AGAAGATCCATCATTCTGGAGCCAAAGTTGTCTTG<br>TCCAAACTCCCCATTGGGGATGTGGCCACCCAGT<br>ACTTTGCTGACAGGGACAT | 4 | MLRL* |
| 1685 | NM_0064<br>29.2_249 | 249 | CAAGCTTCTGGGTATTTCTATTGCGCGAGGCATTG<br>TGGGTTGCTGGGCGGCCCGGTCTCGGAGAAGAG<br>GGGAGAGTGGCGGGCCGCTGAATAAGCTTCCAAA<br>ATGATGCCCACACCAGTTATCCTATTGAAAGAGGG<br>GACTGATAGCTCCCAAGGCATCCCCCAGCTTGTG<br>AGTAACATCAGTGCCTGCCAGGTGATTGCTGAGG<br>CTGTAAGAACTACCCTGGGTCCCCGTGGCATGGA<br>CAAGCTTATGTAGATGGCAGAGGCAAAGCAACAAT<br>TTCTAATGATGGGGCCACAATTCTGAAACTTCTTGA | 1 | M* |

TABLE 3A-continued

| SEQ ID | identifier_position | position | modified_RNA | PAP length | PAP |
|---|---|---|---|---|---|
| | | | TGTTGTCCATCCTGCAGCAAAGACTTTGGTAGACA TTGCCAAATCCCAAGATGCTGAGGTGGGTGATGG CACCACCTCAGTGACCTTGCTGGCTGCAGAGTTTC TGAAGCAGGTGAAACCCTATGTGGAGGAAGGTTTA CACCCCCAGATCATCATTCGAGCTTTCCGCACAGC CACCCAGCTGGCAGTTAACAAGATCAAAGAGATTG CTGTGACCGTGAAGAAGGCAGATAAAGTGGAGCA GAGGAAGCTGCTGGAAAAGTGTGCCATGACCGCT CTGAGCTCCAAGCTGATCTCCCAGCAGAAAGCTTT CTTTGCTAAGATGGTGGTGGATGCAGTGATGATGC TCGATGATTTGCTGCAGCTTAAAATGATTGGAATC AAGAAGGTACAGGGTGGAGCCCTCGAGGATTCTC AGCTGGTAGCTGGTGTTGCATTCAAGAAGACTTTC TCTTACGCTGGGTTTGAAATGCAACCCAAAAAGTA CCACAATCCCAAGATTGCCCTTTTGAATGTCGAGC TCGAGTTGAAAGCTGAGAAAGACAATGCTGAGATA AGAGTCCACACAGTTGAGGATTATCAGGCAATTGT TGATGCTGAGTGGAACATTCTCTATGACAAGTTAG AGAAGATCCATCATTCTGGAGCCAAAGTTGTCTTG TCCAAACTCCCCATTGGGGATGTGGCCACCCAGT ACTTTGCTGACAGGGACAT | | |
| 1686 | NM_0064 29.2_338 | 338 | CAAGCTTCTGGGTATTTCTATTGCGCGAGGCATTG TGGGTTGCTGGGCGGCCCGGTCTCGGAGAAGAG GGGAGAGTGGCGGGCCGCTGAATAAGCTTCCAAA ATGATGCCCACACCAGTTATCCTATTGAAAGAGGG GACTGATAGCTCCCAAGGCATCCCCCAGCTTGTG AGTAACATCAGTGCCTGCCAGGTGATTGCTGAGG CTGTAAGAACTACCCTGGGTCCCCGTGGCATGGA CAAGCTTATTGTAGATGGCAGAGGCAAAGCAACAA TTTCTAATGATGGGGCCACAATTCTGAAACTTCTTG ATGTTGTCCATCCTGCAGCAAAGACTTGGTAGACA TTGCCAAATCCCAAGATGCTGAGGTGGGTGATGG CACCACCTCAGTGACCTTGCTGGCTGCAGAGTTTC TGAAGCAGGTGAAACCCTATGTGGAGGAAGGTTTA CACCCCCAGATCATCATTCGAGCTTTCCGCACAGC CACCCAGCTGGCAGTTAACAAGATCAAAGAGATTG CTGTGACCGTGAAGAAGGCAGATAAAGTGGAGCA GAGGAAGCTGCTGGAAAAGTGTGCCATGACCGCT CTGAGCTCCAAGCTGATCTCCCAGCAGAAAGCTTT CTTTGCTAAGATGGTGGTGGATGCAGTGATGATGC TCGATGATTTGCTGCAGCTTAAAATGATTGGAATC AAGAAGGTACAGGGTGGAGCCCTCGAGGATTCTC AGCTGGTAGCTGGTGTTGCATTCAAGAAGACTTTC TCTTACGCTGGGTTTGAAATGCAACCCAAAAAGTA CCACAATCCCAAGATTGCCCTTTTGAATGTCGAGC TCGAGTTGAAAGCTGAGAAAGACAATGCTGAGATA AGAGTCCACACAGTTGAGGATTATCAGGCAATTGT TGATGCTGAGTGGAACATTCTCTATGACAAGTTAG AGAAGATCCATCATTCTGGAGCCAAAGTTGTCTTG TCCAAACTCCCCATTGGGGATGTGGCCACCCAGT ACTTTGCTGACAGGGACAT | 1 | W* |
| 1687 | NM_0064 29.2_486 | 486 | CAAGCTTCTGGGTATTTCTATTGCGCGAGGCATTG TGGGTTGCTGGGCGGCCCGGTCTCGGAGAAGAG GGGAGAGTGGCGGGCCGCTGAATAAGCTTCCAAA ATGATGCCCACACCAGTTATCCTATTGAAAGAGGG GACTGATAGCTCCCAAGGCATCCCCCAGCTTGTG AGTAACATCAGTGCCTGCCAGGTGATTGCTGAGG CTGTAAGAACTACCCTGGGTCCCCGTGGCATGGA CAAGCTTATTGTAGATGGCAGAGGCAAAGCAACAA TTTCTAATGATGGGGCCACAATTCTGAAACTTCTTG ATGTTGTCCATCCTGCAGCAAAGACTTTGGTAGAC ATTGCCAAATCCCAAGATGCTGAGGTGGGTGATG GCACCACCTCAGTGACCTTGCTGGCTGCAGAGTTT CTGAAGCAGGTGAAACCCTATGTGGAGGAAGGTT TACACCCCCAGATCATCATTCGAGCTTTCCGCACA GCACCCAGCTGGCAGTTAACAAGATCAAAGAGATT GCTGTGACCGTGAAGAAGGCAGATAAAGTGGAGC AGAGGAAGCTGCTGGAAAAGTGTGCCATGACCGC TCTGAGCTCCAAGCTGATCTCCCAGCAGAAAGCTT TCTTTGCTAAGATGGTGGTGGATGCAGTGATGATG CTCGATGATTTGCTGCAGCTTAAAATGATTGGAAT CAAGAAGGTACAGGGTGGAGCCCTCGAGGATTCT CAGCTGGTAGCTGGTGTTGCATTCAAGAAGACTTT CTCTTACGCTGGGTTTGAAATGCAACCCAAAAAGT ACCACAATCCCAAGATTGCCCTTTTGAATGTCGAG CTCGAGTTGAAAGCTGAGAAAGACAATGCTGAGAT AAGAGTCCACACAGTTGAGGATTATCAGGCAATTG | 12 | PSWQLTR SKRLL* |

TABLE 3A-continued

| SEQ ID | identifier_position | position | modified_RNA | PAP length | PAP |
|---|---|---|---|---|---|
| | | | TTGATGCTGAGTGGAACATTCTCTATGACAAGTTA GAGAAGATCCATCATTCTGGAGCCAAAGTTGTCTT GTCCAAACTCCCCATTGGGGATGTGGCCACCCAG TACTTTGCTGACAGGGACAT | | |
| 1688 | NM_0064 76.4_357 | 357 | CGAGTGGCTGCCCCACAAAATGCCTGCTTCTCTGC GGAATCCTACTGTTCTTCACATGCTCTCTAATACCA TCTTTTCATATCCACTTTCTCTTCCATGTTGAAAAAT TAAATTGACAGGCTGGATTCTGCAAAGATCTTTGG ACATTTAAGTATCTTCGACCGGCGCGAAAAGAGGC GGCCTGACCTTGGAAGTGGGACGGGGTCCTGCAG CGGGTCCTTCCGGCGGGTGACATTCAGCCGGCGG TTCGGGGCGACGGACTCTCCATTCCAGAACCATG GCCCAATTTGTCCGTAACCTTGTGGAGAAGACCCC GGCGCTGGTGAACGCTGCTGTGACTTACTCGAAG CCTCGATGGCCACATTTTGGTACTACGCCAAGGTT GAGCTGGTTCCTCCCACCCCTGCTGAGATCCCTA GAGCTATTCAGAGCCTGAAAAAAATAGTCAATAGT GCTCAGACTGGTAGCTTCAAACAGCTCACAGTTAA GGAAGCTGTGCTGAATGGTTTGGTGGCCACTGAG GTGTTGATGTGGTTTTATGTCGGAGAGATTATAGG CAAGCGGGGCATCATTGGCTATGATGTTTGAAGAC CAATCTTTAACATCTGATTATATTTGATTTATTATTT GAGTGTTGTTGGACCATGTGTGATCAGACTGCTAT CTGAATAAAATAAGATTTGTCAAAACTCAGTGTTTT CTCCATCAGATACTCCATGAAAGGTCACAATTTCT CTTGATATTAAGCTGGGTTGTCTTTAAACAACCCTA AATACACGTCTGTTTAGCCCGCAATTGGAAAGGAT ATATGTGGCAATATTAACCTGGTACATGAATATATG GGGATAACATTTTAATTTGAAGGTTTGGAATATATA TATTTAAGCTTTATTTCCAGAACAGTGAGGGTTAGG TCTTGGGAAAACTATAACTTGCCAAAGTAGAAGAA ATAGTAGTACCATATGCCAAAGTGATAGAGATGAA TCATGTCAGTAGTTAGAATAACATTTCAACTGTTTT CTTT | 26 | WPHFGTT PRLSWFLP PLLRSLELF RA* |
| 1689 | NM_0064 76.4_368 | 368 | CGAGTGGCTGCCCCACAAAATGCCTGCTTCTCTGC GGAATCCTACTGTTCTTCACATGCTCTCTAATACCA TCTTTTCATATCCACTTTCTCTTCCATGTTGAAAAAT TAAATTGACAGGCTGGATTCTGCAAAGATCTTTGG ACATTTAAGTATCTTCGACCGGCGCGAAAAGAGGC GGCCTGACCTTGGAAGTGGGACGGGGTCCTGCAG CGGGTCCTTCCGGCGGGTGACATTCAGCCGGCGG TTCGGGGCGACGGACTCTCCATTCCAGAACCATG GCCCAATTTGTCCGTAACCTTGTGGAGAAGACCCC GGCGCTGGTGAACGCTGCTGTGACTTACTCGAAG CCTCGATTGGCCACATTTGGTACTACGCCAAGGTT GAGCTGGTTCCTCCCACCCCTGCTGAGATCCCTA GAGCTATTCAGAGCCTGAAAAAAATAGTCAATAGT GCTCAGACTGGTAGCTTCAAACAGCTCACAGTTAA GGAAGCTGTGCTGAATGGTTTGGTGGCCACTGAG GTGTTGATGTGGTTTTATGTCGGAGAGATTATAGG CAAGCGGGGCATCATTGGCTATGATGTTTGAAGAC CAATCTTTAACATCTGATTATATTTGATTTATTATTT GAGTGTTGTTGGACCATGTGTGATCAGACTGCTAT CTGAATAAAATAAGATTTGTCAAAACTCAGTGTTTT CTCCATCAGATACTCCATGAAAGGTCACAATTTCT CTTGATATTAAGCTGGGTTGTCTTTAAACAACCCTA AATACACGTCTGTTTAGCCCGCAATTGGAAAGGAT ATATGTGGCAATATTAACCTGGTACATGAATATATG GGGATAACATTTTAATTTGAAGGTTTGGAATATATA TATTTAAGCTTTATTTCCAGAACAGTGAGGGTTAGG TCTTGGGAAAACTATAACTTGCCAAAGTAGAAGAA ATAGTAGTACCATATGCCAAAGTGATAGAGATGAA TCATGTCAGTAGTTAGAATAACATTTCAACTGTTTT CTTT | 22 | GTTPRLSW FLPPLLRSL ELFRA* |
| 1690 | NM_0064 76.4_510 | 510 | CGAGTGGCTGCCCCACAAAATGCCTGCTTCTCTGC GGAATCCTACTGTTCTTCACATGCTCTCTAATACCA TCTTTTCATATCCACTTTCTCTTCCATGTTGAAAAAT TAAATTGACAGGCTGGATTCTGCAAAGATCTTTGG ACATTTAAGTATCTTCGACCGGCGCGAAAAGAGGC GGCCTGACCTTGGAAGTGGGACGGGGTCCTGCAG CGGGTCCTTCCGGCGGGTGACATTCAGCCGGCGG TTCGGGGCGACGGACTCTCCATTCCAGAACCATG GCCCAATTTGTCCGTAACCTTGTGGAGAAGACCCC GGCGCTGGTGAACGCTGCTGTGACTTACTCGAAG CCTCGATTGGCCACATTTTGGTACTACGCCAAGGT TGAGCTGGTTCCTCCCACCCCTGCTGAGATCCCTA GAGCTATTCAGAGCCTGAAAAAAATAGTCAATAGT | 6 | WWPLRC* |

TABLE 3A-continued

| SEQ ID | identifier_position | position | modified_RNA | PAP length | PAP |
|---|---|---|---|---|---|
| | | | GCTCAGACTGGTAGCTTCAAACAGCTCACAGTTAA GGAAGCTGTGCTGAATGGTTGGTGGCCACTGAGG TGTTGATGTGGTTTTATGTCGGAGAGATTATAGGC AAGCGGGGCATCATTGGCTATGATGTTTGAAGACC AATCTTTAACATCTGATTATATTTGATTTATTATTTG AGTGTTGTTGGACCATGTGTGATCAGACTGCTATC TGAATAAAATAAGATTTGTCAAAACTCAGTGTTTTC TCCATCAGATACTCCATGAAAGGTCACAATTTCTCT TGATATTAAGCTGGGTTGTCTTTAAACAACCCTAAA TACACGTCTGTTTAGCCCGCAATTGGAAAGGATAT ATGTGGCAATATTAACCTGGTACATGAATATATGG GGATAACATTTTAATTTGAAGGTTTGGAATATATAT ATTTAAGCTTTATTTCCAGAACAGTGAGGGTTAGGT CTTGGGAAAACTATAACTTGCCAAAGTAGAAGAAA TAGTAGTACCATATGCCAAAGTGATAGAGATGAAT CATGTCAGTAGTTAGAATAACATTTCAACTGTTTTC TTT | | |
| 1691 | NM_0065 03.2_742 | 742 | GATCATCCCAGGCCACACAGAGGCCGGCTTGGTC ACTATGGAGGAGATAGGCATCTTGGTGGAGAAGG CTCAGGATGAGATCCCAGCACTGTCCGTGTCCCG GCCCCAGACCGGCCTGTCCTTCCTGGGCCCTGAG CCTGAGGACCTGGAGGACCTGTACAGCCGCTACA AGAAGCTGCAGCAAGAGCTGGAGTTCCTGGAGGT GCAGGAGGAATACATCAAAGATGAGCAAAAGAAC CTGAAAAAGGAATTTCTCCATGCCCAGGAGGAGGT GAAGCGAATCCAAAGCATCCCGCTGGTCATCGGA CAATTTCTGGAGGCTGTGGATCAGAATACAGCCAT CGTGGGCTCTACCACAGGCTCCAACTATTATGTGC GCATCCTGAGCACCATCGATCGGGAGCTGCTCAA GCCCAACGCCTCAGTGGCCCTCCACAAGCACAGC AATGCACTGGTGGACGTGCTGCCCCCCGAAGCCG ACAGCAGCATCATGATGCTCACCTCAGACCAGAAG CCAGATGTGATGTACGCGGACATCGGAGGCATGG ACATCCAGAAGCAGGAGGTGCGGGAGGCCGTGG AGCTCCCGCTCACGCATTTCGAGCTCTACAAGCAG ATCGGCATCGATCCCCCCCGAGGCGTCCTCATGT ATGGCCCACCTGGCTGTGGGAAGACCATGTTGGC AAAGGCGGTGGCACATCACACAACAGCTGCATTC ATCCGGGTCGTGGGCTCGGAGTTGTACAGAAGTA TCTGGGTGAGGGCCCCCGCATGGTCCGGGATGTG TTCCGCCTGGCCAAGGAGAATGCACCTGCCATCA TCTTCATAGACGAGATTGATGCCATCGCCACCAAG AGATTCGATGCTCAGACAGGGGCCGACAGGGAGG TTCAGAGGATCCTGCTGGAGCTGCTGAATCAGATG GATGGATTTGATCAGAATGTCAATGTCAAGGTAAT CATGGCCACAAACAGAGCAGACACCCTGGATCCG GCCCTGCTACGGCCAGGACGGCTGGACCGTA GCAGTGCGGCGGTCACAGGCTGAGTGCTGCGGC GCGATCCTTGCTTCCCTGAGCGTTGGCCCGGGAG GAAAGAAGATGGTGCTGGATCTGGATTTGTTTCGG GTGGATAAAGGAGGGGACCCAGCCCTCATCCGAG AGACGCAGGAGAAGCGCTTCAAGGACCCGGGACT AGTGGACCAGCTGGTGAAGGCAGACAGCGAGTGG CGACGATGTAGATTTCGGGCAGACAACTTGAACAA GCTGAAGAACCTATGCAGCAAGACAATCGGAGAG AAAATGAAGAAAAAAGAGCCAGTGGGAGATGATGA GTCTGTCCCAGAGAATGTGCTGAGTTTCGATGACC TTACTGCAGACGCTTTAGCTAACCTGAAAGTCTCA CAAATCAAAAAAGTCCGACTCCTCATTGATGAAGC CATCCTGAAGTGTGACGCGGAGCGGATAAAGTTG GAAGCAGAGCGGTTTGAGAACCTCCGAGAGATTG GGAACCTTCTGCACCCTTCTGTACCCATCAGTAAC GATGAGGATGTGGACAACAAAGTAGAGAGGATTG GGGTGATTGTACAGTCAGGAAGAAGTACTCTCATG TGGACCTGGTGGTGATGGTAGATGGCTTTGAAGG CGAAAAGGGGGCCGTGGTGGCTGGGAGTCGAGG GTACTTCTTGAAGGGGGTCCTGGTGTTCCTGGAAC AGGCTCTCATCCAGTATGCCCTTCGCACCTTGGGA AGTCGGGGCTACATTCCCATTTATACCCCCTTTTC ATGAGGAAGGAGGTCATGCAGGAGGTGGCACAGC TCAGCCAGTTTGATGAAGAACTTTATAAGGTGATT GGCAAAGGCAGTGAAAAGTCTGATGACAACTCCTA TGATGAGAAGTACCTGATTGCCACCTCAGAGCAGC CCATTGCTGCCCTGCACCGGGATGAGTGGCTCCG GCCGGAGGACCTGCCCATCAAGTATGCTGGCCTG TCTACCTGCTTCCGTCAGGAGGTGGGCTCCCATG GCCGTGACACCCGTGGCATCTTCCG | 29 | LYRSIWVR APAWSGM CSAWPRR MHLPSSS* |
| 1692 | NM_0065 13.2_550 | 550 | | 16 | GVIVQSGR STLMWTW W* |

TABLE 3A-continued

| SEQ ID | identifier_position | position | modified_RNA | PAP length | PAP |
|---|---|---|---|---|---|
| 1693 | NM_006541.3_559 | 559 | GCTTCTGTCTGGCGGCGGCAGCATGGCGGCGGG GGCGGCTGAGGCAGCTGTAGCGGCCGTGGAGGA GGTCGGCTCAGCCGGGCAGTTTGAGGAGCTGCTG CGCCTCAAAGCCAAGTCCCTCCTTGTGGTCCATTT CTGGGCACCATGGGCTCCACAGTGTGCACAGATG AACGAAGTTATGGCAGAGTTAGCTAAAGAACTCCC TCAAGTTTCATTTGTGAAGTTGGAAGCTGAAGGTG TTCCTGAAGTATCTGAAAAATATGAAATTAGCTCTG TTCCCACTTTTCTGTTTTTCAAGAATTCTCAGAAAA TCGACCGATTAGATGGTGCACATGCCCCAGAGTT GACCAAAAAAGTTCAGCGACATGCATCTAGTGGCT CCTTCCTACCCAGCGCTAATGAACATCTTAAAGAA GATCTCAACCTTCGCTTGAAGAAATTGACTCATGC TGCCCCCTGCATGCTGTTTATGAAAGGAACTCCTC AAGAACCACGCTGTGGTTTCAGCAAGCAGATGGT GGAAATTCTTCACAAACATAATATTCAGTTTAGCAG TTTGATATCTTCTCAGATGAAGAGGTTCGACAGGG ACTCAAAGCCTATTCCAGTTGGCCTACCTATCCTC AGCTCTATGTTTCTGGAGAGCTCATAGGAGGACTT GATATAATTAAGGAGCTAGAAGCATCTGAAGAACT AGATACAATTTGTCCCAAAGCTCCCAAATTAGAGG AAAGGCTCAAAGTGCTGACAAATAAAGCTTCTGTG ATGCTCTTTATGAAAGGAAACAAACAGGAAGCAAA ATGTGGATTCAGCAAACAAATTCTGGAAATACTAAA TAGTACTGGTGTTGAATATGAAACATTCGATATATT GGAGGATGAAGAAGTTCGGCAAGGATTAAAAGCTT ACTCAAATTGGCCAACATACCCTCAGCTGTATGTG AAAGGGGAGCTGGTGGGAGGATTGGATATTGTGA AGGAACTGAAAGAAAATGGTGAATTGCTGCCTATA CTGAGAGGAGAAA | 31 | LISSQMKR FDRDSKPI PVGLPILSS MFLESS* |
| 1694 | NM_006556.3_768 | 768 | CAGGCCAGGCTGTGAGCGAAGGTTCTGGGCGGG GCTGGACTGTTCTAAGTGAGTTCGGGTGGGGGAG CTTCACGAGGGGAGGCTGCTCTGTGAAGGAACCG CCTTTCTCTCCGCGTGTCTCACCCTTTTCTCCCCAT ATCTGTTTGGACATGAGCTGAGGGCACGGTCGCG GGCGGTCAGCCCTGTTCGCAGCTACGGCGAGGA GGGGCGCGATTGTTCCTTGTTGCCGCTCCGCTTA GTGGCCGCGTCCATTCCGCGCGGTGTCCCGATTT TAGGGGTAGGGAGAAGTGTCAGCTTCAGGCATCG CGAGGCGTGGCGGCCCCATGGCCCCGCTGGGAG GCGCCCCGCGGCTGGTACTGCTGTTCAGCGGCAA GAGGAAATCCGGGAAGGACTTCGTGACCGAGGCG CTGCAGAGCAGACTTGGAGCTGATGTCTGTGCTGT CCTCCGGCTCTCTGGTCCACTCAAGGAACAGTATG CTCAGGAGCATGGCTTGAACTTCCAGAGACTCCTG GACACCAGCACCTACAAGGAGGCCTTTCGGAAGG ACATGATCCGCTGGGGAGAGGAGAAACGCCAGGC TGACCCAGGCTTCTTTTGCAGGAAGATTGTGGAGG GCATCTCCCAGCCCATCTGGCTGGTGAGTGACAC ACGGAGAGTGTCTGACATCCAGTGGTTTCGGGAG GCCTATGGGGCCGTGACGCAGACGGTCCGCGTTG TAGCGTTGGAGCAGAGCCGACAGCAGCGGGGCT GGGTGTTCACGCCAGGGTGGACGATGCTGAGTCA GAATGTGGCCTGGACAACTTCGGGGACTTTGACT GGGTCATCGAGAACCATGGAGTTGAACAGCGCCT GGAGGAGCAGTTGGAGAACCTGATAGAATTTATCC GCTCCAGACTTTAGTCACTAGGTTCTAGGAGTGAG CTGGGGCCTGCTGAGGTGGGGGTGGGGCTGACT CTGCAAAATGGGGGTGTCCCCCGATCCTGGCCGA GGTGAGGAACAGACAGGGGGGGGTCTAGATTCTGA G | 35 | WTMLSQN VAWTTSGT LTGSSRTM ELNSAWR SSWRT* |
| 1695 | NM_006585.2_132 | 132 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTGCCCA GATGCTCAAGGAGGGAGCGAAACACTTTTCAGGA TTAGAAGAGGCTGTGTATAGAAACATACAAGCTTG CAAGGAGCTTGCCCAAACCACTCGTACAGCATATG GACCAAATGGAATGAACAAAATGGTTATCAACCAC TTGGAGAAGTTGTTTGTGACAAACGATGCAGCAAC TATTTTAAGAGAACTAGAAGTACAGCATCCTGCTG CAAAAAATGATTGTAATGGCTTCTCATATGCAAGAG CAAGAAGTTGGAGATGGCACAAACTTTGTTCTGGT ATTTGCTGGAGCTCTCCTGGAATTAGCTGAAGAAC TTCTGAGGATTGGCCTGTCAGTTTCAGAGGTCATA GAAGGTTATGAAATAGCCTGCAGAAAAGCTCATGA GATTCTTCCTAATTTGGTATGTTGTTCTGCAAAAAA | 14 | LPRCSRRE RNTFQD* |

TABLE 3A-continued

| SEQ ID | identifier_position | position | modified_RNA | PAP length | PAP |
|---|---|---|---|---|---|
| | | | CCTTCGAGATATTGATGAAGTCTCATCTCTACTTCG TACCTCCATAATGAGTAAACAATATGGTAATGAAGT ATTTCTGGCCAAGCTTATTGCTCAGGCATGCGTAT CTATTTTTCCTGATTCCGGCCATTTCAATGTTGATA ACATCAGAGTTTGTAAAATTCTGGGCTCTGGTATC AGTTCCTCTTCAGTATTGCATGGCATGGTTTTTAAG AAGGAAACCGAAGGTGATGTAACATCTGTCAAAGA TGCAAAAATAGCAGTGTACTCTTGTCCTTTTGATGG CATGATAACAGAAACTAAGGGAACAGTGTTGATAA AGACTGCTGAAGAATTGATGAATTTTAGTAAGGGA GAAGAAAACCTCATGGATGCACAAGTCAAAGCTAT TGCTGATACTGGTGCAAATGTCGTAGTAACAGGTG GCAAAGTGGCAGACATGGCTCTTCATTATGCAAAT AAATATAA | | |
| 1696 | NM_0065 85.2_291 | 291 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTGTGACAAACGATGCAGCAAC TATTTTAAGAGAACTAGAAGTACAGCATCCTGCTG CAAAAATGATTGTAATGGCTTCTCATATGCAAGAG CAAGAAGTTGGAGATGGCACAAACTTTGTTCTGGT ATTTGCTGGAGCTCTCCTGGAATTAGCTGAAGAAC TTCTGAGGATTGGCCTGTCAGTTTCAGAGGTCATA GAAGGTTATGAAATAGCCTGCAGAAAAGCTCATGA GATTCTTCCTAATTTGGTATGTTGTTCTGCAAAAAA CCTTCGAGATATTGATGAAGTCTCATCTCTACTTCG TACCTCCATAATGAGTAAACAATATGGTAATGAAGT ATTTCTGGCCAAGCTTATTGCTCAGGCATGCGTAT CTATTTTTCCTGATTCCGGCCATTTCAATGTTGATA ACATCAGAGTTTGTAAAATTCTGGGCTCTGGTATC AGTTCCTCTTCAGTATTGCATGGCATGGTTTTTAAG AAGGAAACCGAAGGTGATGTAACATCTGTCAAAGA TGCAAAAATAGCAGTGTACTCTTGTCCTTTTGATGG CATGATAACAGAAACTAAGGGAACAGTGTTGATAA AGACTGCTGAAGAATTGATGAATTTTAGTAAGGGA GAAGAAAACCTCATGGATGCACAAGTCAAAGCTAT TGCTGATACTGGTGCAAATGTCGTAGTAACAGGTG GCAAAGTGGCAGACATGGCTCTTCATTATGCAAAT AAATATAA | 1 | L* |
| 1697 | NM_0065 85.2_408 | 408 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTTGTGACAAACGATGCAGCAA CTATTTTAAGAGAACTAGAAGTACAGCATCCTGCT GCAAAAATGATTGTAATGGCTTCTCATATGCAAGA GCAAGAAGTTGGAGATGGCACAAACTTGTTCTGGT ATTTGCTGGAGCTCTCCTGGAATTAGCTGAAGAAC TTCTGAGGATTGGCCTGTCAGTTTCAGAGGTCATA GAAGGTTATGAAATAGCCTGCAGAAAAGCTCATGA GATTCTTCCTAATTTGGTATGTTGTTCTGCAAAAAA CCTTCGAGATATTGATGAAGTCTCATCTCTACTTCG TACCTCCATAATGAGTAAACAATATGGTAATGAAGT ATTTCTGGCCAAGCTTATTGCTCAGGCATGCGTAT CTATTTTTCCTGATTCCGGCCATTTCAATGTTGATA ACATCAGAGTTTGTAAAATTCTGGGCTCTGGTATC AGTTCCTCTTCAGTATTGCATGGCATGGTTTTTAAG AAGGAAACCGAAGGTGATGTAACATCTGTCAAAGA TGCAAAAATAGCAGTGTACTCTTGTCCTTTTGATGG CATGATAACAGAAACTAAGGGAACAGTGTTGATAA AGACTGCTGAAGAATTGATGAATTTTAGTAAGGGA GAAGAAAACCTCATGGATGCACAAGTCAAAGCTAT TGCTGATACTGGTGCAAATGTCGTAGTAACAGGTG GCAAAGTGGCAGACATGGCTCTTCATTATGCAAAT AAATATAA | 11 | LFWYLLEL SWN* |

TABLE 3A-continued

| SEQ ID | identifier_position | position | modified_RNA | PAP length | PAP |
|---|---|---|---|---|---|
| 1698 | NM_0065 85.2_462 | 462 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTTGTGACAAACGATGCAGCAA CTATTTTAAGAGAACTAGAAGTACAGCATCCTGCT GCAAAAATGATTGTAATGGCTTCTCATATGCAAGA GCAAGAAGTTGGAGATGGCACAAACTTTGTTCTGG TATTTGCTGGAGCTCTCCTGGAATTAGCTGAAGAA CTTCTGAGGATGGCCTGTCAGTTTCAGAGGTCATA GAAGGTTATGAAATAGCCTGCAGAAAAGCTCATGA GATTCTTCCTAATTTGGTATGTTGTTCTGCAAAAAA CCTTCGAGATATTGATGAAGTCTCATCTCTACTTCG TACCTCCATAATGAGTAAACAATATGGTAATGAAGT ATTTCTGGCCAAGCTTATTGCTCAGGCATGCGTAT CTATTTTTCCTGATTCCGGCCATTTCAATGTTGATA ACATCAGAGTTTGTAAAATTCTGGGCTCTGGTATC AGTTCCTCTTCAGTATTGCATGGCATGGTTTTTAAG AAGGAAACCGAAGGTGATGTAACATCTGTCAAAGA TGCAAAAATAGCAGTGTACTCTTGTCCTTTTGATGG CATGATAACAGAAACTAAGGGAACAGTGTTGATAA AGACTGCTGAAGAATTGATGAATTTTAGTAAGGGA GAAGAAAACCTCATGGATGCACAAGTCAAAGCTAT TGCTGATACTGGTGCAAATGTCGTAGTAACAGGTG GCAAAGTGGCAGACATGGCTCTTCATTATGCAAAT AAATATAA | 8 | MACQFQR S* |
| 1699 | NM_0065 85.2_536 | 536 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTTGTGACAAACGATGCAGCAA CTATTTTAAGAGAACTAGAAGTACAGCATCCTGCT GCAAAAATGATTGTAATGGCTTCTCATATGCAAGA GCAAGAAGTTGGAGATGGCACAAACTTTGTTCTGG TATTTGCTGGAGCTCTCCTGGAATTAGCTGAAGAA CTTCTGAGGATTGGCCTGTCAGTTTCAGAGGTCAT AGAAGGTTATGAAATAGCCTGCAGAAAAGCTCATG AGATTCTTCCTAATTGGTATGTTGTTCTGCAAAAAA CCTTCGAGATATTGATGAAGTCTCATCTCTACTTCG TACCTCCATAATGAGTAAACAATATGGTAATGAAGT ATTTCTGGCCAAGCTTATTGCTCAGGCATGCGTAT CTATTTTTCCTGATTCCGGCCATTTCAATGTTGATA ACATCAGAGTTTGTAAAATTCTGGGCTCTGGTATC AGTTCCTCTTCAGTATTGCATGGCATGGTTTTTAAG AAGGAAACCGAAGGTGATGTAACATCTGTCAAAGA TGCAAAAATAGCAGTGTACTCTTGTCCTTTTGATGG CATGATAACAGAAACTAAGGGAACAGTGTTGATAA AGACTGCTGAAGAATTGATGAATTTTAGTAAGGGA GAAGAAAACCTCATGGATGCACAAGTCAAAGCTAT TGCTGATACTGGTGCAAATGTCGTAGTAACAGGTG GCAAAGTGGCAGACATGGCTCTTCATTATGCAAAT AAATATAA | 22 | WYVVLQKT FEILMKSHL YFVPP* |
| 1700 | NM_0065 85.2_685 | 685 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTTGTGACAAACGATGCAGCAA CTATTTTAAGAGAACTAGAAGTACAGCATCCTGCT GCAAAAATGATTGTAATGGCTTCTCATATGCAAGA GCAAGAAGTTGGAGATGGCACAAACTTTGTTCTGG TATTTGCTGGAGCTCTCCTGGAATTAGCTGAAGAA CTTCTGAGGATTGGCCTGTCAGTTTCAGAGGTCAT AGAAGGTTATGAAATAGCCTGCAGAAAAGCTCATG AGATTCTTCCTAATTTGGTATGTTGTTCTGCAAAAA ACCTTCGAGATATTGATGAAGTCTCATCTCTACTTC | 35 | ISMLITSEF VKFWALVS VPLQYCMA WFLRRKPK VM* |

TABLE 3A-continued

| SEQ ID | identifier_position | position | modified_RNA | PAP length | PAP |
|---|---|---|---|---|---|
| | | | GTACCTCCATAATGAGTAAACAATATGGTAATGAA GTATTTCTGGCCAAGCTTATTGCTCAGGCATGCGT ATCTATTTTCCTGATTCCGGCATTTCAATGTTGAT AACATCAGAGTTTGTAAAATTCTGGGCTCTGGTAT CAGTTCCTCTTCAGTATTGCATGGCATGGTTTTTAA GAAGGAAACCGAAGGTGATGTAACATCTGTCAAAG ATGCAAAAATAGCAGTGTACTCTTGTCCTTTTGATG GCATGATAACAGAAACTAAGGGAACAGTGTTGATA AAGACTGCTGAAGAATTGATGAATTTTAGTAAGGG AGAAGAAAACCTCATGGATGCACAAGTCAAAGCTA TTGCTGATACTGGTGCAAATGTCGTAGTAACAGGT GGCAAAGTGGCAGACATGGCTCTTCATTATGCAAA TAAATATAA | | |
| 1701 | NM_0065 85.2_712 | 712 | GAGGCGGCCCCACGCTGCTTTCCCAGAAGGCTGT GCGTGCTCCTCGCTTCCTCCGCGGTCTTCCGAGC GGTCGCGTGAACTGCTTCCTGCAGGCTGGCCATG GCGCTTCACGTTCCCAAGGCTCCGGGCTTTGCCC AGATGCTCAAGGAGGGAGCGAAACACTTTTCAGG ATTAGAAGAGGCTGTGTATAGAAACATACAAGCTT GCAAGGAGCTTGCCCAAACCACTCGTACAGCATAT GGACCAAATGGAATGAACAAAATGGTTATCAACCA CTTGGAGAAGTTGTTTGTGACAAACGATGCAGCAA CTATTTTAAGAGAACTAGAAGTACAGCATCCTGCT GCAAAAATGATTGTAATGGCTTCTCATATGCAAGA GCAAGAAGTTGGAGATGGCACAAACTTTGTTCTGG TATTTGCTGGAGCTCTCCTGGAATTAGCTGAAGAA CTTCTGAGGATTGGCCTGTCAGTTTCAGAGGTCAT AGAAGGTTATGAAATAGCCTGCAGAAAAGCTCATG AGATTCTTCCTAATTTGGTATGTTGTTCTGCAAAAA ACCTTCGAGATATTGATGAAGTCTCATCTCTACTTC GTACCTCCATAATGAGTAAACAATATGGTAATGAA GTATTTCTGGCCAAGCTTATTGCTCAGGCATGCGT ATCTATTTTCCTGATTCCGGCCATTTCAATGTTGA TAACATCAGAGTTGTAAAATTCTGGGCTCTGGTAT CAGTTCCTCTTCAGTATTGCATGGCATGGTTTTTAA GAAGGAAACCGAAGGTGATGTAACATCTGTCAAAG ATGCAAAAATAGCAGTGTACTCTTGTCCTTTTGATG GCATGATAACAGAAACTAAGGGAACAGTGTTGATA AAGACTGCTGAAGAATTGATGAATTTTAGTAAGGG AGAAGAAAACCTCATGGATGCACAAGTCAAAGCTA TTGCTGATACTGGTGCAAATGTCGTAGTAACAGGT GGCAAAGTGGCAGACATGGCTCTTCATTATGCAAA TAAATATAA | 26 | VKFWALVS VPLQYCMA WFLRRKPK VM* |
| 1702 | NM_0066 00.2_383 | 383 | CGGCTCCGCTGCGGAAGGCGGACGACTAGAGTC GTTGGGCCCGGCGCGACCCGCAGGAGCGTAGAG AGCGCGGGACTAGAGTGCAGAGCTCCGGGACGT GGATCGGAGCCGGCGCGATGGGCGGAGAGCAGG AGGAGGAGCGGTTCGACGGCATGTTGCTGGCCAT GGCTCAGCAGCACGAGGGCGGCGTGCAGGAGCT TGTGAACACCTTCTTCAGCTTCCTTCGACGCAAAA CAGACTTTTTCATTGGAGGAGAAGAAGGGATGGCA GAGAAGCTTATCACACAGACTTTCAGCCACCACAA TCAGCTGGCACAGAAGACCCGGCGGGAGAAGAGA GCCCGGCAGGAGGCCGAGCGGCGGGAGAAGGC GGAGCGGGCGGCAGACTGGCCAAGGAAGCCAAG TCAGAGACCTCAGGGCCCCAGATCAAGGAGCTAA CTGATGAAGAGGCAGAGAGGCTGCAGCTAGAGAT TGACCAGAAAAAGGATGCAGAGAATCATGAGGCC CAGCTCAAGAACGGCAGCCTTGACTCCCCAGGGA AGCAGGATACTGAGGAAGATGAGGAGGAAGATGA GAAGGACAAAGGAAAACTGAAGCCCAACCTAGGC AACGGGGCAGACCTGCCCAATTACCGCTGGACCC AGACCCTGTCGGAGCTGGACCTGGCGGTCCCTTT CTGTGTGAACTTCCGGCTGAAAGGGAAGGACATG GTGGTGGACATCCAGCGGCGGCACCTCCGGGTG GGGCTCAAGGGGCAGCCAGCGATCATTGATGGGG AGCTCTACAATGAAGTGAAGGTGGAGGAGAGCTC GTGGCTCATTGAGGACGGCAAGGTGGTGACTGTG CATCTGGAGAAGATCAATAAGATGGAGTGGTGGA GCCGCTTGGTGTCCAGTGACCCTGAGATCAACAC CAAGAAGATTAACCCTGAGAATTCCAAGCTGTCAG ACCTGGACAGTGAGACTCGCAGCATGGTGGAAAA GATGATGTATGACCAGCGACAGAAGTCCATGGGG CTGCCAACT | 17 | DWPRKPS QRPQGPR SRS* |
| 1703 | NM_0066 01.4_164 | 164 | GGGAGAGAAAAAGCGGAGTCGCCACCGGAGAGAA GTCGACTCCCTAGCAGCAGCCGCCGCCAGAGAGG CCCGCCCACCAGTTCGCCCGTCCCCCTGCCCCGT | 9 | VLKTVRML M* |

TABLE 3A-continued

| SEQ ID | identifier_ position | position | modified_RNA | PAP length | PAP |
|---|---|---|---|---|---|
| | | | TCACAATGCAGCCTGCTTCTGCAAAGTGGTACGAT<br>CGAAGGGACTATGTCTTCATTGAATTTGTGTTGAA<br>GACAGTAAGGATGTTAATGTAAATTTTGAAAAATCC<br>AAACTTACATTCAGTTGTCTCGGAGGAAGTGATAA<br>TTTTAAGCATTTAAATGAAATTGATCTTTTTCACTGT<br>ATTGATCCAAATGATTCCAAGCATAAAAGAACGGA<br>CAGATCAATTTTATGTTGTTTACGAAAAGGAGAATC<br>TGGCCAGTCATGGCCAAGGTTAACAAAAGAAAGG<br>GCAAAGCTTAATTGGCTTAGTGTCGACTTCAATAAT<br>TGGAAAGACTGGGAAGATGATTCAGATGAAGACAT<br>GTCTAATTTTGATCGTTTCTCTGAGATGATGAACAA<br>CATGGGTGGTGATGAGGATGTAGATTTACCAGAAG<br>TAGATGGAGCAGATGATGATTCACAAGACAGTGAT<br>GATGAAAAAAATGCCAGATCTGGAGTAAGGAATATT<br>GTCATCACCTGGATTTTGAGAAAGAAAAATAACTTC<br>TCTGCAAGATTTCATAATTGAGAGAATTCCTGAGTT<br>GATAGCTCTAAAGGCAGATATGCTGTATTTGCCTA<br>CTTTAACCCATTTTTCAACCTGTTTGTTTTTTAAAAG<br>GCTTCACTAAGGGTTGATATGTACCATTGTATGGG<br>GCAATTTTAAGTCAGCTAAGGCAATAACCTTATGC<br>ATGAACATTTCCCAGACTTTCATGAAGCTGTTGAG<br>GTCCTAGGCAATTAATGCAGCAGTTGCGATAAATA<br>AAAACATCTCACCTAAGTCTCCTTTTCTTCATAACA<br>TAGATACTGACATGATAGGAAGCTCTCAGCTTAGG<br>GAAAGAGAATAAATTTTAGATTATAGAACATGGATT<br>CAAAAGTGACTGGAACAAATTGGCTGACACCTTAC<br>TG | | |
| 1704 | NM_0066 23.2_145 | 145 | GAGGAGGAGGAGGAGATGACTGGGGAGCGGGAG<br>CTCGAGAATACTGCCCAGTTACTCTAGCGCGCCA<br>GGCCGAACCGCAGCTTCTTGGCTTAGGTACTTCTA<br>CTCACAGCGGCCGATTCCGAGGCCAACTCCAGCA<br>ATGGCTTTGCAAATCTGCGGAAAGTGCTCATCAGT<br>GACAGCCTGGACCCTTGCTGCCGGAAGATCTTGC<br>AAGATGGAGGGCTGCAGGTGGTGGAAAAGCAGAA<br>CCTTAGCAAAGAGGAGCTGATAGCGGAGCTGCAG<br>GACTGTGAAGGCCTTATTGTTCGCTCTGCCACCAA<br>GGTGACCGCTGATGTCATCAACGCAGCTGAGAAA<br>CTCCAGGTGGTGGGCAGGGCTGGCACAGGTGTG<br>GACAATGTGGATCTGGAGGCCGCAACAAGGAAGG<br>GCATCTTGGTTATGAACACCCCCAATGGGAACAGC<br>CTCAGTGCCGCAGAACTCACTTGTGGAATGATCAT<br>GTGCCTGGCCAGGCAGATTCCCCAGGCGACGGCT<br>TCGATGAAGGACGGCAAATGGGAGCGGAAGAAGT<br>TCATGGGAACAGAGCTGAATGGAAAGACCCTGGG<br>AATTCTTGGCCTGGGCAGGATTGGGAGAGAGGTA<br>GCTACCCGGATGCAGTCCTTTGGGATGAAGACTAT<br>AGGGTATGACCCCATCATTTCCCCAGAGGTCTCGG<br>CCTCCTTTGGTGTTCAGCAGCTGCCCCTGGAGGA<br>GATCTGGCCTCTCTGTGATTTCATCACTGTGCACA<br>CTCCTCTCCTGCCCTCCACGACAGGCTTGCTGAAT<br>GACAACACCTTTGCCCAGTGCAAGAAGGGGTGC<br>GTGTGGTGAACTGTGCCCGTGGAGGGATCGTGGA<br>CGAAGGCGCCCTGCTCCGGGCCCTGCAGTCTGGC<br>CAGTGTGCCGGGGCTGCACTGGACGTGTTTACGG<br>AAGAGCCGCCACGGGACCGGGCCTTGGTGGACC<br>ATGAGAATGTCATCAGCTGTCCCCACCTGGGTGCC<br>AGCACCAAGGAGGCTCAGAGCCGCTGTGGGG | 38 | LQICGKCS<br>SVTAWTLA<br>AGRSCKM<br>EGCRWWK<br>SRTLAKRS* |
| 1705 | NM_0066 23.2_292 | 292 | GAGGAGGAGGAGGAGATGACTGGGGAGCGGGAG<br>CTCGAGAATACTGCCCAGTTACTCTAGCGCGCCA<br>GGCCGAACCGCAGCTTCTTGGCTTAGGTACTTCTA<br>CTCACAGCGGCCGATTCCGAGGCCAACTCCAGCA<br>ATGGCTTTTGCAAATCTGCGGAAAGTGCTCATCAG<br>TGACAGCCTGGACCCTTGCTGCCGGAAGATCTTG<br>CAAGATGGAGGGCTGCAGGTGGTGGAAAAGCAGA<br>ACCTTAGCAAAGAGGAGCTGATAGCGGAGCTGCA<br>GGACTGTGAAGGCCTTATGTTCGCTCTGCCACCAA<br>GGTGACCGCTGATGTCATCAACGCAGCTGAGAAA<br>CTCCAGGTGGTGGGCAGGGCTGGCACAGGTGTG<br>GACAATGTGGATCTGGAGGCCGCAACAAGGAAGG<br>GCATCTTGGTTATGAACACCCCCAATGGGAACAGC<br>CTCAGTGCCGCAGAACTCACTTGTGGAATGATCAT<br>GTGCCTGGCCAGGCAGATTCCCCAGGCGACGGCT<br>TCGATGAAGGACGGCAAATGGGAGCGGAAGAAGT<br>TCATGGGAACAGAGCTGAATGGAAAGACCCTGGG<br>AATTCTTGGCCTGGGCAGGATTGGGAGAGAGGTA<br>GCTACCCGGATGCAGTCCTTTGGGATGAAGACTAT<br>AGGGTATGACCCCATCATTTCCCCAGAGGTCTCGG | 7 | MFALPPR* |

TABLE 3A-continued

| SEQ ID | identifier_position | position | modified_RNA | PAP length | PAP |
|---|---|---|---|---|---|
| | | | CCTCCTTTGGTGTTCAGCAGCTGCCCCTGGAGGA GATCTGGCCTCTCTGTGATTTCATCACTGTGCACA CTCCTCTCCTGCCCTCCACGACAGGCTTGCTGAAT GACAACACCTTTGCCCAGTGCAAGAAGGGGGTGC GTGTGGTGAACTGTGCCCGTGGAGGGATCGTGGA CGAAGGCGCCCTGCTCCGGGCCCTGCAGTCTGGC CAGTGTGCCGGGGCTGCACTGGACGTGTTTACGG AAGAGCCGCCACGGGACCGGGCCTTGGTGGACC ATGAGAATGTCATCAGCTGTCCCCACCTGGGTGCC AGCACCAAGGAGGCTCAGAGCCGCTGTGGGG | | |
| 1706 | NM_0066 23.2_490 | 490 | GAGGAGGAGGAGGAGATGACTGGGGAGCGGGAG CTCGAGAATACTGCCCAGTTACTCTAGCGCGCCA GGCCGAACCGCAGCTTCTTGGCTTAGGTACTTCTA CTCACAGCGGCCGATTCCGAGGCCAACTCCAGCA ATGGCTTTTGCAAATCTGCGGAAAGTGCTCATCAG TGACAGCCTGGACCCTTGCTGCCGGAAGATCTTG CAAGATGGAGGGCTGCAGGTGGTGGAAAAGCAGA ACCTTAGCAAAGAGGAGCTGATAGCGGAGCTGCA GGACTGTGAAGGCCTTATTGTTCGCTCTGCCACCA AGGTGACCGCTGATGTCATCAACGCAGCTGAGAA ACTCCAGGTGGTGGGCAGGGCTGGCACAGGTGT GGACAATGTGGATCTGGAGGCCGCAACAAGGAAG GGCATCTTGGTTATGAACACCCCCAATGGGAACAG CCTCAGTGCCGCAGAACTCACTTGTGGAATGATCA TGTGCCTGGCAGGCAGATTCCCCAGGCGACGGCT TCGATGAAGGACGGCAAATGGGAGCGGAAGAAGT TCATGGGAACAGAGCTGAATGGAAAGACCCTGGG AATTCTTGGCCTGGGCAGGATTGGGAGAGAGGTA GCTACCCGGATGCAGTCCTTTGGGATGAAGACTAT AGGGTATGACCCCATCATTTCCCCAGAGGTCTCGG CCTCCTTTGGTGTTCAGCAGCTGCCCCTGGAGGA GATCTGGCCTCTCTGTGATTTCATCACTGTGCACA CTCCTCTCCTGCCCTCCACGACAGGCTTGCTGAAT GACAACACCTTTGCCCAGTGCAAGAAGGGGGTGC GTGTGGTGAACTGTGCCCGTGGAGGGATCGTGGA CGAAGGCGCCCTGCTCCGGGCCCTGCAGTCTGGC CAGTGTGCCGGGGCTGCACTGGACGTGTTTACGG AAGAGCCGCCACGGGACCGGGCCTTGGTGGACC ATGAGAATGTCATCAGCTGTCCCCACCTGGGTGCC AGCACCAAGGAGGCTCAGAGCCGCTGTGGGG | 9 | GRFPRRRL R* |
| 1707 | NM_0066 23.2_593 | 593 | GAGGAGGAGGAGGAGATGACTGGGGAGCGGGAG CTCGAGAATACTGCCCAGTTACTCTAGCGCGCCA GGCCGAACCGCAGCTTCTTGGCTTAGGTACTTCTA CTCACAGCGGCCGATTCCGAGGCCAACTCCAGCA ATGGCTTTTGCAAATCTGCGGAAAGTGCTCATCAG TGACAGCCTGGACCCTTGCTGCCGGAAGATCTTG CAAGATGGAGGGCTGCAGGTGGTGGAAAAGCAGA ACCTTAGCAAAGAGGAGCTGATAGCGGAGCTGCA GGACTGTGAAGGCCTTATTGTTCGCTCTGCCACCA AGGTGACCGCTGATGTCATCAACGCAGCTGAGAA ACTCCAGGTGGTGGGCAGGGCTGGCACAGGTGT GGACAATGTGGATCTGGAGGCCGCAACAAGGAAG GGCATCTTGGTTATGAACACCCCCAATGGGAACAG CCTCAGTGCCGCAGAACTCACTTGTGGAATGATCA TGTGCCTGGCAGGCAGATTCCCCAGGCGACGGC TTCGATGAAGGACGGCAAATGGGAGCGGAAGAAG TTCATGGGAACAGAGCTGAATGGAAAGACCCTGG GAATTCTTGGCTGGGCAGGATTGGGAGAGAGGTA GCTACCCGGATGCAGTCCTTTGGGATGAAGACTAT AGGGTATGACCCCATCATTTCCCCAGAGGTCTCGG CCTCCTTTGGTGTTCAGCAGCTGCCCCTGGAGGA GATCTGGCCTCTCTGTGATTTCATCACTGTGCACA CTCCTCTCCTGCCCTCCACGACAGGCTTGCTGAAT GACAACACCTTTGCCCAGTGCAAGAAGGGGGTGC GTGTGGTGAACTGTGCCCGTGGAGGGATCGTGGA CGAAGGCGCCCTGCTCCGGGCCCTGCAGTCTGGC CAGTGTGCCGGGGCTGCACTGGACGTGTTTACGG AAGAGCCGCCACGGGACCGGGCCTTGGTGGACC ATGAGAATGTCATCAGCTGTCCCCACCTGGGTGCC AGCACCAAGGAGGCTCAGAGCCGCTGTGGGG | 7 | WAGLGER* |
| 1708 | NM_0066 23.2_688 | 688 | GAGGAGGAGGAGGAGATGACTGGGGAGCGGGAG CTCGAGAATACTGCCCAGTTACTCTAGCGCGCCA GGCCGAACCGCAGCTTCTTGGCTTAGGTACTTCTA CTCACAGCGGCCGATTCCGAGGCCAACTCCAGCA ATGGCTTTTGCAAATCTGCGGAAAGTGCTCATCAG TGACAGCCTGGACCCTTGCTGCCGGAAGATCTTG CAAGATGGAGGGCTGCAGGTGGTGGAAAAGCAGA | 32 | PLVFSSCP WRRSGLS VISSLCTLL SCPPRQA C* |

TABLE 3A-continued

| SEQ ID | identifier_position | position | modified_RNA | PAP length | PAP |
|---|---|---|---|---|---|
| | | | ACCTTAGCAAAGAGGAGCTGATAGCGGAGCTGCA<br>GGACTGTGAAGGCCTTATTGTTCGCTCTGCCACCA<br>AGGTGACCGCTGATGTCATCAACGCAGCTGAGAA<br>ACTCCAGGTGGTGGGCAGGGCTGGCACAGGTGT<br>GGACAATGTGGATCTGGAGGCCGCAACAAGGAAG<br>GGCATCTTGGTTATGAACACCCCCAATGGGAACAG<br>CCTCAGTGCCGCAGAACTCACTTGTGGAATGATCA<br>TGTGCCTGGCCAGGCAGATTCCCCAGGCGACGGC<br>TTCGATGAAGGACGGCAAATGGGAGCGGAAGAAG<br>TTCATGGGAACAGAGCTGAATGGAAAGACCCTGG<br>GAATTCTTGGCCTGGGCAGGATTGGGAGAGAGGT<br>AGCTACCCGGATGCAGTCCTTTGGGATGAAGACTA<br>TAGGGTATGACCCCATCATTTCCCCAGAGGTCTCG<br>GCTCCTTTGGTGTTCAGCAGCTGCCCTGGAGGA<br>GATCTGGCCTCTCTGTGATTTCATCACTGTGCACA<br>CTCCTCTCCTGCCCTCCACGACAGGCTTGCTGAAT<br>GACAACACCTTTGCCCAGTGCAAGAAGGGGGTGC<br>GTGTGGTGAACTGTGCCCGTGGAGGGATCGTGGA<br>CGAAGGCGCCCTGCTCCGGGCCCTGCAGTCTGGC<br>CAGTGTGCCGGGGCTGCACTGGACGTGTTTACGG<br>AAGAGCCGCCACGGGACCGGGCCTTGGTGGACC<br>ATGAGAATGTCATCAGCTGTCCCCACCTGGGTGCC<br>AGCACCAAGGAGGCTCAGAGCCGCTGTGGGG | | |
| 1709 | NM_0066<br>23.2_713 | 713 | GAGGAGGAGGAGGAGATGACTGGGGAGCGGGAG<br>CTCGAGAATACTGCCCAGTTACTCTAGCGCGCCA<br>GGCCGAACCGCAGCTTCTTGGCTTAGGTACTTCTA<br>CTCACAGCGGCCGATTCCGAGGCCAACTCCAGCA<br>ATGGCTTTTGCAAATCTGCGGAAAGTGCTCATCAG<br>TGACAGCCTGGACCCTTGCTGCCGGAAGATCTTG<br>CAAGATGGAGGGCTGCAGGTGGTGGAAAAGCAGA<br>ACCTTAGCAAAGAGGAGCTGATAGCGGAGCTGCA<br>GGACTGTGAAGGCCTTATTGTTCGCTCTGCCACCA<br>AGGTGACCGCTGATGTCATCAACGCAGCTGAGAA<br>ACTCCAGGTGGTGGGCAGGGCTGGCACAGGTGT<br>GGACAATGTGGATCTGGAGGCCGCAACAAGGAAG<br>GGCATCTTGGTTATGAACACCCCCAATGGGAACAG<br>CCTCAGTGCCGCAGAACTCACTTGTGGAATGATCA<br>TGTGCCTGGCCAGGCAGATTCCCCAGGCGACGGC<br>TTCGATGAAGGACGGCAAATGGGAGCGGAAGAAG<br>TTCATGGGAACAGAGCTGAATGGAAAGACCCTGG<br>GAATTCTTGGCCTGGGCAGGATTGGGAGAGAGGT<br>AGCTACCCGGATGCAGTCCTTTGGGATGAAGACTA<br>TAGGGTATGACCCCATCATTTCCCCAGAGGTCTCG<br>GCTCCTTTGGTGTTCAGCAGCTGCCCTGGAGGA<br>GATCTGGCCTCTCTGTGATTTCATCACTGTGCACA<br>CTCCTCTCCTGCCCTCCACGACAGGCTTGCTGAAT<br>GACAACACCTTTGCCCAGTGCAAGAAGGGGGTGC<br>GTGTGGTGAACTGTGCCCGTGGAGGGATCGTGGA<br>CGAAGGCGCCCTGCTCCGGGCCCTGCAGTCTGGC<br>CAGTGTGCCGGGGCTGCACTGGACGTGTTTACGG<br>AAGAGCCGCCACGGGACCGGGCCTTGGTGGACC<br>ATGAGAATGTCATCAGCTGTCCCCACCTGGGTGCC<br>AGCACCAAGGAGGCTCAGAGCCGCTGTGGGG | 24 | WRRSGLS<br>VISSLCTLL<br>SCPPRQA<br>C* |
| 1710 | NM_0066<br>23.2_729 | 729 | GAGGAGGAGGAGGAGATGACTGGGGAGCGGGAG<br>CTCGAGAATACTGCCCAGTTACTCTAGCGCGCCA<br>GGCCGAACCGCAGCTTCTTGGCTTAGGTACTTCTA<br>CTCACAGCGGCCGATTCCGAGGCCAACTCCAGCA<br>ATGGCTTTTGCAAATCTGCGGAAAGTGCTCATCAG<br>TGACAGCCTGGACCCTTGCTGCCGGAAGATCTTG<br>CAAGATGGAGGGCTGCAGGTGGTGGAAAAGCAGA<br>ACCTTAGCAAAGAGGAGCTGATAGCGGAGCTGCA<br>GGACTGTGAAGGCCTTATTGTTCGCTCTGCCACCA<br>AGGTGACCGCTGATGTCATCAACGCAGCTGAGAA<br>ACTCCAGGTGGTGGGCAGGGCTGGCACAGGTGT<br>GGACAATGTGGATCTGGAGGCCGCAACAAGGAAG<br>GGCATCTTGGTTATGAACACCCCCAATGGGAACAG<br>CCTCAGTGCCGCAGAACTCACTTGTGGAATGATCA<br>TGTGCCTGGCCAGGCAGATTCCCCAGGCGACGGC<br>TTCGATGAAGGACGGCAAATGGGAGCGGAAGAAG<br>TTCATGGGAACAGAGCTGAATGGAAAGACCCTGG<br>GAATTCTTGGCCTGGGCAGGATTGGGAGAGAGGT<br>AGCTACCCGGATGCAGTCCTTTGGGATGAAGACTA<br>TAGGGTATGACCCCATCATTTCCCCAGAGGTCTCG<br>GCTCCTTTGGTGTTCAGCAGCTGCCCTGGAGG<br>AGATCTGGCTCTCTGTGATTTCATCACTGTGCACA<br>CTCCTCTCCTGCCCTCCACGACAGGCTTGCTGAAT<br>GACAACACCTTTGCCCAGTGCAAGAAGGGGGTGC | 19 | LSVISSLCT<br>LLSCPPRQ<br>AC* |

TABLE 3A-continued

| SEQ ID | identifier_position | position | modified_RNA | PAP length | PAP |
|---|---|---|---|---|---|
| | | | GTGTGGTGAACTGTGCCCGTGGAGGGATCGTGGA CGAAGGCGCCCTGCTCCGGGCCCTGCAGTCTGGC CAGTGTGCCGGGGCTGCACTGGACGTGTTTACGG AAGAGCCGCCACGGGACCGGGCCTTGGTGGACC ATGAGAATGTCATCAGCTGTCCCCACCTGGGTGCC AGCACCAAGGAGGCTCAGAGCCGCTGTGGGG | | |
| 1711 | NM_0066 36.3_350 | 350 | GGGGCCTGCCACGAGGCCGCAGTATAACCGCGT GGCCCGCGCGCGCTTCCCTCCCGGCGCAGTC ACCGGCGCGGTCTATGGCTGCGACTTCTCTAATGT CTGCTTTGGCTGCCCGGCTGCTGCAGCCCGCGCA CAGCTGCTCCCTTCGCCTTCGCCCTTTCCACCTCG CGGCAGTTCGAAATGAAGCTGTTGTCATTTCTGGA AGGAAACTGGCCCAGCAGATCAAGCAGGAAGTGC GGCAGGAGGTAGAAGAGTGGGTGGCCTCAGGCA ACAAACGGCCACACCTGAGTGTGATCCTGGTTGG CGAGAATCCTGCAAGTCACTCCTATGTCCTCAACA AAACCAGGCAGCTGCAGTTGTGGGAATCAACAGT GAGACAATTATGAAACCAGCTTCAATTTCAGAGGA AGAATTGTTGAATTTAATCAATAAACTGAATAATGA TGATAATGTAGATGGCCTCCTTGTTCAGTTGCCTC TTCCAGAGCATATTGATGAGAGAAGGATCTGCAAT GCTGTTTCTCCAGACAAGGATGTTGATGGCTTTCA TGTAATTAATGTAGGACGAATGTGTTTGGATCAGT ATTCCATGTTACCGGCTACTCCATGGGGTGTGTGG GAAATAATCAAGCGAACTGGCATTCCAACCCTAGG GAAGAATGTGGTTGTGGCTGGAAGGTCAAAAAAC GTTGGAATGCCCATTGCAATGTTACTGCACACAGA TGGGGCGCATGAACGTCCCGGAGGTGATGCCACT GTTACAATATCTCATCGATATACTCCCAAAGAGCA GTTGAAGAAACATACAATTCTTGCAGATATTGTAAT ATCTGCTGCAGGTATTCCAAATCTGATCACAGCAG ATATGATCAAGGAAGGAGCAGCAGTCATTGATGTG GGAATAAATAGAGTTCACGATCCTGTAACTGCCAA ACCCAAGTTGGTTGGAGATGTGGATTTTGAAGGAG TCAGACAAAAAGCTGGGTATATCACTCCAGTTCCT GGAGGTGTTGGCCCCATGA | 12 | QLQLWEST VRQL* |
| 1712 | NM_0067 00.1_457 | 457 | TGCAGCTAGTGTGTCAACTCAGCGTTTCTCCTCTC GTCCCTGGAAGAGCTAAAGATGGCTGAATTTCTAG ATGACCAGGAAACTCGACTGTGTGACAACTGCAAA AAAGAAATTCCTGTGTTTAACTTTACCATCCATGAG ATCCACTGTCAAAGGAACATTGGTATGTGTCCTAC CTGTAAGGAACCATTTCCCAAATCTGACATGGAGA CTCACATGGCTGCAGAACACTGTCAGGTGACCTG CAAATGTAACAAGAAGTTGGAGAAGAGGCTGTTAA AGAAGCATGAGGAGACTGAGTGCCCTTTGCGGCT TGCTGTCTGCCAGCACTGTGATTTAGAACTTTCCA TTCTCAAACTGAAGGAACATGAAGATTATTGTGGT GCCCGGACGGAACTATGTGGCAACTGTGGTCGCA ATGTCCTTGTGAAAGATCTGAAGACTCACCCTGAA GTTGTGGGAGAGAGGGGGAGGAAAAAGAGAAATGA GGTTGCCATACCTCCTAATGCATATGATGAATCTT GGGGTCAGGATGGAATCTGGATTGCATCCCAACT CCTCAGACAAATTGAGGCTCTGGACCCACCCATGA GGCTGCCGCGAAGGCCCCTGAGAGCCTTTGAATC AGATGTTTTCCACAATAGAACTACCAACCAAAGGA ACATTACAGCCCAGGTTTCAATTCAGAATAATCTGT TTGAAGAACAAGAGAGGCAGGAAAGGAATAGAGG CCAACAGCCCCCCAAAGAGGGTGGTGAAGAGAGT GCAAACTTGGACTTCATGTTGGCCCTAAGTCTGCA AAATGAAGGCCAAGCCTCCAGTGTGGCAGAGCAG GACTTCTGGAGGGCCGTATGTGAGGCCGACCAGT CTCATGGCGGTCCCAGGTCTCTCAGTGACATAAAG GGTGCAGCTGACGAGATCATGTTGCCTTGTGAATT TTGTGAGGAGCTCTACCCAGAGGAACTGCTGATTG ACCATCAGACAAGCTGTAACCCTTCACGTGCCTTA CCTTCACTCAATACTGG | 44 | VGERGRK REMRLPYL LMHMMNL GVRMESG LHPNSSDK LRLWTHP* |
| 1713 | NM_0067 04.2_574 | 574 | GAGGTGGTAACCGTGATAGTAGCAGCTCCGGCGG CAGCAACAGCGACTACGAGGGATGGCGGCGGCT GCAGCAGGAACTGCAACATCCCAGAGGTTTTTCCA GAGCTTCTCGGATGCCCTAATCGACGAGGACCCC CAGGCGGCGTTAGAGGAGCTGACTAAGGCTTTGG AACAGAAACCAGATGATGCACAGTATTATTGTCAA AGAGCTTATTGTCACATTCTTCTTGGGAATTACTGT GTTGCTGTTGCTGATGCAAAGAAGTCTCTAGAACT CAATCCAAATAATTCCACTGCTATGCTGAGAAAAG GAATATGTGAATACCATGAAAAAAACTATGCTGCT GCCCTAGAAACTTTTACAGAAGGACAAAAATTAGA | 15 | DCLLWLNF LLERITI* |

TABLE 3A-continued

| SEQ ID | identifier_position | position | modified_RNA | PAP length | PAP |
|---|---|---|---|---|---|
| | | | TAGTGCAGATGCTAATTTCAGTGTCTGGATTAAAA<br>GGTGTCAAGAAGCTCAGAATGGCTCAGAATCTGA<br>GGTGTGGACTCATCAGTCAAAAATCAAGTATGACT<br>GGTATCAAACAGAATCTCAAGTAGTCATTACACTTA<br>TGATCAAGAATGTTCAGAAGAATGATGTAAATGTG<br>GAATTTTCAGAAAAAGATTGTCTGCTTTGGTTAAAC<br>TTCCTTCTGGAGAGGATTACAATTTGAAACTGGAA<br>CTTCTTCATCCTATAATACCAGAACAGAGCACGTTT<br>AAAGTACTTTCAACAAAGATTGAAATTAAACTGAAA<br>AAGCCAGAGGCTGTGAGATGGGAAAAGCTAGAGG<br>GGCAAGGAGATGTGCCTACGCCAAAACAATTCGTA<br>GCAGATGTAAAGAACCTATATCCATCATCATCTCCT<br>TATACAAGAAATTGGGATAAATTGGTTGGTGAGAT<br>CAAAGAAGAAGAAAAGAATGAAAAGTTGGAGGGA<br>GATGCAGCTTTAAACAGATTATTTCAGCAGATCTAT<br>TCAGATGGTTCTGATGAAGTGAAACGTGCCATGAA<br>CAAATCCTTTATGGAGTCGGGTGGTACAGTTTTGA<br>GTACCAACTGGTCTGATGTAGGTAAAAGGAAAGTT<br>GAAATCAATC | | |
| 1714 | NM_0067<br>39.3_568 | 568 | ACCGCCTCTTGTTTTTCCCGCGAAACTCGGCGGCT<br>GAGCGTGGAGGTTCTTGTCTCCCCTGGTTTGTGAA<br>GTGCGGAAAACCAGAGGCGCAGTCATGTCGGGAT<br>TCGACGATCCTGGCATTTTCTACAGCGACAGCTTC<br>GGGGGCGACGCCCAGGCCGACGAGGGGCAGGC<br>CCGCAAATCGCAGCTGCAGAGGCGCTTCAAGGAG<br>TTCCTGCGGCAGTACCGAGTGGGCACCGACCGCA<br>CGGGCTTCACCTTCAAATACAGGGATGAACTCAAG<br>CGGCATTACAACCTGGGGGAGTACTGGATTGAGG<br>TGGAGATGGAGGATCTGGCCAGCTTTGATGAGGA<br>CCTGGCCGACTACTTGTACAAGCAGCCAGCCGAG<br>CACCTGCAGCTGCTGGAGGAAGCTGCCAAGGAGG<br>TAGCTGATGAGGTGACCCGGCCCCGGCCTTCTGG<br>GGAGGAGGTGCTCCAGGACATCCAGGTCATGCTC<br>AAGTCGGACGCCAGCCCTTCCAGCATTCGTAGCC<br>TGAAGTCGGACATGATGTCACACCTGGTGAAGATC<br>CCTGGCATCATCATCGCGGCTCTGCGGTCCGTGC<br>CAAGGCCACCCGCATCTCTATCCAGTGCCGCAGC<br>TGCCGCAACACCCTCACCAACATTGCCATGCGCC<br>CTGGCCTCGAGGGCTATGCCCTGCCCAGGAAGTG<br>CAACACAGATCAGGCTGGGCGCCCAAATGCCCA<br>TTGGACCCGTACTTCATCATGCCCGACAAATGCAA<br>ATGCGTGGACTTCCAGACCCTGAAGCTGCAGGAG<br>CTGCCTGATGCAGTCCCCACGGGGAGATGCCCA<br>GACACATGCAGCTCTACTGCGACAGGTACCTGTGT<br>GACAAGGTCGTCCCTGGGAACAGGGTTACCATCA<br>TGGGCATCTACTCCATCAAGAAGTTTGGCCTGACT<br>ACCAGCAGGGGCCGTGACAGGGTGGGCGTGGGC<br>ATCCGAAGCTCCTACATCCGTGTCCTGGGCATCCA<br>GGTGGACACAGATGGCTCTGGCCGCAGCTTTG | 68 | LRSVPRPP<br>ASLSSAAA<br>AATPSPTL<br>PCALASRA<br>MPCPGSA<br>TQIRLGAP<br>NAHWTRT<br>SSCPTNAN<br>AWTSRP* |
| 1715 | NM_0067<br>43.3_250 | 250 | GGGAACGTTCCGGGACGTTCTCGCTACGTACTCTT<br>TATCAATCGTCTTCCGGCGCAGCCCCGTCCCTGTT<br>TTTTGTGCTCCTCCGAGCTCGCTGTTCGTCCGGGT<br>TTTTTACGTTTAAATTTCCAGGACTTGAACTGCCAT<br>GTCCTCTGAAGAAGGAAAGCTCTTCGTGGGAGGG<br>CTCAACTTTAACACCGACGAGCAGGCACTGGAAG<br>ACCACTTCAGCAGTTTCGGACCTATCTCTGAGGTG<br>GTCGTGTCAAGGACCGGGAGACTCAGCGGTCCAG<br>GGGTTTTGGTTTCATCACCTTCACCAACCCAGAGC<br>ATGCTTCAGTTGCCATGAGAGCCATGAACGGAGA<br>GTCTCTGGATGGTCGTCAGATCCGTGTGGATCATG<br>CAGGCAAGTCTGCTCGGGGAACCAGAGGAGGTG<br>GCTTTGGGGCCCATGGGCGTGGTCGCAGCTACTC<br>TAGAGGTGGTGGGGACCAGGGCTATGGGAGTGG<br>CAGGTATTATGACAGTCGACCTGGAGGGTATGGAT<br>ATGGATATGGACGTTCCAGAGACTATAATGGCAGA<br>AACCAGGGTGGTTATGACCGCTACTCAGGAGGAA<br>ATTACAGAGACAATTATGACAACTGAAATGAGACA<br>TGCACATAATATAGATACACAAGGAATAATTTCTGA<br>TCCAGGATCGTCCTTCCAAATGGCTGTATTTATAAA<br>GGTTTTTGGAGCTGCACCGAAGCATCTTATTTTATA<br>GTATATCAACCTTTTGTTTTTAAATTGACCTGCCAA<br>GGTAGCTGAAGACCTTTTAGACAGTTCCATCTTTTT<br>TTTTAAATTTTTTCTGCCTATTTAAAGACAAATTATG<br>GGACGTTTGTAGAACCTGAGTATTTTTCTTTTTACC<br>AGTTTTTTAGTTTGAGCTCTTAGGTTTATTGGAGCT<br>AGCAATAATTGGTTCTGGCAAGTTTGGCCAGACTG<br>ACTTCAAAAAATTAATGTGTATCCAGGGACATTTTA | 26 | SRTGRLSG<br>PGVLVSSP<br>SPTQSMLQ<br>LP* |

TABLE 3A-continued

| SEQ ID | identifier_position | position | modified_RNA | PAP length | PAP |
|---|---|---|---|---|---|
| | | | AAAACCTGTACACAGTGTTTATTGTGGTTAGGAAGCAATTTCC | | |
| 1716 | NM_0067 43.3_282 | 282 | GGGAACGTTCCGGGACGTTCTCGCTACGTACTCTT TATCAATCGTCTTCCGGCGCAGCCCCGTCCCTGTT TTTTGTGCTCCTCCGAGCTCGCTGTTCGTCCGGGT TTTTTACGTTTTAATTTCCAGGACTTGAACTGCCAT GTCCTCTGAAGAAGGAAAGCTCTTCGTGGGAGGG CTCAACTTTAACACCGACGAGCAGGCACTGGAAG ACCACTTCAGCAGTTTCGGACCTATCTCTGAGGTG GTCGTTGTCAAGGACCGGGAGACTCAGCGGTCCA GGGTTTTGGTTTCATCACCTTCACCAACCCAGAGC ATGCTTCAGTTGCCATGAGAGCCATGAACGGAGA GTCTCTGGATGGTCGTCAGATCCGTGTGGATCATG CAGGCAAGTCTGCTCGGGGAACCAGAGGAGGTG GCTTTGGGGCCCATGGGCGTGGTCGCAGCTACTC TAGAGGTGGTGGGGACCAGGGCTATGGGAGTGG CAGGTATTATGACAGTCGACCTGGAGGGTATGGAT ATGGATATGGACGTTCCAGAGACTATAATGGCAGA AACCAGGGTGGTTATGACCGCTACTCAGGAGGAA ATTACAGAGACAATTATGACAACTGAAATGAGACA TGCACATAATATAGATACACAAGGAATAATTTCTGA TCCAGGATCGTCCTTCCAAATGGCTGTATTTATAAA GGTTTTTGGAGCTGCACCGAAGCATCTTATTTTATA GTATATCAACCTTTTGTTTTTAAATTGACCTGCCAA GGTAGCTGAAGACCTTTTAGACAGTTCCATCTTTTT TTTTAAATTTTTTCTGCCTATTTAAAGACAAATTATG GGACGTTTGTAGAACCTGAGTATTTTTCTTTTTACC AGTTTTTTAGTTTGAGCTCTTAGGTTTATTGGAGCT AGCAATAATTGGTTCTGGCAAGTTTGGCCAGACTG ACTTCAAAAAATTAATGTGTATCCAGGGACATTTTA AAAACCTGTACACAGTGTTTATTGTGGTTAGGAAGCAATTTCC | 16 | VLVSSPSP TQSMLQLP* |
| 1717 | NM_0067 43.3_286 | 286 | GGGAACGTTCCGGGACGTTCTCGCTACGTACTCTT TATCAATCGTCTTCCGGCGCAGCCCCGTCCCTGTT TTTTGTGCTCCTCCGAGCTCGCTGTTCGTCCGGGT TTTTTACGTTTTAATTTCCAGGACTTGAACTGCCAT GTCCTCTGAAGAAGGAAAGCTCTTCGTGGGAGGG CTCAACTTTAACACCGACGAGCAGGCACTGGAAG ACCACTTCAGCAGTTTCGGACCTATCTCTGAGGTG GTCGTTGTCAAGGACCGGGAGACTCAGCGGTCCA GGGGTTTGGTTTCATCACCTTCACCAACCCAGAGC ATGCTTCAGTTGCCATGAGAGCCATGAACGGAGA GTCTCTGGATGGTCGTCAGATCCGTGTGGATCATG CAGGCAAGTCTGCTCGGGGAACCAGAGGAGGTG GCTTTGGGGCCCATGGGCGTGGTCGCAGCTACTC TAGAGGTGGTGGGGACCAGGGCTATGGGAGTGG CAGGTATTATGACAGTCGACCTGGAGGGTATGGAT ATGGATATGGACGTTCCAGAGACTATAATGGCAGA AACCAGGGTGGTTATGACCGCTACTCAGGAGGAA ATTACAGAGACAATTATGACAACTGAAATGAGACA TGCACATAATATAGATACACAAGGAATAATTTCTGA TCCAGGATCGTCCTTCCAAATGGCTGTATTTATAAA GGTTTTTGGAGCTGCACCGAAGCATCTTATTTTATA GTATATCAACCTTTTGTTTTTAAATTGACCTGCCAA GGTAGCTGAAGACCTTTTAGACAGTTCCATCTTTTT TTTTAAATTTTTTCTGCCTATTTAAAGACAAATTATG GGACGTTTGTAGAACCTGAGTATTTTTCTTTTTACC AGTTTTTTAGTTTGAGCTCTTAGGTTTATTGGAGCT AGCAATAATTGGTTCTGGCAAGTTTGGCCAGACTG ACTTCAAAAAATTAATGTGTATCCAGGGACATTTTA AAAACCTGTACACAGTGTTTATTGTGGTTAGGAAGCAATTTCC | 15 | LVSSPSPT QSMLQLP* |
| 1718 | NM_0067 43.3_471 | 471 | GGGAACGTTCCGGGACGTTCTCGCTACGTACTCTT TATCAATCGTCTTCCGGCGCAGCCCCGTCCCTGTT TTTTGTGCTCCTCCGAGCTCGCTGTTCGTCCGGGT TTTTTACGTTTTAATTTCCAGGACTTGAACTGCCAT GTCCTCTGAAGAAGGAAAGCTCTTCGTGGGAGGG CTCAACTTTAACACCGACGAGCAGGCACTGGAAG ACCACTTCAGCAGTTTCGGACCTATCTCTGAGGTG GTCGTTGTCAAGGACCGGGAGACTCAGCGGTCCA GGGGTTTTGGTTTCATCACCTTCACCAACCCAGAG CATGCTTCAGTTGCCATGAGAGCCATGAACGGAG AGTCTCTGGATGGTCGTCAGATCCGTGTGGATCAT GCAGGCAAGTCTGCTCGGGGAACCAGAGGAGGT GGCTTTGGGGCCCATGGGCGTGGTCGCAGCTACT CTAGAGGTGGTGGGGACCAGGGCTATGGGAGTGG CAGGTATTATGACAGTCGACCTGGAGGGTATGGAT | 86 | AMGVAGIM TVDLEGMD MDMDVPE TIMAETRV VMTATQEE ITETIMTTE MRHAHNID TQGIISDPG SSFQMAVF IKVFGAAP KHLIL* |

TABLE 3A-continued

| SEQ ID | identifier_position | position | modified_RNA | PAP length | PAP |
|---|---|---|---|---|---|
| | | | ATGGATATGGACGTTCCAGAGACTATAATGGCAGA AACCAGGGTGGTTATGACCGCTACTCAGGAGGAA ATTACAGAGACAATTATGACAACTGAAATGAGACA TGCACATAATATAGATACACAAGGAATAATTTCTGA TCCAGGATCGTCCTTCCAAATGGCTGTATTTATAAA GGTTTTTGGAGCTGCACCGAAGCATCTTATTTTATA GTATATCAACCTTTTGTTTTTAAATTGACCTGCCAA GGTAGCTGAAGACCTTTTAGACAGTTCCATCTTTTT TTTTAAATTTTTTCTGCCTATTTAAAGACAAATTATG GGACGTTTGTAGAACCTGAGTATTTTTCTTTTTACC AGTTTTTTAGTTTGAGCTCTTAGGTTTATTGGAGCT AGCAATAATTGGTTCTGGCAAGTTTGGCCAGACTG ACTTCAAAAAATTAATGTGTATCCAGGGACATTTTA AAAACCTGTACACAGTGTTTATTGTGGTTAGGAAG CAATTTCC | | |
| 1719 | NM_0067 43.3_561 | 561 | GGGAACGTTCCGGGACGTTCTCGCTACGTACTCTT TATCAATCGTCTTCCGGCGCAGCCCCGTCCCTGTT TTTTGTGCTCCTCCGAGCTCGCTGTTCGTCCGGGT TTTTTACGTTTTAAATTTCCAGGACTTGAACTGCCAT GTCCTCTGAAGAAGGAAAGCTCTTCGTGGGAGGG CTCAACTTTAACACCGACGAGCAGGCACTGGAAG ACCACTTCAGCAGTTTCGGACCTATCTCTGAGGTG GTCGTTGTCAAGGACCGGGAGACTCAGCGGTCCA GGGGTTTTGGTTTCATCACCTTCACCAACCCAGAG CATGCTTCAGTTGCCATGAGAGCCATGAACGGAG AGTCTCTGGATGGTCGTCAGATCCGTGTGGATCAT GCAGGCAAGTCTGCTCGGGGAACCAGAGGAGGT GGCTTTGGGGCCCATGGGCGTGGTCGCAGCTACT CTAGAGGTGGTGGGGACCAGGGCTATGGGAGTG GCAGGTATTATGACAGTCGACCTGGAGGGTATGG ATATGGATATGGACGTTCCAGAGACTATAATGGCA GAAACCAGGTGGTTATGACCGCTACTCAGGAGGA AATTACAGAGACAATTATGACAACTGAAATGAGAC ATGCACATAATATAGATACACAAGGAATAATTTCTG ATCCAGGATCGTCCTTCCAAATGGCTGTATTTATAA AGGTTTTTGGAGCTGCACCGAAGCATCTTATTTTAT AGTATATCAACCTTTTGTTTTTAAATTGACCTGCCA AGGTAGCTGAAGACCTTTTAGACAGTTCCATCTTTT TTTTTAAATTTTTTCTGCCTATTTAAAGACAAATTAT GGGACGTTTGTAGAACCTGAGTATTTTTCTTTTTAC CAGTTTTTTAGTTTGAGCTCTTAGGTTTATTGGAGC TAGCAATAATTGGTTCTGGCAAGTTTGGCCAGACT GACTTCAAAAAATTAATGTGTATCCAGGGACATTTT AAAAACCTGTACACAGTGTTTATTGTGGTTAGGAA GCAATTTCC | 56 | VVMTATQE EITETIMTT EMRHAHNI DTQGIISDP GSSFQMA VFIKVFGA APKHLIL* |
| 1720 | NM_0067 43.3_574 | 574 | GGGAACGTTCCGGGACGTTCTCGCTACGTACTCTT TATCAATCGTCTTCCGGCGCAGCCCCGTCCCTGTT TTTTGTGCTCCTCCGAGCTCGCTGTTCGTCCGGGT TTTTTACGTTTTAAATTTCCAGGACTTGAACTGCCAT GTCCTCTGAAGAAGGAAAGCTCTTCGTGGGAGGG CTCAACTTTAACACCGACGAGCAGGCACTGGAAG ACCACTTCAGCAGTTTCGGACCTATCTCTGAGGTG GTCGTTGTCAAGGACCGGGAGACTCAGCGGTCCA GGGGTTTTGGTTTCATCACCTTCACCAACCCAGAG CATGCTTCAGTTGCCATGAGAGCCATGAACGGAG AGTCTCTGGATGGTCGTCAGATCCGTGTGGATCAT GCAGGCAAGTCTGCTCGGGGAACCAGAGGAGGT GGCTTTGGGGCCCATGGGCGTGGTCGCAGCTACT CTAGAGGTGGTGGGGACCAGGGCTATGGGAGTG GCAGGTATTATGACAGTCGACCTGGAGGGTATGG ATATGGATATGGACGTTCCAGAGACTATAATGGCA GAAACCAGGGTGGTTATGACCGCTACTCAGGAGGA AATTACAGAGACAATTATGACAACTGAAATGAGAC ATGCACATAATATAGATACACAAGGAATAATTTCTG ATCCAGGATCGTCCTTCCAAATGGCTGTATTTATAA AGGTTTTTGGAGCTGCACCGAAGCATCTTATTTTAT AGTATATCAACCTTTTGTTTTTAAATTGACCTGCCA AGGTAGCTGAAGACCTTTTAGACAGTTCCATCTTTT TTTTTAAATTTTTTCTGCCTATTTAAAGACAAATTAT GGGACGTTTGTAGAACCTGAGTATTTTTCTTTTTAC CAGTTTTTTAGTTTGAGCTCTTAGGTTTATTGGAGC TAGCAATAATTGGTTCTGGCAAGTTTGGCCAGACT GACTTCAAAAAATTAATGTGTATCCAGGGACATTTT AAAAACCTGTACACAGTGTTTATTGTGGTTAGGAA GCAATTTCC | 51 | TQEEITETI MTTEMRH AHNIDTQGI ISDPGSSF QMAVFIKV FGAAPKHL IL* |

TABLE 3A-continued

| SEQ ID | identifier_position | position | modified_RNA | PAP length | PAP |
|---|---|---|---|---|---|
| 1721 | NM_0067 55.1_314 | 314 | CGCGCCCGTCCCGTCGCCGCCGCCGCCGCCGCA GACCCCTCGGTCTTGCTATGTCGAGCTCACCCGT GAAGCGTCAGAGGATGGAGTCCGCGCTGGACCAG CTCAAGCAGTTCACCACCGTGGTGGCCGACACGG GCGACTTCCACGCCATCGACGAGTACAAGCCCCA GGATGCTACCACCAACCCGTCCCTGATCCTGGCC GCAGCACAGATGCCCGCTTACCAGGAGCTGGTGG AGGAGGCGATTGCCTATGGCCGGAAGCTGGGCG GGTCACAAGAGGACCAGATTAAAAATGCTATTGAT AAACTTTTGTGTTGTTTGGAGCAGAAATACTAAAGA AGATTCCGGGCCGAGTATCCACAGAAGTAGACGC AAGGCTCTCCTTTGATAAAGATGCGATGGTGGCCA GAGCCAGGCGGCTCATCGAGCTCTACAAGGAAGC TGGGATCAGCAAGGACCGAATTCTTATAAAGCTGT CATCAACCTGGGAAGGAATTCAGGCTGGAAAGGA GCTCGAGGAGCAGCACGGCATCCACTGCAACATG ACGTTACTCTTCTCCTTCGCCCAGGCTGTGGCCTG TGCCGAGGCGGGTGTGACCCTCATCTCCCCATTT GTTGGGCGCATCCTTGATTGGCATGTGGCAAACAC CGACAAGAAATCCTATGAGCCCCTGGAAGACCCT GGGGTAAAGAGTGTCACTAAAATCTACAACTACTA CAAGAAGTTTAGCTACAAAACCATTGTCATGGGCG CCTCCTTCCGCAACACGGGCGAGATCAAAGCACT GGCCGGCTGTGACTTCCTCACCATCTCACCCAAG CTCCTGGGAGAGCTGCTGCAGGACAACGCCAAGC TGGTGCCTGTGCTCTCAGCCAAGGCGGCCCAAGC CAGTGACCTGGAAAAAAATCCACCTGGATGAGAAGT CTTTCCGTTGGTTGCACAACGAGGACCAGATGGCT GTGGAGAAGCTCTCTGACGGGATCCGCAAGTTTG CCGCTGATGCAGTGAAGCTGGAGCGGATG | 8 | LCCLEQKY* |
| 1722 | NM_0067 61.3_518 | 518 | CGGATTGAGGCGCCGCCATTTTTGCTGCCCGGAC GCGGAGCGAGAGGCTGAGAGAGTCGGAGACACT ATCCGCTTCCATCCGTCGCGCAGACCCTGCCGGA GCCGCTGCCGCTATGGATGATCGAGAGGATCTGG TGTACCAGGCGAAGCTGGCCGAGCAGGCTGAGC GATACGACGAAATGGTGGAGTCAATGAAGAAAGTA GCAGGGATGGATGTGGAGCTGACAGTTGAAGAAA GAAACCTCCTATCTGTTGCATATAAGAATGTGATTG GAGCTAGAAGAGCCTCCTGGAGAATAATCAGCAG CATTGAACAGAAAGAAGAAAACAAGGGAGGAGAA GACAAGCTAAAAATGATTCGGGAATATCGGCAAAT GGTTGAGACTGAGCTAAAGTTAATCTGTTGTGACA TTCTGGATGTACTGGACAAACACCTCATTCCAGCA GCTAACACTGGCGAGTCCAAGGTTTTCTATTATAA AATGAAAGGGGACTACCACAGGTATCTGGCAGAAT TGCCACAGGAAACGACAGGAAGGAGGCTGCGGA GAACAGCCTAGTGGCTTATAAAGCTGCTAGTGATA TTGCAATGACAGAACTTCCACCAACGCATCCTATT CGCTTAGGTCTTGCTCTCAATTTTTTCCGTATTCTAC TACGAAATTCTTAATTCCCCTGACCGTGCCTGCAG GTTGGCAAAAGCAGCTTTTGATGATGCAATTGCAG AACTGGATACGCTGAGTGAAGAAAGCTATAAGGAC TCTACACTTATCATGCAGTTGTTACGTGATAATCTG ACACTATGGACTTCAGACATGCAGGGTGACGGTG AAGAGCAGAATAAAGAAGCGCTGCAGGACGTGGA AGACGAAAATCAGTGAGACATAAGCCAACAAGAGA AACCATCTCTGACCACCCCCTCCTCCCCATCCCAC CCTTTGGAAACTCCCCATTGTCACTGAGAACCACC AAATCTGACTTTTACATTTGGTCTCAGAATTTAGGT TCCTGCCCTGTTGGTTTTT | 14 | LPQETTGR RLRRTA* |
| 1723 | NM_0067 61.3_587 | 587 | CGGATTGAGGCGCCGCCATTTTTGCTGCCCGGAC GCGGAGCGAGAGGCTGAGAGAGTCGGAGACACT ATCCGCTTCCATCCGTCGCGCAGACCCTGCCGGA GCCGCTGCCGCTATGGATGATCGAGAGGATCTGG TGTACCAGGCGAAGCTGGCCGAGCAGGCTGAGC GATACGACGAAATGGTGGAGTCAATGAAGAAAGTA GCAGGGATGGATGTGGAGCTGACAGTTGAAGAAA GAAACCTCCTATCTGTTGCATATAAGAATGTGATTG GAGCTAGAAGAGCCTCCTGGAGAATAATCAGCAG CATTGAACAGAAAGAAGAAAACAAGGGAGGAGAA GACAAGCTAAAAATGATTCGGGAATATCGGCAAAT GGTTGAGACTGAGCTAAAGTTAATCTGTTGTGACA TTCTGGATGTACTGGACAAACACCTCATTCCAGCA GCTAACACTGGCGAGTCCAAGGTTTTCTATTATAA AATGAAAGGGGACTACCACAGGTATCTGGCAGAAT TGCCACAGGAAACGACAGGAAGGAGGCTGCGGA GAACAGCCTAGTGGCTTATAAAGCTGCTAGTGATA | 2 | MQ* |

TABLE 3A-continued

| SEQ ID | identifier_position | position | modified_RNA | PAP length | PAP |
|---|---|---|---|---|---|
| | | | TGCAATGACAGAACTTCCACCAACGCATCCTATTC GCTTAGGTCTTGCTCTCAATTTTTCCGTATTCTACT ACGAAATTCTTAATTCCCCTGACCGTGCCTGCAGG TTGGCAAAAGCAGCTTTTGATGATGCAATTGCAGA ACTGGATACGCTGAGTGAAGAAAGCTATAAGGACT CTACACTTATCATGCAGTTGTTACGTGATAATCTGA CACTATGGACTTCAGACATGCAGGGTGACGGTGA AGAGCAGAATAAAGAAGCGCTGCAGGACGTGGAA GACGAAAATCAGTGAGACATAAGCCAACAAGAGAA ACCATCTCTGACCACCCCCTCCTCCCCATCCCACC CTTTGGAAACTCCCCATTGTCACTGAGAACCACCA AATCTGACTTTTACATTTGGTCTCAGAATTTAGGTT CCTGCCCTGTTGGTTTTT | | |
| 1724 | NM_0067 61.3_710 | 710 | CGGATTGAGGCGCCGCCATTTTTGCTGCCCGGAC GCGGAGCGAGAGGCTGAGAGAGTCGGAGACACT ATCCGCTTCCATCCGTCGCGCAGACCCTGCCGGA GCCGCTGCCGCTATGGATGATCGAGAGGATCTGG TGTACCAGGCGAAGCTGGCCGAGCAGGCTGAGC GATACGACGAAATGGTGGAGTCAATGAAGAAAGTA GCAGGGATGGATGTGGAGCTGACAGTTGAAGAAA GAAACCTCCTATCTGTTGCATATAAGAATGTGATTG GAGCTAGAAGAGCCTCCTGGAGAATAATCAGCAG CATTGAACAGAAAGAAGAAAACAAGGGAGGAGAA GACAAGCTAAAAATGATTCGGGAATATCGGCAAAT GGTTGAGACTGAGCTAAAGTTAATCTGTTGTGACA TTCTGGATGTACTGGACAAACACCTCATTCCAGCA GCTAACACTGGCGAGTCCAAGGTTTTCTATTATAA AATGAAAGGGGACTACCACAGGTATCTGGCAGAAT TTGCCACAGGAAACGACAGGAAGGAGGCTGCGGA GAACAGCCTAGTGGCTTATAAAGCTGCTAGTGATA TTGCAATGACAGAACTTCCACCAACGCATCCTATT CGCTTAGGTCTTGCTCTCAATTTTTCCGTATTCTAC TACGAAATTCTTAATTCCCCTGACCGTGCCTGCAG GTTGGCAAAAGCAGCTTTTGATGATGCAATTGCAGA ACTGGATACGCTGAGTGAAGAAAGCTATAAGGACT CTACACTTATCATGCAGTTGTTACGTGATAATCTGA CACTATGGACTTCAGACATGCAGGGTGACGGTGA AGAGCAGAATAAAGAAGCGCTGCAGGACGTGGAA GACGAAAATCAGTGAGACATAAGCCAACAAGAGAA ACCATCTCTGACCACCCCCTCCTCCCCATCCCACC CTTTGGAAACTCCCCATTGTCACTGAGAACCACCA AATCTGACTTTTACATTTGGTCTCAGAATTTAGGTT CCTGCCCTGTTGGTTTTT | 10 | LMMQLQN WIR* |
| 1725 | NM_0067 64.3_495 | 495 | CGTGGATGTGGGCCTGAATCGGATGGCCTGGAAC TCGCCTTCCCGGCGACCTGTTTGGCAGGGCGGGG CGCCTCGCGAAGATGGTGGCGCGCGTGGCGTGT GGCTCCCGTCGTCTGGCCAAGTCTCAGCGCAGCG CACCGGCCGGCGTCTCGTTGGCCTGGAGCCCACA CCCACCGGGTCCCTGACCCCGCGCCCCCCGCGC CCGGTTCCCGGCATGCCTCGCGCCCGTAAGGGCA ACACGCTCCGGAAGGGTGGTCAGCGCCGTGGAG GAGGTGCCCGGAGCAGTGCCCAAGCTGACTCGG GTTCCAGTGACGATGAGGCAGCCAGTGAGGCCCG CAGCACCGCCAGTGAATGCCCCAGCCTTCTCAGC ACCACTGCAGAGGACAGCCTTGGGGGGGATGTCG TGGATGAGCAGGGCCAGCAGGAAGACCTTGAGGA AAAGCTGAAGGAGTATGTGGACTGTCTCACAGACA AGAGTGCCAAGACCCGGCAGGTGCTCTTGAGAGC CTGCGCCTGGCCCTAGCGTCCCGCCTACTCCCCG ACTTCTTGCTGGAGCGCCGCCTCACGCTAGCCGA TGCCCTGGAAAAGTGCCTCAAGAAAGGGAAGGGC GAGGAACAAGCCCTGGCTGCTGCTGTGCTAGGCC TGCTCTGCGTGCAGCTGGGCCCTGGACCTAAGGG TGAGGAGCTGTTTCACAGCCTGCAGCCTCTGCTG GTCTCTGTGCTCAGTGACAGCACAGCTAGCCCTG CTGCCCGGCTCCACTGTGCTTCTGCCCTTGGCCT GGGCTGCTACGTGGCTGCCGCTGACATCCAGGAC CTGGTCTCTCTTGCCTTGCCTGCTTAGAAAGTGTTTT CAGCCGGTTCTATGGCTTGGGGGGCAGCTCCACA AGTCCTGTGGTTCCTGCCAGCCTGCACGGCCTGC TCTCTGCTGCCCTGCAGGCCTGGGCATTGCTGCT CACCCATCTGCCCTAGCACCCAAATCAGCCACATCC TTGACAGGCAGCTGCCCCGGCTGCCCCAGCTCTT GTCCA | 9 | VLLRACAW P* |
| 1726 | NM_0067 64.3_563 | 563 | CGTGGATGTGGGCCTGAATCGGATGGCCTGGAAC TCGCCTTCCCGGCGACCTGTTTGGCAGGGCGGGG CGCCTCGCGAAGATGGTGGCGCGCGTGGCGTGT | 2 | SR* |

TABLE 3A-continued

| SEQ ID | identifier_position | position | modified_RNA | PAP length | PAP |
|---|---|---|---|---|---|
| | | | GGCTCCCGTCGTCTGGCCAAGTCTCAGCGCAGCG CACCGGCCGGCGTCTCGTTGGCCTGGAGCCCACA CCCACCGGGTCCCTGACCCCGCGCCCCCCGCGC CCGGTTCCCGGCATGCCTCGCGCCCGTAAGGGCA ACACGCTCCGGAAGGGTGGTCAGCGCCGTGGAG GAGGTGCCCGGAGCAGTGCCCAAGCTGACTCGG GTTCCAGTGACGATGAGGCAGCCAGTGAGGCCCG CAGCACCGCCAGTGAATGCCCCAGCCTTCTCAGC ACCACTGCAGAGGACAGCCTTGGGGGGATGTCG TGGATGAGCAGGGCCAGCAGGAAGACCTTGAGGA AAAGCTGAAGGAGTATGTGGACTGTCTCACAGACA AGAGTGCCAAGACCCGGCAGGGTGCTCTTGAGAG CCTGCGCCTGGCCCTAGCGTCCCGCCTACTCCCC GACTTCTTGCTGGAGCGCCGCTCACGCTAGCCGA TGCCCTGGAAAAGTGCCTCAAGAAAGGGAAGGGC GAGGAACAAGCCCTGGCTGCTGCTGTGCTAGGCC TGCTCTGCGTGCAGCTGGGCCCTGGACCTAAGGG TGAGGAGCTGTTTCACAGCCTGCAGCCTCTGCTG GTCTCTGTGCTCAGTGACAGCACAGCTAGCCCTG CTGCCCGGCTCCACTGTGCTTCTGCCCTTGGCCT GGGCTGCTACGTGGCTGCCGCTGACATCCAGGAC CTGGTCTCTTGCCTTGCCTGCTTAGAAAGTGTTTT CAGCCGGTTCTATGGCTTGGGGGGCAGCTCCACA AGTCCTGTGGTTCCTGCCAGCCTGCACGGCCTGC TCTCTGCTGCCCTGCAGGCCTGGGCATTGCTGCT CACCATCTGCCCTAGCACCCAAATCAGCCACATCC TTGACAGGCAGCTGCCCCGGCTGCCCCAGCTCTT GTCCA | | |
| 1727 | NM_0067 93.2_174 | 174 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATGTGTTCTGGTTCCAGTCAAGCAAAATTATTCAGC ACCAGTTCCTCATGCCATGCACCTGCTGTCACCCA GCATGCACCCTATTTTAAGGGTACAGCCGTTGTCA ATGGAGAGTTCAAAGACCTAAGCCTTGATGACTTT AAGGGGAAATATTTGGTGCTTTTCTTCTATCCTTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 41 | CVLVPVKQ NYSAPVPH AMHLLSPS MHPILRVQ PLSMESSK T* |
| 1728 | NM_0067 93.2_234 | 234 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGTGTCACCCA GCATGCACCCTATTTTAAGGGTACAGCCGTTGTCA ATGGAGAGTTCAAAGACCTAAGCCTTGATGACTTT AAGGGGAAATATTTGGTGCTTTTCTTCTATCCTTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA | 21 | VSPSMHPI LRVQPLSM ESSKT* |

TABLE 3A-continued

| SEQ ID | identifier_ position | position | modified_RNA | PAP length | PAP |
|---|---|---|---|---|---|
| | | | AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | | |
| 1729 | NM_0067 93.2_274 | 274 | CCCTGCGTCTCTGCCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTGTCA ATGGAGAGTTCAAAGACCTAAGCCTTGATGACTTT AAGGGGAAATATTTGGTGCTTTTCTTCTATCCTTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC | 7 | SMESSKT* |
| 1730 | NM_0067 93.2_304 | 304 | CCCTGCGTCTCTGCCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTTT AAGGGGAAATATTTGGTGCTTTTCTTCTATCCTTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 37 | MTLRGNIW CFSSILWIS PLCVLQKL LLLVTKLTN FTT* |
| 1731 | NM_0067 93.2_327 | 327 | CCCTGCGTCTCTGCCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT | 30 | WCFSSILW ISPLCVLQK LLLLVTKLT NFTT* |

TABLE 3A-continued

| SEQ ID | identifier_ position | position | modified_RNA | PAP length | PAP |
|---|---|---|---|---|---|
| | | | TAAGGGGAAATATTGGTGCTTTTCTTCTATCCTTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | | |
| 1732 | NM_0067 93.2_348 | 348 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTAAGGGTACAGCCGTTGTC AATGGAGAGTTCAAAGACCTAAGCCTTGATGACTT TAAGGGGAAATATTTGGTGCTTTTCTTCTATCCTTG GATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 23 | WISPLCVL QKLLLLVT KLTNFTT* |
| 1733 | NM_0067 93.2_361 | 361 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATTGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA | 19 | LCVLQKLL LLVTKLTNF TT* |

TABLE 3A-continued

| SEQ ID | identifier_ position | position | modified_RNA | PAP length | PAP |
|---|---|---|---|---|---|
| | | | AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | | |
| 1734 | NM_0067 93.2_379 | 379 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATGTTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 13 | MLLLVTKL TNFTT* |
| 1735 | NM_0067 93.2_382 | 382 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATTGTGCT TTTAGTGACAAAGCTAACGAATTTCACGACGTGAA CTGTGAAGTTGTCGCAGTCTCAGTGGATTCCCACT TTAGCCATCTTGCCTGGATAAATACACCAAGGAAG AATGGTGGTTTGGGCCACATGAACATCGCACTCTT GTCAGACTTAACTAAGCAGATTTCCCGAGACTACG GTGTGCTGTTAGAAGGTTCTGGTCTTGCACTAAGA GGTCTCTTCATAATTGACCCCAATGGAGTCATCAA GCATTTGAGCGTCAACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 11 | LLVTKLTNF TT* |
| 1736 | NM_0067 93.2_501 | 501 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATGTTGC TTTTAGTGACAAAGCTAACGAATTTCACGACGTGA ACTGTGAAGTTGTCGCAGTCTCAGTGGATTCCCAC | 3 | WAT* |

TABLE 3A-continued

| SEQ ID | identifier_position | position | modified_RNA | PAP length | PAP |
|---|---|---|---|---|---|
| | | | TTTAGCCATCTTGCCTGGATAAATACACCAAGGAA<br>GAATGGTGGTTGGGCCACATGAACATCGCACTCTT<br>GTCAGACTTAACTAAGCAGATTTCCCGAGACTACG<br>GTGTGCTGTTAGAAGGTTCTGGTCTTGCACTAAGA<br>GGTCTCTTCATAATTGACCCCAATGGAGTCATCAA<br>GCATTTGAGCGTCAACGATCTCCCAGTGGGCCGA<br>AGCGTGGAAGAAACCCTCCGCTTGGTGAAGGCGT<br>TCCAGTATGTAGAAACACATGGAGAAGTCTGCCCA<br>GCGAACTGGACACCGGATTCTCCTACGATCAAGC<br>CAAGTCCAGCTGCTTCCAAAGAGTACTTTCAGAAG<br>GTAAATCAGTAGATCACCCATGTGTATCTGCACCT<br>TCTCAACTGAGAGAAGAACCACAGTTGAAACCTGC<br>TTTTATCATTTTCAAGATGGTTATTTGTAGAAGGCA<br>AGGAACCAATTATGCTTGTATTCATAAGTATTACTC<br>TAAATGTTTTGTTTTTGTAATTCTGGCTAAGACCTTT<br>TAAACATGGTTAGTTGCTAGTACAAGGAATCCTTTA<br>TTGGTAAC | | |
| 1737 | NM_0067<br>93.2_548 | 548 | CCCTGCGTCTCTGCCCGCCCCGTGGCGCCCGAGT<br>GCACTGAAGATGGCGGCTGCTGTAGGACGGTTGC<br>TCCGAGCGTCGGTTGCCCGACATGTGAGTGCCAT<br>TCCTTGGGGCATTTCTGCCACTGCAGCCCTCAGG<br>CCTGCTGCATGTGGAAGAACGAGCTTGACAAATTT<br>ATTGTGTTCTGGTTCCAGTCAAGCAAAATTATTCAG<br>CACCAGTTCCTCATGCCATGCACCTGCTGTCACCC<br>AGCATGCACCCTATTTTAAGGGTACAGCCGTTGTC<br>AATGGAGAGTTCAAAGACCTAAGCCTTGATGACTT<br>TAAGGGGAAATATTTGGTGCTTTTCTTCTATCCTTT<br>GGATTTCACCTTTGTGTGTCCTACAGAAATTGTTGC<br>TTTTAGTGACAAAGCTAACGAATTTCACGACGTGA<br>ACTGTGAAGTTGTCGCAGTCTCAGTGGATTCCCAC<br>TTTAGCCATCTTGCCTGGATAAATACACCAAGGAA<br>GAATGGTGGTTTGGGCCACATGAACATCGCACTCT<br>TGTCAGACTTAACTAAGCAGATTCCCGAGACTACG<br>GTGTGCTGTTAGAAGGTTCTGGTCTTGCACTAAGA<br>GGTCTCTTCATAATTGACCCCAATGGAGTCATCAA<br>GCATTTGAGCGTCAACGATCTCCCAGTGGGCCGA<br>AGCGTGGAAGAAACCCTCCGCTTGGTGAAGGCGT<br>TCCAGTATGTAGAAACACATGGAGAAGTCTGCCCA<br>GCGAACTGGACACCGGATTCTCCTACGATCAAGC<br>CAAGTCCAGCTGCTTCCAAAGAGTACTTTCAGAAG<br>GTAAATCAGTAGATCACCCATGTGTATCTGCACCT<br>TCTCAACTGAGAGAAGAACCACAGTTGAAACCTGC<br>TTTTATCATTTTCAAGATGGTTATTTGTAGAAGGCA<br>AGGAACCAATTATGCTTGTATTCATAAGTATTACTC<br>TAAATGTTTTGTTTTTGTAATTCTGGCTAAGACCTTT<br>TAAACATGGTTAGTTGCTAGTACAAGGAATCCTTTA<br>TTGGTAAC | 7 | PETTVCC* |
| 1738 | NM_0067<br>93.2_616 | 616 | CCCTGCGTCTCTGCCCGCCCCGTGGCGCCCGAGT<br>GCACTGAAGATGGCGGCTGCTGTAGGACGGTTGC<br>TCCGAGCGTCGGTTGCCCGACATGTGAGTGCCAT<br>TCCTTGGGGCATTTCTGCCACTGCAGCCCTCAGG<br>CCTGCTGCATGTGGAAGAACGAGCTTGACAAATTT<br>ATTGTGTTCTGGTTCCAGTCAAGCAAAATTATTCAG<br>CACCAGTTCCTCATGCCATGCACCTGCTGTCACCC<br>AGCATGCACCCTATTTTAAGGGTACAGCCGTTGTC<br>AATGGAGAGTTCAAAGACCTAAGCCTTGATGACTT<br>TAAGGGGAAATATTTGGTGCTTTTCTTCTATCCTTT<br>GGATTTCACCTTTGTGTGTCCTACAGAAATTGTTGC<br>TTTTAGTGACAAAGCTAACGAATTTCACGACGTGA<br>ACTGTGAAGTTGTCGCAGTCTCAGTGGATTCCCAC<br>TTTAGCCATCTTGCCTGGATAAATACACCAAGGAA<br>GAATGGTGGTTTGGGCCACATGAACATCGCACTCT<br>TGTCAGACTTAACTAAGCAGATTTCCCGAGACTAC<br>GGTGTGCTGTTAGAAGGTTCTGGTCTTGCACTAAG<br>AGGTCTCTTCATAATTGACCCAATGGAGTCATCAA<br>GCATTTGAGCGTCAACGATCTCCCAGTGGGCCGA<br>AGCGTGGAAGAAACCCTCCGCTTGGTGAAGGCGT<br>TCCAGTATGTAGAAACACATGGAGAAGTCTGCCCA<br>GCGAACTGGACACCGGATTCTCCTACGATCAAGC<br>CAAGTCCAGCTGCTTCCAAAGAGTACTTTCAGAAG<br>GTAAATCAGTAGATCACCCATGTGTATCTGCACCT<br>TCTCAACTGAGAGAAGAACCACAGTTGAAACCTGC<br>TTTTATCATTTTCAAGATGGTTATTTGTAGAAGGCA<br>AGGAACCAATTATGCTTGTATTCATAAGTATTACTC<br>TAAATGTTTTGTTTTTGTAATTCTGGCTAAGACCTTT<br>TAAACATGGTTAGTTGCTAGTACAAGGAATCCTTTA<br>TTGGTAAC | 6 | MESSSI* |

TABLE 3A-continued

| SEQ ID | identifier_ position | position | modified_RNA | PAP length | PAP |
|---|---|---|---|---|---|
| 1739 | NM_0067 93.2_645 | 645 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATTGTTGC TTTTAGTGACAAAGCTAACGAATTTCACGACGTGA ACTGTGAAGTTGTCGCAGTCTCAGTGGATTCCCAC TTTAGCCATCTTGCCTGGATAAATACACCAAGGAA GAATGGTGGTTTGGGCCACATGAACATCGCACTCT TGTCAGACTTAACTAAGCAGATTTCCCGAGACTAC GGTGTGCTGTTAGAAGGTTCTGGTCTTGCACTAAG AGGTCTCTTCATAATTGACCCCAATGGAGTCATCA AGCATTTGAGCGTCACGATCTCCCAGTGGGCCGA AGCGTGGAAGAAACCCTCCGCTTGGTGAAGGCGT TCCAGTATGTAGAAACACATGGAGAAGTCTGCCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 15 | TISQWAEA WKKPSAW |
| 1740 | NM_0067 93.2_732 | 732 | CCCTGCGTCTCTGCCCGCCCCGTGGCGCCCGAGT GCACTGAAGATGGCGGCTGCTGTAGGACGGTTGC TCCGAGCGTCGGTTGCCCGACATGTGAGTGCCAT TCCTTGGGGCATTTCTGCCACTGCAGCCCTCAGG CCTGCTGCATGTGGAAGAACGAGCTTGACAAATTT ATTGTGTTCTGGTTCCAGTCAAGCAAAATTATTCAG CACCAGTTCCTCATGCCATGCACCTGCTGTCACCC AGCATGCACCCTATTTTAAGGGTACAGCCGTTGTC AATGGAGAGTTCAAAGACCTAAGCCTTGATGACTT TAAGGGGAAATATTTGGTGCTTTTCTTCTATCCTTT GGATTTCACCTTTGTGTGTCCTACAGAAATTGTTGC TTTTAGTGACAAAGCTAACGAATTTCACGACGTGA ACTGTGAAGTTGTCGCAGTCTCAGTGGATTCCCAC TTTAGCCATCTTGCCTGGATAAATACACCAAGGAA GAATGGTGGTTTGGGCCACATGAACATCGCACTCT TGTCAGACTTAACTAAGCAGATTTCCCGAGACTAC GGTGTGCTGTTAGAAGGTTCTGGTCTTGCACTAAG AGGTCTCTTCATAATTGACCCCAATGGAGTCATCA AGCATTTGAGCGTCAACGATCTCCCAGTGGGCCG AAGCGTGGAAGAAACCCTCCGCTTGGTGAAGGCG TTCCAGTATGTAGAAACACATGGAGAAGTCTGCCA GCGAACTGGACACCGGATTCTCCTACGATCAAGC CAAGTCCAGCTGCTTCCAAAGAGTACTTTCAGAAG GTAAATCAGTAGATCACCCATGTGTATCTGCACCT TCTCAACTGAGAGAAGAACCACAGTTGAAACCTGC TTTTATCATTTTCAAGATGGTTATTTGTAGAAGGCA AGGAACCAATTATGCTTGTATTCATAAGTATTACTC TAAATGTTTTGTTTTTGTAATTCTGGCTAAGACCTTT TAAACATGGTTAGTTGCTAGTACAAGGAATCCTTTA TTGGTAAC | 24 | QRTGHRIL LRSSQVQL LPKSTFRR |
| 1741 | NM_0068 02.2_303 | 303 | TTCCGGCACTCGCGGAACTTTGGTGCAGCCTGAT GCGCAACGTGGGGACTCAGGCGCGCTGGGCGGC AGGAGTTGCTTCCGGCCGTGTTGGTGGTCTGAATT GAGAAGCCGCGACTAAGGGAAGATGGAGACAATA CTGGAGCAGCAGCGGCGCTATCATGAGGAGAAGG AACGGCTCATGGACGTCATGGCTAAAGAGATGCT CACCAAGAAGTCCACGCTCCGGGACCAGATCAAT TCTGATCACCGCACTCGGGCCATGCAAGATAGGT ATATGGAGGTCAGTGGGAACCTGAGGGATTGTAT GATGATAAGGATGGATTACGAAAGGAGGAGCTCA ATGCCATTTCAGGACCCAATGAGTTTGCTGAATTC TATAATAGACTCAAGCAAATAAAGGAATTCCACCG GAAGCACCCAAATGAGATCTGTGTGCCAATGTCAG TGGAATTTGAGGAACTCCTGAAGGCTCGAGAGAAT CCAAGTGAAGAGGCACAAAAACTTGGTGGAGTTCA CAGATGAAGAGGGATATGGTCGTTATCTCGATCTC CATGACTGTTACCTCAAGTACATTAACCTGAAGGC | 31 | CMMIRMD YERRSSM PFQDPMSL LNSIIDSSK |

TABLE 3A-continued

| SEQ ID | identifier_position | position | modified_RNA | PAP length | PAP |
|---|---|---|---|---|---|
| | | | ATCTGAGAAGCTGGATTATATCACATACCTGTCCA<br>TCTTTGACCAATTATTTGACATTCCTAAAGAAAGGA<br>AGAATGCAGAGTATAAGAGATACCTAGAGATGCTG<br>CTTGAGTACCTTCAGGATTACACAGATAGAGTGAA<br>GCCTCTCCAAGATCAGAATGAACTTTTTGGGAAGA<br>TTCAGGCTGAGTTTGAGAAGAAATGGGAGAATGG<br>GACCTTTCCTGGATGGCCGAAAGAGACAAGCAGT<br>GCCCTGACCCATGCTGGAGCCCATCTTGACCTCTC<br>TGCATTCTCCTCCTGGGAGGAGTTGGCTTCTCTGG<br>GTTTGGACAGATTGAAATCTGCTCTCTTAGCTTTAG<br>GCTTGAAATGTGGCGGGACCCTAGAAGAGCGAGC<br>CCAGAGACTATTCAGTACCAAAGGAAAGTCCCTGG<br>AGTCACTTGATACCTCTTTGT | | |
| 1742 | NM_0068 16.1_110 | 110 | ATGGCGGCGGAAGGCTGGATTTGGCGTTGGGGCT<br>GGGGCCGGCGGTGCCTGGGAAGGCCTGGGCTTC<br>TCGGCCCCGGCCCTGGCCCCACTACACCTCTCTT<br>TCTTCTTTGTTGTTGGGGTCTGTGACTGCGGATAT<br>AACTGACGGCAACAGTGAACATCTCAAGCGGGAG<br>CATTCGCTCATTAAGCCCTACCAAGGGGTCGGTTC<br>CAGCTCTATGCCCCTCTGGGACTTCCAGGGCAGC<br>ACTATGCTCACGAGCCAGTACGTACGTCTGACCCC<br>TGACGAGCGCAGCAAAGAGGGCTCTATCTGGAAC<br>CACCAGCCGTGCTTCCTCAAAGACTGGGAAATGC<br>ACGTCCACTTCAAAGTCCACGGCACAGGGAAGAA<br>GAACCTCCATGGAGACGGCATCGCCTTGTGGTAC<br>ACCCGGGACCGCCTCGTGCCAGGGCCTGTGTTTG<br>GAAGCAAAGATAACTTCCACGGCTTAGCCATCTTC<br>CTGGACACCTACCCCAATGATGAGACCACTGAGC<br>GCGTGTTCCCGTACATCTCGGTGATGGTGAACAAT<br>GGCTCCCTGTCCTACGACCACAGCAAGGATGGGC<br>GCTGGACCGAGCTGGCGGGCTGCACGGCTGACTT<br>CCGCAACCGCGATCACGACACCTTCCTGGCTGTG<br>CGCTACTCCCGGGGCCGTCTGACGGTGATGACCG<br>ACCTGGAGGACAAGAACGAGTGGAAGAACTGCAT<br>TGACATCACGGGAGTGCGCCTGCCCACCGGCTAC<br>TACTTCGGGGCCTCCGCCGGCACCGGCGACCTGT<br>CTGACAATCATGACATCATCTCCATGAAGCTGTTC<br>CAGCTGATGGTGGAGCACACGCCCGACGAGGAGA<br>GCATCGACTGGACCAAGATCGAGCCCAGCGTCAA<br>CTTCCTCAAGTCGCCCAAAGACAACGTGGACGAC<br>CCCACGGGGAACTTCCGCAGCGGGCCCCTGACG<br>GGGTGGCGGGTGTTCCTGCTGCTGCTGTGCGCTC<br>TCCTGGGCATCGTTGTCTGCGCCGTGGTGGGGGC | 5 | CCWGL* |
| 1743 | NM_0068 16.1_113 | 113 | ATGGCGGCGGAAGGCTGGATTTGGCGTTGGGGCT<br>GGGGCCGGCGGTGCCTGGGAAGGCCTGGGCTTC<br>TCGGCCCCGGCCCTGGCCCCACTACACCTCTCTT<br>TCTTCTTTTGTGTTGGGGTCTGTGACTGCGGATAT<br>AACTGACGGCAACAGTGAACATCTCAAGCGGGAG<br>CATTCGCTCATTAAGCCCTACCAAGGGGTCGGTTC<br>CAGCTCTATGCCCCTCTGGGACTTCCAGGGCAGC<br>ACTATGCTCACGAGCCAGTACGTACGTCTGACCCC<br>TGACGAGCGCAGCAAAGAGGGCTCTATCTGGAAC<br>CACCAGCCGTGCTTCCTCAAAGACTGGGAAATGC<br>ACGTCCACTTCAAAGTCCACGGCACAGGGAAGAA<br>GAACCTCCATGGAGACGGCATCGCCTTGTGGTAC<br>ACCCGGGACCGCCTCGTGCCAGGGCCTGTGTTTG<br>GAAGCAAAGATAACTTCCACGGCTTAGCCATCTTC<br>CTGGACACCTACCCCAATGATGAGACCACTGAGC<br>GCGTGTTCCCGTACATCTCGGTGATGGTGAACAAT<br>GGCTCCCTGTCCTACGACCACAGCAAGGATGGGC<br>GCTGGACCGAGCTGGCGGGCTGCACGGCTGACTT<br>CCGCAACCGCGATCACGACACCTTCCTGGCTGTG<br>CGCTACTCCCGGGGCCGTCTGACGGTGATGACCG<br>ACCTGGAGGACAAGAACGAGTGGAAGAACTGCAT<br>TGACATCACGGGAGTGCGCCTGCCCACCGGCTAC<br>TACTTCGGGGCCTCCGCCGGCACCGGCGACCTGT<br>CTGACAATCATGACATCATCTCCATGAAGCTGTTC<br>CAGCTGATGGTGGAGCACACGCCCGACGAGGAGA<br>GCATCGACTGGACCAAGATCGAGCCCAGCGTCAA<br>CTTCCTCAAGTCGCCCAAAGACAACGTGGACGAC<br>CCCACGGGGAACTTCCGCAGCGGGCCCCTGACG<br>GGGTGGCGGGTGTTCCTGCTGCTGCTGTGCGCTC<br>TCCTGGGCATCGTTGTCTGCGCCGTGGTGGGGGC | 4 | CWGL* |
| 1744 | NM_0068 16.1_236 | 236 | ATGGCGGCGGAAGGCTGGATTTGGCGTTGGGGCT<br>GGGGCCGGCGGTGCCTGGGAAGGCCTGGGCTTC<br>TCGGCCCCGGCCCTGGCCCCACTACACCTCTCTT<br>TCTTCTTTTGTTGTTGGGGTCTGTGACTGCGGATA | 11 | AALCSRAS TYV* |

TABLE 3A-continued

| SEQ ID | identifier_position | position | modified_RNA | PAP length | PAP |
|---|---|---|---|---|---|
| | | | TAACTGACGGCAACAGTGAACATCTCAAGCGGGA GCATTCGCTCATTAAGCCCTACCAAGGGGTCGGTT CCAGCTCTATGCCCCTCTGGGACTTCCAGGCAGC ACTATGCTCACGAGCCAGTACGTACGTCTGACCCC TGACGAGCGCAGCAAAGAGGGCTCTATCTGGAAC CACCAGCCGTGCTTCCTCAAAGACTGGGAAATGC ACGTCCACTTCAAAGTCCACGGCACAGGGAAGAA GAACCTCCATGGAGACGGCATCGCCTTGTGGTAC ACCCGGGACCGCCTCGTGCCAGGGCCTGTGTTTG GAAGCAAAGATAACTTCCACGGCTTAGCCATCTTC CTGGACACCTACCCCAATGATGAGACCACTGAGC GCGTGTTCCCGTACATCTCGGTGATGGTGAACAAT GGCTCCCTGTCCTACGACCACAGCAAGGATGGGC GCTGGACCGAGCTGGCGGGCTGCACGGCTGACTT CCGCAACCGCGATCACGACACCTTCCTGGCTGTG CGCTACTCCCGGGGCCGTCTGACGGTGATGACCG ACCTGGAGGACAAGAACGAGTGGAAGAACTGCAT TGACATCACGGAGTGCGCCTGCCCACCGGCTAC TACTTCGGGGCCTCCGCCGGCACCGGCGACCTGT CTGACAATCATGACATCATCTCCATGAAGCTGTTC CAGCTGATGGTGGAGCACACGCCCGACGAGGAGA GCATCGACTGGACCAAGATCGAGCCCAGCGTCAA CTTCCTCAAGTCGCCCAAAGACAACGTGGACGAC CCCACGGGGAACTTCCGCAGCGGGCCCCTGACG GGGTGGCGGGTGTTCCTGCTGCTGCTGTGCGCTC TCCTGGGCATCGTTGTCTGCGCCGTGGTGGGGGC | | |
| 1745 | NM_0068 16.1_435 | 435 | ATGGCGGCGGAAGGCTGGATTTGGCGTTGGGGCT GGGGCCGGCGGTGCCTGGGAAGGCCTGGGCTTC TCGGCCCCGGCCCTGGCCCCACTACACCTCTCTT TCTTCTTTTGTTGTTGGGGTCTGTGACTGCGGATA TAACTGACGGCAACAGTGAACATCTCAAGCGGGA GCATTCGCTCATTAAGCCCTACCAAGGGGTCGGTT CCAGCTCTATGCCCCTCTGGGACTTCCAGGGCAG CACTATGCTCACGAGCCAGTACGTACGTCTGACCC CTGACGAGCGCAGCAAAGAGGGCTCTATCTGGAA CCACCAGCCGTGCTTCCTCAAAGACTGGGAAATG CACGTCCACTTCAAAGTCCACGGCACAGGGAAGA AGAACCTCCATGGAGACGGCATCGCCTTGTGGTA CACCCGGGACCGCCTCGTGCCAGGGCCTGTGTTTG GAAGCAAAGATAACTTCCACGGCTTAGCCATCTTC CTGGACACCTACCCCAATGATGAGACCACTGAGC GCGTGTTCCCGTACATCTCGGTGATGGTGAACAAT GGCTCCCTGTCCTACGACCACAGCAAGGATGGGC GCTGGACCGAGCTGGCGGGCTGCACGGCTGACTT CCGCAACCGCGATCACGACACCTTCCTGGCTGTG CGCTACTCCCGGGGCCGTCTGACGGTGATGACCG ACCTGGAGGACAAGAACGAGTGGAAGAACTGCAT TGACATCACGGAGTGCGCCTGCCCACCGGCTAC TACTTCGGGGCCTCCGCCGGCACCGGCGACCTGT CTGACAATCATGACATCATCTCCATGAAGCTGTTC CAGCTGATGGTGGAGCACACGCCCGACGAGGAGA GCATCGACTGGACCAAGATCGAGCCCAGCGTCAA CTTCCTCAAGTCGCCCAAAGACAACGTGGACGAC CCCACGGGGAACTTCCGCAGCGGGCCCCTGACG GGGTGGCGGGTGTTCCTGCTGCTGCTGTGCGCTC TCCTGGGCATCGTTGTCTGCGCCGTGGTGGGGGC | 11 | LCLEAKITS TA* |
| 1746 | NM_0068 16.1_611 | 611 | ATGGCGGCGGAAGGCTGGATTTGGCGTTGGGGCT GGGGCCGGCGGTGCCTGGGAAGGCCTGGGCTTC TCGGCCCCGGCCCTGGCCCCACTACACCTCTCTT TCTTCTTTTGTTGTTGGGGTCTGTGACTGCGGATA TAACTGACGGCAACAGTGAACATCTCAAGCGGGA GCATTCGCTCATTAAGCCCTACCAAGGGGTCGGTT CCAGCTCTATGCCCCTCTGGGACTTCCAGGGCAG CACTATGCTCACGAGCCAGTACGTACGTCTGACCC CTGACGAGCGCAGCAAAGAGGGCTCTATCTGGAA CCACCAGCCGTGCTTCCTCAAAGACTGGGAAATG CACGTCCACTTCAAAGTCCACGGCACAGGGAAGA AGAACCTCCATGGAGACGGCATCGCCTTGTGGTA CACCCGGGACCGCCTCGTGCCAGGGCCTGTGTTT GGAAGCAAAGATAACTTCCACGGCTTAGCCATCTT CCTGGACACCTACCCCAATGATGAGACCACTGAG CGCGTGTTCCCGTACATCTCGGTGATGGTGAACAA TGGCTCCCTGTCCTACGACCACAGCAAGGATGGG CGCTGGACCGAGCTGGCGGGCTGCACGGTGACTT CCGCAACCGCGATCACGACACCTTCCTGGCTGTG CGCTACTCCCGGGGCCGTCTGACGGTGATGACCG ACCTGGAGGACAAGAACGAGTGGAAGAACTGCAT | 20 | VTSATAITT PSWLCATP GAV* |

TABLE 3A-continued

| SEQ ID | identifier_position | position | modified_RNA | PAP length | PAP |
|---|---|---|---|---|---|
| 1747 | NM_0068 16.1_625 | 625 | TGACATCACGGGAGTGCGCCTGCCCACCGGCTAC<br>TACTTCGGGGCCTCCGCCGGCACCGGCGACCTGT<br>CTGACAATCATGACATCATCTCCATGAAGCTGTTC<br>CAGCTGATGGTGGAGCACACGCCCGACGAGGAGA<br>GCATCGACTGGACCAAGATCGAGCCCAGCGTCAA<br>CTTCCTCAAGTCGCCCAAAGACAACGTGGACGAC<br>CCCACGGGGAACTTCCGCAGCGGGCCCCTGACG<br>GGGTGGCGGGTGTTCCTGCTGCTGCTGTGCGCTC<br>TCCTGGGCATCGTTGTCTGCGCCGTGGTGGGGGC<br>ATGGCGGCGGAAGGCTGGATTTGGCGTTGGGGCT<br>GGGGCCGGCGGTGCCTGGGAAGGCCTGGGCTTC<br>TCGGCCCCGGCCCTGGCCCCACTACACCTCTCTT<br>TCTTCTTTTGTTGTTGGGGTCTGTGACTGCGGATA<br>TAACTGACGGCAACAGTGAACATCTCAAGCGGGA<br>GCATTCGCTCATTAAGCCCTACCAAGGGGTCGGTT<br>CCAGCTCTATGCCCCTCTGGGACTTCCAGGGCAG<br>CACTATGCTCACGAGCCAGTACGTACGTCTGACCC<br>CTGACGAGCGCAGCAAAGAGGGCTCTATCTGGAA<br>CCACCAGCCGTGCTTCCTCAAAGACTGGGAAATG<br>CACGTCCACTTCAAAGTCCACGGCACAGGGAAGA<br>AGAACCTCCATGGAGACGGCATCGCCTTGTGGTA<br>CACCCGGGACCGCCTCGTGCCAGGGCCTGTGTTT<br>GGAAGCAAAGATAACTTCCACGGCTTAGCCATCTT<br>CCTGGACACCTACCCCAATGATGAGACCACTGAG<br>CGCGTGTTCCCGTACATCTCGGTGATGGTGAACAA<br>TGGCTCCCTGTCCTACGACCACAGCAAGGATGGG<br>CGCTGGACCGAGCTGGCGGGCTGCACGGCTGAC<br>TTCCGCAACGCGATCACGACACCTTCCTGGCTGTG<br>CGCTACTCCCGGGGCCGTCTGACGGTGATGACCG<br>ACCTGGAGGACAAGAACGAGTGGAAGAACTGCAT<br>TGACATCACGGGAGTGCGCCTGCCCACCGGCTAC<br>TACTTCGGGGCCTCCGCCGGCACCGGCGACCTGT<br>CTGACAATCATGACATCATCTCCATGAAGCTGTTC<br>CAGCTGATGGTGGAGCACACGCCCGACGAGGAGA<br>GCATCGACTGGACCAAGATCGAGCCCAGCGTCAA<br>CTTCCTCAAGTCGCCCAAAGACAACGTGGACGAC<br>CCCACGGGGAACTTCCGCAGCGGGCCCCTGACG<br>GGGTGGCGGGTGTTCCTGCTGCTGCTGTGCGCTC<br>TCCTGGGCATCGTTGTCTGCGCCGTGGTGGGGGC | 15 | AITTPSWL CATPGAV* |
| 1748 | NM_0068 26.2_707 | 707 | GTGGTGGGACTCGCGTCGCGGCCGCGGAGACGT<br>GAAGCTCTCGAGGCTCCTCCCGCTGCGGGTCGGC<br>GCTCGCCCTCGCTCTCCTCGCCCTCCGCCCCGGC<br>CCCGGCCCCGCGCCCGCCATGGAGAAGACTGAG<br>CTGATCCAGAAGGCCAAGCTGGCCGAGCAGGCCG<br>AGCGCTACGACGACATGGCCACCTGCATGAAGGC<br>AGTGACCGAGCAGGGCGCCGAGCTGTCCAACGA<br>GGAGCGCAACCTGCTCTCCGTGGCCTACAAGAAC<br>GTGGTCGGGGGCCGCAGGTCCGCCTGGAGGGTC<br>ATCTCTAGCATCGAGCAGAAGACCGACACCTCCG<br>ACAAGAAGTTGCAGCTGATTAAGGACTATCGGGAG<br>AAAGTGGAGTCCGAGCTGAGATCCATCTGCACCA<br>CGGTGCTGGAATTGTTGGATAAATATTTAATAGCC<br>AATGCAACTAATCCAGAGAGTAAGGTCTTCTATCT<br>GAAAAATGAAGGGTGATTACTTCCGGTACCTTGCTG<br>AAGTTGCGTGTGGTGATGATCGAAAACAAACGATA<br>GATAATTCCCAAGGAGCTTACCAAGAGGCATTTGA<br>TATAAGCAAGAAAGAGATGCAACCCACACACCCAA<br>TCCGCCTGGGGCTTGCTCTTAACTTTTCTGTATTTT<br>ACTATGAGATTCTTAATAACCCAGAGCTTGCCTGC<br>ACGCTGGCTAAAACGGCTTTGATGAGGCCATTGCT<br>GAACTTGATACACTGAATGAAGACTCATACAAAGA<br>CAGCACCCTCATCATGCAGTTGCTTAGAGACAACC<br>TAACACTTTGGACATCAGACAGTGCAGGAGAAGAA<br>TGTGATGCGGCAGAAGGGGCTGAAAACTAAATCC<br>ATACAGGGTGTCATCCTTCTTTCCTTCAAGAAACCT<br>TTTTACACATCTCCATTCCTTATTCCACTTGGATTT<br>CCTATAGCAAAGAAACCCATTCATGTGTATGGAAT<br>CAACTGTTTATAGTCTTTTCACACTGCAGCTTTGGG<br>AAAACTTCATTCCTTGATTTG | 10 | LMRPLLNLI H* |
| 1749 | NM_0068 26.2_801 | 801 | GTGGTGGGACTCGCGTCGCGGCCGCGGAGACGT<br>GAAGCTCTCGAGGCTCCTCCCGCTGCGGGTCGGC<br>GCTCGCCCTCGCTCTCCTCGCCCTCCGCCCCGGC<br>CCCGGCCCCGCGCCCGCCATGGAGAAGACTGAG<br>CTGATCCAGAAGGCCAAGCTGGCCGAGCAGGCCG<br>AGCGCTACGACGACATGGCCACCTGCATGAAGGC<br>AGTGACCGAGCAGGGCGCCGAGCTGTCCAACGA<br>GGAGCGCAACCTGCTCTCCGTGGCCTACAAGAAC | 59 | GHQTVQE KNVMRQK GLKTKSIQ GVILLSFKK PFYTSPFLI PLGFPIAKK PIHVYGINC L* |

TABLE 3A-continued

| SEQ ID | identifier_position | position | modified_RNA | PAP length | PAP |
|---|---|---|---|---|---|
| | | | GTGGTCGGGGGCCGCAGGTCCGCCTGGAGGGTC ATCTCTAGCATCGAGCAGAAGACCGACACCTCCG ACAAGAAGTTGCAGCTGATTAAGGACTATCGGGAG AAAGTGGAGTCCGAGCTGAGATCCATCTGCACCA CGGTGCTGGAATTGTTGGATAAATATTTAATAGCC AATGCAACTAATCCAGAGAGTAAGGTCTTCTATCT GAAAATGAAGGGTGATTACTTCCGGTACCTTGCTG AAGTTGCGTGTGGTGATGATCGAAAACAAACGATA GATAATTCCCAAGGAGCTTACCAAGAGGCATTTGA TATAAGCAAGAAAGAGATGCAACCCACACACCCAA TCCGCCTGGGGCTTGCTCTTAACTTTTCTGTATTTT ACTATGAGATTCTTAATAACCCAGAGCTTGCCTGC ACGCTGGCTAAAACGGCTTTTGATGAGGCCATTGC TGAACTTGATACACTGAATGAAGACTCATACAAAG ACAGCACCCTCATCATGCAGTTGCTTAGAGACAAC CTAACACTTGGACATCAGACAGTGCAGGAGAAGAA TGTGATGCGGCAGAAGGGGCTGAAAACTAAATCC ATACAGGGTGTCATCCTTCTTTCCTTCAAGAAACCT TTTTACACATCTCCATTCCTTATTCCACTTGGATTT CCTATAGCAAAGAAACCCATTCATGTGTATGGAAT CAACTGTTTATAGTCTTTTCACACTGCAGCTTTGGG AAAACTTCATTCCTTGATTTG | | |
| 1750 | NM_0068 35.2_885 | 885 | CCCGCGAGCGGACGCGGCAGCGCCTCTGTCTCG CTTTTTCTTATTTTTCCCCCCTTTCCCCTTTCTTTTT TTTTTTTTCTTTTCTTTTCTCCCCTCCCCCCCTTTCA CCATTTCCCCTCGGAGGCGCTTTCCCCGGGCAGG GGCAGAGCCGGTCTCACCCCCCGCCTCTCCCCGG CCCCCGCCGCCCTATGGCGAGAGGGAGCCCCCT CCCAACCCGGGCTCGAGCGGCGGCGGCCTCAGG CCGGGGGTCATCATGGAACTAATTCGCTGACCAG CCCAGCGGCCGCAGCCGTGCGTCCCGCTCGAGC GCCAGCGCCCGCGCCCGCGCCCCCGATCCGCT TCCCCTTTCTCCCTCCTCAGTTGGCCGAGTCGTCC CGCGCGCACCGCCTCCGCGCGCCTATGAGAATGA GGTGGTAACGGGCCCCCGGATGACCCCGCGTCA CCACTGTGAGGCCTACAGCTCTGCCGGGGAGGAG GAGGAGGAGGAAGAGGAGGAGAAGGTAGCTACA GCAAGCTGGGTAGCAGGCAGATCCAAAGGATATC ATGAAGTTTCCAGGGCCTTTGGAAAACCAGAGATT GTCTTTCCTGTTGGAAAAGGCAATCACTAGGGAAG CACAGATGTGGAAAGTGAATGTGCGGAAAATGCCT TCAAATCAGAATGTTTCTCCATCCCAGAGAGATGA AGTAATTCAATGGCTGGCCAAACTCAAGTACCAAT TCAACCTTTACCCAGAAACATTTGCTCTGGCTAGC AGTCTTTTGGATAGGTTTTTAGCTACCGTAAAGGCT CATCCAAAATACTTGAGTTGTATTGCAATCAGCTGT TTTTTCCTAGCTGCCAAGACTGTTGAGGAAGATGA GAGAATTCCAGTACTAAAGGTATGGCAAGAGACAG TTTCTGTGGATGTTCCTCATCTGAAATTTTGAGAAT GGAGAGAATTATTCTGGATAAGTTGAATTGGGATC TTCACACAGCCACACCATTGGATTTTCTTCATATTT TCCATGCCATTGCAGTGTCAA | 14 | WQETVSV DVPHLKF* |
| 1751 | NM_0068 37.2_619 | 619 | GACTATACCACTCCCATACCCTATAACTTTGTTTGT TCTATTTCACACATATAATTTTCCGAGACAAGATGT TCTCATTTAAGCAACAAGAAGATTCGTCTCTCGCTA TTACTGTAACTGCTGTTTATATCGTCATGTCCCGGA AAGGTCCCTGTCTTCCCTGAATGGTCTCTACCAAC TTCACCTCCGGTTCTAGGTGTCATGGCTGCCCCAA GAGTCTAGGTAAGAGTTTGTTCCCGTGGTGCGGA GGGTCAAGGCCCACACCCGGAAACCTAGCGAGGT AAAGTTGCGTCTTGGTTGTAGAGACGACAACTTCT CCGCTTCCTCGGCGATGGCGGCGTCCGGGAGCG GTATGGCCCAGAAAACCTGGGAACTGGCCAACAA CATGCAGGAAGCTCAGAGTATCGATGAAATCTACA AATACGACAAGAAACAGCAGCAAGAAATCCTGGC GGCGAAGCCCTGGACTAAGGATCACCATTACTTTA AGTACTGCAAAATCTCAGCATTGGCTCTGCTGAAG ATGGTGATGCATGCCAGATCGGGAGGCAACTTGG AAGTGATGGGTCTGATGCTAGGAAAGGTGGATGG TGAAACCATGATCATTATGGACAGTTTGCTTTGCCT GTGGAGGGCACTGAAACCCGAGTAAATGCTCAGG CTGCTGCATATGAATACATGGCTGCATACATAGAA AATGCAAAACAGGTTGGCCGCCTTGAAAATGCAAT CGGGTGGTATCATAGCCACCCTGGCTATGGCTGC TGGCTTTCTGGGATTGATGTTAGTACTCAGATGCT CAATCAGCAGTTCAGGAACCATTTGTAGCAGTGG TGATTGATCCAACAAGAACAATATCCGCAGGGAAA | 11 | LLCLWRAL KPE* |

TABLE 3A-continued

| SEQ ID | identifier_ position | position | modified_RNA | PAP length | PAP |
|---|---|---|---|---|---|
| | | | GTGAATCTTGGCGCCTTTAGGACATACCCAAAGGG CTACAAACCTCCTGATGAAGGACCTTCTGAGTACC AGACTATTCCACTTAATAAAATAGAAGATTTTGGTG TACACTGCAAACAATATTATGCCTTAGAAGTCTCAT ATTTCAAATCCT | | |
| 1752 | NM_0068 54.3_643 | 643 | AGGGTGCCCCGCGCGCGCGCGCCGGCAGTTC GGCCACGTCCCTGGCCACGTCGCGGGCGATCTCG CCATCTTCGCCGCTTCCTCTCAGGGGCCGCCGCC TCCTGAGCCGCCCAGCCCCGGGGCCGCCGCGCT GCGCCGACCGCCACCGCCGCCGCCGCCATGAAC ATTTTCCGGCTGACTGGGGACCTGTCCCACCTGG CGGCCATCGTCATCCTGCTGCTGAAGATCTGGAA GACGCGCTCCTGCGCCGGTATTTCTGGGAAAAGC CAGCTTCTGTTTGCACTGGTCTTCACAACTCGTTA CCTGGATCTTTTTACTTCATTTATTTCATTGTATAAC ACATCTATGAAGGTTATCTACCTTGCCTGCTCCTAT GCCACAGTGTACCTGATCTACCTGAAATTTAAGGC AACCTACGATGGAAATCATGATACCTTCCGAGTGG AGTTTCTGGTGGTCCCTGTGGGAGGCCTCTCATTT TTAGTTAATCACGATTTCTCTCCTCTTGAGATCCTC TGGACCTTCTCCATCTACCTGGAGTCCGTGGCTAT CCTTCCGCAGCTATTTATGATCAGCAAGACTGGGG AGGCCGAGACCATCACCACCCACTACCTGTTCTTC CTGGGCCTCTATCGTGCTTGTATCTTGTCAACTGG ATCTGGCGCTTCTACTTTGAGGGCTTCTTTGACCT CATTGCTGTGGTGGCCGGCGTAGTCCAGACCATC CTATACTGTGACTTCTTCTACTTGTACATTACAAAA GTACTCAAGGGAAAGAAGCTCAGTTTGCCAGCATA AGTGCCAAAGACCATCACCAGCATCTGTCCTTCAG GGTGCTCGGACAGAATTCTTACCACAGCAAAGGC ATAAGATGCTTGATACGGAAAATCAGAAACTTAACT CTTTTGTTGCAGATAGTCATCAGTGGCTCTGTAAAA ACGCAGAGGAAAAGAGCCAGAAGGTTTCTGTTTAA TGCATCTTGCCTTATCTTTTTTTATTACTGTGTACAA AGATTTTTTACA | 24 | CILSTGSG ASTLRASL TSLLWWP A* |
| 1753 | NM_0068 99.2_99 | 99 | GCGGGAAACATGGCGGCATTGAGCGGAGTCCGCT GGCTGACCCGAGCGCTGGTCTCCGCCGGGAACC CTGGGGCATGGAGAGGTCTGAGTACCTCGGCGCG GCGCACGCTGCATCGCGGAGCCAGGCCGAGGAC GTGAGGGTGGAGGGCTCCTTTCCCGTGACCATGC TTCCGGGAGACGGTGTGGGGCCTGAGCTGATGCA CGCCGTCAAGGAGGTGTTCAAGGCTGCCGCTGTC CCAGTGGAGTTCCAGGAGCACCACCTGAGTGAGG TGCAGAATATGGCATCTGAGGAGAAGCTGGAGCA GGTGCTGAGTTCCATGAAGGAGAACAAAGTGGCC ATCATTGGAAAGATTCATACCCCGATGGAGTATAA GGGGGAGCTAGCCTCCTATGATATGCGGCTGAGG CGTAAGTTGGACTTATTTGCCAACGTAGTCCATGT GAAGTCACTTCCTGGGTATATGACTCGGCACAACA ATCTAGACCTGGTGATCATTCGAGAGCAGACAGAA GGGGAGTACAGCTCTCTGGAACATGAGAGTGCAA GGGGTGTGATTGAGTGTTTGAAGATTGTCACACGA GCCAAGTCTCAGCGGATTGCAAAGTTCGCCTTTGA CTATGCCACCAAGAAGGGGCGGGGCAAGGTCACT GCTGTCCACAAGGCCAACATCATGAAACTTGGGG ATGGGTTGTTCCTGCAGTGCTGTGAGGAAGTTGCT GAACTGTACCCCAAAATCAAATTTGAGACAATGAT CATAGACAACTGCTGCATGCAGCTGGTGCAGAATC CTTACCAGTTTGATGTGCTTGTGATGCCCAATCTCT ATGGGAACATTATTGACAATCTGGCTGCTGGCCTG GTTGGGGGAGCTGGTGTGGTCCCTGGTGAGAGCT ATAGTGCAGAATACGCAGTCTTTGAGACGGGTGC CCGGCACCCATTTGCCCAGGCAGTGGGCAGGAAT ATAGCCAATCCCACGCCATGCTGCTGTCGGCTTC CAACATGCTGCGGCATCTTAATCTTGA | 12 | RRTLHRGA RPRT* |
| 1754 | NM_0069 37.3_311 | 311 | GCGCACGCAGGGTGGGGGAGGGAGCGCACGAC GTGCGCGCACCCTCTCCCCTCGTCCACCGCTGCC GCCTCCTTCTTCTGCCGCTCCTGGTGCTGCTTGTG TGCTCGTTTGGTGCGGACCTGGTACCTCTTTTGTG AAGCGGCAGCTGAGGAGACTCCGGCGCTCGCCAT GGCCGACGAAAAGCCCAAGGAAGGAGTCAAGACT GAGAACAACGATCATATTAATTTGAAGGTGGCGGG GCAGGATGGTTCTGTGGTGCAGTTTAAGATTAAGA GGCATACACCACTTAGTAAACTAATGAAAGCCTAT GTGAACGACAGGGATTGTCAATGAGGCAGATCAG ATTCCGATTTGACGGGCAACCAATCAATGAAACAG ACACACCTGCACAGTTGGAAATGGAGGATGAAGAT | 7 | VNDRDCQ* |

TABLE 3A-continued

| SEQ ID | identifier_position | position | modified_RNA | PAP length | PAP |
|---|---|---|---|---|---|
| | | | ACAATTGATGTGTTCCAACAGCAGACGGGAGGTGT CTACTGAAAAGGGAACCTGCTTCTTTACTCCAGAA CTCTGTTCTTTAAAGACCAAGATTACATTCTCAATT AGAAAACTGCAATTTGGTTCCACCACATCCTGACT ACTACCGTATAGTTTTCTCTATTCTTTCATTTCCCC CTTCCCCATTCCTTTATTGTACATAAAGTAACTGGT ATATGTGCACAAGCATATTGCATTTTTTTTTTTTTA ACTAAACAGCCAATGGTATGTTTTGATTGACATCAA GTGGAGACGGGATGGGGAAAAATACTGATTCTGT GAAAATACCCCCTTTCTCCATTAGTGGCATGCTCA TTCAGCTCTTATCTTTATATTCCAGTAAGTTATTTTG CTCTCACTGTTTTAACAAAAAAAAAAAACAACAACA TAAAAATCCTTGCATACCTTGTTCAATTGGAGAATT TTAATGTTTTTCATTTATCATTGTAAAACCAAGGAC AATTTTATAACTTTTTTGTACGTAGCTGTTACATGTA GGGCAATCTGTCTTTAAGTAGGGATAAATTACTCT AAAACAAAAAAGAATCCTAGATAGTTTTCCCTTCAA GT | | |
| 1755 | NM_006937.3_327 | 327 | GCGCACGCAGGGTGGGGGGAGGGAGCGCACGAC GTGCGCGCACCCTCTCCCCTCGTCCACCGCTGCC GCCTCCTTCTTCTGCCGCTCCTGGTGCTGCTTGTG TGCTCGTTTGGTGCGGACCTGGTACCTCTTTTGTG AAGCGGCAGCTGAGGAGACTCCGGCGCTCGCCAT GGCCGACGAAAAGCCCAAGGAAGGAGTCAAGACT GAGAACAACGATCATATTAATTTGAAGGTGGCGGG GCAGGATGGTTCTGTGGTGCAGTTTAAGATTAAGA GGCATACACCACTTAGTAAACTAATGAAAGCCTAT TGTGAACGACAGGGATGTCAATGAGGCAGATCAG ATTCCGATTTGACGGGCAACCAATCAATGAAACAG ACACACCTGCACAGTTGGAAATGGAGGATGAAGAT ACAATTGATGTGTTCCAACAGCAGACGGGAGGTGT CTACTGAAAAGGGAACCTGCTTCTTTACTCCAGAA CTCTGTTCTTTAAAGACCAAGATTACATTCTCAATT AGAAAACTGCAATTTGGTTCCACCACATCCTGACT ACTACCGTATAGTTTTCTCTATTCTTTCATTTCCCC CTTCCCCATTCCTTTATTGTACATAAAGTAACTGGT ATATGTGCACAAGCATATTGCATTTTTTTTTTTTTA ACTAAACAGCCAATGGTATGTTTTGATTGACATCAA GTGGAGACGGGATGGGGAAAAATACTGATTCTGT GAAAATACCCCCTTTCTCCATTAGTGGCATGCTCA TTCAGCTCTTATCTTTATATTCCAGTAAGTTATTTTG CTCTCACTGTTTTAACAAAAAAAAAAAACAACAACA TAAAAATCCTTGCATACCTTGTTCAATTGGAGAATT TTAATGTTTTTCATTTATCATTGTAAAACCAAGGAC AATTTTATAACTTTTTTGTACGTAGCTGTTACATGTA GGGCAATCTGTCTTTAAGTAGGGATAAATTACTCT AAAACAAAAAAGAATCCTAGATAGTTTTCCCTTCAA GT | 2 | CQ* |
| 1756 | NM_007103.2_165 | 165 | ATCGCGCCAGTTCCTCAGCCTCAGTGCTATGAAGG TGACAGCGTGAGGTGACCCATCTGGCCCGCCGCG ATGCTGGCAACACGGCGGCTGCTCGGCTGGTCGC TTCCCGCGCGGGTATCTGTGCGTTTCAGCGGCGA CACGACAGCACCCAAGAAAACCTCATTGGCTCGCT GAAGGATGAAGACCGGATTTTCACCAACCTGTACG GCCGCCATGACTGGAGGCTGAAAGGTTCCCTGAG TCGAGGTGACTGGTACAAGACAAAGGAGATCCTG CTGAAGGGGCCCGACTGGATCCTGGGCGAGATCA AGACATCGGGTTTGAGGGGCCGTGGAGGCGCTG GCTTCCCCACTGGCCTCAAGTGGAGCTTCATGAAT AAGCCCTCAGATGGCAGGCCCAAGTATCTGGTGG TGAACGCAGACGAGGGGAGCCGGGCACCTGCA AGGACCGGGAGATCTTACGCCATGATCCTCACAA GCTGCTGGAAGGCTGCCTGGTGGGGGCCGGGC CATGGGCGCCCGCGCTGCCTATATCTACATCCGA GGGGAATTCTACAATGAGGCCTCCAATCTGCAGGT GGCCATCCGAGAGGCCTATGAGGCAGGTCTGATT GGCAAGAATGCTTGTGGCTCTGGCTATGATTTTGA CGTGTTTGTGGTGCGCGGGGCTGGGGCCTACATC TGTGGAGAGGAGACAGCGCTCATCGAGTCCATTG AGGGCAAGCAGGGCAAGCCCCGCCTGAAGCCCC CCTTCCCCGCAGACGTGGGAGTGTTTGGCTGCCC CACAACTGTGGCCAACGTGGAGACAGTGGCAGTG TCCCCCACAATCTGCCGCCGTGGAGGTACCTGGT TGCTGGCTTTGGCAGAGAACGCAACTTCAGGCAC CAAACTATTCAACATCTCTGGCCATGTCAACCACC CTTGCACTGTGGAGGAGGAGATGTCTGTGCCCTT GAAAGAACTGATTGAGAAGCATGCTGGGGGTGTC | 3 | LAR* |

TABLE 3A-continued

| SEQ ID | identifier_position | position | modified_RNA | PAP length | PAP |
|---|---|---|---|---|---|
| | | | ACGGGCGGCTGGGACAACCTCCTTGCTGTGATCCC | | |
| 1757 | NM_0071 03.2_657 | 657 | ATCGCGCCAGTTCCTCAGCCTCAGTGCTATGAAGG TGACAGCGTGAGGTGACCCATCTGGCCCGCCGCG ATGCTGGCAACACGGCGGCTGCTCGGCTGGTCGC TTCCCGCGCGGGTATCTGTGCGTTTCAGCGGCGA CACGACAGCACCCAAGAAAACCTCATTTGGCTCGC TGAAGGATGAAGACCGGATTTTCACCAACCTGTAC GGCCGCCATGACTGGAGGCTGAAAGGTTCCCTGA GTCGAGGTGACTGGTACAAGACAAAGGAGATCCT GCTGAAGGGGCCCGACTGGATCCTGGGCGAGATC AAGACATCGGGTTTGAGGGGCCGTGGAGGCGCTG GCTTCCCCACTGGCCTCAAGTGGAGCTTCATGAAT AAGCCCTCAGATGGCAGGCCCAAGTATCTGGTGG TGAACGCAGACGAGGGGGAGCCGGGCACCTGCA AGGACCGGGAGATCTTACGCCATGATCCTCACAA GCTGCTGGAAGGCTGCCTGGTGGGGGGCCGGGC CATGGGCGCCCGCTGCCTATATCTACATCCGA GGGGAATTCTACAATGAGGCCTCCAATCTGCAGGT GGCCATCCGAGAGGCCTATGAGGCAGGTCTGATT GGCAAGAATGCTTGTGGCTCTGGCTATGATTTTGA CGTGTTGTGGTGCGCGGGGCTGGGGCCTACATCT GTGGAGAGGAGACAGCGCTCATCGAGTCCATTGA GGGCAAGCAGGGCAAGCCCCGCCTGAAGCCCCC CTTCCCCGCAGACGTGGGAGTGTTTGGCTGCCCC ACAACTGTGGCCAACGTGGAGACAGTGGCAGTGT CCCCCACAATCTGCCGCCGTGGAGGTACCTGGTT TGCTGGCTTTGGCAGAGAACGCAACTCAGGCACC AAACTATTCAACATCTCTGGCCATGTCAACCACCC TTGCACTGTGGAGGAGGAGATGTCTGTGCCCTTG AAAGAACTGATTGAGAAGCATGCTGGGGGTGTCA CGGGCGGCTGGGACAACCTCCTTGCTGTGATCCC | 29 | LWCAGLG PTSVERRQ RSSSPLRA SRASPA* |
| 1758 | NM_0071 04.4_216 | 216 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCTAAGTTCTCTGTGTGTGTCCTGGG GGACCAGCAGCACTGTGACGAGGCTAAGGCCGTG GATATCCCCCACATGGACATCGAGGCGCTGAAAA AACTCAACAAGAATAAAAAAACTGGTCAAGAAGCTG GCCAAGAAGTATGATGCGTTTTTGGCCTCAGAGTC TCTGATCAAGCAGATTCCACGAATCCTCGGCCCAG GTTTAAATAAGGCAGGAAAGTTCCCTTCCCTGCTC ACACACAACGAAAACATGGTGGCCAAAGTGGATG AGGTGAAGTCCACAATCAAGTTCCAAATGAAGAAG GTGTTATGTCTGGCTGTAGCTGTTGGTCACGTGAA GATGACAGACGATGAGCTTGTGTATAACATTCACC TGGCTGTCAACTTCTTGGTGTCATTGCTCAAGAAA AACTGGCAGAATGTCCGGGCCTTATATATCAAGAG CACCATGGGCAAGCCCCAGCGCCTATATTAAGGC ACATTTGAATAAATTCTATTACCAGTTC | 29 | LSSLCVSW GTSSTVTR LRPWISPT WTSRR* |
| 1759 | NM_0071 04.4_366 | 366 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAAACTGGTCAAGAAGCT GGCCAAGAAGTATGATGCGTTTTTGGCCTCAGAGTC TCTGATCAAGCAGATTCCACGAATCCTCGGCCCAG GTTTAAATAAGGCAGGAAAGTTCCCTTCCCTGCTC ACACACAACGAAAACATGGTGGCCAAAGTGGATG AGGTGAAGTCCACAATCAAGTTCCAAATGAAGAAG GTGTTATGTCTGGCTGTAGCTGTTGGTCACGTGAA GATGACAGACGATGAGCTTGTGTATAACATTCACC TGGCTGTCAACTTCTTGGTGTCATTGCTCAAGAAA AACTGGCAGAATGTCCGGGCCTTATATATCAAGAG CACCATGGGCAAGCCCCAGCGCCTATATTAAGGC ACATTTGAATAAATTCTATTACCAGTTC | 5 | WPQSL* |
| 1760 | NM_0071 04.4_411 | 411 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC | 2 | QV* |

TABLE 3A-continued

| SEQ ID | identifier_position | position | modified_RNA | PAP length | PAP |
|---|---|---|---|---|---|
| | | | GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCAG GTTTAAATAAGGCAGGAAAGTTCCCTTCCCTGCTC ACACACAACGAAAACATGGTGGCCAAAGTGGATG AGGTGAAGTCCACAATCAAGTTCCAAATGAAGAAG GTGTTATGTCTGGCTGTAGCTGTTGGTCACGTGAA GATGACAGACGATGAGCTTGTGTATAACATTCACC TGGCTGTCAACTTCTTGGTGTCATTGCTCAAGAAA AACTGGCAGAATGTCCGGGCCTTATATATCAAGAG CACCATGGGCAAGCCCCAGCGCCTATATTAAGGC ACATTTGAATAAAATTCTATTACCAGTTC | | |
| 1761 | NM_0071 04.4_541 | 541 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCCA GGTTTAAATAAGGCAGGAAAGTTCCCTTCCCTGCT CACACACAACGAAAACATGGTGGCCAAAGTGGAT GAGGTGAAGTCCACAATCAAGTTCCAAATGAAGAA GGTGTTATGTCTGGCTGTAGCTGTGGTCACGTGAA GATGACAGACGATGAGCTTGTGTATAACATTCACC TGGCTGTCAACTTCTTGGTGTCATTGCTCAAGAAA AACTGGCAGAATGTCCGGGCCTTATATATCAAGAG CACCATGGGCAAGCCCCAGCGCCTATATTAAGGC ACATTTGAATAAAATTCTATTACCAGTTC | 2 | VT* |
| 1762 | NM_0071 04.4_579 | 579 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCCA GGTTTAAATAAGGCAGGAAAGTTCCCTTCCCTGCT CACACACAACGAAAACATGGTGGCCAAAGTGGAT GAGGTGAAGTCCACAATCAAGTTCCAAATGAAGAA GGTGTTATGTCTGGCTGTAGCTGTTGGTCACGTGA AGATGACAGACGATGAGCTTGTGTATACATTCACC TGGCTGTCAACTTCTTGGTGTCATTGCTCAAGAAA AACTGGCAGAATGTCCGGGCCTTATATATCAAGAG CACCATGGGCAAGCCCCAGCGCCTATATTAAGGC ACATTTGAATAAAATTCTATTACCAGTTC | 46 | TFTWLSTS WCHCSRK TGRMSGP YISRAPWA SPSAYIKA HLNKFYYQ F |
| 1763 | NM_0071 04.4_614 | 614 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCCA GGTTTAAATAAGGCAGGAAAGTTCCCTTCCCTGCT CACACACAACGAAAACATGGTGGCCAAAGTGGAT GAGGTGAAGTCCACAATCAAGTTCCAAATGAAGAA GGTGTTATGTCTGGCTGTAGCTGTTGGTCACGTGA AGATGACAGACGATGAGCTTGTGTATAACATTCAC | 34 | SRKTGRM SGPYISRA PWASPSA YIKAHLNKF YYQF |

TABLE 3A-continued

| SEQ ID | identifier_position | position | modified_RNA | PAP length | PAP |
|---|---|---|---|---|---|
| | | | CTGGCTGTCAACTTCTTGGTGTCATTGTCAAGAAA AACTGGCAGAATGTCCGGGCCTTATATATCAAGAG CACCATGGGCAAGCCCCAGCGCCTATATTAAGGC ACATTTGAATAAATTCTATTACCAGTTC | | |
| 1764 | NM_0071 04.4_643 | 643 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCCA GGTTTAAATAAGGCAGGAAAGTTCCCTTCCCTGCT CACACACAACGAAAACATGGTGGCCAAAGTGGAT GAGGTGAAGTCCACAATCAAGTTCCAAATGAAGAA GGTGTTATGTCTGGCTGTAGCTGTTGGTCACGTGA AGATGACAGACGATGAGCTTGTGTATAACATTCAC CTGGCTGTCAACTTCTTGGTGTCATTGCTCAAGAA AAACTGGCAGAATGTCCGGGCTTATATATCAAGAG CACCATGGGCAAGCCCCAGCGCCTATATTAAGGC ACATTTGAATAAATTCTATTACCAGTTC | 24 | YISRAPWA SPSAYIKA HLNKFYYQ F |
| 1765 | NM_0071 04.4_661 | 661 | AGTCTCTTTTCCGGTTAGCGCGGCGTGAGAAGCC ATGAGCAGCAAAGTCTCTCGCGACACCCTGTACG AGGCGGTGCGGGAAGTCCTGCACGGGAACCAGC GCAAGCGCCGCAAGTTCCTGGAGACGGTGGAGTT GCAGATCAGCTTGAAGAACTATGATCCCCAGAAGG ACAAGCGCTTCTCGGGCACCGTCAGGCTTAAGTC CACTCCCCGCCCTAAGTTCTCTGTGTGTGTCCTGG GGGACCAGCAGCACTGTGACGAGGCTAAGGCCGT GGATATCCCCCACATGGACATCGAGGCGCTGAAA AAACTCAACAAGAATAAAAAACTGGTCAAGAAGCT GGCCAAGAAGTATGATGCGTTTTTGGCCTCAGAGT CTCTGATCAAGCAGATTCCACGAATCCTCGGCCCA GGTTTAAATAAGGCAGGAAAGTTCCCTTCCCTGCT CACACACAACGAAAACATGGTGGCCAAAGTGGAT GAGGTGAAGTCCACAATCAAGTTCCAAATGAAGAA GGTGTTATGTCTGGCTGTAGCTGTTGGTCACGTGA AGATGACAGACGATGAGCTTGTGTATAACATTCAC CTGGCTGTCAACTTCTTGGTGTCATTGCTCAAGAA AAACTGGCAGAATGTCCGGGCCTTATATATCAAGA GCACATGGGCAAGCCCCAGCGCCTATATTAAGGC ACATTTGAATAAATTCTATTACCAGTTC | 18 | WASPSAYI KAHLNKFY YQF |
| 1766 | NM_0071 26.2_1868 | 1868 | CTGCCACTGCCACCTCGCGGATCAGGAGCCAGCG TTGTTCGCCCCGACGCCTCGCTGCCGGTGGGAGGA AGCGAGAGGGAAGCCGCTTGGGCTCTTGTCGCCG CTGCTCGCCCACCGCCTGGAAGAGCCGAGCCCC GGCCAGTCGGTCGCTTGCCACCGCTCGTAGCCGT TACCCGCGGGCCGCCACAGCCGCCGGCGGGAGA GGCGCGCGCCATGGCTTCTGGAGCCGATTCAAAA GGTGATGACCTATCAACAGCCATTCTCAAACAGAA GAACCGTCCCAATCGGTTAATTGTTGATGAAGCCA TCAATGAGGACAACAGTGTGGTGTCCTTGTCCCAG CCCAAGATGGATGAATTGCAGTTGTTCCGAGGTGA CACAGTGTTGCTGAAAGGAAAGAAGAGACGAGAA GCTGTTTGCATCGTCCTTTCTGATGATACTTGTTCT GATGAGAAGATTCGGATGAATAGAGTTGTTCGGAA TAACCTTCGTGTACGCCTAGGGGATGTCATCAGCA TCCAGCCATGCCCTGATGTGAAGTACGGCAAACG TATCCATGTGCTGCCCATTGATGACACAGTGGAAG GCATTACTGGTAATCTCTTCGAGGTATACCTTAAG CCGTACTTCCTGGAAGCGTATCGACCCATCCGGA AAGGAGACATTTTTCTTGTCCGTGGTGGGATGCGT GCTGTGGAGTTCAAAGTGGTGGAAACAGATCCTA GCCCTTATTGCATTGTTGCTCCAGACACAGTGATC CACTGCGAAGGGGAGCCTATCAAACGAGAGGATG AGGAAGAGTCCTTGAATGAAGTAGGGTATGATGAC ATTGGTGGCTGCAGGAAGCAGCTAGCTCAGATCA AAGAGATGGTGGAACTGCCCCTGAGACATCCTGC CCTCTTTAAGGCAATTGGTGTGAAGCCTCCTAGAG GAATCCTGCTTTACGGACCTCCTGGAACAGGAAAG ACCCTGATTGCTCGAGCTGTAGCAAATGAGACTGG AGCCTTCTTCTTCTTGATCAATGG | 53 | LGSLRPMS EKSLTRPA KLPPVCYS LMSWIRLP RLVEVTLE MVVGLLTE SSTRS* |

TABLE 3A-continued

| SEQ ID | identifier_position | position | modified_RNA | PAP length | PAP |
|---|---|---|---|---|---|
| 1767 | NM_0071 65.4_449 | 449 | GGAAGTGCTTTCTTTGCCCGCCGTTCGCCAAACGA AGTCGTGGAGGTGGCGAAACGAGGAGGAGATAAC GCGGCCTTGGGCTCTGGTGTCTCCCAGTCTGCTA AAGCCCTAAGGCCATCACCATGGACTTCCAGCATC GCCCCGGGGGCAAGACCGGGAGCGGGGGCGTG GCCTCCTCCTCCGAGAGCAACCGTGACCGCAGGG AGCGCCTCCGGCAGCTGGCCCTGGAGACCATCGA CATCAACAAGGACCCGTACTTCATGAAGAACCACC TGGGCTCCTATGAATGCAAACTCTGCCTGACACTT CACAACAATGAGGGGAGCTACCTGGCACATACGC AGGGGAAGAAGCACCAGACCAACCTGGCCCGGC GAGCAGCCAAGGAGGCCAAGGAGGCCCCTGCCC AGCCCGCGCCTGAGAAGGTCAAGGTGGAGGTGAA GAAGTTGTGAAGATCGGCCGCCCGGGCTACAAAG TGACCAAGCAGAGAGACTCGGAGATGGGCCAGCA GAGCCTCCTCTTCCAGATTGACTACCCTGAGATCG CCGAGGGCATCATGCCACGTCACCGCTTCATGTCT GCGTACGAGCAGAGGATCGAGCCTCCGGACCGG CGCTGGCAGTACCTGCTCATGGCCGCCGAGCCCT ACGAGACCATTGCCTTCAAGGTGCCGAGCAGAGA GATCGACAAGGCGGAGGGCAAGTTCTGGACACAC TGGAACCGGGAGACCAAGCAGTTCTTCCTCCAGTT CCACTTTAAGATGGAGAAGCCCCCGGCTCCACCC AGCCTCCCTGCTGGCCCCCCTGGGGTGAAGCGGC CTCCACCCCCGCTGATGAACGGTCTGCCCCCTCG GCCACCGCTGCCTGAGTCTTTGCCACCGCCCCG CCAGGAGGCCTGCCTCTGCCACCCATGCCCCCCA CAGGGCCTGCGCCCTCAGGGCCCCCGGGACCAC CCCAGCTACCCCGCCAGCTCCAGGGGTCCACCC CCCGGCCCCAGTGGTGCATCCCCCTGCATCTGGG GTC | 1 | L* |
| 1768 | NM_0071 78.3_995 | 995 | TCGTCATTTCCGGCGGGTGCTCTGCGTCATTTACG TCGTCACTTCCTGCCGATGCCGGTGTGGACGCTG TGAATCGTGGCTGGCCCGGTTCTCCGCTTCTCCC CATCCCCTACTTTCCTCCCTCCCTCCCTTTCCCTC CCTCGTCGACTGTTGCTTGCTGGTCGCAGACTCCC TGACCCCTCCCTCACCCCTCCCTAACCTCGGTGCC ACCGGATTGCCCTTCTTTTCCTGTTGCCCAGCCCA GCCCTAGTGTCAGGGCGGGGGCCTGGAGCAGCC CGAGGCACTGCAGCAGAAGAGAGAAAAGACAACG ACGACCCTCAGCTCGCCAGTCCGGTCGCTGGCTT CGCCGCCGCCATGGCAATGAGACAGACGCCGCTC ACCTGCTCTGGCCACACGCGACCCGTGGTTGATTT GGCCTTCAGTGGCATCACGCCTTATGGGTATTTCT TAATCAGCGCTTGCAAAGATGGTAAACCTATGCTA CGCCAGGGAGATACAGGAGACTGGATTGGAACAT TTTGGGTCATAAAGGTGCTGTTTGGGGTGCAACA CTGAATAAGGATGCCACCAAAGCAGCTACAGCAG CTGCAGATTTCACAGCCAAAGTGTGGGATGCTGTC TCAGGAGATGAATTGATGACCCTGGCTCATAAACA CATTGTCAAGACTGTGGATTTCACGCAGGATAGTA ATTATTTGTTAACCGGGGGACAGGATAAACTGTTA CGCATATATGACTTGAACAAACCTGAAGCAGAACC TAAGGAAATTAGTGGTCATACTTCTGGTATAAAAAA AGCTCTGTGGTGCAGTGAGGATAAACAGATTCTTT CTGCTGATGACAAAACTGTTCGACTTTGGGATCAT GCTACTATGACAGAAGTGAAATCTCTAAATTTTAAT ATGTCTGTTAGTAGTATGGAATATATTCCTGAGGG AGAGATTTTGGTTATAACTTATGGACGATCTATTGC TTTTCATAGTGCAGTAAGTTGGACCCAATTAAATCC TTTGAAGCTCCTGC | 44 | WTQLNPLK LLQPSILHL FILRKNFLL QAVKILNFI SMIIIVEKN* |
| 1769 | NM_0072 08.2_275 | 275 | GCTTTCTTTCCGTCGCAGAGAGCATCGGCCGGCG ACCGTTCCGGCGGCCATTGCGAAAACTTCCCCAC GGCTACTGCGTCCACGTGGCGGTGGCGTGGGGA CTCCCTGAAAGCAGAGCGGCAGGGCGCCCGGAA GTCGTGAGTCGAGTCTTCCCGGGCTAATCCATGC CGGGGTTGGAGGCTGCTGACGCAGGTCGGCGCCC AGGTGCTGGGTCGACTCGGGGACGGCCTGGGTG CTGCCCTGGGCCCGGGGAACAGAACACACATCTG GCTTTTGTTAGAGGTCTTCATGGAAAGAGTGGTAC ATGGTGGGATGAGCATCTTTCTGAAGAAAATGTCC CATTCATTAAGCAGTTGGTCTCTGATGAAGATAAA GCCCAATTAGCAAGTAAACTGTGTCCTCTGAAAGA TGAACCATGGCCTATACATCCTTGGGAACCAGGTT CCTTTAGAGTTGGTCTTATTGCCTTGAAGCTGGGC ATGATGCCTTTATGGACCAAGGATGGTCAAAAGCA TGTGGTCACATTACTTCAGGTACAAGACTGTCATG | 36 | LLEVFMER VVHGGMSI FLKKMSHS LSSWSLMK IKPN* |

TABLE 3A-continued

| SEQ ID | identifier_position | position | modified_RNA | PAP length | PAP |
|---|---|---|---|---|---|
| | | | TCTTAAAATATACGTCAAAGGAAAACTGTAATGGAA AAATGGCAACCCTGTCTGTAGGAGGAAAAACTGTA TCACGTTTTCGTAAAGCTACATCCATATTGGAATTT TACCGGGAACTTGGATTGCCGCCGAAACAGACAG TTAAAAATCTTTAATATAACAGATAATGCTGCAATTA AACCAGGCACTCCTCTTTATGCTGCTCACTTTCGT CCAGGACAGTATGTGGATGTCACAGCCAAAACTAT TGGTAAAGGTTTTCAAGGTGTCATGAAAAGATGGG GATTTAAAGGCCAGCCTGCTACGCATGGTCAAACG AAAACCCACAGGAGACCTGGAGCTGTTGCAACTG GTGATATTGGCAGAGTCTGGCCTGGAACTAAAATG CCTGGAAAAATGGGAAACATATACAGGACAGAATA TGGACTGAAAGTGTGGAGAATAAACACAAAGCACA ACATAATCTATGTAAATGGC | | |
| 1770 | NM_0072 44.2_215 | 215 | CAACGCAGAGTTGGGAGCAACTCCAGAGCCTCCT TCAAGATGCTGCTGGTCCTGCTCTCAGTGGTCCTT CTGGCTCTGAGCTCAGCTCAGAGCACAGATAATGA TGTGAACTATGAAGACTTTACTTTCACCATACCAGA TGTAGAGGACTCAAGTCAGAGACCAGATCAGGGA CCCCAGAGACCTCCTCCTGAAGGACTCCTACCTA GACCCCTGGTGATAGTGGTAACCAAGATGATGGT CCTCAGCAGAGACCACCAAAACCAGGAGGCCATC ACCGCCATCCTCCCCCACCTCCTTTTCAAAATCAG CAACGACCACCCCGACGAGGACACCGTCAACTCT CTCTACCCCGATTTCCTTCTGTCAGCCTGCAGGAA GCATCATCATTCTTCCAGAGGGACAGACCAGCAAG ACATCCCCAGGAGCAACCACTCTGGTAATCTAGAA TTCAGTGGCAGAAAATAAATAAGAAGATAACTTCCT TCAGAAAGCCATGACATTGAAATAATGTGGTCATA ACTCTTTCTTCAGTATACCAATAAAATATTAATAGC ATGC | 84 | LVIVVTKM MVLSRDH QNQEAITAI LPHLLFKIS NDHPDEDT VNSLYPDF LLSACRKH HHSSRGT DQQDIPRS NHSGNLEF SGRK* |
| 1771 | NM_0072 62.3_441 | 441 | GGGGTGAGTGGTACCCAACGGGCCGGGGCGCCG CGTCCGCAGGAAGAGGCGCGGGGTGCAGGCTTG TAAACATATAACATAAAAATGGCTTCCAAAAGAGCT CTGGTCATCCTGGCTAAAGGAGCAGAGGAAATGG AGACGGTCATCCCTGTAGATGTCATGAGGCGAGC TGGGATTAAGGTCACCGTTGCAGGCCTGGCTGGA AAAGACCCAGTACAGTGTAGCCGTGATGTGGTCAT TTGTCCTGATGCCAGCCTTGAAGATGCAAAAAAAG AGGGACCATATGATGTGGTGGTTCTACCAGGAGG TAATCTGGGTGCACAGAATTTATCTGAGTCTGCTG CTGTGAAGGAGATACTGAAGGAGCAGGAAAACCG GAAGGGCCTGATAGCCGCCATCTGTGCAGGTCCT ACTGCTCTGTTGGCTCATGAAATAGGTTTTGGAAGT AAAGTTACAACACACCCTCTTGCTAAAGACAAAAT GATGAATGGAGGTCATTACACCTACTCTGAGAATC GTGTGGAAAAAGACGGCTGATTCTTACAAGCCG GGGGCCTGGGACCAGCTTCGAGTTTGCGCTTGCA ATTGTTGAAGCCCTGAATGGCAAGGAGGTGGCGG CTCAAGTGAAGGCTCCACTTGTTCTTAAAGACTAG AGCAGCGAACTGCGACGATCACTTAGAGAAACAG GCCGTTAGGAATCCATTCTCACTGTGTTCGCTCTA AACAAAACAGTGGTAGGTTAATGTGTTCAGAAGTC GCTGTCCTTACTACTTTTGCGGAAGTATGGAAGTC ACAACTACACAGAGATTTCTCAGCCTACAAATTGT GTCTATACATTTCTAAGCCTTGTTTGCAGAATAAAC AGGGCATTTAGC AAAAAA | 14 | LEVKLQHT LLLKTK* |
| 1772 | NM_0072 62.3_535 | 535 | GGGGTGAGTGGTACCCAACGGGCCGGGGCGCCG CGTCCGCAGGAAGAGGCGCGGGGTGCAGGCTTG TAAACATATAACATAAAAATGGCTTCCAAAAGAGCT CTGGTCATCCTGGCTAAAGGAGCAGAGGAAATGG AGACGGTCATCCCTGTAGATGTCATGAGGCGAGC TGGGATTAAGGTCACCGTTGCAGGCCTGGCTGGA AAAGACCCAGTACAGTGTAGCCGTGATGTGGTCAT TTGTCCTGATGCCAGCCTTGAAGATGCAAAAAAAG AGGGACCATATGATGTGGTGGTTCTACCAGGAGG TAATCTGGGTGCACAGAATTTATCTGAGTCTGCTG CTGTGAAGGAGATACTGAAGGAGCAGGAAAACCG GAAGGGCCTGATAGCCGCCATCTGTGCAGGTCCT ACTGCTCTGTTGGCTCATGAAATAGGTTTTGGAAG TAAAGTTACAACACACCCTCTTGCTAAAGACAAAAT GATGAATGGAGGTCATTACACCTACTCTGAGAATC GTGTGGAAAAAGACGGCTGATTCTTACAAGCCGG GGGCCTGGGACCAGCTTCGAGTTTGCGCTTGCAA TTGTTGAAGCCCTGAATGGCAAGGAGGTGGCGGC TCAAGTGAAGGCTCCACTTGTTCTTAAAGACTAGA | 0 | * |

TABLE 3A-continued

| SEQ ID | identifier_position | position | modified_RNA | PAP length | PAP |
|---|---|---|---|---|---|
| | | | GCAGCGAACTGCGACGATCACTTAGAGAAACAGG<br>CCGTTAGGAATCCATTCTCACTGTGTTCGCTCTAA<br>ACAAAACAGTGGTAGGTTAATGTGTTCAGAAGTCG<br>CTGTCCTTACTACTTTTGCGGAAGTATGGAAGTCA<br>CAACTACACAGAGATTTCTCAGCCTACAAATTGTG<br>TCTATACATTTCTAAGCCTTGTTTGCAGAATAAACA<br>GGGCATTTAGC<br>AAAAA | | |
| 1773 | NM_0072<br>63.3_472 | 472 | GACGTGTCTTTCAGGAAGAGGAGCTGGTGAGAAG<br>ACAGCGAAATGGCGCCTCCGGCCCCCGGCCCGG<br>CCTCCGGCGGCTCCGGGGAGGTAGACGAGCTGTT<br>CGACGTAAAGAACGCCTTCTACATCGGCAGCTACC<br>AGCAGTGCATAAACGAGGCGCAGCGGGTGAAGCT<br>ATCAAGCCCAGAGAGAGACGTGGAGAGGGACGTC<br>TTCCTGTATAGAGCGTACCTGGCGCAGAGGAAGTT<br>CGGTGTGGTCCTGGATGAGATCAAGCCCTCCTCG<br>GCCCCTGAGCTCCAGGCCGTGCGCATGTTTGCTG<br>ACTACCTCGCCCACGAGAGTCGGAGGGACAGCAT<br>CGTGGCCGAGCTGGACCGAGAGATGAGCAGGAG<br>CGTGGACGTGACCAACACCACCTTCCTGCTCATG<br>GCCGCCTCCATCTATCTCCACGACCAGAACCCGG<br>ATGCCGCCCTGCGTGCGCTGCACCAGGGGACAG<br>CCTGGAGTGCACAGCCATGACAGTGCAGATCCTG<br>CTGAAGCTGGACCGCCTGGACCTCGCCCGGAAGG<br>AGCTGAAGAGAATGCAGGACCTGGACGAGGATGC<br>CACCCTCACCCAGCTCGCCACTGCCTGGGTCAGC<br>CTGGCCACGGGTGGTGAGAAGCTGCAGGATGCCT<br>ACTACATCTTCCAGGAGATGGCTGACAAGTGCTCG<br>CCCCACCCTGCTGCTGCTCAATGGGCAGGCGGCCT<br>GCCACATGGCCCAGGGCCGCTGGGAGGCCGCTG<br>AGGGCCTGCTGCAGGAGGCGCTAGACAAGGATAG<br>TGGCTACCCAGAGACGCTGGTCAACCTCATCGTC<br>CTGTCCCAGCACCTGGGCAAGCCCCCTGAGGTGA<br>CAAACCGATACCTGTCCCAGCTGAAGGATGCCCA<br>CAGGTCCCATCCCTTCATCAAGGAGTACCAGGCC<br>AAGGAGAACGACTTTGACAGGCTGGTGCTACAGT<br>ACGCTCCCAGCGCCTGAGGCTGGCCCAGAGCTGT<br>CAGGACCATGAAGCCAGGACAGAGGCCAGGAGC<br>CAGCCC | 7 | TAWSAQP* |
| 1774 | NM_0072<br>63.3_618 | 618 | GACGTGTCTTTCAGGAAGAGGAGCTGGTGAGAAG<br>ACAGCGAAATGGCGCCTCCGGCCCCCGGCCCGG<br>CCTCCGGCGGCTCCGGGGAGGTAGACGAGCTGTT<br>CGACGTAAAGAACGCCTTCTACATCGGCAGCTACC<br>AGCAGTGCATAAACGAGGCGCAGCGGGTGAAGCT<br>ATCAAGCCCAGAGAGAGACGTGGAGAGGGACGTC<br>TTCCTGTATAGAGCGTACCTGGCGCAGAGGAAGTT<br>CGGTGTGGTCCTGGATGAGATCAAGCCCTCCTCG<br>GCCCCTGAGCTCCAGGCCGTGCGCATGTTTGCTG<br>ACTACCTCGCCCACGAGAGTCGGAGGGACAGCAT<br>CGTGGCCGAGCTGGACCGAGAGATGAGCAGGAG<br>CGTGGACGTGACCAACACCACCTTCCTGCTCATG<br>GCCGCCTCCATCTATCTCCACGACCAGAACCCGG<br>ATGCCGCCCTGCGTGCGCTGCACCAGGGGGACA<br>GCCTGGAGTGCACAGCCATGACAGTGCAGATCCT<br>GCTGAAGCTGGACCGCCTGGACCTCGCCCGGAAG<br>GAGCTGAAGAGAATGCAGGACCTGGACGAGGATG<br>CCACCCTCACCCAGCTCGCCACTGCCTGGGTCAG<br>CCTGGCACGGGTGGTGAGAAGCTGCAGGATGCCT<br>ACTACATCTTCCAGGAGATGGCTGACAAGTGCTCG<br>CCCACCCTGCTGCTGCTCAATGGGCAGGCGGCCT<br>GCCACATGGCCCAGGGCCGCTGGGAGGCCGCTG<br>AGGGCCTGCTGCAGGAGGCGCTAGACAAGGATAG<br>TGGCTACCCAGAGACGCTGGTCAACCTCATCGTC<br>CTGTCCCAGCACCTGGGCAAGCCCCCTGAGGTGA<br>CAAACCGATACCTGTCCCAGCTGAAGGATGCCCA<br>CAGGTCCCATCCCTTCATCAAGGAGTACCAGGCC<br>AAGGAGAACGACTTTGACAGGCTGGTGCTACAGT<br>ACGCTCCCAGCGCCTGAGGCTGGCCCAGAGCTGT<br>CAGGACCATGAAGCCAGGACAGAGGCCAGGAGC<br>CAGCCC | 50 | RVVRSCR<br>MPTTSSRR<br>WLTSARPP<br>CCCSMGR<br>RPATWPR<br>AAGRPLRA<br>CCRRR* |
| 1775 | NM_0072<br>66.2_79 | 79 | GGGTGGGTGGGGCCAGGAGGAAGATGGCGGCGT<br>CCGCAGCTGCCGCTGAGCTCCAGGCTTCTGGGGG<br>TCCGCGGCACCAGTGTGTCTGTTGGTGTTGGGAA<br>TGGCGGGATCCGGGAAAACCACTTTTGTACAGAG<br>GCTCACAGGACACCTGCATGCCCAAGGCACTCCA<br>CCGTATGTGATCAACCTGGATCCAGCAGTACATGA<br>AGTTCCCTTTCCTGCCAATATTGATATTCGTGATAC | 33 | QCVCWCW<br>EWRDPGK<br>PLLYRGSQ<br>DTCMPKAL<br>HRM* |

TABLE 3A-continued

| SEQ ID | identifier_position | position | modified_RNA | PAP length | PAP |
|---|---|---|---|---|---|
| | | | TGTAAAGTATAAAGAAGTAATGAAACAATATGGACT<br>TGGACCCAATGGCGGCATAGTGACCTCACTCAATC<br>TCTTTGCTACCAGATTTGATCAGGTGATGAAATTTA<br>TTGAGAAGGCCCAGAACATGTCCAAATATGTGTTG<br>ATTGACACACCTGGACAGATTGAGGTATTCACCTG<br>GTCAGCTTCTGGGACAATTATCACTGAAGCCCTTG<br>CATCCTCATTTCCAACAGTTGTCATCTATGTAATGG<br>ACACATCGAGAAGTACCAACCCAGTGACCTTCATG<br>TCCAACATGCTCTATGCCTGCAGCATCTTATACAA<br>AACCAAGCTGCCTTTCATTGTGGTCATGAATAAAA<br>CTGACATCATTGACCACAGCTTTGCAGTGGAATGG<br>ATGCAGGATTTTGAGGCTTTCCAAGATGCCTTGAA<br>TCAAGAGACTACATACGTCAGTAACCTGACTCGTT<br>CAATGAGCCTGGTGTTAGATGAGTTTTACAGCTCA<br>CTCAGGGTGGTGGGTGTCTCTGCTGTTCTGGGTA<br>CTGGATTAGATGAACTCTTTGTGCAAGTTACCAGT<br>GCTGCCGAAGAATATGAAAGGGAGTATCGTCCTG<br>AATATGAACGTCTGAAAAAATCACTGGCCAACGCA<br>GAGAGCCAACAGCAGAGAGAACAACTGGAACGCC<br>TTCGAAAAGATATGGGTTCTGTAGCCTTGGATGCA<br>GGGACTGCCAAAGACAGCTTATCTCCTGTGCTGCA<br>CCCTTCTGATTTGATCCTGACTCGAGGAACCTTGG<br>ATGAAGAGGATGAG | | |
| 1776 | NM_0072 73.3_252 | 252 | AAGTTCGGGTCCGTAGTGGGCTAAGGGGGAGGGT<br>TTCAAAGGGAGCGCACTTCCGCTGCCCTTTCTTTC<br>GCCAGCCTTACGGGCCCGAACCCTCGTGTGAAGG<br>GTGCAGTACCTAAGCCGGAGCGGGGTAGAGGCG<br>GGCCGGCACCCCCTTCTGACCTCCAGTGCCGCCG<br>GCCTCAAGATCAGACATGGCCCAGAACTTGAAGG<br>ACTTGGCGGGACGGCTGCCCGCCGGGCCCCGGG<br>GCATGGGCACGGCCTGAAGCTGTTGCTGGGGGCC<br>GGCGCCGTGGCCTACGGTGTGCGCGAATCTGTGT<br>TCACCGTGGAAGGCGGGCACAGAGCCATCTTCTT<br>CAATCGGATCGGTGGAGTGCAGCAGGACACTATC<br>CTGGCCGAGGGCCTTCACTTCAGGATCCCTTGGTT<br>CCAGTACCCCATTATCTATGACATTCGGGCCAGAC<br>CTCGAAAAATCTCCTCCCCTACAGGCTCCAAAGAC<br>CTACAGATGGTGAATATCTCCCTGCGAGTGTTGTC<br>TCGACCCAATGCTCAGGAGCTTCCTAGCATGTACC<br>AGCGCCTAGGGCTGGACTACGAGGAACGAGTGTT<br>GCCGTCCATTGTCAACGAGGTGCTCAAGAGTGTG<br>GTGGCCAAGTTCAATGCCTCACAGCTGATCACCCA<br>GCGGGCCCAGGTATCCCTGTTGATCCGCCGGGAG<br>CTGACAGAGAGGGCCAAGGACTTCAGCCTCATCC<br>TGGATGATGTGGCCATCACAGAGCTGAGCTTTAGC<br>CGAGAGTACACAGCTGCTGTAGAAGCCAAACAAG<br>TGGCCCAGCAGGAGGCCCAGCGGGCCCAATTCTT<br>GGTAGAAAAAGCAAAGCAGGAACAGCGGCAGAAA<br>ATTGTGCAGGCCGAGGGTGAGGCCGAGGCTGCC<br>AAGATGCTTGGAGAAGCACTGAGCAAGAACCCTG<br>GCTACATCAAACTTCGCAAGATTCGAGCAGCCCAG<br>AATATCTCCAAGACGATCGCCACATCACAGAATCG<br>TATCTATCTCACAGCTGACAACCTTGTGCTG | 0 | * |
| 1777 | NM_0072 73.3_660 | 660 | AAGTTCGGGTCCGTAGTGGGCTAAGGGGGAGGGT<br>TTCAAAGGGAGCGCACTTCCGCTGCCCTTTCTTTC<br>GCCAGCCTTACGGGCCCGAACCCTCGTGTGAAGG<br>GTGCAGTACCTAAGCCGGAGCGGGGTAGAGGCG<br>GGCCGGCACCCCCTTCTGACCTCCAGTGCCGCCG<br>GCCTCAAGATCAGACATGGCCCAGAACTTGAAGG<br>ACTTGGCGGGACGGCTGCCCGCCGGGCCCCGGG<br>GCATGGGCACGGCCTGAAGCTGTTGCTGGGGGC<br>CGGCGCCGTGGCCTACGGTGTGCGCGAATCTGTG<br>TTCACCGTGGAAGGCGGGCACAGAGCCATCTTCT<br>TCAATCGGATCGGTGGAGTGCAGCAGGACACTAT<br>CCTGGCCGAGGGCCTTCACTTCAGGATCCCTTGG<br>TTCCAGTACCCCATTATCTATGACATTCGGGCCAG<br>ACCTCGAAAAATCTCCTCCCCTACAGGCTCCAAAG<br>ACCTACAGATGGTGAATATCTCCCTGCGAGTGTTG<br>TCTCGACCCAATGCTCAGGAGCTTCCTAGCATGTA<br>CCAGCGCCTAGGGCTGGACTACGAGGAACGAGTG<br>TTGCCGTCCATTGTCAACGAGGTGCTCAAGAGTGT<br>GGTGGCCAAGTTCAATGCCTCACAGCTGATCACC<br>CAGCGGGCCAGGTATCCCTGTTGATCCGCCGGGA<br>GCTGACAGAGAGGGCCAAGGACTTCAGCCTCATC<br>CTGGATGATGTGGCCATCACAGAGCTGAGCTTTAG<br>CCGAGAGTACACAGCTGCTGTAGAAGCCAAACAA<br>GTGGCCCAGCAGGAGGCCCAGCGGGCCCAATTCT | 4 | RYPC* |

TABLE 3A-continued

| SEQ ID | identifier_ position | position | modified_RNA | PAP length | PAP |
|---|---|---|---|---|---|
| | | | TGGTAGAAAAAGCAAAGCAGGAACAGCGGCAGAA<br>AATTGTGCAGGCCGAGGGTGAGGCCGAGGCTGC<br>CAAGATGCTTGGAGAAGCACTGAGCAAGAACCCT<br>GGCTACATCAAACTTCGCAAGATTCGAGCAGCCCA<br>GAATATCTCCAAGACGATCGCCACATCACAGAATC<br>GTATCTATCTCACAGCTGACAACCTTGTGCTG | | |
| 1778 | NM_0072 73.3_681 | 681 | AAGTTCGGGTCCGTAGTGGGCTAAGGGGGAGGGT<br>TTCAAAGGGAGCGCACTTCCGCTGCCCTTTCTTTC<br>GCCAGCCTTACGGGCCCGAACCCTCGTGTGAAGG<br>GTGCAGTACCTAAGCCGGAGCGGGGTAGAGGCG<br>GGCCGGCACCCCCTTCTGACCTCCAGTGCCGCCG<br>GCCTCAAGATCAGACATGGCCCAGAACTTGAAGG<br>ACTTGGCGGGACGGCTGCCCGCCGGGCCCCGGG<br>GCATGGGCACGGCCCTGAAGCTGTTGCTGGGGGC<br>CGGCGCCGTGGCCTACGGTGTGCGCGAATCTGTG<br>TTCACCGTGGAAGGCGGGCACAGAGCCATCTTCT<br>TCAATCGGATCGGTGGAGTGCAGCAGGACACTAT<br>CCTGGCCGAGGGCCTTCACTTCAGGATCCCTTGG<br>TTCCAGTACCCCATTATCTATGACATTCGGGCCAG<br>ACCTCGAAAAATCTCCTCCCCTACAGGCTCCAAAG<br>ACCTACAGATGGTGAATATCTCCCTGCGAGTGTTG<br>TCTCGACCCAATGCTCAGGAGCTTCCTAGCATGTA<br>CCAGCGCCTAGGGCTGGACTACGAGGAACGAGTG<br>TTGCCGTCCATTGTCAACGAGGTGCTCAAGAGTGT<br>GGTGGCCAAGTTCAATGCCTCACAGCTGATCACC<br>CAGCGGGCCCAGGTATCCCTGTTGATCCGCGGGA<br>GCTGACAGAGAGGGCCAAGGACTTCAGCCTCATC<br>CTGGATGATGTGGCCATCACAGAGCTGAGCTTTAG<br>CCGAGAGTACACAGCTGCTGTAGAAGCCAAACAA<br>GTGGCCCAGCAGGAGGCCCAGCGGGCCCAATTCT<br>TGGTAGAAAAAGCAAAGCAGGAACAGCGGCAGAA<br>AATTGTGCAGGCCGAGGGTGAGGCCGAGGCTGC<br>CAAGATGCTTGGAGAAGCACTGAGCAAGAACCCT<br>GGCTACATCAAACTTCGCAAGATTCGAGCAGCCCA<br>GAATATCTCCAAGACGATCGCCACATCACAGAATC<br>GTATCTATCTCACAGCTGACAACCTTGTGCTG | 2 | GS* |
| 1779 | NM_0072 73.3_734 | 73 4 | AAGTTCGGGTCCGTAGTGGGCTAAGGGGGAGGGT<br>TTCAAAGGGAGCGCACTTCCGCTGCCCTTTCTTTC<br>GCCAGCCTTACGGGCCCGAACCCTCGTGTGAAGG<br>GTGCAGTACCTAAGCCGGAGCGGGGTAGAGGCG<br>GGCCGGCACCCCCTTCTGACCTCCAGTGCCGCCG<br>GCCTCAAGATCAGACATGGCCCAGAACTTGAAGG<br>ACTTGGCGGGACGGCTGCCCGCCGGGCCCCGGG<br>GCATGGGCACGGCCCTGAAGCTGTTGCTGGGGGC<br>CGGCGCCGTGGCCTACGGTGTGCGCGAATCTGTG<br>TTCACCGTGGAAGGCGGGCACAGAGCCATCTTCT<br>TCAATCGGATCGGTGGAGTGCAGCAGGACACTAT<br>CCTGGCCGAGGGCCTTCACTTCAGGATCCCTTGG<br>TTCCAGTACCCCATTATCTATGACATTCGGGCCAG<br>ACCTCGAAAAATCTCCTCCCCTACAGGCTCCAAAG<br>ACCTACAGATGGTGAATATCTCCCTGCGAGTGTTG<br>TCTCGACCCAATGCTCAGGAGCTTCCTAGCATGTA<br>CCAGCGCCTAGGGCTGGACTACGAGGAACGAGTG<br>TTGCCGTCCATTGTCAACGAGGTGCTCAAGAGTGT<br>GGTGGCCAAGTTCAATGCCTCACAGCTGATCACC<br>CAGCGGGCCCAGGTATCCCTGTTGATCCGCCGGG<br>AGCTGACAGAGAGGGCCAAGGACTTCAGCCTCAT<br>CCTGGATGATGTGGCCATCACAGAGCTGAGCTTTAG<br>CCGAGAGTACACAGCTGCTGTAGAAGCCAAACAA<br>GTGGCCCAGCAGGAGGCCCAGCGGGCCCAATTCT<br>TGGTAGAAAAAGCAAAGCAGGAACAGCGGCAGAA<br>AATTGTGCAGGCCGAGGGTGAGGCCGAGGCTGC<br>CAAGATGCTTGGAGAAGCACTGAGCAAGAACCCT<br>GGCTACATCAAACTTCGCAAGATTCGAGCAGCCCA<br>GAATATCTCCAAGACGATCGCCACATCACAGAATC<br>GTATCTATCTCACAGCTGACAACCTTGTGCTG | 3 | SQS* |
| 1780 | NM_0073 55.2_1079 | 1079 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT | 37 | CYLFLVGL<br>PLTFLRTR<br>RKRTTSNS<br>MSAVCSS<br>WTAVMS* |

TABLE 3A-continued

| SEQ ID | identifier_position | position | modified_RNA | PAP length | PAP |
|---|---|---|---|---|---|
| | | | AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC<br>CCAAGAGGAGTATGGAGAATTCTACAAGAGCCTCA<br>CTAATGACTGGGAAG | | |
| 1781 | NM_0073 55.2_1116 | 1116 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC<br>CCAAGAGGAGTATGGAGAATTCTACAAGAGCCTCA<br>CTAATGACTGGGAAG | 25 | LRTRRKRT<br>TSNSMSAV<br>CSSWTAV<br>MS* |
| 1782 | NM_0073 55.2_129 | 129 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAGG<br>CAGAAATTGCCCAACTCATGTCCCTCATCATCAAT<br>ACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC | 28 | LPFRQKLP<br>NSCPSSSI<br>PSIPTRRF<br>SFGS* |

TABLE 3A-continued

| SEQ ID | identifier_position | position | modified_RNA | PAP length | PAP |
|---|---|---|---|---|---|
| | | | CCAAGAGGAGTATGGAGAATTCTACAAGAGCCTCA CTAATGACTGGGAAGA | | |
| 1783 | NM_0073 55.2_1308 | 1308 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTTGTGATCA CAAAGCACAACGATGATGAACAGTATGCTTGGGAG TCTTCTGCTGGAGGTTCCTTCACTGTGCGTGCTGA CCATGGTGAGCCCATTGGCAGGGGTACCAAAGTG ATCCTCCATCTTAAAGAAGATCAGACAGAGTACCT AGAAGAGAGGCGGGTCAAAGAAGTAGTGAAGAAG CATTCTCAGTTCATAGGCTATCCCATCACCCTTTAT TTGGAGAAGGAACGAGAGAAGGAAATTAGTGATG ATGAGGCAGAGGAAGAGAAAGGTGAGAAAGAAGA GGAAGATAAAGATGATGAAGAAAAAACCCAAGATCG AAGATGTGGGTTCAGATGAGGAGGATGACAGCGG TAAGGATAAGAAGAAGAAAACTAAGAAGATCAAAG AGAAATACATTGATCAGGAAGAACTAAACAAGACC AAGCCTATTTGGACCAGAAACCCTGATGACATCAC CCAAGAGGAGTATGGAGAATTCTACAAGAGCCTCA CTAATGACTGGGAAGA | 58 | MLRSALSS SLSWQKT RRITRNSM RHSLKISSL ESTKTPLT AAACLSCC AIIPPSLEM R* |
| 1784 | NM_0073 55.2_147 | 147 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATGCCCAACTCATGTCCCTCATCATCAAT ACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTTGTGATCA CAAAGCACAACGATGATGAACAGTATGCTTGGGAG TCTTCTGCTGGAGGTTCCTTCACTGTGCGTGCTGA CCATGGTGAGCCCATTGGCAGGGGTACCAAAGTG ATCCTCCATCTTAAAGAAGATCAGACAGAGTACCT AGAAGAGAGGCGGGTCAAAGAAGTAGTGAAGAAG CATTCTCAGTTCATAGGCTATCCCATCACCCTTTAT TTGGAGAAGGAACGAGAGAAGGAAATTAGTGATG ATGAGGCAGAGGAAGAGAAAGGTGAGAAAGAAGA GGAAGATAAAGATGATGAAGAAAAAACCCAAGATCG AAGATGTGGGTTCAGATGAGGAGGATGACAGCGG TAAGGATAAGAAGAAGAAAACTAAGAAGATCAAAG AGAAATACATTGATCAGGAAGAACTAAACAAGACC AAGCCTATTTGGACCAGAAACCCTGATGACATCAC CCAAGAGGAGTATGGAGAATTCTACAAGAGCCTCA CTAATGACTGGGAAGA | 22 | MPNSCPS SSIPSIPTR RFSFGS* |
| 1785 | NM_0073 55.2_1581 | 1581 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTTGTGATCA | 14 | LWSECGN GASRWYI* |

TABLE 3A-continued

| SEQ ID | identifier_position | position | modified_RNA | PAP length | PAP |
|---|---|---|---|---|---|
| | | | CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC<br>CCAAGAGGAGTATGGAGAATTCTACAAGAGCCTCA<br>CTAATGACTGGGAAG | | |
| 1786 | NM_0073<br>55.2_1668 | 1668 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC<br>CCAAGAGGAGTATGGAGAATTCTACAAGAGCCTCA<br>CTAATGACTGGGAAG | 39 | LMGRAWS<br>QLPRRVW<br>SCLRMRR<br>RRRRWKR<br>ARQSLRTS<br>ASS* |
| 1787 | NM_0073<br>55.2_212 | 212 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTGATCTCTAATGCTTCTGATGCCTTGGACAAGAT<br>TCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAAGAAGTAGTGAAGAAG<br>CATTCTCAGTTCATAGGCTATCCCATCACCCTTTAT<br>TTGGAGAAGGAACGAGAGAAGGAAATTAGTGATG<br>ATGAGGCAGAGGAAGAGAAAGGTGAGAAAGAAGA<br>GGAAGATAAAGATGATGAAGAAAAACCCAAGATCG<br>AAGATGTGGGTTCAGATGAGGAGGATGACAGCGG<br>TAAGGATAAGAAGAAGAAAACTAAGAAGATCAAAG<br>AGAAATACATTGATCAGGAAGAACTAAACAAGACC<br>AAGCCTATTTGGACCAGAAACCCTGATGACATCAC<br>CCAAGAGGAGTATGGAGAATTCTACAAGAGCCTCA<br>CTAATGACTGGGAAGA | 0 | * |

TABLE 3A-continued

| SEQ ID | identifier_ position | position | modified_RNA | PAP length | PAP |
|---|---|---|---|---|---|
| 1788 | NM_0073 55.2_236 | 236 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTGGACAAGAT TCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTTGTGATCA CAAAGCACAACGATGATGAACAGTATGCTTGGGAG TCTTCTGCTGGAGGTTCCTTCACTGTGCGTGCTGA CCATGGTGAGCCCATTGGCAGGGGTACCAAAGTG ATCCTCCATCTTAAAGAAGATCAGACAGAGTACCT AGAAGAGAGGCGGGTCAAAGAAGTAGTGAAGAAG CATTCTCAGTTCATAGGCTATCCCATCACCCTTTAT TTGGAGAAGGAACGAGAGAAGGAAATTAGTGATG ATGAGGCAGAGGAAGAGAAAGGTGAGAAAGAAGA GGAAGATAAAGATGATGAAGAAAAACCCAAGATCG AAGATGTGGGTTCAGATGAGGAGGATGACAGCGG TAAGGATAAGAAGAAGAAAAACTAAGAAGATCAAAG AGAAATACATTGATCAGGAAGAACTAAACAAGACC AAGCCTATTTGGACCAGAAACCCTGATGACATCAC CCAAGAGGAGTATGGAGAATTCTACAAGAGCCTCA CTAATGACTGGGAAGA | 8 | WTRFAMR A* |
| 1789 | NM_0073 55.2_285 | 285 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGGGTAAAGAGCTGAAAATTGACATCATCCCC AACCCTCAGGAACGTACCCTGACTTTGGTAGACAC AGGCATTGGCATGACCAAAGCTGATCTCATAAATA ATTTGGGAACCATTGCCAAGTCTGGTACTAAAGCA TTCATGGAGGCTCTTCAGGCTGGTGCAGACATCTC CATGATTGGGCAGTTTGGTGTTGGCTTTTATTCTG CCTACTTGGTGGCAGAGAAAGTGGTTGTGATCACA AAGCACAACGATGATGAACAGTATGCTTGGGAGTC TTCTGCTGGAGGTTCCTTCACTGTGCGTGCTGACC ATGGTGAGCCCATTGGCAGGGGTACCAAAGTGAT CCTCCATCTTAAAGAAGATCAGACAGAGTACCTAG AAGAGAGGCGGGTCAAAGAAGTAGTGAAGAAGCA TTCTCAGTTCATAGGCTATCCCATCACCCTTTATTT GGAGAAGGAACGAGAGAAGGAAATTAGTGATGAT GAGGCAGAGGAAGAGAAAGGTGAGAAAGAAGAGG AAGATAAAGATGATGAAGAAAAACCCAAGATCGAA GATGTGGGTTCAGATGAGGAGGATGACAGCGGTA AGGATAAGAAGAAGAAAACTAAGAAGATCAAAGAG AAATACATTGATCAGGAAGAACTAAACAAGACCAA GCCTATTTGGACCAGAAACCCTGATGACATCACCC AAGAGGAGTATGGAGAATTCTACAAGAGCCTCACT AATGACTGGGAAGA | 4 | RVKS* |
| 1790 | NM_0073 55.2_303 | 303 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATGACATCATCCCC AACCCTCAGGAACGTACCCTGACTTTGGTAGACAC AGGCATTGGCATGACCAAAGCTGATCTCATAAATA ATTTGGGAACCATTGCCAAGTCTGGTACTAAAGCA TTCATGGAGGCTCTTCAGGCTGGTGCAGACATCTC CATGATTGGGCAGTTTGGTGTTGGCTTTTATTCTG CCTACTTGGTGGCAGAGAAAGTGGTTGTGATCACA AAGCACAACGATGATGAACAGTATGCTTGGGAGTC TTCTGCTGGAGGTTCCTTCACTGTGCGTGCTGACC | 11 | MTSSPTLR NVP* |

TABLE 3A-continued

| SEQ ID | identifier_position | position | modified_RNA | PAP length | PAP |
|---|---|---|---|---|---|
| | | | ATGGTGAGCCCATTGGCAGGGGTACCAAAGTGAT<br>CCTCCATCTTAAAGAAGATCAGACAGAGTACCTAG<br>AAGAGAGGCGGGTCAAAGAAGTAGTGAAGAAGCA<br>TTCTCAGTTCATAGGCTATCCCATCACCCTTTATTT<br>GGAGAAGGAACGAGAGAAGGAAATTAGTGATGAT<br>GAGGCAGAGGAAGAGAAAGGTGAGAAAGAAGAGG<br>AAGATAAAGATGATGAAGAAAAACCCAAGATCGAA<br>GATGTGGGTTCAGATGAGGAGGATGACAGCGGTA<br>AGGATAAGAAGAAGAAAACTAAGAAGATCAAAGAG<br>AAATACATTGATCAGGAAGAACTAAACAAGACCAA<br>GCCTATTTGGACCAGAAACCCTGATGACATCACCC<br>AAGAGGAGTATGGAGAATTCTACAAGAGCCTCACT<br>AATGACTGGGAAGA | | |
| 1791 | NM_0073<br>55.2_341 | 341 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTGGTAGACAC<br>AGGCATTGGCATGACCAAAGCTGATCTCATAAATA<br>ATTTGGGAACCATTGCCAAGTCTGGTACTAAAGCA<br>TTCATGGAGGCTCTTCAGGCTGGTGCAGACATCTC<br>CATGATTGGGCAGTTTGGTGTTGGCTTTTATTCTG<br>CCTACTTGGTGGCAGAGAAAGTGGTTGTGATCACA<br>AAGCACAACGATGATGAACAGTATGCTTGGGAGTC<br>TTCTGCTGGAGGTTCCTTCACTGTGCGTGCTGACC<br>ATGGTGAGCCCATTGGCAGGGGTACCAAAGTGAT<br>CCTCCATCTTAAAGAAGATCAGACAGAGTACCTAG<br>AAGAGAGGCGGGTCAAAGAAGTAGTGAAGAAGCA<br>TTCTCAGTTCATAGGCTATCCCATCACCCTTTATTT<br>GGAGAAGGAACGAGAGAAGGAAATTAGTGATGAT<br>GAGGCAGAGGAAGAGAAAGGTGAGAAAGAAGAGG<br>AAGATAAAGATGATGAAGAAAAACCCAAGATCGAA<br>GATGTGGGTTCAGATGAGGAGGATGACAGCGGTA<br>AGGATAAGAAGAAGAAAACTAAGAAGATCAAAGAG<br>AAATACATTGATCAGGAAGAACTAAACAAGACCAA<br>GCCTATTTGGACCAGAAACCCTGATGACATCACCC<br>AAGAGGAGTATGGAGAATTCTACAAGAGCCTCACT<br>AATGACTGGGAAGA | 1 | W* |
| 1792 | NM_0073<br>55.2_357 | 357 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATGGCATGACCAAAGCTGATCTCATAAATA<br>ATTTGGGAACCATTGCCAAGTCTGGTACTAAAGCA<br>TTCATGGAGGCTCTTCAGGCTGGTGCAGACATCTC<br>CATGATTGGGCAGTTTGGTGTTGGCTTTTATTCTG<br>CCTACTTGGTGGCAGAGAAAGTGGTTGTGATCACA<br>AAGCACAACGATGATGAACAGTATGCTTGGGAGTC<br>TTCTGCTGGAGGTTCCTTCACTGTGCGTGCTGACC<br>ATGGTGAGCCCATTGGCAGGGGTACCAAAGTGAT<br>CCTCCATCTTAAAGAAGATCAGACAGAGTACCTAG<br>AAGAGAGGCGGGTCAAAGAAGTAGTGAAGAAGCA<br>TTCTCAGTTCATAGGCTATCCCATCACCCTTTATTT<br>GGAGAAGGAACGAGAGAAGGAAATTAGTGATGAT<br>GAGGCAGAGGAAGAGAAAGGTGAGAAAGAAGAGG<br>AAGATAAAGATGATGAAGAAAAACCCAAGATCGAA<br>GATGTGGGTTCAGATGAGGAGGATGACAGCGGTA<br>AGGATAAGAAGAAGAAAACTAAGAAGATCAAAGAG<br>AAATACATTGATCAGGAAGAACTAAACAAGACCAA<br>GCCTATTTGGACCAGAAACCCTGATGACATCACCC<br>AAGAGGAGTATGGAGAATTCTACAAGAGCCTCACT<br>AATGACTGGGAAGA | 2 | MA* |
| 1793 | NM_0073<br>55.2_389 | 389 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG | 23 | WEPLPSLV<br>LKHSWRLF<br>RLVQTSP* |

TABLE 3A-continued

| SEQ ID | identifier_ position | position | modified_RNA | PAP length | PAP |
|---|---|---|---|---|---|
| | | | GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTGGGAACCATTGCCAAGTCTGGTACTAAAGCA TTCATGGAGGCTCTTCAGGCTGGTGCAGACATCTC CATGATTGGGCAGTTTGGTGTTGGCTTTTATTCTG CCTACTTGGTGGCAGAGAAAGTGGTTGTGATCACA AAGCACAACGATGATGAACAGTATGCTTGGGAGTC TTCTGCTGGAGGTTCCTTCACTGTGCGTGCTGACC ATGGTGAGCCCATTGGCAGGGGTACCAAAGTGAT CCTCCATCTTAAAGAAGATCAGACAGAGTACCTAG AAGAGAGGCGGGTCAAAGAAGTAGTGAAGAAGCA TTCTCAGTTCATAGGCTATCCCATCACCCTTTATTT GGAGAAGGAACGAGAGAAGGAAATTAGTGATGAT GAGGCAGAGGAAGAGAAAGGTGAGAAAGAAGAGG AAGATAAAGATGATGAAGAAAAACCCAAGATCGAA GATGTGGGTTCAGATGAGGAGGATGACAGCGGTA AGGATAAGAAGAAGAAAACTAAGAAGATCAAAGAG AAATACATTGATCAGGAAGAACTAAACAAGACCAA GCCTATTTGGACCAGAAACCCTGATGACATCACCC AAGAGGAGTATGGAGAATTCTACAAGAGCCTCACT AATGACTGGGAAGA | | |
| 1794 | NM_0073 55.2_399 | 399 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTGGGAACCATTGCCAAGTCTGGTACTAAAGCA TTCATGGAGGCTCTTCAGGCTGGTGCAGACATCTC CATGATTGGGCAGTTTGGTGTTGGCTTTTATTCTG CCTACTTGGTGGCAGAGAAAGTGGTTGTGATCACA AAGCACAACGATGATGAACAGTATGCTTGGGAGTC TTCTGCTGGAGGTTCCTTCACTGTGCGTGCTGACC ATGGTGAGCCCATTGGCAGGGGTACCAAAGTGAT CCTCCATCTTAAAGAAGATCAGACAGAGTACCTAG AAGAGAGGCGGGTCAAAGAAGTAGTGAAGAAGCA TTCTCAGTTCATAGGCTATCCCATCACCCTTTATTT GGAGAAGGAACGAGAGAAGGAAATTAGTGATGAT GAGGCAGAGGAAGAGAAAGGTGAGAAAGAAGAGG AAGATAAAGATGATGAAGAAAAACCCAAGATCGAA GATGTGGGTTCAGATGAGGAGGATGACAGCGGTA AGGATAAGAAGAAGAAAACTAAGAAGATCAAAGAG AAATACATTGATCAGGAAGAACTAAACAAGACCAA GCCTATTTGGACCAGAAACCCTGATGACATCACCC AAGAGGAGTATGGAGAATTCTACAAGAGCCTCACT AATGACTGGGAAGA | 20 | MPSLVLKH SWRLFRLV QTSP* |
| 1795 | NM_0073 55.2_471 | 471 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTGGGAACCATTGCCAAGTCTGGTACTAAAGC ATTCATGGAGGCTCTTCAGGCTGGTGCAGACATCT CCATGATTGGGCAGTTGGTGTTGGCTTTTATTCTG CCTACTTGGTGGCAGAGAAAGTGGTTGTGATCACA AAGCACAACGATGATGAACAGTATGCTTGGGAGTC TTCTGCTGGAGGTTCCTTCACTGTGCGTGCTGACC ATGGTGAGCCCATTGGCAGGGGTACCAAAGTGAT CCTCCATCTTAAAGAAGATCAGACAGAGTACCTAG AAGAGAGGCGGGTCAAAGAAGTAGTGAAGAAGCA TTCTCAGTTCATAGGCTATCCCATCACCCTTTATTT | 16 | LVLAFILPT WWQRKWL |

TABLE 3A-continued

| SEQ ID | identifier_position | position | modified_RNA | PAP length | PAP |
|---|---|---|---|---|---|
| | | | GGAGAAGGAACGAGAGAAGGAAATTAGTGATGAT GAGGCAGAGGAAGAGAAAGGTGAGAAAGAAGAGG AAGATAAAGATGATGAAGAAAAACCCAAGATCGAA GATGTGGGTTCAGATGAGGAGGATGACAGCGGTA AGGATAAGAAGAAGAAAACTAAGAAGATCAAAGAG AAATACATTGATCAGGAAGAACTAAACAAGACCAA GCCTATTTGGACCAGAAACCCTGATGACATCACCC AAGAGGAGTATGGAGAATTCTACAAGAGCCTCACT AATGACTGGGAAGA | | |
| 1796 | NM_0073 55.2_516 | 516 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTGTGATCAC AAAGCACAACGATGATGAACAGTATGCTTGGGAGT CTTCTGCTGGAGGTTCCTTCACTGTGCGTGCTGAC CATGGTGAGCCCATTGGCAGGGGTACCAAAGTGA TCCTCCATCTTAAAGAAGATCAGACAGAGTACCTA GAAGAGAGGCGGGTCAAAGAAGTAGTGAAGAAGC ATTCTCAGTTCATAGGCTATCCCATCACCCTTTATT TGGAGAAGGAACGAGAGAAGGAAATTAGTGATGA TGAGGCAGAGGAAGAGAAAGGTGAGAAAGAAGAG GAAGATAAAGATGATGAAGAAAAACCCAAGATCGA AGATGTGGGTTCAGATGAGGAGGATGACAGCGGT AAGGATAAGAAGAAGAAAACTAAGAAGATCAAAGA GAAATACATTGATCAGGAAGAACTAAACAAGACCA AGCCTATTTGGACCAGAAACCCTGATGACATCACC CAAGAGGAGTATGGAGAATTCTACAAGAGCCTCAC TAATGACTGGGAAGA | 0 | * |
| 1797 | NM_0073 55.2_534 | 534 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG GACAGTGGTAAAGAGCTGAAAATTGACATCATCCC CAACCCTCAGGAACGTACCCTGACTTTGGTAGACA CAGGCATTGGCATGACCAAAGCTGATCTCATAAAT AATTTGGGAACCATTGCCAAGTCTGGTACTAAAGC ATTCATGGAGGCTCTTCAGGCTGGTGCAGACATCT CCATGATTGGGCAGTTTGGTGTTGGCTTTTATTCT GCCTACTTGGTGGCAGAGAAAGTGGTTGTGATCA CAAAGCACAAGATGATGAACAGTATGCTTGGGAGT CTTCTGCTGGAGGTTCCTTCACTGTGCGTGCTGAC CATGGTGAGCCCATTGGCAGGGGTACCAAAGTGA TCCTCCATCTTAAAGAAGATCAGACAGAGTACCTA GAAGAGAGGCGGGTCAAAGAAGTAGTGAAGAAGC ATTCTCAGTTCATAGGCTATCCCATCACCCTTTATT TGGAGAAGGAACGAGAGAAGGAAATTAGTGATGA TGAGGCAGAGGAAGAGAAAGGTGAGAAAGAAGAG GAAGATAAAGATGATGAAGAAAAACCCAAGATCGA AGATGTGGGTTCAGATGAGGAGGATGACAGCGGT AAGGATAAGAAGAAGAAAACTAAGAAGATCAAAGA GAAATACATTGATCAGGAAGAACTAAACAAGACCA AGCCTATTTGGACCAGAAACCCTGATGACATCACC CAAGAGGAGTATGGAGAATTCTACAAGAGCCTCAC TAATGACTGGGAAGA | 31 | KMMNSML GSLLLEVP SLCVLTMV SPLAGVPK * |
| 1798 | NM_0073 55.2_609 | 609 | CTCCGGCGCAGTGTTGGGACTGTCTGGGTATCGG AAAGCAAGCCTACGTTGCTCACTATTACGTATAAT CCTTTTCTTTTCAAGATGCCTGAGGAAGTGCACCA TGGAGAGGAGGAGGTGGAGACTTTTGCCTTTCAG GCAGAAATTGCCCAACTCATGTCCCTCATCATCAA TACCTTCTATTCCAACAAGGAGATTTTCCTTCGGGA GTTGATCTCTAATGCTTCTGATGCCTTGGACAAGA TTCGCTATGAGAGCCTGACAGACCCTTCGAAGTTG | 6 | MAGVPK* |

TABLE 3A-continued

| SEQ ID | identifier_position | position | modified_RNA | PAP length | PAP |
|---|---|---|---|---|---|
| | | | GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATGGCAGGGGTACCAAAGTGA<br>TCCTCCATCTTAAAGAAGATCAGACAGAGTACCTA<br>GAAGAGAGGCGGGTCAAAGAAGTAGTGAAGAAGC<br>ATTCTCAGTTCATAGGCTATCCCATCACCCTTTATT<br>TGGAGAAGGAACGAGAGAAGGAAATTAGTGATGA<br>TGAGGCAGAGGAAGAGAAAGGTGAGAAGAAGAG<br>GAAGATAAAGATGATGAAGAAAAACCCAAGATCGA<br>AGATGTGGGTTCAGATGAGGAGGATGACAGCGGT<br>AAGGATAAGAAGAAGAAAACTAAGAAGATCAAAGA<br>GAAATACATTGATCAGGAAGAACTAAACAAGACCA<br>AGCCTATTTGGACCAGAAACCCTGATGACATCACC<br>CAAGAGGAGTATGGAGAATTCTACAAGAGCCTCAC<br>TAATGACTGGGAAGA | | |
| 1799 | NM_0073<br>55.2_661 | 661 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACTA<br>GAAGAGAGGCGGGTCAAAGAAGTAGTGAAGAAGC<br>ATTCTCAGTTCATAGGCTATCCCATCACCCTTTATT<br>TGGAGAAGGAACGAGAGAAGGAAATTAGTGATGA<br>TGAGGCAGAGGAAGAGAAAGGTGAGAAGAAGAG<br>GAAGATAAAGATGATGAAGAAAAACCCAAGATCGA<br>AGATGTGGGTTCAGATGAGGAGGATGACAGCGGT<br>AAGGATAAGAAGAAGAAAACTAAGAAGATCAAAGA<br>GAAATACATTGATCAGGAAGAACTAAACAAGACCA<br>AGCCTATTTGGACCAGAAACCCTGATGACATCACC<br>CAAGAGGAGTATGGAGAATTCTACAAGAGCCTCAC<br>TAATGACTGGGAAGA | 0 | * |
| 1800 | NM_0073<br>55.2_681 | 681 | CTCCGGCGCAGTGTTGGGACTGTCTGGGTATCGG<br>AAAGCAAGCCTACGTTGCTCACTATTACGTATAAT<br>CCTTTTCTTTTCAAGATGCCTGAGGAAGTGCACCA<br>TGGAGAGGAGGAGGTGGAGACTTTTGCCTTTCAG<br>GCAGAAATTGCCCAACTCATGTCCCTCATCATCAA<br>TACCTTCTATTCCAACAAGGAGATTTTCCTTCGGGA<br>GTTGATCTCTAATGCTTCTGATGCCTTGGACAAGA<br>TTCGCTATGAGAGCCTGACAGACCCTTCGAAGTTG<br>GACAGTGGTAAAGAGCTGAAAATTGACATCATCCC<br>CAACCCTCAGGAACGTACCCTGACTTTGGTAGACA<br>CAGGCATTGGCATGACCAAAGCTGATCTCATAAAT<br>AATTTGGGAACCATTGCCAAGTCTGGTACTAAAGC<br>ATTCATGGAGGCTCTTCAGGCTGGTGCAGACATCT<br>CCATGATTGGGCAGTTTGGTGTTGGCTTTTATTCT<br>GCCTACTTGGTGGCAGAGAAAGTGGTTGTGATCA<br>CAAAGCACAACGATGATGAACAGTATGCTTGGGAG<br>TCTTCTGCTGGAGGTTCCTTCACTGTGCGTGCTGA<br>CCATGGTGAGCCCATTGGCAGGGGTACCAAAGTG<br>ATCCTCCATCTTAAAGAAGATCAGACAGAGTACCT<br>AGAAGAGAGGCGGGTCAAGAAGTAGTGAAGAAGC<br>ATTCTCAGTTCATAGGCTATCCCATCACCCTTTATT<br>TGGAGAAGGAACGAGAGAAGGAAATTAGTGATGA<br>TGAGGCAGAGGAAGAGAAAGGTGAGAAGAAGAG<br>GAAGATAAAGATGATGAAGAAAAACCCAAGATCGA<br>AGATGTGGGTTCAGATGAGGAGGATGACAGCGGT | 1 | K* |

TABLE 3A-continued

| SEQ ID | identifier_position | position | modified_RNA | PAP length | PAP |
|---|---|---|---|---|---|
| | | | AAGGATAAGAAGAAGAAAACTAAGAAGATCAAAGA GAAATACATTGATCAGGAAGAACTAAACAAGACCA AGCCTATTTGGACCAGAAACCCTGATGACATCACC CAAGAGGAGTATGGAGAATTCTACAAGAGCCTCAC TAATGACTGGGAAGA | | |
| 1801 | NM_0073 64.2_402 | 402 | ATCCCCTTACATCCTCCTAGGACCCGGTCGGTAGT CGTCGCCCCAGCCCGCCGGGGGCGCAGCGCCCG AGCCGCGGCCCTCGAGACGGGACCGAGAGCATC ATGGGCAGCACTGTCCCGCGCTCCGCCTCCGTGC TGCTTCTGCTGCTGCTCCTGCGCCGGGCCGAGCA GCCCTGCGGGGCCGAGCTCACCTTCGAGCTGCCG GACAACGCCAAGCAGTGCTTCCACGAGGAGGTGG AGCAGGGCGTGAAGTTCTCCCTGGATTACCAGGT CATCACTGGAGGCCACTACGATGTTGACTGCTATG TAGAGGACCCCCAGGGGAACACCATCTACAGAGA AACGAAGAAGCAGTACGACAGCTTCACGTACCGG GCTGAAGTCAAGGGCGTTTATCAGTTTGCTTCAGT AATGAGTTTTCCACCTTCTCTCACAAGACCGTCTAC TTTGACTTTCAAGTGGGCGATGAGCCTCCCATTCT CCCAGACATGGGGAACAGGGTCACAGCTCTCACC CAGATGGAGTCCGCCTGCGTGACCATCCATGAGG CTCTGAAAACGGTTGATTGACTCCCAGACGCATTAC CGGCTGCGGGAGGCCCAGGACCGGGCCCGAGCG GAAGACCTTAATAGCCGAGTCTCTTACTGGTCTGT TGGCGAGACGATTGCCCTGTTCGTGGTCAGCTTCA GTCAGGTGCTACTGTTGAAAAGCTTCTTCACAGAA AAACGACCCATCAGCAGGGCAGTCCACTCCTAGC CCCGGCATCCTGCTCTAGGGCCCCTCATGCCCCA GGCTGGAGCAGCTCTCCTAGGTCACAGCCTGCTG GGCTGGGTCGCGTAGCCCAGGGTGGAGGCAGAA CGATGCTGCTGTGGTAGCCCTTTGCCTTTCATGCC CATGCTTGATTCTTGCACCTCAGCAGCTGAAGGTC TCAGAGACCAGTAATCAGAAGGCATCCGACTGCAT TAAGTGTGCAGCGCTGAAAAGACATTTACAACTAG | 44 | ASVMSFPP SLTRPSTL TFKWAMSL PFSQTWG TGSQLSPR WSPPA* |
| 1802 | NM_0120 94.3_338 | 338 | GCCAGGGATTAGCCACTGTGGGAGGGTG GCAGTGGAGGCGGCCCAGGCCCGCCTTCCGCAG GGTGTCGCCGCTGTGCCGCTAGCGGTGCCCCGC CTGCTGCGGTGGCACCAGCCAGGAGGCGGAGTG GAAGTGGCCGTGGGGCGGGTATGGGACTAGCTG GCGTGTGCGCCCTGAGACGCTCAGCGGGCTATAT ACTCGTCGGTGGGGCCGGCGGTCAGTCTGCGGC AGCGGCAGCAAGACGGTGCAGTGAAGGAGAGTG GGCGTCTGGCGGGGTCCGCAGTTTCAGCAGAGCC GCTGCAGCCATGGCCCCAATCAAGGTGGGAGATG CCATCCCAGCAGTGGAGGTGTTTGAAGGGGAGCC AGGAACAAGGTGAACCTGGCAGAGCTGTTCAAGG GCAAGAAGGGTGTGCTGTTTGGAGTTCCTGGGGC CTTCACCCCTGGATGTTCCAAGACACACCTGCCAG GGTTTGTGGAGCAGGCTGAGGCTCTGAAGGCCAA GGGAGTCCAGGTGGTGGCCTGTCTGAGTGTTAAT GATGCCTTTGTGACTGGCGAGTGGGGCCGAGCCC ACAAGGCGGAAGGCAAGGTTCGGCTCCTGGCTGA TCCCACTGGGGCCTTTGGGAAGGAGACAGACTTA TTACTAGATGATTCGCTGGTGTCCATCTTTGGGAA TCGACGTCTCAAGAGGTTCTCCATGGTGGTACAGG ATGGCATAGTGAAGGCCCTGAATGTGGAACCAGA TGGCACAGGCCTCACCTGCAGCCTGGCACCCAAT ATCATCTCACAGCTCTGAGGCCCTGGGCCAGATTA CTTCCTCCACCCCTCCCTATCTCACCTGCCCAGCC CTGTGCTGGGGCCCTGCAATTGGAATGTTGGCCA GATTTCTGCAATAAACACTTGTGGTTTGCGGCCAA AA | 2 | TR* |
| 1803 | NM_0120 94.3_440 | 440 | GCAGTGGAGGCGGCCCAGGCCCGCCTTCCGCAG GGTGTCGCCGCTGTGCCGCTAGCGGTGCCCCGC CTGCTGCGGTGGCACCAGCCAGGAGGCGGAGTG GAAGTGGCCGTGGGGCGGGTATGGGACTAGCTG GCGTGTGCGCCCTGAGACGCTCAGCGGGCTATAT ACTCGTCGGTGGGGCCGGCGGTCAGTCTGCGGC AGCGGCAGCAAGACGGTGCAGTGAAGGAGAGTG GGCGTCTGGCGGGGTCCGCAGTTTCAGCAGAGCC GCTGCAGCCATGGCCCCAATCAAGGTGGGAGATG CCATCCCAGCAGTGGAGGTGTTTGAAGGGGAGCC AGGAACAAGGTGAACCTGGCAGAGCTGTTCAAG GGCAAGAAGGGTGTGCTGTTTGGAGTTCCTGGGG CCTTCACCCCTGGATGTTCCAAGACACACCTGCCA GGTTTGTGGAGCAGGCTGAGGCTCTGAAGGCCAA GGGAGTCCAGGTGGTGGCCTGTCTGAGTGTTAAT | 7 | LWSRLRL* |

| SEQ ID | identifier_position | position | modified_RNA | PAP length | PAP |
|---|---|---|---|---|---|
| | | | GATGCCTTTGTGACTGGCGAGTGGGGCCGAGCCC ACAAGGCGGAAGGCAAGGTTCGGCTCCTGGCTGA TCCCACTGGGGCCTTTGGGAAGGAGACAGACTTA TTACTAGATGATTCGCTGGTGTCCATCTTTGGGAA TCGACGTCTCAAGAGGTTCTCCATGGTGGTACAGG ATGGCATAGTGAAGGCCCTGAATGTGGAACCAGA TGGCACAGGCCTCACCTGCAGCCTGGCACCCAAT ATCATCTCACAGCTCTGAGGCCCTGGGCCAGATTA CTTCCTCCACCCCTCCCTATCTCACCTGCCCAGCC CTGTGCTGGGGCCCTGCAATTGGAATGTTGGCCA GATTTCTGCAATAAACACTTGTGGTTTGCGGCCAA AA | | |
| 1804 | NM_0124 23.2_232 | 232 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA CAAGTTGAAGTACCTGGCTTTCCTCCGCAAGCGGA TGAACACCAACCCTTCCCGAGGCCCTACCACTTCC GGGCCCCCAGCCGCATCTTCTGGCGGACCGTGCG AGGTATGCTGCCCCACAAAACCAAGCGAGGCCAG GCCGCTCTGGACCGTCTCAAGGTGTTTGACGGCA TCCCACCGCCCTACGACAAGAAAAAGCGGATGGT GGTTCCTGCTGCCCTCAAGGTCGTGCGTCTGAAG CCTACAAGAAAGTTTGCCTATCTGGGGCGCCTGG CTCACGAGGTTGGCTGGAAGTACCAGGCAGTGAC AGCCACCCTGGAGGAGAAGAGGAAAGAGAAAGCC AAGATCCACTACCGGAAGAAGAAACAGCTCATGAG GCTACGGAAACAGGCCGAGAAGAACGTGGAGAAG AAAATTGACAAATACACAGAGGTCCTCAAGACCCA CGGACTCCTGGTCTGAGCCCAATAAAGACTGTTAA TTCCTCATGCGTTGCCTGCCCTTCCTCCATTGTTG CCCTGGAATGTACGGGACCCAGGGGCAGCAGCA GTCCAGGTGCCACAGGCAGCCCTGGGACATAGGA AGCTGGGAGCAAGGAAAGGGTCTTAGTCACTGCC TCCCGAAGTTGCTTGAAAGCACTCGGAGAATTGTG CAGGTGTCATTTATCTATGACCAATAGGAAGAGCA ACCAGTTACTATGAGTGAAAGGGAGCCAGAAGACT GATTGGAGGGCCCTATCTTGTGAGTGGGGCATCT GTTGGACTTTCCACCTGGTCATATACTCTGCAGCT GTTAGAATGTGCAAGCACTTGGGGACAGCATGAG CTTGCTGTTGTACACAGGGTATTTCTAG | 58 | TTSGPPAA SSGGPCE VCCPTKPS EARPLWTV SRCLTASH RPTTRKSG WWFLLPS RSCV* |
| 1805 | NM_0124 23.2_271 | 271 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA CAAGTTGAAGTACCTGGCTTTCCTCCGCAAGCGGA TGAACACCAACCCTTCCCGAGGCCCCTACCACTTC CGGGCCCCCAGCCGCATCTTCTGGCGGACGTGCG AGGTATGCTGCCCCACAAAACCAAGCGAGGCCAG GCCGCTCTGGACCGTCTCAAGGTGTTTGACGGCA TCCCACCGCCCTACGACAAGAAAAAGCGGATGGT GGTTCCTGCTGCCCTCAAGGTCGTGCGTCTGAAG CCTACAAGAAAGTTTGCCTATCTGGGGCGCCTGG CTCACGAGGTTGGCTGGAAGTACCAGGCAGTGAC AGCCACCCTGGAGGAGAAGAGGAAAGAGAAAGCC AAGATCCACTACCGGAAGAAGAAACAGCTCATGAG GCTACGGAAACAGGCCGAGAAGAACGTGGAGAAG AAAATTGACAAATACACAGAGGTCCTCAAGACCCA CGGACTCCTGGTCTGAGCCCAATAAAGACTGTTAA TTCCTCATGCGTTGCCTGCCCTTCCTCCATTGTTG CCCTGGAATGTACGGGACCCAGGGGCAGCAGCA GTCCAGGTGCCACAGGCAGCCCTGGGACATAGGA AGCTGGGAGCAAGGAAAGGGTCTTAGTCACTGCC TCCCGAAGTTGCTTGAAAGCACTCGGAGAATTGTG CAGGTGTCATTTATCTATGACCAATAGGAAGAGCA ACCAGTTACTATGAGTGAAAGGGAGCCAGAAGACT GATTGGAGGGCCCTATCTTGTGAGTGGGGCATCT GTTGGACTTTCCACCTGGTCATATACTCTGCAGCT GTTAGAATGTGCAAGCACTTGGGGACAGCATGAG CTTGCTGTTGTACACAGGGTATTTCTAG | 45 | CEVCCPTK PSEARPLW TVSRCLTA SHRPTTRK SGWWFLL PSRSCV* |
| 1806 | NM_0124 23.2_298 | 298 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA | 36 | SEARPLWT VSRCLTAS HRPTTRKS GWWFLLP SRSCV* |

TABLE 3A-continued

| SEQ ID | identifier_position | position | modified_RNA | PAP length | PAP |
|---|---|---|---|---|---|
| | | | CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACAAGCGAGGCCAG<br>GCCGCTCTGGACCGTCTCAAGGTGTTTGACGGCA<br>TCCCACCGCCCTACGACAAGAAAAAGCGGATGGT<br>GGTTCCTGCTGCCCTCAAGGTCGTGCGTCTGAAG<br>CCTACAAGAAAGTTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | | |
| 1807 | NM_0124<br>23.2_308 | 308 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACAAGCGAGGCAG<br>GCCGCTCTGGACCGTCTCAAGGTGTTTGACGGCA<br>TCCCACCGCCCTACGACAAGAAAAAGCGGATGGT<br>GGTTCCTGCTGCCCTCAAGGTCGTGCGTCTGAAG<br>CCTACAAGAAAGTTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 33 | RPLWTVSR<br>CLTASHRP<br>TTRKSGW<br>WFLLPSRS<br>CV* |
| 1808 | NM_0124<br>23.2_313 | 313 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACAAGCGAGGCCA<br>GGCGCTCTGGACCGTCTCAAGGTGTTTGACGGCA<br>TCCCACCGCCCTACGACAAGAAAAAGCGGATGGT<br>GGTTCCTGCTGCCCTCAAGGTCGTGCGTCTGAAG<br>CCTACAAGAAAGTTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA | 31 | LWTVSRCL<br>TASHRPTT<br>RKSGWWF<br>LLPSRSCV |

TABLE 3A-continued

| SEQ ID | identifier_position | position | modified_RNA | PAP length | PAP |
|---|---|---|---|---|---|
| | | | AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | | |
| 1809 | NM_0124<br>23.2_337 | 337 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTGACGGCA<br>TCCCACCGCCCTACGACAAGAAAAAGCGGATGGT<br>GGTTCCTGCTGCCCTCAAGGTCGTGCGTCTGAAG<br>CCTACAAGAAAGTTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 24 | LTASHRPT<br>TRKSGWW<br>FLLPSRSC<br>V* |
| 1810 | NM_0124<br>23.2_355 | 355 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTTGACGGC<br>ATCCCACCGCCTACGACAAGAAAAAGCGGATGGT<br>GGTTCCTGCTGCCCTCAAGGTCGTGCGTCTGAAG<br>CCTACAAGAAAGTTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 17 | TTRKSGW<br>WFLLPSRS<br>CV* |
| 1811 | NM_0124<br>23.2_427 | 427 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA | 17 | LPIWGAWL<br>TRLAGSTR<br>Q* |

TABLE 3A-continued

| SEQ ID | identifier_position | position | modified_RNA | PAP length | PAP |
|---|---|---|---|---|---|
| | | | GGCCGCTCTGGACCGTCTCAAGGTGTTTGACGGC<br>ATCCCACCGCCCTACGACAAGAAAAAGCGGATGG<br>TGGTTCCTGCTGCCCTCAAGGTCGTGCGTCTGAA<br>GCCTACAAGAAAGTTGCCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | | |
| 1812 | NM_0124<br>23.2_430 | 430 | CTTTTCCAAGCGGCTGCCGAAGATGGCGGAGGTG<br>CAGGTCCTGGTGCTTGATGGTCGAGGCCATCTCC<br>TGGGCCGCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTTGACGGC<br>ATCCCACCGCCCTACGACAAGAAAAAGCGGATGG<br>TGGTTCCTGCTGCCCTCAAGGTCGTGCGTCTGAA<br>GCCTACAAGAAAGTTTGCTATCTGGGGCGCCTGG<br>CTCACGAGGTTGGCTGGAAGTACCAGGCAGTGAC<br>AGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 15 | IWGAWLTR<br>LAGSTRQ* |
| 1813 | NM_0124<br>23.2_484 | 484 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTTGACGGC<br>ATCCCACCGCCCTACGACAAGAAAAAGCGGATGG<br>TGGTTCCTGCTGCCCTCAAGGTCGTGCGTCTGAA<br>GCCTACAAGAAAGTTTGCCTATCTGGGGCGCCTG<br>GCTCACGAGGTTGGCTGGAAGTACCAGGCAGTGA<br>CAGCCACCCTGGAGGAGAAGAGGAAAGAGAAAGCC<br>AAGATCCACTACCGGAAGAAGAAACAGCTCATGAG<br>GCTACGGAAACAGGCCGAGAAGAACGTGGAGAAG<br>AAAATTGACAAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT | 20 | PWRRRGK<br>RKPRSTTG<br>RRNSS* |

TABLE 3A-continued

| SEQ ID | identifier_position | position | modified_RNA | PAP length | PAP |
|---|---|---|---|---|---|
| | | | GATTGGAGGGCCCTATCTTGTGAGTGGGGCATCT GTTGGACTTTCCACCTGGTCATATACTCTGCAGCT GTTAGAATGTGCAAGCACTTGGGGACAGCATGAG CTTGCTGTTGTACACAGGGTATTTCTAG | | |
| 1814 | NM_0124 23.2_542 | 542 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA CAAGTTGAAGTACCTGGCTTTCCTCCGCAAGCGGA TGAACACCAACCCTTCCCGAGGCCCCTACCACTTC CGGGCCCCCAGCCGCATCTTCTGGCGGACCGTGC GAGGTATGCTGCCCCACAAAACCAAGCGAGGCCA GGCCGCTCTGGACCGTCTCAAGGTGTTTGACGGC ATCCCACCGCCCTACGACAAGAAAAAGCGGATGG TGGTTCCTGCTGCCCTCAAGGTCGTGCGTCTGAA GCCTACAAGAAAGTTTGCCTATCTGGGGCGCCTG GCTCACGAGGTTGGCTGGAAGTACCAGGCAGTGA CAGCCACCCTGGAGGAGAAGAGGAAAGAGAAAGC CAAGATCCACTACCGGAAGAAGAAACAGTCATGAG GCTACGGAAACAGGCCGAGAAGAACGTGGAGAAG AAAATTGACAAATACACAGAGGTCCTCAAGACCCA CGGACTCCTGGTCTGAGCCCAATAAAGACTGTTAA TTCCTCATGCGTTGCCTGCCCTTCCTCCATTGTTG CCCTGGAATGTACGGGACCCAGGGGCAGCAGCA GTCCAGGTGCCACAGGCAGCCCTGGGACATAGGA AGCTGGGAGCAAGGAAAGGGTCTTAGTCACTGCC TCCCGAAGTTGCTTGAAAGCACTCGGAGAATTGTG CAGGTGTCATTTATCTATGACCAATAGGAAGAGCA ACCAGTTACTATGAGTGAAAGGGAGCCAGAAGACT GATTGGAGGGCCCTATCTTGTGAGTGGGGCATCT GTTGGACTTTCCACCTGGTCATATACTCTGCAGCT GTTAGAATGTGCAAGCACTTGGGGACAGCATGAG CTTGCTGTTGTACACAGGGTATTTCTAG | 1 | S* |
| 1815 | NM_0124 23.2_589 | 589 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA CAAGTTGAAGTACCTGGCTTTCCTCCGCAAGCGGA TGAACACCAACCCTTCCCGAGGCCCCTACCACTTC CGGGCCCCCAGCCGCATCTTCTGGCGGACCGTGC GAGGTATGCTGCCCCACAAAACCAAGCGAGGCCA GGCCGCTCTGGACCGTCTCAAGGTGTTTGACGGC ATCCCACCGCCCTACGACAAGAAAAAGCGGATGG TGGTTCCTGCTGCCCTCAAGGTCGTGCGTCTGAA GCCTACAAGAAAGTTTGCCTATCTGGGGCGCCTG GCTCACGAGGTTGGCTGGAAGTACCAGGCAGTGA CAGCCACCCTGGAGGAGAAGAGGAAAGAGAAAGC CAAGATCCACTACCGGAAGAAGAAACAGCTCATGA GGCTACGGAAACAGGCCGAGAAGAACGTGGAGAA GAAAATGACAAATACACAGAGGTCCTCAAGACCCA CGGACTCCTGGTCTGAGCCCAATAAAGACTGTTAA TTCCTCATGCGTTGCCTGCCCTTCCTCCATTGTTG CCCTGGAATGTACGGGACCCAGGGGCAGCAGCA GTCCAGGTGCCACAGGCAGCCCTGGGACATAGGA AGCTGGGAGCAAGGAAAGGGTCTTAGTCACTGCC TCCCGAAGTTGCTTGAAAGCACTCGGAGAATTGTG CAGGTGTCATTTATCTATGACCAATAGGAAGAGCA ACCAGTTACTATGAGTGAAAGGGAGCCAGAAGACT GATTGGAGGGCCCTATCTTGTGAGTGGGGCATCT GTTGGACTTTCCACCTGGTCATATACTCTGCAGCT GTTAGAATGTGCAAGCACTTGGGGACAGCATGAG CTTGCTGTTGTACACAGGGTATTTCTAG | 21 | MTNTQRS SRPTDSW SEPNKDC* |
| 1816 | NM_0124 23.2_595 | 595 | CTTTTCCAAGCGGCTGCCGAAGATGGCGGAGGTG CAGGTCCTGGTGCTTGATGGTCGAGGCCATCTCC TGGGCCGCCTGGCGGCCATCGTGGCTAAACAGGT ACTGCTGGGCCGGAAGGTGGTGGTCGTACGCTGT GAAGGCATCAACATTTCTGGCAATTTCTACAGAAA CAAGTTGAAGTACCTGGCTTTCCTCCGCAAGCGGA TGAACACCAACCCTTCCCGAGGCCCCTACCACTTC CGGGCCCCCAGCCGCATCTTCTGGCGGACCGTGC GAGGTATGCTGCCCCACAAAACCAAGCGAGGCCA GGCCGCTCTGGACCGTCTCAAGGTGTTTGACGGC ATCCCACCGCCCTACGACAAGAAAAAGCGGATGG TGGTTCCTGCTGCCCTCAAGGTCGTGCGTCTGAA GCCTACAAGAAAGTTTGCCTATCTGGGGCGCCTG | 19 | NTQRSSRP TDSWSEP NKDC* |

TABLE 3A-continued

| SEQ ID | identifier_position | position | modified_RNA | PAP length | PAP |
|---|---|---|---|---|---|
| | | | GCTCACGAGGTTGGCTGGAAGTACCAGGCAGTGA<br>CAGCCACCCTGGAGGAGAAGAGGAAAGAGAAAGC<br>CAAGATCCACTACCGGAAGAAGAAACAGCTCATGA<br>GGCTACGGAAACAGGCCGAGAAGAACGTGGAGAA<br>GAAAATTGACAATACACAGAGGTCCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | | |
| 1817 | NM_0124 23.2_608 | 608 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTTGACGGC<br>ATCCCACCGCCCTACGACAAGAAAAAGCGGATGG<br>TGGTTCCTGCTGCCCTCAAGGTCGTGCGTCTGAA<br>GCCTACAAGAAAGTTTGCCTATCTGGGGCGCCTG<br>GCTCACGAGGTTGGCTGGAAGTACCAGGCAGTGA<br>CAGCCACCCTGGAGGAGAAGAGGAAAGAGAAAGC<br>CAAGATCCACTACCGGAAGAAGAAACAGCTCATGA<br>GGCTACGGAAACAGGCCGAGAAGAACGTGGAGAA<br>GAAAATTGACAAATACACAGAGGTCTCAAGACCCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 14 | SRPTDSW SEPNKDC* |
| 1818 | NM_0124 23.2_617 | 617 | CTTTTCCAAGCGGCTGCCGAAGATGGCGGAGGTG<br>CAGGTCCTGGTGCTTGATGGTCGAGGCCATCTCC<br>TGGGCCGCCTGGCGGCCATCGTGGCTAAACAGGT<br>ACTGCTGGGCCGGAAGGTGGTGGTCGTACGCTGT<br>GAAGGCATCAACATTTCTGGCAATTTCTACAGAAA<br>CAAGTTGAAGTACCTGGCTTTCCTCCGCAAGCGGA<br>TGAACACCAACCCTTCCCGAGGCCCCTACCACTTC<br>CGGGCCCCCAGCCGCATCTTCTGGCGGACCGTGC<br>GAGGTATGCTGCCCCACAAAACCAAGCGAGGCCA<br>GGCCGCTCTGGACCGTCTCAAGGTGTTTGACGGC<br>ATCCCACCGCCCTACGACAAGAAAAAGCGGATGG<br>TGGTTCCTGCTGCCCTCAAGGTCGTGCGTCTGAA<br>GCCTACAAGAAAGTTTGCCTATCTGGGGCGCCTG<br>GCTCACGAGGTTGGCTGGAAGTACCAGGCAGTGA<br>CAGCCACCCTGGAGGAGAAGAGGAAAGAGAAAGC<br>CAAGATCCACTACCGGAAGAAGAAACAGCTCATGA<br>GGCTACGGAAACAGGCCGAGAAGAACGTGGAGAA<br>GAAAATTGACAAATACACAGAGGTCCTCAAGACCA<br>CGGACTCCTGGTCTGAGCCCAATAAAGACTGTTAA<br>TTCCTCATGCGTTGCCTGCCCTTCCTCCATTGTTG<br>CCCTGGAATGTACGGGACCCAGGGGCAGCAGCA<br>GTCCAGGTGCCACAGGCAGCCCTGGGACATAGGA<br>AGCTGGGAGCAAGGAAAGGGTCTTAGTCACTGCC<br>TCCCGAAGTTGCTTGAAAGCACTCGGAGAATTGTG<br>CAGGTGTCATTTATCTATGACCAATAGGAAGAGCA<br>ACCAGTTACTATGAGTGAAAGGGAGCCAGAAGACT<br>GATTGGAGGGCCCTATCTTGTGAGTGGGGCATCT<br>GTTGGACTTTCCACCTGGTCATATACTCTGCAGCT<br>GTTAGAATGTGCAAGCACTTGGGGACAGCATGAG<br>CTTGCTGTTGTACACAGGGTATTTCTAG | 11 | TDSWSEP NKDC* |

TABLE 3A-continued

| SEQ ID | identifier_position | position | modified_RNA | PAP length | PAP |
|---|---|---|---|---|---|
| 1819 | NM_012423.2_85 | 85 | CTTTTCCAAGCGGCTGCCGAAGATGGCGGAGGTG CAGGTCCTGGTGCTTGATGGTCGAGGCCATCTCC TGGGCCGCCTGGCGGCATCGTGGCTAAACAGGTA CTGCTGGGCCGGAAGGTGGTGGTCGTACGCTGTG AAGGCATCAACATTTCTGGCAATTTCTACAGAAAC AAGTTGAAGTACCTGGCTTTCCTCCGCAAGCGGAT GAACACCAACCCTTCCCGAGGCCCCTACCACTTC CGGGCCCCCAGCCGCATCTTCTGGCGGACCGTGC GAGGTATGCTGCCCCACAAAACCAAGCGAGGCCA GGCCGCTCTGGACCGTCTCAAGGTGTTTGACGGC ATCCCACCGCCCTACGACAAGAAAAAGCGGATGG TGGTTCCTGCTGCCCTCAAGGTCGTGCGTCTGAA GCCTACAAGAAAGTTTGCCTATCTGGGGCGCCTG GCTCACGAGGTTGGCTGGAAGTACCAGGCAGTGA CAGCCACCCTGGAGGAGAAGAGGAAAGAGAAAGC CAAGATCCACTACCGGAAGAAGAAACAGCTCATGA GGCTACGGAAACAGGCCGAGAAGAACGTGGAGAA GAAAATTGACAAATACACAGAGGTCCTCAAGACCC ACGGACTCCTGGTCTGAGCCCAATAAAGACTGTTA ATTCCTCATGCGTTGCCTGCCCTTCCTCCATTGTT GCCCTGGAATGTACGGGACCCAGGGGCAGCAGC AGTCCAGGTGCCACAGGCAGCCCTGGGACATAGG AAGCTGGGAGCAAGGAAAGGGTCTTAGTCACTGC CTCCCGAAGTTGCTTGAAAGCACTCGGAGAATTGT GCAGGTGTCATTTATCTATGACCAATAGGAAGAGC AACCAGTTACTATGAGTGAAAGGGAGCCAGAAGA CTGATTGGAGGGCCCTATCTTGTGAGTGGGGCAT CTGTTGGACTTTCCACCTGGTCATATACTCTGCAG CTGTTAGAATGTGCAAGCACTTGGGGACAGCATGA GCTTGCTGTTGTACACAGGGTATTTCTAG | 30 | SWLNRYC WAGRWW SYAVKAST FLAISTETS |
| 1820 | NM_012458.2_404 | 404 | GCCCTTCGGGACGAGCTGGAGGCAGAGCGTGAG TACAAAGTGATCGGCCTCGGCCGCACGTAGTAGC CCCCCTACTCCCCGGCCAAGTCAGGGCCTCCCTC TTCCCGCGGAGTCGCAACCACGGGTAGCTCGTGT AGGTAACGGCAGGTCCAGGCCTCCGCATGAGCGG AGGGCCCCCCGCGCGACCTTGAATGGCCCGGGC GCGCGCGGTCGTGTGGGAGTTGTAGTCCTCCGTC CCCGTCCGCGCGGACTCCGTTTCCCGTGGTGCCC CGGGCGGCCCGCTTCCGGCGCAGTTAGTTACGAG TCGGCGCACGCGGCCTCGGTCCGGTTGACTTTGC GGAGCCATGGAGGGCGGCTTCGGCTCCGATTTCG GGGGCTCCGGCAGCGGGAAGCTGGACCCAGGCT CATAATGGAGCAGGTGAAAGTGCAGATCGCCGTG GCCAACGCGCAGGAGCTGCTGCAGAGGATGACG GACAAGTGTTTCCGGAAGTGTATAGGGAAACCTG GGGGCTCCCTGGACAACTCCGAGCAGAAGTGCAT CGCCATGTGCATGGACCGCTACATGGACGCCTGG AACACCGTGTCTCGCGCCTACAACTCGCGGCTGC AGCGGGAACGAGCCAACATGTGACCGGCGAGCG CGGGGCCACCCCACCCTGTTCATTTCCATAAACGTG CTTTGAGAGGCGGGGTCCGCATGTACGTACTGCC TGCCCGGGGCTTAGGAGGGTGGCACCGGTGCTG GGACACACGGGACTGTGTCCTCGCCACCCCCCGC CCTGCCCCCTGCCAGCCAGTGCAGCTTGGATCTC GGGGGTGTGGGGCCCTGTGCCTTCCTGAAGTGCT GGCAGCCCAGTGGCACCTCCTTCAGGCCTTTGGG GTATTCCCCTAGTGTGCCCAAGTCAGCCTCATATT CTGGGCGGACAGCTTGTCTGGACTTCGGAGTTGG GGGTGGTCAGACACCACAGGAGCTGTCACCTCCT GCGGATGGGCAAATAAATTGGTGGAGGACGGAGA GAAACCTC | 1 | S* |
| 1821 | NM_013234.2_480 | 480 | AGTCACGTGGCAGCCGGAAAGCGTGGCGGCTGCT GCTAGAGCCTTTCCCTTTACCGCACCCAAGGAGCT GGAGCGACAACAACGACGTCGTTTCCGTTTCCAC CACCTCTTCCTGTTCCCGTCCTTGAGGACGCCGTG CCGGGTCAGTGTTAGCCTCCAGCCCTGGTTGTGG AAGGCGACAGAAGTCATGGCGATGTTTGAGCAGA TGAGAGCCAACGTGGGCAAGTTGCTCAAGGGTAT CGACAGGTACAATCCTGAGAACCTGGCCACCCTG GAGCGCTATGTAGAGACGCAGGCCAAGGAAAATG CCTATGATCTGGAAGCCAACCTGGCTGTCCTGAAG CTGTACCAGTTCAACCCCAGCCTTCTTTCAGACCAG GGTCACCGCCCAGATCCTGCTGAAGGCCCTCACC AACTTGCCGCACACAGACTTCACCCTGTGCAAGTG CATGATCGACCAGGCACATCAAGAAGAACGGCAA TCCGACAGATTTTGTACCTCGGGGACCTGCTGGA GACCTGCCATTTCCAGGCCTTCTGGCAAGCCCTG | 33 | QSDRFCTS GTCWRPAI SRPSGKP WMKTWTS WKV* |

TABLE 3A-continued

| SEQ ID | identifier_position | position | modified_RNA | PAP length | PAP |
|---|---|---|---|---|---|
| | | | GATGAAAACATGGACCTCTTGGAAGGTATAACTGG CTTTGAAGACTCTGTCCGAAAGTTTATCTGCCATGT TGTGGGTATCACTTACCAGCACATTGACCGCTGGC TGCTGGCCGAGATGCTCGGGGATCTGTCGGACAG CCAGCTAAAGGTGTGGATGAGCAAATACGGCTGG AGTGCCGACGAGTCGGGGCAGATCTTCATCTGTA GCCAAGAAGAGAGCATTAAACCCAAGAACATTGTG GAGAAGATTGACTTTGACAGTGTGTCCAGCATCAT GGCCTCCTCCCAGTAACTTCAGGTGTTTAATAAAG ATGTGTTGACTCAGCCAAAAAAAAAAAAAAAAAAA AAAAAAAAAAA | | |
| 1822 | NM_0132 34.2_495 | 495 | AGTCACGTGGCAGCCGGAAAGCGTGGCGGCTGCT GCTAGAGCCTTTCCCTTTACCGCACCCAAGGAGCT GGAGCGACAACAACGACGTCGTTTCCGTTTCCAC CACCTCTTCCTGTTCCCGTCCTTGAGGACGCCGTG CCGGGTCAGTGTTAGCCTCCAGCCCTGGTTGTGG AAGGCGACAGAAGTCATGGCGATGTTTGAGCAGA TGAGAGCCAACGTGGGCAAGTTGCTCAAGGGTAT CGACAGGTACAATCCTGAGAACCTGGCCACCCTG GAGCGCTATGTAGAGACGCAGGCCAAGGAAAATG CCTATGATCTGGAAGCCAACCTGGCTGTCCTGAAG CTGTACCAGTTCAACCCAGCCTTCTTTCAGACCAC GGTCACCGCCCAGATCCTGCTGAAGGCCCTCACC AACTTGCCGCACACAGACTTCACCCTGTGCAAGTG CATGATCGACCAGGCACATCAAGAAGAACGGCCA ATCCGACAGATTTGTACCTCGGGGACCTGCTGGA GACCTGCCATTTCCAGGCCTTCTGGCAAGCCCTG GATGAAAACATGGACCTCTTGGAAGGTATAACTGG CTTTGAAGACTCTGTCCGAAAGTTTATCTGCCATGT TGTGGGTATCACTTACCAGCACATTGACCGCTGGC TGCTGGCCGAGATGCTCGGGGATCTGTCGGACAG CCAGCTAAAGGTGTGGATGAGCAAATACGGCTGG AGTGCCGACGAGTCGGGGCAGATCTTCATCTGTA GCCAAGAAGAGAGCATTAAACCCAAGAACATTGTG GAGAAGATTGACTTTGACAGTGTGTCCAGCATCAT GGCCTCCTCCCAGTAACTTCAGGTGTTTAATAAAG ATGTGTTGACTCAGCCAAAAAAAAAAAAAAAAAAA AAAAAAAAAAA | 28 | CTSGTCW RPAISRPS GKPWMKT WTSWKV* |
| 1823 | NM_0134 11.3_167 | 167 | GACCTGGGAAGCACTGGACCTGTGAGGCGTGCGA ACTGGTGGCAGTGAGAGACTTCGGCGGACATGGC TCCCAGCGTGCCAGCGGCAGAACCCGAGTATCCT AAAGGCATCCGGGCCGTGCTGCTGGGGCCTCCCG GGGCCGGTAAAGGGACCCAGGCACCCAGATGGC TGAAAACTTCTGTGTCTGCCATTTAGCTACTGGGG ACATGCTGAGGGCCATGGTGGCTTCTGGCTCAGA GCTAGGAAAAAAGCTGAAGGCAACTATGGATGCT GGGAAACTGGTGAGTGATGAAATGGTAGTGGAGC TCATTGAGAAGAATTTGGAGACCCCCTTGTGCAAA AATGGTTTTCTTCTGGATGGCTTCCCTCGGACTGT GAGGCAGGCAGAAATGCTCGATGACCTCATGGAG AAGAGGAAAGAGAAGCTTGATTCTGTGATTGAATT CAGCATCCCAGACTCTCTGCTGATCCGAAGAATCA CAGGAAGGCTGATTCACCCCAAGAGTGGCCGTTC CTACCACGAGGAGTTCAACCCTCCAAAAGAGCCC ATGAAAGATGACATCACCGGGGAACCCTTGATCC GTCGATCAGATGATAATGAAAAGGCCTTGAAAATC CGCCTGCAAGCCTACCACACTCAAACCACCCCACT CATAGAGTACTACAGGAAACGGGGGATCCACTCC GCCATCGATGCATCCCAGACCCCCGATGTCGTGTT CGCAAGCATCCTAGCAGCCTTCTCCAAAGCCACAT CCTAGTATCAGAAGGCCAGGCGAGACTGCAACAC TGCTCATCACCCCGCGGCGTGATCCCTGCTCTTAG GTGCTGGGCAGAGGGGAAGGGTGGTCAGGGTGA GGATGGTGAGGGAGGGCTGGTGAGGGGCTCAGA GGAATACTTGGAACAACAGCAGTGTTATTGTAGTG TGGCAGTTTCTTTTATACATAGGTGAGAGTTTTTAA AGTGTAAGGGAAAAATTAATTTTTTAAAAAACACCA TGCTTGGAGGGTGGGGGTAGAAATAG | 9 | WLKTSVSA I* |
| 1824 | NM_0134 42.1_705 | 705 | GGCTTCTGGGAGCGACCGCTCCGCTCGTCTCGTT GGTTCCGGAGGTCGCTGCGGCGGTGGGAAATGCT GGCGCGCGCGGCGCGGGGCACTGGGGCCCTTTT GCTGAGGGGCTCTCTACTGGCTTCTGGCCGCGCT CCGCGCCGCGCCTCCTCTGGATTGCCCCGAAACA CCGTGGTACTGTTCGTGCCGCAGCAGGAGGCCTG GGTGGTGGAGCGAATGGGCCGATTCCACCGGATC CTGGAGCCTGGTTTGAACATCCTCATCCCTGTGTT AGACCGGATCCGATATGTGCAGAGTCTCAAGGAA | 22 | SMWQKGR NRPRSWP PKQKRLNR * |

TABLE 3A-continued

| SEQ ID | identifier_position | position | modified_RNA | PAP length | PAP |
|---|---|---|---|---|---|
| | | | ATTGTCATCAACGTGCCTGAGCAGTCGGCTGTGAC<br>TCTCGACAATGTAACTCTGCAAATCGATGGAGTCC<br>TTTACCTGCGCATCATGGACCCTTACAAGGCAAGC<br>TACGGTGTGGAGGACCCTGAGTATGCCGTCACCC<br>AGCTAGCTCAAACAACCATGAGATCAGAGCTCGG<br>CAAACTCTCTCTGGACAAAGTCTTCCGGGAACGG<br>GAGTCCCTGAATGCCAGCATTGTGGATGCCATCAA<br>CCAAGCTGCTGACTGCTGGGGTATCCGCTGCCTC<br>CGTTATGAGATCAAGGATATCCATGTGCCACCCCG<br>GGTGAAAGAGTCTATGCAGATGCAGGTGGAGGCA<br>GAGCGGCGGAAACGGGCCACAGTTCTAGAGTCTG<br>AGGGGACCCGAGAGTCGGCATCAATGTGGCAGAA<br>GGGAAGAAACAGGCCCAGATCCTGGCCTCCGAAG<br>CAGAAAAGGCTGAACAGATAAATCAGGCAGCAGG<br>AGAGGCCAGTGCAGTTCTGGCGAAGGCCAAGGCT<br>AAAGCTGAAGCTATTCGAATCCTGGCTGCAGCTCT<br>GACACAACATAATGGAGATGCAGCAGCTTCACTGA<br>CTGTGGCCGAGCAGTATGTCAGCGCGTTCTCCAA<br>ACTGGCCAAGGACTCCAACACTATCCTACTGCCCT<br>CCAACCCTGGCGATGTCACCAGCATGGTGGCTCA<br>GGCCATGGGTGTATATGGAGCCCTCACCAA | | |
| 1825 | NM_014038.1_273 | 273 | GGGGCTGCGCCGGGTTCCGTGTGTCTATGTCAAT<br>GTGTCTGTCCTTCACTCCTCCATTGTCTGCCGCCA<br>CTGCTGCTGCTGCTGCTGCTGCCGCTGCTGCTGC<br>ACGAATCGCCGCAGCCCCCAGCCTTGCGCGTCGT<br>CGCTACCTCCTCGGACAGAAATTTTATGAATAAGC<br>ATCAGAAGCCAGTGCTAACAGGCCAGCGGTTCAA<br>AACTCGGAAAAGGGATGAAAAAGAGAAATTCGAAC<br>CCACAGTCTTCAGGGATACACTTGTCCAGGGCTTA<br>ATGAGGCTGGTGATGACCTTGAAGCTGTAGCCAAA<br>TTTCTGGACTCTACAGGCTCAAGATTAGATTATCGT<br>CGCTATGCAGACACACTCTTCGATATCCTGGTGGC<br>TGGCAGTATGCTTGCCCCTGGAGGAACGCGCATA<br>GATGATGGTGACAAGACCAAGATGACCAACCACT<br>GTGTGTTTTCAGCAAATGAAGATCATGAAACCATC<br>CGAAACTATGCTCAGGTCTTCAATAAACTCATCAG<br>GAGATATAAGTATTTGGAGAAGGCATTTGAAGATG<br>AAATGAAAAAGCTTCTCCTCTTCCTTAAAGCCTTTT<br>CCGAAACAGAGCAGACAAAAGTTGGCGATGCTGTC<br>GGGGATTCTGCTGGGCAATGGCACCCTGCCCGCC<br>ACCATCCTCACCAGTCTCTTCACCGACAGCTTAGT<br>CAAAGAAGGCATTGCGGCCTCATTTGCTGTCAAGC<br>TTTTCAAAGCATGGATGGCAGAAAAAGATGCCAAC<br>TCTGTTACCTCGTCTTTGAGAAAAGCCAACTTAGA<br>CAAGAGGCTGCTTGAACTCTTTCCAGTTAACAGAC<br>AGAGTGTGGATCATTTTGCTAAATACTTCACTGAC<br>GCAGGTCTTAAGGAGCTTTCCGACTTCCTCCGAGT<br>CCAGCAGTCCCTGGGCACCAGGAAGGAACTGCAG<br>AAGGAGCTCCAGGAGCGTCTTTCTCAGGAATGCC<br>CGATCAAGGAGGTGGTGCTTTATGTCAAAGAAGAA<br>ATGAAGAGGAATGATCT | 9 | MRLVMTLKL* |
| 1826 | NM_014046.2_165 | 165 | GCCTTTCCGTCAATTCCTGTCCTGGGCGTACGTCA<br>AGATGGCGGCGTCTGTATTAAACACCGTGCTGAG<br>GCGGCTTCCTATGCTATCTCTCTTCCGAGGTTCTC<br>ACAGAGTTCAGGTTCCCCTCCAGACTCTTTGCACC<br>AAAGCTCCCTCTGAGGAAGATTCTTGTCCTCAGTT<br>CCCATTTCTCCTTATAAGGATGAGCCCTGGAAATA<br>TCTGGAATCAGAAGAATACCAGGAGCGATATGGTT<br>CTCGCCCCGTCTGGGCTGACTACCGCCGCAACCA<br>CAAGGGTGGTGTACCCCACAGCGGACTCGGAAG<br>ACATGTATTCGTCGGAATAAAGTTGTTGGGAATCC<br>CTGCCCCATCTGTCGAGATCACAAGTTGCATGTTG<br>ACTTTAGGAACGTGAAGCTCTTGGAGCAATTTGTC<br>TGCGCCCACACGGGTATCATCTTCTATGCTCCATA<br>CACAGGAGTCTGTGTGAAGCAGCACAAGCGGTTG<br>ACCCAGGCCATCCAGAAAGCCAGGGATCATGGTC<br>TCCTCATTTACCACATCCCCCAGGTTGAACCACGG<br>GACCTTGACTTCAGTACCTCTCATGGGGCTGTGAG<br>TGCTACTCCGCCAGCCCCACCCTGGTCTCAGGT<br>GACCCCTGGTACCCATGGTACAACTGGAAACAGC<br>CACCGGAGAGAGAACTGTCTCGCCTTCGCCGGCT<br>TTACCAGGGTCATCTCCAAGAAGAGAGTGGCCCC<br>CCACCTGAGTCAATGCCCAAGATGCCCCCTAGAA<br>CACCAGCGGAAGCCTCCTCCACTGGGCAGACAGG<br>CCCTCAGAGTGCTCTGTAGGAGCTGTAGACTGGG<br>AAGAGAGGCCAGGCGTGGTGGCTCACTCCTGTAA<br>TCCCAGCACTTTGGGAAGCCAAGGTGGGCTGATC | 77 | CPQFPFLLI<br>RMSPGNI<br>WNQKNTR<br>SDMVLAPS<br>GLTTAATT<br>RVVYPHSG<br>LGRHVFVG<br>IKLLGIPAP<br>SVEITSCM<br>LTLGT* |

TABLE 3A-continued

| SEQ ID | identifier_ position | position | modified_RNA | PAP length | PAP |
|---|---|---|---|---|---|
| | | | ACTTGATCCCAGGAGTTTGAGACCAGCCTGGGCA<br>CCATGGTGAAACCTCGTCTTTACCAAAAAATACAA<br>AAATTAGCTGGGTGTGGTGGTGCACACCTGTAGTC<br>TCAACTATTGGGGAGGCTAAGGTA | | |
| 1827 | NM_0140<br>46.2_415 | 415 | GCCTTTCCGTCAATTCCTGTCCTGGGCGTACGTCA<br>AGATGGCGGCGTCTGTATTAAACACCGTGCTGAG<br>GCGGCTTCCTATGCTATCTCTCTTCCGAGGTTCTC<br>ACAGAGTTCAGGTTCCCCTCCAGACTCTTTGCACC<br>AAAGCTCCCTCTGAGGAAGATTCTTTGTCCTCAGT<br>TCCCATTTCTCCTTATAAGGATGAGCCCTGGAAAT<br>ATCTGGAATCAGAAGAATACCAGGAGCGATATGGT<br>TCTCGCCCCGTCTGGGCTGACTACCGCCGCAACC<br>ACAAGGGTGGTGTACCCCACAGCGGACTCGGAA<br>GACATGTATTCGTCGGAATAAAGTTGTTGGGAATC<br>CCTGCCCCATCTGTCGAGATCACAAGTTGCATGTT<br>GACTTTAGGAACGTGAAGCTCTTGGAGCAATTGTC<br>TGCGCCCACACGGGTATCATCTTCTATGCTCCATA<br>CACAGGAGTCTGTGTGAAGCAGCACAAGCGGTTG<br>ACCCAGGCCATCCAGAAAGCCAGGGATCATGGTC<br>TCCTCATTTACCACATCCCCCAGGTTGAACCACGG<br>GACCTTGACTTCAGTACCTCTCATGGGGCTGTGAG<br>TGCTACTCCGCCAGCCCCCACCCTGGTCTCAGGT<br>GACCCCTGGTACCCATGGTACAACTGGAAACAGC<br>CACCGGAGAGAGAACTGTCTCGCCTTCGCCGGCT<br>TTACCAGGGTCATCTCCAAGAAGAGAGTGGCCCC<br>CCACCTGAGTCAATGCCCAAGATGCCCCCTAGAA<br>CACCAGCGGAAGCCTCCTCCACTGGGCAGACAGG<br>CCCTCAGAGTGCTCTGTAGGAGCTGTAGACTGGG<br>AAGAGAGGCCAGGCGTGGTGGCTCACTCCTGTAA<br>TCCCAGCACTTTGGGAAGCCAAGGTGGGCTGATC<br>ACTTGATCCCAGGAGTTTGAGACCAGCCTGGGCA<br>CCATGGTGAAACCTCGTCTTTACCAAAAAATACAA<br>AAATTAGCTGGGTGTGGTGGTGCACACCTGTAGTC<br>TCAACTATTGGGGAGGCTAAGGTA | 18 | LSAPTRVS<br>SSMLHTQE<br>SV* |
| 1828 | NM_0140<br>46.2_512 | 512 | GCCTTTCCGTCAATTCCTGTCCTGGGCGTACGTCA<br>AGATGGCGGCGTCTGTATTAAACACCGTGCTGAG<br>GCGGCTTCCTATGCTATCTCTCTTCCGAGGTTCTC<br>ACAGAGTTCAGGTTCCCCTCCAGACTCTTTGCACC<br>AAAGCTCCCTCTGAGGAAGATTCTTTGTCCTCAGT<br>TCCCATTTCTCCTTATAAGGATGAGCCCTGGAAAT<br>ATCTGGAATCAGAAGAATACCAGGAGCGATATGGT<br>TCTCGCCCCGTCTGGGCTGACTACCGCCGCAACC<br>ACAAGGGTGGTGTACCCCACAGCGGACTCGGAA<br>GACATGTATTCGTCGGAATAAAGTTGTTGGGAATC<br>CCTGCCCCATCTGTCGAGATCACAAGTTGCATGTT<br>GACTTTAGGAACGTGAAGCTCTTGGAGCAATTTGT<br>CTGCGCCCACACGGGTATCATCTTCTATGCTCCAT<br>ACACAGGAGTCTGTGTGAAGCAGCACAAGCGGTT<br>GACCCAGGCCATCCAGAAAGCCAGGGATCATGGTC<br>TCCTCATTTACCACATCCCCCAGGTTGAACCACGG<br>GACCTTGACTTCAGTACCTCTCATGGGGCTGTGAG<br>TGCTACTCCGCCAGCCCCCACCCTGGTCTCAGGT<br>GACCCCTGGTACCCATGGTACAACTGGAAACAGC<br>CACCGGAGAGAGAACTGTCTCGCCTTCGCCGGCT<br>TTACCAGGGTCATCTCCAAGAAGAGAGTGGCCCC<br>CCACCTGAGTCAATGCCCAAGATGCCCCCTAGAA<br>CACCAGCGGAAGCCTCCTCCACTGGGCAGACAGG<br>CCCTCAGAGTGCTCTGTAGGAGCTGTAGACTGGG<br>AAGAGAGGCCAGGCGTGGTGGCTCACTCCTGTAA<br>TCCCAGCACTTTGGGAAGCCAAGGTGGGCTGATC<br>ACTTGATCCCAGGAGTTTGAGACCAGCCTGGGCA<br>CCATGGTGAAACCTCGTCTTTACCAAAAAATACAA<br>AAATTAGCTGGGTGTGGTGGTGCACACCTGTAGTC<br>TCAACTATTGGGGAGGCTAAGGTA | 25 | IMVSSFTT<br>SPRLNHGT<br>LTSVPLMG<br>L* |
| 1829 | NM_0140<br>56.3_218 | 218 | GATTGGCTGGGACGGCTGTGGGTGGGGAGAAGC<br>CGGGAGGACTGGGTGCGCCTGCAGGGATCGGAA<br>GCCGGTTGGGGTGTGAGAGGTTTTCTCGCTCTAG<br>GGAGATTCTTCAAGCAATCACTATGTCAACAGACA<br>CAGGTGTTTCCCTTCCTTCATATGAGGAAGATCAG<br>GGATCAAAACTCATTCGAAAAGCTAAAGAGGCACC<br>ATTCGTACCCGTGGAATAGCGGGTTTTGCAGCAAT<br>TGTTGCATATGGATTATATAAACTGAAGAGCAGGG<br>GAAATACTAAAATGTCCATTCATCTGATCCACATGC<br>GTGTGGCAGCCCAAGGCTTTGTTGTAGGAGCAAT<br>GACTGTTGGTATGGGCTATTCCATGTATCGGGAAT<br>TCTGGGCAAAAACCTAAGCCTTAGAAGAAGAGATGC<br>TGTCTTGGTCTTGTTGGAGGAGCTTGCTTTAGTTA | 1 | E* |

TABLE 3A-continued

| SEQ ID | identifier_position | position | modified_RNA | PAP length | PAP |
|---|---|---|---|---|---|
| | | | GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | | |
| 1830 | NM_0140 56.3_220 | 220 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTAATAGCGGGTTTTGCAGCAAT TGTTGCATATGGATTATATAAACTGAAGAGCAGGG GAAATACTAAAATGTCCATTCATCTGATCCACATGC GTGTGGCAGCCCAAGGCTTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 1 | E* |
| 1831 | NM_0140 56.3_233 | 233 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTGCAGCAAT TGTTGCATATGGATTATATAAACTGAAGAGCAGGG GAAATACTAAAATGTCCATTCATCTGATCCACATGC GTGTGGCAGCCCAAGGCTTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 11 | LQQLLHMD YIN* |

TABLE 3A-continued

| SEQ ID | identifier_position | position | modified_RNA | PAP length | PAP |
|---|---|---|---|---|---|
| 1832 | NM_0140 56.3_242 | 242 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TGTTGCATATGGATTATATAAACTGAAGAGCAGGG GAAATACTAAAATGTCCATTCATCTGATCCACATGC GTGTGGCAGCCCAAGGCTTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 8 | MLHMDYIN* |
| 1833 | NM_0140 56.3_245 | 245 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTGCATATGGATTATATAAACTGAAGAGCAGGG GAAATACTAAAATGTCCATTCATCTGATCCACATGC GTGTGGCAGCCCAAGGCTTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 6 | HMDYIN* |
| 1834 | NM_0140 56.3_277 | 277 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTTGCATATGGATTATATAAACTGAAGAGCAGG GAAATACTAAAATGTCCATTCATCTGATCCACATGC GTGTGGCAGCCCAAGGCTTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA | 8 | EILKCPFI* |

TABLE 3A-continued

| SEQ ID | identifier_ position | position | modified_RNA | PAP length | PAP |
|---|---|---|---|---|---|
| | | | CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | | |
| 1835 | NM_0140 56.3_332 | 332 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTTGCATATGGATTATATAAACTGAAGAGCAGG GGAAATACTAAAATGTCCATTCATCTGATCCACATG CGTGTGGCAGCCCAAGGCTTGTTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 2 | LL* |
| 1836 | NM_0140 56.3_335 | 335 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTTGCATATGGATTATATAAACTGAAGAGCAGG GGAAATACTAAAATGTCCATTCATCTGATCCACATG CGTGTGGCAGCCCAAGGCTTTGTGTAGGAGCAAT GACTGTTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 0 | * |
| 1837 | NM_0140 56.3_353 | 353 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA | 45 | VWAIPCIG NSGQNLSL RRRDAVLV LLEELALV |

TABLE 3A-continued

| SEQ ID | identifier_ position | position | modified_RNA | PAP length | PAP |
|---|---|---|---|---|---|
| | | | CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTTGCATATGGATTATATAAACTGAAGAGCAGG GGAAATACTAAAATGTCCATTCATCTGATCCACATG CGTGTGGCAGCCCAAGGCTTTGTTGTAGGAGCAA TGACTGTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | | RCLIIKVTY YCWK* |
| 1838 | NM_0140 56.3_394 | 394 | GATTGGCTGGGACGGCTGTGGGTGGGGAGAAGC CGGGAGGACTGGGTGCGCCTGCAGGGATCGGAA GCCGGTTGGGGTGTGAGAGGTTTTCTCGCTCTAG GGAGATTCTTCAAGCAATCACTATGTCAACAGACA CAGGTGTTTCCCTTCCTTCATATGAGGAAGATCAG GGATCAAAACTCATTCGAAAAGCTAAAGAGGCACC ATTCGTACCCGTTGGAATAGCGGGTTTTGCAGCAA TTGTTGCATATGGATTATATAAACTGAAGAGCAGG GGAAATACTAAAATGTCCATTCATCTGATCCACATG CGTGTGGCAGCCCAAGGCTTTGTTGTAGGAGCAA TGACTGTGGTATGGGCTATTCCATGTATCGGGAAT TCTGGGCAAAACCTAAGCCTTAGAAGAAGAGATGC TGTCTTGGTCTTGTTGGAGGAGCTTGCTTTAGTTA GATGTCTTATTATTAAAGTTACCTATTATTGTTGGA AATAAACTAATTTGTATGGGTTTAGATGGTAACATG GCATTTTGAATATTGGCTTCCTTTCTTGCAGGCTTG ATTTGCTTGGTGACCGAATTACTAGTGACTAGTTTA CTAACTAGGTCATTCAAGGAAGTCAAGTTAACTTAA ACATGTCACCTAAATGCACTTGATGGTGTTGAAAT GTCCACCTTCTTAAATTTTTAAGATGAACTTAGTTC TAAAGAAGATAACAGGCCAATCCTGAAGGTACTCC CTGTTTGCTGCAGAATGTCAGATATTTTGGATGTTG CATAAGAGTCCTATTTGCCCCAGTTAATTCAACTTT TGTCTGCCTGTTTTGTGGACTGGCTGGCTCTGTTA GAACTCTGTCCAAAAAGTGCATGGAATATAACTTG TAAAGCTTCCCACAATTGACAATATATATGCATGTG TTTAAACCAAATCCAGAAAGCTTAAACAATAGAGCT GCATAATAGTATTTATTAAAGAATCACAACTGTAAA CATGAGAATAATTTAAGGATTCTAGTTTAGTTTTTT GT | 32 | LSLRRRDA VLVLLEELA LVRCLIIKV TYYCWK* |
| 1839 | NM_0141 71.3_386 | 386 | GCCGGAAGTGGGTTGACGTAGCCCGGAAGGGGA ATACTTCCAAGTTGTAGTGTTGTTGTTTTCAGCCTG CTGCTGCTGCTGTTGCGGCTAGGGGAACCGT CGTGGGGAAGGATGGTGTGCGAAAAATGTGAAAA GAAACTTGGTACTGTTATCACTCCAGATACATGGA AAGATGGTGCTAGGAATACCACAGAAAGTGGTGG AAGAAAGCTGAATGAAAATAAAGCTTTGACTTCAAA AAAAGCAAGATTTGATCCATATGAAAGAATAAGTT CTCCACTTGTAGAATTTGTAAAAGTTCTGTGCACCA ACCAGGTTCTCATTACTGCCAGGGCTGTGCCTACA AAAAAGGCATCTGTGCGATGTGTGGAAAAAAGGTT TGGATACCAAAAACTACAAGCAAACATCTGTCTAG ATGTATTGATGGAATTTCTGGCTTTCTAAATGATTT TACTTTCTGCCTTGAATTTTCAAGGCATAGATGTCA ACTTACAGAATAACATGTTTTAAGATAATTAAGTTT AAACCAGAGAATTTGATTGTTACTCATTTTGCTCTC ATGTTCTAAACAGCAACAGTGTAACTAGTCTTTTGT TGTAAATGGTTATTTTCCTTATAAGAATTTTAAGAAC TAAGTGGCAAATTCCATGAAAATATTTCTCAGTTCT GTATGCACTTTTATTTAACATTATTCATATAATTCTC CCCCCACCACTTTATTTATAGATACTGCAAAAGTGA | 39 | WIPKTTSK HLSRCIDGI SGFLNDFT FCLEFSRH RCQLTE* |

TABLE 3A-continued

| SEQ ID | identifier_position | position | modified_RNA | PAP length | PAP |
|---|---|---|---|---|---|
| | | | GAAGGAGATAATAGATACTTTGCTCTGAATTTGGC ATCCAGAGTTAACATTTCTCCCCTCACTCCCTTGCT GGTGTCATAGTTATTAGAATCAGCAGCCTCTTAACT AATTGCGGTTTCATAGGATATATAAATGTTTCAAGC CATTATTGCTGAATGGTTCTTTAGTTATTAACCTAG ACCCAAATCAAAGACCAGTTGGATTTATGATATTTT TTATTTGTTCTTGCAGCCAAAGTGCCAGTTTCTTTA ATATGTGACCAAGAACACAAGGAGCATC | | |
| 1840 | NM_0141 73.2_194 | 194 | GGAGGCGTCGGGGCTGCGCCGTACAACTTCCGG CTGTAAAGATGGCGGCTTCCTAGTGAGTCGGCGG CTGATTTAGAAGGAGGTTCAGGCTACGGTGAGCC GAAGCCACACAGGAGCCATGGAAGTGGCAGAGCC CAGCAGCCCCACTGAAGAGGAGGAGGAGGAAGA GGAGCACTCGGCAGAGCCTCGGCCCGCACTCGCT CCAATCCTGAAGGGGCTGAGGACCGGGCAGTAGG GGCACAGGCCAGCGTGGGCAGCCGCAGCGAGGG TGAGGGTGAGGCCGCCAGTGCTGATGATGGGAGC CTCAACACTTCAGGAGCCGGCCCTAAGTCCTGGC AGGTGCCCCCGCCAGCCCCTGAGGTCCAAATTCG GACACCAAGGGTCAACTGTCCAGAGAAAGTGATTA TCTGCCTGGACCTGTCAGAGGAAATGTCACTGCCA AAGCTGGAGTCGTTCAACGGCTCCAAAACCAACG CCCTCAATGTCTCCCAGAAGATGATTGAGATGTTC GTGCGGACAAAACACAAGATCGACAAAAGCCACG AGTTTGCACTGGTGGTGGTGAACGATGACACGGC CTGGCTGTCTGGCCTGACCTCCGACCCCCGCGAG CTCTGTAGCTGCCTCTATGATCTGGAGACGGCCTC CTGTTCCACCTTCAATCTGGAAGGACTTTTCAGCC TCATCCAGCAGAAAACTGAGCTTCCGGTCACAGAG AACGTGCAGACGATTCCCCCGCCATATGTGGTCC GCACCATCCTTGTCTACAGCCGTCCACCTTGCCAG CCCCAGTTCTCCTTGACGGAGCCCATGAAGAAAAT GTTCCAGTGCCCATATTTCTTCTTTGACGTTGTTTA CATCCACAATGGCACTGAGGAGAAGGAGGAGGAG ATGAGTTGGAAGGATATGTTTGCCTTCATGGGCAG CCTGGATACCAAGGGTACCAGCTACAAGTATGAG GTGGCACTGGCTGGGCCAGCCCTGGAGTTGCACA ACTGCATGGCGAAACTGTTGGCCCACCCCC | 13 | ALAPILKGL RTGQ* |
| 1841 | NM_0141 73.2_646 | 646 | GGAGGCGTCGGGGCTGCGCCGTACAACTTCCGG CTGTAAAGATGGCGGCTTCCTAGTGAGTCGGCGG CTGATTTAGAAGGAGGTTCAGGCTACGGTGAGCC GAAGCCACACAGGAGCCATGGAAGTGGCAGAGCC CAGCAGCCCCACTGAAGAGGAGGAGGAGGAAGA GGAGCACTCGGCAGAGCCTCGGCCCCGCACTCG CTCCAATCCTGAAGGGGCTGAGGACCGGGCAGTA GGGGCACAGGCCAGCGTGGGCAGCCGCAGCGAG GGTGAGGGTGAGGCCGCCAGTGCTGATGATGGG AGCCTCAACACTTCAGGAGCCGGCCCTAAGTCCT GGCAGGTGCCCCCGCCAGCCCCTGAGGTCCAAAT TCGGACACCAAGGGTCAACTGTCCAGAGAAAGTG ATTATCTGCCTGGACCTGTCAGAGGAAATGTCACT GCCAAAGCTGGAGTCGTTCAACGGCTCCAAAACC AACGCCCTCAATGTCTCCCAGAAGATGATTGAGAT GTTCGTGCGGACAAAACACAAGATCGACAAAAGC CACGAGTTTGCACTGGTGGTGGTGAACGATGACA CGGCCTGGCTGTCTGGCCTGACCTCCGACCCCCG CGAGCTCTGTAGCTGCCTCTATGATCTGGAGACG GCTCCTGTTCCACCTTCAATCTGGAAGGACTTTTC AGCCTCATCCAGCAGAAAACTGAGCTTCCGGTCAC AGAGAACGTGCAGACGATTCCCCCGCCATATGTG GTCCGCACCATCCTTGTCTACAGCCGTCCACCTTG CCAGCCCCAGTTCTCCTTGACGGAGCCCATGAAG AAAATGTTCCAGTGCCCATATTTCTTCTTTGACGTT GTTTACATCCACAATGGCACTGAGGAGAAGGAGG AGGAGATGAGTTGGAAGGATATGTTTGCCTTCATG GGCAGCCTGGATACCAAGGGTACCAGCTACAAGT ATGAGGTGGCACTGGCTGGGCCAGCCCTGGAGTT GCACAACTGCATGGCGAAACTGTTGGCCCACCCC C | 51 | PVPPSIWK DFSASSSR KLSFRSQR TCRRFPRH MWSAPSL STAVHLAS PSSP* |
| 1842 | NM_0141 83.2_116 | 116 | CGCAGAAAGGCACAGGACTCGCTAAGTGTTCGCT ACGCGGGGCTACCGGATCGGTCGGAAATGGCAGA GGTGGAGGAGACACTGAAGCGACTGCAGAGCCAG AAGGGAGTGCAGGAATCATCGTCGTGAACACAGA AGGCATTCCCATCAAGAGCACCATGGACAACCCC ACCACCACCCAGTATGCCAGCCTCATGCACAGCTT CATCCTGAAGGCACGGAGCACCGTGCGTGACATC GACCCCCAGAACGATCTCACCTTCCTTCGAATTCG | 4 | ESSS* |

TABLE 3A-continued

| SEQ ID | identifier_position | position | modified_RNA | PAP length | PAP |
|---|---|---|---|---|---|
| | | | CTCCAAGAAAAATGAAATTATGGTTGCACCAGATA AAGACTATTTCCTGATTGTGATTCAGAATCCAACC GAATAAGCCACTCTCTTGGCTCCCTGTGTCATTCC TTAATTTAATGCCCCCCAAGAATGTTAATGTCAATC ATGTCAGTGGACTAGCACATGGCAGTCGCTTGGA ACCCACTCACACCAATCCAGTGACCGTGTGTGGG CTGGCGGCTCTTCTCCCCCACCAACGGAACCCCT GTGTGCACCAACCTTCCCCAGAGCTCCGGAGCGC CCTCTCCTCACTTCCAGGTTTTGGAGCAAGAGCTT GCAGGAAGCCCGCACCCAGCTTCCTTCTGACCTT CAGTTCACTTTGTCGCCCTTGGAGAAAGCTGTTTT TCTTTAACTAAAAATAACCAAAATGCTTAAAAAAAA AAAAAAAAAA | | |
| 1843 | NM_0142 20.2_314 | 314 | AAGGGCGGGACATTCCCCCTGCCTCTTCGCACCA CAGCCAGAGCCTGCCATTAGGACCAATGAAAGCA AAGTACCTCATCCCCTCAGTGACTAAGAATCGCAG TATTTAAGAGGTAGCAGGAATGGGCTGAGAGTGG TGTTTGCTTTCTCCACCAGAAGGGCACACTTTCAT CTAATTTGGGGTATCACTGAGCTGAAGACAAAGAG AAGGGGGAGAAAACCTAGCAGACCACCATGTGCT ATGGGAAGTGTGCACGATGCATCGGACATTCTCTG GTGGGGCTCGCCCTCCTGTGCATCGCGGCTAATA TTTGCTTTACTTTCCCAATGGGGAAACAAAGTATGC CTCCGAAAACCACCTCAGCCGCTTCGTGTGGTTCT TTTCTGGCATCGTAGGAGGTGGCCTGCTGATGCTC CTGCCAGCATTTGTCTTCATTGGGCTGGAACAGGA TGACTGCTGTGGCTGCTGTGGCCATGAAAACTGTG GCAAACGATGTGCGATGCTTTCTTCTGTATTGGCT GCTCTCATTGGAATTGCAGGATCTGGCTACTGTGT CATTGTGGCAGCCCTTGGCTTAGCAGAAGGACCA CTATGTCTTGATTCCCTCGGCCAGTGGAACTACAC CTTTGCCAGCACTGAGGGCCAGTACCTTCTGGATA CCTCCACATGGTCCGAGTGCACTGAACCCAAGCA CATTGTGGAATGGAATGTATCTCTGTTTTCTATCCT CTTGGCTCTTGGTGGAATTGAATTCATCTTGTGTCT TATTCAAGTAATAAATGGAGTGCTTGGAGGCATAT GTGGCTTTTGCTGCTCTCACCAACAGCAATATGAC TGCTAAAAGAACCAACCCAGGACAGAGCCACAATC TTCCTCTATTTCATTGTAATTTATATATTTCACTTGT ATTCATTTGTAAAACTTTGTATTAGTGTAACATACTC CCCACAGTCTACTTTTACAAACGCCTGTAAAGACT GGCATCTTCACAGGATGTCAGTGTTTAAATTTAGTA AACTTCTT | 27 | CFTFPMGK QSMPPKTT SAASCGSF LAS* |
| 1844 | NM_0142 20.2_518 | 518 | AAGGGCGGGACATTCCCCCTGCCTCTTCGCACCA CAGCCAGAGCCTGCCATTAGGACCAATGAAAGCA AAGTACCTCATCCCCTCAGTGACTAAGAATCGCAG TATTTAAGAGGTAGCAGGAATGGGCTGAGAGTGG TGTTTGCTTTCTCCACCAGAAGGGCACACTTTCAT CTAATTTGGGGTATCACTGAGCTGAAGACAAAGAG AAGGGGGAGAAAACCTAGCAGACCACCATGTGCT ATGGGAAGTGTGCACGATGCATCGGACATTCTCTG GTGGGGCTCGCCCTCCTGTGCATCGCGGCTAATA TTTTGCTTTACTTTCCCAATGGGGAAACAAAGTATG CCTCCGAAAACCACCTCAGCCGCTTCGTGTGGTTC TTTTCTGGCATCGTAGGAGGTGGCCTGCTGATGCT CCTGCCAGCATTTGTCTTCATTGGGCTGGAACAGG ATGACTGCTGTGGCTGCTGTGGCCATGAAAACTGT GGCAAACGATGTGCGATGCTTTCTTCTGTATGGCT GCTCTCATTGGAATTGCAGGATCTGGCTACTGTGT CATTGTGGCAGCCCTTGGCTTAGCAGAAGGACCA CTATGTCTTGATTCCCTCGGCCAGTGGAACTACAC CTTTGCCAGCACTGAGGGCCAGTACCTTCTGGATA CCTCCACATGGTCCGAGTGCACTGAACCCAAGCA CATTGTGGAATGGAATGTATCTCTGTTTTCTATCCT CTTGGCTCTTGGTGGAATTGAATTCATCTTGTGTCT TATTCAAGTAATAAATGGAGTGCTTGGAGGCATAT GTGGCTTTTGCTGCTCTCACCAACAGCAATATGAC TGCTAAAAGAACCAACCCAGGACAGAGCCACAATC TTCCTCTATTTCATTGTAATTTATATATTTCACTTGT ATTCATTTGTAAAACTTTGTATTAGTGTAACATACTC CCCACAGTCTACTTTTACAAACGCCTGTAAAGACT GGCATCTTCACAGGATGTCAGTGTTTAAATTTAGTA AACTTCTT | 20 | WLLSLELQ DLATVSLW QPLA* |
| 1845 | NM_0142 20.2_613 | 613 | AAGGGCGGGACATTCCCCCTGCCTCTTCGCACCA CAGCCAGAGCCTGCCATTAGGACCAATGAAAGCA AAGTACCTCATCCCCTCAGTGACTAAGAATCGCAG TATTTAAGAGGTAGCAGGAATGGGCTGAGAGTGG | 54 | SGTTPLPA LRASTFWI PPHGPSAL NPSTLWN |

TABLE 3A-continued

| SEQ ID | identifier_ position | position | modified_RNA | PAP length | PAP |
|---|---|---|---|---|---|
| | | | TGTTTGCTTTCTCCACCAGAAGGGCACACTTTCAT CTAAATTTGGGGTATCACTGAGCTGAAGACAAAGAG AAGGGGGAGAAAACCTAGCAGACCACCATGTGCT ATGGGAAGTGTGCACGATGCATCGGACATTCTCTG GTGGGGCTCGCCCTCCTGTGCATCGCGGCTAATA TTTTGCTTTACTTTCCCAATGGGGAAACAAAGTATG CCTCCGAAAACCACCTCAGCCGCTTCGTGTGGTTC TTTTCTGGCATCGTAGGAGGTGGCCTGCTGATGCT CCTGCCAGCATTTGTCTTCATTGGGCTGGAACAGG ATGACTGCTGTGGCTGCTGTGGCCATGAAAACTGT GGCAAACGATGTGCGATGCTTTCTTCTGTATTGGC TGCTCTCATTGGAATTGCAGGATCTGGCTACTGTG TCATTGTGGCAGCCCTTGGCTTAGCAGAAGGACC ACTATGTCTTGATTCCCTCGGCAGTGGAACTACAC CTTTGCCAGCACTGAGGGCCAGTACCTTCTGGATA CCTCCACATGGTCCGAGTGCACTGAACCCAAGCA CATTGTGGAATGGAATGTATCTCTGTTTTCTATCCT CTTGGCTCTTGGTGGAATTGAATTCATCTTGTGTCT TATTCAAGTAATAAATGGAGTGCTTGGAGGCATAT GTGGCTTTTGCTGCTCTCACCAACAGCAATATGAC TGCTAAAAGAACCAACCCAGGACAGAGCCACAATC TTCCTCTATTTCATTGTAATTTATATATTTCACTTGT ATTCATTTGTAAAACTTTGTATTAGTGTAACATACTC CCCACAGTCTACTTTTACAAACGCCTGTAAAGACT GGCATCTTCACAGGATGTCAGTGTTTAAATTTAGTA AACTTCTT | | GMYLCFLS SWLLVELN SSCVLFK* |
| 1846 | NM_0142 36.2_507 | 507 | CCGGGATCCTGTGTAGCGGCTGCAGAGGGTGCCG CCGCCCTAGGCGAAGTAGGGCCGTCCTGAGCGAA AGAACCGCCCCAGCAGGAGCACCACCACGGCTT AGCAAAGAATCCCAGACCCCGCCCGGGAAGGCAG CCGCACCATGGAGTCTTCCAGTTCATCTAACTCTT ATTTCTCCGTTGGCCCAACCAGTCCCAGCGCTGTC GTGCTCCTCTACTCGAAGGAGCTCAAAAAGTGGG ATGAGTTTGAAGATATTTTAGAAGAGAGGAGGCAT GTCAGTGACTTGAAATTTGCAATGAAATGCTACAC ACCTCTTGTCTATAAGGGAATTACTCCATGTAAACC AATTGATATTAAATGTAGTGTTCTCAATTCTGAGGA GATTCATTATGTCATTAAACAGCTTTCCAAGGAATC CCTTCAATCTGTGGATGTCCTCCGAGAGGAAGTGA GTGAGATCTTAGATGAAATGAGTCACAAACTGCGT CTTGGAGCCATTCGGTTTGTGCCTTCACCCTGAGC AAAGTATTTAAACAAATTTTCTCGAAGGTGTGTGTA AATGAAGAAGGTATTCAGAAAACTACAAAGAGCCAT CCAGGAGCATCCTGTTGTTCTGCTGCCTAGTCATC GAAGTTACATTGACTTCCTCATGTTGTCTTTTCTTC TATACAATTATGATTTGCCTGTGCCAGTTATAGCAG CAGGAATGGACTTCCTGGGAATGAAAAATGGTTGGT GAGCTGCTACGAATGTCGGGTGCCTTTTTCATGCG GCGTACCTTTGGTGGCAATAAACTCTACTGGGCTG TATTCTCTGAATATGTAAAAACTATGTTACGGAATG GTTATGCTCCTGTTGAATTTTTCCTCGAAGGGACA AGAAGCCGCTCTGCCAAGACATTGACTCCTAAATT TGGTCTTCTGAATATTGTGATGGAGCCATTTTTTAA AAGAGAAGTTTTTGATACCTACCTTGTCCCAATTAG TATCAGTTATGATAAGATCTTGGAAGAAACTCTTTA TGTG | 4 | VPSP* |
| 1847 | NM_0143 00.2_515 | 515 | GAAGGTGGCAGAGCAGCCTCCCCAACTAAGCCTG GGTCGCCGCCTCGGTGAAGGGCCGCGGGGCCGA GCGCGGGAAGTGGCGTCCAGTCGGTTTTTGGCAG GCGAGAGCCAGAGCGTGAGAACCCTCCCACGGC GAGGCCAAGCCCTGAGACTGGACTAGCAAGGTCG TGAGTCTCTCTGTCAGCTCTCCGCAGCGAAGGGG CGCGGGGGGCGGGGACCGTGCCCGACCGTGCCA GCTCCCGCTCCGGAAGCGGAAGTGCAAGCACTGC GGGGTCCTGTCCAGTGTGAGCCCGACCCGAGCTC CAGTAGTTCCGCCCGCTGGTCATCGCGCCCTTTC CCCTGCCGGTGTCCTGCTCGCCGTCCCCGCCATG CTGTCTCTAGACTTTTTGGACGATGTGCGGCGGAT GAACAAGCGGCAGCTCTATTATCAAGTCCTAAATT TTGGAATGATTGTCTCATCGGCACTAATGATCTGG AAGGGGTTAATGGTAATAACTGGAAGTGAAAGTCC GATGTAGTGGTGCTCAGTGGCAGCATGGAACCTG CATTTCATAGAGGAGATCTTCTCTTTCTAACAAATC GAGTTGAAGATCCCATACGAGTGGGAGAAATTGTT GTTTTTAGGATAGAAGGAAGAGAGATTCCTATAGT TCACCGAGTCTTGAAGATTCATGAAAAGCAAAATG GGCATATCAAGTTTTTGACCAAAGGAGATAATAAT | 1 | M* |

TABLE 3A-continued

| SEQ ID | identifier_position | position | modified_RNA | PAP length | PAP |
|---|---|---|---|---|---|
| | | | GCGGTTGATGACCGAGGCCTCTATAAACAAGGAC<br>AACATTGGCTAGAGAAAAAAGATGTTGTGGGGAGA<br>GCCAGGGGATTTGTTCCTTATATTGGAATTGTGAC<br>GATCCTCATGAATGACTATCCTAAATTTAAGTATGC<br>AGTTCTCTTTTTGCTGGGTTTATTCGTGCTGGTTCA<br>TCGTGAGTAAGAAGCCTGCCTTGCTGTTCCTGGGA<br>AGATGCCATAGTTTTCGTTACTGGATGTTTGGAGT<br>AGATACTGGTCTGTGATTGGTGGAATGGAGAACAC<br>ACGTGTTGGTGCTTCTGGGTAG | | |
| 1848 | NM_0143<br>00.2_617 | 617 | GAAGGTGGCAGAGCAGCCTCCCCAACTAAGCCTG<br>GGTCGCCGCCTCGGTGAAGGGCCGCGGGGCCGA<br>GCGCGGGAAGTGGCGTCCAGTCGGTTTTTGGCAG<br>GCGAGAGCCAGAGCGTGAGAACCCTCCCACGGC<br>GAGGCCAAGCCCTGAGACTGGACTAGCAAGGTCG<br>TGAGTCTCTCTGTCAGCTCTCCGCAGCGAAGGGG<br>CGCGGGGGGCGGGGACCGTGCCCGACCGTGCCA<br>GCTCCCGCTCCGGAAGCGGAAGTGCAAGCACTGC<br>GGGGTCCTGTCCAGTGTGAGCCCGACCCGAGCTC<br>CAGTAGTTCCGCCCGCTGGTCATCGCGCCCTTTC<br>CCCTGCCGGTGTCCTGCTCGCCGTCCCCGCCATG<br>CTGTCTCTAGACTTTTTGGACGATGTGCGGCGGAT<br>GAACAAGCGGCAGCTCTATTATCAAGTCCTAAATT<br>TTGGAATGATTGTCTCATCGGCACTAATGATCTGG<br>AAGGGGTTAATGGTAATAACTGGAAGTGAAAGTCC<br>GATTGTAGTGGTGCTCAGTGGCAGCATGGAACCT<br>GCATTTCATAGAGGAGATCTTCTCTTTCTAACAAAT<br>CGAGTTGAAGATCCCATACGAGTGGGAGAAATTGT<br>GTTTTTAGGATAGAAGGAAGAGAGATTCCTATAGT<br>TCACCGAGTCTTGAAGATTCATGAAAAGCAAAATG<br>GGCATATCAAGTTTTTGACCAAAGGAGATAATAAT<br>GCGGTTGATGACCGAGGCCTCTATAAACAAGGAC<br>AACATTGGCTAGAGAAAAAAGATGTTGTGGGGAGA<br>GCCAGGGGATTTGTTCCTTATATTGGAATTGTGAC<br>GATCCTCATGAATGACTATCCTAAATTTAAGTATGC<br>AGTTCTCTTTTTGCTGGGTTTATTCGTGCTGGTTCA<br>TCGTGAGTAAGAAGCCTGCCTTGCTGTTCCTGGGA<br>AGATGCCATAGTTTTCGTTACTGGATGTTTGGAGT<br>AGATACTGGTCTGTGATTGGTGGAATGGAGAACAC<br>ACGTGTTGGTGCTTCTGGGTAG | 3 | FLG* |
| 1849 | NM_0143<br>00.2_799 | 799 | GAAGGTGGCAGAGCAGCCTCCCCAACTAAGCCTG<br>GGTCGCCGCCTCGGTGAAGGGCCGCGGGGCCGA<br>GCGCGGGAAGTGGCGTCCAGTCGGTTTTTGGCAG<br>GCGAGAGCCAGAGCGTGAGAACCCTCCCACGGC<br>GAGGCCAAGCCCTGAGACTGGACTAGCAAGGTCG<br>TGAGTCTCTCTGTCAGCTCTCCGCAGCGAAGGGG<br>CGCGGGGGGCGGGGACCGTGCCCGACCGTGCCA<br>GCTCCCGCTCCGGAAGCGGAAGTGCAAGCACTGC<br>GGGGTCCTGTCCAGTGTGAGCCCGACCCGAGCTC<br>CAGTAGTTCCGCCCGCTGGTCATCGCGCCCTTTC<br>CCCTGCCGGTGTCCTGCTCGCCGTCCCCGCCATG<br>CTGTCTCTAGACTTTTTGGACGATGTGCGGCGGAT<br>GAACAAGCGGCAGCTCTATTATCAAGTCCTAAATT<br>TTGGAATGATTGTCTCATCGGCACTAATGATCTGG<br>AAGGGGTTAATGGTAATAACTGGAAGTGAAAGTCC<br>GATTGTAGTGGTGCTCAGTGGCAGCATGGAACCT<br>GCATTTCATAGAGGAGATCTTCTCTTTCTAACAAAT<br>CGAGTTGAAGATCCCATACGAGTGGGAGAAATTGT<br>TGTTTTAGGATAGAAGGAAGAGAGATTCCTATAG<br>TTCACCGAGTCTTGAAGATTCATGAAAAGCAAAAT<br>GGGCATATCAAGTTTTTGACCAAAGGAGATAATAA<br>TGCGGTTGATGACCGAGGCCTCTATAAACAAGGA<br>CAACATTGGCTAGAGAAAAAAGATGTTGTGGGGAG<br>AGCCAGGGGATTTGTTCCTTATATTGGAATTGTGAC<br>GATCCTCATGAATGACTATCCTAAATTTAAGTATGC<br>AGTTCTCTTTTTGCTGGGTTTATTCGTGCTGGTTCA<br>TCGTGAGTAAGAAGCCTGCCTTGCTGTTCCTGGGA<br>AGATGCCATAGTTTTCGTTACTGGATGTTTGGAGT<br>AGATACTGGTCTGTGATTGGTGGAATGGAGAACAC<br>ACGTGTTGGTGCTTCTGGGTAG | 8 | DLFLILEL* |
| 1850 | NM_0143<br>35.2_621 | 621 | GCCTTTGCGCACGCGCACGAACGCACGGCCGCG<br>CAGCATCTGTCTTGCTGGAAGCTTTTTCCTAGAGG<br>TTGAGCGGTTTGCACAATGTCGGAAATGGCTGAGT<br>TGTCCGAGCTGTATGAAGAGAGCAGTGACCTGCA<br>GATGGATGTGATGCCTGGCGAGGGTGACCTTCCG<br>CAGATGGAGGTAGGCAGCGGGAGCCGGGAGCTA<br>TCCCTGCGTCCCTCCCGCAGCGGGGCCCAACAGC<br>TCGAGGAGGAAGGCCCAATGGAGGAGGAGGAGG | 9 | VMRLLIES<br>S* |

TABLE 3A-continued

| SEQ ID | identifier_position | position | modified_RNA | PAP length | PAP |
|---|---|---|---|---|---|
| | | | CCCAGCCAATGGCGGCGCCAGAGGGGAAACGGA<br>GCCTTGCTAACGGGCCCAACGCTGGGGAGCAGCC<br>AGGCCAGGTGGCGGGCGCAGACTTCGAGAGCGA<br>GGACGAGGGCGAGGAATTTGATGACTGGGAGGAC<br>GACTACGACTATCCCGAAGAGGAGCAGCTCAGTG<br>GTGCCGGCTACAGAGTATCAGCCGCTCTTGAAGA<br>AGCCGACAAGATGTTTCTGAGAACAAGAGAACCAG<br>CCCTGGATGGCGGGTTTCAGATGCATTATGAGAA<br>GACCCCGTTTGATCAGTTAGCTTTTATCGAAGAGC<br>TTTTTTCACTGATGGTTGTCAATCGTCTGACCGAAG<br>AACTCGGTGTGATGAGATTATTGATAGAGAGTAGT<br>TAGATGCTGTTAAAAGAGGAGGAAACTACTTGAGG<br>AGGGACCCAACTTTCCGCTATCTTTTGGGTTCATT<br>CCAAATAGTTTTGTGCCATTGAAAAACTTGACCTTC<br>AAAAAAATTTGTTTTTCAGAATAGAACACAATAGGA<br>CAGTGACTGCACAGTTGTGAAAAAGGAAGAGAATC<br>ATTAAAGAAAAAGAAAAAAGATTTTAAGACCGTTGA<br>AATCAATTATCAAGAACGTCCTAAAACACCTATGG<br>CTTTGACTTTGTTATTGATCCAGATTATTTTCCTTG<br>CATTGGGGAAAATATCTTTCATATTTGTTTGCTGTA<br>AAGATGGTTTTGCAAGAATAAGTCATGACCAAGAC<br>AAACTGCCAATACAAAAGCCC | | |
| 1851 | NM_01439<br>4.2_456 | 456 | AGTGTGGCCGCTTTTCCGACAGAGGCCTGCCCGT<br>GATTGGCTGCTCGTACTATTTACGTCCTTTCGATGT<br>TGCGTCATGCAGTGCGCCGGAGGAACTGTGCTCT<br>TTGAGGCCGACGCTAGGGGCCCGGAAGGGAAACT<br>GCGAGGCGAAGGTGACCGGGGACCGAGCATTTCA<br>GATCTGCTCGGTAGACCTGGTGCACCACCACCAT<br>GTTGGCTGCAAGGCTGGTGTGTCTCCGGACACTA<br>CCTTCTAGGGTTTTCCACCCAGCTTTCACCAAGGC<br>CTCCCCTGTTGTGAAGAATTCCATCACGAAGAATC<br>AATGGCTGTTAACACCTAGCAGGGAATATGCCACC<br>AAAACAAGAATTGGGATCCGGCGTGGGAGAACTG<br>GCCAAGAACTCAAAGAGGCAGCATTGGAACCATC<br>GATGGAAAAAAATATTTAAAATTGATCAGATGGGAA<br>GATGGTTGTTGCTGGAGGGGCTGCTGTTGGTCTT<br>GGAGCATTGTGCTACTATGGCTTGGGACTGTCTAA<br>TGAGATTGGAGCTATTGAAAAGGCTGTAATTTGGC<br>CTCAGTATGTCAAGGATAGAATTCATTCCACCTATA<br>TGTACTTAGCAGGGAGTATTGGTTTAACAGCTTTG<br>TCTGCCATAGCAATCAGCAGAACGCCTGTTCTCAT<br>GAACTTCATGATGAGAGGCTCTTGGGTGACAATTG<br>GTGTGACCTTTGCAGCCATGGTTGGAGCTGGAAT<br>GCTGGTACGATCAATACCATATGACCAGAGCCCAG<br>GCCCAAAGCATCTTGCTTGGTTGCTACATTCTGGT<br>GTGATGGGTGCAGTGGTGGCTCCTCTGACAATATT<br>AGGGGGTCCTCTTCTCATCAGAGCTGCATGGTACA<br>CAGCTGGCATTGTGGGAGGCCTCTCCACTGTGGC<br>CATGTGTGCGCCCAGTGAAAAGTTTCTGAACATGG<br>GTGCACCCCTGGGAGTGGGCCTGGGTCTCGTCTT<br>TGTGTCCTCATTGGGATCTATGTTTCTTCCACCTAC<br>CACCGTGGCTGGTGCCAC | 30 | LLLEGLLLV<br>LEHCATMA<br>WDCLMRL<br>ELLKRL* |
| 1852 | NM_01439<br>4.2_609 | 609 | AGTGTGGCCGCTTTTCCGACAGAGGCCTGCCCGT<br>GATTGGCTGCTCGTACTATTTACGTCCTTTCGATGT<br>TGCGTCATGCAGTGCGCCGGAGGAACTGTGCTCT<br>TTGAGGCCGACGCTAGGGGCCCGGAAGGGAAACT<br>GCGAGGCGAAGGTGACCGGGGACCGAGCATTTCA<br>GATCTGCTCGGTAGACCTGGTGCACCACCACCAT<br>GTTGGCTGCAAGGCTGGTGTGTCTCCGGACACTA<br>CCTTCTAGGGTTTTCCACCCAGCTTTCACCAAGGC<br>CTCCCCTGTTGTGAAGAATTCCATCACGAAGAATC<br>AATGGCTGTTAACACCTAGCAGGGAATATGCCACC<br>AAAACAAGAATTGGGATCCGGCGTGGGAGAACTG<br>GCCAAGAACTCAAAGAGGCAGCATTGGAACCATC<br>GATGGAAAAAAATATTTAAAATTGATCAGATGGGAA<br>GATGGTTTGTTGCTGGAGGGGCTGCTGTTGGTCTT<br>GGAGCATTGTGCTACTATGGCTTGGGACTGTCTAA<br>TGAGATTGGAGCTATTGAAAAGGCTGTAATTTGGC<br>CTCAGTATGTCAAGGATAGAATTCATTCCACCTATA<br>TGTACTTAGCAGGGAGTATGGTTTAACAGCTTTGT<br>CTGCCATAGCAATCAGCAGAACGCCTGTTCTCATG<br>AACTTCATGATGAGAGGCTCTTGGGTGACAATTG<br>TGTGACCTTTGCAGCCATGGTTGGAGCTGGAATGC<br>TGGTACGATCAATACCATATGACCAGAGCCCAGGC<br>CCAAAGCATCTTGCTTGGTTGCTACATTCTGGTGT<br>GATGGGTGCAGTGGTGGCTCCTCTGACAATATTAG<br>GGGGTCCTCTTCTCATCAGAGCTGCATGGTACACA | 2 | MV* |

TABLE 3A-continued

| SEQ ID | identifier_position | position | modified_RNA | PAP length | PAP |
|---|---|---|---|---|---|
| | | | GCTGGCATTGTGGGAGGCCTCTCCACTGTGGCCA TGTGTGCGCCCAGTGAAAAGTTTCTGAACATGGGT GCACCCCTGGGAGTGGGCCTGGGTCTCGTCTTTG TGTCCTCATTGGGATCTATGTTTCTTCCACCTACCA CCGTGGCTGGTGCCAC | | |
| 1853 | NM_0144 12.2_472 | 472 | GCGGTCAAATTATAATACATAAAAGTTGTCAGGGC GGAGAGCAAGACATTACTCTTCTCGGATTGCCGGT TCGCTCGCGAGACTTGAGCGTTGCTAGGAGATTC GGCAGGCGGGCGGAGCCAGACTCGGCGGGGCG GGGAGGGGTGGGGCTAGGCTCGGCGAGGCGAGG AAGGGTGGGTGGAGCCAGGCTTGGCGGGCTGTG CGTGCTCGCGGTGGGCGGTGGCGGCGGCTGCCT CGCGAAGGTTCGAGATCCGTCGCGTGCGGGAGG CGGGGCCGCGATCTTGCGCAGGGTCGGTGTGGGC GCAGGCTGCAGCGCCGCGACTCGTGCGGGTAGG CGTCTGCGCTCGGTTTGAGGGCTCGGCGCGGGGT TTCCTGTTCCTCCTTCTGCGCGGCTGCAGCTCGG GACTTCGGCCTGACCCAGCCCCCATGGCTTCAGA AGAGCTACAGAAAGATCTAGAAGAGGTAAAGGTGT GCTGGAAAAGGCTACTAGGAAAAGAGTACGTGAT GCCCTTACAGCTGAAAAATCCAAGATTGAGACAGA AATCAAGAACAAGATGCAACAGAAATCACAGAAGA AAGCAGAACTTCTTGATAATGAAAAACCAGCTGCT GTGGTTGCTCCCATTACAACGGGCTATACGGTGAA AATCAGTAATTATGGATGGGATCAGTCAGATAAGT TTGTGAAAATCTACATTACCTTAACTGGAGTTCATC AAGTTCCCACTGAGAATGTGCAGGTGCATTTCACA GAGAGGTCATTTGATCTTTTGGTAAAGAATCTAAAT GGGAAGAGTTACTCCATGATTGTGAACAATCTCTT GAAACCCATCTCTGTGGAAGGCAGTTCAAAAAAAG TCAAGACTGATACAGTTCTTATATTGTGTAGAAAGA AAGTGGAAAACACAAGGTGGGATTACCTGACCCA GGTTGAAAAGGAGTGCAAAGAAAAAGAGAAGCCC TCCTATGACACTGAAACAGATCCTAGTGAGGGATT GATGAATGTTCTAAAGAAAATTTATGAA | 57 | CWKRLLG KEWMPLQ LKNPRLRQ KSRTRCNR NHRRKQN FLIMKNQLL WLLPLQRA IR* |
| 1854 | NM_0144 12.2_683 | 683 | GCGGTCAAATTATAATACATAAAAGTTGTCAGGGC GGAGAGCAAGACATTACTCTTCTCGGATTGCCGGT TCGCTCGCGAGACTTGAGCGTTGCTAGGAGATTC GGCAGGCGGGCGGAGCCAGACTCGGCGGGGCG GGGAGGGGTGGGGCTAGGCTCGGCGAGGCGAGG AAGGGTGGGTGGAGCCAGGCTTGGCGGGCTGTG CGTGCTCGCGGTGGGCGGTGGCGGCGGCTGCCT CGCGAAGGTTCGAGATCCGTCGCGTGCGGGAGG CGGGGCCGCGATCTTGCGCAGGGTCGGTGTGGGC GCAGGCTGCAGCGCCGCGACTCGTGCGGGTAGG CGTCTGCGCTCGGTTTGAGGGCTCGGCGCGGGGT TTCCTGTTCCTCCTTCTGCGCGGCTGCAGCTCGG GACTTCGGCCTGACCCAGCCCCCATGGCTTCAGA AGAGCTACAGAAAGATCTAGAAGAGGTAAAGGTGT TGCTGGAAAAGGCTACTAGGAAAAGAGTACGTGAT GCCCTTACAGCTGAAAAATCCAAGATTGAGACAGA AATCAAGAACAAGATGCAACAGAAATCACAGAAGA AAGCAGAACTTCTTGATAATGAAAAACCAGCTGCT GTGGTTGCTCCCATTACAACGGGCTATACGGTGAA AATCAGTAATTATGGATGGGATCAGTCAGATAAGT TGTGAAAATCTACATTACCTTAACTGGAGTTCATCA AGTTCCCACTGAGAATGTGCAGGTGCATTTCACAG AGAGGTCATTTGATCTTTTGGTAAAGAATCTAAATG GAAGAGTTACTCCATGATTGTGAACAATCTCTTG AAACCCATCTCTGTGGAAGGCAGTTCAAAAAAAGT CAAGACTGATACAGTTCTTATATTGTGTAGAAAGAA AGTGGAAAACACAAGGTGGGATTACCTGACCCAG GTTGAAAAGGAGTGCAAAGAAAAAGAGAAGCCCT CCTATGACACTGAAACAGATCCTAGTGAGGGATTG ATGAATGTTCTAAAGAAAATTTATGAA | 1 | L* |
| 1855 | NM_0144 12.2_772 | 772 | GCGGTCAAATTATAATACATAAAAGTTGTCAGGGC GGAGAGCAAGACATTACTCTTCTCGGATTGCCGGT TCGCTCGCGAGACTTGAGCGTTGCTAGGAGATTC GGCAGGCGGGCGGAGCCAGACTCGGCGGGGCG GGGAGGGGTGGGGCTAGGCTCGGCGAGGCGAGG AAGGGTGGGTGGAGCCAGGCTTGGCGGGCTGTG CGTGCTCGCGGTGGGCGGTGGCGGCGGCTGCCT CGCGAAGGTTCGAGATCCGTCGCGTGCGGGAGG CGGGGCCGCGATCTTGCGCAGGGTCGGTGTGGGC GCAGGCTGCAGCGCCGCGACTCGTGCGGGTAGG CGTCTGCGCTCGGTTTGAGGGCTCGGCGCGGGGT TTCCTGTTCCTCCTTCTGCGCGGCTGCAGCTCGG | 1 | W* |

TABLE 3A-continued

| SEQ ID | identifier_position | position | modified_RNA | PAP length | PAP |
|---|---|---|---|---|---|
| | | | GACTTCGGCCTGACCCAGCCCCCATGGCTTCAGA<br>AGAGCTACAGAAAGATCTAGAAGAGGTAAAGGTGT<br>TGCTGGAAAAGGCTACTAGGAAAAGAGTACGTGAT<br>GCCCTTACAGCTGAAAAATCCAAGATTGAGACAGA<br>AATCAAGAACAAGATGCAACAGAAATCACAGAAGA<br>AAGCAGAACTTCTTGATAATGAAAAACCAGCTGCT<br>GTGGTTGCTCCCATTACAACGGGCTATACGGTGAA<br>AATCAGTAATTATGGATGGGATCAGTCAGATAAGT<br>TTGTGAAAATCTACATTACCTTAACTGGAGTTCATC<br>AAGTTCCCACTGAGAATGTGCAGGTGCATTTCACA<br>GAGAGGTCATTTGATCTTTGGTAAAGAATCTAAAT<br>GGGAAGAGTTACTCCATGATTGTGAACAATCTCTT<br>GAAACCCATCTCTGTGGAAGGCAGTTCAAAAAAAG<br>TCAAGACTGATACAGTTCTTATATTGTGTAGAAAGA<br>AAGTGGAAAACACAAGGTGGGATTACCTGACCCA<br>GGTTGAAAAGGAGTGCAAAGAAAAAGAGAAGCCC<br>TCCTATGACACTGAAACAGATCCTAGTGAGGGATT<br>GATGAATGTTCTAAAGAAAATTTATGAA | | |
| 1856 | NM_0144 37.3_1031 | 1031 | AGGAGAGTCAGGCCAATGGGGCCGCAGTTCTTTC<br>TTTTTTTTTTCTTTATTCTTATTTTTGGAGACAGGGT<br>CTCGCTCTGTTGCCCAGGCTGGAGTGCGGTGGTG<br>CGATCACGGTTCCATGCAGCCCCCGACCTCCCGG<br>GCTCAGGTGATTCTCCCGCCTCAGCACCGCGAGC<br>AGCTAGGACCACAGGCGCGAGCCACTGCGTCCG<br>GCCGGCGGGACTTATTTGTCAGGCGGGGATTGGG<br>TTCCGCCAGCCTAAAGGGAGGGGTAAGCGCCAGA<br>ATATGAATCGCCGGGAAGCTGGGAGAAAGCTCCG<br>GGAAACCCTGAGCAGCCAGGTCGCCTGCTCCGCC<br>CGCTCCCGCTCCCGATCTCTGATTGCTCCTAACTG<br>ACGTCACTCCCGGTCTGTCCCCGCCCACTCGGTG<br>CTGCCATTGGCAGTCGGTCGTGGGTCTGAGAGTC<br>ACTGGAGCTACCAGAAGCATCATGGGGCCCTGGG<br>GAGAGCCAGAGCTCCTGGTGTGGCGCCCCGAGG<br>CGGTAGCTTCAGAGCCTCCAGTGCCTGTGGGGCT<br>GGAGGTGAAGTTGGGGGCCCTGGTGCTGCTGCTG<br>GTGCTCACCCTCCTCTGCAGCCTGGTGCCCATCT<br>GTGTGCTGCGCCGGCCAGGAGCTAACCATGAAGG<br>CTCAGCTTCCCGCCAGAAAGCCCTGAGCCTAGTA<br>AGCTGTTTCGCGGGGGGCGTCTTTTTGGCCACTT<br>GTCTCCTGGACCTGCTGCCTGACTACCTGGCTGC<br>CATAGATGAGGCCCTGGCAGCCTTGCACGTGACG<br>CTCCAGTTCCCACTGCAAGAGTTCATCCTGGCCAT<br>GG GCTTCTTCCTG GTCCTG GTGATG GAG CAGATG<br>ACACTGGCTTACAAGGAGCAGTCAGGGCCGTCAC<br>CTCTGGAGGAAACAAGGGCTCTGCTGGGAACAGT<br>GAATGGTGGGCCGCAGCATTGGCATGATGGGCCA<br>GGGGTCCCACAGGCGAGTGGAGCCCCAGCAACC<br>CCCTCAGCCTTGCGTGCCTGTGTACTGGTGTTCTC<br>C | 9 | STPCSRG WR* |
| 1857 | NM_0144 37.3_959 | 959 | AGGAGAGTCAGGCCAATGGGGCCGCAGTTCTTTC<br>TTTTTTTTTTCTTTATTCTTATTTTTGGAGACAGGGT<br>CTCGCTCTGTTGCCCAGGCTGGAGTGCGGTGGTG<br>CGATCACGGTTCCATGCAGCCCCCGACCTCCCGG<br>GCTCAGGTGATTCTCCCGCCTCAGCACCGCGAGC<br>AGCTAGGACCACAGGCGCGAGCCACTGCGTCCG<br>GCCGGCGGGACTTATTTGTCAGGCGGGGATTGGG<br>TTCCGCCAGCCTAAAGGGAGGGGTAAGCGCCAGA<br>ATATGAATCGCCGGGAAGCTGGGAGAAAGCTCCG<br>GGAAACCCTGAGCAGCCAGGTCGCCTGCTCCGCC<br>CGCTCCCGCTCCCGATCTCTGATTGCTCCTAACTG<br>ACGTCACTCCCGGTCTGTCCCCGCCCACTCGGTG<br>CTGCCATTGGCAGTCGGTCGTGGGTCTGAGAGTC<br>ACTGGAGCTACCAGAAGCATCATGGGGCCCTGGG<br>GAGAGCCAGAGCTCCTGGTGTGGCGCCCCGAGG<br>CGGTAGCTTCAGAGCCTCCAGTGCCTGTGGGGCT<br>GGAGGTGAAGTTGGGGGCCCTGGTGCTGCTGCTG<br>GTGCTCACCCTCCTCTGCAGCCTGGTGCCCATCT<br>GTGTGCTGCGCCGGCCAGGAGCTAACCATGAAGG<br>CTCAGCTTCCCGCCAGAAAGCCCTGAGCCTAGTA<br>AGCTGTTTCGCGGGGGGCGTCTTTTTGGCCACTT<br>GTCTCCTGGACCTGCTGCCTGACTACCTGGCTGC<br>CATAGATGAGGCCCTGGCAGCCTTGCACGTGACG<br>CTCCAGTTCCCACTGCAAGAGTTCATCCTGGCCAT<br>GGGCTTCTTCCTGGTCCTGGTGATGGAGCAGATC<br>ACACTGGCTTACAAGGAGCAGTCAGGGCCGTCAC<br>CTCTGGAGGAAACAAGGGCTCTGCTGGGAACAGT<br>GAATGGTGGGCCGCAGCATTGGCATGATGGGCCA | 33 | SHRRVEP QQPPQPC VPVYWCS PWPSTPC SRGWR* |

TABLE 3A-continued

| SEQ ID | identifier_position | position | modified_RNA | PAP length | PAP |
|---|---|---|---|---|---|
| | | | GGGTCCCACAGGCGAGTGGAGCCCCAGCAACCC CCTCAGCCTTGCGTGCCTGTGTACTGGTGTTCTCC C | | |
| 1858 | NM_0145 51.4_307 | 307 | GCGCCTACGCATTTTCCTGGGCGGGAACAGCAAA ATGGCGCCAGAACTAGTGGCGGGCTGAGGACGC CGTACCCCTCGGAAGGCAGCCCTGCGGTCCCTTT GCCGCCCGTTCCCTCCCGGACATGGAGGACGTGG AGGCGCGCTTCGCCCACCTCTTGCAGCCCATCCG CGACCTCACCAAGAACTGGGAGGTGGACGTGGCG GCCCAGCTGGGCGAGTATCTGGAGGAGCTGGATC AGATCTGCATTTCTTTTGACGAAGGCAAGACCACA ATGAACTTCATTGAGGCAGCGTTGTTGATCCAGGC TCTGCCTGCGTCTACAGTAAGAAGGTGGAATACCT CTACTCACTCGTCTACCAGGCCCTTGATTTCATCT CTGGAAAGAGGCGGGCCAAGCAGCTCTCTTCGGT GCAGGAGGACAGGGCCAATGGGGTTGCCAGCTC CGGGGTCCCCCAGGAGGCAGAGAATGAGTTCCTG TCGCTGGATGACTTCCCTGACTCCCGGACTAACGT GGATCTCAAGAATGATCAGACGCCCAGTGAGGTC CTCATCATCCCCTCCTGCCCATGGCCCTGGTGG CCCCTGATGAAATGGAGAAGAACAACAATCCCCTG TACAGCCGTCAGGGTGAGGTCCTGGCCAGCCGGA AGGATTTCAGGATGAACACGTGCGTTCCCCACCC CAGAGGGGCCTTCATGTTGGAGCCAGAGGGCATG TCCCCCATGGAACCAGCGGGCGTTTCCCCCATGC CAGGGACCCAGAAGGACACCGGGAGGACTGAGG AGCAGCCAATGGAAGTTTCCGTGTGCAGGAGCCC TGTCCCAGCACTCGGCTTCTCCCAGGAGCCAGGC CCCTCTCCAGAAGGCCCGATGCCCCTGGGTGGGG GCGAGGACGAGGATGCAGAGGAGGCAGTAGAGC TTCCTGAGGCCTCGGCCCCCAAGGCCGCTCTGGA GCCCAAGGAGTCCAGGAGCCCGCAGCAGGTGGG ACCCACATGGAGGCCTGCAGAACCTGAGCTGTGA ACT | 119 | ALPASTVR RWNTSTH SSTRPLISS LERGGPSS SLRCRRTG PMGLPAP GSPRRQR MSSCRWM TSLTPGLT WISRMIRR PVRSSSSP SCPWPWW PLMKWRR TTIPCTAVR VRSWPAG RISG* |
| 1859 | NM_0146 23.2_530 | 530 | ACCGGCGCCGGGATTCGGATGGGGCGGGTGGG GGACGCTGCAGCTGGGGCCATTTGAGGGGAGCC CATGGGGCCTGAAAGGCATCTGTCAGGCGCCCCT GCCCGGATGGCAACAGTAGTTCTAGGAGGAGACA CCATGGGCCTGAGCGTATCTTCCCCAATCAGACT GAGGAACTGGGACATCAGGGCCCTTCAGAAGGCA CTGGGGATTGGAGCAGTGAGGAGCCTGAGGAAGA GCAGGAGGAAACGGGGTCGGGCCCAGCTGGCTA CTCCTACCAGCCCCTGAACCAAGATCCTGAACAAG AGGAGGTGGAACTGGCACCAGTGGGGGATGGAG ATGTAGTTGCTGACATCCAGGATCGAATCCAGGCC CTGGGGCTTCATTTGCCAGACCCACCATTAGAGAG TGAAGATGAAGATGAGGAGGGAGCTACAGCGTTG AACAACCACAGCTCTATTCCCATGGACCCAGAACA TGTAGAGCTGGTGAAAAGGACAATGGCTGGAGTA AGCCTGCCTGCGCCAGGGTTCCTGCCTGGGCTCG GGAGATATCGGATGCCCAGTGGGAAGATGTGGTA CAGAAAGCCCTCCAAGCCCGGCAGGCATCCCCTG CCTGGAAGTGACCACAGTGAGAGCTGCCTTATATT CCTACATTCCAGGCCAGAACCAGCACAGGACTGA ACACATCCCTGGTTGTAATGTCCATTTCCATCTTCC CCGTCTCCCTTTCCACATCAAGGCACATCAGACTT CTCAGAGACCCACTTTATTCAGTTCTGTACATATGG GGACATCGGTCCAAGCCCAACCCACCTTAGCATG TATCACTCTGTGGAGAATAAAGCACCCTATGTACA CAGCCAAAA | 50 | FLPGLGRY RMPSGKM WYRKPSK PGRHPLPG SDHSESCL IFLHSRPEP AQD* |
| 1860 | NM_0146 70.2_158 | 158 | AGGAGACACCGCCGCAGTTGCCGGTACATCGGGG ATTTCTGGCTCTTTCCTCTTCGCCTTAAATTCGGGT GTCTTTTATGAATAATCAAAAGCAGCAAAAGCCAA CGCTATCAGGCCAGCGTTTTAAAACTAGAAAAAGA GATGAAAAAGAGAGGTTGACCCTACTCAGTTTCAA GACTGTATTATTCAAGGCTTAACTGAAACCGGTAC TGATTTGGAAGCAGTAGCTAAGTTTCTTGATGCTTC TGGAGCAAAACTTGATTACCGTCGATATGCAGAAA CACTCTTTGACATTCTGGTGGCTGGTGGAATGCTG GCCCCAGGTGGTACACTGGCAGATGACATGATGC GTACAGATGTCTGCGTGTTTGCAGCCCAAGAAGAT CTAGAGACCATGCAAGCATTTGCTCAGGTTTTTAA CAAGTTAATCAGGCGCTACAAATACCTGGAGAAAG GTTTTGAAGATGAAGTAAAAAAGCTGCTGCTGTTC TTGAAGGGTTTTTCAGAGTCGGAGAGGAACAAGCT AGCTATGTTGACTGGTGTTCTTCTGGCTAATGGAA CACTTAATGCATCCATTCTTAATAGCCTTTATAATG | 13 | LTLLSFKTV LFKA* |

TABLE 3A-continued

| SEQ ID | identifier_position | position | modified_RNA | PAP length | PAP |
|---|---|---|---|---|---|
| | | | AAAATTTGGTTAAAGAAGGAGTTTCAGCAGCTTTT<br>GCTGTGAAGCTCTTTAAATCATGGATAAATGAAAAA<br>GATATCAATGCAGTAGCTGCAAGTCTTCGGAAAGT<br>CAGCATGGATAACAGACTGATGGAACTCTTTCCTG<br>CCAATAAGCAAAGTGTTGAACACTTCACAAAATATT<br>TTACTGAGGCAGGCTTGAAAGAGCTTTCAGAATAT<br>GTTCGGAATCAGCAAACCATCGGAGCTCGTAAGG<br>AGCTCCAGAAAGAACTTCAAGAACAGATGTCCCGT<br>GGTGATCCATTTAAGGATATAATTTTATATGTCAAG<br>GAGGAGATGAAAAAAAACAACATTCATTTCATGAA<br>AGCCTTCCAGAAAATAGTGGTGCTTTTTTATAAAGC<br>TGAAGTCCTGAGCGAGGAGCCCATTTTGAAGTGG<br>TATAAA | | |
| 1861 | NM_014670.2_461 | 461 | AGGAGACACCGCCGCAGTTGCCGGTACATCGGGG<br>ATTTCTGGCTCTTTCCTCTTCGCCTTAAATTCGGGT<br>GTCTTTTATGAATAATCAAAAGCAGCAAAAGCCAA<br>CGCTATCAGGCCAGCGTTTTAAAACTAGAAAAAGA<br>GATGAAAAAGAGAGGTTTGACCCTACTCAGTTTCA<br>AGACTGTATTATTCAAGGCTTAACTGAAACCGGTA<br>CTGATTTGGAAGCAGTAGCTAAGTTTCTTGATGCTT<br>CTGGAGCAAAACTTGATTACCGTCGATATGCAGAA<br>ACACTCTTTGACATTCTGGTGGCTGGTGGAATGCT<br>GGCCCCAGGTGGTACACTGGCAGATGACATGATG<br>CGTACAGATGTCTGCGTGTTTGCAGCCCAAGAAGA<br>TCTAGAGACCATGCAAGCATTTGCTCAGGTTTTTAA<br>CAAGTTAATCAGGCGCTACAAATACCTGGAGAAAG<br>GTTTGAAGATGAAGTAAAAAAGCTGCTGCTGTTCT<br>TGAAGGGTTTTTCAGAGTCGGAGAGGAACAAGCTA<br>GCTATGTTGACTGGTGTTCTTCTGGCTAATGGAAC<br>ACTTAATGCATCCATTCTTAATAGCCTTTATAATGA<br>AAATTTGGTTAAAGAAGGAGTTTCAGCAGCTTTTG<br>CTGTGAAGCTCTTTAAATCATGGATAAATGAAAAAG<br>ATATCAATGCAGTAGCTGCAAGTCTTCGGAAAGTC<br>AGCATGGATAACAGACTGATGGAACTCTTTCCTGC<br>CAATAAGCAAAGTGTTGAACACTTCACAAAATATTT<br>TACTGAGGCAGGCTTGAAAGAGCTTTCAGAATATG<br>TTCGGAATCAGCAAACCATCGGAGCTCGTAAGGA<br>GCTCCAGAAAGAACTTCAAGAACAGATGTCCCGTG<br>GTGATCCATTTAAGGATATAATTTTATATGTCAAGG<br>AGGAGATGAAAAAAAACAACATTCATTTCATGAAA<br>GCCTTCCAGAAAATAGTGGTGCTTTTTTATAAAGCT<br>GAAGTCCTGAGCGAGGAGCCCATTTTGAAGTGGT<br>ATAAA | 4 | LKMK* |
| 1862 | NM_014673.3_440 | 440 | GCCCTCTCACCCCGCTGCCTCTAGGTTCTGGGAA<br>GATGGCGAAGGTCTCAGAGCTTTACGATGTCACTT<br>GGGAAGAAATGAGAGATAAAATGAGAAAATGGAGA<br>GAAGAAAACTCAAGAAATAGTGAGCAAATTGTGGA<br>AGTTGGAGAAGAATTAATTAATGAATATGCTTCTAA<br>GCTGGGAGATGATATTTGGATCATATATGAACAGG<br>TGATGATTGCAGCACTAGACTATGGTCGGGATGAC<br>TTGGCATTGTTTTGTCTTCAAGAGCTGAGAAGACA<br>GTTCCCTGGCAGTCACAGAGTCAAGCGATTAACAG<br>GCATGAGATTTGAAGCCATGGAAAGATATGATGAT<br>GCTATACAGCTATATGATAGGATTTTACAAGAAGAT<br>CCAACTAACACTGCTGCAAGAAAGCGTAAGATTGC<br>CATTCGAAAAGCCCAGGGAAAAATGTGGAGGCCA<br>TTCGGGAGCTGAATGAGTATCTGGAACAATTTGTT<br>GGAGACCAAGAAGCCTGGCATGAACTTGCAGAAC<br>TTTACATCAATGAACATGACTATGCAAAAGCAGCC<br>TTTTGTTTAGAGGAACTAATGATGACTAATCCACAC<br>AACCACTTATACTGTCAGCAGTATGCTGAAGTTAA<br>GTATACCCAAGGTGGACTTGAAAACCTCGAACTTT<br>CAAGAAAGTATTTTGCACAGGCATTGAAACTGAAC<br>AACAGAAATATGAGAGCTTTGTTTGGACTTTATATG<br>TCGGCAAGTCATATTGCTTCTAATCCAAAAGCAAG<br>TGCAAAAACGAAAAAGGACAACATGAAATATGCTA<br>GTTGGGCAGCTAGTCAAATAAACAGAGCTTATCAG<br>TTTGCAGGTCGAAGTAAGAAGGAAACCAAATATTC<br>TCTTAAGGCTGTCGAAGACATGTTGGAAACATTGC<br>AGATCACCCAGTCTTAAGGTTTCAAAAACTCTTTGA<br>CATTAGATTTCACAACTGCACAATTGAACTTATTGG<br>CCTGTAACTTATTTACTAAATGCTCAGTGCTATTTA<br>TATAC | 7 | MWRPFGS* |
| 1863 | NM_014713.3_629 | 629 | GCGCTCAGTGCGCAGGCGCGAAGAAGCTGGCAG<br>GGGCACGAGCCGGGGCGGGTTTGAAGACGCGT<br>CGTTGGGTTTTGGAGGCCGTGAAACAGCCGTTTG<br>AGTTTGGCTGCGGGTGGAGAACGTTTGTCAGGGG | 23 | WTPAASC<br>SLFLCSLP<br>YSSFLRLI* |

TABLE 3A-continued

| SEQ ID | identifier_position | position | modified_RNA | PAP length | PAP |
|---|---|---|---|---|---|
| | | | CCCGGCCAAGAAGGAGGCCCGCCTGTTACGATGG<br>TGTCCATGAGTTTCAAGCGGAACCGCAGTGACCG<br>GTTCTACAGCACCCGGTGCTGCGGCTGTTGCCAT<br>GTCCGCACCGGGACGATCATCCTGGGGACCTGGT<br>ACATGGTAGTAAACCTATTGATGGCAATTTTGCTG<br>ACTGTGGAAGTGACTCATCCAAACTCCATGCCAGC<br>TGTCAACATTCAGTATGAAGTCATCGGTAATTACTA<br>TTCGTCTGAGAGAATGGCTGATAATGCCTGTGTTC<br>TTTTTGCCGTCTCTGTTCTTATGTTTATAATCAGTTC<br>AATGCTGGTTTATGGAGCAATTTCTTATCAAGTGG<br>GTTGGCTGATTCCATTCTTCTGTTACCGACTTTTTG<br>ACTTCGTCCTCAGTTGCCTGGTTGCTATTAGTTCTC<br>TCACCTATTTGCCAAGAATCAAAGAATATCTGGATC<br>AACTACCTGATTTTCCCTACAAAGATGACCTCCTG<br>GCTTGGACTCCAGCTGCCTCCTGTTCATTGTTCTT<br>GTGTTCTTTGCCTTATTCATCATTTTTAAGGCTTAT<br>CTAATTAACTGTGTTTGGAACTGCTATAAATACATC<br>AACAACCGAAACGTGCCGGAGATTGCTGTGTACC<br>CTGCCTTTGAAGCACCTCCTCAGTACGTTTTGCCA<br>ACCTATGAAATGGCCGTGAAAATGCCTGAAAAAGA<br>ACCACCACCTCCTTACTTACCTGCCTGAAGAAATT<br>CTGCCTTTGACAATAAATCCTATACCAGCTTTTTGT<br>TTGTTTATGTTACAGAATGCTGCAATTCAGGGCTCT<br>TCAAACTTGTTTGATATAAAATATGTTGTCTTTTGTT<br>TAAGCATTTATTTTCAAACACTAAGGAGCTTTTTGA<br>CATCTGT | | |
| 1864 | NM_0147<br>13.3_758 | 758 | GCGCTCAGTGCGCAGGCGCGAAGAAGCTGGCAG<br>GGGCACGAGCCGGGGCGGGTTTGAAGACGCGT<br>CGTTGGGTTTTGGAGGCCGTGAAACAGCCGTTTG<br>AGTTTGGCTGCGGGTGGAGAACGTTTGTCAGGGG<br>CCCGGCCAAGAAGGAGGCCCGCCTGTTACGATGG<br>TGTCCATGAGTTTCAAGCGGAACCGCAGTGACCG<br>GTTCTACAGCACCCGGTGCTGCGGCTGTTGCCAT<br>GTCCGCACCGGGACGATCATCCTGGGGACCTGGT<br>ACATGGTAGTAAACCTATTGATGGCAATTTTGCTG<br>ACTGTGGAAGTGACTCATCCAAACTCCATGCCAGC<br>TGTCAACATTCAGTATGAAGTCATCGGTAATTACTA<br>TTCGTCTGAGAGAATGGCTGATAATGCCTGTGTTC<br>TTTTTGCCGTCTCTGTTCTTATGTTTATAATCAGTTC<br>AATGCTGGTTTATGGAGCAATTTCTTATCAAGTGG<br>GTTGGCTGATTCCATTCTTCTGTTACCGACTTTTTG<br>ACTTCGTCCTCAGTTGCCTGGTTGCTATTAGTTCTC<br>TCACCTATTTGCCAAGAATCAAAGAATATCTGGATC<br>AACTACCTGATTTTCCCTACAAAGATGACCTCCTG<br>GCCTTGGACTCCAGCTGCCTCCTGTTCATTGTTCT<br>TGTGTTCTTTGCCTTATTCATCATTTTTAAGGCTTAT<br>CTAATTAACTGTGTTTGGAACTGCTATAAATACATC<br>AACAACCGAAACGTGCCGGAGATGCTGTGTACCC<br>TGCCTTTGAAGCACCTCCTCAGTACGTTTTGCCAA<br>CCTATGAAATGGCCGTGAAAATGCCTGAAAAAGAA<br>CCACCACCTCCTTACTTACCTGCCTGAAGAAATTC<br>TGCCTTTGACAATAAATCCTATACCAGCTTTTTGTT<br>TGTTTATGTTACAGAATGCTGCAATTCAGGGCTCTT<br>CAAACTTGTTTGATATAAAATATGTTGTCTTTTGTTT<br>AAGCATTTATTTTCAAACACTAAGGAGCTTTTTGAC<br>ATCTGT | 21 | MLCTLPLK<br>HLLSTFCQ<br>PMKWP* |
| 1865 | NM_0147<br>36.4_327 | 327 | GAGAGACCTTGGAGCGCGCGGGAAAGAGACCAAT<br>ATAAACTGTGGCGGGATAGTTTTCGGGTCCTTGTC<br>CAGTGAAACACCCTCGGCTGGGAAGTCAGTTCGT<br>TCTCTCCTCTCCTCTCTTCTTGTTTGAACATGGTGC<br>GGACTAAAGCAGACAGTGTTCCAGGCACTTACAGA<br>AAAGTGGTGGCTGCTCGAGCCCCCAGAAAGGTGC<br>TTGGTTCTTCCACCTCTGCCACTAATTCGACATCA<br>GTTTCATCGAGGAAAGCTGAAAATAAATATGCAGG<br>AGGGAACCCCGTTTGCGTGCGCCCAACTCCCAAG<br>TGGCAAAAAGGAATGGAGAATTCTTTAGGTTGTCC<br>CCTAAAGATTCTGAAAAAGAGAATCAGATTCCTGA<br>AGAGGCAGGAAGCAGTGGCTTAGGAAAAGCAAAG<br>AGAAAAGCATGTCCTTTGCAACCTGATCACACAAA<br>TGATGAAAAAGAATAGAACTTTCTCATTCATCTTTG<br>AATAACGTCTCCTTGTTTACCCTGGTATTCTAGAAT<br>GTAAATTTACATAAATGTGTTTGTTCCAATTAGCTTT<br>GTTGAACAGGCATTTAATTAAAAAAATTTAGGTTTAA<br>ATTTAGATGTTCAAAAGTAGTTGTGAAATTTGAGAA<br>TTTGTAAGACTAATTATGGTAACTTAGCTTAGTATT<br>CAAATATAATGCATTGTTTGGTTTCTTTTACCAAATTA<br>AGTGTCTAGTTCTTGCTAAAATCAAGTCATTGCATT | 26 | MENSLGC<br>PLKILKKRI<br>RFLKRQEA<br>VA* |

TABLE 3A-continued

| SEQ ID | identifier_position | position | modified_RNA | PAP length | PAP |
|---|---|---|---|---|---|
| | | | GTGTTCTAATTACAAGTATGTTGTATTTGAGATTTG<br>CTTAGATTGTTGTACTGCTGCCATTTTTATTGGTGT<br>TTGATTATTGGAATGGTGCCATATTGTCACTCCTTC<br>TACTTGCTTTAAAAAGCAGAGTTAGATTTTTGCACA<br>TTAAAAAATTCAGTATTAATTAAACATTACTTATTCT<br>ACCCTCTTTTTTGGCAAGGAGGACAAATACGCAAT<br>GTTGGAAAACCTTGGATGGATATCTTCTCTTTAAAA<br>AAATGTAAAGATAATTTGGTCTTGAGGGTTT | | |
| 1866 | NM_0147<br>48.2_747 | 747 | CCCTATCCGGACAGGTGGCTCTTGCCCTTTAGACT<br>ACAGTTCCCAGCATGCCCAGGCGATTGCGTCCCA<br>GAACCGACGTCCCACCGCCTTCCCACATCGGATC<br>GCAGGGCTCCCAAAATGGCGAGTGAGGCTGCGG<br>GGACTCGCTGAGCAGCGGAGGGGGAGCGTGCAG<br>AGCCGCTGCGGCCCTCACAGTCCGGAGCCCGGC<br>CGTGCCGTGCCGTAGGGAACATGCACTTTTCCATT<br>CCCGAAACCGAGTCCCGCAGCGGGGACAGCGGC<br>GGCTCCGCCTACGTGGCCTATAACATTCACGTGAA<br>TGGAGTCCTGCACTGTCGGGTGCGCTACAGCCAG<br>CTCCTGGGGCTGCACGAGCAGCTTCGGAAGGAGT<br>ATGGGGCCAATGTGCTTCCTGCATTCCCCCCAAAG<br>AAGCTTTTCTCTGACTCCTGCTGAGGTAGAACA<br>GAGGAGAGAGCAGTTAGAGAAGTACATGCAAGCT<br>GTTCGGCAAGACCCATTGCTTGGGAGCAGCGAGA<br>CTTTCAACAGTTTCCTGCGTCGGGCACAACAGGAG<br>ACACAGCAGGTCCCCACAGAGGAAGTGTCCTTGG<br>AAGTGCTGCTCAGCAACGGGCAGAAAGTTCTGGT<br>CAACGTGCTAACTTCAGATCAGACTGAGGATGTCC<br>TGGAGGCTGTAGCTGCAAAGCTGGATCTTCCAGAT<br>GACTTGATTGGATACTTTAGTCTATTCTTAGTTCGA<br>GAAAAAGAGGATGGAGCCTTTTCTTTGTACGGAAG<br>TTGCAAGAGTTTGAGCTGCCTTATGTGTCTGTCAC<br>CAGCCTTCGGAGTCAAGAGTATAAGATTGTGCTAA<br>GGAAGAGTTATTGGGACTCTGCCTATGATGACGAT<br>GTCATGGAGAACCGGGTTGGCCTGAACCTGCTTTA<br>TGCTCAGACGGTATCAGATATTGAGCGTGGGTGG<br>ATCTTGGTCACCAAGGAACAGCACCGGCAACTCAA<br>ATCTCTGCAAGAGAAAGTCTCCAAGAAGGAGTTCC<br>TGAGACTGGCCCAGACGCTGCGGCA | 26 | LYGSCKSL<br>SCLMCLSP<br>AFGVKSIR<br>LC* |
| 1867 | NM_0147<br>52.1_364 | 364 | GGCGGCGGCAGCTGTACAGGGCGGGAGAAGCGG<br>TGGTAGCGGAGGCTGTAGTGGGGCTGGTGGTGCT<br>TCCAACTGCGGGACAGGAAGTGGCCGTAGCGGCT<br>TGTTGGATAAGTGGAAGATAGATGATAAGCCTGTA<br>AAAATTGACAAGTGGGATGGATCAGCTGTGAAAAA<br>CTCTTTGGATGATTCTGCCAAAAAGGTACTTCTGG<br>AAAAAATACAAATATGTGGAGAATTTTGGTCTAATTG<br>ATGGTCGCCTCACCATCTGTACAATCTCCTGTTTCT<br>TTGCCATAGTGGCTTTGATTTGGGATTATATGCAC<br>CCCTTTCCAGAGTCCAAACCCGTTTTGGCTTTGTG<br>TGTCATATCCTATTTGTGATGATGGGGATTCTGAC<br>CATTTATACCTCATATAAGGAGAAGAGCATCTTTCT<br>CGTGGCCCACAGGAAAGATCCTACAGGAATGGAT<br>CCTGATGATATTTGGCAGCTGTCCTCCAGTCTTAA<br>AAGGTTTGATGACAAATACACCTTGAAGCTGACCT<br>TCATCAGTGGGAGAACAAAGCAGCAGCGGGAAGC<br>CGAGTTCACAAAGTCCATTGCTAAGTTTTTTGACCA<br>CAGTGGGACACTGGTCATGGATGCATATGAGCCT<br>GAAATATCCAGGCTCCATGACAGTCTTGCCATAGA<br>AAGAAAAATAAAGTAGCCAATTCTAAAAGTAGCCC<br>TCTTTCTCCTGGATCTTGCTGAATTAGTGGCTTGG<br>GGGGTGGGGGAGATAAAAAGAACTTAAAATGGGT<br>AAAGTAAGAAATGTTAAAAAGTCCCTGTTTTGTCCT<br>GAAATTTTAGTCTATTCTGGGTAAATAGGATTTTCT<br>GACACAGATATGAGAAGTTGTAGCTCTGATGTCTA<br>GCTGTAGTCTCCTTGATCTGCTGATTGCATTATTTT<br>AATTTGCTTTTCTGGGAAAGCAGTTTTGCTAAAAGC<br>TGTACAGACTTTTTCTTTTGTACCTAGCAGTACTTT<br>ATATAGTATAGCTTTGGGCCATGTAGCATTTTAAGA<br>CTCAATT | 1 | L* |
| 1868 | NM_0147<br>61.2_136 | 136 | GAACCCTGAAGTCGGTGTCTGCTGCGTTCACGGC<br>AGGATTCGGTTAGGAGGAACAGCACAGCATGCTG<br>GGCTCTGGATTTAAAGCTGAGCGCTTAAGAGTGAA<br>TTTGAGATTAGTCATAAATCGCCTTAAACTATGGAG<br>AAAAAGAAAACGGAACTGGCCCAGAAAGCAAGGA<br>AGGAGATTGCTGACTATCTGGCTGCTGGGAAAGAT<br>GAACGAGCTCGGATCCGTGTGGAGCACATTATCC<br>GGGAAGACTACCTCGTGGAGGCCATGGAGATCCT<br>GGAGCTGTACTGTGACCTGCTGCTGGCTCGGTTT | 64 | WRKRKRN<br>WPRKQGR<br>RLLTIWLLG<br>KMNELGSV<br>WSTLSGKT<br>TSWRPWR<br>SWSCTVT<br>CCWLGLAL<br>SSL* |

TABLE 3A-continued

| SEQ ID | identifier_position | position | modified_RNA | PAP length | PAP |
|---|---|---|---|---|---|
| | | | GGCCTTATCCAGTCTATGAAGGAACTAGATTCTGG<br>TCTGGCTGAATCTGTGTCTACATTGATCTGGGCTG<br>CTCCTCGACTCCAGTCAGAAGTGGCTGAGTTGAAA<br>ATAGTTGCTGATCAGCTCTGTGCCAAGTATAGCAA<br>GGAATATGGCAAGCTATGTAGGACCAACCAGATTG<br>GAACTGTGAATGACAGGCTAATGCACAAGCTGAGT<br>GTGGAAGCCCCACCCAAAATCCTGGTGGAGAGAT<br>ACCTGATTGAAATTGCAAAGAATTACAACGTACCC<br>TATGAACCTGACTCTGTGGTCATGGCAGAAGCTCC<br>TCCTGGGGTAGAGACAGATCTTATTGATGTTGGAT<br>TCACAGATGATGTGAAGAAAGGAGGCCCTGGAAG<br>AGGAGGGAGTGGTGGCTTCACAGCACCAGTTGGT<br>GGACCTGATGGAACGGTGCCAATGCCCATGCCCA<br>TGCCCATGCCTATGCCATCTGCAAATACGCCTTTC<br>TCATATCCACTGCCAAAGGGACCATCAGATTTCAA<br>TGGACTGCCAATGGGGACTTATCAGGCCTTTCCCA<br>ATATTCATCCACCTCAGATACCAGCAACTCCCCCA<br>TCGTATGAATCTATGACATTAATGCTGATAAGAATA<br>TCTCTTCTGCACAGATTGTTGGTCCTGGACCCAAG<br>CCAGAAGCCTCTGCAAAGCTTCCTTCCAGACCTGC<br>AGATAACTATGACAACT | | |
| 1869 | NM_0150<br>04.2_157 | 157 | GGCAGCATGGCCGTCCGTGACGCTGAGCGAGGCG<br>GAGAAGGTGTACATCGTGCATGGCGTCCAGGAAG<br>ACCTCCGTGTGGATGGCCGTGGCTGTGAGGACTA<br>CCGATGTGTCGAAGTGGAAACTGATGTGGTGTCC<br>AACACTAGTGGGTCCGCCAGGTCAAGCTGGGTCA<br>CACAGACATCTTGGTGGGAGTGAAAGCAGAAATG<br>GGGACGCCGAAGCTGGAGAAACCAAATGAAGGCT<br>ACTTGGAGTTCTTTGTTGACTGTTCAGCCAGTGCT<br>ACCCCTGAATTTGAAGGTAGAGGAGGTGATGACCT<br>TGGCACCGAGATCGCTAACACCCTCTATCGGATAT<br>TTAACAATAAAAGCAGTGTCGACTTAAAGACCCTC<br>TGCATTAGTCCTCGGGAGCACTGCTGGGTTCTCTA<br>TGTGGATGTGCTGCTTCTGGAATGTGGTGGAAATT<br>TGTTTGATGCCATTTCCATTGCTGTAAAGGCTGCT<br>CTCTTCAATACAAGGATACCAAGGGTTCGAGTTTT<br>GGAGGATGAAGAGGGGTCGAAGGACATTGAATTG<br>TCAGATGACCCTTATGACTGCATACGACTAAGTGT<br>GGAGAATGTCCCCTGCATTGTCACTCTGTGCAAGA<br>TTGGCTATCGGCATGTGGTGGATGCTACTCTTCAG<br>GAGGAGGCCTGCTCGCTGGCCAGCTTGCTGGTGT<br>CGGTGACCAGCAAGGGAGTTGTGACGTGCATGAG<br>GAAAGTGGGGAAGGGCAGCCTGGACCCAGAGAG<br>CATCTTCGAGATGATGGAGACTGGCAAGCGTGTG<br>GGCAAGGTACTGCATGCCTCCTTGCAGAGTGTTCT<br>GCACAAGGAAGAAAGCCTGGGGCCCAAGAGACAG<br>AAAGTTGGATTCCTGGGATGATTTGCACATCAACT<br>GCTCAACTGTGGATTGTTTTTACTTTTCCTTTTAAA<br>CCGGTTCGTATATATTTTTCTTCGCTGTTACGAATT<br>TACAGCAGCATTTGTACATGTAAAATTAAAGGCTAT<br>TTTCTGGTAAAAAAAAAAAAA | 11 | SSWVTQT<br>SWWE* |
| 1870 | NM_0153<br>80.3_214 | 214 | CGGGGAATCATGGCCGCCCCAGTGTTCCGCGTC<br>CGGGGGTTTGTGGGAGTTGCCTTGACCTGCAGCT<br>CCGCCACCGCGGACCCGCCTTCTGCCCTCAGCAG<br>CAGACGCTCTGTCCCGCCCGGGCAGCTCTGCGAG<br>GCAGCGGCTGGAGAGGGAACCATGGGGACTGTG<br>CACGCCCGGAGTTTGGAGCCTCTTCCATCAAGTG<br>GACCTGATTTGGAGGATTAGGAGAAGAAGCTGAAT<br>TTGTTGAAGTTGAGCCTGAAGCTAAACAGGAAATT<br>CTTGAAAACAAAGATGTGGTTGTTCAACATGTTCAT<br>TTTGATGGACTTGGAAGGACTAAAGATGATATCAT<br>CATTTGTGAAATTGGAGATGTTTTCAAGGCCAAAA<br>ACCTAATTGAGGTAATGCGGAAATCTCATGAAGCC<br>CGTGAAAAATTGCTCCGTCTTGGAATTTTTAGACAA<br>GTGGATGTTTTGATTGACACATGTCAAGGTGATGA<br>CGCACTTCCAAATGGGTTAGACGTTACCTTTGAAG<br>TAACTGAATTGAGGAGATTAACGGGCAGTTATAAC<br>ACCATGGTTGGAAACAATGAAGGCAGTATGGTACT<br>TGGCCTCAAGCTTCCTAATCTTCTTGGTCGTGCAG<br>AAAAGGTGACCTTTCAGTTTTCCTATGGAACAAAA<br>GAAACTTCGTATGGCCTGTCCTTCTTCAAACCACG<br>GCCCGGAAACTTCGAAAGAAATTTCTCTGTAAACT<br>TATATAAAGTTACTGGACAGTTCCCTTGGAGCTCA<br>CTGCGGGAGACGGACAGAGGAATGTCAGCTGAGT<br>ACAGTTTTCCCATATGGAAGACCAGCCACACTGTC<br>AAGTGGGAAGGCGTATGGCGAGAACTGGGCTGCC<br>TCTCAAGGACGGCGTCATTTGCTGTTCGAAAAGAA | 3 | LED* |

TABLE 3A-continued

| SEQ ID | identifier_ position | position | modified_RNA | PAP length | PAP |
|---|---|---|---|---|---|
| | | | AGCGGACATTCACTGAAATCATCTCTTTCGCACGC CATGGTCATCGATTCTCGGAATTCTTCCATCTTACC AAGGAGAGGTGCTTTGCTGAAAGTTAACCAGGAAC TGGCAGGCTACACTG | | |
| 1871 | NM_0153 80.3_462 | 462 | CGGGGAATCATGGCCGCCCCCAGTGTTCCGCGTC CGGGGGTTTGTGGGAGTTGCCTTGACCTGCAGCT CCGCCACCGCGGACCCGCCTTCTGCCCTCAGCAG CAGACGCTCTGTCCCGCCCGGGCAGCTCTGCGAG GCAGCGGCTGGAGAGGGAACCATGGGGACTGTG CACGCCCGGAGTTTGGAGCCTCTTCCATCAAGTG GACCTGATTTTGGAGGATTAGGAGAAGAAGCTGAA TTTGTTGAAGTTGAGCCTGAAGCTAAACAGGAAAT TCTTGAAAACAAAGATGTGGTTGTTCAACATGTTCA TTTTGATGGACTTGGAAGGACTAAAGATGATATCA TCATTTGTGAAATTGGAGATGTTTTCAAGGCCAAAA ACCTAATTGAGGTAATGCGGAAATCTCATGAAGCC CGTGAAAAATTGCTCCGTCTTGGAATTTTTAGACAA GTGGATGTTTGATTGACACATGTCAAGGTGATGAC GCACTTCCAAATGGGTTAGACGTTACCTTTGAAGT AACTGAATTGAGGAGATTAACGGGCAGTTATAACA CCATGGTTGGAAACAATGAAGGCAGTATGGTACTT GGCCTCAAGCTTCCTAATCTTCTTGGTCGTGCAGA AAAGGTGACCTTTCAGTTTTCCTATGGAACAAAAG AAACTTCGTATGGCCTGTCCTTCTTCAAACCACGG CCCCGGAAACTTCGAAAGAAATTTCTCTGTAAACTTA TATAAAGTTACTGGACAGTTCCCTTGGAGCTCACT GCGGGAGACGGACAGAGGAATGTCAGCTGAGTAC AGTTTTCCCATATGGAAGACCAGCCACACTGTCAA GTGGGAAGGCGTATGGCGAGAACTGGGCTGCCTC TCAAGGACGGCGTCATTTGCTGTTCGAAAAGAAAG CGGACATTCACTGAAATCATCTCTTTCGCACGCCA TGGTCATCGATTCTCGGAATTCTTCCATCTTACCAA GGAGAGGTGCTTTGCTGAAAGTTAACCAGGAACT GGCAGGCTACACTG | 0 | * |
| 1872 | NM_0153 88.2_240 | 240 | AAGTTGCTTTTGTCCAAACATCCGGGCTTCTCCTTT TTGTGTTCCGGCCGATCCCACCTCTCCTCGACCCT GGACGTCTACCTTCCGGAGGCCCACATCTTGCCC ACTCCGCGCGCGGGGCTAGCGCGGGTTTCAGCG ACGGGAGCCCTCAAGGGACATGGCAACTACAGCG GCGCCGGCGGGCGGCGCCCGAAATGGAGCTGGC CCGGAATGGGGAGGGTTCGAAGAAAACATCCAGG CGGAGGCTCAGCTGTGATTGACATGGAGAACATG GATGATACCTCAGGCTCTAGCTTCGAGGATATGGG TGAGCTGCATCAGCGCCTGCGCGAGGAAGAAGTA GACGCTGATGCAGCTGATGCAGCTGCTGCTGAAG AGGAGGATGGAGAGTTCCTGGGCATGAAGGGCTT TAAGGGACAGCTGAGCCGGCAGGTGGCAGATCAG ATGTGGCAGGCTGGGAAAAGACAAGCCTCCAGGG CCTTCAGCTTGTACGCCAACATCGACATCCTCAGA CCCTACTTTGATGTGGAGCCTGCTCAGGTGCGAA GCAGGCTCCTGGAGTCCATGATCCCTATCAAGATG GTCAACTTCCCCCAGAAAATTGCAGGTGAACTCTA TGGACCTCTCATGCTGGTCTTCACTCTGGTTGCTA TCCTACTCCATGGGATGAAGACGTCTGACACTATT ATCCGGGAGGGCACCCTGATGGGCACAGCCATTG GCACCTGCTTCGGCTACTGGCTGGGAGTCTCATC CTTCATTTACTTCCTTGCCTACCTGTGCAACGCCC AGATCACCATGCTGCAGATGTTGGCACTGCTGGG CTATGGCCTCTTTGGGCATTGCATTGTCCTGTTCA TCACCTATAATATCCACCTCCACGCCCTCTTCTACC TCTTCTGGCTGTTGGTGGGTGGACTGTCCACACTG CGCATGGTAGCAGTGTTGGTGTCTCGGACCGTGG GCCCCACACAGCGGCTGCTCCTCTGTGGCACCCT GGCTGCCCTACACATGCTCTTCCTGC | 5 | AEAQL* |
| 1873 | NM_0153 91.2_121 | 121 | GCAGGAGCAAGCGTCTGCCGCGGTGGCCGGGTG CCGATTTGACAAGATCAAAGCTGCAGGAAAATGGA CAGTGAGGTTCAGAGAGATGGAAGGATCTTGGATT TGATTGATGATGCTTGGGAGAAGACAAGCTGCCTT ATGAGGATGTCGCAATACCACTGAATGAGCTTCCT GAACCTGAACAAGACAATGGTGGCACCACAGAAT CTGTCAAAGAACAAGAAATGAAGTGGACAGACTTA GCCTTACAGTACCTCCATGAGAATGTTCCCCCCAT TGGAAACTGACGCTTGGCTCCTTTCTTGTGGATGG ATTTTCTCAAAGTACACAGATAAAGCACGGTTTGTT TCAGTCTCCAAATTCAAACCTTTGAGTAATAAATCA GCACTCAAAAATGTACACCCATTTAGTTTGTGGTA GCAAAGTGCAATGCGAAATTGAATGAGAAACTGAG | 13 | EKTSCLMR MSQYH* |

TABLE 3A-continued

| SEQ ID | identifier_ position | position | modified_RNA | PAP length | PAP |
|---|---|---|---|---|---|
| | | | ATTTCTCAGTAATGGTGAATATTTCGCTCTTTAAAC<br>CTAAAACTCTTCATTGAGTAGCTTATATTTGAACAT<br>GATTGGTTAAACATTTGCCTCTACCTCTGATTTTGC<br>TTTGCTGTCAAAGTTTAACACCTTCCAACTACTTAT<br>GTGTGTCCTGTAACACAGGTGATTGAACGTATGAG<br>AGGGAAAGGCAAAGAAAAAGGAAGCCAGACACTA<br>GGAGAATTATTAACTTCTCATACTTCCCCACATTGA<br>GAAGCATTCGGAGTGTATTTAGCCTGTAGATGTTG<br>TGATATGCAAATATCCCATTCCCTGGTTACTGGCAT<br>TCCTAAGATTCTTCATGGTATTTTCAAACTTTGGAT<br>AAATTTACAGATTAGAAAGATATCTGACAGTTAATC<br>TCTGTTCTCCTTACAAATTCCTTTTGTGCTGCTGGA<br>AAGGATCTTTGGCTAGGTGGATGACTAGTTTTATT<br>CAAAGCCTTTTCTCAAAGCCCTTTCAGTTACAACCA<br>CCCCACTATGGAATCAGTATTTAGTTATACATTTGT<br>ATAAGAACCTGTATTTTGAAAAACACATTCATGTA | | |
| 1874 | NM_0153<br>91.2_279 | 279 | GCAGGAGCAAGCGTCTGCCGCGGTGGCCGGGTG<br>CCGATTTGACAAGATCAAAGCTGCAGGAAAATGGA<br>CAGTGAGGTTCAGAGAGATGGAAGGATCTTGGATT<br>TGATTGATGATGCTTGGCGAGAAGACAAGCTGCCT<br>TATGAGGATGTCGCAATACCACTGAATGAGCTTCC<br>TGAACCTGAACAAGACAATGGTGGCACCACAGAAT<br>CTGTCAAAGAACAAGAAATGAAGTGGACAGACTTA<br>GCCTTACAGTACCTCCATGAGAATGTTCCCCCCAT<br>GGAAACTGACGCTTGGCTCCTTTCTTGTGGATGGA<br>TTTTCTCAAAGTACACAGATAAAGCACGGTTTGTTT<br>CAGTCTCCAAATTCAAACCTTTGAGTAATAAATCAG<br>CACTCAAAAATGTACACCCATTTAGTTTGTGGTAG<br>CAAAGTGCAATGCGAAATTGAATGAGAAACTGAGA<br>TTTCTCAGTAATGGTGAATATTTCGCTCTTTAAACC<br>TAAAACTCTTCATTGAGTAGCTTATATTTGAACATG<br>ATTGGTTAAACATTTGCCTCTACCTCTGATTTTGCT<br>TTGCTGTCAAAGTTTAACACCTTCCAACTACTTATG<br>TGTGTCCTGTAACACAGGTGATTGAACGTATGAGA<br>GGGAAAGGCAAAGAAAAAGGAAGCCAGACACTAG<br>GAGAATTATTAACTTCTCATACTTCCCCACATTGAG<br>AAGCATTCGGAGTGTATTTAGCCTGTAGATGTTGT<br>GATATGCAAATATCCCATTCCCTGGTTACTGGCATT<br>CCTAAGATTCTTCATGGTATTTTCAAACTTTGGATA<br>AATTTACAGATTAGAAAGATATCTGACAGTTAATCT<br>CTGTTCTCCTTACAAATTCCTTTTGTGCTGCTGGAA<br>AGGATCTTTGGCTAGGTGGATGACTAGTTTTATTC<br>AAAGCCTTTTCTCAAAGCCCTTTCAGTTACAACCAC<br>CCCACTATGGAATCAGTATTTAGTTATACATTTGTA<br>TAAGAACCTGTATTTTGAAAAACACATTCATGTA | 47 | METDAWLL<br>SCGWIFSK<br>YTDKARFV<br>SVSKFKPL<br>SNKSALKN<br>VHPFSLW* |
| 1875 | NM_0156<br>59.2_529 | 529 | GGCTTGCTCGCGCGTGCGCACCAGAAGCCAGCAG<br>TGGGGTTGCACACGCGCCTCTTCACGAGGTGGAA<br>ACAAGATGGAGGATTCGGCCTCGGCCTCGCTGTC<br>TTCTGCAGCCGCTACTGGAACCTCCACCTCGACTC<br>CAGCGGCCCCGACAGCACGGAAGCAGCTGGATAA<br>AGAACAGGTTAGAAAGGCAGTGGACGCTCTCTTG<br>ACGCATTGCAAGTCCAGGAAAAACAATTATGGGTT<br>GCTTTTGAATGAGAATGAAAGTTTATTTTTAATGGT<br>GGTATTATGGAAAATTCCAAGTAAAGAACTGAGGG<br>TCAGATTGACCTTGCCTCATAGTATTCGATCAGATT<br>CAGAAGATATCTGTTTATTTACGAAGGATGAACCC<br>AATTCAACTCCTGAAAAGACAGAACAGTTTTATAGA<br>AAGCTTTTAAACAAGCATGGAATTAAAACCGTTTCT<br>CAGATTATCTCCCTCCAAACTCTAAAGAAGGAATAT<br>AAATCCTATGAAGCCAAGCTCCGCCTTCTGAGCAG<br>TTTGATTTCTTCCTTACTGATGCCAGAATTAGGCGG<br>CTCTTACCCTCACTCATTGGGAGACATTTCTATCAA<br>AGAAAGAAAGTTCCAGTATCTGTAAACCTTCTGTC<br>CAAGAATTTATCAAGAGAGATCAATGACTGTATAG<br>GTGGAACAGTCTTAAACATTTCTAAAAGTGGTTCTT<br>GCAGTGCTATACGTATTGGTCACGTTGGAATGCAA<br>ATTGAGCACATCATTGAAAACATTGTTGCTGTCAC<br>CAAAGGACTTTCAGAAAAATTGCCAGAGAAGTGGG<br>AGAGCGTGAAACTCCTGTTTGTGAAAACTGAGAAA<br>TCGGCTGCACTTCCCATCTTTTCCTCGTTTGTCAG<br>CAATTGGGATGAAGCCACCAAAAGATCTTTGCTTA<br>ATAAGAAGAAAAAAGAGGCAAGGAGAAAACGAAG<br>AGAAAGAAATTTTGAAAAACAAAAGGAGAGGAAGA<br>AGAAGAGGCAGCAGGCTAGGAAGACTGCATCAGT<br>TCTTAGTA | 31 | LISSLLMPE<br>LGGSYPHS<br>LGDISIKER<br>KFQYL* |
| 1876 | NM_0156<br>59.2_563 | 563 | GGCTTGCTCGCGCGTGCGCACCAGAAGCCAGCAG<br>TGGGGTTGCACACGCGCCTCTTCACGAGGTGGAA | 19 | SYPHSLGD<br>ISIKERKFQ |

TABLE 3A-continued

| SEQ ID | identifier_ position | position | modified_RNA | PAP length | PAP |
|---|---|---|---|---|---|
| | | | ACAAGATGGAGGATTCGGCCTCGGCCTCGCTGTC TTCTGCAGCCGCTACTGGAACCTCCACCTCGACTC CAGCGGCCCCGACAGCACGGAAGCAGCTGGATAA AGAACAGGTTAGAAAGGCAGTGGACGCTCTCTTG ACGCATTGCAAGTCCAGGAAAAACAATTATGGGTT GCTTTTGAATGAGAATGAAAGTTTATTTTTAATGGT GGTATTATGGAAAATTCCAAGTAAAGAACTGAGGG TCAGATTGACCTTGCCTCATAGTATTCGATCAGATT CAGAAGATATCTGTTTATTTACGAAGGATGAACCC AATTCAACTCCTGAAAAGACAGAACAGTTTTATAGA AAGCTTTTAAACAAGCATGGAATTAAAACCGTTTCT CAGATTATCTCCCTCCAAACTCTAAAGAAGGAATAT AAATCCTATGAAGCCAAGCTCCGCCTTCTGAGCAG TTTTGATTTCTTCCTTACTGATGCCAGAATTAGGCG GTCTTACCCTCACTCATTGGGAGACATTTCTATCAA AGAAAGAAAGTTCCAGTATCTGTAAACCTTCTGTC CAAGAATTTATCAAGAGAGATCAATGACTGTATAG GTGGAACAGTCTTAAACATTTCTAAAAGTGGTTCTT GCAGTGCTATACGTATTGGTCACGTTGGAATGCAA ATTGAGCACATCATTGAAAACATTGTTGCTGTCAC CAAAGGACTTTCAGAAAAATTGCCAGAGAAGTGGG AGAGCGTGAAACTCCTGTTTGTGAAAACTGAGAAA TCGGCTGCACTTCCCATCTTTTCCTCGTTTGTCAG CAATTGGGATGAAGCCACCAAAAGATCTTTGCTTA ATAAGAAGAAAAAAGAGGCAAGGAGAAAACGAAG AGAAAGAAATTTTGAAAAACAAAAGGAGAGGAAGA AGAAGAGGCAGCAGGCTAGGAAGACTGCATCAGT TCTTAGTA | | YL* |
| 1877 | NM_0156 59.2_580 | 580 | GGCTTGCTCGCGCGTGCGCACCAGAAGCCAGCAG TGGGGTTGCACACGCGCCTCTTCACGAGGTGGAA ACAAGATGGAGGATTCGGCCTCGGCCTCGCTGTC TTCTGCAGCCGCTACTGGAACCTCCACCTCGACTC CAGCGGCCCCGACAGCACGGAAGCAGCTGGATAA AGAACAGGTTAGAAAGGCAGTGGACGCTCTCTTG ACGCATTGCAAGTCCAGGAAAAACAATTATGGGTT GCTTTTGAATGAGAATGAAAGTTTATTTTTAATGGT GGTATTATGGAAAATTCCAAGTAAAGAACTGAGGG TCAGATTGACCTTGCCTCATAGTATTCGATCAGATT CAGAAGATATCTGTTTATTTACGAAGGATGAACCC AATTCAACTCCTGAAAAGACAGAACAGTTTTATAGA AAGCTTTTAAACAAGCATGGAATTAAAACCGTTTCT CAGATTATCTCCCTCCAAACTCTAAAGAAGGAATAT AAATCCTATGAAGCCAAGCTCCGCCTTCTGAGCAG TTTTGATTTCTTCCTTACTGATGCCAGAATTAGGCG GCTCTTACCCTCACTCATGGGAGACATTTCTATCA AGAAAGAAAGTTCCAGTATCTGTAAACCTTCTGT CCAAGAATTTATCAAGAGAGATCAATGACTGTATA GGTGGAACAGTCTTAAACATTTCTAAAAGTGGTTC TTGCAGTGCTATACGTATTGGTCACGTTGGAATGC AAATTGAGCACATCATTGAAAACATTGTTGCTGTCA CCAAAGGACTTTCAGAAAAATTGCCAGAGAAGTGG GAGAGCGTGAAACTCCTGTTTGTGAAAACTGAGAA ATCGGCTGCACTTCCCATCTTTTCCTCGTTTGTCA GCAATTGGGATGAAGCCACCAAAAGATCTTTGCTT AATAAGAAGAAAAAAGAGGCAAGGAGAAAACGAA GAGAAAGAAATTTTGAAAAACAAAAGGAGAGGAAG AAGAAGAGGCAGCAGGCTAGGAAGACTGCATCAG TTCTTAGTA | 14 | MGDISIKE RKFQYL* |
| 1878 | NM_0157 02.1_173 | 173 | ATTCGGCACCGCAGCGTAGGTGCTACCACCGCTG CCGTCGCCGCCGCCATTTTGATGGCAGGAAGAGT CCGGTTCTGGGACAGCTGGAGACAGTGGTGGTGA CTGAAATAACTTTACCAAAGGAAAGCTATTTTGCGA ACTATCTTCTCCAGCGGAGATGGCCAATGTGCTTG TAACAGAGCCAGACTGGTTTCCTATCTCCCAGGAT TTTGCTCTTTAGTTAAAAGGGTTGTCAATCCCAAAG CCTTTTCGACTGCAGGATCATCAGGTTCGGATGAG TCTCATGTGGCTGCTGCACCTCCAGATATATGCTC TCGAACAGTGTGGCCTGATGAAACTATGGGACCCT TTGGACCTCAAGATCAGAGGTTCCAGCTTCCTGGG AACATAGGTTTTGATTGTCACCTCAATGGGACTGC TTCACAGAAGAAAAGCCTGGTTCATAAAACTTTGC CTGATGTTCTAGCAGAACCTTTATCAAGTGAAAGA CATGAGTTTGTGATGGCACAATATGTGAATGAATTT CAGGGTAATGATGCACCTGTTGAACAAGAAATTAA CAGTGCAGAAACTTACTTTGAAAGTGCCAGAGTAG AGTGTGCAATACAAACATGTCCAGAATTGCTGCGA AAAGATTTTGAATCACTGTTTCCAGAAGTAGCTAAT | 15 | VTEPDWFP ISQDFAL* |

TABLE 3A-continued

| SEQ ID | identifier_ position | position | modified_RNA | PAP length | PAP |
|---|---|---|---|---|---|
| | | | GGCAAACTAATGATTCTGACTGTAACACAAAAAAC<br>TAAGAATGATATGACTGTTTGGAGTGAAGAAGTAG<br>AAATTGAAAGAGAAGTGCTCTTAGAAAAGTTCATC<br>AATGGTGCTAAGGAAATTTGCTATGCTCTTCGAGC<br>TGAGGGTTATTGGGCTGACTTTATTGACCCATCAT<br>CTGGTTTGGCATTTTTTGGACCATATACAAACAACA<br>CTCTTTTTGAAACTGATGAACGCTACCGACATTTAG<br>GATTCTCTGTTGATGACCTTGGATGCTGTAAAGTG<br>ATTCGTCATAGTCTCTGGGGTACCCATGTAGTTGT<br>AGGGAGTATCTTCACTAATGCAACACCAGACAGCC<br>ATATTA | | |
| 1879 | NM_0157 02.1_191 | 191 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGTTTCCTATCTCCCAGGAT<br>TTTGCTCTTTAGTTAAAAGGGTTGTCAATCCCAAAG<br>CCTTTTCGACTGCAGGATCATCAGGTTCGGATGAG<br>TCTCATGTGGCTGCTGCACCTCCAGATATATGCTC<br>TCGAACAGTGTGGCCTGATGAAACTATGGGACCCT<br>TTGGACCTCAAGATCAGAGGTTCCAGCTTCCTGGG<br>AACATAGGTTTTGATTGTCACCTCAATGGGACTGC<br>TTCACAGAAGAAAAGCCTGGTTCATAAAACTTTGC<br>CTGATGTTCTAGCAGAACCTTTATCAAGTGAAAGA<br>CATGAGTTTGTGATGGCACAATATGTGAATGAATTT<br>CAGGGTAATGATGCACCTGTTGAACAAGAAATTAA<br>CAGTGCAGAAACTTACTTTGAAAGTGCCAGAGTAG<br>AGTGTGCAATACAAACATGTCCAGAATTGCTGCGA<br>AAAGATTTTGAATCACTGTTTCCAGAAGTAGCTAAT<br>GGCAAACTAATGATTCTGACTGTAACACAAAAAAC<br>TAAGAATGATATGACTGTTTGGAGTGAAGAAGTAG<br>AAATTGAAAGAGAAGTGCTCTTAGAAAAGTTCATC<br>AATGGTGCTAAGGAAATTTGCTATGCTCTTCGAGC<br>TGAGGGTTATTGGGCTGACTTTATTGACCCATCAT<br>CTGGTTTGGCATTTTTTGGACCATATACAAACAACA<br>CTCTTTTTGAAACTGATGAACGCTACCGACATTTAG<br>GATTCTCTGTTGATGACCTTGGATGCTGTAAAGTG<br>ATTCGTCATAGTCTCTGGGGTACCCATGTAGTTGT<br>AGGGAGTATCTTCACTAATGCAACACCAGACAGCC<br>ATATTA | 9 | FPISQDFAL* |
| 1880 | NM_0157 02.1_212 | 212 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGGTTTCCTATCTCCCAGGA<br>TTTGCTCTTTAGTTAAAAGGGTTGTCAATCCCAAAG<br>CCTTTTCGACTGCAGGATCATCAGGTTCGGATGAG<br>TCTCATGTGGCTGCTGCACCTCCAGATATATGCTC<br>TCGAACAGTGTGGCCTGATGAAACTATGGGACCCT<br>TTGGACCTCAAGATCAGAGGTTCCAGCTTCCTGGG<br>AACATAGGTTTTGATTGTCACCTCAATGGGACTGC<br>TTCACAGAAGAAAAGCCTGGTTCATAAAACTTTGC<br>CTGATGTTCTAGCAGAACCTTTATCAAGTGAAAGA<br>CATGAGTTTGTGATGGCACAATATGTGAATGAATTT<br>CAGGGTAATGATGCACCTGTTGAACAAGAAATTAA<br>CAGTGCAGAAACTTACTTTGAAAGTGCCAGAGTAG<br>AGTGTGCAATACAAACATGTCCAGAATTGCTGCGA<br>AAAGATTTTGAATCACTGTTTCCAGAAGTAGCTAAT<br>GGCAAACTAATGATTCTGACTGTAACACAAAAAAC<br>TAAGAATGATATGACTGTTTGGAGTGAAGAAGTAG<br>AAATTGAAAGAGAAGTGCTCTTAGAAAAGTTCATC<br>AATGGTGCTAAGGAAATTTGCTATGCTCTTCGAGC<br>TGAGGGTTATTGGGCTGACTTTATTGACCCATCAT<br>CTGGTTTGGCATTTTTTGGACCATATACAAACAACA<br>CTCTTTTTGAAACTGATGAACGCTACCGACATTTAG<br>GATTCTCTGTTGATGACCTTGGATGCTGTAAAGTG<br>ATTCGTCATAGTCTCTGGGGTACCCATGTAGTTGT<br>AGGGAGTATCTTCACTAATGCAACACCAGACAGCC<br>ATATTA | 2 | AL* |
| 1881 | NM_0157 02.1_297 | 297 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGGTTTCCTATCTCCCAGGA | 31 | DLQIYALE QCGLMKL WDPLDLKI RGSSFLGT* |

TABLE 3A-continued

| SEQ ID | identifier_position | position | modified_RNA | PAP length | PAP |
|---|---|---|---|---|---|
| | | | TTTTGCTCTTTAGTTAAAAGGGTTGTCAATCCCAAA GCCTTTTCGACTGCAGGATCATCAGGTTCGGATGA GTCTCATGTGGCTGCTGACCTCCAGATATATGCTC TCGAACAGTGTGGCCTGATGAAACTATGGGACCCT TTGGACCTCAAGATCAGAGGTTCCAGCTTCCTGGG AACATAGGTTTTGATTGTCACCTCAATGGGACTGC TTCACAGAAGAAAAGCCTGGTTCATAAAACTTTGC CTGATGTTCTAGCAGAACCTTTATCAAGTGAAAGA CATGAGTTTGTGATGGCACAATATGTGAATGAATTT CAGGGTAATGATGCACCTGTTGAACAAGAAATTAA CAGTGCAGAAACTTACTTTGAAAGTGCCAGAGTAG AGTGTGCAATACAAACATGTCCAGAATTGCTGCGA AAAGATTTTGAATCACTGTTTCCAGAAGTAGCTAAT GGCAAACTAATGATTCTGACTGTAACACAAAAAAC TAAGAATGATATGACTGTTTGGAGTGAAGAAGTAG AAATTGAAAGAGAAGTGCTCTTAGAAAAGTTCATC AATGGTGCTAAGGAAATTTGCTATGCTCTTCGAGC TGAGGGTTATTGGGCTGACTTTATTGACCCATCAT CTGGTTTGGCATTTTTTGGACCATATACAAACAACA CTCTTTTTGAAACTGATGAACGCTACCGACATTTAG GATTCTCTGTTGATGACCTTGGATGCTGTAAAGTG ATTCGTCATAGTCTCTGGGGTACCCATGTAGTTGT AGGGAGTATCTTCACTAATGCAACACCAGACAGCC ATATTA | | |
| 1882 | NM_0157 02.1_352 | 352 | ATTCGGCACCGCAGCGTAGGTGCTACCACCGCTG CCGTCGCCGCCGCCATTTTGATGGCAGGAAGAGT CCGGTTCTGGGACAGCTGGAGACAGTGGTGGTGA CTGAAATAACTTTACCAAAGGAAAGCTATTTTGCGA ACTATCTTCTCCAGCGGAGATGGCCAATGTGCTTT GTAACAGAGCCAGACTGGTTTCCTATCTCCCAGGA TTTTGCTCTTTAGTTAAAAGGGTTGTCAATCCCAAA GCCTTTTCGACTGCAGGATCATCAGGTTCGGATGA GTCTCATGTGGCTGCTGCACCTCCAGATATATGCT CTCGAACAGTGTGGCCTGATGAAACTATGGGACC CTTGGACCTCAAGATCAGAGGTTCCAGCTTCCTGG GAACATAGGTTTTGATTGTCACCTCAATGGGACTG CTTCACAGAAGAAAAGCCTGGTTCATAAAACTTTG CCTGATGTTCTAGCAGAACCTTTATCAAGTGAAAG ACATGAGTTTGTGATGGCACAATATGTGAATGAAT TCAGGGTAATGATGCACCTGTTGAACAAGAAATT AACAGTGCAGAAACTTACTTTGAAAGTGCCAGAGT AGAGTGTGCAATACAAACATGTCCAGAATTGCTGC GAAAAGATTTTGAATCACTGTTTCCAGAAGTAGCTA ATGGCAAACTAATGATTCTGACTGTAACACAAAAAA CTAAGAATGATATGACTGTTTGGAGTGAAGAAGTA GAAATTGAAAGAGAAGTGCTCTTAGAAAAGTTCAT CAATGGTGCTAAGGAAATTTGCTATGCTCTTCGAG CTGAGGGTTATTGGGCTGACTTTATTGACCCATCA TCTGGTTTGGCATTTTTTGGACCATATACAAACAAC ACTCTTTTTGAAACTGATGAACGCTACCGACATTTA GGATTCTCTGTTGATGACCTTGGATGCTGTAAAGT GATTCGTCATAGTCTCTGGGGTACCCATGTAGTTG TAGGGAGTATCTTCACTAATGCAACACCAGACAGC CATATTA | 13 | LDLKIRGS SFLGT* |
| 1883 | NM_0157 02.1_354 | 354 | ATTCGGCACCGCAGCGTAGGTGCTACCACCGCTG CCGTCGCCGCCGCCATTTTGATGGCAGGAAGAGT CCGGTTCTGGGACAGCTGGAGACAGTGGTGGTGA CTGAAATAACTTTACCAAAGGAAAGCTATTTTGCGA ACTATCTTCTCCAGCGGAGATGGCCAATGTGCTTT GTAACAGAGCCAGACTGGTTTCCTATCTCCCAGGA TTTTGCTCTTTAGTTAAAAGGGTTGTCAATCCCAAA GCCTTTTCGACTGCAGGATCATCAGGTTCGGATGA GTCTCATGTGGCTGCTGCACCTCCAGATATATGCT CTCGAACAGTGTGGCCTGATGAAACTATGGGACC CTTTGACCTCAAGATCAGAGGTTCCAGCTTCCTGG GAACATAGGTTTTGATTGTCACCTCAATGGGACTG CTTCACAGAAGAAAAGCCTGGTTCATAAAACTTTG CCTGATGTTCTAGCAGAACCTTTATCAAGTGAAAG ACATGAGTTTGTGATGGCACAATATGTGAATGAAT TCAGGGTAATGATGCACCTGTTGAACAAGAAATT AACAGTGCAGAAACTTACTTTGAAAGTGCCAGAGT AGAGTGTGCAATACAAACATGTCCAGAATTGCTGC GAAAAGATTTTGAATCACTGTTTCCAGAAGTAGCTA ATGGCAAACTAATGATTCTGACTGTAACACAAAAAA CTAAGAATGATATGACTGTTTGGAGTGAAGAAGTA GAAATTGAAAGAGAAGTGCTCTTAGAAAAGTTCAT CAATGGTGCTAAGGAAATTTGCTATGCTCTTCGAG | 12 | DLKIRGSS FLGT* |

TABLE 3A-continued

| SEQ ID | identifier_position | position | modified_RNA | PAP length | PAP |
|---|---|---|---|---|---|
| | | | CTGAGGGTTATTGGGCTGACTTTATTGACCCATCA<br>TCTGGTTTGGCATTTTTTGGACCATATACAAACAAC<br>ACTCTTTTTGAAACTGATGAACGCTACCGACATTTA<br>GGATTCTCTGTTGATGACCTTGGATGCTGTAAAGT<br>GATTCGTCATAGTCTCTGGGGTACCCATGTAGTTG<br>TAGGGAGTATCTTCACTAATGCAACACCAGACAGC<br>CATATTA | | |
| 1884 | NM_0157<br>02.1_397 | 397 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGGTTTCCTATCTCCCAGGA<br>TTTTGCTCTTTAGTTAAAAGGGTTGTCAATCCCAAA<br>GCCTTTTCGACTGCAGGATCATCAGGTTCGGATGA<br>GTCTCATGTGGCTGCTGCACCTCCAGATATATGCT<br>CTCGAACAGTGTGGCCTGATGAAACTATGGGACC<br>CTTTGGACCTCAAGATCAGAGGTTCCAGCTTCCTG<br>GGAACATAGGTTTGATTGTCACCTCAATGGGACTG<br>CTTCACAGAAGAAAAGCCTGGTTCATAAAACTTTG<br>CCTGATGTTCTAGCAGAACCTTTATCAAGTGAAAG<br>ACATGAGTTTGTGATGGCACAATATGTGAATGAAT<br>TTCAGGGTAATGATGCACCTGTTGAACAAGAAATT<br>AACAGTGCAGAAACTTACTTTGAAAGTGCCAGAGT<br>AGAGTGTGCAATACAAACATGTCCAGAATTGCTGC<br>GAAAAGATTTTGAATCACTGTTTCCAGAAGTAGCTA<br>ATGGCAAACTAATGATTCTGACTGTAACACAAAAAA<br>CTAAGAATGATATGACTGTTTGGAGTGAAGAAGTA<br>GAAATTGAAAGAGAAGTGCTCTTAGAAAAGTTCAT<br>CAATGGTGCTAAGGAAATTTGCTATGCTCTTCGAG<br>CTGAGGGTTATTGGGCTGACTTTATTGACCCATCA<br>TCTGGTTTGGCATTTTTTGGACCATATACAAACAAC<br>ACTCTTTTTGAAACTGATGAACGCTACCGACATTTA<br>GGATTCTCTGTTGATGACCTTGGATGCTGTAAAGT<br>GATTCGTCATAGTCTCTGGGGTACCCATGTAGTTG<br>TAGGGAGTATCTTCACTAATGCAACACCAGACAGC<br>CATATTA | 23 | LIVTSMGLL<br>HRRKAWFI<br>KLCLMF* |
| 1885 | NM_0157<br>02.1_420 | 420 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGGTTTCCTATCTCCCAGGA<br>TTTTGCTCTTTAGTTAAAAGGGTTGTCAATCCCAAA<br>GCCTTTTCGACTGCAGGATCATCAGGTTCGGATGA<br>GTCTCATGTGGCTGCTGCACCTCCAGATATATGCT<br>CTCGAACAGTGTGGCCTGATGAAACTATGGGACC<br>CTTTGGACCTCAAGATCAGAGGTTCCAGCTTCCTG<br>GGAACATAGGTTTGATTGTCACCTCAATGGGACTG<br>TTCACAGAAGAAAAGCCTGGTTCATAAAACTTTG<br>CCTGATGTTCTAGCAGAACCTTTATCAAGTGAAAG<br>ACATGAGTTTGTGATGGCACAATATGTGAATGAAT<br>TTCAGGGTAATGATGCACCTGTTGAACAAGAAATT<br>AACAGTGCAGAAACTTACTTTGAAAGTGCCAGAGT<br>AGAGTGTGCAATACAAACATGTCCAGAATTGCTGC<br>GAAAAGATTTTGAATCACTGTTTCCAGAAGTAGCTA<br>ATGGCAAACTAATGATTCTGACTGTAACACAAAAAA<br>CTAAGAATGATATGACTGTTTGGAGTGAAGAAGTA<br>GAAATTGAAAGAGAAGTGCTCTTAGAAAAGTTCAT<br>CAATGGTGCTAAGGAAATTTGCTATGCTCTTCGAG<br>CTGAGGGTTATTGGGCTGACTTTATTGACCCATCA<br>TCTGGTTTGGCATTTTTTGGACCATATACAAACAAC<br>ACTCTTTTTGAAACTGATGAACGCTACCGACATTTA<br>GGATTCTCTGTTGATGACCTTGGATGCTGTAAAGT<br>GATTCGTCATAGTCTCTGGGGTACCCATGTAGTTG<br>TAGGGAGTATCTTCACTAATGCAACACCAGACAGC<br>CATATTA | 15 | VHRRKAW<br>FIKLCLMF* |
| 1886 | NM_0157<br>02.1_453 | 453 | ATTCGGCACCGCAGCGTAGGTGCTACCACCGCTG<br>CCGTCGCCGCCGCCATTTTGATGGCAGGAAGAGT<br>CCGGTTCTGGGACAGCTGGAGACAGTGGTGGTGA<br>CTGAAATAACTTTACCAAAGGAAAGCTATTTTGCGA<br>ACTATCTTCTCCAGCGGAGATGGCCAATGTGCTTT<br>GTAACAGAGCCAGACTGGTTTCCTATCTCCCAGGA<br>TTTTGCTCTTTAGTTAAAAGGGTTGTCAATCCCAAA<br>GCCTTTTCGACTGCAGGATCATCAGGTTCGGATGA<br>GTCTCATGTGGCTGCTGCACCTCCAGATATATGCT<br>CTCGAACAGTGTGGCCTGATGAAACTATGGGACC | 4 | CLMF* |

TABLE 3A-continued

| SEQ ID | identifier_position | position | modified_RNA | PAP length | PAP |
|---|---|---|---|---|---|
| | | | CTTTGGACCTCAAGATCAGAGGTTCCAGCTTCCTG GGAACATAGGTTTTGATTGTCACCTCAATGGGACT GCTTCACAGAAGAAAAGCCTGGTTCATAAAACTTG CCTGATGTTCTAGCAGAACCTTTATCAAGTGAAAG ACATGAGTTTGTGATGGCACAATATGTGAATGAAT TTCAGGGTAATGATGCACCTGTTGAACAAGAAATT AACAGTGCAGAAACTTACTTTGAAAGTGCCAGAGT AGAGTGTGCAATACAAACATGTCCAGAATTGCTGC GAAAAGATTTTGAATCACTGTTTCCAGAAGTAGCTA ATGGCAAACTAATGATTCTGACTGTAACACAAAAAA CTAAGAATGATATGACTGTTTGGAGTGAAGAAGTA GAAATTGAAAGAGAAGTGCTCTTAGAAAAGTTCAT CAATGGTGCTAAGGAAATTTGCTATGCTCTTCGAG CTGAGGGTTATTGGGCTGACTTTATTGACCCATCA TCTGGTTTGGCATTTTTTGGACCATATACAAACAAC ACTCTTTTTGAAACTGATGAACGCTACCGACATTTA GGATTCTCTGTTGATGACCTTGGATGCTGTAAAGT GATTCGTCATAGTCTCTGGGGTACCCATGTAGTTG TAGGGAGTATCTTCACTAATGCAACACCAGACAGC CATATTA | | |
| 1887 | NM_0157 02.1_499 | 499 | ATTCGGCACCGCAGCGTAGGTGCTACCACCGCTG CCGTCGCCGCCGCCATTTTGATGGCAGGAAGAGT CCGGTTCTGGGACAGCTGGAGACAGTGGTGGTGA CTGAAATAACTTTACCAAAGGAAAGCTATTTTGCGA ACTATCTTCTCCAGCGGAGATGGCCAATGTGCTTT GTAACAGAGCCAGACTGGTTTCCTATCTCCCAGGA TTTTGCTCTTTAGTTAAAAGGGTTGTCAATCCCAAA GCCTTTTCGACTGCAGGATCATCAGGTTCGGATGA GTCTCATGTGGCTGCTGCACCTCCAGATATATGCT CTCGAACAGTGTGGCCTGATGAAACTATGGGACC CTTTGGACCTCAAGATCAGAGGTTCCAGCTTCCTG GGAACATAGGTTTTGATTGTCACCTCAATGGGACT GCTTCACAGAAGAAAAGCCTGGTTCATAAAACTTT GCCTGATGTTCTAGCAGAACCTTTATCAAGTGAAA GACATGAGTTGTGATGGCACAATATGTGAATGAAT TTCAGGGTAATGATGCACCTGTTGAACAAGAAATT AACAGTGCAGAAACTTACTTTGAAAGTGCCAGAGT AGAGTGTGCAATACAAACATGTCCAGAATTGCTGC GAAAAGATTTTGAATCACTGTTTCCAGAAGTAGCTA ATGGCAAACTAATGATTCTGACTGTAACACAAAAAA CTAAGAATGATATGACTGTTTGGAGTGAAGAAGTA GAAATTGAAAGAGAAGTGCTCTTAGAAAAGTTCAT CAATGGTGCTAAGGAAATTTGCTATGCTCTTCGAG CTGAGGGTTATTGGGCTGACTTTATTGACCCATCA TCTGGTTTGGCATTTTTTGGACCATATACAAACAAC ACTCTTTTTGAAACTGATGAACGCTACCGACATTTA GGATTCTCTGTTGATGACCTTGGATGCTGTAAAGT GATTCGTCATAGTCTCTGGGGTACCCATGTAGTTG TAGGGAGTATCTTCACTAATGCAACACCAGACAGC CATATTA | 1 | L* |
| 1888 | NM_0157 02.1_605 | 605 | ATTCGGCACCGCAGCGTAGGTGCTACCACCGCTG CCGTCGCCGCCGCCATTTTGATGGCAGGAAGAGT CCGGTTCTGGGACAGCTGGAGACAGTGGTGGTGA CTGAAATAACTTTACCAAAGGAAAGCTATTTTGCGA ACTATCTTCTCCAGCGGAGATGGCCAATGTGCTTT GTAACAGAGCCAGACTGGTTTCCTATCTCCCAGGA TTTTGCTCTTTAGTTAAAAGGGTTGTCAATCCCAAA GCCTTTTCGACTGCAGGATCATCAGGTTCGGATGA GTCTCATGTGGCTGCTGCACCTCCAGATATATGCT CTCGAACAGTGTGGCCTGATGAAACTATGGGACC CTTTGGACCTCAAGATCAGAGGTTCCAGCTTCCTG GGAACATAGGTTTTGATTGTCACCTCAATGGGACT GCTTCACAGAAGAAAAGCCTGGTTCATAAAACTTT GCCTGATGTTCTAGCAGAACCTTTATCAAGTGAAA GACATGAGTTTGTGATGGCACAATATGTGAATGAA TTTCAGGGTAATGATGCACCTGTTGAACAAGAAAT TAACAGTGCAGAAACTTACTTTGAAAGTGCCAGAG TAGAGTGTGCATACAAACATGTCCAGAATTGCTGC GAAAAGATTTTGAATCACTGTTTCCAGAAGTAGCTA ATGGCAAACTAATGATTCTGACTGTAACACAAAAAA CTAAGAATGATATGACTGTTTGGAGTGAAGAAGTA GAAATTGAAAGAGAAGTGCTCTTAGAAAAGTTCAT CAATGGTGCTAAGGAAATTTGCTATGCTCTTCGAG CTGAGGGTTATTGGGCTGACTTTATTGACCCATCA TCTGGTTTGGCATTTTTTGGACCATATACAAACAAC ACTCTTTTTGAAACTGATGAACGCTACCGACATTTA GGATTCTCTGTTGATGACCTTGGATGCTGTAAAGT | 18 | YKHVQNC CEKILNHC FQK* |

TABLE 3A-continued

| SEQ ID | identifier_position | position | modified_RNA | PAP length | PAP |
|---|---|---|---|---|---|
| | | | GATTCGTCATAGTCTCTGGGGTACCCATGTAGTTG TAGGGAGTATCTTCACTAATGCAACACCAGACAGC CATATTA | | |
| 1889 | NM_0157 10.3_562 | 562 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCAGGACACCGTAGAGC GGCCCTTCTACGACCTCTGGGCCTCAGACAACCC CCTGGACAGGCCGTTGGTTGGCCAGGATGAGTTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | 3 | RTP* |
| 1890 | NM_0157 10.3_582 | 582 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCTTCTACGACCTCTGGGCCTCAGACAACCC CCTGGACAGGCCGTTGGTTGGCCAGGATGAGTTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | 30 | STTSGPQT TPWTGRW LARMSFS WSRPRRK E* |
| 1891 | NM_0157 10.3_600 | 600 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG | 24 | QTTPWTG RWLARMS FSWSRPR RKE* |

TABLE 3A-continued

| SEQ ID | identifier_position | position | modified_RNA | PAP length | PAP |
|---|---|---|---|---|---|
| | | | TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCCTTCTACGACCTCTGGGCTCAGACAACCC CCTGGACAGGCCGTTGGTTGGCCAGGATGAGTTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | | |
| 1892 | NM_0157 10.3_613 | 613 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCCTTCTACGACCTCTGGGCCTCAGACAACCC CCTGGACAGGCCGTTGGTTGGCCAGGATGAGTTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | 20 | WTGRWLA RMSFSWS RPRRKE* |
| 1893 | NM_0157 10.3_634 | 634 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCCTTCTACGACCTCTGGGCCTCAGACAACCC CCTGGACAGGCCGTTGGTTGGCCAGGATGAGTTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG | 13 | RMSFSWS RPRRKE* |

TABLE 3A-continued

| SEQ ID | identifier_ position | position | modified_RNA | PAP length | PAP |
|---|---|---|---|---|---|
| | | | GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | | |
| 1894 | NM_0157 10.3_647 | 647 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCCTTCTACGACCTCTGGGCCTCAGACAACC CCCTGGACAGGCCGTTGGTTGGCCAGGATGAGTT TTCCTGGAGCAGACCAAGAAGAAAGGAGTGAAGC GGCCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | 9 | SWSRPRR KE* |
| 1895 | NM_0157 10.3_683 | 683 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC GAGAACACATCCAAAGTCCCTGCCCCCAAAGACG TCCTCGCCCACCAGGTCCCCAACGCCAAGAAGCT CAGGCGGAAGGAGCAGCTATGGGAGAAGCTGGC CAAGCAGGGCGAGCTGCCCCGGGAGGTGCGCAG GGCCCAGGCCCGGCTCCTCAACCCTTCTGCAACA AGGGCCAAGCCCGGGCCCCAGGACACCGTAGAG CGGCCCTTCTACGACCTCTGGGCCTCAGACAACC CCCTGGACAGGCCGTTGGTTGGCCAGGATGAGTT TTCCTGGAGCAGACCAAGAAGAAAGGAGTGAAG CGGCAGCACGCCTGCACACCAAGCCGTCCCAGGC GCCCGCCGTGGAGGTGGCGCCTGCCGGAGCTTC CTACAATCCATCCTTTGAAGACCACCAGACCCTGC TCTCAGCGGCCCACGAGGTGGAGTTGCAGCGGCA GAAGGAGGCGGAGAAGCTGGAGCGGCAGCTGGC CCTGCCCGCCACGGAGCAGGCCGCCACCCAGGA GTCCACATTCCAGGAGCTGTGCGAGGGGCTGCTG GAGGAGTCGGATGGTGAGGGGGAGCCAGGCCAG GGCGAGGGGCCGGAGGCTGGGGATGCCGAGGTC TGTCCCACGCCCGCCCGCCTGGCCACCACAGAGA AGAAGACGGA | 155 | QHACTPSR PRRPPWR WRLPELPT IHPLKTTRP CSQRPTR WSCSGRR RRRSWSG SWPCPPR SRPPPRSP HSRSCAR GCWRSRM VRGSQAR ARGRRLG MPRSVPR PPAWPPQ RRRRSSS GGGRRLC TGCGYSR PRCGPPG SGTRSCS GCAGSRP RWP* |
| 1896 | NM_0157 10.3_720 | 720 | TTTGACAAGATGGCGGCAGGAGGCAGTGGCGTTG GTGGGAAGCGCAGCTCGAAAAGCGATGCCGATTC TGGTTTCCTGGGGCTGCGGCCCACTTCGGTGGAC CCAGCGCTGAGGCGGCGGCGGCGAGGCCCAAGA AATAAGAAGCGGGGCTGGCGGCGGCTTGCTCAGG AGCCGCTGGGGCTGGAGGTTGACCAGTTCCTGGA AGACGTGCGGCTACAGGAGCGCACGAGCGGTGG CTTGTTGTCAGAGGCCCCAAATGAAAAACTCTTCT TCGTGGACACTGGCTCCAAGGAAAAAGGGCTGAC AAAGAAGAGAACCAAAGTCCAGAAGAAGTCACTGC TTCTCAAGAAACCCCTTCGGGTTGACCTCATCCTC | 142 | WRWRLPE LPTIHPLKT TRPCSQRP TRPCSQRP TRWSCSG RRRRRSW SGSWPCP PRSRPPPR SPHSRSCA RGCWRSR MVRGSQA |

TABLE 3A-continued

| SEQ ID | identifier_position | position | modified_RNA | length PAP | PAP |
|---|---|---|---|---|---|
| | | | GAGAACACATCCAAAGTCCCTGCCCCCAAAGACG<br>TCCTCGCCCACCAGGTCCCCAACGCCAAGAAGCT<br>CAGGCGGAAGGAGCAGCTATGGGAGAAGCTGGC<br>CAAGCAGGGCGAGCTGCCCCGGGAGGTGCGCAG<br>GGCCCAGGCCCGGCTCCTCAACCCTTCTGCAACA<br>AGGGCCAAGCCCGGGCCCCAGGACACCGTAGAG<br>CGGCCCTTCTACGACCTCTGGGCCTCAGACAACC<br>CCCTGGACAGGCCGTTGGTTGGCCAGGATGAGTT<br>TTTCCTGGAGCAGACCAAGAAGAAAGGAGTGAAG<br>CGGCCAGCACGCCTGCACACCAAGCCGTCCCAGG<br>CGCCCGCGTGGAGGTGGCGCCTGCCGGAGCTTC<br>CTACAATCCATCCTTTGAAGACCACCAGACCCTGC<br>TCTCAGCGGCCCACGAGGTGGAGTTGCAGCGGCA<br>GAAGGAGGCGGAGAAGCTGGAGCGGCAGCTGGC<br>CCTGCCCGCCACGGAGCAGGCCGCCACCCAGGA<br>GTCCACATTCCAGGAGCTGTGCGAGGGGCTGCTG<br>GAGGAGTCGGATGGTGAGGGGGAGCCAGGCCAG<br>GGCGAGGGGCCGGAGGCTGGGGATGCCGAGGTC<br>TGTCCCACGCCCGCCCGCCTGGCCACCACAGAGA<br>AGAAGACGGA | | RARGRRL<br>GMPRSVP<br>RPPAWPP<br>QRRRRSS<br>SGGGRRL<br>CTGCGYS<br>RPRCGPP<br>GSGTRSC<br>SGCAGSR<br>PRWP* |
| 1897 | NM_01571<br>0.3_738 | 738 | TTTGACAAGATGGCGGCAGGAGGCAGTGGCGTTG<br>GTGGGAAGCGCAGCTCGAAAAGCGATGCCGATTC<br>TGGTTTCCTGGGGCTGCGGCCCACTTCGGTGGAC<br>CCAGCGCTGAGGCGGCGGCGGCGAGGCCCAAGA<br>AATAAGAAGCGGGGCTGGCGGCGGCTTGCTCAGG<br>AGCCGCTGGGGCTGGAGGTTGACCAGTTCCTGGA<br>AGACGTGCGGCTACAGGAGCGCACGAGCGGTGG<br>CTTGTTGTCAGAGGCCCCAAATGAAAAACTCTTCT<br>TCGTGGACACTGGCTCCAAGGAAAAAGGGCTGAC<br>AAAGAAGAGAACCAAAGTCCAGAAGAAGTCACTGC<br>TTCTCAAGAAACCCCTTCGGGTTGACCTCATCCTC<br>GAGAACACATCCAAAGTCCCTGCCCCCAAAGACG<br>TCCTCGCCCACCAGGTCCCCAACGCCAAGAAGCT<br>CAGGCGGAAGGAGCAGCTATGGGAGAAGCTGGC<br>CAAGCAGGGCGAGCTGCCCCGGGAGGTGCGCAG<br>GGCCCAGGCCCGGCTCCTCAACCCTTCTGCAACA<br>AGGGCCAAGCCCGGGCCCCAGGACACCGTAGAG<br>CGGCCCTTCTACGACCTCTGGGCCTCAGACAACC<br>CCCTGGACAGGCCGTTGGTTGGCCAGGATGAGTT<br>TTTCCTGGAGCAGACCAAGAAGAAAGGAGTGAAG<br>CGGCCAGCACGCCTGCACACCAAGCCGTCCCAGG<br>CGCCCGCCGTGGAGGTGGCGCCTGCGGAGCTTC<br>CTACAATCCATCCTTTGAAGACCACCAGACCCTGC<br>TCTCAGCGGCCCACGAGGTGGAGTTGCAGCGGCA<br>GAAGGAGGCGGAGAAGCTGGAGCGGCAGCTGGC<br>CCTGCCCGCCACGGAGCAGGCCGCCACCCAGGA<br>GTCCACATTCCAGGAGCTGTGCGAGGGGCTGCTG<br>GAGGAGTCGGATGGTGAGGGGGAGCCAGGCCAG<br>GGCGAGGGGCCGGAGGCTGGGGATGCCGAGGTC<br>TGTCCCACGCCCGCCCGCCTGGCCACCACAGAGA<br>AGAAGACGGA | 136 | ELPTIHPLK<br>TTRPCSQR<br>PTRWSCS<br>GRRRRRS<br>WSGSWPC<br>PPRSRPPP<br>RSPHSRSC<br>ARGCWRS<br>RMVRGSQ<br>ARARGRRL<br>GMPRSVP<br>RPPAWPP<br>QRRRRSS<br>SGGGRRL<br>CTGCGYS<br>RPRCGPP<br>GSGTRSC<br>SGCAGSR<br>PRWP* |
| 1898 | NM_01571<br>0.3_793 | 793 | TTTGACAAGATGGCGGCAGGAGGCAGTGGCGTTG<br>GTGGGAAGCGCAGCTCGAAAAGCGATGCCGATTC<br>TGGTTTCCTGGGGCTGCGGCCCACTTCGGTGGAC<br>CCAGCGCTGAGGCGGCGGCGGCGAGGCCCAAGA<br>AATAAGAAGCGGGGCTGGCGGCGGCTTGCTCAGG<br>AGCCGCTGGGGCTGGAGGTTGACCAGTTCCTGGA<br>AGACGTGCGGCTACAGGAGCGCACGAGCGGTGG<br>CTTGTTGTCAGAGGCCCCAAATGAAAAACTCTTCT<br>TCGTGGACACTGGCTCCAAGGAAAAAGGGCTGAC<br>AAAGAAGAGAACCAAAGTCCAGAAGAAGTCACTGC<br>TTCTCAAGAAACCCCTTCGGGTTGACCTCATCCTC<br>GAGAACACATCCAAAGTCCCTGCCCCCAAAGACG<br>TCCTCGCCCACCAGGTCCCCAACGCCAAGAAGCT<br>CAGGCGGAAGGAGCAGCTATGGGAGAAGCTGGC<br>CAAGCAGGGCGAGCTGCCCCGGGAGGTGCGCAG<br>GGCCCAGGCCCGGCTCCTCAACCCTTCTGCAACA<br>AGGGCCAAGCCCGGGCCCCAGGACACCGTAGAG<br>CGGCCCTTCTACGACCTCTGGGCCTCAGACAACC<br>CCCTGGACAGGCCGTTGGTTGGCCAGGATGAGTT<br>TTTCCTGGAGCAGACCAAGAAGAAAGGAGTGAAG<br>CGGCCAGCACGCCTGCACACCAAGCCGTCCCAGG<br>CGCCCGCCGTGGAGGTGGCGCCTGCCGGAGCTT<br>CCTACAATCCATCCTTTGAAGACCACCAGACCCTG<br>CTCTCAGCGGCCACGAGGTGGAGTTGCAGCGGCA<br>GAAGGAGGCGGAGAAGCTGGAGCGGCAGCTGGC<br>CCTGCCCGCCACGGAGCAGGCCGCCACCCAGGA | 118 | TRWSCSG<br>RRRRRSW<br>SGSWPCP<br>PRSRPPPR<br>SPHSRSCA<br>RGCWRSR<br>MVRGSQA<br>RARGRRL<br>GMPRSVP<br>RPPAWPP<br>QRRRRSS<br>SGGGRRL<br>CTGCGYS<br>RPRCGPP<br>GSGTRSC<br>SGCAGSR<br>PRWP* |

TABLE 3A-continued

| SEQ ID | identifier_position | position | modified_RNA | PAP length | PAP |
|---|---|---|---|---|---|
| | | | GTCCACATTCCAGGAGCTGTGCGAGGGGCTGCTG<br>GAGGAGTCGGATGGTGAGGGGGAGCCAGGCCAG<br>GGCGAGGGGCCGGAGGCTGGGGATGCCGAGGTC<br>TGTCCCACGCCCGCCCGCCTGGCCACCACAGAGA<br>AGAAGACGGA | | |
| 1899 | NM_0157<br>10.3_90 | 90 | TTTGACAAGATGGCGGCAGGAGGCAGTGGCGTTG<br>GTGGGAAGCGCAGCTCGAAAAGCGATGCCGATTC<br>TGGTTTCCTGGGGCTGCGGCCACTTCGGTGGACC<br>CAGCGCTGAGGCGGCGGCGGCGAGGCCCAAGAA<br>ATAAGAAGCGGGGCTGGCGGCGGCTTGCTCAGGA<br>GCCGCTGGGGCTGGAGGTTGACCAGTTCCTGGAA<br>GACGTGCGGCTACAGGAGCGCACGAGCGGTGGC<br>TTGTTGTCAGAGGCCCCAAATGAAAAACTCTTCTT<br>CGTGGACACTGGCTCCAAGGAAAAAGGGCTGACA<br>AAGAAGAGAACCAAAGTCCAGAAGAAGTCACTGCT<br>TCTCAAGAAACCCCTTCGGGTTGACCTCATCCTCG<br>AGAACACATCCAAAGTCCCTGCCCCCAAAGACGTC<br>CTCGCCCACCAGGTCCCCAACGCCAAGAAGCTCA<br>GGCGGAAGGAGCAGCTATGGGAGAAGCTGGCCA<br>AGCAGGGCGAGCTGCCCCGGGAGGTGCGCAGGG<br>CCCAGGCCCGGCTCCTCAACCCTTCTGCAACAAG<br>GGCCAAGCCCGGGCCCCAGGACACCGTAGAGCG<br>GCCCTTCTACGACCTCTGGGCCTCAGACAACCCC<br>CTGGACAGGCCGTTGGTTGGCCAGGATGAGTTTTT<br>CCTGGAGCAGACCAAGAAGAAAGGAGTGAAGCGG<br>CCAGCACGCCTGCACACCAAGCCGTCCCAGGCGC<br>CCGCCGTGGAGGTGGCGCCTGCCGGAGCTTCCTA<br>CAATCCATCCTTTGAAGACCACCAGACCCTGCTCT<br>CAGCGGCCCACGAGGTGGAGTTGCAGCGGCAGA<br>AGGAGGCGGAGAAGCTGGAGCGGCAGCTGGCCC<br>TGCCCGCCACGGAGCAGGCCGCCACCCAGGAGT<br>CCACATTCCAGGAGCTGTGCGAGGGGCTGCTGGA<br>GGAGTCGGATGGTGAGGGGGAGCCAGGCCAGGG<br>CGAGGGGCCGGAGGCTGGGGATGCCGAGGTCTG<br>TCCCACGCCCGCCCGCCTGGCCACCACAGAGAAG<br>AAGACGGA | 6 | LRWTQR* |
| 1900 | NM_0158<br>53.3_185 | 185 | GGCTGCTATAGAGCCGGGTGAGAGAGCGAGCGC<br>CCGTCGGCGGGTGTCGAGGGCGGGTTGCCTCGC<br>GCTGACCCTTCCCGCCCTCCTTCTCGTCACACACC<br>AGGTCCCCGCGGAAGCCGCGGTGTCGGCGCCAT<br>GGCGGAGCTGACGGCTCTTGAGAGTCTCATCGAG<br>ATGGGCTTCCCCAGGGACGCGCGGAGAAGGCTCT<br>GGCCCTCACAGGGAACCAGGGCATCGAGGCTGC<br>GATGGACTGGCTGATGGAGCACGAAGACGACCCC<br>GATGTGGACGAGCCTTTAGAGACTCCCCTTGGAC<br>ATATCCTGGGACGGGAGCCCACTTCCTCAGAGCA<br>AGGCGGCCTTGAAGGATCTGGTTCTGCTGCCGGA<br>GAAGGCAAACCCGCTTTGAGTGAAGAGGAAAGAC<br>AGGAACAAACTAAGAGGATGTTGGAGCTGGTGGC<br>CCAGAAGCAGCGGGAGCGTGAAGAAAGAGAGGAA<br>CGGGAGGCATTGGAACGGGAACGGCAGCGCAGG<br>AGACAAGGGCAAGAGTTGTCAGCAGCACGACAGC<br>GGCTACAGGAAGATGAGATGCGCCGGGCTGCTGA<br>GGAGAGGCGGAGGGAAAAGGCCGAGGAGTTAGC<br>AGCCAGACAAAGAGTTAGAGAAAAAGATCGAGAGG<br>GACAAAGCAGAGAGAGCCAAGAAGTATGGTGGCA<br>GTGTGGGCTCTCAGCCACCCCCAGTGGCACCAGA<br>GCCAGGTCCTGTTCCCTCTTCTCCCAGCCAGGAG<br>CCTCCCACCAAGCGGGAGTATGACCAGTGTCGCA<br>TACAGGTCAGGCTGCCAGATGGGACCTCACTGAC<br>CCAGACGTTCCGGGCCCGGGAACAGCTGGCAGCT<br>GTGAGGCTCTATGTGGAGCTCCACCGTGGGGAGG<br>AACTAGGTGGGGGCCAGGACCCTGTGCAATTGCT<br>CAGTGGCTTCCCCAGACGGGCCTTCTCAGAAGCT<br>GACATGGAGCGGCCTCTGCAGGAGCTGGGTATGG<br>CTGCAAGACTAGAAACCAGGACTAGAAACTGGGG<br>GAGTAGGGA | 21 | DARRRLW<br>PSQGTRAS<br>RLRWTG* |
| 1901 | NM_0158<br>53.3_224 | 224 | GGCTGCTATAGAGCCGGGTGAGAGAGCGAGCGC<br>CCGTCGGCGGGTGTCGAGGGCGGGTTGCCTCGC<br>GCTGACCCTTCCCGCCCTCCTTCTCGTCACACACC<br>AGGTCCCCGCGGAAGCCGCGGTGTCGGCGCCAT<br>GGCGGAGCTGACGGCTCTTGAGAGTCTCATCGAG<br>ATGGGCTTCCCCAGGGGACGCGCGGAGAAGGCT<br>CTGGCCCTCACAGGGAACCAGGCATCGAGGCTGC<br>GATGGACTGGCTGATGGAGCACGAAGACGACCCC<br>GATGTGGACGAGCCTTTAGAGACTCCCCTTGGAC<br>ATATCCTGGGACGGGAGCCCACTTCCTCAGAGCA | 8 | ASRLRWT<br>G* |

TABLE 3A-continued

| SEQ ID | identifier_position | position | modified_RNA | PAP length | PAP |
|---|---|---|---|---|---|
| | | | AGGCGGCCTTGAAGGATCTGGTTCTGCTGCCGGA<br>GAAGGCAAACCCGCTTTGAGTGAAGAGGAAAGAC<br>AGGAACAAACTAAGAGGATGTTGGAGCTGGTGGC<br>CCAGAAGCAGCGGGAGCGTGAAGAAAGAGAGGAA<br>CGGGAGGCATTGGAACGGGAACGGCAGCGCAGG<br>AGACAAGGGCAAGAGTTGTCAGCAGCACGACAGC<br>GGCTACAGGAAGATGAGATGCGCCGGGCTGCTGA<br>GGAGAGGCGGAGGGAAAAGGCCGAGGAGTTAGC<br>AGCCAGACAAAGAGTTAGAGAAAAGATCGAGAGG<br>GACAAAGCAGAGAGAGCCAAGAAGTATGGTGGCA<br>GTGTGGGCTCTCAGCCACCCCCAGTGGCACCAGA<br>GCCAGGTCCTGTTCCCTCTTCTCCCAGCCAGGAG<br>CCTCCCACCAAGCGGGAGTATGACCAGTGTCGCA<br>TACAGGTCAGGCTGCCAGATGGGACCTCACTGAC<br>CCAGACGTTCCGGGCCCGGGAACAGCTGGCAGCT<br>GTGAGGCTCTATGTGGAGCTCCACCGTGGGGAGG<br>AACTAGGTGGGGGCCAGGACCCTGTGCAATTGCT<br>CAGTGGCTTCCCCAGACGGGCCTTCTCAGAAGCT<br>GACATGGAGCGGCCTCTGCAGGAGCTGGGTATGG<br>CTGCAAGACTAGAAACCAGGACTAGAAACTGGGG<br>GAGTAGGGA | | |
| 1902 | NM_015853.3_346 | 346 | GGCTGCTATAGAGCCGGGTGAGAGAGCGAGCGC<br>CCGTCGGCGGGTGTCGAGGGCGGGTTGCCTCGC<br>GCTGACCCTTCCCGCCCTCCTTCTCGTCACACACC<br>AGGTCCCCGCGGAAGCCGCGGTGTCGGCGCCAT<br>GGCGGAGCTGACGGCTCTTGAGAGTCTCATCGAG<br>ATGGGCTTCCCCAGGGGACGCGCGGAGAAGGCT<br>CTGGCCCTCACAGGGAACCAGGGCATCGAGGCTG<br>CGATGGACTGGCTGATGGAGCACGAAGACGACCC<br>CGATGTGGACGAGCCTTTAGAGACTCCCCTTGGA<br>CATATCCTGGGACGGGAGCCCACTTCCTCAGAGC<br>AAGGCGGCTTGAAGGATCTGGTTCTGCTGCCGGA<br>GAAGGCAAACCCGCTTTGAGTGAAGAGGAAAGAC<br>AGGAACAAACTAAGAGGATGTTGGAGCTGGTGGC<br>CCAGAAGCAGCGGGAGCGTGAAGAAAGAGAGGAA<br>CGGGAGGCATTGGAACGGGAACGGCAGCGCAGG<br>AGACAAGGGCAAGAGTTGTCAGCAGCACGACAGC<br>GGCTACAGGAAGATGAGATGCGCCGGGCTGCTGA<br>GGAGAGGCGGAGGGAAAAGGCCGAGGAGTTAGC<br>AGCCAGACAAAGAGTTAGAGAAAAGATCGAGAGG<br>GACAAAGCAGAGAGAGCCAAGAAGTATGGTGGCA<br>GTGTGGGCTCTCAGCCACCCCCAGTGGCACCAGA<br>GCCAGGTCCTGTTCCCTCTTCTCCCAGCCAGGAG<br>CCTCCCACCAAGCGGGAGTATGACCAGTGTCGCA<br>TACAGGTCAGGCTGCCAGATGGGACCTCACTGAC<br>CCAGACGTTCCGGGCCCGGGAACAGCTGGCAGCT<br>GTGAGGCTCTATGTGGAGCTCCACCGTGGGGAGG<br>AACTAGGTGGGGGCCAGGACCCTGTGCAATTGCT<br>CAGTGGCTTCCCCAGACGGGCCTTCTCAGAAGCT<br>GACATGGAGCGGCCTCTGCAGGAGCTGGGTATGG<br>CTGCAAGACTAGAAACCAGGACTAGAAACTGGGG<br>GAGTAGGGA | 13 | KDLVLLPE<br>KANPL* |
| 1903 | NM_015853.3_485 | 485 | GGCTGCTATAGAGCCGGGTGAGAGAGCGAGCGC<br>CCGTCGGCGGGTGTCGAGGGCGGGTTGCCTCGC<br>GCTGACCCTTCCCGCCCTCCTTCTCGTCACACACC<br>AGGTCCCCGCGGAAGCCGCGGTGTCGGCGCCAT<br>GGCGGAGCTGACGGCTCTTGAGAGTCTCATCGAG<br>ATGGGCTTCCCCAGGGGACGCGCGGAGAAGGCT<br>CTGGCCCTCACAGGGAACCAGGGCATCGAGGCTG<br>CGATGGACTGGCTGATGGAGCACGAAGACGACCC<br>CGATGTGGACGAGCCTTTAGAGACTCCCCTTGGA<br>CATATCCTGGGACGGGAGCCCACTTCCTCAGAGC<br>AAGGCGGCCTTGAAGGATCTGGTTCTGCTGCCGG<br>AGAAGGCAAACCCGCTTTGAGTGAAGAGGAAAGA<br>CAGGAACAAACTAAGAGGATGTTGGAGCTGGTGG<br>CCCAGAAGCAGCGGGAGCGTGAAGAAAGAGAGG<br>AACGGGAGGCATGGAACGGGAACGGCAGCGCAG<br>GAGACAAGGGCAAGAGTTGTCAGCAGCACGACAG<br>CGGCTACAGGAAGATGAGATGCGCCGGGCTGCTG<br>AGGAGAGGCGGAGGGAAAAGGCCGAGGAGTTAG<br>CAGCCAGACAAAGAGTTAGAGAAAAGATCGAGAG<br>GGACAAAGCAGAGAGAGCCAAGAAGTATGGTGGC<br>AGTGTGGGCTCTCAGCCACCCCCAGTGGCACCAG<br>AGCCAGGTCCTGTTCCCTCTTCTCCCAGCCAGGA<br>GCCTCCCACCAAGCGGGAGTATGACCAGTGTCGC<br>ATACAGGTCAGGCTGCCAGATGGGACCTCACTGA<br>CCCAGACGTTCCGGGCCCGGGAACAGCTGGCAG | 40 | WNGNGSA<br>GDKGKSC<br>QQHDSGY<br>RKMRCAG<br>LLRRGGGK<br>RPRS* |

TABLE 3A-continued

| SEQ ID | identifier_position | position | modified_RNA | PAP length | PAP |
|---|---|---|---|---|---|
| | | | CTGTGAGGCTCTATGTGGAGCTCCACCGTGGGGA GGAACTAGGTGGGGGCCAGGACCCTGTGCAATTG CTCAGTGGCTTCCCCAGACGGGCCTTCTCAGAAG CTGACATGGAGCGGCCTCTGCAGGAGCTGGGTAT GGCTGCAAGACTAGAAACCAGGACTAGAAACTGG GGGAGTAGGGA | | |
| 1904 | NM_0159 13.2_381 | 381 | CGGGACCTGGACACCCAGAATCCACGAAAAGCAA CTCGCGCTCGAGAACAGCTCTCGTACCCTTCTACG TGATCTGCACCTTTAAGCTCACTCCATCCCAAACC GGACCCCGGAGGCACCACCCACATCCGTCTAACA TCACTTCCTTCAGAGTTTGAAAAAAAAAAATCTGGG AAGTAGAGGTGTTGTGCTGAGCGGCGCTCGGCGA ACTGTGTGGACCGTCTGCTGGGACTCCGGCCCTG CGTCCGCTCAGCCCCGTGGCCCCGCGCACCTACT GCCATGGAGACGCGGCCTCGTCTCGGGGCCACCT GTTTGCTGGGCTTCAGTTTCCTGCTCCTCGTCATC TCTTCTGATGGACATAATGGGCTTGGAAAGGGTTT GGAGATCATATTCATTGGAGGACACTGGAAGATGG GAAGAAAGAAGCAGCTGCCAGTGGACTGCCCCTG ATGGTGATTATTCATAAATCCTGGTGTGGAGCTTG CAAAGCTCTAAAGCCCAAATTTGCAGAATCTACGG AAATTTCAGAACTCTCCCATAATTTGTTATGGTAA ATCTTGAGGATGAAGAGGAACCCAAAGATGAAGAT TTCAGCCCTGACGGGGGTTATATTCCACGAATCCT TTTTCTGGATCCCAGTGGCAAGGTGCATCCTGAAA TCATCAATGAGAATGGAAACCCCAGCTACAAGTAT TTTTATGTCAGTGCCGAGCAAGTTGTTCAGGGGAT GAAGGAAGCTCAGGAAAGGCTGACGGGTGATGCC TTCAGAAAGAAACATCTTGAAGATGAATTGTAACAT GAATGTGCCCCTTCTTTCATCAGAGTTAGTGTTCT GGAAGGAAAGCAGCAGGGAAGGGAATATTGAGGA ATCATCTAGAACAATTAAGCCGACCAGGAAACCTC ATTCCTACCTACACTGGAAGGAGCGCTCTCACTGT GGAAGAGTTCTGCTAACAGAAGCTGGTCTGCATGT TTGTGGATCCAGCGGAGAGTGGCAGACTTTCTTCT CCTTTTCCCTCTCAC | 23 | LEIIFIGGH WKMGRKK QLPVDCP* |
| 1905 | NM_0159 13.2_546 | 546 | CGGGACCTGGACACCCAGAATCCACGAAAAGCAA CTCGCGCTCGAGAACAGCTCTCGTACCCTTCTACG TGATCTGCACCTTTAAGCTCACTCCATCCCAAACC GGACCCCGGAGGCACCACCCACATCCGTCTAACA TCACTTCCTTCAGAGTTTGAAAAAAAAAAATCTGGG AAGTAGAGGTGTTGTGCTGAGCGGCGCTCGGCGA ACTGTGTGGACCGTCTGCTGGGACTCCGGCCCTG CGTCCGCTCAGCCCCGTGGCCCCGCGCACCTACT GCCATGGAGACGCGGCCTCGTCTCGGGGCCACCT GTTTGCTGGGCTTCAGTTTCCTGCTCCTCGTCATC TCTTCTGATGGACATAATGGGCTTGGAAAGGGTTT GGAGATCATATTCATTGGAGGACACTGGAAGATG GGAAGAAAGAAGCAGCTGCCAGTGGACTGCCCCT GATGGTGATTATTCATAAATCCTGGTGTGGAGCTT GCAAAGCTCTAAAGCCCAAATTTGCAGAATCTACG GAAATTTCAGAACTCTCCCATAATTTGTTATGGTAA ATCTTGAGGATGAAGAGGAACCCAAAGATGAAGAT TTCAGCCCTGACGGGGGTTATATTCCACGAATCCT TTTTCTGGATCCCAGTGGCAAGGTGCATCCTGAAA TCATCAATGAGAATGGAAACCCCAGCTACAAGTAT TTTTATGTCAGTGCCGAGCAAGTTGTTCAGGGGAT GAAGGAAGCTCAGGAAAGGCTGACGGGTGATGCC TTCAGAAAGAAACATCTTGAAGATGAATTGTAACAT GAATGTGCCCCTTCTTTCATCAGAGTTAGTGTTCT GGAAGGAAAGCAGCAGGGAAGGGAATATTGAGGA ATCATCTAGAACAATTAAGCCGACCAGGAAACCTC ATTCCTACCTACACTGGAAGGAGCGCTCTCACTGT GGAAGAGTTCTGCTAACAGAAGCTGGTCTGCATGT TTGTGGATCCAGCGGAGAGTGGCAGACTTTCTTCT CCTTTTCCCTCTCAC | 3 | LLW* |
| 1906 | NM_0159 17.1_333 | 333 | GAAAAGGAGCTCCTGCTGCCACTGCTCTTCCGGA GCCTGCAGCATGGGGCCCTGCCGCGCACCGTG GAGCTCTTCTATGACGTGCTGTCCCCCTACTCCTG GCTGGGCTTCGAGATCCTGTGCCGGTATCAGAATA TCTGGAACATCAACCTGCAGTTGCGGCCCAGCCT CATAACAGGGATCATGAAAGACAGTGGAAACAAGC CTCCAGGTCTGCTTCCCCGCAAAGGACTATACATG GCAAATGACTTAAAGCCTCCTGAGACACCATCTCCA GATTCCCATCCACTTCCCCAAGGATTTCTTGTCTGT GATGCTTGAAAAAGGAAGTTGTCTGCCATGCGTTT CCTCACCGCCGTGAACTTGGAGCATCCAGAGATG | 9 | CLPCVSSP P* |

TABLE 3A-continued

| SEQ ID | identifier_position | position | modified_RNA | PAP length | PAP |
|---|---|---|---|---|---|
| | | | CTGGAGAAAGCGTCCCGGGAGCTGTGGATGCGC<br>GTCTGGTCAAGGAATGAAGACATCACCGAGCCGC<br>AGAGCATCCTGGCGGCTGCAGAGAAGGCTGGTAT<br>GTCTGCAGAACAAGCCCAGGGACTTCTGGAAAAG<br>ATCGCAACGCCAAAGGTGAAGAACCAGCTCAAGG<br>AGACCACTGAGGCAGCCTGCAGATACGGAGCCTT<br>TGGGTTGCCCATCACCGTGGCCCATGTGGATGGC<br>CAAACCCACATGTTATTTGGCTCTGACCGGATGGA<br>GCTGCTGGCGCACCTGCTGGGAGAGAAGTGGATG<br>GGCCCTATACCTCCAGCCGTGAATGCCAGACTTTA<br>AGATTGCCCGGAGGAAGCAAACTCTTCGTATAAAA<br>AAAGCAGGCCATCTGCTTAACCCTTGGCTCCACCA<br>TAAGGCACTGGGACTCGGATTTCTCTATCTGATAG<br>AGGTATTTTCTGTGGCCCTGGGAGCTGTCTGTCTT<br>TCCCCTACCCCCAAGGATGCCAGGAAGACGTCCA<br>CCATTAGCCATGTGGCAACCTTTACTTCTATGCCT<br>CACAAGTGCCTTTCAGAGAGCCCCAATTCTGCTTT<br>CCCACAAAATAAACCTAATGCCATCAGGCAAAAAA<br>AAAAAAAAAAAAAAA | | |
| 1907 | NM_0159 17.1_504 | 504 | GAAAAGGAGCTCCTGCTGCCACTGCTCTTCCGGA<br>GCCTGCAGCATGGGGCCCCTGCCGCGCACCGTG<br>GAGCTCTTCTATGACGTGCTGTCCCCCTACTCCTG<br>GCTGGGCTTCGAGATCCTGTGCCGGTATCAGAATA<br>TCTGGAACATCAACCTGCAGTTGCGGCCCAGCCT<br>CATAACAGGGATCATGAAAGACAGTGGAAACAAGC<br>CTCCAGGTCTGCTTCCCCGCAAAGGACTATACATG<br>GCAAATGACTTAAAGCTCCTGAGACACCATCTCCA<br>GATTCCCATCCACTTCCCCAAGGATTTCTTGTCTGT<br>GATGCTTGAAAAAGGAAGTTTGTCTGCCATGCGTT<br>TCCTCACCGCCGTGAACTTGGAGCATCCAGAGAT<br>GCTGGAGAAAGCGTCCCGGGAGCTGTGGATGCG<br>CGTCTGGTCAAGGAATGAAGACATCACCGAGCCG<br>CAGAGCATCCTGGCGGCTGCAGAGAAGGCTGGTA<br>TGTCTGCAGAACAAGCCCAGGGACTTCTGGAAAGA<br>TCGCAACGCCAAAGGTGAAGAACCAGCTCAAGGA<br>GACCACTGAGGCAGCCTGCAGATACGGAGCCTTT<br>GGGTTGCCCATCACCGTGGCCCATGTGGATGGCC<br>AAACCCACATGTTATTTGGCTCTGACCGGATGGAG<br>CTGCTGGCGCACCTGCTGGGAGAGAAGTGGATGG<br>GCCCTATACCTCCAGCCGTGAATGCCAGACTTTAA<br>GATTGCCCGGAGGAAGCAAACTCTTCGTATAAAAA<br>AAGCAGGCCATCTGCTTAACCCTTGGCTCCACCAT<br>AAGGCACTGGGACTCGGATTTCTCTATCTGATAGA<br>GGTATTTTCTGTGGCCCTGGGAGCTGTCTGTCTTT<br>CCCCTACCCCCAAGGATGCCAGGAAGACGTCCAC<br>CATTAGCCATGTGGCAACCTTTACTTCTATGCCTCA<br>CAAGTGCCTTTCAGAGAGCCCCAATTCTGCTTTCC<br>CACAAAATAAACCTAATGCCATCAGGCAAAAAAAA<br>AAAAAAAAAAAAA | 10 | DFWKRSQ RQR* |
| 1908 | NM_0159 32.3_199 | 199 | GGAAACGGAAGTGAGCGGCGGGGTCGACTGACG<br>GTAACGGGGCAGAGAGGCTGTTCGCAGAGCTGCG<br>GAAGATGAATGCCAGAGGACTTGGATCTGAGCTAA<br>AGGACAGTATTCCAGTTACTGAACTTTCAGCAAGT<br>GGACCTTTTGAAAGTCATGATCTTCTTCGGAAAGG<br>TTTTTCTTGTGTGAAAAATGAACTTTGCCTAGTCAT<br>CCCCTTGAATTATCAGAAAAAAATTTCCAGCTCAAC<br>CAAGATAAAATGAATTTTTCCACACTGAGAAACATT<br>CAGGGTCTATTTGCTCCGCTAAAATTACAGATGGA<br>ATTCAAGGCAGTGCAGCAGGTTCAGCGTCTTCCAT<br>TTCTTTCAAGCTCAAATCTTTCACTGGATGTTTTGA<br>GGGGTAATGATGAGACTATTGGATTTGAGGATATT<br>CTTAATGATCCATCACAAAGCGAAGTCATGGGAGA<br>GCCACACTTGATGGTGGAATATAAACTTGGTTTAC<br>TGTAATAGTGTGCTGTTCATGGAAACCGAGGGCTG<br>CATCTTGTTTATAGTCATCTTTGTACTGTAATTTGAT<br>GTACACAACATTAAAAGTACTGACACCTGAGAATTT<br>CTGCTCAAGTAGTATCAGTGATCATTTAAAATTTGG<br>AGGGGTCTTTGGTTTACAGCCATGTGACAATTAAA<br>AGCACTAAAGGGAGATCATGTTAAAGCTCTTAATTT<br>ATATTAAAACAGTAGCCTTTGTCTTTAAAAAAGTTG<br>TTGCTCATGAATATTATAAAATGATCTACAGGTTTC<br>AATTCAACCTGTTTCTAGGTTTTTTTGTAAATTTAGT<br>TTTGATTAAGCATTATAAGCATTTGAGTCTATAAAC<br>TTTATAGTAGCATCTTTCAGAATAAACATTTTTAATT<br>GATTTCAGTGGCAACTCTCAAATTGATTACAATATG<br>AGATATATCAGTGTCGTCCATTAACACTCATAAGAA | 19 | CLVIPLNY QKKISSST KIK* |

TABLE 3A-continued

| SEQ ID | identifier_ position | position | modified_RNA | PAP length | PAP |
|---|---|---|---|---|---|
| 1909 | NM_0159 32.3_385 | 385 | TAATATTTACTGTGTCAGTGCTATTTTAGGATTATA GTTATTGTTTGATTATTTCAGGTTGAAA GGAAACGGAAGTGAGCGGCGGGGTCGACTGACG GTAACGGGGCAGAGAGGCTGTTCGCAGAGCTGCG GAAGATGAATGCCAGAGGACTTGGATCTGAGCTAA AGGACAGTATTCCAGTTACTGAACTTTCAGCAAGT GGACCTTTTGAAAGTCATGATCTTCTTCGGAAAGG TTTTTCTTGTGTGAAAAATGAACTTTTGCCTAGTCA TCCCCTTGAATTATCAGAAAAAAATTTCCAGCTCAA CCAAGATAAAATGAATTTTTCCACACTGAGAAACAT TCAGGGTCTATTTGCTCCGCTAAAATTACAGATGG AATTCAAGGCAGTGCAGCAGGTTCAGCGTCTTCCA TTTCTTTCAAGCTCAAATCTTTCACTGGATGTTTGA GGGGTAATGATGAGACTATTGGATTTGAGGATATT CTTAATGATCCATCACAAAGCGAAGTCATGGGAGA GCCACACTTGATGGTGGAATATAAACTTGGTTTAC TGTAATAGTGTGCTGTTCATGGAAACCGAGGGCTG CATCTTGTTTATAGTCATCTTTGTACTGTAATTTGAT GTACACAACATTAAAAGTACTGACACCTGAGAATTT CTGCTCAAGTAGTATCAGTGATCATTTAAAATTTGG AGGGGTCTTTGGTTTACAGCCATGTGACAATTAAA AGCACTAAAGGGAGATCATGTTAAAGCTCTTAATTT ATATTAAAACAGTAGCCTTTGTCTTTAAAAAAGTTG TTGCTCATGAATATTATAAAATGATCTACAGGTTTC AATTCAACCTGTTTCTAGGTTTTTTTGTAAATTTAGT TTTGATTAAGCATTATAAGCATTTGAGTCTATAAAC TTTATAGTAGCATCTTTCAGAATAAACATTTTTAATT GATTTCAGTGGCAACTCTCAAATTGATTACAATATG AGATATATCAGTGTCGTCCATTAACACTCATAAGAA TAATATTTACTGTGTCAGTGCTATTTTAGGATTATA GTTATTGTTTGATTATTTCAGGTTGAAA | 0 | * |
| 1910 | NM_0159 59.1_274 | 274 | GGGGCGAGACCTACGACGCCGGCGAGCAGTGGC CGTTACGCCTAAAAAGATGGCGGTCTTGGCACCTC TAATTGCTCTCGTGTATTCGGTGCCGCGACTTTCA CGATGGCTCGCCCAACCTTACTACCTTCTGTCGGC CCTGCTCTCTGCTGCCTTCCTACTCGTGAGGAAAC TGCCGCCGCTCTGCCACGGTCTGCCCACCCAACG CGAAGACGGTAACCCGTGTGACTTTGACTGGAGA GAAGTGGAGATCCTGATGTTTCTCAGTGCCATGTG ATGATGAAGAACCGCAGATCCATCACTGTGGAGCA ACATATAGGCAACATTTTCATGTTTAGTAAAGTGGC CAACACAATTCTTTTCTTCCGCTTGGATATTCGCAT GGGCCTACTTTACATCACACTCTGCATAGTGTTCC TGATGACGTGCAAACCCCCCCTATATATGGGCCCT GAGTATATCAAGTACTTCAATGATAAAACCATTGAT GAGGAACTAGAACGGGACAAGAGGGTCACTTGGA TTGTGGAGTTCTTTGCCAATTGGTCTAATGACTGC CAATCATTTGCCCCTATCTATGCTGACCTCTCCCTT AAATACAACTGTACAGGGCTAAATTTTGGGAAGGT GGATGTTGGACGCTATACTGATGTTAGTACGCGGT ACAAAGTGAGCACATCACCCCTCACCAAGCAACTC CCTACCCTGATCCTGTTCCAAGGTGGCAAGGAGG CAATGCGGCGGCCACAGATTGACAAGAAAGGACG GGCTGTCTCATGGACCTTCTCTGAGGAGAATGTGA TCCGAGAATTTAACTTAAATGAGCTATACCAGCGG GCCAAGAAACTATCAAAGGCTGGAGACAATATCCC TGAGGAGCAGCCTGTGGCTTCAACCCCCACCACA GTGTCAGATGGGGAAAACAAGAAGGATAAATAAGA TCCTCACTTTGGCAGTGCTTCCTCTCCTGTCAATTC CAGGCTCTTTCCATAACCACAAGCCTGAGGTGCAG CTTTTATTTATG | 1 | M* |
| 1911 | NM_0160 26.2_411 | 411 | GCTGGAGCATCCCGCTCTGGTGCCGCTGCAGCCG GCAGAGATGGTTGAGCTCATGTTCCCGCTGTTGCT CCTCCTTCTGCCCTTCCTTCTGTATATGGCTGCGC CCCAAATCAGGAAAATGCTGTCCAGTGGGGTGTG TACATCAACTGTTCAGCTTCCTGGGAAAGTAGTTG TGGTCACAGGAGCTAATACAGGTATCGGGAAGGA GACAGCCAAAGAGCTGGCTCAGAGAGGAGCTCGA GTATATTTAGCTTGCCGGGATGTGGAAAAGGGGG AATTGGTGGCCAAAGAGATCCAGACCACGACAGG GAACCAGCAGGTGTTGGTGCGGAAACTGGACCTG TCTGATACTAAGTCTATTCGAGCTTTTGCTAAGGG CTTCTTAGCTGAGGAAAAGCACCTCCACGTTTGAT CAACAATGCAGGAGTGATGATGTGTCCGTACTCGA AGACAGCAGATGGCTTTGAGATGCACATAGGAGT CAACCACTTGGGTCACTTCCTCCTAACCCATCTGC TGCTAGAGAAACTAAAGGAATCAGCCCCCATCAAGG | 0 | * |

TABLE 3A-continued

| SEQ ID | identifier_position | position | modified_RNA | PAP length | PAP |
|---|---|---|---|---|---|
| | | | ATAGTAAATGTGTCTTCCCTCGCACATCACCTGGG AAGGATCCACTTCCATAACCTGCAGGGCGAGAAAT TCTACAATGCAGGCCTGGCCTACTGTCACAGCAAG CTAGCCAACATCCTCTTCACCCAGGAACTGGCCC GGAGACTAAAAGGCTCTGGCGTTACGACGTATTCT GTACACCCTGGCACAGTCCAATCTGAACTGGTTCG GCACTCATCTTTCATGAGATGGATGTGGTGGCTTT TCTCCTTTTTCATCAAGACTCCTCAGCAGGGAGCC CAGACCAGCCTGCACTGTGCCTTAACAGAAGGTCT TGAGATTCTAAGTGGGAATCATTTCAGTGACTGTC ATGTGGCATGGGTGTCTGTCCAAGCTCGTAATGAG ACTATAGCAAGGCGGCTGTGGGACGTCAGTTGTG ACCTGCTGGGCCTCCCAATAGACTAACAGGCAGT GCCAGTTGGACCCAAGAGAA | | |
| 1912 | NM_0160 39.1_637 | 637 | GCGGCCACCGTTTTAACCACGATTGGCGAAGCGC CGTCATTTCGGAGCGACTCAGCGCCTGCCCGCCC TCTCGCCGCGTCGCCGGTGCCTGCGCCTCCCGCT CCACCTCGCTTCTTCTCTCCCGGCCGAGGCCCGG GGGACCAGAGCGAGAAGCGGGGACCATGTTCCG ACGCAAGTTGACGGCTCTCGACTACCACAACCCC GCCGGCTTCAACTGCAAAGATGAAACAGAATTTAG AAACTTCATCGTTTGGCTTGAAGACCAGAAAATCA GGCACTACAAGATTGAAGACAGAGGGAATTTAAGA AACATCCACAGCAGCGACTGGCCCAAGTTCTTTGA AAAGTATCTCAGAGATGTTAACTGTCCTTTCAAGAT TCAAGATCGACAAGAAGCTATTGACTGGCTTCTTG GTTTAGCTGTTAGACTTGAATATGGAGATAATGCT GAAAAATACAAGGATTTAGTACCTGATAATTCAAAA ACTGCTGACAATGCAACTAAAAATGCAGAACCATT GATCAATTTGGATGTAAATAATCCTGATTTTAAGGC TGGTGTGATGGCTTTGGCTAACCTGCTTCAGATTC AGCGTCATGATGATTACCTGGTAATGCTTAAGGCA ATTCGGATTTGGTTCAGGAGCGCCTGACACAGGAT GCAGTTGCTAAGGCAAATCAAACAAAAGAGGGCTT ACCTGTTGCTTTAGACAAACATATTCTTGGTTTTGA CACAGGAGATGCAGTTCTTAATGAAGCTGCTCAAA TTCTGCGATTGCTGCACATAGAGGAGCTCAGAGA GCTACAGACAAAAATCAACGAAGCCATAGTAGCTG TTCAGGCAATTATTGCTGATCCAAAGACAGACCAC AGACTGGGAAAAGTTGGAAGATGAACACTTGAGG ACTTCAGCTTCTCACCTACTTAGTACAGTTGGGAA CCATACACTTCTGGCATGTTTGGAAATCAAAATGT CACATTCTCGGGGGAGGAAGCCCAGAAAATTGGG TATGTTCTAGAGATT | 5 | WFRSA* |
| 1913 | NM_0160 65.3_341 | 341 | ATTGTGGGAAGTATAGGGCGGCAAGCGGAGGAGG CGTGGCGAGCGGATCATCCGCTTCCGGAGTCGAG GTTTTCGGGCTTGTACCGCTTGGCGGTGCGGCCT GGTGTCGGCTTGCAGGTTCTTTCTGTGTTTGTTCT CTGCCCTGCCAAGGCCGTAGAGCTGGTGCGTGCG GGTAGCGGGGCTCTCCGAGGAGCCGCACGCCGG CGGCACCATGGTCCACCTCACTACTCTCCTCTGCA AGGCCTACCGTGGGGGCCACTTAACCATCCGCCT TGCCCTGGGTGGCTGCACCAATCGGCCGTTCTAC CGCATTGTGGCTGCTCACAACAAGTGTCCCAGGAT GGCCGTTTCGTAGAGCAGCTGGGCTCCTATGATC CATTGCCCAACAGTCATGGAGAAAAACTCGTTGCC CTCAACCTAGACAGGATCCGTCATTGGATTGGCTG CGGGGCCCACCTCTCTAAGCCTATGGAAAAGCTT CTGGGTCTTGCTGGCTTTTTCCCTCTGCATCCTAT GATGATCACAAATGCTGAGAGACTGCGAAGGAAA CGGGCACGTGAAGTCCTGTTAGCTTCTCAGAAAAC AGATGCAGAAGCTACAGATACAGAGGCTACAGAAA CATAAATGAGCTGACTTTAGTGAGCATAGCAGTGG GAACAAGGTCAAGGTCCTTTTGAAACACTGCAGCG ATCTTAATTTTGTTAGATTTGGAGTTCAATAAATGG AGTATCCTGAGTTGCCCTTGCTCTTCTGGCCTGGC CTGCACAGGGCCCAGGGAGAGATTTGTTCTTGTGT GACTTAGAGCTGGGTGTGGGTACTAATTAGCTTTT TTCGACTTTGTCTTGGGATAGACAGTGGCTATGGG AGGATTGGACTTTTGAGTTGGGCTCTGGGTCTCTT GGACAACTTTACAATTTACTGGCTTCCAAGACTTCC TGCTTCAAAACCCCCAGCCAGACTATTCATGGCCC ATTCAGATCTTCATGTTCATCCCACAAGTGCAAGA ACAGTTAACCTTTCTTAA | 4 | MAVS* |

TABLE 3A-continued

| SEQ ID | identifier_position | position | modified_RNA | PAP length | PAP |
|---|---|---|---|---|---|
| 1914 | NM_016078.4_407 | 407 | GAAGTAGGGCTGGCGTAGGGCCCGCCATGTTGCAG CAGGATAGTAATGATGACACTGAAGATGTTTCACT GTTTGATGCGGAAGAGGAGACGACTAATAGACCA AGAAAAGCCAAAATCAGACATCCAGTAGCATCGTT TTTCCACTTATTCTTTCGAGTCAGTGCAATCATCGT CTATCTTCTCTGTGGGTTGCTCAGCAGCAGCTTTA TTACCTGTATGGTGACAATTATCTTGTTGTTGTCGT GTGACTTTTGGGCAGTGAAGAATGTCACAGGTAGA CTAATGGTTGGCCTACGTTGGTGGAATCACATTGA TGAAGATGGAAAGAGCCATTGGGTGTTTGAATCTA GAAAGGAGTCCTCTCAAGAGAATAAAACTGTGTCA GAGGCTGAATCAAGAATCTTTGGTTGGGACTTATT GCCTGTCCAGTACTGTGGGTGATATTTGCTTTTAG TGCACTCTTCTCCTTCAGAGTAAAGTGGTTGGCGG TGGTTATCATGGGTGTGGTGCTACAAGGTGCCAAC CTGTATGGTTACATCAGGTGTAAGGTGCGCAGCA GAAAGCATTTAACCAGCATGGCTACTTCATATTTTG GAAAGCAGTTTTTAAGACAAAACACTGGAGATGAT CAGACTTCCTGAATAGAGAAAGCTTATGTGCTTTG TTACATTGGGGAACAACTGAAGAGATTCTTGACTC AACCTTTTAGAGCTTAGTCCATGTTGCAACGAGGA GTGTTGGCTTTGTTTTTCCACTTAAAAACTTTATTTA TAAAAAGGAAAAGTAGTTTTCATATTAAGTTTTTATT TCCTTTCCAGCAGTTGGGGCTAGAAAGTATGTGTT GGCACTAGAAACATTGTCAAGATTTGTTCTGTGGT GTAGGTATGCACATTCCATAGGTATGCACACGGCC ATGTAATATCAGTATATCCCAAGTTAATGAAAGTGT TCATTTACATAGGTAATGGAGACCTTTGCATTTTGA TCCATAGAACATAGGAGGATGTTCTTAGTCTGTCT CAA | 11 | GWDLLPV QYCG* |
| 1915 | NM_016091.2_702 | 702 | CCGAGTGGGGCTGAACTTCCGGCCTCAGGACGCA GGCGCGGGCCGCTCATTTCGCTCTTTCCGGCGGT GCTCGCAAGCGAGGCAGCCATGTCTTATCCCGCT GATGATTATGAGTCTGAGGCGGCTTATGACCCCTA CGCTTATCCCAGCGACTATGATATGCACACAGGAG ATCCAAAGCAGGACCTTGCTTATGAACGTCAGTAT GAACAGCAAACCTATCAGGTGATCCCTGAGGTGAT CAAAAACTTCATCCAGTATTTCCACAAAACTGTCTC AGATTTGATTGACCAGAAAGTGTATGAGCTACAGG CCAGTCGTGTCTCCAGTGATGTCATTGACCAGAAG GTGTATGAGATCCAGGACATCTATGAGAACAGCTG GACCAAGCTGACTGAAAGATTCTTCAAGAATACAC CTTGGCCCGAGGCTGAAGCCATTGCTCCACAGGT TGGCAATGATGCTGTCTTCCTGATTTTATACAAAGA ATTATACTACAGGCACATATATGCCAAAGTCAGTG GGGGACCTTCCTTGGAGCAGAGGTTTGAATCCTAT TACAACTACTGCAATCTCTTCAACTACATTCTTAAT GCCGATGGTCCTGCTCCCCTTGAACTACCCAACCA GTGGCTCTGGGATATTATCGATGAGTTCATCTACC AGTTTCAGTCATTCAGTCAGTACCGCTGTAAGACT GCAAGAAGTCAGAGGAGGAGATTGACTTTCTTCGT TCCAATCCCAAAATCTGGAATGTTCATAGTGTCCTC AATGTCCTTCATTCCCTGGTAGACAAATCCAACAT CAACCGACAGTTGGAGGTATACACAAGCGGAGGT GACCCTGAGAGTGTGGCTGGGGAGTATGGGCGG CACTCCCTCTACAAAATGCTTGGTTACTTCAGCCT GGTCGGGCTTCTCCGCCTGCACTCCCTGTTAGGA GATTACTACCAGGCCATCAAGGTGCTGGAGAACAT CGAACTGAACAAGAAGAGTATGTATTCCCGTGTGC CAGAGTGCCAGGT | 29 | RSQRRRLT FFVPIPKS GMFIVSSM SFIPW* |
| 1916 | NM_016091.2_723 | 723 | CCGAGTGGGGCTGAACTTCCGGCCTCAGGACGCA GGCGCGGGCCGCTCATTTCGCTCTTTCCGGCGGT GCTCGCAAGCGAGGCAGCCATGTCTTATCCCGCT GATGATTATGAGTCTGAGGCGGCTTATGACCCCTA CGCTTATCCCAGCGACTATGATATGCACACAGGAG ATCCAAAGCAGGACCTTGCTTATGAACGTCAGTAT GAACAGCAAACCTATCAGGTGATCCCTGAGGTGAT CAAAAACTTCATCCAGTATTTCCACAAAACTGTCTC AGATTTGATTGACCAGAAAGTGTATGAGCTACAGG CCAGTCGTGTCTCCAGTGATGTCATTGACCAGAAG GTGTATGAGATCCAGGACATCTATGAGAACAGCTG GACCAAGCTGACTGAAAGATTCTTCAAGAATACAC CTTGGCCCGAGGCTGAAGCCATTGCTCCACAGGT TGGCAATGATGCTGTCTTCCTGATTTTATACAAAGA ATTATACTACAGGCACATATATGCCAAAGTCAGTG GGGGACCTTCCTTGGAGCAGAGGTTTGAATCCTAT TACAACTACTGCAATCTCTTCAACTACATTCTTAAT | 23 | MTFFVPIP KSGMFIVS SMSFIPW* |

TABLE 3A-continued

| SEQ ID | identifier_position | position | modified_RNA | PAP length | PAP |
|---|---|---|---|---|---|
| | | | GCCGATGGTCCTGCTCCCCTTGAACTACCCAACCA GTGGCTCTGGGATATTATCGATGAGTTCATCTACC AGTTTCAGTCATTCAGTCAGTACCGCTGTAAGACT GCCAAGAAGTCAGAGGAGGAGATGACTTTCTTCGT TCCAATCCCAAAATCTGGAATGTTCATAGTGTCCTC AATGTCCTTCATTCCCTGGTAGACAAATCCAACAT CAACCGACAGTTGGAGGTATACACAAGCGGAGGT GACCCTGAGAGTGTGGCTGGGGAGTATGGGCGG CACTCCCTCTACAAAATGCTTGGTTACTTCAGCCT GGTCGGGCTTCTCCGCCTGCACTCCCTGTTAGGA GATTACTACCAGGCCATCAAGGTGCTGGAGAACAT CGAACTGAACAAGAAGAGTATGTATTCCCGTGTGC CAGAGTGCCAGGT | | |
| 1917 | NM_016101.3_479 | 479 | CTATGCTTTCTCATCCGGCCGGCTTGCTTTCCCCT GCGGTCGTCCAGACTATTGGGCGCTAGCGAGACG AACTATTGGTACGGGGCTAGAGAGGAAGGCTTTG GGATTGCCGGGGAGCAGCGAGCGACCGACTTCC GTTTCCAGTTACCAAGGCACGAGGATCCGGTGTTC CAACCCAGGGGGAAAAATGCGGCCTTTGACTGAA GAGGAGACCCGTGTCATGTTTGAGAAGATAGCGA AATACATTGGGGAGAATCTTCAACTGCTGGTGGAC CGGCCCGATGGCACCTACTGTTTCCGTCTGCACAA CGACCGGGTGTACTATGTGAGTGAGAAGATTATGA AGCTGGCCGCCAATATTTCCGGGGACAAGCTGGT GTCGCTGGGGACCTGCTTTGGAAAATTCACTAAAA CCCACAAGTTTCGGTTGCACGTCACAGCTCTGGAT TACCTTGCACCTTATGCCAAGTATAAAGTTGGATAA AGCCTGGTGCAGAGCAGTCCTTCCTGTATGGGAA CCATGTGTTGAAATCTGGTCTGGGTCGAATCACTG AAAATACTTCTCAGTACCAGGGCGTGGTGGTGTAC TCCATGGCAGACATCCCTTTGGGTTTTGGGGTGGC AGCCAAATCTACACAAGACTGCAGAAAAGTAGACC CCATGGCCGATTGTGGTATTTCATCAAGCAGACATT GGGGAATATGTGCGGCATGAAGAGACGTTGACTT AAAACGAAGCCATTCCAAGGACAGACGGCTGTAT GGAAAGGCCGAGCTTTGTTTCCTGTGTTTGTGTGG ACTCCACCATCATGTTGAATTTTGTCAACACTCTGG CCTCTTCAGGGACTTCTTATTTACTGTACTCTCTAT CACTGACAAATGCAGGCTGGATTCTTATTATATACA GAGATGGCTCAAAAATGGGGTTTCAGATCTTTGTG ACGAAATAGAATACTGTTTCATATTTGAATCAGAGG GCTTCTTGTTCTGAGAAATAGGTTCAAAATCATTGG AACCAGGAACAAG | 1 | G* |
| 1918 | NM_016139.2_467 | 467 | CCATCTTCCGGTCTCCTCAGAAGTCGCTTAGCTCT TCGGTGGTTGTCCCACGTCCGGAGGCCTAGCCGT CGCTTACCTAGGATGCCGCGTGGAAGCCGAAGCC GCACCTCCCGCATGGCCCCTCCGGCCAGCCGGG CCCCTCAGATGAGAGCTGCACCCAGGCCAGCACC AGTCGCTCAGCCACCAGCAGCGGCACCCCCATCT GCAGTTGGCTCTTCTGCTGCTGCGCCCCGGCAGC CAGGTCTGATGGCCCAGATGGCAACCACTGCAGC TGGCGTGGCTGTGGGCTCTGCTGTGGGGCACACA TTGGGTCACGCCATTACTGGGGGCTTCAGTGGAG GAAGTAATGCTGAGCCTGCGAGGCCTGACATCAC TTACCAGGAGCCTCAGGGAACCCAGCCAGCACAG CAGCAGCAGCCTTGCCTCTATGAGATCAAACAGTT TCTGGAGTGTGCCCAGAACCAGGTGACATCAAGC TCTGTGAGGGTTTCAATGAGGTGCTGAAACAGTGC CGACTTGCAAACGGATTGGCCTAATGAAGAAGTTC AACCTGGAGAGATGGAAAATCAGCTCTCATAACTA AGTTAATTTAGTATAAAAATAGAATTGATAGTGAGG GTATAAAGTGTAACCATCAGTTAAACCTCTCCTGTC ATTCCTGGCTTCCTTGCTTCAGAATTGAAATGGAA GTGGGGGTGTCCCTACTCTGTAGAATCTGGGACT GGGCAAATGTTTGTGTGGCCTCCTTAAACTAGCTG TTATGTTATGATTTATTCTTTGTGAGTTAATTAGAA TAAAGTCATTTTCTTCCAAAAAAAAAAAAAAAAAA | 12 | VTSSSVRV SMRC* |
| 1919 | NM_016185.2_345 | 345 | GGCTTAGGCTGAGCCGTGGCCGCCACAGCCCATC GTAATGCCGCATGGTGCTTGGCACTCCAGAGAGC CAATAGGAATGAAAGAATTCATTTGAATCGGCCAA TGCCGGCGGGTTAGGGGCGGGGGTTGAAAAACC CTATAAAGGCGTCGATCGGCCGGACAGGCGGCAG CGGCGGCTCCTGCAGCGGTGGTCGGCTGTTGGGT GTGGAGTTTCCCAGCGCCCCTCGGGTCCGACCCT TTGAGCGTTCTGCTCCGGCGCCAGCCTACCTCGC TCCTCGGCGCCATGACCACAACCACCACCTTCAA GGGAGTCGACCCCAACAGCAGGAATAGCTCCCGA | 11 | CGLQVVDP IFH* |

TABLE 3A-continued

| SEQ ID | identifier_position | position | modified_RNA | PAP length | PAP |
|---|---|---|---|---|---|
| | | | GTTTGCGGCCTCCAGGTGGTGGATCCAATTTTTCA<br>TTAGGTTTTGATGAACCAACAGAACAACCTGTGAG<br>GAAGAACAAAATGGCCTCTAATATCTTTGGGACAC<br>CTGAAGAAAATCAAGCTTCTTGGGCCAAGTCAGCA<br>GGTGCCAAGTCTAGTGGTGGCAGGGAAGACTTGG<br>AGTCATCTGGACTGCAGAGAAGGAACTCCTCTGAA<br>GCAAGCTCCGGAGACTTCTTAGATCTGAAGGGAG<br>AAGGTGATATTCATGAAAATGTGGACACAGACTTG<br>CCAGGCAGCCTGGGGCAGAGTGAAGAGAAGCCC<br>GTGCCTGCTGCGCCTGTGCCCAGCCCGGTGGCCC<br>CGGCCCCAGTGCCATCCAGAAGAAATCCCCCTGG<br>CGGCAAGTCCAGCCTCGTCTTGGGTTAGCTCTGA<br>CTGTCCTGAACGCTGTCGTTCTGTCTGTTTCCTCC<br>ATGCTTGTGAACTGCACAACTTGAGCCTGACTGTA<br>CATCTCTTGGATTTGTTTCATTAAAAAGAAGCACTT<br>TATGTACTGCTGTCTTTTTTTTTTTCTTTTGAAGAA<br>CAGGTTTCTCTCTGTCCTTGACTCTTGGGTCTGTG<br>GGCCATGGCATGAGTGTTTTCTAGTAGTAGATTGG<br>AGGGAAAGCTTTGTGACACTTAGTACTGTGTTTTA<br>AGAAGAAATAATTTGGTTCCAG | | |
| 1920 | NM_0161<br>85.2_385 | 385 | GGCTTAGGCTGAGCCGTGGCCGCCACAGCCCATC<br>GTAATGCCGCATGGTGCTTGGCACTCCAGAGAGC<br>CAATAGGAATGAAAGAATTCATTTGAATCGGCCAA<br>TGCCGGCGGGTTAGGGGCGGGGGTTGAAAACC<br>CTATAAAGGCGTCGATCGGCCGGACAGGCGGCAG<br>CGGCGGCTCCTGCAGCGGTGGTCGGCTGTTGGGT<br>GTGGAGTTTCCCAGCGCCCCTCGGGTCCGACCCT<br>TTGAGCGTTCTGCTCCGGCGCCAGCCTACCTCGC<br>TCCTCGGCGCCATGACCACAACCACCACCTTCAA<br>GGGAGTCGACCCCAACAGCAGGAATAGCTCCCGA<br>GTTTTGCGGCCTCCAGGTGGTGGATCCAATTTTTC<br>ATTAGGTTTTGATGAACCAACAGAACAACCTGTGAG<br>GAAGAACAAAATGGCCTCTAATATCTTTGGGACAC<br>CTGAAGAAAATCAAGCTTCTTGGGCCAAGTCAGCA<br>GGTGCCAAGTCTAGTGGTGGCAGGGAAGACTTGG<br>AGTCATCTGGACTGCAGAGAAGGAACTCCTCTGAA<br>GCAAGCTCCGGAGACTTCTTAGATCTGAAGGGAG<br>AAGGTGATATTCATGAAAATGTGGACACAGACTTG<br>CCAGGCAGCCTGGGGCAGAGTGAAGAGAAGCCC<br>GTGCCTGCTGCGCCTGTGCCCAGCCCGGTGGCCC<br>CGGCCCCAGTGCCATCCAGAAGAAATCCCCCTGG<br>CGGCAAGTCCAGCCTCGTCTTGGGTTAGCTCTGA<br>CTGTCCTGAACGCTGTCGTTCTGTCTGTTTCCTCC<br>ATGCTTGTGAACTGCACAACTTGAGCCTGACTGTA<br>CATCTCTTGGATTTGTTTCATTAAAAAGAAGCACTT<br>TATGTACTGCTGTCTTTTTTTTTTTCTTTTGAAGAA<br>CAGGTTTCTCTCTGTCCTTGACTCTTGGGTCTGTG<br>GGCCATGGCATGAGTGTTTTCTAGTAGTAGATTGG<br>AGGGAAAGCTTTGTGACACTTAGTACTGTGTTTTA<br>AGAAGAAATAATTTGGTTCCAG | 8 | LMNQQNN<br>L* |
| 1921 | NM_0161<br>85.2_693 | 693 | GGCTTAGGCTGAGCCGTGGCCGCCACAGCCCATC<br>GTAATGCCGCATGGTGCTTGGCACTCCAGAGAGC<br>CAATAGGAATGAAAGAATTCATTTGAATCGGCCAA<br>TGCCGGCGGGTTAGGGGCGGGGGTTGAAAACC<br>CTATAAAGGCGTCGATCGGCCGGACAGGCGGCAG<br>CGGCGGCTCCTGCAGCGGTGGTCGGCTGTTGGGT<br>GTGGAGTTTCCCAGCGCCCCTCGGGTCCGACCCT<br>TTGAGCGTTCTGCTCCGGCGCCAGCCTACCTCGC<br>TCCTCGGCGCCATGACCACAACCACCACCTTCAA<br>GGGAGTCGACCCCAACAGCAGGAATAGCTCCCGA<br>GTTTTGCGGCCTCCAGGTGGTGGATCCAATTTTTC<br>ATTAGGTTTTGATGAACCAACAGAACAACCTGTGA<br>GGAAGAACAAAATGGCCTCTAATATCTTTGGGACA<br>CCTGAAGAAAATCAAGCTTCTTGGGCCAAGTCAGC<br>AGGTGCCAAGTCTAGTGGTGGCAGGGAAGACTTG<br>GAGTCATCTGGACTGCAGAGAAGGAACTCCTCTG<br>AAGCAAGCTCCGGAGACTTCTTAGATCTGAAGGGA<br>GAAGGTGATATTCATGAAAATGTGGACACAGACTT<br>GCCAGGCAGCCTGGGGCAGAGTGAAGAGAAGCC<br>CGTGCCTGCTGCGCCTGTGCCCAGCCCGGTGGCC<br>CCGGCCCCAGTGCCATCCAGAAGAAATCCCCCTGG<br>CGGCAAGTCCAGCCTCGTCTTGGGTTAGCTCTGA<br>CTGTCCTGAACGCTGTCGTTCTGTCTGTTTCCTCC<br>ATGCTTGTGAACTGCACAACTTGAGCCTGACTGTA<br>CATCTCTTGGATTTGTTTCATTAAAAAGAAGCACTT<br>TATGTACTGCTGTCTTTTTTTTTTTCTTTTGAAGAA<br>CAGGTTTCTCTCTGTCCTTGACTCTTGGGTCTGTG | 51 | QCHPEEIP<br>LAASPASS<br>WVSSDCP<br>ERCRSVCF<br>LHACELHN<br>LSLTVHLL<br>DLFH* |

TABLE 3A-continued

| SEQ ID | identifier_position | position | modified_RNA | PAP length | PAP |
|---|---|---|---|---|---|
| | | | GGCCATGGCATGAGTGTTTTCTAGTAGTAGATTGG AGGGAAAGCTTTGTGACACTTAGTACTGTGTTTTA AGAAGAAATAATTTGGTTCCAG | | |
| 1922 | NM_0162 37.3_460 | 460 | CCTTGTGGTGACAACTGGCGGCAGCGCGCCGCG GGCCCGAGACTTAGTCTCGGGCCGCCATGGCCAG CGTCCACGAGAGCCTCTACTTCAATCCCATGATGA CCAATGGGGTTGTGCACGCCAATGTGTTCGGCAT CAAGGACTGGGTGACGCCGTACAAGATCGCGGTG CTGGTGCTGCTGAACGAGATGAGCCGCACAGGCG AGGGCGCCGTCAGCCTCATGGAGCGGCGGAGGC TCAACCAGCTGCTCCTGCCCCTGCTGCAGGGCCC AGATATTACACTGTCAAAACTTTACAAGTTAATTGA AGAGTCTTGTCCACAGCTGGCAAATTCAGTGCAGA TCAGAATCAAACTGATGGCTGAAGGCGAGTTGAAG GATATGGAACAGTTTTTTGATGACCTTTCAGATTCT TTCTCTGGAACTGAACCAGAGGTTCACAAAACAAG TGTAGTAGGTTGTTTCTGCGTCACATGATCTTGGC CTACAGTAAGCTTTCTTTCAGCCAAGTGTTTAAACT GTACACTGCCCTTCAGCAGTACTTCCAGAATGGTG AGAAAAAGACAGTGGAGGATGCTGATATGGAACT GACCAGTAGAGATGAGGGTGAAAGAAAAATGGAA AAAGAAGAACTTGATGTATCTGTAAGAGAAGAGGA GGTATCTTGCAGTGGGCCTCTGTCCCAAAAACAAG CAGAATTTTTTCTTTCTCAACAGGCTTCTTTGCTAA AGAATGATGAGACTAAGGCCCTCACTCCAGCTTCC TTGCAGAAGGAATTAAACAATTTGTTGAAATTTAAT CCTGATTTTGCTGAAGCGCATTATCTCAGCTACTTA AACAACCTCCGTGTCCAAGATGTTTTCAGTTCAAC ACACAGTCTCCTCCATTATTTTGATCGTCTGATTCT TACCGGAGCCGAAAGCAAAAGTAATGGGGAAGAG GGCTATGGCCGGAGCTTGAGATACGCCGCTCTGA ATCTTGCCGCCCTGCACTGCCGCTTCGGTCACTAT CAACAGGCAGAGCTC | 5 | CFCVT* |
| 1923 | NM_0162 75.3_147 | 147 | TGCGCAGTGGGGAGCAGCTCGCTCCTGGGCTTTG GGCTGGCTGCAGTCTGTCTGAGGGCGGCCGAAGT GGCTGGCTCATTTAAGATGAGGCTTCTGCTGCTTC TCCTAGTGGCGGCGTCTGCGATGGTCCGGAGCGA GGCCTCGGCAATCTGGGCGGCGTGCCCAGCAAG AGATTAAAGATGCAGTACGCCACGGGGCCGCTGC TCAAGTTCCAGATTTGTGTTTCCTGAGGTTATAGG CGGGTGTTTGAGGAGTACATGCGGGTTATTAGCCA GCGGTACCCAGACATCCGCATTGAAGGAGAGAAT TACCTCCCTCAACCAATATATAGACACATAGCATCT TTCCTGTCAGTCTTCAAACTAGTATTAATAGGCTTA ATAATTGTTGGCAAGGATCCTTTTGCTTTCTTTGGC ATGCAAGCTCCTAGCATCTGGCAGTGGGGCCAAG AAAATAAGGTTTATGCATGTATGATGGTTTTCTTCT TGAGCAACATGATTGAGAACCAGTGTATGTCAACA GGTGCATTTGAGATAACTTTAAATGATGTACCTGTG TGGTCTAAGCTGGAATCTGGTCACCTTCCATCCAT GCAACAACTTGTTCAAATTCTTGACAATGAAATGAA GCTCAATGTGCATATGGATTCAATCCCACACCATC GATCATAGCACCACCTATCAGCACTGAAAACTCTT TTGCATTAAGGGATCATTGCAAGAGCAGCGTGACT GACATTATGAAGGCCTGTACTGAAGACAGCAAGCT GTTAGTACAGACCAGATGCTTTCTTGGCAGGCTCG TTGTACCTCTTGGAAAACCTCAATGCAAGATAGTG TTTCAGTGCTGGCATATTTTGGAATTCTGCACATTC ATGGAGTGCAATAATACTGTATAGCTTTCCCCACC TCCCACAAAATCACCCAGTTAATGTGTGTGTGTGT TTTTTTTTTAAGGTAAACATTACTACTTGTAACTTTT TTTCTTAGTCATATTTGAAAAAGTAGAAAATTGAGT TACAATT | 9 | IWAACPAR D* |
| 1924 | NM_0162 75.3_200 | 200 | TGCGCAGTGGGGAGCAGCTCGCTCCTGGGCTTTG GGCTGGCTGCAGTCTGTCTGAGGGCGGCCGAAGT GGCTGGCTCATTTAAGATGAGGCTTCTGCTGCTTC TCCTAGTGGCGGCGTCTGCGATGGTCCGGAGCGA GGCCTCGGCAATCTGGGCGGCGTGCCCAGCAA GAGATTAAAGATGCAGTACGCCACGGGGCGCTGC TCAAGTTCCAGATTTGTGTTTCCTGAGGTTATAGG CGGGTGTTTGAGGAGTACATGCGGGTTATTAGCCA GCGGTACCCAGACATCCGCATTGAAGGAGAGAAT TACCTCCCTCAACCAATATATAGACACATAGCATCT TTCCTGTCAGTCTTCAAACTAGTATTAATAGGCTTA ATAATTGTTGGCAAGGATCCTTTTGCTTTCTTTGGC ATGCAAGCTCCTAGCATCTGGCAGTGGGGCCAAG AAAATAAGGTTTATGCATGTATGATGGTTTTCTTCT | 46 | RCSSSRFV FPEVIGGC LRSTCGLL ASGTQTSA LKERITSLN QYIDT* |

TABLE 3A-continued

| SEQ ID | identifier_position | position | modified_RNA | PAP length | PAP |
|---|---|---|---|---|---|
| | | | TGAGCAACATGATTGAGAACCAGTGTATGTCAACA<br>GGTGCATTTGAGATAACTTTAAATGATGTACCTGTG<br>TGGTCTAAGCTGGAATCTGGTCACCTTCCATCCAT<br>GCAACAACTTGTTCAAATTCTTGACAATGAAATGAA<br>GCTCAATGTGCATATGGATTCAATCCCACACCATC<br>GATCATAGCACCACCTATCAGCACTGAAAACTCTT<br>TTGCATTAAGGGATCATTGCAAGAGCAGCGTGACT<br>GACATTATGAAGGCCTGTACTGAAGACAGCAAGCT<br>GTTAGTACAGACCAGATGCTTTCTTGGCAGGCTCG<br>TTGTACCTCTTGGAAAACCTCAATGCAAGATAGTG<br>TTTCAGTGCTGGCATATTTTGGAATTCTGCACATTC<br>ATGGAGTGCAATAATACTGTATAGCTTTCCCCACC<br>TCCCACAAAATCACCCAGTTAATGTGTGTGTGTGT<br>TTTTTTTTTAAGGTAAACATTACTACTTGTAACTTTT<br>TTTCTTAGTCATATTTGAAAAAGTAGAAAATTGAGT<br>TACAATT | | |
| 1925 | NM_016275.3_220 | 220 | TGCGCAGTGGGGAGCAGCTCGCTCCTGGGCTTTG<br>GGCTGGCTGCAGTCTGTCTGAGGGCGGCCGAAGT<br>GGCTGGCTCATTTAAGATGAGGCTTCTGCTGCTTC<br>TCCTAGTGGCGGCGTCTGCGATGGTCCGGAGCGA<br>GGCCTCGGCCAATCTGGGCGGCGTGCCCAGCAA<br>GAGATTAAAGATGCAGTACGCCACGGGGCCGCTG<br>CTCAAGTTCCAGATTGTGTTTCCTGAGGTTATAGG<br>CGGGTGTTTGAGGAGTACATGCGGGTTATTAGCCA<br>GCGGTACCCAGACATCCGCATTGAAGGAGAGAAT<br>TACCTCCCTCAACCAATATATAGACACATAGCATCT<br>TTCCTGTCAGTCTTCAAACTAGTATTAATAGGCTTA<br>ATAATTGTTGGCAAGGATCCTTTTGCTTTCTTTGGC<br>ATGCAAGCTCCTAGCATCTGGCAGTGGGGCCAAG<br>AAAAATAAGGTTTATGCATGTATGATGGTTTTCTTCT<br>TGAGCAACATGATTGAGAACCAGTGTATGTCAACA<br>GGTGCATTTGAGATAACTTTAAATGATGTACCTGTG<br>TGGTCTAAGCTGGAATCTGGTCACCTTCCATCCAT<br>GCAACAACTTGTTCAAATTCTTGACAATGAAATGAA<br>GCTCAATGTGCATATGGATTCAATCCCACACCATC<br>GATCATAGCACCACCTATCAGCACTGAAAACTCTT<br>TTGCATTAAGGGATCATTGCAAGAGCAGCGTGACT<br>GACATTATGAAGGCCTGTACTGAAGACAGCAAGCT<br>GTTAGTACAGACCAGATGCTTTCTTGGCAGGCTCG<br>TTGTACCTCTTGGAAAACCTCAATGCAAGATAGTG<br>TTTCAGTGCTGGCATATTTTGGAATTCTGCACATTC<br>ATGGAGTGCAATAATACTGTATAGCTTTCCCCACC<br>TCCCACAAAATCACCCAGTTAATGTGTGTGTGTGT<br>TTTTTTTTTAAGGTAAACATTACTACTTGTAACTTTT<br>TTTCTTAGTCATATTTGAAAAAGTAGAAAATTGAGT<br>TACAATT | 39 | VFPEVIGG<br>CLRSTCGL<br>LASGTQTS<br>ALKERITSL<br>NQYIDT* |
| 1926 | NM_016275.3_249 | 249 | TGCGCAGTGGGGAGCAGCTCGCTCCTGGGCTTTG<br>GGCTGGCTGCAGTCTGTCTGAGGGCGGCCGAAGT<br>GGCTGGCTCATTTAAGATGAGGCTTCTGCTGCTTC<br>TCCTAGTGGCGGCGTCTGCGATGGTCCGGAGCGA<br>GGCCTCGGCCAATCTGGGCGGCGTGCCCAGCAA<br>GAGATTAAAGATGCAGTACGCCACGGGGCCGCTG<br>CTCAAGTTCCAGATTTGTGTTTCCTGAGGTTATAG<br>GCGGGTGTTGAGGAGTACATGCGGGTTATTAGCC<br>AGCGGTACCCAGACATCCGCATTGAAGGAGAGAA<br>TTACCTCCCTCAACCAATATATAGACACATAGCATC<br>TTTCCTGTCAGTCTTCAAACTAGTATTAATAGGCTT<br>AATAATTGTTGGCAAGGATCCTTTTGCTTTCTTTGG<br>CATGCAAGCTCCTAGCATCTGGCAGTGGGGCCAA<br>GAAAAATAAGGTTTATGCATGTATGATGGTTTTCTTC<br>TTGAGCAACATGATTGAGAACCAGTGTATGTCAAC<br>AGGTGCATTTGAGATAACTTTAAATGATGTACCTGT<br>GTGGTCTAAGCTGGAATCTGGTCACCTTCCATCCA<br>TGCAACAACTTGTTCAAATTCTTGACAATGAAATGA<br>AGCTCAATGTGCATATGGATTCAATCCCACACCAT<br>CGATCATAGCACCACCTATCAGCACTGAAAACTCT<br>TTTGCATTAAGGGATCATTGCAAGAGCAGCGTGAC<br>TGACATTATGAAGGCCTGTACTGAAGACAGCAAGC<br>TGTTAGTACAGACCAGATGCTTTCTTGGCAGGCTC<br>GTTGTACCTCTTGGAAAACCTCAATGCAAGATAGT<br>GTTTCAGTGCTGGCATATTTTGGAATTCTGCACATT<br>CATGGAGTGCAATAATACTGTATAGCTTTCCCCAC<br>CTCCCACAAAATCACCCAGTTAATGTGTGTGTGTG<br>TTTTTTTTTAAGGTAAACATTACTACTTGTAACTTT<br>TTTTCTTAGTCATATTTGAAAAAGTAGAAAATTGAG<br>TTACAATT | 30 | LRSTCGLL<br>ASGTQTSA<br>LKERITSLN<br>QYIDT* |

TABLE 3A-continued

| SEQ ID | identifier_position | position | modified_RNA | PAP length | PAP |
|---|---|---|---|---|---|
| 1927 | NM_01621 75.3_323 | 323 | TGCGCAGTGGGGAGCAGCTCGCTCCTGGGCTTTG GGCTGGCTGCAGTCTGTCTGAGGGCGGCCGAAGT GGCTGGCTCATTTAAGATGAGGCTTCTGCTGCTTC TCCTAGTGGCGGCGTCTGCGATGGTCCGGAGCGA GGCCTCGGCCAATCTGGGCGGCGTGCCCAGCAA GAGATTAAAGATGCAGTACGCCACGGGGCCGCTG CTCAAGTTCCAGATTTGTGTTTCCTGAGGTTATAG GCGGGTGTTTGAGGAGTACATGCGGGTTATTAGC CAGCGGTACCCAGACATCCGCATTGAAGGAGAGA ATTACCTCCCTCAACAATATATAGACACATAGCATC TTTCCTGTCAGTCTTCAAACTAGTATTAATAGGCTT AATAATTGTTGGCAAGGATCCTTTTGCTTTCTTTGG CATGCAAGCTCCTAGCATCTGGCAGTGGGGCCAA GAAAATAAGGTTTATGCATGTATGATGGTTTTCTTC TTGAGCAACATGATTGAGAACCAGTGTATGTCAAC AGGTGCATTTGAGATAACTTTAAATGATGTACCTGT GTGGTCTAAGCTGGAATCTGGTCACCTTCCATCCA TGCAACAACTTGTTCAAATTCTTGACAATGAAATGA AGCTCAATGTGCATATGGATTCAATCCCACACCAT CGATCATAGCACCACCTATCAGCACTGAAAACTCT TTTGCATTAAGGGATCATTGCAAGAGCAGCGTGAC TGACATTATGAAGGCCTGTACTGAAGACAGCAAGC TGTTAGTACAGACCAGATGCTTTCTTGGCAGGCTC GTTGTACCTCTTGGAAAACCTCAATGCAAGATAGT GTTTCAGTGCTGGCATATTTTGGAATTCTGCACATT CATGGAGTGCAATAATACTGTATAGCTTTCCCCAC CTCCCACAAAATCACCCAGTTAATGTGTGTGTGTG TTTTTTTTTTAAGGTAAACATTACTACTTGTAACTTT TTTTCTTAGTCATATTTGAAAAAGTAGAAAATTGAG TTACAATT | 5 | QYIDT* |
| 1928 | NM_01621 75.3_390 | 390 | TGCGCAGTGGGGAGCAGCTCGCTCCTGGGCTTTG GGCTGGCTGCAGTCTGTCTGAGGGCGGCCGAAGT GGCTGGCTCATTTAAGATGAGGCTTCTGCTGCTTC TCCTAGTGGCGGCGTCTGCGATGGTCCGGAGCGA GGCCTCGGCCAATCTGGGCGGCGTGCCCAGCAA GAGATTAAAGATGCAGTACGCCACGGGGCCGCTG CTCAAGTTCCAGATTTGTGTTTCCTGAGGTTATAG GCGGGTGTTTGAGGAGTACATGCGGGTTATTAGC CAGCGGTACCCAGACATCCGCATTGAAGGAGAGA ATTACCTCCCTCAACCAATATATAGACACATAGCAT CTTTCCTGTCAGTCTTCAAACTAGTATTAATAGGCT TAATAATTGTGGCAAGGATCCTTTTGCTTTCTTTGG CATGCAAGCTCCTAGCATCTGGCAGTGGGGCCAA GAAAATAAGGTTTATGCATGTATGATGGTTTTCTTC TTGAGCAACATGATTGAGAACCAGTGTATGTCAAC AGGTGCATTTGAGATAACTTTAAATGATGTACCTGT GTGGTCTAAGCTGGAATCTGGTCACCTTCCATCCA TGCAACAACTTGTTCAAATTCTTGACAATGAAATGA AGCTCAATGTGCATATGGATTCAATCCCACACCAT CGATCATAGCACCACCTATCAGCACTGAAAACTCT TTTGCATTAAGGGATCATTGCAAGAGCAGCGTGAC TGACATTATGAAGGCCTGTACTGAAGACAGCAAGC TGTTAGTACAGACCAGATGCTTTCTTGGCAGGCTC GTTGTACCTCTTGGAAAACCTCAATGCAAGATAGT GTTTCAGTGCTGGCATATTTTGGAATTCTGCACATT CATGGAGTGCAATAATACTGTATAGCTTTCCCCAC CTCCCACAAAATCACCCAGTTAATGTGTGTGTGTG TTTTTTTTTTAAGGTAAACATTACTACTTGTAACTTT TTTTCTTAGTCATATTTGAAAAAGTAGAAAATTGAG TTACAATT | 27 | ARILLLSLA CKLLASGS GAKKIRFM HV* |
| 1929 | NM_01621 75.3_482 | 482 | TGCGCAGTGGGGAGCAGCTCGCTCCTGGGCTTTG GGCTGGCTGCAGTCTGTCTGAGGGCGGCCGAAGT GGCTGGCTCATTTAAGATGAGGCTTCTGCTGCTTC TCCTAGTGGCGGCGTCTGCGATGGTCCGGAGCGA GGCCTCGGCCAATCTGGGCGGCGTGCCCAGCAA GAGATTAAAGATGCAGTACGCCACGGGGCCGCTG CTCAAGTTCCAGATTTGTGTTTCCTGAGGTTATAG GCGGGTGTTTGAGGAGTACATGCGGGTTATTAGC CAGCGGTACCCAGACATCCGCATTGAAGGAGAGA ATTACCTCCCTCAACCAATATATAGACACATAGCAT CTTTCCTGTCAGTCTTCAAACTAGTATTAATAGGCT TAATAATTGTTGGCAAGGATCCTTTTGCTTTCTTTG GCATGCAAGCTCCTAGCATCTGGCAGTGGGGCCA AGAAAATAAGGTTTATGCATGTATGATGGTTTTCTTC TTGAGCAACATGATTGAGAACCAGTGTATGTCAAC AGGTGCATTTGAGATAACTTTAAATGATGTACCTGT GTGGTCTAAGCTGGAATCTGGTCACCTTCCATCCA | 2 | SS* |

TABLE 3A-continued

| SEQ ID | identifier_position | position | modified_RNA | PAP length | PAP |
|---|---|---|---|---|---|
| | | | TGCAACAACTTGTTCAAATTCTTGACAATGAAATGA AGCTCAATGTGCATATGGATTCAATCCCACACCAT CGATCATAGCACCACCTATCAGCACTGAAAACTCT TTTGCATTAAGGGATCATTGCAAGAGCAGCGTGAC TGACATTATGAAGGCCTGTACTGAAGACAGCAAGC TGTTAGTACAGACCAGATGCTTTCTTGGCAGGCTC GTTGTACCTCTTGGAAAACCTCAATGCAAGATAGT GTTTCAGTGCTGGCATATTTTGGAATTCTGCACATT CATGGAGTGCAATAATACTGTATAGCTTTCCCCAC CTCCCACAAAATCACCCAGTTAATGTGTGTGTGTG TTTTTTTTTTAAGGTAAACATTACTACTTGTAACTTT TTTTCTTAGTCATATTTGAAAAAGTAGAAAATTGAG TTACAATT | | |
| 1930 | NM_016286.2_377 | 377 | GGAGACTGCGCCGACATGGAGCTGTTCCTCGCGG GCCGCCGGGTGCTGGTCACCGGGGCAGGCAAAG GTATAGGGCGCGGCACGGTCCAGGCGCTGCACG CGACGGGCGCGCGGGTGGTGGCTGTGAGCCGGA CTCAGGCGGATCTTGACAGCCTTGTCCGCGAGTG CCCGGGGATAGAACCCGTGTGCGTGGACCTGGGT GACTGGGAGGCCACCGAGCGGGCGCTGGGCAGC GTGGGCCCCGTGGACCTGCTGGTGAACAACGCCG CTGTCGCCCTGCTGCAGCCCTTCCTGGAGGTCAC CAAGGAGGCCTTTGACAGATCCTTTGAGGTGAACC TGCGTGCGGTCATCCAGGTGTCGCAGATTGTGGC CAGGGGCTTAATAGCCCGGGGAGTCCCAGGGGCCA TCGTGAATGTCTCCAGCCAGTGCTCCCAGCGGGC AGTAACTAACCATAGCGTCTACTGCTCCACCAAGG GTGCCCTGGACATGCTGACCAAGGTGATGGCCCT AGAGCTCGGGCCCCACAAGATCCGAGTGAATGCA GTAAACCCCACAGTGGTGATGACGTCCATGGGCC AGGCCACCTGGAGTGACCCCCACAAGGCCAAGAC TATGCTGAACCGAATCCCACTTGGCAAGTTTGCTG AGGTAGAGCACGTGGTGAACGCCATCCTCTTTCTG CTGAGTGACCGAAGTGGCATGACCACGGGTTCCA CTTTGCCGGTGGAAGGGGGCTTCTGGGCCTGCTG AGCTCCCTCCACACACCTCAAGCCCCATGCCGTG CTCATCCTACCCCCAATCCCTCCAATAAACCTGATT CTGCTGCCCA | 1 | A* |
| 1931 | NM_016286.2_403 | 403 | GGAGACTGCGCCGACATGGAGCTGTTCCTCGCGG GCCGCCGGGTGCTGGTCACCGGGGCAGGCAAAG GTATAGGGCGCGGCACGGTCCAGGCGCTGCACG CGACGGGCGCGCGGGTGGTGGCTGTGAGCCGGA CTCAGGCGGATCTTGACAGCCTTGTCCGCGAGTG CCCGGGGATAGAACCCGTGTGCGTGGACCTGGGT GACTGGGAGGCCACCGAGCGGGCGCTGGGCAGC GTGGGCCCCGTGGACCTGCTGGTGAACAACGCCG CTGTCGCCCTGCTGCAGCCCTTCCTGGAGGTCAC CAAGGAGGCCTTTGACAGATCCTTTGAGGTGAACC TGCGTGCGGTCATCCAGGTGTCGCAGATTGTGGC CAGGGGCTTAATAGCCCGGGGAGTCCCAGGGGCCA TCGTGAATGTCTCCAGCCAGTGCTCCCAGCGGGC AGTAACTAACCATAGCGTCTACTGCTCCACCAAGG GTGCCCTGGACATGCTGACCAAGGTGATGGCCCT AGAGCTCGGGCCCCACAAGATCCGAGTGAATGCA GTAAACCCCACAGTGGTGATGACGTCCATGGGCC AGGCCACCTGGAGTGACCCCCACAAGGCCAAGAC TATGCTGAACCGAATCCCACTTGGCAAGTTTGCTG AGGTAGAGCACGTGGTGAACGCCATCCTCTTTCTG CTGAGTGACCGAAGTGGCATGACCACGGGTTCCA CTTTGCCGGTGGAAGGGGGCTTCTGGGCCTGCTG AGCTCCCTCCACACACCTCAAGCCCCATGCCGTG CTCATCCTACCCCCAATCCCTCCAATAAACCTGATT CTGCTGCCCA | 2 | PS* |
| 1932 | NM_016304.2_219 | 219 | CTGGTCTAACAGACCCGCGAGAACGAAGGACGCT TGCCTTTTTCCGGTCGGGGAAGGGGGAAGAAGGT AACTTCCGGTGACGGGGTTGCATCACTTCCTCTCA AGCTTGGCGTTTGTTTGGTGGGGTTACACGCGGG TTCAACATGCGTATCGAAAAGTGTTATTCTGTTCG GGGCCCATCTATCCTGGACACGGCATGATGTTCGT CCGCAACGATGCAAGGTGTTCAGATTTTGCAAATC TAAATGTCATAAAAACTTTAAAAAGAAGCGCAATCC TCGCAAAGTTAGGTGGACCAAAGCATTCCGGAAA GCAGCTGGTAAAGAGCTTACAGTGGATAATTCATT TGAATTTGAAAAACGTAGAAATGAACCTATCAAATA CCAGCGAGAGCTATGGAATAAAACTATTGATGCGA TGAAGAGAGTTGAAGAAATCAAACAGAAGCGCCAA GCTAAATTTATAATGAACAGATTGAAGAAAAATAAA | 67 | ARCSDFAN LNVIKTLKR SAILAKLG GPKHSGK QLVKSLQ WIIHLNLKN VEMNLSNT SESYGIKLL MR* |

TABLE 3A-continued

| SEQ ID | identifier_ position | position | modified_RNA | PAP length | PAP |
|---|---|---|---|---|---|
| | | | GAGCTACAGAAAGTTCAGGATATCAAAGAAGTCAA<br>GCAAAACATCCATCTTATCCGAGCCCCTCTTGCAG<br>GCAAAGGGAAACAGTTGGAAGAGAAAATGGTACA<br>GCAGTTACAAGAGGATGTGGACATGGAAGATGCT<br>CCTTAAAAATCTCTGTAACCATTTCTTTTATGTACAT<br>TTGAAAATGCCCTTTGGATACTTGGAACTGCTAAAT<br>TATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | | |
| 1933 | NM_0163<br>04.2_237 | 237 | CTGGTCTAACAGACCCGCGAGAACGAAGGACGCT<br>TGCCTTTTTCCGGTCGGGGAAGGGGGAAGAAGGT<br>AACTTCCGGTGACGGGGTTGCATCACTTCCTCTCA<br>AGCTTGGCGTTTGTTTGGTGGGGTTACACGCGGG<br>TTCAACATGCGTATCGAAAAGTGTTATTTCTGTTCG<br>GGGCCCATCTATCCTGGACACGGCATGATGTTCGT<br>CCGCAACGATTGCAAGGTGTTCAGATTTGCAAATC<br>TAAATGTCATAAAAACTTTAAAAAGAAGCGCAATCC<br>TCGCAAAGTTAGGTGGACCAAAGCATTCCGGAAA<br>GCAGCTGGTAAAGAGCTTACAGTGGATAATTCATT<br>TGAATTTGAAAAACGTAGAAATGAACCTATCAAATA<br>CCAGCGAGAGCTATGGAATAAAAACTATTGATGCGA<br>TGAAGAGAGTTGAAGAAATCAAACAGAAGCGCCAA<br>GCTAAATTTATAATGAACAGATTGAAGAAAAATAAA<br>GAGCTACAGAAAGTTCAGGATATCAAAGAAGTCAA<br>GCAAAACATCCATCTTATCCGAGCCCCTCTTGCAG<br>GCAAAGGGAAACAGTTGGAAGAGAAAATGGTACA<br>GCAGTTACAAGAGGATGTGGACATGGAAGATGCT<br>CCTTAAAAATCTCTGTAACCATTTCTTTTATGTACAT<br>TTGAAAATGCCCTTTGGATACTTGGAACTGCTAAAT<br>TATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | 61 | ANLNVIKTL<br>KRSAILAKL<br>GGPKHSG<br>KQLVKSLQ<br>WIIHLNLKN<br>VEMNLSNT<br>SESYGIKLL<br>MR* |
| 1934 | NM_0163<br>04.2_363 | 363 | CTGGTCTAACAGACCCGCGAGAACGAAGGACGCT<br>TGCCTTTTTCCGGTCGGGGAAGGGGGAAGAAGGT<br>AACTTCCGGTGACGGGGTTGCATCACTTCCTCTCA<br>AGCTTGGCGTTTGTTTGGTGGGGTTACACGCGGG<br>TTCAACATGCGTATCGAAAAGTGTTATTTCTGTTCG<br>GGGCCCATCTATCCTGGACACGGCATGATGTTCGT<br>CCGCAACGATTGCAAGGTGTTCAGATTTTGCAAAT<br>CTAAATGTCATAAAAACTTTAAAAAGAAGCGCAATC<br>CTCGCAAAGTTAGGTGGACCAAAGCATTCCGGAAA<br>GCAGCTGGTAAAGAGCTTACAGTGGATAATTCATT<br>TGAATTTGAAAAAGTAGAAATGAACCTATCAAATAC<br>CAGCGAGAGCTATGGAATAAAAACTATTGATGCGAT<br>GAAGAGAGTTGAAGAAATCAAACAGAAGCGCCAA<br>GCTAAATTTATAATGAACAGATTGAAGAAAAATAAA<br>GAGCTACAGAAAGTTCAGGATATCAAAGAAGTCAA<br>GCAAAACATCCATCTTATCCGAGCCCCTCTTGCAG<br>GCAAAGGGAAACAGTTGGAAGAGAAAATGGTACA<br>GCAGTTACAAGAGGATGTGGACATGGAAGATGCT<br>CCTTAAAAATCTCTGTAACCATTTCTTTTATGTACAT<br>TTGAAAATGCCCTTTGGATACTTGGAACTGCTAAAT<br>TATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | 19 | VEMNLSNT<br>SESYGIKLL<br>MR* |
| 1935 | NM_0163<br>04.2_409 | 409 | CTGGTCTAACAGACCCGCGAGAACGAAGGACGCT<br>TGCCTTTTTCCGGTCGGGGAAGGGGGAAGAAGGT<br>AACTTCCGGTGACGGGGTTGCATCACTTCCTCTCA<br>AGCTTGGCGTTTGTTTGGTGGGGTTACACGCGGG | 4 | ILMR* |

TABLE 3A-continued

| SEQ ID | identifier_position | position | modified_RNA | PAP length | PAP |
|---|---|---|---|---|---|
| | | | TTCAACATGCGTATCGAAAAGTGTTATTTCTGTTCG GGGCCCATCTATCCTGGACACGGCATGATGTTCGT CCGCAACGATTGCAAGGTGTTCAGATTTTGCAAAT CTAAATGTCATAAAAACTTTAAAAAGAAGCGCAATC CTCGCAAAGTTAGGTGGACCAAAGCATTCCGGAAA GCAGCTGGTAAAGAGCTTACAGTGGATAATTCATT TGAATTTGAAAAACGTAGAAATGAACCTATCAAATA CCAGCGAGAGCTATGGAATAAAATATTGATGCGAT GAAGAGAGTTGAAGAAATCAAACAGAAGCGCCAA GCTAAATTTATAATGAACAGATTGAAGAAAAATAAA GAGCTACAGAAAGTTCAGGATATCAAAGAAGTCAA GCAAAACATCCATCTTATCCGAGCCCCTCTTGCAG GCAAAGGGAAACAGTTGGAAGAGAAAATGGTACA GCAGTTACAAGAGGATGTGGACATGGAAGATGCT CCTTAAAAATCTCTGTAACCATTTCTTTTATGTACAT TTGAAAATGCCCTTTGGATACTTGGAACTGCTAAAT TATTTTATTTTTTACATAAGGTCACTTAAATGAAAAG CGATTAAAAGACATCTTTCCTGCATTGCCATCTACA TAATATCAGATATTACGGATGTTAGATTGCATCTCA GTGTTAAATCTTTACTGATAGATGTACTTAAGTAAA TCATGAAAATTCTACTTGTAACTATAGAAGTGAATT GTGGACGTAAAATGGTTGTGCTATTTGGATAATGG CACTAGGCAGCATTTGTATAGTAACTAATGGCAAA AATTCATGGCTAGTGATGTATAAAATAAAATATTCT TTGCAGTAAAATATTCCCTTTGTTAATGTTATAGAA | | |
| 1936 | NM_0163 04.2_413 | 413 | CTGGTCTAACAGACCCGCGAGAACGAAGGACGCT TGCCTTTTTCCGGTCGGGGAAGGGGGAAGAAGGT AACTTCCGGTGACGGGGTTGCATCACTTCCTCTCA AGCTTGGCGTTTGTTTGGTGGGGTTACACGCGGG TTCAACATGCGTATCGAAAAGTGTTATTTCTGTTCG GGGCCCATCTATCCTGGACACGGCATGATGTTCGT CCGCAACGATTGCAAGGTGTTCAGATTTTGCAAAT CTAAATGTCATAAAAACTTTAAAAAGAAGCGCAATC CTCGCAAAGTTAGGTGGACCAAAGCATTCCGGAAA GCAGCTGGTAAAGAGCTTACAGTGGATAATTCATT TGAATTTGAAAAACGTAGAAATGAACCTATCAAATA CCAGCGAGAGCTATGGAATAAAACTATGATGCGAT GAAGAGAGTTGAAGAAATCAAACAGAAGCGCCAA GCTAAATTTATAATGAACAGATTGAAGAAAAATAAA GAGCTACAGAAAGTTCAGGATATCAAAGAAGTCAA GCAAAACATCCATCTTATCCGAGCCCCTCTTGCAG GCAAAGGGAAACAGTTGGAAGAGAAAATGGTACA GCAGTTACAAGAGGATGTGGACATGGAAGATGCT CCTTAAAAATCTCTGTAACCATTTCTTTTATGTACAT TTGAAAATGCCCTTTGGATACTTGGAACTGCTAAAT TATTTTATTTTTTACATAAGGTCACTTAAATGAAAAG CGATTAAAAGACATCTTTCCTGCATTGCCATCTACA TAATATCAGATATTACGGATGTTAGATTGCATCTCA GTGTTAAATCTTTACTGATAGATGTACTTAAGTAAA TCATGAAAATTCTACTTGTAACTATAGAAGTGAATT GTGGACGTAAAATGGTTGTGCTATTTGGATAATGG CACTAGGCAGCATTTGTATAGTAACTAATGGCAAA AATTCATGGCTAGTGATGTATAAAATAAAATATTCT TTGCAGTAAAATATTCCCTTTGTTAATGTTATAGAA | 3 | MMR* |
| 1937 | NM_0163 04.2_533 | 533 | CTGGTCTAACAGACCCGCGAGAACGAAGGACGCT TGCCTTTTTCCGGTCGGGGAAGGGGGAAGAAGGT AACTTCCGGTGACGGGGTTGCATCACTTCCTCTCA AGCTTGGCGTTTGTTTGGTGGGGTTACACGCGGG TTCAACATGCGTATCGAAAAGTGTTATTTCTGTTCG GGGCCCATCTATCCTGGACACGGCATGATGTTCGT CCGCAACGATTGCAAGGTGTTCAGATTTTGCAAAT CTAAATGTCATAAAAACTTTAAAAAGAAGCGCAATC CTCGCAAAGTTAGGTGGACCAAAGCATTCCGGAAA GCAGCTGGTAAAGAGCTTACAGTGGATAATTCATT TGAATTTGAAAAACGTAGAAATGAACCTATCAAATA CCAGCGAGAGCTATGGAATAAAACTATGATGCGA TGAAGAGAGTTGAAGAAATCAAACAGAAGCGCCAA GCTAAATTTATAATGAACAGATTGAAGAAAAATAAA GAGCTACAGAAAGTTCAGGATATCAAAGAAGTCAA GCAAAAATCCATCTTATCCGAGCCCCTCTTGCAGG CAAAGGGAAACAGTTGGAAGAGAAAATGGTACAG CAGTTACAAGAGGATGTGGACATGGAAGATGCTC CTTAAAAATCTCTGTAACCATTTCTTTTATGTACATT TGAAAATGCCCTTTGGATACTTGGAACTGCTAAATT ATTTTATTTTTTACATAAGGTCACTTAAATGAAAAG CGATTAAAAGACATCTTTCCTGCATTGCCATCTACA TAATATCAGATATTACGGATGTTAGATTGCATCTCA | 67 | KSILSEPLL QAKGNSW KRKWYSS YKRMWTW KMLLKNLC NHFFYVHL KMPFGYLE LLNYFIFYI RSLK* |

TABLE 3A-continued

| SEQ ID | identifier_ position | position | modified_RNA | PAP length | PAP |
|---|---|---|---|---|---|
| | | | GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | | |
| 1938 | NM_0163<br>04.2_553 | 553 | CTGGTCTAACAGACCCGCGAGAACGAAGGACGCT<br>TGCCTTTTTCCGGTCGGGAAGGGGGAAGAAGGT<br>AACTTCCGGTGACGGGGTTGCATCACTTCCTCTCA<br>AGCTTGGCGTTTGTTTGGTGGGGTTACACGCGGG<br>TTCAACATGCGTATCGAAAAGTGTTATTTCTGTTCG<br>GGGCCCATCTATCCTGGACACGGCATGATGTTCGT<br>CCGCAACGATTGCAAGGTGTTCAGATTTTGCAAAT<br>CTAAATGTCATAAAAACTTTAAAAAGAAGCGCAATC<br>CTCGCAAAGTTAGGTGGACCAAAGCATTCCGGAAA<br>GCAGCTGGTAAAGAGCTTACAGTGGATAATTCATT<br>TGAATTTGAAAAACGTAGAAATGAACCTATCAAATA<br>CCAGCGAGAGCTATGGAATAAAACTATTGATGCGA<br>TGAAGAGAGTTGAAGAAATCAAACAGAAGCGCCAA<br>GCTAAATTTATAATGAACAGATTGAAGAAAAATAAA<br>GAGCTACAGAAAGTTCAGGATATCAAAGAAGTCAA<br>GCAAAACATCCATCTTATCCGAGCCCTCTTGCAGG<br>CAAAGGGAAACAGTTGGAAGAGAAAATGGTACAG<br>CAGTTACAAGAGGATGTGGACATGGAAGATGCTC<br>CTTAAAAATCTCTGTAACCATTTCTTTTATGTACATT<br>TGAAAATGCCCTTTGGATACTTGGAACTGCTAAATT<br>ATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | 60 | LLQAKGNS<br>WKRKWYS<br>SYKRMWT<br>WKMLLKNL<br>CNHFFYVH<br>LKMPFGYL<br>ELLNYFIFY<br>IRSLK* |
| 1939 | NM_0163<br>04.2_566 | 566 | CTGGTCTAACAGACCCGCGAGAACGAAGGACGCT<br>TGCCTTTTTCCGGTCGGGAAGGGGGAAGAAGGT<br>AACTTCCGGTGACGGGGTTGCATCACTTCCTCTCA<br>AGCTTGGCGTTTGTTTGGTGGGGTTACACGCGGG<br>TTCAACATGCGTATCGAAAAGTGTTATTTCTGTTCG<br>GGGCCCATCTATCCTGGACACGGCATGATGTTCGT<br>CCGCAACGATTGCAAGGTGTTCAGATTTTGCAAAT<br>CTAAATGTCATAAAAACTTTAAAAAGAAGCGCAATC<br>CTCGCAAAGTTAGGTGGACCAAAGCATTCCGGAAA<br>GCAGCTGGTAAAGAGCTTACAGTGGATAATTCATT<br>TGAATTTGAAAAACGTAGAAATGAACCTATCAAATA<br>CCAGCGAGAGCTATGGAATAAAACTATTGATGCGA<br>TGAAGAGAGTTGAAGAAATCAAACAGAAGCGCCAA<br>GCTAAATTTATAATGAACAGATTGAAGAAAAATAAA<br>GAGCTACAGAAAGTTCAGGATATCAAAGAAGTCAA<br>GCAAAACATCCATCTTATCCGAGCCCCTCTTGCAG<br>GCAAGGGAAACAGTTGGAAGAGAAAATGGTACAG<br>CAGTTACAAGAGGATGTGGACATGGAAGATGCTC<br>CTTAAAAATCTCTGTAACCATTTCTTTTATGTACATT<br>TGAAAATGCCCTTTGGATACTTGGAACTGCTAAATT<br>ATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | 54 | NSWKRKW<br>YSSYKRM<br>WTWKMLL<br>KNLCNHFF<br>YVHLKMPF<br>GYLELLNY<br>FIFYIRSLK* |
| 1940 | NM_0163<br>04.2_577 | 577 | CTGGTCTAACAGACCCGCGAGAACGAAGGACGCT<br>TGCCTTTTTCCGGTCGGGAAGGGGGAAGAAGGT<br>AACTTCCGGTGACGGGGTTGCATCACTTCCTCTCA<br>AGCTTGGCGTTTGTTTGGTGGGGTTACACGCGGG<br>TTCAACATGCGTATCGAAAAGTGTTATTTCTGTTCG<br>GGGCCCATCTATCCTGGACACGGCATGATGTTCGT<br>CCGCAACGATTGCAAGGTGTTCAGATTTTGCAAAT<br>CTAAATGTCATAAAAACTTTAAAAAGAAGCGCAATC<br>CTCGCAAAGTTAGGTGGACCAAAGCATTCCGGAAA<br>GCAGCTGGTAAAGAGCTTACAGTGGATAATTCATT<br>TGAATTTGAAAAACGTAGAAATGAACCTATCAAATA<br>CCAGCGAGAGCTATGGAATAAAACTATTGATGCGA<br>TGAAGAGAGTTGAAGAAATCAAACAGAAGCGCCAA | 52 | WKRKWYS<br>SYKRMWT<br>WKMLLKNL<br>CNHFFYVH<br>LKMPFGYL<br>ELLNYFIFY<br>IRSLK* |

TABLE 3A-continued

| SEQ ID | identifier_position | position | modified_RNA | PAP length | PAP |
|---|---|---|---|---|---|
| | | | GCTAAATTTATAATGAACAGATTGAAGAAAAATAAA<br>GAGCTACAGAAAGTTCAGGATATCAAAGAAGTCAA<br>GCAAAACATCCATCTTATCCGAGCCCCTCTTGCAG<br>GCAAAGGGAAACAGTGGAAGAGAAAATGGTACAG<br>CAGTTACAAGAGGATGTGGACATGGAAGATGCTC<br>CTTAAAAATCTCTGTAACCATTTCTTTTATGTACATT<br>TGAAAATGCCCTTTGGATACTTGGAACTGCTAAATT<br>ATTTTATTTTTTACATAAGGTCACTTAAATGAAAAG<br>CGATTAAAAGACATCTTTCCTGCATTGCCATCTACA<br>TAATATCAGATATTACGGATGTTAGATTGCATCTCA<br>GTGTTAAATCTTTACTGATAGATGTACTTAAGTAAA<br>TCATGAAAATTCTACTTGTAACTATAGAAGTGAATT<br>GTGGACGTAAAATGGTTGTGCTATTTGGATAATGG<br>CACTAGGCAGCATTTGTATAGTAACTAATGGCAAA<br>AATTCATGGCTAGTGATGTATAAAATAAAATATTCT<br>TTGCAGTAAAATATTCCCTTTGTTAATGTTATAGAA | | |
| 1941 | NM_0163<br>06.4_559 | 559 | TTGGCTCTCGCCTACCGGGGGCTTCTCTCACCGG<br>GACTCGGGACTCCCGGGAAGTGGACCGGCAGAA<br>GAGGGGGCTAGCTAGCTGTCTCTGCGGACCAAGG<br>AGACCCCCGCGCCCCCCGGTGTGAGGCGGCCT<br>CACAGGGCCGGGTGGGCTGGCGAGCCGACGCGG<br>CGGCGGAGGAGGCTGTGAGGAGTGTGTGGAACA<br>GGACCCGGGACAGAGGAACCATGGCTCCGCAGAA<br>CCTGAGCACCTTTTGCCTGTTGCTGCTATACCTCA<br>TCGGGGCGGTGATTGCCGGACGAGATTTCTATAA<br>GATCTTGGGGGTGCCTCGAAGTGCCTCTATAAAG<br>GATATTAAAAAGGCCTATAGGAAACTAGCCCTGCA<br>GCTTCATCCCGACCGGAACCCTGATGATCCACAA<br>GCCCAGGAGAAATTCCAGGATCTGGGTGCTGCTT<br>ATGAGGTTCTGTCAGATAGTGAGAAACGGAAACAG<br>TACGATACTTATGGTGAAGAAGGATTAAAAGATGG<br>TCATCAGAGCTCCCATGGAGACATTTTTTCACACTT<br>CTTTGGGGATTTGGTTTCATGTTTGGAGGAACCCC<br>TCGTCAGCAAGACAGAAATATTCCAAGAGGAAGTG<br>ATATTATTGTAGATCTAGAAGTCACTTTGGAAGAAG<br>TATATGCAGGAAATTTTGTGGAAGTAGTTAGAAAC<br>AAACCTGTGGCAAGGCAGGCTCCTGGCAAACGGA<br>AGTGCAATTGTCGGCAAGAGATGCGGACCACCCA<br>GCTGGGCCCTGGGCGCTTCCAAATGACCCAGGAG<br>GTGGTCTGCGACGAATGCCCTAATGTCAAACTAGT<br>GAATGAAGAACGAACGCTGGAAGTAGAAATAGAG<br>CCTGGGGTGAGAGACGGCATGGAGTACCCCTTTA<br>TTGGAGAAGGTGAGCCTCACGTGGATGGGGAGCC<br>TGGAGATTTACGGTTCCGAATCAAAGTTGTCAAGC<br>ACCCAATATTTGAAAGGAGAGGAGATGATTTGTAC<br>ACAAATGTGACAATCTCATTAGTTGAGT | 23 | LVSCLEEP<br>LVSKTEIFQ<br>EEVILL* |
| 1942 | NM_0164<br>04.1_209 | 209 | TCCGGTTCCGGCCTGGCGAGAGTTTGTGCGGCGA<br>CATGAAACTGCTTACCCACAATCTGCTGAGCTCGC<br>ATGTGCGGGGGTGGGGTCCCGTGGCTTCCCCCT<br>GCGCCTCCAGGCCACCGAGGTCCGTATCTGCCCT<br>GTGGAATTCAACCCCAACTTCGTGGCGCGTATGAT<br>ACCTAAAGTGGAGTGGTCGGCGTTCCTGGAGGCG<br>GCGATAACTTGCGTCTGATCCAGGTGCCGAAAGG<br>GCCGGTTGAGGGATATGAGGAGAATGAGGAGTTT<br>CTGAGGACCATGCACCACCTGCTGCTGGAGGTGG<br>AAGTGATAGAGGGCACCCTGCAGTGCCCGGAATC<br>TGGACGTATGTTCCCCATCAGCCGCGGGATCCCC<br>AACATGCTGCTGAGTGAAGAGGAAACTGAGAGTT<br>GATTGTGCCAGGCGCCAGTTTTTCTTGTTATGACT<br>GTGTATTTTTGTTGATCTATACCCTGTTTCCGAATT<br>CTGCCGTGTGTATCCCCAACCCTTGACCCAATGAC<br>ACCAAACACAGTGTTTTTGAGCTCGGTATTATATAT<br>TTTTTTCTCATTAAAGGTTTAAAACCAAAAAAAAAAA | 4 | ITCV* |
| 1943 | NM_0164<br>07.2_178 | 178 | GGATTTCGCGGGAAATCCCGGAAGTGACAGCTTT<br>GGGGGTTTGCTGCTGGCTCTGACTCCCGTCCTGC<br>GATGGGTTGCGACGGGGGAACAATCCCCAAGAGG<br>CATGAACTGGTGAAGGGGCCGAAGAAGGTTGAGA<br>AGGTCGACAAAGATGCTGAATTAGTGGCCCAATG<br>GAACTATGTACTCTAAGTCAGGAAATATTAAGACG<br>ACCAATAGTTGCCTGTGAACTTGGCAGACTTTATA<br>ACAAAGATGCCGTCATTGAATTTCTCTTGGACAAAT<br>CTGCAGAAAAGGCTCTTGGGAAGGCAGCATCTCA<br>CATTAAAAGCATTAAGAATGTGACAGAGCTGAAGC<br>TTTCTGATAATCCTGCCTGGGAAGGGGATAAAGGA<br>AACACTAAAGGTGACAAGCACGATGACCTCCAGC<br>GGGCGCGTTTCATCTGCCCCGTTGTGGGCCTGGA<br>GATGAACGGCCGACACAGGTTCTGCTTCCTTCGGT | 2 | VL* |

TABLE 3A-continued

| SEQ ID | identifier_position | position | modified_RNA | PAP length | PAP |
|---|---|---|---|---|---|
| | | | GCTGCGGCTGTGTGTTTTCTGAGCGAGCCTTGAAA<br>GAGATAAAAGCGGAAGTTTGCCACACGTGTGGGG<br>CTGCCTTCCAGGAGGATGATGTCATCGTGCTCAAT<br>GGCACCAAGGAGGATGTGGACGTGCTGAAGACAA<br>GGATGGAGGAGAGAAGGCTGAGAGCGAAGCTGG<br>AAAAGAAACCAAAGAAACCCAAGGCAGCAGAGTCT<br>GCTTCAAAACCAGATGTCAGTGAAGAAGCCCCAG<br>GGCCATCAAAAGTTAAGACAGGGAAGCCTGAAGA<br>AGCCAGCCTTGATTCTAGAGAGAAGAAAACCAACT<br>TGGCTCCCAAAAGCACAGCAATGAATGAGAGCTCT<br>TCTGGAAAAGCTGGGAAGCCTCCGTGTGGAGCCA<br>CAAAGAGGTCCATCGCTGACAGTGAAGAATCGGA<br>GGCCTACAAGTCCCTCTTTACCACTCACAGCTCCG<br>CCAAGCGCTCCAAGGAGGAGTCTGCCCACTGGGT<br>CACCCACACGTCCTACTGCTTCTGAAGCCCGCACT<br>GCCACCGCTCCTGCCCCAGAAGGTT | | |
| 1944 | NM_016407.2_460 | 460 | GGATTTCGCGGGAAATCCCGGAAGTGACAGCTTT<br>GGGGGTTTGCTGCTGGCTCTGACTCCCGTCCTGC<br>GATGGGTTGCGACGGGGGAACAATCCCCAAGAGG<br>CATGAACTGGTGAAGGGGCCGAAGAAGGTTGAGA<br>AGGTCGACAAAGATGCTGAATTAGTGGCCCAATG<br>GAACTATTGTACTCTAAGTCAGGAAATATTAAGAC<br>GACCAATAGTTGCCTGTGAACTTGGCAGACTTTAT<br>AACAAAGATGCCGTCATTGAATTTCTCTTGGACAA<br>ATCTGCAGAAAAGGCTCTTGGGAAGGCAGCATCT<br>CACATTAAAAGCATTAAGAATGTGACAGAGCTGAA<br>GCTTTCTGATAATCCTGCCTGGGAAGGGGATAAAG<br>GAAACACTAAAGGTGACAAGCACGATGACCTCCA<br>GCGGGCGCGTTTCATCTGCCCCGTTGTGGGCCTG<br>GAGATGAACGGCGACACAGGTTCTGCTTCCTTCG<br>GTGCTGCGGCTGTGTGTTTTCTGAGCGAGCCTTGA<br>AAGAGATAAAAGCGGAAGTTTGCCACACGTGTGG<br>GGCTGCCTTCCAGGAGGATGATGTCATCGTGCTC<br>AATGGCACCAAGGAGGATGTGGACGTGCTGAAGA<br>CAAGGATGGAGGAGAGAAGGCTGAGAGCGAAGCT<br>GGAAAAGAAACCAAAGAAACCCAAGGCAGCAGAG<br>TCTGCTTCAAAACCAGATGTCAGTGAAGAAGCCCC<br>AGGGCCATCAAAAGTTAAGACAGGGAAGCCTGAA<br>GAAGCCAGCCTTGATTCTAGAGAGAAGAAAACCAA<br>CTTGGCTCCCAAAAGCACAGCAATGAATGAGAGCT<br>CTTCTGGAAAAGCTGGGAAGCCTCCGTGTGGAGC<br>CACAAAGAGGTCCATCGCTGACAGTGAAGAATCG<br>GAGGCCTACAAGTCCCTCTTTACCACTCACAGCTC<br>CGCCAAGCGCTCCAAGGAGGAGTCTGCCCACTGG<br>GTCACCCACACGTCCTACTGCTTCTGAAGCCCGCA<br>CTGCCACCGCTCCTGCCCCAGAAGGTT | 18 | DTGSASFG<br>AAAVCFLS<br>EP* |
| 1945 | NM_016407.2_538 | 538 | GGATTTCGCGGGAAATCCCGGAAGTGACAGCTTT<br>GGGGGTTTGCTGCTGGCTCTGACTCCCGTCCTGC<br>GATGGGTTGCGACGGGGGAACAATCCCCAAGAGG<br>CATGAACTGGTGAAGGGGCCGAAGAAGGTTGAGA<br>AGGTCGACAAAGATGCTGAATTAGTGGCCCAATG<br>GAACTATTGTACTCTAAGTCAGGAAATATTAAGAC<br>GACCAATAGTTGCCTGTGAACTTGGCAGACTTTAT<br>AACAAAGATGCCGTCATTGAATTTCTCTTGGACAA<br>ATCTGCAGAAAAGGCTCTTGGGAAGGCAGCATCT<br>CACATTAAAAGCATTAAGAATGTGACAGAGCTGAA<br>GCTTTCTGATAATCCTGCCTGGGAAGGGGATAAAG<br>GAAACACTAAAGGTGACAAGCACGATGACCTCCA<br>GCGGGCGCGTTTCATCTGCCCCGTTGTGGGCCTG<br>GAGATGAACGGCGACACAGGTTCTGCTTCCTTC<br>GGTGCTGCGGCTGTGTGTTTTCTGAGCGAGCCTT<br>GAAAGAGATAAAAGCGGAAGTTGCCACACGTGTG<br>GGGCTGCCTTCCAGGAGGATGATGTCATCGTGCT<br>CAATGGCACCAAGGAGGATGTGGACGTGCTGAAG<br>ACAAGGATGGAGGAGAGAAGGCTGAGAGCGAAGC<br>TGGAAAAGAAACCAAAGAAACCCAAGGCAGCAGA<br>GTCTGCTTCAAAACCAGATGTCAGTGAAGAAGCCC<br>CAGGGCCATCAAAAGTTAAGACAGGGAAGCCTGA<br>AGAAGCCAGCCTTGATTCTAGAGAGAAGAAAACCA<br>ACTTGGCTCCCAAAAGCACAGCAATGAATGAGAGC<br>TCTTCTGGAAAAGCTGGGAAGCCTCCGTGTGGAG<br>CCACAAAGAGGTCCATCGCTGACAGTGAAGAATC<br>GGAGGCCTACAAGTCCCTCTTTACCACTCACAGCT<br>CCGCCAAGCGCTCCAAGGAGGAGTCTGCCCACTG<br>GGTCACCCACACGTCCTACTGCTTCTGAAGCCCG<br>CACTGCCACCGCTCCTGCCCCAGAAGGTT | 25 | ATRVGLPS<br>RRMMSSC<br>SMAPRRM<br>WTC* |

TABLE 3A-continued

| SEQ ID | identifier_ position | position | modified_RNA | PAP length | PAP |
|---|---|---|---|---|---|
| 1946 | NM_0164 10.3_122 | 122 | GGAAGTCGAGGCGGGAGTGACTCTGCTTCCGTTT CTGGTTTTGCTCTAGTGTTTGGGTTTCTTCGCGGC TGCTCAAGATGAACCGACTCTTCGGGAAAGCGAAA CCCAAGGCTCCGCCGCCAGCCTGACTGGCTGCAT TGGCACGGTGGACAGTAGAGCAGAATCCATTGAC AAGAAGATTTCTCGATTGGATGCTGAGCTAGTGAA GTATAAGGATCAGATCAAGAAGATGAGAGAGGGT CCTGCAAAGAATATGGTCAAGCAGAAAGCCTTGCG AGTTTTAAAGCAAAAGAGGATGTATGAGCAGCAGC GGGACAATCTTGCCCAACAGTCATTCAACATGGAA CAAGCCAATTATACCATCCAGTCTTTGAAGGACAC CAAGACCACGGTTGATGCTATGAAACTGGGAGTAA AGGAAATGAAGAAGGCATACAAGCAAGTGAAGATC GACCAGATTGAGGATTTACAAGACCAGCTAGAGGA TATGATGGAAGATGCAAATGAAATCCAAGAAGCAC TGAGTCGCAGTTATGGCACCCCAGAACTGGATGA AGATGATTTAGAAGCAGAGTTGGATGCACTAGGTG ATGAGCTTCTGGCTGATGAAGCAGTTCTTATTTG GATGAGGCAGCATCTGCACCTGCAATTCCAGAAG GTGTTCCCACTGATACAAAAAACAAGGATGGAGTT CTGGTGGATGAATTTGGATTGCCACAGATCCCTGC TTCATAGATTTGCATCATTCAAGCATATCTTGTAAA ACAAACACATATTATGGGACTAGGAAATATTTATCT TTCCAAATTTGCCATAACAGATTTAGGTTTCTTTCC TTTCTTTGAAGGAAAGTTTAATTACATTGCTCTTTTA TTTTTTCCATTAAGAGACTCATTGCTTGGGAAATGC TTTCTTCGTACTAAAATTTGATTCCTTTTTTTCTTAT GAAAAACGAACTCAGTTTAAAAGTATTTTTAGCTCG TATGACTTGTTTTCATTCATTAATAATAATTTGAAAT AAAA | 1 | A* |
| 1947 | NM_0164 10.3_190 | 190 | GGAAGTCGAGGCGGGAGTGACTCTGCTTCCGTTT CTGGTTTTGCTCTAGTGTTTGGGTTTCTTCGCGGC TGCTCAAGATGAACCGACTCTTCGGGAAAGCGAAA CCCAAGGCTCCGCCGCCCAGCCTGACTGGCTGCA TTGGCACGGTGGACAGTAGAGCAGAATCCATTGA CAAGAAGATTTCTCGATTGGATGCTGAGCTAGTGAA GTATAAGGATCAGATCAAGAAGATGAGAGAGGGT CCTGCAAAGAATATGGTCAAGCAGAAAGCCTTGCG AGTTTTAAAGCAAAAGAGGATGTATGAGCAGCAGC GGGACAATCTTGCCCAACAGTCATTCAACATGGAA CAAGCCAATTATACCATCCAGTCTTTGAAGGACAC CAAGACCACGGTTGATGCTATGAAACTGGGAGTAA AGGAAATGAAGAAGGCATACAAGCAAGTGAAGATC GACCAGATTGAGGATTTACAAGACCAGCTAGAGGA TATGATGGAAGATGCAAATGAAATCCAAGAAGCAC TGAGTCGCAGTTATGGCACCCCAGAACTGGATGA AGATGATTTAGAAGCAGAGTTGGATGCACTAGGTG ATGAGCTTCTGGCTGATGAAGCAGTTCTTATTTG GATGAGGCAGCATCTGCACCTGCAATTCCAGAAG GTGTTCCCACTGATACAAAAAACAAGGATGGAGTT CTGGTGGATGAATTTGGATTGCCACAGATCCCTGC TTCATAGATTTGCATCATTCAAGCATATCTTGTAAA ACAAACACATATTATGGGACTAGGAAATATTTATCT TTCCAAATTTGCCATAACAGATTTAGGTTTCTTTCC TTTCTTTGAAGGAAAGTTTAATTACATTGCTCTTTTA TTTTTTCCATTAAGAGACTCATTGCTTGGGAAATGC TTTCTTCGTACTAAAATTTGATTCCTTTTTTTCTTAT GAAAAACGAACTCAGTTTAAAAGTATTTTTAGCTCG TATGACTTGTTTTCATTCATTAATAATAATTTGAAAT AAAA | 4 | WMLS* |
| 1948 | NM_0164 10.3_456 | 456 | GGAAGTCGAGGCGGGAGTGACTCTGCTTCCGTTT CTGGTTTTGCTCTAGTGTTTGGGTTTCTTCGCGGC TGCTCAAGATGAACCGACTCTTCGGGAAAGCGAAA CCCAAGGCTCCGCCGCCCAGCCTGACTGGCTGCA TTGGCACGGTGGACAGTAGAGCAGAATCCATTGA CAAGAAGATTTCTCGATTGGATGCTGAGCTAGTGA AGTATAAGGATCAGATCAAGAAGATGAGAGAGGGT CCTGCAAAGAATATGGTCAAGCAGAAAGCCTTGCG AGTTTTAAAGCAAAAGAGGATGTATGAGCAGCAGC GGGACAATCTTGCCCAACAGTCATTCAACATGGAA CAAGCCAATTATACCATCCAGTCTTTGAAGGACAC CAAGACCACGGTTGATGCTATGAAACTGGGAGTAA AGGAAATGAAGAAGGCATACAAGCAAGTGAAGATC GACAGATTGAGGATTTACAAGACCAGCTAGAGGAT ATGATGGAAGATGCAAATGAAATCCAAGAAGCACT GAGTCGCAGTTATGGCACCCCAGAACTGGATGAA GATGATTTAGAAGCAGAGTTGGATGCACTAGGTGA | 8 | RLRIYKTS* |

TABLE 3A-continued

| SEQ ID | identifier_ position | position | modified_RNA | PAP length | PAP |
|---|---|---|---|---|---|
| | | | TGAGCTTCTGGCTGATGAAGACAGTTCTTATTTGG ATGAGGCAGCATCTGCACCTGCAATTCCAGAAGGT GTTCCCACTGATACAAAAAACAAGGATGGAGTTCT GGTGGATGAATTTGGATTGCCACAGATCCCTGCTT CATAGATTTGCATCATTCAAGCATATCTTGTAAAAC AAACACATATTATGGGACTAGGAAATATTTATCTTT CCAAATTTGCCATAACAGATTTAGGTTTCTTTCCTT TCTTTGAAGGAAAGTTTAATTACATTGCTCTTTTATT TTTTCCATTAAGAGACTCATTGCTTGGGAAATGCTT TCTTCGTACTAAAATTTGATTCCTTTTTTTCTTATGA AAAACGAACTCAGTTTAAAAGTATTTTTAGCTCGTA TGACTTGTTTTCATTCATTAATAATAATTTGAAATAA AA | | |
| 1949 | NM_0164 10.3_604 | 604 | GGAAGTCGAGGCGGGAGTGACTCTGCTTCCGTTT CTGGTTTTGCTCTAGTGTTTGGGTTTCTTCGCGGC TGCTCAAGATGAACCGACTCTTCGGGAAAGCGAAA CCCAAGGCTCCGCCGCCCAGCCTGACTGGCTGCA TTGGCACGGTGGACAGTAGAGCAGAATCCATTGA CAAGAAGATTTCTCGATTGGATGCTGAGCTAGTGA AGTATAAGGATCAGATCAAGAAGATGAGAGAGGGT CCTGCAAAGAATATGGTCAAGCAGAAAGCCTTGCG AGTTTTAAAGCAAAAGAGGATGTATGAGCAGCAGC GGGACAATCTTGCCCAACAGTCATTCAACATGGAA CAAGCCAATTATACCATCCAGTCTTTGAAGGACAC CAAGACCACGGTTGATGCTATGAAACTGGGAGTAA AGGAAATGAAGAAGGCATACAAGCAAGTGAAGATC GACCAGATTGAGGATTTACAAGACCAGCTAGAGGA TATGATGGAAGATGCAAATGAAATCCAAGAAGCAC TGAGTCGCAGTTATGGCACCCCAGAACTGGATGA AGATGATTTAGAAGCAGAGTTGGATGCACTAGGTG ATGAGCTTCTGGTGATGAAGACAGTTCTTATTTGG ATGAGGCAGCATCTGCACCTGCAATTCCAGAAGGT GTTCCCACTGATACAAAAAACAAGGATGGAGTTCT GGTGGATGAATTTGGATTGCCACAGATCCCTGCTT CATAGATTTGCATCATTCAAGCATATCTTGTAAAAC AAACACATATTATGGGACTAGGAAATATTTATCTTT CCAAATTTGCCATAACAGATTTAGGTTTCTTTCCTT TCTTTGAAGGAAAGTTTAATTACATTGCTCTTTTATT TTTTCCATTAAGAGACTCATTGCTTGGGAAATGCTT TCTTCGTACTAAAATTTGATTCCTTTTTTTCTTATGA AAAACGAACTCAGTTTAAAAGTATTTTTAGCTCGTA TGACTTGTTTTCATTCATTAATAATAATTTGAAATAA AA | 53 | VMKTVLIW MRQHLHL QFQKVFPL IQKTRMEF WWMNLDC HRSLLHRF ASFKHIL* |
| 1950 | NM_0164 56.2_157 | 157 | TACGGCTGCGAGAAGACGACAGAAGGGGATTAAG AGGGAGGGCGGGGACAACTGGGTCTTTTGCGGCT GCAGCGGGCTTGTAGGTGTCCGGCTTTGCTGGCC CAGCAAGCCTGATAAGCATGAAGCTCTTATCTTTG GTGGCTGTGGTCGGGTGTTGCTGGTGCCCCCAGC TGAAGCCAACAAGAGTTCTGAAGATATCCGGTGCA AATGCATCTGTCCACCTTATAGAAACATCAGTGGG CACATTTACAACCAGAATGTATCCCAGAAGGACTG CAACTGCCTGCACGTGGTGGAGCCCATGCCAGTG CCTGGCCATGACGTGGAGGCCTACTGCCTGCTGT GCGAGTGCAGGTACGAGGAGCGCAGCACCACCA CCATCAAGGTCATCATTGTCATCTACCTGTCCGTG GTGGGTGCCCTGTTGCTCTACATGGCCTTCCTGAT GCTGGTGGACCCTCTGATCCGAAAGCCGGATGCA TATACTGAGCAACTGCACAATGAGGAGGAGAATGA GGATGCTCGCTCTATGGCAGCAGCTGCTGCATCC CTCGGGGGACCCCGAGCAAACACAGTCCTGGAGC GTGTGGAAGGTGCCCAGCAGCGGTGGAAGCTGCA GGTGCAGGAGCAGCGGAAGACAGTCTTCGATCGG CACAAGATGCTCAGCTAGATGGGCTGGTGTGGTT GGGTCAAGGCCCCAACACCATGGCTGCCAGCTTC CAGGCTGGACAAAGCAGGGGGCTACTTCTCCCTT CCCTCGGTTCCAGTCTTCCCTTTAAAAGCCTGTGG CATTTTTCCTCCTTCTCCCTAACTTTAGAAATGTTG TACTTGGCTATTTTGATTAGGGAAGAGGGATGTGG TCTCTGATCTCCGTTGTCTTCTTGGGTCTTTGGGG TTGAAGGGAGGGGGAAGGCAGGCCAGAAGGGAA TGGAGACATTCGAGGCGGCCTCAGGAGTGGATGC GATCTGTCTCTCCTGGCTCCACTCTTGCCGCCTTC CAGCTCTGAGTCTTGGGAATGTTGTTA | 96 | CWCPQLK PTRVLKIS GANASVHL IETSVGTFT TRMYPRRT ATACTWW SPCQCLA MTWRPTA CCASAGTR SAAPPPSR SSLSSTCP WWVPCCS TWPS* |
| 1951 | NM_0164 56.2_371 | 371 | TACGGCTGCGAGAAGACGACAGAAGGGGATTAAG AGGGAGGGCGGGGACAACTGGGTCTTTTGCGGCT GCAGCGGGCTTGTAGGTGTCCGGCTTTGCTGGCC CAGCAAGCCTGATAAGCATGAAGCTCTTATCTTTG | 25 | RPPPSRSS LSSTCPW WVPCCST WPS* |

TABLE 3A-continued

| SEQ ID | identifier_position | position | modified_RNA | PAP length | PAP |
|---|---|---|---|---|---|
| | | | GTGGCTGTGGTCGGGTGTTTGCTGGTGCCCCCAG CTGAAGCCAACAAGAGTTCTGAAGATATCCGGTGC AAATGCATCTGTCCACCTTATAGAAACATCAGTGG GCACATTTACAACCAGAATGTATCCCAGAAGGACT GCAACTGCCTGCACGTGGTGGAGCCCATGCCAGT GCCTGGCCATGACGTGGAGGCCTACTGCCTGCTG TGCGAGTGCAGGTACGAGGAGCGCAGACCACCAC CATCAAGGTCATCATTGTCATCTACCTGTCCGTGG TGGGTGCCCTGTTGCTCTACATGGCCTTCCTGATG CTGGTGGACCCTCTGATCCGAAAGCCGGATGCAT ATACTGAGCAACTGCACAATGAGGAGGAGAATGA GGATGCTCGCTCTATGGCAGCAGCTGCTGCATCC CTCGGGGGACCCCGAGCAAACACAGTCCTGGAGC GTGTGGAAGGTGCCCAGCAGCGGTGGAAGCTGCA GGTGCAGGAGCAGCGGAAGACAGTCTTCGATCGG CACAAGATGCTCAGCTAGATGGGCTGGTGTGGTT GGGTCAAGGCCCCAACACCATGGCTGCCAGCTTC CAGGCTGGACAAAGCAGGGGGCTACTTCTCCCTT CCCTCGGTTCCAGTCTTCCCTTTAAAAGCCTGTGG CATTTTTCCTCCTTCTCCCTAACTTTAGAAATGTTG TACTTGGCTATTTTGATTAGGGAAGAGGGATGTGG TCTCTGATCTCCGTTGTCTTCTTGGGTCTTTGGGG TTGAAGGGAGGGGGAAGGCAGGCCAGAAGGGAA TGGAGACATTCGAGGCGGCCTCAGGAGTGGATGC GATCTGTCTCTCCTGGCTCCACTCTTGCCGCCTTC CAGCTCTGAGTCTTGGGAATGTTGTTA | | |
| 1952 | NM_0164 91.2_295 | 295 | CTCATTCGTTCCCAGCAGGCCCTGCGCGCGGCAA CATGGCGGGGTCCAGGTGGAGGTCTTGAGGCTAT CAGATCGGTATGGCATTGGCGTCCGGGCCCGCAA GGCGGGCGCTAGCTGGCTCCGGGCAGCTCGGCC TTGGGGGCTTCGGGGCCCCGAGACGCGGGGCGT ATGAGTGGGGCGTGCGCTCCACGCGGAAGTCGG AGCCTCCTCCCCTGGATAGGGTGTACGAGATCCC TGGACTGGAGCCCATCACCTTTGCGGGGAAGATG CACTTCGTGCCCTGGCTGGCGCGGCGATCTTTCC GCCCTGGGACCGCGGCTACAAGGACCCAAGGTTC TACCGCTCGCCCCCTCTTCACGAGCATCCGCTGTA CAAAGACCAGGCCTGCTATATCTTTCACCACCGTT GCCGCCTTCTCGAGGGTGTAAAGCAGGCCCTCTG GCTCACCAAGACCAAGTTAATAGAAGGCCTTCCCG AGAAAGTGCTTAGCCTTGTTGATGATCCAAGGAAC CACATAGAGAACCAAGACGAGTGCGTTCTGAATGT GATCTCTCACGCCCGTCTCTGGCAGACCACTGAG GAAATCCCCAAGAGAGAGACCTACTGCCCGGTCA TCGTGGACAACCTAATACAGCTGTGTAAATCTCAG ATTCTCAAGCATCCTTCTCTGGCCAGGAGGATCTG TGTCCAAAACTCCACGTTTTCTGCTACCTGGAACC GAGAGTCTCTTCTCCTTCAAGTCCGTGGTTCTGGT GGAGCCCGACTGAGCACTAAGGATCCTCTGCCCA CCATCGCCTCCAGAGAGGAGATTGAAGCTACTAA GAATCATGTTCTAGAGACCTTCTACCCCATATCAC CCATCATCGATCTTCATGAATGCAATATTTATGATG TGAAAAAATGACACAGGATTCCAGGAAGGCTATCCT TACCCCTATCCCCATACCCTGTACTTACTGGACAA AGCCAATTTACGACCACACCGCCTTCAACCAGATC AGCTGCGGGCCAAGATGATCCTGTTT | 44 | RSFRPGTA ATRTQGST ARPLFTSIR CTKTRPAI SFTTVAAF SRV* |
| 1953 | NM_0165 89.3_260 | 260 | TGCCCCGGTCGGGCGGGACTTCCTGTGTCGTATT TCCAAGGACTCCAAAGCGAGGCCGGGGACTGAAG GTGTGGGTGTCGAGCCCTCTGGCAGAGGGTTAAC CTGGGTCAAATGCACGGATTCTCACCTCGTACAGT TACGCTCTCCCGCGGCACGTCCGCGAGGACTTGA AGTCCTGAGCGCTCAAGTTTGTCCGTAGGTCGAGA GAAGGCCATGGAGGTGCCGCCACCGGCACCGCG GAGCTTTCTCTGTAGAGCATGTGCCTATTTCCCCG AGTCTTTGCTGCCGAAGCTGTGACTGCCGATTCGG AAGTCCTTGAGGAGCGTCAGAAGCGGCTTCCCTA CGTCCCAGAGCCCTATTACCCGGAATCTGGATGG GACCGCCTCCGGGAGCTGTTTGGCAAAGATGAAC AGCAGAGAATTTCAAAGGACCTTGCTAATATCTGT AAGACGGCAGCTACAGCAGGCATCATTGGCTGGG TGTATGGGGAATACCAGCTTTTATTCATGCTAAA CAACAATACATTGAGCAGAGCCAGGCAGAAATTTA TCATAACCGGTTTGATGCTGTGCAATCTGCACATC GTGCTGCCACACGAGGCTTCATTCGTTATGGCTGG CGCTGGGGTTGGAGAACTGCAGTGTTTGTGACTAT ATTCAACACAGTGAACACTAGTCTGAATGTATACC GAAATAAAGATGCCTTAAGCCATTTTGTAATTGCAG | 12 | CAYFPESL LPKL* |

TABLE 3A-continued

| SEQ ID | identifier_position | position | modified_RNA | PAP length | PAP |
|---|---|---|---|---|---|
| | | | GAGCTGTCACGGGAAGTCTTTTTAGGATAAACGTA GGCCTGCGTGGCCTGGTGGCTGGTGGCATAATTG GAGCCTTGCTGGGCACTCCTGTAGGAGGCCTGCT GATGGCATTTCAGAAGTACTCTGGTGAGACTGTTC AGGAAAGAAAACAGAAGGATCGAAAGGCACTCCA TGAGCTAAAACTGGAAGAGTGGAAAGGCAGACTA CAAGTTACTGAGCACCTCCCTGAGAAAATTGAAAG TAGTTTACAGGAAGATGAACCTGAGAATGATGCTA AGAAAATTGAAGCACTGCTAAA | | |
| 1954 | NM_016589.3_399 | 399 | TGCCCCGGTCGGGCGGGACTTCCTGTGTCGTATT TCCAAGGACTCCAAAGCGAGGCCGGGGACTGAAG GTGTGGGTGTCGAGCCCTCTGGCAGAGGGTTAAC CTGGGTCAAATGCACGGATTCTCACCTCGTACAGT TACGCTCTCCCGCGGCACGTCCGCGAGGACTTGA AGTCCTGAGCGCTCAAGTTTGTCCGTAGGTCGAGA GAAGGCCATGGAGGTGCCGCCACCGGCACCGCG GAGCTTTCTCTGTAGAGCATTGTGCCTATTTCCCC GAGTCTTTGCTGCCGAAGCTGTGACTGCCGATTCG GAAGTCCTTGAGGAGCGTCAGAAGCGGCTTCCCT ACGTCCAGAGCCCTATTACCCGGAATCTGGATG GGACCGCCTCCGGGAGCTGTTGGCAAAGATGAAC AGCAGAGAATTTCAAAGGACCTTGCTAATATCTGT AAGACGGCAGCTACAGCAGGCATCATTGGCTGGG TGTATGGGGGAATACCAGCTTTTATTCATGCTAAA CAACAATACATTGAGCAGAGCCAGGCAGAAATTTA TCATAACCGGTTTGATGCTGTGCAATCTGCACATC GTGCTGCCACACGAGGCTTCATTCGTTATGGCTGG CGCTGGGGTTGGAGAACTGCAGTGTTTGTGACTAT ATTCAACACAGTGAACACTAGTCTGAATGTATACC GAAATAAAGATGCCTTAAGCCATTTTGTAATTGCAG GAGCTGTCACGGGAAGTCTTTTTAGGATAAACGTA GGCCTGCGTGGCCTGGTGGCTGGTGGCATAATTG GAGCCTTGCTGGGCACTCCTGTAGGAGGCCTGCT GATGGCATTTCAGAAGTACTCTGGTGAGACTGTTC AGGAAAGAAAACAGAAGGATCGAAAGGCACTCCA TGAGCTAAAACTGGAAGAGTGGAAAGGCAGACTA CAAGTTACTGAGCACCTCCCTGAGAAAATTGAAAG TAGTTTACAGGAAGATGAACCTGAGAATGATGCTA AGAAAATTGAAGCACTGCTAAA | 84 | LAKMNSRE FQRTLLISV RRQLQQA SLAGCMG EYQLLFML NNNTLSRA RQKFIITGL MLCNLHIV LPHEASFV MAGAGVG ELQCL* |
| 1955 | NM_016641.3_187 | 187 | ACTCCCTCTCTGGATGTGTCTGCTGCCGCCATTGT GCGGCGCTGGTCCCCTCAGAGGGTTCCTGCTGCT GCCGGTGCCTTGGACCCTCCCCCTCGCTTCTCGT TCTACTGCCCCAGGAGCCCGGCGGGTCCGGGACT CCCGTCCGTGCCGGTGCGGGCGCCGGCATGTGG CTGTGGGAGGACCAGGCGGCCTCCTGGGCCCTTT CTCCTTCCTGCTGCTAGTGCTGCTGCTGGTGACGC GGAGCCCGGTCAATGCCTGCCTCCTCACCGGCAG CCTCTTCGTTCTACTGCGCGTCTTCAGCTTTGAGC CGGTGCCCTCTTGCAGGGCCCTGCAGGTGCTCAA GCCCCGGGACCGCATTTCTGCCATCGCCCACCGT GGCGGCAGCCACGACGCGCCCGAGAACACGCTG GCGGCCATTCGGCAGGCAGCTAAGAATGGAGCAA CAGGCGTGGAGTTGGACATTGAGTTTACTTCTGAC GGGATTCCTGTCTTAATGCACGATAACACAGTAGA TAGGACGACTGATGGGACTGGGCGATTGTGTGAT TTGACATTTGAACAAATTAGGAAGCTGAATCCTGC AGCAAACCACAGACTCAGGAATGATTTCCCTGATG AAAAGATCCCTACCCTAAGGGAAGCTGTTGCAGAG TGCCTAAACCATAACCTCACAATCTTCTTTGATGTC AAAGGCCATGCACACAAGGCTACTGAGGCTCTAAA GAAAAATGTATATGGAATTTCCTCAACTGTATAATAA TAGTGTGGTCTGTTCTTTCTTGCCAGAAGTTATCTA CAAGATGAGACAAACAGATCGGGATGTAATAACAG CATTAACTCACAGACCTTGGAGCCTAAGCCATACA GGAGATGGGAAACCACGCTATGATACTTTCTGGAA ACATTTTATATTTGTTATGATGGACATTTTGCTCGA TTGGAGCATGCATAATATCTTGTGGTACCTGTGTG GAATTTCAGCTTTCCTCATGCAAAAGGATTTTGTAT CCCCGGCCTACTTGAAG | 11 | AASWALSP SCC* |
| 1956 | NM_017450.1_296 | 296 | CCGCTTTCGTCTCCGTCCTGCTGCCGTTACCGCC GCTGCTGCCGCCGCTTGCGTCCCCGCTCCGGTC TGTGGTGCACGGGACCCAGGACCATGTCTCTG TCTCGCTCAGAGGAGATGCACCGGCTCACGGAAA ATGTCTATAAGACCATCATGGAGCAGTTCAACCCT AGCCTCCGGAACTTCATCGCCATGGGGAAGAATTA CGAGAAGGCACTGGCAGGTGTGACGTATGCAGCC AAAGGCTACTTTGACGCCCTGGTGAAGATGGGGG | 26 | APKNSETF SSRWLKST GRSRISWK KC* |

TABLE 3A-continued

| SEQ ID | identifier_ position | position | modified_RNA | PAP length | PAP |
|---|---|---|---|---|---|
| | | | AGCTGGCCAGCGAGAGCCAGGCTCCAAAGAACTC GGGAGACGTTCTCTTCCAGATGGCTGAAGTCCACA GGCAGATCCAGAATCAGCTGGAAGAAATGCTGAA GTCTTTTCACAACGAGCTGCTTACGCAGCTGGAGC AGAAGGTGGAGCTGGACTCCAGGTATCTGAGTGC TGCGCTGAAGAAATACCAGACTGAGCAAAGGAGC AAAGGCGACGCCCTGGACAAGTGTCAGGCTGAGC TGAAGAAGCTTCGGAAGAAGAGCCAGGGCAGCAA GAATCCTCAGAAGTACTCGGACAAGGAGCTGCAG TACATCGACGCCATCAGCAACAAGCAGGGCGAGC TGGAGAATTACGTGTCCGACGGCTACAAGACCGC ACTGACAGAGGAGCGCAGGCGCTTCTGCTTCCTG GTGGAGAAGCAGTGCGCCGTGGCCAAGAACTCCG CGGCCTACCACTCCAAGGGCAAGGAGCTGCTGGC GCAGAAGCTGCCGCTGTGGCAACAGGCCTGTGCC GACCCCAGCAAGATCCCGGAGCGCGCGGTGCAG CTCATGCAGCAGGTGGCCAGCAACGGCGCCACCC TCCCCAGCGCCCTGTCGGCCTCCAAGTCCAACCT GGTCATTTCCGACCCCATTCCGGGGGCCAAGCCC CTGCCGGTGCCCCCCGAGCTGGCACCGTTCGTGG GGCGGATGTCTGCCCAGGAGAGCACACCCATCAT GAACGGCGTCACAGGCCCGGATGGCGAGGACTA CAG | | |
| 1957 | NM_0174 50.1_542 | 542 | CCGCTTTCGTCTCCGTCCTGCTGCCGTTACCGCC GCTGCTGCCGCCGCTTGCGTCCCCCGCTCCGGTC TGTGGTGCAGCCGGGACCCAGGACCATGTCTCTG TCTCGCTCAGAGGAGATGCACCGGCTCACGGAAA ATGTCTATAAGACCATCATGGAGCAGTTCAACCCT AGCCTCCGGAACTTCATCGCCATGGGGAAGAATTA CGAGAAGGCACTGGCAGGTGTGACGTATGCAGCC AAAGGCTACTTTGACGCCCTGGTGAAGATGGGGG AGCTGGCCAGCGAGAGCCAGGGCTCCAAAGAACT CGGAGACGTTCTCTTCCAGATGGCTGAAGTCCACA GGCAGATCCAGAATCAGCTGGAAGAAATGCTGAA GTCTTTTCACAACGAGCTGCTTACGCAGCTGGAGC AGAAGGTGGAGCTGGACTCCAGGTATCTGAGTGC TGCGCTGAAGAAATACCAGACTGAGCAAAGGAGC AAAGGCGACGCCCTGGACAAGTGTCAGGCTGAGC TGAAGAAGCTTCGGAAGAAGAGCCAGGCAGCAAG AATCCTCAGAAGTACTCGGACAAGGAGCTGCAGTA CATCGACGCCATCAGCAACAAGCAGGGCGAGCTG GAGAATTACGTGTCCGACGGCTACAAGACCGCAC TGACAGAGGAGCGCAGGCGCTTCTGCTTCCTGGT GGAGAAGCAGTGCGCCGTGGCCAAGAACTCCGC GGCCTACCACTCCAAGGGCAAGGAGCTGCTGGCG CAGAAGCTGCCGCTGTGGCAACAGGCCTGTGCCG ACCCCAGCAAGATCCCGGAGCGCGCGGTGCAGCT CATGCAGCAGGTGGCCAGCAACGGCGCCACCCTC CCCAGCGCCCTGTCGGCCTCCAAGTCCAACCTGG TCATTTCCGACCCCATTCCGGGGGCCAAGCCCCT GCCGGTGCCCCCCGAGCTGGCACCGTTCGTGGGG GCGGATGTCTGCCCAGGAGAGCACACCCATCATG AACGGCGTCACAGGCCCGGATGGCGAGGACTACA G | 37 | AARILRST RTRSCSTS TPSATSRA SWRITCPT ATRPH* |
| 1958 | NM_0175 10.4_261 | 261 | AAGATGGCTGTGGAGCTGGGCGTGCTGCTCGTCC GGCCCCGGCCCGGAACCGGGCTGGGTAGAGTGA TGCGGACCCTCCTGCTGGTGCTGTGGCTGGCGAC GCGCGGAAGCGCGCTCTACTTTCACATCGGAGAG ACGGAGAAGAAGTGCTTTATTGAGGAGATCCCGG ACGAGACCATGGTCATAGGAAACTACCGGACGCA GCTGTATGACAAGCAGCGGGAGGAGTACCAGCCG GCCACCCCGGGGCTTGGCATGTTGTGGAGGTGAA GGACCCAGAGGACAAGGTCATCCTGGCCCGGCAG TATGGCTCCGAGGGCAGGTTCACTTTCACTTCCCA TACCCCTGGTGAGCACCAGATCTGTCTTCACTCCA ATTCCACCAAGTTCTCCCTCTTTGCTGGAGGCATG CTGAGAGTTCACCTGGACATCCAGGTAGGTGAAC ATGCCAATGACTATGCAGAAATTGCTGCTAAAGAC AAGTTGAGTGAGTTGCAGCTACGAGTGCGACAGC TGGTGGAACAAGTGGAGCAGATCCAGAAAGAGCA GAACTACCAGCGGTGGCGAGAGGAGCGCTTCCG GCAGACCAGTGAGAGCACCAACCAGCGGGTGCTG TGGTGGTCCATTCTGCAGACCCTCATCCTCGTGGC CATCGGTGTCTGGCAGATGCGGCACCTCAAGAGC TTCTTTGAAGCCAAGAAGCTTGTGTAGCTGTCCCA GGCGTCACAACCCATCCTCCCAGGCTGGGGGAGA AAGGACCTCCTGGAACTGACTTCTTCTGTCAGGAG | 3 | LWR* |

TABLE 3A-continued

| SEQ ID | identifier_position | position | modified_RNA | PAP length | PAP |
|---|---|---|---|---|---|
| | | | GACTGGTTTCCAGCCATACCTGTTCTGGAAGGGAG AGGGGCTGGAGGCACCCACAGGCACAAGCTGAA GGCAGCAGCTTGGCTAATACTGAGCAGGTAGTGG GGCAAATTCCTGCCCTCTCTCTGGCCTCTGGGC CGTTTGGTAGTAATCACCCAAGGGCTGGTAAAGCC CCTCCTCTTGGCACCTCAGAATCACAGTGTTACTG ATCAGGGATGTGAGGCTGCTGTTGGGGGTG | | |
| 1959 | NM_0175 28.2_381 | 381 | GACATAAAAACCGGGTGCCGGCAGGCGCCAGTCG CAGGTGTGCTGCTGAGGCGTGAGAATGGCGTCCC GCGGCCGGCGTCCGGAGCATGGCGGACCCCCAG AGCTGTTTTATGACGAGACAGAAGCCCGGAAATAC GTTCGCAACTCACGGATGATTGATATCCAGACCAG GATGGCTGGGCGAGCATTGGAGCTTCTTTATCTGC CAGAGAATAAGCCCTGTTACCTGCTGGATATTGGC TGTGGCACTGGGCTGAGTGGAAGTTATCTGTCAGA TGAAGGGCACTATTGGGTGGGCCTGGATATCAGC CCTGCCATGCTGGATGAGGCTGTGGACCGAGAGA TAGAGGGAGACCTGCTGCTGGGGGATATGGGCCA GGCATCCCATTCAAGCCAGGCACATTTGATGGTTG CATCAGCATTTCTGCTGTGCAGTGGCTCTGTAATG CTAACAAGAAGTCTGAAAACCCTGCCAAGCGCCTG TACTGCTTTTTGCTTCTCTTTTTTCTGTTCTCGTCC GGGGATCCCGAGCTGTCCTGCAGCTGTACCCTGA GAACTCAGAGCAGTTGGAGCTGATCACAACCCAG GCCACAAAGGCAGGCTTCTCCGGTGGCATGGTGG TAGACTACCCTAACAGTGCCAAAGCAAAGAAATTC TACCTCTGCTTGTTTTCTGGGCCTTCGACCTTTATA CCAGAGGGGCTGAGTGAAAATCAGGATGAAGTTG AACCCAGGGAGTCTGTGTTCACCAATGAGAGGTTC CCATTAAGGATGTCGAGGCGGGGAATGGTGAGGA AGAGTCGGGCATGGGTGCTGGAGAAGAAGGAGC GGCACAGGCGCCAGGGCAGGGAAGTCAGACCTG ACACCCAGTACACCGGCCGCAAGCGCAAGCCCCG CTTCTAAGTCACCACGCGGTTCTGGAAAGGCACTT GCCTCTGCACTTTTCTATATTGTTCAGCTGACAAAG TAGTATTTTAGAAAAGTTCTAAAGTTATAAAAATGTT TTCTGCAGTAAAAAAAAAGT | 65 | ASHSSQAH LMVASAFL LCSGSVML TRSLKTLP SACTAFLL LFFLFSSG DPELSCSC TLRTQSSW S* |
| 1960 | NM_0178 22.3_211 | 211 | GAGCCGCTGGCGCCACTAGAGAAGGGCGAGCGG CGCGGCAGAGTGCGGCGCAGCGCAGCTCCTGAG GTTTTGGTTATGAACAGGATTCGGATTCACGTCTT GCCAACCAATCGGGGGAGGATCACTCCAGTGCCC AGGTCTCAGGAACCTCTGTCTTGTGCATTCACTCA TCGTCCATGCTCTCACCCTCGTCTGGAGGGGCAG GAGTTTGCATTAAGCATATCCTTGAAGACAAGAAT GCACCCTTCAAGCAGTGTAGTTATATATCGACGAA GAATGGAAAAAGATGTCCCAATGCTGCCCCAAAGC CAGAGAAGAAAGATGGGGTGTCCTTCTGTGCTGA ACATGTCCGTAGGAATGCCCTGGCACTTCATGCTC AAATGAAGAAGACCAACCCAGGGCCTGTGGGTGA AACACTCCTGTGCCAGCTGAGCTCATATGCTAAGA CAGAGCTGGGGTCTCAGACTCCAGAAAGTAGTCG CAGTGAAGCCAGCCGAATACTAGATGAAGACAGC TGGAGTGATGGGGAGCAGGAACCCATTACTGTGG ATCAGACATGGAGAGGTGACCCTGACAGTGAAGC TGATAGCATAGACAGTGATCAAGAAGATCCCCTAA AACATGCTGGTGTCTACACAGCAGAAGAAGTGGC CCTGATTATGCGTGAAAAGCTAATTCGTTTGCAGT CGTTGTATATTGATCAGTTTAAACGACTTCAGCATC TGCTCAAGGAGAAGAAGCGCCGATACTTACATAAT CGCAAAGTGGAACATGAAGCTCTAGGCAGTAGTCT CCTGACTGGCCCAGAGGGACTTTTGGCCAAAGAA CGAGAGAACTTAAAGCGATTAAAATGTCTGCGACG ATACCGCCAGCGCTATGGAGTGGAAGCCTTACTG CATAGGCAGTTGAAGGAACGGAGAATGCTGGCCA CAGATGGTGCTGCCCAACAGGCCCATACCACTCG TTCCAGTCAGAGGTGCTTGGCCTTTGTGGATGATG TTCGTTGTTCCAATCAGTCTCTTCC | 57 | ALSISLKTR MHPSSSVV IYRRRMEK DVPMLPQS QRRKMGC PSVLNMSV GMPWHFM LK* |
| 1961 | NM_0184 64.2_197 | 197 | GCGCGGTAGCATCGCGGAGTCGGTGCTTTAGTAC GCCGCTGGCACCTTTACTCTCGCCGGCCGCGCGA ACCCGTTTGAGCTCGGTATCCTAGTGCACACGCCT TGCAAGCGACGGCGCCATGAGTCTGACTTCCAGT TCCAGCGTACGAGTTGAATGGATCGCAGCAGTTAC CATTGCTGCTGGGACAGCTGCAATGGTTATCTAGC TTACAAAAGATTTATGTTAAAGATCATCGAAATAA AGCTATGATAAACCTTCACATCCAGAAAGACAACC CCAAGATAGTACATGCTTTTGACATGGAGGATTTG GGAGATAAAGCTGTGTACTGCCGTTGTTGGAGGTC | 3 | MVI* |

TABLE 3A-continued

| SEQ ID | identifier_position | position | modified_RNA | PAP length | PAP |
|---|---|---|---|---|---|
| | | | CAAAAAGTTCCCATTCTGTGATGGGGCTCACACAA<br>AACATAACGAAGAGACTGGAGACAATGTGGGCCC<br>TCTGATCATCAAGAAAAAAGAAACTTAAATGGACA<br>CTTTTGATGCTGCAAATCAGCTTGTCGTGAAGTTA<br>CCTGATTGTTTAATTAGAATGACTACCACCTCTGTC<br>TGATTCACCTTCGCTGGATTCTAAATGTGGTATATT<br>GCAAACTGCAGCTTTCACATTTATGGCATTTGTCTT<br>GTTGAAACATCGTGGTGCACATTTGTTTAAACAAAA<br>AAAAAAAAAAAAAAGGAAAAACCAACCTCATGGCC<br>TGTGGGTTATTTTGGTCTTGTAAGGATCCATTTCTT<br>TAAAATACTGACATATAGAGTTGTACCTTATATAGA<br>ATATAGTTGTATCTTGAAGTCAACATATTAAATTATT<br>CTCAAAATTATGTATTTGCAGATTGTACTTGTAAGT<br>TTCAAAGAAAAATTACCATCTTTTCATATTGACCTG<br>GAAACTAAATAGGATGTGATTCAGCTACATTAATTT<br>CTTAATACAATCTAAAAAAAAAAAAAAAAAAAAAAA<br>AAAAA | | |
| 1962 | NM_0184<br>64.2_281 | 281 | GCGCGGTAGCATCGCGGAGTCGGTGCTTTAGTAC<br>GCCGCTGGCACCTTTACTCTCGCCGGCCGCGCGA<br>ACCCGTTTGAGCTCGGTATCCTAGTGCACACGCCT<br>TGCAAGCGACGGCGCCATGAGTCTGACTTCCAGT<br>TCCAGCGTACGAGTTGAATGGATCGCAGCAGTTAC<br>CATTGCTGCTGGGACAGCTGCAATTGGTTATCTAG<br>CTTACAAAAGATTTTATGTTAAAGATCATCGAAATA<br>AAGCTATGATAAACCTTCACATCCAGAAAGACAAC<br>CCAAGATAGTACATGCTTTTGACATGGAGGATTTG<br>GGAGATAAAGCTGTGTACTGCCGTTGTTGGAGGTC<br>CAAAAAGTTCCCATTCTGTGATGGGGCTCACACAA<br>AACATAACGAAGAGACTGGAGACAATGTGGGCCC<br>TCTGATCATCAAGAAAAAAGAAACTTAAATGGACA<br>CTTTTGATGCTGCAAATCAGCTTGTCGTGAAGTTA<br>CCTGATTGTTTAATTAGAATGACTACCACCTCTGTC<br>TGATTCACCTTCGCTGGATTCTAAATGTGGTATATT<br>GCAAACTGCAGCTTTCACATTTATGGCATTTGTCTT<br>GTTGAAACATCGTGGTGCACATTTGTTTAAACAAAA<br>AAAAAAAAAAAAAAGGAAAAACCAACCTCATGGCC<br>TGTGGGTTATTTTGGTCTTGTAAGGATCCATTTCTT<br>TAAAATACTGACATATAGAGTTGTACCTTATATAGA<br>ATATAGTTGTATCTTGAAGTCAACATATTAAATTATT<br>CTCAAAATTATGTATTTGCAGATTGTACTTGTAAGT<br>TTCAAAGAAAAATTACCATCTTTTCATATTGACCTG<br>GAAACTAAATAGGATGTGATTCAGCTACATTAATTT<br>CTTAATACAATCTAAAAAAAAAAAAAAAAAAAAAAA<br>AAAAA | 1 | R* |
| 1963 | NM_0184<br>64.2_299 | 299 | GCGCGGTAGCATCGCGGAGTCGGTGCTTTAGTAC<br>GCCGCTGGCACCTTTACTCTCGCCGGCCGCGCGA<br>ACCCGTTTGAGCTCGGTATCCTAGTGCACACGCCT<br>TGCAAGCGACGGCGCCATGAGTCTGACTTCCAGT<br>TCCAGCGTACGAGTTGAATGGATCGCAGCAGTTAC<br>CATTGCTGCTGGGACAGCTGCAATTGGTTATCTAG<br>CTTACAAAAGATTTTATGTTAAAGATCATCGAAATA<br>AAGCTATGATAAACCTTCACATCCAGAAAGACAAC<br>CCAAGATAGTACATGCTTTTGACATGGAGGATTTG<br>GGAGATAAAGCTGTGTACTGCCGTTGTTGGAGGTC<br>CAAAAAGTTCCCATTCTGTGATGGGGCTCACACAA<br>AACATAACGAAGAGACTGGAGACAATGTGGGCCC<br>TCTGATCATCAAGAAAAAAGAAACTTAAATGGACA<br>CTTTTGATGCTGCAAATCAGCTTGTCGTGAAGTTA<br>CCTGATTGTTTAATTAGAATGACTACCACCTCTGTC<br>TGATTCACCTTCGCTGGATTCTAAATGTGGTATATT<br>GCAAACTGCAGCTTTCACATTTATGGCATTTGTCTT<br>GTTGAAACATCGTGGTGCACATTTGTTTAAACAAAA<br>AAAAAAAAAAAAAAGGAAAAACCAACCTCATGGCC<br>TGTGGGTTATTTTGGTCTTGTAAGGATCCATTTCTT<br>TAAAATACTGACATATAGAGTTGTACCTTATATAGA<br>ATATAGTTGTATCTTGAAGTCAACATATTAAATTATT<br>CTCAAAATTATGTATTTGCAGATTGTACTTGTAAGT<br>TTCAAAGAAAAATTACCATCTTTTCATATTGACCTG<br>GAAACTAAATAGGATGTGATTCAGCTACATTAATTT<br>CTTAATACAATCTAAAAAAAAAAAAAAAAAAAAAAA<br>AAAAA | 41 | LTWRIWEI<br>KLCTAVVG<br>GPKSSHSV<br>MGLTQNIT<br>KRLETMW<br>AL* |
| 1964 | NM_0184<br>64.2_313 | 313 | GCGCGGTAGCATCGCGGAGTCGGTGCTTTAGTAC<br>GCCGCTGGCACCTTTACTCTCGCCGGCCGCGCGA<br>ACCCGTTTGAGCTCGGTATCCTAGTGCACACGCCT<br>TGCAAGCGACGGCGCCATGAGTCTGACTTCCAGT<br>TCCAGCGTACGAGTTGAATGGATCGCAGCAGTTAC<br>CATTGCTGCTGGGACAGCTGCAATTGGTTATCTAG | 36 | WEIKLCTA<br>VVGGPKSS<br>HSVMGLT<br>QNITKRLE<br>TMWAL* |

TABLE 3A-continued

| SEQ ID | identifier_ position | position | modified_RNA | PAP length | PAP |
|---|---|---|---|---|---|
| | | | CTTACAAAAGATTTTATGTTAAAGATCATCGAAATA<br>AAGCTATGATAAACCTTCACATCCAGAAAGACAAC<br>CCCAAGATAGTACATGCTTTTGACATGGAGGATTG<br>GGAGATAAAGCTGTGTACTGCCGTTGTTGGAGGTC<br>CAAAAAGTTCCCATTCTGTGATGGGGCTCACACAA<br>AACATAACGAAGAGACTGGAGACAATGTGGGCCC<br>TCTGATCATCAAGAAAAAAGAAACTTAAATGGACA<br>CTTTTGATGCTGCAAATCAGCTTGTCGTGAAGTTA<br>CCTGATTGTTTAATTAGAATGACTACCACCTCTGTC<br>TGATTCACCTTCGCTGGATTCTAAATGTGGTATATT<br>GCAAACTGCAGCTTTCACATTTATGGCATTTGTCTT<br>GTTGAAACATCGTGGTGCACATTTGTTTAAACAAAA<br>AAAAAAAAAAAAAAAGGAAAAACCAACCTCATGGCC<br>TGTGGGTTATTTTGGTCTTGTAAGGATCCATTTCTT<br>TAAAATACTGACATATAGAGTTGTACCTTATATAGA<br>ATATAGTTGTATCTTGAAGTCAACATATTAAATTATT<br>CTCAAAATTATGTATTTGCAGATTGTACTTGTAAGT<br>TTCAAAGAAAAATTACCATCTTTTCATATTGACCTG<br>GAAACTAAATAGGATGTGATTCAGCTACATTAATTT<br>CTTAATACAATCTAAAAAAAAAAAAAAAAAAAAAAAA<br>AAAAA | | |
| 1965 | NM_0189<br>47.4_157 | 157 | AGGGCGCGGGAGCGCGGAGCGAGTTTGGTTGCA<br>CTTACACCGGTACTTAAGCGCGGACCGGCGTGTC<br>CTTGGACTTAGAGAGTGGGGACGTCCGGCTTCGG<br>AGCGGGAGTGTTCGTTGTGCCAGCGACTAAAAAG<br>AGAATTAAATATGGGTGATGTGAGAAAGGCAAGAA<br>GATTTTTATTATGAAGTGTTCCCAGTGCCACACCGT<br>TGAAAAGGGAGGCAAGCACAAGACTGGGCCAAAT<br>CTCCATGGTCTCTTTGGGCGGAAGACAGGTCAGG<br>CCCCTGGATACTCTTACACAGCCGCCAATAAGAAC<br>AAAGGCATCATCTGGGGAGAGGATACACTGATGG<br>AGTATTTGGAGAATCCCAAGAAGTACATCCCTGGA<br>ACAAAAATGATCTTTGTCGGCATTAAGAAGAAGGA<br>AGAAAGGGCAGACTTAATAGCTTATCTCAAAAAAG<br>CTACTAATGAGTAATAATTGGCCACTGCCTTATTTA<br>TTACAAAACAGAAATGTCTCATGACTTTTTTATGTG<br>TACCATCCTTTAATAGATCTCATACACCAGAATTCA<br>GATCATGAATGACTGACAGAATATTTTGTTGGGCA<br>GTCCTGATTTAAAACTAAGACTGGCTTGTGGTTAA<br>ATGAATATGTTCAGTTTTTGAATTTTAATAGTAACTC<br>CAATTCAGTAAATGGTATCACTGTTTACCCCTTTTA<br>AAGATATGATTAGACTTCGTTAGTAATGTTCAACTT<br>TTCACAAAGATGGTGAGTGCCATCTTAAAAACTTACT<br>GGAGATTGGTTTTATATTTAGATTTATATAACTGGT<br>TATGTGAATATATTTAAATACTGGGGAAATTGCTTC<br>ACTGTCTTAGAACCAAGCAAGATTCACCTGTGTTTT<br>GTGTTCATGTTCATTTGCCTCTTAAAGGCAAGGGT<br>TGAAGATAAATAAGGTAGCAATGTCTATAGTTTTGG<br>CCTTAACTATGCCAATCTAATTATAATTCCCTGTAT<br>TTAAAAATGGTTTCTTTTACTTATTGAAAGGCATTTA | 8 | RKARRFLL* |
| 1966 | NM_0189<br>47.4_178 | 178 | AGGGCGCGGGAGCGCGGAGCGAGTTTGGTTGCA<br>CTTACACCGGTACTTAAGCGCGGACCGGCGTGTC<br>CTTGGACTTAGAGAGTGGGGACGTCCGGCTTCGG<br>AGCGGGAGTGTTCGTTGTGCCAGCGACTAAAAAG<br>AGAATTAAATATGGGTGATGTGAGAAAGGCAAGA<br>AGATTTTATTATGAAGTGTTCCCAGTGCCACACCG<br>TTGAAAAGGGAGGCAAGCACAAGACTGGGCCAAA<br>TCTCCATGGTCTCTTTGGGCGGAAGACAGGTCAG<br>GCCCCTGGATACTCTTACACAGCCGCCAATAAGAA<br>CAAAGGCATCATCTGGGGAGAGGATACACTGATG<br>GAGTATTTGGAGAATCCCAAGAAGTACATCCCTGG<br>AACAAAAATGATCTTTGTCGGCATTAAGAAGAAGG<br>AAGAAAGGGCAGACTTAATAGCTTATCTCAAAAAA<br>GCTACTAATGAGTAATAATTGGCCACTGCCTTATTT<br>ATTACAAAACAGAAATGTCTCATGACTTTTTTATGT<br>GTACCATCCTTTAATAGATCTCATACACCAGAATTC<br>AGATCATGAATGACTGACAGAATATTTTGTTGGGC<br>AGTCCTGATTTAAAACTAAGACTGGCTTGTGGTTA<br>AATGAATATGTTCAGTTTTTGAATTTTAATAGTAACT<br>CCAATTCAGTAAATGGTATCACTGTTTACCCCTTTT<br>AAAGATATGATTAGACTTCGTTAGTAATGTTCAACT<br>TTTCACAAAGATGGTGAGTGCCATCTTAAAAACTTAC<br>TGGAGATTGGTTTTATATTTAGATTTATATAACTGG<br>TTATGTGAATATATTTAAATACTGGGGAAATTGCTT<br>CACTGTCTTAGAACCAAGCAAGATTCACCTGTGTT<br>TTGTGTTCATGTTCATTTGCCTCTTAAAGGCAAGG<br>GTTGAAGATAAATAAGGTAGCAATGTCTATAGTTTT | 2 | LL* |

TABLE 3A-continued

| SEQ ID | identifier_position | position | modified_RNA | PAP length | PAP |
|---|---|---|---|---|---|
| | | | GGCCTTAACTATGCCAATCTAATTATAATTCCCTGT ATTTAAAATGGTTTCTTTTACTTATTGAAAGGCATTT TAG | | |
| 1967 | NM_0189 47.4_235 | 235 | AGGGCGCGGGAGCGCGGAGCGAGTTTGGTTGCA CTTACACCGGTACTTAAGCGCGGACCGGCGTGTC CTTGGACTTAGAGAGTGGGGACGTCCGGCTTCGG AGCGGGAGTGTTCGTTGTGCCAGCGACTAAAAAG AGAATTAAATATGGGTGATGTTGAGAAAGGCAAGA AGATTTTTATTATGAAGTGTTCCCAGTGCCACACC GTTGAAAAGGGAGGCAAGCACAAGACTGGCCAAA TCTCCATGGTCTCTTTGGGCGGAAGACAGGTCAG GCCCCTGGATACTCTTACACAGCCGCCAATAAGAA CAAAGGCATCATCTGGGGAGAGGATACACTGATG GAGTATTTGGAGAATCCCAAGAAGTACATCCCTGG AACAAAAATGATCTTTGTCGGCATTAAGAAGAAGG AAGAAAGGGCAGACTTAATAGCTTATCTCAAAAAA GCTACTAATGAGTAATAATTGGCCACTGCCTTATTT ATTACAAAACAGAAATGTCTCATGACTTTTTTATGT GTACCATCCTTTAATAGATCTCATACACCAGAATTC AGATCATGAATGACTGACAGAATATTTGTTGGGC AGTCCTGATTTAAAACTAAGACTGGCTTGTGGTTA AATGAATATGTTCAGTTTTTGAATTTTAATAGTAACT CCAATTCAGTAAATGGTATCACTGTTTACCCCTTTT AAAGATATGATTAGACTTCGTTAGTAATGTTCAACT TTTCACAAAGATGGTGAGTGCCATCTTAAAACTTAC TGGAGATTGGTTTATATTTAGATTTATATAACTGG TTATGTGAATATATTTAAATACTGGGGAAATTGCTT CACTGTCTTAGAACCAAGCAAGATTCACCTGTGTT TTGTGTTCATGTTCATTTGCCTCTTAAAGGCAAGG GTTGAAGATAAATAAGGTAGCAATGTCTATAGTTTT GGCCTTAACTATGCCAATCTAATTATAATTCCCTGT ATTTAAAATGGTTTCTTTTACTTATTGAAAGGCATTT TAG | 34 | QISMVSLG GRQVRPL DTLTQPPI RTKASSGE RIH* |
| 1968 | NM_0189 47.4_256 | 256 | AGGGCGCGGGAGCGCGGAGCGAGTTTGGTTGCA CTTACACCGGTACTTAAGCGCGGACCGGCGTGTC CTTGGACTTAGAGAGTGGGGACGTCCGGCTTCGG AGCGGGAGTGTTCGTTGTGCCAGCGACTAAAAAG AGAATTAAATATGGGTGATGTTGAGAAAGGCAAGA AGATTTTTATTATGAAGTGTTCCCAGTGCCACACC GTTGAAAAGGGAGGCAAGCACAAGACTGGGCCAA ATCTCCATGGTCTCTTGGGCGGAAGACAGGTCAG GCCCCTGGATACTCTTACACAGCCGCCAATAAGAA CAAAGGCATCATCTGGGGAGAGGATACACTGATG GAGTATTTGGAGAATCCCAAGAAGTACATCCCTGG AACAAAAATGATCTTTGTCGGCATTAAGAAGAAGG AAGAAAGGGCAGACTTAATAGCTTATCTCAAAAAA GCTACTAATGAGTAATAATTGGCCACTGCCTTATTT ATTACAAAACAGAAATGTCTCATGACTTTTTTATGT GTACCATCCTTTAATAGATCTCATACACCAGAATTC AGATCATGAATGACTGACAGAATATTTGTTGGGC AGTCCTGATTTAAAACTAAGACTGGCTTGTGGTTA AATGAATATGTTCAGTTTTTGAATTTTAATAGTAACT CCAATTCAGTAAATGGTATCACTGTTTACCCCTTTT AAAGATATGATTAGACTTCGTTAGTAATGTTCAACT TTTCACAAAGATGGTGAGTGCCATCTTAAAACTTAC TGGAGATTGGTTTATATTTAGATTTATATAACTGG TTATGTGAATATATTTAAATACTGGGGAAATTGCTT CACTGTCTTAGAACCAAGCAAGATTCACCTGTGTT TTGTGTTCATGTTCATTTGCCTCTTAAAGGCAAGG GTTGAAGATAAATAAGGTAGCAATGTCTATAGTTTT GGCCTTAACTATGCCAATCTAATTATAATTCCCTGT ATTTAAAATGGTTTCTTTTACTTATTGAAAGGCATTT TAG | 28 | LGGRQVR PLDTLTQP PIRTKASS GERIH* |
| 1969 | NM_0189 47.4_282 | 282 | AGGGCGCGGGAGCGCGGAGCGAGTTTGGTTGCA CTTACACCGGTACTTAAGCGCGGACCGGCGTGTC CTTGGACTTAGAGAGTGGGGACGTCCGGCTTCGG AGCGGGAGTGTTCGTTGTGCCAGCGACTAAAAAG AGAATTAAATATGGGTGATGTTGAGAAAGGCAAGA AGATTTTTATTATGAAGTGTTCCCAGTGCCACACC GTTGAAAAGGGAGGCAAGCACAAGACTGGGCCAA ATCTCCATGGTCTCTTTGGGCGGAAGACAGGTCAG GCCCCTGATACTCTTACACAGCCGCCAATAAGAAC AAAGGCATCATCTGGGGAGAGGATACACTGATGG AGTATTTGGAGAATCCCAAGAAGTACATCCCTGGA ACAAAAATGATCTTTGTCGGCATTAAGAAGAAGGA AGAAAGGGCAGACTTAATAGCTTATCTCAAAAAAG CTACTAATGAGTAATAATTGGCCACTGCCTTATTA | 19 | DTLTQPPI RTKASSGE RIH* |

TABLE 3A-continued

| SEQ ID | identifier_ position | position | modified_RNA | PAP length | PAP |
|---|---|---|---|---|---|
| | | | TTACAAAACAGAAATGTCTCATGACTTTTTTATGTG TACCATCCTTTAATAGATCTCATACACCAGAATTCA GATCATGAATGACTGACAGAATATTTTGTTGGGCA GTCCTGATTTAAAACTAAGACTGGCTTGTGGTTAA ATGAATATGTTCAGTTTTTGAATTTTAATAGTAACTC CAATTCAGTAAATGGTATCACTGTTTACCCCTTTTA AAGATATGATTAGACTTCGTTAGTAATGTTCAACTT TTCACAAAGATGGTGAGTGCCATCTTAAAACTTACT GGAGATTGGTTTTATATTTAGATTTATATAACTGGT TATGTGAATATATTTAAATACTGGGGAAATTGCTTC ACTGTCTTAGAACCAAGCAAGATTCACCTGTGTTTT GTGTTCATGTTCATTTGCCTCTTAAAGGCAAGGGT TGAAGATAAATAAGGTAGCAATGTCTATAGTTTTGG CCTTAACTATGCCAATCTAATTATAATTCCCTGTAT TTAAAATGGTTTCTTTTACTTATTGAAAGGCATTTTA G | | |
| 1970 | NM_0189 47.4_301 | 301 | AGGGCGCGGGAGCGCGGAGCGAGTTTGGTTGCA CTTACACCGGTACTTAAGCGCGGACCGGCGTGTC CTTGGACTTAGAGAGTGGGGACGTCCGGCTTCGG AGCGGGAGTGTTCGTTGTGCCAGCGACTAAAAAG AGAATTAAATATGGGTGATGTTGAGAAAGGCAAGA AGATTTTTATTATGAAGTGTTCCCAGTGCCACACC GTTGAAAAGGGAGGCAAGCACAAGACTGGGCCAA ATCTCCATGGTCTCTTTGGGCGGAAGACAGGTCAG GCCCCTGGATACTCTTACACAGCCGCAATAAGAAC AAAGGCATCATCTGGGGAGAGGATACACTGATGG AGTATTTGGAGAATCCCAAGAAGTACATCCCTGGA ACAAAAATGATCTTTGTCGGCATTAAGAAGAAGGA AGAAAGGGCAGACTTAATAGCTTATCTCAAAAAAG CTACTAATGAGTAATAATTGGCCACTGCCTTATTTA TTACAAAACAGAAATGTCTCATGACTTTTTTATGTG TACCATCCTTTAATAGATCTCATACACCAGAATTCA GATCATGAATGACTGACAGAATATTTTGTTGGGCA GTCCTGATTTAAAACTAAGACTGGCTTGTGGTTAA ATGAATATGTTCAGTTTTTGAATTTTAATAGTAACTC CAATTCAGTAAATGGTATCACTGTTTACCCCTTTTA AAGATATGATTAGACTTCGTTAGTAATGTTCAACTT TTCACAAAGATGGTGAGTGCCATCTTAAAACTTACT GGAGATTGGTTTTATATTTAGATTTATATAACTGGT TATGTGAATATATTTAAATACTGGGGAAATTGCTTC ACTGTCTTAGAACCAAGCAAGATTCACCTGTGTTTT GTGTTCATGTTCATTTGCCTCTTAAAGGCAAGGGT TGAAGATAAATAAGGTAGCAATGTCTATAGTTTTGG CCTTAACTATGCCAATCTAATTATAATTCCCTGTAT TTAAAATGGTTTCTTTTACTTATTGAAAGGCATTTTA G | 12 | IRTKASSG ERIH* |
| 1971 | NM_0189 47.4_327 | 327 | AGGGCGCGGGAGCGCGGAGCGAGTTTGGTTGCA CTTACACCGGTACTTAAGCGCGGACCGGCGTGTC CTTGGACTTAGAGAGTGGGGACGTCCGGCTTCGG AGCGGGAGTGTTCGTTGTGCCAGCGACTAAAAAG AGAATTAAATATGGGTGATGTTGAGAAAGGCAAGA AGATTTTTATTATGAAGTGTTCCCAGTGCCACACC GTTGAAAAGGGAGGCAAGCACAAGACTGGGCCAA ATCTCCATGGTCTCTTTGGGCGGAAGACAGGTCAG GCCCCTGGATACTCTTACACAGCCGCAATAAGAAC AAAGGCATCATCTGGGAGAGGATACACTGATGG AGTATTTGGAGAATCCCAAGAAGTACATCCCTGGA ACAAAAATGATCTTTGTCGGCATTAAGAAGAAGGA AGAAAGGGCAGACTTAATAGCTTATCTCAAAAAAG CTACTAATGAGTAATAATTGGCCACTGCCTTATTTA TTACAAAACAGAAATGTCTCATGACTTTTTTATGTG TACCATCCTTTAATAGATCTCATACACCAGAATTCA GATCATGAATGACTGACAGAATATTTTGTTGGGCA GTCCTGATTTAAAACTAAGACTGGCTTGTGGTTAA ATGAATATGTTCAGTTTTTGAATTTTAATAGTAACTC CAATTCAGTAAATGGTATCACTGTTTACCCCTTTTA AAGATATGATTAGACTTCGTTAGTAATGTTCAACTT TTCACAAAGATGGTGAGTGCCATCTTAAAACTTACT GGAGATTGGTTTTATATTTAGATTTATATAACTGGT TATGTGAATATATTTAAATACTGGGGAAATTGCTTC ACTGTCTTAGAACCAAGCAAGATTCACCTGTGTTTT GTGTTCATGTTCATTTGCCTCTTAAAGGCAAGGGT TGAAGATAAATAAGGTAGCAATGTCTATAGTTTTGG CCTTAACTATGCCAATCTAATTATAATTCCCTGTAT TTAAAATGGTTTCTTTTACTTATTGAAAGGCATTTTA G | 4 | ERIH* |

TABLE 3A-continued

| SEQ ID | identifier_position | position | modified_RNA | PAP length | PAP |
|---|---|---|---|---|---|
| 1972 | NM_018947.4_351 | 351 | AGGGCGCGGGAGCGCGGAGCGAGTTTGGTTGCACTTACACCGGTACTTAAGCGCGGACCGGCGTGTCCTTGGACTTAGAGAGTGGGGACGTCCGGCTTCGGAGCGGGAGTGTTCGTTGTGCCAGCGACTAAAAAGAGAATTAAATATGGGTGATGTTGAGAAAGGCAAGAAGATTTTTATTATGAAGTGTTCCCAGTGCCACACCGTTGAAAAGGGAGGCAAGCACAAGACTGGGCCAAATCTCCATGGTCTCTTTGGGCGGAAGACAGGTCAGGCCCCTGGATACTCTTACACAGCCGCCAATAAGAACAAAGGCATCATCTGGGGAGAGGATACACTGATGGAGTATTGGAGAATCCCAAGAAGTACATCCCTGGAACAAAAATGATCTTTGTCGGCATTAAGAAGAAGGAAGAAAGGGCAGACTTAATAGCTTATCTCAAAAAAGCTACTAATGAGTAATAATTGGCCACTGCCTTATTTATTACAAAACAGAAATGTCTCATGACTTTTTTATGTGTACCATCCTTTAATAGATCTCATACACCAGAATTCAGATCATGAATGACTGACAGAATATTTTGTTGGGCAGTCCTGATTTAAAACTAAGACTGGCTTGTGGTTAAATGAATATGTTCAGTTTTTGAATTTTAATAGTAACTCCAATTCAGTAAATGGTATCACTGTTTACCCCTTTTAAAGATATGATTAGACTTCGTTAGTAATGTTCAACTTTTCACAAAGATGGTGAGTGCCATCTTAAAACTTACTGGAGATTGGTTTTATATTTAGATTTATATAACTGGTTATGTGAATATATTTAAATACTGGGGAAATTGCTTCACTGTCTTAGAACCAAGCAAGATTCACCTGTGTTTTGTGTTCATGTTCATTTGCCTCTTAAAGGCAAGGGTTGAAGATAAATAAGGTAGCAATGTCTATAGTTTTGGCCTTAACTATGCCAATCTAATTATAATTCCCTGTATTTAAAATGGTTTCTTTTACTTATTGAAAGGCATTTAG | 12 | WRIPRSTSLEQK* |
| 1973 | NM_018947.4_394 | 394 | AGGGCGCGGGAGCGCGGAGCGAGTTTGGTTGCACTTACACCGGTACTTAAGCGCGGACCGGCGTGTCCTTGGACTTAGAGAGTGGGGACGTCCGGCTTCGGAGCGGGAGTGTTCGTTGTGCCAGCGACTAAAAAGAGAATTAAATATGGGTGATGTTGAGAAAGGCAAGAAGATTTTTATTATGAAGTGTTCCCAGTGCCACACCGTTGAAAAGGGAGGCAAGCACAAGACTGGGCCAAATCTCCATGGTCTCTTTGGGCGGAAGACAGGTCAGGCCCCTGGATACTCTTACACAGCCGCCAATAAGAACAAAGGCATCATCTGGGGAGAGGATACACTGATGGAGTATTTGGAGAATCCCAAGAAGTACATCCCTGGAACAAAAATGATCTTGTCGGCATTAAGAAGAAGGAAGAAAGGGCAGACTTAATAGCTTATCTCAAAAAAGCTACTAATGAGTAATAATTGGCCACTGCCTTATTTATTACAAAACAGAAATGTCTCATGACTTTTTTATGTGTACCATCCTTTAATAGATCTCATACACCAGAATTCAGATCATGAATGACTGACAGAATATTTTGTTGGGCAGTCCTGATTTAAAACTAAGACTGGCTTGTGGTTAAATGAATATGTTCAGTTTTTGAATTTTAATAGTAACTCCAATTCAGTAAATGGTATCACTGTTTACCCCTTTTAAAGATATGATTAGACTTCGTTAGTAATGTTCAACTTTTCACAAAGATGGTGAGTGCCATCTTAAAACTTACTGGAGATTGGTTTTATATTTAGATTTATATAACTGGTTATGTGAATATATTTAAATACTGGGGAAATTGCTTCACTGTCTTAGAACCAAGCAAGATTCACCTGTGTTTTGTGTTCATGTTCATTTGCCTCTTAAAGGCAAGGGTTGAAGATAAATAAGGTAGCAATGTCTATAGTTTTGGCCTTAACTATGCCAATCTAATTATAATTCCCTGTATTTAAAATGGTTTCTTTTACTTATTGAAAGGCATTTAG | 12 | LSALRRRKKGQT* |
| 1974 | NM_019051.1_101 | 101 | AGGCCCGTGGATCTCATCGAAGATGGCGGCGCGATCTGTGTCGGGCATTACCAGAAGAGTCTTCATGTGGACAGTCTCAGGGACACCATGTAGAGAATTTGGTCTCGATTCAGAAAAGAGAAAGAGCCAGTGGTTGTTGAGACAGTAGAAGAGAAAAAGGAACCTATCCTAGTGTGTCCACCTTTACGAAGCCGAGCATACACACCACCTGAAGATCTCCAGAGTCGTTTGGAATCTTACGTTAAAGAAGTTTTTGGTTCATCTCTTCCTAGTAATTGGCAAGACATCTCCCTGGAAGATAGTCGTCTAAAGTTCAATCTTCTGGCTCATTTAGCTGATGACTTGGGTCATGTAGTCCCTAACTCCAGACTCCACCAGATGTGCAGGGTTAGAGATGTTCTTGATTTCTATAATGTCCCTATTCAAGATAGATCTAAATTTGATGAACTCAGTGCCAGTAATCTGCCCCCAATTTGAAAATCACTTGGAGTTACTAAGCAATTCGGAAGAGAAACACATTGAAATCACTGTCTTTCCCTGAGCAAGGGGGCTGCTCATTAGATCTTTTGATACTTTACCATGTGAAATACTACCAGA | 15 | GLDSEKRKSQWLLRQ* |

TABLE 3A-continued

| SEQ ID | identifier_position | position | modified_RNA | PAP length | PAP |
|---|---|---|---|---|---|
| | | | ACTGTTCTCTAAACCCACTTTTTCTGTAGAGGAATG TATCATCTTTTTTTTTCTCATATTACAAATGGACAAA TAACGGACTTTCTATTTTCATATTTGCTGAAACCAT TTTTTAAATGAAATTAGGTCATTATTTATGAAAAGTT TTGAGAGGGCACTGTCAACTTGGGTTTAAGACAGG AGGACATTGCAAGTTCACACCTTTCATAAGCATAA AGTAGTTGCAAGAAAGTATTTTCATCCTGTTAGGAT TCATATCTAAGATAGAGTTATGCATTGCACATACAC AAATAAACTTTTATTAGATAGATACCTATAAAAGAA ACATAAAAGTATGTTGTGTATTACTGACAGTTCTAG ATTAATTTCTTTTAGAATTAAAGTAGATTTGTTAAAG TG | | |
| 1975 | NM_0190 51.1_231 | 231 | AGGCCCGTGGATCTCATCGAAGATGGCGGCGCGA TCTGTGTCGGGCATTACCAGAAGAGTCTTCATGTG GACAGTCTCAGGGACACCATGTAGAGAATTTTGGT CTCGATTCAGAAAAGAGAAAGAGCCAGTGGTTGTT GAGACAGTAGAAGAGAAAAAGGAACCTATCCTAGT GTGTCCACCTTTACGAAGCCGAGCATACACACCAC CTGAAGATCTCCAGAGTCGTTGGAATCTTACGTTA AAGAAGTTTTTGGTTCATCTCTTCCTAGTAATTGGC AAGACATCTCCCTGGAAGATAGTCGTCTAAAGTTC AATCTTCTGGCTCATTTAGCTGATGACTTGGGTCAT GTAGTCCCTAACTCCAGACTCCACCAGATGTGCAG GGTTAGAGATGTTCTTGATTTCTATAATGTCCCTAT TCAAGATAGATCTAAATTTGATGAACTCAGTGCCA GTAATCTGCCCCCCAATTTGAAAATCACTTGGAGT TACTAAGCAATTCGGAAGAGAAACACATTGAAATC ACTGTCTTTCCCTGAGCAAGGGGGCTGCTCATTAG ATCTTTTGATACTTTACCATGTGAAATACTACCAGA ACTGTTCTCTAAACCCACTTTTTCTGTAGAGGAATG TATCATCTTTTTTTTTCTCATATTACAAATGGACAAA TAACGGACTTTCTATTTTCATATTTGCTGAAACCAT TTTTTAAATGAAATTAGGTCATTATTTATGAAAAGTT TTGAGAGGGCACTGTCAACTTGGGTTTAAGACAGG AGGACATTGCAAGTTCACACCTTTCATAAGCATAA AGTAGTTGCAAGAAAGTATTTTCATCCTGTTAGGAT TCATATCTAAGATAGAGTTATGCATTGCACATACAC AAATAAACTTTTATTAGATAGATACCTATAAAAGAA ACATAAAAGTATGTTGTGTATTACTGACAGTTCTAG ATTAATTTCTTTTAGAATTAAAGTAGATTTGTTAAAG TG | 26 | WNLTLKKF LVHLFLVIG KTSPWKIV V* |
| 1976 | NM_0190 51.1_256 | 256 | AGGCCCGTGGATCTCATCGAAGATGGCGGCGCGA TCTGTGTCGGGCATTACCAGAAGAGTCTTCATGTG GACAGTCTCAGGGACACCATGTAGAGAATTTTGGT CTCGATTCAGAAAAGAGAAAGAGCCAGTGGTTGTT GAGACAGTAGAAGAGAAAAAGGAACCTATCCTAGT GTGTCCACCTTTACGAAGCCGAGCATACACACCAC CTGAAGATCTCCAGAGTCGTTTGGAATCTTACGTT AAAGAAGTTTTTGGTTCATCTCTTCCTAGTAATTGGC AAGACATCTCCCTGGAAGATAGTCGTCTAAAGTTC AATCTTCTGGCTCATTTAGCTGATGACTTGGGTCAT GTAGTCCCTAACTCCAGACTCCACCAGATGTGCAG GGTTAGAGATGTTCTTGATTTCTATAATGTCCCTAT TCAAGATAGATCTAAATTTGATGAACTCAGTGCCA GTAATCTGCCCCCCAATTTGAAAATCACTTGGAGT TACTAAGCAATTCGGAAGAGAAACACATTGAAATC ACTGTCTTTCCCTGAGCAAGGGGGCTGCTCATTAG ATCTTTTGATACTTTACCATGTGAAATACTACCAGA ACTGTTCTCTAAACCCACTTTTTCTGTAGAGGAATG TATCATCTTTTTTTTTCTCATATTACAAATGGACAAA TAACGGACTTTCTATTTTCATATTTGCTGAAACCAT TTTTTAAATGAAATTAGGTCATTATTTATGAAAAGTT TTGAGAGGGCACTGTCAACTTGGGTTTAAGACAGG AGGACATTGCAAGTTCACACCTTTCATAAGCATAA AGTAGTTGCAAGAAAGTATTTTCATCCTGTTAGGAT TCATATCTAAGATAGAGTTATGCATTGCACATACAC AAATAAACTTTTATTAGATAGATACCTATAAAAGAA ACATAAAAGTATGTTGTGTATTACTGACAGTTCTAG ATTAATTTCTTTTAGAATTAAAGTAGATTTGTTAAAG TG | 18 | LVHLFLVIG KTSPWKIV V* |
| 1977 | NM_0190 58.2_215 | 215 | AGGGCGCAGCAGGCCAAGGGGGAGGTGCGAGCG TGGACCTGGGACGGGTCTGGGCGGCTCTCGGTG GTTGGCACGGGTTCGCACACCCATTCAAGCGGCA GGACGCACTTGTCTTAGCAGTTCTCGCTGACCGC GCTAGCTGCGGCTTCTACGCTCCGGCACTCTGAG TTCATCAGCAAACGCCCTGGCGTCTGTCCTCACCA TGCCTAGCCTTGGGACCGCTTCTCGTCGTCGTCCA | 91 | GTASRRRP PPLRPRPC PELPPQIG RRAQPGG RRPGRRG LTAPRAWR ARTASPWT |

TABLE 3A-continued

| SEQ ID | identifier_position | position | modified_RNA | PAP length | PAP |
|---|---|---|---|---|---|
| | | | CCTCCTCTTCGCCCTCGTCCTTGCCCCGAACTCCC<br>ACCCCAGATCGGCCGCCGCGCTCAGCCTGGGGG<br>TCGGCGACCCGGGAGGAGGGGTTTGACCGCTCC<br>ACGAGCCTGGAGAGCTCGGACTGCGAGTCCCTGG<br>ACAGCAGCAACAGTGGCTTCGGGCCGGAGGAAGA<br>CACGGCTTACCTGGATGGGGTGTCGTTGCCCGAC<br>TTCGAGCTGCTCAGTGACCCTGAGGATGAACACTT<br>GTGTGCCAACCTGATGCAGCTGCTGCAGGAGAGC<br>CTGGCCCAGGCGCGGCTGGGCTCTCGACGCCCT<br>GCGCGCCTGCTGATGCCTAGCCAGTTGGTAAGCC<br>AGGTGGGCAAAGAACTACTGCGCCTGGCCTACAG<br>CGAGCCGTGCGGCCTGCGGGGGGCGCTGCTGGA<br>CGTCTGCGTGGAGCAGGGCAAGAGCTGCCACAGC<br>GTGGGCCAGCTGGCACTCGACCCCAGCCTGGTGC<br>CCACCTTCCAGCTGACCCTCGTGCTGCGCCTGGA<br>CTCACGACTCTGGCCCAAGATCCAGGGGCTGTTTA<br>GCTCCGCCAACTCTCCCTTCCTCCCTGGCTTCAGC<br>CAGTCCCTGACGCTGAGCACTGGCTTCCGAGTCA<br>TCAAGAAGAAGCTGTACAGCTCGGAACAGCTGCT<br>CATTGAGGAGTGTTGAACTTCAACCTGAGGGGGC<br>CGACAGTGCCCTCCAAGACAGAGACGACTGAACT<br>TTTGGGGTGGAGACTAGAGGCAGGAGCTGAGGGA<br>CTGATTCCTGTGGTTGGAAAACTGAGGCAGCCAC<br>CTAA | | AATVASGR<br>RKTRLTW<br>MGCRCPT<br>SSCSVTLR<br>MNTCVPT* |
| 1978 | NM_0190<br>58.2_331 | 331 | AGGGCGCAGCAGGCCAAGGGGGAGGTGCGAGCG<br>TGGACCTGGGACGGGTCTGGGCGGCTCTCGGTG<br>GTTGGCACGGGTTCGCACACCCATTCAAGCGGCA<br>GGACGCACTTGTCTTAGCAGTTCTCGCTGACCGC<br>GCTAGCTGCGGCTTCTACGCTCCGGCACTCTGAG<br>TTCATCAGCAAACGCCCTGGCGTCTGTCCTCACCA<br>TGCCTAGCCTTTGGGACCGCTTCTCGTCGTCGTCC<br>ACCTCCTCTTCGCCCTCGTCCTTGCCCCGAACTCC<br>CACCCCAGATCGGCCGCCGCGCTCAGCCTGGGG<br>GTCGGCGACCCGGGAGGAGGGGTTGACCGCTCC<br>ACGAGCCTGGAGAGCTCGGACTGCGAGTCCCTGG<br>ACAGCAGCAACAGTGGCTTCGGGCCGGAGGAAGA<br>CACGGCTTACCTGGATGGGGTGTCGTTGCCCGAC<br>TTCGAGCTGCTCAGTGACCCTGAGGATGAACACTT<br>GTGTGCCAACCTGATGCAGCTGCTGCAGGAGAGC<br>CTGGCCCAGGCGCGGCTGGGCTCTCGACGCCCT<br>GCGCGCCTGCTGATGCCTAGCCAGTTGGTAAGCC<br>AGGTGGGCAAAGAACTACTGCGCCTGGCCTACAG<br>CGAGCCGTGCGGCCTGCGGGGGGCGCTGCTGGA<br>CGTCTGCGTGGAGCAGGGCAAGAGCTGCCACAGC<br>GTGGGCCAGCTGGCACTCGACCCCAGCCTGGTGC<br>CCACCTTCCAGCTGACCCTCGTGCTGCGCCTGGA<br>CTCACGACTCTGGCCCAAGATCCAGGGGCTGTTTA<br>GCTCCGCCAACTCTCCCTTCCTCCCTGGCTTCAGC<br>CAGTCCCTGACGCTGAGCACTGGCTTCCGAGTCA<br>TCAAGAAGAAGCTGTACAGCTCGGAACAGCTGCT<br>CATTGAGGAGTGTTGAACTTCAACCTGAGGGGGC<br>CGACAGTGCCCTCCAAGACAGAGACGACTGAACT<br>TTTGGGGTGGAGACTAGAGGCAGGAGCTGAGGGA<br>CTGATTCCTGTGGTTGGAAAACTGAGGCAGCCAC<br>CTAA | 53 | LTAPRAWR<br>ARTASPWT<br>AATVASGR<br>RKTRLTW<br>MGCRCPT<br>SSCSVTLR<br>MNTCVPT* |
| 1979 | NM_0190<br>58.2_518 | 518 | AGGGCGCAGCAGGCCAAGGGGGAGGTGCGAGCG<br>TGGACCTGGGACGGGTCTGGGCGGCTCTCGGTG<br>GTTGGCACGGGTTCGCACACCCATTCAAGCGGCA<br>GGACGCACTTGTCTTAGCAGTTCTCGCTGACCGC<br>GCTAGCTGCGGCTTCTACGCTCCGGCACTCTGAG<br>TTCATCAGCAAACGCCCTGGCGTCTGTCCTCACCA<br>TGCCTAGCCTTTGGGACCGCTTCTCGTCGTCGTCC<br>ACCTCCTCTTCGCCCTCGTCCTTGCCCCGAACTCC<br>CACCCCAGATCGGCCGCCGCGCTCAGCCTGGGG<br>GTCGGCGACCCGGGAGGAGGGGTTTGACCGCTC<br>CACGAGCCTGGAGAGCTCGGACTGCGAGTCCCTG<br>GACAGCAGCAACAGTGGCTTCGGGCCGGAGGAA<br>GACACGGCTTACCTGGATGGGGTGTCGTTGCCCG<br>ACTTCGAGCTGCTCAGTGACCCTGAGGATGAACA<br>CTTGTGTGCCAACCTGATGCAGCTGCTGCAGGAG<br>AGCCTGGCCAGGCGCGGCTGGGCTCTCGACGCC<br>CTGCGCGCCTGCTGATGCCTAGCCAGTTGGTAAG<br>CCAGGTGGGCAAAGAACTACTGCGCCTGGCCTAC<br>AGCGAGCCGTGCGGCCTGCGGGGGGCGCTGCTG<br>GACGTCTGCGTGGAGCAGGGCAAGAGCTGCCACA<br>GCGTGGGCCAGCTGGCACTCGACCCCAGCCTGGT<br>GCCCACCTTCCAGCTGACCCTCGTGCTGCGCCTG | 12 | RRGWALD<br>ALRAC* |

TABLE 3A-continued

| SEQ ID | identifier_position | position | modified_RNA | PAP length | PAP |
|---|---|---|---|---|---|
| | | | GACTCACGACTCTGGCCCAAGATCCAGGGGCTGTTTAGCTCCGCCAACTCTCCCTTCCTCCCTGGCTTCAGCCAGTCCCTGACGCTGAGCACTGGCTTCCGAGTCATCAAGAAGAAGCTGTACAGCTCGGAACAGCTGCTCATTGAGGAGTGTTGAACTTCAACCTGAGGGGGCCGACAGTGCCCTCCAAGACAGAGACGACTGAACTTTTGGGGTGGAGACTAGAGGCAGGAGCTGAGGGACTGATTCCTGTGGTTGGAAAACTGAGGCAGCCACCTAA | | |
| 1980 | NM_019058.2_607 | 607 | AGGGCGCAGCAGGCCAAGGGGGAGGTGCGAGCGTGGACCTGGGACGGGTCTGGGCGGCTCTCGGTGGTTGGCACGGGTTCGCACACCCATTCAAGCGGCAGGACGCACTTGTCTTAGCAGTTCTCGCTGACCGCGCTAGCTGCGGCTTCTACGCTCCGGCACTCTGAGTTCATCAGCAAACGCCCTGGCGTCTGTCCTCACCATGCCTAGCCTTTGGGACCGCTTCTCGTCGTCGTCCACCTCCTCTTCGCCCTCGTCCTTGCCCCGAACTCCCACCCCAGATCGGCCGCCGCGCTCAGCCTGGGGGTCGGCGACCCGGGAGGAGGGGTTTGACCGCTCCACGAGCCTGGAGAGCTCGGACTGCGAGTCCCTGGACAGCAGCAACAGTGGCTTCGGGCCGGAGGAAGACACGGCTTACCTGGATGGGGTGTCGTTGCCCGACTTCGAGCTGCTCAGTGACCCTGAGGATGAACACTTGTGTGCCAACCTGATGCAGCTGCTGCAGGAGAGCCTGGCCCAGGCGCGGCTGGGCTCTCGACGCCCTGCGCGCCTGCTGATGCCTAGCCAGTTGGTAAGCCAGGTGGGCAAAGAACTACTGCGCCTGGCTACAGCGAGCCGTGCGGCCTGCGGGGGGCGCTGCTGGACGTCTGCGTGGAGCAGGGCAAGAGCTGCCACAGCGTGGGCCAGCTGGCACTCGACCCCAGCCTGGTGCCCACCTTCCAGCTGACCCTCGTGCTGCGCCTGGACTCACGACTCTGGCCCAAGATCCAGGGGCTGTTTAGCTCCGCCAACTCTCCCTTCCTCCCTGGCTTCAGCCAGTCCCTGACGCTGAGCACTGGCTTCCGAGTCATCAAGAAGAAGCTGTACAGCTCGGAACAGCTGCTCATTGAGGAGTGTTGAACTTCAACCTGAGGGGGCCGACAGTGCCCTCCAAGACAGAGACGACTGAACTTTTGGGGTGGAGACTAGAGGCAGGAGCTGAGGGACTGATTCCTGTGGTTGGAAAACTGAGGCAGCCACCTAA | 39 | TASRAACGGRCWTSAWSRARAATAWASWHSTPAWCPPSS* |
| 1981 | NM_019058.2_626 | 626 | AGGGCGCAGCAGGCCAAGGGGGAGGTGCGAGCGTGGACCTGGGACGGGTCTGGGCGGCTCTCGGTGGTTGGCACGGGTTCGCACACCCATTCAAGCGGCAGGACGCACTTGTCTTAGCAGTTCTCGCTGACCGCGCTAGCTGCGGCTTCTACGCTCCGGCACTCTGAGTTCATCAGCAAACGCCCTGGCGTCTGTCCTCACCATGCCTAGCCTTTGGGACCGCTTCTCGTCGTCGTCCACCTCCTCTTCGCCCTCGTCCTTGCCCCGAACTCCCACCCCAGATCGGCCGCCGCGCTCAGCCTGGGGGTCGGCGACCCGGGAGGAGGGGTTTGACCGCTCCACGAGCCTGGAGAGCTCGGACTGCGAGTCCCTGGACAGCAGCAACAGTGGCTTCGGGCCGGAGGAAGACACGGCTTACCTGGATGGGGTGTCGTTGCCCGACTTCGAGCTGCTCAGTGACCCTGAGGATGAACACTTGTGTGCCAACCTGATGCAGCTGCTGCAGGAGAGCCTGGCCCAGGCGCGGCTGGGCTCTCGACGCCCTGCGCGCCTGCTGATGCCTAGCCAGTTGGTAAGCCAGGTGGGCAAAGAACTACTGCGCCTGGCCTACAGCGAGCCGTGCGGCTGCGGGGGGCGCTGCTGGACGTCTGCGTGGAGCAGGGCAAGAGCTGCCACAGCGTGGGCCAGCTGGCACTCGACCCCAGCCTGGTGCCCACCTTCCAGCTGACCCTCGTGCTGCGCCTGGACTCACGACTCTGGCCCAAGATCCAGGGGCTGTTTAGCTCCGCCAACTCTCCCTTCCTCCCTGGCTTCAGCCAGTCCCTGACGCTGAGCACTGGCTTCCGAGTCATCAAGAAGAAGCTGTACAGCTCGGAACAGCTGCTCATTGAGGAGTGTTGAACTTCAACCTGAGGGGGCCGACAGTGCCCTCCAAGACAGAGACGACTGAACTTTTGGGGTGGAGACTAGAGGCAGGAGCTGAGGGACTGATTCCTGTGGTTGGAAAACTGAGGCAGCCACCTAA | 33 | CGGRCWTSAWSRARAATAWASWHSTPAWCPPSS* |
| 1982 | NM_019058.2_775 | 775 | AGGGCGCAGCAGGCCAAGGGGGAGGTGCGAGCGTGGACCTGGGACGGGTCTGGGCGGCTCTCGGTGGTTGGCACGGGTTCGCACACCCATTCAAGCGGCAGGACGCACTTGTCTTAGCAGTTCTCGCTGACCGCGCTAGCTGCGGCTTCTACGCTCCGGCACTCTGAGTTCATCAGCAAACGCCCTGGCGTCTGTCCTCACCA | 16 | CLAPPTLPSSLASASP* |

TABLE 3A-continued

| SEQ ID | identifier_position | position | modified_RNA | PAP length | PAP |
|---|---|---|---|---|---|
| | | | TGCCTAGCCTTTGGGACCGCTTCTCGTCGTCGTCC ACCTCCTCTTCGCCCTCGTCCTTGCCCCGAACTCC CACCCCAGATCGGCCGCCGCGCTCAGCCTGGGG GTCGGCGACCCGGGAGGAGGGGTTTGACCGCTC CACGAGCCTGGAGAGCTCGGACTGCGAGTCCCTG GACAGCAGCAACAGTGGCTTCGGGCCGGAGGAA GACACGGCTTACCTGGATGGGGTGTCGTTGCCCG ACTTCGAGCTGCTCAGTGACCCTGAGGATGAACA CTTGTGTGCCAACCTGATGCAGCTGCTGCAGGAG AGCCTGGCCCAGGCGCGGCTGGGCTCTCGACGC CCTGCGCGCCTGCTGATGCCTAGCCAGTTGGTAA GCCAGGTGGGCAAAGAACTACTGCGCCTGGCCTA CAGCGAGCCGTGCGGCCTGCGGGGGGCGCTGCT GGACGTCTGCGTGGAGCAGGGCAAGAGCTGCCA CAGCGTGGGCCAGCTGGCACTCGACCCCAGCCTG GTGCCCACCTTCCAGCTGACCCTCGTGCTGCGCC TGGACTCACGACTCTGGCCCAAGATCCAGGGCTG TTTAGCTCCGCCAACTCTCCCTTCCTCCCTGGCTT CAGCCAGTCCCTGACGCTGAGCACTGGCTTCCGA GTCATCAAGAAGAAGCTGTACAGCTCGGAACAGCT GCTCATTGAGGAGTGTTGAACTTCAACCTGAGGG GGCCGACAGTGCCCTCCAAGACAGAGACGACTGA ACTTTTGGGGTGGAGACTAGAGGCAGGAGCTGAG GGACTGATTCCTGTGGTTGGAAAACTGAGGCAGC CACCTAA | | |
| 1983 | NM_0190 82.2_113 1 | 1131 | TACCACAAATTTACTGGCTTAAAACGACGCAAGTC TGTAGGTCAGAAGTCTGACACGGGTCTTAACTGGT GACCCGAGTCAGATTGGGACACAAAGAACAGAA ACCAAGCTGTGCAGGTTTCTGACAGGCAGTCCGG TTAGGGAGCCCTACAGCAACCCGCCGGTCCTCTC TCTCAGGCAGTTGCTGCCATGGCTCATTATTCCAA CCGGTTCTCCTCAGCCCAGTCTATCTCAGTGGCTC CATTCATAGGGTGATGTGCCCGGCGGGACACTAA CCCTAACCAAGCAGAGAGACGGTCATGCCCGTCA CGACCTCGGCCCTCGCCCCGGCCGAGGCTTCTCC TGCAGGTCGCGAGAATCAGGTGCGTCAGCGGCGT CCGGGAACGCCGGAAGAGCCAGTGGAGCGGCTC TGTAGTCCAAAGTACCCCGTCGACCCCAGCACGG CCGCTCCACCGCCTCCTACTAGACCCAGTCCTAG GGACTGCGCAGTCGCAGAGCTCCGTCCGAGTACC GGAAGCCTAGGCCGCCAGCACTTCCGGGAAGTGA CTTCGTCTCCGAAGCCGATTGGTTGTTGCTTTGCT CCCGCTCGCGTCGGTGGCGTTTTTCCTGCAGCGC GTGCGTGCTGCGCTACTGAGCAGCGCCATGGAGG ACTCTGAAGCACTGGGCTTCGAACACATGGGCCT CGATCCCCGGCTCCTTCAGGCTGTCACCGATCTG GGCTGGTCGCGACCTACGCTGATCCAGGAGAAGG CCATCCCACTGGCCCTAGAAGGGAAGGACCTCCT GGCTCGGGCCCGCACGGGCTCCGGGAAGACGGC CGCTTATGCTATTCCGATGCTGCAGCTGTTGCTCC ATAGGAAGGCGACAGGTCCGGTGGTAGAACAGGC AGTGAGAGGCCTTGTTCTTGTTCCTACCAAGGAGC TGGCACGGCAAGCACAGTCCATGATTCAGCAGCT GGCTACCTACTGTGCTCGGGATGTCCGAGTGGCC AATGTCTCAGCTGCTGAAGACTCAGTCTCTCAG | 47 | WWWTKLT FFFPLALK KSSRVSSV TCPGFTRL FSCQLLLT RTYKHSRS* |
| 1984 | NM_0191 11.3_745 | 745 | ACATTCTCTTTTCTTTTATTCTTGTCTGTTCTGCCTC ACTCCCGAGCTCTACTGACTCCAACAGAGCGCC CAAGAAGAAAATGGCCATAAGTGGAGTCCCTGTG CTAGGATTTTTCATCATAGCTGTGCTGATGAGCGC TCAGGAATCATGGGCTATCAAAGAAGAACATGTGA TCATCCAGGCCGAGTTCTATCTGAATCCTGACCAA TCAGGCGAGTTTATGTTTGACTTTGATGGTGATGA GATTTTCCATGTGGATATGGCAAAGAAGGAGACGG TCTGGCGGCTTGAAGAATTTGGACGATTTGCCAGC TTTGAGGCTCAAGGTGCATTGGCCAACATAGCTGT GGACAAAGCCAACCTGGAAATCATGACAAAGCGC TCCAACTATACTCCGATCACCAATGTACCTCCAGA GGTAACTGTGCTCACGAACAGCCCTGTGGAACTG AGAGAGCCCAACGTCCTCATCTGTTTCATAGACAA GTTCACCCCACCAGTGGTCAATGTCACGTGGCTTC GAAATGGAAAACCTGTCACCACAGGAGTGTCAGA GACAGTCTTCCTGCCCAGGGAAGACCACCTTTTCC GCAAGTTCCACTATCTCCCCTTCCTGCCCTCAACT GAGGACGTTTACGACTGCAGGGTGGAGCACTGGG GCTTGGATGAGCCTCTTCTCAAGCACTGGGAGTTT GATGCTCCAAGCCCTCTCCCAGAGACTACAGAGA ACGTGGTGTGTGCCTGGGCCTGACTGTGGGTCTG | 2 | WA* |

TABLE 3A-continued

| SEQ ID | identifier_position | position | modified_RNA | PAP length | PAP |
|---|---|---|---|---|---|
| | | | GTGGGCATCATTATTGGGACCATCTTCATCATCAA GGGATTGCGCAAAAGCAATGCAGCAGAACGCAGG GGGCCTCTGTAAGGCACATGGAGGTGATGGTGTT TCTTAGAGAGAAGATCACTGAAGAAACTTCTGCTT TAATGGCTTTACAAAGCTGGCAATATTACAATCCTT GACCTCAGTGAAAGCAGTCATCTTCAGCATTTTCC AGCCCTATAGCCACCCCAAGTGTGGATATGCCTCT TCGATTGCTCCGTACT | | |
| 1985 | NM_019887.3_215 | 215 | ACTTCCGGCGTGTGCGTCTGGCGTCCGCGCGCTG CACAATGGCGGCTCTGAAGAGTTGGCTGTCGCGC AGCGTAACTTCATTCTTCAGGTACAGACAGTGTTT GTGTGTTCCTGTTGTGGCTAACTTTAAGAAGCGGT GTTTCTCAGAATTGATAAGACCATGGCACAAAACT GTGACGATTGGCTTTGGAGTAACCCTGTGTGCGGT TCCTATGCACAGAAATCAGAGCCTCATTCCCTTAG TAGTGAAGCATTGATGAGGAGAGCAGTGTCTTTGG TAACAGATAGCACCTCTACCTTTCTCTCTCAGACCA CATATGCGTTGATTGAAGCTATTACTGAATATACTA AGGCTGTTTATACCTTAACTTCTCTTTACCGACAAT ATACAAGTTTACTTGGGAAAATGAATTCAGAGGAG GAAGATGAAGTGTGGCAGGTGATCATAGGAGCCA GAGCTGAGATGACTTCAAAACACCAAGAGTACTTG AAGCTGGAAACCACTTGGATGACTGCAGTTGGTCT TTCAGAGATGGCAGCAGAAGCTGCATATCAAACTG GCGCAGATCAGGCCTCTATAACCGCCAGGAATCA CATTCAGCTGGTGAAACTGCAGGTGGAAGAGGTG CACCAGCTCTCCCGGAAAGCAGAAACCAAGCTGG CAGAAGCACAGATAGAAGAGCTCCGTCAGAAAAC ACAGGAGGAAGGGGAGGAGCGGGCTGAGTCGGA GCAGGAGGCCTACCTGCGTGAGGATTGAGGGCCT GAGCACACTGCCCTGTCTCCCCACTCAGTGGGGA AAGCAGGGCAGATGCCACCCTGCCCAGGGTTGG CATGACTGTCTGTGCACCGAGAAGAGGCGGCAGA TCCTGCCCTGGCCAATCAGGCGAGACGCCTTTGT GAGCTGTGAGTGCCTCCTGTGGTCTCAGGCTTGC GCTGGACCTGGTTCTTAGCCCTTGGGCACTGCAC CCTGTTTAACATTTCACCCCACTCTGTACAGCTGCT CTTACCCATTTTTTTTACCTC | 14 | MHRNQSLI PLVVKH* |
| 1986 | NM_020243.4_277 | 277 | TCCTTTCCGCTTCCGGTGTCCCCTACAGTCATGGC TGCCGCCGTCGCTGCTGCCGGTGCAGGGGAACC CCAGTCCCCGGACGAATTGCTCCCGAAAGGCGAC GCGGAGAAGCCTGAGGAGGAGCTGGAGGAGGAC GACGATGAGGAGCTAGATGAGACCCTGTCGGAGA GACTATGGGGCCTGACGGAGATGTTTCCGGAGAG GGTCCGGTCCGCGGCCGGAGCCACTTTTGATCTT TCCCTCTTTGTGGCTCAGAAAATGTACAGGTTTTC CAGGCAGCCTTGTGGATTGGGACCACTTCCTTTAT GATCCTGGTTCTTCCCGTTGTCTTTGAGACGGAGA AGTTGCAAATGGAGCAACAGCAGCAACTGCAGCA GCGGCAGATACTTCTAGGACCTAACACAGGGCTC TCAGGAGGAATGCCAGGGGCTCTACCCTCACTTC CTGGAAAGATCTAGATTGTTATTGCTGTTTGAGCT GTCTCAGTGGGATAAGTTTGAAATTCAAGTGTTTG AACTGCTGATAATTTGGATTTTTTTTTTTTTAACT TTGGCACATTGATCTATCTAAACCTGGTGGGGAGA ATTATCCCCACATTGTCTCATGGAAAGACTCAACTT GCAACTGTGCCCTCCACACTATCCTTACTTCTGTC TCCACTCTGATACCAGAGTGCAGCCATGCAGATG GTTATTCCAGCTCTGGTCACCCGACTCCTTTCACC AAATTGCTCCTAACTGGAAGATCTCACTTTCCCCTT GTGGGGTAGGAACCGATGCCAGTGGGAGGGATGT GCCCCTGACCATTAACGACTGTTTTTTTTTTTTTT TTAAAGAATGGAGTTGTTGGGGCAGGACATGCACA CAATGTGAAACAGACAAAATGCATTACACCTGTAG TGTAAAGTGGCCACTATGAATCCCTATGTATGAGA GGAGGGAGGCAGGCTGCAGCTTCAGCCACAGAAT GGGGACTATGGAAGACAGCAGGAGCTCATTTCCT CTGCACATTTTGGCTGTT | 10 | QPCGLGPL PL* |
| 1987 | NM_020243.4_430 | 430 | TCCTTTCCGCTTCCGGTGTCCCCTACAGTCATGGC TGCCGCCGTCGCTGCTGCCGGTGCAGGGGAACC CCAGTCCCCGGACGAATTGCTCCCGAAAGGCGAC GCGGAGAAGCCTGAGGAGGAGCTGGAGGAGGAC GACGATGAGGAGCTAGATGAGACCCTGTCGGAGA GACTATGGGGCCTGACGGAGATGTTTCCGGAGAG GGTCCGGTCCGCGGCCGGAGCCACTTTTGATCTT TCCCTCTTTGTGGCTCAGAAAATGTACAGGTTTTC CAGGGCAGCCTTGTGGATTGGGACCACTTCCTTTA | 39 | LYPHFLER SRLLLLFEL SQWDKFEI QVFELLIIW IFFFF* |

TABLE 3A-continued

| SEQ ID | identifier_position | position | modified_RNA | PAP length | PAP |
|---|---|---|---|---|---|
| | | | TGATCCTGGTTCTTCCCGTTGTCTTTGAGACGGAG AAGTTGCAAATGGAGCAACAGCAGCAACTGCAGC AGCGGCAGATACTTCTAGGACCTAACACAGGGCT CTCAGGAGGAATGCCAGGGCTCTACCCTCACTTC CTGGAAAGATCTAGATTGTTATTGCTGTTTGAGCT GTCTCAGTGGGATAAGTTTGAAATTCAAGTGTTTG AACTGCTGATAATTTGGATTTTTTTTTTTTTAACT TTGGCACATTGATCTATCTAAACCTGGTGGGGAGA ATTATCCCCACATTGTCTCATGGAAAGACTCAACTT GCAACTGTGCCCTCCACACTATCCTTACTTCTGTC TCCACTCTGATACCAGAGTGCAGCCATGCAGATG GTTATTCCAGCTCTGGTCACCCGACTCCTTTCACC AAAATTGCTCCTAACTGGAAGATCTCACTTTCCCCTT GTGGGGTAGGAACCGATGCCAGTGGGAGGGATGT GCCCCTGACCATTAACGACTGTTTTTTTTTTTTTTT TTAAAGAATGGAGTTGTTGGGGCAGGACATGCACA CAATGTGAAACAGACAAAATGCATTACACCTGTAG TGTAAAGTGGCCACTATGAATCCCTATGTATGAGA GGAGGGAGGCAGGCTGCAGCTTCAGCCACAGAAT GGGGACTATGGAAGACAGCAGGAGCTCATTTCCT CTGCACATTTTGGCTGTT | | |
| 1988 | NM_020300.3_136 | 136 | AGTCCCTGCATTGCGCGCGACCCGGCGGCGGGA CAGGCTTGCTGCTTCCTCCTCCTCGGCCTCACCAT TCCAGACCAAAATTGAAAAAATGGTTGACCTCACC CAGGTAATGGATGATGAAGTATTCATGGCTTTGCA TCCTATGCAACAATTATTCTTTCAAAAAATGATGCTT ATGAGTACTGCAACTGCATTCTATAGATTGACAAG AAAGGTTTTTGCCAATCCAGAAGACTGTGTAGCAT TTGGCAAAGGAGAAAATGCCAAGAAGTATCTTCGA ACAGATGACAGAGTAGAACGTGTACGCAGAGCCC ACCTGAATGACCTTGAAAATATTATTCCATTTCTTG GAATTGGCCTCCTGTATTCCTTGAGTGGTCCCGAC CCCTCTACAGCCATCCTGCACTTCAGACTATTTGT CGGAGCACGGATCTACCACACCATTGCATATTTGA CACCCCTTCCCCAGCCAAATAGAGCTTTGAGTTTT TTTGTTGGATATGGAGTTACTCTTTCCATGGCTTAC AGGTTGCTGAAAAGTAAATTGTACCTGTAAAGAAA ATCATACAACTCAGCATCCAGTTGGCTTTTTAAGAA TTCTGTACTTCCAATTTATAATGAATACTTTCTTAGA TTTTAGGTAGGAGGGGAGCAGAGGAATTATGAACT GGGGTAAACCCATTTTGAATATTAGCATTGCCAAT ATCCTGTATTCTTGTTTTACATTTGGATTAGAAATTT AACATAGTAATTCTTAAGTCTTTTGTCTGATTTTTAA AGTACTTTCTTATAAATTTGGATCATGTTATGATTTG TAACATTCACACAACACCTCACTTTTGAATCTATAA AAGAATTGCACGTATGAGAAACCTATATTTCAATAC TGCTGAAACAGACATGAAATAAAGAATTTAAAGAAT C | 11 | LHPMQQLF FQK* |
| 1989 | NM_020300.3_204 | 204 | AGTCCCTGCATTGCGCGCGACCCGGCGGCGGGA CAGGCTTGCTGCTTCCTCCTCCTCGGCCTCACCAT TCCAGACCAAAATTGAAAAAATGGTTGACCTCACC CAGGTAATGGATGATGAAGTATTCATGGCTTTTGC ATCCTATGCAACAATTATTCTTTCAAAAATGATGCT TATGAGTACTGCAACTGCATTCTATAGATGACAAG AAAGGTTTTTGCCAATCCAGAAGACTGTGTAGCAT TTGGCAAAGGAGAAAATGCCAAGAAGTATCTTCGA ACAGATGACAGAGTAGAACGTGTACGCAGAGCCC ACCTGAATGACCTTGAAAATATTATTCCATTTCTTG GAATTGGCCTCCTGTATTCCTTGAGTGGTCCCGAC CCCTCTACAGCCATCCTGCACTTCAGACTATTTGT CGGAGCACGGATCTACCACACCATTGCATATTTGA CACCCCTTCCCCAGCCAAATAGAGCTTTGAGTTTT TTTGTTGGATATGGAGTTACTCTTTCCATGGCTTAC AGGTTGCTGAAAAGTAAATTGTACCTGTAAAGAAA ATCATACAACTCAGCATCCAGTTGGCTTTTTAAGAA TTCTGTACTTCCAATTTATAATGAATACTTTCTTAGA TTTTAGGTAGGAGGGGAGCAGAGGAATTATGAACT GGGGTAAACCCATTTTGAATATTAGCATTGCCAAT ATCCTGTATTCTTGTTTTACATTTGGATTAGAAATTT AACATAGTAATTCTTAAGTCTTTTGTCTGATTTTTAA AGTACTTTCTTATAAATTTGGATCATGTTATGATTTG TAACATTCACACAACACCTCACTTTTGAATCTATAA AAGAATTGCACGTATGAGAAACCTATATTTCAATAC TGCTGAAACAGACATGAAATAAAGAATTTAAAGAAT C | 0 | * |

TABLE 3A-continued

| SEQ ID | identifier_position | position | modified_RNA | PAP length | PAP |
|---|---|---|---|---|---|
| 1990 | NM_020300.3_220 | 220 | AGTCCCTGCATTGCGCGCGACCCGGCGGCGGGA CAGGCTTGCTGCTTCCTCCTCCTCGGCCTCACCAT TCCAGACCAAAATTGAAAAAATGGTTGACCTCACC CAGGTAATGGATGATGAAGTATTCATGGCTTTTGC ATCCTATGCAACAATTATTCTTTCAAAAATGATGCT TATGAGTACTGCAACTGCATTCTATAGATTGACAA GAAAGGTTTTGCCAATCCAGAAGACTGTGTAGCAT TTGGCAAAGGAGAAAATGCCAAGAAGTATCTTCGA ACAGATGACAGAGTAGAACGTGTACGCAGAGCCC ACCTGAATGACCTTGAAAATATTATTCCATTTCTTG GAATTGGCCTCCTGTATTCCTTGAGTGGTCCCGAC CCCTCTACAGCCATCCTGCACTTCAGACTATTTGT CGGAGCACGGATCTACCACACCATTGCATATTTGA CACCCCTTCCCCAGCCAAATAGAGCTTTGAGTTTT TTTGTTGGATATGGAGTTACTCTTTCCATGGCTTAC AGGTTGCTGAAAAGTAAATTGTACCTGTAAAGAAA ATCATACAACTCAGCATCCAGTTGGCTTTTTAAGAA TTCTGTACTTCCAATTTATAATGAATACTTTCTTAGA TTTTAGGTAGGAGGGGAGCAGAGGAATTATGAACT GGGGTAAACCCATTTTGAATATTAGCATTGCCAAT ATCCTGTATTCTTGTTTTACATTTGGATTAGAAATTT AACATAGTAATTCTTAAGTCTTTTGTCTGATTTTTAA AGTACTTTCTTATAAATTTGGATCATGTTATGATTTG TAACATTCACACAACACCTCACTTTTGAATCTATAA AAGAATTGCACGTATGAGAAACCTATATTTCAATAC TGCTGAAACAGACATGAAATAAAGAATTTAAAGAAT C | 7 | LPIQKTV* |
| 1991 | NM_020300.3_247 | 247 | AGTCCCTGCATTGCGCGCGACCCGGCGGCGGGA CAGGCTTGCTGCTTCCTCCTCCTCGGCCTCACCAT TCCAGACCAAAATTGAAAAAAATGGTTGACCTCACC CAGGTAATGGATGATGAAGTATTCATGGCTTTTGC ATCCTATGCAACAATTATTCTTTCAAAAATGATGCT TATGAGTACTGCAACTGCATTCTATAGATTGACAA GAAAGGTTTTGCCAATCCAGAAGACTGTGTAGCA TTGGCAAAGGAGAAAATGCCAAGAAGTATCTTCGA ACAGATGACAGAGTAGAACGTGTACGCAGAGCCC ACCTGAATGACCTTGAAAATATTATTCCATTTCTTG GAATTGGCCTCCTGTATTCCTTGAGTGGTCCCGAC CCCTCTACAGCCATCCTGCACTTCAGACTATTTGT CGGAGCACGGATCTACCACACCATTGCATATTTGA CACCCCTTCCCCAGCCAAATAGAGCTTTGAGTTTT TTTGTTGGATATGGAGTTACTCTTTCCATGGCTTAC AGGTTGCTGAAAAGTAAATTGTACCTGTAAAGAAA ATCATACAACTCAGCATCCAGTTGGCTTTTTAAGAA TTCTGTACTTCCAATTTATAATGAATACTTTCTTAGA TTTTAGGTAGGAGGGGAGCAGAGGAATTATGAACT GGGGTAAACCCATTTTGAATATTAGCATTGCCAAT ATCCTGTATTCTTGTTTTACATTTGGATTAGAAATTT AACATAGTAATTCTTAAGTCTTTTGTCTGATTTTTAA AGTACTTTCTTATAAATTTGGATCATGTTATGATTTG TAACATTCACACAACACCTCACTTTTGAATCTATAA AAGAATTGCACGTATGAGAAACCTATATTTCAATAC TGCTGAAACAGACATGAAATAAAGAATTTAAAGAAT C | 16 | LAKEKMPR SIFEQMTE* |
| 1992 | NM_020300.3_471 | 471 | AGTCCCTGCATTGCGCGCGACCCGGCGGCGGGA CAGGCTTGCTGCTTCCTCCTCCTCGGCCTCACCAT TCCAGACCAAAATTGAAAAAATGGTTGACCTCACC CAGGTAATGGATGATGAAGTATTCATGGCTTTTGC ATCCTATGCAACAATTATTCTTTCAAAAATGATGCT TATGAGTACTGCAACTGCATTCTATAGATTGACAA GAAAGGTTTTGCCAATCCAGAAGACTGTGTAGCA TTTGGCAAAGGAGAAAATGCCAAGAAGTATCTTCG AACAGATGACAGAGTAGAACGTGTACGCAGAGCC CACCTGAATGACCTTGAAAATATTATTCCATTTCTT GGAATTGGCCTCCTGTATTCCTTGAGTGGTCCCGA CCCCTCTACAGCCATCCTGCACTTCAGACTATTTG TCGGAGCACGGATCTACCACACCATTGCATATTTG ACACCCCTTCCCCAGCCAAATAGAGCTTTGAGTTTT TTTGTTGGATATGGAGTTACTCTTTCCATGGCTTAC AGGTTGCTGAAAAGTAAATTGTACCTGTAAAGAAA ATCATACAACTCAGCATCCAGTTGGCTTTTTAAGAA TTCTGTACTTCCAATTTATAATGAATACTTTCTTAGA TTTTAGGTAGGAGGGGAGCAGAGGAATTATGAACT GGGGTAAACCCATTTTGAATATTAGCATTGCCAAT ATCCTGTATTCTTGTTTTACATTTGGATTAGAAATTT AACATAGTAATTCTTAAGTCTTTTGTCTGATTTTTAA AGTACTTTCTTATAAATTTGGATCATGTTATGATTTG | 4 | QIEL* |

TABLE 3A-continued

| SEQ ID | identifier_position | position | modified_RNA | PAP length | PAP |
|---|---|---|---|---|---|
| | | | TAACATTCACACAACACCTCACTTTTGAATCTATAA<br>AAGAATTGCACGTATGAGAAACCTATATTTCAATAC<br>TGCTGAAACAGACATGAAATAAAGAATTTAAAGAAT<br>C | | |
| 1993 | NM_0203<br>13.2204 | 204 | ACCACGGCCCTAAGGAGGGCGGAAGTCGTCGCTC<br>CGTGGAGCCTCCTCCTCTCGCGAGAGGCGCAAGG<br>CGTGGAGTCGACGGCTGGAGAGAAGCCGGGAGC<br>GAGCCCAGGCGGCAGTCTTGATTCCCTTTTGGCC<br>AGCAGTTTTTAGGTCTGTCAGTACTGCACTGCAAG<br>AATGGCAGATTTTGGGATCTCTGCTGGCCAGTTGT<br>GGCAGTGGTCTGGGATAAGTCATCCCCAGTGGAG<br>GCTCTGAAAGGTCTGGTGGATAAGCTTCAAGCGTT<br>AACCGGCAATGAGGGCCGCGTGTCTGTGGAAAAC<br>ATCAAGCAGCTGTTGCAATCTGCCCACAAAGAATC<br>CAGCTTTGACATTATTTTGTCAGGTTTAGTCCCAGG<br>AAGCACCACTCTGCACAGTGCTGAGATTTTGGCTG<br>AAATCGCCCGGATCCTTCGGCCTGGTGGATGTCTT<br>TTTCTGAAGGAGCCAGTAGAGACAGCTGTAGATAA<br>CAATAGCAAAGTGAAGACAGCATCTAAGCTGTGTT<br>CAGCCCTGACTCTTTCTGGTCTTGTGGAAGTGAAA<br>GAGCTGCAGCGGGAGCCCCTAACCCCTGAGGAAG<br>TACAGTCTGTTCGAGAACACCTTGGTCATGAAAGT<br>GACAACCTGCTGTTTGTTCAGATCACAGGCAAAAA<br>ACCAAACTTTGAAGTGGGTTCTTCTAGGCAGCTTA<br>AGCTTTCCATCACCAAGAAGTCTTCTCCTTCAGTG<br>AAACCTGCTGTGGACCCTGCTGCTGCCAAGCTGT<br>GGACCCTCTCAGCCAACGATATGGAGGACGACAG<br>CATGGATCTCATTGACTCAGATGAGCTGCTGGATC<br>CAGAAGATTTGAAGAAGCCAGATCCAGCTTCCCTG<br>CGGGCTGCTTCTTGTGGGGAAGGGAAAAAGAGGA<br>AGGCCTGTAAGAACTGCACCTGTGGCCTTGCCGA<br>AGAACTGGAAAAAGAGAAGTCAAGGGAACAGATG<br>AGCTCCCAACCCAAGTCAGCTTGTGGAAACTGCTA<br>CCTGGGCGATGCCTTCCGCTG | 14 | LWQWSGI<br>SHPQWRL* |
| 1994 | NM_0203<br>83.2_296 | 296 | GTCACCGCCGAATGGCAGCCTCCAGAAAGCCACC<br>GCGAGTAAGGGTGAATCACCAGGATTTTCAACTGA<br>GAAATTTAAGAATAATTGAACCTAACGAGGTGACA<br>CACTCAGGAGACACAGGTGTGGAAACAGACGGCA<br>GAATGCCTCCAAAGGTGACTTCAGAGCTGCTTCG<br>GCAGCTGAGACAAGCCATGAGGAACTCTGAGTAT<br>GTGACCGAACCGATCCAGGCCTACATCATCCCATC<br>GGGAGATGCTCATCAGAGTGAGTATATTGCTCCAT<br>GTGACTGTCGGCGGGCTTTGTCTCTGGATTCGATG<br>GCTCTGCGGGCACAGCCATCATCACAGAAGAGCA<br>TGCAGCCATGTGGACTGACGGGCGCTACTTTCTC<br>CAGGCTGCCAAGCAAATGGACAGCAACTGGACAC<br>TTATGAAGATGGGTCTGAAGGACACACCAACTCAG<br>GAAGACTGGCTGGTGAGTGTGCTTCCTGAAGGAT<br>CCAGGGTTGGTGTGGACCCCTTGATCATTCCTACA<br>ATTATTGGAAGAAAATGGCCAAAGTTCTGAGAAG<br>TGCCGGCCATCACCTCATTCCTGTCAAGGAGAACC<br>TCGTTGACAAAATCTGGACAGACCGTCCTGAGCG<br>CCCTTGCAAGCCTCTCCTCACACTGGGCCTGGATT<br>ACACAGGCATCTCCTGGAAGGACAAGGTTGCAGA<br>CCTTCGGTTGAAAATGGCTGAGAGGAACGTCATGT<br>GGTTTGTGGTCACTGCCTTGGATGAGATTGCGTGG<br>CTATTTAATCTCCGAGGATCAGATGTGGAGCACAA<br>TCCAGTATTTTTCTCCTACGCAATCATAGGACTAGA<br>GACGATCATGCTCTTCATTGATGGTGACCGCATAG<br>ACGCCCCAGTGTGAAGGAGCACCTGCTTCTTGA<br>CTTGGGTCTGGAAGCCGAATACAGGATCCAGGTG<br>CATCCCTACAAGTCCATCCTGAGCGAGCTCAAGG<br>CCCTGTGTGCTGACCTCTCCCCAAGGGAGAAGGT<br>GTGGGTCAGTGACAAGGCCAGC | 41 | LSLDSMAL<br>RAQPSSQ<br>KSMQPCG<br>LTGATFSR<br>LPSKWTAT<br>GHL* |
| 1995 | NM_0203<br>83.2_489 | 489 | GTCACCGCCGAATGGCAGCCTCCAGAAAGCCACC<br>GCGAGTAAGGGTGAATCACCAGGATTTTCAACTGA<br>GAAATTTAAGAATAATTGAACCTAACGAGGTGACA<br>CACTCAGGAGACACAGGTGTGGAAACAGACGGCA<br>GAATGCCTCCAAAGGTGACTTCAGAGCTGCTTCG<br>GCAGCTGAGACAAGCCATGAGGAACTCTGAGTAT<br>GTGACCGAACCGATCCAGGCCTACATCATCCCATC<br>GGGAGATGCTCATCAGAGTGAGTATATTGCTCCAT<br>GTGACTGTCGGCGGGCTTTTGTCTCTGGATTCGAT<br>GGCTCTGCGGGCACAGCCATCATCACAGAAGAGC<br>ATGCAGCCATGTGGACTGACGGGCGCTACTTTCTC<br>CAGGCTGCCAAGCAAATGGACAGCAACTGGACAC<br>TTATGAAGATGGGTCTGAAGGACACACCAACTCAG | 5 | LVWTP* |

TABLE 3A-continued

| SEQ ID | identifier_position | position | modified_RNA | PAP length | PAP |
|---|---|---|---|---|---|
| | | | GAAGACTGGCTGGTGAGTGTGCTTCCTGAAGGAT CCAGGTTGGTGTGGACCCCTTGATCATTCCTACAG ATTATTGGAAGAAAATGGCCAAAGTTCTGAGAAGT GCCGGCCATCACCTCATTCCTGTCAAGGAGAACCT CGTTGACAAAATCTGGACAGACCGTCCTGAGCGC CCTTGCAAGCCTCTCCTCACACTGGGCCTGGATTA CACAGGCATCTCCTGGAAGGACAAGGTTGCAGAC CTTCGGTTGAAAATGGCTGAGAGGAACGTCATGTG GTTTGTGGTCACTGCCTTGGATGAGATTGCGTGGC TATTTAATCTCCGAGGATCAGATGTGGAGCACAAT CCAGTATTTTTCTCCTACGCAATCATAGGACTAGA GACGATCATGCTCTTCATTGATGGTGACCGCATAG ACGCCCCAGTGTGAAGGAGCACCTGCTTCTTGA CTTGGGTCTGGAAGCCGAATACAGGATCCAGGTG CATCCCTACAAGTCCATCCTGAGCGAGCTCAAGG CCCTGTGTGCTGACCTCTCCCCAAGGGAGAAGGT GTGGGTCAGTGACAAGGCCAGC | | |
| 1996 | NM_0210 19.3_337 | 337 | GTCATCGGGACGTACTAAGACTAGGGTTGGGCCG AGAGTCGGAGCCATTACTGCAGGAAAAGGTCCCG GAGAGCTGAGCAGTCAAGATGTGTGACTTCACCG AAGACCAGACCGCAGAGTTCAAGGAGGCCTTCCA GCTGTTTGACCGAACAGGTGATGGCAAGATCCTGT ACAGCCAGTGTGGGGATGTGATGAGGGCCCTGGG CCAGAACCCTACCAACGCCGAGGTGCTCAAGGTC CTGGGGAACCCCAAGAGTGATGAGATGAATGTGA AGGTGCTGGACTTTGAGCACTTTCTGCCCATGCTG CAGACAGTGGCCAAGAACAAGGACCAGGCACCTA TGAGGATTATGTCGAAGGACTTCGGGTGTTTGACA AGGAAGGAAATGGCACCGTCATGGGTGCTGAAAT CCGGCATGTTCTTGTCACACTGGGTGAGAAGATGA CAGAGGAAGAAGTAGAGATGCTGGTGGCAGGGCA TGAGGACAGCAATGGTTGTATCAACTATGAAGCGT TTGTGAGGCATATCCTGTCGGGGTGACGGGCCCA TGGGGCGGAGCTCGTCCGCATGGTGCTGAATGGC TGAGGACCTTCCCAGTCTCCCCAGAGTCCGTGCC TTTCCCTGTGTGAATTTTGTATCTAGCCTAAAGTTT CCCTAGGCTTTCTTGTCTCAGCAACTTTCCCATCTT GTCTCTCTTGGATGATGTTTGCCGTCAGCATTCAC CAAATAAACTTGCTCTCTGGGCCCTCGGTAAAA | 36 | APMRIMSK DFGCLTRK EMAPSWV LKSGMFLS HWVRR* |
| 1997 | NM_0210 19.3_518 | 518 | GTCATCGGGACGTACTAAGACTAGGGTTGGGCCG AGAGTCGGAGCCATTACTGCAGGAAAAGGTCCCG GAGAGCTGAGCAGTCAAGATGTGTGACTTCACCG AAGACCAGACCGCAGAGTTCAAGGAGGCCTTCCA GCTGTTTGACCGAACAGGTGATGGCAAGATCCTGT ACAGCCAGTGTGGGGATGTGATGAGGGCCCTGGG CCAGAACCCTACCAACGCCGAGGTGCTCAAGGTC CTGGGGAACCCCAAGAGTGATGAGATGAATGTGA AGGTGCTGGACTTTGAGCACTTTCTGCCCATGCTG CAGACAGTGGCCAAGAACAAGGACCAGGCACCT ATGAGGATTATGTCGAAGGACTTCGGGTGTTTGAC AAGGAAGGAAATGGCACCGTCATGGGTGCTGAAA TCCGGCATGTTCTTGTCACACTGGGTGAGAAGATG ACAGAGGAAGAAGTAGAGATGCTGGTGGCAGGGC ATGAGGACAGCAATGGTTGTATCAACTATGAAGCG TTGTGAGGCATATCCTGTCGGGGTGACGGGCCCA TGGGGCGGAGCTCGTCCGCATGGTGCTGAATGGC TGAGGACCTTCCCAGTCTCCCCAGAGTCCGTGCC TTTCCCTGTGTGAATTTTGTATCTAGCCTAAAGTTT CCCTAGGCTTTCTTGTCTCAGCAACTTTCCCATCTT GTCTCTCTTGGATGATGTTTGCCGTCAGCATTCAC CAAATAAACTTGCTCTCTGGGCCCTCGGTAAAA | 1 | L* |
| 1998 | NM_0211 02.2_415 | 415 | AATAGGCGTTCGCCATTGGCTCTGGCGACCTCCG CGCGTTGGGAGGTGTAGCGCGGCTCTGAACGCGC TGAGGGCCGTTGAGTGTCGCAGGCGGCGAGGGC GCGAGTGAGGAGCAGACCCAGGCATCGCGCGCC GAGAAGGCCGGGCGTCCCCACACTGAAGGTCCG GAAAGGCGACTTCCGGGGGCTTTGGCACCTGGCG GACCCTCCCGGAGCGTCGGCACCTGAACGCGAG GCGCTCCATTGCGCGTGCGCGTTGAGGGGCTTCC CGCACCTGATCGCGAGACCCCAACGGCTGGTGGC GTCGCCTGCGCGTCTCGGCTGAGCTGGCCATGGC GCAGCTGTGCGGGCTGAGGCGGAGCCGGGCGTT TCTCGCCCTGCTGGGATCGCTGCTCCTCTCTGGG GTCCTGGCGGCGACCGAGAACGCAGCATCCACGA CTTCTGCCTGGTGTCGAAGGTGGTGGGCAGATGC CGGGCCTCCATGCCTAGGTGGTGGTACAATGTCA CTGACGGATCCTGCCAGCTGTTTGTGTATGGGGG | 50 | TENAASTT SAWCRRW WADAGPP CLGGGTM SLTDPASC LCMGAVTE TAIIT* |

TABLE 3A-continued

| SEQ ID | identifier_ position | position | modified_RNA | PAP length | PAP |
|---|---|---|---|---|---|
| | | | CTGTGACGGAAACAGCAATAATTACCTGACCAAGG AGGAGTGCCTCAAGAAATGTGCCACTGTCACAGA GAATGCCACGGGTGACCTGGCCACCAGCAGGAAT GCAGCGGATTCCTCTGTCCCAAGTGCTCCCAGAA GGCAGGATTCTGAAGACCACTCCAGCGATATGTTC AACTATGAAGAATACTGCACCGCCAACGCAGTCAC TGGGCCTTGCCGTGCATCCTTCCCACGCTGGTACT TTGACGTGGAGAGGAACTCCTGCAATAACTTCATC TATGGAGGCTGCCGGGGCAATAAGAACAGCTACC GCTCTGAGGAGGCCTGCATGCTCCGCTGCTTCCG CCAGCAGGAGAATCCTCCCCTGCCCCTTGGCTCA AAGGTGGTGGTTCTGGCGGGGCTGTTCGTGATGG TGTTGATCCTCTTCCTGGGAGCCTCCATGGTCTAC CTGATCCGGGTGGCACGGAGGAACCAGGAGCGT GCCC | | |
| 1999 | NM_0211 02.2_736 | 736 | AATAGGCGTTCGCCATTGGCTCTGGCGACCTCCG CGCGTTGGGAGGTGTAGCGCGGCTCTGAACGCGC TGAGGGCCGTTGAGTGTCGCAGGCGGCGAGGGC GCGAGTGAGGAGCAGACCCAGGCATCGCGCGCC GAGAAGGCCGGGCGTCCCCACACTGAAGGTCCG GAAAGGCGACTTCCGGGGGCTTTGGCACCTGGCG GACCCTCCCGGAGCGTCGGCACCTGAACGCGAG GCGCTCCATTGCGCGTGCGCGTTGAGGGGCTTCC CGCACCTGATCGCGAGACCCCAACGGCTGGTGGC GTCGCCTGCGCGTCTCGGCTGAGCTGGCCATGGC GCAGCTGTGCGGGCTGAGGCGGAGCCGGGCGTT TCTCGCCCTGCTGGGATCGCTGCTCCTCTCTGGG GTCCTGGCGGCCGACCGAGAACGCAGCATCCACG ACTTCTGCCTGGTGTCGAAGGTGGTGGGCAGATG CCGGGCCTCCATGCCTAGGTGGTGGTACAATGTC ACTGACGGATCCTGCCAGCTGTTTGTGTATGGGG GCTGTGACGGAAACAGCAATAATTACCTGACCAAG GAGGAGTGCCTCAAGAAATGTGCCACTGTCACAG AGAATGCCACGGGTGACCTGGCCACCAGCAGGAA TGCAGCGGATTCCTCTGTCCCAAGTGCTCCCAGAA GGCAGGATTCTGAAGACCACTCCAGCGATATGTTC AACTATGAAGAATACTGCACCGCAACGCAGTCACT GGGCCTTGCCGTGCATCCTTCCCACGCTGGTACTT TGACGTGGAGAGGAACTCCTGCAATAACTTCATCT ATGGAGGCTGCCGGGGCAATAAGAACAGCTACCG CTCTGAGGAGGCCTGCATGCTCCGCTGCTTCCGC CAGCAGGAGAATCCTCCCCTGCCCCTTGGCTCAA AGGTGGTGGTTCTGGCGGGGCTGTTCGTGATGGT GTTGATCCTCTTCCTGGGAGCCTCCATGGTCTACC TGATCCGGGTGGCACGGAGGAACCAGGAGCGTG CCC | 70 | TQSLGLAV HPSHAGTL TWRGTPAI TSSMEAAG AIRTATALR RPACSAAS ASRRILPC PLAQRWW FWRGCS* |
| 2000 | NM_0211 09.2_182 | 182 | ACAAACTCGGTGGTGGCCACTGCGCAGACCAGACT TCGCTCGTACTCGTGCGCCTCGCTTCGCTTTTCCT CCGCAACCATGTCTGACAAACCCGATATGGCTGA GATCGAGAAATTCGATAAGTCGAAACTGAAGAAGA CAGAGACGCAAGAGAAAAATCCACTGCCTTCCAAA GAAACGATGAACAGGAGAAGCAAGCAGGCGAATC GTAATGAGGCGTGCGCCGCCAATATGCACTGTAC ATTCCACAAGCATTGCCTTCTTATTTTACTTCTTTA GCTGTTTAACTTTGTAAGATGCAAAGAGGTTGGAT CAAGTTTAAATGACTGTGCTGCCCCTTTCACATCAA AGAACTACTGACAACGAAGGCCGCGCCTGCCTTT CCCATCTGTCTATCTATCTGGCTGGCAGGGAAGGA AAGAACTTGCATGTTGGTGAAGGAAGAAGTGGGG TGGAAGAAGTGGGGTGGGACGACAGTGAAATCTA GAGTAAAACCAAGCTGGCCCAAGGTGTCCTGCAG GCTGTAATGCAGTTTAATCAGAGTGCCATTTTTTTT TTTGTTCAAATGATTTTAATTATTGGAATGCACAATT TTTTTAATATGCAAATAAAAAGTTTAAAAACTTAAAA | 35 | MNRRSKQ ANRNEACA ANMHCTF HKHCLLILL LLAV* |
| 2001 | NM_0211 29.3_287 | 287 | CCGGTCCAGTGCTCGCAGTGCGCAGGCGTGGGG CTCTCTCCTTGTCAGTCGGCGCCGCGTGCGGGCT GGTGGCTCTGTGGCAGCGGCGGCGGCAGGACTC CGGCACTATGAGCGGCTTCAGCACCGAGGAGCGC GCCGCGCCCTTCTCCCTGGAGTACCGAGTCTTCC TCAAAAAATGAGAAAGGACAATATATATCTCCATTTC ATGATATTCCAATTTATGCAGATAAGGATGTGTTTC ACATGGTAGTTGAAGTACCACGCTGGTCTAATGCA AAAATGGAGATGCTACAAAGGACCCTTTAAACCCT ATTAAACAAGATGTGAAAAAAGGAAAACTTCGCTAT GTTGCGAATTTGTTCCCGTATAAAGGATATATCTG GAACTATGGTGCCATCCCTCAGACTTGGGAAGAC CCAGGGCACAATGATAAACATACTGGCTGTTGTGG | 6 | MLQRTL* |

TABLE 3A-continued

| SEQ ID | identifier_position | position | modified_RNA | PAP length | PAP |
|---|---|---|---|---|---|
| | | | TGACAATGACCCAATTGATGTGTGTGAAATTGGAA GCAAGGTATGTGCAAGAGGTGAAATAATTGGCGT GAAAGTTCTAGGCATATTGGCTATGATTGACGAAG GGGAAACCGACTGGAAAGTCATTGCCATTAATGTG GATGATCCTGATGCAGCCAATTATAATGATATCAAT GATGTCAAACGGCTGAAACCTGGCTACTTAGAAGC TACTGTGGACTGGTTTAGAAGGTATAAGGTTCCTG ATGGAAAACCAGAAAATGAGTTTGCGTTTAATGCA GAATTTAAAGATAAGGACTTTGCCATTGATATTATT AAAAGCACTCATGACCATTGGAAAGCATTAGTGAC TAAGAAAACGAATGGAAAAGGAATCAGTTGCATGA ATACAACTTTGTCTGAGAGCCCCTTCAAGTGTGAT CCTGATGCTGCCAGAGCCATTGTGGATGCTTTACC ACCACCCTGTGAATCTGCCTGCACAGTACCAACAG ACGTGGATAAGTGGTTCCATCACCAGAAAAACTAA TGAGATTTCTCTGGAATACAAGCTGATATTGCTACA TCGTGTTCATCT | | |
| 2002 | NM_0211 29.3_358 | 358 | CCGGTCCAGTGCTCGCAGTGCGCAGGCGTGGGG CTCTCTCCTTGTCAGTCGGCGCCGCGTGCGGGCT GGTGGCTCTGTGGCAGCGGCGGCGGCAGGACTC CGGCACTATGAGCGGCTTCAGCACCGAGGAGCGC GCCGCGCCCTTCTCCCTGGAGTACCGAGTCTTCC TCAAAAATGAGAAAGGACAATATATATCTCCATTTC ATGATATTCCAATTTATGCAGATAAGGATGTGTTTC ACATGGTAGTTGAAGTACCACGCTGGTCTAATGCA AAAATGGAGATTGCTACAAAGGACCCTTTAAACCC TATTAAACAAGATGTGAAAAAAGGAAAACTTCGCTA TGTTGCGAATTGTTCCCGTATAAAGGATATATCTG GAACTATGGTGCCATCCCTCAGACTTGGGAAGAC CCAGGGCACAATGATAAACATACTGGCTGTTGTGG TGACAATGACCCAATTGATGTGTGTGAAATTGGAA GCAAGGTATGTGCAAGAGGTGAAATAATTGGCGT GAAAGTTCTAGGCATATTGGCTATGATTGACGAAG GGGAAACCGACTGGAAAGTCATTGCCATTAATGTG GATGATCCTGATGCAGCCAATTATAATGATATCAAT GATGTCAAACGGCTGAAACCTGGCTACTTAGAAGC TACTGTGGACTGGTTTAGAAGGTATAAGGTTCCTG ATGGAAAACCAGAAAATGAGTTTGCGTTTAATGCA GAATTTAAAGATAAGGACTTTGCCATTGATATTATT AAAAGCACTCATGACCATTGGAAAGCATTAGTGAC TAAGAAAACGAATGGAAAAGGAATCAGTTGCATGA ATACAACTTTGTCTGAGAGCCCCTTCAAGTGTGAT CCTGATGCTGCCAGAGCCATTGTGGATGCTTTACC ACCACCCTGTGAATCTGCCTGCACAGTACCAACAG ACGTGGATAAGTGGTTCCATCACCAGAAAAACTAA TGAGATTTCTCTGGAATACAAGCTGATATTGCTACA TCGTGTTCATCT | 51 | CSRIKDISG TMVPSLRL GKTQGTMI NILAVVVT MTQLMCV KLEARYVQ EVK* |
| 2003 | NM_0211 30.3_113 | 113 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATGCCGTCGACGGCGAGCCCTTGGGCC GCGTCTCCTTTGAGCTGTTTGCAGACAAGGTCCCA AAGACAGCAGAAAATTTTCGTGCTCTGAGCACTGG AGAGAAAGGATTTGGTTATAAGGGTTCCTGCTTTC ACAGAATTATTCCAGGGTTTATGTGTCAGGGTGGT GACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATTGTGGAGGCCATGGAGCGCTTTGG GTCCAGGAATGGCAAGACCAGCAAGAAGATCACC ATTGCTGACTGTGGACAACTCGAATAAGTTTGACT TGTGTTTTATCTTAACCACCAGATCATTCCTTCTGT AGCTCAGGAGAGCACCCCTCCACCCCATTTGCTC GCAGTATCCTAGAATCTTTGTGCTCTCGCTGCAGT TCCCTTTGGGTTCCATGTTTTCCTTGTTCCCTCCCA TGCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | 29 | MPSTASP WAASPLSC LQTRSQR QQKIFVL* |

TABLE 3A-continued

| SEQ ID | identifier_position | position | modified_RNA | PAP length | PAP |
|---|---|---|---|---|---|
| 2004 | NM_021130.3_133 | 133 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTGGGCC GCGTCTCCTTTGAGCTGTTTGCAGACAAGGTCCCA AAGACAGCAGAAAATTTTCGTGCTCTGAGCACTGG AGAGAAAGGATTTGGTTATAAGGGTTCCTGCTTTC ACAGAATTATTCCAGGGTTTATGTGTCAGGGTGGT GACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATTGTGGAGGCCATGGAGCGCTTTGG GTCCAGGAATGGCAAGACCAGCAAGAAGATCACC ATTGCTGACTGTGGACAACTCGAATAAGTTTGACT TGTGTTTTATCTTAACCACCAGATCATTCCTTCTGT AGCTCAGGAGAGCACCCCTCCACCCCATTTGCTC GCAGTATCCTAGAATCTTTGTGCTCTCGCTGCAGT TCCCTTTGGGTTCCATGTTTTCCTTGTTCCCTCCCA TGCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | 22 | WAASPLSC LQTRSQR QQKIFVL* |
| 2005 | NM_021130.3_158 | 158 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTGCAGACAAGGTCCCA AAGACAGCAGAAAATTTTCGTGCTCTGAGCACTGG AGAGAAAGGATTTGGTTATAAGGGTTCCTGCTTTC ACAGAATTATTCCAGGGTTTATGTGTCAGGGTGGT GACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATTGTGGAGGCCATGGAGCGCTTTGG GTCCAGGAATGGCAAGACCAGCAAGAAGATCACC ATTGCTGACTGTGGACAACTCGAATAAGTTTGACT TGTGTTTTATCTTAACCACCAGATCATTCCTTCTGT AGCTCAGGAGAGCACCCCTCCACCCCATTTGCTC GCAGTATCCTAGAATCTTTGTGCTCTCGCTGCAGT TCCCTTTGGGTTCCATGTTTTCCTTGTTCCCTCCCA TGCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | 14 | LQTRSQR QQKIFVL* |
| 2006 | NM_021130.3_221 | 221 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTTGCAGACAAGGTCCC AAAGACAGCAGAAAATTTTCGTGCTCTGAGCACTG GAGAGAAAGGATTGGTTATAAGGGTTCCTGCTTTC ACAGAATTATTCCAGGGTTTATGTGTCAGGGTGGT GACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATTGTGGAGGCCATGGAGCGCTTTGG GTCCAGGAATGGCAAGACCAGCAAGAAGATCACC ATTGCTGACTGTGGACAACTCGAATAAGTTTGACT | 44 | LVIRVPAFT ELFQGLCV RVVTSHAI MALVASPS MGRNLKM RTSS* |

TABLE 3A-continued

| SEQ ID | identifier_position | position | modified_RNA | PAP length | PAP |
|---|---|---|---|---|---|
| | | | TGTGTTTTATCTTAACCACCAGATCATTCCTTCTGT AGCTCAGGAGAGCACCCCTCCACCCCATTTGCTC GCAGTATCCTAGAATCTTTGTGCTCTCGCTGCAGT TCCCTTTGGGTTCCATGTTTTCCTTGTTCCCTCCCA TGCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | | |
| 2007 | NM_0211 30.3_260 | 260 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTTGCAGACAAGGTCCC AAAGACAGCAGAAAATTTTCGTGCTCTGAGCACTG GAGAGAAAGGATTTGGTTATAAGGGTTCCTGCTTT CACAGAATTATTCCAGGTTTATGTGTCAGGGTGGT GACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCAAGACTGAGTGGTTGGAT GGCAAGCATGTGGTGTTTGGCAAAGTGAAAGAAG GCATGAATATTGTGGAGGCCATGGAGCGCTTTGG GTCCAGGAATGGCAAGACCAGCAAGAAGATCACC ATTGCTGACTGTGGACAACTCGAATAAGTTTGACT TGTGTTTTATCTTAACCACCAGATCATTCCTTCTGT AGCTCAGGAGAGCACCCCTCCACCCCATTTGCTC GCAGTATCCTAGAATCTTTGTGCTCTCGCTGCAGT TCCCTTTGGGTTCCATGTTTTCCTTGTTCCCTCCCA TGCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | 30 | LCVRVVTS HAIMALVA SPSMGRN LKMRTSS* |
| 2008 | NM_0211 30.3_434 | 434 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTTGCAGACAAGGTCCC AAAGACAGCAGAAAATTTTCGTGCTCTGAGCACTG GAGAGAAAGGATTTGGTTATAAGGGTTCCTGCTTT CACAGAATTATTCCAGGGTTTATGTGTCAGGGTGG TGACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCAAGACTGAGTGGTTGGATG GCAAGCATGTGGTGTTTGGCAAAGTGAAAGAAGG CATGAATATTGTGGAGGCCATGGAGCGCTTTGGGT CCAGGAATGGCAAGACCAGCAAGAAGATCACCAT TGCTGACTGTGGACAACTCGAATAAGTTTGACTTG TGTTTTATCTTAACCACCAGATCATTCCTTCTGTAG CTCAGGAGAGCACCCCTCCACCCCATTTGCTCGC AGTATCCTAGAATCTTTGTGCTCTCGCTGCAGTTC CCTTTGGGTTCCATGTTTTCCTTGTTCCCTCCCATG CCTAGCTGGATTGCAGAGTTAAGTTTATGATTATGA ATAAAAACTAAATAACAATTGTCCTCGTTTGAGTT AAGAGTGTTGATGTAGGCTTTATTTTAAGCAGTAAT GGGTTACTTCTGAAACATCACTTGTTTGCTTAATTC TACACAGTACTTAGATTTTTTTACTTTCCAGTCCC AGGAAGTGTCAATGTTTGTTGAGTGGAATATTGAA AATGTAGGCAGCAACTGGGCATGGTGGCTCACTG TCTGTAATGTATTACCTGAGGCAGAAGACCACCTG AGGGTAGGA | 14 | RLSGWMA SMWCLAK* |
| 2009 | NM_0211 30.3_470 | 470 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC | 3 | LAK* |

TABLE 3A-continued

| SEQ ID | identifier_position | position | modified_RNA | PAP length | PAP |
|---|---|---|---|---|---|
| | | | CGCGTCTCCTTTGAGCTGTTTGCAGACAAGGTCCC AAAGACAGCAGAAAATTTTCGTGCTCTGAGCACTG GAGAGAAAGGATTTGGTTATAAGGGTTCCTGCTTT CACAGAATTATTCCAGGGTTTATGTGTCAGGGTGG TGACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTGGCAAAGTGAAAGAAGG CATGAATATTGTGGAGGCCATGGAGCGCTTTGGGT CCAGGAATGGCAAGACCAGCAAGAAGATCACCAT TGCTGACTGTGGACAACTCGAATAAGTTTGACTTG TGTTTTATCTTAACCACCAGATCATTCCTTCTGTAG CTCAGGAGAGCACCCCTCCACCCCATTTGCTCGC AGTATCCTAGAATCTTTGTGCTCTCGCTGCAGTTC CCTTTGGGTTCCATGTTTTCCTTGTTCCCTCCCATG CCTAGCTGGATTGCAGAGTTAAGTTTATGATTATGA AATAAAAACTAAATAACAATTGTCCTCGTTTGAGTT AAGAGTGTTGATGTAGGCTTTATTTTAAGCAGTAAT GGGTTACTTCTGAAACATCACTTGTTTGCTTAATTC TACACAGTACTTAGATTTTTTTTACTTTCCAGTCCC AGGAAGTGTCAATGTTTGTTGAGTGGAATATTGAA AATGTAGGCAGCAACTGGGCATGGTGGCTCACTG TCTGTAATGTATTACCTGAGGCAGAAGACCACCTG AGGGTAGGA | | |
| 2010 | NM_0211 30.3_497 | 497 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTTGCAGACAAGGTCCC AAAGACAGCAGAAAATTTTCGTGCTCTGAGCACTG GAGAGAAAGGATTTGGTTATAAGGGTTCCTGCTTT CACAGAATTATTCCAGGGTTTATGTGTCAGGGTGG TGACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATGTGGAGGCCATGGAGCGCTTTGGG TCCAGGAATGGCAAGACCAGCAAGAAGATCACCA TTGCTGACTGTGGACAACTCGAATAAGTTTGACTT GTGTTTTATCTTAACCACCAGATCATTCCTTCTGTA GCTCAGGAGAGCACCCCTCCACCCCATTTGCTCG CAGTATCCTAGAATCTTTGTGCTCTCGCTGCAGTT CCCTTTGGGTTCCATGTTTTCCTTGTTCCCTCCCAT GCCTAGCTGGATTGCAGAGTTAAGTTTATGATTAT GAAATAAAAACTAAATAACAATTGTCCTCGTTTGAG TTAAGAGTGTTGATGTAGGCTTTATTTTAAGCAGTA ATGGGTTACTTCTGAAACATCACTTGTTTGCTTAAT TCTACACAGTACTTAGATTTTTTTACTTTCCAGTC CCAGGAAGTGTCAATGTTTGTTGAGTGGAATATTG AAAATGTAGGCAGCAACTGGGCATGGTGGCTCAC TGTCTGTAATGTATTACCTGAGGCAGAAGACCACC TGAGGGTAGGA | 43 | MWRPWSA LGPGMAR PARRSPLL TVDNSNKF DLCFILTTR SFLL* |
| 2011 | NM_0211 30.3_518 | 518 | GAACGTGGTATAAAAGGGGCGGGAGGCCAGGCTC GTGCCGTTTTGCAGACGCCACCGCCGAGGAAAAC CGTGTACTATTAGCCATGGTCAACCCCACCGTGTT CTTCGACATTGCCGTCGACGGCGAGCCCTTGGGC CGCGTCTCCTTTGAGCTGTTTGCAGACAAGGTCCC AAAGACAGCAGAAAATTTTCGTGCTCTGAGCACTG GAGAGAAAGGATTTGGTTATAAGGGTTCCTGCTTT CACAGAATTATTCCAGGGTTTATGTGTCAGGGTGG TGACTTCACACGCCATAATGGCACTGGTGGCAAGT CCATCTATGGGGAGAAATTTGAAGATGAGAACTTC ATCCTAAAGCATACGGGTCCTGGCATCTTGTCCAT GGCAAATGCTGGACCCAACACAAATGGTTCCCAGT TTTTCATCTGCACTGCCAAGACTGAGTGGTTGGAT GGCAAGCATGTGGTGTTTGGCAAAGTGAAAGAAG GCATGAATATTGTGGAGGCCATGGAGCGCTTTGGG TCCAGGAATGGCAAGACCAGCAAGAAGATCACCA TTGCTGACTGTGGACAACTCGAATAAGTTTGACTT GTGTTTTATCTTAACCACCAGATCATTCCTTCTGTA GCTCAGGAGAGCACCCCTCCACCCCATTTGCTCG CAGTATCCTAGAATCTTTGTGCTCTCGCTGCAGTT CCCTTTGGGTTCCATGTTTTCCTTGTTCCCTCCCAT | 36 | LGPGMAR PARRSPLL TVDNSNKF DLCFILTTR SFLL* |

TABLE 3A-continued

| SEQ ID | identifier_position | position | modified_RNA | PAP length | PAP |
|---|---|---|---|---|---|
| | | | GCCTAGCTGGATTGCAGAGTTAAGTTTATGATTAT<br>GAAATAAAAACTAAATAACAATTGTCCTCGTTTGAG<br>TTAAGAGTGTTGATGTAGGCTTTATTTTAAGCAGTA<br>ATGGGTTACTTCTGAAACATCACTTGTTTGCTTAAT<br>TCTACACAGTACTTAGATTTTTTTTACTTTCCAGTC<br>CCAGGAAGTGTCAATGTTTGTTGAGTGGAATATTG<br>AAAATGTAGGCAGCAACTGGGCATGGTGGCTCAC<br>TGTCTGTAATGTATTACCTGAGGCAGAAGACCACC<br>TGAGGGTAGGA | | |
| 2012 | NM_021141.2_579 | 579 | GGCGGGCGACCAAAGCGCCTGAGGACCGGCAAC<br>ATGGTGCGGTCGGGGAATAAGGCAGCTGTTGTGC<br>TGTGTATGGACGTGGGCTTTACCATGAGTAACTCC<br>ATTCCTGGTATAGAATCCCCATTTGAACAAGCAAA<br>GAAGGTGATAACCATGTTTGTACAGCGACAGGTGT<br>TTGCTGAGAACAAGGATGAGATTGCTTTAGTCCTG<br>TTTGGTACAGATGGCACTGACAATCCCCTTTCTGG<br>TGGGGATCAGTATCAGAACATCACAGTGCACAGAC<br>ATCTGATGCTACCAGATTTTGATTTGCTGGAGGAC<br>ATTGAAAGCAAAATCCAACCAGGTTCTCAACAGGC<br>TGACTTCCTGGATGCACTAATCGTGAGCATGGATG<br>TGATTCAACATGAAACAATAGGAAAGAAGTTTGAG<br>AAGAGGCATATTGAAATATTCACTGACCTCAGCAG<br>CCGATTCAGCAAAAGTCAGCTGGATATTATAATTC<br>ATAGCTTGAAGAAATGTGACATCTCCCTGCAATTC<br>TTCTTGCCTTTCTCACTTGGCAAGGAAGATGGAAG<br>TGGGGACAGAGGAGATGGCCCTTTCGCTTAGGTG<br>GCCATGGGCCTTCCTTTCCACTAAAAGGAATTACC<br>GAACAGCAAAAAGAAGGTCTTGAGATAGTGAAAAT<br>GGTGATGATATCTTTAGAAGGTGAAGATGGGTTGG<br>ATGAAATTTATTCATTCAGTGAGAGTCTGAGAAAAC<br>TGTGCGTCTTCAAGAAAATTGAGAGGCATTCCATT<br>CACTGGCCCTGCCGACTGACCATTGGCTCCAATTT<br>GTCTATAAGGATTGCAGCCTATAAATCGATTCTACA<br>GGAGAGAGTTAAAAAGACTTGGACAGTTGTGGATG<br>CAAAAAACCCTAAAAAAAGAAGATATACAAAAAGAAA<br>CAGTTTATTGCTTAAATGATGATGATGAAACTGAAG<br>TTTTAAAAGAGGATATTATTCAAGGGTTCCGCTATG<br>GAAGTGATATAGTTCCTTTCTCTAAAGTGGATGAG<br>GAACAAAT | 1 | A* |
| 2013 | NM_021227.2_161 | 161 | TAGGGAGGGCGGGCCTGTTTCCGGGAGGCGCGT<br>GGGGCTTGAGGCCGAGAACGGCCCTTGCTGCCAC<br>CAACATGGAGACTTTGTACCGTGTCCCGTTCTTAG<br>TGCTCGAATGTCCCAACCTGAAGCTGAAGAAGCC<br>GCCCTGGTTGCACATGCCGTCGGCATGACTGTGT<br>ATGCTCTGGTGGTGGTGTCTTACTTCCTCATCACC<br>GGAGGAATAATTTATGATGTTATTGTTGAACCTCCA<br>AGTGTCGGTTCTATGACTGATGAACATGGGCATCA<br>GAGGCCAGTAGCTTTCTTGGCCTACAGAGTAAATG<br>GACAATATATTATGGAAGGACTTGCATCCAGCTTC<br>CTATTTACAATGGGAGGTTTAGGTTTCATAATCCTG<br>GACCGATCGAATGCACCAAATATCCCAAAACTCAA<br>TAGATTCCTTCTTCTGTTCATTGGATTCGTCTGTGT<br>CCTATTGAGTTTTTTCATGGCTAGAGTATTCATGAG<br>AATGAAACTGCCGGGCTATCTGATGGGTTAGAGTG<br>CCTTTGAGAAGAAATCAGTGGATACTGGATTTGCT<br>CCTGTCAATGAAGTTTTAAAGGCTGTACCAATCCT<br>CTAATATGAAATGTGGAAAAGAATGAAGAGCAGCA<br>GTAAAAGAAATATCTAGTGAAAAAAACAGGAAGCGT<br>ATTGAAGCTTGGACTAGAATTTCTTCTTGGTATTAA<br>AGAGACAAGTTTATCACAGAATTTTTTTTCCTGCTG<br>GCCTATTGCTATACCAATGATGTTGAGTGGCATTTT<br>CTTTTTAGTTTTTCATTAAAATATATTCCATATCTAC<br>AACTATAATATCAAATAAAGTGATTATTTTTACAAC<br>CCTCTTAACATTTTTTGGAGATGACATTTCTGATTT<br>TCAGAAATTAACATAAAATCCAGAAGCAAGATTCC<br>GTAAGCTGAGAACTCTGGACAGTTGATCAGCTTTA<br>CCTATGGTGCTTTGCCTTTAACTAGAGTGTGTGAT<br>GGTAGATTATTTCAGATATGTATGTAAAACTGTTTC | 0 | * |
| 2014 | NM_021227.2_367 | 367 | TAGGGAGGGCGGGCCTGTTTCCGGGAGGCGCGT<br>GGGGCTTGAGGCCGAGAACGGCCCTTGCTGCCAC<br>CAACATGGAGACTTTGTACCGTGTCCCGTTCTTAG<br>TGCTCGAATGTCCCAACCTGAAGCTGAAGAAGCC<br>GCCCTGGTTGCACATGCCGTCGGCATGACTGTGT<br>ATGCTCTGGTGGTGGTGTCTTACTTCCTCATCAC<br>CGGAGGAATAATTTATGATGTTATTGTTGAACCTCC<br>AAGTGTCGGTTCTATGACTGATGAACATGGGCATC | 0 | * |

TABLE 3A-continued

| SEQ ID | identifier_position | position | modified_RNA | PAP length | PAP |
|---|---|---|---|---|---|
| | | | AGAGGCCAGTAGCTTTCTTGGCCTACAGAGTAAAT GGACAATATATTATGGAAGGACTTGCATCCAGCTT CCTATTTACAATGGGAGGTTAGGTTTCATAATCCTG GACCGATCGAATGCACCAAATATCCCAAAACTCAA TAGATTCCTTCTTCTGTTCATTGGATTCGTCTGTGT CCTATTGAGTTTTTTCATGGCTAGAGTATTCATGAG AATGAAACTGCCGGGCTATCTGATGGGTTAGAGTG CCTTTGAGAAGAAATCAGTGGATACTGGATTTGCT CCTGTCAATGAAGTTTTAAAGGCTGTACCAATCCT CTAATATGAAATGTGGAAAAGAATGAAGAGCAGCA GTAAAAGAAATATCTAGTGAAAAAACAGGAAGCGT ATTGAAGCTTGGACTAGAATTTCTTCTTGGTATTAA AGAGACAAGTTTATCACAGAATTTTTTTCCTGCTG GCCTATTGCTATACCAATGATGTTGAGTGGCATTTT CTTTTTAGTTTTTCATTAAAATATATTCCATATCTAC AACTATAATATCAAATAAAGTGATTATTTTTACAAC CCTCTTAACATTTTTTGGAGATGACATTTCTGATTT TCAGAAATTAACATAAAATCCAGAAGCAAGATTCC GTAAGCTGAGAACTCTGGACAGTTGATCAGCTTTA CCTATGGTGCTTTGCCTTTAACTAGAGTGTGTGAT GGTAGATTATTTCAGATATGTATGTAAAACTGTTTC C | | |
| 2015 | NM_021227.2_414 | 414 | TAGGGAGGGCGGGCCTGTTTCCGGGAGGCGCGT GGGGCTTGAGGCCGAGAACGGCCCTTGCTGCCAC CAACATGGAGACTTTGTACCGTGTCCCGTTCTTAG TGCTCGAATGTCCCAACCTGAAGCTGAAGAAGCC GCCCTGGTTGCACATGCCGTCGGCCATGACTGTG TATGCTCTGGTGGTGGTGTCTTACTTCCTCATCAC CGGAGGAATAAATTTATGATGTTATTGTTGAACCTCC AAGTGTCGGTTCTATGACTGATGAACATGGGCATC AGAGGCCAGTAGCTTTCTTGGCCTACAGAGTAAAT GGACAATATATTATGGAAGGACTTGCATCCAGCTT CCTATTTACAATGGGAGGTTAGGTTTCATAATCCT GGACCGATCGAATGCACCAAATATCCCAAAATCAA TAGATTCCTTCTTCTGTTCATTGGATTCGTCTGTGT CCTATTGAGTTTTTTCATGGCTAGAGTATTCATGAG AATGAAACTGCCGGGCTATCTGATGGGTTAGAGTG CCTTTGAGAAGAAATCAGTGGATACTGGATTTGCT CCTGTCAATGAAGTTTTAAAGGCTGTACCAATCCT CTAATATGAAATGTGGAAAAGAATGAAGAGCAGCA GTAAAAGAAATATCTAGTGAAAAAACAGGAAGCGT ATTGAAGCTTGGACTAGAATTTCTTCTTGGTATTAA AGAGACAAGTTTATCACAGAATTTTTTTCCTGCTG GCCTATTGCTATACCAATGATGTTGAGTGGCATTTT CTTTTTAGTTTTTCATTAAAATATATTCCATATCTAC AACTATAATATCAAATAAAGTGATTATTTTTACAAC CCTCTTAACATTTTTTGGAGATGACATTTCTGATTT TCAGAAATTAACATAAAATCCAGAAGCAAGATTCC GTAAGCTGAGAACTCTGGACAGTTGATCAGCTTTA CCTATGGTGCTTTGCCTTTAACTAGAGTGTGTGAT GGTAGATTATTTCAGATATGTATGTAAAACTGTTTC C | 15 | SIDSFFCSL DSSVSY* |
| 2016 | NM_021227.2_440 | 440 | TAGGGAGGGCGGGCCTGTTTCCGGGAGGCGCGT GGGGCTTGAGGCCGAGAACGGCCCTTGCTGCCAC CAACATGGAGACTTTGTACCGTGTCCCGTTCTTAG TGCTCGAATGTCCCAACCTGAAGCTGAAGAAGCC GCCCTGGTTGCACATGCCGTCGGCCATGACTGTG TATGCTCTGGTGGTGGTGTCTTACTTCCTCATCAC CGGAGGAATAAATTTATGATGTTATTGTTGAACCTCC AAGTGTCGGTTCTATGACTGATGAACATGGGCATC AGAGGCCAGTAGCTTTCTTGGCCTACAGAGTAAAT GGACAATATATTATGGAAGGACTTGCATCCAGCTT CCTATTTACAATGGGAGGTTAGGTTTCATAATCCT GGACCGATCGAATGCACCAAATATCCCAAAACTCA ATAGATTCCTTCTTCTGTTCATGGATTCGTCTGTGT CCTATTGAGTTTTTTCATGGCTAGAGTATTCATGAG AATGAAACTGCCGGGCTATCTGATGGGTTAGAGTG CCTTTGAGAAGAAATCAGTGGATACTGGATTTGCT CCTGTCAATGAAGTTTTAAAGGCTGTACCAATCCT CTAATATGAAATGTGGAAAAGAATGAAGAGCAGCA GTAAAAGAAATATCTAGTGAAAAAACAGGAAGCGT ATTGAAGCTTGGACTAGAATTTCTTCTTGGTATTAA AGAGACAAGTTTATCACAGAATTTTTTTCCTGCTG GCCTATTGCTATACCAATGATGTTGAGTGGCATTTT CTTTTTAGTTTTTCATTAAAATATATTCCATATCTAC AACTATAATATCAAATAAAGTGATTATTTTTACAAC CCTCTTAACATTTTTTGGAGATGACATTTCTGATTT | 7 | MDSSVSY* |

TABLE 3A-continued

| SEQ ID | identifier_position | position | modified_RNA | PAP length | PAP |
|---|---|---|---|---|---|
| | | | TCAGAAATTAACATAAAATCCAGAAGCAAGATTCC GTAAGCTGAGAACTCTGGACAGTTGATCAGCTTTA CCTATGGTGCTTTGCCTTTAACTAGAGTGTGTGAT GGTAGATTATTTCAGATATGTATGTAAAACTGTTTC C | | |
| 2017 | NM_021227.2_502 | 502 | TAGGGAGGGCGGGCCTGTTTCCGGGAGGCGCGT GGGGCTTGAGGCCGAGAACGGCCCTTGCTGCCAC CAACATGGAGACTTTGTACCGTGTCCCGTTCTTAG TGCTCGAATGTCCCAACCTGAAGCTGAAGAAGCC GCCCTGGTTGCACATGCCGTCGGCCATGACTGTG TATGCTCTGGTGGTGGTGTCTTACTTCCTCATCAC CGGAGGAATAATTTATGATGTTATTGTTGAACCTCC AAGTGTCGGTTCTATGACTGATGAACATGGGCATC AGAGGCCAGTAGCTTTCTTGGCCTACAGAGTAAAT GGACAATATATTATGGAAGGACTTGCATCCAGCTT CCTATTTACAATGGGAGGTTTAGGTTTCATAATCCT GGACCGATCGAATGCACCAAATATCCCAAAACTCA ATAGATTCCTTCTTCTGTTCATTGGATTCGTCTGTG TCCTATTGAGTTTTTTCATGGCTAGAGTATTCATGA GAATGAAACTGCGGGCTATCTGATGGGTTAGAGT GCCTTTGAGAAGAAATCAGTGGATACTGGATTTGC TCCTGTCAATGAAGTTTTAAAGGCTGTACCAATCCT CTAATATGAAATGTGGAAAAGAATGAAGAGCAGCA GTAAAAGAAATATCTAGTGAAAAAAACAGGAAGCGT ATTGAAGCTTGGACTAGAATTTCTTCTTGGTATTAA AGAGACAAGTTTATCACAGAATTTTTTTTCCTGCTG GCCTATTGCTATACCAATGATGTTGAGTGGCATTTT CTTTTTAGTTTTTCATTAAAATATATTCCATATCTAC AACTATAATATCAAATAAAGTGATTATTTTTTACAAC CCTCTTAACATTTTTTGGAGATGACATTTCTGATTT TCAGAAATTAACATAAAATCCAGAAGCAAGATTCC GTAAGCTGAGAACTCTGGACAGTTGATCAGCTTTA CCTATGGTGCTTTGCCTTTAACTAGAGTGTGTGAT GGTAGATTATTTCAGATATGTATGTAAAACTGTTTC C | 3 | RAI* |
| 2018 | NM_022497.3_172 | 172 | AGTGGAACCTGGCTCTGGGGAGAAGCCGCGTGAG ATCCGCGCGGGTGCTAGCTAGTCCTTTCTCGTCG CTGCTCGGCTCGCGGCCCGTGGGGTCGGCCCG CCACCGTTGCCGCCATGCCCATGAAGGGCCGCTT CCCCATCCGCCGCACCCTGCAATATCTGAGCCAG GGAACGTGGTGTTCAAGGACTCCGTGAAGGTCAT GACAGTGAATTACAACACGCATGGGGAGCTGGGC GAGGGCGCCAGGAAGTTTGTGTTTTTCAACATACC TCAGATTCAATACAAAAACCCTTGGGTGCAGATCA TGATGTTTAAGAACATGACGCCGTCACCCTTCCTG CGATTCTACTTAGATTCTGGGGAGCAGGTCCTGGT GGATGTGGAGACCAAGAGCAATAAGGAGATCATG GAGCACATCAGAAAAATCTTGGGGAAGAATGAGG AAACCCTCAGGGAAGAGGAGGAGGAGAAAAAGCA GCTTTCTCACCCAGCCAACTTCGGCCCTCGAAAGT ACTGCCTGCGGGAGTGCATCTGTGAAGTGGAAGG GCAGGTGCCCTGCCCCAGCCTGGTGCCATTACCC AAGGAGATGAGGGGGAAGTACAAAGCCGCTCTGA AAGCCGATGCCCAGGACTAAGGCCCACGGTCACT GTGGGCTGGGGTGATGGTGTCTGACCAGTGGGGA GATTGGAATGGGATTACTTTGGCCCAGGGAAGCC CCTGGTTCTGTCCCTGGAGACTCTGGAAATCCTTT TGCATTAAAAGGACTTTACACACCTGTGTAAAAGG ATGTGGGAGAGGAGGGTCTGAAGCTGAGCTGCTA AATGAATATCCCTGCTCTGCTGGTCAATAAAACGC TTCCTAATAGCAGCTTGGCGTGTATCTGGTCCTAG TGAAGAGGAAGGCCTGTGTAGCAGAAAGGCTTTG GGCCTGAGAGGTTAAGGCCACAGCCTGTTGACAC CTGTTTTGGTCCTGCGACCCTTTACTGGTCTCCGC TGGCTTTGAATCTTCCTCTGGGCTCTACT | 7 | TWCSRTP* |
| 2019 | NM_022551.2_129 | 129 | CTCTCTTCCACAGGAGGCCTACACGCCGCCGCTT GTGCTGCAGCCATGTCTCTAGTGATCCCTGAAAAG TTCCAGCATATTTTGCGAGTACTCAACACCAACAT CGATGGGCGGCGGAAAATAGCCTTGCCATCACTG CCATTAAGGGTGTGGGCCGAAGATATGCTCATGT GGTGTTGAGGAAAGCAGACATTGACCTCACCAAG AGGGCGGGAGAACTCACTGAGGATGAGGTGGAAC GTGTGATCACCATTATGCAGAATCCACGCCAGTAC AAGATCCCAGACTGGTTCTTGAACAGACAGAAGGA TGTAAAGGATGGAAAATACAGCCAGGTCCTAGCCA ATGGTCTGGACAACAAGCTCCGTGAAGACCTGGA GCGACTGAAGAAGATTCGGGCCCATAGAGGGCTG | 17 | LPSLPLRV WAEDMLM WC* |

TABLE 3A-continued

| SEQ ID | identifier_ position | position | modified_RNA | PAP length | PAP |
|---|---|---|---|---|---|
| 2020 | NM_0225 51.2_83 | 83 | CGTCACTTCTGGGGCCTTCGTGTCCGAGGCCAGC ACACCAAGACCACTGGCCGCCGTGGCCGCACCGT GGGTGTGTCCAAGAAGAAATAAGTCTGTAGGCCTT GTCTGTTAATAAATAGTTTATATACAAAAAAA CTCTCTTCCACAGGAGGCCTACACGCGCCGCTT GTGCTGCAGCCATGTCTCTAGTGATCCCTGAAAAG TTCCAGCATATTTGCGAGTACTCAACACCAACATC GATGGGCGGCGGAAAATAGCCTTTGCCATCACTG CCATTAAGGGTGTGGGCCGAAGATATGCTCATGT GGTGTTGAGGAAAGCAGACATTGACCTCACCAAG AGGGCGGGAGAACTCACTGAGGATGAGGTGGAAC GTGTGATCACCATTATGCAGAATCCACGCCAGTAC AAGATCCCAGACTGGTTCTTGAACAGACAGAAGGA TGTAAAGGATGGAAAATACAGCCAGGTCCTAGCCA ATGGTCTGGACAACAAGCTCCGTGAAGACCTGGA GCGACTGAAGAAGATTCGGGCCCATAGAGGGCTG CGTCACTTCTGGGGCCTTCGTGTCCGAGGCCAGC ACACCAAGACCACTGGCCGCCGTGGCCGCACCGT GGGTGTGTCCAAGAAGAAATAAGTCTGTAGGCCTT GTCTGTTAATAAATAGTTTATATACAAAAAAA | 13 | CEYSTPTS MGGGK* |
| 2021 | NM_0240 56.2_196 | 196 | GACATGACACCAGTGGCATATCACGGCCATGGGG TCTCAGCATTCCGCTGCTGCTCGCCCCTCCTCCTG CAGGCGAAAGCAAGAAGATGACAGGGACGGTTTG CTGGCTGAACGAGAGCAGGAAGAAGCCATTGCTC AGTTCCCATATGTGGAATTCACCGGGAGAGATAGC ATCACCTGTCTCACGTGCCAGGGACAGGCTACATT CCAACAGAGCAAGTAAATGAGTTGGTGGCTTTGAT CCCACACAGTGATCAGAGATTGCGCCCTCAGCGA ACTAAGCAATATGTCCTCCTGTCCATCCTGCTTTGT CTCCTGGCATCTGGTTTGGTGGTTTTCTTCCTGTTT CCGCATTCAGTCCTTGTGGATGATGACGGCATCAA AGTGGTGAAAGTCACATTTAATAAGCAAGACTCCC TTGTAATTCTCACCATCATGGCCACCCTGAAAATC AGGAACTCCAACTTCTACACGGTGGCAGTGACCA GCCTGTCCAGCCAGATTCAGTACATGAACACAGTG GTCAGTACATATGTGACTACTAACGTCTCCCTTATT CCACCTCGGAGTGAGCAACTGGTGAATTTTACCG GGAAGGCCGAGATGGGAGGACCGTTTTCCTATGT GTACTTCTTCTGCACGGTACCTGAGATCCTGGTGC ACAACATAGTGATCTTCATGCGAACTTCAGTGAAG ATTTCATACATTGGCCTCATGACCCAGAGCTCCTT GGAGACACATCACTATGTGGATTGTGGAGGAAATT CCACAGCTATTTAACAACTGCTATTGGTTCTTCCAC ACAGCGCCTGTAGAAGAGAGCACAGCATATGTTC CCAAGGCCTGAGTTCTGGACCTACCCCACGTGG TGTAAGCAGAGGAGGAATTGGTTCACTTAACTCCC AGCAAACATCCTCCTGCCACTTAGGAGGAAACACC TCCCTATGGTACCATTTATGTTTCTCAGAACCAGCA GAATCAGTGCCTAGCCTGTGCCCAGCAAATAGTTG GCACTCAATAAAG | 8 | QATFQQSK* |
| 2022 | NM_0240 96.1_334 | 334 | GGAGCTCTGGAGGCGGGGCTTCGAGCGTGGCTC GTGGGTTTTCCGTGAAGTCGCGGTGCAGCGGTGG GCGGCATGTCTGTGGCCGGTGGGGAGATTCGTGG GGACACGGGGGAGAGGACACTGCTGCTCCCGG CCGGTTCAGCTTCAGCCCGGAGCCCACGCTCGAG GACATCCGCCGCCTCCATGCTGAGTTTGCTGCGG AACGAGACTGGGAACAGTTCCATCAGCCTCGGAA TCTCCTCCTGGCCTTGGTTGGGGAAGTGGGGGAG CTGGCAGAACTCTTTCAGTGGAAAACCGATGGGG AACCTGGCCCCCAAGGCTGGTCCCCCAGGAACGG GCAGCCCTTCAAGAGGAGCTTAGTGACGTCCTCAT CTACCTGGTGGCATTAGCAGCCCGCTGCCGTGTG GATCTGCCGCTAGCAGTGCTCTCCAAAATGGACAT CAACCGGCGACGCTACCCAGCCCATCTGGCCCGC AGCTCTTCCCGCAAGTATACAGAATTGCCCCATGG GGCCATCTCTGAAGACCAGGCTGTGGGGCCTGCG GACATTCCCTGTGACTCCACAGGCCAGACCTCAAC CTAGAAAGATGGCCACAGGACTTGCAACTCAGGG TGGTGTCTGAAGAGCAGAGAGTGGCCTGGCCCTG GAGCCTTTTTCTAGTCTTTTCAGAATAGATCATGGG CCTGAGGCCTCCACTTCTTGAGGTCTGAGGCCCA GCAGCCTCTAGAAGGTAGCCTCCTGGTGTTTGTTC TCCCAGTAAAATGGTTTTGGGCGATAACTTCTAGA TTATTCCTGGATGGCCAGGGAGGCTCTCTGTCTCA GCAGGTGATGACGGGGGTACCAGGGGTGCCTCT GAGACCCATTCTCGTGTTTCCCTGTTGTACCTTTTG CCTGCAGGGCAGAGAGATCTGGTTTCTAGCAAATT | 18 | NGQPFKR SLVTSSST WWH* |

TABLE 3A-continued

| SEQ ID | identifier_position | position | modified_RNA | PAP length | PAP |
|---|---|---|---|---|---|
| 2023 | NM_024098.3_564 | 564 | CCCAGTAGGATGTCATGTAAGTTCCTTCCCCCTCT TAGAGATTGAAGGCTGTAAGAGTCCAGATGGTGG AGCCAGGCTGTCTGGGTTCAAATGCCAT ACTCTCCCCAACCCCGGTCCCGCCTCTCCACCCC TCACCAACATGGCCGCCTCAGCAACAGCCCCCCT CCTGTGCGTCACGGACGCGGCGACTCCTGACGTC ATAGGAAGGCGCCGGTTTCGGCGGGGGCTGCAC GTGCGCAGGGGTGTGGAAACTTACCGGCTGAGCC ATGGATACACCGTTAAGGCGCAGCCGACGGCTGG GAGGCCTAAGGCCCGAATCCCCCGAGAGCCTCAC CTCAGTTTCGCGGACGAGACGGGCCCTTGTGGAG TTCGAGTCGAACCCAGAAGAAACGAGGGAGCCCG GGTCTCCTCCGAGTGTGCAGCGGGCTGGCCTGGG GTCCCCCGAAAGGCCGCCGAAGACAAGCCCAGGA TCACCCCGTCTGCAGCAGGGTGCAGGCTTGGAGT CACCCCAAGGGCAGCCAGAGCCAGGCGCAGCGT CCCCCCAGCGTCAGCAAGACCTACACCTGGAGTC GCCTCAAAGACAGCCAGAGTACAGTCCTGAATCC CCACGATGTCAGCCGAAGCCAAGTGAGGAGGCAC CAAAGTGTTCTCAGGACCAGGAGTACTGGCCTCG GAGTTGGCCCAGAATAAGGAGGAGCTGACCCCGG GGGCCCCCCAGCATCAGCTACCGCCGGTCCCAG GATCACCAGAGCCTTACCCCGGTCAGCAAGCTCC CGGTCCGGAGCCCTCTCAGCCACTACTGGAGCTG ACACCCAGGGCACCTGGCTCCCCCCGGGGTCAG CATGAGCCGAGCAAGCCACCTCCAGCTGGGGAGA CGGTGACAGGCGGCTTCGGGGCAAAGAAGCGAAA AGGTTCTTCATCCCAGGCCCCAGCGTCCAAGAAG TTGAATAAAGAGGAGCTTCCTGTAATCCCGAAGGG GAAGCCCAAATCGGGGCGAGTGTGGAAGGACCG CTCCAAGAAAAGATTCTCCCAGATGCTTCAGGACA AGCCCCTGCGCACATCGTGGCAGCGGAAGATGAA GGAACGACAGGAGAGGAAGCTGGCCAAGGACTTT GCCCGTC | 13 | EYWPRSW PRIRRS* |
| 2024 | NM_024104.3_156 | 156 | CCCTGGGGCTTCCGCTTCCGGTTCTGACGGACGC TTCGGCCGTAACGATGATCGGAGACATCCTGCTGT TCGGGACGTTGCTGATGAATGCCGGGGCGGTGCT GAACTTTAAGCTGAAAAAGAAGGACACGCAGGGC TTTGGGGAGGAGTCCAGGAGCCCAGCACAGGTGA CAACATCCGGGAATTCTTGCTGAGCCTCAGATACT TTCGAATCTTCATCGCCCTGTGGAACATCTTCATG ATGTTCTGCATGATTGTGCTGTTCGGCTCTTGAAT CCCAGCGATGAAACCAGGAACTCACTTTCCCGGG ATGCCGAGTCTCCATTCCTCCATTCCTGATGACTT CAAGAATGTTTTTGACCAGAAAACCGACAACCTTC CCAGAAAGTCCAAGCTCGTGGTGGGTGGAAAAGT GTTCGCCGAGGTGTGCATGGTTTCCCAGCCACGT CCCTGTTTTCAAAGATAGTTTCACTTTGGTCTCTGA ATTGAAATGCTGTCTACTGAAAGGGTTTCAGGAGC GTTTATGTAAGGGGCTGTGATGAAATTGCATTCCC CATAGATAAAAGAAAAATCATTTCTATCCAGAGATC TGAGCAGAAGGATTGGCTTGTTAGTTTAACACAGC CGTATTTTTGGACATTCAGTGTTACTTGCTGAGTCT GACAGCCTCTGGGCCCGGCCAGGGGCCCTGTTAA CAAACTGCTTTCACATCCCAACAGGGTCTGCTTGG CCACTCAGTGCAGCTGCGATTAACCCTAAAGGCTT TAAGGAACGGGCCACCTGTAACAGAGACACCAGC CTTCCTGTATAGACACTAAATTGTTAGCAAGAGTGT TGAGCTAGTTCCTGGTGAAGTGTTTCCACAGAAGA CATGTGGAGCAGTTGTGGGGATATTAAGGGAAACT TTCCTCTGCCTTGACCCCTTTGTTAAATAAAATGAC TTTGGGAGCCATTCATTGTACAGTTGCAGGAATGA GAGTGATTTTATGATGTGGTACATTGGGACCATGT TCTAAAACCTTGG | 12 | SPAQVTTS GNSC* |
| 2025 | NM_024844.3351 | 351 | CGGTACTCTGAGTGCAGTCAGTCCTCGGCGCTGT TTTCCCTGATTTGCTGTCGACGCCAGGAAGGAAGG ACGCGTGCAGAGGACCGCAGAGGGGTGGCCGTG GCTGAGAGGAGACAGCGCCGCAGCACTGAGGGTT TGGGCTTGCAGGCGCTGCAGGAGACGCCCAGGC GGAGTCTTGTCTCGCAGCCAGCTCTGAGCGGGAG GCCTGAGCGGGAAGCATTGGCGTCCGAGCGACTT CTAGGGAGCCTGGGGTTCGGCGCTATGGAGGAGCT CGATGGCGAGCCAACAGTCACTTTGATTCCAGGC GTGAATTCCAAGAAGAACCAAATGTATTTTGACTG GGGTCCAGGGAGATGCTGGTATGTGAAACCTCCT TCAACAAAAAAGAAAAATCAGAGATGGTGCCAAGT TGCCCCTTTATCTATATCATCCGTAAGGATGTAGAT | 30 | RCWYVKP PSTKKKNQ RWCQVAP LSISSVRM* |

TABLE 3A-continued

| SEQ ID | identifier_position | position | modified_RNA | PAP length | PAP |
|---|---|---|---|---|---|
| | | | GTTTACTCTCAAATCTTGAGAAAACTCTTCAATGAA<br>TCCCATGGAATCTTTCTGGGCCTCCAGAGAATTGA<br>CGAAGAGTTGACTGGAAAATCCAGAAAATCTCAAT<br>TGGTTCGAGTGAGTAAAAACTACCGATCAGTCATC<br>AGAGCATGTATGGAGGAAATGCACCAGGTTGCAAT<br>TGCTGCTAAAGATCCAGCCAATGGCCGCCAGTTCA<br>GCAGCCAGGTCTCCATTTTGTCAGCAATGGAGCTC<br>ATCTGGAACCTGTGTGAGATTCTTTTTATTGAAGTG<br>GCCCCAGCTGGCCCTCTCCTCCTCCATCTCCTTGA<br>CTGGGTCCGGCTCCATGTGTGCGAGGTGGACAGT<br>TTGTCGGCAGATGTTCTGGGCAGTGAGAATCCAA<br>GCAAACATGACAGCTTCTGGAACTTGGTGACCATC<br>TTGGTGCTGCAGGGCCGGCTGGATGAGGCCCGAC<br>AGATGCTCTCCAAGGAAGCCGATGCCAGCCCCGC<br>CTCTGCAGGCATATGCCGAATCATGGGGGACCTG<br>ATGAGGACAATGCCCATTCTTAGTCCTGGGAACAC<br>CCAGACACTGACAGAGCTGGAG | | |
| 2026 | NM_025072.4_612 | 612 | GGAGGGCAGAGAGAACCGCAACACCTGGTGCCG<br>GGTCGGGTCGTTTCCGGGGCTTTCAGTGGCCGGA<br>AGTCGCGGCGCCTGTACTGACTCTAGGAAGGGCT<br>GGAGTTGTTTTGAATGGGCGCCCGTAAGAGAGGT<br>GGGCAAGTACGTGTTACAGACGGCCACGCCGCCC<br>TTTAGGCGGTCAAGGTGGGGCGAGCAGACGTTCG<br>CCCCCCTGCAGTCGGCCGGGTCACTACCCAAGAG<br>CCTTTGGAGGCGGAAGCATGGAACGGTCTGCAAA<br>CGTTCCCGAGCGGGCCTCTGCGGCTCTGGCGGG<br>CGTTTCGAACTTGGGCGCCGGGCACACGCCCAGT<br>CCCGAGAGCGCTGAGGGTTCCCTTAGCGTCGCCC<br>TCACCCCGGCCAACCCGCGGGGCGCCAGAGTCC<br>TGGCCCTTTAAACGCCGCGCGTGCCTCGGCGTCT<br>TCGTTTCGCGCGCCCGCCCGCGGCGCCGGCGGA<br>GCGAACATGGACCCGGCTGCGCGGGTGGTGCGG<br>GCGCTGTGGCCTGGTGGGTGCGCCTTGGCCTGGA<br>GGCTGGGAGGCCGCCCCCAGCCGCTGCTACCCA<br>CGCAGAGCCGGGCTGGCTTCGCGGGGGCGGCGG<br>GCGGCCGAGCCCCGTGGCTGCAGCTCGTAAGGG<br>GAGCCCGCGGCTGCTGGGAGCTGCGGCGCTGGC<br>CCTGGGGGGAGCCCTGGGGCTGTACCACACGGC<br>GCGGTGGCACCTGCGCGCCCAGGACCTCCACGC<br>AGAGCGCTCAGCCGCGCAGCTCTCCCTGTCCAGC<br>CGCCTGCAGCTGACCCTGTACCAGTACAAGACGT<br>GTCCCTTCTGCAGCAAGGTCCGAGCCTTCCTCGA<br>CTTCCATGCCCTGCCCTACCAGGTGGTGGAGGTG<br>AACCCTGTGCGCAGGGCTGAGATCAAGTTCTCCTC<br>CTACAGAAAGGTGCCCATCCTGGTGCCCAGGAA<br>GGAGAAAGCTCGCAACAACTAAATGACTCCTCTGT<br>CATCATCAGCGCCCTCAAGACCTACCTGGTGTCG<br>GGGCAGCCCCTGG | 57 | RAPWLQLV<br>RGARGCW<br>ELRRWPW<br>GEPWGCT<br>TRRGGTC<br>APRTSTQS<br>AQPRSSPC<br>PAACS* |
| 2027 | NM_031157.2_158 | 158 | GAGAGGGCGAAGGTAGGCTGGCAGATACGTTCGT<br>CAGCTTGCTCCTTTCTGCCCGTGGACGCCGCCGA<br>AGAAGCATCGTTAAAGTCTCTCTTCACCCTGCCGT<br>CATGTCTAAGTCAGAGTCTCCTAAAGAGCCCGAAC<br>AGCTGAGGAAGCTCTTCATGGAGGGTTGAGCTTTG<br>AAACAACTGATGAGAGCCTGAGGAGCCATTTTGAG<br>CAATGGGGAACGCTCACGGACTGTGTGGTAATGA<br>GAGATCCAAACACCAAGCGCTCCAGGGGCTTTGG<br>GTTTGTCACATATGCCACTGTGGAGGAGGTGGATG<br>CAGCTATGAATGCAAGGCCACACAAGGTGGATGG<br>AAGAGTTGTGGAACCAAAGAGAGCTGTCTCCAGA<br>GAAGATTCTCAAAGACCAGGTGCCCACTTAACTGT<br>GAAAAAGATATTTGTTGGTGGCATTAAAGAAGACA<br>CTGAAGAACATCACCTAAGAGATTATTTTGAACAGT<br>ATGGAAAAATTGAAGTGATTGAAATCATGACTGAC<br>CGAGGCAGTGGCAAGAAAAGGGGCTTTGCCTTTG<br>TAACCTTTGACGACCATGACTCCGTGGATAAGATT<br>GTCATTCAGAAATACCATACTGTGAATGGCCACAA<br>CTGTGAAGTTAGAAAAGCCCTGTCAAAGCAAGAGA<br>TGGCTAGTGCTTCATCCAGCCAAAGAGGTCGAAGT<br>GGTTCTGGAAACTTTGGTGGTGGTCGTGGAGGTG<br>GTTTCGGTGGGAATGACAACTTCGGTCGTGGAGG<br>AAACTTCAGTGGTCGTGGTGGCTTTGGTGGCAGC<br>CGTGGTGGTGGTGGATATGGTGGCAGTGGGGATG<br>GCTATAATGGATTTGGTAATGATGGTGGTTATGGA<br>GGAGGCGGCCCTGGTTACTCTGGAGGAAGCAGAG<br>GCTATGGAAGTGGTGGACAGGGTTATGGAAACCA<br>GGGCAGTGGCTATGGCGGGAGTGGCAGCTATGAC | 3 | MEG* |

TABLE 3A-continued

| SEQ ID | identifier_ position | position | modified_RNA | PAP length | PAP |
|---|---|---|---|---|---|
| 2028 | NM_0311 57.2_173 | 173 | AGCTATAACAACGGAGGCGGAGGCGGCTTTGGCG GTGGTAGTGGAAGCAATTTTGGA GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTG AAACAACTGATGAGAGCCTGAGGAGCCATTTTGAG CAATGGGGAACGCTCACGGACTGTGTGGTAATGA GAGATCCAAACACCAAGCGCTCCAGGGGCTTTGG GTTTGTCACATATGCCACTGTGGAGGAGGTGGATG CAGCTATGAATGCAAGGCCACACAAGGTGGATGG AAGAGTTGTGGAACCAAAGAGAGCTGTCTCCAGA GAAGATTCTCAAAGACCAGGTGCCCACTTAACTGT GAAAAAGATATTTGTTGGTGGCATTAAAGAAGACA CTGAAGAACATCACCTAAGAGATTATTTTGAACAGT ATGGAAAAATTGAAGTGATTGAAATCATGACTGAC CGAGGCAGTGGCAAGAAAAGGGGCTTTGCCTTTG TAACCTTTGACGACCATGACTCCGTGGATAAGATT GTCATTCAGAAATACCATACTGTGAATGGCCACAA CTGTGAAGTTAGAAAAGCCCTGTCAAAGCAAGAGA TGGCTAGTGCTTCATCCAGCCAAAGAGGTCGAAGT GGTTCTGGAAACTTTGGTGGTGGTCGTGGAGGTG GTTTCGGTGGGAATGACAACTTCGGTCGTGGAGG AAACTTCAGTGGTCGTGGTGGCTTTGGTGGCAGC CGTGGTGGTGGTGGATATGGTGGCAGTGGGGATG GCTATAATGGATTTGGTAATGATGGTGGTTATGGA GGAGGCGGCCCTGGTTACTCTGGAGGAAGCAGAG GCTATGGAAGTGGTGGACAGGGTTATGGAAACCA GGGCAGTGGCTATGGCGGGAGTGGCAGCTATGAC AGCTATAACAACGGAGGCGGAGGCGGCTTTGGCG GTGGTAGTGGAAGCAATTTTGGA | 7 | LKQLMRA* |
| 2029 | NM_0311 57.2_206 | 206 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTTGTTGGTGGCATTAAAGAAGAC ACTGAAGAACATCACCTAAGAGATTATTTTGAACA GTATGGAAAAATTGAAGTGATTGAAATCATGACTG ACCGAGGCAGTGGCAAGAAAAGGGGCTTTGCCTT TGTAACCTTTGACGACCATGACTCCGTGGATAAGA TTGTCATTCAGAAATACCATACTGTGAATGGCCAC AACTGTGAAGTTAGAAAAGCCCTGTCAAAGCAAGA GATGGCTAGTGCTTCATCCAGCCAAAGAGGTCGA AGTGGTTCTGGAAACTTTGGTGGTGGTCGTGGAG GTGGTTTCGGTGGGAATGACAACTTCGGTCGTGG AGGAAACTTCAGTGGTCGTGGTGGCTTTGGTGGC AGCCGTGGTGGTGGTGGATATGGTGGCAGTGGGG ATGGCTATAATGGATTTGGTAATGATGGTGGTTAT GGAGGAGGCGGCCCTGGTTACTCTGGAGGAAGCA GAGGCTATGGAAGTGGTGGACAGGGTTATGGAAA CCAGGGCAGTGGCTATGGCGGGAGTGGCAGCTAT GACAGCTATAACAACGGAGGCGGAGGCGGCTTTG GCGGTGGTAGTGGAAGCAATTTTGGA | 11 | LSNGERSR TVW* |
| 2030 | NM_0311 57.2_271 | 271 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGAACGCTCACGGACTGTGTGGTAATG AGAGATCCAAACACCAAGCGCTCCAGGGGCTTTGG GTTTGTCACATATGCCACTGTGGAGGAGGTGGATG CAGCTATGAATGCAAGGCCACACAAGGTGGATGG AAGAGTTGTGGAACCAAAGAGAGCTGTCTCCAGA GAAGATTCTCAAAGACCAGGTGCCCACTTAACTGT GAAAAAGATATTTGTTGGTGGCATTAAAGAAGACA CTGAAGAACATCACCTAAGAGATTATTTTGAACAGT ATGGAAAAATTGAAGTGATTGAAATCATGACTGAC | 16 | ALGLSHMP LWRRWMQ L* |

TABLE 3A-continued

| SEQ ID | identifier_position | position | modified_RNA | PAP length | PAP |
|---|---|---|---|---|---|
| | | | CGAGGCAGTGGCAAGAAAAGGGGCTTTGCCTTTG<br>TAACCTTTGACGACCATGACTCCGTGGATAAGATT<br>GTCATTCAGAAATACCATACTGTGAATGGCCACAA<br>CTGTGAAGTTAGAAAAGCCCTGTCAAAGCAAGAGA<br>TGGCTAGTGCTTCATCCAGCCAAAGAGGTCGAAGT<br>GGTTCTGGAAACTTTGGTGGTGGTCGTGGAGGTG<br>GTTTCGGTGGGAATGACAACTTCGGTCGTGGAGG<br>AAACTTCAGTGGTCGTGGTGGCTTTGGTGGCAGC<br>CGTGGTGGTGGTGGATATGGTGGCAGTGGGGATG<br>GCTATAATGGATTTGGTAATGATGGTGGTTATGGA<br>GGAGGCGGCCCTGGTTACTCTGGAGGAAGCAGAG<br>GCTATGGAAGTGGTGGACAGGGTTATGGAAACCA<br>GGGCAGTGGCTATGGCGGGAGTGGCAGCTATGAC<br>AGCTATAACAACGGAGGCGGAGGCGGCTTTGGCG<br>GTGGTAGTGGAAGCAATTTTGGA | | |
| 2031 | NM_0311 57.2_275 | 275 | GAGAGGGCGAAGGTAGGCTGGCAGATACGTTCGT<br>CAGCTTGCTCCTTTCTGCCCGTGGACGCCGCCGA<br>AGAAGCATCGTTAAAGTCTCTCTTCACCCTGCCGT<br>CATGTCTAAGTCAGAGTCTCCTAAAGAGCCCGAAC<br>AGCTGAGGAAGCTCTTCATTGGAGGGTTGAGCTTT<br>GAAACAACTGATGAGAGCCTGAGGAGCCATTTTGA<br>GCAATGGGGAACGCTCACGGACTGTGTGGTAATG<br>AGAGATCCAAACACCAAGCGCTCCAGGGGCTTGG<br>GTTTGTCACATATGCCACTGTGGAGGAGGTGGATG<br>CAGCTATGAATGCAAGGCCACACAAGGTGGATGG<br>AAGAGTTGTGGAACCAAAGAGAGCTGTCTCCAGA<br>GAAGATTCTCAAAGACCAGGTGCCCACTTAACTGT<br>GAAAAAGATATTTGTTGGTGGCATTAAAGAAGACA<br>CTGAAGAACATCACCTAAGAGATTATTTTGAACAGT<br>ATGGAAAAATTGAAGTGATTGAAATCATGACTGAC<br>CGAGGCAGTGGCAAGAAAAGGGGCTTTGCCTTTG<br>TAACCTTTGACGACCATGACTCCGTGGATAAGATT<br>GTCATTCAGAAATACCATACTGTGAATGGCCACAA<br>CTGTGAAGTTAGAAAAGCCCTGTCAAAGCAAGAGA<br>TGGCTAGTGCTTCATCCAGCCAAAGAGGTCGAAGT<br>GGTTCTGGAAACTTTGGTGGTGGTCGTGGAGGTG<br>GTTTCGGTGGGAATGACAACTTCGGTCGTGGAGG<br>AAACTTCAGTGGTCGTGGTGGCTTTGGTGGCAGC<br>CGTGGTGGTGGTGGATATGGTGGCAGTGGGGATG<br>GCTATAATGGATTTGGTAATGATGGTGGTTATGGA<br>GGAGGCGGCCCTGGTTACTCTGGAGGAAGCAGAG<br>GCTATGGAAGTGGTGGACAGGGTTATGGAAACCA<br>GGGCAGTGGCTATGGCGGGAGTGGCAGCTATGAC<br>AGCTATAACAACGGAGGCGGAGGCGGCTTTGGCG<br>GTGGTAGTGGAAGCAATTTTGGA | 15 | LGLSHMPL WRRWMQL* |
| 2032 | NM_0311 57.2_353 | 353 | GAGAGGGCGAAGGTAGGCTGGCAGATACGTTCGT<br>CAGCTTGCTCCTTTCTGCCCGTGGACGCCGCCGA<br>AGAAGCATCGTTAAAGTCTCTCTTCACCCTGCCGT<br>CATGTCTAAGTCAGAGTCTCCTAAAGAGCCCGAAC<br>AGCTGAGGAAGCTCTTCATTGGAGGGTTGAGCTTT<br>GAAACAACTGATGAGAGCCTGAGGAGCCATTTTGA<br>GCAATGGGGAACGCTCACGGACTGTGTGGTAATG<br>AGAGATCCAAACACCAAGCGCTCCAGGGGCTTTG<br>GGTTTGTCACATATGCCACTGTGGAGGAGGTGGAT<br>GCAGCTATGAATGCAAGGCCACACAAGGTGGATG<br>GAAGAGTGTGGAACCAAAGAGAGCTGTCTCCAGA<br>GAAGATTCTCAAAGACCAGGTGCCCACTTAACTGT<br>GAAAAAGATATTTGTTGGTGGCATTAAAGAAGACA<br>CTGAAGAACATCACCTAAGAGATTATTTTGAACAGT<br>ATGGAAAAATTGAAGTGATTGAAATCATGACTGAC<br>CGAGGCAGTGGCAAGAAAAGGGGCTTTGCCTTTG<br>TAACCTTTGACGACCATGACTCCGTGGATAAGATT<br>GTCATTCAGAAATACCATACTGTGAATGGCCACAA<br>CTGTGAAGTTAGAAAAGCCCTGTCAAAGCAAGAGA<br>TGGCTAGTGCTTCATCCAGCCAAAGAGGTCGAAGT<br>GGTTCTGGAAACTTTGGTGGTGGTCGTGGAGGTG<br>GTTTCGGTGGGAATGACAACTTCGGTCGTGGAGG<br>AAACTTCAGTGGTCGTGGTGGCTTTGGTGGCAGC<br>CGTGGTGGTGGTGGATATGGTGGCAGTGGGGATG<br>GCTATAATGGATTTGGTAATGATGGTGGTTATGGA<br>GGAGGCGGCCCTGGTTACTCTGGAGGAAGCAGAG<br>GCTATGGAAGTGGTGGACAGGGTTATGGAAACCA<br>GGGCAGTGGCTATGGCGGGAGTGGCAGCTATGAC<br>AGCTATAACAACGGAGGCGGAGGCGGCTTTGGCG<br>GTGGTAGTGGAAGCAATTTTGGA | 18 | WNQRELS PEKILKDQ VPT* |

TABLE 3A-continued

| SEQ ID | identifier_position | position | modified_RNA | PAP length | PAP |
|---|---|---|---|---|---|
| 2033 | NM_031157.2_428 | 428 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTGTTGGTGGCATTAAAGAAGACA CTGAAGAACATCACCTAAGAGATTATTTTGAACAGT ATGGAAAAATTGAAGTGATTGAAATCATGACTGAC CGAGGCAGTGGCAAGAAAAGGGGCTTTGCCTTTG TAACCTTTGACGACCATGACTCCGTGGATAAGATT GTCATTCAGAAATACCATACTGTGAATGGCCACAA CTGTGAAGTTAGAAAAGCCCTGTCAAAGCAAGAGA TGGCTAGTGCTTCATCCAGCCAAAGAGGTCGAAGT GGTTCTGGAAACTTTGGTGGTGGTCGTGGAGGTG GTTTCGGTGGGAATGACAACTTCGGTCGTGGAGG AAACTTCAGTGGTCGTGGTGGCTTTGGTGGCAGC CGTGGTGGTGGTGGATATGGTGGCAGTGGGGATG GCTATAATGGATTTGGTAATGATGGTGGTTATGGA GGAGGCGGCCCTGGTTACTCTGGAGGAAGCAGAG GCTATGGAAGTGGTGGACAGGGTTATGGAAACCA GGGCAGTGGCTATGGCGGGAGTGGCAGCTATGAC AGCTATAACAACGGAGGCGGAGGCGGCTTTGGCG GTGGTAGTGGAAGCAATTTTGGA | 13 | LLVALKKTL KNIT* |
| 2034 | NM_031157.2_431 | 431 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTGTTGGTGGCATTAAAGAAGACA CTGAAGAACATCACCTAAGAGATTATTTTGAACAGT ATGGAAAAATTGAAGTGATTGAAATCATGACTGAC CGAGGCAGTGGCAAGAAAAGGGGCTTTGCCTTTG TAACCTTTGACGACCATGACTCCGTGGATAAGATT GTCATTCAGAAATACCATACTGTGAATGGCCACAA CTGTGAAGTTAGAAAAGCCCTGTCAAAGCAAGAGA TGGCTAGTGCTTCATCCAGCCAAAGAGGTCGAAGT GGTTCTGGAAACTTTGGTGGTGGTCGTGGAGGTG GTTTCGGTGGGAATGACAACTTCGGTCGTGGAGG AAACTTCAGTGGTCGTGGTGGCTTTGGTGGCAGC CGTGGTGGTGGTGGATATGGTGGCAGTGGGGATG GCTATAATGGATTTGGTAATGATGGTGGTTATGGA GGAGGCGGCCCTGGTTACTCTGGAGGAAGCAGAG GCTATGGAAGTGGTGGACAGGGTTATGGAAACCA GGGCAGTGGCTATGGCGGGAGTGGCAGCTATGAC AGCTATAACAACGGAGGCGGAGGCGGCTTTGGCG GTGGTAGTGGAAGCAATTTTGGA | 11 | VALKKTLK NIT* |
| 2035 | NM_031157.2_479 | 479 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTGTTGGTGGCATTAAAGAAGAC ACTGAAGAACATCACCTAAGAGATTATTTGAACAG TATGGAAAAATTGAAGTGATTGAAATCATGACTGA CCGAGGCAGTGGCAAGAAAAGGGGCTTTGCCTTT GTAACCTTTGACGACCATGACTCCGTGGATAAGAT | 8 | LNSMEKLK* |

TABLE 3A-continued

| SEQ ID | identifier_position | position | modified_RNA | PAP length | PAP |
|---|---|---|---|---|---|
| | | | TGTCATTCAGAAATACCATACTGTGAATGGCCACA ACTGTGAAGTTAGAAAAGCCCTGTCAAAGCAAGAG ATGGCTAGTGCTTCATCCAGCCAAAGAGGTCGAA GTGGTTCTGGAAACTTTGGTGGTGGTCGTGGAGG TGGTTTCGGTGGGAATGACAACTTCGGTCGTGGA GGAAACTTCAGTGGTCGTGGTGGCTTTGGTGGCA GCCGTGGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | | |
| 2036 | NM_0311 57.2_533 | 533 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTTGTTGGTGGCATTAAAGAAGAC ACTGAAGAACATCACCTAAGAGATTATTTTGAACA GTATGGAAAAATTGAAGTGATTGAAATCATGACTG ACCGAGGCAGTGGAAGAAAAGGGGCTTTGCCTTT GTAACCTTTGACGACCATGACTCCGTGGATAAGAT TGTCATTCAGAAATACCATACTGTGAATGGCCACA ACTGTGAAGTTAGAAAAGCCCTGTCAAAGCAAGAG ATGGCTAGTGCTTCATCCAGCCAAAGAGGTCGAA GTGGTTCTGGAAACTTTGGTGGTGGTCGTGGAGG TGGTTTCGGTGGGAATGACAACTTCGGTCGTGGA GGAAACTTCAGTGGTCGTGGTGGCTTTGGTGGCA GCCGTGGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | 7 | RKGALPL* |
| 2037 | NM_0311 57.2_548 | 548 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTTGTTGGTGGCATTAAAGAAGAC ACTGAAGAACATCACCTAAGAGATTATTTTGAACA GTATGGAAAAATTGAAGTGATTGAAATCATGACTG ACCGAGGCAGTGGAAGAAAAGGGGCTTGCCTTT GTAACCTTTGACGACCATGACTCCGTGGATAAGAT TGTCATTCAGAAATACCATACTGTGAATGGCCACA ACTGTGAAGTTAGAAAAGCCCTGTCAAAGCAAGAG ATGGCTAGTGCTTCATCCAGCCAAAGAGGTCGAA GTGGTTCTGGAAACTTTGGTGGTGGTCGTGGAGG TGGTTTCGGTGGGAATGACAACTTCGGTCGTGGA GGAAACTTCAGTGGTCGTGGTGGCTTTGGTGGCA GCCGTGGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | 3 | LPL* |
| 2038 | NM_0311 57.2_570 | 570 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC | 14 | MTPWIRLS FRNTIL* |

TABLE 3A-continued

| SEQ ID | identifier_ position | position | modified_RNA | PAP length | PAP |
|---|---|---|---|---|---|
| | | | AGCTGAGGAAGCTCTTCATTGGAGGGTTGAGCTTT<br>GAAACAACTGATGAGAGCCTGAGGAGCCATTTTGA<br>GCAATGGGGAACGCTCACGGACTGTGTGGTAATG<br>AGAGATCCAAACACCAAGCGCTCCAGGGGCTTTG<br>GGTTTGTCACATATGCCACTGTGGAGGAGGTGGAT<br>GCAGCTATGAATGCAAGGCCACACAAGGTGGATG<br>GAAGAGTTGTGGAACCAAAGAGAGCTGTCTCCAG<br>AGAAGATTCTCAAAGACCAGGTGCCCACTTAACTG<br>TGAAAAAGATATTTGTTGGTGGCATTAAAGAAGAC<br>ACTGAAGAACATCACCTAAGAGATTATTTTGAACA<br>GTATGGAAAAATTGAAGTGATTGAAATCATGACTG<br>ACCGAGGCAGTGGCAAGAAAAGGGGCTTTGCCTT<br>TGTAACCTTTGACGACATGACTCCGTGGATAAGAT<br>TGTCATTCAGAAATACCATACTGTGAATGGCCACA<br>ACTGTGAAGTTAGAAAAGCCCTGTCAAAGCAAGAG<br>ATGGCTAGTGCTTCATCCAGCCAAAGAGGTCGAA<br>GTGGTTCTGGAAACTTTGGTGGTGGTCGTGGAGG<br>TGGTTTCGGTGGGAATGACAACTTCGGTCGTGGA<br>GGAAACTTCAGTGGTCGTGGTGGCTTTGGTGGCA<br>GCCGTGGTGGTGGTGGATATGGTGGCAGTGGGGA<br>TGGCTATAATGGATTTGGTAATGATGGTGGTTATG<br>GAGGAGGCGGCCCTGGTTACTCTGGAGGAAGCAG<br>AGGCTATGGAAGTGGTGGACAGGGTTATGGAAAC<br>CAGGGCAGTGGCTATGGCGGGAGTGGCAGCTATG<br>ACAGCTATAACAACGGAGGCGGAGGCGGCTTTGG<br>CGGTGGTAGTGGAAGCAATTTTGGA | | |
| 2039 | NM_0311<br>57.2_586 | 586 | GAGAGGGCGAAGGTAGGCTGGCAGATACGTTCGT<br>CAGCTTGCTCCTTTCTGCCCGTGGACGCCGCCGA<br>AGAAGCATCGTTAAAGTCTCTCTTCACCCTGCCGT<br>CATGTCTAAGTCAGAGTCTCCTAAAGAGCCCGAAC<br>AGCTGAGGAAGCTCTTCATTGGAGGGTTGAGCTTT<br>GAAACAACTGATGAGAGCCTGAGGAGCCATTTTGA<br>GCAATGGGGAACGCTCACGGACTGTGTGGTAATG<br>AGAGATCCAAACACCAAGCGCTCCAGGGGCTTTG<br>GGTTTGTCACATATGCCACTGTGGAGGAGGTGGAT<br>GCAGCTATGAATGCAAGGCCACACAAGGTGGATG<br>GAAGAGTTGTGGAACCAAAGAGAGCTGTCTCCAG<br>AGAAGATTCTCAAAGACCAGGTGCCCACTTAACTG<br>TGAAAAAGATATTTGTTGGTGGCATTAAAGAAGAC<br>ACTGAAGAACATCACCTAAGAGATTATTTTGAACA<br>GTATGGAAAAATTGAAGTGATTGAAATCATGACTG<br>ACCGAGGCAGTGGCAAGAAAAGGGGCTTTGCCTT<br>TGTAACCTTTGACGACCATGACTCCGTGGATAGAT<br>TGTCATTCAGAAATACCATACTGTGAATGGCCACA<br>ACTGTGAAGTTAGAAAAGCCCTGTCAAAGCAAGAG<br>ATGGCTAGTGCTTCATCCAGCCAAAGAGGTCGAA<br>GTGGTTCTGGAAACTTTGGTGGTGGTCGTGGAGG<br>TGGTTTCGGTGGGAATGACAACTTCGGTCGTGGA<br>GGAAACTTCAGTGGTCGTGGTGGCTTTGGTGGCA<br>GCCGTGGTGGTGGTGGATATGGTGGCAGTGGGGA<br>TGGCTATAATGGATTTGGTAATGATGGTGGTTATG<br>GAGGAGGCGGCCCTGGTTACTCTGGAGGAAGCAG<br>AGGCTATGGAAGTGGTGGACAGGGTTATGGAAAC<br>CAGGGCAGTGGCTATGGCGGGAGTGGCAGCTATG<br>ACAGCTATAACAACGGAGGCGGAGGCGGCTTTGG<br>CGGTGGTAGTGGAAGCAATTTTGGA | 9 | RLSFRNTIL* |
| 2040 | NM_0311<br>57.2_590 | 590 | GAGAGGGCGAAGGTAGGCTGGCAGATACGTTCGT<br>CAGCTTGCTCCTTTCTGCCCGTGGACGCCGCCGA<br>AGAAGCATCGTTAAAGTCTCTCTTCACCCTGCCGT<br>CATGTCTAAGTCAGAGTCTCCTAAAGAGCCCGAAC<br>AGCTGAGGAAGCTCTTCATTGGAGGGTTGAGCTTT<br>GAAACAACTGATGAGAGCCTGAGGAGCCATTTTGA<br>GCAATGGGGAACGCTCACGGACTGTGTGGTAATG<br>AGAGATCCAAACACCAAGCGCTCCAGGGGCTTTG<br>GGTTTGTCACATATGCCACTGTGGAGGAGGTGGAT<br>GCAGCTATGAATGCAAGGCCACACAAGGTGGATG<br>GAAGAGTTGTGGAACCAAAGAGAGCTGTCTCCAG<br>AGAAGATTCTCAAAGACCAGGTGCCCACTTAACTG<br>TGAAAAAGATATTTGTTGGTGGCATTAAAGAAGAC<br>ACTGAAGAACATCACCTAAGAGATTATTTTGAACA<br>GTATGGAAAAATTGAAGTGATTGAAATCATGACTG<br>ACCGAGGCAGTGGCAAGAAAAGGGGCTTTGCCTT<br>TGTAACCTTTGACGACCATGACTCCGTGGATAAGA<br>TGTCATTCAGAAATACCATACTGTGAATGGCCACA<br>ACTGTGAAGTTAGAAAAGCCCTGTCAAAGCAAGAG<br>ATGGCTAGTGCTTCATCCAGCCAAAGAGGTCGAA<br>GTGGTTCTGGAAACTTTGGTGGTGGTCGTGGAGG | 8 | MSFRNTIL* |

TABLE 3A-continued

| SEQ ID | identifier_position | position | modified_RNA | PAP length | PAP |
|---|---|---|---|---|---|
| | | | TGGTTTCGGTGGGAATGACAACTTCGGTCGTGGA GGAAACTTCAGTGGTCGTGGTGGCTTTGGTGGCA GCCGTGGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | | |
| 2041 | NM_0311 57.2_621 | 621 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTTGTTGGTGGCATTAAAGAAGAC ACTGAAGAACATCACCTAAGAGATTATTTTGAACA GTATGGAAAAATTGAAGTGATTGAAATCATGACTG ACCGAGGCAGTGGCAAGAAAAGGGGCTTTGCCTT TGTAACCTTTGACGACCATGACTCCGTGGATAAGA TTGTCATTCAGAAATACCATACTGTGAATGGCACA ACTGTGAAGTTAGAAAAGCCCTGTCAAAGCAAGAG ATGGCTAGTGCTTCATCCAGCCAAAGAGGTCGAA GTGGTTCTGGAAACTTTGGTGGTGGTCGTGGAGG TGGTTTCGGTGGGAATGACAACTTCGGTCGTGGA GGAAACTTCAGTGGTCGTGGTGGCTTTGGTGGCA GCCGTGGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | 155 | TTVKLEKP CQSKRWL VLHPAKEV EVVLETLV VVVEVVSV GMTTSVVE ETSVVVVA LVAAVVVV DMVAVGM AIMDLVMM VVMEEAAL VTLEEAEA MEVVDRV METRAVA MAGVAAM TAITTEAEA ALAVVVEAI LEVVEATM ILGITTISLQ ILDP* |
| 2042 | NM_0311 57.2_652 | 652 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG GGTTTGTCACATATGCCACTGTGGAGGAGGTGGAT GCAGCTATGAATGCAAGGCCACACAAGGTGGATG GAAGAGTTGTGGAACCAAAGAGAGCTGTCTCCAG AGAAGATTCTCAAAGACCAGGTGCCCACTTAACTG TGAAAAAGATATTTGTTGGTGGCATTAAAGAAGAC ACTGAAGAACATCACCTAAGAGATTATTTTGAACA GTATGGAAAAATTGAAGTGATTGAAATCATGACTG ACCGAGGCAGTGGCAAGAAAAGGGGCTTTGCCTT TGTAACCTTTGACGACCATGACTCCGTGGATAAGA TTGTCATTCAGAAATACCATACTGTGAATGGCAC AACTGTGAAGTTAGAAAAGCCCTGTCAAGCAAGAG ATGGCTAGTGCTTCATCCAGCCAAAGAGGTCGAA GTGGTTCTGGAAACTTTGGTGGTGGTCGTGGAGG TGGTTTCGGTGGGAATGACAACTTCGGTCGTGGA GGAAACTTCAGTGGTCGTGGTGGCTTTGGTGGCA GCCGTGGTGGTGGATATGGTGGCAGTGGGGA TGGCTATAATGGATTTGGTAATGATGGTGGTTATG GAGGAGGCGGCCCTGGTTACTCTGGAGGAAGCAG AGGCTATGGAAGTGGTGGACAGGGTTATGGAAAC CAGGGCAGTGGCTATGGCGGGAGTGGCAGCTATG ACAGCTATAACAACGGAGGCGGAGGCGGCTTTGG CGGTGGTAGTGGAAGCAATTTTGGA | 145 | SKRWLVLH PAKEVEVV LETLVVVV EVVSVGMT TSVVEETS VVVVALVA AVVVVDMV AVGMAIMD LVMMVVM EEAALVTL EEAEAMEV VDRVMET RAVAMAG VAAMTAIT TEAEAALA VVVEAILEV VEATMILGI TTISLQILD P* |
| 2043 | NM_0311 57.2_664 | 664 | GAGAGGGCGAAGGTAGGCTGGCAGATACGTTCGT CAGCTTGCTCCTTTCTGCCCGTGGACGCCGCCGA AGAAGCATCGTTAAAGTCTCTCTTCACCCTGCCGT CATGTCTAAGTCAGAGTCTCCTAAAGAGCCCGAAC AGCTGAGGAAGCTCTTCATTGGAGGGTTGAGCTTT GAAACAACTGATGAGAGCCTGAGGAGCCATTTTGA GCAATGGGGAACGCTCACGGACTGTGTGGTAATG AGAGATCCAAACACCAAGCGCTCCAGGGGCTTTG | 141 | VVLHPAKE VEVVLETL VVVEVVS VGMTTSVV EETSWVV ALVAAVVV VDMVAVG MAIMDLVM |

TABLE 3A-continued

| SEQ ID | identifier_position | position | modified_RNA | PAP length | PAP |
|---|---|---|---|---|---|
| | | | GGTTTGTCACATATGCCACTGTGGAGGAGGTGGAT | | MVVMEEA |
| | | | GCAGCTATGAATGCAAGGCCACACAAGGTGGATG | | ALVTLEEA |
| | | | GAAGAGTTGTGGAACCAAAGAGAGCTGTCTCCAG | | EAMEVVD |
| | | | AGAAGATTCTCAAAGACCAGGTGCCCACTTAACTG | | RVMETRAV |
| | | | TGAAAAAGATATTTGTTGGTGGCATTAAAGAAGAC | | AMAGVAA |
| | | | ACTGAAGAACATCACCTAAGAGATTATTTTGAACA | | MTAITTEA |
| | | | GTATGGAAAAATTGAAGTGATTGAAATCATGACTG | | EAALAVVV |
| | | | ACCGAGGCAGTGGCAAGAAAAGGGGCTTTGCCTT | | EAILEVVEA |
| | | | TGTAACCTTTGACGACCATGACTCCGTGGATAAGA | | TMILGITTIS |
| | | | TTGTCATTCAGAAATACCATACTGTGAATGGCCAC | | LQILDP* |
| | | | AACTGTGAAGTTAGAAAAGCCCTGTCAAAGCAAGA | | |
| | | | GATGGTAGTGCTTCATCCAGCCAAAGAGGTCGAA | | |
| | | | GTGGTTCTGGAAACTTTGGTGGTGGTCGTGGAGG | | |
| | | | TGGTTTCGGTGGGAATGACAACTTCGGTCGTGGA | | |
| | | | GGAAACTTCAGTGGTCGTGGTGGCTTTGGTGGCA | | |
| | | | GCCGTGGTGGTGGTGGATATGGTGGCAGTGGGGA | | |
| | | | TGGCTATAATGGATTTGGTAATGATGGTGGTTATG | | |
| | | | GAGGAGGCGGCCCTGGTTACTCTGGAGGAAGCAG | | |
| | | | AGGCTATGGAAGTGGTGGACAGGGTTATGGAAAC | | |
| | | | CAGGGCAGTGGCTATGGCGGGAGTGGCAGCTATG | | |
| | | | ACAGCTATAACAACGGAGGCGGAGGCGGCTTTGG | | |
| | | | CGGTGGTAGTGGAAGCAATTTTGGA | | |
| 2044 | NM_031157.2_681 | 681 | GAGAGGGCGAAGGTAGGCTGGCAGATACGTTCGT | 135 | KEVEVVLE |
| | | | CAGCTTGCTCCTTTCTGCCCGTGGACGCCGCCGA | | TLVWVEV |
| | | | AGAAGCATCGTTAAAGTCTCTCTTCACCCTGCCGT | | VSVGMTTS |
| | | | CATGTCTAAGTCAGAGTCTCCTAAAGAGCCCGAAC | | VVEETSVV |
| | | | AGCTGAGGAAGCTCTTCATTGGAGGGTTGAGCTTT | | VVALVAAV |
| | | | GAAACAACTGATGAGAGCCTGAGGAGCCATTTTGA | | VVVDMVAV |
| | | | GCAATGGGGAACGCTCACGGACTGTGTGGTAATG | | GMAIMDLV |
| | | | AGAGATCCAAACACCAAGCGCTCCAGGGGCTTTG | | MMVVMEE |
| | | | GGTTTGTCACATATGCCACTGTGGAGGAGGTGGAT | | AALVTLEE |
| | | | GCAGCTATGAATGCAAGGCCACACAAGGTGGATG | | AEAMEVVD |
| | | | GAAGAGTTGTGGAACCAAAGAGAGCTGTCTCCAG | | RVMETRAV |
| | | | AGAAGATTCTCAAAGACCAGGTGCCCACTTAACTG | | AMAGVAA |
| | | | TGAAAAAGATATTTGTTGGTGGCATTAAAGAAGAC | | MTAITTEA |
| | | | ACTGAAGAACATCACCTAAGAGATTATTTTGAACA | | EAALAVVV |
| | | | GTATGGAAAAATTGAAGTGATTGAAATCATGACTG | | EAILEVVEA |
| | | | ACCGAGGCAGTGGCAAGAAAAGGGGCTTTGCCTT | | TMILGITTIS |
| | | | TGTAACCTTTGACGACCATGACTCCGTGGATAAGA | | LQILDP* |
| | | | TTGTCATTCAGAAATACCATACTGTGAATGGCCAC | | |
| | | | AACTGTGAAGTTAGAAAAGCCCTGTCAAAGCAAGA | | |
| | | | GATGGCTAGTGCTTCATCCAGCAAAGAGGTCGAA | | |
| | | | GTGGTTCTGGAAACTTTGGTGGTGGTCGTGGAGG | | |
| | | | TGGTTTCGGTGGGAATGACAACTTCGGTCGTGGA | | |
| | | | GGAAACTTCAGTGGTCGTGGTGGCTTTGGTGGCA | | |
| | | | GCCGTGGTGGTGGTGGATATGGTGGCAGTGGGGA | | |
| | | | TGGCTATAATGGATTTGGTAATGATGGTGGTTATG | | |
| | | | GAGGAGGCGGCCCTGGTTACTCTGGAGGAAGCAG | | |
| | | | AGGCTATGGAAGTGGTGGACAGGGTTATGGAAAC | | |
| | | | CAGGGCAGTGGCTATGGCGGGAGTGGCAGCTATG | | |
| | | | ACAGCTATAACAACGGAGGCGGAGGCGGCTTTGG | | |
| | | | CGGTGGTAGTGGAAGCAATTTTGGA | | |
| 2045 | NM_031157.2_684 | 684 | GAGAGGGCGAAGGTAGGCTGGCAGATACGTTCGT | 134 | EVEVVLET |
| | | | CAGCTTGCTCCTTTCTGCCCGTGGACGCCGCCGA | | LVVVVEVV |
| | | | AGAAGCATCGTTAAAGTCTCTCTTCACCCTGCCGT | | SVGMTTSV |
| | | | CATGTCTAAGTCAGAGTCTCCTAAAGAGCCCGAAC | | VEETSVVV |
| | | | AGCTGAGGAAGCTCTTCATTGGAGGGTTGAGCTTT | | VALVAAVV |
| | | | GAAACAACTGATGAGAGCCTGAGGAGCCATTTTGA | | VVDMVAV |
| | | | GCAATGGGGAACGCTCACGGACTGTGTGGTAATG | | MMWMEE |
| | | | AGAGATCCAAACACCAAGCGCTCCAGGGGCTTTG | | GMAIMDLV |
| | | | GGTTTGTCACATATGCCACTGTGGAGGAGGTGGAT | | AALVTLEE |
| | | | GCAGCTATGAATGCAAGGCCACACAAGGTGGATG | | AEAMEVVD |
| | | | GAAGAGTTGTGGAACCAAAGAGAGCTGTCTCCAG | | RVMETRAV |
| | | | AGAAGATTCTCAAAGACCAGGTGCCCACTTAACTG | | AMAGVAA |
| | | | TGAAAAAGATATTTGTTGGTGGCATTAAAGAAGAC | | MTAITTEA |
| | | | ACTGAAGAACATCACCTAAGAGATTATTTTGAACA | | EAALAVVV |
| | | | GTATGGAAAAATTGAAGTGATTGAAATCATGACTG | | EAILEVVEA |
| | | | ACCGAGGCAGTGGCAAGAAAAGGGGCTTTGCCTT | | TMILGITTIS |
| | | | TGTAACCTTTGACGACCATGACTCCGTGGATAAGA | | LQILDP* |
| | | | TTGTCATTCAGAAATACCATACTGTGAATGGCCAC | | |
| | | | AACTGTGAAGTTAGAAAAGCCCTGTCAAAGCAAGA | | |
| | | | GATGGCTAGTGCTTCATCCAGCCAAAGAGGTCGAA | | |
| | | | GTGGTTCTGGAAACTTTGGTGGTGGTCGTGGAGG | | |
| | | | TGGTTTCGGTGGGAATGACAACTTCGGTCGTGGA | | |
| | | | GGAAACTTCAGTGGTCGTGGTGGCTTTGGTGGCA | | |
| | | | GCCGTGGTGGTGGTGGATATGGTGGCAGTGGGGA | | |
| | | | TGGCTATAATGGATTTGGTAATGATGGTGGTTATG | | |

TABLE 3A-continued

| SEQ ID | identifier_position | position | modified_RNA | PAP length | PAP |
|---|---|---|---|---|---|
| | | | GAGGAGGCGGCCCTGGTTACTCTGGAGGAAGCAGAGGCTATGGAAGTGGTGGACAGGGTTATGGAAACCAGGGCAGTGGCTATGGCGGGAGTGGCAGCTATGACAGCTATAACAACGGAGGCGGAGGCGGCTTTGGCGGTGGTAGTGGAAGCAATTTTGGA | | |
| 2046 | NM_031157.2_699 | 699 | GAGAGGGCGAAGGTAGGCTGGCAGATACGTTCGTCAGCTTGCTCCTTTCTGCCCGTGGACGCCGCCGAAGAAGCATCGTTAAAGTCTCTCTTCACCCTGCCGTCATGTCTAAGTCAGAGTCTCCTAAAGAGCCCGAACAGCTGAGGAAGCTCTTCATTGGAGGGTTGAGCTTTGAAACAACTGATGAGAGCCTGAGGAGCCATTTTGAGCAATGGGGAACGCTCACGGACTGTGTGGTAATGAGAGATCCAAACACCAAGCGCTCCAGGGGCTTTGGGTTTGTCACATATGCCACTGTGGAGGAGGTGGATGCAGCTATGAATGCAAGGCCACACAAGGTGGATGGAAGAGTTGTGGAACCAAAGAGAGCTGTCTCCAGAGAAGATTCTCAAAGACCAGGTGCCCACTTAACTGTGAAAAAGATATTTGTTGGTGGCATTAAAGAAGACACTGAAGAACATCACCTAAGAGATTATTTTGAACAGTATGGAAAAATTGAAGTGATTGAAATCATGACTGACCGAGGCAGTGGCAAGAAAAGGGGCTTTGCCTTTGTAACCTTTGACGACCATGACTCCGTGGATAAGATTGTCATTCAGAAATACCATACTGTGAATGGCCACAACTGTGAAGTTAGAAAAGCCCTGTCAAAGCAAGAGATGGCTAGTGCTTCATCCAGCCAAAGAGGTCGAAGTGGTCTGGAAACTTTGGTGGTGGTCGTGGAGGTGGTTTCGGTGGGAATGACAACTTCGGTCGTGGAGGAAACTTCAGTGGTCGTGGTGGCTTTGGTGGCAGCCGTGGTGGTGGTGGATATGGTGGCAGTGGGGATGGCTATAATGGATTTGGTAATGATGGTGGTTATGGAGGAGGCGGCCCTGGTTACTCTGGAGGAAGCAGAGGCTATGGAAGTGGTGGACAGGGTTATGGAAACCAGGGCAGTGGCTATGGCGGGAGTGGCAGCTATGACAGCTATAACAACGGAGGCGGAGGCGGCTTTGGCGGTGGTAGTGGAAGCAATTTTGGA | 129 | LETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP* |
| 2047 | NM_031157.2_710 | 710 | GAGAGGGCGAAGGTAGGCTGGCAGATACGTTCGTCAGCTTGCTCCTTTCTGCCCGTGGACGCCGCCGAAGAAGCATCGTTAAAGTCTCTCTTCACCCTGCCGTCATGTCTAAGTCAGAGTCTCCTAAAGAGCCCGAACAGCTGAGGAAGCTCTTCATTGGAGGGTTGAGCTTTGAAACAACTGATGAGAGCCTGAGGAGCCATTTTGAGCAATGGGGAACGCTCACGGACTGTGTGGTAATGAGAGATCCAAACACCAAGCGCTCCAGGGGCTTTGGGTTTGTCACATATGCCACTGTGGAGGAGGTGGATGCAGCTATGAATGCAAGGCCACACAAGGTGGATGGAAGAGTTGTGGAACCAAAGAGAGCTGTCTCCAGAGAAGATTCTCAAAGACCAGGTGCCCACTTAACTGTGAAAAAGATATTTGTTGGTGGCATTAAAGAAGACACTGAAGAACATCACCTAAGAGATTATTTTGAACAGTATGGAAAAATTGAAGTGATTGAAATCATGACTGACCGAGGCAGTGGCAAGAAAAGGGGCTTTGCCTTTGTAACCTTTGACGACCATGACTCCGTGGATAAGATTGTCATTCAGAAATACCATACTGTGAATGGCCACAACTGTGAAGTTAGAAAAGCCCTGTCAAAGCAAGAGATGGCTAGTGCTTCATCCAGCCAAAGAGGTCGAAGTGGTCTGGAAACTTTGGTGGTGGTCGTGGAGGTGGTTTCGGTGGGAATGACAACTTCGGTCGTGGAGGAAACTTCAGTGGTCGTGGTGGCTTTGGTGGCAGCCGTGGTGGTGGTGGATATGGTGGCAGTGGGGATGGCTATAATGGATTTGGTAATGATGGTGGTTATGGAGGAGGCGGCCCTGGTTACTCTGGAGGAAGCAGAGGCTATGGAAGTGGTGGACAGGGTTATGGAAACCAGGGCAGTGGCTATGGCGGGAGTGGCAGCTATGACAGCTATAACAACGGAGGCGGAGGCGGCTTTGGCGGTGGTAGTGGAAGCAATTTTGGA | 126 | LVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP* |
| 2048 | NM_031209.1_88 | 88 | GTCAAGATGGCGGGAGCAGCTACCCAGGCTTCCCTGGAGTCGGCCCCACGGATCATGCGGCTGGTGGCCGAATGCAGCCGCTCCAGGCCCGGCAGGCGAGCTGTGGCTGCCGCATGGGACAGTGGCCACTCCTGTGTTCATGCCAGTGGGCACGCAGGCCACCATGAAGGGCATCACGACCGAACAGCTGGACGCTCTGGGTTGCCGCATCTGCCTGGGCAATACCTACCATCTGGGTCTAAGGCCGGGACCCGAGCTGATCCAGAAAGCCAACGGTCTCCACGGCTTCATGAATTGGCCTCATAATCTGCTAACGGACAGCGGCGGTTTCCAGATGGTGTCGCTGGTGTCTCTGTCCGAGGTGACGGAGGAGGGCGTCCGCTTCCGCTCCCCCTACGACGGCAATG | 26 | PGQASCGCRMGQWPLLCSCQWARRPP* |

TABLE 3A-continued

| SEQ ID | identifier_position | position | modified_RNA | PAP length | PAP |
|---|---|---|---|---|---|
| | | | AGACCCTGCTGAGCCCGGAGAAATCCGTGCAGAT CCAGAATGCGCTGGGCTCGGACATCATCATGCAG CTGGACGACGTGGTTAGCAGTACTGTGACTGGGC CACGTGTGGAGGAGGCCATGTACAGGTCAATCCG CTGGCTGGACCGGTGCATTGCAGCCCATCAGCGG CCGGACAAGCAGAACCTCTTCGCCATTATCCAGG GTGGGCTGGACGCAGATCTCCGGGCCACCTGCCT TGAAGAGATGACCAAGCGAGACGTGCCTGGCTTC GCCATCGGGGGCCTGAGCGGGGGTGAGAGCAAG TCGCAGTTCTGGCGGATGGTGGCGCTGAGCACCT CTCGGCTGCCAAGGACAAGCCCCGATATCTGAT GGGGGTTGGCTATGCCACTGATCTGGTAGTCTGC GTGGCTCTTGGATGTGACATGTTCGACTGCGTCTT CCCCACACGGACAGCGCGCTTTGGCTCTGCCCTG GTGCCCACTGGGAACCTGCAGTTGAGGAAGAAGG TGTTTGAGAAGGACTTCGGCCCCATAGACCCGGA GTGCACCTGCCCCACGTGCCAAAAGCACAGCCGC GCCTTCCTGCACGCACTGCTGCACAGTGACAACA CGGC | | |
| 2049 | NM_031314.2_400 | 400 | AGGAATGGGGCGGGGACTAGGCCTTCGCCTCGG CGGCAGAGGAGACTCGGGGGCCATTTTGTGAAGA GACGAAGACTGAGCGGTTGTGGCCGCGTTGCCGA CCTCCAGCAGCAGTCGGCTTCTCTACGCAGAACC CGGGAGTAGGAGACTCAGAATCGAATCTCTTCTCC CTCCCCTTCTTGTGAGATTTTTTTGATCTTCAGCTA CATTTTCGGCTTTGTGAGAAACCTTACCATCAAACA CGATGGCCAGCAACGTTACCAACAAGACAGATCCT CGCTCCATGAACTCCCGTGTATTCATTGGGAATCT CAACACTCTTGTGGTCAAGAAATCTGATGTGGAGG CAATCTTTTCGAAGTATGGCAAAATTGTGGGCTGC TCTGTTCATAAGGGCTTGCCTTCGTTCAGTATGTTA ATGAGAGAAATGCCCGGGCTGCTGTAGCAGGAGA GGATGGCAGAATGATTGCTGGCCAGGTTTTAGATA TTAACCTGGCTGCAGAGCCAAAAGTGAACCGAGG AAAAGCAGGTGTGAAACGATCTGCAGCGGAGATG TACGGGTCAGTAACAGAACACCCTTCTCCGTCCCC TCTACTCAGCTCCTCTTTTGACTTGGACTATGACTT TCAACGGGACTATTATGATAGGATGTACAGTTACC CAGCACGTGTACCTCCTCCTCCTCCTATTGCTCGG GCTGTAGTGCCCTCGAAACGTCAGCGTGTATCAG GAAACACTTCACGAAGGGGCAAAAGTGGCTTCAAT TCTAAGAGTGGACAGCGGGGATCTTCCAAGTCTG GAAAGTTGAAAGGAGATGACCTTCAGGCCATTAAG AAGGAGCTGACCCAGATAAAACAAAAAGTGGATTC TCTCCTGGAAAACCTGGAAAAAATTGAAAAGGAAC AGAGCAAACAAGCAGTAGAGATGAAGAATGATAAG TCAGAAGAGGAGCAGAGCAGCAGCTCCGTGAAGA AAGATGAGACTAATGTGAAGATGGAGTCTGAGGG GGGTGCAGATGACTCTG | 15 | LPSFSMLM REMPGLL* |
| 2050 | NM_031966.2_539 | 539 | ACGAACAGGCCAATAAGGAGGGAGCAGTGCGGG GTTTAAATCTGAGGCTAGGCTGGCTCTTCTCGGCG TGCTGCGGCGGAACGGCTGTTGGTTTCTGCTGGG TGTAGGTCCTTGGCTGGTCGGGCCTCCGGTGTTC TGCTTCTCCCCGCTGAGCTGCTGCCTGGTGAAGA GGAAGCCATGGCGCTCCGAGTCACCAGGAACTCG AAAATTAATGCTGAAAATAAGGCGAAGATCAACAT GGCAGGCGCAAAGCGCGTTCCTACGGCCCCTGCT GCAACCTCCAAGCCCGGACTGAGGCCAAGAACAG CTCTTGGGGACATTGGTAACAAAGTCAGTGAACAA CTGCAGGCCAAAATGCCTATGAAGAAGGAAGCAA AACCTTCAGCTACTGGAAAAGTCATTGATAAAAAA CTACCAAAACCTCTTGAAAAGGTACCTATGCTGGT GCCAGTGCCAGTGTCTGAGCCAGTGCCAGAGCCA GAACCTGAGCCAGAACCTGAGCCTGTTAAAGAAG AAAAACTTTCGCCTGAGCCTATTTGGTTGATACTG CCTCTCCAAGCCCAATGGAAACATCTGGATGTGCC CCTGCAGAAGAAGACCTGTGTCAGGCTTTCTCTGA TGTAATTCTTGCAGTAAATGATGTGGATGCAGAAG ATGGAGCTGATCCAAACCTTTGTAGTGAATATGTG AAAGATATTTATGCTTATCTGAGACAACTTGAGGAA GAGCAAGCAGTCAGACCAAAATACCTACTGGGTC GGGAAGTCACTGGAAACATGAGAGCCATCCTAATT GACTGGCTAGTACAGGTTCAAATGAAATTCAGGTT GTTGCAGGAGACCATGTACATGACTGTCTCCATTA TTGATCGGTTCATGCAGAATAATTGTGTGCCCAAG AAGATGCTGCAGCTGGTTGGTGTCACTGCCATGTT TATTGCAAGCAAATATGAAGAAATGTACCCCTCCAG | 28 | WLILPLQA QWKHLDV PLQKKTCV RLSLM* |

TABLE 3A-continued

| SEQ ID | identifier_position | position | modified_RNA | PAP length | PAP |
|---|---|---|---|---|---|
| 2051 | NM_031990.2_117 | 117 | AAATTGGTGACTTTGCTTTTGTGACTGACAACACTT<br>ATACTAAGCACCAAATCAG<br>TTGTGAGTCTATAACTCGGAGCCGTTGGGTCGGTT<br>CCTGCTATTCCGGCGCCTCCACTCCGTCCCCGC<br>GGGTCTGCTCTGTGTGCCATGGACGGCATTGTCC<br>CAGATATAGCCGTGGTACAAAGCGGGGATCTGAC<br>GAGCTTTTCTCTACTTGTGTCACTAACGGACCGTTT<br>ATCATGAGCAGCAACTCGGCTTCTGCAGCAAACG<br>GAAATGACAGCAAGAAGTTCAAAGGTGACAGCCG<br>AAGTGCAGGCGTCCCCTCTAGAGTGATCCACATC<br>CGGAAGCTCCCCATCGACGTCACGGAGGGGGAA<br>GTCATCTCCCTGGGGCTGCCCTTTGGGAAGGTCA<br>CCAACCTCCTGATGCTGAAGGGGAAAAACCAGGC<br>CTTCATCGAGATGAACACGGAGGAGGCTGCCAAC<br>ACCATGGTGAACTACTACACCTCGGTGACCCCTGT<br>GCTGCGCGGCCAGCCCATCTACATCCAGTTCTCC<br>AACCACAAGGAGCTGAAGACCGACAGCTCTCCCA<br>ACCAGGCGCGGGCCCAGGCGGCCCTGCAGGCGG<br>TGAACTCGGTCCAGTCGGGGAACCTGGCCTTGGC<br>TGCCTCGGCGGCGGCCGTGGACGCAGGGATGGC<br>GATGGCCGGGCAGAGCCCCGTGCTCAGGATCATC<br>GTGGAGAACCTCTTCTACCCTGTGACCCTGGATGT<br>GCTGCACCAGATTTTCTCCAAGTTCGGCACAGTGT<br>TGAAGATCATCACCTTCACCAAGAACAACCAGTTC<br>CAGGCCCTGCTGCAGTATGCGGACCCCGTGAGCG<br>CCCAGCACGCCAAGCTGTCGCTGGACGGGCAGAA<br>CATCTACAACGCCTGCTGCACGCTGCGCATCGACT<br>TTTCCAAGCTCACCAGCCTCAACGTCAAGTACAAC<br>AATGACAAGAGCCGTGACTACACACGCCCAGACC<br>TGCCTTCCGGGGACAGCCAGCCCTCGCTGGACCA<br>GACCATGGCCGCGGCCTTCGCCTCTCCGTATGCA<br>GGAGCTGGTTTCCCTCCCACCTTTGCCATTCC | 20 | VQSGDLTS<br>FSLLVSLT<br>DRLS* |
| 2052 | NM_031990.2_597 | 597 | TTGTGAGTCTATAACTCGGAGCCGTTGGGTCGGTT<br>CCTGCTATTCCGGCGCCTCCACTCCGTCCCCGC<br>GGGTCTGCTCTGTGTGCCATGGACGGCATTGTCC<br>CAGATATAGCCGTTGGTACAAAGCGGGGATCTGA<br>CGAGCTTTTCTCTACTTGTGTCACTAACGGACCGT<br>TTATCATGAGCAGCAACTCGGCTTCTGCAGCAAAC<br>GGAAATGACAGCAAGAAGTTCAAAGGTGACAGCC<br>GAAGTGCAGGCGTCCCCTCTAGAGTGATCCACAT<br>CCGGAAGCTCCCCATCGACGTCACGGAGGGGGAA<br>GTCATCTCCCTGGGGCTGCCCTTTGGGAAGGTCA<br>CCAACCTCCTGATGCTGAAGGGGAAAAACCAGGC<br>CTTCATCGAGATGAACACGGAGGAGGCTGCCAAC<br>ACCATGGTGAACTACTACACCTCGGTGACCCCTGT<br>GCTGCGCGGCCAGCCCATCTACATCCAGTTCTCC<br>AACCACAAGGAGCTGAAGACCGACAGCTCTCCCA<br>ACCAGGCGCGGGCCCAGGCGGCCCTGCAGGCGG<br>TGAACTCGGTCCAGTCGGGGAACCTGGCCTTGGC<br>TGCCTCGGCGGCGGCGTGGACGCAGGGATGGCG<br>ATGGCCGGGCAGAGCCCCGTGCTCAGGATCATCG<br>TGGAGAACCTCTTCTACCCTGTGACCCTGGATGTG<br>CTGCACCAGATTTTCTCCAAGTTCGGCACAGTGTT<br>GAAGATCATCACCTTCACCAAGAACAACCAGTTCC<br>AGGCCCTGCTGCAGTATGCGGACCCCGTGAGCGC<br>CCAGCACGCCAAGCTGTCGCTGGACGGGCAGAAC<br>ATCTACAACGCCTGCTGCACGCTGCGCATCGACTT<br>TTCCAAGCTCACCAGCCTCAACGTCAAGTACAACA<br>ATGACAAGAGCCGTGACTACACACGCCCAGACCT<br>GCCTTCCGGGGACAGCCAGCCCTCGCTGGACCAG<br>ACCATGGCCGCGGCCTTCGCCTCTCCGTATGCAG<br>GAGCTGGTTTCCCTCCCACCTTTGCCATTCC | 24 | WTQGWR<br>WPGRAPC<br>SGSSWRT<br>SSTL* |
| 2053 | NM_031990.2_99 | 99 | TTGTGAGTCTATAACTCGGAGCCGTTGGGTCGGTT<br>CCTGCTATTCCGGCGCCTCCACTCCGTCCCCGC<br>GGGTCTGCTCTGTGTGCCATGGACGGCATGTCCC<br>AGATATAGCCGTTGGTACAAAGCGGGGATCTGAC<br>GAGCTTTTCTCTACTTGTGTCACTAACGGACCGTTT<br>ATCATGAGCAGCAACTCGGCTTCTGCAGCAAACG<br>GAAATGACAGCAAGAAGTTCAAAGGTGACAGCCG<br>AAGTGCAGGCGTCCCCTCTAGAGTGATCCACATC<br>CGGAAGCTCCCCATCGACGTCACGGAGGGGGAA<br>GTCATCTCCCTGGGGCTGCCCTTTGGGAAGGTCA<br>CCAACCTCCTGATGCTGAAGGGGAAAAACCAGGC<br>CTTCATCGAGATGAACACGGAGGAGGCTGCCAAC<br>ACCATGGTGAACTACTACACCTCGGTGACCCCTGT<br>GCTGCGCGGCCAGCCCATCTACATCCAGTTCTCC<br>AACCACAAGGAGCTGAAGACCGACAGCTCTCCCA | 4 | MSQI* |

TABLE 3A-continued

| SEQ ID | identifier_position | position | modified_RNA | PAP length | PAP |
|---|---|---|---|---|---|
| | | | ACCAGGCGCGGGCCCAGGCGGCCCTGCAGGCGG TGAACTCGGTCCAGTCGGGGAACCTGGCCTTGGC TGCCTCGGCGGCGGCCGTGGACGCAGGGATGGC GATGGCCGGGCAGAGCCCCGTGCTCAGGATCATC GTGGAGAACCTCTTCTACCCTGTGACCCTGGATGT GCTGCACCAGATTTTCTCCAAGTTCGGCACAGTGT TGAAGATCATCACCTTCACCAAGAACAACCAGTTC CAGGCCCTGCTGCAGTATGCGGACCCCGTGAGCG CCCAGCACGCCAAGCTGTCGCTGGACGGGCAGAA CATCTACAACGCCTGCTGCACGCTGCGCATCGACT TTTCCAAGCTCACCAGCCTCAACGTCAAGTACAAC AATGACAAGAGCCGTGACTACACACGCCCAGACC TGCCTTCCGGGGACAGCCAGCCCTCGCTGGACCA GACCATGGCCGCGGCCTTCGCCTCTCCGTATGCA GGAGCTGGTTTCCCTCCCACCTTTGCCATTCC | | |
| 2054 | NM_0319 92.1_386 | 386 | GACGGCAAATGGCGGACTTCGACACCTACGACGA TCGGGCCTACAGCAGCTTCGGCGGCGGCAGAGG GTCCCGCGGCAGTGCTGGTGGCCATGGTTCCCGT AGCCAGAAGGAGTTGCCCACAGAGCCCCCCTACA CAGCATACGTAGGAAATCTACCTTTCAATACGGTT CAGGGCGACATAGATGCTATCTTTAAGGATCTCAG CATAAGGAGTGTACGGCTAGTCAGAGACAAAGAC ACAGATAAATTTAAAGGATTCTGCTATGTAGAATTC GATGAAGTGGATTCCCTTAAGGAAGCCTTGACATA CGATGGTGCACTGTTGGGCGATCGGTCACTTCGT GTGGACATTGCAGAAGGCAGAAAACAAGATAAAG GTGGCTTGGATTCAGAAAAGGTGGACCAGATGAC AGAGGCTTCAGGGATGACTTCTTAGGGGGCAGGG GAGGTAGTCGCCCAGGCGACCGGCGAACAGGCC CCCCCATGGGCAGCCGCTTCAGAGATGGCCCTCC CCTCCGTGGATCCAACATGGATTTCAGAGAACCCA CAGAAGAGGAAAGAGCACAGAGACCACGACTCCA GCTTAAACCTCGAACAGTCGCGACGCCCCTCAATC AAGTAGCCAATCCCAACTCTGCTATCTTCGGGGGT GCCAGGCCTAGAGAGGAAGTCGTTCAAAAGGAGC AAGAATGAGCCTGCGGTTGGGAGGGAATGGGGC GTGGGGGGTTAGAGCAGGACCACAGCCTGGTGA GTCCCCGGGCAGCCGTCCTGCAGCCGCCACTCCT GCGCCTGCCATTGGCCTCCTCACAGCGGAAACAC AGCTTGTGAGTGCATGTCAGCTGTTAACAAGTGGT TTTTAGTACATTCTGGGCTTTGCTGTATCTATCTAG TGCCTGTTTGTGCGTTTTTTCTTTCTTCCGCTGCT TCCCCATTTTCCTTCTGTCCTTTTTCTCCTGCTCCT TGTTTTCCCAGCAGCACATGGGGTTCCTCGGAGG AGCAGAGGTGGCCGCCGTGGGGGGGCG | 17 | LDSEKVDQ MTEASGM TS* |
| 2055 | NM_0319 92.1_511 | 511 | GACGGCAAATGGCGGACTTCGACACCTACGACGA TCGGGCCTACAGCAGCTTCGGCGGCGGCAGAGG GTCCCGCGGCAGTGCTGGTGGCCATGGTTCCCGT AGCCAGAAGGAGTTGCCCACAGAGCCCCCCTACA CAGCATACGTAGGAAATCTACCTTTCAATACGGTT CAGGGCGACATAGATGCTATCTTTAAGGATCTCAG CATAAGGAGTGTACGGCTAGTCAGAGACAAAGAC ACAGATAAATTTAAAGGATTCTGCTATGTAGAATTC GATGAAGTGGATTCCCTTAAGGAAGCCTTGACATA CGATGGTGCACTGTTGGGCGATCGGTCACTTCGT GTGGACATTGCAGAAGGCAGAAAACAAGATAAAG GTGGCTTTGGATTCAGAAAAGGTGGACCAGATGA CAGAGGCTTCAGGGATGACTTCTTAGGGGGCAGG GGAGGTAGTCGCCCAGGCGACCGGCGAACAGGC CCCCCCATGGGCAGCCGCTTCAGAGATGGCCTCC CCTCCGTGGATCCAACATGGATTTCAGAGAACCCA CAGAAGAGGAAAGAGCACAGAGACCACGACTCCA GCTTAAACCTCGAACAGTCGCGACGCCCCTCAATC AAGTAGCCAATCCCAACTCTGCTATCTTCGGGGGT GCCAGGCCTAGAGAGGAAGTCGTTCAAAAGGAGC AAGAATGAGCCTGCGGTTGGGAGGGAATGGGGC GTGGGGGGTTAGAGCAGGACCACAGCCTGGTGA GTCCCCGGGCAGCCGTCCTGCAGCCGCCACTCCT GCGCCTGCCATTGGCCTCCTCACAGCGGAAACAC AGCTTGTGAGTGCATGTCAGCTGTTAACAAGTGGT TTTTAGTACATTCTGGGCTTTGCTGTATCTATCTAG TGCCTGTTTGTGCGTTTTTTCTTTCTTCCGCTGCT TCCCCATTTTCCTTCTGTCCTTTTTCTCCTGCTCCT TGTTTTCCCAGCAGCACATGGGGTTCCTCGGAGG AGCAGAGGTGGCCGCCGTGGGGGGGCG | 37 | LPSVDPTW ISENPQKR KEHRDHD SSLNLEQS RRPSIK* |

TABLE 3A-continued

| SEQ ID | identifier_ position | position | modified_RNA | PAP length | PAP |
|---|---|---|---|---|---|
| 2056 | NM_0321 12.2_205 | 205 | CCGGAAGCCTCGAGGTTTAGTCCCGCCCCCTCT CCTCGCTGCTTAGGCTCCGCGGCCTCCAAGCTGT AGCTATGACGGCGCGCGGGACTCCGAGCCGCTTC TTGGCCAGCGTTCTCCACAACGGACTGGGTCGCT ATGTGCAGCAGCTGCAGCGTCTGAGCTTCAGCGT CAGCCGCGACGGCGCCTCGTCTCGCGGCGCCAG GAGTTCGTGGAGCGGGAGGTGATCGACTTCGCCC GACGGAATCCAGGGGTCGTAATATATGTAAACTCG CGTCCGTGCTGCGTGCCCAGAGTAGTGGCCGAAT ACCTTAACGGGGCTGTGCGCGAGGAGAGCATCCA CTGCAAGTCGGTCGAGGAGATCTCGACGCTGGTG CAGAAGCTGGCCGACCAGTCGGGCTTGGACGTGA TCCGCATCCGCAAGCCCTTCCACACCGACAACCC TAGCATCCAGGGCCAGTGGCACCCCTTCACCAAC AAGCCGACCACGTTCCGCGGGCTACGCCCCCGAG AGGTTCAGGATCCTGCCCCAGCCCAGGTGCAAGC ACAGTGAAGAGTTGCCCCACCAACTGCAGCCCCA GGCTTTGGACTGTTACTCCGGTAAAGGTGGTTCTT CCCCTTTGGGATTCCAAGCCCAGGCAAATGGAAC CCATCAATGGGCAAGTTGACAGAGGTTCTGCTTGG GATAATGAAGAGCTGCCTGTTTCTTTCCAGTGCCT GCTTCTGGGGGCAGTGACCTTGTGAACCACTCATT TTTATGCAAGTGGCATCCCTAAAACCTGAGATGAG GAAGACTTCAAGGGTTTTACAGGGCCCTTGTTTTT TAAATCCAAATTGATAATAATGATCTCAAAACACAG TGAGAGGTCTGAAGGCTGGCTTCTGAAGAATCCCT GATGTCTTATTGGAACAACCACTGAGCTACGGAGA GCTCTGCTGTGATGGGCTAGGCACTTTATATCTGT GTGAATACAGATTTATAAAACAGGTTAATAAACTTA TCCAAGGTCACATTTC | 6 | SSWSGR* |
| 2057 | NM_0321 12.2_253 | 253 | CCGGAAGCCTCGAGGTTTAGTCCCGCCCCCTCT CCTCGCTGCTTAGGCTCCGCGGCCTCCAAGCTGT AGCTATGACGGCGCGCGGGACTCCGAGCCGCTTC TTGGCCAGCGTTCTCCACAACGGACTGGGTCGCT ATGTGCAGCAGCTGCAGCGTCTGAGCTTCAGCGT CAGCCGCGACGGCGCCTCGTCTCGCGGCGCCAG GGAGTTCGTGGAGCGGGAGGTGATCGACTTCGCC CGACGGAATCCAGGGGTCGTAATATATGTAAACTCG CGTCCGTGCTGCGTGCCCAGAGTAGTGGCCGAAT ACCTTAACGGGGCTGTGCGCGAGGAGAGCATCCA CTGCAAGTCGGTCGAGGAGATCTCGACGCTGGTG CAGAAGCTGGCCGACCAGTCGGGCTTGGACGTGA TCCGCATCCGCAAGCCCTTCCACACCGACAACCC TAGCATCCAGGGCCAGTGGCACCCCTTCACCAAC AAGCCGACCACGTTCCGCGGGCTACGCCCCCGAG AGGTTCAGGATCCTGCCCCAGCCCAGGTGCAAGC ACAGTGAAGAGTTGCCCCACCAACTGCAGCCCCA GGCTTTGGACTGTTACTCCGGTAAAGGTGGTTCTT CCCCTTTGGGATTCCAAGCCCAGGCAAATGGAAC CCATCAATGGGCAAGTTGACAGAGGTTCTGCTTGG GATAATGAAGAGCTGCCTGTTTCTTTCCAGTGCCT GCTTCTGGGGGCAGTGACCTTGTGAACCACTCATT TTTATGCAAGTGGCATCCCTAAAACCTGAGATGAG GAAGACTTCAAGGGTTTTACAGGGCCCTTGTTTTT TAAATCCAAATTGATAATAATGATCTCAAAACACAG TGAGAGGTCTGAAGGCTGGCTTCTGAAGAATCCCT GATGTCTTATTGGAACAACCACTGAGCTACGGAGA GCTCTGCTGTGATGGGCTAGGCACTTTATATCTGT GTGAATACAGATTTATAAAACAGGTTAATAAACTTA TCCAAGGTCACATTTC | 1 | S* |
| 2058 | NM_0322 31.4_528 | 528 | CGAGCCGCGAAGATTGTTTTTGTCCCGCCGAAATC GAGCAAAGCACGCTGGAACTTGTAGTCCTTGAGG CCCCTTCCCTAGGTCCTTCGAGCTACTCCGTCTGG CCCCGCCTTTTCTCTGCTCTCCTGAACCTTTAGGC TTGTCTCGGCCCATTTGAAGACCAGGAAGTTGATC AATCCCGAGGCTGCTGAGAGACGGTGGCGCGATT GGGACAGTCGCCAGGGATGGCTGAGCGTGAAGAT GCAGCGGGTGTCCGGGCTGCTCTCCTGGACGCTG AGCAGAGTCCTGTGGCTCTCCGGCCTCTCTGAGC CGGGGAGCTGCCCGGCAGCCCCGGATCATGGAAG AGAAAGCGCTAGAAGTTTATGATTTGATTAGAACTA TCCGGGACCCAGAAAAGCCCAATACTTTAGAAGAA CTGGAAGTGGTCTCGGAAAGTTGTGTGGAAGTTCA GGAGATAAATGAAGAAGAATATCTGGTTATTATCA GGTTCACGCCAACAGTACCTCATTGCTCTTTGGCG ACTCTTATGGGCTGTGCTTAAGAGTAAAACTTCAG CGATGTTTACCATTTAAACATAAGTTGGAAATCTAC | 4 | MGCA* |

TABLE 3A-continued

| SEQ ID | identifier_position | position | modified_RNA | PAP length | PAP |
|---|---|---|---|---|---|
| | | | ATTTCTGAAGGAACCCACTCAACAGAAGAAGACAT CAATAAGCAGATAAATGACAAAGAGCGAGTGGCA GCTGCAATGGAAAACCCCAACTTACGGGAAATTGT GGAACAGTGTGTCCTTGAACCTGACTGATAGCTGT TTTAAGAGCCACTGGCCTGTAATTGTTTGATATATT TGTTTAAACTCTTTGTATAATGTCAGAGACTCATGT TTAATACATAGGTGATTTGTACCTCAGAGTATTTTT TAAAGGATTCTTTCCAAGCGAGATTTAATTATAAGG TAGTACCTAATTTGTTCAATGTATAACATTCTCAGG ATTTGTAACACTTAAATGATCAGACAGAATAATATT TTCTAGTTATTATGTGTAAGATGAGTTGCTATTTTT CTGATGCTCATTCTGATACAACTATTTTTCGTGTCA AATATCT | | |
| 2059 | NM_032378.2_1675 | 1675 | CCCTTTCATCAGTCTTCCCGCGTCCGCCGATTCCT CCTCCTTGGTCGCCGCGTCCTTGGCTGGCGTTAG AGACAGGGTTTCAACGTGTTAGCCAGGATGGTCTC AGTCTCCAGACCCTGTGATCCGCCCGCCTCGGCC TCCCAAAGTGTTGGGATTACAGGTGTGAGCCACC GTGCCTGGCCGAGGCTCCTTCTTTTATGAGGAGC GGGAAGGCCTCCTGCACCCTGGAGACCGTGTGG GAAGACAAGCACAAGTATGAGGAGGCCGAGCGGC GCTTCTACGAACACGAGGCCACACAGGCGGCCGG CTCCGCCCAGCAGCTGCCAGCCGAGGGGCCAGC CATGAATGGGCCCGGCCAGGACGACCCTGAGGAC GCTGATGAGGCGGAAGCCCCTGACGGCGGCAGC AGGCGTGATCCCAGGAAGAGCCAGGACAGCAGGA AGCCCCTGCAGAAAAAGAGGAAGCGCTCCCCCAA GAGCGGGCTCGGCCCCGCGGACCTGGCCCTCCT GGGCCTCTCGGCCGAACGCGTGTGGCTGGACAA GTCACTTTTCGACCAGGCAGAGAGCTCCTACCGC CAGAAGCTGGCAGATGTGGCTGCCCAGGCAGCCT GGCCTCCTGCCTTGGCCCCTTGGGGTCTCTGCAC CCATGGAAACCAGGTGGCCTGCCACCACGTGACC TGGGGGATCTGGGTCAACAAGTCCTCCTTCGACC AGGCTGAGCGGGCCTTCGTGGAGTGGTCTCAGGC CCTGTTGCTGGCCCCCGACGGCAGCCGCAGGCA GGGGACTCCCAACACAGGCCAGCAGGTGGCCGT CCCCGACCTGGCCCACCAGCCCAGCCCACCGGTC AATGGCCAGCCCCCGCTGGGCAGCCTGCAGGCA CTGGTTCGGGAGGTGTGGCTGGAGAAGCCCCGGT ATGATGCAGCCGAGAGGGGCTTCTACGAGGCCCT GTTTGACGGCCATCCCCCAGGGAAGGTGCGCCTG CAAGAGCGAGCCGGCCTGGCCGAGGGTGCCCGG CGGGGCCGCAG | 157 | HRPSTYLP CAKWSPQ PRSQPHQ QRMTRMM TLTCLAVT MRRRTRR RHSCGRS GYGSTRR RRPRSLH WWPSPPS CWMSSLG MMRRTWP SWRPVCA LSSWTGW SGGLPSW CPWATVS GSYRFSV WWRTTRW GQTCWRR RSPSLRST CRVSISQL STRSEA* |
| 2060 | NM_032390.3_246 | 246 | GTTTGCGGGAGCGCCGCGTGGTTAGCGTCGGCG GCTTTTGGCATGGCGACTTTTTCTGGCCCGGCTGG GCCAATCCTGTCGCTTAATCCGCAGGAAGATGTCG AGTTTCAAAAGGAGGTGGCGCAGGTTCGCAAGCG CATAACCCAGCGAAAAAAACAAGAACAACTTACTC CTGGAGTAGTCTATGTGCGCCACCTACCTAACCTA CTTGACGAAACCCAGATCTTTTCATATTTCTCCCAG TTGGCACTGTGACACGGTTCAGGCTGTCCAGAAGT AAAAGGACTGGAAATAGCAAAGGCTATGCATTTGT GGAGTTTGAGTCTGAGGATGTTGCCAAAATAGTTG CTGAAACAATGAACAACTACCTGTTTGGTGAAAGA CTCTTGGAGTGTCATTTTATGCCACCTGAAAAAGTA CATAAAGAACTCTTTAAAGACTGGAATATTCCATTT AAGCAGCCATCATATCAATCAGTGAAACGGTATAA TCGGAATCGGACACTAACACAAAAGCTACGGATG GAGGAGCGATTTAAAAAAGAAAGAAAGATTACTCAG GAAGAAATTAGCTAAAAAAGGAATTGACTATGATTT TCCTTCTTTGATTTACAGAAAACGGAAAGTATTTC AAAAACTAATCGTCAGACGTCTACAAAAGGCCAGG TTTTACGTAAGAAGAAGAAAAAAGTTTCAGGTACTC TTGACACTCCTGAGAAGACTGTGGATAGCCAGGG CCCCACACCAGTTTGTACACCAACATTTTTGGAGA GGCGAAAATCTCAAGTGGCTGAACTGAATGATGAT GATAAAGATGATGAAATAGTTTTCAAACAGCCCATA TCCTGTGTAAAAGAAGAAATACAAGAGACTCAAAC ACCTACACATTCACGGAAAAAAAGACGAAGAAGCA GCAATCAGTGATTTTCAATGTATTATATTTCTTTTGA AAAATATAATATTTTTATGAGAGTGGACTTTGTATTT CACTAGGTACAATGGAATACAACCTTTGACAAGAT TTT | 3 | LAL* |
| 2061 | NM_032478.2_987 | 987 | CAGGATGGTCTCGATCTCCTGACTTCGTGATCCAC CCGCCTTGGCCTCCCAAAGTGCTGGGATTCCCGG CGTGAGCCACCGCGCCCAGCCCTCAATCTGGGTT | 27 | STETCSTV PPLCPESP CTWPTLW |

TABLE 3A-continued

| SEQ ID | identifier_ position | position | modified_RNA | PAP length | PAP |
|---|---|---|---|---|---|
| | | | TTAAACCCAAGCAGAGTCCGGAATCGGAGCTCGC ACCCCTTCTCCCAACCAGGCCTGCGTCCCTGGGG AAATCAGGACGCAGCGTCCAGGGGTTGGAGGAGG GCCCCGGCGGCCGACCCCGGTCTGTGCCGCCCC CTGGTGGCCAGCCATGGGCGAGCATATGACTGCT CTCGGCTCCGCCCCGCCGTCCAACGGGCACTTCC GGAGCCGGGCGTCTACAGACCGCGGCCACCTTCC ACCTGCGCCCGAGGCAGACGGTGCAGGGGCCTC CGGGACAGGCGTCTGAGGCCTGCTCCGCAGCGC GGGCCCGGGGGCGGGCCTAGGGGCGGGGCCTG CTGTGGTGCGCTCAGGCACCGCGCTGGCCACCTG TGCCCGGGTCCTAGTGGCGGCCGCAGTGTCGCAG GCCGGAGGGAAGATGGCGGCGCCCTGGTGGCGA GCCGCGCTGTGCGAGTGTCGGAGATGGCGGGGC TTCAGCACCTCGGCCGTCCTGGGCCGCCGGACAC CCCCGCTGGGGCCGATGCCCAACAGTGACATCGA CTTGAGCAACCTGGAGCGGCTGGAGAAGTACCGG AGCTTCGACCGCTACCGGCGCCGAGCAGAGCAG GAGGCGCAGGCCCCGCACTGGTGGCGGACCTAC CGAGAGTATTTCGGGGAGAAGACAGATCCCAAAG AGAAGATTGATATTGGGCTGCCTCCACCCAAAGTC TCCCGGACCCAACAGCTACTGGAACGGAAACAGG CCATCCAGGAGCTTCGGGCCAATGTGGAAGAGGA GCGGGCTGCCCGCCTCCGCACAGCCAGTGTCCC GCTGGATGCCGTGCGGGCCGAGTGGGAGAGGAC CTGTGGCCCCTACCACAAGCAGCGTCTGGCTGAG TATTACGGCTCTACCGAGACCTGTTCCACGGTGCC ACCTTTGTGCCC | | VRMT* |
| 2062 | NM_0327 04.3_127 | 127 | ACTACTTCTCCCCCGGACTCCTTGGTAGTCTGTTA GTGGGAGATCCTTGTTGCCGTCCCTTCGCCTCTT CACCGCCGCAGACCCCTTCAAGTTCTAGTCATGCG TGAGTGCATCTCCATCCACGTTGGCCAGGCTGGTG TCCAGATTGGCAATGCCTGCTGGGAGCTCTACTGC CTGGAACACGGCATCCAGCCCGATGGCCAGATGC CAAGTGACAAGACCATTGGGGGAGGAGATGATTC CTTCAACACCTTCTTCAGTGAAACGGGTGCTGGCA AGCATGTGCCCCGGGCAGTGTTTGTAGACTTGGA ACCCACAGTCATTGATGAAGTTCGCACTGGCACTT ACCGCCAGCTCTTCCACCCTGAGCAACTCATCACA GGCAAGGAAGATGCTGCCAATAACTATGCCCGAG GGCACTACACCATTGGCAAGGAGATCATTGACCTC GTGTTGGACCGAATTCGCAAGCTGGCTGACCAGT GCACCGGTCTTCAGGGCTTCTTGGTTTTCCACAGC TTTGGTGGGGGAACTGGTTCTGGGTTCACCTCGCT GCTCATGGAACGTCTCTCAGTTGATTATGGCAAGA AGTCCAAGCTGGAGTTCTCCATTTACCGGCGCCCC CAGGTTTCCACAGCTGTAGTTGAGCCCTACAACTC CATCCTCACCACCCACACCACCCTGGAGCACTCT GATTGTGCCTTCATGGTAGACAATGAGGCCATCTA TGACATCTGTCGTAGAAACCTCGATATCGAGCGCC CAACCTACACTAACCTTAACCGCCTTATTAGCCAG ATTGTGTCCTCCATCACTGCTTCCCTGAGATTTGAT GGAGCCCTGAATGTTGACCTGACAGAATTCCAGAC CAACCTGGTGCCCTACCCCCGCATCCACTTCCCTC TGGCCACATATGCCCCTGTCATCTCTGCTGAGAAA GCCTACCATGAACAGCTTACTGTAGCAGAGATCAC CAATGCTTGCTTTGAGCCAGCCAACCAGATGGTGA AATGTGACCCTCGCC | 58 | ARLVSRLA MPAGSSTA WNTASSP MARCQVT RPLGEEMI PSTPSSVK RVLASMCP GQCL* |
| 2063 | NM_0327 04.3_148 | 148 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATGGCAATGCCTGCTGGGAGCTCTACTG CCTGGAACACGGCATCCAGCCCGATGGCCAGATG CCAAGTGACAAGACCATTGGGGGAGGAGATGATT CCTTCAACACCTTCTTCAGTGAAACGGGTGCTGGC AAGCATGTGCCCCGGGCAGTGTTTGTAGACTTGG AACCCACAGTCATTGATGAAGTTCGCACTGGCACT TACCGCCAGCTCTTCCACCCTGAGCAACTCATCAC AGGCAAGGAAGATGCTGCCAATAACTATGCCCGA GGGCACTACACCATTGGCAAGGAGATCATTGACCT CGTGTTGGACCGAATTCGCAAGCTGGCTGACCAG TGCACCGGTCTTCAGGGCTTCTTGGTTTTCCACAG CTTTGGTGGGGGAACTGGTTCTGGGTTCACCTCG CTGCTCATGGAACGTCTCTCAGTTGATTATGGCAA GAAGTCCAAGCTGGAGTTCTCCATTTACCGGCGC CCCAGGTTTCCACAGCTGTAGTTGAGCCCTACAAC | 52 | MAMPAGS STAWNTAS SPMARCQ VTRPLGEE MIPSTPSS VKRVLASM CPGQCL* |

TABLE 3A-continued

| SEQ ID | identifier_position | position | modified_RNA | PAP length | PAP |
|---|---|---|---|---|---|
| | | | TCCATCCTCACCACCCACACCACCCTGGAGCACTC TGATTGTGCCTTCATGGTAGACAATGAGGCCATCT ATGACATCTGTCGTAGAAACCTCGATATCGAGCGC CCAACCTACACTAACCTTAACCGCCTTATTAGCCA GATTGTGTCCTCCATCACTGCTTCCCTGAGATTTG ATGGAGCCCTGAATGTTGACCTGACAGAATTCCAG ACCAACCTGGTGCCCTACCCCCGCATCCACTTCCC TCTGGCCACATATGCCCCTGTCATCTCTGCTGAGA AAGCCTACCATGAACAGCTTACTGTAGCAGAGATC ACCAATGCTTGCTTTGAGCCAGCCAACCAGATGGT GAAATGTGACCCTCGCC | | |
| 2064 | NM_0327 04.3_226 | 226 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATGGGGGAGGAGATGATT CCTTCAACACCTTCTTCAGTGAAACGGGTGCTGGC AAGCATGTGCCCCGGGCAGTGTTTGTAGACTTGG AACCCACAGTCATTGATGAAGTTCGCACTGGCACT TACCGCCAGCTCTTCCACCCTGAGCAACTCATCAC AGGCAAGGAAGATGCTGCCAATAACTATGCCCGA GGGCACTACACCATTGGCAAGGAGATCATTGACCT CGTGTTGGACCGAATTCGCAAGCTGGCTGACCAG TGCACCGGTCTTCAGGGCTTCTTGGTTTTCCACAG CTTTGGTGGGGGAACTGGTTCTGGGTTCACCTCG CTGCTCATGGAACGTCTCTCAGTTGATTATGGCAA GAAGTCCAAGCTGGAGTTCTCCATTTACCCGGCGC CCCAGGTTTCCACAGCTGTAGTTGAGCCCTACAAC TCCATCCTCACCACCCACACCACCCTGGAGCACTC TGATTGTGCCTTCATGGTAGACAATGAGGCCATCT ATGACATCTGTCGTAGAAACCTCGATATCGAGCGC CCAACCTACACTAACCTTAACCGCCTTATTAGCCA GATTGTGTCCTCCATCACTGCTTCCCTGAGATTTG ATGGAGCCCTGAATGTTGACCTGACAGAATTCCAG ACCAACCTGGTGCCCTACCCCCGCATCCACTTCCC TCTGGCCACATATGCCCCTGTCATCTCTGCTGAGA AAGCCTACCATGAACAGCTTACTGTAGCAGAGATC ACCAATGCTTGCTTTGAGCCAGCCAACCAGATGGT GAAATGTGACCCTCGCC | 26 | MGEEMIPS TPSSVKRV LASMCPG QCL* |
| 2065 | NM_0327 04.3_301 | 301 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATTGGGGGAGGAGATGAT TCCTTCAACACCTTCTTCAGTGAAACGGGTGCTGG CAAGCATGTGCCCCGGGCAGTGTTGTAGACTTGG AACCCACAGTCATTGATGAAGTTCGCACTGGCACT TACCGCCAGCTCTTCCACCCTGAGCAACTCATCAC AGGCAAGGAAGATGCTGCCAATAACTATGCCCGA GGGCACTACACCATTGGCAAGGAGATCATTGACCT CGTGTTGGACCGAATTCGCAAGCTGGCTGACCAG TGCACCGGTCTTCAGGGCTTCTTGGTTTTCCACAG CTTTGGTGGGGGAACTGGTTCTGGGTTCACCTCG CTGCTCATGGAACGTCTCTCAGTTGATTATGGCAA GAAGTCCAAGCTGGAGTTCTCCATTTACCCGGCGC CCCAGGTTTCCACAGCTGTAGTTGAGCCCTACAAC TCCATCCTCACCACCCACACCACCCTGGAGCACTC TGATTGTGCCTTCATGGTAGACAATGAGGCCATCT ATGACATCTGTCGTAGAAACCTCGATATCGAGCGC CCAACCTACACTAACCTTAACCGCCTTATTAGCCA GATTGTGTCCTCCATCACTGCTTCCCTGAGATTTG ATGGAGCCCTGAATGTTGACCTGACAGAATTCCAG ACCAACCTGGTGCCCTACCCCCGCATCCACTTCCC TCTGGCCACATATGCCCCTGTCATCTCTGCTGAGA AAGCCTACCATGAACAGCTTACTGTAGCAGAGATC ACCAATGCTTGCTTTGAGCCAGCCAACCAGATGGT GAAATGTGACCCTCGCC | 1 | L* |
| 2066 | NM_0327 04.3_325 | 325 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT | 106 | MMKFALAL TASSSTLS NSSQARK MLPITMPE GTTPLARR SLTSCWTE |

TABLE 3A-continued

| SEQ ID | identifier_position | position | modified_RNA | PAP length | PAP |
|---|---|---|---|---|---|
| | | | GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATGATGAAGTTCGCACTGGCACT<br>TACCGCCAGCTCTTCCACCCTGAGCAACTCATCAC<br>AGGCAAGGAAGATGCTGCCAATAACTATGCCCGA<br>GGGCACTACACCATTGGCAAGGAGATCATTGACCT<br>CGTGTTGGACCGAATTCGCAAGCTGGCTGACCAG<br>TGCACCGGTCTTCAGGGCTTCTTGGTTTTCCACAG<br>CTTTGGTGGGGGAACTGGTTCTGGGTTCACCTCG<br>CTGCTCATGGAACGTCTCTCAGTTGATTATGGCAA<br>GAAGTCCAAGCTGGAGTTCTCCATTTACCCGGCGC<br>CCCAGGTTTCCACAGCTGTAGTTGAGCCCTACAAC<br>TCCATCCTCACCACCCACACCACCCTGGAGCACTC<br>TGATTGTGCCTTCATGGTAGACAATGAGGCCATCT<br>ATGACATCTGTCGTAGAAACCTCGATATCGAGCGC<br>CCAACCTACACTAACCTTAACCGCCTTATTAGCCA<br>GATTGTGTCCTCCATCACTGCTTCCCTGAGATTTG<br>ATGGAGCCCTGAATGTTGACCTGACAGAATTCCAG<br>ACCAACCTGGTGCCCTACCCCCGCATCCACTTCCC<br>TCTGGCCACATATGCCCCTGTCATCTCTGCTGAGA<br>AAGCCTACCATGAACAGCTTACTGTAGCAGAGATC<br>ACCAATGCTTGCTTTGAGCCAGCCAACCAGATGGT<br>GAAATGTGACCCTCGCC | | FASWLTSA<br>PVFRASWF<br>STALVGEL<br>VLGSPRCS<br>WNVSQLIM<br>ARSPSWS<br>SPFTRRPR<br>FPQL* |
| 2067 | NM_0327<br>04.3_353 | 353 | ACTACTTCTCCCCCGGACTCCTTGGTAGTCTGTTA<br>GTGGGAGATCCTTGTTGCCGTCCCTTCGCCTCCTT<br>CACCGCCGCAGACCCCTTCAAGTTCTAGTCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATTGATGAAGTTCGCACTGGCAC<br>TTACCGCCAGCTCTTCCACCCTGAGCAACTCATCAC<br>AGGCAAGGAAGATGCTGCCAATAACTATGCCCGA<br>GGGCACTACACCATTGGCAAGGAGATCATTGACCT<br>CGTGTTGGACCGAATTCGCAAGCTGGCTGACCAG<br>TGCACCGGTCTTCAGGGCTTCTTGGTTTTCCACAG<br>CTTTGGTGGGGGAACTGGTTCTGGGTTCACCTCG<br>CTGCTCATGGAACGTCTCTCAGTTGATTATGGCAA<br>GAAGTCCAAGCTGGAGTTCTCCATTTACCCGGCGC<br>CCCAGGTTTCCACAGCTGTAGTTGAGCCCTACAAC<br>TCCATCCTCACCACCCACACCACCCTGGAGCACTC<br>TGATTGTGCCTTCATGGTAGACAATGAGGCCATCT<br>ATGACATCTGTCGTAGAAACCTCGATATCGAGCGC<br>CCAACCTACACTAACCTTAACCGCCTTATTAGCCA<br>GATTGTGTCCTCCATCACTGCTTCCCTGAGATTTG<br>ATGGAGCCCTGAATGTTGACCTGACAGAATTCCAG<br>ACCAACCTGGTGCCCTACCCCCGCATCCACTTCCC<br>TCTGGCCACATATGCCCCTGTCATCTCTGCTGAGA<br>AAGCCTACCATGAACAGCTTACTGTAGCAGAGATC<br>ACCAATGCTTGCTTTGAGCCAGCCAACCAGATGGT<br>GAAATGTGACCCTCGCC | 96 | SSSTLSNS<br>SQARKMLP<br>ITMPEGTT<br>PLARRSLT<br>SCWTEFAS<br>WLTSAPVF<br>RASWFSTA<br>LVGELVLG<br>SPRCSWN<br>VSQLIMAR<br>SPSWSSPF<br>TRRPRFPQ<br>L* |
| 2068 | NM_0327<br>04.3_456 | 456 | ACTACTTCTCCCCCGGACTCCTTGGTAGTCTGTTA<br>GTGGGAGATCCTTGTTGCCGTCCCTTCGCCTCCTT<br>CACCGCCGCAGACCCCTTCAAGTTCTAGTCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATTGATGAAGTTCGCACTGGCAC<br>TTACCGCCAGCTCTTCCACCCTGAGCAACTCATCA<br>CAGGCAAGGAAGATGCTGCCAATAACTATGCCCG<br>AGGGCACTACACCATTGGCAAGGAGATCATTGAC<br>CTCGTGTGGACCGAATTCGCAAGCTGGCTGACCA<br>GTGCACCGGTCTTCAGGGCTTCTTGGTTTTCCACA<br>GCTTTGGTGGGGGAACTGGTTCTGGGTTCACCTC<br>GCTGCTCATGGAACGTCTCTCAGTTGATTATGGCA<br>AGAAGTCCAAGCTGGAGTTCTCCATTTACCCGGCG<br>CCCCAGGTTTCCACAGCTGTAGTTGAGCCCTACAA<br>CTCCATCCTCACCACCCACACCACCCTGGAGCACT<br>CTGATTGTGCCTTCATGGTAGACAATGAGGCCATC<br>TATGACATCTGTCGTAGAAACCTCGATATCGAGCG<br>CCCAACCTACACTAACCTTAACCGCCTTATTAGCC | 62 | WTEFASW<br>LTSAPVFR<br>ASWFSTAL<br>VGELVLGS<br>PRCSWNV<br>SQLIMARS<br>PSWSSPFT<br>RRPRFPQL* |

TABLE 3A-continued

| SEQ ID | identifier_position | position | modified_RNA | PAP length | PAP |
|---|---|---|---|---|---|
| | | | AGATTGTGTCCTCCATCACTGCTTCCCTGAGATTT<br>GATGGAGCCCTGAATGTTGACCTGACAGAATTCCA<br>GACCAACCTGGTGCCCTACCCCCGCATCCACTTC<br>CCTCTGGCCACATATGCCCCTGTCATCTCTGCTGA<br>GAAAGCCTACCATGAACAGCTTACTGTAGCAGAGA<br>TCACCAATGCTTGCTTTGAGCCAGCCAACCAGATG<br>GTGAAATGTGACCCTCGCC | | |
| 2069 | NM_0327 04.3_523 | 523 | ACTACTTCTCCCCCGGACTCCTTGGTAGTCTGTTA<br>GTGGGAGATCCTTGTTGCCGTCCCTTCGCCTCCTT<br>CACCGCCGCAGACCCCTTCAAGTTCTAGTCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATTGATGAAGTTCGCACTGGCAC<br>TTACCGCCAGCTCTTCCACCCTGAGCAACTCATCA<br>CAGGCAAGGAAGATGCTGCCAATAACTATGCCCG<br>AGGGCACTACACCATTGGCAAGGAGATCATTGAC<br>CTCGTGTTGGACCGAATTCGCAAGCTGGCTGACC<br>AGTGCACCGGTCTTCAGGGCTTCTTGGTTTTCCAC<br>AGCTTGGTGGGGGAACTGGTTCTGGGTTCACCTC<br>GCTGCTCATGGAACGTCTCTCAGTTGATTATGGCA<br>AGAAGTCCAAGCTGGAGTTCTCCATTTACCCGGCG<br>CCCCAGGTTTCCACAGCTGTAGTTGAGCCCTACAA<br>CTCCATCCTCACCACCCACACCACCCTGGAGCACT<br>CTGATTGTGCCTTCATGGTAGACAATGAGGCCATC<br>TATGACATCTGTCGTAGAAACCTCGATATCGAGCG<br>CCCAACCTACACTAACCTTAACCGCCTTATTAGCC<br>AGATTGTGTCCTCCATCACTGCTTCCCTGAGATTT<br>GATGGAGCCCTGAATGTTGACCTGACAGAATTCCA<br>GACCAACCTGGTGCCCTACCCCCGCATCCACTTC<br>CCTCTGGCCACATATGCCCCTGTCATCTCTGCTGA<br>GAAAGCCTACCATGAACAGCTTACTGTAGCAGAGA<br>TCACCAATGCTTGCTTTGAGCCAGCCAACCAGATG<br>GTGAAATGTGACCCTCGCC | 40 | LVGELVLG<br>SPRCSWN<br>VSQLIMAR<br>SPSWSSPF<br>TRRPRFPQ<br>L* |
| 2070 | NM_0327 04.3_626 | 626 | ACTACTTCTCCCCCGGACTCCTTGGTAGTCTGTTA<br>GTGGGAGATCCTTGTTGCCGTCCCTTCGCCTCCTT<br>CACCGCCGCAGACCCCTTCAAGTTCTAGTCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATTGATGAAGTTCGCACTGGCAC<br>TTACCGCCAGCTCTTCCACCCTGAGCAACTCATCA<br>CAGGCAAGGAAGATGCTGCCAATAACTATGCCCG<br>AGGGCACTACACCATTGGCAAGGAGATCATTGAC<br>CTCGTGTTGGACCGAATTCGCAAGCTGGCTGACC<br>AGTGCACCGGTCTTCAGGGCTTCTTGGTTTTCCAC<br>AGCTTTGGTGGGGGAACTGGTTCTGGGTTCACCT<br>CGCTGCTCATGGAACGTCTCTCAGTTGATTATGGC<br>AAGAAGTCCAAGCTGGAGTTCTCCATTTACCCGGC<br>GCCCAGGTTTCCACAGCTGTAGTTGAGCCCTACAA<br>CTCCATCCTCACCACCCACACCACCCTGGAGCACT<br>CTGATTGTGCCTTCATGGTAGACAATGAGGCCATC<br>TATGACATCTGTCGTAGAAACCTCGATATCGAGCG<br>CCCAACCTACACTAACCTTAACCGCCTTATTAGCC<br>AGATTGTGTCCTCCATCACTGCTTCCCTGAGATTT<br>GATGGAGCCCTGAATGTTGACCTGACAGAATTCCA<br>GACCAACCTGGTGCCCTACCCCCGCATCCACTTC<br>CCTCTGGCCACATATGCCCCTGTCATCTCTGCTGA<br>GAAAGCCTACCATGAACAGCTTACTGTAGCAGAGA<br>TCACCAATGCTTGCTTTGAGCCAGCCAACCAGATG<br>GTGAAATGTGACCCTCGCC | 5 | RFPQL* |
| 2071 | NM_0327 04.3_658 | 658 | ACTACTTCTCCCCCGGACTCCTTGGTAGTCTGTTA<br>GTGGGAGATCCTTGTTGCCGTCCCTTCGCCTCCTT<br>CACCGCCGCAGACCCCTTCAAGTTCTAGTCATGCG<br>TGAGTGCATCTCCATCCACGTTGGCCAGGCTGGT<br>GTCCAGATTGGCAATGCCTGCTGGGAGCTCTACT<br>GCCTGGAACACGGCATCCAGCCCGATGGCCAGAT<br>GCCAAGTGACAAGACCATTGGGGGAGGAGATGAT<br>TCCTTCAACACCTTCTTCAGTGAAACGGGTGCTGG<br>CAAGCATGTGCCCCGGGCAGTGTTTGTAGACTTG<br>GAACCCACAGTCATTGATGAAGTTCGCACTGGCAC | 17 | PSSPPTPP<br>WSTLIVPS<br>W* |

| SEQ ID | identifier_ position | position | modified_RNA | PAP length | PAP |
|---|---|---|---|---|---|
| | | | TTACCGCCAGCTCTTCCACCCTGAGCAACTCATCA CAGGCAAGGAAGATGCTGCCAATAACTATGCCCG AGGGCACTACACCATTGGCAAGGAGATCATTGAC CTCGTGTTGGACCGAATTCGCAAGCTGGCTGACC AGTGCACCGGTCTTCAGGGCTTCTTGGTTTTCCAC AGCTTTGGTGGGGGAACTGGTTCTGGGTTCACCT CGCTGCTCATGGAACGTCTCTCAGTTGATTATGGC AAGAAGTCCAAGCTGGAGTTCTCCATTTACCCGGC GCCCCAGGTTTCCACAGCTGTAGTTGAGCCCTACA ATCCATCCTCACCACCCACACCACCCTGGAGCACT CTGATTGTGCCTTCATGGTAGACAATGAGGCCATC TATGACATCTGTCGTAGAAACCTCGATATCGAGCG CCCAACCTACACTAACCTTAACCGCCTTATTAGCC AGATTGTGTCCTCCATCACTGCTTCCCTGAGATTT GATGGAGCCCTGAATGTTGACCTGACAGAATTCCA GACCAACCTGGTGCCCTACCCCCGCATCCACTTC CCTCTGGCCACATATGCCCCTGTCATCTCTGCTGA GAAAGCCTACCATGAACAGCTTACTGTAGCAGAGA TCACCAATGCTTGCTTTGAGCCAGCCAACCAGATG GTGAAATGTGACCCTCGCC | | |
| 2072 | NM_0327 04.3_698 | 698 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATTGGGGGAGGAGATGAT TCCTTCAACACCTTCTTCAGTGAAACGGGTGCTGG CAAGCATGTGCCCCGGGCAGTGTTTGTAGACTTG GAACCCACAGTCATTGATGAAGTTCGCACTGGCAC TTACCGCCAGCTCTTCCACCCTGAGCAACTCATCA CAGGCAAGGAAGATGCTGCCAATAACTATGCCCG AGGGCACTACACCATTGGCAAGGAGATCATTGAC CTCGTGTTGGACCGAATTCGCAAGCTGGCTGACC AGTGCACCGGTCTTCAGGGCTTCTTGGTTTTCCAC AGCTTTGGTGGGGGAACTGGTTCTGGGTTCACCT CGCTGCTCATGGAACGTCTCTCAGTTGATTATGGC AAGAAGTCCAAGCTGGAGTTCTCCATTTACCCGGC GCCCCAGGTTTCCACAGCTGTAGTTGAGCCCTACA ACTCCATCCTCACCACCCACACCACCCTGGAGCA CTCTGATGTGCCTTCATGGTAGACAATGAGGCCAT CTATGACATCTGTCGTAGAAACCTCGATATCGAGC GCCCAACCTACACTAACCTTAACCGCCTTATTAGC CAGATTGTGTCCTCCATCACTGCTTCCCTGAGATT TGATGGAGCCCTGAATGTTGACCTGACAGAATTCC AGACCAACCTGGTGCCCTACCCCCGCATCCACTTC CCTCTGGCCACATATGCCCCTGTCATCTCTGCTGA GAAAGCCTACCATGAACAGCTTACTGTAGCAGAGA TCACCAATGCTTGCTTTGAGCCAGCCAACCAGATG GTGAAATGTGACCCTCGCC | 4 | VPSW* |
| 2073 | NM_0327 04.3_724 | 724 | ACTACTTCTCCCCCGGACTCCTTGGTAGTCTGTTA GTGGGAGATCCTTGTTGCCGTCCCTTCGCCTCCTT CACCGCCGCAGACCCCTTCAAGTTCTAGTCATGCG TGAGTGCATCTCCATCCACGTTGGCCAGGCTGGT GTCCAGATTGGCAATGCCTGCTGGGAGCTCTACT GCCTGGAACACGGCATCCAGCCCGATGGCCAGAT GCCAAGTGACAAGACCATTGGGGGAGGAGATGAT TCCTTCAACACCTTCTTCAGTGAAACGGGTGCTGG CAAGCATGTGCCCCGGGCAGTGTTTGTAGACTTG GAACCCACAGTCATTGATGAAGTTCGCACTGGCAC TTACCGCCAGCTCTTCCACCCTGAGCAACTCATCA CAGGCAAGGAAGATGCTGCCAATAACTATGCCCG AGGGCACTACACCATTGGCAAGGAGATCATTGAC CTCGTGTTGGACCGAATTCGCAAGCTGGCTGACC AGTGCACCGGTCTTCAGGGCTTCTTGGTTTTCCAC AGCTTTGGTGGGGGAACTGGTTCTGGGTTCACCT CGCTGCTCATGGAACGTCTCTCAGTTGATTATGGC AAGAAGTCCAAGCTGGAGTTCTCCATTTACCCGGC GCCCCAGGTTTCCACAGCTGTAGTTGAGCCCTACA ACTCCATCCTCACCACCCACACCACCCTGGAGCA CTCTGATTGTGCCTTCATGGTAGACAATGAGGCAT CTATGACATCTGTCGTAGAAACCTCGATATCGAGC GCCCAACCTACACTAACCTTAACCGCCTTATTAGC CAGATTGTGTCCTCCATCACTGCTTCCCTGAGATT TGATGGAGCCCTGAATGTTGACCTGACAGAATTCC AGACCAACCTGGTGCCCTACCCCCGCATCCACTTC CCTCTGGCCACATATGCCCCTGTCATCTCTGCTGA | 33 | SMTSVVET SISSAQPTL TLTALLARL CPPSLLP* |

TABLE 3A-continued

| SEQ ID | identifier_ position | position | modified_RNA | PAP length | PAP |
|---|---|---|---|---|---|
| | | | GAAAGCCTACCATGAACAGCTTACTGTAGCAGAGA TCACCAATGCTTGCTTTGAGCCAGCCAACCAGATG GTGAAATGTGACCCTCGCC | | |
| 2074 | NM_0329 40.2_697 | 697 | GGCCTCGCTGACTGACTTCCGGTGTTGGCGGTGG CGCCGCGCAGTCACCGCGGAGCAGACGCGGAGG CTGGTGGCCCCTGGGCGAGATGCCGTACGCCAAC CAGCCTACCGTGCGGATCACGGAGCTCACTGACG AGAATGTCAAGTTCATCATCGAGAACACCGACCTG GCGGTGGCCAATTCGATTCGGAGGGTCTTCATCG CTGAGGTTCCCATAATAGCCATTGACTGGGTTCAG ATTGATGCCAATTCCTCAGTTCTTCATGATGAATTC ATTGCTCACAGGCTTGGATTAATTCCCCTCATTAGT GATGACATTGTGGACAAGCTGCAGTACTCTCGGG ACTGCACATGTGAGGAGTTCTGCCCCGAGTGCTC GGTGGAGTTCACCCTCGATGTGCGGTGCAATGAA GACCAGACGCGACATGTCACGTCTCGAGACCTCA TCTCCAACAGCCCCCGGGTCATTCCGGTGACATC CCGGAACCGAGATAATGACCCCAATGACTACGTG GAGCAGGATGACATCCTCATCGTCAAGTTGAGAAA GGGCCAGGAGCTGAGACTTCGAGCCTATGCCAAA AAGGGCTTTGGCAAGGAGCATGCCAAGTGGAACC CTACTGCAGGGGTGGCTTTTGAATACGATCCAGAC AATGCCCTGAGGCACACAGTGTACCCCAAGCCCG AGGAATGGCAAAGAGTGAGTACTCGGAGCTGGAT GAGGATGAGTCGCAGGCTCCCTATGACCCCAACG GCAAGCCAGAAAGGTTTTACTACAATGTGGAGTCC TGTGGCTCTCTGCGTCCTGAAACCATTGTCCTGTC AGCCCTCTCAGGATTGAAGAAGAAACTGAGTGATT TACAAACTCAATTAAGCCACGAGATCCAGAGTGAT GTGCTAACCATAAATTAACTGCAGCTTGCCTGCTT CAGCAAAAACGGAGATTCAGGCCAGCAGCTGGAT ATGGGGGTCTCTCTTCAGACTCTTCTCGTTTCTGA AATCTAGTCTACTGTTGGTTGAGC | 48 | QRVSTRS WMRMSRR LPMTPTAS QKGFTTM WSPVALCV LKPLSCQP SQD* |
| 2075 | NM_0330 22.2_254 | 254 | GGGGTCCTTCCGTGCGCGTTGATATGATTGGCCG GCGAATCGTGGTTCTCTTTTCCTCCTTGGCTGTCT GAAGATAGATCGCCATCATGAACGACACCGTAACT ATCCGCACTAGAAAGTTCATGACCAACCGACTACT TCAGAGGAAACAAATGGTCATTGATGTCCTTCACC CCGGGAAGGCGACAGTGCCTAAGACAGAAATTCG GGAAAAACTAGCCAAAATGTACAAGACCACACCGG ATGTCATCTTTGTATTTGGATTCAGAACTCATTTTGG TGGTGGCAAGACAACTGGCTTTGGCATGATTTATG ATTCCCTGGATTATGCAAAGAAAAATGAACCCAAA CATAGACTTGCAAGACATGGCCTGTATGAGAAGAA AAAGACCTCAAGAAAGCAACGAAAGGAACGCAAG AACAGAATGAAGAAAGTCAGGGGGACTGCAAAGG CCAATGTTGGTGCTGGCAAAAAGTGAGCTGGAGA TTGGATCACAGCCGAAGGAGTAAAGGTGCTGCAA TGATGTTAGCTGTGGCCACTGTGGATTTTTCGCAA GAACATTAATAAACTAAAAACTTCATGTGTCTGGTT GTTTGAAAAAAAAAAAAAAAAAA | 18 | LYLDSELIL VVARQLAL A* |
| 2076 | NM_0330 22.2_278 | 278 | GGGGTCCTTCCGTGCGCGTTGATATGATTGGCCG GCGAATCGTGGTTCTCTTTTCCTCCTTGGCTGTCT GAAGATAGATCGCCATCATGAACGACACCGTAACT ATCCGCACTAGAAAGTTCATGACCAACCGACTACT TCAGAGGAAACAAATGGTCATTGATGTCCTTCACC CCGGGAAGGCGACAGTGCCTAAGACAGAAATTCG GGAAAAACTAGCCAAAATGTACAAGACCACACCGG ATGTCATCTTTGTATTTGGATTCAGAACTCATTTTGG TGGTGGCAAGACAACTGGCTTTGGCATGATTTATG ATTCCCTGGATTATGCAAAGAAAAATGAACCCAAA CATAGACTTGCAAGACATGGCCTGTATGAGAAGAA AAAGACCTCAAGAAAGCAACGAAAGGAACGCAAG AACAGAATGAAGAAAGTCAGGGGGACTGCAAAGG CCAATGTTGGTGCTGGCAAAAAGTGAGCTGGAGA TTGGATCACAGCCGAAGGAGTAAAGGTGCTGCAA TGATGTTAGCTGTGGCCACTGTGGATTTTTCGCAA GAACATTAATAAACTAAAAACTTCATGTGTCTGGTT GTTTGAAAAAAAAAAAAAAAAAA | 10 | LVVARQLA LA* |
| 2077 | NM_0330 22.2_302 | 302 | GGGGTCCTTCCGTGCGCGTTGATATGATTGGCCG GCGAATCGTGGTTCTCTTTTCCTCCTTGGCTGTCT GAAGATAGATCGCCATCATGAACGACACCGTAACT ATCCGCACTAGAAAGTTCATGACCAACCGACTACT TCAGAGGAAACAAATGGTCATTGATGTCCTTCACC CCGGGAAGGCGACAGTGCCTAAGACAGAAATTCG GGAAAAACTAGCCAAAATGTACAAGACCACACCGG ATGTCATCTTTGTATTTGGATTCAGAACTCATTTTG | 2 | LA* |

TABLE 3A-continued

| SEQ ID | identifier_position | position | modified_RNA | PAP length | PAP |
|---|---|---|---|---|---|
| | | | GTGGTGGCAAGACAACTGGCTTGGCATGATTTATG<br>ATTCCCTGGATTATGCAAAGAAAAATGAACCCAAA<br>CATAGACTTGCAAGACATGGCCTGTATGAGAAGAA<br>AAAGACCTCAAGAAAGCAACGAAAGGAACGCAAG<br>AACAGAATGAAGAAAGTCAGGGGGACTGCAAAGG<br>CCAATGTTGGTGCTGGCAAAAAGTGAGCTGGAGA<br>TTGGATCACAGCCGAAGGAGTAAAGGTGCTGCAA<br>TGATGTTAGCTGTGGCCACTGTGGATTTTTCGCAA<br>GAACATTAATAAACTAAAAACTTCATGTGTCTGGTT<br>GTTTGAAAAAAAAAAAAAAAAAAA | | |
| 2078 | NM_0332<br>96.1_412 | 412 | TTGTCCGTGGCTTCTCTGAGAAGAAAAGTTGAAAA<br>AGGGTAAAAGTTTTCAGGAATATTCGGGCTCTCTA<br>TTGCTAAGCATAGCGAGTGTCGGTTTTCTCTCTCC<br>AACAGACATCGCTATTGCGGTTCCGAGGCAGTGG<br>GAAGAGATGCGGCCCCTGGACATCGTCGAGCTGG<br>CGGAACCGGAGGAAGTGGAGGTGCTGGAGCCCG<br>AGGAGGATTTCGAGCAGTTTCTGCTCCCGGTCATC<br>AACGAGATGCGCGAGGACATCGCGTCGCTGACGC<br>GCGAGCACGGGCGGGCGTACCTGCGGAACCGGA<br>GCAAGCTGTGGGAGATGGACAATATGCTCATCCA<br>GATCAAAACGCAGGTGGAGGCCTCGGAGGAGAGC<br>GCCCTCAACCACCTCCAGAACCCGGGCGACGCGG<br>CCGAGGGCCGGGCGGCCAAGAGGTGCGAGAAGGC<br>CGAGGAGAAGGCCAAGGAGATTGCGAAGATGGCA<br>GAGATGCTGGTGGAGCTGGTCCGGCGGATAGAGA<br>AGAGCGAGTCGTCGTGAGCGCGGTCGGCGGTTTC<br>CAGCCAATGGATTCTGGTCAACTGGTGGAGATTG<br>GCTGACACCCTGGAGAAGCCGAAACCAGAGAGCC<br>TTTTGTTTTCTCTTTTTTCCTGTCTATGCTCTGTCTC<br>ACTTAACACTACGTTTTCTGCTATGGTCTGTGGTTG<br>ATGACCTCAATATGAGTTTCGATTGTTAACGTGTTT<br>TTGTTTGGGAAGTAATTTTGTTTGAAAATGCTCTCA<br>CATACAGGAATTAGGGCCTAGATTGTAAGCTCTTG<br>CAGCAGTCACATTTGTTCCCGGGCTTTGGTGGTTA<br>TTTCTAAATTTTTGAGGTGCTTTGCTATTTCTTGTGT<br>GACCTGATAGCTCCCTGGAACTTTGGGTCTGTGTG<br>TGACACATGAGACTCACAGTTGGAGTTCTCCAGCT<br>CTGGAGGTGCTGAAGGAGCTGCATTAATTCTGGAA<br>GACGACTCCATGCAGCAACTACTGAAGAAAGGAC<br>CAGACTTCAACGGGGAGTGT | 31 | RAGRPRG<br>ARRPRRR<br>PRRLRRW<br>QRCWWS<br>WSGG* |
| 2079 | NM_0332<br>96.1_427 | 427 | TTGTCCGTGGCTTCTCTGAGAAGAAAAGTTGAAAA<br>AGGGTAAAAGTTTTCAGGAATATTCGGGCTCTCTA<br>TTGCTAAGCATAGCGAGTGTCGGTTTTCTCTCTCC<br>AACAGACATCGCTATTGCGGTTCCGAGGCAGTGG<br>GAAGAGATGCGGCCCCTGGACATCGTCGAGCTGG<br>CGGAACCGGAGGAAGTGGAGGTGCTGGAGCCCG<br>AGGAGGATTTCGAGCAGTTTCTGCTCCCGGTCATC<br>AACGAGATGCGCGAGGACATCGCGTCGCTGACGC<br>GCGAGCACGGGCGGGCGTACCTGCGGAACCGGA<br>GCAAGCTGTGGGAGATGGACAATATGCTCATCCA<br>GATCAAAACGCAGGTGGAGGCCTCGGAGGAGAGC<br>GCCCTCAACCACCTCCAGAACCCGGGCGACGCGG<br>CCGAGGGCCGGGCGGCAAGAGGTGCGAGAAGGC<br>CGAGGAGAAGGCCAAGGAGATTGCGAAGATGGCA<br>GAGATGCTGGTGGAGCTGGTCCGGCGGATAGAGA<br>AGAGCGAGTCGTCGTGAGCGCGGTCGGCGGTTTC<br>CAGCCAATGGATTCTGGTCAACTGGTGGAGATTG<br>GCTGACACCCTGGAGAAGCCGAAACCAGAGAGCC<br>TTTTGTTTTCTCTTTTTTCCTGTCTATGCTCTGTCTC<br>ACTTAACACTACGTTTTCTGCTATGGTCTGTGGTTG<br>ATGACCTCAATATGAGTTTCGATTGTTAACGTGTTT<br>TTGTTTGGGAAGTAATTTTGTTTGAAAATGCTCTCA<br>CATACAGGAATTAGGGCCTAGATTGTAAGCTCTTG<br>CAGCAGTCACATTTGTTCCCGGGCTTTGGTGGTTA<br>TTTCTAAATTTTTGAGGTGCTTTGCTATTTCTTGTGT<br>GACCTGATAGCTCCCTGGAACTTTGGGTCTGTGTG<br>TGACACATGAGACTCACAGTTGGAGTTCTCCAGCT<br>CTGGAGGTGCTGAAGGAGCTGCATTAATTCTGGAA<br>GACGACTCCATGCAGCAACTACTGAAGAAAGGAC<br>CAGACTTCAACGGGGAGTGT | 26 | RGARRPR<br>RRPRRLRR<br>WQRCWW<br>SWSGG* |
| 2080 | NM_0335<br>46.2_384 | 384 | AGGAAGTGTCGGCGCCGCCACTGTCCGGCCACAG<br>CCTAACGCTCTTCGCTGTCGTTTGCGGTCTCGGCA<br>GGGCGCCCCCGTTCTGGTGTTTGGCGTCGGAATT<br>AAACAACCACCATGTCGAGCAAAAAGGCAAAGACC<br>AAGACCACCAAGAAGCGCCCTCAGCGTGCAACAT<br>CCAATGTGTTTGCCATGTTTGACCAGTCACAGATT<br>CAGGAGTTCAAAGAGGCCTTCAACATGATTGATCA | 4 | LVRS* |

TABLE 3A-continued

| SEQ ID | identifier_position | position | modified_RNA | PAP length | PAP |
|---|---|---|---|---|---|
| | | | GAACAGAGATGGCTTCATCGACAAGGAAGATTTGC<br>ATGATATGCTTGCTTCTCTAGGGAAGAATCCCACT<br>GATGCATACCTTGATGCCATGATGAATGAGGCCCC<br>AGGGCCAATCAATTTCACCATGTTCCTGACCATGT<br>TGGTGAGAAGTTAAATGGCACAGATCCTGAAGATG<br>TCATCAGAAACGCCTTTGCTTGCTTTGATGAAGAA<br>GCAACAGGTACCATTCAGGAAGATTACCTAAGAGA<br>GCTGCTGACAACCATGGGGGATCGGTTTACAGAT<br>GAGGAAGTGGATGAGCTGTACAGAGAAGCACCTA<br>TTGACAAAAAGGGGAATTTCAATTACATCGAGTTC<br>ACACGCATCCTGAAACATGGAGCCAAAGACAAAGA<br>TGACTGAAAGAACTTTAGCTAAAATCTTCCAGTTAC<br>ATTGTCTTACTCTCTTTTACTTCTCAGACACTTCCC<br>CCACCCTCATAGAACCTGTTGCATGCAACTTAGTT<br>TCACAGCTTTGCCTCTTCTTTTTGATGTATTTATTC<br>CAGACCTTTCTGCCACTTAGCACTTGTATAATCAGA<br>CTGGAAATGGGGATGAGGGTGTAAATTGTATTGAA<br>AAAGATCGCGAATAAAAATCAACAAAGTGTGAAAG<br>CCC | | |
| 2081 | NM_053275.3_247 | 247 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGGCCCGGGA<br>CCGCGGGATGGGTGTCGGCGTGACCAGGCCTGA<br>GCTCCCTGTCTCTCCTCAGTGACATCGTCTTTAAA<br>CCCTGCGTGGCAATCCCTGACGCACCGCCGTGAT<br>GCCCAGGAAGACAGGGCGACCTGGAAGTCCAACT<br>ACTTCCTTAAGATCATCCAACTATTGGATGATTATC<br>CGAAATGTTTCATTGTGGGAGCAGACAATGTGGGC<br>TCCAAGCAGATGCAGCAGATCCGCATGTCCCTTC<br>GCGGGAAGGCTGTGGTGCTGATGGGCAAGAACAC<br>CATGATGCGCAAGGCCATCCGAGGGCACCTGGAA<br>AACAACCCAGCTCTGGAGAAACTGCTGCCTCATAT<br>CCGGGGGAATGTGGGCTTTGTGTTCACCAAGGAG<br>GACCTCACTGAGATCAGGGACATGTTGCTGGCCA<br>ATAAGGTGCCAGCTGCTGCCCGTGCTGGTGCCAT<br>TGCCCCATGTGAAGTCACTGTGCCAGCCCAGAAC<br>ACTGGTCTCGGGCCCGAGAAGACCTCCTTTTTCCA<br>GGCTTTAGGTATCACCACTAAAATCTCCAGGGGCA<br>CCATTGAAATCCTGAGTGATGTGCAGCTGATCAAG<br>ACTGGAGACAAAGTGGGAGCCAGCGAAGCCACGC<br>TGCTGAACATGCTCAACATCTCCCCCTTCTCCTTT<br>GGGCTGGTCATCCAGCAGGTGTTCGACAATGGCA<br>GCATCTACAACCCTGAAGTGCTTGATATCACAGAG<br>GAAACTCTGCATTCTCGCTTCCTGGAGGGTGTCCG<br>CAATGTTGCCAGTGTCTGTCTGCAGATTGGCTACC<br>CAACTGTTGCATCAGTACCCCATTCTATCATCAAC<br>GGGTACAAAACGAGTCCTGGCCTTGTCTGTGGAGA<br>CGGATTACACCTTCCCACTTGCTGA | 50 | KTGRPGSP<br>TTSLRSSN<br>YWMIIRNV<br>SLWEQTM<br>WAPSRCS<br>RSACPFAG<br>RLWC* |
| 2082 | NM_053275.3_299 | 299 | GTCTGACGGGCGATGGCGCAGCCAATAGACAGGA<br>GCGCTATCCGCGGTTTCTGATTGGCTACTTTGTTC<br>GCATTATAAAAGGCACGCGCGGGCGCGAGGCCCT<br>TCTCTCGCCAGGCGTCCTCGTGGAAGGCCCGGGA<br>CCGCGGGATGGGTGTCGGCGTGACCAGGCCTGA<br>GCTCCCTGTCTCTCCTCAGTGACATCGTCTTTAAA<br>CCCTGCGTGGCAATCCCTGACGCACCGCCGTGAT<br>GCCCAGGGAAGACAGGGCGACCTGGAAGTCCAAC<br>TACTTCCTTAAGATCATCCAACTATGGATGATTATC<br>CGAAATGTTTCATTGTGGGAGCAGACAATGTGGGC<br>TCCAAGCAGATGCAGCAGATCCGCATGTCCCTTC<br>GCGGGAAGGCTGTGGTGCTGATGGGCAAGAACAC<br>CATGATGCGCAAGGCCATCCGAGGGCACCTGGAA<br>AACAACCCAGCTCTGGAGAAACTGCTGCCTCATAT<br>CCGGGGGAATGTGGGCTTTGTGTTCACCAAGGAG<br>GACCTCACTGAGATCAGGGACATGTTGCTGGCCA<br>ATAAGGTGCCAGCTGCTGCCCGTGCTGGTGCCAT<br>TGCCCCATGTGAAGTCACTGTGCCAGCCCAGAAC<br>ACTGGTCTCGGGCCCGAGAAGACCTCCTTTTTCCA<br>GGCTTTAGGTATCACCACTAAAATCTCCAGGGGCA<br>CCATTGAAATCCTGAGTGATGTGCAGCTGATCAAG<br>ACTGGAGACAAAGTGGGAGCCAGCGAAGCCACGC<br>TGCTGAACATGCTCAACATCTCCCCCTTCTCCTTT<br>GGGCTGGTCATCCAGCAGGTGTTCGACAATGGCA<br>GCATCTACAACCCTGAAGTGCTTGATATCACAGAG<br>GAAACTCTGCATTCTCGCTTCCTGGAGGGTGTCCG<br>CAATGTTGCCAGTGTCTGTCTGCAGATTGGCTACC<br>CAACTGTTGCATCAGTACCCCATTCTATCATCAAC | 33 | WMIIRNVS<br>LWEQTMW<br>APSRCSRS<br>ACPFAGRL<br>WC* |

TABLE 3A-continued

| SEQ ID | identifier_ position | position | modified_RNA | PAP length | PAP |
|---|---|---|---|---|---|
| 2083 | NM_0532 75.3_686 | 686 | GGGTACAAACGAGTCCTGGCCTTGTCTGTGGAGA CGGATTACACCTTCCCACTTGCTGA GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGGCCCGGGA CCGCGGGATGGGTGTCGGCGTGACCAGGCCTGA GCTCCCTGTCTCTCCTCAGTGACATCGTCTTTAAA CCCTGCGTGGCAATCCCTGACGCACCGCCGTGAT GCCCAGGGAAGACAGGGCGACCTGGAAGTCCAAC TACTTCCTTAAGATCATCCAACTATTGGATGATTAT CCGAAATGTTTCATTGTGGGAGCAGACAATGTGGG CTCCAAGCAGATGCAGCAGATCCGCATGTCCCTTC GCGGGAAGGCTGTGGTGCTGATGGGCAAGAACAC CATGATGCGCAAGGCCATCCGAGGGCACCTGGAA AACAACCCAGCTCTGGAGAAACTGCTGCCTCATAT CCGGGGGAATGTGGGCTTTGTGTTCACCAAGGAG GACCTCACTGAGATCAGGGACATGTTGCTGGCCA ATAAGGTGCCAGCTGCTGCCCGTGCTGGTGCCAT TGCCCCATGTGAAGTCACTGTGCCAGCCCAGAAC ACTGGTCTCGGGCCCGAGAAGACCTCCTTTTTCCA GGCTTTAGGTATCACCACTAAAATCTCCAGGGCAC CATTGAAATCCTGAGTGATGTGCAGCTGATCAAGA CTGGAGACAAAGTGGGAGCCAGCGAAGCCACGCT GCTGAACATGCTCAACATCTCCCCCTTCTCCTTTG GGCTGGTCATCCAGCAGGTGTTCGACAATGGCAG CATCTACAACCCTGAAGTGCTTGATATCACAGAGG AAACTCTGCATTCTCGCTTCCTGGAGGGTGTCCGC AATGTTGCCAGTGTCTGTCTGCAGATTGGCTACCC AACTGTTGCATCAGTACCCCATTCTATCATCAACG GGTACAAACGAGTCCTGGCCTTGTCTGTGGAGAC GGATTACACCTTCCCACTTGCTGA | 5 | APLKS* |
| 2084 | NM_0532 75.3_774 | 774 | GTCTGACGGGCGATGGCGCAGCCAATAGACAGGA GCGCTATCCGCGGTTTCTGATTGGCTACTTTGTTC GCATTATAAAAGGCACGCGCGGGCGCGAGGCCCT TCTCTCGCCAGGCGTCCTCGTGGAAGGCCCGGGA CCGCGGGATGGGTGTCGGCGTGACCAGGCCTGA GCTCCCTGTCTCTCCTCAGTGACATCGTCTTTAAA CCCTGCGTGGCAATCCCTGACGCACCGCCGTGAT GCCCAGGGAAGACAGGGCGACCTGGAAGTCCAAC TACTTCCTTAAGATCATCCAACTATTGGATGATTAT CCGAAATGTTTCATTGTGGGAGCAGACAATGTGGG CTCCAAGCAGATGCAGCAGATCCGCATGTCCCTTC GCGGGAAGGCTGTGGTGCTGATGGGCAAGAACAC CATGATGCGCAAGGCCATCCGAGGGCACCTGGAA AACAACCCAGCTCTGGAGAAACTGCTGCCTCATAT CCGGGGGAATGTGGGCTTTGTGTTCACCAAGGAG GACCTCACTGAGATCAGGGACATGTTGCTGGCCA ATAAGGTGCCAGCTGCTGCCCGTGCTGGTGCCAT TGCCCCATGTGAAGTCACTGTGCCAGCCCAGAAC ACTGGTCTCGGGCCCGAGAAGACCTCCTTTTTCCA GGCTTTAGGTATCACCACTAAAATCTCCAGGGGCA CCATTGAAATCCTGAGTGATGTGCAGCTGATCAAG ACTGGAGACAAAGTGGGAGCCAGCGAAGCCACGC TGCTGAACATGCTCAAATCTCCCCCTTCTCCTTTG GCTGGTCATCCAGCAGGTGTTCGACAATGGCAG CATCTACAACCCTGAAGTGCTTGATATCACAGAGG AAACTCTGCATTCTCGCTTCCTGGAGGGTGTCCGC AATGTTGCCAGTGTCTGTCTGCAGATTGGCTACCC AACTGTTGCATCAGTACCCCATTCTATCATCAACG GGTACAAACGAGTCCTGGCCTTGTCTGTGGAGAC GGATTACACCTTCCCACTTGCTGA | 156 | KSPPSPLG WSSSRCS TMAASTTL KCLISQRK LCILASWR VSAMLPVS VCRLATQL LHQYPILSS TGTNESW PCLWRRIT PSHLLKRS RPSWLIHL PLWLLPLW LLPPQLLLL LLQPQLRL KPRKSRRS RTRIWDLV SLTNHQKA TNLASFICK TRK* |
| 2085 | NM_0571 61.2_598 | 598 | GCTTGGCTGTGTTTATCTCGTTGGGGACTAAGGCG TCGGTTGGCGCGCAACGGGTTCTAGGCTGCAGGC AGCTCGAGGACCCGCGGCCCCGCCCCGGCTCGG CCTGGCAGATAGCAGAGGCAGCAGGCCGTGCCG GGGGGGCATGTTGCTGTAACCAGTGGCCCAGGG GATGTTACGGTGGACAGTGCACCTGGAGGGCGGG CCCCGCAGGGTGAACCATGCTGCAGTGGCTGTCG GGCATCGGGTATACTCCTTCGGGGGTTACTGCTCT GGTGAAGACTATGAGACACTGCGTCAGATAGATGT GCACATTTTCAATGCAGTGTCCTTGCGTTGGACAA AGCTGCCCCCGGTGAAGTCTGCCATCCGTGGGCA AGCTCCTGTGGTACCCTACATGCGCTATGGACACT CAACCGTCCTCATCGACGACACAGTCCTCCTTTGG GGCGGGCGGAATGACACCGAAGGGGCCTGCAAT GTGCTCTATGCCTTTGACGTCAATACGCACAAGTG | 17 | LGATSSRR TVFPMTFT S* |

TABLE 3A-continued

| SEQ ID | identifier_position | position | modified_RNA | PAP length | PAP |
|---|---|---|---|---|---|
| | | | GTTCACACCCCGAGTGTCAGGGACAGTTCCTGGG<br>GCCCGGGATGGACATTCAGCCTGTGTCCTAGGCA<br>AGATCATGTACATTTTGGGGGCTACGAGCAGCAG<br>GCGGACTGTTTTTCCAATGACATTCACAAGCTAGA<br>TACCAGCACCATGACATGGACTCTTATCTGTACAA<br>AGGGCAGCCCTGCACGCTGGAGGGACTTCCACTC<br>AGCCACAATGCTGGGAAGTCACATGTATGTCTTTG<br>GGGGCCGTGCCGACCGCTTTGGGCCATTCCATTC<br>CAACAATGAGATTTACTGCAACCGCATTCGAGTCT<br>TTGACACCAGAACTGAGGCTTGGCTGGACTGTCC<br>CCCGACTCCAGTGCTGCCTGAGGGGCGCCGGAG<br>CCACTCGGCCTTTGGCTACAATGGGGAGCTGTAC<br>ATCTTTGGTGGTTATAATGCAAGGCTGAACCGGCA<br>CTTCCATGACCTCTGGAAGTTTAATCCTGTGTCCTT<br>TACCTGGAAAAAGATTGAACCGAAGGGGA | | |
| 2086 | NM_0581<br>79.2_133 | 133 | GGCCAGGAACGCCAGCCGTTCACGCGTTCGGTCC<br>TCCTTGGCTGACTCACCGCCCTGGCCGCCGCACC<br>ATGGACGCCCCCAGGCAGGTGGTCAACTTTGGGC<br>CTGGTCCCGCCAAGCTGCCGCACTCAGTGTGTTA<br>GAGATACAAAAGGAATTATTAGACTACAAAGGAGT<br>TGGCATTAGTGTTCTTGAAATGAGTCACAGGTCAT<br>CAGATTTTGCCAAGATTATTAACAATACAGAGAATC<br>TTGTGCGGGAATTGCTAGCTGTTCCAGACAACTAT<br>AAGGTGATTTTTCTGCAAGGAGGTGGGTGCGGCC<br>AGTTCAGTGCTGTCCCCTTAAACCTCATTGGCTTG<br>AAAGCAGGAAGGTGTGCTGACTATGTGGTGACAG<br>GAGCTTGGTCAGCTAAGGCCGCAGAAGAAGCCAA<br>GAAGTTTGGGACTATAAATATCGTTCACCCTAAACT<br>TGGGAGTTATACAAAAATTCCAGATCCAAGCACCT<br>GGAACCTCAACCCAGATGCCTCCTACGTGTATTAT<br>TGCGCAAATGAGACGGTGCATGGTGTGGAGTTTG<br>ACTTTATACCCGATGTCAAGGGAGCAGTACTGGTT<br>TGTGACATGTCCTCAAACTTCCTGTCCAAGCCAGT<br>GGATGTTTCCAAGTTTGGTGTGATTTTTGCTGGTG<br>CCCAGAAGAATGTTGGCTCTGCTGGGGTCACCGT<br>GGTGATTGTCCGTGATGACCTGCTGGGGTTTGCC<br>CTCCGAGAGTGCCCCTCGGTCCTGGAATACAAGG<br>TGCAGGCTGGAAACAGCTCCTTGTACAACACGCCT<br>CCATGTTTCAGCATCTACGTCATGGGCTTGGTTCT<br>GGAGTGGATTAAAAACAATGGAGGTGCCGCGGCC<br>ATGGAGAAGCTTAGCTCCATCAAATCTCAAACAAT<br>TTATGAGATTATTGATAATTCTCAAGGATTCTACGT<br>TTGTCCAGTGGAGCCCCAAAATAGAAGCAAGATGA<br>ATATTCCATTCCGCATTGGCAATGCCAAAGGAGAT<br>GATGCTTTAGAAAAAAGA | 1 | C* |
| 2087 | NM_0581<br>79.2_215 | 215 | GGCCAGGAACGCCAGCCGTTCACGCGTTCGGTCC<br>TCCTTGGCTGACTCACCGCCCTGGCCGCCGCACC<br>ATGGACGCCCCCAGGCAGGTGGTCAACTTTGGGC<br>CTGGTCCCGCCAAGCTGCCGCACTCAGTGTTGTTA<br>GAGATACAAAAGGAATTATTAGACTACAAAGGAGT<br>TGGCATTAGTGTTCTTGAAATGAGTCACAGGTCAT<br>CAGATTTGCCAAGATTATTAACAATACAGAGAATCT<br>TGTGCGGGAATTGCTAGCTGTTCCAGACAACTATA<br>AGGTGATTTTTCTGCAAGGAGGTGGGTGCGGCCA<br>GTTCAGTGCTGTCCCCTTAAACCTCATTGGCTTGA<br>AAGCAGGAAGGTGTGCTGACTATGTGGTGACAGG<br>AGCTTGGTCAGCTAAGGCCGCAGAAGAAGCCAAG<br>AAGTTTGGGACTATAAATATCGTTCACCCTAAACTT<br>GGGAGTTATACAAAAATTCCAGATCCAAGCACCTG<br>GAACCTCAACCCAGATGCCTCCTACGTGTATTATT<br>GCGCAAATGAGACGGTGCATGGTGTGGAGTTTGA<br>CTTTATACCCGATGTCAAGGGAGCAGTACTGGTTT<br>GTGACATGTCCTCAAACTTCCTGTCCAAGCCAGTG<br>GATGTTTCCAAGTTTGGTGTGATTTTTGCTGGTGC<br>CCAGAAGAATGTTGGCTCTGCTGGGGTCACCGTG<br>GTGATTGTCCGTGATGACCTGCTGGGGTTTGCCCT<br>CCGAGAGTGCCCCTCGGTCCTGGAATACAAGGTG<br>CAGGCTGGAAACAGCTCCTTGTACAACACGCCTC<br>CATGTTTCAGCATCTACGTCATGGGCTTGGTTCTG<br>GAGTGGATTAAAAACAATGGAGGTGCCGCGGCCA<br>TGGAGAAGCTTAGCTCCATCAAATCTCAAACAATTT<br>ATGAGATTATTGATAATTCTCAAGGATTCTACGTTT<br>GTCCAGTGGAGCCCCAAAATAGAAGCAAGATGAAT<br>ATTCCATTCCGCATTGGCAATGCCAAAGGAGATGA<br>TGCTTTAGAAAAAAGA | 15 | LPRLLTIQR<br>ILCGNC* |

TABLE 3A-continued

| SEQ ID | identifier_position | position | modified_RNA | PAP length | PAP |
|---|---|---|---|---|---|
| 2088 | NM_079423.2_337 | 337 | GTCATCGGGACGTACTAAGACTAGGGTTGGGCCG AGAGTCGGAGCCATTACTGCAGGAAAAGGTCCCG GAGAGCTGAGCAGTCAAGATGTGTGACTTCACCG AAGACCAGACCGCAGAGTTCAAGGAGGCCTTCCA GCTGTTTGACCGAACAGGTGATGGCAAGATCCTGT ACAGCCAGTGTGGGGATGTGATGAGGGCCCTGGG CCAGAACCCTACCAACGCCGAGGTGCTCAAGGTC CTGGGGAACCCCAAGAGTGATGAGATGAATGTGA AGGTGCTGGACTTTGAGCACTTTCTGCCCATGCTG CAGACAGTGGCCAAGAACAAGGACCAGGCACCTA TGAGGATTATGTCGAAGGACTTCGGGTGTTTGACA AGGAAGGAAATGGCACCGTCATGGGTGCTGAAAT CCGGCATGTTCTTGTCACACTGGGTGAGAAGATGA CAGAGGAAGAAGTAGAGATGCTGGTGGCAGGGCA TGAGGACAGCAATGGTTGTATCAACTATGAAGAGC TCGTCCGCATGGTGCTGAATGGCTGAGGACCTTC CCAGTCTCCCCAGAGTCCGTGCCTTTCCCTGTGTG AATTTTGTATCTAGCCTAAAGTTTCCCTAGGCTTTC TTGTCTCAGCAACTTTCCCATCTTGTCTCTCTTGGA TGATGTTTGCCGTCAGCATTCACCAAATAAACTTG CTCTCTGGGCCCTCGGTAAAA | 36 | APMRIMSK DFGCLTRK EMAPSWV LKSGMFLS HWVRR* |
| 2089 | NM_080592.2_458 | 458 | GGAGGGGCCCGAGTTTCTGCGAAGCCGCGACCTC GGCGTCCGGACGCGGGGAACACCGGGCTGAGGG AGTCTGCAGTCGGCTCCGGGAAGCCGCGCGGCG ACGGGGGAGGCCTTCACTAAAGGGGAAAAGGAAG AGGGGGTCGGCCAGTATCCCCGAAAGAGGGCTAG GGCGCATGAAGACCAGCGCAGAGCTCCACGAGCA GGAAAAGCCCCCAAGCAGCCCCAGGGCGACTGG ACCGGGCCGCTTAGGCCACGCCCGGGGAAGAGG GCCTGACGCGCTGCGGGGCGGGGCCGCGGGGC CGGGTCGCGCGAGCAGCGGAGCACCAAGGGAAC GGAAAATGGCGCCTCACGGCCCGGGTAGTCTTAC GACCCTGGTGCCCTGGGCTGCCGCCCTGCTCCTC GCTCTGGGCGTGGAAAGGGCTCTGGCGCTACCCG AGATATGCACCCAATGTCCAGGAGCGTGCAAAATT TGTCAAAAGTGGCCTTTTATTGTAAAACGACACGA GAGCTAATGCTGCATGCCCGTTGCTGCCTGAATCA GAAGGGCACCATCTTGGGGCTGGATCTCCAGAAC TGTTCTCTGGAGGACCCTGGTCCAAACTTTCATCA GGCACATACCACTGTCATCATAGACCTGCAAGCAA ACCCCCTCAAAGGTGACTTGGCCAACACCTTCCGT GGCTTTACTCAGCTCCAGACTCTGATACTGCCACA ACATGTCAACTGTCCTGGAGGAATTAATGCCTGGA ATACTATCACCTCTTATATAGACAACCAAATCTGTC AAGGGCAAAAGAACCTTTGCAATAACACTGGGGAC CCAGAAATGTGTCCTGAGAATGGATCTTGTGTACC TGATGGTCCAGGTCTTTTGCAGTGTGTTTGTGCTG ATGGTTTCCATGGATACAAGTGTATGCGCCAGGGC TCGTTCTCACTGCTTATGTTCTTCGGGATTCTGGG AGCCACCACTCTATCCGTCTCCATTCTGCTTTGGG CGACCCAGCGCCGAAAAGCCAAGACTTCA | 17 | ACKICQKW PFIVKRHE S* |
| 2090 | NM_139207.1_171 | 171 | CTGCTCGCGGCGCCGCCTCCTGCTCCTCCCGCTG CTGCTGCCGCTGCCGCCCTGAGTCACTGCCTGCG CAGCTCCGGCCGCCTGGCTCCCCATACTAGTCGC CGATATTTGGAGTTCTTACAACATGGCAGACATTG ACAACAAAGAACAGTCTGAACTTGATCAAGATTGG ATGATGTTGAAGAAGTAGAAGAAGAGGAAACTGGT GAAGAAACAAAACTCAAAGCACGTCAGCTAACTGT TCAGATGATGCAAAATCCTCAGATTCTTGCAGCCC TTCAAGAAAGACTTGATGGTCTGGTAGAAACACCA ACAGGATACATTGAAAGCCTGCCTAGGGTAGTTAA AAGACGAGTGAATGCTCTCAAAAACCTGCAAGTTA AATGTGCACAGATAGAAGCCAAATTCTATGAGGAA GTTCACGATCTTGAAAGGAAGTATGCTGTTCTCTAT CAGCCTCTATTTGATAAGCGATTTGAAATTATTAAT GCAATTTATGAACCTACGGAAGAAGAATGTGAATG GAAACCAGATGAAGAAGATGAGATTTCGGAGGAAT TGAAAGAAAAGGCCAAGATTGAAGATGAGAAAAAG GATGAAGAAAAAGAAGACCCCAAAGGAATTCCTGA ATTTTGGTTAACTGTTTTTAAGAATGTTGACTTGCT CAGTGATATGGTTCAGGAACACGATGAACCTATTC TGAAGCACTTGAAAGATATTAAAGTGAAGTTCTCA GATGCTGGCCAGCCTATGAGTTTTGTCTTAGAATT TCACTTTGAACCCAATGAATATTTTACAAATGAAGT GCTGACAAAGACATACAGGATGAGGTCAGAACCA GATGATTCTGATCCCTTTTCTTTTGATGGACCAGAA ATTATGGGTTGTACAGGGTGCCAGATAGATTGGAA | 6 | WMMLKK* |

TABLE 3A-continued

| SEQ ID | identifier_position | position | modified_RNA | PAP length | PAP |
|---|---|---|---|---|---|
| | | | AAAAGGAAAGAATGTCACTTTGAAAACTATTAAGAA<br>GAAGCAGAAACACAAGGGACGTGGGACAGTTCGT<br>ACTGTGACTAAAACAGTTTCCAATGACTCTTTCTTT<br>AACTTTT | | |
| 2091 | NM_145690.1_428 | 428 | GCCTGTGAGCAGCGAGATCCAGGGACAGAGTCTC<br>AGCCTCGCCGCTGCTGCCGCCGCCGCCGCCCAG<br>AGACTGCTGAGCCCGTCCGTCCGCCGCCACCACC<br>CACTCCGGACACAGAACATCCAGTCATGGATAAAA<br>ATGAGCTGGTTCAGAAGGCCAAACTGGCCGAGCA<br>GGCTGAGCGATATGATGACATGGCAGCCTGCATG<br>AAGTCTGTAACTGAGCAAGGAGCTGAATTATCCAA<br>TGAGGAGAGGAATCTTCTCTCAGTTGCTTATAAAA<br>ATGTTGTAGGAGCCCGTAGGTCATCTTGGAGGGT<br>CGTCTCAAGTATTGAACAAAAGACGGAAGGTGCTG<br>AGAAAAAACAGCAGATGGCTCGAGAATACAGAGA<br>GAAAATTGAGACGGAGCTAAGAGATATCTGCAATG<br>ATGTACTGTCTCTTTGGAAAAGTTCTTGATCCCCAA<br>TGCTTCACAAGCAGAGAGCAAAGTCTTCTATTTGA<br>AAATGAAAGGAGATTACTACCGTTACTTGGCTGAG<br>GTTGCCGCTGGTGATGACAAGAAAGGGATTGTCG<br>ATCAGTCACAACAAGCATACCAAGAAGCTTTTGAA<br>ATCAGCAAAAAGGAAATGCAACCAACACATCCTAT<br>CAGACTGGGTCTGGCCCTTAACTTCTCTGTGTTCT<br>ATTATGAGATTCTGAACTCCCCAGAGAAAGCCTGC<br>TCTCTTGCAAAGACAGCTTTTGATGAAGCCATTGC<br>TGAACTTGATACATTAAGTGAAGAGTCATACAAAG<br>ACAGCACGCTAATAATGCAATTACTGAGAGACAAC<br>TTGACATTGTGGACATCGGATACCCAAGGAGACGA<br>AGCTGAAGCAGGAGAAGGAGGGGAAAATTAACCG<br>GCCTTCCAACTTTTGTCTGCCTCATTCTAAAATTTA<br>CACAGTAGACCATTTGTCATCCATGCTGTCCCACA<br>AATAGTTTTTTGTTTACGATTATGACAGGTTTATGT<br>TACTTCTATTTGAATTTCTATATTTCCCATGTGGTTT<br>TTATGTTTAATAT | 4 | WKSS* |
| 2092 | NM_145690.1_714 | 714 | GCCTGTGAGCAGCGAGATCCAGGGACAGAGTCTC<br>AGCCTCGCCGCTGCTGCCGCCGCCGCCGCCCAG<br>AGACTGCTGAGCCCGTCCGTCCGCCGCCACCACC<br>CACTCCGGACACAGAACATCCAGTCATGGATAAAA<br>ATGAGCTGGTTCAGAAGGCCAAACTGGCCGAGCA<br>GGCTGAGCGATATGATGACATGGCAGCCTGCATG<br>AAGTCTGTAACTGAGCAAGGAGCTGAATTATCCAA<br>TGAGGAGAGGAATCTTCTCTCAGTTGCTTATAAAA<br>ATGTTGTAGGAGCCCGTAGGTCATCTTGGAGGGT<br>CGTCTCAAGTATTGAACAAAAGACGGAAGGTGCTG<br>AGAAAAAACAGCAGATGGCTCGAGAATACAGAGA<br>GAAAATTGAGACGGAGCTAAGAGATATCTGCAATG<br>ATGTACTGTCTCTTTGGAAAAGTTCTTGATCCCCA<br>ATGCTTCACAAGCAGAGAGCAAAGTCTTCTATTTG<br>AAAATGAAAGGAGATTACTACCGTTACTTGGCTGA<br>GGTTGCCGCTGGTGATGACAAGAAAGGGATTGTC<br>GATCAGTCACAACAAGCATACCAAGAAGCTTTTGA<br>AATCAGCAAAAAGGAAATGCAACCAACACATCCTA<br>TCAGACTGGGTCTGGCCCTTAACTTCTCTGTGTTC<br>TATTATGAGATTCTGAACTCCCCAGAGAAAGCCTG<br>CTCTCTTGCAAAGACAGCTTTTGATGAAGCCATTGC<br>TGAACTTGATACATTAAGTGAAGAGTCATACAAAG<br>ACAGCACGCTAATAATGCAATTACTGAGAGACAAC<br>TTGACATTGTGGACATCGGATACCCAAGGAGACGA<br>AGCTGAAGCAGGAGAAGGAGGGGAAAATTAACCG<br>GCCTTCCAACTTTTGTCTGCCTCATTCTAAAATTTA<br>CACAGTAGACCATTTGTCATCCATGCTGTCCCACA<br>AATAGTTTTTTGTTTACGATTATGACAGGTTTATGT<br>TACTTCTATTTGAATTTCTATATTTCCCATGTGGTTT<br>TTATGTTTAATAT | 10 | LMKPLLNLIH* |
| 2093 | NM_153201.1_105 | 105 | CTCATTGAACTCGCCTGCAGCTCTTGGGTTTTTG<br>TGGCTTCCTTCGTTATTGGAGCCAGGCCTACACCC<br>CAGCAACCATGTCCAAGGGACCTGCAGTTGGTAT<br>GATCTTGGCACCACCTACTCTTGTGTGGGTGTTTT<br>CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC | 19 | MILAPPTLVWVFSSTEKSR* |

TABLE 3A-continued

| SEQ ID | identifier_position | position | modified_RNA | PAP length | PAP |
|---|---|---|---|---|---|
| | | | AAAGATGAAGGAAATTGCAGAAGCCTACCTTGGGA AGACTGTTACCAATGCTGTGGTCACAGTGCCAGCT TACTTTAATGACTCTCAGCGTCAGGCTACCAAAGA TGCTGGAACTATTGCTGGTCTCAATGTACTTAGAAT TATTAATGAGCCAACTGCTGCTGCTATTGCTTACG GCTTAGACAAAAAGGTTGGAGCAGAAAGAAACGT GCTCATCTTTGACCTGGGAGGTGGCACTTTTGATG TGTCAATCCTCACTATTGAGGATGGAATCTTTGAG GTCAAGTCTACAGCTGGAGACACCCACTTGGGTG GAGAAGATTTTGACAACCGAATGGTCAACCATTTT ATTGCTGAGTTTAAGCGCAAGCATAAGAAGGACAT CAGTGAGAACAAGAGAGCTGTAAGACGCCTCCGT ACTGCTTGTGAACGTGCTAAGCGTACCCTCTCTTC CAGCACCCAGGCCAGTATTGAGATCGATTCTCTCT ATGAAGGAATCGACTTCTATACCTCCATTACCCGT GCCCGATTTGAAGAACTGAATGCTGACCTGTTCCG TGGCACCCTGGACCC | | |
| 2094 | NM_1532 01.1_165 | 165 | CTCATTGAACTCGCCTGCAGCTCTTGGGTTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATGCCAATGATCA GGGAAACCGAACCACTCCAAGCTATGTCGCCTTTA CGGACACTGAACGGTTGATCGGTGATGCCGCAAA GAATCAAGTTGCAATGAACCCCACCAACACAGTTT TTGATGCCAAACGTCTGATTGGACGCAGATTTGAT GATGCTGTTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 21 | MPMIRETE PLQAMSPL RTLNG* |
| 2095 | NM_1532 01.1_282 | 282 | CTCATTGAACTCGCCTGCAGCTCTTGGGTTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTGATGCCAAACGTCTGATTGGACGCAGATTTGAT GATGCTGTTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 5 | LMPNV* |

TABLE 3A-continued

| SEQ ID | identifier_position | position | modified_RNA | PAP length | PAP |
|---|---|---|---|---|---|
| 2096 | NM_153201.1_300 | 300 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATGGACGCAGATTTGAT GATGCTGTTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 13 | MDADLMM LLSSLI* |
| 2097 | NM_153201.1_324 | 324 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 4 | SSLI* |
| 2098 | NM_153201.1_346 | 346 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTTGTCCAGTCTGATATGAAACATTGGCC CTTTATGGTGGTGAATGATGCTGGCAGGCCCAAG GTCCAAGTAGAATACAAGGGAGAGACCAAAAGCTT CTATCCAGAGGAGGTGTCTTCTATGGTTCTGACAA AGATGAAGGAAATTGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT | 5 | GPLWW* |

TABLE 3A-continued

| SEQ ID | identifier_position | position | modified_RNA | PAP length | PAP |
|---|---|---|---|---|---|
| | | | ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | | |
| 2099 | NM_1532 01.1_468 | 468 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTTGTCCAGTCTGATATGAAACATTGGC CCTTTATGGTGGTGAATGATGCTGGCAGGCCCAA GGTCCAAGTAGAATACAAGGGAGAGACCAAAAGC TTCTATCCAGAGGAGGTGTCTTCTATGGTTCTGAC AAAGATGAAGGAAATGCAGAAGCCTACCTTGGGAA GACTGTTACCAATGCTGTGGTCACAGTGCCAGCTT ACTTTAATGACTCTCAGCGTCAGGCTACCAAAGAT GCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 55 | MQKPTLG RLLPMLWS QCQLTLMT LSVRLPKM LELLLVSM YLELLMSQ LLLLLLTA* |
| 2100 | NM_1532 01.1_570 | 570 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTTGTCCAGTCTGATATGAAACATTGGC CCTTTATGGTGGTGAATGATGCTGGCAGGCCCAA GGTCCAAGTAGAATACAAGGGAGAGACCAAAAGC TTCTATCCAGAGGAGGTGTCTTCTATGGTTCTGAC AAAGATGAAGGAAATTGCAGAAGCCTACCTTGGGA AGACTGTTACCAATGCTGTGGTCACAGTGCCAGCT TACTTTAATGACTCTCAGCGTCAGGCTACCAAAGA TGCTGGAACTATTGCTGGTCTCAATGTACTTAGAATT ATTAATGAGCCAACTGCTGCTGCTATTGCTTACGG CTTAGACAAAAAGGTTGGAGCAGAAAGAAACGTGC TCATCTTTGACCTGGGAGGTGGCACTTTTGATGTG TCAATCCTCACTATTGAGGATGGAATCTTTGAGGT CAAGTCTACAGCTGGAGACACCCACTTGGGTGGA GAAGATTTTGACAACCGAATGGTCAACCATTTTATT GCTGAGTTTAAGCGCAAGCATAAGAAGGACATCAG TGAGAACAAGAGAGCTGTAAGACGCCTCCGTACT GCTTGTGAACGTGCTAAGCGTACCCTCTCTTCCAG CACCCAGGCCAGTATTGAGATCGATTCTCTCTATG AAGGAATCGACTTCTATACCTCCATTACCCGTGCC CGATTTGAAGAACTGAATGCTGACCTGTTCCGTGG CACCCTGGACCC | 21 | MLVSMYLE LLMSQLLL LLLTA* |
| 2101 | NM_1532 01.1_621 | 621 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT | 4 | MLTA* |

TABLE 3A-continued

| SEQ ID | identifier_ position | position | modified_RNA | PAP length | PAP |
|---|---|---|---|---|---|
| | | | CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACGG<br>CTTAGACAAAAAGGTTGGAGCAGAAAGAAACGTGC<br>TCATCTTTGACCTGGGAGGTGGCACTTTTGATGTG<br>TCAATCCTCACTATTGAGGATGGAATCTTTGAGGT<br>CAAGTCTACAGCTGGAGACACCCACTTGGGTGGA<br>GAAGATTTTGACAACCGAATGGTCAACCATTTTATT<br>GCTGAGTTTAAGCGCAAGCATAAGAAGGACATCAG<br>TGAGAACAAGAGAGCTGTAAGACGCCTCCGTACT<br>GCTTGTGAACGTGCTAAGCGTACCCTCTCTTCCAG<br>CACCCAGGCCAGTATTGAGATCGATTCTCTCTATG<br>AAGGAATCGACTTCTATACCTCCATTACCCGTGCC<br>CGATTTGAAGAACTGAATGCTGACCTGTTCCGTGG<br>CACCCTGGACCC | | |
| 2102 | NM_1532<br>01.1_630 | 630 | CTCATTGAACTCGCCTGCAGCTCTTGGGTTTTTTG<br>TGGCTTCCTTCGTTATTGGAGCCAGGCCTACACCC<br>CAGCAACCATGTCCAAGGGACCTGCAGTTGGTATT<br>GATCTTGGCACCACCTACTCTTGTGTGGGTGTTTT<br>CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACG<br>GTTAGACAAAAAGGTTGGAGCAGAAAGAAACGTG<br>CTCATCTTTGACCTGGGAGGTGGCACTTTTGATGT<br>GTCAATCCTCACTATTGAGGATGGAATCTTTGAGG<br>TCAAGTCTACAGCTGGAGACACCCACTTGGGTGG<br>AGAAGATTTTGACAACCGAATGGTCAACCATTTTAT<br>TGCTGAGTTTAAGCGCAAGCATAAGAAGGACATCA<br>GTGAGAACAAGAGAGCTGTAAGACGCCTCCGTAC<br>TGCTTGTGAACGTGCTAAGCGTACCCTCTCTTCCA<br>GCACCCAGGCCAGTATTGAGATCGATTCTCTCTAT<br>GAAGGAATCGACTTCTATACCTCCATTACCCGTGC<br>CCGATTTGAAGAACTGAATGCTGACCTGTTCCGTG<br>GCACCCTGGACCC | 0 | * |
| 2103 | NM_1532<br>01.1_672 | 672 | CTCATTGAACTCGCCTGCAGCTCTTGGGTTTTTG<br>TGGCTTCCTTCGTTATTGGAGCCAGGCCTACACCC<br>CAGCAACCATGTCCAAGGGACCTGCAGTTGGTATT<br>GATCTTGGCACCACCTACTCTTGTGTGGGTGTTTT<br>CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACG<br>GCTTAGACAAAAAGGTTGGAGCAGAAAGAAACGT<br>GCTCATCTTTGACCTGGGAGGTGGCACTTTTGATGT<br>GTCAATCCTCACTATTGAGGATGGAATCTTTGAGG | 62 | LTWEVALL<br>MCQSSLLR<br>MESLRSSL<br>QLETPTWV<br>EKILTTEW<br>STILLLSLS<br>ASIRRTSV<br>RTREL* |

TABLE 3A-continued

| SEQ ID | identifier_position | position | modified_RNA | PAP length | PAP |
|---|---|---|---|---|---|
| | | | TCAAGTCTACAGCTGGAGACACCCACTTGGGTGG AGAAGATTTTGACAACCGAATGGTCAACCATTTTAT TGCTGAGTTTAAGCGCAAGCATAAGAAGGACATCA GTGAGAACAAGAGAGCTGTAAGACGCCTCCGTAC TGCTTGTGAACGTGCTAAGCGTACCCTCTCTTCCA GCACCCAGGCCAGTATTGAGATCGATTCTCTCTAT GAAGGAATCGACTTCTATACCTCCATTACCCGTGC CCGATTTGAAGAACTGAATGCTGACCTGTTCCGTG GCACCCTGGACCC | | |
| 2104 | NM_153201.1_693 | 693 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTTGTCCAGTCTGATATGAAACATTGGC CCTTTATGGTGGTGAATGATGCTGGCAGGCCCAA GGTCCAAGTAGAATACAAGGGAGAGACCAAAAGC TTCTATCCAGAGGAGGTGTCTTCTATGGTTCTGAC AAAGATGAAGGAAATTGCAGAAGCCTACCTTGGGA AGACTGTTACCAATGCTGTGGTCACAGTGCCAGCT TACTTTAATGACTCTCAGCGTCAGGCTACCAAAGA TGCTGGAACTATTGCTGGTCTCAATGTACTTAGAAT TATTAATGAGCCAACTGCTGCTGCTATTGCTTACG GCTTAGACAAAAAGGTTGGAGCAGAAAGAAACGT GCTCATCTTTGACCTGGGAGGTGGCACTTTGATGT GTCAATCCTCACTATTGAGGATGGAATCTTTGAGG TCAAGTCTACAGCTGGAGACACCCACTTGGGTGG AGAAGATTTTGACAACCGAATGGTCAACCATTTTAT TGCTGAGTTTAAGCGCAAGCATAAGAAGGACATCA GTGAGAACAAGAGAGCTGTAAGACGCCTCCGTAC TGCTTGTGAACGTGCTAAGCGTACCCTCTCTTCCA GCACCCAGGCCAGTATTGAGATCGATTCTCTCTAT GAAGGAATCGACTTCTATACCTCCATTACCCGTGC CCGATTTGAAGAACTGAATGCTGACCTGTTCCGTG GCACCCTGGACCC | 55 | LMCQSSLL RMESLRSS LQLETPTW VEKILTTE WSTILLLSL SASIRRTS VRTREL* |
| 2105 | NM_153201.1_714 | 714 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT TTTGATGCCAAACGTCTGATTGGACGCAGATTTGA TGATGCTGTTGTCCAGTCTGATATGAAACATTGGC CCTTTATGGTGGTGAATGATGCTGGCAGGCCCAA GGTCCAAGTAGAATACAAGGGAGAGACCAAAAGC TTCTATCCAGAGGAGGTGTCTTCTATGGTTCTGAC AAAGATGAAGGAAATTGCAGAAGCCTACCTTGGGA AGACTGTTACCAATGCTGTGGTCACAGTGCCAGCT TACTTTAATGACTCTCAGCGTCAGGCTACCAAAGA TGCTGGAACTATTGCTGGTCTCAATGTACTTAGAAT TATTAATGAGCCAACTGCTGCTGCTATTGCTTACG GCTTAGACAAAAAGGTTGGAGCAGAAAGAAACGT GCTCATCTTTGACCTGGGAGGTGGCACTTTTGATG TGTCAATCCTCACTATGAGGATGGAATCTTTGAGG TCAAGTCTACAGCTGGAGACACCCACTTGGGTGG AGAAGATTTTGACAACCGAATGGTCAACCATTTTAT TGCTGAGTTTAAGCGCAAGCATAAGAAGGACATCA GTGAGAACAAGAGAGCTGTAAGACGCCTCCGTAC TGCTTGTGAACGTGCTAAGCGTACCCTCTCTTCCA GCACCCAGGCCAGTATTGAGATCGATTCTCTCTAT GAAGGAATCGACTTCTATACCTCCATTACCCGTGC CCGATTTGAAGAACTGAATGCTGACCTGTTCCGTG GCACCCTGGACCC | 48 | MRMESLR SSLQLETP TWVEKILT TEWSTILLL SLSASIRRT SVRTREL* |
| 2106 | NM_153201.1_729 | 729 | CTCATTGAACTCGCCTGCAGCTCTTGGGTTTTTG TGGCTTCCTTCGTTATTGGAGCCAGGCCTACACCC CAGCAACCATGTCCAAGGGACCTGCAGTTGGTATT GATCTTGGCACCACCTACTCTTGTGTGGGTGTTTT CCAGCACGGAAAAGTCGAGATAATTGCCAATGATC AGGGAAACCGAACCACTCCAAGCTATGTCGCCTTT ACGGACACTGAACGGTTGATCGGTGATGCCGCAA AGAATCAAGTTGCAATGAACCCCACCAACACAGTT | 43 | LRSSLQLE TPTWVEKI LTTEWSTIL LLSLSASIR RTSVRTRE L* |

TABLE 3A-continued

| SEQ ID | identifier_position | position | modified_RNA | PAP length | PAP |
|---|---|---|---|---|---|
| | | | TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACG<br>GCTTAGACAAAAAGGTTGGAGCAGAAAGAAACGT<br>GCTCATCTTTGACCTGGGAGGTGGCACTTTTGATG<br>TGTCAATCCTCACTATTGAGGATGGAATCTTGAGG<br>TCAAGTCTACAGCTGGAGACACCCACTTGGGTGG<br>AGAAGATTTTGACAACCGAATGGTCAACCATTTTAT<br>TGCTGAGTTTAAGCGCAAGCATAAGAAGGACATCA<br>GTGAGAACAAGAGAGCTGTAAGACGCCTCCGTAC<br>TGCTTGTGAACGTGCTAAGCGTACCCTCTCTTCCA<br>GCACCCAGGCCAGTATTGAGATCGATTCTCTCTAT<br>GAAGGAATCGACTTCTATACCTCCATTACCCGTGC<br>CCGATTTGAAGAACTGAATGCTGACCTGTTCCGTG<br>GCACCCTGGACCC | | |
| 2107 | NM_1532<br>01.1_754 | 754 | CTCATTGAACTCGCCTGCAGCTCTTGGGTTTTTG<br>TGGCTTCCTTCGTTATTGGAGCCAGGCCTACACCC<br>CAGCAACCATGTCCAAGGGACCTGCAGTTGGTATT<br>GATCTTGGCACCACCTACTCTTGTGTGGGTGTTTT<br>CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACG<br>GCTTAGACAAAAAGGTTGGAGCAGAAAGAAACGT<br>GCTCATCTTTGACCTGGGAGGTGGCACTTTTGATG<br>TGTCAATCCTCACTATTGAGGATGGAATCTTTGAG<br>GTCAAGTCTACAGCTGGAGACCCCACTTGGGTGG<br>AGAAGATTTTGACAACCGAATGGTCAACCATTTTAT<br>TGCTGAGTTTAAGCGCAAGCATAAGAAGGACATCA<br>GTGAGAACAAGAGAGCTGTAAGACGCCTCCGTAC<br>TGCTTGTGAACGTGCTAAGCGTACCCTCTCTTCCA<br>GCACCCAGGCCAGTATTGAGATCGATTCTCTCTAT<br>GAAGGAATCGACTTCTATACCTCCATTACCCGTGC<br>CCGATTTGAAGAACTGAATGCTGACCTGTTCCGTG<br>GCACCCTGGACCC | 34 | PTWVEKIL<br>TTEWSTILL<br>LSLSASIRR<br>TSVRTREL* |
| 2108 | NM_1532<br>01.1777 | 777 | CTCATTGAACTCGCCTGCAGCTCTTGGGTTTTTG<br>TGGCTTCCTTCGTTATTGGAGCCAGGCCTACACCC<br>CAGCAACCATGTCCAAGGGACCTGCAGTTGGTATT<br>GATCTTGGCACCACCTACTCTTGTGTGGGTGTTTT<br>CCAGCACGGAAAAGTCGAGATAATTGCCAATGATC<br>AGGGAAACCGAACCACTCCAAGCTATGTCGCCTTT<br>ACGGACACTGAACGGTTGATCGGTGATGCCGCAA<br>AGAATCAAGTTGCAATGAACCCCACCAACACAGTT<br>TTTGATGCCAAACGTCTGATTGGACGCAGATTTGA<br>TGATGCTGTTGTCCAGTCTGATATGAAACATTGGC<br>CCTTTATGGTGGTGAATGATGCTGGCAGGCCCAA<br>GGTCCAAGTAGAATACAAGGGAGAGACCAAAAGC<br>TTCTATCCAGAGGAGGTGTCTTCTATGGTTCTGAC<br>AAAGATGAAGGAAATTGCAGAAGCCTACCTTGGGA<br>AGACTGTTACCAATGCTGTGGTCACAGTGCCAGCT<br>TACTTTAATGACTCTCAGCGTCAGGCTACCAAAGA<br>TGCTGGAACTATTGCTGGTCTCAATGTACTTAGAAT<br>TATTAATGAGCCAACTGCTGCTGCTATTGCTTACG<br>GCTTAGACAAAAAGGTTGGAGCAGAAAGAAACGT<br>GCTCATCTTTGACCTGGGAGGTGGCACTTTTGATG<br>TGTCAATCCTCACTATTGAGGATGGAATCTTTGAG<br>GTCAAGTCTACAGCTGGAGACACCCACTTGGGTG<br>GAGAAGATTTTGACAACCGAATGGTCAACCATTTTA<br>TTGCTGAGTTTAAGCGCAAGCATAAGAAGGACATC<br>AGTGAGAACAAGAGAGCTGTAAGACGCCTCCGTA | 27 | LTTEWSTIL<br>LLSLSASIR<br>RTSVRTRE<br>L* |

TABLE 3A-continued

| SEQ ID | identifier_position | position | modified_RNA | PAP length | PAP |
|---|---|---|---|---|---|
| | | | CTGCTTGTGAACGTGCTAAGCGTACCCTCTCTTCC AGCACCCAGGCCAGTATTGAGATCGATTCTCTCTA TGAAGGAATCGACTTCTATACCTCCATTACCCGTG CCCGATTTGAAGAACTGAATGCTGACCTGTTCCGT GGCACCCTGGACCC | | |
| 2109 | NM_170679.1_156 | 156 | CTGCGCCCTCTCCTATAAAGCAGACGCCGCGCCG CGCTGCGACGCTGTAGTGGCTTCGTCTTCGGTTTT TCTCTTCCTTCGCTAACGCCTCCCGGCTCTCGTCA GCCTCCCGCCGGCCGTCTCCTTAACACCGAACAC CATGCCTTCAATTAAGTGCAGAGTTCTGATGGAGA GATATTTGAAGTTGATGTGGAAATTGCCAAACAAT CTGTGACTATTAAGACCATGTTGGAAGATTTGGGA ATGGATGATGAAGGAGATGATGACCCAGTTCCTCT ACCAAATGTGAATGCAGCAATATTAAAAAAGGTCA TTCAGTGGTGCACCCACCACAAGGATGACCCTCCT CCTCCTGAAGATGATGAGAACAAAGAAAAGCGAAC AGATGATATCCCTGTTGGGACCAAGAATTCCTGA AAGTTGACCAAGGAACACTTTTTGAACTCATTCTG GCTGCAAACTACTTAGACATCAAAGGTTTGCTTGA TGTTACATGCAAGACTGTTGCCAATATGATCAAGG GGAAAACTCCTGAGGAGATTCGCAAGACCTTCAAT ATCAAAAATGACTTTACTGAAGAGGAGGAAGCCCA GGTACGCAAAGAGAACCAGTGGTGTGAAGAGAAG TGAAATGTTGTGCCTGACACTGTAACACTGTAAGG ATTGTTCCAAATACTAGTTGCACTGCTCTGTTTATA ATTGTTAATATTAGACAAACAGTAGACAAATGCAGC AGCAAGTCAATTGTATTAGCAGAATATTGTCCTCAT TGCATGTGTAGTTTGAGCACAGATCCCAAACCTTA CGGCCAAGTTTCTTCTAGTATGATGGAAAGTTTCTT TTTTCTTTGCTCTGAATAAAACTGAACTGTGGGTTC TCTATAAGTGGCATTTTGGGCTTTCCCTCTTTTTTG TAAAGCAATGTCTGCCTAGTTTATTGTCCAGTTAAC TTTAGTGACCTTTTAAAAGTTGGCATTGTAAATAAA ACAACTTGCAAAAAAGTTTTCTGGAATAGAATTAAC AAA | 19 | CRVLMERY LKLMWKLP NNL* |
| 2110 | NM_170679.1_199 | 199 | CTGCGCCCTCTCCTATAAAGCAGACGCCGCGCCG CGCTGCGACGCTGTAGTGGCTTCGTCTTCGGTTTT TCTCTTCCTTCGCTAACGCCTCCCGGCTCTCGTCA GCCTCCCGCCGGCCGTCTCCTTAACACCGAACAC CATGCCTTCAATTAAGTTGCAGAGTTCTGATGGAG AGATATTTGAAGTTGATGTGGAAATGCCAAACAAT CTGTGACTATTAAGACCATGTTGGAAGATTTGGGA ATGGATGATGAAGGAGATGATGACCCAGTTCCTCT ACCAAATGTGAATGCAGCAATATTAAAAAAGGTCA TTCAGTGGTGCACCCACCACAAGGATGACCCTCCT CCTCCTGAAGATGATGAGAACAAAGAAAAGCGAAC AGATGATATCCCTGTTGGGACCAAGAATTCCTGA AAGTTGACCAAGGAACACTTTTTGAACTCATTCTG GCTGCAAACTACTTAGACATCAAAGGTTTGCTTGA TGTTACATGCAAGACTGTTGCCAATATGATCAAGG GGAAAACTCCTGAGGAGATTCGCAAGACCTTCAAT ATCAAAAATGACTTTACTGAAGAGGAGGAAGCCCA GGTACGCAAAGAGAACCAGTGGTGTGAAGAGAAG TGAAATGTTGTGCCTGACACTGTAACACTGTAAGG ATTGTTCCAAATACTAGTTGCACTGCTCTGTTTATA ATTGTTAATATTAGACAAACAGTAGACAAATGCAGC AGCAAGTCAATTGTATTAGCAGAATATTGTCCTCAT TGCATGTGTAGTTTGAGCACAGATCCCAAACCTTA CGGCCAAGTTTCTTCTAGTATGATGGAAAGTTTCTT TTTTCTTTGCTCTGAATAAAACTGAACTGTGGGTTC TCTATAAGTGGCATTTTGGGCTTTCCCTCTTTTTTG TAAAGCAATGTCTGCCTAGTTTATTGTCCAGTTAAC TTTAGTGACCTTTTAAAAGTTGGCATTGTAAATAAA ACAACTTGCAAAAAAGTTTTCTGGAATAGAATTAAC AAA | 5 | MPNNL* |
| 2111 | NM_170679.1361 | 361 | CTGCGCCCTCTCCTATAAAGCAGACGCCGCGCCG CGCTGCGACGCTGTAGTGGCTTCGTCTTCGGTTTT TCTCTTCCTTCGCTAACGCCTCCCGGCTCTCGTCA GCCTCCCGCCGGCCGTCTCCTTAACACCGAACAC CATGCCTTCAATTAAGTGCAGAGTTCTGATGGAG AGATATTTGAAGTTGATGTGGAAATTGCCAAACAAT CTGTGACTATTAAGACCATGTTGGAAGATTTGGGA ATGGATGATGAAGGAGATGATGACCCAGTTCCTCT ACCAAATGTGAATGCAGCAATATTAAAAAAGGTCA TTCAGTGGTGCACCCACCACAAGGATGACCCTCCT CCTCCTGAAGATGATGAGAACAAAGAAAAGCGAACA GATGATATCCCTGTTGGGACCAAGAATTCCTGAA | 19 | EMRTKKSE QMISLFGT KNS* |

TABLE 3A-continued

| SEQ ID | identifier_position | position | modified_RNA | PAP length | PAP |
|---|---|---|---|---|---|
| | | | AGTTGACCAAGGAACACTTTTTGAACTCATTCTGG<br>CTGCAAACTACTTAGACATCAAAGGTTTGCTTGAT<br>GTTACATGCAAGACTGTTGCCAATATGATCAAGGG<br>GAAAACTCCTGAGGAGATTCGCAAGACCTTCAATA<br>TCAAAAATGACTTTACTGAAGAGGAGGAAGCCCAG<br>GTACGCAAAGAGAACCAGTGGTGTGAAGAGAAGT<br>GAAATGTTGTGCCTGACACTGTAACACTGTAAGGA<br>TTGTTCCAAATACTAGTTGCACTGCTCTGTTTATAA<br>TTGTTAATATTAGACAAACAGTAGACAAATGCAGCA<br>GCAAGTCAATTGTATTAGCAGAATATTGTCCTCATT<br>GCATGTGTAGTTTGAGCACAGATCCCAAACCTTAC<br>GGCCAAGTTTCTTCTAGTATGATGGAAAGTTTCTTT<br>TTTCTTTGCTCTGAATAAAACTGAACTGTGGGTTCT<br>CTATAAGTGGCATTTTGGGCTTTCCCTCTTTTTTGT<br>AAAGCAATGTCTGCCTAGTTTATTGTCCAGTTAACT<br>TTAGTGACCTTTTAAAAGTTGGCATTGTAAATAAAA<br>CAACTTGCAAAAAAGTTTTCTGGAATAGAATTAACA<br>AA | | |
| 2112 | NM_170679.1_508 | 508 | CTGCGCCCTCTCCTATAAAGCAGACGCCGCGCCG<br>CGCTGCGACGCTGTAGTGGCTTCGTCTTCGGTTTT<br>TCTCTTCCTTCGCTAACGCCTCCCGGCTCTCGTCA<br>GCCTCCCGCCGGCCGTCTCCTTAACACCGAACAC<br>CATGCCTTCAATTAAGTTGCAGAGTTCTGATGGAG<br>AGATATTTGAAGTTGATGTGGAAATTGCCAAACAAT<br>CTGTGACTATTAAGACCATGTTGGAAGATTTGGGA<br>ATGGATGATGAAGGAGATGATGACCCAGTTCCTCT<br>ACCAAATGTGAATGCAGCAATATTAAAAAAGGTCA<br>TTCAGTGGTGCACCCACCACAAGGATGACCCTCCT<br>CCTCCTGAAGATGATGAGAACAAAGAAAAGCGAAC<br>AGATGATATCCCTGTTTGGGACCAAGAATTCCTGA<br>AAGTTGACCAAGGAACACTTTTTGAACTCATTCTG<br>GCTGCAAACTACTTAGACATCAAAGGTTTGCTTGA<br>TGTTACATGCAAGACTGTGCCAATATGATCAAGGG<br>GAAAACTCCTGAGGAGATTCGCAAGACCTTCAATA<br>TCAAAAATGACTTTACTGAAGAGGAGGAAGCCCAG<br>GTACGCAAAGAGAACCAGTGGTGTGAAGAGAAGT<br>GAAATGTTGTGCCTGACACTGTAACACTGTAAGGA<br>TTGTTCCAAATACTAGTTGCACTGCTCTGTTTATAA<br>TTGTTAATATTAGACAAACAGTAGACAAATGCAGCA<br>GCAAGTCAATTGTATTAGCAGAATATTGTCCTCATT<br>GCATGTGTAGTTTGAGCACAGATCCCAAACCTTAC<br>GGCCAAGTTTCTTCTAGTATGATGGAAAGTTTCTTT<br>TTTCTTTGCTCTGAATAAAACTGAACTGTGGGTTCT<br>CTATAAGTGGCATTTTGGGCTTTCCCTCTTTTTTGT<br>AAAGCAATGTCTGCCTAGTTTATTGTCCAGTTAACT<br>TTAGTGACCTTTTAAAAGTTGGCATTGTAAATAAAA<br>CAACTTGCAAAAAAGTTTTCTGGAATAGAATTAACA<br>AA | 2 | PI* |
| 2113 | NM_170707.2_489 | 489 | AGGAGGACCTATTAGAGCCTTTGCCCCGGCGTCG<br>GTGACTCAGTGTTCGCGGGAGCGCCGCACCTACA<br>CCAGCCAACCCAGATCCCGAGGTCCGACAGCGCC<br>CGGCCCAGATCCCCACGCCTGCCAGGAGCAAGCC<br>GAGAGCCAGCCGGCCGGCGCACTCCGACTCCGA<br>GCAGTCTCTGTCCTTCGACCCGAGCCCCGCGCCC<br>TTTCCGGGACCCCTGCCCCGCGGGCAGCGCTGCC<br>AACCTGCCGGCCATGGAGACCCCGTCCCAGCGGC<br>GCGCCACCCGCAGCGGGGCGCAGGCCAGCTCCA<br>CTCCGCTGTCGCCCACCCGCATCACCCGGCTGCA<br>GGAGAAGGAGGACCTGCAGGAGCTCAATGATCGC<br>TTGGCGGTCTACATCGACCGTGTGCGCTCGCTGG<br>AAACGGAGAACGCAGGGCTGCGCCTTCGCATCAC<br>CGAGTCTGAAGAGGTGGTCAGCCGCGAGGTGTCC<br>GGCATCAAGGCCGCTACGAGGCCGAGCTCGGGG<br>ATGCCCGCAAGACCCTTGACTCAGTAGCCAAGGA<br>GCGCGCCCGCCTGCAGCTGGAGCTGAGCAAAGT<br>GCGTGAGGAGTTTAAGGAGCTGAAAGCGCGCAAT<br>ACCAAGAAGGAGGGTGACCTGATAGCTGCTCAGG<br>CTCGGCTGAAGGACCTGGAGGCTCTGCTGAACTC<br>CAAGGAGGCCGCACTGAGCACTGCTCTCAGTGAG<br>AAGCGCACGCTGGAGGGCGAGCTGCATGATCTGC<br>GGGGCCAGGTGGCCAAGCTTGAGGCAGCCCTAG<br>GTGAGGCCAAGAAGCAACTTCAGGATGAGATGCT<br>GCGGCGGGTGGATGCTGAGAACAGGCTGCAGAC<br>CATGAAGGAGGAACTGGACTTCCAGAAGAACATCT<br>ACAGTGAGGAGCTGCGTGAGACCAAGCGCCGTCA<br>TGAGACCCGACTGGTGGAGATTGACAATGGGAAG<br>CAGCGTGAGTTTGAGAGCCGGCTGGCGGATGCGC | 14 | TRPSSGM PARPLTQ* |

TABLE 3A-continued

| SEQ ID | identifier_ position | position | modified_RNA | PAP length | PAP |
|---|---|---|---|---|---|
| | | | TGCAGGAACTGCGGGCCCAGCATGAGGACCAGGT GGAGCAGTA | | |
| 2114 | NM_1749 09.3_156 | 156 | GGAAGGGTGATGTGGCTGCGGCATCGCCGGCCTC GCTATGTCTGCCATTTTCAATTTTCAGAGTCTATTG ACTGTAATCTTGCTGCTTATATGTACCTGTGCTTAT ATTCGATCCTTGGCACCCAGCCTCCTGGACAGAAA TAAAACTGGATTGTGGGTATATTTTGGAAGTGTGC CAGAATTGGTGAACGGAAGAGTCCTTATGTTGCAG TATGCTGTATAGTAATGGCCTTCAGCATCCTCTTCA TACAGTAGCTGGGGAAAATGCCAGAATGTAGTTGC CATCAGATTTGATTGTGAACAAGGACTGACTGCAG AAAATAATGGAAAGGATGTTTAACTCTTTTATCTCC GAACATTGAATGAGATAAATTTCCAGATGCTGTTCT CTATTTTAATGTTATTGGACCAATGTTCTGTATAAA CAATTAAGATGTAACCATTTAATAGTCTGTAACAAT CAACCTCAGTACTGTCACTACAATATTACATTCTGC AAATGTTATTCTGTTGTATCAGATACAAAATTTTAGT GAGGTATCTCTAAGGCACATAGTAGAAAACAAAAT TGGTTAATTACTCAAGTTCCTTTCACTGTGATTTGG AAATGATTTAATCTTTATAGAATGAGAACCTTTTTTG GACTAGCTTTTTTATTAAAATGGCTCAATTTGTGTT GATAAGGATTGCATTAATATTTAATAGTGCTTGCTT TTCCTCTGGGCACACCATTTTGATCATTAACCAGA GTACCTCTACTCTTAGCAAACTCTAGTTTATGACAA GTATTTAAAATATTTAAAACAAGCTTATGCAGTTCT TAAGGACGAAGGTAAATGAGATGTAACTTAAAAAT AGTATTGGGAAAATGTTGATAGTTAACATTAGTGG ATTTAGACTAGCCAAATGACATAGTAGGCTCTGAA ACATCTTGTCAAGTATATGTATTTTGTGCATGAATT TTTGCTGGAAAGCTGTCTTTCTCTGAAAAACACAA CGTTCTTAGAATGAAAAGAACAATTAT | 22 | WVYFGSV PELVNGRV LMLQYAV* |
| 2115 | NM_1749 09.3_167 | 167 | GGAAGGGTGATGTGGCTGCGGCATCGCCGGCCTC GCTATGTCTGCCATTTTCAATTTTCAGAGTCTATTG ACTGTAATCTTGCTGCTTATATGTACCTGTGCTTAT ATTCGATCCTTGGCACCCAGCCTCCTGGACAGAAA TAAAACTGGATTGTTGGGTATATTTGGAAGTGTGC CAGAATTGGTGAACGGAAGAGTCCTTATGTTGCAG TATGCTGTATAGTAATGGCCTTCAGCATCCTCTTCA TACAGTAGCTGGGGAAAATGCCAGAATGTAGTTGC CATCAGATTTGATTGTGAACAAGGACTGACTGCAG AAAATAATGGAAAGGATGTTTAACTCTTTTATCTCC GAACATTGAATGAGATAAATTTCCAGATGCTGTTCT CTATTTTAATGTTATTGGACCAATGTTCTGTATAAA CAATTAAGATGTAACCATTTAATAGTCTGTAACAAT CAACCTCAGTACTGTCACTACAATATTACATTCTGC AAATGTTATTCTGTTGTATCAGATACAAAATTTTAGT GAGGTATCTCTAAGGCACATAGTAGAAAACAAAAT TGGTTAATTACTCAAGTTCCTTTCACTGTGATTTGG AAATGATTTAATCTTTATAGAATGAGAACCTTTTTTG GACTAGCTTTTTTATTAAAATGGCTCAATTTGTGTT GATAAGGATTGCATTAATATTTAATAGTGCTTGCTT TTCCTCTGGGCACACCATTTTGATCATTAACCAGA GTACCTCTACTCTTAGCAAACTCTAGTTTATGACAA GTATTTAAAATATTTAAAACAAGCTTATGCAGTTCT TAAGGACGAAGGTAAATGAGATGTAACTTAAAAAT AGTATTGGGAAAATGTTGATAGTTAACATTAGTGG ATTTAGACTAGCCAAATGACATAGTAGGCTCTGAA ACATCTTGTCAAGTATATGTATTTTGTGCATGAATT TTTGCTGGAAAGCTGTCTTTCTCTGAAAAACACAA CGTTCTTAGAATGAAAAGAACAATTAT | 18 | GSVPELVN GRVLMLQY AV* |
| 2116 | NM_1774 33.1_604 | 604 | GGAGGCTGAGACTTCGAGAGGGACTTAGAGAAGG CAGACGCATCCCGAACTCGCTGGAGGACAAGGCT CAGCTCTTGCCAGGCCAAATTGAGACATGTCTGAC ACAAGCGAGAGTGGTGCAGGTCTAACTCGCTTCC AGGCTGAAGCTTCAGAAAAGGACAGTAGCTCGAT GATGCAGACTCTGTTGACAGTGACCCAGAATGTG GAGGTCCCAGAGACACCGAAGGCCTCAAAGGCAC TGGAGGTCTCAGAGGATGTGAAGGTCTCAAAAGC CTCTGGGGTCTCAAAGGCCACAGAGGTCTCAAAG ACCCCAGAGGCTCGGGAGGCACCTGCCACCCAG GCCTCATCTACTACTCAGCTGACTGATACCCAGGT TCTGGCAGCTGAAAAACAAGAGTCTAGCAGCTGACA CCAAGAAACAGAATGCTGACCCGCAGGCTGTGAC AATGCCTGCCACTGAGACCAAAAAGGTCAGCCAT GTGGCTGATACAAAGGTCAATACAAAGGCTCAGGA GACTGAGGCTGCACCCTCTCAGGCCCCAGCAGAT GAACCTGAGCCTGAGAGTGCAGCTGCCCAGTCTC | 9 | RSKPRKPE R* |

TABLE 3A-continued

| SEQ ID | identifier_position | position | modified_RNA | PAP length | PAP |
|---|---|---|---|---|---|
| | | | AGGAGAATCAGGATACTCGGCCAAGGTCAAAGCC<br>AAGAAAGCCCGAAAGGTGAAGCATCTGGATGGGG<br>AAGAGGATGGCAGCAGTGATCAGAGTCAGGCTTC<br>TGGAACCACAGGTGGCCGAAGGGTCTCAAAGGCC<br>CTAATGGCCTCAATGGCCCGCAGGGCTTCAAGGG<br>GTCCCATAGCCTTTTGGGCCCGCAGGGCATCAAG<br>GACTCGGTTGGCTGCTTGGGCCCGGAGAGCCTTG<br>CTCTCCCTGAGATCACCTAAAGCCCGTAGGGGCA<br>AGGCTCGCCGTAGAGCTGCCAAGCTCCAGTCATC<br>CCAAGAGCCTGAAGCACCACCACCTCGGGATGTG<br>GCCCTTTTGCAAGGGAGGGCAAATGATTTGGTGAA<br>GTACCTTTTGGCTAAAGACCAGACGAAGATTCCCA<br>TCAAGCGCTCGGACATGCTGAAGGACATCATCA | | |
| 2117 | NM_1780<br>14.2_103<br>3 | 1033 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAAGTGTCTGA<br>CACCGTGGTCGAGCCCTACAATGCCACCCTCTCC<br>GTCCATCAGTTGGTAGAGAATACTGATGAGACCTA<br>TTGCATTGACAACGAGGCCCTCTATGATATCTGCT<br>TCCGCACTCTGAAGCTGACCACACCAACCTACGG<br>GGATCTGAACCACCTTGTCTCAGCCACCATGAGTG<br>GTGTCACCACCTGCCTCCGTTTCCCTGGCCAGCTC<br>AATGCTGACCTCCGCAAGTTGGCAGTCAACATGGT<br>CCCCTTCCCACGTCTCCATTTCTTTATGCCTGGCTT<br>TGCCCCTCTCACCAGCCGTGGAAGCCAGCAGTAT<br>CGAGCTCTCACAGTGCCGGAACTCACCCAGCAGG<br>TCTTCGATGCCAAGAACATG | 20 | VTPATADT<br>SPWLLSSV<br>VGCP* |
| 2118 | NM_1780<br>14.2_105<br>2 | 1052 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAAGTGTCTGA<br>CACCGTGGTCGAGCCCTACAATGCCACCCTCTCC<br>GTCCATCAGTTGGTAGAGAATACTGATGAGACCTA<br>TTGCATTGACAACGAGGCCCTCTATGATATCTGCT<br>TCCGCACTCTGAAGCTGACCACACCAACCTACGG<br>GGATCTGAACCACCTTGTCTCAGCCACCATGAGTG<br>GTGTCACCACCTGCCTCCGTTTCCCTGGCCAGCTC<br>AATGCTGACCTCCGCAAGTTGGCAGTCAACATGGT<br>CCCCTTCCCACGTCTCCATTTCTTTATGCCTGGCTT<br>TGCCCCTCTCACCAGCCGTGGAAGCCAGCAGTAT<br>CGAGCTCTCACAGTGCCGGAACTCACCCAGCAGG<br>TCTTCGATGCCAAGAACATG | 14 | DTSPWLLS<br>SVVGCP* |
| 2119 | NM_1780<br>14.2_370 | 370 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT | 54 | LARSLDQT<br>TLYLVSLG<br>QVTTGPKA<br>TTQRAPS |

TABLE 3A-continued

| SEQ ID | identifier_position | position | modified_RNA | PAP length | PAP |
|---|---|---|---|---|---|
| | | | GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTGGCCAGATCTTT<br>AGACCAGACAACTTTGTATTTGGTCAGTCTGGGGC<br>AGGTAACAACTGGGCCAAAGGCCACTACACAGAG<br>GGCGCCGAGCTGGTTGATTCTGTCCTGGATGTGG<br>TACGGAAGGAGGCAGAGAGCTGTGACTGCCTGCA<br>GGGCTTCCAGCTGACCCACTCACTGGGCGGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | | WLILSWM<br>WYGRRQR<br>AVTACRAS<br>S* |
| 2120 | NM_17801<br>4.2_397 | 397 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGGC<br>AGGTAACAACTGGGCCAAAGGCCACTACACAGAG<br>GGCGCCGAGCTGGTTGATTCTGTCCTGGATGTGG<br>TACGGAAGGAGGCAGAGAGCTGTGACTGCCTGCA<br>GGGCTTCCAGCTGACCCACTCACTGGGCGGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 45 | LYLVSLGQ<br>VTTGPKAT<br>TQRAPSW<br>LILSWMWY<br>GRRQRAV<br>TACRASS* |
| 2121 | NM_17801<br>4.2_403 | 403 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGGC<br>AGGTAACAACTGGGCCAAAGGCCACTACACAGAG<br>GGCGCCGAGCTGGTTGATTCTGTCCTGGATGTGG<br>TACGGAAGGAGGCAGAGAGCTGTGACTGCCTGCA<br>GGGCTTCCAGCTGACCCACTCACTGGGCGGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT | 43 | LVSLGQVT<br>TGPKATTQ<br>RAPSWLIL<br>SWMWYGR<br>RQRAVTAC<br>RASS* |

TABLE 3A-continued

| SEQ ID | identifier_position | position | modified_RNA | PAP length | PAP |
|---|---|---|---|---|---|
| | | | TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | | |
| 2122 | NM_17801<br>4.2_515 | 515 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGCA<br>GGGCTTCCAGCTGACCCACTCACTGGGCGGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 5 | CRASS* |
| 2123 | NM_17801<br>4.2_546 | 546 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGCGGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 24 | AGAQALE<br>WALSLSAR<br>SEKNTLIAS* |
| 2124 | NM_17801<br>4.2_552 | 552 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC | 22 | AQALEWAL<br>SLSARSEK<br>NTLIAS* |

TABLE 3A-continued

| SEQ ID | identifier_ position | position | modified_RNA | PAP length | PAP |
|---|---|---|---|---|---|
| | | | TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGC<br>ACAGGCTCTGGAATGGGCACTCTCCTTATCAGCAA<br>GATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | | |
| 2125 | NM_1780 14.2_606 | 606 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGC<br>CACAGGCTCTGGAATGGGCACTCTCCTTATCAGCA<br>AGATCCGAGAAGAATACCCTGATCGCATCATGAATA<br>CCTTCAGTGTGGTGCCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 4 | LIAS* |
| 2126 | NM_1780 14.2_639 | 639 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCTTCACCCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA | 22 | LHPKCLTP WSSPTMP PSPSISW* |

TABLE 3A-continued

| SEQ ID | identifier_position | position | modified_RNA | PAP length | PAP |
|---|---|---|---|---|---|
| | | | ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | | |
| 2127 | NM_17801<br>4.2_646 | 646 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCAAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 18 | CLTPWSSP<br>TMPPSPSI<br>SW* |
| 2128 | NM_17801<br>4.2_649 | 649 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAGTGTCTGAC<br>ACCGTGGTCGAGCCCTACAATGCCACCCTCTCCG<br>TCCATCAGTTGGTAGAGAATACTGATGAGACCTAT<br>TGCATTGACAACGAGGCCCTCTATGATATCTGCTT<br>CCGCACTCTGAAGCTGACCACACCAACCTACGGG<br>GATCTGAACCACCTTGTCTCAGCCACCATGAGTGG<br>TGTCACCACCTGCCTCCGTTTCCCTGGCCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 18 | CLTPWSSP<br>TMPPSPSI<br>SW* |
| 2129 | NM_17801<br>4.2_673 | 673 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG | 10 | TMPPSPSI<br>SW* |

TABLE 3A-continued

| SEQ ID | identifier_ position | position | modified_RNA | PAP length | PAP |
|---|---|---|---|---|---|
| | | | CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC AGGGCTTCCAGCTGACCCACTCACTGGGCGGGGG CACAGGCTCTGGAATGGGCACTCTCCTTATCAGCA AGATCCGAGAAGAATACCCTGATCGCATCATGAAT ACCTTCAGTGTGGTGCCTTCACCCAAAGTGTCTGA CACCGTGGTCGAGCCTACAATGCCACCCTCTCCG TCCATCAGTTGGTAGAGAATACTGATGAGACCTAT TGCATTGACAACGAGGCCCTCTATGATATCTGCTT CCGCACTCTGAAGCTGACCACACCAACCTACGGG GATCTGAACCACCTTGTCTCAGCCACCATGAGTGG TGTCACCACCTGCCTCCGTTTCCCTGGCCAGCTCA ATGCTGACCTCCGCAAGTTGGCAGTCAACATGGTC CCCTTCCCACGTCTCCATTTCTTTATGCCTGGCTTT GCCCCTCTCACCAGCCGTGGAAGCCAGCAGTATC GAGCTCTCACAGTGCCGGAACTCACCCAGCAGGT CTTCGATGCCAAGAACATGA | | |
| 2130 | NM_1780 14.2_686 | 686 | GCACCTCGCTGCTCCAGCCTCTGGGGCGCATTCC AACCTTCCAGCCTGCGACCTGCGGAGAAAAAAAAT TACTTATTTTCTTGCCCCATACATACCTTGAGGCGA GCAAAAAAATTAAATTTTAACCATGAGGGAAATCGT GCACATCCAGGCTGGTCAGTGTGGCAACCAGATC GGTGCCAAGTTCTGGGAGGTGATCAGTGATGAAC ATGGCATCGACCCCACCGGCACCTACCACGGGGA CAGCGACCTGCAGCTGGACCGCATCTCTGTGTAC TACAATGAAGCCACAGGTGGCAAATATGTTCCTCG TGCCATCCTGGTGGATCTAGAACCTGGGACCATG GACTCTGTTCGCTCAGGTCCTTTTGGCCAGATCTT TAGACCAGACAACTTTGTATTTGGTCAGTCTGGGG CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC AGGGCTTCCAGCTGACCCACTCACTGGGCGGGGG CACAGGCTCTGGAATGGGCACTCTCCTTATCAGCA AGATCCGAGAAGAATACCCTGATCGCATCATGAAT ACCTTCAGTGTGGTGCCTTCACCCAAAGTGTCTGA CACCGTGGTCGAGCCCTACAATGCCACCCTCTCCG TCCATCAGTTGGTAGAGAATACTGATGAGACCTAT TGCATTGACAACGAGGCCCTCTATGATATCTGCTT CCGCACTCTGAAGCTGACCACACCAACCTACGGG GATCTGAACCACCTTGTCTCAGCCACCATGAGTGG TGTCACCACCTGCCTCCGTTTCCCTGGCCAGCTCA ATGCTGACCTCCGCAAGTTGGCAGTCAACATGGTC CCCTTCCCACGTCTCCATTTCTTTATGCCTGGCTTT GCCCCTCTCACCAGCCGTGGAAGCCAGCAGTATC GAGCTCTCACAGTGCCGGAACTCACCCAGCAGGT CTTCGATGCCAAGAACATGA | 6 | SPSISW* |
| 2131 | NM_1780 14.2_702 | 702 | GCACCTCGCTGCTCCAGCCTCTGGGGCGCATTCC AACCTTCCAGCCTGCGACCTGCGGAGAAAAAAAAT TACTTATTTTCTTGCCCCATACATACCTTGAGGCGA GCAAAAAAATTAAATTTTAACCATGAGGGAAATCGT GCACATCCAGGCTGGTCAGTGTGGCAACCAGATC GGTGCCAAGTTCTGGGAGGTGATCAGTGATGAAC ATGGCATCGACCCCACCGGCACCTACCACGGGGA CAGCGACCTGCAGCTGGACCGCATCTCTGTGTAC TACAATGAAGCCACAGGTGGCAAATATGTTCCTCG TGCCATCCTGGTGGATCTAGAACCTGGGACCATG GACTCTGTTCGCTCAGGTCCTTTTGGCCAGATCTT TAGACCAGACAACTTTGTATTTGGTCAGTCTGGGG CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC AGGGCTTCCAGCTGACCCACTCACTGGGCGGGGG CACAGGCTCTGGAATGGGCACTCTCCTTATCAGCA AGATCCGAGAAGAATACCCTGATCGCATCATGAAT ACCTTCAGTGTGGTGCCTTCACCCAAAGTGTCTGA CACCGTGGTCGAGCCCTACAATGCCACCCTCTCC GTCCATCAGTGGTAGAGAATACTGATGAGACCTAT TGCATTGACAACGAGGCCCTCTATGATATCTGCTT CCGCACTCTGAAGCTGACCACACCAACCTACGGG GATCTGAACCACCTTGTCTCAGCCACCATGAGTGG TGTCACCACCTGCCTCCGTTTCCCTGGCCAGCTCA ATGCTGACCTCCGCAAGTTGGCAGTCAACATGGTC CCCTTCCCACGTCTCCATTTCTTTATGCCTGGCTTT GCCCCTCTCACCAGCCGTGGAAGCCAGCAGTATC | 1 | W* |

TABLE 3A-continued

| SEQ ID | identifier_ position | position | modified_RNA | PAP length | PAP |
|---|---|---|---|---|---|
| 2132 | NM_1780 14.2_746 | 746 | GAGCTCTCACAGTGCCGGAACTCACCCAGCAGGT CTTCGATGCCAAGAACATGA GCACCTCGCTGCTCCAGCCTCTGGGGCGCATTCC AACCTTCCAGCCTGCGACCTGCGGAGAAAAAAAAT TACTTATTTTCTTGCCCCATACATACCTTGAGGCGA GCAAAAAAATTAAATTTTAACCATGAGGGAAATCGT GCACATCCAGGCTGGTCAGTGTGGCAACCAGATC GGTGCCAAGTTCTGGGAGGTGATCAGTGATGAAC ATGGCATCGACCCCACCGGCACCTACCACGGGGA CAGCGACCTGCAGCTGGACCGCATCTCTGTGTAC TACAATGAAGCCACAGGTGGCAAATATGTTCCTCG TGCCATCCTGGTGGATCTAGAACCTGGGACCATG GACTCTGTTCGCTCAGGTCCTTTTGGCCAGATCTT TAGACCAGACAACTTTGTATTTGGTCAGTCTGGGG CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC AGGGCTTCCAGCTGACCCACTCACTGGGCGGGGG CACAGGCTCTGGAATGGGCACTCTCCTTATCAGCA AGATCCGAGAAGAATACCCTGATCGCATCATGAAT ACCTTCAGTGTGGTGCCTTCACCCAAAGTGTCTGA CACCGTGGTCGAGCCCTACAATGCCACCCTCTCC GTCCATCAGTTGGTAGAGAATACTGATGAGACCTA TTGCATTGACAACGAGGCCTCTATGATATCTGCTT CCGCACTCTGAAGCTGACCACACCAACCTACGGG GATCTGAACCACCTTGTCTCAGCCACCATGAGTGG TGTCACCACCTGCCTCCGTTTCCCTGGCCAGCTCA ATGCTGACCTCCGCAAGTTGGCAGTCAACATGGTC CCCTTCCCACGTCTCCATTTCTTTATGCCTGGCTTT GCCCCTCTCACCAGCCGTGGAAGCCAGCAGTATC GAGCTCTCACAGTGCCGGAACTCACCCAGCAGGT CTTCGATGCCAAGAACATGA | 8 | SMISASAL* |
| 2133 | NM_1780 14.2_786 | 786 | GCACCTCGCTGCTCCAGCCTCTGGGGCGCATTCC AACCTTCCAGCCTGCGACCTGCGGAGAAAAAAAAT TACTTATTTTCTTGCCCCATACATACCTTGAGGCGA GCAAAAAAATTAAATTTTAACCATGAGGGAAATCGT GCACATCCAGGCTGGTCAGTGTGGCAACCAGATC GGTGCCAAGTTCTGGGAGGTGATCAGTGATGAAC ATGGCATCGACCCCACCGGCACCTACCACGGGGA CAGCGACCTGCAGCTGGACCGCATCTCTGTGTAC TACAATGAAGCCACAGGTGGCAAATATGTTCCTCG TGCCATCCTGGTGGATCTAGAACCTGGGACCATG GACTCTGTTCGCTCAGGTCCTTTTGGCCAGATCTT TAGACCAGACAACTTTGTATTTGGTCAGTCTGGGG CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC AGGGCTTCCAGCTGACCCACTCACTGGGCGGGGG CACAGGCTCTGGAATGGGCACTCTCCTTATCAGCA AGATCCGAGAAGAATACCCTGATCGCATCATGAAT ACCTTCAGTGTGGTGCCTTCACCCAAAGTGTCTGA CACCGTGGTCGAGCCCTACAATGCCACCCTCTCC GTCCATCAGTTGGTAGAGAATACTGATGAGACCTA TTGCATTGACAACGAGGCCTCTATGATATCTGCT TCCGCACTCTGAAGCTGACCACACCAACCTACGGG GATCTGAACCACCTTGTCTCAGCCACCATGAGTGG TGTCACCACCTGCCTCCGTTTCCCTGGCCAGCTCA ATGCTGACCTCCGCAAGTTGGCAGTCAACATGGTC CCCTTCCCACGTCTCCATTTCTTTATGCCTGGCTTT GCCCCTCTCACCAGCCGTGGAAGCCAGCAGTATC GAGCTCTCACAGTGCCGGAACTCACCCAGCAGGT CTTCGATGCCAAGAACATGA | 5 | QPTGI* |
| 2134 | NM_1780 14.2_860 | 860 | GCACCTCGCTGCTCCAGCCTCTGGGGCGCATTCC AACCTTCCAGCCTGCGACCTGCGGAGAAAAAAAAT TACTTATTTTCTTGCCCCATACATACCTTGAGGCGA GCAAAAAAATTAAATTTTAACCATGAGGGAAATCGT GCACATCCAGGCTGGTCAGTGTGGCAACCAGATC GGTGCCAAGTTCTGGGAGGTGATCAGTGATGAAC ATGGCATCGACCCCACCGGCACCTACCACGGGGA CAGCGACCTGCAGCTGGACCGCATCTCTGTGTAC TACAATGAAGCCACAGGTGGCAAATATGTTCCTCG TGCCATCCTGGTGGATCTAGAACCTGGGACCATG GACTCTGTTCGCTCAGGTCCTTTTGGCCAGATCTT TAGACCAGACAACTTTGTATTTGGTCAGTCTGGGG CAGGTAACAACTGGGCCAAAGGCCACTACACAGA GGGCGCCGAGCTGGTTGATTCTGTCCTGGATGTG GTACGGAAGGAGGCAGAGAGCTGTGACTGCCTGC | 54 | SSMLTSAS WQSTWSP SHVSISLCL ALPLSPAV EASSIELS QCRNSPS RSSMPRT* |

TABLE 3A-continued

| SEQ ID | identifier_position | position | modified_RNA | PAP length | PAP |
|---|---|---|---|---|---|
| | | | AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAAGTGTCTGA<br>CACCGTGGTCGAGCCCTACAATGCCACCCTCTCC<br>GTCCATCAGTTGGTAGAGAATACTGATGAGACCTA<br>TTGCATTGACAACGAGGCCCTCTATGATATCTGCT<br>TCCGCACTCTGAAGCTGACCACACCAACCTACGG<br>GGATCTGAACCACCTTGTCTCAGCCACCATGAGTG<br>GTGTCACCACCTGCCTCCGTTTCCCTGGCAGCTCA<br>ATGCTGACCTCCGCAAGTTGGCAGTCAACATGGTC<br>CCCTTCCCACGTCTCCATTTCTTTATGCCTGGCTTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | | |
| 2135 | NM_17801<br>4.2_885 | 885 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAAGTGTCTGA<br>CACCGTGGTCGAGCCCTACAATGCCACCCTCTCC<br>GTCCATCAGTTGGTAGAGAATACTGATGAGACCTA<br>TTGCATTGACAACGAGGCCCTCTATGATATCTGCT<br>TCCGCACTCTGAAGCTGACCACACCAACCTACGG<br>GGATCTGAACCACCTTGTCTCAGCCACCATGAGTG<br>GTGTCACCACCTGCCTCCGTTTCCCTGGCCAGCTC<br>AATGCTGACCTCCGCAAGTGGCAGTCAACATGGT<br>CCCCTTCCCACGTCTCCATTTCTTTATGCCTGGCTT<br>TGCCCCTCTCACCAGCCGTGGAAGCCAGCAGTAT<br>CGAGCTCTCACAGTGCCGGAACTCACCCAGCAGG<br>TCTTCGATGCCAAGAACATGA | 46 | WQSTWSP<br>SHVSISLCL<br>ALPLSPAV<br>EASSIELS<br>QCRNSPS<br>RSSMPRT* |
| 2136 | NM_17801<br>4.2_937 | 937 | GCACCTCGCTGCTCCAGCCTCTGGGGCGCATTCC<br>AACCTTCCAGCCTGCGACCTGCGGAGAAAAAAAAT<br>TACTTATTTTCTTGCCCCATACATACCTTGAGGCGA<br>GCAAAAAAATTAAATTTTAACCATGAGGGAAATCGT<br>GCACATCCAGGCTGGTCAGTGTGGCAACCAGATC<br>GGTGCCAAGTTCTGGGAGGTGATCAGTGATGAAC<br>ATGGCATCGACCCCACCGGCACCTACCACGGGGA<br>CAGCGACCTGCAGCTGGACCGCATCTCTGTGTAC<br>TACAATGAAGCCACAGGTGGCAAATATGTTCCTCG<br>TGCCATCCTGGTGGATCTAGAACCTGGGACCATG<br>GACTCTGTTCGCTCAGGTCCTTTTGGCCAGATCTT<br>TAGACCAGACAACTTTGTATTTGGTCAGTCTGGGG<br>CAGGTAACAACTGGGCCAAAGGCCACTACACAGA<br>GGGCGCCGAGCTGGTTGATTCTGTCCTGGATGTG<br>GTACGGAAGGAGGCAGAGAGCTGTGACTGCCTGC<br>AGGGCTTCCAGCTGACCCACTCACTGGGCGGGGG<br>CACAGGCTCTGGAATGGGCACTCTCCTTATCAGCA<br>AGATCCGAGAAGAATACCCTGATCGCATCATGAAT<br>ACCTTCAGTGTGGTGCCTTCACCCAAAGTGTCTGA<br>CACCGTGGTCGAGCCCTACAATGCCACCCTCTCC<br>GTCCATCAGTTGGTAGAGAATACTGATGAGACCTA<br>TTGCATTGACAACGAGGCCCTCTATGATATCTGCT<br>TCCGCACTCTGAAGCTGACCACACCAACCTACGG<br>GGATCTGAACCACCTTGTCTCAGCCACCATGAGTG<br>GTGTCACCACCTGCCTCCGTTTCCCTGGCCAGCTC<br>AATGCTGACCTCCGCAAGTTGGCAGTCAACATGGT<br>CCCCTTCCCACGTCTCCATTTCTTTATGCCTGGCTT<br>GCCCCTCTCACCAGCCGTGGAAGCCAGCAGTATC<br>GAGCTCTCACAGTGCCGGAACTCACCCAGCAGGT<br>CTTCGATGCCAAGAACATGA | 29 | LPLSPAVE<br>ASSIELSQ<br>CRNSPSRS<br>SMPRT* |

TABLE 3A-continued

| SEQ ID | identifier_position | position | modified_RNA | PAP length | PAP |
|---|---|---|---|---|---|
| 2137 | NM_181471.1_677 | 677 | GGTGGCGGGAAGAGGAGGCGCGAGAATGGAGGT GGGAGGCCGTCTGTGGTGGCGCGGGCGAGGTGGA GGCCCAGGACTCTGACCCTGCCCCTGCCTTCAGC AAGGCCCCCGGCAGCGCCGGCCACTACGAACTG CCGTGGGTTGAAAAATATAGGCCAGTAAAGCTGAA TGAAATTGTCGGGAATGAAGACACCGTGAGCAGG CTAGAGGTCTTTGCAAGGGAAGGAAATGTGCCCA ACATCATCATTGCGGGCCCTCCAGGAACCGGCAA GACCACAAGCATTCTGTGCTTGGCCCGGGCCCTG CTGGGCCCAGCACTCAAAGATGCCATGTTGGAAC TCAATGCTTCAAATGACAGGGGCATTGACGTTGTG AGGAATAAAATTAAAATGTTTGCTCAACAAAAAGTC ACTCTTCCCAAAGGCCGACATAAGATCATCATTCT GGATGAAGCAGACAGCATGACCGACGGAGCCCAG CAAGCCTTGAGGAGAACCATGGAAATCTACTCTAA AACCACTCGCTTCGCCCTTGCTTGTAATGCTTCGG ATAAGATCATCGAGCCCATTCAGTCCCGCTGTGCA GTCCTCCGGTACACAAAGCTGACCGACGCCCAGA TCCTCACCAGGCTGATGAATGTTATCGAGAAGGAG AGGGTACCCTACACTGATGACGGCTAGAAGCCAT CATCTTCACGGCCCAGGGAGACATGAGGCAGGCG CTGAACAACCTGCAGTCCACCTTCTCAGGATTTGG CTTCATTAACAGTGAGAACGTGTTCAAGGTCTGTG ACGAGCCCCACCCACTGCTGGTAAAGGAGATGAT CCAGCACTGTGTGAATGCCAACATTGACGAAGCCT ACAAGATTCTTGCTCACTTGTGGCATCTGGGCTAC TCACCAGAAGATATCATTGGCAACATCTTTCGAGT GTGTAAAACTTTCCAAATGGCAGAATACCTGAAAC TGGAGTTTATCAAGGAAATTGGATACACTCACATG AAAAATAGCGGAAGGAGTGAACTCTC | 0 | * |
| 2138 | NM_181697.1_144 | 144 | ACTCTCGCGAGATCCCTACTGGCTATAAAGGCAGC GCCCCGGAGAGCTCTTGCGCGTCTTGTTCTTGCCT GGTGTCGGTGGTTAGTTTCTGCGACTTGTGTTGGG ACTGCTGATAGGAAGATGTCTTCAGGAAATGCTAA AATGGGCACCCTGCCCCCAACTTCAAAGCCACAG CTGTTATGCCAGATGGTCAGTTTAAAGATATCAGC CTGTCTGACTACAAAGGAAAATATGTTGTGTTCTTC TTTTACCCTCTTGACTTCACCTTTGTGTGCCCCACG GAGATCATTGCTTTCAGTGATAGGGCAGAAGAATT TAAGAAACTCAACTGCCAAGTGATTGGTGCTTCTG TGGATTCTCACTTCTGTCATCTAGCATGGGTCAATA CACCTAAGAAACAAGGAGGACTGGGACCCATGAA CATTCCTTTGGTATCAGACCCGAAGCGCACCATTG CTCAGGATTATGGGGTCTTAAAGGCTGATGAAGGC ATCTCGTTCAGGGGCCTTTTTATCATTGATGATAAG GGTATTCTTCGGCAGATCACTGTAAATGACCTCCC TGTTGGCCGCTCTGTGGATGAGACTTTGAGACTAG TTCAGGCCTTCCAGTTCACTGACAAACATGGGGAA GTGTGCCCAGCTGGCTGGAAACCTGGCAGTGATA CCATCAAGCCTGATGTCCAAAAGAGCAAAGAATAT TTCTCCAAGCAGAAGTGAGCGCTGGGCTGTTTTAG TGCCAGGCTGCGGTGGGCAGCCATGAGAACAAAA CCTCTTCTGTATTTTTTTTTCCATTAGTAAAACACA AGACTTCAGATTCAGCCGAATTGTGGTGTCTTACA AGGCAGGCCTTTCCTACAGGGGGTGGAGAGACCA GCCTTTCTTCCTTTGGTAGGAATGGCCTGAGTTGG CGTTGTGGGCAGGCTACTGGTTTGTATGATGTATT AGTAGAGCAACCCATTAATCTTTTGTAGTTTGTATT AAACTTGAACTGAGACCTTGATGAGTCTTTAAAAAA AAAAAA | 65 | MGTLPPTS KPQLLCQM VSLKISACL TTKENMLC SSFTLLTS PLCAPRRS LLSVIGQK NLRNSTAK* |
| 2139 | NM_181697.1_237 | 237 | ACTCTCGCGAGATCCCTACTGGCTATAAAGGCAGC GCCCCGGAGAGCTCTTGCGCGTCTTGTTCTTGCCT GGTGTCGGTGGTTAGTTTCTGCGACTTGTGTTGGG ACTGCTGATAGGAAGATGTCTTCAGGAAATGCTAA AATTGGGCACCCTGCCCCCAACTTCAAAGCCACA GCTGTTATGCCAGATGGTCAGTTTAAAGATATCAG CCTGTCTGACTACAAAGGAAAATATGTGTGTTCTTC TTTTACCCTCTTGACTTCACCTTTGTGTGCCCCACG GAGATCATTGCTTTCAGTGATAGGGCAGAAGAATT TAAGAAACTCAACTGCCAAGTGATTGGTGCTTCTG TGGATTCTCACTTCTGTCATCTAGCATGGGTCAATA CACCTAAGAAACAAGGAGGACTGGGACCCATGAA CATTCCTTTGGTATCAGACCCGAAGCGCACCATTG CTCAGGATTATGGGGTCTTAAAGGCTGATGAAGGC ATCTCGTTCAGGGGCCTTTTTATCATTGATGATAAG GGTATTCTTCGGCAGATCACTGTAAATGACCTCCC TGTTGGCCGCTCTGTGGATGAGACTTTGAGACTAG | 33 | CSSFTLLT SPLCAPRR SLLSVIGQ KNLRNSTA K* |

TABLE 3A-continued

| SEQ ID | identifier_position | position | modified_RNA | PAP length | PAP |
|---|---|---|---|---|---|
| | | | TTCAGGCCTTCCAGTTCACTGACAAACATGGGGAA<br>GTGTGCCCAGCTGGCTGGAAACCTGGCAGTGATA<br>CCATCAAGCCTGATGTCCAAAAGAGCAAAGAATAT<br>TTCTCCAAGCAGAAGTGAGCGCTGGGCTGTTTTAG<br>TGCCAGGCTGCGGTGGGCAGCCATGAGAACAAAA<br>CCTCTTCTGTATTTTTTTTTCCATTAGTAAAACACA<br>AGACTTCAGATTCAGCCGAATTGTGGTGTCTTACA<br>AGGCAGGCCTTTCCTACAGGGGGTGGAGAGACCA<br>GCCTTTCTTCCTTTGGTAGGAATGGCCTGAGTTGG<br>CGTTGTGGGCAGGCTACTGGTTTGTATGATGTATT<br>AGTAGAGCAACCCATTAATCTTTTGTAGTTTGTATT<br>AAACTTGAACTGAGACCTTGATGAGTCTTTAAAAAA<br>AAAAAA | | |
| 2140 | NM_1816<br>97.1_270 | 270 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA<br>AATTGGGCACCCTGCCCCCAACTTCAAAGCCACA<br>GCTGTTATGCCAGATGGTCAGTTTAAAGATATCAG<br>CCTGTCTGACTACAAAGGAAAATATGTTGTGTTCTT<br>CTTTTACCCTCTTGACTTCACCTTGTGTGCCCCAC<br>GGAGATCATTGCTTTCAGTGATAGGGCAGAAGAAT<br>TAAGAAACTCAACTGCCAAGTGATTGGTGCTTCT<br>GTGGATTCTCACTTCTGTCATCTAGCATGGGTCAA<br>TACACCTAAGAAACAAGGAGGACTGGGACCCATG<br>AACATTCCTTTGGTATCAGACCCGAAGCGCACCAT<br>TGCTCAGGATTATGGGGTCTTAAAGGCTGATGAAG<br>GCATCTCGTTCAGGGGCCTTTTTATCATTGATGATA<br>AGGGTATTCTTCGGCAGATCACTGTAAATGACCTC<br>CCTGTTGGCCGCTCTGTGGATGAGACTTTGAGACT<br>AGTTCAGGCCTTCCAGTTCACTGACAAACATGGGG<br>AAGTGTGCCCAGCTGGCTGGAAACCTGGCAGTGA<br>TACCATCAAGCCTGATGTCCAAAAGAGCAAAGAAT<br>ATTTCTCCAAGCAGAAGTGAGCGCTGGGCTGTTTT<br>AGTGCCAGGCTGCGGTGGGCAGCCATGAGAACAA<br>AACCTCTTCTGTATTTTTTTTTCCATTAGTAAAACA<br>CAAGACTTCAGATTCAGCCGAATTGTGGTGTCTTA<br>CAAGGCAGGCCTTTCCTACAGGGGGTGGAGAGAC<br>CAGCCTTTCTTCCTTTGGTAGGAATGGCCTGAGTT<br>GGCGTTGTGGGCAGGCTACTGGTTTGTATGATGTA<br>TTAGTAGAGCAACCCATTAATCTTTTGTAGTTTGTA<br>TTAAACTTGAACTGAGACCTTGATGAGTCTTTAAAA<br>AAAAAAAA | 23 | LCAPRRSL<br>LSVIGQKN<br>LRNSTAK* |
| 2141 | NM_1816<br>97.1_291 | 291 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA<br>AATTGGGCACCCTGCCCCCAACTTCAAAGCCACA<br>GCTGTTATGCCAGATGGTCAGTTTAAAGATATCAG<br>CCTGTCTGACTACAAAGGAAAATATGTTGTGTTCTT<br>CTTTTACCCTCTTGACTTCACCTTTGTGTGCCCCAC<br>GGAGATCATGCTTTCAGTGATAGGGCAGAAGAATT<br>TAAGAAACTCAACTGCCAAGTGATTGGTGCTTCTG<br>TGGATTCTCACTTCTGTCATCTAGCATGGGTCAATA<br>CACCTAAGAAACAAGGAGGACTGGGACCCATGAA<br>CATTCCTTTGGTATCAGACCCGAAGCGCACCATTG<br>CTCAGGATTATGGGGTCTTAAAGGCTGATGAAGGC<br>ATCTCGTTCAGGGGCCTTTTTATCATTGATGATAAG<br>GGTATTCTTCGGCAGATCACTGTAAATGACCTCCC<br>TGTTGGCCGCTCTGTGGATGAGACTTTGAGACTAG<br>TTCAGGCCTTCCAGTTCACTGACAAACATGGGGAA<br>GTGTGCCCAGCTGGCTGGAAACCTGGCAGTGATA<br>CCATCAAGCCTGATGTCCAAAAGAGCAAAGAATAT<br>TTCTCCAAGCAGAAGTGAGCGCTGGGCTGTTTTAG<br>TGCCAGGCTGCGGTGGGCAGCCATGAGAACAAAA<br>CCTCTTCTGTATTTTTTTTTCCATTAGTAAAACACA<br>AGACTTCAGATTCAGCCGAATTGTGGTGTCTTACA<br>AGGCAGGCCTTTCCTACAGGGGGTGGAGAGACCA<br>GCCTTTCTTCCTTTGGTAGGAATGGCCTGAGTTGG<br>CGTTGTGGGCAGGCTACTGGTTTGTATGATGTATT<br>AGTAGAGCAACCCATTAATCTTTTGTAGTTTGTATT<br>AAACTTGAACTGAGACCTTGATGAGTCTTTAAAAAA<br>AAAAAA | 16 | MLSVIGQK<br>NLRNSTAK* |
| 2142 | NM_1816<br>97.1_342 | 342 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA | 11 | MVLLWILT<br>SVI* |

TABLE 3A-continued

| SEQ ID | identifier_ position | position | modified_RNA | PAP length | PAP |
|---|---|---|---|---|---|
| | | | AATTGGGCACCCTGCCCCCAACTTCAAAGCCACA GCTGTTATGCCAGATGGTCAGTTTAAAGATATCAG CCTGTCTGACTACAAAGGAAAATATGTTGTGTTCTT CTTTTACCCTCTTGACTTCACCTTTGTGTGCCCCAC GGAGATCATTGCTTTCAGTGATAGGGCAGAAGAAT TTAAGAAACTCAACTGCCAAGTGATGGTGCTTCTG TGGATTCTCACTTCTGTCATCTAGCATGGGTCAATA CACCTAAGAAACAAGGAGGACTGGGACCCATGAA CATTCCTTTGGTATCAGACCCGAAGCGCACCATTG CTCAGGATTATGGGGTCTTAAAGGCTGATGAAGGC ATCTCGTTCAGGGGCCTTTTTATCATTGATGATAAG GGTATTCTTCGGCAGATCACTGTAAATGACCTCCC TGTTGGCCGCTCTGTGGATGAGACTTTGAGACTAG TTCAGGCCTTCCAGTTCACTGACAAACATGGGGAA GTGTGCCCAGCTGGCTGGAAACCTGGCAGTGATA CCATCAAGCCTGATGTCCAAAAGAGCAAAGAATAT TTCTCCAAGCAGAAGTGAGCGCTGGGCTGTTTTAG TGCCAGGCTGCGGTGGGCAGCCATGAGAACAAAA CCTCTTCTGTATTTTTTTTTTCCATTAGTAAAACACA AGACTTCAGATTCAGCCGAATTGTGGTGTCTTACA AGGCAGGCCTTTCCTACAGGGGGTGGAGAGACCA GCCTTTCTTCCTTTGGTAGGAATGGCCTGAGTTGG CGTTGTGGGCAGGCTACTGGTTTGTATGATGTATT AGTAGAGCAACCCATTAATCTTTTGTAGTTTGTATT AAACTTGAACTGAGACCTTGATGAGTCTTTAAAAAA AAAAAA | | |
| 2143 | NM_1816 97.1431 | 431 | ACTCTCGCGAGATCCCTACTGGCTATAAAGGCAGC GCCCCGGAGAGCTCTTGCGCGTCTTGTTCTTGCCT GGTGTCGGTGGTTAGTTTCTGCGACTTGTGTTGGG ACTGCTGATAGGAAGATGTCTTCAGGAAATGCTAA AATTGGGCACCCTGCCCCCAACTTCAAAGCCACA GCTGTTATGCCAGATGGTCAGTTTAAAGATATCAG CCTGTCTGACTACAAAGGAAAATATGTTGTGTTCTT CTTTTACCCTCTTGACTTCACCTTTGTGTGCCCCAC GGAGATCATTGCTTTCAGTGATAGGGCAGAAGAAT TTAAGAAACTCAACTGCCAAGTGATTGGTGCTTCT GTGGATTCTCACTTCTGTCATCTAGCATGGGTCAA TACACCTAAGAAACAAGGAGGACTGGGACCCATG AACATTCCTTTGGTATCAGACCCGAAGCGCACCATT GCTCAGGATTATGGGGTCTTAAAGGCTGATGAAG GCATCTCGTTCAGGGGCCTTTTTATCATTGATGATA AGGGTATTCTTCGGCAGATCACTGTAAATGACCTC CCTGTTGGCCGCTCTGTGGATGAGACTTTGAGACT AGTTCAGGCCTTCCAGTTCACTGACAAACATGGGG AAGTGTGCCCAGCTGGCTGGAAACCTGGCAGTGA TACCATCAAGCCTGATGTCCAAAAGAGCAAAGAAT ATTTCTCCAAGCAGAAGTGAGCGCTGGGCTGTTTT AGTGCCAGGCTGCGGTGGGCAGCCATGAGAACAA AACCTCTTCTGTATTTTTTTTTCCATTAGTAAAACA CAAGACTTCAGATTCAGCCGAATTGTGGTGTCTTA CAAGGCAGGCCTTTCCTACAGGGGGTGGAGAGAC CAGCCTTTCTTCCTTTGGTAGGAATGGCCTGAGTT GGCGTTGTGGGCAGGCTACTGGTTTGTATGATGTA TTAGTAGAGCAACCCATTAATCTTTTGTAGTTTGTA TTAAACTTGAACTGAGACCTTGATGAGTCTTTAAAA AAAAAAAA | 15 | WYQTRSA PLLRIMGS* |
| 2144 | NM_1816 97.1_456 | 456 | ACTCTCGCGAGATCCCTACTGGCTATAAAGGCAGC GCCCCGGAGAGCTCTTGCGCGTCTTGTTCTTGCCT GGTGTCGGTGGTTAGTTTCTGCGACTTGTGTTGGG ACTGCTGATAGGAAGATGTCTTCAGGAAATGCTAA AATTGGGCACCCTGCCCCCAACTTCAAAGCCACA GCTGTTATGCCAGATGGTCAGTTTAAAGATATCAG CCTGTCTGACTACAAAGGAAAATATGTTGTGTTCTT CTTTTACCCTCTTGACTTCACCTTTGTGTGCCCCAC GGAGATCATTGCTTTCAGTGATAGGGCAGAAGAAT TTAAGAAACTCAACTGCCAAGTGATTGGTGCTTCT GTGGATTCTCACTTCTGTCATCTAGCATGGGTCAA TACACCTAAGAAACAAGGAGGACTGGGACCCATG AACATTCCTTTGGTATCAGACCCGAAGCGCACCAT GCTCAGGATTATGGGGTCTTAAAGGCTGATGAAG GCATCTCGTTCAGGGGCCTTTTTATCATTGATGATA AGGGTATTCTTCGGCAGATCACTGTAAATGACCTC CCTGTTGGCCGCTCTGTGGATGAGACTTTGAGACT AGTTCAGGCCTTCCAGTTCACTGACAAACATGGGG AAGTGTGCCCAGCTGGCTGGAAACCTGGCAGTGA TACCATCAAGCCTGATGTCCAAAAGAGCAAAGAAT ATTTCTCCAAGCAGAAGTGAGCGCTGGGCTGTTTT | 7 | MLRIMGS* |

TABLE 3A-continued

| SEQ ID | identifier_position | position | modified_RNA | PAP length | PAP |
|---|---|---|---|---|---|
| | | | AGTGCCAGGCTGCGGTGGGCAGCCATGAGAACAA<br>AACCTCTTCTGTATTTTTTTTTCCATTAGTAAAACA<br>CAAGACTTCAGATTCAGCCGAATTGTGGTGTCTTA<br>CAAGGCAGGCCTTTCCTACAGGGGGTGGAGAGAC<br>CAGCCTTTCTTCCTTTGGTAGGAATGGCCTGAGTT<br>GGCGTTGTGGGCAGGCTACTGGTTTGTATGATGTA<br>TTAGTAGAGCAACCCATTAATCTTTTGTAGTTTGTA<br>TTAAACTTGAACTGAGACCTTGATGAGTCTTTAAAA<br>AAAAAAAA | | |
| 2145 | NM_1816<br>97.1_567 | 567 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA<br>AATTGGGCACCCTGCCCCCAACTTCAAAGCCACA<br>GCTGTTATGCCAGATGGTCAGTTTAAAGATATCAG<br>CCTGTCTGACTACAAAGGAAAATATGTTGTGTTCTT<br>CTTTTACCCTCTTGACTTCACCTTTGTGTGCCCCAC<br>GGAGATCATTGCTTTCAGTGATAGGGCAGAAGAAT<br>TTAAGAAACTCAACTGCCAAGTGATTGGTGCTTCT<br>GTGGATTCTCACTTCTGTCATCTAGCATGGGTCAA<br>TACACCTAAGAAACAAGGAGGACTGGGACCCATG<br>AACATTCCTTTGGTATCAGACCCGAAGCGCACCAT<br>TGCTCAGGATTATGGGGTCTTAAAGGCTGATGAAG<br>GCATCTCGTTCAGGGGCCTTTTTATCATTGATGATA<br>AGGGTATTCTTCGGCAGATCACTGTAAATGACCTC<br>CCTGTGGCCGCTCTGTGGATGAGACTTTGAGACTA<br>GTTCAGGCCTTCCAGTTCACTGACAAACATGGGGA<br>AGTGTGCCCAGCTGGCTGGAAACCTGGCAGTGAT<br>ACCATCAAGCCTGATGTCCAAAAGAGCAAAGAATA<br>TTTCTCCAAGCAGAAGTGAGCGCTGGGCTGTTTTA<br>GTGCCAGGCTGCGGTGGGCAGCCATGAGAACAAA<br>ACCTCTTCTGTATTTTTTTTTCCATTAGTAAAACAC<br>AAGACTTCAGATTCAGCCGAATTGTGGTGTCTTAC<br>AAGGCAGGCCTTTCCTACAGGGGGTGGAGAGACC<br>AGCCTTTCTTCCTTTGGTAGGAATGGCCTGAGTTG<br>GCGTTGTGGGCAGGCTACTGGTTTGTATGATGTAT<br>TAGTAGAGCAACCCATTAATCTTTTGTAGTTTGTAT<br>TAAACTTGAACTGAGACCTTGATGAGTCTTTAAAAA<br>AAAAAAA | 7 | AALWMRL* |
| 2146 | NM_1816<br>97.1_571 | 571 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA<br>AATTGGGCACCCTGCCCCCAACTTCAAAGCCACA<br>GCTGTTATGCCAGATGGTCAGTTTAAAGATATCAG<br>CCTGTCTGACTACAAAGGAAAATATGTTGTGTTCTT<br>CTTTTACCCTCTTGACTTCACCTTTGTGTGCCCCAC<br>GGAGATCATTGCTTTCAGTGATAGGGCAGAAGAAT<br>TTAAGAAACTCAACTGCCAAGTGATTGGTGCTTCT<br>GTGGATTCTCACTTCTGTCATCTAGCATGGGTCAA<br>TACACCTAAGAAACAAGGAGGACTGGGACCCATG<br>AACATTCCTTTGGTATCAGACCCGAAGCGCACCAT<br>TGCTCAGGATTATGGGGTCTTAAAGGCTGATGAAG<br>GCATCTCGTTCAGGGGCCTTTTTATCATTGATGATA<br>AGGGTATTCTTCGGCAGATCACTGTAAATGACCTC<br>CCTGTTGGCGCTCTGTGGATGAGACTTTGAGACTA<br>GTTCAGGCCTTCCAGTTCACTGACAAACATGGGGA<br>AGTGTGCCCAGCTGGCTGGAAACCTGGCAGTGAT<br>ACCATCAAGCCTGATGTCCAAAAGAGCAAAGAATA<br>TTTCTCCAAGCAGAAGTGAGCGCTGGGCTGTTTTA<br>GTGCCAGGCTGCGGTGGGCAGCCATGAGAACAAA<br>ACCTCTTCTGTATTTTTTTTTCCATTAGTAAAACAC<br>AAGACTTCAGATTCAGCCGAATTGTGGTGTCTTAC<br>AAGGCAGGCCTTTCCTACAGGGGGTGGAGAGACC<br>AGCCTTTCTTCCTTTGGTAGGAATGGCCTGAGTTG<br>GCGTTGTGGGCAGGCTACTGGTTTGTATGATGTAT<br>TAGTAGAGCAACCCATTAATCTTTTGTAGTTTGTAT<br>TAAACTTGAACTGAGACCTTGATGAGTCTTTAAAAA<br>AAAAAAA | 6 | ALWMRL* |
| 2147 | NM_1816<br>97.1_641 | 641 | ACTCTCGCGAGATCCCTACTGGCTATAAAGGCAGC<br>GCCCCGGAGAGCTCTTGCGCGTCTTGTTCTTGCCT<br>GGTGTCGGTGGTTAGTTTCTGCGACTTGTGTTGGG<br>ACTGCTGATAGGAAGATGTCTTCAGGAAATGCTAA<br>AATTGGGCACCCTGCCCCCAACTTCAAAGCCACA<br>GCTGTTATGCCAGATGGTCAGTTTAAAGATATCAG<br>CCTGTCTGACTACAAAGGAAAATATGTTGTGTTCTT<br>CTTTTACCCTCTTGACTTCACCTTTGTGTGCCCCAC | 40 | QLAGNLAV<br>IPSSLMSK<br>RAKNISPS<br>RSERWAV<br>LVPGCGG<br>QP* |

TABLE 3A-continued

| SEQ ID | identifier_position | position | modified_RNA | PAP length | PAP |
|---|---|---|---|---|---|
| | | | GGAGATCATTGCTTTCAGTGATAGGGCAGAAGAAT TTAAGAAACTCAACTGCCAAGTGATTGGTGCTTCT GTGGATTCTCACTTCTGTCATCTAGCATGGGTCAA TACACCTAAGAAACAAGGAGGACTGGGACCCATG AACATTCCTTTGGTATCAGACCCGAAGCGCACCAT TGCTCAGGATTATGGGGTCTTAAAGGCTGATGAAG GCATCTCGTTCAGGGGCCTTTTTATCATTGATATA AGGGTATTCTTCGGCAGATCACTGTAAATGACCTC CCTGTTGGCCGCTCTGTGGATGAGACTTTGAGACT AGTTCAGGCCTTCCAGTTCACTGACAAACATGGGG AAGTGTGCCAGCTGGCTGGAAACCTGGCAGTGAT ACCATCAAGCCTGATGTCCAAAAGAGCAAAGAATA TTTCTCCAAGCAGAAGTGAGCGCTGGGCTGTTTTA GTGCCAGGCTGCGGTGGGCAGCCATGAGAACAAA ACCTCTTCTGTATTTTTTTTTTCCATTAGTAAAACAC AAGACTTCAGATTCAGCCGAATTGTGGTGTCTTAC AAGGCAGGCCTTTCCTACAGGGGGTGGAGAGACC AGCCTTTCTTCCTTTGGTAGGAATGGCCTGAGTTG GCGTTGTGGGCAGGCTACTGGTTTGTATGATGTAT TAGTAGAGCAACCCATTAATCTTTTGTAGTTTGTAT TAAACTTGAACTGAGACCTTGATGAGTCTTTAAAAA AAAAAAA | | |
| 2148 | NM_1824 70.1_115 0 | 1150 | CGCCGCGCTTCCTCCTGAAGGTGACTGCGCCCGC GGGGACGCAGGGGGCGGGGCCCGGGTCGCCCG GAGCCGGGATTGGGCAGAGGGCGGGGCGGCGGA GGGATTGCGGCGGCCCGCAGCGGGATAACCTTGA GGCTGAGGCAGTGGCTCCTTGCACAGCAGCTGCA CGCGCCGTGGCTCCGGATCTCTTCGTCTTTGCAG CGTAGCCCGAGTCGGTCAGCGCCGGAGGTGAGC GGTGCAGGAGGCTACGCCATCAGTCCCCACCAAG GGCCAGTCGCCCGGCTAGTGCGGAATCCCGGCG CGCCGGCCGGCCCCGGGCACGCAGGCAGGGCG GCGCAGGATCCAGGGCGTCTGGGATGCAGTGGA GCTCAGAGAGAGGAGAACGGCTCCTCACGCCTGG GGCCTGCTCTTCAGAAGTCCCCAGCGCCGTTCCTT CCAGATCAGGACCTCAGCAGCCATGTCGAAGCCC CATAGTGAAGCCGGGACTGCCTTCATTCAGACCCA GCAGCTGCACGCAGCCATGGCTGACACATTCCTG GAGCACATGTGCCGCCTGGACATTGATTCACCAC CCATCACAGCCCGGAACACTGGCATCATCTGTACC ATTGGCCCAGCTTCCCGATCAGTGGAGACGTTGA AGGAGATGATTAAGTCTGGAATGAATGTGGCTCGT CTGAACTTCTCTCATGGAACTCATGAGTACCATGC GGAGACCATCAAGAATGTGCGCACAGCCACGGAA AGCTTTGCTTCTGACCCCATCCTCTACCGGCCCGT TGCTGTGGCTCTAGACACTAAAGGACCTGAGATCC GAACTGGGCTCATCAAGGGCAGCGGCACTGCAGA GGTGGAGCTGAAGAAGGGAGCCACTCTCAAAATC ACGCTGGATAACGCCTACATGGAAAAGTGTGACG AGAACATCCTGTGGCTGGACTACAAGAACATCTGC AAGGTGGTGGAAGTGGGCAGCAAGATCTACGTGG ATGATGGGCTTATTTCTCTCCAGGTGAAGCAGAAA GGT | 66 | LGSSRMLI WCLRHSS ARHLMSM KLGRSWE RRERTSRL SAKSRIMR GFGGLMK SWRPVMG SWWLVVI* |
| 2149 | NM_1824 70.1_118 0 | 1180 | CGCCGCGCTTCCTCCTGAAGGTGACTGCGCCCGC GGGGACGCAGGGGGCGGGGCCCGGGTCGCCCG GAGCCGGGATTGGGCAGAGGGCGGGGCGGCGGA GGGATTGCGGCGGCCCGCAGCGGGATAACCTTGA GGCTGAGGCAGTGGCTCCTTGCACAGCAGCTGCA CGCGCCGTGGCTCCGGATCTCTTCGTCTTTGCAG CGTAGCCCGAGTCGGTCAGCGCCGGAGGTGAGC GGTGCAGGAGGCTACGCCATCAGTCCCCACCAAG GGCCAGTCGCCCGGCTAGTGCGGAATCCCGGCG CGCCGGCCGGCCCCGGGCACGCAGGCAGGGCG GCGCAGGATCCAGGGCGTCTGGGATGCAGTGGA GCTCAGAGAGAGGAGAACGGCTCCTCACGCCTGG GGCCTGCTCTTCAGAAGTCCCCAGCGCCGTTCCTT CCAGATCAGGACCTCAGCAGCCATGTCGAAGCCC CATAGTGAAGCCGGGACTGCCTTCATTCAGACCCA GCAGCTGCACGCAGCCATGGCTGACACATTCCTG GAGCACATGTGCCGCCTGGACATTGATTCACCAC CCATCACAGCCCGGAACACTGGCATCATCTGTACC ATTGGCCCAGCTTCCCGATCAGTGGAGACGTTGA AGGAGATGATTAAGTCTGGAATGAATGTGGCTCGT CTGAACTTCTCTCATGGAACTCATGAGTACCATGC GGAGACCATCAAGAATGTGCGCACAGCCACGGAA AGCTTTGCTTCTGACCCCATCCTCTACCGGCCCGT TGCTGTGGCTCTAGACACTAAAGGACCTGAGATCC | 56 | LRHSSARH LMSMKLG RSWERRE RTSRLSAK SRIMRGFG GLMKSWR PVMGSWW LVVI* |

TABLE 3A-continued

| SEQ ID | identifier_position | position | modified_RNA | PAP length | PAP |
|---|---|---|---|---|---|
| | | | GAACTGGGCTCATCAAGGGCAGCGGCACTGCAGA<br>GGTGGAGCTGAAGAAGGGAGCCACTCTCAAAATC<br>ACGCTGGATAACGCCTACATGGAAAAGTGTGACG<br>AGAACATCCTGTGGCTGGACTACAAGAACATCTGC<br>AAGGTGGTGGAAGTGGGCAGCAAGATCTACGTGG<br>ATGATGGGCTTATTTCTCTCCAGGTGAAGCAGAAA<br>GGT | | |
| 2150 | NM_182470.1_751 | 751 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGTGAGC<br>GGTGCAGGAGGCTACGCCATCAGTCCCCACCAAG<br>GGCCAGTCGCCCGGCTAGTGCGGAATCCCGGCG<br>CGCCGGCCGGCCCCGGGCACGCAGGCAGGGCG<br>GCGCAGGATCCAGGGCGTCTGGGATGCAGTGGA<br>GCTCAGAGAGAGGAGAACGGCTCCTCACGCCTGG<br>GGCCTGCTCTTCAGAAGTCCCCAGCGCCGTTCCTT<br>CCAGATCAGGACCTCAGCAGCCATGTCGAAGCCC<br>CATAGTGAAGCCGGGACTGCCTTCATTCAGACCCA<br>GCAGCTGCACGCAGCCATGGCTGACACATTCCTG<br>GAGCACATGTGCCGCTGGACATTGATTCACCAC<br>CCATCACAGCCCGGAACACTGGCATCATCTGTACC<br>ATTGGCCCAGCTTCCCGATCAGTGGAGACGTTGA<br>AGGAGATGATTAAGTCTGGAATGAATGTGGCTCGT<br>CTGAACTTCTCTCATGGAACTCATGAGTACCATGC<br>GGAGACCATCAAGAATGTGCGCACAGCCACGGAA<br>AGCTTGCTTCTGACCCCATCCTCTACCGGCCCGTT<br>GCTGTGGCTCTAGACACTAAAGGACCTGAGATCC<br>GAACTGGGCTCATCAAGGGCAGCGGCACTGCAGA<br>GGTGGAGCTGAAGAAGGGAGCCACTCTCAAAATC<br>ACGCTGGATAACGCCTACATGGAAAAGTGTGACG<br>AGAACATCCTGTGGCTGGACTACAAGAACATCTGC<br>AAGGTGGTGGAAGTGGGCAGCAAGATCTACGTGG<br>ATGATGGGCTTATTTCTCTCCAGGTGAAGCAGAAA<br>GGTG | 14 | LLLTPSST<br>GPLLWL* |
| 2151 | NM_182471.1_338 | 338 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGCT<br>GGACATTGATTCACCACCCATCACAGCCCGGAACA<br>CTGGCATCATCTGTACCATTGGCCCAGCTTCCCGA<br>TCAGTGGAGACGTTGAAGGAGATGATTAAGTCTGG<br>AATGAATGTGGCTCGTCTGAACTTCTCTCATGGAA<br>CTCATGAGTACCATGCGGAGACCATCAAGAATGTG<br>CGCACAGCCACGGAAAGCTTTGCTTCTGACCCCAT<br>CCTCTACCGGCCCGTTGCTGTGGCTCTAGACACTA<br>AAGGACCTGAGATCCGAACTGGGCTCATCAAGGG<br>CAGCGGCACTGCAGAGGTGGAGCTGAAGAAGGG<br>AGCCACTCTCAAAATCACGCTGGATAACGCCTACA<br>TGGAAAAGTGTGACGAGAACATCCTGTGGCTGGA<br>CTACAAGAACATCTGCAAGGTGGTGGAAGTGGGC<br>AGCAAGATCTACGTGGATGATGGGCTTATTTCTCT<br>CCAGGTGAAGCAGAAAGGTGCCGACTTCCTGGTG<br>ACGGAGGTGGAAAATGGTGGCTCCTTGGGCAGCA<br>AGAAGGGTGTGAACCTTCCTGGGGCTGCTGTGGA<br>CTTGCCTGCTGTGTCGGAGAAGGACATCCAGGAT<br>CTGAAGTTTGGGGTCGAGCAGGATGTTGATATGGT<br>GTTTGCGTCATTCATCCGCAAGGCATCTGATGTCC<br>ATGAAGTTAGGAAGGTCCTGGGAGAGAAGG | 28 | WTLIHHPS<br>QPGTLASS<br>VPLAQLPD<br>QWRR* |
| 2152 | NM_182471.1_346 | 346 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC | 26 | MIHHPSQP<br>GTLASSVP<br>MAQLPDQ<br>WRR* |

TABLE 3A-continued

| SEQ ID | identifier_position | position | modified_RNA | PAP length | PAP |
|---|---|---|---|---|---|
| | | | CATGGCTGACACATTCCTGGAGCACATGTGCCGC<br>CTGGACATGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCCACGGAAAGCTTTGCTTCTGACCC<br>CATCCTCTACCGGCCCGTTGCTGTGGCTCTAGACA<br>CTAAAGGACCTGAGATCCGAACTGGGCTCATCAA<br>GGGCAGCGGCACTGCAGAGGTGGAGCTGAAGAA<br>GGGAGCCACTCTCAAAATCACGCTGGATAACGCC<br>TACATGGAAAAGTGTGACGAGAACATCCTGTGGCT<br>GGACTACAAGAACATCTGCAAGGTGGTGGAAGTG<br>GGCAGCAAGATCTACGTGGATGATGGGCTTATTTC<br>TCTCCAGGTGAAGCAGAAAGGTGCCGACTTCCTG<br>GTGACGGAGGTGGAAAATGGTGGCTCCTTGGGCA<br>GCAAGAAGGGTGTGAACCTTCCTGGGGCTGCTGT<br>GGACTTGCCTGCTGTGTCGGAGAAGGACATCCAG<br>GATCTGAAGTTTGGGGTCGAGCAGGATGTTGATAT<br>GGTGTTTGCGTCATTCATCCGCAAGGCATCTGATG<br>TCCATGAAGTTAGGAAGGTCCTGGGAGAGAAGG | | |
| 2153 | NM_182471.1_394 | 394 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATGGCCCAGCTTCCCG<br>ATCAGTGGAGACGTTGAAGGAGATGATTAAGTCTG<br>GAATGAATGTGGCTCGTCTGAACTTCTCTCATGGA<br>ACTCATGAGTACCATGCGGAGACCATCAAGAATGT<br>GCGCACAGCCACGGAAAGCTTTGCTTCTGACCCC<br>ATCCTCTACCGGCCCGTTGCTGTGGCTCTAGACAC<br>TAAAGGACCTGAGATCCGAACTGGGCTCATCAAG<br>GGCAGCGGCACTGCAGAGGTGGAGCTGAAGAAG<br>GGAGCCACTCTCAAAATCACGCTGGATAACGCCTA<br>CATGGAAAAGTGTGACGAGAACATCCTGTGGCTG<br>GACTACAAGAACATCTGCAAGGTGGTGGAAGTGG<br>GCAGCAAGATCTACGTGGATGATGGGCTTATTTCT<br>CTCCAGGTGAAGCAGAAAGGTGCCGACTTCCTGG<br>TGACGGAGGTGGAAAATGGTGGCTCCTTGGGCAG<br>CAAGAAGGGTGTGAACCTTCCTGGGGCTGCTGTG<br>GACTTGCCTGCTGTGTCGGAGAAGGACATCCAGG<br>ATCTGAAGTTTGGGGTCGAGCAGGATGTTGATATG<br>GTGTTTGCGTCATTCATCCGCAAGGCATCTGATGT<br>CCATGAAGTTAGGAAGGTCCTGGGAGAGAAGG | 10 | MAQLPDQ<br>WRR* |
| 2154 | NM_182471.1_523 | 523 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCACGGAAAGCTTTGCTTCTGACCCC<br>ATCCTCTACCGGCCCGTTGCTGTGGCTCTAGACAC<br>TAAAGGACCTGAGATCCGAACTGGGCTCATCAAG<br>GCAGCGGCACTGCAGAGGTGGAGCTGAAGAAG<br>GGAGCCACTCTCAAAATCACGCTGGATAACGCCTA<br>CATGGAAAAGTGTGACGAGAACATCCTGTGGCTG<br>GACTACAAGAACATCTGCAAGGTGGTGGAAGTGG<br>GCAGCAAGATCTACGTGGATGATGGGCTTATTTCT<br>CTCCAGGTGAAGCAGAAAGGTGCCGACTTCCTGG<br>TGACGGAGGTGGAAAATGGTGGCTCCTTGGGCAG<br>CAAGAAGGGTGTGAACCTTCCTGGGGCTGCTGTG | 17 | RKALLLTP<br>SSTGPLLW<br>L* |

TABLE 3A-continued

| SEQ ID | identifier_position | position | modified_RNA | PAP length | PAP |
|---|---|---|---|---|---|
| 2155 | NM_182471.1_535 | 535 | GACTTGCCTGCTGTGTCGGAGAAGGACATCCAGG<br>ATCTGAAGTTTGGGGTCGAGCAGGATGTTGATATG<br>GTGTTTGCGTCATTCATCCGAAGGCATCTGATGT<br>CCATGAAGTTAGGAAGGTCCTGGGAGAGAAGG<br>CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCCACGGAAAGCTTGCTTCTGACCCC<br>ATCCTCTACCGGCCCGTTGCTGTGGCTCTAGACAC<br>TAAAGGACCTGAGATCCGAACTGGGCTCATCAAG<br>GGCAGCGGCACTGCAGAGGTGGAGCTGAAGAAG<br>GGAGCCACTCTCAAAATCACGCTGGATAACGCCTA<br>CATGGAAAAGTGTGACGAGAACATCCTGTGGCTG<br>GACTACAAGAACATCTGCAAGGTGGTGGAAGTGG<br>GCAGCAAGATCTACGTGGATGATGGGCTTATTTCT<br>CTCCAGGTGAAGCAGAAAGGTGCCGACTTCCTGG<br>TGACGGAGGTGGAAAATGGTGGCTCCTTGGGCAG<br>CAAGAAGGGTGTGAACCTTCCTGGGGCTGCTGTG<br>GACTTGCCTGCTGTGTCGGAGAAGGACATCCAGG<br>ATCTGAAGTTTGGGGTCGAGCAGGATGTTGATATG<br>GTGTTTGCGTCATTCATCCGAAGGCATCTGATGT<br>CCATGAAGTTAGGAAGGTCCTGGGAGAGAAGG | 14 | LLLTPSST<br>GPLLWL* |
| 2156 | NM_182471.1_562 | 562 | CGCCGCGCTTCCTCCTGAAGGTGACTGCGCCCGC<br>GGGGACGCAGGGGGCGGGGCCCGGGTCGCCCG<br>GAGCCGGGATTGGGCAGAGGGCGGGGCGGCGGA<br>GGGATTGCGGCGGCCCGCAGCGGGATAACCTTGA<br>GGCTGAGGCAGTGGCTCCTTGCACAGCAGCTGCA<br>CGCGCCGTGGCTCCGGATCTCTTCGTCTTTGCAG<br>CGTAGCCCGAGTCGGTCAGCGCCGGAGGACCTCA<br>GCAGCCATGTCGAAGCCCCATAGTGAAGCCGGGA<br>CTGCCTTCATTCAGACCCAGCAGCTGCACGCAGC<br>CATGGCTGACACATTCCTGGAGCACATGTGCCGC<br>CTGGACATTGATTCACCACCCATCACAGCCCGGAA<br>CACTGGCATCATCTGTACCATTGGCCCAGCTTCCC<br>GATCAGTGGAGACGTTGAAGGAGATGATTAAGTCT<br>GGAATGAATGTGGCTCGTCTGAACTTCTCTCATGG<br>AACTCATGAGTACCATGCGGAGACCATCAAGAATG<br>TGCGCACAGCCACGGAAAGCTTTGCTTCTGACCC<br>CATCCTCTACCGGCCCGTTGCTGTGGCTCTAGACAC<br>TAAAGGACCTGAGATCCGAACTGGGCTCATCAAG<br>GGCAGCGGCACTGCAGAGGTGGAGCTGAAGAAG<br>GGAGCCACTCTCAAAATCACGCTGGATAACGCCTA<br>CATGGAAAAGTGTGACGAGAACATCCTGTGGCTG<br>GACTACAAGAACATCTGCAAGGTGGTGGAAGTGG<br>GCAGCAAGATCTACGTGGATGATGGGCTTATTTCT<br>CTCCAGGTGAAGCAGAAAGGTGCCGACTTCCTGG<br>TGACGGAGGTGGAAAATGGTGGCTCCTTGGGCAG<br>CAAGAAGGGTGTGAACCTTCCTGGGGCTGCTGTG<br>GACTTGCCTGCTGTGTCGGAGAAGGACATCCAGG<br>ATCTGAAGTTTGGGGTCGAGCAGGATGTTGATATG<br>GTGTTTGCGTCATTCATCCGAAGGCATCTGATGT<br>CCATGAAGTTAGGAAGGTCCTGGGAGAGAAGG | 4 | LLWL* |
| 2157 | NM_182649.1_229 | 229 | AACGCGGCGCAGGGTGAGAGCGCGCGCTTGCGG<br>ACGCGGCGGCATTAAACGGTTGCAGGCGTAGCAG<br>AGTGGTCGTTGTCTTTCTAGGTCTCAGCCGGTCGT<br>CGCGACGTTCGCCCGCTCGCTCTGAGGCTCCTGA<br>AGCCGAAACCAGCTAGACTTTCCTCCTTCCCGCCT<br>GCCTGTAGCGGCGTTGTTGCCACTCCGCCACCAT<br>GTTCGAGGCGCGCCTGGTCCAGGCTCCATCCTCA<br>AGAAGGTGTTGGAGGCACTCAAGGACCTCATCAA<br>CGAGGCCTGCTGGGATATTAGCTCCAGCGGTGTA<br>AACCTGCAGAGCATGGACTCGTCCCACGTCTCTTT<br>GGTGCAGCTCACCCTGCGGTCTGAGGGCTTCGAC<br>ACCTACCGCTGCGACCGCAACCTGGCCATGGGCG<br>TGAACCTCACCAGTATGTCCAAAATACTAAAATGC | 26 | APSSRRC<br>WRHSRTS<br>STRPAGIL<br>APAV* |

TABLE 3A-continued

| SEQ ID | identifier_position | position | modified_RNA | PAP length | PAP |
|---|---|---|---|---|---|
| | | | GCCGGCAATGAAGATATCATTACACTAAGGGCCGA AGATAACGCGGATACCTTGGCGCTAGTATTTGAAG CACCAAACCAGGAGAAAGTTTCAGACTATGAAATG AAGTTGATGGATTTAGATGTTGAACAACTTGGAATT CCAGAACAGGAGTACAGCTGTGTAGTAAAGATGC CTTCTGGTGAATTTGCACGTATATGCCGAGATCTC AGCCATATTGGAGATGCTGTTGTAATTTCCTGTGC AAAAGACGGAGTGAAATTTTCTGCAAGTGGAGAAC TTGGAAATGGAAACATTAAATTGTCACAGACAAGT AATGTCGATAAAGAGGAGGAAGCTGTTACCATAGA GATGAATGAACCAGTTCAACTAACTTTTGCACTGA GGTACCTGAACTTCTTTACAAAAGCCACTCCACTC TCTTCAACGGTGACACTCAGTATGTCTGCAGATGT ACCCCTTGTTGTAGAGTATAAAATTGCGGATATGG GACACTTAAAATACTACTTGGCTCCCAAGATCGAG GATGAAGAAGGATCTTAGGCATTCTTAAAATTCAA GAAAATAAAACTAAGCTCT | | |
| 2158 | NM_182649.1_250 | 250 | AACGCGGCGCAGGGTGAGAGCGCGCGCTTGCGG ACGCGGCGGCATTAAACGGTTGCAGGCGTAGCAG AGTGGTCGTTGTCTTTCTAGGTCTCAGCCGGTCGT CGCGACGTTCGCCCGCTCGCTCTGAGGCTCCTGA AGCCGAAACCAGCTAGACTTTCCTCCTTCCCGCCT GCCTGTAGCGGCGTTGTTGCCACTCCGCCACCAT GTTCGAGGCGCGCCTGGTCCAGGGCTCCATCCTC AAGAAGGTGTGGAGGCACTCAAGGACCTCATCAA CGAGGCCTGCTGGGATATTAGCTCCAGCGGTGTA AACCTGCAGAGCATGGACTCGTCCCACGTCTCTTT GGTGCAGCTCACCCTGCGGTCTGAGGGCTTCGAC ACCTACCGCTGCGACCGCAACCTGGCCATGGGCG TGAACCTCACCAGTATGTCCAAAATACTAAAATGC GCCGGCAATGAAGATATCATTACACTAAGGGCCGA AGATAACGCGGATACCTTGGCGCTAGTATTTGAAG CACCAAACCAGGAGAAAGTTTCAGACTATGAAATG AAGTTGATGGATTTAGATGTTGAACAACTTGGAATT CCAGAACAGGAGTACAGCTGTGTAGTAAAGATGC CTTCTGGTGAATTTGCACGTATATGCCGAGATCTC AGCCATATTGGAGATGCTGTTGTAATTTCCTGTGC AAAAGACGGAGTGAAATTTTCTGCAAGTGGAGAAC TTGGAAATGGAAACATTAAATTGTCACAGACAAGT AATGTCGATAAAGAGGAGGAAGCTGTTACCATAGA GATGAATGAACCAGTTCAACTAACTTTTGCACTGA GGTACCTGAACTTCTTTACAAAAGCCACTCCACTC TCTTCAACGGTGACACTCAGTATGTCTGCAGATGT ACCCCTTGTTGTAGAGTATAAAATTGCGGATATGG GACACTTAAAATACTACTTGGCTCCCAAGATCGAG GATGAAGAAGGATCTTAGGCATTCTTAAAATTCAA GAAAATAAAACTAAGCTCT | 19 | WRHSRTS STRPAGIL APAV* |
| 2159 | NM_182715.1_176 | 176 | GCGCCAGCCCCGCCTGCCCTTCCTCGCCACCGGG CTGCTCTGGTCTCGTCGGTCCCTCCTCCGCCCC GTCGTCCTGACTCTCTCTCCCTCCTTTCCTCAGAG GATGTCCGGCTTCCAGATCAACCTCAACCCGCTCA AGGAGCCACTCGGCTTCATCAAGGTCCTCGAGTG GATGCTTCTATCTTTGCTTTTGCCACCTGTGGAGG TTTTAAGGGCCAAACAGAAATTCAAGTGAATTGTC CTCCTGCAGTTACTGAGAATAAAACTGTTACAGCT ACTTTTGGTTATCCATTCAGGTTGAATGAGGCATCA TTTCAGCCACCTCCAGGTGTAAACATATGTGATGT AAATTGGAAAGATTACGTCCTCATAGGCGATTACT CTTCTTCTGCACAATTCTATGTTACCTTTGCAGTCT TTGTGTTCCTGTACTGCATTGCTGCCCTTCTGCTTT ATGTTGGCTACACGAGTCTGTATCTGGATAGTCGT AAACTTCCTATGATAGACTTTGTTGTTACACTTGTT GCCACTTTTTTGTGGTTGGTGAGCACTTCAGCCTG GGCTAAAGCTCTGACAGATATTAAAATAGCTACTG GTCACAATATTATTGATGAACTTCCGCCTTGTAAGA AGAAAGCAGTACTGTGTTACTTTGGCTCTGTGACC AGTATGGGATCCCTAAATGTATCTGTGATATTTGG CTTTCTAAATATGATACTCTGGGGAGGAAATGCTT GGTTTGTGTACAAGGAGACCAGCCTACACAGTCCA TCAAATACATCTGCCCCTCATAGCCAAGGAGGTAT TCCACCTCCTACCGGAATATAATTAAAGGGAGAAA TACACTGTATGAAGTATATGTTGATACTATGACATG TTGCCAACACCTTGAGAAGCATTATTTGTTTCTAAT AAAAGTAATGGCTTTGTCAATATATTGGTGGGTTTA AAACTTTGCTGCTTTTTTACATAAAGCCTGTGCCTT TCCTAGAAAAGTTAAGATGTAAATGTATTCTCACATG TA | 20 | MLLSLLLP PVEVLRAK QKFK* |

TABLE 3A-continued

| SEQ ID | identifier_ position | position | modified_RNA | PAP length | PAP |
|---|---|---|---|---|---|
| 2160 | NM_182715.1_284 | 284 | GCGCCAGCCCCGCCTGCCCTTCCTCGCCACCGGGCTGCTCTGGTCTCGTCGGTCCCTCCTCCGCCCCGTCGTCCTGACTCTCTCTCCCTCCTTTCCTCAGAGGATGTCCGGCTTCCAGATCAACCTCAACCCGCTCAAGGAGCCACTCGGCTTCATCAAGGTCCTCGAGTGGATTGCTTCTATCTTTGCTTTTGCCACCTGTGGAGGTTTTAAGGGCCAAACAGAAATTCAAGTGAATTGTCCTCCTGCAGTTACTGAGAATAAAACTGTTACAGCTACTTTGGTTATCCATTCAGGTTGAATGAGGCATCATTTCAGCCACCTCCAGGTGTAAACATATGTGATGTAAATTGGAAAGATTACGTCCTCATAGGCGATTACTCTTCTTCTGCACAATTCTATGTTACCTTTGCAGTCTTTGTGTTCCTGTACTGCATTGCTGCCCTTCTGCTTTATGTTGGCTACACGAGTCTGTATCTGGATAGTCGTAAACTTCCTATGATAGACTTTGTTGTTACACTTGTTGCCACTTTTTTGTGGTTGGTGAGCACTTCAGCCTGGGCTAAAGCTCTGACAGATATTAAAATAGCTACTGGTCACAATATTATTGATGAACTTCCGCCTTGTAAGAAGAAAGCAGTACTGTGTTACTTTGGCTCTGTGACCAGTATGGGATCCCTAAATGTATCTGTGATATTTGGCTTTCTAAATATGATACTCTGGGGAGGAAATGCTTGGTTTGTGTACAAGGAGACCAGCCTACACAGTCCATCAAATACATCTGCCCCTCATAGCCAAGGAGGTATTCCACCTCCTACCGGAATATAATTAAAGGGAGAAATACACTGTATGAAGTATATGTTGATACTATGACATGTTGCCAACACCTTGAGAAGCATTATTTGTTTCTAATAAAAGTAATGGCTTTGTCAATATATTGGTGGGTTTAAAACTTTGCTGCTTTTTTACATAAAGCCTGTGCCTTTCCTAGAAAGTTAAGATGTAAATGTATTCTCACATGTA | 6 | LVIHSG* |
| 2161 | NM_182810.1_315 | 315 | TTTCTACTTTGCCCGCCCACAGATGTAGTTTTCTCTGCGCGTGTGCGTTTTCCCTCCTCCCCGCCCTCAGGGTCCACGGCCACCATGGCGTATTAGGGGCAGCAGTGCCTGCGGCAGCATTGGCCTTTGCAGCGGCGGCAGCAGCACCAGGCTCTGCAGCGGCAACCCCCAGCGGCTTAAGCCATGGCGCTTCTCACGGCATTCAGCAGCAGCGTTGCTGTAACCGACAAAGACACCTTCGAATTAAGCACATTCCTCGATTCCAGCAAAGCACCGCAACATGACCGAAATGAGCTTCCTGAGCAGCGAGGTGTGGTGGGGGACTTGATGTCCCCCTTCGACCAGTCGGGTTTGGGGGCTGAAGAAAGCCTAGGTCTCTTAGATGATTACCTGGAGGTGGCCAAGCACTTCAAACCTCATGGGTTCTCCAGCGACAAGGCTAAGGCGGGCTCCTCCGAATGGCTGGCTGTGGATGGGTTGGTCAGTCCCTCCAACAACAGCAAGGAGGATGCCTTCTCCGGGACAGATTGGATGTTGGAGAAAATGGATTTGAAGGAGTTCGACTTGGATGCCCTGTTGGGTATAGATGACCTGGAAACCATGCCAGATGACCTTCTGACCACGTTGGATGACACTTGTGATCTCTTTGCCCCCCTAGTCCAGGAGACTAATAAGCAGCCCCCCCAGACGGTGAACCCAATTGGCCATCTCCCAGAAAGTTTAACAAAACCCGACCAGGTTGCCCCCTTCACCTTCTTACAACCTCTTCCCCTTTCCCCAGGGGTCCTGTCCTCCACTCCAGATCATTCCTTTAGTTTAGAGCTGGGCAGTGAAGTGGATATCACTGAAGGAGATAGGAAGCCAGACTACACTGCTTACGTTGCCATGATCCCTCAGTGCATAAAGGAGGAAGACACCCCTTCAGATAATGATAGTGGCATCTGTATGAGCCCAGAGTCCTATCTGGGGTCTCCTCAGCACAGCCCCTCTACCAGGGGCTCTCCAAATAGGAGCCTCCCATCTC | 4 | WWGT* |
| 2162 | NM_182810.1_354 | 354 | TTTCTACTTTGCCCGCCCACAGATGTAGTTTTCTCTGCGCGTGTGCGTTTTCCCTCCTCCCCGCCCTCAGGGTCCACGGCCACCATGGCGTATTAGGGGCAGCAGTGCCTGCGGCAGCATTGGCCTTTGCAGCGGCGGCAGCAGCACCAGGCTCTGCAGCGGCAACCCCCAGCGGCTTAAGCCATGGCGCTTCTCACGGCATTCAGCAGCAGCGTTGCTGTAACCGACAAAGACACCTTCGAATTAAGCACATTCCTCGATTCCAGCAAAGCACCGCAACATGACCGAAATGAGCTTCCTGAGCAGCGAGGTGTTGGTGGGGACTTGATGTCCCCCTTCGACCAGTCGGGTTGGGGGCTGAAGAAAGCCTAGGTCTCTTAGATGATTACCTGGAGGTGGCCAAGCACTTCAAACCTCATGGGTTCTCCAGCGACAAGGCTAAGGCGGGCTCCTCCGAATGGCTGGCTGTGGATGGGTTGGTCAGTCCCTCCAACAACAGCAAGGAGGATGCCTTCTCCGGGACAGATTGGATGTTGGAGAAAATGGATTTGAAGGAGTTCGACTTGGATGCCCTGTTGGGTAT | 6 | WGLKKA* |

TABLE 3A-continued

| SEQ ID | identifier_position | position | modified_RNA | PAP length | PAP |
|---|---|---|---|---|---|
| | | | AGATGACCTGGAAACCATGCCAGATGACCTTCTGA<br>CCACGTTGGATGACACTTGTGATCTCTTTGCCCCC<br>CTAGTCCAGGAGACTAATAAGCAGCCCCCCAGA<br>CGGTGAACCCAATTGGCCATCTCCCAGAAAGTTTA<br>ACAAAACCCGACCAGGTTGCCCCCTTCACCTTCTT<br>ACAACCTCTTCCCCTTTCCCCAGGGGTCCTGTCCT<br>CCACTCCAGATCATTCCTTTAGTTTAGAGCTGGGC<br>AGTGAAGTGGATATCACTGAAGGAGATAGGAAGC<br>CAGACTACACTGCTTACGTTGCCATGATCCCTCAG<br>TGCATAAAGGAGGAAGACACCCCTTCAGATAATGA<br>TAGTGGCATCTGTATGAGCCCAGAGTCCTATCTGG<br>GGTCTCCTCAGCACAGCCCTCTACCAGGGGCTC<br>TCCAAATAGGAGCCTCCCATCTC | | |
| 2163 | NM_1828<br>10.1_579 | 579 | TTTCTACTTTGCCCGCCCACAGATGTAGTTTTCTCT<br>GCGCGTGTGCGTTTTCCCTCCTCCCCGCCCTCAG<br>GGTCCACGGCCACCATGGCGTATTAGGGGCAGCA<br>GTGCCTGCGGCAGCATTGGCCTTTGCAGCGGCGG<br>CAGCAGCACCAGGCTCTGCAGCGGCAACCCCCAG<br>CGGCTTAAGCCATGGCGCTTCTCACGGCATTCAG<br>CAGCAGCGTTGCTGTAACCGACAAAGACACCTTC<br>GAATTAAGCACATTCCTCGATTCCAGCAAAGCACC<br>GCAACATGACCGAAATGAGCTTCCTGAGCAGCGA<br>GGTGTTGGTGGGGGACTTGATGTCCCCCTTCGAC<br>CAGTCGGGTTTGGGGGCTGAAGAAAGCCTAGGTC<br>TCTTAGATGATTACCTGGAGGTGGCCAAGCACTTC<br>AAACCTCATGGGTTCTCCAGCGACAAGGCTAAGG<br>CGGGCTCCTCCGAATGGCTGGCTGTGGATGGGTT<br>GGTCAGTCCCTCCAACAACAGCAAGGAGGATGCC<br>TTCTCCGGGACAGATTGGATGTTGGAGAAAATGGA<br>TTTGAAGGAGTTCGACTTGGATGCCCTGTGGGTAT<br>AGATGACCTGGAAACCATGCCAGATGACCTTCTGA<br>CCACGTTGGATGACACTTGTGATCTCTTTGCCCCC<br>CTAGTCCAGGAGACTAATAAGCAGCCCCCCAGA<br>CGGTGAACCCAATTGGCCATCTCCCAGAAAGTTTA<br>ACAAAACCCGACCAGGTTGCCCCCTTCACCTTCTT<br>ACAACCTCTTCCCCTTTCCCCAGGGGTCCTGTCCT<br>CCACTCCAGATCATTCCTTTAGTTTAGAGCTGGGC<br>AGTGAAGTGGATATCACTGAAGGAGATAGGAAGC<br>CAGACTACACTGCTTACGTTGCCATGATCCCTCAG<br>TGCATAAAGGAGGAAGACACCCCTTCAGATAATGA<br>TAGTGGCATCTGTATGAGCCCAGAGTCCTATCTGG<br>GGTCTCCTCAGCACAGCCCTCTACCAGGGGCTC<br>TCCAAATAGGAGCCTCCCATCTC | 2 | WV* |
| 2164 | NM_1828<br>10.1_614 | 614 | TTTCTACTTTGCCCGCCCACAGATGTAGTTTTCTCT<br>GCGCGTGTGCGTTTTCCCTCCTCCCCGCCCTCAG<br>GGTCCACGGCCACCATGGCGTATTAGGGGCAGCA<br>GTGCCTGCGGCAGCATTGGCCTTTGCAGCGGCGG<br>CAGCAGCACCAGGCTCTGCAGCGGCAACCCCCAG<br>CGGCTTAAGCCATGGCGCTTCTCACGGCATTCAG<br>CAGCAGCGTTGCTGTAACCGACAAAGACACCTTC<br>GAATTAAGCACATTCCTCGATTCCAGCAAAGCACC<br>GCAACATGACCGAAATGAGCTTCCTGAGCAGCGA<br>GGTGTTGGTGGGGGACTTGATGTCCCCCTTCGAC<br>CAGTCGGGTTTGGGGGCTGAAGAAAGCCTAGGTC<br>TCTTAGATGATTACCTGGAGGTGGCCAAGCACTTC<br>AAACCTCATGGGTTCTCCAGCGACAAGGCTAAGG<br>CGGGCTCCTCCGAATGGCTGGCTGTGGATGGGTT<br>GGTCAGTCCCTCCAACAACAGCAAGGAGGATGCC<br>TTCTCCGGGACAGATTGGATGTTGGAGAAAATGGA<br>TTTGAAGGAGTTCGACTTGGATGCCCTGTTGGGTA<br>TAGATGACCTGGAAACCATGCCAGATGACCTTCTGA<br>CCACGTTGGATGACACTTGTGATCTCTTTGCCCCC<br>CTAGTCCAGGAGACTAATAAGCAGCCCCCCAGA<br>CGGTGAACCCAATTGGCCATCTCCCAGAAAGTTTA<br>ACAAAACCCGACCAGGTTGCCCCCTTCACCTTCTT<br>ACAACCTCTTCCCCTTTCCCCAGGGGTCCTGTCCT<br>CCACTCCAGATCATTCCTTTAGTTTAGAGCTGGGC<br>AGTGAAGTGGATATCACTGAAGGAGATAGGAAGC<br>CAGACTACACTGCTTACGTTGCCATGATCCCTCAG<br>TGCATAAAGGAGGAAGACACCCCTTCAGATAATGA<br>TAGTGGCATCTGTATGAGCCCAGAGTCCTATCTGG<br>GGTCTCCTCAGCACAGCCCTCTACCAGGGGCTC<br>TCCAAATAGGAGCCTCCCATCTC | 1 | F* |
| 2165 | NM_1828<br>10.1_627 | 627 | TTTCTACTTTGCCCGCCCACAGATGTAGTTTTCTCT<br>GCGCGTGTGCGTTTTCCCTCCTCCCCGCCCTCAG<br>GGTCCACGGCCACCATGGCGTATTAGGGGCAGCA<br>GTGCCTGCGGCAGCATTGGCCTTTGCAGCGGCGG | 10 | WMTLVISL<br>PP* |

TABLE 3A-continued

| SEQ ID | identifier_position | position | modified_RNA | PAP length | PAP |
|---|---|---|---|---|---|
| | | | CAGCAGCACCAGGCTCTGCAGCGGCAACCCCCAG<br>CGGCTTAAGCCATGGCGCTTCTCACGGCATTCAG<br>CAGCAGCGTTGCTGTAACCGACAAAGACACCTTC<br>GAATTAAGCACATTCCTCGATTCCAGCAAAGCACC<br>GCAACATGACCGAAATGAGCTTCCTGAGCAGCGA<br>GGTGTTGGTGGGGGACTTGATGTCCCCCTTCGAC<br>CAGTCGGGTTTGGGGGCTGAAGAAAGCCTAGGTC<br>TCTTAGATGATTACCTGGAGGTGGCCAAGCACTTC<br>AAACCTCATGGGTTCTCCAGCGACAAGGCTAAGG<br>CGGGCTCCTCCGAATGGCTGGCTGTGGATGGGTT<br>GGTCAGTCCCTCCAACAACAGCAAGGAGGATGCC<br>TTCTCCGGGACAGATTGGATGTTGGAGAAAATGGA<br>TTTGAAGGAGTTCGACTTGGATGCCCTGTTGGGTA<br>TAGATGACCTGGAAACCATGCCAGATGACCTTCTG<br>ACCACGTGGATGACACTTGTGATCTCTTTGCCCCC<br>CTAGTCCAGGAGACTAATAAGCAGCCCCCCCAGA<br>CGGTGAACCCAATTGGCCATCTCCCAGAAAGTTTA<br>ACAAAACCCGACCAGGTTGCCCCCTTCACCTTCTT<br>ACAACCTCTTCCCCTTTCCCCAGGGGTCCTGTCCT<br>CCACTCCAGATCATTCCTTTAGTTTAGAGCTGGGC<br>AGTGAAGTGGATATCACTGAAGGAGATAGGAAGC<br>CAGACTACACTGCTTACGTTGCCATGATCCCTCAG<br>TGCATAAAGGAGGAAGACACCCCTTCAGATAATGA<br>TAGTGGCATCTGTATGAGCCCAGAGTCCTATCTGG<br>GGTCTCCTCAGCACAGCCCCTCTACCAGGGGCTC<br>TCCAAATAGGAGCCTCCCATCTC | | |
| 2166 | NM_182810.1_707 | 707 | TTTCTACTTTGCCCGCCCACAGATGTAGTTTTCTCT<br>GCGCGTGTGCGTTTTCCCTCCTCCCCGCCCTCAG<br>GGTCCACGGCCACCATGGCGTATTAGGGGCAGCA<br>GTGCCTGCGGCAGCATTGGCCTTTGCAGCGGCGG<br>CAGCAGCACCAGGCTCTGCAGCGGCAACCCCCAG<br>CGGCTTAAGCCATGGCGCTTCTCACGGCATTCAG<br>CAGCAGCGTTGCTGTAACCGACAAAGACACCTTC<br>GAATTAAGCACATTCCTCGATTCCAGCAAAGCACC<br>GCAACATGACCGAAATGAGCTTCCTGAGCAGCGA<br>GGTGTTGGTGGGGACTTGATGTCCCCCTTCGAC<br>CAGTCGGGTTTGGGGGCTGAAGAAAGCCTAGGTC<br>TCTTAGATGATTACCTGGAGGTGGCCAAGCACTTC<br>AAACCTCATGGGTTCTCCAGCGACAAGGCTAAGG<br>CGGGCTCCTCCGAATGGCTGGCTGTGGATGGGTT<br>GGTCAGTCCCTCCAACAACAGCAAGGAGGATGCC<br>TTCTCCGGGACAGATTGGATGTTGGAGAAAATGGA<br>TTTGAAGGAGTTCGACTTGGATGCCCTGTTGGGTA<br>TAGATGACCTGGAAACCATGCCAGATGACCTTCTG<br>ACCACGTTGGATGACACTTGTGATCTCTTTGCCCC<br>CCTAGTCCAGGAGACTAATAAGCAGCCCCCCCAG<br>ACGGTGAACCCAATTGGCATCTCCCAGAAAGTTTA<br>ACAAAACCCGACCAGGTTGCCCCCTTCACCTTCTT<br>ACAACCTCTTCCCCTTTCCCCAGGGGTCCTGTCCT<br>CCACTCCAGATCATTCCTTTAGTTTAGAGCTGGGC<br>AGTGAAGTGGATATCACTGAAGGAGATAGGAAGC<br>CAGACTACACTGCTTACGTTGCCATGATCCCTCAG<br>TGCATAAAGGAGGAAGACACCCCTTCAGATAATGA<br>TAGTGGCATCTGTATGAGCCCAGAGTCCTATCTGG<br>GGTCTCCTCAGCACAGCCCCTCTACCAGGGGCTC<br>TCCAAATAGGAGCCTCCCATCTC | 5 | ISQKV* |
| 2167 | NM_184041.1_448 | 448 | GTGGTGCCTTTAAAAGGCCGGGCGCCGCCTTCCG<br>CCTGCCCGCCTCCTGCGCCGCCCCTTCCGAGGCT<br>AAATCGGCTGCGTTCCTCTCGGAACGCGCCGCAG<br>AAGGGGTCCTGGTGACGAGTCCCGCGTTCTCTCC<br>TTGAATCCACTCGCCAGCCCGCCGCCCTCTGCCG<br>CCGCACCCTGCACACCCGCCCCTCTCCTGTGCCA<br>GGAACTTGCTACTACCAGCACCATGCCCTACCAAT<br>ATCCAGCACTGACCCCGGAGCAGAAGAAGGAGCT<br>GTCTGACATCGCTCACCGCATCGTGGCACCTGGC<br>AAGGGCATCCTGGCTGCAGATGAGTCCACTGGGA<br>GCATTGCCAAGCGGCTGCAGTCCATTGGCACCGA<br>GAACACCGAGGAGAACCGGCGCTTCTACCGCCAG<br>CTGCTGCTGACAGCTGACGACCGCGTGAACCCCT<br>GCATGGGGTGTCATCCTCTTCCATGAGACACTCT<br>ACCAGAAGGCGGATGATGGGCGTCCCTTCCCCCA<br>AGTTATCAAATCCAAGGGCGGTGTTGTGGGCATCA<br>AGGTAGACAAGGGCGTGGTCCCCCTGGCAGGGA<br>CAAATGGCGAGACTACCACCCAAGGGTTGGATGG<br>GCTGTCTGAGCGCTGTGCCCAGTACAAGAAGGAC<br>GGAGCTGACTTCGCCAAGTGGCGTTGTGTGCTGA<br>AGATTGGGGAACACACCCCCTCAGCCCTCGCCAT | 35 | MGVSSSS<br>MRHSTRR<br>RMMGVPS<br>PKLSNPRA<br>VLWASR* |

TABLE 3A-continued

| SEQ ID | identifier_position | position | modified_RNA | PAP length | PAP |
|---|---|---|---|---|---|
| | | | CATGGAAAATGCCAATGTTCTGGCCCGTTATGCCA GTATCTGCCAGCAGAATGGCATTGTGCCCATCGTG GAGCCTGAGATCCTCCCTGATGGGGACCATGACT TGAAGCGCTGCCAGTATGTGACCGAGAAGGTGCT GGCTGCTGTCTACAAGGCTCTGAGTGACCACCAC ATCTACCTGGAAGGCACCTTGCTGAAGCCCAACAT GGTCACCCCAGGCCATGCTTGCACTCAGAAGTTTT CTCATGAGGAGATTGCCATGGCGACCGTCACAGC GCTGCGCCGCACAGTGCCCCCCGCTGTCACTG | | |
| 2168 | NM_184041.1_505 | 505 | GTGGTGCCTTTAAAAGGCCGGGCGCCGCCTTCCG CCTGCCCGCCTCCTGCGCCGCCCCTTCCGAGGCT AAATCGGCTGCGTTCCTCTCGGAACGCGCCGCAG AAGGGGTCCTGGTGACGAGTCCCGCGTTCTCTCC TTGAATCCACTCGCCAGCCCGCCGCCCTCTGCCG CCGCACCCTGCACACCCGCCCCTCTCCTGTGCCA GGAACTTGCTACTACCAGCACCATGCCCTACCAAT ATCCAGCACTGACCCCGGAGCAGAAGAAGGAGCT GTCTGACATCGCTCACCGCATCGTGGCACCTGGC AAGGGCATCCTGGCTGCAGATGAGTCCACTGGGA GCATTGCCAAGCGGCTGCAGTCCATTGGCACCGA GAACACCGAGGAGAACCGGCGCTTCTACCGCCAG CTGCTGCTGACAGCTGACGACCGCGTGAACCCCT GCATTGGGGGTGTCATCCTCTTCCATGAGACACTC TACCAGAAGGCGGATGATGGGCGTCCTTCCCCCA AGTTATCAAATCCAAGGGCGGTGTTGTGGGCATCA AGGTAGACAAGGGCGTGGTCCCCCTGGCAGGGA CAAATGGCGAGACTACCACCCAAGGGTTGGATGG GCTGTCTGAGCGCTGTGCCCAGTACAAGAAGGAC GGAGCTGACTTCGCCAAGTGGCGTTGTGTGCTGA AGATTGGGGAACACACCCCCTCAGCCCTCGCCAT CATGGAAAATGCCAATGTTCTGGCCCGTTATGCCA GTATCTGCCAGCAGAATGGCATTGTGCCCATCGTG GAGCCTGAGATCCTCCCTGATGGGGACCATGACT TGAAGCGCTGCCAGTATGTGACCGAGAAGGTGCT GGCTGCTGTCTACAAGGCTCTGAGTGACCACCAC ATCTACCTGGAAGGCACCTTGCTGAAGCCCAACAT GGTCACCCCAGGCCATGCTTGCACTCAGAAGTTTT CTCATGAGGAGATTGCCATGGCGACCGTCACAGC GCTGCGCCGCACAGTGCCCCCCGCTGTCACTG | 15 | SPKLSNPR AVLWASR* |
| 2169 | NM_184041.1_602 | 602 | GTGGTGCCTTTAAAAGGCCGGGCGCCGCCTTCCG CCTGCCCGCCTCCTGCGCCGCCCCTTCCGAGGCT AAATCGGCTGCGTTCCTCTCGGAACGCGCCGCAG AAGGGGTCCTGGTGACGAGTCCCGCGTTCTCTCC TTGAATCCACTCGCCAGCCCGCCGCCCTCTGCCG CCGCACCCTGCACACCCGCCCCTCTCCTGTGCCA GGAACTTGCTACTACCAGCACCATGCCCTACCAAT ATCCAGCACTGACCCCGGAGCAGAAGAAGGAGCT GTCTGACATCGCTCACCGCATCGTGGCACCTGGC AAGGGCATCCTGGCTGCAGATGAGTCCACTGGGA GCATTGCCAAGCGGCTGCAGTCCATTGGCACCGA GAACACCGAGGAGAACCGGCGCTTCTACCGCCAG CTGCTGCTGACAGCTGACGACCGCGTGAACCCCT GCATTGGGGGTGTCATCCTCTTCCATGAGACACTC TACCAGAAGGCGGATGATGGGCGTCCTTCCCCC AAGTTATCAAATCCAAGGGCGGTGTTGTGGGCATC AAGGTAGACAAGGGCGTGGTCCCCCTGGCAGGGA CAAATGGCGAGACTACCACCCAAGGGTTGGATGGG CTGTCTGAGCGCTGTGCCCAGTACAAGAAGGACG GAGCTGACTTCGCCAAGTGGCGTTGTGTGCTGAA GATTGGGGAACACACCCCCTCAGCCCTCGCCATC ATGGAAAATGCCAATGTTCTGGCCCGTTATGCCAG TATCTGCCAGCAGAATGGCATTGTGCCCATCGTGG AGCCTGAGATCCTCCCTGATGGGGACCATGACTT GAAGCGCTGCCAGTATGTGACCGAGAAGGTGCTG GCTGCTGTCTACAAGGCTCTGAGTGACCACCACAT CTACCTGGAAGGCACCTTGCTGAAGCCCAACATG GTCACCCCAGGCCATGCTTGCACTCAGAAGTTTTC TCATGAGGAGATTGCCATGGCGACCGTCACAGCG CTGCGCCGCACAGTGCCCCCGCTGTCACTG | 26 | KGWMGCL SAVPSTRR TELTSPSG VVC* |
| 2170 | NM_198216.1_265 | 265 | AACTCCAGGGCTAGTGAGCTGGACCGGAAGTAGG TTTCTACCCGACCGCATTTTACGTGGTGCTGCATT TCCGGTAGCGGCGGCGGGAAATCGGCTGTGGGA GAGAGGCTAGGCCTCTGAGGAGGCGAATCCGGC GGGTATCAGAGCCATCAGAACCGCCACCATGACG GTGGGCAAGAGCAGCAAGATGCTGCAGCATATTG ATTACAGGATGAGGTGCATCCTGCAGGACGGCCG GATCTTCATTGGCACCTTCAAGGCTTTGACAAGCA | 4 | LTST* |

TABLE 3A-continued

| SEQ ID | identifier_position | position | modified_RNA | PAP length | PAP |
|---|---|---|---|---|---|
| | | | CATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACCTATGGGCCGAGGAGCACCCC<br>CTCCAGGCATGATGGGCCCACCTCCTGGTATGAG<br>ACCTCCTATGGGTCCCCCAATGGGGATCCCCCCT<br>GGAAGAGGGACTCCAATGGGCATGCCCCCTCCGG<br>GAATGCGGCCTCCTCCCCCTGGGATGCGAGGGCC<br>CCCTCCCCCGGGAATGCGCCCACCAAGGCCCTAG<br>ACTCATCTTGGCCCTCCTCAGCTCCCTGCCTGTTT<br>CCCGTAAGGCTGTACATAGTCCTTTTATCTCCTTGT<br>GGCCTATGAAACTGGTTTATAATAAACTCTTAAGAG<br>AACATTATAATTGC | | |
| 2171 | NM_1982<br>16.1_478 | 478 | AACTCCAGGGCTAGTGAGCTGGACCGGAAGTAGG<br>TTTCTACCCGACCGCATTTTACGTGGTGCTGCATT<br>TCCGGTAGCGGCGGCGGGAAATCGGCTGTGGGA<br>GAGAGGCTAGGCCTCTGAGGAGGCGAATCCGGC<br>GGGTATCAGAGCCATCAGAACCGCCACCATGACG<br>GTGGGCAAGAGCAGCAAGATGCTGCAGCATATTG<br>ATTACAGGATGAGGTGCATCCTGCAGGACGGCCG<br>GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGATC<br>GGCAGGGCTGCTGGCAGAGGAATCCCAGCTGGG<br>GTTCCCATGCCCCAGGCTCCTGCAGGACTTGCTG<br>GGCCAGTCCGTGGGGTTGGCGGGCCATCCCAACA<br>GGTGATGACCCCACAAGGAAGAGGTACTGTTGCA<br>GCCGCTGCAGCTGCTGCCACAGCCAGTATTGCCG<br>GGGCTCCAACCCAGTACCCACCTGGCCGTGGGG<br>GTCCTCCCCACCTATGGGCCGAGGAGCACCCCC<br>TCCAGGCATGATGGGCCCACCTCCTGGTATGAGA<br>CCTCCTATGGGTCCCCCAATGGGGATCCCCCCTG<br>GAAGAGGGACTCCAATGGGCATGCCCCCTCCGGG<br>AATGCGGCCTCCTCCCCCTGGGATGCGAGGGCCC<br>CCTCCCCCGGGAATGCGCCCACCAAGGCCCTAGA<br>CTCATCTTGGCCCTCCTCAGCTCCCTGCCTGTTTC<br>CCGTAAGGCTGTACATAGTCCTTTTATCTCCTTGTG<br>GCCTATGAAACTGGTTTATAATAAACTCTTAAGAGA<br>ACATTATAATTGC | 35 | SAGLLAEE<br>SQLGFPCP<br>RLLQDLLG<br>QSVGLAG<br>HPNR* |
| 2172 | NM_1982<br>16.1_677 | 677 | AACTCCAGGGCTAGTGAGCTGGACCGGAAGTAGG<br>TTTCTACCCGACCGCATTTTACGTGGTGCTGCATT<br>TCCGGTAGCGGCGGCGGGAAATCGGCTGTGGGA<br>GAGAGGCTAGGCCTCTGAGGAGGCGAATCCGGC<br>GGGTATCAGAGCCATCAGAACCGCCACCATGACG<br>GTGGGCAAGAGCAGCAAGATGCTGCAGCATATTG<br>ATTACAGGATGAGGTGCATCCTGCAGGACGGCCG<br>GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACCTATGGGCCGAGGAGCACCCC<br>CTCCAGGCATGATGGGCCCACCTCCTGGTATGAG<br>ACCTCCTATGGGTCCCCCAATGGGGATCCCCCCT<br>GGAAGAGGGACTCCAATGGGCATGCCCCCTCCGG<br>GAATGCGGCCTCCTCCCCCTGGGATGCGAGGGCC | 16 | VGVLPHLW<br>AEEHPLQA* |

TABLE 3A-continued

| SEQ ID | identifier_position | position | modified_RNA | PAP length | PAP |
|---|---|---|---|---|---|
| | | | CCCTCCCCCGGGAATGCGCCCACCAAGGCCCTAG<br>ACTCATCTTGGCCCTCCTCAGCTCCCTGCCTGTTT<br>CCCGTAAGGCTGTACATAGTCCTTTTATCTCCTTGT<br>GGCCTATGAAACTGGTTTATAATAAACTCTTAAGAG<br>AACATTATAATTGC | | |
| 2173 | NM_198216.1_696 | 696 | AACTCCAGGGCTAGTGAGCTGGACCGGAAGTAGG<br>TTTCTACCCGACCGCATTTTACGTGGTGCTGCATT<br>TCCGGTAGCGGCGGCGGGAAATCGGCTGTGGGA<br>GAGAGGCTAGGCCTCTGAGGAGGCGAATCCGGC<br>GGGTATCAGAGCCATCAGAACCGCCACCATGACG<br>GTGGGCAAGAGCAGCAAGATGCTGCAGCATATTG<br>ATTACAGGATGAGGTGCATCCTGCAGGACGGCCG<br>GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACTATGGGCCGAGGAGCACCCCC<br>TCCAGGCATGATGGGCCCACCTCCTGGTATGAGA<br>CCTCCTATGGGTCCCCCAATGGGGATCCCCCCTG<br>GAAGAGGGACTCCAATGGGCATGCCCCCTCCGGG<br>AATGCGGCCTCCTCCCCCTGGGATGCGAGGGCCC<br>CCTCCCCCGGGAATGCGCCCACCAAGGCCCTAGA<br>CTCATCTTGGCCCTCCTCAGCTCCCTGCCTGTTTC<br>CGTAAGGCTGTACATAGTCCTTTTATCTCCTTGTG<br>GCCTATGAAACTGGTTTATAATAAACTCTTAAGAGA<br>ACATTATAATTGC | 10 | LWAEEHPL<br>QA* |
| 2174 | NM_198216.1_717 | 717 | AACTCCAGGGCTAGTGAGCTGGACCGGAAGTAGG<br>TTTCTACCCGACCGCATTTTACGTGGTGCTGCATT<br>TCCGGTAGCGGCGGCGGGAAATCGGCTGTGGGA<br>GAGAGGCTAGGCCTCTGAGGAGGCGAATCCGGC<br>GGGTATCAGAGCCATCAGAACCGCCACCATGACG<br>GTGGGCAAGAGCAGCAAGATGCTGCAGCATATTG<br>ATTACAGGATGAGGTGCATCCTGCAGGACGGCCG<br>GATCTTCATTGGCACCTTCAAGGCTTTTGACAAGC<br>ACATGAATTTGATCCTCTGTGACTGTGATGAGTTCA<br>GAAAGATCAAGCCAAAGAACTCCAAACAAGCAGAA<br>AGGGAAGAGAAGCGAGTCCTCGGTCTGGTGCTGC<br>TGCGAGGGGAGAATCTGGTCTCAATGACAGTAGA<br>GGGACCTCCTCCCAAAGATACTGGTATTGCTCGAG<br>TTCCACTTGCTGGAGCTGCCGGGGGCCCAGGGAT<br>CGGCAGGGCTGCTGGCAGAGGAATCCCAGCTGG<br>GGTTCCCATGCCCCAGGCTCCTGCAGGACTTGCT<br>GGGCCAGTCCGTGGGGTTGGCGGGCCATCCCAA<br>CAGGTGATGACCCCACAAGGAAGAGGTACTGTTG<br>CAGCCGCTGCAGCTGCTGCCACAGCCAGTATTGC<br>CGGGGCTCCAACCCAGTACCCACCTGGCCGTGGG<br>GGTCCTCCCCCACTATGGGCCGAGGAGCACCCCC<br>TCCAGGCATGATGGGCCCACCTCCTGGTATGAGA<br>CCTCCTATGGGTCCCCCAATGGGGATCCCCCCTG<br>GAAGAGGGACTCCAATGGGCATGCCCCCTCCGGG<br>AATGCGGCCTCCTCCCCCTGGGATGCGAGGGCCC<br>CCTCCCCCGGGAATGCGCCCACCAAGGCCCTAGA<br>CTCATCTTGGCCCTCCTCAGCTCCCTGCCTGTTTC<br>CGTAAGGCTGTACATAGTCCTTTTATCTCCTTGTG<br>GCCTATGAAACTGGTTTATAATAAACTCTTAAGAGA<br>ACATTATAATTGC | 3 | LQA* |
| 2175 | NM_198318.2_594 | 594 | GGGGGGGTCTTGGCGGCCGGAGGAGGAGTAGGTG<br>CGGGTGAAGATGGCGGCAGCCGAGGCCGCGAAC<br>TGCATCATGGAGGTGCCTGTGGCCAGGCGGAAA<br>GCAGTGAGAAGCCCAACGCTGAGGACATGACATC<br>CAAAGATTACTACTTTGACTCCTACGCACACTTTGG<br>CATCCACGAGGAGATGCTGAAGGACGAGGTGCGC<br>ACCCTCACTTACCGCAACTCCATGTTTCATAACCG<br>GCACCTCTTCAAGGACAAGGTGGTGCTGGACGTC<br>GGCTCGGGCACCGGCATCCTCTGCATGTTTGCTG<br>CCAAGGCCGGGGCCCGCAAGGTCATCGGGATCG<br>AGTGTTCCAGTATCTCTGATTATGCGGTGAAGATC<br>GTCAAAGCCAACAAGTTAGACCACGTGGTGACCAT | 33 | SRTGSTKT<br>TRSTGGRT<br>CMASTCLA<br>SKMWPLR<br>SP* |

TABLE 3A-continued

| SEQ ID | identifier_position | position | modified_RNA | PAP length | PAP |
|---|---|---|---|---|---|
| | | | CATCAAGGGGAAGGTGGAGGAGGTGGAGCTCCCA GTGGAGAAGGTGGACATCATCATCAGCGAGTGGA TGGGCTACTGCCTCTTCTACGAGTCCATGCTCAAC ACCGTGCTCTATGCCCGGGACAAGTGGCTGGCGC CCGATGGCCTCATCTTCCCAGACCGGGCCACGCT GTATGTGACGGCATCGAGGACCGGCAGTACAAAG ACTACAAGATCCACTGGTGGGAGAACGTGTATGG CTTCGACATGTCTTGCATCAAAGATGTGGCCATTA AGGAGCCCCTAGTGGATGTCGTGGACCCCAAACA GCTGGTCACCAACGCCTGCCTCATAAAGGAGGTG GACATCTATACCGTCAAGGTGGAAGACCTGACCTT CACCTCCCCGTTCTGCCTGCAAGTGAAGCGGAAT GACTACGTGCACGCCCTGGTGGCCTACTTCAACAT CGAGTTCACACGCTGCCACAAGAGGACCGGCTTC TCCACCAGCCCCGAGTCCCCGTACACGCACTGGA AGCAGACGGTGTTCTACATGGAGGACTACCTGAC CGTGAAGACGGGCGAGGAGATCTTCGGCACCATC GGCATGCGGCCCAACGCCAAGAACAACCGGGA | | |
| 2176 | NM_198336.1_305 | 305 | GGGCCCCGCGGCCCGCCATATAAACCCGCGCGC CCGCCAGGCGCTGCGGCCGTCCCGGGCCGTGAC TCCTCCTTTCCCCCGCCCCGCCTCCGTTCGGAGA GCCGGCGGGCGGGCGCCTCGGCCAGGAAGCG CCTCTTGGACGCGTGTGACCGATGCCCAGATTGC ACGACCACTTCTGGAGCTGCTCCTGTGCGCACAG CGCGAGGCGCCGAGGCCCCCGCGAGCCAGCGC CGCGGGGCTGGCGGCCAAGGTTGGGGAGATGAT CAACGTTTCCGTGTCCGGGCCCTCCCTGCTGGCG GCCACGGTGCCCCGGACGCTGACCCCGCGCCCA GGGGCCGCAGTGCTGCGATGAGCGGCCCCGAGC CCGGCAGCCCCTACCCCAACACCTGGCATCATCG CCTGTTGCAGAGGAGCCTCGTGCTCTTCTCGGTTG GGGTGGTCCTAGCCCTGGTGCTCAACCTGCTGCA GATCCAGAGGAATGTCACTCTCTTCCCCGAGGAG GTGATCGCCACCATCTTTTCCTCCGCCTGGTGGGT CCCTCCCTGCTGCGGGACAGCAGCTGCTGTTGTT GGCCTACTGTACCCCTGTATCGACAGTCACCTCGG AGAACCCCACAAATTTAAGAGAGAATGGGCCAGTG TCATGCGCTGCATAGCAGTTTTTGTTGGCATTAAC CACGCCAGTGCTAAATTGGATTTTGCCAATAATGT CCAGCTGTCCTTGACTTTAGCAGCCCTATCTTTGG GCCTTTGGTGGACATTTGATCGTTCCAGAAGTGGC CTTGGGCTGGGGATCACCATAGCTTTTCTAGCTAC GCTGATCACGCAGTTTCTCGTGTATAATGGTGTCT ATCAGTATACATCCCCAGATTTCCTCTATATTCGTT CTTGGCTCCCTTGTATATTTTTCTCAGGAGGCGTC ACGGTGGGGAACATAGGACGACAGTTAGCTATGC TGATACCCTTCTGTGAGGAGTTGAATTTGAAGACC ACTTGGCTGTTTCACAAAACCAGAAGTAATT | 16 | TVPRTLTP RPGAAVLR* |
| 2177 | NM_198589.1_389 | 389 | GTGCGCGCGCCCGGTCCGCGCCTCCGCCGCTTTT TATAGCGGCCGCGGGCGGCGGCGGCAGCGGTTG GAGGTTGTAGGACCGGCGAGGAATAGGAATCATG GCGGCTGCGCTGTTCGTGCTGCTGGGATTCGCGC TGCTGGGCACCCACGGAGCCTCCGGGGCTGCCG GCACAGTCTTCACTACCGTAGAAGACCTTGGCTCC AAGATACTCCTCACCTGCTCCTTGAATGACAGCGC CACAGAGGTCACAGGGCACCGCTGGCTGAAGGG GGGCGTGGTGCTGAAGGAGGACGCGCTGCCCGG CCAGAAAACGGAGTTCAAGGTGGACTCCGACGAC CAGTGGGGAGAGTACTCCTGCGTCTTCCTCCCCG AGCCCATGGGCACGGCAACATCCAGCTCCACGGG CCTCCCAGAGTGAAGGCTGTGAAGTCGTCAGAAC ACATCAACGAGGGGGAGACGGCCATGCTGGTCTG CAAGTCAGAGTCCGTGCCACCTGTCACTGACTGG GCCTGGTACAAGATCACTGACTCTGAGGACAAGG CCCTCATGAACGGCTCCGAGAGCAGGTTCTTCGT GAGTTCCTCGCAGGGCCGGTCAGAGCTACACATT GAGAACCTGAACATGGAGGCCGACCCCGGCCAGT ACCGGGTGCAACGGCACCAGCTCCAAGGGCTCCGA CCAGGCCATCATCACGCTCCGCGTGCGCAGCCAC CTGGCCGCCCTCTGGCCCTTCCTGGGCATCGTGG CTGAGGTGCTGGTGCTGGTCACCATCATCTTCATC TACGAGAAGCGCCGGAAGCCCGAGGACGTCCTG GATGATGACGACGCCGGCTCTGCACCCCTGAAGA GCAGCGGGCAGCACCAGAATGACAAAGGCAAGAA CGTCCGCCAGAGGAACTCTTCCTGAGGCAGGTGG CCCGAGGACGCTCCCTGCTCCACGTCTGCGCCGC CGCCGGAGTCCACTCCCAGTGCTTGCAAGATTCC | 9 | TSSSTGLP E* |

TABLE 3A-continued

| SEQ ID | identifier_position | position | modified_RNA | PAP length | PAP |
|---|---|---|---|---|---|
| | | | AAGTTCTCACCTCTTAAAGAAAACCCACCCCGTAG<br>ATTCC | | |
| 2178 | NM_1985<br>89.1_464 | 464 | GTGCGCGCGCCCGGTCCGCGCCTCCGCCGCTTTT<br>TATAGCGGCCGCGGGCGGCGGCGGCAGCGGTTG<br>GAGGTTGTAGGACCGGCGAGGAATAGGAATCATG<br>GCGGCTGCGCTGTTCGTGCTGCTGGGATTCGCGC<br>TGCTGGGCACCCACGGAGCCTCCGGGGCTGCCG<br>GCACAGTCTTCACTACCGTAGAAGACCTTGGCTCC<br>AAGATACTCCTCACCTGCTCCTTGAATGACAGCGC<br>CACAGAGGTCACAGGGCACCGCTGGCTGAAGGG<br>GGGCGTGGTGCTGAAGGAGGACGCGCTGCCCGG<br>CCAGAAAACGGAGTTCAAGGTGGACTCCGACGAC<br>CAGTGGGGAGAGTACTCCTGCGTCTTCCTCCCCG<br>AGCCCATGGGCACGGCCAACATCCAGCTCCACGG<br>GCCTCCCAGAGTGAAGGCTGTGAAGTCGTCAGAA<br>CACATCAACGAGGGGGAGACGGCATGCTGGTCTG<br>CAAGTCAGAGTCCGTGCCACCTGTCACTGACTGG<br>GCCTGGTACAAGATCACTGACTCTGAGGACAAGG<br>CCCTCATGAACGGCTCCGAGAGCAGGTTCTTCGT<br>GAGTTCCTCGCAGGGCCGGTCAGAGCTACACATT<br>GAGAACCTGAACATGGAGGCCGACCCCGGCCAGT<br>ACCGGTGCAACGGCACCAGCTCCAAGGGCTCCGA<br>CCAGGCCATCATCACGCTCCGCGTGCGCAGCCAC<br>CTGGCCGCCCTCTGGCCCTTCCTGGGCATCGTGG<br>CTGAGGTGCTGGTGCTGGTCACCATCATCTTCATC<br>TACGAGAAGCGCCGGAAGCCCGAGGACGTCCTG<br>GATGATGACGACGCCGGCTCTGCACCCCTGAAGA<br>GCAGCGGGCAGCACCAGAATGACAAAGGCAAGAA<br>CGTCCGCCAGAGGAACTCTTCCTGAGGCAGGTGG<br>CCCGAGGACGCTCCCTGCTCCACGTCTGCGCCGC<br>CGCCGGAGTCCACTCCCAGTGCTTGCAAGATTCC<br>AAGTTCTCACCTCTTAAAGAAAACCCACCCCGTAG<br>ATTCC | 28 | CWSASQS<br>PCHLSLTG<br>PGTRSLTL<br>RTRPS* |
| 2179 | NM_1985<br>89.1_557 | 557 | GTGCGCGCGCCCGGTCCGCGCCTCCGCCGCTTTT<br>TATAGCGGCCGCGGGCGGCGGCGGCAGCGGTTG<br>GAGGTTGTAGGACCGGCGAGGAATAGGAATCATG<br>GCGGCTGCGCTGTTCGTGCTGCTGGGATTCGCGC<br>TGCTGGGCACCCACGGAGCCTCCGGGGCTGCCG<br>GCACAGTCTTCACTACCGTAGAAGACCTTGGCTCC<br>AAGATACTCCTCACCTGCTCCTTGAATGACAGCGC<br>CACAGAGGTCACAGGGCACCGCTGGCTGAAGGG<br>GGGCGTGGTGCTGAAGGAGGACGCGCTGCCCGG<br>CCAGAAAACGGAGTTCAAGGTGGACTCCGACGAC<br>CAGTGGGGAGAGTACTCCTGCGTCTTCCTCCCCG<br>AGCCCATGGGCACGGCCAACATCCAGCTCCACGG<br>GCCTCCCAGAGTGAAGGCTGTGAAGTCGTCAGAA<br>CACATCAACGAGGGGGAGACGGCCATGCTGGTCT<br>GCAAGTCAGAGTCCGTGCCACCTGTCACTGACTG<br>GCCTGGTACAAGATCACTGACTCTGAGGACAAG<br>GCCCTCATGAACGGTCCGAGAGCAGGTTCTTCGT<br>GAGTTCCTCGCAGGGCCGGTCAGAGCTACACATT<br>GAGAACCTGAACATGGAGGCCGACCCCGGCCAGT<br>ACCGGTGCAACGGCACCAGCTCCAAGGGCTCCGA<br>CCAGGCCATCATCACGCTCCGCGTGCGCAGCCAC<br>CTGGCCGCCCTCTGGCCCTTCCTGGGCATCGTGG<br>CTGAGGTGCTGGTGCTGGTCACCATCATCTTCATC<br>TACGAGAAGCGCCGGAAGCCCGAGGACGTCCTG<br>GATGATGACGACGCCGGCTCTGCACCCCTGAAGA<br>GCAGCGGGCAGCACCAGAATGACAAAGGCAAGAA<br>CGTCCGCCAGAGGAACTCTTCCTGAGGCAGGTGG<br>CCCGAGGACGCTCCCTGCTCCACGTCTGCGCCGC<br>CGCCGGAGTCCACTCCCAGTGCTTGCAAGATTCC<br>AAGTTCTCACCTCTTAAAGAAAACCCACCCCGTAG<br>ATTCC | 6 | PRAGSS* |
| 2180 | NM_1985<br>89.1_642 | 642 | GTGCGCGCGCCCGGTCCGCGCCTCCGCCGCTTTT<br>TATAGCGGCCGCGGGCGGCGGCGGCAGCGGTTG<br>GAGGTTGTAGGACCGGCGAGGAATAGGAATCATG<br>GCGGCTGCGCTGTTCGTGCTGCTGGGATTCGCGC<br>TGCTGGGCACCCACGGAGCCTCCGGGGCTGCCG<br>GCACAGTCTTCACTACCGTAGAAGACCTTGGCTCC<br>AAGATACTCCTCACCTGCTCCTTGAATGACAGCGC<br>CACAGAGGTCACAGGGCACCGCTGGCTGAAGGG<br>GGGCGTGGTGCTGAAGGAGGACGCGCTGCCCGG<br>CCAGAAAACGGAGTTCAAGGTGGACTCCGACGAC<br>CAGTGGGGAGAGTACTCCTGCGTCTTCCTCCCCG<br>AGCCCATGGGCACGGCCAACATCCAGCTCCACGG<br>GCCTCCCAGAGTGAAGGCTGTGAAGTCGTCAGAA | 67 | STGATAPA<br>PRAPTRPS<br>SRSACAAT<br>WPPSGPS<br>WASWLRC<br>WCWSPSS<br>SSTRSAGS<br>PRTSWMM<br>TTPALHP* |

TABLE 3A-continued

| SEQ ID | identifier_position | position | modified_RNA | PAP length | PAP |
|---|---|---|---|---|---|
| | | | CACATCAACGAGGGGGAGACGGCCATGCTGGTCT GCAAGTCAGAGTCCGTGCCACCTGTCACTGACTG GGCCTGGTACAAGATCACTGACTCTGAGGACAAG GCCCTCATGAACGGCTCCGAGAGCAGGTTCTTCG TGAGTTCCTCGCAGGGCCGGTCAGAGCTACACAT TGAGAACCTGAACATGGAGGCCGACCCCGGCAGT ACCGGTGCAACGGCACCAGCTCCAAGGGCTCCGA CCAGGCCATCATCACGCTCCGCGTGCGCAGCCAC CTGGCCGCCCTCTGGCCCTTCCTGGGCATCGTGG CTGAGGTGCTGGTGCTGGTCACCATCATCTTCATC TACGAGAAGCGCCGGAAGCCCGAGGACGTCCTG GATGATGACGACGCCGGCTCTGCACCCCTGAAGA GCAGCGGGCAGCACCAGAATGACAAAGGCAAGAA CGTCCGCCAGAGGAACTCTTCCTGAGGCAGGTGG CCCGAGGACGCTCCCTGCTCCACGTCTGCGCCGC CGCCGGAGTCCACTCCCAGTGCTTGCAAGATTCC AAGTTCTCACCTCTTAAAGAAAACCCACCCCGTAG ATTCC | | |
| 2181 | NM_1985 89.1_662 | 662 | GTGCGCGCGCCCGGTCCGCGCCTCCGCCGCTTTT TATAGCGGCCGCGGGCGGCGGCGGCAGCGGTTG GAGGTTGTAGGACCGGCGAGGAATAGGAATCATG GCGGCTGCGCTGTTCGTGCTGCTGGGATTCGCGC TGCTGGGCACCCACGGAGCCTCCGGGGCTGCCG GCACAGTCTTCACTACCGTAGAAGACCTTGGCTCC AAGATACTCCTCACCTGCTCCTTGAATGACAGCGC CACAGAGGTCACAGGGCACCGCTGGCTGAAGGG GGGCGTGGTGCTGAAGGAGGACGCGCTGCCCGG CCAGAAAACGGAGTTCAAGGTGGACTCCGACGAC CAGTGGGGAGAGTACTCCTGCGTCTTCCTCCCCG AGCCCATGGGCACGGCCAACATCCAGCTCCACGG GCCTCCCAGAGTGAAGGCTGTGAAGTCGTCAGAA CACATCAACGAGGGGGAGACGGCCATGCTGGTCT GCAAGTCAGAGTCCGTGCCACCTGTCACTGACTG GGCCTGGTACAAGATCACTGACTCTGAGGACAAG GCCCTCATGAACGGCTCCGAGAGCAGGTTCTTCG TGAGTTCCTCGCAGGGCCGGTCAGAGCTACACAT TGAGAACCTGAACATGGAGGCCGACCCCGGCCAG TACCGGTGCAACGGCACAGCTCCAAGGGCTCCGA CCAGGCCATCATCACGCTCCGCGTGCGCAGCCAC CTGGCCGCCCTCTGGCCCTTCCTGGGCATCGTGG CTGAGGTGCTGGTGCTGGTCACCATCATCTTCATC TACGAGAAGCGCCGGAAGCCCGAGGACGTCCTG GATGATGACGACGCCGGCTCTGCACCCCTGAAGA GCAGCGGGCAGCACCAGAATGACAAAGGCAAGAA CGTCCGCCAGAGGAACTCTTCCTGAGGCAGGTGG CCCGAGGACGCTCCCTGCTCCACGTCTGCGCCGC CGCCGGAGTCCACTCCCAGTGCTTGCAAGATTCC AAGTTCTCACCTCTTAAAGAAAACCCACCCCGTAG ATTCC | 60 | APRAPTRP SSRSACAA TWPPSGP SWASWLR CWCWSPS SSSTRSAG SPRTSWM MTTPALHP* |
| 2182 | NM_1985 89.1_686 | 686 | GTGCGCGCGCCCGGTCCGCGCCTCCGCCGCTTTT TATAGCGGCCGCGGGCGGCGGCGGCAGCGGTTG GAGGTTGTAGGACCGGCGAGGAATAGGAATCATG GCGGCTGCGCTGTTCGTGCTGCTGGGATTCGCGC TGCTGGGCACCCACGGAGCCTCCGGGGCTGCCG GCACAGTCTTCACTACCGTAGAAGACCTTGGCTCC AAGATACTCCTCACCTGCTCCTTGAATGACAGCGC CACAGAGGTCACAGGGCACCGCTGGCTGAAGGG GGGCGTGGTGCTGAAGGAGGACGCGCTGCCCGG CCAGAAAACGGAGTTCAAGGTGGACTCCGACGAC CAGTGGGGAGAGTACTCCTGCGTCTTCCTCCCCG AGCCCATGGGCACGGCCAACATCCAGCTCCACGG GCCTCCCAGAGTGAAGGCTGTGAAGTCGTCAGAA CACATCAACGAGGGGGAGACGGCCATGCTGGTCT GCAAGTCAGAGTCCGTGCCACCTGTCACTGACTG GGCCTGGTACAAGATCACTGACTCTGAGGACAAG GCCCTCATGAACGGCTCCGAGAGCAGGTTCTTCG TGAGTTCCTCGCAGGGCCGGTCAGAGCTACACAT TGAGAACCTGAACATGGAGGCCGACCCCGGCCAG TACCGGTGCAACGGCACCAGCTCCAAGGGCTCCG ACCAGGCATCATCACGCTCCGCGTGCGCAGCCAC CTGGCCGCCCTCTGGCCCTTCCTGGGCATCGTGG CTGAGGTGCTGGTGCTGGTCACCATCATCTTCATC TACGAGAAGCGCCGGAAGCCCGAGGACGTCCTG GATGATGACGACGCCGGCTCTGCACCCCTGAAGA GCAGCGGGCAGCACCAGAATGACAAAGGCAAGAA CGTCCGCCAGAGGAACTCTTCCTGAGGCAGGTGG CCCGAGGACGCTCCCTGCTCCACGTCTGCGCCGC | 52 | SSRSACAA TWPPSGP SWASWLR CWCWSPS SSSTRSAG SPRTSWM MTTPALHP* |

TABLE 3A-continued

| SEQ ID | identifier_position | position | modified_RNA | PAP length | PAP |
|---|---|---|---|---|---|
| | | | CGCCGGAGTCCACTCCCAGTGCTTGCAAGATTCC AAGTTCTCACCTCTTAAAGAAAACCCACCCCGTAG ATTCC | | |
| 2183 | NM_198589.1_723 | 723 | GTGCGCGCGCCCGGTCCGCGCCTCCGCCGCTTTT TATAGCGGCCGCGGGCGGCGGCGGCAGCGGTTG GAGGTTGTAGGACCGGCGAGGAATAGGAATCATG GCGGCTGCGCTGTTCGTGCTGCTGGGATTCGCGC TGCTGGGCACCCACGGAGCCTCCGGGGCTGCCG GCACAGTCTTCACTACCGTAGAAGACCTTGGCTCC AAGATACTCCTCACCTGCTCCTTGAATGACAGCGC CACAGAGGTCACAGGGCACCGCTGGCTGAAGGG GGGCGTGGTGCTGAAGGAGGACGCGCTGCCCGG CCAGAAAACGGAGTTCAAGGTGGACTCCGACGAC CAGTGGGGAGAGTACTCCTGCGTCTTCCTCCCCG AGCCCATGGGCACGGCCAACATCCAGCTCCACGG GCCTCCCAGAGTGAAGGCTGTGAAGTCGTCAGAA CACATCAACGAGGGGGAGACGGCCATGCTGGTCT GCAAGTCAGAGTCCGTGCCACCTGTCACTGACTG GGCCTGGTACAAGATCACTGACTCTGAGGACAAG GCCCTCATGAACGGCTCCGAGAGCAGGTTCTTCG TGAGTTCCTCGCAGGGCCGGTCAGAGCTACACAT TGAGAACCTGAACATGGAGGCCGACCCCGGCCAG TACCGGTGCAACGGCACCAGCTCCAAGGGCTCCG ACCAGGCCATCATCACGCTCCGCGTGCGCAGCCA CCTGGCCGCCTCTGGCCCTTCCTGGGCATCGTGG CTGAGGTGCTGGTGCTGGTCACCATCATCTTCATC TACGAGAAGCGCCGGAAGCCCGAGGACGTCCTG GATGATGACGACGCCGGCTCTGCACCCCTGAAGA GCAGCGGGCAGCACCAGAATGACAAAGGCAAGAA CGTCCGCCAGAGGAACTCTTCCTGAGGCAGGTGG CCCGAGGACGCTCCCTGCTCCACGTCTGCGCCGC CGCCGGAGTCCACTCCCAGTGCTTGCAAGATTCC AAGTTCTCACCTCTTAAAGAAAACCCACCCCGTAG ATTCC | 40 | SGPSWAS WLRCWCW SPSSSSTR SAGSPRTS WMMTTPA LHP* |
| 2184 | NM_199440.1_1029 | 1029 | GCCCCGACGCGCACCGCGATTCGCCCCAAGGGC CCTGCGCAGGACGCTGACGCGAAGACTCGGAGG CGGAAGAAAAAAGGAGCTGTTTCTAGGCTTTTCTA GGCGCCCAGCCGAGAAATGCTTCGGTTACCCACA GTCTTTCGCCAGATGAGACCGGTGTCCAGGGTAC TGGCTCCTCATCTCACTCGGGCTTATGCCAAAGAT GTAAAATTTGGTGCAGATGCCCGAGCCTTAATGCT TCAAGGTGTAGACCTTTTAGCCGATGCTGTGGCCG TTACAATGGGGCCAAAGGGAAGAACAGTGATTATT GAGCAGAGTTGGGGAAGTCCCAAAGTAACAAAAG ATGGTGTGACTGTTGCAAAGTCAATTGACTTAAAA GATAAATACAAAAACATTGGAGCTAAACTTGTTCAA GATGTTGCCAATAACACAAATGAAGAAGCTGGGGA TGGCACTACCACTGCTACTGTACTGGCACGCTCTA TAGCCAAGGAAGGCTTCGAGAAGATTAGCAAAGG TGCTAATCCAGTGGAAATCAGGAGAGGTGTGATGT TAGCTGTTGATGCTGTAATTGCTGAACTTAAAAAG CAGTCTAAACCTGTGACCACCCCTGAAGAAATTGC ACAGGTTGCTACGATTTCTGCAAACGGAGACAAAG AAATTGGCAATATCATCTCTGATGCAATGAAAAAAG TTGGAAGAAAGGGTGTCATCACAGTAAAGGATGGA AAAACACTGAATGATGAATTAGAAATTATTGAAGGC ATGAAGTTTGATCGAGGCTATATTTCTCCATACTTT ATTAATACATCAAAAGGTCAGAAATGTGAATTCCAG GATGCCTATGTTCTGTTGAGTGAAAAGAAAATTTCT AGTATCCAGTCCATTGTACCTGCTCTTGAAATTGC CAATGCTCACCGTAAGCCTTTGGTCATAATCGCTG AAGATGTTGATGGAGAAGCTCTAAGTACACTCGTC TTGAATAGGCTAAAGGTTGGTCTTCAGGTTGTGGC AGTCAAGGCTC | 25 | LVTIERTSL KIWLLLLVV QCLEKRD* |
| 2185 | NM_199440.1_1071 | 1071 | GCCCCGACGCGCACCGCGATTCGCCCCAAGGGC CCTGCGCAGGACGCTGACGCGAAGACTCGGAGG CGGAAGAAAAAAGGAGCTGTTTCTAGGCTTTTCTA GGCGCCCAGCCGAGAAATGCTTCGGTTACCCACA GTCTTTCGCCAGATGAGACCGGTGTCCAGGGTAC TGGCTCCTCATCTCACTCGGGCTTATGCCAAAGAT GTAAAATTTGGTGCAGATGCCCGAGCCTTAATGCT TCAAGGTGTAGACCTTTTAGCCGATGCTGTGGCCG TTACAATGGGGCCAAAGGGAAGAACAGTGATTATT GAGCAGAGTTGGGGAAGTCCCAAAGTAACAAAAG ATGGTGTGACTGTTGCAAAGTCAATTGACTTAAAA GATAAATACAAAAACATTGGAGCTAAACTTGTTCAA GATGTTGCCAATAACACAAATGAAGAAGCTGGGGA | 12 | MLLVVQCL EKRD* |

TABLE 3A-continued

| SEQ ID | identifier_position | position | modified_RNA | PAP length | PAP |
|---|---|---|---|---|---|
| | | | TGGCACTACCACTGCTACTGTACTGGCACGCTCTA<br>TAGCCAAGGAAGGCTTCGAGAAGATTAGCAAAGG<br>TGCTAATCCAGTGGAAATCAGGAGAGGTGTGATGT<br>TAGCTGTTGATGCTGTAATTGCTGAACTTAAAAAG<br>CAGTCTAAACCTGTGACCACCCCTGAAGAAATTGC<br>ACAGGTTGCTACGATTTCTGCAAACGGAGACAAAG<br>AAATTGGCAATATCATCTCTGATGCAATGAAAAAAG<br>TTGGAAGAAAGGGTGTCATCACAGTAAAGGATGGA<br>AAAACACTGAATGATGAATTAGAAATTATTGAAGGC<br>ATGAAGTTTGATCGAGGCTATATTTCTCCATACTTT<br>ATTAATACATCAAAAGGTCAGAAATGTGAATTCCAG<br>GATGCCTATGTTCTGTTGAGTGAAAAGAAAATTTCT<br>AGTATCCAGTCCATTGTACCTGCTCTTGAAATTGC<br>CAATGCTCACCGTAAGCCTTTGGTCATAATCGCTG<br>AAGATGTTGATGGAGAAGCTCTAAGTACACTCGTC<br>TTGAATAGGCTAAAGGTTGGTCTTCAGGTTGTGGC<br>AGTCAAGGCTC | | |
| 2186 | NM_199440.1_1092 | 1092 | GCCCCGACGCGCACCGCGATTCGCCCCAAGGGC<br>CCTGCGCAGGACGCTGACGCGAAGACTCGGAGG<br>CGGAAGAAAAAAGGAGCTGTTTCTAGGCTTTTCTA<br>GGCGCCCAGCCGAGAAATGCTTCGGTTACCCACA<br>GTCTTTCGCCAGATGAGACCGGTGTCCAGGGTAC<br>TGGCTCCTCATCTCACTCGGGCTTATGCCAAAGAT<br>GTAAAATTTGGTGCAGATGCCCGAGCCTTAATGCT<br>TCAAGGTGTAGACCTTTTAGCCGATGCTGTGGCCG<br>TTACAATGGGGCCAAAGGGAAGAACAGTGATTATT<br>GAGCAGAGTTGGGGAAGTCCCAAAGTAACAAAAG<br>ATGGTGTGACTGTTGCAAAGTCAATTGACTTAAAA<br>GATAAATACAAAAACATTGGAGCTAAACTTGTTCAA<br>GATGTTGCCAATAACACAAATGAAGAAGCTGGGGA<br>TGGCACTACCACTGCTACTGTACTGGCACGCTCTA<br>TAGCCAAGGAAGGCTTCGAGAAGATTAGCAAAGG<br>TGCTAATCCAGTGGAAATCAGGAGAGGTGTGATGT<br>TAGCTGTTGATGCTGTAATTGCTGAACTTAAAAAG<br>CAGTCTAAACCTGTGACCACCCCTGAAGAAATTGC<br>ACAGGTTGCTACGATTTCTGCAAACGGAGACAAAG<br>AAATTGGCAATATCATCTCTGATGCAATGAAAAAAG<br>TTGGAAGAAAGGGTGTCATCACAGTAAAGGATGGA<br>AAAACACTGAATGATGAATTAGAAATTATTGAAGGC<br>ATGAAGTTTGATCGAGGCTATATTTCTCCATACTTT<br>ATTAATACATCAAAAGGTCAGAAATGTGAATTCCAG<br>GATGCCTATGTTCTGTTGAGTGAAAAGAAAATTTCT<br>AGTATCCAGTCCATTGTACCTGCTCTTGAAATTGC<br>CAATGCTCACCGTAAGCCTTTGGTCATAATCGCTG<br>AAGATGTTGATGGAGAAGCTCTAAGTACACTCGTC<br>TTGAATAGGCTAAAGGTTGGTCTTCAGGTTGTGGC<br>AGTCAAGGCTC | 5 | LEKRD* |
| 2187 | NM_199440.1_1647 | 1647 | GCCCCGACGCGCACCGCGATTCGCCCCAAGGGC<br>CCTGCGCAGGACGCTGACGCGAAGACTCGGAGG<br>CGGAAGAAAAAAGGAGCTGTTTCTAGGCTTTTCTA<br>GGCGCCCAGCCGAGAAATGCTTCGGTTACCCACA<br>GTCTTTCGCCAGATGAGACCGGTGTCCAGGGTAC<br>TGGCTCCTCATCTCACTCGGGCTTATGCCAAAGAT<br>GTAAAATTTGGTGCAGATGCCCGAGCCTTAATGCT<br>TCAAGGTGTAGACCTTTTAGCCGATGCTGTGGCCG<br>TTACAATGGGGCCAAAGGGAAGAACAGTGATTATT<br>GAGCAGAGTTGGGGAAGTCCCAAAGTAACAAAAG<br>ATGGTGTGACTGTTGCAAAGTCAATTGACTTAAAA<br>GATAAATACAAAAACATTGGAGCTAAACTTGTTCAA<br>GATGTTGCCAATAACACAAATGAAGAAGCTGGGGA<br>TGGCACTACCACTGCTACTGTACTGGCACGCTCTA<br>TAGCCAAGGAAGGCTTCGAGAAGATTAGCAAAGG<br>TGCTAATCCAGTGGAAATCAGGAGAGGTGTGATGT<br>TAGCTGTTGATGCTGTAATTGCTGAACTTAAAAAG<br>CAGTCTAAACCTGTGACCACCCCTGAAGAAATTGC<br>ACAGGTTGCTACGATTTCTGCAAACGGAGACAAAG<br>AAATTGGCAATATCATCTCTGATGCAATGAAAAAAG<br>TTGGAAGAAAGGGTGTCATCACAGTAAAGGATGGA<br>AAAACACTGAATGATGAATTAGAAATTATTGAAGGC<br>ATGAAGTTTGATCGAGGCTATATTTCTCCATACTTT<br>ATTAATACATCAAAAGGTCAGAAATGTGAATTCCAG<br>GATGCCTATGTTCTGTTGAGTGAAAAGAAAATTTCT<br>AGTATCCAGTCCATTGTACCTGCTCTTGAAATTGC<br>CAATGCTCACCGTAAGCCTTTGGTCATAATCGCTG<br>AAGATGTTGATGGAGAAGCTCTAAGTACACTCGTC<br>TTGAATAGGCTAAAGGTTGGTCTTCAGGTTGTGGC<br>AGTCAAGGCTC | 1 | L* |

TABLE 3A-continued

| SEQ ID | identifier_position | position | modified_RNA | PAP length | PAP |
|---|---|---|---|---|---|
| 2188 | NM_203339.1_1173 | 1173 | GGGCAGCCTGCTGTCGGCTTAGAGGGGATGGGC AGTGTGGAGGGCCTGGCAGAGCAAGAGGACTCAT CCTTCCAAAGGGACTTTCTCTGGGAAGCCTGCTCC TCGGGCCACTGCGAACCCTCTCTACTCTCCGAAG GGAATTGTCCTTCCTGGCTTCCACTACTTCCACCC CTGAATGCACAGGCAGCCCGGCCCAAGTCTCCCA CTAGGGATGCAGATGGATTCGGTGTGAAGGGCTG GCTGCTGTTGCCTCCGGCTCTTGAAAGTCAAGTTC AGAGGCGTGCAAAGACTCCAGAATTGGAGGCATG ATGAAGACTCTGCTGCTGTTTGTGGGGCTGCTGCT GACCTGGGAGAGTGGGCAGGTCCTGGGGGACCA GACGGTCTCAGACAATGAGCTCCAGGAAATGTCC AATCAGGGAAGTAAGTACGTCAATAAGGAAATTCA AAATGCTGTCAACGGGGTGAAACAGATAAAGACTC TCATAGAAAAAACAAACGAAGAGCGCAAGACACTG CTCAGCAACCTAGAAGAAGCCAAGAAGAAGAAAG AGGATGCCCTAAATGAGACCAGGGAATCAGAGAC AAAGCTGAAGGAGCTCCCAGGAGTGTGCAATGAG ACCATGATGGCCCTCTGGGAAGAGTGTAAGCCCT GCCTGAAACAGACCTGCATGAAGTTCTACGCACG CGTCTGCAGAAGTGGCTCAGGCCTGGTTGGCCGC CAGCTTGAGGAGTTCCTGAACCAGAGCTCGCCCTT CTACTTCTGGATGAATGGTGACCGCATCGACTCCC TGCTGGAGAACGACCGGCAGCAGACGCACATGCT GGATGTCATGCAGGACCACTTCAGCCGCGCGTCC AGCATCATAGACGAGCTCTTCCAGGACAGGTTCTT CACCCGGGAGCCCCAGGATACCTACCACTACCTG CCCTTCAGCCTGCCCCACCGGAGGCCTCACTTCTT CTTTCCCAAGTCCCGCATCGTCCGCAGCTTGATGC CCTTCTCTCCGTACGAGCCCCTGAACTT | 8 | TTPRAACG* |
| 2189 | NM_203339.1573 | 573 | GGGCAGCCTGCTGTCGGCTTAGAGGGGATGGGC AGTGTGGAGGGCCTGGCAGAGCAAGAGGACTCAT CCTTCCAAAGGGACTTTCTCTGGGAAGCCTGCTCC TCGGGCCACTGCGAACCCTCTCTACTCTCCGAAG GGAATTGTCCTTCCTGGCTTCCACTACTTCCACCC CTGAATGCACAGGCAGCCCGGCCCAAGTCTCCCA CTAGGGATGCAGATGGATTCGGTGTGAAGGGCTG GCTGCTGTTGCCTCCGGCTCTTGAAAGTCAAGTTC AGAGGCGTGCAAAGACTCCAGAATTGGAGGCATG ATGAAGACTCTGCTGCTGTTTGTGGGGCTGCTGCT GACCTGGGAGAGTGGGCAGGTCCTGGGGGACCA GACGGTCTCAGACAATGAGCTCCAGGAAATGTCC AATCAGGGAAGTAAGTACGTCAATAAGGAAATTCA AAATGCTGTCAACGGGGTGAAACAGATAAAGACTC TCATAGAAAAAACAAACGAAGAGCGCAAGACACTG CTCAGCAACCTAGAAGAAGCCAAGAAGAAGAAAG AGGATGCCCTAAATGAGACCAGGAATCAGAGACA AAGCTGAAGGAGCTCCCAGGAGTGTGCAATGAGA CCATGATGGCCCTCTGGGAAGAGTGTAAGCCCTG CCTGAAACAGACCTGCATGAAGTTCTACGCACGC GTCTGCAGAAGTGGCTCAGGCCTGGTTGGCCGCC AGCTTGAGGAGTTCCTGAACCAGAGCTCGCCCTTC TACTTCTGGATGAATGGTGACCGCATCGACTCCCT GCTGGAGAACGACCGGCAGCAGACGCACATGCTG GATGTCATGCAGGACCACTTCAGCCGCGCGTCCA GCATCATAGACGAGCTCTTCCAGGACAGGTTCTTC ACCCGGGAGCCCCAGGATACCTACCACTACCTGC CCTTCAGCCTGCCCCACCGGAGGCCTCACTTCTTC TTTCCCAAGTCCCGCATCGTCCGCAGCTTGATGCC CTTCTCTCCGTACGAGCCCCTGAACTTC | 5 | NQRQS* |
| 2190 | NM_203456.1_130 | 130 | ACGGGTCGAGTGCTGGCTTCCGGCGGAAAAGCGC GCGAGCAAGATGGCCACCACCAAGCGCGTCTTGT ACGTGGGTGGACTGGCAGAGGAAGTGGACGACAA AGTTCTTCATGCTGCGTTCATTCCTTTGGAGACATC ACAGATATTCAGATTCCTCTGGATTATGAAACAGAA AAGCACCGAGGATTTGCTTTTGTTGAATTTGAGTT GGCAGAGGATGCTGCAGCAGCTATCGACAACATG AATGAATCTGAGCTTTTTGGACGTACAATTCGTGTC AATTTGGCCAAACCAATGAGAATTAAGGAAGGCTC TTCCAGGCCAGTTTGGTCAGATGATGACTGGTTGA AGAAGTTTTCTGGGAAGACGCTTGAAGAGAATAAA GAGGAAGAAGGGTCAGAGCCTCCCAAAGCAGAGA CCCAGGAGGGAGAGCCCATTGCTAAAAAGGCCCG CTCAAATCCTCAGGTGTACATGGACATCAAGATTG GGAACAAGCCGGCTGGCCGCATCCAGATGCTCCT GCGTTCTGATGTCGTGCCCATGACAGCAGAGAATT TCCGCTGCCTGTGCACTCATGAAAAGGGCTTTGGC | 38 | LETSQIFRF LWIMKQKS TEDLLLLNL SWQRMLQ QLSTT* |

TABLE 3A-continued

| SEQ ID | identifier_position | position | modified_RNA | PAP length | PAP |
|---|---|---|---|---|---|
| | | | TTTAAGGGAAGCAGCTTCCACCGCATCATCCCCCA<br>GTTCATGTGCCAGGGCGGTGATTTCACAAACCACA<br>ATGGCACTGGGGGCAAGTCCATCTATGGGAAGAA<br>GTTCGATGATGAAAACTTTATCCTCAAGCATACGG<br>GACCAGGTCTACTATCCATGGCCAACTCTGGCCCA<br>AACACCAATGGCTCTCAGTTCTTCCTGACATGTGA<br>CAAGACAGACTGGCTGGATGGCAAGCATGTGGTG<br>TTTGGAGAGGTCACCGAAGGCCTAGATGTCTTGC<br>GGCAAATTGAGAAACAAGAAGAGTCAGCAATTACC<br>AGCCAGCCGAGGTCCTGGAAGCTGACGTAGAGCT<br>CGTGCCGACGGCAGACCTGCCGGCCGTGGGAGC<br>CGTGGACGTCATCTGCAGGGACAGAAGGGGCAAG<br>GTCTTTTCTGGGGTTCCTAC | | |
| 2191 | NM_203456.1_196 | 196 | ACGGGTCGAGTGCTGGCTTCCGGCGGAAAAGCGC<br>GCGAGCAAGATGGCCACCACCAAGCGCGTCTTGT<br>ACGTGGGTGGACTGGCAGAGGAAGTGGACGACAA<br>AGTTCTTCATGCTGCGTTCATTCCTTTTGGAGACAT<br>CACAGATATTCAGATTCCTCTGGATTATGAAACAG<br>AAAAGCACCGAGGATTTGCTTTGTTGAATTTGAGTT<br>GGCAGAGGATGCTGCAGCAGCTATCGACAACATG<br>AATGAATCTGAGCTTTTTGGACGTACAATTCGTGTC<br>AATTTGGCCAAACCAATGAGAATTAAGGAAGGCTC<br>TTCCAGGCCAGTTTGGTCAGATGATGACTGGTTGA<br>AGAAGTTTTCTGGGAAGACGCTTGAAGAGAATAAA<br>GAGGAAGAAGGGTCAGAGCCTCCCAAAGCAGAGA<br>CCCAGGAGGGAGAGCCCATTGCTAAAAAGGCCCG<br>CTCAAATCCTCAGGTGTACATGGACATCAAGATTG<br>GGAACAAGCCGGCTGGCCGCATCCAGATGCTCCT<br>GCGTTCTGATGTCGTGCCCATGACAGCAGAGAATT<br>TCCGCTGCCTGTGCACTCATGAAAAGGGCTTTGGC<br>TTTAAGGGAAGCAGCTTCCACCGCATCATCCCCCA<br>GTTCATGTGCCAGGGCGGTGATTTCACAAACCACA<br>ATGGCACTGGGGGCAAGTCCATCTATGGGAAGAA<br>GTTCGATGATGAAAACTTTATCCTCAAGCATACGG<br>GACCAGGTCTACTATCCATGGCCAACTCTGGCCCA<br>AACACCAATGGCTCTCAGTTCTTCCTGACATGTGA<br>CAAGACAGACTGGCTGGATGGCAAGCATGTGGTG<br>TTTGGAGAGGTCACCGAAGGCCTAGATGTCTTGC<br>GGCAAATTGAGAAACAAGAAGAGTCAGCAATTACC<br>AGCCAGCCGAGGTCCTGGAAGCTGACGTAGAGCT<br>CGTGCCGACGGCAGACCTGCCGGCCGTGGGAGC<br>CGTGGACGTCATCTGCAGGGACAGAAGGGGCAAG<br>GTCTTTTCTGGGGTTCCTAC | 16 | LLNLSWQR MLQQLSTT* |
| 2192 | NM_203456.1_262 | 262 | ACGGGTCGAGTGCTGGCTTCCGGCGGAAAAGCGC<br>GCGAGCAAGATGGCCACCACCAAGCGCGTCTTGT<br>ACGTGGGTGGACTGGCAGAGGAAGTGGACGACAA<br>AGTTCTTCATGCTGCGTTCATTCCTTTTGGAGACAT<br>CACAGATATTCAGATTCCTCTGGATTATGAAACAG<br>AAAAGCACCGAGGATTTGCTTTTGTTGAATTTGAGT<br>TGGCAGAGGATGCTGCAGCAGCTATCGACAACAT<br>GAATGAATCTGAGCTTTTGGACGTACAATTCGTGT<br>CAATTTGGCCAAACCAATGAGAATTAAGGAAGGCT<br>CTTCCAGGCCAGTTTGGTCAGATGATGACTGGTTG<br>AAGAAGTTTTCTGGGAAGACGCTTGAAGAGAATAA<br>AGAGGAAGAAGGGTCAGAGCCTCCCAAAGCAGAG<br>ACCCAGGAGGGAGAGCCCATTGCTAAAAAGGCCC<br>GCTCAAATCCTCAGGTGTACATGGACATCAAGATT<br>GGGAACAAGCCGGCTGGCCGCATCCAGATGCTCC<br>TGCGTTCTGATGTCGTGCCCATGACAGCAGAGAAT<br>TCCGCTGCCTGTGCACTCATGAAAAGGGCTTTGG<br>CTTTAAGGGAAGCAGCTTCCACCGCATCATCCCCC<br>AGTTCATGTGCCAGGGCGGTGATTTCACAAACCAC<br>AATGGCACTGGGGGCAAGTCCATCTATGGGAAGA<br>AGTTCGATGATGAAAACTTTATCCTCAAGCATACG<br>GGACCAGGTCTACTATCCATGGCCAACTCTGGCC<br>CAAACACCAATGGCTCTCAGTTCTTCCTGACATGT<br>GACAAGACAGACTGGCTGGATGGCAAGCATGTGG<br>TGTTTGGAGAGGTCACCGAAGGCCTAGATGTCTTG<br>CGGCAAATTGAGAAACAAGAAGAGTCAGCAATTAC<br>CAGCCAGCCGAGGTCCTGGAAGCTGACGTAGAGC<br>TCGTGCCGACGGCAGACCTGCCGGCCGTGGGAG<br>CCGTGGACGTCATCTGCAGGGACAGAAGGGGCAA<br>GGTCTTTTCTGGGGTTCCTAC | 12 | LDVQFVSI WPNQ* |
| 2193 | NM_203456.1_329 | 329 | ACGGGTCGAGTGCTGGCTTCCGGCGGAAAAGCGC<br>GCGAGCAAGATGGCCACCACCAAGCGCGTCTTGT<br>ACGTGGGTGGACTGGCAGAGGAAGTGGACGACAA<br>AGTTCTTCATGCTGCGTTCATTCCTTTTGGAGACAT | 6 | GQMMTG* |

TABLE 3A-continued

| SEQ ID | identifier_position | position | modified_RNA | PAP length | PAP |
|---|---|---|---|---|---|
| | | | CACAGATATTCAGATTCCTCTGGATTATGAAACAG AAAAGCACCGAGGATTTGCTTTTGTTGAATTTGAGT TGGCAGAGGATGCTGCAGCAGCTATCGACAACAT GAATGAATCTGAGCTTTTTGGACGTACAATTCGTG TCAATTTGGCCAAACCAATGAGAATTAAGGAAGGC TCTTCCAGGCCAGTTGGTCAGATGATGACTGGTTG AAGAAGTTTTCTGGGAAGACGCTTGAAGAGAATAA AGAGGAAGAAGGGTCAGAGCCTCCCAAAGCAGAG ACCCAGGAGGGAGAGCCCATTGCTAAAAAGGCCC GCTCAAATCCTCAGGTGTACATGGACATCAAGATT GGGAACAAGCCGGCTGGCCGCATCCAGATGCTCC TGCGTTCTGATGTCGTGCCCATGACAGCAGAGAAT TTCCGCTGCCTGTGCACTCATGAAAAGGGCTTTGG CTTTAAGGGAAGCAGCTTCCACCGCATCATCCCCC AGTTCATGTGCCAGGGCGGTGATTTCACAAACCAC AATGGCACTGGGGGCAAGTCCATCTATGGGAAGA AGTTCGATGATGAAAACTTTATCCTCAAGCATACG GGACCAGGTCTACTATCCATGGCCAACTCTGGCC CAAACACCAATGGCTCTCAGTTCTTCCTGACATGT GACAAGACAGACTGGCTGGATGGCAAGCATGTGG TGTTTGGAGAGGTCACCGAAGGCCTAGATGTCTTG CGGCAAATTGAGAAACAAGAAGAGTCAGCAATTAC CAGCCAGCCGAGGTCCTGGAAGCTGACGTAGAGC TCGTGCCGACGGCAGACCTGCCGGCCGTGGGAG CCGTGGACGTCATCTGCAGGGACAGAAGGGGCAA GGTCTTTTCTGGGGTTCCTAC | | |
| 2194 | NM_2075 20.1_132 6 | 1326 | AGTCCCTGCCCTCCCCTGGGGAGGGTGAGTCACG CCAAACTGGGCGGAGAGTCCGCTGGCCTCACTCC TAGCTCATCTGGGCGGCGGCGGCAAGTGGGGAC AGGGCGGGTGGCGCATCACCGGCGCGGAGGCAG GAGGAGCAGTCTCATTGTTCCGGGAGCCGTCACC ACAGTAGGTCCCTCGGCTCAGTCGGCCCAGCCCC TCTCAGTCCTCCCCAACCCCCACAACCGCCCGCG GCTCTGAGACGCGGCCCCGGCGGCGGCGGCAGC AGCTGCAGCATCATCTCCACCCTCCAGCCATGGAA GACCTGGACCAGTCTCCTCTGGTCTCGTCCTCGG ACAGCCCACCCCGGCCGCAGCCCGCGTTCAAGTA CCAGTTCGTGAGGGAGCCCGAGGACGAGGAGGA AGAAGAGGAGGAGGAAGAGGAGGACGAGGACGA AGACCTGGAGGAGCTGGAGGTGCTGGAGAGGAA GCCCGCCGCCGGGCTGTCCGCGGCCCCAGTGCC CACCGCCCCTGCCGCCGGCGCGCCCCTGATGGA CTTCGGAAAATGACTTCGTGCCGCCGGCGCCCCGG GGACCCCTGCCGGCCGCTCCCCCCGTCGCCCCG GAGCGGCAGCCGTCTTGGGACCCGAGCCCGGTG TCGTCGACCGTGCCCGCGCCATCCCCGCTGTCTG CTGCCGCAGTCTCGCCCTCCAAGCTCCCTGAGGA CGACGAGCCTCCGGCCCGGCCTCCCCCTCCTCCC CCGGCCAGCGTGAGCCCCCAGGCAGAGCCCGTG TGGACCCCGCCAGCCCCGGCTCCCGCCGCGCCC CCCTCCACCCCGGCCGCGCCCAAGCGCAGGGGC TCCTCGGGCTCAGTGGATGAGACCCTTTTTGCTCT TCCTGCTGCATCTGAGCCTGTGATACGCTCCTCTG CAGTTGTTGACCTCCTGTACTGGAGAGACATTAAG AAGACTGGAGTGGTGTTTGGTGCCAGCCTATTCCT GCTGCTTTCATTGACAGTATTCAGCATTGTGAGCG TAACAGCCTAC | 19 | WLSFHSSV FLLFMNGI RHR* |
| 2195 | NM_2075 20.1_143 1 | 1431 | AGTCCCTGCCCTCCCCTGGGGAGGGTGAGTCACG CCAAACTGGGCGGAGAGTCCGCTGGCCTCACTCC TAGCTCATCTGGGCGGCGGCGGCAAGTGGGGAC AGGGCGGGTGGCGCATCACCGGCGCGGAGGCAG GAGGAGCAGTCTCATTGTTCCGGGAGCCGTCACC ACAGTAGGTCCCTCGGCTCAGTCGGCCCAGCCCC TCTCAGTCCTCCCCAACCCCCACAACCGCCCGCG GCTCTGAGACGCGGCCCCGGCGGCGGCGGCAGC AGCTGCAGCATCATCTCCACCCTCCAGCCATGGAA GACCTGGACCAGTCTCCTCTGGTCTCGTCCTCGG ACAGCCCACCCCGGCCGCAGCCCGCGTTCAAGTA CCAGTTCGTGAGGGAGCCCGAGGACGAGGAGGA AGAAGAGGAGGAGGAAGAGGAGGACGAGGACGA AGACCTGGAGGAGCTGGAGGTGCTGGAGAGGAA GCCCGCCGCCGGGCTGTCCGCGGCCCCAGTGCC CACCGCCCCTGCCGCCGGCGCGCCCCTGATGGA CTTCGGAAAATGACTTCGTGCCGCCGGCGCCCCGG GGACCCCTGCCGGCCGCTCCCCCCGTCGCCCCG GAGCGGCAGCCGTCTTGGGACCCGAGCCCGGTG TCGTCGACCGTGCCCGCGCCATCCCCGCTGTCTG | 9 | VKSKQKSL D* |

TABLE 3A-continued

| SEQ ID | identifier_ position | position | modified_RNA | PAP length | PAP |
|---|---|---|---|---|---|
| | | | CTGCCGCAGTCTCGCCCTCCAAGCTCCCTGAGGA CGACGAGCCTCCGGCCCGGCCTCCCCCTCCTCCC CCGGCCAGCGTGAGCCCCCAGGCAGAGCCCGTG TGGACCCCGCCAGCCCCGGCTCCCGCCGCGCCC CCCTCCACCCCGGCCGCGCCCAAGCGCAGGGGC TCCTCGGGCTCAGTGGATGAGACCCTTTTTGCTCT TCCTGCTGCATCTGAGCCTGTGATACGCTCCTCTG CAGTTGTTGACCTCCTGTACTGGAGAGACATTAAG AAGACTGGAGTGGTGTTTGGTGCCAGCCTATTCCT GCTGCTTTCATTGACAGTATTCAGCATTGTGAGCG TAACAGCCTAC | | |
| 2196 | XM_0011 27122.1_ 265 | 265 | ATGACGGACACAGAAGCAGCTTCTCATCTATCATC GCCTTTTTTAGAAGAGAGACCAAACATGTACAACA TGGCAGTTATTATCCTGGAGTCGGCGGCGGCAGG GATTGTGGGAAATGTAGTTTGGAGACTCCGCCCTC CTCGCCATTCCTGTAATGGCTGCTTCCTAGAAGGT CGTGTCACGTGGAACCTCTTAATCTCAGCATCCGG AGCTCCAGGAAGGGAAAATTTCAAGTCAGATAGAA TTCTATATATACCATTTCTTGGAACCTTCAGCCCTC AAGATTCCAACATCATGACCTCAGTTTCAACACAG TTGTCCTTAGTCCTCATGTCACTGCTTTGGTGCTG CCTGTTGTGGAAGCAGTAGAAGCCGGTGATGCAA TCGCCCTTTTGTTAGGTGTGGTTCTCAGCATTACA GGCATTTGTGCCTGCTTGGGGGTATATGCACGAAA AAGAAATGGACAGATGTGACTTTGAAAGGCCTACT GAGTCAAACCTCACCCTGAAAACCTTTGCGCTTTA GAGGCTAAACCTGAGATTTGGTGTGTGAAAGGTTC CAAGAATCAGTAAATAAGGGAGTTTCACATTTTTCA TTGTTTCCATGAAATGGCAACAAACATACATTTATA AATTGAAAAAAAAAATGTTTTCTTTACAACAAATAAT GCACAGAAAAATGCAGCCTATAATTTGCTAGTTAG GTAGTCAAAGAAGTAAGATGGCTGAAATTTACATA AGTAATATTTCATAATCTTAGAATTCTCTCAAAGCA TGTGAAATAGGAAGAAGGAAGTTCTTGCCCAGAAT CTTAGGAAATCACCACTGTTCGGTTATAATCACTG CCTCCTGAATCGTTGAGGAGTCTTTTAAATTAGATT TTTGTTTTGTTGTCTCCCAAGTTAATATTATATTTAG ATATCAGAGAGTCAGGCAAAAAGGAAAACTTTTAT CTCTAGGGAAAAAAACATTTAGAAAAAATGTATTCAGT GTATCTAATACTGAAATGCGGAAAAAAATTTAATGT | 69 | GTFSPQDS NIMTSVST QLSLVLMS LLLVLPVVE AVEAGDAI ALLLGVVL SITGICACL GVYARKR NGQM* |
| 2197 | XM_0011 27122.1_ 345 | 345 | ATGACGGACACAGAAGCAGCTTCTCATCTATCATC GCCTTTTTTAGAAGAGAGACCAAACATGTACAACA TGGCAGTTATTATCCTGGAGTCGGCGGCGGCAGG GATTGTGGGAAATGTAGTTTGGAGACTCCGCCCTC CTCGCCATTCCTGTAATGGCTGCTTCCTAGAAGGT CGTGTCACGTGGAACCTCTTAATCTCAGCATCCGG AGCTCCAGGAAGGGAAAATTTCAAGTCAGATAGAA TTCTATATATACCATTTCTTTGGAACCTTCAGCCCT CAAGATTCCAACATCATGACCTCAGTTTCAACACA GTTGTCCTTAGTCCTCATGTCACTGCTTTGGTGCT GCCTGTTGTGGAAGCAGTAGAAGCCGGTGATGCA ATCGCCCTTTTGTTAGGTGTGGTTCTCAGCATTAC AGGCATTTGTGCCTGCTTGGGGGTATATGCACGAA AAAGAAATGGACAGATGTGACTTTGAAAGGCCTAC TGAGTCAAACCTCACCCTGAAAACCTTTGCGCTTT AGAGGCTAAACCTGAGATTTGGTGTGTGAAAGGTT CCAAGAATCAGTAAATAAGGGAGTTTCACATTTTTC ATTGTTTCCATGAAATGGCAACAAACATACATTTAT AAATTGAAAAAAAAATGTTTTCTTTACAACAAATAAT GCACAGAAAAATGCAGCCTATAATTTGCTAGTTAG GTAGTCAAAGAAGTAAGATGGCTGAAATTTACATA AGTAATATTTCATAATCTTAGAATTCTCTCAAAGCA TGTGAAATAGGAAGAAGGAAGTTCTTGCCCAGAAT CTTAGGAAATCACCACTGTTCGGTTATAATCACTG CCTCCTGAATCGTTGAGGAGTCTTTTAAATTAGATT TTTGTTTTGTTGTCTCCCAAGTTAATATTATATTTAG ATATCAGAGAGTCAGGCAAAAAGGAAAACTTTTAT CTCTAGGGAAAAAAACATTTAGAAAAAATGTATTCAGT GTATCTAATACTGAAATGCGGAAAAAAATTTAATGT | 43 | LVLPVVEA VEAGDAIA LLLGVVLSI TGICACLG VYARKRN GQM* |
| 2198 | XM_0011 27122.1_ 358 | 358 | ATGACGGACACAGAAGCAGCTTCTCATCTATCATC GCCTTTTTTAGAAGAGAGACCAAACATGTACAACA TGGCAGTTATTATCCTGGAGTCGGCGGCGGCAGG GATTGTGGGAAATGTAGTTTGGAGACTCCGCCCTC CTCGCCATTCCTGTAATGGCTGCTTCCTAGAAGGT CGTGTCACGTGGAACCTCTTAATCTCAGCATCCGG AGCTCCAGGAAGGGAAAATTTCAAGTCAGATAGAA TTCTATATATACCATTTCTTTGGAACCTTCAGCCCT | 38 | VEAVEAGD AIALLLGVV LSITGICAC LGVYARKR NGQM* |

TABLE 3A-continued

| SEQ ID | identifier_position | position | modified_RNA | PAP length | PAP |
|---|---|---|---|---|---|
| | | | CAAGATTCCAACATCATGACCTCAGTTTCAACACA GTTGTCCTTAGTCCTCATGTCACTGCTTTTGGTGCT GCCTGTGTGGAAGCAGTAGAAGCCGGTGATGCAA TCGCCCTTTTGTTAGGTGTGGTTCTCAGCATTACA GGCATTTGTGCCTGCTTGGGGGTATATGCACGAAA AAGAAATGGACAGATGTGACTTTGAAAGGCCTACT GAGTCAAACCTCACCCTGAAAACCTTTGCGCTTTA GAGGCTAAACCTGAGATTTGGTGTGTGAAAGGTTC CAAGAATCAGTAAATAAGGGAGTTTCACATTTTTCA TTGTTTCCATGAAATGGCAACAAACATACATTTATA AATTGAAAAAAAAATGTTTTCTTTACAACAAATAAT GCACAGAAAAATGCAGCCTATAATTTGCTAGTTAG GTAGTCAAAGAAGTAAGATGGCTGAAATTTACATA AGTAATATTTCATAATCTTAGAATTCTCTCAAAGCA TGTGAAATAGGAAGAAGGAAGTTCTTGCCCAGAAT CTTAGGAAATCACCACTGTTCGGTTATAATCACTG CCTCCTGAATCGTTGAGGAGTCTTTTAAATTAGATT TTTGTTTTGTTGTCTCCCAAGTTAATATTATATTTAG ATATCAGAGAGTCAGGCAAAAAGGAAAACTTTTAT CTCTAGGGAAAAAACATTTAGAAAAATGTATTCAGT GTATCTAATACTGAAATGCGGAAAAAAATTTAATGT | | |
| 2199 | XM_0011 31713.1_ 1391 | 1391 | ATGCAGGACTTTGAAAGTGACACGTTTTTTCCAGA AATTGATTTGGAGAAATATAAAATTCTGCCAGAATA TCCAGGCATTCTCTCGGATAGAGAAAACCCCTGTC TCTACACCTCCATTCCCAGGGCGAGCTCACTCTCT GGCATCAAGTTCTCCGTGATCAGTTTCCCTACACA AGATCCAAGAGGAGAGGATACTCGTGACGCGTCC CCATTTCCCACTCCCATTGGGTGTCGGGTGTCTAG AGAAGCCAATCAGTGTCGCCGGGGTCCCAGTTCT AAAGTCCCCACGCACCCACCCGGACTCAGAATCT CCTCAGACGCCGAGATGCGGGTCACGGCGCCCC GAACCCTCCTCCTGCTGCTCTGGGGGGCAGTGGC CCTGACCGAGACCTGGGCTGGCTCCCACTCCATG AGGTATTTCCACACCTCCGTGTCCCGGCCCGGCC GCGGGGAGCCCCGCTTCATCTCAGTGGGCTACGT GGACGGCACCCAGTTCGTGAGGTTCGACAGCGAC GCCGCGAGTCCGAGGACGGAGCCCCGGGCGCCG TGGATAGAGCAAGAGGGGCCGGAGTATTGGGACC GGAACACACAGATCTCCAAGACCAACACACAGACT TACCGAGAGAGCCTGCGGAACCTGCGCGGCTACT ACAACCAGAGCGAGGCCGGGTCTCACACCCTCCA GAGGATGTACGGCTGCGACGTGGGGCCGGACGG GCGCCTCCTCCGCGGGCATGACCAGTCCGCCTAC GACGGCAAGGATTACATCGCCCTGAACGAGGACC TGAGCTCCTGGACCGCGGCGGACACCGCGGCTC AGATCACCCAGCGCAAGTGGGAGGCGGCCGTGT GGCGGAGCAGCTGAGAGCCTACCTGGAGGGCAC GTGCGTGGAGTGGCTCCGCAGACACCTGGAGAAC GGGAAGGAGACGCTGCAGCGCGCGGACCCCCCA AAGACACATGTGACCCACCACCCCATCTCTGACCA TGAGGCCACCCTGAGGTGCTGGGCCCTGGGCTTC T | 16 | ALMCLSQL EKPETAVL* |
| 2200 | XM_0011 31713.1_ 850 | 850 | ATGCAGGACTTTGAAAGTGACACGTTTTTTCCAGA AATTGATTTGGAGAAATATAAAATTCTGCCAGAATA TCCAGGCATTCTCTCGGATAGAGAAAACCCCTGTC TCTACACCTCCATTCCCAGGGCGAGCTCACTCTCT GGCATCAAGTTCTCCGTGATCAGTTTCCCTACACA AGATCCAAGAGGAGAGGATACTCGTGACGCGTCC CCATTTCCCACTCCCATTGGGTGTCGGGTGTCTAG AGAAGCCAATCAGTGTCGCCGGGGTCCCAGTTCT AAAGTCCCCACGCACCCACCCGGACTCAGAATCT CCTCAGACGCCGAGATGCGGGTCACGGCGCCCC GAACCCTCCTCCTGCTGCTCTGGGGGGCAGTGGC CCTGACCGAGACCTGGGCTGGCTCCCACTCCATG AGGTATTTCCACACCTCCGTGTCCCGGCCCGGCC GCGGGGAGCCCCGCTTCATCTCAGTGGGCTACGT GGACGGCACCCAGTTCGTGAGGTTCGACAGCGAC GCCGCGAGTCCGAGGACGGAGCCCCGGGCGCCG TGGATAGAGCAAGAGGGGCCGGAGTATTGGGACC GGAACACACAGATCTCCAAGACCAACACACAGACT TACCGAGAGAGCCTGCGGAACCTGCGCGGCTACT ACAACCAGAGCGAGGCCGGGTCTCACACCCTCCA GAGGATGTACGGCTGCGACGTGGGGCCGGACGG GCGCCTCCTCCGCGGGCATGACCAGTCCGCCTAC GACGGCAAGGATTACATCGCCCTGAACGAGGACC TGAGCTCCTGGACCGCGGCGGACACCGCGGCTC AGATCACCCAGCGCAAGTGGGAGGCGGCCGTGT | 5 | VWRSS* |

TABLE 3A-continued

| SEQ ID | identifier_ position | position | modified_RNA | PAP length | PAP |
|---|---|---|---|---|---|
| | | | GGCGGAGCAGCTGAGAGCCTACCTGGAGGGCAC GTGCGTGGAGTGGCTCCGCAGACACCTGGAGAAC GGGAAGGAGACGCTGCAGCGCGCGGACCCCCCA AAGACACATGTGACCCACCACCCCATCTCTGACCA TGAGGCCACCCTGAGGTGCTGGGCCCTGGGCTTC TA | | |
| 2201 | XM_0011 32506.1_ 2086 | 2086 | CTTCTCTCTCGGCGTTTCCGCTGTCAGGGCCCTGC GGTGTGACTCGCGGGCTCAGCTGGTTGGTATTTTT TGGGCCTCGTGCTTCGTGGTGGGAGACCCAGGTC GAGGTCCGGCCGTAGCACCTCCGCGCCGTCGCCA TGTCGCGGTTTTTCACCACCGGTTCGGACAGCGA GTCCGAGTCGTCCTTGTCCGGGGAGGAGCTCGTC ACCAAACCTGTCGGAGGCAACTATGGCAAACAGC CATTGTTGCTGAGCGAGGATGAAGAAGATACCAAG AGAGTTGTCCGCAGTGCCAAGGACAAGAGGTTTG AGGAGCTGACCAACCTTATCCGGACCATCCGTAAT GCCATGAAGATTCGTGATGTCACCAAGTGCCTGGA AGAGTTTGAGCTCCTGGGAAAAGCATATGGGAAG GCCAAAAGCATTGTGGACAAAGAAGGTGTCCCCC GGTTCTATATCCGCATCCTGGCTGACCTAGAGGAC TATCTTAATGAGCTTTGGGAAGATAAGGAAGGGAA GAAGAAGATGAACAAGAACAATGCCAAGGCTCTGA GCACCTTGCGTCAGAAGATCCGAAAATACAACCGT GATTTCGAGTCCCATATCACAAGCTACAAGCAGAA CCCCGAGCAGTCTGCGGATGAAGATGCTGAGAAA AATGAGGAGGATTCAGAAGGCTCTTCAGATGAGG ATGAGGATGAGGACGGAGTCAGTGCTGCAACTTT CTTGAAGAAGAAATCAGAAGCTCCTTCTGGGGAGA GTCGCAAGTTCCTCAAAAAGATGGATGATGAAGAT GAGGACTCAGAAGATTCCGAAGATGATGAAGACT GGGACACAGGTTCCACATCTTCCGATTCCGACTCA GAGGAGGAAGAAGGGAAACAAACCGCGCTGGCCT CAAGATTTCTTAAAAAGGCACCCACCACAGATGAG GACAAGAAGGCAGCCGAGAAGAAACGGGAGGACA AAGCTAAGAAGAAGCACGACAGGAAATCCAAGCG CCTGGATGAGGAGGAGGAGGAGGA | 60 | ACCCAAC RSATRSRR RWSGAVR SPSTCTST WSCWSVS TWCLPCS WRSPTWP PMRAMPA DA* |
| 2202 | XM_0011 33517.1_ 131 | 131 | AATGAACTTTCCCTTTCGGCCGGAACCGCCATCTT CCAGTAATTCGCCAAAATGACGAACACAAAGGGAA AGAGGAGAGGCACCCGATATATGTTCTCTAGGCCT TTTAGAAAACATGGAGTTGTTCCTTGGCCACATATA TGCGAATCTATAAGAAAGGTGATATTGTAGACATC AAGGGAATGGGTACTGTTCAAAAAGGAATGCCCCA CAAGTGTTACCATGGCAAAACTGGAAGAGTCTACA ATGTTACCCAGCATGCTGTTGGCATTGTTGTAAAC AAACAAGTTAAGGGCAAGATTCTTGCCAAGAGAAT TAATGTGCGTATTGAGCACATTAAGCACTCTAAGA GCCGAGATAGCTTCCTGAAACGTGTGAAGGAAAAT GATCAGAAAAAGAAAGAAGCCAAAGAGAAAGGTAC CTGGGTTCAACTAAAGCGCCAGCCTGCTCCACCC AGAGAAGCACACTTTGTGAGAACCAATGGGAAGG AGCCTGAGCTGCTGGAACCTATTCCCTATGAATTC ATGGCATAATAGGTGTTAAAAAAAAAAAATAAAGGA CCTCTGGGCTACAAAAAAAAAAAAAAAAAGAATG AACTTTCA | 13 | WPHICESI RKVIL* |
| 2203 | XM_0011 33517.1_ 168 | 168 | AATGAACTTTCCCTTTCGGCCGGAACCGCCATCTT CCAGTAATTCGCCAAAATGACGAACACAAAGGGAA AGAGGAGAGGCACCCGATATATGTTCTCTAGGCCT TTTAGAAAACATGGAGTTGTTCCTTGGCCACATAT ATGCGAATCTATAAGAAAGGTGATATTGTAGACATC AAGGGAATGGGTACTGTTCAAAAAGGAATGCCCCA CAAGTGTTACCATGGCAAAACTGGAAGAGTCTACA ATGTTACCCAGCATGCTGTTGGCATTGTTGTAAAC AAACAAGTTAAGGGCAAGATTCTTGCCAAGAGAAT TAATGTGCGTATTGAGCACATTAAGCACTCTAAGA GCCGAGATAGCTTCCTGAAACGTGTGAAGGAAAAT GATCAGAAAAAGAAAGAAGCCAAAGAGAAAGGTAC CTGGGTTCAACTAAAGCGCCAGCCTGCTCCACCC AGAGAAGCACACTTTGTGAGAACCAATGGGAAGG AGCCTGAGCTGCTGGAACCTATTCCCTATGAATTC ATGGCATAATAGGTGTTAAAAAAAAAAAATAAAGGA CCTCTGGGCTACAAAAAAAAAAAAAAAAAGAATG AACTTTCA | 1 | M* |
| 2204 | XM_0011 33517.1_ 276 | 276 | AATGAACTTTCCCTTTCGGCCGGAACCGCCATCTT CCAGTAATTCGCCAAAATGACGAACACAAAGGGAA AGAGGAGAGGCACCCGATATATGTTCTCTAGGCCT TTTAGAAAACATGGAGTTGTTCCTTGGCCACATAT ATGCGAATCTATAAGAAAGGTGATATTGTAGACAT | 0 | * |

TABLE 3A-continued

| SEQ ID | identifier_position | position | modified_RNA | PAP length | PAP |
|---|---|---|---|---|---|
| | | | CAAGGGAATGGGTACTGTTCAAAAAGGAATGCCC CACAAGTGTTACCATGGCAAAACTGGAAGAGTCTA CAATGTTACCCAGCATGCTGTTGGCATTGTGTAAA CAAACAAGTTAAGGGCAAGATTCTTGCCAAGAGAA TTAATGTGCGTATTGAGCACATTAAGCACTCTAAG AGCCGAGATAGCTTCCTGAAACGTGTGAAGGAAAA TGATCAGAAAAAGAAAGAAGCCAAAGAGAAAGGTA CCTGGGTTCAACTAAAGCGCCAGCCTGCTCCACC CAGAGAAGCACACTTTGTGAGAACCAATGGGAAG GAGCCTGAGCTGCTGGAACCTATTCCCTATGAATT CATGGCATAATAGGTGTTAAAAAAAAAAATAAAGG ACCTCTGGGCTACAAAAAAAAAAAAAAAAAGAAT GAACTTTCA | | |
| 2205 | XM_0011 33517.1_ 330 | 330 | AATGAACTTTCCCTTTCGGCCGGAACCGCCATCTT CCAGTAATTCGCCAAAATGACGAACACAAAGGGAA AGAGGAGAGGCACCCGATATATGTTCTCTAGGCCT TTTAGAAAACATGGAGTTGTTCCTTTGGCCACATAT ATGCGAATCTATAAGAAAGGTGATATTGTAGACAT CAAGGGAATGGGTACTGTTCAAAAAGGAATGCCC CACAAGTGTTACCATGGCAAAACTGGAAGAGTCTA CAATGTTACCCAGCATGCTGTTGGCATTGTTGTAA ACAAACAAGTTAAGGGCAAGATTCTTGCCAAGAGA ATTAATGTGCGTATGAGCACATTAAGCACTCTAAG AGCCGAGATAGCTTCCTGAAACGTGTGAAGGAAAA TGATCAGAAAAAGAAAGAAGCCAAAGAGAAAGGTA CCTGGGTTCAACTAAAGCGCCAGCCTGCTCCACC CAGAGAAGCACACTTTGTGAGAACCAATGGGAAG GAGCCTGAGCTGCTGGAACCTATTCCCTATGAATT CATGGCATAATAGGTGTTAAAAAAAAAAATAAAGG ACCTCTGGGCTACAAAAAAAAAAAAAAAAAGAAT GAACTTTCA | 13 | MSTLSTLR AEIAS* |
| 2206 | XM_9401 81.2_281 | 281 | GTAAAAAAAAAAAAGTCAGATACGGAGGGAGACGC AGAGGCGGACAAGATGGCGGCGGCAGCTGTACA GGGCGAGAGAAGCGGTGGTAGCGGAGGCTGTAG TGGGGCTGGTGGTGCTTCCAACTGCGGGACAGGA AGTGGCCGTAGCGGCTTGTTGGATAAGTGGAAGA TAGATGATAAGCCTGTAAAAATTGACAAGTGGGAT GGATCAGCTGTGAAAAACTCTTTGGATGATTCTGC CAAAAAGGTACTTCTGGAAAAATACAAATATGTGG AGAATTTGGTCTAATTGATGGTCGCCTCACCATCT GTACAATCTCCTGTTTCTTTGCCATAGTGGCTTTGA TTTGGGATTATATGCACCCCTTTCCAGAGTCCAAA CCCGTTTTGGCTTTGTGTGTCATATCCTATTTTGTG ATGATGGGGATTCTGACCATTTATACCTCATATAAG GAGAAGAGCATCTTTCTCGTGGCCCACAGGAAAG ATCCTACAGGAATGGATCCTGATGATATTTGGCAG CTGTCCTCCAGTCTTAAAGGGTTTGATGACAAATA CACCTTGAAGCTGACCTTCATCAGTGGGAGAACAA AGCAGCAGCGGGAAGCCGAGTTCACAAAGTCCAT TGCTAAGTTTTTTGACCACAGTGGGACACTGGTCA TGGATGCATATGAGCCTGAAATATCCAGGCTCCAT GACAGTCTTGCCATAGAAAGAAAAATAAAGTAGCC AATTCTAAAAGTAGCCCTCTTTCTCCTGGATCTTGC TGAATTAGTGGCTTGGGGGGTGGGGGAGATAAAA AGAACTTAAAATGGGTAAAGTAAGAAATGTTAAAAA GTCCCTGTTTTGTCCTGAAATTTTAGTCTATTCTGG ATAAATAGGATTTTCTGACACAGATATGAGAAGTTG TAGCTCTGATGTCTAGCTGTAGTCTCCTTGATCTG CTGATTGCATTATTTTAATTTGCTTTTCTGGGAAAG CAGTTTTGCTAAAAGCTGTACAGACTTTTTCTTTTG TACCTAGCAG | 2 | LV* |

TABLE 3B

| SEQ ID | identifier_position | position | modified RNA | PAP length | PAP |
|---|---|---|---|---|---|
| 2207 | NM_0001 46.3_200 | 200 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ANTGAGCTCCCAGATTCGTCAGAATTATTCCACC | 41 | XELPDSSELF HRRGGSRQQ PGQFVPAGLL HLPLSGLLFR PR* |

TABLE 3B-continued

| SEQ ID | identifier_position | position | modified RNA | PAP length | PAP |
|---|---|---|---|---|---|
| | | | GACGTGGAGGCAGCCGTCAACAGCCTGGTCAAT TTGTACCTGCAGGCCTCCTACACCTACCTCTCTC TGGGCTTCTATTTCGACCGCGATGATGTGGCTC TGGAAGGCGTGAGCCACTTCTTCCGCGAATTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | | |
| 2208 | NM_0001 46.3_264 | 264 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAANT TTGTACCTGCAGGCCTCCTACACCTACCTCTCTC TGGGCTTCTATTTCGACCGCGATGATGTGGCTC TGGAAGGCGTGAGCCACTTCTTCCGCGAATTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | 20 | XFVPAGLLHL PLSGLLFRPR* |
| 2209 | NM_0001 46.3_266 | 266 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT NTGTACCTGCAGGCCTCCTACACCTACCTCTCT CTGGGCTTCTATTTCGACCGCGATGATGTGGCT CTGGAAGGCGTGAGCCACTTCTTCCGCGAATTG GCCGAGGAGAAGCGCGAGGGCTACGAGCGTCT CCTGAAGATGCAAAACCAGCGTGGCGGCCGCG CTCTCTTCCAGGACATCAAGAAGCCAGCTGAAG ATGAGTGGGGTAAAACCCCAGACGCCATGAAAG CTGCCATGGCCCTGGAGAAAAAGCTGAACCAGG CCCTTTTGGATCTTCATGCCCTGGGTTCTGCCC GCACGGACCCCCATCTCTGTGACTTCCTGGAGA CTCACTTCCTAGATGAGGAAGTGAAGCTTATCAA GAAGATGGGTGACCACCTGACCAACCTCCACAG GCTGGGTGGCCCGGAGGCTGGGCTGGGCGAGT ATCTCTTCGAAAGGCTCACTCTCAAGCACGACTA AGAGCCTTCTGAGCCCAGCGACTTCTGAAGGGC CCCTTGCAAAGTAATAGGGCTTCTGCCTAAGCC TCTCCCTCCAGCCAATAGGCAGCTTTCTTAACTA TCCTAACAAGCCTTGGACCAAATGGAAATAAAGC TTTTTGATGCAAAAAAAAAAAAAAAAAAA | 19 | XVPAGLLHLP LSGLLFRPR* |
| 2210 | NM_0001 46.3_267 | 267 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC | 19 | XVPAGLLHLP LSGLLFRPR* |

TABLE 3B-continued

| SEQ ID | identifier_ position | position | modified RNA | PAP length | PAP |
|---|---|---|---|---|---|
| | | | CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TNGTACCTGCAGGCCTCCTACACCTACCTCTCT CTGGGCTTCTATTTCGACCGCGATGATGTGGCT CTGGAAGGCGTGAGCCACTTCTTCCGCGAATTG GCCGAGGAGAAGCGCGAGGGCTACGAGCGTCT CCTGAAGATGCAAAACCAGCGTGGCGGCCGCG CTCTCTTCCAGGACATCAAGAAGCCAGCTGAAG ATGAGTGGGGTAAAACCCCAGACGCCATGAAAG CTGCCATGGCCCTGGAGAAAAAGCTGAACCAGG CCCTTTTGGATCTTCATGCCCTGGGTTCTGCCC GCACGGACCCCCATCTCTGTGACTTCCTGGAGA CTCACTTCCTAGATGAGGAAGTGAAGCTTATCAA GAAGATGGGTGACCACCTGACCAACCTCCACAG GCTGGGTGGCCCGGAGGCTGGGCTGGGCGAGT ATCTCTTCGAAAGGCTCACTCTCAAGCACGACTA AGAGCCTTCTGAGCCCAGCGACTTCTGAAGGGC CCCTTGCAAAGTAATAGGGCTTCTGCCTAAGCC TCTCCCTCCAGCCAATAGGCAGCTTTCTTAACTA TCCTAACAAGCCTTGGACCAAATGGAAATAAAGC TTTTTGATGCAAAAAAAAAAAAAAAAAAAA | | |
| 2211 | NM_0001 46.3_337 | 337 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAANGGCGTGAGCCACTTCTTCCGCGAATTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAAA | 40 | XREPLLPRIGR GEARGLRASP EDAKPAWRP RSLPGHQEAS* |
| 2212 | NM_0001 46.3_339 | 339 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGNCGTGAGCCACTTCTTCCGCGAATTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT | 39 | REPLLPRIGR GEARGLRASP EDAKPAWRP RSLPGHQEAS* |

TABLE 3B-continued

| SEQ ID | identifier_ position | position | modified RNA | PAP length | PAP |
|---|---|---|---|---|---|
| 2213 | NM_0001 46.3_347 | 347 | CCTAACAAGCCTTGGACCAAATGGAAATAAAGCT TTTTGATGCAAAAAAAAAAAAAAAAAAA GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCNACTTCTTCCGCGAATTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | 37 | XLLPRIGRGE ARGLRASPED AKPAWRPRSL PGHQEAS* |
| 2214 | NM_0001 46.3_362 | 362 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATNTGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | 32 | XGRGEARGL RASPEDAKPA WRPRSLPGH QEAS* |
| 2215 | NM_0001 46.3_363 | 363 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATTNGG CCGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA | 32 | XGRGEARGL RASPEDAKPA WRPRSLPGH QEAS* |

TABLE 3B-continued

| SEQ ID | identifier_position | position | modified RNA | PAP length | PAP |
|---|---|---|---|---|---|
| 2216 | NM_0001 46.3_375 | 375 | TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATTGGC CGAGGAGAAGCGCGAGGGCTACGAGCGTCTC CTGAAGATGCAAAACCAGCGTGGCGGCCGCGC TCTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | 28 | XARGLRASPE DAKPAWRPR SLPGHQEAS* |
| 2217 | NM_0001 46.3_447 | 447 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATTGGC CGAGGAGAAGCGCGAGGGCTACGAGCGTCTCC TGAAGATGCAAAACCAGCGTGGCGGCCGCGCT CTCTTCCAGGACATCAANGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG CACGGACCCCCATCTCTGTGACTTCCTGGAGAC TCACTTCCTAGATGAGGAAGTGAAGCTTATCAAG AAGATGGGTGACCACCTGACCAACCTCCACAGG CTGGGTGGCCCGGAGGCTGGGCTGGGCGAGTA TCTCTTCGAAAGGCTCACTCTCAAGCACGACTAA GAGCCTTCTGAGCCCAGCGACTTCTGAAGGGCC CCTTGCAAAGTAATAGGGCTTCTGCCTAAGCCT CTCCCTCCAGCCAATAGGCAGCTTTCTTAACTAT CCTAACAAGCCTTGGACCAAATGGAAATAAAGCT TTTTGATGCAAAAAAAAAAAAAAAAAAA | 4 | XEAS* |
| 2218 | NM_0001 46.3_456 | 456 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATTGGC CGAGGAGAAGCGCGAGGGCTACGAGCGTCTCC TGAAGATGCAAAACCAGCGTGGCGGCCGCGCT CTCTTCCAGGACATCAAGAAGCCAGCTGAAGA TGAGTGGGGTAAAACCCCAGACGCCATGAAAGC TGCCATGGCCCTGGAGAAAAAGCTGAACCAGGC CCTTTTGGATCTTCATGCCCTGGGTTCTGCCCG | 0 | * |

TABLE 3B-continued

| SEQ ID | identifier_ position | position | modified RNA | PAP length | PAP |
|---|---|---|---|---|---|
| | | | CACGGACCCCCATCTCTGTGACTTCCTGGAGAC<br>TCACTTCCTAGATGAGGAAGTGAAGCTTATCAAG<br>AAGATGGGTGACCACCTGACCAACCTCCACAGG<br>CTGGGTGGCCCGGAGGCTGGGCTGGGCGAGTA<br>TCTCTTCGAAAGGCTCACTCTCAAGCACGACTAA<br>GAGCCTTCTGAGCCCAGCGACTTCTGAAGGGCC<br>CCTTGCAAAGTAATAGGGCTTCTGCCTAAGCCT<br>CTCCCTCCAGCCAATAGGCAGCTTTCTTAACTAT<br>CCTAACAAGCCTTGGACCAAATGGAAATAAAGCT<br>TTTTGATGCAAAAAAAAAAAAAAAAAAA | | |
| 2219 | NM_0001 46.3_466 | 466 | GCAGTTCGGCGGTCCCGCGGGTCTGTCTCTTGC<br>TTCAACAGTGTTTGGACGGAACAGATCCGGGGA<br>CTCTCTTCCAGCCTCCGACCGCCCTCCGATTTC<br>CTCTCCGCTTGCAACCTCCGGGACCATCTTCTC<br>GGCCATCTCCTGCTTCTGGGACCTGCCAGCACC<br>GTTTTTGTGGTTAGCTCCTTCTTGCCAACCAACC<br>ATGAGCTCCCAGATTCGTCAGAATTATTCCACCG<br>ACGTGGAGGCAGCCGTCAACAGCCTGGTCAATT<br>TGTACCTGCAGGCCTCCTACACCTACCTCTCTCT<br>GGGCTTCTATTTCGACCGCGATGATGTGGCTCT<br>GGAAGGCGTGAGCCACTTCTTCCGCGAATTGGC<br>CGAGGAGAAGCGCGAGGGCTACGAGCGTCTCC<br>TGAAGATGCAAAACCAGCGTGGCGGCCGCGCT<br>CTCTTCCAGGACATCAAGAAGCCAGCTGAAGAT<br>GAGNTGGGGTAAAACCCCAGACGCCATGAAAGC<br>TGCCATGGCCCTGGAGAAAAAGCTGAACCAGGC<br>CCTTTTGGATCTTCATGCCCTGGGTTCTGCCCG<br>CACGGACCCCCATCTCTGTGACTTCCTGGAGAC<br>TCACTTCCTAGATGAGGAAGTGAAGCTTATCAAG<br>AAGATGGGTGACCACCTGACCAACCTCCACAGG<br>CTGGGTGGCCCGGAGGCTGGGCTGGGCGAGTA<br>TCTCTTCGAAAGGCTCACTCTCAAGCACGACTAA<br>GAGCCTTCTGAGCCCAGCGACTTCTGAAGGGCC<br>CCTTGCAAAGTAATAGGGCTTCTGCCTAAGCCT<br>CTCCCTCCAGCCAATAGGCAGCTTTCTTAACTAT<br>CCTAACAAGCCTTGGACCAAATGGAAATAAAGCT<br>TTTTGATGCAAAAAAAAAAAAAAAAAAA | 2 | XG* |
| 2220 | NM_0001 46.3_509 | 509 | GCAGTTCGGCGGTCCCGCGGGTCTGTCTCTTGC<br>TTCAACAGTGTTTGGACGGAACAGATCCGGGGA<br>CTCTCTTCCAGCCTCCGACCGCCCTCCGATTTC<br>CTCTCCGCTTGCAACCTCCGGGACCATCTTCTC<br>GGCCATCTCCTGCTTCTGGGACCTGCCAGCACC<br>GTTTTTGTGGTTAGCTCCTTCTTGCCAACCAACC<br>ATGAGCTCCCAGATTCGTCAGAATTATTCCACCG<br>ACGTGGAGGCAGCCGTCAACAGCCTGGTCAATT<br>TGTACCTGCAGGCCTCCTACACCTACCTCTCTCT<br>GGGCTTCTATTTCGACCGCGATGATGTGGCTCT<br>GGAAGGCGTGAGCCACTTCTTCCGCGAATTGGC<br>CGAGGAGAAGCGCGAGGGCTACGAGCGTCTCC<br>TGAAGATGCAAAACCAGCGTGGCGGCCGCGCT<br>CTCTTCCAGGACATCAAGAAGCCAGCTGAAGAT<br>GAGTGGGGTAAAACCCCAGACGCCATGAAAGCT<br>GCCATGGCCCTGGNAGAAAAAGCTGAACCAGG<br>CCCTTTTGGATCTTCATGCCCTGGGTTCTGCCC<br>GCACGGACCCCCATCTCTGTGACTTCCTGGAGA<br>CTCACTTCCTAGATGAGGAAGTGAAGCTTATCAA<br>GAAGATGGGTGACCACCTGACCAACCTCCACAG<br>GCTGGGTGGCCCGGAGGCTGGGCTGGGCGAGT<br>ATCTCTTCGAAAGGCTCACTCTCAAGCACGACTA<br>AGAGCCTTCTGAGCCCAGCGACTTCTGAAGGGC<br>CCCTTGCAAAGTAATAGGGCTTCTGCCTAAGCC<br>TCTCCCTCCAGCCAATAGGCAGCTTTCTTAACTA<br>TCCTAACAAGCCTTGGACCAAATGGAAATAAAGC<br>TTTTGATGCAAAAAAAAAAAAAAAAAA | 24 | XEKAEPGPFG SSCPGFCPHG PPSL* |
| 2221 | NM_0001 46.3_516 | 516 | GCAGTTCGGCGGTCCCGCGGGTCTGTCTCTTGC<br>TTCAACAGTGTTTGGACGGAACAGATCCGGGGA<br>CTCTCTTCCAGCCTCCGACCGCCCTCCGATTTC<br>CTCTCCGCTTGCAACCTCCGGGACCATCTTCTC<br>GGCCATCTCCTGCTTCTGGGACCTGCCAGCACC<br>GTTTTTGTGGTTAGCTCCTTCTTGCCAACCAACC<br>ATGAGCTCCCAGATTCGTCAGAATTATTCCACCG<br>ACGTGGAGGCAGCCGTCAACAGCCTGGTCAATT<br>TGTACCTGCAGGCCTCCTACACCTACCTCTCTCT<br>GGGCTTCTATTTCGACCGCGATGATGTGGCTCT<br>GGAAGGCGTGAGCCACTTCTTCCGCGAATTGGC<br>CGAGGAGAAGCGCGAGGGCTACGAGCGTCTCC<br>TGAAGATGCAAAACCAGCGTGGCGGCCGCGCT | 22 | XAEPGPFGSS CPGFCPHGPP SL* |

TABLE 3B-continued

| SEQ ID | identifier_ position | position | modified RNA | PAP length | PAP |
|---|---|---|---|---|---|
| | | | CTCTTCCAGGACATCAAGAAGCCAGCTGAAGAT GAGTGGGGTAAAACCCCAGACGCCATGAAAGCT GCCATGGCCCTGGAGAAAAANGCTGAACCAGG CCCTTTTGGATCTTCATGCCCTGGGTTCTGCCC GCACGGACCCCCATCTCTGTGACTTCCTGGAGA CTCACTTCCTAGATGAGGAAGTGAAGCTTATCAA GAAGATGGGTGACCACCTGACCAACCTCCACAG GCTGGGTGGCCCGGAGGCTGGGCTGGGCGAGT ATCTCTTCGAAAGGCTCACTCTCAAGCACGACTA AGAGCCTTCTGAGCCCAGCGACTTCTGAAGGGC CCCTTGCAAAGTAATAGGGCTTCTGCCTAAGCC TCTCCCTCCAGCCAATAGGCAGCTTTCTTAACTA TCCTAACAAGCCTTGGACCAAATGGAAATAAAGC TTTTTGATGCAAAAAAAAAAAAAAAAAAA | | |
| 2222 | NM_0001 46.3_587 | 587 | GCAGTTCGGCGGTCCCGCGGGTCTGTCTCTTGC TTCAACAGTGTTTGGACGGAACAGATCCGGGGA CTCTCTTCCAGCCTCCGACCGCCCTCCGATTTC CTCTCCGCTTGCAACCTCCGGGACCATCTTCTC GGCCATCTCCTGCTTCTGGGACCTGCCAGCACC GTTTTTGTGGTTAGCTCCTTCTTGCCAACCAACC ATGAGCTCCCAGATTCGTCAGAATTATTCCACCG ACGTGGAGGCAGCCGTCAACAGCCTGGTCAATT TGTACCTGCAGGCCTCCTACACCTACCTCTCTCT GGGCTTCTATTTCGACCGCGATGATGTGGCTCT GGAAGGCGTGAGCCACTTCTTCCGCGAATTGGC CGAGGAGAAGCGCGAGGGCTACGAGCGTCTCC TGAAGATGCAAAACCAGCGTGGCGGCCGCGCT CTCTTCCAGGACATCAAGAAGCCAGCTGAAGAT GAGTGGGGTAAAACCCCAGACGCCATGAAAGCT GCCATGGCCCTGGAGAAAAAAGCTGAACCAGGC CCTTTTGGATCTTCATGCCCTGGGTTCTGCCCG CACGGACCCCCATCTCTGTGACTTCCNTGGAGA CTCACTTCCTAGATGAGGAAGTGAAGCTTATCAA GAAGATGGGTGACCACCTGACCAACCTCCACAG GCTGGGTGGCCCGGAGGCTGGGCTGGGCGAGT ATCTCTTCGAAAGGCTCACTCTCAAGCACGACTA AGAGCCTTCTGAGCCCAGCGACTTCTGAAGGGC CCCTTGCAAAGTAATAGGGCTTCTGCCTAAGCC TCTCCCTCCAGCCAATAGGCAGCTTTCTTAACTA TCCTAACAAGCCTTGGACCAAATGGAAATAAAGC TTTTTGATGCAAAAAAAAAAAAAAAAAAA | 7 | XGDSLPR* |
| 2223 | NM_0002 24.2_756 | 756 | TCCGGGGCGGGGGCGGGGCCTCACTCTGCGAT ATAACTCGGGTCGCGCGGCTCGCGCAGGCCGC CACCGTCGTCCGCAAAGCCTGAGTCCTGTCCTT TCTCTCTCCCCGGACAGCATGAGCTTCACCACT CGCTCCACCTTCTCCACCAACTACCGGTCCCTG GGCTCTGTCCAGGCGCCCAGCTACGGCGCCCG GCCGGTCAGCAGCGCGGCCAGCGTCTATGCAG GCGCTGGGGGCTCTGGTTCCCGGATCTCCGTG TCCCGCTCCACCAGCTTCAGGGGCGGCATGGG GTCCGGGGGCCTGGCCACCGGGATAGCCGGG GGTCTGGCAGGAATGGGGAGGCATCCAGAACGA GAAGGAGACCATGCAAAGCCTGAACGACCGCCT GGCCTCTTACCTGGACAGAGTGAGGAGCCTGGA GACCGAGAAACCGGAGGCTGGAGAGCAAAATCC GGGAGCACTTGGAGAAGAAGGGACCCCAGGTC AGAGACTGGAGCCATTACTTCAAGATCATCGAG GACCTGAGGGCTCAGATCTTCGCAAATACTGTG GACAATGCCCGCATCGTTCTGCAGATTGACAAT GCCCGTCTTGCTGCTGATGACTTTAGAGTCAAG TATGAGACAGAGCTGGCCATGCGCCAGTCTGTG GAGAACGACATCCATGGGCTCCGCAAGGTCATT GATGACACCAATATCACACGACTGCAGCTGGAG ACAGAGATCGAGGCTCTCAAGGAGGAGCTGCTC TTCATGAANGAAGAACCACGAAGAGGAAGTAAA AGGCCTACAAGCCCAGATTGCCAGCTCTGGGTT GACCGTGGAGGTAGATGCCCCCAAATCTCAGGA CCTCGCCAAGATCATGGCAGACATCCGGGCCCA ATATGACGAGCTGGCTCGGAAGAACCGAGAGGA GCTAGACAAGTACTGGTCTCAGCAGATTGAGGA GAGCACCACAGTGGTCACCACACAGTCTGCTGA GGTTGGAGCTGCTGAGACGACGCTCACAGAGCT GAGACGTACAGT | 43 | XEEPRRGSKR PTSPDCQLWV DRGGRCPQIS GPRQDHGRH PGPI* |
| 2224 | NM_0002 24.2_821 | 821 | TCCGGGGCGGGGGCGGGGCCTCACTCTGCGAT ATAACTCGGGTCGCGCGGCTCGCGCAGGCCGC CACCGTCGTCCGCAAAGCCTGAGTCCTGTCCTT TCTCTCTCCCCGGACAGCATGAGCTTCACCACT | 21 | XGRCPQISGP RQDHGRHPG PI* |

TABLE 3B-continued

| SEQ ID | identifier_position | position | modified RNA | PAP length | PAP |
|---|---|---|---|---|---|
| | | | CGCTCCACCTTCTCCACCAACTACCGGTCCCTG<br>GGCTCTGTCCAGGCGCCCAGCTACGGCGCCCG<br>GCCGGTCAGCAGCGCGGCCAGCGTCTATGCAG<br>GCGCTGGGGGCTCTGGTTCCCGGATCTCCGTG<br>TCCCGCTCCACCAGCTTCAGGGGCGGCATGGG<br>GTCCGGGGGCCTGGCCACCGGGATAGCCGGG<br>GGTCTGGCAGGAATGGGAGGCATCCAGAACGA<br>GAAGGAGACCATGCAAAGCCTGAACGACCGCCT<br>GGCCTCTTACCTGGACAGAGTGAGGAGCCTGGA<br>GACCGAGAACCGGAGGCTGGAGAGCAAAATCC<br>GGGAGCACTTGGAGAAGAAGGGACCCCAGGTC<br>AGAGACTGGAGCCATTACTTCAAGATCATCGAG<br>GACCTGAGGGCTCAGATCTTCGCAAATACTGTG<br>GACAATGCCCGCATCGTTCTGCAGATTGACAAT<br>GCCCGTCTTGCTGCTGATGACTTTAGAGTCAAG<br>TATGAGACAGAGCTGGCCATGCGCCAGTCTGTG<br>GAGAACGACATCCATGGGCTCCGCAAGGTCATT<br>GATGACACCAATATCACACGACTGCAGCTGGAG<br>ACAGAGATCGAGGCTCTCAAGGAGGAGCTGCTC<br>TTCATGAAGAAGAACCACGAAGAGGAAGTAAAA<br>GGCCTACAAGCCCAGATTGCCAGCTCTGGGTTG<br>ACCGTGGNAGGTAGATGCCCCCAAATCTCAGGA<br>CCTCGCCAAGATCATGGCAGACATCCGGGCCCA<br>ATATGACGAGCTGGCTCGGAAGAACCGAGAGGA<br>GCTAGACAAGTACTGGTCTCAGCAGATTGAGGA<br>GAGCACCACAGTGGTCACCACACAGTCTGCTGA<br>GGTTGGAGCTGCTGAGACGACGCTCACAGAGCT<br>GAGACGTACAGT | | |
| 2225 | NM_0002<br>24.2_875 | 875 | TCCGGGGCGGGGGCGGGGCCTCACTCTGCGAT<br>ATAACTCGGGTCGCGCGGCTCGGCAGGCCGC<br>CACCGTCGTCCGCAAAGCCTGAGTCCTGTCCTT<br>TCTCTCTCCCCGGACAGCATGAGCTTCACCACT<br>CGCTCCACCTTCTCCACCAACTACCGGTCCCTG<br>GGCTCTGTCCAGGCGCCCAGCTACGGCGCCCG<br>GCCGGTCAGCAGCGCGGCCAGCGTCTATGCAG<br>GCGCTGGGGGCTCTGGTTCCCGGATCTCCGTG<br>TCCCGCTCCACCAGCTTCAGGGGCGGCATGGG<br>GTCCGGGGGCCTGGCCACCGGGATAGCCGGG<br>GGTCTGGCAGGAATGGGAGGCATCCAGAACGA<br>GAAGGAGACCATGCAAAGCCTGAACGACCGCCT<br>GGCCTCTTACCTGGACAGAGTGAGGAGCCTGGA<br>GACCGAGAACCGGAGGCTGGAGAGCAAAATCC<br>GGGAGCACTTGGAGAAGAAGGGACCCCAGGTC<br>AGAGACTGGAGCCATTACTTCAAGATCATCGAG<br>GACCTGAGGGCTCAGATCTTCGCAAATACTGTG<br>GACAATGCCCGCATCGTTCTGCAGATTGACAAT<br>GCCCGTCTTGCTGCTGATGACTTTAGAGTCAAG<br>TATGAGACAGAGCTGGCCATGCGCCAGTCTGTG<br>GAGAACGACATCCATGGGCTCCGCAAGGTCATT<br>GATGACACCAATATCACACGACTGCAGCTGGAG<br>ACAGAGATCGAGGCTCTCAAGGAGGAGCTGCTC<br>TTCATGAAGAAGAACCACGAAGAGGAAGTAAAA<br>GGCCTACAAGCCCAGATTGCCAGCTCTGGGTTG<br>ACCGTGGAGGTAGATGCCCCCAAATCTCAGGAC<br>CTCGCCAAGATCATGGCAGACATCCGGGNCCCA<br>ATATGACGAGCTGGCTCGGAAGAACCGAGAGGA<br>GCTAGACAAGTACTGGTCTCAGCAGATTGAGGA<br>GAGCACCACAGTGGTCACCACACAGTCTGCTGA<br>GGTTGGAGCTGCTGAGACGACGCTCACAGAGCT<br>GAGACGTACAGT | 3 | XPI* |
| 2226 | NM_0002<br>91.2_466 | 466 | AGCGCACGTCGGCAGTCGGCTCCCTCGTTGAC<br>CGAATCACCGACCTCTCTCCCCAGCTGTATTTCC<br>AAAATGTCGCTTTCTAACAAGCTGACGCTGGACA<br>AGCTGGACGTTAAAGGGAAGCGGGTCGTTATGA<br>GAGTCGACTTCAATGTTCCTATGAAGAACAACCA<br>GATAACAAACAACCAGAGGATTAAGGCTGCTGT<br>CCCAAGCATCAAATTCTGCTTGGACAATGGAGC<br>CAAGTCGGTAGTCCTTATGAGCCACCTAGGCCG<br>GCCTGATGGTGTGCCCATGCCTGACAAGTACTC<br>CTTAGAGCCAGTTGCTGTAGAACTCAAATCTCTG<br>CTGGGCAAGGATGTTCTGTTCTTGAAGGACTGT<br>GTAGGCCCAGAAGTGGAGAAAGCCTGTGCCAAC<br>CCAGCTGCTGGGTCTGTCATCCTGCTGGAGAAC<br>CTCCGCTTTCATGTGGAGGAAGAAGGGAAGGGA<br>ANAAGATGCTTCTGGGAACAAGGTTAAAGCCGA<br>GCCAGCCAAAATAGAAGCTTTCCGAGCTTCACTT<br>TCCAAGCTAGGGGATGTCTATGTCAATGATGCTT | 8 | XRCFWEQG* |

TABLE 3B-continued

| SEQ ID | identifier_position | position | modified RNA | PAP length | PAP |
|---|---|---|---|---|---|
| | | | TTGGCACTGCTCACAGAGCCCACAGCTCCATGG TAGGAGTCAATCTGCCACAGAAGGCTGGTGGGT TTTTGATGAAGAAGGAGCTGAACTACTTTGCAAA GGCCTTGGAGAGCCCAGAGCGACCCTTCCTGG CCATCCTGGGCGGAGCTAAAGTTGCAGACAAGA TCCAGCTCATCAATAATATGCTGGACAAAGTCAA TGAGATGATTATTGGTGGTGGAATGGCTTTTACC TTCCTTAAGGTGCTCAACAACATGGAGATTGGCA CTTCTCTGTTTGATGAAGAGGGAGCCAAGATTGT CAAAGACCTAATGTCCAAAGCTGAGAAGAATGG TGTGAAGATTACCTTGCCTGTTGACTTTGTCACT GCTGACAAGTTTGATGAGAATGCCAAGACTGGC CAAGCCACTGTGGCTTCTGGCATACCTGCTGGC TGGATGGGCTTGGACTGTGGTCCT | | |
| 2227 | NM_0003 65.4_148 | 148 | CCTTCAGCGCCTCGGCTCCAGCGCCATGGCGC CCTCCAGGAAGTTCTTCGTTGGGGGAAACTGGA AGATGAACGGGCGGAAGCAGAGTCTGGGGGAG CTCATCGGCACTCTGAACGCGGCCAAGGTGCC GGCCGACACCGAGGTGGTTNTGTGCTCCCCCTA CTGCCTATATCGACTTCGCCCGGCAGAAGCTAG ATCCCAAGATTGCTGTGGCTGCGCAGAACTGCT ACAAAGTGACTAATGGGGCTTTTACTGGGGAGA TCAGCCCTGGCATGATCAAAGACTGCGGAGCCA CGTGGGTGGTCCTGGGGCACTCAGAGAGAAGG CATGTCTTTGGGGAGTCAGATGAGCTGATTGGG CAGAAAGTGGCCCATGCTCTGGCAGAGGGACTC GGAGTAATCGCCTGCATTGGGGAGAAGCTAGAT GAAAGGGAAGCTGGCATCACTGAGAAGGTTGTT TTCGAGCAGACAAAGGTCATCGCAGATAACGTG AAGGACTGGAGCAAGGTCGTCCTGGCCTATGAG CCTGTGTGGGCCATTGGTACTGGCAAGACTGCA ACACCCCAACAGGCCCAGGAAGTACACGAGAAG CTCCGAGGATGGCTGAAGTCCAACGTCTCTGAT GCGGTGGCTCAGAGCACCCGTATCATTTATGGA GGCTCTGTGACTGGGGCAACCTGCAAGGAGCT GGCCAGCCAGCCTGATGTGGATGGCTTCCTTGT GGGTGGTGCTTCCCTCAAGCCCGAATTCGTGGA CATCATCAATGCCAAACAATGAGCCCCATCCATC TTCCCTACCCTTCCTGCCAAGCCAGGGACTAAG CAGCCCAGAAGCCCAGTAACTGCCCTTTCCCTG CATATGCTTCTGATGGTGTCATCTGCTCCTTCCT GTGGCCTCATCCAAACTGTATCTTCCTTTACTGT TTATATCTTCACCCTGTAATGGTTGGGACCAGGC CAATCCCTTCTCCACTTACTATAATGGTTGGAAC TAAACGTCACCAAGGTGGCTTCTCCTTGGCTGA G | 30 | XCSPYCLYRL RPAEARSQDC CGCAELLQSD* |
| 2228 | NM_0003 65.4_354 | 354 | CCTTCAGCGCCTCGGCTCCAGCGCCATGGCGC CCTCCAGGAAGTTCTTCGTTGGGGGAAACTGGA AGATGAACGGGCGGAAGCAGAGTCTGGGGGAG CTCATCGGCACTCTGAACGCGGCCAAGGTGCC GGCCGACACCGAGGTGGTTTGTGCTCCCCCTAC TGCCTATATCGACTTCGCCCGGCAGAAGCTAGA TCCCAAGATTGCTGTGGCTGCGCAGAACTGCTA CAAAGTGACTAATGGGGCTTTTACTGGGGAGAT CAGCCCTGGCATGATCAAAGACTGCGGAGCCAC GTGGGTGGTCCTGGGGCACTCAGAGAGAAGGC ATGTCTTTGGGGAGTCAGATGAGCTGATNTGGG CAGAAAGTGGCCCATGCTCTGGCAGAGGGACTC GGAGTAATCGCCTGCATTGGGGAGAAGCTAGAT GAAAGGGAAGCTGGCATCACTGAGAAGGTTGTT TTCGAGCAGACAAAGGTCATCGCAGATAACGTG AAGGACTGGAGCAAGGTCGTCCTGGCCTATGAG CCTGTGTGGGCCATTGGTACTGGCAAGACTGCA ACACCCCAACAGGCCCAGGAAGTACACGAGAAG CTCCGAGGATGGCTGAAGTCCAACGTCTCTGAT GCGGTGGCTCAGAGCACCCGTATCATTTATGGA GGCTCTGTGACTGGGGCAACCTGCAAGGAGCT GGCCAGCCAGCCTGATGTGGATGGCTTCCTTGT GGGTGGTGCTTCCCTCAAGCCCGAATTCGTGGA CATCATCAATGCCAAACAATGAGCCCCATCCATC TTCCCTACCCTTCCTGCCAAGCCAGGGACTAAG CAGCCCAGAAGCCCAGTAACTGCCCTTTCCCTG CATATGCTTCTGATGGTGTCATCTGCTCCTTCCT GTGGCCTCATCCAAACTGTATCTTCCTTTACTGT TTATATCTTCACCCTGTAATGGTTGGGACCAGGC CAATCCCTTCTCCACTTACTATAATGGTTGGAAC | 24 | XWAESGPCS GRGTRSNRLH WGEAR* |

TABLE 3B-continued

| SEQ ID | identifier_position | position | modified RNA | PAP length | PAP |
|---|---|---|---|---|---|
| | | | TAAACGTCACCAAGGTGGCTTCTCCTTGGCTGAG | | |
| 2229 | NM_000365.4_426 | 426 | CCTTCAGCGCCTCGGCTCCAGCGCCATGGCGCCCTCCAGGAAGTTCTTCGTTGGGGGAAACTGGAAGATGAACGGGCGGAAGCAGAGTCTGGGGGAGCTCATCGGCACTCTGAACGCGGCCAAGGTGCCGGCCGACACCGAGGTGGTTTGTGCTCCCCCTACTGCCTATATCGACTTCGCCCGGCAGAAGCTAGATCCCAAGATTGCTGTGGCTGCGCAGAACTGCTACAAAGTGACTAATGGGGCTTTTACTGGGGAGATCAGCCCTGGCATGATCAAAGACTGCGGAGCCACGTGGGTGGTCCTGGGGCACTCAGAGAGAAGGCATGTCTTTGGGGAGTCAGATGAGCTGATTGGGCAGAAAGTGGCCCATGCTCTGGCAGAGGGACTCGGAGTAATCGCCTGCATTGGGGAGAAGCTAGATGANAAGGGAAGCTGGCATCACTGAGAAGGTTGTTTTCGAGCAGACAAAGGTCATCGCAGATAACGTGAAGGACTGGAGCAAGGTCGTCCTGGCCTATGAGCCTGTGTGGGCCATTGGTACTGGCAAGACTGCAACACCCCAACAGGCCCAGGAAGTACACGAGAAGCTCCGAGGATGGCTGAAGTCCAACGTCTCTGATGCGGTGGCTCAGAGCACCCGTATCATTTATGGAGGCTCTGTGACTGGGGCAACCTGCAAGGAGCTGGCCAGCCAGCCTGATGTGGATGGCTTCCTTGTGGGTGGTGCTTCCCTCAAGCCCGAATTCGTGGACATCATCAATGCCAAACAATGAGCCCCATCCATCTTCCCTACCCTTCCTGCCAAGCCAGGGACTAAGCAGCCCAGAAGCCCAGTAACTGCCCTTTCCCTGCATATGCTTCTGATGGTGTCATCTGCTCCTTCCTGTGGCCTCATCCAAACTGTATCTTCCTTTACTGTTTATATCTTCACCCTGTAATGGTTGGGACCAGGCCAATCCCTTCTCCACTTACTATAATGGTTGGAACTAAACGTCACCAAGGTGGCTTCTCCTTGGCTGAG | 7 | XKGSWHH* |
| 2230 | NM_000365.4_427 | 427 | CCTTCAGCGCCTCGGCTCCAGCGCCATGGCGCCCTCCAGGAAGTTCTTCGTTGGGGGAAACTGGAAGATGAACGGGCGGAAGCAGAGTCTGGGGGAGCTCATCGGCACTCTGAACGCGGCCAAGGTGCCGGCCGACACCGAGGTGGTTTGTGCTCCCCCTACTGCCTATATCGACTTCGCCCGGCAGAAGCTAGATCCCAAGATTGCTGTGGCTGCGCAGAACTGCTACAAAGTGACTAATGGGGCTTTTACTGGGGAGATCAGCCCTGGCATGATCAAAGACTGCGGAGCCACGTGGGTGGTCCTGGGGCACTCAGAGAGAAGGCATGTCTTTGGGGAGTCAGATGAGCTGATTGGGCAGAAAGTGGCCCATGCTCTGGCAGAGGGACTCGGAGTAATCGCCTGCATTGGGGAGAAGCTAGATGAANAGGGAAGCTGGCATCACTGAGAAGGTTGTTTTCGAGCAGACAAAGGTCATCGCAGATAACGTGAAGGACTGGAGCAAGGTCGTCCTGGCCTATGAGCCTGTGTGGGCCATTGGTACTGGCAAGACTGCAACACCCCAACAGGCCCAGGAAGTACACGAGAAGCTCCGAGGATGGCTGAAGTCCAACGTCTCTGATGCGGTGGCTCAGAGCACCCGTATCATTTATGGAGGCTCTGTGACTGGGGCAACCTGCAAGGAGCTGGCCAGCCAGCCTGATGTGGATGGCTTCCTTGTGGGTGGTGCTTCCCTCAAGCCCGAATTCGTGGACATCATCAATGCCAAACAATGAGCCCCATCCATCTTCCCTACCCTTCCTGCCAAGCCAGGGACTAAGCAGCCCAGAAGCCCAGTAACTGCCCTTTCCCTGCATATGCTTCTGATGGTGTCATCTGCTCCTTCCTGTGGCCTCATCCAAACTGTATCTTCCTTTACTGTTTATATCTTCACCCTGTAATGGTTGGGACCAGGCCAATCCCTTCTCCACTTACTATAATGGTTGGAACTAAACGTCACCAAGGTGGCTTCTCCTTGGCTGAG | 6 | XGSWHH* |
| 2231 | NM_000365.4_742 | 742 | CCTTCAGCGCCTCGGCTCCAGCGCCATGGCGCCCTCCAGGAAGTTCTTCGTTGGGGGAAACTGGAAGATGAACGGGCGGAAGCAGAGTCTGGGGGAGCTCATCGGCACTCTGAACGCGGCCAAGGTGCCGGCCGACACCGAGGTGGTTTGTGCTCCCCCTACTGCCTATATCGACTTCGCCCGGCAGAAGCTAGATCCCAAGATTGCTGTGGCTGCGCAGAACTGCTACAAAGTGACTAATGGGGCTTTTACTGGGGAGATCAGCCCTGGCATGATCAAAGACTGCGGAGCCACGTGGGTGGTCCTGGGGCACTCAGAGAGAAGGCATGTCTTTGGGGAGTCAGATGAGCTGATTGGGC | 25 | XIRGHHQCQTMSPIHLPYPSCQARD* |

TABLE 3B-continued

| SEQ ID | identifier_ position | position | modified RNA | PAP length | PAP |
|---|---|---|---|---|---|
| | | | AGAAAGTGGCCCATGCTCTGGCAGAGGGACTC GGAGTAATCGCCTGCATTGGGGAGAAGCTAGAT GAAAGGGAAGCTGGCATCACTGAGAAGGTTGTT TTCGAGCAGACAAAGGTCATCGCAGATAACGTG AAGGACTGGAGCAAGGTCGTCCTGGCCTATGAG CCTGTGTGGGCCATTGGTACTGGCAAGACTGCA ACACCCCAACAGGCCCAGGAAGTACACGAGAAG CTCCGAGGATGGCTGAAGTCCAACGTCTCTGAT GCGGTGGCTCAGAGCACCCGTATCATTTATGGA GGCTCTGTGACTGGGGCAACCTGCAAGGAGCT GGCCAGCCAGCCTGATGTGGATGGCTTCCTTGT GGGTGGTGCTTCCCTCAAGCCCNGAATTCGTGG ACATCATCAATGCCAAACAATGAGCCCCATCCAT CTTCCCTACCCTTCCTGCCAAGCCAGGGACTAA GCAGCCCAGAAGCCCAGTAACTGCCCTTTCCCT GCATATGCTTCTGATGGTGTCATCTGCTCCTTCC TGTGGCCTCATCCAAACTGTATCTTCCTTTACTG TTTATATCTTCACCCTGTAATGGTTGGGACCAGG CCAATCCCTTCTCCACTTACTATAATGGTTGGAA CTAAACGTCACCAAGGTGGCTTCTCCTTGGCTG AG | | |
| 2232 | NM_0004 77.3_106 | 106 | AGCTTTTCTCTTCTGTCAACCCCACACGCCTTTG GCACAATGAAGTGGGTAACCTTTATTTCCCTTCT TTTTCTCTTTAGCTCGGCTTATTCCAGGGGTGTG TTTCNGTCGAGATGCACACAAGAGTGAGGTTGC TCATCGGTTTAAAGATTTGGGAGAAGAAAATTTC AAAGCCTTGGTGTTGATTGCCTTTGCTCAGTATC TTCAGCAGTGTCCATTTGAAGATCATGTAAAATT AGTGAATGAAGTAACTGAATTTGCAAAAACATGT GTTGCTGATGAGTCAGCTGAAAATTGTGACAAAT CACTTCATACCCTTTTTGGAGACAAATTATGCAC AGTTGCAACTCTTCGTGAAACCTATGGTGAAATG GCTGACTGCTGTGCAAAACAAGAACCTGAGAGA AATGAATGCTTCTTGCAACACAAAGATGACAACC CAAACCTCCCCCGATTGGTGAGACCAGAGGTTG ATGTGATGTGCACTGCTTTTCATGACAATGAAGA GACATTTTTGAAAAAATACTTATATGAAATTGCCA GAAGACATCCTTACTTTTATGCCCCGGAACTCCT TTTCTTTGCTAAAAGGTATAAAGCTGCTTTTACA GAATGTTGCCAAGCTGCTGATAAAGCTGCCTGC CTGTTGCCAAAGCTCGATGAACTTCGGGATGAA GGGAAGGCTTCGTCTGCCAAACAGAGACTCAAG TGTGCCAGTCTCCAAAAAATTTGGAGAAAGAGCTT TCAAAGCATGGGCAGTAGCTCGCCTGAGCCAGA GATTTCCCAAAGCTGAGTTTGCAGAAGTTTCCAA GTTAGTGACAGATCTTACCAAAGTCCACACGGA ATGCTGCCATGGAGATCTGCTTGAATGTGCTGA TGACAGGGCGGACCTTGCCAAGTATATCTGTGA AAATCAAGATTCGATCTCCAGTAAACTGAAGGAA TGCTGTGAAAAACCTCTGTTGGAAAAATCCCACT GCATTGCCGAAGTGGAAAATGATGAGATGCCTG CTGACTTGCCTTCA | 7 | XSRCTQE* |
| 2233 | NM_0004 77.3_251 | 251 | AGCTTTTCTCTTCTGTCAACCCCACACGCCTTTG GCACAATGAAGTGGGTAACCTTTATTTCCCTTCT TTTTCTCTTTAGCTCGGCTTATTCCAGGGGTGTG TTTCGTCGAGATGCACACAAGAGTGAGGTTGCT CATCGGTTTAAAGATTTGGGAGAAGAAAATTTCA AAGCCTTGGTGTTGATTGCCTTTGCTCAGTATCT TCAGCAGTGTCCATTTGAAGATCATGTAAAATTA GTGAATGAAGTAACNTGAATTTGCAAAAACATGT GTTGCTGATGAGTCAGCTGAAAATTGTGACAAAT CACTTCATACCCTTTTTGGAGACAAATTATGCAC AGTTGCAACTCTTCGTGAAACCTATGGTGAAATG GCTGACTGCTGTGCAAAACAAGAACCTGAGAGA AATGAATGCTTCTTGCAACACAAAGATGACAACC CAAACCTCCCCCGATTGGTGAGACCAGAGGTTG ATGTGATGTGCACTGCTTTTCATGACAATGAAGA GACATTTTTGAAAAAATACTTATATGAAATTGCCA GAAGACATCCTTACTTTTATGCCCCGGAACTCCT TTTCTTTGCTAAAAGGTATAAAGCTGCTTTTACA GAATGTTGCCAAGCTGCTGATAAAGCTGCCTGC CTGTTGCCAAAGCTCGATGAACTTCGGGATGAA GGGAAGGCTTCGTCTGCCAAACAGAGACTCAAG TGTGCCAGTCTCCAAAAAATTTGGAGAAAGAGCTT TCAAAGCATGGGCAGTAGCTCGCCTGAGCCAGA GATTTCCCAAAGCTGAGTTTGCAGAAGTTTCCAA GTTAGTGACAGATCTTACCAAAGTCCACACGGA | 0 | * |

TABLE 3B-continued

| SEQ ID | identifier_ position | position | modified RNA | PAP length | PAP |
|---|---|---|---|---|---|
| | | | ATGCTGCCATGGAGATCTGCTTGAATGTGCTGA TGACAGGGCGGACCTTGCCAAGTATATCTGTGA AAATCAAGATTCGATCTCCAGTAAACTGAAGGAA TGCTGTGAAAAACCTCTGTTGGAAAAATCCCACT GCATTGCCGAAGTGGAAAATGATGAGATGCCTG CTGACTTGCCTTCA | | |
| 2234 | NM_0004 77.3_252 | 252 | AGCTTTTCTCTTCTGTCAACCCCACACGCCTTTG GCACAATGAAGTGGGTAACCTTTATTTCCCTTCT TTTTCTCTTTAGCTCGGCTTATTCCAGGGGTGTG TTTCGTCGAGATGCACACAAGAGTGAGGTTGCT CATCGGTTTAAAGATTTGGGAGAAGAAAATTTCA AAGCCTTGGTGTTGATTGCCTTTGCTCAGTATCT TCAGCAGTGTCCATTTGAAGATCATGTAAAATTA GTGAATGAAGTAACTNGAATTTGCAAAAACATGT GTTGCTGATGAGTCAGCTGAAAATTGTGACAAAT CACTTCATACCCTTTTTGGAGACAAATTATGCAC AGTTGCAACTCTTCGTGAAACCTATGGTGAAATG GCTGACTGCTGTGCAAAACAAGAACCTGAGAGA AATGAATGCTTCTTGCAACACAAAGATGACAACC CAAACCTCCCCCGATTGGTGAGACCAGAGGTTG ATGTGATGTGCACTGCTTTTCATGACAATGAAGA GACATTTTTGAAAAAATACTTATATGAAATTGCCA GAAGACATCCTTACTTTTATGCCCCGGAACTCCT TTTCTTTGCTAAAAGGTATAAAGCTGCTTTTACA GAATGTTGCCAAGCTGCTGATAAAGCTGCCTGC CTGTTGCCAAAGCTCGATGAACTTCGGGATGAA GGGAAGGCTTCGTCTGCCAAACAGAGACTCAAG TGTGCCAGTCTCCAAAAATTTGGAGAAAGAGCTT TCAAAGCATGGGCAGTAGCTCGCCTGAGCCAGA GATTTCCCAAAGCTGAGTTTGCAGAAGTTTCCAA GTTAGTGACAGATCTTACCAAAGTCCACACGGA ATGCTGCCATGGAGATCTGCTTGAATGTGCTGA TGACAGGGCGGACCTTGCCAAGTATATCTGTGA AAATCAAGATTCGATCTCCAGTAAACTGAAGGAA TGCTGTGAAAAACCTCTGTTGGAAAAATCCCACT GCATTGCCGAAGTGGAAAATGATGAGATGCCTG CTGACTTGCCTTCA | 8 | XICKNMCC* |
| 2235 | NM_0004 77.3_309 | 309 | AGCTTTTCTCTTCTGTCAACCCCACACGCCTTTG GCACAATGAAGTGGGTAACCTTTATTTCCCTTCT TTTTCTCTTTAGCTCGGCTTATTCCAGGGGTGTG TTTCGTCGAGATGCACACAAGAGTGAGGTTGCT CATCGGTTTAAAGATTTGGGAGAAGAAAATTTCA AAGCCTTGGTGTTGATTGCCTTTGCTCAGTATCT TCAGCAGTGTCCATTTGAAGATCATGTAAAATTA GTGAATGAAGTAACTGAATTTGCAAAAACATGTG TTGCTGATGAGTCAGCTGAAAATTGTGACAAATC ACTTNCATACCCTTTTTGGAGACAAATTATGCAC AGTTGCAACTCTTCGTGAAACCTATGGTGAAATG GCTGACTGCTGTGCAAAACAAGAACCTGAGAGA AATGAATGCTTCTTGCAACACAAAGATGACAACC CAAACCTCCCCCGATTGGTGAGACCAGAGGTTG ATGTGATGTGCACTGCTTTTCATGACAATGAAGA GACATTTTTGAAAAAATACTTATATGAAATTGCCA GAAGACATCCTTACTTTTATGCCCCGGAACTCCT TTTCTTTGCTAAAAGGTATAAAGCTGCTTTTACA GAATGTTGCCAAGCTGCTGATAAAGCTGCCTGC CTGTTGCCAAAGCTCGATGAACTTCGGGATGAA GGGAAGGCTTCGTCTGCCAAACAGAGACTCAAG TGTGCCAGTCTCCAAAAATTTGGAGAAAGAGCTT TCAAAGCATGGGCAGTAGCTCGCCTGAGCCAGA GATTTCCCAAAGCTGAGTTTGCAGAAGTTTCCAA GTTAGTGACAGATCTTACCAAAGTCCACACGGA ATGCTGCCATGGAGATCTGCTTGAATGTGCTGA TGACAGGGCGGACCTTGCCAAGTATATCTGTGA AAATCAAGATTCGATCTCCAGTAAACTGAAGGAA TGCTGTGAAAAACCTCTGTTGGAAAAATCCCACT GCATTGCCGAAGTGGAAAATGATGAGATGCCTG CTGACTTGCCTTCA | 15 | XYPFWRQIMH SCNSS* |
| 2236 | NM_0005 33.3_176 | 176 | TCAATCAGAAAGCCCTTTTCATTGCAGGAGAAGA GGACAAAGATACTCAGAGAGAAAAAGTAAAAGA CCGAAGAAGGAGGCTGGAGAGACCAGGATCCT TCCAGCTGAACAAAGTCAGCCACAAAGCAGACT AGCCAGCCGGCTACAATTGGAGTCAGAGTCCCA AAGACATGGGCNTTGTTAGAGTGCTGTGCAAGA TGTCTGGTAGGGGCCCCCTTTGCTTCCCTGGTG GCCACTGGATTGTGTTTCTTTGGGGTGGCACTG TTCTGTGGCTGTGGACATGAAGCCCTCACTGGC | 35 | XVRVLCKMSG RGPLCFPGGH WIVFLWGGTV LWLWT* |

TABLE 3B-continued

| SEQ ID | identifier_position | position | modified RNA | PAP length | PAP |
|---|---|---|---|---|---|
| | | | ACAGAAAAGCTAATTGAGACCTATTTCTCCAAAA ACTACCAAGACTATGAGTATCTCATCAATGTGAT CCATGCCTTCCAGTATGTCATCTATGGAACTGCC TCTTTCTTCTTCCTTTATGGGGCCCTCCTGCTGG CTGAGGGCTTCTACACCACCGGCGCAGTCAGG CAGATCTTTGGCGACTACAAGACCACCATCTGC GGCAAGGGCCTGAGCGCAACGGTAACAGGGGG CCAGAAGGGGAGGGGTTCCAGAGGCCAACATC AAGCTCATTCTTTGGAGCGGGTGTGTCATTGTTT GGGAAAATGGCTAGGACATCCCGACAAGTTTGT GGGCATCACCTATGCCCTGACCGTTGTGTGGCT CCTGGTGTTTGCCTGCTCTGCTGTGCCTGTGTA CATTTACTTCAACACCTGGACCACCTGCCAGTCT ATTGCCTTCCCCAGCAAGACCTCTGCCAGTATA GGCAGTCTCTGTGCTGATGCCAGAATGTATGGT GTTCTCCCATGGAATGCTTTCCCTGGCAAGGTTT GTGGCTCCAACCTTCTGTCCATCTGCAAAACAG CTGAGTTCCAAATGACCTTCCACCTGTTTATTGC TGCATTTGTGGGGCTGCAGCTACACTGGTTTC CCTGCTCACCTTCATGATTGCTGCCACTTACAAC TTTGCCGTCCTTAAACTCATGGGCCGAGGCACC AAGTTCTGATCCCCCGTAGAAATCCCCC | | |
| 2237 | NM_0006 61.4_609 | 609 | ACGCGATACAAGTACGTAATGACGACAGACGTT CTTTCTTTGCTGCGTCTACTGCGAGAATGAAGAC TATTCTCAGCAATCAGACTGTCGACATTCCAGAA AATGTCGACATTACTCTGAAGGGACGCACAGTT ATCGTGAAGGGCCCCAGAGGAACCCTGCGGAG GGACTTCAATCACATCAATGTAGAACTCAGCCTT CTTGGAAAGAAAAAAAAGAGGCTCCGGGTTGAC AAATGGTGGGGTAACAGAAAGGAACTGGCTACC GTTCGGACTATTTGTAGTCATGTACAGAACATGA TCAAGGGTGTTACACTGGGCTTCCGTTACAAGA TGAGGTCTGTGTATGCTCACTTCCCCATCAACGT TGTTATCCAGGAGAATGGGTCTCTTGTTGAAATC CGAAATTTCTTGGGTGAAAAATATATCCGCAGGG TTCGGATGAGACCAGGTGTTGCTTGTTCAGTATC TCAAGCCCAGAAAGATGAATTAATCCTTGAAGGA AATGACATTGAGCTTGTTTCAAATTCAGCGGCTT TGATTCAGCAAGCCACAACAGTTAAAAACAAGGA TATCAGGAAATTTTTGGATGGTATCTATGTCTCT GAAANAAGGAACTGTTCAGCAGGCTGATGAATA AGATCTAAGAGTTACCTGGCTACAGAAAGAAGAT GCCAGATGACACTTAAGACCTACTTGTGATATTT AAATGATGCAATAAAAGACCTATTGATTTGGACC TTCTTCTTAAAAAAAAAAAAAAAAAAAA | 7 | XRNCSAG* |
| 2238 | NM_0006 61.4_611 | 611 | ACGCGATACAAGTACGTAATGACGACAGACGTT CTTTCTTTGCTGCGTCTACTGCGAGAATGAAGAC TATTCTCAGCAATCAGACTGTCGACATTCCAGAA AATGTCGACATTACTCTGAAGGGACGCACAGTT ATCGTGAAGGGCCCCAGAGGAACCCTGCGGAG GGACTTCAATCACATCAATGTAGAACTCAGCCTT CTTGGAAAGAAAAAAAAGAGGCTCCGGGTTGAC AAATGGTGGGGTAACAGAAAGGAACTGGCTACC GTTCGGACTATTTGTAGTCATGTACAGAACATGA TCAAGGGTGTTACACTGGGCTTCCGTTACAAGA TGAGGTCTGTGTATGCTCACTTCCCCATCAACGT TGTTATCCAGGAGAATGGGTCTCTTGTTGAAATC CGAAATTTCTTGGGTGAAAAATATATCCGCAGGG TTCGGATGAGACCAGGTGTTGCTTGTTCAGTATC TCAAGCCCAGAAAGATGAATTAATCCTTGAAGGA AATGACATTGAGCTTGTTTCAAATTCAGCGGCTT TGATTCAGCAAGCCACAACAGTTAAAAACAAGGA TATCAGGAAATTTTTGGATGGTATCTATGTCTCT GAAAAANGGAACTGTTCAGCAGGCTGATGAATA AGATCTAAGAGTTACCTGGCTACAGAAAGAAGAT GCCAGATGACACTTAAGACCTACTTGTGATATTT AAATGATGCAATAAAAGACCTATTGATTTGGACC TTCTTCTTAAAAAAAAAAAAAAAAAAAA | 6 | XNCSAG* |
| 2239 | NM_0006 61.4_635 | 635 | ACGCGATACAAGTACGTAATGACGACAGACGTT CTTTCTTTGCTGCGTCTACTGCGAGAATGAAGAC TATTCTCAGCAATCAGACTGTCGACATTCCAGAA AATGTCGACATTACTCTGAAGGGACGCACAGTT ATCGTGAAGGGCCCCAGAGGAACCCTGCGGAG GGACTTCAATCACATCAATGTAGAACTCAGCCTT CTTGGAAAGAAAAAAAAGAGGCTCCGGGTTGAC AAATGGTGGGGTAACAGAAAGGAACTGGCTACC GTTCGGACTATTTGTAGTCATGTACAGAACATGA | 21 | XRSKSYLATE RRCQMTLKTY L* |

TABLE 3B-continued

| SEQ ID | identifier_position | position | modified RNA | PAP length | PAP |
|---|---|---|---|---|---|
| | | | TCAAGGGTGTTACACTGGGCTTCCGTTACAAGA TGAGGTCTGTGTATGCTCACTTCCCCATCAACGT TGTTATCCAGGAGAATGGGTCTCTTGTTGAAATC CGAAATTTCTTGGGTGAAAAATATATCCGCAGGG TTCGGATGAGACCAGGTGTTGCTTGTTCAGTATC TCAAGCCCAGAAAGATGAATTAATCCTTGAAGGA AATGACATTGAGCTTGTTTCAAATTCAGCGGCTT TGATTCAGCAAGCCACAACAGTTAAAAACAAGGA TATCAGGAAATTTTTGGATGGTATCTATGTCTCT GAAAAAGGAACTGTTCAGCAGGCTGATGAANTA AGATCTAAGAGTTACCTGGCTACAGAAAGAAGAT GCCAGATGACACTTAAGACCTACTTGTGATATTT AAATGATGCAATAAAAGACCTATTGATTTGGACC TTCTTCTTAAAAAAAAAAAAAAAAAAA | | |
| 2240 | NM_0009 67.3_201 | 201 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGNCCTTCCTGGGATACAAGGCTGGCATGA CTCACATCGTGCGGGAAGTCGACAGGCCGGGA TCCAAGGTGAACAAGAAGGAGGTGGTGGAGGC TGTGACCATTGTAGAGACACCACCCATGGTGGT TGTGGGCATTGTGGGCTACGTGGAAACCCCTCG AGGCCTCCGGACCTTCAAGACTGTCTTTGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | 63 | XLPGIQGWHD SHRAGSRQA GIQGEQEGG GGGCDHCRD TTHGGCGHC GLRGNPSRPP DLQDCLC* |
| 2241 | NM_0009 67.3_219 | 219 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGNCTGGCATGA CTCACATCGTGCGGGAAGTCGACAGGCCGGGA TCCAAGGTGAACAAGAAGGAGGTGGTGGAGGC TGTGACCATTGTAGAGACACCACCCATGGTGGT TGTGGGCATTGTGGGCTACGTGGAAACCCCTCG AGGCCTCCGGACCTTCAAGACTGTCTTTGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG | 57 | XWHDSHRAG SRQAGIQGEQ EGGGGGCDH CRDTTHGGC GHCGLRGNP SRPPDLQDCL C* |

TABLE 3B-continued

| SEQ ID | identifier_position | position | modified RNA | PAP length | PAP |
|---|---|---|---|---|---|
| | | | ACTATGACCTATCTGACAAGAGCATCAACCCTCT GGGTG | | |
| 2242 | NM_0009 67.3_274 | 274 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAANGAAGGAGGTGGTGGAGGC TGTGACCATTGTAGAGACACCACCCATGGTGGT TGTGGGCATTGTGGGCTACGTGGAAACCCCTCG AGGCCTCCGGACCTTCAAGACTGTCTTTGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | 39 | XEGGGGGCD HCRDTTHGG CGHCGLRGN PSRPPDLQDC LC* |
| 2243 | NM_0009 67.3_301 | 301 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATNTGTAGAGACACCACCCATGGTGGT TGTGGGCATTGTGGGCTACGTGGAAACCCCTCG AGGCCTCCGGACCTTCAAGACTGTCTTTGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | 30 | XCRDTTHGG CGHCGLRGN PSRPPDLQDC LC* |
| 2244 | NM_0009 67.3_385 | 385 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA | 2 | XC* |

TABLE 3B-continued

| SEQ ID | identifier_position | position | modified RNA | PAP length | PAP |
|---|---|---|---|---|---|
| | | | GGCCTCCGGACCTTCAAGACTGTCTTNTGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | | |
| 2245 | NM_0009 67.3_386 | 386 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAAACCCCTCGA GGCCTCCGGACCTTCAAGACTGTCTTTNGCTGA GCACATCAGTGATGAATGCAAGAGGCGTTTCTA TAAGAATTGGCATAAATCTAAGAAGAAGGCCTTT ACCAAGTACTGCAAGAAATGGCAGGATGAGGAT GGCAAGAAGCAGCTGGAGAAGGACTTCAGCAG CATGAAGAAGTACTGCCAAGTCATCCGTGTCATT GCCCACACCCAGATGCGCCTGCTTCCTCTGCGC CAGAAGAAGGCCCACCTGATGGAGATCCAGGTG AACGGAGGCACTGTGGCCGAGAAGCTGGACTG GGCCCGCGAGAGGCTTGAGCAGCAGGTACCTG TGAACCAAGTGTTTGGGCAGGATGAGATGATCG ACGTCATCGGGGTGACCAAGGGCAAAGGCTACA AAGGGGTCACCAGTCGTTGGCACACCAAGAAGC TGCCCCGCAAGACCCACCGAGGCCTGCGCAAG GTGGCCTGTATTGGGGCATGGCATCCTGCTCGT GTAGCCTTCTCTGTGGCACGCGCTGGGCAGAAA GGCTACCATCACCGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | 1 | X* |
| 2246 | NM_0009 67.3_427 | 427 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAAACCCCTCGA GGCCTCCGGACCTTCAAGACTGTCTTTGCTGAG CACATCAGTGATGAATGCAAGAGGCGTTTCTATA ANGAATTGGCATAAATCTAAGAAGAAGGCCTTTA CCAAGTACTGCAAGAAATGGCAGGATGAGGATG GCAAGAAGCAGCTGGAGAAGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT | 4 | XELA* |

TABLE 3B-continued

| SEQ ID | identifier_position | position | modified RNA | PAP length | PAP |
|---|---|---|---|---|---|
| | | | GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2247 | NM_0009 67.3_445 | 445 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAANGAAGAAGGCCTTTA CCAAGTACTGCAAGAAATGGCAGGATGAGGATG GCAAGAAGCAGCTGGAGAAGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 14 | XEEGLYQVLQ EMAG* |
| 2248 | NM_0009 67.3_473 | 473 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGNAAATGGCAGGATGAGGATG GCAAGAAGCAGCTGGAGAAGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 4 | XMAG* |
| 2249 | NM_0009 67.3_496 | 496 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT | 59 | XEAAGEGLQQ HEEVLPSHPC HCPHPDAPAS SAPEEGPPDG DPGERRHCG |

TABLE 3B-continued

| SEQ ID | identifier_position | position | modified RNA | PAP length | PAP |
|---|---|---|---|---|---|
| | | | CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAANGAAGCAGCTGGAGAAGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | REAGLGPREA* |
| 2250 | NM_0009 67.3_499 | 499 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAANGCAGCTGGAGAAGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 58 | XAAGEGLQQ HEEVLPSHPC HCPHPDAPAS SAPEEGPPDG DPGERRHCG REAGLGPREA* |
| 2251 | NM_0009 67.3_507 | 507 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGNAGAAGGACTTCAGCAGCA TGAAGAAGTACTGCCAAGTCATCCGTGTCATTG CCCACACCCAGATGCGCCTGCTTCCTCTGCGCC | 55 | XEGLQQHEEV LPSHPCHCPH PDAPASSAPE EGPPDGDPG ERRHCGREA GLGPREA* |

TABLE 3B-continued

| SEQ ID | identifier_position | position | modified RNA | PAP length | PAP |
|---|---|---|---|---|---|
| | | | AGAAGAAGGCCCACCTGATGGAGATCCAGGTGAACGGAGGCACTGTGGCCGAGAAGCTGGACTGGGCCCGCGAGAGGCTTGAGCAGCAGGTACCTGTGAACCAAGTGTTTGGGCAGGATGAGATGATCGACGTCATCGGGGTGACCAAGGGCAAAGGCTACAAAGGGGTCACCAGTCGTTGGCACACCAAGAAGCTGCCCCGCAAGACCCACCGAGGCCTGCGCAAGGTGGCCTGTATTGGGGCATGGCATCCTGCTCGTGTAGCCTTCTCTGTGGCACGCGCTGGGCAGAAAGGCTACCATCACCGCACTGAGATCAACAAGAAGATTTATAAGATTGGCCAGGGCTACCTTATCAAGGACGGCAAGCTGATCAAGAACAATGCCTCCACTGACTATGACCTATCTGACAAGAGCATCAACCCTCTGGGTG | | |
| 2252 | NM_0009 67.3_508 | 508 | CCAGATTTGGCTTTATATAGCGGACCCGTAAGGCCGACCGGCCTCTACCGGCGGGATTTGATGGCGTGATGTCTCACAGAAAGTTCTCCGCTCCCAGACATGGGTCCCTCGGCTTCCTGCCTCGGAAGCGCAGCAGCAGGCATCGTGGGAAGGTGAAGAGCTTCCCTAAGGATGACCCGTCCAAGCCGGTCCACCTCACAGCCTTCCTGGGATACAAGGCTGGCATGACTCACATCGTGCGGGAAGTCGACAGGCCGGGATCCAAGGTGAACAAGAAGGAGGTGGTGGAGGCTGTGACCATTGTAGAGACACCACCCATGGTGGTTGTGGGCATTGTGGGCTACGTGGAAACCCCTCGAGGCCTCCGGACCTTCAAGACTGTCTTTGCTGAGCACATCAGTGATGAATGCAAGAGGCGTTTCTATAAGAATTGGCATAAATCTAAGAAGAAGGCCTTTACCAAGTACTGCAAGAAATGGCAGGATGAGGATGGCAAGAAGCAGCTGGANGAAGGACTTCAGCAGCATGAAGAAGTACTGCCAAGTCATCCGTGTCATTGCCCACACCCAGATGCGCCTGCTTCCTCTGCGCCAGAAGAAGGCCCACCTGATGGAGATCCAGGTGAACGGAGGCACTGTGGCCGAGAAGCTGGACTGGGCCCGCGAGAGGCTTGAGCAGCAGGTACCTGTGAACCAAGTGTTTGGGCAGGATGAGATGATCGACGTCATCGGGGTGACCAAGGGCAAAGGCTACAAAGGGGTCACCAGTCGTTGGCACACCAAGAAGCTGCCCCGCAAGACCCACCGAGGCCTGCGCAAGGTGGCCTGTATTGGGGCATGGCATCCTGCTCGTGTAGCCTTCTCTGTGGCACGCGCTGGGCAGAAAGGCTACCATCACCGCACTGAGATCAACAAGAAGATTTATAAGATTGGCCAGGGCTACCTTATCAAGGACGGCAAGCTGATCAAGAACAATGCCTCCACTGACTATGACCTATCTGACAAGAGCATCAACCCTCTGGGTG | 55 | XEGLQQHEEVLPSHPCHCPHPDAPASSAPEEGPPDGDPGERRHCGREAGLGPREA* |
| 2253 | NM_0009 67.3_520 | 520 | CCAGATTTGGCTTTATATAGCGGACCCGTAAGGCCGACCGGCCTCTACCGGCGGGATTTGATGGCGTGATGTCTCACAGAAAGTTCTCCGCTCCCAGACATGGGTCCCTCGGCTTCCTGCCTCGGAAGCGCAGCAGCAGGCATCGTGGGAAGGTGAAGAGCTTCCCTAAGGATGACCCGTCCAAGCCGGTCCACCTCACAGCCTTCCTGGGATACAAGGCTGGCATGACTCACATCGTGCGGGAAGTCGACAGGCCGGGATCCAAGGTGAACAAGAAGGAGGTGGTGGAGGCTGTGACCATTGTAGAGACACCACCCATGGTGGTTGTGGGCATTGTGGGCTACGTGGAAACCCCTCGAGGCCTCCGGACCTTCAAGACTGTCTTTGCTGAGCACATCAGTGATGAATGCAAGAGGCGTTTCTATAAGAATTGGCATAAATCTAAGAAGAAGGCCTTTACCAAGTACTGCAAGAAATGGCAGGATGAGGATGGCAAGAAGCAGCTGGAGAAGGACTTCAGNCAGCATGAAGAAGTACTGCCAAGTCATCCGTGTCATTGCCCACACCCAGATGCGCCTGCTTCCTCTGCGCCAGAAGAAGGCCCACCTGATGGAGATCCAGGTGAACGGAGGCACTGTGGCCGAGAAGCTGGACTGGGCCCGCGAGAGGCTTGAGCAGCAGGTACCTGTGAACCAAGTGTTTGGGCAGGATGAGATGATCGACGTCATCGGGGTGACCAAGGGCAAAGGCTACAAAGGGGTCACCAGTCGTTGGCACACCAAGAAGCTGCCCCGCAAGACCCACCGAGGCCTGCGCAAGGTGGCCTGTATTGGGGCATGGCATCCTGCTCGTGTAGCCTTCTCTGTGGCACGCGCTGGGCAGAAAGGCTACCATCACCGCACTGAGATCAACAAGAAGATTTATAAGATTGGCCAGGGCTACCTTATCAAGGACGGCAAGCTGATCAAGAACAATGCCTCCACTGA | 51 | XQHEEVLPSHPCHCPHPDAPASSAPEEGPPDGDPGERRHCGREAGLGPREA* |

TABLE 3B-continued

| SEQ ID | identifier_position | position | modified RNA | PAP length | PAP |
|---|---|---|---|---|---|
| 2254 | NM_0009 67.3_521 | 521 | CTATGACCTATCTGACAAGAGCATCAACCCTCTG GGTG CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCNAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 50 | XHEEVLPSHP CHCPHPDAPA SSAPEEGPPD GDPGERRHC GREAGLGPRE A* |
| 2255 | NM_0009 67.3_529 | 529 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAANGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 48 | XEVLPSHPCH CPHPDAPASS APEEGPPDGD PGERRHCGR EAGLGPREA* |
| 2256 | NM_0009 67.3_542 | 542 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA | 43 | XHPCHCPHPD APASSAPEEG PPDGDPGER RHCGREAGL GPREA* |

TABLE 3B-continued

| SEQ ID | identifier_ position | position | modified RNA | PAP length | PAP |
|---|---|---|---|---|---|
| | | | GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAANGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2257 | NM_0009 67.3_543 | 543 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGNTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 43 | XHPCHCPHPD APASSAPEEG PPDGDPGER RHCGREAGL GPREA* |
| 2258 | NM_0009 67.3_557 | 557 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTNG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT | 38 | XPHPDAPASS APEEGPPDGD PGERRHCGR EAGLGPREA* |

TABLE 3B-continued

| SEQ ID | identifier_position | position | modified RNA | PAP length | PAP |
|---|---|---|---|---|---|
| | | | GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2259 | NM_0009 67.3_579 | 579 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCNTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 31 | XSSAPEEGPP DGDPGERRH CGREAGLGP REA* |
| 2260 | NM_0009 67.3_587 | 587 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGNCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 28 | XPEEGPPDGD PGERRHCGR EAGLGPREA* |
| 2261 | NM_0009 67.3_595 | 595 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT | 26 | XEGPPDGDP GERRHCGRE AGLGPREA* |

TABLE 3B-continued

| SEQ ID | identifier_position | position | modified RNA | PAP length | PAP |
|---|---|---|---|---|---|
| | | | CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAANGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2262 | NM_0009 67.3_600 | 600 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGNCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 24 | XPPDGDPGE RRHCGREAG LGPREA* |
| 2263 | NM_0009 67.3_619 | 619 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA | 18 | XGERRHCGR EAGLGPREA* |

TABLE 3B-continued

| SEQ ID | identifier_position | position | modified RNA | PAP length | PAP |
|---|---|---|---|---|---|
| | | | GAAGAAGGCCCACCTGATGGAGATCCANGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2264 | NM_0009 67.3_625 | 625 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA NCGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 16 | XRRHCGREA GLGPREA* |
| 2265 | NM_0009 67.3_631 | 631 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGNCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA | 13 | HCGREAGLG PREA* |

TABLE 3B-continued

| SEQ ID | identifier_position | position | modified RNA | PAP length | PAP |
|---|---|---|---|---|---|
| | | | CTATGACCTATCTGACAAGAGCATCAACCCTCTGGGTG | | |
| 2266 | NM_0009 67.3_643 | 643 | CCAGATTTGGCTTTATATAGCGGACCCGTAAGGCCGACCGGCCTCTACCGGCGGGATTTGATGGCGTGATGTCTCACAGAAAGTTCTCCGCTCCCAGACATGGGTCCCTCGGCTTCCTGCCTCGGAAGCGCAGCAGCAGGCATCGTGGGAAGGTGAAGAGCTTCCCTAAGGATGACCCGTCCAAGCCGGTCCACCTCACAGCCTTCCTGGGATACAAGGCTGGCATGACTCACATCGTGCGGGAAGTCGACAGGCCGGGATCCAAGGTGAACAAGAAGGAGGTGGTGGAGGCTGTGACCATTGTAGAGACACCACCCATGGTGGTTGTGGGCATTGTGGGCTACGTGGAAACCCCTCGAGGCCTCCGGACCTTCAAGACTGTCTTTGCTGAGCACATCAGTGATGAATGCAAGAGGCGTTTCTATAAGAATTGGCATAAATCTAAGAAGAAGGCCTTTACCAAGTACTGCAAGAAATGGCAGGATGAGGATGGCAAGAAGCAGCTGGAGAAGGACTTCAGCAGCATGAAGAAGTACTGCCAAGTCATCCGTGTCATTGCCCACACCCAGATGCGCCTGCTTCCTCTGCGCCAGAAGAAGGCCCACCTGATGGAGATCCAGGTGAACGGAGGCACTGTGGCCGANGAAGCTGGACTGGGCCCGCGAGAGGCTTGAGCAGCAGGTACCTGTGAACCAAGTGTTTGGGCAGGATGAGATGATCGACGTCATCGGGGTGACCAAGGGCAAAGGCTACAAAGGGGTCACCAGTCGTTGGCACACCAAGAAGCTGCCCCGCAAGACCCACCGAGGCCTGCGCAAGGTGGCCTGTATTGGGGCATGGCATCCTGCTCGTGTAGCCTTCTCTGTGGCACGCGCTGGGCAGAAAGGCTACCATCACCGCACTGAGATCAACAAGAAGATTTATAAGATTGGCCAGGGCTACCTTATCAAGGACGGCAAGCTGATCAAGAACAATGCCTCCACTGACTATGACCTATCTGACAAGAGCATCAACCCTCTGGGTG | 10 | XEAGLGPREA* |
| 2267 | NM_0009 67.3_646 | 646 | CCAGATTTGGCTTTATATAGCGGACCCGTAAGGCCGACCGGCCTCTACCGGCGGGATTTGATGGCGTGATGTCTCACAGAAAGTTCTCCGCTCCCAGACATGGGTCCCTCGGCTTCCTGCCTCGGAAGCGCAGCAGCAGGCATCGTGGGAAGGTGAAGAGCTTCCCTAAGGATGACCCGTCCAAGCCGGTCCACCTCACAGCCTTCCTGGGATACAAGGCTGGCATGACTCACATCGTGCGGGAAGTCGACAGGCCGGGATCCAAGGTGAACAAGAAGGAGGTGGTGGAGGCTGTGACCATTGTAGAGACACCACCCATGGTGGTTGTGGGCATTGTGGGCTACGTGGAAACCCCTCGAGGCCTCCGGACCTTCAAGACTGTCTTTGCTGAGCACATCAGTGATGAATGCAAGAGGCGTTTCTATAAGAATTGGCATAAATCTAAGAAGAAGGCCTTTACCAAGTACTGCAAGAAATGGCAGGATGAGGATGGCAAGAAGCAGCTGGAGAAGGACTTCAGCAGCATGAAGAAGTACTGCCAAGTCATCCGTGTCATTGCCCACACCCAGATGCGCCTGCTTCCTCTGCGCCAGAAGAAGGCCCACCTGATGGAGATCCAGGTGAACGGAGGCACTGTGGCCGAGAANGCTGGACTGGGCCCGCGAGAGGCTTGAGCAGCAGGTACCTGTGAACCAAGTGTTTGGGCAGGATGAGATGATCGACGTCATCGGGGTGACCAAGGGCAAAGGCTACAAAGGGGTCACCAGTCGTTGGCACACCAAGAAGCTGCCCCGCAAGACCCACCGAGGCCTGCGCAAGGTGGCCTGTATTGGGGCATGGCATCCTGCTCGTGTAGCCTTCTCTGTGGCACGCGCTGGGCAGAAAGGCTACCATCACCGCACTGAGATCAACAAGAAGATTTATAAGATTGGCCAGGGCTACCTTATCAAGGACGGCAAGCTGATCAAGAACAATGCCTCCACTGACTATGACCTATCTGACAAGAGCATCAACCCTCTGGGTG | 9 | XAGLGPREA* |
| 2268 | NM_0009 67.3_653 | 653 | CCAGATTTGGCTTTATATAGCGGACCCGTAAGGCCGACCGGCCTCTACCGGCGGGATTTGATGGCGTGATGTCTCACAGAAAGTTCTCCGCTCCCAGACATGGGTCCCTCGGCTTCCTGCCTCGGAAGCGCAGCAGCAGGCATCGTGGGAAGGTGAAGAGCTTCCCTAAGGATGACCCGTCCAAGCCGGTCCACCTCACAGCCTTCCTGGGATACAAGGCTGGCATGACTCACATCGTGCGGGAAGTCGACAGGCCGGGATCCAAGGTGAACAAGAAGGAGGTGGTGGAGGCTGTGACCATTGTAGAGACACCACCCATGGTGGTTGTGGGCATTGTGGGCTACGTGGAAACCCCTCGA | 6 | XGPREA* |

TABLE 3B-continued

| SEQ ID | identifier_ position | position | modified RNA | PAP length | PAP |
|---|---|---|---|---|---|
| | | | GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACNTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2269 | NM_0009 67.3_657 | 657 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG NCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 5 | XPREA* |
| 2270 | NM_0009 67.3_664 | 664 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGANGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT | 3 | XEA* |

TABLE 3B-continued

| SEQ ID | identifier_ position | position | modified RNA | PAP length | PAP |
|---|---|---|---|---|---|
| | | | GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2271 | NM_0009 67.3_666 | 666 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGANGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 2 | XA* |
| 2272 | NM_0009 67.3_676 | 676 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCANGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 12 | XAGTCEPSV WAG* |
| 2273 | NM_0009 67.3_678 | 678 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT | 11 | XGTCEPSVW AG* |

TABLE 3B-continued

| SEQ ID | identifier_ position | position | modified RNA | PAP length | PAP |
|---|---|---|---|---|---|
| | | | CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCNAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2274 | NM_0009 67.3_679 | 679 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCANGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 11 | XGTCEPSVW AG* |
| 2275 | NM_0009 67.3_681 | 681 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA | 10 | XTCEPSVWA G* |

TABLE 3B-continued

| SEQ ID | identifier_ position | position | modified RNA | PAP length | PAP |
|---|---|---|---|---|---|
| | | | GAAGAAGGCCCACCTGATGGAGATCCAGGTGAA CGGAGGCACTGTGGCCGAGAAGCTGGACTGGG CCCGCGAGAGGCTTGAGCAGCAGGNTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2276 | NM_0009 67.3_685 | 685 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCNTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 8 | CEPSVWAG* |
| 2277 | NM_0009 67.3_691 | 691 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AANCCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA | 7 | XPSVWAG* |

TABLE 3B-continued

| SEQ ID | identifier_position | position | modified RNA | PAP length | PAP |
|---|---|---|---|---|---|
| | | | CTATGACCTATCTGACAAGAGCATCAACCCTCTGGGTG | | |
| 2278 | NM_0009 67.3_693 | 693 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCNAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTGGGTG | 6 | XSVWAG* |
| 2279 | NM_0009 67.3_695 | 695 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAANGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTGGGTG | 5 | XVWAG* |
| 2280 | NM_0009 67.3_713 | 713 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA | 63 | XDRRHRGDQ GQRLQRGHQ SLAHQEAAPQ DPPRPAQGGL YWGMASCSC SLLCGTRWAE RLPSPH* |

TABLE 3B-continued

| SEQ ID | identifier_position | position | modified RNA | PAP length | PAP |
|---|---|---|---|---|---|
| | | | GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGNATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2281 | NM_0009 67.3_722 | 722 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC NGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 60 | XHRGDQGQR LQRGHQSLAH QEAAPQDPPR PAQGGLYWG MASCSCSLLC GTRWAERLPS PH* |
| 2282 | NM_0009 67.3_725 | 725 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCNATCGGGGTGACCAAGGGCAAAGGCTACAA AGGGGTCACCAGTCGTTGGCACACCAAGAAGCT | 59 | XRGDQGQRL QRGHQSLAH QEAAPQDPPR PAQGGLYWG MASCSCSLLC GTRWAERLPS PH* |

TABLE 3B-continued

| SEQ ID | identifier_position | position | modified RNA | PAP length | PAP |
|---|---|---|---|---|---|
| | | | GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2283 | NM_0009 67.3_726 | 726 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCANTCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 59 | XRGDQGQRL QRGHQSLAH QEAAPQDPPR PAQGGLYWG MASCSCSLLC GTRWAERLPS PH* |
| 2284 | NM_0009 67.3_742 | 742 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGNCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 53 | QRLQRGHQS LAHQEAAPQD PPRPAQGGLY WGMASCSCS LLCGTRWAER LPSPH* |
| 2285 | NM_0009 67.3_743 | 743 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT | 53 | XRLQRGHQSL AHQEAAPQDP PRPAQGGLY WGMASCSCS LLCGTRWAER |

TABLE 3B-continued

| SEQ ID | identifier_position | position | modified RNA | PAP length | PAP |
|---|---|---|---|---|---|
| | | | CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCNAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | LPSPH* |
| 2286 | NM_0009 67.3_752 | 752 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACNAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 50 | XRGHQSLAH QEAAPQDPPR PAQGGLYWG MASCSCSLLC GTRWAERLPS PH* |
| 2287 | NM_0009 67.3_764 | 764 | CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA | 46 | XSLAHQEAAP QDPPRPAQG GLYWGMASC SCSLLCGTRW AERLPSPH* |

TABLE 3B-continued

| SEQ ID | identifier_position | position | modified RNA | PAP length | PAP |
|---|---|---|---|---|---|
| | | | CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCNAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2288 | NM_0009 67.3_765 | 765 | CCAGATTTGGCTTTATATAGCGGACCCGTAAGG CCAGATTTGGCTTTATATAGCGGACCCGTAAGG GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCANGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 46 | XSLAHQEAAP QDPPRPAQG GLYWGMASC SCSLLCGTRW AERLPSPH* |
| 2289 | NM_0009 67.3_782 | 782 | CCAGATTTGGCTTTATATAGCGGACCCGTAAGG CCAGATTTGGCTTTATATAGCGGACCCGTAAGG GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGNAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 40 | XAAPQDPPRP AQGGLYWGM ASCSCSLLCG TRWAERLPSP H* |

TABLE 3B-continued

| SEQ ID | identifier_position | position | modified RNA | PAP length | PAP |
|---|---|---|---|---|---|
| 2290 | NM_0009 67.3_810 | 810 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCNTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 31 | XAQGGLYWG MASCSCSLLC GTRWAERLPS PH* |
| 2291 | NM_0009 67.3_822 | 822 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCTGCGCAAGGT GGNCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 27 | XLYWGMASC SCSLLCGTRW AERLPSPH* |
| 2292 | NM_0009 67.3_826 | 826 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA | 26 | XYWGMASCS CSLLCGTRWA ERLPSPH* |

TABLE 3B-continued

| SEQ ID | identifier_ position | position | modified RNA | PAP length | PAP |
|---|---|---|---|---|---|
| | | | AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCTGCGCAAGGT GGCCTGNTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 2293 | NM_0009 67.3_844 | 844 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCTGCGCAAGGT GGCCTGTATTGGGGCATGGCATCCNTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 19 | CSCSLLCGTR WAERLPSPH* |
| 2294 | NM_0009 67.3_897 | 897 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCTGCGCAAGGT GGCCTGTATTGGGGCATGGCATCCTGCTCGTGT | 2 | XH* |

TABLE 3B-continued

| SEQ ID | identifier_ position | position | modified RNA | PAP length | PAP |
|---|---|---|---|---|---|
| | | | AGCCTTCTCTGTGGCACGCGCTGGGCAGAAAG GCTACCATCACCNGCACTGAGATCAACAAGAAG ATTTATAAGATTGGCCAGGGCTACCTTATCAAGG ACGGCAAGCTGATCAAGAACAATGCCTCCACTG ACTATGACCTATCTGACAAGAGCATCAACCCTCT GGGTG | | |
| 2295 | NM_0009 67.3_937 | 937 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CGGAGGCACTGTGGCCGAGAAGCTGGACTGGG CCCGCGAGAGGCTTGAGCAGCAGGTACCTGTG AACCAAGTGTTTGGGCAGGATGAGATGATCGAC GTCATCGGGGTGACCAAGGGCAAAGGCTACAAA GGGGTCACCAGTCGTTGGCACACCAAGAAGCTG CCCCGCAAGACCCACCGAGGCCTGCGCAAGGT GGCCTGTATTGGGGCATGGCATCCTGCTCGTGT AGCCTTCTCTGTGGCACGCGCTGGGCAGAAAG GCTACCATCACCNGCACTGAGATCAACAAGAAGA TTTATAAGATTGGCCAGGGNCTACCTTATCAAGG ACGGCAAGCTGATCAAGAACAATGCCTCCACTG ACTATGACCTATCTGACAAGAGCATCAACCCTCT GGGTG | 15 | LPYQGRQAD QEQCLH* |
| 2296 | NM_0009 68.2_144 | 144 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGNCTCCTATTCGACCAGATATT GTGAACTTTGTTCACACCAACTTGCGCAAAAACA ACAGACAGCCCTATGCTGTCAGTGAATTAGCAG GTCATCAGACTAGTGCTGAGTCTTGGGGTACTG GCAGAGCTGTGGCTCGAATTCCCAGAGTTCGAG GTGGTGGGACTCACCGCTCTGGCCAGGGTGCT TTTGGAAACATGTGTCGTGGAGGCCGAATGTTT GCACCAACCAAAACCTGGCGCCGTTGGCATCGT AGAGTGAACACAACCCAAAAACGATACGCCATC TGTTCTGCCCTGGCTGCCTCAGCCCTACCAGCA CTGGTCATGTCTAAAGGTCATCGTATTGAGGAA GTTCCTGAACTTCCTTTGGTAGTTGAAGATAAAG TTGAAGGCTACAAGAAGACCAAGGAAGCTGTTT TGCTCCTTAAGAAACTTAAAGCCTGGAATGATAT CAAAAAGGTCTATGCCTCTCAGCGAATGAGAGC TGGCAAAGGCAAAATGAGAAACCGTCGCCGTAT CCAGCGCAGGGGCCCGTGCATCATCTATAATGA GGATAATGGTATCATCAAGGCCTTCAGAAACATC CCTGGAATTACTCTGCTTAATGTAAGCAAGCTGA ACATTTTGAAGCTTGCTCCTGGTGGGCATGTGG GACGTTTCTGCATTTGGACTGAAAGTGCTTTCCG GAAGTTAGATGAATTGTACGGCACTTGGCGTAA AGCCGCTTCCCTCAAGAGTAACTACAATCTTCCC ATGCACAAGATGATTAATACAGATCTTAGCAGAA TCTTGAAAAGCCCAGAGATCCAAAGAGCCCTTC GAGCACCACGCAAGAAGTCCATCGCAGAGTCC TAAAGAAGAACCCACTGAAAAACTTGA | 26 | XSYSTRYCEL CSHQLAQKQ QTALCCQ* |
| 2297 | NM_0009 68.2_475 | 475 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG | 5 | XRSSY* |

TABLE 3B-continued

| SEQ ID | identifier_position | position | modified RNA | PAP length | PAP |
|---|---|---|---|---|---|
| | | | CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAANAGGTCATCGTATTGAGGAAG<br>TTCCTGAACTTCCTTTGGTAGTTGAAGATAAAGT<br>TGAAGGCTACAAGAAGACCAAGGAAGCTGTTTT<br>GCTCCTTAAGAAACTTAAAGCCTGGAATGATATC<br>AAAAAGGTCTATGCCTCTCAGCGAATGAGAGCT<br>GGCAAAGGCAAAATGAGAAACCGTCGCCGTATC<br>CAGCGCAGGGGCCCGTGCATCATCTATAATGAG<br>GATAATGGTATCATCAAGGCCTTCAGAAACATCC<br>CTGGAATTACTCTGCTTAATGTAAGCAAGCTGAA<br>CATTTTGAAGCTTGCTCCTGGTGGGCATGTGGG<br>ACGTTTCTGCATTTGGACTGAAAGTGCTTTCCGG<br>AAGTTAGATGAATTGTACGGCACTTGGCGTAAA<br>GCCGCTTCCCTCAAGAGTAACTACAATCTTCCCA<br>TGCACAAGATGATTAATACAGATCTTAGCAGAAT<br>CTTGAAAAGCCCAGAGATCCAAAGAGCCCTTCG<br>AGCACCACGCAAGAAGATCCATCGCAGAGTCCT<br>AAAGAAGAACCCACTGAAAAACTTGA | | |
| 2298 | NM_0009<br>68.2_510 | 510 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTNTGGTAGTTGAAGATAAAGTT<br>GAAGGCTACAAGAAGACCAAGGAAGCTGTTTTG<br>CTCCTTAAGAAACTTAAAGCCTGGAATGATATCA<br>AAAAGGTCTATGCCTCTCAGCGAATGAGAGCTG<br>GCAAAGGCAAAATGAGAAACCGTCGCCGTATCC<br>AGCGCAGGGGCCCGTGCATCATCTATAATGAGG<br>ATAATGGTATCATCAAGGCCTTCAGAAACATCCC<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | 3 | XGS* |
| 2299 | NM_0009<br>68.2_521 | 521 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAANGATAAAGTT<br>GAAGGCTACAAGAAGACCAAGGAAGCTGTTTTG<br>CTCCTTAAGAAACTTAAAGCCTGGAATGATATCA<br>AAAAGGTCTATGCCTCTCAGCGAATGAGAGCTG<br>GCAAAGGCAAAATGAGAAACCGTCGCCGTATCC<br>AGCGCAGGGGCCCGTGCATCATCTATAATGAGG<br>ATAATGGTATCATCAAGGCCTTCAGAAACATCCC<br>TGGAATTACTCTGCTTAATGTAAGCAAGCTGAAC | 1 | X* |

TABLE 3B-continued

| SEQ ID | identifier_position | position | modified RNA | PAP length | PAP |
|---|---|---|---|---|---|
| | | | ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | | |
| 2300 | NM_0009 68.2_526 | 526 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAANGTT GAAGGCTACAAGAAGACCAAGGAAGCTGTTTTG CTCCTTAAGAAACTTAAAGCCTGGAATGATATCA AAAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 2 | XS* |
| 2301 | NM_0009 68.2_527 | 527 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAANGTT GAAGGCTACAAGAAGACCAAGGAAGCTGTTTTG CTCCTTAAGAAACTTAAAGCCTGGAATGATATCA AAAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 1 | X* |
| 2302 | NM_0009 68.2_552 | 552 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG | 6 | XSCFAP* |

TABLE 3B-continued

| SEQ ID | identifier_position | position | modified RNA | PAP length | PAP |
|---|---|---|---|---|---|
| | | | TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGNAAGCTGTTTTG CTCCTTAAGAAACTTAAAGCCTGGAATGATATCA AAAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | | |
| 2303 | NM_0009 68.2_562 | 562 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTNG CTCCTTAAGAAACTTAAAGCCTGGAATGATATCA AAAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 3 | XAP* |
| 2304 | NM_0009 68.2_598 | 598 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA NAAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC | 31 | XKGLCLSANE SWQRQNEKP SPYPAQGPVH HL* |

TABLE 3B-continued

| SEQ ID | identifier_ position | position | modified RNA | PAP length | PAP |
|---|---|---|---|---|---|
| | | | TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | | |
| 2305 | NM_0009 68.2_599 | 599 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA ANAAGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 30 | XGLCLSANES WQRQNEKPS PYPAQGPVHH L* |
| 2306 | NM_0009 68.2_601 | 601 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAANGGTCTATGCCTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 30 | XGLCLSANES WQRQNEKPS PYPAQGPVHH L* |
| 2307 | NM_0009 68.2_611 | 611 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGTCCTATTCGACCAGATATTG TGAACTTTGTTCACACCAACTTGCGCAAAAACAA | 26 | XSANESWQR QNEKPSPYPA QGPVHHL* |

TABLE 3B-continued

| SEQ ID | identifier_position | position | modified RNA | PAP length | PAP |
|---|---|---|---|---|---|
| | | | CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAAGGTCTATGCCNTCTCAGCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | | |
| 2308 | NM_0009 68.2_617 | 617 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAAGGTCTATGCCTCTCAGNCGAATGAGAGCTG GCAAAGGCAAAATGAGAAACCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 24 | XNESWQRQN EKPSPYPAQG PVHHL* |
| 2309 | NM_0009 68.2_642 | 642 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAAGGTCTATGCCTCTCAGCGAATGAGAGCTGG CAAAGGCAAAANTGAGAAACCGTCGCCGTATCC AGCGCAGGGGCCCGTGCATCATCTATAATGAGG | 16 | XEKPSPYPAQ GPVHHL* |

TABLE 3B-continued

| SEQ ID | identifier_position | position | modified RNA | PAP length | PAP |
|---|---|---|---|---|---|
| | | | ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | | |
| 2310 | NM_0009 68.2_649 | 649 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAAGGTCTATGCCTCTCAGCGAATGAGAGCTGG CAAAGGCAAAATGAGAAANCCGTCGCCGTATCC AGCGCAGGGGCCCGTGCATCATCTATAATGAGG ATAATGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 14 | XPSPYPAQGP VHHL* |
| 2311 | NM_0009 68.2_700 | 700 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG TGAACTTTGTTCACACCAACTTGCGCAAAAACAA CAGACAGCCCTATGCTGTCAGTGAATTAGCAGG TCATCAGACTAGTGCTGAGTCTTGGGGTACTGG CAGAGCTGTGGCTCGAATTCCCAGAGTTCGAGG TGGTGGGACTCACCGCTCTGGCCAGGGTGCTTT TGGAAACATGTGTCGTGGAGGCCGAATGTTTGC ACCAACCAAAACCTGGCGCCGTTGGCATCGTAG AGTGAACACAACCCAAAAACGATACGCCATCTG TTCTGCCCTGGCTGCCTCAGCCCTACCAGCACT GGTCATGTCTAAAGGTCATCGTATTGAGGAAGTT CCTGAACTTCCTTTGGTAGTTGAAGATAAAGTTG AAGGCTACAAGAAGACCAAGGAAGCTGTTTTGC TCCTTAAGAAACTTAAAGCCTGGAATGATATCAA AAAGGTCTATGCCTCTCAGCGAATGAGAGCTGG CAAAGGCAAAATGAGAAACCGTCGCCGTATCCA GCGCAGGGGCCCGTGCATCATCTATAATGAGGA TAANTGGTATCATCAAGGCCTTCAGAAACATCCC TGGAATTACTCTGCTTAATGTAAGCAAGCTGAAC ATTTTGAAGCTTGCTCCTGGTGGGCATGTGGGA CGTTTCTGCATTTGGACTGAAAGTGCTTTCCGGA AGTTAGATGAATTGTACGGCACTTGGCGTAAAG CCGCTTCCCTCAAGAGTAACTACAATCTTCCCAT GCACAAGATGATTAATACAGATCTTAGCAGAATC TTGAAAAGCCCAGAGATCCAAAGAGCCCTTCGA GCACCACGCAAGAAGATCCATCGCAGAGTCCTA AAGAAGAACCCACTGAAAAACTTGA | 16 | XWYHQGLQK HPWNYSA* |
| 2312 | NM_0009 68.2_712 | 712 | CTTTTCCTGTGGCAGCAGCCGGGCTGAGAGGA GCGTGGCTGTCTCCTCTCTCCGCCATGGCGTGT GCTCGCCCACTGATATCGGTGTACTCCGAAAAG GGGGAGTCATCTGGCAAAAATGTCACTTTGCCT GCTGTATTCAAGGCTCCTATTCGACCAGATATTG | 12 | XGLQKHPWN YSA* |

TABLE 3B-continued

| SEQ ID | identifier_position | position | modified RNA | PAP length | PAP |
|---|---|---|---|---|---|
| | | | TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAANGGCCTTCAGAAACATCCC<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | | |
| 2313 | NM_0009<br>68.2_714 | 714 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAAGGNCCTTCAGAAACATCCC<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | 11 | XLQKHPWNY<br>SA* |
| 2314 | NM_0009<br>68.2_716 | 716 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA | 10 | XQKHPWNYS<br>A* |

TABLE 3B-continued

| SEQ ID | identifier_position | position | modified RNA | PAP length | PAP |
|---|---|---|---|---|---|
| | | | GCGCAGGGGCCCGTGCATCATCTATAATGAGGA<br>TAATGGTATCATCAAGGCCN TTCAGAAACATCCC<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | | |
| 2315 | NM_0009<br>68.2_724 | 724 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAAGGCCTTCAGAAANCATCCC<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | 8 | XHPWNYSA* |
| 2316 | NM_0009<br>68.2_730 | 730 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAAGGCCTTCAGAAACATCCCN<br>TGGAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | 5 | WNYSA* |
| 2317 | NM_0009<br>68.2_733 | 733 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT | 4 | NYSA* |

TABLE 3B-continued

| SEQ ID | identifier_position | position | modified RNA | PAP length | PAP |
|---|---|---|---|---|---|
| | | | GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAAGGCCTTCAGAAACATCCCT<br>GGNAATTACTCTGCTTAATGTAAGCAAGCTGAAC<br>ATTTTGAAGCTTGCTCCTGGTGGGCATGTGGGA<br>CGTTTCTGCATTTGGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | | |
| 2318 | NM_0009<br>68.2_810 | 810 | CTTTTCCTGTGGCAGCAGCCGGGCTGAGAGGA<br>GCGTGGCTGTCTCCTCTCTCCGCCATGGCGTGT<br>GCTCGCCCACTGATATCGGTGTACTCCGAAAAG<br>GGGGAGTCATCTGGCAAAAATGTCACTTTGCCT<br>GCTGTATTCAAGGCTCCTATTCGACCAGATATTG<br>TGAACTTTGTTCACACCAACTTGCGCAAAAACAA<br>CAGACAGCCCTATGCTGTCAGTGAATTAGCAGG<br>TCATCAGACTAGTGCTGAGTCTTGGGGTACTGG<br>CAGAGCTGTGGCTCGAATTCCCAGAGTTCGAGG<br>TGGTGGGACTCACCGCTCTGGCCAGGGTGCTTT<br>TGGAAACATGTGTCGTGGAGGCCGAATGTTTGC<br>ACCAACCAAAACCTGGCGCCGTTGGCATCGTAG<br>AGTGAACACAACCCAAAAACGATACGCCATCTG<br>TTCTGCCCTGGCTGCCTCAGCCCTACCAGCACT<br>GGTCATGTCTAAAGGTCATCGTATTGAGGAAGTT<br>CCTGAACTTCCTTTGGTAGTTGAAGATAAAGTTG<br>AAGGCTACAAGAAGACCAAGGAAGCTGTTTTGC<br>TCCTTAAGAAACTTAAAGCCTGGAATGATATCAA<br>AAAGGTCTATGCCTCTCAGCGAATGAGAGCTGG<br>CAAAGGCAAAATGAGAAACCGTCGCCGTATCCA<br>GCGCAGGGGCCCGTGCATCATCTATAATGAGGA<br>TAATGGTATCATCAAGGCCTTCAGAAACATCCCT<br>GGAATTACTCTGCTTAATGTAAGCAAGCTGAACA<br>TTTTGAAGCTTGCTCCTGGTGGGCATGTGGGAC<br>GTTTCTGCATTTN GGACTGAAAGTGCTTTCCGGA<br>AGTTAGATGAATTGTACGGCACTTGGCGTAAAG<br>CCGCTTCCCTCAAGAGTAACTACAATCTTCCCAT<br>GCACAAGATGATTAATACAGATCTTAGCAGAATC<br>TTGAAAAGCCCAGAGATCCAAAGAGCCCTTCGA<br>GCACCACGCAAGAAGATCCATCGCAGAGTCCTA<br>AAGAAGAACCCACTGAAAAACTTGA | 2 | XD* |
| 2319 | NM_0009<br>69.3_787 | 787 | GGCCCTTTTCCCACCCCCTAGCGCCGCTGGGC<br>CTGCAGGTCTCTGTCGAGCAGCGGACGCCGGT<br>CTCTGTTCCGCAGGATGGGGTTTGTTAAAGTTGT<br>TAAGAATAAGGCCTACTTTAAGAGATACCAAGTG<br>AAATTTAGAAGACGACGAGAGGGTAAAACTGATT<br>ATTATGCTCGGAAACGCTTGGTGATACAAGATAA<br>AAATAAATACAACACACCCAAATACAGGATGATA<br>GTTCGTGTGACAAACAGAGATATCATTTGTCAGA<br>TTGCTTATGCCCGTATAGAGGGGGATATGATAG<br>TCTGCGCAGCGTATGCACACGAACTGCCAAAAT<br>ATGGTGTGAAGGTTGGCCTGACAAATTATGCTG<br>CAGCATATTGTACTGGCCTGCTGCTGGCCCGCA<br>GGCTTCTCAATAGGTTTGGCATGGACAAGATCTA<br>TGAAGGCCAAGTGGAGGTGACTGGTGATGAATA<br>CAATGTGGAAAGCATTGATGGTCAGCCAGGTGC<br>CTTCACCTGCTATTTGGATGCAGGCCTTGCCAG<br>AACTACCACTGGCAATAAAGTTTTTGGTGCCCTG<br>AAGGGAGCTGTGGATGGAGGCTTGTCTATCCCT<br>CACAGTACCAAAACGATTCCCTGGTTATGATTCTG | 4 | XGDV* |

TABLE 3B-continued

| SEQ ID | identifier_position | position | modified RNA | PAP length | PAP |
|---|---|---|---|---|---|
| | | | AAAGCAAGGAATTTAATGCAGAAGTACATCGGAA
GCACATCATGGGCCAGAATGTTGCAGATTACAT
GCGCTACTTAATGGAAGAAGATGAAGATGCTTA
CAAGAAACAGTTCTCTCAATACATAAAGAACAGC
GTAACTCCAGACATGATGGNAGGAGATGTATAA
GAAAGCTCATGCTGCTATACGAGAGAATCCAGT
CTATGAAAAGAAGCCCAAGAAAGAAGTTAAAAAG
AAGAGGTGGAACCGTCCCAAAATGTCCCTTGCT
CAGAAGAAGGATCGGGTAGCTCAAAAGAAGGCA
AGCTTCCTCAGAGCTCAGGAGCGGGCTGCTGA
GAGCTAAACCCAGCAATTTTCTATGATTTTTTCA
GATATAGATAATAAACTTATGAAC | | |
| 2320 | NM_0009
70.3_301 | 301 | GATTGCTTATAGACCGGAAGCCGGGACCTTAAT
TCTCTTTCCCATCTTGCAAGATGGCGGGTGAAAA
AGTTGAGAAGCCAGATACTAAAGAGAAGAAACC
CGAAGCCAAGAAGGTTGATGCTGGTGGCAAGGT
GAAAAAGGGTAACCTCAAAGCTAAAAAGCCCAA
GAAGGGGAAGCCCCATTGCAGCCGCAACCCTG
TCCTTGTCAGAGGAATTGGCAGGTATTCCCGAT
CTGCCATGTATTCCAGAAAGGCCATGTACAAGA
GGAAGTACTCAGCCGCTAAATCCAAGGTTGAAA
AGAANAAAGAAGGAGAAGGTTCTCGCAACTGTT
ACAAAACCAGTTGGTGGTGACAAGAACGGCGGT
ACCCGGGTGGTTAAACTTCGCAAAATGCCTAGA
TATTATCCTACTGAAGATGTGCCTCGAAAGCTGT
TGAGCCACGGCAAAAAACCCTTCAGTCAGCACG
TGAGAAAACTGCGAGCCAGCATTACCCCCGGGA
CCATTCTGATCATCCTCACTGGACGCCACAGGG
GCAAGAGGGTGGTTTTCCTGAAGCAGCTGGCTA
GTGGCTTATTACTTGTGACTGGACCTCTGGTCCT
CAATCGAGTTCCTCTACGAAGAACACACCAGAA
ATTTGTCATTGCCACTTCAACCAAAATCGATATC
AGCAATGTAAAAATCCCAAAACATCTTACTGATG
CTTACTTCAAGAAGAAGAAGCTGCGGAAGCCCA
GACACCAGGAAGGTGAGATCTTCGACACAGAAA
AAGAGAAATATGAGATTACGGAGCAGCGCAAGA
TTGATCAGAAAGCTGTGGACTCACAAATTTTACC
AAAAATCAAAGCTATTCCTCAGCTCCAGGGCTAC
CTGCGATCTGTGTTTGCTCTGACGAATGGAATTT
ATCCTCACAAATTGGTGTTCTAAATGTCTTAAGA
ACCTAATTAAATAGCTGACTACAAAAAAAAAAAA
AAAAAAA | 16 | XKEGEGSRN
CYKTSWW* |
| 2321 | NM_0009
70.3_740 | 740 | GATTGCTTATAGACCGGAAGCCGGGACCTTAAT
TCTCTTTCCCATCTTGCAAGATGGCGGGTGAAAA
AGTTGAGAAGCCAGATACTAAAGAGAAGAAACC
CGAAGCCAAGAAGGTTGATGCTGGTGGCAAGGT
GAAAAAGGGTAACCTCAAAGCTAAAAAGCCCAA
GAAGGGGAAGCCCCATTGCAGCCGCAACCCTG
TCCTTGTCAGAGGAATTGGCAGGTATTCCCGAT
CTGCCATGTATTCCAGAAAGGCCATGTACAAGA
GGAAGTACTCAGCCGCTAAATCCAAGGTTGAAA
AGAAAAAGAAGGAGAAGGTTCTCGCAACTGTTA
CAAAACCAGTTGGTGGTGACAAGAACGGCGGTA
CCCGGGTGGTTAAACTTCGCAAAATGCCTAGAT
ATTATCCTACTGAAGATGTGCCTCGAAAGCTGTT
GAGCCACGGCAAAAAACCCTTCAGTCAGCACGT
GAGAAAACTGCGAGCCAGCATTACCCCCGGGAC
CATTCTGATCATCCTCACTGGACGCCACAGGGG
CAAGAGGGTGGTTTTCCTGAAGCAGCTGGCTAG
TGGCTTATTACTTGTGACTGGACCTCTGGTCCTC
AATCGAGTTCCTCTACGAAGAACACACCAGAAAT
TTGTCATTGCCACTTCAACCAAAATCGATATCAG
CAATGTAAAAATCCCAAAACATCTTACTGATGCT
TACTTCAAGAAGAAGAAGCTGCGGAAGCCCAGA
CACCAGGAANGGTGAGATCTTCGACACAGAAAA
AGAGAAATATGAGATTACGGAGCAGCGCAAGAT
TGATCAGAAAGCTGTGGACTCACAAATTTTACCA
AAAATCAAAGCTATTCCTCAGCTCCAGGGCTACC
TGCGATCTGTGTTTGCTCTGACGAATGGAATTTA
TCCTCACAAATTGGTGTTCTAAATGTCTTAAGAA
CCTAATTAAATAGCTGACTACAAAAAAAAAAAAA
AAAAAA | 1 | X* |
| 2322 | NM_0009
70.3_742 | 742 | GATTGCTTATAGACCGGAAGCCGGGACCTTAAT
TCTCTTTCCCATCTTGCAAGATGGCGGGTGAAAA
AGTTGAGAAGCCAGATACTAAAGAGAAGAAACC
CGAAGCCAAGAAGGTTGATGCTGGTGGCAAGGT
GAAAAAGGGTAACCTCAAAGCTAAAAAGCCCAA | 0 | * |

TABLE 3B-continued

| SEQ ID | identifier_position | position | modified RNA | PAP length | PAP |
|---|---|---|---|---|---|
| | | | GAAGGGGAAGCCCCATTGCAGCCGCAACCCTG TCCTTGTCAGAGGAATTGGCAGGTATTCCCGAT CTGCCATGTATTCCAGAAAGGCCATGTACAAGA GGAAGTACTCAGCCGCTAAATCCAAGGTTGAAA AGAAAAAAGAAGGAGAAGGTTCTCGCAACTGTTA CAAAACCAGTTGGTGGTGACAAGAACGGCGGTA CCCGGGTGGTTAAACTTCGCAAAATGCCTAGAT ATTATCCTACTGAAGATGTGCCTCGAAAGCTGTT GAGCCACGGCAAAAAACCCTTCAGTCAGCACGT GAGAAAACTGCGAGCCAGCATTACCCCCGGGAC CATTCTGATCATCCTCACTGGACGCCACAGGGG CAAGAGGGTGGTTTTCCTGAAGCAGCTGGCTAG TGGCTTATTACTTGTGACTGGACCTCTGGTCCTC AATCGAGTTCCTCTACGAAGAACACACCAGAAAT TTGTCATTGCCACTTCAACCAAAATCGATATCAG CAATGTAAAAATCCCAAAACATCTTACTGATGCT TACTTCAAGAAGAAGAAGCTGCGGAAGCCCAGA CACCAGGAAGGN TGAGATCTTCGACACAGAAAA AGAGAAATATGAGATTACGGAGCAGCGCAAGAT TGATCAGAAAGCTGTGGACTCACAAATTTTACCA AAAAATCAAAGCTATTCCTCAGCTCCAGGGCTACC TGCGATCTGTGTTTGCTCTGACGAATGGAATTTA TCCTCACAAATTGGTGTTCTAAATGTCTTAAGAA CCTAATTAAATAGCTGACTACAAAAAAAAAAAAA AAAAAA | | |
| 2323 | NM_0009 71.3_341 | 341 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAANAGGTGTTGCAGCTTCTTCGCCTTC GTCAAATCTTCAATGGAACCTTTGTGAAGCTCAA CAAGGCTTCGATTAACATGCTGAGGATTGTAGA GCCATATATTGCATGGGGGTACCCCAATCTGAA GTCAGTAAATGAACTAATCTACAAGCGTGGTTAT GGCAAAATCAATAAGAAGCGAATTGCTTTGACAG ATAACGCTTTGATTGCTCGATCTCTTGGTAAATA CGGCATCATCTGCATGGAGGATTTGATTCATGA GATCTATACTGTTGGAAAAACGCTTCAAAGAGGCA AATAACTTCCTGTGGCCCTTCAAATTGTCTTCTC CACGAGGTGGAATGAAGAAAAAGACCACCCATT TTGTAGAAGGTGGAGATGCTGGCAACAGGGAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAA | 24 | XGVAASSPSS NLQWNLCEA QQGFD* |
| 2324 | NM_0009 71.3_387 | 387 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTNTGTGAAGCTCAA CAAGGCTTCGATTAACATGCTGAGGATTGTAGA GCCATATATTGCATGGGGGTACCCCAATCTGAA GTCAGTAAATGAACTAATCTACAAGCGTGGTTAT GGCAAAATCAATAAGAAGCGAATTGCTTTGACAG ATAACGCTTTGATTGCTCGATCTCTTGGTAAATA CGGCATCATCTGCATGGAGGATTTGATTCATGA GATCTATACTGTTGGAAAAACGCTTCAAAGAGGCA AATAACTTCCTGTGGCCCTTCAAATTGTCTTCTC CACGAGGTGGAATGAAGAAAAAGACCACCCATT TTGTAGAAGGTGGAGATGCTGGCAACAGGGAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAA | 9 | XCEAQQGFD* |

TABLE 3B-continued

| SEQ ID | identifier_ position | position | modified RNA | PAP length | PAP |
|---|---|---|---|---|---|
| 2325 | NM_0009 71.3_459 | 459 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAANTCTGAA GTCAGTAAATGAACTAATCTACAAGCGTGGTTAT GGCAAAATCAATAAGAAGCGAATTGCTTTGACAG ATAACGCTTTGATTGCTCGATCTCTTGGTAAATA CGGCATCATCTGCATGGAGGATTTGATTCATGA GATCTATACTGTTGGAAAACGCTTCAAAGAGGCA AATAACTTCCTGTGGCCCTTCAAATTGTCTTCTC CACGAGGTGGAATGAAGAAAAAGACCACCCATT TTGTAGAAGGTGGAGATGCTGGCAACAGGGAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA | 6 | XSEVSK* |
| 2326 | NM_0009 71.3_565 | 565 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAATCTGAAG TCAGTAAATGAACTAATCTACAAGCGTGGTTATG GCAAAATCAATAAGAAGCGAATTGCTTTGACAGA TAACGCTTTGATTGCTCGATCTCTTGGTAAAN TA CGGCATCATCTGCATGGAGGATTTGATTCATGA GATCTATACTGTTGGAAAACGCTTCAAAGAGGCA AATAACTTCCTGTGGCCCTTCAAATTGTCTTCTC CACGAGGTGGAATGAAGAAAAAGACCACCCATT TTGTAGAAGGTGGAGATGCTGGCAACAGGGAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA | 11 | XRHHLHGGFD S* |
| 2327 | NM_0009 71.3_628 | 628 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAATCTGAAG TCAGTAAATGAACTAATCTACAAGCGTGGTTATG GCAAAATCAATAAGAAGCGAATTGCTTTGACAGA TAACGCTTTGATTGCTCGATCTCTTGGTAAATAC GGCATCATCTGCATGGAGGATTTGATTCATGAG ATCTATACTGTTGGAAAACGCTTCAAAN GAGGCA AATAACTTCCTGTGGCCCTTCAAATTGTCTTCTC CACGAGGTGGAATGAAGAAAAAGACCACCCATT TTGTAGAAGGTGGAGATGCTGGCAACAGGGAG GACCAGATCAACAGGCTTATTAGAAGAATGAACT AAGGTGTCTACCATGATTATTTTTCTAAGCTGGT | 3 | XGK* |

TABLE 3B-continued

| SEQ ID | identifier_ position | position | modified RNA | PAP length | PAP |
|---|---|---|---|---|---|
| 2328 | NM_0009 71.3_678 | 678 | TGGTTAATAAACAGTACCTGCTCTCAAATTGAAA<br>TAAAAAAAAAAAAAAAAAAAAAAAAAAAAAA<br>TCCTCTTTTTCCGGCTGGAACCATGGAGGGTGT<br>AGAAGAGAAGAAGAAGGAGGTTCCTGCTGTGCC<br>AGAAACCCTTAAGAAAAAGCGAAGGAATTTCGC<br>AGAGCTGAAGATCAAGCGCCTGAGAAAGAAGTT<br>TGCCCAAAAGATGCTTCGAAAGGCAAGGAGGAA<br>GCTTATCTATGAAAAAGCAAAGCACTATCACAAG<br>GAATATAGGCAGATGTACAGAACTGAAATTCGAA<br>TGGCGAGGATGGCAAGAAAAGCTGGCAACTTCT<br>ATGTACCTGCAGAACCCAAATTGGCGTTTGTCAT<br>CAGAATCAGAGGTATCAATGGAGTGAGCCCAAA<br>GGTTCGAAAGGTGTTGCAGCTTCTTCGCCTTCG<br>TCAAATCTTCAATGGAACCTTTGTGAAGCTCAAC<br>AAGGCTTCGATTAACATGCTGAGGATTGTAGAG<br>CCATATATTGCATGGGGGTACCCCAATCTGAAG<br>TCAGTAAATGAACTAATCTACAAGCGTGGTTATG<br>GCAAAATCAATAAGAAGCGAATTGCTTTGACAGA<br>TAACGCTTTGATTGCTCGATCTCTTGGTAAATAC<br>GGCATCATCTGCATGGAGGATTTGATTCATGAG<br>ATCTATACTGTTGGAAAACGCTTCAAAGAGGCAA<br>ATAACTTCCTGTGGCCCTTCAAATTGTCTTCTCC<br>ACGAGGTGGNAATGAAGAAAAAAGACCACCCATT<br>TTGTAGAAGGTGGAGATGCTGGCAACAGGGAG<br>GACCAGATCAACAGGCTTATTAGAAGAATGAACT<br>AAGGTGTCTACCATGATTATTTTTCTAAGCTGGT<br>TGGTTAATAAACAGTACCTGCTCTCAAATTGAAA<br>TAAAAAAAAAAAAAAAAAAAAAAAAAAAAAA | 25 | NEEKDHPFCR RWRCWQQG GPDQQAY* |
| 2329 | NM_0009 71.3_680 | 680 | TCCTCTTTTTCCGGCTGGAACCATGGAGGGTGT<br>AGAAGAGAAGAAGAAGGAGGTTCCTGCTGTGCC<br>AGAAACCCTTAAGAAAAAGCGAAGGAATTTCGC<br>AGAGCTGAAGATCAAGCGCCTGAGAAAGAAGTT<br>TGCCCAAAAGATGCTTCGAAAGGCAAGGAGGAA<br>GCTTATCTATGAAAAAGCAAAGCACTATCACAAG<br>GAATATAGGCAGATGTACAGAACTGAAATTCGAA<br>TGGCGAGGATGGCAAGAAAAGCTGGCAACTTCT<br>ATGTACCTGCAGAACCCAAATTGGCGTTTGTCAT<br>CAGAATCAGAGGTATCAATGGAGTGAGCCCAAA<br>GGTTCGAAAGGTGTTGCAGCTTCTTCGCCTTCG<br>TCAAATCTTCAATGGAACCTTTGTGAAGCTCAAC<br>AAGGCTTCGATTAACATGCTGAGGATTGTAGAG<br>CCATATATTGCATGGGGGTACCCCAATCTGAAG<br>TCAGTAAATGAACTAATCTACAAGCGTGGTTATG<br>GCAAAATCAATAAGAAGCGAATTGCTTTGACAGA<br>TAACGCTTTGATTGCTCGATCTCTTGGTAAATAC<br>GGCATCATCTGCATGGAGGATTTGATTCATGAG<br>ATCTATACTGTTGGAAAACGCTTCAAAGAGGCAA<br>ATAACTTCCTGTGGCCCTTCAAATTGTCTTCTCC<br>ACGAGGTGGAANTGAAGAAAAAGACCACCCATT<br>TTGTAGAAGGTGGAGATGCTGGCAACAGGGAG<br>GACCAGATCAACAGGCTTATTAGAAGAATGAACT<br>AAGGTGTCTACCATGATTATTTTTCTAAGCTGGT<br>TGGTTAATAAACAGTACCTGCTCTCAAATTGAAA<br>TAAAAAAAAAAAAAAAAAAAAAAAAAAAAAA | 25 | XEEKDHPFCR RWRCWQQG GPDQQAY* |
| 2330 | NM_0009 71.3_690 | 690 | TCCTCTTTTTCCGGCTGGAACCATGGAGGGTGT<br>AGAAGAGAAGAAGAAGGAGGTTCCTGCTGTGCC<br>AGAAACCCTTAAGAAAAAGCGAAGGAATTTCGC<br>AGAGCTGAAGATCAAGCGCCTGAGAAAGAAGTT<br>TGCCCAAAAGATGCTTCGAAAGGCAAGGAGGAA<br>GCTTATCTATGAAAAAGCAAAGCACTATCACAAG<br>GAATATAGGCAGATGTACAGAACTGAAATTCGAA<br>TGGCGAGGATGGCAAGAAAAGCTGGCAACTTCT<br>ATGTACCTGCAGAACCCAAATTGGCGTTTGTCAT<br>CAGAATCAGAGGTATCAATGGAGTGAGCCCAAA<br>GGTTCGAAAGGTGTTGCAGCTTCTTCGCCTTCG<br>TCAAATCTTCAATGGAACCTTTGTGAAGCTCAAC<br>AAGGCTTCGATTAACATGCTGAGGATTGTAGAG<br>CCATATATTGCATGGGGGTACCCCAATCTGAAG<br>TCAGTAAATGAACTAATCTACAAGCGTGGTTATG<br>GCAAAATCAATAAGAAGCGAATTGCTTTGACAGA<br>TAACGCTTTGATTGCTCGATCTCTTGGTAAATAC<br>GGCATCATCTGCATGGAGGATTTGATTCATGAG<br>ATCTATACTGTTGGAAAACGCTTCAAAGAGGCAA<br>ATAACTTCCTGTGGCCCTTCAAATTGTCTTCTCC<br>ACGAGGTGGAATGAAGAAAAAN GACCACCCATT<br>TTGTAGAAGGTGGAGATGCTGGCAACAGGGAG<br>GACCAGATCAACAGGCTTATTAGAAGAATGAACT | 22 | XDHPFCRRW RCWQQGGPD QQAY* |

TABLE 3B-continued

| SEQ ID | identifier_ position | position | modified RNA | PAP length | PAP |
|---|---|---|---|---|---|
| 2331 | NM_0009 71.3_709 | 709 | AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAATCTGAAG TCAGTAAATGAACTAATCTACAAGCGTGGTTATG GCAAAATCAATAAGAAGCGAATTGCTTTGACAGA TAACGCTTTGATTGCTCGATCTCTTGGTAAATAC GGCATCATCTGCATGGAGGATTTGATTCATGAG ATCTATACTGTTGGAAAACGCTTCAAAGAGGCAA ATAACTTCCTGTGGCCCTTCAAATTGTCTTCTCC ACGAGGTGGAATGAAGAAAAAGACCACCCATTT TGTAGAANGGTGGAGATGCTGGCAACAGGGAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA | 15 | XWRCWQQG GPDQQAY* |
| 2332 | NM_0009 71.3_731 | 731 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAATCTGAAG TCAGTAAATGAACTAATCTACAAGCGTGGTTATG GCAAAATCAATAAGAAGCGAATTGCTTTGACAGA TAACGCTTTGATTGCTCGATCTCTTGGTAAATAC GGCATCATCTGCATGGAGGATTTGATTCATGAG ATCTATACTGTTGGAAAACGCTTCAAAGAGGCAA ATAACTTCCTGTGGCCCTTCAAATTGTCTTCTCC ACGAGGTGGAATGAAGAAAAAGACCACCCATTT TGTAGAAGGTGGAGATGCTGGCAACAGGGNAG GACCAGATCAACAGGCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA | 8 | XGPDQQAY* |
| 2333 | NM_0009 71.3_748 | 748 | TCCTCTTTTTCCGGCTGGAACCATGGAGGGTGT AGAAGAGAAGAAGAAGGAGGTTCCTGCTGTGCC AGAAACCCTTAAGAAAAAGCGAAGGAATTTCGC AGAGCTGAAGATCAAGCGCCTGAGAAAGAAGTT TGCCCAAAAGATGCTTCGAAAGGCAAGGAGGAA GCTTATCTATGAAAAAGCAAAGCACTATCACAAG GAATATAGGCAGATGTACAGAACTGAAATTCGAA TGGCGAGGATGGCAAGAAAAGCTGGCAACTTCT ATGTACCTGCAGAACCCAAATTGGCGTTTGTCAT CAGAATCAGAGGTATCAATGGAGTGAGCCCAAA GGTTCGAAAGGTGTTGCAGCTTCTTCGCCTTCG TCAAATCTTCAATGGAACCTTTGTGAAGCTCAAC AAGGCTTCGATTAACATGCTGAGGATTGTAGAG CCATATATTGCATGGGGGTACCCCAATCTGAAG TCAGTAAATGAACTAATCTACAAGCGTGGTTATG GCAAAATCAATAAGAAGCGAATTGCTTTGACAGA TAACGCTTTGATTGCTCGATCTCTTGGTAAATAC GGCATCATCTGCATGGAGGATTTGATTCATGAG ATCTATACTGTTGGAAAACGCTTCAAAGAGGCAA ATAACTTCCTGTGGCCCTTCAAATTGTCTTCTCC ACGAGGTGGAATGAAGAAAAAGACCACCCATTT TGTAGAAGGTGGAGATGCTGGCAACAGGGAGG | 2 | XY* |

TABLE 3B-continued

| SEQ ID | identifier_position | position | modified RNA | PAP length | PAP |
|---|---|---|---|---|---|
| 2334 | NM_0009 72.2_493 | 493 | ACCAGATCAACAGGNCTTATTAGAAGAATGAACT AAGGTGTCTACCATGATTATTTTTCTAAGCTGGT TGGTTAATAAACAGTACCTGCTCTCAAATTGAAA TAAAAAAAAAAAAAAAAAAAAAAAAAAAAAAA TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GNTGGTGATTGCACACGACGTGGATCCCATCGA GCTGGTTGTCTTCTTGCCTGCCCTGTGTCGTAAA ATGGGGGTCCCTTACTGCATTATCAAGGGAAAG GCAAGACTGGGACGTCTAGTCCACAGGAAGACC TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | 21 | XGDCTRRGS HRAGCLLACP VS* |
| 2335 | NM_0009 72.2_557 | 557 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAANA ATGGGGGTCCCTTACTGCATTATCAAGGGAAAG GCAAGACTGGGACGTCTAGTCCACAGGAAGACC TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | 41 | XNGGPLLHYQ GKGKTGTSSP QEDLHHCRLH TGELGRQRRF G* |
| 2336 | NM_0009 72.2_559 | 559 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA NTGGGGGTCCCTTACTGCATTATCAAGGGAAAG GCAAGACTGGGACGTCTAGTCCACAGGAAGACC | 40 | XGGPLLHYQG KGKTGTSSPQ EDLHHCRLHT GELGRQRRF G* |

TABLE 3B-continued

| SEQ ID | identifier_ position | position | modified RNA | PAP length | PAP |
|---|---|---|---|---|---|
| | | | TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | | |
| 2337 | NM_0009 72.2_588 | 588 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA TGGGGGTCCCTTACTGCATTATCAAGGGANAAG GCAAGACTGGGACGTCTAGTCCACAGGAAGACC TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | 30 | XGKTGTSSPQ EDLHHCRLHT GELGRQRRF G* |
| 2338 | NM_0009 72.2_589 | 589 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA TGGGGGTCCCTTACTGCATTATCAAGGGAANAG GCAAGACTGGGACGTCTAGTCCACAGGAAGACC TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | 30 | XGKTGTSSPQ EDLHHCRLHT GELGRQRRF G* |
| 2339 | NM_0009 72.2_620 | 620 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG | 20 | XDLHHCRLHT GELGRQRRF G* |

TABLE 3B-continued

| SEQ ID | identifier_position | position | modified RNA | PAP length | PAP |
|---|---|---|---|---|---|
| | | | GTGGTGATTGCACACGACGTGGATCCCATCGAG CTGGTTGTCTTCTTGCCTGCCCTGTGTCGTAAAA TGGGGGTCCCTTACTGCATTATCAAGGGAAAGG CAAGACTGGGACGTCTAGTCCACAGGAANGACC TGCACCACTGTCGCCTTCACACAGGTGAACTCG GAAGACAAAGGCGCTTTGGCTAAGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | | |
| 2340 | NM_0009 72.2_680 | 680 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA TGGGGGTCCCTTACTGCATTATCAAGGGAAAGG CAAGACTGGGACGTCTAGTCCACAGGAAGACCT GCACCACTGTCGCCTTCACACAGGTGAACTCGG AAGACAAAGGCGCTTTGGCTAANGCTGGTGGAA GCTATCAGGACCAATTACAATGACAGATACGATG AGATCCGCCGTCACTGGGGTGGCAATGTCCTGG GTCCTAAGTCTGTGGCTCGTATCGCCAAGCTCG AAAAGGCAAAGGCTAAAGAACTTGCCACTAAACT GGGTTAAATGTACACTGTTGAGTTTTCTGTACAT AAAAATAATTGAAATAATACAAATTTTCCTTC | 11 | XAGGSYQDQ LQ* |
| 2341 | NM_0009 72.2_758 | 758 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA TGGGGGTCCCTTACTGCATTATCAAGGGAAAGG CAAGACTGGGACGTCTAGTCCACAGGAAGACCT GCACCACTGTCGCCTTCACACAGGTGAACTCGG AAGACAAAGGCGCTTTGGCTAAGCTGGTGGAAG CTATCAGGACCAATTACAATGACAGATACGATGA GATCCGCCGTCACTGGGGTGGCAATGTCCTGG GNTCCTAAGTCTGTGGCTCGTATCGCCAAGCTC GAAAAGGCAAAGGCTAAAGAACTTGCCACTAAA CTGGGTTAAATGTACACTGTTGAGTTTTCTGTAC ATAAAAATAATTGAAATAATACAAATTTTCCTTC | 1 | S* |
| 2342 | NM_0009 72.2_783 | 783 | TTTCCTTTCTCTCTCCTCCCGCCGCCCAAGATGC CGAAAGGAAAGAAGGCCAAGGGAAAGAAGGTG GCTCCGGCCCCAGCTGTCGTGAAGAAGCAGGA GGCTAAGAAAGTGGTGAATCCCCTGTTTGAGAA AAGGCCTAAGAATTTTGGCATTGGACAGGACAT CCAGCCCAAAAGAGACCTCACCCGCTTTGTGAA ATGGCCCCGCTATATCAGGTTGCAGCGGCAGAG AGCCATCCTCTATAAGCGGCTGAAAGTGCCTCC TGCGATTAACCAGTTCACCCAGGCCCTGGACCG CCAAACAGCTACTCAGCTGCTTAAGCTGGCCCA CAAGTACAGACCAGAGACAAAGCAAGAGAAGAA | 7 | XARKGKG* |

TABLE 3B-continued

| SEQ ID | identifier_ position | position | modified RNA | PAP length | PAP |
|---|---|---|---|---|---|
| | | | GCAGAGACTGTTGGCCCGGGCCGAGAAGAAGG CTGCTGGCAAAGGGGACGTCCCAACGAAGAGA CCACCTGTCCTTCGAGCAGGAGTTAACACCGTC ACCACCTTGGTGGAGAACAAGAAAGCTCAGCTG GTGGTGATTGCACACGACGTGGATCCCATCGAG CTGGTTGTCTTCTTGCCTGCCCTGTGTCGTAAAA TGGGGGTCCCTTACTGCATTATCAAGGGAAAGG CAAGACTGGGACGTCTAGTCCACAGGAAGACCT GCACCACTGTCGCCTTCACACAGGTGAACTCGG AAGACAAAGGCGCTTTGGCTAAGCTGGTGGAAG CTATCAGGACCAATTACAATGACAGATACGATGA GATCCGCCGTCACTGGGGTGGCAATGTCCTGG GTCCTAAGTCTGTGGCTCGTATCGCCNAAGCTC GAAAAGGCAAAGGCTAAAGAACTTGCCACTAAA CTGGGTTAAATGTACACTGTTGAGTTTTCTGTAC ATAAAAATAATTGAAATAATACAAATTTTCCTTC | | |
| 2343 | NM_0009 73.3_699 | 699 | AGATAAGGCCGCTCGCTGACGCCGTGTTTCCTC TTTCGGCCGCGCTGGTGAACAGGACCCGTCGC CATGGGCCGTGTGATCCGTGGACAGAGGAAGG GCGCCGGGTCTGTGTTCCGCGCGCACGTGAAG CACCGTAAAGGCGCTGCGCGCCTGCGCGCCGT GGATTTCGCTGAGCGGCACGGCTACATCAAGGG CATCGTCAAGGACATCATCCACGACCCGGGCCG CGGCGCGCCCCTCGCCAAGGTGGTCTTCCGGG ATCCGTATCGGTTTAAGAAGCGGACGGAGCTGT TCATTGCCGCCGAGGGCATTCACACGGGCCAGT TTGTGTATTGCGGCAAGAAGGCCCAGCTCAACA TTGGCAATGTGCTCCCTGTGGGCACCATGCCTG AGGGTACAATCGTGTGCTGCCTGGAGGAGAAGC CTGGAGACCGTGGCAAGCTGGCCCGGGCATCA GGGAACTATGCCACCGTTATCTCCCACAACCCT GAGACCAAGAAGACCCGTGTGAAGCTGCCCTCC GGCTCCAAGAAGGTTATCTCCTCAGCCAACAGA GCTGTGGTTGGTGTGGTGGCTGGAGGTGGCCG AATTGACAAACCCATCTTGAAGGCTGGCCGGGC GTACCACAAATATAAGGCAAAGAGGAACTGCTG GCCACGAGTACGGGGTGTGGCCATGAATCCTGT GGAGCATCCTTTTNGGAGGTGGCAACCACCAGC ACATCGGCAAGCCCTCCACCATCCGCAGAGATG CCCCTGCTGGCCGCAAAGTGGGTCTCATTGCTG CCCGCCGGACTGGACGTCTCCGGGGAACCAAG ACTGTGCAGGAGAAAGAGAACTAGTGCTGAGGG CCTCAATAAAGTTTGTGTTTATGCCAAAAAAAAA AAAAAAAAAAAAAAAAAAAAA | 67 | XRWQPPAHR QALHHPQRCP CWPQSGSHC CPPDWTSPG NQDCAGEREL VLRASIKFVFM PKKKKKKKKK |
| 2344 | NM_0009 73.3_755 | 755 | AGATAAGGCCGCTCGCTGACGCCGTGTTTCCTC TTTCGGCCGCGCTGGTGAACAGGACCCGTCGC CATGGGCCGTGTGATCCGTGGACAGAGGAAGG GCGCCGGGTCTGTGTTCCGCGCGCACGTGAAG CACCGTAAAGGCGCTGCGCGCCTGCGCGCCGT GGATTTCGCTGAGCGGCACGGCTACATCAAGGG CATCGTCAAGGACATCATCCACGACCCGGGCCG CGGCGCGCCCCTCGCCAAGGTGGTCTTCCGGG ATCCGTATCGGTTTAAGAAGCGGACGGAGCTGT TCATTGCCGCCGAGGGCATTCACACGGGCCAGT TTGTGTATTGCGGCAAGAAGGCCCAGCTCAACA TTGGCAATGTGCTCCCTGTGGGCACCATGCCTG AGGGTACAATCGTGTGCTGCCTGGAGGAGAAGC CTGGAGACCGTGGCAAGCTGGCCCGGGCATCA GGGAACTATGCCACCGTTATCTCCCACAACCCT GAGACCAAGAAGACCCGTGTGAAGCTGCCCTCC GGCTCCAAGAAGGTTATCTCCTCAGCCAACAGA GCTGTGGTTGGTGTGGTGGCTGGAGGTGGCCG AATTGACAAACCCATCTTGAAGGCTGGCCGGGC GTACCACAAATATAAGGCAAAGAGGAACTGCTG GCCACGAGTACGGGGTGTGGCCATGAATCCTGT GGAGCATCCTTTTGGAGGTGGCAACCACCAGCA CATCGGCAAGCCCTCCACCATCCGCAGAGATGC CCCNTGCTGGCCGCAAAGTGGGTCTCATTGCTG CCCGCCGGACTGGACGTCTCCGGGGAACCAAG ACTGTGCAGGAGAAAGAGAACTAGTGCTGAGGG CCTCAATAAAGTTTGTGTTTATGCCAAAAAAAAA AAAAAAAAAAAAAAAAAAAA | 48 | CWPQSGSHC CPPDWTSPG NQDCAGEREL VLRASIKFVFM PKKKKKKKKK |
| 2345 | NM_0009 73.3_773 | 773 | AGATAAGGCCGCTCGCTGACGCCGTGTTTCCTC TTTCGGCCGCGCTGGTGAACAGGACCCGTCGC CATGGGCCGTGTGATCCGTGGACAGAGGAAGG GCGCCGGGTCTGTGTTCCGCGCGCACGTGAAG CACCGTAAAGGCGCTGCGCGCCTGCGCGCCGT | 42 | SHCCPPDWT SPGNQDCAG ERELVLRASIK FVFMPKKKKK KKKK |

TABLE 3B-continued

| SEQ ID | identifier_position | position | modified RNA | PAP length | PAP |
|---|---|---|---|---|---|
| | | | GGATTTCGCTGAGCGGCACGGCTACATCAAGGG<br>CATCGTCAAGGACATCATCCACGACCCGGGCCG<br>CGGCGCGCCCCTCGCCAAGGTGGTCTTCCGGG<br>ATCCGTATCGGTTTAAGAAGCGGACGGAGCTGT<br>TCATTGCCGCCGAGGGCATTCACACGGGCCAGT<br>TTGTGTATTGCGGCAAGAAGGCCCAGCTCAACA<br>TTGGCAATGTGCTCCCTGTGGGCACCATGCCTG<br>AGGGTACAATCGTGTGCTGCCTGGAGGAGAAGC<br>CTGGAGACCGTGGCAAGCTGGCCCGGGCATCA<br>GGGAACTATGCCACCGTTATCTCCCACAACCCT<br>GAGACCAAGAAGACCCGTGTGAAGCTGCCCTCC<br>GGCTCCAAGAAGGTTATCTCCTCAGCCAACAGA<br>GCTGTGGTTGGTGTGGTGGCTGGAGGTGGCCG<br>AATTGACAAACCCATCTTGAAGGCTGGCCGGGC<br>GTACCACAAATATAAGGCAAAGAGGAACTGCTG<br>GCCACGAGTACGGGGTGTGGCCATGAATCCTGT<br>GGAGCATCCTTTTGGAGGTGGCAACCACCAGCA<br>CATCGGCAAGCCCTCCACCATCCGCAGAGATGC<br>CCCTGCTGGCCGCAAAGTGGGNTCTCATTGCTG<br>CCCGCCGGACTGGACGTCTCCGGGGAACCAAG<br>ACTGTGCAGGAGAAAGAGAACTAGTGCTGAGGG<br>CCTCAATAAAGTTTGTGTTTATGCCAAAAAAAAA<br>AAAAAAAAAAAAAAAAAAAA | | |
| 2346 | NM_0009<br>73.3_787 | 787 | AGATAAGGCCGCTCGCTGACGCCGTGTTTCCTC<br>TTTCGGCCGCGCTGGTGAACAGGACCCGTCGC<br>CATGGGCCGTGTGATCCGTGGACAGAGGAAGG<br>GCGCCGGGTCTGTGTTCCGCGCGCACGTGAAG<br>CACCGTAAAGGCGCTGCGCGCCTGCGCGCCGT<br>GGATTTCGCTGAGCGGCACGGCTACATCAAGGG<br>CATCGTCAAGGACATCATCCACGACCCGGGCCG<br>CGGCGCGCCCCTCGCCAAGGTGGTCTTCCGGG<br>ATCCGTATCGGTTTAAGAAGCGGACGGAGCTGT<br>TCATTGCCGCCGAGGGCATTCACACGGGCCAGT<br>TTGTGTATTGCGGCAAGAAGGCCCAGCTCAACA<br>TTGGCAATGTGCTCCCTGTGGGCACCATGCCTG<br>AGGGTACAATCGTGTGCTGCCTGGAGGAGAAGC<br>CTGGAGACCGTGGCAAGCTGGCCCGGGCATCA<br>GGGAACTATGCCACCGTTATCTCCCACAACCCT<br>GAGACCAAGAAGACCCGTGTGAAGCTGCCCTCC<br>GGCTCCAAGAAGGTTATCTCCTCAGCCAACAGA<br>GCTGTGGTTGGTGTGGTGGCTGGAGGTGGCCG<br>AATTGACAAACCCATCTTGAAGGCTGGCCGGGC<br>GTACCACAAATATAAGGCAAAGAGGAACTGCTG<br>GCCACGAGTACGGGGTGTGGCCATGAATCCTGT<br>GGAGCATCCTTTTGGAGGTGGCAACCACCAGCA<br>CATCGGCAAGCCCTCCACCATCCGCAGAGATGC<br>CCCTGCTGGCCGCAAAGTGGGTCTCATTGCTGC<br>CCNGCCGGACTGGACGTCTCCGGGGAACCAAG<br>ACTGTGCAGGAGAAAGAGAACTAGTGCTGAGGG<br>CCTCAATAAAGTTTGTGTTTATGCCAAAAAAAAA<br>AAAAAAAAAAAAAAAAAAAA | 38 | XPDWTSPGN<br>QDCAGERELV<br>LRASIKFVFMP<br>KKKKKKKKK |
| 2347 | NM_0009<br>73.3_809 | 809 | AGATAAGGCCGCTCGCTGACGCCGTGTTTCCTC<br>TTTCGGCCGCGCTGGTGAACAGGACCCGTCGC<br>CATGGGCCGTGTGATCCGTGGACAGAGGAAGG<br>GCGCCGGGTCTGTGTTCCGCGCGCACGTGAAG<br>CACCGTAAAGGCGCTGCGCGCCTGCGCGCCGT<br>GGATTTCGCTGAGCGGCACGGCTACATCAAGGG<br>CATCGTCAAGGACATCATCCACGACCCGGGCCG<br>CGGCGCGCCCCTCGCCAAGGTGGTCTTCCGGG<br>ATCCGTATCGGTTTAAGAAGCGGACGGAGCTGT<br>TCATTGCCGCCGAGGGCATTCACACGGGCCAGT<br>TTGTGTATTGCGGCAAGAAGGCCCAGCTCAACA<br>TTGGCAATGTGCTCCCTGTGGGCACCATGCCTG<br>AGGGTACAATCGTGTGCTGCCTGGAGGAGAAGC<br>CTGGAGACCGTGGCAAGCTGGCCCGGGCATCA<br>GGGAACTATGCCACCGTTATCTCCCACAACCCT<br>GAGACCAAGAAGACCCGTGTGAAGCTGCCCTCC<br>GGCTCCAAGAAGGTTATCTCCTCAGCCAACAGA<br>GCTGTGGTTGGTGTGGTGGCTGGAGGTGGCCG<br>AATTGACAAACCCATCTTGAAGGCTGGCCGGGC<br>GTACCACAAATATAAGGCAAAGAGGAACTGCTG<br>GCCACGAGTACGGGGTGTGGCCATGAATCCTGT<br>GGAGCATCCTTTTGGAGGTGGCAACCACCAGCA<br>CATCGGCAAGCCCTCCACCATCCGCAGAGATGC<br>CCCTGCTGGCCGCAAAGTGGGTCTCATTGCTGC<br>CCGCCGGACTGGACGTCTCCGGGGNAACCAAG<br>ACTGTGCAGGAGAAAGAGAACTAGTGCTGAGGG | 30 | NQDCAGEREL<br>VLRASIKFVFM<br>PKKKKKKKKK |

TABLE 3B-continued

| SEQ ID | identifier_ position | position | modified RNA | PAP length | PAP |
|---|---|---|---|---|---|
| 2348 | NM_0009 77.2_217 | 217 | CCTCAATAAAGTTTGTGTTTATGCCAAAAAAAAA AAAAAAAAAAAAAAAAAAAA CTTTCCGCTCGGCTGTTTTCCTGCGCAGGAGCC GCAGGGCCGTAGGCAGCCATGGCGCCCAGCCG GAATGGCATGGTCTTGAAGCCCCACTTCCACAA GGACTGGCAGCGGCGCGTGGCCACGTGGTTCA ACCAGCCGGCCCGTAAGATCCGCAGACGTAAG GCCCGGCAAGCCAAGGCGCGCCGCATCGCCCC GCGCCCCGCGTCGGGTCCCATCCNGGCCCATC GTGCGCTGCCCCACGGTTCGGTACCACACGAA GGTGCGCGCCGGCCGCGGCTTCAGCCTGGAGG AGCTCAGGGTGGCCGGCATTCACAAGAAGGTG GCCCGGACCATCGGCATTTCTGTGGATCCGAGG AGGCGGAACAAGTCCACGGAGTCCCTGCAGGC CAACGTGCAGCGGCTGAAGGAGTACCGCTCCAA ACTCATCCTCTTCCCCAGGAAGCCCTCGGCCCC CAAGAAGGGAGACAGTTCTGCTGAAGAACTGAA ACTGGCCACCCAGCTGACCGGACCGGTCATGC CCGTCCGGAACGTCTATAAGAAGGAGAAAGCTC GAGTCATCACTGAGGAAGAGAAGAATTTCAAAG CCTTCGCTAGTCTCCGTATGGCCCGTGCCAACG CCCGGCTCTTCGGCATACGGGCAAAAAGAGCCA AGGAAGCCGCAGAACAGGATGTTGAAAAGAAAA AATAAAGCCCTCCTGGGGACTTGGAATCAGTCG GCAGTCATGCTGGGTCTCCACGTGGTGTGTTTC GTGGGAACAACTGGGCCTGGGATGGGGCTTCA CTGCTGTGACTTCCTCCTGCCAGGGGATTTGGG GCTTTCTTGAAAGACAGTCCAAGCCCTGGATAAT GCTTTACTTTCTGTGTTGAAGCACTGTTGGTTGT TTGGTTAGTGACTGATGTAAAACGGTTTTCTTGT GGGGAGGTTACAGAGGCTGACTTCAGAGTGGA CTTGTGTTTTTTCTTTTTAAAGAGGCAAGGTTGG GCTGGTGCTCACAGCTGTAATCCCAGCACTTTG AGGTTGGCT | 86 | XAHRALPHGS VPHEGARRPR LQPGGAQGG RHSQEGGPD HRHFCGSEEA EQVHGVPAG QRAAAEGVPL QTHPLPQEAL GPQEGRQFC* |
| 2349 | NM_0009 77.2_472 | 472 | CTTTCCGCTCGGCTGTTTTCCTGCGCAGGAGCC GCAGGGCCGTAGGCAGCCATGGCGCCCAGCCG GAATGGCATGGTCTTGAAGCCCCACTTCCACAA GGACTGGCAGCGGCGCGTGGCCACGTGGTTCA ACCAGCCGGCCCGTAAGATCCGCAGACGTAAG GCCCGGCAAGCCAAGGCGCGCCGCATCGCCCC GCGCCCCGCGTCGGGTCCCATCCGGCCCATCG TGCGCTGCCCCACGGTTCGGTACCACACGAAG GTGCGCGCCGGCCGCGGCTTCAGCCTGGAGGA GCTCAGGGTGGCCGGCATTCACAAGAAGGTGG CCCGGACCATCGGCATTTCTGTGGATCCGAGGA GGCGGAACAAGTCCACGGAGTCCCTGCAGGCC AACGTGCAGCGGCTGAAGGAGTACCGCTCCAAA CTCATCCTCTTCCCCAGGAAGCCCTCGGCCCCC AAGAAGGGAGACAGTTCTGNCTGAAGAACTGAA ACTGGCCACCCAGCTGACCGGACCGGTCATGC CCGTCCGGAACGTCTATAAGAAGGAGAAAGCTC GAGTCATCACTGAGGAAGAGAAGAATTTCAAAG CCTTCGCTAGTCTCCGTATGGCCCGTGCCAACG CCCGGCTCTTCGGCATACGGGCAAAAAGAGCCA AGGAAGCCGCAGAACAGGATGTTGAAAAGAAAA AATAAAGCCCTCCTGGGGACTTGGAATCAGTCG GCAGTCATGCTGGGTCTCCACGTGGTGTGTTTC GTGGGAACAACTGGGCCTGGGATGGGGCTTCA CTGCTGTGACTTCCTCCTGCCAGGGGATTTGGG GCTTTCTTGAAAGACAGTCCAAGCCCTGGATAAT GCTTTACTTTCTGTGTTGAAGCACTGTTGGTTGT TTGGTTAGTGACTGATGTAAAACGGTTTTCTTGT GGGGAGGTTACAGAGGCTGACTTCAGAGTGGA CTTGTGTTTTTTCTTTTTAAAGAGGCAAGGTTGG GCTGGTGCTCACAGCTGTAATCCCAGCACTTTG AGGTTGGCT | 1 | X* |
| 2350 | NM_0009 77.2_490 | 490 | CTTTCCGCTCGGCTGTTTTCCTGCGCAGGAGCC GCAGGGCCGTAGGCAGCCATGGCGCCCAGCCG GAATGGCATGGTCTTGAAGCCCCACTTCCACAA GGACTGGCAGCGGCGCGTGGCCACGTGGTTCA ACCAGCCGGCCCGTAAGATCCGCAGACGTAAG GCCCGGCAAGCCAAGGCGCGCCGCATCGCCCC GCGCCCCGCGTCGGGTCCCATCCGGCCCATCG TGCGCTGCCCCACGGTTCGGTACCACACGAAG GTGCGCGCCGGCCGCGGCTTCAGCCTGGAGGA GCTCAGGGTGGCCGGCATTCACAAGAAGGTGG CCCGGACCATCGGCATTTCTGTGGATCCGAGGA | 15 | XHPADRTGHA RPERL* |

TABLE 3B-continued

| SEQ ID | identifier_position | position | modified RNA | PAP length | PAP |
|---|---|---|---|---|---|
| | | | GGCGGAACAAGTCCACGGAGTCCCTGCAGGCC<br>AACGTGCAGCGGCTGAAGGAGTACCGCTCCAAA<br>CTCATCCTCTTCCCCAGGAAGCCCTCGGCCCCC<br>AAGAAGGGAGACAGTTCTGCTGAAGAACTGAAA<br>CTGGNCCACCCAGCTGACCGGACCGGTCATGC<br>CCGTCCGGAACGTCTATAAGAAGGAGAAAGCTC<br>GAGTCATCACTGAGGAAGAGAAGAATTTCAAAG<br>CCTTCGCTAGTCTCCGTATGGCCCGTGCCAACG<br>CCCGGCTCTTCGGCATACGGGCAAAAAGAGCCA<br>AGGAAGCCGCAGAACAGGATGTTGAAAAGAAAA<br>AATAAAGCCCTCCTGGGGACTTGGAATCAGTCG<br>GCAGTCATGCTGGGTCTCCACGTGGTGTGTTTC<br>GTGGGAACAACTGGGCCTGGGATGGGGCTTCA<br>CTGCTGTGACTTCCTCCTGCCAGGGGATTTGGG<br>GCTTTCTTGAAAGACAGTCCAAGCCCTGGATAAT<br>GCTTTACTTTCTGTGTTGAAGCACTGTTGGTTGT<br>TTGGTTAGTGACTGATGTAAAACGGTTTTCTTGT<br>GGGGAGGTTACAGAGGCTGACTTCAGAGTGGA<br>CTTGTGTTTTTTCTTTTTAAAGAGGCAAGGTTGG<br>GCTGGTGCTCACAGCTGTAATCCCAGCACTTTG<br>AGGTTGGCT | | |
| 2351 | NM_0009<br>77.2_643 | 643 | CTTTCCGCTCGGCTGTTTTCCTGCGCAGGAGCC<br>GCAGGGCCGTAGGCAGCCATGGCGCCCAGCCG<br>GAATGGCATGGTCTTGAAGCCCCACTTCCACAA<br>GGACTGGCAGCGGCGCGTGGCCACGTGGTTCA<br>ACCAGCCGGCCCGTAAGATCCGCAGACGTAAG<br>GCCCGGCAAGCCAAGGCGCGCCGCATCGCCCC<br>GCGCCCCGCGTCGGGTCCCATCCGGCCCATCG<br>TGCGCTGCCCCACGGTTCGGTACCACACGAAG<br>GTGCGCGCCGGCCGCGGCTTCAGCCTGGAGGA<br>GCTCAGGGTGGCCGGCATTCACAAGAAGGTGG<br>CCCCGGACCATCGGCATTTCTGTGGATCCGAGGA<br>GGCGGAACAAGTCCACGGAGTCCCTGCAGGCC<br>AACGTGCAGCGGCTGAAGGAGTACCGCTCCAAA<br>CTCATCCTCTTCCCCAGGAAGCCCTCGGCCCCC<br>AAGAAGGGAGACAGTTCTGCTGAAGAACTGAAA<br>CTGGCCACCCAGCTGACCGGACCGGTCATGCC<br>CGTCCGGAACGTCTATAAGAAGGAGAAAGCTCG<br>AGTCATCACTGAGGAAGAGAAGAATTTCAAAGC<br>CTTCGCTAGTCTCCGTATGGCCCGTGCCAACGC<br>CCGGCTCTTCGGCATACGGGCAAAAANGAGCCA<br>AGGAAGCCGCAGAACAGGATGTTGAAAAGAAAA<br>AATAAAGCCCTCCTGGGGACTTGGAATCAGTCG<br>GCAGTCATGCTGGGTCTCCACGTGGTGTGTTTC<br>GTGGGAACAACTGGGCCTGGGATGGGGCTTCA<br>CTGCTGTGACTTCCTCCTGCCAGGGGATTTGGG<br>GCTTTCTTGAAAGACAGTCCAAGCCCTGGATAAT<br>GCTTTACTTTCTGTGTTGAAGCACTGTTGGTTGT<br>TTGGTTAGTGACTGATGTAAAACGGTTTTCTTGT<br>GGGGAGGTTACAGAGGCTGACTTCAGAGTGGA<br>CTTGTGTTTTTTCTTTTTAAAGAGGCAAGGTTGG<br>GCTGGTGCTCACAGCTGTAATCCCAGCACTTTG<br>AGGTTGGCT | 10 | XSQGSRRTG<br>C* |
| 2352 | NM_0009<br>77.2_98 | 98 | CTTTCCGCTCGGCTGTTTTCCTGCGCAGGAGCC<br>GCAGGGCCGTAGGCAGCCATGGCGCCCAGCCG<br>GAATGGCATGGTCTTGAAGCCCCACTTCCACAA<br>NGGACTGGCAGCGGCGCGTGGCCACGTGGTTC<br>AACCAGCCGGCCCGTAAGATCCGCAGACGTAAG<br>GCCCGGCAAGCCAAGGCGCGCCGCATCGCCCC<br>GCGCCCCGCGTCGGGTCCCATCCGGCCCATCG<br>TGCGCTGCCCCACGGTTCGGTACCACACGAAG<br>GTGCGCGCCGGCCGCGGCTTCAGCCTGGAGGA<br>GCTCAGGGTGGCCGGCATTCACAAGAAGGTGG<br>CCCCGGACCATCGGCATTTCTGTGGATCCGAGGA<br>GGCGGAACAAGTCCACGGAGTCCCTGCAGGCC<br>AACGTGCAGCGGCTGAAGGAGTACCGCTCCAAA<br>CTCATCCTCTTCCCCAGGAAGCCCTCGGCCCCC<br>AAGAAGGGAGACAGTTCTGCTGAAGAACTGAAA<br>CTGGCCACCCAGCTGACCGGACCGGTCATGCC<br>CGTCCGGAACGTCTATAAGAAGGAGAAAGCTCG<br>AGTCATCACTGAGGAAGAGAAGAATTTCAAAGC<br>CTTCGCTAGTCTCCGTATGGCCCGTGCCAACGC<br>CCGGCTCTTCGGCATACGGGCAAAAAGAGCCAA<br>GGAAGCCGCAGAACAGGATGTTGAAAAGAAAA<br>ATAAAGCCCTCCTGGGGACTTGGAATCAGTCGG<br>CAGTCATGCTGGGTCTCCACGTGGTGTGTTTCG<br>TGGGAACAACTGGGCCTGGGATGGGGCTTCACT | 16 | XGLAAARGHV<br>VQPAGP* |

TABLE 3B-continued

| SEQ ID | identifier_position | position | modified RNA | PAP length | PAP |
|---|---|---|---|---|---|
| | | | GCTGTGACTTCCTCCTGCCAGGGGATTTGGGGC<br>TTTCTTGAAAGACAGTCCAAGCCCTGGATAATGC<br>TTTACTTTCTGTGTTGAAGCACTGTTGGTTGTTT<br>GGTTAGTGACTGATGTAAAACGGTTTTCTTGTGG<br>GGAGGTTACAGAGGCTGACTTCAGAGTGGACTT<br>GTGTTTTTTCTTTTTAAAGAGGCAAGGTTGGGCT<br>GGTGCTCACAGCTGTAATCCCAGCACTTTGAGG<br>TTGGCT | | |
| 2353 | NM_0009<br>81.3_564 | 564 | GCAGATAATGGGAGGAGCCGGGCCCGAGCGAG<br>CTCTTTCCTTTCGCTGCTGCGGCCGCAGCCATG<br>AGTATGCTCAGGCTTCAGAAGAGGCTCGCCTCT<br>AGTGTCCTCCGCTGTGGCAAGAAGAAGGTCTGG<br>TTAGACCCCAATGAGACCAATGAAATCGCCAAT<br>GCCAACTCCCGTCAGCAGATCCGGAAGCTCATC<br>AAAGATGGGCTGATCATCCGCAAGCCTGTGACG<br>GTCCATTCCCGGGCTCGATGCCGGAAAAACACC<br>TTGGCCCGCCGGAAGGGCAGGCACATGGGCAT<br>AGGTAAGCGGAAGGGTACAGCCAATGCCCGAAT<br>GCCAGAGAAGGTCACATGGATGAGGAGAATGAG<br>GATTTTGCGCCGGCTGCTCAGAAGATACCGTGA<br>ATCTAAGAAGATCGATCGCCACATGTATCACAGC<br>CTGTACCTGAAGGTGAAGGGGAATGTGTTCAAA<br>AACAAGCGGATTCTCATGGAACACATCCACAAG<br>CTGAAGGCAGACAAGGCCCGCAAGAAGCTCCT<br>GGCTGACCAGGCTGAGGCCCGCAGGTCTAAGA<br>CCAAGGNAAGCACGCAAGCGCCGTGAAGAGCG<br>CCTCCAGGCCAAGAAGGAGGAGATCATCAAGAC<br>TTTATCCAAGGAGGAAGAGACCAAGAAATAAAAC<br>CTCCCACTTTGTCTGTACATACTGGCCTCTGTGA<br>TTACATAGATCAGCCATTAAAATAAAACAAGCCT<br>TAATCTGCAAAAAAAAAAAAAAAA | 6 | XSTQAP* |
| 2354 | NM_0010<br>01937.1_<br>1494 | 1494 | TCTGGCATTGCAAGCCTCGCTTCGTTGCCACTT<br>CCCAGCTCTTCCCGCCTTCCGCGGTATAATCAA<br>CACTACGAGAGATAGAGCCGCCTAGAACCAGTC<br>CGGAGGCTGCGGCTGCAGAAGTACCGCCTGCG<br>GAGTAACTGCAAAGATGCTGTCCGTGCGCGTTG<br>CTGCGGCCGTGGTCCGCGCCCTTCCTCGGCGG<br>GCCGGACTGGTCTCCAGAAATGCTTTGGGTTCA<br>TCTTTCATTGCTGCAAGGAACTTCCATGCCTCTA<br>ACACTCATCTTCAAAAGACTGGGACTGCTGAGAT<br>GTCCTCTATTCTTGAAGAGCGTATTCTTGGAGCT<br>GATACCTCTGTTGATCTTGAAGAAACTGGGCGT<br>GTCTTAAGTATTGGTGATGGTATTGCCCGCGTAC<br>ATGGGCTGAGGAATGTTCAAGCAGAAGAAATGG<br>TAGAGTTTTCTTCAGGCTTAAAGGGTATGTCCTT<br>GAACTTGGAACCTGACAATGTTGGTGTTGTCGT<br>GTTTGGAAATGATAAACTAATTAAGGAAGGAGAT<br>ATAGTGAAGAGGACAGGAGCCATTGTGGACGTT<br>CCAGTTGGTGAGGAGCTGTTGGGTCGTGTAGTT<br>GATGCCCTTGGTAATGCTATTGATGGAAAGGGT<br>CCAATTGGTTCCAAGACGCGTAGGCGAGTTGGT<br>CTGAAAGCCCCCGGTATCATTCCTCGAATTTCAG<br>TGCGGGAACCAATGCAGACTGGCATTAAGGCTG<br>TGGATAGCTTGGTGCCAATTGGTCGTGGTCAGC<br>GTGAACTGATTATTGGTGACCGACAGACTGGGA<br>AAACCTCAATTGCTATTGACACAATCATTAACCA<br>GAAACGTTTCAATGATGGATCTGATGAAAAGAAG<br>AAGCTGTACTGTATTTATGTTGCTATTGGTCAAA<br>AGAGATCCACTGTTGCCCAGTTGGTGAAGAGAC<br>TTACAGATGCAGATGCCATGAAGTACACCATTGT<br>GGTGTCGGCTACGGCCTCGGATGCTGCCCCAC<br>TTCAGTACCTGGCTCCTTACTCTGGC | 1 | F* |
| 2355 | NM_0010<br>01937.1_<br>356 | 356 | TCTGGCATTGCAAGCCTCGCTTCGTTGCCACTT<br>CCCAGCTCTTCCCGCCTTCCGCGGTATAATCAA<br>CACTACGAGAGATAGAGCCGCCTAGAACCAGTC<br>CGGAGGCTGCGGCTGCAGAAGTACCGCCTGCG<br>GAGTAACTGCAAAGATGCTGTCCGTGCGCGTTG<br>CTGCGGCCGTGGTCCGCGCCCTTCCTCGGCGG<br>GCCGGACTGGTCTCCAGAAATGCTTTGGGTTCA<br>TCTTTCATTGCTGCAAGGAACTTCCATGCCTCTA<br>ACACTCATCTTCAAAAGACTGGGACTGCTGAGAT<br>GTCCTCTATTCTTGAAGAGCGTATTCTTGGAGCT<br>GATACCTCTGTTGATCTTGAAGAAANCTGGGCG<br>TGTCTTAAGTATTGGTGATGGTATTGCCCGCGTA<br>CATGGGCTGAGGAATGTTCAAGCAGAAGAAATG<br>GTAGAGTTTTCTTCAGGCTTAAAGGGTATGTCCT<br>TGAACTTGGAACCTGACAATGTTGGTGTTGTCGT | 8 | XWACLKYW* |

TABLE 3B-continued

| SEQ ID | identifier_position | position | modified RNA | PAP length | PAP |
|---|---|---|---|---|---|
| | | | GTTTGGAAATGATAAACTAATTAAGGAAGGAGAT<br>ATAGTGAAGAGGACAGGAGCCATTGTGGACGTT<br>CCAGTTGGTGAGGAGCTGTTGGGTCGTGTAGTT<br>GATGCCCTTGGTAATGCTATTGATGGAAAGGGT<br>CCAATTGGTTCCAAGACGCGTAGGCGAGTTGGT<br>CTGAAAGCCCCCGGTATCATTCCTCGAATTTCAG<br>TGCGGGAACCAATGCAGACTGGCATTAAGGCTG<br>TGGATAGCTTGGTGCCAATTGGTCGTGGTCAGC<br>GTGAACTGATTATTGGTGACCGACAGACTGGGA<br>AAACCTCAATTGCTATTGACACAATCATTAACCA<br>GAAACGTTTCAATGATGGATCTGATGAAAAGAAG<br>AAGCTGTACTGTATTTATGTTGCTATTGGTCAAA<br>AGAGATCCACTGTTGCCCAGTTGGTGAAGAGAC<br>TTACAGATGCAGATGCCATGAAGTACACCATTGT<br>GGTGTCGGCTACGGCCTCGGATGCTGCCCCAC<br>TTCAGTACCTGGCTCCTTACTCTGG | | |
| 2356 | NM_0010<br>01937.1_<br>751 | 751 | TCTGGCATTGCAAGCCTCGCTTCGTTGCCACTT<br>CCCAGCTCTTCCCGCCTTCCGCGGTATAATCAA<br>CACTACGAGAGATAGAGCCGCCTAGAACCAGTC<br>CGGAGGCTGCGGCTGCAGAAGTACCGCCTGCG<br>GAGTAACTGCAAAGATGCTGTCCGTGCGCGTTG<br>CTGCGGCCGTGGTCCGCGCCCTTCCTCGGCGG<br>GCCGGACTGGTCTCCAGAAATGCTTTGGGTTCA<br>TCTTTCATTGCTGCAAGGAACTTCCATGCCTCTA<br>ACACTCATCTTCAAAAGACTGGGACTGCTGAGAT<br>GTCCTCTATTCTTGAAGAGCGTATTCTTGGAGCT<br>GATACCTCTGTTGATCTTGAAGAAACTGGGCGT<br>GTCTTAAGTATTGGTGATGGTATTGCCCGCGTAC<br>ATGGGCTGAGGAATGTTCAAGCAGAAGAAATGG<br>TAGAGTTTTCTTCAGGCTTAAAGGGTATGTCCTT<br>GAACTTGGAACCTGACAATGTTGGTGTTGTCGT<br>GTTTGGAAATGATAAACTAATTAAGGAAGGAGAT<br>ATAGTGAAGAGGACAGGAGCCATTGTGGACGTT<br>CCAGTTGGTGAGGAGCTGTTGGGTCGTGTAGTT<br>GATGCCCTTGGTAATGCTATTGATGGAAAGGGT<br>CCAATTGGTTCCAAGACGCGTAGGCGAGTTGGT<br>CTGAAAGCCCCCGGTATCATTCCTCGAATTTCAG<br>TGCGGGAACCAATGCAGACTGGCATTAAGGCTG<br>TGGATAGCTTGGTGCCAATTNGGTCGTGGTCAG<br>CGTGAACTGATTATTGGTGACCGACAGACTGGG<br>AAAACCTCAATTGCTATTGACACAATCATTAACC<br>AGAAACGTTTCAATGATGGATCTGATGAAAAGAA<br>GAAGCTGTATCTGTATTTATGTTGCTATTGGTCAA<br>AAGAGATCCACTGTTGCCCAGTTGGTGAAGAGA<br>CTTACAGATGCAGATGCCATGAAGTACACCATTG<br>TGGTGTCGGCTACGGCCTCGGATGCTGCCCCA<br>CTTCAGTACCTGGCTCCTTACTCTGG | 5 | XSWSA* |
| 2357 | NM_0010<br>01937.1_<br>772 | 772 | TCTGGCATTGCAAGCCTCGCTTCGTTGCCACTT<br>CCCAGCTCTTCCCGCCTTCCGCGGTATAATCAA<br>CACTACGAGAGATAGAGCCGCCTAGAACCAGTC<br>CGGAGGCTGCGGCTGCAGAAGTACCGCCTGCG<br>GAGTAACTGCAAAGATGCTGTCCGTGCGCGTTG<br>CTGCGGCCGTGGTCCGCGCCCTTCCTCGGCGG<br>GCCGGACTGGTCTCCAGAAATGCTTTGGGTTCA<br>TCTTTCATTGCTGCAAGGAACTTCCATGCCTCTA<br>ACACTCATCTTCAAAAGACTGGGACTGCTGAGAT<br>GTCCTCTATTCTTGAAGAGCGTATTCTTGGAGCT<br>GATACCTCTGTTGATCTTGAAGAAACTGGGCGT<br>GTCTTAAGTATTGGTGATGGTATTGCCCGCGTAC<br>ATGGGCTGAGGAATGTTCAAGCAGAAGAAATGG<br>TAGAGTTTTCTTCAGGCTTAAAGGGTATGTCCTT<br>GAACTTGGAACCTGACAATGTTGGTGTTGTCGT<br>GTTTGGAAATGATAAACTAATTAAGGAAGGAGAT<br>ATAGTGAAGAGGACAGGAGCCATTGTGGACGTT<br>CCAGTTGGTGAGGAGCTGTTGGGTCGTGTAGTT<br>GATGCCCTTGGTAATGCTATTGATGGAAAGGGT<br>CCAATTGGTTCCAAGACGCGTAGGCGAGTTGGT<br>CTGAAAGCCCCCGGTATCATTCCTCGAATTTCAG<br>TGCGGGAACCAATGCAGACTGGCATTAAGGCTG<br>TGGATAGCTTGGTGCCAATTGGTCGTGGTCAGC<br>GTGAACTGNATTATTGGTGACCGACAGACTGGG<br>AAAACCTCAATTGCTATTGACACAATCATTAACC<br>AGAAACGTTTCAATGATGGATCTGATGAAAAGAA<br>GAAGCTGTACTGTATTTATGTTGCTATTGGTCAA<br>AAGAGATCCACTGTTGCCCAGTTGGTGAAGAGA<br>CTTACAGATGCAGATGCCATGAAGTACACCATTG | 3 | XYW* |

TABLE 3B-continued

| SEQ ID | identifier_ position | position | modified RNA | PAP length | PAP |
|---|---|---|---|---|---|
| 2358 | NM_0010 01937.1_ 861 | 861 | TGGTGTCGGCTACGGCCTCGGATGCTGCCCCA CTTCAGTACCTGGCTCCTTACTCTGG TCTGGCATTGCAAGCCTCGCTTCGTTGCCACTT CCCAGCTCTTCCCGCCTTCCGCGGTATAATCAA CACTACGAGAGATAGAGCCGCCTAGAACCAGTC CGGAGGCTGCGGCTGCAGAAGTACCGCCTGCG GAGTAACTGCAAAGATGCTGTCCGTGCGCGTTG CTGCGGCCGTGGTCCGCGCCCTTCCTCGGCGG GCCGGACTGGTCTCCAGAAATGCTTTGGGTTCA TCTTTCATTGCTGCAAGGAACTTCCATGCCTCTA ACACTCATCTTCAAAAGACTGGGACTGCTGAGAT GTCCTCTATTCTTGAAGAGCGTATTCTTGGAGCT GATACCTCTGTTGATCTTGAAGAAACTGGGCGT GTCTTAAGTATTGGTGATGGTATTGCCCGCGTAC ATGGGCTGAGGAATGTTCAAGCAGAAGAAATGG TAGAGTTTTCTTCAGGCTTAAAGGGTATGTCCTT GAACTTGGAACCTGACAATGTTGGTGTTGTCGT GTTTGGAAATGATAAACTAATTAAGGAAGGAGAT ATAGTGAAGAGGACAGGAGCCATTGTGGACGTT CCAGTTGGTGAGGAGCTGTTGGGTCGTGTAGTT GATGCCCTTGGTAATGCTATTGATGGAAAGGGT CCAATTGGTTCCAAGACGCGTAGGCGAGTTGGT CTGAAAGCCCCCGGTATCATTCCTCGAATTTCAG TGCGGGAACCAATGCAGACTGGCATTAAGGCTG TGGATAGCTTGGTGCCAATTGGTCGTGGTCAGC GTGAACTGATTATTGGTGACCGACAGACTGGGA AAACCTCAATTGCTATTGACACAATCATTAACCA GAAACGTTTCAATGATGGATCTGATGAAAANGAA GAAGCTGTACTGTATTTATGTTGCTATTGGTCAA AAGAGATCCACTGTTGCCCAGTTGGTGAAGAGA CTTACAGATGCAGATGCCATGAAGTACACCATTG TGGTGTCGGCTACGGCCTCGGATGCTGCCCCA CTTCAGTACCTGGCTCCTTACTCTGG | 62 | XEEAVLYLCC YWSKEIHCCP VGEETYRCRC HEVHHCGVG YGLGCCPTSV PGSLLWLFHG RVF* |
| 2359 | NM_0010 01937.1_ 894 | 894 | TCTGGCATTGCAAGCCTCGCTTCGTTGCCACTT CCCAGCTCTTCCCGCCTTCCGCGGTATAATCAA CACTACGAGAGATAGAGCCGCCTAGAACCAGTC CGGAGGCTGCGGCTGCAGAAGTACCGCCTGCG GAGTAACTGCAAAGATGCTGTCCGTGCGCGTTG CTGCGGCCGTGGTCCGCGCCCTTCCTCGGCGG GCCGGACTGGTCTCCAGAAATGCTTTGGGTTCA TCTTTCATTGCTGCAAGGAACTTCCATGCCTCTA ACACTCATCTTCAAAAGACTGGGACTGCTGAGAT GTCCTCTATTCTTGAAGAGCGTATTCTTGGAGCT GATACCTCTGTTGATCTTGAAGAAACTGGGCGT GTCTTAAGTATTGGTGATGGTATTGCCCGCGTAC ATGGGCTGAGGAATGTTCAAGCAGAAGAAATGG TAGAGTTTTCTTCAGGCTTAAAGGGTATGTCCTT GAACTTGGAACCTGACAATGTTGGTGTTGTCGT GTTTGGAAATGATAAACTAATTAAGGAAGGAGAT ATAGTGAAGAGGACAGGAGCCATTGTGGACGTT CCAGTTGGTGAGGAGCTGTTGGGTCGTGTAGTT GATGCCCTTGGTAATGCTATTGATGGAAAGGGT CCAATTGGTTCCAAGACGCGTAGGCGAGTTGGT CTGAAAGCCCCCGGTATCATTCCTCGAATTTCAG TGCGGGAACCAATGCAGACTGGCATTAAGGCTG TGGATAGCTTGGTGCCAATTGGTCGTGGTCAGC GTGAACTGATTATTGGTGACCGACAGACTGGGA AAACCTCAATTGCTATTGACACAATCATTAACCA GAAACGTTTCAATGATGGATCTGATGAAAAGAAG AAGCTGTACTGTATTTATGTTGCTATTGGNTCAA AAGAGATCCACTGTTGCCCAGTTGGTGAAGAGA CTTACAGATGCAGATGCCATGAAGTACACCATTG TGGTGTCGGCTACGGCCTCGGATGCTGCCCCA CTTCAGTACCTGGCTCCTTACTCTGG | 50 | SKEIHCCPVG EETYRCRCHE VHHCGVGYG LGCCPTSVPG SLLWLFHGRV F* |
| 2360 | NM_0010 01973.1_ 407 | 407 | GGGAGGGGCGCGCTGGGGAGCTTCGGCGCAT GCGCGCTGAGGCCTGCCTGACCGACCTTCAGC AGGGCTGTGGCTACCATGTTCTCTCGCGCGGGT GTCGCTGGGCTGTCGGCCTGGACCTTGCAGCC GCAATGGATTCAAGTTCGAAATATGGCAACTTTG AAAGATATCACCAGGAGACTAAAGTCCATCAAAA ACATCCAGAAAATTACCAAGTCTATGAAAATGGT AGCGGCAGCAAAATGCCCGAGCTGAGAGAGA GCTGAAACCAGCTCGAATATATGGATTGGGATC TTTAGCTCTGTATGAAAAAGCTGATATCAAGGGG CCTGAAGACAAGAAGAAACACCTCCTTATTGGT GTGTCCTCAGATCGAGGACTGTGTGGTGCTATT CATTCCTCCATNTGCTAAACAGATGAAAAGCGAG | 2 | XC* |

TABLE 3B-continued

| SEQ ID | identifier_position | position | modified RNA | PAP length | PAP |
|---|---|---|---|---|---|
| | | | GTTGCTACACTAACAGCAGCTGGGAAAGAAGTT ATGCTTGTTGGAATTGGTGACAAAATCAGAGGC ATACTTTATAGGACTCATTCTGACCAGTTTCTGG TGGCATTCAAAGAAGTGGGAAGAAAGCCCCCCA CTTTTGGAGATGCGTCAGTCATTGCCCTTGAATT ACTAAATTCTGGATATGAATTTGATGAAGGCTCC ATCATCTTTAATAAATTCAGGTCTGTCATCTCCTA TAAGACAGAAGAAAAGCCCATCTTTTCCCTTAAT ACCGTTGCAAGTGCTGACAGCATGAGTATCTAT GACGATATTGATGCTGACGTGCTGCAAAATTACC AAGAATACAATCTGGCCAACATCATCTACTACTC TCTGAAGGAGTCCACCACTAGTGAGCAGAGTGC CAGGATGACAGCCATGGACAATGCCAGCAAGAA TGCTTCTGAGATGATTGACAAATTGACATTGACA TTCAACCGTACCCGCCAAGCTGTCATCACAAAA GAGTTGATTGAAATTATCTCTGGTGCTGCAGCTC TGGATTAATGAAAATCAAGTTCCATCCTCAGACA AGAGGTAAAGAAGGAAAATTCA | | |
| 2361 | NM_0010 02.3_187 | 187 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGNAAGACAG GGCGACCTGGAAGTCCAACTACTTCCTTAAGAT CATCCAACTATTGGATGATTATCCGAAATGTTTC ATTGTGGGAGCAGACAATGTGGGCTCCAAGCAG ATGCAGCAGATCCGCATGTCCCTTCGCGGGAAG GCTGTGGTGCTGATGGGCAAGAACACCATGATG CGCAAGGCCATCCGAGGGCACCTGGAAAACAA CCCAGCTCTGGAGAAACTGCTGCCTCATATCCG GGGGAATGTGGGCTTTGTGTTCACCAAGGAGGA CCTCACTGAGATCAGGGACATGTTGCTGGCCAA TAAGGTGCCAGCTGCTGCCCGTGCTGGTGCCAT TGCCCCATGTGAAGTCACTGTGCCAGCCCAGAA CACTGGTCTCGGGCCCGAGAAGACCTCCTTTTT CCAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCTT GATATCACAGAGGAAACTCTGCATTCTCGCTTCC TGGAGGGTGTCCGCAATGTTGCCAGTGTCTGTC TGCAGATTGGCTACCCAACTGTTGCATCAGTAC CCCATTCTATCATCAACGGGTACAAACGAGTCCT GGCCTTGTCTGTGGAGACGGATTACACCTTCCC ACTTGCTGAAAAGGTCAAGGCCTTCTTGGCTGA TCCATCTGCCTTTGTGGCTGCTGCCCCTGTGGC T | 12 | XRQGDLEVQL LP* |
| 2362 | NM_0010 02.3_440 | 440 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTNTGTGTTCACCAAGGAGGA CCTCACTGAGATCAGGGACATGTTGCTGGCCAA TAAGGTGCCAGCTGCTGCCCGTGCTGGTGCCAT TGCCCCATGTGAAGTCACTGTGCCAGCCCAGAA CACTGGTCTCGGGCCCGAGAAGACCTCCTTTTT CCAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCTT GATATCACAGAGGAAACTCTGCATTCTCGCTTCC TGGAGGGTGTCCGCAATGTTGCCAGTGTCTGTC TGCAGATTGGCTACCCAACTGTTGCATCAGTAC | 9 | XCVHQGGPH* |

TABLE 3B-continued

| SEQ ID | identifier_ position | position | modified RNA | PAP length | PAP |
|---|---|---|---|---|---|
| | | | CCCATTCTATCATCAACGGGTACAAACGAGTCCTGGCCTTGTCTGTGGAGACGGATTACACCTTCCCACTTGCTGAAAAGGTCAAGGCCTTCTTGGCTGATCCATCTGCCTTTGTGGCTGCTGCCCCTGTGGCT | | |
| 2363 | NM_0010 02.3_454 | 454 | GTCTGACGGGCGATGGCGCAGCCAATAGACAGGAGCGCTATCCGCGGTTTCTGATTGGCTACTTTGTTCGCATTATAAAAGGCACGCGCGGGCGCGAGGCCCTTCTCTCGCCAGGCGTCCTCGTGGAAGTGACATCGTCTTTAAACCCTGCGTGGCAATCCCTGACGCACCGCCGTGATGCCCAGGGAAGACAGGGCGACCTGGAAGTCCAACTACTTCCTTAAGATCATCCAACTATTGGATGATTATCCGAAATGTTTCATTGTGGGAGCAGACAATGTGGGCTCCAAGCAGATGCAGCAGATCCGCATGTCCCTTCGCGGGAAGGCTGTGGTGCTGATGGGCAAGAACACCATGATGCGCAAGGCCATCCGAGGGCACCTGGAAAACAACCCAGCTCTGGAGAAACTGCTGCCTCATATCCGGGGGAATGTGGGCTTTGTGTTCACCAAGGNAGGACCTCACTGAGATCAGGGACATGTTGCTGGCCAATAAGGTGCCAGCTGCTGCCCGTGCTGGTGCCATTGCCCCATGTGAAGTCACTGTGCCAGCCCAGAACACTGGTCTCGGGCCCGAGAAGACCTCCTTTTTCCAGGCTTTAGGTATCACCACTAAAATCTCCAGGGGCACCATTGAAATCCTGAGTGATGTGCAGCTGATCAAGACTGGAGACAAAGTGGGAGCCAGCGAAGCCACGCTGCTGAACATGCTCAACATCTCCCCCTTCTCCTTTGGGCTGGTCATCCAGCAGGTGTTCGACAATGGCAGCATCTACAACCCTGAAGTGCTTGATATCACAGAGGAAACTCTGCATTCTCGCTTCCTGGAGGGTGTCCGCAATGTTGCCAGTGTCTGTCTGCAGATTGGCTACCCAACTGTTGCATCAGTACCCCATTCTATCATCAACGGGTACAAACGAGTCCTGGCCTTGTCTGTGGAGACGGATTACACCTTCCCACTTGCTGAAAAGGTCAAGGCCTTCTTGGCTGATCCATCTGCCTTTGTGGCTGCTGCCCCTGTGGCT | 4 | XGPH* |
| 2364 | NM_0010 02.3_602 | 602 | GTCTGACGGGCGATGGCGCAGCCAATAGACAGGAGCGCTATCCGCGGTTTCTGATTGGCTACTTTGTTCGCATTATAAAAGGCACGCGCGGGCGCGAGGCCCTTCTCTCGCCAGGCGTCCTCGTGGAAGTGACATCGTCTTTAAACCCTGCGTGGCAATCCCTGACGCACCGCCGTGATGCCCAGGGAAGACAGGGCGACCTGGAAGTCCAACTACTTCCTTAAGATCATCCAACTATTGGATGATTATCCGAAATGTTTCATTGTGGGAGCAGACAATGTGGGCTCCAAGCAGATGCAGCAGATCCGCATGTCCCTTCGCGGGAAGGCTGTGGTGCTGATGGGCAAGAACACCATGATGCGCAAGGCCATCCGAGGGCACCTGGAAAACAACCCAGCTCTGGAGAAACTGCTGCCTCATATCCGGGGGAATGTGGGCTTTGTGTTCACCAAGGAGGACCTCACTGAGATCAGGGACATGTTGCTGGCCAATAAGGTGCCAGCTGCTGCCCGTGCTGGTGCCATTGCCCCATGTGAAGTCACTGTGCCAGCCCAGAACACTGGTCTCGGGCCCGAGAAGACCTCCTTTTTCAGGCTTTAGGNTATCACCACTAAAATCTCCAGGGGCACCATTGAAATCCTGAGTGATGTGCAGCTGATCAAGACTGGAGACAAAGTGGGAGCCAGCGAAGCCACGCTGCTGAACATGCTCAACATCTCCCCCTTCTCCTTTGGGCTGGTCATCCAGCAGGTGTTCGACAATGGCAGCATCTACAACCCTGAAGTGCTTGATATCACAGAGGAAACTCTGCATTCTCGCTTCCTGGAGGGTGTCCGCAATGTTGCCAGTGTCTGTCTGCAGATTGGCTACCCAACTGTTGCATCAGTACCCCATTCTATCATCAACGGGTACAAACGAGTCCTGGCCTTGTCTGTGGAGACGGATTACACCTTCCCACTTGCTGAAAAGGTCAAGGCCTTCTTGGCTGATCCATCTGCCTTTGTGGCTGCTGCCCCTGTGGCT | 3 | YHH* |
| 2365 | NM_0010 02.3_662 | 662 | GTCTGACGGGCGATGGCGCAGCCAATAGACAGGAGCGCTATCCGCGGTTTCTGATTGGCTACTTTGTTCGCATTATAAAAGGCACGCGCGGGCGCGAGGCCCTTCTCTCGCCAGGCGTCCTCGTGGAAGTGACATCGTCTTTAAACCCTGCGTGGCAATCCCTGACGCACCGCCGTGATGCCCAGGGAAGACAGGGCGACCTGGAAGTCCAACTACTTCCTTAAGATCATCCAACTATTGGATGATTATCCGAAATGTTTCATT | 40 | XDWRQSGSQRSHAAEHAQHLPLLLWAGHPAGVRQWQHLQP* |

TABLE 3B-continued

| SEQ ID | identifier_position | position | modified RNA | PAP length | PAP |
|---|---|---|---|---|---|
| | | | GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAANGACTGGAGACAAAGTGGGAGCCAGCGA AGCCACGCTGCTGAACATGCTCAACATCTCCCC CTTCTCCTTTGGGCTGGTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | | |
| 2366 | NM_0010 02.3_713 | 713 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAANCATCTCCCC CTTCTCCTTTGGGCTGGTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 23 | XHLPLLLWAG HPAGVRQWQ HLQP* |
| 2367 | NM_0010 02.3_731 | 731 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA | 17 | XWAGHPAGV RQWQHLQP* |

TABLE 3B-continued

| SEQ ID | identifier_ position | position | modified RNA | PAP length | PAP |
|---|---|---|---|---|---|
| | | | GCCACGCTGCTGAACATGCTCAACATCTCCCCC TTCTCCTTNTGGGCTGGTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | | |
| 2368 | NM_0010 02.3_732 | 732 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTNGGGCTGGTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 16 | XAGHPAGVR QWQHLQP* |
| 2369 | NM_0010 02.3_735 | 735 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGNCTGGTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 15 | XGHPAGVRQ WQHLQP* |

TABLE 3B-continued

| SEQ ID | identifier_position | position | modified RNA | PAP length | PAP |
|---|---|---|---|---|---|
| 2370 | NM_001002.3_739 | 739 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGNTCATCCAGCAGGTGTT CGACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 14 | XHPAGVRQW QHLQP* |
| 2371 | NM_001002.3_759 | 759 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACNAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 7 | XWQHLQP* |
| 2372 | NM_001002.3_761 | 761 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG | 7 | XWQHLQP* |

TABLE 3B-continued

| SEQ ID | identifier_position | position | modified RNA | PAP length | PAP |
|---|---|---|---|---|---|
| | | | GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAANTGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | | |
| 2373 | NM_0010 02.3_762 | 762 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCT TGATATCACAGAGGAAACTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 6 | XQHLQP* |
| 2374 | NM_0010 02.3_797 | 797 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCTT GATATCACNAGAGGAAACTCTGCATTCTCGCTTC CTGGAGGGTGTCCGCAATGTTGCCAGTGTCTGT | 55 | RGNSAFSLPG GCPQCCQCL SADWLPNCCI STPFYHQRVQ TSPGLVCGDG LHLPTC* |

TABLE 3B-continued

| SEQ ID | identifier_ position | position | modified RNA | PAP length | PAP |
|---|---|---|---|---|---|
| | | | CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | | |
| 2375 | NM_0010 02.3_805 | 805 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCTT GATATCACAGAGGAAANCTCTGCATTCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 53 | XSAFSLPGGC PQCCQCLSAD WLPNCCISTP FYHQRVQTSP GLVCGDGLHL PTC* |
| 2376 | NM_0010 02.3_814 | 814 | GTCTGACGGGCGATGGCGCAGCCAATAGACAG GAGCGCTATCCGCGGTTTCTGATTGGCTACTTT GTTCGCATTATAAAAGGCACGCGCGGGCGCGA GGGCCCTTCTCTCGCCAGGCGTCCTCGTGGAAGT GACATCGTCTTTAAACCCTGCGTGGCAATCCCT GACGCACCGCCGTGATGCCCAGGGAAGACAGG GCGACCTGGAAGTCCAACTACTTCCTTAAGATCA TCCAACTATTGGATGATTATCCGAAATGTTTCATT GTGGGAGCAGACAATGTGGGCTCCAAGCAGAT GCAGCAGATCCGCATGTCCCTTCGCGGGAAGG CTGTGGTGCTGATGGGCAAGAACACCATGATGC GCAAGGCCATCCGAGGGCACCTGGAAAACAAC CCAGCTCTGGAGAAACTGCTGCCTCATATCCGG GGGAATGTGGGCTTTGTGTTCACCAAGGAGGAC CTCACTGAGATCAGGGACATGTTGCTGGCCAAT AAGGTGCCAGCTGCTGCCCCGTGCTGGTGCCATT GCCCCATGTGAAGTCACTGTGCCAGCCCAGAAC ACTGGTCTCGGGCCCGAGAAGACCTCCTTTTTC CAGGCTTTAGGTATCACCACTAAAATCTCCAGG GGCACCATTGAAATCCTGAGTGATGTGCAGCTG ATCAAGACTGGAGACAAAGTGGGAGCCAGCGAA GCCACGCTGCTGAACATGCTCAACATCTCCCCC TTCTCCTTTGGGCTGGTCATCCAGCAGGTGTTC GACAATGGCAGCATCTACAACCCTGAAGTGCTT GATATCACAGAGGAAACTCTGCATTNCTCGCTTC CTGGAGGGTGTCCGCAATGTTGCCAGTGTCTGT CTGCAGATTGGCTACCCAACTGTTGCATCAGTA CCCCATTCTATCATCAACGGGTACAAACGAGTC CTGGCCTTGTCTGTGGAGACGGATTACACCTTC CCACTTGCTGAAAAGGTCAAGGCCTTCTTGGCT GATCCATCTGCCTTTGTGGCTGCTGCCCCTGTG GCT | 50 | XSLPGGCPQC CQCLSADWLP NCCISTPFYH QRVQTSPGLV CGDGLHLPTC* |
| 2377 | NM_0010 05.3_413 | 413 | CCTTTCCTTTCAGCGGAGCGCGGCGGCAAGATG GCAGTGCAAATATCCAAGAAGAGGAAGTTTGTC GCTGATGGCATCTTCAAAGCTGAACTGAATGAG TTTCTTACTCGGGAGCTGGCTGAAGATGGCTAC TCTGGAGTTGAGGTGCGAGTTACACCAACCAGG ACAGAAATCATTATCTTAGCCACCAGAACACAGA ATGTTCTTGGTGAGAAGGGGCCGGCGGATTCGG | 20 | XEWGQRLRG CGVWETPRT EG* |

TABLE 3B-continued

| SEQ ID | identifier_position | position | modified RNA | PAP length | PAP |
|---|---|---|---|---|---|
| | | | GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGANGAGTGGGGCCAAA<br>GGCTGCGAGGTTGTGGTGTCTGGGAAACTCCGA<br>GGACAGAGGGCTAAATCCATGAAGTTTGTGGAT<br>GGCCTGATGATCCACAGCGGAGACCCTGTTAAC<br>TACTACGTTGACACTGCTGTGCGCCACGTGTTG<br>CTCAGACAGGGTGTGCTGGGCATCAAGGTGAAG<br>ATCATGCTGCCCTGGGACCCAACTGGTAAGATT<br>GGCCCTAAGAAGCCCCTGCCTGACCACGTGAG<br>CATTGTGGAACCCAAAGATGAGATACTGCCCAC<br>CACCCCCATCTCAGAACAGAAGGGTGGGAAGCC<br>AGAGCCGCCTGCCATGCCCCAGCCAGTCCCCA<br>CAGCATAACAGGGTCTCCTTGGCAGCTGTATTC<br>TGGAGTCTGGATGTTGCTCTCTAAAGACCTTTAA<br>TAAAATTTTGTACAAAGACAAAAAAAAAAAAAAAA | | |
| 2378 | NM_0010 05.3_584 | 584 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAA<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAANGGTGAAG<br>ATCATGCTGCCCTGGGACCCAACTGGTAAGATT<br>GGCCCTAAGAAGCCCCTGCCTGACCACGTGAG<br>CATTGTGGAACCCAAAGATGAGATACTGCCCAC<br>CACCCCCATCTCAGAACAGAAGGGTGGGAAGCC<br>AGAGCCGCCTGCCATGCCCCAGCCAGTCCCCA<br>CAGCATAACAGGGTCTCCTTGGCAGCTGTATTC<br>TGGAGTCTGGATGTTGCTCTCTAAAGACCTTTAA<br>TAAAATTTTGTACAAAGACAAAAAAAAAAAAAAAA | 12 | XGEDHAALGP NW* |
| 2379 | NM_0010 05.3_586 | 586 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGNTGAAG<br>ATCATGCTGCCCTGGGACCCAACTGGTAAGATT<br>GGCCCTAAGAAGCCCCTGCCTGACCACGTGAG<br>CATTGTGGAACCCAAAGATGAGATACTGCCCAC<br>CACCCCCATCTCAGAACAGAAGGGTGGGAAGCC<br>AGAGCCGCCTGCCATGCCCCAGCCAGTCCCCA<br>CAGCATAACAGGGTCTCCTTGGCAGCTGTATTC<br>TGGAGTCTGGATGTTGCTCTCTAAAGACCTTTAA<br>TAAAATTTTGTACAAAGACAAAAAAAAAAAAAAAA | 11 | XEDHAALGPN W* |
| 2380 | NM_0010 05.3_611 | 611 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA | 2 | NW* |

TABLE 3B-continued

| SEQ ID | identifier_position | position | modified RNA | PAP length | PAP |
|---|---|---|---|---|---|
| | | | ATGTTCTTGGTGAGAAGGGCCGGCGGATTCGG GAACTGACTGCTGTAGTTCAGAAGAGGTTTGGC TTTCCAGAGGGCAGTGTAGAGCTTTATGCTGAA AAGGTGGCCACTAGAGGTCTGTGTGCCATTGCC CAGGCAGAGTCTCTGCGTTACAAACTCCTAGGA GGGCTTGCTGTGCGGAGGGCCTGCTATGGTGT GCTGCGGTTCATCATGGAGAGTGGGGCCAAAG GCTGCGAGGTTGTGGTGTCTGGGAAACTCCGAG GACAGAGGGCTAAATCCATGAAGTTTGTGGATG GCCTGATGATCCACAGCGGAGACCCTGTTAACT ACTACGTTGACACTGCTGTGCGCCACGTGTTGC TCAGACAGGGTGTGCTGGGCATCAAGGTGAAGA TCATGCTGCCCTGGGACCCNAACTGGTAAGATT GGCCCTAAGAAGCCCCTGCCTGACCACGTGAG CATTGTGGAACCCAAAGATGAGATACTGCCCAC CACCCCCATCTCAGAACAGAAGGGTGGGAAGCC AGAGCCGCCTGCCATGCCCCAGCCAGTCCCCA CAGCATAACAGGGTCTCCTTGGCAGCTGTATTC TGGAGTCTGGATGTTGCTCTCTAAAGACCTTTAA TAAAATTTTGTACAAAGACAAAAAAAAAAAAAAA | | |
| 2381 | NM_0010 05.3_613 | 613 | CCTTTCCTTTCAGCGGAGCGCGGCGGCAAGATG GCAGTGCAAATATCCAAGAAGAGGAAGTTTGTC GCTGATGGCATCTTCAAAGCTGAACTGAATGAG TTTCTTACTCGGGAGCTGGCTGAAGATGGCTAC TCTGGAGTTGAGGTGCGAGTTACACCAACCAGG ACAGAAATCATTATCTTAGCCACCAGAACACAGA ATGTTCTTGGTGAGAAGGGCCGGCGGATTCGG GAACTGACTGCTGTAGTTCAGAAGAGGTTTGGC TTTCCAGAGGGCAGTGTAGAGCTTTATGCTGAA AAGGTGGCCACTAGAGGTCTGTGTGCCATTGCC CAGGCAGAGTCTCTGCGTTACAAACTCCTAGGA GGGCTTGCTGTGCGGAGGGCCTGCTATGGTGT GCTGCGGTTCATCATGGAGAGTGGGGCCAAAG GCTGCGAGGTTGTGGTGTCTGGGAAACTCCGAG GACAGAGGGCTAAATCCATGAAGTTTGTGGATG GCCTGATGATCCACAGCGGAGACCCTGTTAACT ACTACGTTGACACTGCTGTGCGCCACGTGTTGC TCAGACAGGGTGTGCTGGGCATCAAGGTGAAGA TCATGCTGCCCTGGGACCCAANCTGGTAAGATT GGCCCTAAGAAGCCCCTGCCTGACCACGTGAG CATTGTGGAACCCAAAGATGAGATACTGCCCAC CACCCCCATCTCAGAACAGAAGGGTGGGAAGCC AGAGCCGCCTGCCATGCCCCAGCCAGTCCCCA CAGCATAACAGGGTCTCCTTGGCAGCTGTATTC TGGAGTCTGGATGTTGCTCTCTAAAGACCTTTAA TAAAATTTTGTACAAAGACAAAAAAAAAAAAAAA | 2 | XW* |
| 2382 | NM_0010 05.3_632 | 632 | CCTTTCCTTTCAGCGGAGCGCGGCGGCAAGATG GCAGTGCAAATATCCAAGAAGAGGAAGTTTGTC GCTGATGGCATCTTCAAAGCTGAACTGAATGAG TTTCTTACTCGGGAGCTGGCTGAAGATGGCTAC TCTGGAGTTGAGGTGCGAGTTACACCAACCAGG ACAGAAATCATTATCTTAGCCACCAGAACACAGA ATGTTCTTGGTGAGAAGGGCCGGCGGATTCGG GAACTGACTGCTGTAGTTCAGAAGAGGTTTGGC TTTCCAGAGGGCAGTGTAGAGCTTTATGCTGAA AAGGTGGCCACTAGAGGTCTGTGTGCCATTGCC CAGGCAGAGTCTCTGCGTTACAAACTCCTAGGA GGGCTTGCTGTGCGGAGGGCCTGCTATGGTGT GCTGCGGTTCATCATGGAGAGTGGGGCCAAAG GCTGCGAGGTTGTGGTGTCTGGGAAACTCCGAG GACAGAGGGCTAAATCCATGAAGTTTGTGGATG GCCTGATGATCCACAGCGGAGACCCTGTTAACT ACTACGTTGACACTGCTGTGCGCCACGTGTTGC TCAGACAGGGTGTGCTGGGCATCAAGGTGAAGA TCATGCTGCCCTGGGACCCAACTGGTAAGATTG GCCCTAANGAAGCCCCTGCCTGACCACGTGAGC ATTGTGGAACCCAAAGATGAGATACTGCCCACC ACCCCCATCTCAGAACAGAAGGGTGGGAAGCCA GAGCCGCCTGCCATGCCCCAGCCAGTCCCCAC AGCATAACAGGGTCTCCTTGGCAGCTGTATTCT GGAGTCTGGATGTTGCTCTCTAAAGACCTTTAAT AAAATTTTGTACAAAGACAAAAAAAAAAAAAAAA | 5 | XEAPA* |
| 2383 | NM_0010 05.3_642 | 642 | CCTTTCCTTTCAGCGGAGCGCGGCGGCAAGATG GCAGTGCAAATATCCAAGAAGAGGAAGTTTGTC GCTGATGGCATCTTCAAAGCTGAACTGAATGAG TTTCTTACTCGGGAGCTGGCTGAAGATGGCTAC TCTGGAGTTGAGGTGCGAGTTACACCAACCAGG | 1 | X* |

TABLE 3B-continued

| SEQ ID | identifier_position | position | modified RNA | PAP length | PAP |
|---|---|---|---|---|---|
| | | | ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGNCCTGACCACGTGAGC<br>ATTGTGGAACCCAAAGATGAGATACTGCCCACC<br>ACCCCCATCTCAGAACAGAAGGGTGGGAAGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | | |
| 2384 | NM_0010<br>05.3_654 | 654 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGCCTGACCACGTGNAGC<br>ATTGTGGAACCCAAAGATGAGATACTGCCCACC<br>ACCCCCATCTCAGAACAGAAGGGTGGGAAGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | 7 | XHCGTQR* |
| 2385 | NM_0010<br>05.3_660 | 660 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGCCTGACCACGTGAGCA<br>TTNGTGGAACCCAAAGATGAGATACTGCCCACC<br>ACCCCCATCTCAGAACAGAAGGGTGGGAAGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | 5 | XGTQR* |
| 2386 | NM_0010<br>05.3_684 | 684 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC | 45 | XHHPHLRTEG<br>WEARAACHA<br>PASPHSITGS<br>PWQLYSGVW |

TABLE 3B-continued

| SEQ ID | identifier_ position | position | modified RNA | PAP length | PAP |
|---|---|---|---|---|---|
| | | | TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGCCTGACCACGTGAGCA<br>TTGTGGAACCCAAAGATGAGATACTGNCCCACC<br>ACCCCCATCTCAGAACAGAAGGGTGGGAAGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | | MLLSKDL* |
| 2387 | NM_0010 05.3_713 | 713 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGCCTGACCACGTGAGCA<br>TTGTGGAACCCAAAGATGAGATACTGCCCACCA<br>CCCCCATCTCAGAACAGAAGGGNTGGGAAGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | 35 | WEARAACHA PASPHSITGS PWQLYSGVW MLLSKDL* |
| 2388 | NM_0010 05.3_719 | 719 | CCTTTCCTTTCAGCGGAGCGCGGCGGCAAGATG<br>GCAGTGCAAATATCCAAGAAGAGGAAGTTTGTC<br>GCTGATGGCATCTTCAAAGCTGAACTGAATGAG<br>TTTCTTACTCGGGAGCTGGCTGAAGATGGCTAC<br>TCTGGAGTTGAGGTGCGAGTTACACCAACCAGG<br>ACAGAAATCATTATCTTAGCCACCAGAACACAGA<br>ATGTTCTTGGTGAGAAGGGCCGGCGGATTCGG<br>GAACTGACTGCTGTAGTTCAGAAGAGGTTTGGC<br>TTTCCAGAGGGCAGTGTAGAGCTTTATGCTGAA<br>AAGGTGGCCACTAGAGGTCTGTGTGCCATTGCC<br>CAGGCAGAGTCTCTGCGTTACAAACTCCTAGGA<br>GGGCTTGCTGTGCGGAGGGCCTGCTATGGTGT<br>GCTGCGGTTCATCATGGAGAGTGGGGCCAAAG<br>GCTGCGAGGTTGTGGTGTCTGGGAAACTCCGAG<br>GACAGAGGGCTAAATCCATGAAGTTTGTGGATG<br>GCCTGATGATCCACAGCGGAGACCCTGTTAACT<br>ACTACGTTGACACTGCTGTGCGCCACGTGTTGC<br>TCAGACAGGGTGTGCTGGGCATCAAGGTGAAGA<br>TCATGCTGCCCTGGGACCCAACTGGTAAGATTG<br>GCCCTAAGAAGCCCCTGCCTGACCACGTGAGCA<br>TTGTGGAACCCAAAGATGAGATACTGCCCACCA<br>CCCCCATCTCAGAACAGAAGGGTGGGAANGCCA<br>GAGCCGCCTGCCATGCCCCAGCCAGTCCCCAC<br>AGCATAACAGGGTCTCCTTGGCAGCTGTATTCT<br>GGAGTCTGGATGTTGCTCTCTAAAGACCTTTAAT<br>AAAATTTTGTACAAAGACAAAAAAAAAAAAAAAA | 34 | XARAACHAPA SPHSITGSPW QLYSGVWMLL SKDL* |

TABLE 3B-continued

| SEQ ID | identifier_position | position | modified RNA | PAP length | PAP |
|---|---|---|---|---|---|
| 2389 | NM_0010 05340.1_ 216 | 216 | TGCCGCTTAATACCATCACATGATCCTCCCCGA GGGCCCTGTATTTAATTAAAATAGAGAGGGAGGC ACCACAGATGCCAGAAGAACACTGTTGCTCTTG GTGGACGGGCCCAGAGGAATTCAGAGTTAAACC TTGAGTGCCTGCGTCCGTGAGAATTCAGCATGG AATGTCTCTACTATTTCCTGGGATTTCTGCTCCT GGCTGCAAGATTGCCACNTTGATGCCGCCAAAC GATTTCATGATGTGCTGGGCAATGAAAGACCTTC TGCTTACATGAGGGAGCACAATCAATTAAATGGC TGGTCTTCTGATGAAAATGACTGGAATGAAAAAC TCTACCCAGTGTGGAAGCGGGGAGACATGAGGT GGAAAAACTCCTGGAAGGGAGGCCGTGTGCAG GCGGTCCTGACCAGTGACTCACCAGCCCTCGTG GGCTCAAATATAACATTTGCGGTGAACCTGATAT TCCCTAGATGCCAAAAGGAAGATGCCAATGGCA ACATAGTCTATGAGAAGAACTGCAGAAATGAGG CTGGTTTATCTGCTGATCCGTATGTTTACAACTG GACAGCATGGTCAGAGGACAGTGACGGGGAAA ATGGCACCGGCCAAAGCCATCATAACGTCTTCC CTGATGGGAAACCTTTTCCTCACCACCCCGGAT GGAGAAGATGGAATTTCATCTACGTCTTCCACAC ACTTGGTCAGTATTTCCAGAAATTGGGACGATGT TCAGTGAGAGTTTCTGTGAACACAGCCAATGTG ACACTTGGGCCTCAACTCATGGAAGTGACTGTC TACAGAAGACATGGACGGGCATATGTTCCCATC GCACAAGTGAAAGATGTGTACGTGGTAACAGAT CAGATTCCTGTGTTTGTGACTATGTTCCAGAAGA ACGATCGAAATTCATCCGACGAAACCTTCCTCAA AGATCTCCCCATTATGTTTGATGTCCTGATTCAT GATCCTAGCCACTTCCTCAATTATTCTACCATTA ACTACAAGTGGAGCTTCGGGGATA | 1 | X* |
| 2390 | NM_0010 05340.1_ 246 | 246 | TGCCGCTTAATACCATCACATGATCCTCCCCGA GGGCCCTGTATTTAATTAAAATAGAGAGGGAGGC ACCACAGATGCCAGAAGAACACTGTTGCTCTTG GTGGACGGGCCCAGAGGAATTCAGAGTTAAACC TTGAGTGCCTGCGTCCGTGAGAATTCAGCATGG AATGTCTCTACTATTTCCTGGGATTTCTGCTCCT GGCTGCAAGATTGCCACTTGATGCCGCCAAACG ATTTCATGATGTGCNTGGGCAATGAAAGACCTTC TGCTTACATGAGGGAGCACAATCAATTAAATGGC TGGTCTTCTGATGAAAATGACTGGAATGAAAAAC TCTACCCAGTGTGGAAGCGGGGAGACATGAGGT GGAAAAACTCCTGGAAGGGAGGCCGTGTGCAG GCGGTCCTGACCAGTGACTCACCAGCCCTCGTG GGCTCAAATATAACATTTGCGGTGAACCTGATAT TCCCTAGATGCCAAAAGGAAGATGCCAATGGCA ACATAGTCTATGAGAAGAACTGCAGAAATGAGG CTGGTTTATCTGCTGATCCGTATGTTTACAACTG GACAGCATGGTCAGAGGACAGTGACGGGGAAA ATGGCACCGGCCAAAGCCATCATAACGTCTTCC CTGATGGGAAACCTTTTCCTCACCACCCCGGAT GGAGAAGATGGAATTTCATCTACGTCTTCCACAC ACTTGGTCAGTATTTCCAGAAATTGGGACGATGT TCAGTGAGAGTTTCTGTGAACACAGCCAATGTG ACACTTGGGCCTCAACTCATGGAAGTGACTGTC TACAGAAGACATGGACGGGCATATGTTCCCATC GCACAAGTGAAAGATGTGTACGTGGTAACAGAT CAGATTCCTGTGTTTGTGACTATGTTCCAGAAGA ACGATCGAAATTCATCCGACGAAACCTTCCTCAA AGATCTCCCCATTATGTTTGATGTCCTGATTCAT GATCCTAGCCACTTCCTCAATTATTCTACCATTA ACTACAAGTGGAGCTTCGGGGATA | 3 | XGQ* |
| 2391 | NM_0010 06.3_170 | 170 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AGATTGGTATGATGTGAAAGCACCTGCTATGTT CAANTATAAGAAATATTGGAAAGACGCTCGTCAC CAGGACCCAAGGAACCAAAATTGCATCTGATGG TCTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA | 20 | XYKKYWKDA RHQDPRNQN CI* |

TABLE 3B-continued

| SEQ ID | identifier_position | position | modified RNA | PAP length | PAP |
|---|---|---|---|---|---|
| | | | AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTGCCAATCTATTTATCCTCTC<br>CATGATGTCTTCGTTAGAAAAGTAAAAATGCTGA<br>AGAAGCCCAAGTTTGAATTGGGAAAGCTCATGG<br>AGCTTCATGGTGAAGGCAGTAGTTCTGGAAAAG<br>CCACTGGGGACGAGACAGGTGCTAAAGTTGAAC<br>GAGCTGATGGATATGAACCACCAGTCCAAGAAT<br>CTGTTTAAAGTTCAGACTTCAAATAGTGGCAAAT<br>AAAAAGTGCTATTTGTGATGGTTTGCTTCTGAAA<br>AAAAAAAAAAAAAAAAAAAAAAAA | | |
| 2392 | NM_0010<br>06.3_212 | 212 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGNAACCAAAATTGCATCTGATGG<br>TCTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTGCCAATCTATTTATCCTCTC<br>CATGATGTCTTCGTTAGAAAAGTAAAAATGCTGA<br>AGAAGCCCAAGTTTGAATTGGGAAAGCTCATGG<br>AGCTTCATGGTGAAGGCAGTAGTTCTGGAAAAG<br>CCACTGGGGACGAGACAGGTGCTAAAGTTGAAC<br>GAGCTGATGGATATGAACCACCAGTCCAAGAAT<br>CTGTTTAAAGTTCAGACTTCAAATAGTGGCAAAT<br>AAAAAGTGCTATTTGTGATGGTTTGCTTCTGAAA<br>AAAAAAAAAAAAAAAAAAAAAAAA | 5 | NQNCI* |
| 2393 | NM_0010<br>06.3_395 | 395 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAANAAAATGG<br>CAGACAATGATTGAAGCTCACGTTGATGTCAAGA<br>CTACCGATGGTTACTTGCTTCGTCTGTTCTGTGT<br>TGGTTTTACTAAAAAACGCAACAATCAGATACGG<br>AAGACCTCTTATGCTCAGCACCAACAGGTCCGC<br>CAAATCCGGAAGAAGATGATGGAAATCATGACC<br>CGAGAGGTGCAGACAAATGACTTGAAAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAA | 7 | XKMADND* |
| 2394 | NM_0010<br>06.3_483 | 483 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT | 35 | XTQQSDTEDL<br>LCSAPTGPPN<br>PEEDDGNHD<br>PRGADK* |

TABLE 3B-continued

| SEQ ID | identifier_position | position | modified RNA | PAP length | PAP |
|---|---|---|---|---|---|
| | | | GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAANAAACGCAACAATCAGATACGG<br>AAGACCTCTTATGCTCAGCACCAACAGGTCCGC<br>CAAATCCGGAAGAAGATGATGGAAATCATGACC<br>CGAGAGGTGCAGACAAATGACTTGAAAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAA | | |
| 2395 | NM_0010<br>06.3_560 | 560 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGANAATCATGACC<br>CGAGAGGTGCAGACAAATGACTTGAAAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAA | 10 | XNHDPRGAD<br>K* |
| 2396 | NM_0010<br>06.3_561 | 561 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACC<br>CGAGAGGTGCAGACAAATGACTTGAAAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAA | 9 | XHDPRGADK* |

TABLE 3B-continued

| SEQ ID | identifier_position | position | modified RNA | PAP length | PAP |
|---|---|---|---|---|---|
| 2397 | NM_0010 06.3_562 | 562 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAANTCATGACC CGAGAGGTGCAGACAAATGACTTGAAAGAAGTG GTCAATAAATTGATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 9 | XHDPRGADK* |
| 2398 | NM_0010 06.3_584 | 584 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACNAAATGACTTGAAAGAAGTG GTCAATAAATTGATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 1 | K* |
| 2399 | NM_0010 06.3_594 | 594 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGNAAAGAAGTG GTCAATAAATTGATTCCAGACAGCATTGGAAAAG ACATAGAAAAGGCTTGCCAATCTATTTATCCTCT CCATGATGTCTTCGTTAGAAAAGTAAAAATGCTG | 5 | XRSGQ* |

TABLE 3B-continued

| SEQ ID | identifier_ position | position | modified RNA | PAP length | PAP |
|---|---|---|---|---|---|
| | | | AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | | |
| 2400 | NM_0010<br>06.3_595 | 595 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGANAAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 5 | XRSGQ* |
| 2401 | NM_0010<br>06.3_596 | 596 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAANAGAAGTG<br>GTCAATAAATTGATTCCAGACAGCATTGGAAAAG<br>ACATAGAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 5 | XRSGQ* |
| 2402 | NM_0010<br>06.3_611 | 611 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT | 22 | XIDSRQHWKR<br>HRKGLPIYLSS<br>P* |

TABLE 3B-continued

| SEQ ID | identifier_ position | position | modified RNA | PAP length | PAP |
|---|---|---|---|---|---|
| | | | GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAANATTGATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAA | | |
| 2403 | NM_0010 06.3_612 | 612 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAANTTGATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAA | 21 | XDSRQHWKR HRKGLPIYLSS P* |
| 2404 | NM_0010 06.3_615 | 615 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGNATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAA | 20 | XSRQHWKRH RKGLPIYLSSP* |
| 2405 | NM_0010 06.3_620 | 620 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT | 18 | RQHWKRHRK GLPIYLSSP* |

TABLE 3B-continued

| SEQ ID | identifier_ position | position | modified RNA | PAP length | PAP |
|---|---|---|---|---|---|
| | | | CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCNAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | | |
| 2406 | NM_0010 06.3_626 | 626 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGNCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 17 | XHWKRHRKG LPIYLSSP* |
| 2407 | NM_0010 06.3_633 | 633 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGANAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 14 | XRHRKGLPIYL SSP* |

TABLE 3B-continued

| SEQ ID | identifier_ position | position | modified RNA | PAP length | PAP |
|---|---|---|---|---|---|
| 2408 | NM_0010 06.3_634 | 634 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAANAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 14 | XRHRKGLPIYL SSP* |
| 2409 | NM_0010 06.3_635 | 635 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAANAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 14 | XRHRKGLPIYL SSP* |
| 2410 | NM_0010 06.3_636 | 636 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAANG ACATAGAAAAGGCTTGCCAATCTATTTATCCTCT CCATGATGTCTTCGTTAGAAAAGTAAAAATGCTG | 13 | XHRKGLPIYLS SP* |

TABLE 3B-continued

| SEQ ID | identifier_position | position | modified RNA | PAP length | PAP |
|---|---|---|---|---|---|
| | | | AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | | |
| 2411 | NM_0010<br>06.3_643 | 643 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGNAAAAGGCTTGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 11 | XKGLPIYLSSP* |
| 2412 | NM_0010<br>06.3_652 | 652 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTNGCCAATCTATTTATCCTCT<br>CCATGATGTCTTCGTTAGAAAAGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 8 | XPIYLSSP* |
| 2413 | NM_0010<br>06.3_657 | 657 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT | 6 | XYLSSP* |

TABLE 3B-continued

| SEQ ID | identifier_position | position | modified RNA | PAP length | PAP |
|---|---|---|---|---|---|
| | | | GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAANTCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | | |
| 2414 | NM_0010 06.3_691 | 691 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAANAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 10 | XSKNAEEAQV* |
| 2415 | NM_0010 06.3_692 | 692 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAANAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 10 | XSKNAEEAQV* |
| 2416 | NM_0010 06.3_693 | 693 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT | 9 | XKNAEEAQV* |

TABLE 3B-continued

| SEQ ID | identifier_position | position | modified RNA | PAP length | PAP |
|---|---|---|---|---|---|
| | | | CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTGCCAATCTATTTATCCTCTC<br>CATGATGTCTTCGTTAGAAAANGTAAAAATGCTG<br>AAGAAGCCCAAGTTTGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | | |
| 2417 | NM_0010<br>06.3_720 | 720 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTGCCAATCTATTTATCCTCTC<br>CATGATGTCTTCGTTAGAAAAGTAAAAATGCTGA<br>AGAAGCCCAAGTTTNGAATTGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 10 | XIGKAHGASW* |
| 2418 | NM_0010<br>06.3_725 | 725 | AAGTTCTCGCGCGACTCCCACTTCCGCCCTTTT<br>GGCTCTCTGACCAGCACCATGGCGGTTGGCAAG<br>AACAAGCGCCTTACGAAAGGCGGCAAAAAGGGA<br>GCCAAGAAGAAAGTGGTTGATCCATTTTCTAAGA<br>AAGATTGGTATGATGTGAAAGCACCTGCTATGTT<br>CAATATAAGAAATATTGGAAAGACGCTCGTCACC<br>AGGACCCAAGGAACCAAAATTGCATCTGATGGT<br>CTCAAGGGTCGTGTGTTTGAAGTGAGTCTTGCT<br>GATTTGCAGAATGATGAAGTTGCATTTAGAAAAT<br>TCAAGCTGATTACTGAAGATGTTCAGGGTAAAAA<br>CTGCCTGACTAACTTCCATGGCATGGATCTTACC<br>CGTGACAAAATGTGTTCCATGGTCAAAAAATGGC<br>AGACAATGATTGAAGCTCACGTTGATGTCAAGAC<br>TACCGATGGTTACTTGCTTCGTCTGTTCTGTGTT<br>GGTTTTACTAAAAAACGCAACAATCAGATACGGA<br>AGACCTCTTATGCTCAGCACCAACAGGTCCGCC<br>AAATCCGGAAGAAGATGATGGAAATCATGACCC<br>GAGAGGTGCAGACAAATGACTTGAAAGAAGTGG<br>TCAATAAATTGATTCCAGACAGCATTGGAAAAGA<br>CATAGAAAAGGCTTGCCAATCTATTTATCCTCTC<br>CATGATGTCTTCGTTAGAAAAGTAAAAATGCTGA<br>AGAAGCCCAAGTTTGAATTNGGGAAAGCTCATG<br>GAGCTTCATGGTGAAGGCAGTAGTTCTGGAAAA<br>GCCACTGGGGACGAGACAGGTGCTAAAGTTGAA<br>CGAGCTGATGGATATGAACCACCAGTCCAAGAA<br>TCTGTTTAAAGTTCAGACTTCAAATAGTGGCAAA<br>TAAAAAGTGCTATTTGTGATGGTTTGCTTCTGAA<br>AAAAAAAAAAAAAAAAAAAAAAAAAA | 9 | XGKAHGASW* |

TABLE 3B-continued

| SEQ ID | identifier_position | position | modified RNA | PAP length | PAP |
|---|---|---|---|---|---|
| 2419 | NM_0010 06.3_728 | 728 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGNAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 6 | AHGASW* |
| 2420 | NM_0010 06.3_731 | 731 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAANGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 7 | XAHGASW* |
| 2421 | NM_0010 06.3_740 | 740 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG | 4 | XASW* |

TABLE 3B-continued

| SEQ ID | identifier_ position | position | modified RNA | PAP length | PAP |
|---|---|---|---|---|---|
| | | | ANGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAAGTGCTATTTGTGATGGTTTGCTTCTGAA AAAAAAAAAAAAAAAAAAAAAAAAAA | | |
| 2422 | NM_0010 06.3_741 | 741 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGNCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAAA | 3 | XSW* |
| 2423 | NM_0010 06.3_755 | 755 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGNCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAAA | 1 | Q* |
| 2424 | NM_0010 06.3_756 | 756 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA | 1 | X* |

TABLE 3B-continued

| SEQ ID | identifier_position | position | modified RNA | PAP length | PAP |
|---|---|---|---|---|---|
| | | | AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCNAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAAA | | |
| 2425 | NM_0010 06.3_767 | 767 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGNAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAAA | 8 | SHWGRDRC* |
| 2426 | NM_0010 06.3_771 | 771 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAN GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAAA | 8 | XHWGRDRC* |
| 2427 | NM_0010 06.3_788 | 788 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT | 2 | RC* |

TABLE 3B-continued

| SEQ ID | identifier_position | position | modified RNA | PAP length | PAP |
|---|---|---|---|---|---|
| | | | GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAG CCACTGGGGACGAGACNAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | | |
| 2428 | NM_0010 06.3_793 | 793 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAG CCACTGGGGACGAGACAGGTGNCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 1 | X* |
| 2429 | NM_0010 06.3_798 | 798 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAG CCACTGGGGACGAGACAGGTGCTAAANGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 1 | X* |

TABLE 3B-continued

| SEQ ID | identifier_position | position | modified RNA | PAP length | PAP |
|---|---|---|---|---|---|
| 2430 | NM_0010 06.3_822 | 822 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAG CCACTGGGGACGAGACAGGTGCTAAAGTTGAAC GAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA AAAAAAAAAAAAAAAAAAAAAAAAA | 22 | XTSPRICLKFR LQIVANKKCYL* |
| 2431 | NM_0010 06.3_841 | 841 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGAAGATGATGGAAATCATGACCC GAGAGGTGCAGACAAATGACTTGAAAGAAGTGG TCAATAAATTGATTCCAGACAGCATTGGAAAAGA CATAGAAAAGGCTTGCCAATCTATTTATCCTCTC CATGATGTCTTCGTTAGAAAAGTAAAAATGCTGA AGAAGCCCAAGTTTGAATTGGGAAAGCTCATGG AGCTTCATGGTGAAGGCAGTAGTTCTGGAAAAG CCACTGGGGACGAGACAGGTGCTAAAGTTGAAC GAGCTGATGGATATGAACCACCAGTCCAAGAAT CTGNTTTAAAGTTCAGACTTCAAATAGTGGCAAA TAAAAAGTGCTATTTGTGATGGTTTGCTTCTGAA AAAAAAAAAAAAAAAAAAAAAAAAA | 16 | XLKFRLQIVAN KKCYL* |
| 2432 | NM_0010 10.2_319 | 319 | CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAANAGAGAAAATCAG TTCGTGGTTGCATTGTGGATGCAAATCTGAGCG TTCTCAACTTGGTTATTGTAAAAAAAGGAGAGAA GGATATTCCTGGACTGACTGATACTACAGTGCCT CGCCGCCTGGGCCCCAAAAAGAGCTAGCAGAAT CCGCAAACTTTTCAATCTCTCTAAAGAAGATGAT GTCCGCCAGTATGTTGTAAGAAAGCCCTTAAATA AGAAGGTAAGAAACCTAGGACCAAAGCACCCA AGATTCAGCGTCTTGTTACTCCACGTGTCCTGCA GCACAAACGGCGGCGTATTGCTCTGAAGAAGCA GCGTACCAAGAAAAATAAAGAAGAGGCTGCAGA ATATGCTAAACTTTTGGCCAAGAGAATGAAGGAG | 33 | XEKISSWLHC GCKSERSQLG YCKKRREGYS WTD* |

TABLE 3B-continued

| SEQ ID | identifier_position | position | modified RNA | PAP length | PAP |
|---|---|---|---|---|---|
| 2433 | NM_0010 10.2_373 | 373 | GCTAAGGAGAAGCGCCAGGAACAAATTGCGAAG AGACGCAGACTTTCCTCTCTGCGAGCTTCTACTT CTAAGTCTGAATCCAGTCAGAAATAAGATTTTTT GAGTAACAAATAAATAAGATCAGACTCTG CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTNTGGTTATTGTAAAAAAAGGAGAGAA GGATATTCCTGGACTGACTGATACTACAGTGCCT CGCCGCCTGGGCCCCAAAAGAGCTAGCAGAAT CCGCAAACTTTTCAATCTCTCTAAAGAAGATGAT GTCCGCCAGTATGTTGTAAGAAAGCCCTTAAATA AAGAAGGTAAGAAACCTAGGACCAAAGCACCCA AGATTCAGCGTCTTGTTACTCCACGTGTCCTGCA GCACAAACGGCGGCGTATTGCTCTGAAGAAGCA GCGTACCAAGAAAAATAAAGAAGAGGCTGCAGA ATATGCTAAACTTTTGGCCAAGAGAATGAAGGAG GCTAAGGAGAAGCGCCAGGAACAAATTGCGAAG AGACGCAGACTTTCCTCTCTGCGAGCTTCTACTT CTAAGTCTGAATCCAGTCAGAAATAAGATTTTTT GAGTAACAAATAAATAAGATCAGACTCTG | 15 | XGYCKKRRE GYSWTD* |
| 2434 | NM_0010 10.2_626 | 626 | CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTTGGTTATTGTAAAAAAAGGAGAGAAG GATATTCCTGGACTGACTGATACTACAGTGCCTC GCCGCCTGGGCCCCAAAAGAGCTAGCAGAATC CGCAAACTTTTCAATCTCTCTAAAGAAGATGATG TCCGCCAGTATGTTGTAAGAAAGCCCTTAAATAA AGAAGGTAAGAAACCTAGGACCAAAGCACCCAA GATTCAGCGTCTTGTTACTCCACGTGTCCTGCA GCACAAACGGCGGCGTATTGCTCTGAANGAAGC AGCGTACCAAGAAAAATAAAGAAGAGGCTGCAG AATATGCTAAACTTTTGGCCAAGAGAATGAAGGA GGCTAAGGAGAAGCGCCAGGAACAAATTGCGAA GAGACGCAGACTTTCCTCTCTGCGAGCTTCTAC TTCTAAGTCTGAATCCAGTCAGAAATAAGATTTTT TGAGTAACAAATAAATAAGATCAGACTCTG | 8 | XEAAYQEK* |
| 2435 | NM_0010 10.2_651 | 651 | CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTTGGTTATTGTAAAAAAAGGAGAGAAG GATATTCCTGGACTGACTGATACTACAGTGCCTC GCCGCCTGGGCCCCAAAAGAGCTAGCAGAATC CGCAAACTTTTCAATCTCTCTAAAGAAGATGATG TCCGCCAGTATGTTGTAAGAAAGCCCTTAAATAA AGAAGGTAAGAAACCTAGGACCAAAGCACCCAA GATTCAGCGTCTTGTTACTCCACGTGTCCTGCA GCACAAACGGCGGCGTATTGCTCTGAAGAAGCA GCGTACCAAGAAAAATAAANGAAGAGGCTGCAG AATATGCTAAACTTTTGGCCAAGAGAATGAAGGA GGCTAAGGAGAAGCGCCAGGAACAAATTGCGAA GAGACGCAGACTTTCCTCTCTGCGAGCTTCTAC | 7 | XRGCRIC* |

TABLE 3B-continued

| SEQ ID | identifier_ position | position | modified RNA | PAP length | PAP |
|---|---|---|---|---|---|
| 2436 | NM_0010 10.2_710 | 710 | TTCTAAGTCTGAATCCAGTCAGAAATAAGATTTTT TGAGTAACAAATAAATAAGATCAGACTCTG CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTTGGTTATTGTAAAAAAAGGAGAGAAG GATATTCCTGGACTGACTGATACTACAGTGCCTC GCCGCCTGGGCCCCAAAAGAGCTAGCAGAATC CGCAAACTTTTCAATCTCTCTAAAGAAGATGATG TCCGCCAGTATGTTGTAAGAAAGCCCTTAAATAA AGAAGGTAAGAAACCTAGGACCAAAGCACCCAA GATTCAGCGTCTTGTTACTCCACGTGTCCTGCA GCACAAACGGCGGCGTATTGCTCTGAAGAAGCA GCGTACCAAGAAAAATAAAGAAGAGGCTGCAGA ATATGCTAAACTTTTGGCCAAGAGAATGAAGGAG GCTAAGGAGAANGCGCCAGGAACAAATTGCGAA GAGACGCAGACTTTCCTCTCTGCGAGCTTCTAC TTCTAAGTCTGAATCCAGTCAGAAATAAGATTTTT TGAGTAACAAATAAATAAGATCAGACTCTG | 20 | XAPGTNCEET QTFLSASFYF* |
| 2437 | NM_0010 10.2_745 | 745 | CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTTGGTTATTGTAAAAAAAGGAGAGAAG GATATTCCTGGACTGACTGATACTACAGTGCCTC GCCGCCTGGGCCCCAAAAGAGCTAGCAGAATC CGCAAACTTTTCAATCTCTCTAAAGAAGATGATG TCCGCCAGTATGTTGTAAGAAAGCCCTTAAATAA AGAAGGTAAGAAACCTAGGACCAAAGCACCCAA GATTCAGCGTCTTGTTACTCCACGTGTCCTGCA GCACAAACGGCGGCGTATTGCTCTGAAGAAGCA GCGTACCAAGAAAAATAAAGAAGAGGCTGCAGA ATATGCTAAACTTTTGGCCAAGAGAATGAAGGAG GCTAAGGAGAAGCGCCAGGAACAAATTGCGAAG AGACGCAGACTTTNCCTCTCTGCGAGCTTCTACT TCTAAGTCTGAATCCAGTCAGAAATAAGATTTTT GAGTAACAAATAAATAAGATCAGACTCTG | 8 | XLSASFYF* |
| 2438 | NM_0010 13398.1_ 139 | 139 | AGATGCGAGCACTGCGGCTGGGCGCTGAGGAT CAGCCGCTTCCTGCCTGGATTCCACAGCTTCGC GCCGTGTACTGTCGCCCCATCCCTGCGCGCCCA GCCTGCCAAGCAGCGTGCCCCGGTTGCAGGCG TCATGCAGCNGGGCGCGACCCACGCTCTGGGC CGCTGCGCTGACTCTGCTGGTGCTGCTCCGCG GGCCGCCGGTGGCGCGGGCTGGCGCGAGCTC GGCGGGCTTGGGTCCCGTGGTGCGCTGCGAGC CGTGCGACGCGCGTGCACTGGCCCAGTGCGCG CCTCCGCCCGCCGTGTGCGCGGAGCTGGTGCG CGAGCCGGGCTGCGGCTGCTGCCTGACGTGCG CACTGAGCGAGGGCCAGCCGTGCGGCATCTAC ACCGAGCGCTGTGGCTCCGGCCTTCGCTGCCA GCCGTCGCCCGACGAGGCGCGACCGCTGCAGG CGCTGCTGGACGGCCGCGGGCTCTGCGTCAAC GCTAGTGCCGTCAGCCGCCTGCGCGCCTACCT GCTGCCAGCGCCGCCAGCTCCAGGTGAGCCGC CCGCGCCAGGAAATGCTAGTGAGTCGGAGGAA GACCGCAGCGCCGGCAGTGTGGAGAGCCCGTC CGTCTCCAGCACGCACCGGGTGTCTGATCCCAA GTTCCACCCCCTCCATTCAAAGATAATCATCATC AAGAAAGGGCATGCTAAAGACAGCCAGCGCTAC AAAGTTGACTACGAGTCTCAGAGCACAGATACC CAGAACTTCTCCTCCGAGTCCAAGCGGGAGACA GAATATGGTCCCTGCCGTAGAGAAATGGAAGAC | 115 | XGATHALGRC ADSAGAAPRA AGGAGWREL GGLGSRGALR AVRRACTGPV RASARRVRGA GARAGLRLLP DVRTERGPAV RHLHRALWLR PSLPAVARRG ATAAGAAGRP RALRQR* |

TABLE 3B-continued

| SEQ ID | identifier_ position | position | modified RNA | PAP length | PAP |
|---|---|---|---|---|---|
| | | | ACACTGAATCACCTGAAGTTCCTCAATGTGCTGA GTCCCAGGGGTGTACACATTCCCAACTGTGACA AGAAGGGATTTTATAAGAAAAAGCAGTGTCGCC CTTCCAAAGGCAGGAAGCGGGGCTTCTGCTGGT GTGTGGATAAGTATGGGCAGCCTCTCCCAGGCT ACACCACCAAGGGGAAGGAGGACGTGCACTGC TACAGCATGCAGAGCAAG | | |
| 2439 | NM_0010 15.3_171 | 171 | ACTTCCTCTCCAGCCCCTGCGTAATCGATAAGG AAACCCGGACGCTGCTGCCCCTTTCTTTTTTTCA GGCGGCCGGGAAGATGGCGGACATTCAGACTG AGCGTGCCTACCAAAAGCAGCCGACCATCTTTC AAAACAAGAAGAGGGTCCTGCTGGGAGAAACTG GCAAGGNAGAAGCTCCCGCGGTACTACAAGAAC ATCGGTCTGGGCTTCAAGACACCCAAGGAGGCT ATTGAGGGCACCTACATTGACAAGAAATGCCCC TTCACTGGTAATGTGTCCATTCGAGGGCGGATC CTCTCTGGCGTGGTGACCAAGATGAAGATGCAG AGGACCATTGTCATCCGCCGAGACTATCTGCAC TACATCCGCAAGTACAACCGCTTCGAGAAGCGC CACAAGAACATGTCTGTACACCTGTCCCCCTGC TTCAGGGACGTCCAGATCGGTGACATCGTCACA GTGGGCGAGTGCCGGCCTCTGAGCAAGACAGT GCGCTTCAACGTGCTCAAGGTCACCAAGGCTGC CGGCACCAAGAAGCAGTTCCAGAAGTTCTGAGG CTGGACATCGGCCCGCTCCCCACAATGAAATAA AGTTATTTTCTCATTCCAAAAAAAAAAAAAAAAAA AAAAAAAAAAAAAA | 21 | XEAPAVLQEH RSGLQDTQG GY* |
| 2440 | NM_0010 24662.1_ 1079 | 1079 | GATTGCTTATAGACCGGAAGCCGGGACCTTAAT TCTCTTTCCCATCTTGCAAGGTAAGAATCGCGG GCCTGTCTGCAAGACTTGAGTTCAGGACTCCCA ATCCTTCGCCATCCGAACCTGGAGGGCATCCAG TCGACACCTACAGGGGTCGGACATGTCCAAGGC TAACTGAGAGGCCTTCCAGACGCTTCATTTTTGT TGTTTGGGTTTGCGGCAGGGCACAAAGAGGATG GCGGGTGAAAAAGTTGAGAAGCCAGATACTAAA GAGAAGAAACCCGAAGCCAAGAAGGTTGATGCT GGTGGCAAGGTGAAAAAGGGTAACCTCAAAGCT AAAAAGCCCAAGAAGGGGAAGCCCCATTGCAGC CGCAACCCTGTCCTTGTCAGAGGAATTGGCAGG TATTCCCGATCTGCCATGTATTCCAGAAAGGCCA TGTACAAGAGGAAGTACTCAGCCGCTAAATCCA AGGTTGAAAAGAAAAAGAAGGAGAAGGTTCTCG CAACTGTTACAAAACCAGTTGGTGGTGACAAGA ACGGCGGTACCCGGGTGGTTAAACTTCGCAAAA TGCCTAGATATTATCCTACTGAAGATGTGCCTCG AAAGCTGTTGAGCCACGGCAAAAAACCCTTCAG TCAGCACGTGAGAAAACTGCGAGCCAGCATTAC CCCCGGGACCATTCTGATCATCCTCACTGGACG CCACAGGGGCAAGAGGGTGGTTTTCCTGAAGCA GCTGGCTAGTGGCTTATTACTTGTGACTGGACC TCTGGTCCTCAATCGAGTTCCTCTACGAAGAACA CACCAGAAATTTGTCATTGCCACTTCAACCAAAA TCGATATCAGCAATGTAAAAATCCCAAAACATCT TACTGATGCTTACTTCAAGAAGAAGAAGCTGCG GAAGCCCAGACACCAGGAAGGTGAGATCTTCGA CACAGAAAAAGAGAAATATGAGATTACGGAGCA GCGCAAGATTGATCAGAAAGCTGTGGACTCACA AATTTTACCAAAAATCAAAGCTATTCCT | 11 | XQIGVLNVLRT* |
| 2441 | NM_0010 24662.1_ 916 | 916 | GATTGCTTATAGACCGGAAGCCGGGACCTTAAT TCTCTTTCCCATCTTGCAAGGTAAGAATCGCGG GCCTGTCTGCAAGACTTGAGTTCAGGACTCCCA ATCCTTCGCCATCCGAACCTGGAGGGCATCCAG TCGACACCTACAGGGGTCGGACATGTCCAAGGC TAACTGAGAGGCCTTCCAGACGCTTCATTTTTGT TGTTTGGGTTTGCGGCAGGGCACAAAGAGGATG GCGGGTGAAAAAGTTGAGAAGCCAGATACTAAA GAGAAGAAACCCGAAGCCAAGAAGGTTGATGCT GGTGGCAAGGTGAAAAAGGGTAACCTCAAAGCT AAAAAGCCCAAGAAGGGGAAGCCCCATTGCAGC CGCAACCCTGTCCTTGTCAGAGGAATTGGCAGG TATTCCCGATCTGCCATGTATTCCAGAAAGGCCA TGTACAAGAGGAAGTACTCAGCCGCTAAATCCA AGGTTGAAAAGAAAAAGAAGGAGAAGGTTCTCG CAACTGTTACAAAACCAGTTGGTGGTGACAAGA ACGGCGGTACCCGGGTGGTTAAACTTCGCAAAA TGCCTAGATATTATCCTACTGAAGATGTGCCTCG AAAGCTGTTGAGCCACGGCAAAAAACCCTTCAG | 1 | X* |

TABLE 3B-continued

| SEQ ID | identifier_ position | position | modified RNA | PAP length | PAP |
|---|---|---|---|---|---|
| | | | TCAGCACGTGAGAAAACTGCGAGCCAGCATTAC<br>CCCCGGGACCATTCTGATCATCCTCACTGGACG<br>CCACAGGGGCAAGAGGGTGGTTTTCCTGAAGCA<br>GCTGGCTAGTGGCTTATTACTTGTGACTGGACC<br>TCTGGTCCTCAATCGAGTTCCTCTACGAAGAACA<br>CACCAGAAATTTGTCATTGCCACTTCAACCAAAA<br>TCGATATCAGCAATGTAAAAATCCCAAAACATCT<br>TACTGATGCTTACTTCAAGAAGAAGAAGCTGCG<br>GAAGCCCAGACACCAGGAANGGTGAGATCTTCG<br>ACACAGAAAAAGAGAAATATGAGATTACGGAGC<br>AGCGCAAGATTGATCAGAAAGCTGTGGACTCAC<br>AAATTTTACCAAAAATCAAAGCTATTCC | | |
| 2442 | NM_0010 25092.1_ 124 | 124 | GGACAACACCTTCAAAGACAGGCCCTCTGAGTC<br>CGACGAGCTCCAGACCATCCAAGAAGACAGTGC<br>AGCCACCTCCGAGAGCCTGGATGTGATGGCGTC<br>ACAGAAGAGACCCTCCCAGAGGCACNGGATCCA<br>AGTACCTGGCCACAGCAAGTACCATGGACCATG<br>CCAGGCATGGCTTCCTCCCAAGGCACAGAGACA<br>CGGGCATCCTTGACTCCATCGGGCGCTTCTTTG<br>GCGGTGACAGGGGTGCGCCCAAGCGGGGCTCT<br>GGCAAGGACTCACACCACCCGGCAAGAACTGCT<br>CACTACGGCTCCCTGCCCCAGAAGTCACACGGC<br>CGGACCCAAGATGAAAACCCCGTAGTCCACTTC<br>TTCAAGAACATTGTGACGCCTCGCACACCACCC<br>CCGTCGCAGGGAAAGGGGGCCGAAGGCCAGAG<br>ACCAGGATTTGGCTACGGAGGCAGAGCGTCCG<br>ACTATAAATCGGCTCACAAGGGATTCAAGGGAG<br>TCGATGCCCAGGGCACGCTTTCCAAAATTTTTAA<br>GCTGGGAGGAAGAGATAGTCGCTCTGGATCACC<br>CATGGCTAGACGCTGAAAACCCACCTGGTTCCG<br>GAATCCTGTCCTCAGCTTCTTAATATAACTGCCT<br>TAAAACTTTAATCCCACTTGCCCCTGTTACCTAA<br>TTAGAGCAGATGACCCCTCCCCTAATGCCTGCG<br>GAGTTGTGCACGTAGTAGGGTCAGGCCACGGC<br>AGCCTACCGGCAATTTCCGGCCAACAGTTAAAT<br>GAGAACATGAAAACAGAAAACGGTTAAAACTGTC<br>CCTTTCTGTGTGAAGATCACGTTCCTTCCCCCGC<br>AATGTGCCCCCAGACGCACGTGGGTCTTCAGGG<br>GGCCAGGTGCACAGACGTCCCTCCACGTTCACC<br>CCTCCACCCTTGGACTTTCTTTTCGCCGTGGCT<br>GCGGCACCCTTGCGCTTTTGCTGGTCACTGCCA<br>TGGAGGCACACAGCTGCAGAGACAGAGAGGAC<br>GTGGGCGGCAGAGAGGACTGTTGACATCCAAG<br>CT | 28 | XIQVPGHSKY HGPCQAWLP PKAQRHGHP* |
| 2443 | NM_0010 25092.1_ 175 | 175 | GGACAACACCTTCAAAGACAGGCCCTCTGAGTC<br>CGACGAGCTCCAGACCATCCAAGAAGACAGTGC<br>AGCCACCTCCGAGAGCCTGGATGTGATGGCGTC<br>ACAGAAGAGACCCTCCCAGAGGCACGGATCCAA<br>GTACCTGGCCACAGCAAGTACCATGGACCATGC<br>CAGGCATGGCNTTCCTCCCAAGGCACAGAGACA<br>CGGGCATCCTTGACTCCATCGGGCGCTTCTTTG<br>GCGGTGACAGGGGTGCGCCCAAGCGGGGCTCT<br>GGCAAGGACTCACACCACCCGGCAAGAACTGCT<br>CACTACGGCTCCCTGCCCCAGAAGTCACACGGC<br>CGGACCCAAGATGAAAACCCCGTAGTCCACTTC<br>TTCAAGAACATTGTGACGCCTCGCACACCACCC<br>CCGTCGCAGGGAAAGGGGGCCGAAGGCCAGAG<br>ACCAGGATTTGGCTACGGAGGCAGAGCGTCCG<br>ACTATAAATCGGCTCACAAGGGATTCAAGGGAG<br>TCGATGCCCAGGGCACGCTTTCCAAAATTTTTAA<br>GCTGGGAGGAAGAGATAGTCGCTCTGGATCACC<br>CATGGCTAGACGCTGAAAACCCACCTGGTTCCG<br>GAATCCTGTCCTCAGCTTCTTAATATAACTGCCT<br>TAAAACTTTAATCCCACTTGCCCCTGTTACCTAA<br>TTAGAGCAGATGACCCCTCCCCTAATGCCTGCG<br>GAGTTGTGCACGTAGTAGGGTCAGGCCACGGC<br>AGCCTACCGGCAATTTCCGGCCAACAGTTAAAT<br>GAGAACATGAAAACAGAAAACGGTTAAAACTGTC<br>CCTTTCTGTGTGAAGATCACGTTCCTTCCCCCGC<br>AATGTGCCCCCAGACGCACGTGGGTCTTCAGGG<br>GGCCAGGTGCACAGACGTCCCTCCACGTTCACC<br>CCTCCACCCTTGGACTTTCTTTTCGCCGTGGCT<br>GCGGCACCCTTGCGCTTTTGCTGGTCACTGCCA<br>TGGAGGCACACAGCTGCAGAGACAGAGAGGAC<br>GTGGGCGGCAGAGAGGACTGTTGACATCCAAG<br>CT | 11 | XPPKAQRHG HP* |

TABLE 3B-continued

| SEQ ID | identifier_ position | position | modified RNA | PAP length | PAP |
|---|---|---|---|---|---|
| 2444 | NM_0010 25092.1_ 96 | 96 | GGACAACACCTTCAAAGACAGGCCCTCTGAGTC CGACGAGCTCCAGACCATCCAAGAAGACAGTGC AGCCACCTCCGAGAGCCTGGATGTGATGGCNGT CACAGAAGAGACCCTCCCAGAGGCACGGATCCA AGTACCTGGCCACAGCAAGTACCATGGACCATG CCAGGCATGGCTTCCTCCCAAGGCACAGAGACA CGGGCATCCTTGACTCCATCGGGCGCTTCTTTG GCGGTGACAGGGGTGCGCCCAAGCGGGGCTCT GGCAAGGACTCACACCACCCGGCAAGAACTGCT CACTACGGCTCCCTGCCCCAGAAGTCACACGGC CGGACCCAAGATGAAAACCCCGTAGTCCACTTC TTCAAGAACATTGTGACGCCTCGCACACCACCC CCGTCGCAGGGAAAGGGGGCCGAAGGCCAGAG ACCAGGATTTGGCTACGGAGGCAGAGCGTCCG ACTATAAATCGGCTCACAAGGGATTCAAGGGAG TCGATGCCCAGGGCACGCTTTCCAAAATTTTTAA GCTGGGAGGAAGAGATAGTCGCTCTGGATCACC CATGGCTAGACGCTGAAAACCCACCTGGTTCCG GAATCCTGTCCTCAGCTTCTTAATATAACTGCCT TAAAACTTTAATCCCACTTGCCCCTGTTACCTAA TTAGAGCAGATGACCCCTCCCCTAATGCCTGCG GAGTTGTGCACGTAGTAGGGTCAGGCCACGGC AGCCTACCGGCAATTTCCGGCCAACAGTTAAAT GAGAACATGAAAACAGAAAACGGTTAAAACTGTC CCTTTCTGTGTGAAGATCACGTTCCTTCCCCCGC AATGTGCCCCCAGACGCACGTGGGTCTTCAGGG GGCCAGGTGCACAGACGTCCCTCCACGTTCACC CCTCCACCCTTGGACTTTCTTTTCGCCGTGGCT GCGGCACCCTTGCGCTTTGCTGGTCACTGCCA TGGAGGCACACAGCTGCAGAGACAGAGAGGAC GTGGGCGGCAGAGAGGACTGTTGACATCCAAG CT | 37 | VTEETLPEARI QVPGHSKYH GPCQAWLPP KAQRHGHP* |
| 2445 | NM_0010 25101.1_ 668 | 668 | TGGGTGCGCGCCCGTCCCTCGGAGCCGCCGCC GTCAGTCACCGCCGCGCGCCAGAGAGAAG CAGCCTCCGGCCCGGCGGCCCTGTCTCCCG ACCCCGGAAGGCGAAGCAGGCTGCCCGGGGAC CCCGCGCGTGGGCGCTTGAAGCCGAGACCAGC CTGCCCGGGCCTGGGCAGGCGGAGCAGGGCCT TGGACCCCGCGGCGCCCCTCGGCCTCGGAGCA ACGAGCGCAGCGCCGCCTCTGAAGAGCCAATC CATTCAGGATGGGAAACCACGCAGGCAAACGAG AATTAAATGCCGAGAAGGCCAGTACGAATAGTG AAACTAACAGAGGAGAATCTGAAAAAAAGAGAAA CCTGGGTGAACTTTCACGGACAACCTCAGAGGA CAACGAAGTGTTCGGAGAGGCAGATGCGAACCA GAACAATGGGACCTCCTCTCAGGACACAGCGGT GACTGACTCCAAGCGCACAGCGGACCCGAAGA ATGCCTGGCAGGATGCCCACCCAGCTGACCCA GGGAGCCGCCCCACTTGATCCGCCTCTTTTCC CGAGATGCCCCGGGGAGGGAGGACAACACCTT CAAAGACAGGCCCTCTGAGTCCGACGAGCTCCA GACCATCCAAGAAGACAGTGCAGCCACCTCCGA GAGCCTGGATGTGATGGCNGTCACAGAAGAGAC CCTCCCAGAGGCACGGATCCAAGTACCTGGCCA CAGCAAGTACCATGGACCATGCCAGGCATGGCT TCCTCCCAAGGCACAGAGACACGGGCATCCTTG ACTCCATCGGGCGCTTCTTTGGCGGTGACAGGG GTGCGCCCAAGCGGGGCTCTGGCAAGGACTCA CACCACCCGGCAAGAACTGCTCACTACGGCTCC CTGCCCCAGAAGTCACACGGCCGGACCCAAGAT GAAAACCCCGTAGTCCACTTCTTCAAGAACATTG TGACGCCTCGCACACCACCCCCGTCGCAGGGA AAGGGGAGAGGACTGTCCCTGAGCAGATTTAGC TGGGGGGCCGAA | 37 | VTEETLPEARI QVPGHSKYH GPCQAWLPP KAQRHGHP* |
| 2446 | NM_0010 25101.1_ 696 | 696 | TGGGTGCGCGCCCGTCCCTCGGAGCCGCCGCC GTCAGTCACCGCCGCCGCGCGCCAGAGAGAAG CAGCCTCCGGCCCCGGCGGCCCTGTCTCCCG ACCCCGGAAGGCGAAGCAGGCTGCCCGGGGAC CCCGCGCGTGGGCGCTTGAAGCCGAGACCAGC CTGCCCGGGCCTGGGCAGGCGGAGCAGGGCCT TGGACCCCGCGGCGCCCCTCGGCCTCGGAGCA ACGAGCGCAGCGCCGCCTCTGAAGAGCCAATC CATTCAGGATGGGAAACCACGCAGGCAAACGAG AATTAAATGCCGAGAAGGCCAGTACGAATAGTG AAACTAACAGAGGAGAATCTGAAAAAAAGAGAAA CCTGGGTGAACTTTCACGGACAACCTCAGAGGA CAACGAAGTGTTCGGAGAGGCAGATGCGAACCA | 28 | XIQVPGHSKY HGPCQAWLP PKAQRHGHP* |

TABLE 3B-continued

| SEQ ID | identifier_ position | position | modified RNA | PAP length | PAP |
|---|---|---|---|---|---|
| | | | GAACAATGGGACCTCCTCTCAGGACACAGCGGT<br>GACTGACTCCAAGCGCACAGCGGACCCGAAGA<br>ATGCCTGGCAGGATGCCCACCCAGCTGACCCA<br>GGGAGCCGCCCCCACTTGATCCGCCTCTTTTCC<br>CGAGATGCCCCGGGGAGGGAGGACAACACCTT<br>CAAAGACAGGCCCTCTGAGTCCGACGAGCTCCA<br>GACCATCCAAGAAGACAGTGCAGCCACCTCCGA<br>GAGCCTGGATGTGATGGCGTCACAGAAGAGACC<br>CTCCCAGAGGCACNGGATCCAAGTACCTGGCCA<br>CAGCAAGTACCATGGACCATGCCAGGCATGGCT<br>TCCTCCCAAGGCACAGAGACACGGGCATCCTTG<br>ACTCCATCGGGCGCTTCTTTGGCGGTGACAGGG<br>GTGCGCCCAAGCGGGGCTCTGGCAAGGACTCA<br>CACCACCCGGCAAGAACTGCTCACTACGGCTCC<br>CTGCCCCAGAAGTCACACGGCCGGACCCAAGAT<br>GAAAACCCCGTAGTCCACTTCTTCAAGAACATTG<br>TGACGCCTCGCACACCACCCCCGTCGCAGGGA<br>AAGGGGAGAGGACTGTCCCTGAGCAGATTTAGC<br>TGGGGGGCCGAA | | |
| 2447 | NM_0010 25101.1_ 747 | 747 | TGGGTGCGCGCCCGTCCCTCGGAGCCGCCGCC<br>GTCAGTCACCGCCGCCGCGCGCCAGAGAGAAG<br>CAGCCTCCGGCCCCGGCGGCCCCTGTCTCCCG<br>ACCCCGGAAGGCGAAGCAGGCTGCCCGGGGAC<br>CCCGCGCGTGGGCGCTTGAAGCCGAGACCAGC<br>CTGCCCGGGCCTGGGCAGGCGGAGCAGGGCCT<br>TGGACCCCGCGGCGCCCCTCGGCCTCGGAGCA<br>ACGAGCGCAGCGCCGCCTCTGAAGAGCCAATC<br>CATTCAGGATGGGAAACCACGCAGGCAAACGAG<br>AATTAAATGCCGAGAAGGCCAGTACGAATAGTG<br>AAACTAACAGAGGAGAATCTGAAAAAAAGAGAAA<br>CCTGGGTGAACTTTCACGGACAACCTCAGAGGA<br>CAACGAAGTGTTCGGAGAGGCAGATGCGAACCA<br>GAACAATGGGACCTCCTCTCAGGACACAGCGGT<br>GACTGACTCCAAGCGCACAGCGGACCCGAAGA<br>ATGCCTGGCAGGATGCCCACCCAGCTGACCCA<br>GGGAGCCGCCCCCACTTGATCCGCCTCTTTTCC<br>CGAGATGCCCCGGGGAGGGAGGACAACACCTT<br>CAAAGACAGGCCCTCTGAGTCCGACGAGCTCCA<br>GACCATCCAAGAAGACAGTGCAGCCACCTCCGA<br>GAGCCTGGATGTGATGGCGTCACAGAAGAGACC<br>CTCCCAGAGGCACGGATCCAAGTACCTGGCCAC<br>AGCAAGTACCATGGACCATGCCAGGCATGGCNT<br>TCCTCCCAAGGCACAGAGACACGGGCATCCTTG<br>ACTCCATCGGGCGCTTCTTTGGCGGTGACAGGG<br>GTGCGCCCAAGCGGGGCTCTGGCAAGGACTCA<br>CACCACCCGGCAAGAACTGCTCACTACGGCTCC<br>CTGCCCCAGAAGTCACACGGCCGGACCCAAGAT<br>GAAAACCCCGTAGTCCACTTCTTCAAGAACATTG<br>TGACGCCTCGCACACCACCCCCGTCGCAGGGA<br>AAGGGGAGAGGACTGTCCCTGAGCAGATTTAGC<br>TGGGGGGCCGAA | 11 | XPPKAQRHG HP* |
| 2448 | NM_0010 25101.1_ 770 | 770 | TGGGTGCGCGCCCGTCCCTCGGAGCCGCCGCC<br>GTCAGTCACCGCCGCCGCGCGCCAGAGAGAAG<br>CAGCCTCCGGCCCCGGCGGCCCCTGTCTCCCG<br>ACCCCGGAAGGCGAAGCAGGCTGCCCGGGGAC<br>CCCGCGCGTGGGCGCTTGAAGCCGAGACCAGC<br>CTGCCCGGGCCTGGGCAGGCGGAGCAGGGCCT<br>TGGACCCCGCGGCGCCCCTCGGCCTCGGAGCA<br>ACGAGCGCAGCGCCGCCTCTGAAGAGCCAATC<br>CATTCAGGATGGGAAACCACGCAGGCAAACGAG<br>AATTAAATGCCGAGAAGGCCAGTACGAATAGTG<br>AAACTAACAGAGGAGAATCTGAAAAAAAGAGAAA<br>CCTGGGTGAACTTTCACGGACAACCTCAGAGGA<br>CAACGAAGTGTTCGGAGAGGCAGATGCGAACCA<br>GAACAATGGGACCTCCTCTCAGGACACAGCGGT<br>GACTGACTCCAAGCGCACAGCGGACCCGAAGA<br>ATGCCTGGCAGGATGCCCACCCAGCTGACCCA<br>GGGAGCCGCCCCCACTTGATCCGCCTCTTTTCC<br>CGAGATGCCCCGGGGAGGGAGGACAACACCTT<br>CAAAGACAGGCCCTCTGAGTCCGACGAGCTCCA<br>GACCATCCAAGAAGACAGTGCAGCCACCTCCGA<br>GAGCCTGGATGTGATGGCGTCACAGAAGAGACC<br>CTCCCAGAGGCACGGATCCAAGTACCTGGCCAC<br>AGCAAGTACCATGGACCATGCCAGGCATGGCTT<br>CCTCCCAAGGCACAGAGACACNGGGCATCCTTG<br>ACTCCATCGGGCGCTTCTTTGGCGGTGACAGGG<br>GTGCGCCCAAGCGGGGCTCTGGCAAGGACTCA | 2 | HP* |

TABLE 3B-continued

| SEQ ID | identifier_ position | position | modified RNA | PAP length | PAP |
|---|---|---|---|---|---|
| | | | CACCACCCGGCAAGAACTGCTCACTACGGCTCC CTGCCCCAGAAGTCACACGGCCGGACCCAAGAT GAAAACCCCGTAGTCCACTTCTTCAAGAACATTG TGACGCCTCGCACACCACCCCCGTCGCAGGGA AAGGGGAGAGGACTGTCCCTGAGCAGATTTAGC TGGGGGGCCGAA | | |
| 2449 | NM_0010 35006.1_ 548 | 548 | TACGAATCTCGCGAGAAGTCAAGTTCTCATGAGT TCTCCCAAAATCCACCGCTCTTCCTCTTTCCCTA AGCAGCCTGAGGTGATCTGTGAAAATGGTTCGC TATTCACTTGACCCGGAGAACCCCACGAAATCAT GCAAATCAAGAGGTTCCAATCTTCGTGTTCACTT TAAGAACACTCGTGAAACTGCTCAGGCCATCAA GGGTATGCATATACGAAAAGCCACGAAGTATCT GAAAGATGTCACTTTACAGAAACAGTGTGTACCA TTCCGACGTTACAATGGTGGAGTTGGCAGGTGT GCGCAGGCCAAGCAATGGGGCTGGACACAAGG TCGGTGGCCCAAAAAGAGTGCTGAATTTTTGCT GCACATGCTTAAAAACGCAGAGAGTAATGCTGA ACTTAAGGGTTTAGATGTAGATTCTCTGGTCATT GAGCATATCCAAGTGAACAAAGCACCTAAGATG CGCCGCCGGACCTACAGAGCTCATGGTCGGATT AACCCATACATGAGCTCTCCCTGCCACATTGAG ATGATCCTTACGGAANAAGGAACAGATTGTTCCT AAACCAGAAGAGGAGGTTGCCCAGAAGAAAAAG ATATCCCAGAAGAAACTGAAGAAACAAAAACTTA TGGCACGGGAGTAAATTCAGCATTAAAATAAATG TAATTAAAAGGAAAAAAAAAAAAAAA | 6 | XGTDCS* |
| 2450 | NM_0010 42498.2_ 372 | 372 | ATCGGGGGATGATCTGGAAAGCGCGATCAGTGA AGCGGACGAACGGCAGGATAAGGCGGGTCTAG TGACAGGAATGGCCGATGAAGCTCTGTAGGGA TGGTGGGTAGGCCGATCGGGCCGTGTCCCCGG CCTCCCGATCCGACGGAATTTGGAAATCCCGGG GCTATTCATACATTGAGCTTTTAGGAGCGGAGG AGAAAAGCCACCACCCTGACGATCCCGGCTCTC GCTCCACCTTCACTCAGGTGGCCCGGCAGCGG AAGTGACGAACGCGGAAGTGGTTTTTCTGTTGC CGAGGGGACGGGCCGGGCAGATGCCAACATGG CAGCGGTTGGGGCTGGTGGTTCCACCGCGGCG CCCGGGCCAGGGGCNGGTTTCCGCGGGTGCAT TGGAGCCGGGGACCGCCAGTGCGGCTCACAGG CGCCTGAAGTACATATCCCTAGCTGTGCTGGTG GTCCAGAATGCCTCCCTCATCCTCAGCATCCGC TACGCCCGCACGTTGCCAGGGGACCGCTTCTTT GCCACCACTGCTGTGGTCATGGCGGAAGTGCTC AAAGGTCTCACCTGCCTGCTGCTGCTCTTCGCA CAGAAGAGGGGTAACGTGAAGCACCTGGTTCTC TTCCTCCATGAGGCTGTCCTGGTGCAGTATGTG GACACGCTCAAGCTCGCAGTGCCCTCTCTCATC TACACCTTGCAGAATAACCTCCAGTATGTTGCCA TCTCTAACCTACCAGCTGCCACTTTCCAGGTGAC ATACCAGCTGAAGATCCTGACCACAGCGCTGTT CTCCGTGCTCATGCTGAATCGCAGCCTTTCCCG GCTGCAGTGGGCCTCCCTGCTGCTCCTCTTCAC TGGCGTCGCCATTGTCCAGGCACAGCAAGCCG GTGGGGGAGGCCCACGGCCACTGGATCAGAAC CCTGGGGCAGGCCTGGCAGCCGTCGTGGCCTC CTGTCTCTCCTCCGGCTTCGCAGGTGTCTACTTT GAGAAGATCCTCAAAGGCAGCTCAGGCTCCGTG TGGCTGCG | 75 | GFRGCIGAGD RQCGSQAPE VHIPSCAGGP ECLPHPQHPL RPHVARGPLL CHHCCGHGG SAQRSHLPAA ALRTEEG* |
| 2451 | NM_0011 01.2_108 7 | 1087 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT | 24 | XVDRRLHPGL AVHLPADVDQ QAGV* |

TABLE 3B-continued

| SEQ ID | identifier_position | position | modified RNA | PAP length | PAP |
|---|---|---|---|---|---|
| | | | CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGATC | | |
| 2452 | NM_0011 01.2_117 0 | 1170 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGATC | 12 | LHRPPQMLLG GL* |
| 2453 | NM_0011 01.2_156 | 156 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGNGCC GTCTTCCCCTCCATCGTGGGGCGCCCCAGGCA CCAGGGCGTGATGGTGGGCATGGGTCAGAAGG ATTCCTATGTGGGCGACGAGGCCCAGAGCAAGA GAGGCATCCTCACCCTGAAGTACCCCATCGAGC ACGGCATCGTCACCAACTGGGACGACATGGAGA AAATCTGGCACCACACCTTCTACAATGAGCTGC GTGTGGCTCCCGAGGAGCACCCCGTGCTGCTG ACCGAGGCCCCCCTGAACCCCAAGGCCAACCG CGAGAAGATGACCCAGATCATGTTTGAGACCTT CAACACCCCAGCCATGTACGTTGCTATCCAGGC TGTGCTATCCCTGTACGCCTCTGGCCGTACCAC TGGCATCGTGATGGACTCCGGTGACGGGGTCA CCCACACTGTGCCCATCTACGAGGGGTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC | 64 | GRLPLHRGAP QAPGRDGGH GSEGFLCGRR GPEQERHPH PEVPHRARHR HQLGRHGENL APHLLQ* |

TABLE 3B-continued

| SEQ ID | identifier_position | position | modified RNA | PAP length | PAP |
|---|---|---|---|---|---|
| 2454 | NM_0011 01.2_320 | 320 | ACCACCATGTACCCTGGCATTGCCGACAGGATG CAGAAGGAGAT CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGNAGA AAATCTGGCACCACACCTTCTACAATGAGCTGC GTGTGGCTCCCGAGGAGCACCCCGTGCTGCTG ACCGAGGCCCCCCTGAACCCCAAGGCCAACCG CGAGAAGATGACCCAGATCATGTTTGAGACCTT CAACACCCCAGCCATGTACGTTGCTATCCAGGC TGTGCTATCCCTGTACGCCTCTGGCCGTACCAC TGGCATCGTGATGGACTCCGGTGACGGGGTCA CCCACACTGTGCCCATCTACGAGGGGTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | 10 | XENLAPHLLQ* |
| 2455 | NM_0011 01.2_348 | 348 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAANTGAGCTGC GTGTGGCTCCCGAGGAGCACCCCGTGCTGCTG ACCGAGGCCCCCCTGAACCCCAAGGCCAACCG CGAGAAGATGACCCAGATCATGTTTGAGACCTT CAACACCCCAGCCATGTACGTTGCTATCCAGGC TGTGCTATCCCTGTACGCCTCTGGCCGTACCAC TGGCATCGTGATGGACTCCGGTGACGGGGTCA CCCACACTGTGCCCATCTACGAGGGGTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | 1 | X* |
| 2456 | NM_0011 01.2_372 | 372 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG | 25 | XAPRAADRGP PEPQGQPRE DDPDHV* |

TABLE 3B-continued

| SEQ ID | identifier_position | position | modified RNA | PAP length | PAP |
|---|---|---|---|---|---|
| | | | TGTGGCTCCCGAGGANGCACCCCGTGCTGCTG<br>ACCGAGGCCCCCCTGAACCCCAAGGCCAACCG<br>CGAGAAGATGACCCAGATCATGTTTGAGACCTT<br>CAACACCCCAGCCATGTACGTTGCTATCCAGGC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | | |
| 2457 | NM_0011<br>01.2_380 | 380 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGNTGCTGCTG<br>ACCGAGGCCCCCCTGAACCCCAAGGCCAACCG<br>CGAGAAGATGACCCAGATCATGTTTGAGACCTT<br>CAACACCCCAGCCATGTACGTTGCTATCCAGGC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 22 | XAADRGPPEP<br>QGQPREDDP<br>DHV* |
| 2458 | NM_0011<br>01.2_391 | 391 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCNGAGGCCCCCCTGAACCCCAAGGCCAACCG<br>CGAGAAGATGACCCAGATCATGTTTGAGACCTT<br>CAACACCCCAGCCATGTACGTTGCTATCCAGGC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG | 18 | XGPPEPQGQ<br>PREDDPDHV* |

TABLE 3B-continued

| SEQ ID | identifier_position | position | modified RNA | PAP length | PAP |
|---|---|---|---|---|---|
| | | | AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | | |
| 2459 | NM_0011<br>01.2_413 | 413 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGNCCAACCG<br>CGAGAAGATGACCCAGATCATGTTTGAGACCTT<br>CAACACCCCAGCCATGTACGTTGCTATCCAGGC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 11 | XQPREDDPD<br>HV* |
| 2460 | NM_0011<br>01.2_464 | 464 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGNCCATGTACGTTGCTATCCAGGC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 26 | XHVRCYPGCA<br>IPVRLWPYHW<br>HRDGLR* |
| 2461 | NM_0011<br>01.2_485 | 485 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG | 19 | XCAIPVRLWP<br>YHWHRDGLR* |

TABLE 3B-continued

| SEQ ID | identifier_ position | position | modified RNA | PAP length | PAP |
|---|---|---|---|---|---|
| | | | TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGNC<br>TGTGCTATCCCTGTACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | | |
| 2462 | NM_0011<br>01.2_500 | 500 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTNACGCCTCTGGCCGTACCAC<br>TGGCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 14 | XRLWPYHWH<br>RDGLR* |
| 2463 | NM_0011<br>01.2_520 | 520 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>NGGCATCGTGATGGACTCCGGTGACGGGGTCA<br>CCCACACTGTGCCCATCTACGAGGGGTATGCCC | 7 | XHRDGLR* |

TABLE 3B-continued

| SEQ ID | identifier_position | position | modified RNA | PAP length | PAP |
|---|---|---|---|---|---|
| | | | TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | | |
| 2464 | NM_0011<br>01.2_522 | 522 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGNCATCGTGATGGACTCCGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 6 | HRDGLR* |
| 2465 | NM_0011<br>01.2_538 | 538 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCNGGTGACGGGGTCA<br>CCCACACTGTGCCCATCTACGAGGGGTATGCCC<br>TCCCCCATGCCATCCTGCGTCTGGACCTGGCTG<br>GCCGGGACCTGACTGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC | 1 | X* |

TABLE 3B-continued

| SEQ ID | identifier_position | position | modified RNA | PAP length | PAP |
|---|---|---|---|---|---|
| 2466 | NM_0011 01.2_571 | 571 | ACCACCATGTACCCTGGCATTGCCGACAGGATG CAGAAGGAGAT CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACNGAGGGGTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | 20 | XGVCPPPCHP ASGPGWPGP D* |
| 2467 | NM_0011 01.2_577 | 577 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGNTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | 18 | XCPPPCHPAS GPGWPGPD* |
| 2468 | NM_0011 01.2_585 | 585 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG | 14 | PCHPASGPG WPGPD* |

TABLE 3B-continued

| SEQ ID | identifier_ position | position | modified RNA | PAP length | PAP |
|---|---|---|---|---|---|
| | | | TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT NCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | | |
| 2469 | NM_0011 01.2_590 | 590 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCNATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | 14 | XCHPASGPG WPGPD* |
| 2470 | NM_0011 01.2_606 | 606 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTNGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG | 8 | GPGWPGPD* |

TABLE 3B-continued

| SEQ ID | identifier_position | position | modified RNA | PAP length | PAP |
|---|---|---|---|---|---|
| | | | AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | | |
| 2471 | NM_0011<br>01.2_631 | 631 | CGCGTCCGCCCCGCGAGCACAGAGCCTCGCCT<br>TTGCCGATCCGCCGCCCGTCCACACCCGCCGC<br>CAGCTCACCATGGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTNGACTACCTCATGAAGATCC<br>TCACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAAGTGTGACGTGGACATCCGCAAA<br>GACCTGTACGCCAACACAGTGCTGTCTGGCGGC<br>ACCACCATGTACCCTGGCATTGCCGACAGGATG<br>CAGAAGGAGAT | 24 | XLPHEDPHRA<br>RLQLHHHGRA<br>GNRA* |
| 2472 | NM_0011<br>01.2_685 | 685 | CGCGTCCGCCCCGCGAGCACAGAGCCTCGCCT<br>TTGCCGATCCGCCGCCCGTCCACACCCGCCGC<br>CAGCTCACCATGGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCNGAGCGGGAAATCGTGCGTGACATTAAGGAG<br>AAGCTGTGCTACGTCGCCCTGGACTTCGAGCAA<br>GAGATGGCCACGGCTGCTTCCAGCTCCTCCCTG<br>GAGAAGAGCTACGAGCTGCCTGACGGCCAGGT<br>CATCACCATTGGCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | 6 | XAGNRA* |
| 2473 | NM_0011<br>01.2_692 | 692 | CGCGTCCGCCCCGCGAGCACAGAGCCTCGCCT<br>TTGCCGATCCGCCGCCCGTCCACACCCGCCGC<br>CAGCTCACCATGGATGATATCGCCGCGCTC<br>GTCGTCGACAACGGCTCCGGCATGTGCAAGGC<br>CGGCTTCGCGGGCGACGATGCCCCCCGGGCCG | 4 | XNRA* |

TABLE 3B-continued

| SEQ ID | identifier_position | position | modified RNA | PAP length | PAP |
|---|---|---|---|---|---|
| | | | TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGNAAATCGTGCGTGACATTAAGGAG AAGCTGTGCTACGTCGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | | |
| 2474 | NM_0011 01.2_695 | 695 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAANTCGTGCGTGACATTAAGGAG AAGCTGTGCTACGTCGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | 3 | XRA* |
| 2475 | NM_0011 01.2_711 | 711 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT | 31 | XGEAVLRRPG LRARDGHGCF QLLPGEELRA A* |

TABLE 3B-continued

| SEQ ID | identifier_position | position | modified RNA | PAP length | PAP |
|---|---|---|---|---|---|
| | | | CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAANGGAG AAGCTGTGCTACGTCGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | | |
| 2476 | NM_0011 01.2_713 | 713 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGNAG AAGCTGTGCTACGTCGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGAC GTGGACATCCGCAA AGACCTGTACGCCAACACAGTGCTGTCTGGCGG CACCACCATGTACCCTGGCATTGCCGACAGGAT GCAGAAGGAGAT | 30 | XEAVLRRPGL RARDGHGCF QLLPGEELRA A* |
| 2477 | NM_0011 01.2_717 | 717 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA ANGCTGTGCTACGTCGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG | 29 | XAVLRRPGLR ARDGHGCFQ LLPGEELRAA* |

TABLE 3B-continued

| SEQ ID | identifier_ position | position | modified RNA | PAP length | PAP |
|---|---|---|---|---|---|
| 2478 | NM_0011 01.2_730 | 730 | CACCACCATGTACCCTGGCATTGCCGACAGGAT GCAGAAGGAGAT CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA AGCTGTGCTACGTCNGCCCTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | 24 | XPGLRARDGH GCFQLLPGEE LRAA* |
| 2479 | NM_0011 01.2_734 | 734 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG TGTGGCTCCCGAGGAGCACCCCGTGCTGCTGA CCGAGGCCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA AGCTGTGCTACGTCGCCCNTGGACTTCGAGCAA GAGATGGCCACGGCTGCTTCCAGCTCCTCCCTG GAGAAGAGCTACGAGCTGCCTGACGGCCAGGT CATCACCATTGGCAATGAGCGGTTCCGCTGCCC TGAGGCACTCTTCCAGCCTTCCTTCCTGGGCAT GGAGTCCTGTGGCATCCACGAAACTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | 23 | XGLRARDGH GCFQLLPGEE LRAA* |
| 2480 | NM_0011 01.2_761 | 761 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG | 14 | XCFQLLPGEE LRAA* |

TABLE 3B-continued

| SEQ ID | identifier_position | position | modified RNA | PAP length | PAP |
|---|---|---|---|---|---|
| | | | TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGNCTGCTTCCAGCTCCTCCCTG<br>GAGAAGAGCTACGAGCTGCCTGACGGCCAGGT<br>CATCACCATTGGCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | | |
| 2481 | NM_0011<br>01.2_775 | 775 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCNTCCCTG<br>GAGAAGAGCTACGAGCTGCCTGACGGCCAGGT<br>CATCACCATTGGCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | 9 | XPGEELRAA* |
| 2482 | NM_0011<br>01.2_779 | 779 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCNTG | 8 | XGEELRAA* |

TABLE 3B-continued

| SEQ ID | identifier_position | position | modified RNA | PAP length | PAP |
|---|---|---|---|---|---|
| | | | GAGAAGAGCTACGAGCTGCCTGACGGCCAGGT<br>CATCACCATTGGCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | | |
| 2483 | NM_0011<br>01.2_784 | 784 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGNAAGAGCTACGAGCTGCCTGACGGCCAGGT<br>CATCACCATTGGCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | 6 | XELRAA* |
| 2484 | NM_0011<br>01.2_825 | 825 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGNCAATGAGCGGTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | 1 | Q* |
| 2485 | NM_0011<br>01.2_835 | 835 | CGCGTCCGCCCCGCGAGCACAGAGCCTCGCCT<br>TTGCCGATCCGCCGCCCGTCCACACCCGCCGC<br>CAGCTCACCATGGATGATGATATCGCCGCGCTC<br>GTCGTCGACAACGGCTCCGGCATGTGCAAGGC<br>CGGCTTCGCGGGCGACGATGCCCCCCGGGCCG | 4 | XPLP* |

TABLE 3B-continued

| SEQ ID | identifier_position | position | modified RNA | PAP length | PAP |
|---|---|---|---|---|---|
| | | | TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGNTTCCGCTGCCC<br>TGAGGCACTCTTCCAGCCTTCCTTCCTGGGCAT<br>GGAGTCCTGTGGCATCCACGAAACTACCTTCAA<br>CTCCATCATGAAGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | | |
| 2486 | NM_0011<br>01.2_924 | 924 | CGCGTCCGCCCCGCGAGCACAGAGCCTCGCCT<br>TTGCCGATCCGCCGCCCGTCCACACCCGCCGC<br>CAGCTCACCATGGATGATATCGCCGCGCTC<br>GTCGTCGACAACGGCTCCGGCATGTGCAAGGC<br>CGGCTTCGCGGGCGACGATGCCCCCCGGGCCG<br>TCTTCCCCTCCATCGTGGGGCGCCCCAGGCACC<br>AGGGCGTGATGGTGGGCATGGGTCAGAAGGAT<br>TCCTATGTGGGCGACGAGGCCCAGAGCAAGAG<br>AGGCATCCTCACCCTGAAGTACCCCATCGAGCA<br>CGGCATCGTCACCAACTGGGACGACATGGAGAA<br>AATCTGGCACCACACCTTCTACAATGAGCTGCG<br>TGTGGCTCCCGAGGAGCACCCCGTGCTGCTGA<br>CCGAGGCCCCCTGAACCCCAAGGCCAACCGC<br>GAGAAGATGACCCAGATCATGTTTGAGACCTTC<br>AACACCCCAGCCATGTACGTTGCTATCCAGGCT<br>GTGCTATCCCTGTACGCCTCTGGCCGTACCACT<br>GGCATCGTGATGGACTCCGGTGACGGGGTCAC<br>CCACACTGTGCCCATCTACGAGGGGTATGCCCT<br>CCCCCATGCCATCCTGCGTCTGGACCTGGCTGG<br>CCGGGACCTGACTGACTACCTCATGAAGATCCT<br>CACCGAGCGCGGCTACAGCTTCACCACCACGG<br>CCGAGCGGGAAATCGTGCGTGACATTAAGGAGA<br>AGCTGTGCTACGTCGCCCTGGACTTCGAGCAAG<br>AGATGGCCACGGCTGCTTCCAGCTCCTCCCTGG<br>AGAAGAGCTACGAGCTGCCTGACGGCCAGGTC<br>ATCACCATTGGCAATGAGCGGTTCCGCTGCCCT<br>GAGGCACTCTTCCAGCCTTCCTTCCTGGGCATG<br>GAGTCCTGTGGCATCCACGAAACTACCTTCAAC<br>TCCATCATGAANGTGTGACGTGGACATCCGCAA<br>AGACCTGTACGCCAACACAGTGCTGTCTGGCGG<br>CACCACCATGTACCCTGGCATTGCCGACAGGAT<br>GCAGAAGGAGAT | 2 | XV* |
| 2487 | NM_0012<br>35.2_253 | 253 | TCTTTGGCTTTTTTTGGCGGAGCTGGGGCGCCC<br>TCCGGAAGCGTTTCCAACTTTCCAGAAGTTTCTC<br>GGGACGGGCAGGAGGGGGTGGGGACTGCCATA<br>TATAGATCCCGGGAGCAGGGGAGCGGGCTAAG<br>AGTAGAATCGTGTCGCGGCTCGAGGCGAGAGT<br>CACGTCCCGGCGCTAGCCCAGCCCGACCCAGG<br>CCCACCGTGGTGCACGCAAACCACTTCCTGGCC<br>ATGCGCTCCCTCCTGCTTCTCAGCNGCCTTCTG<br>CCTCCTGGAGGCGGCCCTGGCCGCCGAGGTGA<br>AGAAACCTGCAGCCGCAGCAGCTCCTGGCACTG<br>CGGAGAAGTTGAGCCCCAAGGCGGCCACGCTT<br>GCCGAGCGCAGCGCCGGCCTGGCCTTCAGCTT<br>GTACCAGGCCATGGCCAAGGACCAGCAGTGA<br>AGAACATCTGGTGTCACCCGTGGTGGTGGCCT<br>CGTCGCTAGGGCTCGTGTCGCTGGGCGGCAAG<br>GCGACCACGGCGTCGCAGGCCAAGGCAGTGCT<br>GAGCGCCGAGCAGCTGCGCGACGAGGAGGTGC<br>ACGCCGGCCTGGGCGAGCTGCTGCGCTCACTC | 135 | XLLPPGGGPG<br>RRGEETCSRS<br>SSWHCGEVE<br>PQGGHACRA<br>QRRPGLQLVP<br>GHGQGPGSG<br>EHPGVTRGG<br>GLVARARVAG<br>RQGDHGVAG<br>QGSAERRAAA<br>RRGGARRPG<br>RAAALTQQLH<br>GAQRDLEAG<br>QPTVRTQLSE<br>LR* |

TABLE 3B-continued

| SEQ ID | identifier_position | position | modified RNA | PAP length | PAP |
|---|---|---|---|---|---|
| | | | AGCAACTCCACGGCGCGCAACGTGACCTGGAA<br>GCTGGGCAGCCGACTGTACGGACCCAGCTCAG<br>TGAGCTTCGCTGATGACTTCGTGCGCAGCAGCA<br>AGCAGCACTACAACTGCGAGCACTCCAAGATCA<br>ACTTCCGCGACAAGCGCAGCGCGCTGCAGTCC<br>ATCAACGAGTGGGCCGCGCAGACCACCGACGG<br>CAAGCTGCCCGAGGTCACCAAGGACGTGGAGC<br>GCACGGACGGCGCCCTGCTAGTCAACGCCATG<br>TTCTTCAAGCCACACTGGGATGAGAAATTCCACC<br>ACAAGATGGTGGACAACCGTGGCTTCATGGTGA<br>CTCGGTCCTATACCGTGGGTGTCATGATGATGC<br>ACCGGACAGGCCTCTACAACTACTACGACGACG<br>AGAAGGAAAAGCTGCAAATCGTGGAGATGCCCC<br>TGGCCCACAAGCTCTC | | |
| 2488 | NM_0014<br>02.5_100<br>1 | 1001 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AANGAATGTGTCTGTCAAGGATGTT | 15 | XECVCQGCS<br>SWQRCW* |
| 2489 | NM_0014<br>02.5_101<br>8 | 1018 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGNATGTT | 9 | XCSSWQRCW* |

TABLE 3B-continued

| SEQ ID | identifier_position | position | modified RNA | PAP length | PAP |
|---|---|---|---|---|---|
| 2490 | NM_001402.5_1034 | 1034 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | 4 | XRCW* |
| 2491 | NM_001402.5_1035 | 1035 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | 3 | XCW* |
| 2492 | NM_001402.5_1053 | 1053 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA | 1 | X* |

TABLE 3B-continued

| SEQ ID | identifier_ position | position | modified RNA | PAP length | PAP |
|---|---|---|---|---|---|
| | | | AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | | |
| 2493 | NM_0014 02.5_105 5 | 1055 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 1 | X* |
| 2494 | NM_0014 02.5_106 6 | 1066 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA | 39 | XGSSWLHCS GDYPEPSRPN KRRLCPCIGL PHGSHCMQV C* |

TABLE 3B-continued

| SEQ ID | identifier_ position | position | modified RNA | PAP length | PAP |
|---|---|---|---|---|---|
| 2495 | NM_0014 02.5_107 1 | 1071 | GCTCTTCCTGGGGACAATGTGGGCTTCAATGTC AAGAATGTGTCTGTCAAGGATGTTC CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 37 | XSWLHCSGD YPEPSRPNKR RLCPCIGLPH GSHCMQVC* |
| 2496 | NM_0014 02.5_108 7 | 1087 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 32 | XSGDYPEPSR PNKRRLCPCI GLPHGSHCM QVC* |
| 2497 | NM_0014 02.5_112 | 112 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGNATTCGGGCAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT | 13 | XFGQVHHYW PSDL* |

TABLE 3B-continued

| SEQ ID | identifier_position | position | modified RNA | PAP length | PAP |
|---|---|---|---|---|---|
| | | | GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2498 | NM_0014 02.5_113 1 | 1131 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA ACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 17 | XCPCIGLPHG SHCMQVC* |
| 2499 | NM_0014 02.5_113 9 | 1139 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA ACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA | 14 | CIGLPHGSHC MQVC* |

TABLE 3B-continued

| SEQ ID | identifier_position | position | modified RNA | PAP length | PAP |
|---|---|---|---|---|---|
| 2500 | NM_0014 02.5_114 7 | 1147 | TCTGTCGAAATGCACCATGAAGCTTTGAGTGAA GCTCTTCCTGGGGACAATGTGGGCTTCAATGTC AAGAATGTGTCTGTCAAGGATGTTC CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 12 | XLPHGSHCM QVC* |
| 2501 | NM_0014 02.5_116 | 116 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCNGGGCAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 10 | QVHHYWPSD L* |
| 2502 | NM_0014 02.5_116 4 | 1164 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT | 6 | XCMQVC* |

TABLE 3B-continued

| SEQ ID | identifier_position | position | modified RNA | PAP length | PAP |
|---|---|---|---|---|---|
| | | | GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | | |
| 2503 | NM_0014<br>02.5_117<br>5 | 1175 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | 3 | XVC* |
| 2504 | NM_0014<br>02.5_119<br>0 | 1190 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC | 4 | XGKD* |

TABLE 3B-continued

| SEQ ID | identifier_position | position | modified RNA | PAP length | PAP |
|---|---|---|---|---|---|
| 2505 | NM_0014 02.5_119 6 | 1196 | CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 2 | XD* |
| 2506 | NM_0014 02.5_120 | 120 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCNAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 10 | XVHHYWPSDL* |
| 2507 | NM_0014 02.5_121 4 | 1214 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC | 0 | * |

TABLE 3B-continued

| SEQ ID | identifier_position | position | modified RNA | PAP length | PAP |
|---|---|---|---|---|---|
| | | | ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | | |
| 2508 | NM_0014 02.5_122 0 | 1220 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 6 | XAGRWP* |
| 2509 | NM_0014 02.5_123 | 123 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGNTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG | 9 | XHHYWPSDL* |

TABLE 3B-continued

| SEQ ID | identifier_position | position | modified RNA | PAP length | PAP |
|---|---|---|---|---|---|
| 2510 | NM_0014 02.5_123 9 | 1239 | AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 5 | XLEVW* |
| 2511 | NM_0014 02.5_124 7 | 1247 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 3 | XVW* |
| 2512 | NM_0014 02.5_128 0 | 1280 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT | 6 | WQAHVC* |

TABLE 3B-continued

| SEQ ID | identifier_position | position | modified RNA | PAP length | PAP |
|---|---|---|---|---|---|
| | | | GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | | |
| 2513 | NM_0014<br>02.5_128<br>7 | 1287 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTTC | 4 | XHVC* |
| 2514 | NM_0014<br>02.5_132<br>4 | 1324 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG | 7 | XGSLCCS* |

TABLE 3B-continued

| SEQ ID | identifier_ position | position | modified RNA | PAP length | PAP |
|---|---|---|---|---|---|
| | | | TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | | |
| 2515 | NM_0014 02.5_132 8 | 1328 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 5 | SLCCS* |
| 2516 | NM_0014 02.5_136 2 | 1362 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 28 | XGGCHQSSG QEGCWSWQ GHQVCPESSE G* |
| 2517 | NM_0014 02.5_137 | 137 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGNCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA | 4 | PSDL* |

TABLE 3B-continued

| SEQ ID | identifier_ position | position | modified RNA | PAP length | PAP |
|---|---|---|---|---|---|
| | | | AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2518 | NM_0014 02.5_140 9 | 1409 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | 12 | QGHQVCPES SEG* |
| 2519 | NM_0014 02.5_144 9 | 1449 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT | 43 | XNIIPNTCHPT LNQWWKNGL RTVCFNWPFK FSSKRLVNDN NAS* |

TABLE 3B-continued

| SEQ ID | identifier_ position | position | modified RNA | PAP length | PAP |
|---|---|---|---|---|---|
| | | | GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTTC | | |
| 2520 | NM_0014 02.5_153 | 153 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAANTGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | XRWHRQKNH* |
| 2521 | NM_0014 02.5_167 | 167 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ANCAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | XQKNH* |
| 2522 | NM_0014 02.5_168 | 168 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACNAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT | 4 | XKNH* |

TABLE 3B-continued

| SEQ ID | identifier_position | position | modified RNA | PAP length | PAP |
|---|---|---|---|---|---|
| | | | GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2523 | NM_0014<br>02.5_170 | 170 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAANAAGAACCATTGAAAAATTTGAGAAGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XKNH* |
| 2524 | NM_0014<br>02.5_171 | 171 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAANAGAACCATTGAAAAATTTGAGAAGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC | 3 | XNH* |

TABLE 3B-continued

| SEQ ID | identifier_position | position | modified RNA | PAP length | PAP |
|---|---|---|---|---|---|
| | | | ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2525 | NM_0014 02.5_175 | 175 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAANCCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XH* |
| 2526 | NM_0014 02.5_178 | 178 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCANTTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2527 | NM_0014 02.5_182 | 182 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGANAAAATTTGAGAAGGAG GCTGCTGAGATGGGAAAGGGCTCCTTCAAGTAT | 3 | XKI* |

TABLE 3B-continued

| SEQ ID | identifier_position | position | modified RNA | PAP length | PAP |
|---|---|---|---|---|---|
| | | | GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2528 | NM_001402.5_183 | 183 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAANAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XI* |
| 2529 | NM_001402.5_184 | 184 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAANAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC | 2 | XI* |

TABLE 3B-continued

| SEQ ID | identifier_ position | position | modified RNA | PAP length | PAP |
|---|---|---|---|---|---|
| | | | AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2530 | NM_0014<br>02.5_186 | 186 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAANTTTGAGAAGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 1 | X* |
| 2531 | NM_0014<br>02.5_194 | 194 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAANGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XGGC* |
| 2532 | NM_0014<br>02.5_212 | 212 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG | 9 | LLQVCLGLG* |

TABLE 3B-continued

| SEQ ID | identifier_position | position | modified RNA | PAP length | PAP |
|---|---|---|---|---|---|
| | | | CTGCTGAGATGGGNAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2533 | NM_0014<br>02.5_214 | 214 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAANAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 11 | XGLLQVCLGL<br>G* |
| 2534 | NM_0014<br>02.5_215 | 215 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAANGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG | 11 | XGLLQVCLGL<br>G* |

TABLE 3B-continued

| SEQ ID | identifier_position | position | modified RNA | PAP length | PAP |
|---|---|---|---|---|---|
| | | | GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2535 | NM_0014 02.5_228 | 228 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGNTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 6 | XCLGLG* |
| 2536 | NM_0014 02.5_238 | 238 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGNTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 3 | XLG* |
| 2537 | NM_0014 02.5_241 | 241 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG | 2 | XG* |

TABLE 3B-continued

| SEQ ID | identifier_position | position | modified RNA | PAP length | PAP |
|---|---|---|---|---|---|
| | | | ACAAAAGAACCATTGAAAAATTTGAGAAGGAGG<br>CTGCTGAGATGGGAAAGGGCTCCTTCAAGTATG<br>CCTGGGTCTNTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2538 | NM_0014 02.5_243 | 243 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGNGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 1 | X* |
| 2539 | NM_0014 02.5_249 | 249 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAANCTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG | 3 | XES* |

TABLE 3B-continued

| SEQ ID | identifier_position | position | modified RNA | PAP length | PAP |
|---|---|---|---|---|---|
| | | | CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2540 | NM_0014 02.5_250 | 250 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACNTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XES* |
| 2541 | NM_0014 02.5_256 | 256 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGNCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 1 | X* |
| 2542 | NM_0014 02.5_280 | 280 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA | 1 | X* |

TABLE 3B-continued

| SEQ ID | identifier_position | position | modified RNA | PAP length | PAP |
|---|---|---|---|---|---|
| | | | CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCANTTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2543 | NM_0014 02.5_281 | 281 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATNTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2544 | NM_0014 02.5_294 | 294 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGNTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT | 3 | XEI* |

TABLE 3B-continued

| SEQ ID | identifier_ position | position | modified RNA | PAP length | PAP |
|---|---|---|---|---|---|
| | | | GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2545 | NM_0014 02.5_299 | 299 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA NATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XI* |
| 2546 | NM_0014 02.5_300 | 300 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ANTTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2547 | NM_0014 02.5_311 | 311 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA | 8 | XQVLCDYH* |

TABLE 3B-continued

| SEQ ID | identifier_position | position | modified RNA | PAP length | PAP |
|---|---|---|---|---|---|
| | | | TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGNCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2548 | NM_0014<br>02.5_312 | 312 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCNAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 7 | XVLCDYH* |
| 2549 | NM_0014<br>02.5_362 | 362 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAANAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA | 10 | XKHDYRDISG* |

TABLE 3B-continued

| SEQ ID | identifier_position | position | modified RNA | PAP length | PAP |
|---|---|---|---|---|---|
| | | | GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2550 | NM_0014 02.5_363 | 363 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAANAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | XHDYRDISG* |
| 2551 | NM_0014 02.5_366 | 366 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC NATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 8 | XDYRDISG* |

TABLE 3B-continued

| SEQ ID | identifier_position | position | modified RNA | PAP length | PAP |
|---|---|---|---|---|---|
| 2552 | NM_0014 02.5_375 | 375 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACANGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | XDISG* |
| 2553 | NM_0014 02.5_380 | 380 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACNATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 3 | ISG* |
| 2554 | NM_0014 02.5_419 | 419 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGNTGTTGGTGAATTT GAAGCTGGTATCTCCAAGAATGGGCAGACCCGA GAGCATGCCCTTCTGGCTTACACACTGGGTGTG | 2 | CW* |

TABLE 3B-continued

| SEQ ID | identifier_ position | position | modified RNA | PAP length | PAP |
|---|---|---|---|---|---|
| | | | AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2555 | NM_0014 02.5_429 | 429 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAANTTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2556 | NM_0014 02.5_431 | 431 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTNT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA | 1 | X* |

TABLE 3B-continued

| SEQ ID | identifier_position | position | modified RNA | PAP length | PAP |
|---|---|---|---|---|---|
| 2557 | NM_0014 02.5_432 | 432 | GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTN GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 29 | XSWYLQEWA DPRACPSGLH TGCETTNCRC* |
| 2558 | NM_0014 02.5_435 | 435 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AANGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 28 | XWYLQEWAD PRACPSGLHT GCETTNCRC* |
| 2559 | NM_0014 02.5_447 | 447 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG | 24 | XEWADPRAC PSGLHTGCET TNCRC* |

TABLE 3B-continued

| SEQ ID | identifier_ position | position | modified RNA | PAP length | PAP |
|---|---|---|---|---|---|
| | | | AAGCTGGTATCTCCNAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2560 | NM_0014 02.5_449 | 449 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAANGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 24 | XEWADPRAC PSGLHTGCET TNCRC* |
| 2561 | NM_0014 02.5_450 | 450 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGNAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA | 23 | XWADPRACP SGLHTGCETT NCRC* |

TABLE 3B-continued

| SEQ ID | identifier_ position | position | modified RNA | PAP length | PAP |
|---|---|---|---|---|---|
| 2562 | NM_0014 02.5_452 | 452 | ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAANTGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 23 | XWADPRACP SGLHTGCETT NCRC* |
| 2563 | NM_0014 02.5_466 | 466 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG NAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 18 | XACPSGLHTG CETTNCRC* |
| 2564 | NM_0014 02.5_478 | 478 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT | 14 | XGLHTGCETT NCRC* |

TABLE 3B-continued

| SEQ ID | identifier_ position | position | modified RNA | PAP length | PAP |
|---|---|---|---|---|---|
| | | | GTCCTGATTGTTGCTGCTGGTGTTGGTGAATTTG AAGCTGGTATCTCCAAGAATGGGCAGACCCGAG AGCATGCCCTTCNTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2565 | NM_0014 02.5_481 | 481 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGNCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 13 | XLHTGCETTN CRC* |
| 2566 | NM_0014 02.5_482 | 482 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCNTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA | 12 | LHTGCETTNC RC* |

TABLE 3B-continued

| SEQ ID | identifier_position | position | modified RNA | PAP length | PAP |
|---|---|---|---|---|---|
| | | | CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2567 | NM_0014 02.5_487 | 487 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACANCACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 11 | XTGCETTNCRC* |
| 2568 | NM_0014 02.5_488 | 488 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACNACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 10 | TGCETTNCRC* |
| 2569 | NM_0014 02.5_489 | 489 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC | 10 | XGCETTNCRC* |

TABLE 3B-continued

| SEQ ID | identifier_ position | position | modified RNA | PAP length | PAP |
|---|---|---|---|---|---|
| | | | ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACANCTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2570 | NM_0014 02.5_490 | 490 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACNTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 10 | XGCETTNCRC* |
| 2571 | NM_0014 02.5_493 | 493 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGNGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG | 9 | XCETTNCRC* |

TABLE 3B-continued

| SEQ ID | identifier_position | position | modified RNA | PAP length | PAP |
|---|---|---|---|---|---|
| 2572 | NM_0014 02.5_494 | 494 | AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGNTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 8 | CETTNCRC* |
| 2573 | NM_0014 02.5_498 | 498 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGN AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 7 | XTTNCRC* |
| 2574 | NM_0014 02.5_500 | 500 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT | 7 | XTTNCRC* |

TABLE 3B-continued

| SEQ ID | identifier_ position | position | modified RNA | PAP length | PAP |
|---|---|---|---|---|---|
| | | | GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA ANACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2575 | NM_0014 02.5_501 | 501 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AANCAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 6 | XTNCRC* |
| 2576 | NM_0014 02.5_502 | 502 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACNAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG | 6 | XTNCRC* |

TABLE 3B-continued

| SEQ ID | identifier_position | position | modified RNA | PAP length | PAP |
|---|---|---|---|---|---|
| 2577 | NM_0014 02.5_504 | 504 | GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAANCTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | XNCRC* |
| 2578 | NM_0014 02.5_505 | 505 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACNTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | XNCRC* |
| 2579 | NM_0014 02.5_508 | 508 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT | 4 | XCRC* |

TABLE 3B-continued

| SEQ ID | identifier_position | position | modified RNA | PAP length | PAP |
|---|---|---|---|---|---|
| | | | GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAANTTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2580 | NM_0014 02.5_509 | 509 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATNTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 4 | XCRC* |
| 2581 | NM_0014 02.5_514 | 514 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGNGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG | 2 | XC* |

TABLE 3B-continued

| SEQ ID | identifier_position | position | modified RNA | PAP length | PAP |
|---|---|---|---|---|---|
| | | | GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2582 | NM_0014 02.5_519 | 519 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTNAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 6 | XQNGFH* |
| 2583 | NM_0014 02.5_521 | 521 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAANCAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 6 | XQNGFH* |
| 2584 | NM_0014 02.5_522 | 522 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA | 5 | XNGFH* |

TABLE 3B-continued

| SEQ ID | identifier_ position | position | modified RNA | PAP length | PAP |
|---|---|---|---|---|---|
| | | | ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACNAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2585 | NM_0014<br>02.5_523 | 523 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACANAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 5 | XNGFH* |
| 2586 | NM_0014<br>02.5_524 | 524 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAANAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC | 5 | XNGFH* |

TABLE 3B-continued

| SEQ ID | identifier_ position | position | modified RNA | PAP length | PAP |
|---|---|---|---|---|---|
| | | | TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2587 | NM_0014<br>02.5_525 | 525 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAANATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XGFH* |
| 2588 | NM_0014<br>02.5_526 | 526 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAANTGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XGFH* |
| 2589 | NM_0014<br>02.5_527 | 527 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG | 4 | XGFH* |

TABLE 3B-continued

| SEQ ID | identifier_position | position | modified RNA | PAP length | PAP |
|---|---|---|---|---|---|
| | | | AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATNGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2590 | NM_0014 02.5_534 | 534 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CNACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2591 | NM_0014 02.5_536 | 536 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACNTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC | 0 | * |

TABLE 3B-continued

| SEQ ID | identifier_position | position | modified RNA | PAP length | PAP |
|---|---|---|---|---|---|
| | | | ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2592 | NM_0014 02.5_538 | 538 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGNAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | XATLQPEEI* |
| 2593 | NM_0014 02.5_539 | 539 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGNAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | XATLQPEEI* |
| 2594 | NM_0014 02.5_540 | 540 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG | 8 | XTLQPEEI* |

TABLE 3B-continued

| SEQ ID | identifier_ position | position | modified RNA | PAP length | PAP |
|---|---|---|---|---|---|
| | | | CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGNCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2595 | NM_0014<br>02.5_551 | 551 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGNCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 5 | XPEEI* |
| 2596 | NM_0014<br>02.5_557 | 557 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAANGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC | 3 | XEI* |

TABLE 3B-continued

| SEQ ID | identifier_ position | position | modified RNA | PAP length | PAP |
|---|---|---|---|---|---|
| | | | AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2597 | NM_0014 02.5_558 | 558 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGNAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XI* |
| 2598 | NM_0014 02.5_560 | 560 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGNATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XI* |
| 2599 | NM_0014 02.5_566 | 566 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG | 4 | XGNC* |

| SEQ ID | identifier_position | position | modified RNA | PAP length | PAP |
|---|---|---|---|---|---|
| | | | CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>NGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2600 | NM_0014<br>02.5_569 | 569 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGANAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XNC* |
| 2601 | NM_0014<br>02.5_570 | 570 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAANATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG | 2 | XC* |

TABLE 3B-continued

| SEQ ID | identifier_position | position | modified RNA | PAP length | PAP |
|---|---|---|---|---|---|
| | | | GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2602 | NM_0014 02.5_571 | 571 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAANTTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XC* |
| 2603 | NM_0014 02.5_572 | 572 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATNGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XC* |
| 2604 | NM_0014 02.5_573 | 573 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG | 1 | X* |

TABLE 3B-continued

| SEQ ID | identifier_position | position | modified RNA | PAP length | PAP |
|---|---|---|---|---|---|
| | | | ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTNGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2605 | NM_0014<br>02.5_575 | 575 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTNTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 0 | * |
| 2606 | NM_0014<br>02.5_576 | 576 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTNAAGGAAGTCAGCACTTACATTAA<br>GAAAATTGGCTACAACCCCGACACAGTAGCATTT<br>GTGCCAATTTCTGGTTGGAATGGTGACAACATG | 7 | XGSQHLH* |

TABLE 3B-continued

| SEQ ID | identifier_position | position | modified RNA | PAP length | PAP |
|---|---|---|---|---|---|
| | | | CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2607 | NM_0014 02.5_578 | 578 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 7 | XGSQHLH* |
| 2608 | NM_0014 02.5_582 | 582 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAANGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 5 | XQHLH* |
| 2609 | NM_0014 02.5_587 | 587 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA | 4 | XHLH* |

TABLE 3B-continued

| SEQ ID | identifier_position | position | modified RNA | PAP length | PAP |
|---|---|---|---|---|---|
| | | | CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGNCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2610 | NM_0014 02.5_588 | 588 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCNACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 3 | XLH* |
| 2611 | NM_0014 02.5_590 | 590 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACNTTACATTAA GAAAATTGGCTACAACCCCGACACAGTAGCATTT | 2 | LH* |

TABLE 3B-continued

| SEQ ID | identifier_ position | position | modified RNA | PAP length | PAP |
|---|---|---|---|---|---|
| | | | GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2612 | NM_0014 02.5_592 | 592 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTNACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XH* |
| 2613 | NM_0014 02.5_594 | 594 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACNATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2614 | NM_0014 02.5_597 | 597 | CTTTTTCGCAACGGGTTTGCCGCCAGAACACAG GTGTCGTGAAAACTACCCCTAAAAGCCAAATG GGAAAGGAAAAGACTCATATCAACATTGTCGTCA | 20 | XENWLQPRH SSICANFWLE W* |

TABLE 3B-continued

| SEQ ID | identifier_ position | position | modified RNA | PAP length | PAP |
|---|---|---|---|---|---|
| | | | TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTNAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2615 | NM_0014 02.5_598 | 598 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTANA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 20 | XENWLQPRH SSICANFWLE W* |
| 2616 | N_M0014 02.5_599 | 599 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAN | 20 | XENWLQPRH SSICANFWLE W* |

TABLE 3B-continued

| SEQ ID | identifier_position | position | modified RNA | PAP length | PAP |
|---|---|---|---|---|---|
| | | | GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2617 | NM_0014<br>02.5_602 | 602 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AANAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 19 | XNWLQPRHS<br>SICANFWLEW* |
| 2618 | NM_0014<br>02.5_603 | 603 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAANATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 18 | XWLQPRHSSI<br>CANFWLEW* |
| 2619 | NM_0014<br>02.5_604 | 604 | CTTTTTCGCAACGGGTTTGCCGCCAGAACACAG<br>GTGTCGTGAAAACTACCCCTAAAAGCCAAAATG | 18 | XWLQPRHSSI<br>CANFWLEW* |

TABLE 3B-continued

| SEQ ID | identifier_position | position | modified RNA | PAP length | PAP |
|---|---|---|---|---|---|
| | | | GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAANTTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2620 | NM_0014<br>02.5_614 | 614 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAANCCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 15 | XPRHSSICAN<br>FWLEW* |
| 2621 | NM_0014<br>02.5_620 | 620 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA | 13 | XHSSICANFW<br>LEW* |

TABLE 3B-continued

| SEQ ID | identifier_position | position | modified RNA | PAP length | PAP |
|---|---|---|---|---|---|
| | | | GGAAATTGTTAAGGAAGTCAGCACTTACATTAAG<br>AAAATTGGCTACAACCCCGANCACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2622 | NM_0014<br>02.5_621 | 621 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACNACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 12 | XSSICANFWL<br>EW* |
| 2623 | NM_0014<br>02.5_622 | 622 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACANCAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 12 | XSSICANFWL<br>EW* |

TABLE 3B-continued

| SEQ ID | identifier_position | position | modified RNA | PAP length | PAP |
|---|---|---|---|---|---|
| 2624 | NM_0014 02.5_623 | 623 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACNAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 11 | SSICANFWLE W* |
| 2625 | NM_0014 02.5_625 | 625 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGNTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 11 | XSICANFWLE W* |
| 2626 | NM_0014 02.5_627 | 627 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA | 10 | XICANFWLEW* |

TABLE 3B-continued

| SEQ ID | identifier_position | position | modified RNA | PAP length | PAP |
|---|---|---|---|---|---|
| | | | AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTANGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2627 | NM_0014<br>02.5_628 | 628 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGNCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 10 | XICANFWLEW* |
| 2628 | NM_0014<br>02.5_632 | 632 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTNT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA | 9 | XCANFWLEW* |

TABLE 3B-continued

| SEQ ID | identifier_position | position | modified RNA | PAP length | PAP |
|---|---|---|---|---|---|
| 2629 | NM_0014 02.5_633 | 633 | GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTN GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 8 | XANFWLEW* |
| 2630 | NM_0014 02.5_634 | 634 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG NTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 8 | XANFWLEW* |
| 2631 | NM_0014 02.5_635 | 635 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG | 7 | ANFWLEW* |

TABLE 3B-continued

| SEQ ID | identifier_position | position | modified RNA | PAP length | PAP |
|---|---|---|---|---|---|
| | | | AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TNGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2632 | NM_0014 02.5_638 | 638 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCNAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 6 | NFWLEW* |
| 2633 | NM_0014 02.5_640 | 640 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAANTTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA | 6 | XFWLEW* |

TABLE 3B-continued

| SEQ ID | identifier_position | position | modified RNA | PAP length | PAP |
|---|---|---|---|---|---|
| 2634 | NM_0014 02.5_643 | 643 | ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTNCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | XWLEW* |
| 2635 | NM_0014 02.5_644 | 644 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCNTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 4 | WLEW* |
| 2636 | NM_0014 02.5_645 | 645 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT | 4 | XLEW* |

TABLE 3B-continued

| SEQ ID | identifier_position | position | modified RNA | PAP length | PAP |
|---|---|---|---|---|---|
| | | | GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTNGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2637 | NM_0014 02.5_647 | 647 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGNTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | LEW* |
| 2638 | NM_0014 02.5_648 | 648 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTNTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA | 3 | XEW* |

TABLE 3B-continued

| SEQ ID | identifier_position | position | modified RNA | PAP length | PAP |
|---|---|---|---|---|---|
| 2639 | NM_0014 02.5_649 | 649 | CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTNGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 3 | XEW* |
| 2640 | NM_0014 02.5_650 | 650 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGNAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 3 | XEW* |
| 2641 | NM_0014 02.5_651 | 651 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC | 2 | XW* |

TABLE 3B-continued

| SEQ ID | identifier_position | position | modified RNA | PAP length | PAP |
|---|---|---|---|---|---|
| | | | ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGNAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2642 | NM_0014 02.5_652 | 652 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGANATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 2 | XW* |
| 2643 | NM_0014 02.5_653 | 653 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAANTGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG | 2 | XW* |

TABLE 3B-continued

| SEQ ID | identifier_position | position | modified RNA | PAP length | PAP |
|---|---|---|---|---|---|
| 2644 | NM_0014 02.5_654 | 654 | AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATNGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 1 | X* |
| 2645 | NM_0014 02.5_656 | 656 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGNTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 0 | * |
| 2646 | NM_0014 02.5_657 | 657 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT | 8 | XQHAGAKC* |

TABLE 3B-continued

| SEQ ID | identifier_position | position | modified RNA | PAP length | PAP |
|---|---|---|---|---|---|
| | | | GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTNGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2647 | NM_0014<br>02.5_660 | 660 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACNAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 7 | XHAGAKC* |
| 2648 | NM_0014<br>02.5_662 | 662 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAANCATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG | 7 | XHAGAKC* |

TABLE 3B-continued

| SEQ ID | identifier_position | position | modified RNA | PAP length | PAP |
|---|---|---|---|---|---|
| | | | GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2649 | NM_0014<br>02.5_663 | 663 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACNATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 6 | XAGAKC* |
| 2650 | NM_0014<br>02.5_664 | 664 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACANTG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 6 | XAGAKC* |
| 2651 | NM_0014<br>02.5_665 | 665 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA | 6 | XAGAKC* |

TABLE 3B-continued

| SEQ ID | identifier_position | position | modified RNA | PAP length | PAP |
|---|---|---|---|---|---|
| | | | ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATNG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2652 | NM_0014<br>02.5_666 | 666 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGN<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 5 | XGAKC* |
| 2653 | NM_0014<br>0.25_667 | 667 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGC<br>NTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC | 5 | XGAKC* |

TABLE 3B-continued

| SEQ ID | identifier_position | position | modified RNA | PAP length | PAP |
|---|---|---|---|---|---|
| | | | TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2654 | NM_0014<br>02.5_668 | 668 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>NGGAGCCAAGTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | GAKC* |
| 2655 | NM_0014<br>02.5_671 | 671 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGANGCCAAGTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XAKC* |
| 2656 | NM_0014<br>02.5_672 | 672 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG | 3 | XKC* |

TABLE 3B-continued

| SEQ ID | identifier_position | position | modified RNA | PAP length | PAP |
|---|---|---|---|---|---|
| | | | AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGNCCAAGTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2657 | NM_0014<br>02.5_674 | 674 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCNAAGTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 2 | KC* |
| 2658 | NM_0014<br>02.5_676 | 676 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAANGTGCTAACATGCCTTGGTTCAAGG<br>GATGGAAAGTCACCCGTAAGGATGGCAATGCCA<br>GTGGAACCACGCTGCTTGAGGCTCTGGACTGCA | 2 | XC* |

TABLE 3B-continued

| SEQ ID | identifier_position | position | modified RNA | PAP length | PAP |
|---|---|---|---|---|---|
| | | | TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2659 | NM_0014 02.5_677 | 677 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGNTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 2 | XC* |
| 2660 | NM_0014 02.5_680 | 680 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCNTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 0 | * |
| 2661 | NM_0014 02.5_681 | 681 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG | 12 | XHALVQGMES HP* |

TABLE 3B-continued

| SEQ ID | identifier_ position | position | modified RNA | PAP length | PAP |
|---|---|---|---|---|---|
| | | | CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTNAACATGCCTTGGTTCAAGG GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2662 | NM_0014 02.5_683 | 683 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAANCATGCCTTGGTTCAAGG GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 12 | XHALVQGMES HP* |
| 2663 | NM_0014 02.5_684 | 684 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACNATGCCTTGGTTCAAGG GATGGAAAGTCACCCGTAAGGATGGCAATGCCA | 11 | XALVQGMESH P* |

TABLE 3B-continued

| SEQ ID | identifier_ position | position | modified RNA | PAP length | PAP |
|---|---|---|---|---|---|
| 2664 | NM_0014 02.5_685 | 685 | GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACANTGCCTTGGTTCAAGG GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 11 | XALVQGMESH P* |
| 2665 | NM_0014 02.5_686 | 686 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATNGCCTTGGTTCAAGG GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 11 | XALVQGMESH P* |
| 2666 | NM_0014 02.5_687 | 687 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG | 10 | XLVQGMESHP* |

TABLE 3B-continued

| SEQ ID | identifier_position | position | modified RNA | PAP length | PAP |
|---|---|---|---|---|---|
| | | | CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGNCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2667 | NM_0014<br>02.5_689 | 689 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCNTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 9 | LVQGMESHP* |
| 2668 | NM_0014<br>02.5_690 | 690 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTNTGGTTCAAGG | 9 | XVQGMESHP* |

TABLE 3B-continued

| SEQ ID | identifier_position | position | modified RNA | PAP length | PAP |
|---|---|---|---|---|---|
| | | | GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2669 | NM_0014<br>02.5_693 | 693 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGNTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 8 | XQGMESHP* |
| 2670 | NM_0014<br>02.5_695 | 695 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTNCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 8 | XQGMESHP* |
| 2671 | NM_0014<br>02.5_696 | 696 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG | 7 | XGMESHP* |

TABLE 3B-continued

| SEQ ID | identifier_position | position | modified RNA | PAP length | PAP |
|---|---|---|---|---|---|
| | | | ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCNAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2672 | NM_0014<br>02.5_698 | 698 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAANGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 7 | XGMESHP* |
| 2673 | NM_0014<br>02.5_700 | 700 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT | 6 | XMESHP* |

TABLE 3B-continued

| SEQ ID | identifier_ position | position | modified RNA | PAP length | PAP |
|---|---|---|---|---|---|
| | | | GGAGCCAAGTGCTAACATGCCTTGGTTCAAGGN GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2674 | NM_0014 02.5_701 | 701 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG NATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 5 | MESHP* |
| 2675 | NM_0014 02.5_702 | 702 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ANTGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 5 | XESHP* |
| 2676 | NM_0014 02.5_705 | 705 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA | 4 | XSHP* |

TABLE 3B-continued

| SEQ ID | identifier_ position | position | modified RNA | PAP length | PAP |
|---|---|---|---|---|---|
| | | | CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGNAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2677 | NM_0014 02.5_706 | 706 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGANAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 4 | XSHP* |
| 2678 | NM_0014 02.5_707 | 707 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG | 4 | XSHP* |

TABLE 3B-continued

| SEQ ID | identifier_position | position | modified RNA | PAP length | PAP |
|---|---|---|---|---|---|
| | | | TGCCAATTTCTGGTTGGAATGGTGACAACATGCT<br>GGGAGCCAAGTGCTAACATGCCTTGGTTCAAGGG<br>ATGGAANAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2679 | NM_0014<br>02.5_708 | 708 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAANGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XHP* |
| 2680 | NM_0014<br>02.5_71 | 71 | CTTTTTCGCAACGGGTTTGCCGCCAGAACACAG<br>GTGTCGTGAAAACTACCCCTAAAAGCCAAAATG<br>GGAAANGGAAAAGACTCATATCAACATTGTCGTC<br>ATTGGACACGTAGATTCGGGCAAGTCCACCACT<br>ACTGGCCATCTGATCTATAAATGCGGTGGCATC<br>GACAAAAGAACCATTGAAAAATTTGAGAAGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 27 | XGKDSYQHC<br>RHWTRRFGQ<br>VHHYWPSDL* |
| 2681 | NM_0014<br>02.5_711 | 711 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA | 2 | XP* |

TABLE 3B-continued

| SEQ ID | identifier_ position | position | modified RNA | PAP length | PAP |
|---|---|---|---|---|---|
| | | | TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCNACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2682 | NM_0014 02.5_712 | 712 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCANCCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 2 | XP* |
| 2683 | NM_0014 02.5_715 | 715 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG | 1 | X* |

TABLE 3B-continued

| SEQ ID | identifier_ position | position | modified RNA | PAP length | PAP |
|---|---|---|---|---|---|
| | | | AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCNGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2684 | NM_0014 02.5_718 | 718 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA ACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTANAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 11 | XGWQCQWN HAA* |
| 2685 | NM_0014 02.5_719 | 719 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA ACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAANGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 11 | XGWQCQWN HAA* |

TABLE 3B-continued

| SEQ ID | identifier_position | position | modified RNA | PAP length | PAP |
|---|---|---|---|---|---|
| 2686 | NM_0014 02.5_721 | 721 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGNATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 10 | XWQCQWNHAA* |
| 2687 | NM_0014 02.5_725 | 725 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGNCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 8 | QCQWNHAA* |
| 2688 | NM_0014 02.5_726 | 726 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA | 8 | XCQWNHAA* |

TABLE 3B-continued

| SEQ ID | identifier_ position | position | modified RNA | PAP length | PAP |
|---|---|---|---|---|---|
| | | | AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCNAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2689 | NM_0014 02.5_728 | 728 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAANTGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 8 | XCQWNHAA* |
| 2690 | NM_0014 02.5_729 | 729 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAANTGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA | 7 | XQWNHAA* |

TABLE 3B-continued

| SEQ ID | identifier_position | position | modified RNA | PAP length | PAP |
|---|---|---|---|---|---|
| 2691 | NM_0014 02.5_730 | 730 | GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGNCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 7 | XQWNHAA* |
| 2692 | NM_0014 02.5_732 | 732 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCNA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 6 | XWNHAA* |
| 2693 | NM_0014 02.5_733 | 733 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG | 6 | XWNHAA* |

TABLE 3B-continued

| SEQ ID | identifier_position | position | modified RNA | PAP length | PAP |
|---|---|---|---|---|---|
| | | | AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAN<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2694 | NM_0014<br>02.5_734 | 734 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>NTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 6 | XWNHAA* |
| 2695 | NM_0014<br>02.5_735 | 735 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TNGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA | 5 | XNHAA* |

TABLE 3B-continued

| SEQ ID | identifier_ position | position | modified RNA | PAP length | PAP |
|---|---|---|---|---|---|
| 2696 | NM_0014 02.5_737 | 737 | TCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGNAACCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA | 4 | NHAA* |
| 2697 | NM_0014 02.5_739 | 739 | TCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAANCCACGCTGCTTGAGGCTCTGGACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 4 | XHAA* |
| 2698 | NM_0014 02.5_741 | 741 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT | 3 | XAA* |

TABLE 3B-continued

| SEQ ID | identifier_ position | position | modified RNA | PAP length | PAP |
|---|---|---|---|---|---|
| | | | GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCNACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2699 | NM_0014<br>02.5_742 | 742 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCANCGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XAA* |
| 2700 | NM_0014<br>02.5_743 | 743 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACNGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC | 2 | AA* |

TABLE 3B-continued

| SEQ ID | identifier_position | position | modified RNA | PAP length | PAP |
|---|---|---|---|---|---|
| | | | CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2701 | NM_0014<br>02.5_744 | 744 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCNTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 2 | XA* |
| 2702 | NM_0014<br>02.5_745 | 745 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCNTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 2 | XA* |
| 2703 | NM_0014<br>02.5_746 | 746 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC | 1 | A* |

TABLE 3B-continued

| SEQ ID | identifier_position | position | modified RNA | PAP length | PAP |
|---|---|---|---|---|---|
| | | | ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTNGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2704 | NM_0014 02.5_747 | 747 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGNCTTGAG GCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 1 | X* |
| 2705 | NM_0014 02.5_748 | 748 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCNTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA | 1 | X* |

TABLE 3B-continued

| SEQ ID | identifier_position | position | modified RNA | PAP length | PAP |
|---|---|---|---|---|---|
| | | | GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2706 | NM_0014<br>02.5_75 | 75 | CTTTTTCGCAACGGGTTTGCCGCCAGAACACAG<br>GTGTCGTGAAAACTACCCCTAAAAGCCAAAATG<br>GGAAAGGAANAAGACTCATATCAACATTGTCGTC<br>ATTGGACACGTAGATTCGGGCAAGTCCACCACT<br>ACTGGCCATCTGATCTATAAATGCGGTGGCATC<br>GACAAAAGAACCATTGAAAAATTTGAGAAGGAG<br>GCTGCTGAGATGGGAAAGGGCTCCTTCAAGTAT<br>GCCTGGGTCTTGGATAAACTGAAAGCTGAGCGT<br>GAACGTGGTATCACCATTGATATCTCCTTGTGGA<br>AATTTGAGACCAGCAAGTACTATGTGACTATCAT<br>TGATGCCCCAGGACACAGAGACTTTATCAAAAA<br>CATGATTACAGGGACATCTCAGGCTGACTGTGC<br>TGTCCTGATTGTTGCTGCTGGTGTTGGTGAATTT<br>GAAGCTGGTATCTCCAAGAATGGGCAGACCCGA<br>GAGCATGCCCTTCTGGCTTACACACTGGGTGTG<br>AAACAACTAATTGTCGGTGTTAACAAAATGGATT<br>CCACTGAGCCACCCTACAGCCAGAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 25 | XDSYQHCRH<br>WTRRFGQVH<br>HYWPSDL* |
| 2707 | NM_0014<br>02.5_750 | 750 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTNGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 13 | XGSGLHPTTN<br>SSN* |
| 2708 | NM_0014<br>02.5_752 | 752 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT | 13 | XGSGLHPTTN<br>SSN* |

| SEQ ID | identifier_position | position | modified RNA | PAP length | PAP |
|---|---|---|---|---|---|
| | | | GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGANGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2709 | NM_0014<br>02.5_754 | 754 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGNCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 12 | XSGLHPTTNS<br>SN* |
| 2710 | NM_0014<br>02.5_758 | 758 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTNGGACTGCA<br>TCCTACCACCAACTCGTCCAACTGACAAGCCCTT<br>GCGCCTGCCTCTCCAGGATGTCTACAAAATTGG | 10 | GLHPTTNSSN* |

TABLE 3B-continued

| SEQ ID | identifier_ position | position | modified RNA | PAP length | PAP |
|---|---|---|---|---|---|
| | | | TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2711 | NM_0014 02.5_76 | 76 | CTTTTTCGCAACGGGTTTGCCGCCAGAACACAG GTGTCGTGAAAACTACCCCTAAAAGCCAAAATG GGAAAGGAAAANAGACTCATATCAACATTGTCGTC ATTGGACACGTAGATTCGGGCAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 25 | XDSYQHCRH WTRRFGQVH HYWPSDL* |
| 2712 | NM_0014 02.5_760 | 760 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGNACTGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 10 | XLHPTTNSSN* |
| 2713 | NM_0014 02.5_763 | 763 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA | 9 | XHPTTNSSN* |

TABLE 3B-continued

| SEQ ID | identifier_ position | position | modified RNA | PAP length | PAP |
|---|---|---|---|---|---|
| | | | ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTNGCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | | |
| 2714 | NM_0014 02.5_764 | 764 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGNCA TCCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC AAGAATGTGTCTGTCAAGGATGTT | 9 | XHPTTNSSN* |
| 2715 | NM_0014 02.5_771 | 771 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTANCCACCAACTCGTCCAACTGACAAGCCCT | 6 | XTNSSN* |

TABLE 3B-continued

| SEQ ID | identifier_position | position | modified RNA | PAP length | PAP |
|---|---|---|---|---|---|
| | | | TGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2716 | NM_0014<br>02.5_773 | 773 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCNACCAACTCGTCCAACTGACAAGCCCT<br>TGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 5 | TNSSN* |
| 2717 | NM_0014<br>02.5_776 | 776 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCNAACTCGTCCAACTGACAAGCCCT<br>TGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | NSSN* |
| 2718 | NM_0014<br>02.5_778 | 778 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG | 4 | XSSN* |

TABLE 3B-continued

| SEQ ID | identifier_position | position | modified RNA | PAP length | PAP |
|---|---|---|---|---|---|
| | | | AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAANCTCGTCCAACTGACAAGCCCT<br>TGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2719 | NM_0014<br>02.5_781 | 781 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCNGTCCAACTGACAAGCCCT<br>TGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XSN* |
| 2720 | NM_0014<br>02.5_782 | 782 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT | 2 | SN* |

TABLE 3B-continued

| SEQ ID | identifier_position | position | modified RNA | PAP length | PAP |
|---|---|---|---|---|---|
| | | | CCTACCACCAACTCGNTCCAACTGACAAGCCCT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2721 | NM_0014 02.5_790 | 790 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGNACAAGCCCT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 54 | XQALAPASPG CLQNWWYWY CSCWPSGDW CSQTRYGGHL CSSQRYNGS KICRNAP* |
| 2722 | NM_0014 02.5_791 | 791 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGANCAAGCCCT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 54 | XQALAPASPG CLQNWWYWY CSCWPSGDW CSQTRYGGHL CSSQRYNGS KICRNAP* |
| 2723 | NM_0014 02.5_794 | 794 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG | 53 | XALAPASPGC LQNWWYWYC SCWPSGDWC SQTRYGGHLC SSQRYNGSKI CRNAP* |

TABLE 3B-continued

| SEQ ID | identifier_ position | position | modified RNA | PAP length | PAP |
|---|---|---|---|---|---|
| | | | CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAANGCCCT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2724 | NM_0014 02.5_795 | 795 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGNCCCT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 52 | XLAPASPGCL QNWWYWYC SCWPSGDWC SQTRYGGHLC SSQRYNGSKI CRNAP* |
| 2725 | NM_0014 02.5_798 | 798 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG | 51 | XAPASPGCLQ NWWYWYCSC WPSGDWCSQ TRYGGHLCSS QRYNGSKICR NAP* |

TABLE 3B-continued

| SEQ ID | identifier_position | position | modified RNA | PAP length | PAP |
|---|---|---|---|---|---|
| | | | TGGAACCACGCTGCTTGAGGCTCTGGACTGCAT CCTACCACCAACTCGTCCAACTGACAAGCCCNT TGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2726 | NM_0014 02.5_800 | 800 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT NGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 51 | XAPASPGCLQ NWWYWYCSC WPSGDWCSQ TRYGGHLCSS QRYNGSKICR NAP* |
| 2727 | NM_0014 02.5_801 | 801 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GN CGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 50 | XPASPGCLQN WWYWYCSC WPSGDWCSQ TRYGGHLCSS QRYNGSKICR NAP* |
| 2728 | NM_0014 02.5_805 | 805 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG | 49 | XASPGCLQN WWYWYCSC WPSGDWCSQ TRYGGHLCSS QRYNGSKICR NAP* |

TABLE 3B-continued

| SEQ ID | identifier_ position | position | modified RNA | PAP length | PAP |
|---|---|---|---|---|---|
| | | | CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCNTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2729 | NM_0014<br>02.5_807 | 807 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGNCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 48 | XSPGCLQNW<br>WYWYCSCWP<br>SGDWCSQTR<br>YGGHLCSSQ<br>RYNGSKICRN<br>AP* |
| 2730 | NM_0014<br>02.5_809 | 809 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG | 47 | SPGCLQNWW<br>YWYCSCWPS<br>GDWCSQTRY<br>GGHLCSSQR<br>YNGSKICRNA<br>P* |

TABLE 3B-continued

| SEQ ID | identifier_ position | position | modified RNA | PAP length | PAP |
|---|---|---|---|---|---|
| | | | ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCNTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2731 | NM_0014 02.5_810 | 810 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTNCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 47 | XPGCLQNWW YWYCSCWPS GDWCSQTRY GGHLCSSQR YNGSKICRNA P* |
| 2732 | NM_0014 02.5_815 | 815 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCANGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 46 | XGCLQNWWY WYCSCWPSG DWCSQTRYG GHLCSSQRYN GSKICRNAP* |
| 2733 | NM_0014 02.5_825 | 825 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG | 42 | XNWWYWYCS CWPSGDWCS QTRYGGHLCS SQRYNGSKIC RNAP* |

TABLE 3B-continued

| SEQ ID | identifier_ position | position | modified RNA | PAP length | PAP |
|---|---|---|---|---|---|
| | | | ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACNAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2734 | NM_0014 02.5_831 | 831 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTNG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 40 | XWYWYCSCW PSGDWCSQT RYGGHLCSS QRYNGSKICR NAP* |
| 2735 | NM_0014 02.5_833 | 833 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT | 39 | WYVVYCSCWP SGDWCSQTR YGGHLCSSQ RYNGSKICRN AP* |

TABLE 3B-continued

| SEQ ID | identifier_ position | position | modified RNA | PAP length | PAP |
|---|---|---|---|---|---|
| | | | GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG NTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2736 | NM_0014 02.5_836 | 836 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGNTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 38 | YWYCSCWPS GDWCSQTRY GGHLCSSQR YNGSKICRNA P* |
| 2737 | NM_0014 02.5_847 | 847 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTG NTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 35 | XSCWPSGDW CSQTRYGGHL CSSQRYNGS KICRNAP* |
| 2738 | NM_0014 02.5_849 | 849 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA | 34 | XCW PSG DWC SQTRYGG H LC SSQRYNGSKI CRNAP* |

TABLE 3B-continued

| SEQ ID | identifier_position | position | modified RNA | PAP length | PAP |
|---|---|---|---|---|---|
| | | | CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTNCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2739 | NM_0014 02.5_851 | 851 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCNTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 33 | CWPSGDWCS QTRYGGHLCS SQRYNGSKIC RNAP* |
| 2740 | NM_0014 02.5_853 | 853 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG | 33 | XVVPSGDWCS QTRYGGHLCS SQRYNGSKIC RNAP* |

TABLE 3B-continued

| SEQ ID | identifier_position | position | modified RNA | PAP length | PAP |
|---|---|---|---|---|---|
| | | | TGCCAATTTCTGGTTGGAATGGTGACAACATGCT<br>GGGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGNTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2741 | NM_0014<br>02.5_854 | 854 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTNTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 32 | WPSGDWCSQ<br>TRYGGHLCSS<br>QRYNGSKICR<br>NAP* |
| 2742 | NM_0014<br>02.5_859 | 859 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCNGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 31 | XSGDWCSQT<br>RYGGHLCSS<br>QRYNGSKICR<br>NAP* |

TABLE 3B-continued

| SEQ ID | identifier_position | position | modified RNA | PAP length | PAP |
|---|---|---|---|---|---|
| 2743 | NM_0014 02.5_861 | 861 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGANGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 30 | XGDWCSQTR YGGHLCSSQ RYNGSKICRN AP* |
| 2744 | NM_0014 02.5_863 | 863 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTNGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 29 | GDWCSQTRY GGHLCSSQR YNGSKICRNA P* |
| 2745 | NM_0014 02.5_865 | 865 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA | 29 | XDWCSQTRY GGHLCSSQR YNGSKICRNA P* |

TABLE 3B-continued

| SEQ ID | identifier_position | position | modified RNA | PAP length | PAP |
|---|---|---|---|---|---|
| | | | AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGN<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2746 | NM_0014<br>02.5_866 | 866 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TG GTATTGGTACTGTTCCTGTTGGCCGAGTGGA<br>NGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 29 | XDWCSQTRY<br>GGHLCSSQR<br>YNGSKICRNA<br>P* |
| 2747 | NM_0014<br>02.5_872 | 872 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGNTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA | 26 | CSQTRYGGHL<br>CSSQRYNGS<br>KICRNAP* |

TABLE 3B-continued

| SEQ ID | identifier_ position | position | modified RNA | PAP length | PAP |
|---|---|---|---|---|---|
| 2748 | NM_0014 02.5_873 | 873 | GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGT3GGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTNGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 26 | XSQTRYGGHL CSSQRYNGS KICRNAP* |
| 2749 | NM_0014 02.5_874 | 874 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGNTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 26 | XSQTRYGGHL CSSQRYNGS KICRNAP* |
| 2750 | NM_0014 02.5_882 | 882 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG | 23 | XRYGGHLCSS QRYNGSKICR NAP* |

TABLE 3B-continued

| SEQ ID | identifier_position | position | modified RNA | PAP length | PAP |
|---|---|---|---|---|---|
| | | | AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAANCCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2751 | NM_0014 02.5_885 | 885 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCNGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 22 | XYGGHLCSSQ RYNGSKICRN AP* |
| 2752 | NM_0014 02.5_89 | 89 | CTTTTTCGCAACGGGTTTGCCGCCAGAACACAG GTGTCGTGAAAACTACCCCTAAAAGCCAAAATG GGAAAGGAAAAGACTCATATCAANCATTGTCGTC ATTGGACACGTAGATTCGGGCAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA | 21 | XHCRHWTRR FGQVHHYWP SDL* |

TABLE 3B-continued

| SEQ ID | identifier_ position | position | modified RNA | PAP length | PAP |
|---|---|---|---|---|---|
| 2753 | NM_0014 02.5_892 | 892 | ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGNTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 20 | XGHLCSSQRY NGSKICRNAP* |
| 2754 | NM_0014 02.5_895 | 895 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGNTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 19 | XHLCSSQRYN GSKICRNAP* |
| 2755 | NM_0014 02.5_900 | 900 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT | 17 | XCSSQRYNG SKICRNAP* |

TABLE 3B-continued

| SEQ ID | identifier_position | position | modified RNA | PAP length | PAP |
|---|---|---|---|---|---|
| | | | GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CNTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2756 | NM_0014<br>02.5_902 | 902 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTNTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 17 | XCSSQRYNG<br>SKICRNAP* |
| 2757 | NM_0014<br>02.5_903 | 903 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC | 16 | XSSQRYNGSK<br>ICRNAP* |

TABLE 3B-continued

| SEQ ID | identifier_position | position | modified RNA | PAP length | PAP |
|---|---|---|---|---|---|
| | | | CTTTN GCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2758 | NM_0014 02.5_904 | 904 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTG NCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 16 | XSSQRYNGSK ICRNAP* |
| 2759 | NM_0014 02.5_914 | 914 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAANCGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 13 | XRYNGSKICR NAP* |
| 2760 | NM_0014 02.5_915 | 915 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC | 12 | XYNGSKICRN AP* |

TABLE 3B-continued

| SEQ ID | identifier_ position | position | modified RNA | PAP length | PAP |
|---|---|---|---|---|---|
| | | | ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACNGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2761 | NM_0014 02.5_916 | 916 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGNTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 12 | XYNGSKICRN AP* |
| 2762 | NM_0014 02.5_918 | 918 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA | 11 | XNGSKICRNA P* |

TABLE 3B-continued

| SEQ ID | identifier_position | position | modified RNA | PAP length | PAP |
|---|---|---|---|---|---|
| 2763 | NM_0014 02.5_923 | 923 | GACTGGTGTTCTCAAACCCGGTATGGTGGTCAC CTTTGCTCCAGTCAACGTTNACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACNGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | GSKICRNAP* |
| 2764 | NM_0014 02.5_925 | 925 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGNAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 9 | XSKICRNAP* |
| 2765 | NM_0014 02.5_927 | 927 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT | 8 | XKICRNAP* |

TABLE 3B-continued

| SEQ ID | identifier_position | position | modified RNA | PAP length | PAP |
|---|---|---|---|---|---|
| | | | GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAANGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 2766 | NM_0014 02.5_928 | 928 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGNTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 8 | XKICRNAP* |
| 2767 | NM_0014 02.5_931 | 931 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG | 7 | XICRNAP* |

TABLE 3B-continued

| SEQ ID | identifier_position | position | modified RNA | PAP length | PAP |
|---|---|---|---|---|---|
| | | | TGGTATTGGTACTGTTCCTGTTGGCCGAGTGGA GACTGGTGTTCTCAAACCCGGTATGGTGGTCAC CTTTGCTCCAGTCAACGTTACAACGGAAGTAANA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 2768 | NM_0014 02.5_937 | 937 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGNTCGAAATGCACCATGAAGCTTTGAGTGAA GCTCTTCCTGGGGACAATGTGGGCTTCAATGTC AAGAATGTGTCTGTCAAGGATGTT | 5 | XRNAP* |
| 2769 | NM_0014 02.5_939 | 939 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCNGAAATGCACCATGAAGCTTTGAGTGAA GCTCTTCCTGGGGACAATGTGGGCTTCAATGTC AAGAATGTGTCTGTCAAGGATGTT | 4 | XNAP* |
| 2770 | NM_0014 02.5_943 | 943 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA | 3 | XAP* |

TABLE 3B-continued

| SEQ ID | identifier_position | position | modified RNA | PAP length | PAP |
|---|---|---|---|---|---|
| | | | ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAANTGCACCATGAAGCTTTGAGTGAA GCTCTTCCTGGGGACAATGTGGGCTTCAATGTC AAGAATGTGTCTGTCAAGGATGTT | | |
| 2771 | NM_0014 02.5_949 | 949 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCNATGAAGCTTTGAGTGAA GCTCTTCCTGGGGACAATGTGGGCTTCAATGTC AAGAATGTGTCTGTCAAGGATGTT | 1 | X* |
| 2772 | NM_0014 02.5_951 | 951 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT | 4 | XSFE* |

TABLE 3B-continued

| SEQ ID | identifier_ position | position | modified RNA | PAP length | PAP |
|---|---|---|---|---|---|
| | | | GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATNGAAGCTTTGAGTGAA<br>GCTCTTCCTGGGGACAATGTGGGCTTCAATGTC<br>AAGAATGTGTCTGTCAAGGATGTT | | |
| 2773 | NM_0014 02.5_952 | 952 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGNAAGCTTTGAGTGAA<br>GCTCTTCCTGGGGACAATGTGGGCTTCAATGTC<br>AAGAATGTGTCTGTCAAGGATGTT | 4 | XSFE* |
| 2774 | NM_0014 02.5_954 | 954 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAANGCTTTGAGTGAA<br>GCTCTTCCTGGGGACAATGTGGGCTTCAATGTC<br>AAGAATGTGTCTGTCAAGGATGTT | 3 | XFE* |
| 2775 | NM_0014 02.5_955 | 955 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG | 3 | XFE* |

TABLE 3B-continued

| SEQ ID | identifier_position | position | modified RNA | PAP length | PAP |
|---|---|---|---|---|---|
| | | | AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGNCTTTGAGTGAA<br>GCTCTTCCTGGGGACAATGTGGGCTTCAATGTC<br>AAGAATGTGTCTGTCAAGGATGTT | | |
| 2776 | NM_0014<br>02.5_956 | 956 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCNTTTGAGTGAA<br>GCTCTTCCTGGGGACAATGTGGGCTTCAATGTC<br>AAGAATGTGTCTGTCAAGGATGTT | 2 | FE* |
| 2777 | NM_0014<br>02.5_959 | 959 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT | 2 | XE* |

TABLE 3B-continued

| SEQ ID | identifier_position | position | modified RNA | PAP length | PAP |
|---|---|---|---|---|---|
| | | | CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTNGAGTGAA<br>GCTCTTCCTGGGGACAATGTGGGCTTCAATGTC<br>AAGAATGTGTCTGTCAAGGATGTT | | |
| 2778 | NM_0014<br>02.5_966 | 966 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAAN<br>GCTCTTCCTGGGGACAATGTGGGCTTCAATGTC<br>AAGAATGTGTCTGTCAAGGATGTT | 26 | XSSWGQCGL<br>QCQECVCQG<br>CSSWQRCW* |
| 2779 | NM_0014<br>02.5_979 | 979 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGAGCCAAGTGCTAACATGCCTTGGTTCAAGGG<br>ATGGAAAGTCACCCGTAAGGATGGCAATGCCAG<br>TGGAACCACGCTGCTTGAGGCTCTGGACTGCAT<br>CCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGNACAATGTGGGCTTCAATGT<br>CAAGAATGTGTCTGTCAAGGATGTT | 22 | XQCGLQCQE<br>CVCQGCSSW<br>QRCW* |
| 2780 | NM_0014<br>02.5_983 | 983 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG | 21 | XCGLQCQEC<br>VCQGCSSWQ<br>RCW* |

TABLE 3B-continued

| SEQ ID | identifier_position | position | modified RNA | PAP length | PAP |
|---|---|---|---|---|---|
| | | | CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAANTGTGGGCTTCAATGT CAAGAATGTGTCTGTCAAGGATGTT | | |
| 2781 | NM_0014 02.5_989 | 989 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGNCTTCAATGT CAAGAATGTGTCTGTCAAGGATGTT | 18 | LQCQECVCQ GCSSWQRCW |
| 2782 | NM_0014 02.5_995 | 995 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG | 17 | XCQECVCQG CSSWQRCW* |

TABLE 3B-continued

| SEQ ID | identifier_position | position | modified RNA | PAP length | PAP |
|---|---|---|---|---|---|
| | | | TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAANTGT CAAGAATGTGTCTGTCAAGGATGTT | | |
| 2783 | NM_0014 02.5_999 | 999 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGCTAACATGCCTTGGTTCAAGGG ATGGAAAGTCACCCGTAAGGATGGCAATGCCAG TGGAACCACGCTGCTTGAGGCTCTGGACTGCAT CCTACCACCAACTCGTCCAACTGACAAGCCCTT GCGCCTGCCTCTCCAGGATGTCTACAAAATTGG TGGTATTGGTACTGTTCCTGTTGGCCGAGTGGA GACTGGTGTTCTCAAACCCGGTATGGTGGTCAC CTTTGCTCCAGTCAACGTTACAACGGAAGTAAAA TCTGTCGAAATGCACCATGAAGCTTTGAGTGAA GCTCTTCCTGGGGACAATGTGGGCTTCAATGTC NAAGAATGTGTCTGTCAAGGATGTT | 15 | XECVCQGCS SWQRCW* |
| 2784 | NM_0014 04.4_198 | 198 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGNC TCTCATCGCTGCTCAGTACAGCGGGGCTCAGGT CCGCGTGCTCTCCGCACCACCCCACTTCCATTT TGGCCAAACCAACCGCACCCCTGAATTTCTCCG CAAATTTCCTGCCGGCAAGGTCCCAGCATTTGA GGGTGATGATGGATTCTGTGTGTTTGAGAGCAA CGCCATTGCCTACTATGTGAGCAATGAGGAGCT GCGGGGAAGTACTCCAGAGGCAGCAGCCCAGG TGGTGCAGTGGGTGAGCTTTGCTGATTCCGATA TAGTGCCCCCAGCCAGTACCTGGGTGTTCCCCA CCTTGGGCATCATGCACCACAACAAACAGGCCA CTGAGAATGCAAAGGAGGAAGTGAGGCGAATTC TGGGGCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 30 | XSHRCSVQR GSGPRALRTT PLPFWPNQPH P* |
| 2785 | NM_0014 04.4_246 | 246 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT | 14 | XTTPLPFWPN QPHP* |

TABLE 3B-continued

| SEQ ID | identifier_ position | position | modified RNA | PAP length | PAP |
|---|---|---|---|---|---|
| | | | CTCATCGCTGCTCAGTACAGCGGGGCTCAGGTC CGCGTGCTCTCCGNCACCACCCCACTTCCATTT TGGCCAAACCAACCGCACCCCTGAATTTCTCCG CAAATTTCCTGCCGGCAAGGTCCCAGCATTTGA GGGTGATGATGGATTCTGTGTGTTTGAGAGCAA CGCCATTGCCTACTATGTGAGCAATGAGGAGCT GCGGGGAAGTACTCCAGAGGCAGCAGCCCAGG TGGTGCAGTGGGTGAGCTTTGCTGATTCCGATA TAGTGCCCCCAGCCAGTACCTGGGTGTTCCCCA CCTTGGGCATCATGCACCACAACAAACAGGCCA CTGAGAATGCAAAGGAGGAAGTGAGGCGAATTC TGGGGCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | | |
| 2786 | NM_0014 04.4_540 | 540 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGT3AGCTTTGCTGATTCCGATAT AGTGCCCCCAGCCAGTACCTGGGTGTTCCCCAC CTTGGGCATCATGCACCACAACAAACAGGCCAC TGAGAATGCAANAGGAGGAAGTGAGGCGAATTC TGGGGCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 29 | XGGSEANSG AAGCLLEDED FSGGRTSDIG* |
| 2787 | NM_0014 04.4_548 | 548 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAANGTGAGGCGAATTC TGGGGCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC | 26 | XEANSGAAGC LLEDEDFSGG RTSDIG* |

TABLE 3B-continued

| SEQ ID | identifier_ position | position | modified RNA | PAP length | PAP |
|---|---|---|---|---|---|
| | | | CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | | |
| 2788 | NM_0014 04.4_558 | 558 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAANTTC TGGGGCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 23 | XSGAAGCLLE DEDFSGGRTS DIG* |
| 2789 | NM_0014 04.4_566 | 566 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGNCTGCTGGATGCTTACTTGAAGACGAGGA CTTTTCTGGTGGGCGAACGAGTGACATTGGCTG ACATCACAGTTGTCTGCACCCTGTTGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 20 | XAGCLLEDED FSGGRTSDIG* |
| 2790 | NM_0014 04.4_586 | 586 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC | 14 | XDEDFSGGRT SDIG* |

TABLE 3B-continued

| SEQ ID | identifier_position | position | modified RNA | PAP length | PAP |
|---|---|---|---|---|---|
| | | | ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAANGACGAGGA<br>CTTTTCTGGTGGGCGAACGAGTGACATTGGCTG<br>ACATCACAGTTGTCTGCACCCTGTTGTGGCTCTA<br>TAAGCAGGTTCTAGAGCCTTCTTTCCGCCAGGC<br>CTTTCCCAATACCAACCGCTGGTTCCTCACCTGC<br>ATTAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | | |
| 2791 | NM_0014<br>04.4_636 | 636 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGNTTGTCTGCACCCTGTTGTGGCTCTA<br>TAAGCAGGTTCTAGAGCCTTCTTTCCGCCAGGC<br>CTTTCCCAATACCAACCGCTGGTTCCTCACCTGC<br>ATTAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | 9 | XCLHPVVAL* |
| 2792 | NM_0014<br>04.4_638 | 638 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGT3AGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTNGTCTGCACCCTGTTGTGGCTCTA | 8 | XLHPVVAL* |

TABLE 3B-continued

| SEQ ID | identifier_position | position | modified RNA | PAP length | PAP |
|---|---|---|---|---|---|
| 2793 | NM_0014 04.4_652 | 652 | TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCAACGAGTGACATTGGCTGA CATCACAGTTGTCTGCACCCTGTTNGTGGCTCTA TAAGCAGGTTCTAGAGCCTTCTTTCCGCCAGGC CTTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 4 | XVAL* |
| 2794 | NM_0014 04.4_703 | 703 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGC ATTAACCAGCCCCAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 10 | XYQPLVPHLH* |
| 2795 | NM_0014 04.4_709 | 709 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT | 8 | XPLVPHLH* |

| SEQ ID | identifier_position | position | modified RNA | PAP length | PAP |
|---|---|---|---|---|---|
| | | | GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAANCCGCTGGTTCCTCACCTGC<br>ATTAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | | |
| 2796 | NM_0014 04.4_731 | 731 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTNAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | 15 | XPAPVPGCLG RSETV* |
| 2797 | NM_0014 04.4_741 | 741 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA | 12 | XVPGCLGRSE TV* |

TABLE 3B-continued

| SEQ ID | identifier_ position | position | modified RNA | PAP length | PAP |
|---|---|---|---|---|---|
| | | | CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCNAGTTCCGGGCTGTCTTGGGC GAAGTGAAACTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | | |
| 2798 | NM_0014 04.4_771 | 771 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACNTGTGTGAGAAGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 2 | XV* |
| 2799 | NM_0014 04.4_781 | 781 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAANGATGGCCCAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 5 | XDGPV* |

TABLE 3B-continued

| SEQ ID | identifier_ position | position | modified RNA | PAP length | PAP |
|---|---|---|---|---|---|
| 2800 | NM_0014 04.4_789 | 789 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCNAGTTT GATGCTAAAAAGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 2 | XV* |
| 2801 | NM_0014 04.4_805 | 805 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAANGTTTGCAGAGACCCAACCTAAAA AGGACACACCACGGAAAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 7 | XVCRDPT* |
| 2802 | NM_0014 04.4_838 | 838 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC | 15 | TEREGFTGRE AEAPG* |

TABLE 3B-continued

| SEQ ID | identifier_position | position | modified RNA | PAP length | PAP |
|---|---|---|---|---|---|
| | | | CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCNACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | | |
| 2803 | NM_0014 04.4_840 | 840 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCACNGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | 15 | XEREGFTGRE AEAPG* |
| 2804 | NM_0014 04.4_842 | 842 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCACGGNAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG | 14 | XREGFTGREA EAPG* |

TABLE 3B-continued

| SEQ ID | identifier_position | position | modified RNA | PAP length | PAP |
|---|---|---|---|---|---|
| 2805 | NM_0014 04.4_844 | 844 | GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAANAGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 14 | XREGFTGREA EAPG* |
| 2806 | NM_0014 04.4_845 | 845 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAANGAGAAGGGTTCACGG GAAGAGAAGCAGAAGCCCCAGGCTGAGCGGAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT | 13 | XEGFTGREAE APG* |
| 2807 | NM_0014 04.4_861 | 861 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT | 8 | XREAEAPG* |

TABLE 3B-continued

| SEQ ID | identifier_position | position | modified RNA | PAP length | PAP |
|---|---|---|---|---|---|
| | | | GGTGCAGTGGGT3AGCTTTGCTGATTCCGATAT<br>AGTGCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCACGGAAAGAGAAGGGTTCACGGG<br>NAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | | |
| 2808 | NM_0014<br>04.4_863 | 863 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCACGGAAAGAGAAGGGTTCACGGG<br>AANGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | 7 | XEAEAPG* |
| 2809 | NM_0014<br>04.4_874 | 874 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGATGCTTACTTGAAGACGAGGAC<br>TTTTCTGGTGGGCGAACGAGTGACATTGGCTGA<br>CATCACAGTTGTCTGCACCCTGTTGTGGCTCTAT<br>AAGCAGGTTCTAGAGCCTTCTTTCCGCCAGGCC<br>TTTCCCAATACCAACCGCTGGTTCCTCACCTGCA<br>TTAACCAGCCCCAGTTCCGGGCTGTCTTGGGCG<br>AAGTGAAACTGTGTGAGAAGATGGCCCAGTTTG<br>ATGCTAAAAAGTTTGCAGAGACCCAACCTAAAAA<br>GGACACACCACGGAAAGAGAAGGGTTCACGGG<br>AAGAGAAGCAGAANGCCCCAGGCTGAGCGGAA<br>GGAGGAGAAAAAGGCGGCTGCCCCTGCTCCTG | 4 | XAPG* |

TABLE 3B-continued

| SEQ ID | identifier_position | position | modified RNA | PAP length | PAP |
|---|---|---|---|---|---|
| 2810 | NM_0014 04.4_879 | 879 | AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAAGAGAAGGGTTCACGGG AAGAGAAGCAGAAGCCCCNAGGCTGAGCGGAA GGAGGAGAAAAAGGCGGCTGCCCCTGCTCCTG | 2 | XG* |
| 2811 | NM_0014 04.4_882 | 882 | AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAAGAGAAGGGTTCACGGG AAGAGAAGCAGAAGCCCCAGGNCTGAGCGGAA GGAGGAGAAAAAGGCGGCTGCCCCTGCTCCTG | 1 | X* |
| 2812 | NM_0014 04.4_890 | 890 | AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG | 11 | XGGEKGGCP CS* |

TABLE 3B-continued

| SEQ ID | identifier_position | position | modified RNA | PAP length | PAP |
|---|---|---|---|---|---|
| 2813 | NM_0014 04.4_983 | 983 | CGGGGAAGTACTCCAGAGGCAGCAGCCCAGGT GGTGCAGTGGGTGAGCTTTGCTGATTCCGATAT AGTGCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAAGAGAAGGGTTCACGGG AAGAGAAGCAGAAGCCCCAGGCTGAGCGGNAA GGAGGAGAAAAAGGCGGCTGCCCCTGCTCCTG AGGAGGAGATGGATGAATGTGAGCAGGCGCTG GCTGCTGAGCCCAAGGCCAAGGACCCCTTCGCT CACCTGCCCAAGAGTACCTTTGTGTTGGATGAAT AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAAGAGAAGGGTTCACGGG AAGAGAAGCAGAAGCCCCAGGCTGAGCGGAAG GAGGAGAAAAAGGCGGCTGCCCCTGCTCCTGA GGAGGAGATGGATGAATGTGAGCAGGCGCTGG CTGCTGAGCCCAAGGCCAAGGACCCCNTTCGCT CACCTGCCCAAGAGTACCTTTGTGTTGGATGAAT | 12 | XRSPAQEYLC VG* |
| 2814 | NM_0014 04.4_985 | 985 | AACTGTCGTACGTATGTCTTCTGTTTCGTCCTCG CTTTCCGGCTGCTGTTTCTCCACGGCTCTCCTCT TTCCCCCTCCCTTCTCTCCCGGGCGGCTTACTTT GCGGCAGCGCCGAGAACCCCACCCCCTTTCTTT GCGGAATCACCATGGCGGCTGGGACCCTGTAC ACGTATCCTGAAAACTGGAGGGCCTTCAAGGCT CTCATCGCTGCTCAGTACAGCGGGGCTCAGGTC CGCGTGCTCTCCGCACCACCCCACTTCCATTTT GGCCAAACCAACCGCACCCCTGAATTTCTCCGC AAATTTCCTGCCGGCAAGGTCCCAGCATTTGAG GGTGATGATGGATTCTGTGTGTTTGAGAGCAAC GCCATTGCCTACTATGTGAGCAATGAGGAGCTG CGGGGAAGTACTCCAGAGGCAGCAGCCCAGGT GGTGCAGTGGGTGAGCTTTGCTGATTCCGATAT AGTGCCCCAGCCAGTACCTGGGTGTTCCCCAC CTTGGGCATCATGCACCACAACAAACAGGCCAC TGAGAATGCAAAGGAGGAAGTGAGGCGAATTCT GGGGCTGCTGGATGCTTACTTGAAGACGAGGAC TTTTCTGGTGGGCGAACGAGTGACATTGGCTGA CATCACAGTTGTCTGCACCCTGTTGTGGCTCTAT AAGCAGGTTCTAGAGCCTTCTTTCCGCCAGGCC TTTCCCAATACCAACCGCTGGTTCCTCACCTGCA TTAACCAGCCCCAGTTCCGGGCTGTCTTGGGCG AAGTGAAACTGTGTGAGAAGATGGCCCAGTTTG ATGCTAAAAAGTTTGCAGAGACCCAACCTAAAAA GGACACACCACGGAAAGAGAAGGGTTCACGGG AAGAGAAGCAGAAGCCCCAGGCTGAGCGGAAG | 12 | XRSPAQEYLC VG* |

TABLE 3B-continued

| SEQ ID | identifier_ position | position | modified RNA | PAP length | PAP |
|---|---|---|---|---|---|
| 2815 | NM_0014 16.2_708 | 708 | GAGGAGAAAAAGGCGGCTGCCCCTGCTCCTGA GGAGGAGATGGATGAATGTGAGCAGGCGCTGG CTGCTGAGCCCAAGGCCAAGGACCCCTTNCGCT CACCTGCCCAAGAGTACCTTTGTGTTGGATGAAT GCAGGCGGGGCCGGGGCGGCCAAACCAATGC GATGGCCGGGGCGGAGTCGGGCGCTCTATAAG TTGTCGATAGGCGGGCACTCCGCCCTAGTTTCT AAGGATCATGTCTGCGAGCCAGGATTCCCGATC CAGAGACAATGGCCCCGATGGGATGGAGCCCG AAGGCGTCATCGAGAGTAACTGGAATGAGATTG TTGACAGCTTTGATGACATGAACCTCTCGGAGTC CCTTCTCCGTGGCATCTACGCGTATGGTTTTGA GAAGCCCTCTGCCATCCAGCAGCGAGCCATTCT ACCTTGTATCAAGGGTTATGATGTGATTGCTCAA GCCCAATCTGGGACTGGGAAAACGGCCACATTT GCCATATCGATTCTGCAGCAGATTGAATTAGATC TAAAAGCCACCCAGGCCTTGGTCCTAGCACCCA CTCGAGAATTGGCTCAGCAGATACAGAAGGTGG TCATGGCACTAGGAGACTACATGGGCGCCTCCT GTCACGCCTGTATCGGGGGCACCAACGTGCGT GCTGAGGTGCAGAAACTGCAGATGGAAGCTCCC CACATCATCGTGGGTACCCCTGGCCGTGTGTTT GATATGCTTAACCGGAGATACCTGTCCCCCAAAT ACATCAAGATGTTTGTACTGGATGAAGCTGACGA AATGTTAAGCCGTGGATTCAAGGACCAGATCTAT GACATATTCCAAAANGCTCAACAGCAACACCCA GGTAGTTTTGCTGTCAGCCACAATGCCTTCTGAT GTGCTTGAGGTGACCAAGAAGTTCATGAGGGAC CCCATTCGGATTCTTGTCAAGAAGGAAGAGTTG ACCCTGGAGGGTATCCGCCAGTTCTACATCAAC GTGGAACGAGAG3AGTGGAAGCTGGACACACT ATGTGACTTGTATGAAACCCTGACCATCACCCAG GCAGTCATCTTCATCAACACCCGGAGGAAGGTG GACTGGCTCACCGAGAAGATGCATGCTCGAGAT TTCACTGTATCCGCCATGCATGGAGATATGGA | 17 | XAQQQHPGS FAVSHNAF* |
| 2816 | NM_0014 28.2_1103 | 1103 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCTGTACCGCCACATCGCTGACTTGGC TGGCAACTCTGAAGTCATCCTGCCAGTCCCGGC GTTCAATGTCATCAATGGCGGTTCTCATGCTGG CAACAAGCTGGCCATGCAGGAGTTCATGATCCT CCCAGTCGGTGCAGCAAACTTCAGGGAAGCCAT GCGCATTGGAGCAGAGGTTTACCACAACCTGAA GAATGTCATCAAGGAGAAATATGGGAAAGATGC CACCAATGTGGGGATGAAGGCGGGTTTGCTCC CAACATCCTGGAGAATAAAGAAGGCCTGGAGCT GCTGAAGACTGCTATTGGGAAAGCTGGCTACAC TGATAAGGTGGTCATCGGCATGGACGTAGCGGC CTCCGAGTTCTTCAGGTCTGGGAAGTATGACCT GGACTTCAAGTCTCCCGATGACCCCAGCAGGTA CATCTCGCCTGACCAGCTGGCTGACCTGTACAA GTCCTTCATCAAGGACTACCCAGTGGTGTCT | 1 | X* |
| 2817 | NM_0014 28.2_152 | 152 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCANTGTCTATTCTCA AGATCCATGCCAGGGAGATCTTTGACTCTCGCG GGAATCCCACTGTTGAGGTTGATCTCTTCACCTC AAAAGGTCTCTTCAGAGCTGCTGTGCCCAGTGG TGCTTCAACTGGTATCTATGAGGCCCTAGAGCT CCGGGACAATGATAAGACTCGCTATATGGGGAA GGGTGTCTCAAAGGCTGTTGAGCACATCAATAA | 12 | XVYSQDPCQ GDL* |

TABLE 3B-continued

| SEQ ID | identifier_ position | position | modified RNA | PAP length | PAP |
|---|---|---|---|---|---|
| | | | AACTATTGCGCCTGCCCTGGTTAGCAAGAAACT GAACGTCACAGAACAAGAGAAGATTGACAAACT GATGATCGAGATGGATGGAACAGAAAATAAATCT AAGTTTGGTGCGAACGCCATTCTGGGGGTGTCC CTTGCCGTCTGCAAAGCTGGTGCCGTTGAGAAG GGGGTCCCCCTGTACCGCCACATCGCTGACTTG GCTGGCAACTCTGAAGTCATCCTGCCAGTCCCG GCGTTCAATGTCATCAATGGCGGTTCTCATGCT GGCAACAAGCTGGCCATGCAGGAGTTCATGATC CTCCCAGTCGGTGCAGCAAACTTCAGGGAAGCC ATGCGCATTGGAGCAGAGGTTTACCACAACCTG AAGAATGTCATCAAGGAGAAATATGGGAAAGAT GCCACCAATGTGGGGGATGAAGGCGGGTTTGC TCCCAACATCCTGGAGAATAAAGAAGGCCTGGA GCTGCTGAAGACTGCTATTGGGAAAGCTGGCTA CACTGATAAGGTGGTCATCGGCATGGACGTAGC GGCCTCCGAGTTCTTCAGGTCTGGGAAGTATGA CCTGGACTTCAAGTCTCCCGATGACCCCAGCAG GTACATCTCGCCTGACCAGCTGGCTGACCTGTA CAAGTCCTTCATCAAGGACTACCCAGTGGTGTC | | |
| 2818 | NM_0014 28.2_195 | 195 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGNCG GGAATCCCACTGTTGAGGTTGATCTCTTCACCTC AAAAGGTCTCTTCAGAGCTGCTGTGCCCAGTGG TGCTTCAACTGGTATCTATGAGGCCCTAGAGCT CCGGGACAATGATAAGACTCGCTATATGGGGAA GGGTGTCTCAAAGGCTGTTGAGCACATCAATAA AACTATTGCGCCTGCCCTGGTTAGCAAGAAACT GAACGTCACAGAACAAGAGAAGATTGACAAACT GATGATCGAGATGGATGGAACAGAAAATAAATCT AAGTTTGGTGCGAACGCCATTCTGGGGGTGTCC CTTGCCGTCTGCAAAGCTGGTGCCGTTGAGAAG GGGGTCCCCCTGTACCGCCACATCGCTGACTTG GCTGGCAACTCTGAAGTCATCCTGCCAGTCCCG GCGTTCAATGTCATCAATGGCGGTTCTCATGCT GGCAACAAGCTGGCCATGCAGGAGTTCATGATC CTCCCAGTCGGTGCAGCAAACTTCAGGGAAGCC ATGCGCATTGGAGCAGAGGTTTACCACAACCTG AAGAATGTCATCAAGGAGAAATATGGGAAAGAT GCCACCAATGTGGGGGATGAAGGCGGGTTTGC TCCCAACATCCTGGAGAATAAAGAAGGCCTGGA GCTGCTGAAGACTGCTATTGGGAAAGCTGGCTA CACTGATAAGGTGGTCATCGGCATGGACGTAGC GGCCTCCGAGTTCTTCAGGTCTGGGAAGTATGA CCTGGACTTCAAGTCTCCCGATGACCCCAGCAG GTACATCTCGCCTGACCAGCTGGCTGACCTGTA CAAGTCCTTCATCAAGGACTACCCAGTGGTGTC | 5 | RESHC* |
| 2819 | NM_0014 28.2_246 | 246 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGNAGCTGCTGTGCCCAGTGG TGCTTCAACTGGTATCTATGAGGCCCTAGAGCT CCGGGACAATGATAAGACTCGCTATATGGGGAA GGGTGTCTCAAAGGCTGTTGAGCACATCAATAA AACTATTGCGCCTGCCCTGGTTAGCAAGAAACT GAACGTCACAGAACAAGAGAAGATTGACAAACT GATGATCGAGATGGATGGAACAGAAAATAAATCT AAGTTTGGTGCGAACGCCATTCTGGGGGTGTCC CTTGCCGTCTGCAAAGCTGGTGCCGTTGAGAAG GGGGTCCCCCTGTACCGCCACATCGCTGACTTG GCTGGCAACTCTGAAGTCATCCTGCCAGTCCCG GCGTTCAATGTCATCAATGGCGGTTCTCATGCT GGCAACAAGCTGGCCATGCAGGAGTTCATGATC CTCCCAGTCGGTGCAGCAAACTTCAGGGAAGCC ATGCGCATTGGAGCAGAGGTTTACCACAACCTG AAGAATGTCATCAAGGAGAAATATGGGAAAGAT GCCACCAATGTGGGGGATGAAGGCGGGTTTGC TCCCAACATCCTGGAGAATAAAGAAGGCCTGGA GCTGCTGAAGACTGCTATTGGGAAAGCTGGCTA | 13 | XSCCAQWCF NWYL* |

TABLE 3B-continued

| SEQ ID | identifier_position | position | modified RNA | PAP length | PAP |
|---|---|---|---|---|---|
| 2820 | NM_0014 28.2_264 | 264 | CACTGATAAGGTGGTCATCGGCATGGACGTAGC GGCCTCCGAGTTCTTCAGGTCTGGGAAGTATGA CCTGGACTTCAAGTCTCCCGATGACCCCAGCAG GTACATCTCGCCTGACCAGCTGGCTGACCTGTA CAAGTCCTTCATCAAGGACTACCCAGTGGTGTC TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGN TGCTTCAACTGGTATCTATGAGGCCCTAGAGCT CCGGGACAATGATAAGACTCGCTATATGGGGAA GGGTGTCTCAAAGGCTGTTGAGCACATCAATAA AACTATTGCGCCTGCCCTGGTTAGCAAGAAACT GAACGTCACAGAACAAGAGAAGATTGACAAACT GATGATCGAGATGGATGGAACAGAAAATAAATCT AAGTTTGGTGCGAACGCCATTCTGGGGGTGTCC CTTGCCGTCTGCAAAGCTGGTGCCGTTGAGAAG GGGGTCCCCCTGTACCGCCACATCGCTGACTTG GCTGGCAACTCTGAAGTCATCCTGCCAGTCCCG GCGTTCAATGTCATCAATGGCGGTTCTCATGCT GGCAACAAGCTGGCCATGCAGGAGTTCATGATC CTCCCAGTCGGTGCAGCAAACTTCAGGGAAGCC ATGCGCATTGGAGCAGAGGTTTACCACAACCTG AAGAATGTCATCAAGGAGAAATATGGGAAAGAT GCCACCAATGTGGGGGATGAAGGCGGGTTTGC TCCCAACATCCTGGAGAATAAAGAAGGCCTGGA GCTGCTGAAGACTGCTATTGGGAAAGCTGGCTA CACTGATAAGGTGGTCATCGGCATGGACGTAGC GGCCTCCGAGTTCTTCAGGTCTGGGAAGTATGA CCTGGACTTCAAGTCTCCCGATGACCCCAGCAG GTACATCTCGCCTGACCAGCTGGCTGACCTGTA CAAGTCCTTCATCAAGGACTACCCAGTGGTGTC TAGCTAGGCAGGAAGTCGGCGCGGGCGGCGCG | 6 | CFNWYL* |
| 2821 | NM_0014 28.2_273 | 273 | GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACNTGGTATCTATGAGGCCCTAGAGCT CCGGGACAATGATAAGACTCGCTATATGGGGAA GGGTGTCTCAAAGGCTGTTGAGCACATCAATAA AACTATTGCGCCTGCCCTGGTTAGCAAGAAACT GAACGTCACAGAACAAGAGAAGATTGACAAACT GATGATCGAGATGGATGGAACAGAAAATAAATCT AAGTTTGGTGCGAACGCCATTCTGGGGGTGTCC CTTGCCGTCTGCAAAGCTGGTGCCGTTGAGAAG GGGGTCCCCCTGTACCGCCACATCGCTGACTTG GCTGGCAACTCTGAAGTCATCCTGCCAGTCCCG GCGTTCAATGTCATCAATGGCGGTTCTCATGCT GGCAACAAGCTGGCCATGCAGGAGTTCATGATC CTCCCAGTCGGTGCAGCAAACTTCAGGGAAGCC ATGCGCATTGGAGCAGAGGTTTACCACAACCTG AAGAATGTCATCAAGGAGAAATATGGGAAAGAT GCCACCAATGTGGGGGATGAAGGCGGGTTTGC TCCCAACATCCTGGAGAATAAAGAAGGCCTGGA GCTGCTGAAGACTGCTATTGGGAAAGCTGGCTA CACTGATAAGGTGGTCATCGGCATGGACGTAGC GGCCTCCGAGTTCTTCAGGTCTGGGAAGTATGA CCTGGACTTCAAGTCTCCCGATGACCCCAGCAG GTACATCTCGCCTGACCAGCTGGCTGACCTGTA CAAGTCCTTCATCAAGGACTACCCAGTGGTGTC TAGCTAGGCAGGAAGTCGGCGCGGGCGGCGCG | 3 | WYL* |
| 2822 | NM_0014 28.2_417 | 417 | GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG | 2 | XD* |

TABLE 3B-continued

| SEQ ID | identifier_position | position | modified RNA | PAP length | PAP |
|---|---|---|---|---|---|
| | | | GGTGTCTCAAAGGCTGTTGAGCACATCAATAAAA<br>CTATTGCGCCTGCCCTGGTTAGCAAGAAACTGA<br>ACGTCACAGAACAAGAGAANGATTGACAAACTG<br>ATGATCGAGATGGATGGAACAGAAAATAAATCTA<br>AGTTTGGTGCGAACGCCATTCTGGGGGTGTCCC<br>TTGCCGTCTGCAAAGCTGGTGCCGTTGAGAAGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | | |
| 2823 | NM_0014<br>28.2_427 | 427 | TAGCTAGGCAGGAAGTCGGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAANCTG<br>ATGATCGAGATGGATGGAACAGAAAATAAATCTA<br>AGTTTGGTGCGAACGCCATTCTGGGGGTGTCCC<br>TTGCCGTCTGCAAAGCTGGTGCCGTTGAGAAGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | 10 | XDDRDGWNR<br>K* |
| 2824 | NM_0014<br>28.2_454 | 454 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAANAATAAATCTA<br>AGTTTGGTGCGAACGCCATTCTGGGGGTGTCCC<br>TTGCCGTCTGCAAAGCTGGTGCCGTTGAGAAGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC | 1 | X* |

TABLE 3B-continued

| SEQ ID | identifier_ position | position | modified RNA | PAP length | PAP |
|---|---|---|---|---|---|
| | | | TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | | |
| 2825 | NM_0014 28.2_500 | 500 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGNCCGTCTGCAAAGCTGGTGCCGTTGAGAAGG GGGTCCCCCTGTACCGCCACATCGCTGACTTGG CTGGCAACTCTGAAGTCATCCTGCCAGTCCCGG CGTTCAATGTCATCAATGGCGGTTCTCATGCTG GCAACAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | 8 | XRLQSWCR* |
| 2826 | NM_0014 28.2_511 | 511 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAANGCTGGTGCCGTTGAGAAGG GGGTCCCCCTGTACCGCCACATCGCTGACTTGG CTGGCAACTCTGAAGTCATCCTGCCAGTCCCGG CGTTCAATGTCATCAATGGCGGTTCTCATGCTG GCAACAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | 4 | XVVCR* |
| 2827 | NM_0014 28.2_512 | 512 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC | 4 | XWCR* |

TABLE 3B-continued

| SEQ ID | identifier_position | position | modified RNA | PAP length | PAP |
|---|---|---|---|---|---|
| | | | CGGGACAATGATAAGACTCGCTATATGGGGAAG | | |
| | | | GGTGTCTCAAAGGCTGTTGAGCACATCAATAAAA | | |
| | | | CTATTGCGCCTGCCCTGGTTAGCAAGAAACTGA | | |
| | | | ACGTCACAGAACAAGAGAAGATTGACAAACTGA | | |
| | | | TGATCGAGATGGATGGAACAGAAAATAAATCTAA | | |
| | | | GTTTGGTGCGAACGCCATTCTGGGGGTGTCCCT | | |
| | | | TGCCGTCTGCAAAGNCTGGTGCCGTTGAGAAGG | | |
| | | | GGGTCCCCCTGTACCGCCACATCGCTGACTTGG | | |
| | | | CTGGCAACTCTGAAGTCATCCTGCCAGTCCCGG | | |
| | | | CGTTCAATGTCATCAATGGCGGTTCTCATGCTG | | |
| | | | GCAACAAGCTGGCCATGCAGGAGTTCATGATCC | | |
| | | | TCCCAGTCGGTGCAGCAAACTTCAGGGAAGCCA | | |
| | | | TGCGCATTGGAGCAGAGGTTTACCACAACCTGA | | |
| | | | AGAATGTCATCAAGGAGAAATATGGGAAAGATG | | |
| | | | CCACCAATGTGGGGGATGAAGGCGGGTTTGCTC | | |
| | | | CCAACATCCTGGAGAATAAAGAAGGCCTGGAGC | | |
| | | | TGCTGAAGACTGCTATTGGGAAAGCTGGCTACA | | |
| | | | CTGATAAGGTGGTCATCGGCATGGACGTAGCGG | | |
| | | | CCTCCGAGTTCTTCAGGTCTGGGAAGTATGACC | | |
| | | | TGGACTTCAAGTCTCCCGATGACCCCAGCAGGT | | |
| | | | ACATCTCGCCTGACCAGCTGGCTGACCTGTACA | | |
| | | | AGTCCTTCATCAAGGACTACCCAGTGGTGTC | | |
| 2828 | NM_0014 28.2_522 | 522 | TAGCTAGGCAGGAAGTCGGCGCGGGCGGCGCG | 0 | * |
| | | | GACAGTATCTGTGGGTACCCGGAGCACGGAGAT | | |
| | | | CTCGCCGGCTTTACGTTCACCTCGGTGTCTGCA | | |
| | | | GCACCCTCCGCTTCCTCTCCTAGGCGACGAGAC | | |
| | | | CCAGTGGCTAGAAGTTCACCATGTCTATTCTCAA | | |
| | | | GATCCATGCCAGGGAGATCTTTGACTCTCGCGG | | |
| | | | GAATCCCACTGTTGAGGTTGATCTCTTCACCTCA | | |
| | | | AAAGGTCTCTTCAGAGCTGCTGTGCCCAGTGGT | | |
| | | | GCTTCAACTGGTATCTATGAGGCCCTAGAGCTC | | |
| | | | CGGGACAATGATAAGACTCGCTATATGGGGAAG | | |
| | | | GGTGTCTCAAAGGCTGTTGAGCACATCAATAAAA | | |
| | | | CTATTGCGCCTGCCCTGGTTAGCAAGAAACTGA | | |
| | | | ACGTCACAGAACAAGAGAAGATTGACAAACTGA | | |
| | | | TGATCGAGATGGATGGAACAGAAAATAAATCTAA | | |
| | | | GTTTGGTGCGAACGCCATTCTGGGGGTGTCCCT | | |
| | | | TGCCGTCTGCAAAGCTGGTGCCGTNTGAGAAGG | | |
| | | | GGGTCCCCCTGTACCGCCACATCGCTGACTTGG | | |
| | | | CTGGCAACTCTGAAGTCATCCTGCCAGTCCCGG | | |
| | | | CGTTCAATGTCATCAATGGCGGTTCTCATGCTG | | |
| | | | GCAACAAGCTGGCCATGCAGGAGTTCATGATCC | | |
| | | | TCCCAGTCGGTGCAGCAAACTTCAGGGAAGCCA | | |
| | | | TGCGCATTGGAGCAGAGGTTTACCACAACCTGA | | |
| | | | AGAATGTCATCAAGGAGAAATATGGGAAAGATG | | |
| | | | CCACCAATGTGGGGGATGAAGGCGGGTTTGCTC | | |
| | | | CCAACATCCTGGAGAATAAAGAAGGCCTGGAGC | | |
| | | | TGCTGAAGACTGCTATTGGGAAAGCTGGCTACA | | |
| | | | CTGATAAGGTGGTCATCGGCATGGACGTAGCGG | | |
| | | | CCTCCGAGTTCTTCAGGTCTGGGAAGTATGACC | | |
| | | | VTGGACTTCAAGTCTCCCGATGACCCCAGCAGGT | | |
| | | | ACATCTCGCCTGACCAGCTGGCTGACCTGTACA | | |
| | | | AGTCCTTCATCAAGGACTACCCAGTGGTGTC | | |
| 2829 | NM_0014 28.2_523 | 523 | TAGCTAGGCAGGAAGTCGGCGCGGGCGGCGCG | 11 | XEGGPPVPPHR* |
| | | | GACAGTATCTGTGGGTACCCGGAGCACGGAGAT | | |
| | | | CTCGCCGGCTTTACGTTCACCTCGGTGTCTGCA | | |
| | | | GCACCCTCCGCTTCCTCTCCTAGGCGACGAGAC | | |
| | | | CCAGTGGCTAGAAGTTCACCATGTCTATTCTCAA | | |
| | | | GATCCATGCCAGGGAGATCTTTGACTCTCGCGG | | |
| | | | GAATCCCACTGTTGAGGTTGATCTCTTCACCTCA | | |
| | | | AAAGGTCTCTTCAGAGCTGCTGTGCCCAGTGGT | | |
| | | | GCTTCAACTGGTATCTATGAGGCCCTAGAGCTC | | |
| | | | CGGGACAATGATAAGACTCGCTATATGGGGAAG | | |
| | | | GGTGTCTCAAAGGCTGTTGAGCACATCAATAAAA | | |
| | | | CTATTGCGCCTGCCCTGGTTAGCAAGAAACTGA | | |
| | | | ACGTCACAGAACAAGAGAAGATTGACAAACTGA | | |
| | | | TGATCGAGATGGATGGAACAGAAAATAAATCTAA | | |
| | | | GTTTGGTGCGAACGCCATTCTGGGGGTGTCCCT | | |
| | | | TGCCGTCTGCAAAGCTGGTGCCGTTNGAGAAGG | | |
| | | | GGGTCCCCCTGTACCGCCACATCGCTGACTTGG | | |
| | | | CTGGCAACTCTGAAGTCATCCTGCCAGTCCCGG | | |
| | | | CGTTCAATGTCATCAATGGCGGTTCTCATGCTG | | |
| | | | GCAACAAGCTGGCCATGCAGGAGTTCATGATCC | | |
| | | | TCCCAGTCGGTGCAGCAAACTTCAGGGAAGCCA | | |
| | | | TGCGCATTGGAGCAGAGGTTTACCACAACCTGA | | |
| | | | AGAATGTCATCAAGGAGAAATATGGGAAAGATG | | |
| | | | CCACCAATGTGGGGGATGAAGGCGGGTTTGCTC | | |

TABLE 3B-continued

| SEQ ID | identifier_position | position | modified RNA | PAP length | PAP |
|---|---|---|---|---|---|
| | | | CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | | |
| 2830 | NM_0014<br>28.2_525 | 525 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGANGAAGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | 11 | XEGGPPVPPH<br>R* |
| 2831 | NM_0014<br>28.2_526 | 526 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGAGNAAGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | 10 | XGGPPVPPHR |
| 2832 | NM_0014<br>28.2_539 | 539 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT | 6 | XVPPHR* |

TABLE 3B-continued

| SEQ ID | identifier_ position | position | modified RNA | PAP length | PAP |
|---|---|---|---|---|---|
| | | | GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCNTGTACCGCCACATCGCTGACTTGG CTGGCAACTCTGAAGTCATCCTGCCAGTCCCGG CGTTCAATGTCATCAATGGCGGTTCTCATGCTG GCAACAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | | |
| 2833 | NM_0014 28.2_565 | 565 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCTGTACCGCCACATCGCTGACTTGGC TN GGCAACTCTGAAGTCATCCTGCCAGTCCCGG CGTTCAATGTCATCAATGGCGGTTCTCATGCTG GCAACAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | 3 | XQL* |
| 2834 | NM_0014 28.2_603 | 603 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCTGTACCGCCACATCGCTGACTTGGC TGGCAACTCTGAAGTCATCCTGCCAGTCCCGG GTTCAANTGTCATCAATGGCGGTTCTCATGCTG GCAACAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG | 59 | XCHQWRFSC WQQAGHAGV HDPPSRCSKL QGSHAHWSR GLPQPEECHQ GEIWERCHQC GG* |

TABLE 3B-continued

| SEQ ID | identifier_ position | position | modified RNA | PAP length | PAP |
|---|---|---|---|---|---|
| | | | CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | | |
| 2835 | NM_0014 28.2_633 | 633 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCTGTACCGCCACATCGCTGACTTGGC TGGCAACTCTGAAGTCATCCTGCCAGTCCCGGC GTTCAATGTCATCAATGGCGGTTCTCATGCTGG CAANCAAGCTGGCCATGCAGGAGTTCATGATCC TCCCAGTCGGTGCAGCAAACTTCAGGGAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | 49 | XQAGHAGVH DPPSRCSKLQ GSHAHWSRG LPQPEECHQG EIWERCHQCG G* |
| 2836 | NM_0014 28.2_689 | 689 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA AAAGGTCTCTTCAGAGCTGCTGTGCCCAGTGGT GCTTCAACTGGTATCTATGAGGCCCTAGAGCTC CGGGACAATGATAAGACTCGCTATATGGGGAAG GGTGTCTCAAAGGCTGTTGAGCACATCAATAAAA CTATTGCGCCTGCCCTGGTTAGCAAGAAACTGA ACGTCACAGAACAAGAGAAGATTGACAAACTGA TGATCGAGATGGATGGAACAGAAAATAAATCTAA GTTTGGTGCGAACGCCATTCTGGGGGTGTCCCT TGCCGTCTGCAAAGCTGGTGCCGTTGAGAAGGG GGTCCCCCTGTACCGCCACATCGCTGACTTGGC TGGCAACTCTGAAGTCATCCTGCCAGTCCCGGC GTTCAATGTCATCAATGGCGGTTCTCATGCTGG CAACAAGCTGGCCATGCAGGAGTTCATGATCCT CCCAGTCGGTGCAGCAAACTTCAGGGNAAGCCA TGCGCATTGGAGCAGAGGTTTACCACAACCTGA AGAATGTCATCAAGGAGAAATATGGGAAAGATG CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | 30 | XSHAHWSRG LPQPEECHQG EIWERCHQCG G* |
| 2837 | NM_0014 28.2_691 | 691 | TAGCTAGGCAGGAAGTCGGCGCGGGCGGCGCG GACAGTATCTGTGGGTACCCGGAGCACGGAGAT CTCGCCGGCTTTACGTTCACCTCGGTGTCTGCA GCACCCTCCGCTTCCTCTCCTAGGCGACGAGAC CCAGTGGCTAGAAGTTCACCATGTCTATTCTCAA GATCCATGCCAGGGAGATCTTTGACTCTCGCGG GAATCCCACTGTTGAGGTTGATCTCTTCACCTCA | 29 | XHAHWSRGL PQPEECHQG EIWERCHQCG G* |

TABLE 3B-continued

| SEQ ID | identifier_position | position | modified RNA | PAP length | PAP |
|---|---|---|---|---|---|
| | | | AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGAGAAGGG<br>GGTCCCCCTGTACCGCCACATCGCTGACTTGGC<br>TGGCAACTCTGAAGTCATCCTGCCAGTCCCGGC<br>GTTCAATGTCATCAATGGCGGTTCTCATGCTGG<br>CAACAAGCTGGCCATGCAGGAGTTCATGATCCT<br>CCCAGTCGGTGCAGCAAACTTCAGGGAANGCCA<br>TGCGCATTGGAGCAGAGGTTTACCACAACCTGA<br>AGAATGTCATCAAGGAGAAATATGGGAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TGGACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | | |
| 2838 | NM_0014 28.2_754 | 754 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGAGAAGGG<br>GGTCCCCCTGTACCGCCACATCGCTGACTTGGC<br>TGGCAACTCTGAAGTCATCCTGCCAGTCCCGGC<br>GTTCAATGTCATCAATGGCGGTTCTCATGCTGG<br>CAACAAGCTGGCCATGCAGGAGTTCATGATCCT<br>CCCAGTCGGTGCAGCAAACTTCAGGGAAGCCAT<br>GCGCATTGGAGCAGAGGTTTACCACAACCTGAA<br>GAATGTCATCAAGGAGAAATATGGGNAAAGATG<br>CCACCAATGTGGGGGATGAAGGCGGGTTTGCTC<br>CCAACATCCTGGAGAATAAAGAAGGCCTGGAGC<br>TGCTGAAGACTGCTATTGGGAAAGCTGGCTACA<br>CTGATAAGGTGGTCATCGGCATGGACGTAGCGG<br>CCTCCGAGTTCTTCAGGTCTGGGAAGTATGACC<br>TG GACTTCAAGTCTCCCGATGACCCCAGCAGGT<br>ACATCTCGCCTGACCAGCTGGCTGACCTGTACA<br>AGTCCTTCATCAAGGACTACCCAGTGGTGTC | 8 | XRCHQCGG* |
| 2839 | NM_0014 28.2_807 | 807 | TAGCTAGGCAGGAAGTCGGCGCGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGAGAAGGG<br>GGTCCCCCTGTACCGCCACATCGCTGACTTGGC<br>TGGCAACTCTGAAGTCATCCTGCCAGTCCCGGC<br>GTTCAATGTCATCAATGGCGGTTCTCATGCTGG<br>CAACAAGCTGGCCATGCAGGAGTTCATGATCCT<br>CCCAGTCGGTGCAGCAAACTTCAGGGAAGCCAT<br>GCGCATTGGAGCAGAGGTTTACCACAACCTGAA | 2 | XE* |

TABLE 3B-continued

| SEQ ID | identifier_position | position | modified RNA | PAP length | PAP |
|---|---|---|---|---|---|
| | | | GAATGTCATCAAGGAGAAATATGGGAAAGATGC CACCAATGTGGGGGATGAAGGCGGGTTTGCTCC CAACATCCTGGANGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | | |
| 2840 | NM_0014 69.3_209 | 209 | GCGCATGCGTGGATTGTCGTCTTCTGTCCAAGT TGGTCGCTTCCCTGCGCCAAAGTGAGCAGTAGC CAACATGTCAGGGTGGGAGTCATATTACAAAAC CGAGGGCGATGAAGAAGCAGAGGAAGAACAAG AAGAGAACCTTGAAGCAAGTGGAGACTATAAATA TTCAGGAAGAGATAGTTTGATTTTTTTGGTTGAT GCCTCCAAGGNCTATGTTTGAATCTCAGAGTGA AGATGAGTTGACACCTTTTGACATGAGCATCCAG TGTATCCAAAGTGTGTACATCAGTAAGATCATAA GCAGTGATCGAGATCTCTTGGCTGTGGTGTTCT ATGGTACCGAGAAAGACAAAAATTCAGTGAATTT TAAAAATATTTACGTCTTACAGGAGCTGGATAAT CCAGGTGCAAAACGAATTCTAGAGCTTGACCAG TTTAAGGGGCAGCAGGGACAAAAACGTTTCCAA GACATGATGGGCCACGGATCTGACTACTCACTC AGTGAAGTGCTGTGGGTCTGTGCCAACCTCTTT AGTGATGTCCAATTCAAGATGAGTCATAAGAGGA TCATGCTGTTCACCAATGAAGACAACCCCCATG GCAATGACAGTGCCAAAGCCAGCCGGGCCAGG ACCAAAGCCGGTGATCTCCGAGATACAGGCATC TTCCTTGACTTGATGCACCTGAAGAAACCTGGG GGCTTTGACATATCCTTGTTCTACAGAGATATCA TCAGCATAGCAGAGGATGAGGACCTCAGGGTTC ACTTTGAGGAATCCAGCAAGCTAGAAGACCTGT TGCGGAAGGTTCGCGCCAAGGAGACCAGGAAG CGAGCACTCAGCAGGTTAAAGCTGAAGCTCAAC AAAGATATAGTGATCTCTGTGGGCATTTATAATC TGGTCCAGAAGGCTCTCAAGCCTCCTCCAATAA AGCTCTATCGGGAAACAAATGAACCAGTGAAAA CCAAGACCCGGACCTTTAATACAAGTACAGGCG GTTTGCTTCTGCCTAGCGATACCAAGAG | 3 | XYV* |
| 2841 | NM_0014 69.3_515 | 515 | GCGCATGCGTGGATTGTCGTCTTCTGTCCAAGT TGGTCGCTTCCCTGCGCCAAAGTGAGCAGTAGC CAACATGTCAGGGTGGGAGTCATATTACAAAAC CGAGGGCGATGAAGAAGCAGAGGAAGAACAAG AAGAGAACCTTGAAGCAAGTGGAGACTATAAATA TTCAGGAAGAGATAGTTTGATTTTTTTGGTTGAT GCCTCCAAGGCTATGTTTGAATCTCAGAGTGAA GATGAGTTGACACCTTTTGACATGAGCATCCAGT GTATCCAAAGTGTGTACATCAGTAAGATCATAAG CAGTGATCGAGATCTCTTGGCTGTGGTGTTCTAT GGTACCGAGAAAGACAAAAATTCAGTGAATTTA AAAATATTTACGTCTTACAGGAGCTGGATAATCC AGGTGCAAAACGAATTCTAGAGCTTGACCAGTTT AAGGGGCAGCAGGGACAAAAACGTTTCCAAGAC ATGATGGGCCACGGATCTGACTACTCACTCAGT GAAGTGCTGTGGGNTCTGTGCCAACCTCTTTAG TGATGTCCAATTCAAGATGAGTCATAAGAGGATC ATGCTGTTCACCAATGAAGACAACCCCCATGGC AATGACAGTGCCAAAGCCAGCCGGGCCAGGAC CAAAGCCGGTGATCTCCGAGATACAGGCATCTT CCTTGACTTGATGCACCTGAAGAAACCTGGGGG CTTTGACATATCCTTGTTCTACAGAGATATCATC AGCATAGCAGAGGATGAGGACCTCAGGGTTCAC TTTGAGGAATCCAGCAAGCTAGAAGACCTGTTG CGGAAGGTTCGCGCCAAGGAGACCAGGAAGCG AGCACTCAGCAGGTTAAAGCTGAAGCTCAACAA AGATATAGTGATCTCTGTGGGCATTTATAATCTG GTCCAGAAGGCTCTCAAGCCTCCTCCAATAAAG CTCTATCGGGAAACAAATGAACCAGTGAAAACC AAGACCCGGACCTTTAATACAAGTACAGGCGGT TTGCTTCTGCCTAGCGATACCAAGAG | 6 | XLCQPL* |
| 2842 | NM_0015 68.2_116 | 116 | GAGCACAGACTCCCTTTTCTTTGGCAAGATGGC GGGAGTACGACTTGACTACTCGCATCGCGCACTT TTTGGATCGGCATCTAGTCTTTCCGCTTCTTGAA TTTCTCTCTGTAAAGGNAGATATATAATGAAAAG GAATTATTACAAGGTAAATTGGACCTTCTTAGTG ATACCAACATGGTAGACTTTGCTATGGATGTATA | 3 | XDI* |

TABLE 3B-continued

| SEQ ID | identifier_position | position | modified RNA | PAP length | PAP |
|---|---|---|---|---|---|
| | | | CAAAAACCTTTATTCTGATGATATTCCTCATGCTT<br>TGAGAGAGAAAAGAACCACAGTGGTTGCACAAC<br>TGAAACAGCTTCAGGCAGAAACAGAACCAATTG<br>TGAAGATGTTTGAAGATCCAGAAACTACAAGGCA<br>AATGCAGTCAACCAGGGATGGTAGGATGCTCTT<br>TGACTACCTGGCGGACAAGCATGGTTTTAGGCA<br>GGAATATTTAGATACACTCTACAGATATGCAAAA<br>TTCCAGTACGAATGTGGGAATTACTCAGGAGCA<br>GCAGAATATCTTTATTTTTTTAGAGTGCTGGTTC<br>CAGCAACAGATAGAAATGCTTTAAGTTCACTCTG<br>GGGAAAGCTGGCCTCTGAAATCTTAATGCAGAA<br>TTGGGATGCAGCCATGGAAGACCTTACACGGTT<br>AAAAGAGACCATAGATAATAATTCTGTGAGTTCT<br>CCACTTCAGTCTCTTCAGCAGAGAACATGGCTC<br>ATTCACTGGTCTCTGTTTGTTTTCTTCAATCACCC<br>CAAAGGTCGCGATAATATTATTGACCTCTTCCTT<br>TATCAGCCACAATATCTTAATGCAATTCAGACAA<br>TGTGTCCACACATTCTTCGCTATTTGACTACAGC<br>AGTCATAACAAACAAGGATGTTCGAAAACGTCG<br>GCAGGTTCTAAAAGATCTAGTTAAAGTTATTCAA<br>CAGGAGTCTTACACATATAAAGACCCAATTACAG<br>AATTTGTTGAATGTTTATATGTTAACTTTGACTTT<br>GATGGGGCTCAGAAAAAGCTGAGGGAATGTGAA<br>TCAGTGCTTGTGAATGACTTCTTCTTGGTGGCTT<br>GTCTTGAGGATTT | | |
| 2843 | NM_0016<br>14.2_101<br>8 | 1018 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAATGAGCGGTTCCGGTGTCCGGA<br>GGCGCTGTTCCAGCCTTCCTTCCTGGGTATGGA<br>ATCTTGCGGCATCCACGAGACCACCTTCAACTC<br>CATCATGAAGTGTGACGTGGACATCCGCAAAGA<br>CCTGTACGCCAACACGGTGCTGTCGGGCGCA<br>CCACCATGTACCCGGGCATTGCCGACAGGATGC<br>AGAAANGGAGA | 43 | XGDHRPGAQ<br>HHEDQDHRT<br>PRAQVLGVDR<br>WLHPGLTVHL<br>PADVD* |
| 2844 | NM_0016<br>14.2_109<br>1 | 1091 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC | 18 | XDRWLHPGLT<br>VHLPADVD* |

TABLE 3B-continued

| SEQ ID | identifier_ position | position | modified RNA | PAP length | PAP |
|---|---|---|---|---|---|
| | | | ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTCCTGGGTATGGA ATCTTGCGGCATCCACGAGACCACCTTCAACTC CATCATGAAGTGTGACGTGGACATCCGCAAAGA CCTGTACGCCAACACGGTGCTGTCGGGCGGCA CCACCATGTACCCGGGCATTGCCGACAGGATGC AGAAGGAGAT | | |
| 2845 | NM_0016 14.2_199 | 199 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGNCGTCATGGTGGGCATGGGCCAGAAGGAC TCCTACGTGGGCGACGAGGCCCAGAGCAAGCG TGGCATCCTGACCCTGAAGTACCCCATTGAGCA TGGCATCGTCACCAACTGGGACGACATGGAGAA GATCTGGCACCACACCTTCTACAACGAGCTGCG CGTGGCCCCGGAGGAGCACCCAGTGCTGCTGA CCGAGGCCCCCCTGAACCCCAAGGCCAACAGA GAGAAGATGACTCAGATTATGTTTGAGACCTTCA ACACCCCGGCCATGTACGTGGCCATCCAGGCC GTGCTGTCCCTCTACGCCTCTGGGCGCACCACT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 29 | RHGGHGPEG LLRGRRGPEQ AWHPDPEVPH* |
| 2846 | NM_0016 14.2_256 | 256 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAANGCG TGGCATCCTGACCCTGAAGTACCCCATTGAGCA TGGCATCGTCACCAACTGGGACGACATGGAGAA GATCTGGCACCACACCTTCTACAACGAGCTGCG CGTGGCCCCGGAGGAGCACCCAGTGCTGCTGA CCGAGGCCCCCCTGAACCCCAAGGCCAACAGA GAGAAGATGACTCAGATTATGTTTGAGACCTTCA ACACCCCGGCCATGTACGTGGCCATCCAGGCC GTGCTGTCCCTCTACGCCTCTGGGCGCACCACT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 11 | XAWHPDPEV PH* |

TABLE 3B-continued

| SEQ ID | identifier_position | position | modified RNA | PAP length | PAP |
|---|---|---|---|---|---|
| 2847 | NM_0016 14.2_414 | 414 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCTGAACCCCAAGGNCCAACAGA GAGAAGATGACTCAGATTATGTTTGAGACCTTCA ACACCCCGGCCATGTACGTGGCCATCCAGGCC GTGCTGTCCCTCTACGCCTCTGGGCGCACCACT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 11 | XQQREDDSD YV* |
| 2848 | NM_0016 14.2_446 | 446 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCTGAACCCCAAGGCCAACAGAG AGAAGATGACTCAGATTATGTTTNGAGACCTTCA ACACCCCGGCCATGTACGTGGCCATCCAGGCC GTGCTGTCCCTCTACGCCTCTGGGCGCACCACT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 70 | XDLQHPGHVR GHPGRAVPLR LWAHHWHCH GLWRRGHPH GAHLRGLRPP PRHPASGPG WPGPDRLPH EDPH* |
| 2849 | NM_0016 14.2_513 | 513 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCTGAACCCCAAGGCCAACAGAG | 48 | XHHWHCHGL WRRGHPHGA HLRGLRPPPR HPASGPGWP GPDRLPHEDP H* |

TABLE 3B-continued

| SEQ ID | identifier_ position | position | modified RNA | PAP length | PAP |
|---|---|---|---|---|---|
| | | | AGAAGATGACTCAGATTATGTTTGAGACCTTCAA CACCCCGGCCATGTACGTGGCCATCCAGGCCG TGCTGTCCCTCTACGCCTCTGGGCNGCACCACT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2850 | NM_0016 14.2_520 | 520 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACNT GGCATTGTCATGGACTCTGGAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 45 | WHCHGLWRR GHPHGAHLR GLRPPPRHPA SGPGWPGPD RLPHEDPH* |
| 2851 | NM_0016 14.2_541 | 541 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGNAGACGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG | 38 | RRGHPHGAH LRGLRPPPRH PASGPGWPG PDRLPHEDPH* |

TABLE 3B-continued

| SEQ ID | identifier_ position | position | modified RNA | PAP length | PAP |
|---|---|---|---|---|---|
| | | | GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2852 | NM_0016 14.2_545 | 545 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACNGGGGTCACC CACACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 37 | XGHPHGAHLR GLRPPPRHPA SGPGWPGPD RLPHEDPH* |
| 2853 | NM_0016 14.2_557 | 557 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACNACGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 33 | XGAHLRGLRP PPRHPASGPG WPGPDRLPH EDPH* |
| 2854 | NM_0016 14.2_558 | 558 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT | 33 | XGAHLRGLRP PPRHPASGPG WPGPDRLPH EDPH* |

TABLE 3B-continued

| SEQ ID | identifier_position | position | modified RNA | PAP length | PAP |
|---|---|---|---|---|---|
| | | | CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACANCGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2855 | NM_0016 14.2_559 | 559 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACNGGTGCCCATCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 32 | GAHLRGLRPP PRHPASGPG WPGPDRLPH EDPH* |
| 2856 | NM_0016 14.2_566 | 566 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCNATCTACGAGGGCTACGCCCTC CCCCACGCCATCCTGCGTCTGGACCTGGCTGG CCGGGACCTGACCGACTACCTCATGAAGATCCT | 30 | XLRGLRPPPR HPASGPGWP GPDRLPHEDP H* |

TABLE 3B-continued

| SEQ ID | identifier_position | position | modified RNA | PAP length | PAP |
|---|---|---|---|---|---|
| | | | CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2857 | NM_0016 14.2_567 | 567 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCANTCTACGAGGGCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 30 | XLRGLRPPPR HPASGPGWP GPDRLPHEDP H* |
| 2858 | NM_0016 14.2_577 | 577 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGNCTACGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 26 | LRPPPRHPAS GPGWPGPDR LPHEDPH* |

TABLE 3B-continued

| SEQ ID | identifier_ position | position | modified RNA | PAP length | PAP |
|---|---|---|---|---|---|
| 2859 | NM_0016 14.2_581 | 581 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACNGCCCTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 25 | XPPPRHPASG PGWPGPDRL PHEDPH* |
| 2860 | NM_0016 14.2_585 | 585 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCNTC CCCCACGCCATCCTGCGTCTGGACCTGGCTGG CCGGGACCTGACCGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 24 | XPPRHPASGP GWPGPDRLP HEDPH* |
| 2861 | NM_0016 14.2_600 | 600 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG | 19 | XASGPGWPG PDRLPHEDPH* |

TABLE 3B-continued

| SEQ ID | identifier_position | position | modified RNA | PAP length | PAP |
|---|---|---|---|---|---|
| | | | AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCNTGCGTCTGGACCTGGCTGG<br>CCGGGACCTGACCGACTACCTCATGAAGATCCT<br>CACTGAGCGAGGCTACAGCTTCACCACCACGGC<br>CGAGCGGGAAATCGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | | |
| 2862 | NM_0016<br>14.2_607 | 607 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTNGGACCTGGCTGG<br>CCGGGACCTGACCGACTACCTCATGAAGATCCT<br>CACTGAGCGAGGCTACAGCTTCACCACCACGGC<br>CGAGCGGGAAATCGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | 16 | GPGWPGPDR<br>LPHEDPH* |
| 2863 | NM_0016<br>14.2_615 | 615 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGNCTGG<br>CCGGGACCTGACCGACTACCTCATGAAGATCCT<br>CACTGAGCGAGGCTACAGCTTCACCACCACGGC<br>CGAGCGGGAAATCGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG | 14 | XWPGPDRLP<br>HEDPH* |

TABLE 3B-continued

| SEQ ID | identifier_position | position | modified RNA | PAP length | PAP |
|---|---|---|---|---|---|
| | | | GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2864 | NM_0016 14.2_632 | 632 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCNGACTACCTCATGAAGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 8 | XLPHEDPH* |
| 2865 | NM_0016 14.2_646 | 646 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAANGATCCT CACTGAGCGAGGCTACAGCTTCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 4 | XDPH* |
| 2866 | NM_0016 14.2_656 | 656 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT | 58 | XARLQLHHHG RAGNRARHQ GEAVLRRPGL RAGDGHRRIL LFSGEELRAA RWPGHHHWQ* |

TABLE 3B-continued

| SEQ ID | identifier_position | position | modified RNA | PAP length | PAP |
|---|---|---|---|---|---|
| | | | CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTNGAGCGAGGCTACAGCTTCACCACCACGGC<br>CGAGCGGGAAATCGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | | |
| 2867 | NM_0016<br>14.2_659 | 659 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGNCGAGGCTACAGCTTCACCACCACGGC<br>CGAGCGGGAAATCGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | 57 | XRLQLHHHGR<br>AGNRARHQG<br>EAVLRRPGLR<br>AGDGHRRILL<br>FSGEELRAAR<br>WPGHHHWQ* |
| 2868 | NM_0016<br>14.2_673 | 673 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC | 53 | XHHHGRAGN<br>RARHQGEAVL<br>RRPGLRAGD<br>GHRRILLFSG<br>EELRAARWP<br>GHHHWQ* |

TABLE 3B-continued

| SEQ ID | identifier_position | position | modified RNA | PAP length | PAP |
|---|---|---|---|---|---|
| | | | ACTGAGCGAGGCTACAGCTTNCACCACCACGGC CGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2869 | NM_0016 14.2_686 | 686 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC NGAGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 48 | XAGNRARHQ GEAVLRRPGL RAGDGHRRIL LFSGEELRAA RWPGHHHWQ* |
| 2870 | NM_0016 14.2_688 | 688 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GANGCGGGAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 48 | XAGNRARHQ GEAVLRRPGL RAGDGHRRIL LFSGEELRAA RWPGHHHWQ* |

TABLE 3B-continued

| SEQ ID | identifier_position | position | modified RNA | PAP length | PAP |
|---|---|---|---|---|---|
| 2871 | NM_0016 14.2_693 | 693 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGNAAATCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 46 | XNRARHQGE AVLRRPGLRA GDGHRRILLF SGEELRAAR WPGHHHWQ* |
| 2872 | NM_0016 14.2_696 | 696 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAANTCGTGCGCGACATCAAGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 45 | XRARHQGEA VLRRPGLRAG DGHRRILLFS GEELRAARW PGHHHWQ* |
| 2873 | NM_0016 14.2_698 | 698 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG | 44 | XARHQGEAVL RRPGLRAGD GHRRILLFSG EELRAARWP GHHHWQ* |

TABLE 3B-continued

| SEQ ID | identifier_position | position | modified RNA | PAP length | PAP |
|---|---|---|---|---|---|
| | | | AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCNGTGCGCGACATCAAGGAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | | |
| 2874 | NM_0016<br>14.2_714 | 714 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGNAGA<br>AGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | 39 | XEAVLRRPGL<br>RAGDGHRRIL<br>LFSGEELRAA<br>RWPGHHHWQ* |
| 2875 | NM_0016<br>14.2_718 | 718 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>NGCTGTGCTACGTCGCCCTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG | 38 | XAVLRRPGLR<br>AGDGHRRILL<br>FSGEELRAAR<br>WPGHHHWQ* |

TABLE 3B-continued

| SEQ ID | identifier_position | position | modified RNA | PAP length | PAP |
|---|---|---|---|---|---|
| | | | GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2876 | NM_0016 14.2_728 | 728 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACNGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 34 | XRPGLRAGD GHRRILLFSG EELRAARWP GHHHWQ* |
| 2877 | NM_0016 14.2_731 | 731 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCNGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 33 | XPGLRAGDG HRRILLFSGEE LRAARWPGH HHWQ* |
| 2878 | NM_0016 14.2_735 | 735 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT | 32 | XGLRAGDGH RRILLFSGEEL RAARWPGHH HWQ* |

TABLE 3B-continued

| SEQ ID | identifier_position | position | modified RNA | PAP length | PAP |
|---|---|---|---|---|---|
| | | | CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCNTGGACTTCGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | | |
| 2879 | NM_0016<br>14.2_743 | 743 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCNGAGCAGG<br>AGATGGCCACCGCCGCATCCTCCTCTTCTCTGG<br>AGAAGAGCTACGAGCTGCCCGATGGCCAGGTC<br>ATCACCATTGGCAATGAGCGGTTCCGGTGTCCG<br>GAGGCGCTGTTCCAGCCTTCCTTCCTGGGTATG<br>GAATCTTGCGGCATCCACGAGACCACCTTCAAC<br>TCCATCATGAAGTGTGACGTGGACATCCGCAAA<br>GACCTGTACGCCAACACGGTGCTGTCGGGCGG<br>CACCACCATGTACCCGGGCATTGCCGACAGGAT<br>GCAGAAGGAGA | 29 | XAGDGHRRIL<br>LFSGEELRAA<br>RWPGHHHWQ* |
| 2880 | NM_0016<br>14.2_745 | 745 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC | 29 | XAGDGHRRIL<br>LFSGEELRAA<br>RWPGHHHWQ* |

TABLE 3B-continued

| SEQ ID | identifier_ position | position | modified RNA | PAP length | PAP |
|---|---|---|---|---|---|
| | | | ACTGAGCGAGGCTACAGCTTCACCACCACGGCC GAGCGGGAAATCGTGCGCGACATCAAGGAGAA GCTGTGCTACGTCGCCCTGGACTTCGANGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 2881 | NM_0016 14.2_777 | 777 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTNCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 18 | XSGEELRAAR WPGHHHWQ* |
| 2882 | NM_0016 14.2_80 | 80 | GTCTCAGTCGCCGCTGCCAGCTCTCGCACTCTG TTCTTCCGCCGCTCCGCCGTCGCGTTTCTCTGC CGGTCGCAATGGAANGAAGAGATCGCCGCGCT GGTCATTGACAATGGCTCCGGCATGTGCAAAGC TGGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTCCTGGGTATGGA ATCTTGCGGCATCCACGAGACCACCTTCAACTC CATCATGAAGTGTGACGTGGACATCCGCAAAGA CCTGTACGCCAACACGGTGCTGTCGGGCGGCA CCACCATGTACCCGGGCATTGCCGACAGGATGC AGAAGGAGA | 8 | XRDRRAGH* |

TABLE 3B-continued

| SEQ ID | identifier_position | position | modified RNA | PAP length | PAP |
|---|---|---|---|---|---|
| 2883 | NM_0016 14.2_803 | 803 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCNGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 9 | XVVPGHHHWQ* |
| 2884 | NM_0016 14.2_813 | 813 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGNTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | 6 | XHHHWQ* |
| 2885 | NM_0016 14.2_826 | 826 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG | 1 | Q* |

TABLE 3B-continued

| SEQ ID | identifier_position | position | modified RNA | PAP length | PAP |
|---|---|---|---|---|---|
| | | | AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGNCAATGAGCGGTTCCGGTGTCCGG<br>AGGCGCTGTTCCAGCCTTCCTTCCTGGGTATGG<br>AATCTTGCGGCATCCACGAGACCACCTTCAACT<br>CCATCATGAAGTGTGACGTGGACATCCGCAAAG<br>ACCTGTACGCCAACACGGTGCTGTCGGGCGGC<br>ACCACCATGTACCCGGGCATTGCCGACAGGATG<br>CAGAAGGAGA | | |
| 2886 | NM_0016<br>14.2_829 | 829 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAANTGAGCGGTTCCGGTGTCCGG<br>AGGCGCTGTTCCAGCCTTCCTTCCTGGGTATGG<br>AATCTTGCGGCATCCACGAGACCACCTTCAACT<br>CCATCATGAAGTGTGACGTGGACATCCGCAAAG<br>ACCTGTACGCCAACACGGTGCTGTCGGGCGGC<br>ACCACCATGTACCCGGGCATTGCCGACAGGATG<br>CAGAAGGAGA | 1 | X* |
| 2887 | NM_0016<br>14.2_834 | 834 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAAATGAGCNGGTTCCGGTGTCCGG | 32 | XVPVSGGAVP<br>AFLPGYGILRH<br>PRDHLQLHHE<br>V* |

TABLE 3B-continued

| SEQ ID | identifier_ position | position | modified RNA | PAP length | PAP |
|---|---|---|---|---|---|
| | | | AGGCGCTGTTCCAGCCTTCCTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | | |
| 2888 | NM_0016 14.2_836 | 836 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGNTTCCGGTGTCCGG AGGCGCTGTTCCAGCCTTCCTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 31 | XPVSGGAVPA FLPGYGILRHP RDHLQLHHEV* |
| 2889 | NM_0016 14.2_847 | 847 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCNGG AGGCGCTGTTCCAGCCTTCCTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 27 | GGAVPAFLPG YGILRHPRDH LQLHHEV* |
| 2890 | NM_0016 14.2_849 | 849 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT | 27 | XGAVPAFLPG YGILRHPRDH LQLHHEV* |

TABLE 3B-continued

| SEQ ID | identifier_ position | position | modified RNA | PAP length | PAP |
|---|---|---|---|---|---|
| | | | CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGN AGGCGCTGTTCCAGCCTTCCTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | | |
| 2891 | NM_0016 14.2_865 | 865 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCNTTCCTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 21 | FLPGYGILRHP RDHLQLHHEV* |
| 2892 | NM_0016 14.2_869 | 869 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC | 20 | XPGYGILRHP RDHLQLHHEV* |

TABLE 3B-continued

| SEQ ID | identifier_position | position | modified RNA | PAP length | PAP |
|---|---|---|---|---|---|
| | | | ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCNTTCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | | |
| 2893 | NM_0016 14.2_871 | 871 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTNCCTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 20 | XPGYGILRHP RDHLQLHHEV* |
| 2894 | NM_0016 14.2_873 | 873 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTCCNTGGGTATGG AATCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 19 | XGYGILRHPR DHLQLHHEV* |

TABLE 3B-continued

| SEQ ID | identifier_ position | position | modified RNA | PAP length | PAP |
|---|---|---|---|---|---|
| 2895 | NM_0016 14.2_884 | 884 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTCCTGGGTATGGA ANTCTTGCGGCATCCACGAGACCACCTTCAACT CCATCATGAAGTGTGACGTGGACATCCGCAAAG ACCTGTACGCCAACACGGTGCTGTCGGGCGGC ACCACCATGTACCCGGGCATTGCCGACAGGATG CAGAAGGAGA | 15 | XLRHPRDHLQ LHHEV* |
| 2896 | NM_0016 14.2_925 | 925 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAAGGAGAA GCTGTGCTACGTCGCCCTGGACTTCGAGCAGGA GATGGCCACCGCCGCATCCTCCTCTTCTCTGGA GAAGAGCTACGAGCTGCCCGATGGCCAGGTCAT CACCATTGGCAATGAGCGGTTCCGGTGTCCGGA GGCGCTGTTCCAGCCTTCCTTCCTGGGTATGGA ATCTTGCGGCATCCACGAGACCACCTTCAACTC CATCATGAANGTGTGACGTGGACATCCGCAAAG ACCTGTACGCCAACACGGTGCTGTCGGGCGGC ACCACCATGTACCCGGGCATTGCCGACAGGATG CAGAAGGAGA | 2 | XV* |
| 2897 | NM_0016 14.2_932 | 932 | GTCTCAGTCGCCGCTGCCAGCTCTCGCACTCTG TTCTTCCGCCGCTCCGCCGTCGCGTTTCTCTGC CGGTCGCAATGGAAGAAGAGATCGCCGCGCTG GTCATTGACAATGGCTCCGGCATGTGCAAAGCT GGTTTTGCTGGGGACGACGCTCCCCGAGCCGT GTTTCCTTCCATCGTCGGGCGCCCCAGACACCA GGGCGTCATGGTGGGCATGGGCCAGAAGGACT CCTACGTGGGCGACGAGGCCCAGAGCAAGCGT GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCCTGAACCCCAAGGCCAACAGAG | 71 | XGHPQRPVR QHGAVGRHH HVPGHCRQD AEGDHRPGA QHHEDQDHR TPRAQVLGVD RWLHPGLTVH LPADVD* |

TABLE 3B-continued

| SEQ ID | identifier_position | position | modified RNA | PAP length | PAP |
|---|---|---|---|---|---|
| | | | AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAATGAGCGGTTCCGGTGTCCGGA<br>GGCGCTGTTCCAGCCTTCCTTCCTGGGTATGGA<br>ATCTTGCGGCATCCACGAGACCACCTTCAACTC<br>CATCATGAAGTGTGACNGTGGACATCCGCAAAG<br>ACCTGTACGCCAACACGGTGCTGTCGGGCGGC<br>ACCACCATGTACCCGGGCATTGCCGACAGGATG<br>CAGAAGGAGA | | |
| 2898 | NM_0016<br>14.2_961 | 961 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAATGAGCGGTTCCGGTGTCCGGA<br>GGCGCTGTTCCAGCCTTCCTTCCTGGGTATGGA<br>ATCTTGCGGCATCCACGAGACCACCTTCAACTC<br>CATCATGAAGTGTGACGTGGACATCCGCAAAGA<br>CCTGTACGCCAANCACGGTGCTGTCGGGCGGC<br>ACCACCATGTACCCGGGCATTGCCGACAGGATG<br>CAGAAGGAGA | 62 | XHGAVGRHH<br>HVPGHCRQD<br>AEGDHRPGA<br>QHHEDQDHR<br>TPRAQVLGVD<br>RWLHPGLTVH<br>LPADVD* |
| 2899 | NM_0016<br>14.2_966 | 966 | GTCTCAGTCGCCGCTGCCAGCTCTCGCACTCTG<br>TTCTTCCGCCGCTCCGCCGTCGCGTTTCTCTGC<br>CGGTCGCAATGGAAGAAGAGATCGCCGCGCTG<br>GTCATTGACAATGGCTCCGGCATGTGCAAAGCT<br>GGTTTTGCTGGGGACGACGCTCCCCGAGCCGT<br>GTTTCCTTCCATCGTCGGGCGCCCCAGACACCA<br>GGGCGTCATGGTGGGCATGGGCCAGAAGGACT<br>CCTACGTGGGCGACGAGGCCCAGAGCAAGCGT<br>GGCATCCTGACCCTGAAGTACCCCATTGAGCAT<br>GGCATCGTCACCAACTGGGACGACATGGAGAAG<br>ATCTGGCACCACACCTTCTACAACGAGCTGCGC<br>GTGGCCCCGGAGGAGCACCCAGTGCTGCTGAC<br>CGAGGCCCCCCTGAACCCCAAGGCCAACAGAG<br>AGAAGATGACTCAGATTATGTTTGAGACCTTCAA<br>CACCCCGGCCATGTACGTGGCCATCCAGGCCG<br>TGCTGTCCCTCTACGCCTCTGGGCGCACCACTG<br>GCATTGTCATGGACTCTGGAGACGGGGTCACCC<br>ACACGGTGCCCATCTACGAGGGCTACGCCCTCC<br>CCCACGCCATCCTGCGTCTGGACCTGGCTGGC<br>CGGGACCTGACCGACTACCTCATGAAGATCCTC<br>ACTGAGCGAGGCTACAGCTTCACCACCACGGCC<br>GAGCGGGAAATCGTGCGCGACATCAAGGAGAA<br>GCTGTGCTACGTCGCCCTGGACTTCGAGCAGGA<br>GATGGCCACCGCCGCATCCTCCTCTTCTCTGGA<br>GAAGAGCTACGAGCTGCCCGATGGCCAGGTCAT<br>CACCATTGGCAATGAGCGGTTCCGGTGTCCGGA | 60 | XAVGRHHHVP<br>GHCRQDAEG<br>DHRPGAQHH<br>EDQDHRTPRA<br>QVLGVDRWL<br>HPGLTVHLPA<br>DVD* |

TABLE 3B-continued

| SEQ ID | identifier_ position | position | modified RNA | PAP length | PAP |
|---|---|---|---|---|---|
| | | | GGCGCTGTTCCAGCCTTCCTTCCTGGGTATGGA ATCTTGCGGCATCCACGAGACCACCTTCAACTC CATCATGAAGTGTGACGTGGACATCCGCAAAGA CCTGTACGCCAACACGGNTGCTGTCGGGCGGC ACCACCATGTACCCGGGCATTGCCGACAGGATG CAGAAGGAGA | | |
| 2900 | NM_0016 42.1_77 | 77 | GTCGCGGTGTGTCTAAGCGAGGAGTCCGAGTGT GTGAGCTTGAGAGCCGCGCGCTAGAGCGACCC GGCGAGGGATGGCNGGCCACCGGGACCGCGG CCGCCGCAGCCACGGGCAGGCTCCTGCTTCTG CTGCTGGTGGGGCTCACGGCGCCTGCCTTGGC GCTGGCCGGCTACATCGAGGCTCTTGCAGCCAA TGCCGGAACAGGATTTGCTGTTGCTGAGCCTCA AATCGCAATGTTTTGTGGGAAGTTAAATATGCAT GTGAACATTCAGACTGGGAAATGGGAACCTGAT CCAACAGGCACCAAGAGCTGCTTTGAAACAAAA GAAGAAGTTCTTCAGTACTGTCAGGAGATGTATC CAGAGCTACAGATCACAAATGTGATGGAGGCAA ACCAGCGGGTTAGTATTGACAACTGGTGCCGGA GGGACAAAAAGCAATGCAAGAGTCGCTTTGTTA CACCTTTCAAGTGTCTCGTGGGTGAATTTGTAAG TGATGTCCTGCTAGTTCCAGAAAAGTGCCAGTTT TTCCACAAAGAGCGGATGGAGGTGTGTGAGAAT CACCAGCACTGGCACACGGTAGTCAAAGAGGCA TGTCTGACTCAGGGAATGACCTTATATAGCTACG GCATGCTGCTCCCATGTGGGGTAGACCAGTTCC ATGGCACTGAATATGTGTGCTGCCCTCAGACAA AGATTATTGGATCTGTGTCAAAAGAAGAGGAAGA GGAAGATGAAGAGGAAGAGGAAGAGGAAGATG AAGAGGAAGACTATGATGTTTATAAAAGTGAATT TCCTACTGAAGCAGATCTGGAAGACTTCACAGA AGCAGCTGTGGATGAGGATGATGAGGATGAGGA AGAAGGGGAGGAAGTGGTGGAGGACCGAGATT ACTACTATGACACCTTCAAAGGAGATGACTACAA TGAGGAGAATCCTACTGAACCCGGCAGCGACG GCACCATGTCAGACAAGGAAATTACTCATGATGT CAAAGCTGTCTGCTCCCAGGAGGCGATGACGG GG | 46 | GHRDRGRRS HGQAPASAA GGAHGACLG AGRLHRGSCS QCRNRICCC* |
| 2901 | NM_0016 60.2_393 | 393 | CCGCGCCAGTCGCCTAGCAGGTCCTCTACCGG CTTATTCCTGTGCCGGATCTTCATCGGCACAGG GGCCACTGAGACGTTTCTGCCTCCCTCTTTCTTC CTCCGCTCTTTCTCTTCCCTCTCGTTTAGTTTGC CTGGAGCTTGAAAGGAGAAAAGCACGGGGTCGC CCCAAACCCCTTCTGCTTCTGCCCATCACAAGT GCCACTACCGCCATGGGCCTCACTATCTCCTCC CTCTTCTCCCGACTATTTGGCAAGAAGCAGATG CGCATTTTGATGGTTGGATTGGATGCTGCTGGC AAGACAACCATTCTGTATAAACTGAAGTTAGGGG AGATAGTCACCACCATTCCTACCATTGGTTTTAA TGTGGAAACAGTAGAATATAAGAACATTNTGTTT CACAGTATGGGATGTTGGTGGTCAAGATAGAAT TAGGCCTCTCTGGAAGCATTACTTCCAGAATACC CAGGGTCTTATTTTTGTGGTAGATAGCAACGATC GTGAAAGAATTCAGGAAGTAGCAGATGAGCTGC AGAAAATGCTTCTGGTAGATGAATTGAGAGATGC AGTGCTGCTACTTTTTGCAAACAAACAGGATTTG CCAAATGCTATGGCCATCAGTGAAATGACAGATA AACTAGGGCTTCAGTCTCTTCGTAACAGAACATG GTATGTTCAAGCCACTTGTGCAACACAAGGAACT GGTCTGTATGAAGGACTTGACTGGCTGTCAAAT GAGCTTTCAAAACGTTAAATGAAATTGGATATCT AACCAAGGACATGTTTGATAAAATTGGTCTAGGC TTGTTACAACAAAATTAGTTTGTATCTTGGTTATT AAACAGTATCTGGGACTGGTTTGGGCAGAATATT AAACTTATTTTGTTGCCAATTATTGTTTACCGAGT ATAATGTTGCTATTTAGCAATGTGCTTGGTTTTAA AGAAATTCTCCTTGGGAAAAAAGTATCCTCTTTT AATTTTACTTCCCATAAGCGTAAATGCCTGGACA TAGCTCTTGTGAA | 11 | XFHSMGCWW SR* |
| 2902 | NM_0016 86.3_568 | 568 | AGTTCACCCAATGGACCTGCCTACTGCAGCGTA GGCCTCGCCTCAACGGCAGGAGAGCAGGCGGC TGCGGTTGCTGCAGCCTTCAGTCTCCACCCGGA CTACGCCATGTTGGGGTTTGTGGGTCGGGTGGC CGCTGCTCCGGCCTCCGGGGCCTTGCGGAGAC TCACCCCTTCAGCGTCGCTGCCCCAGCTCAGC TCTTACTGCGGGCCGCTCCGACGGCGGTCCATC CTGTCAGGGACTATGCGGCGCAAACATCTCCTT | 14 | XRSHQNQTIC SHSC* |

TABLE 3B-continued

| SEQ ID | identifier_position | position | modified RNA | PAP length | PAP |
|---|---|---|---|---|---|
| | | | CGCCAAAAGCAGGCGCCGCCACCGGGCGCATC GTGGCGGTCATTGGCGCAGTGGTGGACGTCCA GTTTGATGAGGGACTACCACCAATTCTAAATGCC CTGGAAGTGCAAGGCAGGGAGACCAGACTGGT TTTGGAGGTGGCCCAGCATTTGGGTGAGAGCAC AGTAAGGACTATTGCTATGGATGGTACAGAAGG CTTGGTTAGAGGCCAGAAAGTACTGGATTCTGG TGCACCAATCAAAATTCCTGTTGGTCCTGAGACT TTGGGCAGAATCATGAATGTCATTGGAGAACCTA TTGATGAAANGAGGTCCCATCAAAACCAAACAAT TTGCTCCCATTCATGCTGAGGCTCCAGAGTTCAT GGAAATGAGTGTTGAGCAGGAAATTCTGGTGAC TGGTATCAAGGTTGTCGATCTGCTAGCTCCCTAT GCCAAGGGTGGCAAAATTGGGCTTTTTGGTGGT GCTGGAGTTGGCAAGACTGTACTGATCATGGAG TTAATCAACAATGTCGCCAAAGCCCATGGTGGTT ACTCTGTGTTTGCTGGTGTTGGTGAGAGGACCC GTGAAGGCAATGATTTATACCATGAAATGATTGA ATCTGGTGTTATCAACTTAAAAGATGCCACCTCT AAGGTAGCGCTGGTATATGGTCAAATGAATGAA CCACCTGGTGCTCGTGCCCGGGTAGCTCTGACT GGGCTGACTGTGGCTGAATACTTCAGAGACCAA GAAGGTCAAGATGTACTGCTATTTATTGAT | | |
| 2903 | NM_0016 88.4_921 | 921 | ACTCCCGGGCCGCCGGGGGCACTAGGGGGGG TGGGGTTTCCTTCCGCATCTCCACGGTTCCAAC TCCAACCTAGACTCAAACTGGACGCCGGCCGGA GACTCCGCTCCGGCAGCAAACCCCACGTGGTG CACCTCTGAGCCTCCGCCCCTCTCCCGAGGGAA CCGCAACTCTACTTCTCGCGAGAATTGCTTCTAT GGCTCCATCCTGCTTTCCGGCTGTCGCCCTCAT GCGATAGGCTCTCAGCGTTACTTGACTCTTCTC GCGATAATTTTTTTTAAAAATCTCCCAAGGAAAG TTGAAGGAAGAGTACAAAATTTTCATCTCGCGAG ACTTGTGAGCGGCCATCTTGGTCCTGCCCTGAC AGATTCTCCTATCGGGGTCACAGGGACGCTAAG ATTGCTACCTGGACTTTCGTTGACCATGCTGTCC CGGGTGGTACTTTCCGCCGCCGCCACAGCGGC CCCCTCTCTGAAGAATGCAGCCTTCCTAGGTCC AGGGGTATTGCAGGCAACAAGGACCTTTCATAC AGGGCAGCCACACCTTGTCCCTGTACCACCTCT TCCTGAATACGGAGGAAAAGTTCGTTATGGACT GATCCCTGAGGAATTCTTCCAGTTTCTTTATCCT AAAACTGGTGTAACAGGACCCTATGTACTCGGA ACTGGGCTTATCTTGTACGCTTTATCCAAAGAAA TATATGTGATTAGCGCAGAGACCTTCACTGCCCT ATCAGTACTAGGTGTAATGGTCTATGGAATTAAA AAATATGGTCCCTTTGTTGCAGACTTTGCTGATA AACTCAATGAGCAAAAACTTGCCCAACTAGAAGA GGCGAAGCAGGCTTCCATCCAACACATCCAGAA TGCAATTGATACGGAGAAGTCACAACAGGCACT GGTTCAGAAGCGCCATTACCTTTTNTGATGTGCA AAGGAATAACATTGCTATGGCTTTGGAAGTTACT TACCGGGAACGACTGTATAGAGTATATAAGGAA GTAAAGAATCGCCTGGACTATCATAT | 1 | X* |
| 2904 | NM_0017 43.3_127 | 127 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTNTGAC AAAGATGGTGATGGAACTATAACAACAAAGGAAT TGGGAACTGTAATGAGATCTCTTGGGCAGAATC CCACAGAAGCAGAGTTACAGGACATGATTAATG AAGTAGATGCTGATGGTAATGGCACAATTGACTT CCCTGAATTTCTGACAATGATGGCAAGAAAAATG AAAGACACAGACAGTGAAGAAGAAATTAGAGAA GCATTCCGTGTGTTTGATAAGGATGGCAATGGC TATATTAGTGCTGCAGAACTTCGCCATGTGATGA CAAACCTTGGAGAGAAGTTAACAGATGAAGAAG TTGATGAAATGATCAGGGAAGCAGATATTGATG GTGATGGTCAAGTAAACTATGAAGAGTTTGTACA AATGATGACAGCAAAGTGAAGACCTTGTACAGA ATGTGTTAAATTCTTGTACAAAATTGTTTATTTG CCTTTTCTTTGTTTGTAACTTATCTGTAAAAGGTT TCTCCCTACTGTCAAAAAAATATGCATGTATAGT AATTAGGACTTCATTCCTCCATGTTTCTTCCCTT ATCTTACTGTCATTGTCCTAAAACCTTATTTTAGA AAATTGATCAAGTAACATGTTGCATGTGGCTTAC TCTGGATATATCTAAGCCCTTCTGCACATCTAAA | 1 | X* |

TABLE 3B-continued

| SEQ ID | identifier_position | position | modified RNA | PAP length | PAP |
|---|---|---|---|---|---|
| | | | CTTAGATGGAGTTGGTCAAATGAGGGAACATCT GGGTTATGCCTTTTTTAAAGTAGTTTTCTTTAGGA ACTGTCAGCATGTTGTTGTTGAAGTGTGGAGTTG TAACTCTGCGTGGACTATGGACAGTCAACAATAT GTACTTAAAAGTTGCACTATTGCAAAACGGGTGT ATTATCCAGGTACTCGTACACTATTTTTTTGTACT GCTGGTCCTGTACCAGAAACATTTTCTTTTATTG TTACTTGCTT | | |
| 2905 | NM_0017 43.3_187 | 187 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTNTGGGCAGAATC CCACAGAAGCAGAGTTACAGGACATGATTAATG AAGTAGATGCTGATGGTAATGGCACAATTGACTT CCCTGAATTTCTGACAATGATGGCAAGAAAAATG AAAGACACAGACAGTGAAGAAGAAATTAGAGAA GCATTCCGTGTGTTTGATAAGGATGGCAATGGC TATATTAGTGCTGCAGAACTTCGCCATGTGATGA CAAACCTTGGAGAGAAGTTAACAGATGAAGAAG TTGATGAAATGATCAGGGAAGCAGATATTGATG GTGATGGTCAAGTAAACTATGAAGAGTTTGTACA AATGATGACAGCAAAGTGAAGACCTTGTACAGA ATGTGTTAAATTTCTTGTACAAAATTGTTTATTTG CCTTTTCTTTGTTTGTAACTTATCTGTAAAAGGTT TCTCCCTACTGTCAAAAAAATATGCATGTATAGT AATTAGGACTTCATTCCTCCATGTTTTCTTCCCTT ATCTTACTGTCATTGTCCTAAAACCTTATTTTAGA AAATTGATCAAGTAACATGTTGCATGTGGCTTAC TCTGGATATATCTAAGCCCTTCTGCACATCTAAA CTTAGATGGAGTTGGTCAAATGAGGGAACATCT GGGTTATGCCTTTTTTAAAGTAGTTTTCTTTAGGA ACTGTCAGCATGTTGTTGTTGAAGTGTGGAGTTG TAACTCTGCGTGGACTATGGACAGTCAACAATAT GTACTTAAAAGTTGCACTATTGCAAAACGGGTGT ATTATCCAGGTACTCGTACACTATTTTTTTGTACT GCTGGTCCTGTACCAGAAACATTTTCTTTTATTG TTACTTGCTT | 13 | WAESHRSRV TGHD* |
| 2906 | NM_0017 43.3_259 | 259 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA AGTAGATGCTGATGGTAATGGCACAATNGACTT CCCTGAATTTCTGACAATGATGGCAAGAAAAATG AAAGACACAGACAGTGAAGAAGAAATTAGAGAA GCATTCCGTGTGTTTGATAAGGATGGCAATGGC TATATTAGTGCTGCAGAACTTCGCCATGTGATGA CAAACCTTGGAGAGAAGTTAACAGATGAAGAAG TTGATGAAATGATCAGGGAAGCAGATATTGATG GTGATGGTCAAGTAAACTATGAAGAGTTTGTACA AATGATGACAGCAAAGTGAAGACCTTGTACAGA ATGTGTTAAATTTCTTGTACAAAATTGTTTATTTG CCTTTTCTTTGTTTGTAACTTATCTGTAAAAGGTT TCTCCCTACTGTCAAAAAAATATGCATGTATAGT AATTAGGACTTCATTCCTCCATGTTTTCTTCCCTT ATCTTACTGTCATTGTCCTAAAACCTTATTTTAGA AAATTGATCAAGTAACATGTTGCATGTGGCTTAC TCTGGATATATCTAAGCCCTTCTGCACATCTAAA CTTAGATGGAGTTGGTCAAATGAGGGAACATCT GGGTTATGCCTTTTTTAAAGTAGTTTTCTTTAGGA ACTGTCAGCATGTTGTTGTTGAAGTGTGGAGTTG TAACTCTGCGTGGACTATGGACAGTCAACAATAT GTACTTAAAAGTTGCACTATTGCAAAACGGGTGT ATTATCCAGGTACTCGTACACTATTTTTTTGTACT GCTGGTCCTGTACCAGAAACATTTTCTTTTATTG TTACTTGCTT | 1 | X* |
| 2907 | NM_0017 43.3_278 | 278 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA | 12 | XNDGKKNER HRQ* |

TABLE 3B-continued

| SEQ ID | identifier_position | position | modified RNA | PAP length | PAP |
|---|---|---|---|---|---|
| | | | AGTAGATGCTGATGGTAATGGCACAATTGACTTC CCTGAATTTCTGNACAATGATGGCAAGAAAAATG AAAGACACAGACAGTGAAGAAGAAATTAGAGAA GCATTCCGTGTGTTTGATAAGGATGGCAATGGC TATATTAGTGCTGCAGAACTTCGCCATGTGATGA CAAACCTTGGAGAGAAGTTAACAGATGAAGAAG TTGATGAAATGATCAGGGAAGCAGATATTGATG GTGATGGTCAAGTAAACTATGAAGAGTTTGTACA AATGATGACAGCAAAGTGAAGACCTTGTACAGA ATGTGTTAAATTTCTTGTACAAAATTGTTTATTTG CCTTTTCTTTGTTTGTAACTTATCTGTAAAAGGTT TCTCCCTACTGTCAAAAAAATATGCATGTATAGT AATTAGGACTTCATTCCTCCATGTTTTCTTCCCTT ATCTTACTGTCATTGTCCTAAAACCTTATTTTAGA AAATTGATCAAGTAACATGTTGCATGTGGCTTAC TCTGGATATATCTAAGCCCTTCTGCACATCTAAA CTTAGATGGAGTTGGTCAAATGAGGGAACATCT GGGTTATGCCTTTTTAAAGTAGTTTTCTTTAGGA ACTGTCAGCATGTTGTTGTTGAAGTGTGGAGTTG TAACTCTGCGTGGACTATGGACAGTCAACAATAT GTACTTAAAAGTTGCACTATTGCAAAACGGGTGT ATTATCCAGGTACTCGTACACTATTTTTTTGTACT GCTGGTCCTGTACCAGAAACATTTTCTTTTATTG TTACTTGCTT | | |
| 2908 | NM_0017 43.3_406 | 406 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA AGTAGATGCTGATGGTAATGGCACAATTGACTTC CCTGAATTTCTGACAATGATGGCAAGAAAAATGA AGACACAGACAGTGAAGAAGAAATTAGAGAAG CATTCCGTGTGTTTGATAAGGATGGCAATGGCTA TATTAGTGCTGCAGAACTTCGCCATGTGATGACA AACCTNTGGAGAGAAGTTAACAGATGAAGAAGT TGATGAAATGATCAGGGAAGCAGATATTGATGG TGATGGTCAAGTAAACTATGAAGAGTTTGTACAA ATGATGACAGCAAAGTGAAGACCTTGTACAGAAT GTGTTAAATTTCTTGTACAAAATTGTTTATTTGCC TTTTCTTTGTTTGTAACTTATCTGTAAAAGGTTTC TCCCTACTGTCAAAAAAATATGCATGTATAGTAA TTAGGACTTCATTCCTCCATGTTTTCTTCCCTTAT CTTACTGTCATTGTCCTAAAACCTTATTTTAGAAA ATTGATCAAGTAACATGTTGCATGTGGCTTACTC TGGATATATCTAAGCCCTTCTGCACATCTAAACT TAGATGGAGTTGGTCAAATGAGGGAACATCTGG GTTATGCCTTTTTAAAGTAGTTTTCTTTAGGAAC TGTCAGCATGTTGTTGTTGAAGTGTGGAGTTGTA ACTCTGCGTGGACTATGGACAGTCAACAATATGT ACTTAAAAGTTGCACTATTGCAAAACGGGTGTAT TATCCAGGTACTCGTACACTATTTTTTTGTACTG CTGGTCCTGTACCAGAAACATTTTCTTTTATTGTT ACTTGCTT | 6 | WREVNR* |
| 2909 | NM_0017 43.3_421 | 421 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA AGTAGATGCTGATGGTAATGGCACAATTGACTTC CCTGAATTTCTGACAATGATGGCAAGAAAAATGA AGACACAGACAGTGAAGAAGAAATTAGAGAAG CATTCCGTGTGTTTGATAAGGATGGCAATGGCTA TATTAGTGCTGCAGAACTTCGCCATGTGATGACA AACCTTGGAGAGAAGTTAACNAGATGAAGAAGT TGATGAAATGATCAGGGAAGCAGATATTGATGG TGATGGTCAAGTAAACTATGAAGAGTTTGTACAA ATGATGACAGCAAAGTGAAGACCTTGTACAGAAT GTGTTAAATTTCTTGTACAAAATTGTTTATTTGCC TTTTCTTTGTTTGTAACTTATCTGTAAAAGGTTTC TCCCTACTGTCAAAAAAATATGCATGTATAGTAA TTAGGACTTCATTCCTCCATGTTTTCTTCCCTTAT CTTACTGTCATTGTCCTAAAACCTTATTTTAGAAA ATTGATCAAGTAACATGTTGCATGTGGCTTACTC | 1 | R* |

TABLE 3B-continued

| SEQ ID | identifier_position | position | modified RNA | PAP length | PAP |
|---|---|---|---|---|---|
| | | | TGGATATATCTAAGCCCTTCTGCACATCTAAACT TAGATGGAGTTGGTCAAATGAGGGAACATCTGG GTTATGCCTTTTTAAAGTAGTTTTCTTTAGGAAC TGTCAGCATGTTGTTGTTGAAGTGTGGAGTTGTA ACTCTGCGTGGACTATGGACAGTCAACAATATGT ACTTAAAAGTTGCACTATTGCAAAACGGGTGTAT TATCCAGGTACTCGTACACTATTTTTTTGTACTG CTGGTCCTGTACCAGAAACATTTTCTTTTATTGTT ACTTGCTT | | |
| 2910 | NM_0017 43.3_481 | 481 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA AGTAGATGCTGATGGTAATGGCACAATTGACTTC CCTGAATTTCTGACAATGATGGCAAGAAAAATGA AAGCACAGACAGTGAAGAAGAAATTAGAGAAG CATTCCGTGTGTTTGATAAGGATGGCAATGGCTA TATTAGTGCTGCAGAACTTCGCCATGTGATGACA AACCTTGGAGAGAAGTTAACAGATGAAGAAGTT GATGAAATGATCAGGGAAGCAGATATTGATGGT GATGGTCAAGTAAANCTATGAAGAGTTTGTACAA ATGATGACAGCAAAGTGAAGACCTTGTACAGAAT GTGTTAAATTTCTTGTACAAAATTGTTTATTTGCC TTTTCTTTGTTTGTAACTTATCTGTAAAAGGTTTC TCCCTACTGTCAAAAAAATATGCATGTATAGTAA TTAGGACTTCATTCCTCCATGTTTTCTTCCCTTAT CTTACTGTCATTGTCCTAAAAACCTTATTTTAGAAA ATTGATCAAGTAACATGTTGCATGTGGCTTACTC TGGATATATCTAAGCCCTTCTGCACATCTAAACT TAGATGGAGTTGGTCAAATGAGGGAACATCTGG GTTATGCCTTTTTAAAGTAGTTTTCTTTAGGAAC TGTCAGCATGTTGTTGTTGAAGTGTGGAGTTGTA ACTCTGCGTGGACTATGGACAGTCAACAATATGT ACTTAAAAGTTGCACTATTGCAAAACGGGTGTAT TATCCAGGTACTCGTACACTATTTTTTTGTACTG CTGGTCCTGTACCAGAAACATTTTCTTTTATTGTT ACTTGCTT | 2 | XL* |
| 2911 | NM_0017 43.3_482 | 482 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC CACAGAAGCAGAGTTACAGGACATGATTAATGA AGTAGATGCTGATGGTAATGGCACAATTGACTTC CCTGAATTTCTGACAATGATGGCAAGAAAAATGA AAGACACAGACAGTGAAGAAGAAATTAGAGAAG CATTCCGTGTGTTTGATAAGGATGGCAATGGCTA TATTAGTGCTGCAGAACTTCGCCATGTGATGACA AACCTTGGAGAGAAGTTAACAGATGAAGAAGTT GATGAAATGATCAGGGAAGCAGATATTGATGGT GATGGTCAAGTAAACNTATGAAGAGTTTGTACAA ATGATGACAGCAAAGTGAAGACCTTGTACAGAAT GTGTTAAATTTCTTGTACAAAATTGTTTATTTGCC TTTTCTTTGTTTGTAACTTATCTGTAAAAGGTTTC TCCCTACTGTCAAAAAAATATGCATGTATAGTAA TTAGGACTTCATTCCTCCATGTTTTCTTCCCTTAT CTTACTGTCATTGTCCTAAAAACCTTATTTTAGAAA ATTGATCAAGTAACATGTTGCATGTGGCTTACTC TGGATATATCTAAGCCCTTCTGCACATCTAAACT TAGATGGAGTTGGTCAAATGAGGGAACATCTGG GTTATGCCTTTTTAAAGTAGTTTTCTTTAGGAAC TGTCAGCATGTTGTTGTTGAAGTGTGGAGTTGTA ACTCTGCGTGGACTATGGACAGTCAACAATATGT ACTTAAAAGTTGCACTATTGCAAAACGGGTGTAT TATCCAGGTACTCGTACACTATTTTTTTGTACTG CTGGTCCTGTACCAGAAACATTTTCTTTTATTGTT ACTTGCTT | 1 | X* |
| 2912 | NM_0017 43.3514 | 514 | AGTCCGAGTGGAGAGAGCGAGCTGAGTGGTTG TGTGGTCGCGTCTCGGAAACCGGTAGCGCTTGC AGCATGGCTGACCAACTGACTGAAGAGCAGATT GCAGAATTCAAAGAAGCTTTTTCACTATTTGACA AAGATGGTGATGGAACTATAACAACAAAGGAATT GGGAACTGTAATGAGATCTCTTGGGCAGAATCC | 9 | XVKTLYRMC* |

TABLE 3B-continued

| SEQ ID | identifier_ position | position | modified RNA | PAP length | PAP |
|---|---|---|---|---|---|
| | | | CACAGAAGCAGAGTTACAGGACATGATTAATGA AGTAGATGCTGATGGTAATGGCACAATTGACTTC CCTGAATTTCTGACAATGATGGCAAGAAAAATGA AAGCACAGACAGTGAAGAAGAAATTAGAGAAG CATTCCGTGTGTTTGATAAGGATGGCAATGGCTA TATTAGTGCTGCAGAACTTCGCCATGTGATGACA AACCTTGGAGAGAAGTTAACAGATGAAGAAGTT GATGAAATGATCAGGGAAGCAGATATTGATGGT GATGGTCAAGTAAACTATGAAGAGTTTGTACAAA TGATGACAGCAAANGTGAAGACCTTGTACAGAA TGTGTTAAATTTCTTGTACAAAATTGTTTATTTGC CTTTTCTTTGTTTGTAACTTATCTGTAAAAGGTTT CTCCCTACTGTCAAAAAAATATGCATGTATAGTA ATTAGGACTTCATTCCTCCATGTTTTCTTCCCTTA TCTTACTGTCATTGTCCTAAAACCTTATTTTAGAA AATTGATCAAGTAACATGTTGCATGTGGCTTACT CTGGATATATCTAAGCCCTTCTGCACATCTAAAC TTAGATGGAGTTGGTCAAATGAGGGAACATCTG GGTTATGCCTTTTTTAAAGTAGTTTTCTTTAGGAA CTGTCAGCATGTTGTTGTTGAAGTGTGGAGTTGT AACTCTGCGTGGACTATGGACAGTCAACAATAT GTACTTAAAAGTTGCACTATTGCAAAACGGGTGT ATTATCCAGGTACTCGTACACTATTTTTTTGTACT GCTGGTCCTGTACCAGAAACATTTTCTTTTATTG TTACTTGCTT | | |
| 2913 | NM_0020 46.3_107 2 | 1072 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTTG | 54 | XGGPHGPHG LQGVRPLDHQ PQQEHKRKR ETLTAGESLP HSVPHHTESP LLTVAM* |
| 2914 | NM_0020 46.3_107 5 | 1075 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT | 53 | XGPHGPHGL QGVRPLDHQ PQQEHKRKR ETLTAGESLP HSVPHHTESP LLTVAM* |

TABLE 3B-continued

| SEQ ID | identifier_ position | position | modified RNA | PAP length | PAP |
|---|---|---|---|---|---|
| 2915 | NM_0020 46.3_163 | 163 | GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTTG AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGNC TGCTTTTAACTCTGGTAAAGTGGATATTGTTGCC ATCAATGACCCCTTCATTGACCTCAACTACATGG TTTACATGTTCCAATATGATTCCACCCATGGCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 3 | XCF* |
| 2916 | NM_0020 46.3_203 | 203 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAANTGACCCCTTCATTGACCTCAACTACATGG TTTACATGTTCCAATATGATTCCACCCATGGCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 1 | X* |
| 2917 | NM_0020 46.3_210 | 210 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA | 2 | XH* |

TABLE 3B-continued

| SEQ ID | identifier_position | position | modified RNA | PAP length | PAP |
|---|---|---|---|---|---|
| | | | CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCNTTCATTGACCTCAACTACATGG TTTACATGTTCCAATATGATTCCACCCATGGCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | | |
| 2918 | NM_0020 46.3_224 | 224 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAANCTACATGG TTTACATGTTCCAATATGATTCCACCCATGGCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 9 | XLHGLHVPI* |
| 2919 | NM_0020 46.3_246 | 246 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAANTATGATTCCACCCATGGCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG | 1 | X* |

TABLE 3B-continued

| SEQ ID | identifier_ position | position | modified RNA | PAP length | PAP |
|---|---|---|---|---|---|
| | | | CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | | |
| 2920 | NM_0020 46.3_263 | 263 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGNCAA ATTCCATGGCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 8 | QIPWHRQG* |
| 2921 | NM_0020 46.3_275 | 275 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGNCACCGTCAAGGCTGAGAACGGGAA GCTTGTCATCAATGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA | 4 | HRQG* |

TABLE 3B-continued

| SEQ ID | identifier_ position | position | modified RNA | PAP length | PAP |
|---|---|---|---|---|---|
| | | | CTTCAACAGCGACACCCACTCCTCCACCTTTGA CGCTGGGGCTGGCATTGCCCTCAACGACCACTT T | | |
| 2922 | NM_0020 46.3_311 | 311 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAANTGGAAATCCCATCACCATCTTC CAGGAGCGAGATCCCTCCAAAATCAAGTGGGGC GATGCTGGCGCTGAGTACGTCGTGGAGTCCACT GGCGTCTTCACCACCATGGAGAAGGCTGGGGC TCATTTGCAGGGGGGAGCCAAAAGGGTCATCAT CTCTGCCCCCTCTGCTGATGCCCCCATGTTCGT CATGGGTGTGAACCATGAGAAGTATGACAACAG CCTCAAGATCATCAGCAATGCCTCCTGCACCAC CAACTGCTTAGCACCCCTGGCCAAGGTCATCCA TGACAACTTTGGTATCGTGGAAGGACTCATGAC CACAGTCCATGCCATCACTGCCACCCAGAAGAC TGTGGATGGCCCCTCCGGGAAACTGTGGCGTG ATGGCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 23 | XWKSHHHLP GARSLQNQV GRCWR* |
| 2923 | NM_0020 46.3_602 | 602 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAANCTTTGGTATCGTGGAAGGACTCATGACC ACAGTCCATGCCATCACTGCCACCCAGAAGACT GTGGATGGCCCCTCCGGGAAACTGTGGCGTGA TGGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT | 31 | XLWYRGRTH DHSPCHHCH PEDCGWPLR ETVA* |
| 2924 | NM_0020 46.3_649 | 649 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG | 15 | XHPEDCGWP LRETVA* |

TABLE 3B-continued

| SEQ ID | identifier_position | position | modified RNA | PAP length | PAP |
|---|---|---|---|---|---|
| | | | ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGNCCACCCAGAAGACT<br>GTGGATGGCCCCTCCGGGAAACTGTGGCGTGA<br>TGGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT<br>GGTGGACCTGACCTGCCGTCTAGAAAAACCTGC<br>CAAATATGATGACATCAAGAAGGTGGTGAAGCA<br>GGCGTCGGAGGGCCCCCTCAAGGGCATCCTGG<br>GCTACACTGAGCACCAGGTGGTCTCCTCTGACT<br>TCAACAGCGACACCCACTCCTCCACCTTTGACG<br>CTGGGGCTGGCATTGCCCTCAACGACCACTTT | | |
| 2925 | NM_0020<br>46.3_659 | 659 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAANGACT<br>GTGGATGGCCCCTCCGGGAAACTGTGGCGTGA<br>TGGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT<br>GGTGGACCTGACCTGCCGTCTAGAAAAACCTGC<br>CAAATATGATGACATCAAGAAGGTGGTGAAGCA<br>GGCGTCGGAGGGCCCCCTCAAGGGCATCCTGG<br>GCTACACTGAGCACCAGGTGGTCTCCTCTGACT<br>TCAACAGCGACACCCACTCCTCCACCTTTGACG<br>CTGGGGCTGGCATTGCCCTCAACGACCACTTT | 12 | XDCGWPLRE<br>TVA* |
| 2926 | NM_0020<br>46.3_661 | 661 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGANCT<br>GTGGATGGCCCCTCCGGGAAACTGTGGCGTGA<br>TGGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT<br>GGTGGACCTGACCTGCCGTCTAGAAAAACCTGC | 11 | XCGWPLRETV<br>A* |

TABLE 3B-continued

| SEQ ID | identifier_position | position | modified RNA | PAP length | PAP |
|---|---|---|---|---|---|
| 2927 | NM_0020 46.3_669 | 669 | CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATNGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT | 8 | XPLRETVA* |
| 2928 | NM_0020 46.3_678 | 678 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCNGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT | 5 | XETVA* |
| 2929 | NM_0020 46.3_686 | 686 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC | 2 | VA* |

TABLE 3B-continued

| SEQ ID | identifier_position | position | modified RNA | PAP length | PAP |
|---|---|---|---|---|---|
| | | | AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTNGTGGCGTGAT<br>GGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT<br>GGTGGACCTGACCTGCCGTCTAGAAAAACCTGC<br>CAAATATGATGACATCAAGAAGGTGGTGAAGCA<br>GGCGTCGGAGGGCCCCCTCAAGGGCATCCTGG<br>GCTACACTGAGCACCAGGTGGTCTCCTCTGACT<br>TCAACAGCGACACCCACTCCTCCACCTTTGACG<br>CTGGGGCTGGCATTGCCCTCAACGACCACTTT | | |
| 2930 | NM_0020<br>46.3_691 | 691 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTGTGGCNGTGAT<br>GGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT<br>GGTGGACCTGACCTGCCGTCTAGAAAAACCTGC<br>CAAATATGATGACATCAAGAAGGTGGTGAAGCA<br>GGCGTCGGAGGGCCCCCTCAAGGGCATCCTGG<br>GCTACACTGAGCACCAGGTGGTCTCCTCTGACT<br>TCAACAGCGACACCCACTCCTCCACCTTTGACG<br>CTGGGGCTGGCATTGCCCTCAACGACCACTTT | 1 | X* |
| 2931 | NM_0020<br>46.3_696 | 696 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTGTGGCGTGATN<br>GGCCGCGGGGCTCTCCAGAACATCATCCCTGC<br>CTCTACTGGCGCTGCCAAGGCTGTGGGCAAGGT<br>CATCCCTGAGCTGAACGGGAAGCTCACTGGCAT<br>GGCCTTCCGTGTCCCCACTGCCAACGTGTCAGT | 24 | XPRGSPEHHP<br>CLYWRCQGC<br>GQGHP* |

TABLE 3B-continued

| SEQ ID | identifier_position | position | modified RNA | PAP length | PAP |
|---|---|---|---|---|---|
| 2932 | NM_0020 46.3_698 | 698 | GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGNCCGCGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 23 | PRGSPEHHPC LYWRCQGCG QGHP* |
| 2933 | NM_0020 46.3_702 | 702 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCNGGGGCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 22 | XGSPEHHPCL YWRCQGCGQ GHP* |
| 2934 | NM_0020 46.3_706 | 706 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT | 21 | XSPEHHPCLY WRCQGCGQG HP* |

TABLE 3B-continued

| SEQ ID | identifier_position | position | modified RNA | PAP length | PAP |
|---|---|---|---|---|---|
| | | | TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGNCTCTCCAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | | |
| 2935 | NM_0020 46.3_712 | 712 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCNAGAACATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 19 | XEHHPCLYW RCQGCGQGH P* |
| 2936 | NM_0020 46.3_716 | 716 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG | 18 | XHHPCLYWR CQGCGQGHP* |

TABLE 3B-continued

| SEQ ID | identifier_position | position | modified RNA | PAP length | PAP |
|---|---|---|---|---|---|
| | | | TGGATGGCCCCTCCGGGAAACTGTGGCGTGAT GGCCGCGGGGCTCTCCAGAANCATCATCCCTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | | |
| 2937 | NM_0020 46.3_725 | 725 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCNTG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 14 | CLYWRCQGC GQGHP* |
| 2938 | NM_0020 46.3_726 | 726 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTNG CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 14 | XLYWRCQGC GQGHP* |

TABLE 3B-continued

| SEQ ID | identifier_position | position | modified RNA | PAP length | PAP |
|---|---|---|---|---|---|
| 2939 | NM_0020 46.3_727 | 727 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGN CCTCTACTGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 14 | XLYWRCQGC GQGHP* |
| 2940 | NM_0020 46.3_735 | 735 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTNGGCGCTGCCAAGGCTGTGGGCAAG GTCATCCCTGAGCTGAACGGGAAGCTCACTGGC ATGGCCTTCCGTGTCCCCACTGCCAACGTGTCA GTGGTGGACCTGACCTGCCGTCTAGAAAAACCT GCCAAATATGATGACATCAAGAAGGTGGTGAAG CAGGCGTCGGAGGGCCCCCTCAAGGGCATCCT GGGCTACACTGAGCACCAGGTGGTCTCCTCTGA CTTCAACAGCGACACCCACTCCTCCACCTTTGA CGCTGGGGCTGGCATTGCCCTCAACGACCACTT T | 11 | XRCQGCGQG HP* |
| 2941 | NM_0020 46.3_748 | 748 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC | 7 | XCGQGHP* |

TABLE 3B-continued

| SEQ ID | identifier_position | position | modified RNA | PAP length | PAP |
|---|---|---|---|---|---|
| | | | ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTGTGGCGTGAT<br>GGCCGCGGGGCTCTCCAGAACATCATCCCTGC<br>CTCTACTGGCGCTGCCAAGGNCTGTGGGCAAG<br>GTCATCCCTGAGCTGAACGGGAAGCTCACTGGC<br>ATGGCCTTCCGTGTCCCCACTGCCAACGTGTCA<br>GTGGTGGACCTGACCTGCCGTCTAGAAAAACCT<br>GCCAAATATGATGACATCAAGAAGGTGGTGAAG<br>CAGGCGTCGGAGGGCCCCCTCAAGGGCATCCT<br>GGGCTACACTGAGCACCAGGTGGTCTCCTCTGA<br>CTTCAACAGCGACACCCACTCCTCCACCTTTGA<br>CGCTGGGGCTGGCATTGCCCTCAACGACCACTT<br>T | | |
| 2942 | NM_0020<br>46.3_749 | 749 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTGTGGCGTGAT<br>GGCCGCGGGGCTCTCCAGAACATCATCCCTGC<br>CTCTACTGGCGCTGCCAAGGCNTGTGGGCAAG<br>GTCATCCCTGAGCTGAACGGGAAGCTCACTGGC<br>ATGGCCTTCCGTGTCCCCACTGCCAACGTGTCA<br>GTGGTGGACCTGACCTGCCGTCTAGAAAAACCT<br>GCCAAATATGATGACATCAAGAAGGTGGTGAAG<br>CAGGCGTCGGAGGGCCCCCTCAAGGGCATCCT<br>GGGCTACACTGAGCACCAGGTGGTCTCCTCTGA<br>CTTCAACAGCGACACCCACTCCTCCACCTTTGA<br>CGCTGGGGCTGGCATTGCCCTCAACGACCACTT<br>T | 6 | CGQGHP* |
| 2943 | NM_0020<br>46.3_750 | 750 | AAATTGAGCCCGCAGCCTCCCGCTTCGCTCTCT<br>GCTCCTCCTGTTCGACAGTCAGCCGCATCTTCTT<br>TTGCGTCGCCAGCCGAGCCACATCGCTCAGACA<br>CCATGGGGAAGGTGAAGGTCGGAGTCAACGGA<br>TTTGGTCGTATTGGGCGCCTGGTCACCAGGGCT<br>GCTTTTAACTCTGGTAAAGTGGATATTGTTGCCA<br>TCAATGACCCCTTCATTGACCTCAACTACATGGT<br>TTACATGTTCCAATATGATTCCACCCATGGCAAA<br>TTCCATGGCACCGTCAAGGCTGAGAACGGGAAG<br>CTTGTCATCAATGGAAATCCCATCACCATCTTCC<br>AGGAGCGAGATCCCTCCAAAATCAAGTGGGGCG<br>ATGCTGGCGCTGAGTACGTCGTGGAGTCCACTG<br>GCGTCTTCACCACCATGGAGAAGGCTGGGGCTC<br>ATTTGCAGGGGGGAGCCAAAAGGGTCATCATCT<br>CTGCCCCCTCTGCTGATGCCCCCATGTTCGTCA<br>TGGGTGTGAACCATGAGAAGTATGACAACAGCC<br>TCAAGATCATCAGCAATGCCTCCTGCACCACCA<br>ACTGCTTAGCACCCCTGGCCAAGGTCATCCATG<br>ACAACTTTGGTATCGTGGAAGGACTCATGACCA<br>CAGTCCATGCCATCACTGCCACCCAGAAGACTG<br>TGGATGGCCCCTCCGGGAAACTGTGGCGTGAT<br>GGCCGCGGGGCTCTCCAGAACATCATCCCTGC<br>CTCTACTGGCGCTGCCAAGGCTNGTGGGCAAG<br>GTCATCCCTGAGCTGAACGGGAAGCTCACTGGC<br>ATGGCCTTCCGTGTCCCCACTGCCAACGTGTCA<br>GTGGTGGACCTGACCTGCCGTCTAGAAAAACCT | 6 | XGQGHP* |

TABLE 3B-continued

| SEQ ID | identifier_position | position | modified RNA | PAP length | PAP |
|---|---|---|---|---|---|
| | | | GCCAAATATGATGACATCAAGAAGGTGGTGAAGCAGGCGTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTT | | |
| 2944 | NM_0020 46.3_767 | 767 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAGCTTGTCATCAATGGAAATCCCATCACCATCTTCCAGGAGCGAGATCCCTCCAAAATCAAGTGGGGCGATGCTGGCGCTGAGTACGTCGTGGAGTCCACTGGCGTCTTCACCACCATGGAGAAGGCTGGGGCTCATTTGCAGGGGGGAGCCAAAAGGGTCATCATCTCTGCCCCCTCTGCTGATGCCCCCATGTTCGTCATGGGTGTGAACCATGAGAAGTATGACAACAGCCTCAAGATCATCAGCAATGCCTCCTGCACCACCAACTGCTTAGCACCCCTGGCCAAGGTCATCCATGACAACTTTGGTATCGTGGAAGGACTCATGACCACAGTCCATGCCATCACTGCCACCCAGAAGACTGTGGATGGCCCCTCCGGGAAACTGTGGCGTGATGGCCGCGGGGCTCTCCAGAACATCATCCCTGCCTCTACTGGCGCTGCCAAGGCTGTGGGCAAGGTCATCCCNTGAGCTGAACGGGAAGCTCACTGGCATGGCCTTCCGTGTCCCCACTGCCAACGTGTCAGTGGTGGACCTGACCTGCCGTCTAGAAAAACCTGCCAAATATGATGACATCAAGAAGGTGGTGAAGCAGGCGTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTT | 0 | * |
| 2945 | NM_0020 46.3_773 | 773 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAGCTTGTCATCAATGGAAATCCCATCACCATCTTCCAGGAGCGAGATCCCTCCAAAATCAAGTGGGGCGATGCTGGCGCTGAGTACGTCGTGGAGTCCACTGGCGTCTTCACCACCATGGAGAAGGCTGGGGCTCATTTGCAGGGGGGAGCCAAAAGGGTCATCATCTCTGCCCCCTCTGCTGATGCCCCCATGTTCGTCATGGGTGTGAACCATGAGAAGTATGACAACAGCCTCAAGATCATCAGCAATGCCTCCTGCACCACCAACTGCTTAGCACCCCTGGCCAAGGTCATCCATGACAACTTTGGTATCGTGGAAGGACTCATGACCACAGTCCATGCCATCACTGCCACCCAGAAGACTGTGGATGGCCCCTCCGGGAAACTGTGGCGTGATGGCCGCGGGGCTCTCCAGAACATCATCCCTGCCTCTACTGGCGCTGCCAAGGCTGTGGGCAAGGTCATCCCTGAGCTNGAACGGGAAGCTCACTGGCATGGCCTTCCGTGTCCCCACTGCCAACGTGTCAGTGGTGGACCTGACCTGCCGTCTAGAAAAACCTGCCAAATATGATGACATCAAGAAGGTGGTGAAGCAGGCGTCGGAGGGCCCCCTCAAGGGCATCCTGGGCTACACTGAGCACCAGGTGGTCTCCTCTGACTTCAACAGCGACACCCACTCCTCCACCTTTGACGCTGGGGCTGGCATTGCCCTCAACGACCACTTT | 31 | EREAHWHGL PCPHCQRVS GGPDLPSRKT CQI* |
| 2946 | NM_0020 46.3_776 | 776 | AAATTGAGCCCGCAGCCTCCCGCTTCGCTCTCTGCTCCTCCTGTTCGACAGTCAGCCGCATCTTCTTTTGCGTCGCCAGCCGAGCCACATCGCTCAGACACCATGGGGAAGGTGAAGGTCGGAGTCAACGGATTTGGTCGTATTGGGCGCCTGGTCACCAGGGCTGCTTTTAACTCTGGTAAAGTGGATATTGTTGCCATCAATGACCCCTTCATTGACCTCAACTACATGGTTTACATGTTCCAATATGATTCCACCCATGGCAAATTCCATGGCACCGTCAAGGCTGAGAACGGGAAG | 31 | XREAHWHGL PCPHCQRVS GGPDLPSRKT CQI* |

TABLE 3B-continued

| SEQ ID | identifier_position | position | modified RNA | PAP length | PAP |
|---|---|---|---|---|---|
| | | | CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAANCGGGAAGCTCACTGGCA TGGCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | | |
| 2947 | NM_0020 46.3_777 | 777 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACNGGGAAGCTCACTGGCA TGGCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | 30 | XEAHWHGLP CPHCQRVSG GPDLPSRKTC QI* |
| 2948 | NM_0020 46.3_780 | 780 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGNAAGCTCACTGGCA | 29 | XAHWHGLPC PHCQRVSGG PDLPSRKTCQ I* |

TABLE 3B-continued

| SEQ ID | identifier_position | position | modified RNA | PAP length | PAP |
|---|---|---|---|---|---|
| | | | TGGCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | | |
| 2949 | NM_0020 46.3_791 | 791 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGNCA TGGCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | 25 | HGLPCPHCQ RVSGGPDLPS RKTCQI* |
| 2950 | NM_0020 46.3_794 | 794 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT NGGCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | 25 | XGLPCPHCQR VSGGPDLPSR KTCQI* |
| 2951 | NM_0020 46.3_796 | 796 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA | 24 | XLPCPHCQRV SGGPDLPSRK TCQI* |

TABLE 3B-continued

| SEQ ID | identifier_ position | position | modified RNA | PAP length | PAP |
|---|---|---|---|---|---|
| | | | TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGNCCTTCCGTGTCCCCACTGCCAACGTGTCAG TGGTGGACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | | |
| 2952 | NM_0020 46.3_832 | 832 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGNACCTGACCTGCCGTCTAGAAAAACCTG CCAAATATGATGACATCAAGAAGGTGGTGAAGC AGGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | 12 | XPDLPSRKTC QI* |
| 2953 | NM_0020 46.3_910 | 910 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT | 8 | XQGHPGLH* |

TABLE 3B-continued

| SEQ ID | identifier_ position | position | modified RNA | PAP length | PAP |
|---|---|---|---|---|---|
| 2954 | NM_0020 46.3_914 | 914 | CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCNTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTG GGCTACACTGAGCACCAGGTGGTCTCCTCTGAC TTCAACAGCGACACCCACTCCTCCACCTTTGAC GCTGGGGCTGGCATTGCCCTCAACGACCACTTT | 7 | XGHPGLH* |
| 2955 | NM_0020 46.3_997 | 997 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCTGGCCAAGGTCATCCATG ACAACTTTGGTATCGTGGAAGGACTCATGACCA CAGTCCATGCCATCACTGCCACCCAGAAGACTG TGGATGGCCCCTCCGGGAAACTGTGGCGTGAT GGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGNCTGGCATTGCCCTCAACGACCACTTT | 16 | XWHCPQRPL CQAHFLV* |
| 2956 | NM_0020 87.2_274 | 274 | GGCGAGAGGAAGCAGGGAGGAGAGTGATTTGA GTAGAAAAGAAACACAGCATTCCAGGCTGGCCC CACCTCTATATTGATAAGTAGCCAATGGGAGCG GGTAGCCCTGATCCCTGGCCAATGGAAACTGAG GTAGGCGGGTCATCGCGCTGGGGTCTGTAGTCT GAGCGCTACCCGGTTGCTGCTGCCCAAGGACC GCGGAGTCGGACGCAGGCAGACCATGTGGACC | 45 | XVPRWSVLPC GLLPGPRRSQ LQLLPSPSGQ MAHNTEQAS GWPLPG* |

TABLE 3B-continued

| SEQ ID | identifier_position | position | modified RNA | PAP length | PAP |
|---|---|---|---|---|---|
| | | | CTGGTGAGCTGGGTGGCCTTAACAGCAGGGCT GGTGGCTGGAACGCNGGTGCCCAGATGGTCAG TTCTGCCCTGTGGCCTGCTGCCTGGACCCCGGA GGAGCCAGCTACAGCTGCTGCCGTCCCCTTCTG GACAAATGGCCCACAACACTGAGCAGGCATCTG GGTGGCCCCTGCCAGGTTGATGCCCACTGCTCT GCCGGCCACTCCTGCATCTTTACCGTCTCAGGG ACTTCCAGTTGCTGCCCCTTCCCAGAGGCCGTG GCATGCGGGGATGGCCATCACTGCTGCCCACG GGGCTTCCACTGCAGTGCAGACGGGCGATCCT GCTTCCAAAGATCAGGTAACAACTCCGTGGGTG CCATCCAGTGCCCTGATAGTCAGTTCGAATGCC CGGACTTCTCCACGTGCTGTGTTATGGTCGATG GCTCCTGGGGGTGCTGCCCCATGCCCCAGGCT TCCTGCTGTGAAGACAGGGTGCACTGCTGTCCG CACGGTGCCTTCTGCGACCTGGTTCACACCCGC TGCATCACACCCACGGGCACCCACCCCCTGGCA AAGAAGCTCCCTGCCCAGAGGACTAACAGGGCA GTGGCCTTGTCCAGCTCGGTCATGTGTCCGGAC GCACGGTCCCGGTGCCCTGATGGTTCTACCTGC TGTGAGCTGCCCAGTGGGAAGTATGGCTGCTGC CCAATGCCCAACGCCACCTGCTGCTCCGATCAC CTGCACTGCTGCCCCAAGACACTGTGTGTGAC CTGATCCAGAGTAAGTGCCTCTCCAAGGAGAAC GCTACCACG | | |
| 2957 | NM_002106.3_474 | 474 | ATTGGTGGGATGAGCAATCCGAGTTCCCGGATG AGGGAACATTCTGCAGTATAAAGGGAGCAGGGA AGGCGGGAGACAGCGCAGTTTGAATCGCGGTG CGACGAAGGAGTAGGTGGTGGGATCTCACCGT GGGTCCGATTAGCCTTTTCTCTGCCTTGCTTGCT TGAGCTTCAGCGGAATTCGAAATGGCTGGCGGT AAGGCTGGAAAGGACTCCGGAAAGGCCAAGAC AAAGGCGGTTTCCCGCTCGCAGAGAGCCGGCTT GCAGTTCCCAGTGGGCCGTATTCATCGACACCT AAAATCTAGGACGACCAGTCATGGACGTGTGGG CGCGACTGCCGCTGTGTACAGCGCAGCCATCCT GGAGTACCTCACCGCAGAGGTACTTGAACTGGC AGGAAATGCATCAAAAGACTTAAAGGTAAAGCGT ATTACCCCTCGTCACTTGCAACTTGCTATTCGTG GAGATGAAGAATNTGGATTCTCTCATCAAGGCTA CAATTGCTGGTGGTGGTGTCATTCCACACATCC ACAAATCTCTGATTGGGAAGAAAGGACAACAGA AGACTGTCTAAAGGATGCCTGGATTCCTTGTTAT CTCAGGACTCTAAATACTCTAACAGCTGTCCAGT GTTGGTGATTCCAGTGGACTGTATCTCTGTGAAA AACACAATTTTGCCTTTTTGTAATTCTATTTGAGC AAGTTGGAAGTTTAATTAGCTTTCCAACCAACCA AATTTCTGCATTCGAGTCTTAACCATATTTAAGTG TTACTGTGGCTTCAAAGAAGCTATTGATTCTGAA GTAGTGGGTTTTGATTGAGTTGACTGTTTTTAAA AAACTGTTTGGATTTTAATTGTGATGCAGAAGTT ATAGTAACAAACATTTGGTTTTGTACAGACATTAT TTCCACTCTGGTGGATAAGTTCAATAAAGGTCAT ATCCCAAACAAAA | 54 | XGFSHQGYN CWWWCHSTH PQISDWEERT TEDCLKDAWI PCYLRTLNTLT AVQCW* |
| 2958 | NM_002273.2_782 | 782 | ATTCCTGAGAGCTCTCCTCACCAAGAAGCAGCT TCTCCGCTCCTTCTAGGATCTCCGCCTGGTTCG GCCCGCCTGCCTCCACTCCTGCCTCTACCATGT CCATCAGGGTGACCCAGAAGTCCTACAAGGTGT CCACCTCTGGCCCCCGGGCCTTCAGCAGCCGC TCCTACACGAGTGGGCCCGGTTCCCGCATCAGC TCCTCGAGCTTCTCCCGAGTGGGCAGCAGCAAC TTTCGCGGTGGCCTGGGCGGCGGCTATGGTGG GGCCAGCGGCATGGGAGGCATCACCGCAGTTA CGGTCAACCAGAGCCTGCTGAGCCCCCTTGTCC TGGAGGTGGACCCCAACATCCAGGCCGTGCGC ACCCAGGAGAAGGAGCAGATCAAGACCCTCAAC AACAAGTTTGCCTCCTTCATAGACAAGGTACGGT TCCTGGAGCAGCAGAACAAGATGCTGGAGACCA AGTGGAGCCTCCTGCAGCAGCAGAAGACGGCT CGAAGCAACATGGACAACATGTTCGAGAGCTAC ATCAACAACCTTAGGCGGCAGCTGGAGACTCTG GGCCAGGAGAAGCTGAAGCTGGAGGCGGAGCT TGGCAACATGCAGGGGCTGGTGGAGGACTTCAA GAACAAGTATGAGGATGAGATCAATAAGCGTAC AGAGATGGAGAACGAATTTGTCCTCATCAAGAA GGATGTGGATGAAGCTTACATGAACAAGGTAGA GCTGGAGTCTCGCCTGGAAGGGCTGACCGACG | 32 | XGDPGAAVPD LGHICGAVHG QQPLPGHGQ HHC* |

TABLE 3B-continued

| SEQ ID | identifier_ position | position | modified RNA | PAP length | PAP |
|---|---|---|---|---|---|
| | | | AGATCAACTTCCTCAGGCAGCTATATGAANGAG GAGATCCGGGAGCTGCAGTCCCAGATCTCGGA CACATCTGTGGTGCTGTCCATGGACAACAGCCG CTCCCTGGACATGGACAGCATCATTGCTGAGGT CAAGGCACAGTACGAGGATATTGCCAACCGCAG CCGGGCTGAGGCTGAGAGCATGTACCAGATCAA GTATGAGGAGCTGCAGAGCCTGGCTGGGAAGC ACGGGGATGACCTGCGGCGCACAAAGACTGAG ATCTCTGAGA | | |
| 2959 | NM_0022 73.2_795 | 795 | ATTCCTGAGAGCTCTCCTCACCAAGAAGCAGCT TCTCCGCTCCTTCTAGGATCTCCGCCTGGTTCG GCCCGCCTGCCTCCACTCCTGCCTCTACCATGT CCATCAGGGTGACCCAGAAGTCCTACAAGGTGT CCACCTCTGGCCCCGGGCCTTCAGCAGCCGC TCCTACACGAGTGGGCCCGGTTCCCGCATCAGC TCCTCGAGCTTCTCCCGAGTGGGCAGCAGCAAC TTTCGCGGTGGCCTGGGCGGCGGCTATGGTGG GGCCAGCGGCATGGGAGGCATCACCGCAGTTA CGGTCAACCAGAGCCTGCTGAGCCCCCTTGTCC TGGAGGTGGACCCCAACATCCAGGCCGTGCGC ACCCAGGAGAAGGAGCAGATCAAGACCCTCAAC AACAAGTTTGCCTCCTTCATAGACAAGGTACGGT TCCTGGAGCAGCAGAACAAGATGCTGGAGACCA AGTGGAGCCTCCTGCAGCAGCAGAAGACGGCT CGAAGCAACATGGACAACATGTTCGAGAGCTAC ATCAACAACCTTAGGCGGCAGCTGGAGACTCTG GGCCAGGAGAAGCTGAAGCTGGAGGCGGAGCT TGGCAACATGCAGGGGCTGGTGGAGGACTTCAA GAACAAGTATGAGGATGAGATCAATAAGCGTAC AGAGATGGAGAACGAATTTGTCCTCATCAAGAA GGATGTGGATGAAGCTTACATGAACAAGGTAGA GCTGGAGTCTCGCCTGGAAGGGCTGACCGACG AGATCAACTTCCTCAGGCAGCTATATGAAGAGG AGATCCGGGNAGCTGCAGTCCCAGATCTCGGAC ACATCTGTGGTGCTGTCCATGGACAACAGCCGC TCCCTGGACATGGACAGCATCATTGCTGAGGTC AAGGCACAGTACGAGGATATTGCCAACCGCAGC CGGGCTGAGGCTGAGAGCATGTACCAGATCAAG TATGAGGAGCTGCAGAGCCTGGCTGGGAAGCA CGGGGATGACCTGCGGCGCACAAAGACTGAGA TCTCTGAGA | 28 | XAAVPDLGHI CGAVHGQQP LPGHGQHHC* |
| 2960 | NM_0022 73.2_828 | 828 | ATTCCTGAGAGCTCTCCTCACCAAGAAGCAGCT TCTCCGCTCCTTCTAGGATCTCCGCCTGGTTCG GCCCGCCTGCCTCCACTCCTGCCTCTACCATGT CCATCAGGGTGACCCAGAAGTCCTACAAGGTGT CCACCTCTGGCCCCGGGCCTTCAGCAGCCGC TCCTACACGAGTGGGCCCGGTTCCCGCATCAGC TCCTCGAGCTTCTCCCGAGTGGGCAGCAGCAAC TTTCGCGGTGGCCTGGGCGGCGGCTATGGTGG GGCCAGCGGCATGGGAGGCATCACCGCAGTTA CGGTCAACCAGAGCCTGCTGAGCCCCCTTGTCC TGGAGGTGGACCCCAACATCCAGGCCGTGCGC ACCCAGGAGAAGGAGCAGATCAAGACCCTCAAC AACAAGTTTGCCTCCTTCATAGACAAGGTACGGT TCCTGGAGCAGCAGAACAAGATGCTGGAGACCA AGTGGAGCCTCCTGCAGCAGCAGAAGACGGCT CGAAGCAACATGGACAACATGTTCGAGAGCTAC ATCAACAACCTTAGGCGGCAGCTGGAGACTCTG GGCCAGGAGAAGCTGAAGCTGGAGGCGGAGCT TGGCAACATGCAGGGGCTGGTGGAGGACTTCAA GAACAAGTATGAGGATGAGATCAATAAGCGTAC AGAGATGGAGAACGAATTTGTCCTCATCAAGAA GGATGTGGATGAAGCTTACATGAACAAGGTAGA GCTGGAGTCTCGCCTGGAAGGGCTGACCGACG AGATCAACTTCCTCAGGCAGCTATATGAAGAGG AGATCCGGGAGCTGCAGTCCCAGATCTCGGACA CATCTGTGGNTGCTGTCCATGGACAACAGCCGC TCCCTGGACATGGACAGCATCATTGCTGAGGTC AAGGCACAGTACGAGGATATTGCCAACCGCAGC CGGGCTGAGGCTGAGAGCATGTACCAGATCAAG TATGAGGAGCTGCAGAGCCTGGCTGGGAAGCA CGGGGATGACCTGCGGCGCACAAAGACTGAGA TCTCTGAGA | 17 | XAVHGQQPLP GHGQHHC* |
| 2961 | NM_0022 95.4_414 | 414 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT | 16 | XPDPGSLPGA TASCGY* |

TABLE 3B-continued

| SEQ ID | identifier_ position | position | modified RNA | PAP length | PAP |
|---|---|---|---|---|---|
| | | | AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAANCCAGATCCAGGCAGCCTTC CGGGAGCCACGGCTTCTTGTGGTTACTGACCCC AGGGCTGACCACCAGCCTCTCACGGAGGCATCT TATGTTAACCTACCTACCATTGCGCTGTGTAACA CAGATTCTCCTCTGCGCTATGTGGACATTGCCAT CCCATGCAACAACAAGGGAGCTCACTCAGTGGG TTTGATGTGGTGGATGCTGGCTCGGGAAGTTCT GCGCATGCGTGGCACCATTTCCCGTGAACACCC ATGGGAGGTCATGCCTGATCTGTACTTCTACAG AGATCCTGAAGAGATTGAAAAAGAAGAGCAGGC TGCTGCTGAGAAGGCAGTGACCAAGGAGGAATT TCAGGGTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | | |
| 2962 | NM_0022 95.4_519 | 519 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATNTGCGCTGTGTAACA CAGATTCTCCTCTGCGCTATGTGGACATTGCCAT CCCATGCAACAACAAGGGAGCTCACTCAGTGGG TTTGATGTGGTGGATGCTGGCTCGGGAAGTTCT GCGCATGCGTGGCACCATTTCCCGTGAACACCC ATGGGAGGTCATGCCTGATCTGTACTTCTACAG AGATCCTGAAGAGATTGAAAAAGAAGAGCAGGC TGCTGCTGAGAAGGCAGTGACCAAGGAGGAATT TCAGGGTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | 4 | XCAV* |
| 2963 | NM_0022 95.4_666 | 666 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG | 5 | MGGHA* |

TABLE 3B-continued

| SEQ ID | identifier_position | position | modified RNA | PAP length | PAP |
|---|---|---|---|---|---|
| | | | CGCATGCGTGGCACCATTTCCCGTGAACACCCN ATGGGAGGTCATGCCTGATCTGTACTTCTACAG AGATCCTGAAGAGATTGAAAAAGAAGAGCAGGC TGCTGCTGAGAAGGCAGTGACCAAGGAGGAATT TCAGGGTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | | |
| 2964 | NM_0022 95.4_681 | 681 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCA TGGGAGGTCATGCCNTGATCTGTACTTCTACAG AGATCCTGAAGAGATTGAAAAAGAAGAGCAGGC TGCTGCTGAGAAGGCAGTGACCAAGGAGGAATT TCAGGGTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | 0 | * |
| 2965 | NM_0022 95.4_771 | 771 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCA TGGGAGGTCATGCCTGATCTGTACTTCTACAGA GATCCTGAAGAGATTGAAAAAGAAGAGCAGGCT GCTGCTGAGAAGGCAGTGACCAAGGAGGAATTT CAGGGNTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | 0 | * |
| 2966 | NM_0022 95.4_787 | 787 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT | 2 | XS* |

TABLE 3B-continued

| SEQ ID | identifier_ position | position | modified RNA | PAP length | PAP |
|---|---|---|---|---|---|
| | | | GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCA TGGGAGGTCATGCCTGATCTGTACTTCTACAGA GATCCTGAAGAGATTGAAAAAGAAGAGCAGGCT GCTGCTGAGAAGGCAGTGACCAAGGAGGAATTT CAGGGTGAATGGACTGCTCCCNGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | | |
| 2967 | NM_0022 95.4_829 | 829 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCA TGGGAGGTCATGCCTGATCTGTACTTCTACAGA GATCCTGAAGAGATTGAAAAAGAAGAGCAGGCT GCTGCTGAGAAGGCAGTGACCAAGGAGGAATTT CAGGGTGAATGGACTGCTCCCGCTCCTGAGTTC ACTGCTACTCAGCCTGAGGTTGCAGACTGGNTC TGAAGGTGTACAGGTGCCCTCTGTGCCTATTCA GCAATTCCCTACTGAAGACTGGAGCGCTCAGCC TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | 1 | X* |
| 2968 | NM_0022 95.4_845 | 845 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT | 11 | XALCAYSAIPY* |

| SEQ ID | identifier_ position | position | modified RNA | PAP length | PAP |
|---|---|---|---|---|---|
| | | | TTGATGTGGTGGATGCTGGCTCGGGAAGTTCTG<br>CGCATGCGTGGCACCATTTCCCGTGAACACCCA<br>TGGGAGGTCATGCCTGATCTGTACTTCTACAGA<br>GATCCTGAAGAGATTGAAAAAGAAGAGCAGGCT<br>GCTGCTGAGAAGGCAGTGACCAAGGAGGAATTT<br>CAGGGTGAATGGACTGCTCCCGCTCCTGAGTTC<br>ACTGCTACTCAGCCTGAGGTTGCAGACTGGTCT<br>GAAGGTGTACAGGNTGCCCTCTGTGCCTATTCA<br>GCAATTCCCTACTGAAGACTGGAGCGCTCAGCC<br>TGCCACGGAAGACTGGTCTGCAGCTCCCACTGC<br>TCAGGCCACTGAATGGGTAGGAGCAACCACTGA<br>CTGGTCTTAAGCTGTTCTTGCATAGGCTCTTAAG<br>CAGCATGGAAAAATGGTTGATGGAAA | | |
| 2969 | NM_0022<br>95.4_847 | 847 | CGCCTGTCTTTTCCGTGCTACCTGCAGAGGGGT<br>CCATACGGCGTTGTTCTGGATTCCCGTCGTAAC<br>TTAAAGGGAAATTTTCACAATGTCCGGAGCCCTT<br>GATGTCCTGCAAATGAAGGAGGAGGATGTCCTT<br>AAGTTCCTTGCAGCAGGAACCCACTTAGGTGGC<br>ACCAATCTTGACTTCCAGATGGAACAGTACATCT<br>ATAAAAGGAAAAGTGATGGCATCTATATCATAAA<br>TCTCAAGAGGACCTGGGAGAAGCTTCTGCTGGC<br>AGCTCGTGCAATTGTTGCCATTGAAAACCCTGCT<br>GATGTCAGTGTTATATCCTCCAGGAATACTGGCC<br>AGAGGGCTGTGCTGAAGTTTGCTGCTGCCACTG<br>GAGCCACTCCAATTGCTGGCCGCTTCACTCCTG<br>GAACCTTCACTAACCAGATCCAGGCAGCCTTCC<br>GGGAGCCACGGCTTCTTGTGGTTACTGACCCCA<br>GGGCTGACCACCAGCCTCTCACGGAGGCATCTT<br>ATGTTAACCTACCTACCATTGCGCTGTGTAACAC<br>AGATTCTCCTCTGCGCTATGTGGACATTGCCATC<br>CCATGCAACAACAAGGGAGCTCACTCAGTGGGT<br>TTGATGTGGTGGATGCTGGCTCGGGAAGTTCTG<br>CGCATGCGTGGCACCATTTCCCGTGAACACCCA<br>TGGGAGGTCATGCCTGATCTGTACTTCTACAGA<br>GATCCTGAAGAGATTGAAAAAGAAGAGCAGGCT<br>GCTGCTGAGAAGGCAGTGACCAAGGAGGAATTT<br>CAGGGTGAATGGACTGCTCCCGCTCCTGAGTTC<br>ACTGCTACTCAGCCTGAGGTTGCAGACTGGTCT<br>GAAGGTGTACAGGTGNCCCTCTGTGCCTATTCA<br>GCAATTCCCTACTGAAGACTGGAGCGCTCAGCC<br>TGCCACGGAAGACTGGTCTGCAGCTCCCACTGC<br>TCAGGCCACTGAATGGGTAGGAGCAACCACTGA<br>CTGGTCTTAAGCTGTTCTTGCATAGGCTCTTAAG<br>CAGCATGGAAAAATGGTTGATGGAAA | 10 | XLCAYSAIPY* |
| 2970 | NM_0022<br>95.4_850 | 850 | CGCCTGTCTTTTCCGTGCTACCTGCAGAGGGGT<br>CCATACGGCGTTGTTCTGGATTCCCGTCGTAAC<br>TTAAAGGGAAATTTTCACAATGTCCGGAGCCCTT<br>GATGTCCTGCAAATGAAGGAGGAGGATGTCCTT<br>AAGTTCCTTGCAGCAGGAACCCACTTAGGTGGC<br>ACCAATCTTGACTTCCAGATGGAACAGTACATCT<br>ATAAAAGGAAAAGTGATGGCATCTATATCATAAA<br>TCTCAAGAGGACCTGGGAGAAGCTTCTGCTGGC<br>AGCTCGTGCAATTGTTGCCATTGAAAACCCTGCT<br>GATGTCAGTGTTATATCCTCCAGGAATACTGGCC<br>AGAGGGCTGTGCTGAAGTTTGCTGCTGCCACTG<br>GAGCCACTCCAATTGCTGGCCGCTTCACTCCTG<br>GAACCTTCACTAACCAGATCCAGGCAGCCTTCC<br>GGGAGCCACGGCTTCTTGTGGTTACTGACCCCA<br>GGGCTGACCACCAGCCTCTCACGGAGGCATCTT<br>ATGTTAACCTACCTACCATTGCGCTGTGTAACAC<br>AGATTCTCCTCTGCGCTATGTGGACATTGCCATC<br>CCATGCAACAACAAGGGAGCTCACTCAGTGGGT<br>TTGATGTGGTGGATGCTGGCTCGGGAAGTTCTG<br>CGCATGCGTGGCACCATTTCCCGTGAACACCCA<br>TGGGAGGTCATGCCTGATCTGTACTTCTACAGA<br>GATCCTGAAGAGATTGAAAAAGAAGAGCAGGCT<br>GCTGCTGAGAAGGCAGTGACCAAGGAGGAATTT<br>CAGGGTGAATGGACTGCTCCCGCTCCTGAGTTC<br>ACTGCTACTCAGCCTGAGGTTGCAGACTGGTCT<br>GAAGGTGTACAGGTGCCCNTCTGTGCCTATTCA<br>GCAATTCCCTACTGAAGACTGGAGCGCTCAGCC<br>TGCCACGGAAGACTGGTCTGCAGCTCCCACTGC<br>TCAGGCCACTGAATGGGTAGGAGCAACCACTGA<br>CTGGTCTTAAGCTGTTCTTGCATAGGCTCTTAAG<br>CAGCATGGAAAAATGGTTGATGGAAA | 9 | XCAYSAIPY* |
| 2971 | NM_0023<br>00.4_343 | 343 | CTTGCAGAGCCGGCGCCGGAGGAGACGCACGC<br>AGCTGACTTTGTCTTCTCCGCACGACTGTTACAG | 9 | XRLFCDRQF* |

TABLE 3B-continued

| SEQ ID | identifier_position | position | modified RNA | PAP length | PAP |
|---|---|---|---|---|---|
| | | | AGGTCTCCAGAGCCTTCTCTCTCCTGTGCAAAAT<br>GGCAACTCTTAAGGAAAAACTCATTGCACCAGTT<br>GCGGAAGAAGAGGCAACAGTTCCAAACAATAAG<br>ATCACTGTAGTGGGTGTTGGACAAGTTGGTATG<br>GCGTGTGCTATCAGCATTCTGGGAAAGTCTCTG<br>GCTGATGAACTTGCTCTTGTGGATGTTTTGGAAG<br>ATAAGCTTAAAGGAGAAATGATGGATCTGCAGC<br>ATGGGAGCTTATTTCTTCAGACACCTAAAATTGT<br>GGCAGATAANAGATTATTCTGTGACCGCCAATTC<br>TAAGATTGTAGTGGTAACTGCAGGAGTCCGTCA<br>GCAAGAAGGGGAGAGTCGGCTCAATCTGGTGC<br>AGAGAAATGTTAATGTCTTCAAATTCATTATTCCT<br>CAGATCGTCAAGTACAGTCCTGATTGCATCATAA<br>TTGTGGTTTCCAACCCAGTGGACATTCTTACGTA<br>TGTTACCTGGAAACTAAGTGGATTACCCAAACAC<br>CGCGTGATTGGAAGTGGATGTAATCTGGATTCT<br>GCTAGATTTCGCTACCTTATGGCTGAAAAACTTG<br>GCATTCATCCCAGCAGCTGCCATGGATGGATTT<br>TGGGGGAACATGGCGACTCAAGTGTGGCTGTGT<br>GGAGTGGTGTGAATGTGGCAGGTGTTTCTCTCC<br>AGGAATTGAATCCAGAAATGGGAACTGACAATG<br>ATAGTGAAAATTGGAAGGAAGTGCATAAGATGG<br>TGGTTGAAAGTGCCTATGAAGTCATCAAGCTAAA<br>AGGATATACCAACTGGGCTATTGGATTAAGTGTG<br>GCTGATCTTATTGAATCCATGTTGAAAAATCTAT<br>CCAGGATTCATCCCGTGTCAACAATGGTAAAGG<br>GGATGTATGGCATTGAGAATGAAGTCTTCCTGA<br>GCCTTCCATGTATCCTCAATGCCCGGGGATTAA<br>CCAGCGTTATCAACCAGAAGC | | |
| 2972 | NM_0023<br>00.4_439 | 439 | CTTGCAGAGCCGGCGCCGGAGGAGACGCACGC<br>AGCTGACTTTGTCTTCTCCGCACGACTGTTACAG<br>AGGTCTCCAGAGCCTTCTCTCTCCTGTGCAAAAT<br>GGCAACTCTTAAGGAAAAACTCATTGCACCAGTT<br>GCGGAAGAAGAGGCAACAGTTCCAAACAATAAG<br>ATCACTGTAGTGGGTGTTGGACAAGTTGGTATG<br>GCGTGTGCTATCAGCATTCTGGGAAAGTCTCTG<br>GCTGATGAACTTGCTCTTGTGGATGTTTTGGAAG<br>ATAAGCTTAAAGGAGAAATGATGGATCTGCAGC<br>ATGGGAGCTTATTTCTTCAGACACCTAAAATTGT<br>GGCAGATAAAGATTATTCTGTGACCGCCAATTCT<br>AAGATTGTAGTGGTAACTGCAGGAGTCCGTCAG<br>CAAGAAGGGGAGAGTCGGCTCAATCTGGTGCA<br>GAGAAANTGTTAATGTCTTCAAATTCATTATTCCT<br>CAGATCGTCAAGTACAGTCCTGATTGCATCATAA<br>TTGTGGTTTCCAACCCAGTGGACATTCTTACGTA<br>TGTTACCTGGAAACTAAGTGGATTACCCAAACAC<br>CGCGTGATTGGAAGTGGATGTAATCTGGATTCT<br>GCTAGATTTCGCTACCTTATGGCTGAAAAACTTG<br>GCATTCATCCCAGCAGCTGCCATGGATGGATTT<br>TGGGGGAACATGGCGACTCAAGTGTGGCTGTGT<br>GGAGTGGTGTGAATGTGGCAGGTGTTTCTCTCC<br>AGGAATTGAATCCAGAAATGGGAACTGACAATG<br>ATAGTGAAAATTGGAAGGAAGTGCATAAGATGG<br>TGGTTGAAAGTGCCTATGAAGTCATCAAGCTAAA<br>AGGATATACCAACTGGGCTATTGGATTAAGTGTG<br>GCTGATCTTATTGAATCCATGTTGAAAAATCTAT<br>CCAGGATTCATCCCGTGTCAACAATGGTAAAGG<br>GGATGTATGGCATTGAGAATGAAGTCTTCCTGA<br>GCCTTCCATGTATCCTCAATGCCCGGGGATTAA<br>CCAGCGTTATCAACCAGAAGC | 2 | XC* |
| 2973 | NM_0023<br>00.4_720 | 720 | CTTGCAGAGCCGGCGCCGGAGGAGACGCACGC<br>AGCTGACTTTGTCTTCTCCGCACGACTGTTACAG<br>AGGTCTCCAGAGCCTTCTCTCTCCTGTGCAAAAT<br>GGCAACTCTTAAGGAAAAACTCATTGCACCAGTT<br>GCGGAAGAAGAGGCAACAGTTCCAAACAATAAG<br>ATCACTGTAGTGGGTGTTGGACAAGTTGGTATG<br>GCGTGTGCTATCAGCATTCTGGGAAAGTCTCTG<br>GCTGATGAACTTGCTCTTGTGGATGTTTTGGAAG<br>ATAAGCTTAAAGGAGAAATGATGGATCTGCAGC<br>ATGGGAGCTTATTTCTTCAGACACCTAAAATTGT<br>GGCAGATAAAGATTATTCTGTGACCGCCAATTCT<br>AAGATTGTAGTGGTAACTGCAGGAGTCCGTCAG<br>CAAGAAGGGGAGAGTCGGCTCAATCTGGTGCA<br>GAGAAATGTTAATGTCTTCAAATTCATTATTCCTC<br>AGATCGTCAAGTACAGTCCTGATTGCATCATAAT<br>TGTGGTTCCAACCCAGTGGACATTCTTACGTAT<br>GTTACCTGGAAACTAAGTGGATTACCCAAACACC | 14 | XRCFSPGIES<br>RNGN* |

TABLE 3B-continued

| SEQ ID | identifier_position | position | modified RNA | PAP length | PAP |
|---|---|---|---|---|---|
| | | | GCGTGATTGGAAGTGGATGTAATCTGGATTCTG<br>CTAGATTTCGCTACCTTATGGCTGAAAAACTTGG<br>CATTCATCCCAGCAGCTGCCATGGATGGATTTT<br>GGGGGAACATGGCGACTCAAGTGTGGCTGTGT<br>GGAGTGGTGTGAATGTGGNCAGGTGTTTCTCTC<br>CAGGAATTGAATCCAGAAATGGGAACTGACAAT<br>GATAGTGAAAATTGGAAGGAAGTGCATAAGATG<br>GTGGTTGAAAGTGCCTATGAAGTCATCAAGCTAA<br>AAGGATATACCAACTGGGCTATTGGATTAAGTGT<br>GGCTGATCTTATTGAATCCATGTTGAAAAATCTA<br>TCCAGGATTCATCCCGTGTCAACAATGGTAAAG<br>GGGATGTATGGCATTGAGAATGAAGTCTTCCTG<br>AGCCTTCCATGTATCCTCAATGCCCGGGGATTA<br>ACCAGCGTTATCAACCAGAAGC | | |
| 2974 | NM_0025<br>20.5_215 | 215 | GGGAAGCGCTCGCGAGATCTTCAGGGTCTATAT<br>ATAAGCGCGGGGAGCCTGCGTCCTTTCCCTGGT<br>GTGATTCCGTCCTGCGCGGTTGTTCTCTGGAGC<br>AGCGTTCTTTTATCTCCGTCCGCCTTCTCTCCTA<br>CCTAAGTGCGTGCCGCCACCCGATGGAAGATTC<br>GATGGACATGGACATGAGCCCCCTGAGGCCCC<br>AGAACTATCTTTTCGGTNTGTGAACTAAAGGCCG<br>ACAAAGATTATCACTTTAAGGTGGATAATGATGA<br>AAATGAGCACCAGTTATCTTTAAGAACGGTCAGT<br>TTAGGGGCTGGTGCAAAGGATGAGTTGCACATT<br>GTTGAAGCAGAGGCAATGAATTACGAAGGCAGT<br>CCAATTAAAGTAACACTGGCAACTTTGAAAATGT<br>CTGTACAGCCAACGGTTTCCCTTGGGGGCTTTG<br>AAATAACACCACCAGTGGTCTTAAGGTTGAAGTG<br>TGGTTCAGGGCCAGTGCATATTAGTGGACAGCA<br>CTTAGTAGCTGTGGAGGAAGATGCAGAGTCAGA<br>AGATGAAGAGGAGGAGGATGTGAAACTCTTAAG<br>TATATCTGGAAAGCGGTCTGCCCCTGGAGGTGG<br>TAGCAAGGTTCCACAGAAAAAAGTAAAACTTGCT<br>GCTGATGAAGATGATGACGATGATGATGAAGAG<br>GATGATGATGAAGATGATGATGATGATGATTTTG<br>ATGATGAGGAAGCTGAAGAAAAAGCGCCAGTGA<br>AGAAATCTATACGAGATACTCCAGCCAAAAATGC<br>ACAAAAGTCAAATCAGAATGGAAAAGACTCAAAA<br>CCATCATCAACACCAAGATCAAAAGGACAAGAAT<br>CCTTCAAGAAACAGGAAAAAACTCCTAAAACACC<br>AAAAGGACCTAGTTCTGTAGAAGACATTAAAGCA<br>AAAATGCAAGCAAGTATAGAAAAAGGTGGTTCTC<br>TTCCCAAAGTGGAAGCCAAATTCATCAATTATGT<br>GAAGAATTGCTTCCGGATGACTGACCAAGAGGC<br>TATTCAAGATCTCTGGCAGT | 1 | X* |
| 2975 | NM_0025<br>20.5_316 | 316 | GGGAAGCGCTCGCGAGATCTTCAGGGTCTATAT<br>ATAAGCGCGGGGAGCCTGCGTCCTTTCCCTGGT<br>GTGATTCCGTCCTGCGCGGTTGTTCTCTGGAGC<br>AGCGTTCTTTTATCTCCGTCCGCCTTCTCTCCTA<br>CCTAAGTGCGTGCCGCCACCCGATGGAAGATTC<br>GATGGACATGGACATGAGCCCCCTGAGGCCCC<br>AGAACTATCTTTTCGGTTGTGAACTAAAGGCCGA<br>CAAAGATTATCACTTTAAGGTGGATAATGATGAA<br>AATGAGCACCAGTTATCTTTAAGAACGGTCAGTT<br>TAGGGGCTGGTGCAAANGGATGAGTTGCACATT<br>GTTGAAGCAGAGGCAATGAATTACGAAGGCAGT<br>CCAATTAAAGTAACACTGGCAACTTTGAAAATGT<br>CTGTACAGCCAACGGTTTCCCTTGGGGGCTTTG<br>AAATAACACCACCAGTGGTCTTAAGGTTGAAGTG<br>TGGTTCAGGGCCAGTGCATATTAGTGGACAGCA<br>CTTAGTAGCTGTGGAGGAAGATGCAGAGTCAGA<br>AGATGAAGAGGAGGAGGATGTGAAACTCTTAAG<br>TATATCTGGAAAGCGGTCTGCCCCTGGAGGTGG<br>TAGCAAGGTTCCACAGAAAAAAGTAAAACTTGCT<br>GCTGATGAAGATGATGACGATGATGATGAAGAG<br>GATGATGATGAAGATGATGATGATGATGATTTTG<br>ATGATGAGGAAGCTGAAGAAAAAGCGCCAGTGA<br>AGAAATCTATACGAGATACTCCAGCCAAAAATGC<br>ACAAAAGTCAAATCAGAATGGAAAAGACTCAAAA<br>CCATCATCAACACCAAGATCAAAAGGACAAGAAT<br>CCTTCAAGAAACAGGAAAAAACTCCTAAAACACC<br>AAAAGGACCTAGTTCTGTAGAAGACATTAAAGCA<br>AAAATGCAAGCAAGTATAGAAAAAGGTGGTTCTC<br>TTCCCAAAGTGGAAGCCAAATTCATCAATTATGT<br>GAAGAATTGCTTCCGGATGACTGACCAAGAGGC<br>TATTCAAGATCTCTGGCAGT | 2 | XG* |

TABLE 3B-continued

| SEQ ID | identifier_position | position | modified RNA | PAP length | PAP |
|---|---|---|---|---|---|
| 2976 | NM_0025 20.5_421 | 421 | GGGAAGCGCTCGCGAGATCTTCAGGGTCTATAT ATAAGCGCGGGGAGCCTGCGTCCTTTCCCTGGT GTGATTCCGTCCTGCGCGGTTGTTCTCTGGAGC AGCGTTCTTTTATCTCCGTCCGCCTTCTCTCCTA CCTAAGTGCGTGCCGCCACCCGATGGAAGATTC GATGGACATGGACATGAGCCCCCTGAGGCCCC AGAACTATCTTTTCGGTTGTGAACTAAAGGCCGA CAAAGATTATCACTTTAAGGTGGATAATGATGAA AATGAGCACCAGTTATCTTTAAGAACGGTCAGTT TAGGGGCTGGTGCAAAGGATGAGTTGCACATTG TTGAAGCAGAGGCAATGAATTACGAAGGCAGTC CAATTAAAGTAACACTGGCAACTTTGAAAATGTC TGTACAGCCAACGGTTTCCCTNTGGGGGCTTTG AAATAACACCACCAGTGGTCTTAAGGTTGAAGTG TGGTTCAGGGCCAGTGCATATTAGTGGACAGCA CTTAGTAGCTGTGGAGGAAGATGCAGAGTCAGA AGATGAAGAGGAGGAGGATGTGAAACTCTTAAG TATATCTGGAAAGCGGTCTGCCCCTGGAGGTGG TAGCAAGGTTCCACAGAAAAAAGTAAAACTTGCT GCTGATGAAGATGATGACGATGATGATGAAGAG GATGATGATGAAGATGATGATGATGATTTTG ATGATGAGGAAGCTGAAGAAAAAGCGCCAGTGA AGAAATCTATACGAGATACTCCAGCCAAAAATGC ACAAAAGTCAAATCAGAATGGAAAAGACTCAAAA CCATCATCAACACCAAGATCAAAAGGACAAGAAT CCTTCAAGAAACAGGAAAAAAACTCCTAAAACACC AAAAGGACCTAGTTCTGTAGAAGACATTAAAGCA AAAATGCAAGCAAGTATAGAAAAAGGTGGTTCTC TTCCCAAAGTGGAAGCCAAATTCATCAATTATGT GAAGAATTGCTTCCGGATGACTGACCAAGAGGC TATTCAAGATCTCTGGCAGT | 3 | WGL* |
| 2977 | NM_0025 20.5_463 | 463 | GGGAAGCGCTCGCGAGATCTTCAGGGTCTATAT ATAAGCGCGGGGAGCCTGCGTCCTTTCCCTGGT GTGATTCCGTCCTGCGCGGTTGTTCTCTGGAGC AGCGTTCTTTTATCTCCGTCCGCCTTCTCTCCTA CCTAAGTGCGTGCCGCCACCCGATGGAAGATTC GATGGACATGGACATGAGCCCCCTGAGGCCCC AGAACTATCTTTTCGGTTGTGAACTAAAGGCCGA CAAAGATTATCACTTTAAGGTGGATAATGATGAA AATGAGCACCAGTTATCTTTAAGAACGGTCAGTT TAGGGGCTGGTGCAAAGGATGAGTTGCACATTG TTGAAGCAGAGGCAATGAATTACGAAGGCAGTC CAATTAAAGTAACACTGGCAACTTTGAAAATGTC TGTACAGCCAACGGTTTCCCTTGGGGCTTTGA AATAACACCACCAGTGGTCTTAAGGTTGAANGT GTGGTTCAGGGCCAGTGCATATTAGTGGACAGC ACTTAGTAGCTGTGGAGGAAGATGCAGAGTCAG AAGATGAAGAGGAGGAGGATGTGAAACTCTTAA GTATATCTGGAAAGCGGTCTGCCC0TGGAGGTG GTAGCAAGGTTCCACAGAAAAAAGTAAAACTTGC TGCTGATGAAGATGATGACGATGATGATGAAGA GGATGATGATGAAGATGATGATGATGATGATTTT GATGATGAGGAAGCTGAAGAAAAAGCGCCAGTG AAGAAATCTATACGAGATACTCCAGCCAAAAATG CACAAAAGTCAAATCAGAATGGAAAAGACTCAAA ACCATCATCAACACCAAGATCAAAAGGACAAGAA TCCTTCAAGAAACAGGAAAAAAACTCCTAAAACAC CAAAAGGACCTAGTTCTGTAGAAGACATTAAAGC AAAAATGCAAGCAAGTATAGAAAAAGGTGGTTCT CTTCCCAAAGTGGAAGCCAAATTCATCAATTATG TGAAGAATTGCTTCCGGATGACTGACCAAGAGG CTATTCAAGATCTCTGGCAGT | 9 | XVWFRASAY* |
| 2978 | NM_0025 20.5_539 | 539 | GGGAAGCGCTCGCGAGATCTTCAGGGTCTATAT ATAAGCGCGGGGAGCCTGCGTCCTTTCCCTGGT GTGATTCCGTCCTGCGCGGTTGTTCTCTGGAGC AGCGTTCTTTTATCTCCGTCCGCCTTCTCTCCTA CCTAAGTGCGTGCCGCCACCCGATGGAAGATTC GATGGACATGGACATGAGCCCCCTGAGGCCCC AGAACTATCTTTTCGGTTGTGAACTAAAGGCCGA CAAAGATTATCACTTTAAGGTGGATAATGATGAA AATGAGCACCAGTTATCTTTAAGAACGGTCAGTT TAGGGGCTGGTGCAAAGGATGAGTTGCACATTG TTGAAGCAGAGGCAATGAATTACGAAGGCAGTC CAATTAAAGTAACACTGGCAACTTTGAAAATGTC TGTACAGCCAACGGTTTCCCTTGGGGCTTTGA AATAACACCACCAGTGGTCTTAAGGTTGAAGTGT GGTTCAGGGCCAGTGCATATTAGTGGACAGCAC | 20 | XGGGCETLKY IWKAVCPWR W* |

TABLE 3B-continued

| SEQ ID | identifier_position | position | modified RNA | PAP length | PAP |
|---|---|---|---|---|---|
| | | | TTAGTAGCTGTGGAGGAAGATGCAGAGTCAGAA<br>GATGAANGAGGAGGAGGATGTGAAACTCTTAAG<br>TATATCTGGAAAGCGGTCTGCCCCTGGAGGTGG<br>TAGCAAGGTTCCACAGAAAAAAGTAAAACTTGCT<br>GCTGATGAAGATGATGACGATGATGATGAAGAG<br>GATGATGATGAAGATGATGATGATGATTTTG<br>ATGATGAGGAAGCTGAAGAAAAAGCGCCAGTGA<br>AGAAATCTATACGAGATACTCCAGCCAAAAATGC<br>ACAAAAGTCAAATCAGAATGGAAAAGACTCAAAA<br>CCATCATCAACACCAAGATCAAAAGGACAAGAAT<br>CCTTCAAGAAACAGGAAAAAACTCCTAAAACACC<br>AAAAGGACCTAGTTCTGTAGAAGACATTAAAGCA<br>AAAATGCAAGCAAGTATAGAAAAAGGTGGTTCTC<br>TTCCCAAAGTGGAAGCCAAATTCATCAATTATGT<br>GAAGAATTGCTTCCGGATGACTGACCAAGAGGC<br>TATTCAAGATCTCTGGCAGT | | |
| 2979 | NM_0026<br>29.2_545 | 545 | GCTAATCCCAGTCGGTGCCGCATCCC0AGCCCG<br>CCGCCATGGCCGCCTACAAACTGGTGCTGATCC<br>GGCACGGCGAGAGCGCATGGAACCTGGAGAAC<br>CGCTTCAGCGGCTGGTACGACGCCGACCTGAG<br>CCCCGGCGGGCCACGAGGAGGCGAAGCGCGGC<br>GGGCAGGCGCTACGAGATGCTGGCTATGAGTTT<br>GACATCTGCTTCACCTCAGTGCAGAAGAGAGCG<br>ATCCGGACCCTCTGGACAGTGCTAGATGCCATT<br>GATCAGATGTGGCTGCCAGTGGTGAGGACTTGG<br>CGCCTCAATGAGCGGCACTATGGGGGTCTAACC<br>GGTCTCAATAAAGCAGAAACTGCTGCAAAGCAT<br>GGTGAGGCCCAGGTGAAGATCTGGAGGCGCTC<br>CTATGATGTCCCACCACCTCCGATGGAGCCCGA<br>CCATCCTTTCTACAGCAACATCAGTAAGGATCGC<br>AGGTATGCAGACCTCACAGAAGATCAGCTACCC<br>TCCTGTGAGAGTCTGAAGGATACTATTGCCAGA<br>GCTCTGCCCTTCTGGAATGAANGAAATAGTTCC<br>CCAGATCAAGGAGGGGAAACGTGTACTGATTGC<br>AGCCCATGGCAACAGCCTCCGGGGCATTGTCAA<br>GCATCTGGAGGGTCTCTCTGAAGAGGCTATCAT<br>GGAGCTGAACCTGCCGACTGGTATTCCCATTGT<br>CTATGAATTGGACAAGAACTTGAAGCCTATCAAG<br>CCCATGCAGTTTCTGGGGGATGAAGAGACGGTG<br>CGCAAAGCCATGGAAGCTGTGGCTGCCCAGGG<br>CAAGGCCAAGAAGTGAAGGCCGGCGGGGAGGA<br>TACTGTCCCCAGGAGCACCCTCCCTGCCCGTCT<br>TGTCCCTCTGCCCCTCCCACCTGCACATGTCAC<br>ACTGACCACATCTGTAGACATCTTGAGTTGTAGC<br>TGCAGACGGGGACCAGTGGCTCCCATTTTCATT<br>TTAGCCATTTTGTCGCCTGCACCCACTCCCTTCA<br>TACAATCTAGTCAGAATAGCAGTTCTAGAGCACA<br>GGT | 32 | XNSSPDQGG<br>ETCTDCSPW<br>QQPPGHCQA<br>SGGSL* |
| 2980 | NM_0026<br>35.2_710 | 710 | GTGTGCGTCACGCCGACGACGCGCAAGGGCA<br>CACATCTTAGGACCCGGAGGACGTCCGGCCTCT<br>GTGAGCGCAACCTTTCCAAGGGAGTGGTTGTG<br>TGATCGCCATCTTAGGGAAAAGATGTTCTCGTCC<br>GTGGCGCACCTGGCGCGGGCGAACCCCTTCAA<br>CACGCCACATCTGCAGCTGGTGCACGATGGTCT<br>CGGGGACCTCCGCAGCAGCTCCCCAGGGCCCA<br>CGGGCCAGCCCCGCCGCCCTCGCAACCTGGCA<br>GCCGCCGCCGTGGAAGAGTACAGTTGTGAATTT<br>GGCTCCGCGAAGTATTATGCACTGTGTGGCTTT<br>GGTGGGGTCTTAAGTTGTGGTCTGACACACACT<br>GCTGTGGTTCCCCTGGATTTAGTGAAATGCCGT<br>ATGCAGGTGGACCCCCAAAAGTACAAGGGCATA<br>TTTAACGGATTCTCAGTTACACTTAAAGAGGATG<br>GTGTTCGTGGTTTGGCTAAAGGATGGGCTCCGA<br>CTTTCCTTGGCTACTCCATGCAGGGACTCTGCA<br>AGTTTGGCTTTATGAAGTCTTTAAAGTCTTGTAT<br>AGCAATATGCTTGGAGAGGAGAATACTTATCTCT<br>GGCGCACATCACTATATTTGGCTGCCTCTGCCA<br>GTGCTGAATTCTTTGCTGACATTGCCCTGGCTC<br>TATGGAAGCTGCTAAGGTTCGAATTCAAACCCA<br>GCCAGGTTATGCCAANCACTTTGAGGGATGCAG<br>CTCCCAAAATGTATAAGGAAGAAGGCCTAAAAG<br>CATTCTACAAGGGGGTTGCTCCTCTCTGGATGA<br>GACAGATACCATACACCATGATGAAGTTCGCCT<br>GCTTTGAACGTACTGTTGAAGCACTGTACAAGTT<br>TGTGGTTCCTAAGCCCCGCAGTGAATGTTCAAA<br>GCCAGAGCAGCTGGTTGTAACATTTGTAGCAGG<br>TTACATAGCTGGAGTCTTTTGTGCAATTGTTTCT | 11 | XHFEGCSSQN<br>V* |

TABLE 3B-continued

| SEQ ID | identifier_ position | position | modified RNA | PAP length | PAP |
|---|---|---|---|---|---|
| 2981 | NM_0026 35.2_716 | 716 | CACCCTGCTGATTCTGTGGTATCTGTGTTGAATA AAGAAAAAGGTAGCAGTGCTTCTCTGGTC GTGTGCGTCACGCCGACGACGCGCGAAGGGCA CACATCTTAGGACCCGGAGGACGTCCGGCCTCT GTGAGCCGCAACCTTTCCAAGGGAGTGGTTGTG TGATCGCCATCTTAGGGAAAAGATGTTCTCGTCC GTGGCGCACCTGGCGCGGGCGAACCCCTTCAA CACGCCACATCTGCAGCTGGTGCACGATGGTCT CGGGGACCTCCGCAGCAGCTCCCCAGGGCCCA CGGGGCCAGCCCCGCCGCCCTCGCAACCTGGCA GCCGCCGCCGTGGAAGAGTACAGTTGTGAATTT GGCTCCGCGAAGTATTATGCACTGTGTGGCTTT GGTGGGGTCTTAAGTTGTGGTCTGACACACACT GCTGTGGTTCCCCTGGATTTAGTGAAATGCCGT ATGCAGGTGGACCCCCAAAAGTACAAGGGCATA TTTAACGGATTCTCAGTTACACTTAAAGAGGATG GTGTTCGTGGTTTGGCTAAAGGATGGGCTCCGA CTTTCCTTGGCTACTCCATGCAGGGACTCTGCA AGTTTGGCTTTTATGAAGTCTTTAAAGTCTTGTAT AGCAATATGCTTGGAGAGGAGAATACTTATCTCT GGCGCACATCACTATATTTGGCTGCCTCTGCCA GTGCTGAATTCTTTGCTGACATTGCCCTGGCTCC TATGGAAGCTGCTAAGGTTCGAATTCAAACCCA GCCAGGTTATGCCAACACTTTNGAGGGATGCAG CTCCCAAAATGTATAAGGAAGAAGGCCTAAAAG CATTCTACAAGGGGGTTGCTCCTCTCTGGATGA GACAGATACCATACACCATGATGAAGTTCGCCT GCTTTGAACGTACTGTTGAAGCACTGTACAAGTT TGTGGTTCCTAAGCCCCGCAGTGAATGTTCAAA GCCAGAGCAGCTGGTTGTAACATTTGTAGCAGG TTACATAGCTGGAGTCTTTTGTGCAATTGTTTCT CACCCTGCTGATTCTGTGGTATCTGTGTTGAATA AAGAAAAAGGTAGCAGTGCTTCTCTGGTC | 9 | XEGCSSQNV* |
| 2982 | NM_0026 35.2_745 | 745 | GTGTGCGTCACGCCGACGACGCGCGAAGGGCA CACATCTTAGGACCCGGAGGACGTCCGGCCTCT GTGAGCCGCAACCTTTCCAAGGGAGTGGTTGTG TGATCGCCATCTTAGGGAAAAGATGTTCTCGTCC GTGGCGCACCTGGCGCGGGCGAACCCCTTCAA CACGCCACATCTGCAGCTGGTGCACGATGGTCT CGGGGACCTCCGCAGCAGCTCCCCAGGGCCCA CGGGGCCAGCCCCGCCGCCCTCGCAACCTGGCA GCCGCCGCCGTGGAAGAGTACAGTTGTGAATTT GGCTCCGCGAAGTATTATGCACTGTGTGGCTTT GGTGGGGTCTTAAGTTGTGGTCTGACACACACT GCTGTGGTTCCCCTGGATTTAGTGAAATGCCGT ATGCAGGTGGACCCCCAAAAGTACAAGGGCATA TTTAACGGATTCTCAGTTACACTTAAAGAGGATG GTGTTCGTGGTTTGGCTAAAGGATGGGCTCCGA CTTTCCTTGGCTACTCCATGCAGGGACTCTGCA AGTTTGGCTTTTATGAAGTCTTTAAAGTCTTGTAT AGCAATATGCTTGGAGAGGAGAATACTTATCTCT GGCGCACATCACTATATTTGGCTGCCTCTGCCA GTGCTGAATTCTTTGCTGACATTGCCCTGGCTCC TATGGAAGCTGCTAAGGTTCGAATTCAAACCCA GCCAGGTTATGCCAACACTTTGAGGGATGCAGC TCCCAAAATGTATAAGGNAAGAAGGCCTAAAAG CATTCTACAAGGGGGTTGCTCCTCTCTGGATGA GACAGATACCATACACCATGATGAAGTTCGCCT GCTTTGAACGTACTGTTGAAGCACTGTACAAGTT TGTGGTTCCTAAGCCCCGCAGTGAATGTTCAAA GCCAGAGCAGCTGGTTGTAACATTTGTAGCAGG TTACATAGCTGGAGTCTTTTGTGCAATTGTTTCT CACCCTGCTGATTCTGTGGTATCTGTGTTGAATA AAGAAAAAGGTAGCAGTGCTTCTCTGGTC | 29 | XRRPKSILQG GCSSLDETDTI HHDEVRLL* |
| 2983 | NM_0027 78.2_469 | 469 | GGGGTTAGCGCCTGCGCTCTGGACGGCTTTGG GGCAGGGCAGATTTATATCTGCGGGGATCAGC TGACGCTCCGCATTGCAGACTGCGGAGTCAGAC GGCGCTATGTACGCCCTCTTCCTCCTGGCCAGC CTCCTGGGCGCGGCTCTAGCCGGCCCGGTCCT TGGACTGAAAGAATGCACCAGGGGCTCGGCAGT GTGGTGCCAGAATGTGAAGACGGCGTCCGACT GCGGGGCAGTGAAGCACTGCCTGCAGACCGTT TGGAACAAGCCAACAGTGAAATCCCTTCCCTGC GACATATGCAAAGACGTTGTCACCGCAGCTGGT GATATGCTGAAGGACAATGCCACTGAGGAGGAG ATCCTTGTTTACTTGGAGAAGACCTGTGACTGGC TTCCGAAACCGAACATGTCTGCTTCATGCAAGG | 36 | XRRNEPSWG GVLCSQPLRV SPEAPSRAES PEAAGVQ* |

| SEQ ID | identifier_ position | position | modified RNA | PAP length | PAP |
|---|---|---|---|---|---|
| | | | AGATAGTGGACTCCTACCTCCCTGTCATCCTGG ACATCATTAANAGGAGAAATGAGCCGTCCTGGG GAGGTGTGCTCTGCTCTCAACCTCTGCGAGTCT CTCCAGAAGCACCTAGCAGAGCTGAATCACCAG AAGCAGCTGGAGTCCAATAAGATCCCAGAGCTG GACATGACTGAGGTGGTGGCCCCCTTCATGGCC AACATCCCTCTCCTCCTCTACCCTCAGGACGGC CCCCGCAGCAAGCCCCAGCCAAAGGATAATGG GGACGTTTGCCAGGACTGCATTCAGATGGTGAC TGACATCCAGACTGCTGTACGGACCAACTCCAC CTTTGTCCAGGCCTTGGTGGAACATGTCAAGGA GGGAGTGTGACCGCCTGGGCCCTGGCATGGCCG ACATATGCAAGAACTATATCAGCCAGTATTCTGA AATTGCTATCCAGATGATGATGCACATGCAACCC AAGGAGATCTGTGCGCTGGTTGGGTTCTGTGAT GAGGTGAAAGAGATGCCCATGCAGACTCTGGTC CCCGCCAAAGTGGCCTCCAAGAATGTCATCCCT GCCCTGGAACTGGTGGAGCCCATTAAGAAGCAC GAGG | | |
| 2984 | NM_0027 78.2_493 | 493 | GGGGTTAGCGCCTGCGCTCTGGACGGCTTTGG GGCAGGGCAGATTTATATCTGCGGGGGATCAGC TGACGCTCCGCATTGCAGACTGCGGAGTCAGAC GGCGCTATGTACGCCCTCTTCCTCCTGGCCAGC CTCCTGGGCGCGGCTCTAGCCGGCCCGGTCCT TGGACTGAAAGAATGCACCAGGGGCTCGGCAGT GTGGTGCCAGAATGTGAAGACGGCGTCCGACT GCGGGGCAGTGAAGCACTGCCTGCAGACCGTT TGGAACAAGCCAACAGTGAAATCCCTTCCCTGC GACATATGCAAAGACGTTGTCACCGCAGCTGGT GATATGCTGAAGGACAATGCCACTGAGGAGGAG ATCCTTGTTTACTTGGAGAAGACCTGTGACTGGC TTCCGAAACCGAACATGTCTGCTTCATGCAAGG AGATAGTGGACTCCTACCTCCCTGTCATCCTGG ACATCATTAAAGGAGAAATGAGCCGTCCTGGGG ANGGTGTGCTCTGCTCTCAACCTCTGCGAGTCT CTCCAGAAGCACCTAGCAGAGCTGAATCACCAG AAGCAGCTGGAGTCCAATAAGATCCCAGAGCTG GACATGACTGAGGTGGTGGCCCCCTTCATGGCC AACATCCCTCTCCTCCTCTACCCTCAGGACGGC CCCCGCAGCAAGCCCCAGCCAAAGGATAATGG GGACGTTTGCCAGGACTGCATTCAGATGGTGAC TGACATCCAGACTGCTGTACGGACCAACTCCAC CTTTGTCCAGGCCTTGGTGGAACATGTCAAGGA GGGAGTGTGACCGCCTGGGCCCTGGCATGGCCG ACATATGCAAGAACTATATCAGCCAGTATTCTGA AATTGCTATCCAGATGATGATGCACATGCAACCC AAGGAGATCTGTGCGCTGGTTGGGTTCTGTGAT GAGGTGAAAGAGATGCCCATGCAGACTCTGGTC CCCGCCAAAGTGGCCTCCAAGAATGTCATCCCT GCCCTGGAACTGGTGGAGCCCATTAAGAAGCAC GAGG | 28 | XGVLCSQPLR VSPEAPSRAE SPEAAGVQ* |
| 2985 | NM_0029 48.2_563 | 563 | CCTTTCCGTCTGGCGGCAGCCATCAGGTAAGCC AAGATGGGTGCATACAAGTACATCCAGGAGCTA TGGAGAAAGAAGCAGTCTGATGTCATGCGCTTT CTTCTGAGGGTCCGCTGCTGGCAGTACCGCCAG CTCTCTGCTCTCCACAGGGCTCCCCGCCCCACC CGGCCTGATAAAGCGCGCCGACTGGGCTACAA GGCCAAGCAAGGTTACGTTATATATAGGATTCGT GTTCGCCGTGGTGGCCGAAAACGCCCAGTTCCT AAGGGTGCAACTTACGGCAAGCCTGTCCATCAT GGTGTTAACCAGCTAAAGTTTGCTCGAAGCCTTC AGTCCGTTGCAGAGGAGCGAGCTGGACGCCAC TGTGGGGCTCTGAGAGTCCTGAATTCTTACTGG GTTGGTGAAGATTCCACATACAAATTTTTTGAGG TTATCCTCATTGATCCATTCCATAAAGCTATCAG AAGAAATCCTGACACCCAGTGGATCACCAAACC AGTCCACAAGCACAGGGGAGATGCGTGGGCTGA CATCTGCAGGCCGAAAGAGCCGTGGCCTTGGAA ANGGGCCACAAGTTCCACCACACTATTGGTGGC TCTCGCCGGGCAGCTTGGAGAAGGCGCAATACT CTCCAGCTCCACCGTTACCGCTAATATAAGTAAA GTTTGTAAAATTCATACTTAATAAACAATTTAGGA CAGTCATGTCTGCTTACAGGTGTTATTTGTCTGT TAAAACTAGTCTGCAGATGTTTCTTGAATGCTTT GTCAAATTAAGAAAGTTAAAGTGCAATAATGTTT GAAGACAATAAGTGGTGGTGTATCTTGTTTCTAA TAAGATAAACTTTTTTGTCTTTGCTTTATCTTATTA | 31 | XGPQVPPHY WWLSPGSLE KAQYSPAPPL PLI* |

TABLE 3B-continued

| SEQ ID | identifier_position | position | modified RNA | PAP length | PAP |
|---|---|---|---|---|---|
| | | | GGGAGTTGTATGTCAGTGTATAAAACATACTGTG TGGTATAACAGGCTTAATAAATTCTTTAAAAGGA GAGAACTGAAACTAGCCCTGTAGATTTGTCTGGT GCATGTGATGAAACCTGCAGCTTTATCGGAGTG ATGGCAATGCTCTGCTGGTT | | |
| 2986 | NM_0029 48.2_566 | 566 | CCTTTCCGTCTGGCGGCAGCCATCAGGTAAGCC AAGATGGGTGCATACAAGTACATCCAGGAGCTA TGGAGAAAGAAGCAGTCTGATGTCATGCGCTTT CTTCTGAGGGTCCGCTGCTGGCAGTACCGCCAG CTCTCTGCTCTCCACAGGGCTCCCCGCCCCACC CGGCCTGATAAAGCGCGCCGACTGGGCTACAA GGCCAAGCAAGGTTACGTTATATATAGGATTCGT GTTCGCCGTGGTGGCCGAAAACGCCCAGTTCCT AAGGGTGCAACTTACGGCAAGCCTGTCCATCAT GGTGTTAACCAGCTAAAGTTTGCTCGAAGCCTTC AGTCCGTTGCAGAGGAGCGAGCTGGACGCCAC TGTGGGGCTCTGAGAGTCCTGAATTCTTACTGG GTTGGTGAAGATTCCACATACAAATTTTTTGAGG TTATCCTCATTGATCCATTCCATAAAGCTATCAG AAGAAATCCTGACACCCAGTGGATCACCAAACC AGTCCACAAGCACAGGGAGATGCGTGGGCTGA CATCTGCAGGCCGAAAGAGCCGTGGCCTTGGAA AGGGNCCACAAGTTCCACCACACTATTGGTGGC TCTCGCCGGGCAGCTTGGAGAAGGCGCAATACT CTCCAGCTCCACCGTTACCGCTAATATAAGTAAA GTTTGTAAAATTCATACTTAATAAACAATTTAGGA CAGTCATGTCTGCTTACAGGTGTTATTTGTCTGT TAAAACTAGTCTGCAGATGTTTCTTGAATGCTTT GTCAAATTAAGAAAGTTAAAGTGCAATAATGTTT GAAGACAATAAGTGGTGGTGTATCTTGTTTCTAA TAAGATAAACTTTTTTGTCTTTGCTTTATCTTATTA GGGAGTTGTATGTCAGTGTATAAAACATACTGTG TGGTATAACAGGCTTAATAAATTCTTTAAAAGGA GAGAACTGAAACTAGCCCTGTAGATTTGTCTGGT GCATGTGATGAAACCTGCAGCTTTATCGGAGTG ATGGCAATGCTCTGCTGGTT | 29 | PQVPPHYWW LSPGSLEKAQ YSPAPPLPLI* |
| 2987 | NM_0029 48.2_612 | 612 | CCTTTCCGTCTGGCGGCAGCCATCAGGTAAGCC AAGATGGGTGCATACAAGTACATCCAGGAGCTA TGGAGAAAGAAGCAGTCTGATGTCATGCGCTTT CTTCTGAGGGTCCGCTGCTGGCAGTACCGCCAG CTCTCTGCTCTCCACAGGGCTCCCCGCCCCACC CGGCCTGATAAAGCGCGCCGACTGGGCTACAA GGCCAAGCAAGGTTACGTTATATATAGGATTCGT GTTCGCCGTGGTGGCCGAAAACGCCCAGTTCCT AAGGGTGCAACTTACGGCAAGCCTGTCCATCAT GGTGTTAACCAGCTAAAGTTTGCTCGAAGCCTTC AGTCCGTTGCAGAGGAGCGAGCTGGACGCCAC TGTGGGGCTCTGAGAGTCCTGAATTCTTACTGG GTTGGTGAAGATTCCACATACAAATTTTTTGAGG TTATCCTCATTGATCCATTCCATAAAGCTATCAG AAGAAATCCTGACACCCAGTGGATCACCAAACC AGTCCACAAGCACAGGGAGATGCGTGGGCTGA CATCTGCAGGCCGAAAGAGCCGTGGCCTTGGAA AGGGCCACAAGTTCCACCACACTATTGGTGGCT CTCGCCGGGCAGCTTGGNAGAAGGCGCAATAC TCTCCAGCTCCACCGTTACCGCTAATATAAGTAA AGTTTGTAAAATTCATACTTAATAAACAATTTAGG ACAGTCATGTCTGCTTACAGGTGTTATTTGTCTG TTAAAACTAGTCTGCAGATGTTTCTTGAATGCTTT GTCAAATTAAGAAAGTTAAAGTGCAATAATGTTT GAAGACAATAAGTGGTGGTGTATCTTGTTTCTAA TAAGATAAACTTTTTTGTCTTTGCTTTATCTTATTA GGGAGTTGTATGTCAGTGTATAAAACATACTGTG TGGTATAACAGGCTTAATAAATTCTTTAAAAGGA GAGAACTGAAACTAGCCCTGTAGATTTGTCTGGT GCATGTGATGAAACCTGCAGCTTTATCGGAGTG ATGGCAATGCTCTGCTGGTT | 14 | XKAQYSPAPP LPLI* |
| 2988 | NM_0029 50.3_539 | 539 | AACGGCTGCTCAGTGGCGGGAGGGCGGGCTAC CGCGCCCGGGCCCTACCCGCCCTGGCGCACTG CTCTTCCCGGTCATGGAGGCGCCAGCCGCCGG CTTGTTTCTGCTCCTGTTGCTTGGGACTTGGGC CCCGGCGCGGGCAGCGCCTCCTCCGAGGCAC CGCCGCTGATCAATGAGGACGTGAAGCGCACA GTGGACCTAAGCAGCCACCTGGCTAAGGTGACG GCCGAGGTGGTCCTGGCGCACCTGGGCGGCGG CTCCACGTCCCGAGCTACCTCTTTCCTGCTGGC TTTGGAGCCTGAGCTCGAGGCCCGGCTGGCGC | 2 | XV* |

TABLE 3B-continued

| SEQ ID | identifier_ position | position | modified RNA | PAP length | PAP |
|---|---|---|---|---|---|
| | | | ACCTGGGCGTGCAGGTAAAGGGAGAAGATGAG GAAGAGAACAATTTGGAAGTACGTGAAACCAAA ATTAAGGGTAAAAGTGGGAGATTCTTCACAGTCA AGCTCCCAGTTGCTCTTGATCCTGGGGCCAAGA TTTCAGTCATTGTGGAAACAGTCTACACCCATGT GCTTCATCCGTATCCAACCCAGATCACCCAGTC AGAGAAACAGTTTGTGGNTGTTTGAGGGGAACC ATTATTTCTACTCTCCCTATCCAACGAAGACACA AACCATGCGTGTGAAGCTTGCCTCTCGAAATGT GGAGAGCTACACCAAGCTGGGGAACCCCACGC GCTCTGAGGACCTACTGGATTATGGGCCTTTCA GAGATGTGCCTGCCTATAGTCAGGATACTTTTAA AGTACATTATGAGAACAACAGCCCTTTCCTGACC ATCACCAGCATGACCCGAGTCATTGAAGTCTCT CACTGGGGTAATATTGCTGTGGAAGAAAATGTG GACTTAAAGCACACAGGAGCTGTGCTTAAGGGG CCTTTCTCACGCTATGATTACCAGAGACAGCCA GATAGTGGAATATCCTCCATCCGTTCTTTTAAGA CCATCCTTCCTGCTGCTGCCCAGGATGTTTATTA CCGGGATGAGATTGGCAATGTTTCTACCAGCCA CCTCCTTATTTTGGATGACTCTGTAGAGATGGAA AT | | |
| 2989 | NM_0029 52.3_101 | 101 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCNGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 31 | XRFRQWHPG PGSRPWTGP GPRPRSSRR QGRG* |
| 2990 | NM_0029 52.3_110 | 110 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCNGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC | 28 | XQWHPGPGS RPWTGPGPR PRSSRRQGR G* |

TABLE 3B-continued

| SEQ ID | identifier_position | position | modified RNA | PAP length | PAP |
|---|---|---|---|---|---|
| | | | CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | | |
| 2991 | NM_0029<br>52.3_123 | 123 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCNGGGGC<br>CGGGGTCGCGGCCGTGGACGGGGCCGGGGCC<br>GAGGCCGCGGAGCTCGCGGAGGCAAGGCCGA<br>GGATAAGGAGTGGATGCCCGTCACCAAGTTGGG<br>CCGCTTGGTCAAGGACATGAAGATCAAGTCCCT<br>GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | 24 | XGPGSRPWT<br>GPGPRPRSS<br>RRQGRG* |
| 2992 | NM_0029<br>52.3_141 | 141 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCNGTGGACGGGGCCGGGGCC<br>GAGGCCGCGGAGCTCGCGGAGGCAAGGCCGA<br>GGATAAGGAGTGGATGCCCGTCACCAAGTTGGG<br>CCGCTTGGTCAAGGACATGAAGATCAAGTCCCT<br>GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | 18 | XWTGPGPRP<br>RSSRRQGRG* |
| 2993 | NM_0029<br>52.3_147 | 147 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACNGGGGCCGGGGCC<br>GAGGCCGCGGAGCTCGCGGAGGCAAGGCCGA<br>GGATAAGGAGTGGATGCCCGTCACCAAGTTGGG<br>CCGCTTGGTCAAGGACATGAAGATCAAGTCCCT<br>GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA | 16 | XGPGPRPRSS<br>RRQGRG* |

TABLE 3B-continued

| SEQ ID | identifier_ position | position | modified RNA | PAP length | PAP |
|---|---|---|---|---|---|
| | | | GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | | |
| 2994 | NM_0029 52.3_149 | 149 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGNGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 15 | XPGPRPRSSR RQGRG* |
| 2995 | NM_0029 52.3_153 | 153 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCNGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA | 14 | XGPRPRSSRR QGRG* |

TABLE 3B-continued

| SEQ ID | identifier_position | position | modified RNA | PAP length | PAP |
|---|---|---|---|---|---|
| 2996 | NM_0029 52.3_159 | 159 | CAAGAAAAATAAAGTGAATTAAGCGTGAAAAAAA AAAAAAAAAAAAA CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCN GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCC0GTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCC00G ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 12 | XRPRSSRRQ GRG* |
| 2997 | NM_0029 52.3_161 | 161 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG ANGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 11 | XPRSSRRQG RG* |
| 2998 | NM_0029 52.3_165 | 165 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCNGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC | 10 | XRSSRRQGR G* |

TABLE 3B-continued

| SEQ ID | identifier_position | position | modified RNA | PAP length | PAP |
|---|---|---|---|---|---|
| | | | ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | | |
| 2999 | NM_0029<br>52.3_167 | 167 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCNGGAGCTCGCGGAGGCAAGGCCGA<br>GGATAAGGAGTGGATGCCCGTCACCAAGTTGGG<br>CCGCTTGGTCAAGGACATGAAGATCAAGTCCCT<br>GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | 9 | XSSRRQGRG* |
| 3000 | NM_0029<br>52.3_176 | 176 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCNGGAGGCAAGGCCGA<br>GGATAAGGAGTGGATGCCCGTCACCAAGTTGGG<br>CCGCTTGGTCAAGGACATGAAGATCAAGTCCCT<br>GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | 6 | XRQGRG* |

TABLE 3B-continued

| SEQ ID | identifier_position | position | modified RNA | PAP length | PAP |
|---|---|---|---|---|---|
| 3001 | NM_002952.3_180 | 180 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGNGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCC0GTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCC00G ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 5 | XQGRG* |
| 3002 | NM_002952.3_184 | 184 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAANGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 4 | XGRG* |
| 3003 | NM_002952.3_188 | 188 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGGC GGGGTCGCGGCCGTGGACGGGGCCGGGGCCG AGGCCGCGGAGCTCGCGGAGGCAAGGCCNGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC | 2 | XG* |

TABLE 3B-continued

| SEQ ID | identifier_ position | position | modified RNA | PAP length | PAP |
|---|---|---|---|---|---|
| | | | CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | | |
| 3004 | NM_0029 52.3_196 | 196 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 31 | XGVDARHQV GPLGQGHED QVPGGDLSLL PAY* |
| 3005 | NM_0029 52.3_209 | 209 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCNGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 26 | XHQVGPLGQ GHEDQVPGG DLSLLPAY* |
| 3006 | NM_0029 52.3_217 | 217 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC | 24 | XVGPLGQGH EDQVPGGDLS LLPAY* |

TABLE 3B-continued

| SEQ ID | identifier_position | position | modified RNA | PAP length | PAP |
|---|---|---|---|---|---|
| | | | GGGGTCGCGGCCGTGGACGGGGCCGGGGCCG AGGCCGCGGAGCTCGCGGAGGCAAGGCCGAG GATAAGGAGTGGATGCCCGTCACCAANGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | | |
| 3007 | NM_0029 52.3_225 | 225 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CNGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 21 | XLGQGHEDQ VPGGDLSLLP AY* |
| 3008 | NM_0029 52.3_235 | 235 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCC0GTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG | 18 | XGHEDQVPG GDLSLLPAY* |

TABLE 3B-continued

| SEQ ID | identifier_position | position | modified RNA | PAP length | PAP |
|---|---|---|---|---|---|
| 3009 | NM_0029 52.3_237 | 237 | ACTGCTACACCTCAGCCCGGGGCTGCACTGCCA CCCTGGGCAACTTCGCCAAGGCCACCTTTGATG CCATTTCTAAGACCTACAGCTACCTGACCC00G ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGNACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 17 | XHEDQVPGG DLSLLPAY* |
| 3010 | NM_0029 52.3_250 | 250 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAANGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 13 | XVPGGDLSLL PAY* |
| 3011 | NM_0029 52.3_315 | 315 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG | 7 | XGGLSQG* |

TABLE 3B-continued

| SEQ ID | identifier_position | position | modified RNA | PAP length | PAP |
|---|---|---|---|---|---|
| | | | AATCAGAGATCATTGATTTCTTCCNTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAAA | | |
| 3012 | NM_002952.3_317 | 317 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGNGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAAA | 6 | XGLSQG* |
| 3013 | NM_002952.3_318 | 318 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGNGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA | 6 | XGLSQG* |

TABLE 3B-continued

| SEQ ID | identifier_position | position | modified RNA | PAP length | PAP |
|---|---|---|---|---|---|
| 3014 | NM_0029 52.3_333 | 333 | CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGNATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 1 | X* |
| 3015 | NM_0029 52.3_343 | 343 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTNGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 35 | XEDYASAEAD PCRPAHQVQ GICCYRGLQW PRRSGC* |
| 3016 | NM_0029 52.3_346 | 346 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAANGATTATGCCAGT GCAGAAGCAGACCCGTGCCGGCCAGCGCACCA GGTTCAAGGCATTTGTTGCTATCGGGGACTACA | 34 | XDYASAEADP CRPAHQVQGI CCYRGLQWP RRSGC* |

TABLE 3B-continued

| SEQ ID | identifier_position | position | modified RNA | PAP length | PAP |
|---|---|---|---|---|---|
| | | | ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | | |
| 3017 | NM_0029 52.3_372 | 372 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCNGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 25 | XCRPAHQVQ GICCYRGLQW PRRSGC* |
| 3018 | NM_0029 52.3_404 | 404 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTNGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 14 | XCYRGLQWP RRSGC* |

TABLE 3B-continued

| SEQ ID | identifier_ position | position | modified RNA | PAP length | PAP |
|---|---|---|---|---|---|
| 3019 | NM_0029 52.3_407 | 407 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTNGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 13 | XYRGLQWPR RSGC* |
| 3020 | NM_0029 52.3_417 | 417 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGNACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 10 | XLQWPRRSG C* |
| 3021 | NM_0029 52.3_424 | 424 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAA NTGGCCACGTCGGTCTGGGTGTTAAGTGCTCCA AGGAGGTGGCCACCGCCATCCGTGGGGCCATC ATCCTGGCCAAGCTCTCCATCGTCCC0GTGCGC AGAGGCTACTGGGGGAACAAGATCGGCAAGCC | 8 | XWPRRSGC* |

TABLE 3B-continued

| SEQ ID | identifier_ position | position | modified RNA | PAP length | PAP |
|---|---|---|---|---|---|
| | | | CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCC00G ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | | |
| 3022 | NM_0029 52.3_425 | 425 | CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT NGGCCACGTCGGTCTGGGTGTTAAGTGCTCCAA GGAGGTGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAA | 7 | XPRRSGC* |
| 3023 | NM_0029 52.3_448 | 448 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAANGTGCTCCAA GGAGGTGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAA | 69 | XVLQGGGHR HPWGHHPGQ ALHRPRAQRL LGEQDRQAP HCPLQGDRPL RLCAGTPHPC TQGHWHRLR TCA* |
| 3024 | NM_0029 52.3_457 | 457 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG | 66 | XGGGHRHPW GHHPGQALH RPRAQRLLGE QDRQAPHCPL QGDRPLRLCA |

TABLE 3B-continued

| SEQ ID | identifier_ position | position | modified RNA | PAP length | PAP |
|---|---|---|---|---|---|
| | | | AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAN GGAGGTGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | GTPHPCTQG HWHRLRTCA* |
| 3025 | NM_0029 52.3_459 | 459 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GNAGGTGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 65 | XGGHRHPWG HHPGQALHRP RAQRLLGEQD RQAPHCPLQ GDRPLRLCAG TPHPCTQGH WHRLRTCA* |
| 3026 | NM_0029 52.3_461 | 461 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGNGTGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC | 64 | XGHRHPWGH HPGQALHRPR AQRLLGEQDR QAPHCPLQG DRPLRLCAGT PHPCTQGHW HRLRTCA* |

TABLE 3B-continued

| SEQ ID | identifier_ position | position | modified RNA | PAP length | PAP |
|---|---|---|---|---|---|
| | | | CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3027 | NM_0029 52.3_463 | 463 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTNGGCCACCGCCATCCGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 63 | GHRHPWGHH PGQALHRPRA QRLLGEQDR QAPHCPLQG DRPLRLCAGT PHPCTQGHW HRLRTCA* |
| 3028 | NM_0029 52.3_477 | 477 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCNGTGGGGCCATCA TCCTGGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 59 | XWGHHPGQA LHRPRAQRLL GEQDRQAPH CPLQGDRPLR LCAGTPHPCT QGHWHRLRT CA* |
| 3029 | NM_0029 52.3_494 | 494 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG | 53 | XQALHRPRAQ RLLGEQDRQA PHCPLQGDRP LRLCAGTPHP CTQGHWHRL RTCA* |

TABLE 3B-continued

| SEQ ID | identifier_ position | position | modified RNA | PAP length | PAP |
|---|---|---|---|---|---|
| | | | AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGNGCCAAGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3030 | NM_0029 52.3_499 | 499 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAANGCTCTCCATCGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 52 | XALHRPRAQR LLGEQDRQAP HCPLQGDRPL RLCAGTPHPC TQGHWHRLR TCA* |
| 3031 | NM_0029 52.3_509 | 509 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCNGTCCCCGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC | 48 | XPRAQRLLGE QDRQAPHCPL QGDRPLRLCA GTPHPCTQG HWHRLRTCA* |

TABLE 3B-continued

| SEQ ID | identifier_position | position | modified RNA | PAP length | PAP |
|---|---|---|---|---|---|
| | | | CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3032 | NM_0029 52.3_515 | 515 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCNGTGCGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 46 | XAQRLLGEQD RQAPHCPLQ GDRPLRLCAG TPHPCTQGH WHRLRTCA* |
| 3033 | NM_0029 52.3_519 | 519 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCNGCA GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 45 | XQRLLGEQDR QAPHCPLQG DRPLRLCAGT PHPCTQGHW HRLRTCA* |
| 3034 | NM_0029 52.3_522 | 522 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT | 44 | XRLLGEQDRQ APHCPLQGDR PLRLCAGTPH PCTQGHWHR LRTCA* |

TABLE 3B-continued

| SEQ ID | identifier_position | position | modified RNA | PAP length | PAP |
|---|---|---|---|---|---|
| | | | GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAN GAGGCTACTGGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3035 | NM_0029 52.3_531 | 531 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTNGGGGAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 41 | XGEQDRQAP HCPLQGDRPL RLCAGTPHPC TQGHWHRLR TCA* |
| 3036 | NM_0029 52.3_536 | 536 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGNAACAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 39 | XQDRQAPHC PLQGDRPLRL CAGTPHPCTQ GHWHRLRTC A* |

TABLE 3B-continued

| SEQ ID | identifier_position | position | modified RNA | PAP length | PAP |
|---|---|---|---|---|---|
| 3037 | NM_0029 52.3_539 | 539 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACNAAGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 38 | XDRQAPHCPL QGDRPLRLCA GTPHPCTQG HWHRLRTCA* |
| 3038 | NM_0029 52.3_541 | 541 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAANGATCGGCAAGCCC CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 38 | XDRQAPHCPL QGDRPLRLCA GTPHPCTQG HWHRLRTCA* |
| 3039 | NM_0029 52.3_550 | 550 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAANGCCC | 35 | XAPHCPLQGD RPLRLCAGTP HPCTQGHWH RLRTCA* |

TABLE 3B-continued

| SEQ ID | identifier_position | position | modified RNA | PAP length | PAP |
|---|---|---|---|---|---|
| | | | CACACTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3040 | NM_0029 52.3_558 | 558 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACANCTGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 32 | XCPLQGDRPL RLCAGTPHPC TQGHWHRLR TCA* |
| 3041 | NM_0029 52.3_560 | 560 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTNGTCCCTTGCAAGGTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 31 | XPLQGDRPLR LCAGTPHPCT QGHWHRLRT CA* |
| 3042 | NM_0029 52.3_565 | 565 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC | 29 | LQGDRPLRLC AGTPHPCTQG HWHRLRTCA* |

TABLE 3B-continued

| SEQ ID | identifier_position | position | modified RNA | PAP length | PAP |
|---|---|---|---|---|---|
| | | | GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCNTTGCAAGGTGACAGGCCGCTGC<br>GGCTCTGTGCTGGTACGCCTCATCCCTGCACCC<br>AGGGGCACTGGCATCGTCTCCGCACCTGTGCCT<br>AAGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | | |
| 3043 | NM_0029<br>52.3_567 | 567 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTNGCAAGGTGACAGGCCGCTGC<br>GGCTCTGTGCTGGTACGCCTCATCCCTGCACCC<br>AGGGGCACTGGCATCGTCTCCGCACCTGTGCCT<br>AAGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | 29 | XQGDRPLRLC<br>AGTPHPCTQG<br>HWHRLRTCA* |
| 3044 | NM_0029<br>52.3_571 | 571 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAANGGTGACAGGCCGCTGC<br>GGCTCTGTGCTGGTACGCCTCATCCCTGCACCC<br>AGGGGCACTGGCATCGTCTCCGCACCTGTGCCT<br>AAGAAGCTGCTCATGATGGCTGGTATCGATGAC | 28 | XGDRPLRLCA<br>GTPHPCTQG<br>HWHRLRTCA* |

TABLE 3B-continued

| SEQ ID | identifier_position | position | modified RNA | PAP length | PAP |
|---|---|---|---|---|---|
| | | | TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3045 | NM_0029 52.3_573 | 573 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGNTGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 27 | XDRPLRLCAG TPHPCTQGH WHRLRTCA* |
| 3046 | NM_0029 52.3_574 | 574 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTNGACAGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 26 | DRPLRLCAGT PHPCTQGHW HRLRTCA* |
| 3047 | NM_0029 52.3_578 | 578 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG | 25 | XPLRLCAGTP HPCTQGHWH RLRTCA* |

TABLE 3B-continued

| SEQ ID | identifier_position | position | modified RNA | PAP length | PAP |
|---|---|---|---|---|---|
| | | | GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACANGGCCGCTGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3048 | NM_0029 52.3_585 | 585 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTNGC GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 23 | XRLCAGTPHP CTQGHWHRL RTCA* |
| 3049 | NM_0029 52.3_587 | 587 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCN GGCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC | 22 | XLCAGTPHPC TQGHWHRLR TCA* |

TABLE 3B-continued

| SEQ ID | identifier_position | position | modified RNA | PAP length | PAP |
|---|---|---|---|---|---|
| | | | TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3050 | NM_0029 52.3_589 | 589 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GNCTCTGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 21 | LCAGTPHPCT QGHWHRLRT CA* |
| 3051 | NM_0029 52.3_593 | 593 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTNGTGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 20 | XAGTPHPCTQ GHWHRLRTC A* |
| 3052 | NM_0029 52.3_595 | 595 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG | 19 | AGTPHPCTQG HWHRLRTCA* |

TABLE 3B-continued

| SEQ ID | identifier_position | position | modified RNA | PAP length | PAP |
|---|---|---|---|---|---|
| | | | GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTNGCTGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3053 | NM_0029 52.3_598 | 598 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTNGGTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 18 | GTPHPCTQG HWHRLRTCA* |
| 3054 | NM_0029 52.3_600 | 600 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGNTACGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA | 18 | XTPHPCTQGH WHRLRTCA* |

TABLE 3B-continued

| SEQ ID | identifier_position | position | modified RNA | PAP length | PAP |
|---|---|---|---|---|---|
| 3055 | NM_0029 52.3_603 | 603 | GAAAAATAAAGTGAATTAAGCGTGAAAAAAAAAA AAAAAAAAAA CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACNGCCTCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 17 | XPHPCTQGH WHRLRTCA* |
| 3056 | NM_0029 52.3_606 | 606 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCNCATCCCTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 16 | XHPCTQGHW HRLRTCA* |
| 3057 | NM_0029 52.3_613 | 613 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT | 13 | CTQGHWHRL RTCA* |

TABLE 3B-continued

| SEQ ID | identifier_position | position | modified RNA | PAP length | PAP |
|---|---|---|---|---|---|
| | | | CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCNTGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3058 | NM_0029 52.3_614 | 614 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTNGCACCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 13 | XTQGHWHRL RTCA* |
| 3059 | NM_0029 52.3_617 | 617 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCANCCC AGGGGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 12 | XQGHWHRLR TCA* |

TABLE 3B-continued

| SEQ ID | identifier_ position | position | modified RNA | PAP length | PAP |
|---|---|---|---|---|---|
| 3060 | NM_0029 52.3_624 | 624 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGNGCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 10 | XHWHRLRTC A* |
| 3061 | NM_0029 52.3_625 | 625 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGNCACTGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 9 | HWHRLRTCA* |
| 3062 | NM_0029 52.3_629 | 629 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC | 8 | XHRLRTCA* |

TABLE 3B-continued

| SEQ ID | identifier_ position | position | modified RNA | PAP length | PAP |
|---|---|---|---|---|---|
| | | | ACACTGTCCCTTGCAAGGTGACAGGCCGCTGCG GCTCTGTGCTGGTACGCCTCATCCCTGCACCCA GGGGCACTNGGCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3063 | NM_0029 52.3_631 | 631 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGNCATCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 7 | HRLRTCA* |
| 3064 | NM_0029 52.3_634 | 634 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATNCGTCTCCGCACCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 7 | XRLRTCA* |
| 3065 | NM_0029 52.3_635 | 635 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC | 6 | XLRTCA* |

TABLE 3B-continued

| SEQ ID | identifier_position | position | modified RNA | PAP length | PAP |
|---|---|---|---|---|---|
| | | | GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCNGTCTCCGCACCTGTGCCT<br>AAGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | | |
| 3066 | NM_0029<br>52.3_641 | 641 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCNGCACCTGTGCCT<br>AAGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | 4 | XTCA* |
| 3067 | NM_0029<br>52.3_642 | 642 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCNCACCTGTGCCT<br>AAGAAGCTGCTCATGATGGCTGGTATCGATGAC | 4 | XTCA* |

| SEQ ID | identifier_position | position | modified RNA | PAP length | PAP |
|---|---|---|---|---|---|
| | | | TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3068 | NM_0029 52.3_644 | 644 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCANCCTGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 3 | XCA* |
| 3069 | NM_0029 52.3_647 | 647 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTNGTGCCT AAGAAGCTGCTCATGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 2 | XA* |
| 3070 | NM_0029 52.3_653 | 653 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG | 10 | XEAAHDGWY R* |

TABLE 3B-continued

| SEQ ID | identifier_position | position | modified RNA | PAP length | PAP |
|---|---|---|---|---|---|
| | | | GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTN<br>AAGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | | |
| 3071 | NM_0029<br>52.3_655 | 655 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>ANGAAGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC<br>TATCAGGAGTTCACTGACCACCTCGTCAAGACC<br>CACACCAGAGTCTCCGTGCAGCGGACTCAGGCT<br>CCAGCTGTGGCTACAACATAGGGTTTTTATACAA<br>GAAAAATAAAGTGAATTAAGCGTGAAAAAAAAAA<br>AAAAAAAAAA | 10 | XEAAHDGWY<br>R* |
| 3072 | NM_0029<br>52.3_658 | 658 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAANGCTGCTCATGATGGCTGGTATCGATGAC<br>TGCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCCC | 9 | XAAHDGWYR* |

TABLE 3B-continued

| SEQ ID | identifier_ position | position | modified RNA | PAP length | PAP |
|---|---|---|---|---|---|
| | | | TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | | |
| 3073 | NM_0029 52.3_667 | 667 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATNGATGGCTGGTATCGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 6 | XDGWYR* |
| 3074 | NM_0029 52.3_680 | 680 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCNGATGAC TGCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGACCACCTCGTCAAGACC CACACCAGAGTCTCCGTGCAGCGGACTCAGGCT CCAGCTGTGGCTACAACATAGGGTTTTTATACAA GAAAAATAAAGTGAATTAAGCGTGAAAAAAAAAA AAAAAAAAAA | 1 | X* |
| 3075 | NM_0029 52.3_687 | 687 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG | 20 | XLHLSPGLHC HPGQLRQGH L* |

| SEQ ID | identifier_position | position | modified RNA | PAP length | PAP |
|---|---|---|---|---|---|
| | | | GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT<br>NGCTACACCTCAGCCCGGGGCTGCACTGCCAC<br>CCTGGGCAACTTCGCCAAGGCCACCTTTGATGC<br>CATTTCTAAGACCTACAGCTACCTGACCCCCGA<br>CCTCTGGAAGGAGACTGTATTCACCAAGTCTCC<br>CTATCAGGAGTTCACTGACCACCTCGTCAAGAC<br>CCACACCAGAGTCTCCGTGCAGCGGACTCAGG<br>CTCCAGCTGTGGCTACAACATAGGGTTTTTATAC<br>AAGAAAAATAAAGTGAATTAAGCGTGAAAAAAAA<br>AAAAAAAAAAAA | | |
| 3076 | NM_0029<br>52.3_699 | 699 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT<br>GCTACACCTCAGNCCCGGGGCTGCACTGCCAC<br>CCTGGGCAACTTCGCCAAGGCCACCTTTGATGC<br>CATTTCTAAGACCTACAGCTACCTGACCCCCGA<br>CCTCTGGAAGGAGACTGTATTCACCAAGTCTCC<br>CTATCAGGAGTTCACTGACCACCTCGTCAAGAC<br>CCACACCAGAGTCTCCGTGCAGCGGACTCAGG<br>CTCCAGCTGTGGCTACAACATAGGGTTTTTATAC<br>AAGAAAAATAAAGTGAATTAAGCGTGAAAAAAAA<br>AAAAAAAAAAAA | 16 | XPGLHCHPG<br>QLRQGHL* |
| 3077 | NM_0029<br>52.3_714 | 714 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT<br>GCTACACCTCAGCCCGGGGCTGCACTGNCCAC<br>CCTGGGCAACTTCGCCAAGGCCACCTTTGATGC<br>CATTTCTAAGACCTACAGCTACCTGACCCCCGA<br>CCTCTGGAAGGAGACTGTATTCACCAAGTCTCC<br>CTATCAGGAGTTCACTGACCACCTCGTCAAGAC<br>CCACACCAGAGTCTCCGTGCAGCGGACTCAGG<br>CTCCAGCTGTGGCTACAACATAGGGTTTTTATAC | 11 | XHPGQLRQG<br>HL* |

TABLE 3B-continued

| SEQ ID | identifier_position | position | modified RNA | PAP length | PAP |
|---|---|---|---|---|---|
| 3078 | NM_0029 52.3_724 | 724 | AAGAAAAATAAAGTGAATTAAGCGTGAAAAAAAA AAAAAAAAAAAA CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGNCAACTTCGCCAAGGCCACCTTTGATGC CATTTCTAAGACCTACAGCTACCTGACCCCCGA CCTCTGGAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | 7 | QLRQGHL* |
| 3079 | NM_0029 52.3_727 | 727 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAANCTTCGCCAAGGCCACCTTTGATGC CATTTCTAAGACCTACAGCTACCTGACCCCCGA CCTCTGGAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | 7 | XLRQGHL* |
| 3080 | NM_0029 52.3_730 | 730 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT | 6 | XRQGHL* |

TABLE 3B-continued

| SEQ ID | identifier_position | position | modified RNA | PAP length | PAP |
|---|---|---|---|---|---|
| | | | CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTNCGCCAAGGCCACCTTTGATGC CATTTCTAAGACCTACAGCTACCTGACCCCCGA CCTCTGGAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | | |
| 3081 | NM_0029 52.3_738 | 738 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTCGCCAAGGNCCACCTTTGATGC CATTTCTAAGACCTACAGCTACCTGACCCCCGA CCTCTGGAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | 3 | XHL* |
| 3082 | NM_0029 52.3_75 | 75 | CTTCTTTTCCGACAAAACACCAAATGGCGGATGA CGCCGGTGCAGCGGGGGGGCCCGGGGGCCCT GGTGGCCCTGNGGATGGGGAACCGCGGTGGCT TCCGCGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 40 | XDGEPRWLP RRFRQWHPG PGSRPWTGP GPRPRSSRR QGRG* |

TABLE 3B-continued

| SEQ ID | identifier_position | position | modified RNA | PAP length | PAP |
|---|---|---|---|---|---|
| 3083 | NM_0029 52.3_756 | 756 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTCGCCAAGGCCACCTTTGATGCC ATTTNCTAAGACCTACAGCTACCTGACCCCCGA CCTCTGGAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAAA | 1 | X* |
| 3084 | NM_0029 52.3_76 | 76 | CTTCTTTTCCGACAAAACACCAAATGGCGGATGA CGCCGGTGCAGCGGGGGGGCCCGGGGGCCCT GGTGGCCCTGGGNGATGGGGAACCGCGGTGGCT TCCGCGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAAA | 39 | DGEPRWLPR RFRQWHPGP GSRPWTGPG PRPRSSRRQ GRG* |
| 3085 | NM_0029 52.3_791 | 791 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC | 14 | XGDCIHQVSL SGVH* |

TABLE 3B-continued

| SEQ ID | identifier_position | position | modified RNA | PAP length | PAP |
|---|---|---|---|---|---|
| | | | ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGNAAGGAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | | |
| 3086 | NM_0029 52.3_795 | 795 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGNAGACTGTATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | 13 | XDCIHQVSLS GVH* |
| 3087 | NM_0029 52.3_801 | 801 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC GGGGTCGCGGCCGTGGACGGGGCCGGGGCCG AGGCCGCGGAGCTCGCGGAGGCAAGGCCGAG GATAAGGAGTGGATGCCCGTCACCAAGTTGGGC CGCTTGGTCAAGGACATGAAGATCAAGTCCCTG GAGGAGATCTATCTCTTCTCCCTGCCTATTAAGG AATCAGAGATCATTGATTTCTTCCTGGGGGCCTC TCTCAAGGATGAGGTTTTGAAGATTATGCCAGTG CAGAAGCAGACCCGTGCCGGCCAGCGCACCAG GTTCAAGGCATTTGTTGCTATCGGGGACTACAAT GGCCACGTCGGTCTGGGTGTTAAGTGCTCCAAG GAGGTGGCCACCGCCATCCGTGGGGCCATCAT CCTGGCCAAGCTCTCCATCGTCCCCGTGCGCAG AGGCTACTGGGGGAACAAGATCGGCAAGCCCC ACACTGTCCCTTGCAAGGTGACAGGCCGCTGCG GCTCTGTGCTGGTACGCCTCATCCCTGCACCCA GGGGCACTGGCATCGTCTCCGCACCTGTGCCTA AGAAGCTGCTCATGATGGCTGGTATCGATGACT GCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGGAGACTGNATTCACCAAGTCTCC CTATCAGGAGTTCACTGACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | 11 | XIHQVSLSGV H* |
| 3088 | NM_0029 52.3_811 | 811 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCGCGGAGGTTTCGGCAGTGGCATCCGGGGCC | 8 | XVSLSGVH* |

TABLE 3B-continued

| SEQ ID | identifier_ position | position | modified RNA | PAP length | PAP |
|---|---|---|---|---|---|
| | | | GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT<br>GCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAANGTCTCC<br>CTATCAGGAGTTCACTGACCACCTCGTCAAGAC<br>CCACACCAGAGTCTCCGTGCAGCGGACTCAGG<br>CTCCAGCTGTGGCTACAACATAGGGTTTTTATAC<br>AAGAAAAATAAAGTGAATTAAGCGTGAAAAAAAA<br>AAAAAAAAAAAA | | |
| 3089 | NM_0029<br>52.3_818 | 818 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT<br>GCTACACCTCAGCCCGGGGCTGCACTGCCACC<br>CTGGGCAACTTCGCCAAGGCCACCTTTGATGCC<br>ATTTCTAAGACCTACAGCTACCTGACCCCCGAC<br>CTCTGGAAGGAGACTGTATTCACCAAGTCTCC<br>NTATCAGGAGTTCACTGACCACCTCGTCAAGAC<br>CCACACCAGAGTCTCCGTGCAGCGGACTCAGG<br>CTCCAGCTGTGGCTACAACATAGGGTTTTTATAC<br>AAGAAAAATAAAGTGAATTAAGCGTGAAAAAAAA<br>AAAAAAAAAAAA | 5 | XSGVH* |
| 3090 | NM_0029<br>52.3_834 | 834 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGAGATCTATCTCTTCTCCCTGCCTATTAAGG<br>AATCAGAGATCATTGATTTCTTCCTGGGGGCCTC<br>TCTCAAGGATGAGGTTTTGAAGATTATGCCAGTG<br>CAGAAGCAGACCCGTGCCGGCCAGCGCACCAG<br>GTTCAAGGCATTTGTTGCTATCGGGGACTACAAT<br>GGCCACGTCGGTCTGGGTGTTAAGTGCTCCAAG<br>GAGGTGGCCACCGCCATCCGTGGGGCCATCAT<br>CCTGGCCAAGCTCTCCATCGTCCCCGTGCGCAG<br>AGGCTACTGGGGGAACAAGATCGGCAAGCCCC<br>ACACTGTCCCTTGCAAGGTGACAGGCCGCTGCG<br>GCTCTGTGCTGGTACGCCTCATCCCTGCACCCA<br>GGGGCACTGGCATCGTCTCCGCACCTGTGCCTA<br>AGAAGCTGCTCATGATGGCTGGTATCGATGACT | 34 | XPPRQDPHQ<br>SLRAADSGSS<br>CGYNIGFLYK<br>KNKVN* |

TABLE 3B-continued

| SEQ ID | identifier_position | position | modified RNA | PAP length | PAP |
|---|---|---|---|---|---|
| | | | GCTACACCTCAGCCCGGGGCTGCACTGCCACC CTGGGCAACTTCGCCAAGGCCACCTTTGATGCC ATTTCTAAGACCTACAGCTACCTGACCCCCGAC CTCTGGAAGGAGACTGTATTCACCAAGTCTCCC TATCAGGAGTTCACTGNACCACCTCGTCAAGAC CCACACCAGAGTCTCCGTGCAGCGGACTCAGG CTCCAGCTGTGGCTACAACATAGGGTTTTTATAC AAGAAAAATAAAGTGAATTAAGCGTGAAAAAAAA AAAAAAAAAAAA | | |
| 3091 | NM_0029 52.3_87 | 87 | CTTCTTTTCCGACAAAACACCAAATGGCGGATGA CGCCGGTGCAGCGGGGGGGCCCGGGGGCCCT GGTGGCCCTGGGATGGGGAACCNGCGGTGGCT TCCGCGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 36 | XRWLPRRFR QWHPGPGSR PWTGPGPRP RSSRRQGRG* |
| 3092 | NM_0029 52.3_89 | 89 | CTTCTTTTCCGACAAAACACCAAATGGCGGATGA CGCCGGTGCAGCGGGGGGGCCCGGGGGCCCT GGTGGCCCTGGGATGGGGAACCGCNGGTGGCT TCCGCGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT GGAGGAGATCTATCTCTTCTCCCTGCCTATTAAG GAATCAGAGATCATTGATTTCTTCCTGGGGGCCT CTCTCAAGGATGAGGTTTTGAAGATTATGCCAGT GCAGAAGCAGACCCGTGCCGGCCAGCGCACCA GGTTCAAGGCATTTGTTGCTATCGGGGACTACA ATGGCCACGTCGGTCTGGGTGTTAAGTGCTCCA AGGAGGTGGCCACCGCCATCCGTGGGGCCATC ATCCTGGCCAAGCTCTCCATCGTCCCCGTGCGC AGAGGCTACTGGGGGAACAAGATCGGCAAGCC CCACACTGTCCCTTGCAAGGTGACAGGCCGCTG CGGCTCTGTGCTGGTACGCCTCATCCCTGCACC CAGGGGCACTGGCATCGTCTCCGCACCTGTGC CTAAGAAGCTGCTCATGATGGCTGGTATCGATG ACTGCTACACCTCAGCCCGGGGCTGCACTGCCA CCCTGGGCAACTTCGCCAAGGCCACCTTTGATG CCATTTCTAAGACCTACAGCTACCTGACCCCCG ACCTCTGGAAGGAGACTGTATTCACCAAGTCTC CCTATCAGGAGTTCACTGACCACCTCGTCAAGA CCCACACCAGAGTCTCCGTGCAGCGGACTCAG GCTCCAGCTGTGGCTACAACATAGGGTTTTTATA CAAGAAAAATAAAGTGAATTAAGCGTGAAAAAAA AAAAAAAAAAAA | 35 | XWLPRRFRQ WHPGPGSRP WTGPGPRPR SSRRQGRG* |
| 3093 | NM_0029 52.3_99 | 99 | CTTCTTTTCCGACAAAACACCAAATGGCGGATGA CGCCGGTGCAGCGGGGGGGCCCGGGGGCCCT GGTGGCCCTGGGATGGGGAACCGCGGTGGCTT CCNGCGGAGGTTTCGGCAGTGGCATCCGGGGC CGGGGTCGCGGCCGTGGACGGGGCCGGGGCC GAGGCCGCGGAGCTCGCGGAGGCAAGGCCGA GGATAAGGAGTGGATGCCCGTCACCAAGTTGGG CCGCTTGGTCAAGGACATGAAGATCAAGTCCCT | 32 | XRRFRQWHP GPGSRPWTG PGPRPRSSRR QGRG* |

TABLE 3B-continued

| SEQ ID | identifier_position | position | modified RNA | PAP length | PAP |
|---|---|---|---|---|---|
| | | | GGAGGAGATCTATCTCTTCTCCCTGCCTATTAAG<br>GAATCAGAGATCATTGATTTCTTCCTGGGGGCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | | |
| 3094 | NM_0029<br>79.3_140<br>4 | 1404 | ACGCGCCTGTGTTGCCGCCCGCGGCCCTGGCT<br>TCGGGCTTCAGGGAGCTCTGGTGCAGTCTCCGC<br>CTGTCAGTGCCGGCAGTCGTCCGCGGCGCCCG<br>CCCCGGTCCCGCACTGGTGCAGCCATGTCCTCT<br>TCCCCGTGGGAGCCTGCGACCCTGCGCCGGGT<br>GTTCGTGGTGGGGGTTGGCATGACCAAGTTTGT<br>GAAGCCTGGAGCTGAGAATTCAAGAGACTACCC<br>TGACTTGGCAGAAGAAGCAGGCAAGAAGGCTTT<br>AGCTGATGCACAGATCCCTTATTCAGCAGTGGA<br>CCAGGCATGTGTTGGCTATGTTTTTGGTGACTCT<br>ACCTGTGGGCAGAGGGCTATCTATCACAGTTTG<br>GGAATGACTGGAATTCCTATAATCAATGTCAACA<br>ATAACTGTGCTACTGGTTCTACTGCTTTGTTTAT<br>GGCCCGCCAGCTGATTCAGGGTGGTGTGGCAG<br>AATGTGTCTTGGCTCTTGGGTTTGAGAAGATGA<br>GTAAGGGAAGCCTTGGAATAAAATTTTCAGATAG<br>AACCATTCCCACTGATAAGCATGTTGACCTCCTG<br>ATCAATAAGTATGGATTGTCTGCTCACCCAGTTG<br>CTCCTCAGATGTTTGGGTATGCTGGAAAAGAAC<br>ATATGGAAAAATATGGAACAAAAATTGAACACTT<br>TGCAAAAATTGGATGGAAAAATCATAAACATTCA<br>GTTAATAACCCGTATTCCCAGTTCCAAGATGAAT<br>ACAGTTTAGATGAAGTGATGGCATCTAAAGAAGT<br>TTTTGATTTTTTGACTATCTTACAATGTTGTCCCA<br>CTTCAGATGGTGCTGCAGCAGCAATTTTGGCCA<br>GTGAAGCATTTGTACAGAAGTATGGCCTGCAAT<br>CCAAAGCTGTGGAAATTTTGGCACAAGAAATGAT<br>GACTGATTTGCCAAGCTCGTTTGAAGAAAAAAGC<br>ATTATTAAAATGGTTGGCTTTGATATGAGTAAAG<br>AAGCTGCAAGAAAATGCTATGAGAAATCTGGCC<br>TGACACCAAATGATATTGACGTA | 1 | X* |
| 3095 | NM_0030<br>02.1_338 | 338 | CCAGGAACGAGATGGCGGTTCTCTGGAGGCTG<br>AGTGCCGTTTGCGGTGCCCTAGGAGGGCCGAGC<br>TCTGTTGCTTCGAACTCCAGTGGTCAGACCTGC<br>TCATATCTCAGCATTTCTTCAGGACCGACCTATC<br>CCAGAATGGTGTGGAGTGCAGCACATACACTTG<br>TCACCGAGCCACCATTCTGGCTCCAAGGCTGCA<br>TCTCTCCACTGGACTAGCGAGAGGGTTGTCAGT<br>GTTTTGCTCCTGGGTCTGCTTCCGGCTGCTTATT<br>TGAATCCTTGCTCTGCGATGGACTATTCCCTGG<br>CTGCAGCCCTCACTCTTCATGGTCACTGGGGCC<br>TTGGACAANGTTGTTACTGACTATGTTCATGGGG<br>ATGCCTTGCAGAAAGCTGCCAAGGCAGGGCTTT<br>TGGCACTTTCAGCTTTAACCTTTGCTGGGCTTTG<br>CTATTTCAACTATCACGATGTGGGCATCTGCAAA<br>GCTGTTGCCATGCTGTGGAAGCTCTGACCTTTTT<br>GACTTCATACTTTGAAGAATTGATGTATGCCTCT<br>TTGCCTCTGCTTTGTCATGCCATTAAGCTCACAA<br>TAAGGAAGAAATAACAGATAAGTCCATTGGTGGA<br>CAGCCTTCTTCTCTTAATCACAAGATTATTTTCAG<br>AATTTAATCTTTGAGGAAAAGGTTTGAGAGGAAT<br>TATATCTAAGTTGTGAGACTGAGTTCTATATTCT<br>GGTGAGTTAATGGGGTTGCCTCCCAGCTTCTTA<br>TAAGACTCACAGTATAACTAAACATGATATATCA<br>GCTTTTGCCTTTCAATTTATCAATCTCTTAAAGAG | 3 | XCY* |

TABLE 3B-continued

| SEQ ID | identifier_ position | position | modified RNA | PAP length | PAP |
|---|---|---|---|---|---|
| | | | AATCCAACTTTATTACGATTAGTATATGATCAAAC TTCCATATTTGCCTTGGGAATAATGGACAAAGGG AAATACTCTTAATTCATGAATAAAAACTTTGCAGA AAATTAGACAGTGTTTAATTTTCGAAAACTTCCCT CTCTAGACAGTAGATACCACCTACTGATGGTTAC ATATACTAGGGAAATTTTAAAATTAGGAAATGCT GATAGCTCATA | | |
| 3096 | NM_0030 02.1_377 | 377 | CCAGGAACGAGATGGCGGTTCTCTGGAGGCTG AGTGCCGTTTGCGGTGCCCTAGGAGGCCGAGC TCTGTTGCTTCGAACTCCAGTGGTCAGACCTGC TCATATCTCAGCATTTCTTCAGGACCGACCTATC CCAGAATGGTGTGGAGTGCAGCACATACACTTG TCACCGAGCCACCATTCTGGCTCCAAGGCTGCA TCTCTCCACTGGACTAGCGAGAGGGTTGTCAGT GTTTTGCTCCTGGGTCTGCTTCCGGCTGCTTATT TGAATCCTTGCTCTGCGATGGACTATTCCCTGG CTGCAGCCCTCACTCTTCATGGTCACTGGGGCC TTGGACAAGTTGTTACTGACTATGTTCATGGGGA TGCCTTGCAGAAANGCTGCCAAGGCAGGGCTTT TGGCACTTTCAGCTTTAACCTTTGCTGGGCTTTG CTATTTCAACTATCACGATGTGGGCATCTGCAAA GCTGTTGCCATGCTGTGGAAGCTCTGACCTTTTT GACTTCATACTTTGAAGAATTGATGTATGCCTCT TTGCCTCTGCTTTGTCATGCCATTAAGCTCACAA TAAGGAAGAAATAACAGATAAGTCCATTGGTGGA CAGCCTTCTTCTCTTAATCACAAGATTATTTTCAG AATTTAATCTTTGAGGAAAAGGTTTGAGAGGAAT TATATCTAAGTTGTGAGACTGAGTTCTATATTCT GGTGAGTTAATGGGGTTGCCTCCCAGCTTCTTA TAAGACTCACAGTATAACTAAACATGATATATCA GCTTTTGCCTTTCAATTTATCAATCTCTTAAAGAG AATCCAACTTTATTACGATTAGTATATGATCAAAC TTCCATATTTGCCTTGGGAATAATGGACAAAGGG AAATACTCTTAATTCATGAATAAAAACTTTGCAGA AAATTAGACAGTGTTTAATTTTCGAAAACTTCCCT CTCTAGACAGTAGATACCACCTACTGATGGTTAC ATATACTAGGGAAATTTTAAAATTAGGAAATGCT GATAGCTCATA | 67 | XCQGRAFGTF SFNLCWALLF QLSRCGHLQS CCHAVEALTF LTSYFEELMY ASLPLLCHAIK LTIRKK* |
| 3097 | NM_0030 02.1_418 | 418 | CCAGGAACGAGATGGCGGTTCTCTGGAGGCTG AGTGCCGTTTGCGGTGCCCTAGGAGGCCGAGC TCTGTTGCTTCGAACTCCAGTGGTCAGACCTGC TCATATCTCAGCATTTCTTCAGGACCGACCTATC CCAGAATGGTGTGGAGTGCAGCACATACACTTG TCACCGAGCCACCATTCTGGCTCCAAGGCTGCA TCTCTCCACTGGACTAGCGAGAGGGTTGTCAGT GTTTTGCTCCTGGGTCTGCTTCCGGCTGCTTATT TGAATCCTTGCTCTGCGATGGACTATTCCCTGG CTGCAGCCCTCACTCTTCATGGTCACTGGGGCC TTGGACAAGTTGTTACTGACTATGTTCATGGGGA TGCCTTGCAGAAAGCTGCCAAGGCAGGGCTTTT GGCACTTTCAGCTTTAACCTTNTGCTGGGCTTTG CTATTTCAACTATCACGATGTGGGCATCTGCAAA GCTGTTGCCATGCTGTGGAAGCTCTGACCTTTTT GACTTCATACTTTGAAGAATTGATGTATGCCTCT TTGCCTCTGCTTTGTCATGCCATTAAGCTCACAA TAAGGAAGAAATAACAGATAAGTCCATTGGTGGA CAGCCTTCTTCTCTTAATCACAAGATTATTTTCAG AATTTAATCTTTGAGGAAAAGGTTTGAGAGGAAT TATATCTAAGTTGTGAGACTGAGTTCTATATTCT GGTGAGTTAATGGGGTTGCCTCCCAGCTTCTTA TAAGACTCACAGTATAACTAAACATGATATATCA GCTTTTGCCTTTCAATTTATCAATCTCTTAAAGAG AATCCAACTTTATTACGATTAGTATATGATCAAAC TTCCATATTTGCCTTGGGAATAATGGACAAAGGG AAATACTCTTAATTCATGAATAAAAACTTTGCAGA AAATTAGACAGTGTTTAATTTTCGAAAACTTCCCT CTCTAGACAGTAGATACCACCTACTGATGGTTAC ATATACTAGGGAAATTTTAAAATTAGGAAATGCT GATAGCTCATA | 54 | XCWALLFQLS RCGHLQSCC HAVEALTFLTS YFEELMYASL PLLCHAIKLTIR KK* |
| 3098 | NM_0030 17.3_380 | 380 | GAGAGAGTTGGTTGGTGTTGGGCCGGAGGAAA GCGGGAAGACTCATCGGAGCGTGTGGATTTGAG CCGCCGCATTTTTAACCCTAGATCTCGAAATGC ATCGTGATTCCTGTCCATTGGACTGTAAGGTTTA TGTAGGCAATCTTGGAAACAATGGCAACAAGAC GGAATTGGAACGGGCTTTTGGCTACTATGGACC ACTCCGAAGTGTGTGGGTTGCTAGAAACCCACC CGGCTTTGCTTTTGTTGAATTTGAAGATCCCCGA | 7 | XGSSPSR* |

TABLE 3B-continued

| SEQ ID | identifier_position | position | modified RNA | PAP length | PAP |
|---|---|---|---|---|---|
| | | | GATGCAGCTGATGCAGTCCGAGAGCTAGATGGA AGAACACTATGTGGCTGCCGTGTAAGAGTGGAA CTGTCGAATGGTGAAAAAAGAAGTAGAAATCGT GGCCCACCTCCCTCTNTGGGGTCGTCGCCCTC GAGATGATTATCGTAGGAGGAGTCCTCCACCTC GTCGCAGATCTCCAAGAAGGAGAAGCTTCTCTC GCAGCCGGAGCAGGTCCCTTTCTAGAGATAGGA GAAGAGAGAGATCGCTGTCTCGGGAGAGAAATC ACAAGCCGTCCCGATCCTTCTCTAGGTCTCGTA GTCGATCTAGGTCAAATGAAAGGAAATAGAAGA CAGTTTGCAAGAGAAGTGGTGTACAGGAAATTA CTTCATTTGACAGGAGTATGTACAGAAAATTCAA GTTTTGTTTGAGACTTCATAAGCTTGGTGCATTT TTAAGATGTTTTAGCTGTTCAAATCTGTTTGTCTC TTGAAACAGTGACACAAAGGTGTAATTCTCTATG GTTTGAAATGGATCATACGAGGCATGTAATACCA AGAATTGTTACTTTACAATGTTCCCTTAAGCAAAA TTGAATTTGCTTTGAACTTTTAGTTATGCACAGAC TGATAATAAACCTCTAAACCTGCCCAGCGGAAGT GTGTTTTTTTTAAATTTAAATACAGAAACAACTG GCAAAAATGAACTAAGATTTACTTTTTTTTCCATA GCTGGGATATAGGCTGCAGCTATAGTTGAACAA GCAGTCTTTAAAAACTGC | | |
| 3099 | NM_0031 33.4_224 | 224 | GCCATCTTGGGGCTGCTGGGACTCGCGTCGGTT GGCGACTCCCGGACGTAGGTAGTTTGTTGGGCC GGGTTCTGAGGCCTTGCTTCTCTTTACTTTTCCA CTCTAGGCCACGATGCCGCAGTACCAGACCTGG GAGGAGTTCAGCCGCGCTGCCGAGAAGCTTTAC CTCGCTGACCCTATGAAGGCACGTGTGGTTCTC AAATATAGGCATTCTGATGGGAACTNTGTGTGTT AAAGTAACAGATGATTTAGTTTGTTTGGTGTATA AAACAGACCAAGCTCAAGATGTAAAGAAGATTGA GAAATTCCACAGTCAACTAATGCGACTTATGGTA GCCAAGGAAGCCCGCAATGTTACCATGGAAACT GAGTGAATGGTTTGAAATGAAGACTTTGTCGTGT ACTTAGGAAGTAAATATCTTTTGAATTAGAGAAA GTGTTGGGACAGAAAGTACTTTATGTAACTAAGT GGGCTGTTCAGAAGCTTAGAGGTCATTTTTTGTA ATTTTCTTTTTAATTACTTTAGAGAGCTAGGGATG CAAATGTTTTCAGTTAGAAAGCCTTTATTTACTTT TGGAAATTGAACAAGAAATGCATCTGTCTTAGAA ACTGGAGATTATTTGATGTTAGGTAAAACATGTA ATTGTTTCTCTGGCAAATTTGTATCAGTAATTTGA AAATGAGATATTAGGAAAAACCAATTCTTCTTAAA TTTAGTTCATCTTTCTTTAAAAGAACATTAAATGT AACCATTTTGTCAGATCCATGTATTTTGGAGCAT AAAATGTATGCTGTTGTGACCAATAAATATAAAAT ATGGTAATTGGAATTAACTCCACACCATAGTATG CATTGTTATACATACTGTGTACCTAATTATGTATA GCAGTGTAGTCTCAATTATATCTGAAAGTAATTG TGACTAACAAGTATGCTTTGCCTTATTTCCACATT TAAACTACCTGTTAATATAAGGGATTTGTAGTAT CAGCTTGTTGAGCAATGACTTTGAATCTAGTTTT CA | 3 | XVC* |
| 3100 | NM_0031 33.4_297 | 297 | GCCATCTTGGGGCTGCTGGGACTCGCGTCGGTT GGCGACTCCCGGACGTAGGTAGTTTGTTGGGCC GGGTTCTGAGGCCTTGCTTCTCTTTACTTTTCCA CTCTAGGCCACGATGCCGCAGTACCAGACCTGG GAGGAGTTCAGCCGCGCTGCCGAGAAGCTTTAC CTCGCTGACCCTATGAAGGCACGTGTGGTTCTC AAATATAGGCATTCTGATGGGAACTTGTGTGTTA AAGTAACAGATGATTTAGTTTGTTTGGTGTATAA AACAGACCAAGCTCAAGATGTAAAGAAGATNTGA GAAATTCCACAGTCAACTAATGCGACTTATGGT AGCCAAGGAAGCCCGCAATGTTACCATGGAAAC TGAGTGAATGGTTTGAAATGAAGACTTTGTCGTG TACTTAGGAAGTAAATATCTTTTGAATTAGAGAAA GTGTTGGGACAGAAAGTACTTTATGTAACTAAGT GGGCTGTTCAGAAGCTTAGAGGTCATTTTTTGTA ATTTTCTTTTAATTACTTTAGAGAGCTAGGGATG CAAATGTTTTCAGTTAGAAAGCCTTTATTTACTTT TGGAAATTGAACAAGAAATGCATCTGTCTTAGAA ACTGGAGATTATTTGATGTTAGGTAAAACATGTA ATTGTTTCTCTGGCAAATTTGTATCAGTAATTTGA AAATGAGATATTAGGAAAAACCAATTCTTCTTAAA TTTAGTTCATCTTTCTTTAAAAGAACATTAAATGT AACCATTTTGTCAGATCCATGTATTTTGGAGCAT | 1 | X* |

TABLE 3B-continued

| SEQ ID | identifier_position | position | modified RNA | PAP length | PAP |
|---|---|---|---|---|---|
| | | | AAAATGTATGCTGTTGTGACCAATAAATATAAAAT ATGGTAATTGGAATTAACTCCACACCATAGTATG CATTGTTATACATACTGTGTACCTAATTATGTATA GCAGTGTAGTCTCAATTATATCTGAAAGTAATTG TGACTAACAAGTATGCTTTGCCTTATTTCCACATT TAAACTACCTGTTAATATAAGGGATTTGTAGTAT CAGCTTGTTGAGCAATGACTTTGAATCTAGTTTT CA | | |
| 3101 | NM_0031 33.4_359 | 359 | GCCATCTTGGGGCTGCTGGGACTCGCGTCGGTT GGCGACTCCCGGACGTAGGTAGTTTGTTGGGCC GGGTTCTGAGGCCTTGCTTCTCTTTACTTTTCCA CTCTAGGCCACGATGCCGCAGTACCAGACCTGG GAGGAGTTCAGCCGCGCTGCCGAGAAGCTTTAC CTCGCTGACCCTATGAAGGCACGTGTGGTTCTC AAATATAGGCATTCTGATGGGAACTTGTGTGTTA AAGTAACAGATGATTTAGTTTGTTTGGTGTATAA AACAGACCAAGCTCAAGATGTAAAGAAGATTGA GAAATTCCACAGTCAACTAATGCGACTTATGGTA GCCAAGGAAGCCCGCAATGTTACCANTGGAAAC TGAGTGAATGGTTTGAAATGAAGACTTTGTCGTG TACTTAGGAAGTAAATATCTTTTGAATTAGAGAAA GTGTTGGGACAGAAAGTACTTTATGTAACTAAGT GGGCTGTTCAGAAGCTTAGAGGTCATTTTTTGTA ATTTTCTTTTTAATTACTTTAGAGAGCTAGGGATG CAAATGTTTTCAGTTAGAAAGCCTTTATTTACTTT TGGAAATTGAACAAGAAATGCATCTGTCTTAGAA ACTGGAGATTATTTGATGTTAGGTAAAACATGTA ATTGTTTCTCTGGCAAATTTGTATCAGTAATTTGA AAATGAGATATTAGGAAAAACCAATTCTTCTTAAA TTTAGTTCATCTTTCTTTAAAAGAACATTAAATGT AACCATTTTGTCAGATCCATGTATTTTGGAGCAT AAAATGTATGCTGTTGTGACCAATAAATATAAAAT ATGGTAATTGGAATTAACTCCACACCATAGTATG CATTGTTATACATACTGTGTACCTAATTATGTATA GCAGTGTAGTCTCAATTATATCTGAAAGTAATTG TGACTAACAAGTATGCTTTGCCTTATTTCCACATT TAAACTACCTGTTAATATAAGGGATTTGTAGTAT CAGCTTGTTGAGCAATGACTTTGAATCTAGTTTT CA | 3 | XGN* |
| 3102 | NM_0032 95.2_500 | 500 | CCCCCCGAGCGCCGCTCCGGCTGCACCGCGCT CGCTCCGAGTTTCAGGCTCGTGCTAAGCTAGCG CCGTCGTCGTCTCCCTTCAGTCGCCATCATGATT ATCTACCGGGACCTCATCAGCCACGATGAGATG TTCTCCGACATCTACAAGATCCGGGAGATCGCG GACGGGTTGTGCCTGGAGGTGGAGGGGAAGAT GGTCAGTAGGACAGAAGGTAACATTGATGACTC GCTCATTGGTGGAAATGCCTCCGCTGAAGGCCC CGAGGGCGAAGGTACCGAAAGCACAGTAATCAC TGGTGTCGATATTGTCATGAACCATCACCTGCAG GAAACAAGTTTCACAAAAGAAGCCTACAAGAAGT ACATCAAAGATTACATGAAATCAATCAAAGGGAA ACTTGAAGAACAGAGACCAGAAAGAGTAAAACC TTTTATGACAGGGGCTGCAGAACAAATCAAGCA CATCCTTGCTAATTTCAAAAACTACCAGTTCTTTA TNTGGTGAAAACATGAATCCAGATGGCATGGTT GCTCTATTGGACTACCGTGAGGATGGTGTGACC CCATATATGATTTTCTTTAAGGATGGTTTAGAAAT GGAAAAATGTTAACAAATGTGGCAATTATTTTGG ATCTATCACCTGTCATCATAACTGGCTTCTGCTT GTCATCCACACAACACCAGGACTTAAGACAAAT GGGACTGATGTCATCTTGAGCTCTTCATTTATTT TGACTGTGATTTATTTGGAGTGGAGGCATTGTTT TTAAGAAAAACATGTCATGTAGGTTGTCTAAAAA TAAAAATGCATTTAAACTCATTTGAGAG | 2 | XW* |
| 3103 | NM_0032 95.2_578 | 578 | CCCCCCGAGCGCCGCTCCGGCTGCACCGCGCT CGCTCCGAGTTTCAGGCTCGTGCTAAGCTAGCG CCGTCGTCGTCTCCCTTCAGTCGCCATCATGATT ATCTACCGGGACCTCATCAGCCACGATGAGATG TTCTCCGACATCTACAAGATCCGGGAGATCGCG GACGGGTTGTGCCTGGAGGTGGAGGGGAAGAT GGTCAGTAGGACAGAAGGTAACATTGATGACTC GCTCATTGGTGGAAATGCCTCCGCTGAAGGCCC CGAGGGCGAAGGTACCGAAAGCACAGTAATCAC TGGTGTCGATATTGTCATGAACCATCACCTGCAG GAAACAAGTTTCACAAAAGAAGCCTACAAGAAGT ACATCAAAGATTACATGAAATCAATCAAAGGGAA ACTTGAAGAACAGAGACCAGAAAGAGTAAAACC | 2 | XL* |

TABLE 3B-continued

| SEQ ID | identifier_position | position | modified RNA | PAP length | PAP |
|---|---|---|---|---|---|
| | | | TTTTATGACAGGGGCTGCAGAACAAATCAAGCA CATCCTTGCTAATTTCAAAAACTACCAGTTCTTTA TTGGTGAAAACATGAATCCAGATGGCATGGTTG CTCTATTGGACTACCGTGAGGATGGTGTGACCC CATATATGATTTTNCTTTAAGGATGGTTTAGAAAT GGAAAAATGTTAACAAATGTGGCAATTATTTTGG ATCTATCACCTGTCATCATAACTGGCTTCTGCTT GTCATCCACACAACACCAGGACTTAAGACAAAT GGGACTGATGTCATCTTGAGCTCTTCATTTATTT TGACTGTGATTTATTTGGAGTGGAGGCATTGTTT TTAAGAAAAACATGTCATGTAGGTTGTCTAAAAA TAAAAATGCATTTAAACTCATTTGAGAG | | |
| 3104 | NM_0032 95.2_598 | 598 | CCCCCCGAGCGCCGCTCCGGCTGCACCGCGCT CGCTCCGAGTTTCAGGCTCGTGCTAAGCTAGCG CCGTCGTCGTCTCCCTTCAGTCGCCATCATGATT ATCTACCGGGACCTCATCAGCCACGATGAGATG TTCTCCGACATCTACAAGATCCGGGAGATCGCG GACGGGTTGTGCCTGGAGGTGGAGGGGAAGAT GGTCAGTAGGACAGAAGGTAACATTGATGACTC GCTCATTGGTGGAAATGCCTCCGCTGAAGGCCC CGAGGGCGAAGGTACCGAAAGCACAGTAATCAC TGGTGTCGATATTGTCATGAACCATCACCTGCAG GAAACAAGTTTCACAAAAGAAGCCTACAAGAAGT ACATCAAAGATTACATGAAATCAATCAAAGGGAA ACTTGAAGAACAGAGACCAGAAAGAGTAAAACC TTTTATGACAGGGGCTGCAGAACAAATCAAGCA CATCCTTGCTAATTTCAAAAACTACCAGTTCTTTA TTGGTGAAAACATGAATCCAGATGGCATGGTTG CTCTATTGGACTACCGTGAGGATGGTGTGACCC CATATATGATTTTCTTTAAGGATGGTTTAGAAANT GGAAAAATGTTAACAAATGTGGCAATTATTTTGG ATCTATCACCTGTCATCATAACTGGCTTCTGCTT GTCATCCACACAACACCAGGACTTAAGACAAAT GGGACTGATGTCATCTTGAGCTCTTCATTTATTT TGACTGTGATTTATTTGGAGTGGAGGCATTGTTT TTAAGAAAAACATGTCATGTAGGTTGTCTAAAAA TAAAAATGCATTTAAACTCATTTGAGAG | 40 | XGKMLTNVAII LDLSPVIITGF CLSSTQHQDL RQMGLMSS* |
| 3105 | NM_0032 95.2_603 | 603 | CCCCCCGAGCGCCGCTCCGGCTGCACCGCGCT CGCTCCGAGTTTCAGGCTCGTGCTAAGCTAGCG CCGTCGTCGTCTCCCTTCAGTCGCCATCATGATT ATCTACCGGGACCTCATCAGCCACGATGAGATG TTCTCCGACATCTACAAGATCCGGGAGATCGCG GACGGGTTGTGCCTGGAGGTGGAGGGGAAGAT GGTCAGTAGGACAGAAGGTAACATTGATGACTC GCTCATTGGTGGAAATGCCTCCGCTGAAGGCCC CGAGGGCGAAGGTACCGAAAGCACAGTAATCAC TGGTGTCGATATTGTCATGAACCATCACCTGCAG GAAACAAGTTTCACAAAAGAAGCCTACAAGAAGT ACATCAAAGATTACATGAAATCAATCAAAGGGAA ACTTGAAGAACAGAGACCAGAAAGAGTAAAACC TTTTATGACAGGGGCTGCAGAACAAATCAAGCA CATCCTTGCTAATTTCAAAAACTACCAGTTCTTTA TTGGTGAAAACATGAATCCAGATGGCATGGTTG CTCTATTGGACTACCGTGAGGATGGTGTGACCC CATATATGATTTTCTTTAAGGATGGTTTAGAAATG GAANAAATGTTAACAAATGTGGCAATTATTTTGG ATCTATCACCTGTCATCATAACTGGCTTCTGCTT GTCATCCACACAACACCAGGACTTAAGACAAAT GGGACTGATGTCATCTTGAGCTCTTCATTTATTT TGACTGTGATTTATTTGGAGTGGAGGCATTGTTT TTAAGAAAAACATGTCATGTAGGTTGTCTAAAAA TAAAAATGCATTTAAACTCATTTGAGAG | 38 | XMLTNVAIILD LSPVIITGFCL SSTQHQDLRQ MGLMSS* |
| 3106 | NM_0033 50.2_220 | 220 | CGCGTCGGGCTGCAGGAGAAGATGGCGGTCTC CACAGGAGTTAAAGTTCCTCGTAATTTTCGCTTG TTGGAAGAACTTGAAGAAGGACAAAAAGGAGTA GGCGACGGTACAGTTAGCTGGGGCCTTGAAGAT GATGAAGATATGACACTTACAAGGTGGACAGGC ATGATTATTGGGCCACCAAGGACAAATTATGAAA ACAGAATATATAGCCTGAAAGNTAGAATGTGGAC CTAAATACCCAGAAGCTCCTCCGTCAGTTAGATT TGTAACAAAAATTAATATGAACGGAATAAATAATT CCAGTGGGATGGTGGATGCCCGGAGCATACCA GTGTTAGCAAAATGGCAAAATTCATATAGCATTA AAGTTGTACTTCAAGAGCTAAGACGTCTAATGAT GTCCAAAGAAAATATGAAGCTTCCACAGCCACC AGAAGGACAAACATACAACAATTAATTTTAGTGG ATCTCAAAACTTGTCTTAAATCAACAACCTTCTACT | 5 | XRMWT* |

TABLE 3B-continued

| SEQ ID | identifier_ position | position | modified RNA | PAP length | PAP |
|---|---|---|---|---|---|
| | | | CATGTTAATGTCTTGATTAAATATCACAATGCAAA ATACACATTAAGTAAAAGAATTCCAGCTGGTAAA CATGACCTGGACATTTGTAAGAATATATTTAATAT ATGTACACCCATTATGTTTTCAGGTAACAGGAGG AAAAATGCAGCACAATTTTTTTTCTCTTGAAAGG CACTGTCATTTAAACATAAACCTGGAGTACTCGA AATAGAATTCAGGTTTACAAGATGAAAGCGTGTG GAGAAGTGTCAGATGGCAGTGGAAGCATGTGTG TTTCTAAAAAGTAAAAATCTCAAGAAAACAGAAAT GGCATGCTTTACCCATCTTACTTAGTGAAAGAGA GCTGCAGTTGAAATTGTTTAAAAAGTAGCAGGTA CAATGAATATTGTCACAGATGTGTTAATTTTTGAA GCAATGTGGGTGCTGACTACTAGTAGTATCAAAA ATATGTTCAGGATTGTTTTGATACCTGTATTTATA ATAAAAAATGTTGGGGGGAGTTGATGAATTCCTG TTAAAA | | |
| 3107 | NM_0033 50.2_371 | 371 | CGCGTCGGGCTGCAGGAGAAGATGGCGGTCTC CACAGGAGTTAAAGTTCCTCGTAATTTTCGCTTG TTGGAAGAACTTGAAGAAGGACAAAAAGGAGTA GGCGACGGTACAGTTAGCTGGGGCCTTGAAGAT GATGAAGATATGACACTTACAAGGTGGACAGGC ATGATTATTGGGCCACCAAGGACAAATTATGAAA ACAGAATATATAGCCTGAAAGTAGAATGTGGACC TAAATACCCAGAAGCTCCTCCGTCAGTTAGATTT GTAACAAAAATTAATATGAACGGAATAAATAATTC CAGTGGGATGGTGGATGCCCGGAGCATACCAG TGTTAGCAAAATGGCAAAATTCATATAGCATTAA AGTNTGTACTTCAAGAGCTAAGACGTCTAATGAT GTCCAAAGAAAATATGAAGCTTCCACAGCCACC AGAAGGACAAACATACAACAATTAATTTTAGTGG ATCTCAAACTTGTCTTAAATCAACAACCTTCTACT CATGTTAATGTCTTGATTAAATATCACAATGCAAA ATACACATTAAGTAAAAGAATTCCAGCTGGTAAA CATGACCTGGACATTTGTAAGAATATATTTAATAT ATGTACACCCATTATGTTTTCAGGTAACAGGAGG AAAAATGCAGCACAATTTTTTTTCTCTTGAAAGG CACTGTCATTTAAACATAAACCTGGAGTACTCGA AATAGAATTCAGGTTTACAAGATGAAAGCGTGTG GAGAAGTGTCAGATGGCAGTGGAAGCATGTGTG TTTCTAAAAAGTAAAAATCTCAAGAAAACAGAAAT GGCATGCTTTACCCATCTTACTTAGTGAAAGAGA GCTGCAGTTGAAATTGTTTAAAAAGTAGCAGGTA CAATGAATATTGTCACAGATGTGTTAATTTTTGAA GCAATGTGGGTGCTGACTACTAGTAGTATCAAAA ATATGTTCAGGATTGTTTTGATACCTGTATTTATA ATAAAAAATGTTGGGGGGAGTTGATGAATTCCTG TTAAAA | 99 | CTSRAKTSND VQRKYEASTA TRRTNIQQLIL VDLKLVLNQQ PSTHVNVLIKY HNAKYTLSKR1 PAGKHDLDIC KNIFNICTPIMF SGNRRKNAA QFFFS* |
| 3108 | NM_0033 80.2_632 | 632 | GTCCCCGCGCCAGAGACGCAGCCGCGCTCCCA CCACCCACACCCACCGCGCCCTCGTTCGCCTCT TCTCCGGGAGCCAGTCCGCGCCACCGCCGCCG CCCCAGGCCATCGCCACCCTCCGCAGCCATGTCC ACCAGGTCCGTGTCCTCGTCCTCCTACCGCAGG ATGTTCGGCGGCCGGGCACCGCGAGCCGGCC GAGCTCCAGCCGGAGCTACGTGACTACGTCCAC CCGCACCTACAGCCTGGGCAGCGCGCTGCGCC CCAGCACCAGCCGCAGCCTCTACGCCTCGTCCC CGGGCGGCGTGTATGCCACGCGCTCCTCTGCC GTGCGCCTGCGGAGCAGCGTGCCCGGGGTGCG GCTCCTGCAGGACTCGGTGGACTTCTCGCTGGC CGACGCCATCAACACCGAGTTCAAGAACACCCG CACCAACGAGAAGGTGGAGCTGCAGGAGCTGA ATGACCGCTTCGCCAACTACATCGACAAGGTGC GCTTCCTGGAGCAGCAGAATAAGATCCTGCTGG CCGAGCTCGAGCAGCTCAAGGGCCAAGGCAAG TCGCGCCTGGGGGACCTCTACGAGGAGGAGAT GCGGGAGCTGCGCCGGCAGGTGGACCAGCTAA CCAACGACAAAGCCCNGCGTCGAGGTGGAGCG CGACAACCTGGCCGAGGACATCATGCGCCTCC GGGAGAAATTGCAGGAGGAGATGCTTCAGAGAG AGGAAGCCGAAAACACCCTGCAATCTTTCAGAC AGGATGTTGACAATGCGTCTCTGGCACGTCTTG ACCTTGAACGCAAAGTGGAATCTTTGCAAGAAG AGATTGCCTTTTTGAAGAAACTCCACGAAGAGGA AATCCAGGAGCTGCAGGCTCAGATTCAGGAACA GCATGTCCAAATCGATGTGGATGTTTCCAAGCCT GACCTCACGGCTGCCCTGCGTGACGTACGTCAG CAATATGAAAGTGTGGCTGCCAAGAACCTGCAG | 41 | XRRGGARQP GRGHHAPPG EIAGGDASER GSRKHPAIFQ TGC* |

TABLE 3B-continued

| SEQ ID | identifier_position | position | modified RNA | PAP length | PAP |
|---|---|---|---|---|---|
| | | | GAGGCAGAAGAATGGTACAAATCCAAGTTTGCTGACCTCTCTGA | | |
| 3109 | NM_0033 80.2_661 | 661 | GTCCCCGCGCCAGAGACGCAGCCGCGCTCCCACCACCCACACCCACCGCGCCCTCGTTCGCCTCTTCTCCGGGAGCCAGTCCGCGCCACCGCCGCCGCCCAGGCCATCGCCACCCTCCGCAGCCATGTCCACCAGGTCCGTGTCCTCGTCCTCCTACCGCAGGATGTTCGGCGGCCCGGGCACCGCGAGCCGGCCGAGCTCCAGCCGGAGCTACGTGACTACGTCCACCCGCACCTACAGCCTGGGCAGCGCGCTGCGCCCCAGCACCAGCCGCAGCCTCTACGCCTCGTCCCCGGGCGGCGTGTATGCCACGCGCTCCTCTGCCGTGCGCCTGCGGAGCAGCGTGCCCGGGGTGCGGCTCCTGCAGGACTCGGTGGACTTCTCGCTGGCCGACGCCATCAACACCGAGTTCAAGAACACCCGCACCAACGAGAAGGTGGAGCTGCAGGAGCTGAATGACCGCTTCGCCAACTACATCGACAAGGTGCGCTTCCTGGAGCAGCAGAATAAGATCCTGCTGGCCCGAGCTCGAGCAGCTCAAGGGCCAAGGCAAGTCGCGCCTGGGGGACCTCTACGAGGAGGAGATGCGGGAGCTGCGCCGGCAGGTGGACCAGCTAACCAACGACAAAGCCCGCGTCGAGGTGGAGCGCGACAACCTGGCCNGAGGACATCATGCGCCTCCGGGAGAAATTGCAGGAGGAGATGCTTCAGAGAGAGGAAGCCGAAAACACCCTGCAATCTTTCAGACAGGATGTTGACAATGCGTCTCTGGCACGTCTTGACCTTGAACGCAAAGTGGAATCTTTGCAAGAAGAGATTGCCTTTTTGAAGAAACTCCACGAAGAGGAAATCCAGGAGCTGCAGGCTCAGATTCAGGAACAGCATGTCCAAATCGATGTGGATGTTTCCAAGCCTGACCTCACGGCTGCCCTGCGTGACGTACGTCAGCAATATGAAAGTGTGGCTGCCAAGAACCTGCAGGAGGCAGAAGAATGGTACAAATCCAAGTTTGCTGACCTCTCTGA | 31 | XGHHAPPGEIAGGDASERGSRKHPAIFQTGC* |
| 3110 | NM_0033 80.2_677 | 677 | GTCCCCGCGCCAGAGACGCAGCCGCGCTCCCACCACCCACACCCACCGCGCCCTCGTTCGCCTCTTCTCCGGGAGCCAGTCCGCGCCACCGCCGCCGCCCAGGCCATCGCCACCCTCCGCAGCCATGTCCACCAGGTCCGTGTCCTCGTCCTCCTACCGCAGGATGTTCGGCGGCCCGGGCACCGCGAGCCGGCCGAGCTCCAGCCGGAGCTACGTGACTACGTCCACCCGCACCTACAGCCTGGGCAGCGCGCTGCGCCCCAGCACCAGCCGCAGCCTCTACGCCTCGTCCCCGGGCGGCGTGTATGCCACGCGCTCCTCTGCCGTGCGCCTGCGGAGCAGCGTGCCCGGGGTGCGGCTCCTGCAGGACTCGGTGGACTTCTCGCTGGCCGACGCCATCAACACCGAGTTCAAGAACACCCGCACCAACGAGAAGGTGGAGCTGCAGGAGCTGAATGACCGCTTCGCCAACTACATCGACAAGGTGCGCTTCCTGGAGCAGCAGAATAAGATCCTGCTGGCCCGAGCTCGAGCAGCTCAAGGGCCAAGGCAAGTCGCGCCTGGGGGACCTCTACGAGGAGGAGATGCGGGAGCTGCGCCGGCAGGTGGACCAGCTAACCAACGACAAAGCCCGCGTCGAGGTGGAGCGCGACAACCTGGCCGAGGACATCATGCGCCNTCCGGGAGAAATTGCAGGAGGAGATGCTTCAGAGAGAGGAAGCCGAAAACACCCTGCAATCTTTCAGACAGGATGTTGACAATGCGTCTCTGGCACGTCTTGACCTTGAACGCAAAGTGGAATCTTTGCAAGAAGAGATTGCCTTTTTGAAGAAACTCCACGAAGAGGAAATCCAGGAGCTGCAGGCTCAGATTCAGGAACAGCATGTCCAAATCGATGTGGATGTTTCCAAGCCTGACCTCACGGCTGCCCTGCGTGACGTACGTCAGCAATATGAAAGTGTGGCTGCCAAGAACCTGCAGGAGGCAGAAGAATGGTACAAATCCAAGTTTGCTGACCTCTCTGA | 26 | XPGEIAGGDASERGSRKHPAIFQTGC* |
| 3111 | NM_0033 80.2_680 | 680 | GTCCCCGCGCCAGAGACGCAGCCGCGCTCCCACCACCCACACCCACCGCGCCCTCGTTCGCCTCTTCTCCGGGAGCCAGTCCGCGCCACCGCCGCCGCCCAGGCCATCGCCACCCTCCGCAGCCATGTCCACCAGGTCCGTGTCCTCGTCCTCCTACCGCAGGATGTTCGGCGGCCCGGGCACCGCGAGCCGGCCGAGCTCCAGCCGGAGCTACGTGACTACGTCCACCCGCACCTACAGCCTGGGCAGCGCGCTGCGCCCCAGCACCAGCCGCAGCCTCTACGCCTCGTCCCCGGGCGGCGTGTATGCCACGCGCTCCTCTGCCGTGCGCCTGCGGAGCAGCGTGCCCGGGGTGCG | 25 | XGEIAGGDASERGSRKHPAIFQTGC* |

TABLE 3B-continued

| SEQ ID | identifier_ position | position | modified RNA | PAP length | PAP |
|---|---|---|---|---|---|
| | | | GCTCCTGCAGGACTCGGTGGACTTCTCGCTGGC CGACGCCATCAACACCGAGTTCAAGAACACCCG CACCAACGAGAAGGTGGAGCTGCAGGAGCTGA ATGACCGCTTCGCCAACTACATCGACAAGGTGC GCTTCCTGGAGCAGCAGAATAAGATCCTGCTGG CCGAGCTCGAGCAGCTCAAGGGCCAAGGCAAG TCGCGCCTGGGGGACCTCTACGAGGAGGAGAT GCGGGAGCTGCGCCGGCAGGTGGACCAGCTAA CCAACGACAAAGCCCGCGTCGAGGTGGAGCGC GACAACCTGGCCGAGGACATCATGCGCCTCCN GGGAGAAATTGCAGGAGGAGATGCTTCAGAGAG AGGAAGCCGAAAACACCCTGCAATCTTTCAGAC AGGATGTTGACAATGCGTCTCTGGCACGTCTTG ACCTTGAACGCAAAGTGGAATCTTTGCAAGAAG AGATTGCCTTTTTGAAGAAACTCCACGAAGAGGA AATCCAGGAGCTGCAGGCTCAGATTCAGGAACA GCATGTCCAAATCGATGTGGATGTTTCCAAGCCT GACCTCACGGCTGCCCTGCGTGACGTACGTCAG CAATATGAAAGTGTGGCTGCCAAGAACCTGCAG GAGGCAGAAGAATGGTACAAATCCAAGTTTGCT GACCTCTCTGA | | |
| 3112 | NM_0033 80.2_683 | 683 | GTCCCCGCGCCAGAGACGCAGCCGCGCTCCCA CCACCCACACCCACCGCGCCCTCGTTCGCCTCT TCTCCGGGAGCCAGTCCGCGCCACCGCCGCCG CCCAGGCCATCGCCACCCTCCGCAGCCATGTCC ACCAGGTCCGTGTCCTCGTCCTCCTACCGCAGG ATGTTCGGCGGCCCGGGCACCGCGAGCCGGCC GAGCTCCAGCCGGAGCTACGTGACTACGTCCAC CCGCACCTACAGCCTGGGCAGCGCGCTGCGCC CCAGCACCAGCCGAGCCTCTACGCCTCGTCCC CGGGCGGCGTGTATGCCACGCGCTCCTCTGCC GTGCGCCTGCGGAGCAGCGTGCCCGGGGTGCG GCTCCTGCAGGACTCGGTGGACTTCTCGCTGGC CGACGCCATCAACACCGAGTTCAAGAACACCCG CACCAACGAGAAGGTGGAGCTGCAGGAGCTGA ATGACCGCTTCGCCAACTACATCGACAAGGTGC GCTTCCTGGAGCAGCAGAATAAGATCCTGCTGG CCGAGCTCGAGCAGCTCAAGGGCCAAGGCAAG TCGCGCCTGGGGGACCTCTACGAGGAGGAGAT GCGGGAGCTGCGCCGGCAGGTGGACCAGCTAA CCAACGACAAAGCCCGCGTCGAGGTGGAGCGC GACAACCTGGCCGAGGACATCATGCGCCTCCG GGNAGAAATTGCAGGAGGAGATGCTTCAGAGAG AGGAAGCCGAAAACACCCTGCAATCTTTCAGAC AGGATGTTGACAATGCGTCTCTGGCACGTCTTG ACCTTGAACGCAAAGTGGAATCTTTGCAAGAAG AGATTGCCTTTTTGAAGAAACTCCACGAAGAGGA AATCCAGGAGCTGCAGGCTCAGATTCAGGAACA GCATGTCCAAATCGATGTGGATGTTTCCAAGCCT GACCTCACGGCTGCCCTGCGTGACGTACGTCAG CAATATGAAAGTGTGGCTGCCAAGAACCTGCAG GAGGCAGAAGAATGGTACAAATCCAAGTTTGCT GACCTCTCTGA | 24 | XEIAGGDASE RGSRKHPAIF QTGC* |
| 3113 | NM_0040 39.2_222 | 222 | GCTCAGCATTTGGGGACGCTCTCAGCTCTCGGC GCACGGCCCAGCTTCCTTCAAAATGTCTACTGTT CACGAAATCCTGTGCAAGCTCAGCTTGGAGGGT GATCACTCTACACCCCCAAGTGCATATGGGTCT GTCAAAGCCTATACTAACTTTGATGCTGAGCGG GATGCTTTGAACATTGAAACAGCCATCAAGACCA AAGGTGTGGATGAGGTCACCATNTGTCAACATTT TGACCAACCGCAGCAATGCACAGAGACAGGATA TTGCCTTCGCCTACCAGAGAAGGACCAAAAAGG AACTTGCATCAGCACTGAAGTCAGCCTTATCTGG CCACCTGGAGACGGTGATTTTGGGCCTATTGAA GACACCTGCTCAGTATGACGCTTCTGAGCTAAA AGCTTCCATGAAGGGGCTGGGAACCGACGAGG ACTCTCTCATTGAGATCATCTGCTCCAGAACCAA CCAGGAGCTGCAGGAAATTAACAGAGTCTACAA GGAAATGTACAAGACTGATCTGGAGAAGGACAT TATTTCGGACACATCTGGTGACTTCCGCAAGCT GATGGTTGCCCTGGCAAAGGGTAGAAGAGCAGA GGATGGCTCTGTCATTGATTATGAACTGATTGAC CAAGATGCTCGGGATCTCTATGACGCTGGAGTG AAGAGGAAAGGAACTGATGTTCCCAAGTGGATC AGCATCATGACCGAGCGGAGCGTGCCCCACCT CCAGAAAGTATTTGATAGGTACAAGAGTTACAGC CCTTATGACATGTTGGAAAGCATCAGGAAAGAG | 54 | XCQHFDQPQ QCTETGYCLR LPEKDQKGTC ISTEVSLIWPP GDGDFGPIED TCSV* |

TABLE 3B-continued

| SEQ ID | identifier_ position | position | modified RNA | PAP length | PAP |
|---|---|---|---|---|---|
| | | | GTTAAAGGAGACCTGGAAAATGCTTTCCTGAAC CTGGTTCAGTGCATTCAGAACAAGCCCCTGTATT TTGCTGATCGGCTGTATGACTCCATGAAGGGCA AGGGGACGCGAGATAAGGTCCTGATCAGAATCA TGGTCTCCCGCAGTGAAGTGGACATGTTGAAAA TTAGGTCTGAATTCAAGAGAAAGTACGGCAAGT CCCTGTACTATTATATCCAGCAAGACAC | | |
| 3114 | NM_0040 39.2_233 | 233 | GCTCAGCATTTGGGGACGCTCTCAGCTCTCGGC GCACGGCCCAGCTTCCTTCAAAATGTCTACTGTT CACGAAATCCTGTGCAAGCTCAGCTTGGAGGGT GATCACTCTACACCCCCAAGTGCATATGGGTCT GTCAAAGCCTATACTAACTTTGATGCTGAGCGG GATGCTTTGAACATTGAAACAGCCATCAAGACCA AAGGTGTGGATGAGGTCACCATTGTCAACATTTN TGACCAACCGCAGCAATGCACAGAGACAGGATA TTGCCTTCGCCTACCAGAGAAGGACCAAAAAGG AACTTGCATCAGCACTGAAGTCAGCCTTATCTGG CCACCTGGAGACGGTGATTTTGGGCCTATTGAA GACACCTGCTCAGTATGACGCTTCTGAGCTAAA AGCTTCCATGAAGGGGCTGGGAACCGACGAGG ACTCTCTCATTGAGATCATCTGCTCCAGAACCAA CCAGGAGCTGCAGGAAATTAACAGAGTCTACAA GGAAATGTACAAGACTGATCTGGAGAAGGACAT TATTTCGGACACATCTGGTGACTTCCGCAAGCT GATGGTTGCCCTGGCAAAGGGTAGAAGAGCAGA GGATGGCTCTGTCATTGATTATGAACTGATTGAC CAAGATGCTCGGGATCTCTATGACGCTGGAGTG AAGAGGAAAGGAACTGATGTTCCCAAGTGGATC AGCATCATGACCGAGCGGAGCGTGCCCCACCT CCAGAAAGTATTTGATAGGTACAAGAGTTACAGC CCTTATGACATGTTGGAAAGCATCAGGAAAGAG GTTAAAGGAGACCTGGAAAATGCTTTCCTGAAC CTGGTTCAGTGCATTCAGAACAAGCCCCTGTATT TTGCTGATCGGCTGTATGACTCCATGAAGGGCA AGGGGACGCGAGATAAGGTCCTGATCAGAATCA TGGTCTCCCGCAGTGAAGTGGACATGTTGAAAA TTAGGTCTGAATTCAAGAGAAAGTACGGCAAGT CCCTGTACTATTATATCCAGCAAGACAC | 50 | XDQPQQCTET GYCLRLPEKD QKGTCISTEV SLIWPPGDGD FGPIEDTCSV* |
| 3115 | NM_0040 39.2_666 | 666 | GCTCAGCATTTGGGGACGCTCTCAGCTCTCGGC GCACGGCCCAGCTTCCTTCAAAATGTCTACTGTT CACGAAATCCTGTGCAAGCTCAGCTTGGAGGGT GATCACTCTACACCCCCAAGTGCATATGGGTCT GTCAAAGCCTATACTAACTTTGATGCTGAGCGG GATGCTTTGAACATTGAAACAGCCATCAAGACCA AAGGTGTGGATGAGGTCACCATTGTCAACATTTT GACCAACCGCAGCAATGCACAGAGACAGGATAT TGCCTTCGCCTACCAGAGAAGGACCAAAAAGGA ACTTGCATCAGCACTGAAGTCAGCCTTATCTGG CCACCTGGAGACGGTGATTTTGGGCCTATTGAA GACACCTGCTCAGTATGACGCTTCTGAGCTAAA AGCTTCCATGAAGGGGCTGGGAACCGACGAGG ACTCTCTCATTGAGATCATCTGCTCCAGAACCAA CCAGGAGCTGCAGGAAATTAACAGAGTCTACAA GGAAATGTACAAGACTGATCTGGAGAAGGACAT TATTTCGGACACATCTGGTGACTTCCGCAAGCT GATGGTTGCCCTGGCAAAGGGTAGAAGAGCAGA GGATGGCTCTGTCATTGATTATGAACTGATTGAC CAAGATGCTCGGGATCTCTATGACGCTGGAGTG AANGAGGAAAGGAACTGATGTTCCCAAGTGGAT CAGCATCATGACCGAGCGGAGCGTGCCCCACC TCCAGAAAGTATTTGATAGGTACAAGAGTTACAG CCCTTATGACATGTTGGAAAGCATCAGGAAAGA GGTTAAAGGAGACCTGGAAAATGCTTTCCTGAA CCTGGTTCAGTGCATTCAGAACAAGCCCCTGTA TTTTGCTGATCGGCTGTATGACTCCATGAAGGG CAAGGGGACGCGAGATAAGGTCCTGATCAGAAT CATGGTCTCCCGCAGTGAAGTGGACATGTTGAA AATTAGGTCTGAATTCAAGAGAAAGTACGGCAA GTCCCTGTACTATTATATCCAGCAAGACAC | 5 | XEERN* |
| 3116 | NM_0040 39.2_765 | 765 | GCTCAGCATTTGGGGACGCTCTCAGCTCTCGGC GCACGGCCCAGCTTCCTTCAAAATGTCTACTGTT CACGAAATCCTGTGCAAGCTCAGCTTGGAGGGT GATCACTCTACACCCCCAAGTGCATATGGGTCT GTCAAAGCCTATACTAACTTTGATGCTGAGCGG GATGCTTTGAACATTGAAACAGCCATCAAGACCA AAGGTGTGGATGAGGTCACCATTGTCAACATTTT GACCAACCGCAGCAATGCACAGAGACAGGATAT | 1 | L* |

TABLE 3B-continued

| SEQ ID | identifier_position | position | modified RNA | PAP length | PAP |
|---|---|---|---|---|---|
| | | | TGCCTTCGCCTACCAGAGAAGGACCAAAAAGGA ACTTGCATCAGCACTGAAGTCAGCCTTATCTGG CCACCTGGAGACGGTGATTTTGGGCCTATTGAA GACACCTGCTCAGTATGACGCTTCTGAGCTAAA AGCTTCCATGAAGGGGCTGGGAACCGACGAGG ACTCTCTCATTGAGATCATCTGCTCCAGAACCAA CCAGGAGCTGCAGGAAATTAACAGAGTCTACAA GGAAATGTACAAGACTGATCTGGAGAAGGACAT TATTTCGGACACATCTGGTGACTTCCGCAAGCT GATGGTTGCCCTGGCAAAGGGTAGAAGAGCAGA GGATGGCTCTGTCATTGATTATGAACTGATTGAC CAAGATGCTCGGGATCTCTATGACGCTGGAGTG AAGAGGAAAGGAACTGATGTTCCCAAGTGGATC AGCATCATGACCGAGCGGAGCGTGCCCCACCT CCAGAAAGTATTTGATAGGTACAAGAGTTACAGC CCNTTATGACATGTTGGAAAGCATCAGGAAAGA GGTTAAAGGAGACCTGGAAAATGCTTTCCTGAA CCTGGTTCAGTGCATTCAGAACAAGCCCCTGTA TTTTGCTGATCGGCTGTATGACTCCATGAAGGG CAAGGGGACGCGAGATAAGGTCCTGATCAGAAT CATGGTCTCCCGCAGTGAAGTGGACATGTTGAA AATTAGGTCTGAATTCAAGAGAAAGTACGGCAA GTCCCTGTACTATTATATCCAGCAAGACAC | | |
| 3117 | NM_0040 39.2_779 | 779 | GCTCAGCATTTGGGGACGCTCTCAGCTCTCGGC GCACGGCCCAGCTTCCTTCAAAATGTCTACTGTT CACGAAATCCTGTGCAAGCTCAGCTTGGAGGGT GATCACTCTACACCCCAAGTGCATATGGGTCT GTCAAAGCCTATACTAACTTTGATGCTGAGCGG GATGCTTTGAACATTGAAACAGCCATCAAGACCA AAGGTGTGGATGAGGTCACCATTGTCAACATTTT GACCAACCGCAGCAATGCACAGAGACAGGATAT TGCCTTCGCCTACCAGAGAAGGACCAAAAAGGA ACTTGCATCAGCACTGAAGTCAGCCTTATCTGG CCACCTGGAGACGGTGATTTTGGGCCTATTGAA GACACCTGCTCAGTATGACGCTTCTGAGCTAAA AGCTTCCATGAAGGGGCTGGGAACCGACGAGG ACTCTCTCATTGAGATCATCTGCTCCAGAACCAA CCAGGAGCTGCAGGAAATTAACAGAGTCTACAA GGAAATGTACAAGACTGATCTGGAGAAGGACAT TATTTCGGACACATCTGGTGACTTCCGCAAGCT GATGGTTGCCCTGGCAAAGGGTAGAAGAGCAGA GGATGGCTCTGTCATTGATTATGAACTGATTGAC CAAGATGCTCGGGATCTCTATGACGCTGGAGTG AAGAGGAAAGGAACTGATGTTCCCAAGTGGATC AGCATCATGACCGAGCGGAGCGTGCCCCACCT CCAGAAAGTATTTGATAGGTACAAGAGTTACAGC CCTTATGACATGTTGGNAAAGCATCAGGAAAGA GGTTAAAGGAGACCTGGAAAATGCTTTCCTGAA CCTGGTTCAGTGCATTCAGAACAAGCCCCTGTA TTTTGCTGATCGGCTGTATGACTCCATGAAGGG CAAGGGGACGCGAGATAAGGTCCTGATCAGAAT CATGGTCTCCCGCAGTGAAGTGGACATGTTGAA AATTAGGTCTGAATTCAAGAGAAAGTACGGCAA GTCCCTGTACTATTATATCCAGCAAGACAC | 7 | XKHQERG* |
| 3118 | NM_0043 55.2_645 | 645 | CAGGGTCCCAGATGCACAGGAGGAGAAGCAGG AGCTGTCGGGAAGATCAGAAGCCAGTCATGGAT GACCAGCGCGACCTTATCTCAACAATGAGCAA CTGCCCATGCTGGGCCGGCGCCCTGGGGCCCC GGAGAGCAAGTGCAGCCGCGGAGCCCTGTACA CAGGCTTTTCCATCCTGGTGACTCTGCTCCTCG CTGGCCAGGCCACCACCGCCTACTTCCTGTACC AGCAGCAGGGCCGGCTGGACAAACTGACAGTC ACCTCCCAGAACCTGCAGCTGGAGAACCTGCGC ATGAAGCTTCCCAAGCCTCCCAAGCCTGTGAGC AAGATGCGCATGGCCACCCCGCTGCTGATGCAG GCGCTGCCCATGGGAGCCCTGCCCCAGGGGCC CATGCAGAATGCCACCAAGTATGGCAACATGAC AGAGGACCATGTGATGCACCTGCTCCAGAATGC TGACCCCCTGAAGGTGTACCCGCCACTGAAGGG GAGCTTCCCGGAGAACCTGAGACACCTTAAGAA CACCATGGAGACCATAGACTGGAAGGTCTTTGA GAGCTGGATGCACCATTGGCTCCTGTTTGAAAT GAGCAGGCACTCCTTGGAGCAAAAGCCCACTGA CGCTCCACCGAAAGAGTCACTGGNAACTGGAGG ACCCGTCTTCTGGGCTGGGTGTGACCAAGCAGG ATCTGGGCCCAGTCCCCATGTGAGAGCAGCAGA GGCGGTCTTCAACATCCTGCCAGCCCCACACAG | 80 | XTGGPVFWA GCDQAGSGP SPHVRAAEAV FNILPAPHSYS FLAPFSPQPL PHLPPCTSSH ETLVPGSFVT LGQDKPSRNS R* |

TABLE 3B-continued

| SEQ ID | identifier_position | position | modified RNA | PAP length | PAP |
|---|---|---|---|---|---|
| | | | CTACAGCTTTCTTGCTCCCTTCAGCCCCCAGCC CCTCCCCCATCTCCCACCCTGTACCTCATCCCAT GAGACCCTGGTGCCTGGCTCTTTCGTCACCCTT GGACAAGACAAACCAAGTCGGAACAGCAGATAA CAATGCAGCAAGGCCCTGCTGCCCAATCTCCAT CTGTCAACAGGGGCGTGAGGTCCCAGGAAGTG GCCAAAAGCTAGACAGATCCCCGTTCCTGACAT CACAGCAGCCTCCAACACAAGGCTCCAAGACCT AGGCTC | | |
| 3119 | NM_0047 66.1_103 | 103 | GGTGGGTTTATCTCAAGGCCTGAGTAGCCGGTA ACAAACGAGGGTTCCCGGGATTGGACCGACGC ACCATGCCTCTGCGACTTGATATCAAAAGAAAGC TAACNTGCTAGATCTGATCGAGTTAAGAGTGTG GATCTGCATCCTACAGAGCCATGGATGTTGGCA AGTCTTTACAATGGCAGTGTGTGTGTTTGGAATC ATGAAACACAGACACTGGTGAAGACATTTGAAGT ATGTGATCTTCCTGTTCGAGCTGCAAAGTTTGTT GCAAGGAAGAATTGGGTTGTGACAGGAGCGGAT GACATGCAGATTAGAGTGTTCAATTACAATACTC TGGAGAGAGTTCATATGTTTGAAGCACACTCAGA CTACATTCGCTGTATTGCTGTTCATCCAACCCAG CCTTTCATTCTAACTAGCAGTGATGACATGCTTA TTAAGCTCTGGGACTGGGATAAAAAATGGTCTTG CTCACAAGTGTTTGAAGGACACACCCATTATGTT ATGCAGATTGTGATCAACCCCAAAGATAACAATC AGTTTGCCAGTGCCTCTTTGGACAGGACTATCAA GGTGTGGCAGTTGGGCTCTTCGTCACCAAACTT CACTTTGGAAGGACATGAGAAAGGCGTGAATTG CATTGATTACTACAGTGGTGGGGACAAGCCATA CCTCATTTCAGGTGCAGATGACCGTCTTGTTAAA ATATGGGATTATCAGAATAAAACATGTGTGCAGA CACTGGAAGGACATGCCCAAAATGTGTCTTGTG CCAGCTTTCATCCTGAGTTGCCAATCATTATCAC AGGTTCAGAAGATGGAACAGTACGTATTTGGCA TTCAAGCACCTACCGGCTTGAGAGCACACTGAA TTATGGAATGGAGAGGGTATGGTGCGTGGCCAG TCTAAGAGGGTCAAACAATGTCGCTTTGGGCTAT GATGAAGGGAGCATCATTGTTAAGCTTGGTCGG GAGGAACCTGCCATGTCCATGGATGCCAATGGA AAGATAATTTGGGCCAAGC | 1 | C* |
| 3120 | NM_0049 05.2_423 | 423 | GAACCAACCGGTTGCTTGCTGTCCCAGCGGCGC CCCCTCATCACCGTCGCCATGCCCGGAGGTCTG CTTCTCGGGGACGTGGCTCCAACTTTGAGGCG AATACCACCGTCGGCCGCATCCGTTTCCACGAC TTTCTGGGAGACTCATGGGGCATTCTCTTCTCCC ACCCTCGGGACTTTACCCCAGTGTGCACCACAG AGCTTGGCAGAGCTGCAAAGCTGGCACCAGAAT TTGCCAAGAGGAATGTTAAGTTGATTGCCCTTTC AATAGACAGTGTTGAGGACCATCTTGCCTGGAG CAAGGATATCAATGCTTACAATTGTGAAGAGCCC ACAGAAAAGTTACCTTTTCCCATCATCGATGATA GGAATCGGGAGCTTGCCATCCTGTTGGGCATGC TGGATCCAGCAGAGAAGGATGAANAAGGGCATG CCTGTGACAGCTCGTGTGGTGTTTGTTTTGGTC CTGATAAGAAGCTGAAGCTGTCTATCCTCTACCC AGCTACCACTGGCAGGAACTTTGATGAGATTCT CAGGGTAGTCATCTCTCTCCAGCTGACAGCAGA AAAAAGGGGTTGCCACCCCAGTTGATTGGAAGGA TGGGGATAGTGTGATGGTCCTTCCAACCATCCC TGAAGAAGAAGCCAAAAAACTTTTCCCGAAAGG AGTCTTCACCAAAGAGCTCCCATCTGGCAAGAA ATACCTCCGCTACACACCCCAGCCTTAAGTCTCT TGGAGAAGCTGGTGCTGTGAGCCAGAGGATGTC AGCTGCCAATTGTGTTTTCCTGCAGCAATTCCAT AAACACATCCTGGTGTCATCACAGCCAAGGTTTT TAGGTTGCTATACCAATGGCTTATTAAATGAAAA TGGCACTAAAAGTTTCTTGAGATTCTTTATACTCT CTGCCTTCAGCAATCAATTCCATTCATACATCAG CACTCTGCTGGTTCTGTTTGAAATATGTTCTGTA TTTAAAACTCAAATCTTGTTGGATCTCTGCAGGG CTTGTGACCAATGAAGTCA | 15 | XGHACDSSC GVCFWS* |
| 3121 | NM_0050 51.1_727 | 727 | CTGCAATGGCGGCTCTAGACTCCCTGTCGCTCT TCACTAGCCTCGGCCTGAGCGAGCAGAAGGCC CGCGAGACGCTCAAGAACTCGGCTCTGAGCGC GCAGCTGCGCGAGGCCGCTACTCAGGCTCAGC AGACCCTGGGTTCCACCATTGACAAAGCTACCG GGATCCTGTTATATGGCTTGGCCTCCCGACTCA | 61 | RLCGHSTHHE STKAAPGDY WWAGTYPVP ARTQWNPAY WTCQSHQFQ LWLCQGQQW |

TABLE 3B-continued

| SEQ ID | identifier_position | position | modified RNA | PAP length | PAP |
|---|---|---|---|---|---|
| | | | GGGATACCCGGCGTCTCTCCTTCCTTGTAAGCT ACATAGCCAGTAAGAAGATCCACACTGAGCCCC AGCTAAGCGCTGCCCTTGAGTATGTGCGGAGTC ACCCCTTGGACCCCATCGACACTGTGGACTTCG AGCGGGAATGTGGCGTGGGTGTCATTGTGACCC CAGAGCAGATTGAGGAGGCTGTGGAGGCTGCT ATTAACAGGCACCGGCCCCAGCTCCTGGTGGAA CGTTACCATTTCAACATGGGGCTGCTGATGGGA GAGGCTCGGGCTGTGCTGAAGTGGGCAGATGG CAAAATGATCAAGAATGAAGTGGACATGCAGGT CCTCCACCTTCTGGGCCCCAAGTTGGAGGCTGA TCTGGAGAAGAAGTTCAAGGTGGCAAAAGCTCG GCTAGAAGAAACAGACCGGAGGACGGCAAAGG ATGTGGTGGAGAATGGCGAGACTGCTGACCAGA CCCTGTCTCTGATGGAGCAGCTCCGGGGGGAG GCCCTTAAGTTCCACAAGCCTGGTGAGAACTAC AAGACCCCNAGGCTATGTGGTCACTCCACACAC CATGAATCTACTAAAGCAGCACCTGGAGATTACT GGTGGGCAGGTACGTACCCGGTTCCCGCCAGA ACCCAATGGAATCCTGCATATTGGACATGCCAAA GCCATCAATTTCAACTTTGGCTATGCCAAGGCCA ACAATGGCATCTGTTTTCTGCGTTTTGATGACAC CAACCCTGAGAAGGAGGAAGCAAAGTTCTTCAC GGCCATCTGTGACATGGTAGCCTGGCTAGGCTA CACACCTTACAAAGTCACATATGCGTCTGACTAT TTTG | | HLFSAF* |
| 3122 | NM_0052 16.4_867 | 867 | AATCCACCTCCCACCAGGGCACTTCCGGCGGC GCTCTCCGCGCCTTATCGCCAAAGCTGCGGCTC TGGACGCCCAGCCGCGGCGTATCCCGATCACTT CCGGGTAGTGCTCCACGGGCACGAGCCGCGAT TGGGCTACCGTAGATGGGGTACTTCCGGTGTGC AGGTGCTGGGTCCTTCGGCAGGAGGAGGAAGA TGGAGCCCAGCACCGCGGCCCGGGCTTGGGCC CTCTTTTGGTTGCTGCTGCCCTTGCTTGGCGCG GTTTGCGCCAGCGGACCCCGCACCTTAGTGCTG CTGGACAACCTCAACGTGCGGGAGACTCATTCG CTTTTCTTCCGGAGCCTGAAGGACCGGGGCTTT GAGCTCACATTCAAGACCGCTGATGACCCCAGC CTGTCTCTCATAAAGTATGGGGAATTCCTCTATG ACAATCTCATCATTTTCTCCCCTTCGGTAGAAGA TTTTGGAGGCAACATCAACGTGGAGACCATCAG TGCCTTTATTGACGGCGGAGGCAGTGTGCTGGT AGCTGCCAGCTCCGACATTGGTGACCCTCTTCG AGAGCTGGGCAGTGAGTGCGGGATTGAGTTTGA CGAGGAGAAAACGGCTGTCATTGACCATCACAA CTATGACATCTCAGACCTTGGCCAGCATACGCT CATCGTGGCTGACACTGAGAACCTGCTGAAGGC CCCAACCATCGTTGGGAAATCATCTCTAAATCCC ATCCTCTTTCGAGGTGTTGGGATGGTGGCCGAT CCTGATAACCCTTTGGTGCTGGACATCCTGACG GGCTCTTCCACCTCTTACTCCTTCTTCCCGGACA AGCCTATCACCCAGTATCCACATGCGGTGGGGA AGAACACCCNTCCTCATTGCTGGGCTCCAGGCC AGGAACAATGCCCGCGTCATCTTCAGCGGCTCC CTCGACTTCTTCAGCGACTCCTTCTTCAACTCAG CAGTGCAGAAGGCGGCGCCCGGCTCCCAGAGG TATTCCCAGACAGGCAACTATGAACTAGCTGTG G | 48 | XPHCWAPGQ EQCPRHLQRL PRLLQRLLLQL SSAEGGARLP EVFPDRQL* |
| 3123 | NM_0053 48.3_596 | 596 | GCATGCGTAGGCGCGCGGCCGCGGCGGCGGC TGGGGAGGGTTCTTCCGGAAGGTTCGGGAGGC TTCTGGAAAAAGCGCCGCGCGCTGGGCGGGCC CGTCGCTATATAAGGCAGGCGCGGGGGTGGCG CGTCAGTTGCTTCAGCGTCCCGGTGTGGCTGTG CCGTTGGTCCTGTGCGGTCACTTAGCCAAGATG CCTGAGGAAACCCAGACCCAAGACCAACCGATG GAGGAGGAGGAGGTTGAGACGTTCGCCTTTCAC- GCAGAAATTGCCCAGTTGATGTCATTGATCATCA ATACTTTCTACTCGAACAAAGAGATCTTTCTGAG AGAGCTCATTTCAAATTCATCAGATGCATTGGAC AAAATCCGGTATGAAAGCTTGACAGATCCCAGT+ AATTAGACTCTGGGAAAGAGCTGCATATTAACCT TATACCGAACAAACAAGATCGAACTCTCACTATT GTGGATACTGGAATTGGAATGACCAAGGCTGAC TTGATCAATAACCTTGGTACTATCGCCAAGTCTG GGACCAAAGCGTTCATGGAAGCTTTGCAGGCTG GTGCAGATATCTCTATGATTGGCCAGTTCGGTG NTTGGTTTTTATTCTGCTTATTGGTTGCTGAGA/3 | 10 | XWFLFCLFGC* |

TABLE 3B-continued

| SEQ ID | identifier_position | position | modified RNA | PAP length | PAP |
|---|---|---|---|---|---|
| | | | AGTAACTGTGATCACCAAACATAACGATGATGAG CAGTACGCTTGGGAGTCCTCAGCAGGGGGATC/3 TTCACAGTGAGGACAGACACAGGTGAACCTATG GGTCGTGGAACAAAAGTTATCCTACACCTGAAA GAAGACCAAACTGAGTACTTGGAGGAACGAAGA ATAAAGGAGATTGTGAAGAAACATTCTCAGTTTA TTGGATATCCCATTACTCTTTTTGTGGAGAAGGA ACGTGATAAAGAAGTAAGCGATGATGAGGCTGA AGAAAAGGAAGACAAAGAAGAAGAAAAAGAAAA AGAAGAGAAAGAGTCGGAAGACAAACCTGAAAT TGAAGATGTTGGTTCTGATGAGGAAGAAGAAAA GAAGGATGGTGACAAGAAGAAGAAGAA | | |
| 3124 | NM_0055 07.2_577 | 577 | GGCCGGCGGGAAGACTCCGTTACCCAGCGAGC GAGGCGGCGGCGCAGGGCCAGCGGACTCCATT TCCCGTCGGCTCGCGGTGGGAGCGCCGGAAGC CCGCCCCACCCCTCATTGTGCGGCTCCTACTAA ACGGAAGGGGCCGGGAGAGGCCGCGTTCAGTC GGGTCCCGGCAGCGGCTGCAGCGCTCTCGTCT TCTGCGGCTCTCGGTGCCCTCTCCTTTTCGTTTC CGGAAACATGGCCTCCGGTGTGGCTGTCTCTGA TGGTGTCATCAAGGTGTTCAACGACATGAAGGT GCGTAAGTCTTCAACGCCAGAGGAGGTGAAGAA GCGCAAGAAGGCGGTGCTCTTCTGCCTGAGTGA GGACAAGAAGAACATCATCCTGGAGGAGGGCAA GGAGATCCTGGTGGGCGATGTGGGCCAGACTG TCGACGACCCCTACGCCACCTTTGTCAAGATGC TGCCAGATAAGGACTGCCGCTATGCCCTCTATG ATGCAACCTATGAGACCAAGGAGAGCAAGAAGG AGGATCTGGTGTTTATCTTCTGGGCCCCCGAGT CTGCGCCCCTTAAGAGCAAAANTGATTTATGCCA GCTCCAAGGACGCCATCAAGAAGAAGCTGACAG GGATCAAGCATGAATTGCAAGCAAACTGCTACG AGGAGGTCAAGGACCGCTGCACCCTGGCAGAG AAGCTGGGGGGCAGTGCCGTCATCTCCCTGGA GGGCAAGCCTTTGTGAGCCCCTTCTGGCCCCCT GCCTGGAGCATCTGGCAGCCCCACACCTGCCCT TGGGGGTTGCAGGCTGCCCCCTTCCTGCCAGA CCGGAGGGGCTGGGGGGATCCCAGCAGGGGG AGGGCAATCCCTTCACCCCAGTTGCCAAACAGA CCCCCCACCCCCTGGATTTTCCTTCTCCCTCCAT CCCTTGACGGTTCTGGCCTTCCCAAACTGCTTTT GATCTTTTGATTCCTCTTGGGCTGAAGCAGACCA AGTTCCCCCCAGGCACCCCAGTTGTGGGGGAG CCTGTATT | 19 | XDLCQLQGRH QEEADRDQA* |
| 3125 | NM_0055 66.1_778 | 778 | TGCTGCAGCCGCTGCCGCCGATTCCGGATCTCA TTGCCACGCGCCCCCGACGACCGCCCGACGTG CATTCCCGATTCCTTTTGGTTCCAAGTCCAATAT GGCAACTCTAAAGGATCAGCTGATTTATAATCTT CTAAAGGAAGAACAGACCCCCCAGAATAAGATT ACAGTTGTTGGGGTTGGTGCTGTTGGCATGGCC TGTGCCATCAGTATCTTAATGAAGGACTTGGCAG ATGAACTTGCTCTTGTTGATGTCATCGAAGACAA ATTGAAGGGAGAGATGATGGATCTCCAACATGG CAGCCTTTTCCTTAGAACACCAAAGATTGTCTCT GGCAAAGACTATAATGTAACTGCAAACTCCAAGC TGGTCATTATCACGGCTGGGGCACGTCAGCAAG AGGGAGAAAGCCGTCTTAATTTGGTCCAGCGTA ACGTGAACATATTTAAATTCATCATTCCTAATGTT GTAAAATACAGCCCGAACTGCAAGTTGCTTATTG TTTCAAATCCAGTGGATATCTTGACCTACGTGGC TTGGAAGATAAGTGGTTTTCCCAAAAACCGTGTT ATTGGAAGTGGTTGCAATCTGGATTCAGCCCGA TTCCGTTACCTGATGGGGGAAAGGCTGGGAGTT CACCCATTAAGCTGTCATGGGTGGGTCCTTGGG GAACATGGAGATTCCAGTGTGCCTGTATGGAGT GGAATGAATGTTGCTGGTGTCTCTCTGAAGACT CTGCACCCAGATTTAGGGACTGATAAAGATAAG GAACAGTGGNAAAGAGGTTCACAAGCAGGTGGT TGAGAGTGCTTATGAGGTGATCAAACTCAAAGG CTACACATCCTGGGCTATTGGACTCTCTGTAGCA GATTTGGCAGAGAGTATAATGAAGAATCTTAGGC GGGTGCACCCAGTTTCCACCATGATTAAGGGTC TTTACGGAATAAAGGATGATGTCTTCCTTAGTGT TCCTTGCATTTTGGGACAGAATGGAATCTCAGAC CTTGTGAAGGTGACTCTGAC | 8 | XRGSQAGG* |

TABLE 3B-continued

| SEQ ID | identifier_position | position | modified RNA | PAP length | PAP |
|---|---|---|---|---|---|
| 3126 | NM_0059 98.3_291 | 291 | GGCCGTTCTTGCGTAGGGGCGGGACTAAGGC TGTCAATTGGTCTGTTTTTGTGCCGATCAATGAG ATGGGTGCGGTGATTGGCGACTACCTTGAGAGT AGCGGGTTGAGGTGTAAGCCCTGAGGAGGCAG CGTTTTCTGGGCTTCTGTCTGGTTCTCTCTCC AGAAGGTTCTGCCGGTTCCCCCAGCTCTGGGTA CCCGGCTCTGCATCGCGTCGCCATGATGGGCC ATCGTCCAGTGCTCGTGCTCAGCCAGAACACAA AGCGTGAATCCGGAAGAAAAGTTCAATCNTGGA AACATCAATGCTGCCAAGACTATTGCAGATATCA TCCGAACATGTTTGGGACCCAAGTCCATGATGA AGATGCTTTTGGACCCAATGGGAGGCATTGTGA TGACCAATGATGGCAATGCCATTCTTCGAGAGAT TCAAGTCCAGCATCCAGCGGCCAAGTCCATGAT CGAAATTAGCCGGACCCAGGATGAAGAGGTTGG AGATGGGACCACATCAGTAATTATTCTTGCAGG GGAAATGCTGTCTGTAGCTGAGCACTTCCTGGA GCAGCAGATGCACCCAACAGTGGTGATCAGTGC TTACCGCAAGGCATTGGATGATATGATCAGCAC CCTAAAGAAAATAAGTATCCCAGTCGACATCAGT GACAGTGATATGATGCTGAACATCATCAACAGCT CTATTACTACCAAAGCCATCAGTCGGTGGTCATC TTTGGCTTGCAACATTGCCCTGGATGCTGTCAA GATGGTACAGTTTGAGGAGAATGGTCGGAAAGA GATTGACATAAAAAAATATGCAAGAGTGGAAAAG ATACCTGGAGGCATCATTGAAGACTCCTGTGTCT TGCGTGGAGTCATGATTAACAAGGATGTGACCC ATCCACGTATGCGGCGCTATATCAAGAACCCTC GCATTGTGCTGCTGGATTCTTCTCTGGAATACAA GAAAGGAGAAAGCCAGACTGACATTGAGATTAC ACGAGAGGAGGACTTCACCCGAATTCT | 37 | WKHQCCQDY CRYHPNMFG TQVHDEDAFG PNGRHCDDQ* |
| 3127 | NM_0060 13.2_185 | 185 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTNTGTGGCCACAT GGTGTCAGATGAATATGAGCAGCTGTCCTCTGA AGCCCTGGAGGCTGCCCGAATTTGTGCCAATAA GTACATGGTAAAAAGTTGTGGCAAAGATGGCTT CCATATCCGGGTGCGGCTCCACCCCTTCCACGT CATCCGCATCAACAAGATGTTGTCCTGTGCTGG GGCTGACAGGCTCCAAACAGGCATGCGAGGTG CCTTTGGAAAGCCCCAGGGCACTGTGGCCAGG GTTCACATTGGCCAAGTTATCATGTCCATCCGCA CCAAGCTGCAGAACAAGGAGCATGTGATTGAGG CCCTGCGCAGGGCCAAGTTCAAGTTTCCTGGCC GCCAGAAGATCCACATCTCAAAGAAGTGGGGCT TCACCAAGTTCAATGCTGATGAATTTGAAGACAT GGTGGCTGAAAAGCGGCTCATCCCAGATGGCTG TGGGGTCAAGTACATCCCCAGTCGTGGCCCTCT GGACAAGTGGCGGGCCCTGCACTCATGAGGGC TTCCAATGTGCTGCCCCCCTCTTAATACTCACCA ATAAAATTCTACTTCCTGTCCACCTATGTCTTTGTA TCTACATTCTTGACGGGGAAGGAACTTCCTCTG GGAACCTTTGGGTCATTGCCCTTTCACTTCAGAA ACAGGTTGACAACTCAGCCCTGCTCATGAGGCA GCAAACCCTGCAAAGGGCTGGGACTGGTGGCC TTATGTCAGTTGTCTACTCTGGAGCTTGACTTGG ACCTCCCCAGGTCCTAGGCAGTAGGTTGAAAAA CACTGAAGTGCTTTTCATGAAGCACAGCTGCAG CAAAGCCTTGCAATCCCAGGCTGGGGTCAGCC | 7 | XWPHGVR* |
| 3128 | NM_0060 13.2_397 | 397 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TNTGGAAAGCCCCAGGGCACTGTGGCCAGGGT TCACATTGGCCAAGTTATCATGTCCATCCGCACC AAGCTGCAGAACAAGGAGCATGTGATTGAGGCC | 31 | XVVKAPGHCG QGSHWPSYH VHPHQAAEQ GACD* |

TABLE 3B-continued

| SEQ ID | identifier_position | position | modified RNA | PAP length | PAP |
|---|---|---|---|---|---|
| | | | CTGCGCAGGGCCAAGTTCAAGTTTCCTGGCCGC<br>CAGAAGATCCACATCTCAAAGAAGTGGGGCTTC<br>ACCAAGTTCAATGCTGATGAATTTGAAGACATGG<br>TGGCTGAAAAGCGGCTCATCCCAGATGGCTGTG<br>GGGTCAAGTACATCCCCAGTCGTGGCCCTCTGG<br>ACAAGTGGCGGGCCCTGCACTCATGAGGGCTTC<br>CAATGTGCTGCCCCCCTCTTAATACTCACCAATA<br>AATTCTACTTCCTGTCCACCTATGTCTTTGTATCT<br>ACATTCTTGACGGGGAAGGAACTTCCTCTGGGA<br>ACCTTTGGGTCATTGCCCTTTCACTTCAGAAACA<br>GGTTGACAACTCAGCCCTGCTCATGAGGCAGCA<br>AACCCTGCAAAGGGCTGGGACTGGTGGCCTTAT<br>GTCAGTTGTCTACTCTGGAGCTTGACTTGGACCT<br>CCCCAGGTCCTAGGCAGTAGGTTGAAAAACACT<br>GAAGTGCTTTTCATGAAGCACAGCTGCAGCAAA<br>GCCTTGCAATCCCAGGCTGGGGTCAGCC | | |
| 3129 | NM_0060<br>13.2_488 | 488 | CTCTTTCCCTTCGGTGTGCCACTGAAGATCCTG<br>GTGTCGCCATGGGCCGCCGCCCCGCCCGTTGT<br>TACCGGTATTGTAAGAACAAGCCGTACCCAAAG<br>TCTCGCTTCTGCCGAGGTGTCCCTGATGCCAAG<br>ATTCGCATTTTTGACCTGGGGCGGAAAAAGGCA<br>AAAGTGGATGAGTTTCCGCTTTGTGGCCACATG<br>GTGTCAGATGAATATGAGCAGCTGTCCTCTGAA<br>GCCCTGGAGGCTGCCCGAATTTGTGCCAATAAG<br>TACATGGTAAAAAGTTGTGGCAAAGATGGCTTCC<br>ATATCCGGGTGCGGCTCCACCCCTTCCACGTCA<br>TCCGCATCAACAAGATGTTGTCCTGTGCTGGGG<br>CTGACAGGCTCCAAACAGGCATGCGAGGTGCCT<br>TTGGAAAGCCCCAGGGCACTGTGGCCAGGGTT<br>CACATTGGCCAAGTTATCATGTCCATCCGCACCA<br>AGCTGCAGAACAAGGAGCATGTGATTNGAGGCC<br>CTGCGCAGGGCCAAGTTCAAGTTTCCTGGCCGC<br>CAGAAGATCCACATCTCAAAGAAGTGGGGCTTC<br>ACCAAGTTCAATGCTGATGAATTTGAAGACATGG<br>TGGCTGAAAAGCGGCTCATCCCAGATGGCTGTG<br>GGGTCAAGTACATCCCCAGTCGTGGCCCTCTGG<br>ACAAGTGGCGGGCCCTGCACTCATGAGGGCTTC<br>CAATGTGCTGCCCCCCTCTTAATACTCACCAATA<br>AATTCTACTTCCTGTCCACCTATGTCTTTGTATCT<br>ACATTCTTGACGGGGAAGGAACTTCCTCTGGGA<br>ACCTTTGGGTCATTGCCCTTTCACTTCAGAAACA<br>GGTTGACAACTCAGCCCTGCTCATGAGGCAGCA<br>AACCCTGCAAAGGGCTGGGACTGGTGGCCTTAT<br>GTCAGTTGTCTACTCTGGAGCTTGACTTGGACCT<br>CCCCAGGTCCTAGGCAGTAGGTTGAAAAACACT<br>GAAGTGCTTTTCATGAAGCACAGCTGCAGCAAA<br>GCCTTGCAATCCCAGGCTGGGGTCAGCC | 29 | XGPAQGQVQ<br>VSWPPEDPHL<br>KEVGLHQVQC* |
| 3130 | NM_0060<br>13.2_508 | 508 | CTCTTTCCCTTCGGTGTGCCACTGAAGATCCTG<br>GTGTCGCCATGGGCCGCCGCCCCGCCCGTTGT<br>TACCGGTATTGTAAGAACAAGCCGTACCCAAAG<br>TCTCGCTTCTGCCGAGGTGTCCCTGATGCCAAG<br>ATTCGCATTTTTGACCTGGGGCGGAAAAAGGCA<br>AAAGTGGATGAGTTTCCGCTTTGTGGCCACATG<br>GTGTCAGATGAATATGAGCAGCTGTCCTCTGAA<br>GCCCTGGAGGCTGCCCGAATTTGTGCCAATAAG<br>TACATGGTAAAAAGTTGTGGCAAAGATGGCTTCC<br>ATATCCGGGTGCGGCTCCACCCCTTCCACGTCA<br>TCCGCATCAACAAGATGTTGTCCTGTGCTGGGG<br>CTGACAGGCTCCAAACAGGCATGCGAGGTGCCT<br>TTGGAAAGCCCCAGGGCACTGTGGCCAGGGTT<br>CACATTGGCCAAGTTATCATGTCCATCCGCACCA<br>AGCTGCAGAACAAGGAGCATGTGATTGAGGCCC<br>TGCGCAGGGCCAANGTTCAAGTTTCCTGGCCGC<br>CAGAAGATCCACATCTCAAAGAAGTGGGGCTTC<br>ACCAAGTTCAATGCTGATGAATTTGAAGACATGG<br>TGGCTGAAAAGCGGCTCATCCCAGATGGCTGTG<br>GGGTCAAGTACATCCCCAGTCGTGGCCCTCTGG<br>ACAAGTGGCGGGCCCTGCACTCATGAGGGCTTC<br>CAATGTGCTGCCCCCCTCTTAATACTCACCAATA<br>AATTCTACTTCCTGTCCACCTATGTCTTTGTATCT<br>ACATTCTTGACGGGGAAGGAACTTCCTCTGGGA<br>ACCTTTGGGTCATTGCCCTTTCACTTCAGAAACA<br>GGTTGACAACTCAGCCCTGCTCATGAGGCAGCA<br>AACCCTGCAAAGGGCTGGGACTGGTGGCCTTAT<br>GTCAGTTGTCTACTCTGGAGCTTGACTTGGACCT<br>CCCCAGGTCCTAGGCAGTAGGTTGAAAAACACT | 23 | XVQVSWPPE<br>DPHLKEVGLH<br>QVQC* |

TABLE 3B-continued

| SEQ ID | identifier_position | position | modified RNA | PAP length | PAP |
|---|---|---|---|---|---|
| 3131 | NM_0060 13.2_571 | 571 | GAAGTGCTTTTCATGAAGCACAGCTGCAGCAAA GCCTTGCAATCCCAGGCTGGGGTCAGCC CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAANTGCTGATGAATTTGAAGACATGG TGGCTGAAAAGCGGCTCATCCCAGATGGCTGTG GGGTCAAGTACATCCCCAGTCGTGGCCCTCTGG ACAAGTGGCGGGCCCTGCACTCATGAGGGCTTC CAATGTGCTGCCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT | 2 | XC* |
| 3132 | NM_0060 13.2_584 | 584 | GAAGTGCTTTTCATGAAGCACAGCTGCAGCAAA GCCTTGCAATCCCAGGCTGGGGTCAGCC CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTNGAAGACATGG TGGCTGAAAAGCGGCTCATCCCAGATGGCTGTG GGGTCAAGTACATCCCCAGTCGTGGCCCTCTGG ACAAGTGGCGGGCCCTGCACTCATGAGGGCTTC CAATGTGCTGCCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT | 5 | XRHGG* |
| 3133 | NM_0060 13.2_587 | 587 | GAAGTGCTTTTCATGAAGCACAGCTGCAGCAAA GCCTTGCAATCCCAGGCTGGGGTCAGCC CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT | 4 | XHGG* |

TABLE 3B-continued

| SEQ ID | identifier_ position | position | modified RNA | PAP length | PAP |
|---|---|---|---|---|---|
| | | | CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAANGACATGG TGGCTGAAAAGCGGCTCATCCCAGATGGCTGTG GGGTCAAGTACATCCCCAGTCGTGGCCCTCTGG ACAAGTGGCGGGCCCTGCACTCATGAGGGCTTC CAATGTGCTGCCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT GAAGTGCTTTTCATGAAGCACAGCTGCAGCAAA GCCTTGCAATCCCAGGCTGGGGTCAGCC | | |
| 3134 | NM_0060 13.2_592 | 592 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAAGACATNGG TGGCTGAAAAGCGGCTCATCCCAGATGGCTGTG GGGTCAAGTACATCCCCAGTCGTGGCCCTCTGG ACAAGTGGCGGGCCCTGCACTCATGAGGGCTTC CAATGTGCTGCCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT GAAGTGCTTTTCATGAAGCACAGCTGCAGCAAA GCCTTGCAATCCCAGGCTGGGGTCAGCC | 3 | XGG* |
| 3135 | NM_0060 13.2_604 | 604 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAAGACATGGT GGCTGAAAANGCGGCTCATCCCAGATGGCTGTG GGGTCAAGTACATCCCCAGTCGTGGCCCTCTGG ACAAGTGGCGGGCCCTGCACTCATGAGGGCTTC CAATGTGCTGCCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT | 37 | XAAHPRWLW GQVHPQSWP SGQVAGPAL MRASNVLPPS* |

TABLE 3B-continued

| SEQ ID | identifier_position | position | modified RNA | PAP length | PAP |
|---|---|---|---|---|---|
| 3136 | NM_0060 13.2_634 | 634 | CCCCAGGTCCTAGGCAGTAGGTTGAAAAACACT GAAGTGCTTTTCATGAAGCACAGCTGCAGCAAA GCCTTGCAATCCCAGGCTGGGGTCAGCC CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAAGACATGGT GGCTGAAAAGCGGCTCATCCCAGATGGCTGTGG GGTCAANGTACATCCCCAGTCGTGGCCCTCTGG ACAAGTGGCGGGCCCTGCACTCATGAGGGCTTC CAATGTGCTGCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT GAAGTGCTTTTCATGAAGCACAGCTGCAGCAAA GCCTTGCAATCCCAGGCTGGGGTCAGCC | 27 | XVHPQSWPS GQVAGPALM RASNVLPPS* |
| 3137 | NM_0060 13.2_640 | 640 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAAGACATGGT GGCTGAAAAGCGGCTCATCCCAGATGGCTGTGG GGTCAAGTACATNCCCCAGTCGTGGCCCTCTGG ACAAGTGGCGGGCCCTGCACTCATGAGGGCTTC CAATGTGCTGCCCCCTCTTAATACTCACCAATA AATTCTACTTCCTGTCCACCTATGTCTTTGTATCT ACATTCTTGACGGGGAAGGAACTTCCTCTGGGA ACCTTTGGGTCATTGCCCTTTCACTTCAGAAACA GGTTGACAACTCAGCCCTGCTCATGAGGCAGCA AACCCTGCAAAGGGCTGGGACTGGTGGCCTTAT GTCAGTTGTCTACTCTGGAGCTTGACTTGGACCT CCCCAGGTCCTAGGCAGTAGGTTGAAAAACACT GAAGTGCTTTTCATGAAGCACAGCTGCAGCAAA GCCTTGCAATCCCAGGCTGGGGTCAGCC | 25 | XPQSWPSGQ VAGPALMRAS NVLPPS* |
| 3138 | NM_0060 13.2_664 | 664 | CTCTTTCCCTTCGGTGTGCCACTGAAGATCCTG GTGTCGCCATGGGCCGCCGCCCCGCCCGTTGT TACCGGTATTGTAAGAACAAGCCGTACCCAAAG TCTCGCTTCTGCCGAGGTGTCCCTGATGCCAAG ATTCGCATTTTTGACCTGGGGCGGAAAAAGGCA AAAGTGGATGAGTTTCCGCTTTGTGGCCACATG GTGTCAGATGAATATGAGCAGCTGTCCTCTGAA GCCCTGGAGGCTGCCCGAATTTGTGCCAATAAG TACATGGTAAAAAGTTGTGGCAAAGATGGCTTCC ATATCCGGGTGCGGCTCCACCCCTTCCACGTCA TCCGCATCAACAAGATGTTGTCCTGTGCTGGGG CTGACAGGCTCCAAACAGGCATGCGAGGTGCCT | 17 | XVAGPALMRA SNVLPPS* |

TABLE 3B-continued

| SEQ ID | identifier_position | position | modified RNA | PAP length | PAP |
|---|---|---|---|---|---|
| | | | TTGGAAAGCCCCAGGGCACTGTGGCCAGGGTT CACATTGGCCAAGTTATCATGTCCATCCGCACCA AGCTGCAGAACAAGGAGCATGTGATTGAGGCCC TGCGCAGGGCCAAGTTCAAGTTTCCTGGCCGCC AGAAGATCCACATCTCAAAGAAGTGGGGCTTCA CCAAGTTCAATGCTGATGAATTTGAAGACATGGT GGCTGAAAAGCGGCTCATCCCAGATGGCTGTGG GGTCAAGTACATCCCCAGTCGTGGCCCTCTGGA CAANGTGGCGGGCCCTGCACTCATGAGGGCTT CCAATGTGCTGCCCCCCTCTTAATACTCACCAAT AAATTCTACTTCCTGTCCACCTATGTCTTTGTATC TACATTCTTGACGGGGAAGGAACTTCCTCTGGG AACCTTTGGGTCATTGCCCTTTCACTTCAGAAAC AGGTTGACAACTCAGCCCTGCTCATGAGGCAGC AAACCCTGCAAAGGGCTGGGACTGGTGGCCTTA TGTCAGTTGTCTACTCTGGAGCTTGACTTGGACC TCCCCAGGTCCTAGGCAGTAGGTTGAAAAACAC TGAAGTGCTTTTCATGAAGCACAGCTGCAGCAA AGCCTTGCAATCCAGGCTGGGGTCAGCC | | |
| 3139 | NM_0060 82.2_101 1 | 1011 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCNGCATCCAC TTCC | 15 | XHPLPSGHIC PCHLC* |
| 3140 | NM_0060 82.2_102 1 | 1021 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA | 12 | XPSGHICPCH LC* |

TABLE 3B-continued

| SEQ ID | identifier_position | position | modified RNA | PAP length | PAP |
|---|---|---|---|---|---|
| | | | CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCGCATCCACT TNCC | | |
| 3141 | NM_0060 82.2_104 2 | 1042 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCGCATCCACT TCCC | 4 | CHLC* |
| 3142 | NM_0060 82.2_125 0 | 1250 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCGCATCCACT TCCC | 42 | XGLVPHWLQ GWHQLPASH CGAWWRPGQ GTESCVHAEQ HHSHC* |
| 3143 | NM_0060 82.2_127 0 | 1270 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC | 35 | LQGWHQLPA SHCGAWWRP GQGTESCVH AEQHHSHC* |

TABLE 3B-continued

| SEQ ID | identifier_position | position | modified RNA | PAP length | PAP |
|---|---|---|---|---|---|
| | | | GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCGCATCCACT TCCC | | |
| 3144 | NM_0060 82.2_333 | 333 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAANGTGACAAGACCATTGGGGGAG GAGATGACTCCTTCAACACCTTCTTCAGTGAGAC GGGCGCTGGCAAGCACGTGCCCCGGGCTGTGT TTGTAGACTTGGAACCCACAGTCATTGATGAAGT TCGCACTGGCACCTACCGCCAGCTCTTCCACCC TGAGCAGCTCATCACAGGCAAGGAAGATGCTGC CAATAACTATGCCCGAGGGCACTACACCATTGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 1 | X* |
| 3145 | NM_0060 82.2_382 | 382 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGNTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA | 1 | X* |

TABLE 3B-continued

| SEQ ID | identifier_position | position | modified RNA | PAP length | PAP |
|---|---|---|---|---|---|
|  |  |  | CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGAGCCCTGAATGTTGACCTGACAGAATTCC AGACCAACCTGGTGCCCTACCCCCGCATCCACT TCC |  |  |
| 3146 | NM_0060 82.2_400 | 400 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAANGCACGTGCCCCGGGCTGTGT TTGTAGACTTGGAACCCACAGTCATTGATGAAGT TCGCACTGGCACCTACCGCCAGCTCTTCCACCC TGAGCAGCTCATCACAGGCAAGGAAGATGCTGC CAATAACTATGCCCGAGGGCACTACACCATTGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 16 | XARAPGCVCR LGTHSH* |
| 3147 | NM_0060 82.2_401 | 401 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGNCACGTGCCCCGGGCTGTGT TTGTAGACTTGGAACCCACAGTCATTGATGAAGT TCGCACTGGCACCTACCGCCAGCTCTTCCACCC TGAGCAGCTCATCACAGGCAAGGAAGATGCTGC CAATAACTATGCCCGAGGGCACTACACCATTGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 15 | XRAPGCVCRL GTHSH* |

TABLE 3B-continued

| SEQ ID | identifier_position | position | modified RNA | PAP length | PAP |
|---|---|---|---|---|---|
| 3148 | NM_006082.2_421 | 421 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT NTGTAGACTTGGAACCCACAGTCATTGATGAAGT TCGCACTGGCACCTACCGCCAGCTCTTCCACCC TGAGCAGCTCATCACAGGCAAGGAAGATGCTGC CAATAACTATGCCCGAGGGCACTACACCATTGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 9 | XCRLGTHSH* |
| 3149 | NM_006082.2_476 | 476 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGNCTCTTCCACCC TGAGCAGCTCATCACAGGCAAGGAAGATGCTGC CAATAACTATGCCCGAGGGCACTACACCATTGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 4 | XLPP* |
| 3150 | NM_006082.2_491 | 491 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT | 11 | XAHHRQGRC CQ* |

| SEQ ID | identifier_position | position | modified RNA | PAP length | PAP |
|---|---|---|---|---|---|
| | | | TGTAGACTTGGAACCCACAGTCATTGATGAAGTT<br>CGCACTGGCACCTACCGCCAGCTCTTCCACCCT<br>GAGNCAGCTCATCACAGGCAAGGAAGATGCTGC<br>CAATAACTATGCCCGAGGGCACTACACCATTGG<br>CAAGGAGATCATTGACCTTGTGTTGGACCGAATT<br>CGCAAGCTGGCTGACCAGTGCACCGGTCTTCAG<br>GGCTTCTTGGTTTTCCACAGCTTTGGTGGGGGA<br>ACTGGTTCTGGGTTCACCTCCCTGCTCATGGAA<br>CGTCTCTCAGTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC<br>CAACCTACACTAACCTTAACCGCCTTATTAGCCA<br>GATTGTGTCCTCCATCACTGCTTCCCTGAGATTT<br>GATGGAGCCCTGAATGTTGACCTGACAGAATTC<br>CAGACCAACCTGGTGCCCTACCCCCGCATCCAC<br>TTCC | | |
| 3151 | NM_0060<br>82.2_510 | 510 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGNAAGATGCTGC<br>CAATAACTATGCCCGAGGGCACTACACCATTGG<br>CAAGGAGATCATTGACCTTGTGTTGGACCGAATT<br>CGCAAGCTGGCTGACCAGTGCACCGGTCTTCAG<br>GGCTTCTTGGTTTTCCACAGCTTTGGTGGGGGA<br>ACTGGTTCTGGGTTCACCTCCCTGCTCATGGAA<br>CGTCTCTCAGTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC<br>CAACCTACACTAACCTTAACCGCCTTATTAGCCA<br>GATTGTGTCCTCCATCACTGCTTCCCTGAGATTT<br>GATGGAGCCCTGAATGTTGACCTGACAGAATTC<br>CAGACCAACCTGGTGCCCTACCCCCGCATCCAC<br>TTCC | 5 | XRCCQ* |
| 3152 | NM_0060<br>82.2_534 | 534 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCNGAGGGCACTACACCATTGG<br>CAAGGAGATCATTGACCTTGTGTTGGACCGAATT<br>CGCAAGCTGGCTGACCAGTGCACCGGTCTTCAG<br>GGCTTCTTGGTTTTCCACAGCTTTGGTGGGGGA<br>ACTGGTTCTGGGTTCACCTCCCTGCTCATGGAA<br>CGTCTCTCAGTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG | 11 | XRALHHWQG<br>DH* |

TABLE 3B-continued

| SEQ ID | identifier_ position | position | modified RNA | PAP length | PAP |
|---|---|---|---|---|---|
| | | | ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3153 | NM_0060 82.2_551 | 551 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTNGG CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 5 | XQGDH* |
| 3154 | NM_0060 82.2_553 | 553 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGN CAAGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 4 | QGDH* |
| 3155 | NM_0060 82.2_556 | 556 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC | 4 | XGDH* |

TABLE 3B-continued

| SEQ ID | identifier_position | position | modified RNA | PAP length | PAP |
|---|---|---|---|---|---|
| | | | GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AANGGAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3156 | NM_0060 82.2_558 | 558 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGNAGATCATTGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 3 | XDH* |
| 3157 | NM_0060 82.2_559 | 559 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGANGATCATTGACCTTGTGTTGGACCGAATT CGCAAGCTGGCTGACCAGTGCACCGGTCTTCAG GGCTTCTTGGTTTTCCACAGCTTTGGTGGGGGA | 3 | XDH* |

TABLE 3B-continued

| SEQ ID | identifier_ position | position | modified RNA | PAP length | PAP |
|---|---|---|---|---|---|
| | | | ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3158 | NM_0060 82.2_566 | 566 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTNGACCTTGTGTTGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 11 | XPCVGPNSQA G* |
| 3159 | NM_0060 82.2_577 | 577 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTNGGACCGAATT CGCAAGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 8 | XGPNSQAG* |

TABLE 3B-continued

| SEQ ID | identifier_ position | position | modified RNA | PAP length | PAP |
|---|---|---|---|---|---|
| 3160 | NM_0060 82.2_592 | 592 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAANGCTGGCTGACCAGTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 3 | XAG* |
| 3161 | NM_0060 82.2_605 | 605 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGNTGCACCGGTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 31 | XHRSSGLLGF PQLWWGNWF WVHLPAHGTS LS* |
| 3162 | NM_0060 82.2_613 | 613 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT | 28 | SSGLLGFPQL WWGNWFWV HLPAHGTSLS* |

TABLE 3B-continued

| SEQ ID | identifier_ position | position | modified RNA | PAP length | PAP |
|---|---|---|---|---|---|
| | | | TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGNTCTTCAG GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3163 | NM_0060 82.2_620 | 620 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGN GGCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 26 | XLLGFPQLW WGNWFWVHL PAHGTSLS* |
| 3164 | NM_0060 82.2_622 | 622 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GNCTTCTTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG | 25 | LLGFPQLWW GNWFWVHLP AHGTSLS* |

TABLE 3B-continued

| SEQ ID | identifier_ position | position | modified RNA | PAP length | PAP |
|---|---|---|---|---|---|
| | | | ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3165 | NM_0060 82.2_627 | 627 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTNTGGTTTTCCACAGCTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 24 | XGFPQLWWG NWFWVHLPA HGTSLS* |
| 3166 | NM_0060 82.2_641 | 641 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCNTTTGGTGGGGGA ACTGGTTCTGGGTTCACCTCCCTGCTCATGGAA CGTCTCTCAGTTGATTATGGCAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 19 | XWWGNWFW VHLPAHGTSL S* |
| 3167 | NM_0060 82.2_665 | 665 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC | 11 | XHLPAHGTSL S* |

TABLE 3B-continued

| SEQ ID | identifier_position | position | modified RNA | PAP length | PAP |
|---|---|---|---|---|---|
| | | | GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCGAGGGCACTACACCATTGGC<br>AAGGAGATCATTGACCTTGTGTTGGACCGAATTC<br>GCAAGCTGGCTGACCAGTGCACCGGTCTTCAGG<br>GCTTCTTGGTTTTCCACAGCTTTGGTGGGGGAA<br>CTGGTTCTGGGNTTCACCTCCCTGCTCATGGAA<br>CGTCTCTCAGTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC<br>CAACCTACACTAACCTTAACCGCCTTATTAGCCA<br>GATTGTGTCCTCCATCACTGCTTCCCTGAGATTT<br>GATGGAGCCCTGAATGTTGACCTGACAGAATTC<br>CAGACCAACCTGGTGCCCTACCCCCGCATCCAC<br>TTCC | | |
| 3168 | NM_0060<br>82.2_671 | 671 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCGAGGGCACTACACCATTGGC<br>AAGGAGATCATTGACCTTGTGTTGGACCGAATTC<br>GCAAGCTGGCTGACCAGTGCACCGGTCTTCAGG<br>GCTTCTTGGTTTTCCACAGCTTTGGTGGGGGAA<br>CTGGTTCTGGGTTCACCNTCCCTGCTCATGGAA<br>CGTCTCTCAGTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC<br>CAACCTACACTAACCTTAACCGCCTTATTAGCCA<br>GATTGTGTCCTCCATCACTGCTTCCCTGAGATTT<br>GATGGAGCCCTGAATGTTGACCTGACAGAATTC<br>CAGACCAACCTGGTGCCCTACCCCCGCATCCAC<br>TTCC | 9 | XPAHGTSLS* |
| 3169 | NM_0060<br>82.2_707 | 707 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCGAGGGCACTACACCATTGGC<br>AAGGAGATCATTGACCTTGTGTTGGACCGAATTC<br>GCAAGCTGGCTGACCAGTGCACCGGTCTTCAGG<br>GCTTCTTGGTTTTCCACAGCTTTGGTGGGGGAA | 20 | XEVQAGVLHL<br>PSTPGFHSCS |

TABLE 3B-continued

| SEQ ID | identifier_position | position | modified RNA | PAP length | PAP |
|---|---|---|---|---|---|
| | | | CTGGTTCTGGGTTCACCTCCCTGCTCATGGAAC GTCTCTCAGTTGATTATGGCNAAGAAGTCCAAG CTGGAGTTCTCCATTTACCCAGCACCCCAGGTTT CCACAGCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3170 | NM_0060 82.2_759 | 759 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGNCTGTAGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 3 | XCS* |
| 3171 | NM_0060 82.2_764 | 764 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTANGTTGAGCCCTACAACTCCATCC TCACCACCCACACCACCCTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 1 | X* |

TABLE 3B-continued

| SEQ ID | identifier_ position | position | modified RNA | PAP length | PAP |
|---|---|---|---|---|---|
| 3172 | NM_0060 82.2_804 | 804 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCNTGGAGCACTCTGATT GTGCCTTCATGGTAGACAATGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 4 | XGAL* |
| 3173 | NM_0060 82.2_854 | 854 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CNATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 3 | XLS* |
| 3174 | NM_0060 82.2_900 | 900 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT | 1 | X* |

… TABLE 3B-continued

| SEQ ID | identifier_position | position | modified RNA | PAP length | PAP |
|---|---|---|---|---|---|
| | | | TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCNTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3175 | NM_0060 82.2_926 | 926 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGNTCCTCCATCACTGCTTCCCTGAGATTT GATGGAGCCCTGAATGTTGACCTGACAGAATTC CAGACCAACCTGGTGCCCTACCCCCGCATCCAC TTCC | 9 | XLHHCFPEI* |
| 3176 | NM_0060 82.2_939 | 939 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA | 5 | XFPEI* |

TABLE 3B-continued

| SEQ ID | identifier_position | position | modified RNA | PAP length | PAP |
|---|---|---|---|---|---|
| | | | CATCTGTCGTAGAAACCTCGATATCGAGCGCCC AACCTACACTAACCTTAACCGCCTTATTAGCCAG ATTGTGTCCTCCATCACTGNCTTCCCTGAGATTT GATGGAGCCCTGAATGTTGACCTGACAGAATTC CAGACCAACCTGGTGCCCTACCCCCGCATCCAC TTCC | | |
| 3177 | NM_0060 82.2_942 | 942 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTNCCCTGAGATTT GATGGAGCCCTGAATGTTGACCTGACAGAATTC CAGACCAACCTGGTGCCCTACCCCCGCATCCAC TTCC | 4 | XPEI* |
| 3178 | NM_0060 82.2_945 | 945 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCNTGAGATTT GATGGAGCCCTGAATGTTGACCTGACAGAATTC CAGACCAACCTGGTGCCCTACCCCCGCATCCAC TTCC | 3 | XEI* |
| 3179 | NM_0060 82.2_958 | 958 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC | 4 | SPEC* |

TABLE 3B-continued

| SEQ ID | identifier_position | position | modified RNA | PAP length | PAP |
|---|---|---|---|---|---|
| | | | GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAATGAGGCCATCTATGA CATCTGTCGTAGAAACCTCGATATCGAGCGCCC AACCTACACTAACCTTAACCGCCTTATTAGCCAG ATTGTGTCCTCCATCACTGCTTCCCTGAGATTTG ATGGNAGCCCTGAATGTTGACCTGACAGAATTC CAGACCAACCTGGTGCCCTACCCCCGCATCCAC TTCC | | |
| 3180 | NM0060 88.5_466 | 466 | ATATAAGCGTTGGCGGAGCGTCGGTTGTAGCAC TCTGCGCGCCCGCTCTTCTGCTGCTGTTTGTCT ACTTCCTCCTGCTTCCCCGCCGCCGCCGCCGCC ATCATGAGGGAAATCGTGCACTTGCAGGCCGGG CAGTGCGGCAACCAAATCGGCGCCAAGTTTTGG GAGGTGATCAGCGATGAGCACGGCATCGACCC CACGGGCACCTACCACGGGGACAGCGACCTGC AGCTGGAACGCATCAACGTGTACTACAATGAGG CCACCGGCGGCAAGTACGTGCCCCGCGCCGTG CTCGTGGATCTGGAGCCCGGCACCATGGACTCC GTGCGCTCGGGGCCCTTCGGGCAGATCTTCCG GCCGGACAACTTCGTTTTCGGTCAGAGTGGTGC TGGGAACAACTGGGCCAAGGGGCACTACACAG AAGGCGCGGAGCTGGTGGACTCGGTGCTGGAT GTTGTGAGAANAGGAGGCTGAGAGCTGTGACTG CCTGCAGGGTTTCCAGCTGACCCACTCCCTGGG TGGGGGGACTGGGTCTGGGATGGGTACCCTCC TCATCAGCAAGATCCGGGAGGAGTACCCAGACA GGATCATGAACACGTTTAGTGTGGTGCCTTCGC CCAAAGTGTCAGACACAGTGGTGGAGCCCTACA ACGCCACCCTCTCAGTCCACCAGCTCGTAGAAA ACACAGACGAGACCTACTGCATTGATAACGAAG CTCTCTACGACATTTGCTTCAGAACCCTAAAGCT GACCACGCCCACCTATGGTGACCTGAACCACCT GGTGTCTGCTACCATGAGTGGGGTCACCACCTG CCTGCGCTTCCCAGGCCAGCTCAATGCTGACCT GCGGAAGCTGGCTGTGAACATGGTCCCGTTTCC CCGGCTGCACTTCTTCATGCCCGGCTTTGCCCC ACTGACCAGCCGGGGCAGCCAGCAGTACCGGG CGCTGACCGTGCCCGAGCTCACCCAGCAGATGT TTGATGCCAAGAACATGATGGCTGCCTGCGACC CCGCCAT | 3 | XGG* |
| 3181 | NM_0060 98.4_276 | 276 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGNTGCTCTGCGGGGTCACTCCC ACTTTGTTAGTGATGTGGTTATCTCCTCAGATGG CCAGTTTGCCCTCTCAGGCTCCTGGGATGGAAC CCTGCGCCTCTGGGATCTCACAACGGGCACCAC CACGAGGCGATTTGTGGGCCATACCAAGGATGT GCTGAGTGTGGCCTTCTCCTCTGACAACCGGCA GATTGTCTCTGGATCTCGAGATAAAACCATCAAG CTATGGAATACCCTGGGTGTGTGCAAATACACT GTCCAGGATGAGAGCCACTCAGAGTGGGTGTCT TGTGTCCGCTTCTCGCCCAACAGCAGCAACCCT ATCATCGTCTCCTGTGGCTGGGACAAGCTGGTC AAGGTATGGAACCTGGCTAACTGCAAGCTGAAG | 9 | CSAGSLPLC* |

TABLE 3B-continued

| SEQ ID | identifier_position | position | modified RNA | PAP length | PAP |
|---|---|---|---|---|---|
| 3182 | NM_0060 98.4_409 | 409 | ACCAACCACATTGGCCACACAGGCTATCTGAAC ACGGTGACTGTCTCTCCAGATGGATCCCTCTGT GCTTCTGGAGGCAAGGATGGCCAGGCCATGTTA TGGGATCTCAACGAAGGCAAACACCTTTACACG CTAGATGGTGGGGACATCATCAACGCCCTGTGC TTCAGCCCTAACCGCTACTGGCTGTGTGCTGCC ACAGGCCCCAGCATCAAGATCTGGGATTTAGAG GGAAAGATCATTGTAGATGAACTGAAGCAAGAA GTTATCAGTACCAGCAGCAAGGCAGAACCACCC CAGTGCACCTCCCTGGCCTGGTCTGCTGATGGC CAGACTCTGTTTGCTGGCTACACGGACAACCT CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTNGTGGGCCATACCAAGGATGT GCTGAGTGTGGCCTTCTCCTCTGACAACCGGCA GATTGTCTCTGGATCTCGAGATAAAACCATCAAG CTATGGAATACCCTGGGTGTGTGCAAATACACT GTCCAGGATGAGAGCCACTCAGAGTGGGTGTCT TGTGTCCGCTTCTCGCCCAACAGCAGCAACCCT ATCATCGTCTCCTGTGGCTGGGACAAGCTGGTC AAGGTATGGAACCTGGCTAACTGCAAGCTGAAG ACCAACCACATTGGCCACACAGGCTATCTGAAC ACGGTGACTGTCTCTCCAGATGGATCCCTCTGT GCTTCTGGAGGCAAGGATGGCCAGGCCATGTTA TGGGATCTCAACGAAGGCAAACACCTTTACACG CTAGATGGTGGGGACATCATCAACGCCCTGTGC TTCAGCCCTAACCGCTACTGGCTGTGTGCTGCC ACAGGCCCCAGCATCAAGATCTGGGATTTAGAG GGAAAGATCATTGTAGATGAACTGAAGCAAGAA GTTATCAGTACCAGCAGCAAGGCAGAACCACCC CAGTGCACCTCCCTGGCCTGGTCTGCTGATGGC CAGACTCTGTTTGCTGGCTACACGGACAACCT | 14 | XGPYQGCAE CGLLL* |
| 3183 | NM_0060 98.4_569 | 569 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCNGCTTCTCGCCCAACAGCAGCAACCCTA TCATCGTCTCCTGTGGCTGGGACAAGCTGGTCA AGGTATGGAACCTGGCTAACTGCAAGCTGAAGA CCAACCACATTGGCCACACAGGCTATCTGAACA CGGTGACTGTCTCTCCAGATGGATCCCTCTGTG CTTCTGGAGGCAAGGATGGCCAGGCCATGTTAT GGGATCTCAACGAAGGCAAACACCTTTACACGC TAGATGGTGGGGACATCATCAACGCCCTGTGCT TCAGCCCTAACCGCTACTGGCTGTGTGCTGCCA CAGGCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | 26 | XLLAQQQQPY HRLLWLGQA GQGMEPG* |
| 3184 | NM_0060 98.4_582 | 582 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG | 22 | XQQQPYHRLL WLGQAGQGM EPG* |

TABLE 3B-continued

| SEQ ID | identifier_position | position | modified RNA | PAP length | PAP |
|---|---|---|---|---|---|
| | | | CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCGCTTCTCGCCCAANCAGCAGCAACCCTA TCATCGTCTCCTGTGGCTGGGACAAGCTGGTCA AGGTATGGAACCTGGCTAACTGCAAGCTGAAGA CCAACCACATTGGCCACACAGGCTATCTGAACA CGGTGACTGTCTCTCCAGATGGATCCCTCTGTG CTTCTGGAGGCAAGGATGGCCAGGCCATGTTAT GGGATCTCAACGAAGGCAAACACCTTTACACGC TAGATGGTGGGGACATCATCAACGCCCTGTGCT TCAGCCCTAACCGCTACTGGCTGTGTGCTGCCA CAGGCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | | |
| 3185 | NM_0060 98.4_648 | 648 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCGCTTCTCGCCCAACAGCAGCAACCCTAT CATCGTCTCCTGTGGCTGGGACAAGCTGGTCAA GGTATGGAACCTGGCTAANCTGCAAGCTGAAGA CCAACCACATTGGCCACACAGGCTATCTGAACA CGGTGACTGTCTCTCCAGATGGATCCCTCTGTG CTTCTGGAGGCAAGGATGGCCAGGCCATGTTAT GGGATCTCAACGAAGGCAAACACCTTTACACGC TAGATGGTGGGGACATCATCAACGCCCTGTGCT TCAGCCCTAACCGCTACTGGCTGTGTGCTGCCA CAGGCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | 63 | XLQAEDQPH WPHRLSEHG DCLSRWIPLC FWRQGWPGH VMGSQRRQT PLHARWWGH HQRPVLQP* |
| 3186 | NM_0060 98.4_660 | 660 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCGCTTCTCGCCCAACAGCAGCAACCCTAT CATCGTCTCCTGTGGCTGGGACAAGCTGGTCAA | 59 | XDQPHWPHR LSEHGDCLSR WIPLCFWRQG WPGHVMGSQ RRQTPLHAR WWGHHQRPV LQP* |

TABLE 3B-continued

| SEQ ID | identifier_position | position | modified RNA | PAP length | PAP |
|---|---|---|---|---|---|
| | | | GGTATGGAACCTGGCTAACTGCAAGCTGAANGA<br>CCAACCACATTGGCCACACAGGCTATCTGAACA<br>CGGTGACTGTCTCTCCAGATGGATCCCTCTGTG<br>CTTCTGGAGGCAAGGATGGCCAGGCCATGTTAT<br>GGGATCTCAACGAAGGCAAACACCTTTACACGC<br>TAGATGGTGGGGACATCATCAACGCCCTGTGCT<br>TCAGCCCTAACCGCTACTGGCTGTGTGCTGCCA<br>CAGGCCCCAGCATCAAGATCTGGGATTTAGAGG<br>GAAAGATCATTGTAGATGAACTGAAGCAAGAAGT<br>TATCAGTACCAGCAGCAAGGCAGAACCACCCCA<br>GTGCACCTCCCTGGCCTGGTCTGCTGATGGCCA<br>GACTCTGTTTGCTGGCTACACGGACAACCT | | |
| 3187 | NM_0060<br>98.4_684 | 684 | CTCTCTTTCACTGCAAGGCGGCGGCAGGAGAG<br>GTTGTGGTGCTAGTTTCTCTAAGCCATCCAGTGC<br>CATCCTCGTCGCTGCAGCGACACACGCTCTCGC<br>CGCCGCCATGACTGAGCAGATGACCCTTCGTGG<br>CACCCTCAAGGGCCACAACGGCTGGGTAACCCA<br>GATCGCTACTACCCCGCAGTTCCCGGACATGAT<br>CCTCTCCGCCTCTCGAGATAAGACCATCATCAT<br>GTGGAAACTGACCAGGGATGAGACCAACTATGG<br>AATTCCACAGCGTGCTCTGCGGGGTCACTCCCA<br>CTTTGTTAGTGATGTGGTTATCTCCTCAGATGGC<br>CAGTTTGCCCTCTCAGGCTCCTGGGATGGAACC<br>CTGCGCCTCTGGGATCTCACAACGGGCACCACC<br>ACGAGGCGATTTGTGGGCCATACCAAGGATGTG<br>CTGAGTGTGGCCTTCTCCTCTGACAACCGGCAG<br>ATTGTCTCTGGATCTCGAGATAAAACCATCAAGC<br>TATGGAATACCCTGGGTGTGTGCAAATACACTGT<br>CCAGGATGAGAGCCACTCAGAGTGGGTGTCTTG<br>TGTCCGCTTCTCGCCCAACAGCAGCAACCCTAT<br>CATCGTCCTGTGGCTGGGACAAGCTGGTCAA<br>GGTATGGAACCTGGCTAACTGCAAGCTGAAGAC<br>CAACCACATTGGCCACACAGGNCTATCTGAACA<br>CGGTGACTGTCTCTCCAGATGGATCCCTCTGTG<br>CTTCTGGAGGCAAGGATGGCCAGGCCATGTTAT<br>GGGATCTCAACGAAGGCAAACACCTTTACACGC<br>TAGATGGTGGGGACATCATCAACGCCCTGTGCT<br>TCAGCCCTAACCGCTACTGGCTGTGTGCTGCCA<br>CAGGCCCCAGCATCAAGATCTGGGATTTAGAGG<br>GAAAGATCATTGTAGATGAACTGAAGCAAGAAGT<br>TATCAGTACCAGCAGCAAGGCAGAACCACCCCA<br>GTGCACCTCCCTGGCCTGGTCTGCTGATGGCCA<br>GACTCTGTTTGCTGGCTACACGGACAACCT | 50 | LSEHGDCLSR<br>WIPLCFWRQG<br>WPGHVMGSQ<br>RRQTPLHAR<br>WWGHHQRPV<br>LQP* |
| 3188 | NM_0060<br>98.4_696 | 696 | CTCTCTTTCACTGCAAGGCGGCGGCAGGAGAG<br>GTTGTGGTGCTAGTTTCTCTAAGCCATCCAGTGC<br>CATCCTCGTCGCTGCAGCGACACACGCTCTCGC<br>CGCCGCCATGACTGAGCAGATGACCCTTCGTGG<br>CACCCTCAAGGGCCACAACGGCTGGGTAACCCA<br>GATCGCTACTACCCCGCAGTTCCCGGACATGAT<br>CCTCTCCGCCTCTCGAGATAAGACCATCATCAT<br>GTGGAAACTGACCAGGGATGAGACCAACTATGG<br>AATTCCACAGCGTGCTCTGCGGGGTCACTCCCA<br>CTTTGTTAGTGATGTGGTTATCTCCTCAGATGGC<br>CAGTTTGCCCTCTCAGGCTCCTGGGATGGAACC<br>CTGCGCCTCTGGGATCTCACAACGGGCACCACC<br>ACGAGGCGATTTGTGGGCCATACCAAGGATGTG<br>CTGAGTGTGGCCTTCTCCTCTGACAACCGGCAG<br>ATTGTCTCTGGATCTCGAGATAAAACCATCAAGC<br>TATGGAATACCCTGGGTGTGTGCAAATACACTGT<br>CCAGGATGAGAGCCACTCAGAGTGGGTGTCTTG<br>TGTCCGCTTCTCGCCCAACAGCAGCAACCCTAT<br>CATCGTCCTGTGGCTGGGACAAGCTGGTCAA<br>GGTATGGAACCTGGCTAACTGCAAGCTGAAGAC<br>CAACCACATTGGCCACACAGGCTATCTGAACAC<br>NGGTGACTGTCTCTCCAGATGGATCCCTCTGTG<br>CTTCTGGAGGCAAGGATGGCCAGGCCATGTTAT<br>GGGATCTCAACGAAGGCAAACACCTTTACACGC<br>TAGATGGTGGGGACATCATCAACGCCCTGTGCT<br>TCAGCCCTAACCGCTACTGGCTGTGTGCTGCCA<br>CAGGCCCCAGCATCAAGATCTGGGATTTAGAGG<br>GAAAGATCATTGTAGATGAACTGAAGCAAGAAGT<br>TATCAGTACCAGCAGCAAGGCAGAACCACCCCA<br>GTGCACCTCCCTGGCCTGGTCTGCTGATGGCCA<br>GACTCTGTTTGCTGGCTACACGGACAACCT | 46 | GDCLSRWIPL<br>CFWRQGWPG<br>HVMGSQRRQ<br>TPLHARWWG<br>HHQRPVLQP* |

TABLE 3B-continued

| SEQ ID | identifier_position | position | modified RNA | PAP length | PAP |
|---|---|---|---|---|---|
| 3189 | NM_0060 98.4_711 | 711 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCGCTTCTCGCCCAACAGCAGCAACCCTAT CATCGTCTCCTGTGGCTGGGACAAGCTGGTCAA GGTATGGAACCTGGCTAACTGCAAGCTGAAGAC CAACCACATTGGCCACACAGGCTATCTGAACAC GGTGACTGTCTCTCCNAGATGGATCCCTCTGTG CTTCTGGAGGCAAGGATGGCCAGGCCATGTTAT GGGATCTCAACGAAGGCAAACACCTTTACACGC TAGATGGTGGGGACATCATCAACGCCCTGTGCT TCAGCCCTAACCGCTACTGGCTGTGTGCTGCCA CAGGCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | 41 | RWIPLCFWRQ GWPGHVMGS QRRQTPLHAR WWGHHQRPV LQP* |
| 3190 | NM_0060 98.4_834 | 834 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC TATGGAATACCCTGGGTGTGTGCAAATACACTGT CCAGGATGAGAGCCACTCAGAGTGGGTGTCTTG TGTCCGCTTCTCGCCCAACAGCAGCAACCCTAT CATCGTCTCCTGTGGCTGGGACAAGCTGGTCAA GGTATGGAACCTGGCTAACTGCAAGCTGAAGAC CAACCACATTGGCCACACAGGCTATCTGAACAC GGTGACTGTCTCTCCAGATGGATCCCTCTGTGC TTCTGGAGGCAAGGATGGCCAGGCCATGTTATG GGATCTCAACGAAGGCAAACACCTTTACACGCT AGATGGTGGGGACATCATCAACGCCCTGTGCTT CAGCCCNTAACCGCTACTGGCTGTGTGCTGCCA CAGGCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | 0 | * |
| 3191 | NM_0060 98.4_864 | 864 | CTCTCTTTCACTGCAAGGCGGCGGCAGGAGAG GTTGTGGTGCTAGTTTCTCTAAGCCATCCAGTGC CATCCTCGTCGCTGCAGCGACACACGCTCTCGC CGCCGCCATGACTGAGCAGATGACCCTTCGTGG CACCCTCAAGGGCCACAACGGCTGGGTAACCCA GATCGCTACTACCCCGCAGTTCCCGGACATGAT CCTCTCCGCCTCTCGAGATAAGACCATCATCAT GTGGAAACTGACCAGGGATGAGACCAACTATGG AATTCCACAGCGTGCTCTGCGGGGTCACTCCCA CTTTGTTAGTGATGTGGTTATCTCCTCAGATGGC CAGTTTGCCCTCTCAGGCTCCTGGGATGGAACC CTGCGCCTCTGGGATCTCACAACGGGCACCACC ACGAGGCGATTTGTGGGCCATACCAAGGATGTG CTGAGTGTGGCCTTCTCCTCTGACAACCGGCAG ATTGTCTCTGGATCTCGAGATAAAACCATCAAGC | 14 | QHQDLGFRG KDHCR* |

TABLE 3B-continued

| SEQ ID | identifier_position | position | modified RNA | PAP length | PAP |
|---|---|---|---|---|---|
| | | | TATGGAATACCCTGGGTGTGTGCAAATACACTGT CCAGGATGAGAGCCACTCAGAGTGGGTGTCTTG TGTCCGCTTCTCGCCCAACAGCAGCAACCCTAT CATCGTCTCCTGTGGCTGGGACAAGCTGGTCAA GGTATGGAACCTGGCTAACTGCAAGCTGAAGAC CAACCACATTGGCCACACAGGCTATCTGAACAC GGTGACTGTCTCTCCAGATGGATCCCTCTGTGC TTCTGGAGGCAAGGATGGCCAGGCCATGTTATG GGATCTCAACGAAGGCAAACACCTTTACACGCT AGATGGTGGGGACATCATCAACGCCCTGTGCTT CAGCCCTAACCGCTACTGGCTGTGTGCTGCCAC AGGNCCCCAGCATCAAGATCTGGGATTTAGAGG GAAAGATCATTGTAGATGAACTGAAGCAAGAAGT TATCAGTACCAGCAGCAAGGCAGAACCACCCCA GTGCACCTCCCTGGCCTGGTCTGCTGATGGCCA GACTCTGTTTGCTGGCTACACGGACAACCT | | |
| 3192 | NM_0064 29.2_155 | 155 | CAAGCTTCTGGGTATTTCTATTGCGCGAGGCATT GTGGGTTGCTGGGCGGCCCGGTCTCGGAGAAG AGGGGAGAGTGGCGGGCCGCTGAATAAGCTTC CAAAATGATGCCCACACCAGTTATCCTATTGAAA GAGGGGACTGATAGCTCCCAAGGNCATCCCCCA GCTTGTGAGTAACATCAGTGCCTGCCAGGTGAT TGCTGAGGCTGTAAGAACTACCCTGGGTCCCCG TGGCATGGACAAGCTTATTGTAGATGGCAGAGG CAAAGCAACAATTTCTAATGATGGGGCCACAATT CTGAAACTTCTTGATGTTGTCCATCCTGCAGCAA AGACTTTGGTAGACATTGCCAAATCCCAAGATGC TGAGGTGGGTGATGGCACCACCTCAGTGACCTT GCTGGCTGCAGAGTTTCTGAAGCAGGTGAAACC CTATGTGGAGGAAGGTTTACACCCCCAGATCAT CATTCGAGCTTTCCGCACAGCCACCCAGCTGGC AGTTAACAAGATCAAAGAGATTGCTGTGACCGT GAAGAAGGCAGATAAAGTGGAGCAGAGGAAGCT GCTGGAAAAGTGTGCCATGACCGCTCTGAGCTC CAAGCTGATCTCCCAGCAGAAAGCTTTCTTTGCT AAGATGGTGGTGGATGCAGTGATGATGCTCGAT GATTTGCTGCAGCTTAAAATGATTGGAATCAAGA AGGTACAGGGTGGAGCCCTCGAGGATTCTCAGC TGGTAGCTGGTGTTGCATTCAAGAAGACTTTCTC TTACGCTGGGTTTGAAATGCAACCCAAAAAGTAC CACAATCCCAAGATTGCCCTTTTGAATGTCGAGC TCGAGTTGAAAGCTGAGAAAGACAATGCTGAGA TAAGAGTCCACACAGTTGAGGATTATCAGGCAAT TGTTGATGCTGAGTGGAACATTCTCTATGACAAG TTAGAGAAGATCCATCATTCTGGAGCCAAAGTTG TCTTGTCCAAACTCCCCATTGGGGATGTGGCCA CCCAGTACTTTGCTGACAGGGAC | 6 | HPPACE* |
| 3193 | NM_0064 29.2_817 | 817 | CAAGCTTCTGGGTATTTCTATTGCGCGAGGCATT GTGGGTTGCTGGGCGGCCCGGTCTCGGAGAAG AGGGGAGAGTGGCGGGCCGCTGAATAAGCTTC CAAAATGATGCCCACACCAGTTATCCTATTGAAA GAGGGGACTGATAGCTCCCAAGGCATCCCCCA GCTTGTGAGTAACATCAGTGCCTGCCAGGTGAT TGCTGAGGCTGTAAGAACTACCCTGGGTCCCCG TGGCATGGACAAGCTTATTGTAGATGGCAGAGG CAAAGCAACAATTTCTAATGATGGGGCCACAATT CTGAAACTTCTTGATGTTGTCCATCCTGCAGCAA AGACTTTGGTAGACATTGCCAAATCCCAAGATGC TGAGGTGGGTGATGGCACCACCTCAGTGACCTT GCTGGCTGCAGAGTTTCTGAAGCAGGTGAAACC CTATGTGGAGGAAGGTTTACACCCCCAGATCAT CATTCGAGCTTTCCGCACAGCCACCCAGCTGGC AGTTAACAAGATCAAAGAGATTGCTGTGACCGT GAAGAAGGCAGATAAAGTGGAGCAGAGGAAGCT GCTGGAAAAGTGTGCCATGACCGCTCTGAGCTC CAAGCTGATCTCCCAGCAGAAAGCTTTCTTTGCT AAGATGGTGGTGGATGCAGTGATGATGCTCGAT GATTTGCTGCAGCTTAAAATGATTGGAATCAAGA AGGTACAGGGTGGAGCCCTCGAGGATTCTCAGC TGGTAGCTGGTGTTGCATTCAAGAAGACTTTCTC TTACGCTGGGTTTGAAATGCAACCCAAAAAGTAC CACAATCCCAAGATTGCCCNTTTTGAATGTCGAG CTCGAGTTGAAAGCTGAGAAAGACAATGCTGAG ATAAGAGTCCACACAGTTGAGGATTATCAGGCA ATTGTTGATGCTGAGTGGAACATTCTCTATGACA AGTTAGAGAAGATCCATCATTCTGGAGCCAAAGT | 10 | XFECRARVES* |

TABLE 3B-continued

| SEQ ID | identifier_position | position | modified RNA | PAP length | PAP |
|---|---|---|---|---|---|
| 3194 | NM_0065 16.1_613 | 613 | TGTCTTGTCCAAACTCCCCATTGGGGATGTGGC CACCCAGTACTTTGCTGACAGGGAC TAGTCGCGGGTCCCCGAGTGAGCACGCCAGGG AGCAGGAGACCAAACGACGGGGGTCGGAGTCA GAGTCGCAGTGGGAGTCCCCGGACCGGAGCAC GAGCCTGAGCGGGAGAGCGCCGCTCGCACGCC CGTCGCCACCCGCGTACCCGGCGCAGCCAGAG CCACCAGCGCAGCGCTGCCATGGAGCCCAGCA GCAAGAAGCTGACGGGTCGCCTCATGCTGGCT GTGGGAGGAGCAGTGCTTGGCTCCCTGCAGTTT GGCTACAACACTGGAGTCATCAATGCCCCCCAG AAGGTGATCGAGGAGTTCTACAACCAGACATGG GTCCACCGCTATGGGGAGAGCATCCTGCCCACC ACGCTCACCACGCTCTGGTCCCTCTCAGTGGCC ATCTTTTCTGTTGGGGGCATGATTGGCTCCTTCT CTGTGGGCCTTTTCGTTAACCGCTTTGGCCGGC GGAATTCAATGCTGATGATGAACCTGCTGGCCT TCGTGTCCGCCGTGCTCATGGGCTTCTCGAAAC TGGGCAAGTCCTTTGAGATGCTGATCCTGGGCC GCTTCATCATCGGTGTGTACTGCGGCCTGACCA CAGGCTTCGTGCCCATGTATGTGGGNTGAAGTG TCACCCACAGCCTTTCGTGGGGCCCTGGGCACC CTGCACCAGCTGGGCATCGTCGTCGGCATCCTC ATCGCCCAGGTGTTCGGCCTGGACTCCATCATG GGCAACAAGGACCTGTGGCCCCTGCTGCTGAG CATCATCTTCATCCCGGCCCTGCTGCAGTGCAT CGTGCTGCCCTTCTGCCCCGAGAGTCCCCGCTT CCTGCTCATCAACCGCAACGAGGAGAACCGGG CCAAGAGTGTGCTAAAGAAGCTGCGCGGGACA GCTGACGTGACCCATGACCTGCAGGAGATGAAG GAAGAGAGTCGGCAGATGATGCGGGAGAAGAA GGTCACCATCCTGGAGCTGTTCCGCTCCCCCGC CTACCGCCAGCCCATCCTCATCGCTGTGGTGCT GCAGCTGTCCC | 0 | * |
| 3195 | NM_0065 97.3_157 7 | 1577 | CTCATTGAACTCGCCTGCAGCTCTTGGGTTTTTT GTGGCTTCCTTCGTTATTGGAGCCAGGCCTACA CCCCAGCAACCATGTCCAAGGGACCTGCAGTTG GTATTGATCTTGGCACCACCTACTCTTGTGTGGG TGTTTTCCAGCACGGAAAAGTCGAGATAATTGCC AATGATCAGGGAAACCGAACCACTCCAAGCTAT GTCGCCTTTACGGACACTGAACGGTTGATCGGT GATGCCGCAAAGAATCAAGTTGCAATGAACCCC ACCAACACAGTTTTTGATGCCAAACGTCTGATTG GACGCAGATTTGATGATGCTGTTGTCCAGTCTG ATATGAAACATTGGCCCTTTATGGTGGTGAATGA TGCTGGCAGGCCCAAGGTCCAAGTAGAATACAA GGGAGAGACCAAAAGCTTCTATCCAGAGGAGGT GTCTTCTATGGTTCTGACAAAGATGAAGGAAATT GCAGAAGCCTACCTTGGGAAGACTGTTACCAAT GCTGTGGTCACAGTGCCAGCTTACTTTAATGACT CTCAGCGTCAGGCTACCAAAGATGCTGGAACTA TTGCTGGTCTCAATGTACTTAGAATTATTAATGA GCCAACTGCTGCTGCTATTGCTTACGGCTTAGA CAAAAAGGTTGGAGCAGAAAGAAACGTGCTCAT CTTTGACCTGGGAGGTGGCACTTTTGATGTGTC AATCCTCACTATTGAGGATGGAATCTTTGAGGTC AAGTCTACAGCTGGAGACACCCACTTGGGTGGA GAAGATTTTGACAACCGAATGGTCAACCATTTTA TTGCTGAGTTTAAGCGCAAGCATAAGAAGGACA TCAGTGAGAACAAGAGAGCTGTAAGACGCCTCC GTACTGCTTGTGAACGTGCTAAGCGTACCCTCT CTTCCAGCACCCAGGCCAGTATTGAGATCGATT CTCTCTATGAAGGAATCGACTTCTATACCTCCAT TACCCGTGCCCGATTTGAAGAACTGAATGCTGA CCTGTTCCGTGGCACCCTGGACC | 5 | XDYYH* |
| 3196 | NM_0067 61.3_676 | 676 | CGGATTGAGGCGCCGCCATTTTTGCTGCCCGGA CGCGGAGCGAGAGGCTGAGAGAGTCGGAGACA CTATCCGCTTCCATCCGTCGCGCAGACCCTGCC GGAGCCGCTGCCGCTATGGATGATCGAGAGGA TCTGGTGTACCAGGCGAAGCTGGCCGAGCAGG CTGAGCGATACGACGAAATGGTGGAGTCAATGA AGAAAGTAGCAGGGATGGATGTGGAGCTGACAG TTGAAGAAAGAAACCTCCTATCTGTTGCATATAA GAATGTGATTGGAGCTAGAAGAGCCTCCTGGAG AATAATCAGCAGCATTGAACAGAAAGAAGAAAAC AAGGGAGGAGAAGACAAGCTAAAAATGATTCGG GAATATCGGCAAATGGTTGAGACTGAGCTAAAG | 0 | * |

TABLE 3B-continued

| SEQ ID | identifier_ position | position | modified RNA | PAP length | PAP |
|---|---|---|---|---|---|
| | | | TTAATCTGTTGTGACATTCTGGATGTACTGGACA AACACCTCATTCCAGCAGCTAACACTGGCGAGT CCAAGGTTTTCTATTATAAAATGAAAGGGGACTA CCACAGGTATCTGGCAGAATTTGCCACAGGAAA CGACAGGAAGGAGGCTGCGGAGAACAGCCTAG TGGCTTATAAAGCTGCTAGTGATATTGCAATGAC AGAACTTCCACCAACGCATCCTATTCGCTTAGGT CTTGCTCTCAATTTTTCCGTATTCTACTACGAAAT TCTTAATTCCCCNTGACCGTGCCTGCAGGTTGG CAAAAAGCAGCTTTTGATGATGCAATTGCAGAACT GGATACGCTGAGTGAAGAAAGCTATAAGGACTC TACACTTATCATGCAGTTGTTACGTGATAATCTG ACACTATGGACTTCAGACATGCAGGGTGACGGT GAAGAGCAGAATAAAGAAGCGCTGCAGGACGTG GAAGACGAAAATCAGTGAGACATAAGCCAACAA GAGAAACCATCTCTGACCACCCCCTCCTCCCCA TCCCACCCTTTGGAAACTCCCCATTGTCACTGAG AACCACCAAATCTGACTTTTACATTTGGTCTCAG AATTTAGGTTCCTGCCCTGTTGGTTT | | |
| 3197 | NM_0067 93.2_347 | 347 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTNTGGATTTCACCTTTGTGTG TCCTACAGAAATTGTTGCTTTTAGTGACAAAGCT AACGAATTTCACGACGTGAACTGTGAAGTTGTC GCAGTCTCAGTGGATTCCCACTTTAGCCATCTTG CCTGGATAAATACACCAAGGAAGAATGGTGGTT TGGGCCACATGAACATCGCACTCTTGTCAGACT TAACTAAGCAGATTTCCCGAGACTACGGTGTGC TGTTAGAAGGTTCTGGTCTTGCACTAAGAGGTCT CTTCATAATTGACCCCAATGGAGTCATCAAGCAT TTGAGCGTCAACGATCTCCCAGTGGGCCGAAGC GTGGAAGAAACCCTCCGCTTGGTGAAGGCGTTC CAGTATGTAGAAACACATGGAGAAGTCTGCCCA GCGAACTGGACACCGGATTCTCCTACGATCAAG CCAAGTCCAGCTGCTTCCAAAGAGTACTTTCAGA AGGTAAATCAGTAGATCACCCATGTGTATCTGCA CCTTCTCAACTGAGAGAAGAACCACAGTTGAAA CCTGCTTTTATCATTTTCAAGATGGTTATTTGTAG AAGGCAAGGAACCAATTATGCTTGTATTCATAAG TATTACTCTAAATGTTTTGTTTTTGTAATTCTGGC TAAGACCTTTTAAACATGGTTAGTTGCTAGTACA AGGAATCCTTTATTGGTA | 14 | XGFHLCVSYR NCCF* |
| 3198 | NM_0067 93.2_360 | 360 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTTGGATTTCACCTTNTGTGTG TCCTACAGAAATTGTTGCTTTTAGTGACAAAGCT AACGAATTTCACGACGTGAACTGTGAAGTTGTC GCAGTCTCAGTGGATTCCCACTTTAGCCATCTTG CCTGGATAAATACACCAAGGAAGAATGGTGGTT TGGGCCACATGAACATCGCACTCTTGTCAGACT TAACTAAGCAGATTTCCCGAGACTACGGTGTGC TGTTAGAAGGTTCTGGTCTTGCACTAAGAGGTCT CTTCATAATTGACCCCAATGGAGTCATCAAGCAT TTGAGCGTCAACGATCTCCCAGTGGGCCGAAGC GTGGAAGAAACCCTCCGCTTGGTGAAGGCGTTC CAGTATGTAGAAACACATGGAGAAGTCTGCCCA GCGAACTGGACACCGGATTCTCCTACGATCAAG CCAAGTCCAGCTGCTTCCAAAGAGTACTTTCAGA AGGTAAATCAGTAGATCACCCATGTGTATCTGCA CCTTCTCAACTGAGAGAAGAACCACAGTTGAAA CCTGCTTTTATCATTTTCAAGATGGTTATTTGTAG | 10 | XCVSYRNCCF* |

TABLE 3B-continued

| SEQ ID | identifier_position | position | modified RNA | PAP length | PAP |
|---|---|---|---|---|---|
| | | | AAGGCAAGGAACCAATTATGCTTGTATTCATAAG TATTACTCTAAATGTTTTGTTTTTGTAATTCTGGC TAAGACCTTTTAAACATGGTTAGTTGCTAGTACA AGGAATCCTTTATTGGTA | | |
| 3199 | NM_0067 93.2_465 | 465 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTTGGATTTCACCTTTGTGTGT CCTACAGAAATTGTTGCTTTTAGTGACAAAGCTA ACGAATTTCACGACGTGAACTGTGAAGTTGTCG CAGTCTCAGTGGATTCCCACTTTAGCCATCTNTG CCTGGATAAATACACCAAGGAAGAATGGTGGTT TGGGCCACATGAACATCGCACTCTTGTCAGACT TAACTAAGCAGATTTCCCGAGACTACGGTGTGC TGTTAGAAGGTTCTGGTCTTGCACTAAGAGGTCT CTTCATAATTGACCCCAATGGAGTCATCAAGCAT TTGAGCGTCAACGATCTCCCAGTGGGCCGAAGC GTGGAAGAAACCCTCCGCTTGGTGAAGGCGTTC CAGTATGTAGAAACACATGGAGAAGTCTGCCCA GCGAACTGGACACCGGATTCTCCTACGATCAAG CCAAGTCCAGCTGCTTCCAAAGAGTACTTTCAGA AGGTAAATCAGTAGATCACCCATGTGTATCTGCA CCTTCTCAACTGAGAGAAGAACCACAGTTGAAA CCTGCTTTTATCATTTTCAAGATGGTTATTTGTAG AAGGCAAGGAACCAATTATGCTTGTATTCATAAG TATTACTCTAAATGTTTTGTTTTTGTAATTCTGGC TAAGACCTTTTAAACATGGTTAGTTGCTAGTACA AGGAATCCTTTATTGGTA | 24 | CLDKYTKEEW WFGPHEHRTL VRLN* |
| 3200 | NM_0067 93.2_500 | 500 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTTGGATTTCACCTTTGTGTGT CCTACAGAAATTGTTGCTTTTAGTGACAAAGCTA ACGAATTTCACGACGTGAACTGTGAAGTTGTCG CAGTCTCAGTGGATTCCCACTTTAGCCATCTTGC CTGGATAAATACACCAAGGAAGAATGGTGGTTN TGGGCCACATGAACATCGCACTCTTGTCAGACT TAACTAAGCAGATTTCCCGAGACTACGGTGTGC TGTTAGAAGGTTCTGGTCTTGCACTAAGAGGTCT CTTCATAATTGACCCCAATGGAGTCATCAAGCAT TTGAGCGTCAACGATCTCCCAGTGGGCCGAAGC GTGGAAGAAACCCTCCGCTTGGTGAAGGCGTTC CAGTATGTAGAAACACATGGAGAAGTCTGCCCA GCGAACTGGACACCGGATTCTCCTACGATCAAG CCAAGTCCAGCTGCTTCCAAAGAGTACTTTCAGA AGGTAAATCAGTAGATCACCCATGTGTATCTGCA CCTTCTCAACTGAGAGAAGAACCACAGTTGAAA CCTGCTTTTATCATTTTCAAGATGGTTATTTGTAG AAGGCAAGGAACCAATTATGCTTGTATTCATAAG TATTACTCTAAATGTTTTGTTTTTGTAATTCTGGC TAAGACCTTTTAAACATGGTTAGTTGCTAGTACA AGGAATCCTTTATTGGTA | 13 | XGPHEHRTLV RLN* |
| 3201 | NM_0067 93.2_590 | 590 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTTGGATTTCACCTTTGTGTGT | 7 | XKRSLHN* |

TABLE 3B-continued

| SEQ ID | identifier_position | position | modified RNA | PAP length | PAP |
|---|---|---|---|---|---|
| | | | CCTACAGAAATTGTTGCTTTTAGTGACAAAGCTA ACGAATTTCACGACGTGAACTGTGAAGTTGTCG CAGTCTCAGTGGATTCCCACTTTAGCCATCTTGC CTGGATAAATACACCAAGGAAGAATGGTGGTTT GGGCCACATGAACATCGCACTCTTGTCAGACTT AACTAAGCAGATTTCCCGAGACTACGGTGTGCT GTTAGAAGGTTCTGGTCTTGCACNTAAGAGGTC TCTTCATAATTGACCCCAATGGAGTCATCAAGCA TTTGAGCGTCAACGATCTCCCAGTGGGCCGAAG CGTGGAAGAAACCCTCCGCTTGGTGAAGGCGTT CCAGTATGTAGAAACACATGGAGAAGTCTGCCC AGCGAACTGGACACCGGATTCTCCTACGATCAA GCCAAGTCCAGCTGCTTCCAAAGAGTACTTTCA GAAGGTAAATCAGTAGATCACCCATGTGTATCTG CACCTTCTCAACTGAGAGAAGAACCACAGTTGA AACCTGCTTTTATCATTTTCAAGATGGTTATTTGT AGAAGGCAAGGAACCAATTATGCTTGTATTCATA AGTATTACTCTAAATGTTTTGTTTTTGTAATTCTG GCTAAGACCTTTTAAACATGGTTAGTTGCTAGTA CAAGGAATCCTTTATTGGTA | | |
| 3202 | NM_0067 93.2_593 | 593 | CCCTGCGTCTCTGCCCGCCCCGTGGCGCCCGA GTGCACTGAAGATGGCGGCTGCTGTAGGACGG TTGCTCCGAGCGTCGGTTGCCCGACATGTGAGT GCCATTCCTTGGGGCATTTCTGCCACTGCAGCC CTCAGGCCTGCTGCATGTGGAAGAACGAGCTTG ACAAATTTATTGTGTTCTGGTTCCAGTCAAGCAA AATTATTCAGCACCAGTTCCTCATGCCATGCACC TGCTGTCACCCAGCATGCACCCTATTTTAAGGGT ACAGCCGTTGTCAATGGAGAGTTCAAAGACCTA AGCCTTGATGACTTTAAGGGGAAATATTTGGTGC TTTTCTTCTATCCTTTGGATTTCACCTTTGTGTGT CCTACAGAAATTGTTGCTTTTAGTGACAAAGCTA ACGAATTTCACGACGTGAACTGTGAAGTTGTCG CAGTCTCAGTGGATTCCCACTTTAGCCATCTTGC CTGGATAAATACACCAAGGAAGAATGGTGGTTT GGGCCACATGAACATCGCACTCTTGTCAGACTT AACTAAGCAGATTTCCCGAGACTACGGTGTGCT GTTAGAAGGTTCTGGTCTTGCACTAANGAGGTC TCTTCATAATTGACCCCAATGGAGTCATCAAGCA TTTGAGCGTCAACGATCTCCCAGTGGGCCGAAG CGTGGAAGAAACCCTCCGCTTGGTGAAGGCGTT CCAGTATGTAGAAACACATGGAGAAGTCTGCCC AGCGAACTGGACACCGGATTCTCCTACGATCAA GCCAAGTCCAGCTGCTTCCAAAGAGTACTTTCA GAAGGTAAATCAGTAGATCACCCATGTGTATCTG CACCTTCTCAACTGAGAGAAGAACCACAGTTGA AACCTGCTTTTATCATTTTCAAGATGGTTATTTGT AGAAGGCAAGGAACCAATTATGCTTGTATTCATA AGTATTACTCTAAATGTTTTGTTTTTGTAATTCTG GCTAAGACCTTTTAAACATGGTTAGTTGCTAGTA CAAGGAATCCTTTATTGGTA | 6 | XRSLHN* |
| 3203 | NM_0071 04.4_552 | 552 | AGTCTCTTTTCCGGTTAGCGCGGCGTGAGAAGC CATGAGCAGCAAAGTCTCTCGCGACACCCTGTA CGAGGCGGTGCGGGAAGTCCTGCACGGGAACC AGCGCAAGCGCCGCAAGTTCCTGGAGACGGTG GAGTTGCAGATCAGCTTGAAGAACTATGATCCC CAGAAGGACAAGCGCTTCTCGGGCACCGTCAG GCTTAAGTCCACTCCCCGCCCTAAGTTCTCTGT GTGTGTCCTGGGGGACCAGCAGCACTGTGACG AGGCTAAGGCCGTGGATATCCCCCACATGGACA TCGAGGCGCTGAAAAAACTCAACAAGAATAAAAA ACTGGTCAAGAAGCTGGCCAAGAAGTATGATGC GTTTTTGGCCCTCAGAGTCTCTGATCAAGCAGATT CCACGAATCCTCGGCCCAGGTTTAAATAAGGCA GGAAAGTTCCCTTCCCTGCTCACACACAACGAA AACATGGTGGCCAAAGTGGATGAGGTGAAGTCC ACAATCAAGTTCCAAATGAAGAAGGTGTTATGTC TGGCTGTAGCTGTTGGTCACGTGAANGATGACA GACGATGAGCTTGTGTATAACATTCACCTGGCT GTCAACTTCTTGGTGTCATTGCTCAAGAAAAACT GGCAGAATGTCCGGGCCTTATATATCAAGAGCA CCATGGGCAAGCCCCAGCGCCTATATTAAGGCA CATTTGAATAAATTCTATTACCAGTTC | 5 | XDDRR* |
| 3204 | NM_0071 04.4_583 | 583 | AGTCTCTTTTCCGGTTAGCGCGGCGTGAGAAGC CATGAGCAGCAAAGTCTCTCGCGACACCCTGTA CGAGGCGGTGCGGGAAGTCCTGCACGGGAACC AGCGCAAGCGCCGCAAGTTCCTGGAGACGGTG | 38 | XPGCQLLGVI AQEKLAECPG LIYQEHHGQA PAPILRHI* |

TABLE 3B-continued

| SEQ ID | identifier_position | position | modified RNA | PAP length | PAP |
|---|---|---|---|---|---|
| | | | GAGTTGCAGATCAGCTTGAAGAACTATGATCCC CAGAAGGACAAGCGCTTCTCGGGCACCGTCAG GCTTAAGTCCACTCCCCGCCCTAAGTTCTCTGT GTGTGTCCTGGGGGACCAGCAGCACTGTGACG AGGCTAAGGCCGTGGATATCCCCCACATGGACA TCGAGGCGCTGAAAAAACTCAACAAGAATAAAAA ACTGGTCAAGAAGCTGGCCAAGAAGTATGATGC GTTTTTTGGCCTCAGAGTCTCTGATCAAGCAGATT CCACGAATCCTCGGCCCAGGTTTAAATAAGGCA GGAAAGTTCCCTTCCCTGCTCACACACAACGAA AACATGGTGGCCAAAGTGGATGAGGTGAAGTCC ACAATCAAGTTCCAAATGAAGAAGGTGTTATGTC TGGCTGTAGCTGTTGGTCACGTGAAGATGACAG ACGATGAGCTTGTGTATAACATTNCACCTGGCTG TCAACTTCTTGGTGTCATTGCTCAAGAAAAACTG GCAGAATGTCCGGGCCTTATATATCAAGAGCAC CATGGGCAAGCCCCAGCGCCTATATTAAGGCAC ATTTGAATAAATTCTATTACCAGTTC | | |
| 3205 | NM_0071 04.4_624 | 624 | AGTCTCTTTTCCGGTTAGCGCGGCGTGAGAAGC CATGAGCAGCAAAGTCTCTCGCGACACCCTGTA CGAGGCGGTGCGGGAAGTCCTGCACGGGAACC AGCGCAAGCGCCGCAAGTTCCTGGAGACGGTG GAGTTGCAGATCAGCTTGAAGAACTATGATCCC CAGAAGGACAAGCGCTTCTCGGGCACCGTCAG GCTTAAGTCCACTCCCCGCCCTAAGTTCTCTGT GTGTGTCCTGGGGGACCAGCAGCACTGTGACG AGGCTAAGGCCGTGGATATCCCCCACATGGACA TCGAGGCGCTGAAAAAACTCAACAAGAATAAAAA ACTGGTCAAGAAGCTGGCCAAGAAGTATGATGC GTTTTTTGGCCTCAGAGTCTCTGATCAAGCAGATT CCACGAATCCTCGGCCCAGGTTTAAATAAGGCA GGAAAGTTCCCTTCCCTGCTCACACACAACGAA AACATGGTGGCCAAAGTGGATGAGGTGAAGTCC ACAATCAAGTTCCAAATGAAGAAGGTGTTATGTC TGGCTGTAGCTGTTGGTCACGTGAAGATGACAG ACGATGAGCTTGTGTATAACATTCACCTGGCTGT CAACTTCTTGGTGTCATTGCTCAAGAAAAANCTG GCAGAATGTCCGGGCCTTATATATCAAGAGCAC CATGGGCAAGCCCCAGCGCCTATATTAAGGCAC ATTTGAATAAATTCTATTACCAGTTC | 25 | XLAECPGLIYQ EHHGQAPAPI LRHI* |
| 3206 | NM_0071 04.4_638 | 638 | AGTCTCTTTTCCGGTTAGCGCGGCGTGAGAAGC CATGAGCAGCAAAGTCTCTCGCGACACCCTGTA CGAGGCGGTGCGGGAAGTCCTGCACGGGAACC AGCGCAAGCGCCGCAAGTTCCTGGAGACGGTG GAGTTGCAGATCAGCTTGAAGAACTATGATCCC CAGAAGGACAAGCGCTTCTCGGGCACCGTCAG GCTTAAGTCCACTCCCCGCCCTAAGTTCTCTGT GTGTGTCCTGGGGGACCAGCAGCACTGTGACG AGGCTAAGGCCGTGGATATCCCCCACATGGACA TCGAGGCGCTGAAAAAACTCAACAAGAATAAAAA ACTGGTCAAGAAGCTGGCCAAGAAGTATGATGC GTTTTTTGGCCTCAGAGTCTCTGATCAAGCAGATT CCACGAATCCTCGGCCCAGGTTTAAATAAGGCA GGAAAGTTCCCTTCCCTGCTCACACACAACGAA AACATGGTGGCCAAAGTGGATGAGGTGAAGTCC ACAATCAAGTTCCAAATGAAGAAGGTGTTATGTC TGGCTGTAGCTGTTGGTCACGTGAAGATGACAG ACGATGAGCTTGTGTATAACATTCACCTGGCTGT CAACTTCTTGGTGTCATTGCTCAAGAAAAACTGG CAGAATGTCCNGGGCCTTATATATCAAGAGCAC CATGGGCAAGCCCCAGCGCCTATATTAAGGCAC ATTTGAATAAATTCTATTACCAGTTC | 20 | XGLIYQEHHG QAPAPILRHI* |
| 3207 | NM_0073 55.2_193 | 193 | CTCCGGCGCAGTGTTGGGACTGTCTGGGTATCG GAAAGCAAGCCTACGTTGCTCACTATTACGTATA ATCCTTTTCTTTTCAAGATGCCTGAGGAAGTGCA CCATGGAGAGGAGGAGGTGGAGACTTTTGCCTT TCAGGCAGAAATTGCCCAACTCATGTCCCTCATC ATCAATACCTTCTATTCCAACAAGGNAGATTTTC CTTCGGGAGTTGATCTCTAATGCTTCTGATGCCT TGGACAAGATTCGCTATGAGAGCCTGACAGACC CTTCGAAGTTGGACAGTGGTAAAGAGCTGAAAA TTGACATCATCCCCAACCCTCAGGAACGTACCC TGACTTTGGTAGACACAGGCATTGGCATGACCA AAGCTGATCTCATAAATAATTTGGGAACCATTGC CAAGTCTGGTACTAAAGCATTCATGGAGGCTCTT CAGGCTGGTGCAGACATCTCCATGATTGGGCAG TTTGGTGTTGGCTTTTATTCTGCCTACTTGGTGG | 9 | XDFPSGVDL* |

TABLE 3B-continued

| SEQ ID | identifier_ position | position | modified RNA | PAP length | PAP |
|---|---|---|---|---|---|
| | | | CAGAGAAAGTGGTTGTGATCACAAAGCACAACG ATGATGAACAGTATGCTTGGGAGTCTTCTGCTG GAGGTTCCTTCACTGTGCGTGCTGACCATGGTG AGCCCATTGGCAGGGGTACCAAAGTGATCCTCC ATCTTAAAGAAGATCAGACAGAGTACCTAGAAGA GAGGCGGGTCAAAGAAGTAGTGAAGAAGCATTC TCAGTTCATAGGCTATCCCATCACCCTTTATTTG GAGAAGGAACGAGAGAAGGAAATTAGTGATGAT GAGGCAGAGGAAGAGAAAGGTGAGAAAGAAGA GGAAGATAAAGATGATGAAGAAAAACCCAAGAT CGAAGATGTGGGTTCAGATGAGGAGGATGACAG CGGTAAGGATAAGAAGAAGAAAACTAAGAAGAT CAAAGAGAAATACATTGATCAGGAAGAACTAAAC AAGACCAAGCCTATTTGGACCAGAAACCCTGAT GACATCACCCAAGAGGAGTATGGAGAATTCTAC AAGAGCCTCACTAATGACTGGGAA | | |
| 3208 | NM_0073 55.2_193 7 | 1937 | CTCCGGCGCAGTGTTGGGACTGTCTGGGTATCG GAAAGCAAGCCTACGTTGCTCACTATTACGTATA ATCCTTTTCTTTTCAAGATGCCTGAGGAAGTGCA CCATGGAGAGGAGGAGGTGGAGACTTTTGCCTT TCAGGCAGAAATTGCCCAACTCATGTCCCTCATC ATCAATACCTTCTATTCCAACAAGGAGATTTTCC TTCGGGAGTTGATCTCTAATGCTTCTGATGCCTT GGACAAGATTCGCTATGAGAGCCTGACAGACCC TTCGAAGTTGGACAGTGGTAAAGAGCTGAAAATT GACATCATCCCCAACCCTCAGGAACGTACCCTG ACTTTGGTAGACACAGGCATTGGCATGACCAAA GCTGATCTCATAAATAATTTGGGAACCATTGCCA AGTCTGGTACTAAAGCATTCATGGAGGCTCTTCA GGCTGGTGCAGACATCTCCATGATTGGGCAGTT TGGTGTTGGCTTTTATTCTGCCTACTTGGTGGCA GAGAAAGTGGTTGTGATCACAAAGCACAACGAT GATGAACAGTATGCTTGGGAGTCTTCTGCTGGA GGTTCCTTCACTGTGCGTGCTGACCATGGTGAG CCCATTGGCAGGGGTACCAAAGTGATCCTCCAT CTTAAAGAAGATCAGACAGAGTACCTAGAAGAG AGGCGGGTCAAAGAAGTAGTGAAGAAGCATTCT CAGTTCATAGGCTATCCCATCACCCTTTATTTGG AGAAGGAACGAGAGAAGGAAATTAGTGATGATG AGGCAGAGGAAGAGAAAGGTGAGAAAGAAGAG GAAGATAAAGATGATGAAGAAAAACCCAAGATC GAAGATGTGGGTTCAGATGAGGAGGATGACAGC GGTAAGGATAAGAAGAAGAAAACTAAGAAGATC AAAGAGAAATACATTGATCAGGAAGAACTAAACA AGACCAAGCCTATTTGGACCAGAAACCCTGATG ACATCACCCAAGAGGAGTATGGAGAATTCTACA AGAGCCTCACTAATGACTGGGAAG | 12 | LYDGQKAPGD QP* |
| 3209 | NM_0073 55.2_692 | 692 | CTCCGGCGCAGTGTTGGGACTGTCTGGGTATCG GAAAGCAAGCCTACGTTGCTCACTATTACGTATA ATCCTTTTCTTTTCAAGATGCCTGAGGAAGTGCA CCATGGAGAGGAGGAGGTGGAGACTTTTGCCTT TCAGGCAGAAATTGCCCAACTCATGTCCCTCATC ATCAATACCTTCTATTCCAACAAGGAGATTTTCC TTCGGGAGTTGATCTCTAATGCTTCTGATGCCTT GGACAAGATTCGCTATGAGAGCCTGACAGACCC TTCGAAGTTGGACAGTGGTAAAGAGCTGAAAATT GACATCATCCCCAACCCTCAGGAACGTACCCTG ACTTTGGTAGACACAGGCATTGGCATGACCAAA GCTGATCTCATAAATAATTTGGGAACCATTGCCA AGTCTGGTACTAAAGCATTCATGGAGGCTCTTCA GGCTGGTGCAGACATCTCCATGATTGGGCAGTT TGGTGTTGGCTTTTATTCTGCCTACTTGGTGGCA GAGAAAGTGGTTGTGATCACAAAGCACAACGAT GATGAACAGTATGCTTGGGAGTCTTCTGCTGGA GGTTCCTTCACTGTGCGTGCTGACCATGGTGAG CCCATTGGCAGGGGTACCAAAGTGATCCTCCAT CTTAAAGAAGATCAGACAGAGTACCTAGAAGAG AGGCGGGTCAAAGAAGTAGTGAANGAAGCATTC TCAGTTCATAGGCTATCCCATCACCCTTTATTTG GAGAAGGAACGAGAGAAGGAAATTAGTGATGAT GAGGCAGAGGAAGAGAAAGGTGAGAAAGAAGA GGAAGATAAAGATGATGAAGAAAAACCCAAGAT CGAAGATGTGGGTTCAGATGAGGAGGATGACAG CGGTAAGGATAAGAAGAAGAAAACTAAGAAGAT CAAAGAGAAATACATTGATCAGGAAGAACTAAAC AAGACCAAGCCTATTTGGACCAGAAACCCTGAT | 23 | XEAFSVHRLS HHPLFGEGTR EGN* |

TABLE 3B-continued

| SEQ ID | identifier_ position | position | modified RNA | PAP length | PAP |
|---|---|---|---|---|---|
| 3210 | NM_0124 23.2_242 | 242 | GACATCACCCAAGAGGAGTATGGAGAATTCTAC AAGAGCCTCACTAATGACTGGGAA CTTTTCCAAGCGGCTGCCGAAGATGGCGGAGGT GCAGGTCCTGGTGCTTGATGGTCGAGGCCATCT CCTGGGCCGCCTGGCGGCCATCGTGGCTAAAC AGGTACTGCTGGGCCGGAAGGTGGTGGTCGTA CGCTGTGAAGGCATCAACATTTCTGGCAATTTCT ACAGAAACAAGTTGAAGTACCTGGCTTTCCTCC GCAAGCGGATGAACACCAACCCTTCCCGAGGCC CCTACCACTTCCNGGGCCCCCAGCCGCATCTTC TGGCGGACCGTGCGAGGTATGCTGCCCCACAA AACCAAGCGAGGCCAGGCCGCTCTGGACCGTC TCAAGGTGTTTGACGGCATCCCACCGCCCTACG ACAAGAAAAAGCGGATGGTGGTTCCTGCTGCCC TCAAGGTCGTGCGTCTGAAGCCTACAAGAAAGT TTGCCTATCTGGGGCGCCTGGCTCACGAGGTTG GCTGGAAGTACCAGGCAGTGACAGCCACCCTG GAGGAGAAGAGGAAAGAGAAAGCCAAGATCCA CTACCGGAAGAAGAAACAGCTCATGAGGCTACGG AAACAGGCCGAGAAGAACGTGGAGAAGAAAATT GACAAATACACAGAGGTCCTCAAGACCCACGGA CTCCTGGTCTGAGCCCAATAAAGACTGTTAATTC CTCATGCGTTGCCTGCCCTTCCTCCATTGTTGCC CTGGAATGTACGGGACCCAGGGGCAGCAGCAG TCCAGGTGCCACAGGCAGCCCTGGGACATAGG AAGCTGGGAGCAAGGAAAGGGTCTTAGTCACTG CCTCCCGAAGTTGCTTGAAAGCACTCGGAGAAT TGTGCAGGTGTCATTTATCTATGACCAATAGGAA GAGCAACCAGTTACTATGAGTGAAAGGGAGCCA GAAGACTGATTGGAGGGCCCTATCTTGTGAGTG GGGCATCTGTTGGACTTTCCACCTGGTCATATAC TCTGCAGCTGTTAGAATGTGCAAGCACTTGGGG ACAGCATGAGCTTGCTGTTGTACACAGGGTATTT CT | 32 | XGPQPHLLAD RARYAAPQN QARPGRSGP SQGV* |
| 3211 | NM_0124 23.2_498 | 498 | CTTTTCCAAGCGGCTGCCGAAGATGGCGGAGGT GCAGGTCCTGGTGCTTGATGGTCGAGGCCATCT CCTGGGCCGCCTGGCGGCCATCGTGGCTAAAC AGGTACTGCTGGGCCGGAAGGTGGTGGTCGTA CGCTGTGAAGGCATCAACATTTCTGGCAATTTCT ACAGAAACAAGTTGAAGTACCTGGCTTTCCTCC GCAAGCGGATGAACACCAACCCTTCCCGAGGCC CCTACCACTTCCGGGCCCCCAGCCGCATCTTCT GGCGGACCGTGCGAGGTATGCTGCCCCACAAA ACCAAGCGAGGCCAGGCCGCTCTGGACCGTCT CAAGGTGTTTGACGGCATCCCACCGCCCTACGA CAAGAAAAAGCGGATGGTGGTTCCTGCTGCCCT CAAGGTCGTGCGTCTGAAGCCTACAAGAAAGTT TGCCTATCTGGGGCGCCTGGCTCACGAGGTTG GCTGGAAGTACCAGGCAGTGACAGCCACCCTG GAGGAGAANGAGGAAAGAGAAAGCCAAGATCCA CTACCGGAAGAAGAAACAGCTCATGAGGCTACG GAAACAGGCCGAGAAGAACGTGGAGAAGAAAAT TGACAAATACACAGAGGTCCTCAAGACCCACGG ACTCCTGGTCTGAGCCCAATAAAGACTGTTAATT CCTCATGCGTTGCCTGCCCTTCCTCCATTGTTGC CCTGGAATGTACGGGACCCAGGGGCAGCAGCA GTCCAGGTGCCACAGGCAGCCCTGGGACATAG GAAGCTGGGAGCAAGGAAAGGGTCTTAGTCACT GCCTCCCGAAGTTGCTTGAAAGCACTCGGAGAA TTGTGCAGGTGTCATTTATCTATGACCAATAGGA AGAGCAACCAGTTACTATGAGTGAAAGGGAGCC AGAAGACTGATTGGAGGGCCCTATCTTGTGAGT GGGGCATCTGTTGGACTTTCCACCTGGTCATAT ACTCTGCAGCTGTTAGAATGTGCAAGCACTTGG GGACAGCATGAGCTTGCTGTTGTACACAGGGTA TTTCT | 31 | XEERESQDPL PEEETAHEAT ETGREERGEE N* |
| 3212 | NM_0124 23.2_504 | 504 | CTTTTCCAAGCGGCTGCCGAAGATGGCGGAGGT GCAGGTCCTGGTGCTTGATGGTCGAGGCCATCT CCTGGGCCGCCTGGCGGCCATCGTGGCTAAAC AGGTACTGCTGGGCCGGAAGGTGGTGGTCGTA CGCTGTGAAGGCATCAACATTTCTGGCAATTTCT ACAGAAACAAGTTGAAGTACCTGGCTTTCCTCC GCAAGCGGATGAACACCAACCCTTCCCGAGGCC CCTACCACTTCCGGGCCCCCAGCCGCATCTTCT GGCGGACCGTGCGAGGTATGCTGCCCCACAAA ACCAAGCGAGGCCAGGCCGCTCTGGACCGTCT CAAGGTGTTTGACGGCATCCCACCGCCCTACGA | 29 | XRESQDPLPE EETAHEATET GREERGEEN* |

TABLE 3B-continued

| SEQ ID | identifier_position | position | modified RNA | PAP length | PAP |
|---|---|---|---|---|---|
| | | | CAAGAAAAAGCGGATGGTGGTTCCTGCTGCCCT<br>CAAGGTCGTGCGTCTGAAGCCTACAAGAAAGTT<br>TGCCTATCTGGGGCGCCTGGCTCACGAGGTTG<br>GCTGGAAGTACCAGGCAGTGACAGCCACCCTG<br>GAGGAGAAGAGGAANAGAGAAAGCCAAGATCCA<br>CTACCGGAAGAAGAAACAGCTCATGAGGCTACG<br>GAAACAGGCCGAGAAGAACGTGGAGAAGAAAAT<br>TGACAAATACACAGAGGTCCTCAAGACCCACGG<br>ACTCCTGGTCTGAGCCCAATAAAGACTGTTAATT<br>CCTCATGCGTTGCCTGCCCTTCCTCCATTGTTGC<br>CCTGGAATGTACGGGACCCAGGGGCAGCAGCA<br>GTCCAGGTGCCACAGGCAGCCCTGGGACATAG<br>GAAGCTGGGAGCAAGGAAAGGGTCTTAGTCACT<br>GCCTCCCGAAGTTGCTTGAAAGCACTCGGAGAA<br>TTGTGCAGGTGTCATTTATCTATGACCAATAGGA<br>AGAGCAACCAGTTACTATGAGTGAAAGGGAGCC<br>AGAAGACTGATTGGAGGGCCCTATCTTGTGAGT<br>GGGGCATCTGTTGGACTTTCCACCTGGTCATAT<br>ACTCTGCAGCTGTTAGAATGTGCAAGCACTTGG<br>GGACAGCATGAGCTTGCTGTTGTACACAGGGTA<br>TTTCT | | |
| 3213 | NM_0124<br>23.2_582 | 582 | CTTTTCCAAGCGGCTGCCGAAGATGGCGGAGGT<br>GCAGGTCCTGGTGCTTGATGGTCGAGGCCATCT<br>CCTGGGCCGCCTGGCGGCCATCGTGGCTAAAC<br>AGGTACTGCTGGGCCGGAAGGTGGTGGTCGTA<br>CGCTGTGAAGGCATCAACATTTCTGGCAATTTCT<br>ACAGAAACAAGTTGAAGTACCTGGCTTTCCTCC<br>GCAAGCGGATGAACACCAACCCTTCCCGAGGCC<br>CCTACCACTTCCGGGCCCCCAGCCGCATCTTCT<br>GGCGGACCGTGCGAGGTATGCTGCCCCACAAA<br>ACCAAGCGAGGCCAGGCCGCTCTGGACCGTCT<br>CAAGGTGTTTGACGGCATCCCACCGCCCTACGA<br>CAAGAAAAAGCGGATGGTGGTTCCTGCTGCCCT<br>CAAGGTCGTGCGTCTGAAGCCTACAAGAAAGTT<br>TGCCTATCTGGGGCGCCTGGCTCACGAGGTTG<br>GCTGGAAGTACCAGGCAGTGACAGCCACCCTG<br>GAGGAGAAGAGGAAAGAGAAAGCCAAGATCCAC<br>TACCGGAAGAAGAAACAGCTCATGAGGCTACGG<br>AAACAGGCCGAGAAGAACGTGGAGAAGAAAAT<br>TGACAAATACACAGAGGTCCTCAAGACCCACGG<br>ACTCCTGGTCTGAGCCCAATAAAGACTGTTAATT<br>CCTCATGCGTTGCCTGCCCTTCCTCCATTGTTGC<br>CCTGGAATGTACGGGACCCAGGGGCAGCAGCA<br>GTCCAGGTGCCACAGGCAGCCCTGGGACATAG<br>GAAGCTGGGAGCAAGGAAAGGGTCTTAGTCACT<br>GCCTCCCGAAGTTGCTTGAAAGCACTCGGAGAA<br>TTGTGCAGGTGTCATTTATCTATGACCAATAGGA<br>AGAGCAACCAGTTACTATGAGTGAAAGGGAGCC<br>AGAAGACTGATTGGAGGGCCCTATCTTGTGAGT<br>GGGGCATCTGTTGGACTTTCCACCTGGTCATAT<br>ACTCTGCAGCTGTTAGAATGTGCAAGCACTTGG<br>GGACAGCATGAGCTTGCTGTTGTACACAGGGTA<br>TTTCT | 3 | XEN* |
| 3214 | NM_0124<br>23.2_592 | 592 | CTTTTCCAAGCGGCTGCCGAAGATGGCGGAGGT<br>GCAGGTCCTGGTGCTTGATGGTCGAGGCCATCT<br>CCTGGGCCGCCTGGCGGCCATCGTGGCTAAAC<br>AGGTACTGCTGGGCCGGAAGGTGGTGGTCGTA<br>CGCTGTGAAGGCATCAACATTTCTGGCAATTTCT<br>ACAGAAACAAGTTGAAGTACCTGGCTTTCCTCC<br>GCAAGCGGATGAACACCAACCCTTCCCGAGGCC<br>CCTACCACTTCCGGGCCCCCAGCCGCATCTTCT<br>GGCGGACCGTGCGAGGTATGCTGCCCCACAAA<br>ACCAAGCGAGGCCAGGCCGCTCTGGACCGTCT<br>CAAGGTGTTTGACGGCATCCCACCGCCCTACGA<br>CAAGAAAAAGCGGATGGTGGTTCCTGCTGCCCT<br>CAAGGTCGTGCGTCTGAAGCCTACAAGAAAGTT<br>TGCCTATCTGGGGCGCCTGGCTCACGAGGTTG<br>GCTGGAAGTACCAGGCAGTGACAGCCACCCTG<br>GAGGAGAAGAGGAAAGAGAAAGCCAAGATCCAC<br>TACCGGAAGAAGAAACAGCTCATGAGGCTACGG<br>AAACAGGCCGAGAAGAACGTGGAGAAGAAAAT<br>GACNAAATACACAGAGGTCCTCAAGACCCACGG<br>ACTCCTGGTCTGAGCCCAATAAAGACTGTTAATT<br>CCTCATGCGTTGCCTGCCCTTCCTCCATTGTTGC<br>CCTGGAATGTACGGGACCCAGGGGCAGCAGCA<br>GTCCAGGTGCCACAGGCAGCCCTGGGACATAG<br>GAAGCTGGGAGCAAGGAAAGGGTCTTAGTCACT | 53 | XIHRGPQDPR<br>TPGLSPIKTVN<br>SSCVACPSSI<br>VALECTGPRG<br>SSSPGATGSP<br>GT* |

TABLE 3B-continued

| SEQ ID | identifier_ position | position | modified RNA | PAP length | PAP |
|---|---|---|---|---|---|
| | | | GCCTCCCGAAGTTGCTTGAAAGCACTCGGAGAA TTGTGCAGGTGTCATTTATCTATGACCAATAGGA AGAGCAACCAGTTACTATGAGTGAAAGGGAGCC AGAAGACTGATTGGAGGGCCCTATCTTGTGAGT GGGGCATCTGTTGGACTTTCCACCTGGTCATAT ACTCTGCAGCTGTTAGAATGTGCAAGCACTTGG GGACAGCATGAGCTTGCTGTTGTACACAGGGTA TTTCT | | |
| 3215 | NM_0140 56.3_352 | 352 | GATTGGCTGGGACGGCTGTGGGTGGGGAGAAG CCGGGAGGACTGGGTGCGCCTGCAGGGATCGG AAGCCGGTTGGGGTGTGAGAGGTTTTCTCGCTC TAGGGAGATTCTTCAAGCAATCACTATGTCAACA GACACAGGTGTTTCCCTTCCTTCATATGAGGAAG ATCAGGGATCAAAACTCATTCGAAAAGCTAAAGA GGCACCATTCGTACCCGTTGGAATAGCGGGTTT TGCAGCAATTGTTGCATATGGATTATATAAACTG AAGAGCAGGGGAAATACTAAAATGTCCATTCATC TGATCCACATGCGTGTGGCAGCCCAAGGCTTTG TTGTAGGAGCAATGACTGTNTGGTATGGGCTATT CCATGTATCGGGAATTCTGGGCAAAACCTAAGC CTTAGAAGAAGAGATGCTGTCTTGGTCTTGTTGG AGGAGCTTGCTTTAGTTAGATGTCTTATTATTAA GTTACCTATTATTGTTGGAAATAAACTAATTTGTA TGGGTTTAGATGGTAACATGGCATTTTGAATATT GGCTTCCTTTCTTGCAGGCTTGATTTGCTTGGTG ACCGAATTACTAGTGACTAGTTTACTAACTAGGT CATTCAAGGAAGTCAAGTTAACTTAAACATGTCA CCTAAATGCACTTGATGGTGTTGAAATGTCCACC TTCTTAAATTTTTAAGATGAACTTAGTTCTAAAGA AGATAACAGGCCAATCCTGAAGGTACTCCCTGT TTGCTGCAGAATGTCAGATATTTTGGATGTTGCA TAAGAGTCCTATTTGCCCCAGTTAATTCAACTTTT GTCTGCCTGTTTTGTGGACTGGCTGGCTCTGTT AGAACTCTGTCCAAAAAGTGCATGGAATATAACT TGTAAAGCTTCCCACAATTGACAATATATATGCA TGTGTTTAAACCAAATCCAGAAAGCTTAAACAAT AGAGCTGCATAATAGTATTTATTAAAGAATCACA ACTGTAAACATGAGAATAATTTAAGGATTCTAGT TTAGTTTTTT | 14 | WYGLFHVSGI LGKT* |
| 3216 | NM_0140 56.3_387 | 387 | GATTGGCTGGGACGGCTGTGGGTGGGGAGAAG CCGGGAGGACTGGGTGCGCCTGCAGGGATCGG AAGCCGGTTGGGGTGTGAGAGGTTTTCTCGCTC TAGGGAGATTCTTCAAGCAATCACTATGTCAACA GACACAGGTGTTTCCCTTCCTTCATATGAGGAAG ATCAGGGATCAAAACTCATTCGAAAAGCTAAAGA GGCACCATTCGTACCCGTTGGAATAGCGGGTTT TGCAGCAATTGTTGCATATGGATTATATAAACTG AAGAGCAGGGGAAATACTAAAATGTCCATTCATC TGATCCACATGCGTGTGGCAGCCCAAGGCTTTG TTGTAGGAGCAATGACTGTTGGTATGGGCTATTC CATGTATCGGGAATTCTGGGNCAAAACCTAAGC CTTAGAAGAAGAGATGCTGTCTTGGTCTTGTTGG AGGAGCTTGCTTTAGTTAGATGTCTTATTATTAAA GTTACCTATTATTGTTGGAAATAAACTAATTTGTA TGGGTTTAGATGGTAACATGGCATTTTGAATATT GGCTTCCTTTCTTGCAGGCTTGATTTGCTTGGTG ACCGAATTACTAGTGACTAGTTTACTAACTAGGT CATTCAAGGAAGTCAAGTTAACTTAAACATGTCA CCTAAATGCACTTGATGGTGTTGAAATGTCCACC TTCTTAAATTTTTAAGATGAACTTAGTTCTAAAGA AGATAACAGGCCAATCCTGAAGGTACTCCCTGT TTGCTGCAGAATGTCAGATATTTTGGATGTTGCA TAAGAGTCCTATTTGCCCCAGTTAATTCAACTTTT GTCTGCCTGTTTTGTGGACTGGCTGGCTCTGTT AGAACTCTGTCCAAAAAGTGCATGGAATATAACT TGTAAAGCTTCCCACAATTGACAATATATATGCA TGTGTTTAAACCAAATCCAGAAAGCTTAAACAAT AGAGCTGCATAATAGTATTTATTAAAGAATCACA ACTGTAAACATGAGAATAATTTAAGGATTCTAGT TTAGTTTTTT | 3 | XKT* |
| 3217 | NM_0147 13.3_753 | 753 | GCGCTCAGTGCGCAGGCGCGAAGAAGCTGGCA GGGGCACGAGCCGGGGGCGGGTTTGAAGACGC GTCGTTGGGTTTTGGAGGCCGTGAAACAGCCGT TTGAGTTTGGCTGCGGGTGGAGAACGTTTGTCA GGGGCCCGGCCAAGAAGGAGGCCCGCCTGTTA CGATGGTGTCCATGAGTTTCAAGCGGAACCGCA GTGACCGGTTCTACAGCACCCGGTGCTGCGGCT | 8 | XDCCVPCL* |

TABLE 3B-continued

| SEQ ID | identifier_ position | position | modified RNA | PAP length | PAP |
|---|---|---|---|---|---|
| | | | GTTGCCATGTCCGCACCGGGACGATCATCCTGG GGACCTGGTACATGGTAGTAAACCTATTGATGG CAATTTTGCTGACTGTGGAAGTGACTCATCCAAA CTCCATGCCAGCTGTCAACATTCAGTATGAAGTC ATCGGTAATTACTATTCGTCTGAGAGAATGGCTG ATAATGCCTGTGTTCTTTTTGCCGTCTCTGTTCTT ATGTTTATAATCAGTTCAATGCTGGTTTATGGAG CAATTTCTTATCAAGTGGGTTGGCTGATTCCATT CTTCTGTTACCGACTTTTTGACTTCGTCCTCAGT TGCCTGGTTGCTATTAGTTCTCTCACCTATTTGC CAAGAATCAAAGAATATCTGGATCAACTACCTGA TTTTCCCTACAAAGATGACCTCCTGGCCTTGGAC TCCAGCTGCCTCCTGTTCATTGTTCTTGTGTTCT TTGCCTTATTCATCATTTTTAAGGCTTATCTAATT AACTGTGTTTGGAACTGCTATAAATACATCAACA ACCGAAACGTGCCGGNAGATTGCTGTGTACCCT GCCTTTGAAGCACCTCCTCAGTACGTTTTGCCAA CCTATGAAATGGCCGTGAAAATGCCTGAAAAAG AACCACCACCTCCTTACTTACCTGCCTGAAGAAA TTCTGCCTTTGACAATAAATCCTATACCAGCTTTT TGTTTGTTTATGTTACAGAATGCTGCAATTCAGG GCTCTTCAAACTTGTTTGATATAAAATATGTTGTC TTTTGTTTAAGCATTTATTTTCAAACACTAAGGAG CTTTTTGACATCT | | |
| 3218 | NM_0151 61.1_107 | 107 | GTGCGGGTTTCGGTTGGAGGACTCGTTGGGGA GGTGGCCTGCGCTTGTAGAGACTGCATCCCCGA GACGATGGCGGAGGGAGATAATCGCAGCACCA ACCTGCTGGCNTGCAGAGACTGCAAGTCTGGAA GAACAGCTGCAAGGATGGGGAGAAGTGATGCT GATGGCTGATAAAGTCCTCCGATGGGAAAGAGC CTGGTTTCCACCTGCCATCATGGGTGTGGTTTCT TTGGTGTTTCTGATTATCTACTATCTAGATCCATC TGTTCTGTCCGGCGTTTCCTGTTTTGTTATGTTTT TGTGCTTGGCTGACTACCTTGTTCCCATTCTAGC GCCTAGAATTTTTGGCTCCAATAAATGGACCACT GAACAACAGCAAAGATTCCATGAAATTTGCAGCA ATCTAGTAAAAACTCGACGCAGAGCTGTGGGTT GGTGGAAACGCCTCTTCACACTAAAGGAAGAAA AACCTAAGATGTACTTCATGACCATGATCGTTTC CCTTGCTGCGGTTGCTTGGGTGGGACAACAAGT CCACAACCTGCTTCTCACCTACCTGATAGTGACT TCCTTACTATTGCTTCCTGGACTAAACCAACATG GAATCATTTTGAAGTACATTGGAATGGCCAAGAG GGAGATAAACAAACTTCTCAAACAAAAAGAAAAG AAAAACGAATGATTCATCTGCTTTAATCAGTGTG ATTAATGCAGCACCCATTGCCCCGGGAACCGTT TCTGCTGTACTATCTGGATACTAAAAATGTTACGG AAGTAGCTCTTTGTTCTCCCTCACTCTGCCCTTA GTTAATAGAAATTCAGACTCGCCAAGTAAGGCTT CGTGCATAGTGTCTTCATGTCGCGTATAGTTGAG CGCGTTCTTAGCAGTTGGCTTCATGGACAACTC ATTAGTGTTTTGACTTTTCTTACCCAGCGTTAATT GAATTCTTGCTTTTAGACAACTTCCTTTTTGTAGT GGTGAACCTTGCCCTTTAGTACAGTTCAAGTGAA TCTGGATAATTGTT | 20 | CRDCKSGRTA ARMGRSDAD G* |
| 3219 | NM_0157 02.1_172 | 172 | ATTCGGCACCGCAGCGTAGGTGCTACCACCGCT GCCGTCGCCGCCGCCATTTTGATGGCAGGAAGA GTCCGGTTCTGGGACAGCTGGAGACAGTGGTG GTGACTGAAATAACTTTACCAAAGGAAAGCTATT TTGCGAACTATCTTCTCCAGCGGAGATGGCCAA TGTGCTTNTGTAACAGAGCCAGACTGGTTTCCTA TCTCCCAGGATTTTGCTCTTTAGTTAAAAGGGTT GTCAATCCCAAAGCCTTTTCGACTGCAGGATCAT CAGGTTCGGATGAGTCTCATGTGGCTGCTGCAC CTCCAGATATATGCTCTCGAACAGTGTGGCCTG ATGAAACTATGGGACCCTTTGGACCTCAAGATCA GAGGTTCCAGCTTCCTGGGAACATAGGTTTTGA TTGTCACCTCAATGGGACTGCTTCACAGAAGAAA AGCCTGGTTCATAAAACTTTGCCTGATGTTCTAG CAGAACCTTTATCAAGTGAAAGACATGAGTTTGT GATGGCACAATATGTGAATGAATTTCAGGGTAAT GATGCACCTGTTGAACAAGAAATTAACAGTGCA GAAACTTACTTTGAAAGTGCCAGAGTAGAGTGT GCAATACAAACATGTCCAGAATTGCTGCGAAAA GATTTTGAATCACTGTTTCCAGAAGTAGCTAATG GCAAACTAATGATTCTGACTGTAACACAAAAAAC TAAGAATGATATGACTGTTTGGAGTGAAGAAGTA | 1 | X* |

TABLE 3B-continued

| SEQ ID | identifier_position | position | modified RNA | PAP length | PAP |
|---|---|---|---|---|---|
| | | | GAAATTGAAAGAGAAGTGCTCTTAGAAAAGTTCA TCAATGGTGCTAAGGAAATTTGCTATGCTCTTCG AGCTGAGGGTTATTGGGCTGACTTTATTGACCC ATCATCTGGTTTGGCATTTTTTGGACCATATACA AACAACACTCTTTTTGAAACTGATGAACGCTACC GACATTTAGGATTCTCTGTTGATGACCTTGGATG CTGTAAAGTGATTCGTCATAGTCTCTGGGGTACC CATGTAGTTGTAGGGAGTATCTTCACTAATGCAA CACCAGACAGCCATAT | | |
| 3220 | NM_0157 02.1_452 | 452 | ATTCGGCACCGCAGCGTAGGTGCTACCACCGCT GCCGTCGCCGCCGCCATTTTGATGGCAGGAAGA GTCCGGTTCTGGGACAGCTGGAGACAGTGGTG GTGACTGAAATAACTTTACCAAAGGAAAGCTATT TTGCGAACTATCTTCTCCAGCGGAGATGGCCAA TGTGCTTTGTAACAGAGCCAGACTGGTTTCCTAT CTCCCAGGATTTTGCTCTTTAGTTAAAAGGGTTG TCAATCCCAAAGCCTTTTCGACTGCAGGATCATC AGGTTCGGATGAGTCTCATGTGGCTGCTGCACC TCCAGATATATGCTCTCGAACAGTGTGGCCTGAT GAAACTATGGGACCCTTTGGACCTCAAGATCAG AGGTTCCAGCTTCCTGGGAACATAGGTTTTGATT GTCACCTCAATGGGACTGCTTCACAGAAGAAAA GCCTGGTTCATAAAACTTNTGCCTGATGTTCTAG CAGAACCTTTATCAAGTGAAAGACATGAGTTTGT GATGGCACAATATGTGAATGAATTTCAGGGTAAT GATGCACCTGTTGAACAAGAAATTAACAGTGCA GAAACTTACTTTGAAAGTGCCAGAGTAGAGTGT GCAATACAAACATGTCCAGAATTGCTGCGAAAA GATTTTGAATCACTGTTTCCAGAAGTAGCTAATG GCAAACTAATGATTCTGACTGTAACACAAAAAAC TAAGAATGATATGACTGTTTGGAGTGAAGAAGTA GAAATTGAAAGAGAAGTGCTCTTAGAAAAGTTCA TCAATGGTGCTAAGGAAATTTGCTATGCTCTTCG AGCTGAGGGTTATTGGGCTGACTTTATTGACCC ATCATCTGGTTTGGCATTTTTTGGACCATATACA AACAACACTCTTTTTGAAACTGATGAACGCTACC GACATTTAGGATTCTCTGTTGATGACCTTGGATG CTGTAAAGTGATTCGTCATAGTCTCTGGGGTACC CATGTAGTTGTAGGGAGTATCTTCACTAATGCAA CACCAGACAGCCATAT | 2 | XA* |
| 3221 | NM_0157 02.1_579 | 579 | ATTCGGCACCGCAGCGTAGGTGCTACCACCGCT GCCGTCGCCGCCGCCATTTTGATGGCAGGAAGA GTCCGGTTCTGGGACAGCTGGAGACAGTGGTG GTGACTGAAATAACTTTACCAAAGGAAAGCTATT TTGCGAACTATCTTCTCCAGCGGAGATGGCCAA TGTGCTTTGTAACAGAGCCAGACTGGTTTCCTAT CTCCCAGGATTTTGCTCTTTAGTTAAAAGGGTTG TCAATCCCAAAGCCTTTTCGACTGCAGGATCATC AGGTTCGGATGAGTCTCATGTGGCTGCTGCACC TCCAGATATATGCTCTCGAACAGTGTGGCCTGAT GAAACTATGGGACCCTTTGGACCTCAAGATCAG AGGTTCCAGCTTCCTGGGAACATAGGTTTTGATT GTCACCTCAATGGGACTGCTTCACAGAAGAAAA GCCTGGTTCATAAAACTTTGCCTGATGTTCTAGC AGAACCTTTATCAAGTGAAAGACATGAGTTTGTG ATGGCACAATATGTGAATGAATTTCAGGGTAATG ATGCACCTGTTGAACAAGAAATTAACAGTGCAGA AACTTACTTNTGAAAGTGCCAGAGTAGAGTGTG CAATACAAACATGTCCAGAATTGCTGCGAAAAGA TTTTGAATCACTGTTTCCAGAAGTAGCTAATGGC AAACTAATGATTCTGACTGTAACACAAAAAACTA GAATGATATGACTGTTTGGAGTGAAGAAGTAGA AATTGAAAGAGAAGTGCTCTTAGAAAAGTTCATC AATGGTGCTAAGGAAATTTGCTATGCTCTTCGAG CTGAGGGTTATTGGGCTGACTTTATTGACCCATC ATCTGGTTTGGCATTTTTTGGACCATATACAAAC AACACTCTTTTTGAAACTGATGAACGCTACCGAC ATTTAGGATTCTCTGTTGATGACCTTGGATGCTG TAAAGTGATTCGTCATAGTCTCTGGGGTACCCAT GTAGTTGTAGGGAGTATCTTCACTAATGCAACAC CAGACAGCCATAT | 1 | X* |
| 3222 | NM_0160 91.2_688 | 688 | CCGAGTGGGGCTGAACTTCCGGCCTCAGGACG CAGGCGCGGGCCGCTCATTTCGCTCTTTCCGGC GGTGCTCGCAAGCGAGGCAGCCATGTCTTATCC CGCTGATGATTATGAGTCTGAGGCGGCTTATGA CCCCTACGCTTATCCCAGCGACTATGATATGCA CACAGGAGATCCAAAGCAGGACCTTGCTTATGA | 2 | XL* |

TABLE 3B-continued

| SEQ ID | identifier_ position | position | modified RNA | PAP length | PAP |
|---|---|---|---|---|---|
| | | | ACGTCAGTATGAACAGCAAACCTATCAGGTGAT CCCTGAGGTGATCAAAAACTTCATCCAGTATTTC CACAAAACTGTCTCAGATTTGATTGACCAGAAAG TGTATGAGCTACAGGCCAGTCGTGTCTCCAGTG ATGTCATTGACCAGAAGGTGTATGAGATCCAGG ACATCTATGAGAACAGCTGGACCAAGCTGACTG AAAGATTCTTCAAGAATACACCTTGGCCCGAGG CTGAAGCCATTGCTCCACAGGTTGGCAATGATG CTGTCTTCCTGATTTTATACAAAGAATTATACTAC AGGCACATATATGCCAAAGTCAGTGGGGGACCT TCCTTGGAGCAGAGGTTTGAATCCTATTACAACT ACTGCAATCTCTTCAACTACATTCTTAATGCCGA TGGTCCTGCTCCCCTTGAACTACCCAACCAGTG GCTCTGGGATATTATCGATGAGTTCATCTACCAG TTTCAGTCATTCAGTCAGTACCNGCTGTAAGACT GCCAAGAAGTCAGAGGAGGAGATTGACTTTCTT CGTTCCAATCCCAAAATCTGGAATGTTCATAGTG TCCTCAATGTCCTTCATTCCTGGTAGACAAATC CAACATCAACCGACAGTTGGAGGTATACACAAG CGGAGGTGACCCTGAGAGTGTGGCTGGGGAGT ATGGGCGGCACTCCCTCTACAAAATGCTTGGTT ACTTCAGCCTGGTCGGGCTTCTCCGCCTGCACT CCCTGTTAGGAGATTACTACCAGGCCATCAAGG TGCTGGAGAACATCGAACTGAACAAGAAGAGTA TGTATTCCCGTGTGCCAGAGTGCCAG | | |
| 3223 | NM_0160 91.2_862 | 862 | CCGAGTGGGGCTGAACTTCCGGCCTCAGGACG CAGGCGCGGGCCGCTCATTTCGCTCTTTCCGGC GGTGCTCGCAAGCGAGGCAGCCATGTCTTATCC CGCTGATGATTATGAGTCTGAGGCGGCTTATGA CCCCTACGCTTATCCCAGCGACTATGATATGCA CACAGGAGATCCAAAGCAGGACCTTGCTTATGA ACGTCAGTATGAACAGCAAACCTATCAGGTGAT CCCTGAGGTGATCAAAAACTTCATCCAGTATTTC CACAAAACTGTCTCAGATTTGATTGACCAGAAAG TGTATGAGCTACAGGCCAGTCGTGTCTCCAGTG ATGTCATTGACCAGAAGGTGTATGAGATCCAGG ACATCTATGAGAACAGCTGGACCAAGCTGACTG AAAGATTCTTCAAGAATACACCTTGGCCCGAGG CTGAAGCCATTGCTCCACAGGTTGGCAATGATG CTGTCTTCCTGATTTTATACAAAGAATTATACTAC AGGCACATATATGCCAAAGTCAGTGGGGGACCT TCCTTGGAGCAGAGGTTTGAATCCTATTACAACT ACTGCAATCTCTTCAACTACATTCTTAATGCCGA TGGTCCTGCTCCCCTTGAACTACCCAACCAGTG GCTCTGGGATATTATCGATGAGTTCATCTACCAG TTTCAGTCATTCAGTCAGTACCGCTGTAAGACTG CCAAGAAGTCAGAGGAGGAGATTGACTTTCTTC GTTCCAATCCCAAAATCTGGAATGTTCATAGTGT CCTCAATGTCCTTCATTCCTGGTAGACAAATCC AACATCAACCGACAGTTGGAGGTATACACAAGC GGAGGTGACCCTGAGAGTGTGGCTGGGGNAGT ATGGGCGGCACTCCCTCTACAAAATGCTTGGTT ACTTCAGCCTGGTCGGGCTTCTCCGCCTGCACT CCCTGTTAGGAGATTACTACCAGGCCATCAAGG TGCTGGAGAACATCGAACTGAACAAGAAGAGTA TGTATTCCCGTGTGCCAGAGTGCCAG | 99 | XVWAALPLQN AWLLQPGRAS PPALPVRRLL PGHQGAGEH RTEQEEYVFP CARVPGHHIL LCWVCIFDDA SLPGCHPGLR QHPPLHPEDQ EHVPEDHVQV* |
| 3224 | NM_0162 75.3_413 | 413 | TGCGCAGTGGGGAGCAGCTCGCTCCTGGGCTT TGGGCTGGCTGCAGTCTGTCTGAGGGCGGCCG AAGTGGCTGGCTCATTTAAGATGAGGCTTCTGC TGCTTCTCCTAGTGGCGGCGTCTGCGATGGTCC GGAGCGAGGCCTCGGCCAATCTGGGCGGCGTG CCCAGCAAGAGATTAAAGATGCAGTACGCCACG GGGCCGCTGCTCAAGTTCCAGATTTGTGTTTCC TGAGGTTATAGGCGGGTGTTTGAGGAGTACATG CGGGTTATTAGCCAGCGGTACCCAGACATCCGC ATTGAAGGAGAGAATTACCTCCCTCAACCAATAT ATAGACACATAGCATCTTTCCTGTCAGTCTTCAA ACTAGTATTAATAGGCTTAATAATTGTTGGCAAG GATCCTTTTGCTTTCTTNTGGCATGCAAGCTCCT AGCATCTGGCAGTGGGGCCAAGAAAATAAGGTT TATGCATGTATGATGGTTTTCTTCTTGAGCAACA TGATTGAGAACCAGTGTATGTCAACAGGTGCATT TGAGATAACTTTAAATGATGTACCTGTGTGGTCT AAGCTGGAATCTGGTCACCTTCCATCCATGCAA CAACTTGTTCAAATTCTTGACAATGAAATGAAGC TCAATGTGCATATGGATTCAATCCCACACCATCG ATCATAGCACCACCTATCAGCACTGAAAACTCTT | 6 | XWHASS* |

TABLE 3B-continued

| SEQ ID | identifier_position | position | modified RNA | PAP length | PAP |
|---|---|---|---|---|---|
| | | | TTGCATTAAGGGATCATTGCAAGAGCAGCGTGA CTGACATTATGAAGGCCTGTACTGAAGACAGCA AGCTGTTAGTACAGACCAGATGCTTTCTTGGCA GGCTCGTTGTACCTCTTGGAAAACCTCAATGCAA GATAGTGTTTCAGTGCTGGCATATTTGGAATTC TGCACATTCATGGAGTGCAATAATACTGTATAGC TTTCCCCACCTCCCACAAAATCACCCAGTTAATG TGTGTGTGTGTTTTTTTTTAAGGTAAACATTACT ACTTGTAACTTTTTTTCTTAGTCATATTTGAAAAA GTAGAAAATTGAGTTACAA | | |
| 3225 | NM_0163 04.2_576 | 576 | CTGGTCTAACAGACCCGCGAGAACGAAGGACG CTTGCCTTTTTCCGGTCGGGGAAGGGGGAAGAA GGTAACTTCCGGTGACGGGGTTGCATCACTTCC TCTCAAGCTTGGCGTTTGTTTGGTGGGGTTACA CGCGGGTTCAACATGCGTATCGAAAAGTGTTATT TCTGTTCGGGGCCCATCTATCCTGGACACGGCA TGATGTTCGTCCGCAACGATTGCAAGGTGTTCA GATTTTGCAAATCTAAATGTCATAAAAACTTTAAA AAGAAGCGCAATCCTCGCAAAGTTAGGTGGACC AAAGCATTCCGGAAAGCAGCTGGTAAAGAGCTT ACAGTGGATAATTCATTTGAATTTGAAAAACGTA GAAATGAACCTATCAAATACCAGCGAGAGCTAT GGAATAAAACTATTGATGCGATGAAGAGAGTTGA AGAAATCAAACAGAAGCGCCAAGCTAAATTTATA ATGAACAGATTGAAGAAAAATAAAGAGCTACAGA AAGTTCAGGATATCAAAGAAGTCAAGCAAAACAT CCATCTTATCCGAGCCCCTCTTGCAGGCAAAGG GAAACAGTNTGGAAGAGAAAATGGTACAGCAGT TACAAGAGGATGTGGACATGGAAGATGCTCCTT AAAAATCTCTGTAACCATTCTTTTATGTACATTT GAAAATGCCCTTTGGATACTTGGAACTGCTAAAT TATTTTATTTTTTACATAAGGTCACTTAAATGAAA AGCGATTAAAAGACATCTTTCCTGCATTGCCATC TACATAAATATCAGATATTACGGATGTTAGATTGC ATCTCAGTGTTAAATCTTTACTGATAGATGTACTT AAGTAAATCATGAAAATTCTACTTGTAACTATAGA AGTGAATTGTGACGTAAAATGGTTGTGCTATTT GGATAATGGCACTAGGCAGCATTTGTATAGTAAC TAATGGCAAAAATTCATGGCTAGTGATGTATAAA ATAAAATATTCTTTGCAGTAAAATATTCCCTTTGT TAATGTTATAG | 31 | XGRENGTAVT RGCGHGRCS LKISVTISFMYI* |
| 3226 | NM_0164 10.3_251 | 251 | GGAAGTCGAGGCGGGAGTGACTCTGCTTCCGTT TCTGGTTTTGCTCTAGTGTTTGGGTTTCTTCGCG GCTGCTCAAGATGAACCGACTCTTCGGGAAAGC GAAACCCAAGGCTCCGCCGCCCAGCCTGACTG GCTGCATTGGCACGGTGGACAGTAGAGCAGAAT CCATTGACAAGAAGATTTCTCGATTGGATGCTGA GCTAGTGAAGTATAAGGATCAGATCAAGAAGAT GAGAGAGGGTCCTGCAAAGNAATATGGTCAAGC AGAAAGCCTTGCGAGTTTTAAAGCAAAAGAGGA TGTATGAGCAGCAGCGGGACAATCTTGCCCAAC AGTCATTCAACATGGAACAAGCCAATTATACCAT CCAGTCTTTGAAGGACACCAAGACCACGGTTGA TGCTATGAAACTGGGAGTAAAGGAAATGAAGAA GGCATACAAGCAAGTGAAGATCGACCAGATTGA GGATTTACAAGACCAGCTAGAGGATATGATGGA AGATGCAAATGAAATCCAAGAAGCACTGAGTCG CAGTTATGGCACCCCAGAACTGGATGAAGATGA TTTAGAAGCAGAGTTGGATGCACTAGGTGATGA GCTTCTGGCTGATGAAGACAGTTCTTATTTGGAT GAGGCAGCATCTGCACCTGCAATTCCAGAAGGT GTTCCCACTGATACAAAAAACAAGGATGGAGTTC TGGTGGATGAATTTGGATTGCCACAGATCCCTG CTTCATAGATTTGCATCATTCAAGCATATCTTGTA AAACAAACACATATTATGGGACTAGGAAATATTT ATCTTTCCAAATTTGCCATAACAGATTTAGGTTTC TTTCCTTTCTTTGAAGGAAAGTTTAATTACATTGC TCTTTTATTTTTTCCATTAAGAGACTCATTGCTTG GGAAATGCTTTCTTCGTACTAAAATTTGATTCCTT TTTTTCTTATGAAAAACGAACTCAGTTTAAAAGTA TTTTTAGCTCGTATGACTTGTTTTCATTCATTAAT AATAATTTGAAATAA | 17 | XYGQAESLAS FKAKEDV* |
| 3227 | NM_0189 47.4_255 | 255 | AGGGCGCGGGAGCGCGGAGCGAGTTTGGTTGC ACTTACACCGGTACTTAAGCGCGGACCGGCGTG TCCTTGGACTTAGAGAGTGGGGACGTCCGGCTT CGGAGCGGGAGTGTTCGTTGTGCCAGCGACTAA AAAGAGAATTAAATATGGGTGATGTTGAGAAAGG | 17 | XWAEDRSGP WILLHSRQ* |

TABLE 3B-continued

| SEQ ID | identifier_ position | position | modified RNA | PAP length | PAP |
|---|---|---|---|---|---|
| | | | CAAGAAGATTTTTATTATGAAGTGTTCCCAGTGC CACACCGTTGAAAAGGGAGGCAAGCACAAGACT GGGCCAAATCTCCATGGTCTCTTNTGGGCGGAA GACAGGTCAGGCCCCTGGATACTCTTACACAGC CGCCAATAAGAACAAAGGCATCATCTGGGGAGA GGATACACTGATGGAGTATTTGGAGAATCCCAA GAAGTACATCCCTGGAACAAAAATGATCTTTGTC GGCATTAAGAAGAAGGAAGAAAGGGCAGACTTA ATAGCTTATCTCAAAAAAGCTACTAATGAGTAAT AATTGGCCACTGCCTTATTTATTACAAAACAGAA ATGTCTCATGACTTTTTTATGTGTACCATCCTTTA ATAGATCTCATACACCAGAATTCAGATCATGAAT GACTGACAGAATATTTTGTTGGGCAGTCCTGATT TAAAACTAAGACTGGCTTGTGGTTAAATGAATAT GTTCAGTTTTTGAATTTTAATAGTAACTCCAATTC AGTAAATGGTATCACTGTTTACCCCTTTTAAAGA TATGATTAGACTTCGTTAGTAATGTTCAACTTTTC ACAAAGATGGTGAGTGCCATCTTAAAACTTACTG GAGATTGGTTTTATATTTAGATTTATATAACTGGT TATGTGAATATATTTAAATACTGGGGAAATTGCTT CACTGTCTTAGAACCAAGCAAGATTCACCTGTGT TTTGTGTTCATGTTCATTTGCCTCTTAAAGGCAA GGGTTGAAGATAAATAAGGTAGCAATGTCTATAG TTTTGGCCTTAACTATGCCAATCTAATTATAATTC CCTGTATTTAAAATGGTTTCTTTTACTTATTGAAA GGCATTTT | | |
| 3228 | NM_0189 47.4393 | 393 | AGGGCGCGGGAGCGCGGAGCGAGTTTGGTTGC ACTTACACCGGTACTTAAGCGCGGACCGGCGTG TCCTTGGACTTAGAGAGTGGGGACGTCCGGCTT CGGAGCGGGAGTGTTCGTTGTGCCAGCGACTAA AAAGAGAATTAAATATGGGTGATGTTGAGAAAGG CAAGAAGATTTTTATTATGAAGTGTTCCCAGTGC CACACCGTTGAAAAGGGAGGCAAGCACAAGACT GGGCCAAATCTCCATGGTCTCTTTGGGCGGAAG ACAGGTCAGGCCCCTGGATACTCTTACACAGCC GCCAATAAGAACAAAGGCATCATCTGGGGAGAG GATACACTGATGGAGTATTTGGAGAATCCCAAG AAGTACATCCCTGGAACAAAAATGATCTTNTGTC GGCATTAAGAAGAAGGAAGAAAGGGCAGACTTA ATAGCTTATCTCAAAAAAGCTACTAATGAGTAAT AATTGGCCACTGCCTTATTTATTACAAAACAGAA ATGTCTCATGACTTTTTTATGTGTACCATCCTTTA ATAGATCTCATACACCAGAATTCAGATCATGAAT GACTGACAGAATATTTTGTTGGGCAGTCCTGATT TAAAACTAAGACTGGCTTGTGGTTAAATGAATAT GTTCAGTTTTTGAATTTTAATAGTAACTCCAATTC AGTAAATGGTATCACTGTTTACCCCTTTTAAAGA TATGATTAGACTTCGTTAGTAATGTTCAACTTTTC ACAAAGATGGTGAGTGCCATCTTAAAACTTACTG GAGATTGGTTTTATATTTAGATTTATATAACTGGT TATGTGAATATATTTAAATACTGGGGAAATTGCTT CACTGTCTTAGAACCAAGCAAGATTCACCTGTGT TTTGTGTTCATGTTCATTTGCCTCTTAAAGGCAA GGGTTGAAGATAAATAAGGTAGCAATGTCTATAG TTTTGGCCTTAACTATGCCAATCTAATTATAATTC CCTGTATTTAAAATGGTTTCTTTTACTTATTGAAA GGCATTTT | 4 | XCRH* |
| 3229 | NM_0211 09.2_181 | 181 | ACAACTCGGTGGTGGCCACTGCGCAGACCAGA CTTCGCTCGTACTCGTGCGCCTCGCTTCGCTTTT CCTCCGCAACCATGTCTGACAAACCCGATATGG CTGAGATCGAGAAATTCGATAAGTCGAAACTGAA GAAGACAGAGACGCAAGAGAAAAATCCACTGCC TTCCAAAGAAACGATNTGAACAGGAGAAGCAAG CAGGCGAATCGTAATGAGGCGTGCGCCGCCAAT ATGCACTGTACATTCCACAAGCATTGCCTTCTTA TTTTACTTCTTTTAGCTGTTTAACTTTGTAAGATG CAAAGAGGTTGGATCAAGTTTAAATGACTGTGCT GCCCCTTTCACATCAAAGAACTACTGACAACGAA GGCCGCGCCTGCCTTTCCCATCTGTCTATCTAT CTGGCTGGCAGGGAAGGAAAGAACTTGCATGTT GGTGAAGGAAGAAGTGGGGTGGAAGAAGTGGG GTGGGACGACAGTGAAATCTAGAGTAAAACCAA GCTGGCCCAAGGTGTCCTGCAGGCTGTAATGCA GTTTAATCAGAGTGCCATTTTTTTTTTTGTTCAAA TGATTTTAATTATTGGAATGCACAATTTTTTTAAT ATGCAAATAAAAAGTTTAAAAACTTAAAAAAAAAA AAAAAAAAAAAAAAAAAAAA | 1 | X* |

TABLE 3B-continued

| SEQ ID | identifier_ position | position | modified RNA | PAP length | PAP |
|---|---|---|---|---|---|
| 3230 | NM_0211 30.3_138 | 138 | GAACGTGGTATAAAAGGGGCGGGAGGCCAGGC TCGTGCCGTTTTGCAGACGCCACCGCCGAGGAA AACCGTGTACTATTAGCCATGGTCAACCCCACC GTGTTCTTCGACATTGCCGTCGACGGCGAGCCC TTGGGCCNGCGTCTCCTTTGAGCTGTTTGCAGA CAAGGTCCCAAAGACAGCAGAAAATTTTCGTGC TCTGAGCACTGGAGAGAAAGGATTTGGTTATAA GGGTTCCTGCTTTCACAGAATTATTCCAGGGTTT ATGTGTCAGGGTGGTGACTTCACACGCCATAAT GGCACTGGTGGCAAGTCCATCTATGGGGAGAAA TTTGAAGATGAGAACTTCATCCTAAAGCATACGG GTCCTGGCATCTTGTCCATGGCAAATGCTGGAC CCAACACAAATGGTTCCCAGTTTTTCATCTGCAC TGCCAAGACTGAGTGGTTGGATGGCAAGCATGT GGTGTTTGGCAAAGTGAAAGAAGGCATGAATAT TGTGGAGGCCATGGAGCGCTTTGGGTCCAGGA ATGGCAAGACCAGCAAGAAGATCACCATTGCTG ACTGTGGACAACTCGAATAAGTTTGACTTGTGTT TTATCTTAACCACCAGATCATTCCTTCTGTAGCT CAGGAGAGCACCCCTCCACCCCATTTGCTCGCA GTATCCTAGAATCTTTGTGCTCTCGCTGCAGTTC CCTTTGGGTTCCATGTTTTCCTTGTTCCCTCCCA TGCCTAGCTGGATTGCAGAGTTAAGTTTATGATT ATGAAATAAAAACTAAATAACAATTGTCCTCGTTT GAGTTAAGAGTGTTGATGTAGGCTTTATTTTAAG CAGTAATGGGTTACTTCTGAAACATCACTTGTTT GCTTAATTCTACACAGTACTTAGATTTTTTTTACT TTCCAGTCCCAGGAAGTGTCAATGTTTGTTGAGT GGAATATTGAAAATGTAGGCAGCAACTGGGCAT GGTGGCTCACTGTCTGTAATGTATTACCTGAGG CAGAAGACCACCTGAGGGTAG | 4 | XRLL* |
| 3231 | NM_0211 30.3_375 | 375 | GAACGTGGTATAAAAGGGGCGGGAGGCCAGGC TCGTGCCGTTTTGCAGACGCCACCGCCGAGGAA AACCGTGTACTATTAGCCATGGTCAACCCCACC GTGTTCTTCGACATTGCCGTCGACGGCGAGCCC TTGGGCCGCGTCTCCTTTGAGCTGTTTGCAGAC AAGGTCCCAAAGACAGCAGAAAATTTTCGTGCT CTGAGCACTGGAGAGAAAGGATTTGGTTATAAG GGTTCCTGCTTTCACAGAATTATTCCAGGGTTTA TGTGTCAGGGTGGTGACTTCACACGCCATAATG GCACTGGTGGCAAGTCCATCTATGGGGAGAAAT TTGAAGATGAGAACTTCATCCTAAAGCATACGGG TCCTGGCATCTNTGTCCATGGCAAATGCTGGAC CCAACACAAATGGTTCCCAGTTTTTCATCTGCAC TGCCAAGACTGAGTGGTTGGATGGCAAGCATGT GGTGTTTGGCAAAGTGAAAGAAGGCATGAATAT TGTGGAGGCCATGGAGCGCTTTGGGTCCAGGA ATGGCAAGACCAGCAAGAAGATCACCATTGCTG ACTGTGGACAACTCGAATAAGTTTGACTTGTGTT TTATCTTAACCACCAGATCATTCCTTCTGTAGCT CAGGAGAGCACCCCTCCACCCCATTTGCTCGCA GTATCCTAGAATCTTTGTGCTCTCGCTGCAGTTC CCTTTGGGTTCCATGTTTTCCTTGTTCCCTCCCA TGCCTAGCTGGATTGCAGAGTTAAGTTTATGATT ATGAAATAAAAACTAAATAACAATTGTCCTCGTTT GAGTTAAGAGTGTTGATGTAGGCTTTATTTTAAG CAGTAATGGGTTACTTCTGAAACATCACTTGTTT GCTTAATTCTACACAGTACTTAGATTTTTTTTACT TTCCAGTCCCAGGAAGTGTCAATGTTTGTTGAGT GGAATATTGAAAATGTAGGCAGCAACTGGGCAT GGTGGCTCACTGTCTGTAATGTATTACCTGAGG CAGAAGACCACCTGAGGGTAG | 22 | XVHGKCWTQ HKWFPVFHLH CQD* |
| 3232 | NM_0211 30.3_481 | 481 | GAACGTGGTATAAAAGGGGCGGGAGGCCAGGC TCGTGCCGTTTTGCAGACGCCACCGCCGAGGAA AACCGTGTACTATTAGCCATGGTCAACCCCACC GTGTTCTTCGACATTGCCGTCGACGGCGAGCCC TTGGGCCGCGTCTCCTTTGAGCTGTTTGCAGAC AAGGTCCCAAAGACAGCAGAAAATTTTCGTGCT CTGAGCACTGGAGAGAAAGGATTTGGTTATAAG GGTTCCTGCTTTCACAGAATTATTCCAGGGTTTA TGTGTCAGGGTGGTGACTTCACACGCCATAATG GCACTGGTGGCAAGTCCATCTATGGGGAGAAAT TTGAAGATGAGAACTTCATCCTAAAGCATACGGG TCCTGGCATCTTGTCCATGGCAAATGCTGGACC CAACACAAATGGTTCCCAGTTTTTCATCTGCACT GCCAAGACTGAGTGGTTGGATGGCAAGCATGTG GTGTTTGGCAAAGTGAANAGAAGGCATGAATATT | 27 | XRRHEYCGG HGALWVQEW QDQQEDHHC* |

TABLE 3B-continued

| SEQ ID | identifier_position | position | modified RNA | PAP length | PAP |
|---|---|---|---|---|---|
| | | | GTGGAGGCCATGGAGCGCTTTGGGTCCAGGAA TGGCAAGACCAGCAAGAAGATCACCATTGCTGA CTGTGGACAACTCGAATAAGTTTGACTTGTGTTT TATCTTAACCACCAGATCATTCCTTCTGTAGCTC AGGAGAGCACCCCTCCACCCCATTTGCTCGCAG TATCCTAGAATCTTTGTGCTCTCGCTGCAGTTCC CTTTGGGTTCCATGTTTTCCTTGTTCCCTCCCAT GCCTAGCTGGATTGCAGAGTTAAGTTTATGATTA TGAAATAAAAACTAAATAACAATTGTCCTCGTTTG AGTTAAGAGTGTTGATGTAGGCTTTATTTTAAGC AGTAATGGGTTACTTCTGAAACATCACTTGTTTG CTTAATTCTACACAGTACTTAGATTTTTTTACTT TCCAGTCCCAGGAAGTGTCAATGTTTGTTGAGT GGAATATTGAAAATGTAGGCAGCAACTGGGCAT GGTGGCTCACTGTCTGTAATGTATTACCTGAGG CAGAAGACCACCTGAGGGTAG | | |
| 3233 | NM_021130.3_556 | 556 | GAACGTGGTATAAAAGGGGCGGGAGGCCAGGC TCGTGCCGTTTTGCAGACGCCACCGCCGAGGAA AACCGTGTACTATTAGCCATGGTCAACCCCACC GTGTTCTTCGACATTGCCGTCGACGGCGAGCCC TTGGGCCGCGTCTCCTTTGAGCTGTTTGCAGAC AAGGTCCCAAAGACAGCAGAAAATTTTCGTGCT CTGAGCACTGGAGAGAAAGGATTTGGTTATAAG GGTTCCTGCTTTCACAGAATTATTCCAGGGTTTA TGTGTCAGGGTGGTGACTTCACACGCCATAATG GCACTGGTGGCAAGTCCATCTATGGGGAGAAAT TTGAAGATGAGAACTTCATCCTAAAGCATACGGG TCCTGGCATCTTGTCCATGGCAAATGCTGGACC CAACACAAATGGTTCCCAGTTTTTCATCTGCACT GCCAAGACTGAGTGGTTGGATGGCAAGCATGTG GTGTTTGGCAAAGTGAAAGAAGGCATGAATATT GTGGAGGCCATGGAGCGCTTTGGGTCCAGGAA TGGCAAGACCAGCAAGAAGATCACCATNTGCTG ACTGTGGACAACTCGAATAAGTTTGACTTGTGTT TTATCTTAACCACCAGATCATTCCTTCTGTAGCT CAGGAGAGCACCCCTCCACCCCATTTGCTCGCA GTATCCTAGAATCTTTGTGCTCTCGCTGCAGTTC CCTTTGGGTTCCATGTTTTCCTTGTTCCCTCCCA TGCCTAGCTGGATTGCAGAGTTAAGTTTATGATT ATGAAATAAAAACTAAATAACAATTGTCCTCGTTT GAGTTAAGAGTGTTGATGTAGGCTTTATTTTAAG CAGTAATGGGTTACTTCTGAAACATCACTTGTTT GCTTAATTCTACACAGTACTTAGATTTTTTTTACT TTCCAGTCCCAGGAAGTGTCAATGTTTGTTGAGT GGAATATTGAAAATGTAGGCAGCAACTGGGCAT GGTGGCTCACTGTCTGTAATGTATTACCTGAGG CAGAAGACCACCTGAGGGTAG | 2 | XC* |
| 3234 | NM_031157.2_443 | 443 | GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAANGAAGACACTGAAGAACATC ACCTAAGAGATTATTTTGAACAGTATGGAAAAAT TGAAGTGATTGAAATCATGACTGACCGAGGCAG TGGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG | 3 | XRH* |

TABLE 3B-continued

| SEQ ID | identifier_position | position | modified RNA | PAP length | PAP |
|---|---|---|---|---|---|
| 3235 | NM_0311 57.2_492 | 492 | GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAANAAAT TGAAGTGATTGAAATCATGACTGACCGAGGCAG TGGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC | 2 | XN* |
| 3236 | NM_0311 57.2_492 | 535 | GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAANGAAAAGGGGCTTTGCCTTTGTAACCTT TGACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC | 10 | XEKGLCLCNL* |
| 3237 | NM_0311 57.2_539 | 539 | GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT | 8 | XGLCLCNL* |

TABLE 3B-continued

| SEQ ID | identifier_position | position | modified RNA | PAP length | PAP |
|---|---|---|---|---|---|
| 3238 | NM_0311 57.2_553 | 553 | TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAANAGGGGCTTTGCCTTTGTAACCTT TGACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTNTGTAACCTT TGACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG | 4 | XCNL* |
| 3239 | NM_0311 57.2_563 | 563 | GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT NGACGACCATGACTCCGTGGATAAGATTGTCAT TCAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA | 3 | XRP* |

TABLE 3B-continued

| SEQ ID | identifier_position | position | modified RNA | PAP length | PAP |
|---|---|---|---|---|---|
| 3240 | NM_031157.2_582 | 582 | TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGNATAAGATTGTCAT TCAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC | 1 | X* |
| 3241 | NM_031157.2_586 | 586 | GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGATAANGATTGTCAT TCAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTGGTGGTGGTCGTGGAGGT GGTTTCGGTGGGAATGACAACTTCGGTCGTGGA GGAAACTTCAGTGGTCGTGGTGGCTTTGGTGGC AGCCGTGGTGGTGGTGGATATGGTGGCAGTGG GGATGGCTATAATGGATTTGGTAATGATGGTGG TTATGGAGGAGGCGGCCCTGGTTACTCTGGAGG AAGCAGAGGCTATGGAAGTGGTGGACAGGGTTA TGGAAACCAGGGCAGTGGCTATGGCGGGAGTG GCAGCTATGACAGCTATAACAACGGAGGCGGAG GCGGCTTTGGCGGTGGTAGTGGAAGCAATTTTG GAGAGGGCGAAGGTAGGCTGGCAGATACGTTC | 15 | XDCHSEIPYC EWPQL* |
| 3242 | NM_031157.2_652 | 652 | GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC | 5 | XARDG* |

TABLE 3B-continued

| SEQ ID | identifier_position | position | modified RNA | PAP length | PAP |
|---|---|---|---|---|---|
| | | | CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAANGCAAGAGAT GGCTAGTGCTTCATCCAGCCAAAGAGGTCGAAG TGGTTCTGGAAACTTTGGTGGTGGTCGTGGAGG TGGTTTCGGTGGGAATGACAACTTCGGTCGTGG AGGAAACTTCAGTGGTCGTGGTGGCTTTGGTGG CAGCCGTGGTGGTGGTGGATATGGTGGCAGTG GGGATGGCTATAATGGATTTGGTAATGATGGTG GTTATGGAGGAGGCGGCCCTGGTTACTCTGGAG GAAGCAGAGGCTATGGAAGTGGTGGACAGGGT TATGGAAACCAGGGCAGTGGCTATGGCGGGAG TGGCAGCTATGACAGCTATAACAACGGAGGCGG AGGCGGCTTTGGCGGTGGTAGTGGAAGCAATTT TG | | |
| 3243 | NM_0311 57.2_667 | 667 | GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAAGCAAGAGATG GCTAGNTGCTTCATCCAGCCAAAGAGGTCGAAG TGGTTCTGGAAACTTTGGTGGTGGTCGTGGAGG TGGTTTCGGTGGGAATGACAACTTCGGTCGTGG AGGAAACTTCAGTGGTCGTGGTGGCTTTGGTGG CAGCCGTGGTGGTGGTGGATATGGTGGCAGTG GGGATGGCTATAATGGATTTGGTAATGATGGTG GTTATGGAGGAGGCGGCCCTGGTTACTCTGGAG GAAGCAGAGGCTATGGAAGTGGTGGACAGGGT TATGGAAACCAGGGCAGTGGCTATGGCGGGAG TGGCAGCTATGACAGCTATAACAACGGAGGCGG AGGCGGCTTTGGCGGTGGTAGTGGAAGCAATTT TG | 26 | XCFIQPKRSK WFWKLWWW SWRWFRWE* |
| 3244 | NM_0311 57.2_694 | 694 | GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGN TGGTTCTGGAAACTTTGGTGGTGGTCGTGGAGG TGGTTTCGGTGGGAATGACAACTTCGGTCGTGG AGGAAACTTCAGTGGTCGTGGTGGCTTTGGTGG CAGCCGTGGTGGTGGTGGATATGGTGGCAGTG | 17 | XWFWKLWW WSWRWFRW E* |

TABLE 3B-continued

| SEQ ID | identifier_position | position | modified RNA | PAP length | PAP |
|---|---|---|---|---|---|
| | | | GGGATGGCTATAATGGATTTGGTAATGATGGTG GTTATGGAGGAGGCGGCCCTGGTTACTCTGGAG GAAGCAGAGGCTATGGAAGTGGTGGACAGGGT TATGGAAACCAGGGCAGTGGCTATGGCGGGAG TGGCAGCTATGACAGCTATAACAACGGAGGCGG AGGCGGCTTTGGCGGTGGTAGTGGAAGCAATTT TG | | |
| 3245 | NM_0311 57.2_710 | 710 | GAGAGGGCGAAGGTAGGCTGGCAGATACGTTC GTCAGCTTGCTCCTTTCTGCCCGTGGACGCCGC CGAAGAAGCATCGTTAAAGTCTCTCTTCACCCTG CCGTCATGTCTAAGTCAGAGTCTCCTAAAGAGC CCGAACAGCTGAGGAAGCTCTTCATTGGAGGGT TGAGCTTTGAAACAACTGATGAGAGCCTGAGGA GCCATTTTGAGCAATGGGGAACGCTCACGGACT GTGTGGTAATGAGAGATCCAAACACCAAGCGCT CCAGGGGCTTTGGGTTTGTCACATATGCCACTG TGGAGGAGGTGGATGCAGCTATGAATGCAAGGC CACACAAGGTGGATGGAAGAGTTGTGGAACCAA AGAGAGCTGTCTCCAGAGAAGATTCTCAAAGAC CAGGTGCCCACTTAACTGTGAAAAAGATATTTGT TGGTGGCATTAAAGAAGACACTGAAGAACATCA CCTAAGAGATTATTTTGAACAGTATGGAAAAATT GAAGTGATTGAAATCATGACTGACCGAGGCAGT GGCAAGAAAAGGGGCTTTGCCTTTGTAACCTTT GACGACCATGACTCCGTGGATAAGATTGTCATT CAGAAATACCATACTGTGAATGGCCACAACTGT GAAGTTAGAAAAGCCCTGTCAAAGCAAGAGATG GCTAGTGCTTCATCCAGCCAAAGAGGTCGAAGT GGTTCTGGAAACTTTNGGTGGTGGTCGTGGAGG TGGTTTCGGTGGGAATGACAACTTCGGTCGTGG AGGAAACTTCAGTGGTCGTGGTGGCTTTGGTGG CAGCCGTGGTGGTGGTGGATATGGTGGCAGTG GGGATGGCTATAATGGATTTGGTAATGATGGTG GTTATGGAGGAGGCGGCCCTGGTTACTCTGGAG GAAGCAGAGGCTATGGAAGTGGTGGACAGGGT TATGGAAACCAGGGCAGTGGCTATGGCGGGAG TGGCAGCTATGACAGCTATAACAACGGAGGCGG AGGCGGCTTTGGCGGTGGTAGTGGAAGCAATTT TG | 11 | XWWSWRWF RWE* |
| 3246 | NM_0530 24.3_188 | 188 | CCCCGCCTCCCCCCGCGCCGCCGCCGCCCGCT ACCGCCGCCGCCGCCGCTGCGCCTGCTGCTCC TCGCCGTCCGCGCTGCAGTGCGAAGGGCTCGA AGATGGCCGGTTGGCAGAGCTACGTGGATAACC TGATGTGCGATGGCTGCTGCCAGGAGGCCGCC ATTGTCGGCTACTGCGACGCCAAATACNGTCTG GGCAGCCACGGCCGGGGCGTCTTTCAGAGCA TTACGCCAATAGAAATAGATATGATTGTAGGAAA AGACCGGGAAGGTTTCTTTACCAACGGTTTGAC TCTTGGCGCGAAGAAATGCTCAGTGATCAGAGA TAGTCTATACGTCGATGGTGACTGCACAATGGA CATCCGGACAAAGAGTCAAGGTGGGGAGCCAA CATACAATGTGGCTGTCGGCAGAGCTGGTAGAG TCTTGGTCTTTGTAATGGGAAAAGAAGGGGTCC ATGGAGGCGGATTGAATAAGAAGGCATACTCAA TGGCAAAATACTTGAGAGACTCTGGGTTCTAGCT GCTAGGCAGACTGTTAAGTATTAGGGGAAAATT GCTCTTAAACTTTCCTAGCTATAAGCTTAAGTCTT AATTCTGGAAATTTTATTAGCAATGCAGGGTGAT GGGGTATGAACCTGTGTCTCCTTTGTATCCCTCT GTTGGTGGGGAAAGGTGTCTTTCTTTCTGCCCT CCCCCCCCAAAATAATTCTGTTCACTTTTGTTTT GTTTCCTTGTGTACTCCAGCATTGGTTATAGTCA TGGGAAAGGAAGGTGTCCACGGAGGCACACTTA ACAAGAAAGCATATGAACTCGCTTTATACCTGAG GAGGTCTGATGTGTAAGCAGCCTCTCCCCATCT ACCTAGCAACTGTCTTCATCAACAACCCTAATTA TGGTCACAATGCTACCAAACTGTAGATGGTAGCT AATTTTTCTTTACCTATTTTCTAATGTCATGATTC CTGTTTGCCCAATGGATCATTTGTATGTTAACCA CTGTATGTAACCAACCCTTATCTGGC | 46 | XLGSHGRGRL SEHYANRNRY DCRKRPGRFL YQRFDSWRE EMLSDQR* |
| 3247 | NM_1532 01.1_581 | 581 | CTCATTGAACTCGCCTGCAGCTCTTGGGTTTTTT GTGGCTTCCTTCGTTATTGGAGCCAGGCTACA CCCCAGCAACCATGTCCAAGGGACCTGCAGTTG GTATTGATCTTGGCACCACCTACTCTTGTGTGGG TGTTTTCCAGCACGGAAAAGTCGAGATAATTGCC AATGATCAGGGAAACCGAACCACTCCAAGCTAT GTCGCCTTTACGGACACTGAACGGTTGATCGGT | 3 | XCT* |

US 9,068,988 B2

TABLE 3B-continued

| SEQ ID | identifier_position | position | modified RNA | PAP length | PAP |
|---|---|---|---|---|---|
| | | | GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAANTGTACTTAGAATTATTAATG<br>AGCCAACTGCTGCTGCTATTGCTTACGGCTTAG<br>ACAAAAAGGTTGGAGCAGAAAGAAACGTGCTCA<br>TCTTTGACCTGGGAGGTGGCACTTTTGATGTGT<br>CAATCCTCACTATTGAGGATGGAATCTTTGAGGT<br>CAAGTCTACAGCTGGAGACACCCACTTGGGTGG<br>AGAAGATTTTGACAACCGAATGGTCAACCATTTT<br>ATTGCTGAGTTTAAGCGCAAGCATAAGAAGGAC<br>ATCAGTGAGAACAAGAGAGCTGTAAGACGCCTC<br>CGTACTGCTTGTGAACGTGCTAAGCGTACCCTC<br>TCTTCCAGCACCCAGGCCAGTATTGAGATCGAT<br>TCTCTCTATGAAGGAATCGACTTCTATACCTCCA<br>TTACCCGTGCCCGATTTGAAGAACTGAATGCTG<br>ACCTGTTCCGTGGCACCCTGGAC | | |
| 3248 | NM_1532 01.1_737 | 737 | CTCATTGAACTCGCCTGCAGCTCTTGGGTTTTTT<br>GTGGCTTCCTTCGTTATTGGAGCCAGGCCTACA<br>CCCCAGCAACCATGTCCAAGGGACCTGCAGTTG<br>GTATTGATCTTGGCACCACCTACTCTTGTGTGGG<br>TGTTTTCCAGCACGGAAAAGTCGAGATAATTGCC<br>AATGATCAGGGAAACCGAACCACTCCAAGCTAT<br>GTCGCCTTTACGGACACTGAACGGTTGATCGGT<br>GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAATGTACTTAGAATTATTAATGA<br>GCCAACTGCTGCTGCTATTGCTTACGGCTTAGA<br>CAAAAAGGTTGGAGCAGAAAGAAACGTGCTCAT<br>CTTTGACCTGGGAGGTGGCACTTTTGATGTGTC<br>AATCCTCACTATTGAGGATGGAATCTTTGAGGTC<br>AANGTCTACAGCTGGAGACACCCACTTGGGTGG<br>AGAAGATTTTGACAACCGAATGGTCAACCATTTT<br>ATTGCTGAGTTTAAGCGCAAGCATAAGAAGGAC<br>ATCAGTGAGAACAAGAGAGCTGTAAGACGCCTC<br>CGTACTGCTTGTGAACGTGCTAAGCGTACCCTC<br>TCTTCCAGCACCCAGGCCAGTATTGAGATCGAT<br>TCTCTCTATGAAGGAATCGACTTCTATACCTCCA<br>TTACCCGTGCCCGATTTGAAGAACTGAATGCTG<br>ACCTGTTCCGTGGCACCCTGGAC | 14 | XVYSWRHPL GWRRF* |
| 3249 | NM_1532 01.1_749 | 749 | CTCATTGAACTCGCCTGCAGCTCTTGGGTTTTTT<br>GTGGCTTCCTTCGTTATTGGAGCCAGGCCTACA<br>CCCCAGCAACCATGTCCAAGGGACCTGCAGTTG<br>GTATTGATCTTGGCACCACCTACTCTTGTGTGGG<br>TGTTTTCCAGCACGGAAAAGTCGAGATAATTGCC<br>AATGATCAGGGAAACCGAACCACTCCAAGCTAT<br>GTCGCCTTTACGGACACTGAACGGTTGATCGGT<br>GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAATGTACTTAGAATTATTAATGA<br>GCCAACTGCTGCTGCTATTGCTTACGGCTTAGA<br>CAAAAAGGTTGGAGCAGAAAGAAACGTGCTCAT<br>CTTTGACCTGGGAGGTGGCACTTTTGATGTGTC<br>AATCCTCACTATTGAGGATGGAATCTTTGAGGTC | 9 | RHPLGWRRF* |

TABLE 3B-continued

| SEQ ID | identifier_position | position | modified RNA | PAP length | PAP |
|---|---|---|---|---|---|
| | | | AAGTCTACAGCTGGNAGACACCCACTTGGGTGG AGAAGATTTTGACAACCGAATGGTCAACCATTTT ATTGCTGAGTTTAAGCGCAAGCATAAGAAGGAC ATCAGTGAGAACAAGAGAGCTGTAAGACGCCTC CGTACTGCTTGTGAACGTGCTAAGCGTACCCTC TCTTCCAGCACCCAGGCCAGTATTGAGATCGAT TCTCTCTATGAAGGAATCGACTTCTATACCTCCA TTACCCGTGCCCGATTTGAAGAACTGAATGCTG ACCTGTTCCGTGGCACCCTGGAC | | |
| 3250 | NM_1532 01.1_761 | 761 | CTCATTGAACTCGCCTGCAGCTCTTGGGTTTTTT GTGGCTTCCTTCGTTATTGGAGCCAGGCCTACA CCCCAGCAACCATGTCCAAGGGACCTGCAGTTG GTATTGATCTTGGCACCACCTACTCTTGTGTGGG TGTTTTCCAGCACGGAAAAGTCGAGATAATTGCC AATGATCAGGGAAACCGAACCACTCCAAGCTAT GTCGCCTTTACGGACACTGAACGGTTGATCGGT GATGCCGCAAAGAATCAAGTTGCAATGAACCCC ACCAACACAGTTTTTGATGCCAAACGTCTGATTG GACGCAGATTTGATGATGCTGTTGTCCAGTCTG ATATGAAACATTGGCCCTTTATGGTGGTGAATGA TGCTGGCAGGCCCAAGGTCCAAGTAGAATACAA GGGAGAGACCAAAAGCTTCTATCCAGAGGAGGT GTCTTCTATGGTTCTGACAAAGATGAAGGAAATT GCAGAAGCCTACCTTGGGAAGACTGTTACCAAT GCTGTGGTCACAGTGCCAGCTTACTTTAATGACT CTCAGCGTCAGGCTACCAAAGATGCTGGAACTA TTGCTGGTCTCAATGTACTTAGAATTATTAATGA GCCAACTGCTGCTGCTATTGCTTACGGCTTAGA CAAAAAGGTTGGAGCAGAAAGAAACGTGCTCAT CTTTGACCTGGGAGGTGGCACTTTTGATGTGTC AATCCTCACTATTGAGGATGGAATCTTTGAGGTC AAGTCTACAGCTGGAGACACCCACTTNGGGTGG AGAAGATTTTGACAACCGAATGGTCAACCATTTT ATTGCTGAGTTTAAGCGCAAGCATAAGAAGGAC ATCAGTGAGAACAAGAGAGCTGTAAGACGCCTC CGTACTGCTTGTGAACGTGCTAAGCGTACCCTC TCTTCCAGCACCCAGGCCAGTATTGAGATCGAT TCTCTCTATGAAGGAATCGACTTCTATACCTCCA TTACCCGTGCCCGATTTGAAGAACTGAATGCTG ACCTGTTCCGTGGCACCCTGGAC | 6 | XGWRRF* |
| 3251 | NM_1532 01.1_764 | 764 | CTCATTGAACTCGCCTGCAGCTCTTGGGTTTTTT GTGGCTTCCTTCGTTATTGGAGCCAGGCCTACA CCCCAGCAACCATGTCCAAGGGACCTGCAGTTG GTATTGATCTTGGCACCACCTACTCTTGTGTGGG TGTTTTCCAGCACGGAAAAGTCGAGATAATTGCC AATGATCAGGGAAACCGAACCACTCCAAGCTAT GTCGCCTTTACGGACACTGAACGGTTGATCGGT GATGCCGCAAAGAATCAAGTTGCAATGAACCCC ACCAACACAGTTTTTGATGCCAAACGTCTGATTG GACGCAGATTTGATGATGCTGTTGTCCAGTCTG ATATGAAACATTGGCCCTTTATGGTGGTGAATGA TGCTGGCAGGCCCAAGGTCCAAGTAGAATACAA GGGAGAGACCAAAAGCTTCTATCCAGAGGAGGT GTCTTCTATGGTTCTGACAAAGATGAAGGAAATT GCAGAAGCCTACCTTGGGAAGACTGTTACCAAT GCTGTGGTCACAGTGCCAGCTTACTTTAATGACT CTCAGCGTCAGGCTACCAAAGATGCTGGAACTA TTGCTGGTCTCAATGTACTTAGAATTATTAATGA GCCAACTGCTGCTGCTATTGCTTACGGCTTAGA CAAAAAGGTTGGAGCAGAAAGAAACGTGCTCAT CTTTGACCTGGGAGGTGGCACTTTTGATGTGTC AATCCTCACTATTGAGGATGGAATCTTTGAGGTC AAGTCTACAGCTGGAGACACCCACTTGGGNTGG AGAAGATTTTGACAACCGAATGGTCAACCATTTT ATTGCTGAGTTTAAGCGCAAGCATAAGAAGGAC ATCAGTGAGAACAAGAGAGCTGTAAGACGCCTC CGTACTGCTTGTGAACGTGCTAAGCGTACCCTC TCTTCCAGCACCCAGGCCAGTATTGAGATCGAT TCTCTCTATGAAGGAATCGACTTCTATACCTCCA TTACCCGTGCCCGATTTGAAGAACTGAATGCTG ACCTGTTCCGTGGCACCCTGGAC | 4 | WRRF* |
| 3252 | NM_1532 01.1_767 | 767 | CTCATTGAACTCGCCTGCAGCTCTTGGGTTTTTT GTGGCTTCCTTCGTTATTGGAGCCAGGCCTACA CCCCAGCAACCATGTCCAAGGGACCTGCAGTTG GTATTGATCTTGGCACCACCTACTCTTGTGTGGG TGTTTTCCAGCACGGAAAAGTCGAGATAATTGCC AATGATCAGGGAAACCGAACCACTCCAAGCTAT | 3 | RRF* |

TABLE 3B-continued

| SEQ ID | identifier_position | position | modified RNA | PAP length | PAP |
|---|---|---|---|---|---|
| | | | GTCGCCTTTACGGACACTGAACGGTTGATCGGT<br>GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAATGTACTTAGAATTATTAATGA<br>GCCAACTGCTGCTGCTATTGCTTACGGCTTAGA<br>CAAAAAGGTTGGAGCAGAAAGAAACGTGCTCAT<br>CTTTGACCTGGGAGGTGGCACTTTTGATGTGTC<br>AATCCTCACTATTGAGGATGGAATCTTTGAGGTC<br>AAGTCTACAGCTGGAGACACCCACTTGGGTGGN<br>AGAAGATTTTGACAACCGAATGGTCAACCATTTT<br>ATTGCTGAGTTTAAGCGCAAGCATAAGAAGGAC<br>ATCAGTGAGAACAAGAGAGCTGTAAGACGCCTC<br>CGTACTGCTTGTGAACGTGCTAAGCGTACCCTC<br>TCTTCCAGCACCCAGGCCAGTATTGAGATCGAT<br>TCTCTCTATGAAGGAATCGACTTCTATACCTCCA<br>TTACCCGTGCCCGATTTGAAGAACTGAATGCTG<br>ACCTGTTCCGTGGCACCCTGGAC | | |
| 3253 | NM_1532 01.1_784 | 784 | CTCATTGAACTCGCCTGCAGCTCTTGGGTTTTTT<br>GTGGCTTCCTTCGTTATTGGAGCCAGGCCTACA<br>CCCCAGCAACCATGTCCAAGGGACCTGCAGTTG<br>GTATTGATCTTGGCACCACCTACTCTTGTGTGGG<br>TGTTTTCCAGCACGGAAAAGTCGAGATAATTGCC<br>AATGATCAGGGAAACCGAACCACTCCAAGCTAT<br>GTCGCCTTTACGGACACTGAACGGTTGATCGGT<br>GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAATGTACTTAGAATTATTAATGA<br>GCCAACTGCTGCTGCTATTGCTTACGGCTTAGA<br>CAAAAAGGTTGGAGCAGAAAGAAACGTGCTCAT<br>CTTTGACCTGGGAGGTGGCACTTTTGATGTGTC<br>AATCCTCACTATTGAGGATGGAATCTTTGAGGTC<br>AAGTCTACAGCTGGAGACACCCACTTGGGTGGA<br>GAAGATTTTGACAACCNGAATGGTCAACCATTTT<br>ATTGCTGAGTTTAAGCGCAAGCATAAGAAGGAC<br>ATCAGTGAGAACAAGAGAGCTGTAAGACGCCTC<br>CGTACTGCTTGTGAACGTGCTAAGCGTACCCTC<br>TCTTCCAGCACCCAGGCCAGTATTGAGATCGAT<br>TCTCTCTATGAAGGAATCGACTTCTATACCTCCA<br>TTACCCGTGCCCGATTTGAAGAACTGAATGCTG<br>ACCTGTTCCGTGGCACCCTGGAC | 8 | XNGQPFYC* |
| 3254 | NM_1532 01.1_801 | 801 | CTCATTGAACTCGCCTGCAGCTCTTGGGTTTTTT<br>GTGGCTTCCTTCGTTATTGGAGCCAGGCCTACA<br>CCCCAGCAACCATGTCCAAGGGACCTGCAGTTG<br>GTATTGATCTTGGCACCACCTACTCTTGTGTGGG<br>TGTTTTCCAGCACGGAAAAGTCGAGATAATTGCC<br>AATGATCAGGGAAACCGAACCACTCCAAGCTAT<br>GTCGCCTTTACGGACACTGAACGGTTGATCGGT<br>GATGCCGCAAAGAATCAAGTTGCAATGAACCCC<br>ACCAACACAGTTTTTGATGCCAAACGTCTGATTG<br>GACGCAGATTTGATGATGCTGTTGTCCAGTCTG<br>ATATGAAACATTGGCCCTTTATGGTGGTGAATGA<br>TGCTGGCAGGCCCAAGGTCCAAGTAGAATACAA<br>GGGAGAGACCAAAAGCTTCTATCCAGAGGAGGT<br>GTCTTCTATGGTTCTGACAAAGATGAAGGAAATT<br>GCAGAAGCCTACCTTGGGAAGACTGTTACCAAT<br>GCTGTGGTCACAGTGCCAGCTTACTTTAATGACT<br>CTCAGCGTCAGGCTACCAAAGATGCTGGAACTA<br>TTGCTGGTCTCAATGTACTTAGAATTATTAATGA<br>GCCAACTGCTGCTGCTATTGCTTACGGCTTAGA<br>CAAAAAGGTTGGAGCAGAAAGAAACGTGCTCAT<br>CTTTGACCTGGGAGGTGGCACTTTTGATGTGTC | 2 | XC* |

TABLE 3B-continued

| SEQ ID | identifier_ position | position | modified RNA | PAP length | PAP |
|---|---|---|---|---|---|
| | | | AATCCTCACTATTGAGGATGGAATCTTTGAGGTC AAGTCTACAGCTGGAGACACCCACTTGGGTGGA GAAGATTTTGACAACCGAATGGTCAACCATTTTN ATTGCTGAGTTTAAGCGCAAGCATAAGAAGGAC ATCAGTGAGAACAAGAGAGCTGTAAGACGCCTC CGTACTGCTTGTGAACGTGCTAAGCGTACCCTC TCTTCCAGCACCCAGGCCAGTATTGAGATCGAT TCTCTCTATGAAGGAATCGACTTCTATACCTCCA TTACCCGTGCCCGATTTGAAGAACTGAATGCTG ACCTGTTCCGTGGCACCCTGGAC | | |
| 3255 | NM_1707 07.2_290 | 290 | AGGAGGACCTATTAGAGCCTTTGCCCCGGCGTC GGTGACTCAGTGTTCGCGGGAGCGCCGCACCT ACACCAGCCAACCCAGATCCCGAGGTCCGACAG CGCCCGGCCCAGATCCCCACGCCTGCCAGGAG CAAGCCGAGAGCCAGCCGGCCGGCGCACTCCG ACTCCGAGCAGTCTCTGTCCTTCGACCCGAGCC CCGCGCCCTTTCCGGGACCCCTGCCCCGCGGG CAGCGCTGCCAACCTGCCGGCCATGGAGACCC CGTCCCAGCGGCGCGCCACCCGCAGCGGGGC NGCAGGCCAGCTCCACTCCGCTGTCGCCCACC CGCATCACCCGGCTGCAGGAGAAGGAGGACCT GCAGGAGCTCAATGATCGCTTGGCGGTCTACAT CGACCGTGTGCGCTCGCTGGAAACGGAGAACG CAGGGCTGCGCCTTCGCATCACCGAGTCTGAAG AGGTGGTCAGCCGCGAGGTGTCCGGCATCAAG GCCGCCTACGAGGCCGAGCTCGGGGATGCCCG CAAGACCCTTGACTCAGTAGCCAAGGAGCGCGC CCGCCTGCAGCTGGAGCTGAGCAAAGTGCGTG AGGAGTTTAAGGAGCTGAAAGCGCGCAATACCA AGAAGGAGGGTGACCTGATAGCTGCTCAGGCTC GGCTGAAGGACCTGGAGGCTCTGCTGAACTCCA AGGAGGCCGCACTGAGCACTGCTCTCAGTGAGA AGCGCACGCTGGAGGGCGAGCTGCATGATCTG CGGGGCCAGGTGGCCAAGCTTGAGGCAGCCCT AGGTGAGGCCAAGAAGCAACTTCAGGATGAGAT GCTGCGGCGGGTGGATGCTGAGAACAGGCTGC AGACCATGAAGGAGGAACTGGACTTCCAGAAGA ACATCTACAGTGAGGAGCTGCGTGAGACCAAGC GCCGTCATGAGACCCGACTGGTGGAGATTGACA ATGGGAAGCAGCGTGAGTTTGAGAGCCGGCTG GCGGATGCGCTGCAGGAACTGCGGGCCCAGCA TGAGGACCAGGTGGAGCAG | 25 | AGQLHSAVAH PHHPAAGEG GPAGAQ* |
| 3256 | NM_1780 12.3_130 | 130 | CCCGAGCGCCTTCCCGGTGACCCCGCAGTGGGT GTGTGAGGGGAGGACGGACAGACCCAGACGCC GCCGGACCAGGAGGACGCTGACGAGGCACCAT GCGTGAGATCGTGCACATCCAGGCGGGCCAGT GCNGGCAACCAGATCGGCGCCAAGTTTTGGGA GGTCATCAGTGATGAGCATGGGATTGACCCCAC TGGCAGTTACCATGGAGACAGTGATTTGCAGCT GGAGAGAATCAATGTTTACTACAATGAAGCCACT GGTAACAAATATGTTCCTCGGGCCATCCTCGTG GATCTGGAGCCAGGCACGATGGATTCGGTTAGG TCTGGACCATTCGGCCAGATCTTCAGACCAGAC AATTTCGTGTTTGGCCAGAGTGGAGCCGGGAAT AACTGGGCCAAGGGCCACTACACAGAGGGAGC CGAGCTGGTCGACTCGGTCCTGGATGTGGTGA GGAAGGAGTCAGAGAGCTGTGACTGTCTCCAGG GCTTCCAGCTGACCCACTCTCTGGGGGGCGGC ACGGGGTCCGGGATGGGCACCCTGCTCATCAG CAAGATCCGGGAAGAGTACCCAGACCGCATCAT GAACACCTTCAGCGTCATGCCCTCACCCAAGGT GTCAGACACGGTGGTGGAGCCCTACAACGCCA CCCTCTCGGTCCACCAGCTGGTGGAAAACACAG ATGAAACCTACTGCATTGACAACGAGGCCCTGT ATGACATCTGCTTCCGCACCCTGAAGCTGACCA CCCCCACCTACGGGGACCTCAACCACCTGGTGT CGGCCACCATGAGCGGGGTCACCACCTGCCTG CGCTTCCCGGGCCAGCTGAACGCAGACCTGCG CAAGCTGGCGGTGAACATGGTGCCCTTCCCTCG CCTGCACTTCTTCATGCCCGGCTTCGCGCCCCT GACCAGCCGGGGCAGCCAGCAGTACCGGGCGC TCACGGTGCCCGAGCTCACCCAGCAGATGTTCG ACTCCAAGAACATGATGGCCGCCTGCGACCCGC GCCACGGCCGCTA | 13 | XQPDRRQVL GGHQ* |
| 3257 | NM_1780 | 242 | GCACCCTCGCTGCTCCAGCCTCTGGGGCGCATTC CAACCTTCCAGCCTGCGACCTGCGGAGAAAAAA AATTACTTATTTTCTTGCCCCATACATACCTTGAG | 14 | XQRPAAGPHL CVLQ* |

TABLE 3B-continued

| SEQ ID | identifier_position | position | modified RNA | PAP length | PAP |
|---|---|---|---|---|---|
| | | | GCGAGCAAAAAAATTAAATTTTAACCATGAGGGA<br>CCAGATCGGTGCCAAGTTCTGGGAGGTGATCAG<br>TGATGAACATGGCATCGACCCCACCGGCACCTA<br>CCACGGGGNACAGCGACCTGCAGCTGGACCGC<br>ATCTCTGTGTACTACAATGAAGCCACAGGTGGC<br>AAATATGTTCCTCGTGCCATCCTGGTGGATCTAG<br>AACCTGGGACCATGGACTCTGTTCGCTCAGGTC<br>CTTTTGGCCAGATCTTTAGACCAGACAACTTTGT<br>ATTTGGTCAGTCTGGGGCAGGTAACAACTGGGC<br>CAAAGGCCACTACACAGAGGGCGCCGAGCTGG<br>TTGATTCTGTCCTGGATGTGGTACGGAAGGAGG<br>CAGAGAGCTGTGACTGCCTGCAGGGCTTCCAGC<br>TGACCCACTCACTGGGCGGGGGCACAGGCTCT<br>GGAATGGGCACTCTCCTTATCAGCAAGATCCGA<br>GAAGAATACCCTGATCGCATCATGAATACCTTCA<br>GTGTGGTGCCTTCACCCAAAGTGTCTGACACCG<br>TGGTCGAGCCCTACAATGCCACCCTCTCCGTCC<br>ATCAGTTGGTAGAGAATACTGATGAGACCTATTG<br>CATTGACAACGAGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | | |
| 3258 | NM_1780<br>14.2_323 | 323 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGNTGGATCTAG<br>AACCTGGGACCATGGACTCTGTTCGCTCAGGTC<br>CTTTTGGCCAGATCTTTAGACCAGACAACTTTGT<br>ATTTGGTCAGTCTGGGGCAGGTAACAACTGGGC<br>CAAAGGCCACTACACAGAGGGCGCCGAGCTGG<br>TTGATTCTGTCCTGGATGTGGTACGGAAGGAGG<br>CAGAGAGCTGTGACTGCCTGCAGGGCTTCCAGC<br>TGACCCACTCACTGGGCGGGGGCACAGGCTCT<br>GGAATGGGCACTCTCCTTATCAGCAAGATCCGA<br>GAAGAATACCCTGATCGCATCATGAATACCTTCA<br>GTGTGGTGCCTTCACCCAAAGTGTCTGACACCG<br>TGGTCGAGCCCTACAATGCCACCCTCTCCGTCC<br>ATCAGTTGGTAGAGAATACTGATGAGACCTATTG<br>CATTGACAACGAGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 20 | XGSRTWDHG<br>LCSLRSFWPD<br>L* |
| 3259 | NM_1780<br>14.2_384 | 384 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGNACCAGACAACTTTGT<br>ATTTGGTCAGTCTGGGGCAGGTAACAACTGGGC<br>CAAAGGCCACTACACAGAGGGCGCCGAGCTGG<br>TTGATTCTGTCCTGGATGTGGTACGGAAGGAGG<br>CAGAGAGCTGTGACTGCCTGCAGGGCTTCCAGC<br>TGACCCACTCACTGGGCGGGGGCACAGGCTCT<br>GGAATGGGCACTCTCCTTATCAGCAAGATCCGA<br>GAAGAATACCCTGATCGCATCATGAATACCTTCA | 13 | XTRQLCIWSV<br>WGR* |

TABLE 3B-continued

| SEQ ID | identifier_position | position | modified RNA | PAP length | PAP |
|---|---|---|---|---|---|
| 3260 | NM_1780 14.2_385 | 385 | GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGANCCAGACAACTTTGT ATTTGGTCAGTCTGGGGCAGGTAACAACTGGGC CAAAGGCCACTACACAGAGGGCGCCGAGCTGG TTGATTCTGTCCTGGATGTGGTACGGAAGGAGG CAGAGAGCTGTGACTGCCTGCAGGGCTTCCAGC TGACCCACTCACTGGGCGGGGGCACAGGCTCT GGAATGGGCACTCTCCTTATCAGCAAGATCCGA GAAGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 12 | XRQLCIWSVW GR* |
| 3261 | NM_1780 14.2_402 | 402 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTNTGGTCAGTCTGGGGCAGGTAACAACTGGGC CAAAGGCCACTACACAGAGGGCGCCGAGCTGG TTGATTCTGTCCTGGATGTGGTACGGAAGGAGG CAGAGAGCTGTGACTGCCTGCAGGGCTTCCAGC TGACCCACTCACTGGGCGGGGGCACAGGCTCT GGAATGGGCACTCTCCTTATCAGCAAGATCCGA GAAGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 7 | XWSVWGR* |

TABLE 3B-continued

| SEQ ID | identifier_position | position | modified RNA | PAP length | PAP |
|---|---|---|---|---|---|
| 3262 | NM_178014.2_566 | 566 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAANTGGGCACTCTCCTTATCAGCAAGATCCGA GAAGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 14 | XGHSPYQQD PRRIP* |
| 3263 | NM_178014.2_570 | 570 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGNCACTCTCCTTATCAGCAAGATCCGA GAAGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 12 | HSPYQQDPR RIP* |
| 3264 | NM_178014.2_593 | 593 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC | 5 | XRRIP* |

TABLE 3B-continued

| SEQ ID | identifier_position | position | modified RNA | PAP length | PAP |
|---|---|---|---|---|---|
| | | | AGAGAGCTGTGACTGCCTGCAGGGCTTCCAGCT GACCCACTCACTGGGCGGGGGCACAGGCTCTG GAATGGGCACTCTCCTTATCAGCAAGATCCNGA GAAGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | | |
| 3265 | NM_1780 14.2_598 | 598 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AANGAATACCCTGATCGCATCATGAATACCTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 3 | XIP* |
| 3266 | NM_1780 14.2_625 | 625 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCNTTCA GTGTGGTGCCTTCACCCAAAGTGTCTGACACCG TGGTCGAGCCCTACAATGCCACCCTCTCCGTCC ATCAGTTGGTAGAGAATACTGATGAGACCTATTG CATTGACAACGAGGCCCTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC | 10 | XQCGAFTQSV* |

TABLE 3B-continued

| SEQ ID | identifier_position | position | modified RNA | PAP length | PAP |
|---|---|---|---|---|---|
| 3267 | NM_1780 14.2_665 | 665 | AGCAGTATCGAGCTCTCACAGTGCCGGAACTCA<br>CCCAGCAGGTCTTCGATGCCAAGAACAT<br>GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGNTCGAGCCCTACAATGCCACCCTCTCCGTCC<br>ATCAGTTGGTAGAGAATACTGATGAGACCTATTG<br>CATTGACAACGAGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 17 | XRALQCHPLR PSVGREY* |
| 3268 | NM_1780 14.2_686 | 686 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCNTCTCCGTCC<br>ATCAGTTGGTAGAGAATACTGATGAGACCTATTG<br>CATTGACAACGAGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 10 | XLRPSVGREY* |
| 3269 | NM_1780 14.2_704 | 704 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC | 4 | XREY* |

TABLE 3B-continued

| SEQ ID | identifier_position | position | modified RNA | PAP length | PAP |
|---|---|---|---|---|---|
| | | | AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGNTAGAGAATACTGATGAGACCTATTG<br>CATTGACAACGAGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | | |
| 3270 | NM_1780<br>14.2_741 | 741 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGANGGCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 4 | XGPL* |
| 3271 | NM_1780<br>14.2_743 | 743 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGNCCCTCTATGATATCTGCTTC<br>CGCACTCTGAAGCTGACCACACCAACCTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC | 3 | XPL* |

TABLE 3B-continued

| SEQ ID | identifier_position | position | modified RNA | PAP length | PAP |
|---|---|---|---|---|---|
| 3272 | NM_1780 14.2_746 | 746 | CTGGCTTTGCCCCTCTCACCAGCCGTGGAAGCC AGCAGTATCGAGCTCTCACAGTGCCGGAACTCA CCCAGCAGGTCTTCGATGCCAAGAACAT GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCNTCTATGATATCTGCTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 2 | XL* |
| 3273 | NM_1780 14.2_760 | 760 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCTCTATGATATCTGCNTTC CGCACTCTGAAGCTGACCACACCAACCTACGGG GATCTGAACCACCTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 37 | XPHSEADHTN LRGSEPPCLS HHEWCHHLP PFPWPAQC* |
| 3274 | NM_1780 14.2_790 | 790 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA | 27 | XRGSEPPCLS HHEWCHHLP PFPWPAQC* |

| SEQ ID | identifier_position | position | modified RNA | PAP length | PAP |
|---|---|---|---|---|---|
| | | | TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCNTACGGG<br>GATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | | |
| 3275 | NM_1780<br>14.2_797 | 797 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCTACGGGG<br>NATCTGAACCACCTTGTCTCAGCCACCATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 25 | XSEPPCLSHH<br>EWCHHLPPFP<br>WPAQC* |
| 3276 | NM_1780<br>14.2_804 | 804 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCTACGGGG<br>ATCTGAANCCACCTTGTCTCAGCCACCATGAGT<br>GGTGTCACCACCTGCCTCCGTTTCCCTGGCCAG<br>CTCAATGCTGACCTCCGCAAGTTGGCAGTCAAC | 23 | XPPCLSHHEW<br>CHHLPPFPWP<br>AQC* |

TABLE 3B-continued

| SEQ ID | identifier_ position | position | modified RNA | PAP length | PAP |
|---|---|---|---|---|---|
| 3277 | NM_1780 14.2_809 | 809 | ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCTCTATGATATCTGCTTCC GCACTCTGAAGCTGACCACACCAACCTACGGGG ATCTGAACCACCNTTGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 21 | XCLSHHEWC HHLPPFPWPA QC* |
| 3278 | NM_1780 14.2_811 | 811 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCTCTATGATATCTGCTTCC GCACTCTGAAGCTGACCACACCAACCTACGGGG ATCTGAACCACCTTNGTCTCAGCCACCATGAGT GGTGTCACCACCTGCCTCCGTTTCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 20 | XLSHHEWCH HLPPFPWPAQ C* |
| 3279 | NM_1780 14.2_823 | 823 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC | 16 | XEWCHHLPPF PWPAQC* |

TABLE 3B-continued

| SEQ ID | identifier_position | position | modified RNA | PAP length | PAP |
|---|---|---|---|---|---|
| | | | TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCTACGGGG<br>ATCTGAACCACCTTGTCTCAGCCACCNATGAGT<br>GGTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | | |
| 3280 | NM_17801<br>4.2_831 | 831 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCTACGGGG<br>ATCTGAACCACCTTGTCTCAGCCACCATGAGTG<br>GNTGTCACCACCTGCCTCCGTTTCCCTGGCCAG<br>CTCAATGCTGACCTCCGCAAGTTGGCAGTCAAC<br>ATGGTCCCCTTCCCACGTCTCCATTTCTTTATGC<br>CTGGCTTTGCCCCTCTCACCAGCCGTGGAAGCC<br>AGCAGTATCGAGCTCTCACAGTGCCGGAACTCA<br>CCCAGCAGGTCTTCGATGCCAAGAACAT | 13 | CHHLPPFPWP<br>AQC* |
| 3281 | NM_17801<br>4.2_845 | 845 | GCACCTCGCTGCTCCAGCCTCTGGGGCGCATTC<br>CAACCTTCCAGCCTGCGACCTGCGGAGAAAAAA<br>AATTACTTATTTTCTTGCCCCATACATACCTTGAG<br>GCGAGCAAAAAAATTAAATTTTAACCATGAGGGA<br>AATCGTGCACATCCAGGCTGGTCAGTGTGGCAA<br>CCAGATCGGTGCCAAGTTCTGGGAGGTGATCAG<br>TGATGAACATGGCATCGACCCCACCGGCACCTA<br>CCACGGGGACAGCGACCTGCAGCTGGACCGCA<br>TCTCTGTGTACTACAATGAAGCCACAGGTGGCA<br>AATATGTTCCTCGTGCCATCCTGGTGGATCTAGA<br>ACCTGGGACCATGGACTCTGTTCGCTCAGGTCC<br>TTTTGGCCAGATCTTTAGACCAGACAACTTTGTA<br>TTTGGTCAGTCTGGGGCAGGTAACAACTGGGCC<br>AAAGGCCACTACACAGAGGGCGCCGAGCTGGT<br>TGATTCTGTCCTGGATGTGGTACGGAAGGAGGC<br>AGAGAGCTGTGACTGCCTGCAGGGCTTCCAGCT<br>GACCCACTCACTGGGCGGGGGCACAGGCTCTG<br>GAATGGGCACTCTCCTTATCAGCAAGATCCGAG<br>AAGAATACCCTGATCGCATCATGAATACCTTCAG<br>TGTGGTGCCTTCACCCAAAGTGTCTGACACCGT<br>GGTCGAGCCCTACAATGCCACCCTCTCCGTCCA<br>TCAGTTGGTAGAGAATACTGATGAGACCTATTGC<br>ATTGACAACGAGGCCCTCTATGATATCTGCTTCC<br>GCACTCTGAAGCTGACCACACCAACCTACGGGG<br>ATCTGAACCACCTTGTCTCAGCCACCATGAGTG<br>GTGTCACCACCTGCCNTCCGTTTCCCTGGCCAG | 9 | XPFPWPAQC* |

TABLE 3B-continued

| SEQ ID | identifier_ position | position | modified RNA | PAP length | PAP |
|---|---|---|---|---|---|
| 3282 | NM_1780 14.2_852 | 852 | CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCTCTATGATATCTGCTTCC GCACTCTGAAGCTGACCACACCAACCTACGGGG ATCTGAACCACCTTGTCTCAGCCACCATGAGTG GTGTCACCACCTGCCTCCGTTTNCCCTGGCCAG CTCAATGCTGACCTCCGCAAGTTGGCAGTCAAC ATGGTCCCCTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 7 | XPWPAQC* |
| 3283 | NM_1780 14.2_904 | 904 | GCACCTCGCTGCTCCAGCCTCTGGGGCGCATTC CAACCTTCCAGCCTGCGACCTGCGGAGAAAAAA AATTACTTATTTTCTTGCCCCATACATACCTTGAG GCGAGCAAAAAAATTAAATTTTAACCATGAGGGA AATCGTGCACATCCAGGCTGGTCAGTGTGGCAA CCAGATCGGTGCCAAGTTCTGGGAGGTGATCAG TGATGAACATGGCATCGACCCCACCGGCACCTA CCACGGGGACAGCGACCTGCAGCTGGACCGCA TCTCTGTGTACTACAATGAAGCCACAGGTGGCA AATATGTTCCTCGTGCCATCCTGGTGGATCTAGA ACCTGGGACCATGGACTCTGTTCGCTCAGGTCC TTTTGGCCAGATCTTTAGACCAGACAACTTTGTA TTTGGTCAGTCTGGGGCAGGTAACAACTGGGCC AAAGGCCACTACACAGAGGGCGCCGAGCTGGT TGATTCTGTCCTGGATGTGGTACGGAAGGAGGC AGAGAGCTGTGACTGCCTGCAGGGCTTCCAGCT GACCCACTCACTGGGCGGGGGCACAGGCTCTG GAATGGGCACTCTCCTTATCAGCAAGATCCGAG AAGAATACCCTGATCGCATCATGAATACCTTCAG TGTGGTGCCTTCACCCAAAGTGTCTGACACCGT GGTCGAGCCCTACAATGCCACCCTCTCCGTCCA TCAGTTGGTAGAGAATACTGATGAGACCTATTGC ATTGACAACGAGGCCCTCTATGATATCTGCTTCC GCACTCTGAAGCTGACCACACCAACCTACGGGG ATCTGAACCACCTTGTCTCAGCCACCATGAGTG GTGTCACCACCTGCCTCCGTTTCCCTGGCAGC TCAATGCTGACCTCCGCAAGTTGGCAGTCAACA TGGTCCCCNTTCCCACGTCTCCATTTCTTTATGC CTGGCTTTGCCCCTCTCACCAGCCGTGGAAGCC AGCAGTATCGAGCTCTCACAGTGCCGGAACTCA CCCAGCAGGTCTTCGATGCCAAGAACAT | 44 | XPTSPFLYAW LCPSHQPWK PAVSSSHSAG THPAGLRCQE HDGCL* |
| 3284 | NM_1816 97.1_633 | 633 | ACTCTCGCGAGATCCCTACTGGCTATAAAGGCA GCGCCCCGGAGAGCTCTTGCGCGTCTTGTTCTT GCCTGGTGTCGGTGGTTAGTTTCTGCGACTTGT GTTGGGACTGCTGATAGGAAGATGTCTTCAGGA AATGCTAAAATTGGGCACCCTGCCCCCAACTTC AAAGCCACAGCTGTTATGCCAGATGGTCAGTTTA AAGATATCAGCCTGTCTGACTACAAAGGAAAATA TGTTTGTGTTCTTCTTTTACCCTCTTGACTTCACCT TTGTGTGCCCCACGGAGATCATTGCTTTCAGTG ATAGGGCAGAAGAATTTAAGAAACTCAACTGCCA | 10 | XVPSWLETW Q* |

TABLE 3B-continued

| SEQ ID | identifier_position | position | modified RNA | PAP length | PAP |
|---|---|---|---|---|---|
| | | | AGTGATTGGTGCTTCTGTGGATTCTCACTTCTGT<br>CATCTAGCATGGGTCAATACACCTAAGAAACAAG<br>GAGGACTGGGACCCATGAACATTCCTTTGGTAT<br>CAGACCCGAAGCGCACCATTGCTCAGGATTATG<br>GGGTCTTAAAGGCTGATGAAGGCATCTCGTTCA<br>GGGGCCTTTTTATCATTGATGATAAGGGTATTCT<br>TCGGCAGATCACTGTAAATGACCTCCCTGTTGG<br>CCGCTCTGTGGATGAGACTTTGAGACTAGTTCA<br>GGCCTTCCAGTTCACTGACAAACATGGGGAANG<br>TGTGCCCAGCTGGCTGGAAACCTGGCAGTGATA<br>CCATCAAGCCTGATGTCCAAAAGAGCAAAGAAT<br>ATTTCTCCAAGCAGAAGTGAGCGCTGGGCTGTT<br>TTAGTGCCAGGCTGCGGTGGGCAGCCATGAGA<br>ACAAAACCTCTTCTGTATTTTTTTTTTCCATTAGT<br>AAAACACAAGACTTCAGATTCAGCCGAATTGTGG<br>TGTCTTACAAGGCAGGCCTTTCCTACAGGGGGT<br>GGAGAGACCAGCCTTTCTTCCTTTGGTAGGAAT<br>GGCCTGAGTTGGCGTTGTGGGCAGGCTACTGG<br>TTTGTATGATGTATTAGTAGAGCAACCCATTAAT<br>CTTTTGTAGTTTGTATTAAACTTGAACTGAGACCT<br>TGATGAGTCTTTAAAAAAAAAA | | |
| 3285 | NM_182471.1_246 | 246 | CGCCGCGCTTCCTCCTGAAGGTGACTGCGCCC<br>GCGGGGACGCAGGGGGCGGGGCCCGGGTCGC<br>CCGGAGCCGGGATTGGGCAGAGGGCGGGGCG<br>GCGGAGGGATTGCGGCGGCCCGCAGCGGGATA<br>ACCTTGAGGCTGAGGCAGTGGCTCCTTGCACAG<br>CAGCTGCACGCGCCGTGGCTCCGGATCTCTTCG<br>TCTTTGCAGCGTAGCCCGAGTCGGTCAGCGCCG<br>GAGGACCTCAGCAGCCATGTCNGAAGCCCCATA<br>GTGAAGCCGGGACTGCCTTCATTCAGACCCAGC<br>AGCTGCACGCAGCCATGGCTGACACATTCCTGG<br>AGCACATGTGCCGCCTGGACATTGATTCACCAC<br>CCATCACAGCCCGGAACACTGGCATCATCTGTA<br>CCATTGGCCCAGCTTCCCGATCAGTGGAGACGT<br>TGAAGGAGATGATTAAGTCTGGAATGAATGTGG<br>CTCGTCTGAACTTCTCTCATGGAACTCATGAGTA<br>CCATGCGGAGACCATCAAGAATGTGCGCACAGC<br>CACGGAAAGCTTTGCTTCTGACCCCATCCTCTAC<br>CGGCCCGTTGCTGTGGCTCTAGACACTAAAGGA<br>CCTGAGATCCGAACTGGGCTCATCAAGGGCAGC<br>GGCACTGCAGAGGTGGAGCTGAAGAAGGGAGC<br>CACTCTCAAAATCACGCTGGATAACGCCTACATG<br>GAAAAGTGTGACGAGAACATCCTGTGGCTGGAC<br>TACAAGAACATCTGCAAGGTGGTGGAAGTGGGC<br>AGCAAGATCTACGTGGATGATGGGCTTATTTCTC<br>TCCAGGTGAAGCAGAAAGGTGCCGACTTCCTGG<br>TGACGGAGGTGGAAAATGGTGGCTCCTTGGGCA<br>GCAAGAAGGGTGTGAACCTTCCTGGGGCTGCTG<br>TGGACTTGCCTGCTGTGTCGGAGAAGGACATCC<br>AGGATCTGAAGTTTGGGGTCGAGCAGGATGTTG<br>ATATGGTGTTTGCGTCATTCATCCGCAAGGCATC<br>TGATGTCCATGAAGTTAGGAAGGTCCTGGGAGA<br>GAA | 3 | EAP* |
| 3286 | NM_182471.1_450 | 450 | CGCCGCGCTTCCTCCTGAAGGTGACTGCGCCC<br>GCGGGGACGCAGGGGGCGGGGCCCGGGTCGC<br>CCGGAGCCGGGATTGGGCAGAGGGCGGGGCG<br>GCGGAGGGATTGCGGCGGCCCGCAGCGGGATA<br>ACCTTGAGGCTGAGGCAGTGGCTCCTTGCACAG<br>CAGCTGCACGCGCCGTGGCTCCGGATCTCTTCG<br>TCTTTGCAGCGTAGCCCGAGTCGGTCAGCGCCG<br>GAGGACCTCAGCAGCCATGTCGAAGCCCCATAG<br>TGAAGCCGGGACTGCCTTCATTCAGACCCAGCA<br>GCTGCACGCAGCCATGGCTGACACATTCCTGGA<br>GCACATGTGCCGCCTGGACATTGATTCACCACC<br>CATCACAGCCCGGAACACTGGCATCATCTGTAC<br>CATTGGCCCAGCTTCCCGATCAGTGGAGACGTT<br>GAAGGAGATGATTAAGTCTGGAATGAANTGTGG<br>CTCGTCTGAACTTCTCTCATGGAACTCATGAGTA<br>CCATGCGGAGACCATCAAGAATGTGCGCACAGC<br>CACGGAAAGCTTTGCTTCTGACCCCATCCTCTAC<br>CGGCCCGTTGCTGTGGCTCTAGACACTAAAGGA<br>CCTGAGATCCGAACTGGGCTCATCAAGGGCAGC<br>GGCACTGCAGAGGTGGAGCTGAAGAAGGGAGC<br>CACTCTCAAAATCACGCTGGATAACGCCTACATG<br>GAAAAGTGTGACGAGAACATCCTGTGGCTGGAC<br>TACAAGAACATCTGCAAGGTGGTGGAAGTGGGC<br>AGCAAGATCTACGTGGATGATGGGCTTATTTCTC | 12 | XCGSSELLSWNS* |

TABLE 3B-continued

| SEQ ID | identifier_ position | position | modified RNA | PAP length | PAP |
|---|---|---|---|---|---|
| | | | TCCAGGTGAAGCAGAAAGGTGCCGACTTCCTGG TGACGGAGGTGGAAAATGGTGGCTCCTTGGGCA GCAAGAAGGGTGTGAACCTTCCTGGGGCTGCTG TGGACTTGCCTGCTGTGTCGGAGAAGGACATCC AGGATCTGAAGTTTGGGGTCGAGCAGGATGTTG ATATGGTGTTTGCGTCATTCATCCGCAAGGCATC TGATGTCCATGAAGTTAGGAAGGTCCTGGGAGA GAA | | |
| 3287 | NM_1824 71.1_492 | 492 | CGCCGCGCTTCCTCCTGAAGGTGACTGCGCCC GCGGGGACGCAGGGGGCGGGGCCCGGGTCGC CCGGAGCCGGGATTGGGCAGAGGGCGGGGCG GCGGAGGGATTGCGGCGGCCCGCAGCGGGATA ACCTTGAGGCTGAGGCAGTGGCTCCTTGCACAG CAGCTGCACGCGCCGTGGCTCCGGATCTCTTCG TCTTTGCAGCGTAGCCCGAGTCGGTCAGCGCCG GAGGACCTCAGCAGCCATGTCGAAGCCCCATAG TGAAGCCGGGACTGCCTTCATTCAGACCCAGCA GCTGCACGCAGCCATGGCTGACACATTCCTGGA GCACATGTGCCGCCTGGACATTGATTCACCACC CATCACAGCCCGGAACACTGGCATCATCTGTAC CATTGGCCCAGCTTCCCGATCAGTGGAGACGTT GAAGGAGATGATTAAGTCTGGAATGAATGTGGC TCGTCTGAACTTCTCTCATGGAACTCATGAGTAC CANTGCGGAGACCATCAAGAATGTGCGCACAGC CACGGAAAGCTTTGCTTCTGACCCCATCCTCTAC CGGCCCGTTGCTGTGGCTCTAGACACTAAAGGA CCTGAGATCCGAACTGGGCTCATCAAGGGCAGC GGCACTGCAGAGGTGGAGCTGAAGAAGGGAGC CACTCTCAAAATCACGCTGGATAACGCCTACATG GAAAAGTGTGACGAGAACATCCTGTGGCTGGAC TACAAGAACATCTGCAAGGTGGTGGAAGTGGGC AGCAAGATCTACGTGGATGATGGGCTTATTTCTC TCCAGGTGAAGCAGAAAGGTGCCGACTTCCTGG TGACGGAGGTGGAAAATGGTGGCTCCTTGGGCA GCAAGAAGGGTGTGAACCTTCCTGGGGCTGCTG TGGACTTGCCTGCTGTGTCGGAGAAGGACATCC AGGATCTGAAGTTTGGGGTCGAGCAGGATGTTG ATATGGTGTTTGCGTCATTCATCCGCAAGGCATC TGATGTCCATGAAGTTAGGAAGGTCCTGGGAGA GAA | 17 | XCGDHQECA HSHGKLCF* |
| 3288 | NM_1824 71.1_625 | 625 | CGCCGCGCTTCCTCCTGAAGGTGACTGCGCCC GCGGGGACGCAGGGGGCGGGGCCCGGGTCGC CCGGAGCCGGGATTGGGCAGAGGGCGGGGCG GCGGAGGGATTGCGGCGGCCCGCAGCGGGATA ACCTTGAGGCTGAGGCAGTGGCTCCTTGCACAG CAGCTGCACGCGCCGTGGCTCCGGATCTCTTCG TCTTTGCAGCGTAGCCCGAGTCGGTCAGCGCCG GAGGACCTCAGCAGCCATGTCGAAGCCCCATAG TGAAGCCGGGACTGCCTTCATTCAGACCCAGCA GCTGCACGCAGCCATGGCTGACACATTCCTGGA GCACATGTGCCGCCTGGACATTGATTCACCACC CATCACAGCCCGGAACACTGGCATCATCTGTAC CATTGGCCCAGCTTCCCGATCAGTGGAGACGTT GAAGGAGATGATTAAGTCTGGAATGAATGTGGC TCGTCTGAACTTCTCTCATGGAACTCATGAGTAC CATGCGGAGACCATCAAGAATGTGCGCACAGCC ACGGAAAGCTTTGCTTCTGACCCCATCCTCTACC GGCCCGTTGCTGTGGCTCTAGACACTAAAGGAC CTGAGATCCGAACTGGGCTCATCAAGGGCAGCG GCNACTGCAGAGGTGGAGCTGAAGAAGGGAGC CACTCTCAAAATCACGCTGGATAACGCCTACATG GAAAAGTGTGACGAGAACATCCTGTGGCTGGAC TACAAGAACATCTGCAAGGTGGTGGAAGTGGGC AGCAAGATCTACGTGGATGATGGGCTTATTTCTC TCCAGGTGAAGCAGAAAGGTGCCGACTTCCTGG TGACGGAGGTGGAAAATGGTGGCTCCTTGGGCA GCAAGAAGGGTGTGAACCTTCCTGGGGCTGCTG TGGACTTGCCTGCTGTGTCGGAGAAGGACATCC AGGATCTGAAGTTTGGGGTCGAGCAGGATGTTG ATATGGTGTTTGCGTCATTCATCCGCAAGGCATC TGATGTCCATGAAGTTAGGAAGGTCCTGGGAGA GAA | 17 | XCRGGAEEG SHSQNHAG* |
| 3289 | NM_1824 71.1_644 | 644 | CGCCGCGCTTCCTCCTGAAGGTGACTGCGCCC GCGGGGACGCAGGGGGCGGGGCCCGGGTCGC CCGGAGCCGGGATTGGGCAGAGGGCGGGGCG GCGGAGGGATTGCGGCGGCCCGCAGCGGGATA ACCTTGAGGCTGAGGCAGTGGCTCCTTGCACAG | 11 | XEGSHSQNH AG* |

TABLE 3B-continued

| SEQ ID | identifier_position | position | modified RNA | PAP length | PAP |
|---|---|---|---|---|---|
| | | | CAGCTGCACGCGCCGTGGCTCCGGATCTCTTCG TCTTTGCAGCGTAGCCCGAGTCGGTCAGCGCCG GAGGACCTCAGCAGCCATGTCGAAGCCCCATAG TGAAGCCGGGACTGCCTTCATTCAGACCCAGCA GCTGCACGCAGCCATGGCTGACACATTCCTGGA GCACATGTGCCGCCTGGACATTGATTCACCACC CATCACAGCCCGGAACACTGGCATCATCTGTAC CATTGGCCCAGCTTCCCGATCAGTGGAGACGTT GAAGGAGATGATTAAGTCTGGAATGAATGTGGC TCGTCTGAACTTCTCTCATGGAACTCATGAGTAC CATGCGGAGACCATCAAGAATGTGCGCACAGCC ACGGAAAGCTTTGCTTCTGACCCCATCCTCTACC GGCCCGTTGCTGTGGCTCTAGACACTAAAGGAC CTGAGATCCGAACTGGGCTCATCAAGGGCAGCG GCACTGCAGAGGTGGAGCTGANAGAAGGGAGC CACTCTCAAAATCACGCTGGATAACGCCTACATG GAAAAGTGTGACGAGAACATCCTGTGGCTGGAC TACAAGAACATCTGCAAGGTGGTGGAAGTGGGC AGCAAGATCTACGTGGATGATGGGCTTATTTCTC TCCAGGTGAAGCAGAAAGGTGCCGACTTCCTGG TGACGGAGGTGGAAAATGGTGGCTCCTTGGGCA GCAAGAAGGGTGTGAACCTTCCTGGGGCTGCTG TGGACTTGCCTGCTGTGTCGGAGAAGGACATCC AGGATCTGAAGTTTGGGGTCGAGCAGGATGTTG ATATGGTGTTTGCGTCATTCATCCGCAAGGCATC TGATGTCCATGAAGTTAGGAAGGTCCTGGGAGA GAA | | |
| 3290 | NM_1824 71.1_645 | 645 | CGCCGCGCTTCCTCCTGAAGGTGACTGCGCCC GCGGGGACGCAGGGGGCGGGGCCCGGGTCGC CCGGAGCCGGGATTGGGCAGAGGGCGGGGCG GCGGAGGGATTGCGGCGGCCCGCAGCGGGATA ACCTTGAGGCTGAGGCAGTGGCTCCTTGCACAG CAGCTGCACGCGCCGTGGCTCCGGATCTCTTCG TCTTTGCAGCGTAGCCCGAGTCGGTCAGCGCCG GAGGACCTCAGCAGCCATGTCGAAGCCCCATAG TGAAGCCGGGACTGCCTTCATTCAGACCCAGCA GCTGCACGCAGCCATGGCTGACACATTCCTGGA GCACATGTGCCGCCTGGACATTGATTCACCACC CATCACAGCCCGGAACACTGGCATCATCTGTAC CATTGGCCCAGCTTCCCGATCAGTGGAGACGTT GAAGGAGATGATTAAGTCTGGAATGAATGTGGC TCGTCTGAACTTCTCTCATGGAACTCATGAGTAC CATGCGGAGACCATCAAGAATGTGCGCACAGCC ACGGAAAGCTTTGCTTCTGACCCCATCCTCTACC GGCCCGTTGCTGTGGCTCTAGACACTAAAGGAC CTGAGATCCGAACTGGGCTCATCAAGGGCAGCG GCACTGCAGAGGTGGAGCTGAANGAAGGGAGC CACTCTCAAAATCACGCTGGATAACGCCTACATG GAAAAGTGTGACGAGAACATCCTGTGGCTGGAC TACAAGAACATCTGCAAGGTGGTGGAAGTGGGC AGCAAGATCTACGTGGATGATGGGCTTATTTCTC TCCAGGTGAAGCAGAAAGGTGCCGACTTCCTGG TGACGGAGGTGGAAAATGGTGGCTCCTTGGGCA GCAAGAAGGGTGTGAACCTTCCTGGGGCTGCTG TGGACTTGCCTGCTGTGTCGGAGAAGGACATCC AGGATCTGAAGTTTGGGGTCGAGCAGGATGTTG ATATGGTGTTTGCGTCATTCATCCGCAAGGCATC TGATGTCCATGAAGTTAGGAAGGTCCTGGGAGA GAA | 11 | XEGSHSQNH AG* |
| 3291 | NM_1824 71.1_692 | 692 | CGCCGCGCTTCCTCCTGAAGGTGACTGCGCCC GCGGGGACGCAGGGGGCGGGGCCCGGGTCGC CCGGAGCCGGGATTGGGCAGAGGGCGGGGCG GCGGAGGGATTGCGGCGGCCCGCAGCGGGATA ACCTTGAGGCTGAGGCAGTGGCTCCTTGCACAG CAGCTGCACGCGCCGTGGCTCCGGATCTCTTCG TCTTTGCAGCGTAGCCCGAGTCGGTCAGCGCCG GAGGACCTCAGCAGCCATGTCGAAGCCCCATAG TGAAGCCGGGACTGCCTTCATTCAGACCCAGCA GCTGCACGCAGCCATGGCTGACACATTCCTGGA GCACATGTGCCGCCTGGACATTGATTCACCACC CATCACAGCCCGGAACACTGGCATCATCTGTAC CATTGGCCCAGCTTCCCGATCAGTGGAGACGTT GAAGGAGATGATTAAGTCTGGAATGAATGTGGC TCGTCTGAACTTCTCTCATGGAACTCATGAGTAC CATGCGGAGACCATCAAGAATGTGCGCACAGCC ACGGAAAGCTTTGCTTCTGACCCCATCCTCTACC GGCCCGTTGCTGTGGCTCTAGACACTAAAGGAC | 2 | XV* |

TABLE 3B-continued

| SEQ ID | identifier_position | position | modified RNA | PAP length | PAP |
|---|---|---|---|---|---|
| | | | CTGAGATCCGAACTGGGCTCATCAAGGGCAGCG GCACTGCAGAGGTGGAGCTGAAGAAGGGAGCC ACTCTCAAAATCACGCTGGATAACGCCTACATG GAAAANAGTGTGACGAGAACATCCTGTGGCTGGA CTACAAGAACATCTGCAAGGTGGTGGAAGTGGG CAGCAAGATCTACGTGGATGATGGGCTTATTTCT CTCCAGGTGAAGCAGAAAGGTGCCGACTTCCTG GTGACGGAGGTGGAAAATGGTGGCTCCTTGGG CAGCAAGAAGGGTGTGAACCTTCCTGGGGCTGC TGTGGACTTGCCTGCTGTGTCGGAGAAGGACAT CCAGGATCTGAAGTTTGGGGTCGAGCAGGATGT TGATATGGTGTTTGCGTCATTCATCCGCAAGGCA TCTGATGTCCATGAAGTTAGGAAGGTCCTGGGA GAGAA | | |
| 3292 | NM_1840 41.1_1312 | 312 | GTGGTGCCTTTAAAAGGCCGGGCGCCGCCTTCC GCCTGCCCGCCTCCTGCGCCGCCCCTTCCGAG GCTAAATCGGCTGCGTTCCTCTCGGAACGCGCC GCAGAAGGGGTCCTGGTGACGAGTCCCGCGTT CTCTCCTTGAATCCACTCGCCAGCCCGCCGCCC TCTGCCGCCGCACCCTGCACACCCGCCCCTCTC CTGTGCCAGGAACTTGCTACTACCAGCACCATG CCCTACCAATATCCAGCACTGACCCCGGAGCAG AAGAAGGAGCTGTCTGACATCGCTCACCGCATC GTGGCACCTGGCAAGGGNCATCCTGGCTGCAG ATGAGTCCACTGGGAGCATTGCCAAGCGGCTGC AGTCCATTGGCACCGAGAACACCGAGGAGAACC GGCGCTTCTACCGCCAGCTGCTGCTGACAGCTG ACGACCGCGTGAACCCCTGCATTGGGGGTGTCA TCCTCTTCCATGAGACACTCTACCAGAAGGCGG ATGATGGGCGTCCCTTCCCCCAAGTTATCAAATC CAAGGGCGGTGTTGTGGGCATCAAGGTAGACAA GGGCGTGGTCCCCCTGGCAGGGACAAATGGCG AGACTACCACCCAAGGGTTGGATGGGCTGTCTG AGCGCTGTGCCCAGTACAAGAAGGACGGAGCT GACTTCGCCAAGTGGCGTTGTGTGCTGAAGATT GGGGAACACACCCCCTCAGCCCTCGCCATCATG GAAAATGCCAATGTTCTGGCCCGTTATGCCAGT ATCTGCCAGCAGAATGGCATTGTGCCCATCGTG GAGCCTGAGATCCTCCCTGATGGGGACCATGAC TTGAAGCGCTGCCAGTATGTGACCGAGAAGGTG CTGGCTGCTGTCTACAAGGCTCTGAGTGACCAC CACATCTACCTGGAAGGCACCTTGCTGAAGCCC AACATGGTCACCCCAGGCCATGCTTGCACTCAG AAGTTTTCTCATGAGGAGATTGCCATGGCGACC GTCACAGCGCTGCGCCGCACAGTGCCCCCCGC TGTCAC | 5 | HPGCR* |
| 3293 | NM_1840 41.1_572 | 572 | GTGGTGCCTTTAAAAGGCCGGGCGCCGCCTTCC GCCTGCCCGCCTCCTGCGCCGCCCCTTCCGAG GCTAAATCGGCTGCGTTCCTCTCGGAACGCGCC GCAGAAGGGGTCCTGGTGACGAGTCCCGCGTT CTCTCCTTGAATCCACTCGCCAGCCCGCCGCCC TCTGCCGCCGCACCCTGCACACCCGCCCCTCTC CTGTGCCAGGAACTTGCTACTACCAGCACCATG CCCTACCAATATCCAGCACTGACCCCGGAGCAG AAGAAGGAGCTGTCTGACATCGCTCACCGCATC GTGGCACCTGGCAAGGGCATCCTGGCTGCAGA TGAGTCCACTGGGAGCATTGCCAAGCGGCTGCA GTCCATTGGCACCGAGAACACCGAGGAGAACC GGCGCTTCTACCGCCAGCTGCTGCTGACAGCTG ACGACCGCGTGAACCCCTGCATTGGGGGTGTCA TCCTCTTCCATGAGACACTCTACCAGAAGGCGG ATGATGGGCGTCCCTTCCCCCAAGTTATCAAATC CAAGGGCGGTGTTGTGGGCATCAAGGTAGACAA GGGCGTGGTCCCCCNTGGCAGGGACAAATGGC GAGACTACCACCCAAGGGTTGGATGGGCTGTCT GAGCGCTGTGCCCAGTACAAGAAGGACGGAGC TGACTTCGCCAAGTGGCGTTGTGTGCTGAAGAT TGGGGAACACACCCCCTCAGCCCTCGCCATCAT GGAAAATGCCAATGTTCTGGCCCGTTATGCCAG TATCTGCCAGCAGAATGGCATTGTGCCCATCGT GGAGCCTGAGATCCTCCCTGATGGGGACCATGA CTTGAAGCGCTGCCAGTATGTGACCGAGAAGGT GCTGGCTGCTGTCTACAAGGCTCTGAGTGACCA CCACATCTACCTGGAAGGCACCTTGCTGAAGCC CAACATGGTCACCCCAGGCCATGCTTGCACTCA GAAGTTTTCTCATGAGGAGATTGCCATGGCGAC | 17 | XGRDKWRDY HPRVGWAV* |

TABLE 3B-continued

| SEQ ID | identifier_position | position | modified RNA | PAP length | PAP |
|---|---|---|---|---|---|
| 3294 | NM_1985 89.1_799 | 799 | CGTCACAGCGCTGCGCCGCACAGTGCCCCCG CTGTCAC GTGCGCGCGCCCGGTCCGCGCCTCCGCCGCTT TTTATAGCGGCCGCGGGCGGCGGCGGCAGCGG TTGGAGGTTGTAGGACCGGCGAGGAATAGGAAT CATGGCGGCTGCGCTGTTCGTGCTGCTGGGATT CGCGCTGCTGGGCACCCACGGAGCCTCCGGGG CTGCCGGCACAGTCTTCACTACCGTAGAAGACC TTGGCTCCAAGATACTCCTCACCTGCTCCTTGAA TGACAGCGCCACAGAGGTCACAGGGCACCGCT GGCTGAAGGGGGGCGTGGTGCTGAAGGAGGAC GCGCTGCCCGGCCAGAAAACGGAGTTCAAGGT GGACTCCGACGACCAGTGGGGAGAGTACTCCT GCGTCTTCCTCCCCGAGCCCATGGGCACGGCC AACATCCAGCTCCACGGGCCTCCCAGAGTGAAG GCTGTGAAGTCGTCAGAACACATCAACGAGGGG GAGACGGCCATGCTGGTCTGCAAGTCAGAGTCC GTGCCACCTGTCACTGACTGGGCCTGGTACAAG ATCACTGACTCTGAGGACAAGGCCCTCATGAAC GGCTCCGAGAGCAGGTTCTTCGTGAGTTCCTCG CAGGGCCGGTCAGAGCTACACATTGAGAACCTG AACATGGAGGCCGACCCCGGCCAGTACCGGTG CAACGGCACCAGCTCCAAGGGCTCCGACCAGG CCATCATCACGCTCCGCGTGCGCAGCCACCTGG CCGCCCTCTGGCCCTTCCTGGGCATCGTGGCTG AGGTGCTGGTGCTGGTCACCATCATCTTCATCTA CGAGAAGCGCCGGAANGCCCGAGGACGTCCTG GATGATGACGACGCCGGCTCTGCACCCCTGAAG AGCAGCGGGCAGCACCAGAATGACAAAGGCAA GAACGTCCGCCAGAGGAACTCTTCCTGAGGCAG GTGGCCCGAGGACGCTCCCTGCTCCACGTCTG CGCCGCCGCCGGAGTCCACTCCCAGTGCTTGC AAGATTCCAAGTTCTCACCTCTTAAAGAAAACCC ACCCCGTAGATT | 7 | XARGRPG* |
| 3295 | NM_1985 89.1_816 | 816 | GTGCGCGCGCCCGGTCCGCGCCTCCGCCGCTT TTTATAGCGGCCGCGGGCGGCGGCGGCAGCGG TTGGAGGTTGTAGGACCGGCGAGGAATAGGAAT CATGGCGGCTGCGCTGTTCGTGCTGCTGGGATT CGCGCTGCTGGGCACCCACGGAGCCTCCGGGG CTGCCGGCACAGTCTTCACTACCGTAGAAGACC TTGGCTCCAAGATACTCCTCACCTGCTCCTTGAA TGACAGCGCCACAGAGGTCACAGGGCACCGCT GGCTGAAGGGGGGCGTGGTGCTGAAGGAGGAC GCGCTGCCCGGCCAGAAAACGGAGTTCAAGGT GGACTCCGACGACCAGTGGGGAGAGTACTCCT GCGTCTTCCTCCCCGAGCCCATGGGCACGGCC AACATCCAGCTCCACGGGCCTCCCAGAGTGAAG GCTGTGAAGTCGTCAGAACACATCAACGAGGGG GAGACGGCCATGCTGGTCTGCAAGTCAGAGTCC GTGCCACCTGTCACTGACTGGGCCTGGTACAAG ATCACTGACTCTGAGGACAAGGCCCTCATGAAC GGCTCCGAGAGCAGGTTCTTCGTGAGTTCCTCG CAGGGCCGGTCAGAGCTACACATTGAGAACCTG AACATGGAGGCCGACCCCGGCCAGTACCGGTG CAACGGCACCAGCTCCAAGGGCTCCGACCAGG CCATCATCACGCTCCGCGTGCGCAGCCACCTGG CCGCCCTCTGGCCCTTCCTGGGCATCGTGGCTG AGGTGCTGGTGCTGGTCACCATCATCTTCATCTA CGAGAAGCGCCGGAAGCCCGAGGACGTCCTGG NATGATGACGACGCCGGCTCTGCACCCCTGAAG AGCAGCGGGCAGCACCAGAATGACAAAGGCAA GAACGTCCGCCAGAGGAACTCTTCCTGAGGCAG GTGGCCCGAGGACGCTCCCTGCTCCACGTCTG CGCCGCCGCCGGAGTCCACTCCCAGTGCTTGC AAGATTCCAAGTTCTCACCTCTTAAAGAAAACCC ACCCCGTAGATT | 1 | X* |
| 3296 | NM_1985 89.1_832 | 832 | GTGCGCGCGCCCGGTCCGCGCCTCCGCCGCTT TTTATAGCGGCCGCGGGCGGCGGCGGCAGCGG TTGGAGGTTGTAGGACCGGCGAGGAATAGGAAT CATGGCGGCTGCGCTGTTCGTGCTGCTGGGATT CGCGCTGCTGGGCACCCACGGAGCCTCCGGGG CTGCCGGCACAGTCTTCACTACCGTAGAAGACC TTGGCTCCAAGATACTCCTCACCTGCTCCTTGAA TGACAGCGCCACAGAGGTCACAGGGCACCGCT GGCTGAAGGGGGGCGTGGTGCTGAAGGAGGAC GCGCTGCCCGGCCAGAAAACGGAGTTCAAGGT GGACTCCGACGACCAGTGGGGAGAGTACTCCT | 12 | LCTPEEQRAA PE* |

TABLE 3B-continued

| SEQ ID | identifier_ position | position | modified RNA | PAP length | PAP |
|---|---|---|---|---|---|
| | | | GCGTCTTCCTCCCCGAGCCCATGGGCACGGCC AACATCCAGCTCCACGGGCCTCCCAGAGTGAAG GCTGTGAAGTCGTCAGAACACATCAACGAGGGG GAGACGGCCATGCTGGTCTGCAAGTCAGAGTCC GTGCCACCTGTCACTGACTGGGCCTGGTACAAG ATCACTGACTCTGAGGACAAGGCCCTCATGAAC GGCTCCGAGAGCAGGTTCTTCGTGAGTTCCTCG CAGGGCCGGTCAGAGCTACACATTGAGAACCTG AACATGGAGGCCGACCCCGGCCAGTACCGGTG CAACGGCACCAGCTCCAAGGGCTCCGACCAGG CCATCATCACGCTCCGCGTGCGCAGCCACCTGG CCGCCCTCTGGCCCTTCCTGGGCATCGTGGCTG AGGTGCTGGTGCTGGTCACCATCATCTTCATCTA CGAGAAGCGCCGGAAGCCCGAGGACGTCCTGG ATGATGACGACGCCGGNCTCTGCACCCCTGAAG AGCAGCGGGCAGCACCAGAATGACAAAGGCAA GAACGTCCGCCAGAGGAACTCTTCCTGAGGCAG GTGGCCCGAGGACGCTCCCTGCTCCACGTCTG CGCCGCCGCCGGAGTCCACTCCCAGTGCTTGC AAGATTCCAAGTTCTCACCTCTTAAAGAAAACCC ACCCCGTAGATT | | |
| 3297 | XM_0011 33517.1_ 396 | 396 | AATGAACTTTCCCTTTCGGCCGGAACCGCCATC TTCCAGTAATTCGCCAAAATGACGAACACAAAGG GAAAGAGGAGAGGCACCCGATATATGTTCTCTA GGCCTTTTAGAAAACATGGAGTTGTTCCTTTGGC CACATATATGCGAATCTATAAGAAAGGTGATATT GTAGACATCAAGGGAATGGGTACTGTTCAAAAA GGAATGCCCCACAAGTGTTACCATGGCAAAACT GGAAGAGTCTACAATGTTACCCAGCATGCTGTT GGCATTGTTGTAAACAAACAAGTTAAGGGCAAG ATTCTTGCCAAGAGAATTAATGTGCGTATTGAGC ACATTAAGCACTCTAAGAGCCGAGATAGCTTCCT GAAACGTGTGAAGGAAAATGATCAGAAANAAGA AAGAAGCCAAAGAGAAAGGTACCTGGGTTCAAC TAAAGCGCCAGCCTGCTCCACCCAGAGAAGCAC ACTTTGTGAGAACCAATGGGAAGGAGCCTGAGC TGCTGGAACCTATTCCCTATGAATTCATGGCATA ATAGGTGTTAAAAAAAAAAAATAAAGGACCTCTGG GCTACAAAAAAAAAAAAAAAAAAAGAATGAACTTT CA | 33 | XERSQRERYL GSTKAPACST QRSTLCENQ WEGA* |
| 3298 | NM_0009 67.3_618 | 618 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCNAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 18 | XGERRHCGR EAGLGPREA* |
| 3299 | NM_0009 67.3_626 | 626 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT | 15 | XRHCGREAGL GPREA* |

TABLE 3B-continued

| SEQ ID | identifier_position | position | modified RNA | PAP length | PAP |
|---|---|---|---|---|---|
| | | | CCCTAAGGATGACCCGTCCAAGCCGGTCCACCT CACAGCCTTCCTGGGATACAAGGCTGGCATGAC TCACATCGTGCGGGAAGTCGACAGGCCGGGAT CCAAGGTGAACAAGAAGGAGGTGGTGGAGGCT GTGACCATTGTAGAGACACCCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAAGGACTTCAGCAGCAT GAAGAAGTACTGCCAAGTCATCCGTGTCATTGC CCACACCCAGATGCGCCTGCTTCCTCTGCGCCA GAAGAAGGCCCACCTGATGGAGATCCAGGTGAA CNGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | | |
| 3300 | NM_0010 05.3_672 | 672 | CCTTTCCTTTCAGCGGAGCGCGGCGGCAAGATG GCAGTGCAAATATCCAAGAAGAGGAAGTTTGTC GCTGATGGCATCTTCAAAGCTGAACTGAATGAG TTTCTTACTCGGGAGCTGGCTGAAGATGGCTAC TCTGGAGTTGAGGTGCGAGTTACACCAACCAGG ACAGAAATCATTATCTTAGCCACCAGAACACAGA ATGTTCTTGGTGAGAAGGGCCGGCGGATTCGG GAACTGACTGCTGTAGTTCAGAAGAGGTTTGGC TTTCCAGAGGGCAGTGTAGAGCTTTATGCTGAA AAGGTGGCCACTAGAGGTCTGTGTGCCATTGCC CAGGCAGAGTCTCTGCGTTACAAACTCCTAGGA GGGCTTGCTGTGCGGAGGGCCTGCTATGGTGT GCTGCGGTTCATCATGGAGAGTGGGGCCAAAG GCTGCGAGGTTGTGGTGTCTGGGAAACTCCGAG GACAGAGGGCTAAATCCATGAAGTTTGTGGATG GCCTGATGATCCACAGCGGAGACCCTGTTAACT ACTACGTTGACACTGCTGTGCGCCACGTGTTGC TCAGACAGGGTGTGCTGGGCATCAAGGTGAAGA TCATGCTGCCCTGGGACCCAACTGGTAAGATTG GCCCTAAGAAGCCCCTGCCTGACCACGTGAGCA TTGTGGAACCCAAANGATGAGATACTGCCCACC ACCCCCATCTCAGAACAGAAGGGTGGGAAGCCA GAGCCGCCTGCCATGCCCAGCCAGTCCCCAC AGCATAACAGGGTCTCCTTGGCAGCTGTATTCT GGAGTCTGGATGTTGCTCTCTAAAGACCTTTAAT AAAATTTTGTACAAAGACAAAAAAAAAAAAAAAA | 1 | X* |
| 3301 | NM_0010 10.2_731 | 731 | CCTCTTTTCCGTGGCGCCTCGGAGGCGTTCAGC TGCTTCAAGATGAAGCTGAACATCTCCTTCCCAG CCACTGGCTGCCAGAAACTCATTGAAGTGGACG ATGAACGCAAACTTCGTACTTTCTATGAGAAGCG TATGGCCACAGAAGTTGCTGCTGACGCTCTGGG TGAAGAATGGAAGGGTTATGTGGTCCGAATCAG TGGTGGGAACGACAAACAAGGTTTCCCCATGAA GCAGGGTGTCTTGACCCATGGCCGTGTCCGCCT GCTACTGAGTAAGGGGCATTCCTGTTACAGACC AAGGAGAACTGGAGAAAGAAAGAGAAAATCAGT TCGTGGTTGCATTGTGGATGCAAATCTGAGCGT TCTCAACTTGGTTATTGTAAAAAAAGGAGAGAAG GATATTCCTGGACTGACTGATACTACAGTGCCTC GCCGCCTGGGCCCCAAAAGAGCTAGCAGAATC CGCAAACTTTTCAATCTCTCTAAAGAAGATGATG TCCGCCAGTATGTTGTAAGAAAGCCCTTAAATAA AGAAGGTAAGAAACCTAGGACCAAAGCACCCAA GATTCAGCGTCTTGTTACTCCACGTGTCCTGCA GCACAAACGGCGGCGTATTGCTCTGAAGAAGCA GCGTACCAAGAAAAATAAAGAAGAGGCTGCAGA ATATGCTAAACTTTTGGCCAAGAGAATGAAGGAG GCTAAGGAGAAGCGCCAGGAACAAATTGCGAAN GAGACGCAGACTTTCCTCTCTGCGAGCTTCTAC | 13 | XETQTFLSAS FYF* |

TABLE 3B-continued

| SEQ ID | identifier_position | position | modified RNA | PAP length | PAP |
|---|---|---|---|---|---|
| 3302 | NM_0010 17956.1_165 | 165 | TTCTAAGTCTGAATCCAGTCAGAAATAAGATTTTT TGAGTAACAAATAAATAAGATCAGACTCTG GAGGCCGCTGCCTGGCTTAGGGCGGAAACAGA TTCTCTGCATAAGAAGGGGAACGAAAGATGGCG GCGGAAACGCTGCTGTCCAGTTTGTTAGGACTG CTGCTTCTGGGACTCCTGTTACCCGCAAGTCTG ACCGGCGGTGTCGGGAGCCTGAACCTGGAGGA GCNTGAGTGAGATGCGTTATGGGATCGAGATCC TGCCGTTGCCTGTCATGGGAGGGCAGAGCCAAT CTTCGGACGTGGTGATTGTCTCCTCTAAGTACAA ACAGCGCTATGAGTGTCGCCTGCCAGCTGGAGC TATTCACTTCCAGCGTGAAAGGGAGGAGGAAAC ACCTGCTTACCAAGGGCCTGGGATCCCTGAGTT GTTGAGCCCAATGAGAGATGCTCCCTGCTTGCT GAAGACAAAGGACTGGTGGACATATGAATTCTG TTATGGACGCCACATCCAGCAATACCACATGGA AGATTCAGAGATCAAAGGTGAAGTCCTCTATCTC GGCTACTACCAATCAGCCTTCGACTGGGATGAT GAAACAGCCAAGGCCTCCAAGCAGCATCGTCTT AAACGCTACCACAGCCAGACCTATGGCAATGGG TCCAAGTGCGACCTTAATGGGAGGCCCCGGGA GGCCGAGGTTCGGTTCCTCTGTGACGAGGGTG CAGGTATCTCTGGGGACTACATCGATCGCGTGG ACGAGCCCTTGTCCTGCTCTTATGTGCTGACCAT TCGCACTCCTCGGCTCTGCCCCCACCCTCTCCT CCGGCCCCCACCCAGTGCTGCACCGCAGGCCA TCCTCTGTCACCCTTCCCTACAGCCTGAGGAGT ACATGGCCTACGTTCAGAGGCAAGCCGACTCAA AGCAGTATGGAGATAAAATCATAGAGGAGCTGC AAGATCTAGGCCCCCAAGTGTGGAGTGAGACCA AGTCTGGGGTGGCACCCCAAAAGATGGCAGGT GCGAGCCCGACCAAGGATGACAGTAAGGACTCA GATTTCTGGAAGATGCTTAATGAGCCAGAGGAC CAGG | 2 | XE* |
| 3303 | NM_0010 17956.1_177 | 177 | GAGGCCGCTGCCTGGCTTAGGGCGGAAACAGA TTCTCTGCATAAGAAGGGGAACGAAAGATGGCG GCGGAAACGCTGCTGTCCAGTTTGTTAGGACTG CTGCTTCTGGGACTCCTGTTACCCGCAAGTCTG ACCGGCGGTGTCGGGAGCCTGAACCTGGAGGA GCTGAGTGAGATGCNGTTATGGGATCGAGATCC TGCCGTTGCCTGTCATGGGAGGGCAGAGCCAAT CTTCGGACGTGGTGATTGTCTCCTCTAAGTACAA ACAGCGCTATGAGTGTCGCCTGCCAGCTGGAGC TATTCACTTCCAGCGTGAAAGGGAGGAGGAAAC ACCTGCTTACCAAGGGCCTGGGATCCCTGAGTT GTTGAGCCCAATGAGAGATGCTCCCTGCTTGCT GAAGACAAAGGACTGGTGGACATATGAATTCTG TTATGGACGCCACATCCAGCAATACCACATGGA AGATTCAGAGATCAAAGGTGAAGTCCTCTATCTC GGCTACTACCAATCAGCCTTCGACTGGGATGAT GAAACAGCCAAGGCCTCCAAGCAGCATCGTCTT AAACGCTACCACAGCCAGACCTATGGCAATGGG TCCAAGTGCGACCTTAATGGGAGGCCCCGGGA GGCCGAGGTTCGGTTCCTCTGTGACGAGGGTG CAGGTATCTCTGGGGACTACATCGATCGCGTGG ACGAGCCCTTGTCCTGCTCTTATGTGCTGACCAT TCGCACTCCTCGGCTCTGCCCCCACCCTCTCCT CCGGCCCCCACCCAGTGCTGCACCGCAGGCCA TCCTCTGTCACCCTTCCCTACAGCCTGAGGAGT ACATGGCCTACGTTCAGAGGCAAGCCGACTCAA AGCAGTATGGAGATAAAATCATAGAGGAGCTGC AAGATCTAGGCCCCCAAGTGTGGAGTGAGACCA AGTCTGGGGTGGCACCCCAAAAGATGGCAGGT GCGAGCCCGACCAAGGATGACAGTAAGGACTCA GATTTCTGGAAGATGCTTAATGAGCCAGAGGAC CAGG | 26 | XLWDRDPAVA CHGRAEPIFG RGDCLL* |
| 3304 | NM_0011 01.2_902 | 902 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCAGAAGGAT TCCTATGTGGGCGACGAGGCCCAGAGCAAGAG AGGCATCCTCACCCTGAAGTACCCCATCGAGCA CGGCATCGTCACCAACTGGGACGACATGGAGAA AATCTGGCACCACACCTTCTACAATGAGCTGCG | 9 | XYLQLHHEV* |

TABLE 3B-continued

| SEQ ID | identifier_ position | position | modified RNA | PAP length | PAP |
|---|---|---|---|---|---|
| | | | TGTGGCTCCCGAGGAGCACCCCGTGCTGCTGA CCGAGGCCCCCTGAACCCCAAGGCCAACCGC GAGAAGATGACCCAGATCATGTTTGAGACCTTC AACACCCCAGCCATGTACGTTGCTATCCAGGCT GTGCTATCCCTGTACGCCTCTGGCCGTACCACT GGCATCGTGATGGACTCCGGTGACGGGGTCAC CCACACTGTGCCCATCTACGAGGGGTATGCCCT CCCCCATGCCATCCTGCGTCTGGACCTGGCTGG CCGGGACCTGACTGACTACCTCATGAAGATCCT CACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT GAGGCACTCTTCCAGCCTTCCTTCCTGGGCATG GAGTCCTGTGGCATCCACGAAANCTACCTTCAA CTCCATCATGAAGTGTGACGTGGACATCCGCAA AGACCTGTACGCCAACACAGTGCTGTCTGGCGG CACCACCATGTACCCTGGCATTGCCGACAGGAT GCAGAAGGAGAT | | |
| 3305 | NM_0014 02.5_636 | 636 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGNCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 7 | XNFWLEW* |
| 3306 | NM_0014 02.5_679 | 679 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCTACAGCCAGAAGAGATATGA GGAAATTGTTAAGGAAGTCAGCACTTACATTAAG AAAATTGGCTACAACCCCGACACAGTAGCATTTG TGCCAATTTCTGGTTGGAATGGTGACAACATGCT GGAGCCAAGTGNCTAACATGCCTTGGTTCAAGG GATGGAAAGTCACCCGTAAGGATGGCAATGCCA GTGGAACCACGCTGCTTGAGGCTCTGGACTGCA TCCTACCACCAACTCGTCCAACTGACAAGCCCTT GCGCCTGCCTCTCCAGGATGTCTACAAAATTGG | 1 | X* |

TABLE 3B-continued

| SEQ ID | identifier_position | position | modified RNA | PAP length | PAP |
|---|---|---|---|---|---|
| | | | TGGTATTGGTACTGTTCCTGTTGGCCGAGTGGAGACTGGTGTTCTCAAACCCGGTATGGTGGTCACCTTTGCTCCAGTCAACGTTACAACGGAAGTAAAATCTGTCGAAATGCACCATGAAGCTTTGAGTGAAGCTCTTCCTGGGGACAATGTGGGCTTCAATGTCAAGAATGTGTCTGTCAAGGATGTT | | |
| 3307 | NM_001404.4_894 | 894 | AACTGTCGTACGTATGTCTTCTGTTTCGTCCTCGCTTTCCGGCTGCTGTTTCTCCACGGCTCTCCTCTTTCCCCCTCCCTTCTCTCCCGGGCGGCTTACTTTGCGGCAGCGCCGAGAACCCCACCCCCTTTCTTTGCGGAATCACCATGGCGGCTGGGACCCTGTACACGTATCCTGAAAACTGGAGGGCCTTCAAGGCTCTCATCGCTGCTCAGTACAGCGGGGCTCAGGTCCGCGTGCTCTCCGCACCACCCCACTTCCATTTTGGCCAAACCAACCGCACCCCTGAATTTCTCCGCAAATTTCCTGCCGGCAAGGTCCCAGCATTTGAGGGTGATGATGGATTCTGTGTGTTTGAGAGCAACGCCATTGCCTACTATGTGAGCAATGAGGAGCTGCGGGGAAGTACTCCAGAGGCAGCAGCCCAGGTGGTGCAGTGGGTGAGCTTTGCTGATTCCGATATAGTGCCCCCAGCCAGTACCTGGGTGTTCCCCACCTTGGGCATCATGCACCACAACAAACAGGCCACTGAGAATGCAAAGGAGGAAGTGAGGCGAATTCTGGGGCTGCTGGATGCTTACTTGAAGACGAGGACTTTTCTGGTGGGCGAACGAGTGACATTGGCTGACATCACAGTTGTCTGCACCCTGTTGTGGCTCTATAAGCAGGTTCTAGAGCCTTCTTTCCGCCAGGCCTTTCCCAATACCAACCGCTGGTTCCTCACCTGCATTAACCAGCCCCAGTTCCGGGCTGTCTTGGGCGAAGTGAAACTGTGTGAGAAGATGGCCCAGTTTGATGCTAAAAAGTTTGCAGAGACCCAACCTAAAAAGGACACACCACGGAAAGAGAAGGGTTCACGGGAAGAGAAGCAGAAGCCCCAGGCTGAGCGGAAGGNAGGAGAAAAAGGCGGCTGCCCCTGCTCCTGAGGAGGAGATGGATGAATGTGAGCAGGCGCTGGCTGCTGAGCCCAAGGCCAAGGACCCCTTCGCTCACCTGCCCAAGAGTACCTTTGTGTTGGATGAAT | 10 | XGEKGGCPCS* |
| 3308 | NM_001614.2_527 | 527 | GTCTCAGTCGCCGCTGCCAGCTCTCGCACTCTGTTCTTCCGCCGCTCCGCCGTCGCGTTTCTCTGCCGGTCGCAATGGAAGAAGAGATCGCCGCGCTGGTCATTGACAATGGCTCCGGCATGTGCAAAGCTGGTTTTGCTGGGGACGACGCTCCCCGAGCCGTGTTTCCTTCCATCGTCGGGCGCCCCAGACACCAGGGCGTCATGGTGGGCATGGGCCAGAAGGACTCCTACGTGGGCGACGAGGCCCAGAGCAAGCGTGGCATCCTGACCCTGAAGTACCCCATTGAGCATGGCATCGTCACCAACTGGGACGACATGGAGAAGATCTGGCACCACACCTTCTACAACGAGCTGCGCGTGGCCCCGGAGGAGCACCCAGTGCTGCTGACCGAGGCCCCCCTGAACCCCAAGGCCAACAGAGAGAAGATGACTCAGATTATGTTTGAGACCTTCAACACCCCGGCCATGTACGTGGCCATCCAGGCCGTGCTGTCCCTCTACGCCTCTGGGCGCACCACTGGCATTNGTCATGGACTCTGGAGACGGGGTCACCCACACGGTGCCCATCTACGAGGGCTACGCCCTCCCCCACGCCATCCTGCGTCTGGACCTGGCTGGCCGGGACCTGACCGACTACCTCATGAAGATCCTCACTGAGCGAGGCTACAGCTTCACCACCACGGCCGAGCGGGAAATCGTGCGCGACATCAAGGAGAAGCTGTGCTACGTCGCCCTGGACTTCGAGCAGGAGATGGCCACCGCCGCATCCTCCTCTTCTCTGGAGAAGAGCTACGAGCTGCCCGATGGCCAGGTCATCACCATTGGCAATGAGCGGTTCCGGTGTCCGGAGGCGCTGTTCCAGCCTTCCTTCCTGGGTATGGAATCTTGCGGCATCCACGAGACCACCTTCAACTCCATCATGAAGTGTGACGTGGACATCCGCAAAGACCTGTACGCCAACACGGTGCTGTCGGGCGGCACCACCATGTACCCGGGCATTGCCGACAGGATGCAGAAGGAGA | 43 | XHGLWRRGHPHGAHLRGLRPPPRHPASGPGWPGPDRLPHEDPH* |
| 3309 | NM_001614.2_712 | 712 | GTCTCAGTCGCCGCTGCCAGCTCTCGCACTCTGTTCTTCCGCCGCTCCGCCGTCGCGTTTCTCTGCCGGTCGCAATGGAAGAAGAGATCGCCGCGCTGGTCATTGACAATGGCTCCGGCATGTGCAAAGCTGGTTTTGCTGGGGACGACGCTCCCCGAGCCGTGTTTCCTTCCATCGTCGGGCGCCCCAGACACCAGGGCGTCATGGTGGGCATGGGCCAGAAGGACTCCTACGTGGGCGACGAGGCCCAGAGCAAGCGT | 40 | XGEAVLRRPGLRAGDGHRRILLFSGEELRAARWPGHHHWQ* |

TABLE 3B-continued

| SEQ ID | identifier_position | position | modified RNA | PAP length | PAP |
|---|---|---|---|---|---|
| | | | GGCATCCTGACCCTGAAGTACCCCATTGAGCAT GGCATCGTCACCAACTGGGACGACATGGAGAAG ATCTGGCACCACACCTTCTACAACGAGCTGCGC GTGGCCCCGGAGGAGCACCCAGTGCTGCTGAC CGAGGCCCCCTGAACCCCAAGGCCAACAGAG AGAAGATGACTCAGATTATGTTTGAGACCTTCAA CACCCCGGCCATGTACGTGGCCATCCAGGCCG TGCTGTCCCTCTACGCCTCTGGGCGCACCACTG GCATTGTCATGGACTCTGGAGACGGGGTCACCC ACACGGTGCCCATCTACGAGGGCTACGCCCTCC CCCACGCCATCCTGCGTCTGGACCTGGCTGGC CGGGACCTGACCGACTACCTCATGAAGATCCTC ACTGAGCGAGGCTACAGCTTCACCACCACGGCC GAGCGGGAAATCGTGCGCGACATCAANGGAGA AGCTGTGCTACGTCGCCCTGGACTTCGAGCAGG AGATGGCCACCGCCGCATCCTCCTCTTCTCTGG AGAAGAGCTACGAGCTGCCCGATGGCCAGGTC ATCACCATTGGCAATGAGCGGTTCCGGTGTCCG GAGGCGCTGTTCCAGCCTTCCTTCCTGGGTATG GAATCTTGCGGCATCCACGAGACCACCTTCAAC TCCATCATGAAGTGTGACGTGGACATCCGCAAA GACCTGTACGCCAACACGGTGCTGTCGGGCGG CACCACCATGTACCCGGGCATTGCCGACAGGAT GCAGAAGGAGA | | |
| 3310 | NM_0022 95.4_666 | 666 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCN ATGGGAGGTCATGCCTGATCTGTACTTCTACAG AGATCCTGAAGAGATTGAAAAAGAAGAGCAGGC TGCTGCTGAGAAGGCAGTGACCAAGGAGGAATT TCAGGGTGAATGGACTGCTCCCGCTCCTGAGTT CACTGCTACTCAGCCTGAGGTTGCAGACTGGTC TGAAGGTGTACAGGTGCCCTCTGTGCCTATTCA GCAATTCCCTACTGAAGACTGGAGCGCTCAGCT TGCCACGGAAGACTGGTCTGCAGCTCCCACTGC TCAGGCCACTGAATGGGTAGGAGCAACCACTGA CTGGTCTTAAGCTGTTCTTGCATAGGCTCTTAAG CAGCATGGAAAAATGGTTGATGGAAA | 5 | MGGHA* |
| 3311 | NM_0022 95.4_693 | 693 | CGCCTGTCTTTTCCGTGCTACCTGCAGAGGGGT CCATACGGCGTTGTTCTGGATTCCCGTCGTAAC TTAAAGGGAAATTTTCACAATGTCCGGAGCCCTT GATGTCCTGCAAATGAAGGAGGAGGATGTCCTT AAGTTCCTTGCAGCAGGAACCCACTTAGGTGGC ACCAATCTTGACTTCCAGATGGAACAGTACATCT ATAAAAGGAAAAGTGATGGCATCTATATCATAAA TCTCAAGAGGACCTGGGAGAAGCTTCTGCTGGC AGCTCGTGCAATTGTTGCCATTGAAAACCCTGCT GATGTCAGTGTTATATCCTCCAGGAATACTGGCC AGAGGGCTGTGCTGAAGTTTGCTGCTGCCACTG GAGCCACTCCAATTGCTGGCCGCTTCACTCCTG GAACCTTCACTAACCAGATCCAGGCAGCCTTCC GGGAGCCACGGCTTCTTGTGGTTACTGACCCCA GGGCTGACCACCAGCCTCTCACGGAGGCATCTT ATGTTAACCTACCTACCATTGCGCTGTGTAACAC AGATTCTCCTCTGCGCTATGTGGACATTGCCATC CCATGCAACAACAAGGGAGCTCACTCAGTGGGT TTGATGTGGTGGATGCTGGCTCGGGAAGTTCTG CGCATGCGTGGCACCATTTCCCGTGAACACCCA TGGGAGGTCATGCCTGATCTGTACTTNCTACAG AGATCCTGAAGAGATTGAAAAAGAAGAGCAGGC | 5 | XLQRS* |

TABLE 3B-continued

| SEQ ID | identifier_position | position | modified RNA | PAP length | PAP |
|---|---|---|---|---|---|
| | | | TGCTGCTGAGAAGGCAGTGACCAAGGAGGAATT<br>TCAGGGTGAATGGACTGCTCCCGCTCCTGAGTT<br>CACTGCTACTCAGCCTGAGGTTGCAGACTGGTC<br>TGAAGGTGTACAGGTGCCCTCTGTGCCTATTCA<br>GCAATTCCCTACTGAAGACTGGAGCGCTCAGCC<br>TGCCACGGAAGACTGGTCTGCAGCTCCCACTGC<br>TCAGGCCACTGAATGGGTAGGAGCAACCACTGA<br>CTGGTCTTAAGCTGTTCTTGCATAGGCTCTTAAG<br>CAGCATGGAAAAATGGTTGATGGAAA | | |
| 3312 | NM_002295.4_721 | 721 | CGCCTGTCTTTTCCGTGCTACCTGCAGAGGGGT<br>CCATACGGCGTTGTTCTGGATTCCCGTCGTAAC<br>TTAAAGGGAAATTTTCACAATGTCCGGAGCCCTT<br>GATGTCCTGCAAATGAAGGAGGAGGATGTCCTT<br>AAGTTCCTTGCAGCAGGAACCCACTTAGGTGGC<br>ACCAATCTTGACTTCCAGATGGAACAGTACATCT<br>ATAAAAGGAAAAGTGATGGCATCTATATCATAAA<br>TCTCAAGAGGACCTGGGAGAAGCTTCTGCTGGC<br>AGCTCGTGCAATTGTTGCCATTGAAAACCCTGCT<br>GATGTCAGTGTTATATCCTCCAGGAATACTGGCC<br>AGAGGGCTGTGCTGAAGTTTGCTGCTGCCACTG<br>GAGCCACTCCAATTGCTGGCCGCTTCACTCCTG<br>GAACCTTCACTAACCAGATCCAGGCAGCCTTCC<br>GGGAGCCACGGCTTCTTGTGGTTACTGACCCCA<br>GGGCTGACCACCAGCCTCTCACGGAGGCATCTT<br>ATGTTAACCTACCTACCATTGCGCTGTGTAACAC<br>AGATTCTCCTCTGCGCTATGTGGACATTGCCATC<br>CCATGCAACAACAAGGGAGCTCACTCAGTGGGT<br>TGATGTGGTGGATGCTGGCTCGGGAAGTTCTG<br>CGCATGCGTGGCACCATTTCCCGTGAACACCCA<br>TGGGAGGTCATGCCTGATCTGTACTTCTACAGA<br>GATCCTGAAGAGATTGAAAAANGAAGAGCAGGC<br>TGCTGCTGAGAAGGCAGTGACCAAGGAGGAATT<br>TCAGGGTGAATGGACTGCTCCCGCTCCTGAGTT<br>CACTGCTACTCAGCCTGAGGTTGCAGACTGGTC<br>TGAAGGTGTACAGGTGCCCTCTGTGCCTATTCA<br>GCAATTCCCTACTGAAGACTGGAGCGCTCAGCC<br>TGCCACGGAAGACTGGTCTGCAGCTCCCACTGC<br>TCAGGCCACTGAATGGGTAGGAGCAACCACTGA<br>CTGGTCTTAAGCTGTTCTTGCATAGGCTCTTAAG<br>CAGCATGGAAAAATGGTTGATGGAAA | 6 | XRAGCC* |
| 3313 | NM_002952.3_321 | 321 | CTTCTTTTCCGACAAAACACCAAATGGCGGATGA<br>CGCCGGTGCAGCGGGGGGGCCCGGGGGCCCT<br>GGTGGCCCTGGGATGGGGAACCGCGGTGGCTT<br>CCGCGGAGGTTTCGGCAGTGGCATCCGGGGCC<br>GGGGTCGCGGCCGTGGACGGGGCCGGGGCCG<br>AGGCCGCGGAGCTCGCGGAGGCAAGGCCGAG<br>GATAAGGAGTGGATGCCCGTCACCAAGTTGGGC<br>CGCTTGGTCAAGGACATGAAGATCAAGTCCCTG<br>GAGGGAGATCTATCTCTTCTCCCTGCCTATTAAGG<br>AATCAGAGATCATTGATTTCTTCCTGGGGGNCCT<br>CTCTCAAGGATGAGGTTTTGAAGATTATGCCAGT<br>GCAGAAGCAGACCCGTGCCGGCCAGCGCACCA<br>GGTTCAAGGCATTTGTTGCTATCGGGGACTACA<br>ATGGCCACGTCGGTCTGGGTGTTAAGTGCTCCA<br>AGGAGGTGGCCACCGCCATCCGTGGGGCCATC<br>ATCCTGGCCAAGCTCTCCATCGTCCCCGTGCGC<br>AGAGGCTACTGGGGGAACAAGATCGGCAAGCC<br>CCACACTGTCCCTTGCAAGGTGACAGGCCGCTG<br>CGGCTCTGTGCTGGTACGCCTCATCCCTGCACC<br>CAGGGGCACTGGCATCGTCTCCGCACCTGTGC<br>CTAAGAAGCTGCTCATGATGGCTGGTATCGATG<br>ACTGCTACACCTCAGCCCGGGGCTGCACTGCCA<br>CCCTGGGCAACTTCGCCAAGGCCACCTTTGATG<br>CCATTTCTAAGACCTACAGCTACCTGACCCCCG<br>ACCTCTGGAAGGAGACTGTATTCACCAAGTCTC<br>CCTATCAGGAGTTCACTGACCACCTCGTCAAGA<br>CCCACACCAGAGTCTCCGTGCAGCGGACTCAG<br>GCTCCAGCTGTGGCTACAACATAGGGTTTTTATA<br>CAAGAAAAATAAAGTGAATTAAGCGTGAAAAAAA<br>AAAAAAAAAAAAA | 5 | XLSQG* |
| 3314 | NM_003295.2_476 | 476 | CCCCCCGAGCGCCGCTCCGGCTGCACCGCGCT<br>CGCTCCGAGTTTCAGGCTCGTGCTAAGCTAGCC<br>CCGTCGTCGTCTCCCTTCAGTCGCCATCATGATT<br>ATCTACCGGGACCTCATCAGCCACGATGAGATG<br>TTCTCCGACATCTACAAGATCCGGGAGATCGCG<br>GACGGGTTGTGCCTGGAGGTGGAGGGGAAGAT<br>GGTCAGTAGGACAGAAGGTAACATTGATGACTC | 10 | XFQKLPVLYW* |

TABLE 3B-continued

| SEQ ID | identifier_ position | position | modified RNA | PAP length | PAP |
|---|---|---|---|---|---|
| | | | GCTCATTGGTGGAAATGCCTCCGCTGAAGGCCC<br>CGAGGGCGAAGGTACCGAAAGCACAGTAATCAC<br>TGGTGTCGATATTGTCATGAACCATCACCTGCAG<br>GAAACAAGTTTCACAAAAGAAGCCTACAAGAAGT<br>ACATCAAAGATTACATGAAATCAATCAAAGGGAA<br>ACTTGAAGAACAGAGACCAGAAAGAGTAAAACC<br>TTTTATGACAGGGGCTGCAGAACAAATCAAGCA<br>CATCCTTGCTAANTTTCAAAAACTACCAGTTCTTT<br>ATTGGTGAAAACATGAATCCAGATGGCATGGTT<br>GCTCTATTGGACTACCGTGAGGATGGTGTGACC<br>CCATATATGATTTTCTTTAAGGATGGTTTAGAAAT<br>GGAAAAATGTTAACAAATGTGGCAATTATTTTGG<br>ATCTATCACCTGTCATCATAACTGGCTTCTGCTT<br>GTCATCCACACAACACCAGGACTTAAGACAAAT<br>GGGACTGATGTCATCTTGAGCTCTTCATTTATTT<br>TGACTGTGATTTATTTGGAGTGGAGGCATTGTTT<br>TTAAGAAAAACATGTCATGTAGGTTGTCTAAAAA<br>TAAAAATGCATTTAAACTCATTTGAGAG | | |
| 3315 | NM_0060<br>82.2_696 | 696 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCGAGGGCACTACACCATTGGC<br>AAGGAGATCATTGACCTTGTGTTGGACCGAATTC<br>GCAAGCTGGCTGACCAGTGCACCGGTCTTCAGG<br>GCTTCTTGGTTTTCCACAGCTTTGGTGGGGGAA<br>CTGGTTCTGGGTTCACCTCCCTGCTCATGGAAC<br>GTCTCTCAGNTTGATTATGGCAAGAAGTCCAAG<br>CTGGAGTTCTCCATTTACCCAGCACCCCAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC<br>CAACCTACACTAACCTTAACCGCCTTATTAGCCA<br>GATTGTGTCCTCCATCACTGCTTCCCTGAGATTT<br>GATGGAGCCCTGAATGTTGACCTGACAGAATTC<br>CAGACCAACCTGGTGCCCTACCCCCGCATCCAC<br>TTCC | 1 | X* |
| 3316 | NM_0060<br>82.2_747 | 747 | GGCGGCCAGGCCGGGCGCGGAGTGGGCGCGC<br>GGGGCCGGAGGAGGGGCCAGCGACCGCGGCA<br>CCGCCTGTGCCCGCCCGCCCCTCCGCAGCCGC<br>TACTTAAGAGGCTCCAGCGCCGGCCCCGCCCTA<br>GTGCGTTACTTACCTCGACTCTTAGCTTGTCGG<br>GGACGGTAACCGGGACCCGGTGTCTGCTCCTG<br>TCGCCTTCGCCTCCTAATCCCTAGCCACTATGC<br>GTGAGTGCATCTCCATCCACGTTGGCCAGGCTG<br>GTGTCCAGATTGGCAATGCCTGCTGGGAGCTCT<br>ACTGCCTGGAACACGGCATCCAGCCCGATGGC<br>CAGATGCCAAGTGACAAGACCATTGGGGGAGGA<br>GATGACTCCTTCAACACCTTCTTCAGTGAGACG<br>GGCGCTGGCAAGCACGTGCCCCGGGCTGTGTT<br>TGTAGACTTGGAACCCACAGTCATTGATGAAGTT<br>CGCACTGGCACCTACCGCCAGCTCTTCCACCCT<br>GAGCAGCTCATCACAGGCAAGGAAGATGCTGCC<br>AATAACTATGCCCGAGGGCACTACACCATTGGC<br>AAGGAGATCATTGACCTTGTGTTGGACCGAATTC<br>GCAAGCTGGCTGACCAGTGCACCGGTCTTCAGG<br>GCTTCTTGGTTTTCCACAGCTTTGGTGGGGGAA<br>CTGGTTCTGGGTTCACCTCCCTGCTCATGGAAC<br>GTCTCTCAGTTGATTATGGCAAGAAGTCCAAG<br>GGAGTTCTCCATTTACCCAGCACCCCNAGGTTT<br>CCACAGCTGTAGTTGAGCCCTACAACTCCATCC<br>TCACCACCCACACCACCCTGGAGCACTCTGATT<br>GTGCCTTCATGGTAGACAATGAGGCCATCTATG<br>ACATCTGTCGTAGAAACCTCGATATCGAGCGCC | 7 | XGFHSCS* |

TABLE 3B-continued

| SEQ ID | identifier_position | position | modified RNA | PAP length | PAP |
|---|---|---|---|---|---|
| | | | CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | | |
| 3317 | NM_0060 82.2_838 | 838 | GGCGGCCAGGCCGGGCGCGGAGTGGGCGCGC GGGGCCGGAGGAGGGGCCAGCGACCGCGGCA CCGCCTGTGCCCGCCCGCCCCTCCGCAGCCGC TACTTAAGAGGCTCCAGCGCCGGCCCCGCCCTA GTGCGTTACTTACCTCGACTCTTAGCTTGTCGG GGACGGTAACCGGGACCCGGTGTCTGCTCCTG TCGCCTTCGCCTCCTAATCCCTAGCCACTATGC GTGAGTGCATCTCCATCCACGTTGGCCAGGCTG GTGTCCAGATTGGCAATGCCTGCTGGGAGCTCT ACTGCCTGGAACACGGCATCCAGCCCGATGGC CAGATGCCAAGTGACAAGACCATTGGGGGAGGA GATGACTCCTTCAACACCTTCTTCAGTGAGACG GGCGCTGGCAAGCACGTGCCCCGGGCTGTGTT TGTAGACTTGGAACCCACAGTCATTGATGAAGTT CGCACTGGCACCTACCGCCAGCTCTTCCACCCT GAGCAGCTCATCACAGGCAAGGAAGATGCTGCC AATAACTATGCCCGAGGGCACTACACCATTGGC AAGGAGATCATTGACCTTGTGTTGGACCGAATTC GCAAGCTGGCTGACCAGTGCACCGGTCTTCAGG GCTTCTTGGTTTTCCACAGCTTTGGTGGGGGAA CTGGTTCTGGGTTCACCTCCCTGCTCATGGAAC GTCTCTCAGTTGATTATGGCAAGAAGTCCAAGCT GGAGTTCTCCATTTACCCAGCACCCCAGGTTTC CACAGCTGTAGTTGAGCCCTACAACTCCATCCT CACCACCCACACCACCCTGGAGCACTCTGATTG TGCCTTCATGGTAGACAANTGAGGCCATCTATG ACATCTGTCGTAGAAACCTCGATATCGAGCGCC CAACCTACACTAACCTTAACCGCCTTATTAGCCA GATTGTGTCCTCCATCACTGCTTCCCTGAGATTT GATGGAGCCCTGAATGTTGACCTGACAGAATTC CAGACCAACCTGGTGCCCTACCCCCGCATCCAC TTCC | 1 | X* |
| 3318 | NM_0009 67.3_511 | 511 | CCAGATTTGGCTTTATATAGCGGACCCGTAAGG CCGACCGGCCTCTACCGGCGGGATTTGATGGC GTGATGTCTCACAGAAAGTTCTCCGCTCCCAGA CATGGGTCCCTCGGCTTCCTGCCTCGGAAGCGC AGCAGCAGGCATCGTGGGAAGGTGAAGAGCTT CCCTAAGGATGACCCGTCCAAGCCGGTCCACCT CACAGCCTTCCTGGGATACAAGGCTGGCATGAC TCACATCGTGCGGGAAGTCGACAGGCGGGAT CCAAGGTGAACAAGAAGGAGGTGGTGGAGGCT GTGACCATTGTAGAGACACCACCCATGGTGGTT GTGGGCATTGTGGGCTACGTGGAAACCCCTCGA GGCCTCCGGACCTTCAAGACTGTCTTTGCTGAG CACATCAGTGATGAATGCAAGAGGCGTTTCTATA AGAATTGGCATAAATCTAAGAAGAAGGCCTTTAC CAAGTACTGCAAGAAATGGCAGGATGAGGATGG CAAGAAGCAGCTGGAGAANGGACTTCAGCAGCA TGAAGAAGTACTGCCAAGTCATCCGTGTCATTG CCCACACCCAGATGCGCCTGCTTCCTCTGCGCC AGAAGAAGGCCCACCTGATGGAGATCCAGGTGA ACGGAGGCACTGTGGCCGAGAAGCTGGACTGG GCCCGCGAGAGGCTTGAGCAGCAGGTACCTGT GAACCAAGTGTTTGGGCAGGATGAGATGATCGA CGTCATCGGGGTGACCAAGGGCAAAGGCTACAA AGGGGTCACCAGTCGTTGGCACACCAAGAAGCT GCCCCGCAAGACCCACCGAGGCCTGCGCAAGG TGGCCTGTATTGGGGCATGGCATCCTGCTCGTG TAGCCTTCTCTGTGGCACGCGCTGGGCAGAAAG GCTACCATCACCGCACTGAGATCAACAAGAAGA TTTATAAGATTGGCCAGGGCTACCTTATCAAGGA CGGCAAGCTGATCAAGAACAATGCCTCCACTGA CTATGACCTATCTGACAAGAGCATCAACCCTCTG GGTG | 54 | XGLQQHEEVL PSHPCHCPHP DAPASSAPEE GPPDGDPGE RRHCGREAG LGPREA* |
| 3319 | NM_0010 06.3_548 | 548 | AAGTTCTCGCGCGACTCCCACTTCCGCCCTTTT GGCTCTCTGACCAGCACCATGGCGGTTGGCAAG AACAAGCGCCTTACGAAAGGCGGCAAAAAGGGA GCCAAGAAGAAAGTGGTTGATCCATTTTCTAAGA AAGATTGGTATGATGTGAAAGCACCTGCTATGTT CAATATAAGAAATATTGGAAAGACGCTCGTCACC AGGACCCAAGGAACCAAAATTGCATCTGATGGT CTCAAGGGTCGTGTGTTTGAAGTGAGTCTTGCT | 14 | XEDDGNHDP RGADK* |

TABLE 3B-continued

| SEQ ID | identifier_position | position | modified RNA | PAP length | PAP |
|---|---|---|---|---|---|
| | | | GATTTGCAGAATGATGAAGTTGCATTTAGAAAAT TCAAGCTGATTACTGAAGATGTTCAGGGTAAAAA CTGCCTGACTAACTTCCATGGCATGGATCTTACC CGTGACAAAATGTGTTCCATGGTCAAAAAATGGC AGACAATGATTGAAGCTCACGTTGATGTCAAGAC TACCGATGGTTACTTGCTTCGTCTGTTCTGTGTT GGTTTTACTAAAAAACGCAACAATCAGATACGGA AGACCTCTTATGCTCAGCACCAACAGGTCCGCC AAATCCGGAAGGAAGATGATGGAAATCATGACC CGAGAGGTGCAGACAAATGACTTGAAAGAAGTG GTCAATAAATTGATTCCAGACAGCATTGGAAAAG ACATAGAAAAGGCTTGCCAATCTATTTATCCTCT CCATGATGTCTTCGTTAGAAAAGTAAAAATGCTG AAGAAGCCCAAGTTTGAATTGGGAAAGCTCATG GAGCTTCATGGTGAAGGCAGTAGTTCTGGAAAA GCCACTGGGGACGAGACAGGTGCTAAAGTTGAA CGAGCTGATGGATATGAACCACCAGTCCAAGAA TCTGTTTAAAGTTCAGACTTCAAATAGTGGCAAA TAAAAAGTGCTATTTGTGATGGTTTGCTTCTGAA | | |
| 3320 | NM_0010 25092.1_ 198 | 198 | GGACAACACCTTCAAAGACAGGCCCTCTGAGTC CGACGAGCTCCAGACCATCCAAGAAGACAGTGC AGCCACCTCCGAGAGCCTGGATGTGATGGCGTC ACAGAAGAGACCCTCCCAGAGGCACGGATCCAA GTACCTGGCCACAGCAAGTACCATGGACCATGC CAGGCATGGCTTCCTCCCAAGGCACAGAGACAC NGGGCATCCTTGACTCCATCGGGCGCTTCTTTG GCGGTGACAGGGGTGCGCCCAAGCGGGGCTCT GGCAAGGACTCACACCACCCGGCAAGAACTGCT CACTACGGCTCCCTGCCCCAGAAGTCACACGGC CGGACCCAAGATGAAAACCCCGTAGTCCACTTC TTCAAGAACATTGTGACGCCTCGCACACCACCC CGTCGCAGGGAAAGGGGGCCGAAGGCCAGAG ACCAGGATTTGGCTACGGAGGCAGAGCGTCCG ACTATAAATCGGCTCACAAGGGATTCAAGGGAG TCGATGCCCAGGGCACGCTTTCCAAAATTTTTAA GCTGGGAGGAAGAGATAGTCGCTCTGGATCACC CATGGCTAGACGCTGAAAACCCACCTGGTTCCG GAATCCTGTCCTCAGCTTCTTAATATAACTGCCT TAAAACTTTAATCCCACTTGCCCCTGTTACCTAA TTAGAGCAGATGACCCCTCCCCTAATGCCTGCG GAGTTGTGCACGTAGTAGGGTCAGGCCACGGC AGCCTACCGGCAATTTCCGGCCAACAGTTAAAT GAGAACATGAAAACAGAAAACGGTTAAAACTGTC CCTTTCTGTGTGAAGATCACGTTCCTTCCCCCGC AATGTGCCCCCAGACGCACGTGGGTCTTCAGGG GGCCAGGTGCACAGACGTCCCTCCACGTTCACC CCTCCACCCTTGGACTTTCTTTTCGCCGTGGCT GCGGCACCCTTGCGCTTTTGCTGGTCACTGCCA TGGAGGCACACAGCTGCAGAGACAGAGAGGAC GTGGGCGGCAGAGAGGACTGTTGACATCCAAG CT | 2 | HP* |
| 3321 | NM_0011 01.2_219 | 219 | CGCGTCCGCCCCGCGAGCACAGAGCCTCGCCT TTGCCGATCCGCCGCCCGTCCACACCCGCCGC CAGCTCACCATGGATGATGATATCGCCGCGCTC GTCGTCGACAACGGCTCCGGCATGTGCAAGGC CGGCTTCGCGGGCGACGATGCCCCCCGGGCCG TCTTCCCCTCCATCGTGGGGCGCCCCAGGCACC AGGGCGTGATGGTGGGCATGGGTCANGAAGGA TTCCTATGTGGGCGACGAGGCCCAGAGCAAGA GAGGCATCCTCACCCTGAAGTACCCCATCGAGC ACGGCATCGTCACCAACTGGGACGACATGGAGA AAATCTGGCACCACACCTTCTACAATGAGCTGC GTGTGGCTCCCGAGGAGCACCCCGTGCTGCTG ACCGAGGCCCCCCTGAACCCCAAGGCCAACCG CGAGAAGATGACCCAGATCATGTTTGAGACCTT CAACACCCCAGCCATGTACGTTGCTATCCAGGC TGTGCTATCCCTGTACGCCTCTGGCCGTACCAC TGGCATCGTGATGGACTCCGGTGACGGGGTCA CCCACACTGTGCCCATCTACGAGGGGTATGCCC TCCCCCATGCCATCCTGCGTCTGGACCTGGCTG GCCGGGACCTGACTGACTACCTCATGAAGATCC TCACCGAGCGCGGCTACAGCTTCACCACCACGG CCGAGCGGGAAATCGTGCGTGACATTAAGGAGA AGCTGTGCTACGTCGCCCTGGACTTCGAGCAAG AGATGGCCACGGCTGCTTCCAGCTCCTCCCTGG AGAAGAGCTACGAGCTGCCTGACGGCCAGGTC ATCACCATTGGCAATGAGCGGTTCCGCTGCCCT | 44 | XEGFLCGRRG PEQERHPHPE VPHRARHRH QLGRHGENLA PHLLQ* |

TABLE 3B-continued

| SEQ ID | identifier_ position | position | modified RNA | PAP length | PAP |
|---|---|---|---|---|---|
| | | | GAGGCACTCTTCCAGCCTTCCTTCCTGGGCATG GAGTCCTGTGGCATCCACGAAACTACCTTCAAC TCCATCATGAAGTGTGACGTGGACATCCGCAAA GACCTGTACGCCAACACAGTGCTGTCTGGCGGC ACCACCATGTACCCTGGCATTGCCGACAGGATG CAGAAGGAGAT | | |
| 3322 | NM_0014 02.5_109 | 109 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGNTAGATTCGGGCAAGTCCACCACT ACTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 14 | XRFGQVHHY WPSDL* |
| 3323 | NM_0014 02.5_134 | 134 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CNTGGCCATCTGATCTATAAATGCGGTGGCATC GACAAAAGAACCATTGAAAAATTTGAGAAGGAG GCTGCTGAGATGGGAAAGGGCTCCTTCAAGTAT GCCTGGGTCTTGGATAAACTGAAAGCTGAGCGT GAACGTGGTATCACCATTGATATCTCCTTGTGGA AATTTGAGACCAGCAAGTACTATGTGACTATCAT TGATGCCCCAGGACACAGAGACTTTATCAAAAA CATGATTACAGGGACATCTCAGGCTGACTGTGC TGTCCTGATTGTTGCTGCTGGTGTTGGTGAATTT GAAGCTGGTATCTCCAAGAATGGGCAGACCCGA GAGCATGCCCTTCTGGCTTACACACTGGGTGTG AAACAACTAATTGTCGGTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 5 | WPSDL* |
| 3324 | NM_0014 02.5_515 | 515 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA | 1 | C* |

TABLE 3B-continued

| SEQ ID | identifier_ position | position | modified RNA | PAP length | PAP |
|---|---|---|---|---|---|
| | | | ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGNTGTTAACAAAATGGATT CCACTGAGCCACCCTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | | |
| 3325 | NM_0014 02.5_546 | 546 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC CACTGAGCCACCCNTACAGCCAGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC TTGCGCCTGCCTCTCCAGGATGTCTACAAAATTG GTGGTATTGGTACTGTTCCTGTTGGCCGAGTGG AGACTGGTGTTCTCAAACCCGGTATGGTGGTCA CCTTTGCTCCAGTCAACGTTACAACGGAAGTAAA ATCTGTCGAAATGCACCATGAAGCTTTGAGTGAA GCTCTTCCTGGGGACAATGTGGGCTTCAATGTC AAGAATGTGTCTGTCAAGGATGTT | 6 | XQPEEI* |
| 3326 | NM_0014 02.5_554 | 554 | CTTTTTCGCAACGGGTTTGCCGCCAGAACACAG GTGTCGTGAAAACTACCCCTAAAAGCCAAAATG GGAAAGGAAAAGACTCATATCAACATTGTCGTCA TTGGACACGTAGATTCGGGCAAGTCCACCACTA CTGGCCATCTGATCTATAAATGCGGTGGCATCG ACAAAAGAACCATTGAAAAATTTGAGAAGGAGG CTGCTGAGATGGGAAAGGGCTCCTTCAAGTATG CCTGGGTCTTGGATAAACTGAAAGCTGAGCGTG AACGTGGTATCACCATTGATATCTCCTTGTGGAA ATTTGAGACCAGCAAGTACTATGTGACTATCATT GATGCCCCAGGACACAGAGACTTTATCAAAAAC ATGATTACAGGGACATCTCAGGCTGACTGTGCT GTCCTGATTGTTGCTGCTGGTGTTGGTGAATTTG AAGCTGGTATCTCCAAGAATGGGCAGACCCGAG AGCATGCCCTTCTGGCTTACACACTGGGTGTGA AACAACTAATTGTCGGTGTTAACAAAATGGATTC ACTGAGCCACCCTACAGCCANGAAGAGATATG AGGAAATTGTTAAGGAAGTCAGCACTTACATTAA GAAAATTGGCTACAACCCCGACACAGTAGCATTT GTGCCAATTTCTGGTTGGAATGGTGACAACATG CTGGAGCCAAGTGCTAACATGCCTTGGTTCAAG GGATGGAAAGTCACCCGTAAGGATGGCAATGCC AGTGGAACCACGCTGCTTGAGGCTCTGGACTGC ATCCTACCACCAACTCGTCCAACTGACAAGCCC | 4 | XEEI* |

TABLE 3B-continued

| SEQ ID | identifier_position | position | modified RNA | PAP length | PAP |
|---|---|---|---|---|---|
| | | | TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | | |
| 3327 | NM_0014<br>02.5_555 | 555 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGNAAGAGATATG<br>AGGAAATTGTTAAGGAAGTCAGCACTTACATTAA<br>GAAAATTGGCTACAACCCCGACACAGTAGCATTT<br>GTGCCAATTTCTGGTTGGAATGGTGACAACATG<br>CTGGAGCCAAGTGCTAACATGCCTTGGTTCAAG<br>GGATGGAAAGTCACCCGTAAGGATGGCAATGCC<br>AGTGGAACCACGCTGCTTGAGGCTCTGGACTGC<br>ATCCTACCACCAACTCGTCCAACTGACAAGCCC<br>TTGCGCCTGCCTCTCCAGGATGTCTACAAAATTG<br>GTGGTATTGGTACTGTTCCTGTTGGCCGAGTGG<br>AGACTGGTGTTCTCAAACCCGGTATGGTGGTCA<br>CCTTTGCTCCAGTCAACGTTACAACGGAAGTAAA<br>ATCTGTCGAAATGCACCATGAAGCTTTGAGTGAA<br>GCTCTTCCTGGGGACAATGTGGGCTTCAATGTC<br>AAGAATGTGTCTGTCAAGGATGTT | 3 | XEI* |
| 3328 | NM_0014<br>02.5_670 | 670 | CTTTTTCGCAACGGGTTTGCCGCCAGAACACAG<br>GTGTCGTGAAAACTACCCCTAAAAGCCAAAATG<br>GGAAAGGAAAAGACTCATATCAACATTGTCGTCA<br>TTGGACACGTAGATTCGGGCAAGTCCACCACTA<br>CTGGCCATCTGATCTATAAATGCGGTGGCATCG<br>ACAAAAGAACCATTGAAAAATTTGAGAAGGAGG<br>CTGCTGAGATGGGAAAGGGCTCCTTCAAGTATG<br>CCTGGGTCTTGGATAAACTGAAAGCTGAGCGTG<br>AACGTGGTATCACCATTGATATCTCCTTGTGGAA<br>ATTTGAGACCAGCAAGTACTATGTGACTATCATT<br>GATGCCCCAGGACACAGAGACTTTATCAAAAAC<br>ATGATTACAGGGACATCTCAGGCTGACTGTGCT<br>GTCCTGATTGTTGCTGCTGGTGTTGGTGAATTTG<br>AAGCTGGTATCTCCAAGAATGGGCAGACCCGAG<br>AGCATGCCCTTCTGGCTTACACACTGGGTGTGA<br>AACAACTAATTGTCGGTGTTAACAAAATGGATTC<br>CACTGAGCCACCCTACAGCCAGAAGAGATATGA<br>GGAAATTGTTAAGGAAGTCAGCACTTACATTAAG<br>AAAATTGGCTACAACCCCGACACAGTAGCATTTG<br>TGCCAATTTCTGGTTGGAATGGTGACAACATGCT<br>GGNAGCCAAGTGCTAACATGCCTTGGTTCAAGG<br>GATGGAAAGTCACCCGTAAGGATGGCAATGCCA<br>GTGGAACCACGCTGCTTGAGGCTCTGGACTGCA<br>TCCTACCACCAACTCGTCCAACTGACAAGCCCTT<br>GCGCCTGCCTCTCCAGGATGTCTACAAAATTGG<br>TGGTATTGGTACTGTTCCTGTTGGCCGAGTGGA<br>GACTGGTGTTCTCAAACCCGGTATGGTGGTCAC<br>CTTTGCTCCAGTCAACGTTACAACGGAAGTAAAA<br>TCTGTCGAAATGCACCATGAAGCTTTGAGTGAA<br>GCTCTTCCTGGGGACAATGTGGGCTTCAATGTC<br>AAGAATGTGTCTGTCAAGGATGTT | 4 | XAKC* |
| 3329 | NM_0014<br>04.4_544 | 544 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTT<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT | 28 | XGSEANSGAA<br>GCLLEDEDFS<br>GGRTSDIG* |

TABLE 3B-continued

| SEQ ID | identifier_ position | position | modified RNA | PAP length | PAP |
|---|---|---|---|---|---|
| | | | GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGANGGAAGTGAGGCGAATTC<br>TGGGGCTGCTGGATGCTTACTTGAAGACGAGGA<br>CTTTTCTGGTGGGCGAACGAGTGACATTGGCTG<br>ACATCACAGTTGTCTGCACCCTGTTGTGGCTCTA<br>TAAGCAGGTTCTAGAGCCTTCTTTCCGCCAGGC<br>CTTTCCCAATACCAACCGCTGGTTCCTCACCTGC<br>ATTAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | | |
| 3330 | NM_0014 04.4_574 | 574 | AACTGTCGTACGTATGTCTTCTGTTTCGTCCTCG<br>CTTTCCGGCTGCTGTTTCTCCACGGCTCTCCTCT<br>TTCCCCCTCCCTTCTCTCCCGGGCGGCTTACTTG<br>GCGGCAGCGCCGAGAACCCCACCCCCTTTCTTT<br>GCGGAATCACCATGGCGGCTGGGACCCTGTAC<br>ACGTATCCTGAAAACTGGAGGGCCTTCAAGGCT<br>CTCATCGCTGCTCAGTACAGCGGGGCTCAGGTC<br>CGCGTGCTCTCCGCACCACCCCACTTCCATTTT<br>GGCCAAACCAACCGCACCCCTGAATTTCTCCGC<br>AAATTTCCTGCCGGCAAGGTCCCAGCATTTGAG<br>GGTGATGATGGATTCTGTGTGTTTGAGAGCAAC<br>GCCATTGCCTACTATGTGAGCAATGAGGAGCTG<br>CGGGGAAGTACTCCAGAGGCAGCAGCCCAGGT<br>GGTGCAGTGGGTGAGCTTTGCTGATTCCGATAT<br>AGTGCCCCCAGCCAGTACCTGGGTGTTCCCCAC<br>CTTGGGCATCATGCACCACAACAAACAGGCCAC<br>TGAGAATGCAAAGGAGGAAGTGAGGCGAATTCT<br>GGGGCTGCTGGANTGCTTACTTGAAGACGAGGA<br>CTTTTCTGGTGGGCGAACGAGTGACATTGGCTG<br>ACATCACAGTTGTCTGCACCCTGTTGTGGCTCTA<br>TAAGCAGGTTCTAGAGCCTTCTTTCCGCCAGGC<br>CTTTCCCAATACCAACCGCTGGTTCCTCACCTGC<br>ATTAACCAGCCCCAGTTCCGGGCTGTCTTGGGC<br>GAAGTGAAACTGTGTGAGAAGATGGCCCAGTTT<br>GATGCTAAAAAGTTTGCAGAGACCCAACCTAAAA<br>AGGACACACCACGGAAAGAGAAGGGTTCACGG<br>GAAGAGAAGCAGAAGCCCCAGGCTGAGCGGAA<br>GGAGGAGAAAAAGGCGGCTGCCCCTGCTCCTG<br>AGGAGGAGATGGATGAATGTGAGCAGGCGCTG<br>GCTGCTGAGCCCAAGGCCAAGGACCCCTTCGCT<br>CACCTGCCCAAGAGTACCTTTGTGTTGGATGAAT | 18 | XCLLEDEDFS GGRTSDIG* |
| 3331 | NM_0014 28.2_528 | 528 | TAGCTAGGCAGGAAGTCGGCGGGGCGGCGCG<br>GACAGTATCTGTGGGTACCCGGAGCACGGAGAT<br>CTCGCCGGCTTTACGTTCACCTCGGTGTCTGCA<br>GCACCCTCCGCTTCCTCTCCTAGGCGACGAGAC<br>CCAGTGGCTAGAAGTTCACCATGTCTATTCTCAA<br>GATCCATGCCAGGGAGATCTTTGACTCTCGCGG<br>GAATCCCACTGTTGAGGTTGATCTCTTCACCTCA<br>AAAGGTCTCTTCAGAGCTGCTGTGCCCAGTGGT<br>GCTTCAACTGGTATCTATGAGGCCCTAGAGCTC<br>CGGGACAATGATAAGACTCGCTATATGGGGAAG<br>GGTGTCTCAAAGGCTGTTGAGCACATCAATAAAA<br>CTATTGCGCCTGCCCTGGTTAGCAAGAAACTGA<br>ACGTCACAGAACAAGAGAAGATTGACAAACTGA<br>TGATCGAGATGGATGGAACAGAAAATAAATCTAA<br>GTTTGGTGCGAACGCCATTCTGGGGGTGTCCCT<br>TGCCGTCTGCAAAGCTGGTGCCGTTGAGAANGG<br>GGGTCCCCCTGTACCGCCACATCGCTGACTTGG<br>CTGGCAACTCTGAAGTCATCCTGCCAGTCCCGG<br>CGTTCAATGTCATCAATGGCGGTTCTCATGCTG<br>GCAACAAGCTGGCCATGCAGGAGTTCATGATCC<br>TCCCAGTCGGTGCAGCAAACTTCAGGGAAGCCA<br>TGCGCATTGGAGCAGAGGTTTACCACAACCTGA<br>AGAATGTCATCAAGGAGAAATATGGGAAAGATG | 10 | XGGPPVPPHR* |

TABLE 3B-continued

| SEQ ID | identifier_ position | position | modified RNA | PAP length | PAP |
|---|---|---|---|---|---|
| | | | CCACCAATGTGGGGGATGAAGGCGGGTTTGCTC CCAACATCCTGGAGAATAAAGAAGGCCTGGAGC TGCTGAAGACTGCTATTGGGAAAGCTGGCTACA CTGATAAGGTGGTCATCGGCATGGACGTAGCGG CCTCCGAGTTCTTCAGGTCTGGGAAGTATGACC TGGACTTCAAGTCTCCCGATGACCCCAGCAGGT ACATCTCGCCTGACCAGCTGGCTGACCTGTACA AGTCCTTCATCAAGGACTACCCAGTGGTGTC | | |
| 3332 | NM_0020 46.3_580 | 580 | AAATTGAGCCCGCAGCCTCCCGCTTCGCTCTCT GCTCCTCCTGTTCGACAGTCAGCCGCATCTTCTT TTGCGTCGCCAGCCGAGCCACATCGCTCAGACA CCATGGGGAAGGTGAAGGTCGGAGTCAACGGA TTTGGTCGTATTGGGCGCCTGGTCACCAGGGCT GCTTTTAACTCTGGTAAAGTGGATATTGTTGCCA TCAATGACCCCTTCATTGACCTCAACTACATGGT TTACATGTTCCAATATGATTCCACCCATGGCAAA TTCCATGGCACCGTCAAGGCTGAGAACGGGAAG CTTGTCATCAATGGAAATCCCATCACCATCTTCC AGGAGCGAGATCCCTCCAAAATCAAGTGGGGCG ATGCTGGCGCTGAGTACGTCGTGGAGTCCACTG GCGTCTTCACCACCATGGAGAAGGCTGGGGCTC ATTTGCAGGGGGGAGCCAAAAGGGTCATCATCT CTGCCCCCTCTGCTGATGCCCCCATGTTCGTCA TGGGTGTGAACCATGAGAAGTATGACAACAGCC TCAAGATCATCAGCAATGCCTCCTGCACCACCA ACTGCTTAGCACCCCNTGGCCAAGGTCATCCAT GACAACTTTGGTATCGTGGAAGGACTCATGACC ACAGTCCATGCCATCACTGCCACCCAGAAGACT GTGGATGGCCCCTCCGGGAAACTGTGGCGTGA TGGCCGCGGGGCTCTCCAGAACATCATCCCTGC CTCTACTGGCGCTGCCAAGGCTGTGGGCAAGGT CATCCCTGAGCTGAACGGGAAGCTCACTGGCAT GGCCTTCCGTGTCCCCACTGCCAACGTGTCAGT GGTGGACCTGACCTGCCGTCTAGAAAAACCTGC CAAATATGATGACATCAAGAAGGTGGTGAAGCA GGCGTCGGAGGGCCCCCTCAAGGGCATCCTGG GCTACACTGAGCACCAGGTGGTCTCCTCTGACT TCAACAGCGACACCCACTCCTCCACCTTTGACG CTGGGGCTGGCATTGCCCTCAACGACCACTTT | 6 | XGQGHP* |
| 3333 | NM_0023 00.4_582 | 582 | CTTGCAGAGCCGGCGCCGGAGGAGACGCACGC AGCTGACTTTGTCTTCTCCGCACGACTGTTACAG AGGTCTCCAGAGCCTTCTCTCTCCTGTGCAAAAT GGCAACTCTTAAGGAAAAACTCATTGCACCAGTT GCGGAAGAAGAGGCAACAGTTCCAAACAATAAG ATCACTGTAGTGGGTGTTGGACAAGTTGGTATG GCGTGTGCTATCAGCATTCTGGGAAAGTCTCTG GCTGATGAACTTGCTCTTGTGGATGTTTTGGAAG ATAAGCTTAAAGGAGAAATGATGGATCTGCAGC ATGGGAGCTTATTTCTTCAGACACCTAAAATTGT GGCAGATAAAGATTATTCTGTGACCGCCAATTCT AAGATTGTAGTGGTAACTGCAGGAGTCCGTCAG CAAGAAGGGGAGAGTCGGCTCAATCTGGTGCA GAGAAATGTTAATGTCTTCAAATTCATTATTCCTC AGATCGTCAAGTACAGTCCTGATTGCATCATAAT TGTGGTTTCCAACCCAGTGGACATTCTTACGTAT GTTACCTGGAAACTAAGTGGATTACCCAAACACC GCGTGATTGGAANGTGGATGTAATCTGGATTCT GCTAGATTTCGCTACCTTATGGCTGAAAAACTTG GCATTCATCCCAGCAGCTGCCATGGATGGATTT TGGGGGAACATGGCGACTCAAGTGTGGCTGTGT GGAGTGGTGTGAATGTGGCAGGTGTTTCTCTCC AGGAATTGAATCCAGAAATGGGAACTGACAATG ATAGTGAAAATTGGAAGGAAGTGCATAAGATGG TGGTTGAAAGTGCCTATGAAGTCATCAAGCTAAA AGGATATACCAACTGGGCTATTGGATTAAGTGTG GCTGATCTTATTGAATCCATGTTGAAAAATCTAT CCAGGATTCATCCCGTGTCAACAATGGTAAAGG GGATGTATGGCATTGAGAATGAAGTCTTCCTGA GCCTTCCATGTATCCTCAATGCCCGGGGATTAA CCAGCGTTATCAACCAGAAGC | 3 | XWM* |
| 3334 | NM_0207 55.2_79 | 79 | AATCTCGGAAAGGCGAGAAAGAAGCTGTCTCCA TCTTGTCTGTATCCGCTGCTCTTGTGACGTTGTG GAGATGGGGAGCNGTCCTGGGGCTGTGCTCCA TGGCGAGCTGGATACCATGTTTGTGTGGAAGTG CCCCGTGTTTGCTATGCCGATGCTGTCCTAGTG GAAACAACTCCACTGTAACTAGATTGATCTATGC ACTTTTCTTGCTTGTTGGAGTATGTGTAGCTTGT | 27 | XPGAVLHGEL DTMFVWKCP VFAMPMLS* |

TABLE 3B-continued

| SEQ ID | identifier_position | position | modified RNA | PAP length | PAP |
|---|---|---|---|---|---|
| | | | GTAATGTTGATACCAGGAATGGAAGAACAACTG<br>AATAAGATTCCTGGATTTTGTGAGAATGAGAAAG<br>GTGTTGTCCCTTGTAACATTTTGGTTGGCTATAA<br>AGCTGTATATCGTTTGTGCTTTGGTTTGGCTATG<br>TTCTATCTTCTTCTCTCTTTACTAATGATCAAAGT<br>GAAGAGTAGCAGTGATCCTAGAGCTGCAGTGCA<br>CAATGGATTTTGGTTCTTTAAATTTGCTGCAGCA<br>ATTGCAATTATTATTGGGGCATTCTTCATTCCAG<br>AAGGAACTTTTACAACTGTGTGGTTTTATGTAGG<br>CATGGCAGGTGCCTTTTGTTTCATCCTCATACAA<br>CTAGTCTTACTTATTGATTTTGCACATTCATGGAA<br>TGAATCGTGGGTTGAAAAAATGGAAGAAGGGAA<br>CTCGAGATGTTGGTATGCAGCCTTGTTATCAGCT<br>ACAGCTCTGAATTATCTGCTGTCTTTAGTTGCTA<br>TCGTCCTGTTCTTTGTCTACTACACTCATCCAGC<br>CAGTTGTTCAGAAAACAAGGCGTTCATCAGTGTC<br>AACATGCTCCTCTGCGTTGGTGCTTCTGTAATGT<br>CTATACTGCCAAAAATCCAAGAATCACAACCAAG<br>ATCTGGTTTGTTACAGTCTTCAGTAATTACAGTC<br>TACACAATGTATTTGACATGGTCAGCTATGACCA<br>ATGAACCAGAAACAAATTGCAACCCAAGTCTACT<br>AAGCATAATTGGCTACAATACAACAAGCACTGTC<br>CCAAAGGAAGGGCAGTCAGTCCAGTGGTGGCAT<br>GCTCAAGGAAT | | |

TABLE 4

Clinical data of control individuals and cancer subjects.

| | Number | Age (Years) | Female | Male | Stage* |
|---|---|---|---|---|---|
| Healthy Control | 26 | 55 ± 18 | 13 | 13 | — |
| Chronic Obstructive Pulmonary Disease | 12 | 55 ± 11 | 2 | 10 | — |
| All Cancer STUDY I | 46 | 61 ± 11 | 26 | 20 | |
| Colon | 9 | 65 ± 13 | 1 | 8 | T+N0M0 → T+N+M+ |
| Lung (7 NSCLC + 2 SCLC) | 9 | 67 ± 7 | 2 | 7 | T+N0M0 → T+N+M+ |
| Breast | 9 | 60 ± 11 | 9 | 0 | T+N0M0 → T+N+M+ |
| Ovarian | 4 | 58 ± 6 | 4 | 0 | T+N0M0 → T+N+M+ |
| Uterus | 5 | 50 ± 8 | 5 | 0 | T+N0M0 → T+N+M0 |
| Head & Neck | 7 | 60 ± 11 | 3 | 4 | T+N0M0 → T+N+M+ |
| Melanoma | 3 | 58 ± 14 | 2 | 1 | T+N+M0 → T+N+M+ |
| Lung Cancer STUDY II (NSCLC) | 49 | 67 ± 13 | 10 | 39 | |
| | 10 | 66 ± 14 | 3 | 7 | N0M0 |
| | 25 | 68 ± 14 | 4 | 21 | N+M0 |
| | 14 | 67 ± 10 | 3 | 11 | N+M1 |

| | n | % | Age (y) | min | max |
|---|---|---|---|---|---|
| Study III | | | | | |
| Controls | 161 | | 42 ± 14 | 18 | 65 |
| NSCLC | 140 | | 61 ± 11 | 38 | 86 |
| T1-2-3-4N0M0 | 78 | 56 | 61 | 38 | 86 |
| T+N+M0 | 43 | 31 | 69 | 44 | 86 |
| T+N+M+ | 19 | 13 | 61 | 46 | 77 |
| ADK | 67 | 48 | 60 | 45 | 82 |
| Squamous | 40 | 33 | 65 | 48 | 86 |
| Other | 33 | 19 | 58 | 38 | 82 |
| Study IV | | | | | |
| Controls | 20 | | 47 ± 13 | 20 | 62 |
| NSCLC | 20 | | 61 ± 10 | 48 | 83 |
| T1N0M0 | 9 | 45 | 60 ± 7 | 49 | 70 |
| T2N0M0 | 11 | 55 | 62 ± 12 | 48 | 83 |
| Breast | 20 | | 56 ± 10 | 36 | 68 |
| Grade level 1 | 4 | 20 | 60 ± 6 | 53 | 67 |
| Grade level 2 | 9 | 45 | 56 ± 10 | 40 | 68 |
| Grade level 3 | 7 | 35 | 54 ± 11 | 36 | 68 |

International Union Against Cancer (UICC): TNM Classification of malignant tumours. 4th ed. Hermanek P, Sobin LH, eds. Berlin, Heidelberg, New York: Springer Verlag; 1987. Revised 1992.

TABLE 5

Characteristics of 45 PAP polypeptides

| Gene | Accession Number | peptide position | length | % devN | % devC | peptide | PAP number | SEQ ID NO | PAP coordonates on SEQ ID |
|---|---|---|---|---|---|---|---|---|---|
| MRPL12 | NM_002949.2 | 687 | 30 | 3.85 | 17.74 | WRRWAAPWFWSSLQLGGLVFRGPGPRARSR | 1 | 1 | 1-30 |

TABLE 5-continued

Characteristics of 45 PAP polypeptides

| Gene | Accession Number | peptide position | peptide length | % devN | % devC | peptide | PAP number | SEQ ID NO | PAP coordonates on SEQ ID |
|---|---|---|---|---|---|---|---|---|---|
| DECRI | NM_001359.1 | 257 | 35 | 9.30 | 41.38 | NLNSFHLFKKRCYHLIVFKEKWHS LLGEVLALVKE | 2 | 2 | 1-35 |
| ALDOA | NM_184041.1 | 602 | 25 | 0.42 | 4.26 | GWMGCLSAVPSTRRTELTSPSGVV C | 3 | 3 | 1-25 |
| COX4I1 | NM_001861.2 | 549 | 18 | 2.43 | 9.05 | RKALTKSGWPSRPRGCWT | 4 | 4 | 1-18 |
| TPII | NM_000365.4 | 149 | 13 | 1.59 | 8.59 | LPLLPISTSPGRS | 5 | 5 | 1-13 |
| ENOL | NM_001428.2 | 548 | 17 | 1.13 | 8.23 | SLTWLATLKSSCQSRRS | 6 | 6 | 1-17 |
| IK | NM_006083.3 | 614 | 19 | 0.00 | 15.38 | LCFKRYELRLPAKRKRKRN | 7 | 7 | 1-19 |
| LYZ | NM_000239.1 | 78 | 12 | 8.58 | 41.03 | ARSLKGVSWPEL | 8 | 8 | 1-12 |
| PRR4 | NM_007244.2 | 215 | 30 | 0.00 | 30.14 | VIVVTKMMVLSRDHQNQEAITAIL PHLLFK | 9 | 1770 | 2-31 |
| CCNBI | NM_031966.2 | 539 | 27 | 0.93 | 22.73 | LILPLQAQWKHLDVPLQKKTCVRL SLM | 10 | 10 | 1-27 |
| CRABP2 | NM_001878.2 | 537 | 37 | 2.00 | 18.62 | STSESEWPQVEPRPKPTTGHAHRP ASLPPPSHPLLLG | 11 | 11 | 1-37 |
| HSPA8 | NM_153201.1 | 165 | 20 | 0.09 | 2.23 | PMIRETEPLQAMSPLRTLNG | 12 | 12 | 1-20 |
| LCPI | NM_002298.2 | 227 | 16 | 1.31 | 18.89 | LPKLILMAMDTSASMS | 13 | 13 | 1-16 |
| PSMDI3 | NM_02817.2 | 223 | 21 | 1.60 | 12.57 | LPKEMVSLSFMKTLSVNLNTG | 14 | 14 | 1-21 |
| FH | NM_000143.2 | 141 | 16 | 0.00 | 21.13 | FGLRTRLEWQAKIPSG | 15 | 15 | 1-16 |
| GPI | NM_000175.2 | 1255 | 16 | 5.56 | 33.04 | PMASMLFTSSSTKAPR | 20 | 44 | 1-16 |
| ACO2 | NM_001098.2 | 623 | 12 | 5.17 | 20.21 | MLWMSWLGSPGS | 21 | 532 | 10-21 |
| NDUFBS | NM_002492.2 | 194 | 13 | 4.84 | 15.08 | LSSDLLDSMTGVF | 22 | 1063 | 1-13 |
| NDUFS3 | NM_004551.1 | 195 | 23 | 4.41 | 17.95 | LESMWLKSCPSMSNKFRCPASMS | 23 | 1380 | 1-23 |
| NDUFABI | NM_005003.2 | 366 | 19 | 2.07 | 13.08 | WTKWRLSWPWKTNLGLKFL | 24 | 1413 | 1-19 |
| ECHI | NM_001398.2 | 871 | 30 | 1.59 | 14.61 | RFPARAPWRCRAPRSTCCIP ATIRWPRAST | 25 | 581 | 1-30 |
| NPMI | NM_002520.5 | 589 | 11 | 8.33 | 27.59 | LEVVARFHRKK | 26 | 1075 | 1-11 |
| ECHSI | NM_004092.2 | 149 | 22 | 5.13 | 12.41 | SPRVLTLSTSSQKKEGRITPWG | 27 | 1330 | 1-22 |
| CFLI | NM_005507.2 | 447 | 30 | 0.48 | 4.31 | LSRCCQIRTAAMPSMMQPMRP RRARRRIWC | 28 | 1457 | 1-30 |
| MRPL3 | NM_007208.2 | 275 | 30 | 1.76 | 12.38 | LLEVFMERVVHGGMSIFLKKM SHSLSSWSL | 29 | 1769 | 1-30 |
| CYCS | NM_018947.4 | 351 | 12 | 8.78 | 35.77 | WRIPRSTSLEQK | 35 | 1972 | 1-12 |
| B2M | NM_004048.2 | 193 | 15 | 2.58 | 10.85 | AMCLGFIHPTLKLTY | 37 | 1323 | 1-15 |
| ILF2 | NM_004515.2 | 360 | 19 | 1.92 | 15.81 | HLKCKLKKFDRWDPIKRGQ | 38 | 1373 | 1-19 |
| BCAP31 | NM_005745.6 | 194 | 27 | 1.54 | 8.72 | LLCCFSAFPSFLLKDGRRFSS PGWWSC | 39 | 1499 | 1-27 |
| PHB | NM_002634.2 | 703 | 12 | 11.69 | 20.41 | SSLLRATPRQLS | 40 | 1098 | 1-12 |
| PGKI | NM_000291.2 | 567 | 11 | 0.33 | 5.71 | LALLTEPTAPW | 41 | 57 | 1-11 |
| UQCRCI | NM_003365.2 | 323 | 30 | 1.44 | 10.55 | WSIWLSREQRIGLAVPWRRRWR AWGPILMP | 44 | 1270 | 1-30 |

TABLE 5-continued

Characteristics of 45 PAP polypeptides

| Gene | Accession Number | peptide position | peptide length | % devN | % devC | peptide | PAP number | SEQ ID NO | PAP coordinates on SEQ ID |
|---|---|---|---|---|---|---|---|---|---|
| NDUFVI | NM_007103.2 | 657 | 29 | 2.47 | 11.94 | LWCAGLGPTSVERRQRSSSPLR ASRASPA | 46 | 1757 | 1-29 |
| ATF4 | NM_001675.2 | 1387 | 11 | 5.50 | 17.22 | SCPPLQIIPLV | 47 | 864 | 1-11 |
| VIM | NM_003380.2 | 652 | 30 | 0.00 | 2.49 | TWPRTSCASGRNCRRRCFRERK PKTPCNLS | 48 | 1276 | 2-31 |
| PTTG1 | NM_004219.2 | 236 | 11 | 1.82 | 19.77 | WELSTELQKSL | 49 | 1336 | 1-11 |
| PABPC1 | NM_002568.3 | 1293 | 19 | 1.16 | 4.17 | VELRKRWNGRRNLSANLNR | 62 | 1079 | 1-19 |
| CDKNIA | NM_000389.2 | 378 | 30 | 0 | 6.09 | LAPHLLCCRGQQRKTMWTCHCL VPLCLAQG | 70 | 80 | 1-30 |
| PRDX6 | NM_004905.2 | 322 | 30 | 0.31 | 3.66 | VKSPQKSYLFPSSMIGIGSLPS CWACWIQQ | 66 | 1396 | 1-30 |
| RPL13A | NM_012423.2 | 355 | 17 | 0.63 | 4.88 | TTRKSGWWFLLPSRSCV | 68 | 1810 | 1-17 |
| APEX1 | NM_001641.2 | 419 | 30 | 0.81 | 8.72 | QRKMTKRQQERAQPCMRTPQIR KPHPVANL | 74 | 847 | 1-30 |
| MLF2 | NM_005439.1 | 343 | 31 | 2.27 | 12.64 | PGLPAAGCSRLELSPPLGCWEC RVVSWTCLG | 82 | 1451 | 1-31 |
| TUBB | NM_178014.2 | 370 | 30 | 0.40 | 9.76 | LARSLDQTTLYLVSLGQVTTGP KATTQRAP | 94 | 2119 | 1-30 |
| LAPTM4A | NM_014713.3 | 758 | 21 | 2.01 | 7.03 | MLCTLPLKHLLSTFCQPMKWP | 69 | 1864 | 1-21 |
| CCT8 | NM_006585.2 | 536 | 22 | 0.21 | 5.70 | WYVVLQKTFEILMKSHLYFVPP | 86 | 1699 | 1-22 |

"PAP number" is the number of the PAP as referred to in the text.
"SEQ ID NO" is the identifier in the Sequence Listing.
"PAP coordinates on SEQ ID" designates the position of the amino acid residues of the PAP polypeptide in the quoted SEQ ID.

TABLE 6

Five negative controls

| symbol | gene name | sequence |
|---|---|---|
|  | ALB | QHKDDNPNLPRLVRP (SEQ ID NO: 3335) |
| CP on gene 1 | MRPL12 | IQQLVQDIASLTLLE ISDLNELLKKTLKIQ (SEQ ID NO: 3336) |
| CP 7 | IK | ALLQKVRAEIASKEKEEEE (SEQ ID NO: 3337) |
| CP 28 | CFL1 | FVKMLPDKDCRYALY EDATYTKESKKEDLV (SEQ ID NO: 3338) |
| CP 24 | NDUFAB1 | LDQVEIIMAMEDEFGFEIP (SEQ ID NO: 3339) |

REFERENCES

1. Weinberg, R. in *The biology of cancer* 655-724 (Garland Science, Taylor and Francis Group, LLC, 2007).
2. Vogelstein, B. & Kinzler, K. W. Cancer genes and the pathways they control. *Nat Med* 10, 789-99 (2004).
3. ASCO. American Society of Clinical Oncology policy statement update: genetic testing for cancer susceptibility. *J Clin Oncol* 21, 2397-406 (2003).
4. Fackenthal, J. D. & Olopade, O. I. Breast cancer risk associated with BRCA1 and BRCA2 in diverse populations. *Nat Rev Cancer* 7, 937-48 (2007).
5. Guillem, J. G. et al. ASCO/SSO review of current role of risk-reducing surgery in common hereditary cancer syndromes. *J Clin Oncol* 24, 4642-60 (2006).
6. van de Vijver, M. J. et al. A gene-expression signature as a predictor of survival in breast cancer. *N Engl J Med* 347, 1999-2009 (2002).
7. Anderson, N. L. et al. The human plasma proteome: a nonredundant list developed by combination of four separate sources. *Mol Cell Proteomics* 3, 311-26 (2004).
8. Wulfkuhle, J. D., Liotta, L. A. & Petricoin, E. F. Proteomic applications for the early detection of cancer. *Nat Rev Cancer* 3, 267-75 (2003).
9. Ishikawa, N. et al. ADAM8 as a novel serological and histochemical marker for lung cancer. *Clin Cancer Res* 10, 8363-70 (2004).
10. Ransohoff, D. F. Rules of evidence for cancer molecular-marker discovery and validation. *Nat Rev Cancer* 4, 309-14 (2004).
11. Ransohoff, D. F. Bias as a threat to the validity of cancer molecular-marker research. *Nat Rev Cancer* 5, 142-9 (2005).
12. Stroun, M. et al. Neoplastic characteristics of the DNA found in the plasma of cancer patients. *Oncology* 46, 318-22 (1989).
13. Boddy, J. L., Gal, S., Malone, P. R., Harris, A. L. & Wainscoat, J. S. Prospective study of quantitation of plasma DNA levels in the diagnosis of malignant versus benign prostate disease. *Clin Cancer Res* 11, 1394-9 (2005).
14. Boddy, J. L. et al. The role of cell-free DNA size distribution in the management of prostate cancer. *Oncol Res* 16, 35-41 (2006).
15. Lund, A. H. & van Lohuizen, M. Epigenetics and cancer. *Genes Dev* 18, 2315-35 (2004).
16. Ducasse, M. & Brown, M. A. Epigenetic aberrations and cancer. *Mol Cancer* 5, 60 (2006).
17. Goessl, C. et al. Fluorescent methylation-specific polymerase chain reaction for DNA-based detection of prostate cancer in bodily fluids. *Cancer Res* 60, 5941-5 (2000).
18. Jeronimo, C. et al. Quantitative GSTP1 hypermethylation in bodily fluids of patients with prostate cancer. *Urology* 60, 1131-5 (2002).
19. Reibenwein, J. et al. Promoter hypermethylation of GSTP1, AR, and 14-3-3sigma in serum of prostate cancer patients and its clinical relevance. *Prostate* 67, 427-32 (2007).
20. Wang, Y. et al. Identification of epigenetic aberrant promoter methylation of RASSF1A in serum DNA and its clinicopathological significance in lung cancer. *Lung Cancer* 56, 289-94 (2007).
21. Diehl, F. et al. Detection and quantification of mutations in the plasma of patients with colorectal tumors. *Proc Natl Acad Sci USA* 102, 16368-73 (2005).
22. Korshunova, Y. et al. Massively parallel bisulphite pyrosequencing reveals the molecular complexity of breast cancer-associated cytosine-methylation patterns obtained from tissue and serum DNA. Genome Res (2007).
23. Bentley, D. R. Whole-genome re-sequencing. *Curr Opin Genet Dev* 16, 545-52 (2006).
24. Meyer, M., Stenzel, U., Myles, S., Prufer, K. & Hofreiter, M. Targeted high-throughput sequencing of tagged nucleic acid samples. *Nucleic Acids Res* 35, e97 (2007).
25. Tan, E. M. Autoantibodies as reporters identifying aberrant cellular mechanisms in tumorigenesis. *J Clin Invest* 108, 1411-5 (2001).
26. Finn, O. J. Immune response as a biomarker for cancer detection and a lot more. *N Engl J Med* 353, 1288-90 (2005).
27. Zinkernagel, R. M. What is missing in immunology to understand immunity?*Nat Immunol* 1, 181-5 (2000).
28. Wang, X. et al. Autoantibody signatures in prostate cancer. *N Engl J Med* 353, 1224-35 (2005).
29. Somers, V. A. et al. A panel of candidate tumor antigens in colorectal cancer revealed by the serological selection of a phage displayed cDNA expression library. *J Immunol* 169, 2772-80 (2002).
30. Hardouin, J., Lasserre, J. P., Sylvius, L., Joubert-Caron, R. & Caron, M. Cancer immunomics: from serological proteome analysis to multiple affinity protein profiling. *Ann NY Acad Sci* 1107, 223-30 (2007).
31. Sjoblom, T. et al. The consensus coding sequences of human breast and colorectal cancers. *Science* 314, 268-74 (2006).
32. Wood, L. D. et al. The genomic landscapes of human breast and colorectal cancers. *Science* 318, 1108-13 (2007).
33. Nelkin B, P. D., Robinson S, Small D, Vogelstein B. (ed. Owens, A., Coffey, D S, Baylin, S B) 441-460 (Academic Press, New York, 1982).
34. Brulliard, M. et al. Nonrandom variations in human cancer ESTs indicate that mRNA heterogeneity increases during carcinogenesis. *Proc Natl Acad Sci USA* 104, 7522-7 (2007).
35. Armache, K. J., Kettenberger, H. & Cramer, P. The dynamic machinery of mRNA elongation. *Curr Opin Struct Biol* 15, 197-203 (2005).
36. Kashkina, E. et al. Template misalignment in multisubunit RNA polymerases and transcription fidelity. *Mol Cell* 24, 257-66 (2006).
37. Pomerantz, R. T., Temiakov, D., Anikin, M., Vassylyev, D. G. & McAllister, W. T. A mechanism of nucleotide misincorporation during transcription due to template-strand misalignment. *Mol Cell* 24, 245-55 (2006).
38. Zhang, Z., Schwartz, S., Wagner, L. & Miller, W. A greedy algorithm for aligning DNA sequences. *J Comput Biol* 7, 203-14 (2000).
39. Boguski, M. S., Lowe, T. M. & Tolstoshev, C. M. dbEST—database for "expressed sequence tags". *Nat Genet.* 4, 332-3 (1993).
40. Pruitt, K. D., Tatusova, T. & Maglott, D. R. NCBI reference sequences (RefSeq): a curated non-redundant sequence database of genomes, transcripts and proteins. *Nucleic Acids Res* 35, D61-5 (2007).
41. Dalmasso, C., Broet, P. Procédures d' estimation du false discovery rate basées sur la distribution des degrés de signification. *Journal de la Société Française de Statistiques* 146 (2005).
42. Bairoch, A. & Apweiler, R. The SWISS-PROT protein sequence data bank and its supplement TrEMBL in 1999. *Nucleic Acids Res* 27, 49-54 (1999).
43. Bamford, S. et al. The COSMIC (Catalogue of Somatic Mutations in Cancer) database and website. *Br J Cancer* 91, 355-8 (2004).
44. Sherry, S. T. et al. dbSNP: the NCBI database of genetic variation. *Nucleic Acids Res* 29, 308-11 (2001).
45. Sharma, S. et al. T cell-derived IL-10 promotes lung cancer growth by suppressing both T cell and APC function. *J Immunol* 163, 5020-8 (1999).
46. Bertram, J. S. & Janik, P. Establishment of a cloned line of Lewis Lung Carcinoma cells adapted to cell culture. *Cancer Lett* 11, 63-73 (1980).
47. Gott, J. M. & Emeson, R. B. Functions and mechanisms of RNA editing. *Annu Rev Genet.* 34, 499-531 (2000).
48. Rogers, K., Gao, G. & Simpson, L. U-specific 3'-5' exoribonucleases involved in U-deletion RNA editing in trypanosomatid mitochondria. *J Biol Chem* (2007).
49. Lodish, H., Berk, A., Zipursky, L., Matsudaira, P., Baltimore, D., Darnell, J. in *Molecular cell biology* (ed. Freeman) 404-452 (2000).
50. Lamant, L. et al. Gene-expression profiling of systemic anaplastic large-cell lymphoma reveals differences based on ALK status and two distinct morphologic ALK+ subtypes. *Blood* 109, 2156-64 (2007).
51. Chiarle, R. et al. NPM-ALK transgenic mice spontaneously develop T-cell lymphomas and plasma cell tumors. *Blood* 101, 1919-27 (2003).
52. Wormington, M. Zero tolerance for nonsense: nonsense-mediated mRNA decay uses multiple degradation pathways. *Mol Cell* 12, 536-8 (2003).
53. Biemann, K. Sequencing of peptides by tandem mass spectrometry and high-energy collision-induced dissociation. *Methods Enzymol* 193, 455-79 (1990).
54. Glickman, M. H. & Ciechanover, A. The ubiquitin-proteasome proteolytic pathway: destruction for the sake of construction. *Physiol Rev* 82, 373-428 (2002).

SEQUENCE LISTING (3363 sequences)

SEQ ID NO: 1 - protein, 30 aa, Homo Sapiens
WRRWAAPWFWSSLQLGGLVFRGPGPRARSR

SEQ ID NO: 2 - protein, 35 aa, Homo Sapiens
NLNSFHLFKKRCYHLIVFKEKWHSLLGEVLALVKE

SEQ ID NO: 3 - protein, 25 aa, Homo Sapiens
GWMGCLSAVPSTRRTELTSPSGVVC

SEQ ID NO: 4 - protein, 18 aa, Homo Sapiens
RKALTKSGWPSRPRGCWT

SEQ ID NO: 5 - protein, 13 aa, Homo Sapiens
LPLLPISTSPGRS

SEQ ID NO: 6 - protein, 30 aa, Homo Sapiens
SLTWLATLKSSCQSRRSMSSMAVLMLATSW

SEQ ID NO: 7 - protein, 19 aa, Homo Sapiens
LCFKRYELRLPAKRKRKRN

SEQ ID NO: 8 - protein, 12 aa, Homo Sapiens
ARSLKGVSWPEL

SEQ ID NO: 9 - protein, 30 aa, Homo Sapiens
FKISNDHPNEDTVNSLYPDFLLSACRKHHH

SEQ ID NO: 10 - protein, 27 aa, Homo Sapiens
LILPLQAQWKHLDVPLQKKTCVRLSLM

SEQ ID NO: 11 - protein, 37 aa, Homo Sapiens
STSESEWPQVEPRPKPTTGHAHRPASLPPPSHPLLLG

SEQ ID NO: 12 - protein, 20 aa, Homo Sapiens
PMIRETEPLQAMSPLRTLNG

SEQ ID NO: 13 - protein, 16 aa, Homo Sapiens
LPKLILMAMDTSASMS

SEQ ID NO: 14 - protein, 21 aa, Homo Sapiens
LPKEMVSLSFMKTLSVNLNTG

SEQ ID NO: 15 - protein, 16 aa, Homo Sapiens
FGLRTRLEWQAKIPSG

SEQ ID NO: 16 - protein, 6 aa, Homo Sapiens
CQSLPE

SEQ ID NO: 17 - protein, 71 aa, Homo Sapiens
LWRSSSGRPSSPAHCMRTATSWAPLLPGPASPANKWKSPSGRGPSMCPTAPQERGTIRSGLSSAATHWPPR

SEQ ID NO: 18 - protein, 5 aa, Homo Sapiens
KRSRI

SEQ ID NO: 19 - protein, 66 aa, Homo Sapiens
ESTATRWHLHPWLLHSGTELPKFFCSPHMQHLWTCGVLAVSLQRCFVESLSSVETLKPTSWAKSLT

SEQ ID NO: 20 - protein, 62 aa, Homo Sapiens
TRWHLHPWLLHSGTELPKFFCSPHMQHLWTCGVLAVSLQRCFVESLSSVETLKPTSWAKSLT

SEQ ID NO: 21 - protein, 15 aa, Homo Sapiens
GLRTRLEWQAKIPSG

SEQ ID NO: 22 - protein, 3 aa, Homo Sapiens
LAS

SEQ ID NO: 23 - protein, 34 aa, Homo Sapiens
RQPSTAWSICTCRPPTPTSLWASISTAMMWLWKA

SEQ ID NO: 24 - protein, 31 aa, Homo Sapiens
STAWSICTCRPPTPTSLWASISTAMMWLWKA

SEQ ID NO: 25 - protein, 25 aa, Homo Sapiens
CTCRPPTPTSLWASISTAMMWLWKA

SEQ ID NO: 26 - skipped

SEQ ID NO: 27 - protein, 17 aa, Homo Sapiens
TSLWASISTAMMWLWKA

SEQ ID NO: 28 - protein, 7 aa, Homo Sapiens
MMWLWKA

SEQ ID NO: 29 - protein, 16 aa, Homo Sapiens
SSANWPRRSARATSVS

SEQ ID NO: 30 - protein, 12 aa, Homo Sapiens
WPRRSARATSVS

SEQ ID NO: 31 - protein, 22 aa, Homo Sapiens
AALSSRTSRSQLKMSGVKPQTP

SEQ ID NO: 32 - protein, 21 aa, Homo Sapiens
ALSSRTSRSQLKMSGVKPQTP

SEQ ID NO: 33 - protein, 11 aa, Homo Sapiens
VKMSGVKPQTP

SEQ ID NO: 34 - protein, 2 aa, Homo Sapiens
EP

SEQ ID NO: 35 - skipped

SEQ ID NO: 36 - protein, 6 aa, Homo Sapiens
WPWRKS

SEQ ID NO: 37 - protein, 4 aa, Homo Sapiens
WRKS

SEQ ID NO: 38 - protein, 24 aa, Homo Sapiens
FWIFMPWVLPARTPISVTSWRLTS

SEQ ID NO: 39 - protein, 23 aa, Homo Sapiens
WIFMPWVLPARTPISVTSWRLTS

SEQ ID NO: 40 - protein, 18 aa, Homo Sapiens
WVLPARTPISVTSWRLTS

SEQ ID NO: 41 - protein, 13 aa, Homo Sapiens
RTPISVTSWRLTS

SEQ ID NO: 42 - skipped

SEQ ID NO: 43 - protein, 7 aa, Homo Sapiens
SRRWVTT

SEQ ID NO: 44 - protein, 16 aa, Homo Sapiens
PMASMLFTSSSTKAPR

SEQ ID NO: 45 - protein, 1 aa, Homo Sapiens
C

SEQ ID NO: 46 - protein, 9 aa, Homo Sapiens
FELTLPIQR

SEQ ID NO: 47 - protein, 9 aa, Homo Sapiens
WWVCLLLWT

SEQ ID NO: 48 - protein, 33 aa, Homo Sapiens
ASMQALGALVPGSPCPAPPASGAAWGPGAWPPG

SEQ ID NO: 49 - protein, 5 aa, Homo Sapiens
LTWTE

SEQ ID NO: 50 - protein, 2 aa, Homo Sapiens
SS

SEQ ID NO: 51 - protein, 5 aa, Homo Sapiens
TTKRK

SEQ ID NO: 52 - protein, 4 aa, Homo Sapiens
TKRK

SEQ ID NO: 53 - protein, 10 aa, Homo Sapiens
LSRKDSALLV

SEQ ID NO: 54 - protein, 8 aa, Homo Sapiens
RMGSNTTG

SEQ ID NO: 55 - protein, 11 aa, Homo Sapiens
LMVCPCLTSTP

SEQ ID NO: 56 - skipped

SEQ ID NO: 57 - protein, 11 aa, Homo Sapiens
LALLTEPTAPW

SEQ ID NO: 58 - protein, 2 aa, Homo Sapiens
PW

SEQ ID NO: 59 - protein, 7 aa, Homo Sapiens
HRRLVGF

SEQ ID NO: 60 - skipped

SEQ ID NO: 61 - protein, 33 aa, Homo Sapiens
MVVEWLLPSLRCSTTWRLALLCLMKREPRLSKT

SEQ ID NO: 62 - protein, 32 aa, Homo Sapiens
LFIVIASALRTAASRPTTRGGGTGPCSRWTGC

SEQ ID NO: 63 - protein, 16 aa, Homo Sapiens
TTRGGGTGPCSRWTGC

SEQ ID NO: 64 - protein, 81 aa, Homo Sapiens
TCVLCRRLLALIGSTSPTASSGTKGKSVANQQSSATSAVLDMKRSLGRRAVQQPYHSQTFTRPWESLDPPPLSCTRTARRS

SEQ ID NO: 65 - skipped

SEQ ID NO: 66 - protein, 3 aa, Homo Sapiens
QKP

SEQ ID NO: 67 - protein, 23 aa, Homo Sapiens
RCRPTPRWFVLPLLPISTSPGRS

SEQ ID NO: 68 - protein, 19 aa, Homo Sapiens
TPRWFVLPLLPISTSPGRS

SEQ ID NO: 69 - protein, 14 aa, Homo Sapiens
VLPLLPISTSPGRS

SEQ ID NO: 70 - protein, 10 aa, Homo Sapiens
MLWLRRTATK

SEQ ID NO: 71 - protein, 6 aa, Homo Sapiens
LGSQMS

SEQ ID NO: 72 - protein, 8 aa, Homo Sapiens
MLWQRDSE

SEQ ID NO: 73 - protein, 10 aa, Homo Sapiens
SSRQRSSQIT

SEQ ID NO: 74 - protein, 28 aa, Homo Sapiens
MSLCGPLVLARLQHPNRPRKYTRSSEDG

SEQ ID NO: 75 - protein, 4 aa, Homo Sapiens
ETGR

SEQ ID NO: 76 - protein, 16 aa, Homo Sapiens
EHPNRPRKYTRSSEDG

SEQ ID NO: 77 - protein, 15 aa, Homo Sapiens
NPNRPRKYTRSSEDG

SEQ ID NO: 78 - protein, 41 aa, Homo Sapiens
SLWVVLPSSPNSWTSSMPNNEPHPSSLPFLPSQGLSSPEAQ

SEQ ID NO: 79 - protein, 11 aa, Homo Sapiens
WKLLRFFRRRA

SEQ ID NO: 80 - protein, 52 aa, Homo Sapiens
LAPHLLCCRGQQRKTMWTCHCLVPLCLAQGSRLKGPQVDLETLRVENGGRPA

SEQ ID NO: 81 - protein, 2 aa, Homo Sapiens
CA

SEQ ID NO: 82 - protein, 7 aa, Homo Sapiens
CAGCWMS

SEQ ID NO: 83 - protein, 17 aa, Homo Sapiens
EPTWRCRLRTSRRSWPT

SEQ ID NO: 84 - protein, 1 aa, Homo Sapiens
T

SEQ ID NO: 85 - protein, 37 aa, Homo Sapiens
LEIIQQAVPVQVLTLILYPENTVGQRMKRGMLETWAM

SEQ ID NO: 86 - protein, 91 aa, Homo Sapiens
SSSPGLRCVATMLPGTLRSSWWALTVCPYAGTAAASRPLTSSLTSKPCCLKGPAVPRAPLLPRLLGSCSAAVSGGFSSMRVFPLNLRGRNT

SEQ ID NO: 87 - protein, 6 aa, Homo Sapiens
VVMYRT

SEQ ID NO: 88 - protein, 11 aa, Homo Sapiens
LVQYLKPRKMN

SEQ ID NO: 89 - protein, 1 aa, Homo Sapiens
V

SEQ ID NO: 90 - skipped

SEQ ID NO: 91 - protein, 19 aa, Homo Sapiens
WMVSMSLKKELFSRLMNKI

SEQ ID NO: 92 - protein, 1 aa, Homo Sapiens
V

SEQ ID NO: 93 - protein, 13 aa, Homo Sapiens
PCMKQEKGERGQT

SEQ ID NO: 94 - protein, 6 aa, Homo Sapiens
LLGSSP

SEQ ID NO: 95 - protein, 56 aa, Homo Sapiens
FLMPWANVEVLELRSSWSQETIQSQLKLLPKVWASSQKAMRPWKTLLPASTSQSAR

SEQ ID NO: 96 - protein, 5 aa, Homo Sapiens
MPRPA

SEQ ID NO: 97 - protein, 30 aa, Homo Sapiens
RPAWCTTPGCLKMERNLIPPGTETSPLSLC

SEQ ID NO: 98 - protein, 22 aa, Homo Sapiens
EARPSLWETRSPSLTTTCWTCC

SEQ ID NO: 99 - protein, 29 aa, Homo Sapiens
WMRSPCSQHMWGASAPGPSSRPSWPPLST

SEQ ID NO: 100 - protein, 4 aa, Homo Sapiens
PLST

SEQ ID NO: 101 - protein, 16 aa, Homo Sapiens
CACCWQIRARAGRRRW

SEQ ID NO: 102 - protein, 42 aa, Homo Sapiens
KQQQCTRCQSMHGALVFRSLLMEESKMWVILRKPWPLGPPQS

SEQ ID NO: 103 - protein, 19 aa, Homo Sapiens
MASSTTTVHLNSRPMKFGK

SEQ ID NO: 104 - protein, 47 aa, Homo Sapiens
LRPRPGMVSAVSQSQTQAGWGAAWWASSPPGTLIFSKRRNMTVSWKR

SEQ ID NO: 105 - protein, 14 aa, Homo Sapiens
MKFCSAARRESCPL

SEQ ID NO: 106 - protein, 13 aa, Homo Sapiens
WTLPREIPSSRSI

SEQ ID NO: 107 - protein, 8 aa, Homo Sapiens
EIPSSRSI

SEQ ID NO: 108 - protein, 110 aa, Homo Sapiens
ASATGARGAQRRVAPSAPTGTAARWPRSPTAGGGQTPSGWAWGTTTTAETQIETQSPGATSLRRGSTAQSSAAPLPALRETVTATLGMGQPTVARTASPSRVPPASRGIP

SEQ ID NO: 109 - protein, 5 aa, Homo Sapiens
MEMKM

SEQ ID NO: 110 - protein, 17 aa, Homo Sapiens
LVSSERLFQKQWIILWP

SEQ ID NO: 111 - protein, 3 aa, Homo Sapiens
LWP

SEQ ID NO: 112 - protein, 10 aa, Homo Sapiens
LATKTANSIV

SEQ ID NO: 113 - protein, 26 aa, Homo Sapiens
AETSPGEMAQEERASTVSASPMRTSN

SEQ ID NO: 114 - protein, 20 aa, Homo Sapiens
EMAQEERASTVSASPMRTSN

SEQ ID NO: 115 - protein, 4 aa, Homo Sapiens
LAKF

SEQ ID NO: 116 - protein, 4 aa, Homo Sapiens
GINP

SEQ ID NO: 117 - protein, 64 aa, Homo Sapiens
MWATWKPLEASGPSRLSLLSTSVMNARGVSIRIGINLRRRPLPSTARNGRMRMARSSWRRTSAA

SEQ ID NO: 118 - protein, 54 aa, Homo Sapiens
SGPSRLSLLSTSVMNARGVSIRIGINLRRRPLPSTARNGRMRMARSSWRRTSAA

SEQ ID NO: 119 - protein, 51 aa, Homo Sapiens
SRLSLLSTSVMNARGVSIRIGINLRRRPLPSTARNGRMRMARSSWRRTSAA

SEQ ID NO: 120 - protein, 35 aa, Homo Sapiens
SIRIGINLRRRPLPSTARNGRMRMARSSWRRTSAA

SEQ ID NO: 121 - protein, 31 aa, Homo Sapiens
GINLRRRPLPSTARNGRMRMARSSWRRTSAA

SEQ ID NO: 122 - protein, 23 aa, Homo Sapiens
LPSTARNGRMRMARSSWRRTSAA

SEQ ID NO: 123 - protein, 22 aa, Homo Sapiens
KSSVSLPTPRCACFLCARRRPT

SEQ ID NO: 124 - protein, 17 aa, Homo Sapiens
MPTPRCACFLCARRRPT

SEQ ID NO: 125 - protein, 15 aa, Homo Sapiens
TPRCACFLCARRRPT

SEQ ID NO: 126 - protein, 13 aa, Homo Sapiens
RCACFLCARRRPT

SEQ ID NO: 127 - protein, 9 aa, Homo Sapiens
FLCARRRPT

SEQ ID NO: 128 - protein, 5 aa, Homo Sapiens
RRRPT

SEQ ID NO: 129 - protein, 1 aa, Homo Sapiens
T

SEQ ID NO: 130 - skipped

SEQ ID NO: 131 - protein, 15 aa, Homo Sapiens
RSWTGPARGLSSRYL

SEQ ID NO: 132 - protein, 10 aa, Homo Sapiens
PARGLSSRYL

SEQ ID NO: 133 - protein, 9 aa, Homo Sapiens
ARGLSSRYL

SEQ ID NO: 134 - protein, 8 aa, Homo Sapiens
RGLSSRYL

SEQ ID NO: 135 - protein, 5 aa, Homo Sapiens
SSRYL

SEQ ID NO: 136 - protein, 1 aa, Homo Sapiens
L

SEQ ID NO: 137 - protein, 5 aa, Homo Sapiens
LGRMR

SEQ ID NO: 138 - protein, 3 aa, Homo Sapiens
RMR

SEQ ID NO: 139 - protein, 2 aa, Homo Sapiens
SG

SEQ ID NO: 140 - protein, 38 aa, Homo Sapiens
RAKATKGSPVVGTPRSCPARPTEACARWPVLGHGILLV

SEQ ID NO: 141 - protein, 37 aa, Homo Sapiens
AKATKGSPVVGTPRSCPARPTEACARWPVLGHGILLV

SEQ ID NO: 142 - protein, 31 aa, Homo Sapiens
SPVVGTPRSCPARPTEACARWPVLGHGILLV

SEQ ID NO: 143 - protein, 27 aa, Homo Sapiens
GTPRSCPARPTEACARWPVLGHGILLV

SEQ ID NO: 144 - protein, 26 aa, Homo Sapiens
TPRSCPARPTEACARWPVLGHGILLV

SEQ ID NO: 145 - protein, 14 aa, Homo Sapiens
CARWPVLGHGILLV

SEQ ID NO: 146 - protein, 8 aa, Homo Sapiens
MGHGILLV

SEQ ID NO: 147 - protein, 25 aa, Homo Sapiens
ATITALRSTRRFIRLARATLSRTAS

SEQ ID NO: 148 - protein, 20 aa, Homo Sapiens
LRSTRRFIRLARATLSRTAS

SEQ ID NO: 149 - protein, 16 aa, Homo Sapiens
RRFIRLARATLSRTAS

SEQ ID NO: 150 - protein, 8 aa, Homo Sapiens
ATLSRTAS

SEQ ID NO: 151 - skipped

SEQ ID NO: 152 - protein, 48 aa, Homo Sapiens
VLRSRRSLWWEKRQQLPRNQPLKRSLQRRNLLQRRRSLLHKLLNLIIP

SEQ ID NO: 153 - protein, 13 aa, Homo Sapiens
CLLYSRLLFDQIL

SEQ ID NO: 154 - protein, 18 aa, Homo Sapiens
LFTPTCAKTTDSPMLSVN

SEQ ID NO: 155 - protein, 48 aa, Homo Sapiens
GVLAELWLEFPEFEVVGLTALARVLLETCVVEAECLHQPKPGAVGIVE

SEQ ID NO: 156 - protein, 25 aa, Homo Sapiens
VLLETCVVEAECLHQPKPGAVGIVE

SEQ ID NO: 157 - protein, 23 aa, Homo Sapiens
LETCVVEAECLHQPKPGAVGIVE

SEQ ID NO: 158 - protein, 13 aa, Homo Sapiens
LHQPKPGAVGIVE

SEQ ID NO: 159 - protein, 7 aa, Homo Sapiens
GAVGIVE

SEQ ID NO: 160 - protein, 34 aa, Homo Sapiens
KNDTPSVLPWLPQPYQHWSCLKVIVLRKFLNFLW

SEQ ID NO: 161 - protein, 24 aa, Homo Sapiens
VPQPYQHWSCLKVIVLRKFLNFLW

SEQ ID NO: 162 - protein, 22 aa, Homo Sapiens
QPYQHWSCLKVIVLRKFLNFLW

SEQ ID NO: 163 - protein, 9 aa, Homo Sapiens
MRKFLNFLW

SEQ ID NO: 164 - protein, 1 aa, Homo Sapiens
W

SEQ ID NO: 165 - protein, 20 aa, Homo Sapiens
CSLRNLKPGMISKRSMPLSE

SEQ ID NO: 166 - skipped

SEQ ID NO: 167 - protein, 7 aa, Homo Sapiens
RSMPLSE

SEQ ID NO: 168 - protein, 1 aa, Homo Sapiens
E

SEQ ID NO: 169 - protein, 2 aa, Homo Sapiens
AK

SEQ ID NO: 170 - protein, 2 aa, Homo Sapiens
AK

SEQ ID NO: 171 - skipped

SEQ ID NO: 172 - protein, 31 aa, Homo Sapiens
VSSAGARASSIMRIMVSSRPSETSLELLCLM

SEQ ID NO: 173 - protein, 26 aa, Homo Sapiens
ARASSIMRIMVSSRPSETSLELLCLM

SEQ ID NO: 174 - protein, 25 aa, Homo Sapiens
RASSIMRIMVSSRPSETSLELLCLM

SEQ ID NO: 175 - protein, 20 aa, Homo Sapiens
MRIMVSSRPSETSLELLCLM

SEQ ID NO: 176 - protein, 17 aa, Homo Sapiens
MVSSRPSETSLELLCLM

SEQ ID NO: 177 - protein, 11 aa, Homo Sapiens
SETSLELLCLM

SEQ ID NO: 178 - protein, 7 aa, Homo Sapiens
LELLCLM

SEQ ID NO: 179 - skipped

SEQ ID NO: 180 - protein, 8 aa, Homo Sapiens
GLKVLSGS

SEQ ID NO: 181 - protein, 21 aa, Homo Sapiens
CTALGVKPLPSRVTTIFPCTR

SEQ ID NO: 182 - protein, 7 aa, Homo Sapiens
VRLLMPV

SEQ ID NO: 183 - protein, 25 aa, Homo Sapiens
VLACCWPAGFSIGLAWTRSMKAKWR

SEQ ID NO: 184 - protein, 18 aa, Homo Sapiens
AGFSIGLAWTRSMKAKWR

SEQ ID NO: 185 - protein, 12 aa, Homo Sapiens
LAWTRSMKAKWR

SEQ ID NO: 186 - protein, 3 aa, Homo Sapiens
LVP

SEQ ID NO: 187 - protein, 30 aa, Homo Sapiens
LVMILKARNLMQKYIGSTSWARMLQITCAT

SEQ ID NO: 188 - protein, 15 aa, Homo Sapiens
LLKLLRIRPTLRDTK

SEQ ID NO: 189 - protein, 72 aa, Homo Sapiens
MAGIPDLPCIPERPCTRGSTQPLNPRLKRKRRRRFSQLLQNQLVVTRTAVPGWLNFAKCLDIILLKMCLESC

SEQ ID NO: 190 - protein, 6 aa, Homo Sapiens
NPSVST

SEQ ID NO: 191 - protein, 1 aa, Homo Sapiens
F

SEQ ID NO: 192 - protein, 3 aa, Homo Sapiens
YYL

SEQ ID NO: 193 - protein, 64 aa, Homo Sapiens
LPKRCFERQGGSLSMKKQSTITRNIGRCTELKFEWRGWQEKLATSMYLQNPNWRLSSESEVSME

SEQ ID NO: 194 - protein, 10 aa, Homo Sapiens
LSSESEVSME

SEQ ID NO: 195 - protein, 14 aa, Homo Sapiens
CSFFAFVKSSMEPL

SEQ ID NO: 196 - protein, 1 aa, Homo Sapiens
L

SEQ ID NO: 197 - protein, 1 aa, Homo Sapiens
M

SEQ ID NO: 198 - protein, 7 aa, Homo Sapiens
MHGGTPI

SEQ ID NO: 199 - protein, 2 aa, Homo Sapiens
ML

SEQ ID NO: 200 - protein, 1 aa, Homo Sapiens
V

SEQ ID NO: 201 - protein, 15 aa, Homo Sapiens
MLDLLVNTASSAWRI

SEQ ID NO: 202 - protein, 14 aa, Homo Sapiens
VDLLVNTASSAWRI

SEQ ID NO: 203 - protein, 6 aa, Homo Sapiens
SSAWRI

SEQ ID NO: 204 - skipped

SEQ ID NO: 205 - protein, 22 aa, Homo Sapiens
ENASKRQITSCGPSNCLLHEVE

SEQ ID NO: 206 - protein, 15 aa, Homo Sapiens
ITSCGPSNCLLHEVE

SEQ ID NO: 207 - protein, 9 aa, Homo Sapiens
SNCLLHEVE

SEQ ID NO: 208 - protein, 7 aa, Homo Sapiens
CLLHEVE

SEQ ID NO: 209 - protein, 3 aa, Homo Sapiens
PIL

SEQ ID NO: 210 - protein, 2 aa, Homo Sapiens
IL

SEQ ID NO: 211 - protein, 1 aa, Homo Sapiens
L

SEQ ID NO: 212 - protein, 12 aa, Homo Sapiens
TGRTRSTGLLEE

SEQ ID NO: 213 - protein, 3 aa, Homo Sapiens
LEE

SEQ ID NO: 214 - protein, 22 aa, Homo Sapiens
TKVSTMIIFLSWLVNKQYLLSN

SEQ ID NO: 215 - protein, 23 aa, Homo Sapiens
LRKGLRILALDRTSSPKETSPAL

SEQ ID NO: 216 - protein, 16 aa, Homo Sapiens
LALDRTSSPKETSPAL

SEQ ID NO: 217 - protein, 14 aa, Homo Sapiens
MDRTSSPKETSPAL

SEQ ID NO: 218 - protein, 1 aa, Homo Sapiens
L

SEQ ID NO: 219 - protein, 56 aa, Homo Sapiens
TSTDQRQSKRRSRDCWPGPRRRLLAKGTSQRRDHLSFEQELTPSPPWWRTRKLSWW

SEQ ID NO: 220 - protein, 41 aa, Homo Sapiens
WPGPRRRLLAKGTSQRRDHLSFEQELTPSPPWWRTRKLSWW

SEQ ID NO: 221 - protein, 36 aa, Homo Sapiens
MHTTWIPSSWLSSCLPCVVKWGSLTALSRERQDWDV

SEQ ID NO: 222 - protein, 20 aa, Homo Sapiens
CVVKWGSLTALSRERQDWDV

SEQ ID NO: 223 - protein, 13 aa, Homo Sapiens
LTALSRERQDWDV

SEQ ID NO: 224 - protein, 3 aa, Homo Sapiens
SHR

SEQ ID NO: 225 - protein, 72 aa, Homo Sapiens
WLSWWKLSGPITMTDTMRSAVTGVAMSWVLSLWLVSPSSKRQRLKNLPLNWVKCTLLSFLYIKIIEIIQIFL

SEQ ID NO: 226 - protein, 71 aa, Homo Sapiens
VSWWKLSGPITMTDTMRSAVTGVAMSWVLSLWLVSPSSKRQRLKNLPLNWVKCTLLSFLYIKIIEIIQIFL

SEQ ID NO: 227 - protein, 60 aa, Homo Sapiens
MTDTMRSAVTGVAMSWVLSLWLVSPSSKRQRLKNLPLNWVKCTLLSFLYIKIIEIIQIFL

SEQ ID NO: 228 - protein, 52 aa, Homo Sapiens
VTGVAMSWVLSLWLVSPSSKRQRLKNLPLNWVKCTLLSFLYIKIIEIIQIFL

SEQ ID NO: 229 - protein, 47 aa, Homo Sapiens
MSWVLSLWLVSPSSKRQRLKNLPLNWVKCTLLSFLYIKIIEIIQIFL

SEQ ID NO: 230 - protein, 43 aa, Homo Sapiens
LSLWLVSPSSKRQRLKNLPLNWVKCTLLSFLYIKIIEIIQIFL

SEQ ID NO: 231 - protein, 39 aa, Homo Sapiens
VVSPSSKRQRLKNLPLNWVKCTLLSFLYIKIIEIIQIFL

SEQ ID NO: 232 - protein, 31 aa, Homo Sapiens
QRLKNLPLNWVKCTLLSFLYIKIIEIIQIFL

SEQ ID NO: 233 - protein, 30 aa, Homo Sapiens
RLKNLPLNWVKCTLLSFLYIKIIEIIQIFL

SEQ ID NO: 234 - protein, 108 aa, Homo Sapiens
TSRASSRTSSTTRAAARPSPRWSSGIRIGLRSGRSCSLPPRAFTRASLCIAARRPSSTLAMCSLWAPCLRVQSCAAWRRSLETVASWPGHQGTMPPLSPTTLRPRRPV

SEQ ID NO: 235 - protein, 92 aa, Homo Sapiens
RPSPRWSSGIRIGLRSGRSCSLPPRAFTRASLCIAARRPSSTLAMCSLWAPCLRVQSCAAWRRSLETVASWPGHQGTMPPLSPTTLRPRRPV

SEQ ID NO: 236 - protein, 61 aa, Homo Sapiens
LCIAARRPSSTLAMCSLWAPCLRVQSCAAWRRSLETVASWPGHQGTMPPLSPTTLRPRRPV

SEQ ID NO: 237 - protein, 58 aa, Homo Sapiens
AARRPSSTLAMCSLWAPCLRVQSCAAWRRSLETVASWPGHQGTMPPLSPTTLRPRRPV

SEQ ID NO: 238 - protein, 20 aa, Homo Sapiens
GHQGTMPPLSPTTLRPRRPV

SEQ ID NO: 239 - protein, 7 aa, Homo Sapiens
LRPRRPV

SEQ ID NO: 240 - protein, 28 aa, Homo Sapiens
PAPRRLSPQPTELWLVWWLEVAELTNPS

SEQ ID NO: 241 - protein, 6 aa, Homo Sapiens
ELTNPS

SEQ ID NO: 242 - protein, 1 aa, Homo Sapiens
S

SEQ ID NO: 243 - protein, 20 aa, Homo Sapiens
GRTTNIRQRGTAGHEYGVWP

SEQ ID NO: 244 - protein, 14 aa, Homo Sapiens
RQRGTAGHEYGVWP

SEQ ID NO: 245 - protein, 8 aa, Homo Sapiens
GHEYGVWP

SEQ ID NO: 246 - protein, 7 aa, Homo Sapiens
HEYGVWP

SEQ ID NO: 247 - skipped

SEQ ID NO: 248 - protein, 69 aa, Homo Sapiens [sequence omitted]

SEQ ID NO: 249 - protein, 68 aa, Homo Sapiens
LEVATTSTSASPPPSAEMPLLAAKWVSLLPAGLDVSGEPRLCRRKRTSAEGLNKVCVYAKKKKKKKKK

SEQ ID NO: 250 - protein, 64 aa, Homo Sapiens
TTSTSASPPPSAEMPLLAAKWVSLLPAGLDVSGEPRLCRRKRTSAEGLNKVCVYAKKKKKKKKK

SEQ ID NO: 251 - protein, 52 aa, Homo Sapiens
EMPLLAAKWVSLLPAGLDVSGEPRLCRRKRTSAEGLNKVCVYAKKKKKKKKK

SEQ ID NO: 252 - protein, 38 aa, Homo Sapiens
AGLDVSGEPRLCRRKRTSAEGLNKVCVYAKKKKKKKKK

SEQ ID NO: 253 - protein, 37 aa, Homo Sapiens
GLDVSGEPRLCRRKRTSAEGLNKVCVYAKKKKKKKKK

SEQ ID NO: 254 - protein, 27 aa, Homo Sapiens
LASGEMKRLLSTAQFEGPRQKKSWRRV

SEQ ID NO: 255 - protein, 86 aa, Homo Sapiens
LGSRNTSIWVSNMTQALVSTAWTSMWCWVGQVSASQTRSAGQAALGPNTESAKRRPCAGSSRSMMGSSFLANKFPFLSKRAIKSFQ

SEQ ID NO: 256 - protein, 70 aa, Homo Sapiens
MVSTAWTSMWCWVGQVSASQTRSAGQAALGPNTESAKRRPCAGSSRSMMGSSFLANKFPFLSKRAIKSFQ

SEQ ID NO: 257 - protein, 42 aa, Homo Sapiens
MGPNTESAKRRPCAGSSRSMMGSSFLANKFPFLSKRAIKSFQ

SEQ ID NO: 258 - protein, 5 aa, Homo Sapiens
RVETD

SEQ ID NO: 259 - protein, 25 aa, Homo Sapiens
RSAPWVCLQKKLVMTLPRQRVTGRA

SEQ ID NO: 260 - protein, 21 aa, Homo Sapiens
WVCLQKKLVMTLPRQRVTGRA

SEQ ID NO: 261 - protein, 34 aa, Homo Sapiens
ILMTSSMTSTVVLWNAQPVKHKGKHFNKGSFDNW

SEQ ID NO: 262 - protein, 93 aa, Homo Sapiens
RGSTSRPVRSADVRPGKPRRAASPRAPRRVPSGPSCAAPRFGTTRRCAPAAASAWRSSGWPAFTRRWPGPSAFLWIRGGGTSPRSPCRPTCSG

SEQ ID NO: 263 - protein, 71 aa, Homo Sapiens
SPRAPRRVPSGPSCAAPRFGTTRRCAPAAASAWRSSGWPAFTRRWPGPSAFLWIRGGGTSPRSPCRPTCSG

SEQ ID NO: 264 - protein, 54 aa, Homo Sapiens
RFGTTRRCAPAAASAWRSSGWPAFTRRWPGPSAFLWIRGGGTSPRSPCRPTCSG

SEQ ID NO: 265 - protein, 43 aa, Homo Sapiens
AASAWRSSGWPAFTRRWPGPSAFLWIRGGGTSPRSPCRPTCSG

SEQ ID NO: 266 - protein, 41 aa, Homo Sapiens
SAWRSSGWPAFTRRWPGPSAFLWIRGGGTSPRSPCRPTCSG

SEQ ID NO: 267 - protein, 23 aa, Homo Sapiens
SAFLWIRGGGTSPRSPCRPTCSG

SEQ ID NO: 268 - skipped

SEQ ID NO: 269 - protein, 22 aa, Homo Sapiens
PNSSSSPGSPRPPRRETVLLKN

SEQ ID NO: 270 - protein, 9 aa, Homo Sapiens
RRETVLLKN

SEQ ID NO: 271 - protein, 2 aa, Homo Sapiens
PS

SEQ ID NO: 272 - protein, 1 aa, Homo Sapiens
S

SEQ ID NO: 273 - protein, 104 aa, Homo Sapiens
RSCPSGTSIRRRKLESSLRKRRISKPSLVSVWPVPTPGSSAYGQKEPRKPQNRMLKRKNKALLGTWNQSAVMLGLHVVCFVGTTGPGMGLHCCDFLLPGDLGLS

SEQ ID NO: 274 - protein, 95 aa, Homo Sapiens
RRRKLESSLRKRRISKPSLVSVWPVPTPGSSAYGQKEPRKPQNRMLKRKNKALLGTWNQSAVMLGLHVVCFVGTTGPGMGLHCCDFLLPGDLGLS

SEQ ID NO: 275 - protein, 81 aa, Homo Sapiens
SKPSLVSVWPVPTPGSSAYGQKEPRKPQNRMLKRKNKALLGTWNQSAVMLGLHVVCFVGTTGPGMGLHCCDFLLPGDLGLS

SEQ ID NO: 276 - protein, 71 aa, Homo Sapiens
VPTPGSSAYGQKEPRKPQNRMLKRKNKALLGTWNQSAVMLGLHVVCFVGTTGPGMGLHCCDFLLPGDLGLS

SEQ ID NO: 277 - protein, 69 aa, Homo Sapiens
TPGSSAYGQKEPRKPQNRMLKRKNKALLGTWNQSAVMLGLHVVCFVGTTGPGMGLHCCDFLLPGDLGLS

SEQ ID NO: 278 - protein, 66 aa, Homo Sapiens
SSAYGQKEPRKPQNRMLKRKNKALLGTWNQSAVMLGLHVVCFVGTTGPGMGLHCCDFLLPGDLGLS

SEQ ID NO: 279 - protein, 57 aa, Homo Sapiens
RKPQNRMLKRKNKALLGTWNQSAVMLGLHVVCFVGTTGPGMGLHCCDFLLPGDLGLS

SEQ ID NO: 280 - protein, 7 aa, Homo Sapiens
LKIMQES

SEQ ID NO: 281 - protein, 20 aa, Homo Sapiens
WSSYTGFWPEEPTPHSTRLC

SEQ ID NO: 282 - protein, 2 aa, Homo Sapiens
CL

SEQ ID NO: 283 - protein, 5 aa, Homo Sapiens
WLWGP

SEQ ID NO: 284 - protein, 43 aa, Homo Sapiens
TPNPTSAPRAGSSSVPEADGPAEATKTNPGSYSLIKKIFADKK

SEQ ID NO: 285 - protein, 27 aa, Homo Sapiens
EADGPAEATKTNPGSYSLIKKIFADKK

SEQ ID NO: 286 - protein, 24 aa, Homo Sapiens
STACESLRLIMSSPSPASGTLYLS

SEQ ID NO: 287 - protein, 4 aa, Homo Sapiens
LYLS

SEQ ID NO: 288 - protein, 14 aa, Homo Sapiens
MSTVGRCLRSPPCG

SEQ ID NO: 289 - protein, 7 aa, Homo Sapiens
LRSPPCG

SEQ ID NO: 290 - protein, 10 aa, Homo Sapiens
PTTCTGNTGT

SEQ ID NO: 291 - protein, 9 aa, Homo Sapiens
TTCTGNTGT

SEQ ID NO: 292 - protein, 9 aa, Homo Sapiens
APEPTPFRS

SEQ ID NO: 293 - protein, 8 aa, Homo Sapiens
PEPTPFRS

SEQ ID NO: 294 - protein, 53 aa, Homo Sapiens
ASAAGRLSSSSTTPRSSSRCPTGSCAVSTSHASPPRGPTPSSRCRALVRVCPK

SEQ ID NO: 295 - protein, 48 aa, Homo Sapiens
RLSSSSTTPRSSSRCPTGSCAVSTSHASPPRGPTPSSRCRALVRVCPK

SEQ ID NO: 296 - protein, 32 aa, Homo Sapiens
TGSCAVSTSHASPPRGPTPSSRCRALVRVCPK

SEQ ID NO: 297 - protein, 19 aa, Homo Sapiens
PRGPTPSSRCRALVRVCPK

SEQ ID NO: 298 - protein, 15 aa, Homo Sapiens
TPSSRCRALVRVCPK

SEQ ID NO: 299 - protein, 13 aa, Homo Sapiens
SSRCRALVRVCPK

SEQ ID NO: 300 - protein, 23 aa, Homo Sapiens
CAGCSEDTVNLRRSIATCITACT

SEQ ID NO: 301 - protein, 3 aa, Homo Sapiens
MAK

SEQ ID NO: 302 - protein, 1 aa, Homo Sapiens
L

SEQ ID NO: 303 - protein, 26 aa, Homo Sapiens
AVMLVVCITTGSTSTNTTQATLGKLV

SEQ ID NO: 304 - protein, 86 aa, Homo Sapiens
PRAPEPPAPRAIKSAGFLTCLDWASLFETLWGALALCVVIQAMSSKLCMSPCPSGGDVNGWPCRRGGVAALSLVRARVTVFTEKVC

SEQ ID NO: 305 - protein, 31 aa, Homo Sapiens
MVMEATKKQSTCCPVASGSSWSTTSRSWKCC

SEQ ID NO: 306 - protein, 63 aa, Homo Sapiens
LLAISGVSGTKGSTQLFLKLKVFTPEMKQNSIWARDALMYIKQRTTQSLLAANQTKPESSGEK

SEQ ID NO: 307 - protein, 6 aa, Homo Sapiens
PPSGKW

SEQ ID NO: 308 - protein, 5 aa, Homo Sapiens
PPRPA

SEQ ID NO: 309 - skipped

SEQ ID NO: 310 - protein, 6 aa, Homo Sapiens
MHRANL

SEQ ID NO: 311 - protein, 1 aa, Homo Sapiens
L

SEQ ID NO: 312 - protein, 9 aa, Homo Sapiens
CTSLGNTEL

SEQ ID NO: 313 - protein, 5 aa, Homo Sapiens
LVVAP

SEQ ID NO: 314 - protein, 27 aa, Homo Sapiens
CSTKVSALQLTLVCLYLVSDPLPKPGL

SEQ ID NO: 315 - protein, 1 aa, Homo Sapiens
L

SEQ ID NO: 316 - protein, 21 aa, Homo Sapiens
IVRLLLLPSSVLTSMLPLNNF

SEQ ID NO: 317 - protein, 17 aa, Homo Sapiens
SILPWLLKNKWLLSMRV

SEQ ID NO: 318 - protein, 68 aa, Homo Sapiens
LRPWSAPFLGGPDWSPEMLWVHLSLLQGTSMPLTLIFKRLGLLRCPLFLKSVFLELIPLLILKKLGVS

SEQ ID NO: 319 - protein, 65 aa, Homo Sapiens
WSAPFLGGPDWSPEMLWVHLSLLQGTSMPLTLIFKRLGLLRCPLFLKSVFLELIPLLILKKLGVS

SEQ ID NO: 320 - protein, 49 aa, Homo Sapiens
WVHLSLLQGTSMPLTLIFKRLGLLRCPLFLKSVFLELIPLLILKKLGVS

SEQ ID NO: 321 - protein, 44 aa, Homo Sapiens
MLQGTSMPLTLIFKRLGLLRCPLFLKSVFLELIPLLILKKLGVS

SEQ ID NO: 322 - protein, 10 aa, Homo Sapiens
MVMVLPAYMG

SEQ ID NO: 323 - protein, 3 aa, Homo Sapiens
LQA

SEQ ID NO: 324 - protein, 5 aa, Homo Sapiens
LEMIN

SEQ ID NO: 325 - protein, 3 aa, Homo Sapiens
WVV

SEQ ID NO: 326 - protein, 10 aa, Homo Sapiens
MVPRRVGELV

SEQ ID NO: 327 - protein, 1 aa, Homo Sapiens
V

SEQ ID NO: 328 - protein, 31 aa, Homo Sapiens
VSFLEFQCGNQCRLALRLWIAWCQLVVVSVN

SEQ ID NO: 329 - protein, 7 aa, Homo Sapiens
MVVVSVN

SEQ ID NO: 330 - protein, 49 aa, Homo Sapiens
MVTDRLGKPQLLLTQSLTRNVSMMDLMKRRSCTVFMLLLVKRDPLLPSW

SEQ ID NO: 331 - protein, 11 aa, Homo Sapiens
MVKRDPLLPSW

SEQ ID NO: 332 - protein, 3 aa, Homo Sapiens
WDL

SEQ ID NO: 333 - protein, 42 aa, Homo Sapiens
ELVTKSEAYFIGLILTSFWWHSKKWEESPPLLEMRQSLPLNY

SEQ ID NO: 334 - protein, 50 aa, Homo Sapiens
KTGRPGSPTTSLRSSNYWMIIRNVSLWEQTMWAPSRCSRSACPFAGRLWC

SEQ ID NO: 335 - protein, 45 aa, Homo Sapiens
GSPTTSLRSSNYWMIIRNVSLWEQTMWAPSRCSRSACPFAGRLWC

SEQ ID NO: 336 - protein, 33 aa, Homo Sapiens
WMIIRNVSLWEQTMWAPSRCSRSACPFAGRLWC

SEQ ID NO: 337 - protein, 25 aa, Homo Sapiens
MWEQTMWAPSRCSRSACPFAGRLWC

SEQ ID NO: 338 - protein, 53 aa, Homo Sapiens
LCSPRRTSLRSGTCCWPIRCQLLPVLVPLPHVKSLCQPRTLVSGPRRPPFSRL

SEQ ID NO: 339 - protein, 15 aa, Homo Sapiens
RTLVSGPRRPPFSRL

SEQ ID NO: 340 - protein, 5 aa, Homo Sapiens
APLKS

SEQ ID NO: 341-342 - skipped (2 entries)

SEQ ID NO: 343 - protein, 156 aa, Homo Sapiens [sequence omitted]

SEQ ID NO: 344 - protein, 150 aa, Homo Sapiens
LGWSSSRCSTMAASTTLKCLISQRKLCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 345 - protein, 142 aa, Homo Sapiens
STMAASTTLKCLISQRKLCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 346 - protein, 138 aa, Homo Sapiens
ASTTLKCLISQRKLCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 347 - protein, 138 aa, Homo Sapiens
RSTTLKCLISQRKLCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 348 - protein, 134 aa, Homo Sapiens
LKCLISQRKLCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 349 - protein, 125 aa, Homo Sapiens
LCILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 350 - protein, 123 aa, Homo Sapiens
ILASWRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 351 - protein, 119 aa, Homo Sapiens
WRVSAMLPVSVCRLATQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 352 - protein, 104 aa, Homo Sapiens
TQLLHQYPILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 353 - protein, 96 aa, Homo Sapiens
ILSSTGTNESWPCLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 354 - protein, 84 aa, Homo Sapiens
CLWRRITPSHLLKRSRPSWLIHLPLWLLPLWLLPPQLLLLLLQPQLRLKPRKSRRSRTRIWDLVSLTNHQKATNLASFICKTRK

SEQ ID NO: 355 - protein, 1 aa, Homo Sapiens
V

SEQ ID NO: 356-357 - skipped (2 entries)

SEQ ID NO: 358 - protein, 2 aa, Homo Sapiens
LS

SEQ ID NO: 359 - protein, 8 aa, Homo Sapiens
LLIGCMTP

SEQ ID NO: 360 - protein, 7 aa, Homo Sapiens
SFCTTMR

SEQ ID NO: 361 - protein, 20 aa, Homo Sapiens
GLACLQRPWPTSTLGASSAM

SEQ ID NO: 362 - protein, 10 aa, Homo Sapiens
TSTLGASSAM

SEQ ID NO: 363 - protein, 9 aa, Homo Sapiens
LVFLTKPLL

SEQ ID NO: 364 - protein, 9 aa, Homo Sapiens
VRRAGGFGN

SEQ ID NO: 365 - protein, 7 aa, Homo Sapiens
LAFQRAV

SEQ ID NO: 366 - protein, 4 aa, Homo Sapiens
LWMA

SEQ ID NO: 367 - skipped

SEQ ID NO: 368 - protein, 12 aa, Homo Sapiens
TCCSDRVCWASR

SEQ ID NO: 369 - protein, 10 aa, Homo Sapiens
CSDRVCWASR

SEQ ID NO: 370 - protein, 16 aa, Homo Sapiens
GTQLVRLALRSPCLTT

SEQ ID NO: 371 - protein, 14 aa, Homo Sapiens
QLVRLALRSPCLTT

SEQ ID NO: 372 - protein, 8 aa, Homo Sapiens
LRSPCLTT

SEQ ID NO: 373 - protein, 10 aa, Homo Sapiens
LSLMASSKLN

SEQ ID NO: 374 - protein, 4 aa, Homo Sapiens
CLTT

SEQ ID NO: 375 - protein, 3 aa, Homo Sapiens
LTT

SEQ ID NO: 376 - protein, 1 aa, Homo Sapiens
T

SEQ ID NO: 377 - protein, 50 aa, Homo Sapiens
MWNPKMRYCPPPPSQNRRVGSQSRLPCPSQSPQHNRVSLAAVFWSLDVAL

SEQ ID NO: 378 - protein, 48 aa, Homo Sapiens
DPKMRYCPPPPSQNRRVGSQSRLPCPSQSPQHNRVSLAAVFWSLDVAL

SEQ ID NO: 379 - protein, 45 aa, Homo Sapiens
MRYCPPPPSQNRRVGSQSRLPCPSQSPQHNRVSLAAVFWSLDVAL

SEQ ID NO: 380 - protein, 45 aa, Homo Sapiens; identical to SEQ ID NO: 379

SEQ ID NO: 381 - protein, 32 aa, Homo Sapiens
VGSQSRLPCPSQSPQHNRVSLAAVFWSLDVAL

SEQ ID NO: 382 - protein, 26 aa, Homo Sapiens
LPCPSQSPQHNRVSLAAVFWSLDVAL

SEQ ID NO: 383 - protein, 21 aa, Homo Sapiens
QSPQHNRVSLAAVFWSLDVAL

SEQ ID NO: 384 - protein, 3 aa, Homo Sapiens
GMM

SEQ ID NO: 385 - protein, 25 aa, Homo Sapiens
MERRSSPGPKEPKLHLMVSRVVCLK

SEQ ID NO: 386 - protein, 12 aa, Homo Sapiens
MHLMVSRVVCLK

SEQ ID NO: 387 - protein, 2 aa, Homo Sapiens
LK

SEQ ID NO: 388 - protein, 14 aa, Homo Sapiens
LICRMMKLHLENSS

SEQ ID NO: 389 - protein, 12 aa, Homo Sapiens
CRMMKLHLENSS

SEQ ID NO: 390 - protein, 27 aa, Homo Sapiens
VLLKNATIRYGRPLMLSTNRSAKSGRR

SEQ ID NO: 391 - protein, 5 aa, Homo Sapiens
KSGRR

SEQ ID NO: 392 - protein, 2 aa, Homo Sapiens
MT

SEQ ID NO: 393 - protein, 2 aa, Homo Sapiens
IN

SEQ ID NO: 394 - skipped

SEQ ID NO: 395 - protein, 4 aa, Homo Sapiens
MEKT

SEQ ID NO: 396 - protein, 1 aa, Homo Sapiens
T

SEQ ID NO: 397 - protein, 15 aa, Homo Sapiens
VANLFILSMMSSLEK

SEQ ID NO: 398 - protein, 14 aa, Homo Sapiens
ANLFILSMMSSLEK

SEQ ID NO: 399 - protein, 13 aa, Homo Sapiens
NLFILSMMSSLEK

SEQ ID NO: 400 - protein, 10 aa, Homo Sapiens
ILSMMSSLEK

SEQ ID NO: 401 - protein, 9 aa, Homo Sapiens
LSMMSSLEK

SEQ ID NO: 402 - protein, 1 aa, Homo Sapiens
C

SEQ ID NO: 403 - skipped

SEQ ID NO: 404 - protein, 52 aa, Homo Sapiens
SLNWESSWSFMVKAVVLEKPLGTRQVLKLNELMDMNHQSKNLFKVQTSNSGK

SEQ ID NO: 405 - protein, 51 aa, Homo Sapiens
LNWESSWSFMVKAVVLEKPLGTRQVLKLNELMDMNHQSKNLFKVQTSNSGK

SEQ ID NO: 406 - protein, 49 aa, Homo Sapiens
WESSWSFMVKAVVLEKPLGTRQVLKLNELMDMNHQSKNLFKVQTSNSGK

SEQ ID NO: 407 - protein, 42 aa, Homo Sapiens
MVKAVVLEKPLGTRQVLKLNELMDMNHQSKNLFKVQTSNSGK

SEQ ID NO: 408 - protein, 36 aa, Homo Sapiens
LEKPLGTRQVLKLNELMDMNHQSKNLFKVQTSNSGK

SEQ ID NO: 409 - protein, 33 aa, Homo Sapiens
PLGTRQVLKLNELMDMNHQSKNLFKVQTSNSGK

SEQ ID NO: 410 - protein, 32 aa, Homo Sapiens
LGTRQVLKLNELMDMNHQSKNLFKVQTSNSGK

SEQ ID NO: 411 - protein, 21 aa, Homo Sapiens
VMDMNHQSKNLFKVQTSNSGK

SEQ ID NO: 412 - protein, 16 aa, Homo Sapiens
HQSKNLFKVQTSNSGK

SEQ ID NO: 413 - protein, 15 aa, Homo Sapiens
QSKNLFKVQTSNSGK

SEQ ID NO: 414 - protein, 49 aa, Homo Sapiens
LDLLKQPIMIRKSFSITVSSLVMLIAWNWGTWSSIACPKAKATKSVQKK

SEQ ID NO: 415 - protein, 7 aa, Homo Sapiens
LASLTMK

SEQ ID NO: 416 - protein, 21 aa, Homo Sapiens
GESVRAPRLLQLLDLIGWSIA

SEQ ID NO: 417 - protein, 22 aa, Homo Sapiens
LVQKERSVKLVSLTNHIHKAHH

SEQ ID NO: 418 - protein, 11 aa, Homo Sapiens
VGPPRWLWPMP

SEQ ID NO: 419 - protein, 12 aa, Homo Sapiens
LWRLVLWQLEEF

SEQ ID NO: 420 - protein, 21 aa, Homo Sapiens
LGSGAPMMCRSMTFPCRITLQ

SEQ ID NO: 421 - protein, 7 aa, Homo Sapiens
ATTARSS

SEQ ID NO: 422 - protein, 77 aa, Homo Sapiens
SGCCAQALVRLPSGTLRPLLSAWQMSSSMLPRAPRTPMPLRRRTSWSVWPSPTADFPSCCPINLSALWGSPSQKKKK

SEQ ID NO: 423 - protein, 65 aa, Homo Sapiens
SGTLRPLLSAWQMSSSMLPRAPRTPMPLRRRTSWSVWPSPTADFPSCCPINLSALWGSPSQKKKK

SEQ ID NO: 424 - protein, 46 aa, Homo Sapiens
RAPRTPMPLRRRTSWSVWPSPTADFPSCCPINLSALWGSPSQKKKK

SEQ ID NO: 425 - protein, 37 aa, Homo Sapiens
RRRTSWSVWPSPTADFPSCCPINLSALWGSPSQKKKK

SEQ ID NO: 426 - protein, 26 aa, Homo Sapiens
LLTLWVKNGRVMWSESVVGTTNKVSP

SEQ ID NO: 427 - protein, 7 aa, Homo Sapiens
TTNKVSP

SEQ ID NO: 428 - protein, 5 aa, Homo Sapiens
MWMQI

SEQ ID NO: 429 - protein, 25 aa, Homo Sapiens
WAPKELAESANFSISLKKMMSASML

SEQ ID NO: 430 - protein, 3 aa, Homo Sapiens
SML

SEQ ID NO: 431 - skipped

SEQ ID NO: 432 - protein, 19 aa, Homo Sapiens
RFSVLLLHVSCSTNGGVLL

SEQ ID NO: 433 - protein, 14 aa, Homo Sapiens
LLHVSCSTNGGVLL

SEQ ID NO: 434 - protein, 9 aa, Homo Sapiens
CSTNGGVLL

SEQ ID NO: 435 - protein, 4 aa, Homo Sapiens
GVLL

SEQ ID NO: 436 - protein, 3 aa, Homo Sapiens
VLL

SEQ ID NO: 437 - protein, 2 aa, Homo Sapiens
ML

SEQ ID NO: 438 - protein, 19 aa, Homo Sapiens
VPRKIKKRLQNMLNFWPRE

SEQ ID NO: 439 - protein, 10 aa, Homo Sapiens
ENMLNFWPRE

SEQ ID NO: 440 - protein, 4 aa, Homo Sapiens
WPRE

SEQ ID NO: 441 - protein, 2 aa, Homo Sapiens
RE

SEQ ID NO: 442 - protein, 33 aa, Homo Sapiens
VRRSARNKLRRDADFPLCELLLLSLNPVRNKIF

SEQ ID NO: 443 - protein, 25 aa, Homo Sapiens
LRRDADFPLCELLLLSLNPVRNKIF

SEQ ID NO: 444 - protein, 25 aa, Homo Sapiens
MRRDADFPLCELLLLSLNPVRNKIF

SEQ ID NO: 445 - protein, 24 aa, Homo Sapiens
GRDADFPLCELLLLSLNPVRNKIF

SEQ ID NO: 446 - protein, 15 aa, Homo Sapiens
ELLLLSLNPVRNKIF

SEQ ID NO: 447 - protein, 47 aa, Homo Sapiens
MKWTMNANFVLSMRSVWPQKLLLTLWVKNGRVMWSESVVGTTNKVSP

SEQ ID NO: 448 - protein, 6 aa, Homo Sapiens
LFPFLN

SEQ ID NO: 449 - protein, 39 aa, Homo Sapiens
WRKSSVGSMSSLSLRGEFCLSQLEKAVQKISKSVPGAVL

SEQ ID NO: 450 - protein, 15 aa, Homo Sapiens
RMLILNSQSFNCKQK

SEQ ID NO: 451 - protein, 40 aa, Homo Sapiens
PLFSATGMRLAWMQLPFLDSLWRLQSCCGMSPASLTSQGL

SEQ ID NO: 452 - protein, 3 aa, Homo Sapiens
GNC

SEQ ID NO: 453 - protein, 8 aa, Homo Sapiens
MGCWMRAR

SEQ ID NO: 454 - protein, 10 aa, Homo Sapiens
SAISGSASRW

SEQ ID NO: 455 - protein, 22 aa, Homo Sapiens
WIPRSTSTSLCALPTGVAARAA

SEQ ID NO: 456 - protein, 3 aa, Homo Sapiens
RAA

SEQ ID NO: 457 - protein, 1 aa, Homo Sapiens
A

SEQ ID NO: 458 - protein, 29 aa, Homo Sapiens
VGLGLETTRRRIKSTCPSWAAGLSRFPAK

SEQ ID NO: 459 - protein, 25 aa, Homo Sapiens
LETTRRRIKSTCPSWAAGLSRFPAK

SEQ ID NO: 460 - protein, 5 aa, Homo Sapiens
VAKLM

SEQ ID NO: 461 - protein, 121 aa, Homo Sapiens
LPGDISTGTLPMRVSSISVITFICPRRLCLPPYAVAVQRLAGLGLKVWRVSDLRDSQEGKLTEIPTDGVLCHLVPTRKPRLGLGQQPNSSLEADLVVDVVSHLSKIGEDSFALNKLTAKKP

SEQ ID NO: 462 - protein, 94 aa, Homo Sapiens
MCLPPYAVAVQRLAGLGLKVWRVSDLRDSQEGKLTEIPTDGVLCHLVPTRKPRLGLGQQPNSSLEADLVVDVVSHLSKIGEDSFALNKLTAKKP

SEQ ID NO: 463 - protein, 77 aa, Homo Sapiens
LKVWRVSDLRDSQEGKLTEIPTDGVLCHLVPTRKPRLGLGQQPNSSLEADLVVDVVSHLSKIGEDSFALNKLTAKKP

SEQ ID NO: 464 - protein, 69 aa, Homo Sapiens
LRDSQEGKLTEIPTDGVLCHLVPTRKPRLGLGQQPNSSLEADLVVDVVSHLSKIGEDSFALNKLTAKKP

SEQ ID NO: 465 - protein, 27 aa, Homo Sapiens
LVVDVVSHLSKIGEDSFALNKLTAKKP

SEQ ID NO: 466 - protein, 10 aa, Homo Sapiens
AFSASTCSTA

SEQ ID NO: 467 - protein, 5 aa, Homo Sapiens
MLLEV

SEQ ID NO: 468 - protein, 5 aa, Homo Sapiens
HKYVL

SEQ ID NO: 469 - protein, 1 aa, Homo Sapiens
L

SEQ ID NO: 470 - protein, 35 aa, Homo Sapiens
WLDIIRPSESSLPIGNMNHLQPLPWSHKFVCVLKQ

SEQ ID NO: 471 - protein, 40 aa, Homo Sapiens
MSPLSTNSAMSVACQLELFTSSVKGRRKHLLTKGLGSLSC

SEQ ID NO: 472 - protein, 46 aa, Homo Sapiens
RPTPTRQANSCARSPRKTARTRCPPALAWLTRKRRRSRPWRLRKKE

SEQ ID NO: 473 - protein, 72 aa, Homo Sapiens
HLVNEDSKSHLKKRVKEANFQLIDRLLTDLFEVVVVLEEVEGAVDVEWAEEMDLILVANVNLIGIVEVIDLA

SEQ ID NO: 474 - protein, 46 aa, Homo Sapiens; identical to SEQ ID NO: 472

SEQ ID NO: 475 - protein, 78 aa, Homo Sapiens
HLVNEDSKSHLKKRVKEANFQLIDRLLTDLFEVVVVLEEVEGAVDVEWAEEMDLILVANVNLIGIVEVIDLLFHITVA

SEQ ID NO: 476 - protein, 7 aa, Homo Sapiens
CGLTGMG

SEQ ID NO: 477 - protein, 13 aa, Homo Sapiens
TSVMELRLRILPH

SEQ ID NO: 478 - protein, 2 aa, Homo Sapiens
WR

SEQ ID NO: 479 - protein, 3 aa, Homo Sapiens
LLV

SEQ ID NO: 480 - protein, 2 aa, Homo Sapiens
CW

SEQ ID NO: 481 - protein, 7 aa, Homo Sapiens
WIRRLLK

SEQ ID NO: 482 - protein, 2 aa, Homo Sapiens
MK

SEQ ID NO: 483 - protein, 17 aa, Homo Sapiens
WTSAVCPTFRSLSLQLG

SEQ ID NO: 484 - protein, 30 aa, Homo Sapiens
TTRAWATTSTRTSACARRSPLSPAKSSATR

SEQ ID NO: 485 - protein, 2 aa, Homo Sapiens
AN

SEQ ID NO: 486 - protein, 30 aa, Homo Sapiens
MLSRLLPSVLSQELRWKSPLQMLKSTILIN

SEQ ID NO: 487 - protein, 8 aa, Homo Sapiens
ATCDLCLL

SEQ ID NO: 488 - protein, 2 aa, Homo Sapiens
LL

SEQ ID NO: 489 - protein, 72 aa, Homo Sapiens; identical to SEQ ID NO: 189

SEQ ID NO: 490 - protein, 38 aa, Homo Sapiens
FSQLLQNQLVVTRTAVPGWLNFAKCLDIILLKMCLESC

SEQ ID NO: 491 - protein, 1 aa, Homo Sapiens
F

SEQ ID NO: 492 - protein, 2 aa, Homo Sapiens
FS

SEQ ID NO: 493 - protein, 13 aa, Homo Sapiens
LSLPLQPKSISAM

SEQ ID NO: 494 - protein, 66 aa, Homo Sapiens
ILLMLTSRRRSCGSPDTRKVRSSTQKKRNMRLRSSARLIRKLWTHKFYQKSKLFLSSRATCDLCLL

SEQ ID NO: 495 - protein, 29 aa, Homo Sapiens
MIRKLWTHKFYQKSKLFLSSRATCDLCLL

SEQ ID NO: 496 - protein, 14 aa, Homo Sapiens
LEVLLMQKESCWKK

SEQ ID NO: 497 - protein, 20 aa, Homo Sapiens
LVAKVMLLVIFLESALRLSK

SEQ ID NO: 498 - protein, 15 aa, Homo Sapiens
WPYTKARRKDQDHKY

SEQ ID NO: 499 - protein, 15 aa, Homo Sapiens
LSMSLIFLARKPSAV

SEQ ID NO: 500 - protein, 21 aa, Homo Sapiens
QPFRSSLVKDLSNWFQSTELK

SEQ ID NO: 501 - protein, 27 aa, Homo Sapiens
TCSLFAALTVPDACPRTRPLRNSSFET

SEQ ID NO: 502 - protein, 13 aa, Homo Sapiens
VLALVVSVQTGTV

SEQ ID NO: 503 - protein, 34 aa, Homo Sapiens
VIEILMMRRSLFSTKKQSILNAIYVTRNCIQDLA

SEQ ID NO: 504 - protein, 84 aa, Homo Sapiens
LPTASQGPRVHITVVWEQTEPMAGTSWRPITGPACMLESRLRGLMPRSCLPSGNFRLDLVKESAWEIISGWPVSSCIVCVKTLE

SEQ ID NO: 505 - protein, 75 aa, Homo Sapiens
VHITVVWEQTEPMAGTSWRPITGPACMLESRLRGLMPRSCLPSGNFRLDLVKESAWEIISGWPVSSCIVCVKTLE

SEQ ID NO: 506 - protein, 30 aa, Homo Sapiens [sequence omitted]

SEQ ID NO: 507 - protein, 8 aa, Homo Sapiens
ATLSRTAS

SEQ ID NO: 508 - protein, 6 aa, Homo Sapiens
EPRTSR

SEQ ID NO: 509 - protein, 15 aa, Homo Sapiens
RSRPSRTRSSCSSRR

SEQ ID NO: 510 - protein, 39 aa, Homo Sapiens
AGVRRPSNGAGHKVGGPKRVLNFCCTCLKTQRVMLNLRV

SEQ ID NO: 511 - protein, 16 aa, Homo Sapiens
CCTCLKTQRVMLNLRV

SEQ ID NO: 512 - protein, 12 aa, Homo Sapiens
GPTELMVGLTHT

SEQ ID NO: 513 - protein, 10 aa, Homo Sapiens
TELMVGLTHT

SEQ ID NO: 514 - protein, 19 aa, Homo Sapiens
MFLNQKRRLPRRKRYPRRN

SEQ ID NO: 515 - protein, 9 aa, Homo Sapiens
RRKRYPRRN

SEQ ID NO: 516 - protein, 60 aa, Homo Sapiens
SRCSTITWRTRATSRGMCHHKQMWQYLKPCPAHRLPTCVMPYVGIITSSLTKRKRPACQE

SEQ ID NO: 517 - protein, 42 aa, Homo Sapiens
WANMVLPMWKTLQEVELQIVKMMMTLTSLDLMMRRKVKKQRG

SEQ ID NO: 518 - protein, 2 aa, Homo Sapiens
GN

SEQ ID NO: 519 - skipped

SEQ ID NO: 520 - protein, 36 aa, Homo Sapiens
LPLALCCQWSSSQWVSSSSWWLLWAAAGPARRTIVL

SEQ ID NO: 521 - protein, 11 aa, Homo Sapiens
CCSTAACVPHS

SEQ ID NO: 522 - protein, 27 aa, Homo Sapiens
LCSPRAMQLPSSTRSGLKLVSWPRRSC

SEQ ID NO: 523 - protein, 54 aa, Homo Sapiens [sequence omitted]

SEQ ID NO: 524 - protein, 78 aa, Homo Sapiens
TAYVSAPSRPPLRRALATPRHAAAPQRSWLSSFSTPCATSPRTPGIRTMTALCSPRAMQLPSSTRSGLKLVSWPRRSC

SEQ ID NO: 525 - protein, 15 aa, Homo Sapiens
LPSFSMLMREMPGLL

SEQ ID NO: 526 - protein, 15 aa, Homo Sapiens
LPSFSMLMREMPGLL

SEQ ID NO: 527 - protein, 1 aa, Homo Sapiens
C

SEQ ID NO: 528 - protein, 6 aa, Homo Sapiens
ALLDFL

SEQ ID NO: 529 - protein, 1 aa, Homo Sapiens
V

SEQ ID NO: 530 - protein, 28 aa, Homo Sapiens
RMVTARPSRVPTAQPPVAESSLMGRELW

SEQ ID NO: 531 - protein, 14 aa, Homo Sapiens
MWMLKPTSTRLNRL

SEQ ID NO: 532 - protein, 21 aa, Homo Sapiens
ASALELGVPMLWMSWLGSPGS

SEQ ID NO: 533 - protein, 5 aa, Homo Sapiens
WHPAQ

SEQ ID NO: 534 - protein, 33 aa, Homo Sapiens
RCPPSSRCGSASRSMTSPAPPSSTANASRRTMT

SEQ ID NO: 535 - protein, 13 aa, Homo Sapiens
PSSTANASRRTMT

SEQ ID NO: 536 - protein, 8 aa, Homo Sapiens
NASRRTMT

SEQ ID NO: 537 - protein, 1 aa, Homo Sapiens
A

SEQ ID NO: 538 - protein, 8 aa, Homo Sapiens
RAREASSP

SEQ ID NO: 539 - protein, 2 aa, Homo Sapiens
SP

SEQ ID NO: 540 - protein, 30 aa, Homo Sapiens
SSPTGTTWRKSGTTPSTMSCVWLPRSTPCC

SEQ ID NO: 541 - skipped

SEQ ID NO: 542 - protein, 4 aa, Homo Sapiens
TARR

SEQ ID NO: 543 - protein, 31 aa, Homo Sapiens
RSCLRPSTPQPCTLLSRLCYPCTPLAVPLAS

SEQ ID NO: 544 - protein, 28 aa, Homo Sapiens
LRPSTPQPCTLLSRLCYPCTPLAVPLAS

SEQ ID NO: 545 - protein, 25 aa, Homo Sapiens
STPQPCTLLSRLCYPCTPLAVPLAS

SEQ ID NO: 546 - protein, 22 aa, Homo Sapiens
QPCTLLSRLCYPCTPLAVPLAS

SEQ ID NO: 547 - protein, 20 aa, Homo Sapiens
CTLLSRLCYPCTPLAVPLAS

SEQ ID NO: 548 - protein, 5 aa, Homo Sapiens
VPLAS

SEQ ID NO: 549 - protein, 20 aa, Homo Sapiens
STRGMPSPMPSCVWTWLAGT

SEQ ID NO: 550 - protein, 10 aa, Homo Sapiens
SCVWTWLAGT

SEQ ID NO: 551 - protein, 5 aa, Homo Sapiens
WLAGT

SEQ ID NO: 552 - protein, 2 aa, Homo Sapiens
GT

SEQ ID NO: 553 - skipped

SEQ ID NO: 554 - protein, 1 aa, Homo Sapiens
S

SEQ ID NO: 555 - protein, 90 aa, Homo Sapiens
SPSAATASPPRPSGKSCVTLRRSCATSPWTSSKRWPRLLPAPPWRRATSCLTARSSPLAMSGSAALRHSSSLPSWAWSPVASTKLPSTPS

SEQ ID NO: 556 - protein, 85 aa, Homo Sapiens
TASPPRPSGKSCVTLRRSCATSPWTSSKRWPRLLPAPPWRRATSCLTARSSPLAMSGSAALRHSSSLPSWAWSPVASTKLPSTPS

SEQ ID NO: 557 - protein, 80 aa, Homo Sapiens
RPSGKSCVTLRRSCATSPWTSSKRWPRLLPAPPWRRATSCLTARSSPLAMSGSAALRHSSSLPSWAWSPVASTKLPSTPS

SEQ ID NO: 558 - protein, 78 aa, Homo Sapiens
SGKSCVTLRRSCATSPWTSSKRWPRLLPAPPWRRATSCLTARSSPLAMSGSAALRHSSSLPSWAWSPVASTKLPSTPS

SEQ ID NO: 559 - protein, 62 aa, Homo Sapiens
WTSSKRWPRLLPAPPWRRATSCLTARSSPLAMSGSAALRHSSSLPSWAWSPVASTKLPSTPS

SEQ ID NO: 560 - protein, 53 aa, Homo Sapiens
VLPAPPWRRATSCLTARSSPLAMSGSAALRHSSSLPSWAWSPVASTKLPSTPS

SEQ ID NO: 561 - protein, 37 aa, Homo Sapiens
RSSPLAMSGSAALRHSSSLPSWAWSPVASTKLPSTPS

SEQ ID NO: 562 - protein, 33 aa, Homo Sapiens
MAMSGSAALRHSSSLPSWAWSPVASTKLPSTPS

SEQ ID NO: 563 - protein, 25 aa, Homo Sapiens
LRHSSSLPSWAWSPVASTKLPSTPS

SEQ ID NO: 564 - protein, 22 aa, Homo Sapiens
PPCTLALPTGCRRRSLPWHPAQ

SEQ ID NO: 565 - protein, 1 aa, Homo Sapiens
D

SEQ ID NO: 566 - protein, 7 aa, Homo Sapiens
LPPLFIP

SEQ ID NO: 567 - protein, 8 aa, Homo Sapiens
LAGIFWMT

SEQ ID NO: 568 - protein, 53 aa, Homo Sapiens
WWFSFRLTETLMLELMKLKLNKMLRLYFRLENLNGGQMKKSLSPSLEHEVCLI

SEQ ID NO: 569 - protein, 34 aa, Homo Sapiens
LGQMSRQLWMWWPTVPMIRGKKLKQHLRPPMARI

SEQ ID NO: 570 - protein, 93 aa, Homo Sapiens
LRSMSSSLQLRRLPRACWREARTTTSPSSPTMTSKTTSAGSGTCRLRRSGQNECIHPFPHPCHLEEFSQACSAPCPSSLSTAGSLFNTATFPY

SEQ ID NO: 571 - protein, 28 aa, Homo Sapiens
MVGKELLAERRRWFIEQPQQMTKNFSSP

SEQ ID NO: 572 - protein, 48 aa, Homo Sapiens
TDPTAPAGLRAELLANPVPRFRPLLANLAVTAISPIAVLPRWRWPASS

SEQ ID NO: 573 - protein, 4 aa, Homo Sapiens
LLEG

SEQ ID NO: 574 - protein, 36 aa, Homo Sapiens
SSHSCCMALKCTQTPTRLRNFWRQCCALPGTPSWQL

SEQ ID NO: 575 - protein, 5 aa, Homo Sapiens
TEVTV

SEQ ID NO: 576 - protein, 6 aa, Homo Sapiens
WSAREN

SEQ ID NO: 577 - protein, 1 aa, Homo Sapiens
W

SEQ ID NO: 578 - protein, 153 aa, Homo Sapiens
TTSSKTSTIRWWPPGRSGRWVPRSTSAGPPPACCSLAGGCFAATVHPAQTSLTPPSILLPALLLPATTCKVPRLHSVPLCFVLPWTELSAGCDPRRALPRATGCWGLGTGQRLSQAGRQQPSASLAHSDNFPRPPPASKNRVHPPLDIGEGRK

SEQ ID NO: 579 - protein, 32 aa, Homo Sapiens
RRGPAEPPVSPLSPGSPTRARAAARRCTSLRR

SEQ ID NO: 580 - protein, 36 aa, Homo Sapiens
CNLNSFHLFKKRCYHLIVFKEKWHSLLGEVLALVKE

SEQ ID NO: 581 - protein, 36 aa, Homo Sapiens
RFPARAPWRCRAPRSTCCIPATIRWPRASTTWRPGT

SEQ ID NO: 582 - protein, 31 aa, Homo Sapiens
RMCLSRMFVVATLLVTAKMTHQWKQLASLLR

SEQ ID NO: 583 - protein, 26 aa, Homo Sapiens
RMFVVATLLVTAKMTHQWKQLASLLR

SEQ ID NO: 584 - protein, 3 aa, Homo Sapiens
MDT

SEQ ID NO: 585 - protein, 23 aa, Homo Sapiens
VVATLLVTAKMTHQWKQLASLLR

SEQ ID NO: 586 - protein, 18 aa, Homo Sapiens
LVTAKMTHQWKQLASLLR

SEQ ID NO: 587 - protein, 15 aa, Homo Sapiens
RKMTHQWKQLASLLR

SEQ ID NO: 588 - protein, 11 aa, Homo Sapiens
HQWKQLASLLR

SEQ ID NO: 589 - protein, 10 aa, Homo Sapiens
QWKQLASLLR

SEQ ID NO: 590 - protein, 4 aa, Homo Sapiens
SLLR

SEQ ID NO: 591 - protein, 2 aa, Homo Sapiens
VR

SEQ ID NO: 592 - protein, 4 aa, Homo Sapiens
IQAK

SEQ ID NO: 593 - protein, 1 aa, Homo Sapiens
K

SEQ ID NO: 594 - skipped

SEQ ID NO: 595 - protein, 18 aa, Homo Sapiens
MPLYWIATRLTLHASLLS

SEQ ID NO: 596 - protein, 16 aa, Homo Sapiens
LYWIATRLTLHASLLS

SEQ ID NO: 597 - protein, 14 aa, Homo Sapiens
WIATRLTLHASLLS

SEQ ID NO: 598 - protein, 11 aa, Homo Sapiens
TRLTLHASLLS

SEQ ID NO: 599 - protein, 9 aa, Homo Sapiens
VTLHASLLS

SEQ ID NO: 600 - protein, 7 aa, Homo Sapiens
MHASLLS

SEQ ID NO: 601 - protein, 3 aa, Homo Sapiens
LLS

SEQ ID NO: 602 - protein, 2 aa, Homo Sapiens
VS

SEQ ID NO: 603 - protein, 15 aa, Homo Sapiens
MIAVLVKSWKMALNS

SEQ ID NO: 604 - protein, 12 aa, Homo Sapiens
VLVKSWKMALNS

SEQ ID NO: 605 - protein, 11 aa, Homo Sapiens
LVKSWKMALNS

SEQ ID NO: 606 - protein, 8 aa, Homo Sapiens
SWKMALNS

SEQ ID NO: 607 - protein, 3 aa, Homo Sapiens
LNS

SEQ ID NO: 608 - protein, 28 aa, Homo Sapiens
LLIWFLASPCVLRASQTIHLWVALLFVI

SEQ ID NO: 609 - protein, 28 aa, Homo Sapiens
MLIWFLASPCVLRASQTIHLWVALLFVI

SEQ ID NO: 610 - protein, 26 aa, Homo Sapiens
IWFLASPCVLRASQTIHLWVALLFVI

SEQ ID NO: 611 - protein, 19 aa, Homo Sapiens
CVLRASQTIHLWVALLFVI

SEQ ID NO: 612 - protein, 16 aa, Homo Sapiens
RASQTIHLWVALLFVI

SEQ ID NO: 613 - protein, 8 aa, Homo Sapiens
WVALLFVI

SEQ ID NO: 614 - protein, 5 aa, Homo Sapiens
LLFVI

SEQ ID NO: 615 - protein, 2 aa, Homo Sapiens
VI

SEQ ID NO: 616 - protein, 2 aa, Homo Sapiens
AI

SEQ ID NO: 617 - protein, 17 aa, Homo Sapiens
RSPSLPRKLRRLNEYYP

SEQ ID NO: 618 - protein, 11 aa, Homo Sapiens
RKLRRLNEYYP

SEQ ID NO: 619 - protein, 6 aa, Homo Sapiens
VNEYYP

SEQ ID NO: 620 - protein, 30 aa, Homo Sapiens
ASTKEPLKNLRRRLLRWERAPSSMPGSWIN

SEQ ID NO: 621 - protein, 26 aa, Homo Sapiens
EPLKNLRRRLLRWERAPSSMPGSWIN

SEQ ID NO: 622 - protein, 24 aa, Homo Sapiens
MKNLRRRLLRWERAPSSMPGSWIN

SEQ ID NO: 623 - protein, 21 aa, Homo Sapiens
LRRRLLRWERAPSSMPGSWIN

SEQ ID NO: 624 - protein, 3 aa, Homo Sapiens
WIN

SEQ ID NO: 625 - protein, 7 aa, Homo Sapiens
LRPASTM

SEQ ID NO: 626 - protein, 30 aa, Homo Sapiens
MLLLVLVNLKLVSPRMGRPESMPFWLTHWV

SEQ ID NO: 627 - protein, 28 aa, Homo Sapiens
LLVLVNLKLVSPRMGRPESMPFWLTHWV

SEQ ID NO: 628 - protein, 24 aa, Homo Sapiens
VNLKLVSPRMGRPESMPFWLTHWV

SEQ ID NO: 629 - protein, 22 aa, Homo Sapiens
LKLVSPRMGRPESMPFWLTHWV

SEQ ID NO: 630 - protein, 11 aa, Homo Sapiens
ESMPFWLTHWV

SEQ ID NO: 631 - protein, 7 aa, Homo Sapiens
FWLTHWV

SEQ ID NO: 632 - protein, 5 aa, Homo Sapiens
VTHWV

SEQ ID NO: 633 - protein, 4 aa, Homo Sapiens
THWV

SEQ ID NO: 634 - skipped

SEQ ID NO: 635 - protein, 3 aa, Homo Sapiens
HWV

SEQ ID NO: 636 - protein, 39 aa, Homo Sapiens
MSVLTKWIPLSHPTARRDMRKLLRKSALTLRKLATTPTQ

SEQ ID NO: 637 - protein, 35 aa, Homo Sapiens
TKWIPLSHPTARRDMRKLLRKSALTLRKLATTPTQ

SEQ ID NO: 638 - protein, 30 aa, Homo Sapiens
LSHPTARRDMRKLLRKSALTLRKLATTPTQ

SEQ ID NO: 639 - protein, 26 aa, Homo Sapiens
TARRDMRKLLRKSALTLRKLATTPTQ

SEQ ID NO: 640 - protein, 24 aa, Homo Sapiens
RRDMRKLLRKSALTLRKLATTPTQ

SEQ ID NO: 641 - protein, 18 aa, Homo Sapiens
MLRKSALTLRKLATTPTQ

SEQ ID NO: 642 - protein, 13 aa, Homo Sapiens
RLTLRKLATTPTQ

SEQ ID NO: 643 - protein, 7 aa, Homo Sapiens
MATTPTQ

SEQ ID NO: 644 - protein, 5 aa, Homo Sapiens
TTPTQ

SEQ ID NO: 645 - protein, 2 aa, Homo Sapiens
TQ

SEQ ID NO: 646 - protein, 99 aa, Homo Sapiens
LCQFLVGMVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 647 - protein, 97 aa, Homo Sapiens
QFLVGMVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 648 - protein, 96 aa, Homo Sapiens
FLVGMVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 649 - protein, 95 aa, Homo Sapiens
LVGMVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 650 - protein, 93 aa, Homo Sapiens
GMVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 651 - protein, 92 aa, Homo Sapiens
MVTTCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 652 - protein, 89 aa, Homo Sapiens
TCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 653 - protein, 89 aa, Homo Sapiens
KCWSQVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 654 - protein, 85 aa, Homo Sapiens
QVLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 655 - protein, 84 aa, Homo Sapiens
VLTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 656 - protein, 83 aa, Homo Sapiens
VTCLGSRDGKSPVRMAMPVEPRCLRLWTASYHQLVQLTSPCACLSRMSTKLVVLVLFLLAEWRLVFSNPVWWSPLLQSTLQRK

SEQ ID NO: 657 - protein, 80 aa, Homo Sapiens
LGSRDGKSPVRMAMPVEPRCLRLWTASYHQLVQLTSPCACLSRMSTKLVVLVLFLLAEWRLVFSNPVWWSPLLQSTLQRK

SEQ ID NO: 658 - protein, 79 aa, Homo Sapiens
GSRDGKSPVRMAMPVEPRCLRLWTASYHQLVQLTSPCACLSRMSTKLVVLVLFLLAEWRLVFSNPVWWSPLLQSTLQRK

SEQ ID NO: 659 - protein, 77 aa, Homo Sapiens
RDGKSPVRMAMPVEPRCLRLWTASYHQLVQLTSPCACLSRMSTKLVVLVLFLLAEWRLVFSNPVWWSPLLQSTLQRK

SEQ ID NO: 660 - protein, 76 aa, Homo Sapiens
DGKSPVRMAMPVEPRCLRLWTASYHQLVQLTSPCACLSRMSTKLVVLVLFLLAEWRLVFSNPVWWSPLLQSTLQRK

SEQ ID NO: 661 - protein, 73 aa, Homo Sapiens
SPVRMAMPVEPRCLRLWTASYHQLVQLTSPCACLSRMSTKLVVLVLFLLAEWRLVFSNPVWWSPLLQSTLQRK

SEQ ID NO: 662 - protein, 71 aa, Homo Sapiens
VRMAMPVEPRCLRLWTASYHQLVQLTSPCACLSRMSTKLVVLVLFLLAEWRLVFSNPVWWSPLLQSTLQRK

SEQ ID NO: 663 - protein, 70 aa, Homo Sapiens
RMAMPVEPRCLRLWTASYHQLVQLTSPCACLSRMSTKLVVLVLFLLAEWRLVFSNPVWWSPLLQSTLQRK

SEQ ID NO: 664 - protein, 67 aa, Homo Sapiens
MPVEPRCLRLWTASYHQLVQLTSPCACLSRMSTKLVVLVLFLLAEWRLVFSNPVWWSPLLQSTLQRK

SEQ ID NO: 665 - protein, 67 aa, Homo Sapiens; identical to SEQ ID NO: 664

SEQ ID NO: 666 - protein, 62 aa, Homo Sapiens
RCLRLWTASYHQLVQLTSPCACLSRMSTKLVVLVLFLLAEWRLVFSNPVWWSPLLQSTLQRK

SEQ ID NO: 667 - protein, 59 aa, Homo Sapiens
RLWTASYHQLVQLTSPCACLSRMSTKLVVLVLFLLAEWRLVFSNPVWWSPLLQSTLQRK

SEQ ID NO: 668 - protein, 59 aa, Homo Sapiens; identical to SEQ ID NO: 667

SEQ ID NO: 669 - protein, 58 aa, Homo Sapiens
LWTASYHQLVQLTSPCACLSRMSTKLVVLVLFLLAEWRLVFSNPVWWSPLLQSTLQRK

SEQ ID NO: 670 - skipped

SEQ ID NO: 671 - protein, 11 aa, Homo Sapiens
RLISTLSSLDT

SEQ ID NO: 672 - protein, 51 aa, Homo Sapiens
QLVQLTSPCACLSRMSTKLVVLVLFLLAEWRLVFSNPVWWSPLLQSTLQRK

SEQ ID NO: 673 - protein, 50 aa, Homo Sapiens
IVQLTSPCACLSRMSTKLVVLVLFLLAEWRLVFSNPVWWSPLLQSTLQRK

SEQ ID NO: 674 - protein, 48 aa, Homo Sapiens
QLTSPCACLSRMSTKLVVLVLFLLAEWRLVFSNPVWWSPLLQSTLQRK

SEQ ID NO: 675 - protein, 45 aa, Homo Sapiens
SPCACLSRMSTKLVVLVLFLLAEWRLVFSNPVWWSPLLQSTLQRK

SEQ ID NO: 676 - protein, 43 aa, Homo Sapiens
CACLSRMSTKLVVLVLFLLAEWRLVFSNPVWWSPLLQSTLQRK

SEQ ID NO: 677 - protein, 43 aa, Homo Sapiens; identical to SEQ ID NO: 676

SEQ ID NO: 678 - protein, 41 aa, Homo Sapiens
CLSRMSTKLVVLVLFLLAEWRLVFSNPVWWSPLLQSTLQRK

SEQ ID NO: 679 - protein, 40 aa, Homo Sapiens
LSRMSTKLVVLVLFLLAEWRLVFSNPVWWSPLLQSTLQRK

SEQ ID NO: 680 - protein, 33 aa, Homo Sapiens
LVVLVLFLLAEWRLVFSNPVWWSPLLQSTLQRK

SEQ ID NO: 681 - protein, 33 aa, Homo Sapiens
MVVLVLFLLAEWRLVFSNPVWWSPLLQSTLQRK

SEQ ID NO: 682 - protein, 30 aa, Homo Sapiens
MVLFLLAEWRLVFSNPVWWSPLLQSTLQRK

SEQ ID NO: 683 - protein, 24 aa, Homo Sapiens
AEWRLVFSNPVWWSPLLQSTLQRK

SEQ ID NO: 684 - protein, 24 aa, Homo Sapiens
AEWRLVFSNPVWWSPLLQSTLQRK

SEQ ID NO: 685 - protein, 23 aa, Homo Sapiens
EWRLVFSNPVWWSPLLQSTLQRK

SEQ ID NO: 686 - protein, 9 aa, Homo Sapiens
LLQSTLQRK

SEQ ID NO: 687 - protein, 5 aa, Homo Sapiens
TLQRK

SEQ ID NO: 688 - protein, 6 aa, Homo Sapiens
MSSLDT

SEQ ID NO: 689 - protein, 9 aa, Homo Sapiens
NLSKCTMKL

SEQ ID NO: 690 - skipped

SEQ ID NO: 691 - protein, 38 aa, Homo Sapiens
TMWASMSRMCLSRMFVVATLLVTAKMTHQWKQLASLLR

SEQ ID NO: 692 - protein, 37 aa, Homo Sapiens
MWASMSRMCLSRMFVVATLLVTAKMTHQWKQLASLLR

SEQ ID NO: 693 - protein, 33 aa, Homo Sapiens
MSRMCLSRMFVVATLLVTAKMTHQWKQLASLLR

SEQ ID NO: 694 - protein, 18 aa, Homo Sapiens
GPCGTQSIASLKNSLRPS

SEQ ID NO: 695 - protein, 23 aa, Homo Sapiens
LEPTIAAPFLESGSSEARSLPFR

SEQ ID NO: 696 - protein, 71 aa, Homo Sapiens
GRWTTSHTHGGNWILAARRPRRWFESTFPGRGPSSMWAKPSIRARSSSEHLLPSPSCLHLPFREMGVIKGN

SEQ ID NO: 697 - protein, 45 aa, Homo Sapiens
DHPTSILAKPTAPLNFSANFLPARSQHLRVMMDSVCLRATPLPTM

SEQ ID NO: 698 - protein, 44 aa, Homo Sapiens
HPTSILAKPTAPLNFSANFLPARSQHLRVMMDSVCLRATPLPTM

SEQ ID NO: 699 - protein, 42 aa, Homo Sapiens
TSILAKPTAPLNFSANFLPARSQHLRVMMDSVCLRATPLPTM

SEQ ID NO: 700 - protein, 39 aa, Homo Sapiens
LAKPTAPLNFSANFLPARSQHLRVMMDSVCLRATPLPTM

SEQ ID NO: 701 - protein, 18 aa, Homo Sapiens
LRVMMDSVCLRATPLPTM

SEQ ID NO: 702 - protein, 9 aa, Homo Sapiens
LRATPLPTM

SEQ ID NO: 703 - protein, 4 aa, Homo Sapiens
MPTM

SEQ ID NO: 704 - protein, 5 aa, Homo Sapiens
LLIPI

SEQ ID NO: 705 - protein, 12 aa, Homo Sapiens
QTNRPLRMQRRK

SEQ ID NO: 706 - protein, 11 aa, Homo Sapiens
KNRPLRMQRRK

SEQ ID NO: 707 - protein, 5 aa, Homo Sapiens
WWANE

SEQ ID NO: 708 - protein, 17 aa, Homo Sapiens
WLTSQLSAPCCGSISRF

SEQ ID NO: 709 - protein, 16 aa, Homo Sapiens
VTSQLSAPCCGSISRF

SEQ ID NO: 710 - protein, 11 aa, Homo Sapiens
SAPCCGSISRF

SEQ ID NO: 711 - protein, 7 aa, Homo Sapiens
CGSISRF

SEQ ID NO: 712 - protein, 25 aa, Homo Sapiens
RPFPIPTAGSSPALTSPSSGLSWAK

SEQ ID NO: 713 - protein, 21 aa, Homo Sapiens
IPTAGSSPALTSPSSGLSWAK

SEQ ID NO: 714 - protein, 18 aa, Homo Sapiens
AGSSPALTSPSSGLSWAK

SEQ ID NO: 715 - protein, 17 aa, Homo Sapiens
GSSPALTSPSSGLSWAK

SEQ ID NO: 716 - protein, 17 aa, Homo Sapiens
CSSPALTSPSSGLSWAK

SEQ ID NO: 717 - skipped

SEQ ID NO: 718 - protein, 8 aa, Homo Sapiens
SSGLSWAK

SEQ ID NO: 719 - protein, 3 aa, Homo Sapiens
WAK

SEQ ID NO: 720 - protein, 129 aa, Homo Sapiens
NCVRRWPSLMLKSLQRPNLKRTHHGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 721 - protein, 122 aa, Homo Sapiens
SLMLKSLQRPNLKRTHHGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 722 - protein, 121 aa, Homo Sapiens
LMLKSLQRPNLKRTHHGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 723 - protein, 116 aa, Homo Sapiens
LQRPNLKRTHHGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 724 - protein, 111 aa, Homo Sapiens
LKRTHHGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 725 - protein, 106 aa, Homo Sapiens
HGKRRVHGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 726 - protein, 100 aa, Homo Sapiens
HGKRSRSPRLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 727 - protein, 92 aa, Homo Sapiens
RLSGRRRKRRLPLLLRRRWMNVSRRWLLSPRPRTPSLTCPRVPLCWMNLSASTPMRTHSLWHCHISGSTLIRTAGPCGTQSIASLKNSLRPS

SEQ ID NO: 728 - protein, 60 aa, Homo Sapiens
RTPSLTCPRVPLCWMNLSASTPMRTHSLWHCHISGSTLIRTAGPCGTQSIASLKNSLRPS

SEQ ID NO: 729 - skipped

SEQ ID NO: 730 - protein, 7 aa, Homo Sapiens
MLTALMT

SEQ ID NO: 731 - protein, 3 aa, Homo Sapiens
LMT

SEQ ID NO: 732 - protein, 23 aa, Homo Sapiens
MLKPNLGLGKRPHLPYRFCSRLN

SEQ ID NO: 733 - protein, 11 aa, Homo Sapiens
HLPYRFCSRLN

SEQ ID NO: 734 - protein, 10 aa, Homo Sapiens
LPYRFCSRLN

SEQ ID NO: 735 - protein, 2 aa, Homo Sapiens
WS

SEQ ID NO: 736 - protein, 11 aa, Homo Sapiens
WLSRYRRWSWH

SEQ ID NO: 737 - protein, 27 aa, Homo Sapiens
VCLICLTGDTCPPNTSRCLYWMKLTKC

SEQ ID NO: 738 - protein, 9 aa, Homo Sapiens
LYWMKLTKC

SEQ ID NO: 739 - protein, 1 aa, Homo Sapiens
R

SEQ ID NO: 740 - protein, 12 aa, Homo Sapiens
CCQPQCLLMCLR

SEQ ID NO: 741 - protein, 8 aa, Homo Sapiens
QCLLMCLR

SEQ ID NO: 742 - protein, 5 aa, Homo Sapiens
SRRKS

SEQ ID NO: 743 - protein, 22 aa, Homo Sapiens
SSTSTWNERSGSWTHYVTCMKP

SEQ ID NO: 744 - protein, 15 aa, Homo Sapiens
LVMLNLRTWIPCSVP

SEQ ID NO: 745 - protein, 8 aa, Homo Sapiens
LERWEASL

SEQ ID NO: 746 - skipped

SEQ ID NO: 747 - protein, 5 aa, Homo Sapiens
WKERD

SEQ ID NO: 748 - protein, 2 aa, Homo Sapiens
DL

SEQ ID NO: 749 - protein, 1 aa, Homo Sapiens
L

SEQ ID NO: 750 - protein, 3 aa, Homo Sapiens
CSR

SEQ ID NO: 751 - protein, 7 aa, Homo Sapiens
QRGSPRP

SEQ ID NO: 752 - protein, 37 aa, Homo Sapiens
RSLTLAGIPLLRLISSPQKVSSELLCPVVLQLVSMRP

SEQ ID NO: 753 - protein, 35 aa, Homo Sapiens
LTLAGIPLLRLISSPQKVSSELLCPVVLQLVSMRP

SEQ ID NO: 754 - protein, 26 aa, Homo Sapiens
RLISSPQKVSSELLCPVVLQLVSMRP

SEQ ID NO: 755 - protein, 15 aa, Homo Sapiens
STSIKLLRLPWLARN

SEQ ID NO: 756 - protein, 9 aa, Homo Sapiens
MRLPWLARN

SEQ ID NO: 757 - protein, 5 aa, Homo Sapiens
WLARN

SEQ ID NO: 758 - protein, 3 aa, Homo Sapiens
MTN

SEQ ID NO: 759 - protein, 63 aa, Homo Sapiens
LVRTPFWGCPLPSAKLVPLRRGSPCTATSLTWLATLKSSCQSRRSMSSMAVLMLATSWPCRSS

SEQ ID NO: 760 - protein, 36 aa, Homo Sapiens
TSLTWLATLKSSCQSRRSMSSMAVLMLATSWPCRSS

SEQ ID NO: 761 - protein, 31 aa, Homo Sapiens
VATLKSSCQSRRSMSSMAVLMLATSWPCRSS

SEQ ID NO: 762 - protein, 19 aa, Homo Sapiens
SMSSMAVLMLATSWPCRSS

SEQ ID NO: 763 - protein, 8 aa, Homo Sapiens
TSWPCRSS

SEQ ID NO: 764 - protein, 8 aa, Homo Sapiens
TSWPCRSS

SEQ ID NO: 765 - protein, 4 aa, Homo Sapiens
CRSS

SEQ ID NO: 766 - protein, 15 aa, Homo Sapiens
TSGKPCALEQRFTTT

SEQ ID NO: 767 - protein, 8 aa, Homo Sapiens
MEQRFTTT

SEQ ID NO: 768 - skipped

SEQ ID NO: 769 - protein, 15 aa, Homo Sapiens
MGKLATLIRWSSAWT

SEQ ID NO: 770 - protein, 66 aa, Homo Sapiens
PSSSGLGSMTWTSSLPMTPAGTSRLTSWLTCTSPSSRTTQWCLSKIPLTRMTGELGRSSQPVQESR

SEQ ID NO: 771 - protein, 2 aa, Homo Sapiens
LT

SEQ ID NO: 772 - protein, 26 aa, Homo Sapiens
MAMTVPKPAGPGPKPVISEIQASSLT

SEQ ID NO: 773 - protein, 17 aa, Homo Sapiens
GPGPKPVISEIQASSLT

SEQ ID NO: 774 - protein, 15 aa, Homo Sapiens
GPKPVISEIQASSLT

SEQ ID NO: 775 - protein, 12 aa, Homo Sapiens
LTYPCSTEISSA

SEQ ID NO: 776 - protein, 27 aa, Homo Sapiens
CFCLAIPRGLRSMGVVRLYWRKRKQKS

SEQ ID NO: 777 - protein, 2 aa, Homo Sapiens
ML

SEQ ID NO: 778 - protein, 44 aa, Homo Sapiens
LLASVTSWYQKTWEQKARSLFPAHMMPPLILRQRVMTLKTSIRG

SEQ ID NO: 779 - protein, 22 aa, Homo Sapiens
LSIRVEKSTRFLPLKQKPWHLA

SEQ ID NO: 780 - protein, 10 aa, Homo Sapiens
CLKNVASGNS

SEQ ID NO: 781 - protein, 78 aa, Homo Sapiens
ASSSTPFSARTSALPFWVGGRPGLMTQVSWDQTSMPGTFPPLTSTPRSDGRWSCTSWWAPPVQLSARTWLSSSARLGS

SEQ ID NO: 782 - protein, 10 aa, Homo Sapiens
WCQRFKEPSP

SEQ ID NO: 783 - protein, 9 aa, Homo Sapiens
WTFLVIPTW

SEQ ID NO: 784 - protein, 17 aa, Homo Sapiens
LLWMYTKTFILMIFLML

SEQ ID NO: 785 - skipped

SEQ ID NO: 786 - protein, 1 aa, Homo Sapiens
M

SEQ ID NO: 787 - protein, 33 aa, Homo Sapiens
LKIQKLQGKCSQPGMVGCSLTTWRTSMVLGRNI

SEQ ID NO: 788 - protein, 19 aa, Homo Sapiens
MVGCSLTTWRTSMVLGRNI

SEQ ID NO: 789 - protein, 14 aa, Homo Sapiens
LTTWRTSMVLGRNI

SEQ ID NO: 790 - protein, 3 aa, Homo Sapiens
LKS

SEQ ID NO: 791 - protein, 10 aa, Homo Sapiens
GMQPWKTLHG

SEQ ID NO: 792 - protein, 43 aa, Homo Sapiens
SFTGLCLFSSITPKVAIILLTSSFISHNILMQFRQCVHTFFAI

SEQ ID NO: 793 - protein, 37 aa, Homo Sapiens
LFSSITPKVAIILLTSSFISHNILMQFRQCVHTFFAI

SEQ ID NO: 794 - protein, 4 aa, Homo Sapiens
WIGI

SEQ ID NO: 795 - protein, 17 aa, Homo Sapiens
LLNVYMLTLTLMGLRKS

SEQ ID NO: 796 - protein, 14 aa, Homo Sapiens
TGCRRRSPPWRPAP

SEQ ID NO: 797 - protein, 5 aa, Homo Sapiens
WRPAP

SEQ ID NO: 798 - protein, 55 aa, Homo Sapiens
MTMAPACAKLVLLGTTLPEPCFLPSSGAPDTRASWWAWARRTPTWATRPRASVAS

SEQ ID NO: 799 - protein, 41 aa, Homo Sapiens
HCPPSSRCGLASRSTTSRAPPSSTANASKRTQQMRSICCMG

SEQ ID NO: 800 - protein, 21 aa, Homo Sapiens
PSSTANASKRTQQMRSICCMG

SEQ ID NO: 801 - protein, 16 aa, Homo Sapiens
NASKRTQQMRSICCMG

SEQ ID NO: 802 - protein, 44 aa, Homo Sapiens
LLGTTLPEPCFLPSSGAPDTRASWWAWARRTPTWATRPRASVAS

SEQ ID NO: 803 - protein, 35 aa, Homo Sapiens
GFLPSSGAPDTRASWWAWARRTPTWATRPRASVAS

SEQ ID NO: 804 - protein, 23 aa, Homo Sapiens
ASWWAWARRTPTWATRPRASVAS

SEQ ID NO: 805 - protein, 6 aa, Homo Sapiens
RASVAS

SEQ ID NO: 806 - protein, 7 aa, Homo Sapiens
RRSTQCC

SEQ ID NO: 807 - skipped

SEQ ID NO: 808 - protein, 4 aa, Homo Sapiens
TERR

SEQ ID NO: 809 - protein, 61 aa, Homo Sapiens
LRPSTPRPCTWPSRPCCPSTPLGAPLALSWTLETGSPTRCPSTRATPSPTPSCVWTWLAGT

SEQ ID NO: 810 - protein, 53 aa, Homo Sapiens
CTWPSRPCCPSTPLGAPLALSWTLETGSPTRCPSTRATPSPTPSCVWTWLAGT

SEQ ID NO: 811 - protein, 49 aa, Homo Sapiens
SRPCCPSTPLGAPLALSWTLETGSPTRCPSTRATPSPTPSCVWTWLAGT

SEQ ID NO: 812 - protein, 46 aa, Homo Sapiens
CCPSTPLGAPLALSWTLETGSPTRCPSTRATPSPTPSCVWTWLAGT

SEQ ID NO: 813 - protein, 36 aa, Homo Sapiens
LALSWTLETGSPTRCPSTRATPSPTPSCVWTWLAGT

SEQ ID NO: 814 - protein, 34 aa, Homo Sapiens
MSWTLETGSPTRCPSTRATPSPTPSCVWTWLAGT

SEQ ID NO: 815 - protein, 24 aa, Homo Sapiens
TRCPSTRATPSPTPSCVWTWLAGT

SEQ ID NO: 816 - protein, 20 aa, Homo Sapiens
STRATPSPTPSCVWTWLAGT

SEQ ID NO: 817 - protein, 12 aa, Homo Sapiens
QPSCVWTWLAGT

SEQ ID NO: 818 - protein, 4 aa, Homo Sapiens
VAGT

SEQ ID NO: 819 - protein, 2 aa, Homo Sapiens
GT

SEQ ID NO: 820 - skipped

SEQ ID NO: 821 - protein, 3 aa, Homo Sapiens
TTS

SEQ ID NO: 822 - protein, 2 aa, Homo Sapiens
TS

SEQ ID NO: 823 - protein, 1 aa, Homo Sapiens
S

SEQ ID NO: 824 - protein, 90 aa, Homo Sapiens
SLSEATASPPRPSGKSCATSRRSCATSPWTSSRRWPPPHPPLLWRRATSCPMARSSPLAMSGSGVRRRCSSLPSWVWNLAASTRPPSTPS

SEQ ID NO: 825 - protein, 85 aa, Homo Sapiens
TASPPRPSGKSCATSRRSCATSPWTSSRRWPPPHPPLLWRRATSCPMARSSPLAMSGSGVRRRCSSLPSWVWNLAASTRPPSTPS

SEQ ID NO: 826 - protein, 83 aa, Homo Sapiens
SPPRPSGKSCATSRRSCATSPWTSSRRWPPPHPPLLWRRATSCPMARSSPLAMSGSGVRRRCSSLPSWVWNLAASTRPPSTPS

SEQ ID NO: 827 - protein, 78 aa, Homo Sapiens
SGKSCATSRRSCATSPWTSSRRWPPPHPPLLWRRATSCPMARSSPLAMSGSGVRRRCSSLPSWVWNLAASTRPPSTPS

SEQ ID NO: 828 - protein, 72 aa, Homo Sapiens
ESRRSCATSPWTSSRRWPPPHPPLLWRRATSCPMARSSPLAMSGSGVRRRCSSLPSWVWNLAASTRPPSTPS

SEQ ID NO: 829 - protein, 70 aa, Homo Sapiens
RRSCATSPWTSSRRWPPPHPPLLWRRATSCPMARSSPLAMSGSGVRRRCSSLPSWVWNLAASTRPPSTPS

SEQ ID NO: 830 - protein, 62 aa, Homo Sapiens
WTSSRRWPPPHPPLLWRRATSCPMARSSPLAMSGSGVRRRCSSLPSWVWNLAASTRPPSTPS

SEQ ID NO: 831 - protein, 64 aa, Homo Sapiens [sequence omitted]

SEQ ID NO: 832 - protein, 52 aa, Homo Sapiens
DPPLLWRRATSCPMARSSPLAMSGSGVRRRCSSLPSWVWNLAASTRPPSTPS

SEQ ID NO: 833 - protein, 45 aa, Homo Sapiens
RATSCPMARSSPLAMSGSGVRRRCSSLPSWVWNLAASTRPPSTPS

SEQ ID NO: 834 - protein, 39 aa, Homo Sapiens
MARSSPLAMSGSGVRRRCSSLPSWVWNLAASTRPPSTPS

SEQ ID NO: 835 - protein, 33 aa, Homo Sapiens
MAMSGSGVRRRCSSLPSWVWNLAASTRPPSTPS

SEQ ID NO: 836 - protein, 31 aa, Homo Sapiens
MSGSGVRRRCSSLPSWVWNLAASTRPPSTPS

SEQ ID NO: 837 - protein, 28 aa, Homo Sapiens
SGVRRRCSSLPSWVWNLAASTRPPSTPS

SEQ ID NO: 838 - protein, 9 aa, Homo Sapiens
STRPPSTPS

SEQ ID NO: 839 - protein, 5 aa, Homo Sapiens
PSTPS

SEQ ID NO: 840 - protein, 3 aa, Homo Sapiens
TPS

SEQ ID NO: 841 - protein, 22 aa, Homo Sapiens
PPCTRALPTGCRRRSPPWRPAP

SEQ ID NO: 842 - protein, 1 aa, Homo Sapiens
R

SEQ ID NO: 843 - protein, 9 aa, Homo Sapiens
WKSWWMKGW

SEQ ID NO: 844 - protein, 6 aa, Homo Sapiens
SPKASW

SEQ ID NO: 845 - protein, 39 aa, Homo Sapiens
TAPSALLTGPGPSPRTLLSWRIPGSRRSQPSTIKLQPRS

SEQ ID NO: 846 - protein, 34 aa, Homo Sapiens
LLTGPGPSPRTLLSWRIPGSRRSQPSTIKLQPRS

SEQ ID NO: 847 - protein, 51 aa, Homo Sapiens
QRKMTKRQQERAQPCMRTPQIRKPHPVANLPHSRSALGMWMGFEPGLRRKD

SEQ ID NO: 848 - protein, 1 aa, Homo Sapiens
G

SEQ ID NO: 849 - protein, 30 aa, Homo Sapiens
LAKKKCASSWWAWMLQGRPRSSTSLSWVRS

SEQ ID NO: 850 - protein, 69 aa, Homo Sapiens
RSQTSWGCTHYATGTGTFRPPAPPAATGSMKDWTGCPISSGTRSERDPPPSHSSCPLLYSHVANVRLVV

SEQ ID NO: 851 - protein, 8 aa, Homo Sapiens
LARSRCAF

SEQ ID NO: 852 - skipped

SEQ ID NO: 853 - protein, 7 aa, Homo Sapiens
MVLMWKQ

SEQ ID NO: 854 - protein, 23 aa, Homo Sapiens
VVKIELGLSGSITSRIPRVLFLW

SEQ ID NO: 855 - protein, 2 aa, Homo Sapiens
LW

SEQ ID NO: 856 - protein, 15 aa, Homo Sapiens
LQTNRICQMLWPSVK

SEQ ID NO: 857 - protein, 13 aa, Homo Sapiens
MLVMEPVERHACS

SEQ ID NO: 858 - protein, 11 aa, Homo Sapiens
VMEPVERHACS

SEQ ID NO: 859 - protein, 14 aa, Homo Sapiens
LRTMWQISRWMESR

SEQ ID NO: 860 - protein, 12 aa, Homo Sapiens
CGTQLGRKIMIA

SEQ ID NO: 861 - protein, 3 aa, Homo Sapiens
LIV

SEQ ID NO: 862 - protein, 13 aa, Homo Sapiens
LGTWSVQQRPKME

SEQ ID NO: 863 - protein, 5 aa, Homo Sapiens
ISQKV

SEQ ID NO: 864 - protein, 11 aa, Homo Sapiens
SCPPLQIIPLV

SEQ ID NO: 865 - protein, 30 aa, Homo Sapiens
LTWVLCRKELPLPRRDLSPLYRLSMCLLMT

SEQ ID NO: 866 - protein, 74 aa, Homo Sapiens
WQVNMTISQNRPSIWWDPLKKLWQKLISWLKSIHREGSLSSVLSLSLPLTQKASFFCVGCTRALIEDIFFLNSI

SEQ ID NO: 867 - protein, 55 aa, Homo Sapiens
QLSSYCGPLRRRSILSGTMRRKHLLRQKQAPPPGASWRSLAQWWTSSLMRDYHQF

SEQ ID NO: 868 - protein, 23 aa, Homo Sapiens
PGASWRSLAQWWTSSLMRDYHQF

SEQ ID NO: 869 - protein, 16 aa, Homo Sapiens
MAQWWTSSLMRDYHQF

SEQ ID NO: 870 - protein, 8 aa, Homo Sapiens
LMRDYHQF

SEQ ID NO: 871 - protein, 16 aa, Homo Sapiens
RPDWFWRWPSIWVRAQ

SEQ ID NO: 872 - protein, 11 aa, Homo Sapiens
WRWPSIWVRAQ

SEQ ID NO: 873 - protein, 34 aa, Homo Sapiens
MLWMVQKAWLEARKYWILVHQSKFLLVLRLWAES

SEQ ID NO: 874 - protein, 8 aa, Homo Sapiens
VLRLWAES

SEQ ID NO: 875 - protein, 15 aa, Homo Sapiens
NNLLPFMLRLQSSWK

SEQ ID NO: 876 - skipped

SEQ ID NO: 877 - protein, 10 aa, Homo Sapiens
LVVLELARLY

SEQ ID NO: 878 - protein, 5 aa, Homo Sapiens
QRPPL

SEQ ID NO: 879 - protein, 31 aa, Homo Sapiens
YCRQQGPFIQGSHTLSLYHLFLNTEEKFVMD

SEQ ID NO: 880 - protein, 12 aa, Homo Sapiens
LLINSMSKNLPN

SEQ ID NO: 881 - protein, 15 aa, Homo Sapiens
WKLLTGNDCIEYIRK

SEQ ID NO: 882 - protein, 13 aa, Homo Sapiens
LAALSLVMPETLR

SEQ ID NO: 883 - protein, 26 aa, Homo Sapiens
CLPCNKLLLDMLAFILITDVILCILL

SEQ ID NO: 884 - protein, 8 aa, Homo Sapiens
LTKMVMEL

SEQ ID NO: 885 - protein, 3 aa, Homo Sapiens
WEL

SEQ ID NO: 886 - protein, 10 aa, Homo Sapiens
RIPQKQSYRT

SEQ ID NO: 887 - protein, 6 aa, Homo Sapiens
MTSLNF

SEQ ID NO: 888 - protein, 16 aa, Homo Sapiens
LIRMAMAILVLQNFAM

SEQ ID NO: 889 - protein, 9 aa, Homo Sapiens
ILVLQNFAM

SEQ ID NO: 890 - protein, 3 aa, Homo Sapiens
ERS

SEQ ID NO: 891 - protein, 3 aa, Homo Sapiens
ERS

SEQ ID NO: 892 - protein, 2 aa, Homo Sapiens
MK

SEQ ID NO: 893 - protein, 6 aa, Homo Sapiens
MMVMVK

SEQ ID NO: 894 - protein, 6 aa, Homo Sapiens
MKSLYK

SEQ ID NO: 895 - protein, 3 aa, Homo Sapiens
LYK

SEQ ID NO: 896 - protein, 24 aa, Homo Sapiens [sequence omitted]

SEQ ID NO: 897 - protein, 23 aa, Homo Sapiens
SEDLVQNVLNFLYKIVYLPFLCL

SEQ ID NO: 898 - protein, 3 aa, Homo Sapiens
VTN

SEQ ID NO: 899 - protein, 18 aa, Homo Sapiens
MQNSKKLFHYLTKMVMEL

SEQ ID NO: 900 - protein, 9 aa, Homo Sapiens
ASSSRGTPT

SEQ ID NO: 901 - protein, 5 aa, Homo Sapiens
WKKSK

SEQ ID NO: 902 - protein, 4 aa, Homo Sapiens
MCWW

SEQ ID NO: 903 - protein, 9 aa, Homo Sapiens
WELSLPAAS

SEQ ID NO: 904 - protein, 28 aa, Homo Sapiens [sequence omitted]

SEQ ID NO: 905 - protein, 5 aa, Homo Sapiens
NQRQS

SEQ ID NO: 906 - protein, 2 aa, Homo Sapiens
AS

SEQ ID NO: 907 - protein, 3 aa, Homo Sapiens
YLA

SEQ ID NO: 908 - protein, 19 aa, Homo Sapiens
SRKALTKSGWPSRPRGCWT

SEQ ID NO: 909 - protein, 1 aa, Homo Sapiens
A

SEQ ID NO: 910 - protein, 37 aa, Homo Sapiens; identical to SEQ ID NO: 11

SEQ ID NO: 911 - protein, 27 aa, Homo Sapiens
TCVDSSAKLSWTTFQILSWKPMFHFWY

SEQ ID NO: 912 - protein, 74 aa, Homo Sapiens
APVAPAGPSGLWKPSLTGSASTPMRTSAWRCRRRTCSHAVAACVGTAVMVAILLKLGTSGQEKAWFLVASMNPM

SEQ ID NO: 913 - protein, 22 aa, Homo Sapiens
LVPLERIKIYAKNRKQEVIPFS

SEQ ID NO: 914 - protein, 28 aa, Homo Sapiens
MPVWKWRTRVCVAWYRSCSRPSPSWRPG

SEQ ID NO: 915 - protein, 157 aa, Homo Sapiens
HRPSTYLPCAKWSPQPRSQPHQQRMTRMMTLTCLAVTMRRRTRRRHSCGRSGYGSTRRRRPRSLHWWPSPPSCWMSSLGMMRRTWPSWRPVCALSSWTGWSGGLPSWCPWATVSGSYRFSVWWRTTRWGQTCWRRRSPSLRSTCRVSISQLSTRSEA

SEQ ID NO: 916 - protein, 36 aa, Homo Sapiens
GPGRHASLIPGRTSRSVASPSSQLPSPSSTSSRRMT

SEQ ID NO: 917 - protein, 20 aa, Homo Sapiens
LRSLPLFSRELLFPVLKGMM

SEQ ID NO: 918 - protein, 3 aa, Homo Sapiens
LIC

SEQ ID NO: 919 - skipped

SEQ ID NO: 920 - protein, 12 aa, Homo Sapiens
GLCTTISSCLVI

SEQ ID NO: 921 - protein, 1 aa, Homo Sapiens
G

SEQ ID NO: 922 - protein, 25 aa, Homo Sapiens
MENLLMTTVMMYVALLLMLELKVIR

SEQ ID NO: 923 - protein, 104 aa, Homo Sapiens
PPLKIGLLFKKTPSEYSHRRLRQAIEIWELNQSLFKKQSGLHLNLISILMLLRYKRSLIRLCLVLLCSFFFFFLARVSTIPIKELQYTSPESINVFLAHSVIVQ

SEQ ID NO: 924 - protein, 61 aa, Homo Sapiens
LWCSKAGHVRSSRCLLRRLASTATPRSIWLVLTSLLGRNMKISARQLIIWMSPTSKGMTSS

SEQ ID NO: 925 - protein, 2 aa, Homo Sapiens
TS

SEQ ID NO: 926 - protein, 20 aa, Homo Sapiens
MPGSRRSWSTMPLEASITGV

SEQ ID NO: 927 - protein, 17 aa, Homo Sapiens
WMPSMMLTSWKHVSTAC

SEQ ID NO: 928 - protein, 1 aa, Homo Sapiens
C

SEQ ID NO: 929 - protein, 30 aa, Homo Sapiens
RAMWILSDSLKRGTNLLSSTRQLSTPSTFL

SEQ ID NO: 930 - protein, 29 aa, Homo Sapiens
AMWILSDSLKRGTNLLSSTRQLSTPSTFL

SEQ ID NO: 931 - protein, 67 aa, Homo Sapiens
MPSTTTLSSSFPGMTTNLATATGWWTSWPTWPPRSKTPGPPAPARAQEEERDPHCWGVPATLSPPPH

SEQ ID NO: 932 - protein, 38 aa, Homo Sapiens
TWPPRSKTPGPPAPARAQEEERDPHCWGVPATLSPPPH

SEQ ID NO: 933 - protein, 124 aa, Homo Sapiens
LVVLGAWSPGLLLTLVKWILLPSMTPSLTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 934 - protein, 121 aa, Homo Sapiens
MGAWSPGLLLTLVKWILLPSMTPSLTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 935 - protein, 114 aa, Homo Sapiens
LLLTLVKWILLPSMTPSLTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 936 - protein, 105 aa, Homo Sapiens
MLPSMTPSLTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 937 - protein, 103 aa, Homo Sapiens
PSMTPSLTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 938 - protein, 97 aa, Homo Sapiens
MTSTTWFTCSNMIPPMANSMAPSRLRTGSLSSMEIPSPSSRSEIPPKSSGAMLALSTSWSPLASSPPWRRLGLICRGEPKGSSSLPPLLMPPCSSWV

SEQ ID NO: 939 - protein, 67 aa, Homo Sapiens
SSMEIPSPSSRSEIPPKSSGAMLALSTSWSPLASSPPWRRLGLICRGEPKGSSSLPPLLMPPCSSWV

SEQ ID NO: 940 - protein, 13 aa, Homo Sapiens
SRSSAMPPAPPTA

SEQ ID NO: 941 - protein, 3 aa, Homo Sapiens
PTA

SEQ ID NO: 942 - protein, 2 aa, Homo Sapiens
TA

SEQ ID NO: 943 - skipped

SEQ ID NO: 944 - protein, 13 aa, Homo Sapiens
RSSMTTLVSWKDS

SEQ ID NO: 945 - protein, 7 aa, Homo Sapiens
LVSWKDS

SEQ ID NO: 946 - protein, 47 aa, Homo Sapiens
QSMPSLPPRRLWMAPPGNCGVMAAGLSRTSSLPLLALPRLWARSSLS

SEQ ID NO: 947 - protein, 40 aa, Homo Sapiens
PRRLWMAPPGNCGVMAAGLSRTSSLPLLALPRLWARSSLS

SEQ ID NO: 948 - protein, 39 aa, Homo Sapiens
RRLWMAPPGNCGVMAAGLSRTSSLPLLALPRLWARSSLS

SEQ ID NO: 949 - protein, 32 aa, Homo Sapiens
PGNCGVMAAGLSRTSSLPLLALPRLWARSSLS

SEQ ID NO: 950 - protein, 24 aa, Homo Sapiens
AGLSRTSSLPLLALPRLWARSSLS

SEQ ID NO: 951 - protein, 22 aa, Homo Sapiens
LSRTSSLPLLALPRLWARSSLS

SEQ ID NO: 952 - protein, 22 aa, Homo Sapiens
LSRTSSLPLLALPRLWARSSLS

SEQ ID NO: 953 - protein, 22 aa, Homo Sapiens
VSRTSSLPLLALPRLWARSSLS

SEQ ID NO: 954 - protein, 16 aa, Homo Sapiens
LPLLALPRLWARSSLS

SEQ ID NO: 955 - protein, 14 aa, Homo Sapiens
LLALPRLWARSSLS

SEQ ID NO: 956 - protein, 9 aa, Homo Sapiens
RLWARSSLS

SEQ ID NO: 957 - protein, 5 aa, Homo Sapiens
RSSLS

SEQ ID NO: 958 - protein, 4 aa, Homo Sapiens
SSLS

SEQ ID NO: 959 - protein, 2 aa, Homo Sapiens
LS

SEQ ID NO: 960 - protein, 20 aa, Homo Sapiens
TGSSLAWPSVSPLPTCQWWT

SEQ ID NO: 961 - protein, 12 aa, Homo Sapiens
SVSPLPTCQWWT

SEQ ID NO: 962 - protein, 8 aa, Homo Sapiens
LPTCQWWT

SEQ ID NO: 963 - protein, 11 aa, Homo Sapiens
NLPNMMTSRRW

SEQ ID NO: 964 - protein, 10 aa, Homo Sapiens
LPNMMTSRRW

SEQ ID NO: 965 - protein, 2 aa, Homo Sapiens
CQ

SEQ ID NO: 966 - protein, 50 aa, Homo Sapiens
SPGSPPPSTRASPPRPLPEPAPGGPMWKWDLQIPFWESLKPLRGTPIAKR

SEQ ID NO: 967 - protein, 43 aa, Homo Sapiens
STRASPPRPLPEPAPGGPMWKWDLQIPFWESLKPLRGTPIAKR

SEQ ID NO: 968 - protein, 4 aa, Homo Sapiens
ATRV

SEQ ID NO: 969 - protein, 35 aa, Homo Sapiens
ASVVLIGATAVLLASAAQPGVPSVCAGRPRAGTPL

SEQ ID NO: 970 - protein, 15 aa, Homo Sapiens
VPSVCAGRPRAGTPL

SEQ ID NO: 971 - protein, 82 aa, Homo Sapiens
WFTPAASHPRAPTPWQRSSLPRGLTGQWPCPARSCVRTHGPGALMVLPAVSCPVGSMAAAQCPTPPAAPITCTAAPKTLCVT

SEQ ID NO: 972 - protein, 68 aa, Homo Sapiens
WQRSSLPRGLTGQWPCPARSCVRTHGPGALMVLPAVSCPVGSMAAAQCPTPPAAPITCTAAPKTLCVT

SEQ ID NO: 973 - protein, 39 aa, Homo Sapiens
LMVLPAVSCPVGSMAAAQCPTPPAAPITCTAAPKTLCVT

SEQ ID NO: 974 - protein, 19 aa, Homo Sapiens
SWSTSPQRYLNWQEMHQKT

SEQ ID NO: 975 - protein, 21 aa, Homo Sapiens
WILSSRLQLLVVVSFHTSTNL

SEQ ID NO: 976 - protein, 30 aa, Homo Sapiens
ALMCPSQLVKCETAALCGTERQELFLPFPL

SEQ ID NO: 977 - protein, 5 aa, Homo Sapiens
MRRSS

SEQ ID NO: 978 - protein, 5 aa, Homo Sapiens
VRRSS

SEQ ID NO: 979 - protein, 56 aa, Homo Sapiens
LCKLVGRSIRRSTQMLQSTSQSFLRSAQRGGRPCLLKRKENLKIWQKRTRPVMKEK

SEQ ID NO: 980 - protein, 49 aa, Homo Sapiens
SSSSALSIAQKSKENILACPLVMLRRNWERCGITLLQMTSSLMKRRLRS

SEQ ID NO: 981 - protein, 40 aa, Homo Sapiens
QKSKENILACPLVMLRRNWERCGITLLQMTSSLMKRRLRS

SEQ ID NO: 982 - protein, 31 aa, Homo Sapiens
CPLVMLRRNWERCGITLLQMTSSLMKRRLRS

SEQ ID NO: 983 - protein, 8 aa, Homo Sapiens
LMKRRLRS

SEQ ID NO: 984 - protein, 45 aa, Homo Sapiens
ALNIAQRSKVNTLAYPLGILQRNWVKCGLSSQPKINNHMNRKQLS

SEQ ID NO: 985 - protein, 4 aa, Homo Sapiens
DHSQ

SEQ ID NO: 986 - protein, 13 aa, Homo Sapiens
YWLLISLGLMPKM

SEQ ID NO: 987 - protein, 7 aa, Homo Sapiens
LVQMPEP

SEQ ID NO: 988 - protein, 9 aa, Homo Sapiens
WLKGVLLKL

SEQ ID NO: 989 - protein, 10 aa, Homo Sapiens
LPSSPTPTVW

SEQ ID NO: 990 - protein, 15 aa, Homo Sapiens
LVVSWKDQSPVSSNH

SEQ ID NO: 991 - protein, 1 aa, Homo Sapiens
M

SEQ ID NO: 992 - protein, 1 aa, Homo Sapiens
D

SEQ ID NO: 993 - skipped

SEQ ID NO: 994 - protein, 2 aa, Homo Sapiens
AL

SEQ ID NO: 995 - skipped

SEQ ID NO: 996 - protein, 42 aa, Homo Sapiens
LQMPSSVESWPLRMPTPSCPSWRPPCSGPSRTWRGSCVSTRS

SEQ ID NO: 997 - protein, 17 aa, Homo Sapiens
CSGPSRTWRGSCVSTRS

SEQ ID NO: 998 - protein, 13 aa, Homo Sapiens
SRTWRGSCVSTRS

SEQ ID NO: 999 - protein, 25 aa, Homo Sapiens
WTSRSPPTGSCWRARRAGWSLGCRT

SEQ ID NO: 1000 - protein, 36 aa, Homo Sapiens
MGASQAPASATAWAPALALARAPAPSAAPAPPGPWL

SEQ ID NO: 1001 - protein, 28 aa, Homo Sapiens
SATAWAPALALARAPAPSAAPAPPGPWL

SEQ ID NO: 1002 - protein, 3 aa, Homo Sapiens
PWL

SEQ ID NO: 1003 - protein, 4 aa, Homo Sapiens
LPPS

SEQ ID NO: 1004 - protein, 27 aa, Homo Sapiens
VEATWTTCSRATSTTLGGSWRLWARRS

SEQ ID NO: 1005 - protein, 39 aa, Homo Sapiens
ATCRGWWRTSRTSMRMRSISVQRWRTNLSSSRRMWMKLT

SEQ ID NO: 1006 - protein, 34 aa, Homo Sapiens
WWRTSRTSMRMRSISVQRWRTNLSSSRRMWMKLT

SEQ ID NO: 1007 - protein, 12 aa, Homo Sapiens
LSSSRRMWMKLT

SEQ ID NO: 1008 - protein, 35 aa, Homo Sapiens
GLRLRACTRSSMRSCRAWLGSTGMTCGAQRLRSLR

SEQ ID NO: 1009 - protein, 3 aa, Homo Sapiens
TAS

SEQ ID NO: 1010 - protein, 7 aa, Homo Sapiens
CAGCWMS

SEQ ID NO: 1011 - protein, 4 aa, Homo Sapiens
MSCK

SEQ ID NO: 1012 - protein, 8 aa, Homo Sapiens
GKVMASIS

SEQ ID NO: 1013 - protein, 23 aa, Homo Sapiens
MLPLKTLLMSVLYPPGILARGLC

SEQ ID NO: 1014 - protein, 21 aa, Homo Sapiens
PLKTLLMSVLYPPGILARGLC

SEQ ID NO: 1015 - protein, 83 aa, Homo Sapiens
LLLPLEPLQLLAASLLEPSLTRSRQPSGSHGFLWLLTPGLTTSLSRRHLMLTYLPLRCVTQILLCAMWTLPSHATTRELTQWV

SEQ ID NO: 1016 - protein, 71 aa, Homo Sapiens
ASLLEPSLTRSRQPSGSHGFLWLLTPGLTTSLSRRHLMLTYLPLRCVTQILLCAMWTLPSHATTRELTQWV

SEQ ID NO: 1017 - protein, 57 aa, Homo Sapiens
SGSHGFLWLLTPGLTTSLSRRHLMLTYLPLRCVTQILLCAMWTLPSHATTRELTQWV

SEQ ID NO: 1018 - protein, 52 aa, Homo Sapiens
FLWLLTPGLTTSLSRRHLMLTYLPLRCVTQILLCAMWTLPSHATTRELTQWV

SEQ ID NO: 1019 - protein, 44 aa, Homo Sapiens
LTTSLSRRHLMLTYLPLRCVTQILLCAMWTLPSHATTRELTQWV

SEQ ID NO: 1020 - protein, 12 aa, Homo Sapiens
SHATTRELTQWV

SEQ ID NO: 1021 - protein, 9 aa, Homo Sapiens
KTRELTQWV

SEQ ID NO: 1022 - skipped

SEQ ID NO: 1023 - protein, 43 aa, Homo Sapiens
VGKFCACVAPFPVNTHGRSCLICTSTEILKRLKKKSRLLLRRQ

SEQ ID NO: 1024 - protein, 39 aa, Homo Sapiens
CACVAPFPVNTHGRSCLICTSTEILKRLKKKSRLLLRRQ

SEQ ID NO: 1025 - protein, 34 aa, Homo Sapiens
PFPVNTHGRSCLICTSTEILKRLKKKSRLLLRRQ

SEQ ID NO: 1026 - protein, 28 aa, Homo Sapiens
HGRSCLICTSTEILKRLKKKSRLLLRRQ

SEQ ID NO: 1027 - protein, 23 aa, Homo Sapiens
LICTSTEILKRLKKKSRLLLRRQ

SEQ ID NO: 1028 - protein, 15 aa, Homo Sapiens
LKRLKKKSRLLLRRQ

SEQ ID NO: 1029 - protein, 9 aa, Homo Sapiens
KSRLLLRRQ

SEQ ID NO: 1030 - protein, 5 aa, Homo Sapiens
VLRRQ

SEQ ID NO: 1031 - protein, 60 aa, Homo Sapiens
RVNGLLPLLSSLLLSLRLQTGLKVYRCPLCLFSNSLLKTGALSLPRKTGLQLPLLRPLNG

SEQ ID NO: 1032 - protein, 55 aa, Homo Sapiens
VPLLSSLLLSLRLQTGLKVYRCPLCLFSNSLLKTGALSLPRKTGLQLPLLRPLNG

SEQ ID NO: 1033 - protein, 48 aa, Homo Sapiens
VLSLRLQTGLKVYRCPLCLFSNSLLKTGALSLPRKTGLQLPLLRPLNG

SEQ ID NO: 1034 - protein, 16 aa, Homo Sapiens
LPKLILMAMDTSASMS

SEQ ID NO: 1035 - protein, 17 aa, Homo Sapiens
MHQLRKKRQQFQTIRSL

SEQ ID NO: 1036 - protein, 33 aa, Homo Sapiens
DKLVWRVLSAFWESLWLMNLLLWMFWKISLKEK

SEQ ID NO: 1037 - protein, 8 aa, Homo Sapiens
WKISLKEK

SEQ ID NO: 1038 - protein, 8 aa, Homo Sapiens
MWQIKIIL

SEQ ID NO: 1039 - protein, 4 aa, Homo Sapiens
ILRL

SEQ ID NO: 1040 - protein, 1 aa, Homo Sapiens
M

SEQ ID NO: 1041 - protein, 2 aa, Homo Sapiens
AS

SEQ ID NO: 1042 - protein, 16 aa, Homo Sapiens
MWFPTQWTFLRMLPGN

SEQ ID NO: 1043 - skipped

SEQ ID NO: 1044 - protein, 45 aa, Homo Sapiens
MEVDVIWILLDFATLWLKNLAFIPAAAMDGFWGNMATQVWLCGVV

SEQ ID NO: 1045 - protein, 40 aa, Homo Sapiens
IWILLDFATLWLKNLAFIPAAAMDGFWGNMATQVWLCGVV

SEQ ID NO: 1046 - protein, 36 aa, Homo Sapiens
VDFATLWLKNLAFIPAAAMDGFWGNMATQVWLCGVV

SEQ ID NO: 1047 - protein, 30 aa, Homo Sapiens
WLKNLAFIPAAAMDGFWGNMATQVWLCGVV

SEQ ID NO: 1048 - protein, 29 aa, Homo Sapiens
VKNLAFIPAAAMDGFWGNMATQVWLCGVV

SEQ ID NO: 1049 - protein, 24 aa, Homo Sapiens
FIPAAAMDGFWGNMATQVWLCGVV

SEQ ID NO: 1050 - protein, 18 aa, Homo Sapiens
MDGFWGNMATQVWLCGVV

SEQ ID NO: 1051 - protein, 14 aa, Homo Sapiens
WGNMATQVWLCGVV

SEQ ID NO: 1052 - protein, 9 aa, Homo Sapiens
TQVWLCGVV

SEQ ID NO: 1053 - protein, 22 aa, Homo Sapiens
MIVKIGRKCIRWWLKVPMKSSS

SEQ ID NO: 1054 - protein, 17 aa, Homo Sapiens
GRKCIRWWLKVPMKSSS

SEQ ID NO: 1055 - protein, 42 aa, Homo Sapiens
TPTPSCATARTAGPGGPSSGRLSFPSSLEVLQRCASPSTRPT

SEQ ID NO: 1056 - skipped

SEQ ID NO: 1057 - protein, 36 aa, Homo Sapiens
VQTHTSTSSGCAGKLATTLLGQAWCKSTKVMGRRQW

SEQ ID NO: 1058 - protein, 49 aa, Homo Sapiens
MWAGTTPPSPKSRRDPRCLRWLHPGTRRTLCSRPAHPNLLVGRNKRFRD

SEQ ID NO: 1059 - protein, 48 aa, Homo Sapiens
LYLLELELLEQHCISCVWHCSIQMFVGTEITQSPGTNWVPMINTSSTQ

SEQ ID NO: 1060 - protein, 29 aa, Homo Sapiens
CSIQMFVGTEITQSPGTNWVPMINTSSTQ

SEQ ID NO: 1061 - protein, 60 aa, Homo Sapiens
WLIFWSLRERSNWKKQLKYGSSGHMLCGSSMKQKRQGQRISYPSSMLATIHEVIQWKDAR

SEQ ID NO: 1062 - protein, 39 aa, Homo Sapiens
LGASSLVAFRRLLLLFDTVETMGKDYLSSDLLDSMTGVF

SEQ ID NO: 1063 - protein, 13 aa, Homo Sapiens
LSSDLLDSMTGVF

SEQ ID NO: 1064 - skipped

SEQ ID NO: 1065 - protein, 2 aa, Homo Sapiens
MH

SEQ ID NO: 1066 - protein, 5 aa, Homo Sapiens
MVKLN

SEQ ID NO: 1067 - protein, 12 aa, Homo Sapiens
SFRLKLKRLNYG

SEQ ID NO: 1068 - protein, 44 aa, Homo Sapiens
ALASDLGASSLVAFRRLLLLFDTVETMGKDYLSSDLLDSMTGVF

SEQ ID NO: 1069 - protein, 5 aa, Homo Sapiens
FRPGR

SEQ ID NO: 1070 - protein, 2 aa, Homo Sapiens
VN

SEQ ID NO: 1071 - protein, 6 aa, Homo Sapiens
MLKQRQ

SEQ ID NO: 1072 - protein, 8 aa, Homo Sapiens
RFPLGALK

SEQ ID NO: 1073 - protein, 2 aa, Homo Sapiens
LK

SEQ ID NO: 1074 - protein, 1 aa, Homo Sapiens
S

SEQ ID NO: 1075 - protein, 11 aa, Homo Sapiens
LEVVARFHRKK

SEQ ID NO: 1076 - protein, 47 aa, Homo Sapiens
DDLSLVKNEKLNLELGQKNSPMFTSRILEKTWMMSALRISLASLGLP

SEQ ID NO: 1077 - protein, 20 aa, Homo Sapiens
LEKTWMMSALRISLASLGLP

SEQ ID NO: 1078 - protein, 3 aa, Homo Sapiens
LDL

SEQ ID NO: 1079 - protein, 19 aa, Homo Sapiens
VELRKRWNGRRNLSANLNR

SEQ ID NO: 1080 - protein, 5 aa, Homo Sapiens
VLIFM

SEQ ID NO: 1081 - protein, 18 aa, Homo Sapiens
LVLYVSPPQKKPLKQLQK

SEQ ID NO: 1082 - protein, 36 aa, Homo Sapiens
LVTSFHVRWFVMKMVPRAMDLYTLRRRKQLKELLKK

SEQ ID NO: 1083 - protein, 26 aa, Homo Sapiens
VMKMVPRAMDLYTLRRRKQLKELLKK

SEQ ID NO: 1084 - protein, 5 aa, Homo Sapiens
SPTCV

SEQ ID NO: 1085 - protein, 28 aa, Homo Sapiens
RRYEMLAMSLTSASPQCRRERSGPSGQC

SEQ ID NO: 1086 - protein, 32 aa, Homo Sapiens
LRWSPTILSTATSVRIAGMQTSQKISYPPVRV

SEQ ID NO: 1087 - protein, 26 aa, Homo Sapiens
ILSTATSVRIAGMQTSQKISYPPVRV

SEQ ID NO: 1088 - protein, 6 aa, Homo Sapiens
YPPVRV

SEQ ID NO: 1089 - protein, 22 aa, Homo Sapiens
MATASGALSSIWRVSLKRLSWS

SEQ ID NO: 1090 - protein, 18 aa, Homo Sapiens
SGALSSIWRVSLKRLSWS

SEQ ID NO: 1091 - protein, 13 aa, Homo Sapiens
RLVFPLSMNWTRT

SEQ ID NO: 1092 - protein, 8 aa, Homo Sapiens
LSMNWTRT

SEQ ID NO: 1093 - protein, 8 aa, Homo Sapiens
MSMNWTRT

SEQ ID NO: 1094 - protein, 43 aa, Homo Sapiens
ARPRSEGRRGGYCPQEHPPCPSCPSAPPTCTCHTDHICRHLEL

SEQ ID NO: 1095 - protein, 31 aa, Homo Sapiens
LWSVLLIGLSPKLMISWPMRQREPKWWVPSP

SEQ ID NO: 1096 - protein, 31 aa, Homo Sapiens
TSRPSSKALLQKWELENPAVTGWEMREQATS

SEQ ID NO: 1097 - protein, 2 aa, Homo Sapiens
MW

SEQ ID NO: 1098 - protein, 12 aa, Homo Sapiens
SSLLRATPRQLS

SEQ ID NO: 1099 - protein, 39 aa, Homo Sapiens
STTCNYLRNSAAWRPLPATPQKPPPWVPWRPPSSAAVGP

SEQ ID NO: 1100 - protein, 19 aa, Homo Sapiens
QKPPPWVPWRPPSSAAVGP

SEQ ID NO: 1101 - protein, 10 aa, Homo Sapiens
DTAHVPPSLL

SEQ ID NO: 1102 - protein, 7 aa, Homo Sapiens
HVPPSLL

SEQ ID NO: 1103 - protein, 66 aa, Homo Sapiens
LGSSRMLIWCLRHSSARHLMSMKLGRSWERRERTSRLSAKSRIMRGFGGLMKSWRPVMGSWWLVVI

SEQ ID NO: 1104 - protein, 6 aa, Homo Sapiens
LARMYS

SEQ ID NO: 1105 - skipped

SEQ ID NO: 1106 - protein, 58 aa, Homo Sapiens
QMCLTRACCVTCCGLTLTRTCRAGARTTVASLLPLEPRWWPSSSTSTTWTSSAEHTRW

SEQ ID NO: 1107 - protein, 72 aa, Homo Sapiens
ISPCWELRSVYGAQATGARTQRQQPSAMLSSIANAMCGTRRRNIPSWQKPQHWFFSTCVSGGMNAQICLTLL

SEQ ID NO: 1108 - protein, 4 aa, Homo Sapiens
RSLD

SEQ ID NO: 1109 - protein, 8 aa, Homo Sapiens
ARQCGARM

SEQ ID NO: 1110 - protein, 31 aa, Homo Sapiens
TSLSSSTLRTAPAASPSQRIMGTFARTAFRW

SEQ ID NO: 1111 - protein, 19 aa, Homo Sapiens
AASPSQRIMGTFARTAFRW

SEQ ID NO: 1112 - protein, 14 aa, Homo Sapiens
QRIMGTFARTAFRW

SEQ ID NO: 1113 - protein, 21 aa, Homo Sapiens
AGFIKLNMQWKLLNKVQPQLV

SEQ ID NO: 1114 - protein, 3 aa, Homo Sapiens
WLH

SEQ ID NO: 1115 - protein, 41 aa, Homo Sapiens
MVSQLRGLLLMLDCYVILCVRSVWIPDLYSIDHCLCLVLYL

SEQ ID NO: 1116 - protein, 18 aa, Homo Sapiens
WIPDLYSIDHCLCLVLYL

SEQ ID NO: 1117 - protein, 14 aa, Homo Sapiens
LYSIDHCLCLVLYL

SEQ ID NO: 1118 - protein, 53 aa, Homo Sapiens
VSLLLVMMIWALTFSKPVHLLTILTAEPCPLEPVPNQLVLTWRDICLNLWSVI

SEQ ID NO: 1119 - protein, 16 aa, Homo Sapiens
LTATLPFFHPRVGSTK

SEQ ID NO: 1120 - protein, 5 aa, Homo Sapiens
VALHQ

SEQ ID NO: 1121 - protein, 5 aa, Homo Sapiens
WIPAQ

SEQ ID NO: 1122 - protein, 14 aa, Homo Sapiens
MLEKILQLLLLILD

SEQ ID NO: 1123 - protein, 9 aa, Homo Sapiens
LQLLLLILD

SEQ ID NO: 1124 - protein, 5 aa, Homo Sapiens
LLILD

SEQ ID NO: 1125 - protein, 12 aa, Homo Sapiens
MDAAVFMETVLR

SEQ ID NO: 1126 - protein, 14 aa, Homo Sapiens
VREMCTLGTHSGSA

SEQ ID NO: 1127 - protein, 8 aa, Homo Sapiens
PCTAGARR

SEQ ID NO: 1128 - protein, 2 aa, Homo Sapiens
AT

SEQ ID NO: 1129 - protein, 5 aa, Homo Sapiens
VSVMV

SEQ ID NO: 1130 - protein, 11 aa, Homo Sapiens
LQRVLTLPPRR

SEQ ID NO: 1131 - protein, 35 aa, Homo Sapiens
RRPMQILGGWTTKFRKLRNLWSFLSPILNIMKRWV

SEQ ID NO: 1132 - protein, 29 aa, Homo Sapiens
MGGWTTKFRKLRNLWSFLSPILNIMKRWV

SEQ ID NO: 1133 - protein, 3 aa, Homo Sapiens
MPC

SEQ ID NO: 1134 - protein, 21 aa, Homo Sapiens
WLQISRHSRVNSLYRLPGVQR

SEQ ID NO: 1135 - protein, 1 aa, Homo Sapiens
L

SEQ ID NO: 1136 - protein, 6 aa, Homo Sapiens
QSMTRG

SEQ ID NO: 1137 - protein, 18 aa, Homo Sapiens
RGRPSWPGPVPHRLRPPS

SEQ ID NO: 1138 - protein, 10 aa, Homo Sapiens
LLLTSSPFWP

SEQ ID NO: 1139 - protein, 24 aa, Homo Sapiens
VIQRPAATLRTTWALSHWLMTVKC

SEQ ID NO: 1140 - protein, 2 aa, Homo Sapiens
KE

SEQ ID NO: 1141 - protein, 8 aa, Homo Sapiens
ALHGPSPK

SEQ ID NO: 1142 - protein, 28 aa, Homo Sapiens
WRQDWCLCTLIPRGTRKHCIWVLSCCGS

SEQ ID NO: 1143 - protein, 6 aa, Homo Sapiens
WWKYSF

SEQ ID NO: 1144 - protein, 21 aa, Homo Sapiens
LPKEMVSLSFMKTLSVNLNTG

SEQ ID NO: 1145 - protein, 30 aa, Homo Sapiens
TTKMLCGFWAVLTSRIYQCLSSRREPSRWG

SEQ ID NO: 1146 - protein, 22 aa, Homo Sapiens
WAVLTSRIYQCLSSRREPSRWG

SEQ ID NO: 1147 - protein, 56 aa, Homo Sapiens
LGTISVIVLWVFLRCSKPRNRKLIQEKLLKTLPNTSQTMNVLKKLKLLVLVLLMST

SEQ ID NO: 1148 - protein, 5 aa, Homo Sapiens
LYQNN

SEQ ID NO: 1149 - protein, 19 aa, Homo Sapiens
LLEAFSPLQRSELDATVGL

SEQ ID NO: 1150 - protein, 34 aa, Homo Sapiens
LRLSSLIHSIKLSEEILTPSGSPNQSTSTGRCVG

SEQ ID NO: 1151 - protein, 46 aa, Homo Sapiens
ERAVALERATSSTTLLVALAGQLGEGAILSSSTVTANISKVCKIHT

SEQ ID NO: 1152 - protein, 40 aa, Homo Sapiens
ERATSSTTLLVALAGQLGEGAILSSSTVTANISKVCKIHT

SEQ ID NO: 1153 - protein, 31 aa, Homo Sapiens
MVALAGQLGEGAILSSSTVTANISKVCKIHT

SEQ ID NO: 1154 - protein, 19 aa, Homo Sapiens
ILSSSTVTANISKVCKIHT

SEQ ID NO: 1155 - protein, 10 aa, Homo Sapiens
NISKVCKIHT

SEQ ID NO: 1156 - protein, 42 aa, Homo Sapiens
LAFPWHPKKHSVPLLLVSARRRLCWQQSRLCRQHPTCPSRLT

SEQ ID NO: 1157 - protein, 39 aa, Homo Sapiens
GAGVAAVDGAGAEAAELAEARPRIRSGCPSPSWAAWSRT

SEQ ID NO: 1158 - protein, 33 aa, Homo Sapiens
VDGAGAEAAELAEARPRIRSGCPSPSWAAWSRT

SEQ ID NO: 1159 - protein, 24 aa, Homo Sapiens
ELAEARPRIRSGCPSPSWAAWSRT

SEQ ID NO: 1160 - protein, 19 aa, Homo Sapiens
RPRIRSGCPSPSWAAWSRT

SEQ ID NO: 1161 - protein, 15 aa, Homo Sapiens
RSGCPSPSWAAWSRT

SEQ ID NO: 1162 - protein, 7 aa, Homo Sapiens
WAAWSRT

SEQ ID NO: 1163 - protein, 6 aa, Homo Sapiens
AAWSRT

SEQ ID NO: 1164 - protein, 29 aa, Homo Sapiens
WRRSISSPCLLRNQRSLISSWGPLSRMRF

SEQ ID NO: 1165 - protein, 13 aa, Homo Sapiens
MISSWGPLSRMRF

SEQ ID NO: 1166 - protein, 7 aa, Homo Sapiens
PLSRMRF

SEQ ID NO: 1167 - skipped

SEQ ID NO: 1168 - protein, 64 aa, Homo Sapiens
SAPGSRHLLLSGTTMATSVWVLSAPRRWPPPSVGPSSWPSSPSSPCAEATGGTRSASPTLSLAR

SEQ ID NO: 1169 - protein, 61 aa, Homo Sapiens
GSRHLLLSGTTMATSVWVLSAPRRWPPPSVGPSSWPSSPSSPCAEATGGTRSASPTLSLAR

SEQ ID NO: 1170 - protein, 57 aa, Homo Sapiens
LLLSGTTMATSVWVLSAPRRWPPPSVGPSSWPSSPSSPCAEATGGTRSASPTLSLAR

SEQ ID NO: 1171 - protein, 55 aa, Homo Sapiens
LSGTTMATSVWVLSAPRRWPPPSVGPSSWPSSPSSPCAEATGGTRSASPTLSLAR

SEQ ID NO: 1172 - protein, 42 aa, Homo Sapiens
SAPRRWPPPSVGPSSWPSSPSSPCAEATGGTRSASPTLSLAR

SEQ ID NO: 1173 - protein, 35 aa, Homo Sapiens
PPSVGPSSWPSSPSSPCAEATGGTRSASPTLSLAR

SEQ ID NO: 1174 - protein, 34 aa, Homo Sapiens
PSVGPSSWPSSPSSPCAEATGGTRSASPTLSLAR

SEQ ID NO: 1175 - protein, 33 aa, Homo Sapiens
SVGPSSWPSSPSSPCAEATGGTRSASPTLSLAR

SEQ ID NO: 1176 - protein, 25 aa, Homo Sapiens
SSPSSPCAEATGGTRSASPTLSLAR

SEQ ID NO: 1177 - protein, 19 aa, Homo Sapiens
CAEATGGTRSASPTLSLAR

SEQ ID NO: 1178 - protein, 12 aa, Homo Sapiens
TRSASPTLSLAR

SEQ ID NO: 1179 - protein, 8 aa, Homo Sapiens
SPTLSLAR

SEQ ID NO: 1180 - protein, 6 aa, Homo Sapiens
TLSLAR

SEQ ID NO: 1181 - protein, 6 aa, Homo Sapiens
QLSLAR

SEQ ID NO: 1182 - protein, 3 aa, Homo Sapiens
LAR

SEQ ID NO: 1183 - protein, 1 aa, Homo Sapiens
R

SEQ ID NO: 1184 - protein, 27 aa, Homo Sapiens
AALCWYASSLHPGALASSPHLCLRSCS

SEQ ID NO: 1185 - protein, 25 aa, Homo Sapiens
LCWYASSLHPGALASSPHLCLRSCS

SEQ ID NO: 1186 - protein, 18 aa, Homo Sapiens
LHPGALASSPHLCLRSCS

SEQ ID NO: 1187 - protein, 17 aa, Homo Sapiens
DPGALASSPHLCLRSCS

SEQ ID NO: 1188 - protein, 15 aa, Homo Sapiens
GALASSPHLCLRSCS

SEQ ID NO: 1189 - protein, 14 aa, Homo Sapiens
ALASSPHLCLRSCS

SEQ ID NO: 1190 - protein, 8 aa, Homo Sapiens
HLCLRSCS

SEQ ID NO: 1191 - protein, 8 aa, Homo Sapiens
DLCLRSCS

SEQ ID NO: 1192 - protein, 7 aa, Homo Sapiens
LCLRSCS

SEQ ID NO: 1193 - protein, 5 aa, Homo Sapiens
LRSCS

SEQ ID NO: 1194 - protein, 1 aa, Homo Sapiens
S

SEQ ID NO: 1195 - protein, 34 aa, Homo Sapiens
VVSMTATPQPGAALPPWATSPRPPLMPFLRPTAT

SEQ ID NO: 1196 - protein, 33 aa, Homo Sapiens
VSMTATPQPGAALPPWATSPRPPLMPFLRPTAT

SEQ ID NO: 1197 - protein, 28 aa, Homo Sapiens
TPQPGAALPPWATSPRPPLMPFLRPTAT

SEQ ID NO: 1198 - protein, 26 aa, Homo Sapiens
QPGAALPPWATSPRPPLMPFLRPTAT

SEQ ID NO: 1199 - protein, 24 aa, Homo Sapiens
GAALPPWATSPRPPLMPFLRPTAT

SEQ ID NO: 1200 - protein, 19 aa, Homo Sapiens
PWATSPRPPLMPFLRPTAT

SEQ ID NO: 1201 - protein, 18 aa, Homo Sapiens
WATSPRPPLMPFLRPTAT

SEQ ID NO: 1202 - protein, 16 aa, Homo Sapiens
TSPRPPLMPFLRPTAT

SEQ ID NO: 1203 - protein, 15 aa, Homo Sapiens
SPRPPLMPFLRPTAT

SEQ ID NO: 1204 - protein, 11 aa, Homo Sapiens
PLMPFLRPTAT

SEQ ID NO: 1205 - protein, 10 aa, Homo Sapiens
LMPFLRPTAT

SEQ ID NO: 1206 - protein, 7 aa, Homo Sapiens
FLRPTAT

SEQ ID NO: 1207 - protein, 6 aa, Homo Sapiens
LRPTAT

SEQ ID NO: 1208 - protein, 1 aa, Homo Sapiens
T

SEQ ID NO: 1209 - protein, 46 aa, Homo Sapiens
SGRRLYSPSLPIRSSLTTSSRPTPESPCSGLRLQLWLQHRVFIQEK

SEQ ID NO: 1210 - protein, 1 aa, Homo Sapiens
L

SEQ ID NO: 1211 - protein, 16 aa, Homo Sapiens
FLRRLRRNLKRKGNSL

SEQ ID NO: 1212 - protein, 12 aa, Homo Sapiens
MRRNLKRKGNSL

SEQ ID NO: 1213 - protein, 1 aa, Homo Sapiens
L

SEQ ID NO: 1214 - protein, 4 aa, Homo Sapiens
LPSR

SEQ ID NO: 1215 - protein, 11 aa, Homo Sapiens
LGVKRPPGWWM

SEQ ID NO: 1216 - protein, 5 aa, Homo Sapiens
SFKAN

SEQ ID NO: 1217-1218 - skipped (2 entries)

SEQ ID NO: 1219 - protein, 10 aa, Homo Sapiens
CSWVCFRLLI

SEQ ID NO: 1220 - protein, 28 aa, Homo Sapiens
ALDKLLLTMFMGMPCRKLPRQGFWHFQL

SEQ ID NO: 1221 - protein, 23 aa, Homo Sapiens
LLTMFMGMPCRKLPRQGFWHFQL

SEQ ID NO: 1222 - protein, 9 aa, Homo Sapiens
RQGFWHFQL

SEQ ID NO: 1223 - protein, 5 aa, Homo Sapiens
WHFQL

SEQ ID NO: 1224 - protein, 4 aa, Homo Sapiens
HFQL

SEQ ID NO: 1225 - protein, 27 aa, Homo Sapiens
AISTITMWASAKLLPCCGSSDLFDFIL

SEQ ID NO: 1226 - protein, 65 aa, Homo Sapiens
CFELQWSDLLISQHFFRTDLSQNGVECSTYTCHRATILAPRLHLSTGLARGLSVFCSWVCFRLLI

SEQ ID NO: 1227 - protein, 6 aa, Homo Sapiens
WTVRFM

SEQ ID NO: 1228 - protein, 40 aa, Homo Sapiens
WNGLLATMDHSEVCGLLETHPALLLLNLKIPEMQLMQSES

SEQ ID NO: 1229 - protein, 36 aa, Homo Sapiens
LATMDHSEVCGLLETHPALLLLNLKIPEMQLMQSES

SEQ ID NO: 1230 - protein, 24 aa, Homo Sapiens
LETHPALLLLNLKIPEMQLMQSES

SEQ ID NO: 1231 - protein, 16 aa, Homo Sapiens
LLNLKIPEMQLMQSES

SEQ ID NO: 1232 - protein, 100 aa, Homo Sapiens
HLPLGVVALEMIIVGGVLHLVADLQEGEASLAAGAGPFLEIGEERDRCLGREITSRPDPSLGLVVDLGQMKGNRRQFAREVVYRKLLHLTGVCTENSSFV

SEQ ID NO: 1233 - protein, 67 aa, Homo Sapiens
GAGPFLEIGEERDRCLGREITSRPDPSLGLVVDLGQMKGNRRQFAREVVYRKLLHLTGVCTENSSFV

SEQ ID NO: 1234 - protein, 53 aa, Homo Sapiens
CLGREITSRPDPSLGLVVDLGQMKGNRRQFAREVVYRKLLHLTGVCTENSSFV

SEQ ID NO: 1235 - protein, 43 aa, Homo Sapiens
DPSLGLVVDLGQMKGNRRQFAREVVYRKLLHLTGVCTENSSFV

SEQ ID NO: 1236 - protein, 39 aa, Homo Sapiens
VWTCLPIRTRRPTRRPSSWRSTATPKSVPSVPTRASTGR

SEQ ID NO: 1237 - protein, 10 aa, Homo Sapiens
LWAEEHPLQA

SEQ ID NO: 1238 - protein, 114 aa, Homo Sapiens
QWGSPLEEGLQWACPLRECGLLPLGCEAFFDPWPQSMEVAPQRRGLDSSGPRYHRPVCFLCCCSWSLMGLSGFPYRAPSPGNAPTKALDSSWPSSAPCLFPVRLYIVLLSPCGL

SEQ ID NO: 1239 - protein, 109 aa, Homo Sapiens
LEEGLQWACPLRECGLLPLGCEAFFDPWPQSMEVAPQRRGLDSSGPRYHRPVCFLCCCSWSLMGLSGFPYRAPSPGNAPTKALDSSWPSSAPCLFPVRLYIVLLSPCGL

SEQ ID NO: 1240 - protein, 1 aa, Homo Sapiens
F

SEQ ID NO: 1241 - protein, 8 aa, Homo Sapiens
RSFTSLTL

SEQ ID NO: 1242 - protein, 11 aa, Homo Sapiens
VWCIKQTKLKM

SEQ ID NO: 1243 - protein, 10 aa, Homo Sapiens
WCIKQTKLKM

SEQ ID NO: 1244 - protein, 7 aa, Homo Sapiens
MRNSTVN

SEQ ID NO: 1245 - protein, 11 aa, Homo Sapiens
LATSICHGTSF

SEQ ID NO: 1246 - protein, 1 aa, Homo Sapiens
L

SEQ ID NO: 1247 - protein, 6 aa, Homo Sapiens
WFLKDP

SEQ ID NO: 1248 - protein, 2 aa, Homo Sapiens
IM

SEQ ID NO: 1249 - protein, 6 aa, Homo Sapiens
WLPNHC

SEQ ID NO: 1250 - protein, 5 aa, Homo Sapiens
QPLGS

SEQ ID NO: 1251 - protein, 3 aa, Homo Sapiens
CRN

SEQ ID NO: 1252 - protein, 27 aa, Homo Sapiens
AGSAVSPTWSPKSWRREPASCTSATFF

SEQ ID NO: 1253 - protein, 17 aa, Homo Sapiens
VLLSTPASFPLLSWARQ

SEQ ID NO: 1254 - protein, 56 aa, Homo Sapiens
CLPWGMFSLDPFGFSRQTCMWDWWSCVASSFLILNSLLKRPNMEIKIISGTALISS

SEQ ID NO: 1255 - protein, 10 aa, Homo Sapiens
CAPGSPCGPR

SEQ ID NO: 1256 - protein, 2 aa, Homo Sapiens
MS

SEQ ID NO: 1257 - protein, 3 aa, Homo Sapiens
NLL

SEQ ID NO: 1258 - protein, 4 aa, Homo Sapiens
MVKT

SEQ ID NO: 1259 - protein, 7 aa, Homo Sapiens
WTTVRMV

SEQ ID NO: 1260 - protein, 11 aa, Homo Sapiens
GKNLVPTSSLV

SEQ ID NO: 1261 - protein, 22 aa, Homo Sapiens
CPRPESTYYWPDRLGWSMWWCM

SEQ ID NO: 1262 - protein, 50 aa, Homo Sapiens
MFLTTLHMIREPSESKSTFQQSTHSNHRRSHLKQRSITQTSTKRGRSVCQ

SEQ ID NO: 1263 - protein, 14 aa, Homo Sapiens
MGHQGQIMKTEYIA

SEQ ID NO: 1264 - protein, 1 aa, Homo Sapiens
L

SEQ ID NO: 1265 - protein, 2 aa, Homo Sapiens
KE

SEQ ID NO: 1266 - protein, 26 aa, Homo Sapiens
HQKDKHTTINFSGSQTCLKSTTFYSC

SEQ ID NO: 1267 - protein, 10 aa, Homo Sapiens
WKNLKKDKKE

SEQ ID NO: 1268 - protein, 141 aa, Homo Sapiens
CCGRQPCGVRQPSLRRSSSCRRRRLACWTTACVWPPSSPLSPLARWECGLMLAAVLRLRRIMGQATFWSIWLSREQRIGLAVPWRRRWRAWGPILMPTAPGSTQLTTSRRCPRICRKLWSSWVTLCRTVVWKTHRLRRNVM

SEQ ID NO: 1269 - protein, 86 aa, Homo Sapiens
LRLRRIMGQATFWSIWLSREQRIGLAVPWRRRWRAWGPILMPTAPGSTQLTTSRRCPRICRKLWSSWVTLCRTVVWKTHRLRRNVM

SEQ ID NO: 1270 - protein, 74 aa, Homo Sapiens
WSIWLSREQRIGLAVPWRRRWRAWGPILMPTAPGSTQLTTSRRCPRICRKLWSSWVTLCRTVVWKTHRLRRNVM

SEQ ID NO: 1271 - protein, 10 aa, Homo Sapiens
MSSPRAMDLA

SEQ ID NO: 1272 - protein, 8 aa, Homo Sapiens
LAAPFTRK

SEQ ID NO: 1273 - protein, 11 aa, Homo Sapiens
LVMRAGLLATR

SEQ ID NO: 1274 - protein, 69 aa, Homo Sapiens
TGTMTPCARQSRSPLSTGDRCSPSPVKWMPLKEPMSPWNARCVKWKRTLPLKLLTTKTLLAACRMRFRI

SEQ ID NO: 1275 - protein, 68 aa, Homo Sapiens [sequence omitted]

SEQ ID NO: 1276 - protein, 58 aa, Homo Sapiens
ETWPRTSCASGRNCRRRCFRERKPKTPCNLSDRMLTMRLWHVLTLNAKWNLCKKRLPF

SEQ ID NO: 1277 - protein, 7 aa, Homo Sapiens
CKKRLPF

SEQ ID NO: 1278 - protein, 3 aa, Homo Sapiens
MPF

SEQ ID NO: 1279 - protein, 90 aa, Homo Sapiens [sequence omitted]

SEQ ID NO: 1280 - protein, 81 aa, Homo Sapiens
VIAVVSLVILPRIVIFRRMPAITAVEVATLPRTARSPRESESNAATTVANQAIWLVTATMQMSRNAILVENSDTFKKTAPK

SEQ ID NO: 1281 - protein, 19 aa, Homo Sapiens
LEPVGPACLAVQLQTITIP

SEQ ID NO: 1282 - protein, 17 aa, Homo Sapiens
GPLFIDQSWSDQPWKTH

SEQ ID NO: 1283 - protein, 5 aa, Homo Sapiens
WTRRV

SEQ ID NO: 1284 - protein, 9 aa, Homo Sapiens
GKIRKGRRR

SEQ ID NO: 1285 - protein, 35 aa, Homo Sapiens
LVVEVNMLISMRRMKVASSWWIQRAHRRRPTSGIE

SEQ ID NO: 1286 - protein, 5 aa, Homo Sapiens
TSGIE

SEQ ID NO: 1287 - protein, 26 aa, Homo Sapiens
LGLGRNGIRNHRNPETLQLKFVVIGK

SEQ ID NO: 1288 - protein, 162 aa, Homo Sapiens
QPQFQRQRQHRLRLRFPLRLQPHPQTLRQQRLQLRLLARPRPQRKLQRRPQRPLCLVLLFQGPSPAAAWSGCTQSFWPPLWTATRDATRVLPELSGPCWELSTNTQWRSPIAFQCRTMSQKMKWLLTWNLLRICMNCIKKFLQMSSSWAGTLRAMTSQSTLC

SEQ ID NO: 1289 - protein, 4 aa, Homo Sapiens
WVWL

SEQ ID NO: 1290 - protein, 10 aa, Homo Sapiens
VKKRIFPLKH

SEQ ID NO: 1291 - protein, 13 aa, Homo Sapiens
ISPLSTCLKKCRL

SEQ ID NO: 1292 - protein, 21 aa, Homo Sapiens
LTLGATSSCSPRTSRWATSAL

SEQ ID NO: 1293 - protein, 1 aa, Homo Sapiens
L

SEQ ID NO: 1294 - protein, 15 aa, Homo Sapiens
LTCGIRARLTTMSPT

SEQ ID NO: 1295 - protein, 28 aa, Homo Sapiens
GDPWGSASSLAMRVESSTSIVPSLERCW

SEQ ID NO: 1296 - protein, 17 aa, Homo Sapiens
MRVESSTSIVPSLERCW

SEQ ID NO: 1297 - protein, 10 aa, Homo Sapiens
SIVPSLERCW

SEQ ID NO: 1298 - protein, 1 aa, Homo Sapiens
W

SEQ ID NO: 1299 - protein, 1 aa, Homo Sapiens
T

SEQ ID NO: 1300 - protein, 47 aa, Homo Sapiens
RTTQPSFLTPQLLNIRRLSGQNVLSTQLPSPPTMTMWSWAVVRKPWM

SEQ ID NO: 1301 - protein, 42 aa, Homo Sapiens
SFLTPQLLNIRRLSGQNVLSTQLPSPPTMTMWSWAVVRKPWM

SEQ ID NO: 1302 - protein, 28 aa, Homo Sapiens
WNMAPNSLEEPLQGKEARHIWAYLSLIL

SEQ ID NO: 1303 - protein, 13 aa, Homo Sapiens
EARHIWAYLSLIL

SEQ ID NO: 1304 - protein, 14 aa, Homo Sapiens
LNSWRRSMGQTEFF

SEQ ID NO: 1305 - protein, 19 aa, Homo Sapiens
LILSLELATKEMEVYMAGI

SEQ ID NO: 1306 - protein, 15 aa, Homo Sapiens
HRVLRRRPATWCTPM

SEQ ID NO: 1307 - protein, 1 aa, Homo Sapiens
G

SEQ ID NO: 1308 - protein, 7 aa, Homo Sapiens
LMLSGML

SEQ ID NO: 1309 - skipped

SEQ ID NO: 1310 - protein, 4 aa, Homo Sapiens
MSTF

SEQ ID NO: 1311 - skipped

SEQ ID NO: 1312 - protein, 16 aa, Homo Sapiens
MPSPTREGPKRNLHQH

SEQ ID NO: 1313 - protein, 3 aa, Homo Sapiens
WAY

SEQ ID NO: 1314 - protein, 36 aa, Homo Sapiens
PEPTRSCRKLTESTRKCTRLIWRRTLFRTHLVTSAS

SEQ ID NO: 1315 - protein, 1 aa, Homo Sapiens
S

SEQ ID NO: 1316 - protein, 14 aa, Homo Sapiens
RVEEQRMALSLIMN

SEQ ID NO: 1317 - protein, 6 aa, Homo Sapiens
LSLIMN

SEQ ID NO: 1318 - protein, 5 aa, Homo Sapiens
SGSAS

SEQ ID NO: 1319 - protein, 38 aa, Homo Sapiens
SGACPTSRKYLIGTRVTALMTCWKASGKRLKETWKMLS

SEQ ID NO: 1320 - protein, 33 aa, Homo Sapiens
TSRKYLIGTRVTALMTCWKASGKRLKETWKMLS

SEQ ID NO: 1321 - protein, 20 aa, Homo Sapiens
LMTCWKASGKRLKETWKMLS

SEQ ID NO: 1322 - protein, 27 aa, Homo Sapiens
WRVITLHPQVHMGLSKPILTLMLSGML

SEQ ID NO: 1323 - protein, 15 aa, Homo Sapiens
AMCLGFIHPTLKLTY

SEQ ID NO: 1324 - protein, 36 aa, Homo Sapiens
MKKWSIQTCLSARTGLSISCTTLNSPPLKKMSMPAV

SEQ ID NO: 1325 - protein, 5 aa, Homo Sapiens
CHSPR

SEQ ID NO: 1326 - protein, 3 aa, Homo Sapiens
PSA

SEQ ID NO: 1327 - protein, 11 aa, Homo Sapiens
LCSYMSCWMRF

SEQ ID NO: 1328 - protein, 11 aa, Homo Sapiens
LATHRIPRQAR

SEQ ID NO: 1329 - protein, 22 aa, Homo Sapiens
MAGGERVSSIVGMSSSWMCWRV

SEQ ID NO: 1330 - protein, 22 aa, Homo Sapiens
SPRVLTLSTSSQKKEGRITPWG

SEQ ID NO: 1331 - protein, 28 aa, Homo Sapiens
MGIPVAQSDLFTQWPIIKTNWDLRMDQF

SEQ ID NO: 1332 - protein, 12 aa, Homo Sapiens
TSMNLMDECLFR

SEQ ID NO: 1333 - protein, 9 aa, Homo Sapiens
SRNSTRKRR

SEQ ID NO: 1334 - protein, 29 aa, Homo Sapiens [sequence omitted]

SEQ ID NO: 1335 - protein, 29 aa, Homo Sapiens
LAKRSMPHQPYLKLLERLWELSTELQKSL

SEQ ID NO: 1336 - protein, 11 aa, Homo Sapiens
WELSTELQKSL

SEQ ID NO: 1337 - protein, 38 aa, Homo Sapiens
ACSLPKTCARGLLIALSPSLVSRPLPRLAISLLYFLSL

SEQ ID NO: 1338 - protein, 28 aa, Homo Sapiens
LGYGCCWRLCFKRCLLLGQSFHRRHAES

SEQ ID NO: 1339 - protein, 22 aa, Homo Sapiens
WRLCFKRCLLLGQSFHRRHAES

SEQ ID NO: 1340 - protein, 12 aa, Homo Sapiens
LGQSFHRRHAES

SEQ ID NO: 1341 - protein, 37 aa, Homo Sapiens
VDENWEGSLKSKLLLGVINPNCSEDCKSSMSVVQTLY

SEQ ID NO: 1342 - protein, 33 aa, Homo Sapiens
WEGSLKSKLLLGVINPNCSEDCKSSMSVVQTLY

SEQ ID NO: 1343 - protein, 24 aa, Homo Sapiens
LLGVINPNCSEDCKSSMSVVQTLY

SEQ ID NO: 1344 - protein, 10 aa, Homo Sapiens
WTTMGTLLKN

SEQ ID NO: 1345 - protein, 41 aa, Homo Sapiens
VMPLEYCSNVVLLPLSIIFRQQLTKTSQLTLQKSMPSFLQH

SEQ ID NO: 1346 - protein, 58 aa, Homo Sapiens
MQRRTRRMSTRSTTSPRPRRASRRSRSWTRTTRACESTRRPCWAAWPFPQTPTSPTSW

SEQ ID NO: 1347 - protein, 7 aa, Homo Sapiens
RAPWSWT

SEQ ID NO: 1348 - protein, 10 aa, Homo Sapiens
WRASRSSRLC

SEQ ID NO: 1349 - protein, 5 aa, Homo Sapiens
RSTSS

SEQ ID NO: 1350 - protein, 51 aa, Homo Sapiens
LANSFSVPASSTVTRRKIKVCRQARMHAFMLCRPVSSLSATKARRWWCSSR

SEQ ID NO: 1351 - protein, 24 aa, Homo Sapiens
LVPTSVALAPRRFMSSSTTRARTC

SEQ ID NO: 1352 - protein, 6 aa, Homo Sapiens
QTTPMR

SEQ ID NO: 1353 - protein, 8 aa, Homo Sapiens
GTSCHPRR

SEQ ID NO: 1354 - protein, 17 aa, Homo Sapiens
WEPCPRGPCRMPPSMAT

SEQ ID NO: 1355 - protein, 25 aa, Homo Sapiens
LVHLDLEEVGQGPYLERSLETLGRN

SEQ ID NO: 1356 - protein, 7 aa, Homo Sapiens
VKCMKNI

SEQ ID NO: 1357 - protein, 10 aa, Homo Sapiens
MGWQSFWISM

SEQ ID NO: 1358 - protein, 4 aa, Homo Sapiens
WISM

SEQ ID NO: 1359 - protein, 7 aa, Homo Sapiens
GAGMLRS

SEQ ID NO: 1360 - protein, 31 aa, Homo Sapiens
EANVGSSSTLPVWLPSRVRLDKLHTLLPRGE

SEQ ID NO: 1361 - protein, 47 aa, Homo Sapiens
MGISTLLWSRNLMWRQSFRSMAKLWAALFIRALPSFSMLMREMPGLL

SEQ ID NO: 1362 - protein, 24 aa, Homo Sapiens
MWAALFIRALPSFSMLMREMPGLL

SEQ ID NO: 1363 - protein, 15 aa, Homo Sapiens
LPSFSMLMREMPGLL

SEQ ID NO: 1364 - skipped

SEQ ID NO: 1365 - protein, 33 aa, Homo Sapiens
PLLTWTMTFNGTIMIGCTVTQHVYLLLLLLLGL

SEQ ID NO: 1366 - protein, 13 aa, Homo Sapiens
NITFLAQILLWIR

SEQ ID NO: 1367 - protein, 17 aa, Homo Sapiens
MMKMTIKLELRPRRIVT

SEQ ID NO: 1368 - protein, 10 aa, Homo Sapiens
MELRPRRIVT

SEQ ID NO: 1369 - protein, 45 aa, Homo Sapiens
LVPEEAQEEGSGPLYHISHLTSICVKWPFPGSSQHLMKLPSVRPC

SEQ ID NO: 1370 - protein, 32 aa, Homo Sapiens
LYHISHLTSICVKWPFPGSSQHLMKLPSVRPC

SEQ ID NO: 1371 - protein, 22 aa, Homo Sapiens
CVKWPFPGSSQHLMKLPSVRPC

SEQ ID NO: 1372 - protein, 24 aa, Homo Sapiens
MWLQGHLKCKLKKFDRWDPIKRGQ

SEQ ID NO: 1373 - protein, 19 aa, Homo Sapiens
HLKCKLKKFDRWDPIKRGQ

SEQ ID NO: 1374 - protein, 9 aa, Homo Sapiens
WISKYCRVP

SEQ ID NO: 1375 - protein, 37 aa, Homo Sapiens
WRNFTMIREAMMATVTACSPGCTAVACCSTQMPWSTC

SEQ ID NO: 1376 - protein, 51 aa, Homo Sapiens
LSSTSECLEPECMLLISGQEECTRTYPLGLWMTFISFLRTSLFGLMSWRSC

SEQ ID NO: 1377 - protein, 33 aa, Homo Sapiens
QEECTRTYPLGLWMTFISFLRTSLFGLMSWRSC

SEQ ID NO: 1378 - protein, 30 aa, Homo Sapiens
LGELLCTQAKKQPTGSLHLGMMWTLQRTQL

SEQ ID NO: 1379 - protein, 7 aa, Homo Sapiens
LEKSHVC

SEQ ID NO: 1380 - protein, 23 aa, Homo Sapiens
LESMWLKSCPSMSNKFRCPASMS

SEQ ID NO: 1381 - protein, 10 aa, Homo Sapiens
LGDPPFCCCR

SEQ ID NO: 1382 - protein, 29 aa, Homo Sapiens
TAGEGSHLTTCGDPMGVDHSIPTLLCREK

SEQ ID NO: 1383 - protein, 8 aa, Homo Sapiens
VQENKVDQ

SEQ ID NO: 1384 - protein, 12 aa, Homo Sapiens
LARSWISWYHGA

SEQ ID NO: 1385 - protein, 41 aa, Homo Sapiens
LSSSRRSAAPPTPCAPCRVSLSMTNLCVSSMPRPTQISLPR

SEQ ID NO: 1386 - protein, 22 aa, Homo Sapiens
WMNVIRCLNSSTCVGMSRKFFA

SEQ ID NO: 1387 - protein, 19 aa, Homo Sapiens
LSWPHCNSWSQLLGRCLYW

SEQ ID NO: 1388 - protein, 4 aa, Homo Sapiens
RLGS

SEQ ID NO: 1389 - protein, 1 aa, Homo Sapiens
D

SEQ ID NO: 1390 - protein, 25 aa, Homo Sapiens
LVMVIPHHRMDSHSLALGTACEMKR

SEQ ID NO: 1391 - protein, 14 aa, Homo Sapiens
LSVTFGQKSMKTTA

SEQ ID NO: 1392 - protein, 46 aa, Homo Sapiens
ASVSTTFWETHGAFSSPTLGTLPQCAPQSLAELQSWHQNLPRGMLS

SEQ ID NO: 1393 - protein, 16 aa, Homo Sapiens
AELQSWHQNLPRGMLS

SEQ ID NO: 1394 - protein, 7 aa, Homo Sapiens
LPRGMLS

SEQ ID NO: 1395 - protein, 4 aa, Homo Sapiens
MPFQ

SEQ ID NO: 1396 - protein, 38 aa, Homo Sapiens
VKSPQKSYLFPSSMIGIGSLPSCWACWIQQRRMKRACL

SEQ ID NO: 1397 - protein, 15 aa, Homo Sapiens
WACWIQQRRMKRACL

SEQ ID NO: 1398 - protein, 8 aa, Homo Sapiens
LFLVLIRS

SEQ ID NO: 1399 - protein, 6 aa, Homo Sapiens
GRMGIV

SEQ ID NO: 1400 - protein, 129 aa, Homo Sapiens
SLKKKPKNFSRKESSPKSSHLARNTSATHPSLKSLGEAGAVSQRMSAANCVFLQQFHKHILVSSQPRFLGCYTNGLLNENGTKSFLRFFILSAFSNQFHSYISTLLVLFEICSVFKTQILLDLCRACDQ

SEQ ID NO: 1401 - protein, 21 aa, Homo Sapiens
LFRAPMAQPASLLPTPLDTWI

SEQ ID NO: 1402 - protein, 69 aa, Homo Sapiens
LWSLWMNISLWSACYRLPGSQIPQSMNIILPLVAGSLPETPHPTCLTLYDALGCTTSPSTRTSRMATGR

SEQ ID NO: 1403 - protein, 5 aa, Homo Sapiens
VWSRS

SEQ ID NO: 1404 - protein, 7 aa, Homo Sapiens
CLLPCTI

SEQ ID NO: 1405 - protein, 18 aa, Homo Sapiens
CGEPYTHYCKIPPTSLRS

SEQ ID NO: 1406 - protein, 5 aa, Homo Sapiens
TSLRS

SEQ ID NO: 1407 - protein, 41 aa, Homo Sapiens
CTQRFLMFLRKSLKMQHIESIQNRLQMRSWLWLKRNQMLKN

SEQ ID NO: 1408 - protein, 4 aa, Homo Sapiens
QYNY

SEQ ID NO: 1409 - protein, 21 aa, Homo Sapiens
LEQQDSWGDMLSTTLDAWGHR

SEQ ID NO: 1410 - protein, 5 aa, Homo Sapiens
LRMFL

SEQ ID NO: 1411 - protein, 1 aa, Homo Sapiens
L

SEQ ID NO: 1412 - protein, 3 aa, Homo Sapiens
ERK

SEQ ID NO: 1413 - protein, 20 aa, Homo Sapiens
WTKWRLSWPWKTNLGLKFLI

SEQ ID NO: 1414 - protein, 35 aa, Homo Sapiens
LRRCPGSGCWPWPGLSAPLSAPRGPRRGSGLCSRP

SEQ ID NO: 1415 - protein, 38 aa, Homo Sapiens [sequence omitted]

SEQ ID NO: 1416 - protein, 39 aa, Homo Sapiens
SWATRTRPPSGPPSPGKRSSTSRQLRWVSWLAKTGQVFT

SEQ ID NO: 1417 - skipped

SEQ ID NO: 1418 - protein, 83 aa, Homo Sapiens
PTFGVPSTDLVCPFPFTAPHSFAPLSSPYTHKPFYFLGHYPIPLIAAKTTWAGGQGWMDRHLPLPISLPCVVGKLLFFGVFFF

SEQ ID NO: 1419 - protein, 28 aa, Homo Sapiens
LMLDECWEFRGMSSLILGFALFPFLIVV

SEQ ID NO: 1420 - protein, 73 aa, Homo Sapiens
VPQHPQRPHPQLPQSPLHPSRLPPPQACPIPHLPPERTRAHQRNPPPRRPQSLCQALFPLQVAAGERKTRPPR

SEQ ID NO: 1421 - protein, 2 aa, Homo Sapiens
PR

SEQ ID NO: 1422 - protein, 3 aa, Homo Sapiens
ERC

SEQ ID NO: 1423 - protein, 14 aa, Homo Sapiens
LSPLPPWSRAPHSC

SEQ ID NO: 1424 - protein, 13 aa, Homo Sapiens
LGASSLVMPGTLL

SEQ ID NO: 1425 - protein, 1 aa, Homo Sapiens
V

SEQ ID NO: 1426 - protein, 7 aa, Homo Sapiens
APADPAP

SEQ ID NO: 1427 - protein, 21 aa, Homo Sapiens
LEATSTWRPSVPLLTAEAVCW

SEQ ID NO: 1428 - protein, 32 aa, Homo Sapiens
LTRRKRLSLTITTMTSQTLASIRSSWLTLRTC

SEQ ID NO: 1429 - protein, 13 aa, Homo Sapiens
WWPILITLWCWTS

SEQ ID NO: 1430 - protein, 6 aa, Homo Sapiens
LVSALT

SEQ ID NO: 1431 - protein, 9 aa, Homo Sapiens
GKALPLPAG

SEQ ID NO: 1432 - protein, 1 aa, Homo Sapiens
W

SEQ ID NO: 1433 - protein, 48 aa, Homo Sapiens
SVRCRRLAKRTWWVCSKIPTCVPSTLRESPSCPKTSSWLAGYGERELK

SEQ ID NO: 1434 - protein, 8 aa, Homo Sapiens
GYGERELK

SEQ ID NO: 1435 - protein, 5 aa, Homo Sapiens
WSKNA

SEQ ID NO: 1436 - protein, 3 aa, Homo Sapiens
MPS

SEQ ID NO: 1437 - protein, 8 aa, Homo Sapiens
WTKSGMKA

SEQ ID NO: 1438 - protein, 7 aa, Homo Sapiens
MWILELE

SEQ ID NO: 1439 - protein, 11 aa, Homo Sapiens
VFILLIWLLRK

SEQ ID NO: 1440 - protein, 5 aa, Homo Sapiens
WLLRK

SEQ ID NO: 1441 - protein, 1 aa, Homo Sapiens
M

SEQ ID NO: 1442 - protein, 9 aa, Homo Sapiens
LWRRNVIKK

SEQ ID NO: 1443 - protein, 36 aa, Homo Sapiens
ATRESKSHRTSRRGAAFSDVFFCEEHRLTLSLAQPS

SEQ ID NO: 1444 - protein, 33 aa, Homo Sapiens
ESKSHRTSRRGAAFSDVFFCEEHRLTLSLAQPS

SEQ ID NO: 1445 - protein, 87 aa, Homo Sapiens
WKPLTWILHSGESMSSPTPGPQPTWPSTQPFCNLTTGSWGWTCPMGAISPTATCLTSSGYQPRPSSSSLCPISSTPKLASLTTTSWH

SEQ ID NO: 1446 - protein, 63 aa, Homo Sapiens
WPSTQPFCNLTTGSWGWTCPMGAISPTATCLTSSGYQPRPSSSSLCPISSTPKLASLTTTSWH

SEQ ID NO: 1447 - protein, 61 aa, Homo Sapiens
STQPFCNLTTGSWGWTCPMGAISPTATCLTSSGYQPRPSSSSLCPISSTPKLASLTTTSWH

SEQ ID NO: 1448 - protein, 54 aa, Homo Sapiens
LTTGSWGWTCPMGAISPTATCLTSSGYQPRPSSSSLCPISSTPKLASLTTTSWH

SEQ ID NO: 1449 - protein, 35 aa, Homo Sapiens
TCLTSSGYQPRPSSSSLCPISSTPKLASLTTTSWH

SEQ ID NO: 1450 - protein, 25 aa, Homo Sapiens
RPSSSSLCPISSTPKLASLTTTSWH

SEQ ID NO: 1451 - protein, 31 aa, Homo Sapiens
PGLPAAGCSRLELSPPLGCWECRVVSWTCLG

SEQ ID NO: 1452 - protein, 2 aa, Homo Sapiens
LG

SEQ ID NO: 1453 - protein, 21 aa, Homo Sapiens
QRSTSPWGSPLGVPHLAATRS

SEQ ID NO: 1454 - protein, 2 aa, Homo Sapiens
MS

SEQ ID NO: 1455 - protein, 10 aa, Homo Sapiens
LATMDTHLPI

SEQ ID NO: 1456 - protein, 1 aa, Homo Sapiens
L

SEQ ID NO: 1457 - protein, 44 aa, Homo Sapiens
LSRCCQIRTAAMPSMMQPMRPRRARRRIWCLSSGPPSLRPLRAK

SEQ ID NO: 1458 - protein, 82 aa, Homo Sapiens
APWQRSWGAVPSSPWRASLCEPLLAPCLEHLAAPHLPLGVAGCPLPARPEGLGGSQQGEGNPFTPVAKQTPHPLDFPSPSIP

SEQ ID NO: 1459 - protein, 16 aa, Homo Sapiens
ALMCLSQLEKPETAVL

SEQ ID NO: 1460 - protein, 7 aa, Homo Sapiens
TPHRFSE

SEQ ID NO: 1461 - protein, 7 aa, Homo Sapiens
SLTMRPP

SEQ ID NO: 1462 - protein, 13 aa, Homo Sapiens
LLNLNQKMKSNWP

SEQ ID NO: 1463 - protein, 14 aa, Homo Sapiens
GVRGRPSCSLLHRK

SEQ ID NO: 1464 - protein, 102 aa, Homo Sapiens
AVVAWVVHVEELALAAAVCMAWGAPRGSPLEGAAVPSVAAMAAEPEAAMALVAPGVDLVSVVEPALALVWVVEPALLVALGALASLCAPLEASKRSPSTRVS

SEQ ID NO: 1465 - protein, 2 aa, Homo Sapiens
LS

SEQ ID NO: 1466 - protein, 36 aa, Homo Sapiens
VPNWNVCERRISTLKKCGRTKNPKTLLTRLKLTNLF

SEQ ID NO: 1467 - protein, 34 aa, Homo Sapiens
NWNVCERRISTLKKCGRTKNPKTLLTRLKLTNLF

SEQ ID NO: 1468 - protein, 30 aa, Homo Sapiens
CERRISTLKKCGRTKNPKTLLTRLKLTNLF

SEQ ID NO: 1469 - protein, 12 aa, Homo Sapiens
LVLLAWPVPSVS

SEQ ID NO: 1470 - protein, 6 aa, Homo Sapiens
MSSKTN

SEQ ID NO: 1471 - skipped

SEQ ID NO: 1472 - protein, 8 aa, Homo Sapiens
MSLAKTIM

SEQ ID NO: 1473 - protein, 5 aa, Homo Sapiens
WSSVT

SEQ ID NO: 1474 - skipped

SEQ ID NO: 1475 - protein, 10 aa, Homo Sapiens
CLLFQIQWIS

SEQ ID NO: 1476 - protein, 8 aa, Homo Sapiens
MFQIQWIS

SEQ ID NO: 1477 - protein, 4 aa, Homo Sapiens
DSVT

SEQ ID NO: 1478 - protein, 4 aa, Homo Sapiens
MDSL

SEQ ID NO: 1479 - protein, 4 aa, Homo Sapiens
WQRV

SEQ ID NO: 1480 - protein, 9 aa, Homo Sapiens
WDRMESQTL

SEQ ID NO: 1481 - protein, 21 aa, Homo Sapiens
SSRRPLARSLTASGAATCPSA

SEQ ID NO: 1482 - protein, 4 aa, Homo Sapiens
TRSS

SEQ ID NO: 1483 - protein, 16 aa, Homo Sapiens
TWRPRPCGRSRAAMSP

SEQ ID NO: 1484 - protein, 53 aa, Homo Sapiens
NRVGVKRRHGRLCPNWVFGRLQELLESLSGNLRISSLSSQNQMSTRALLQILT

SEQ ID NO: 1485 - protein, 17 aa, Homo Sapiens
LSSQNQMSTRALLQILT

SEQ ID NO: 1486 - protein, 14 aa, Homo Sapiens
LGKPRSKIYPSKHN

SEQ ID NO: 1487 - protein, 1 aa, Homo Sapiens
M

SEQ ID NO: 1488 - protein, 15 aa, Homo Sapiens
LSMSLIFLARKPSAV

SEQ ID NO: 1489 - protein, 8 aa, Homo Sapiens
SEPLPARV

SEQ ID NO: 1490 - protein, 27 aa, Homo Sapiens
CQKLLLLSLTMEISIPDCIQSSLNTWG

SEQ ID NO: 1491 - skipped

SEQ ID NO: 1492 - protein, 16 aa, Homo Sapiens
ALPWTTSSDSLSPTVR

SEQ ID NO: 1493 - protein, 27 aa, Homo Sapiens
MWMKPSITSRPMSSSKTMKLRMKLIGP

SEQ ID NO: 1494 - protein, 1 aa, Homo Sapiens
L

SEQ ID NO: 1495 - protein, 36 aa, Homo Sapiens
RVFQDLDSEGSPGSHRLQSPGQHFPARCTQSFAFIS

SEQ ID NO: 1496 - protein, 97 aa, Homo Sapiens
WDMFTEQRWKMRLIAAFRKCIRPTMEPTLMLLAGLLIMYRDSCIVVEFTTTQTGKIQIGSKKPKTRVSLLAAAERLPAIVMAAWPTLPTSMLRGVRL

SEQ ID NO: 1497 - protein, 38 aa, Homo Sapiens
APAARAPATRPLPPPPGTRSCTWTWTPTGSRSAAWCWS

SEQ ID NO: 1498 - protein, 20 aa, Homo Sapiens
LDPTKTDQKITKVAELVKPL

SEQ ID NO: 1499 - protein, 27 aa, Homo Sapiens
LLCCFSAFPSFLLKDGRRFSSPGWWSC

SEQ ID NO: 1500 - protein, 1 aa, Homo Sapiens
C

SEQ ID NO: 1501 - protein, 24 aa, Homo Sapiens
LWFSLSSLCCWSSMPCAKFGSMMM

SEQ ID NO: 1502 - protein, 27 aa, Homo Sapiens
RSTWRRMTSSRRELLLTEASWMSGMLR

SEQ ID NO: 1503 - skipped

SEQ ID NO: 1504 - protein, 139 aa, Homo Sapiens
LRLQEPLVPHPWLAWPLSRRRRRRLPLEPLLLPLRALRPNLCLWLLRRVLVLRVPAWPHLVAAPAQGWRWWLLRVPQPQVVAREPWMTVPPFAVSARSQAIWLCATSVSFVSTWTVTCRPCRMYQGRSGAAHSAMCSLT

SEQ ID NO: 1505 - protein, 29 aa, Homo Sapiens
VSTWTVTCRPCRMYQGRSGAAHSAMCSLT

SEQ ID NO: 1506 - protein, 13 aa, Homo Sapiens
RSGAAHSAMCSLT

SEQ ID NO: 1507 - protein, 24 aa, Homo Sapiens
VRAVILSPAETASSMPTRTTSTSS

SEQ ID NO: 1508 - protein, 3 aa, Homo Sapiens
GTL

SEQ ID NO: 1509 - protein, 3 aa, Homo Sapiens
LMS

SEQ ID NO: 1510 - protein, 22 aa, Homo Sapiens
VQQSGLHWVSICPSWHIIFGGI

SEQ ID NO: 1511 - protein, 3 aa, Homo Sapiens
GGI

SEQ ID NO: 1512 - protein, 8 aa, Homo Sapiens
VRRKDGAN

SEQ ID NO: 1513 - protein, 1 aa, Homo Sapiens
W

SEQ ID NO: 1514 - protein, 26 aa, Homo Sapiens
WILKFKNWIRWMRMNWNALKKRDSRH

SEQ ID NO: 1515 - protein, 11 aa, Homo Sapiens
WNALKKRDSRH

SEQ ID NO: 1516 - protein, 41 aa, Homo Sapiens
FLKDMGNTEKSLVKETFFKKSRRVKMWFAISTETPHSGVKY

SEQ ID NO: 1517 - protein, 13 aa, Homo Sapiens
AISTETPHSGVKY

SEQ ID NO: 1518 - skipped

SEQ ID NO: 1519 - protein, 6 aa, Homo Sapiens
LPAMVL

SEQ ID NO: 1520 - protein, 40 aa, Homo Sapiens
WITMKRKSPRLLKRAHQLPLRKTSRDPTFPSTALASGTFC

SEQ ID NO: 1521 - protein, 21 aa, Homo Sapiens
HLQMLLQWTQQNKSISLPWHC

SEQ ID NO: 1522 - protein, 5 aa, Homo Sapiens
LALTV

SEQ ID NO: 1523 - protein, 31 aa, Homo Sapiens
LIKVMKPLVCGKRLQRWWRRKLADTDLLRTT

SEQ ID NO: 1524 - protein, 22 aa, Homo Sapiens
WCQLEKVLLKLKQMSFLAMGAT

SEQ ID NO: 1525 - protein, 3 aa, Homo Sapiens
VQP

SEQ ID NO: 1526 - protein, 5 aa, Homo Sapiens
RTMLK

SEQ ID NO: 1527 - protein, 11 aa, Homo Sapiens
CSTPMPRLWPP

SEQ ID NO: 1528 - protein, 8 aa, Homo Sapiens
VPSTARKP

SEQ ID NO: 1529 - protein, 5 aa, Homo Sapiens
TKSSA

SEQ ID NO: 1530 - protein, 74 aa, Homo Sapiens
RLHLSSPQAQPKADEDRPAEIGWRTVLCPQVLSLHRNLNSRMEFFLLCWDSFAWQGLISPLARGSLCSIFFNLK

SEQ ID NO: 1531 - protein, 63 aa, Homo Sapiens
WRQRRKMSSTRRLMGVSQRNPEMMSIKGTSQTQRTKWTLTLTLMKGMNHPVMEKQKSQEGSAE

SEQ ID NO: 1532 - protein, 1 aa, Homo Sapiens
H

SEQ ID NO: 1533 - protein, 13 aa, Homo Sapiens
MQISSEHVWDPSP

SEQ ID NO: 1534 - protein, 5 aa, Homo Sapiens
WDPSP

SEQ ID NO: 1535 - protein, 7 aa, Homo Sapiens
WTQWEAL

SEQ ID NO: 1536 - protein, 1 aa, Homo Sapiens
M

SEQ ID NO: 1537 - protein, 6 aa, Homo Sapiens
EMGPHQ

SEQ ID NO: 1538 - protein, 5 aa, Homo Sapiens
RHWMI

SEQ ID NO: 1539 - protein, 3 aa, Homo Sapiens
WMI

SEQ ID NO: 1540 - protein, 10 aa, Homo Sapiens
LRRMVGKRLT

SEQ ID NO: 1541 - protein, 128 aa, Homo Sapiens
AWNMGFSLMGRCPVTRPLVEGTTPSPPSSVKLVLENTYPGQFLWIWSLRSLMRSEMAHTDSSSTQSSSSLGKRMLPTTMPVVTIPLARRSLTQCWIGSASCLTSAQDFRASWCSTALVGALALASPHS

SEQ ID NO: 1542 - protein, 86 aa, Homo Sapiens
LWIWSLRSLMRSEMAHTDSSSTQSSSSLGKRMLPTTMPVVTIPLARRSLTQCWIGSASCLTSAQDFRASWCSTALVGALALASPHS

SEQ ID NO: 1543 - protein, 26 aa, Homo Sapiens
MGEEMIPSTPSSVRRGLASMCPGQCL

SEQ ID NO: 1544 - protein, 1 aa, Homo Sapiens
L

SEQ ID NO: 1545 - protein, 47 aa, Homo Sapiens
ASWFSTALVGELVLGSPRCSWNVSQLIMARSPSWSSLFTRRPRFPQL

SEQ ID NO: 1546 - protein, 28 aa, Homo Sapiens
VFLIWEDFTRTSKTEMSHSHQPLLKTNL

SEQ ID NO: 1547 - protein, 43 aa, Homo Sapiens
LTWGGKRQKWMSFRFVATWCQMNMSSCPLKPWRLPEFVPISTW

SEQ ID NO: 1548 - protein, 28 aa, Homo Sapiens
VATWCQMNMSSCPLKPWRLPEFVPISTW

SEQ ID NO: 1549 - protein, 8 aa, Homo Sapiens
EFVPISTW

SEQ ID NO: 1550 - protein, 6 aa, Homo Sapiens
VPISTW

SEQ ID NO: 1551 - protein, 57 aa, Homo Sapiens
STPSTSSASTRCCPVLGLTGSKQACEVPLESPRALWPGFTLAKLSCPSAPSCRTRSM

SEQ ID NO: 1552 - protein, 24 aa, Homo Sapiens
ALWPGFTLAKLSCPSAPSCRTRSM

SEQ ID NO: 1553 - protein, 19 aa, Homo Sapiens
FTLAKLSCPSAPSCRTRSM

SEQ ID NO: 1554 - protein, 17 aa, Homo Sapiens
MAKLSCPSAPSCRTRSM

SEQ ID NO: 1555 - protein, 15 aa, Homo Sapiens
KLSCPSAPSCRTRSM

SEQ ID NO: 1556 - protein, 115 aa, Homo Sapiens
SSSFLAARRSTSQRSGASPSSMLMNLKTWWLKSGSSQMAVGSSTSPVVALWTSGGPCTHEGFQCAAPLLILTNKFYFLSTYVFVSTFLTGKELPLGTFGSLPFHFRNRLTTQPCS

SEQ ID NO: 1557 - protein, 109 aa, Homo Sapiens
ARRSTSQRSGASPSSMLMNLKTWWLKSGSSQMAVGSSTSPVVALWTSGGPCTHEGFQCAAPLLILTNKFYFLSTYVFVSTFLTGKELPLGTFGSLPFHFRNRLTTQPCS

SEQ ID NO: 1558 - protein, 108 aa, Homo Sapiens
RRSTSQRSGASPSSMLMNLKTWWLKSGSSQMAVGSSTSPVVALWTSGGPCTHEGFQCAAPLLILTNKFYFLSTYVFVSTFLTGKELPLGTFGSLPFHFRNRLTTQPCS

SEQ ID NO: 1559 - protein, 85 aa, Homo Sapiens
VKSGSSQMAVGSSTSPVVALWTSGGPCTHEGFQCAAPLLILTNKFYFLSTYVFVSTFLTGKELPLGTFGSLPFHFRNRLTTQPCS

SEQ ID NO: 1560 - protein, 81 aa, Homo Sapiens
SSQMAVGSSTSPVVALWTSGGPCTHEGFQCAAPLLILTNKFYFLSTYVFVSTFLTGKELPLGTFGSLPFHFRNRLTTQPCS

SEQ ID NO: 1561 - protein, 76 aa, Homo Sapiens
VGSSTSPVVALWTSGGPCTHEGFQCAAPLLILTNKFYFLSTYVFVSTFLTGKELPLGTFGSLPFHFRNRLTTQPCS

SEQ ID NO: 1562 - protein, 69 aa, Homo Sapiens
VTGIVRTSRTQSLASAEVSLMPRFAFLTWGGKRQKWMSFRFVATWCQMNMSSCPLKPWRLPEFVPISTW

SEQ ID NO: 1563 - protein, 73 aa, Homo Sapiens
STSPVVALWTSGGPCTHEGFQCAAPLLILTNKFYFLSTYVFVSTFLTGKELPLGTFGSLPFHFRNRLTTQPCS

SEQ ID NO: 1564 - protein, 69 aa, Homo Sapiens
VVALWTSGGPCTHEGFQCAAPLLILTNKFYFLSTYVFVSTFLTGKELPLGTFGSLPFHFRNRLTTQPCS

SEQ ID NO: 1565 - protein, 66 aa, Homo Sapiens
LWTSGGPCTHEGFQCAAPLLILTNKFYFLSTYVFVSTFLTGKELPLGTFGSLPFHFRNRLTTQPCS

SEQ ID NO: 1566 - protein, 61 aa, Homo Sapiens
GPCTHEGFQCAAPLLILTNKFYFLSTYVFVSTFLTGKELPLGTFGSLPFHFRNRLTTQPCS

SEQ ID NO: 1567 - protein, 59 aa, Homo Sapiens
CTHEGFQCAAPLLILTNKFYFLSTYVFVSTFLTGKELPLGTFGSLPFHFRNRLTTQPCS

SEQ ID NO: 1568 - protein, 65 aa, Homo Sapiens
VRTSRTQSLASAEVSLMPRFAFLTWGGKRQKWMSFRFVATWCQMNMSSCPLKPWRLPEFVPISTW

SEQ ID NO: 1569 - protein, 45 aa, Homo Sapiens
LSRKTSLLVFLKETTHNTMIIFLNKRKKFADAYKTFSRNTYSTNS

SEQ ID NO: 1570 - protein, 3 aa, Homo Sapiens
TRW

SEQ ID NO: 1571 - protein, 40 aa, Homo Sapiens
SAASSLWIGAPLASRLASTTSLPLWCLVETWPRYRELCAC

SEQ ID NO: 1572 - protein, 35 aa, Homo Sapiens
LWIGAPLASRLASTTSLPLWCLVETWPRYRELCAC

SEQ ID NO: 1573 - protein, 8 aa, Homo Sapiens
RYRELCAC

SEQ ID NO: 1574 - protein, 69 aa, Homo Sapiens
LFTGTWVRGWRKASFQRPVKIWLPLRRIMRRLVWILLKERVRKKERNTNYPFLLALQHVMLPEFQLQLN

SEQ ID NO: 1575 - protein, 44 aa, Homo Sapiens
RRIMRRLVWILLKERVRKKERNTNYPFLLALQHVMLPEFQLQLN

SEQ ID NO: 1576 - protein, 37 aa, Homo Sapiens
VWILLKERVRKKERNTNYPFLLALQHVMLPEFQLQLN

SEQ ID NO: 1577 - protein, 58 aa, Homo Sapiens
ARLVSRLAMPAGSSTAWNTASSPMARCQVTRPLGEEMTPSTPSSVRRALASTCPGLCL

SEQ ID NO: 1578 - protein, 57 aa, Homo Sapiens
RLVSRLAMPAGSSTAWNTASSPMARCQVTRPLGEEMTPSTPSSVRRALASTCPGLCL

SEQ ID NO: 1579 - protein, 53 aa, Homo Sapiens
RLAMPAGSSTAWNTASSPMARCQVTRPLGEEMTPSTPSSVRRALASTCPGLCL

SEQ ID NO: 1580 - protein, 52 aa, Homo Sapiens
MAMPAGSSTAWNTASSPMARCQVTRPLGEEMTPSTPSSVRRALASTCPGLCL

SEQ ID NO: 1581 - protein, 33 aa, Homo Sapiens
RCQVTRPLGEEMTPSTPSSVRRALASTCPGLCL

SEQ ID NO: 1582 - protein, 26 aa, Homo Sapiens
MGEEMTPSTPSSVRRALASTCPGLCL

SEQ ID NO: 1583 - protein, 24 aa, Homo Sapiens
EEMTPSTPSSVRRALASTCPGLCL

SEQ ID NO: 1584 - protein, 1 aa, Homo Sapiens
L

SEQ ID NO: 1585 - protein, 106 aa, Homo Sapiens
MMKFALAPTASSSTLSSSSQARKMLPITMPEGTTPLARRSLTLCWTEFASWLTSAPVFRASWFSTALVGELVLGSPPCSWNVSQLIMARSPSWSSPFTQHPRFPQL

SEQ ID NO: 1586 - protein, 96 aa, Homo Sapiens
SSSTLSSSSQARKMLPITMPEGTTPLARRSLTLCWTEFASWLTSAPVFRASWFSTALVGELVLGSPPCSWNVSQLIMARSPSWSSPFTQHPRFPQL

SEQ ID NO: 1587 - protein, 80 aa, Homo Sapiens
ITMPEGTTPLARRSLTLCWTEFASWLTSAPVFRASWFSTALVGELVLGSPPCSWNVSQLIMARSPSWSSPFTQHPRFPQL

SEQ ID NO: 1588 - protein, 71 aa, Homo Sapiens
MARRSLTLCWTEFASWLTSAPVFRASWFSTALVGELVLGSPPCSWNVSQLIMARSPSWSSPFTQHPRFPQL

SEQ ID NO: 1589 - protein, 66 aa, Homo Sapiens
MTLCWTEFASWLTSAPVFRASWFSTALVGELVLGSPPCSWNVSQLIMARSPSWSSPFTQHPRFPQL

SEQ ID NO: 1590 - protein, 62 aa, Homo Sapiens
WTEFASWLTSAPVFRASWFSTALVGELVLGSPPCSWNVSQLIMARSPSWSSPFTQHPRFPQL

SEQ ID NO: 1591 - protein, 55 aa, Homo Sapiens
VTSAPVFRASWFSTALVGELVLGSPPCSWNVSQLIMARSPSWSSPFTQHPRFPQL

SEQ ID NO: 1592 - protein, 45 aa, Homo Sapiens
WFSTALVGELVLGSPPCSWNVSQLIMARSPSWSSPFTQHPRFPQL

SEQ ID NO: 1593 - protein, 40 aa, Homo Sapiens
LVGELVLGSPPCSWNVSQLIMARSPSWSSPFTQHPRFPQL

SEQ ID NO: 1594 - protein, 21 aa, Homo Sapiens
IMARSPSWSSPFTQHPRFPQL

SEQ ID NO: 1595 - protein, 5 aa, Homo Sapiens
RFPQL

SEQ ID NO: 1596 - protein, 3 aa, Homo Sapiens
PQL

SEQ ID NO: 1597 - protein, 19 aa, Homo Sapiens
TTPSSPPTPPWSTLIVPSW

SEQ ID NO: 1598 - protein, 17 aa, Homo Sapiens
PSSPPTPPWSTLIVPSW

SEQ ID NO: 1599 - protein, 12 aa, Homo Sapiens
TPPWSTLIVPSW

SEQ ID NO: 1600 - protein, 4 aa, Homo Sapiens
VPSW

SEQ ID NO: 1601 - protein, 2 aa, Homo Sapiens
SW

SEQ ID NO: 1602 - protein, 33 aa, Homo Sapiens
SMTSVVETSISSAQPTLTLTALLARLCPPSLLP

SEQ ID NO: 1603 - protein, 26 aa, Homo Sapiens
TSISSAQPTLTLTALLARLCPPSLLP

SEQ ID NO: 1604 - protein, 18 aa, Homo Sapiens
TLTLTALLARLCPPSLLP

SEQ ID NO: 1605 - protein, 13 aa, Homo Sapiens
ALLARLCPPSLLP

SEQ ID NO: 1606 - protein, 8 aa, Homo Sapiens
MCPPSLLP

SEQ ID NO: 1607 - protein, 5 aa, Homo Sapiens
PSLLP

SEQ ID NO: 1608 - protein, 4 aa, Homo Sapiens
LMEP

SEQ ID NO: 1609 - protein, 30 aa, Homo Sapiens
TWCPTPASTSLWPHMPLSSLLRKPTMNSFL

SEQ ID NO: 1610 - protein, 50 aa, Homo Sapiens
LHLPLHHLLSHVTMRCQGSTMRMKTQLHEGGKRKVIMPSYANKKLRERES

SEQ ID NO: 1611 - protein, 16 aa, Homo Sapiens
APLLRRTNQLQRREDS

SEQ ID NO: 1612 - protein, 20 aa, Homo Sapiens
LLCFKRYELRLPAKRKRKRN

SEQ ID NO: 1613 - protein, 2 aa, Homo Sapiens
GR

SEQ ID NO: 1614 - protein, 39 aa, Homo Sapiens
SGRSSGRTTSFSVRVVLGTTGPRGTTQKARSWWTRCWML

SEQ ID NO: 1615 - skipped

SEQ ID NO: 1616 - protein, 18 aa, Homo Sapiens
CQTQWWSPTTPPSQSTSS

SEQ ID NO: 1617 - protein, 9 aa, Homo Sapiens
KPPSQSTSS

SEQ ID NO: 1618 - protein, 6 aa, Homo Sapiens
SQSTSS

SEQ ID NO: 1619 - protein, 15 aa, Homo Sapiens
TALITKLSTTFASEP

SEQ ID NO: 1620 - protein, 1 aa, Homo Sapiens
G

SEQ ID NO: 1621 - protein, 10 aa, Homo Sapiens
LEIRPSSCGN

SEQ ID NO: 1622 - protein, 61 aa, Homo Sapiens
MRPTMEFHSVLCGVTPTLLVMWLSPQMASLPSQAPGMEPCASGISQRAPPRGDLWAIPRMC

SEQ ID NO: 1623 - protein, 44 aa, Homo Sapiens
LLVMWLSPQMASLPSQAPGMEPCASGISQRAPPRGDLWAIPRMC

SEQ ID NO: 1624 - protein, 32 aa, Homo Sapiens
LPSQAPGMEPCASGISQRAPPRGDLWAIPRMC

SEQ ID NO: 1625 - protein, 15 aa, Homo Sapiens
RAPPRGDLWAIPRMC

SEQ ID NO: 1626 - protein, 11 aa, Homo Sapiens
RGDLWAIPRMC

SEQ ID NO: 1627 - protein, 8 aa, Homo Sapiens
LWAIPRMC

SEQ ID NO: 1628 - protein, 71 aa, Homo Sapiens
SPLTTGRLSLDLEIKPSSYGIPWVCANTLSRMRATQSGCLVSASRPTAATLSSSPVAGTSWSRYGTWLTAS

SEQ ID NO: 1629 - protein, 64 aa, Homo Sapiens
MSLDLEIKPSSYGIPWVCANTLSRMRATQSGCLVSASRPTAATLSSSPVAGTSWSRYGTWLTAS

SEQ ID NO: 1630 - protein, 49 aa, Homo Sapiens
WVCANTLSRMRATQSGCLVSASRPTAATLSSSPVAGTSWSRYGTWLTAS

SEQ ID NO: 1631 - protein, 28 aa, Homo Sapiens
SRPTAATLSSSPVAGTSWSRYGTWLTAS

SEQ ID NO: 1632 - protein, 23 aa, Homo Sapiens
RTLSSSPVAGTSWSRYGTWLTAS

SEQ ID NO: 1633 - protein, 21 aa, Homo Sapiens
LSSSPVAGTSWSRYGTWLTAS

SEQ ID NO: 1634 - protein, 13 aa, Homo Sapiens
TSWSRYGTWLTAS

SEQ ID NO: 1635 - protein, 9 aa, Homo Sapiens
RYGTWLTAS

SEQ ID NO: 1636 - protein, 4 aa, Homo Sapiens
VTAS

SEQ ID NO: 1637 - skipped

SEQ ID NO: 1638 - protein, 8 aa, Homo Sapiens
TTLATQAI

SEQ ID NO: 1639 - protein, 7 aa, Homo Sapiens
TLATQAI

SEQ ID NO: 1640 - protein, 4 aa, Homo Sapiens
TQAI

SEQ ID NO: 1641 - protein, 24 aa, Homo Sapiens
SVLLEARMARPCYGISTKANTFTR

SEQ ID NO: 1642 - protein, 18 aa, Homo Sapiens
RMARPCYGISTKANTFTR

SEQ ID NO: 1643 - protein, 17 aa, Homo Sapiens
MARPCYGISTKANTFTR

SEQ ID NO: 1644 - protein, 15 aa, Homo Sapiens
RPCYGISTKANTFTR

SEQ ID NO: 1645 - protein, 13 aa, Homo Sapiens
CYGISTKANTFTR

SEQ ID NO: 1646 - protein, 23 aa, Homo Sapiens
WPGLLMARLCLLATRTTWCECGR

SEQ ID NO: 1647 - protein, 37 aa, Homo Sapiens
NLMKYSMTFGYYLIMTISSGKGQHMHLPSITWISSRL

SEQ ID NO: 1648 - skipped

SEQ ID NO: 1649 - protein, 13 aa, Homo Sapiens
WIQRTESVLNLIT

SEQ ID NO: 1650 - protein, 23 aa, Homo Sapiens
GMVVGGQNGSLQSLLQPLKWLAS

SEQ ID NO: 1651 - protein, 4 aa, Homo Sapiens
LWLM

SEQ ID NO: 1652 - protein, 12 aa, Homo Sapiens
WLVMVVLEKRPS

SEQ ID NO: 1653 - protein, 4 aa, Homo Sapiens
RFIP

SEQ ID NO: 1654 - protein, 6 aa, Homo Sapiens
RRNSVD

SEQ ID NO: 1655 - protein, 2 aa, Homo Sapiens
LM

SEQ ID NO: 1656 - protein, 14 aa, Homo Sapiens
MCCVATKWILRTGK

SEQ ID NO: 1657 - protein, 12 aa, Homo Sapiens
CVATKWILRTGK

SEQ ID NO: 1658 - protein, 32 aa, Homo Sapiens
METLTWNLLPCLLSPHQKLSWTQLWQHSMSTT

SEQ ID NO: 1659 - protein, 25 aa, Homo Sapiens
LLPCLLSPHQKLSWTQLWQHSMSTT

SEQ ID NO: 1660 - protein, 20 aa, Homo Sapiens
VSPHQKLSWTQLWQHSMSTT

SEQ ID NO: 1661 - protein, 8 aa, Homo Sapiens
WQHSMSTT

SEQ ID NO: 1662 - protein, 41 aa, Homo Sapiens
VSRMRMMTCENEAGAQRQKSSFIGSCPVMSAVQRVCHLIII

SEQ ID NO: 1663 - skipped

SEQ ID NO: 1664 - protein, 3 aa, Homo Sapiens
LHS

SEQ ID NO: 1665 - protein, 6 aa, Homo Sapiens
GEGCFP

SEQ ID NO: 1666 - protein, 19 aa, Homo Sapiens
QQEMDQWPWLGQPQWVAFS

SEQ ID NO: 1667 - protein, 16 aa, Homo Sapiens
LETIDNISRTSFLGFL

SEQ ID NO: 1668 - protein, 18 aa, Homo Sapiens
MVVVSFKQSKVFAILQWE

SEQ ID NO: 1669 - protein, 1 aa, Homo Sapiens
I

SEQ ID NO: 1670 - skipped

SEQ ID NO: 1671 - protein, 24 aa, Homo Sapiens
CSEVTQRTMLPRLELMPTGVLYEH

SEQ ID NO: 1672 - protein, 4 aa, Homo Sapiens
MYEH

SEQ ID NO: 1673 - protein, 9 aa, Homo Sapiens
WKASLFMIF

SEQ ID NO: 1674 - protein, 15 aa, Homo Sapiens
MGETCRNMRRWSTQV

SEQ ID NO: 1675 - protein, 28 aa, Homo Sapiens
WLQLLSVNSQQKISFPICWHPSQSRSKK

SEQ ID NO: 1676 - protein, 2 aa, Homo Sapiens
LM

SEQ ID NO: 1677 - protein, 18 aa, Homo Sapiens
CFIQTESSKSTKMWIRSM

SEQ ID NO: 1678 - protein, 88 aa, Homo Sapiens
VSCFPRSSGPWSRHFGHKCPSSRFSAFQSSRPTPSRSESAGSSPHPQPKTALALRTSWISSVCSVTQPRQTSSPIMPSASLTLMMTEP

SEQ ID NO: 1679 - protein, 13 aa, Homo Sapiens
LCGQPTIKTSFAG

SEQ ID NO: 1680 - protein, 5 aa, Homo Sapiens
GSQPW

SEQ ID NO: 1681 - protein, 1 aa, Homo Sapiens
L

SEQ ID NO: 1682 - protein, 10 aa, Homo Sapiens
VTLSLKMTGG

SEQ ID NO: 1683 - protein, 38 aa, Homo Sapiens
CWQQDHVTSNAECFLPTLKKWMKSQPARPGAARCLLGS

SEQ ID NO: 1684 - protein, 4 aa, Homo Sapiens
MLRL

SEQ ID NO: 1685 - protein, 1 aa, Homo Sapiens
M

SEQ ID NO: 1686 - protein, 1 aa, Homo Sapiens
W

SEQ ID NO: 1687 - protein, 12 aa, Homo Sapiens
PSWQLTRSKRLL

SEQ ID NO: 1688 - protein, 26 aa, Homo Sapiens
WPHFGTTPRLSWFLPPLLRSLELFRA

SEQ ID NO: 1689 - protein, 22 aa, Homo Sapiens
GTTPRLSWFLPPLLRSLELFRA

SEQ ID NO: 1690 - protein, 6 aa, Homo Sapiens
WWPLRC

SEQ ID NO: 1691 - protein, 29 aa, Homo Sapiens
LYRSIWVRAPAWSGMCSAWPRRMHLPSSS

SEQ ID NO: 1692 - protein, 16 aa, Homo Sapiens
GVIVQSGRSTLMWTWW

SEQ ID NO: 1693 - protein, 31 aa, Homo Sapiens
LISSQMKRFDRDSKPIPVGLPILSSMFLESS

SEQ ID NO: 1694 - protein, 35 aa, Homo Sapiens
WTMLSQNVAWTTSGTLTGSSRTMELNSAWRSSWRT

SEQ ID NO: 1695 - protein, 14 aa, Homo Sapiens
LPRCSRRERNTFQD

SEQ ID NO: 1696 - protein, 1 aa, Homo Sapiens
L

SEQ ID NO: 1697 - protein, 11 aa, Homo Sapiens
LFWYLLELSWN

SEQ ID NO: 1698 - protein, 8 aa, Homo Sapiens
MACQFQRS

SEQ ID NO: 1699 - protein, 22 aa, Homo Sapiens
WYVVLQKTFEILMKSHLYFVPP

SEQ ID NO: 1700 - protein, 35 aa, Homo Sapiens
ISMLITSEFVKFWALVSVPLQYCMAWFLRRKPKVM

SEQ ID NO: 1701 - protein, 26 aa, Homo Sapiens
VKFWALVSVPLQYCMAWFLRRKPKVM

SEQ ID NO: 1702 - protein, 17 aa, Homo Sapiens
DWPRKPSQRPQGPRSRS

SEQ ID NO: 1703 - protein, 9 aa, Homo Sapiens
VLKTVRMLM

SEQ ID NO: 1704 - protein, 38 aa, Homo Sapiens
LQICGKCSSVTAWTLAAGRSCKMEGCRWWKSRTLAKRS

SEQ ID NO: 1705 - protein, 7 aa, Homo Sapiens
MFALPPR

SEQ ID NO: 1706 - protein, 9 aa, Homo Sapiens
GRFPRRRLR

SEQ ID NO: 1707 - protein, 7 aa, Homo Sapiens
WAGLGER

SEQ ID NO: 1708 - protein, 32 aa, Homo Sapiens
PLVFSSCPWRRSGLSVISSLCTLLSCPPRQAC

SEQ ID NO: 1709 - protein, 24 aa, Homo Sapiens
WRRSGLSVISSLCTLLSCPPRQAC

SEQ ID NO: 1710 - protein, 19 aa, Homo Sapiens
LSVISSLCTLLSCPPRQAC

SEQ ID NO: 1711 - protein, 12 aa, Homo Sapiens
QLQLWESTVRQL

SEQ ID NO: 1712 - protein, 44 aa, Homo Sapiens
VGERGRKREMRLPYLLMHMMNLGVRMESGLHPNSSDKLRLWTHP

SEQ ID NO: 1713 - protein, 15 aa, Homo Sapiens
DCLLWLNFLLERITI

SEQ ID NO: 1714 - protein, 68 aa, Homo Sapiens
LRSVPRPPASLSSAAAAATPSPTLPCALASRAMPCPGSATQIRLGAPNAHWTRTSSCPTNANAWTSRP

SEQ ID NO: 1715 - protein, 26 aa, Homo Sapiens
SRTGRLSGPGVLVSSPSPTQSMLQLP

SEQ ID NO: 1716 - protein, 16 aa, Homo Sapiens
VLVSSPSPTQSMLQLP

SEQ ID NO: 1717 - protein, 15 aa, Homo Sapiens
LVSSPSPTQSMLQLP

SEQ ID NO: 1718 - protein, 86 aa, Homo Sapiens
AMGVAGIMTVDLEGMDMDMDVPETIMAETRVVMTATQEEITETIMTTEMRHAHNIDTQGIISDPGSSFQMAVFIKVFGAAPKHLIL

SEQ ID NO: 1719 - protein, 56 aa, Homo Sapiens
VVMTATQEEITETIMTTEMRHAHNIDTQGIISDPGSSFQMAVFIKVFGAAPKHLIL

SEQ ID NO: 1720 - protein, 51 aa, Homo Sapiens
TQEEITETIMTTEMRHAHNIDTQGIISDPGSSFQMAVFIKVFGAAPKHLIL

SEQ ID NO: 1721 - protein, 8 aa, Homo Sapiens
LCCLEQKY

SEQ ID NO: 1722 - protein, 14 aa, Homo Sapiens
LPQETTGRRLRRTA

SEQ ID NO: 1723 - protein, 2 aa, Homo Sapiens
MQ

SEQ ID NO: 1724 - protein, 10 aa, Homo Sapiens
LMMQLQNWIR

SEQ ID NO: 1725 - protein, 9 aa, Homo Sapiens
VLLRACAWP

SEQ ID NO: 1726 - protein, 2 aa, Homo Sapiens
SR

SEQ ID NO: 1727 - protein, 41 aa, Homo Sapiens
CVLVPVKQNYSAPVPHAMHLLSPSMHPILRVQPLSMESSKT

SEQ ID NO: 1728 - protein, 21 aa, Homo Sapiens
VSPSMHPILRVQPLSMESSKT

SEQ ID NO: 1729 - protein, 7 aa, Homo Sapiens
SMESSKT

SEQ ID NO: 1730 - protein, 37 aa, Homo Sapiens
MTLRGNIWCFSSILWISPLCVLQKLLLLVTKLTNFTT

SEQ ID NO: 1731 - protein, 30 aa, Homo Sapiens
WCFSSILWISPLCVLQKLLLLVTKLTNFTT

SEQ ID NO: 1732 - protein, 23 aa, Homo Sapiens
WISPLCVLQKLLLLVTKLTNFTT

SEQ ID NO: 1733 - protein, 19 aa, Homo Sapiens
LCVLQKLLLLVTKLTNFTT

SEQ ID NO: 1734 - protein, 13 aa, Homo Sapiens
MLLLVTKLTNFTT

SEQ ID NO: 1735 - protein, 11 aa, Homo Sapiens
LLVTKLTNFTT

SEQ ID NO: 1736 - protein, 3 aa, Homo Sapiens
WAT

SEQ ID NO: 1737 - protein, 7 aa, Homo Sapiens
PETTVCC

SEQ ID NO: 1738 - protein, 6 aa, Homo Sapiens
MESSSI

SEQ ID NO: 1739 - protein, 15 aa, Homo Sapiens
TISQWAEAWKKPSAW

SEQ ID NO: 1740 - protein, 24 aa, Homo Sapiens
QRTGHRILLRSSQVQLLPKSTFRR

SEQ ID NO: 1741 - protein, 31 aa, Homo Sapiens
CMMIRMDYERRSSMPFQDPMSLLNSIIDSSK

SEQ ID NO: 1742 - protein, 5 aa, Homo Sapiens
CCWGL

SEQ ID NO: 1743 - protein, 4 aa, Homo Sapiens
CWGL

SEQ ID NO: 1744 - protein, 11 aa, Homo Sapiens
AALCSRASTYV

SEQ ID NO: 1745 - protein, 11 aa, Homo Sapiens
LCLEAKITSTA

SEQ ID NO: 1746 - protein, 20 aa, Homo Sapiens [sequence omitted]

SEQ ID NO: 1747 - protein, 15 aa, Homo Sapiens
AITTPSWLCATPGAV

SEQ ID NO: 1748 - protein, 10 aa, Homo Sapiens
LMRPLLNLIH

SEQ ID NO: 1749 - protein, 59 aa, Homo Sapiens
GHQTVQEKNVMRQKGLKTKSIQGVILLSFKKPFYTSPFLIPLGFPIAKKPIHVYGINCL

SEQ ID NO: 1750 - protein, 14 aa, Homo Sapiens
WQETVSVDVPHLKF

SEQ ID NO: 1751 - protein, 11 aa, Homo Sapiens
LLCLWRALKPE

SEQ ID NO: 1752 - protein, 24 aa, Homo Sapiens
CILSTGSGASTLRASLTSLLWWPA

SEQ ID NO: 1753 - protein, 12 aa, Homo Sapiens
RRTLHRGARPRT

SEQ ID NO: 1754 - protein, 7 aa, Homo Sapiens
VNDRDCQ

SEQ ID NO: 1755 - protein, 2 aa, Homo Sapiens
CQ

SEQ ID NO: 1756 - protein, 3 aa, Homo Sapiens
LAR

SEQ ID NO: 1757 - protein, 29 aa, Homo Sapiens
LWCAGLGPTSVERRQRSSSPLRASRASPA

SEQ ID NO: 1758 - protein, 29 aa, Homo Sapiens
LSSLCVSWGTSSTVTRLRPWISPTWTSRR

SEQ ID NO: 1759 - protein, 5 aa, Homo Sapiens
WPQSL

SEQ ID NO: 1760 - protein, 2 aa, Homo Sapiens
QV

SEQ ID NO: 1761 - protein, 2 aa, Homo Sapiens
VT

SEQ ID NO: 1762 - protein, 47 aa, Homo Sapiens
TFTWLSTSWCHCSRKTGRMSGPYISRAPWASPSAYIKAHLNKFYYQF

SEQ ID NO: 1763 - protein, 35 aa, Homo Sapiens
SRKTGRMSGPYISRAPWASPSAYIKAHLNKFYYQF

SEQ ID NO: 1764 - protein, 25 aa, Homo Sapiens
YISRAPWASPSAYIKAHLNKFYYQF

SEQ ID NO: 1765 - protein, 19 aa, Homo Sapiens
WASPSAYIKAHLNKFYYQF

SEQ ID NO: 1766 - protein, 53 aa, Homo Sapiens
LGSLRPMSEKSLTRPAKLPPVCYSLMSWIRLPRLVEVTLEMVVGLLTESSTRS

SEQ ID NO: 1767 - protein, 1 aa, Homo Sapiens
L

SEQ ID NO: 1768 - protein, 44 aa, Homo Sapiens
WTQLNPLKLLQPSILHLFILRKNFLLQAVKILNFISMIIIVEKN

SEQ ID NO: 1769 - protein, 36 aa, Homo Sapiens
LLEVFMERVVHGGMSIFLKKMSHSLSSWSLMKIKPN

SEQ ID NO: 1770 - protein, 84 aa, Homo Sapiens
LVIVVTKMMVLSRDHQNQEAITAILPHLLFKISNDHPDEDTVNSLYPDFLLSACRKHHHSSRGTDQQDIPRSNHSGNLEFSGRK

SEQ ID NO: 1771 - protein, 14 aa, Homo Sapiens
LEVKLQHTLLLKTK

SEQ ID NO: 1772 - skipped

SEQ ID NO: 1773 - protein, 7 aa, Homo Sapiens
TAWSAQP

SEQ ID NO: 1774 - protein, 50 aa, Homo Sapiens
RVVRSCRMPTTSSRRWLTSARPPCCCSMGRRPATWPRAAGRPLRACCRRR

SEQ ID NO: 1775 - protein, 33 aa, Homo Sapiens
QCVCWCWEWRDPGKPLLYRGSQDTCMPKALHRM

SEQ ID NO: 1776 - skipped

SEQ ID NO: 1777 - protein, 4 aa, Homo Sapiens
RYPC

SEQ ID NO: 1778 - protein, 2 aa, Homo Sapiens
GS

SEQ ID NO: 1779 - protein, 3 aa, Homo Sapiens
SQS

SEQ ID NO: 1780 - protein, 37 aa, Homo Sapiens
CYLFLVGLPLTFLRTRRKRTTSNSMSAVCSSWTAVMS

SEQ ID NO: 1781 - protein, 25 aa, Homo Sapiens
LRTRRKRTTSNSMSAVCSSWTAVMS

SEQ ID NO: 1782 - protein, 28 aa, Homo Sapiens
LPFRQKLPNSCPSSSIPSIPTRRFSFGS

SEQ ID NO: 1783 - protein, 58 aa, Homo Sapiens
MLRSALSSSLSWQKTRRITRNSMRHSLKISSLESTKTPLTAAACLSCCAIIPPSLEMR

SEQ ID NO: 1784 - protein, 22 aa, Homo Sapiens
MPNSCPSSSIPSIPTRRFSFGS

SEQ ID NO: 1785 - protein, 14 aa, Homo Sapiens
LWSECGNGASRWYI

SEQ ID NO: 1786 - protein, 39 aa, Homo Sapiens
LMGRAWSQLPRRVWSCLRMRRRRRRWKRARQSLRTSASS

SEQ ID NO: 1787 - skipped

SEQ ID NO: 1788 - protein, 8 aa, Homo Sapiens
WTRFAMRA

SEQ ID NO: 1789 - protein, 4 aa, Homo Sapiens
RVKS

SEQ ID NO: 1790 - protein, 11 aa, Homo Sapiens
MTSSPTLRNVP

SEQ ID NO: 1791 - protein, 1 aa, Homo Sapiens
W

SEQ ID NO: 1792 - protein, 2 aa, Homo Sapiens
MA

SEQ ID NO: 1793 - protein, 23 aa, Homo Sapiens
WEPLPSLVLKHSWRLFRLVQTSP

SEQ ID NO: 1794 - protein, 20 aa, Homo Sapiens
MPSLVLKHSWRLFRLVQTSP

SEQ ID NO: 1795 - protein, 16 aa, Homo Sapiens
LVLAFILPTWWQRKWL

SEQ ID NO: 1796 - skipped

SEQ ID NO: 1797 - protein, 31 aa, Homo Sapiens
KMMNSMLGSLLLEVPSLCVLTMVSPLAGVPK

SEQ ID NO: 1798 - protein, 6 aa, Homo Sapiens
MAGVPK

SEQ ID NO: 1799 - skipped

SEQ ID NO: 1800 - protein, 1 aa, Homo Sapiens
K

SEQ ID NO: 1801 - protein, 44 aa, Homo Sapiens
ASVMSFPPSLTRPSTLTFKWAMSLPFSQTWGTGSQLSPRWSPPA

SEQ ID NO: 1802 - protein, 2 aa, Homo Sapiens
TR

SEQ ID NO: 1803 - protein, 7 aa, Homo Sapiens
LWSRLRL

SEQ ID NO: 1804 - protein, 58 aa, Homo Sapiens
TTSGPPAASSGGPCEVCCPTKPSEARPLWTVSRCLTASHRPTTRKSGWWFLLPSRSCV

SEQ ID NO: 1805 - protein, 45 aa, Homo Sapiens
CEVCCPTKPSEARPLWTVSRCLTASHRPTTRKSGWWFLLPSRSCV

SEQ ID NO: 1806 - protein, 36 aa, Homo Sapiens
SEARPLWTVSRCLTASHRPTTRKSGWWFLLPSRSCV

SEQ ID NO: 1807 - protein, 33 aa, Homo Sapiens
RPLWTVSRCLTASHRPTTRKSGWWFLLPSRSCV

SEQ ID NO: 1808 - protein, 31 aa, Homo Sapiens
LWTVSRCLTASHRPTTRKSGWWFLLPSRSCV

SEQ ID NO: 1809 - protein, 24 aa, Homo Sapiens
LTASHRPTTRKSGWWFLLPSRSCV

SEQ ID NO: 1810 - protein, 17 aa, Homo Sapiens
TTRKSGWWFLLPSRSCV

SEQ ID NO: 1811 - protein, 17 aa, Homo Sapiens
LPIWGAWLTRLAGSTRQ

SEQ ID NO: 1812 - protein, 15 aa, Homo Sapiens
IWGAWLTRLAGSTRQ

SEQ ID NO: 1813 - protein, 20 aa, Homo Sapiens
PWRRRGKRKPRSTTGRRNSS

SEQ ID NO: 1814 - protein, 1 aa, Homo Sapiens
S

SEQ ID NO: 1815 - protein, 21 aa, Homo Sapiens
MTNTQRSSRPTDSWSEPNKDC

SEQ ID NO: 1816 - protein, 19 aa, Homo Sapiens
NTQRSSRPTDSWSEPNKDC

SEQ ID NO: 1817 - protein, 14 aa, Homo Sapiens
SRPTDSWSEPNKDC

SEQ ID NO: 1818 - protein, 11 aa, Homo Sapiens
TDSWSEPNKDC

SEQ ID NO: 1819 - protein, 30 aa, Homo Sapiens
SWLNRYCWAGRWWSYAVKASTFLAISTETS

SEQ ID NO: 1820 - protein, 1 aa, Homo Sapiens
S

SEQ ID NO: 1821 - protein, 33 aa, Homo Sapiens
QSDRFCTSGTCWRPAISRPSGKPWMKTWTSWKV

SEQ ID NO: 1822 - protein, 28 aa, Homo Sapiens
CTSGTCWRPAISRPSGKPWMKTWTSWKV

SEQ ID NO: 1823 - protein, 9 aa, Homo Sapiens
WLKTSVSAI

SEQ ID NO: 1824 - protein, 22 aa, Homo Sapiens
SMWQKGRNRPRSWPPKQKRLNR

SEQ ID NO: 1825 - protein, 9 aa, Homo Sapiens
MRLVMTLKL

SEQ ID NO: 1826 - protein, 77 aa, Homo Sapiens
CPQFPFLLIRMSPGNIWNQKNTRSDMVLAPSGLTTAATTRVVYPHSGLGRHVFVGIKLLGIPAPSVEITSCMLTLGT

SEQ ID NO: 1827 - protein, 18 aa, Homo Sapiens
LSAPTRVSSSMLHTQESV

SEQ ID NO: 1828 - protein, 25 aa, Homo Sapiens
IMVSSFTTSPRLNHGTLTSVPLMGL

SEQ ID NO: 1829 - protein, 1 aa, Homo Sapiens
E

SEQ ID NO: 1830 - protein, 1 aa, Homo Sapiens
E

SEQ ID NO: 1831 - protein, 11 aa, Homo Sapiens
LQQLLHMDYIN

SEQ ID NO: 1832 - protein, 8 aa, Homo Sapiens
MLHMDYIN

SEQ ID NO: 1833 - protein, 6 aa, Homo Sapiens
HMDYIN

SEQ ID NO: 1834 - protein, 8 aa, Homo Sapiens
EILKCPFI

SEQ ID NO: 1835 - protein, 2 aa, Homo Sapiens
LL

SEQ ID NO: 1836 - skipped

SEQ ID NO: 1837 - protein, 45 aa, Homo Sapiens
VWAIPCIGNSGQNLSLRRRDAVLVLLEELALVRCLIIKVTYYCWK

SEQ ID NO: 1838 - protein, 32 aa, Homo Sapiens
LSLRRRDAVLVLLEELALVRCLIIKVTYYCWK

SEQ ID NO: 1839 - protein, 39 aa, Homo Sapiens
WIPKTTSKHLSRCIDGISGFLNDFTFCLEFSRHRCQLTE

SEQ ID NO: 1840 - protein, 13 aa, Homo Sapiens
ALAPILKGLRTGQ

SEQ ID NO: 1841 - protein, 51 aa, Homo Sapiens
PVPPSIWKDFSASSSRKLSFRSQRTCRRFPRHMWSAPSLSTAVHLASPSSP

SEQ ID NO: 1842 - protein, 4 aa, Homo Sapiens
ESSS

SEQ ID NO: 1843 - protein, 27 aa, Homo Sapiens
CFTFPMGKQSMPPKTTSAASCGSFLAS

SEQ ID NO: 1844 - protein, 20 aa, Homo Sapiens
WLLSLELQDLATVSLWQPLA

SEQ ID NO: 1845 - protein, 54 aa, Homo Sapiens
SGTTPLPALRASTFWIPPHGPSALNPSTLWNGMYLCFLSSWLLVELNSSCVLFK

SEQ ID NO: 1846 - protein, 4 aa, Homo Sapiens
VPSP

SEQ ID NO: 1847 - protein, 1 aa, Homo Sapiens
M

SEQ ID NO: 1848 - protein, 3 aa, Homo Sapiens
FLG

SEQ ID NO: 1849 - protein, 8 aa, Homo Sapiens
DLFLILEL

SEQ ID NO: 1850 - protein, 9 aa, Homo Sapiens
VMRLLIESS

SEQ ID NO: 1851 - protein, 30 aa, Homo Sapiens
LLLEGLLLVLEHCATMAWDCLMRLELLKRL

SEQ ID NO: 1852 - protein, 2 aa, Homo Sapiens
MV

SEQ ID NO: 1853 - protein, 57 aa, Homo Sapiens
CWKRLLGKEYVMPLQLKNPRLRQKSRTRCNRNHRRKQNFLIMKNQLLWLLPLQRAIR

SEQ ID NO: 1854 - protein, 1 aa, Homo Sapiens
L

SEQ ID NO: 1855 - protein, 1 aa, Homo Sapiens
W

SEQ ID NO: 1856 - protein, 9 aa, Homo Sapiens
STPCSRGWR

SEQ ID NO: 1857 - protein, 33 aa, Homo Sapiens
SHRRVEPQQPPQPCVPVYWCSPWPSTPCSRGWR

SEQ ID NO: 1858 - protein, 119 aa, Homo Sapiens
ALPASTVRRWNTSTHSSTRPLISSLERGGPSSSLRCRRTGPMGLPAPGSPRRQRMSSCRWMTSLTPGLTWISRMIRRPVRSSSSPSCPWPWWPLMKWRRTTIPCTAVRVRSWPAGRISG

SEQ ID NO: 1859 - protein, 50 aa, Homo Sapiens
FLPGLGRYRMPSGKMWYRKPSKPGRHPLPGSDHSESCLIFLHSRPEPAQD

SEQ ID NO: 1860 - protein, 13 aa, Homo Sapiens
LTLLSFKTVLFKA

SEQ ID NO: 1861 - protein, 4 aa, Homo Sapiens
LKMK

SEQ ID NO: 1862 - protein, 7 aa, Homo Sapiens
MWRPFGS

SEQ ID NO: 1863 - protein, 23 aa, Homo Sapiens
WTPAASCSLFLCSLPYSSFLRLI

SEQ ID NO: 1864 - protein, 21 aa, Homo Sapiens
MLCTLPLKHLLSTFCQPMKWP

SEQ ID NO: 1865 - protein, 26 aa, Homo Sapiens
MENSLGCPLKILKKRIRFLKRQEAVA

SEQ ID NO: 1866 - protein, 26 aa, Homo Sapiens
LYGSCKSLSCLMCLSPAFGVKSIRLC

SEQ ID NO: 1867 - protein, 1 aa, Homo Sapiens
L

SEQ ID NO: 1868 - protein, 64 aa, Homo Sapiens
WRKRKRNWPRKQGRRLLTIWLLGKMNELGSVWSTLSGKTTSWRPWRSWSCTVTCCWLGLALSSL

SEQ ID NO: 1869 - protein, 11 aa, Homo Sapiens
SSWVTQTSWWE

SEQ ID NO: 1870 - protein, 3 aa, Homo Sapiens
LED

SEQ ID NO: 1871 - skipped

SEQ ID NO: 1872 - protein, 5 aa, Homo Sapiens
AEAQL

SEQ ID NO: 1873 - protein, 13 aa, Homo Sapiens
EKTSCLMRMSQYH

SEQ ID NO: 1874 - protein, 47 aa, Homo Sapiens
METDAWLLSCGWIFSKYTDKARFVSVSKFKPLSNKSALKNVHPFSLW

SEQ ID NO: 1875 - protein, 31 aa, Homo Sapiens
LISSLLMPELGGSYPHSLGDISIKERKFQYL

SEQ ID NO: 1876 - protein, 19 aa, Homo Sapiens
SYPHSLGDISIKERKFQYL

SEQ ID NO: 1877 - protein, 14 aa, Homo Sapiens
MGDISIKERKFQYL

SEQ ID NO: 1878 - protein, 15 aa, Homo Sapiens
VTEPDWFPISQDFAL

SEQ ID NO: 1879 - protein, 9 aa, Homo Sapiens
FPISQDFAL

SEQ ID NO: 1880 - protein, 2 aa, Homo Sapiens
AL

SEQ ID NO: 1881 - protein, 31 aa, Homo Sapiens [sequence omitted]

SEQ ID NO: 1882 - protein, 13 aa, Homo Sapiens
LDLKIRGSSFLGT

SEQ ID NO: 1883 - protein, 12 aa, Homo Sapiens
DLKIRGSSFLGT

SEQ ID NO: 1884 - protein, 23 aa, Homo Sapiens
LIVTSMGLLHRRKAWFIKLCLMF

SEQ ID NO: 1885 - protein, 15 aa, Homo Sapiens
VHRRKAWFIKLCLMF

SEQ ID NO: 1886 - protein, 4 aa, Homo Sapiens
CLMF

SEQ ID NO: 1887 - protein, 1 aa, Homo Sapiens
L

SEQ ID NO: 1888 - protein, 18 aa, Homo Sapiens [sequence omitted]

SEQ ID NO: 1889 - protein, 3 aa, Homo Sapiens
RTP

SEQ ID NO: 1890 - protein, 30 aa, Homo Sapiens
STTSGPQTTPWTGRWLARMSFSWSRPRRKE

SEQ ID NO: 1891 - protein, 24 aa, Homo Sapiens
QTTPWTGRWLARMSFSWSRPRRKE

SEQ ID NO: 1892 - protein, 20 aa, Homo Sapiens
WTGRWLARMSFSWSRPRRKE

SEQ ID NO: 1893 - protein, 13 aa, Homo Sapiens
RMSFSWSRPRRKE

SEQ ID NO: 1894 - protein, 9 aa, Homo Sapiens
SWSRPRRKE

SEQ ID NO: 1895 - protein, 155 aa, Homo Sapiens
QHACTPSRPRRPPWRWRLPELPTIHPLKTTRPCSQRPTRWSCSGRRRRRSWSGSWPCPPRSRPPPRSPHSRSCARGCWRSRMVRGSQARARGRRLGMPRSVPRPPAWPPQRRRRSSSGGGRRLCTGCGYSRPRCGPPGSGTRSCSGCAGSRPRWP

SEQ ID NO: 1896 - protein, 142 aa, Homo Sapiens
WRWRLPELPTIHPLKTTRPCSQRPTRWSCSGRRRRRSWSGSWPCPPRSRPPPRSPHSRSCARGCWRSRMVRGSQARARGRRLGMPRSVPRPPAWPPQRRRRSSSGGGRRLCTGCGYSRPRCGPPGSGTRSCSGCAGSRPRWP

SEQ ID NO: 1897 - protein, 136 aa, Homo Sapiens
ELPTIHPLKTTRPCSQRPTRWSCSGRRRRRSWSGSWPCPPRSRPPPRSPHSRSCARGCWRSRMVRGSQARARGRRLGMPRSVPRPPAWPPQRRRRSSSGGGRRLCTGCGYSRPRCGPPGSGTRSCSGCAGSRPRWP

SEQ ID NO: 1898 - protein, 118 aa, Homo Sapiens
TRWSCSGRRRRRSWSGSWPCPPRSRPPPRSPHSRSCARGCWRSRMVRGSQARARGRRLGMPRSVPRPPAWPPQRRRRSSSGGGRRLCTGCGYSRPRCGPPGSGTRSCSGCAGSRPRWP

SEQ ID NO: 1899 - protein, 6 aa, Homo Sapiens
LRWTQR

SEQ ID NO: 1900 - protein, 21 aa, Homo Sapiens
DARRRLWPSQGTRASRLRWTG

SEQ ID NO: 1901 - protein, 8 aa, Homo Sapiens
ASRLRWTG

SEQ ID NO: 1902 - protein, 13 aa, Homo Sapiens
KDLVLLPEKANPL

SEQ ID NO: 1903 - protein, 40 aa, Homo Sapiens
WNGNGSAGDKGKSCQQHDSGYRKMRCAGLLRRGGGKRPRS

SEQ ID NO: 1904 - protein, 23 aa, Homo Sapiens
LEIIFIGGHWKMGRKKQLPVDCP

SEQ ID NO: 1905 - protein, 3 aa, Homo Sapiens
LLW

SEQ ID NO: 1906 - protein, 9 aa, Homo Sapiens
CLPCVSSPP

SEQ ID NO: 1907 - protein, 10 aa, Homo Sapiens
DFWKRSQRQR

SEQ ID NO: 1908 - protein, 19 aa, Homo Sapiens
CLVIPLNYQKKISSSTKIK

SEQ ID NO: 1909 - skipped

SEQ ID NO: 1910 - protein, 1 aa, Homo Sapiens
M

SEQ ID NO: 1911 - skipped

SEQ ID NO: 1912 - protein, 5 aa, Homo Sapiens
WFRSA

SEQ ID NO: 1913 - protein, 4 aa, Homo Sapiens
MAVS

SEQ ID NO: 1914 - protein, 11 aa, Homo Sapiens
GWDLLPVQYCG

SEQ ID NO: 1915 - protein, 29 aa, Homo Sapiens
RSQRRRLTFFVPIPKSGMFIVSSMSFIPW

SEQ ID NO: 1916 - protein, 23 aa, Homo Sapiens
MTFFVPIPKSGMFIVSSMSFIPW

SEQ ID NO: 1917 - protein, 1 aa, Homo Sapiens
G

SEQ ID NO: 1918 - protein, 12 aa, Homo Sapiens
VTSSSVRVSMRC

SEQ ID NO: 1919 - protein, 11 aa, Homo Sapiens
CGLQVVDPIFH

SEQ ID NO: 1920 - protein, 8 aa, Homo Sapiens
LMNQQNNL

SEQ ID NO: 1921 - protein, 51 aa, Homo Sapiens
QCHPEEIPLAASPASSWVSSDCPERCRSVCFLHACELHNLSLTVHLLDLFH

SEQ ID NO: 1922 - protein, 5 aa, Homo Sapiens
CFCVT

SEQ ID NO: 1923 - protein, 9 aa, Homo Sapiens
IWAACPARD

SEQ ID NO: 1924 - protein, 46 aa, Homo Sapiens
RCSSSRFVFPEVIGGCLRSTCGLLASGTQTSALKERITSLNQYIDT

SEQ ID NO: 1925 - protein, 39 aa, Homo Sapiens
VFPEVIGGCLRSTCGLLASGTQTSALKERITSLNQYIDT

SEQ ID NO: 1926 - protein, 30 aa, Homo Sapiens
LRSTCGLLASGTQTSALKERITSLNQYIDT

SEQ ID NO: 1927 - protein, 5 aa, Homo Sapiens
QYIDT

SEQ ID NO: 1928 - protein, 27 aa, Homo Sapiens
ARILLLSLACKLLASGSGAKKIRFMHV

SEQ ID NO: 1929 - protein, 2 aa, Homo Sapiens
SS

SEQ ID NO: 1930 - protein, 1 aa, Homo Sapiens
A

SEQ ID NO: 1931 - protein, 2 aa, Homo Sapiens
PS

SEQ ID NO: 1932 - protein, 67 aa, Homo Sapiens
ARCSDFANLNVIKTLKRSAILAKLGGPKHSGKQLVKSLQWIIHLNLKNVEMNLSNTSESYGIKLLMR

SEQ ID NO: 1933 - protein, 61 aa, Homo Sapiens
ANLNVIKTLKRSAILAKLGGPKHSGKQLVKSLQWIIHLNLKNVEMNLSNTSESYGIKLLMR

SEQ ID NO: 1934 - protein, 19 aa, Homo Sapiens
VEMNLSNTSESYGIKLLMR

SEQ ID NO: 1935 - protein, 4 aa, Homo Sapiens
ILMR

SEQ ID NO: 1936 - protein, 3 aa, Homo Sapiens
MMR

SEQ ID NO: 1937 - protein, 67 aa, Homo Sapiens [sequence omitted]

SEQ ID NO: 1938 - protein, 60 aa, Homo Sapiens
LLQAKGNSWKRKWYSSYKRMWTWKMLLKNLCNHFFYVHLKMPFGYLELLNYFIFYIRSLK

SEQ ID NO: 1939 - protein, 54 aa, Homo Sapiens
NSWKRKWYSSYKRMWTWKMLLKNLCNHFFYVHLKMPFGYLELLNYFIFYIRSLK

SEQ ID NO: 1940 - protein, 52 aa, Homo Sapiens
WKRKWYSSYKRMWTWKMLLKNLCNHFFYVHLKMPFGYLELLNYFIFYIRSLK

SEQ ID NO: 1941 - protein, 23 aa, Homo Sapiens
LVSCLEEPLVSKTEIFQEEVILL

SEQ ID NO: 1942 - protein, 4 aa, Homo Sapiens
ITCV

SEQ ID NO: 1943 - protein, 2 aa, Homo Sapiens
VL

SEQ ID NO: 1944 - protein, 18 aa, Homo Sapiens
DTGSASFGAAAVCFLSEP

SEQ ID NO: 1945 - protein, 25 aa, Homo Sapiens
ATRVGLPSRRMMSSCSMAPRRMWTC

SEQ ID NO: 1946 - protein, 1 aa, Homo Sapiens
A

SEQ ID NO: 1947 - protein, 4 aa, Homo Sapiens
WMLS

SEQ ID NO: 1948 - protein, 8 aa, Homo Sapiens
RLRIYKTS

SEQ ID NO: 1949 - protein, 53 aa, Homo Sapiens
VMKTVLIWMRQHLHLQFQKVFPLIQKTRMEFWWMNLDCHRSLLHRFASFKHIL

SEQ ID NO: 1950 - protein, 96 aa, Homo Sapiens
CWCPQLKPTRVLKISGANASVHLIETSVGTFTTRMYPRRTATACTWWSPCQCLAMTWRPTACCASAGTRSAAPPPSRSSLSSTCPWWVPCCSTWPS

SEQ ID NO: 1951 - protein, 25 aa, Homo Sapiens
RPPPSRSSLSSTCPWWVPCCSTWPS

SEQ ID NO: 1952 - protein, 44 aa, Homo Sapiens
RSFRPGTAATRTQGSTARPLFTSIRCTKTRPAISFTTVAAFSRV

SEQ ID NO: 1953 - protein, 12 aa, Homo Sapiens
CAYFPESLLPKL

SEQ ID NO: 1954 - protein, 84 aa, Homo Sapiens
LAKMNSREFQRTLLISVRRQLQQASLAGCMGEYQLLFMLNNNTLSRARQKFIITGLMLCNLHIVLPHEASFVMAGAGVGELQCL

SEQ ID NO: 1955 - protein, 11 aa, Homo Sapiens
AASWALSPSCC

SEQ ID NO: 1956 - protein, 26 aa, Homo Sapiens
APKNSETFSSRWLKSTGRSRISWKKC

SEQ ID NO: 1957 - protein, 37 aa, Homo Sapiens
AARILRSTRTRSCSTSTPSATSRASWRITCPTATRPH

SEQ ID NO: 1958 - protein, 3 aa, Homo Sapiens
LWR

SEQ ID NO: 1959 - protein, 65 aa, Homo Sapiens
ASHSSQAHLMVASAFLLCSGSVMLTRSLKTLPSACTAFLLLFFLFSSGDPELSCSCTLRTQSSWS

SEQ ID NO: 1960 - protein, 57 aa, Homo Sapiens
ALSISLKTRMHPSSSVVIYRRRMEKDVPMLPQSQRRKMGCPSVLNMSVGMPWHFMLK

SEQ ID NO: 1961 - protein, 3 aa, Homo Sapiens
MVI

SEQ ID NO: 1962 - protein, 1 aa, Homo Sapiens
R

SEQ ID NO: 1963 - protein, 41 aa, Homo Sapiens
LTWRIWEIKLCTAVVGGPKSSHSVMGLTQNITKRLETMWAL

SEQ ID NO: 1964 - protein, 36 aa, Homo Sapiens
WEIKLCTAVVGGPKSSHSVMGLTQNITKRLETMWAL

SEQ ID NO: 1965 - protein, 8 aa, Homo Sapiens
RKARRFLL

SEQ ID NO: 1966 - protein, 2 aa, Homo Sapiens
LL

SEQ ID NO: 1967 - protein, 34 aa, Homo Sapiens
QISMVSLGGRQVRPLDTLTQPPIRTKASSGERIH

SEQ ID NO: 1968 - protein, 28 aa, Homo Sapiens
LGGRQVRPLDTLTQPPIRTKASSGERIH

SEQ ID NO: 1969 - protein, 19 aa, Homo Sapiens
DTLTQPPIRTKASSGERIH

SEQ ID NO: 1970 - protein, 12 aa, Homo Sapiens
IRTKASSGERIH

SEQ ID NO: 1971 - protein, 4 aa, Homo Sapiens
ERIH

SEQ ID NO: 1972 - protein, 12 aa, Homo Sapiens
WRIPRSTSLEQK

SEQ ID NO: 1973 - protein, 12 aa, Homo Sapiens
LSALRRRKKGQT

SEQ ID NO: 1974 - protein, 15 aa, Homo Sapiens
GLDSEKRKSQWLLRQ

SEQ ID NO: 1975 - protein, 26 aa, Homo Sapiens
WNLTLKKFLVHLFLVIGKTSPWKIVV

SEQ ID NO: 1976 - protein, 18 aa, Homo Sapiens
LVHLFLVIGKTSPWKIVV

SEQ ID NO: 1977 - protein, 91 aa, Homo Sapiens
GTASRRRPPPLRPRPCPELPPQIGRRAQPGGRRPGRRGLTAPRAWRARTASPWTAATVASGRRKTRLTWMGCRCPTSSCSVTLRMNTCVPT

SEQ ID NO: 1978 - protein, 53 aa, Homo Sapiens
LTAPRAWRARTASPWTAATVASGRRKTRLTWMGCRCPTSSCSVTLRMNTCVPT

SEQ ID NO: 1979 - protein, 12 aa, Homo Sapiens
RRGWALDALRAC

SEQ ID NO: 1980 - protein, 39 aa, Homo Sapiens
TASRAACGGRCWTSAWSRARAATAWASWHSTPAWCPPSS

SEQ ID NO: 1981 - protein, 33 aa, Homo Sapiens
CGGRCWTSAWSRARAATAWASWHSTPAWCPPSS

SEQ ID NO: 1982 - protein, 16 aa, Homo Sapiens
CLAPPTLPSSLASASP

SEQ ID NO: 1983 - protein, 47 aa, Homo Sapiens
WWWTKLTFFFPLALKKSSRVSSVTCPGFTRLFSCQLLLTRTYKHSRS

SEQ ID NO: 1984 - protein, 2 aa, Homo Sapiens
WA

SEQ ID NO: 1985 - protein, 14 aa, Homo Sapiens
MHRNQSLIPLVVKH

SEQ ID NO: 1986 - protein, 10 aa, Homo Sapiens
QPCGLGPLPL

SEQ ID NO: 1987 - protein, 39 aa, Homo Sapiens
LYPHFLERSRLLLLFELSQWDKFEIQVFELLIIWIFFFF

SEQ ID NO: 1988 - protein, 11 aa, Homo Sapiens
LHPMQQLFFQK

SEQ ID NO: 1989 - skipped

SEQ ID NO: 1990 - protein, 7 aa, Homo Sapiens
LPIQKTV

SEQ ID NO: 1991 - protein, 16 aa, Homo Sapiens
LAKEKMPRSIFEQMTE

SEQ ID NO: 1992 - protein, 4 aa, Homo Sapiens
QIEL

SEQ ID NO: 1993 - protein, 14 aa, Homo Sapiens
LWQWSGISHPQWRL

SEQ ID NO: 1994 - protein, 41 aa, Homo Sapiens
LSLDSMALRAQPSSQKSMQPCGLTGATFSRLPSKWTATGHL

SEQ ID NO: 1995 - protein, 5 aa, Homo Sapiens
LVWTP

SEQ ID NO: 1996 - protein, 36 aa, Homo Sapiens
APMRIMSKDFGCLTRKEMAPSWVLKSGMFLSHWVRR

SEQ ID NO: 1997 - protein, 1 aa, Homo Sapiens
L

SEQ ID NO: 1998 - protein, 50 aa, Homo Sapiens
TENAASTTSAWCRRWWADAGPPCLGGGTMSLTDPASCLCMGAVTETAIIT

SEQ ID NO: 1999 - protein, 70 aa, Homo Sapiens
TQSLGLAVHPSHAGTLTWRGTPAITSSMEAAGAIRTATALRRPACSAASASRRILPCPLAQRWWFWRGCS

SEQ ID NO: 2000 - protein, 35 aa, Homo Sapiens
MNRRSKQANRNEACAANMHCTFHKHCLLILLLLAV

SEQ ID NO: 2001 - protein, 6 aa, Homo Sapiens
MLQRTL

SEQ ID NO: 2002 - protein, 51 aa, Homo Sapiens
CSRIKDISGTMVPSLRLGKTQGTMINILAVVVTMTQLMCVKLEARYVQEVK

SEQ ID NO: 2003 - protein, 29 aa, Homo Sapiens
MPSTASPWAASPLSCLQTRSQRQQKIFVL

SEQ ID NO: 2004 - protein, 22 aa, Homo Sapiens
WAASPLSCLQTRSQRQQKIFVL

SEQ ID NO: 2005 - protein, 14 aa, Homo Sapiens
LQTRSQRQQKIFVL

SEQ ID NO: 2006 - protein, 44 aa, Homo Sapiens
LVIRVPAFTELFQGLCVRVVTSHAIMALVASPSMGRNLKMRTSS

SEQ ID NO: 2007 - protein, 30 aa, Homo Sapiens
LCVRVVTSHAIMALVASPSMGRNLKMRTSS

SEQ ID NO: 2008 - protein, 14 aa, Homo Sapiens
RLSGWMASMWCLAK

SEQ ID NO: 2009 - protein, 3 aa, Homo Sapiens
LAK

SEQ ID NO: 2010 - protein, 43 aa, Homo Sapiens
MWRPWSALGPGMARPARRSPLLTVDNSNKFDLCFILTTRSFLL

SEQ ID NO: 2011 - protein, 36 aa, Homo Sapiens
LGPGMARPARRSPLLTVDNSNKFDLCFILTTRSFLL

SEQ ID NO: 2012 - protein, 1 aa, Homo Sapiens
A

SEQ ID NO: 2013-2014 - skipped (2 entries)

SEQ ID NO: 2015 - protein, 15 aa, Homo Sapiens
SIDSFFCSLDSSVSY

SEQ ID NO: 2016 - protein, 7 aa, Homo Sapiens
MDSSVSY

SEQ ID NO: 2017 - protein, 3 aa, Homo Sapiens
RAI

SEQ ID NO: 2018 - protein, 7 aa, Homo Sapiens
TWCSRTP

SEQ ID NO: 2019 - protein, 17 aa, Homo Sapiens
LPSLPLRVWAEDMLMWC

SEQ ID NO: 2020 - protein, 13 aa, Homo Sapiens
CEYSTPTSMGGGK

SEQ ID NO: 2021 - protein, 8 aa, Homo Sapiens
QATFQQSK

SEQ ID NO: 2022 - protein, 18 aa, Homo Sapiens
NGQPFKRSLVTSSSTWWH

SEQ ID NO: 2023 - protein, 13 aa, Homo Sapiens
EYWPRSWPRIRRS

SEQ ID NO: 2024 - protein, 12 aa, Homo Sapiens
SPAQVTTSGNSC

SEQ ID NO: 2025 - protein, 30 aa, Homo Sapiens
RCWYVKPPSTKKKNQRWCQVAPLSISSVRM

SEQ ID NO: 2026 - protein, 57 aa, Homo Sapiens
RAPWLQLVRGARGCWELRRWPWGEPWGCTTRRGGTCAPRTSTQSAQPRSSPCPAACS

SEQ ID NO: 2027 - protein, 3 aa, Homo Sapiens
MEG

SEQ ID NO: 2028 - protein, 7 aa, Homo Sapiens
LKQLMRA

SEQ ID NO: 2029 - protein, 11 aa, Homo Sapiens
LSNGERSRTVW

SEQ ID NO: 2030 - protein, 16 aa, Homo Sapiens
ALGLSHMPLWRRWMQL

SEQ ID NO: 2031 - protein, 15 aa, Homo Sapiens
LGLSHMPLWRRWMQL

SEQ ID NO: 2032 - protein, 18 aa, Homo Sapiens
WNQRELSPEKILKDQVPT

SEQ ID NO: 2033 - protein, 13 aa, Homo Sapiens
LLVALKKTLKNIT

SEQ ID NO: 2034 - protein, 11 aa, Homo Sapiens
VALKKTLKNIT

SEQ ID NO: 2035 - protein, 8 aa, Homo Sapiens
LNSMEKLK

SEQ ID NO: 2036 - protein, 7 aa, Homo Sapiens
RKGALPL

SEQ ID NO: 2037 - protein, 3 aa, Homo Sapiens
LPL

SEQ ID NO: 2038 - protein, 14 aa, Homo Sapiens
MTPWIRLSFRNTIL

SEQ ID NO: 2039 - protein, 9 aa, Homo Sapiens
RLSFRNTIL

SEQ ID NO: 2040 - protein, 8 aa, Homo Sapiens
MSFRNTIL

SEQ ID NO: 2041 - protein, 155 aa, Homo Sapiens
TTVKLEKPCQSKRWLVLHPAKEVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2042 - protein, 145 aa, Homo Sapiens
SKRWLVLHPAKEVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2043 - protein, 141 aa, Homo Sapiens
VVLHPAKEVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2044 - protein, 135 aa, Homo Sapiens
KEVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2045 - protein, 134 aa, Homo Sapiens
EVEVVLETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2046 - protein, 129 aa, Homo Sapiens
LETLVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2047 - protein, 126 aa, Homo Sapiens
LVVVVEVVSVGMTTSVVEETSVVVVALVAAVVVVDMVAVGMAIMDLVMMVVMEEAALVTLEEAEAMEVVDRVMETRAVAMAGVAAMTAITTEAEAALAVVVEAILEVVEATMILGITTISLQILDP

SEQ ID NO: 2048 - protein, 26 aa, Homo Sapiens
PGQASCGCRMGQWPLLCSCQWARRPP

SEQ ID NO: 2049 - protein, 15 aa, Homo Sapiens
LPSFSMLMREMPGLL

SEQ ID NO: 2050 - protein, 28 aa, Homo Sapiens
WLILPLQAQWKHLDVPLQKKTCVRLSLM

SEQ ID NO: 2051 - protein, 20 aa, Homo Sapiens
VQSGDLTSFSLLVSLTDRLS

SEQ ID NO: 2052 - protein, 24 aa, Homo Sapiens
WTQGWRWPGRAPCSGSSWRTSSTL

SEQ ID NO: 2053 - protein, 4 aa, Homo Sapiens
MSQI

SEQ ID NO: 2054 - protein, 17 aa, Homo Sapiens
LDSEKVDQMTEASGMTS

SEQ ID NO: 2055 - protein, 37 aa, Homo Sapiens
LPSVDPTWISENPQKRKEHRDHDSSLNLEQSRRPSIK

SEQ ID NO: 2056 - protein, 6 aa, Homo Sapiens
SSWSGR

SEQ ID NO: 2057 - protein, 1 aa, Homo Sapiens
S

SEQ ID NO: 2058 - protein, 4 aa, Homo Sapiens
MGCA

SEQ ID NO: 2059 - protein, 157 aa, Homo Sapiens; identical to SEQ ID NO: 915

SEQ ID NO: 2060 - protein, 3 aa, Homo Sapiens
LAL

SEQ ID NO: 2061 - protein, 27 aa, Homo Sapiens
STETCSTVPPLCPESPCTWPTLWVRMT

SEQ ID NO: 2062 - protein, 58 aa, Homo Sapiens
ARLVSRLAMPAGSSTAWNTASSPMARCQVTRPLGEEMIPSTPSSVKRVLASMCPGQCL

SEQ ID NO: 2063 - protein, 52 aa, Homo Sapiens
MAMPAGSSTAWNTASSPMARCQVTRPLGEEMIPSTPSSVKRVLASMCPGQCL

SEQ ID NO: 2064 - protein, 26 aa, Homo Sapiens
MGEEMIPSTPSSVKRVLASMCPGQCL

SEQ ID NO: 2065 - protein, 1 aa, Homo Sapiens
L

SEQ ID NO: 2066 - protein, 106 aa, Homo Sapiens
MMKFALALTASSSTLSNSSQARKMLPITMPEGTTPLARRSLTSCWTEFASWLTSAPVFRASWFSTALVGELVLGSPRCSWNVSQLIMARSPSWSSPFTRRPRFPQL

SEQ ID NO: 2067 - protein, 96 aa, Homo Sapiens
SSSTLSNSSQARKMLPITMPEGTTPLARRSLTSCWTEFASWLTSAPVFRASWFSTALVGELVLGSPRCSWNVSQLIMARSPSWSSPFTRRPRFPQL

SEQ ID NO: 2068 - protein, 62 aa, Homo Sapiens
WTEFASWLTSAPVFRASWFSTALVGELVLGSPRCSWNVSQLIMARSPSWSSPFTRRPRFPQL

SEQ ID NO: 2069 - protein, 40 aa, Homo Sapiens
LVGELVLGSPRCSWNVSQLIMARSPSWSSPFTRRPRFPQL

SEQ ID NO: 2070 - protein, 5 aa, Homo Sapiens
RFPQL

SEQ ID NO: 2071 - protein, 17 aa, Homo Sapiens
PSSPPTPPWSTLIVPSW

SEQ ID NO: 2072 - protein, 4 aa, Homo Sapiens
VPSW

SEQ ID NO: 2073 - protein, 33 aa, Homo Sapiens; identical to SEQ ID NO: 1602

SEQ ID NO: 2074 - protein, 48 aa, Homo Sapiens
QRVSTRSWMRMSRRLPMTPTASQKGFTTMWSPVALCVLKPLSCQPSQD

SEQ ID NO: 2075 - protein, 18 aa, Homo Sapiens
LYLDSELILVVARQLALA

SEQ ID NO: 2076 - protein, 10 aa, Homo Sapiens
LVVARQLALA

SEQ ID NO: 2077 - protein, 2 aa, Homo Sapiens
LA

SEQ ID NO: 2078 - protein, 31 aa, Homo Sapiens
RAGRPRGARRPRRRPRRLRRWQRCWWSWSGG

SEQ ID NO: 2079 - protein, 26 aa, Homo Sapiens
RGARRPRRRPRRLRRWQRCWWSWSGG

SEQ ID NO: 2080 - protein, 4 aa, Homo Sapiens
LVRS

SEQ ID NO: 2081 - protein, 50 aa, Homo Sapiens; identical to SEQ ID NO: 334

SEQ ID NO: 2082 - protein, 33 aa, Homo Sapiens; identical to SEQ ID NO: 336

SEQ ID NO: 2083 - protein, 5 aa, Homo Sapiens
APLKS

SEQ ID NO: 2084 - protein, 156 aa, Homo Sapiens [sequence omitted]

SEQ ID NO: 2085 - protein, 17 aa, Homo Sapiens
LGATSSRRTVFPMTFTS

SEQ ID NO: 2086 - protein, 1 aa, Homo Sapiens
C

SEQ ID NO: 2087 - protein, 15 aa, Homo Sapiens
LPRLLTIQRILCGNC

SEQ ID NO: 2088 - protein, 36 aa, Homo Sapiens; identical to SEQ ID NO: 1996

SEQ ID NO: 2089 - protein, 17 aa, Homo Sapiens
ACKICQKWPFIVKRHES

SEQ ID NO: 2090 - protein, 6 aa, Homo Sapiens
WMMLKK

SEQ ID NO: 2091 - protein, 4 aa, Homo Sapiens
WKSS

SEQ ID NO: 2092 - protein, 10 aa, Homo Sapiens
LMKPLLNLIH

SEQ ID NO: 2093 - protein, 19 aa, Homo Sapiens
MILAPPTLVWVFSSTEKSR

SEQ ID NO: 2094 - protein, 21 aa, Homo Sapiens
MPMIRETEPLQAMSPLRTLNG

SEQ ID NO: 2095 - protein, 5 aa, Homo Sapiens
LMPNV

SEQ ID NO: 2096 - protein, 13 aa, Homo Sapiens
MDADLMMLLSSLI

SEQ ID NO: 2097 - protein, 4 aa, Homo Sapiens
SSLI

SEQ ID NO: 2098 - protein, 5 aa, Homo Sapiens
GPLWW

SEQ ID NO: 2099 - protein, 55 aa, Homo Sapiens
MQKPTLGRLLPMLWSQCQLTLMTLSVRLPKMLELLLVSMYLELLMSQLLLLLLTA

SEQ ID NO: 2100 - protein, 21 aa, Homo Sapiens
MLVSMYLELLMSQLLLLLLTA

SEQ ID NO: 2101 - protein, 4 aa, Homo Sapiens
MLTA

SEQ ID NO: 2102 - skipped

SEQ ID NO: 2103 - protein, 62 aa, Homo Sapiens
LTWEVALLMCQSSLLRMESLRSSLQLETPTWVEKILTTEWSTILLLSLSASIRRTSVRTREL

SEQ ID NO: 2104 - protein, 55 aa, Homo Sapiens
LMCQSSLLRMESLRSSLQLETPTWVEKILTTEWSTILLLSLSASIRRTSVRTREL

SEQ ID NO: 2105 - protein, 48 aa, Homo Sapiens
MRMESLRSSLQLETPTWVEKILTTEWSTILLLSLSASIRRTSVRTREL

SEQ ID NO: 2106 - protein, 43 aa, Homo Sapiens
LRSSLQLETPTWVEKILTTEWSTILLLSLSASIRRTSVRTREL

SEQ ID NO: 2107 - protein, 34 aa, Homo Sapiens
PTWVEKILTTEWSTILLLSLSASIRRTSVRTREL

SEQ ID NO: 2108 - protein, 27 aa, Homo Sapiens
LTTEWSTILLLSLSASIRRTSVRTREL

SEQ ID NO: 2109 - protein, 19 aa, Homo Sapiens
CRVLMERYLKLMWKLPNNL

SEQ ID NO: 2110 - protein, 5 aa, Homo Sapiens
MPNNL

SEQ ID NO: 2111 - protein, 19 aa, Homo Sapiens
EMRTKKSEQMISLFGTKNS

SEQ ID NO: 2112 - protein, 2 aa, Homo Sapiens
PI

SEQ ID NO: 2113 - protein, 14 aa, Homo Sapiens
TRPSSGMPARPLTQ

SEQ ID NO: 2114 - protein, 22 aa, Homo Sapiens
WVYFGSVPELVNGRVLMLQYAV

SEQ ID NO: 2115 - protein, 18 aa, Homo Sapiens
GSVPELVNGRVLMLQYAV

SEQ ID NO: 2116 - protein, 9 aa, Homo Sapiens
RSKPRKPER

SEQ ID NO: 2117 - protein, 20 aa, Homo Sapiens
VTPATADTSPWLLSSVVGCP

SEQ ID NO: 2118 - protein, 14 aa, Homo Sapiens
DTSPWLLSSVVGCP

SEQ ID NO: 2119 - protein, 54 aa, Homo Sapiens
LARSLDQTTLYLVSLGQVTTGPKATTQRAPSWLILSWMWYGRRQRAVTACRASS

SEQ ID NO: 2120 - protein, 45 aa, Homo Sapiens
LYLVSLGQVTTGPKATTQRAPSWLILSWMWYGRRQRAVTACRASS

SEQ ID NO: 2121 - protein, 43 aa, Homo Sapiens
LVSLGQVTTGPKATTQRAPSWLILSWMWYGRRQRAVTACRASS

SEQ ID NO: 2122 - protein, 5 aa, Homo Sapiens
CRASS

SEQ ID NO: 2123 - protein, 24 aa, Homo Sapiens
AGAQALEWALSLSARSEKNTLIAS

SEQ ID NO: 2124 - protein, 22 aa, Homo Sapiens
AQALEWALSLSARSEKNTLIAS

SEQ ID NO: 2125 - protein, 4 aa, Homo Sapiens
LIAS

SEQ ID NO: 2126 - protein, 22 aa, Homo Sapiens
LHPKCLTPWSSPTMPPSPSISW

SEQ ID NO: 2127 - protein, 18 aa, Homo Sapiens
CLTPWSSPTMPPSPSISW

SEQ ID NO: 2128 - protein, 18 aa, Homo Sapiens
CLTPWSSPTMPPSPSISW

SEQ ID NO: 2129 - protein, 10 aa, Homo Sapiens
TMPPSPSISW

SEQ ID NO: 2130 - protein, 6 aa, Homo Sapiens
SPSISW

SEQ ID NO: 2131 - protein, 1 aa, Homo Sapiens
W

SEQ ID NO: 2132 - protein, 8 aa, Homo Sapiens
SMISASAL

SEQ ID NO: 2133 - protein, 5 aa, Homo Sapiens
QPTGI

SEQ ID NO: 2134 - protein, 54 aa, Homo Sapiens
SSMLTSASWQSTWSPSHVSISLCLALPLSPAVEASSIELSQCRNSPSRSSMPRT

SEQ ID NO: 2135 - protein, 46 aa, Homo Sapiens
WQSTWSPSHVSISLCLALPLSPAVEASSIELSQCRNSPSRSSMPRT

SEQ ID NO: 2136 - protein, 29 aa, Homo Sapiens
LPLSPAVEASSIELSQCRNSPSRSSMPRT

SEQ ID NO: 2137 - skipped

SEQ ID NO: 2138 - protein, 65 aa, Homo Sapiens
MGTLPPTSKPQLLCQMVSLKISACLTTKENMLCSSFTLLTSPLCAPRRSLLSVIGQKNLRNSTAK

SEQ ID NO: 2139 - protein, 33 aa, Homo Sapiens
CSSFTLLTSPLCAPRRSLLSVIGQKNLRNSTAK

SEQ ID NO: 2140 - protein, 23 aa, Homo Sapiens
LCAPRRSLLSVIGQKNLRNSTAK

SEQ ID NO: 2141 - protein, 16 aa, Homo Sapiens
MLSVIGQKNLRNSTAK

SEQ ID NO: 2142 - protein, 11 aa, Homo Sapiens
MVLLWILTSVI

SEQ ID NO: 2143 - protein, 15 aa, Homo Sapiens
WYQTRSAPLLRIMGS

SEQ ID NO: 2144 - protein, 7 aa, Homo Sapiens
MLRIMGS

SEQ ID NO: 2145 - protein, 7 aa, Homo Sapiens
AALWMRL

SEQ ID NO: 2146 - protein, 6 aa, Homo Sapiens
ALWMRL

SEQ ID NO: 2147 - protein, 40 aa, Homo Sapiens
QLAGNLAVIPSSLMSKRAKNISPSRSERWAVLVPGCGGQP

SEQ ID NO: 2148 - protein, 66 aa, Homo Sapiens; identical to SEQ ID NO: 1103

SEQ ID NO: 2149 - protein, 56 aa, Homo Sapiens
LRHSSARHLMSMKLGRSWERRERTSRLSAKSRIMRGFGGLMKSWRPVMGSWWLVVI

SEQ ID NO: 2150 - protein, 14 aa, Homo Sapiens
LLLTPSSTGPLLWL

SEQ ID NO: 2151 - protein, 28 aa, Homo Sapiens
WTLIHHPSQPGTLASSVPLAQLPDQWRR

SEQ ID NO: 2152 - protein, 26 aa, Homo Sapiens
MIHHPSQPGTLASSVPLAQLPDQWRR

SEQ ID NO: 2153 - protein, 10 aa, Homo Sapiens
MAQLPDQWRR

SEQ ID NO: 2154 - protein, 17 aa, Homo Sapiens
RKALLLTPSSTGPLLWL

SEQ ID NO: 2155 - protein, 14 aa, Homo Sapiens
LLLTPSSTGPLLWL

SEQ ID NO: 2156 - protein, 4 aa, Homo Sapiens
LLWL

SEQ ID NO: 2157 - protein, 26 aa, Homo Sapiens
APSSRRCWRHSRTSSTRPAGILAPAV

SEQ ID NO: 2158 - protein, 19 aa, Homo Sapiens
WRHSRTSSTRPAGILAPAV

SEQ ID NO: 2159 - protein, 20 aa, Homo Sapiens
MLLSLLLPPVEVLRAKQKFK

SEQ ID NO: 2160 - protein, 6 aa, Homo Sapiens
LVIHSG

SEQ ID NO: 2161 - protein, 4 aa, Homo Sapiens
WWGT

SEQ ID NO: 2162 - protein, 6 aa, Homo Sapiens
WGLKKA

SEQ ID NO: 2163 - protein, 2 aa, Homo Sapiens
WV

SEQ ID NO: 2164 - protein, 1 aa, Homo Sapiens
F

SEQ ID NO: 2165 - protein, 10 aa, Homo Sapiens
WMTLVISLPP

SEQ ID NO: 2166 - protein, 5 aa, Homo Sapiens
ISQKV

SEQ ID NO: 2167 - protein, 35 aa, Homo Sapiens
MGVSSSSMRHSTRRRMMGVPSPKLSNPRAVLWASR

SEQ ID NO: 2168 - protein, 15 aa, Homo Sapiens
SPKLSNPRAVLWASR

SEQ ID NO: 2169 - protein, 26 aa, Homo Sapiens
KGWMGCLSAVPSTRRTELTSPSGVVC

SEQ ID NO: 2170 - protein, 4 aa, Homo Sapiens
LTST

SEQ ID NO: 2171 - protein, 35 aa, Homo Sapiens
SAGLLAEESQLGFPCPRLLQDLLGQSVGLAGHPNR

SEQ ID NO: 2172 - protein, 16 aa, Homo Sapiens
VGVLPHLWAEEHPLQA

SEQ ID NO: 2173 - protein, 10 aa, Homo Sapiens
LWAEEHPLQA

SEQ ID NO: 2174 - protein, 3 aa, Homo Sapiens
LQA

SEQ ID NO: 2175 - protein, 33 aa, Homo Sapiens
SRTGSTKTTRSTGGRTCMASTCLASKMWPLRSP

SEQ ID NO: 2176 - protein, 16 aa, Homo Sapiens
TVPRTLTPRPGAAVLR

SEQ ID NO: 2177 - protein, 9 aa, Homo Sapiens
TSSSTGLPE

SEQ ID NO: 2178 - protein, 28 aa, Homo Sapiens
CWSASQSPCHLSLTGPGTRSLTLRTRPS

SEQ ID NO: 2179 - protein, 6 aa, Homo Sapiens
PRAGSS

SEQ ID NO: 2180 - protein, 67 aa, Homo Sapiens
STGATAPAPRAPTRPSSRSACAATWPPSGPSWASWLRCWCWSPSSSSTRSAGSPRTSWMMTTPALHP

SEQ ID NO: 2181 - protein, 60 aa, Homo Sapiens
APRAPTRPSSRSACAATWPPSGPSWASWLRCWCWSPSSSSTRSAGSPRTSWMMTTPALHP

SEQ ID NO: 2182 - protein, 52 aa, Homo Sapiens
SSRSACAATWPPSGPSWASWLRCWCWSPSSSSTRSAGSPRTSWMMTTPALHP

SEQ ID NO: 2183 - protein, 40 aa, Homo Sapiens
SGPSWASWLRCWCWSPSSSSTRSAGSPRTSWMMTTPALHP

SEQ ID NO: 2184 - protein, 25 aa, Homo Sapiens
LVTIERTSLKIWLLLLVVQCLEKRD

SEQ ID NO: 2185 - protein, 12 aa, Homo Sapiens
MLLVVQCLEKRD

SEQ ID NO: 2186 - protein, 5 aa, Homo Sapiens
LEKRD

SEQ ID NO: 2187 - protein, 1 aa, Homo Sapiens
L

SEQ ID NO: 2188 - protein, 8 aa, Homo Sapiens
TTPRAACG

SEQ ID NO: 2189 - protein, 5 aa, Homo Sapiens
NQRQS

SEQ ID NO: 2190 - protein, 38 aa, Homo Sapiens
LETSQIFRFLWIMKQKSTEDLLLLNLSWQRMLQQLSTT

SEQ ID NO: 2191 - protein, 16 aa, Homo Sapiens
LLNLSWQRMLQQLSTT

SEQ ID NO: 2192 - protein, 12 aa, Homo Sapiens
LDVQFVSIWPNQ

SEQ ID NO: 2193 - protein, 6 aa, Homo Sapiens
GQMMTG

SEQ ID NO: 2194 - protein, 19 aa, Homo Sapiens
WLSFHSSVFLLFMNGIRHR

SEQ ID NO: 2195 - protein, 9 aa, Homo Sapiens
VKSKQKSLD

SEQ ID NO: 2196 - protein, 69 aa, Homo Sapiens
GTFSPQDSNIMTSVSTQLSLVLMSLLLVLPVVEAVEAGDAIALLLGVVLSITGICACLGVYARKRNGQM

SEQ ID NO: 2197 - protein, 43 aa, Homo Sapiens
LVLPVVEAVEAGDAIALLLGVVLSITGICACLGVYARKRNGQM

SEQ ID NO: 2198 - protein, 38 aa, Homo Sapiens
VEAVEAGDAIALLLGVVLSITGICACLGVYARKRNGQM

SEQ ID NO: 2199 - protein, 16 aa, Homo Sapiens
ALMCLSQLEKPETAVL

SEQ ID NO: 2200 - protein, 5 aa, Homo Sapiens
VWRSS

SEQ ID NO: 2201 - protein, 60 aa, Homo Sapiens
ACCCAACRSATRSRRRWSGAVRSPSTCTSTWSCWSVSTWCLPCSWRSPTWPPMRAMPADA

SEQ ID NO: 2202 - protein, 13 aa, Homo Sapiens
WPHICESIRKVIL

SEQ ID NO: 2203 - protein, 1 aa, Homo Sapiens
M

SEQ ID NO: 2204 - skipped

SEQ ID NO: 2205 - protein, 13 aa, Homo Sapiens
MSTLSTLRAEIAS

SEQ ID NO: 2206 - protein, 2 aa, Homo Sapiens
LV

SEQ ID NO: 2207 - protein, 41 aa, Homo Sapiens
  misc_feature (1)..(1): Xaa can be any naturally occurring amino acid
XELPDSSELFHRRGGSRQQPGQFVPAGLLHLPLSGLLFRPR

SEQ ID NO: 2208 - protein, 20 aa, Homo Sapiens
  misc_feature (1)..(1): Xaa can be any naturally occurring amino acid
XFVPAGLLHLPLSGLLFRPR

SEQ ID NO: 2209 - protein, 19 aa, Homo Sapiens
  misc_feature (1)..(1): Xaa can be any naturally occurring amino acid
XVPAGLLHLPLSGLLFRPR

SEQ ID NO: 2210 - protein, 19 aa, Homo Sapiens
  misc_feature (1)..(1): Xaa can be any naturally occurring amino acid
XVPAGLLHLPLSGLLFRPR

SEQ ID NO: 2211 - protein, 40 aa, Homo Sapiens
  misc_feature (1)..(1): Xaa can be any naturally occurring amino acid
XREPLLPRIGRGEARGLRASPEDAKPAWRPRSLPGHQEAS

SEQ ID NO: 2212 - protein, 39 aa, Homo Sapiens
REPLLPRIGRGEARGLRASPEDAKPAWRPRSLPGHQEAS

SEQ ID NO: 2213 - protein, 37 aa, Homo Sapiens
  misc_feature (1)..(1): Xaa can be any naturally occurring amino acid
XLLPRIGRGEARGLRASPEDAKPAWRPRSLPGHQEAS

SEQ ID NO: 2214 - protein, 32 aa, Homo Sapiens
  misc_feature (1)..(1): Xaa can be any naturally occurring amino acid
XGRGEARGLRASPEDAKPAWRPRSLPGHQEAS

SEQ ID NO: 2215 - protein, 32 aa, Homo Sapiens; identical to SEQ ID NO: 2214
  misc_feature (1)..(1): Xaa can be any naturally occurring amino acid

SEQ ID NO: 2216 - protein, 28 aa, Homo Sapiens
  misc_feature (1)..(1): Xaa can be any naturally occurring amino acid
XARGLRASPEDAKPAWRPRSLPGHQEAS

SEQ ID NO: 2217 - protein, 4 aa, Homo Sapiens
  misc_feature (1)..(1): Xaa can be any naturally occurring amino acid
XEAS

SEQ ID NO: 2218 - skipped

SEQ ID NO: 2219 - protein, 2 aa, Homo Sapiens
  misc_feature (1)..(1): Xaa can be any naturally occurring amino acid
XG

SEQ ID NO: 2220 - protein, 24 aa, Homo Sapiens
  misc_feature (1)..(1): Xaa can be any naturally occurring amino acid
XEKAEPGPFGSSCPGFCPHGPPSL

SEQ ID NO: 2221 - protein, 22 aa, Homo Sapiens
  misc_feature (1)..(1): Xaa can be any naturally occurring amino acid
XAEPGPFGSSCPGFCPHGPPSL

SEQ ID NO: 2222 - protein, 7 aa, Homo Sapiens
  misc_feature (1)..(1): Xaa can be any naturally occurring amino acid
XGDSLPR

SEQ ID NO: 2223 - protein, 43 aa, Homo Sapiens
  misc_feature (1)..(1): Xaa can be any naturally occurring amino acid
XEEPRRGSKRPTSPDCQLWVDRGGRCPQISGPRQDHGRHPGPI

SEQ ID NO: 2224 - protein, 21 aa, Homo Sapiens
  misc_feature (1)..(1): Xaa can be any naturally occurring amino acid
XGRCPQISGPRQDHGRHPGPI

SEQ ID NO: 2225 - protein, 3 aa, Homo Sapiens
  misc_feature (1)..(1): Xaa can be any naturally occurring amino acid
XPI

SEQ ID NO: 2226 - protein, 8 aa, Homo Sapiens
  misc_feature (1)..(1): Xaa can be any naturally occurring amino acid
XRCFWEQG

SEQ ID NO: 2227 - protein, 30 aa, Homo Sapiens
  misc_feature (1)..(1): Xaa can be any naturally occurring amino acid
XCSPYCLYRLRPAEARSQDCCGCAELLQSD

SEQ ID NO: 2228 - protein, 24 aa, Homo Sapiens
  misc_feature (1)..(1): Xaa can be any naturally occurring amino acid
XWAESGPCSGRGTRSNRLHWGEAR

SEQ ID NO: 2229 - protein, 7 aa, Homo Sapiens
  misc_feature (1)..(1): Xaa can be any naturally occurring amino acid
XKGSWHH

SEQ ID NO: 2230 - protein, 6 aa, Homo Sapiens
  misc_feature (1)..(1): Xaa can be any naturally occurring amino acid
XGSWHH

SEQ ID NO: 2231 - protein, 25 aa, Homo Sapiens
  misc_feature (1)..(1): Xaa can be any naturally occurring amino acid
XIRGHHQCQTMSPIHLPYPSCQARD

SEQ ID NO: 2232 - protein, 7 aa, Homo Sapiens
  misc_feature (1)..(1): Xaa can be any naturally occurring amino acid
XSRCTQE

SEQ ID NO: 2233 - skipped

SEQ ID NO: 2234 - protein, 8 aa, Homo Sapiens
  misc_feature (1)..(1): Xaa can be any naturally occurring amino acid
XICKNMCC

SEQ ID NO: 2235 - protein, 15 aa, Homo Sapiens
  misc_feature (1)..(1): Xaa can be any naturally occurring amino acid
XYPFWRQIMHSCNSS

SEQ ID NO: 2236 - protein, 35 aa, Homo Sapiens
  misc_feature (1)..(1): Xaa can be any naturally occurring amino acid
XVRVLCKMSGRGPLCFPGGHWIVFLWGGTVLWLWT

SEQ ID NO: 2237 - protein, 7 aa, Homo Sapiens
  misc_feature (1)..(1): Xaa can be any naturally occurring amino acid
XRNCSAG

SEQ ID NO: 2238 - protein, 6 aa, Homo Sapiens
  misc_feature (1)..(1): Xaa can be any naturally occurring amino acid
XNCSAG

SEQ ID NO: 2239 - protein, 21 aa, Homo Sapiens
  misc_feature (1)..(1): Xaa can be any naturally occurring amino acid
XRSKSYLATERRCQMTLKTYL

SEQ ID NO: 2240 - protein, 63 aa, Homo Sapiens
  misc_feature (1)..(1): Xaa can be any naturally occurring amino acid
XLPGIQGWHDSHRAGSRQAGIQGEQEGGGGGCDHCRDTTHGGCGHCGLRGNPSRPPDLQDCLC

SEQ ID NO: 2241 - protein, 57 aa, Homo Sapiens
  misc_feature (1)..(1): Xaa can be any naturally occurring amino acid
XWHDSHRAGSRQAGIQGEQEGGGGGCDHCRDTTHGGCGHCGLRGNPSRPPDLQDCLC

SEQ ID NO: 2242 - protein, 39 aa, Homo Sapiens
  misc_feature (1)..(1): Xaa can be any naturally occurring amino acid
XEGGGGGCDHCRDTTHGGCGHCGLRGNPSRPPDLQDCLC

SEQ ID NO: 2243 - protein, 30 aa, Homo Sapiens
  misc_feature (1)..(1): Xaa can be any naturally occurring amino acid
XCRDTTHGGCGHCGLRGNPSRPPDLQDCLC

SEQ ID NO: 2244 - protein, 2 aa, Homo Sapiens
  misc_feature (1)..(1): Xaa can be any naturally occurring amino acid
XC

SEQ ID NO: 2245 - protein, 1 aa, Homo Sapiens
  misc_feature (1)..(1): Xaa can be any naturally occurring amino acid
X

SEQ ID NO: 2246 - protein, 4 aa, Homo Sapiens
  misc_feature (1)..(1): Xaa can be any naturally occurring amino acid
XELA

SEQ ID NO: 2247 - protein, 14 aa, Homo Sapiens
  misc_feature (1)..(1): Xaa can be any naturally occurring amino acid
XEEGLYQVLQEMAG

SEQ ID NO: 2248 - protein, 4 aa, Homo Sapiens
  misc_feature (1)..(1): Xaa can be any naturally occurring amino acid
XMAG

SEQ ID NO: 2249 - protein, 59 aa, Homo Sapiens
  misc_feature (1)..(1): Xaa can be any naturally occurring amino acid
XEAAGEGLQQHEEVLPSHPCHCPHPDAPASSAPEEGPPDGDPGERRHCGREAGLGPREA

SEQ ID NO: 2250 - protein, 58 aa, Homo Sapiens
  misc_feature (1)..(1): Xaa can be any naturally occurring amino acid
XAAGEGLQQHEEVLPSHPCHCPHPDAPASSAPEEGPPDGDPGERRHCGREAGLGPREA

SEQ ID NO: 2251 - protein, 55 aa, Homo Sapiens
  misc_feature (1)..(1): Xaa can be any naturally occurring amino acid
XEGLQQHEEVLPSHPCHCPHPDAPASSAPEEGPPDGDPGERRHCGREAGLGPREA

SEQ ID NO: 2252 - protein, 55 aa, Homo Sapiens; identical to SEQ ID NO: 2251
  misc_feature (1)..(1): Xaa can be any naturally occurring amino acid

SEQ ID NO: 2253 - protein, 51 aa, Homo Sapiens
  misc_feature (1)..(1): Xaa can be any naturally occurring amino acid
XQHEEVLPSHPCHCPHPDAPASSAPEEGPPDGDPGERRHCGREAGLGPREA

SEQ ID NO: 2254 - protein, 50 aa, Homo Sapiens
  misc_feature (1)..(1): Xaa can be any naturally occurring amino acid
XHEEVLPSHPCHCPHPDAPASSAPEEGPPDGDPGERRHCGREAGLGPREA

SEQ ID NO: 2255 - protein, 48 aa, Homo Sapiens
  misc_feature (1)..(1): Xaa can be any naturally occurring amino acid
XEVLPSHPCHCPHPDAPASSAPEEGPPDGDPGERRHCGREAGLGPREA

SEQ ID NO: 2256 - protein, 43 aa, Homo Sapiens
  misc_feature (1)..(1): Xaa can be any naturally occurring amino acid
XHPCHCPHPDAPASSAPEEGPPDGDPGERRHCGREAGLGPREA

SEQ ID NO: 2257 - protein, 43 aa, Homo Sapiens; identical to SEQ ID NO: 2256
  misc_feature (1)..(1): Xaa can be any naturally occurring amino acid

SEQ ID NO: 2258 - protein, 38 aa, Homo Sapiens
  misc_feature (1)..(1): Xaa can be any naturally occurring amino acid
XPHPDAPASSAPEEGPPDGDPGERRHCGREAGLGPREA

SEQ ID NO: 2259 - protein, 31 aa, Homo Sapiens
  misc_feature (1)..(1): Xaa can be any naturally occurring amino acid
XSSAPEEGPPDGDPGERRHCGREAGLGPREA

SEQ ID NO: 2260 - protein, 28 aa, Homo Sapiens
  misc_feature (1)..(1): Xaa can be any naturally occurring amino acid
XPEEGPPDGDPGERRHCGREAGLGPREA

SEQ ID NO: 2261 - protein, 26 aa, Homo Sapiens
  misc_feature (1)..(1): Xaa can be any naturally occurring amino acid
XEGPPDGDPGERRHCGREAGLGPREA

SEQ ID NO: 2262 - protein, 24 aa, Homo Sapiens
  misc_feature (1)..(1): Xaa can be any naturally occurring amino acid
XPPDGDPGERRHCGREAGLGPREA

SEQ ID NO: 2263 - protein, 18 aa, Homo Sapiens
  misc_feature (1)..(1): Xaa can be any naturally occurring amino acid
XGERRHCGREAGLGPREA

SEQ ID NO: 2264 - protein, 16 aa, Homo Sapiens
  misc_feature (1)..(1): Xaa can be any naturally occurring amino acid
XRRHCGREAGLGPREA

SEQ ID NO: 2265 - protein, 13 aa, Homo Sapiens
HCGREAGLGPREA

SEQ ID NO: 2266 - protein, 10 aa, Homo Sapiens
  misc_feature (1)..(1): Xaa can be any naturally occurring amino acid
XEAGLGPREA

SEQ ID NO: 2267 - protein, 9 aa, Homo Sapiens
  misc_feature (1)..(1): Xaa can be any naturally occurring amino acid
XAGLGPREA

SEQ ID NO: 2268 - protein, 6 aa, Homo Sapiens
  misc_feature (1)..(1): Xaa can be any naturally occurring amino acid
XGPREA

SEQ ID NO: 2269 - protein, 5 aa, Homo Sapiens
  misc_feature (1)..(1): Xaa can be any naturally occurring amino acid
XPREA

SEQ ID NO: 2270 - protein, 3 aa, Homo Sapiens
  misc_feature (1)..(1): Xaa can be any naturally occurring amino acid
XEA

SEQ ID NO: 2271 - protein, 2 aa, Homo Sapiens
  misc_feature (1)..(1): Xaa can be any naturally occurring amino acid
XA

SEQ ID NO: 2272 - protein, 12 aa, Homo Sapiens
  misc_feature (1)..(1): Xaa can be any naturally occurring amino acid
XAGTCEPSVWAG

SEQ ID NO: 2273 - protein, 11 aa, Homo Sapiens
  misc_feature (1)..(1): Xaa can be any naturally occurring amino acid
XGTCEPSVWAG

SEQ ID NO: 2274 - protein, 11 aa, Homo Sapiens
  misc_feature (1)..(1): Xaa can be any naturally occurring amino acid
XGTCEPSVWAG

SEQ ID NO: 2275 - protein, 10 aa, Homo Sapiens
  misc_feature (1)..(1): Xaa can be any naturally occurring amino acid
XTCEPSVWAG

SEQ ID NO: 2276 - protein, 8 aa, Homo Sapiens
CEPSVWAG

SEQ ID NO: 2277 - protein, 7 aa, Homo Sapiens
  misc_feature (1)..(1): Xaa can be any naturally occurring amino acid
XPSVWAG

SEQ ID NO: 2278 - protein, 6 aa, Homo Sapiens
  misc_feature (1)..(1): Xaa can be any naturally occurring amino acid
XSVWAG

SEQ ID NO: 2279 - protein, 5 aa, Homo Sapiens
  misc_feature (1)..(1): Xaa can be any naturally occurring amino acid
XVWAG

SEQ ID NO: 2280 - protein, 63 aa, Homo Sapiens
  misc_feature (1)..(1): Xaa can be any naturally occurring amino acid
XDRRHRGDQGQRLQRGHQSLAHQEAAPQDPPRPAQGGLYWGMASCSCSLLCGTRWAERLPSPH

SEQ ID NO: 2281 - protein, 60 aa, Homo Sapiens
  misc_feature (1)..(1): Xaa can be any naturally occurring amino acid
XHRGDQGQRLQRGHQSLAHQEAAPQDPPRPAQGGLYWGMASCSCSLLCGTRWAERLPSPH

SEQ ID NO: 2282 - protein, 59 aa, Homo Sapiens
  misc_feature (1)..(1): Xaa can be any naturally occurring amino acid
XRGDQGQRLQRGHQSLAHQEAAPQDPPRPAQGGLYWGMASCSCSLLCGTRWAERLPSPH

SEQ ID NO: 2283 - protein, 59 aa, Homo Sapiens; identical to SEQ ID NO: 2282
  misc_feature (1)..(1): Xaa can be any naturally occurring amino acid

SEQ ID NO: 2284 - protein, 53 aa, Homo Sapiens
QRLQRGHQSLAHQEAAPQDPPRPAQGGLYWGMASCSCSLLCGTRWAERLPSPH

SEQ ID NO: 2285 - protein, 53 aa, Homo Sapiens
  misc_feature (1)..(1): Xaa can be any naturally occurring amino acid
XRLQRGHQSLAHQEAAPQDPPRPAQGGLYWGMASCSCSLLCGTRWAERLPSPH

SEQ ID NO: 2286 - protein, 50 aa, Homo Sapiens
  misc_feature (1)..(1): Xaa can be any naturally occurring amino acid
XRGHQSLAHQEAAPQDPPRPAQGGLYWGMASCSCSLLCGTRWAERLPSPH

SEQ ID NO: 2287 - protein, 46 aa, Homo Sapiens
  misc_feature (1)..(1): Xaa can be any naturally occurring amino acid
XSLAHQEAAPQDPPRPAQGGLYWGMASCSCSLLCGTRWAERLPSPH

SEQ ID NO: 2288 - protein, 46 aa, Homo Sapiens; identical to SEQ ID NO: 2287
  misc_feature (1)..(1): Xaa can be any naturally occurring amino acid

SEQ ID NO: 2289 - protein, 40 aa, Homo Sapiens
  misc_feature (1)..(1): Xaa can be any naturally occurring amino acid
XAAPQDPPRPAQGGLYWGMASCSCSLLCGTRWAERLPSPH

SEQ ID NO: 2290 - protein, 31 aa, Homo Sapiens
  misc_feature (1)..(1): Xaa can be any naturally occurring amino acid
XAQGGLYWGMASCSCSLLCGTRWAERLPSPH

SEQ ID NO: 2291 - protein, 27 aa, Homo Sapiens
  misc_feature (1)..(1): Xaa can be any naturally occurring amino acid
XLYWGMASCSCSLLCGTRWAERLPSPH

SEQ ID NO: 2292 - protein, 26 aa, Homo Sapiens
  misc_feature (1)..(1): Xaa can be any naturally occurring amino acid
XYWGMASCSCSLLCGTRWAERLPSPH

SEQ ID NO: 2293 - protein, 19 aa, Homo Sapiens
CSCSLLCGTRWAERLPSPH

SEQ ID NO: 2294 - protein, 2 aa, Homo Sapiens
  misc_feature (1)..(1): Xaa can be any naturally occurring amino acid
XH

SEQ ID NO: 2295 - protein, 15 aa, Homo Sapiens
LPYQGRQADQEQCLH

SEQ ID NO: 2296 - protein, 26 aa, Homo Sapiens
  misc_feature (1)..(1): Xaa can be any naturally occurring amino acid
XSYSTRYCELCSHQLAQKQQTALCCQ

SEQ ID NO: 2297 - protein, 5 aa, Homo Sapiens
  misc_feature (1)..(1): Xaa can be any naturally occurring amino acid
XRSSY

SEQ ID NO: 2298 - protein, 3 aa, Homo Sapiens
  misc_feature (1)..(1): Xaa can be any naturally occurring amino acid
XGS

SEQ ID NO: 2299 - protein, 1 aa, Homo Sapiens
  misc_feature (1)..(1): Xaa can be any naturally occurring amino acid
X

SEQ ID NO: 2300 - protein, 2 aa, Homo Sapiens
  misc_feature (1)..(1): Xaa can be any naturally occurring amino acid
XS

SEQ ID NO: 2301 - protein, 1 aa, Homo Sapiens
  misc_feature (1)..(1): Xaa can be any naturally occurring amino acid
X

SEQ ID NO: 2302 - protein, 6 aa, Homo Sapiens
  misc_feature (1)..(1): Xaa can be any naturally occurring amino acid
XSCFAP

SEQ ID NO: 2303 - protein, 3 aa, Homo Sapiens
  misc_feature (1)..(1): Xaa can be any naturally occurring amino acid
XAP

SEQ ID NO: 2304 - protein, 31 aa, Homo Sapiens
  misc_feature (1)..(1): Xaa can be any naturally occurring amino acid
XKGLCLSANESWQRQNEKPSPYPAQGPVHHL

SEQ ID NO: 2305 - protein, 30 aa, Homo Sapiens
  misc_feature (1)..(1): Xaa can be any naturally occurring amino acid
XGLCLSANESWQRQNEKPSPYPAQGPVHHL

SEQ ID NO: 2306 - protein, 30 aa, Homo Sapiens; identical to SEQ ID NO: 2305
  misc_feature (1)..(1): Xaa can be any naturally occurring amino acid

SEQ ID NO: 2307 - protein, 26 aa, Homo Sapiens
  misc_feature (1)..(1): Xaa can be any naturally occurring amino acid
XSANESWQRQNEKPSPYPAQGPVHHL

SEQ ID NO: 2308 - protein, 24 aa, Homo Sapiens
  misc_feature (1)..(1): Xaa can be any naturally occurring amino acid
XNESWQRQNEKPSPYPAQGPVHHL

SEQ ID NO: 2309 - protein, 16 aa, Homo Sapiens
  misc_feature (1)..(1): Xaa can be any naturally occurring amino acid
XEKPSPYPAQGPVHHL

SEQ ID NO: 2310 - protein, 14 aa, Homo Sapiens
  misc_feature (1)..(1): Xaa can be any naturally occurring amino acid
XPSPYPAQGPVHHL

SEQ ID NO: 2311 - protein, 16 aa, Homo Sapiens
  misc_feature (1)..(1): Xaa can be any naturally occurring amino acid
XWYHQGLQKHPWNYSA

SEQ ID NO: 2312 - protein, 12 aa, Homo Sapiens
  misc_feature (1)..(1): Xaa can be any naturally occurring amino acid
XGLQKHPWNYSA

SEQ ID NO: 2313 - protein, 11 aa, Homo Sapiens
  misc_feature (1)..(1): Xaa can be any naturally occurring amino acid
XLQKHPWNYSA

SEQ ID NO: 2314 - protein, 10 aa, Homo Sapiens
  misc_feature (1)..(1): Xaa can be any naturally occurring amino acid
XQKHPWNYSA

SEQ ID NO: 2315 - protein, 8 aa, Homo Sapiens
  misc_feature (1)..(1): Xaa can be any naturally occurring amino acid
XHPWNYSA

SEQ ID NO: 2316 - protein, 5 aa, Homo Sapiens
WNYSA

SEQ ID NO: 2317 - protein, 4 aa, Homo Sapiens
NYSA

SEQ ID NO: 2318 - protein, 2 aa, Homo Sapiens
  misc_feature (1)..(1): Xaa can be any naturally occurring amino acid
XD

SEQ ID NO: 2319 - protein, 4 aa, Homo Sapiens
  misc_feature (1)..(1): Xaa can be any naturally occurring amino acid
XGDV

SEQ ID NO: 2320 - protein, 16 aa, Homo Sapiens
  misc_feature (1)..(1): Xaa can be any naturally occurring amino acid
XKEGEGSRNCYKTSWW

SEQ ID NO: 2321 - protein, 1 aa, Homo Sapiens
  misc_feature (1)..(1): Xaa can be any naturally occurring amino acid
X

SEQ ID NO: 2322 - skipped

SEQ ID NO: 2323 - protein, 24 aa, Homo Sapiens
  misc_feature (1)..(1): Xaa can be any naturally occurring amino acid
XGVAASSPSSNLQWNLCEAQQGFD

SEQ ID NO: 2324 - protein, 9 aa, Homo Sapiens
  misc_feature (1)..(1): Xaa can be any naturally occurring amino acid
XCEAQQGFD

SEQ ID NO: 2325 - protein, 6 aa, Homo Sapiens
  misc_feature (1)..(1): Xaa can be any naturally occurring amino acid
XSEVSK

SEQ ID NO: 2326 - protein, 11 aa, Homo Sapiens
  misc_feature (1)..(1): Xaa can be any naturally occurring amino acid
XRHHLHGGFDS

SEQ ID NO: 2327 - protein, 3 aa, Homo Sapiens
  misc_feature (1)..(1): Xaa can be any naturally occurring amino acid
XGK

SEQ ID NO: 2328 - protein, 25 aa, Homo Sapiens
NEEKDHPFCRRWRCWQQGGPDQQAY

SEQ ID NO: 2329 - protein, 25 aa, Homo Sapiens
  misc_feature (1)..(1): Xaa can be any naturally occurring amino acid
XEEKDHPFCRRWRCWQQGGPDQQAY

SEQ ID NO: 2330 - protein, 22 aa, Homo Sapiens
  misc_feature (1)..(1): Xaa can be any naturally occurring amino acid
XDHPFCRRWRCWQQGGPDQQAY

SEQ ID NO: 2331 - protein, 15 aa, Homo Sapiens
  misc_feature (1)..(1): Xaa can be any naturally occurring amino acid
XWRCWQQGGPDQQAY

SEQ ID NO: 2332 - protein, 8 aa, Homo Sapiens
  misc_feature (1)..(1): Xaa can be any naturally occurring amino acid
XGPDQQAY

SEQ ID NO: 2333 - protein, 2 aa, Homo Sapiens
  misc_feature (1)..(1): Xaa can be any naturally occurring amino acid
XY

SEQ ID NO: 2334 - protein, 21 aa, Homo Sapiens
  misc_feature (1)..(1): Xaa can be any naturally occurring amino acid
XGDCTRRGSHRAGCLLACPVS

SEQ ID NO: 2335 - protein, 41 aa, Homo Sapiens
  misc_feature (1)..(1): Xaa can be any naturally occurring amino acid
XNGGPLLHYQGKGKTGTSSPQEDLHHCRLHTGELGRQRRFG

SEQ ID NO: 2336 - protein, 40 aa, Homo Sapiens
  misc_feature (1)..(1): Xaa can be any naturally occurring amino acid
XGGPLLHYQGKGKTGTSSPQEDLHHCRLHTGELGRQRRFG

SEQ ID NO: 2337 - protein, 30 aa, Homo Sapiens
  misc_feature (1)..(1): Xaa can be any naturally occurring amino acid
XGKTGTSSPQEDLHHCRLHTGELGRQRRFG

SEQ ID NO: 2338 - protein, 30 aa, Homo Sapiens; identical to SEQ ID NO: 2337
  misc_feature (1)..(1): Xaa can be any naturally occurring amino acid

SEQ ID NO: 2339 - protein, 20 aa, Homo Sapiens
  misc_feature (1)..(1): Xaa can be any naturally occurring amino acid
XDLHHCRLHTGELGRQRRFG

SEQ ID NO: 2340 - protein, 11 aa, Homo Sapiens
  misc_feature (1)..(1): Xaa can be any naturally occurring amino acid
XAGGSYQDQLQ

SEQ ID NO: 2341 - protein, 1 aa, Homo Sapiens
S

SEQ ID NO: 2342 - protein, 7 aa, Homo Sapiens
  misc_feature (1)..(1): Xaa can be any naturally occurring amino acid
XARKGKG

SEQ ID NO: 2343 - protein, 68 aa, Homo Sapiens
  misc_feature (1)..(1): Xaa can be any naturally occurring amino acid
XRWQPPAHRQALHHPQRCPCWPQSGSHCCPPDWTSPGNQDCAGERELVLRASIKFVFMPKKKKKKKKK

SEQ ID NO: 2344 - protein, 49 aa, Homo Sapiens
CWPQSGSHCCPPDWTSPGNQDCAGERELVLRASIKFVFMPKKKKKKKKK

SEQ ID NO: 2345 - protein, 43 aa, Homo Sapiens
SHCCPPDWTSPGNQDCAGERELVLRASIKFVFMPKKKKKKKKK

SEQ ID NO: 2346 - protein, 39 aa, Homo Sapiens
  misc_feature (1)..(1): Xaa can be any naturally occurring amino acid
XPDWTSPGNQDCAGERELVLRASIKFVFMPKKKKKKKKK

SEQ ID NO: 2347 - protein, 31 aa, Homo Sapiens
NQDCAGERELVLRASIKFVFMPKKKKKKKKK

SEQ ID NO: 2348 - protein, 86 aa, Homo Sapiens
  misc_feature (1)..(1): Xaa can be any naturally occurring amino acid
XAHRALPHGSVPHEGARRPRLQPGGAQGGRHSQEGGPDHRHFCGSEEAEQVHGVPAGQRAAAEGVPLQTHPLPQEALGPQEGRQFC

SEQ ID NO: 2349 - protein, 1 aa, Homo Sapiens
  misc_feature (1)..(1): Xaa can be any naturally occurring amino acid
X

SEQ ID NO: 2350 - protein, 15 aa, Homo Sapiens
  misc_feature (1)..(1): Xaa can be any naturally occurring amino acid
XHPADRTGHARPERL

SEQ ID NO: 2351 - protein, 10 aa, Homo Sapiens
  misc_feature (1)..(1): Xaa can be any naturally occurring amino acid
XSQGSRRTGC

SEQ ID NO: 2352 - protein, 16 aa, Homo Sapiens
  misc_feature (1)..(1): Xaa can be any naturally occurring amino acid
XGLAAARGHVVQPAGP

SEQ ID NO: 2353 - protein, 6 aa, Homo Sapiens
  misc_feature (1)..(1): Xaa can be any naturally occurring amino acid
XSTQAP

SEQ ID NO: 2354 - protein, 1 aa, Homo Sapiens
F

SEQ ID NO: 2355 - protein, 8 aa, Homo Sapiens
  misc_feature (1)..(1): Xaa can be any naturally occurring amino acid
XWACLKYW

SEQ ID NO: 2356 - protein, 5 aa, Homo Sapiens
  misc_feature (1)..(1): Xaa can be any naturally occurring amino acid
XSWSA

SEQ ID NO: 2357 - protein, 3 aa, Homo Sapiens
  misc_feature (1)..(1): Xaa can be any naturally occurring amino acid
XYW

SEQ ID NO: 2358 - protein, 62 aa, Homo Sapiens
  misc_feature (1)..(1): Xaa can be any naturally occurring amino acid
XEEAVLYLCCYWSKEIHCCPVGEETYRCRCHEVHHCGVGYGLGCCPTSVPGSLLWLFHGRVF

SEQ ID NO: 2359 - protein, 50 aa, Homo Sapiens
SKEIHCCPVGEETYRCRCHEVHHCGVGYGLGCCPTSVPGSLLWLFHGRVF

SEQ ID NO: 2360 - protein, 2 aa, Homo Sapiens
  misc_feature (1)..(1): Xaa can be any naturally occurring amino acid
XC

SEQ ID NO: 2361 - protein, 12 aa, Homo Sapiens
  misc_feature (1)..(1): Xaa can be any naturally occurring amino acid
XRQGDLEVQLLP

SEQ ID NO: 2362 - protein, 9 aa, Homo Sapiens
  misc_feature (1)..(1): Xaa can be any naturally occurring amino acid
XCVHQGGPH

SEQ ID NO: 2363 - protein, 4 aa, Homo Sapiens
  misc_feature (1)..(1): Xaa can be any naturally occurring amino acid
XGPH

SEQ ID NO: 2364 - protein, 3 aa, Homo Sapiens
YHH

SEQ ID NO: 2365 - protein, 40 aa, Homo Sapiens
  misc_feature (1)..(1): Xaa can be any naturally occurring amino acid
XDWRQSGSQRSHAAEHAQHLPLLLWAGHPAGVRQWQHLQP

SEQ ID NO: 2366 - protein, 23 aa, Homo Sapiens
  misc_feature (1)..(1): Xaa can be any naturally occurring amino acid
XHLPLLLWAGHPAGVRQWQHLQP

SEQ ID NO: 2367 - protein, 17 aa, Homo Sapiens
  misc_feature (1)..(1): Xaa can be any naturally occurring amino acid
XWAGHPAGVRQWQHLQP

SEQ ID NO: 2368 - protein, 16 aa, Homo Sapiens
  misc_feature (1)..(1): Xaa can be any naturally occurring amino acid
XAGHPAGVRQWQHLQP

SEQ ID NO: 2369 - protein, 15 aa, Homo Sapiens
  misc_feature (1)..(1): Xaa can be any naturally occurring amino acid
XGHPAGVRQWQHLQP

SEQ ID NO: 2370 - protein, 14 aa, Homo Sapiens
  misc_feature (1)..(1): Xaa can be any naturally occurring amino acid
XHPAGVRQWQHLQP

SEQ ID NO: 2371 - protein, 7 aa, Homo Sapiens
  misc_feature (1)..(1): Xaa can be any naturally occurring amino acid
XWQHLQP

SEQ ID NO: 2372 - protein, 7 aa, Homo Sapiens
  misc_feature (1)..(1): Xaa can be any naturally occurring amino acid
XWQHLQP

SEQ ID NO: 2373 - protein, 6 aa, Homo Sapiens
  misc_feature (1)..(1): Xaa can be any naturally occurring amino acid
XQHLQP

SEQ ID NO: 2374 - protein, 55 aa, Homo Sapiens
RGNSAFSLPGGCPQCCQCLSADWLPNCCISTPFYHQRVQTSPGLVCGDGLHLPTC

SEQ ID NO: 2375 - protein, 53 aa, Homo Sapiens
  misc_feature (1)..(1): Xaa can be any naturally occurring amino acid
XSAFSLPGGCPQCCQCLSADWLPNCCISTPFYHQRVQTSPGLVCGDGLHLPTC

SEQ ID NO: 2376 - protein, 50 aa, Homo Sapiens
  misc_feature (1)..(1): Xaa can be any naturally occurring amino acid
XSLPGGCPQCCQCLSADWLPNCCISTPFYHQRVQTSPGLVCGDGLHLPTC

SEQ ID NO: 2377 - protein, 20 aa, Homo Sapiens
  misc_feature (1)..(1): Xaa can be any naturally occurring amino acid
XEWGQRLRGCGVWETPRTEG

SEQ ID NO: 2378 - protein, 12 aa, Homo Sapiens
  misc_feature (1)..(1): Xaa can be any naturally occurring amino acid
XGEDHAALGPNW

SEQ ID NO: 2379 - protein, 11 aa, Homo Sapiens
  misc_feature (1)..(1): Xaa can be any naturally occurring amino acid
XEDHAALGPNW

SEQ ID NO: 2380 - protein, 2 aa, Homo Sapiens
NW

SEQ ID NO: 2381 - protein, 2 aa, Homo Sapiens
  misc_feature (1)..(1): Xaa can be any naturally occurring amino acid
XW

SEQ ID NO: 2382 - protein, 5 aa, Homo Sapiens
  misc_feature (1)..(1): Xaa can be any naturally occurring amino acid
XEAPA

SEQ ID NO: 2383 - protein, 1 aa, Homo Sapiens
  misc_feature (1)..(1): Xaa can be any naturally occurring amino acid
X

SEQ ID NO: 2384 - protein, 7 aa, Homo Sapiens
  misc_feature (1)..(1): Xaa can be any naturally occurring amino acid
XHCGTQR

SEQ ID NO: 2385 - protein, 5 aa, Homo Sapiens
  misc_feature (1)..(1): Xaa can be any naturally occurring amino acid
XGTQR

SEQ ID NO: 2386 - protein, 45 aa, Homo Sapiens
  misc_feature (1)..(1): Xaa can be any naturally occurring amino acid
XHHPHLRTEGWEARAACHAPASPHSITGSPWQLYSGVWMLLSKDL

SEQ ID NO: 2387 - protein, 35 aa, Homo Sapiens
WEARAACHAPASPHSITGSPWQLYSGVWMLLSKDL

SEQ ID NO: 2388 - protein, 34 aa, Homo Sapiens
  misc_feature (1)..(1): Xaa can be any naturally occurring amino acid
XARAACHAPASPHSITGSPWQLYSGVWMLLSKDL

SEQ ID NO: 2389 - protein, 1 aa, Homo Sapiens
  misc_feature (1)..(1): Xaa can be any naturally occurring amino acid
X

SEQ ID NO: 2390 - protein, 3 aa, Homo Sapiens
  misc_feature (1)..(1): Xaa can be any naturally occurring amino acid
XGQ

SEQ ID NO: 2391 - protein, 20 aa, Homo Sapiens
  misc_feature (1)..(1): Xaa can be any naturally occurring amino acid
XYKKYWKDARHQDPRNQNCI

SEQ ID NO: 2392 - protein, 5 aa, Homo Sapiens
NQNCI

SEQ ID NO: 2393 - protein, 7 aa, Homo Sapiens
  misc_feature (1)..(1): Xaa can be any naturally occurring amino acid
XKMADND

SEQ ID NO: 2394 - protein, 35 aa, Homo Sapiens
  misc_feature (1)..(1): Xaa can be any naturally occurring amino acid
XTQQSDTEDLLCSAPTGPPNPEEDDGNHDPRGADK

SEQ ID NO: 2395 - protein, 10 aa, Homo Sapiens
  misc_feature (1)..(1): Xaa can be any naturally occurring amino acid
XNHDPRGADK

SEQ ID NO: 2396 - protein, 9 aa, Homo Sapiens
  misc_feature (1)..(1): Xaa can be any naturally occurring amino acid
XHDPRGADK

SEQ ID NO: 2397 - protein, 9 aa, Homo Sapiens
  misc_feature (1)..(1): Xaa can be any naturally occurring amino acid
XHDPRGADK

SEQ ID NO: 2398 - protein, 1 aa, Homo Sapiens
K

SEQ ID NO: 2399 - protein, 5 aa, Homo Sapiens
  misc_feature (1)..(1): Xaa can be any naturally occurring amino acid
XRSGQ

SEQ ID NO: 2400 - protein, 5 aa, Homo Sapiens
  misc_feature (1)..(1): Xaa can be any naturally occurring amino acid
XRSGQ

SEQ ID NO: 2401 - protein, 5 aa, Homo Sapiens
  misc_feature (1)..(1): Xaa can be any naturally occurring amino acid
XRSGQ

SEQ ID NO: 2402 - protein, 22 aa, Homo Sapiens
  misc_feature (1)..(1): Xaa can be any naturally occurring amino acid
XIDSRQHWKRHRKGLPIYLSSP

SEQ ID NO: 2403 - protein, 21 aa, Homo Sapiens
  misc_feature (1)..(1): Xaa can be any naturally occurring amino acid
XDSRQHWKRHRKGLPIYLSSP

SEQ ID NO: 2404 - protein, 20 aa, Homo Sapiens
  misc_feature (1)..(1): Xaa can be any naturally occurring amino acid
XSRQHWKRHRKGLPIYLSSP

SEQ ID NO: 2405 - protein, 18 aa, Homo Sapiens
RQHWKRHRKGLPIYLSSP

SEQ ID NO: 2406 - protein, 17 aa, Homo Sapiens
  misc_feature (1)..(1): Xaa can be any naturally occurring amino acid
XHWKRHRKGLPIYLSSP

SEQ ID NO: 2407 - protein, 14 aa, Homo Sapiens
  misc_feature (1)..(1): Xaa can be any naturally occurring amino acid
XRHRKGLPIYLSSP

SEQ ID NO: 2408 - protein, 14 aa, Homo Sapiens
  misc_feature (1)..(1): Xaa can be any naturally occurring amino acid
XRHRKGLPIYLSSP

SEQ ID NO: 2409 - protein, 14 aa, Homo Sapiens
  misc_feature (1)..(1): Xaa can be any naturally occurring amino acid
XRHRKGLPIYLSSP

SEQ ID NO: 2410 - protein, 13 aa, Homo Sapiens
  misc_feature (1)..(1): Xaa can be any naturally occurring amino acid
XHRKGLPIYLSSP

SEQ ID NO: 2411 - protein, 11 aa, Homo Sapiens
  misc_feature (1)..(1): Xaa can be any naturally occurring amino acid
XKGLPIYLSSP

SEQ ID NO: 2412 - protein, 8 aa, Homo Sapiens
  misc_feature (1)..(1): Xaa can be any naturally occurring amino acid
XPIYLSSP

SEQ ID NO: 2413 - protein, 6 aa, Homo Sapiens
  misc_feature (1)..(1): Xaa can be any naturally occurring amino acid
XYLSSP

SEQ ID NO: 2414 - protein, 10 aa, Homo Sapiens
  misc_feature (1)..(1): Xaa can be any naturally occurring amino acid
XSKNAEEAQV

SEQ ID NO: 2415 - protein, 10 aa, Homo Sapiens
  misc_feature (1)..(1): Xaa can be any naturally occurring amino acid
XSKNAEEAQV

SEQ ID NO: 2416 - protein, 9 aa, Homo Sapiens
  misc_feature (1)..(1): Xaa can be any naturally occurring amino acid
XKNAEEAQV

SEQ ID NO: 2417 - protein, 10 aa, Homo Sapiens
  misc_feature (1)..(1): Xaa can be any naturally occurring amino acid
XIGKAHGASW

SEQ ID NO: 2418 - protein, 9 aa, Homo Sapiens
  misc_feature (1)..(1): Xaa can be any naturally occurring amino acid
XGKAHGASW

SEQ ID NO: 2419 - protein, 6 aa, Homo Sapiens
AHGASW

SEQ ID NO: 2420 - protein, 7 aa, Homo Sapiens
  misc_feature (1)..(1): Xaa can be any naturally occurring amino acid
XAHGASW

SEQ ID NO: 2421 - protein, 4 aa, Homo Sapiens
  misc_feature (1)..(1): Xaa can be any naturally occurring amino acid
XASW

SEQ ID NO: 2422 - protein, 3 aa, Homo Sapiens
  misc_feature (1)..(1): Xaa can be any naturally occurring amino acid
XSW

SEQ ID NO: 2423 - protein, 1 aa, Homo Sapiens
Q

SEQ ID NO: 2424 - protein, 1 aa, Homo Sapiens
  misc_feature (1)..(1): Xaa can be any naturally occurring amino acid
X

SEQ ID NO: 2425 - protein, 8 aa, Homo Sapiens
SHWGRDRC

SEQ ID NO: 2426 - protein, 8 aa, Homo Sapiens
  misc_feature (1)..(1): Xaa can be any naturally occurring amino acid
XHWGRDRC

SEQ ID NO: 2427 - protein, 2 aa, Homo Sapiens
RC

SEQ ID NO: 2428 - protein, 1 aa, Homo Sapiens
  misc_feature (1)..(1): Xaa can be any naturally occurring amino acid
X

SEQ ID NO: 2429 - protein, 1 aa, Homo Sapiens
  misc_feature (1)..(1): Xaa can be any naturally occurring amino acid
X

SEQ ID NO: 2430 - protein, 22 aa, Homo Sapiens
  misc_feature (1)..(1): Xaa can be any naturally occurring amino acid
XTSPRICLKFRLQIVANKKCYL

SEQ ID NO: 2431 - protein, 16 aa, Homo Sapiens
  misc_feature (1)..(1): Xaa can be any naturally occurring amino acid
XLKFRLQIVANKKCYL

SEQ ID NO: 2432 - protein, 33 aa, Homo Sapiens
  misc_feature (1)..(1): Xaa can be any naturally occurring amino acid
XEKISSWLHCGCKSERSQLGYCKKRREGYSWTD

SEQ ID NO: 2433 - protein, 15 aa, Homo Sapiens
  misc_feature (1)..(1): Xaa can be any naturally occurring amino acid
XGYCKKRREGYSWTD

SEQ ID NO: 2434 - protein, 8 aa, Homo Sapiens
  misc_feature (1)..(1): Xaa can be any naturally occurring amino acid
XEAAYQEK

SEQ ID NO: 2435 - protein, 7 aa, Homo Sapiens
  misc_feature (1)..(1): Xaa can be any naturally occurring amino acid
XRGCRIC

SEQ ID NO: 2436 - protein, 20 aa, Homo Sapiens
  misc_feature (1)..(1): Xaa can be any naturally occurring amino acid
XAPGTNCEETQTFLSASFYF

SEQ ID NO: 2437 - protein, 8 aa, Homo Sapiens
  misc_feature (1)..(1): Xaa can be any naturally occurring amino acid
XLSASFYF

SEQ ID NO: 2438 - protein, 115 aa, Homo Sapiens
  misc_feature (1)..(1): Xaa can be any naturally occurring amino acid
XGATHALGRCADSAGAAPRAAGGAGWRELGGLGSRGALRAVRRACTGPVRASARRVRGAGARAGLRLLPDVRTERGPAVRHLHRALWLRPSLPAVARRGATAAGAAGRPRALRQR

SEQ ID NO: 2439 - protein, 21 aa, Homo Sapiens
  misc_feature (1)..(1): Xaa can be any naturally occurring amino acid
XEAPAVLQEHRSGLQDTQGGY

SEQ ID NO: 2440 - protein, 11 aa, Homo Sapiens
  misc_feature (1)..(1): Xaa can be any naturally occurring amino acid
XQIGVLNVLRT

SEQ ID NO: 2441 - protein, 1 aa, Homo Sapiens
  misc_feature (1)..(1): Xaa can be any naturally occurring amino acid
X

SEQ ID NO: 2442 - protein, 28 aa, Homo Sapiens
  misc_feature (1)..(1): Xaa can be any naturally occurring amino acid
XIQVPGHSKYHGPCQAWLPPKAQRHGHP

SEQ ID NO: 2443 - protein, 11 aa, Homo Sapiens
  misc_feature (1)..(1): Xaa can be any naturally occurring amino acid
XPPKAQRHGHP

SEQ ID NO: 2444 - protein, 37 aa, Homo Sapiens
VTEETLPEARIQVPGHSKYHGPCQAWLPPKAQRHGHP

SEQ ID NO: 2445 - protein, 37 aa, Homo Sapiens; identical to SEQ ID NO: 2444

SEQ ID NO: 2446 - protein, 28 aa, Homo Sapiens
  misc_feature (1)..(1): Xaa can be any naturally occurring amino acid
XIQVPGHSKYHGPCQAWLPPKAQRHGHP

SEQ ID NO: 2447 - protein, 11 aa, Homo Sapiens
  misc_feature (1)..(1): Xaa can be any naturally occurring amino acid
XPPKAQRHGHP

SEQ ID NO: 2448 - protein, 2 aa, Homo Sapiens
HP

SEQ ID NO: 2449 - protein, 6 aa, Homo Sapiens
  misc_feature (1)..(1): Xaa can be any naturally occurring amino acid
XGTDCS

SEQ ID NO: 2450 - protein, 75 aa, Homo Sapiens
GFRGCIGAGDRQCGSQAPEVHIPSCAGGPECLPHPQHPLRPHVARGPLLCHHCCGHGGSAQRSHLPAAALRTEEG

SEQ ID NO: 2451 - protein, 24 aa, Homo Sapiens
  misc_feature (1)..(1): Xaa can be any naturally occurring amino acid
XVDRRLHPGLAVHLPADVDQQAGV

SEQ ID NO: 2452 - protein, 12 aa, Homo Sapiens
LHRPPQMLLGGL

SEQ ID NO: 2453 - protein, 64 aa, Homo Sapiens
GRLPLHRGAPQAPGRDGGHGSEGFLCGRRGPEQERHPHPEVPHRARHRHQLGRHGENLAPHLLQ

SEQ ID NO: 2454 - protein, 10 aa, Homo Sapiens
  misc_feature (1)..(1): Xaa can be any naturally occurring amino acid
XENLAPHLLQ

SEQ ID NO: 2455 - protein, 1 aa, Homo Sapiens
  misc_feature (1)..(1): Xaa can be any naturally occurring amino acid
X

SEQ ID NO: 2456 - protein, 25 aa, Homo Sapiens
  misc_feature (1)..(1): Xaa can be any naturally occurring amino acid
XAPRAADRGPPEPQGQPREDDPDHV

SEQ ID NO: 2457 - protein, 22 aa, Homo Sapiens
  misc_feature (1)..(1): Xaa can be any naturally occurring amino acid
XAADRGPPEPQGQPREDDPDHV

SEQ ID NO: 2458 - protein, 18 aa, Homo Sapiens
  misc_feature (1)..(1): Xaa can be any naturally occurring amino acid
XGPPEPQGQPREDDPDHV

SEQ ID NO: 2459 - protein, 11 aa, Homo Sapiens
  misc_feature (1)..(1): Xaa can be any naturally occurring amino acid
XQPREDDPDHV

SEQ ID NO: 2460 - protein, 26 aa, Homo Sapiens
  misc_feature (1)..(1): Xaa can be any naturally occurring amino acid
XHVRCYPGCAIPVRLWPYHWHRDGLR

SEQ ID NO: 2461 - protein, 19 aa, Homo Sapiens
  misc_feature (1)..(1): Xaa can be any naturally occurring amino acid
XCAIPVRLWPYHWHRDGLR

SEQ ID NO: 2462 - protein, 14 aa, Homo Sapiens
  misc_feature (1)..(1): Xaa can be any naturally occurring amino acid
XRLWPYHWHRDGLR

SEQ ID NO: 2463 - protein, 7 aa, Homo Sapiens
  misc_feature (1)..(1): Xaa can be any naturally occurring amino acid
XHRDGLR

SEQ ID NO: 2464 - protein, 6 aa, Homo Sapiens
HRDGLR

SEQ ID NO: 2465 - protein, 1 aa, Homo Sapiens
  misc_feature (1)..(1): Xaa can be any naturally occurring amino acid
X

SEQ ID NO: 2466 - protein, 20 aa, Homo Sapiens
  misc_feature (1)..(1): Xaa can be any naturally occurring amino acid
XGVCPPPCHPASGPGWPGPD

SEQ ID NO: 2467 - protein, 18 aa, Homo Sapiens
  misc_feature (1)..(1): Xaa can be any naturally occurring amino acid
XCPPPCHPASGPGWPGPD

SEQ ID NO: 2468 - protein, 14 aa, Homo Sapiens
PCHPASGPGWPGPD

SEQ ID NO: 2469 - protein, 14 aa, Homo Sapiens
  misc_feature (1)..(1): Xaa can be any naturally occurring amino acid
XCHPASGPGWPGPD

SEQ ID NO: 2470 - protein, 8 aa, Homo Sapiens
GPGWPGPD

SEQ ID NO: 2471 - protein, 24 aa, Homo Sapiens
  misc_feature (1)..(1): Xaa can be any naturally occurring amino acid
XLPHEDPHRARLQLHHHGRAGNRA

SEQ ID NO: 2472 - protein, 6 aa, Homo Sapiens
  misc_feature (1)..(1): Xaa can be any naturally occurring amino acid
XAGNRA

SEQ ID NO: 2473 - protein, 4 aa, Homo Sapiens
  misc_feature (1)..(1): Xaa can be any naturally occurring amino acid
XNRA

SEQ ID NO: 2474 - protein, 3 aa, Homo Sapiens
  misc_feature (1)..(1): Xaa can be any naturally occurring amino acid
XRA

SEQ ID NO: 2475 - protein, 31 aa, Homo Sapiens
  misc_feature (1)..(1): Xaa can be any naturally occurring amino acid
XGEAVLRRPGLRARDGHGCFQLLPGEELRAA

SEQ ID NO: 2476 - protein, 30 aa, Homo Sapiens
  misc_feature (1)..(1): Xaa can be any naturally occurring amino acid
XEAVLRRPGLRARDGHGCFQLLPGEELRAA

SEQ ID NO: 2477 - protein, 29 aa, Homo Sapiens
  misc_feature (1)..(1): Xaa can be any naturally occurring amino acid
XAVLRRPGLRARDGHGCFQLLPGEELRAA

SEQ ID NO: 2478 - protein, 24 aa, Homo Sapiens
  misc_feature (1)..(1): Xaa can be any naturally occurring amino acid
XPGLRARDGHGCFQLLPGEELRAA

SEQ ID NO: 2479 - protein, 23 aa, Homo Sapiens
  misc_feature (1)..(1): Xaa can be any naturally occurring amino acid
XGLRARDGHGCFQLLPGEELRAA

SEQ ID NO: 2480 - protein, 14 aa, Homo Sapiens
  misc_feature (1)..(1): Xaa can be any naturally occurring amino acid
XCFQLLPGEELRAA

SEQ ID NO: 2481 - protein, 9 aa, Homo Sapiens
  misc_feature (1)..(1): Xaa can be any naturally occurring amino acid
XPGEELRAA

SEQ ID NO: 2482 - protein, 8 aa, Homo Sapiens
  misc_feature (1)..(1): Xaa can be any naturally occurring amino acid
XGEELRAA

SEQ ID NO: 2483 - protein, 6 aa, Homo Sapiens
  misc_feature (1)..(1): Xaa can be any naturally occurring amino acid
XELRAA

SEQ ID NO: 2484 - protein, 1 aa, Homo Sapiens
Q

SEQ ID NO: 2485 - protein, 4 aa, Homo Sapiens
  misc_feature (1)..(1): Xaa can be any naturally occurring amino acid
XPLP

SEQ ID NO: 2486 - protein, 2 aa, Homo Sapiens
  misc_feature (1)..(1): Xaa can be any naturally occurring amino acid
XV

SEQ ID NO: 2487 - protein, 135 aa, Homo Sapiens
  misc_feature (1)..(1): Xaa can be any naturally occurring amino acid
XLLPPGGGPGRRGEETCSRSSSWHCGEVEPQGGHACRAQRRPGLQLVPGHGQGPGSGEHPGVTRGGGLVARARVAGRQGDHGVAGQGSAERRAAARRGGARRPGRAAALTQQLHGAQRDLEAGQPTVRTQLSELR

SEQ ID NO: 2488 - protein, 15 aa, Homo Sapiens
  misc_feature (1)..(1): Xaa can be any naturally occurring amino acid
XECVCQGCSSWQRCW

SEQ ID NO: 2489 - protein, 9 aa, Homo Sapiens
  misc_feature (1)..(1): Xaa can be any naturally occurring amino acid
XCSSWQRCW

SEQ ID NO: 2490 - protein, 4 aa, Homo Sapiens
  misc_feature (1)..(1): Xaa can be any naturally occurring amino acid
XRCW

SEQ ID NO: 2491 - protein, 3 aa, Homo Sapiens
  misc_feature (1)..(1): Xaa can be any naturally occurring amino acid
XCW

SEQ ID NO: 2492 - protein, 1 aa, Homo Sapiens
  misc_feature (1)..(1): Xaa can be any naturally occurring amino acid
X

SEQ ID NO: 2493 - protein, 1 aa, Homo Sapiens
  misc_feature (1)..(1): Xaa can be any naturally occurring amino acid
X

SEQ ID NO: 2494 - protein, 39 aa, Homo Sapiens
  misc_feature (1)..(1): Xaa can be any naturally occurring amino acid
XGSSWLHCSGDYPEPSRPNKRRLCPCIGLPHGSHCMQVC

SEQ ID NO: 2495 - protein, 37 aa, Homo Sapiens
  misc_feature (1)..(1): Xaa can be any naturally occurring amino acid
XSWLHCSGDYPEPSRPNKRRLCPCIGLPHGSHCMQVC

SEQ ID NO: 2496 - protein, 32 aa, Homo Sapiens
  misc_feature (1)..(1): Xaa can be any naturally occurring amino acid
XSGDYPEPSRPNKRRLCPCIGLPHGSHCMQVC

SEQ ID NO: 2497 - protein, 13 aa, Homo Sapiens
  misc_feature (1)..(1): Xaa can be any naturally occurring amino acid
XFGQVHHYWPSDL

SEQ ID NO: 2498 - protein, 17 aa, Homo Sapiens
  misc_feature (1)..(1): Xaa can be any naturally occurring amino acid
XCPCIGLPHGSHCMQVC

SEQ ID NO: 2499 - protein, 14 aa, Homo Sapiens
CIGLPHGSHCMQVC

SEQ ID NO: 2500 - protein, 12 aa, Homo Sapiens
  misc_feature (1)..(1): Xaa can be any naturally occurring amino acid
XLPHGSHCMQVC

SEQ ID NO: 2501 - protein, 10 aa, Homo Sapiens
QVHHYWPSDL

SEQ ID NO: 2502 - protein, 6 aa, Homo Sapiens
  misc_feature (1)..(1): Xaa can be any naturally occurring amino acid
XCMQVC

SEQ ID NO: 2503 - protein, 3 aa, Homo Sapiens
  misc_feature (1)..(1): Xaa can be any naturally occurring amino acid
XVC

SEQ ID NO: 2504 - protein, 4 aa, Homo Sapiens
  misc_feature (1)..(1): Xaa can be any naturally occurring amino acid
XGKD

SEQ ID NO: 2505 - protein, 2 aa, Homo Sapiens
  misc_feature (1)..(1): Xaa can be any naturally occurring amino acid
XD

SEQ ID NO: 2506 - protein, 10 aa, Homo Sapiens
  misc_feature (1)..(1): Xaa can be any naturally occurring amino acid
XVHHYWPSDL

SEQ ID NO: 2507 - skipped

SEQ ID NO: 2508 - protein, 6 aa, Homo Sapiens
  misc_feature (1)..(1): Xaa can be any naturally occurring amino acid
XAGRWP

SEQ ID NO: 2509 - protein, 9 aa, Homo Sapiens
  misc_feature (1)..(1): Xaa can be any naturally occurring amino acid
XHHYWPSDL

SEQ ID NO: 2510 - protein, 5 aa, Homo Sapiens
  misc_feature (1)..(1): Xaa can be any naturally occurring amino acid
XLEVW

SEQ ID NO: 2511 - protein, 3 aa, Homo Sapiens
  misc_feature (1)..(1): Xaa can be any naturally occurring amino acid
XVW

SEQ ID NO: 2512 - protein, 6 aa, Homo Sapiens
WQAHVC

SEQ ID NO: 2513 - protein, 4 aa, Homo Sapiens
  misc_feature (1)..(1): Xaa can be any naturally occurring amino acid
XHVC

SEQ ID NO: 2514 - protein, 7 aa, Homo Sapiens
  misc_feature (1)..(1): Xaa can be any naturally occurring amino acid
XGSLCCS

SEQ ID NO: 2515 - protein, 5 aa, Homo Sapiens
SLCCS

SEQ ID NO: 2516 - protein, 28 aa, Homo Sapiens
  misc_feature (1)..(1): Xaa can be any naturally occurring amino acid
XGGCHQSSGQEGCWSWQGHQVCPESSEG

SEQ ID NO: 2517 - protein, 4 aa, Homo Sapiens
PSDL

SEQ ID NO: 2518 - protein, 12 aa, Homo Sapiens
QGHQVCPESSEG

SEQ ID NO: 2519 - protein, 43 aa, Homo Sapiens
  misc_feature (1)..(1): Xaa can be any naturally occurring amino acid
XNIIPNTCHPTLNQWWKNGLRTVCFNWPFKFSSKRLVNDNNAS

SEQ ID NO: 2520 - protein, 9 aa, Homo Sapiens
  misc_feature (1)..(1): Xaa can be any naturally occurring amino acid
XRWHRQKNH

SEQ ID NO: 2521 - protein, 5 aa, Homo Sapiens
  misc_feature (1)..(1): Xaa can be any naturally occurring amino acid
XQKNH

SEQ ID NO: 2522 - protein, 4 aa, Homo Sapiens
  misc_feature (1)..(1): Xaa can be any naturally occurring amino acid
XKNH

SEQ ID NO: 2523 - protein, 4 aa, Homo Sapiens
  misc_feature (1)..(1): Xaa can be any naturally occurring amino acid
XKNH

SEQ ID NO: 2524 - protein, 3 aa, Homo Sapiens
  misc_feature (1)..(1): Xaa can be any naturally occurring amino acid
XNH

SEQ ID NO: 2525 - protein, 2 aa, Homo Sapiens
  misc_feature (1)..(1): Xaa can be any naturally occurring amino acid
XH

SEQ ID NO: 2526 - protein, 1 aa, Homo Sapiens
  misc_feature (1)..(1): Xaa can be any naturally occurring amino acid
X

SEQ ID NO: 2527 - protein, 3 aa, Homo Sapiens
  misc_feature (1)..(1): Xaa can be any naturally occurring amino acid
XKI

SEQ ID NO: 2528 - protein, 2 aa, Homo Sapiens
  misc_feature (1)..(1): Xaa can be any naturally occurring amino acid
XI

SEQ ID NO: 2529 - protein, 2 aa, Homo Sapiens
  misc_feature (1)..(1): Xaa can be any naturally occurring amino acid
XI

SEQ ID NO: 2530 - protein, 1 aa, Homo Sapiens
  misc_feature (1)..(1): Xaa can be any naturally occurring amino acid
X

SEQ ID NO: 2531 - protein, 4 aa, Homo Sapiens
  misc_feature (1)..(1): Xaa can be any naturally occurring amino acid
XGGC

SEQ ID NO: 2532 - protein, 9 aa, Homo Sapiens
LLQVCLGLG

SEQ ID NO: 2533 - protein, 11 aa, Homo Sapiens
  misc_feature (1)..(1): Xaa can be any naturally occurring amino acid
XGLLQVCLGLG

SEQ ID NO: 2534 - protein, 11 aa, Homo Sapiens
  misc_feature (1)..(1): Xaa can be any naturally occurring amino acid
XGLLQVCLGLG

SEQ ID NO: 2535 - protein, 6 aa, Homo Sapiens
  misc_feature (1)..(1): Xaa can be any naturally occurring amino acid
XCLGLG

SEQ ID NO: 2536 - protein, 3 aa, Homo Sapiens
  misc_feature (1)..(1): Xaa can be any naturally occurring amino acid
XLG

SEQ ID NO: 2537 - protein, 2 aa, Homo Sapiens
  misc_feature (1)..(1): Xaa can be any naturally occurring amino acid
XG

SEQ ID NO: 2538 - protein, 1 aa, Homo Sapiens
  misc_feature (1)..(1): Xaa can be any naturally occurring amino acid
X

SEQ ID NO: 2539 - protein, 3 aa, Homo Sapiens
  misc_feature (1)..(1): Xaa can be any naturally occurring amino acid
XES

SEQ ID NO: 2540 - protein, 3 aa, Homo Sapiens
  misc_feature (1)..(1): Xaa can be any naturally occurring amino acid
XES

SEQ ID NO: 2541 - protein, 1 aa, Homo Sapiens
  misc_feature (1)..(1): Xaa can be any naturally occurring amino acid
X

SEQ ID NO: 2542 - protein, 1 aa, Homo Sapiens
  misc_feature (1)..(1): Xaa can be any naturally occurring amino acid
X

SEQ ID NO: 2543 - protein, 1 aa, Homo Sapiens
  misc_feature (1)..(1): Xaa can be any naturally occurring amino acid
X

SEQ ID NO: 2544 - protein, 3 aa, Homo Sapiens
  misc_feature (1)..(1): Xaa can be any naturally occurring amino acid
XEI

SEQ ID NO: 2545 - protein, 2 aa, Homo Sapiens
  misc_feature (1)..(1): Xaa can be any naturally occurring amino acid
XI

SEQ ID NO: 2546 - protein, 1 aa, Homo Sapiens
  misc_feature (1)..(1): Xaa can be any naturally occurring amino acid
X

SEQ ID NO: 2547 - protein, 8 aa, Homo Sapiens
  misc_feature (1)..(1): Xaa can be any naturally occurring amino acid
XQVLCDYH

SEQ ID NO: 2548 - protein, 7 aa, Homo Sapiens
  misc_feature (1)..(1): Xaa can be any naturally occurring amino acid
XVLCDYH

SEQ ID NO: 2549 - protein, 10 aa, Homo Sapiens
  misc_feature (1)..(1): Xaa can be any naturally occurring amino acid
XKHDYRDISG

SEQ ID NO: 2550 - protein, 9 aa, Homo Sapiens
  misc_feature (1)..(1): Xaa can be any naturally occurring amino acid
XHDYRDISG

SEQ ID NO: 2551 - protein, 8 aa, Homo Sapiens
  misc_feature (1)..(1): Xaa can be any naturally occurring amino acid
XDYRDISG

SEQ ID NO: 2552 - protein, 5 aa, Homo Sapiens
  misc_feature (1)..(1): Xaa can be any naturally occurring amino acid
XDISG

SEQ ID NO: 2553 - protein, 3 aa, Homo Sapiens
ISG

SEQ ID NO: 2554 - protein, 2 aa, Homo Sapiens
CW

SEQ ID NO: 2555 - protein, 1 aa, Homo Sapiens
  misc_feature (1)..(1): Xaa can be any naturally occurring amino acid
X

SEQ ID NO: 2556 - protein, 1 aa, Homo Sapiens
  misc_feature (1)..(1): Xaa can be any naturally occurring amino acid
X

SEQ ID NO: 2557 - protein, 29 aa, Homo Sapiens
  misc_feature (1)..(1): Xaa can be any naturally occurring amino acid
XSWYLQEWADPRACPSGLHTGCETTNCRC

SEQ ID NO: 2558 - protein, 28 aa, Homo Sapiens
  misc_feature (1)..(1): Xaa can be any naturally occurring amino acid
XWYLQEWADPRACPSGLHTGCETTNCRC

SEQ ID NO: 2559 - protein, 24 aa, Homo Sapiens
  misc_feature (1)..(1): Xaa can be any naturally occurring amino acid
XEWADPRACPSGLHTGCETTNCRC

SEQ ID NO: 2560 - protein, 24 aa, Homo Sapiens
  misc_feature (1)..(1): Xaa can be any naturally occurring amino acid
XEWADPRACPSGLHTGCETTNCRC

SEQ ID NO: 2561 - protein, 23 aa, Homo Sapiens
  misc_feature (1)..(1): Xaa can be any naturally occurring amino acid
XWADPRACPSGLHTGCETTNCRC

SEQ ID NO: 2562 - protein, 23 aa, Homo Sapiens
  misc_feature (1)..(1): Xaa can be any naturally occurring amino acid
XWADPRACPSGLHTGCETTNCRC

SEQ ID NO: 2563 - protein, 18 aa, Homo Sapiens
  misc_feature (1)..(1): Xaa can be any naturally occurring amino acid
XACPSGLHTGCETTNCRC

SEQ ID NO: 2564 - protein, 14 aa, Homo Sapiens
  misc_feature (1)..(1): Xaa can be any naturally occurring amino acid
XGLHTGCETTNCRC

SEQ ID NO: 2565 - protein, 13 aa, Homo Sapiens
  misc_feature (1)..(1): Xaa can be any naturally occurring amino acid
XLHTGCETTNCRC

SEQ ID NO: 2566 - protein, 12 aa, Homo Sapiens
LHTGCETTNCRC

SEQ ID NO: 2567 - protein, 11 aa, Homo Sapiens
  misc_feature (1)..(1): Xaa can be any naturally occurring amino acid
XTGCETTNCRC

SEQ ID NO: 2568 - protein, 10 aa, Homo Sapiens
TGCETTNCRC

SEQ ID NO: 2569 - protein, 10 aa, Homo Sapiens
  misc_feature (1)..(1): Xaa can be any naturally occurring amino acid
XGCETTNCRC

SEQ ID NO: 2570 - protein, 10 aa, Homo Sapiens
  misc_feature (1)..(1): Xaa can be any naturally occurring amino acid
XGCETTNCRC

SEQ ID NO: 2571 - protein, 9 aa, Homo Sapiens
  misc_feature (1)..(1): Xaa can be any naturally occurring amino acid
XCETTNCRC

SEQ ID NO: 2572 - protein, 8 aa, Homo Sapiens
CETTNCRC

SEQ ID NO: 2573 - protein, 7 aa, Homo Sapiens
  misc_feature (1)..(1): Xaa can be any naturally occurring amino acid
XTTNCRC

SEQ ID NO: 2574 - protein, 7 aa, Homo Sapiens
  misc_feature (1)..(1): Xaa can be any naturally occurring amino acid
XTTNCRC

SEQ ID NO: 2575 - protein, 6 aa, Homo Sapiens
  misc_feature (1)..(1): Xaa can be any naturally occurring amino acid
XTNCRC

SEQ ID NO: 2576 - protein, 6 aa, Homo Sapiens
  misc_feature (1)..(1): Xaa can be any naturally occurring amino acid
XTNCRC

SEQ ID NO: 2577 - protein, 5 aa, Homo Sapiens
  misc_feature (1)..(1): Xaa can be any naturally occurring amino acid
XNCRC

SEQ ID NO: 2578 - protein, 5 aa, Homo Sapiens
  misc_feature (1)..(1): Xaa can be any naturally occurring amino acid
XNCRC

SEQ ID NO: 2579 - protein, 4 aa, Homo Sapiens
  misc_feature (1)..(1): Xaa can be any naturally occurring amino acid
XCRC

SEQ ID NO: 2580 - protein, 4 aa, Homo Sapiens
  misc_feature (1)..(1): Xaa can be any naturally occurring amino acid
XCRC

SEQ ID NO: 2581 - protein, 2 aa, Homo Sapiens
  misc_feature (1)..(1): Xaa can be any naturally occurring amino acid
XC

SEQ ID NO: 2582 - protein, 6 aa, Homo Sapiens
  misc_feature (1)..(1): Xaa can be any naturally occurring amino acid
XQNGFH

SEQ ID NO: 2583 - protein, 6 aa, Homo Sapiens
  misc_feature (1)..(1): Xaa can be any naturally occurring amino acid
XQNGFH

SEQ ID NO: 2584 - protein, 5 aa, Homo Sapiens
  misc_feature (1)..(1): Xaa can be any naturally occurring amino acid
XNGFH

SEQ ID NO: 2585 - protein, 5 aa, Homo Sapiens
  misc_feature (1)..(1): Xaa can be any naturally occurring amino acid
XNGFH

SEQ ID NO: 2586 - protein, 5 aa, Homo Sapiens
  misc_feature (1)..(1): Xaa can be any naturally occurring amino acid
XNGFH

SEQ ID NO: 2587 - protein, 4 aa, Homo Sapiens
  misc_feature (1)..(1): Xaa can be any naturally occurring amino acid
XGFH

SEQ ID NO: 2588 - protein, 4 aa, Homo Sapiens
  misc_feature (1)..(1): Xaa can be any naturally occurring amino acid
XGFH

SEQ ID NO: 2589 - protein, 4 aa, Homo Sapiens
  misc_feature (1)..(1): Xaa can be any naturally occurring amino acid
XGFH

SEQ ID NO: 2590 - protein, 1 aa, Homo Sapiens
  misc_feature (1)..(1): Xaa can be any naturally occurring amino acid
X

SEQ ID NO: 2591 - skipped

SEQ ID NO: 2592 - protein, 9 aa, Homo Sapiens
  misc_feature (1)..(1): Xaa can be any naturally occurring amino acid
XATLQPEEI

SEQ ID NO: 2593 - protein, 9 aa, Homo Sapiens
  misc_feature (1)..(1): Xaa can be any naturally occurring amino acid
XATLQPEEI

SEQ ID NO: 2594 - protein, 8 aa, Homo Sapiens
  misc_feature (1)..(1): Xaa can be any naturally occurring amino acid
XTLQPEEI

SEQ ID NO: 2595 - protein, 5 aa, Homo Sapiens
  misc_feature (1)..(1): Xaa can be any naturally occurring amino acid
XPEEI

SEQ ID NO: 2596 - protein, 3 aa, Homo Sapiens
  misc_feature (1)..(1): Xaa can be any naturally occurring amino acid
XEI

SEQ ID NO: 2597 - protein, 2 aa, Homo Sapiens
  misc_feature (1)..(1): Xaa can be any naturally occurring amino acid
XI

SEQ ID NO: 2598 - protein, 2 aa, Homo Sapiens
  misc_feature (1)..(1): Xaa can be any naturally occurring amino acid
XI

SEQ ID NO: 2599 - protein, 4 aa, Homo Sapiens
  misc_feature (1)..(1): Xaa can be any naturally occurring amino acid
XGNC

SEQ ID NO: 2600 - protein, 3 aa, Homo Sapiens
  misc_feature (1)..(1): Xaa can be any naturally occurring amino acid
XNC

SEQ ID NO: 2601 - protein, 2 aa, Homo Sapiens
  misc_feature (1)..(1): Xaa can be any naturally occurring amino acid
XC

SEQ ID NO: 2602 - protein, 2 aa, Homo Sapiens
  misc_feature (1)..(1): Xaa can be any naturally occurring amino acid
XC

SEQ ID NO: 2603 - protein, 2 aa, Homo Sapiens
  misc_feature (1)..(1): Xaa can be any naturally occurring amino acid
XC

SEQ ID NO: 2604 - protein, 1 aa, Homo Sapiens
  misc_feature (1)..(1): Xaa can be any naturally occurring amino acid
X

SEQ ID NO: 2605 - skipped

SEQ ID NO: 2606 - protein, 7 aa, Homo Sapiens
  misc_feature (1)..(1): Xaa can be any naturally occurring amino acid
XGSQHLH

SEQ ID NO: 2607 - protein, 7 aa, Homo Sapiens
  misc_feature (1)..(1): Xaa can be any naturally occurring amino acid
XGSQHLH

SEQ ID NO: 2608 - protein, 5 aa, Homo Sapiens
  misc_feature (1)..(1): Xaa can be any naturally occurring amino acid
XQHLH

SEQ ID NO: 2609 - protein, 4 aa, Homo Sapiens
  misc_feature (1)..(1): Xaa can be any naturally occurring amino acid
XHLH

SEQ ID NO: 2610 - protein, 3 aa, Homo Sapiens
  misc_feature (1)..(1): Xaa can be any naturally occurring amino acid
XLH

SEQ ID NO: 2611 - protein, 2 aa, Homo Sapiens
LH

SEQ ID NO: 2612 - protein, 2 aa, Homo Sapiens
  misc_feature (1)..(1): Xaa can be any naturally occurring amino acid
XH

SEQ ID NO: 2613 - protein, 1 aa, Homo Sapiens
  misc_feature (1)..(1): Xaa can be any naturally occurring amino acid
X

SEQ ID NO: 2614 - protein, 20 aa, Homo Sapiens
  misc_feature (1)..(1): Xaa can be any naturally occurring amino acid
XENWLQPRHSSICANFWLEW

SEQ ID NO: 2615 - protein, 20 aa, Homo Sapiens
  misc_feature (1)..(1): Xaa can be any naturally occurring amino acid
XENWLQPRHSSICANFWLEW

SEQ ID NO: 2616 - protein, 20 aa, Homo Sapiens
  misc_feature (1)..(1): Xaa can be any naturally occurring amino acid
XENWLQPRHSSICANFWLEW

SEQ ID NO: 2617 - protein, 19 aa, Homo Sapiens
  misc_feature (1)..(1): Xaa can be any naturally occurring amino acid
XNWLQPRHSSICANFWLEW

SEQ ID NO: 2618 - protein, 18 aa, Homo Sapiens
  misc_feature (1)..(1): Xaa can be any naturally occurring amino acid
XWLQPRHSSICANFWLEW

SEQ ID NO: 2619 - protein, 18 aa, Homo Sapiens
  misc_feature (1)..(1): Xaa can be any naturally occurring amino acid
XWLQPRHSSICANFWLEW

SEQ ID NO: 2620 - protein, 15 aa, Homo Sapiens
  misc_feature (1)..(1): Xaa can be any naturally occurring amino acid
XPRHSSICANFWLEW

SEQ ID NO: 2621 - protein, 13 aa, Homo Sapiens
  misc_feature (1)..(1): Xaa can be any naturally occurring amino acid
XHSSICANFWLEW

SEQ ID NO: 2622 - protein, 12 aa, Homo Sapiens
  misc_feature (1)..(1): Xaa can be any naturally occurring amino acid
XSSICANFWLEW

SEQ ID NO: 2623 - protein, 12 aa, Homo Sapiens
  misc_feature (1)..(1): Xaa can be any naturally occurring amino acid
XSSICANFWLEW

SEQ ID NO: 2624 - protein, 11 aa, Homo Sapiens
SSICANFWLEW

SEQ ID NO: 2625 - protein, 11 aa, Homo Sapiens
  misc_feature (1)..(1): Xaa can be any naturally occurring amino acid
XSICANFWLEW

SEQ ID NO: 2626 - protein, 10 aa, Homo Sapiens
  misc_feature (1)..(1): Xaa can be any naturally occurring amino acid
XICANFWLEW

SEQ ID NO: 2627 - protein, 10 aa, Homo Sapiens
  misc_feature (1)..(1): Xaa can be any naturally occurring amino acid
XICANFWLEW

SEQ ID NO: 2628 - protein, 9 aa, Homo Sapiens
  misc_feature (1)..(1): Xaa can be any naturally occurring amino acid
XCANFWLEW

SEQ ID NO: 2629 - protein, 8 aa, Homo Sapiens
  misc_feature (1)..(1): Xaa can be any naturally occurring amino acid
XANFWLEW

SEQ ID NO: 2630 - protein, 8 aa, Homo Sapiens
  misc_feature (1)..(1): Xaa can be any naturally occurring amino acid
XANFWLEW

SEQ ID NO: 2631 - protein, 7 aa, Homo Sapiens
ANFWLEW

SEQ ID NO: 2632 - protein, 6 aa, Homo Sapiens
NFWLEW

SEQ ID NO: 2633 - protein, 6 aa, Homo Sapiens
  misc_feature (1)..(1): Xaa can be any naturally occurring amino acid
XFWLEW

SEQ ID NO: 2634 - protein, 5 aa, Homo Sapiens
  misc_feature (1)..(1): Xaa can be any naturally occurring amino acid
XWLEW

SEQ ID NO: 2635 - protein, 4 aa, Homo Sapiens
WLEW

SEQ ID NO: 2636 - protein, 4 aa, Homo Sapiens
  misc_feature (1)..(1): Xaa can be any naturally occurring amino acid
XLEW

SEQ ID NO: 2637 - protein, 3 aa, Homo Sapiens
LEW

SEQ ID NO: 2638 - protein, 3 aa, Homo Sapiens
  misc_feature (1)..(1): Xaa can be any naturally occurring amino acid
XEW

SEQ ID NO: 2639 - protein, 3 aa, Homo Sapiens
  misc_feature (1)..(1): Xaa can be any naturally occurring amino acid
XEW

SEQ ID NO: 2640 - protein, 3 aa, Homo Sapiens
  misc_feature (1)..(1): Xaa can be any naturally occurring amino acid
XEW

SEQ ID NO: 2641 - protein, 2 aa, Homo Sapiens
  misc_feature (1)..(1): Xaa can be any naturally occurring amino acid
XW

SEQ ID NO: 2642 - protein, 2 aa, Homo Sapiens
  misc_feature (1)..(1): Xaa can be any naturally occurring amino acid
XW

SEQ ID NO: 2643 - protein, 2 aa, Homo Sapiens
  misc_feature (1)..(1): Xaa can be any naturally occurring amino acid
XW

SEQ ID NO: 2644 - protein, 1 aa, Homo Sapiens
  misc_feature (1)..(1): Xaa can be any naturally occurring amino acid
X

SEQ ID NO: 2645 - skipped

SEQ ID NO: 2646 - protein, 8 aa, Homo Sapiens
  misc_feature (1)..(1): Xaa can be any naturally occurring amino acid
XQHAGAKC

SEQ ID NO: 2647 - protein, 7 aa, Homo Sapiens
  misc_feature (1)..(1): Xaa can be any naturally occurring amino acid
XHAGAKC

SEQ ID NO: 2648 - protein, 7 aa, Homo Sapiens
  misc_feature (1)..(1): Xaa can be any naturally occurring amino acid
XHAGAKC

SEQ ID NO: 2649 - protein, 6 aa, Homo Sapiens
  misc_feature (1)..(1): Xaa can be any naturally occurring amino acid
XAGAKC

SEQ ID NO: 2650 - protein, 6 aa, Homo Sapiens
  misc_feature (1)..(1): Xaa can be any naturally occurring amino acid
XAGAKC

SEQ ID NO: 2651 - protein, 6 aa, Homo Sapiens
  misc_feature (1)..(1): Xaa can be any naturally occurring amino acid
XAGAKC

SEQ ID NO: 2652 - protein, 5 aa, Homo Sapiens
  misc_feature (1)..(1): Xaa can be any naturally occurring amino acid
XGAKC

SEQ ID NO: 2653 - protein, 5 aa, Homo Sapiens
  misc_feature (1)..(1): Xaa can be any naturally occurring amino acid
XGAKC

SEQ ID NO: 2654 - protein, 4 aa, Homo Sapiens
GAKC

SEQ ID NO: 2655 - protein, 4 aa, Homo Sapiens
  misc_feature (1)..(1): Xaa can be any naturally occurring amino acid
XAKC

SEQ ID NO: 2656 - protein, 3 aa, Homo Sapiens
  misc_feature (1)..(1): Xaa can be any naturally occurring amino acid
XKC

SEQ ID NO: 2657 - protein, 2 aa, Homo Sapiens
KC

SEQ ID NO: 2658 - protein, 2 aa, Homo Sapiens
  misc_feature (1)..(1): Xaa can be any naturally occurring amino acid
XC

SEQ ID NO: 2659 - protein, 2 aa, Homo Sapiens
  misc_feature (1)..(1): Xaa can be any naturally occurring amino acid
XC

SEQ ID NO: 2660 - skipped

SEQ ID NO: 2661 - protein, 12 aa, Homo Sapiens
  misc_feature (1)..(1): Xaa can be any naturally occurring amino acid
XHALVQGMESHP

SEQ ID NO: 2662 - protein, 12 aa, Homo Sapiens
  misc_feature (1)..(1): Xaa can be any naturally occurring amino acid
XHALVQGMESHP

SEQ ID NO: 2663 - protein, 11 aa, Homo Sapiens
  misc_feature (1)..(1): Xaa can be any naturally occurring amino acid
XALVQGMESHP

SEQ ID NO: 2664 - protein, 11 aa, Homo Sapiens
  misc_feature (1)..(1): Xaa can be any naturally occurring amino acid
XALVQGMESHP

SEQ ID NO: 2665 - protein, 11 aa, Homo Sapiens
  misc_feature (1)..(1): Xaa can be any naturally occurring amino acid
XALVQGMESHP

SEQ ID NO: 2666 - protein, 10 aa, Homo Sapiens
  misc_feature (1)..(1): Xaa can be any naturally occurring amino acid
XLVQGMESHP

SEQ ID NO: 2667 - protein, 9 aa, Homo Sapiens
LVQGMESHP

SEQ ID NO: 2668 - protein, 9 aa, Homo Sapiens
  misc_feature (1)..(1): Xaa can be any naturally occurring amino acid
XVQGMESHP

SEQ ID NO: 2669 - protein, 8 aa, Homo Sapiens
  misc_feature (1)..(1): Xaa can be any naturally occurring amino acid
XQGMESHP

SEQ ID NO: 2670 - protein, 8 aa, Homo Sapiens
  misc_feature (1)..(1): Xaa can be any naturally occurring amino acid
XQGMESHP

SEQ ID NO: 2671 - protein, 7 aa, Homo Sapiens
  misc_feature (1)..(1): Xaa can be any naturally occurring amino acid
XGMESHP

SEQ ID NO: 2672 - protein, 7 aa, Homo Sapiens
  misc_feature (1)..(1): Xaa can be any naturally occurring amino acid
XGMESHP

SEQ ID NO: 2673 - protein, 6 aa, Homo Sapiens
  misc_feature (1)..(1): Xaa can be any naturally occurring amino acid
XMESHP

SEQ ID NO: 2674 - protein, 5 aa, Homo Sapiens
MESHP

SEQ ID NO: 2675 - protein, 5 aa, Homo Sapiens
  misc_feature (1)..(1): Xaa can be any naturally occurring amino acid
XESHP

SEQ ID NO: 2676 - protein, 4 aa, Homo Sapiens
  misc_feature (1)..(1): Xaa can be any naturally occurring amino acid
XSHP

SEQ ID NO: 2677 - protein, 4 aa, Homo Sapiens
  misc_feature (1)..(1): Xaa can be any naturally occurring amino acid
XSHP

SEQ ID NO: 2678 - protein, 4 aa, Homo Sapiens
  misc_feature (1)..(1): Xaa can be any naturally occurring amino acid
XSHP

SEQ ID NO: 2679 - protein, 3 aa, Homo Sapiens
  misc_feature (1)..(1): Xaa can be any naturally occurring amino acid
XHP

SEQ ID NO: 2680 - protein, 27 aa, Homo Sapiens
  misc_feature (1)..(1): Xaa can be any naturally occurring amino acid
XGKDSYQHCRHWTRRFGQVHHYWPSDL

SEQ ID NO: 2681 - protein, 2 aa, Homo Sapiens
  misc_feature (1)..(1): Xaa can be any naturally occurring amino acid
XP

SEQ ID NO: 2682 - protein, 2 aa, Homo Sapiens
  misc_feature (1)..(1): Xaa can be any naturally occurring amino acid
XP

SEQ ID NO: 2683 - protein, 1 aa, Homo Sapiens
  misc_feature (1)..(1): Xaa can be any naturally occurring amino acid
X

SEQ ID NO: 2684 - protein, 11 aa, Homo Sapiens
  misc_feature (1)..(1): Xaa can be any naturally occurring amino acid
XGWQCQWNHAA

SEQ ID NO: 2685 - protein, 11 aa, Homo Sapiens
  misc_feature (1)..(1): Xaa can be any naturally occurring amino acid
XGWQCQWNHAA

SEQ ID NO: 2686 - protein, 10 aa, Homo Sapiens
  misc_feature (1)..(1): Xaa can be any naturally occurring amino acid
XWQCQWNHAA

SEQ ID NO: 2687 - protein, 8 aa, Homo Sapiens
QCQWNHAA

SEQ ID NO: 2688 - protein, 8 aa, Homo Sapiens
  misc_feature (1)..(1): Xaa can be any naturally occurring amino acid
XCQWNHAA

SEQ ID NO: 2689 - protein, 8 aa, Homo Sapiens
  misc_feature (1)..(1): Xaa can be any naturally occurring amino acid
XCQWNHAA

SEQ ID NO: 2690 - protein, 7 aa, Homo Sapiens
  misc_feature (1)..(1): Xaa can be any naturally occurring amino acid
XQWNHAA

SEQ ID NO: 2691 - protein, 7 aa, Homo Sapiens
  misc_feature (1)..(1): Xaa can be any naturally occurring amino acid
XQWNHAA

SEQ ID NO: 2692 - protein, 6 aa, Homo Sapiens
  misc_feature (1)..(1): Xaa can be any naturally occurring amino acid
XWNHAA

SEQ ID NO: 2693 - protein, 6 aa, Homo Sapiens
  misc_feature (1)..(1): Xaa can be any naturally occurring amino acid
XWNHAA

SEQ ID NO: 2694 - protein, 6 aa, Homo Sapiens
  misc_feature (1)..(1): Xaa can be any naturally occurring amino acid
XWNHAA

SEQ ID NO: 2695 - protein, 5 aa, Homo Sapiens
  misc_feature (1)..(1): Xaa can be any naturally occurring amino acid
XNHAA

SEQ ID NO: 2696 - protein, 4 aa, Homo Sapiens
NHAA

SEQ ID NO: 2697 - protein, 4 aa, Homo Sapiens
  misc_feature (1)..(1): Xaa can be any naturally occurring amino acid
XHAA

SEQ ID NO: 2698 - protein, 3 aa, Homo Sapiens
  misc_feature (1)..(1): Xaa can be any naturally occurring amino acid
XAA

SEQ ID NO: 2699 - protein, 3 aa, Homo Sapiens
  misc_feature (1)..(1): Xaa can be any naturally occurring amino acid
XAA

SEQ ID NO: 2700 - protein, 2 aa, Homo Sapiens
AA

SEQ ID NO: 2701 - protein, 2 aa, Homo Sapiens
  misc_feature (1)..(1): Xaa can be any naturally occurring amino acid
XA

SEQ ID NO: 2702 - protein, 2 aa, Homo Sapiens
  misc_feature (1)..(1): Xaa can be any naturally occurring amino acid
XA

SEQ ID NO: 2703 - protein, 1 aa, Homo Sapiens
A

SEQ ID NO: 2704 - protein, 1 aa, Homo Sapiens
  misc_feature (1)..(1): Xaa can be any naturally occurring amino acid
X

SEQ ID NO: 2705 - protein, 1 aa, Homo Sapiens
  misc_feature (1)..(1): Xaa can be any naturally occurring amino acid
X

SEQ ID NO: 2706 - protein, 25 aa, Homo Sapiens
  misc_feature (1)..(1): Xaa can be any naturally occurring amino acid
XDSYQHCRHWTRRFGQVHHYWPSDL

SEQ ID NO: 2707 - protein, 13 aa, Homo Sapiens
  misc_feature (1)..(1): Xaa can be any naturally occurring amino acid
XGSGLHPTTNSSN

SEQ ID NO: 2708 - protein, 13 aa, Homo Sapiens
  misc_feature (1)..(1): Xaa can be any naturally occurring amino acid
XGSGLHPTTNSSN

SEQ ID NO: 2709 - protein, 12 aa, Homo Sapiens
  misc_feature (1)..(1): Xaa can be any naturally occurring amino acid
XSGLHPTTNSSN

SEQ ID NO: 2710 - protein, 10 aa, Homo Sapiens
GLHPTTNSSN

SEQ ID NO: 2711 - protein, 25 aa, Homo Sapiens
  misc_feature (1)..(1): Xaa can be any naturally occurring amino acid
XDSYQHCRHWTRRFGQVHHYWPSDL

SEQ ID NO: 2712 - protein, 10 aa, Homo Sapiens
  misc_feature (1)..(1): Xaa can be any naturally occurring amino acid
XLHPTTNSSN

SEQ ID NO: 2713 - protein, 9 aa, Homo Sapiens
  misc_feature (1)..(1): Xaa can be any naturally occurring amino acid
XHPTTNSSN

SEQ ID NO: 2714 - protein, 9 aa, Homo Sapiens
  misc_feature (1)..(1): Xaa can be any naturally occurring amino acid
XHPTTNSSN

SEQ ID NO: 2715 - protein, 6 aa, Homo Sapiens
  misc_feature (1)..(1): Xaa can be any naturally occurring amino acid
XTNSSN

SEQ ID NO: 2716 - protein, 5 aa, Homo Sapiens
TNSSN

SEQ ID NO: 2717 - protein, 4 aa, Homo Sapiens
NSSN

SEQ ID NO: 2718 - protein, 4 aa, Homo Sapiens
  misc_feature (1)..(1): Xaa can be any naturally occurring amino acid
XSSN

SEQ ID NO: 2719 - protein, 3 aa, Homo Sapiens
  misc_feature (1)..(1): Xaa can be any naturally occurring amino acid
XSN

SEQ ID NO: 2720 - protein, 2 aa, Homo Sapiens
SN

SEQ ID NO: 2721 - protein, 54 aa, Homo Sapiens
  misc_feature (1)..(1): Xaa can be any naturally occurring amino acid
XQALAPASPGCLQNWWYWYCSCWPSGDWCSQTRYGGHLCSSQRYNGSKICRNAP

SEQ ID NO: 2722 - protein, 54 aa, Homo Sapiens; identical to SEQ ID NO: 2721
  misc_feature (1)..(1): Xaa can be any naturally occurring amino acid

SEQ ID NO: 2723 - protein, 53 aa, Homo Sapiens
  misc_feature (1)..(1): Xaa can be any naturally occurring amino acid
XALAPASPGCLQNWWYWYCSCWPSGDWCSQTRYGGHLCSSQRYNGSKICRNAP

SEQ ID NO: 2724 - protein, 52 aa, Homo Sapiens
  misc_feature (1)..(1): Xaa can be any naturally occurring amino acid
XLAPASPGCLQNWWYWYCSCWPSGDWCSQTRYGGHLCSSQRYNGSKICRNAP

SEQ ID NO: 2725 - protein, 51 aa, Homo Sapiens
  misc_feature (1)..(1): Xaa can be any naturally occurring amino acid
XAPASPGCLQNWWYWYCSCWPSGDWCSQTRYGGHLCSSQRYNGSKICRNAP

SEQ ID NO: 2726 - protein, 51 aa, Homo Sapiens; identical to SEQ ID NO: 2725
  misc_feature (1)..(1): Xaa can be any naturally occurring amino acid

SEQ ID NO: 2727 - protein, 50 aa, Homo Sapiens
  misc_feature (1)..(1): Xaa can be any naturally occurring amino acid
XPASPGCLQNWWYWYCSCWPSGDWCSQTRYGGHLCSSQRYNGSKICRNAP

SEQ ID NO: 2728 - protein, 49 aa, Homo Sapiens
  misc_feature (1)..(1): Xaa can be any naturally occurring amino acid
XASPGCLQNWWYWYCSCWPSGDWCSQTRYGGHLCSSQRYNGSKICRNAP

SEQ ID NO: 2729 - protein, 48 aa, Homo Sapiens
  misc_feature (1)..(1): Xaa can be any naturally occurring amino acid
XSPGCLQNWWYWYCSCWPSGDWCSQTRYGGHLCSSQRYNGSKICRNAP

SEQ ID NO: 2730 - protein, 47 aa, Homo Sapiens
SPGCLQNWWYWYCSCWPSGDWCSQTRYGGHLCSSQRYNGSKICRNAP

SEQ ID NO: 2731 - protein, 47 aa, Homo Sapiens
  misc_feature (1)..(1): Xaa can be any naturally occurring amino acid
XPGCLQNWWYWYCSCWPSGDWCSQTRYGGHLCSSQRYNGSKICRNAP

SEQ ID NO: 2732 - protein, 46 aa, Homo Sapiens
  misc_feature (1)..(1): Xaa can be any naturally occurring amino acid
XGCLQNWWYWYCSCWPSGDWCSQTRYGGHLCSSQRYNGSKICRNAP

SEQ ID NO: 2733 - protein, 42 aa, Homo Sapiens
  misc_feature (1)..(1): Xaa can be any naturally occurring amino acid
XNWWYWYCSCWPSGDWCSQTRYGGHLCSSQRYNGSKICRNAP

SEQ ID NO: 2734 - protein, 40 aa, Homo Sapiens
  misc_feature (1)..(1): Xaa can be any naturally occurring amino acid
XWYWYCSCWPSGDWCSQTRYGGHLCSSQRYNGSKICRNAP

SEQ ID NO: 2735 - protein, 39 aa, Homo Sapiens
WYWYCSCWPSGDWCSQTRYGGHLCSSQRYNGSKICRNAP

SEQ ID NO: 2736 - protein, 38 aa, Homo Sapiens
YWYCSCWPSGDWCSQTRYGGHLCSSQRYNGSKICRNAP

SEQ ID NO: 2737 - protein, 35 aa, Homo Sapiens
  misc_feature (1)..(1): Xaa can be any naturally occurring amino acid
XSCWPSGDWCSQTRYGGHLCSSQRYNGSKICRNAP

SEQ ID NO: 2738 - protein, 34 aa, Homo Sapiens
  misc_feature (1)..(1): Xaa can be any naturally occurring amino acid
XCWPSGDWCSQTRYGGHLCSSQRYNGSKICRNAP

SEQ ID NO: 2739 - protein, 33 aa, Homo Sapiens
CWPSGDWCSQTRYGGHLCSSQRYNGSKICRNAP

SEQ ID NO: 2740 - protein, 33 aa, Homo Sapiens
  misc_feature (1)..(1): Xaa can be any naturally occurring amino acid
XWPSGDWCSQTRYGGHLCSSQRYNGSKICRNAP

SEQ ID NO: 2741 - protein, 32 aa, Homo Sapiens
WPSGDWCSQTRYGGHLCSSQRYNGSKICRNAP

SEQ ID NO: 2742 - protein, 31 aa, Homo Sapiens
  misc_feature (1)..(1): Xaa can be any naturally occurring amino acid
XSGDWCSQTRYGGHLCSSQRYNGSKICRNAP

SEQ ID NO: 2743 - protein, 30 aa, Homo Sapiens
  misc_feature (1)..(1): Xaa can be any naturally occurring amino acid
XGDWCSQTRYGGHLCSSQRYNGSKICRNAP

SEQ ID NO: 2744 - protein, 29 aa, Homo Sapiens
GDWCSQTRYGGHLCSSQRYNGSKICRNAP

SEQ ID NO: 2745 - protein, 29 aa, Homo Sapiens
  misc_feature (1)..(1): Xaa can be any naturally occurring amino acid
XDWCSQTRYGGHLCSSQRYNGSKICRNAP

SEQ ID NO: 2746 - protein, 29 aa, Homo Sapiens
  misc_feature (1)..(1): Xaa can be any naturally occurring amino acid
XDWCSQTRYGGHLCSSQRYNGSKICRNAP

SEQ ID NO: 2747 - protein, 26 aa, Homo Sapiens
CSQTRYGGHLCSSQRYNGSKICRNAP

SEQ ID NO: 2748 - protein, 26 aa, Homo Sapiens
  misc_feature (1)..(1): Xaa can be any naturally occurring amino acid
XSQTRYGGHLCSSQRYNGSKICRNAP

SEQ ID NO: 2749 - protein, 26 aa, Homo Sapiens
  misc_feature (1)..(1): Xaa can be any naturally occurring amino acid
XSQTRYGGHLCSSQRYNGSKICRNAP

SEQ ID NO: 2750 - protein, 23 aa, Homo Sapiens
  misc_feature (1)..(1): Xaa can be any naturally occurring amino acid
XRYGGHLCSSQRYNGSKICRNAP

SEQ ID NO: 2751 - protein, 22 aa, Homo Sapiens
  misc_feature (1)..(1): Xaa can be any naturally occurring amino acid
XYGGHLCSSQRYNGSKICRNAP

SEQ ID NO: 2752 - protein, 21 aa, Homo Sapiens
  misc_feature (1)..(1): Xaa can be any naturally occurring amino acid
XHCRHWTRRFGQVHHYWPSDL

SEQ ID NO: 2753 - protein, 20 aa, Homo Sapiens
  misc_feature (1)..(1): Xaa can be any naturally occurring amino acid
XGHLCSSQRYNGSKICRNAP

SEQ ID NO: 2754 - protein, 19 aa, Homo Sapiens
  misc_feature (1)..(1): Xaa can be any naturally occurring amino acid
XHLCSSQRYNGSKICRNAP

SEQ ID NO: 2755 - protein, 17 aa, Homo Sapiens
  misc_feature (1)..(1): Xaa can be any naturally occurring amino acid
XCSSQRYNGSKICRNAP

SEQ ID NO: 2756 - protein, 17 aa, Homo Sapiens
  misc_feature (1)..(1): Xaa can be any naturally occurring amino acid
XCSSQRYNGSKICRNAP

SEQ ID NO: 2757 - protein, 16 aa, Homo Sapiens
  misc_feature (1)..(1): Xaa can be any naturally occurring amino acid
XSSQRYNGSKICRNAP

SEQ ID NO: 2758 - protein, 16 aa, Homo Sapiens
  misc_feature (1)..(1): Xaa can be any naturally occurring amino acid
XSSQRYNGSKICRNAP

SEQ ID NO: 2759 - protein, 13 aa, Homo Sapiens
  misc_feature (1)..(1): Xaa can be any naturally occurring amino acid
XRYNGSKICRNAP

SEQ ID NO: 2760 - protein, 12 aa, Homo Sapiens
  misc_feature (1)..(1): Xaa can be any naturally occurring amino acid
XYNGSKICRNAP

SEQ ID NO: 2761 - protein, 12 aa, Homo Sapiens
  misc_feature (1)..(1): Xaa can be any naturally occurring amino acid
XYNGSKICRNAP

SEQ ID NO: 2762 - protein, 11 aa, Homo Sapiens
  misc_feature (1)..(1): Xaa can be any naturally occurring amino acid
XNGSKICRNAP

SEQ ID NO: 2763 - protein, 9 aa, Homo Sapiens
GSKICRNAP

SEQ ID NO: 2764 - protein, 9 aa, Homo Sapiens
  misc_feature (1)..(1): Xaa can be any naturally occurring amino acid
XSKICRNAP

SEQ ID NO: 2765 - protein, 8 aa, Homo Sapiens
  misc_feature (1)..(1): Xaa can be any naturally occurring amino acid
XKICRNAP

SEQ ID NO: 2766 - protein, 8 aa, Homo Sapiens
  misc_feature (1)..(1): Xaa can be any naturally occurring amino acid
XKICRNAP

SEQ ID NO: 2767 - protein, 7 aa, Homo Sapiens
  misc_feature (1)..(1): Xaa can be any naturally occurring amino acid
XICRNAP

SEQ ID NO: 2768 - protein, 5 aa, Homo Sapiens
  misc_feature (1)..(1): Xaa can be any naturally occurring amino acid
XRNAP

SEQ ID NO: 2769 - protein, 4 aa, Homo Sapiens
  misc_feature (1)..(1): Xaa can be any naturally occurring amino acid
XNAP

SEQ ID NO: 2770 - protein, 3 aa, Homo Sapiens
  misc_feature (1)..(1): Xaa can be any naturally occurring amino acid
XAP

SEQ ID NO: 2771 - protein, 1 aa, Homo Sapiens
  misc_feature (1)..(1): Xaa can be any naturally occurring amino acid
X

SEQ ID NO: 2772 - protein, 4 aa, Homo Sapiens
  misc_feature (1)..(1): Xaa can be any naturally occurring amino acid
XSFE

SEQ ID NO: 2773 - protein, 4 aa, Homo Sapiens
  misc_feature (1)..(1): Xaa can be any naturally occurring amino acid
XSFE

SEQ ID NO: 2774 - protein, 3 aa, Homo Sapiens
  misc_feature (1)..(1): Xaa can be any naturally occurring amino acid
XFE

SEQ ID NO: 2775 - protein, 3 aa, Homo Sapiens
  misc_feature (1)..(1): Xaa can be any naturally occurring amino acid
XFE

SEQ ID NO: 2776 - protein, 2 aa, Homo Sapiens
FE

SEQ ID NO: 2777 - protein, 2 aa, Homo Sapiens
  misc_feature (1)..(1): Xaa can be any naturally occurring amino acid
XE

SEQ ID NO: 2778 - protein, 26 aa, Homo Sapiens
  misc_feature (1)..(1): Xaa can be any naturally occurring amino acid
XSSWGQCGLQCQECVCQGCSSWQRCW

SEQ ID NO: 2779 - protein, 22 aa, Homo Sapiens
  misc_feature (1)..(1): Xaa can be any naturally occurring amino acid
XQCGLQCQECVCQGCSSWQRCW

SEQ ID NO: 2780 - protein, 21 aa, Homo Sapiens
  misc_feature (1)..(1): Xaa can be any naturally occurring amino acid
XCGLQCQECVCQGCSSWQRCW

SEQ ID NO: 2781 - protein, 18 aa, Homo Sapiens
LQCQECVCQGCSSWQRCW

SEQ ID NO: 2782 - protein, 17 aa, Homo Sapiens
  misc_feature (1)..(1): Xaa can be any naturally occurring amino acid
XCQECVCQGCSSWQRCW

SEQ ID NO: 2783 - protein, 15 aa, Homo Sapiens
  misc_feature (1)..(1): Xaa can be any naturally occurring amino acid
XECVCQGCSSWQRCW

SEQ ID NO: 2784 - protein, 30 aa, Homo Sapiens
  misc_feature (1)..(1): Xaa can be any naturally occurring amino acid
XSHRCSVQRGSGPRALRTTPLPFWPNQPHP

SEQ ID NO: 2785 - protein, 14 aa, Homo Sapiens
  misc_feature (1)..(1): Xaa can be any naturally occurring amino acid
XTTPLPFWPNQPHP

SEQ ID NO: 2786 - protein, 29 aa, Homo Sapiens
  misc_feature (1)..(1): Xaa can be any naturally occurring amino acid
XGGSEANSGAAGCLLEDEDFSGGRTSDIG

SEQ ID NO: 2787 - protein, 26 aa, Homo Sapiens
  misc_feature (1)..(1): Xaa can be any naturally occurring amino acid
XEANSGAAGCLLEDEDFSGGRTSDIG

SEQ ID NO: 2788 - protein, 23 aa, Homo Sapiens
  misc_feature (1)..(1): Xaa can be any naturally occurring amino acid
XSGAAGCLLEDEDFSGGRTSDIG

SEQ ID NO: 2789 - protein, 20 aa, Homo Sapiens
  misc_feature (1)..(1): Xaa can be any naturally occurring amino acid
XAGCLLEDEDFSGGRTSDIG

SEQ ID NO: 2790 - protein, 14 aa, Homo Sapiens
  misc_feature (1)..(1): Xaa can be any naturally occurring amino acid
XDEDFSGGRTSDIG

SEQ ID NO: 2791 - protein, 9 aa, Homo Sapiens
  misc_feature (1)..(1): Xaa can be any naturally occurring amino acid
XCLHPVVAL

SEQ ID NO: 2792 - protein, 8 aa, Homo Sapiens
  misc_feature (1)..(1): Xaa can be any naturally occurring amino acid
XLHPVVAL

SEQ ID NO: 2793 - protein, 4 aa, Homo Sapiens
  misc_feature (1)..(1): Xaa can be any naturally occurring amino acid
XVAL

SEQ ID NO: 2794 - protein, 10 aa, Homo Sapiens
  misc_feature (1)..(1): Xaa can be any naturally occurring amino acid
XYQPLVPHLH

SEQ ID NO: 2795 - protein, 8 aa, Homo Sapiens
  misc_feature (1)..(1): Xaa can be any naturally occurring amino acid
XPLVPHLH

SEQ ID NO: 2796 - protein, 15 aa, Homo Sapiens
  misc_feature (1)..(1): Xaa can be any naturally occurring amino acid
XPAPVPGCLGRSETV

SEQ ID NO: 2797 - protein, 12 aa, Homo Sapiens
  misc_feature (1)..(1): Xaa can be any naturally occurring amino acid
XVPGCLGRSETV

SEQ ID NO: 2798 - protein, 2 aa, Homo Sapiens
  misc_feature (1)..(1): Xaa can be any naturally occurring amino acid
XV

SEQ ID NO: 2799 - protein, 5 aa, Homo Sapiens
  misc_feature (1)..(1): Xaa can be any naturally occurring amino acid
XDGPV

SEQ ID NO: 2800 - protein, 2 aa, Homo Sapiens
  misc_feature (1)..(1): Xaa can be any naturally occurring amino acid
XV

SEQ ID NO: 2801 - protein, 7 aa, Homo Sapiens
  misc_feature (1)..(1): Xaa can be any naturally occurring amino acid
XVCRDPT

SEQ ID NO: 2802 - protein, 15 aa, Homo Sapiens
TEREGFTGREAEAPG

SEQ ID NO: 2803 - protein, 15 aa, Homo Sapiens
  misc_feature (1)..(1): Xaa can be any naturally occurring amino acid
XEREGFTGREAEAPG

SEQ ID NO: 2804 - protein, 14 aa, Homo Sapiens
  misc_feature (1)..(1): Xaa can be any naturally occurring amino acid
XREGFTGREAEAPG

SEQ ID NO: 2805 - protein, 14 aa, Homo Sapiens
  misc_feature (1)..(1): Xaa can be any naturally occurring amino acid
XREGFTGREAEAPG

SEQ ID NO: 2806 - protein, 13 aa, Homo Sapiens
  misc_feature (1)..(1): Xaa can be any naturally occurring amino acid
XEGFTGREAEAPG

SEQ ID NO: 2807 - protein, 8 aa, Homo Sapiens
  misc_feature (1)..(1): Xaa can be any naturally occurring amino acid
XREAEAPG

SEQ ID NO: 2808 - protein, 7 aa, Homo Sapiens
  misc_feature (1)..(1): Xaa can be any naturally occurring amino acid
XEAEAPG

SEQ ID NO: 2809 - protein, 4 aa, Homo Sapiens
  misc_feature (1)..(1): Xaa can be any naturally occurring amino acid
XAPG

SEQ ID NO: 2810 - protein, 2 aa, Homo Sapiens
  misc_feature (1)..(1): Xaa can be any naturally occurring amino acid
XG

SEQ ID NO: 2811 - protein, 1 aa, Homo Sapiens
  misc_feature (1)..(1): Xaa can be any naturally occurring amino acid
X

SEQ ID NO: 2812 - protein, 11 aa, Homo Sapiens
  misc_feature (1)..(1): Xaa can be any naturally occurring amino acid
XGGEKGGCPCS

SEQ ID NO: 2813 - protein, 12 aa, Homo Sapiens
  misc_feature (1)..(1): Xaa can be any naturally occurring amino acid
XRSPAQEYLCVG

SEQ ID NO: 2814 - protein, 12 aa, Homo Sapiens
  misc_feature (1)..(1): Xaa can be any naturally occurring amino acid
XRSPAQEYLCVG

SEQ ID NO: 2815 - protein, 17 aa, Homo Sapiens
  misc_feature (1)..(1): Xaa can be any naturally occurring amino acid
XAQQQHPGSFAVSHNAF

SEQ ID NO: 2816 - protein, 1 aa, Homo Sapiens
  misc_feature (1)..(1): Xaa can be any naturally occurring amino acid
X

SEQ ID NO: 2817 - protein, 12 aa, Homo Sapiens
  misc_feature (1)..(1): Xaa can be any naturally occurring amino acid
XVYSQDPCQGDL

SEQ ID NO: 2818 - protein, 5 aa, Homo Sapiens
RESHC

SEQ ID NO: 2819 - protein, 13 aa, Homo Sapiens
  misc_feature (1)..(1): Xaa can be any naturally occurring amino acid
XSCCAQWCFNWYL

SEQ ID NO: 2820 - protein, 6 aa, Homo Sapiens
CFNWYL

SEQ ID NO: 2821 - protein, 3 aa, Homo Sapiens
WYL

SEQ ID NO: 2822 - protein, 2 aa, Homo Sapiens
  misc_feature (1)..(1): Xaa can be any naturally occurring amino acid
XD

SEQ ID NO: 2823 - protein, 10 aa, Homo Sapiens
  misc_feature (1)..(1): Xaa can be any naturally occurring amino acid
XDDRDGWNRK

SEQ ID NO: 2824 - protein, 1 aa, Homo Sapiens
  misc_feature (1)..(1): Xaa can be any naturally occurring amino acid
X

SEQ ID NO: 2825 - protein, 8 aa, Homo Sapiens
  misc_feature (1)..(1): Xaa can be any naturally occurring amino acid
XRLQSWCR

SEQ ID NO: 2826 - protein, 4 aa, Homo Sapiens
  misc_feature (1)..(1): Xaa can be any naturally occurring amino acid
XWCR

SEQ ID NO: 2827 - protein, 4 aa, Homo Sapiens
  misc_feature (1)..(1): Xaa can be any naturally occurring amino acid
XWCR

SEQ ID NO: 2828 - skipped

SEQ ID NO: 2829 - protein, 11 aa, Homo Sapiens
  misc_feature (1)..(1): Xaa can be any naturally occurring amino acid
XEGGPPVPPHR

SEQ ID NO: 2830 - protein, 11 aa, Homo Sapiens
  misc_feature (1)..(1): Xaa can be any naturally occurring amino acid
XEGGPPVPPHR

SEQ ID NO: 2831 - protein, 10 aa, Homo Sapiens
  misc_feature (1)..(1): Xaa can be any naturally occurring amino acid
XGGPPVPPHR

SEQ ID NO: 2832 - protein, 6 aa, Homo Sapiens
  misc_feature (1)..(1): Xaa can be any naturally occurring amino acid
XVPPHR

SEQ ID NO: 2833 - protein, 3 aa, Homo Sapiens
  misc_feature (1)..(1): Xaa can be any naturally occurring amino acid
XQL

SEQ ID NO: 2834 - protein, 59 aa, Homo Sapiens
  misc_feature (1)..(1): Xaa can be any naturally occurring amino acid
XCHQWRFSCWQQAGHAGVHDPPSRCSKLQGSHAHWSRGLPQPEECHQGEIWERCHQCGG

SEQ ID NO: 2835 - protein, 49 aa, Homo Sapiens
  misc_feature (1)..(1): Xaa can be any naturally occurring amino acid
XQAGHAGVHDPPSRCSKLQGSHAHWSRGLPQPEECHQGEIWERCHQCGG

SEQ ID NO: 2836 - protein, 30 aa, Homo Sapiens
  misc_feature (1)..(1): Xaa can be any naturally occurring amino acid
XSHAHWSRGLPQPEECHQGEIWERCHQCGG

SEQ ID NO: 2837 - protein, 29 aa, Homo Sapiens
  misc_feature (1)..(1): Xaa can be any naturally occurring amino acid
XHAHWSRGLPQPEECHQGEIWERCHQCGG

SEQ ID NO: 2838 - protein, 8 aa, Homo Sapiens
  misc_feature (1)..(1): Xaa can be any naturally occurring amino acid
XRCHQCGG

SEQ ID NO: 2839 - protein, 2 aa, Homo Sapiens
  misc_feature (1)..(1): Xaa can be any naturally occurring amino acid
XE

SEQ ID NO: 2840 - protein, 3 aa, Homo Sapiens
  misc_feature (1)..(1): Xaa can be any naturally occurring amino acid
XYV

SEQ ID NO: 2841 - protein, 6 aa, Homo Sapiens
  misc_feature (1)..(1): Xaa can be any naturally occurring amino acid
XLCQPL

SEQ ID NO: 2842 - protein, 3 aa, Homo Sapiens
  misc_feature (1)..(1): Xaa can be any naturally occurring amino acid
XDI

SEQ ID NO: 2843 - protein, 43 aa, Homo Sapiens
  misc_feature (1)..(1): Xaa can be any naturally occurring amino acid
XGDHRPGAQHHEDQDHRTPRAQVLGVDRWLHPGLTVHLPADVD

SEQ ID NO: 2844 - protein, 18 aa, Homo Sapiens
  misc_feature (1)..(1): Xaa can be any naturally occurring amino acid
XDRWLHPGLTVHLPADVD

SEQ ID NO: 2845 - protein, 29 aa, Homo Sapiens
RHGGHGPEGLLRGRRGPEQAWHPDPEVPH

SEQ ID NO: 2846 - protein, 11 aa, Homo Sapiens
  misc_feature (1)..(1): Xaa can be any naturally occurring amino acid
XAWHPDPEVPH

SEQ ID NO: 2847 - protein, 11 aa, Homo Sapiens
  misc_feature (1)..(1): Xaa can be any naturally occurring amino acid
XQQREDDSDYV

SEQ ID NO: 2848 - protein, 70 aa, Homo Sapiens
  misc_feature (1)..(1): Xaa can be any naturally occurring amino acid
XDLQHPGHVRGHPGRAVPLRLWAHHWHCHGLWRRGHPHGAHLRGLRPPPRHPASGPGWPGPDRLPHEDPH

SEQ ID NO: 2849 - protein, 48 aa, Homo Sapiens
  misc_feature (1)..(1): Xaa can be any naturally occurring amino acid
XHHWHCHGLWRRGHPHGAHLRGLRPPPRHPASGPGWPGPDRLPHEDPH

SEQ ID NO: 2850 - protein, 45 aa, Homo Sapiens
WHCHGLWRRGHPHGAHLRGLRPPPRHPASGPGWPGPDRLPHEDPH

SEQ ID NO: 2851 - protein, 38 aa, Homo Sapiens
RRGHPHGAHLRGLRPPPRHPASGPGWPGPDRLPHEDPH

SEQ ID NO: 2852 - protein, 37 aa, Homo Sapiens
  misc_feature (1)..(1): Xaa can be any naturally occurring amino acid
XGHPHGAHLRGLRPPPRHPASGPGWPGPDRLPHEDPH

SEQ ID NO: 2853 - protein, 33 aa, Homo Sapiens
  misc_feature (1)..(1): Xaa can be any naturally occurring amino acid
XGAHLRGLRPPPRHPASGPGWPGPDRLPHEDPH

SEQ ID NO: 2854 - protein, 33 aa, Homo Sapiens; identical to SEQ ID NO: 2853
  misc_feature (1)..(1): Xaa can be any naturally occurring amino acid

SEQ ID NO: 2855 - protein, 32 aa, Homo Sapiens
GAHLRGLRPPPRHPASGPGWPGPDRLPHEDPH

SEQ ID NO: 2856 - protein, 30 aa, Homo Sapiens
  misc_feature (1)..(1): Xaa can be any naturally occurring amino acid
XLRGLRPPPRHPASGPGWPGPDRLPHEDPH

SEQ ID NO: 2857 - protein, 30 aa, Homo Sapiens; identical to SEQ ID NO: 2856
  misc_feature (1)..(1): Xaa can be any naturally occurring amino acid

SEQ ID NO: 2858 - protein, 26 aa, Homo Sapiens
LRPPPRHPASGPGWPGPDRLPHEDPH

SEQ ID NO: 2859 - protein, 25 aa, Homo Sapiens
  misc_feature (1)..(1): Xaa can be any naturally occurring amino acid
XPPPRHPASGPGWPGPDRLPHEDPH

SEQ ID NO: 2860 - protein, 24 aa, Homo Sapiens
  misc_feature (1)..(1): Xaa can be any naturally occurring amino acid
XPPRHPASGPGWPGPDRLPHEDPH

SEQ ID NO: 2861 - protein, 19 aa, Homo Sapiens
  misc_feature (1)..(1): Xaa can be any naturally occurring amino acid
XASGPGWPGPDRLPHEDPH

SEQ ID NO: 2862 - protein, 16 aa, Homo Sapiens
GPGWPGPDRLPHEDPH

SEQ ID NO: 2863 - protein, 14 aa, Homo Sapiens
  misc_feature (1)..(1): Xaa can be any naturally occurring amino acid
XWPGPDRLPHEDPH

SEQ ID NO: 2864 - protein, 8 aa, Homo Sapiens
  misc_feature (1)..(1): Xaa can be any naturally occurring amino acid
XLPHEDPH

SEQ ID NO: 2865 - protein, 4 aa, Homo Sapiens
  misc_feature (1)..(1): Xaa can be any naturally occurring amino acid
XDPH

SEQ ID NO: 2866 - protein, 58 aa, Homo Sapiens
  misc_feature (1)..(1): Xaa can be any naturally occurring amino acid
XARLQLHHHGRAGNRARHQGEAVLRRPGLRAGDGHRRILLFSGEELRAARWPGHHHWQ

SEQ ID NO: 2867 - protein, 57 aa, Homo Sapiens
  misc_feature (1)..(1): Xaa can be any naturally occurring amino acid
XRLQLHHHGRAGNRARHQGEAVLRRPGLRAGDGHRRILLFSGEELRAARWPGHHHWQ

SEQ ID NO: 2868 - protein, 53 aa, Homo Sapiens
  misc_feature (1)..(1): Xaa can be any naturally occurring amino acid
XHHHGRAGNRARHQGEAVLRRPGLRAGDGHRRILLFSGEELRAARWPGHHHWQ

SEQ ID NO: 2869 - protein, 48 aa, Homo Sapiens
  misc_feature (1)..(1): Xaa can be any naturally occurring amino acid
XAGNRARHQGEAVLRRPGLRAGDGHRRILLFSGEELRAARWPGHHHWQ

SEQ ID NO: 2870 - protein, 48 aa, Homo Sapiens; identical to SEQ ID NO: 2869
  misc_feature (1)..(1): Xaa can be any naturally occurring amino acid

SEQ ID NO: 2871 - protein, 46 aa, Homo Sapiens
  misc_feature (1)..(1): Xaa can be any naturally occurring amino acid
XNRARHQGEAVLRRPGLRAGDGHRRILLFSGEELRAARWPGHHHWQ

SEQ ID NO: 2872 - protein, 45 aa, Homo Sapiens
  misc_feature (1)..(1): Xaa can be any naturally occurring amino acid
XRARHQGEAVLRRPGLRAGDGHRRILLFSGEELRAARWPGHHHWQ

SEQ ID NO: 2873 - protein, 44 aa, Homo Sapiens
  misc_feature (1)..(1): Xaa can be any naturally occurring amino acid
XARHQGEAVLRRPGLRAGDGHRRILLFSGEELRAARWPGHHHWQ

SEQ ID NO: 2874 - protein, 39 aa, Homo Sapiens
  misc_feature (1)..(1): Xaa can be any naturally occurring amino acid
XEAVLRRPGLRAGDGHRRILLFSGEELRAARWPGHHHWQ

SEQ ID NO: 2875 - protein, 38 aa, Homo Sapiens
  misc_feature (1)..(1): Xaa can be any naturally occurring amino acid
XAVLRRPGLRAGDGHRRILLFSGEELRAARWPGHHHWQ

SEQ ID NO: 2876 - protein, 34 aa, Homo Sapiens
  misc_feature (1)..(1): Xaa can be any naturally occurring amino acid
XRPGLRAGDGHRRILLFSGEELRAARWPGHHHWQ

SEQ ID NO: 2877 - protein, 33 aa, Homo Sapiens
  misc_feature (1)..(1): Xaa can be any naturally occurring amino acid
XPGLRAGDGHRRILLFSGEELRAARWPGHHHWQ

SEQ ID NO: 2878 - protein, 32 aa, Homo Sapiens
  misc_feature (1)..(1): Xaa can be any naturally occurring amino acid
XGLRAGDGHRRILLFSGEELRAARWPGHHHWQ

SEQ ID NO: 2879 - protein, 29 aa, Homo Sapiens
  misc_feature (1)..(1): Xaa can be any naturally occurring amino acid
XAGDGHRRILLFSGEELRAARWPGHHHWQ

SEQ ID NO: 2880 - protein, 29 aa, Homo Sapiens
  misc_feature (1)..(1): Xaa can be any naturally occurring amino acid
XAGDGHRRILLFSGEELRAARWPGHHHWQ

SEQ ID NO: 2881 - protein, 18 aa, Homo Sapiens
  misc_feature (1)..(1): Xaa can be any naturally occurring amino acid
XSGEELRAARWPGHHHWQ

SEQ ID NO: 2882 - protein, 8 aa, Homo Sapiens
  misc_feature (1)..(1): Xaa can be any naturally occurring amino acid
XRDRRAGH

SEQ ID NO: 2883 - protein, 9 aa, Homo Sapiens
  misc_feature (1)..(1): Xaa can be any naturally occurring amino acid
XWPGHHHWQ

SEQ ID NO: 2884 - protein, 6 aa, Homo Sapiens
  misc_feature (1)..(1): Xaa can be any naturally occurring amino acid
XHHHWQ

SEQ ID NO: 2885 - protein, 1 aa, Homo Sapiens
Q

SEQ ID NO: 2886 - protein, 1 aa, Homo Sapiens
  misc_feature (1)..(1): Xaa can be any naturally occurring amino acid
X

SEQ ID NO: 2887 - protein, 32 aa, Homo Sapiens
  misc_feature (1)..(1): Xaa can be any naturally occurring amino acid
XVPVSGGAVPAFLPGYGILRHPRDHLQLHHEV

SEQ ID NO: 2888 - protein, 31 aa, Homo Sapiens
  misc_feature (1)..(1): Xaa can be any naturally occurring amino acid
XPVSGGAVPAFLPGYGILRHPRDHLQLHHEV

SEQ ID NO: 2889 - protein, 27 aa, Homo Sapiens
GGAVPAFLPGYGILRHPRDHLQLHHEV

SEQ ID NO: 2890 - protein, 27 aa, Homo Sapiens
  misc_feature (1)..(1): Xaa can be any naturally occurring amino acid
XGAVPAFLPGYGILRHPRDHLQLHHEV

SEQ ID NO: 2891 - protein, 21 aa, Homo Sapiens
FLPGYGILRHPRDHLQLHHEV

SEQ ID NO: 2892 - protein, 20 aa, Homo Sapiens
  misc_feature (1)..(1): Xaa can be any naturally occurring amino acid
XPGYGILRHPRDHLQLHHEV

SEQ ID NO: 2893 - protein, 20 aa, Homo Sapiens
  misc_feature (1)..(1): Xaa can be any naturally occurring amino acid
XPGYGILRHPRDHLQLHHEV

SEQ ID NO: 2894 - protein, 19 aa, Homo Sapiens
  misc_feature (1)..(1): Xaa can be any naturally occurring amino acid
XGYGILRHPRDHLQLHHEV

SEQ ID NO: 2895 - protein, 15 aa, Homo Sapiens
  misc_feature (1)..(1): Xaa can be any naturally occurring amino acid
XLRHPRDHLQLHHEV

SEQ ID NO: 2896 - protein, 2 aa, Homo Sapiens
  misc_feature (1)..(1): Xaa can be any naturally occurring amino acid
XV

SEQ ID NO: 2897 - protein, 71 aa, Homo Sapiens
  misc_feature (1)..(1): Xaa can be any naturally occurring amino acid
XGHPQRPVRQHGAVGRHHHVPGHCRQDAEGDHRPGAQHHEDQDHRTPRAQVLGVDRWLHPGLTVHLPADVD

SEQ ID NO: 2898 - protein, 62 aa, Homo Sapiens
  misc_feature (1)..(1): Xaa can be any naturally occurring amino acid
XHGAVGRHHHVPGHCRQDAEGDHRPGAQHHEDQDHRTPRAQVLGVDRWLHPGLTVHLPADVD

SEQ ID NO: 2899 - protein, 60 aa, Homo Sapiens
  misc_feature (1)..(1): Xaa can be any naturally occurring amino acid
XAVGRHHHVPGHCRQDAEGDHRPGAQHHEDQDHRTPRAQVLGVDRWLHPGLTVHLPADVD

SEQ ID NO: 2900 - protein, 46 aa, Homo Sapiens
GHRDRGRRSHGQAPASAAGGAHGACLGAGRLHRGSCSQCRNRICCC

SEQ ID NO: 2901 - protein, 11 aa, Homo Sapiens
  misc_feature (1)..(1): Xaa can be any naturally occurring amino acid
XFHSMGCWWSR

SEQ ID NO: 2902 - protein, 14 aa, Homo Sapiens
  misc_feature (1)..(1): Xaa can be any naturally occurring amino acid
XRSHQNQTICSHSC

SEQ ID NO: 2903 - protein, 1 aa, Homo Sapiens
  misc_feature (1)..(1): Xaa can be any naturally occurring amino acid
X

SEQ ID NO: 2904 - protein, 1 aa, Homo Sapiens
  misc_feature (1)..(1): Xaa can be any naturally occurring amino acid
X

SEQ ID NO: 2905 - protein, 13 aa, Homo Sapiens
WAESHRSRVTGHD

SEQ ID NO: 2906 - protein, 1 aa, Homo Sapiens
  misc_feature (1)..(1): Xaa can be any naturally occurring amino acid
X

SEQ ID NO: 2907 - protein, 12 aa, Homo Sapiens
  misc_feature (1)..(1): Xaa can be any naturally occurring amino acid
XNDGKKNERHRQ

SEQ ID NO: 2908 - protein, 6 aa, Homo Sapiens
WREVNR

SEQ ID NO: 2909 - protein, 1 aa, Homo Sapiens
R

SEQ ID NO: 2910 - protein, 2 aa, Homo Sapiens
  misc_feature (1)..(1): Xaa can be any naturally occurring amino acid
XL

SEQ ID NO: 2911 - protein, 1 aa, Homo Sapiens
  misc_feature (1)..(1): Xaa can be any naturally occurring amino acid
X

SEQ ID NO: 2912 - protein, 9 aa, Homo Sapiens
  misc_feature (1)..(1): Xaa can be any naturally occurring amino acid
XVKTLYRMC

SEQ ID NO: 2913 - protein, 54 aa, Homo Sapiens
  misc_feature (1)..(1): Xaa can be any naturally occurring amino acid
XGGPHGPHGLQGVRPLDHQPQQEHKRKRETLTAGESLPHSVPHHTESPLLTVAM

SEQ ID NO: 2914 - protein, 53 aa, Homo Sapiens
  misc_feature (1)..(1): Xaa can be any naturally occurring amino acid
XGPHGPHGLQGVRPLDHQPQQEHKRKRETLTAGESLPHSVPHHTESPLLTVAM

SEQ ID NO: 2915 - protein, 3 aa, Homo Sapiens
  misc_feature (1)..(1): Xaa can be any naturally occurring amino acid
XCF

SEQ ID NO: 2916 - protein, 1 aa, Homo Sapiens
  misc_feature (1)..(1): Xaa can be any naturally occurring amino acid
X

SEQ ID NO: 2917 - protein, 2 aa, Homo Sapiens
  misc_feature (1)..(1): Xaa can be any naturally occurring amino acid
XH

SEQ ID NO: 2918 - protein, 9 aa, Homo Sapiens
  misc_feature (1)..(1): Xaa can be any naturally occurring amino acid
XLHGLHVPI

SEQ ID NO: 2919 - protein, 1 aa, Homo Sapiens
  misc_feature (1)..(1): Xaa can be any naturally occurring amino acid
X

SEQ ID NO: 2920 - protein, 8 aa, Homo Sapiens
QIPWHRQG

SEQ ID NO: 2921 - protein, 4 aa, Homo Sapiens
HRQG

SEQ ID NO: 2922 - protein, 23 aa, Homo Sapiens
  misc_feature (1)..(1): Xaa can be any naturally occurring amino acid
XWKSHHHLPGARSLQNQVGRCWR

SEQ ID NO: 2923 - protein, 31 aa, Homo Sapiens
  misc_feature (1)..(1): Xaa can be any naturally occurring amino acid
XLWYRGRTHDHSPCHHCHPEDCGWPLRETVA

SEQ ID NO: 2924 - protein, 15 aa, Homo Sapiens
  misc_feature (1)..(1): Xaa can be any naturally occurring amino acid
XHPEDCGWPLRETVA

SEQ ID NO: 2925 - protein, 12 aa, Homo Sapiens
  misc_feature (1)..(1): Xaa can be any naturally occurring amino acid
XDCGWPLRETVA

SEQ ID NO: 2926 - protein, 11 aa, Homo Sapiens
  misc_feature (1)..(1): Xaa can be any naturally occurring amino acid
XCGWPLRETVA

SEQ ID NO: 2927 - protein, 8 aa, Homo Sapiens
  misc_feature (1)..(1): Xaa can be any naturally occurring amino acid
XPLRETVA

SEQ ID NO: 2928 - protein, 5 aa, Homo Sapiens
  misc_feature (1)..(1): Xaa can be any naturally occurring amino acid
XETVA

SEQ ID NO: 2929 - protein, 2 aa, Homo Sapiens
VA

SEQ ID NO: 2930 - protein, 1 aa, Homo Sapiens
  misc_feature (1)..(1): Xaa can be any naturally occurring amino acid
X

SEQ ID NO: 2931 - protein, 24 aa, Homo Sapiens
  misc_feature (1)..(1): Xaa can be any naturally occurring amino acid
XPRGSPEHHPCLYWRCQGCGQGHP

SEQ ID NO: 2932 - protein, 23 aa, Homo Sapiens
PRGSPEHHPCLYWRCQGCGQGHP

SEQ ID NO: 2933 - protein, 22 aa, Homo Sapiens
  misc_feature (1)..(1): Xaa can be any naturally occurring amino acid
XGSPEHHPCLYWRCQGCGQGHP

SEQ ID NO: 2934 - protein, 21 aa, Homo Sapiens
  misc_feature (1)..(1): Xaa can be any naturally occurring amino acid
XSPEHHPCLYWRCQGCGQGHP

SEQ ID NO: 2935 - protein, 19 aa, Homo Sapiens
  misc_feature (1)..(1): Xaa can be any naturally occurring amino acid
XEHHPCLYWRCQGCGQGHP

SEQ ID NO: 2936 - protein, 18 aa, Homo Sapiens
  misc_feature (1)..(1): Xaa can be any naturally occurring amino acid
XHHPCLYWRCQGCGQGHP

SEQ ID NO: 2937 - protein, 14 aa, Homo Sapiens
CLYWRCQGCGQGHP

SEQ ID NO: 2938 - protein, 14 aa, Homo Sapiens
  misc_feature (1)..(1): Xaa can be any naturally occurring amino acid
XLYWRCQGCGQGHP

SEQ ID NO: 2939 - protein, 14 aa, Homo Sapiens
  misc_feature (1)..(1): Xaa can be any naturally occurring amino acid
XLYWRCQGCGQGHP

SEQ ID NO: 2940 - protein, 11 aa, Homo Sapiens
  misc_feature (1)..(1): Xaa can be any naturally occurring amino acid
XRCQGCGQGHP

SEQ ID NO: 2941 - protein, 7 aa, Homo Sapiens
  misc_feature (1)..(1): Xaa can be any naturally occurring amino acid
XCGQGHP

SEQ ID NO: 2942 - protein, 6 aa, Homo Sapiens
CGQGHP

SEQ ID NO: 2943 - protein, 6 aa, Homo Sapiens
  misc_feature (1)..(1): Xaa can be any naturally occurring amino acid
XGQGHP

SEQ ID NO: 2944 - skipped

SEQ ID NO: 2945 - protein, 31 aa, Homo Sapiens
EREAHWHGLPCPHCQRVSGGPDLPSRKTCQI

SEQ ID NO: 2946 - protein, 31 aa, Homo Sapiens
  misc_feature (1)..(1): Xaa can be any naturally occurring amino acid
XREAHWHGLPCPHCQRVSGGPDLPSRKTCQI

SEQ ID NO: 2947 - protein, 30 aa, Homo Sapiens
  misc_feature (1)..(1): Xaa can be any naturally occurring amino acid
XEAHWHGLPCPHCQRVSGGPDLPSRKTCQI

SEQ ID NO: 2948 - protein, 29 aa, Homo Sapiens
  misc_feature (1)..(1): Xaa can be any naturally occurring amino acid
XAHWHGLPCPHCQRVSGGPDLPSRKTCQI

SEQ ID NO: 2949 - protein, 25 aa, Homo Sapiens
HGLPCPHCQRVSGGPDLPSRKTCQI

SEQ ID NO: 2950 - protein, 25 aa, Homo Sapiens
  misc_feature (1)..(1): Xaa can be any naturally occurring amino acid
XGLPCPHCQRVSGGPDLPSRKTCQI

SEQ ID NO: 2951 - protein, 24 aa, Homo Sapiens
  misc_feature (1)..(1): Xaa can be any naturally occurring amino acid
XLPCPHCQRVSGGPDLPSRKTCQI

SEQ ID NO: 2952 - protein, 12 aa, Homo Sapiens
  misc_feature (1)..(1): Xaa can be any naturally occurring amino acid
XPDLPSRKTCQI

SEQ ID NO: 2953 - protein, 8 aa, Homo Sapiens
  misc_feature (1)..(1): Xaa can be any naturally occurring amino acid
XQGHPGLH

SEQ ID NO: 2954 - protein, 7 aa, Homo Sapiens
  misc_feature (1)..(1): Xaa can be any naturally occurring amino acid
XGHPGLH

SEQ ID NO: 2955 - protein, 16 aa, Homo Sapiens
  misc_feature (1)..(1): Xaa can be any naturally occurring amino acid
XWHCPQRPLCQAHFLV

SEQ ID NO: 2956 - protein, 45 aa, Homo Sapiens
  misc_feature (1)..(1): Xaa can be any naturally occurring amino acid
XVPRWSVLPCGLLPGPRRSQLQLLPSPSGQMAHNTEQASGWPLPG

SEQ ID NO: 2957 - protein, 54 aa, Homo Sapiens
  misc_feature (1)..(1): Xaa can be any naturally occurring amino acid
XGFSHQGYNCWWWCHSTHPQISDWEERTTEDCLKDAWIPCYLRTLNTLTAVQCW

SEQ ID NO: 2958 - protein, 32 aa, Homo Sapiens
  misc_feature (1)..(1): Xaa can be any naturally occurring amino acid
XGDPGAAVPDLGHICGAVHGQQPLPGHGQHHC

SEQ ID NO: 2959 - protein, 28 aa, Homo Sapiens
  misc_feature (1)..(1): Xaa can be any naturally occurring amino acid
XAAVPDLGHICGAVHGQQPLPGHGQHHC

SEQ ID NO: 2960 - protein, 17 aa, Homo Sapiens
  misc_feature (1)..(1): Xaa can be any naturally occurring amino acid
XAVHGQQPLPGHGQHHC

SEQ ID NO: 2961 - protein, 16 aa, Homo Sapiens
  misc_feature (1)..(1): Xaa can be any naturally occurring amino acid
XPDPGSLPGATASCGY

SEQ ID NO: 2962 - protein, 4 aa, Homo Sapiens
  misc_feature (1)..(1): Xaa can be any naturally occurring amino acid
XCAV

SEQ ID NO: 2963 - protein, 5 aa, Homo Sapiens
MGGHA

SEQ ID NO: 2964-2965 - skipped (2 entries)

SEQ ID NO: 2966 - protein, 2 aa, Homo Sapiens
  misc_feature (1)..(1): Xaa can be any naturally occurring amino acid
XS

SEQ ID NO: 2967 - protein, 1 aa, Homo Sapiens
  misc_feature (1)..(1): Xaa can be any naturally occurring amino acid
X

SEQ ID NO: 2968 - protein, 11 aa, Homo Sapiens
  misc_feature (1)..(1): Xaa can be any naturally occurring amino acid
XALCAYSAIPY

SEQ ID NO: 2969 - protein, 10 aa, Homo Sapiens
  misc_feature (1)..(1): Xaa can be any naturally occurring amino acid
XLCAYSAIPY

SEQ ID NO: 2970 - protein, 9 aa, Homo Sapiens
  misc_feature (1)..(1): Xaa can be any naturally occurring amino acid
XCAYSAIPY

SEQ ID NO: 2971 - protein, 9 aa, Homo Sapiens
  misc_feature (1)..(1): Xaa can be any naturally occurring amino acid
XRLFCDRQF

SEQ ID NO: 2972 - protein, 2 aa, Homo Sapiens
  misc_feature (1)..(1): Xaa can be any naturally occurring amino acid
XC

SEQ ID NO: 2973 - protein, 14 aa, Homo Sapiens
  misc_feature (1)..(1): Xaa can be any naturally occurring amino acid
XRCFSPGIESRNGN

SEQ ID NO: 2974 - protein, 1 aa, Homo Sapiens
  misc_feature (1)..(1): Xaa can be any naturally occurring amino acid
X

SEQ ID NO: 2975 - protein, 2 aa, Homo Sapiens
  misc_feature (1)..(1): Xaa can be any naturally occurring amino acid
XG

SEQ ID NO: 2976 - protein, 3 aa, Homo Sapiens
WGL

SEQ ID NO: 2977 - protein, 9 aa, Homo Sapiens
  misc_feature (1)..(1): Xaa can be any naturally occurring amino acid
XVWFRASAY

SEQ ID NO: 2978 - protein, 20 aa, Homo Sapiens
  misc_feature (1)..(1): Xaa can be any naturally occurring amino acid
XGGGCETLKYIWKAVCPWRW

SEQ ID NO: 2979 - protein, 32 aa, Homo Sapiens
  misc_feature (1)..(1): Xaa can be any naturally occurring amino acid
XNSSPDQGGETCTDCSPWQQPPGHCQASGGSL

SEQ ID NO: 2980 - protein, 11 aa, Homo Sapiens
  misc_feature (1)..(1): Xaa can be any naturally occurring amino acid
XHFEGCSSQNV

SEQ ID NO: 2981 - protein, 9 aa, Homo Sapiens
  misc_feature (1)..(1): Xaa can be any naturally occurring amino acid
XEGCSSQNV

SEQ ID NO: 2982 - protein, 29 aa, Homo Sapiens
  misc_feature (1)..(1): Xaa can be any naturally occurring amino acid
XRRPKSILQGGCSSLDETDTIHHDEVRLL

SEQ ID NO: 2983 - protein, 36 aa, Homo Sapiens
  misc_feature (1)..(1): Xaa can be any naturally occurring amino acid
XRRNEPSWGGVLCSQPLRVSPEAPSRAESPEAAGVQ

SEQ ID NO: 2984 - protein, 28 aa, Homo Sapiens
  misc_feature (1)..(1): Xaa can be any naturally occurring amino acid
XGVLCSQPLRVSPEAPSRAESPEAAGVQ

SEQ ID NO: 2985 - protein, 31 aa, Homo Sapiens
  misc_feature (1)..(1): Xaa can be any naturally occurring amino acid
XGPQVPPHYWWLSPGSLEKAQYSPAPPLPLI

SEQ ID NO: 2986 - protein, 29 aa, Homo Sapiens
PQVPPHYWWLSPGSLEKAQYSPAPPLPLI

SEQ ID NO: 2987 - protein, 14 aa, Homo Sapiens
  misc_feature (1)..(1): Xaa can be any naturally occurring amino acid
XKAQYSPAPPLPLI

SEQ ID NO: 2988 - protein, 2 aa, Homo Sapiens
  misc_feature (1)..(1): Xaa can be any naturally occurring amino acid
XV

SEQ ID NO: 2989 - protein, 31 aa, Homo Sapiens
  misc_feature (1)..(1): Xaa can be any naturally occurring amino acid
XRFRQWHPGPGSRPWTGPGPRPRSSRRQGRG

SEQ ID NO: 2990 - protein, 28 aa, Homo Sapiens
  misc_feature (1)..(1): Xaa can be any naturally occurring amino acid
XQWHPGPGSRPWTGPGPRPRSSRRQGRG

SEQ ID NO: 2991 - protein, 24 aa, Homo Sapiens
  misc_feature (1)..(1): Xaa can be any naturally occurring amino acid
XGPGSRPWTGPGPRPRSSRRQGRG

SEQ ID NO: 2992 - protein, 18 aa, Homo Sapiens
  misc_feature (1)..(1): Xaa can be any naturally occurring amino acid
XWTGPGPRPRSSRRQGRG

SEQ ID NO: 2993 - protein, 16 aa, Homo Sapiens
  misc_feature (1)..(1): Xaa can be any naturally occurring amino acid
XGPGPRPRSSRRQGRG

SEQ ID NO: 2994 - protein, 15 aa, Homo Sapiens
  misc_feature (1)..(1): Xaa can be any naturally occurring amino acid
XPGPRPRSSRRQGRG

SEQ ID NO: 2995 - protein, 14 aa, Homo Sapiens
  misc_feature (1)..(1): Xaa can be any naturally occurring amino acid
XGPRPRSSRRQGRG

SEQ ID NO: 2996 - protein, 12 aa, Homo Sapiens
  misc_feature (1)..(1): Xaa can be any naturally occurring amino acid
XRPRSSRRQGRG

SEQ ID NO: 2997 - protein, 11 aa, Homo Sapiens
  misc_feature (1)..(1): Xaa can be any naturally occurring amino acid
XPRSSRRQGRG

SEQ ID NO: 2998 - protein, 10 aa, Homo Sapiens
  misc_feature (1)..(1): Xaa can be any naturally occurring amino acid
XRSSRRQGRG

SEQ ID NO: 2999 - protein, 9 aa, Homo Sapiens
  misc_feature (1)..(1): Xaa can be any naturally occurring amino acid
XSSRRQGRG

SEQ ID NO: 3000 - protein, 6 aa, Homo Sapiens
  misc_feature (1)..(1): Xaa can be any naturally occurring amino acid
XRQGRG

SEQ ID NO: 3001 - protein, 5 aa, Homo Sapiens
  misc_feature (1)..(1): Xaa can be any naturally occurring amino acid
XQGRG

SEQ ID NO: 3002 - protein, 4 aa, Homo Sapiens
  misc_feature (1)..(1): Xaa can be any naturally occurring amino acid
XGRG

SEQ ID NO: 3003 - protein, 2 aa, Homo Sapiens
  misc_feature (1)..(1): Xaa can be any naturally occurring amino acid
XG

SEQ ID NO: 3004 - protein, 31 aa, Homo Sapiens
  misc_feature (1)..(1): Xaa can be any naturally occurring amino acid
XGVDARHQVGPLGQGHEDQVPGGDLSLLPAY

SEQ ID NO: 3005 - protein, 26 aa, Homo Sapiens
  misc_feature (1)..(1): Xaa can be any naturally occurring amino acid
XHQVGPLGQGHEDQVPGGDLSLLPAY

SEQ ID NO: 3006 - protein, 24 aa, Homo Sapiens
  misc_feature (1)..(1): Xaa can be any naturally occurring amino acid
XVGPLGQGHEDQVPGGDLSLLPAY

SEQ ID NO: 3007 - protein, 21 aa, Homo Sapiens
  misc_feature (1)..(1): Xaa can be any naturally occurring amino acid
XLGQGHEDQVPGGDLSLLPAY

SEQ ID NO: 3008 - protein, 18 aa, Homo Sapiens
  misc_feature (1)..(1): Xaa can be any naturally occurring amino acid
XGHEDQVPGGDLSLLPAY

SEQ ID NO: 3009 - protein, 17 aa, Homo Sapiens
  misc_feature (1)..(1): Xaa can be any naturally occurring amino acid
XHEDQVPGGDLSLLPAY

SEQ ID NO: 3010 - protein, 13 aa, Homo Sapiens
  misc_feature (1)..(1): Xaa can be any naturally occurring amino acid
XVPGGDLSLLPAY

SEQ ID NO: 3011 - protein, 7 aa, Homo Sapiens
  misc_feature (1)..(1): Xaa can be any naturally occurring amino acid
XGGLSQG

SEQ ID NO: 3012 - protein, 6 aa, Homo Sapiens
  misc_feature (1)..(1): Xaa can be any naturally occurring amino acid
XGLSQG

SEQ ID NO: 3013 - protein, 6 aa, Homo Sapiens
  misc_feature (1)..(1): Xaa can be any naturally occurring amino acid
XGLSQG

SEQ ID NO: 3014 - protein, 1 aa, Homo Sapiens
  misc_feature (1)..(1): Xaa can be any naturally occurring amino acid
X

SEQ ID NO: 3015 - protein, 35 aa, Homo Sapiens
  misc_feature (1)..(1): Xaa can be any naturally occurring amino acid
XEDYASAEADPCRPAHQVQGICCYRGLQWPRRSGC

SEQ ID NO: 3016 - protein, 34 aa, Homo Sapiens
  misc_feature (1)..(1): Xaa can be any naturally occurring amino acid
XDYASAEADPCRPAHQVQGICCYRGLQWPRRSGC

SEQ ID NO: 3017 - protein, 25 aa, Homo Sapiens
  misc_feature (1)..(1): Xaa can be any naturally occurring amino acid
XCRPAHQVQGICCYRGLQWPRRSGC

SEQ ID NO: 3018 - protein, 14 aa, Homo Sapiens
  misc_feature (1)..(1): Xaa can be any naturally occurring amino acid
XCYRGLQWPRRSGC

SEQ ID NO: 3019 - protein, 13 aa, Homo Sapiens
  misc_feature (1)..(1): Xaa can be any naturally occurring amino acid
XYRGLQWPRRSGC

SEQ ID NO: 3020 - protein, 10 aa, Homo Sapiens
  misc_feature (1)..(1): Xaa can be any naturally occurring amino acid
XLQWPRRSGC

SEQ ID NO: 3021 - protein, 8 aa, Homo Sapiens
  misc_feature (1)..(1): Xaa can be any naturally occurring amino acid
XWPRRSGC

SEQ ID NO: 3022 - protein, 7 aa, Homo Sapiens
  misc_feature (1)..(1): Xaa can be any naturally occurring amino acid
XPRRSGC

SEQ ID NO: 3023 - protein, 69 aa, Homo Sapiens
  misc_feature (1)..(1): Xaa can be any naturally occurring amino acid
XVLQGGGHRHPWGHHPGQALHRPRAQRLLGEQDRQAPHCPLQGDRPLRLCAGTPHPCTQGHWHRLRTCA

SEQ ID NO: 3024 - protein, 66 aa, Homo Sapiens
  misc_feature (1)..(1): Xaa can be any naturally occurring amino acid
XGGGHRHPWGHHPGQALHRPRAQRLLGEQDRQAPHCPLQGDRPLRLCAGTPHPCTQGHWHRLRTCA

SEQ ID NO: 3025 - protein, 65 aa, Homo Sapiens
  misc_feature (1)..(1): Xaa can be any naturally occurring amino acid
XGGHRHPWGHHPGQALHRPRAQRLLGEQDRQAPHCPLQGDRPLRLCAGTPHPCTQGHWHRLRTCA

SEQ ID NO: 3026 - protein, 64 aa, Homo Sapiens
  misc_feature (1)..(1): Xaa can be any naturally occurring amino acid
XGHRHPWGHHPGQALHRPRAQRLLGEQDRQAPHCPLQGDRPLRLCAGTPHPCTQGHWHRLRTCA

SEQ ID NO: 3027 - protein, 63 aa, Homo Sapiens
GHRHPWGHHPGQALHRPRAQRLLGEQDRQAPHCPLQGDRPLRLCAGTPHPCTQGHWHRLRTCA

SEQ ID NO: 3028 - protein, 59 aa, Homo Sapiens
  misc_feature (1)..(1): Xaa can be any naturally occurring amino acid
XWGHHPGQALHRPRAQRLLGEQDRQAPHCPLQGDRPLRLCAGTPHPCTQGHWHRLRTCA

SEQ ID NO: 3029 - protein, 53 aa, Homo Sapiens
  misc_feature (1)..(1): Xaa can be any naturally occurring amino acid
XQALHRPRAQRLLGEQDRQAPHCPLQGDRPLRLCAGTPHPCTQGHWHRLRTCA

SEQ ID NO: 3030 - protein, 52 aa, Homo Sapiens
  misc_feature (1)..(1): Xaa can be any naturally occurring amino acid
XALHRPRAQRLLGEQDRQAPHCPLQGDRPLRLCAGTPHPCTQGHWHRLRTCA

SEQ ID NO: 3031 - protein, 48 aa, Homo Sapiens
  misc_feature (1)..(1): Xaa can be any naturally occurring amino acid
XPRAQRLLGEQDRQAPHCPLQGDRPLRLCAGTPHPCTQGHWHRLRTCA

SEQ ID NO: 3032 - protein, 46 aa, Homo Sapiens
  misc_feature (1)..(1): Xaa can be any naturally occurring amino acid
XAQRLLGEQDRQAPHCPLQGDRPLRLCAGTPHPCTQGHWHRLRTCA

SEQ ID NO: 3033 - protein, 45 aa, Homo Sapiens
  misc_feature (1)..(1): Xaa can be any naturally occurring amino acid
XQRLLGEQDRQAPHCPLQGDRPLRLCAGTPHPCTQGHWHRLRTCA

SEQ ID NO: 3034 - protein, 44 aa, Homo Sapiens
  misc_feature (1)..(1): Xaa can be any naturally occurring amino acid
XRLLGEQDRQAPHCPLQGDRPLRLCAGTPHPCTQGHWHRLRTCA

SEQ ID NO: 3035 - protein, 41 aa, Homo Sapiens
  misc_feature (1)..(1): Xaa can be any naturally occurring amino acid
XGEQDRQAPHCPLQGDRPLRLCAGTPHPCTQGHWHRLRTCA

SEQ ID NO: 3036 - protein, 39 aa, Homo Sapiens
  misc_feature (1)..(1): Xaa can be any naturally occurring amino acid
XQDRQAPHCPLQGDRPLRLCAGTPHPCTQGHWHRLRTCA

SEQ ID NO: 3037 - protein, 38 aa, Homo Sapiens
  misc_feature (1)..(1): Xaa can be any naturally occurring amino acid
XDRQAPHCPLQGDRPLRLCAGTPHPCTQGHWHRLRTCA

SEQ ID NO: 3038 - protein, 38 aa, Homo Sapiens; identical to SEQ ID NO: 3037
  misc_feature (1)..(1): Xaa can be any naturally occurring amino acid

SEQ ID NO: 3039 - protein, 35 aa, Homo Sapiens
  misc_feature (1)..(1): Xaa can be any naturally occurring amino acid
XAPHCPLQGDRPLRLCAGTPHPCTQGHWHRLRTCA

SEQ ID NO: 3040 - protein, 32 aa, Homo Sapiens
  misc_feature (1)..(1): Xaa can be any naturally occurring amino acid
XCPLQGDRPLRLCAGTPHPCTQGHWHRLRTCA

SEQ ID NO: 3041 - protein, 31 aa, Homo Sapiens
  misc_feature (1)..(1): Xaa can be any naturally occurring amino acid
XPLQGDRPLRLCAGTPHPCTQGHWHRLRTCA

SEQ ID NO: 3042 - protein, 29 aa, Homo Sapiens
LQGDRPLRLCAGTPHPCTQGHWHRLRTCA

SEQ ID NO: 3043 - protein, 29 aa, Homo Sapiens
  misc_feature (1)..(1): Xaa can be any naturally occurring amino acid
XQGDRPLRLCAGTPHPCTQGHWHRLRTCA

SEQ ID NO: 3044 - protein, 28 aa, Homo Sapiens
  misc_feature (1)..(1): Xaa can be any naturally occurring amino acid
XGDRPLRLCAGTPHPCTQGHWHRLRTCA

SEQ ID NO: 3045 - protein, 27 aa, Homo Sapiens
  misc_feature (1)..(1): Xaa can be any naturally occurring amino acid
XDRPLRLCAGTPHPCTQGHWHRLRTCA

SEQ ID NO: 3046 - protein, 26 aa, Homo Sapiens
DRPLRLCAGTPHPCTQGHWHRLRTCA

SEQ ID NO: 3047 - protein, 25 aa, Homo Sapiens
  misc_feature (1)..(1): Xaa can be any naturally occurring amino acid
XPLRLCAGTPHPCTQGHWHRLRTCA

SEQ ID NO: 3048 - protein, 23 aa, Homo Sapiens
  misc_feature (1)..(1): Xaa can be any naturally occurring amino acid
XRLCAGTPHPCTQGHWHRLRTCA

SEQ ID NO: 3049 - protein, 22 aa, Homo Sapiens
  misc_feature (1)..(1): Xaa can be any naturally occurring amino acid
XLCAGTPHPCTQGHWHRLRTCA

SEQ ID NO: 3050 - protein, 21 aa, Homo Sapiens
LCAGTPHPCTQGHWHRLRTCA

SEQ ID NO: 3051 - protein, 20 aa, Homo Sapiens
  misc_feature (1)..(1): Xaa can be any naturally occurring amino acid
XAGTPHPCTQGHWHRLRTCA

SEQ ID NO: 3052 - protein, 19 aa, Homo Sapiens
AGTPHPCTQGHWHRLRTCA

SEQ ID NO: 3053 - protein, 18 aa, Homo Sapiens
GTPHPCTQGHWHRLRTCA

SEQ ID NO: 3054 - protein, 18 aa, Homo Sapiens
  misc_feature (1)..(1): Xaa can be any naturally occurring amino acid
XTPHPCTQGHWHRLRTCA

SEQ ID NO: 3055 - protein, 17 aa, Homo Sapiens
  misc_feature (1)..(1): Xaa can be any naturally occurring amino acid
XPHPCTQGHWHRLRTCA

SEQ ID NO: 3056 - protein, 16 aa, Homo Sapiens
  misc_feature (1)..(1): Xaa can be any naturally occurring amino acid
XHPCTQGHWHRLRTCA

SEQ ID NO: 3057 - protein, 13 aa, Homo Sapiens
CTQGHWHRLRTCA

SEQ ID NO: 3058 - protein, 13 aa, Homo Sapiens
  misc_feature (1)..(1): Xaa can be any naturally occurring amino acid
XTQGHWHRLRTCA

SEQ ID NO: 3059 - protein, 12 aa, Homo Sapiens
  misc_feature (1)..(1): Xaa can be any naturally occurring amino acid
XQGHWHRLRTCA

SEQ ID NO: 3060 - protein, 10 aa, Homo Sapiens
  misc_feature (1)..(1): Xaa can be any naturally occurring amino acid
XHWHRLRTCA

SEQ ID NO: 3061 - protein, 9 aa, Homo Sapiens
HWHRLRTCA

SEQ ID NO: 3062 - protein, 8 aa, Homo Sapiens
  misc_feature (1)..(1): Xaa can be any naturally occurring amino acid
XHRLRTCA

SEQ ID NO: 3063 - protein, 7 aa, Homo Sapiens
HRLRTCA

SEQ ID NO: 3064 - protein, 7 aa, Homo Sapiens
  misc_feature (1)..(1): Xaa can be any naturally occurring amino acid
XRLRTCA

SEQ ID NO: 3065 - protein, 6 aa, Homo Sapiens
  misc_feature (1)..(1): Xaa can be any naturally occurring amino acid
XLRTCA

SEQ ID NO: 3066 - protein, 4 aa, Homo Sapiens
  misc_feature (1)..(1): Xaa can be any naturally occurring amino acid
XTCA

SEQ ID NO: 3067 - protein, 4 aa, Homo Sapiens
  misc_feature (1)..(1): Xaa can be any naturally occurring amino acid
XTCA

SEQ ID NO: 3068 - protein, 3 aa, Homo Sapiens
  misc_feature (1)..(1): Xaa can be any naturally occurring amino acid
XCA

SEQ ID NO: 3069 - protein, 2 aa, Homo Sapiens
  misc_feature (1)..(1): Xaa can be any naturally occurring amino acid
XA

SEQ ID NO: 3070 - protein, 10 aa, Homo Sapiens
  misc_feature (1)..(1): Xaa can be any naturally occurring amino acid
XEAAHDGWYR

SEQ ID NO: 3071 - protein, 10 aa, Homo Sapiens
  misc_feature (1)..(1): Xaa can be any naturally occurring amino acid
XEAAHDGWYR

SEQ ID NO: 3072 - protein, 9 aa, Homo Sapiens
  misc_feature (1)..(1): Xaa can be any naturally occurring amino acid
XAAHDGWYR

SEQ ID NO: 3073 - protein, 6 aa, Homo Sapiens
  misc_feature (1)..(1): Xaa can be any naturally occurring amino acid
XDGWYR

SEQ ID NO: 3074 - protein, 1 aa, Homo Sapiens
  misc_feature (1)..(1): Xaa can be any naturally occurring amino acid
X

SEQ ID NO: 3075 - protein, 20 aa, Homo Sapiens
  misc_feature (1)..(1): Xaa can be any naturally occurring amino acid
XLHLSPGLHCHPGQLRQGHL

SEQ ID NO: 3076 - protein, 16 aa, Homo Sapiens
  misc_feature (1)..(1): Xaa can be any naturally occurring amino acid
XPGLHCHPGQLRQGHL

SEQ ID NO: 3077 - protein, 11 aa, Homo Sapiens
  misc_feature (1)..(1): Xaa can be any naturally occurring amino acid
XHPGQLRQGHL

SEQ ID NO: 3078 - protein, 7 aa, Homo Sapiens
QLRQGHL

SEQ ID NO: 3079 - protein, 7 aa, Homo Sapiens
  misc_feature (1)..(1): Xaa can be any naturally occurring amino acid
XLRQGHL

SEQ ID NO: 3080 - protein, 6 aa, Homo Sapiens
  misc_feature (1)..(1): Xaa can be any naturally occurring amino acid
XRQGHL

SEQ ID NO: 3081 - protein, 3 aa, Homo Sapiens
  misc_feature (1)..(1): Xaa can be any naturally occurring amino acid
XHL

SEQ ID NO: 3082 - protein, 40 aa, Homo Sapiens
  misc_feature (1)..(1): Xaa can be any naturally occurring amino acid
XDGEPRWLPRRFRQWHPGPGSRPWTGPGPRPRSSRRQGRG

SEQ ID NO: 3083 - protein, 1 aa, Homo Sapiens
  misc_feature (1)..(1): Xaa can be any naturally occurring amino acid
X

SEQ ID NO: 3084 - protein, 39 aa, Homo Sapiens
DGEPRWLPRRFRQWHPGPGSRPWTGPGPRPRSSRRQGRG

SEQ ID NO: 3085 - protein, 14 aa, Homo Sapiens
  misc_feature (1)..(1): Xaa can be any naturally occurring amino acid
XGDCIHQVSLSGVH

SEQ ID NO: 3086 - protein, 13 aa, Homo Sapiens
  misc_feature (1)..(1): Xaa can be any naturally occurring amino acid
XDCIHQVSLSGVH

SEQ ID NO: 3087 - protein, 11 aa, Homo Sapiens
  misc_feature (1)..(1): Xaa can be any naturally occurring amino acid
XIHQVSLSGVH

SEQ ID NO: 3088 - protein, 8 aa, Homo Sapiens
  misc_feature (1)..(1): Xaa can be any naturally occurring amino acid
XVSLSGVH

SEQ ID NO: 3089 - protein, 5 aa, Homo Sapiens
  misc_feature (1)..(1): Xaa can be any naturally occurring amino acid
XSGVH

SEQ ID NO: 3090 - protein, 34 aa, Homo Sapiens
  misc_feature (1)..(1): Xaa can be any naturally occurring amino acid
XPPRQDPHQSLRAADSGSSCGYNIGFLYKKNKVN

SEQ ID NO: 3091 - protein, 36 aa, Homo Sapiens
  misc_feature (1)..(1): Xaa can be any naturally occurring amino acid
XRWLPRRFRQWHPGPGSRPWTGPGPRPRSSRRQGRG

SEQ ID NO: 3092 - protein, 35 aa, Homo Sapiens
  misc_feature (1)..(1): Xaa can be any naturally occurring amino acid
XWLPRRFRQWHPGPGSRPWTGPGPRPRSSRRQGRG

SEQ ID NO: 3093 - protein, 32 aa, Homo Sapiens
  misc_feature (1)..(1): Xaa can be any naturally occurring amino acid
XRRFRQWHPGPGSRPWTGPGPRPRSSRRQGRG

SEQ ID NO: 3094 - protein, 1 aa, Homo Sapiens
  misc_feature (1)..(1): Xaa can be any naturally occurring amino acid
X

SEQ ID NO: 3095 - protein, 3 aa, Homo Sapiens
  misc_feature (1)..(1): Xaa can be any naturally occurring amino acid
XCY

SEQ ID NO: 3096 - protein, 67 aa, Homo Sapiens
  misc_feature (1)..(1): Xaa can be any naturally occurring amino acid
XCQGRAFGTFSFNLCWALLFQLSRCGHLQSCCHAVEALTFLTSYFEELMYASLPLLCHAIKLTIRKK

SEQ ID NO: 3097 - protein, 54 aa, Homo Sapiens
  misc_feature (1)..(1): Xaa can be any naturally occurring amino acid
XCWALLFQLSRCGHLQSCCHAVEALTFLTSYFEELMYASLPLLCHAIKLTIRKK

SEQ ID NO: 3098 - protein, 7 aa, Homo Sapiens
  misc_feature (1)..(1): Xaa can be any naturally occurring amino acid
XGSSPSR

SEQ ID NO: 3099 - protein, 3 aa, Homo Sapiens
  misc_feature (1)..(1): Xaa can be any naturally occurring amino acid
XVC

SEQ ID NO: 3100 - protein, 1 aa, Homo Sapiens
  misc_feature (1)..(1): Xaa can be any naturally occurring amino acid
X

SEQ ID NO: 3101 - protein, 3 aa, Homo Sapiens
  misc_feature (1)..(1): Xaa can be any naturally occurring amino acid
XGN

SEQ ID NO: 3102 - protein, 2 aa, Homo Sapiens
  misc_feature (1)..(1): Xaa can be any naturally occurring amino acid
XW

SEQ ID NO: 3103 - protein, 2 aa, Homo Sapiens
  misc_feature (1)..(1): Xaa can be any naturally occurring amino acid
XL

SEQ ID NO: 3104 - protein, 40 aa, Homo Sapiens
  misc_feature (1)..(1): Xaa can be any naturally occurring amino acid
XGKMLTNVAIILDLSPVIITGFCLSSTQHQDLRQMGLMSS

SEQ ID NO: 3105 - protein, 38 aa, Homo Sapiens
  misc_feature (1)..(1): Xaa can be any naturally occurring amino acid
XMLTNVAIILDLSPVIITGFCLSSTQHQDLRQMGLMSS

SEQ ID NO: 3106 - protein, 5 aa, Homo Sapiens
  misc_feature (1)..(1): Xaa can be any naturally occurring amino acid
XRMWT

SEQ ID NO: 3107 - protein, 99 aa, Homo Sapiens
CTSRAKTSNDVQRKYEASTATRRTNIQQLILVDLKLVLNQQPSTHVNVLIKYHNAKYTLSKRIPAGKHDLDICKNIFNICTPIMFSGNRRKNAAQFFFS

SEQ ID NO: 3108 - protein, 41 aa, Homo Sapiens
  misc_feature (1)..(1): Xaa can be any naturally occurring amino acid
XRRGGARQPGRGHHAPPGEIAGGDASERGSRKHPAIFQTGC

SEQ ID NO: 3109 - protein, 31 aa, Homo Sapiens
  misc_feature (1)..(1): Xaa can be any naturally occurring amino acid
XGHHAPPGEIAGGDASERGSRKHPAIFQTGC

SEQ ID NO: 3110 - protein, 26 aa, Homo Sapiens
  misc_feature (1)..(1): Xaa can be any naturally occurring amino acid
XPGEIAGGDASERGSRKHPAIFQTGC

SEQ ID NO: 3111 - protein, 25 aa, Homo Sapiens
  misc_feature (1)..(1): Xaa can be any naturally occurring amino acid
XGEIAGGDASERGSRKHPAIFQTGC

SEQ ID NO: 3112 - protein, 24 aa, Homo Sapiens
  misc_feature (1)..(1): Xaa can be any naturally occurring amino acid
XEIAGGDASERGSRKHPAIFQTGC

SEQ ID NO: 3113 - protein, 54 aa, Homo Sapiens
  misc_feature (1)..(1): Xaa can be any naturally occurring amino acid
XCQHFDQPQQCTETGYCLRLPEKDQKGTCISTEVSLIWPPGDGDFGPIEDTCSV

SEQ ID NO: 3114 - protein, 50 aa, Homo Sapiens
  misc_feature (1)..(1): Xaa can be any naturally occurring amino acid
XDQPQQCTETGYCLRLPEKDQKGTCISTEVSLIWPPGDGDFGPIEDTCSV

SEQ ID NO: 3115 - protein, 5 aa, Homo Sapiens
  misc_feature (1)..(1): Xaa can be any naturally occurring amino acid
XEERN

SEQ ID NO: 3116 - protein, 1 aa, Homo Sapiens
L

SEQ ID NO: 3117 - protein, 7 aa, Homo Sapiens
  misc_feature (1)..(1): Xaa can be any naturally occurring amino acid
XKHQERG

SEQ ID NO: 3118 - protein, 80 aa, Homo Sapiens
  misc_feature (1)..(1): Xaa can be any naturally occurring amino acid
XTGGPVFWAGCDQAGSGPSPHVRAAEAVFNILPAPHSYSFLAPFSPQPLPHLPPCTSSHETLVPGSFVTLGQDKPSRNSR

SEQ ID NO: 3119 - protein, 1 aa, Homo Sapiens
C

SEQ ID NO: 3120 - protein, 15 aa, Homo Sapiens
  misc_feature (1)..(1): Xaa can be any naturally occurring amino acid
XGHACDSSCGVCFWS

SEQ ID NO: 3121 - protein, 61 aa, Homo Sapiens
RLCGHSTHHESTKAAPGDYWWAGTYPVPARTQWNPAYWTCQSHQFQLWLCQGQQWHLFSAF

SEQ ID NO: 3122 - protein, 48 aa, Homo Sapiens
  misc_feature (1)..(1): Xaa can be any naturally occurring amino acid
XPHCWAPGQEQCPRHLQRLPRLLQRLLLQLSSAEGGARLPEVFPDRQL

SEQ ID NO: 3123 - protein, 10 aa, Homo Sapiens
  misc_feature (1)..(1): Xaa can be any naturally occurring amino acid
XWFLFCLFGC

SEQ ID NO: 3124 - protein, 19 aa, Homo Sapiens
  misc_feature (1)..(1): Xaa can be any naturally occurring amino acid
XDLCQLQGRHQEEADRDQA

SEQ ID NO: 3125 - protein, 8 aa, Homo Sapiens
  misc_feature (1)..(1): Xaa can be any naturally occurring amino acid
XRGSQAGG

SEQ ID NO: 3126 - protein, 37 aa, Homo Sapiens
WKHQCCQDYCRYHPNMFGTQVHDEDAFGPNGRHCDDQ

SEQ ID NO: 3127 - protein, 7 aa, Homo Sapiens
  misc_feature (1)..(1): Xaa can be any naturally occurring amino acid
XWPHGVR

SEQ ID NO: 3128 - protein, 31 aa, Homo Sapiens
  misc_feature (1)..(1): Xaa can be any naturally occurring amino acid
XWKAPGHCGQGSHWPSYHVHPHQAAEQGACD

SEQ ID NO: 3129 - protein, 29 aa, Homo Sapiens
  misc_feature (1)..(1): Xaa can be any naturally occurring amino acid
XGPAQGQVQVSWPPEDPHLKEVGLHQVQC

SEQ ID NO: 3130 - protein, 23 aa, Homo Sapiens
  misc_feature (1)..(1): Xaa can be any naturally occurring amino acid
XVQVSWPPEDPHLKEVGLHQVQC

SEQ ID NO: 3131 - protein, 2 aa, Homo Sapiens
  misc_feature (1)..(1): Xaa can be any naturally occurring amino acid
XC

SEQ ID NO: 3132 - protein, 5 aa, Homo Sapiens
  misc_feature (1)..(1): Xaa can be any naturally occurring amino acid
XRHGG

SEQ ID NO: 3133 - protein, 4 aa, Homo Sapiens
  misc_feature (1)..(1): Xaa can be any naturally occurring amino acid
XHGG

SEQ ID NO: 3134 - protein, 3 aa, Homo Sapiens
  misc_feature (1)..(1): Xaa can be any naturally occurring amino acid
XGG

SEQ ID NO: 3135 - protein, 37 aa, Homo Sapiens
  misc_feature (1)..(1): Xaa can be any naturally occurring amino acid
XAAHPRWLWGQVHPQSWPSGQVAGPALMRASNVLPPS

SEQ ID NO: 3136 - protein, 27 aa, Homo Sapiens
  misc_feature (1)..(1): Xaa can be any naturally occurring amino acid
XVHPQSWPSGQVAGPALMRASNVLPPS

SEQ ID NO: 3137 - protein, 25 aa, Homo Sapiens
  misc_feature (1)..(1): Xaa can be any naturally occurring amino acid
XPQSWPSGQVAGPALMRASNVLPPS

SEQ ID NO: 3138 - protein, 17 aa, Homo Sapiens
  misc_feature (1)..(1): Xaa can be any naturally occurring amino acid
XVAGPALMRASNVLPPS

SEQ ID NO: 3139 - protein, 15 aa, Homo Sapiens
  misc_feature (1)..(1): Xaa can be any naturally occurring amino acid
XHPLPSGHICPCHLC

SEQ ID NO: 3140 - protein, 12 aa, Homo Sapiens
  misc_feature (1)..(1): Xaa can be any naturally occurring amino acid
XPSGHICPCHLC

SEQ ID NO: 3141 - protein, 4 aa, Homo Sapiens
CHLC

SEQ ID NO: 3142 - protein, 42 aa, Homo Sapiens
  misc_feature (1)..(1): Xaa can be any naturally occurring amino acid
XGLVPHWLQGWHQLPASHCGAWWRPGQGTESCVHAEQHHSHC

SEQ ID NO: 3143 - protein, 35 aa, Homo Sapiens
LQGWHQLPASHCGAWWRPGQGTESCVHAEQHHSHC

SEQ ID NO: 3144 - protein, 1 aa, Homo Sapiens
  misc_feature (1)..(1): Xaa can be any naturally occurring amino acid
X

SEQ ID NO: 3145 - protein, 1 aa, Homo Sapiens
  misc_feature (1)..(1): Xaa can be any naturally occurring amino acid
X

SEQ ID NO: 3146 - protein, 16 aa, Homo Sapiens
  misc_feature (1)..(1): Xaa can be any naturally occurring amino acid
XARAPGCVCRLGTHSH

SEQ ID NO: 3147 - protein, 15 aa, Homo Sapiens
  misc_feature (1)..(1): Xaa can be any naturally occurring amino acid
XRAPGCVCRLGTHSH

SEQ ID NO: 3148 - protein, 9 aa, Homo Sapiens
  misc_feature (1)..(1): Xaa can be any naturally occurring amino acid
XCRLGTHSH

SEQ ID NO: 3149 - protein, 4 aa, Homo Sapiens
  misc_feature (1)..(1): Xaa can be any naturally occurring amino acid
XLPP

SEQ ID NO: 3150 - protein, 11 aa, Homo Sapiens
  misc_feature (1)..(1): Xaa can be any naturally occurring amino acid
XAHHRQGRCCQ

SEQ ID NO: 3151 - protein, 5 aa, Homo Sapiens
  misc_feature (1)..(1): Xaa can be any naturally occurring amino acid
XRCCQ

SEQ ID NO: 3152 - protein, 11 aa, Homo Sapiens
  misc_feature (1)..(1): Xaa can be any naturally occurring amino acid
XRALHHWQGDH

SEQ ID NO: 3153 - protein, 5 aa, Homo Sapiens
  misc_feature (1)..(1): Xaa can be any naturally occurring amino acid
XQGDH

SEQ ID NO: 3154 - protein, 4 aa, Homo Sapiens
QGDH

SEQ ID NO: 3155 - protein, 4 aa, Homo Sapiens
  misc_feature (1)..(1): Xaa can be any naturally occurring amino acid
XGDH

SEQ ID NO: 3156 - protein, 3 aa, Homo Sapiens
  misc_feature (1)..(1): Xaa can be any naturally occurring amino acid
XDH

SEQ ID NO: 3157 - protein, 3 aa, Homo Sapiens
  misc_feature (1)..(1): Xaa can be any naturally occurring amino acid
XDH

SEQ ID NO: 3158 - protein, 11 aa, Homo Sapiens
  misc_feature (1)..(1): Xaa can be any naturally occurring amino acid
XPCVGPNSQAG

SEQ ID NO: 3159 - protein, 8 aa, Homo Sapiens
  misc_feature (1)..(1): Xaa can be any naturally occurring amino acid
XGPNSQAG

SEQ ID NO: 3160 - protein, 3 aa, Homo Sapiens
  misc_feature (1)..(1): Xaa can be any naturally occurring amino acid
XAG

SEQ ID NO: 3161 - protein, 31 aa, Homo Sapiens
  misc_feature (1)..(1): Xaa can be any naturally occurring amino acid
XHRSSGLLGFPQLWWGNWFWVHLPAHGTSLS

SEQ ID NO: 3162 - protein, 28 aa, Homo Sapiens
SSGLLGFPQLWWGNWFWVHLPAHGTSLS

SEQ ID NO: 3163 - protein, 26 aa, Homo Sapiens
  misc_feature (1)..(1): Xaa can be any naturally occurring amino acid
XLLGFPQLWWGNWFWVHLPAHGTSLS

SEQ ID NO: 3164 - protein, 25 aa, Homo Sapiens
LLGFPQLWWGNWFWVHLPAHGTSLS

SEQ ID NO: 3165 - protein, 24 aa, Homo Sapiens
  misc_feature (1)..(1): Xaa can be any naturally occurring amino acid
XGFPQLWWGNWFWVHLPAHGTSLS

SEQ ID NO: 3166 - protein, 19 aa, Homo Sapiens
  misc_feature (1)..(1): Xaa can be any naturally occurring amino acid
XWWGNWFWVHLPAHGTSLS

SEQ ID NO: 3167 - protein, 11 aa, Homo Sapiens
  misc_feature (1)..(1): Xaa can be any naturally occurring amino acid
XHLPAHGTSLS

SEQ ID NO: 3168 - protein, 9 aa, Homo Sapiens
  misc_feature (1)..(1): Xaa can be any naturally occurring amino acid
XPAHGTSLS

SEQ ID NO: 3169 - protein, 20 aa, Homo Sapiens
  misc_feature (1)..(1): Xaa can be any naturally occurring amino acid
XEVQAGVLHLPSTPGFHSCS

SEQ ID NO: 3170 - protein, 3 aa, Homo Sapiens
  misc_feature (1)..(1): Xaa can be any naturally occurring amino acid
XCS

SEQ ID NO: 3171 - protein, 1 aa, Homo Sapiens
  misc_feature (1)..(1): Xaa can be any naturally occurring amino acid
X

SEQ ID NO: 3172 - protein, 4 aa, Homo Sapiens
  misc_feature (1)..(1): Xaa can be any naturally occurring amino acid
XGAL

SEQ ID NO: 3173 - protein, 3 aa, Homo Sapiens
  misc_feature (1)..(1): Xaa can be any naturally occurring amino acid
XLS

SEQ ID NO: 3174 - protein, 1 aa, Homo Sapiens
  misc_feature (1)..(1): Xaa can be any naturally occurring amino acid
X

SEQ ID NO: 3175 - protein, 9 aa, Homo Sapiens
  misc_feature (1)..(1): Xaa can be any naturally occurring amino acid
XLHHCFPEI

SEQ ID NO: 3176 - protein, 5 aa, Homo Sapiens
  misc_feature (1)..(1): Xaa can be any naturally occurring amino acid
XFPEI

SEQ ID NO: 3177 - protein, 4 aa, Homo Sapiens
  misc_feature (1)..(1): Xaa can be any naturally occurring amino acid
XPEI

SEQ ID NO: 3178 - protein, 3 aa, Homo Sapiens
  misc_feature (1)..(1): Xaa can be any naturally occurring amino acid
XEI

SEQ ID NO: 3179 - protein, 4 aa, Homo Sapiens
SPEC

SEQ ID NO: 3180 - protein, 3 aa, Homo Sapiens
  misc_feature (1)..(1): Xaa can be any naturally occurring amino acid
XGG

SEQ ID NO: 3181 - protein, 9 aa, Homo Sapiens
CSAGSLPLC

SEQ ID NO: 3182 - protein, 14 aa, Homo Sapiens
  misc_feature (1)..(1): Xaa can be any naturally occurring amino acid
XGPYQGCAECGLLL

SEQ ID NO: 3183 - protein, 26 aa, Homo Sapiens
  misc_feature (1)..(1): Xaa can be any naturally occurring amino acid
XLLAQQQQPYHRLLWLGQAGQGMEPG

SEQ ID NO: 3184 - protein, 22 aa, Homo Sapiens
  misc_feature (1)..(1): Xaa can be any naturally occurring amino acid
XQQQPYHRLLWLGQAGQGMEPG

SEQ ID NO: 3185 - protein, 63 aa, Homo Sapiens
  misc_feature (1)..(1): Xaa can be any naturally occurring amino acid
XLQAEDQPHWPHRLSEHGDCLSRWIPLCFWRQGWPGHVMGSQRRQTPLHARWWGHHQRPVLQP

SEQ ID NO: 3186 - protein, 59 aa, Homo Sapiens
  misc_feature (1)..(1): Xaa can be any naturally occurring amino acid
XDQPHWPHRLSEHGDCLSRWIPLCFWRQGWPGHVMGSQRRQTPLHARWWGHHQRPVLQP

SEQ ID NO: 3187 - protein, 50 aa, Homo Sapiens
LSEHGDCLSRWIPLCFWRQGWPGHVMGSQRRQTPLHARWWGHHQRPVLQP

SEQ ID NO: 3188 - protein, 46 aa, Homo Sapiens
GDCLSRWIPLCFWRQGWPGHVMGSQRRQTPLHARWWGHHQRPVLQP

SEQ ID NO: 3189 - protein, 41 aa, Homo Sapiens
RWIPLCFWRQGWPGHVMGSQRRQTPLHARWWGHHQRPVLQP

SEQ ID NO: 3190 - skipped

SEQ ID NO: 3191 - protein, 14 aa, Homo Sapiens
QHQDLGFRGKDHCR

SEQ ID NO: 3192 - protein, 6 aa, Homo Sapiens
HPPACE

SEQ ID NO: 3193 - protein, 10 aa, Homo Sapiens
  misc_feature (1)..(1): Xaa can be any naturally occurring amino acid
XFECRARVES

SEQ ID NO: 3194 - skipped

SEQ ID NO: 3195 - protein, 5 aa, Homo Sapiens
  misc_feature (1)..(1): Xaa can be any naturally occurring amino acid
XDYYH

SEQ ID NO: 3196 - skipped

SEQ ID NO: 3197 - protein, 14 aa, Homo Sapiens
  misc_feature (1)..(1): Xaa can be any naturally occurring amino acid
XGFHLCVSYRNCCF

SEQ ID NO: 3198 - protein, 10 aa, Homo Sapiens
  misc_feature (1)..(1): Xaa can be any naturally occurring amino acid
XCVSYRNCCF

SEQ ID NO: 3199 - protein, 24 aa, Homo Sapiens
CLDKYTKEEWWFGPHEHRTLVRLN

SEQ ID NO: 3200 - protein, 13 aa, Homo Sapiens
  misc_feature (1)..(1): Xaa can be any naturally occurring amino acid
XGPHEHRTLVRLN

SEQ ID NO: 3201 - protein, 7 aa, Homo Sapiens
  misc_feature (1)..(1): Xaa can be any naturally occurring amino acid
XKRSLHN

SEQ ID NO: 3202 - protein, 6 aa, Homo Sapiens
  misc_feature (1)..(1): Xaa can be any naturally occurring amino acid
XRSLHN

SEQ ID NO: 3203 - protein, 5 aa, Homo Sapiens
  misc_feature (1)..(1): Xaa can be any naturally occurring amino acid
XDDRR

SEQ ID NO: 3204 - protein, 38 aa, Homo Sapiens
  misc_feature (1)..(1): Xaa can be any naturally occurring amino acid
XPGCQLLGVIAQEKLAECPGLIYQEHHGQAPAPILRHI

SEQ ID NO: 3205 - protein, 25 aa, Homo Sapiens
  misc_feature (1)..(1): Xaa can be any naturally occurring amino acid
XLAECPGLIYQEHHGQAPAPILRHI

SEQ ID NO: 3206 - protein, 20 aa, Homo Sapiens
  misc_feature (1)..(1): Xaa can be any naturally occurring amino acid
XGLIYQEHHGQAPAPILRHI

SEQ ID NO: 3207 - protein, 9 aa, Homo Sapiens
  misc_feature (1)..(1): Xaa can be any naturally occurring amino acid
XDFPSGVDL

SEQ ID NO: 3208 - protein, 12 aa, Homo Sapiens
LYDGQKAPGDQP

SEQ ID NO: 3209 - protein, 23 aa, Homo Sapiens
  misc_feature (1)..(1): Xaa can be any naturally occurring amino acid
XEAFSVHRLSHHPLFGEGTREGN

SEQ ID NO: 3210 - protein, 32 aa, Homo Sapiens
  misc_feature (1)..(1): Xaa can be any naturally occurring amino acid
XGPQPHLLADRARYAAPQNQARPGRSGPSQGV

SEQ ID NO: 3211 - protein, 31 aa, Homo Sapiens
  misc_feature (1)..(1): Xaa can be any naturally occurring amino acid
XEERESQDPLPEEETAHEATETGREERGEEN

SEQ ID NO: 3212 - protein, 29 aa, Homo Sapiens
  misc_feature (1)..(1): Xaa can be any naturally occurring amino acid
XRESQDPLPEEETAHEATETGREERGEEN

SEQ ID NO: 3213 - protein, 3 aa, Homo Sapiens
  misc_feature (1)..(1): Xaa can be any naturally occurring amino acid
XEN

SEQ ID NO: 3214 - protein, 53 aa, Homo Sapiens
  misc_feature (1)..(1): Xaa can be any naturally occurring amino acid
XIHRGPQDPRTPGLSPIKTVNSSCVACPSSIVALECTGPRGSSSPGATGSPGT

SEQ ID NO: 3215 - protein, 14 aa, Homo Sapiens
WYGLFHVSGILGKT

SEQ ID NO: 3216 - protein, 3 aa, Homo Sapiens
  misc_feature (1)..(1): Xaa can be any naturally occurring amino acid
XKT

SEQ ID NO: 3217 - protein, 8 aa, Homo Sapiens
  misc_feature (1)..(1): Xaa can be any naturally occurring amino acid
XDCCVPCL

SEQ ID NO: 3218 - protein, 20 aa, Homo Sapiens
CRDCKSGRTAARMGRSDADG

SEQ ID NO: 3219 - protein, 1 aa, Homo Sapiens
  misc_feature (1)..(1): Xaa can be any naturally occurring amino acid
X

SEQ ID NO: 3220 - protein, 2 aa, Homo Sapiens
  misc_feature (1)..(1): Xaa can be any naturally occurring amino acid
XA

SEQ ID NO: 3221 - protein, 1 aa, Homo Sapiens
  misc_feature (1)..(1): Xaa can be any naturally occurring amino acid
X

SEQ ID NO: 3222 - protein, 2 aa, Homo Sapiens
  misc_feature (1)..(1): Xaa can be any naturally occurring amino acid
XL

SEQ ID NO: 3223 - protein, 99 aa, Homo Sapiens
  misc_feature (1)..(1): Xaa can be any naturally occurring amino acid
XVWAALPLQNAWLLQPGRASPPALPVRRLLPGHQGAGEHRTEQEEYVFPCARVPGHHILLCWVCIFDDASLPGCHPGLRQHPPLHPEDQEHVPEDHVQV

SEQ ID NO: 3224 - protein, 6 aa, Homo Sapiens
  misc_feature (1)..(1): Xaa can be any naturally occurring amino acid
XWHASS

SEQ ID NO: 3225 - protein, 31 aa, Homo Sapiens
  misc_feature (1)..(1): Xaa can be any naturally occurring amino acid
XGRENGTAVTRGCGHGRCSLKISVTISFMYI

SEQ ID NO: 3226 - protein, 17 aa, Homo Sapiens
  misc_feature (1)..(1): Xaa can be any naturally occurring amino acid
XYGQAESLASFKAKEDV

SEQ ID NO: 3227 - protein, 17 aa, Homo Sapiens
  misc_feature (1)..(1): Xaa can be any naturally occurring amino acid
XWAEDRSGPWILLHSRQ

SEQ ID NO: 3228 - protein, 4 aa, Homo Sapiens
  misc_feature (1)..(1): Xaa can be any naturally occurring amino acid
XCRH

SEQ ID NO: 3229 - protein, 1 aa, Homo Sapiens
  misc_feature (1)..(1): Xaa can be any naturally occurring amino acid
X

SEQ ID NO: 3230 - protein, 4 aa, Homo Sapiens
  misc_feature (1)..(1): Xaa can be any naturally occurring amino acid
XRLL

SEQ ID NO: 3231 - protein, 22 aa, Homo Sapiens
  misc_feature (1)..(1): Xaa can be any naturally occurring amino acid
XVHGKCWTQHKWFPVFHLHCQD

SEQ ID NO: 3232 - protein, 27 aa, Homo Sapiens
  misc_feature (1)..(1): Xaa can be any naturally occurring amino acid
XRRHEYCGGHGALWVQEWQDQQEDHHC

SEQ ID NO: 3233 - protein, 2 aa, Homo Sapiens
  misc_feature (1)..(1): Xaa can be any naturally occurring amino acid
XC

SEQ ID NO: 3234 - protein, 3 aa, Homo Sapiens
  misc_feature (1)..(1): Xaa can be any naturally occurring amino acid
XRH

SEQ ID NO: 3235 - protein, 2 aa, Homo Sapiens
  misc_feature (1)..(1): Xaa can be any naturally occurring amino acid
XN

SEQ ID NO: 3236 - protein, 10 aa, Homo Sapiens
  misc_feature (1)..(1): Xaa can be any naturally occurring amino acid
XEKGLCLCNL

SEQ ID NO: 3237 - protein, 8 aa, Homo Sapiens
  misc_feature (1)..(1): Xaa can be any naturally occurring amino acid
XGLCLCNL

SEQ ID NO: 3238 - protein, 4 aa, Homo Sapiens
  misc_feature (1)..(1): Xaa can be any naturally occurring amino acid
XCNL

SEQ ID NO: 3239 - protein, 3 aa, Homo Sapiens
  misc_feature (1)..(1): Xaa can be any naturally occurring amino acid
XRP

SEQ ID NO: 3240 - protein, 1 aa, Homo Sapiens
  misc_feature (1)..(1): Xaa can be any naturally occurring amino acid
X

SEQ ID NO: 3241 - protein, 15 aa, Homo Sapiens
  misc_feature (1)..(1): Xaa can be any naturally occurring amino acid
XDCHSEIPYCEWPQL

SEQ ID NO: 3242 - protein, 5 aa, Homo Sapiens
  misc_feature (1)..(1): Xaa can be any naturally occurring amino acid
XARDG

SEQ ID NO: 3243 - protein, 26 aa, Homo Sapiens
  misc_feature (1)..(1): Xaa can be any naturally occurring amino acid
XCFIQPKRSKWFWKLWWWSWRWFRWE

SEQ ID NO: 3244 - protein, 17 aa, Homo Sapiens
  misc_feature (1)..(1): Xaa can be any naturally occurring amino acid
XWFWKLWWWSWRWFRWE

SEQ ID NO: 3245 - protein, 11 aa, Homo Sapiens
  misc_feature (1)..(1): Xaa can be any naturally occurring amino acid
XWWSWRWFRWE

SEQ ID NO: 3246 - protein, 46 aa, Homo Sapiens
  misc_feature (1)..(1): Xaa can be any naturally occurring amino acid
XLGSHGRGRLSEHYANRNRYDCRKRPGRFLYQRFDSWREEMLSDQR

SEQ ID NO: 3247 - protein, 3 aa, Homo Sapiens
  misc_feature (1)..(1): Xaa can be any naturally occurring amino acid
XCT

SEQ ID NO: 3248 - protein, 14 aa, Homo Sapiens
  misc_feature (1)..(1): Xaa can be any naturally occurring amino acid
XVYSWRHPLGWRRF

SEQ ID NO: 3249 - protein, 9 aa, Homo Sapiens
RHPLGWRRF

SEQ ID NO: 3250 - protein, 6 aa, Homo Sapiens
  misc_feature (1)..(1): Xaa can be any naturally occurring amino acid
XGWRRF

SEQ ID NO: 3251 - protein, 4 aa, Homo Sapiens
WRRF

SEQ ID NO: 3252 - protein, 3 aa, Homo Sapiens
RRF

SEQ ID NO: 3253 - protein, 8 aa, Homo Sapiens
  misc_feature (1)..(1): Xaa can be any naturally occurring amino acid
XNGQPFYC

SEQ ID NO: 3254 - protein, 2 aa, Homo Sapiens
  misc_feature (1)..(1): Xaa can be any naturally occurring amino acid
XC

SEQ ID NO: 3255 - protein, 25 aa, Homo Sapiens
AGQLHSAVAHPHHPAAGEGGPAGAQ

SEQ ID NO: 3256 - protein, 13 aa, Homo Sapiens
  misc_feature (1)..(1): Xaa can be any naturally occurring amino acid
XQPDRRQVLGGHQ

SEQ ID NO: 3257 - protein, 14 aa, Homo Sapiens
  misc_feature (1)..(1): Xaa can be any naturally occurring amino acid
XQRPAAGPHLCVLQ

SEQ ID NO: 3258 - protein, 20 aa, Homo Sapiens
  misc_feature (1)..(1): Xaa can be any naturally occurring amino acid
XGSRTWDHGLCSLRSFWPDL

SEQ ID NO: 3259 - protein, 13 aa, Homo Sapiens
  misc_feature (1)..(1): Xaa can be any naturally occurring amino acid
XTRQLCIWSVWGR

SEQ ID NO: 3260 - protein, 12 aa, Homo Sapiens
  misc_feature (1)..(1): Xaa can be any naturally occurring amino acid
XRQLCIWSVWGR

SEQ ID NO: 3261 - protein, 7 aa, Homo Sapiens
  misc_feature (1)..(1): Xaa can be any naturally occurring amino acid
XWSVWGR

SEQ ID NO: 3262 - protein, 14 aa, Homo Sapiens
  misc_feature (1)..(1): Xaa can be any naturally occurring amino acid
XGHSPYQQDPRRIP

SEQ ID NO: 3263 - protein, 12 aa, Homo Sapiens
HSPYQQDPRRIP

SEQ ID NO: 3264 - protein, 5 aa, Homo Sapiens
  misc_feature (1)..(1): Xaa can be any naturally occurring amino acid
XRRIP

SEQ ID NO: 3265 - protein, 3 aa, Homo Sapiens
  misc_feature (1)..(1): Xaa can be any naturally occurring amino acid
XIP

SEQ ID NO: 3266 - protein, 10 aa, Homo Sapiens
  misc_feature (1)..(1): Xaa can be any naturally occurring amino acid
XQCGAFTQSV

SEQ ID NO: 3267 - protein, 17 aa, Homo Sapiens
  misc_feature (1)..(1): Xaa can be any naturally occurring amino acid
XRALQCHPLRPSVGREY

SEQ ID NO: 3268 - protein, 10 aa, Homo Sapiens
  misc_feature (1)..(1): Xaa can be any naturally occurring amino acid
XLRPSVGREY

SEQ ID NO: 3269 - protein, 4 aa, Homo Sapiens
  misc_feature (1)..(1): Xaa can be any naturally occurring amino acid
XREY

SEQ ID NO: 3270 - protein, 4 aa, Homo Sapiens
  misc_feature (1)..(1): Xaa can be any naturally occurring amino acid
XGPL

SEQ ID NO: 3271 - protein, 3 aa, Homo Sapiens
  misc_feature (1)..(1): Xaa can be any naturally occurring amino acid
XPL

SEQ ID NO: 3272 - protein, 2 aa, Homo Sapiens
  misc_feature (1)..(1): Xaa can be any naturally occurring amino acid
XL

SEQ ID NO: 3273 - protein, 37 aa, Homo Sapiens
  misc_feature (1)..(1): Xaa can be any naturally occurring amino acid
XPHSEADHTNLRGSEPPCLSHHEWCHHLPPFPWPAQC

SEQ ID NO: 3274 - protein, 27 aa, Homo Sapiens
  misc_feature (1)..(1): Xaa can be any naturally occurring amino acid
XRGSEPPCLSHHEWCHHLPPFPWPAQC

SEQ ID NO: 3275 - protein, 25 aa, Homo Sapiens
  misc_feature (1)..(1): Xaa can be any naturally occurring amino acid
XSEPPCLSHHEWCHHLPPFPWPAQC

SEQ ID NO: 3276 - protein, 23 aa, Homo Sapiens
  misc_feature (1)..(1): Xaa can be any naturally occurring amino acid
XPPCLSHHEWCHHLPPFPWPAQC

SEQ ID NO: 3277 - protein, 21 aa, Homo Sapiens
  misc_feature (1)..(1): Xaa can be any naturally occurring amino acid
XCLSHHEWCHHLPPFPWPAQC

SEQ ID NO: 3278 - protein, 20 aa, Homo Sapiens
  misc_feature (1)..(1): Xaa can be any naturally occurring amino acid
XLSHHEWCHHLPPFPWPAQC

SEQ ID NO: 3279 - protein, 16 aa, Homo Sapiens
  misc_feature (1)..(1): Xaa can be any naturally occurring amino acid
XEWCHHLPPFPWPAQC

SEQ ID NO: 3280 - protein, 13 aa, Homo Sapiens
CHHLPPFPWPAQC

SEQ ID NO: 3281 - protein, 9 aa, Homo Sapiens
  misc_feature (1)..(1): Xaa can be any naturally occurring amino acid
XPFPWPAQC

SEQ ID NO: 3282 - protein, 7 aa, Homo Sapiens
  misc_feature (1)..(1): Xaa can be any naturally occurring amino acid
XPWPAQC

SEQ ID NO: 3283 - protein, 44 aa, Homo Sapiens
  misc_feature (1)..(1): Xaa can be any naturally occurring amino acid
XPTSPFLYAWLCPSHQPWKPAVSSSHSAGTHPAGLRCQEHDGCL

SEQ ID NO: 3284 - protein, 10 aa, Homo Sapiens
  misc_feature (1)..(1): Xaa can be any naturally occurring amino acid
XVPSWLETWQ

SEQ ID NO: 3285 - protein, 3 aa, Homo Sapiens
EAP

SEQ ID NO: 3286 - protein, 12 aa, Homo Sapiens
  misc_feature (1)..(1): Xaa can be any naturally occurring amino acid
XCGSSELLSWNS

SEQ ID NO: 3287 - protein, 17 aa, Homo Sapiens
  misc_feature (1)..(1): Xaa can be any naturally occurring amino acid
XCGDHQECAHSHGKLCF

SEQ ID NO: 3288 - protein, 17 aa, Homo Sapiens
  misc_feature (1)..(1): Xaa can be any naturally occurring amino acid
XCRGGAEEGSHSQNHAG

SEQ ID NO: 3289 - protein, 11 aa, Homo Sapiens
  misc_feature (1)..(1): Xaa can be any naturally occurring amino acid
XEGSHSQNHAG

SEQ ID NO: 3290 - protein, 11 aa, Homo Sapiens
  misc_feature (1)..(1): Xaa can be any naturally occurring amino acid
XEGSHSQNHAG

SEQ ID NO: 3291 - protein, 2 aa, Homo Sapiens
  misc_feature (1)..(1): Xaa can be any naturally occurring amino acid
XV

SEQ ID NO: 3292 - protein, 5 aa, Homo Sapiens
HPGCR

SEQ ID NO: 3293 - protein, 17 aa, Homo Sapiens
  misc_feature (1)..(1): Xaa can be any naturally occurring amino acid
XGRDKWRDYHPRVGWAV

SEQ ID NO: 3294 - protein, 7 aa, Homo Sapiens
  misc_feature (1)..(1): Xaa can be any naturally occurring amino acid
XARGRPG

SEQ ID NO: 3295 - protein, 1 aa, Homo Sapiens
  misc_feature (1)..(1): Xaa can be any naturally occurring amino acid
X

SEQ ID NO: 3296 - protein, 12 aa, Homo Sapiens
LCTPEEQRAAPE

SEQ ID NO: 3297 - protein, 33 aa, Homo Sapiens
  misc_feature (1)..(1): Xaa can be any naturally occurring amino acid
XERSQRERYLGSTKAPACSTQRSTLCENQWEGA

SEQ ID NO: 3298 - protein, 18 aa, Homo Sapiens
  misc_feature (1)..(1): Xaa can be any naturally occurring amino acid
XGERRHCGREAGLGPREA

SEQ ID NO: 3299 - protein, 15 aa, Homo Sapiens
  misc_feature (1)..(1): Xaa can be any naturally occurring amino acid
XRHCGREAGLGPREA

SEQ ID NO: 3300 - protein, 1 aa, Homo Sapiens
  misc_feature (1)..(1): Xaa can be any naturally occurring amino acid
X

SEQ ID NO: 3301 - protein, 13 aa, Homo Sapiens
  misc_feature (1)..(1): Xaa can be any naturally occurring amino acid
XETQTFLSASFYF

SEQ ID NO: 3302 - protein, 2 aa, Homo Sapiens
  misc_feature (1)..(1): Xaa can be any naturally occurring amino acid
XE

SEQ ID NO: 3303 - protein, 26 aa, Homo Sapiens
  misc_feature (1)..(1): Xaa can be any naturally occurring amino acid
XLWDRDPAVACHGRAEPIFGRGDCLL

SEQ ID NO: 3304 - protein, 9 aa, Homo Sapiens
  misc_feature (1)..(1): Xaa can be any naturally occurring amino acid
XYLQLHHEV

SEQ ID NO: 3305 - protein, 7 aa, Homo Sapiens
  misc_feature (1)..(1): Xaa can be any naturally occurring amino acid
XNFWLEW

SEQ ID NO: 3306 - protein, 1 aa, Homo Sapiens
  misc_feature (1)..(1): Xaa can be any naturally occurring amino acid
X

SEQ ID NO: 3307 - protein, 10 aa, Homo Sapiens
  misc_feature (1)..(1): Xaa can be any naturally occurring amino acid
XGEKGGCPCS

SEQ ID NO: 3308 - protein, 43 aa, Homo Sapiens
  misc_feature (1)..(1): Xaa can be any naturally occurring amino acid
XHGLWRRGHPHGAHLRGLRPPPRHPASGPGWPGPDRLPHEDPH

SEQ ID NO: 3309 - protein, 40 aa, Homo Sapiens
  misc_feature (1)..(1): Xaa can be any naturally occurring amino acid
XGEAVLRRPGLRAGDGHRRILLFSGEELRAARWPGHHHWQ

SEQ ID NO: 3310 - protein, 5 aa, Homo Sapiens
MGGHA

SEQ ID NO: 3311 - protein, 5 aa, Homo Sapiens
  misc_feature (1)..(1): Xaa can be any naturally occurring amino acid
XLQRS

SEQ ID NO: 3312 - protein, 6 aa, Homo Sapiens
  misc_feature (1)..(1): Xaa can be any naturally occurring amino acid
XRAGCC

SEQ ID NO: 3313 - protein, 5 aa, Homo Sapiens
  misc_feature (1)..(1): Xaa can be any naturally occurring amino acid
XLSQG

SEQ ID NO: 3314 - protein, 10 aa, Homo Sapiens
  misc_feature (1)..(1): Xaa can be any naturally occurring amino acid
XFQKLPVLYW

SEQ ID NO: 3315 - protein, 1 aa, Homo Sapiens
  misc_feature (1)..(1): Xaa can be any naturally occurring amino acid
X

SEQ ID NO: 3316 - protein, 7 aa, Homo Sapiens
  misc_feature (1)..(1): Xaa can be any naturally occurring amino acid
XGFHSCS

SEQ ID NO: 3317 - protein, 1 aa, Homo Sapiens
  misc_feature (1)..(1): Xaa can be any naturally occurring amino acid
X

SEQ ID NO: 3318 - protein, 54 aa, Homo Sapiens
  misc_feature (1)..(1): Xaa can be any naturally occurring amino acid
XGLQQHEEVLPSHPCHCPHPDAPASSAPEEGPPDGDPGERRHCGREAGLGPREA

SEQ ID NO: 3319 - protein, 14 aa, Homo Sapiens
  misc_feature (1)..(1): Xaa can be any naturally occurring amino acid
XEDDGNHDPRGADK

SEQ ID NO: 3320 - protein, 2 aa, Homo Sapiens
HP

SEQ ID NO: 3321 - protein, 44 aa, Homo Sapiens
  misc_feature (1)..(1): Xaa can be any naturally occurring amino acid
XEGFLCGRRGPEQERHPHPEVPHRARHRHQLGRHGENLAPHLLQ

SEQ ID NO: 3322 - protein, 14 aa, Homo Sapiens
  misc_feature (1)..(1): Xaa can be any naturally occurring amino acid
XRFGQVHHYWPSDL

SEQ ID NO: 3323 - protein, 5 aa, Homo Sapiens
WPSDL

SEQ ID NO: 3324 - protein, 1 aa, Homo Sapiens
C

SEQ ID NO: 3325 - protein, 6 aa, Homo Sapiens
  misc_feature (1)..(1): Xaa can be any naturally occurring amino acid
XQPEEI

SEQ ID NO: 3326 - protein, 4 aa, Homo Sapiens
  misc_feature (1)..(1): Xaa can be any naturally occurring amino acid
XEEI

SEQ ID NO: 3327 - protein, 3 aa, Homo Sapiens
  misc_feature (1)..(1): Xaa can be any naturally occurring amino acid
XEI

SEQ ID NO: 3328 - protein, 4 aa, Homo Sapiens
  misc_feature (1)..(1): Xaa can be any naturally occurring amino acid
XAKC

SEQ ID NO: 3329 - protein, 28 aa, Homo Sapiens
  misc_feature (1)..(1): Xaa can be any naturally occurring amino acid
XGSEANSGAAGCLLEDEDFSGGRTSDIG

SEQ ID NO: 3330 - protein, 18 aa, Homo Sapiens
  misc_feature (1)..(1): Xaa can be any naturally occurring amino acid
XCLLEDEDFSGGRTSDIG

SEQ ID NO: 3331 - protein, 10 aa, Homo Sapiens
  misc_feature (1)..(1): Xaa can be any naturally occurring amino acid
XGGPPVPPHR

SEQ ID NO: 3332 - protein, 6 aa, Homo Sapiens
  misc_feature (1)..(1): Xaa can be any naturally occurring amino acid
XGQGHP

SEQ ID NO: 3333 - protein, 3 aa, Homo Sapiens
  misc_feature (1)..(1): Xaa can be any naturally occurring amino acid
XWM

SEQ ID NO: 3334 - protein, 27 aa, Homo Sapiens
  misc_feature (1)..(1): Xaa can be any naturally occurring amino acid
XPGAVLHGELDTMFVWKCPVFAMPMLS

SEQ ID NO: 3335 - protein, 15 aa, Homo sapiens
QHKDDNPNLPRLVRP

SEQ ID NO: 3336 - protein, 30 aa, Homo sapiens
IQQLVQDIASLTLLEISDLNELLKKTLKIQ

SEQ ID NO: 3337 - protein, 19 aa, Homo sapiens
ALLQKVRAEIASKEKEEEE

SEQ ID NO: 3338 - protein, 30 aa, Homo sapiens
FVKMLPDKDCRYALYDATYETKESKKEDLV

SEQ ID NO: 3339 - protein, 19 aa, Homo sapiens
LDQVEIIMAMEDEFGFEIP

SEQ ID NO: 3340 - DNA, 40 bp, Homo sapiens
gacgacccctacgccacctttgtcaagatgctgccagata

SEQ ID NO: 3341 - DNA, 162 bp, Homo sapiens
ccatgggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggctagc

SEQ ID NO: 3342 - DNA, 161 bp, Homo sapiens
ccatgggacaagaagaacatcatcctggaggagggcaaggagatcctggtgggcgatgtgggccagactgtcgacgacccctacgccaccttgtcaagatgctgccagataaggactgccgctatgccctctatgatgcaacctatgagaccaaggctagc

SEQ ID NO: 3343 - DNA, 161 bp, Homo sapiens; identical to SEQ ID NO: 3342

SEQ ID NO: 3344 - DNA, 140 bp, Homo sapiens
ctggaggagggcaaggagatcctggtgggcgatgtgggccagactgtcgacgacccctacgccacctttgtcaagatgctgccagataaggactgccgctatgccctctatgatgcaacctatgagaccaaggagagcaa

SEQ ID NO: 3345 - DNA, 35 bp, Homo Sapiens
gtggagcgcgacaacctggccgaggacatcatgcg

SEQ ID NO: 3346 - DNA, 35 bp, Mus Musculus
gtggagcgggacaacctggccgaggacatcatgcg

SEQ ID NO: 3347 - DNA, 38 bp, Homo Sapiens
aatggaaaacaaatttatgttggtcgagctcagaaaaa

SEQ ID NO: 3348 - DNA, 38 bp, Mus Musculus
aatggaaaacagatttatgttggacgagctcagaaaaa

SEQ ID NO: 3349 - DNA, 38 bp, Homo Sapiens
ttggtgaaaggcttggattttgctctgcttcaaaaggt

SEQ ID NO: 3350 - DNA, 38 bp, Mus Musculus
ttggtgaaaggtttggattttgcgttgcttcaaaaggt

SEQ ID NO: 3351 - protein, 35 aa, Homo Sapiens; identical to SEQ ID NO: 2

SEQ ID NO: 3352 - protein, 8 aa, Mus Musculus
SLNSSSPF

SEQ ID NO: 3353 - protein, 30 aa, Homo Sapiens
VIVVTKMMVLSRDHQNQEAITAILPHLLFK

SEQ ID NO: 3354 - protein, 19 aa, Homo Sapiens
  MISC_FEATURE (1)..(19): sequence identical to that of mice (Mus Musculus) as indicated in Figure 6A
ALLQKVRAEIASKEKEEEE

SEQ ID NO: 3355 - protein, 27 aa, Homo sapiens
TWPRTSCASGRNCRRRCFRERKPKTPC

SEQ ID NO: 3356 - protein, 22 aa, Artificial sequence
  sequence alignment
TWPRTSCRNCRRRCRERKPKPC

SEQ ID NO: 3357 - protein, 27 aa, Mus musculus
TWPRTSCGCERNCRRRCSRERKPKAPC

SEQ ID NO: 3358 - protein, 18 aa, Homo sapiens
ELRKRWNGRRNLSANLNR

SEQ ID NO: 3359 - protein, 16 aa, Artificial sequence
  sequence alignment
ELRKWNGRRNLSANLR

SEQ ID NO: 3360 - protein, 18 aa, Mus musculus
ELRKKWNGRRNLSANLSR

SEQ ID NO: 3361 - protein, 20 aa, Homo sapiens
LLCFKRYELRLPAKRKRKRN

SEQ ID NO: 3362 - protein, 16 aa, Artificial sequence
  sequence alignment
LCFKRLRLPAKRRKRN

SEQ ID NO: 3363 - protein, 20 aa, Mus musculus
LRCFKRCALRLPAKRRRKRN

The invention claimed is:

1. A method for detecting the presence of a lung cancer in a subject, the method comprising contacting in vitro:
   (i) a sample from the subject, said sample being previously treated by heating between 36° C. and 60° C. to activate a Transcription Infidelity Antibody (TIAB), with
   (ii) a polypeptide comprising a sequence selected from the group consisting of SEQ ID NOs: 3, 4, 7, 80, 581, 847, 1276, 1396, 1413, 1457, 1499, 1757, 1769, 1770 and 1810,
wherein the formation of a complex between said polypeptide and said TIAB in said sample is an indication of the presence of a lung cancer, said TIAB being an IgG antibody.

2. The method of claim 1, wherein the level of said TIAB IgG in said sample is compared to a reference value, and wherein increase in the level of TIAB IgG in said sample, as compared to the reference value, is indicative of the presence of an early stage lung cancer.

3. The method of claim 2, wherein said increase as compared to the reference value is 10%, 20%, 30%, 40%, 50% or more.

4. The method of claim 1, wherein the method further comprises contacting said sample with a polypeptide selected from the group consisting of SEQ ID NOs: 1, 2, 5, 6, 8, 9, 10, 11, 12, 13, 14, 15, 44, 532, 1063, 1330, 1075, 1330, 1972, 1323, 1373, 1098, 57, 1270, 864, 1336, 1079, 1451, 2119, 1864 and 1699.

5. The method of claim 1, wherein the contacting step comprises contacting the sample simultaneously with several of said polypeptides comprising a sequence selected from the group consisting of SEQ ID NOs: 3, 4, 7, 80, 581, 847, 1276, 1396, 1413, 1457, 1499, 1757, 1769, 1770 and 1810.

6. The method of claim 1, wherein the polypeptide is immobilized on a support.

7. The method of claim 1, wherein the formation of a complex between said polypeptide and said TIAB antibody is detected by a labeled antibody.

8. The method of claim 1, wherein the formation of a complex between said polypeptide and said TIAB antibody is detected by an immunoassay.

9. A method for detecting the presence of a breast cancer in a subject, the method comprising contacting in vitro:
   (i) a sample from the subject, said sample being previously treated by heating between 36° C. and 60° C. to activate a Transcription Infidelity Antibody (TIAB), with
   (ii) a polypeptide comprising a sequence selected from the group consisting of SEQ ID NOs: 6, 11, 581, 847, 911, 1396, 1413, 1451, 1457, 1499, 1699 and 1770,
   wherein the formation of a complex between said polypeptide and said TIAB in said sample is an indication of the presence of breast cancer, said TIAB being an IgG.

10. The method of claim 9, wherein the contacting step comprises contacting the sample simultaneously with several of said polypeptides comprising a sequence selected from the group consisting of SEQ ID NOs: 6, 11, 581, 847, 911, 1396, 1413, 1451, 1457, 1499, 1699 and 1770.

11. The method of claim 1, wherein the method further comprises contacting said sample with a polypeptide comprising SEQ ID NO: 1; SEQ ID NO: 2; SEQ ID NO: 3; SEQ ID NO: 4; SEQ ID NO 5; amino acids 1-17 of SEQ ID NO: 6; SEQ ID NO: 7; SEQ ID NO: 8; amino acids 2-31 of SEQ ID NO: 1770; SEQ ID NO: 10; SEQ ID NO: 11; SEQ ID NO: 12; SEQ ID NO: 13; SEQ ID NO: 14; SEQ ID NO: 15; SEQ ID NO: 44; amino acids 10-21 of SEQ ID NO: 532; SEQ ID NO: 1063; SEQ ID NO: 1380; amino acids 1-19 of SEQ ID NO: 1413; amino acids 1-30 of SEQ ID NO: 581; SEQ ID NO; 1075; SEQ ID NO: 1330; amino acids 1-30 of SEQ ID NO: 1457; amino acids 1-30 of SEQ ID NO: 1769; SEQ ID NO: 1972; SEQ ID NO: 1323; SEQ ID NO: 1373; SEQ ID NO: 1499; SEQ ID NO: 1098; SEQ ID NO: 57; amino acids 1-30 of SEQ ID NO: 1270; SEQ ID NO: 1757; SEQ ID NO: 864; amino acids 2-31 of SEQ ID NO: 1276; SEQ ID NO: 1336; SEQ ID NO: 1079; amino acids 1-30 of SEQ ID NO: 80; amino acids 1-30 of SEQ ID NO: 1396; SEQ ID NO: 1810; amino acids 1-30 of SEQ ID NO: 847; SEQ ID NO: 1451; amino acids 1-30 of SEQ ID NO: 2119; SEQ ID NO: 1864; and SEQ ID NO: 1699.

12. The method of claim 1, wherein the method further comprises contacting said sample with a polypeptide comprising SEQ ID NO: 3; SEQ ID NO: 4; SEQ ID NO: 7; amino acids 1-30 of SEQ ID NO: 80; amino acids 1-30 of SEQ ID NO: 581; amino acids 1-30 of SEQ ID NO: 847; amino acids 2-31 of SEQ ID NO: 1276; amino acids 1-30 of SEQ ID NO: 1396; amino acids 1-19 of SEQ ID NO: 1413; amino acids 1-30 of SEQ ID NO: 1457; SEQ ID NO: 1499; SEQ ID NO: 1757; amino acids 1-30 of SEQ ID NO: 1769; amino acids 2-31 of SEQ ID NO: 1770; or SEQ ID NO: 1810.

13. A method for detecting the presence of a lung cancer in a subject, the method comprising contacting in vitro:
   (i) a sample from the subject, said sample being previously treated by heating between 36° C. and 60° C. to activate a Transcription Infidelity Antibody (TIAB), with
   (ii) a polypeptide comprising amino acids 1-30 of SEQ ID NO: 80, amino acids 1-30 of SEQ ID NO: 581, amino acids 1-30 of SEQ ID NO: 847, amino acids 2-31 of SEQ ID NO: 1276, amino acids 1-30 of SEQ ID NO: 1396, amino acids 1-19 of SEQ ID NO: 1413, amino acids 1-30 of SEQ ID NO: 1457, amino acids 1-30 of SEQ ID NO: 1769, or amino acids 2-31 of SEQ ID NO: 1770, wherein the formation of a complex between said polypeptide and said TIAB in said sample is an indication of the presence of a lung cancer, said TIAB being an IgG antibody.

* * * * *

UNITED STATES PATENT AND TRADEMARK OFFICE
CERTIFICATE OF CORRECTION

PATENT NO. : 9,068,988 B2  Page 1 of 1
APPLICATION NO. : 12/747945
DATED : June 30, 2015
INVENTOR(S) : Bernard Bihain, Virginie Ogier and Marie Brulliard It is certified that error appears in the above-identified patent and that said Letters Patent is hereby corrected as shown below:

In the specification

Column 2,
Lines 51-52, "Polymerase II (Pol. II)" should read --Polymerase II (Pol II)--.

Column 17,
Lines 42-43, "(goodness-of-fit chit test," should read --(goodness-of-fit $chi^2$ test,--.

Signed and Sealed this
Fifteenth Day of December, 2015

Michelle K. Lee
*Director of the United States Patent and Trademark Office*